United States Patent 11,492,591 (UNIVERSAL DONOR STEM CELLS AND RELATED METHODS) - sequence listing, part 20

SEQ ID NO: 639011 - DNA, 20 bp, Artificial
  CRISPR gRNA sequence
aaaaagataacttctcattg

SEQ ID NO: 639012 - DNA, 20 bp, Artificial
  CRISPR gRNA sequence
ctcattgtaagtagttactt

SEQ ID NO: 639013 - DNA, 20 bp, Artificial
  CRISPR gRNA sequence
tcattgtaagtagttacttt

SEQ ID NO: 639014 - DNA, 20 bp, Artificial
  CRISPR gRNA sequence
attgtaagtagttactttaa

SEQ ID NO: 639015 - DNA, 20 bp, Artificial
  CRISPR gRNA sequence
taagtagttactttaagcat

SEQ ID NO: 639016 - DNA, 20 bp, Artificial
  CRISPR gRNA sequence
ctttaagcatgccatccttg

SEQ ID NO: 639017 - DNA, 20 bp, Artificial
  CRISPR gRNA sequence
taagcatgccatccttgtat

SEQ ID NO: 639018 - DNA, 20 bp, Artificial
  CRISPR gRNA sequence
aagcatgccatccttgtatt

SEQ ID NO: 639019 - DNA, 20 bp, Artificial
  CRISPR gRNA sequence
agcatgccatccttgtattt

SEQ ID NO: 639020 - DNA, 20 bp, Artificial
  CRISPR gRNA sequence
gtatttgtgaactgaagtct

SEQ ID NO: 639021 - DNA, 20 bp, Artificial
  CRISPR gRNA sequence
tatttgtgaactgaagtctt

SEQ ID NO: 639022 - DNA, 20 bp, Artificial
  CRISPR gRNA sequence
gtgaactgaagtcttggtta

SEQ ID NO: 639023 - DNA, 20 bp, Artificial
  CRISPR gRNA sequence
tgaactgaagtcttggttat

SEQ ID NO: 639024 - DNA, 20 bp, Artificial
  CRISPR gRNA sequence
aagtcttggttattcaatga

SEQ ID NO: 639025 - DNA, 20 bp, Artificial
  CRISPR gRNA sequence
ggttattcaatgagttatct

SEQ ID NO: 639026 - DNA, 20 bp, Artificial
  CRISPR gRNA sequence
gttattcaatgagttatctc

SEQ ID NO: 639027 - DNA, 20 bp, Artificial
  CRISPR gRNA sequence
ttcaatgagttatctccatt

SEQ ID NO: 639028 - DNA, 20 bp, Artificial
  CRISPR gRNA sequence
aatgagttatctccatttct

SEQ ID NO: 639029 - DNA, 20 bp, Artificial
  CRISPR gRNA sequence
tctccatttctaaatcacca

SEQ ID NO: 639030 - DNA, 20 bp, Artificial
  CRISPR gRNA sequence
catttctaaatcaccattta

SEQ ID NO: 639031 - DNA, 20 bp, Artificial
  CRISPR gRNA sequence
ctaaatcaccatttaaacag

SEQ ID NO: 639032 - DNA, 20 bp, Artificial
  CRISPR gRNA sequence
taaatcaccatttaaacagc

SEQ ID NO: 639033 - DNA, 20 bp, Artificial
  CRISPR gRNA sequence
aatcaccatttaaacagctt

SEQ ID NO: 639034 - DNA, 20 bp, Artificial
  CRISPR gRNA sequence
aaacagctttctaaagctca

SEQ ID NO: 639035 - DNA, 20 bp, Artificial
  CRISPR gRNA sequence
aacagctttctaaagctcat

SEQ ID NO: 639036 - DNA, 20 bp, Artificial
  CRISPR gRNA sequence
tctaaagctcataactaaag

SEQ ID NO: 639037 - DNA, 20 bp, Artificial
  CRISPR gRNA sequence
ctaaagctcataactaaagt

SEQ ID NO: 639038 - DNA, 20 bp, Artificial
  CRISPR gRNA sequence
taaagctcataactaaagta

SEQ ID NO: 639039 - DNA, 20 bp, Artificial
  CRISPR gRNA sequence
aagctcataactaaagtatg

SEQ ID NO: 639040 - DNA, 20 bp, Artificial
  CRISPR gRNA sequence
ataactaaagtatgtgaaac

SEQ ID NO: 639041 - DNA, 20 bp, Artificial
  CRISPR gRNA sequence
aagtatgtgaaacatattaa

SEQ ID NO: 639042 - DNA, 20 bp, Artificial
  CRISPR gRNA sequence
aagtgatgactatgcaccat

SEQ ID NO: 639043 - DNA, 20 bp, Artificial
  CRISPR gRNA sequence
tgcaccatagaaagcaaagt

SEQ ID NO: 639044 - DNA, 20 bp, Artificial
  CRISPR gRNA sequence
aagggcatataaatggcttt

SEQ ID NO: 639045 - DNA, 20 bp, Artificial
  CRISPR gRNA sequence
tcttttaacacttgtgtatg

SEQ ID NO: 639046 - DNA, 20 bp, Artificial
  CRISPR gRNA sequence
cttttaacacttgtgtatgt

SEQ ID NO: 639047 - DNA, 20 bp, Artificial
  CRISPR gRNA sequence
ttttaacacttgtgtatgta

SEQ ID NO: 639048 - DNA, 20 bp, Artificial
  CRISPR gRNA sequence
ttaacacttgtgtatgtatg

SEQ ID NO: 639049 - DNA, 20 bp, Artificial
  CRISPR gRNA sequence
taacacttgtgtatgtatga

SEQ ID NO: 639050 - DNA, 20 bp, Artificial
  CRISPR gRNA sequence
aacacttgtgtatgtatgat

SEQ ID NO: 639051 - DNA, 20 bp, Artificial
  CRISPR gRNA sequence
acacttgtgtatgtatgata

SEQ ID NO: 639052 - DNA, 20 bp, Artificial
  CRISPR gRNA sequence
gtgtatgtatgatattacat

SEQ ID NO: 639053 - DNA, 20 bp, Artificial
  CRISPR gRNA sequence
tgtatgtatgatattacatt

SEQ ID NO: 639054 - DNA, 20 bp, Artificial
  CRISPR gRNA sequence
cattaatcagatgtaagaga

SEQ ID NO: 639055 - DNA, 20 bp, Artificial
  CRISPR gRNA sequence
atcagatgtaagagagttcc

SEQ ID NO: 639056 - DNA, 20 bp, Artificial
  CRISPR gRNA sequence
cttatccatttaaaaatact

SEQ ID NO: 639057 - DNA, 20 bp, Artificial
  CRISPR gRNA sequence
atccatttaaaaatacttct

SEQ ID NO: 639058 - DNA, 20 bp, Artificial
  CRISPR gRNA sequence
tccatttaaaaatacttctt

SEQ ID NO: 639059 - DNA, 20 bp, Artificial
  CRISPR gRNA sequence
aaaaatacttcttttagaat

SEQ ID NO: 639060 - DNA, 20 bp, Artificial
  CRISPR gRNA sequence
aaaatacttcttttagaata

SEQ ID NO: 639061 - DNA, 20 bp, Artificial
  CRISPR gRNA sequence
cttttagaatacttgatgct

SEQ ID NO: 639062 - DNA, 20 bp, Artificial
  CRISPR gRNA sequence
ttttagaatacttgatgctt

SEQ ID NO: 639063 - DNA, 20 bp, Artificial
  CRISPR gRNA sequence
ttagaatacttgatgctttc

SEQ ID NO: 639064 - DNA, 20 bp, Artificial
  CRISPR gRNA sequence
tagaatacttgatgctttct

SEQ ID NO: 639065 - DNA, 20 bp, Artificial
  CRISPR gRNA sequence
agaatacttgatgctttctg

SEQ ID NO: 639066 - DNA, 20 bp, Artificial
  CRISPR gRNA sequence
gaatacttgatgctttctgg

SEQ ID NO: 639067 - DNA, 20 bp, Artificial
  CRISPR gRNA sequence
gatgctttctggtcaggtaa

SEQ ID NO: 639068 - DNA, 20 bp, Artificial
  CRISPR gRNA sequence
atgctttctggtcaggtaag

SEQ ID NO: 639069 - DNA, 20 bp, Artificial
  CRISPR gRNA sequence
tctggtcaggtaagtagatc

SEQ ID NO: 639070 - DNA, 20 bp, Artificial
  CRISPR gRNA sequence
ctggtcaggtaagtagatca

SEQ ID NO: 639071 - DNA, 20 bp, Artificial
  CRISPR gRNA sequence
tggtcaggtaagtagatcaa

SEQ ID NO: 639072 - DNA, 20 bp, Artificial
  CRISPR gRNA sequence
gtcaggtaagtagatcaaaa

SEQ ID NO: 639073 - DNA, 20 bp, Artificial
  CRISPR gRNA sequence
atacaaactgggttttattt

SEQ ID NO: 639074 - DNA, 20 bp, Artificial
  CRISPR gRNA sequence
tacaaactgggttttatttc

SEQ ID NO: 639075 - DNA, 20 bp, Artificial
  CRISPR gRNA sequence
ggttttatttcttctattaa

SEQ ID NO: 639076 - DNA, 20 bp, Artificial
  CRISPR gRNA sequence
tatttcttctattaactggt

SEQ ID NO: 639077 - DNA, 20 bp, Artificial
  CRISPR gRNA sequence
atttcttctattaactggtg

SEQ ID NO: 639078 - DNA, 20 bp, Artificial
  CRISPR gRNA sequence
tttcttctattaactggtga

SEQ ID NO: 639079 - DNA, 20 bp, Artificial
  CRISPR gRNA sequence
cttctattaactggtgattt

SEQ ID NO: 639080 - DNA, 20 bp, Artificial
  CRISPR gRNA sequence
ttctattaactggtgattta

SEQ ID NO: 639081 - DNA, 20 bp, Artificial
  CRISPR gRNA sequence
ctattaactggtgatttagc

SEQ ID NO: 639082 - DNA, 20 bp, Artificial
  CRISPR gRNA sequence
tattaactggtgatttagca

SEQ ID NO: 639083 - DNA, 20 bp, Artificial
  CRISPR gRNA sequence
ttaactggtgatttagcact

SEQ ID NO: 639084 - DNA, 20 bp, Artificial
  CRISPR gRNA sequence
actggtgatttagcactgaa

SEQ ID NO: 639085 - DNA, 20 bp, Artificial
  CRISPR gRNA sequence
gtgatttagcactgaagatc

SEQ ID NO: 639086 - DNA, 20 bp, Artificial
  CRISPR gRNA sequence
agcactgaagatcacatcta

SEQ ID NO: 639087 - DNA, 20 bp, Artificial
  CRISPR gRNA sequence
gcactgaagatcacatctat

SEQ ID NO: 639088 - DNA, 20 bp, Artificial
  CRISPR gRNA sequence
aagatcacatctatgtcacc

SEQ ID NO: 639089 - DNA, 20 bp, Artificial
  CRISPR gRNA sequence
tgtcacctggaattgtacaa

SEQ ID NO: 639090 - DNA, 20 bp, Artificial
  CRISPR gRNA sequence
gaattgtacaagttaccttc

SEQ ID NO: 639091 - DNA, 20 bp, Artificial
  CRISPR gRNA sequence
tacaagttaccttctaaggg

SEQ ID NO: 639092 - DNA, 20 bp, Artificial
  CRISPR gRNA sequence
ccttctaaggggcttagctt

SEQ ID NO: 639093 - DNA, 20 bp, Artificial
  CRISPR gRNA sequence
ctaaggggcttagcttcctt

SEQ ID NO: 639094 - DNA, 20 bp, Artificial
  CRISPR gRNA sequence
taaggggcttagcttccttt

SEQ ID NO: 639095 - DNA, 20 bp, Artificial
  CRISPR gRNA sequence
aggggcttagcttccttttc

SEQ ID NO: 639096 - DNA, 20 bp, Artificial
  CRISPR gRNA sequence
agcttccttttctgtgaaat

SEQ ID NO: 639097 - DNA, 20 bp, Artificial
  CRISPR gRNA sequence
gcttccttttctgtgaaata

SEQ ID NO: 639098 - DNA, 20 bp, Artificial
  CRISPR gRNA sequence
ccttttctgtgaaataaagg

SEQ ID NO: 639099 - DNA, 20 bp, Artificial
  CRISPR gRNA sequence
cttttctgtgaaataaaggt

SEQ ID NO: 639100 - DNA, 20 bp, Artificial
  CRISPR gRNA sequence
ttctgtgaaataaaggtaat

SEQ ID NO: 639101 - DNA, 20 bp, Artificial
  CRISPR gRNA sequence
tctgtgaaataaaggtaatg

SEQ ID NO: 639102 - DNA, 20 bp, Artificial
  CRISPR gRNA sequence
ctgtgaaataaaggtaatgc

SEQ ID NO: 639103 - DNA, 20 bp, Artificial
  CRISPR gRNA sequence
tgtgaaataaaggtaatgct

SEQ ID NO: 639104 - DNA, 20 bp, Artificial
  CRISPR gRNA sequence
tgaaataaaggtaatgctac

SEQ ID NO: 639105 - DNA, 20 bp, Artificial
  CRISPR gRNA sequence
ccgatttgtgcaggtaaaat

SEQ ID NO: 639106 - DNA, 20 bp, Artificial
  CRISPR gRNA sequence
gtgcaggtaaaatgcttaaa

SEQ ID NO: 639107 - DNA, 20 bp, Artificial
  CRISPR gRNA sequence
tgcaggtaaaatgcttaaaa

SEQ ID NO: 639108 - DNA, 20 bp, Artificial
  CRISPR gRNA sequence
aaaagcctacctgcctgagg

SEQ ID NO: 639109 - DNA, 20 bp, Artificial
  CRISPR gRNA sequence
aaagcctacctgcctgaggt

SEQ ID NO: 639110 - DNA, 20 bp, Artificial
  CRISPR gRNA sequence
cctgcctgaggttaaggatc

SEQ ID NO: 639111 - DNA, 20 bp, Artificial
  CRISPR gRNA sequence
cctgaggttaaggatcttaa

SEQ ID NO: 639112 - DNA, 20 bp, Artificial
  CRISPR gRNA sequence
aggttaaggatcttaaggtc

SEQ ID NO: 639113 - DNA, 20 bp, Artificial
  CRISPR gRNA sequence
aggatcttaaggtcccttca

SEQ ID NO: 639114 - DNA, 20 bp, Artificial
  CRISPR gRNA sequence
aaggtcccttcaatctatgg

SEQ ID NO: 639115 - DNA, 20 bp, Artificial
  CRISPR gRNA sequence
aggtcccttcaatctatggt

SEQ ID NO: 639116 - DNA, 20 bp, Artificial
  CRISPR gRNA sequence
caatctatggtatctatcta

SEQ ID NO: 639117 - DNA, 20 bp, Artificial
  CRISPR gRNA sequence
aatctatggtatctatctat

SEQ ID NO: 639118 - DNA, 20 bp, Artificial
  CRISPR gRNA sequence
tggtatctatctatgattac

SEQ ID NO: 639119 - DNA, 20 bp, Artificial
  CRISPR gRNA sequence
tctatgattacagaatacaa

SEQ ID NO: 639120 - DNA, 20 bp, Artificial
  CRISPR gRNA sequence
tgattacagaatacaaccag

SEQ ID NO: 639121 - DNA, 20 bp, Artificial
  CRISPR gRNA sequence
cagaatacaaccagactatt

SEQ ID NO: 639122 - DNA, 20 bp, Artificial
  CRISPR gRNA sequence
ttctttaagttttccataaa

SEQ ID NO: 639123 - DNA, 20 bp, Artificial
  CRISPR gRNA sequence
tttaagttttccataaataa

SEQ ID NO: 639124 - DNA, 20 bp, Artificial
  CRISPR gRNA sequence
taagttttccataaataaca

SEQ ID NO: 639125 - DNA, 20 bp, Artificial
  CRISPR gRNA sequence
aagttttccataaataacaa

SEQ ID NO: 639126 - DNA, 20 bp, Artificial
  CRISPR gRNA sequence
agttttccataaataacaat

SEQ ID NO: 639127 - DNA, 20 bp, Artificial
  CRISPR gRNA sequence
tccataaataacaatttgtg

SEQ ID NO: 639128 - DNA, 20 bp, Artificial
  CRISPR gRNA sequence
ccataaataacaatttgtgt

SEQ ID NO: 639129 - DNA, 20 bp, Artificial
  CRISPR gRNA sequence
cataaataacaatttgtgta

SEQ ID NO: 639130 - DNA, 20 bp, Artificial
  CRISPR gRNA sequence
gtgtaattggtaatagttat

SEQ ID NO: 639131 - DNA, 20 bp, Artificial
  CRISPR gRNA sequence
tgtaattggtaatagttatt

SEQ ID NO: 639132 - DNA, 20 bp, Artificial
  CRISPR gRNA sequence
gtaatagttattggtcacta

SEQ ID NO: 639133 - DNA, 20 bp, Artificial
  CRISPR gRNA sequence
ttggtcactattataagtaa

SEQ ID NO: 639134 - DNA, 20 bp, Artificial
  CRISPR gRNA sequence
gtcactattataagtaatag

SEQ ID NO: 639135 - DNA, 20 bp, Artificial
  CRISPR gRNA sequence
ttataagtaatagtataaat

SEQ ID NO: 639136 - DNA, 20 bp, Artificial
  CRISPR gRNA sequence
taagtaatagtataaattta

SEQ ID NO: 639137 - DNA, 20 bp, Artificial
  CRISPR gRNA sequence
atttatacaaaatctggggt

SEQ ID NO: 639138 - DNA, 20 bp, Artificial
  CRISPR gRNA sequence
tttatacaaaatctggggta

SEQ ID NO: 639139 - DNA, 20 bp, Artificial
  CRISPR gRNA sequence
atacaaaatctggggtaaag

SEQ ID NO: 639140 - DNA, 20 bp, Artificial
  CRISPR gRNA sequence
tacaaaatctggggtaaaga

SEQ ID NO: 639141 - DNA, 20 bp, Artificial
  CRISPR gRNA sequence
gggtaaagatctacctttta

SEQ ID NO: 639142 - DNA, 20 bp, Artificial
  CRISPR gRNA sequence
ccttttagatcacatatttg

SEQ ID NO: 639143 - DNA, 20 bp, Artificial
  CRISPR gRNA sequence
ttagatcacatatttgaaac

SEQ ID NO: 639144 - DNA, 20 bp, Artificial
  CRISPR gRNA sequence
tagatcacatatttgaaacg

SEQ ID NO: 639145 - DNA, 20 bp, Artificial
  CRISPR gRNA sequence
agatcacatatttgaaacgt

SEQ ID NO: 639146 - DNA, 20 bp, Artificial
  CRISPR gRNA sequence
gatcacatatttgaaacgtc

SEQ ID NO: 639147 - DNA, 20 bp, Artificial
  CRISPR gRNA sequence
gaaacgtctgggcatgccta

SEQ ID NO: 639148 - DNA, 20 bp, Artificial
  CRISPR gRNA sequence
aaacgtctgggcatgcctaa

SEQ ID NO: 639149 - DNA, 20 bp, Artificial
  CRISPR gRNA sequence
ggcatgcctaattctatgtg

SEQ ID NO: 639150 - DNA, 20 bp, Artificial
  CRISPR gRNA sequence
attctatgtgttcaggtgtt

SEQ ID NO: 639151 - DNA, 20 bp, Artificial
  CRISPR gRNA sequence
tatgtgttcaggtgtttctg

SEQ ID NO: 639152 - DNA, 20 bp, Artificial
  CRISPR gRNA sequence
tgtgttcaggtgtttctgag

SEQ ID NO: 639153 - DNA, 20 bp, Artificial
  CRISPR gRNA sequence
aggtgtttctgagggtcata

SEQ ID NO: 639154 - DNA, 20 bp, Artificial
  CRISPR gRNA sequence
ctgagggtcataggtaaaag

SEQ ID NO: 639155 - DNA, 20 bp, Artificial
  CRISPR gRNA sequence
tgagggtcataggtaaaagc

SEQ ID NO: 639156 - DNA, 20 bp, Artificial
  CRISPR gRNA sequence
agggtcataggtaaaagcat

SEQ ID NO: 639157 - DNA, 20 bp, Artificial
  CRISPR gRNA sequence
aaatgtgaatgtacatttat

SEQ ID NO: 639158 - DNA, 20 bp, Artificial
  CRISPR gRNA sequence
aatgtgaatgtacatttata

SEQ ID NO: 639159 - DNA, 20 bp, Artificial
  CRISPR gRNA sequence
atacatatgcatagtaatat

SEQ ID NO: 639160 - DNA, 20 bp, Artificial
  CRISPR gRNA sequence
tacatatgcatagtaatata

SEQ ID NO: 639161 - DNA, 20 bp, Artificial
  CRISPR gRNA sequence
gaaacctagttggtatgtgt

SEQ ID NO: 639162 - DNA, 20 bp, Artificial
  CRISPR gRNA sequence
gttggtatgtgtgcaggatg

SEQ ID NO: 639163 - DNA, 20 bp, Artificial
  CRISPR gRNA sequence
gtatgtgtgcaggatgttct

SEQ ID NO: 639164 - DNA, 20 bp, Artificial
  CRISPR gRNA sequence
tttattaagcaataaatgtt

SEQ ID NO: 639165 - DNA, 20 bp, Artificial
  CRISPR gRNA sequence
tattaagcaataaatgttag

SEQ ID NO: 639166 - DNA, 20 bp, Artificial
  CRISPR gRNA sequence
attaagcaataaatgttagc

SEQ ID NO: 639167 - DNA, 20 bp, Artificial
  CRISPR gRNA sequence
ttaagcaataaatgttagct

SEQ ID NO: 639168 - DNA, 20 bp, Artificial
  CRISPR gRNA sequence
agcaataaatgttagctact

SEQ ID NO: 639169 - DNA, 20 bp, Artificial
  CRISPR gRNA sequence
gctacttaagcaaaagatag

SEQ ID NO: 639170 - DNA, 20 bp, Artificial
  CRISPR gRNA sequence
cttaagcaaaagatagtgca

SEQ ID NO: 639171 - DNA, 20 bp, Artificial
  CRISPR gRNA sequence
aagcaaaagatagtgcaatg

SEQ ID NO: 639172 - DNA, 20 bp, Artificial
  CRISPR gRNA sequence
agcaaaagatagtgcaatgt

SEQ ID NO: 639173 - DNA, 20 bp, Artificial
  CRISPR gRNA sequence
ccttcagttgaatgttggct

SEQ ID NO: 639174 - DNA, 20 bp, Artificial
  CRISPR gRNA sequence
cttcagttgaatgttggcta

SEQ ID NO: 639175 - DNA, 20 bp, Artificial
  CRISPR gRNA sequence
cagttgaatgttggctagta

SEQ ID NO: 639176 - DNA, 20 bp, Artificial
  CRISPR gRNA sequence
agttgaatgttggctagtat

SEQ ID NO: 639177 - DNA, 20 bp, Artificial
  CRISPR gRNA sequence
aatgttggctagtatccagg

SEQ ID NO: 639178 - DNA, 20 bp, Artificial
  CRISPR gRNA sequence
gctagtatccaggagggaga

SEQ ID NO: 639179 - DNA, 20 bp, Artificial
  CRISPR gRNA sequence
gtatccaggagggagaaaac

SEQ ID NO: 639180 - DNA, 20 bp, Artificial
  CRISPR gRNA sequence
aaaactttaaaaagaaaaaa

SEQ ID NO: 639181 - DNA, 20 bp, Artificial
  CRISPR gRNA sequence
taaaaagaaaaaagaagtgc

SEQ ID NO: 639182 - DNA, 20 bp, Artificial
  CRISPR gRNA sequence
aaaaagaaaaaagaagtgct

SEQ ID NO: 639183 - DNA, 20 bp, Artificial
  CRISPR gRNA sequence
aaaagaaaaaagaagtgcta

SEQ ID NO: 639184 - DNA, 20 bp, Artificial
  CRISPR gRNA sequence
caaccttcacaaaaagcata

SEQ ID NO: 639185 - DNA, 20 bp, Artificial
  CRISPR gRNA sequence
cacaaaaagcataaagtcct

SEQ ID NO: 639186 - DNA, 20 bp, Artificial
  CRISPR gRNA sequence
acaaaaagcataaagtcctt

SEQ ID NO: 639187 - DNA, 20 bp, Artificial
  CRISPR gRNA sequence
gactcaaataatgttatgaa

SEQ ID NO: 639188 - DNA, 20 bp, Artificial
  CRISPR gRNA sequence
actcaaataatgttatgaag

SEQ ID NO: 639189 - DNA, 20 bp, Artificial
  CRISPR gRNA sequence
aaataatgttatgaagactc

SEQ ID NO: 639190 - DNA, 20 bp, Artificial
  CRISPR gRNA sequence
tgaagactcttctgaatttc

SEQ ID NO: 639191 - DNA, 20 bp, Artificial
  CRISPR gRNA sequence
ttctgaatttctctttttct

SEQ ID NO: 639192 - DNA, 20 bp, Artificial
  CRISPR gRNA sequence
ctgaatttctctttttctct

SEQ ID NO: 639193 - DNA, 20 bp, Artificial
  CRISPR gRNA sequence
tgaatttctctttttctcta

SEQ ID NO: 639194 - DNA, 20 bp, Artificial
  CRISPR gRNA sequence
aatttctctttttctctact

SEQ ID NO: 639195 - DNA, 20 bp, Artificial
  CRISPR gRNA sequence
ctctttttctctactttgtc

SEQ ID NO: 639196 - DNA, 20 bp, Artificial
  CRISPR gRNA sequence
tctttttctctactttgtcc

SEQ ID NO: 639197 - DNA, 20 bp, Artificial
  CRISPR gRNA sequence
tttttctctactttgtcccc

SEQ ID NO: 639198 - DNA, 20 bp, Artificial
  CRISPR gRNA sequence
tttctctactttgtccccgt

SEQ ID NO: 639199 - DNA, 20 bp, Artificial
  CRISPR gRNA sequence
ttctctactttgtccccgtc

SEQ ID NO: 639200 - DNA, 20 bp, Artificial
  CRISPR gRNA sequence
tctctactttgtccccgtca

SEQ ID NO: 639201 - DNA, 20 bp, Artificial
  CRISPR gRNA sequence
ctctactttgtccccgtcag

SEQ ID NO: 639202 - DNA, 20 bp, Artificial
  CRISPR gRNA sequence
tctactttgtccccgtcagg

SEQ ID NO: 639203 - DNA, 20 bp, Artificial
  CRISPR gRNA sequence
tactttgtccccgtcaggat

SEQ ID NO: 639204 - DNA, 20 bp, Artificial
  CRISPR gRNA sequence
ctttgtccccgtcaggatgt

SEQ ID NO: 639205 - DNA, 20 bp, Artificial
  CRISPR gRNA sequence
tgtccccgtcaggatgtgaa

SEQ ID NO: 639206 - DNA, 20 bp, Artificial
  CRISPR gRNA sequence
gtccccgtcaggatgtgaac

SEQ ID NO: 639207 - DNA, 20 bp, Artificial
  CRISPR gRNA sequence
tccccgtcaggatgtgaacc

SEQ ID NO: 639208 - DNA, 20 bp, Artificial
  CRISPR gRNA sequence
ccattatgtatggcttgcgg

SEQ ID NO: 639209 - DNA, 20 bp, Artificial
  CRISPR gRNA sequence
tgtatggcttgcggctgttt

SEQ ID NO: 639210 - DNA, 20 bp, Artificial
  CRISPR gRNA sequence
gcggctgtttgggagtttcc

SEQ ID NO: 639211 - DNA, 20 bp, Artificial
  CRISPR gRNA sequence
cggctgtttgggagtttcct

SEQ ID NO: 639212 - DNA, 20 bp, Artificial
  CRISPR gRNA sequence
tttgggagtttcctccccat

SEQ ID NO: 639213 - DNA, 20 bp, Artificial
  CRISPR gRNA sequence
gggagtttcctccccatctg

SEQ ID NO: 639214 - DNA, 20 bp, Artificial
  CRISPR gRNA sequence
ggagtttcctccccatctgg

SEQ ID NO: 639215 - DNA, 20 bp, Artificial
  CRISPR gRNA sequence
cctccccatctgggactaag

SEQ ID NO: 639216 - DNA, 20 bp, Artificial
  CRISPR gRNA sequence
ctccccatctgggactaaga

SEQ ID NO: 639217 - DNA, 20 bp, Artificial
  CRISPR gRNA sequence
cccatctgggactaagaggc

SEQ ID NO: 639218 - DNA, 20 bp, Artificial
  CRISPR gRNA sequence
ggactaagaggcaaattgca

SEQ ID NO: 639219 - DNA, 20 bp, Artificial
  CRISPR gRNA sequence
agaggcaaattgcaggtttc

SEQ ID NO: 639220 - DNA, 20 bp, Artificial
  CRISPR gRNA sequence
caggtttccagggaggggaa

SEQ ID NO: 639221 - DNA, 20 bp, Artificial
  CRISPR gRNA sequence
ccagggaggggaatgctgtt

SEQ ID NO: 639222 - DNA, 20 bp, Artificial
  CRISPR gRNA sequence
cagggaggggaatgctgtta

SEQ ID NO: 639223 - DNA, 20 bp, Artificial
  CRISPR gRNA sequence
ttacagtagggatcacctca

SEQ ID NO: 639224 - DNA, 20 bp, Artificial
  CRISPR gRNA sequence
cagtagggatcacctcagca

SEQ ID NO: 639225 - DNA, 20 bp, Artificial
  CRISPR gRNA sequence
agcacttcacatggattgtg

SEQ ID NO: 639226 - DNA, 20 bp, Artificial
  CRISPR gRNA sequence
cacatggattgtgcctagcc

SEQ ID NO: 639227 - DNA, 20 bp, Artificial
  CRISPR gRNA sequence
acatggattgtgcctagcct

SEQ ID NO: 639228 - DNA, 20 bp, Artificial
  CRISPR gRNA sequence
tgcctagcctagtgatacca

SEQ ID NO: 639229 - DNA, 20 bp, Artificial
  CRISPR gRNA sequence
gcctagtgataccagctacc

SEQ ID NO: 639230 - DNA, 20 bp, Artificial
  CRISPR gRNA sequence
gtgataccagctaccttgat

SEQ ID NO: 639231 - DNA, 20 bp, Artificial
  CRISPR gRNA sequence
ccttgatccctgtgacaagc

SEQ ID NO: 639232 - DNA, 20 bp, Artificial
  CRISPR gRNA sequence
gatccctgtgacaagctagc

SEQ ID NO: 639233 - DNA, 20 bp, Artificial
  CRISPR gRNA sequence
atccctgtgacaagctagcc

SEQ ID NO: 639234 - DNA, 20 bp, Artificial
  CRISPR gRNA sequence
tgacaagctagccaccaggt

SEQ ID NO: 639235 - DNA, 20 bp, Artificial
  CRISPR gRNA sequence
gccaccaggttttgtactct

SEQ ID NO: 639236 - DNA, 20 bp, Artificial
  CRISPR gRNA sequence
tgtactctttgttactgaaa

SEQ ID NO: 639237 - DNA, 20 bp, Artificial
  CRISPR gRNA sequence
gtactctttgttactgaaat

SEQ ID NO: 639238 - DNA, 20 bp, Artificial
  CRISPR gRNA sequence
tactctttgttactgaaatt

SEQ ID NO: 639239 - DNA, 20 bp, Artificial
  CRISPR gRNA sequence
tttgttactgaaattatgta

SEQ ID NO: 639240 - DNA, 20 bp, Artificial
  CRISPR gRNA sequence
tgttactgaaattatgtaag

SEQ ID NO: 639241 - DNA, 20 bp, Artificial
  CRISPR gRNA sequence
gttactgaaattatgtaagg

SEQ ID NO: 639242 - DNA, 20 bp, Artificial
  CRISPR gRNA sequence
ttactgaaattatgtaaggt

SEQ ID NO: 639243 - DNA, 20 bp, Artificial
  CRISPR gRNA sequence
ctgaaattatgtaaggtatt

SEQ ID NO: 639244 - DNA, 20 bp, Artificial
  CRISPR gRNA sequence
aaattatgtaaggtattagt

SEQ ID NO: 639245 - DNA, 20 bp, Artificial
  CRISPR gRNA sequence
tgtaaggtattagttttaga

SEQ ID NO: 639246 - DNA, 20 bp, Artificial
  CRISPR gRNA sequence
gttttagaagcctaaagtct

SEQ ID NO: 639247 - DNA, 20 bp, Artificial
  CRISPR gRNA sequence
tagaagcctaaagtctttgt

SEQ ID NO: 639248 - DNA, 20 bp, Artificial
  CRISPR gRNA sequence
agaagcctaaagtctttgtt

SEQ ID NO: 639249 - DNA, 20 bp, Artificial
  CRISPR gRNA sequence
gaagcctaaagtctttgttt

SEQ ID NO: 639250 - DNA, 20 bp, Artificial
  CRISPR gRNA sequence
aagtctttgttttctcaaag

SEQ ID NO: 639251 - DNA, 20 bp, Artificial
  CRISPR gRNA sequence
tgttttctcaaaggctataa

SEQ ID NO: 639252 - DNA, 20 bp, Artificial
  CRISPR gRNA sequence
gttttctcaaaggctataaa

SEQ ID NO: 639253 - DNA, 20 bp, Artificial
  CRISPR gRNA sequence
ttttctcaaaggctataaac

SEQ ID NO: 639254 - DNA, 20 bp, Artificial
  CRISPR gRNA sequence
tctcaaaggctataaacata

SEQ ID NO: 639255 - DNA, 20 bp, Artificial
  CRISPR gRNA sequence
ctcaaaggctataaacatat

SEQ ID NO: 639256 - DNA, 20 bp, Artificial
  CRISPR gRNA sequence
tcaaaggctataaacatatg

SEQ ID NO: 639257 - DNA, 20 bp, Artificial
  CRISPR gRNA sequence
aaaggctataaacatatgaa

SEQ ID NO: 639258 - DNA, 20 bp, Artificial
  CRISPR gRNA sequence
taaacatatgaataaccatt

SEQ ID NO: 639259 - DNA, 20 bp, Artificial
  CRISPR gRNA sequence
aaagttattttaatcttctt

SEQ ID NO: 639260 - DNA, 20 bp, Artificial
  CRISPR gRNA sequence
ttttaatcttcttccacctt

SEQ ID NO: 639261 - DNA, 20 bp, Artificial
  CRISPR gRNA sequence
taatcttcttccacctttaa

SEQ ID NO: 639262 - DNA, 20 bp, Artificial
  CRISPR gRNA sequence
aatcttcttccacctttaaa

SEQ ID NO: 639263 - DNA, 20 bp, Artificial
  CRISPR gRNA sequence
atcttcttccacctttaaaa

SEQ ID NO: 639264 - DNA, 20 bp, Artificial
  CRISPR gRNA sequence
cttccacctttaaaatgaat

SEQ ID NO: 639265 - DNA, 20 bp, Artificial
  CRISPR gRNA sequence
ttccacctttaaaatgaatg

SEQ ID NO: 639266 - DNA, 20 bp, Artificial
  CRISPR gRNA sequence
ccacctttaaaatgaatgca

SEQ ID NO: 639267 - DNA, 20 bp, Artificial
  CRISPR gRNA sequence
cacctttaaaatgaatgcaa

SEQ ID NO: 639268 - DNA, 20 bp, Artificial
  CRISPR gRNA sequence
taaaatgaatgcaattattt

SEQ ID NO: 639269 - DNA, 20 bp, Artificial
  CRISPR gRNA sequence
aaaatgaatgcaattatttc

SEQ ID NO: 639270 - DNA, 20 bp, Artificial
  CRISPR gRNA sequence
aaatgaatgcaattatttca

SEQ ID NO: 639271 - DNA, 20 bp, Artificial
  CRISPR gRNA sequence
tttcaggagcacaagaattc

SEQ ID NO: 639272 - DNA, 20 bp, Artificial
  CRISPR gRNA sequence
caggagcacaagaattcccg

SEQ ID NO: 639273 - DNA, 20 bp, Artificial
  CRISPR gRNA sequence
aggagcacaagaattcccga

SEQ ID NO: 639274 - DNA, 20 bp, Artificial
  CRISPR gRNA sequence
ccgaatctacgtttttgtca

SEQ ID NO: 639275 - DNA, 20 bp, Artificial
  CRISPR gRNA sequence
cgtttttgtcactctcatct

SEQ ID NO: 639276 - DNA, 20 bp, Artificial
  CRISPR gRNA sequence
ttgtcactctcatcttccaa

SEQ ID NO: 639277 - DNA, 20 bp, Artificial
  CRISPR gRNA sequence
tgtcactctcatcttccaaa

SEQ ID NO: 639278 - DNA, 20 bp, Artificial
  CRISPR gRNA sequence
gtcactctcatcttccaaag

SEQ ID NO: 639279 - DNA, 20 bp, Artificial
  CRISPR gRNA sequence
tcactctcatcttccaaagc

SEQ ID NO: 639280 - DNA, 20 bp, Artificial
  CRISPR gRNA sequence
tcatcttccaaagcccactg

SEQ ID NO: 639281 - DNA, 20 bp, Artificial
  CRISPR gRNA sequence
atcttccaaagcccactgtc

SEQ ID NO: 639282 - DNA, 20 bp, Artificial
  CRISPR gRNA sequence
ccaaagcccactgtcttctt

SEQ ID NO: 639283 - DNA, 20 bp, Artificial
  CRISPR gRNA sequence
caaagcccactgtcttcttt

SEQ ID NO: 639284 - DNA, 20 bp, Artificial
  CRISPR gRNA sequence
tcttctttcacactcctagc

SEQ ID NO: 639285 - DNA, 20 bp, Artificial
  CRISPR gRNA sequence
ctttcacactcctagcaggt

SEQ ID NO: 639286 - DNA, 20 bp, Artificial
  CRISPR gRNA sequence
tttcacactcctagcaggtt

SEQ ID NO: 639287 - DNA, 20 bp, Artificial
  CRISPR gRNA sequence
tcacactcctagcaggttgc

SEQ ID NO: 639288 - DNA, 20 bp, Artificial
  CRISPR gRNA sequence
cacactcctagcaggttgcc

SEQ ID NO: 639289 - DNA, 20 bp, Artificial
  CRISPR gRNA sequence
acactcctagcaggttgcct

SEQ ID NO: 639290 - DNA, 20 bp, Artificial
  CRISPR gRNA sequence
ctagcaggttgcctttgttc

SEQ ID NO: 639291 - DNA, 20 bp, Artificial
  CRISPR gRNA sequence
gcaggttgcctttgttcaag

SEQ ID NO: 639292 - DNA, 20 bp, Artificial
  CRISPR gRNA sequence
cctttgttcaaggcagcaca

SEQ ID NO: 639293 - DNA, 20 bp, Artificial
  CRISPR gRNA sequence
tgttcaaggcagcacatgct

SEQ ID NO: 639294 - DNA, 20 bp, Artificial
  CRISPR gRNA sequence
gttcaaggcagcacatgctt

SEQ ID NO: 639295 - DNA, 20 bp, Artificial
  CRISPR gRNA sequence
ttcaaggcagcacatgctta

SEQ ID NO: 639296 - DNA, 20 bp, Artificial
  CRISPR gRNA sequence
aaggcagcacatgcttacta

SEQ ID NO: 639297 - DNA, 20 bp, Artificial
  CRISPR gRNA sequence
actaaaagcacctgacagca

SEQ ID NO: 639298 - DNA, 20 bp, Artificial
  CRISPR gRNA sequence
ctaaaagcacctgacagcaa

SEQ ID NO: 639299 - DNA, 20 bp, Artificial
  CRISPR gRNA sequence
aaagcacctgacagcaatta

SEQ ID NO: 639300 - DNA, 20 bp, Artificial
  CRISPR gRNA sequence
acagcaattaccgcaatgaa

SEQ ID NO: 639301 - DNA, 20 bp, Artificial
  CRISPR gRNA sequence
ccgcaatgaactttaaatct

SEQ ID NO: 639302 - DNA, 20 bp, Artificial
  CRISPR gRNA sequence
taaatctttttcctctaact

SEQ ID NO: 639303 - DNA, 20 bp, Artificial
  CRISPR gRNA sequence
aaatctttttcctctaacta

SEQ ID NO: 639304 - DNA, 20 bp, Artificial
  CRISPR gRNA sequence
aatctttttcctctaactac

SEQ ID NO: 639305 - DNA, 20 bp, Artificial
  CRISPR gRNA sequence
tttcctctaactactgtagt

SEQ ID NO: 639306 - DNA, 20 bp, Artificial
  CRISPR gRNA sequence
ttcctctaactactgtagta

SEQ ID NO: 639307 - DNA, 20 bp, Artificial
  CRISPR gRNA sequence
tcctctaactactgtagtat

SEQ ID NO: 639308 - DNA, 20 bp, Artificial
  CRISPR gRNA sequence
cctctaactactgtagtatt

SEQ ID NO: 639309 - DNA, 20 bp, Artificial
  CRISPR gRNA sequence
ctctaactactgtagtattc

SEQ ID NO: 639310 - DNA, 20 bp, Artificial
  CRISPR gRNA sequence
taactactgtagtattctag

SEQ ID NO: 639311 - DNA, 20 bp, Artificial
  CRISPR gRNA sequence
actactgtagtattctagaa

SEQ ID NO: 639312 - DNA, 20 bp, Artificial
  CRISPR gRNA sequence
ctgtagtattctagaaataa

SEQ ID NO: 639313 - DNA, 20 bp, Artificial
  CRISPR gRNA sequence
tagtattctagaaataatga

SEQ ID NO: 639314 - DNA, 20 bp, Artificial
  CRISPR gRNA sequence
tagaaataatgacacaactt

SEQ ID NO: 639315 - DNA, 20 bp, Artificial
  CRISPR gRNA sequence
gaaataatgacacaacttct

SEQ ID NO: 639316 - DNA, 20 bp, Artificial
  CRISPR gRNA sequence
ctcactgctttaaaatgtca

SEQ ID NO: 639317 - DNA, 20 bp, Artificial
  CRISPR gRNA sequence
tcactgctttaaaatgtcaa

SEQ ID NO: 639318 - DNA, 20 bp, Artificial
  CRISPR gRNA sequence
actgctttaaaatgtcaagc

SEQ ID NO: 639319 - DNA, 20 bp, Artificial
  CRISPR gRNA sequence
ctttaaaatgtcaagctgac

SEQ ID NO: 639320 - DNA, 20 bp, Artificial
  CRISPR gRNA sequence
taaaatgtcaagctgaccac

SEQ ID NO: 639321 - DNA, 20 bp, Artificial
  CRISPR gRNA sequence
aaaatgtcaagctgaccact

SEQ ID NO: 639322 - DNA, 20 bp, Artificial
  CRISPR gRNA sequence
aaatgtcaagctgaccactc

SEQ ID NO: 639323 - DNA, 20 bp, Artificial
  CRISPR gRNA sequence
accactcagaaattcaagct

SEQ ID NO: 639324 - DNA, 20 bp, Artificial
  CRISPR gRNA sequence
agaaattcaagctatgtttc

SEQ ID NO: 639325 - DNA, 20 bp, Artificial
  CRISPR gRNA sequence
aagctatgtttctccaggaa

SEQ ID NO: 639326 - DNA, 20 bp, Artificial
  CRISPR gRNA sequence
tgtttctccaggaaggtcca

SEQ ID NO: 639327 - DNA, 20 bp, Artificial
  CRISPR gRNA sequence
ctccaggaaggtccaaatga

SEQ ID NO: 639328 - DNA, 20 bp, Artificial
  CRISPR gRNA sequence
tccaggaaggtccaaatgat

SEQ ID NO: 639329 - DNA, 20 bp, Artificial
  CRISPR gRNA sequence
caggaaggtccaaatgatga

SEQ ID NO: 639330 - DNA, 20 bp, Artificial
  CRISPR gRNA sequence
tatgtgccttccattttatc

SEQ ID NO: 639331 - DNA, 20 bp, Artificial
  CRISPR gRNA sequence
atgtgccttccattttatct

SEQ ID NO: 639332 - DNA, 20 bp, Artificial
  CRISPR gRNA sequence
tgtgccttccattttatctc

SEQ ID NO: 639333 - DNA, 20 bp, Artificial
  CRISPR gRNA sequence
ccattttatctcctgttcca

SEQ ID NO: 639334 - DNA, 20 bp, Artificial
  CRISPR gRNA sequence
cattttatctcctgttccat

SEQ ID NO: 639335 - DNA, 20 bp, Artificial
  CRISPR gRNA sequence
tatctcctgttccattacta

SEQ ID NO: 639336 - DNA, 20 bp, Artificial
  CRISPR gRNA sequence
atctcctgttccattactac

SEQ ID NO: 639337 - DNA, 20 bp, Artificial
  CRISPR gRNA sequence
tctcctgttccattactaca

SEQ ID NO: 639338 - DNA, 20 bp, Artificial
  CRISPR gRNA sequence
ctgttccattactacactgc

SEQ ID NO: 639339 - DNA, 20 bp, Artificial
  CRISPR gRNA sequence
ttccattactacactgccta

SEQ ID NO: 639340 - DNA, 20 bp, Artificial
  CRISPR gRNA sequence
cattactacactgcctaaca

SEQ ID NO: 639341 - DNA, 20 bp, Artificial
  CRISPR gRNA sequence
ctacactgcctaacaccttc

SEQ ID NO: 639342 - DNA, 20 bp, Artificial
  CRISPR gRNA sequence
cactgcctaacaccttcaca

SEQ ID NO: 639343 - DNA, 20 bp, Artificial
  CRISPR gRNA sequence
cctaacaccttcacagtata

SEQ ID NO: 639344 - DNA, 20 bp, Artificial
  CRISPR gRNA sequence
acaccttcacagtatagcaa

SEQ ID NO: 639345 - DNA, 20 bp, Artificial
  CRISPR gRNA sequence
cacagtatagcaacacctcc

SEQ ID NO: 639346 - DNA, 20 bp, Artificial
  CRISPR gRNA sequence
acagtatagcaacacctcct

SEQ ID NO: 639347 - DNA, 20 bp, Artificial
  CRISPR gRNA sequence
ctgggacaagctgaaaccta

SEQ ID NO: 639348 - DNA, 20 bp, Artificial
  CRISPR gRNA sequence
ggacaagctgaaacctaaat

SEQ ID NO: 639349 - DNA, 20 bp, Artificial
  CRISPR gRNA sequence
aaacctaaatgaaacacaaa

SEQ ID NO: 639350 - DNA, 20 bp, Artificial
  CRISPR gRNA sequence
aatgaaacacaaaagctgca

SEQ ID NO: 639351 - DNA, 20 bp, Artificial
  CRISPR gRNA sequence
caacctgaacaaagttagca

SEQ ID NO: 639352 - DNA, 20 bp, Artificial
  CRISPR gRNA sequence
aacaaagttagcaatatgtt

SEQ ID NO: 639353 - DNA, 20 bp, Artificial
  CRISPR gRNA sequence
gcaatatgtttttggcaaga

SEQ ID NO: 639354 - DNA, 20 bp, Artificial
  CRISPR gRNA sequence
ttggcaagagtaagctgttt

SEQ ID NO: 639355 - DNA, 20 bp, Artificial
  CRISPR gRNA sequence
tggcaagagtaagctgtttt

SEQ ID NO: 639356 - DNA, 20 bp, Artificial
  CRISPR gRNA sequence
ggcaagagtaagctgttttt

SEQ ID NO: 639357 - DNA, 20 bp, Artificial
  CRISPR gRNA sequence
gcaagagtaagctgtttttt

SEQ ID NO: 639358 - DNA, 20 bp, Artificial
  CRISPR gRNA sequence
tttttttcttttctttccat

SEQ ID NO: 639359 - DNA, 20 bp, Artificial
  CRISPR gRNA sequence
ttttcttttctttccatgat

SEQ ID NO: 639360 - DNA, 20 bp, Artificial
  CRISPR gRNA sequence
tttcttttctttccatgatc

SEQ ID NO: 639361 - DNA, 20 bp, Artificial
  CRISPR gRNA sequence
ttcttttctttccatgatct

SEQ ID NO: 639362 - DNA, 20 bp, Artificial
  CRISPR gRNA sequence
tcttttctttccatgatctg

SEQ ID NO: 639363 - DNA, 20 bp, Artificial
  CRISPR gRNA sequence
cttttctttccatgatctga

SEQ ID NO: 639364 - DNA, 20 bp, Artificial
  CRISPR gRNA sequence
ttttctttccatgatctgac

SEQ ID NO: 639365 - DNA, 20 bp, Artificial
  CRISPR gRNA sequence
ttctttccatgatctgacac

SEQ ID NO: 639366 - DNA, 20 bp, Artificial
  CRISPR gRNA sequence
tctttccatgatctgacact

SEQ ID NO: 639367 - DNA, 20 bp, Artificial
  CRISPR gRNA sequence
ctttccatgatctgacacta

SEQ ID NO: 639368 - DNA, 20 bp, Artificial
  CRISPR gRNA sequence
tttccatgatctgacactat

SEQ ID NO: 639369 - DNA, 20 bp, Artificial
  CRISPR gRNA sequence
tccatgatctgacactatca

SEQ ID NO: 639370 - DNA, 20 bp, Artificial
  CRISPR gRNA sequence
ccatgatctgacactatcag

SEQ ID NO: 639371 - DNA, 20 bp, Artificial
  CRISPR gRNA sequence
catgatctgacactatcagc

SEQ ID NO: 639372 - DNA, 20 bp, Artificial
  CRISPR gRNA sequence
acactatcagctgaattaat

SEQ ID NO: 639373 - DNA, 20 bp, Artificial
  CRISPR gRNA sequence
tcagctgaattaattttatt

SEQ ID NO: 639374 - DNA, 20 bp, Artificial
  CRISPR gRNA sequence
aattaattttattttcttcc

SEQ ID NO: 639375 - DNA, 20 bp, Artificial
  CRISPR gRNA sequence
attttattttcttcctcaca

SEQ ID NO: 639376 - DNA, 20 bp, Artificial
  CRISPR gRNA sequence
tattttcttcctcacagtgc

SEQ ID NO: 639377 - DNA, 20 bp, Artificial
  CRISPR gRNA sequence
attttcttcctcacagtgct

SEQ ID NO: 639378 - DNA, 20 bp, Artificial
  CRISPR gRNA sequence
ttttcttcctcacagtgcta

SEQ ID NO: 639379 - DNA, 20 bp, Artificial
  CRISPR gRNA sequence
tcttcctcacagtgctattt

SEQ ID NO: 639380 - DNA, 20 bp, Artificial
  CRISPR gRNA sequence
cttcctcacagtgctatttc

SEQ ID NO: 639381 - DNA, 20 bp, Artificial
  CRISPR gRNA sequence
ttcctcacagtgctatttct

SEQ ID NO: 639382 - DNA, 20 bp, Artificial
  CRISPR gRNA sequence
cctcacagtgctatttctaa

SEQ ID NO: 639383 - DNA, 20 bp, Artificial
  CRISPR gRNA sequence
ctcacagtgctatttctaag

SEQ ID NO: 639384 - DNA, 20 bp, Artificial
  CRISPR gRNA sequence
acagtgctatttctaagtag

SEQ ID NO: 639385 - DNA, 20 bp, Artificial
  CRISPR gRNA sequence
tttctaagtagattaaacct

SEQ ID NO: 639386 - DNA, 20 bp, Artificial
  CRISPR gRNA sequence
ctaagtagattaaacctatt

SEQ ID NO: 639387 - DNA, 20 bp, Artificial
  CRISPR gRNA sequence
taagtagattaaacctattg

SEQ ID NO: 639388 - DNA, 20 bp, Artificial
  CRISPR gRNA sequence
agtagattaaacctattgca

SEQ ID NO: 639389 - DNA, 20 bp, Artificial
  CRISPR gRNA sequence
aacctattgcatgactaatt

SEQ ID NO: 639390 - DNA, 20 bp, Artificial
  CRISPR gRNA sequence
ttgcatgactaatttaccta

SEQ ID NO: 639391 - DNA, 20 bp, Artificial
  CRISPR gRNA sequence
catgactaatttacctagtg

SEQ ID NO: 639392 - DNA, 20 bp, Artificial
  CRISPR gRNA sequence
atttacctagtggcaaggta

SEQ ID NO: 639393 - DNA, 20 bp, Artificial
  CRISPR gRNA sequence
acctagtggcaaggtagcct

SEQ ID NO: 639394 - DNA, 20 bp, Artificial
  CRISPR gRNA sequence
cctagtggcaaggtagcctg

SEQ ID NO: 639395 - DNA, 20 bp, Artificial
  CRISPR gRNA sequence
gtggcaaggtagcctgcctt

SEQ ID NO: 639396 - DNA, 20 bp, Artificial
  CRISPR gRNA sequence
cctttaattgtgcgatattt

SEQ ID NO: 639397 - DNA, 20 bp, Artificial
  CRISPR gRNA sequence
taattgtgcgatatttttaa

SEQ ID NO: 639398 - DNA, 20 bp, Artificial
  CRISPR gRNA sequence
aattgtgcgatatttttaac

SEQ ID NO: 639399 - DNA, 20 bp, Artificial
  CRISPR gRNA sequence
attgtgcgatatttttaacc

SEQ ID NO: 639400 - DNA, 20 bp, Artificial
  CRISPR gRNA sequence
tgcgatatttttaaccataa

SEQ ID NO: 639401 - DNA, 20 bp, Artificial
  CRISPR gRNA sequence
ttaaccataaacacctaaca

SEQ ID NO: 639402 - DNA, 20 bp, Artificial
  CRISPR gRNA sequence
taaccataaacacctaacac

SEQ ID NO: 639403 - DNA, 20 bp, Artificial
  CRISPR gRNA sequence
aaccataaacacctaacaca

SEQ ID NO: 639404 - DNA, 20 bp, Artificial
  CRISPR gRNA sequence
accataaacacctaacacac

SEQ ID NO: 639405 - DNA, 20 bp, Artificial
  CRISPR gRNA sequence
acacactccattattttcat

SEQ ID NO: 639406 - DNA, 20 bp, Artificial
  CRISPR gRNA sequence
cattattttcatgcattttg

SEQ ID NO: 639407 - DNA, 20 bp, Artificial
  CRISPR gRNA sequence
ttttcatgcattttgagatt

SEQ ID NO: 639408 - DNA, 20 bp, Artificial
  CRISPR gRNA sequence
tcatgcattttgagattaag

SEQ ID NO: 639409 - DNA, 20 bp, Artificial
  CRISPR gRNA sequence
catgcattttgagattaagt

SEQ ID NO: 639410 - DNA, 20 bp, Artificial
  CRISPR gRNA sequence
atgcattttgagattaagtt

SEQ ID NO: 639411 - DNA, 20 bp, Artificial
  CRISPR gRNA sequence
tgagattaagtttatattca

SEQ ID NO: 639412 - DNA, 20 bp, Artificial
  CRISPR gRNA sequence
gagattaagtttatattcaa

SEQ ID NO: 639413 - DNA, 20 bp, Artificial
  CRISPR gRNA sequence
agattaagtttatattcaaa

SEQ ID NO: 639414 - DNA, 20 bp, Artificial
  CRISPR gRNA sequence
agtttatattcaaatgtctg

SEQ ID NO: 639415 - DNA, 20 bp, Artificial
  CRISPR gRNA sequence
atattcaaatgtctggtttg

SEQ ID NO: 639416 - DNA, 20 bp, Artificial
  CRISPR gRNA sequence
tattcaaatgtctggtttga

SEQ ID NO: 639417 - DNA, 20 bp, Artificial
  CRISPR gRNA sequence
aaatgtctggtttgactttc

SEQ ID NO: 639418 - DNA, 20 bp, Artificial
  CRISPR gRNA sequence
gtttgactttcacactcaga

SEQ ID NO: 639419 - DNA, 20 bp, Artificial
  CRISPR gRNA sequence
gactttcacactcagaggaa

SEQ ID NO: 639420 - DNA, 20 bp, Artificial
  CRISPR gRNA sequence
actttcacactcagaggaaa

SEQ ID NO: 639421 - DNA, 20 bp, Artificial
  CRISPR gRNA sequence
tcacactcagaggaaaaaaa

SEQ ID NO: 639422 - DNA, 20 bp, Artificial
  CRISPR gRNA sequence
cacactcagaggaaaaaaaa

SEQ ID NO: 639423 - DNA, 20 bp, Artificial
  CRISPR gRNA sequence
acactcagaggaaaaaaaaa

SEQ ID NO: 639424 - DNA, 20 bp, Artificial
  CRISPR gRNA sequence
agaggaaaaaaaaattcctt

SEQ ID NO: 639425 - DNA, 20 bp, Artificial
  CRISPR gRNA sequence
ctttcagaaatttgaactaa

SEQ ID NO: 639426 - DNA, 20 bp, Artificial
  CRISPR gRNA sequence
tcagaaatttgaactaactt

SEQ ID NO: 639427 - DNA, 20 bp, Artificial
  CRISPR gRNA sequence
cagaaatttgaactaacttc

SEQ ID NO: 639428 - DNA, 20 bp, Artificial
  CRISPR gRNA sequence
agaaatttgaactaacttcc

SEQ ID NO: 639429 - DNA, 20 bp, Artificial
  CRISPR gRNA sequence
gaactaacttccttaaactc

SEQ ID NO: 639430 - DNA, 20 bp, Artificial
  CRISPR gRNA sequence
aactaacttccttaaactca

SEQ ID NO: 639431 - DNA, 20 bp, Artificial
  CRISPR gRNA sequence
acttccttaaactcaggaag

SEQ ID NO: 639432 - DNA, 20 bp, Artificial
  CRISPR gRNA sequence
ccttaaactcaggaagcttt

SEQ ID NO: 639433 - DNA, 20 bp, Artificial
  CRISPR gRNA sequence
cttaaactcaggaagcttta

SEQ ID NO: 639434 - DNA, 20 bp, Artificial
  CRISPR gRNA sequence
aaactcaggaagctttaaac

SEQ ID NO: 639435 - DNA, 20 bp, Artificial
  CRISPR gRNA sequence
aactcaggaagctttaaact

SEQ ID NO: 639436 - DNA, 20 bp, Artificial
  CRISPR gRNA sequence
aggaagctttaaacttccag

SEQ ID NO: 639437 - DNA, 20 bp, Artificial
  CRISPR gRNA sequence
taaacttccagctgacacaa

SEQ ID NO: 639438 - DNA, 20 bp, Artificial
  CRISPR gRNA sequence
aaacttccagctgacacaag

SEQ ID NO: 639439 - DNA, 20 bp, Artificial
  CRISPR gRNA sequence
aacttccagctgacacaaga

SEQ ID NO: 639440 - DNA, 20 bp, Artificial
  CRISPR gRNA sequence
ccagctgacacaagaattat

SEQ ID NO: 639441 - DNA, 20 bp, Artificial
  CRISPR gRNA sequence
cagctgacacaagaattatc

SEQ ID NO: 639442 - DNA, 20 bp, Artificial
  CRISPR gRNA sequence
acacaagaattatcagttta

SEQ ID NO: 639443 - DNA, 20 bp, Artificial
  CRISPR gRNA sequence
tcagtttacaaggttcatat

SEQ ID NO: 639444 - DNA, 20 bp, Artificial
  CRISPR gRNA sequence
acaaggttcatatgaataca

SEQ ID NO: 639445 - DNA, 20 bp, Artificial
  CRISPR gRNA sequence
caaggttcatatgaatacag

SEQ ID NO: 639446 - DNA, 20 bp, Artificial
  CRISPR gRNA sequence
atatgaatacagtaaaatcc

SEQ ID NO: 639447 - DNA, 20 bp, Artificial
  CRISPR gRNA sequence
atagtttttcaaataatatg

SEQ ID NO: 639448 - DNA, 20 bp, Artificial
  CRISPR gRNA sequence
ttcaaataatatggaaaaca

SEQ ID NO: 639449 - DNA, 20 bp, Artificial
  CRISPR gRNA sequence
tcaaataatatggaaaacac

SEQ ID NO: 639450 - DNA, 20 bp, Artificial
  CRISPR gRNA sequence
caaataatatggaaaacaca

SEQ ID NO: 639451 - DNA, 20 bp, Artificial
  CRISPR gRNA sequence
aaataatatggaaaacacag

SEQ ID NO: 639452 - DNA, 20 bp, Artificial
  CRISPR gRNA sequence
taactatgcttagttatggg

SEQ ID NO: 639453 - DNA, 20 bp, Artificial
  CRISPR gRNA sequence
aactatgcttagttatggga

SEQ ID NO: 639454 - DNA, 20 bp, Artificial
  CRISPR gRNA sequence
actatgcttagttatgggaa

SEQ ID NO: 639455 - DNA, 20 bp, Artificial
  CRISPR gRNA sequence
tgcttagttatgggaaagag

SEQ ID NO: 639456 - DNA, 20 bp, Artificial
  CRISPR gRNA sequence
agttatgggaaagagatgcc

SEQ ID NO: 639457 - DNA, 20 bp, Artificial
  CRISPR gRNA sequence
gttatgggaaagagatgccc

SEQ ID NO: 639458 - DNA, 20 bp, Artificial
  CRISPR gRNA sequence
tgggaaagagatgcccatta

SEQ ID NO: 639459 - DNA, 20 bp, Artificial
  CRISPR gRNA sequence
ttaagagatcaagttaagct

SEQ ID NO: 639460 - DNA, 20 bp, Artificial
  CRISPR gRNA sequence
agagatcaagttaagcttta

SEQ ID NO: 639461 - DNA, 20 bp, Artificial
  CRISPR gRNA sequence
agctttaaatgccattatct

SEQ ID NO: 639462 - DNA, 20 bp, Artificial
  CRISPR gRNA sequence
taaatgccattatctttaac

SEQ ID NO: 639463 - DNA, 20 bp, Artificial
  CRISPR gRNA sequence
aaatgccattatctttaact

SEQ ID NO: 639464 - DNA, 20 bp, Artificial
  CRISPR gRNA sequence
aatgccattatctttaacta

SEQ ID NO: 639465 - DNA, 20 bp, Artificial
  CRISPR gRNA sequence
tctttaactacatagcaaaa

SEQ ID NO: 639466 - DNA, 20 bp, Artificial
  CRISPR gRNA sequence
taactacatagcaaaattaa

SEQ ID NO: 639467 - DNA, 20 bp, Artificial
  CRISPR gRNA sequence
aactacatagcaaaattaaa

SEQ ID NO: 639468 - DNA, 20 bp, Artificial
  CRISPR gRNA sequence
actacatagcaaaattaaat

SEQ ID NO: 639469 - DNA, 20 bp, Artificial
  CRISPR gRNA sequence
catagcaaaattaaattaag

SEQ ID NO: 639470 - DNA, 20 bp, Artificial
  CRISPR gRNA sequence
aattaaggaatagaatcctg

SEQ ID NO: 639471 - DNA, 20 bp, Artificial
  CRISPR gRNA sequence
aggaatagaatcctgaagaa

SEQ ID NO: 639472 - DNA, 20 bp, Artificial
  CRISPR gRNA sequence
aagaatagcttttacagata

SEQ ID NO: 639473 - DNA, 20 bp, Artificial
  CRISPR gRNA sequence
ttacagatagaaaacttagc

SEQ ID NO: 639474 - DNA, 20 bp, Artificial
  CRISPR gRNA sequence
tacagatagaaaacttagct

SEQ ID NO: 639475 - DNA, 20 bp, Artificial
  CRISPR gRNA sequence
acagatagaaaacttagctt

SEQ ID NO: 639476 - DNA, 20 bp, Artificial
  CRISPR gRNA sequence
cagatagaaaacttagcttc

SEQ ID NO: 639477 - DNA, 20 bp, Artificial
  CRISPR gRNA sequence
agcttcttcctttacatatt

SEQ ID NO: 639478 - DNA, 20 bp, Artificial
  CRISPR gRNA sequence
gcttcttcctttacatatta

SEQ ID NO: 639479 - DNA, 20 bp, Artificial
  CRISPR gRNA sequence
cttcctttacatattaaaac

SEQ ID NO: 639480 - DNA, 20 bp, Artificial
  CRISPR gRNA sequence
ttcctttacatattaaaact

SEQ ID NO: 639481 - DNA, 20 bp, Artificial
  CRISPR gRNA sequence
cctttacatattaaaactcc

SEQ ID NO: 639482 - DNA, 20 bp, Artificial
  CRISPR gRNA sequence
ctttacatattaaaactcct

SEQ ID NO: 639483 - DNA, 20 bp, Artificial
  CRISPR gRNA sequence
tacatattaaaactcctgtt

SEQ ID NO: 639484 - DNA, 20 bp, Artificial
  CRISPR gRNA sequence
acatattaaaactcctgtta

SEQ ID NO: 639485 - DNA, 20 bp, Artificial
  CRISPR gRNA sequence
catattaaaactcctgttac

SEQ ID NO: 639486 - DNA, 20 bp, Artificial
  CRISPR gRNA sequence
aaactcctgttactacttac

SEQ ID NO: 639487 - DNA, 20 bp, Artificial
  CRISPR gRNA sequence
ctgttactacttacatctaa

SEQ ID NO: 639488 - DNA, 20 bp, Artificial
  CRISPR gRNA sequence
ttactacttacatctaatat

SEQ ID NO: 639489 - DNA, 20 bp, Artificial
  CRISPR gRNA sequence
ctacttacatctaatatata

SEQ ID NO: 639490 - DNA, 20 bp, Artificial
  CRISPR gRNA sequence
cttacatctaatatataaag

SEQ ID NO: 639491 - DNA, 20 bp, Artificial
  CRISPR gRNA sequence
acatctaatatataaagagt

SEQ ID NO: 639492 - DNA, 20 bp, Artificial
  CRISPR gRNA sequence
catctaatatataaagagtg

SEQ ID NO: 639493 - DNA, 20 bp, Artificial
  CRISPR gRNA sequence
atatataaagagtgtggact

SEQ ID NO: 639494 - DNA, 20 bp, Artificial
  CRISPR gRNA sequence
gggaagtcactggattgtat

SEQ ID NO: 639495 - DNA, 20 bp, Artificial
  CRISPR gRNA sequence
ggaagtcactggattgtatt

SEQ ID NO: 639496 - DNA, 20 bp, Artificial
  CRISPR gRNA sequence
gattgtattccaggatcagg

SEQ ID NO: 639497 - DNA, 20 bp, Artificial
  CRISPR gRNA sequence
tattccaggatcagggaatt

SEQ ID NO: 639498 - DNA, 20 bp, Artificial
  CRISPR gRNA sequence
caggatcagggaattcactg

SEQ ID NO: 639499 - DNA, 20 bp, Artificial
  CRISPR gRNA sequence
actgattttcaggattccct

SEQ ID NO: 639500 - DNA, 20 bp, Artificial
  CRISPR gRNA sequence
attttcaggattccctcttg

SEQ ID NO: 639501 - DNA, 20 bp, Artificial
  CRISPR gRNA sequence
tcaggattccctcttgccat

SEQ ID NO: 639502 - DNA, 20 bp, Artificial
  CRISPR gRNA sequence
caggattccctcttgccatc

SEQ ID NO: 639503 - DNA, 20 bp, Artificial
  CRISPR gRNA sequence
aggattccctcttgccatca

SEQ ID NO: 639504 - DNA, 20 bp, Artificial
  CRISPR gRNA sequence
cctcttgccatcatcacttt

SEQ ID NO: 639505 - DNA, 20 bp, Artificial
  CRISPR gRNA sequence
ttgccatcatcactttccca

SEQ ID NO: 639506 - DNA, 20 bp, Artificial
  CRISPR gRNA sequence
gccatcatcactttcccata

SEQ ID NO: 639507 - DNA, 20 bp, Artificial
  CRISPR gRNA sequence
ccatcatcactttcccataa

SEQ ID NO: 639508 - DNA, 20 bp, Artificial
  CRISPR gRNA sequence
tcccataataacagaaaaac

SEQ ID NO: 639509 - DNA, 20 bp, Artificial
  CRISPR gRNA sequence
cccataataacagaaaaaca

SEQ ID NO: 639510 - DNA, 20 bp, Artificial
  CRISPR gRNA sequence
ccataataacagaaaaacaa

SEQ ID NO: 639511 - DNA, 20 bp, Artificial
  CRISPR gRNA sequence
atcaaataccaatttataga

SEQ ID NO: 639512 - DNA, 20 bp, Artificial
  CRISPR gRNA sequence
tcaaataccaatttatagag

SEQ ID NO: 639513 - DNA, 20 bp, Artificial
  CRISPR gRNA sequence
atagagtacagtatacacac

SEQ ID NO: 639514 - DNA, 20 bp, Artificial
  CRISPR gRNA sequence
tagagtacagtatacacact

SEQ ID NO: 639515 - DNA, 20 bp, Artificial
  CRISPR gRNA sequence
gacactgttaagtattggat

SEQ ID NO: 639516 - DNA, 20 bp, Artificial
  CRISPR gRNA sequence
ttaagtattggatctatagg

SEQ ID NO: 639517 - DNA, 20 bp, Artificial
  CRISPR gRNA sequence
agtattggatctataggact

SEQ ID NO: 639518 - DNA, 20 bp, Artificial
  CRISPR gRNA sequence
gatctataggactagacaag

SEQ ID NO: 639519 - DNA, 20 bp, Artificial
  CRISPR gRNA sequence
taggactagacaagacaggc

SEQ ID NO: 639520 - DNA, 20 bp, Artificial
  CRISPR gRNA sequence
gacaagacaggcttatagtc

SEQ ID NO: 639521 - DNA, 20 bp, Artificial
  CRISPR gRNA sequence
atagtctggttggggataca

SEQ ID NO: 639522 - DNA, 20 bp, Artificial
  CRISPR gRNA sequence
tagtctggttggggatacag

SEQ ID NO: 639523 - DNA, 20 bp, Artificial
  CRISPR gRNA sequence
gttggggatacagacaaacc

SEQ ID NO: 639524 - DNA, 20 bp, Artificial
  CRISPR gRNA sequence
gggatacagacaaacctaac

SEQ ID NO: 639525 - DNA, 20 bp, Artificial
  CRISPR gRNA sequence
acaaggtaagcagttctcag

SEQ ID NO: 639526 - DNA, 20 bp, Artificial
  CRISPR gRNA sequence
tcagacaaggacagtacaga

SEQ ID NO: 639527 - DNA, 20 bp, Artificial
  CRISPR gRNA sequence
agacaaggacagtacagaac

SEQ ID NO: 639528 - DNA, 20 bp, Artificial
  CRISPR gRNA sequence
agtgcaaaatacagtgtttg

SEQ ID NO: 639529 - DNA, 20 bp, Artificial
  CRISPR gRNA sequence
gagaggaactaaaaggaaaa

SEQ ID NO: 639530 - DNA, 20 bp, Artificial
  CRISPR gRNA sequence
agaggaactaaaaggaaaag

SEQ ID NO: 639531 - DNA, 20 bp, Artificial
  CRISPR gRNA sequence
aaaggaaaagacaggagagt

SEQ ID NO: 639532 - DNA, 20 bp, Artificial
  CRISPR gRNA sequence
tcaaaataatactgctggaa

SEQ ID NO: 639533 - DNA, 20 bp, Artificial
  CRISPR gRNA sequence
aaaataatactgctggaaaa

SEQ ID NO: 639534 - DNA, 20 bp, Artificial
  CRISPR gRNA sequence
ctggaaaagaaaggtttaag

SEQ ID NO: 639535 - DNA, 20 bp, Artificial
  CRISPR gRNA sequence
gaaaagaaaggtttaaggcc

SEQ ID NO: 639536 - DNA, 20 bp, Artificial
  CRISPR gRNA sequence
aaggcccttaaaggttaaaa

SEQ ID NO: 639537 - DNA, 20 bp, Artificial
  CRISPR gRNA sequence
aggcccttaaaggttaaaat

SEQ ID NO: 639538 - DNA, 20 bp, Artificial
  CRISPR gRNA sequence
aaaggttaaaatccagggcc

SEQ ID NO: 639539 - DNA, 20 bp, Artificial
  CRISPR gRNA sequence
aaggttaaaatccagggcca

SEQ ID NO: 639540 - DNA, 20 bp, Artificial
  CRISPR gRNA sequence
aaatccagggccaatagggc

SEQ ID NO: 639541 - DNA, 20 bp, Artificial
  CRISPR gRNA sequence
attattctgtgggctagttt

SEQ ID NO: 639542 - DNA, 20 bp, Artificial
  CRISPR gRNA sequence
ttattctgtgggctagtttt

SEQ ID NO: 639543 - DNA, 20 bp, Artificial
  CRISPR gRNA sequence
ttctgtgggctagttttgtg

SEQ ID NO: 639544 - DNA, 20 bp, Artificial
  CRISPR gRNA sequence
tgtgggctagttttgtgaaa

SEQ ID NO: 639545 - DNA, 20 bp, Artificial
  CRISPR gRNA sequence
tgggctagttttgtgaaatt

SEQ ID NO: 639546 - DNA, 20 bp, Artificial
  CRISPR gRNA sequence
gttttgtgaaattggtagca

SEQ ID NO: 639547 - DNA, 20 bp, Artificial
  CRISPR gRNA sequence
tgtgaaattggtagcaatgg

SEQ ID NO: 639548 - DNA, 20 bp, Artificial
  CRISPR gRNA sequence
gtgaaattggtagcaatgga

SEQ ID NO: 639549 - DNA, 20 bp, Artificial
  CRISPR gRNA sequence
tgaaattggtagcaatggaa

SEQ ID NO: 639550 - DNA, 20 bp, Artificial
  CRISPR gRNA sequence
gtagcaatggaaggaacaaa

SEQ ID NO: 639551 - DNA, 20 bp, Artificial
  CRISPR gRNA sequence
acatctagtgaaggtgcatt

SEQ ID NO: 639552 - DNA, 20 bp, Artificial
  CRISPR gRNA sequence
gtgaaggtgcatttagttgg

SEQ ID NO: 639553 - DNA, 20 bp, Artificial
  CRISPR gRNA sequence
agttgggcgtccttcaacat

SEQ ID NO: 639554 - DNA, 20 bp, Artificial
  CRISPR gRNA sequence
gttgggcgtccttcaacatt

SEQ ID NO: 639555 - DNA, 20 bp, Artificial
  CRISPR gRNA sequence
ggcgtccttcaacattagcc

SEQ ID NO: 639556 - DNA, 20 bp, Artificial
  CRISPR gRNA sequence
caacattagccatttaatta

SEQ ID NO: 639557 - DNA, 20 bp, Artificial
  CRISPR gRNA sequence
aacattagccatttaattac

SEQ ID NO: 639558 - DNA, 20 bp, Artificial
  CRISPR gRNA sequence
gccatttaattaccaaacaa

SEQ ID NO: 639559 - DNA, 20 bp, Artificial
  CRISPR gRNA sequence
aattaccaaacaaatctttc

SEQ ID NO: 639560 - DNA, 20 bp, Artificial
  CRISPR gRNA sequence
attaccaaacaaatctttcc

SEQ ID NO: 639561 - DNA, 20 bp, Artificial
  CRISPR gRNA sequence
ccaaacaaatctttccaata

SEQ ID NO: 639562 - DNA, 20 bp, Artificial
  CRISPR gRNA sequence
tccaataagtattagtttca

SEQ ID NO: 639563 - DNA, 20 bp, Artificial
  CRISPR gRNA sequence
ccaataagtattagtttcat

SEQ ID NO: 639564 - DNA, 20 bp, Artificial
  CRISPR gRNA sequence
caataagtattagtttcatt

SEQ ID NO: 639565 - DNA, 20 bp, Artificial
  CRISPR gRNA sequence
gtttcattttatacaaaagg

SEQ ID NO: 639566 - DNA, 20 bp, Artificial
  CRISPR gRNA sequence
cattttatacaaaaggaagc

SEQ ID NO: 639567 - DNA, 20 bp, Artificial
  CRISPR gRNA sequence
attttatacaaaaggaagct

SEQ ID NO: 639568 - DNA, 20 bp, Artificial
  CRISPR gRNA sequence
tatacaaaaggaagctgagg

SEQ ID NO: 639569 - DNA, 20 bp, Artificial
  CRISPR gRNA sequence
atacaaaaggaagctgagga

SEQ ID NO: 639570 - DNA, 20 bp, Artificial
  CRISPR gRNA sequence
tacaaaaggaagctgaggat

SEQ ID NO: 639571 - DNA, 20 bp, Artificial
  CRISPR gRNA sequence
aggatcaggaccacatcaca

SEQ ID NO: 639572 - DNA, 20 bp, Artificial
  CRISPR gRNA sequence
aataatactgtgtgtctgaa

SEQ ID NO: 639573 - DNA, 20 bp, Artificial
  CRISPR gRNA sequence
tgtgtctgaaccagccaaat

SEQ ID NO: 639574 - DNA, 20 bp, Artificial
  CRISPR gRNA sequence
aaccagccaaataccctcat

SEQ ID NO: 639575 - DNA, 20 bp, Artificial
  CRISPR gRNA sequence
attatgtatatcactggcta

SEQ ID NO: 639576 - DNA, 20 bp, Artificial
  CRISPR gRNA sequence
tgtatatcactggctataaa

SEQ ID NO: 639577 - DNA, 20 bp, Artificial
  CRISPR gRNA sequence
gctataaaagaaaccaagtt

SEQ ID NO: 639578 - DNA, 20 bp, Artificial
  CRISPR gRNA sequence
taaaagaaaccaagttgggg

SEQ ID NO: 639579 - DNA, 20 bp, Artificial
  CRISPR gRNA sequence
ggggaaaatgtttctacaaa

SEQ ID NO: 639580 - DNA, 20 bp, Artificial
  CRISPR gRNA sequence
ctacaaatatgggaattcaa

SEQ ID NO: 639581 - DNA, 20 bp, Artificial
  CRISPR gRNA sequence
tacaaatatgggaattcaaa

SEQ ID NO: 639582 - DNA, 20 bp, Artificial
  CRISPR gRNA sequence
caaatatgggaattcaaagt

SEQ ID NO: 639583 - DNA, 20 bp, Artificial
  CRISPR gRNA sequence
aaagtctttttccattaatg

SEQ ID NO: 639584 - DNA, 20 bp, Artificial
  CRISPR gRNA sequence
tttccattaatggggccatt

SEQ ID NO: 639585 - DNA, 20 bp, Artificial
  CRISPR gRNA sequence
ttccattaatggggccattt

SEQ ID NO: 639586 - DNA, 20 bp, Artificial
  CRISPR gRNA sequence
tccattaatggggccattta

SEQ ID NO: 639587 - DNA, 20 bp, Artificial
  CRISPR gRNA sequence
ccattaatggggccatttat

SEQ ID NO: 639588 - DNA, 20 bp, Artificial
  CRISPR gRNA sequence
cattaatggggccatttata

SEQ ID NO: 639589 - DNA, 20 bp, Artificial
  CRISPR gRNA sequence
atggggccatttatatttta

SEQ ID NO: 639590 - DNA, 20 bp, Artificial
  CRISPR gRNA sequence
atattttactagatactata

SEQ ID NO: 639591 - DNA, 20 bp, Artificial
  CRISPR gRNA sequence
tattttactagatactatac

SEQ ID NO: 639592 - DNA, 20 bp, Artificial
  CRISPR gRNA sequence
tactagatactatacaaaca

SEQ ID NO: 639593 - DNA, 20 bp, Artificial
  CRISPR gRNA sequence
actagatactatacaaacaa

SEQ ID NO: 639594 - DNA, 20 bp, Artificial
  CRISPR gRNA sequence
ctagatactatacaaacaaa

SEQ ID NO: 639595 - DNA, 20 bp, Artificial
  CRISPR gRNA sequence
gatactatacaaacaaatat

SEQ ID NO: 639596 - DNA, 20 bp, Artificial
  CRISPR gRNA sequence
tacaaacaaatatttattag

SEQ ID NO: 639597 - DNA, 20 bp, Artificial
  CRISPR gRNA sequence
attagtaactgatatctgaa

SEQ ID NO: 639598 - DNA, 20 bp, Artificial
  CRISPR gRNA sequence
ttagtaactgatatctgaat

SEQ ID NO: 639599 - DNA, 20 bp, Artificial
  CRISPR gRNA sequence
gtaactgatatctgaatatt

SEQ ID NO: 639600 - DNA, 20 bp, Artificial
  CRISPR gRNA sequence
atatctgaatattacggaat

SEQ ID NO: 639601 - DNA, 20 bp, Artificial
  CRISPR gRNA sequence
aatattacggaataaaaata

SEQ ID NO: 639602 - DNA, 20 bp, Artificial
  CRISPR gRNA sequence
cggaataaaaatatacaaca

SEQ ID NO: 639603 - DNA, 20 bp, Artificial
  CRISPR gRNA sequence
aaaaacacaagctcatttac

SEQ ID NO: 639604 - DNA, 20 bp, Artificial
  CRISPR gRNA sequence
aaaacacaagctcatttact

SEQ ID NO: 639605 - DNA, 20 bp, Artificial
  CRISPR gRNA sequence
atttactaagtaataggcaa

SEQ ID NO: 639606 - DNA, 20 bp, Artificial
  CRISPR gRNA sequence
actaagtaataggcaaacaa

SEQ ID NO: 639607 - DNA, 20 bp, Artificial
  CRISPR gRNA sequence
ctaagtaataggcaaacaag

SEQ ID NO: 639608 - DNA, 20 bp, Artificial
  CRISPR gRNA sequence
agtaataggcaaacaagtga

SEQ ID NO: 639609 - DNA, 20 bp, Artificial
  CRISPR gRNA sequence
cagagaaaaggaattgaatg

SEQ ID NO: 639610 - DNA, 20 bp, Artificial
  CRISPR gRNA sequence
aatgtaacgagtgagtttaa

SEQ ID NO: 639611 - DNA, 20 bp, Artificial
  CRISPR gRNA sequence
aagaactgggcttttacgcc

SEQ ID NO: 639612 - DNA, 20 bp, Artificial
  CRISPR gRNA sequence
agaactgggcttttacgccc

SEQ ID NO: 639613 - DNA, 20 bp, Artificial
  CRISPR gRNA sequence
ggcttttacgcccggtttca

SEQ ID NO: 639614 - DNA, 20 bp, Artificial
  CRISPR gRNA sequence
ttacgcccggtttcaaggtg

SEQ ID NO: 639615 - DNA, 20 bp, Artificial
  CRISPR gRNA sequence
tacgcccggtttcaaggtga

SEQ ID NO: 639616 - DNA, 20 bp, Artificial
  CRISPR gRNA sequence
acgcccggtttcaaggtgat

SEQ ID NO: 639617 - DNA, 20 bp, Artificial
  CRISPR gRNA sequence
cgcccggtttcaaggtgata

SEQ ID NO: 639618 - DNA, 20 bp, Artificial
  CRISPR gRNA sequence
caaggtgataaaatgtgagt

SEQ ID NO: 639619 - DNA, 20 bp, Artificial
  CRISPR gRNA sequence
aaggtgataaaatgtgagtg

SEQ ID NO: 639620 - DNA, 20 bp, Artificial
  CRISPR gRNA sequence
attccttcactcaacaaata

SEQ ID NO: 639621 - DNA, 20 bp, Artificial
  CRISPR gRNA sequence
cttcactcaacaaatattta

SEQ ID NO: 639622 - DNA, 20 bp, Artificial
  CRISPR gRNA sequence
cactcaacaaatatttatgg

SEQ ID NO: 639623 - DNA, 20 bp, Artificial
  CRISPR gRNA sequence
actcaacaaatatttatggg

SEQ ID NO: 639624 - DNA, 20 bp, Artificial
  CRISPR gRNA sequence
aacaaatatttatggggtaa

SEQ ID NO: 639625 - DNA, 20 bp, Artificial
  CRISPR gRNA sequence
atggggtaagacttttgtac

SEQ ID NO: 639626 - DNA, 20 bp, Artificial
  CRISPR gRNA sequence
tggggtaagacttttgtacc

SEQ ID NO: 639627 - DNA, 20 bp, Artificial
  CRISPR gRNA sequence
ttgtaccggacacactgcta

SEQ ID NO: 639628 - DNA, 20 bp, Artificial
  CRISPR gRNA sequence
tgtaccggacacactgctaa

SEQ ID NO: 639629 - DNA, 20 bp, Artificial
  CRISPR gRNA sequence
gtaccggacacactgctaag

SEQ ID NO: 639630 - DNA, 20 bp, Artificial
  CRISPR gRNA sequence
taccggacacactgctaagc

SEQ ID NO: 639631 - DNA, 20 bp, Artificial
  CRISPR gRNA sequence
ctaagcactaaagatacagt

SEQ ID NO: 639632 - DNA, 20 bp, Artificial
  CRISPR gRNA sequence
agcactaaagatacagtaac

SEQ ID NO: 639633 - DNA, 20 bp, Artificial
  CRISPR gRNA sequence
aagatacagtaacaatcaag

SEQ ID NO: 639634 - DNA, 20 bp, Artificial
  CRISPR gRNA sequence
acttcatattctgtttatat

SEQ ID NO: 639635 - DNA, 20 bp, Artificial
  CRISPR gRNA sequence
catattctgtttatattagg

SEQ ID NO: 639636 - DNA, 20 bp, Artificial
  CRISPR gRNA sequence
atattctgtttatattaggt

SEQ ID NO: 639637 - DNA, 20 bp, Artificial
  CRISPR gRNA sequence
tgtttatattaggtggagac

SEQ ID NO: 639638 - DNA, 20 bp, Artificial
  CRISPR gRNA sequence
tttatattaggtggagacaa

SEQ ID NO: 639639 - DNA, 20 bp, Artificial
  CRISPR gRNA sequence
atattaggtggagacaagaa

SEQ ID NO: 639640 - DNA, 20 bp, Artificial
  CRISPR gRNA sequence
tattaggtggagacaagaag

SEQ ID NO: 639641 - DNA, 20 bp, Artificial
  CRISPR gRNA sequence
ggtggagacaagaagagatc

SEQ ID NO: 639642 - DNA, 20 bp, Artificial
  CRISPR gRNA sequence
caagtgtctgtctgtgtgga

SEQ ID NO: 639643 - DNA, 20 bp, Artificial
  CRISPR gRNA sequence
tctgtgtggaaggagaagta

SEQ ID NO: 639644 - DNA, 20 bp, Artificial
  CRISPR gRNA sequence
tgtggaaggagaagtataaa

SEQ ID NO: 639645 - DNA, 20 bp, Artificial
  CRISPR gRNA sequence
ggaagaagaaaggctcacag

SEQ ID NO: 639646 - DNA, 20 bp, Artificial
  CRISPR gRNA sequence
acagcaattcacttaaattc

SEQ ID NO: 639647 - DNA, 20 bp, Artificial
  CRISPR gRNA sequence
acttaaattcctgaactaag

SEQ ID NO: 639648 - DNA, 20 bp, Artificial
  CRISPR gRNA sequence
aaattcctgaactaaggact

SEQ ID NO: 639649 - DNA, 20 bp, Artificial
  CRISPR gRNA sequence
aattcctgaactaaggactt

SEQ ID NO: 639650 - DNA, 20 bp, Artificial
  CRISPR gRNA sequence
ctgaactaaggacttgtagc

SEQ ID NO: 639651 - DNA, 20 bp, Artificial
  CRISPR gRNA sequence
aactaaggacttgtagccct

SEQ ID NO: 639652 - DNA, 20 bp, Artificial
  CRISPR gRNA sequence
aggacttgtagccctaccat

SEQ ID NO: 639653 - DNA, 20 bp, Artificial
  CRISPR gRNA sequence
gtagccctaccatatatccc

SEQ ID NO: 639654 - DNA, 20 bp, Artificial
  CRISPR gRNA sequence
tagccctaccatatatccct

SEQ ID NO: 639655 - DNA, 20 bp, Artificial
  CRISPR gRNA sequence
ccatatatccctttatcaga

SEQ ID NO: 639656 - DNA, 20 bp, Artificial
  CRISPR gRNA sequence
tatcagaaagcagaatattt

SEQ ID NO: 639657 - DNA, 20 bp, Artificial
  CRISPR gRNA sequence
atcagaaagcagaatattta

SEQ ID NO: 639658 - DNA, 20 bp, Artificial
  CRISPR gRNA sequence
tcagaaagcagaatatttac

SEQ ID NO: 639659 - DNA, 20 bp, Artificial
  CRISPR gRNA sequence
actgttgaagatacatgtca

SEQ ID NO: 639660 - DNA, 20 bp, Artificial
  CRISPR gRNA sequence
ctgttgaagatacatgtcag

SEQ ID NO: 639661 - DNA, 20 bp, Artificial
  CRISPR gRNA sequence
ttgaagatacatgtcagtat

SEQ ID NO: 639662 - DNA, 20 bp, Artificial
  CRISPR gRNA sequence
aagatacatgtcagtatcaa

SEQ ID NO: 639663 - DNA, 20 bp, Artificial
  CRISPR gRNA sequence
tcactaatacttcctagcct

SEQ ID NO: 639664 - DNA, 20 bp, Artificial
  CRISPR gRNA sequence
actaatacttcctagcctgt

SEQ ID NO: 639665 - DNA, 20 bp, Artificial
  CRISPR gRNA sequence
atacttcctagcctgtttcc

SEQ ID NO: 639666 - DNA, 20 bp, Artificial
  CRISPR gRNA sequence
cctagcctgtttccacgaca

SEQ ID NO: 639667 - DNA, 20 bp, Artificial
  CRISPR gRNA sequence
ctagcctgtttccacgacaa

SEQ ID NO: 639668 - DNA, 20 bp, Artificial
  CRISPR gRNA sequence
gcctgtttccacgacaaata

SEQ ID NO: 639669 - DNA, 20 bp, Artificial
  CRISPR gRNA sequence
tttccacgacaaatataaac

SEQ ID NO: 639670 - DNA, 20 bp, Artificial
  CRISPR gRNA sequence
ccacgacaaatataaacaaa

SEQ ID NO: 639671 - DNA, 20 bp, Artificial
  CRISPR gRNA sequence
cacgacaaatataaacaaaa

SEQ ID NO: 639672 - DNA, 20 bp, Artificial
  CRISPR gRNA sequence
tataattgtcttttttcact

SEQ ID NO: 639673 - DNA, 20 bp, Artificial
  CRISPR gRNA sequence
tcttttttcactatgaactt

SEQ ID NO: 639674 - DNA, 20 bp, Artificial
  CRISPR gRNA sequence
ttttcactatgaacttagcc

SEQ ID NO: 639675 - DNA, 20 bp, Artificial
  CRISPR gRNA sequence
tttcactatgaacttagccc

SEQ ID NO: 639676 - DNA, 20 bp, Artificial
  CRISPR gRNA sequence
ttcactatgaacttagccct

SEQ ID NO: 639677 - DNA, 20 bp, Artificial
  CRISPR gRNA sequence
tcactatgaacttagcccta

SEQ ID NO: 639678 - DNA, 20 bp, Artificial
  CRISPR gRNA sequence
cactatgaacttagccctac

SEQ ID NO: 639679 - DNA, 20 bp, Artificial
  CRISPR gRNA sequence
actatgaacttagccctaca

SEQ ID NO: 639680 - DNA, 20 bp, Artificial
  CRISPR gRNA sequence
tgaacttagccctacaatgc

SEQ ID NO: 639681 - DNA, 20 bp, Artificial
  CRISPR gRNA sequence
agccctacaatgcaagcaaa

SEQ ID NO: 639682 - DNA, 20 bp, Artificial
  CRISPR gRNA sequence
gccctacaatgcaagcaaaa

SEQ ID NO: 639683 - DNA, 20 bp, Artificial
  CRISPR gRNA sequence
caatgcaagcaaaacctaaa

SEQ ID NO: 639684 - DNA, 20 bp, Artificial
  CRISPR gRNA sequence
aaaatattaaaatgaaacac

SEQ ID NO: 639685 - DNA, 20 bp, Artificial
  CRISPR gRNA sequence
aaatgaaacacacacataca

SEQ ID NO: 639686 - DNA, 20 bp, Artificial
  CRISPR gRNA sequence
ttgaatgaaaacctaaaatg

SEQ ID NO: 639687 - DNA, 20 bp, Artificial
  CRISPR gRNA sequence
tgaatgaaaacctaaaatga

SEQ ID NO: 639688 - DNA, 20 bp, Artificial
  CRISPR gRNA sequence
gaatgaaaacctaaaatgaa

SEQ ID NO: 639689 - DNA, 20 bp, Artificial
  CRISPR gRNA sequence
aatgaaaacctaaaatgaaa

SEQ ID NO: 639690 - DNA, 20 bp, Artificial
  CRISPR gRNA sequence
aaatgaaacctcttcaaccc

SEQ ID NO: 639691 - DNA, 20 bp, Artificial
  CRISPR gRNA sequence
ttcaacccattatattcacc

SEQ ID NO: 639692 - DNA, 20 bp, Artificial
  CRISPR gRNA sequence
caacccattatattcaccat

SEQ ID NO: 639693 - DNA, 20 bp, Artificial
  CRISPR gRNA sequence
aacccattatattcaccatc

SEQ ID NO: 639694 - DNA, 20 bp, Artificial
  CRISPR gRNA sequence
tattcaccatcattagatac

SEQ ID NO: 639695 - DNA, 20 bp, Artificial
  CRISPR gRNA sequence
accatcattagatacaagat

SEQ ID NO: 639696 - DNA, 20 bp, Artificial
  CRISPR gRNA sequence
gatacaagatcgctatgaca

SEQ ID NO: 639697 - DNA, 20 bp, Artificial
  CRISPR gRNA sequence
tgacaagtaatagaacattg

SEQ ID NO: 639698 - DNA, 20 bp, Artificial
  CRISPR gRNA sequence
gtcaaaaataatagcttggt

SEQ ID NO: 639699 - DNA, 20 bp, Artificial
  CRISPR gRNA sequence
ggttaaaatttcttcatgct

SEQ ID NO: 639700 - DNA, 20 bp, Artificial
  CRISPR gRNA sequence
gttaaaatttcttcatgctg

SEQ ID NO: 639701 - DNA, 20 bp, Artificial
  CRISPR gRNA sequence
aaatttcttcatgctgataa

SEQ ID NO: 639702 - DNA, 20 bp, Artificial
  CRISPR gRNA sequence
cttcatgctgataatagttg

SEQ ID NO: 639703 - DNA, 20 bp, Artificial
  CRISPR gRNA sequence
ttcatgctgataatagttgc

SEQ ID NO: 639704 - DNA, 20 bp, Artificial
  CRISPR gRNA sequence
catgctgataatagttgcaa

SEQ ID NO: 639705 - DNA, 20 bp, Artificial
  CRISPR gRNA sequence
atgctgataatagttgcaag

SEQ ID NO: 639706 - DNA, 20 bp, Artificial
  CRISPR gRNA sequence
ataatagttgcaagctttca

SEQ ID NO: 639707 - DNA, 20 bp, Artificial
  CRISPR gRNA sequence
caagctttcactatgttgcc

SEQ ID NO: 639708 - DNA, 20 bp, Artificial
  CRISPR gRNA sequence
tcactatgttgccatattat

SEQ ID NO: 639709 - DNA, 20 bp, Artificial
  CRISPR gRNA sequence
cactatgttgccatattatc

SEQ ID NO: 639710 - DNA, 20 bp, Artificial
  CRISPR gRNA sequence
actatgttgccatattatca

SEQ ID NO: 639711 - DNA, 20 bp, Artificial
  CRISPR gRNA sequence
tgttgccatattatcagtct

SEQ ID NO: 639712 - DNA, 20 bp, Artificial
  CRISPR gRNA sequence
ccatattatcagtcttaatg

SEQ ID NO: 639713 - DNA, 20 bp, Artificial
  CRISPR gRNA sequence
tcagtcttaatgaaattcac

SEQ ID NO: 639714 - DNA, 20 bp, Artificial
  CRISPR gRNA sequence
aatgaaattcacttgtcagt

SEQ ID NO: 639715 - DNA, 20 bp, Artificial
  CRISPR gRNA sequence
atgaaattcacttgtcagtt

SEQ ID NO: 639716 - DNA, 20 bp, Artificial
  CRISPR gRNA sequence
acttgtcagttctgttttga

SEQ ID NO: 639717 - DNA, 20 bp, Artificial
  CRISPR gRNA sequence
gtcagttctgttttgaaaca

SEQ ID NO: 639718 - DNA, 20 bp, Artificial
  CRISPR gRNA sequence
tcagttctgttttgaaacag

SEQ ID NO: 639719 - DNA, 20 bp, Artificial
  CRISPR gRNA sequence
tgttttgaaacagtgaattc

SEQ ID NO: 639720 - DNA, 20 bp, Artificial
  CRISPR gRNA sequence
ttttgaaacagtgaattctc

SEQ ID NO: 639721 - DNA, 20 bp, Artificial
  CRISPR gRNA sequence
tgaaacagtgaattctcgcc

SEQ ID NO: 639722 - DNA, 20 bp, Artificial
  CRISPR gRNA sequence
gaaacagtgaattctcgccc

SEQ ID NO: 639723 - DNA, 20 bp, Artificial
  CRISPR gRNA sequence
aaacagtgaattctcgccca

SEQ ID NO: 639724 - DNA, 20 bp, Artificial
  CRISPR gRNA sequence
tcgcccagcatgacaggggt

SEQ ID NO: 639725 - DNA, 20 bp, Artificial
  CRISPR gRNA sequence
gcccagcatgacaggggtaa

SEQ ID NO: 639726 - DNA, 20 bp, Artificial
  CRISPR gRNA sequence
aaatctcttttctcttccca

SEQ ID NO: 639727 - DNA, 20 bp, Artificial
  CRISPR gRNA sequence
ttttctcttcccaatcaaat

SEQ ID NO: 639728 - DNA, 20 bp, Artificial
  CRISPR gRNA sequence
ttctcttcccaatcaaatca

SEQ ID NO: 639729 - DNA, 20 bp, Artificial
  CRISPR gRNA sequence
tctcttcccaatcaaatcag

SEQ ID NO: 639730 - DNA, 20 bp, Artificial
  CRISPR gRNA sequence
ctcttcccaatcaaatcagc

SEQ ID NO: 639731 - DNA, 20 bp, Artificial
  CRISPR gRNA sequence
tcttcccaatcaaatcagct

SEQ ID NO: 639732 - DNA, 20 bp, Artificial
  CRISPR gRNA sequence
ttcccaatcaaatcagctaa

SEQ ID NO: 639733 - DNA, 20 bp, Artificial
  CRISPR gRNA sequence
cccaatcaaatcagctaacg

SEQ ID NO: 639734 - DNA, 20 bp, Artificial
  CRISPR gRNA sequence
ccaatcaaatcagctaacga

SEQ ID NO: 639735 - DNA, 20 bp, Artificial
  CRISPR gRNA sequence
acgatgaaatataagaaagg

SEQ ID NO: 639736 - DNA, 20 bp, Artificial
  CRISPR gRNA sequence
ggaaatttctgtcactaatt

SEQ ID NO: 639737 - DNA, 20 bp, Artificial
  CRISPR gRNA sequence
ctgtcactaattggtcaaaa

SEQ ID NO: 639738 - DNA, 20 bp, Artificial
  CRISPR gRNA sequence
tgtcactaattggtcaaaaa

SEQ ID NO: 639739 - DNA, 20 bp, Artificial
  CRISPR gRNA sequence
tcactaattggtcaaaaaaa

SEQ ID NO: 639740 - DNA, 20 bp, Artificial
  CRISPR gRNA sequence
attggtcaaaaaaaagatta

SEQ ID NO: 639741 - DNA, 20 bp, Artificial
  CRISPR gRNA sequence
gtcaaaaaaaagattagttt

SEQ ID NO: 639742 - DNA, 20 bp, Artificial
  CRISPR gRNA sequence
gttttcagattcctttcctt

SEQ ID NO: 639743 - DNA, 20 bp, Artificial
  CRISPR gRNA sequence
tcagattcctttcctttgtt

SEQ ID NO: 639744 - DNA, 20 bp, Artificial
  CRISPR gRNA sequence
cagattcctttcctttgttt

SEQ ID NO: 639745 - DNA, 20 bp, Artificial
  CRISPR gRNA sequence
agattcctttcctttgtttt

SEQ ID NO: 639746 - DNA, 20 bp, Artificial
  CRISPR gRNA sequence
ctttcctttgtttttttttt

SEQ ID NO: 639747 - DNA, 20 bp, Artificial
  CRISPR gRNA sequence
tcctttgttttttttttttt

SEQ ID NO: 639748 - DNA, 20 bp, Artificial
  CRISPR gRNA sequence
cctttgtttttttttttttc

SEQ ID NO: 639749 - DNA, 20 bp, Artificial
  CRISPR gRNA sequence
ctttgtttttttttttttct

SEQ ID NO: 639750 - DNA, 20 bp, Artificial
  CRISPR gRNA sequence
tgtttttttttttttctgtt

SEQ ID NO: 639751 - DNA, 20 bp, Artificial
  CRISPR gRNA sequence
gtttttttttttttctgttt

SEQ ID NO: 639752 - DNA, 20 bp, Artificial
  CRISPR gRNA sequence
tttttttttttttctgtttc

SEQ ID NO: 639753 - DNA, 20 bp, Artificial
  CRISPR gRNA sequence
ttttttttttctgtttcgac

SEQ ID NO: 639754 - DNA, 20 bp, Artificial
  CRISPR gRNA sequence
tttttttttctgtttcgact

SEQ ID NO: 639755 - DNA, 20 bp, Artificial
  CRISPR gRNA sequence
ttttttttctgtttcgactg

SEQ ID NO: 639756 - DNA, 20 bp, Artificial
  CRISPR gRNA sequence
tttttttctgtttcgactga

SEQ ID NO: 639757 - DNA, 20 bp, Artificial
  CRISPR gRNA sequence
ttttttctgtttcgactgat

SEQ ID NO: 639758 - DNA, 20 bp, Artificial
  CRISPR gRNA sequence
tttttctgtttcgactgatg

SEQ ID NO: 639759 - DNA, 20 bp, Artificial
  CRISPR gRNA sequence
ttttctgtttcgactgatga

SEQ ID NO: 639760 - DNA, 20 bp, Artificial
  CRISPR gRNA sequence
tttctgtttcgactgatgat

SEQ ID NO: 639761 - DNA, 20 bp, Artificial
  CRISPR gRNA sequence
ttctgtttcgactgatgatc

SEQ ID NO: 639762 - DNA, 20 bp, Artificial
  CRISPR gRNA sequence
tctgtttcgactgatgatct

SEQ ID NO: 639763 - DNA, 20 bp, Artificial
  CRISPR gRNA sequence
ctgtttcgactgatgatctc

SEQ ID NO: 639764 - DNA, 20 bp, Artificial
  CRISPR gRNA sequence
tgtttcgactgatgatctcc

SEQ ID NO: 639765 - DNA, 20 bp, Artificial
  CRISPR gRNA sequence
tttcgactgatgatctccct

SEQ ID NO: 639766 - DNA, 20 bp, Artificial
  CRISPR gRNA sequence
cgactgatgatctccctaaa

SEQ ID NO: 639767 - DNA, 20 bp, Artificial
  CRISPR gRNA sequence
gactgatgatctccctaaat

SEQ ID NO: 639768 - DNA, 20 bp, Artificial
  CRISPR gRNA sequence
atgatctccctaaatgttac

SEQ ID NO: 639769 - DNA, 20 bp, Artificial
  CRISPR gRNA sequence
cctaaatgttactagtcagc

SEQ ID NO: 639770 - DNA, 20 bp, Artificial
  CRISPR gRNA sequence
aatgttactagtcagctaat

SEQ ID NO: 639771 - DNA, 20 bp, Artificial
  CRISPR gRNA sequence
ctagtcagctaattcttttc

SEQ ID NO: 639772 - DNA, 20 bp, Artificial
  CRISPR gRNA sequence
gtcagctaattcttttcttt

SEQ ID NO: 639773 - DNA, 20 bp, Artificial
  CRISPR gRNA sequence
attcttttctttaaaaactc

SEQ ID NO: 639774 - DNA, 20 bp, Artificial
  CRISPR gRNA sequence
ttttctttaaaaactcattt

SEQ ID NO: 639775 - DNA, 20 bp, Artificial
  CRISPR gRNA sequence
ttctttaaaaactcattttg

SEQ ID NO: 639776 - DNA, 20 bp, Artificial
  CRISPR gRNA sequence
tctttaaaaactcattttgt

SEQ ID NO: 639777 - DNA, 20 bp, Artificial
  CRISPR gRNA sequence
ctttaaaaactcattttgtc

SEQ ID NO: 639778 - DNA, 20 bp, Artificial
  CRISPR gRNA sequence
tttaaaaactcattttgtcg

SEQ ID NO: 639779 - DNA, 20 bp, Artificial
  CRISPR gRNA sequence
taaaaactcattttgtcgcc

SEQ ID NO: 639780 - DNA, 20 bp, Artificial
  CRISPR gRNA sequence
aaaaactcattttgtcgcca

SEQ ID NO: 639781 - DNA, 20 bp, Artificial
  CRISPR gRNA sequence
aaaactcattttgtcgccag

SEQ ID NO: 639782 - DNA, 20 bp, Artificial
  CRISPR gRNA sequence
attttgtcgccagcaaatat

SEQ ID NO: 639783 - DNA, 20 bp, Artificial
  CRISPR gRNA sequence
tgtcgccagcaaatatattg

SEQ ID NO: 639784 - DNA, 20 bp, Artificial
  CRISPR gRNA sequence
gtcgccagcaaatatattga

SEQ ID NO: 639785 - DNA, 20 bp, Artificial
  CRISPR gRNA sequence
tcgccagcaaatatattgag

SEQ ID NO: 639786 - DNA, 20 bp, Artificial
  CRISPR gRNA sequence
agtaaaacttgctgaaaata

SEQ ID NO: 639787 - DNA, 20 bp, Artificial
  CRISPR gRNA sequence
gctgaaaatacacagtgtta

SEQ ID NO: 639788 - DNA, 20 bp, Artificial
  CRISPR gRNA sequence
ctgaaaatacacagtgttat

SEQ ID NO: 639789 - DNA, 20 bp, Artificial
  CRISPR gRNA sequence
aaaatacacagtgttataca

SEQ ID NO: 639790 - DNA, 20 bp, Artificial
  CRISPR gRNA sequence
tacaatagtaaggaataatg

SEQ ID NO: 639791 - DNA, 20 bp, Artificial
  CRISPR gRNA sequence
caatctgcagattttattat

SEQ ID NO: 639792 - DNA, 20 bp, Artificial
  CRISPR gRNA sequence
cagattttattatcattatc

SEQ ID NO: 639793 - DNA, 20 bp, Artificial
  CRISPR gRNA sequence
tattatcattatcgctcact

SEQ ID NO: 639794 - DNA, 20 bp, Artificial
  CRISPR gRNA sequence
attatcattatcgctcactg

SEQ ID NO: 639795 - DNA, 20 bp, Artificial
  CRISPR gRNA sequence
ttatcattatcgctcactgg

SEQ ID NO: 639796 - DNA, 20 bp, Artificial
  CRISPR gRNA sequence
tcattatcgctcactgggta

SEQ ID NO: 639797 - DNA, 20 bp, Artificial
  CRISPR gRNA sequence
tcgctcactgggtattgaac

SEQ ID NO: 639798 - DNA, 20 bp, Artificial
  CRISPR gRNA sequence
actgggtattgaacttatcc

SEQ ID NO: 639799 - DNA, 20 bp, Artificial
  CRISPR gRNA sequence
ggtattgaacttatccctgt

SEQ ID NO: 639800 - DNA, 20 bp, Artificial
  CRISPR gRNA sequence
aacttatccctgtagtggaa

SEQ ID NO: 639801 - DNA, 20 bp, Artificial
  CRISPR gRNA sequence
atccctgtagtggaataatg

SEQ ID NO: 639802 - DNA, 20 bp, Artificial
  CRISPR gRNA sequence
tccctgtagtggaataatgt

SEQ ID NO: 639803 - DNA, 20 bp, Artificial
  CRISPR gRNA sequence
tagtggaataatgtcaccaa

SEQ ID NO: 639804 - DNA, 20 bp, Artificial
  CRISPR gRNA sequence
attcaaagatagacaaggca

SEQ ID NO: 639805 - DNA, 20 bp, Artificial
  CRISPR gRNA sequence
aaagatagacaaggcaaaga

SEQ ID NO: 639806 - DNA, 20 bp, Artificial
  CRISPR gRNA sequence
tctacatactgactttagtt

SEQ ID NO: 639807 - DNA, 20 bp, Artificial
  CRISPR gRNA sequence
ctacatactgactttagtta

SEQ ID NO: 639808 - DNA, 20 bp, Artificial
  CRISPR gRNA sequence
tacatactgactttagttac

SEQ ID NO: 639809 - DNA, 20 bp, Artificial
  CRISPR gRNA sequence
catactgactttagttacaa

SEQ ID NO: 639810 - DNA, 20 bp, Artificial
  CRISPR gRNA sequence
actttagttacaaactttta

SEQ ID NO: 639811 - DNA, 20 bp, Artificial
  CRISPR gRNA sequence
tagttacaaacttttataag

SEQ ID NO: 639812 - DNA, 20 bp, Artificial
  CRISPR gRNA sequence
agttacaaacttttataagc

SEQ ID NO: 639813 - DNA, 20 bp, Artificial
  CRISPR gRNA sequence
gttacaaacttttataagcc

SEQ ID NO: 639814 - DNA, 20 bp, Artificial
  CRISPR gRNA sequence
caaacttttataagccttag

SEQ ID NO: 639815 - DNA, 20 bp, Artificial
  CRISPR gRNA sequence
ttataagccttagtgaattt

SEQ ID NO: 639816 - DNA, 20 bp, Artificial
  CRISPR gRNA sequence
tataagccttagtgaatttc

SEQ ID NO: 639817 - DNA, 20 bp, Artificial
  CRISPR gRNA sequence
ataagccttagtgaatttca

SEQ ID NO: 639818 - DNA, 20 bp, Artificial
  CRISPR gRNA sequence
taagccttagtgaatttcag

SEQ ID NO: 639819 - DNA, 20 bp, Artificial
  CRISPR gRNA sequence
agtgaatttcagcactcttg

SEQ ID NO: 639820 - DNA, 20 bp, Artificial
  CRISPR gRNA sequence
gtgaatttcagcactcttga

SEQ ID NO: 639821 - DNA, 20 bp, Artificial
  CRISPR gRNA sequence
cagcactcttgaaagttaag

SEQ ID NO: 639822 - DNA, 20 bp, Artificial
  CRISPR gRNA sequence
agcactcttgaaagttaagt

SEQ ID NO: 639823 - DNA, 20 bp, Artificial
  CRISPR gRNA sequence
ttgaaagttaagtctgttaa

SEQ ID NO: 639824 - DNA, 20 bp, Artificial
  CRISPR gRNA sequence
gaaagttaagtctgttaaga

SEQ ID NO: 639825 - DNA, 20 bp, Artificial
  CRISPR gRNA sequence
aaagttaagtctgttaagag

SEQ ID NO: 639826 - DNA, 20 bp, Artificial
  CRISPR gRNA sequence
agtctgttaagagaaaggac

SEQ ID NO: 639827 - DNA, 20 bp, Artificial
  CRISPR gRNA sequence
ttaagagaaaggaccatatt

SEQ ID NO: 639828 - DNA, 20 bp, Artificial
  CRISPR gRNA sequence
agagaaaggaccatatttat

SEQ ID NO: 639829 - DNA, 20 bp, Artificial
  CRISPR gRNA sequence
atttgtttccccatttatag

SEQ ID NO: 639830 - DNA, 20 bp, Artificial
  CRISPR gRNA sequence
tttgtttccccatttatagg

SEQ ID NO: 639831 - DNA, 20 bp, Artificial
  CRISPR gRNA sequence
gtttccccatttatagggca

SEQ ID NO: 639832 - DNA, 20 bp, Artificial
  CRISPR gRNA sequence
tttccccatttatagggcac

SEQ ID NO: 639833 - DNA, 20 bp, Artificial
  CRISPR gRNA sequence
ccccatttatagggcacctt

SEQ ID NO: 639834 - DNA, 20 bp, Artificial
  CRISPR gRNA sequence
cccatttatagggcacctta

SEQ ID NO: 639835 - DNA, 20 bp, Artificial
  CRISPR gRNA sequence
atagggcaccttatcaagcc

SEQ ID NO: 639836 - DNA, 20 bp, Artificial
  CRISPR gRNA sequence
tagggcaccttatcaagcct

SEQ ID NO: 639837 - DNA, 20 bp, Artificial
  CRISPR gRNA sequence
atcaagccttgcatattagg

SEQ ID NO: 639838 - DNA, 20 bp, Artificial
  CRISPR gRNA sequence
tcaagccttgcatattaggt

SEQ ID NO: 639839 - DNA, 20 bp, Artificial
  CRISPR gRNA sequence
gcatattaggtacattaaac

SEQ ID NO: 639840 - DNA, 20 bp, Artificial
  CRISPR gRNA sequence
catattaggtacattaaact

SEQ ID NO: 639841 - DNA, 20 bp, Artificial
  CRISPR gRNA sequence
ggtacattaaactttatatt

SEQ ID NO: 639842 - DNA, 20 bp, Artificial
  CRISPR gRNA sequence
aactttatatttttctagtg

SEQ ID NO: 639843 - DNA, 20 bp, Artificial
  CRISPR gRNA sequence
tatatttttctagtgttttt

SEQ ID NO: 639844 - DNA, 20 bp, Artificial
  CRISPR gRNA sequence
atatttttctagtgttttta

SEQ ID NO: 639845 - DNA, 20 bp, Artificial
  CRISPR gRNA sequence
tatttttctagtgtttttat

SEQ ID NO: 639846 - DNA, 20 bp, Artificial
  CRISPR gRNA sequence
ttctagtgtttttattttaa

SEQ ID NO: 639847 - DNA, 20 bp, Artificial
  CRISPR gRNA sequence
tctagtgtttttattttaag

SEQ ID NO: 639848 - DNA, 20 bp, Artificial
  CRISPR gRNA sequence
ctagtgtttttattttaagc

SEQ ID NO: 639849 - DNA, 20 bp, Artificial
  CRISPR gRNA sequence
tagtgtttttattttaagct

SEQ ID NO: 639850 - DNA, 20 bp, Artificial
  CRISPR gRNA sequence
gtgtttttattttaagcttt

SEQ ID NO: 639851 - DNA, 20 bp, Artificial
  CRISPR gRNA sequence
ttattttaagcttttgctga

SEQ ID NO: 639852 - DNA, 20 bp, Artificial
  CRISPR gRNA sequence
tattttaagcttttgctgaa

SEQ ID NO: 639853 - DNA, 20 bp, Artificial
  CRISPR gRNA sequence
attttaagcttttgctgaaa

SEQ ID NO: 639854 - DNA, 20 bp, Artificial
  CRISPR gRNA sequence
ttttaagcttttgctgaaaa

SEQ ID NO: 639855 - DNA, 20 bp, Artificial
  CRISPR gRNA sequence
taagcttttgctgaaaactg

SEQ ID NO: 639856 - DNA, 20 bp, Artificial
  CRISPR gRNA sequence
aagcttttgctgaaaactgt

SEQ ID NO: 639857 - DNA, 20 bp, Artificial
  CRISPR gRNA sequence
agcttttgctgaaaactgtt

SEQ ID NO: 639858 - DNA, 20 bp, Artificial
  CRISPR gRNA sequence
ttgctgaaaactgttaaaca

SEQ ID NO: 639859 - DNA, 20 bp, Artificial
  CRISPR gRNA sequence
tgctgaaaactgttaaacac

SEQ ID NO: 639860 - DNA, 20 bp, Artificial
  CRISPR gRNA sequence
gctgaaaactgttaaacaca

SEQ ID NO: 639861 - DNA, 20 bp, Artificial
  CRISPR gRNA sequence
ctgaaaactgttaaacacag

SEQ ID NO: 639862 - DNA, 20 bp, Artificial
  CRISPR gRNA sequence
aaaactgttaaacacagcaa

SEQ ID NO: 639863 - DNA, 20 bp, Artificial
  CRISPR gRNA sequence
ttaaacacagcaactcaata

SEQ ID NO: 639864 - DNA, 20 bp, Artificial
  CRISPR gRNA sequence
aacacagcaactcaataaaa

SEQ ID NO: 639865 - DNA, 20 bp, Artificial
  CRISPR gRNA sequence
aataaaaattaagtatggcc

SEQ ID NO: 639866 - DNA, 20 bp, Artificial
  CRISPR gRNA sequence
agtatggcctagaagaagaa

SEQ ID NO: 639867 - DNA, 20 bp, Artificial
  CRISPR gRNA sequence
gaagaagaaataaaaattca

SEQ ID NO: 639868 - DNA, 20 bp, Artificial
  CRISPR gRNA sequence
aacgaaaatgacacatgaac

SEQ ID NO: 639869 - DNA, 20 bp, Artificial
  CRISPR gRNA sequence
aggcactggaacccattcag

SEQ ID NO: 639870 - DNA, 20 bp, Artificial
  CRISPR gRNA sequence
gaacccattcagttagagac

SEQ ID NO: 639871 - DNA, 20 bp, Artificial
  CRISPR gRNA sequence
agttagagactgaatttatg

SEQ ID NO: 639872 - DNA, 20 bp, Artificial
  CRISPR gRNA sequence
gagactgaatttatgctgtt

SEQ ID NO: 639873 - DNA, 20 bp, Artificial
  CRISPR gRNA sequence
aatttatgctgttttataaa

SEQ ID NO: 639874 - DNA, 20 bp, Artificial
  CRISPR gRNA sequence
atgctgttttataaatttta

SEQ ID NO: 639875 - DNA, 20 bp, Artificial
  CRISPR gRNA sequence
tgctgttttataaattttat

SEQ ID NO: 639876 - DNA, 20 bp, Artificial
  CRISPR gRNA sequence
ttttataaattttattctgc

SEQ ID NO: 639877 - DNA, 20 bp, Artificial
  CRISPR gRNA sequence
tataaattttattctgctta

SEQ ID NO: 639878 - DNA, 20 bp, Artificial
  CRISPR gRNA sequence
ataaattttattctgcttaa

SEQ ID NO: 639879 - DNA, 20 bp, Artificial
  CRISPR gRNA sequence
taaattttattctgcttaag

SEQ ID NO: 639880 - DNA, 20 bp, Artificial
  CRISPR gRNA sequence
tattctgcttaagcttcttc

SEQ ID NO: 639881 - DNA, 20 bp, Artificial
  CRISPR gRNA sequence
attctgcttaagcttcttca

SEQ ID NO: 639882 - DNA, 20 bp, Artificial
  CRISPR gRNA sequence
ttctgcttaagcttcttcaa

SEQ ID NO: 639883 - DNA, 20 bp, Artificial
  CRISPR gRNA sequence
tgcttaagcttcttcaatac

SEQ ID NO: 639884 - DNA, 20 bp, Artificial
  CRISPR gRNA sequence
cttaagcttcttcaatactc

SEQ ID NO: 639885 - DNA, 20 bp, Artificial
  CRISPR gRNA sequence
aagcttcttcaatactctca

SEQ ID NO: 639886 - DNA, 20 bp, Artificial
  CRISPR gRNA sequence
agcttcttcaatactctcaa

SEQ ID NO: 639887 - DNA, 20 bp, Artificial
  CRISPR gRNA sequence
cttcaatactctcaaatgat

SEQ ID NO: 639888 - DNA, 20 bp, Artificial
  CRISPR gRNA sequence
ttcaatactctcaaatgatg

SEQ ID NO: 639889 - DNA, 20 bp, Artificial
  CRISPR gRNA sequence
caatactctcaaatgatggt

SEQ ID NO: 639890 - DNA, 20 bp, Artificial
  CRISPR gRNA sequence
aatactctcaaatgatggtc

SEQ ID NO: 639891 - DNA, 20 bp, Artificial
  CRISPR gRNA sequence
tcaaatgatggtcaatcaat

SEQ ID NO: 639892 - DNA, 20 bp, Artificial
  CRISPR gRNA sequence
aaatgatggtcaatcaatgt

SEQ ID NO: 639893 - DNA, 20 bp, Artificial
  CRISPR gRNA sequence
ccctttttcattcatttaat

SEQ ID NO: 639894 - DNA, 20 bp, Artificial
  CRISPR gRNA sequence
cctttttcattcatttaata

SEQ ID NO: 639895 - DNA, 20 bp, Artificial
  CRISPR gRNA sequence
tttcattcatttaataatgc

SEQ ID NO: 639896 - DNA, 20 bp, Artificial
  CRISPR gRNA sequence
ttcattcatttaataatgca

SEQ ID NO: 639897 - DNA, 20 bp, Artificial
  CRISPR gRNA sequence
tcattcatttaataatgcat

SEQ ID NO: 639898 - DNA, 20 bp, Artificial
  CRISPR gRNA sequence
cattcatttaataatgcata

SEQ ID NO: 639899 - DNA, 20 bp, Artificial
  CRISPR gRNA sequence
attcatttaataatgcataa

SEQ ID NO: 639900 - DNA, 20 bp, Artificial
  CRISPR gRNA sequence
atttaataatgcataaattc

SEQ ID NO: 639901 - DNA, 20 bp, Artificial
  CRISPR gRNA sequence
aataatgcataaattcagta

SEQ ID NO: 639902 - DNA, 20 bp, Artificial
  CRISPR gRNA sequence
ataatgcataaattcagtaa

SEQ ID NO: 639903 - DNA, 20 bp, Artificial
  CRISPR gRNA sequence
agtaaatattcagacagaat

SEQ ID NO: 639904 - DNA, 20 bp, Artificial
  CRISPR gRNA sequence
agacagaatacttatccagt

SEQ ID NO: 639905 - DNA, 20 bp, Artificial
  CRISPR gRNA sequence
atccagtataagtacagtat

SEQ ID NO: 639906 - DNA, 20 bp, Artificial
  CRISPR gRNA sequence
tccagtataagtacagtatt

SEQ ID NO: 639907 - DNA, 20 bp, Artificial
  CRISPR gRNA sequence
tctcggatgcaagaaagcag

SEQ ID NO: 639908 - DNA, 20 bp, Artificial
  CRISPR gRNA sequence
ggatgcaagaaagcagaagg

SEQ ID NO: 639909 - DNA, 20 bp, Artificial
  CRISPR gRNA sequence
acaggaatagatgtaaatat

SEQ ID NO: 639910 - DNA, 20 bp, Artificial
  CRISPR gRNA sequence
caggaatagatgtaaatatt

SEQ ID NO: 639911 - DNA, 20 bp, Artificial
  CRISPR gRNA sequence
tacttaaaaaccttaaggtc

SEQ ID NO: 639912 - DNA, 20 bp, Artificial
  CRISPR gRNA sequence
acttaaaaaccttaaggtct

SEQ ID NO: 639913 - DNA, 20 bp, Artificial
  CRISPR gRNA sequence
cttaaaaaccttaaggtcta

SEQ ID NO: 639914 - DNA, 20 bp, Artificial
  CRISPR gRNA sequence
aaaaaccttaaggtctactt

SEQ ID NO: 639915 - DNA, 20 bp, Artificial
  CRISPR gRNA sequence
aaaaccttaaggtctactta

SEQ ID NO: 639916 - DNA, 20 bp, Artificial
  CRISPR gRNA sequence
aaggtctacttaatacgtca

SEQ ID NO: 639917 - DNA, 20 bp, Artificial
  CRISPR gRNA sequence
aggtctacttaatacgtcat

SEQ ID NO: 639918 - DNA, 20 bp, Artificial
  CRISPR gRNA sequence
cttaatacgtcataagtcca

SEQ ID NO: 639919 - DNA, 20 bp, Artificial
  CRISPR gRNA sequence
aatacgtcataagtccatat

SEQ ID NO: 639920 - DNA, 20 bp, Artificial
  CRISPR gRNA sequence
atacgtcataagtccatatt

SEQ ID NO: 639921 - DNA, 20 bp, Artificial
  CRISPR gRNA sequence
tttgtgatttgggggaagtg

SEQ ID NO: 639922 - DNA, 20 bp, Artificial
  CRISPR gRNA sequence
tgtgatttgggggaagtgga

SEQ ID NO: 639923 - DNA, 20 bp, Artificial
  CRISPR gRNA sequence
gtgatttgggggaagtggaa

SEQ ID NO: 639924 - DNA, 20 bp, Artificial
  CRISPR gRNA sequence
tgatttgggggaagtggaaa

SEQ ID NO: 639925 - DNA, 20 bp, Artificial
  CRISPR gRNA sequence
gggggaagtggaaaatgaag

SEQ ID NO: 639926 - DNA, 20 bp, Artificial
  CRISPR gRNA sequence
ggggaagtggaaaatgaaga

SEQ ID NO: 639927 - DNA, 20 bp, Artificial
  CRISPR gRNA sequence
ttttccactccttgaaaaac

SEQ ID NO: 639928 - DNA, 20 bp, Artificial
  CRISPR gRNA sequence
tccactccttgaaaaacatc

SEQ ID NO: 639929 - DNA, 20 bp, Artificial
  CRISPR gRNA sequence
ccactccttgaaaaacatca

SEQ ID NO: 639930 - DNA, 20 bp, Artificial
  CRISPR gRNA sequence
cactccttgaaaaacatcac

SEQ ID NO: 639931 - DNA, 20 bp, Artificial
  CRISPR gRNA sequence
cttgaaaaacatcacaaata

SEQ ID NO: 639932 - DNA, 20 bp, Artificial
  CRISPR gRNA sequence
gaaaaacatcacaaataaaa

SEQ ID NO: 639933 - DNA, 20 bp, Artificial
  CRISPR gRNA sequence
aaaaacatcacaaataaaag

SEQ ID NO: 639934 - DNA, 20 bp, Artificial
  CRISPR gRNA sequence
atacgaggagctaatatagt

SEQ ID NO: 639935 - DNA, 20 bp, Artificial
  CRISPR gRNA sequence
atatagttaatctggtacta

SEQ ID NO: 639936 - DNA, 20 bp, Artificial
  CRISPR gRNA sequence
atctggtactagaaactgag

SEQ ID NO: 639937 - DNA, 20 bp, Artificial
  CRISPR gRNA sequence
gtactagaaactgagataca

SEQ ID NO: 639938 - DNA, 20 bp, Artificial
  CRISPR gRNA sequence
gaaactgagatacaataaac

SEQ ID NO: 639939 - DNA, 20 bp, Artificial
  CRISPR gRNA sequence
agatacaataaaccaatcac

SEQ ID NO: 639940 - DNA, 20 bp, Artificial
  CRISPR gRNA sequence
aactagaagtaagattccta

SEQ ID NO: 639941 - DNA, 20 bp, Artificial
  CRISPR gRNA sequence
gaagtaagattcctaggttc

SEQ ID NO: 639942 - DNA, 20 bp, Artificial
  CRISPR gRNA sequence
ctaggttctactgctggtta

SEQ ID NO: 639943 - DNA, 20 bp, Artificial
  CRISPR gRNA sequence
ggttctactgctggttagtg

SEQ ID NO: 639944 - DNA, 20 bp, Artificial
  CRISPR gRNA sequence
tactgctggttagtgatgga

SEQ ID NO: 639945 - DNA, 20 bp, Artificial
  CRISPR gRNA sequence
ctgctggttagtgatggagt

SEQ ID NO: 639946 - DNA, 20 bp, Artificial
  CRISPR gRNA sequence
ctggttagtgatggagttca

SEQ ID NO: 639947 - DNA, 20 bp, Artificial
  CRISPR gRNA sequence
gttagtgatggagttcagtg

SEQ ID NO: 639948 - DNA, 20 bp, Artificial
  CRISPR gRNA sequence
gtgatggagttcagtgagta

SEQ ID NO: 639949 - DNA, 20 bp, Artificial
  CRISPR gRNA sequence
agtgagtaagagtggaggta

SEQ ID NO: 639950 - DNA, 20 bp, Artificial
  CRISPR gRNA sequence
gtgtctcagtttcccaataa

SEQ ID NO: 639951 - DNA, 20 bp, Artificial
  CRISPR gRNA sequence
agtttcccaataagtaacca

SEQ ID NO: 639952 - DNA, 20 bp, Artificial
  CRISPR gRNA sequence
cccaataagtaaccagaaat

SEQ ID NO: 639953 - DNA, 20 bp, Artificial
  CRISPR gRNA sequence
ccaataagtaaccagaaata

SEQ ID NO: 639954 - DNA, 20 bp, Artificial
  CRISPR gRNA sequence
actccatatttaccacagaa

SEQ ID NO: 639955 - DNA, 20 bp, Artificial
  CRISPR gRNA sequence
catatttaccacagaagaag

SEQ ID NO: 639956 - DNA, 20 bp, Artificial
  CRISPR gRNA sequence
accacagaagaagtatacaa

SEQ ID NO: 639957 - DNA, 20 bp, Artificial
  CRISPR gRNA sequence
ccacagaagaagtatacaaa

SEQ ID NO: 639958 - DNA, 20 bp, Artificial
  CRISPR gRNA sequence
aacagaaaacactgccagga

SEQ ID NO: 639959 - DNA, 20 bp, Artificial
  CRISPR gRNA sequence
ccaggaaaatattaaacaaa

SEQ ID NO: 639960 - DNA, 20 bp, Artificial
  CRISPR gRNA sequence
aacaaatgatagtaatccat

SEQ ID NO: 639961 - DNA, 20 bp, Artificial
  CRISPR gRNA sequence
ttgacatgatctatgtttca

SEQ ID NO: 639962 - DNA, 20 bp, Artificial
  CRISPR gRNA sequence
acatgatctatgtttcataa

SEQ ID NO: 639963 - DNA, 20 bp, Artificial
  CRISPR gRNA sequence
tgtttcataaatataaaaag

SEQ ID NO: 639964 - DNA, 20 bp, Artificial
  CRISPR gRNA sequence
cataaatataaaaaggtttt

SEQ ID NO: 639965 - DNA, 20 bp, Artificial
  CRISPR gRNA sequence
ataaatataaaaaggtttta

SEQ ID NO: 639966 - DNA, 20 bp, Artificial
  CRISPR gRNA sequence
tagagtatgacagttattca

SEQ ID NO: 639967 - DNA, 20 bp, Artificial
  CRISPR gRNA sequence
agagtatgacagttattcaa

SEQ ID NO: 639968 - DNA, 20 bp, Artificial
  CRISPR gRNA sequence
gagtatgacagttattcaaa

SEQ ID NO: 639969 - DNA, 20 bp, Artificial
  CRISPR gRNA sequence
ttcaaatgtttaatagcatg

SEQ ID NO: 639970 - DNA, 20 bp, Artificial
  CRISPR gRNA sequence
aaatgtttaatagcatgtta

SEQ ID NO: 639971 - DNA, 20 bp, Artificial
  CRISPR gRNA sequence
aatagcatgttacacctttg

SEQ ID NO: 639972 - DNA, 20 bp, Artificial
  CRISPR gRNA sequence
atagcatgttacacctttga

SEQ ID NO: 639973 - DNA, 20 bp, Artificial
  CRISPR gRNA sequence
cacctttgaaagaggtaaca

SEQ ID NO: 639974 - DNA, 20 bp, Artificial
  CRISPR gRNA sequence
tgaaagaggtaacactacaa

SEQ ID NO: 639975 - DNA, 20 bp, Artificial
  CRISPR gRNA sequence
gaaagaggtaacactacaag

SEQ ID NO: 639976 - DNA, 20 bp, Artificial
  CRISPR gRNA sequence
aaagaggtaacactacaaga

SEQ ID NO: 639977 - DNA, 20 bp, Artificial
  CRISPR gRNA sequence
caagaaaaacaacagaaaaa

SEQ ID NO: 639978 - DNA, 20 bp, Artificial
  CRISPR gRNA sequence
cacctttccaaaatgtaaag

SEQ ID NO: 639979 - DNA, 20 bp, Artificial
  CRISPR gRNA sequence
acctttccaaaatgtaaagc

SEQ ID NO: 639980 - DNA, 20 bp, Artificial
  CRISPR gRNA sequence
tccaaaatgtaaagcatata

SEQ ID NO: 639981 - DNA, 20 bp, Artificial
  CRISPR gRNA sequence
ccaaaatgtaaagcatatat

SEQ ID NO: 639982 - DNA, 20 bp, Artificial
  CRISPR gRNA sequence
caaaatgtaaagcatatatt

SEQ ID NO: 639983 - DNA, 20 bp, Artificial
  CRISPR gRNA sequence
aacaaattaaatgaaaatca

SEQ ID NO: 639984 - DNA, 20 bp, Artificial
  CRISPR gRNA sequence
aatgaaaatcagggaagtga

SEQ ID NO: 639985 - DNA, 20 bp, Artificial
  CRISPR gRNA sequence
acttccaacgaatcagaagt

SEQ ID NO: 639986 - DNA, 20 bp, Artificial
  CRISPR gRNA sequence
ccaacgaatcagaagtccat

SEQ ID NO: 639987 - DNA, 20 bp, Artificial
  CRISPR gRNA sequence
caacgaatcagaagtccata

SEQ ID NO: 639988 - DNA, 20 bp, Artificial
  CRISPR gRNA sequence
atgaataacataatttttgt

SEQ ID NO: 639989 - DNA, 20 bp, Artificial
  CRISPR gRNA sequence
tgaataacataatttttgtt

SEQ ID NO: 639990 - DNA, 20 bp, Artificial
  CRISPR gRNA sequence
ttgttttctttgagatggag

SEQ ID NO: 639991 - DNA, 20 bp, Artificial
  CRISPR gRNA sequence
tgttttctttgagatggagt

SEQ ID NO: 639992 - DNA, 20 bp, Artificial
  CRISPR gRNA sequence
gttttctttgagatggagtc

SEQ ID NO: 639993 - DNA, 20 bp, Artificial
  CRISPR gRNA sequence
ttttctttgagatggagtct

SEQ ID NO: 639994 - DNA, 20 bp, Artificial
  CRISPR gRNA sequence
tctttgagatggagtcttgc

SEQ ID NO: 639995 - DNA, 20 bp, Artificial
  CRISPR gRNA sequence
ctttgagatggagtcttgct

SEQ ID NO: 639996 - DNA, 20 bp, Artificial
  CRISPR gRNA sequence
tttgagatggagtcttgctc

SEQ ID NO: 639997 - DNA, 20 bp, Artificial
  CRISPR gRNA sequence
tgagatggagtcttgctctg

SEQ ID NO: 639998 - DNA, 20 bp, Artificial
  CRISPR gRNA sequence
gagatggagtcttgctctgt

SEQ ID NO: 639999 - DNA, 20 bp, Artificial
  CRISPR gRNA sequence
agatggagtcttgctctgtc

SEQ ID NO: 640000 - DNA, 20 bp, Artificial
  CRISPR gRNA sequence
gctctgtcgccaggtctgga

SEQ ID NO: 640001 - DNA, 20 bp, Artificial
  CRISPR gRNA sequence
ctctgtcgccaggtctggag

SEQ ID NO: 640002 - DNA, 20 bp, Artificial
  CRISPR gRNA sequence
tgtcgccaggtctggagtgc

SEQ ID NO: 640003 - DNA, 20 bp, Artificial
  CRISPR gRNA sequence
tcgccaggtctggagtgcag

SEQ ID NO: 640004 - DNA, 20 bp, Artificial
  CRISPR gRNA sequence
gagtgcagtggcacgatctt

SEQ ID NO: 640005 - DNA, 20 bp, Artificial
  CRISPR gRNA sequence
ggctcactgcaacctccaca

SEQ ID NO: 640006 - DNA, 20 bp, Artificial
  CRISPR gRNA sequence
gctcactgcaacctccacat

SEQ ID NO: 640007 - DNA, 20 bp, Artificial
  CRISPR gRNA sequence
actgcaacctccacatctct

SEQ ID NO: 640008 - DNA, 20 bp, Artificial
  CRISPR gRNA sequence
caacctccacatctctaaat

SEQ ID NO: 640009 - DNA, 20 bp, Artificial
  CRISPR gRNA sequence
cacatctctaaataacctaa

SEQ ID NO: 640010 - DNA, 20 bp, Artificial
  CRISPR gRNA sequence
taaataacctaaattttaaa

SEQ ID NO: 640011 - DNA, 20 bp, Artificial
  CRISPR gRNA sequence
aataacctaaattttaaaaa

SEQ ID NO: 640012 - DNA, 20 bp, Artificial
  CRISPR gRNA sequence
aattttaaaaattcagaatg

SEQ ID NO: 640013 - DNA, 20 bp, Artificial
  CRISPR gRNA sequence
taaaaattcagaatgatgtg

SEQ ID NO: 640014 - DNA, 20 bp, Artificial
  CRISPR gRNA sequence
aaaaattcagaatgatgtga

SEQ ID NO: 640015 - DNA, 20 bp, Artificial
  CRISPR gRNA sequence
aaaattcagaatgatgtgaa

SEQ ID NO: 640016 - DNA, 20 bp, Artificial
  CRISPR gRNA sequence
agaatgatgtgaagaattat

SEQ ID NO: 640017 - DNA, 20 bp, Artificial
  CRISPR gRNA sequence
tctctaaagtaacatccaga

SEQ ID NO: 640018 - DNA, 20 bp, Artificial
  CRISPR gRNA sequence
taaagtaacatccagaagta

SEQ ID NO: 640019 - DNA, 20 bp, Artificial
  CRISPR gRNA sequence
aagtaacatccagaagtaga

SEQ ID NO: 640020 - DNA, 20 bp, Artificial
  CRISPR gRNA sequence
ccatttcacaatccctggga

SEQ ID NO: 640021 - DNA, 20 bp, Artificial
  CRISPR gRNA sequence
catttcacaatccctgggat

SEQ ID NO: 640022 - DNA, 20 bp, Artificial
  CRISPR gRNA sequence
cacaatccctgggatccaga

SEQ ID NO: 640023 - DNA, 20 bp, Artificial
  CRISPR gRNA sequence
acaatccctgggatccagaa

SEQ ID NO: 640024 - DNA, 20 bp, Artificial
  CRISPR gRNA sequence
ggatccagaaacttgtacct

SEQ ID NO: 640025 - DNA, 20 bp, Artificial
  CRISPR gRNA sequence
gtacctatttgacccagctc

SEQ ID NO: 640026 - DNA, 20 bp, Artificial
  CRISPR gRNA sequence
tacctatttgacccagctcc

SEQ ID NO: 640027 - DNA, 20 bp, Artificial
  CRISPR gRNA sequence
tttgacccagctcctataat

SEQ ID NO: 640028 - DNA, 20 bp, Artificial
  CRISPR gRNA sequence
gacccagctcctataatcat

SEQ ID NO: 640029 - DNA, 20 bp, Artificial
  CRISPR gRNA sequence
acccagctcctataatcata

SEQ ID NO: 640030 - DNA, 20 bp, Artificial
  CRISPR gRNA sequence
ctataatcatatttccctgg

SEQ ID NO: 640031 - DNA, 20 bp, Artificial
  CRISPR gRNA sequence
taatcatatttccctggtcc

SEQ ID NO: 640032 - DNA, 20 bp, Artificial
  CRISPR gRNA sequence
ccctggtcccttgaatgtat

SEQ ID NO: 640033 - DNA, 20 bp, Artificial
  CRISPR gRNA sequence
cctggtcccttgaatgtatt

SEQ ID NO: 640034 - DNA, 20 bp, Artificial
  CRISPR gRNA sequence
gtcccttgaatgtattttac

SEQ ID NO: 640035 - DNA, 20 bp, Artificial
  CRISPR gRNA sequence
gaatgtattttactatcctc

SEQ ID NO: 640036 - DNA, 20 bp, Artificial
  CRISPR gRNA sequence
aatgtattttactatcctct

SEQ ID NO: 640037 - DNA, 20 bp, Artificial
  CRISPR gRNA sequence
tactatcctctcaaactgag

SEQ ID NO: 640038 - DNA, 20 bp, Artificial
  CRISPR gRNA sequence
actatcctctcaaactgaga

SEQ ID NO: 640039 - DNA, 20 bp, Artificial
  CRISPR gRNA sequence
ctatcctctcaaactgagaa

SEQ ID NO: 640040 - DNA, 20 bp, Artificial
  CRISPR gRNA sequence
tcctctcaaactgagaaagt

SEQ ID NO: 640041 - DNA, 20 bp, Artificial
  CRISPR gRNA sequence
tcaaactgagaaagtgacaa

SEQ ID NO: 640042 - DNA, 20 bp, Artificial
  CRISPR gRNA sequence
aaactgagaaagtgacaata

SEQ ID NO: 640043 - DNA, 20 bp, Artificial
  CRISPR gRNA sequence
agaaagtgacaatattcatt

SEQ ID NO: 640044 - DNA, 20 bp, Artificial
  CRISPR gRNA sequence
attattttgttgcaaatatc

SEQ ID NO: 640045 - DNA, 20 bp, Artificial
  CRISPR gRNA sequence
ttttgttgcaaatatccaga

SEQ ID NO: 640046 - DNA, 20 bp, Artificial
  CRISPR gRNA sequence
tgttgcaaatatccagagca

SEQ ID NO: 640047 - DNA, 20 bp, Artificial
  CRISPR gRNA sequence
gttgcaaatatccagagcac

SEQ ID NO: 640048 - DNA, 20 bp, Artificial
  CRISPR gRNA sequence
ttgcaaatatccagagcact

SEQ ID NO: 640049 - DNA, 20 bp, Artificial
  CRISPR gRNA sequence
caaatatccagagcactgat

SEQ ID NO: 640050 - DNA, 20 bp, Artificial
  CRISPR gRNA sequence
atttaaatatcatacaaatg

SEQ ID NO: 640051 - DNA, 20 bp, Artificial
  CRISPR gRNA sequence
aaatatcatacaaatgaaaa

SEQ ID NO: 640052 - DNA, 20 bp, Artificial
  CRISPR gRNA sequence
aatatcatacaaatgaaaaa

SEQ ID NO: 640053 - DNA, 20 bp, Artificial
  CRISPR gRNA sequence
aaaagaaaaaactttgaaga

SEQ ID NO: 640054 - DNA, 20 bp, Artificial
  CRISPR gRNA sequence
tgaagagacacatccatctc

SEQ ID NO: 640055 - DNA, 20 bp, Artificial
  CRISPR gRNA sequence
gaagagacacatccatctct

SEQ ID NO: 640056 - DNA, 20 bp, Artificial
  CRISPR gRNA sequence
aagagacacatccatctcta

SEQ ID NO: 640057 - DNA, 20 bp, Artificial
  CRISPR gRNA sequence
taactaaaaacatgaacaga

SEQ ID NO: 640058 - DNA, 20 bp, Artificial
  CRISPR gRNA sequence
actaaaaacatgaacagagt

SEQ ID NO: 640059 - DNA, 20 bp, Artificial
  CRISPR gRNA sequence
aaaacatgaacagagtagca

SEQ ID NO: 640060 - DNA, 20 bp, Artificial
  CRISPR gRNA sequence
tgccctttactttttaaccc

SEQ ID NO: 640061 - DNA, 20 bp, Artificial
  CRISPR gRNA sequence
gccctttactttttaacccc

SEQ ID NO: 640062 - DNA, 20 bp, Artificial
  CRISPR gRNA sequence
ccctttactttttaacccca

SEQ ID NO: 640063 - DNA, 20 bp, Artificial
  CRISPR gRNA sequence
tactttttaaccccatataa

SEQ ID NO: 640064 - DNA, 20 bp, Artificial
  CRISPR gRNA sequence
actttttaaccccatataaa

SEQ ID NO: 640065 - DNA, 20 bp, Artificial
  CRISPR gRNA sequence
ctttttaaccccatataaaa

SEQ ID NO: 640066 - DNA, 20 bp, Artificial
  CRISPR gRNA sequence
tttaaccccatataaaacta

SEQ ID NO: 640067 - DNA, 20 bp, Artificial
  CRISPR gRNA sequence
ttaaccccatataaaactaa

SEQ ID NO: 640068 - DNA, 20 bp, Artificial
  CRISPR gRNA sequence
taaccccatataaaactaag

SEQ ID NO: 640069 - DNA, 20 bp, Artificial
  CRISPR gRNA sequence
aaccccatataaaactaagt

SEQ ID NO: 640070 - DNA, 20 bp, Artificial
  CRISPR gRNA sequence
accccatataaaactaagtc

SEQ ID NO: 640071 - DNA, 20 bp, Artificial
  CRISPR gRNA sequence
agtcaaggaaaatatattat

SEQ ID NO: 640072 - DNA, 20 bp, Artificial
  CRISPR gRNA sequence
ttctgacatgtttataacta

SEQ ID NO: 640073 - DNA, 20 bp, Artificial
  CRISPR gRNA sequence
tgacatgtttataactatta

SEQ ID NO: 640074 - DNA, 20 bp, Artificial
  CRISPR gRNA sequence
acatgtttataactattaca

SEQ ID NO: 640075 - DNA, 20 bp, Artificial
  CRISPR gRNA sequence
ataactattacataaaatca

SEQ ID NO: 640076 - DNA, 20 bp, Artificial
  CRISPR gRNA sequence
taactattacataaaatcaa

SEQ ID NO: 640077 - DNA, 20 bp, Artificial
  CRISPR gRNA sequence
ttacataaaatcaactatca

SEQ ID NO: 640078 - DNA, 20 bp, Artificial
  CRISPR gRNA sequence
cataaaatcaactatcacct

SEQ ID NO: 640079 - DNA, 20 bp, Artificial
  CRISPR gRNA sequence
tcacctaactacaggaatgt

SEQ ID NO: 640080 - DNA, 20 bp, Artificial
  CRISPR gRNA sequence
actacaggaatgtgctctga

SEQ ID NO: 640081 - DNA, 20 bp, Artificial
  CRISPR gRNA sequence
caggaatgtgctctgagaaa

SEQ ID NO: 640082 - DNA, 20 bp, Artificial
  CRISPR gRNA sequence
tgagaaatgtgtccttagct

SEQ ID NO: 640083 - DNA, 20 bp, Artificial
  CRISPR gRNA sequence
agaaatgtgtccttagctgt

SEQ ID NO: 640084 - DNA, 20 bp, Artificial
  CRISPR gRNA sequence
agctgtgaacactatcaagt

SEQ ID NO: 640085 - DNA, 20 bp, Artificial
  CRISPR gRNA sequence
gctgtgaacactatcaagtg

SEQ ID NO: 640086 - DNA, 20 bp, Artificial
  CRISPR gRNA sequence
tgaacactatcaagtgtaca

SEQ ID NO: 640087 - DNA, 20 bp, Artificial
  CRISPR gRNA sequence
tcaagtgtacatcacaaatc

SEQ ID NO: 640088 - DNA, 20 bp, Artificial
  CRISPR gRNA sequence
gataggatagcctacttcat

SEQ ID NO: 640089 - DNA, 20 bp, Artificial
  CRISPR gRNA sequence
cttcatacctaggccgtatg

SEQ ID NO: 640090 - DNA, 20 bp, Artificial
  CRISPR gRNA sequence
catacctaggccgtatggta

SEQ ID NO: 640091 - DNA, 20 bp, Artificial
  CRISPR gRNA sequence
atacctaggccgtatggtat

SEQ ID NO: 640092 - DNA, 20 bp, Artificial
  CRISPR gRNA sequence
ggccgtatggtatatattgc

SEQ ID NO: 640093 - DNA, 20 bp, Artificial
  CRISPR gRNA sequence
cctgttgttcctaagctaca

SEQ ID NO: 640094 - DNA, 20 bp, Artificial
  CRISPR gRNA sequence
ttgttcctaagctacaaacc

SEQ ID NO: 640095 - DNA, 20 bp, Artificial
  CRISPR gRNA sequence
ttcctaagctacaaacctgc

SEQ ID NO: 640096 - DNA, 20 bp, Artificial
  CRISPR gRNA sequence
ctaagctacaaacctgcaca

SEQ ID NO: 640097 - DNA, 20 bp, Artificial
  CRISPR gRNA sequence
agctacaaacctgcacagca

SEQ ID NO: 640098 - DNA, 20 bp, Artificial
  CRISPR gRNA sequence
caaacctgcacagcatgtta

SEQ ID NO: 640099 - DNA, 20 bp, Artificial
  CRISPR gRNA sequence
cacagcatgttactgtactg

SEQ ID NO: 640100 - DNA, 20 bp, Artificial
  CRISPR gRNA sequence
ctgtactgaatacgtaggca

SEQ ID NO: 640101 - DNA, 20 bp, Artificial
  CRISPR gRNA sequence
tactgaatacgtaggcaatt

SEQ ID NO: 640102 - DNA, 20 bp, Artificial
  CRISPR gRNA sequence
aatacgtaggcaattgtaac

SEQ ID NO: 640103 - DNA, 20 bp, Artificial
  CRISPR gRNA sequence
taacccaatggtatctacat

SEQ ID NO: 640104 - DNA, 20 bp, Artificial
  CRISPR gRNA sequence
catatacacagaaaatgtat

SEQ ID NO: 640105 - DNA, 20 bp, Artificial
  CRISPR gRNA sequence
aaaaataccctatttataat

SEQ ID NO: 640106 - DNA, 20 bp, Artificial
  CRISPR gRNA sequence
aaaataccctatttataata

SEQ ID NO: 640107 - DNA, 20 bp, Artificial
  CRISPR gRNA sequence
tttataatattatggcatca

SEQ ID NO: 640108 - DNA, 20 bp, Artificial
  CRISPR gRNA sequence
ataatattatggcatcaccg

SEQ ID NO: 640109 - DNA, 20 bp, Artificial
  CRISPR gRNA sequence
taatattatggcatcaccgc

SEQ ID NO: 640110 - DNA, 20 bp, Artificial
  CRISPR gRNA sequence
tggcatcaccgctgtatatg

SEQ ID NO: 640111 - DNA, 20 bp, Artificial
  CRISPR gRNA sequence
tatatgttgtatatgtggtc

SEQ ID NO: 640112 - DNA, 20 bp, Artificial
  CRISPR gRNA sequence
tatatgtggtctatcattga

SEQ ID NO: 640113 - DNA, 20 bp, Artificial
  CRISPR gRNA sequence
tcattgaaaagttatcaggc

SEQ ID NO: 640114 - DNA, 20 bp, Artificial
  CRISPR gRNA sequence
aaaagttatcaggcatgcac

SEQ ID NO: 640115 - DNA, 20 bp, Artificial
  CRISPR gRNA sequence
tcaggcatgcacatgactgt

SEQ ID NO: 640116 - DNA, 20 bp, Artificial
  CRISPR gRNA sequence
tacatatttatgtcaaatat

SEQ ID NO: 640117 - DNA, 20 bp, Artificial
  CRISPR gRNA sequence
atgtcaaatattaaaatcca

SEQ ID NO: 640118 - DNA, 20 bp, Artificial
  CRISPR gRNA sequence
tgtcaaatattaaaatccag

SEQ ID NO: 640119 - DNA, 20 bp, Artificial
  CRISPR gRNA sequence
aaatccagatggaacattag

SEQ ID NO: 640120 - DNA, 20 bp, Artificial
  CRISPR gRNA sequence
gttagaataacaaaagccta

SEQ ID NO: 640121 - DNA, 20 bp, Artificial
  CRISPR gRNA sequence
gaataacaaaagcctaacaa

SEQ ID NO: 640122 - DNA, 20 bp, Artificial
  CRISPR gRNA sequence
acaaaactcttaaatccaat

SEQ ID NO: 640123 - DNA, 20 bp, Artificial
  CRISPR gRNA sequence
ttaaatccaatcaatggatt

SEQ ID NO: 640124 - DNA, 20 bp, Artificial
  CRISPR gRNA sequence
aaatccaatcaatggatttt

SEQ ID NO: 640125 - DNA, 20 bp, Artificial
  CRISPR gRNA sequence
aatccaatcaatggattttg

SEQ ID NO: 640126 - DNA, 20 bp, Artificial
  CRISPR gRNA sequence
tgcttacatacatatttttt

SEQ ID NO: 640127 - DNA, 20 bp, Artificial
  CRISPR gRNA sequence
gcttacatacatatttttta

SEQ ID NO: 640128 - DNA, 20 bp, Artificial
  CRISPR gRNA sequence
cttacatacatattttttag

SEQ ID NO: 640129 - DNA, 20 bp, Artificial
  CRISPR gRNA sequence
acatacatattttttagaag

SEQ ID NO: 640130 - DNA, 20 bp, Artificial
  CRISPR gRNA sequence
catacatattttttagaaga

SEQ ID NO: 640131 - DNA, 20 bp, Artificial
  CRISPR gRNA sequence
tttagaagactgacattgca

SEQ ID NO: 640132 - DNA, 20 bp, Artificial
  CRISPR gRNA sequence
ttagaagactgacattgcat

SEQ ID NO: 640133 - DNA, 20 bp, Artificial
  CRISPR gRNA sequence
tagaagactgacattgcatt

SEQ ID NO: 640134 - DNA, 20 bp, Artificial
  CRISPR gRNA sequence
agaagactgacattgcatta

SEQ ID NO: 640135 - DNA, 20 bp, Artificial
  CRISPR gRNA sequence
gaagactgacattgcattac

SEQ ID NO: 640136 - DNA, 20 bp, Artificial
  CRISPR gRNA sequence
acattgcattaccacataga

SEQ ID NO: 640137 - DNA, 20 bp, Artificial
  CRISPR gRNA sequence
cattaccacatagaagctgt

SEQ ID NO: 640138 - DNA, 20 bp, Artificial
  CRISPR gRNA sequence
ccacatagaagctgtgattc

SEQ ID NO: 640139 - DNA, 20 bp, Artificial
  CRISPR gRNA sequence
tgattcaaatttcactaaga

SEQ ID NO: 640140 - DNA, 20 bp, Artificial
  CRISPR gRNA sequence
aaatttcactaagaatctag

SEQ ID NO: 640141 - DNA, 20 bp, Artificial
  CRISPR gRNA sequence
cactaagaatctagattctg

SEQ ID NO: 640142 - DNA, 20 bp, Artificial
  CRISPR gRNA sequence
actaagaatctagattctgt

SEQ ID NO: 640143 - DNA, 20 bp, Artificial
  CRISPR gRNA sequence
agaatctagattctgttctg

SEQ ID NO: 640144 - DNA, 20 bp, Artificial
  CRISPR gRNA sequence
gattctgttctgtactttgg

SEQ ID NO: 640145 - DNA, 20 bp, Artificial
  CRISPR gRNA sequence
tgttctgtactttggtcttt

SEQ ID NO: 640146 - DNA, 20 bp, Artificial
  CRISPR gRNA sequence
ttctgtactttggtctttgc

SEQ ID NO: 640147 - DNA, 20 bp, Artificial
  CRISPR gRNA sequence
tgtactttggtctttgccaa

SEQ ID NO: 640148 - DNA, 20 bp, Artificial
  CRISPR gRNA sequence
tactttggtctttgccaagt

SEQ ID NO: 640149 - DNA, 20 bp, Artificial
  CRISPR gRNA sequence
tggtctttgccaagttttgc

SEQ ID NO: 640150 - DNA, 20 bp, Artificial
  CRISPR gRNA sequence
ggtctttgccaagttttgct

SEQ ID NO: 640151 - DNA, 20 bp, Artificial
  CRISPR gRNA sequence
gtctttgccaagttttgcta

SEQ ID NO: 640152 - DNA, 20 bp, Artificial
  CRISPR gRNA sequence
tgccaagttttgctacagta

SEQ ID NO: 640153 - DNA, 20 bp, Artificial
  CRISPR gRNA sequence
gccaagttttgctacagtaa

SEQ ID NO: 640154 - DNA, 20 bp, Artificial
  CRISPR gRNA sequence
ccaagttttgctacagtaat

SEQ ID NO: 640155 - DNA, 20 bp, Artificial
  CRISPR gRNA sequence
tgctacagtaatagaatgcc

SEQ ID NO: 640156 - DNA, 20 bp, Artificial
  CRISPR gRNA sequence
gctacagtaatagaatgcca

SEQ ID NO: 640157 - DNA, 20 bp, Artificial
  CRISPR gRNA sequence
ctacagtaatagaatgccaa

SEQ ID NO: 640158 - DNA, 20 bp, Artificial
  CRISPR gRNA sequence
cagtaatagaatgccaaatt

SEQ ID NO: 640159 - DNA, 20 bp, Artificial
  CRISPR gRNA sequence
tctgcaattatttcatttag

SEQ ID NO: 640160 - DNA, 20 bp, Artificial
  CRISPR gRNA sequence
ctgcaattatttcatttagg

SEQ ID NO: 640161 - DNA, 20 bp, Artificial
  CRISPR gRNA sequence
tgcaattatttcatttagga

SEQ ID NO: 640162 - DNA, 20 bp, Artificial
  CRISPR gRNA sequence
caattatttcatttaggaaa

SEQ ID NO: 640163 - DNA, 20 bp, Artificial
  CRISPR gRNA sequence
tttcatttaggaaaaaacct

SEQ ID NO: 640164 - DNA, 20 bp, Artificial
  CRISPR gRNA sequence
catttaggaaaaaaccttct

SEQ ID NO: 640165 - DNA, 20 bp, Artificial
  CRISPR gRNA sequence
atttaggaaaaaaccttctc

SEQ ID NO: 640166 - DNA, 20 bp, Artificial
  CRISPR gRNA sequence
aggaaaaaaccttctcttaa

SEQ ID NO: 640167 - DNA, 20 bp, Artificial
  CRISPR gRNA sequence
ggaaaaaaccttctcttaaa

SEQ ID NO: 640168 - DNA, 20 bp, Artificial
  CRISPR gRNA sequence
ctcttaaacattctataaaa

SEQ ID NO: 640169 - DNA, 20 bp, Artificial
  CRISPR gRNA sequence
tcttaaacattctataaaaa

SEQ ID NO: 640170 - DNA, 20 bp, Artificial
  CRISPR gRNA sequence
ttaaacattctataaaaatt

SEQ ID NO: 640171 - DNA, 20 bp, Artificial
  CRISPR gRNA sequence
aaacattctataaaaatttg

SEQ ID NO: 640172 - DNA, 20 bp, Artificial
  CRISPR gRNA sequence
aacattctataaaaatttga

SEQ ID NO: 640173 - DNA, 20 bp, Artificial
  CRISPR gRNA sequence
tataaaaatttgattcatca

SEQ ID NO: 640174 - DNA, 20 bp, Artificial
  CRISPR gRNA sequence
taaaaatttgattcatcaaa

SEQ ID NO: 640175 - DNA, 20 bp, Artificial
  CRISPR gRNA sequence
gattcatcaaaccttattaa

SEQ ID NO: 640176 - DNA, 20 bp, Artificial
  CRISPR gRNA sequence
attcatcaaaccttattaat

SEQ ID NO: 640177 - DNA, 20 bp, Artificial
  CRISPR gRNA sequence
atcaaaccttattaatatga

SEQ ID NO: 640178 - DNA, 20 bp, Artificial
  CRISPR gRNA sequence
attaatatgatgatgaattt

SEQ ID NO: 640179 - DNA, 20 bp, Artificial
  CRISPR gRNA sequence
ttaatatgatgatgaattta

SEQ ID NO: 640180 - DNA, 20 bp, Artificial
  CRISPR gRNA sequence
atatgatgatgaatttatta

SEQ ID NO: 640181 - DNA, 20 bp, Artificial
  CRISPR gRNA sequence
attacaattgtatttaaatg

SEQ ID NO: 640182 - DNA, 20 bp, Artificial
  CRISPR gRNA sequence
ttacaattgtatttaaatgg

SEQ ID NO: 640183 - DNA, 20 bp, Artificial
  CRISPR gRNA sequence
caattgtatttaaatggtta

SEQ ID NO: 640184 - DNA, 20 bp, Artificial
  CRISPR gRNA sequence
tatttaaatggttattaaac

SEQ ID NO: 640185 - DNA, 20 bp, Artificial
  CRISPR gRNA sequence
aaatggttattaaacgtaag

SEQ ID NO: 640186 - DNA, 20 bp, Artificial
  CRISPR gRNA sequence
aatggttattaaacgtaagc

SEQ ID NO: 640187 - DNA, 20 bp, Artificial
  CRISPR gRNA sequence
ttaaacgtaagcctaaatta

SEQ ID NO: 640188 - DNA, 20 bp, Artificial
  CRISPR gRNA sequence
aacgtaagcctaaattattc

SEQ ID NO: 640189 - DNA, 20 bp, Artificial
  CRISPR gRNA sequence
aattattcaggctagacaga

SEQ ID NO: 640190 - DNA, 20 bp, Artificial
  CRISPR gRNA sequence
ttcaggctagacagacaagc

SEQ ID NO: 640191 - DNA, 20 bp, Artificial
  CRISPR gRNA sequence
aggctagacagacaagcatg

SEQ ID NO: 640192 - DNA, 20 bp, Artificial
  CRISPR gRNA sequence
gacagacaagcatggatcct

SEQ ID NO: 640193 - DNA, 20 bp, Artificial
  CRISPR gRNA sequence
aaaaggcggtttgttttctt

SEQ ID NO: 640194 - DNA, 20 bp, Artificial
  CRISPR gRNA sequence
gttttcttaaaactaacttc

SEQ ID NO: 640195 - DNA, 20 bp, Artificial
  CRISPR gRNA sequence
ttttcttaaaactaacttcc

SEQ ID NO: 640196 - DNA, 20 bp, Artificial
  CRISPR gRNA sequence
tcttaaaactaacttccagt

SEQ ID NO: 640197 - DNA, 20 bp, Artificial
  CRISPR gRNA sequence
cttaaaactaacttccagtt

SEQ ID NO: 640198 - DNA, 20 bp, Artificial
  CRISPR gRNA sequence
ttaaaactaacttccagtta

SEQ ID NO: 640199 - DNA, 20 bp, Artificial
  CRISPR gRNA sequence
aaaactaacttccagttatt

SEQ ID NO: 640200 - DNA, 20 bp, Artificial
  CRISPR gRNA sequence
aaactaacttccagttattt

SEQ ID NO: 640201 - DNA, 20 bp, Artificial
  CRISPR gRNA sequence
acttccagttatttcagatt

SEQ ID NO: 640202 - DNA, 20 bp, Artificial
  CRISPR gRNA sequence
ccagttatttcagatttcaa

SEQ ID NO: 640203 - DNA, 20 bp, Artificial
  CRISPR gRNA sequence
cagttatttcagatttcaac

SEQ ID NO: 640204 - DNA, 20 bp, Artificial
  CRISPR gRNA sequence
tttcagatttcaactatgtg

SEQ ID NO: 640205 - DNA, 20 bp, Artificial
  CRISPR gRNA sequence
cagatttcaactatgtgtgt

SEQ ID NO: 640206 - DNA, 20 bp, Artificial
  CRISPR gRNA sequence
agatttcaactatgtgtgta

SEQ ID NO: 640207 - DNA, 20 bp, Artificial
  CRISPR gRNA sequence
caactatgtgtgtacttttc

SEQ ID NO: 640208 - DNA, 20 bp, Artificial
  CRISPR gRNA sequence
aactatgtgtgtacttttct

SEQ ID NO: 640209 - DNA, 20 bp, Artificial
  CRISPR gRNA sequence
tgtgtgtacttttctagaag

SEQ ID NO: 640210 - DNA, 20 bp, Artificial
  CRISPR gRNA sequence
ttctagaagacaattctaaa

SEQ ID NO: 640211 - DNA, 20 bp, Artificial
  CRISPR gRNA sequence
tctagaagacaattctaaag

SEQ ID NO: 640212 - DNA, 20 bp, Artificial
  CRISPR gRNA sequence
ctagaagacaattctaaagt

SEQ ID NO: 640213 - DNA, 20 bp, Artificial
  CRISPR gRNA sequence
tagaagacaattctaaagtg

SEQ ID NO: 640214 - DNA, 20 bp, Artificial
  CRISPR gRNA sequence
gaagacaattctaaagtggc

SEQ ID NO: 640215 - DNA, 20 bp, Artificial
  CRISPR gRNA sequence
taaagtggctttcaaactgt

SEQ ID NO: 640216 - DNA, 20 bp, Artificial
  CRISPR gRNA sequence
aagtggctttcaaactgttc

SEQ ID NO: 640217 - DNA, 20 bp, Artificial
  CRISPR gRNA sequence
tcaaactgttccttggctat

SEQ ID NO: 640218 - DNA, 20 bp, Artificial
  CRISPR gRNA sequence
caaactgttccttggctata

SEQ ID NO: 640219 - DNA, 20 bp, Artificial
  CRISPR gRNA sequence
aaactgttccttggctatac

SEQ ID NO: 640220 - DNA, 20 bp, Artificial
  CRISPR gRNA sequence
ttccttggctatacactata

SEQ ID NO: 640221 - DNA, 20 bp, Artificial
  CRISPR gRNA sequence
cttggctatacactatacag

SEQ ID NO: 640222 - DNA, 20 bp, Artificial
  CRISPR gRNA sequence
ggctatacactatacagata

SEQ ID NO: 640223 - DNA, 20 bp, Artificial
  CRISPR gRNA sequence
gctatacactatacagatac

SEQ ID NO: 640224 - DNA, 20 bp, Artificial
  CRISPR gRNA sequence
tacactatacagatactgag

SEQ ID NO: 640225 - DNA, 20 bp, Artificial
  CRISPR gRNA sequence
tacagatactgagacagtct

SEQ ID NO: 640226 - DNA, 20 bp, Artificial
  CRISPR gRNA sequence
agacagtctcaataaaagag

SEQ ID NO: 640227 - DNA, 20 bp, Artificial
  CRISPR gRNA sequence
aataaaagagaaatgctgaa

SEQ ID NO: 640228 - DNA, 20 bp, Artificial
  CRISPR gRNA sequence
aagtctatactaccttattt

SEQ ID NO: 640229 - DNA, 20 bp, Artificial
  CRISPR gRNA sequence
tactaccttatttcattcag

SEQ ID NO: 640230 - DNA, 20 bp, Artificial
  CRISPR gRNA sequence
ccttatttcattcagttaaa

SEQ ID NO: 640231 - DNA, 20 bp, Artificial
  CRISPR gRNA sequence
atttcattcagttaaagttt

SEQ ID NO: 640232 - DNA, 20 bp, Artificial
  CRISPR gRNA sequence
tttcattcagttaaagtttt

SEQ ID NO: 640233 - DNA, 20 bp, Artificial
  CRISPR gRNA sequence
cattcagttaaagttttgtt

SEQ ID NO: 640234 - DNA, 20 bp, Artificial
  CRISPR gRNA sequence
attcagttaaagttttgttc

SEQ ID NO: 640235 - DNA, 20 bp, Artificial
  CRISPR gRNA sequence
agttaaagttttgttctgtt

SEQ ID NO: 640236 - DNA, 20 bp, Artificial
  CRISPR gRNA sequence
aagttttgttctgttctgct

SEQ ID NO: 640237 - DNA, 20 bp, Artificial
  CRISPR gRNA sequence
tgttctgttctgctggctta

SEQ ID NO: 640238 - DNA, 20 bp, Artificial
  CRISPR gRNA sequence
gttctgttctgctggcttaa

SEQ ID NO: 640239 - DNA, 20 bp, Artificial
  CRISPR gRNA sequence
ttctgttctgctggcttaat

SEQ ID NO: 640240 - DNA, 20 bp, Artificial
  CRISPR gRNA sequence
tgttctgctggcttaatatg

SEQ ID NO: 640241 - DNA, 20 bp, Artificial
  CRISPR gRNA sequence
ttctgctggcttaatatggc

SEQ ID NO: 640242 - DNA, 20 bp, Artificial
  CRISPR gRNA sequence
tgctggcttaatatggcctt

SEQ ID NO: 640243 - DNA, 20 bp, Artificial
  CRISPR gRNA sequence
ctggcttaatatggccttat

SEQ ID NO: 640244 - DNA, 20 bp, Artificial
  CRISPR gRNA sequence
gcttaatatggccttatcgt

SEQ ID NO: 640245 - DNA, 20 bp, Artificial
  CRISPR gRNA sequence
aatatggccttatcgttatt

SEQ ID NO: 640246 - DNA, 20 bp, Artificial
  CRISPR gRNA sequence
atatggccttatcgttattt

SEQ ID NO: 640247 - DNA, 20 bp, Artificial
  CRISPR gRNA sequence
atcgttatttcaacacatgt

SEQ ID NO: 640248 - DNA, 20 bp, Artificial
  CRISPR gRNA sequence
tcgttatttcaacacatgtc

SEQ ID NO: 640249 - DNA, 20 bp, Artificial
  CRISPR gRNA sequence
tttcaacacatgtcccattc

SEQ ID NO: 640250 - DNA, 20 bp, Artificial
  CRISPR gRNA sequence
caacacatgtcccattccca

SEQ ID NO: 640251 - DNA, 20 bp, Artificial
  CRISPR gRNA sequence
aacacatgtcccattcccat

SEQ ID NO: 640252 - DNA, 20 bp, Artificial
  CRISPR gRNA sequence
ccatttattaacattaaata

SEQ ID NO: 640253 - DNA, 20 bp, Artificial
  CRISPR gRNA sequence
attaacattaaatatgaaat

SEQ ID NO: 640254 - DNA, 20 bp, Artificial
  CRISPR gRNA sequence
ttaacattaaatatgaaata

SEQ ID NO: 640255 - DNA, 20 bp, Artificial
  CRISPR gRNA sequence
acattaaatatgaaatagta

SEQ ID NO: 640256 - DNA, 20 bp, Artificial
  CRISPR gRNA sequence
aatatgaaatagtaaatctc

SEQ ID NO: 640257 - DNA, 20 bp, Artificial
  CRISPR gRNA sequence
actgggaaaagttttctaaa

SEQ ID NO: 640258 - DNA, 20 bp, Artificial
  CRISPR gRNA sequence
ggaaaagttttctaaaagct

SEQ ID NO: 640259 - DNA, 20 bp, Artificial
  CRISPR gRNA sequence
tctaaaagctaatcgctgct

SEQ ID NO: 640260 - DNA, 20 bp, Artificial
  CRISPR gRNA sequence
ctaaaagctaatcgctgctt

SEQ ID NO: 640261 - DNA, 20 bp, Artificial
  CRISPR gRNA sequence
taaaagctaatcgctgcttt

SEQ ID NO: 640262 - DNA, 20 bp, Artificial
  CRISPR gRNA sequence
aaagctaatcgctgctttag

SEQ ID NO: 640263 - DNA, 20 bp, Artificial
  CRISPR gRNA sequence
atcgctgctttagagaaaca

SEQ ID NO: 640264 - DNA, 20 bp, Artificial
  CRISPR gRNA sequence
ctttagagaaacaatctatt

SEQ ID NO: 640265 - DNA, 20 bp, Artificial
  CRISPR gRNA sequence
tagagaaacaatctattggc

SEQ ID NO: 640266 - DNA, 20 bp, Artificial
  CRISPR gRNA sequence
agagaaacaatctattggca

SEQ ID NO: 640267 - DNA, 20 bp, Artificial
  CRISPR gRNA sequence
gagaaacaatctattggcac

SEQ ID NO: 640268 - DNA, 20 bp, Artificial
  CRISPR gRNA sequence
ttggcacatgctgtatgtgt

SEQ ID NO: 640269 - DNA, 20 bp, Artificial
  CRISPR gRNA sequence
gcacatgctgtatgtgttta

SEQ ID NO: 640270 - DNA, 20 bp, Artificial
  CRISPR gRNA sequence
tatgtgtttatgttcattag

SEQ ID NO: 640271 - DNA, 20 bp, Artificial
  CRISPR gRNA sequence
atgttcattagcaaactggc

SEQ ID NO: 640272 - DNA, 20 bp, Artificial
  CRISPR gRNA sequence
tgttcattagcaaactggcc

SEQ ID NO: 640273 - DNA, 20 bp, Artificial
  CRISPR gRNA sequence
attagcaaactggccattgc

SEQ ID NO: 640274 - DNA, 20 bp, Artificial
  CRISPR gRNA sequence
gcaaactggccattgcaata

SEQ ID NO: 640275 - DNA, 20 bp, Artificial
  CRISPR gRNA sequence
gccattgcaatacttcaaat

SEQ ID NO: 640276 - DNA, 20 bp, Artificial
  CRISPR gRNA sequence
caatacttcaaattagggta

SEQ ID NO: 640277 - DNA, 20 bp, Artificial
  CRISPR gRNA sequence
caaattagggtatcagctga

SEQ ID NO: 640278 - DNA, 20 bp, Artificial
  CRISPR gRNA sequence
aaattagggtatcagctgaa

SEQ ID NO: 640279 - DNA, 20 bp, Artificial
  CRISPR gRNA sequence
gggtatcagctgaaatatta

SEQ ID NO: 640280 - DNA, 20 bp, Artificial
  CRISPR gRNA sequence
aaatattaggttgatgccaa

SEQ ID NO: 640281 - DNA, 20 bp, Artificial
  CRISPR gRNA sequence
ggttgatgccaaagtaactg

SEQ ID NO: 640282 - DNA, 20 bp, Artificial
  CRISPR gRNA sequence
atgccaaagtaactgtggtt

SEQ ID NO: 640283 - DNA, 20 bp, Artificial
  CRISPR gRNA sequence
tggtttttgccataatattt

SEQ ID NO: 640284 - DNA, 20 bp, Artificial
  CRISPR gRNA sequence
ttgccataatatttaaaatg

SEQ ID NO: 640285 - DNA, 20 bp, Artificial
  CRISPR gRNA sequence
tgccataatatttaaaatga

SEQ ID NO: 640286 - DNA, 20 bp, Artificial
  CRISPR gRNA sequence
gccataatatttaaaatgaa

SEQ ID NO: 640287 - DNA, 20 bp, Artificial
  CRISPR gRNA sequence
ccataatatttaaaatgaac

SEQ ID NO: 640288 - DNA, 20 bp, Artificial
  CRISPR gRNA sequence
aaaatgaaccaagaaataaa

SEQ ID NO: 640289 - DNA, 20 bp, Artificial
  CRISPR gRNA sequence
aaatgaaccaagaaataaat

SEQ ID NO: 640290 - DNA, 20 bp, Artificial
  CRISPR gRNA sequence
caagtactttcaagttatac

SEQ ID NO: 640291 - DNA, 20 bp, Artificial
  CRISPR gRNA sequence
tcaagttatactcagtagaa

SEQ ID NO: 640292 - DNA, 20 bp, Artificial
  CRISPR gRNA sequence
caagttatactcagtagaaa

SEQ ID NO: 640293 - DNA, 20 bp, Artificial
  CRISPR gRNA sequence
aagttatactcagtagaaaa

SEQ ID NO: 640294 - DNA, 20 bp, Artificial
  CRISPR gRNA sequence
tactcagtagaaaaaatata

SEQ ID NO: 640295 - DNA, 20 bp, Artificial
  CRISPR gRNA sequence
agtagaaaaaatatatatct

SEQ ID NO: 640296 - DNA, 20 bp, Artificial
  CRISPR gRNA sequence
atcctatatttgagttcccc

SEQ ID NO: 640297 - DNA, 20 bp, Artificial
  CRISPR gRNA sequence
tcctatatttgagttccccc

SEQ ID NO: 640298 - DNA, 20 bp, Artificial
  CRISPR gRNA sequence
tatttgagttcccccaatgt

SEQ ID NO: 640299 - DNA, 20 bp, Artificial
  CRISPR gRNA sequence
gagttcccccaatgtggatg

SEQ ID NO: 640300 - DNA, 20 bp, Artificial
  CRISPR gRNA sequence
agttcccccaatgtggatgt

SEQ ID NO: 640301 - DNA, 20 bp, Artificial
  CRISPR gRNA sequence
ccccaatgtggatgttgtca

SEQ ID NO: 640302 - DNA, 20 bp, Artificial
  CRISPR gRNA sequence
tcataatgtcattagtagaa

SEQ ID NO: 640303 - DNA, 20 bp, Artificial
  CRISPR gRNA sequence
gtagaagtttattttttaaa

SEQ ID NO: 640304 - DNA, 20 bp, Artificial
  CRISPR gRNA sequence
attttttaaagtgacagttt

SEQ ID NO: 640305 - DNA, 20 bp, Artificial
  CRISPR gRNA sequence
ttttttaaagtgacagtttg

SEQ ID NO: 640306 - DNA, 20 bp, Artificial
  CRISPR gRNA sequence
tttaaagtgacagtttgctc

SEQ ID NO: 640307 - DNA, 20 bp, Artificial
  CRISPR gRNA sequence
ttaaagtgacagtttgctcc

SEQ ID NO: 640308 - DNA, 20 bp, Artificial
  CRISPR gRNA sequence
taaagtgacagtttgctcca

SEQ ID NO: 640309 - DNA, 20 bp, Artificial
  CRISPR gRNA sequence
aaagtgacagtttgctccaa

SEQ ID NO: 640310 - DNA, 20 bp, Artificial
  CRISPR gRNA sequence
aagtgacagtttgctccaaa

SEQ ID NO: 640311 - DNA, 20 bp, Artificial
  CRISPR gRNA sequence
gctccaaatgtcacctaaat

SEQ ID NO: 640312 - DNA, 20 bp, Artificial
  CRISPR gRNA sequence
ctccaaatgtcacctaaata

SEQ ID NO: 640313 - DNA, 20 bp, Artificial
  CRISPR gRNA sequence
caaatgtcacctaaataaat

SEQ ID NO: 640314 - DNA, 20 bp, Artificial
  CRISPR gRNA sequence
aataaatattatttatcaac

SEQ ID NO: 640315 - DNA, 20 bp, Artificial
  CRISPR gRNA sequence
tttatcaactctcatttgag

SEQ ID NO: 640316 - DNA, 20 bp, Artificial
  CRISPR gRNA sequence
atcaactctcatttgagaat

SEQ ID NO: 640317 - DNA, 20 bp, Artificial
  CRISPR gRNA sequence
tcaactctcatttgagaatc

SEQ ID NO: 640318 - DNA, 20 bp, Artificial
  CRISPR gRNA sequence
tcatttgagaatctgaatac

SEQ ID NO: 640319 - DNA, 20 bp, Artificial
  CRISPR gRNA sequence
atttgagaatctgaatacaa

SEQ ID NO: 640320 - DNA, 20 bp, Artificial
  CRISPR gRNA sequence
gagaatctgaatacaagtat

SEQ ID NO: 640321 - DNA, 20 bp, Artificial
  CRISPR gRNA sequence
agaatctgaatacaagtatt

SEQ ID NO: 640322 - DNA, 20 bp, Artificial
  CRISPR gRNA sequence
aatacaagtattaattttct

SEQ ID NO: 640323 - DNA, 20 bp, Artificial
  CRISPR gRNA sequence
attttctgaggtcacacaga

SEQ ID NO: 640324 - DNA, 20 bp, Artificial
  CRISPR gRNA sequence
tctgaggtcacacagaagtt

SEQ ID NO: 640325 - DNA, 20 bp, Artificial
  CRISPR gRNA sequence
ctgaggtcacacagaagttt

SEQ ID NO: 640326 - DNA, 20 bp, Artificial
  CRISPR gRNA sequence
tgaggtcacacagaagtttt

SEQ ID NO: 640327 - DNA, 20 bp, Artificial
  CRISPR gRNA sequence
aggtcacacagaagttttct

SEQ ID NO: 640328 - DNA, 20 bp, Artificial
  CRISPR gRNA sequence
tcttttaacaaaactagaat

SEQ ID NO: 640329 - DNA, 20 bp, Artificial
  CRISPR gRNA sequence
cttttaacaaaactagaatc

SEQ ID NO: 640330 - DNA, 20 bp, Artificial
  CRISPR gRNA sequence
ttttaacaaaactagaatcc

SEQ ID NO: 640331 - DNA, 20 bp, Artificial
  CRISPR gRNA sequence
ttaacaaaactagaatcctc

SEQ ID NO: 640332 - DNA, 20 bp, Artificial
  CRISPR gRNA sequence
taacaaaactagaatcctca

SEQ ID NO: 640333 - DNA, 20 bp, Artificial
  CRISPR gRNA sequence
aacaaaactagaatcctcaa

SEQ ID NO: 640334 - DNA, 20 bp, Artificial
  CRISPR gRNA sequence
acaaaactagaatcctcaaa

SEQ ID NO: 640335 - DNA, 20 bp, Artificial
  CRISPR gRNA sequence
gaatcctcaaaggaaacatt

SEQ ID NO: 640336 - DNA, 20 bp, Artificial
  CRISPR gRNA sequence
aaaggaaacatttgattaat

SEQ ID NO: 640337 - DNA, 20 bp, Artificial
  CRISPR gRNA sequence
gattaatttttcattaattg

SEQ ID NO: 640338 - DNA, 20 bp, Artificial
  CRISPR gRNA sequence
attaatttttcattaattga

SEQ ID NO: 640339 - DNA, 20 bp, Artificial
  CRISPR gRNA sequence
atttttcattaattgatata

SEQ ID NO: 640340 - DNA, 20 bp, Artificial
  CRISPR gRNA sequence
ttcattaattgatatatact

SEQ ID NO: 640341 - DNA, 20 bp, Artificial
  CRISPR gRNA sequence
tcattaattgatatatactg

SEQ ID NO: 640342 - DNA, 20 bp, Artificial
  CRISPR gRNA sequence
cattaattgatatatactga

SEQ ID NO: 640343 - DNA, 20 bp, Artificial
  CRISPR gRNA sequence
attaattgatatatactgac

SEQ ID NO: 640344 - DNA, 20 bp, Artificial
  CRISPR gRNA sequence
attgatatatactgacacaa

SEQ ID NO: 640345 - DNA, 20 bp, Artificial
  CRISPR gRNA sequence
atatatactgacacaataac

SEQ ID NO: 640346 - DNA, 20 bp, Artificial
  CRISPR gRNA sequence
acacaataaccattaagtag

SEQ ID NO: 640347 - DNA, 20 bp, Artificial
  CRISPR gRNA sequence
agtagtttatgttaaacaca

SEQ ID NO: 640348 - DNA, 20 bp, Artificial
  CRISPR gRNA sequence
atgttaaacacacccagtgt

SEQ ID NO: 640349 - DNA, 20 bp, Artificial
  CRISPR gRNA sequence
tgttaaacacacccagtgta

SEQ ID NO: 640350 - DNA, 20 bp, Artificial
  CRISPR gRNA sequence
aacacacccagtgtatttta

SEQ ID NO: 640351 - DNA, 20 bp, Artificial
  CRISPR gRNA sequence
taaccatcctcgtttgggtg

SEQ ID NO: 640352 - DNA, 20 bp, Artificial
  CRISPR gRNA sequence
aaccatcctcgtttgggtga

SEQ ID NO: 640353 - DNA, 20 bp, Artificial
  CRISPR gRNA sequence
accatcctcgtttgggtgag

SEQ ID NO: 640354 - DNA, 20 bp, Artificial
  CRISPR gRNA sequence
gtttgggtgagaaatgaaga

SEQ ID NO: 640355 - DNA, 20 bp, Artificial
  CRISPR gRNA sequence
gggtgagaaatgaagataaa

SEQ ID NO: 640356 - DNA, 20 bp, Artificial
  CRISPR gRNA sequence
ggtgagaaatgaagataaaa

SEQ ID NO: 640357 - DNA, 20 bp, Artificial
  CRISPR gRNA sequence
tcatgtgacctctatcttga

SEQ ID NO: 640358 - DNA, 20 bp, Artificial
  CRISPR gRNA sequence
catgtgacctctatcttgat

SEQ ID NO: 640359 - DNA, 20 bp, Artificial
  CRISPR gRNA sequence
atgtgacctctatcttgata

SEQ ID NO: 640360 - DNA, 20 bp, Artificial
  CRISPR gRNA sequence
tatcttgatattatacaagc

SEQ ID NO: 640361 - DNA, 20 bp, Artificial
  CRISPR gRNA sequence
tcttgatattatacaagcac

SEQ ID NO: 640362 - DNA, 20 bp, Artificial
  CRISPR gRNA sequence
gatattatacaagcactgac

SEQ ID NO: 640363 - DNA, 20 bp, Artificial
  CRISPR gRNA sequence
atattatacaagcactgaca

SEQ ID NO: 640364 - DNA, 20 bp, Artificial
  CRISPR gRNA sequence
tacaagcactgacattcaaa

SEQ ID NO: 640365 - DNA, 20 bp, Artificial
  CRISPR gRNA sequence
acattcaaactaaagaatat

SEQ ID NO: 640366 - DNA, 20 bp, Artificial
  CRISPR gRNA sequence
aaactaaagaatatggaaag

SEQ ID NO: 640367 - DNA, 20 bp, Artificial
  CRISPR gRNA sequence
aagaatatggaaagaagatt

SEQ ID NO: 640368 - DNA, 20 bp, Artificial
  CRISPR gRNA sequence
ttgatttttctctgcctggg

SEQ ID NO: 640369 - DNA, 20 bp, Artificial
  CRISPR gRNA sequence
tgatttttctctgcctggga

SEQ ID NO: 640370 - DNA, 20 bp, Artificial
  CRISPR gRNA sequence
gatttttctctgcctgggaa

SEQ ID NO: 640371 - DNA, 20 bp, Artificial
  CRISPR gRNA sequence
atttttctctgcctgggaat

SEQ ID NO: 640372 - DNA, 20 bp, Artificial
  CRISPR gRNA sequence
ttctctgcctgggaataata

SEQ ID NO: 640373 - DNA, 20 bp, Artificial
  CRISPR gRNA sequence
tctctgcctgggaataatat

SEQ ID NO: 640374 - DNA, 20 bp, Artificial
  CRISPR gRNA sequence
ctctgcctgggaataatatt

SEQ ID NO: 640375 - DNA, 20 bp, Artificial
  CRISPR gRNA sequence
tctgcctgggaataatatta

SEQ ID NO: 640376 - DNA, 20 bp, Artificial
  CRISPR gRNA sequence
tgcctgggaataatattatc

SEQ ID NO: 640377 - DNA, 20 bp, Artificial
  CRISPR gRNA sequence
cctgggaataatattatcaa

SEQ ID NO: 640378 - DNA, 20 bp, Artificial
  CRISPR gRNA sequence
ggaataatattatcaaagaa

SEQ ID NO: 640379 - DNA, 20 bp, Artificial
  CRISPR gRNA sequence
tcaaagaactcataaaataa

SEQ ID NO: 640380 - DNA, 20 bp, Artificial
  CRISPR gRNA sequence
ataaaataatcataagcaaa

SEQ ID NO: 640381 - DNA, 20 bp, Artificial
  CRISPR gRNA sequence
agaatacaccaccaccacac

SEQ ID NO: 640382 - DNA, 20 bp, Artificial
  CRISPR gRNA sequence
taccaaatttaggttaatgg

SEQ ID NO: 640383 - DNA, 20 bp, Artificial
  CRISPR gRNA sequence
ccaaatttaggttaatggca

SEQ ID NO: 640384 - DNA, 20 bp, Artificial
  CRISPR gRNA sequence
aggttaatggcacatagcaa

SEQ ID NO: 640385 - DNA, 20 bp, Artificial
  CRISPR gRNA sequence
ggttaatggcacatagcaaa

SEQ ID NO: 640386 - DNA, 20 bp, Artificial
  CRISPR gRNA sequence
atggcacatagcaaagagca

SEQ ID NO: 640387 - DNA, 20 bp, Artificial
  CRISPR gRNA sequence
atatacaaatttaaaacaca

SEQ ID NO: 640388 - DNA, 20 bp, Artificial
  CRISPR gRNA sequence
aaaacacacagacacactaa

SEQ ID NO: 640389 - DNA, 20 bp, Artificial
  CRISPR gRNA sequence
aaacacacagacacactaat

SEQ ID NO: 640390 - DNA, 20 bp, Artificial
  CRISPR gRNA sequence
atgactatgtttttaaatca

SEQ ID NO: 640391 - DNA, 20 bp, Artificial
  CRISPR gRNA sequence
tgtttttaaatcactgattg

SEQ ID NO: 640392 - DNA, 20 bp, Artificial
  CRISPR gRNA sequence
ttaaatcactgattgtaaaa

SEQ ID NO: 640393 - DNA, 20 bp, Artificial
  CRISPR gRNA sequence
taaatcactgattgtaaaaa

SEQ ID NO: 640394 - DNA, 20 bp, Artificial
  CRISPR gRNA sequence
aaatcactgattgtaaaaaa

SEQ ID NO: 640395 - DNA, 20 bp, Artificial
  CRISPR gRNA sequence
aatcactgattgtaaaaaaa

SEQ ID NO: 640396 - DNA, 20 bp, Artificial
  CRISPR gRNA sequence
attgtaaaaaaacaaataat

SEQ ID NO: 640397 - DNA, 20 bp, Artificial
  CRISPR gRNA sequence
taaaaaaacaaataatgttt

SEQ ID NO: 640398 - DNA, 20 bp, Artificial
  CRISPR gRNA sequence
tcccaacgctttcctacaca

SEQ ID NO: 640399 - DNA, 20 bp, Artificial
  CRISPR gRNA sequence
cccaacgctttcctacacat

SEQ ID NO: 640400 - DNA, 20 bp, Artificial
  CRISPR gRNA sequence
ccaacgctttcctacacatc

SEQ ID NO: 640401 - DNA, 20 bp, Artificial
  CRISPR gRNA sequence
tcctacacatcatgtaaact

SEQ ID NO: 640402 - DNA, 20 bp, Artificial
  CRISPR gRNA sequence
cctacacatcatgtaaacta

SEQ ID NO: 640403 - DNA, 20 bp, Artificial
  CRISPR gRNA sequence
ctacacatcatgtaaactaa

SEQ ID NO: 640404 - DNA, 20 bp, Artificial
  CRISPR gRNA sequence
cacatcatgtaaactaaaca

SEQ ID NO: 640405 - DNA, 20 bp, Artificial
  CRISPR gRNA sequence
aacaggattttttttaaaca

SEQ ID NO: 640406 - DNA, 20 bp, Artificial
  CRISPR gRNA sequence
tttttaaacaggcagggaaa

SEQ ID NO: 640407 - DNA, 20 bp, Artificial
  CRISPR gRNA sequence
ttttaaacaggcagggaaaa

SEQ ID NO: 640408 - DNA, 20 bp, Artificial
  CRISPR gRNA sequence
tttaaacaggcagggaaaaa

SEQ ID NO: 640409 - DNA, 20 bp, Artificial
  CRISPR gRNA sequence
ttaaacaggcagggaaaaaa

SEQ ID NO: 640410 - DNA, 20 bp, Artificial
  CRISPR gRNA sequence
taaacaggcagggaaaaaag

SEQ ID NO: 640411 - DNA, 20 bp, Artificial
  CRISPR gRNA sequence
aaacaggcagggaaaaaagt

SEQ ID NO: 640412 - DNA, 20 bp, Artificial
  CRISPR gRNA sequence
aacaggcagggaaaaaagtg

SEQ ID NO: 640413 - DNA, 20 bp, Artificial
  CRISPR gRNA sequence
catgaaaccccattacaaaa

SEQ ID NO: 640414 - DNA, 20 bp, Artificial
  CRISPR gRNA sequence
atgaaaccccattacaaaac

SEQ ID NO: 640415 - DNA, 20 bp, Artificial
  CRISPR gRNA sequence
caaaactaatgcttttccta

SEQ ID NO: 640416 - DNA, 20 bp, Artificial
  CRISPR gRNA sequence
atgcttttcctagggataaa

SEQ ID NO: 640417 - DNA, 20 bp, Artificial
  CRISPR gRNA sequence
ttcctagggataaagtcata

SEQ ID NO: 640418 - DNA, 20 bp, Artificial
  CRISPR gRNA sequence
tcctagggataaagtcatat

SEQ ID NO: 640419 - DNA, 20 bp, Artificial
  CRISPR gRNA sequence
cctagggataaagtcatatg

SEQ ID NO: 640420 - DNA, 20 bp, Artificial
  CRISPR gRNA sequence
ctagggataaagtcatatgc

SEQ ID NO: 640421 - DNA, 20 bp, Artificial
  CRISPR gRNA sequence
gggataaagtcatatgcacc

SEQ ID NO: 640422 - DNA, 20 bp, Artificial
  CRISPR gRNA sequence
gttttccactagaaaaaaaa

SEQ ID NO: 640423 - DNA, 20 bp, Artificial
  CRISPR gRNA sequence
tccactagaaaaaaaaatag

SEQ ID NO: 640424 - DNA, 20 bp, Artificial
  CRISPR gRNA sequence
ccactagaaaaaaaaataga

SEQ ID NO: 640425 - DNA, 20 bp, Artificial
  CRISPR gRNA sequence
cactagaaaaaaaaatagaa

SEQ ID NO: 640426 - DNA, 20 bp, Artificial
  CRISPR gRNA sequence
gaaaaaaaaatagaaaactc

SEQ ID NO: 640427 - DNA, 20 bp, Artificial
  CRISPR gRNA sequence
tttttatagaaattccattt

SEQ ID NO: 640428 - DNA, 20 bp, Artificial
  CRISPR gRNA sequence
tttatagaaattccatttat

SEQ ID NO: 640429 - DNA, 20 bp, Artificial
  CRISPR gRNA sequence
ttatagaaattccatttatt

SEQ ID NO: 640430 - DNA, 20 bp, Artificial
  CRISPR gRNA sequence
tatagaaattccatttattc

SEQ ID NO: 640431 - DNA, 20 bp, Artificial
  CRISPR gRNA sequence
atagaaattccatttattct

SEQ ID NO: 640432 - DNA, 20 bp, Artificial
  CRISPR gRNA sequence
tagaaattccatttattcta

SEQ ID NO: 640433 - DNA, 20 bp, Artificial
  CRISPR gRNA sequence
catttattctaaaacaccga

SEQ ID NO: 640434 - DNA, 20 bp, Artificial
  CRISPR gRNA sequence
attctaaaacaccgaaacaa

SEQ ID NO: 640435 - DNA, 20 bp, Artificial
  CRISPR gRNA sequence
ttctaaaacaccgaaacaaa

SEQ ID NO: 640436 - DNA, 20 bp, Artificial
  CRISPR gRNA sequence
taaaacaccgaaacaaaact

SEQ ID NO: 640437 - DNA, 20 bp, Artificial
  CRISPR gRNA sequence
aaacaccgaaacaaaactac

SEQ ID NO: 640438 - DNA, 20 bp, Artificial
  CRISPR gRNA sequence
ctatataatctcattttcta

SEQ ID NO: 640439 - DNA, 20 bp, Artificial
  CRISPR gRNA sequence
tataatctcattttctaaaa

SEQ ID NO: 640440 - DNA, 20 bp, Artificial
  CRISPR gRNA sequence
attttctaaaataataaaca

SEQ ID NO: 640441 - DNA, 20 bp, Artificial
  CRISPR gRNA sequence
tctaaaataataaacacaaa

SEQ ID NO: 640442 - DNA, 20 bp, Artificial
  CRISPR gRNA sequence
ctaaaataataaacacaaaa

SEQ ID NO: 640443 - DNA, 20 bp, Artificial
  CRISPR gRNA sequence
taaaataataaacacaaaat

SEQ ID NO: 640444 - DNA, 20 bp, Artificial
  CRISPR gRNA sequence
aaataataaacacaaaattc

SEQ ID NO: 640445 - DNA, 20 bp, Artificial
  CRISPR gRNA sequence
ctaaacatgtaatataaaca

SEQ ID NO: 640446 - DNA, 20 bp, Artificial
  CRISPR gRNA sequence
aacatgtaatataaacaaga

SEQ ID NO: 640447 - DNA, 20 bp, Artificial
  CRISPR gRNA sequence
tttaaacacaaataatgtgt

SEQ ID NO: 640448 - DNA, 20 bp, Artificial
  CRISPR gRNA sequence
aaacacaaataatgtgtagt

SEQ ID NO: 640449 - DNA, 20 bp, Artificial
  CRISPR gRNA sequence
aacacaaataatgtgtagta

SEQ ID NO: 640450 - DNA, 20 bp, Artificial
  CRISPR gRNA sequence
aacatggtggtttgcgatac

SEQ ID NO: 640451 - DNA, 20 bp, Artificial
  CRISPR gRNA sequence
gcgatacagttatactgata

SEQ ID NO: 640452 - DNA, 20 bp, Artificial
  CRISPR gRNA sequence
cgatacagttatactgatat

SEQ ID NO: 640453 - DNA, 20 bp, Artificial
  CRISPR gRNA sequence
tactgatataacatctatcg

SEQ ID NO: 640454 - DNA, 20 bp, Artificial
  CRISPR gRNA sequence
atataacatctatcgatcta

SEQ ID NO: 640455 - DNA, 20 bp, Artificial
  CRISPR gRNA sequence
tcgatctatcttcagcagtt

SEQ ID NO: 640456 - DNA, 20 bp, Artificial
  CRISPR gRNA sequence
tcttcagcagttgtacttta

SEQ ID NO: 640457 - DNA, 20 bp, Artificial
  CRISPR gRNA sequence
cagcagttgtactttattta

SEQ ID NO: 640458 - DNA, 20 bp, Artificial
  CRISPR gRNA sequence
agcagttgtactttatttaa

SEQ ID NO: 640459 - DNA, 20 bp, Artificial
  CRISPR gRNA sequence
tactttatttaaattaaatg

SEQ ID NO: 640460 - DNA, 20 bp, Artificial
  CRISPR gRNA sequence
tatttaaattaaatgaaata

SEQ ID NO: 640461 - DNA, 20 bp, Artificial
  CRISPR gRNA sequence
atttaaattaaatgaaatat

SEQ ID NO: 640462 - DNA, 20 bp, Artificial
  CRISPR gRNA sequence
tttaaattaaatgaaatatg

SEQ ID NO: 640463 - DNA, 20 bp, Artificial
  CRISPR gRNA sequence
aaattaaatgaaatatgtat

SEQ ID NO: 640464 - DNA, 20 bp, Artificial
  CRISPR gRNA sequence
aattaaatgaaatatgtatg

SEQ ID NO: 640465 - DNA, 20 bp, Artificial
  CRISPR gRNA sequence
aatgaaatatgtatgtgaag

SEQ ID NO: 640466 - DNA, 20 bp, Artificial
  CRISPR gRNA sequence
tttaactccaaacgtaaatt

SEQ ID NO: 640467 - DNA, 20 bp, Artificial
  CRISPR gRNA sequence
ttaactccaaacgtaaattc

SEQ ID NO: 640468 - DNA, 20 bp, Artificial
  CRISPR gRNA sequence
taactccaaacgtaaattca

SEQ ID NO: 640469 - DNA, 20 bp, Artificial
  CRISPR gRNA sequence
aactccaaacgtaaattcat

SEQ ID NO: 640470 - DNA, 20 bp, Artificial
  CRISPR gRNA sequence
actccaaacgtaaattcata

SEQ ID NO: 640471 - DNA, 20 bp, Artificial
  CRISPR gRNA sequence
caaacgtaaattcatatatt

SEQ ID NO: 640472 - DNA, 20 bp, Artificial
  CRISPR gRNA sequence
atatattcactgctagttat

SEQ ID NO: 640473 - DNA, 20 bp, Artificial
  CRISPR gRNA sequence
actgctagttattataatat

SEQ ID NO: 640474 - DNA, 20 bp, Artificial
  CRISPR gRNA sequence
ctagttattataatattttt

SEQ ID NO: 640475 - DNA, 20 bp, Artificial
  CRISPR gRNA sequence
gttattataatatttttgga

SEQ ID NO: 640476 - DNA, 20 bp, Artificial
  CRISPR gRNA sequence
ttataatatttttggaatta

SEQ ID NO: 640477 - DNA, 20 bp, Artificial
  CRISPR gRNA sequence
taatatttttggaattaaat

SEQ ID NO: 640478 - DNA, 20 bp, Artificial
  CRISPR gRNA sequence
ttggaattaaatgtttaata

SEQ ID NO: 640479 - DNA, 20 bp, Artificial
  CRISPR gRNA sequence
tggaattaaatgtttaatat

SEQ ID NO: 640480 - DNA, 20 bp, Artificial
  CRISPR gRNA sequence
ggaattaaatgtttaatata

SEQ ID NO: 640481 - DNA, 20 bp, Artificial
  CRISPR gRNA sequence
gaattaaatgtttaatatag

SEQ ID NO: 640482 - DNA, 20 bp, Artificial
  CRISPR gRNA sequence
aatgtttaatatagaaaaga

SEQ ID NO: 640483 - DNA, 20 bp, Artificial
  CRISPR gRNA sequence
aatatagaaaagagaataaa

SEQ ID NO: 640484 - DNA, 20 bp, Artificial
  CRISPR gRNA sequence
atatagaaaagagaataaat

SEQ ID NO: 640485 - DNA, 20 bp, Artificial
  CRISPR gRNA sequence
ccctatacttaataccatgg

SEQ ID NO: 640486 - DNA, 20 bp, Artificial
  CRISPR gRNA sequence
cctatacttaataccatgga

SEQ ID NO: 640487 - DNA, 20 bp, Artificial
  CRISPR gRNA sequence
tacttaataccatggaatat

SEQ ID NO: 640488 - DNA, 20 bp, Artificial
  CRISPR gRNA sequence
aataccatggaatatttatc

SEQ ID NO: 640489 - DNA, 20 bp, Artificial
  CRISPR gRNA sequence
ataccatggaatatttatct

SEQ ID NO: 640490 - DNA, 20 bp, Artificial
  CRISPR gRNA sequence
atcttcaattgtttaggata

SEQ ID NO: 640491 - DNA, 20 bp, Artificial
  CRISPR gRNA sequence
tcttcaattgtttaggataa

SEQ ID NO: 640492 - DNA, 20 bp, Artificial
  CRISPR gRNA sequence
caattgtttaggataaatta

SEQ ID NO: 640493 - DNA, 20 bp, Artificial
  CRISPR gRNA sequence
aattgtttaggataaattat

SEQ ID NO: 640494 - DNA, 20 bp, Artificial
  CRISPR gRNA sequence
tttaggataaattatgatat

SEQ ID NO: 640495 - DNA, 20 bp, Artificial
  CRISPR gRNA sequence
aggataaattatgatatttt

SEQ ID NO: 640496 - DNA, 20 bp, Artificial
  CRISPR gRNA sequence
ggataaattatgatatttta

SEQ ID NO: 640497 - DNA, 20 bp, Artificial
  CRISPR gRNA sequence
tgatattttaatttaaaaga

SEQ ID NO: 640498 - DNA, 20 bp, Artificial
  CRISPR gRNA sequence
taatttaaaagaagcttgag

SEQ ID NO: 640499 - DNA, 20 bp, Artificial
  CRISPR gRNA sequence
aatttaaaagaagcttgaga

SEQ ID NO: 640500 - DNA, 20 bp, Artificial
  CRISPR gRNA sequence
atttaaaagaagcttgagag

SEQ ID NO: 640501 - DNA, 20 bp, Artificial
  CRISPR gRNA sequence
aaaagaagcttgagagatgt

SEQ ID NO: 640502 - DNA, 20 bp, Artificial
  CRISPR gRNA sequence
aaagaagcttgagagatgtc

SEQ ID NO: 640503 - DNA, 20 bp, Artificial
  CRISPR gRNA sequence
gagagatgtccaacttccaa

SEQ ID NO: 640504 - DNA, 20 bp, Artificial
  CRISPR gRNA sequence
agagatgtccaacttccaaa

SEQ ID NO: 640505 - DNA, 20 bp, Artificial
  CRISPR gRNA sequence
ccaaattctacatccaaatt

SEQ ID NO: 640506 - DNA, 20 bp, Artificial
  CRISPR gRNA sequence
caaattctacatccaaattc

SEQ ID NO: 640507 - DNA, 20 bp, Artificial
  CRISPR gRNA sequence
tacatccaaattctacaatt

SEQ ID NO: 640508 - DNA, 20 bp, Artificial
  CRISPR gRNA sequence
catccaaattctacaattca

SEQ ID NO: 640509 - DNA, 20 bp, Artificial
  CRISPR gRNA sequence
tacaattcactattaagaaa

SEQ ID NO: 640510 - DNA, 20 bp, Artificial
  CRISPR gRNA sequence
caattcactattaagaaatg

SEQ ID NO: 640511 - DNA, 20 bp, Artificial
  CRISPR gRNA sequence
actattaagaaatgaaagtc

SEQ ID NO: 640512 - DNA, 20 bp, Artificial
  CRISPR gRNA sequence
ttaagaaatgaaagtccagc

SEQ ID NO: 640513 - DNA, 20 bp, Artificial
  CRISPR gRNA sequence
agaaatgaaagtccagctac

SEQ ID NO: 640514 - DNA, 20 bp, Artificial
  CRISPR gRNA sequence
ctccggaggctgaggcagga

SEQ ID NO: 640515 - DNA, 20 bp, Artificial
  CRISPR gRNA sequence
cggaggctgaggcaggagaa

SEQ ID NO: 640516 - DNA, 20 bp, Artificial
  CRISPR gRNA sequence
aggcaggagaagggcgtgaa

SEQ ID NO: 640517 - DNA, 20 bp, Artificial
  CRISPR gRNA sequence
gcgtgagcggagatcgcgcc

SEQ ID NO: 640518 - DNA, 20 bp, Artificial
  CRISPR gRNA sequence
cgtgagcggagatcgcgcca

SEQ ID NO: 640519 - DNA, 20 bp, Artificial
  CRISPR gRNA sequence
cactccagcctgggcgacaa

SEQ ID NO: 640520 - DNA, 20 bp, Artificial
  CRISPR gRNA sequence
cagcctgggcgacaaagcca

SEQ ID NO: 640521 - DNA, 20 bp, Artificial
  CRISPR gRNA sequence
ggcgacaaagccagactccg

SEQ ID NO: 640522 - DNA, 20 bp, Artificial
  CRISPR gRNA sequence
cgtctccaaaaaaaataaat

SEQ ID NO: 640523 - DNA, 20 bp, Artificial
  CRISPR gRNA sequence
caaaaaaaataaataaataa

SEQ ID NO: 640524 - DNA, 20 bp, Artificial
  CRISPR gRNA sequence
agtgagtctgaagacataca

SEQ ID NO: 640525 - DNA, 20 bp, Artificial
  CRISPR gRNA sequence
gtgagtctgaagacatacaa

SEQ ID NO: 640526 - DNA, 20 bp, Artificial
  CRISPR gRNA sequence
aagacatacaactaatatat

SEQ ID NO: 640527 - DNA, 20 bp, Artificial
  CRISPR gRNA sequence
atatataaatcatttcaagg

SEQ ID NO: 640528 - DNA, 20 bp, Artificial
  CRISPR gRNA sequence
caaggaaaattttggtttcc

SEQ ID NO: 640529 - DNA, 20 bp, Artificial
  CRISPR gRNA sequence
aaggaaaattttggtttcct

SEQ ID NO: 640530 - DNA, 20 bp, Artificial
  CRISPR gRNA sequence
tggtttcctcagaataaaag

SEQ ID NO: 640531 - DNA, 20 bp, Artificial
  CRISPR gRNA sequence
ggtttcctcagaataaaaga

SEQ ID NO: 640532 - DNA, 20 bp, Artificial
  CRISPR gRNA sequence
gtttcctcagaataaaagat

SEQ ID NO: 640533 - DNA, 20 bp, Artificial
  CRISPR gRNA sequence
cctcagaataaaagattgtt

SEQ ID NO: 640534 - DNA, 20 bp, Artificial
  CRISPR gRNA sequence
ctcagaataaaagattgtta

SEQ ID NO: 640535 - DNA, 20 bp, Artificial
  CRISPR gRNA sequence
agaataaaagattgttacac

SEQ ID NO: 640536 - DNA, 20 bp, Artificial
  CRISPR gRNA sequence
ttacacacaggtacaagttt

SEQ ID NO: 640537 - DNA, 20 bp, Artificial
  CRISPR gRNA sequence
cacacaggtacaagtttacc

SEQ ID NO: 640538 - DNA, 20 bp, Artificial
  CRISPR gRNA sequence
accaaaaggactgtggaata

SEQ ID NO: 640539 - DNA, 20 bp, Artificial
  CRISPR gRNA sequence
ccaaaaggactgtggaatat

SEQ ID NO: 640540 - DNA, 20 bp, Artificial
  CRISPR gRNA sequence
tggaatatctttatgcaagc

SEQ ID NO: 640541 - DNA, 20 bp, Artificial
  CRISPR gRNA sequence
tatgcaagctgcttaataat

SEQ ID NO: 640542 - DNA, 20 bp, Artificial
  CRISPR gRNA sequence
atgcaagctgcttaataatt

SEQ ID NO: 640543 - DNA, 20 bp, Artificial
  CRISPR gRNA sequence
tgcaagctgcttaataatta

SEQ ID NO: 640544 - DNA, 20 bp, Artificial
  CRISPR gRNA sequence
cttaataattatccatctta

SEQ ID NO: 640545 - DNA, 20 bp, Artificial
  CRISPR gRNA sequence
aataattatccatcttatat

SEQ ID NO: 640546 - DNA, 20 bp, Artificial
  CRISPR gRNA sequence
ataattatccatcttatata

SEQ ID NO: 640547 - DNA, 20 bp, Artificial
  CRISPR gRNA sequence
tccatcttatatacatgaaa

SEQ ID NO: 640548 - DNA, 20 bp, Artificial
  CRISPR gRNA sequence
atatacatgaaattcactga

SEQ ID NO: 640549 - DNA, 20 bp, Artificial
  CRISPR gRNA sequence
tatacatgaaattcactgaa

SEQ ID NO: 640550 - DNA, 20 bp, Artificial
  CRISPR gRNA sequence
actgaatctggtatagagaa

SEQ ID NO: 640551 - DNA, 20 bp, Artificial
  CRISPR gRNA sequence
aatctggtatagagaaggct

SEQ ID NO: 640552 - DNA, 20 bp, Artificial
  CRISPR gRNA sequence
gtatagagaaggcttatttt

SEQ ID NO: 640553 - DNA, 20 bp, Artificial
  CRISPR gRNA sequence
attttaaggattttctagtg

SEQ ID NO: 640554 - DNA, 20 bp, Artificial
  CRISPR gRNA sequence
ttttaaggattttctagtga

SEQ ID NO: 640555 - DNA, 20 bp, Artificial
  CRISPR gRNA sequence
taaggattttctagtgactt

SEQ ID NO: 640556 - DNA, 20 bp, Artificial
  CRISPR gRNA sequence
aaggattttctagtgactta

SEQ ID NO: 640557 - DNA, 20 bp, Artificial
  CRISPR gRNA sequence
aggattttctagtgacttaa

SEQ ID NO: 640558 - DNA, 20 bp, Artificial
  CRISPR gRNA sequence
tctagtgacttaattctaca

SEQ ID NO: 640559 - DNA, 20 bp, Artificial
  CRISPR gRNA sequence
ctagtgacttaattctacat

SEQ ID NO: 640560 - DNA, 20 bp, Artificial
  CRISPR gRNA sequence
tagtgacttaattctacatt

SEQ ID NO: 640561 - DNA, 20 bp, Artificial
  CRISPR gRNA sequence
gtgacttaattctacattta

SEQ ID NO: 640562 - DNA, 20 bp, Artificial
  CRISPR gRNA sequence
aattctacatttacagaatt

SEQ ID NO: 640563 - DNA, 20 bp, Artificial
  CRISPR gRNA sequence
attctacatttacagaattc

SEQ ID NO: 640564 - DNA, 20 bp, Artificial
  CRISPR gRNA sequence
tacatttacagaattctaac

SEQ ID NO: 640565 - DNA, 20 bp, Artificial
  CRISPR gRNA sequence
catttacagaattctaacac

SEQ ID NO: 640566 - DNA, 20 bp, Artificial
  CRISPR gRNA sequence
acagaattctaacaccaaat

SEQ ID NO: 640567 - DNA, 20 bp, Artificial
  CRISPR gRNA sequence
cagaattctaacaccaaatg

SEQ ID NO: 640568 - DNA, 20 bp, Artificial
  CRISPR gRNA sequence
taacaccaaatgaatatgat

SEQ ID NO: 640569 - DNA, 20 bp, Artificial
  CRISPR gRNA sequence
acaccaaatgaatatgataa

SEQ ID NO: 640570 - DNA, 20 bp, Artificial
  CRISPR gRNA sequence
atgtgtcacttgtttaaatc

SEQ ID NO: 640571 - DNA, 20 bp, Artificial
  CRISPR gRNA sequence
gtttaaatcagtggttctta

SEQ ID NO: 640572 - DNA, 20 bp, Artificial
  CRISPR gRNA sequence
tttaaatcagtggttcttaa

SEQ ID NO: 640573 - DNA, 20 bp, Artificial
  CRISPR gRNA sequence
aaatcagtggttcttaaaat

SEQ ID NO: 640574 - DNA, 20 bp, Artificial
  CRISPR gRNA sequence
aatcagtggttcttaaaatg

SEQ ID NO: 640575 - DNA, 20 bp, Artificial
  CRISPR gRNA sequence
ttaaaatgtatccatgaaaa

SEQ ID NO: 640576 - DNA, 20 bp, Artificial
  CRISPR gRNA sequence
aaaatgtatccatgaaaagc

SEQ ID NO: 640577 - DNA, 20 bp, Artificial
  CRISPR gRNA sequence
aaatgtatccatgaaaagca

SEQ ID NO: 640578 - DNA, 20 bp, Artificial
  CRISPR gRNA sequence
tagatattaaattgtagtat

SEQ ID NO: 640579 - DNA, 20 bp, Artificial
  CRISPR gRNA sequence
aattgtagtattccatagct

SEQ ID NO: 640580 - DNA, 20 bp, Artificial
  CRISPR gRNA sequence
tagtattccatagctcaagt

SEQ ID NO: 640581 - DNA, 20 bp, Artificial
  CRISPR gRNA sequence
catagctcaagtaaaataat

SEQ ID NO: 640582 - DNA, 20 bp, Artificial
  CRISPR gRNA sequence
aagtaaaataatactagtct

SEQ ID NO: 640583 - DNA, 20 bp, Artificial
  CRISPR gRNA sequence
gtcttttttccatcacagaa

SEQ ID NO: 640584 - DNA, 20 bp, Artificial
  CRISPR gRNA sequence
ttttccatcacagaaatatg

SEQ ID NO: 640585 - DNA, 20 bp, Artificial
  CRISPR gRNA sequence
tttccatcacagaaatatga

SEQ ID NO: 640586 - DNA, 20 bp, Artificial
  CRISPR gRNA sequence
ttccatcacagaaatatgaa

SEQ ID NO: 640587 - DNA, 20 bp, Artificial
  CRISPR gRNA sequence
tccatcacagaaatatgaat

SEQ ID NO: 640588 - DNA, 20 bp, Artificial
  CRISPR gRNA sequence
ccatcacagaaatatgaatt

SEQ ID NO: 640589 - DNA, 20 bp, Artificial
  CRISPR gRNA sequence
catcacagaaatatgaattt

SEQ ID NO: 640590 - DNA, 20 bp, Artificial
  CRISPR gRNA sequence
cttgaactttctgtatttaa

SEQ ID NO: 640591 - DNA, 20 bp, Artificial
  CRISPR gRNA sequence
ttgaactttctgtatttaaa

SEQ ID NO: 640592 - DNA, 20 bp, Artificial
  CRISPR gRNA sequence
gaactttctgtatttaaatt

SEQ ID NO: 640593 - DNA, 20 bp, Artificial
  CRISPR gRNA sequence
aactttctgtatttaaattt

SEQ ID NO: 640594 - DNA, 20 bp, Artificial
  CRISPR gRNA sequence
tctgtatttaaattttctct

SEQ ID NO: 640595 - DNA, 20 bp, Artificial
  CRISPR gRNA sequence
ctgtatttaaattttctcta

SEQ ID NO: 640596 - DNA, 20 bp, Artificial
  CRISPR gRNA sequence
tgtatttaaattttctctaa

SEQ ID NO: 640597 - DNA, 20 bp, Artificial
  CRISPR gRNA sequence
tatttaaattttctctaata

SEQ ID NO: 640598 - DNA, 20 bp, Artificial
  CRISPR gRNA sequence
aaattttctctaataattta

SEQ ID NO: 640599 - DNA, 20 bp, Artificial
  CRISPR gRNA sequence
aattttctctaataatttat

SEQ ID NO: 640600 - DNA, 20 bp, Artificial
  CRISPR gRNA sequence
tctctaataatttatattaa

SEQ ID NO: 640601 - DNA, 20 bp, Artificial
  CRISPR gRNA sequence
ctctaataatttatattaaa

SEQ ID NO: 640602 - DNA, 20 bp, Artificial
  CRISPR gRNA sequence
tctaataatttatattaaac

SEQ ID NO: 640603 - DNA, 20 bp, Artificial
  CRISPR gRNA sequence
taataatttatattaaacca

SEQ ID NO: 640604 - DNA, 20 bp, Artificial
  CRISPR gRNA sequence
ataatttatattaaaccact

SEQ ID NO: 640605 - DNA, 20 bp, Artificial
  CRISPR gRNA sequence
atattaaaccactgccatga

SEQ ID NO: 640606 - DNA, 20 bp, Artificial
  CRISPR gRNA sequence
tattaaaccactgccatgaa

SEQ ID NO: 640607 - DNA, 20 bp, Artificial
  CRISPR gRNA sequence
aaccactgccatgaactacc

SEQ ID NO: 640608 - DNA, 20 bp, Artificial
  CRISPR gRNA sequence
ccatgaactacctcttatct

SEQ ID NO: 640609 - DNA, 20 bp, Artificial
  CRISPR gRNA sequence
cctcttatctatagtgaatg

SEQ ID NO: 640610 - DNA, 20 bp, Artificial
  CRISPR gRNA sequence
ttatctatagtgaatgctgt

SEQ ID NO: 640611 - DNA, 20 bp, Artificial
  CRISPR gRNA sequence
atctatagtgaatgctgtca

SEQ ID NO: 640612 - DNA, 20 bp, Artificial
  CRISPR gRNA sequence
tctatagtgaatgctgtcaa

SEQ ID NO: 640613 - DNA, 20 bp, Artificial
  CRISPR gRNA sequence
tagtgaatgctgtcaatcaa

SEQ ID NO: 640614 - DNA, 20 bp, Artificial
  CRISPR gRNA sequence
tcaatcaacaaaatgaatga

SEQ ID NO: 640615 - DNA, 20 bp, Artificial
  CRISPR gRNA sequence
taaaaatgggaaacaatctt

SEQ ID NO: 640616 - DNA, 20 bp, Artificial
  CRISPR gRNA sequence
aacatctttgcaatttgttt

SEQ ID NO: 640617 - DNA, 20 bp, Artificial
  CRISPR gRNA sequence
acatctttgcaatttgtttt

SEQ ID NO: 640618 - DNA, 20 bp, Artificial
  CRISPR gRNA sequence
tgcaatttgttttttaaatt

SEQ ID NO: 640619 - DNA, 20 bp, Artificial
  CRISPR gRNA sequence
gcaatttgttttttaaattt

SEQ ID NO: 640620 - DNA, 20 bp, Artificial
  CRISPR gRNA sequence
caatttgttttttaaatttt

SEQ ID NO: 640621 - DNA, 20 bp, Artificial
  CRISPR gRNA sequence
gttttttaaatttttttaat

SEQ ID NO: 640622 - DNA, 20 bp, Artificial
  CRISPR gRNA sequence
ttttttaaatttttttaatt

SEQ ID NO: 640623 - DNA, 20 bp, Artificial
  CRISPR gRNA sequence
tttaaatttttttaattgac

SEQ ID NO: 640624 - DNA, 20 bp, Artificial
  CRISPR gRNA sequence
ttaaatttttttaattgacc

SEQ ID NO: 640625 - DNA, 20 bp, Artificial
  CRISPR gRNA sequence
taaatttttttaattgacct

SEQ ID NO: 640626 - DNA, 20 bp, Artificial
  CRISPR gRNA sequence
aaatttttttaattgacctt

SEQ ID NO: 640627 - DNA, 20 bp, Artificial
  CRISPR gRNA sequence
aatttttttaattgaccttt

SEQ ID NO: 640628 - DNA, 20 bp, Artificial
  CRISPR gRNA sequence
ttttaattgacctttgggct

SEQ ID NO: 640629 - DNA, 20 bp, Artificial
  CRISPR gRNA sequence
tttaattgacctttgggctt

SEQ ID NO: 640630 - DNA, 20 bp, Artificial
  CRISPR gRNA sequence
ttaattgacctttgggcttc

SEQ ID NO: 640631 - DNA, 20 bp, Artificial
  CRISPR gRNA sequence
taattgacctttgggcttcc

SEQ ID NO: 640632 - DNA, 20 bp, Artificial
  CRISPR gRNA sequence
aattgacctttgggcttcca

SEQ ID NO: 640633 - DNA, 20 bp, Artificial
  CRISPR gRNA sequence
attgacctttgggcttccag

SEQ ID NO: 640634 - DNA, 20 bp, Artificial
  CRISPR gRNA sequence
acctttgggcttccagttct

SEQ ID NO: 640635 - DNA, 20 bp, Artificial
  CRISPR gRNA sequence
tgggcttccagttctgatac

SEQ ID NO: 640636 - DNA, 20 bp, Artificial
  CRISPR gRNA sequence
gggcttccagttctgatact

SEQ ID NO: 640637 - DNA, 20 bp, Artificial
  CRISPR gRNA sequence
ggcttccagttctgatacta

SEQ ID NO: 640638 - DNA, 20 bp, Artificial
  CRISPR gRNA sequence
ccagttctgatactattcta

SEQ ID NO: 640639 - DNA, 20 bp, Artificial
  CRISPR gRNA sequence
cagttctgatactattctat

SEQ ID NO: 640640 - DNA, 20 bp, Artificial
  CRISPR gRNA sequence
tgatactattctatgtactt

SEQ ID NO: 640641 - DNA, 20 bp, Artificial
  CRISPR gRNA sequence
atactattctatgtactttt

SEQ ID NO: 640642 - DNA, 20 bp, Artificial
  CRISPR gRNA sequence
ttctatgtactttttttttt

SEQ ID NO: 640643 - DNA, 20 bp, Artificial
  CRISPR gRNA sequence
tatgtacttttttttttttt

SEQ ID NO: 640644 - DNA, 20 bp, Artificial
  CRISPR gRNA sequence
tgtacttttttttttttttt

SEQ ID NO: 640645 - DNA, 20 bp, Artificial
  CRISPR gRNA sequence
tttttttttttttttttttt

SEQ ID NO: 640646 - DNA, 20 bp, Artificial
  CRISPR gRNA sequence
tttttttttttttttttttt

SEQ ID NO: 640647 - DNA, 20 bp, Artificial
  CRISPR gRNA sequence
tttttttttttttttttttt

SEQ ID NO: 640648 - DNA, 20 bp, Artificial
  CRISPR gRNA sequence
tttttttttttttttttttt

SEQ ID NO: 640649 - DNA, 20 bp, Artificial
  CRISPR gRNA sequence
tttttttttttttttttttg

SEQ ID NO: 640650 - DNA, 20 bp, Artificial
  CRISPR gRNA sequence
ttttttttttttttttttga

SEQ ID NO: 640651 - DNA, 20 bp, Artificial
  CRISPR gRNA sequence
tttttttttttttttttgag

SEQ ID NO: 640652 - DNA, 20 bp, Artificial
  CRISPR gRNA sequence
ttttttttttttttttgaga

SEQ ID NO: 640653 - DNA, 20 bp, Artificial
  CRISPR gRNA sequence
tttttttttttttttgagac

SEQ ID NO: 640654 - DNA, 20 bp, Artificial
  CRISPR gRNA sequence
ttttttttttttttgagaca

SEQ ID NO: 640655 - DNA, 20 bp, Artificial
  CRISPR gRNA sequence
tttttttttttttgagacag

SEQ ID NO: 640656 - DNA, 20 bp, Artificial
  CRISPR gRNA sequence
ttttttttttttgagacaga

SEQ ID NO: 640657 - DNA, 20 bp, Artificial
  CRISPR gRNA sequence
tttttttttttgagacagag

SEQ ID NO: 640658 - DNA, 20 bp, Artificial
  CRISPR gRNA sequence
ttttttttttgagacagagt

SEQ ID NO: 640659 - DNA, 20 bp, Artificial
  CRISPR gRNA sequence
tttttttttgagacagagtc

SEQ ID NO: 640660 - DNA, 20 bp, Artificial
  CRISPR gRNA sequence
ttttttttgagacagagtct

SEQ ID NO: 640661 - DNA, 20 bp, Artificial
  CRISPR gRNA sequence
tttttttgagacagagtctt

SEQ ID NO: 640662 - DNA, 20 bp, Artificial
  CRISPR gRNA sequence
ttttttgagacagagtcttg

SEQ ID NO: 640663 - DNA, 20 bp, Artificial
  CRISPR gRNA sequence
tttttgagacagagtcttgc

SEQ ID NO: 640664 - DNA, 20 bp, Artificial
  CRISPR gRNA sequence
ttttgagacagagtcttgct

SEQ ID NO: 640665 - DNA, 20 bp, Artificial
  CRISPR gRNA sequence
tttgagacagagtcttgctc

SEQ ID NO: 640666 - DNA, 20 bp, Artificial
  CRISPR gRNA sequence
ttgagacagagtcttgctct

SEQ ID NO: 640667 - DNA, 20 bp, Artificial
  CRISPR gRNA sequence
tgagacagagtcttgctctc

SEQ ID NO: 640668 - DNA, 20 bp, Artificial
  CRISPR gRNA sequence
gagacagagtcttgctctct

SEQ ID NO: 640669 - DNA, 20 bp, Artificial
  CRISPR gRNA sequence
agacagagtcttgctctctc

SEQ ID NO: 640670 - DNA, 20 bp, Artificial
  CRISPR gRNA sequence
gctctctcgcccaggctgga

SEQ ID NO: 640671 - DNA, 20 bp, Artificial
  CRISPR gRNA sequence
ctctctcgcccaggctggag

SEQ ID NO: 640672 - DNA, 20 bp, Artificial
  CRISPR gRNA sequence
tctcgcccaggctggagtgc

SEQ ID NO: 640673 - DNA, 20 bp, Artificial
  CRISPR gRNA sequence
tcgcccaggctggagtgcag

SEQ ID NO: 640674 - DNA, 20 bp, Artificial
  CRISPR gRNA sequence
gcccaggctggagtgcagtg

SEQ ID NO: 640675 - DNA, 20 bp, Artificial
  CRISPR gRNA sequence
gagtgcagtggtgcaatttc

SEQ ID NO: 640676 - DNA, 20 bp, Artificial
  CRISPR gRNA sequence
cggctcactgcaagctccac

SEQ ID NO: 640677 - DNA, 20 bp, Artificial
  CRISPR gRNA sequence
ggctcactgcaagctccacc

SEQ ID NO: 640678 - DNA, 20 bp, Artificial
  CRISPR gRNA sequence
actgcaagctccacctccca

SEQ ID NO: 640679 - DNA, 20 bp, Artificial
  CRISPR gRNA sequence
caagctccacctcccaggtt

SEQ ID NO: 640680 - DNA, 20 bp, Artificial
  CRISPR gRNA sequence
cacctcccaggttcacgcca

SEQ ID NO: 640681 - DNA, 20 bp, Artificial
  CRISPR gRNA sequence
ccaggttcacgccattctcc

SEQ ID NO: 640682 - DNA, 20 bp, Artificial
  CRISPR gRNA sequence
acgccattctcctgccccag

SEQ ID NO: 640683 - DNA, 20 bp, Artificial
  CRISPR gRNA sequence
tcctgccccagcctcccaag

SEQ ID NO: 640684 - DNA, 20 bp, Artificial
  CRISPR gRNA sequence
ctgccccagcctcccaagta

SEQ ID NO: 640685 - DNA, 20 bp, Artificial
  CRISPR gRNA sequence
ccccagcctcccaagtagct

SEQ ID NO: 640686 - DNA, 20 bp, Artificial
  CRISPR gRNA sequence
ccaagtagctgggactacag

SEQ ID NO: 640687 - DNA, 20 bp, Artificial
  CRISPR gRNA sequence
ggactacaggcgcccgccac

SEQ ID NO: 640688 - DNA, 20 bp, Artificial
  CRISPR gRNA sequence
caggcgcccgccaccatgtc

SEQ ID NO: 640689 - DNA, 20 bp, Artificial
  CRISPR gRNA sequence
atttttgtgtatttttagta

SEQ ID NO: 640690 - DNA, 20 bp, Artificial
  CRISPR gRNA sequence
ttgtgtatttttagtagaga

SEQ ID NO: 640691 - DNA, 20 bp, Artificial
  CRISPR gRNA sequence
tgtgtatttttagtagagac

SEQ ID NO: 640692 - DNA, 20 bp, Artificial
  CRISPR gRNA sequence
gtgtatttttagtagagacg

SEQ ID NO: 640693 - DNA, 20 bp, Artificial
  CRISPR gRNA sequence
tgtatttttagtagagacgg

SEQ ID NO: 640694 - DNA, 20 bp, Artificial
  CRISPR gRNA sequence
ttagtagagacggggtttca

SEQ ID NO: 640695 - DNA, 20 bp, Artificial
  CRISPR gRNA sequence
tagtagagacggggtttcac

SEQ ID NO: 640696 - DNA, 20 bp, Artificial
  CRISPR gRNA sequence
agtagagacggggtttcacc

SEQ ID NO: 640697 - DNA, 20 bp, Artificial
  CRISPR gRNA sequence
gtagagacggggtttcaccg

SEQ ID NO: 640698 - DNA, 20 bp, Artificial
  CRISPR gRNA sequence
caccgtgttagccaggatgg

SEQ ID NO: 640699 - DNA, 20 bp, Artificial
  CRISPR gRNA sequence
accgtgttagccaggatggt

SEQ ID NO: 640700 - DNA, 20 bp, Artificial
  CRISPR gRNA sequence
gccaggatggtctcgatctc

SEQ ID NO: 640701 - DNA, 20 bp, Artificial
  CRISPR gRNA sequence
gatctcctgacctcgtgatc

SEQ ID NO: 640702 - DNA, 20 bp, Artificial
  CRISPR gRNA sequence
ctgacctcgtgatccaccct

SEQ ID NO: 640703 - DNA, 20 bp, Artificial
  CRISPR gRNA sequence
acctcgtgatccaccctcct

SEQ ID NO: 640704 - DNA, 20 bp, Artificial
  CRISPR gRNA sequence
gtgatccaccctcctcggcc

SEQ ID NO: 640705 - DNA, 20 bp, Artificial
  CRISPR gRNA sequence
ctcggcctcccaaagtactg

SEQ ID NO: 640706 - DNA, 20 bp, Artificial
  CRISPR gRNA sequence
ggcctcccaaagtactggga

SEQ ID NO: 640707 - DNA, 20 bp, Artificial
  CRISPR gRNA sequence
ccaaagtactgggattacag

SEQ ID NO: 640708 - DNA, 20 bp, Artificial
  CRISPR gRNA sequence
ggattacaggtgtgagccac

SEQ ID NO: 640709 - DNA, 20 bp, Artificial
  CRISPR gRNA sequence
caggtgtgagccaccgcacc

SEQ ID NO: 640710 - DNA, 20 bp, Artificial
  CRISPR gRNA sequence
ttctatgtacttattttttt

SEQ ID NO: 640711 - DNA, 20 bp, Artificial
  CRISPR gRNA sequence
tatgtacttattttttttaa

SEQ ID NO: 640712 - DNA, 20 bp, Artificial
  CRISPR gRNA sequence
tgtacttattttttttaatc

SEQ ID NO: 640713 - DNA, 20 bp, Artificial
  CRISPR gRNA sequence
attttttttaatcatgttta

SEQ ID NO: 640714 - DNA, 20 bp, Artificial
  CRISPR gRNA sequence
ttttttttaatcatgtttac

SEQ ID NO: 640715 - DNA, 20 bp, Artificial
  CRISPR gRNA sequence
tttttaatcatgtttacatt

SEQ ID NO: 640716 - DNA, 20 bp, Artificial
  CRISPR gRNA sequence
ttttaatcatgtttacatta

SEQ ID NO: 640717 - DNA, 20 bp, Artificial
  CRISPR gRNA sequence
tttaatcatgtttacattag

SEQ ID NO: 640718 - DNA, 20 bp, Artificial
  CRISPR gRNA sequence
ttaatcatgtttacattagt

SEQ ID NO: 640719 - DNA, 20 bp, Artificial
  CRISPR gRNA sequence
taatcatgtttacattagtt

SEQ ID NO: 640720 - DNA, 20 bp, Artificial
  CRISPR gRNA sequence
aatcatgtttacattagttt

SEQ ID NO: 640721 - DNA, 20 bp, Artificial
  CRISPR gRNA sequence
atcatgtttacattagtttg

SEQ ID NO: 640722 - DNA, 20 bp, Artificial
  CRISPR gRNA sequence
acattagtttggaagataaa

SEQ ID NO: 640723 - DNA, 20 bp, Artificial
  CRISPR gRNA sequence
cattagtttggaagataaaa

SEQ ID NO: 640724 - DNA, 20 bp, Artificial
  CRISPR gRNA sequence
gtttggaagataaaattcta

SEQ ID NO: 640725 - DNA, 20 bp, Artificial
  CRISPR gRNA sequence
ggaagataaaattctatcta

SEQ ID NO: 640726 - DNA, 20 bp, Artificial
  CRISPR gRNA sequence
gaagataaaattctatctat

SEQ ID NO: 640727 - DNA, 20 bp, Artificial
  CRISPR gRNA sequence
tatctatatttctctctaaa

SEQ ID NO: 640728 - DNA, 20 bp, Artificial
  CRISPR gRNA sequence
tctatatttctctctaaaat

SEQ ID NO: 640729 - DNA, 20 bp, Artificial
  CRISPR gRNA sequence
tatttctctctaaaatctag

SEQ ID NO: 640730 - DNA, 20 bp, Artificial
  CRISPR gRNA sequence
ctctctaaaatctagctttg

SEQ ID NO: 640731 - DNA, 20 bp, Artificial
  CRISPR gRNA sequence
tctctaaaatctagctttgt

SEQ ID NO: 640732 - DNA, 20 bp, Artificial
  CRISPR gRNA sequence
tctaaaatctagctttgttt

SEQ ID NO: 640733 - DNA, 20 bp, Artificial
  CRISPR gRNA sequence
taaaatctagctttgtttaa

SEQ ID NO: 640734 - DNA, 20 bp, Artificial
  CRISPR gRNA sequence
aaatctagctttgtttaatc

SEQ ID NO: 640735 - DNA, 20 bp, Artificial
  CRISPR gRNA sequence
gctttgtttaatctataaca

SEQ ID NO: 640736 - DNA, 20 bp, Artificial
  CRISPR gRNA sequence
tgtttaatctataacacaag

SEQ ID NO: 640737 - DNA, 20 bp, Artificial
  CRISPR gRNA sequence
gtttaatctataacacaagt

SEQ ID NO: 640738 - DNA, 20 bp, Artificial
  CRISPR gRNA sequence
tttaatctataacacaagtg

SEQ ID NO: 640739 - DNA, 20 bp, Artificial
  CRISPR gRNA sequence
aatctataacacaagtgggt

SEQ ID NO: 640740 - DNA, 20 bp, Artificial
  CRISPR gRNA sequence
atctataacacaagtgggtt

SEQ ID NO: 640741 - DNA, 20 bp, Artificial
  CRISPR gRNA sequence
taacacaagtgggttagagt

SEQ ID NO: 640742 - DNA, 20 bp, Artificial
  CRISPR gRNA sequence
gagtagaagattgcatattc

SEQ ID NO: 640743 - DNA, 20 bp, Artificial
  CRISPR gRNA sequence
catattcctttccgtcttaa

SEQ ID NO: 640744 - DNA, 20 bp, Artificial
  CRISPR gRNA sequence
ctttccgtcttaagagcttt

SEQ ID NO: 640745 - DNA, 20 bp, Artificial
  CRISPR gRNA sequence
tccgtcttaagagctttatg

SEQ ID NO: 640746 - DNA, 20 bp, Artificial
  CRISPR gRNA sequence
ccgtcttaagagctttatga

SEQ ID NO: 640747 - DNA, 20 bp, Artificial
  CRISPR gRNA sequence
cgtcttaagagctttatgat

SEQ ID NO: 640748 - DNA, 20 bp, Artificial
  CRISPR gRNA sequence
aagagctttatgatcctact

SEQ ID NO: 640749 - DNA, 20 bp, Artificial
  CRISPR gRNA sequence
agagctttatgatcctacta

SEQ ID NO: 640750 - DNA, 20 bp, Artificial
  CRISPR gRNA sequence
tatgatcctactaaggatcc

SEQ ID NO: 640751 - DNA, 20 bp, Artificial
  CRISPR gRNA sequence
atgatcctactaaggatccc

SEQ ID NO: 640752 - DNA, 20 bp, Artificial
  CRISPR gRNA sequence
tgatcctactaaggatccca

SEQ ID NO: 640753 - DNA, 20 bp, Artificial
  CRISPR gRNA sequence
ctaaggatcccactgataaa

SEQ ID NO: 640754 - DNA, 20 bp, Artificial
  CRISPR gRNA sequence
aggatcccactgataaacgc

SEQ ID NO: 640755 - DNA, 20 bp, Artificial
  CRISPR gRNA sequence
ataaacgcacatattcctgt

SEQ ID NO: 640756 - DNA, 20 bp, Artificial
  CRISPR gRNA sequence
ctgtatcctcaactcttcaa

SEQ ID NO: 640757 - DNA, 20 bp, Artificial
  CRISPR gRNA sequence
tatcctcaactcttcaagtg

SEQ ID NO: 640758 - DNA, 20 bp, Artificial
  CRISPR gRNA sequence
aactcttcaagtgtaaacag

SEQ ID NO: 640759 - DNA, 20 bp, Artificial
  CRISPR gRNA sequence
ttcaagtgtaaacagattat

SEQ ID NO: 640760 - DNA, 20 bp, Artificial
  CRISPR gRNA sequence
caagtgtaaacagattatgt

SEQ ID NO: 640761 - DNA, 20 bp, Artificial
  CRISPR gRNA sequence
aagtgtaaacagattatgtg

SEQ ID NO: 640762 - DNA, 20 bp, Artificial
  CRISPR gRNA sequence
tgtgtcctttaaaaaaaaca

SEQ ID NO: 640763 - DNA, 20 bp, Artificial
  CRISPR gRNA sequence
taaaaaaaacaattcatgaa

SEQ ID NO: 640764 - DNA, 20 bp, Artificial
  CRISPR gRNA sequence
aaaaaaaacaattcatgaat

SEQ ID NO: 640765 - DNA, 20 bp, Artificial
  CRISPR gRNA sequence
aaaaaaacaattcatgaata

SEQ ID NO: 640766 - DNA, 20 bp, Artificial
  CRISPR gRNA sequence
atgaatacaaagatttatgt

SEQ ID NO: 640767 - DNA, 20 bp, Artificial
  CRISPR gRNA sequence
atgttttgctatattatttt

SEQ ID NO: 640768 - DNA, 20 bp, Artificial
  CRISPR gRNA sequence
tgttttgctatattatttta

SEQ ID NO: 640769 - DNA, 20 bp, Artificial
  CRISPR gRNA sequence
tgctatattattttagaagg

SEQ ID NO: 640770 - DNA, 20 bp, Artificial
  CRISPR gRNA sequence
gctatattattttagaaggg

SEQ ID NO: 640771 - DNA, 20 bp, Artificial
  CRISPR gRNA sequence
ctatattattttagaagggt

SEQ ID NO: 640772 - DNA, 20 bp, Artificial
  CRISPR gRNA sequence
tattattttagaagggtaga

SEQ ID NO: 640773 - DNA, 20 bp, Artificial
  CRISPR gRNA sequence
ttttagaagggtagagaaat

SEQ ID NO: 640774 - DNA, 20 bp, Artificial
  CRISPR gRNA sequence
tagaagggtagagaaattgg

SEQ ID NO: 640775 - DNA, 20 bp, Artificial
  CRISPR gRNA sequence
agaagggtagagaaattggc

SEQ ID NO: 640776 - DNA, 20 bp, Artificial
  CRISPR gRNA sequence
gaagggtagagaaattggct

SEQ ID NO: 640777 - DNA, 20 bp, Artificial
  CRISPR gRNA sequence
gctgaaattgctaagaaaac

SEQ ID NO: 640778 - DNA, 20 bp, Artificial
  CRISPR gRNA sequence
aaattgctaagaaaacttaa

SEQ ID NO: 640779 - DNA, 20 bp, Artificial
  CRISPR gRNA sequence
ctaagaaaacttaaaaatgt

SEQ ID NO: 640780 - DNA, 20 bp, Artificial
  CRISPR gRNA sequence
agaaaacttaaaaatgtaga

SEQ ID NO: 640781 - DNA, 20 bp, Artificial
  CRISPR gRNA sequence
aaaaatgtagacagtaatat

SEQ ID NO: 640782 - DNA, 20 bp, Artificial
  CRISPR gRNA sequence
aaaatgtagacagtaatatt

SEQ ID NO: 640783 - DNA, 20 bp, Artificial
  CRISPR gRNA sequence
tatcttctgttgaaaatgtt

SEQ ID NO: 640784 - DNA, 20 bp, Artificial
  CRISPR gRNA sequence
atcttctgttgaaaatgtta

SEQ ID NO: 640785 - DNA, 20 bp, Artificial
  CRISPR gRNA sequence
tcttctgttgaaaatgttaa

SEQ ID NO: 640786 - DNA, 20 bp, Artificial
  CRISPR gRNA sequence
ctgttgaaaatgttaaaaat

SEQ ID NO: 640787 - DNA, 20 bp, Artificial
  CRISPR gRNA sequence
tgttgaaaatgttaaaaatg

SEQ ID NO: 640788 - DNA, 20 bp, Artificial
  CRISPR gRNA sequence
ttgaaaatgttaaaaatgta

SEQ ID NO: 640789 - DNA, 20 bp, Artificial
  CRISPR gRNA sequence
aaaatgttaaaaatgtactt

SEQ ID NO: 640790 - DNA, 20 bp, Artificial
  CRISPR gRNA sequence
aaaatgtactttctattttt

SEQ ID NO: 640791 - DNA, 20 bp, Artificial
  CRISPR gRNA sequence
tctatttttaacaaaggttt

SEQ ID NO: 640792 - DNA, 20 bp, Artificial
  CRISPR gRNA sequence
ctatttttaacaaaggtttt

SEQ ID NO: 640793 - DNA, 20 bp, Artificial
  CRISPR gRNA sequence
tatttttaacaaaggttttt

SEQ ID NO: 640794 - DNA, 20 bp, Artificial
  CRISPR gRNA sequence
tttttaacaaaggtttttct

SEQ ID NO: 640795 - DNA, 20 bp, Artificial
  CRISPR gRNA sequence
ttaacaaaggtttttcttcc

SEQ ID NO: 640796 - DNA, 20 bp, Artificial
  CRISPR gRNA sequence
taacaaaggtttttcttccc

SEQ ID NO: 640797 - DNA, 20 bp, Artificial
  CRISPR gRNA sequence
aacaaaggtttttcttccct

SEQ ID NO: 640798 - DNA, 20 bp, Artificial
  CRISPR gRNA sequence
acaaaggtttttcttccctt

SEQ ID NO: 640799 - DNA, 20 bp, Artificial
  CRISPR gRNA sequence
ttcttcccttttcttaacat

SEQ ID NO: 640800 - DNA, 20 bp, Artificial
  CRISPR gRNA sequence
tcttcccttttcttaacatt

SEQ ID NO: 640801 - DNA, 20 bp, Artificial
  CRISPR gRNA sequence
cttcccttttcttaacatta

SEQ ID NO: 640802 - DNA, 20 bp, Artificial
  CRISPR gRNA sequence
ttcccttttcttaacattaa

SEQ ID NO: 640803 - DNA, 20 bp, Artificial
  CRISPR gRNA sequence
cccttttcttaacattaaat

SEQ ID NO: 640804 - DNA, 20 bp, Artificial
  CRISPR gRNA sequence
ccttttcttaacattaaatt

SEQ ID NO: 640805 - DNA, 20 bp, Artificial
  CRISPR gRNA sequence
ttcttaacattaaattagtt

SEQ ID NO: 640806 - DNA, 20 bp, Artificial
  CRISPR gRNA sequence
tcttaacattaaattagttc

SEQ ID NO: 640807 - DNA, 20 bp, Artificial
  CRISPR gRNA sequence
cttaacattaaattagttct

SEQ ID NO: 640808 - DNA, 20 bp, Artificial
  CRISPR gRNA sequence
ttaacattaaattagttctc

SEQ ID NO: 640809 - DNA, 20 bp, Artificial
  CRISPR gRNA sequence
aacattaaattagttctcaa

SEQ ID NO: 640810 - DNA, 20 bp, Artificial
  CRISPR gRNA sequence
acattaaattagttctcaat

SEQ ID NO: 640811 - DNA, 20 bp, Artificial
  CRISPR gRNA sequence
aattagttctcaattcacag

SEQ ID NO: 640812 - DNA, 20 bp, Artificial
  CRISPR gRNA sequence
gttctcaattcacagcaaca

SEQ ID NO: 640813 - DNA, 20 bp, Artificial
  CRISPR gRNA sequence
tcaattcacagcaacaatta

SEQ ID NO: 640814 - DNA, 20 bp, Artificial
  CRISPR gRNA sequence
aattcacagcaacaattact

SEQ ID NO: 640815 - DNA, 20 bp, Artificial
  CRISPR gRNA sequence
acagcaacaattactatatt

SEQ ID NO: 640816 - DNA, 20 bp, Artificial
  CRISPR gRNA sequence
ctatattctttccagaaaca

SEQ ID NO: 640817 - DNA, 20 bp, Artificial
  CRISPR gRNA sequence
tattctttccagaaacaaaa

SEQ ID NO: 640818 - DNA, 20 bp, Artificial
  CRISPR gRNA sequence
tttccagaaacaaaatcagt

SEQ ID NO: 640819 - DNA, 20 bp, Artificial
  CRISPR gRNA sequence
tccagaaacaaaatcagtat

SEQ ID NO: 640820 - DNA, 20 bp, Artificial
  CRISPR gRNA sequence
ccagaaacaaaatcagtatc

SEQ ID NO: 640821 - DNA, 20 bp, Artificial
  CRISPR gRNA sequence
cagaaacaaaatcagtatcc

SEQ ID NO: 640822 - DNA, 20 bp, Artificial
  CRISPR gRNA sequence
cagaggttatgagaaactct

SEQ ID NO: 640823 - DNA, 20 bp, Artificial
  CRISPR gRNA sequence
tgagaaactcttttctttat

SEQ ID NO: 640824 - DNA, 20 bp, Artificial
  CRISPR gRNA sequence
ttttctttatgagttatatt

SEQ ID NO: 640825 - DNA, 20 bp, Artificial
  CRISPR gRNA sequence
ttctttatgagttatattat

SEQ ID NO: 640826 - DNA, 20 bp, Artificial
  CRISPR gRNA sequence
tctttatgagttatattata

SEQ ID NO: 640827 - DNA, 20 bp, Artificial
  CRISPR gRNA sequence
ctttatgagttatattataa

SEQ ID NO: 640828 - DNA, 20 bp, Artificial
  CRISPR gRNA sequence
tttatgagttatattataat

SEQ ID NO: 640829 - DNA, 20 bp, Artificial
  CRISPR gRNA sequence
tatgagttatattataatgt

SEQ ID NO: 640830 - DNA, 20 bp, Artificial
  CRISPR gRNA sequence
atgagttatattataatgta

SEQ ID NO: 640831 - DNA, 20 bp, Artificial
  CRISPR gRNA sequence
tgagttatattataatgtaa

SEQ ID NO: 640832 - DNA, 20 bp, Artificial
  CRISPR gRNA sequence
tattataatgtaactcatac

SEQ ID NO: 640833 - DNA, 20 bp, Artificial
  CRISPR gRNA sequence
taatgtaactcatacttaaa

SEQ ID NO: 640834 - DNA, 20 bp, Artificial
  CRISPR gRNA sequence
atacttaaacagtttattta

SEQ ID NO: 640835 - DNA, 20 bp, Artificial
  CRISPR gRNA sequence
aaacagtttatttagttcag

SEQ ID NO: 640836 - DNA, 20 bp, Artificial
  CRISPR gRNA sequence
aacagtttatttagttcaga

SEQ ID NO: 640837 - DNA, 20 bp, Artificial
  CRISPR gRNA sequence
atttagttcagagtgttttc

SEQ ID NO: 640838 - DNA, 20 bp, Artificial
  CRISPR gRNA sequence
tttagttcagagtgttttca

SEQ ID NO: 640839 - DNA, 20 bp, Artificial
  CRISPR gRNA sequence
agttcagagtgttttcaaat

SEQ ID NO: 640840 - DNA, 20 bp, Artificial
  CRISPR gRNA sequence
gttcagagtgttttcaaatc

SEQ ID NO: 640841 - DNA, 20 bp, Artificial
  CRISPR gRNA sequence
agagtgttttcaaatcttcc

SEQ ID NO: 640842 - DNA, 20 bp, Artificial
  CRISPR gRNA sequence
tcaaatcttccatctcaata

SEQ ID NO: 640843 - DNA, 20 bp, Artificial
  CRISPR gRNA sequence
caaatcttccatctcaatag

SEQ ID NO: 640844 - DNA, 20 bp, Artificial
  CRISPR gRNA sequence
aaatcttccatctcaataga

SEQ ID NO: 640845 - DNA, 20 bp, Artificial
  CRISPR gRNA sequence
ccatctcaatagatcttcac

SEQ ID NO: 640846 - DNA, 20 bp, Artificial
  CRISPR gRNA sequence
catctcaatagatcttcaca

SEQ ID NO: 640847 - DNA, 20 bp, Artificial
  CRISPR gRNA sequence
aatagatcttcacactagaa

SEQ ID NO: 640848 - DNA, 20 bp, Artificial
  CRISPR gRNA sequence
cacactagaatatgaagtag

SEQ ID NO: 640849 - DNA, 20 bp, Artificial
  CRISPR gRNA sequence
acactagaatatgaagtagg

SEQ ID NO: 640850 - DNA, 20 bp, Artificial
  CRISPR gRNA sequence
gaatatgaagtaggtgctat

SEQ ID NO: 640851 - DNA, 20 bp, Artificial
  CRISPR gRNA sequence
ttattatccccagtaaacgt

SEQ ID NO: 640852 - DNA, 20 bp, Artificial
  CRISPR gRNA sequence
ttatccccagtaaacgtaca

SEQ ID NO: 640853 - DNA, 20 bp, Artificial
  CRISPR gRNA sequence
tccccagtaaacgtacaaga

SEQ ID NO: 640854 - DNA, 20 bp, Artificial
  CRISPR gRNA sequence
aatcgcagaaaacagaatta

SEQ ID NO: 640855 - DNA, 20 bp, Artificial
  CRISPR gRNA sequence
tttgagcaaaatcacacagc

SEQ ID NO: 640856 - DNA, 20 bp, Artificial
  CRISPR gRNA sequence
gagcaaaatcacacagctaa

SEQ ID NO: 640857 - DNA, 20 bp, Artificial
  CRISPR gRNA sequence
agcaaaatcacacagctaat

SEQ ID NO: 640858 - DNA, 20 bp, Artificial
  CRISPR gRNA sequence
ataagtaagttgaagagcag

SEQ ID NO: 640859 - DNA, 20 bp, Artificial
  CRISPR gRNA sequence
aagagcagggcttaggtttt

SEQ ID NO: 640860 - DNA, 20 bp, Artificial
  CRISPR gRNA sequence
aggttttgttttttgctttg

SEQ ID NO: 640861 - DNA, 20 bp, Artificial
  CRISPR gRNA sequence
ggttttgttttttgctttgc

SEQ ID NO: 640862 - DNA, 20 bp, Artificial
  CRISPR gRNA sequence
tgttttttgctttgccctct

SEQ ID NO: 640863 - DNA, 20 bp, Artificial
  CRISPR gRNA sequence
gttttttgctttgccctcta

SEQ ID NO: 640864 - DNA, 20 bp, Artificial
  CRISPR gRNA sequence
ttttttgctttgccctctaa

SEQ ID NO: 640865 - DNA, 20 bp, Artificial
  CRISPR gRNA sequence
tttgctttgccctctaaata

SEQ ID NO: 640866 - DNA, 20 bp, Artificial
  CRISPR gRNA sequence
ttgctttgccctctaaatac

SEQ ID NO: 640867 - DNA, 20 bp, Artificial
  CRISPR gRNA sequence
tgctttgccctctaaatact

SEQ ID NO: 640868 - DNA, 20 bp, Artificial
  CRISPR gRNA sequence
gctttgccctctaaatactg

SEQ ID NO: 640869 - DNA, 20 bp, Artificial
  CRISPR gRNA sequence
ctttgccctctaaatactgt

SEQ ID NO: 640870 - DNA, 20 bp, Artificial
  CRISPR gRNA sequence
tgccctctaaatactgtgtt

SEQ ID NO: 640871 - DNA, 20 bp, Artificial
  CRISPR gRNA sequence
gccctctaaatactgtgttt

SEQ ID NO: 640872 - DNA, 20 bp, Artificial
  CRISPR gRNA sequence
ccctctaaatactgtgtttc

SEQ ID NO: 640873 - DNA, 20 bp, Artificial
  CRISPR gRNA sequence
taaatactgtgtttcttcat

SEQ ID NO: 640874 - DNA, 20 bp, Artificial
  CRISPR gRNA sequence
aatactgtgtttcttcatcc

SEQ ID NO: 640875 - DNA, 20 bp, Artificial
  CRISPR gRNA sequence
tgtttcttcatccctttgaa

SEQ ID NO: 640876 - DNA, 20 bp, Artificial
  CRISPR gRNA sequence
cttcatccctttgaaaagtg

SEQ ID NO: 640877 - DNA, 20 bp, Artificial
  CRISPR gRNA sequence
ttcatccctttgaaaagtga

SEQ ID NO: 640878 - DNA, 20 bp, Artificial
  CRISPR gRNA sequence
catccctttgaaaagtgagt

SEQ ID NO: 640879 - DNA, 20 bp, Artificial
  CRISPR gRNA sequence
atccctttgaaaagtgagtc

SEQ ID NO: 640880 - DNA, 20 bp, Artificial
  CRISPR gRNA sequence
tgaaaagtgagtccagaagg

SEQ ID NO: 640881 - DNA, 20 bp, Artificial
  CRISPR gRNA sequence
gaaaagtgagtccagaaggg

SEQ ID NO: 640882 - DNA, 20 bp, Artificial
  CRISPR gRNA sequence
aaaagtgagtccagaagggt

SEQ ID NO: 640883 - DNA, 20 bp, Artificial
  CRISPR gRNA sequence
tacattttagtgaaatagag

SEQ ID NO: 640884 - DNA, 20 bp, Artificial
  CRISPR gRNA sequence
acattttagtgaaatagagt

SEQ ID NO: 640885 - DNA, 20 bp, Artificial
  CRISPR gRNA sequence
cattttagtgaaatagagtg

SEQ ID NO: 640886 - DNA, 20 bp, Artificial
  CRISPR gRNA sequence
tagtgaaatagagtgagtgg

SEQ ID NO: 640887 - DNA, 20 bp, Artificial
  CRISPR gRNA sequence
agtgaaatagagtgagtggc

SEQ ID NO: 640888 - DNA, 20 bp, Artificial
  CRISPR gRNA sequence
gtgaaatagagtgagtggct

SEQ ID NO: 640889 - DNA, 20 bp, Artificial
  CRISPR gRNA sequence
cctaattttgacagttctca

SEQ ID NO: 640890 - DNA, 20 bp, Artificial
  CRISPR gRNA sequence
attttgacagttctcattta

SEQ ID NO: 640891 - DNA, 20 bp, Artificial
  CRISPR gRNA sequence
tgacagttctcatttatctg

SEQ ID NO: 640892 - DNA, 20 bp, Artificial
  CRISPR gRNA sequence
gacagttctcatttatctgt

SEQ ID NO: 640893 - DNA, 20 bp, Artificial
  CRISPR gRNA sequence
acagttctcatttatctgtc

SEQ ID NO: 640894 - DNA, 20 bp, Artificial
  CRISPR gRNA sequence
tcatttatctgtctcattag

SEQ ID NO: 640895 - DNA, 20 bp, Artificial
  CRISPR gRNA sequence
atttatctgtctcattagca

SEQ ID NO: 640896 - DNA, 20 bp, Artificial
  CRISPR gRNA sequence
atctgtctcattagcatgga

SEQ ID NO: 640897 - DNA, 20 bp, Artificial
  CRISPR gRNA sequence
tctgtctcattagcatggac

SEQ ID NO: 640898 - DNA, 20 bp, Artificial
  CRISPR gRNA sequence
tctcattagcatggacagac

SEQ ID NO: 640899 - DNA, 20 bp, Artificial
  CRISPR gRNA sequence
attagcatggacagaccaga

SEQ ID NO: 640900 - DNA, 20 bp, Artificial
  CRISPR gRNA sequence
gcatggacagaccagatgga

SEQ ID NO: 640901 - DNA, 20 bp, Artificial
  CRISPR gRNA sequence
tgctgtcatttcctgccaaa

SEQ ID NO: 640902 - DNA, 20 bp, Artificial
  CRISPR gRNA sequence
ctgtcatttcctgccaaacc

SEQ ID NO: 640903 - DNA, 20 bp, Artificial
  CRISPR gRNA sequence
tcatttcctgccaaaccaaa

SEQ ID NO: 640904 - DNA, 20 bp, Artificial
  CRISPR gRNA sequence
cctgccaaaccaaagtgatt

SEQ ID NO: 640905 - DNA, 20 bp, Artificial
  CRISPR gRNA sequence
ctgccaaaccaaagtgattc

SEQ ID NO: 640906 - DNA, 20 bp, Artificial
  CRISPR gRNA sequence
ccaaaccaaagtgattcttc

SEQ ID NO: 640907 - DNA, 20 bp, Artificial
  CRISPR gRNA sequence
ttctctcccatgttaaccaa

SEQ ID NO: 640908 - DNA, 20 bp, Artificial
  CRISPR gRNA sequence
ctctcccatgttaaccaact

SEQ ID NO: 640909 - DNA, 20 bp, Artificial
  CRISPR gRNA sequence
tctcccatgttaaccaactg

SEQ ID NO: 640910 - DNA, 20 bp, Artificial
  CRISPR gRNA sequence
tcccatgttaaccaactgtg

SEQ ID NO: 640911 - DNA, 20 bp, Artificial
  CRISPR gRNA sequence
ccatgttaaccaactgtgtt

SEQ ID NO: 640912 - DNA, 20 bp, Artificial
  CRISPR gRNA sequence
accaactgtgttcacaacca

SEQ ID NO: 640913 - DNA, 20 bp, Artificial
  CRISPR gRNA sequence
tgttcacaaccaaactgctc

SEQ ID NO: 640914 - DNA, 20 bp, Artificial
  CRISPR gRNA sequence
acaaccaaactgctctctga

SEQ ID NO: 640915 - DNA, 20 bp, Artificial
  CRISPR gRNA sequence
ctctctgagttttctgtttc

SEQ ID NO: 640916 - DNA, 20 bp, Artificial
  CRISPR gRNA sequence
tctgagttttctgtttccaa

SEQ ID NO: 640917 - DNA, 20 bp, Artificial
  CRISPR gRNA sequence
tgagttttctgtttccaaac

SEQ ID NO: 640918 - DNA, 20 bp, Artificial
  CRISPR gRNA sequence
agttttctgtttccaaacct

SEQ ID NO: 640919 - DNA, 20 bp, Artificial
  CRISPR gRNA sequence
tctgtttccaaacctatgag

SEQ ID NO: 640920 - DNA, 20 bp, Artificial
  CRISPR gRNA sequence
ctgtttccaaacctatgaga

SEQ ID NO: 640921 - DNA, 20 bp, Artificial
  CRISPR gRNA sequence
tgtttccaaacctatgagaa

SEQ ID NO: 640922 - DNA, 20 bp, Artificial
  CRISPR gRNA sequence
tttccaaacctatgagaaac

SEQ ID NO: 640923 - DNA, 20 bp, Artificial
  CRISPR gRNA sequence
ccaaacctatgagaaacaat

SEQ ID NO: 640924 - DNA, 20 bp, Artificial
  CRISPR gRNA sequence
caaacctatgagaaacaata

SEQ ID NO: 640925 - DNA, 20 bp, Artificial
  CRISPR gRNA sequence
tgagaaacaatagtggcatg

SEQ ID NO: 640926 - DNA, 20 bp, Artificial
  CRISPR gRNA sequence
acttctgatatgtcaggttg

SEQ ID NO: 640927 - DNA, 20 bp, Artificial
  CRISPR gRNA sequence
ctgatatgtcaggttgatat

SEQ ID NO: 640928 - DNA, 20 bp, Artificial
  CRISPR gRNA sequence
tgatatgtcaggttgatatg

SEQ ID NO: 640929 - DNA, 20 bp, Artificial
  CRISPR gRNA sequence
atatgtcaggttgatatgac

SEQ ID NO: 640930 - DNA, 20 bp, Artificial
  CRISPR gRNA sequence
atatgacagtagtactagcc

SEQ ID NO: 640931 - DNA, 20 bp, Artificial
  CRISPR gRNA sequence
gcccatcattgtgacgttaa

SEQ ID NO: 640932 - DNA, 20 bp, Artificial
  CRISPR gRNA sequence
tgacgttaaatctattgaaa

SEQ ID NO: 640933 - DNA, 20 bp, Artificial
  CRISPR gRNA sequence
aatctattgaaaaataaacc

SEQ ID NO: 640934 - DNA, 20 bp, Artificial
  CRISPR gRNA sequence
ttgaaaaataaaccttaaat

SEQ ID NO: 640935 - DNA, 20 bp, Artificial
  CRISPR gRNA sequence
aaaaataaaccttaaataca

SEQ ID NO: 640936 - DNA, 20 bp, Artificial
  CRISPR gRNA sequence
aaatacagcatttgttgttg

SEQ ID NO: 640937 - DNA, 20 bp, Artificial
  CRISPR gRNA sequence
aatacagcatttgttgttgc

SEQ ID NO: 640938 - DNA, 20 bp, Artificial
  CRISPR gRNA sequence
gttgttgctgctattgttgt

SEQ ID NO: 640939 - DNA, 20 bp, Artificial
  CRISPR gRNA sequence
ttgttgctgctattgttgtt

SEQ ID NO: 640940 - DNA, 20 bp, Artificial
  CRISPR gRNA sequence
ttgctgctattgttgttgct

SEQ ID NO: 640941 - DNA, 20 bp, Artificial
  CRISPR gRNA sequence
ctgctattgttgttgctgtc

SEQ ID NO: 640942 - DNA, 20 bp, Artificial
  CRISPR gRNA sequence
ctattgttgttgctgtctaa

SEQ ID NO: 640943 - DNA, 20 bp, Artificial
  CRISPR gRNA sequence
ttgttgttgctgtctaattt

SEQ ID NO: 640944 - DNA, 20 bp, Artificial
  CRISPR gRNA sequence
ttgttgctgtctaattttct

SEQ ID NO: 640945 - DNA, 20 bp, Artificial
  CRISPR gRNA sequence
ttgctgtctaattttctctt

SEQ ID NO: 640946 - DNA, 20 bp, Artificial
  CRISPR gRNA sequence
ctgtctaattttctcttttt

SEQ ID NO: 640947 - DNA, 20 bp, Artificial
  CRISPR gRNA sequence
tctaattttctcttttttgt

SEQ ID NO: 640948 - DNA, 20 bp, Artificial
  CRISPR gRNA sequence
attttctcttttttgttgag

SEQ ID NO: 640949 - DNA, 20 bp, Artificial
  CRISPR gRNA sequence
tctcttttttgttgagggag

SEQ ID NO: 640950 - DNA, 20 bp, Artificial
  CRISPR gRNA sequence
ctcttttttgttgagggaga

SEQ ID NO: 640951 - DNA, 20 bp, Artificial
  CRISPR gRNA sequence
tcttttttgttgagggagaa

SEQ ID NO: 640952 - DNA, 20 bp, Artificial
  CRISPR gRNA sequence
ttttttgttgagggagaagg

SEQ ID NO: 640953 - DNA, 20 bp, Artificial
  CRISPR gRNA sequence
ttttgttgagggagaagggg

SEQ ID NO: 640954 - DNA, 20 bp, Artificial
  CRISPR gRNA sequence
tttgttgagggagaaggggg

SEQ ID NO: 640955 - DNA, 20 bp, Artificial
  CRISPR gRNA sequence
ttgttgagggagaaggggga

SEQ ID NO: 640956 - DNA, 20 bp, Artificial
  CRISPR gRNA sequence
tgttgagggagaagggggag

SEQ ID NO: 640957 - DNA, 20 bp, Artificial
  CRISPR gRNA sequence
gttgagggagaagggggaga

SEQ ID NO: 640958 - DNA, 20 bp, Artificial
  CRISPR gRNA sequence
ttgagggagaagggggagaa

SEQ ID NO: 640959 - DNA, 20 bp, Artificial
  CRISPR gRNA sequence
agggagaagggggagaaggt

SEQ ID NO: 640960 - DNA, 20 bp, Artificial
  CRISPR gRNA sequence
taaagaagagtcttggttgg

SEQ ID NO: 640961 - DNA, 20 bp, Artificial
  CRISPR gRNA sequence
ggttgggtgtcatggctcat

SEQ ID NO: 640962 - DNA, 20 bp, Artificial
  CRISPR gRNA sequence
gttgggtgtcatggctcatg

SEQ ID NO: 640963 - DNA, 20 bp, Artificial
  CRISPR gRNA sequence
ggtgtcatggctcatgcctg

SEQ ID NO: 640964 - DNA, 20 bp, Artificial
  CRISPR gRNA sequence
atgcctgtagtcccaacagt

SEQ ID NO: 640965 - DNA, 20 bp, Artificial
  CRISPR gRNA sequence
tagtcccaacagtttgggag

SEQ ID NO: 640966 - DNA, 20 bp, Artificial
  CRISPR gRNA sequence
gggagcctgggtagatcact

SEQ ID NO: 640967 - DNA, 20 bp, Artificial
  CRISPR gRNA sequence
ggagcctgggtagatcactt

SEQ ID NO: 640968 - DNA, 20 bp, Artificial
  CRISPR gRNA sequence
ggtagatcacttgagcccac

SEQ ID NO: 640969 - DNA, 20 bp, Artificial
  CRISPR gRNA sequence
gagcccactggttcaagacg

SEQ ID NO: 640970 - DNA, 20 bp, Artificial
  CRISPR gRNA sequence
agcccactggttcaagacga

SEQ ID NO: 640971 - DNA, 20 bp, Artificial
  CRISPR gRNA sequence
gttcaagacgagcctgggca

SEQ ID NO: 640972 - DNA, 20 bp, Artificial
  CRISPR gRNA sequence
aagacgagcctgggcaacat

SEQ ID NO: 640973 - DNA, 20 bp, Artificial
  CRISPR gRNA sequence
ggcaacatagtgggatccca

SEQ ID NO: 640974 - DNA, 20 bp, Artificial
  CRISPR gRNA sequence
tacaaaaaatttaaaatgta

SEQ ID NO: 640975 - DNA, 20 bp, Artificial
  CRISPR gRNA sequence
aaaatgtagccaggtgtggt

SEQ ID NO: 640976 - DNA, 20 bp, Artificial
  CRISPR gRNA sequence
aaatgtagccaggtgtggta

SEQ ID NO: 640977 - DNA, 20 bp, Artificial
  CRISPR gRNA sequence
gtagtcccaactacttgggg

SEQ ID NO: 640978 - DNA, 20 bp, Artificial
  CRISPR gRNA sequence
tagtcccaactacttggggg

SEQ ID NO: 640979 - DNA, 20 bp, Artificial
  CRISPR gRNA sequence
cttgggggactgggacagga

SEQ ID NO: 640980 - DNA, 20 bp, Artificial
  CRISPR gRNA sequence
gggggactgggacaggagta

SEQ ID NO: 640981 - DNA, 20 bp, Artificial
  CRISPR gRNA sequence
ggggactgggacaggagtat

SEQ ID NO: 640982 - DNA, 20 bp, Artificial
  CRISPR gRNA sequence
ggacaggagtattgcttcag

SEQ ID NO: 640983 - DNA, 20 bp, Artificial
  CRISPR gRNA sequence
cttcagcccaggagttcaag

SEQ ID NO: 640984 - DNA, 20 bp, Artificial
  CRISPR gRNA sequence
cagcccaggagttcaaggct

SEQ ID NO: 640985 - DNA, 20 bp, Artificial
  CRISPR gRNA sequence
agcccaggagttcaaggctg

SEQ ID NO: 640986 - DNA, 20 bp, Artificial
  CRISPR gRNA sequence
aaggctggagtaagccatga

SEQ ID NO: 640987 - DNA, 20 bp, Artificial
  CRISPR gRNA sequence
gagtaagccatgattgtgcc

SEQ ID NO: 640988 - DNA, 20 bp, Artificial
  CRISPR gRNA sequence
tgccactgtactgaagccta

SEQ ID NO: 640989 - DNA, 20 bp, Artificial
  CRISPR gRNA sequence
tactgaagcctaggtgacac

SEQ ID NO: 640990 - DNA, 20 bp, Artificial
  CRISPR gRNA sequence
aagcctaggtgacacaatag

SEQ ID NO: 640991 - DNA, 20 bp, Artificial
  CRISPR gRNA sequence
ggtgacacaatagaaaagaa

SEQ ID NO: 640992 - DNA, 20 bp, Artificial
  CRISPR gRNA sequence
catctataaaccatctccat

SEQ ID NO: 640993 - DNA, 20 bp, Artificial
  CRISPR gRNA sequence
taaaccatctccataaattt

SEQ ID NO: 640994 - DNA, 20 bp, Artificial
  CRISPR gRNA sequence
cataaatttcttgtatacta

SEQ ID NO: 640995 - DNA, 20 bp, Artificial
  CRISPR gRNA sequence
cttgtatactaccaagagag

SEQ ID NO: 640996 - DNA, 20 bp, Artificial
  CRISPR gRNA sequence
ttgtatactaccaagagaga

SEQ ID NO: 640997 - DNA, 20 bp, Artificial
  CRISPR gRNA sequence
gtatactaccaagagagaaa

SEQ ID NO: 640998 - DNA, 20 bp, Artificial
  CRISPR gRNA sequence
tatactaccaagagagaaag

SEQ ID NO: 640999 - DNA, 20 bp, Artificial
  CRISPR gRNA sequence
ccaagagagaaagcttgtgt

SEQ ID NO: 641000 - DNA, 20 bp, Artificial
  CRISPR gRNA sequence
gtgttgtcccaccacagttg

SEQ ID NO: 641001 - DNA, 20 bp, Artificial
  CRISPR gRNA sequence
tgttgtcccaccacagttgg

SEQ ID NO: 641002 - DNA, 20 bp, Artificial
  CRISPR gRNA sequence
tcccaccacagttgggcagg

SEQ ID NO: 641003 - DNA, 20 bp, Artificial
  CRISPR gRNA sequence
ggcaggatacatttgccagc

SEQ ID NO: 641004 - DNA, 20 bp, Artificial
  CRISPR gRNA sequence
gccagcccaagtaaaaatat

SEQ ID NO: 641005 - DNA, 20 bp, Artificial
  CRISPR gRNA sequence
ccagcccaagtaaaaatatg

SEQ ID NO: 641006 - DNA, 20 bp, Artificial
  CRISPR gRNA sequence
aaataggcaaagcttgtcat

SEQ ID NO: 641007 - DNA, 20 bp, Artificial
  CRISPR gRNA sequence
gtcatctcctgatttttact

SEQ ID NO: 641008 - DNA, 20 bp, Artificial
  CRISPR gRNA sequence
tcatctcctgatttttactt

SEQ ID NO: 641009 - DNA, 20 bp, Artificial
  CRISPR gRNA sequence
ctgatttttactttctctat

SEQ ID NO: 641010 - DNA, 20 bp, Artificial
  CRISPR gRNA sequence
atttttactttctctatgtt

SEQ ID NO: 641011 - DNA, 20 bp, Artificial
  CRISPR gRNA sequence
ttactttctctatgttttcc

SEQ ID NO: 641012 - DNA, 20 bp, Artificial
  CRISPR gRNA sequence
tactttctctatgttttcct

SEQ ID NO: 641013 - DNA, 20 bp, Artificial
  CRISPR gRNA sequence
actttctctatgttttccta

SEQ ID NO: 641014 - DNA, 20 bp, Artificial
  CRISPR gRNA sequence
ctttctctatgttttcctag

SEQ ID NO: 641015 - DNA, 20 bp, Artificial
  CRISPR gRNA sequence
tctctatgttttcctagcag

SEQ ID NO: 641016 - DNA, 20 bp, Artificial
  CRISPR gRNA sequence
ctctatgttttcctagcagc

SEQ ID NO: 641017 - DNA, 20 bp, Artificial
  CRISPR gRNA sequence
tctatgttttcctagcagca

SEQ ID NO: 641018 - DNA, 20 bp, Artificial
  CRISPR gRNA sequence
tatgttttcctagcagcaac

SEQ ID NO: 641019 - DNA, 20 bp, Artificial
  CRISPR gRNA sequence
tgttttcctagcagcaactt

SEQ ID NO: 641020 - DNA, 20 bp, Artificial
  CRISPR gRNA sequence
tcctagcagcaacttccatt

SEQ ID NO: 641021 - DNA, 20 bp, Artificial
  CRISPR gRNA sequence
cctagcagcaacttccattt

SEQ ID NO: 641022 - DNA, 20 bp, Artificial
  CRISPR gRNA sequence
ctagcagcaacttccatttt

SEQ ID NO: 641023 - DNA, 20 bp, Artificial
  CRISPR gRNA sequence
gcagcaacttccatttttcc

SEQ ID NO: 641024 - DNA, 20 bp, Artificial
  CRISPR gRNA sequence
ccatttttcccaaagtgcta

SEQ ID NO: 641025 - DNA, 20 bp, Artificial
  CRISPR gRNA sequence
catttttcccaaagtgctac

SEQ ID NO: 641026 - DNA, 20 bp, Artificial
  CRISPR gRNA sequence
ttcccaaagtgctacccacc

SEQ ID NO: 641027 - DNA, 20 bp, Artificial
  CRISPR gRNA sequence
tcccaaagtgctacccacct

SEQ ID NO: 641028 - DNA, 20 bp, Artificial
  CRISPR gRNA sequence
cccaaagtgctacccacctt

SEQ ID NO: 641029 - DNA, 20 bp, Artificial
  CRISPR gRNA sequence
ccaaagtgctacccacctta

SEQ ID NO: 641030 - DNA, 20 bp, Artificial
  CRISPR gRNA sequence
cccaccttaaggcatctaat

SEQ ID NO: 641031 - DNA, 20 bp, Artificial
  CRISPR gRNA sequence
aaggcatctaattagtgccc

SEQ ID NO: 641032 - DNA, 20 bp, Artificial
  CRISPR gRNA sequence
aggcatctaattagtgccca

SEQ ID NO: 641033 - DNA, 20 bp, Artificial
  CRISPR gRNA sequence
attagtgcccactgtttttc

SEQ ID NO: 641034 - DNA, 20 bp, Artificial
  CRISPR gRNA sequence
gtgcccactgtttttccacc

SEQ ID NO: 641035 - DNA, 20 bp, Artificial
  CRISPR gRNA sequence
tttttccaccctccagtttg

SEQ ID NO: 641036 - DNA, 20 bp, Artificial
  CRISPR gRNA sequence
ttccaccctccagtttgatg

SEQ ID NO: 641037 - DNA, 20 bp, Artificial
  CRISPR gRNA sequence
tccaccctccagtttgatgc

SEQ ID NO: 641038 - DNA, 20 bp, Artificial
  CRISPR gRNA sequence
ccaccctccagtttgatgcc

SEQ ID NO: 641039 - DNA, 20 bp, Artificial
  CRISPR gRNA sequence
caccctccagtttgatgccc

SEQ ID NO: 641040 - DNA, 20 bp, Artificial
  CRISPR gRNA sequence
cagtttgatgcccagctttc

SEQ ID NO: 641041 - DNA, 20 bp, Artificial
  CRISPR gRNA sequence
gatgcccagctttctatgac

SEQ ID NO: 641042 - DNA, 20 bp, Artificial
  CRISPR gRNA sequence
atgcccagctttctatgaca

SEQ ID NO: 641043 - DNA, 20 bp, Artificial
  CRISPR gRNA sequence
tctatgacataccctaaatg

SEQ ID NO: 641044 - DNA, 20 bp, Artificial
  CRISPR gRNA sequence
ctatgacataccctaaatga

SEQ ID NO: 641045 - DNA, 20 bp, Artificial
  CRISPR gRNA sequence
tatgacataccctaaatgaa

SEQ ID NO: 641046 - DNA, 20 bp, Artificial
  CRISPR gRNA sequence
tgacataccctaaatgaacc

SEQ ID NO: 641047 - DNA, 20 bp, Artificial
  CRISPR gRNA sequence
aatgaaccacactttgtatt

SEQ ID NO: 641048 - DNA, 20 bp, Artificial
  CRISPR gRNA sequence
tgtatttgctttcctatcac

SEQ ID NO: 641049 - DNA, 20 bp, Artificial
  CRISPR gRNA sequence
gtatttgctttcctatcacc

SEQ ID NO: 641050 - DNA, 20 bp, Artificial
  CRISPR gRNA sequence
tatttgctttcctatcacct

SEQ ID NO: 641051 - DNA, 20 bp, Artificial
  CRISPR gRNA sequence
gctttcctatcacctgcccc

SEQ ID NO: 641052 - DNA, 20 bp, Artificial
  CRISPR gRNA sequence
ctttcctatcacctgccccc

SEQ ID NO: 641053 - DNA, 20 bp, Artificial
  CRISPR gRNA sequence
tcctatcacctgcccccaat

SEQ ID NO: 641054 - DNA, 20 bp, Artificial
  CRISPR gRNA sequence
cctatcacctgcccccaatc

SEQ ID NO: 641055 - DNA, 20 bp, Artificial
  CRISPR gRNA sequence
ctatcacctgcccccaatca

SEQ ID NO: 641056 - DNA, 20 bp, Artificial
  CRISPR gRNA sequence
tcacctgcccccaatcaaaa

SEQ ID NO: 641057 - DNA, 20 bp, Artificial
  CRISPR gRNA sequence
cccccaatcaaaattcactt

SEQ ID NO: 641058 - DNA, 20 bp, Artificial
  CRISPR gRNA sequence
acttttcatttctcctatca

SEQ ID NO: 641059 - DNA, 20 bp, Artificial
  CRISPR gRNA sequence
ttcatttctcctatcacctg

SEQ ID NO: 641060 - DNA, 20 bp, Artificial
  CRISPR gRNA sequence
tcatttctcctatcacctgg

SEQ ID NO: 641061 - DNA, 20 bp, Artificial
  CRISPR gRNA sequence
catttctcctatcacctgga

SEQ ID NO: 641062 - DNA, 20 bp, Artificial
  CRISPR gRNA sequence
atttctcctatcacctggaa

SEQ ID NO: 641063 - DNA, 20 bp, Artificial
  CRISPR gRNA sequence
ctcctatcacctggaaccct

SEQ ID NO: 641064 - DNA, 20 bp, Artificial
  CRISPR gRNA sequence
tcctatcacctggaaccctg

SEQ ID NO: 641065 - DNA, 20 bp, Artificial
  CRISPR gRNA sequence
ctatcacctggaaccctgcc

SEQ ID NO: 641066 - DNA, 20 bp, Artificial
  CRISPR gRNA sequence
tcacctggaaccctgccaaa

SEQ ID NO: 641067 - DNA, 20 bp, Artificial
  CRISPR gRNA sequence
gaaccctgccaaaagctttt

SEQ ID NO: 641068 - DNA, 20 bp, Artificial
  CRISPR gRNA sequence
ccaaaagctttttaggaaac

SEQ ID NO: 641069 - DNA, 20 bp, Artificial
  CRISPR gRNA sequence
tttaggaaaccaattaccta

SEQ ID NO: 641070 - DNA, 20 bp, Artificial
  CRISPR gRNA sequence
ttaggaaaccaattacctaa

SEQ ID NO: 641071 - DNA, 20 bp, Artificial
  CRISPR gRNA sequence
taggaaaccaattacctaat

SEQ ID NO: 641072 - DNA, 20 bp, Artificial
  CRISPR gRNA sequence
aggaaaccaattacctaatc

SEQ ID NO: 641073 - DNA, 20 bp, Artificial
  CRISPR gRNA sequence
ggaaaccaattacctaatct

SEQ ID NO: 641074 - DNA, 20 bp, Artificial
  CRISPR gRNA sequence
cctaatctgataaactgctg

SEQ ID NO: 641075 - DNA, 20 bp, Artificial
  CRISPR gRNA sequence
atctgataaactgctgagca

SEQ ID NO: 641076 - DNA, 20 bp, Artificial
  CRISPR gRNA sequence
ataaactgctgagcaatatt

SEQ ID NO: 641077 - DNA, 20 bp, Artificial
  CRISPR gRNA sequence
ctgagcaatatttagcaaga

SEQ ID NO: 641078 - DNA, 20 bp, Artificial
  CRISPR gRNA sequence
agcaatatttagcaagaaat

SEQ ID NO: 641079 - DNA, 20 bp, Artificial
  CRISPR gRNA sequence
agcaagaaatttgactaaca

SEQ ID NO: 641080 - DNA, 20 bp, Artificial
  CRISPR gRNA sequence
gcaagaaatttgactaacac

SEQ ID NO: 641081 - DNA, 20 bp, Artificial
  CRISPR gRNA sequence
gactaacacttaaaaacaca

SEQ ID NO: 641082 - DNA, 20 bp, Artificial
  CRISPR gRNA sequence
actaacacttaaaaacacat

SEQ ID NO: 641083 - DNA, 20 bp, Artificial
  CRISPR gRNA sequence
acacttaaaaacacatgtac

SEQ ID NO: 641084 - DNA, 20 bp, Artificial
  CRISPR gRNA sequence
aaaaacacatgtacccaatt

SEQ ID NO: 641085 - DNA, 20 bp, Artificial
  CRISPR gRNA sequence
aaaacacatgtacccaattc

SEQ ID NO: 641086 - DNA, 20 bp, Artificial
  CRISPR gRNA sequence
cagttcccacaacttacaac

SEQ ID NO: 641087 - DNA, 20 bp, Artificial
  CRISPR gRNA sequence
ccacaacttacaactacaaa

SEQ ID NO: 641088 - DNA, 20 bp, Artificial
  CRISPR gRNA sequence
acaactacaaagttcaaagg

SEQ ID NO: 641089 - DNA, 20 bp, Artificial
  CRISPR gRNA sequence
caactacaaagttcaaagga

SEQ ID NO: 641090 - DNA, 20 bp, Artificial
  CRISPR gRNA sequence
caaagttcaaaggaacaaaa

SEQ ID NO: 641091 - DNA, 20 bp, Artificial
  CRISPR gRNA sequence
aaaggaacaaaagaaataaa

SEQ ID NO: 641092 - DNA, 20 bp, Artificial
  CRISPR gRNA sequence
tcctaagagaaaaagagata

SEQ ID NO: 641093 - DNA, 20 bp, Artificial
  CRISPR gRNA sequence
ctaagagaaaaagagataag

SEQ ID NO: 641094 - DNA, 20 bp, Artificial
  CRISPR gRNA sequence
agagaaaaagagataagcct

SEQ ID NO: 641095 - DNA, 20 bp, Artificial
  CRISPR gRNA sequence
agcttctatttaccctgaag

SEQ ID NO: 641096 - DNA, 20 bp, Artificial
  CRISPR gRNA sequence
ctatttaccctgaagtatat

SEQ ID NO: 641097 - DNA, 20 bp, Artificial
  CRISPR gRNA sequence
tatttaccctgaagtatata

SEQ ID NO: 641098 - DNA, 20 bp, Artificial
  CRISPR gRNA sequence
tttaccctgaagtatatatt

SEQ ID NO: 641099 - DNA, 20 bp, Artificial
  CRISPR gRNA sequence
accctgaagtatatatttaa

SEQ ID NO: 641100 - DNA, 20 bp, Artificial
  CRISPR gRNA sequence
ccctgaagtatatatttaaa

SEQ ID NO: 641101 - DNA, 20 bp, Artificial
  CRISPR gRNA sequence
aagtatatatttaaaaaatc

SEQ ID NO: 641102 - DNA, 20 bp, Artificial
  CRISPR gRNA sequence
aaaaaatctatatagagata

SEQ ID NO: 641103 - DNA, 20 bp, Artificial
  CRISPR gRNA sequence
aaaaatctatatagagatag

SEQ ID NO: 641104 - DNA, 20 bp, Artificial
  CRISPR gRNA sequence
tatagagatagatagataga

SEQ ID NO: 641105 - DNA, 20 bp, Artificial
  CRISPR gRNA sequence
gtcatattctgttatgatgt

SEQ ID NO: 641106 - DNA, 20 bp, Artificial
  CRISPR gRNA sequence
tcatattctgttatgatgtg

SEQ ID NO: 641107 - DNA, 20 bp, Artificial
  CRISPR gRNA sequence
tgttatgatgtgataatatg

SEQ ID NO: 641108 - DNA, 20 bp, Artificial
  CRISPR gRNA sequence
ttatgatgtgataatatgga

SEQ ID NO: 641109 - DNA, 20 bp, Artificial
  CRISPR gRNA sequence
tgatgtgataatatggaaag

SEQ ID NO: 641110 - DNA, 20 bp, Artificial
  CRISPR gRNA sequence
ttttgcccacccataattta

SEQ ID NO: 641111 - DNA, 20 bp, Artificial
  CRISPR gRNA sequence
ttgcccacccataatttaca

SEQ ID NO: 641112 - DNA, 20 bp, Artificial
  CRISPR gRNA sequence
tgcccacccataatttacaa

SEQ ID NO: 641113 - DNA, 20 bp, Artificial
  CRISPR gRNA sequence
gcccacccataatttacaaa

SEQ ID NO: 641114 - DNA, 20 bp, Artificial
  CRISPR gRNA sequence
cccacccataatttacaaat

SEQ ID NO: 641115 - DNA, 20 bp, Artificial
  CRISPR gRNA sequence
acaaatactgtgtcagtgaa

SEQ ID NO: 641116 - DNA, 20 bp, Artificial
  CRISPR gRNA sequence
caaatactgtgtcagtgaac

SEQ ID NO: 641117 - DNA, 20 bp, Artificial
  CRISPR gRNA sequence
tgtcagtgaacttctaaagt

SEQ ID NO: 641118 - DNA, 20 bp, Artificial
  CRISPR gRNA sequence
ctaaagttggaaattacttt

SEQ ID NO: 641119 - DNA, 20 bp, Artificial
  CRISPR gRNA sequence
taaagttggaaattacttta

SEQ ID NO: 641120 - DNA, 20 bp, Artificial
  CRISPR gRNA sequence
aagttggaaattactttaaa

SEQ ID NO: 641121 - DNA, 20 bp, Artificial
  CRISPR gRNA sequence
gaaattactttaaaataatt

SEQ ID NO: 641122 - DNA, 20 bp, Artificial
  CRISPR gRNA sequence
ctttaaaataatttgggagg

SEQ ID NO: 641123 - DNA, 20 bp, Artificial
  CRISPR gRNA sequence
taaaataatttgggagggaa

SEQ ID NO: 641124 - DNA, 20 bp, Artificial
  CRISPR gRNA sequence
aaaataatttgggagggaaa

SEQ ID NO: 641125 - DNA, 20 bp, Artificial
  CRISPR gRNA sequence
aaataatttgggagggaaag

SEQ ID NO: 641126 - DNA, 20 bp, Artificial
  CRISPR gRNA sequence
gggagggaaagtattttggg

SEQ ID NO: 641127 - DNA, 20 bp, Artificial
  CRISPR gRNA sequence
ggagggaaagtattttggga

SEQ ID NO: 641128 - DNA, 20 bp, Artificial
  CRISPR gRNA sequence
tgggatatggaggcacaaag

SEQ ID NO: 641129 - DNA, 20 bp, Artificial
  CRISPR gRNA sequence
gggatatggaggcacaaagg

SEQ ID NO: 641130 - DNA, 20 bp, Artificial
  CRISPR gRNA sequence
ggatatggaggcacaaaggt

SEQ ID NO: 641131 - DNA, 20 bp, Artificial
  CRISPR gRNA sequence
attaaatatctacttctcta

SEQ ID NO: 641132 - DNA, 20 bp, Artificial
  CRISPR gRNA sequence
aatatctacttctctatata

SEQ ID NO: 641133 - DNA, 20 bp, Artificial
  CRISPR gRNA sequence
cttctctatatatccaaatt

SEQ ID NO: 641134 - DNA, 20 bp, Artificial
  CRISPR gRNA sequence
ctctatatatccaaattttc

SEQ ID NO: 641135 - DNA, 20 bp, Artificial
  CRISPR gRNA sequence
tctatatatccaaattttca

SEQ ID NO: 641136 - DNA, 20 bp, Artificial
  CRISPR gRNA sequence
tatatatccaaattttcaac

SEQ ID NO: 641137 - DNA, 20 bp, Artificial
  CRISPR gRNA sequence
tatatccaaattttcaacat

SEQ ID NO: 641138 - DNA, 20 bp, Artificial
  CRISPR gRNA sequence
tcaacattaaaggaaagaga

SEQ ID NO: 641139 - DNA, 20 bp, Artificial
  CRISPR gRNA sequence
caacattaaaggaaagagaa

SEQ ID NO: 641140 - DNA, 20 bp, Artificial
  CRISPR gRNA sequence
aacattaaaggaaagagaaa

SEQ ID NO: 641141 - DNA, 20 bp, Artificial
  CRISPR gRNA sequence
aaggaaagagaaaacgagga

SEQ ID NO: 641142 - DNA, 20 bp, Artificial
  CRISPR gRNA sequence
tgaaactgcaactattataa

SEQ ID NO: 641143 - DNA, 20 bp, Artificial
  CRISPR gRNA sequence
caactattataattcagaaa

SEQ ID NO: 641144 - DNA, 20 bp, Artificial
  CRISPR gRNA sequence
ttataattcagaaaactttg

SEQ ID NO: 641145 - DNA, 20 bp, Artificial
  CRISPR gRNA sequence
taattcagaaaactttgaaa

SEQ ID NO: 641146 - DNA, 20 bp, Artificial
  CRISPR gRNA sequence
agaaaactttgaaaatggtt

SEQ ID NO: 641147 - DNA, 20 bp, Artificial
  CRISPR gRNA sequence
tgaaaatggttgaaatagaa

SEQ ID NO: 641148 - DNA, 20 bp, Artificial
  CRISPR gRNA sequence
gaaaatggttgaaatagaaa

SEQ ID NO: 641149 - DNA, 20 bp, Artificial
  CRISPR gRNA sequence
aaaatggttgaaatagaaaa

SEQ ID NO: 641150 - DNA, 20 bp, Artificial
  CRISPR gRNA sequence
aaatagaaaataagtgaaaa

SEQ ID NO: 641151 - DNA, 20 bp, Artificial
  CRISPR gRNA sequence
taataatgtatgactgtaag

SEQ ID NO: 641152 - DNA, 20 bp, Artificial
  CRISPR gRNA sequence
ataatgtatgactgtaagag

SEQ ID NO: 641153 - DNA, 20 bp, Artificial
  CRISPR gRNA sequence
taagagacatgggtaaaatg

SEQ ID NO: 641154 - DNA, 20 bp, Artificial
  CRISPR gRNA sequence
agactagttcaaaataaatg

SEQ ID NO: 641155 - DNA, 20 bp, Artificial
  CRISPR gRNA sequence
gttcaaaataaatgagaact

SEQ ID NO: 641156 - DNA, 20 bp, Artificial
  CRISPR gRNA sequence
aaaataaatgagaactaaat

SEQ ID NO: 641157 - DNA, 20 bp, Artificial
  CRISPR gRNA sequence
aatgttcagaaaagactttt

SEQ ID NO: 641158 - DNA, 20 bp, Artificial
  CRISPR gRNA sequence
agaaaagacttttaaatatt

SEQ ID NO: 641159 - DNA, 20 bp, Artificial
  CRISPR gRNA sequence
ttaaatattttcttacaact

SEQ ID NO: 641160 - DNA, 20 bp, Artificial
  CRISPR gRNA sequence
taaatattttcttacaacta

SEQ ID NO: 641161 - DNA, 20 bp, Artificial
  CRISPR gRNA sequence
aaatattttcttacaactag

SEQ ID NO: 641162 - DNA, 20 bp, Artificial
  CRISPR gRNA sequence
aatattttcttacaactagt

SEQ ID NO: 641163 - DNA, 20 bp, Artificial
  CRISPR gRNA sequence
tcttacaactagtaaatttt

SEQ ID NO: 641164 - DNA, 20 bp, Artificial
  CRISPR gRNA sequence
cttacaactagtaaattttc

SEQ ID NO: 641165 - DNA, 20 bp, Artificial
  CRISPR gRNA sequence
ttacaactagtaaattttca

SEQ ID NO: 641166 - DNA, 20 bp, Artificial
  CRISPR gRNA sequence
acaactagtaaattttcatg

SEQ ID NO: 641167 - DNA, 20 bp, Artificial
  CRISPR gRNA sequence
caactagtaaattttcatgt

SEQ ID NO: 641168 - DNA, 20 bp, Artificial
  CRISPR gRNA sequence
gtaaattttcatgtatctag

SEQ ID NO: 641169 - DNA, 20 bp, Artificial
  CRISPR gRNA sequence
tcatgtatctagtgaatatt

SEQ ID NO: 641170 - DNA, 20 bp, Artificial
  CRISPR gRNA sequence
catgtatctagtgaatattt

SEQ ID NO: 641171 - DNA, 20 bp, Artificial
  CRISPR gRNA sequence
atgtatctagtgaatatttt

SEQ ID NO: 641172 - DNA, 20 bp, Artificial
  CRISPR gRNA sequence
gtgaatatttttaaaggaac

SEQ ID NO: 641173 - DNA, 20 bp, Artificial
  CRISPR gRNA sequence
ttaaaggaacaacattaatc

SEQ ID NO: 641174 - DNA, 20 bp, Artificial
  CRISPR gRNA sequence
taaaggaacaacattaatct

SEQ ID NO: 641175 - DNA, 20 bp, Artificial
  CRISPR gRNA sequence
aaaggaacaacattaatctt

SEQ ID NO: 641176 - DNA, 20 bp, Artificial
  CRISPR gRNA sequence
aaggaacaacattaatcttt

SEQ ID NO: 641177 - DNA, 20 bp, Artificial
  CRISPR gRNA sequence
atctttaaatcactgacaaa

SEQ ID NO: 641178 - DNA, 20 bp, Artificial
  CRISPR gRNA sequence
taaatcactgacaaatttaa

SEQ ID NO: 641179 - DNA, 20 bp, Artificial
  CRISPR gRNA sequence
aaatcactgacaaatttaag

SEQ ID NO: 641180 - DNA, 20 bp, Artificial
  CRISPR gRNA sequence
aatcactgacaaatttaaga

SEQ ID NO: 641181 - DNA, 20 bp, Artificial
  CRISPR gRNA sequence
acaaatttaagataaaggac

SEQ ID NO: 641182 - DNA, 20 bp, Artificial
  CRISPR gRNA sequence
aagataaaggacatgggcta

SEQ ID NO: 641183 - DNA, 20 bp, Artificial
  CRISPR gRNA sequence
agataaaggacatgggctag

SEQ ID NO: 641184 - DNA, 20 bp, Artificial
  CRISPR gRNA sequence
gccatggcaagaaatggttt

SEQ ID NO: 641185 - DNA, 20 bp, Artificial
  CRISPR gRNA sequence
aatgataccacacatatcac

SEQ ID NO: 641186 - DNA, 20 bp, Artificial
  CRISPR gRNA sequence
atgataccacacatatcact

SEQ ID NO: 641187 - DNA, 20 bp, Artificial
  CRISPR gRNA sequence
actcaaaatcctaactaatt

SEQ ID NO: 641188 - DNA, 20 bp, Artificial
  CRISPR gRNA sequence
aaaatcctaactaattctaa

SEQ ID NO: 641189 - DNA, 20 bp, Artificial
  CRISPR gRNA sequence
actaattctaataggtttga

SEQ ID NO: 641190 - DNA, 20 bp, Artificial
  CRISPR gRNA sequence
attctaataggtttgacaat

SEQ ID NO: 641191 - DNA, 20 bp, Artificial
  CRISPR gRNA sequence
taataggtttgacaattgca

SEQ ID NO: 641192 - DNA, 20 bp, Artificial
  CRISPR gRNA sequence
ataggtttgacaattgcaac

SEQ ID NO: 641193 - DNA, 20 bp, Artificial
  CRISPR gRNA sequence
gacaattgcaacacatatgg

SEQ ID NO: 641194 - DNA, 20 bp, Artificial
  CRISPR gRNA sequence
acaattgcaacacatatgga

SEQ ID NO: 641195 - DNA, 20 bp, Artificial
  CRISPR gRNA sequence
caacacatatggaaggaaaa

SEQ ID NO: 641196 - DNA, 20 bp, Artificial
  CRISPR gRNA sequence
tttactaagctccttctcta

SEQ ID NO: 641197 - DNA, 20 bp, Artificial
  CRISPR gRNA sequence
actaagctccttctctaatc

SEQ ID NO: 641198 - DNA, 20 bp, Artificial
  CRISPR gRNA sequence
ctaagctccttctctaatcc

SEQ ID NO: 641199 - DNA, 20 bp, Artificial
  CRISPR gRNA sequence
agctccttctctaatccatt

SEQ ID NO: 641200 - DNA, 20 bp, Artificial
  CRISPR gRNA sequence
cttctctaatccatttaata

SEQ ID NO: 641201 - DNA, 20 bp, Artificial
  CRISPR gRNA sequence
ctctaatccatttaataagg

SEQ ID NO: 641202 - DNA, 20 bp, Artificial
  CRISPR gRNA sequence
tctaatccatttaataaggg

SEQ ID NO: 641203 - DNA, 20 bp, Artificial
  CRISPR gRNA sequence
taatccatttaataagggat

SEQ ID NO: 641204 - DNA, 20 bp, Artificial
  CRISPR gRNA sequence
atccatttaataagggatga

SEQ ID NO: 641205 - DNA, 20 bp, Artificial
  CRISPR gRNA sequence
aataagggatgaaatgtttg

SEQ ID NO: 641206 - DNA, 20 bp, Artificial
  CRISPR gRNA sequence
ataagggatgaaatgtttgg

SEQ ID NO: 641207 - DNA, 20 bp, Artificial
  CRISPR gRNA sequence
ggcaccatcttgacctattg

SEQ ID NO: 641208 - DNA, 20 bp, Artificial
  CRISPR gRNA sequence
gcaccatcttgacctattgt

SEQ ID NO: 641209 - DNA, 20 bp, Artificial
  CRISPR gRNA sequence
gacctattgttaaattagtc

SEQ ID NO: 641210 - DNA, 20 bp, Artificial
  CRISPR gRNA sequence
acctattgttaaattagtcc

SEQ ID NO: 641211 - DNA, 20 bp, Artificial
  CRISPR gRNA sequence
ttgttaaattagtcctaatc

SEQ ID NO: 641212 - DNA, 20 bp, Artificial
  CRISPR gRNA sequence
ttaaattagtcctaatcatt

SEQ ID NO: 641213 - DNA, 20 bp, Artificial
  CRISPR gRNA sequence
aattagtcctaatcattaaa

SEQ ID NO: 641214 - DNA, 20 bp, Artificial
  CRISPR gRNA sequence
gtcctaatcattaaatatcc

SEQ ID NO: 641215 - DNA, 20 bp, Artificial
  CRISPR gRNA sequence
atcattaaatatccctttca

SEQ ID NO: 641216 - DNA, 20 bp, Artificial
  CRISPR gRNA sequence
aatatccctttcataaagaa

SEQ ID NO: 641217 - DNA, 20 bp, Artificial
  CRISPR gRNA sequence
tcataaagaaaaaaaaattt

SEQ ID NO: 641218 - DNA, 20 bp, Artificial
  CRISPR gRNA sequence
cataaagaaaaaaaaatttg

SEQ ID NO: 641219 - DNA, 20 bp, Artificial
  CRISPR gRNA sequence
ataaagaaaaaaaaatttgg

SEQ ID NO: 641220 - DNA, 20 bp, Artificial
  CRISPR gRNA sequence
ggtgttaggttgagtttttt

SEQ ID NO: 641221 - DNA, 20 bp, Artificial
  CRISPR gRNA sequence
gtgttaggttgagttttttt

SEQ ID NO: 641222 - DNA, 20 bp, Artificial
  CRISPR gRNA sequence
ggttgagtttttttagtata

SEQ ID NO: 641223 - DNA, 20 bp, Artificial
  CRISPR gRNA sequence
agtttttttagtataaatct

SEQ ID NO: 641224 - DNA, 20 bp, Artificial
  CRISPR gRNA sequence
ttttagtataaatctattac

SEQ ID NO: 641225 - DNA, 20 bp, Artificial
  CRISPR gRNA sequence
tttagtataaatctattaca

SEQ ID NO: 641226 - DNA, 20 bp, Artificial
  CRISPR gRNA sequence
ttagtataaatctattacaa

SEQ ID NO: 641227 - DNA, 20 bp, Artificial
  CRISPR gRNA sequence
tagtataaatctattacaac

SEQ ID NO: 641228 - DNA, 20 bp, Artificial
  CRISPR gRNA sequence
agtataaatctattacaact

SEQ ID NO: 641229 - DNA, 20 bp, Artificial
  CRISPR gRNA sequence
gtataaatctattacaacta

SEQ ID NO: 641230 - DNA, 20 bp, Artificial
  CRISPR gRNA sequence
ttacaactaataaaaaagca

SEQ ID NO: 641231 - DNA, 20 bp, Artificial
  CRISPR gRNA sequence
caactaataaaaaagcaatt

SEQ ID NO: 641232 - DNA, 20 bp, Artificial
  CRISPR gRNA sequence
ataaaaaagcaattagagtt

SEQ ID NO: 641233 - DNA, 20 bp, Artificial
  CRISPR gRNA sequence
gagtttctatttatatgtcc

SEQ ID NO: 641234 - DNA, 20 bp, Artificial
  CRISPR gRNA sequence
ctatttatatgtccaacatg

SEQ ID NO: 641235 - DNA, 20 bp, Artificial
  CRISPR gRNA sequence
tatttatatgtccaacatgt

SEQ ID NO: 641236 - DNA, 20 bp, Artificial
  CRISPR gRNA sequence
tttatatgtccaacatgtat

SEQ ID NO: 641237 - DNA, 20 bp, Artificial
  CRISPR gRNA sequence
atatgtccaacatgtattaa

SEQ ID NO: 641238 - DNA, 20 bp, Artificial
  CRISPR gRNA sequence
tatgtccaacatgtattaag

SEQ ID NO: 641239 - DNA, 20 bp, Artificial
  CRISPR gRNA sequence
agttaggtctgtgaaggcct

SEQ ID NO: 641240 - DNA, 20 bp, Artificial
  CRISPR gRNA sequence
ggtctgtgaaggcctagagt

SEQ ID NO: 641241 - DNA, 20 bp, Artificial
  CRISPR gRNA sequence
tgaaggcctagagtctagga

SEQ ID NO: 641242 - DNA, 20 bp, Artificial
  CRISPR gRNA sequence
gagtctaggaagatgagtaa

SEQ ID NO: 641243 - DNA, 20 bp, Artificial
  CRISPR gRNA sequence
ggaagatgagtaaggcccat

SEQ ID NO: 641244 - DNA, 20 bp, Artificial
  CRISPR gRNA sequence
ggaagagtataggaggtagt

SEQ ID NO: 641245 - DNA, 20 bp, Artificial
  CRISPR gRNA sequence
agaaagacttacagcatata

SEQ ID NO: 641246 - DNA, 20 bp, Artificial
  CRISPR gRNA sequence
acagcatatagagctagcca

SEQ ID NO: 641247 - DNA, 20 bp, Artificial
  CRISPR gRNA sequence
cagcatatagagctagccag

SEQ ID NO: 641248 - DNA, 20 bp, Artificial
  CRISPR gRNA sequence
gccagtggttatcccagcaa

SEQ ID NO: 641249 - DNA, 20 bp, Artificial
  CRISPR gRNA sequence
tcccagcaatcaacaaactg

SEQ ID NO: 641250 - DNA, 20 bp, Artificial
  CRISPR gRNA sequence
gagcatggcccaaaggtagg

SEQ ID NO: 641251 - DNA, 20 bp, Artificial
  CRISPR gRNA sequence
aaatcaggatattagccaga

SEQ ID NO: 641252 - DNA, 20 bp, Artificial
  CRISPR gRNA sequence
gccagaacagaagaaaaaaa

SEQ ID NO: 641253 - DNA, 20 bp, Artificial
  CRISPR gRNA sequence
gtagattcaattaaatccag

SEQ ID NO: 641254 - DNA, 20 bp, Artificial
  CRISPR gRNA sequence
aattaaatccagtatctata

SEQ ID NO: 641255 - DNA, 20 bp, Artificial
  CRISPR gRNA sequence
aatccagtatctataatatc

SEQ ID NO: 641256 - DNA, 20 bp, Artificial
  CRISPR gRNA sequence
taatatcctccaagtagatg

SEQ ID NO: 641257 - DNA, 20 bp, Artificial
  CRISPR gRNA sequence
caagtagatgcaggacaggt

SEQ ID NO: 641258 - DNA, 20 bp, Artificial
  CRISPR gRNA sequence
gcaatgatccaaaacaaagt

SEQ ID NO: 641259 - DNA, 20 bp, Artificial
  CRISPR gRNA sequence
actcttttaaacatttattg

SEQ ID NO: 641260 - DNA, 20 bp, Artificial
  CRISPR gRNA sequence
ttttaaacatttattgaact

SEQ ID NO: 641261 - DNA, 20 bp, Artificial
  CRISPR gRNA sequence
ttaaacatttattgaactac

SEQ ID NO: 641262 - DNA, 20 bp, Artificial
  CRISPR gRNA sequence
taaacatttattgaactaca

SEQ ID NO: 641263 - DNA, 20 bp, Artificial
  CRISPR gRNA sequence
aaacatttattgaactacaa

SEQ ID NO: 641264 - DNA, 20 bp, Artificial
  CRISPR gRNA sequence
aacatttattgaactacaat

SEQ ID NO: 641265 - DNA, 20 bp, Artificial
  CRISPR gRNA sequence
attgaactacaatgagctca

SEQ ID NO: 641266 - DNA, 20 bp, Artificial
  CRISPR gRNA sequence
ttgaactacaatgagctcaa

SEQ ID NO: 641267 - DNA, 20 bp, Artificial
  CRISPR gRNA sequence
aactacaatgagctcaaagt

SEQ ID NO: 641268 - DNA, 20 bp, Artificial
  CRISPR gRNA sequence
caatgagctcaaagtccaat

SEQ ID NO: 641269 - DNA, 20 bp, Artificial
  CRISPR gRNA sequence
aaagtccaatatagacagaa

SEQ ID NO: 641270 - DNA, 20 bp, Artificial
  CRISPR gRNA sequence
atagatgtgtggactcaggt

SEQ ID NO: 641271 - DNA, 20 bp, Artificial
  CRISPR gRNA sequence
aggtataaggagaagatata

SEQ ID NO: 641272 - DNA, 20 bp, Artificial
  CRISPR gRNA sequence
gggtaggctggggaaggttt

SEQ ID NO: 641273 - DNA, 20 bp, Artificial
  CRISPR gRNA sequence
ggtaggctggggaaggtttc

SEQ ID NO: 641274 - DNA, 20 bp, Artificial
  CRISPR gRNA sequence
gggaaggtttctcaaagaag

SEQ ID NO: 641275 - DNA, 20 bp, Artificial
  CRISPR gRNA sequence
ctcaaagaagatgactgaat

SEQ ID NO: 641276 - DNA, 20 bp, Artificial
  CRISPR gRNA sequence
tcaaagaagatgactgaatt

SEQ ID NO: 641277 - DNA, 20 bp, Artificial
  CRISPR gRNA sequence
aaagaagatgactgaattcc

SEQ ID NO: 641278 - DNA, 20 bp, Artificial
  CRISPR gRNA sequence
aattccaccttgaaacatga

SEQ ID NO: 641279 - DNA, 20 bp, Artificial
  CRISPR gRNA sequence
caccttgaaacatgaagttt

SEQ ID NO: 641280 - DNA, 20 bp, Artificial
  CRISPR gRNA sequence
gaaacatgaagtttcaccag

SEQ ID NO: 641281 - DNA, 20 bp, Artificial
  CRISPR gRNA sequence
aaacatgaagtttcaccagt

SEQ ID NO: 641282 - DNA, 20 bp, Artificial
  CRISPR gRNA sequence
caccagtcacacttggtggg

SEQ ID NO: 641283 - DNA, 20 bp, Artificial
  CRISPR gRNA sequence
accagtcacacttggtggga

SEQ ID NO: 641284 - DNA, 20 bp, Artificial
  CRISPR gRNA sequence
ggtgggaagatatcccagaa

SEQ ID NO: 641285 - DNA, 20 bp, Artificial
  CRISPR gRNA sequence
gtgggaagatatcccagaag

SEQ ID NO: 641286 - DNA, 20 bp, Artificial
  CRISPR gRNA sequence
tcagggcaagaaactcaaga

SEQ ID NO: 641287 - DNA, 20 bp, Artificial
  CRISPR gRNA sequence
cagggcaagaaactcaagac

SEQ ID NO: 641288 - DNA, 20 bp, Artificial
  CRISPR gRNA sequence
agggcaagaaactcaagacc

SEQ ID NO: 641289 - DNA, 20 bp, Artificial
  CRISPR gRNA sequence
aagaccctgagagcaaacca

SEQ ID NO: 641290 - DNA, 20 bp, Artificial
  CRISPR gRNA sequence
agagcaaaccataaaatcat

SEQ ID NO: 641291 - DNA, 20 bp, Artificial
  CRISPR gRNA sequence
aggaaccgaggtaccaaggt

SEQ ID NO: 641292 - DNA, 20 bp, Artificial
  CRISPR gRNA sequence
acattaaatgtgactgtgta

SEQ ID NO: 641293 - DNA, 20 bp, Artificial
  CRISPR gRNA sequence
aatgtgactgtgtactaaac

SEQ ID NO: 641294 - DNA, 20 bp, Artificial
  CRISPR gRNA sequence
tgtactaaactagtgagcta

SEQ ID NO: 641295 - DNA, 20 bp, Artificial
  CRISPR gRNA sequence
aactagtgagctactacacc

SEQ ID NO: 641296 - DNA, 20 bp, Artificial
  CRISPR gRNA sequence
gtgagctactacacccctcc

SEQ ID NO: 641297 - DNA, 20 bp, Artificial
  CRISPR gRNA sequence
ctacacccctcctaatatcc

SEQ ID NO: 641298 - DNA, 20 bp, Artificial
  CRISPR gRNA sequence
cacccctcctaatatcctct

SEQ ID NO: 641299 - DNA, 20 bp, Artificial
  CRISPR gRNA sequence
ctaatatcctctgggggtag

SEQ ID NO: 641300 - DNA, 20 bp, Artificial
  CRISPR gRNA sequence
atatcctctgggggtagggt

SEQ ID NO: 641301 - DNA, 20 bp, Artificial
  CRISPR gRNA sequence
tgggggtagggtccagaatc

SEQ ID NO: 641302 - DNA, 20 bp, Artificial
  CRISPR gRNA sequence
ggggtagggtccagaatctg

SEQ ID NO: 641303 - DNA, 20 bp, Artificial
  CRISPR gRNA sequence
agtccattaaggatattcaa

SEQ ID NO: 641304 - DNA, 20 bp, Artificial
  CRISPR gRNA sequence
aggatattcaattgtaaagg

SEQ ID NO: 641305 - DNA, 20 bp, Artificial
  CRISPR gRNA sequence
aattgtaaaggtcagaggtc

SEQ ID NO: 641306 - DNA, 20 bp, Artificial
  CRISPR gRNA sequence
taaaggtcagaggtctggct

SEQ ID NO: 641307 - DNA, 20 bp, Artificial
  CRISPR gRNA sequence
gctgcaaagtcagggaggtc

SEQ ID NO: 641308 - DNA, 20 bp, Artificial
  CRISPR gRNA sequence
caaagtcagggaggtcctta

SEQ ID NO: 641309 - DNA, 20 bp, Artificial
  CRISPR gRNA sequence
aaataagtttaaataagaac

SEQ ID NO: 641310 - DNA, 20 bp, Artificial
  CRISPR gRNA sequence
aataagtttaaataagaact

SEQ ID NO: 641311 - DNA, 20 bp, Artificial
  CRISPR gRNA sequence
aaataagaactaaactagtt

SEQ ID NO: 641312 - DNA, 20 bp, Artificial
  CRISPR gRNA sequence
aataagaactaaactagtta

SEQ ID NO: 641313 - DNA, 20 bp, Artificial
  CRISPR gRNA sequence
aactagttatattttaataa

SEQ ID NO: 641314 - DNA, 20 bp, Artificial
  CRISPR gRNA sequence
gttatattttaataagaact

SEQ ID NO: 641315 - DNA, 20 bp, Artificial
  CRISPR gRNA sequence
tattttaataagaactttat

SEQ ID NO: 641316 - DNA, 20 bp, Artificial
  CRISPR gRNA sequence
taataagaactttatagacc

SEQ ID NO: 641317 - DNA, 20 bp, Artificial
  CRISPR gRNA sequence
aataagaactttatagacct

SEQ ID NO: 641318 - DNA, 20 bp, Artificial
  CRISPR gRNA sequence
ataagaactttatagaccta

SEQ ID NO: 641319 - DNA, 20 bp, Artificial
  CRISPR gRNA sequence
tatagacctaaagaaaggtc

SEQ ID NO: 641320 - DNA, 20 bp, Artificial
  CRISPR gRNA sequence
atagacctaaagaaaggtct

SEQ ID NO: 641321 - DNA, 20 bp, Artificial
  CRISPR gRNA sequence
tagacctaaagaaaggtctc

SEQ ID NO: 641322 - DNA, 20 bp, Artificial
  CRISPR gRNA sequence
aagaaaggtctctgaagagc

SEQ ID NO: 641323 - DNA, 20 bp, Artificial
  CRISPR gRNA sequence
tgaagagcaagtgggactca

SEQ ID NO: 641324 - DNA, 20 bp, Artificial
  CRISPR gRNA sequence
aagagcaagtgggactcatg

SEQ ID NO: 641325 - DNA, 20 bp, Artificial
  CRISPR gRNA sequence
atgatcaagttaaaggcaag

SEQ ID NO: 641326 - DNA, 20 bp, Artificial
  CRISPR gRNA sequence
aaggcaagtgaggctgacta

SEQ ID NO: 641327 - DNA, 20 bp, Artificial
  CRISPR gRNA sequence
actacaagttacccaatagt

SEQ ID NO: 641328 - DNA, 20 bp, Artificial
  CRISPR gRNA sequence
caagttacccaatagtgatg

SEQ ID NO: 641329 - DNA, 20 bp, Artificial
  CRISPR gRNA sequence
cccaatagtgatgaaatatc

SEQ ID NO: 641330 - DNA, 20 bp, Artificial
  CRISPR gRNA sequence
ggattttgataacatgtcaa

SEQ ID NO: 641331 - DNA, 20 bp, Artificial
  CRISPR gRNA sequence
tgataacatgtcaaacagaa

SEQ ID NO: 641332 - DNA, 20 bp, Artificial
  CRISPR gRNA sequence
gataacatgtcaaacagaaa

SEQ ID NO: 641333 - DNA, 20 bp, Artificial
  CRISPR gRNA sequence
ataacatgtcaaacagaaat

SEQ ID NO: 641334 - DNA, 20 bp, Artificial
  CRISPR gRNA sequence
ttctagttttgttctataca

SEQ ID NO: 641335 - DNA, 20 bp, Artificial
  CRISPR gRNA sequence
tctagttttgttctatacat

SEQ ID NO: 641336 - DNA, 20 bp, Artificial
  CRISPR gRNA sequence
ctagttttgttctatacatt

SEQ ID NO: 641337 - DNA, 20 bp, Artificial
  CRISPR gRNA sequence
tagttttgttctatacattg

SEQ ID NO: 641338 - DNA, 20 bp, Artificial
  CRISPR gRNA sequence
gttttgttctatacattgtt

SEQ ID NO: 641339 - DNA, 20 bp, Artificial
  CRISPR gRNA sequence
tgttctatacattgttatgt

SEQ ID NO: 641340 - DNA, 20 bp, Artificial
  CRISPR gRNA sequence
gttctatacattgttatgtg

SEQ ID NO: 641341 - DNA, 20 bp, Artificial
  CRISPR gRNA sequence
ttctatacattgttatgtgc

SEQ ID NO: 641342 - DNA, 20 bp, Artificial
  CRISPR gRNA sequence
tatacattgttatgtgctat

SEQ ID NO: 641343 - DNA, 20 bp, Artificial
  CRISPR gRNA sequence
tacattgttatgtgctatat

SEQ ID NO: 641344 - DNA, 20 bp, Artificial
  CRISPR gRNA sequence
ttatgtgctatatgttaaaa

SEQ ID NO: 641345 - DNA, 20 bp, Artificial
  CRISPR gRNA sequence
tgtgctatatgttaaaacag

SEQ ID NO: 641346 - DNA, 20 bp, Artificial
  CRISPR gRNA sequence
tatgttaaaacagtttttca

SEQ ID NO: 641347 - DNA, 20 bp, Artificial
  CRISPR gRNA sequence
aaacagtttttcatgaaatc

SEQ ID NO: 641348 - DNA, 20 bp, Artificial
  CRISPR gRNA sequence
ttcatgaaatcaagcagcaa

SEQ ID NO: 641349 - DNA, 20 bp, Artificial
  CRISPR gRNA sequence
tcatgaaatcaagcagcaat

SEQ ID NO: 641350 - DNA, 20 bp, Artificial
  CRISPR gRNA sequence
catgaaatcaagcagcaata

SEQ ID NO: 641351 - DNA, 20 bp, Artificial
  CRISPR gRNA sequence
atgaaatcaagcagcaataa

SEQ ID NO: 641352 - DNA, 20 bp, Artificial
  CRISPR gRNA sequence
aaggcttgcaatagaaaaac

SEQ ID NO: 641353 - DNA, 20 bp, Artificial
  CRISPR gRNA sequence
aggcttgcaatagaaaaact

SEQ ID NO: 641354 - DNA, 20 bp, Artificial
  CRISPR gRNA sequence
gcaatagaaaaactattgtg

SEQ ID NO: 641355 - DNA, 20 bp, Artificial
  CRISPR gRNA sequence
caatagaaaaactattgtgc

SEQ ID NO: 641356 - DNA, 20 bp, Artificial
  CRISPR gRNA sequence
ttgtgctaagtttgaggaat

SEQ ID NO: 641357 - DNA, 20 bp, Artificial
  CRISPR gRNA sequence
tgctaagtttgaggaataaa

SEQ ID NO: 641358 - DNA, 20 bp, Artificial
  CRISPR gRNA sequence
agtttgaggaataaatacaa

SEQ ID NO: 641359 - DNA, 20 bp, Artificial
  CRISPR gRNA sequence
gaggaataaatacaacgata

SEQ ID NO: 641360 - DNA, 20 bp, Artificial
  CRISPR gRNA sequence
aggaataaatacaacgataa

SEQ ID NO: 641361 - DNA, 20 bp, Artificial
  CRISPR gRNA sequence
actctcaagaagtttacagc

SEQ ID NO: 641362 - DNA, 20 bp, Artificial
  CRISPR gRNA sequence
ctctcaagaagtttacagcc

SEQ ID NO: 641363 - DNA, 20 bp, Artificial
  CRISPR gRNA sequence
tcaagaagtttacagccaaa

SEQ ID NO: 641364 - DNA, 20 bp, Artificial
  CRISPR gRNA sequence
aagaagtttacagccaaatt

SEQ ID NO: 641365 - DNA, 20 bp, Artificial
  CRISPR gRNA sequence
acagccaaattaaggaaata

SEQ ID NO: 641366 - DNA, 20 bp, Artificial
  CRISPR gRNA sequence
cagccaaattaaggaaataa

SEQ ID NO: 641367 - DNA, 20 bp, Artificial
  CRISPR gRNA sequence
aggaaataaaacagctatct

SEQ ID NO: 641368 - DNA, 20 bp, Artificial
  CRISPR gRNA sequence
tctagaaatatgagcaaata

SEQ ID NO: 641369 - DNA, 20 bp, Artificial
  CRISPR gRNA sequence
gaaatatgagcaaatataca

SEQ ID NO: 641370 - DNA, 20 bp, Artificial
  CRISPR gRNA sequence
cttttataaaccaatgtact

SEQ ID NO: 641371 - DNA, 20 bp, Artificial
  CRISPR gRNA sequence
ttttataaaccaatgtactt

SEQ ID NO: 641372 - DNA, 20 bp, Artificial
  CRISPR gRNA sequence
ttataaaccaatgtactttt

SEQ ID NO: 641373 - DNA, 20 bp, Artificial
  CRISPR gRNA sequence
tataaaccaatgtacttttt

SEQ ID NO: 641374 - DNA, 20 bp, Artificial
  CRISPR gRNA sequence
ataaaccaatgtacttttta

SEQ ID NO: 641375 - DNA, 20 bp, Artificial
  CRISPR gRNA sequence
taaaccaatgtactttttac

SEQ ID NO: 641376 - DNA, 20 bp, Artificial
  CRISPR gRNA sequence
tttactagcttatcctgtga

SEQ ID NO: 641377 - DNA, 20 bp, Artificial
  CRISPR gRNA sequence
ttactagcttatcctgtgat

SEQ ID NO: 641378 - DNA, 20 bp, Artificial
  CRISPR gRNA sequence
tactagcttatcctgtgatg

SEQ ID NO: 641379 - DNA, 20 bp, Artificial
  CRISPR gRNA sequence
actagcttatcctgtgatgt

SEQ ID NO: 641380 - DNA, 20 bp, Artificial
  CRISPR gRNA sequence
ctagcttatcctgtgatgtt

SEQ ID NO: 641381 - DNA, 20 bp, Artificial
  CRISPR gRNA sequence
gcttatcctgtgatgttata

SEQ ID NO: 641382 - DNA, 20 bp, Artificial
  CRISPR gRNA sequence
atcctgtgatgttatattaa

SEQ ID NO: 641383 - DNA, 20 bp, Artificial
  CRISPR gRNA sequence
tcctgtgatgttatattaat

SEQ ID NO: 641384 - DNA, 20 bp, Artificial
  CRISPR gRNA sequence
tgatgttatattaatgcaag

SEQ ID NO: 641385 - DNA, 20 bp, Artificial
  CRISPR gRNA sequence
tattaatgcaagaaataaga

SEQ ID NO: 641386 - DNA, 20 bp, Artificial
  CRISPR gRNA sequence
atgcaagaaataagatttat

SEQ ID NO: 641387 - DNA, 20 bp, Artificial
  CRISPR gRNA sequence
ataatgataaaaacatagat

SEQ ID NO: 641388 - DNA, 20 bp, Artificial
  CRISPR gRNA sequence
taatgataaaaacatagata

SEQ ID NO: 641389 - DNA, 20 bp, Artificial
  CRISPR gRNA sequence
gcacaaaagaatctgtgcta

SEQ ID NO: 641390 - DNA, 20 bp, Artificial
  CRISPR gRNA sequence
cacaaaagaatctgtgctaa

SEQ ID NO: 641391 - DNA, 20 bp, Artificial
  CRISPR gRNA sequence
tgctaatgttagcaatgaag

SEQ ID NO: 641392 - DNA, 20 bp, Artificial
  CRISPR gRNA sequence
atgttagcaatgaagcaaac

SEQ ID NO: 641393 - DNA, 20 bp, Artificial
  CRISPR gRNA sequence
gcaatgaagcaaaccctctg

SEQ ID NO: 641394 - DNA, 20 bp, Artificial
  CRISPR gRNA sequence
tgactaagtcaactttaaaa

SEQ ID NO: 641395 - DNA, 20 bp, Artificial
  CRISPR gRNA sequence
actaagtcaactttaaaact

SEQ ID NO: 641396 - DNA, 20 bp, Artificial
  CRISPR gRNA sequence
agtcaactttaaaactctaa

SEQ ID NO: 641397 - DNA, 20 bp, Artificial
  CRISPR gRNA sequence
taaaactctaagtttattgg

SEQ ID NO: 641398 - DNA, 20 bp, Artificial
  CRISPR gRNA sequence
aaaactctaagtttattgga

SEQ ID NO: 641399 - DNA, 20 bp, Artificial
  CRISPR gRNA sequence
aaactctaagtttattggat

SEQ ID NO: 641400 - DNA, 20 bp, Artificial
  CRISPR gRNA sequence
taagtttattggatttagaa

SEQ ID NO: 641401 - DNA, 20 bp, Artificial
  CRISPR gRNA sequence
agtttattggatttagaact

SEQ ID NO: 641402 - DNA, 20 bp, Artificial
  CRISPR gRNA sequence
attggatttagaacttaaca

SEQ ID NO: 641403 - DNA, 20 bp, Artificial
  CRISPR gRNA sequence
ttggatttagaacttaacac

SEQ ID NO: 641404 - DNA, 20 bp, Artificial
  CRISPR gRNA sequence
gatttagaacttaacacata

SEQ ID NO: 641405 - DNA, 20 bp, Artificial
  CRISPR gRNA sequence
agaacttaacacatatatag

SEQ ID NO: 641406 - DNA, 20 bp, Artificial
  CRISPR gRNA sequence
gaacttaacacatatatagt

SEQ ID NO: 641407 - DNA, 20 bp, Artificial
  CRISPR gRNA sequence
aacacatatatagtcaatat

SEQ ID NO: 641408 - DNA, 20 bp, Artificial
  CRISPR gRNA sequence
acacatatatagtcaatatc

SEQ ID NO: 641409 - DNA, 20 bp, Artificial
  CRISPR gRNA sequence
aaattactcaaggcactcag

SEQ ID NO: 641410 - DNA, 20 bp, Artificial
  CRISPR gRNA sequence
ctcaaggcactcagtataca

SEQ ID NO: 641411 - DNA, 20 bp, Artificial
  CRISPR gRNA sequence
aaggcactcagtatacagaa

SEQ ID NO: 641412 - DNA, 20 bp, Artificial
  CRISPR gRNA sequence
agtatacagaatatgaagaa

SEQ ID NO: 641413 - DNA, 20 bp, Artificial
  CRISPR gRNA sequence
agatcatcggaacttgccta

SEQ ID NO: 641414 - DNA, 20 bp, Artificial
  CRISPR gRNA sequence
gatcatcggaacttgcctat

SEQ ID NO: 641415 - DNA, 20 bp, Artificial
  CRISPR gRNA sequence
gcctattataaagcaagggt

SEQ ID NO: 641416 - DNA, 20 bp, Artificial
  CRISPR gRNA sequence
cctattataaagcaagggtt

SEQ ID NO: 641417 - DNA, 20 bp, Artificial
  CRISPR gRNA sequence
ttataaagcaagggttaaaa

SEQ ID NO: 641418 - DNA, 20 bp, Artificial
  CRISPR gRNA sequence
taaagcaagggttaaaaata

SEQ ID NO: 641419 - DNA, 20 bp, Artificial
  CRISPR gRNA sequence
aaaatactcttcttcaaagt

SEQ ID NO: 641420 - DNA, 20 bp, Artificial
  CRISPR gRNA sequence
ttcttcaaagtttggtgagt

SEQ ID NO: 641421 - DNA, 20 bp, Artificial
  CRISPR gRNA sequence
cttcaaagtttggtgagtgt

SEQ ID NO: 641422 - DNA, 20 bp, Artificial
  CRISPR gRNA sequence
ttcaaagtttggtgagtgtg

SEQ ID NO: 641423 - DNA, 20 bp, Artificial
  CRISPR gRNA sequence
caaagtttggtgagtgtgtg

SEQ ID NO: 641424 - DNA, 20 bp, Artificial
  CRISPR gRNA sequence
aaagtttggtgagtgtgtga

SEQ ID NO: 641425 - DNA, 20 bp, Artificial
  CRISPR gRNA sequence
ggtgagtgtgtgagtaagaa

SEQ ID NO: 641426 - DNA, 20 bp, Artificial
  CRISPR gRNA sequence
gtgagtgtgtgagtaagaaa

SEQ ID NO: 641427 - DNA, 20 bp, Artificial
  CRISPR gRNA sequence
ctgccaactccatacagata

SEQ ID NO: 641428 - DNA, 20 bp, Artificial
  CRISPR gRNA sequence
ccaactccatacagatagca

SEQ ID NO: 641429 - DNA, 20 bp, Artificial
  CRISPR gRNA sequence
catacagatagcaaaaagac

SEQ ID NO: 641430 - DNA, 20 bp, Artificial
  CRISPR gRNA sequence
ataaatttcactgacaattt

SEQ ID NO: 641431 - DNA, 20 bp, Artificial
  CRISPR gRNA sequence
cactgacaatttttttggat

SEQ ID NO: 641432 - DNA, 20 bp, Artificial
  CRISPR gRNA sequence
actgacaatttttttggatg

SEQ ID NO: 641433 - DNA, 20 bp, Artificial
  CRISPR gRNA sequence
acaatttttttggatggggt

SEQ ID NO: 641434 - DNA, 20 bp, Artificial
  CRISPR gRNA sequence
ttttggatggggtttcagct

SEQ ID NO: 641435 - DNA, 20 bp, Artificial
  CRISPR gRNA sequence
tttggatggggtttcagcta

SEQ ID NO: 641436 - DNA, 20 bp, Artificial
  CRISPR gRNA sequence
ttggatggggtttcagctaa

SEQ ID NO: 641437 - DNA, 20 bp, Artificial
  CRISPR gRNA sequence
tggatggggtttcagctaat

SEQ ID NO: 641438 - DNA, 20 bp, Artificial
  CRISPR gRNA sequence
ggatggggtttcagctaatt

SEQ ID NO: 641439 - DNA, 20 bp, Artificial
  CRISPR gRNA sequence
gatggggtttcagctaattc

SEQ ID NO: 641440 - DNA, 20 bp, Artificial
  CRISPR gRNA sequence
cagctaattcacttattaca

SEQ ID NO: 641441 - DNA, 20 bp, Artificial
  CRISPR gRNA sequence
agctaattcacttattacat

SEQ ID NO: 641442 - DNA, 20 bp, Artificial
  CRISPR gRNA sequence
attcacttattacatccata

SEQ ID NO: 641443 - DNA, 20 bp, Artificial
  CRISPR gRNA sequence
acttattacatccataaaca

SEQ ID NO: 641444 - DNA, 20 bp, Artificial
  CRISPR gRNA sequence
attacatccataaacactgg

SEQ ID NO: 641445 - DNA, 20 bp, Artificial
  CRISPR gRNA sequence
ttacatccataaacactgga

SEQ ID NO: 641446 - DNA, 20 bp, Artificial
  CRISPR gRNA sequence
catccataaacactggagac

SEQ ID NO: 641447 - DNA, 20 bp, Artificial
  CRISPR gRNA sequence
gagacatttcactacttttg

SEQ ID NO: 641448 - DNA, 20 bp, Artificial
  CRISPR gRNA sequence
cactacttttgacagttcaa

SEQ ID NO: 641449 - DNA, 20 bp, Artificial
  CRISPR gRNA sequence
actacttttgacagttcaag

SEQ ID NO: 641450 - DNA, 20 bp, Artificial
  CRISPR gRNA sequence
cttttgacagttcaagtttt

SEQ ID NO: 641451 - DNA, 20 bp, Artificial
  CRISPR gRNA sequence
ttgacagttcaagttttcct

SEQ ID NO: 641452 - DNA, 20 bp, Artificial
  CRISPR gRNA sequence
tgacagttcaagttttcctt

SEQ ID NO: 641453 - DNA, 20 bp, Artificial
  CRISPR gRNA sequence
gacagttcaagttttccttc

SEQ ID NO: 641454 - DNA, 20 bp, Artificial
  CRISPR gRNA sequence
acagttcaagttttccttct

SEQ ID NO: 641455 - DNA, 20 bp, Artificial
  CRISPR gRNA sequence
aagttttccttctaaaatat

SEQ ID NO: 641456 - DNA, 20 bp, Artificial
  CRISPR gRNA sequence
tccttctaaaatatgtttgc

SEQ ID NO: 641457 - DNA, 20 bp, Artificial
  CRISPR gRNA sequence
ccttctaaaatatgtttgca

SEQ ID NO: 641458 - DNA, 20 bp, Artificial
  CRISPR gRNA sequence
cttctaaaatatgtttgcaa

SEQ ID NO: 641459 - DNA, 20 bp, Artificial
  CRISPR gRNA sequence
ctaaaatatgtttgcaaaat

SEQ ID NO: 641460 - DNA, 20 bp, Artificial
  CRISPR gRNA sequence
taaaatatgtttgcaaaata

SEQ ID NO: 641461 - DNA, 20 bp, Artificial
  CRISPR gRNA sequence
aaatatgtttgcaaaatata

SEQ ID NO: 641462 - DNA, 20 bp, Artificial
  CRISPR gRNA sequence
gcaaaatataatttcagagg

SEQ ID NO: 641463 - DNA, 20 bp, Artificial
  CRISPR gRNA sequence
caaaatataatttcagagga

SEQ ID NO: 641464 - DNA, 20 bp, Artificial
  CRISPR gRNA sequence
cagaggagaaatgttgcttt

SEQ ID NO: 641465 - DNA, 20 bp, Artificial
  CRISPR gRNA sequence
agaggagaaatgttgctttg

SEQ ID NO: 641466 - DNA, 20 bp, Artificial
  CRISPR gRNA sequence
ctttggtttgcagggttttt

SEQ ID NO: 641467 - DNA, 20 bp, Artificial
  CRISPR gRNA sequence
tggtttgcagggtttttaac

SEQ ID NO: 641468 - DNA, 20 bp, Artificial
  CRISPR gRNA sequence
ggtttgcagggtttttaaca

SEQ ID NO: 641469 - DNA, 20 bp, Artificial
  CRISPR gRNA sequence
gtttgcagggtttttaacaa

SEQ ID NO: 641470 - DNA, 20 bp, Artificial
  CRISPR gRNA sequence
gcagggtttttaacaattca

SEQ ID NO: 641471 - DNA, 20 bp, Artificial
  CRISPR gRNA sequence
cagggtttttaacaattcat

SEQ ID NO: 641472 - DNA, 20 bp, Artificial
  CRISPR gRNA sequence
ttaacaattcatttagaggt

SEQ ID NO: 641473 - DNA, 20 bp, Artificial
  CRISPR gRNA sequence
taacaattcatttagaggtc

SEQ ID NO: 641474 - DNA, 20 bp, Artificial
  CRISPR gRNA sequence
aacaattcatttagaggtcc

SEQ ID NO: 641475 - DNA, 20 bp, Artificial
  CRISPR gRNA sequence
acaattcatttagaggtcca

SEQ ID NO: 641476 - DNA, 20 bp, Artificial
  CRISPR gRNA sequence
atttagaggtccagaaaagc

SEQ ID NO: 641477 - DNA, 20 bp, Artificial
  CRISPR gRNA sequence
agaggtccagaaaagcattt

SEQ ID NO: 641478 - DNA, 20 bp, Artificial
  CRISPR gRNA sequence
gaggtccagaaaagcatttt

SEQ ID NO: 641479 - DNA, 20 bp, Artificial
  CRISPR gRNA sequence
tatatttcttttccttcata

SEQ ID NO: 641480 - DNA, 20 bp, Artificial
  CRISPR gRNA sequence
atatttcttttccttcatat

SEQ ID NO: 641481 - DNA, 20 bp, Artificial
  CRISPR gRNA sequence
tatttcttttccttcatatg

SEQ ID NO: 641482 - DNA, 20 bp, Artificial
  CRISPR gRNA sequence
cttttccttcatatgtctgc

SEQ ID NO: 641483 - DNA, 20 bp, Artificial
  CRISPR gRNA sequence
ttttccttcatatgtctgct

SEQ ID NO: 641484 - DNA, 20 bp, Artificial
  CRISPR gRNA sequence
ttccttcatatgtctgctta

SEQ ID NO: 641485 - DNA, 20 bp, Artificial
  CRISPR gRNA sequence
tccttcatatgtctgcttat

SEQ ID NO: 641486 - DNA, 20 bp, Artificial
  CRISPR gRNA sequence
ccttcatatgtctgcttatt

SEQ ID NO: 641487 - DNA, 20 bp, Artificial
  CRISPR gRNA sequence
cttcatatgtctgcttattt

SEQ ID NO: 641488 - DNA, 20 bp, Artificial
  CRISPR gRNA sequence
catatgtctgcttatttgat

SEQ ID NO: 641489 - DNA, 20 bp, Artificial
  CRISPR gRNA sequence
atatgtctgcttatttgatg

SEQ ID NO: 641490 - DNA, 20 bp, Artificial
  CRISPR gRNA sequence
cttatttgatggtaatttta

SEQ ID NO: 641491 - DNA, 20 bp, Artificial
  CRISPR gRNA sequence
atttgatggtaattttatac

SEQ ID NO: 641492 - DNA, 20 bp, Artificial
  CRISPR gRNA sequence
tttgatggtaattttatacc

SEQ ID NO: 641493 - DNA, 20 bp, Artificial
  CRISPR gRNA sequence
gatggtaattttatacctct

SEQ ID NO: 641494 - DNA, 20 bp, Artificial
  CRISPR gRNA sequence
atggtaattttatacctctg

SEQ ID NO: 641495 - DNA, 20 bp, Artificial
  CRISPR gRNA sequence
tatacctctgagacaacaaa

SEQ ID NO: 641496 - DNA, 20 bp, Artificial
  CRISPR gRNA sequence
atacctctgagacaacaaaa

SEQ ID NO: 641497 - DNA, 20 bp, Artificial
  CRISPR gRNA sequence
tacctctgagacaacaaaat

SEQ ID NO: 641498 - DNA, 20 bp, Artificial
  CRISPR gRNA sequence
tgagacaacaaaatgacttt

SEQ ID NO: 641499 - DNA, 20 bp, Artificial
  CRISPR gRNA sequence
agacaacaaaatgacttttt

SEQ ID NO: 641500 - DNA, 20 bp, Artificial
  CRISPR gRNA sequence
tttaaaccttcagttaaaat

SEQ ID NO: 641501 - DNA, 20 bp, Artificial
  CRISPR gRNA sequence
ttaaaccttcagttaaaatg

SEQ ID NO: 641502 - DNA, 20 bp, Artificial
  CRISPR gRNA sequence
taaaccttcagttaaaatga

SEQ ID NO: 641503 - DNA, 20 bp, Artificial
  CRISPR gRNA sequence
aaaccttcagttaaaatgag

SEQ ID NO: 641504 - DNA, 20 bp, Artificial
  CRISPR gRNA sequence
aaccttcagttaaaatgagc

SEQ ID NO: 641505 - DNA, 20 bp, Artificial
  CRISPR gRNA sequence
cagttaaaatgagccatata

SEQ ID NO: 641506 - DNA, 20 bp, Artificial
  CRISPR gRNA sequence
agttaaaatgagccatatag

SEQ ID NO: 641507 - DNA, 20 bp, Artificial
  CRISPR gRNA sequence
aaatgagccatatagttgaa

SEQ ID NO: 641508 - DNA, 20 bp, Artificial
  CRISPR gRNA sequence
aaaagtctattaaaaactat

SEQ ID NO: 641509 - DNA, 20 bp, Artificial
  CRISPR gRNA sequence
ttaaaaactatagccagaaa

SEQ ID NO: 641510 - DNA, 20 bp, Artificial
  CRISPR gRNA sequence
aaaactatagccagaaagta

SEQ ID NO: 641511 - DNA, 20 bp, Artificial
  CRISPR gRNA sequence
tagccagaaagtaagacatg

SEQ ID NO: 641512 - DNA, 20 bp, Artificial
  CRISPR gRNA sequence
aaattaaacactactttaag

SEQ ID NO: 641513 - DNA, 20 bp, Artificial
  CRISPR gRNA sequence
aacactactttaagtaatga

SEQ ID NO: 641514 - DNA, 20 bp, Artificial
  CRISPR gRNA sequence
ctttaagtaatgaaaacact

SEQ ID NO: 641515 - DNA, 20 bp, Artificial
  CRISPR gRNA sequence
taagtaatgaaaacactctg

SEQ ID NO: 641516 - DNA, 20 bp, Artificial
  CRISPR gRNA sequence
aagtaatgaaaacactctgc

SEQ ID NO: 641517 - DNA, 20 bp, Artificial
  CRISPR gRNA sequence
agtaatgaaaacactctgct

SEQ ID NO: 641518 - DNA, 20 bp, Artificial
  CRISPR gRNA sequence
tgcttttgcaatgtttgaag

SEQ ID NO: 641519 - DNA, 20 bp, Artificial
  CRISPR gRNA sequence
cttttgcaatgtttgaagtt

SEQ ID NO: 641520 - DNA, 20 bp, Artificial
  CRISPR gRNA sequence
ttgcaatgtttgaagttcaa

SEQ ID NO: 641521 - DNA, 20 bp, Artificial
  CRISPR gRNA sequence
tgcaatgtttgaagttcaaa

SEQ ID NO: 641522 - DNA, 20 bp, Artificial
  CRISPR gRNA sequence
gcaatgtttgaagttcaaat

SEQ ID NO: 641523 - DNA, 20 bp, Artificial
  CRISPR gRNA sequence
caatgtttgaagttcaaata

SEQ ID NO: 641524 - DNA, 20 bp, Artificial
  CRISPR gRNA sequence
gaagttcaaataacttctat

SEQ ID NO: 641525 - DNA, 20 bp, Artificial
  CRISPR gRNA sequence
aagttcaaataacttctata

SEQ ID NO: 641526 - DNA, 20 bp, Artificial
  CRISPR gRNA sequence
aaataacttctataagttct

SEQ ID NO: 641527 - DNA, 20 bp, Artificial
  CRISPR gRNA sequence
ctataagttctagtgccagg

SEQ ID NO: 641528 - DNA, 20 bp, Artificial
  CRISPR gRNA sequence
tataagttctagtgccaggc

SEQ ID NO: 641529 - DNA, 20 bp, Artificial
  CRISPR gRNA sequence
taagttctagtgccaggcat

SEQ ID NO: 641530 - DNA, 20 bp, Artificial
  CRISPR gRNA sequence
tagtgccaggcatccccaaa

SEQ ID NO: 641531 - DNA, 20 bp, Artificial
  CRISPR gRNA sequence
gtgccaggcatccccaaacc

SEQ ID NO: 641532 - DNA, 20 bp, Artificial
  CRISPR gRNA sequence
gtcacatagcaggaggtgag

SEQ ID NO: 641533 - DNA, 20 bp, Artificial
  CRISPR gRNA sequence
catctgtatttacagcactt

SEQ ID NO: 641534 - DNA, 20 bp, Artificial
  CRISPR gRNA sequence
tatttacagcacttcccatc

SEQ ID NO: 641535 - DNA, 20 bp, Artificial
  CRISPR gRNA sequence
acagcacttcccatctctca

SEQ ID NO: 641536 - DNA, 20 bp, Artificial
  CRISPR gRNA sequence
cagcacttcccatctctcat

SEQ ID NO: 641537 - DNA, 20 bp, Artificial
  CRISPR gRNA sequence
cccatctctcatactactgc

SEQ ID NO: 641538 - DNA, 20 bp, Artificial
  CRISPR gRNA sequence
ccatctctcatactactgct

SEQ ID NO: 641539 - DNA, 20 bp, Artificial
  CRISPR gRNA sequence
tcatactactgcttgagctc

SEQ ID NO: 641540 - DNA, 20 bp, Artificial
  CRISPR gRNA sequence
atactactgcttgagctcca

SEQ ID NO: 641541 - DNA, 20 bp, Artificial
  CRISPR gRNA sequence
ctgcttgagctccacctcct

SEQ ID NO: 641542 - DNA, 20 bp, Artificial
  CRISPR gRNA sequence
cttgagctccacctcctgtc

SEQ ID NO: 641543 - DNA, 20 bp, Artificial
  CRISPR gRNA sequence
gagctccacctcctgtcaga

SEQ ID NO: 641544 - DNA, 20 bp, Artificial
  CRISPR gRNA sequence
agctccacctcctgtcagat

SEQ ID NO: 641545 - DNA, 20 bp, Artificial
  CRISPR gRNA sequence
cacctcctgtcagatcagct

SEQ ID NO: 641546 - DNA, 20 bp, Artificial
  CRISPR gRNA sequence
ctgtcagatcagctatggca

SEQ ID NO: 641547 - DNA, 20 bp, Artificial
  CRISPR gRNA sequence
tcagatcagctatggcacta

SEQ ID NO: 641548 - DNA, 20 bp, Artificial
  CRISPR gRNA sequence
tggcactagattctcatagg

SEQ ID NO: 641549 - DNA, 20 bp, Artificial
  CRISPR gRNA sequence
gattctcataggacggcgaa

SEQ ID NO: 641550 - DNA, 20 bp, Artificial
  CRISPR gRNA sequence
tcataggacggcgaaccttt

SEQ ID NO: 641551 - DNA, 20 bp, Artificial
  CRISPR gRNA sequence
ataggacggcgaaccttttt

SEQ ID NO: 641552 - DNA, 20 bp, Artificial
  CRISPR gRNA sequence
tttttttttttttttttttt

SEQ ID NO: 641553 - DNA, 20 bp, Artificial
  CRISPR gRNA sequence
tttttttttttttttttttt

SEQ ID NO: 641554 - DNA, 20 bp, Artificial
  CRISPR gRNA sequence
tttttttttttttttttttg

SEQ ID NO: 641555 - DNA, 20 bp, Artificial
  CRISPR gRNA sequence
ttttttttttttttttttga

SEQ ID NO: 641556 - DNA, 20 bp, Artificial
  CRISPR gRNA sequence
tttttttttttttttttgag

SEQ ID NO: 641557 - DNA, 20 bp, Artificial
  CRISPR gRNA sequence
ttttttttttttttttgaga

SEQ ID NO: 641558 - DNA, 20 bp, Artificial
  CRISPR gRNA sequence
tttttttttttttttgagac

SEQ ID NO: 641559 - DNA, 20 bp, Artificial
  CRISPR gRNA sequence
ttttttttttttttgagacg

SEQ ID NO: 641560 - DNA, 20 bp, Artificial
  CRISPR gRNA sequence
tttttttttttttgagacgg

SEQ ID NO: 641561 - DNA, 20 bp, Artificial
  CRISPR gRNA sequence
ttttttttttttgagacgga

SEQ ID NO: 641562 - DNA, 20 bp, Artificial
  CRISPR gRNA sequence
tttttttttttgagacggag

SEQ ID NO: 641563 - DNA, 20 bp, Artificial
  CRISPR gRNA sequence
ttttttttttgagacggagt

SEQ ID NO: 641564 - DNA, 20 bp, Artificial
  CRISPR gRNA sequence
tttttttttgagacggagtt

SEQ ID NO: 641565 - DNA, 20 bp, Artificial
  CRISPR gRNA sequence
ttttttttgagacggagttt

SEQ ID NO: 641566 - DNA, 20 bp, Artificial
  CRISPR gRNA sequence
tttttttgagacggagtttc

SEQ ID NO: 641567 - DNA, 20 bp, Artificial
  CRISPR gRNA sequence
ttttttgagacggagtttcg

SEQ ID NO: 641568 - DNA, 20 bp, Artificial
  CRISPR gRNA sequence
tttttgagacggagtttcgc

SEQ ID NO: 641569 - DNA, 20 bp, Artificial
  CRISPR gRNA sequence
ttttgagacggagtttcgct

SEQ ID NO: 641570 - DNA, 20 bp, Artificial
  CRISPR gRNA sequence
tttgagacggagtttcgctc

SEQ ID NO: 641571 - DNA, 20 bp, Artificial
  CRISPR gRNA sequence
ttgagacggagtttcgctct

SEQ ID NO: 641572 - DNA, 20 bp, Artificial
  CRISPR gRNA sequence
tgagacggagtttcgctctt

SEQ ID NO: 641573 - DNA, 20 bp, Artificial
  CRISPR gRNA sequence
gagacggagtttcgctcttg

SEQ ID NO: 641574 - DNA, 20 bp, Artificial
  CRISPR gRNA sequence
agacggagtttcgctcttgt

SEQ ID NO: 641575 - DNA, 20 bp, Artificial
  CRISPR gRNA sequence
cgctcttgttgcccaggctg

SEQ ID NO: 641576 - DNA, 20 bp, Artificial
  CRISPR gRNA sequence
gctcttgttgcccaggctgg

SEQ ID NO: 641577 - DNA, 20 bp, Artificial
  CRISPR gRNA sequence
ttgttgcccaggctggagtg

SEQ ID NO: 641578 - DNA, 20 bp, Artificial
  CRISPR gRNA sequence
gttgcccaggctggagtgca

SEQ ID NO: 641579 - DNA, 20 bp, Artificial
  CRISPR gRNA sequence
ttgcccaggctggagtgcaa

SEQ ID NO: 641580 - DNA, 20 bp, Artificial
  CRISPR gRNA sequence
cccaggctggagtgcaatgg

SEQ ID NO: 641581 - DNA, 20 bp, Artificial
  CRISPR gRNA sequence
gagtgcaatggcgcaatctt

SEQ ID NO: 641582 - DNA, 20 bp, Artificial
  CRISPR gRNA sequence
ggctcaccacaacctctgcc

SEQ ID NO: 641583 - DNA, 20 bp, Artificial
  CRISPR gRNA sequence
gctcaccacaacctctgcct

SEQ ID NO: 641584 - DNA, 20 bp, Artificial
  CRISPR gRNA sequence
accacaacctctgcctccca

SEQ ID NO: 641585 - DNA, 20 bp, Artificial
  CRISPR gRNA sequence
tgcctcccagtttcaagcga

SEQ ID NO: 641586 - DNA, 20 bp, Artificial
  CRISPR gRNA sequence
cctcccagtttcaagcgatt

SEQ ID NO: 641587 - DNA, 20 bp, Artificial
  CRISPR gRNA sequence
ccagtttcaagcgattctcc

SEQ ID NO: 641588 - DNA, 20 bp, Artificial
  CRISPR gRNA sequence
caagcgattctcctgcctca

SEQ ID NO: 641589 - DNA, 20 bp, Artificial
  CRISPR gRNA sequence
aagcgattctcctgcctcag

SEQ ID NO: 641590 - DNA, 20 bp, Artificial
  CRISPR gRNA sequence
tcctgcctcagcctagctgg

SEQ ID NO: 641591 - DNA, 20 bp, Artificial
  CRISPR gRNA sequence
ctgcctcagcctagctggga

SEQ ID NO: 641592 - DNA, 20 bp, Artificial
  CRISPR gRNA sequence
cctcagcctagctgggatta

SEQ ID NO: 641593 - DNA, 20 bp, Artificial
  CRISPR gRNA sequence
agcctagctgggattacaga

SEQ ID NO: 641594 - DNA, 20 bp, Artificial
  CRISPR gRNA sequence
gctgggattacagacatgcg

SEQ ID NO: 641595 - DNA, 20 bp, Artificial
  CRISPR gRNA sequence
ggattacagacatgcgccac

SEQ ID NO: 641596 - DNA, 20 bp, Artificial
  CRISPR gRNA sequence
cagacatgcgccaccacacc

SEQ ID NO: 641597 - DNA, 20 bp, Artificial
  CRISPR gRNA sequence
actttttttttttttttttt

SEQ ID NO: 641598 - DNA, 20 bp, Artificial
  CRISPR gRNA sequence
tttttttttttttttttttt

SEQ ID NO: 641599 - DNA, 20 bp, Artificial
  CRISPR gRNA sequence
tttttttttttttttttttg

SEQ ID NO: 641600 - DNA, 20 bp, Artificial
  CRISPR gRNA sequence
ttttttttttttttttttgt

SEQ ID NO: 641601 - DNA, 20 bp, Artificial
  CRISPR gRNA sequence
tttttttttttttttttgta

SEQ ID NO: 641602 - DNA, 20 bp, Artificial
  CRISPR gRNA sequence
ttttttttttttttttgtat

SEQ ID NO: 641603 - DNA, 20 bp, Artificial
  CRISPR gRNA sequence
tttttttttttttttgtatt

SEQ ID NO: 641604 - DNA, 20 bp, Artificial
  CRISPR gRNA sequence
ttttttttttttttgtattt

SEQ ID NO: 641605 - DNA, 20 bp, Artificial
  CRISPR gRNA sequence
tttttttttttttgtatttt

SEQ ID NO: 641606 - DNA, 20 bp, Artificial
  CRISPR gRNA sequence
ttttttttttttgtattttt

SEQ ID NO: 641607 - DNA, 20 bp, Artificial
  CRISPR gRNA sequence
tttttttttttgtattttta

SEQ ID NO: 641608 - DNA, 20 bp, Artificial
  CRISPR gRNA sequence
ttttttttttgtatttttag

SEQ ID NO: 641609 - DNA, 20 bp, Artificial
  CRISPR gRNA sequence
tttttttttgtatttttagt

SEQ ID NO: 641610 - DNA, 20 bp, Artificial
  CRISPR gRNA sequence
ttttttttgtatttttagta

SEQ ID NO: 641611 - DNA, 20 bp, Artificial
  CRISPR gRNA sequence
tttttttgtatttttagtag

SEQ ID NO: 641612 - DNA, 20 bp, Artificial
  CRISPR gRNA sequence
ttttttgtatttttagtaga

SEQ ID NO: 641613 - DNA, 20 bp, Artificial
  CRISPR gRNA sequence
tttttgtatttttagtagag

SEQ ID NO: 641614 - DNA, 20 bp, Artificial
  CRISPR gRNA sequence
ttttgtatttttagtagaga

SEQ ID NO: 641615 - DNA, 20 bp, Artificial
  CRISPR gRNA sequence
tttgtatttttagtagagat

SEQ ID NO: 641616 - DNA, 20 bp, Artificial
  CRISPR gRNA sequence
ttgtatttttagtagagatg

SEQ ID NO: 641617 - DNA, 20 bp, Artificial
  CRISPR gRNA sequence
tgtatttttagtagagatgg

SEQ ID NO: 641618 - DNA, 20 bp, Artificial
  CRISPR gRNA sequence
gtatttttagtagagatgga

SEQ ID NO: 641619 - DNA, 20 bp, Artificial
  CRISPR gRNA sequence
tatttttagtagagatggag

SEQ ID NO: 641620 - DNA, 20 bp, Artificial
  CRISPR gRNA sequence
ttagtagagatggagtttct

SEQ ID NO: 641621 - DNA, 20 bp, Artificial
  CRISPR gRNA sequence
tagtagagatggagtttctc

SEQ ID NO: 641622 - DNA, 20 bp, Artificial
  CRISPR gRNA sequence
agtagagatggagtttctct

SEQ ID NO: 641623 - DNA, 20 bp, Artificial
  CRISPR gRNA sequence
gtagagatggagtttctcta

SEQ ID NO: 641624 - DNA, 20 bp, Artificial
  CRISPR gRNA sequence
ctctatgttggtcaggctgg

SEQ ID NO: 641625 - DNA, 20 bp, Artificial
  CRISPR gRNA sequence
tctatgttggtcaggctggt

SEQ ID NO: 641626 - DNA, 20 bp, Artificial
  CRISPR gRNA sequence
tatgttggtcaggctggtct

SEQ ID NO: 641627 - DNA, 20 bp, Artificial
  CRISPR gRNA sequence
tgttggtcaggctggtctca

SEQ ID NO: 641628 - DNA, 20 bp, Artificial
  CRISPR gRNA sequence
gtcaggctggtctcaaactc

SEQ ID NO: 641629 - DNA, 20 bp, Artificial
  CRISPR gRNA sequence
gtctcaaactctcaacctca

SEQ ID NO: 641630 - DNA, 20 bp, Artificial
  CRISPR gRNA sequence
aaactctcaacctcaggtga

SEQ ID NO: 641631 - DNA, 20 bp, Artificial
  CRISPR gRNA sequence
tcaacctcaggtgatccgcc

SEQ ID NO: 641632 - DNA, 20 bp, Artificial
  CRISPR gRNA sequence
aacctcaggtgatccgccca

SEQ ID NO: 641633 - DNA, 20 bp, Artificial
  CRISPR gRNA sequence
aggtgatccgcccacctcgg

SEQ ID NO: 641634 - DNA, 20 bp, Artificial
  CRISPR gRNA sequence
ggcctcccaaagtactagga

SEQ ID NO: 641635 - DNA, 20 bp, Artificial
  CRISPR gRNA sequence
ccaaagtactaggattacaa

SEQ ID NO: 641636 - DNA, 20 bp, Artificial
  CRISPR gRNA sequence
ggattacaagtgtgaagcac

SEQ ID NO: 641637 - DNA, 20 bp, Artificial
  CRISPR gRNA sequence
caagtgtgaagcactgcgcc

SEQ ID NO: 641638 - DNA, 20 bp, Artificial
  CRISPR gRNA sequence
cgcccagcctcagatggcga

SEQ ID NO: 641639 - DNA, 20 bp, Artificial
  CRISPR gRNA sequence
agatggcgaactttattgtg

SEQ ID NO: 641640 - DNA, 20 bp, Artificial
  CRISPR gRNA sequence
tattgtgaactgcacatgcc

SEQ ID NO: 641641 - DNA, 20 bp, Artificial
  CRISPR gRNA sequence
attgtgaactgcacatgcca

SEQ ID NO: 641642 - DNA, 20 bp, Artificial
  CRISPR gRNA sequence
ttgtgaactgcacatgccag

SEQ ID NO: 641643 - DNA, 20 bp, Artificial
  CRISPR gRNA sequence
tgaactgcacatgccagaga

SEQ ID NO: 641644 - DNA, 20 bp, Artificial
  CRISPR gRNA sequence
cacatgccagagatctagct

SEQ ID NO: 641645 - DNA, 20 bp, Artificial
  CRISPR gRNA sequence
gcttgtgtgctccttatgag

SEQ ID NO: 641646 - DNA, 20 bp, Artificial
  CRISPR gRNA sequence
gtgtgctccttatgagaatc

SEQ ID NO: 641647 - DNA, 20 bp, Artificial
  CRISPR gRNA sequence
tgtgctccttatgagaatct

SEQ ID NO: 641648 - DNA, 20 bp, Artificial
  CRISPR gRNA sequence
cttatgagaatctaacgcct

SEQ ID NO: 641649 - DNA, 20 bp, Artificial
  CRISPR gRNA sequence
atgagaatctaacgcctgat

SEQ ID NO: 641650 - DNA, 20 bp, Artificial
  CRISPR gRNA sequence
tgagaatctaacgcctgatg

SEQ ID NO: 641651 - DNA, 20 bp, Artificial
  CRISPR gRNA sequence
acgcctgatgatctgtcact

SEQ ID NO: 641652 - DNA, 20 bp, Artificial
  CRISPR gRNA sequence
atgatctgtcactgtctccc

SEQ ID NO: 641653 - DNA, 20 bp, Artificial
  CRISPR gRNA sequence
tcactgtctcccatcacccc

SEQ ID NO: 641654 - DNA, 20 bp, Artificial
  CRISPR gRNA sequence
tctcccatcacccccagact

SEQ ID NO: 641655 - DNA, 20 bp, Artificial
  CRISPR gRNA sequence
ccatcacccccagactatct

SEQ ID NO: 641656 - DNA, 20 bp, Artificial
  CRISPR gRNA sequence
tctgggactatctagttgca

SEQ ID NO: 641657 - DNA, 20 bp, Artificial
  CRISPR gRNA sequence
ggactatctagttgcaggaa

SEQ ID NO: 641658 - DNA, 20 bp, Artificial
  CRISPR gRNA sequence
tctagttgcaggaaaacaag

SEQ ID NO: 641659 - DNA, 20 bp, Artificial
  CRISPR gRNA sequence
gttgcaggaaaacaagctta

SEQ ID NO: 641660 - DNA, 20 bp, Artificial
  CRISPR gRNA sequence
caggaaaacaagcttaggac

SEQ ID NO: 641661 - DNA, 20 bp, Artificial
  CRISPR gRNA sequence
aggactccacagattctaca

SEQ ID NO: 641662 - DNA, 20 bp, Artificial
  CRISPR gRNA sequence
ggactccacagattctacat

SEQ ID NO: 641663 - DNA, 20 bp, Artificial
  CRISPR gRNA sequence
cacagattctacattatgat

SEQ ID NO: 641664 - DNA, 20 bp, Artificial
  CRISPR gRNA sequence
tacattatgatgagttatag

SEQ ID NO: 641665 - DNA, 20 bp, Artificial
  CRISPR gRNA sequence
cattatgatgagttatagaa

SEQ ID NO: 641666 - DNA, 20 bp, Artificial
  CRISPR gRNA sequence
tgatgagttatagaattatt

SEQ ID NO: 641667 - DNA, 20 bp, Artificial
  CRISPR gRNA sequence
tagaattatttcattatata

SEQ ID NO: 641668 - DNA, 20 bp, Artificial
  CRISPR gRNA sequence
tttcattatatataacaatg

SEQ ID NO: 641669 - DNA, 20 bp, Artificial
  CRISPR gRNA sequence
cattatatataacaatgtaa

SEQ ID NO: 641670 - DNA, 20 bp, Artificial
  CRISPR gRNA sequence
attatatataacaatgtaat

SEQ ID NO: 641671 - DNA, 20 bp, Artificial
  CRISPR gRNA sequence
tatataacaatgtaataata

SEQ ID NO: 641672 - DNA, 20 bp, Artificial
  CRISPR gRNA sequence
ttgaatcatcccgaaaccat

SEQ ID NO: 641673 - DNA, 20 bp, Artificial
  CRISPR gRNA sequence
gaatcatcccgaaaccatcc

SEQ ID NO: 641674 - DNA, 20 bp, Artificial
  CRISPR gRNA sequence
aatcatcccgaaaccatccc

SEQ ID NO: 641675 - DNA, 20 bp, Artificial
  CRISPR gRNA sequence
accctcaggctgtggaaaaa

SEQ ID NO: 641676 - DNA, 20 bp, Artificial
  CRISPR gRNA sequence
aggctgtggaaaaattgtct

SEQ ID NO: 641677 - DNA, 20 bp, Artificial
  CRISPR gRNA sequence
tggaaaaattgtcttccaca

SEQ ID NO: 641678 - DNA, 20 bp, Artificial
  CRISPR gRNA sequence
tcttccacaaaaccagtact

SEQ ID NO: 641679 - DNA, 20 bp, Artificial
  CRISPR gRNA sequence
ccacaaaaccagtacttggt

SEQ ID NO: 641680 - DNA, 20 bp, Artificial
  CRISPR gRNA sequence
cacaaaaccagtacttggtg

SEQ ID NO: 641681 - DNA, 20 bp, Artificial
  CRISPR gRNA sequence
ggtgccaaaaaggttgggga

SEQ ID NO: 641682 - DNA, 20 bp, Artificial
  CRISPR gRNA sequence
gtgccaaaaaggttggggat

SEQ ID NO: 641683 - DNA, 20 bp, Artificial
  CRISPR gRNA sequence
gggatagaatacagattatt

SEQ ID NO: 641684 - DNA, 20 bp, Artificial
  CRISPR gRNA sequence
tttggagtaagtcaggcctc

SEQ ID NO: 641685 - DNA, 20 bp, Artificial
  CRISPR gRNA sequence
ggagtaagtcaggcctcagt

SEQ ID NO: 641686 - DNA, 20 bp, Artificial
  CRISPR gRNA sequence
gagtaagtcaggcctcagtt

SEQ ID NO: 641687 - DNA, 20 bp, Artificial
  CRISPR gRNA sequence
agtttaaatacccaaactga

SEQ ID NO: 641688 - DNA, 20 bp, Artificial
  CRISPR gRNA sequence
aaatacccaaactgacactt

SEQ ID NO: 641689 - DNA, 20 bp, Artificial
  CRISPR gRNA sequence
aatacccaaactgacacttg

SEQ ID NO: 641690 - DNA, 20 bp, Artificial
  CRISPR gRNA sequence
acacttgtcacctgccaatt

SEQ ID NO: 641691 - DNA, 20 bp, Artificial
  CRISPR gRNA sequence
gtcacctgccaattattcaa

SEQ ID NO: 641692 - DNA, 20 bp, Artificial
  CRISPR gRNA sequence
tcacctgccaattattcaag

SEQ ID NO: 641693 - DNA, 20 bp, Artificial
  CRISPR gRNA sequence
ccaattattcaagtacacct

SEQ ID NO: 641694 - DNA, 20 bp, Artificial
  CRISPR gRNA sequence
ttcaagtacacctgtctaaa

SEQ ID NO: 641695 - DNA, 20 bp, Artificial
  CRISPR gRNA sequence
aagtacacctgtctaaacta

SEQ ID NO: 641696 - DNA, 20 bp, Artificial
  CRISPR gRNA sequence
tctaaactacagtaaagtga

SEQ ID NO: 641697 - DNA, 20 bp, Artificial
  CRISPR gRNA sequence
aactacagtaaagtgagcat

SEQ ID NO: 641698 - DNA, 20 bp, Artificial
  CRISPR gRNA sequence
cagtaaagtgagcatatgat

SEQ ID NO: 641699 - DNA, 20 bp, Artificial
  CRISPR gRNA sequence
aaccaccttgattttgcatc

SEQ ID NO: 641700 - DNA, 20 bp, Artificial
  CRISPR gRNA sequence
gattttgcatcccaaacctg

SEQ ID NO: 641701 - DNA, 20 bp, Artificial
  CRISPR gRNA sequence
attttgcatcccaaacctgt

SEQ ID NO: 641702 - DNA, 20 bp, Artificial
  CRISPR gRNA sequence
tgcatcccaaacctgtcact

SEQ ID NO: 641703 - DNA, 20 bp, Artificial
  CRISPR gRNA sequence
gcatcccaaacctgtcactt

SEQ ID NO: 641704 - DNA, 20 bp, Artificial
  CRISPR gRNA sequence
catcccaaacctgtcactta

SEQ ID NO: 641705 - DNA, 20 bp, Artificial
  CRISPR gRNA sequence
tcacttaccagctgtatatc

SEQ ID NO: 641706 - DNA, 20 bp, Artificial
  CRISPR gRNA sequence
accagctgtatatcacagag

SEQ ID NO: 641707 - DNA, 20 bp, Artificial
  CRISPR gRNA sequence
ccagctgtatatcacagagc

SEQ ID NO: 641708 - DNA, 20 bp, Artificial
  CRISPR gRNA sequence
tatatcacagagcatattag

SEQ ID NO: 641709 - DNA, 20 bp, Artificial
  CRISPR gRNA sequence
gtcagcctcagtttccctgg

SEQ ID NO: 641710 - DNA, 20 bp, Artificial
  CRISPR gRNA sequence
agtttccctggaatgcttcc

SEQ ID NO: 641711 - DNA, 20 bp, Artificial
  CRISPR gRNA sequence
ccctggaatgcttccctggc

SEQ ID NO: 641712 - DNA, 20 bp, Artificial
  CRISPR gRNA sequence
cctggaatgcttccctggct

SEQ ID NO: 641713 - DNA, 20 bp, Artificial
  CRISPR gRNA sequence
gaatgcttccctggcttaga

SEQ ID NO: 641714 - DNA, 20 bp, Artificial
  CRISPR gRNA sequence
ccctggcttagaaatttgag

SEQ ID NO: 641715 - DNA, 20 bp, Artificial
  CRISPR gRNA sequence
cctggcttagaaatttgaga

SEQ ID NO: 641716 - DNA, 20 bp, Artificial
  CRISPR gRNA sequence
gcttagaaatttgagataat

SEQ ID NO: 641717 - DNA, 20 bp, Artificial
  CRISPR gRNA sequence
agaaatttgagataataact

SEQ ID NO: 641718 - DNA, 20 bp, Artificial
  CRISPR gRNA sequence
gaaatttgagataataactt

SEQ ID NO: 641719 - DNA, 20 bp, Artificial
  CRISPR gRNA sequence
gagataataactttccaggg

SEQ ID NO: 641720 - DNA, 20 bp, Artificial
  CRISPR gRNA sequence
agataataactttccaggga

SEQ ID NO: 641721 - DNA, 20 bp, Artificial
  CRISPR gRNA sequence
tccagggaagttttaaggag

SEQ ID NO: 641722 - DNA, 20 bp, Artificial
  CRISPR gRNA sequence
ccagggaagttttaaggagt

SEQ ID NO: 641723 - DNA, 20 bp, Artificial
  CRISPR gRNA sequence
cagggaagttttaaggagta

SEQ ID NO: 641724 - DNA, 20 bp, Artificial
  CRISPR gRNA sequence
taaggagtaaattgtataga

SEQ ID NO: 641725 - DNA, 20 bp, Artificial
  CRISPR gRNA sequence
aaggagtaaattgtatagac

SEQ ID NO: 641726 - DNA, 20 bp, Artificial
  CRISPR gRNA sequence
aggagtaaattgtatagact

SEQ ID NO: 641727 - DNA, 20 bp, Artificial
  CRISPR gRNA sequence
tatagactgtatgaaagtac

SEQ ID NO: 641728 - DNA, 20 bp, Artificial
  CRISPR gRNA sequence
tatgaaagtacctcacacag

SEQ ID NO: 641729 - DNA, 20 bp, Artificial
  CRISPR gRNA sequence
acacagtacctaacatatag

SEQ ID NO: 641730 - DNA, 20 bp, Artificial
  CRISPR gRNA sequence
acatatagggatactcaata

SEQ ID NO: 641731 - DNA, 20 bp, Artificial
  CRISPR gRNA sequence
aataaataatagttctgttc

SEQ ID NO: 641732 - DNA, 20 bp, Artificial
  CRISPR gRNA sequence
tgttcctcactacaaaagat

SEQ ID NO: 641733 - DNA, 20 bp, Artificial
  CRISPR gRNA sequence
ttcctcactacaaaagattc

SEQ ID NO: 641734 - DNA, 20 bp, Artificial
  CRISPR gRNA sequence
ctcactacaaaagattctcc

SEQ ID NO: 641735 - DNA, 20 bp, Artificial
  CRISPR gRNA sequence
actacaaaagattctcctaa

SEQ ID NO: 641736 - DNA, 20 bp, Artificial
  CRISPR gRNA sequence
caaaagattctcctaaacta

SEQ ID NO: 641737 - DNA, 20 bp, Artificial
  CRISPR gRNA sequence
tcctaaactacagtttactc

SEQ ID NO: 641738 - DNA, 20 bp, Artificial
  CRISPR gRNA sequence
ctaaactacagtttactcac

SEQ ID NO: 641739 - DNA, 20 bp, Artificial
  CRISPR gRNA sequence
aactacagtttactcacagc

SEQ ID NO: 641740 - DNA, 20 bp, Artificial
  CRISPR gRNA sequence
cagtttactcacagcaatgt

SEQ ID NO: 641741 - DNA, 20 bp, Artificial
  CRISPR gRNA sequence
actcacagcaatgttaattt

SEQ ID NO: 641742 - DNA, 20 bp, Artificial
  CRISPR gRNA sequence
ctcacagcaatgttaatttc

SEQ ID NO: 641743 - DNA, 20 bp, Artificial
  CRISPR gRNA sequence
acagcaatgttaatttcatt

SEQ ID NO: 641744 - DNA, 20 bp, Artificial
  CRISPR gRNA sequence
atttcattcttatggtcagt

SEQ ID NO: 641745 - DNA, 20 bp, Artificial
  CRISPR gRNA sequence
cattcttatggtcagtgtta

SEQ ID NO: 641746 - DNA, 20 bp, Artificial
  CRISPR gRNA sequence
attcttatggtcagtgttag

SEQ ID NO: 641747 - DNA, 20 bp, Artificial
  CRISPR gRNA sequence
ttatggtcagtgttagaaaa

SEQ ID NO: 641748 - DNA, 20 bp, Artificial
  CRISPR gRNA sequence
atggtcagtgttagaaaagt

SEQ ID NO: 641749 - DNA, 20 bp, Artificial
  CRISPR gRNA sequence
tggtcagtgttagaaaagtg

SEQ ID NO: 641750 - DNA, 20 bp, Artificial
  CRISPR gRNA sequence
gaaaagtgcttagtaatcat

SEQ ID NO: 641751 - DNA, 20 bp, Artificial
  CRISPR gRNA sequence
agtaatcatttttattatgg

SEQ ID NO: 641752 - DNA, 20 bp, Artificial
  CRISPR gRNA sequence
gtaatcatttttattatggc

SEQ ID NO: 641753 - DNA, 20 bp, Artificial
  CRISPR gRNA sequence
ttattatggctttggggtaa

SEQ ID NO: 641754 - DNA, 20 bp, Artificial
  CRISPR gRNA sequence
tattatggctttggggtaag

SEQ ID NO: 641755 - DNA, 20 bp, Artificial
  CRISPR gRNA sequence
attatggctttggggtaagg

SEQ ID NO: 641756 - DNA, 20 bp, Artificial
  CRISPR gRNA sequence
ttatggctttggggtaagga

SEQ ID NO: 641757 - DNA, 20 bp, Artificial
  CRISPR gRNA sequence
tggctttggggtaaggaaat

SEQ ID NO: 641758 - DNA, 20 bp, Artificial
  CRISPR gRNA sequence
tggggtaaggaaatgaacat

SEQ ID NO: 641759 - DNA, 20 bp, Artificial
  CRISPR gRNA sequence
ggggtaaggaaatgaacata

SEQ ID NO: 641760 - DNA, 20 bp, Artificial
  CRISPR gRNA sequence
gggtaaggaaatgaacatat

SEQ ID NO: 641761 - DNA, 20 bp, Artificial
  CRISPR gRNA sequence
acagaagtaacaaggtctac

SEQ ID NO: 641762 - DNA, 20 bp, Artificial
  CRISPR gRNA sequence
cagaagtaacaaggtctaca

SEQ ID NO: 641763 - DNA, 20 bp, Artificial
  CRISPR gRNA sequence
caaaaaggtttctgaaaaaa

SEQ ID NO: 641764 - DNA, 20 bp, Artificial
  CRISPR gRNA sequence
ctgaaaaaaatcataagatg

SEQ ID NO: 641765 - DNA, 20 bp, Artificial
  CRISPR gRNA sequence
tgaaaaaaatcataagatga

SEQ ID NO: 641766 - DNA, 20 bp, Artificial
  CRISPR gRNA sequence
aaaaaaatcataagatgata

SEQ ID NO: 641767 - DNA, 20 bp, Artificial
  CRISPR gRNA sequence
tgtcactctaaaaaagaaat

SEQ ID NO: 641768 - DNA, 20 bp, Artificial
  CRISPR gRNA sequence
taaaaaagaaattgaaaaaa

SEQ ID NO: 641769 - DNA, 20 bp, Artificial
  CRISPR gRNA sequence
aaaaagaaattgaaaaaaaa

SEQ ID NO: 641770 - DNA, 20 bp, Artificial
  CRISPR gRNA sequence
aaaaaaaaaacaggttcctt

SEQ ID NO: 641771 - DNA, 20 bp, Artificial
  CRISPR gRNA sequence
cttcaactctccctttctta

SEQ ID NO: 641772 - DNA, 20 bp, Artificial
  CRISPR gRNA sequence
caactctccctttcttaagt

SEQ ID NO: 641773 - DNA, 20 bp, Artificial
  CRISPR gRNA sequence
aactctccctttcttaagta

SEQ ID NO: 641774 - DNA, 20 bp, Artificial
  CRISPR gRNA sequence
tccctttcttaagtattttc

SEQ ID NO: 641775 - DNA, 20 bp, Artificial
  CRISPR gRNA sequence
cctttcttaagtattttctg

SEQ ID NO: 641776 - DNA, 20 bp, Artificial
  CRISPR gRNA sequence
tcttaagtattttctgttac

SEQ ID NO: 641777 - DNA, 20 bp, Artificial
  CRISPR gRNA sequence
cttaagtattttctgttact

SEQ ID NO: 641778 - DNA, 20 bp, Artificial
  CRISPR gRNA sequence
ttaagtattttctgttacta

SEQ ID NO: 641779 - DNA, 20 bp, Artificial
  CRISPR gRNA sequence
aagtattttctgttactatt

SEQ ID NO: 641780 - DNA, 20 bp, Artificial
  CRISPR gRNA sequence
agtattttctgttactatta

SEQ ID NO: 641781 - DNA, 20 bp, Artificial
  CRISPR gRNA sequence
tctgttactattaagtccca

SEQ ID NO: 641782 - DNA, 20 bp, Artificial
  CRISPR gRNA sequence
ctgttactattaagtcccaa

SEQ ID NO: 641783 - DNA, 20 bp, Artificial
  CRISPR gRNA sequence
tgttactattaagtcccaat

SEQ ID NO: 641784 - DNA, 20 bp, Artificial
  CRISPR gRNA sequence
ttactattaagtcccaatat

SEQ ID NO: 641785 - DNA, 20 bp, Artificial
  CRISPR gRNA sequence
ctattaagtcccaatatcag

SEQ ID NO: 641786 - DNA, 20 bp, Artificial
  CRISPR gRNA sequence
ttaagtcccaatatcaggtg

SEQ ID NO: 641787 - DNA, 20 bp, Artificial
  CRISPR gRNA sequence
agtcccaatatcaggtgatg

SEQ ID NO: 641788 - DNA, 20 bp, Artificial
  CRISPR gRNA sequence
tctgaaggccttttacacat

SEQ ID NO: 641789 - DNA, 20 bp, Artificial
  CRISPR gRNA sequence
aaggccttttacacatgaaa

SEQ ID NO: 641790 - DNA, 20 bp, Artificial
  CRISPR gRNA sequence
ttacacatgaaaaaatatta

SEQ ID NO: 641791 - DNA, 20 bp, Artificial
  CRISPR gRNA sequence
tacacatgaaaaaatattat

SEQ ID NO: 641792 - DNA, 20 bp, Artificial
  CRISPR gRNA sequence
acacatgaaaaaatattatc

SEQ ID NO: 641793 - DNA, 20 bp, Artificial
  CRISPR gRNA sequence
cacatgaaaaaatattatca

SEQ ID NO: 641794 - DNA, 20 bp, Artificial
  CRISPR gRNA sequence
tcatgccttctctaatctga

SEQ ID NO: 641795 - DNA, 20 bp, Artificial
  CRISPR gRNA sequence
ctctaatctgaaagaataaa

SEQ ID NO: 641796 - DNA, 20 bp, Artificial
  CRISPR gRNA sequence
tctaatctgaaagaataaaa

SEQ ID NO: 641797 - DNA, 20 bp, Artificial
  CRISPR gRNA sequence
taatctgaaagaataaaata

SEQ ID NO: 641798 - DNA, 20 bp, Artificial
  CRISPR gRNA sequence
atctgaaagaataaaataac

SEQ ID NO: 641799 - DNA, 20 bp, Artificial
  CRISPR gRNA sequence
aaagaataaaataacattaa

SEQ ID NO: 641800 - DNA, 20 bp, Artificial
  CRISPR gRNA sequence
agccttgttgaagttgtact

SEQ ID NO: 641801 - DNA, 20 bp, Artificial
  CRISPR gRNA sequence
gttgaagttgtactttgtaa

SEQ ID NO: 641802 - DNA, 20 bp, Artificial
  CRISPR gRNA sequence
ttgaagttgtactttgtaac

SEQ ID NO: 641803 - DNA, 20 bp, Artificial
  CRISPR gRNA sequence
aagttgtactttgtaacctt

SEQ ID NO: 641804 - DNA, 20 bp, Artificial
  CRISPR gRNA sequence
tactttgtaacctttagagc

SEQ ID NO: 641805 - DNA, 20 bp, Artificial
  CRISPR gRNA sequence
tgtaacctttagagcccatc

SEQ ID NO: 641806 - DNA, 20 bp, Artificial
  CRISPR gRNA sequence
gtaacctttagagcccatca

SEQ ID NO: 641807 - DNA, 20 bp, Artificial
  CRISPR gRNA sequence
taacctttagagcccatcac

SEQ ID NO: 641808 - DNA, 20 bp, Artificial
  CRISPR gRNA sequence
tagagcccatcacatactta

SEQ ID NO: 641809 - DNA, 20 bp, Artificial
  CRISPR gRNA sequence
agagcccatcacatacttac

SEQ ID NO: 641810 - DNA, 20 bp, Artificial
  CRISPR gRNA sequence
gagcccatcacatacttaca

SEQ ID NO: 641811 - DNA, 20 bp, Artificial
  CRISPR gRNA sequence
acaactctctttgctcatgt

SEQ ID NO: 641812 - DNA, 20 bp, Artificial
  CRISPR gRNA sequence
caactctctttgctcatgta

SEQ ID NO: 641813 - DNA, 20 bp, Artificial
  CRISPR gRNA sequence
tctttgctcatgtagtatcc

SEQ ID NO: 641814 - DNA, 20 bp, Artificial
  CRISPR gRNA sequence
tttgctcatgtagtatccct

SEQ ID NO: 641815 - DNA, 20 bp, Artificial
  CRISPR gRNA sequence
tgctcatgtagtatcccttt

SEQ ID NO: 641816 - DNA, 20 bp, Artificial
  CRISPR gRNA sequence
gctcatgtagtatccctttg

SEQ ID NO: 641817 - DNA, 20 bp, Artificial
  CRISPR gRNA sequence
ctcatgtagtatccctttgc

SEQ ID NO: 641818 - DNA, 20 bp, Artificial
  CRISPR gRNA sequence
atgtagtatccctttgcatt

SEQ ID NO: 641819 - DNA, 20 bp, Artificial
  CRISPR gRNA sequence
tgcattggatgtcctcattt

SEQ ID NO: 641820 - DNA, 20 bp, Artificial
  CRISPR gRNA sequence
gcattggatgtcctcatttg

SEQ ID NO: 641821 - DNA, 20 bp, Artificial
  CRISPR gRNA sequence
cattggatgtcctcatttgt

SEQ ID NO: 641822 - DNA, 20 bp, Artificial
  CRISPR gRNA sequence
gatgtcctcatttgtcctca

SEQ ID NO: 641823 - DNA, 20 bp, Artificial
  CRISPR gRNA sequence
atttgtcctcattttctagc

SEQ ID NO: 641824 - DNA, 20 bp, Artificial
  CRISPR gRNA sequence
gtcctcattttctagctttc

SEQ ID NO: 641825 - DNA, 20 bp, Artificial
  CRISPR gRNA sequence
tcctcattttctagctttca

SEQ ID NO: 641826 - DNA, 20 bp, Artificial
  CRISPR gRNA sequence
attttctagctttcatgatt

SEQ ID NO: 641827 - DNA, 20 bp, Artificial
  CRISPR gRNA sequence
tctagctttcatgattcaag

SEQ ID NO: 641828 - DNA, 20 bp, Artificial
  CRISPR gRNA sequence
ctagctttcatgattcaagg

SEQ ID NO: 641829 - DNA, 20 bp, Artificial
  CRISPR gRNA sequence
tagctttcatgattcaaggt

SEQ ID NO: 641830 - DNA, 20 bp, Artificial
  CRISPR gRNA sequence
gctttcatgattcaaggtcc

SEQ ID NO: 641831 - DNA, 20 bp, Artificial
  CRISPR gRNA sequence
tcatgattcaaggtccagtt

SEQ ID NO: 641832 - DNA, 20 bp, Artificial
  CRISPR gRNA sequence
catgattcaaggtccagttt

SEQ ID NO: 641833 - DNA, 20 bp, Artificial
  CRISPR gRNA sequence
atgattcaaggtccagtttc

SEQ ID NO: 641834 - DNA, 20 bp, Artificial
  CRISPR gRNA sequence
aaggtccagtttcaatgtga

SEQ ID NO: 641835 - DNA, 20 bp, Artificial
  CRISPR gRNA sequence
caatgtgatttcctaaaaga

SEQ ID NO: 641836 - DNA, 20 bp, Artificial
  CRISPR gRNA sequence
aatgtgatttcctaaaagaa

SEQ ID NO: 641837 - DNA, 20 bp, Artificial
  CRISPR gRNA sequence
cctaaaagaatatccctttc

SEQ ID NO: 641838 - DNA, 20 bp, Artificial
  CRISPR gRNA sequence
ctaaaagaatatccctttct

SEQ ID NO: 641839 - DNA, 20 bp, Artificial
  CRISPR gRNA sequence
aaagaatatccctttctgtc

SEQ ID NO: 641840 - DNA, 20 bp, Artificial
  CRISPR gRNA sequence
tctgtccaattttggtgaaa

SEQ ID NO: 641841 - DNA, 20 bp, Artificial
  CRISPR gRNA sequence
ctgtccaattttggtgaaat

SEQ ID NO: 641842 - DNA, 20 bp, Artificial
  CRISPR gRNA sequence
tgtccaattttggtgaaatt

SEQ ID NO: 641843 - DNA, 20 bp, Artificial
  CRISPR gRNA sequence
tccaattttggtgaaattaa

SEQ ID NO: 641844 - DNA, 20 bp, Artificial
  CRISPR gRNA sequence
tggtgaaattaatggctcct

SEQ ID NO: 641845 - DNA, 20 bp, Artificial
  CRISPR gRNA sequence
ggtgaaattaatggctccta

SEQ ID NO: 641846 - DNA, 20 bp, Artificial
  CRISPR gRNA sequence
gtgaaattaatggctcctaa

SEQ ID NO: 641847 - DNA, 20 bp, Artificial
  CRISPR gRNA sequence
atggctcctaacagaatagt

SEQ ID NO: 641848 - DNA, 20 bp, Artificial
  CRISPR gRNA sequence
ctaacagaatagtgaatcta

SEQ ID NO: 641849 - DNA, 20 bp, Artificial
  CRISPR gRNA sequence
acagaatagtgaatctacac

SEQ ID NO: 641850 - DNA, 20 bp, Artificial
  CRISPR gRNA sequence
caccgcaaatataatttaac

SEQ ID NO: 641851 - DNA, 20 bp, Artificial
  CRISPR gRNA sequence
aactgtcacttctattacgc

SEQ ID NO: 641852 - DNA, 20 bp, Artificial
  CRISPR gRNA sequence
actgtcacttctattacgct

SEQ ID NO: 641853 - DNA, 20 bp, Artificial
  CRISPR gRNA sequence
tcacttctattacgctgtac

SEQ ID NO: 641854 - DNA, 20 bp, Artificial
  CRISPR gRNA sequence
ctattacgctgtacgctatg

SEQ ID NO: 641855 - DNA, 20 bp, Artificial
  CRISPR gRNA sequence
tattacgctgtacgctatga

SEQ ID NO: 641856 - DNA, 20 bp, Artificial
  CRISPR gRNA sequence
ttacgctgtacgctatgacc

SEQ ID NO: 641857 - DNA, 20 bp, Artificial
  CRISPR gRNA sequence
cgctgtacgctatgacccaa

SEQ ID NO: 641858 - DNA, 20 bp, Artificial
  CRISPR gRNA sequence
tacgctatgacccaagaaca

SEQ ID NO: 641859 - DNA, 20 bp, Artificial
  CRISPR gRNA sequence
tgacccaagaacaatcttat

SEQ ID NO: 641860 - DNA, 20 bp, Artificial
  CRISPR gRNA sequence
attcatctctgcattccagg

SEQ ID NO: 641861 - DNA, 20 bp, Artificial
  CRISPR gRNA sequence
ttcatctctgcattccaggc

SEQ ID NO: 641862 - DNA, 20 bp, Artificial
  CRISPR gRNA sequence
atctctgcattccaggcact

SEQ ID NO: 641863 - DNA, 20 bp, Artificial
  CRISPR gRNA sequence
tgcattccaggcacttaaca

SEQ ID NO: 641864 - DNA, 20 bp, Artificial
  CRISPR gRNA sequence
cattccaggcacttaacaca

SEQ ID NO: 641865 - DNA, 20 bp, Artificial
  CRISPR gRNA sequence
caggcacttaacacagtggc

SEQ ID NO: 641866 - DNA, 20 bp, Artificial
  CRISPR gRNA sequence
aacacagtggctggcacaca

SEQ ID NO: 641867 - DNA, 20 bp, Artificial
  CRISPR gRNA sequence
acacagtggctggcacacaa

SEQ ID NO: 641868 - DNA, 20 bp, Artificial
  CRISPR gRNA sequence
gcacacaataatgttcaaaa

SEQ ID NO: 641869 - DNA, 20 bp, Artificial
  CRISPR gRNA sequence
aaaaaatatttacagaatca

SEQ ID NO: 641870 - DNA, 20 bp, Artificial
  CRISPR gRNA sequence
acagaatcaagttgaattct

SEQ ID NO: 641871 - DNA, 20 bp, Artificial
  CRISPR gRNA sequence
cagaatcaagttgaattctt

SEQ ID NO: 641872 - DNA, 20 bp, Artificial
  CRISPR gRNA sequence
aattcttccccaagtcatct

SEQ ID NO: 641873 - DNA, 20 bp, Artificial
  CRISPR gRNA sequence
ttccccaagtcatctttctc

SEQ ID NO: 641874 - DNA, 20 bp, Artificial
  CRISPR gRNA sequence
ccccaagtcatctttctctt

SEQ ID NO: 641875 - DNA, 20 bp, Artificial
  CRISPR gRNA sequence
cccaagtcatctttctcttt

SEQ ID NO: 641876 - DNA, 20 bp, Artificial
  CRISPR gRNA sequence
tctcttttaaaacacttaga

SEQ ID NO: 641877 - DNA, 20 bp, Artificial
  CRISPR gRNA sequence
ctcttttaaaacacttagaa

SEQ ID NO: 641878 - DNA, 20 bp, Artificial
  CRISPR gRNA sequence
tcttttaaaacacttagaaa

SEQ ID NO: 641879 - DNA, 20 bp, Artificial
  CRISPR gRNA sequence
ttttaaaacacttagaaaca

SEQ ID NO: 641880 - DNA, 20 bp, Artificial
  CRISPR gRNA sequence
ttaaaacacttagaaacact

SEQ ID NO: 641881 - DNA, 20 bp, Artificial
  CRISPR gRNA sequence
taaaacacttagaaacactt

SEQ ID NO: 641882 - DNA, 20 bp, Artificial
  CRISPR gRNA sequence
aaaacacttagaaacactta

SEQ ID NO: 641883 - DNA, 20 bp, Artificial
  CRISPR gRNA sequence
aaacacttagaaacacttag

SEQ ID NO: 641884 - DNA, 20 bp, Artificial
  CRISPR gRNA sequence
agaaacacttagaaacagat

SEQ ID NO: 641885 - DNA, 20 bp, Artificial
  CRISPR gRNA sequence
gaaacacttagaaacagatg

SEQ ID NO: 641886 - DNA, 20 bp, Artificial
  CRISPR gRNA sequence
agaaacagatgatgttaaaa

SEQ ID NO: 641887 - DNA, 20 bp, Artificial
  CRISPR gRNA sequence
gaaacagatgatgttaaaag

SEQ ID NO: 641888 - DNA, 20 bp, Artificial
  CRISPR gRNA sequence
aaagcaatttttagtaagca

SEQ ID NO: 641889 - DNA, 20 bp, Artificial
  CRISPR gRNA sequence
ttagtaagcatttttaaaat

SEQ ID NO: 641890 - DNA, 20 bp, Artificial
  CRISPR gRNA sequence
tagtaagcatttttaaaatc

SEQ ID NO: 641891 - DNA, 20 bp, Artificial
  CRISPR gRNA sequence
agtaagcatttttaaaatcg

SEQ ID NO: 641892 - DNA, 20 bp, Artificial
  CRISPR gRNA sequence
gtaagcatttttaaaatcga

SEQ ID NO: 641893 - DNA, 20 bp, Artificial
  CRISPR gRNA sequence
ttaaaatcgaaaggtgagct

SEQ ID NO: 641894 - DNA, 20 bp, Artificial
  CRISPR gRNA sequence
taaaatcgaaaggtgagctc

SEQ ID NO: 641895 - DNA, 20 bp, Artificial
  CRISPR gRNA sequence
aaaatcgaaaggtgagctcc

SEQ ID NO: 641896 - DNA, 20 bp, Artificial
  CRISPR gRNA sequence
aaatcgaaaggtgagctcct

SEQ ID NO: 641897 - DNA, 20 bp, Artificial
  CRISPR gRNA sequence
cttcttttattaaaaggcac

SEQ ID NO: 641898 - DNA, 20 bp, Artificial
  CRISPR gRNA sequence
cttttattaaaaggcactaa

SEQ ID NO: 641899 - DNA, 20 bp, Artificial
  CRISPR gRNA sequence
ttttattaaaaggcactaaa

SEQ ID NO: 641900 - DNA, 20 bp, Artificial
  CRISPR gRNA sequence
ttattaaaaggcactaaaga

SEQ ID NO: 641901 - DNA, 20 bp, Artificial
  CRISPR gRNA sequence
tattaaaaggcactaaagag

SEQ ID NO: 641902 - DNA, 20 bp, Artificial
  CRISPR gRNA sequence
attaaaaggcactaaagagc

SEQ ID NO: 641903 - DNA, 20 bp, Artificial
  CRISPR gRNA sequence
ttaaaaggcactaaagagca

SEQ ID NO: 641904 - DNA, 20 bp, Artificial
  CRISPR gRNA sequence
aaaggcactaaagagcaatt

SEQ ID NO: 641905 - DNA, 20 bp, Artificial
  CRISPR gRNA sequence
aagagcaattaaatattttt

SEQ ID NO: 641906 - DNA, 20 bp, Artificial
  CRISPR gRNA sequence
aatatttttcaaattatgta

SEQ ID NO: 641907 - DNA, 20 bp, Artificial
  CRISPR gRNA sequence
ttcaaattatgtatgttttt

SEQ ID NO: 641908 - DNA, 20 bp, Artificial
  CRISPR gRNA sequence
tcaaattatgtatgttttta

SEQ ID NO: 641909 - DNA, 20 bp, Artificial
  CRISPR gRNA sequence
caaattatgtatgtttttaa

SEQ ID NO: 641910 - DNA, 20 bp, Artificial
  CRISPR gRNA sequence
aaattatgtatgtttttaaa

SEQ ID NO: 641911 - DNA, 20 bp, Artificial
  CRISPR gRNA sequence
tgtatgtttttaaacaaaaa

SEQ ID NO: 641912 - DNA, 20 bp, Artificial
  CRISPR gRNA sequence
ttaaacaaaaagccttttgg

SEQ ID NO: 641913 - DNA, 20 bp, Artificial
  CRISPR gRNA sequence
taaacaaaaagccttttgga

SEQ ID NO: 641914 - DNA, 20 bp, Artificial
  CRISPR gRNA sequence
aaacaaaaagccttttggac

SEQ ID NO: 641915 - DNA, 20 bp, Artificial
  CRISPR gRNA sequence
aacaaaaagccttttggaca

SEQ ID NO: 641916 - DNA, 20 bp, Artificial
  CRISPR gRNA sequence
ttggacacatgttcttatta

SEQ ID NO: 641917 - DNA, 20 bp, Artificial
  CRISPR gRNA sequence
tggacacatgttcttattat

SEQ ID NO: 641918 - DNA, 20 bp, Artificial
  CRISPR gRNA sequence
ggacacatgttcttattatg

SEQ ID NO: 641919 - DNA, 20 bp, Artificial
  CRISPR gRNA sequence
gacacatgttcttattatga

SEQ ID NO: 641920 - DNA, 20 bp, Artificial
  CRISPR gRNA sequence
ttattatgagccaaatttgc

SEQ ID NO: 641921 - DNA, 20 bp, Artificial
  CRISPR gRNA sequence
attatgagccaaatttgcca

SEQ ID NO: 641922 - DNA, 20 bp, Artificial
  CRISPR gRNA sequence
ttatgagccaaatttgccag

SEQ ID NO: 641923 - DNA, 20 bp, Artificial
  CRISPR gRNA sequence
tgagccaaatttgccagcaa

SEQ ID NO: 641924 - DNA, 20 bp, Artificial
  CRISPR gRNA sequence
gccagcaaggcaagtgacac

SEQ ID NO: 641925 - DNA, 20 bp, Artificial
  CRISPR gRNA sequence
ccagcaaggcaagtgacact

SEQ ID NO: 641926 - DNA, 20 bp, Artificial
  CRISPR gRNA sequence
ttgacatcttagggtataaa

SEQ ID NO: 641927 - DNA, 20 bp, Artificial
  CRISPR gRNA sequence
acatcttagggtataaatgg

SEQ ID NO: 641928 - DNA, 20 bp, Artificial
  CRISPR gRNA sequence
agggtataaatggcttatat

SEQ ID NO: 641929 - DNA, 20 bp, Artificial
  CRISPR gRNA sequence
gggtataaatggcttatata

SEQ ID NO: 641930 - DNA, 20 bp, Artificial
  CRISPR gRNA sequence
atatattaacataccaacac

SEQ ID NO: 641931 - DNA, 20 bp, Artificial
  CRISPR gRNA sequence
tatattaacataccaacact

SEQ ID NO: 641932 - DNA, 20 bp, Artificial
  CRISPR gRNA sequence
acataccaacactaaatata

SEQ ID NO: 641933 - DNA, 20 bp, Artificial
  CRISPR gRNA sequence
aatatattaatgtatttcaa

SEQ ID NO: 641934 - DNA, 20 bp, Artificial
  CRISPR gRNA sequence
atgtatttcaatatgattca

SEQ ID NO: 641935 - DNA, 20 bp, Artificial
  CRISPR gRNA sequence
caatatgattcatttaaaca

SEQ ID NO: 641936 - DNA, 20 bp, Artificial
  CRISPR gRNA sequence
aatatgattcatttaaacat

SEQ ID NO: 641937 - DNA, 20 bp, Artificial
  CRISPR gRNA sequence
atttaaacatggctttgttt

SEQ ID NO: 641938 - DNA, 20 bp, Artificial
  CRISPR gRNA sequence
aaacatggctttgtttaaaa

SEQ ID NO: 641939 - DNA, 20 bp, Artificial
  CRISPR gRNA sequence
aacatggctttgtttaaaaa

SEQ ID NO: 641940 - DNA, 20 bp, Artificial
  CRISPR gRNA sequence
tgtttaaaaaatctagttag

SEQ ID NO: 641941 - DNA, 20 bp, Artificial
  CRISPR gRNA sequence
gtttaaaaaatctagttagg

SEQ ID NO: 641942 - DNA, 20 bp, Artificial
  CRISPR gRNA sequence
tttaaaaaatctagttagga

SEQ ID NO: 641943 - DNA, 20 bp, Artificial
  CRISPR gRNA sequence
aaaaaatctagttaggactt

SEQ ID NO: 641944 - DNA, 20 bp, Artificial
  CRISPR gRNA sequence
aaaaatctagttaggacttt

SEQ ID NO: 641945 - DNA, 20 bp, Artificial
  CRISPR gRNA sequence
gttaggactttattcaccat

SEQ ID NO: 641946 - DNA, 20 bp, Artificial
  CRISPR gRNA sequence
ggactttattcaccatgatc

SEQ ID NO: 641947 - DNA, 20 bp, Artificial
  CRISPR gRNA sequence
tattcaccatgatcttattc

SEQ ID NO: 641948 - DNA, 20 bp, Artificial
  CRISPR gRNA sequence
attcaccatgatcttattcc

SEQ ID NO: 641949 - DNA, 20 bp, Artificial
  CRISPR gRNA sequence
ttcaccatgatcttattcca

SEQ ID NO: 641950 - DNA, 20 bp, Artificial
  CRISPR gRNA sequence
accatgatcttattccagaa

SEQ ID NO: 641951 - DNA, 20 bp, Artificial
  CRISPR gRNA sequence
attccagaaactatttttaa

SEQ ID NO: 641952 - DNA, 20 bp, Artificial
  CRISPR gRNA sequence
ttccagaaactatttttaaa

SEQ ID NO: 641953 - DNA, 20 bp, Artificial
  CRISPR gRNA sequence
cagaaactatttttaaagtt

SEQ ID NO: 641954 - DNA, 20 bp, Artificial
  CRISPR gRNA sequence
tttttaaagtttcatttata

SEQ ID NO: 641955 - DNA, 20 bp, Artificial
  CRISPR gRNA sequence
ttaaagtttcatttataaat

SEQ ID NO: 641956 - DNA, 20 bp, Artificial
  CRISPR gRNA sequence
taaagtttcatttataaatg

SEQ ID NO: 641957 - DNA, 20 bp, Artificial
  CRISPR gRNA sequence
aaagtttcatttataaatgc

SEQ ID NO: 641958 - DNA, 20 bp, Artificial
  CRISPR gRNA sequence
aagtttcatttataaatgca

SEQ ID NO: 641959 - DNA, 20 bp, Artificial
  CRISPR gRNA sequence
catttataaatgcagtaaaa

SEQ ID NO: 641960 - DNA, 20 bp, Artificial
  CRISPR gRNA sequence
atttataaatgcagtaaaat

SEQ ID NO: 641961 - DNA, 20 bp, Artificial
  CRISPR gRNA sequence
ataaatgcagtaaaattaga

SEQ ID NO: 641962 - DNA, 20 bp, Artificial
  CRISPR gRNA sequence
taaatgcagtaaaattagag

SEQ ID NO: 641963 - DNA, 20 bp, Artificial
  CRISPR gRNA sequence
gagtttattcatcaactcat

SEQ ID NO: 641964 - DNA, 20 bp, Artificial
  CRISPR gRNA sequence
attcatcaactcatgagagt

SEQ ID NO: 641965 - DNA, 20 bp, Artificial
  CRISPR gRNA sequence
ttcatcaactcatgagagtt

SEQ ID NO: 641966 - DNA, 20 bp, Artificial
  CRISPR gRNA sequence
atcaactcatgagagttggc

SEQ ID NO: 641967 - DNA, 20 bp, Artificial
  CRISPR gRNA sequence
atgagagttggcagtgctgg

SEQ ID NO: 641968 - DNA, 20 bp, Artificial
  CRISPR gRNA sequence
gcagtgctggtttcaccatg

SEQ ID NO: 641969 - DNA, 20 bp, Artificial
  CRISPR gRNA sequence
gtttcaccatggtgtaataa

SEQ ID NO: 641970 - DNA, 20 bp, Artificial
  CRISPR gRNA sequence
caccatggtgtaataaaaga

SEQ ID NO: 641971 - DNA, 20 bp, Artificial
  CRISPR gRNA sequence
accatggtgtaataaaagaa

SEQ ID NO: 641972 - DNA, 20 bp, Artificial
  CRISPR gRNA sequence
ctcagtgaaggtgttgcagc

SEQ ID NO: 641973 - DNA, 20 bp, Artificial
  CRISPR gRNA sequence
agtgaaggtgttgcagcatt

SEQ ID NO: 641974 - DNA, 20 bp, Artificial
  CRISPR gRNA sequence
cagcattaatgatagggaaa

SEQ ID NO: 641975 - DNA, 20 bp, Artificial
  CRISPR gRNA sequence
atgatagggaaactgacctg

SEQ ID NO: 641976 - DNA, 20 bp, Artificial
  CRISPR gRNA sequence
acctgagaaaaacacctgaa

SEQ ID NO: 641977 - DNA, 20 bp, Artificial
  CRISPR gRNA sequence
agaaaaacacctgaaaccca

SEQ ID NO: 641978 - DNA, 20 bp, Artificial
  CRISPR gRNA sequence
aaacccataacataatctgt

SEQ ID NO: 641979 - DNA, 20 bp, Artificial
  CRISPR gRNA sequence
tagaatgaaggaggcaacac

SEQ ID NO: 641980 - DNA, 20 bp, Artificial
  CRISPR gRNA sequence
ggtcagcctgccagacaatg

SEQ ID NO: 641981 - DNA, 20 bp, Artificial
  CRISPR gRNA sequence
ccagacaatgcatgcactct

SEQ ID NO: 641982 - DNA, 20 bp, Artificial
  CRISPR gRNA sequence
tatttaagaactatcgcatc

SEQ ID NO: 641983 - DNA, 20 bp, Artificial
  CRISPR gRNA sequence
tttaagaactatcgcatcct

SEQ ID NO: 641984 - DNA, 20 bp, Artificial
  CRISPR gRNA sequence
aagaactatcgcatcctgct

SEQ ID NO: 641985 - DNA, 20 bp, Artificial
  CRISPR gRNA sequence
agaactatcgcatcctgctg

SEQ ID NO: 641986 - DNA, 20 bp, Artificial
  CRISPR gRNA sequence
tcgcatcctgctgtataacc

SEQ ID NO: 641987 - DNA, 20 bp, Artificial
  CRISPR gRNA sequence
ctgtataacctctttatgtt

SEQ ID NO: 641988 - DNA, 20 bp, Artificial
  CRISPR gRNA sequence
tataacctctttatgttttg

SEQ ID NO: 641989 - DNA, 20 bp, Artificial
  CRISPR gRNA sequence
tttatgttttgctatacata

SEQ ID NO: 641990 - DNA, 20 bp, Artificial
  CRISPR gRNA sequence
tatgttttgctatacataca

SEQ ID NO: 641991 - DNA, 20 bp, Artificial
  CRISPR gRNA sequence
atgttttgctatacatacag

SEQ ID NO: 641992 - DNA, 20 bp, Artificial
  CRISPR gRNA sequence
tgttttgctatacatacaga

SEQ ID NO: 641993 - DNA, 20 bp, Artificial
  CRISPR gRNA sequence
tgctatacatacagaagagc

SEQ ID NO: 641994 - DNA, 20 bp, Artificial
  CRISPR gRNA sequence
gctatacatacagaagagca

SEQ ID NO: 641995 - DNA, 20 bp, Artificial
  CRISPR gRNA sequence
ctatacatacagaagagcag

SEQ ID NO: 641996 - DNA, 20 bp, Artificial
  CRISPR gRNA sequence
tacatacagaagagcaggtc

SEQ ID NO: 641997 - DNA, 20 bp, Artificial
  CRISPR gRNA sequence
ctttctcgattatccttaag

SEQ ID NO: 641998 - DNA, 20 bp, Artificial
  CRISPR gRNA sequence
tctcgattatccttaaggag

SEQ ID NO: 641999 - DNA, 20 bp, Artificial
  CRISPR gRNA sequence
ctcgattatccttaaggagg

SEQ ID NO: 642000 - DNA, 20 bp, Artificial
  CRISPR gRNA sequence
tcgattatccttaaggaggt

SEQ ID NO: 642001 - DNA, 20 bp, Artificial
  CRISPR gRNA sequence
gattatccttaaggaggttg

SEQ ID NO: 642002 - DNA, 20 bp, Artificial
  CRISPR gRNA sequence
tccttaaggaggttgcagcc

SEQ ID NO: 642003 - DNA, 20 bp, Artificial
  CRISPR gRNA sequence
aaggaggttgcagccttgtt

SEQ ID NO: 642004 - DNA, 20 bp, Artificial
  CRISPR gRNA sequence
aggaggttgcagccttgtta

SEQ ID NO: 642005 - DNA, 20 bp, Artificial
  CRISPR gRNA sequence
cagccttgttaatgataggt

SEQ ID NO: 642006 - DNA, 20 bp, Artificial
  CRISPR gRNA sequence
gttaatgataggtgtcaaga

SEQ ID NO: 642007 - DNA, 20 bp, Artificial
  CRISPR gRNA sequence
ttaatgataggtgtcaagat

SEQ ID NO: 642008 - DNA, 20 bp, Artificial
  CRISPR gRNA sequence
atgataggtgtcaagatctc

SEQ ID NO: 642009 - DNA, 20 bp, Artificial
  CRISPR gRNA sequence
caaaagagatggactttact

SEQ ID NO: 642010 - DNA, 20 bp, Artificial
  CRISPR gRNA sequence
tactcactggaaaatgttga

SEQ ID NO: 642011 - DNA, 20 bp, Artificial
  CRISPR gRNA sequence
actcactggaaaatgttgag

SEQ ID NO: 642012 - DNA, 20 bp, Artificial
  CRISPR gRNA sequence
ctcactggaaaatgttgaga

SEQ ID NO: 642013 - DNA, 20 bp, Artificial
  CRISPR gRNA sequence
actggaaaatgttgagactt

SEQ ID NO: 642014 - DNA, 20 bp, Artificial
  CRISPR gRNA sequence
gaaaatgttgagactttccg

SEQ ID NO: 642015 - DNA, 20 bp, Artificial
  CRISPR gRNA sequence
agactttccgggatcactct

SEQ ID NO: 642016 - DNA, 20 bp, Artificial
  CRISPR gRNA sequence
tccgggatcactctggccaa

SEQ ID NO: 642017 - DNA, 20 bp, Artificial
  CRISPR gRNA sequence
ccgggatcactctggccaag

SEQ ID NO: 642018 - DNA, 20 bp, Artificial
  CRISPR gRNA sequence
cgggatcactctggccaagt

SEQ ID NO: 642019 - DNA, 20 bp, Artificial
  CRISPR gRNA sequence
tggccaagttcttaaacttg

SEQ ID NO: 642020 - DNA, 20 bp, Artificial
  CRISPR gRNA sequence
gccaagttcttaaacttgag

SEQ ID NO: 642021 - DNA, 20 bp, Artificial
  CRISPR gRNA sequence
ttaaacttgagaaggtggtg

SEQ ID NO: 642022 - DNA, 20 bp, Artificial
  CRISPR gRNA sequence
aaacttgagaaggtggtgat

SEQ ID NO: 642023 - DNA, 20 bp, Artificial
  CRISPR gRNA sequence
aacttgagaaggtggtgatt

SEQ ID NO: 642024 - DNA, 20 bp, Artificial
  CRISPR gRNA sequence
gagaaggtggtgattaaaag

SEQ ID NO: 642025 - DNA, 20 bp, Artificial
  CRISPR gRNA sequence
agaaggtggtgattaaaagt

SEQ ID NO: 642026 - DNA, 20 bp, Artificial
  CRISPR gRNA sequence
aaagttagcaagtggttctg

SEQ ID NO: 642027 - DNA, 20 bp, Artificial
  CRISPR gRNA sequence
gcaagtggttctgcagtggt

SEQ ID NO: 642028 - DNA, 20 bp, Artificial
  CRISPR gRNA sequence
tgcagtggtgagacgtgggg

SEQ ID NO: 642029 - DNA, 20 bp, Artificial
  CRISPR gRNA sequence
cagtggtgagacgtggggta

SEQ ID NO: 642030 - DNA, 20 bp, Artificial
  CRISPR gRNA sequence
ctaacccaaactgagggcaa

SEQ ID NO: 642031 - DNA, 20 bp, Artificial
  CRISPR gRNA sequence
acccaaactgagggcaacac

SEQ ID NO: 642032 - DNA, 20 bp, Artificial
  CRISPR gRNA sequence
agggcaacaccaaatgctaa

SEQ ID NO: 642033 - DNA, 20 bp, Artificial
  CRISPR gRNA sequence
acttcaccaaattaaagaaa

SEQ ID NO: 642034 - DNA, 20 bp, Artificial
  CRISPR gRNA sequence
caccaaattaaagaaaacaa

SEQ ID NO: 642035 - DNA, 20 bp, Artificial
  CRISPR gRNA sequence
accaaattaaagaaaacaaa

SEQ ID NO: 642036 - DNA, 20 bp, Artificial
  CRISPR gRNA sequence
aagaaaacaaaactgcttag

SEQ ID NO: 642037 - DNA, 20 bp, Artificial
  CRISPR gRNA sequence
cttagtataggaatcattac

SEQ ID NO: 642038 - DNA, 20 bp, Artificial
  CRISPR gRNA sequence
agtataggaatcattactcc

SEQ ID NO: 642039 - DNA, 20 bp, Artificial
  CRISPR gRNA sequence
gtataggaatcattactcca

SEQ ID NO: 642040 - DNA, 20 bp, Artificial
  CRISPR gRNA sequence
ctccactaaaaacataaatt

SEQ ID NO: 642041 - DNA, 20 bp, Artificial
  CRISPR gRNA sequence
cactaaaaacataaattact

SEQ ID NO: 642042 - DNA, 20 bp, Artificial
  CRISPR gRNA sequence
aaaacataaattacttggac

SEQ ID NO: 642043 - DNA, 20 bp, Artificial
  CRISPR gRNA sequence
cttggacttggaaaaaaact

SEQ ID NO: 642044 - DNA, 20 bp, Artificial
  CRISPR gRNA sequence
ggacttggaaaaaaactttt

SEQ ID NO: 642045 - DNA, 20 bp, Artificial
  CRISPR gRNA sequence
gacttggaaaaaaacttttg

SEQ ID NO: 642046 - DNA, 20 bp, Artificial
  CRISPR gRNA sequence
ggaaaaaaacttttgaattt

SEQ ID NO: 642047 - DNA, 20 bp, Artificial
  CRISPR gRNA sequence
gaaaaaaacttttgaatttt

SEQ ID NO: 642048 - DNA, 20 bp, Artificial
  CRISPR gRNA sequence
ttgaattttcacctaaaaca

SEQ ID NO: 642049 - DNA, 20 bp, Artificial
  CRISPR gRNA sequence
tgaattttcacctaaaacac

SEQ ID NO: 642050 - DNA, 20 bp, Artificial
  CRISPR gRNA sequence
gaattttcacctaaaacact

SEQ ID NO: 642051 - DNA, 20 bp, Artificial
  CRISPR gRNA sequence
aattttcacctaaaacactg

SEQ ID NO: 642052 - DNA, 20 bp, Artificial
  CRISPR gRNA sequence
tcacctaaaacactgtacta

SEQ ID NO: 642053 - DNA, 20 bp, Artificial
  CRISPR gRNA sequence
cacctaaaacactgtactag

SEQ ID NO: 642054 - DNA, 20 bp, Artificial
  CRISPR gRNA sequence
acctaaaacactgtactagt

SEQ ID NO: 642055 - DNA, 20 bp, Artificial
  CRISPR gRNA sequence
aaacactgtactagtgaacc

SEQ ID NO: 642056 - DNA, 20 bp, Artificial
  CRISPR gRNA sequence
tactagtgaaccttatgttc

SEQ ID NO: 642057 - DNA, 20 bp, Artificial
  CRISPR gRNA sequence
gtgaaccttatgttcagcaa

SEQ ID NO: 642058 - DNA, 20 bp, Artificial
  CRISPR gRNA sequence
atgttcagcaatattcaaca

SEQ ID NO: 642059 - DNA, 20 bp, Artificial
  CRISPR gRNA sequence
tgttcagcaatattcaacaa

SEQ ID NO: 642060 - DNA, 20 bp, Artificial
  CRISPR gRNA sequence
agcaatattcaacaatactt

SEQ ID NO: 642061 - DNA, 20 bp, Artificial
  CRISPR gRNA sequence
aacaatacttcttggtattc

SEQ ID NO: 642062 - DNA, 20 bp, Artificial
  CRISPR gRNA sequence
cttggtattcaaatataact

SEQ ID NO: 642063 - DNA, 20 bp, Artificial
  CRISPR gRNA sequence
ttggtattcaaatataactc

SEQ ID NO: 642064 - DNA, 20 bp, Artificial
  CRISPR gRNA sequence
ggtattcaaatataactcca

SEQ ID NO: 642065 - DNA, 20 bp, Artificial
  CRISPR gRNA sequence
gtattcaaatataactccat

SEQ ID NO: 642066 - DNA, 20 bp, Artificial
  CRISPR gRNA sequence
aaatataactccatgtgagc

SEQ ID NO: 642067 - DNA, 20 bp, Artificial
  CRISPR gRNA sequence
catgtgagcatgtagaatcc

SEQ ID NO: 642068 - DNA, 20 bp, Artificial
  CRISPR gRNA sequence
gaatgctgtaactgtttgaa

SEQ ID NO: 642069 - DNA, 20 bp, Artificial
  CRISPR gRNA sequence
taactgtttgaatagttcat

SEQ ID NO: 642070 - DNA, 20 bp, Artificial
  CRISPR gRNA sequence
tttgaatagttcatatcctg

SEQ ID NO: 642071 - DNA, 20 bp, Artificial
  CRISPR gRNA sequence
gaatagttcatatcctgcaa

SEQ ID NO: 642072 - DNA, 20 bp, Artificial
  CRISPR gRNA sequence
aatagttcatatcctgcaaa

SEQ ID NO: 642073 - DNA, 20 bp, Artificial
  CRISPR gRNA sequence
atatcctgcaaatacctaca

SEQ ID NO: 642074 - DNA, 20 bp, Artificial
  CRISPR gRNA sequence
caaatacctacatccaaaaa

SEQ ID NO: 642075 - DNA, 20 bp, Artificial
  CRISPR gRNA sequence
catccaaaaagaaaaaagag

SEQ ID NO: 642076 - DNA, 20 bp, Artificial
  CRISPR gRNA sequence
gaagaaagctgcaaatgtta

SEQ ID NO: 642077 - DNA, 20 bp, Artificial
  CRISPR gRNA sequence
caaatgttactaatttacca

SEQ ID NO: 642078 - DNA, 20 bp, Artificial
  CRISPR gRNA sequence
ctaatttaccagtactaaat

SEQ ID NO: 642079 - DNA, 20 bp, Artificial
  CRISPR gRNA sequence
atttaccagtactaaatacc

SEQ ID NO: 642080 - DNA, 20 bp, Artificial
  CRISPR gRNA sequence
accagtactaaataccaaca

SEQ ID NO: 642081 - DNA, 20 bp, Artificial
  CRISPR gRNA sequence
ccagtactaaataccaacaa

SEQ ID NO: 642082 - DNA, 20 bp, Artificial
  CRISPR gRNA sequence
aataccaacaaaatatagtt

SEQ ID NO: 642083 - DNA, 20 bp, Artificial
  CRISPR gRNA sequence
taacaatgcaaaataatata

SEQ ID NO: 642084 - DNA, 20 bp, Artificial
  CRISPR gRNA sequence
aacaatgcaaaataatatat

SEQ ID NO: 642085 - DNA, 20 bp, Artificial
  CRISPR gRNA sequence
acaatgcaaaataatatatg

SEQ ID NO: 642086 - DNA, 20 bp, Artificial
  CRISPR gRNA sequence
acaaaaaacagactaaaata

SEQ ID NO: 642087 - DNA, 20 bp, Artificial
  CRISPR gRNA sequence
caaaaaacagactaaaataa

SEQ ID NO: 642088 - DNA, 20 bp, Artificial
  CRISPR gRNA sequence
aaataagctctaaatttctg

SEQ ID NO: 642089 - DNA, 20 bp, Artificial
  CRISPR gRNA sequence
taaatttctgtggacaagat

SEQ ID NO: 642090 - DNA, 20 bp, Artificial
  CRISPR gRNA sequence
aatttctgtggacaagatga

SEQ ID NO: 642091 - DNA, 20 bp, Artificial
  CRISPR gRNA sequence
ctgtggacaagatgaatgtg

SEQ ID NO: 642092 - DNA, 20 bp, Artificial
  CRISPR gRNA sequence
tgtggacaagatgaatgtgt

SEQ ID NO: 642093 - DNA, 20 bp, Artificial
  CRISPR gRNA sequence
tggacaagatgaatgtgtgt

SEQ ID NO: 642094 - DNA, 20 bp, Artificial
  CRISPR gRNA sequence
aagggaagcaaaagtgatcc

SEQ ID NO: 642095 - DNA, 20 bp, Artificial
  CRISPR gRNA sequence
atcccatggtattaaggtag

SEQ ID NO: 642096 - DNA, 20 bp, Artificial
  CRISPR gRNA sequence
aggtagttcaggtgagtatg

SEQ ID NO: 642097 - DNA, 20 bp, Artificial
  CRISPR gRNA sequence
aggtgagtatgattattttt

SEQ ID NO: 642098 - DNA, 20 bp, Artificial
  CRISPR gRNA sequence
tttttcacacataaacacta

SEQ ID NO: 642099 - DNA, 20 bp, Artificial
  CRISPR gRNA sequence
ttcacacataaacactagcc

SEQ ID NO: 642100 - DNA, 20 bp, Artificial
  CRISPR gRNA sequence
tcacacataaacactagccc

SEQ ID NO: 642101 - DNA, 20 bp, Artificial
  CRISPR gRNA sequence
cacacataaacactagcccg

SEQ ID NO: 642102 - DNA, 20 bp, Artificial
  CRISPR gRNA sequence
acacataaacactagcccgg

SEQ ID NO: 642103 - DNA, 20 bp, Artificial
  CRISPR gRNA sequence
gcccggaagctcacctttac

SEQ ID NO: 642104 - DNA, 20 bp, Artificial
  CRISPR gRNA sequence
acctttactgcatatcccta

SEQ ID NO: 642105 - DNA, 20 bp, Artificial
  CRISPR gRNA sequence
tactgcatatccctaaagat

SEQ ID NO: 642106 - DNA, 20 bp, Artificial
  CRISPR gRNA sequence
actgcatatccctaaagatg

SEQ ID NO: 642107 - DNA, 20 bp, Artificial
  CRISPR gRNA sequence
ctgcatatccctaaagatgt

SEQ ID NO: 642108 - DNA, 20 bp, Artificial
  CRISPR gRNA sequence
catatccctaaagatgtcca

SEQ ID NO: 642109 - DNA, 20 bp, Artificial
  CRISPR gRNA sequence
aagatgtccagagattgcta

SEQ ID NO: 642110 - DNA, 20 bp, Artificial
  CRISPR gRNA sequence
ctaggcttcctcagcaacga

SEQ ID NO: 642111 - DNA, 20 bp, Artificial
  CRISPR gRNA sequence
ggcttcctcagcaacgacta

SEQ ID NO: 642112 - DNA, 20 bp, Artificial
  CRISPR gRNA sequence
cctcagcaacgactacaggg

SEQ ID NO: 642113 - DNA, 20 bp, Artificial
  CRISPR gRNA sequence
ctcagcaacgactacaggga

SEQ ID NO: 642114 - DNA, 20 bp, Artificial
  CRISPR gRNA sequence
agcaacgactacagggacta

SEQ ID NO: 642115 - DNA, 20 bp, Artificial
  CRISPR gRNA sequence
cagggactaggaactctttc

SEQ ID NO: 642116 - DNA, 20 bp, Artificial
  CRISPR gRNA sequence
ggaactctttcagagagacc

SEQ ID NO: 642117 - DNA, 20 bp, Artificial
  CRISPR gRNA sequence
tttcagagagaccccctact

SEQ ID NO: 642118 - DNA, 20 bp, Artificial
  CRISPR gRNA sequence
tcagagagaccccctactct

SEQ ID NO: 642119 - DNA, 20 bp, Artificial
  CRISPR gRNA sequence
cagagagaccccctactctc

SEQ ID NO: 642120 - DNA, 20 bp, Artificial
  CRISPR gRNA sequence
agagagaccccctactctcc

SEQ ID NO: 642121 - DNA, 20 bp, Artificial
  CRISPR gRNA sequence
ctctccagcctccaaacagt

SEQ ID NO: 642122 - DNA, 20 bp, Artificial
  CRISPR gRNA sequence
tccagcctccaaacagtcag

SEQ ID NO: 642123 - DNA, 20 bp, Artificial
  CRISPR gRNA sequence
cagcctccaaacagtcaggc

SEQ ID NO: 642124 - DNA, 20 bp, Artificial
  CRISPR gRNA sequence
caaacagtcaggcactagtc

SEQ ID NO: 642125 - DNA, 20 bp, Artificial
  CRISPR gRNA sequence
gtccagcagcccttggctgt

SEQ ID NO: 642126 - DNA, 20 bp, Artificial
  CRISPR gRNA sequence
ggctgtgctcaagcaaagaa

SEQ ID NO: 642127 - DNA, 20 bp, Artificial
  CRISPR gRNA sequence
gctgtgctcaagcaaagaat

SEQ ID NO: 642128 - DNA, 20 bp, Artificial
  CRISPR gRNA sequence
tgctcaagcaaagaatttta

SEQ ID NO: 642129 - DNA, 20 bp, Artificial
  CRISPR gRNA sequence
aagcaaagaattttaggaat

SEQ ID NO: 642130 - DNA, 20 bp, Artificial
  CRISPR gRNA sequence
taggaatgggtaaaggaatg

SEQ ID NO: 642131 - DNA, 20 bp, Artificial
  CRISPR gRNA sequence
aggaatgggtaaaggaatgg

SEQ ID NO: 642132 - DNA, 20 bp, Artificial
  CRISPR gRNA sequence
ggaatgggtaaaggaatggc

SEQ ID NO: 642133 - DNA, 20 bp, Artificial
  CRISPR gRNA sequence
cctagagagtttagtgtgga

SEQ ID NO: 642134 - DNA, 20 bp, Artificial
  CRISPR gRNA sequence
gagagtttagtgtggaatgg

SEQ ID NO: 642135 - DNA, 20 bp, Artificial
  CRISPR gRNA sequence
agtgtggaatgggagtggag

SEQ ID NO: 642136 - DNA, 20 bp, Artificial
  CRISPR gRNA sequence
gtgtggaatgggagtggagg

SEQ ID NO: 642137 - DNA, 20 bp, Artificial
  CRISPR gRNA sequence
cacatccctgtcaatcaact

SEQ ID NO: 642138 - DNA, 20 bp, Artificial
  CRISPR gRNA sequence
acatccctgtcaatcaacta

SEQ ID NO: 642139 - DNA, 20 bp, Artificial
  CRISPR gRNA sequence
tcaatcaactattattaact

SEQ ID NO: 642140 - DNA, 20 bp, Artificial
  CRISPR gRNA sequence
ttattaactattatgctgat

SEQ ID NO: 642141 - DNA, 20 bp, Artificial
  CRISPR gRNA sequence
ttaactattatgctgatgga

SEQ ID NO: 642142 - DNA, 20 bp, Artificial
  CRISPR gRNA sequence
actattatgctgatggaatg

SEQ ID NO: 642143 - DNA, 20 bp, Artificial
  CRISPR gRNA sequence
ttatgctgatggaatggaat

SEQ ID NO: 642144 - DNA, 20 bp, Artificial
  CRISPR gRNA sequence
tgctgatggaatggaatcta

SEQ ID NO: 642145 - DNA, 20 bp, Artificial
  CRISPR gRNA sequence
atggaatggaatctaacgtt

SEQ ID NO: 642146 - DNA, 20 bp, Artificial
  CRISPR gRNA sequence
acgttatactggctaagact

SEQ ID NO: 642147 - DNA, 20 bp, Artificial
  CRISPR gRNA sequence
tactggctaagactggcttt

SEQ ID NO: 642148 - DNA, 20 bp, Artificial
  CRISPR gRNA sequence
gctaagactggctttcctcc

SEQ ID NO: 642149 - DNA, 20 bp, Artificial
  CRISPR gRNA sequence
agactggctttcctccaggt

SEQ ID NO: 642150 - DNA, 20 bp, Artificial
  CRISPR gRNA sequence
gctttcctccaggttcaaca

SEQ ID NO: 642151 - DNA, 20 bp, Artificial
  CRISPR gRNA sequence
tcctccaggttcaacactat

SEQ ID NO: 642152 - DNA, 20 bp, Artificial
  CRISPR gRNA sequence
cctccaggttcaacactatt

SEQ ID NO: 642153 - DNA, 20 bp, Artificial
  CRISPR gRNA sequence
ctccaggttcaacactattg

SEQ ID NO: 642154 - DNA, 20 bp, Artificial
  CRISPR gRNA sequence
caggttcaacactattgcca

SEQ ID NO: 642155 - DNA, 20 bp, Artificial
  CRISPR gRNA sequence
aacactattgccaaaaaaca

SEQ ID NO: 642156 - DNA, 20 bp, Artificial
  CRISPR gRNA sequence
ttgccaaaaaacagactgtg

SEQ ID NO: 642157 - DNA, 20 bp, Artificial
  CRISPR gRNA sequence
ccaaaaaacagactgtggtt

SEQ ID NO: 642158 - DNA, 20 bp, Artificial
  CRISPR gRNA sequence
tggttttattaagtgatctg

SEQ ID NO: 642159 - DNA, 20 bp, Artificial
  CRISPR gRNA sequence
tattaagtgatctggccttt

SEQ ID NO: 642160 - DNA, 20 bp, Artificial
  CRISPR gRNA sequence
attaagtgatctggcctttg

SEQ ID NO: 642161 - DNA, 20 bp, Artificial
  CRISPR gRNA sequence
ttaagtgatctggcctttgc

SEQ ID NO: 642162 - DNA, 20 bp, Artificial
  CRISPR gRNA sequence
agtgatctggcctttgctcc

SEQ ID NO: 642163 - DNA, 20 bp, Artificial
  CRISPR gRNA sequence
gcctttgctccataaagatc

SEQ ID NO: 642164 - DNA, 20 bp, Artificial
  CRISPR gRNA sequence
tgctccataaagatctccct

SEQ ID NO: 642165 - DNA, 20 bp, Artificial
  CRISPR gRNA sequence
gctccataaagatctccctg

SEQ ID NO: 642166 - DNA, 20 bp, Artificial
  CRISPR gRNA sequence
ctccataaagatctccctgt

SEQ ID NO: 642167 - DNA, 20 bp, Artificial
  CRISPR gRNA sequence
cataaagatctccctgttaa

SEQ ID NO: 642168 - DNA, 20 bp, Artificial
  CRISPR gRNA sequence
cctgttaatgcaatagggag

SEQ ID NO: 642169 - DNA, 20 bp, Artificial
  CRISPR gRNA sequence
ttaatgcaatagggagaata

SEQ ID NO: 642170 - DNA, 20 bp, Artificial
  CRISPR gRNA sequence
atgcaatagggagaatatca

SEQ ID NO: 642171 - DNA, 20 bp, Artificial
  CRISPR gRNA sequence
tctaatatatatttactcta

SEQ ID NO: 642172 - DNA, 20 bp, Artificial
  CRISPR gRNA sequence
taatatatatttactctatt

SEQ ID NO: 642173 - DNA, 20 bp, Artificial
  CRISPR gRNA sequence
atatatatttactctattct

SEQ ID NO: 642174 - DNA, 20 bp, Artificial
  CRISPR gRNA sequence
actctattctgaataaaaca

SEQ ID NO: 642175 - DNA, 20 bp, Artificial
  CRISPR gRNA sequence
ctctattctgaataaaacac

SEQ ID NO: 642176 - DNA, 20 bp, Artificial
  CRISPR gRNA sequence
tattctgaataaaacacctt

SEQ ID NO: 642177 - DNA, 20 bp, Artificial
  CRISPR gRNA sequence
ttctgaataaaacaccttcc

SEQ ID NO: 642178 - DNA, 20 bp, Artificial
  CRISPR gRNA sequence
tgaataaaacaccttccaca

SEQ ID NO: 642179 - DNA, 20 bp, Artificial
  CRISPR gRNA sequence
aataaaacaccttccacaat

SEQ ID NO: 642180 - DNA, 20 bp, Artificial
  CRISPR gRNA sequence
ccacaataccagtacactta

SEQ ID NO: 642181 - DNA, 20 bp, Artificial
  CRISPR gRNA sequence
cacaataccagtacacttaa

SEQ ID NO: 642182 - DNA, 20 bp, Artificial
  CRISPR gRNA sequence
aaagtggtaatcttaggttt

SEQ ID NO: 642183 - DNA, 20 bp, Artificial
  CRISPR gRNA sequence
aagtggtaatcttaggtttt

SEQ ID NO: 642184 - DNA, 20 bp, Artificial
  CRISPR gRNA sequence
aggttttgaaacaaaaggta

SEQ ID NO: 642185 - DNA, 20 bp, Artificial
  CRISPR gRNA sequence
ggttttgaaacaaaaggtag

SEQ ID NO: 642186 - DNA, 20 bp, Artificial
  CRISPR gRNA sequence
tgaaacaaaaggtaggggaa

SEQ ID NO: 642187 - DNA, 20 bp, Artificial
  CRISPR gRNA sequence
gaaacaaaaggtaggggaag

SEQ ID NO: 642188 - DNA, 20 bp, Artificial
  CRISPR gRNA sequence
aaacaaaaggtaggggaagt

SEQ ID NO: 642189 - DNA, 20 bp, Artificial
  CRISPR gRNA sequence
gatatgcaatgtatagtaaa

SEQ ID NO: 642190 - DNA, 20 bp, Artificial
  CRISPR gRNA sequence
atatgcaatgtatagtaaaa

SEQ ID NO: 642191 - DNA, 20 bp, Artificial
  CRISPR gRNA sequence
acccaagcagagcagaggaa

SEQ ID NO: 642192 - DNA, 20 bp, Artificial
  CRISPR gRNA sequence
atttaaacactgcctgttgc

SEQ ID NO: 642193 - DNA, 20 bp, Artificial
  CRISPR gRNA sequence
aaacactgcctgttgctgta

SEQ ID NO: 642194 - DNA, 20 bp, Artificial
  CRISPR gRNA sequence
aacactgcctgttgctgtat

SEQ ID NO: 642195 - DNA, 20 bp, Artificial
  CRISPR gRNA sequence
cctgttgctgtatttgactc

SEQ ID NO: 642196 - DNA, 20 bp, Artificial
  CRISPR gRNA sequence
ttgctgtatttgactcatta

SEQ ID NO: 642197 - DNA, 20 bp, Artificial
  CRISPR gRNA sequence
ctgtatttgactcattattt

SEQ ID NO: 642198 - DNA, 20 bp, Artificial
  CRISPR gRNA sequence
tatttgactcattatttctg

SEQ ID NO: 642199 - DNA, 20 bp, Artificial
  CRISPR gRNA sequence
gactcattatttctgtggga

SEQ ID NO: 642200 - DNA, 20 bp, Artificial
  CRISPR gRNA sequence
actcattatttctgtgggaa

SEQ ID NO: 642201 - DNA, 20 bp, Artificial
  CRISPR gRNA sequence
attatttctgtgggaacttt

SEQ ID NO: 642202 - DNA, 20 bp, Artificial
  CRISPR gRNA sequence
tttctgtgggaactttgatt

SEQ ID NO: 642203 - DNA, 20 bp, Artificial
  CRISPR gRNA sequence
ctgtgggaactttgatttgc

SEQ ID NO: 642204 - DNA, 20 bp, Artificial
  CRISPR gRNA sequence
tgtgggaactttgatttgca

SEQ ID NO: 642205 - DNA, 20 bp, Artificial
  CRISPR gRNA sequence
tgggaactttgatttgcata

SEQ ID NO: 642206 - DNA, 20 bp, Artificial
  CRISPR gRNA sequence
tgatttgcataaaggcatgg

SEQ ID NO: 642207 - DNA, 20 bp, Artificial
  CRISPR gRNA sequence
gatttgcataaaggcatggc

SEQ ID NO: 642208 - DNA, 20 bp, Artificial
  CRISPR gRNA sequence
atttgcataaaggcatggca

SEQ ID NO: 642209 - DNA, 20 bp, Artificial
  CRISPR gRNA sequence
gcataaaggcatggcagatc

SEQ ID NO: 642210 - DNA, 20 bp, Artificial
  CRISPR gRNA sequence
cataaaggcatggcagatct

SEQ ID NO: 642211 - DNA, 20 bp, Artificial
  CRISPR gRNA sequence
aagaggcagcaaacatttac

SEQ ID NO: 642212 - DNA, 20 bp, Artificial
  CRISPR gRNA sequence
agaggcagcaaacatttact

SEQ ID NO: 642213 - DNA, 20 bp, Artificial
  CRISPR gRNA sequence
actcatgtcactaatcacat

SEQ ID NO: 642214 - DNA, 20 bp, Artificial
  CRISPR gRNA sequence
ctcatgtcactaatcacatt

SEQ ID NO: 642215 - DNA, 20 bp, Artificial
  CRISPR gRNA sequence
atgtcactaatcacatttat

SEQ ID NO: 642216 - DNA, 20 bp, Artificial
  CRISPR gRNA sequence
atcacatttataattcagaa

SEQ ID NO: 642217 - DNA, 20 bp, Artificial
  CRISPR gRNA sequence
ataattcagaaagttcctca

SEQ ID NO: 642218 - DNA, 20 bp, Artificial
  CRISPR gRNA sequence
taattcagaaagttcctcac

SEQ ID NO: 642219 - DNA, 20 bp, Artificial
  CRISPR gRNA sequence
agaaagttcctcacacgtac

SEQ ID NO: 642220 - DNA, 20 bp, Artificial
  CRISPR gRNA sequence
ctcacacgtacgcataaaat

SEQ ID NO: 642221 - DNA, 20 bp, Artificial
  CRISPR gRNA sequence
acacgtacgcataaaattca

SEQ ID NO: 642222 - DNA, 20 bp, Artificial
  CRISPR gRNA sequence
aaaatcctgattttaatact

SEQ ID NO: 642223 - DNA, 20 bp, Artificial
  CRISPR gRNA sequence
attttaatactttgtagttc

SEQ ID NO: 642224 - DNA, 20 bp, Artificial
  CRISPR gRNA sequence
taatactttgtagttctgag

SEQ ID NO: 642225 - DNA, 20 bp, Artificial
  CRISPR gRNA sequence
aatactttgtagttctgagg

SEQ ID NO: 642226 - DNA, 20 bp, Artificial
  CRISPR gRNA sequence
atactttgtagttctgagga

SEQ ID NO: 642227 - DNA, 20 bp, Artificial
  CRISPR gRNA sequence
tgtagttctgaggaaaaaaa

SEQ ID NO: 642228 - DNA, 20 bp, Artificial
  CRISPR gRNA sequence
gtagttctgaggaaaaaaat

SEQ ID NO: 642229 - DNA, 20 bp, Artificial
  CRISPR gRNA sequence
tagttctgaggaaaaaaatg

SEQ ID NO: 642230 - DNA, 20 bp, Artificial
  CRISPR gRNA sequence
tgaggaaaaaaatgcaactc

SEQ ID NO: 642231 - DNA, 20 bp, Artificial
  CRISPR gRNA sequence
aggaaaaaaatgcaactcat

SEQ ID NO: 642232 - DNA, 20 bp, Artificial
  CRISPR gRNA sequence
atttaaaaagaaaaagttgt

SEQ ID NO: 642233 - DNA, 20 bp, Artificial
  CRISPR gRNA sequence
aaaaagaaaaagttgtttta

SEQ ID NO: 642234 - DNA, 20 bp, Artificial
  CRISPR gRNA sequence
aaaagaaaaagttgttttat

SEQ ID NO: 642235 - DNA, 20 bp, Artificial
  CRISPR gRNA sequence
ttttatttacattagtgtgt

SEQ ID NO: 642236 - DNA, 20 bp, Artificial
  CRISPR gRNA sequence
tatttacattagtgtgtgtg

SEQ ID NO: 642237 - DNA, 20 bp, Artificial
  CRISPR gRNA sequence
atttacattagtgtgtgtgt

SEQ ID NO: 642238 - DNA, 20 bp, Artificial
  CRISPR gRNA sequence
tttacattagtgtgtgtgta

SEQ ID NO: 642239 - DNA, 20 bp, Artificial
  CRISPR gRNA sequence
acattagtgtgtgtgtatat

SEQ ID NO: 642240 - DNA, 20 bp, Artificial
  CRISPR gRNA sequence
cattagtgtgtgtgtatata

SEQ ID NO: 642241 - DNA, 20 bp, Artificial
  CRISPR gRNA sequence
gtgtgtgtgtatatatgtat

SEQ ID NO: 642242 - DNA, 20 bp, Artificial
  CRISPR gRNA sequence
cacatgtgaaatgactatcc

SEQ ID NO: 642243 - DNA, 20 bp, Artificial
  CRISPR gRNA sequence
tccattactaatttattttt

SEQ ID NO: 642244 - DNA, 20 bp, Artificial
  CRISPR gRNA sequence
ctaatttattttttaattat

SEQ ID NO: 642245 - DNA, 20 bp, Artificial
  CRISPR gRNA sequence
atttattttttaattatact

SEQ ID NO: 642246 - DNA, 20 bp, Artificial
  CRISPR gRNA sequence
attttttaattatactttaa

SEQ ID NO: 642247 - DNA, 20 bp, Artificial
  CRISPR gRNA sequence
ttttttaattatactttaag

SEQ ID NO: 642248 - DNA, 20 bp, Artificial
  CRISPR gRNA sequence
tttaattatactttaagttc

SEQ ID NO: 642249 - DNA, 20 bp, Artificial
  CRISPR gRNA sequence
ttaattatactttaagttct

SEQ ID NO: 642250 - DNA, 20 bp, Artificial
  CRISPR gRNA sequence
taattatactttaagttcta

SEQ ID NO: 642251 - DNA, 20 bp, Artificial
  CRISPR gRNA sequence
aattatactttaagttctag

SEQ ID NO: 642252 - DNA, 20 bp, Artificial
  CRISPR gRNA sequence
attatactttaagttctagg

SEQ ID NO: 642253 - DNA, 20 bp, Artificial
  CRISPR gRNA sequence
tactttaagttctagggtac

SEQ ID NO: 642254 - DNA, 20 bp, Artificial
  CRISPR gRNA sequence
taagttctagggtacatgtg

SEQ ID NO: 642255 - DNA, 20 bp, Artificial
  CRISPR gRNA sequence
aagttctagggtacatgtgc

SEQ ID NO: 642256 - DNA, 20 bp, Artificial
  CRISPR gRNA sequence
agttctagggtacatgtgca

SEQ ID NO: 642257 - DNA, 20 bp, Artificial
  CRISPR gRNA sequence
tagggtacatgtgcacaaca

SEQ ID NO: 642258 - DNA, 20 bp, Artificial
  CRISPR gRNA sequence
gggtacatgtgcacaacatg

SEQ ID NO: 642259 - DNA, 20 bp, Artificial
  CRISPR gRNA sequence
gttacacatgtatacatgtg

SEQ ID NO: 642260 - DNA, 20 bp, Artificial
  CRISPR gRNA sequence
ttacacatgtatacatgtgc

SEQ ID NO: 642261 - DNA, 20 bp, Artificial
  CRISPR gRNA sequence
cacatgtatacatgtgccat

SEQ ID NO: 642262 - DNA, 20 bp, Artificial
  CRISPR gRNA sequence
gtgtgctgcacccgttaact

SEQ ID NO: 642263 - DNA, 20 bp, Artificial
  CRISPR gRNA sequence
cacccgttaactcatcattt

SEQ ID NO: 642264 - DNA, 20 bp, Artificial
  CRISPR gRNA sequence
actcatcatttacattaggt

SEQ ID NO: 642265 - DNA, 20 bp, Artificial
  CRISPR gRNA sequence
atcatttacattaggtatat

SEQ ID NO: 642266 - DNA, 20 bp, Artificial
  CRISPR gRNA sequence
acattaggtatatctcctaa

SEQ ID NO: 642267 - DNA, 20 bp, Artificial
  CRISPR gRNA sequence
cattaggtatatctcctaat

SEQ ID NO: 642268 - DNA, 20 bp, Artificial
  CRISPR gRNA sequence
ggtatatctcctaatgctat

SEQ ID NO: 642269 - DNA, 20 bp, Artificial
  CRISPR gRNA sequence
ctaatgctatccctctaccc

SEQ ID NO: 642270 - DNA, 20 bp, Artificial
  CRISPR gRNA sequence
atgctatccctctaccctcc

SEQ ID NO: 642271 - DNA, 20 bp, Artificial
  CRISPR gRNA sequence
tccctctaccctccccactc

SEQ ID NO: 642272 - DNA, 20 bp, Artificial
  CRISPR gRNA sequence
taccctccccactccctgca

SEQ ID NO: 642273 - DNA, 20 bp, Artificial
  CRISPR gRNA sequence
ccctccccactccctgcacc

SEQ ID NO: 642274 - DNA, 20 bp, Artificial
  CRISPR gRNA sequence
cccactccctgcaccccatg

SEQ ID NO: 642275 - DNA, 20 bp, Artificial
  CRISPR gRNA sequence
cctgcaccccatgacaggcc

SEQ ID NO: 642276 - DNA, 20 bp, Artificial
  CRISPR gRNA sequence
caccccatgacaggccccag

SEQ ID NO: 642277 - DNA, 20 bp, Artificial
  CRISPR gRNA sequence
cccaccctgtgtccaagtgt

SEQ ID NO: 642278 - DNA, 20 bp, Artificial
  CRISPR gRNA sequence
tgtccaagtgttctcattgt

SEQ ID NO: 642279 - DNA, 20 bp, Artificial
  CRISPR gRNA sequence
tcattgttcagttcccacct

SEQ ID NO: 642280 - DNA, 20 bp, Artificial
  CRISPR gRNA sequence
attgttcagttcccacctat

SEQ ID NO: 642281 - DNA, 20 bp, Artificial
  CRISPR gRNA sequence
ttcagttcccacctatgagt

SEQ ID NO: 642282 - DNA, 20 bp, Artificial
  CRISPR gRNA sequence
agttcccacctatgagtgag

SEQ ID NO: 642283 - DNA, 20 bp, Artificial
  CRISPR gRNA sequence
ccacctatgagtgagaacat

SEQ ID NO: 642284 - DNA, 20 bp, Artificial
  CRISPR gRNA sequence
tgagtgagaacatgcggtgt

SEQ ID NO: 642285 - DNA, 20 bp, Artificial
  CRISPR gRNA sequence
ggttttctgtccttgcgata

SEQ ID NO: 642286 - DNA, 20 bp, Artificial
  CRISPR gRNA sequence
gttttctgtccttgcgatag

SEQ ID NO: 642287 - DNA, 20 bp, Artificial
  CRISPR gRNA sequence
tctgtccttgcgatagtttg

SEQ ID NO: 642288 - DNA, 20 bp, Artificial
  CRISPR gRNA sequence
ctgtccttgcgatagtttgc

SEQ ID NO: 642289 - DNA, 20 bp, Artificial
  CRISPR gRNA sequence
tgtccttgcgatagtttgct

SEQ ID NO: 642290 - DNA, 20 bp, Artificial
  CRISPR gRNA sequence
tccttgcgatagtttgctca

SEQ ID NO: 642291 - DNA, 20 bp, Artificial
  CRISPR gRNA sequence
gcgatagtttgctcataatg

SEQ ID NO: 642292 - DNA, 20 bp, Artificial
  CRISPR gRNA sequence
cgatagtttgctcataatga

SEQ ID NO: 642293 - DNA, 20 bp, Artificial
  CRISPR gRNA sequence
gctcataatgatggtttcca

SEQ ID NO: 642294 - DNA, 20 bp, Artificial
  CRISPR gRNA sequence
ctcataatgatggtttccag

SEQ ID NO: 642295 - DNA, 20 bp, Artificial
  CRISPR gRNA sequence
ataatgatggtttccagctt

SEQ ID NO: 642296 - DNA, 20 bp, Artificial
  CRISPR gRNA sequence
ccagcttcatccatgtccct

SEQ ID NO: 642297 - DNA, 20 bp, Artificial
  CRISPR gRNA sequence
cagcttcatccatgtcccta

SEQ ID NO: 642298 - DNA, 20 bp, Artificial
  CRISPR gRNA sequence
catccatgtccctacaaagg

SEQ ID NO: 642299 - DNA, 20 bp, Artificial
  CRISPR gRNA sequence
atccatgtccctacaaagga

SEQ ID NO: 642300 - DNA, 20 bp, Artificial
  CRISPR gRNA sequence
caaaggacatgaactcatcc

SEQ ID NO: 642301 - DNA, 20 bp, Artificial
  CRISPR gRNA sequence
atcctttttcgtggctgcat

SEQ ID NO: 642302 - DNA, 20 bp, Artificial
  CRISPR gRNA sequence
tttcgtggctgcatagtatt

SEQ ID NO: 642303 - DNA, 20 bp, Artificial
  CRISPR gRNA sequence
ttcgtggctgcatagtattt

SEQ ID NO: 642304 - DNA, 20 bp, Artificial
  CRISPR gRNA sequence
tcgtggctgcatagtattta

SEQ ID NO: 642305 - DNA, 20 bp, Artificial
  CRISPR gRNA sequence
cgtggctgcatagtatttat

SEQ ID NO: 642306 - DNA, 20 bp, Artificial
  CRISPR gRNA sequence
gtggctgcatagtatttatt

SEQ ID NO: 642307 - DNA, 20 bp, Artificial
  CRISPR gRNA sequence
catagtatttattccatggt

SEQ ID NO: 642308 - DNA, 20 bp, Artificial
  CRISPR gRNA sequence
attccatggtgtatatgtgc

SEQ ID NO: 642309 - DNA, 20 bp, Artificial
  CRISPR gRNA sequence
ttccatggtgtatatgtgcc

SEQ ID NO: 642310 - DNA, 20 bp, Artificial
  CRISPR gRNA sequence
catggtgtatatgtgccaca

SEQ ID NO: 642311 - DNA, 20 bp, Artificial
  CRISPR gRNA sequence
tcttaatccagtctatcact

SEQ ID NO: 642312 - DNA, 20 bp, Artificial
  CRISPR gRNA sequence
cttaatccagtctatcactg

SEQ ID NO: 642313 - DNA, 20 bp, Artificial
  CRISPR gRNA sequence
ttaatccagtctatcactga

SEQ ID NO: 642314 - DNA, 20 bp, Artificial
  CRISPR gRNA sequence
aatccagtctatcactgatg

SEQ ID NO: 642315 - DNA, 20 bp, Artificial
  CRISPR gRNA sequence
atccagtctatcactgatgg

SEQ ID NO: 642316 - DNA, 20 bp, Artificial
  CRISPR gRNA sequence
tcactgatggacatttgggt

SEQ ID NO: 642317 - DNA, 20 bp, Artificial
  CRISPR gRNA sequence
atggacatttgggttggttc

SEQ ID NO: 642318 - DNA, 20 bp, Artificial
  CRISPR gRNA sequence
gggttggttccaagtctttg

SEQ ID NO: 642319 - DNA, 20 bp, Artificial
  CRISPR gRNA sequence
ggttggttccaagtctttgc

SEQ ID NO: 642320 - DNA, 20 bp, Artificial
  CRISPR gRNA sequence
gttccaagtctttgctattg

SEQ ID NO: 642321 - DNA, 20 bp, Artificial
  CRISPR gRNA sequence
caagtctttgctattgtgaa

SEQ ID NO: 642322 - DNA, 20 bp, Artificial
  CRISPR gRNA sequence
tgctattgtgaatagtgcct

SEQ ID NO: 642323 - DNA, 20 bp, Artificial
  CRISPR gRNA sequence
gctattgtgaatagtgcctc

SEQ ID NO: 642324 - DNA, 20 bp, Artificial
  CRISPR gRNA sequence
ctattgtgaatagtgcctca

SEQ ID NO: 642325 - DNA, 20 bp, Artificial
  CRISPR gRNA sequence
ttgtgaatagtgcctcaata

SEQ ID NO: 642326 - DNA, 20 bp, Artificial
  CRISPR gRNA sequence
tgaatagtgcctcaataaac

SEQ ID NO: 642327 - DNA, 20 bp, Artificial
  CRISPR gRNA sequence
aataaacacacgtgtgcatg

SEQ ID NO: 642328 - DNA, 20 bp, Artificial
  CRISPR gRNA sequence
tatagcagcatgatttataa

SEQ ID NO: 642329 - DNA, 20 bp, Artificial
  CRISPR gRNA sequence
atagcagcatgatttataat

SEQ ID NO: 642330 - DNA, 20 bp, Artificial
  CRISPR gRNA sequence
tagcagcatgatttataatc

SEQ ID NO: 642331 - DNA, 20 bp, Artificial
  CRISPR gRNA sequence
ataatcctttgggtatatac

SEQ ID NO: 642332 - DNA, 20 bp, Artificial
  CRISPR gRNA sequence
taatcctttgggtatatacc

SEQ ID NO: 642333 - DNA, 20 bp, Artificial
  CRISPR gRNA sequence
tgggtatatacccagtaatg

SEQ ID NO: 642334 - DNA, 20 bp, Artificial
  CRISPR gRNA sequence
gggtatatacccagtaatgg

SEQ ID NO: 642335 - DNA, 20 bp, Artificial
  CRISPR gRNA sequence
ggtatatacccagtaatggg

SEQ ID NO: 642336 - DNA, 20 bp, Artificial
  CRISPR gRNA sequence
ggtcaaatgatatttctagt

SEQ ID NO: 642337 - DNA, 20 bp, Artificial
  CRISPR gRNA sequence
ctagttctagatccctgagg

SEQ ID NO: 642338 - DNA, 20 bp, Artificial
  CRISPR gRNA sequence
tagttctagatccctgagga

SEQ ID NO: 642339 - DNA, 20 bp, Artificial
  CRISPR gRNA sequence
gttctagatccctgaggaat

SEQ ID NO: 642340 - DNA, 20 bp, Artificial
  CRISPR gRNA sequence
tagatccctgaggaattgcc

SEQ ID NO: 642341 - DNA, 20 bp, Artificial
  CRISPR gRNA sequence
gatccctgaggaattgccac

SEQ ID NO: 642342 - DNA, 20 bp, Artificial
  CRISPR gRNA sequence
aggaattgccacactgtctt

SEQ ID NO: 642343 - DNA, 20 bp, Artificial
  CRISPR gRNA sequence
ccacactgtcttccacaatg

SEQ ID NO: 642344 - DNA, 20 bp, Artificial
  CRISPR gRNA sequence
tcttccacaatggttgaact

SEQ ID NO: 642345 - DNA, 20 bp, Artificial
  CRISPR gRNA sequence
ccacaatggttgaactagtt

SEQ ID NO: 642346 - DNA, 20 bp, Artificial
  CRISPR gRNA sequence
cacaatggttgaactagttt

SEQ ID NO: 642347 - DNA, 20 bp, Artificial
  CRISPR gRNA sequence
aactagtttacagtcccagc

SEQ ID NO: 642348 - DNA, 20 bp, Artificial
  CRISPR gRNA sequence
gtttacagtcccagcaacag

SEQ ID NO: 642349 - DNA, 20 bp, Artificial
  CRISPR gRNA sequence
acagtcccagcaacagtgta

SEQ ID NO: 642350 - DNA, 20 bp, Artificial
  CRISPR gRNA sequence
cagtcccagcaacagtgtaa

SEQ ID NO: 642351 - DNA, 20 bp, Artificial
  CRISPR gRNA sequence
ccatttctccacatcctctc

SEQ ID NO: 642352 - DNA, 20 bp, Artificial
  CRISPR gRNA sequence
ctccacatcctctccagcac

SEQ ID NO: 642353 - DNA, 20 bp, Artificial
  CRISPR gRNA sequence
tccacatcctctccagcacc

SEQ ID NO: 642354 - DNA, 20 bp, Artificial
  CRISPR gRNA sequence
cacatcctctccagcacctg

SEQ ID NO: 642355 - DNA, 20 bp, Artificial
  CRISPR gRNA sequence
tccagcacctgctgtttcct

SEQ ID NO: 642356 - DNA, 20 bp, Artificial
  CRISPR gRNA sequence
cagcacctgctgtttcctga

SEQ ID NO: 642357 - DNA, 20 bp, Artificial
  CRISPR gRNA sequence
ctgtttcctgacttgttaat

SEQ ID NO: 642358 - DNA, 20 bp, Artificial
  CRISPR gRNA sequence
tttcctgacttgttaatgat

SEQ ID NO: 642359 - DNA, 20 bp, Artificial
  CRISPR gRNA sequence
cctgacttgttaatgatcgc

SEQ ID NO: 642360 - DNA, 20 bp, Artificial
  CRISPR gRNA sequence
ctgacttgttaatgatcgcc

SEQ ID NO: 642361 - DNA, 20 bp, Artificial
  CRISPR gRNA sequence
acttgttaatgatcgccatt

SEQ ID NO: 642362 - DNA, 20 bp, Artificial
  CRISPR gRNA sequence
gttaatgatcgccattctaa

SEQ ID NO: 642363 - DNA, 20 bp, Artificial
  CRISPR gRNA sequence
ttaatgatcgccattctaac

SEQ ID NO: 642364 - DNA, 20 bp, Artificial
  CRISPR gRNA sequence
atgatcgccattctaactgg

SEQ ID NO: 642365 - DNA, 20 bp, Artificial
  CRISPR gRNA sequence
taactggtgtgagatggtat

SEQ ID NO: 642366 - DNA, 20 bp, Artificial
  CRISPR gRNA sequence
actggtgtgagatggtatct

SEQ ID NO: 642367 - DNA, 20 bp, Artificial
  CRISPR gRNA sequence
gtgtgagatggtatctcatt

SEQ ID NO: 642368 - DNA, 20 bp, Artificial
  CRISPR gRNA sequence
attgtggttttgatttgcat

SEQ ID NO: 642369 - DNA, 20 bp, Artificial
  CRISPR gRNA sequence
tggttttgatttgcatttct

SEQ ID NO: 642370 - DNA, 20 bp, Artificial
  CRISPR gRNA sequence
tgatttgcatttctctgatg

SEQ ID NO: 642371 - DNA, 20 bp, Artificial
  CRISPR gRNA sequence
gatttgcatttctctgatgg

SEQ ID NO: 642372 - DNA, 20 bp, Artificial
  CRISPR gRNA sequence
atttgcatttctctgatggc

SEQ ID NO: 642373 - DNA, 20 bp, Artificial
  CRISPR gRNA sequence
gcatttctctgatggccagt

SEQ ID NO: 642374 - DNA, 20 bp, Artificial
  CRISPR gRNA sequence
catttctctgatggccagtg

SEQ ID NO: 642375 - DNA, 20 bp, Artificial
  CRISPR gRNA sequence
ctctgatggccagtgatgat

SEQ ID NO: 642376 - DNA, 20 bp, Artificial
  CRISPR gRNA sequence
tctgatggccagtgatgatg

SEQ ID NO: 642377 - DNA, 20 bp, Artificial
  CRISPR gRNA sequence
tgatggccagtgatgatgag

SEQ ID NO: 642378 - DNA, 20 bp, Artificial
  CRISPR gRNA sequence
atggccagtgatgatgagca

SEQ ID NO: 642379 - DNA, 20 bp, Artificial
  CRISPR gRNA sequence
ttccatgtgtctgtcagcta

SEQ ID NO: 642380 - DNA, 20 bp, Artificial
  CRISPR gRNA sequence
tccatgtgtctgtcagctac

SEQ ID NO: 642381 - DNA, 20 bp, Artificial
  CRISPR gRNA sequence
ccatgtgtctgtcagctaca

SEQ ID NO: 642382 - DNA, 20 bp, Artificial
  CRISPR gRNA sequence
catgtgtctgtcagctacat

SEQ ID NO: 642383 - DNA, 20 bp, Artificial
  CRISPR gRNA sequence
tcagctacataaatgtcttc

SEQ ID NO: 642384 - DNA, 20 bp, Artificial
  CRISPR gRNA sequence
cataaatgtcttctttcgag

SEQ ID NO: 642385 - DNA, 20 bp, Artificial
  CRISPR gRNA sequence
ctttcgagaagtgtctgttc

SEQ ID NO: 642386 - DNA, 20 bp, Artificial
  CRISPR gRNA sequence
tttcgagaagtgtctgttca

SEQ ID NO: 642387 - DNA, 20 bp, Artificial
  CRISPR gRNA sequence
tcgagaagtgtctgttcata

SEQ ID NO: 642388 - DNA, 20 bp, Artificial
  CRISPR gRNA sequence
cgagaagtgtctgttcatat

SEQ ID NO: 642389 - DNA, 20 bp, Artificial
  CRISPR gRNA sequence
gagaagtgtctgttcatatc

SEQ ID NO: 642390 - DNA, 20 bp, Artificial
  CRISPR gRNA sequence
ttcatatcctttgcccactt

SEQ ID NO: 642391 - DNA, 20 bp, Artificial
  CRISPR gRNA sequence
atatcctttgcccacttttt

SEQ ID NO: 642392 - DNA, 20 bp, Artificial
  CRISPR gRNA sequence
tgcccactttttgatggggt

SEQ ID NO: 642393 - DNA, 20 bp, Artificial
  CRISPR gRNA sequence
gcccactttttgatggggtt

SEQ ID NO: 642394 - DNA, 20 bp, Artificial
  CRISPR gRNA sequence
cccactttttgatggggttg

SEQ ID NO: 642395 - DNA, 20 bp, Artificial
  CRISPR gRNA sequence
tttgatggggttgtttgatt

SEQ ID NO: 642396 - DNA, 20 bp, Artificial
  CRISPR gRNA sequence
ttgatggggttgtttgattt

SEQ ID NO: 642397 - DNA, 20 bp, Artificial
  CRISPR gRNA sequence
tgatggggttgtttgatttt

SEQ ID NO: 642398 - DNA, 20 bp, Artificial
  CRISPR gRNA sequence
gatggggttgtttgattttt

SEQ ID NO: 642399 - DNA, 20 bp, Artificial
  CRISPR gRNA sequence
atggggttgtttgatttttt

SEQ ID NO: 642400 - DNA, 20 bp, Artificial
  CRISPR gRNA sequence
tttgatttttttcttgtaaa

SEQ ID NO: 642401 - DNA, 20 bp, Artificial
  CRISPR gRNA sequence
gatttttttcttgtaaattt

SEQ ID NO: 642402 - DNA, 20 bp, Artificial
  CRISPR gRNA sequence
atttttttcttgtaaatttg

SEQ ID NO: 642403 - DNA, 20 bp, Artificial
  CRISPR gRNA sequence
ttttcttgtaaatttgttta

SEQ ID NO: 642404 - DNA, 20 bp, Artificial
  CRISPR gRNA sequence
tttcttgtaaatttgtttaa

SEQ ID NO: 642405 - DNA, 20 bp, Artificial
  CRISPR gRNA sequence
ttcttgtaaatttgtttaag

SEQ ID NO: 642406 - DNA, 20 bp, Artificial
  CRISPR gRNA sequence
tcttgtaaatttgtttaagt

SEQ ID NO: 642407 - DNA, 20 bp, Artificial
  CRISPR gRNA sequence
cttgtaaatttgtttaagtt

SEQ ID NO: 642408 - DNA, 20 bp, Artificial
  CRISPR gRNA sequence
ttgtaaatttgtttaagttc

SEQ ID NO: 642409 - DNA, 20 bp, Artificial
  CRISPR gRNA sequence
gtaaatttgtttaagttctt

SEQ ID NO: 642410 - DNA, 20 bp, Artificial
  CRISPR gRNA sequence
taaatttgtttaagttcttt

SEQ ID NO: 642411 - DNA, 20 bp, Artificial
  CRISPR gRNA sequence
gtttaagttctttgtagatt

SEQ ID NO: 642412 - DNA, 20 bp, Artificial
  CRISPR gRNA sequence
tttaagttctttgtagattc

SEQ ID NO: 642413 - DNA, 20 bp, Artificial
  CRISPR gRNA sequence
aagttctttgtagattctgg

SEQ ID NO: 642414 - DNA, 20 bp, Artificial
  CRISPR gRNA sequence
agttctttgtagattctgga

SEQ ID NO: 642415 - DNA, 20 bp, Artificial
  CRISPR gRNA sequence
tttgtagattctggatatac

SEQ ID NO: 642416 - DNA, 20 bp, Artificial
  CRISPR gRNA sequence
tgtagattctggatatacta

SEQ ID NO: 642417 - DNA, 20 bp, Artificial
  CRISPR gRNA sequence
gtagattctggatatactaa

SEQ ID NO: 642418 - DNA, 20 bp, Artificial
  CRISPR gRNA sequence
tagattctggatatactaag

SEQ ID NO: 642419 - DNA, 20 bp, Artificial
  CRISPR gRNA sequence
tggatatactaagtattaat

SEQ ID NO: 642420 - DNA, 20 bp, Artificial
  CRISPR gRNA sequence
gatatactaagtattaattt

SEQ ID NO: 642421 - DNA, 20 bp, Artificial
  CRISPR gRNA sequence
agtattaatttatatccaat

SEQ ID NO: 642422 - DNA, 20 bp, Artificial
  CRISPR gRNA sequence
atttatatccaatttcattc

SEQ ID NO: 642423 - DNA, 20 bp, Artificial
  CRISPR gRNA sequence
atatccaatttcattccaaa

SEQ ID NO: 642424 - DNA, 20 bp, Artificial
  CRISPR gRNA sequence
tatccaatttcattccaaag

SEQ ID NO: 642425 - DNA, 20 bp, Artificial
  CRISPR gRNA sequence
cattccaaagctgatattta

SEQ ID NO: 642426 - DNA, 20 bp, Artificial
  CRISPR gRNA sequence
attccaaagctgatatttaa

SEQ ID NO: 642427 - DNA, 20 bp, Artificial
  CRISPR gRNA sequence
caaagctgatatttaaaaac

SEQ ID NO: 642428 - DNA, 20 bp, Artificial
  CRISPR gRNA sequence
atatttaaaaacagctttaa

SEQ ID NO: 642429 - DNA, 20 bp, Artificial
  CRISPR gRNA sequence
aaaaacagctttaaaaataa

SEQ ID NO: 642430 - DNA, 20 bp, Artificial
  CRISPR gRNA sequence
aaaacagctttaaaaataat

SEQ ID NO: 642431 - DNA, 20 bp, Artificial
  CRISPR gRNA sequence
taaaaataattttcctggcc

SEQ ID NO: 642432 - DNA, 20 bp, Artificial
  CRISPR gRNA sequence
aaaaataattttcctggcct

SEQ ID NO: 642433 - DNA, 20 bp, Artificial
  CRISPR gRNA sequence
aaaataattttcctggcctg

SEQ ID NO: 642434 - DNA, 20 bp, Artificial
  CRISPR gRNA sequence
tcctggcctggcacagtggc

SEQ ID NO: 642435 - DNA, 20 bp, Artificial
  CRISPR gRNA sequence
cctggcctggcacagtggct

SEQ ID NO: 642436 - DNA, 20 bp, Artificial
  CRISPR gRNA sequence
ctggcctggcacagtggctc

SEQ ID NO: 642437 - DNA, 20 bp, Artificial
  CRISPR gRNA sequence
gcctggcacagtggctcaca

SEQ ID NO: 642438 - DNA, 20 bp, Artificial
  CRISPR gRNA sequence
gcacagtggctcacacctgt

SEQ ID NO: 642439 - DNA, 20 bp, Artificial
  CRISPR gRNA sequence
acacctgtaatcttagcaat

SEQ ID NO: 642440 - DNA, 20 bp, Artificial
  CRISPR gRNA sequence
taatcttagcaatttgagag

SEQ ID NO: 642441 - DNA, 20 bp, Artificial
  CRISPR gRNA sequence
agcaatttgagaggctgagg

SEQ ID NO: 642442 - DNA, 20 bp, Artificial
  CRISPR gRNA sequence
gcaatttgagaggctgaggc

SEQ ID NO: 642443 - DNA, 20 bp, Artificial
  CRISPR gRNA sequence
gagaggctgaggcaggggga

SEQ ID NO: 642444 - DNA, 20 bp, Artificial
  CRISPR gRNA sequence
agaggctgaggcagggggat

SEQ ID NO: 642445 - DNA, 20 bp, Artificial
  CRISPR gRNA sequence
aggcagggggatcatttgaa

SEQ ID NO: 642446 - DNA, 20 bp, Artificial
  CRISPR gRNA sequence
gaagtcaagagtttgaaacc

SEQ ID NO: 642447 - DNA, 20 bp, Artificial
  CRISPR gRNA sequence
aagtcaagagtttgaaacca

SEQ ID NO: 642448 - DNA, 20 bp, Artificial
  CRISPR gRNA sequence
gaaaccagcctggccaacat

SEQ ID NO: 642449 - DNA, 20 bp, Artificial
  CRISPR gRNA sequence
aaaccagcctggccaacatg

SEQ ID NO: 642450 - DNA, 20 bp, Artificial
  CRISPR gRNA sequence
gccaacatggtgaaacctcc

SEQ ID NO: 642451 - DNA, 20 bp, Artificial
  CRISPR gRNA sequence
ctctctagtaaaaacataaa

SEQ ID NO: 642452 - DNA, 20 bp, Artificial
  CRISPR gRNA sequence
tctagtaaaaacataaaaat

SEQ ID NO: 642453 - DNA, 20 bp, Artificial
  CRISPR gRNA sequence
tagtaaaaacataaaaatta

SEQ ID NO: 642454 - DNA, 20 bp, Artificial
  CRISPR gRNA sequence
gtaaaaacataaaaattagc

SEQ ID NO: 642455 - DNA, 20 bp, Artificial
  CRISPR gRNA sequence
gccagtcatagtggtgggcg

SEQ ID NO: 642456 - DNA, 20 bp, Artificial
  CRISPR gRNA sequence
taatcacaccacttgggaat

SEQ ID NO: 642457 - DNA, 20 bp, Artificial
  CRISPR gRNA sequence
gggaatctgaggcaggagaa

SEQ ID NO: 642458 - DNA, 20 bp, Artificial
  CRISPR gRNA sequence
ggaatctgaggcaggagaat

SEQ ID NO: 642459 - DNA, 20 bp, Artificial
  CRISPR gRNA sequence
aggcaggagaatcgcttgaa

SEQ ID NO: 642460 - DNA, 20 bp, Artificial
  CRISPR gRNA sequence
gaacccagaaggcggaggtt

SEQ ID NO: 642461 - DNA, 20 bp, Artificial
  CRISPR gRNA sequence
aacccagaaggcggaggttg

SEQ ID NO: 642462 - DNA, 20 bp, Artificial
  CRISPR gRNA sequence
cagtgagccaagattgcgcc

SEQ ID NO: 642463 - DNA, 20 bp, Artificial
  CRISPR gRNA sequence
cgccactgcactccagtctg

SEQ ID NO: 642464 - DNA, 20 bp, Artificial
  CRISPR gRNA sequence
cactccagtctgggcaacag

SEQ ID NO: 642465 - DNA, 20 bp, Artificial
  CRISPR gRNA sequence
cagtctgggcaacagagcga

SEQ ID NO: 642466 - DNA, 20 bp, Artificial
  CRISPR gRNA sequence
ggcaacagagcgagactctg

SEQ ID NO: 642467 - DNA, 20 bp, Artificial
  CRISPR gRNA sequence
tgtctcaaaataaataaata

SEQ ID NO: 642468 - DNA, 20 bp, Artificial
  CRISPR gRNA sequence
tctcaaaataaataaataaa

SEQ ID NO: 642469 - DNA, 20 bp, Artificial
  CRISPR gRNA sequence
aaaataaataaataaataaa

SEQ ID NO: 642470 - DNA, 20 bp, Artificial
  CRISPR gRNA sequence
attttaccaaaattaataac

SEQ ID NO: 642471 - DNA, 20 bp, Artificial
  CRISPR gRNA sequence
taccaaaattaataacaaca

SEQ ID NO: 642472 - DNA, 20 bp, Artificial
  CRISPR gRNA sequence
accaaaattaataacaacaa

SEQ ID NO: 642473 - DNA, 20 bp, Artificial
  CRISPR gRNA sequence
ccaaaattaataacaacaat

SEQ ID NO: 642474 - DNA, 20 bp, Artificial
  CRISPR gRNA sequence
ataacaacaataatggaaga

SEQ ID NO: 642475 - DNA, 20 bp, Artificial
  CRISPR gRNA sequence
attaggtgctaattacttgt

SEQ ID NO: 642476 - DNA, 20 bp, Artificial
  CRISPR gRNA sequence
ttaggtgctaattacttgtc

SEQ ID NO: 642477 - DNA, 20 bp, Artificial
  CRISPR gRNA sequence
ggtgctaattacttgtcaag

SEQ ID NO: 642478 - DNA, 20 bp, Artificial
  CRISPR gRNA sequence
attacttgtcaagaattaca

SEQ ID NO: 642479 - DNA, 20 bp, Artificial
  CRISPR gRNA sequence
cttgtcaagaattacactga

SEQ ID NO: 642480 - DNA, 20 bp, Artificial
  CRISPR gRNA sequence
gtcaagaattacactgagtt

SEQ ID NO: 642481 - DNA, 20 bp, Artificial
  CRISPR gRNA sequence
tcaagaattacactgagttt

SEQ ID NO: 642482 - DNA, 20 bp, Artificial
  CRISPR gRNA sequence
cactgagtttcacaaacatt

SEQ ID NO: 642483 - DNA, 20 bp, Artificial
  CRISPR gRNA sequence
agtttcacaaacattatcta

SEQ ID NO: 642484 - DNA, 20 bp, Artificial
  CRISPR gRNA sequence
cacaaacattatctaatgtt

SEQ ID NO: 642485 - DNA, 20 bp, Artificial
  CRISPR gRNA sequence
acaaacattatctaatgtta

SEQ ID NO: 642486 - DNA, 20 bp, Artificial
  CRISPR gRNA sequence
tctaatgttaccttcaaaga

SEQ ID NO: 642487 - DNA, 20 bp, Artificial
  CRISPR gRNA sequence
atgttaccttcaaagaaccc

SEQ ID NO: 642488 - DNA, 20 bp, Artificial
  CRISPR gRNA sequence
ccttcaaagaacccagtgaa

SEQ ID NO: 642489 - DNA, 20 bp, Artificial
  CRISPR gRNA sequence
caaagaacccagtgaaataa

SEQ ID NO: 642490 - DNA, 20 bp, Artificial
  CRISPR gRNA sequence
aaagaacccagtgaaataag

SEQ ID NO: 642491 - DNA, 20 bp, Artificial
  CRISPR gRNA sequence
taagtgaggacactaagtct

SEQ ID NO: 642492 - DNA, 20 bp, Artificial
  CRISPR gRNA sequence
agtcttaaaaaactgttggg

SEQ ID NO: 642493 - DNA, 20 bp, Artificial
  CRISPR gRNA sequence
aaaaaactgttgggtagctt

SEQ ID NO: 642494 - DNA, 20 bp, Artificial
  CRISPR gRNA sequence
aaaaactgttgggtagcttt

SEQ ID NO: 642495 - DNA, 20 bp, Artificial
  CRISPR gRNA sequence
ttgggtagctttggttctct

SEQ ID NO: 642496 - DNA, 20 bp, Artificial
  CRISPR gRNA sequence
ggtagctttggttctctgct

SEQ ID NO: 642497 - DNA, 20 bp, Artificial
  CRISPR gRNA sequence
tggttctctgctgcattgta

SEQ ID NO: 642498 - DNA, 20 bp, Artificial
  CRISPR gRNA sequence
ggttctctgctgcattgtaa

SEQ ID NO: 642499 - DNA, 20 bp, Artificial
  CRISPR gRNA sequence
gttctctgctgcattgtaag

SEQ ID NO: 642500 - DNA, 20 bp, Artificial
  CRISPR gRNA sequence
tctgctgcattgtaagggaa

SEQ ID NO: 642501 - DNA, 20 bp, Artificial
  CRISPR gRNA sequence
tgctgcattgtaagggaaac

SEQ ID NO: 642502 - DNA, 20 bp, Artificial
  CRISPR gRNA sequence
ctgcattgtaagggaaacca

SEQ ID NO: 642503 - DNA, 20 bp, Artificial
  CRISPR gRNA sequence
cattgtaagggaaaccataa

SEQ ID NO: 642504 - DNA, 20 bp, Artificial
  CRISPR gRNA sequence
taagggaaaccataattgca

SEQ ID NO: 642505 - DNA, 20 bp, Artificial
  CRISPR gRNA sequence
cactactctgcaggagcatc

SEQ ID NO: 642506 - DNA, 20 bp, Artificial
  CRISPR gRNA sequence
ctctgcaggagcatcctggc

SEQ ID NO: 642507 - DNA, 20 bp, Artificial
  CRISPR gRNA sequence
tgcaggagcatcctggctct

SEQ ID NO: 642508 - DNA, 20 bp, Artificial
  CRISPR gRNA sequence
caggagcatcctggctctcg

SEQ ID NO: 642509 - DNA, 20 bp, Artificial
  CRISPR gRNA sequence
gctctcgaatcctttggcta

SEQ ID NO: 642510 - DNA, 20 bp, Artificial
  CRISPR gRNA sequence
tcgaatcctttggctaagac

SEQ ID NO: 642511 - DNA, 20 bp, Artificial
  CRISPR gRNA sequence
gaatcctttggctaagacat

SEQ ID NO: 642512 - DNA, 20 bp, Artificial
  CRISPR gRNA sequence
tggctaagacattttgatta

SEQ ID NO: 642513 - DNA, 20 bp, Artificial
  CRISPR gRNA sequence
ggctaagacattttgattaa

SEQ ID NO: 642514 - DNA, 20 bp, Artificial
  CRISPR gRNA sequence
gctaagacattttgattaag

SEQ ID NO: 642515 - DNA, 20 bp, Artificial
  CRISPR gRNA sequence
agacattttgattaagactc

SEQ ID NO: 642516 - DNA, 20 bp, Artificial
  CRISPR gRNA sequence
tgattaagactcatcttgat

SEQ ID NO: 642517 - DNA, 20 bp, Artificial
  CRISPR gRNA sequence
gattaagactcatcttgatt

SEQ ID NO: 642518 - DNA, 20 bp, Artificial
  CRISPR gRNA sequence
attaagactcatcttgattt

SEQ ID NO: 642519 - DNA, 20 bp, Artificial
  CRISPR gRNA sequence
agactcatcttgatttgaga

SEQ ID NO: 642520 - DNA, 20 bp, Artificial
  CRISPR gRNA sequence
atcttgatttgagattctag

SEQ ID NO: 642521 - DNA, 20 bp, Artificial
  CRISPR gRNA sequence
gatttgagattctaggaatg

SEQ ID NO: 642522 - DNA, 20 bp, Artificial
  CRISPR gRNA sequence
atttgagattctaggaatga

SEQ ID NO: 642523 - DNA, 20 bp, Artificial
  CRISPR gRNA sequence
gagattctaggaatgactct

SEQ ID NO: 642524 - DNA, 20 bp, Artificial
  CRISPR gRNA sequence
agattctaggaatgactctc

SEQ ID NO: 642525 - DNA, 20 bp, Artificial
  CRISPR gRNA sequence
taggaatgactctcaagctt

SEQ ID NO: 642526 - DNA, 20 bp, Artificial
  CRISPR gRNA sequence
ggaatgactctcaagcttca

SEQ ID NO: 642527 - DNA, 20 bp, Artificial
  CRISPR gRNA sequence
tcaagcttcacctgttcaaa

SEQ ID NO: 642528 - DNA, 20 bp, Artificial
  CRISPR gRNA sequence
aagcttcacctgttcaaaac

SEQ ID NO: 642529 - DNA, 20 bp, Artificial
  CRISPR gRNA sequence
cacctgttcaaaacagagct

SEQ ID NO: 642530 - DNA, 20 bp, Artificial
  CRISPR gRNA sequence
acctgttcaaaacagagctc

SEQ ID NO: 642531 - DNA, 20 bp, Artificial
  CRISPR gRNA sequence
ttcaaaacagagctcttcat

SEQ ID NO: 642532 - DNA, 20 bp, Artificial
  CRISPR gRNA sequence
aaaacagagctcttcatttc

SEQ ID NO: 642533 - DNA, 20 bp, Artificial
  CRISPR gRNA sequence
ttcatttccccaagtcagta

SEQ ID NO: 642534 - DNA, 20 bp, Artificial
  CRISPR gRNA sequence
catttccccaagtcagtaag

SEQ ID NO: 642535 - DNA, 20 bp, Artificial
  CRISPR gRNA sequence
atttccccaagtcagtaagt

SEQ ID NO: 642536 - DNA, 20 bp, Artificial
  CRISPR gRNA sequence
ccccaagtcagtaagtgaca

SEQ ID NO: 642537 - DNA, 20 bp, Artificial
  CRISPR gRNA sequence
cccaagtcagtaagtgacat

SEQ ID NO: 642538 - DNA, 20 bp, Artificial
  CRISPR gRNA sequence
ttcaccaggctacttaagcc

SEQ ID NO: 642539 - DNA, 20 bp, Artificial
  CRISPR gRNA sequence
accaggctacttaagccaaa

SEQ ID NO: 642540 - DNA, 20 bp, Artificial
  CRISPR gRNA sequence
cttaagccaaacactagcag

SEQ ID NO: 642541 - DNA, 20 bp, Artificial
  CRISPR gRNA sequence
aagccaaacactagcagtca

SEQ ID NO: 642542 - DNA, 20 bp, Artificial
  CRISPR gRNA sequence
agccaaacactagcagtcac

SEQ ID NO: 642543 - DNA, 20 bp, Artificial
  CRISPR gRNA sequence
gcagtcactccttagacctc

SEQ ID NO: 642544 - DNA, 20 bp, Artificial
  CRISPR gRNA sequence
cttagacctctttttccctc

SEQ ID NO: 642545 - DNA, 20 bp, Artificial
  CRISPR gRNA sequence
agacctctttttccctcaca

SEQ ID NO: 642546 - DNA, 20 bp, Artificial
  CRISPR gRNA sequence
gacctctttttccctcacat

SEQ ID NO: 642547 - DNA, 20 bp, Artificial
  CRISPR gRNA sequence
tttttccctcacatgccgct

SEQ ID NO: 642548 - DNA, 20 bp, Artificial
  CRISPR gRNA sequence
tttccctcacatgccgcttc

SEQ ID NO: 642549 - DNA, 20 bp, Artificial
  CRISPR gRNA sequence
ttccctcacatgccgcttcc

SEQ ID NO: 642550 - DNA, 20 bp, Artificial
  CRISPR gRNA sequence
tccctcacatgccgcttcca

SEQ ID NO: 642551 - DNA, 20 bp, Artificial
  CRISPR gRNA sequence
ccctcacatgccgcttccaa

SEQ ID NO: 642552 - DNA, 20 bp, Artificial
  CRISPR gRNA sequence
cctcacatgccgcttccaat

SEQ ID NO: 642553 - DNA, 20 bp, Artificial
  CRISPR gRNA sequence
acatgccgcttccaatccat

SEQ ID NO: 642554 - DNA, 20 bp, Artificial
  CRISPR gRNA sequence
ccaatccatcagcaagtcca

SEQ ID NO: 642555 - DNA, 20 bp, Artificial
  CRISPR gRNA sequence
caatccatcagcaagtccaa

SEQ ID NO: 642556 - DNA, 20 bp, Artificial
  CRISPR gRNA sequence
tacttacaaaagaccacttc

SEQ ID NO: 642557 - DNA, 20 bp, Artificial
  CRISPR gRNA sequence
cttacaaaagaccacttctc

SEQ ID NO: 642558 - DNA, 20 bp, Artificial
  CRISPR gRNA sequence
acaaaagaccacttctcacc

SEQ ID NO: 642559 - DNA, 20 bp, Artificial
  CRISPR gRNA sequence
caaaagaccacttctcacca

SEQ ID NO: 642560 - DNA, 20 bp, Artificial
  CRISPR gRNA sequence
ctcaccacccccactgctcc

SEQ ID NO: 642561 - DNA, 20 bp, Artificial
  CRISPR gRNA sequence
tcaccacccccactgctcct

SEQ ID NO: 642562 - DNA, 20 bp, Artificial
  CRISPR gRNA sequence
accacccccactgctcctgc

SEQ ID NO: 642563 - DNA, 20 bp, Artificial
  CRISPR gRNA sequence
ctcctgctctagttggatac

SEQ ID NO: 642564 - DNA, 20 bp, Artificial
  CRISPR gRNA sequence
ctgctctagttggatacacc

SEQ ID NO: 642565 - DNA, 20 bp, Artificial
  CRISPR gRNA sequence
ctctagttggatacaccacc

SEQ ID NO: 642566 - DNA, 20 bp, Artificial
  CRISPR gRNA sequence
tagttggatacaccaccatc

SEQ ID NO: 642567 - DNA, 20 bp, Artificial
  CRISPR gRNA sequence
gttggatacaccaccatctt

SEQ ID NO: 642568 - DNA, 20 bp, Artificial
  CRISPR gRNA sequence
gatacaccaccatctttcac

SEQ ID NO: 642569 - DNA, 20 bp, Artificial
  CRISPR gRNA sequence
tcacacaaatcactttcacg

SEQ ID NO: 642570 - DNA, 20 bp, Artificial
  CRISPR gRNA sequence
cacacaaatcactttcacgc

SEQ ID NO: 642571 - DNA, 20 bp, Artificial
  CRISPR gRNA sequence
acacaaatcactttcacgca

SEQ ID NO: 642572 - DNA, 20 bp, Artificial
  CRISPR gRNA sequence
tcacgcagaccttctcactt

SEQ ID NO: 642573 - DNA, 20 bp, Artificial
  CRISPR gRNA sequence
cacgcagaccttctcacttc

SEQ ID NO: 642574 - DNA, 20 bp, Artificial
  CRISPR gRNA sequence
acgcagaccttctcacttca

SEQ ID NO: 642575 - DNA, 20 bp, Artificial
  CRISPR gRNA sequence
ctcacttcagctcaggcctc

SEQ ID NO: 642576 - DNA, 20 bp, Artificial
  CRISPR gRNA sequence
tcacttcagctcaggcctct

SEQ ID NO: 642577 - DNA, 20 bp, Artificial
  CRISPR gRNA sequence
acttcagctcaggcctcttc

SEQ ID NO: 642578 - DNA, 20 bp, Artificial
  CRISPR gRNA sequence
cagctcaggcctcttcactt

SEQ ID NO: 642579 - DNA, 20 bp, Artificial
  CRISPR gRNA sequence
agctcaggcctcttcacttt

SEQ ID NO: 642580 - DNA, 20 bp, Artificial
  CRISPR gRNA sequence
aggcctcttcacttttgtgc

SEQ ID NO: 642581 - DNA, 20 bp, Artificial
  CRISPR gRNA sequence
ttcacttttgtgcaggcctc

SEQ ID NO: 642582 - DNA, 20 bp, Artificial
  CRISPR gRNA sequence
cacttttgtgcaggcctcct

SEQ ID NO: 642583 - DNA, 20 bp, Artificial
  CRISPR gRNA sequence
acttttgtgcaggcctcctc

SEQ ID NO: 642584 - DNA, 20 bp, Artificial
  CRISPR gRNA sequence
ttgtgcaggcctcctcacag

SEQ ID NO: 642585 - DNA, 20 bp, Artificial
  CRISPR gRNA sequence
tgtgcaggcctcctcacagg

SEQ ID NO: 642586 - DNA, 20 bp, Artificial
  CRISPR gRNA sequence
gtgcaggcctcctcacaggg

SEQ ID NO: 642587 - DNA, 20 bp, Artificial
  CRISPR gRNA sequence
tgcaggcctcctcacagggc

SEQ ID NO: 642588 - DNA, 20 bp, Artificial
  CRISPR gRNA sequence
ctcacagggcaccttgcttg

SEQ ID NO: 642589 - DNA, 20 bp, Artificial
  CRISPR gRNA sequence
acagggcaccttgcttgcag

SEQ ID NO: 642590 - DNA, 20 bp, Artificial
  CRISPR gRNA sequence
gcttgcagtcctctcccttt

SEQ ID NO: 642591 - DNA, 20 bp, Artificial
  CRISPR gRNA sequence
cttgcagtcctctccctttg

SEQ ID NO: 642592 - DNA, 20 bp, Artificial
  CRISPR gRNA sequence
gcagtcctctccctttgtcc

SEQ ID NO: 642593 - DNA, 20 bp, Artificial
  CRISPR gRNA sequence
cagtcctctccctttgtcca

SEQ ID NO: 642594 - DNA, 20 bp, Artificial
  CRISPR gRNA sequence
tccctttgtccactctccac

SEQ ID NO: 642595 - DNA, 20 bp, Artificial
  CRISPR gRNA sequence
cctttgtccactctccacat

SEQ ID NO: 642596 - DNA, 20 bp, Artificial
  CRISPR gRNA sequence
tgtccactctccacatggga

SEQ ID NO: 642597 - DNA, 20 bp, Artificial
  CRISPR gRNA sequence
gtccactctccacatgggac

SEQ ID NO: 642598 - DNA, 20 bp, Artificial
  CRISPR gRNA sequence
tccactctccacatgggacc

SEQ ID NO: 642599 - DNA, 20 bp, Artificial
  CRISPR gRNA sequence
tccacatgggacccagataa

SEQ ID NO: 642600 - DNA, 20 bp, Artificial
  CRISPR gRNA sequence
cacatgggacccagataatt

SEQ ID NO: 642601 - DNA, 20 bp, Artificial
  CRISPR gRNA sequence
atgaaatatatgatcacccc

SEQ ID NO: 642602 - DNA, 20 bp, Artificial
  CRISPR gRNA sequence
tgaaatatatgatcacccca

SEQ ID NO: 642603 - DNA, 20 bp, Artificial
  CRISPR gRNA sequence
tcccctctttcagaccactg

SEQ ID NO: 642604 - DNA, 20 bp, Artificial
  CRISPR gRNA sequence
ccctctttcagaccactgta

SEQ ID NO: 642605 - DNA, 20 bp, Artificial
  CRISPR gRNA sequence
tttcagaccactgtaaccaa

SEQ ID NO: 642606 - DNA, 20 bp, Artificial
  CRISPR gRNA sequence
tcagaccactgtaaccaaac

SEQ ID NO: 642607 - DNA, 20 bp, Artificial
  CRISPR gRNA sequence
cagaccactgtaaccaaacc

SEQ ID NO: 642608 - DNA, 20 bp, Artificial
  CRISPR gRNA sequence
agaccactgtaaccaaacca

SEQ ID NO: 642609 - DNA, 20 bp, Artificial
  CRISPR gRNA sequence
taaccaaaccaaactggtac

SEQ ID NO: 642610 - DNA, 20 bp, Artificial
  CRISPR gRNA sequence
gtacccttgctgttcctcaa

SEQ ID NO: 642611 - DNA, 20 bp, Artificial
  CRISPR gRNA sequence
gctgttcctcaagtacacca

SEQ ID NO: 642612 - DNA, 20 bp, Artificial
  CRISPR gRNA sequence
ctgttcctcaagtacaccaa

SEQ ID NO: 642613 - DNA, 20 bp, Artificial
  CRISPR gRNA sequence
ttcctcaagtacaccaaata

SEQ ID NO: 642614 - DNA, 20 bp, Artificial
  CRISPR gRNA sequence
ctcaagtacaccaaatatgc

SEQ ID NO: 642615 - DNA, 20 bp, Artificial
  CRISPR gRNA sequence
aagtacaccaaatatgcaaa

SEQ ID NO: 642616 - DNA, 20 bp, Artificial
  CRISPR gRNA sequence
ccaagaatgattctaactag

SEQ ID NO: 642617 - DNA, 20 bp, Artificial
  CRISPR gRNA sequence
taactagaaaatccactgct

SEQ ID NO: 642618 - DNA, 20 bp, Artificial
  CRISPR gRNA sequence
actagaaaatccactgcttt

SEQ ID NO: 642619 - DNA, 20 bp, Artificial
  CRISPR gRNA sequence
gaaaatccactgcttttgta

SEQ ID NO: 642620 - DNA, 20 bp, Artificial
  CRISPR gRNA sequence
cttttgtaatagaacatttt

SEQ ID NO: 642621 - DNA, 20 bp, Artificial
  CRISPR gRNA sequence
ttgtaatagaacatttttgg

SEQ ID NO: 642622 - DNA, 20 bp, Artificial
  CRISPR gRNA sequence
tgtaatagaacatttttggc

SEQ ID NO: 642623 - DNA, 20 bp, Artificial
  CRISPR gRNA sequence
gtaatagaacatttttggct

SEQ ID NO: 642624 - DNA, 20 bp, Artificial
  CRISPR gRNA sequence
taatagaacatttttggctg

SEQ ID NO: 642625 - DNA, 20 bp, Artificial
  CRISPR gRNA sequence
ttggctgacagatcatgggc

SEQ ID NO: 642626 - DNA, 20 bp, Artificial
  CRISPR gRNA sequence
tggctgacagatcatgggcc

SEQ ID NO: 642627 - DNA, 20 bp, Artificial
  CRISPR gRNA sequence
ggctgacagatcatgggcca

SEQ ID NO: 642628 - DNA, 20 bp, Artificial
  CRISPR gRNA sequence
gctgacagatcatgggccaa

SEQ ID NO: 642629 - DNA, 20 bp, Artificial
  CRISPR gRNA sequence
acagatcatgggccaaaaat

SEQ ID NO: 642630 - DNA, 20 bp, Artificial
  CRISPR gRNA sequence
aacctccactctccaggccc

SEQ ID NO: 642631 - DNA, 20 bp, Artificial
  CRISPR gRNA sequence
acctccactctccaggccca

SEQ ID NO: 642632 - DNA, 20 bp, Artificial
  CRISPR gRNA sequence
cactctccaggcccaatctg

SEQ ID NO: 642633 - DNA, 20 bp, Artificial
  CRISPR gRNA sequence
tccaggcccaatctggtttg

SEQ ID NO: 642634 - DNA, 20 bp, Artificial
  CRISPR gRNA sequence
caggcccaatctggtttgta

SEQ ID NO: 642635 - DNA, 20 bp, Artificial
  CRISPR gRNA sequence
gtttgtaaccatgtacatgc

SEQ ID NO: 642636 - DNA, 20 bp, Artificial
  CRISPR gRNA sequence
gtaaccatgtacatgcatgg

SEQ ID NO: 642637 - DNA, 20 bp, Artificial
  CRISPR gRNA sequence
taaccatgtacatgcatggc

SEQ ID NO: 642638 - DNA, 20 bp, Artificial
  CRISPR gRNA sequence
attctgttacggggagaagg

SEQ ID NO: 642639 - DNA, 20 bp, Artificial
  CRISPR gRNA sequence
ttctgttacggggagaagga

SEQ ID NO: 642640 - DNA, 20 bp, Artificial
  CRISPR gRNA sequence
tgttacggggagaaggagga

SEQ ID NO: 642641 - DNA, 20 bp, Artificial
  CRISPR gRNA sequence
ttacggggagaaggaggagg

SEQ ID NO: 642642 - DNA, 20 bp, Artificial
  CRISPR gRNA sequence
cggggagaaggaggaggaaa

SEQ ID NO: 642643 - DNA, 20 bp, Artificial
  CRISPR gRNA sequence
ggagaattctgtaaggggga

SEQ ID NO: 642644 - DNA, 20 bp, Artificial
  CRISPR gRNA sequence
tgtaagggggagaagggtta

SEQ ID NO: 642645 - DNA, 20 bp, Artificial
  CRISPR gRNA sequence
taagggggagaagggttagt

SEQ ID NO: 642646 - DNA, 20 bp, Artificial
  CRISPR gRNA sequence
gtaaaaggtaagtatagaga

SEQ ID NO: 642647 - DNA, 20 bp, Artificial
  CRISPR gRNA sequence
gcatctgttcttcattggac

SEQ ID NO: 642648 - DNA, 20 bp, Artificial
  CRISPR gRNA sequence
ttcttcattggactccttgc

SEQ ID NO: 642649 - DNA, 20 bp, Artificial
  CRISPR gRNA sequence
ttcattggactccttgcctg

SEQ ID NO: 642650 - DNA, 20 bp, Artificial
  CRISPR gRNA sequence
cattggactccttgcctgag

SEQ ID NO: 642651 - DNA, 20 bp, Artificial
  CRISPR gRNA sequence
attggactccttgcctgaga

SEQ ID NO: 642652 - DNA, 20 bp, Artificial
  CRISPR gRNA sequence
gactccttgcctgagattaa

SEQ ID NO: 642653 - DNA, 20 bp, Artificial
  CRISPR gRNA sequence
cttgcctgagattaaatgct

SEQ ID NO: 642654 - DNA, 20 bp, Artificial
  CRISPR gRNA sequence
gcctgagattaaatgcttac

SEQ ID NO: 642655 - DNA, 20 bp, Artificial
  CRISPR gRNA sequence
cctgagattaaatgcttaca

SEQ ID NO: 642656 - DNA, 20 bp, Artificial
  CRISPR gRNA sequence
agattaaatgcttacagtaa

SEQ ID NO: 642657 - DNA, 20 bp, Artificial
  CRISPR gRNA sequence
aatgcttacagtaaaggaat

SEQ ID NO: 642658 - DNA, 20 bp, Artificial
  CRISPR gRNA sequence
acagtaaaggaatgacagcc

SEQ ID NO: 642659 - DNA, 20 bp, Artificial
  CRISPR gRNA sequence
cagtaaaggaatgacagcca

SEQ ID NO: 642660 - DNA, 20 bp, Artificial
  CRISPR gRNA sequence
aaatgaaattctggaaaaaa

SEQ ID NO: 642661 - DNA, 20 bp, Artificial
  CRISPR gRNA sequence
tggaaaaaagattatgacca

SEQ ID NO: 642662 - DNA, 20 bp, Artificial
  CRISPR gRNA sequence
gaaaaaagattatgaccaga

SEQ ID NO: 642663 - DNA, 20 bp, Artificial
  CRISPR gRNA sequence
tgaccagaaattgatcaaga

SEQ ID NO: 642664 - DNA, 20 bp, Artificial
  CRISPR gRNA sequence
atcaagagacacttcctgat

SEQ ID NO: 642665 - DNA, 20 bp, Artificial
  CRISPR gRNA sequence
cctgatactctgggcactag

SEQ ID NO: 642666 - DNA, 20 bp, Artificial
  CRISPR gRNA sequence
ctgatactctgggcactagc

SEQ ID NO: 642667 - DNA, 20 bp, Artificial
  CRISPR gRNA sequence
atactctgggcactagcaga

SEQ ID NO: 642668 - DNA, 20 bp, Artificial
  CRISPR gRNA sequence
tgggcactagcagagcttct

SEQ ID NO: 642669 - DNA, 20 bp, Artificial
  CRISPR gRNA sequence
ggcactagcagagcttcttt

SEQ ID NO: 642670 - DNA, 20 bp, Artificial
  CRISPR gRNA sequence
gcagagcttctttaaggccc

SEQ ID NO: 642671 - DNA, 20 bp, Artificial
  CRISPR gRNA sequence
ctttaaggcccagacaatac

SEQ ID NO: 642672 - DNA, 20 bp, Artificial
  CRISPR gRNA sequence
tttaaggcccagacaataca

SEQ ID NO: 642673 - DNA, 20 bp, Artificial
  CRISPR gRNA sequence
taaggcccagacaatacaat

SEQ ID NO: 642674 - DNA, 20 bp, Artificial
  CRISPR gRNA sequence
aaggcccagacaatacaata

SEQ ID NO: 642675 - DNA, 20 bp, Artificial
  CRISPR gRNA sequence
aggcccagacaatacaatat

SEQ ID NO: 642676 - DNA, 20 bp, Artificial
  CRISPR gRNA sequence
acagctggggagagacctcc

SEQ ID NO: 642677 - DNA, 20 bp, Artificial
  CRISPR gRNA sequence
gggagagacctcctgccaaa

SEQ ID NO: 642678 - DNA, 20 bp, Artificial
  CRISPR gRNA sequence
ctgccaaaacacccagaagc

SEQ ID NO: 642679 - DNA, 20 bp, Artificial
  CRISPR gRNA sequence
ccaaaacacccagaagcatc

SEQ ID NO: 642680 - DNA, 20 bp, Artificial
  CRISPR gRNA sequence
gactcaagcactgattttct

SEQ ID NO: 642681 - DNA, 20 bp, Artificial
  CRISPR gRNA sequence
actcaagcactgattttctc

SEQ ID NO: 642682 - DNA, 20 bp, Artificial
  CRISPR gRNA sequence
aagcactgattttctcctga

SEQ ID NO: 642683 - DNA, 20 bp, Artificial
  CRISPR gRNA sequence
attttctcctgataggaagt

SEQ ID NO: 642684 - DNA, 20 bp, Artificial
  CRISPR gRNA sequence
tctcctgataggaagtaaca

SEQ ID NO: 642685 - DNA, 20 bp, Artificial
  CRISPR gRNA sequence
ctcctgataggaagtaacaa

SEQ ID NO: 642686 - DNA, 20 bp, Artificial
  CRISPR gRNA sequence
tcctgataggaagtaacaac

SEQ ID NO: 642687 - DNA, 20 bp, Artificial
  CRISPR gRNA sequence
ctgataggaagtaacaacaa

SEQ ID NO: 642688 - DNA, 20 bp, Artificial
  CRISPR gRNA sequence
ataggaagtaacaacaaagg

SEQ ID NO: 642689 - DNA, 20 bp, Artificial
  CRISPR gRNA sequence
tgccaatggacctcctgagc

SEQ ID NO: 642690 - DNA, 20 bp, Artificial
  CRISPR gRNA sequence
gccaatggacctcctgagct

SEQ ID NO: 642691 - DNA, 20 bp, Artificial
  CRISPR gRNA sequence
ccaatggacctcctgagctg

SEQ ID NO: 642692 - DNA, 20 bp, Artificial
  CRISPR gRNA sequence
ctgagctgtggatgcaaaca

SEQ ID NO: 642693 - DNA, 20 bp, Artificial
  CRISPR gRNA sequence
agctgtggatgcaaacattt

SEQ ID NO: 642694 - DNA, 20 bp, Artificial
  CRISPR gRNA sequence
tggatgcaaacatttgggaa

SEQ ID NO: 642695 - DNA, 20 bp, Artificial
  CRISPR gRNA sequence
gggaactaggggagaaatgt

SEQ ID NO: 642696 - DNA, 20 bp, Artificial
  CRISPR gRNA sequence
ggaactaggggagaaatgtg

SEQ ID NO: 642697 - DNA, 20 bp, Artificial
  CRISPR gRNA sequence
ggggagaaatgtgggcagtg

SEQ ID NO: 642698 - DNA, 20 bp, Artificial
  CRISPR gRNA sequence
gtgacagctgagagaatggt

SEQ ID NO: 642699 - DNA, 20 bp, Artificial
  CRISPR gRNA sequence
agagaatggtttctggacat

SEQ ID NO: 642700 - DNA, 20 bp, Artificial
  CRISPR gRNA sequence
ctggacatatgtgaggtgac

SEQ ID NO: 642701 - DNA, 20 bp, Artificial
  CRISPR gRNA sequence
tggacatatgtgaggtgaca

SEQ ID NO: 642702 - DNA, 20 bp, Artificial
  CRISPR gRNA sequence
gacatatgtgaggtgacagt

SEQ ID NO: 642703 - DNA, 20 bp, Artificial
  CRISPR gRNA sequence
ctagagggtcacaggtacat

SEQ ID NO: 642704 - DNA, 20 bp, Artificial
  CRISPR gRNA sequence
gagggtcacaggtacatggt

SEQ ID NO: 642705 - DNA, 20 bp, Artificial
  CRISPR gRNA sequence
atatgaatcaggccagtgcg

SEQ ID NO: 642706 - DNA, 20 bp, Artificial
  CRISPR gRNA sequence
tatgaatcaggccagtgcgg

SEQ ID NO: 642707 - DNA, 20 bp, Artificial
  CRISPR gRNA sequence
tctcaatctgctcactaaag

SEQ ID NO: 642708 - DNA, 20 bp, Artificial
  CRISPR gRNA sequence
aatctgctcactaaagtata

SEQ ID NO: 642709 - DNA, 20 bp, Artificial
  CRISPR gRNA sequence
ctcactaaagtatatgtgtc

SEQ ID NO: 642710 - DNA, 20 bp, Artificial
  CRISPR gRNA sequence
actaaagtatatgtgtcttt

SEQ ID NO: 642711 - DNA, 20 bp, Artificial
  CRISPR gRNA sequence
aagtatatgtgtctttatgc

SEQ ID NO: 642712 - DNA, 20 bp, Artificial
  CRISPR gRNA sequence
tatgcagaagtcaaggctgg

SEQ ID NO: 642713 - DNA, 20 bp, Artificial
  CRISPR gRNA sequence
atgcagaagtcaaggctggt

SEQ ID NO: 642714 - DNA, 20 bp, Artificial
  CRISPR gRNA sequence
tgcagaagtcaaggctggta

SEQ ID NO: 642715 - DNA, 20 bp, Artificial
  CRISPR gRNA sequence
gtaaggtctgtaaacatctt

SEQ ID NO: 642716 - DNA, 20 bp, Artificial
  CRISPR gRNA sequence
taaacatcttggttctgcct

SEQ ID NO: 642717 - DNA, 20 bp, Artificial
  CRISPR gRNA sequence
ggttctgcctttaggttaag

SEQ ID NO: 642718 - DNA, 20 bp, Artificial
  CRISPR gRNA sequence
gttctgcctttaggttaagt

SEQ ID NO: 642719 - DNA, 20 bp, Artificial
  CRISPR gRNA sequence
tgcctttaggttaagtccaa

SEQ ID NO: 642720 - DNA, 20 bp, Artificial
  CRISPR gRNA sequence
cctttaggttaagtccaatt

SEQ ID NO: 642721 - DNA, 20 bp, Artificial
  CRISPR gRNA sequence
taggttaagtccaatttttt

SEQ ID NO: 642722 - DNA, 20 bp, Artificial
  CRISPR gRNA sequence
aggttaagtccaattttttt

SEQ ID NO: 642723 - DNA, 20 bp, Artificial
  CRISPR gRNA sequence
ggttaagtccaatttttttt

SEQ ID NO: 642724 - DNA, 20 bp, Artificial
  CRISPR gRNA sequence
agtccaattttttttctttt

SEQ ID NO: 642725 - DNA, 20 bp, Artificial
  CRISPR gRNA sequence
tttttcttttcctctaacat

SEQ ID NO: 642726 - DNA, 20 bp, Artificial
  CRISPR gRNA sequence
ttttcttttcctctaacatt

SEQ ID NO: 642727 - DNA, 20 bp, Artificial
  CRISPR gRNA sequence
tttcttttcctctaacattt

SEQ ID NO: 642728 - DNA, 20 bp, Artificial
  CRISPR gRNA sequence
ttcttttcctctaacatttc

SEQ ID NO: 642729 - DNA, 20 bp, Artificial
  CRISPR gRNA sequence
tcttttcctctaacatttct

SEQ ID NO: 642730 - DNA, 20 bp, Artificial
  CRISPR gRNA sequence
cttttcctctaacatttcta

SEQ ID NO: 642731 - DNA, 20 bp, Artificial
  CRISPR gRNA sequence
ttttcctctaacatttctaa

SEQ ID NO: 642732 - DNA, 20 bp, Artificial
  CRISPR gRNA sequence
ttcctctaacatttctaaag

SEQ ID NO: 642733 - DNA, 20 bp, Artificial
  CRISPR gRNA sequence
tcctctaacatttctaaagg

SEQ ID NO: 642734 - DNA, 20 bp, Artificial
  CRISPR gRNA sequence
cctctaacatttctaaagga

SEQ ID NO: 642735 - DNA, 20 bp, Artificial
  CRISPR gRNA sequence
ctctaacatttctaaaggag

SEQ ID NO: 642736 - DNA, 20 bp, Artificial
  CRISPR gRNA sequence
taacatttctaaaggagact

SEQ ID NO: 642737 - DNA, 20 bp, Artificial
  CRISPR gRNA sequence
acatttctaaaggagactaa

SEQ ID NO: 642738 - DNA, 20 bp, Artificial
  CRISPR gRNA sequence
ctaaaggagactaaacaaac

SEQ ID NO: 642739 - DNA, 20 bp, Artificial
  CRISPR gRNA sequence
taaaggagactaaacaaaca

SEQ ID NO: 642740 - DNA, 20 bp, Artificial
  CRISPR gRNA sequence
aaggagactaaacaaacatg

SEQ ID NO: 642741 - DNA, 20 bp, Artificial
  CRISPR gRNA sequence
aacaaacatggtcttttctg

SEQ ID NO: 642742 - DNA, 20 bp, Artificial
  CRISPR gRNA sequence
ttctgtcactaactccaggc

SEQ ID NO: 642743 - DNA, 20 bp, Artificial
  CRISPR gRNA sequence
tctgtcactaactccaggct

SEQ ID NO: 642744 - DNA, 20 bp, Artificial
  CRISPR gRNA sequence
ctgtcactaactccaggctc

SEQ ID NO: 642745 - DNA, 20 bp, Artificial
  CRISPR gRNA sequence
tgtcactaactccaggctca

SEQ ID NO: 642746 - DNA, 20 bp, Artificial
  CRISPR gRNA sequence
tcactaactccaggctcact

SEQ ID NO: 642747 - DNA, 20 bp, Artificial
  CRISPR gRNA sequence
actccaggctcacttacttt

SEQ ID NO: 642748 - DNA, 20 bp, Artificial
  CRISPR gRNA sequence
caggctcacttactttggca

SEQ ID NO: 642749 - DNA, 20 bp, Artificial
  CRISPR gRNA sequence
acttactttggcattcacat

SEQ ID NO: 642750 - DNA, 20 bp, Artificial
  CRISPR gRNA sequence
actttggcattcacatttct

SEQ ID NO: 642751 - DNA, 20 bp, Artificial
  CRISPR gRNA sequence
ctttggcattcacatttcta

SEQ ID NO: 642752 - DNA, 20 bp, Artificial
  CRISPR gRNA sequence
tggcattcacatttctattt

SEQ ID NO: 642753 - DNA, 20 bp, Artificial
  CRISPR gRNA sequence
ggcattcacatttctatttg

SEQ ID NO: 642754 - DNA, 20 bp, Artificial
  CRISPR gRNA sequence
gcattcacatttctatttga

SEQ ID NO: 642755 - DNA, 20 bp, Artificial
  CRISPR gRNA sequence
acatttctatttgatgcttt

SEQ ID NO: 642756 - DNA, 20 bp, Artificial
  CRISPR gRNA sequence
ctatttgatgctttggctat

SEQ ID NO: 642757 - DNA, 20 bp, Artificial
  CRISPR gRNA sequence
tatttgatgctttggctata

SEQ ID NO: 642758 - DNA, 20 bp, Artificial
  CRISPR gRNA sequence
tttgatgctttggctataca

SEQ ID NO: 642759 - DNA, 20 bp, Artificial
  CRISPR gRNA sequence
gatgctttggctatacacag

SEQ ID NO: 642760 - DNA, 20 bp, Artificial
  CRISPR gRNA sequence
atgctttggctatacacaga

SEQ ID NO: 642761 - DNA, 20 bp, Artificial
  CRISPR gRNA sequence
tggctatacacagacagaag

SEQ ID NO: 642762 - DNA, 20 bp, Artificial
  CRISPR gRNA sequence
ggctatacacagacagaaga

SEQ ID NO: 642763 - DNA, 20 bp, Artificial
  CRISPR gRNA sequence
gctatacacagacagaagac

SEQ ID NO: 642764 - DNA, 20 bp, Artificial
  CRISPR gRNA sequence
tacacagacagaagacaatt

SEQ ID NO: 642765 - DNA, 20 bp, Artificial
  CRISPR gRNA sequence
tacaataaaatggttttata

SEQ ID NO: 642766 - DNA, 20 bp, Artificial
  CRISPR gRNA sequence
tatatcatactcttttcacc

SEQ ID NO: 642767 - DNA, 20 bp, Artificial
  CRISPR gRNA sequence
atatcatactcttttcacca

SEQ ID NO: 642768 - DNA, 20 bp, Artificial
  CRISPR gRNA sequence
tatcatactcttttcaccaa

SEQ ID NO: 642769 - DNA, 20 bp, Artificial
  CRISPR gRNA sequence
ttttcaccaaaaaacaagcc

SEQ ID NO: 642770 - DNA, 20 bp, Artificial
  CRISPR gRNA sequence
ttcaccaaaaaacaagccaa

SEQ ID NO: 642771 - DNA, 20 bp, Artificial
  CRISPR gRNA sequence
tcaccaaaaaacaagccaat

SEQ ID NO: 642772 - DNA, 20 bp, Artificial
  CRISPR gRNA sequence
caccaaaaaacaagccaatt

SEQ ID NO: 642773 - DNA, 20 bp, Artificial
  CRISPR gRNA sequence
accaaaaaacaagccaattt

SEQ ID NO: 642774 - DNA, 20 bp, Artificial
  CRISPR gRNA sequence
aaaaactaagtttctttaaa

SEQ ID NO: 642775 - DNA, 20 bp, Artificial
  CRISPR gRNA sequence
aaaactaagtttctttaaaa

SEQ ID NO: 642776 - DNA, 20 bp, Artificial
  CRISPR gRNA sequence
agtttctttaaaaattgcag

SEQ ID NO: 642777 - DNA, 20 bp, Artificial
  CRISPR gRNA sequence
ctttaaaaattgcagatgta

SEQ ID NO: 642778 - DNA, 20 bp, Artificial
  CRISPR gRNA sequence
tttaaaaattgcagatgtaa

SEQ ID NO: 642779 - DNA, 20 bp, Artificial
  CRISPR gRNA sequence
taaaaattgcagatgtaatg

SEQ ID NO: 642780 - DNA, 20 bp, Artificial
  CRISPR gRNA sequence
aaaaattgcagatgtaatga

SEQ ID NO: 642781 - DNA, 20 bp, Artificial
  CRISPR gRNA sequence
aaaattgcagatgtaatgaa

SEQ ID NO: 642782 - DNA, 20 bp, Artificial
  CRISPR gRNA sequence
cagatgtaatgaattaaggt

SEQ ID NO: 642783 - DNA, 20 bp, Artificial
  CRISPR gRNA sequence
aggtaagatgaagtcgtact

SEQ ID NO: 642784 - DNA, 20 bp, Artificial
  CRISPR gRNA sequence
gagtagggtgagcccttaat

SEQ ID NO: 642785 - DNA, 20 bp, Artificial
  CRISPR gRNA sequence
aatctattgtgactggtgtc

SEQ ID NO: 642786 - DNA, 20 bp, Artificial
  CRISPR gRNA sequence
atctattgtgactggtgtcc

SEQ ID NO: 642787 - DNA, 20 bp, Artificial
  CRISPR gRNA sequence
ttgtgactggtgtccttaca

SEQ ID NO: 642788 - DNA, 20 bp, Artificial
  CRISPR gRNA sequence
tgactggtgtccttacaaaa

SEQ ID NO: 642789 - DNA, 20 bp, Artificial
  CRISPR gRNA sequence
gtgtccttacaaaaagggaa

SEQ ID NO: 642790 - DNA, 20 bp, Artificial
  CRISPR gRNA sequence
acaaaaagggaaagtttaga

SEQ ID NO: 642791 - DNA, 20 bp, Artificial
  CRISPR gRNA sequence
caaaaagggaaagtttagac

SEQ ID NO: 642792 - DNA, 20 bp, Artificial
  CRISPR gRNA sequence
agacagagacatgcatatgg

SEQ ID NO: 642793 - DNA, 20 bp, Artificial
  CRISPR gRNA sequence
gacagagacatgcatatggg

SEQ ID NO: 642794 - DNA, 20 bp, Artificial
  CRISPR gRNA sequence
tgaacatgaaggcaaagatg

SEQ ID NO: 642795 - DNA, 20 bp, Artificial
  CRISPR gRNA sequence
tccctcacagccctcacatg

SEQ ID NO: 642796 - DNA, 20 bp, Artificial
  CRISPR gRNA sequence
cctcacagccctcacatgaa

SEQ ID NO: 642797 - DNA, 20 bp, Artificial
  CRISPR gRNA sequence
acagccctcacatgaaacca

SEQ ID NO: 642798 - DNA, 20 bp, Artificial
  CRISPR gRNA sequence
acatgaaaccaatactgctt

SEQ ID NO: 642799 - DNA, 20 bp, Artificial
  CRISPR gRNA sequence
cttacaccttaatctcagac

SEQ ID NO: 642800 - DNA, 20 bp, Artificial
  CRISPR gRNA sequence
acaccttaatctcagacttc

SEQ ID NO: 642801 - DNA, 20 bp, Artificial
  CRISPR gRNA sequence
caccttaatctcagacttcc

SEQ ID NO: 642802 - DNA, 20 bp, Artificial
  CRISPR gRNA sequence
aatctcagacttccagcctc

SEQ ID NO: 642803 - DNA, 20 bp, Artificial
  CRISPR gRNA sequence
atctcagacttccagcctcc

SEQ ID NO: 642804 - DNA, 20 bp, Artificial
  CRISPR gRNA sequence
agacttccagcctccagaac

SEQ ID NO: 642805 - DNA, 20 bp, Artificial
  CRISPR gRNA sequence
ccagcctccagaactgtgag

SEQ ID NO: 642806 - DNA, 20 bp, Artificial
  CRISPR gRNA sequence
cagcctccagaactgtgagg

SEQ ID NO: 642807 - DNA, 20 bp, Artificial
  CRISPR gRNA sequence
cagaactgtgaggcaataaa

SEQ ID NO: 642808 - DNA, 20 bp, Artificial
  CRISPR gRNA sequence
tgaggcaataaacttctgtt

SEQ ID NO: 642809 - DNA, 20 bp, Artificial
  CRISPR gRNA sequence
ctgttgtttaagccacccag

SEQ ID NO: 642810 - DNA, 20 bp, Artificial
  CRISPR gRNA sequence
tgttgtttaagccacccagt

SEQ ID NO: 642811 - DNA, 20 bp, Artificial
  CRISPR gRNA sequence
ttgtttaagccacccagtct

SEQ ID NO: 642812 - DNA, 20 bp, Artificial
  CRISPR gRNA sequence
tttaagccacccagtctgtg

SEQ ID NO: 642813 - DNA, 20 bp, Artificial
  CRISPR gRNA sequence
aagccacccagtctgtggta

SEQ ID NO: 642814 - DNA, 20 bp, Artificial
  CRISPR gRNA sequence
agccacccagtctgtggtag

SEQ ID NO: 642815 - DNA, 20 bp, Artificial
  CRISPR gRNA sequence
tggtagttcgttacagcaaa

SEQ ID NO: 642816 - DNA, 20 bp, Artificial
  CRISPR gRNA sequence
gttacagcaaaccaaggaaa

SEQ ID NO: 642817 - DNA, 20 bp, Artificial
  CRISPR gRNA sequence
cagcaaaccaaggaaattaa

SEQ ID NO: 642818 - DNA, 20 bp, Artificial
  CRISPR gRNA sequence
atacaggctcagatgagata

SEQ ID NO: 642819 - DNA, 20 bp, Artificial
  CRISPR gRNA sequence
agatgagatatattttagga

SEQ ID NO: 642820 - DNA, 20 bp, Artificial
  CRISPR gRNA sequence
taggaaccagaaaggagatg

SEQ ID NO: 642821 - DNA, 20 bp, Artificial
  CRISPR gRNA sequence
aggaaccagaaaggagatgc

SEQ ID NO: 642822 - DNA, 20 bp, Artificial
  CRISPR gRNA sequence
ggaaccagaaaggagatgca

SEQ ID NO: 642823 - DNA, 20 bp, Artificial
  CRISPR gRNA sequence
ggacactacagcaagaacat

SEQ ID NO: 642824 - DNA, 20 bp, Artificial
  CRISPR gRNA sequence
cagcaagaacattttgaagt

SEQ ID NO: 642825 - DNA, 20 bp, Artificial
  CRISPR gRNA sequence
tgaagtccttcagaggaaag

SEQ ID NO: 642826 - DNA, 20 bp, Artificial
  CRISPR gRNA sequence
gaagtccttcagaggaaagg

SEQ ID NO: 642827 - DNA, 20 bp, Artificial
  CRISPR gRNA sequence
aagtccttcagaggaaagga

SEQ ID NO: 642828 - DNA, 20 bp, Artificial
  CRISPR gRNA sequence
cagaggaaaggaaaggtgcc

SEQ ID NO: 642829 - DNA, 20 bp, Artificial
  CRISPR gRNA sequence
agaggaaaggaaaggtgcca

SEQ ID NO: 642830 - DNA, 20 bp, Artificial
  CRISPR gRNA sequence
attttacgatttttaaaggc

SEQ ID NO: 642831 - DNA, 20 bp, Artificial
  CRISPR gRNA sequence
tacgatttttaaaggcaaag

SEQ ID NO: 642832 - DNA, 20 bp, Artificial
  CRISPR gRNA sequence
acgatttttaaaggcaaagg

SEQ ID NO: 642833 - DNA, 20 bp, Artificial
  CRISPR gRNA sequence
cgatttttaaaggcaaagga

SEQ ID NO: 642834 - DNA, 20 bp, Artificial
  CRISPR gRNA sequence
ttaaaggcaaaggatgtgaa

SEQ ID NO: 642835 - DNA, 20 bp, Artificial
  CRISPR gRNA sequence
taaaggcaaaggatgtgaat

SEQ ID NO: 642836 - DNA, 20 bp, Artificial
  CRISPR gRNA sequence
aaaggcaaaggatgtgaatt

SEQ ID NO: 642837 - DNA, 20 bp, Artificial
  CRISPR gRNA sequence
aaggcaaaggatgtgaattt

SEQ ID NO: 642838 - DNA, 20 bp, Artificial
  CRISPR gRNA sequence
tgtcaatctaagataaatat

SEQ ID NO: 642839 - DNA, 20 bp, Artificial
  CRISPR gRNA sequence
gtcaatctaagataaatatg

SEQ ID NO: 642840 - DNA, 20 bp, Artificial
  CRISPR gRNA sequence
tcaatctaagataaatatgc

SEQ ID NO: 642841 - DNA, 20 bp, Artificial
  CRISPR gRNA sequence
agataaatatgcttacaatg

SEQ ID NO: 642842 - DNA, 20 bp, Artificial
  CRISPR gRNA sequence
acaatgaaccaattaaaatt

SEQ ID NO: 642843 - DNA, 20 bp, Artificial
  CRISPR gRNA sequence
caatgaaccaattaaaattg

SEQ ID NO: 642844 - DNA, 20 bp, Artificial
  CRISPR gRNA sequence
aaattggaaggtaagtgttt

SEQ ID NO: 642845 - DNA, 20 bp, Artificial
  CRISPR gRNA sequence
gaaggtaagtgtttgtgtaa

SEQ ID NO: 642846 - DNA, 20 bp, Artificial
  CRISPR gRNA sequence
gtgtaacaactttttaaaaa

SEQ ID NO: 642847 - DNA, 20 bp, Artificial
  CRISPR gRNA sequence
tgtaacaactttttaaaaag

SEQ ID NO: 642848 - DNA, 20 bp, Artificial
  CRISPR gRNA sequence
tttaaaaagtatgatccaat

SEQ ID NO: 642849 - DNA, 20 bp, Artificial
  CRISPR gRNA sequence
ttaaaaagtatgatccaata

SEQ ID NO: 642850 - DNA, 20 bp, Artificial
  CRISPR gRNA sequence
taaaaagtatgatccaatat

SEQ ID NO: 642851 - DNA, 20 bp, Artificial
  CRISPR gRNA sequence
aaaaagtatgatccaatatg

SEQ ID NO: 642852 - DNA, 20 bp, Artificial
  CRISPR gRNA sequence
aaaagtatgatccaatatgg

SEQ ID NO: 642853 - DNA, 20 bp, Artificial
  CRISPR gRNA sequence
actaaaaataatatttttat

SEQ ID NO: 642854 - DNA, 20 bp, Artificial
  CRISPR gRNA sequence
aaaataatatttttattgtt

SEQ ID NO: 642855 - DNA, 20 bp, Artificial
  CRISPR gRNA sequence
ttattgttgatggaattatt

SEQ ID NO: 642856 - DNA, 20 bp, Artificial
  CRISPR gRNA sequence
tattgttgatggaattatta

SEQ ID NO: 642857 - DNA, 20 bp, Artificial
  CRISPR gRNA sequence
attgttgatggaattattaa

SEQ ID NO: 642858 - DNA, 20 bp, Artificial
  CRISPR gRNA sequence
ttgttgatggaattattaaa

SEQ ID NO: 642859 - DNA, 20 bp, Artificial
  CRISPR gRNA sequence
ttgatggaattattaaactg

SEQ ID NO: 642860 - DNA, 20 bp, Artificial
  CRISPR gRNA sequence
atggaattattaaactggta

SEQ ID NO: 642861 - DNA, 20 bp, Artificial
  CRISPR gRNA sequence
ttaaactggtagtttaaaaa

SEQ ID NO: 642862 - DNA, 20 bp, Artificial
  CRISPR gRNA sequence
aactggtagtttaaaaatgt

SEQ ID NO: 642863 - DNA, 20 bp, Artificial
  CRISPR gRNA sequence
gtagtttaaaaatgtggact

SEQ ID NO: 642864 - DNA, 20 bp, Artificial
  CRISPR gRNA sequence
aaaaatgtggactttgttca

SEQ ID NO: 642865 - DNA, 20 bp, Artificial
  CRISPR gRNA sequence
aaaatgtggactttgttcat

SEQ ID NO: 642866 - DNA, 20 bp, Artificial
  CRISPR gRNA sequence
tgttcattctgaacttaatt

SEQ ID NO: 642867 - DNA, 20 bp, Artificial
  CRISPR gRNA sequence
gttcattctgaacttaattc

SEQ ID NO: 642868 - DNA, 20 bp, Artificial
  CRISPR gRNA sequence
ttcattctgaacttaattcc

SEQ ID NO: 642869 - DNA, 20 bp, Artificial
  CRISPR gRNA sequence
attctgaacttaattccata

SEQ ID NO: 642870 - DNA, 20 bp, Artificial
  CRISPR gRNA sequence
tgaacttaattccatatctg

SEQ ID NO: 642871 - DNA, 20 bp, Artificial
  CRISPR gRNA sequence
aacttaattccatatctgaa

SEQ ID NO: 642872 - DNA, 20 bp, Artificial
  CRISPR gRNA sequence
aattccatatctgaagaaag

SEQ ID NO: 642873 - DNA, 20 bp, Artificial
  CRISPR gRNA sequence
attccatatctgaagaaagc

SEQ ID NO: 642874 - DNA, 20 bp, Artificial
  CRISPR gRNA sequence
catatctgaagaaagctctc

SEQ ID NO: 642875 - DNA, 20 bp, Artificial
  CRISPR gRNA sequence
aagaaagctctcataatgtt

SEQ ID NO: 642876 - DNA, 20 bp, Artificial
  CRISPR gRNA sequence
tcataatgttcttgaggtcg

SEQ ID NO: 642877 - DNA, 20 bp, Artificial
  CRISPR gRNA sequence
ataatgttcttgaggtcgaa

SEQ ID NO: 642878 - DNA, 20 bp, Artificial
  CRISPR gRNA sequence
ttgaggtcgaaatggagaaa

SEQ ID NO: 642879 - DNA, 20 bp, Artificial
  CRISPR gRNA sequence
gaggtcgaaatggagaaata

SEQ ID NO: 642880 - DNA, 20 bp, Artificial
  CRISPR gRNA sequence
aggtcgaaatggagaaatat

SEQ ID NO: 642881 - DNA, 20 bp, Artificial
  CRISPR gRNA sequence
ataacaggttgaacaaccac

SEQ ID NO: 642882 - DNA, 20 bp, Artificial
  CRISPR gRNA sequence
aacaaccacacccaaacagt

SEQ ID NO: 642883 - DNA, 20 bp, Artificial
  CRISPR gRNA sequence
attaatgacaagatgttaac

SEQ ID NO: 642884 - DNA, 20 bp, Artificial
  CRISPR gRNA sequence
atgacaagatgttaacttga

SEQ ID NO: 642885 - DNA, 20 bp, Artificial
  CRISPR gRNA sequence
acttgaaaacagatctcagg

SEQ ID NO: 642886 - DNA, 20 bp, Artificial
  CRISPR gRNA sequence
gaaaacagatctcaggttgt

SEQ ID NO: 642887 - DNA, 20 bp, Artificial
  CRISPR gRNA sequence
aaaacagatctcaggttgtg

SEQ ID NO: 642888 - DNA, 20 bp, Artificial
  CRISPR gRNA sequence
aggttgtgtgccatagggct

SEQ ID NO: 642889 - DNA, 20 bp, Artificial
  CRISPR gRNA sequence
tgtgccatagggctattttc

SEQ ID NO: 642890 - DNA, 20 bp, Artificial
  CRISPR gRNA sequence
ttttcacaagattgaaaaga

SEQ ID NO: 642891 - DNA, 20 bp, Artificial
  CRISPR gRNA sequence
tcacaagattgaaaagaaac

SEQ ID NO: 642892 - DNA, 20 bp, Artificial
  CRISPR gRNA sequence
cacaagattgaaaagaaact

SEQ ID NO: 642893 - DNA, 20 bp, Artificial
  CRISPR gRNA sequence
acaagattgaaaagaaactt

SEQ ID NO: 642894 - DNA, 20 bp, Artificial
  CRISPR gRNA sequence
aaaagaaacttgcaaggcat

SEQ ID NO: 642895 - DNA, 20 bp, Artificial
  CRISPR gRNA sequence
gcaaggcatgtttatcaaac

SEQ ID NO: 642896 - DNA, 20 bp, Artificial
  CRISPR gRNA sequence
caaggcatgtttatcaaacc

SEQ ID NO: 642897 - DNA, 20 bp, Artificial
  CRISPR gRNA sequence
atcaaacctgtgcatgacac

SEQ ID NO: 642898 - DNA, 20 bp, Artificial
  CRISPR gRNA sequence
tcaaacctgtgcatgacaca

SEQ ID NO: 642899 - DNA, 20 bp, Artificial
  CRISPR gRNA sequence
tgcatgacacacagctgaca

SEQ ID NO: 642900 - DNA, 20 bp, Artificial
  CRISPR gRNA sequence
acaaggatacctgatcccct

SEQ ID NO: 642901 - DNA, 20 bp, Artificial
  CRISPR gRNA sequence
atcccctcaatggctgagtt

SEQ ID NO: 642902 - DNA, 20 bp, Artificial
  CRISPR gRNA sequence
aatggctgagttttgattcc

SEQ ID NO: 642903 - DNA, 20 bp, Artificial
  CRISPR gRNA sequence
agttttgattccagaaatca

SEQ ID NO: 642904 - DNA, 20 bp, Artificial
  CRISPR gRNA sequence
tgattccagaaatcatccgt

SEQ ID NO: 642905 - DNA, 20 bp, Artificial
  CRISPR gRNA sequence
gattccagaaatcatccgtc

SEQ ID NO: 642906 - DNA, 20 bp, Artificial
  CRISPR gRNA sequence
attccagaaatcatccgtct

SEQ ID NO: 642907 - DNA, 20 bp, Artificial
  CRISPR gRNA sequence
cagaaatcatccgtctgaag

SEQ ID NO: 642908 - DNA, 20 bp, Artificial
  CRISPR gRNA sequence
aagaagaaaggaattagaga

SEQ ID NO: 642909 - DNA, 20 bp, Artificial
  CRISPR gRNA sequence
gagatgttaaccaagagaaa

SEQ ID NO: 642910 - DNA, 20 bp, Artificial
  CRISPR gRNA sequence
accaagagaaaaacaacagg

SEQ ID NO: 642911 - DNA, 20 bp, Artificial
  CRISPR gRNA sequence
gatttatgaaagatgtggga

SEQ ID NO: 642912 - DNA, 20 bp, Artificial
  CRISPR gRNA sequence
atgaaagatgtgggatcaaa

SEQ ID NO: 642913 - DNA, 20 bp, Artificial
  CRISPR gRNA sequence
tgaaagatgtgggatcaaag

SEQ ID NO: 642914 - DNA, 20 bp, Artificial
  CRISPR gRNA sequence
atgcagaaaagatgtgaaaa

SEQ ID NO: 642915 - DNA, 20 bp, Artificial
  CRISPR gRNA sequence
tgcagaaaagatgtgaaaat

SEQ ID NO: 642916 - DNA, 20 bp, Artificial
  CRISPR gRNA sequence
aataaaagaaagaatattct

SEQ ID NO: 642917 - DNA, 20 bp, Artificial
  CRISPR gRNA sequence
ataaaagaaagaatattcta

SEQ ID NO: 642918 - DNA, 20 bp, Artificial
  CRISPR gRNA sequence
tatttctctgtgtaactgtc

SEQ ID NO: 642919 - DNA, 20 bp, Artificial
  CRISPR gRNA sequence
tttctctgtgtaactgtcac

SEQ ID NO: 642920 - DNA, 20 bp, Artificial
  CRISPR gRNA sequence
ctctgtgtaactgtcactct

SEQ ID NO: 642921 - DNA, 20 bp, Artificial
  CRISPR gRNA sequence
tctgtgtaactgtcactcta

SEQ ID NO: 642922 - DNA, 20 bp, Artificial
  CRISPR gRNA sequence
tgtgtaactgtcactctagt

SEQ ID NO: 642923 - DNA, 20 bp, Artificial
  CRISPR gRNA sequence
tgtaactgtcactctagtgc

SEQ ID NO: 642924 - DNA, 20 bp, Artificial
  CRISPR gRNA sequence
tcactctagtgctaatatat

SEQ ID NO: 642925 - DNA, 20 bp, Artificial
  CRISPR gRNA sequence
tagtgctaatatattttact

SEQ ID NO: 642926 - DNA, 20 bp, Artificial
  CRISPR gRNA sequence
gtgctaatatattttactta

SEQ ID NO: 642927 - DNA, 20 bp, Artificial
  CRISPR gRNA sequence
atatattttacttaattatt

SEQ ID NO: 642928 - DNA, 20 bp, Artificial
  CRISPR gRNA sequence
tacttaattattgctggtcc

SEQ ID NO: 642929 - DNA, 20 bp, Artificial
  CRISPR gRNA sequence
acttaattattgctggtcct

SEQ ID NO: 642930 - DNA, 20 bp, Artificial
  CRISPR gRNA sequence
cttaattattgctggtcctc

SEQ ID NO: 642931 - DNA, 20 bp, Artificial
  CRISPR gRNA sequence
aattattgctggtcctctcc

SEQ ID NO: 642932 - DNA, 20 bp, Artificial
  CRISPR gRNA sequence
attattgctggtcctctcca

SEQ ID NO: 642933 - DNA, 20 bp, Artificial
  CRISPR gRNA sequence
ttgctggtcctctccatggc

SEQ ID NO: 642934 - DNA, 20 bp, Artificial
  CRISPR gRNA sequence
ctggtcctctccatggccac

SEQ ID NO: 642935 - DNA, 20 bp, Artificial
  CRISPR gRNA sequence
gtcctctccatggccactag

SEQ ID NO: 642936 - DNA, 20 bp, Artificial
  CRISPR gRNA sequence
tccatggccactagcttccc

SEQ ID NO: 642937 - DNA, 20 bp, Artificial
  CRISPR gRNA sequence
catggccactagcttcccca

SEQ ID NO: 642938 - DNA, 20 bp, Artificial
  CRISPR gRNA sequence
gcttccccatttcttccctt

SEQ ID NO: 642939 - DNA, 20 bp, Artificial
  CRISPR gRNA sequence
ccccatttcttcccttacat

SEQ ID NO: 642940 - DNA, 20 bp, Artificial
  CRISPR gRNA sequence
cccatttcttcccttacatt

SEQ ID NO: 642941 - DNA, 20 bp, Artificial
  CRISPR gRNA sequence
cttcccttacattttccaat

SEQ ID NO: 642942 - DNA, 20 bp, Artificial
  CRISPR gRNA sequence
ttcccttacattttccaatc

SEQ ID NO: 642943 - DNA, 20 bp, Artificial
  CRISPR gRNA sequence
cccttacattttccaatcca

SEQ ID NO: 642944 - DNA, 20 bp, Artificial
  CRISPR gRNA sequence
ccttacattttccaatccat

SEQ ID NO: 642945 - DNA, 20 bp, Artificial
  CRISPR gRNA sequence
acattttccaatccattctg

SEQ ID NO: 642946 - DNA, 20 bp, Artificial
  CRISPR gRNA sequence
cattttccaatccattctgt

SEQ ID NO: 642947 - DNA, 20 bp, Artificial
  CRISPR gRNA sequence
tccaatccattctgtgaaag

SEQ ID NO: 642948 - DNA, 20 bp, Artificial
  CRISPR gRNA sequence
ccaatccattctgtgaaaga

SEQ ID NO: 642949 - DNA, 20 bp, Artificial
  CRISPR gRNA sequence
caatccattctgtgaaagag

SEQ ID NO: 642950 - DNA, 20 bp, Artificial
  CRISPR gRNA sequence
tgtgaaagagagtataagct

SEQ ID NO: 642951 - DNA, 20 bp, Artificial
  CRISPR gRNA sequence
tgaaagagagtataagctgt

SEQ ID NO: 642952 - DNA, 20 bp, Artificial
  CRISPR gRNA sequence
tgtgtgtgtgtgtgcgtgtg

SEQ ID NO: 642953 - DNA, 20 bp, Artificial
  CRISPR gRNA sequence
atactatttttatttaattt

SEQ ID NO: 642954 - DNA, 20 bp, Artificial
  CRISPR gRNA sequence
tttttatttaatttatttac

SEQ ID NO: 642955 - DNA, 20 bp, Artificial
  CRISPR gRNA sequence
ttatttaatttatttactta

SEQ ID NO: 642956 - DNA, 20 bp, Artificial
  CRISPR gRNA sequence
tatttaatttatttacttat

SEQ ID NO: 642957 - DNA, 20 bp, Artificial
  CRISPR gRNA sequence
atttaatttatttacttatt

SEQ ID NO: 642958 - DNA, 20 bp, Artificial
  CRISPR gRNA sequence
tttaatttatttacttatta

SEQ ID NO: 642959 - DNA, 20 bp, Artificial
  CRISPR gRNA sequence
aatttatttacttattattt

SEQ ID NO: 642960 - DNA, 20 bp, Artificial
  CRISPR gRNA sequence
atttatttacttattatttt

SEQ ID NO: 642961 - DNA, 20 bp, Artificial
  CRISPR gRNA sequence
atttacttattattttttgt

SEQ ID NO: 642962 - DNA, 20 bp, Artificial
  CRISPR gRNA sequence
tttacttattattttttgtt

SEQ ID NO: 642963 - DNA, 20 bp, Artificial
  CRISPR gRNA sequence
acttattattttttgtttat

SEQ ID NO: 642964 - DNA, 20 bp, Artificial
  CRISPR gRNA sequence
cttattattttttgtttatt

SEQ ID NO: 642965 - DNA, 20 bp, Artificial
  CRISPR gRNA sequence
attattttttgtttattata

SEQ ID NO: 642966 - DNA, 20 bp, Artificial
  CRISPR gRNA sequence
ttattttttgtttattatat

SEQ ID NO: 642967 - DNA, 20 bp, Artificial
  CRISPR gRNA sequence
ttttttgtttattatatttt

SEQ ID NO: 642968 - DNA, 20 bp, Artificial
  CRISPR gRNA sequence
tttgtttattatatttttat

SEQ ID NO: 642969 - DNA, 20 bp, Artificial
  CRISPR gRNA sequence
ttgtttattatatttttatt

SEQ ID NO: 642970 - DNA, 20 bp, Artificial
  CRISPR gRNA sequence
tgtttattatatttttatta

SEQ ID NO: 642971 - DNA, 20 bp, Artificial
  CRISPR gRNA sequence
gtttattatatttttattaa

SEQ ID NO: 642972 - DNA, 20 bp, Artificial
  CRISPR gRNA sequence
tttattatatttttattaat

SEQ ID NO: 642973 - DNA, 20 bp, Artificial
  CRISPR gRNA sequence
attatatttttattaattta

SEQ ID NO: 642974 - DNA, 20 bp, Artificial
  CRISPR gRNA sequence
ttatatttttattaatttat

SEQ ID NO: 642975 - DNA, 20 bp, Artificial
  CRISPR gRNA sequence
tatttttattaatttatcta

SEQ ID NO: 642976 - DNA, 20 bp, Artificial
  CRISPR gRNA sequence
ttattaatttatctatttta

SEQ ID NO: 642977 - DNA, 20 bp, Artificial
  CRISPR gRNA sequence
tattaatttatctattttat

SEQ ID NO: 642978 - DNA, 20 bp, Artificial
  CRISPR gRNA sequence
attaatttatctattttatt

SEQ ID NO: 642979 - DNA, 20 bp, Artificial
  CRISPR gRNA sequence
ttaatttatctattttattt

SEQ ID NO: 642980 - DNA, 20 bp, Artificial
  CRISPR gRNA sequence
atttatctattttatttatt

SEQ ID NO: 642981 - DNA, 20 bp, Artificial
  CRISPR gRNA sequence
atctattttatttattatac

SEQ ID NO: 642982 - DNA, 20 bp, Artificial
  CRISPR gRNA sequence
tctattttatttattatact

SEQ ID NO: 642983 - DNA, 20 bp, Artificial
  CRISPR gRNA sequence
ttttatttattatactagta

SEQ ID NO: 642984 - DNA, 20 bp, Artificial
  CRISPR gRNA sequence
tatttattatactagtattt

SEQ ID NO: 642985 - DNA, 20 bp, Artificial
  CRISPR gRNA sequence
atttattatactagtatttg

SEQ ID NO: 642986 - DNA, 20 bp, Artificial
  CRISPR gRNA sequence
tttattatactagtatttgt

SEQ ID NO: 642987 - DNA, 20 bp, Artificial
  CRISPR gRNA sequence
attatactagtatttgtata

SEQ ID NO: 642988 - DNA, 20 bp, Artificial
  CRISPR gRNA sequence
ttatactagtatttgtatac

SEQ ID NO: 642989 - DNA, 20 bp, Artificial
  CRISPR gRNA sequence
tactagtatttgtatacatg

SEQ ID NO: 642990 - DNA, 20 bp, Artificial
  CRISPR gRNA sequence
gtatttgtatacatgcacat

SEQ ID NO: 642991 - DNA, 20 bp, Artificial
  CRISPR gRNA sequence
gtatacatgcacatactatt

SEQ ID NO: 642992 - DNA, 20 bp, Artificial
  CRISPR gRNA sequence
tatacatgcacatactattt

SEQ ID NO: 642993 - DNA, 20 bp, Artificial
  CRISPR gRNA sequence
tttttgagacagggtctcac

SEQ ID NO: 642994 - DNA, 20 bp, Artificial
  CRISPR gRNA sequence
ttgagacagggtctcactct

SEQ ID NO: 642995 - DNA, 20 bp, Artificial
  CRISPR gRNA sequence
tgagacagggtctcactctg

SEQ ID NO: 642996 - DNA, 20 bp, Artificial
  CRISPR gRNA sequence
gagacagggtctcactctgt

SEQ ID NO: 642997 - DNA, 20 bp, Artificial
  CRISPR gRNA sequence
agacagggtctcactctgtt

SEQ ID NO: 642998 - DNA, 20 bp, Artificial
  CRISPR gRNA sequence
actctgttgcccaggctgga

SEQ ID NO: 642999 - DNA, 20 bp, Artificial
  CRISPR gRNA sequence
tgttgcccaggctggagtgc

SEQ ID NO: 643000 - DNA, 20 bp, Artificial
  CRISPR gRNA sequence
ttgcccaggctggagtgcag

SEQ ID NO: 643001 - DNA, 20 bp, Artificial
  CRISPR gRNA sequence
cccaggctggagtgcagtag

SEQ ID NO: 643002 - DNA, 20 bp, Artificial
  CRISPR gRNA sequence
gagtgcagtagcacaatcaa

SEQ ID NO: 643003 - DNA, 20 bp, Artificial
  CRISPR gRNA sequence
actgcagcatcgacttcctg

SEQ ID NO: 643004 - DNA, 20 bp, Artificial
  CRISPR gRNA sequence
cagcatcgacttcctgggct

SEQ ID NO: 643005 - DNA, 20 bp, Artificial
  CRISPR gRNA sequence
cctgggcttaagtgatcttc

SEQ ID NO: 643006 - DNA, 20 bp, Artificial
  CRISPR gRNA sequence
ctgggcttaagtgatcttcc

SEQ ID NO: 643007 - DNA, 20 bp, Artificial
  CRISPR gRNA sequence
ggcttaagtgatcttccctc

SEQ ID NO: 643008 - DNA, 20 bp, Artificial
  CRISPR gRNA sequence
aagtgatcttccctcctcag

SEQ ID NO: 643009 - DNA, 20 bp, Artificial
  CRISPR gRNA sequence
agtgatcttccctcctcagt

SEQ ID NO: 643010 - DNA, 20 bp, Artificial
  CRISPR gRNA sequence
ccctcctcagtctcctgagt

SEQ ID NO: 643011 - DNA, 20 bp, Artificial
  CRISPR gRNA sequence
cctcctcagtctcctgagtc

SEQ ID NO: 643012 - DNA, 20 bp, Artificial
  CRISPR gRNA sequence
ctcagtctcctgagtcgctg

SEQ ID NO: 643013 - DNA, 20 bp, Artificial
  CRISPR gRNA sequence
agtctcctgagtcgctggaa

SEQ ID NO: 643014 - DNA, 20 bp, Artificial
  CRISPR gRNA sequence
ctgagtcgctggaaccacat

SEQ ID NO: 643015 - DNA, 20 bp, Artificial
  CRISPR gRNA sequence
agtcgctggaaccacatatg

SEQ ID NO: 643016 - DNA, 20 bp, Artificial
  CRISPR gRNA sequence
gaaccacatatgcacaccac

SEQ ID NO: 643017 - DNA, 20 bp, Artificial
  CRISPR gRNA sequence
gctaatttaaaataattatt

SEQ ID NO: 643018 - DNA, 20 bp, Artificial
  CRISPR gRNA sequence
atttaaaataattattttgt

SEQ ID NO: 643019 - DNA, 20 bp, Artificial
  CRISPR gRNA sequence
aaaataattattttgtagag

SEQ ID NO: 643020 - DNA, 20 bp, Artificial
  CRISPR gRNA sequence
aaataattattttgtagaga

SEQ ID NO: 643021 - DNA, 20 bp, Artificial
  CRISPR gRNA sequence
ttttgtagagatgagatctc

SEQ ID NO: 643022 - DNA, 20 bp, Artificial
  CRISPR gRNA sequence
tgtagagatgagatctccct

SEQ ID NO: 643023 - DNA, 20 bp, Artificial
  CRISPR gRNA sequence
gtagagatgagatctcccta

SEQ ID NO: 643024 - DNA, 20 bp, Artificial
  CRISPR gRNA sequence
tagagatgagatctccctat

SEQ ID NO: 643025 - DNA, 20 bp, Artificial
  CRISPR gRNA sequence
cctatgttgcccagactagt

SEQ ID NO: 643026 - DNA, 20 bp, Artificial
  CRISPR gRNA sequence
tgttgcccagactagttttg

SEQ ID NO: 643027 - DNA, 20 bp, Artificial
  CRISPR gRNA sequence
cccagactagttttgaactt

SEQ ID NO: 643028 - DNA, 20 bp, Artificial
  CRISPR gRNA sequence
gttttgaactttgagactaa

SEQ ID NO: 643029 - DNA, 20 bp, Artificial
  CRISPR gRNA sequence
tgaactttgagactaaagca

SEQ ID NO: 643030 - DNA, 20 bp, Artificial
  CRISPR gRNA sequence
gaactttgagactaaagcag

SEQ ID NO: 643031 - DNA, 20 bp, Artificial
  CRISPR gRNA sequence
aactttgagactaaagcagt

SEQ ID NO: 643032 - DNA, 20 bp, Artificial
  CRISPR gRNA sequence
tgagactaaagcagttctcc

SEQ ID NO: 643033 - DNA, 20 bp, Artificial
  CRISPR gRNA sequence
gagactaaagcagttctcct

SEQ ID NO: 643034 - DNA, 20 bp, Artificial
  CRISPR gRNA sequence
agactaaagcagttctcctg

SEQ ID NO: 643035 - DNA, 20 bp, Artificial
  CRISPR gRNA sequence
aagcagttctcctgccttgg

SEQ ID NO: 643036 - DNA, 20 bp, Artificial
  CRISPR gRNA sequence
tcctgccttggcctcccaaa

SEQ ID NO: 643037 - DNA, 20 bp, Artificial
  CRISPR gRNA sequence
ctgccttggcctcccaaaat

SEQ ID NO: 643038 - DNA, 20 bp, Artificial
  CRISPR gRNA sequence
ccttggcctcccaaaatgct

SEQ ID NO: 643039 - DNA, 20 bp, Artificial
  CRISPR gRNA sequence
ggcctcccaaaatgctgaga

SEQ ID NO: 643040 - DNA, 20 bp, Artificial
  CRISPR gRNA sequence
gcctcccaaaatgctgagat

SEQ ID NO: 643041 - DNA, 20 bp, Artificial
  CRISPR gRNA sequence
ccaaaatgctgagattacag

SEQ ID NO: 643042 - DNA, 20 bp, Artificial
  CRISPR gRNA sequence
agattacagtgtgagccact

SEQ ID NO: 643043 - DNA, 20 bp, Artificial
  CRISPR gRNA sequence
cagtgtgagccactgtgcct

SEQ ID NO: 643044 - DNA, 20 bp, Artificial
  CRISPR gRNA sequence
tgcctggcctataagctatc

SEQ ID NO: 643045 - DNA, 20 bp, Artificial
  CRISPR gRNA sequence
gcctataagctatcttttat

SEQ ID NO: 643046 - DNA, 20 bp, Artificial
  CRISPR gRNA sequence
taagctatcttttataaact

SEQ ID NO: 643047 - DNA, 20 bp, Artificial
  CRISPR gRNA sequence
tcttttataaactgtaacca

SEQ ID NO: 643048 - DNA, 20 bp, Artificial
  CRISPR gRNA sequence
ttataaactgtaaccataat

SEQ ID NO: 643049 - DNA, 20 bp, Artificial
  CRISPR gRNA sequence
tataaactgtaaccataata

SEQ ID NO: 643050 - DNA, 20 bp, Artificial
  CRISPR gRNA sequence
ataaactgtaaccataataa

SEQ ID NO: 643051 - DNA, 20 bp, Artificial
  CRISPR gRNA sequence
taaactgtaaccataataac

SEQ ID NO: 643052 - DNA, 20 bp, Artificial
  CRISPR gRNA sequence
taaccataataacctcctct

SEQ ID NO: 643053 - DNA, 20 bp, Artificial
  CRISPR gRNA sequence
ctctaccatttcaatgtaca

SEQ ID NO: 643054 - DNA, 20 bp, Artificial
  CRISPR gRNA sequence
taccatttcaatgtacagtt

SEQ ID NO: 643055 - DNA, 20 bp, Artificial
  CRISPR gRNA sequence
ccatttcaatgtacagttat

SEQ ID NO: 643056 - DNA, 20 bp, Artificial
  CRISPR gRNA sequence
caatgtacagttatggtcat

SEQ ID NO: 643057 - DNA, 20 bp, Artificial
  CRISPR gRNA sequence
aatgtacagttatggtcata

SEQ ID NO: 643058 - DNA, 20 bp, Artificial
  CRISPR gRNA sequence
tggtcatatttaaattttta

SEQ ID NO: 643059 - DNA, 20 bp, Artificial
  CRISPR gRNA sequence
aaatttttacttcaaatata

SEQ ID NO: 643060 - DNA, 20 bp, Artificial
  CRISPR gRNA sequence
aatttttacttcaaatatag

SEQ ID NO: 643061 - DNA, 20 bp, Artificial
  CRISPR gRNA sequence
ttacttcaaatatagctggc

SEQ ID NO: 643062 - DNA, 20 bp, Artificial
  CRISPR gRNA sequence
tacttcaaatatagctggct

SEQ ID NO: 643063 - DNA, 20 bp, Artificial
  CRISPR gRNA sequence
acttcaaatatagctggcta

SEQ ID NO: 643064 - DNA, 20 bp, Artificial
  CRISPR gRNA sequence
cttcaaatatagctggctag

SEQ ID NO: 643065 - DNA, 20 bp, Artificial
  CRISPR gRNA sequence
caaatatagctggctagagt

SEQ ID NO: 643066 - DNA, 20 bp, Artificial
  CRISPR gRNA sequence
aaatatagctggctagagtt

SEQ ID NO: 643067 - DNA, 20 bp, Artificial
  CRISPR gRNA sequence
gctagagttctcacttgccc

SEQ ID NO: 643068 - DNA, 20 bp, Artificial
  CRISPR gRNA sequence
gagttctcacttgccccaga

SEQ ID NO: 643069 - DNA, 20 bp, Artificial
  CRISPR gRNA sequence
tcacttgccccagaacttca

SEQ ID NO: 643070 - DNA, 20 bp, Artificial
  CRISPR gRNA sequence
acttgccccagaacttcagt

SEQ ID NO: 643071 - DNA, 20 bp, Artificial
  CRISPR gRNA sequence
gccccagaacttcagtctac

SEQ ID NO: 643072 - DNA, 20 bp, Artificial
  CRISPR gRNA sequence
ccccagaacttcagtctaca

SEQ ID NO: 643073 - DNA, 20 bp, Artificial
  CRISPR gRNA sequence
cagtctacataccatgccac

SEQ ID NO: 643074 - DNA, 20 bp, Artificial
  CRISPR gRNA sequence
agtctacataccatgccacg

SEQ ID NO: 643075 - DNA, 20 bp, Artificial
  CRISPR gRNA sequence
cataccatgccacgcagaga

SEQ ID NO: 643076 - DNA, 20 bp, Artificial
  CRISPR gRNA sequence
gtaaaccataattaatctgc

SEQ ID NO: 643077 - DNA, 20 bp, Artificial
  CRISPR gRNA sequence
atctgctattcacaaggcta

SEQ ID NO: 643078 - DNA, 20 bp, Artificial
  CRISPR gRNA sequence
ctattcacaaggctactggt

SEQ ID NO: 643079 - DNA, 20 bp, Artificial
  CRISPR gRNA sequence
ttcacaaggctactggtctt

SEQ ID NO: 643080 - DNA, 20 bp, Artificial
  CRISPR gRNA sequence
acaaggctactggtctttta

SEQ ID NO: 643081 - DNA, 20 bp, Artificial
  CRISPR gRNA sequence
ctggtcttttatcacccaac

SEQ ID NO: 643082 - DNA, 20 bp, Artificial
  CRISPR gRNA sequence
gtcttttatcacccaacaat

SEQ ID NO: 643083 - DNA, 20 bp, Artificial
  CRISPR gRNA sequence
ttatcacccaacaatgttag

SEQ ID NO: 643084 - DNA, 20 bp, Artificial
  CRISPR gRNA sequence
tatcacccaacaatgttagt

SEQ ID NO: 643085 - DNA, 20 bp, Artificial
  CRISPR gRNA sequence
atcacccaacaatgttagtc

SEQ ID NO: 643086 - DNA, 20 bp, Artificial
  CRISPR gRNA sequence
tcacccaacaatgttagtcc

SEQ ID NO: 643087 - DNA, 20 bp, Artificial
  CRISPR gRNA sequence
gtcccccctgtgatggtacc

SEQ ID NO: 643088 - DNA, 20 bp, Artificial
  CRISPR gRNA sequence
tgatggtaccatcccaccgc

SEQ ID NO: 643089 - DNA, 20 bp, Artificial
  CRISPR gRNA sequence
ttcgagccacagtgatgatc

SEQ ID NO: 643090 - DNA, 20 bp, Artificial
  CRISPR gRNA sequence
gagccacagtgatgatcctg

SEQ ID NO: 643091 - DNA, 20 bp, Artificial
  CRISPR gRNA sequence
tttcctttggtgcccagctc

SEQ ID NO: 643092 - DNA, 20 bp, Artificial
  CRISPR gRNA sequence
cctttggtgcccagctcagt

SEQ ID NO: 643093 - DNA, 20 bp, Artificial
  CRISPR gRNA sequence
ctttggtgcccagctcagtc

SEQ ID NO: 643094 - DNA, 20 bp, Artificial
  CRISPR gRNA sequence
tggtgcccagctcagtcaag

SEQ ID NO: 643095 - DNA, 20 bp, Artificial
  CRISPR gRNA sequence
ggtgcccagctcagtcaagg

SEQ ID NO: 643096 - DNA, 20 bp, Artificial
  CRISPR gRNA sequence
gtgcccagctcagtcaaggg

SEQ ID NO: 643097 - DNA, 20 bp, Artificial
  CRISPR gRNA sequence
agtcaagggtgctctacttc

SEQ ID NO: 643098 - DNA, 20 bp, Artificial
  CRISPR gRNA sequence
tacttctgtgtttgcaacta

SEQ ID NO: 643099 - DNA, 20 bp, Artificial
  CRISPR gRNA sequence
cttctgtgtttgcaactacc

SEQ ID NO: 643100 - DNA, 20 bp, Artificial
  CRISPR gRNA sequence
ctgtgtttgcaactaccatt

SEQ ID NO: 643101 - DNA, 20 bp, Artificial
  CRISPR gRNA sequence
tgtgtttgcaactaccatta

SEQ ID NO: 643102 - DNA, 20 bp, Artificial
  CRISPR gRNA sequence
tgtttgcaactaccattacc

SEQ ID NO: 643103 - DNA, 20 bp, Artificial
  CRISPR gRNA sequence
gcaactaccattaccagctg

SEQ ID NO: 643104 - DNA, 20 bp, Artificial
  CRISPR gRNA sequence
caactaccattaccagctgt

SEQ ID NO: 643105 - DNA, 20 bp, Artificial
  CRISPR gRNA sequence
ccattaccagctgttcttcc

SEQ ID NO: 643106 - DNA, 20 bp, Artificial
  CRISPR gRNA sequence
ccagctgttcttccctaagg

SEQ ID NO: 643107 - DNA, 20 bp, Artificial
  CRISPR gRNA sequence
ttcttccctaaggtactaac

SEQ ID NO: 643108 - DNA, 20 bp, Artificial
  CRISPR gRNA sequence
ttccctaaggtactaactac

SEQ ID NO: 643109 - DNA, 20 bp, Artificial
  CRISPR gRNA sequence
ccctaaggtactaactacac

SEQ ID NO: 643110 - DNA, 20 bp, Artificial
  CRISPR gRNA sequence
cctaaggtactaactacact

SEQ ID NO: 643111 - DNA, 20 bp, Artificial
  CRISPR gRNA sequence
aggtactaactacactgatg

SEQ ID NO: 643112 - DNA, 20 bp, Artificial
  CRISPR gRNA sequence
actacactgatgacagcata

SEQ ID NO: 643113 - DNA, 20 bp, Artificial
  CRISPR gRNA sequence
cactgatgacagcatataca

SEQ ID NO: 643114 - DNA, 20 bp, Artificial
  CRISPR gRNA sequence
atgacagcatatacaaaatt

SEQ ID NO: 643115 - DNA, 20 bp, Artificial
  CRISPR gRNA sequence
tctatcatcagccccatgag

SEQ ID NO: 643116 - DNA, 20 bp, Artificial
  CRISPR gRNA sequence
ctatcatcagccccatgagt

SEQ ID NO: 643117 - DNA, 20 bp, Artificial
  CRISPR gRNA sequence
tatcatcagccccatgagtt

SEQ ID NO: 643118 - DNA, 20 bp, Artificial
  CRISPR gRNA sequence
tcatcagccccatgagttca

SEQ ID NO: 643119 - DNA, 20 bp, Artificial
  CRISPR gRNA sequence
aaaagggtttctcttgaatg

SEQ ID NO: 643120 - DNA, 20 bp, Artificial
  CRISPR gRNA sequence
ctcttgaatgttggttgcca

SEQ ID NO: 643121 - DNA, 20 bp, Artificial
  CRISPR gRNA sequence
tcttgaatgttggttgccag

SEQ ID NO: 643122 - DNA, 20 bp, Artificial
  CRISPR gRNA sequence
ttgaatgttggttgccaggt

SEQ ID NO: 643123 - DNA, 20 bp, Artificial
  CRISPR gRNA sequence
gaatgttggttgccaggtgg

SEQ ID NO: 643124 - DNA, 20 bp, Artificial
  CRISPR gRNA sequence
aatgttggttgccaggtggg

SEQ ID NO: 643125 - DNA, 20 bp, Artificial
  CRISPR gRNA sequence
gttgccaggtggggtacccc

SEQ ID NO: 643126 - DNA, 20 bp, Artificial
  CRISPR gRNA sequence
ccaggtggggtacccctttc

SEQ ID NO: 643127 - DNA, 20 bp, Artificial
  CRISPR gRNA sequence
tctgtcctcaatgtaacttc

SEQ ID NO: 643128 - DNA, 20 bp, Artificial
  CRISPR gRNA sequence
ctgtcctcaatgtaacttca

SEQ ID NO: 643129 - DNA, 20 bp, Artificial
  CRISPR gRNA sequence
tgtcctcaatgtaacttcat

SEQ ID NO: 643130 - DNA, 20 bp, Artificial
  CRISPR gRNA sequence
tcctcaatgtaacttcattt

SEQ ID NO: 643131 - DNA, 20 bp, Artificial
  CRISPR gRNA sequence
aatgtaacttcatttcagga

SEQ ID NO: 643132 - DNA, 20 bp, Artificial
  CRISPR gRNA sequence
catttcaggaatctcattgc

SEQ ID NO: 643133 - DNA, 20 bp, Artificial
  CRISPR gRNA sequence
atttcaggaatctcattgcc

SEQ ID NO: 643134 - DNA, 20 bp, Artificial
  CRISPR gRNA sequence
caggaatctcattgcccttt

SEQ ID NO: 643135 - DNA, 20 bp, Artificial
  CRISPR gRNA sequence
aggaatctcattgccctttc

SEQ ID NO: 643136 - DNA, 20 bp, Artificial
  CRISPR gRNA sequence
attgccctttccagagactg

SEQ ID NO: 643137 - DNA, 20 bp, Artificial
  CRISPR gRNA sequence
ccctttccagagactgggat

SEQ ID NO: 643138 - DNA, 20 bp, Artificial
  CRISPR gRNA sequence
tccagagactgggattgagt

SEQ ID NO: 643139 - DNA, 20 bp, Artificial
  CRISPR gRNA sequence
ccagagactgggattgagtc

SEQ ID NO: 643140 - DNA, 20 bp, Artificial
  CRISPR gRNA sequence
cagagactgggattgagtca

SEQ ID NO: 643141 - DNA, 20 bp, Artificial
  CRISPR gRNA sequence
ggattgagtcagtgccacac

SEQ ID NO: 643142 - DNA, 20 bp, Artificial
  CRISPR gRNA sequence
agtcagtgccacacagctct

SEQ ID NO: 643143 - DNA, 20 bp, Artificial
  CRISPR gRNA sequence
tatgtcagcagagactaggt

SEQ ID NO: 643144 - DNA, 20 bp, Artificial
  CRISPR gRNA sequence
tgtcagcagagactaggtat

SEQ ID NO: 643145 - DNA, 20 bp, Artificial
  CRISPR gRNA sequence
ggtattagttctttctctcc

SEQ ID NO: 643146 - DNA, 20 bp, Artificial
  CRISPR gRNA sequence
gttctttctctcccagaagg

SEQ ID NO: 643147 - DNA, 20 bp, Artificial
  CRISPR gRNA sequence
tttctctcccagaaggcgct

SEQ ID NO: 643148 - DNA, 20 bp, Artificial
  CRISPR gRNA sequence
tctctcccagaaggcgctgg

SEQ ID NO: 643149 - DNA, 20 bp, Artificial
  CRISPR gRNA sequence
ctctcccagaaggcgctgga

SEQ ID NO: 643150 - DNA, 20 bp, Artificial
  CRISPR gRNA sequence
tctcccagaaggcgctggac

SEQ ID NO: 643151 - DNA, 20 bp, Artificial
  CRISPR gRNA sequence
tcccagaaggcgctggacat

SEQ ID NO: 643152 - DNA, 20 bp, Artificial
  CRISPR gRNA sequence
ccagaaggcgctggacatct

SEQ ID NO: 643153 - DNA, 20 bp, Artificial
  CRISPR gRNA sequence
gacatcttgtgtaaactgat

SEQ ID NO: 643154 - DNA, 20 bp, Artificial
  CRISPR gRNA sequence
gtgtaaactgatctcctccc

SEQ ID NO: 643155 - DNA, 20 bp, Artificial
  CRISPR gRNA sequence
tgtaaactgatctcctcccc

SEQ ID NO: 643156 - DNA, 20 bp, Artificial
  CRISPR gRNA sequence
atctcctccccaggaaccag

SEQ ID NO: 643157 - DNA, 20 bp, Artificial
  CRISPR gRNA sequence
ctccccaggaaccagcttta

SEQ ID NO: 643158 - DNA, 20 bp, Artificial
  CRISPR gRNA sequence
cccaggaaccagctttacag

SEQ ID NO: 643159 - DNA, 20 bp, Artificial
  CRISPR gRNA sequence
tacagagcagaatacaagtg

SEQ ID NO: 643160 - DNA, 20 bp, Artificial
  CRISPR gRNA sequence
acagagcagaatacaagtgc

SEQ ID NO: 643161 - DNA, 20 bp, Artificial
  CRISPR gRNA sequence
cagagcagaatacaagtgca

SEQ ID NO: 643162 - DNA, 20 bp, Artificial
  CRISPR gRNA sequence
tcagggagtggcagacttct

SEQ ID NO: 643163 - DNA, 20 bp, Artificial
  CRISPR gRNA sequence
agggagtggcagacttctat

SEQ ID NO: 643164 - DNA, 20 bp, Artificial
  CRISPR gRNA sequence
ctattaatgaagtcagaaag

SEQ ID NO: 643165 - DNA, 20 bp, Artificial
  CRISPR gRNA sequence
tattaatgaagtcagaaagt

SEQ ID NO: 643166 - DNA, 20 bp, Artificial
  CRISPR gRNA sequence
ttaatgaagtcagaaagttt

SEQ ID NO: 643167 - DNA, 20 bp, Artificial
  CRISPR gRNA sequence
atgaagtcagaaagttttct

SEQ ID NO: 643168 - DNA, 20 bp, Artificial
  CRISPR gRNA sequence
tctgctctatgacaatgatt

SEQ ID NO: 643169 - DNA, 20 bp, Artificial
  CRISPR gRNA sequence
ctgctctatgacaatgattg

SEQ ID NO: 643170 - DNA, 20 bp, Artificial
  CRISPR gRNA sequence
tgctctatgacaatgattgt

SEQ ID NO: 643171 - DNA, 20 bp, Artificial
  CRISPR gRNA sequence
ctctatgacaatgattgtgt

SEQ ID NO: 643172 - DNA, 20 bp, Artificial
  CRISPR gRNA sequence
tatgacaatgattgtgtacc

SEQ ID NO: 643173 - DNA, 20 bp, Artificial
  CRISPR gRNA sequence
tgacaatgattgtgtacctg

SEQ ID NO: 643174 - DNA, 20 bp, Artificial
  CRISPR gRNA sequence
tgtacctgctctatatttgc

SEQ ID NO: 643175 - DNA, 20 bp, Artificial
  CRISPR gRNA sequence
ctctatatttgctaaactaa

SEQ ID NO: 643176 - DNA, 20 bp, Artificial
  CRISPR gRNA sequence
tatatttgctaaactaagaa

SEQ ID NO: 643177 - DNA, 20 bp, Artificial
  CRISPR gRNA sequence
tatttgctaaactaagaaag

SEQ ID NO: 643178 - DNA, 20 bp, Artificial
  CRISPR gRNA sequence
gctaaactaagaaagttatt

SEQ ID NO: 643179 - DNA, 20 bp, Artificial
  CRISPR gRNA sequence
ctaaactaagaaagttattc

SEQ ID NO: 643180 - DNA, 20 bp, Artificial
  CRISPR gRNA sequence
aactaagaaagttattcaag

SEQ ID NO: 643181 - DNA, 20 bp, Artificial
  CRISPR gRNA sequence
agaaagttattcaagtaata

SEQ ID NO: 643182 - DNA, 20 bp, Artificial
  CRISPR gRNA sequence
ttcaagtaatacagaagata

SEQ ID NO: 643183 - DNA, 20 bp, Artificial
  CRISPR gRNA sequence
aagtaatacagaagataagc

SEQ ID NO: 643184 - DNA, 20 bp, Artificial
  CRISPR gRNA sequence
ctagatttaaatatctgctc

SEQ ID NO: 643185 - DNA, 20 bp, Artificial
  CRISPR gRNA sequence
tagatttaaatatctgctct

SEQ ID NO: 643186 - DNA, 20 bp, Artificial
  CRISPR gRNA sequence
gatttaaatatctgctcttc

SEQ ID NO: 643187 - DNA, 20 bp, Artificial
  CRISPR gRNA sequence
aaatatctgctcttctcccc

SEQ ID NO: 643188 - DNA, 20 bp, Artificial
  CRISPR gRNA sequence
aatatctgctcttctcccca

SEQ ID NO: 643189 - DNA, 20 bp, Artificial
  CRISPR gRNA sequence
ctcttctccccacccaacac

SEQ ID NO: 643190 - DNA, 20 bp, Artificial
  CRISPR gRNA sequence
ttctccccacccaacaccta

SEQ ID NO: 643191 - DNA, 20 bp, Artificial
  CRISPR gRNA sequence
ctccccacccaacacctaaa

SEQ ID NO: 643192 - DNA, 20 bp, Artificial
  CRISPR gRNA sequence
tccccacccaacacctaaaa

SEQ ID NO: 643193 - DNA, 20 bp, Artificial
  CRISPR gRNA sequence
cccacccaacacctaaaaaa

SEQ ID NO: 643194 - DNA, 20 bp, Artificial
  CRISPR gRNA sequence
aaaaaatcataaatcaaatt

SEQ ID NO: 643195 - DNA, 20 bp, Artificial
  CRISPR gRNA sequence
taccaagtcagtgttcaaca

SEQ ID NO: 643196 - DNA, 20 bp, Artificial
  CRISPR gRNA sequence
ccaagtcagtgttcaacact

SEQ ID NO: 643197 - DNA, 20 bp, Artificial
  CRISPR gRNA sequence
aacactatttcaatagttgt

SEQ ID NO: 643198 - DNA, 20 bp, Artificial
  CRISPR gRNA sequence
tttcaatagttgtttgttgc

SEQ ID NO: 643199 - DNA, 20 bp, Artificial
  CRISPR gRNA sequence
caatagttgtttgttgcttt

SEQ ID NO: 643200 - DNA, 20 bp, Artificial
  CRISPR gRNA sequence
aatagttgtttgttgctttt

SEQ ID NO: 643201 - DNA, 20 bp, Artificial
  CRISPR gRNA sequence
tttgttgcttttaggataaa

SEQ ID NO: 643202 - DNA, 20 bp, Artificial
  CRISPR gRNA sequence
gttgcttttaggataaaaat

SEQ ID NO: 643203 - DNA, 20 bp, Artificial
  CRISPR gRNA sequence
ttgcttttaggataaaaatc

SEQ ID NO: 643204 - DNA, 20 bp, Artificial
  CRISPR gRNA sequence
cttttaggataaaaatccaa

SEQ ID NO: 643205 - DNA, 20 bp, Artificial
  CRISPR gRNA sequence
ttaggataaaaatccaaaat

SEQ ID NO: 643206 - DNA, 20 bp, Artificial
  CRISPR gRNA sequence
taggataaaaatccaaaatt

SEQ ID NO: 643207 - DNA, 20 bp, Artificial
  CRISPR gRNA sequence
aggataaaaatccaaaattc

SEQ ID NO: 643208 - DNA, 20 bp, Artificial
  CRISPR gRNA sequence
ggataaaaatccaaaattct

SEQ ID NO: 643209 - DNA, 20 bp, Artificial
  CRISPR gRNA sequence
ttccccaaatcctcaaaaaa

SEQ ID NO: 643210 - DNA, 20 bp, Artificial
  CRISPR gRNA sequence
ccccaaatcctcaaaaaaat

SEQ ID NO: 643211 - DNA, 20 bp, Artificial
  CRISPR gRNA sequence
cccaaatcctcaaaaaaata

SEQ ID NO: 643212 - DNA, 20 bp, Artificial
  CRISPR gRNA sequence
aaaaaaataaagtatattac

SEQ ID NO: 643213 - DNA, 20 bp, Artificial
  CRISPR gRNA sequence
catggctccttctcacctct

SEQ ID NO: 643214 - DNA, 20 bp, Artificial
  CRISPR gRNA sequence
cttctcacctctccagatac

SEQ ID NO: 643215 - DNA, 20 bp, Artificial
  CRISPR gRNA sequence
ctcacctctccagatacatc

SEQ ID NO: 643216 - DNA, 20 bp, Artificial
  CRISPR gRNA sequence
tcacctctccagatacatca

SEQ ID NO: 643217 - DNA, 20 bp, Artificial
  CRISPR gRNA sequence
acctctccagatacatcatg

SEQ ID NO: 643218 - DNA, 20 bp, Artificial
  CRISPR gRNA sequence
tccagatacatcatgagcca

SEQ ID NO: 643219 - DNA, 20 bp, Artificial
  CRISPR gRNA sequence
cagatacatcatgagccact

SEQ ID NO: 643220 - DNA, 20 bp, Artificial
  CRISPR gRNA sequence
catctccctccatagcaggc

SEQ ID NO: 643221 - DNA, 20 bp, Artificial
  CRISPR gRNA sequence
cctccatagcaggctcacag

SEQ ID NO: 643222 - DNA, 20 bp, Artificial
  CRISPR gRNA sequence
catagcaggctcacaggcct

SEQ ID NO: 643223 - DNA, 20 bp, Artificial
  CRISPR gRNA sequence
acaggccttctttcagttct

SEQ ID NO: 643224 - DNA, 20 bp, Artificial
  CRISPR gRNA sequence
ctttcagttctttggtgaac

SEQ ID NO: 643225 - DNA, 20 bp, Artificial
  CRISPR gRNA sequence
tttcagttctttggtgaaca

SEQ ID NO: 643226 - DNA, 20 bp, Artificial
  CRISPR gRNA sequence
tcagttctttggtgaacata

SEQ ID NO: 643227 - DNA, 20 bp, Artificial
  CRISPR gRNA sequence
cagttctttggtgaacatat

SEQ ID NO: 643228 - DNA, 20 bp, Artificial
  CRISPR gRNA sequence
agttctttggtgaacatatt

SEQ ID NO: 643229 - DNA, 20 bp, Artificial
  CRISPR gRNA sequence
tttggtgaacatattataaa

SEQ ID NO: 643230 - DNA, 20 bp, Artificial
  CRISPR gRNA sequence
tggtgaacatattataaaag

SEQ ID NO: 643231 - DNA, 20 bp, Artificial
  CRISPR gRNA sequence
ggtgaacatattataaaagc

SEQ ID NO: 643232 - DNA, 20 bp, Artificial
  CRISPR gRNA sequence
gtgaacatattataaaagcc

SEQ ID NO: 643233 - DNA, 20 bp, Artificial
  CRISPR gRNA sequence
taaaagccaactttttcctg

SEQ ID NO: 643234 - DNA, 20 bp, Artificial
  CRISPR gRNA sequence
tttcctgctgcggggccttt

SEQ ID NO: 643235 - DNA, 20 bp, Artificial
  CRISPR gRNA sequence
ttcctgctgcggggcctttg

SEQ ID NO: 643236 - DNA, 20 bp, Artificial
  CRISPR gRNA sequence
tcctgctgcggggcctttgc

SEQ ID NO: 643237 - DNA, 20 bp, Artificial
  CRISPR gRNA sequence
cctgctgcggggcctttgca

SEQ ID NO: 643238 - DNA, 20 bp, Artificial
  CRISPR gRNA sequence
ctgctgcggggcctttgcac

SEQ ID NO: 643239 - DNA, 20 bp, Artificial
  CRISPR gRNA sequence
ctgcggggcctttgcacata

SEQ ID NO: 643240 - DNA, 20 bp, Artificial
  CRISPR gRNA sequence
cggggcctttgcacatatac

SEQ ID NO: 643241 - DNA, 20 bp, Artificial
  CRISPR gRNA sequence
tgcacatatacaatggtctc

SEQ ID NO: 643242 - DNA, 20 bp, Artificial
  CRISPR gRNA sequence
gcacatatacaatggtctct

SEQ ID NO: 643243 - DNA, 20 bp, Artificial
  CRISPR gRNA sequence
cacatatacaatggtctctc

SEQ ID NO: 643244 - DNA, 20 bp, Artificial
  CRISPR gRNA sequence
tcatactctactgctatctg

SEQ ID NO: 643245 - DNA, 20 bp, Artificial
  CRISPR gRNA sequence
atactctactgctatctgag

SEQ ID NO: 643246 - DNA, 20 bp, Artificial
  CRISPR gRNA sequence
tactgctatctgagtggccc

SEQ ID NO: 643247 - DNA, 20 bp, Artificial
  CRISPR gRNA sequence
ctgctatctgagtggccccc

SEQ ID NO: 643248 - DNA, 20 bp, Artificial
  CRISPR gRNA sequence
ctatctgagtggcccccact

SEQ ID NO: 643249 - DNA, 20 bp, Artificial
  CRISPR gRNA sequence
tctgagtggcccccactcct

SEQ ID NO: 643250 - DNA, 20 bp, Artificial
  CRISPR gRNA sequence
agtggcccccactccttacc

SEQ ID NO: 643251 - DNA, 20 bp, Artificial
  CRISPR gRNA sequence
cttacctcctctatagttta

SEQ ID NO: 643252 - DNA, 20 bp, Artificial
  CRISPR gRNA sequence
acctcctctatagtttaaat

SEQ ID NO: 643253 - DNA, 20 bp, Artificial
  CRISPR gRNA sequence
cctcctctatagtttaaatt

SEQ ID NO: 643254 - DNA, 20 bp, Artificial
  CRISPR gRNA sequence
ctctatagtttaaatttcac

SEQ ID NO: 643255 - DNA, 20 bp, Artificial
  CRISPR gRNA sequence
tatagtttaaatttcactta

SEQ ID NO: 643256 - DNA, 20 bp, Artificial
  CRISPR gRNA sequence
tagtttaaatttcacttact

SEQ ID NO: 643257 - DNA, 20 bp, Artificial
  CRISPR gRNA sequence
aaatttcacttactctaaat

SEQ ID NO: 643258 - DNA, 20 bp, Artificial
  CRISPR gRNA sequence
aatttcacttactctaaatc

SEQ ID NO: 643259 - DNA, 20 bp, Artificial
  CRISPR gRNA sequence
cacttactctaaatcgtcaa

SEQ ID NO: 643260 - DNA, 20 bp, Artificial
  CRISPR gRNA sequence
acttactctaaatcgtcaat

SEQ ID NO: 643261 - DNA, 20 bp, Artificial
  CRISPR gRNA sequence
actctaaatcgtcaatataa

SEQ ID NO: 643262 - DNA, 20 bp, Artificial
  CRISPR gRNA sequence
ctctaaatcgtcaatataaa

SEQ ID NO: 643263 - DNA, 20 bp, Artificial
  CRISPR gRNA sequence
taaatcgtcaatataaacta

SEQ ID NO: 643264 - DNA, 20 bp, Artificial
  CRISPR gRNA sequence
aatcgtcaatataaactaag

SEQ ID NO: 643265 - DNA, 20 bp, Artificial
  CRISPR gRNA sequence
aggacccgatgttcttttta

SEQ ID NO: 643266 - DNA, 20 bp, Artificial
  CRISPR gRNA sequence
tttttaattataatgtccta

SEQ ID NO: 643267 - DNA, 20 bp, Artificial
  CRISPR gRNA sequence
tttaattataatgtcctatt

SEQ ID NO: 643268 - DNA, 20 bp, Artificial
  CRISPR gRNA sequence
ttaattataatgtcctatta

SEQ ID NO: 643269 - DNA, 20 bp, Artificial
  CRISPR gRNA sequence
taattataatgtcctattat

SEQ ID NO: 643270 - DNA, 20 bp, Artificial
  CRISPR gRNA sequence
aattataatgtcctattatt

SEQ ID NO: 643271 - DNA, 20 bp, Artificial
  CRISPR gRNA sequence
attataatgtcctattattt

SEQ ID NO: 643272 - DNA, 20 bp, Artificial
  CRISPR gRNA sequence
taatgtcctattatttttat

SEQ ID NO: 643273 - DNA, 20 bp, Artificial
  CRISPR gRNA sequence
ttatttttattttacagcat

SEQ ID NO: 643274 - DNA, 20 bp, Artificial
  CRISPR gRNA sequence
tttttattttacagcatcta

SEQ ID NO: 643275 - DNA, 20 bp, Artificial
  CRISPR gRNA sequence
ttattttacagcatctaata

SEQ ID NO: 643276 - DNA, 20 bp, Artificial
  CRISPR gRNA sequence
tattttacagcatctaatat

SEQ ID NO: 643277 - DNA, 20 bp, Artificial
  CRISPR gRNA sequence
attttacagcatctaatata

SEQ ID NO: 643278 - DNA, 20 bp, Artificial
  CRISPR gRNA sequence
ttttacagcatctaatataa

SEQ ID NO: 643279 - DNA, 20 bp, Artificial
  CRISPR gRNA sequence
tacagcatctaatataaatt

SEQ ID NO: 643280 - DNA, 20 bp, Artificial
  CRISPR gRNA sequence
acagcatctaatataaatta

SEQ ID NO: 643281 - DNA, 20 bp, Artificial
  CRISPR gRNA sequence
cagcatctaatataaattat

SEQ ID NO: 643282 - DNA, 20 bp, Artificial
  CRISPR gRNA sequence
atataaattattacatactt

SEQ ID NO: 643283 - DNA, 20 bp, Artificial
  CRISPR gRNA sequence
ttacatacttatatatgtgc

SEQ ID NO: 643284 - DNA, 20 bp, Artificial
  CRISPR gRNA sequence
catacttatatatgtgctta

SEQ ID NO: 643285 - DNA, 20 bp, Artificial
  CRISPR gRNA sequence
atatatgtgcttacattttt

SEQ ID NO: 643286 - DNA, 20 bp, Artificial
  CRISPR gRNA sequence
tatatgtgcttacattttta

SEQ ID NO: 643287 - DNA, 20 bp, Artificial
  CRISPR gRNA sequence
acatttttaatgtcttcttt

SEQ ID NO: 643288 - DNA, 20 bp, Artificial
  CRISPR gRNA sequence
catttttaatgtcttctttc

SEQ ID NO: 643289 - DNA, 20 bp, Artificial
  CRISPR gRNA sequence
ttaatgtcttctttcaactg

SEQ ID NO: 643290 - DNA, 20 bp, Artificial
  CRISPR gRNA sequence
taatgtcttctttcaactgt

SEQ ID NO: 643291 - DNA, 20 bp, Artificial
  CRISPR gRNA sequence
aatgtcttctttcaactgta

SEQ ID NO: 643292 - DNA, 20 bp, Artificial
  CRISPR gRNA sequence
atgtcttctttcaactgtaa

SEQ ID NO: 643293 - DNA, 20 bp, Artificial
  CRISPR gRNA sequence
ctttcaactgtaagctctat

SEQ ID NO: 643294 - DNA, 20 bp, Artificial
  CRISPR gRNA sequence
tttcaactgtaagctctata

SEQ ID NO: 643295 - DNA, 20 bp, Artificial
  CRISPR gRNA sequence
tcaactgtaagctctataag

SEQ ID NO: 643296 - DNA, 20 bp, Artificial
  CRISPR gRNA sequence
caactgtaagctctataagg

SEQ ID NO: 643297 - DNA, 20 bp, Artificial
  CRISPR gRNA sequence
aactgtaagctctataagga

SEQ ID NO: 643298 - DNA, 20 bp, Artificial
  CRISPR gRNA sequence
taagctctataaggatagag

SEQ ID NO: 643299 - DNA, 20 bp, Artificial
  CRISPR gRNA sequence
tataaggatagagccttgtc

SEQ ID NO: 643300 - DNA, 20 bp, Artificial
  CRISPR gRNA sequence
taaggatagagccttgtctg

SEQ ID NO: 643301 - DNA, 20 bp, Artificial
  CRISPR gRNA sequence
gtctgttttgttcactgctg

SEQ ID NO: 643302 - DNA, 20 bp, Artificial
  CRISPR gRNA sequence
tctgttttgttcactgctgt

SEQ ID NO: 643303 - DNA, 20 bp, Artificial
  CRISPR gRNA sequence
ttttgttcactgctgtagag

SEQ ID NO: 643304 - DNA, 20 bp, Artificial
  CRISPR gRNA sequence
tgttcactgctgtagagcaa

SEQ ID NO: 643305 - DNA, 20 bp, Artificial
  CRISPR gRNA sequence
gttcactgctgtagagcaag

SEQ ID NO: 643306 - DNA, 20 bp, Artificial
  CRISPR gRNA sequence
ttcactgctgtagagcaagc

SEQ ID NO: 643307 - DNA, 20 bp, Artificial
  CRISPR gRNA sequence
actgctgtagagcaagctta

SEQ ID NO: 643308 - DNA, 20 bp, Artificial
  CRISPR gRNA sequence
ctgtagagcaagcttagtgc

SEQ ID NO: 643309 - DNA, 20 bp, Artificial
  CRISPR gRNA sequence
tagagcaagcttagtgcctg

SEQ ID NO: 643310 - DNA, 20 bp, Artificial
  CRISPR gRNA sequence
agtgcctgacccaaagtaag

SEQ ID NO: 643311 - DNA, 20 bp, Artificial
  CRISPR gRNA sequence
gtgcctgacccaaagtaagc

SEQ ID NO: 643312 - DNA, 20 bp, Artificial
  CRISPR gRNA sequence
acccaaagtaagcctcaaga

SEQ ID NO: 643313 - DNA, 20 bp, Artificial
  CRISPR gRNA sequence
aagaaatattttattagata

SEQ ID NO: 643314 - DNA, 20 bp, Artificial
  CRISPR gRNA sequence
tattagataattgaaggaat

SEQ ID NO: 643315 - DNA, 20 bp, Artificial
  CRISPR gRNA sequence
attagataattgaaggaata

SEQ ID NO: 643316 - DNA, 20 bp, Artificial
  CRISPR gRNA sequence
ttagataattgaaggaataa

SEQ ID NO: 643317 - DNA, 20 bp, Artificial
  CRISPR gRNA sequence
gataattgaaggaataacta

SEQ ID NO: 643318 - DNA, 20 bp, Artificial
  CRISPR gRNA sequence
aaggaataactagaaatacc

SEQ ID NO: 643319 - DNA, 20 bp, Artificial
  CRISPR gRNA sequence
gaaatacccaataacagaac

SEQ ID NO: 643320 - DNA, 20 bp, Artificial
  CRISPR gRNA sequence
gctttattgtcttggaagaa

SEQ ID NO: 643321 - DNA, 20 bp, Artificial
  CRISPR gRNA sequence
tattgtcttggaagaaatct

SEQ ID NO: 643322 - DNA, 20 bp, Artificial
  CRISPR gRNA sequence
attgtcttggaagaaatctt

SEQ ID NO: 643323 - DNA, 20 bp, Artificial
  CRISPR gRNA sequence
ttgtcttggaagaaatcttc

SEQ ID NO: 643324 - DNA, 20 bp, Artificial
  CRISPR gRNA sequence
tcttggaagaaatcttcatt

SEQ ID NO: 643325 - DNA, 20 bp, Artificial
  CRISPR gRNA sequence
ggaagaaatcttcattgtac

SEQ ID NO: 643326 - DNA, 20 bp, Artificial
  CRISPR gRNA sequence
gaagaaatcttcattgtaca

SEQ ID NO: 643327 - DNA, 20 bp, Artificial
  CRISPR gRNA sequence
cattgtacatcgcatgcttt

SEQ ID NO: 643328 - DNA, 20 bp, Artificial
  CRISPR gRNA sequence
attgtacatcgcatgctttg

SEQ ID NO: 643329 - DNA, 20 bp, Artificial
  CRISPR gRNA sequence
tacatcgcatgctttgcaca

SEQ ID NO: 643330 - DNA, 20 bp, Artificial
  CRISPR gRNA sequence
tgcacaaaggtttcctaagt

SEQ ID NO: 643331 - DNA, 20 bp, Artificial
  CRISPR gRNA sequence
gcacaaaggtttcctaagtt

SEQ ID NO: 643332 - DNA, 20 bp, Artificial
  CRISPR gRNA sequence
cacaaaggtttcctaagttg

SEQ ID NO: 643333 - DNA, 20 bp, Artificial
  CRISPR gRNA sequence
cctaagttgggaagaaagat

SEQ ID NO: 643334 - DNA, 20 bp, Artificial
  CRISPR gRNA sequence
ctaagttgggaagaaagatc

SEQ ID NO: 643335 - DNA, 20 bp, Artificial
  CRISPR gRNA sequence
agttgggaagaaagatcaac

SEQ ID NO: 643336 - DNA, 20 bp, Artificial
  CRISPR gRNA sequence
ggaagaaagatcaactacat

SEQ ID NO: 643337 - DNA, 20 bp, Artificial
  CRISPR gRNA sequence
catgaccttgaactttctag

SEQ ID NO: 643338 - DNA, 20 bp, Artificial
  CRISPR gRNA sequence
gaactttctagttcgggaac

SEQ ID NO: 643339 - DNA, 20 bp, Artificial
  CRISPR gRNA sequence
aactttctagttcgggaact

SEQ ID NO: 643340 - DNA, 20 bp, Artificial
  CRISPR gRNA sequence
tctagttcgggaactaatac

SEQ ID NO: 643341 - DNA, 20 bp, Artificial
  CRISPR gRNA sequence
ctagttcgggaactaataca

SEQ ID NO: 643342 - DNA, 20 bp, Artificial
  CRISPR gRNA sequence
tagttcgggaactaatacat

SEQ ID NO: 643343 - DNA, 20 bp, Artificial
  CRISPR gRNA sequence
gttcgggaactaatacatta

SEQ ID NO: 643344 - DNA, 20 bp, Artificial
  CRISPR gRNA sequence
gggaactaatacattataag

SEQ ID NO: 643345 - DNA, 20 bp, Artificial
  CRISPR gRNA sequence
atacattataagacataagc

SEQ ID NO: 643346 - DNA, 20 bp, Artificial
  CRISPR gRNA sequence
taagacataagctgctatgt

SEQ ID NO: 643347 - DNA, 20 bp, Artificial
  CRISPR gRNA sequence
ctatgtggattctaagaaca

SEQ ID NO: 643348 - DNA, 20 bp, Artificial
  CRISPR gRNA sequence
tgtggattctaagaacagaa

SEQ ID NO: 643349 - DNA, 20 bp, Artificial
  CRISPR gRNA sequence
taagaacagaaggtcattct

SEQ ID NO: 643350 - DNA, 20 bp, Artificial
  CRISPR gRNA sequence
agaacagaaggtcattctta

SEQ ID NO: 643351 - DNA, 20 bp, Artificial
  CRISPR gRNA sequence
ttatttgggaagttagtaaa

SEQ ID NO: 643352 - DNA, 20 bp, Artificial
  CRISPR gRNA sequence
atttgggaagttagtaaaag

SEQ ID NO: 643353 - DNA, 20 bp, Artificial
  CRISPR gRNA sequence
tttgggaagttagtaaaagt

SEQ ID NO: 643354 - DNA, 20 bp, Artificial
  CRISPR gRNA sequence
gggaagttagtaaaagtttc

SEQ ID NO: 643355 - DNA, 20 bp, Artificial
  CRISPR gRNA sequence
ggaagttagtaaaagtttca

SEQ ID NO: 643356 - DNA, 20 bp, Artificial
  CRISPR gRNA sequence
gtaaaagtttcaaggaggaa

SEQ ID NO: 643357 - DNA, 20 bp, Artificial
  CRISPR gRNA sequence
caaggaggaattacttgaaa

SEQ ID NO: 643358 - DNA, 20 bp, Artificial
  CRISPR gRNA sequence
aaggaggaattacttgaaat

SEQ ID NO: 643359 - DNA, 20 bp, Artificial
  CRISPR gRNA sequence
cttgaaatataatcgagata

SEQ ID NO: 643360 - DNA, 20 bp, Artificial
  CRISPR gRNA sequence
gaaatataatcgagatataa

SEQ ID NO: 643361 - DNA, 20 bp, Artificial
  CRISPR gRNA sequence
aaatataatcgagatataac

SEQ ID NO: 643362 - DNA, 20 bp, Artificial
  CRISPR gRNA sequence
agaggaaatgtttgatttga

SEQ ID NO: 643363 - DNA, 20 bp, Artificial
  CRISPR gRNA sequence
gaggaaatgtttgatttgaa

SEQ ID NO: 643364 - DNA, 20 bp, Artificial
  CRISPR gRNA sequence
gatttgaaactgcacaagag

SEQ ID NO: 643365 - DNA, 20 bp, Artificial
  CRISPR gRNA sequence
atttgaaactgcacaagaga

SEQ ID NO: 643366 - DNA, 20 bp, Artificial
  CRISPR gRNA sequence
gaaactgcacaagagagaac

SEQ ID NO: 643367 - DNA, 20 bp, Artificial
  CRISPR gRNA sequence
aaactgcacaagagagaact

SEQ ID NO: 643368 - DNA, 20 bp, Artificial
  CRISPR gRNA sequence
cacaagagagaactccagag

SEQ ID NO: 643369 - DNA, 20 bp, Artificial
  CRISPR gRNA sequence
cagagatgtgaacatgtgaa

SEQ ID NO: 643370 - DNA, 20 bp, Artificial
  CRISPR gRNA sequence
gtgggaaaaggtaaacctga

SEQ ID NO: 643371 - DNA, 20 bp, Artificial
  CRISPR gRNA sequence
tgggaaaaggtaaacctgag

SEQ ID NO: 643372 - DNA, 20 bp, Artificial
  CRISPR gRNA sequence
agttcatctgagaaaggtat

SEQ ID NO: 643373 - DNA, 20 bp, Artificial
  CRISPR gRNA sequence
atctgagaaaggtatggatt

SEQ ID NO: 643374 - DNA, 20 bp, Artificial
  CRISPR gRNA sequence
agaaaggtatggattaacag

SEQ ID NO: 643375 - DNA, 20 bp, Artificial
  CRISPR gRNA sequence
acaggttaagcagacatggt

SEQ ID NO: 643376 - DNA, 20 bp, Artificial
  CRISPR gRNA sequence
agcagacatggtaaagtgag

SEQ ID NO: 643377 - DNA, 20 bp, Artificial
  CRISPR gRNA sequence
ataaaaagtttgaactgggt

SEQ ID NO: 643378 - DNA, 20 bp, Artificial
  CRISPR gRNA sequence
gaactgggttcaaatttcca

SEQ ID NO: 643379 - DNA, 20 bp, Artificial
  CRISPR gRNA sequence
aactgggttcaaatttccat

SEQ ID NO: 643380 - DNA, 20 bp, Artificial
  CRISPR gRNA sequence
ggttcaaatttccatctctt

SEQ ID NO: 643381 - DNA, 20 bp, Artificial
  CRISPR gRNA sequence
aaatttccatctcttagggg

SEQ ID NO: 643382 - DNA, 20 bp, Artificial
  CRISPR gRNA sequence
ccatctcttaggggagtgat

SEQ ID NO: 643383 - DNA, 20 bp, Artificial
  CRISPR gRNA sequence
catctcttaggggagtgata

SEQ ID NO: 643384 - DNA, 20 bp, Artificial
  CRISPR gRNA sequence
ttaggggagtgataaaatta

SEQ ID NO: 643385 - DNA, 20 bp, Artificial
  CRISPR gRNA sequence
aggggagtgataaaattagg

SEQ ID NO: 643386 - DNA, 20 bp, Artificial
  CRISPR gRNA sequence
ggggagtgataaaattaggg

SEQ ID NO: 643387 - DNA, 20 bp, Artificial
  CRISPR gRNA sequence
gggagattcatctgactatg

SEQ ID NO: 643388 - DNA, 20 bp, Artificial
  CRISPR gRNA sequence
atctgactatgctgagtatg

SEQ ID NO: 643389 - DNA, 20 bp, Artificial
  CRISPR gRNA sequence
actatgctgagtatgtcaga

SEQ ID NO: 643390 - DNA, 20 bp, Artificial
  CRISPR gRNA sequence
tgctgagtatgtcagaagga

SEQ ID NO: 643391 - DNA, 20 bp, Artificial
  CRISPR gRNA sequence
agtatgtcagaaggataagt

SEQ ID NO: 643392 - DNA, 20 bp, Artificial
  CRISPR gRNA sequence
gaggtaaagagtaactaagg

SEQ ID NO: 643393 - DNA, 20 bp, Artificial
  CRISPR gRNA sequence
aggggctactaatctaccat

SEQ ID NO: 643394 - DNA, 20 bp, Artificial
  CRISPR gRNA sequence
ctaatctaccataacagcta

SEQ ID NO: 643395 - DNA, 20 bp, Artificial
  CRISPR gRNA sequence
atctaccataacagctatga

SEQ ID NO: 643396 - DNA, 20 bp, Artificial
  CRISPR gRNA sequence
ccataacagctatgaagctt

SEQ ID NO: 643397 - DNA, 20 bp, Artificial
  CRISPR gRNA sequence
tgaagcttggagtaaagata

SEQ ID NO: 643398 - DNA, 20 bp, Artificial
  CRISPR gRNA sequence
ggagtaaagatagggtgata

SEQ ID NO: 643399 - DNA, 20 bp, Artificial
  CRISPR gRNA sequence
gagtaaagatagggtgatag

SEQ ID NO: 643400 - DNA, 20 bp, Artificial
  CRISPR gRNA sequence
cgtatttaacaattctataa

SEQ ID NO: 643401 - DNA, 20 bp, Artificial
  CRISPR gRNA sequence
aacaattctataaactggca

SEQ ID NO: 643402 - DNA, 20 bp, Artificial
  CRISPR gRNA sequence
acaattctataaactggcaa

SEQ ID NO: 643403 - DNA, 20 bp, Artificial
  CRISPR gRNA sequence
tataaactggcaacagcaga

SEQ ID NO: 643404 - DNA, 20 bp, Artificial
  CRISPR gRNA sequence
taaactggcaacagcagaga

SEQ ID NO: 643405 - DNA, 20 bp, Artificial
  CRISPR gRNA sequence
gcaacagcagagaggctgca

SEQ ID NO: 643406 - DNA, 20 bp, Artificial
  CRISPR gRNA sequence
cagttcccacaagcaatagc

SEQ ID NO: 643407 - DNA, 20 bp, Artificial
  CRISPR gRNA sequence
ccacaagcaatagcaagaga

SEQ ID NO: 643408 - DNA, 20 bp, Artificial
  CRISPR gRNA sequence
gcaagagactaccatagctt

SEQ ID NO: 643409 - DNA, 20 bp, Artificial
  CRISPR gRNA sequence
ccatagcttcaggggcccat

SEQ ID NO: 643410 - DNA, 20 bp, Artificial
  CRISPR gRNA sequence
caggggcccatgtaagtact

SEQ ID NO: 643411 - DNA, 20 bp, Artificial
  CRISPR gRNA sequence
aggggcccatgtaagtacta

SEQ ID NO: 643412 - DNA, 20 bp, Artificial
  CRISPR gRNA sequence
tttgctggtgtaccagcact

SEQ ID NO: 643413 - DNA, 20 bp, Artificial
  CRISPR gRNA sequence
gctggtgtaccagcactgac

SEQ ID NO: 643414 - DNA, 20 bp, Artificial
  CRISPR gRNA sequence
ctggtgtaccagcactgaca

SEQ ID NO: 643415 - DNA, 20 bp, Artificial
  CRISPR gRNA sequence
gtgtaccagcactgacacca

SEQ ID NO: 643416 - DNA, 20 bp, Artificial
  CRISPR gRNA sequence
acaccagggtaccatctttc

SEQ ID NO: 643417 - DNA, 20 bp, Artificial
  CRISPR gRNA sequence
tcctggaagaatctgagacc

SEQ ID NO: 643418 - DNA, 20 bp, Artificial
  CRISPR gRNA sequence
cctggaagaatctgagaccc

SEQ ID NO: 643419 - DNA, 20 bp, Artificial
  CRISPR gRNA sequence
ctggaagaatctgagacccc

SEQ ID NO: 643420 - DNA, 20 bp, Artificial
  CRISPR gRNA sequence
gaagaatctgagacccccct

SEQ ID NO: 643421 - DNA, 20 bp, Artificial
  CRISPR gRNA sequence
agacccccctagcctgggag

SEQ ID NO: 643422 - DNA, 20 bp, Artificial
  CRISPR gRNA sequence
gcctgggagagaacatccat

SEQ ID NO: 643423 - DNA, 20 bp, Artificial
  CRISPR gRNA sequence
ggagagaacatccatgggca

SEQ ID NO: 643424 - DNA, 20 bp, Artificial
  CRISPR gRNA sequence
aggctgagatgcgcaggctg

SEQ ID NO: 643425 - DNA, 20 bp, Artificial
  CRISPR gRNA sequence
agatgcgcaggctgggacac

SEQ ID NO: 643426 - DNA, 20 bp, Artificial
  CRISPR gRNA sequence
ggacacaggctggttagcca

SEQ ID NO: 643427 - DNA, 20 bp, Artificial
  CRISPR gRNA sequence
gttagccagttgacagcata

SEQ ID NO: 643428 - DNA, 20 bp, Artificial
  CRISPR gRNA sequence
gccagttgacagcatattaa

SEQ ID NO: 643429 - DNA, 20 bp, Artificial
  CRISPR gRNA sequence
acagcatattaagcagggta

SEQ ID NO: 643430 - DNA, 20 bp, Artificial
  CRISPR gRNA sequence
agcagggtacccacaaagct

SEQ ID NO: 643431 - DNA, 20 bp, Artificial
  CRISPR gRNA sequence
ttgggatgaagggagtacag

SEQ ID NO: 643432 - DNA, 20 bp, Artificial
  CRISPR gRNA sequence
gggatgaagggagtacaggt

SEQ ID NO: 643433 - DNA, 20 bp, Artificial
  CRISPR gRNA sequence
ggatgaagggagtacaggta

SEQ ID NO: 643434 - DNA, 20 bp, Artificial
  CRISPR gRNA sequence
aatggacttgaggaaaagtc

SEQ ID NO: 643435 - DNA, 20 bp, Artificial
  CRISPR gRNA sequence
gaggaaaagtctctttctca

SEQ ID NO: 643436 - DNA, 20 bp, Artificial
  CRISPR gRNA sequence
aggaaaagtctctttctcaa

SEQ ID NO: 643437 - DNA, 20 bp, Artificial
  CRISPR gRNA sequence
tttctcaaacctgtacaaaa

SEQ ID NO: 643438 - DNA, 20 bp, Artificial
  CRISPR gRNA sequence
tctcaaacctgtacaaaagc

SEQ ID NO: 643439 - DNA, 20 bp, Artificial
  CRISPR gRNA sequence
ctcaaacctgtacaaaagca

SEQ ID NO: 643440 - DNA, 20 bp, Artificial
  CRISPR gRNA sequence
tcaaacctgtacaaaagcat

SEQ ID NO: 643441 - DNA, 20 bp, Artificial
  CRISPR gRNA sequence
aaacctgtacaaaagcattt

SEQ ID NO: 643442 - DNA, 20 bp, Artificial
  CRISPR gRNA sequence
tacaaaagcattttaatatt

SEQ ID NO: 643443 - DNA, 20 bp, Artificial
  CRISPR gRNA sequence
taatattttagcaaccagta

SEQ ID NO: 643444 - DNA, 20 bp, Artificial
  CRISPR gRNA sequence
aatattttagcaaccagtat

SEQ ID NO: 643445 - DNA, 20 bp, Artificial
  CRISPR gRNA sequence
atattttagcaaccagtata

SEQ ID NO: 643446 - DNA, 20 bp, Artificial
  CRISPR gRNA sequence
tagcaaccagtataatcata

SEQ ID NO: 643447 - DNA, 20 bp, Artificial
  CRISPR gRNA sequence
agcaaccagtataatcatat

SEQ ID NO: 643448 - DNA, 20 bp, Artificial
  CRISPR gRNA sequence
gcaaccagtataatcatatc

SEQ ID NO: 643449 - DNA, 20 bp, Artificial
  CRISPR gRNA sequence
taagtgctgggtgcatatca

SEQ ID NO: 643450 - DNA, 20 bp, Artificial
  CRISPR gRNA sequence
ggtgcatatcagccacaggt

SEQ ID NO: 643451 - DNA, 20 bp, Artificial
  CRISPR gRNA sequence
gataagatgtggactggcaa

SEQ ID NO: 643452 - DNA, 20 bp, Artificial
  CRISPR gRNA sequence
gcaagaggagagaggacaga

SEQ ID NO: 643453 - DNA, 20 bp, Artificial
  CRISPR gRNA sequence
aacggaaaaagaacaagata

SEQ ID NO: 643454 - DNA, 20 bp, Artificial
  CRISPR gRNA sequence
acggaaaaagaacaagatac

SEQ ID NO: 643455 - DNA, 20 bp, Artificial
  CRISPR gRNA sequence
ggagaagccaagaatattaa

SEQ ID NO: 643456 - DNA, 20 bp, Artificial
  CRISPR gRNA sequence
agtaatctgattccaagatt

SEQ ID NO: 643457 - DNA, 20 bp, Artificial
  CRISPR gRNA sequence
attccaagatttcaagtctg

SEQ ID NO: 643458 - DNA, 20 bp, Artificial
  CRISPR gRNA sequence
caagatttcaagtctgaaga

SEQ ID NO: 643459 - DNA, 20 bp, Artificial
  CRISPR gRNA sequence
caagtctgaagaaccatata

SEQ ID NO: 643460 - DNA, 20 bp, Artificial
  CRISPR gRNA sequence
aagtctgaagaaccatatag

SEQ ID NO: 643461 - DNA, 20 bp, Artificial
  CRISPR gRNA sequence
aagaaccatataggggagag

SEQ ID NO: 643462 - DNA, 20 bp, Artificial
  CRISPR gRNA sequence
tattaatgacagacataagg

SEQ ID NO: 643463 - DNA, 20 bp, Artificial
  CRISPR gRNA sequence
atgacagacataaggtattt

SEQ ID NO: 643464 - DNA, 20 bp, Artificial
  CRISPR gRNA sequence
tggaaacagaataaatttga

SEQ ID NO: 643465 - DNA, 20 bp, Artificial
  CRISPR gRNA sequence
ggaaacagaataaatttgag

SEQ ID NO: 643466 - DNA, 20 bp, Artificial
  CRISPR gRNA sequence
gaaacagaataaatttgagt

SEQ ID NO: 643467 - DNA, 20 bp, Artificial
  CRISPR gRNA sequence
gagtgaagtggtatatgaga

SEQ ID NO: 643468 - DNA, 20 bp, Artificial
  CRISPR gRNA sequence
agtgaagtggtatatgagaa

SEQ ID NO: 643469 - DNA, 20 bp, Artificial
  CRISPR gRNA sequence
tgagtttttaaattattgac

SEQ ID NO: 643470 - DNA, 20 bp, Artificial
  CRISPR gRNA sequence
ttaaattattgacttgaaaa

SEQ ID NO: 643471 - DNA, 20 bp, Artificial
  CRISPR gRNA sequence
taaattattgacttgaaaat

SEQ ID NO: 643472 - DNA, 20 bp, Artificial
  CRISPR gRNA sequence
aaattattgacttgaaaatg

SEQ ID NO: 643473 - DNA, 20 bp, Artificial
  CRISPR gRNA sequence
aattattgacttgaaaatgt

SEQ ID NO: 643474 - DNA, 20 bp, Artificial
  CRISPR gRNA sequence
ttgacttgaaaatgttattc

SEQ ID NO: 643475 - DNA, 20 bp, Artificial
  CRISPR gRNA sequence
acttgaaaatgttattcata

SEQ ID NO: 643476 - DNA, 20 bp, Artificial
  CRISPR gRNA sequence
gaaaatgttattcatagttg

SEQ ID NO: 643477 - DNA, 20 bp, Artificial
  CRISPR gRNA sequence
aaaatgttattcatagttgt

SEQ ID NO: 643478 - DNA, 20 bp, Artificial
  CRISPR gRNA sequence
ttcatagttgttcataaaca

SEQ ID NO: 643479 - DNA, 20 bp, Artificial
  CRISPR gRNA sequence
atagttgttcataaacatcc

SEQ ID NO: 643480 - DNA, 20 bp, Artificial
  CRISPR gRNA sequence
ttcataaacatccataaagg

SEQ ID NO: 643481 - DNA, 20 bp, Artificial
  CRISPR gRNA sequence
ataaacatccataaaggcaa

SEQ ID NO: 643482 - DNA, 20 bp, Artificial
  CRISPR gRNA sequence
aaagtacaaaccttaagttc

SEQ ID NO: 643483 - DNA, 20 bp, Artificial
  CRISPR gRNA sequence
aagttcagatctgaactcaa

SEQ ID NO: 643484 - DNA, 20 bp, Artificial
  CRISPR gRNA sequence
agttcagatctgaactcaaa

SEQ ID NO: 643485 - DNA, 20 bp, Artificial
  CRISPR gRNA sequence
agatctgaactcaaagttac

SEQ ID NO: 643486 - DNA, 20 bp, Artificial
  CRISPR gRNA sequence
aactcaaagttacagacttt

SEQ ID NO: 643487 - DNA, 20 bp, Artificial
  CRISPR gRNA sequence
aaagttacagactttgggga

SEQ ID NO: 643488 - DNA, 20 bp, Artificial
  CRISPR gRNA sequence
cagactttggggaaaactat

SEQ ID NO: 643489 - DNA, 20 bp, Artificial
  CRISPR gRNA sequence
tggggaaaactatgcaaata

SEQ ID NO: 643490 - DNA, 20 bp, Artificial
  CRISPR gRNA sequence
ggggaaaactatgcaaatat

SEQ ID NO: 643491 - DNA, 20 bp, Artificial
  CRISPR gRNA sequence
gggaaaactatgcaaatatc

SEQ ID NO: 643492 - DNA, 20 bp, Artificial
  CRISPR gRNA sequence
tgcaaatatcagtataaatg

SEQ ID NO: 643493 - DNA, 20 bp, Artificial
  CRISPR gRNA sequence
tttaagtaagtgaacattaa

SEQ ID NO: 643494 - DNA, 20 bp, Artificial
  CRISPR gRNA sequence
taagtaagtgaacattaaaa

SEQ ID NO: 643495 - DNA, 20 bp, Artificial
  CRISPR gRNA sequence
aagtaagtgaacattaaaat

SEQ ID NO: 643496 - DNA, 20 bp, Artificial
  CRISPR gRNA sequence
agtaagtgaacattaaaatg

SEQ ID NO: 643497 - DNA, 20 bp, Artificial
  CRISPR gRNA sequence
aaatgaatcctgaataaatg

SEQ ID NO: 643498 - DNA, 20 bp, Artificial
  CRISPR gRNA sequence
aataaatgtgcatatagata

SEQ ID NO: 643499 - DNA, 20 bp, Artificial
  CRISPR gRNA sequence
tcttttaggataaagtaaat

SEQ ID NO: 643500 - DNA, 20 bp, Artificial
  CRISPR gRNA sequence
cttttaggataaagtaaatt

SEQ ID NO: 643501 - DNA, 20 bp, Artificial
  CRISPR gRNA sequence
ttttaggataaagtaaatta

SEQ ID NO: 643502 - DNA, 20 bp, Artificial
  CRISPR gRNA sequence
ttaggataaagtaaattaaa

SEQ ID NO: 643503 - DNA, 20 bp, Artificial
  CRISPR gRNA sequence
taggataaagtaaattaaaa

SEQ ID NO: 643504 - DNA, 20 bp, Artificial
  CRISPR gRNA sequence
aggataaagtaaattaaaat

SEQ ID NO: 643505 - DNA, 20 bp, Artificial
  CRISPR gRNA sequence
ggataaagtaaattaaaatt

SEQ ID NO: 643506 - DNA, 20 bp, Artificial
  CRISPR gRNA sequence
aaattggccaaaacatatca

SEQ ID NO: 643507 - DNA, 20 bp, Artificial
  CRISPR gRNA sequence
gccaaaacatatcattaaat

SEQ ID NO: 643508 - DNA, 20 bp, Artificial
  CRISPR gRNA sequence
aattaaaaattagaatgtta

SEQ ID NO: 643509 - DNA, 20 bp, Artificial
  CRISPR gRNA sequence
aaaattagaatgttataaaa

SEQ ID NO: 643510 - DNA, 20 bp, Artificial
  CRISPR gRNA sequence
gaatgttataaaatatacta

SEQ ID NO: 643511 - DNA, 20 bp, Artificial
  CRISPR gRNA sequence
taaaatatactaaataaatc

SEQ ID NO: 643512 - DNA, 20 bp, Artificial
  CRISPR gRNA sequence
aataaatcatttttaaatat

SEQ ID NO: 643513 - DNA, 20 bp, Artificial
  CRISPR gRNA sequence
ttaaatatccaagattcatt

SEQ ID NO: 643514 - DNA, 20 bp, Artificial
  CRISPR gRNA sequence
taaatatccaagattcattt

SEQ ID NO: 643515 - DNA, 20 bp, Artificial
  CRISPR gRNA sequence
aaatatccaagattcatttt

SEQ ID NO: 643516 - DNA, 20 bp, Artificial
  CRISPR gRNA sequence
aatatccaagattcatttta

SEQ ID NO: 643517 - DNA, 20 bp, Artificial
  CRISPR gRNA sequence
attttaaaacgtgatcccca

SEQ ID NO: 643518 - DNA, 20 bp, Artificial
  CRISPR gRNA sequence
taaaacgtgatccccaaact

SEQ ID NO: 643519 - DNA, 20 bp, Artificial
  CRISPR gRNA sequence
aaaacgtgatccccaaactg

SEQ ID NO: 643520 - DNA, 20 bp, Artificial
  CRISPR gRNA sequence
aaacgtgatccccaaactgg

SEQ ID NO: 643521 - DNA, 20 bp, Artificial
  CRISPR gRNA sequence
gggtgcatattagactcttt

SEQ ID NO: 643522 - DNA, 20 bp, Artificial
  CRISPR gRNA sequence
gactctttgggtaactttta

SEQ ID NO: 643523 - DNA, 20 bp, Artificial
  CRISPR gRNA sequence
tttgggtaacttttaccatc

SEQ ID NO: 643524 - DNA, 20 bp, Artificial
  CRISPR gRNA sequence
tgggtaacttttaccatcat

SEQ ID NO: 643525 - DNA, 20 bp, Artificial
  CRISPR gRNA sequence
gggtaacttttaccatcata

SEQ ID NO: 643526 - DNA, 20 bp, Artificial
  CRISPR gRNA sequence
ggtaacttttaccatcatac

SEQ ID NO: 643527 - DNA, 20 bp, Artificial
  CRISPR gRNA sequence
ttaccatcatactggtggtt

SEQ ID NO: 643528 - DNA, 20 bp, Artificial
  CRISPR gRNA sequence
taccatcatactggtggttg

SEQ ID NO: 643529 - DNA, 20 bp, Artificial
  CRISPR gRNA sequence
accatcatactggtggttga

SEQ ID NO: 643530 - DNA, 20 bp, Artificial
  CRISPR gRNA sequence
ccatcatactggtggttgac

SEQ ID NO: 643531 - DNA, 20 bp, Artificial
  CRISPR gRNA sequence
gtggttgaccaattagatgg

SEQ ID NO: 643532 - DNA, 20 bp, Artificial
  CRISPR gRNA sequence
accaattagatgggaatcac

SEQ ID NO: 643533 - DNA, 20 bp, Artificial
  CRISPR gRNA sequence
gatgggaatcactgaattaa

SEQ ID NO: 643534 - DNA, 20 bp, Artificial
  CRISPR gRNA sequence
aattaaaatagtctgtaaaa

SEQ ID NO: 643535 - DNA, 20 bp, Artificial
  CRISPR gRNA sequence
aaatagtctgtaaaatgaac

SEQ ID NO: 643536 - DNA, 20 bp, Artificial
  CRISPR gRNA sequence
taaaatgaacatatgtaaag

SEQ ID NO: 643537 - DNA, 20 bp, Artificial
  CRISPR gRNA sequence
agaaaaagatttgaataatc

SEQ ID NO: 643538 - DNA, 20 bp, Artificial
  CRISPR gRNA sequence
gaaaaagatttgaataatct

SEQ ID NO: 643539 - DNA, 20 bp, Artificial
  CRISPR gRNA sequence
gaataatcttcaatgaagag

SEQ ID NO: 643540 - DNA, 20 bp, Artificial
  CRISPR gRNA sequence
aataatcttcaatgaagagc

SEQ ID NO: 643541 - DNA, 20 bp, Artificial
  CRISPR gRNA sequence
caatgaagagctttaaaaaa

SEQ ID NO: 643542 - DNA, 20 bp, Artificial
  CRISPR gRNA sequence
aatgaagagctttaaaaaat

SEQ ID NO: 643543 - DNA, 20 bp, Artificial
  CRISPR gRNA sequence
taaaaaataaagatttatct

SEQ ID NO: 643544 - DNA, 20 bp, Artificial
  CRISPR gRNA sequence
aaaaaataaagatttatcta

SEQ ID NO: 643545 - DNA, 20 bp, Artificial
  CRISPR gRNA sequence
aaaaataaagatttatctag

SEQ ID NO: 643546 - DNA, 20 bp, Artificial
  CRISPR gRNA sequence
atctagacactgaaaagagt

SEQ ID NO: 643547 - DNA, 20 bp, Artificial
  CRISPR gRNA sequence
tctagacactgaaaagagtt

SEQ ID NO: 643548 - DNA, 20 bp, Artificial
  CRISPR gRNA sequence
gacactgaaaagagtttaaa

SEQ ID NO: 643549 - DNA, 20 bp, Artificial
  CRISPR gRNA sequence
aaaagagtttaaacatagaa

SEQ ID NO: 643550 - DNA, 20 bp, Artificial
  CRISPR gRNA sequence
aaacatagaagaatcaaaaa

SEQ ID NO: 643551 - DNA, 20 bp, Artificial
  CRISPR gRNA sequence
aacatagaagaatcaaaaat

SEQ ID NO: 643552 - DNA, 20 bp, Artificial
  CRISPR gRNA sequence
aaaaccatgcatatgttatt

SEQ ID NO: 643553 - DNA, 20 bp, Artificial
  CRISPR gRNA sequence
aaaccatgcatatgttattt

SEQ ID NO: 643554 - DNA, 20 bp, Artificial
  CRISPR gRNA sequence
tttaaccacaggtataccat

SEQ ID NO: 643555 - DNA, 20 bp, Artificial
  CRISPR gRNA sequence
aaccacaggtataccataaa

SEQ ID NO: 643556 - DNA, 20 bp, Artificial
  CRISPR gRNA sequence
accacaggtataccataaac

SEQ ID NO: 643557 - DNA, 20 bp, Artificial
  CRISPR gRNA sequence
taaagattaaaatatgtttt

SEQ ID NO: 643558 - DNA, 20 bp, Artificial
  CRISPR gRNA sequence
aaagattaaaatatgttttt

SEQ ID NO: 643559 - DNA, 20 bp, Artificial
  CRISPR gRNA sequence
aagattaaaatatgtttttg

SEQ ID NO: 643560 - DNA, 20 bp, Artificial
  CRISPR gRNA sequence
aaatatgtttttgtaaaaat

SEQ ID NO: 643561 - DNA, 20 bp, Artificial
  CRISPR gRNA sequence
ttgtaaaaatatgtctttca

SEQ ID NO: 643562 - DNA, 20 bp, Artificial
  CRISPR gRNA sequence
tgtaaaaatatgtctttcaa

SEQ ID NO: 643563 - DNA, 20 bp, Artificial
  CRISPR gRNA sequence
gtaaaaatatgtctttcaaa

SEQ ID NO: 643564 - DNA, 20 bp, Artificial
  CRISPR gRNA sequence
taaaaatatgtctttcaaat

SEQ ID NO: 643565 - DNA, 20 bp, Artificial
  CRISPR gRNA sequence
tcaaattttttaaatctagt

SEQ ID NO: 643566 - DNA, 20 bp, Artificial
  CRISPR gRNA sequence
caaattttttaaatctagtt

SEQ ID NO: 643567 - DNA, 20 bp, Artificial
  CRISPR gRNA sequence
aaattttttaaatctagttt

SEQ ID NO: 643568 - DNA, 20 bp, Artificial
  CRISPR gRNA sequence
tttaaatctagttttactga

SEQ ID NO: 643569 - DNA, 20 bp, Artificial
  CRISPR gRNA sequence
ttaaatctagttttactgaa

SEQ ID NO: 643570 - DNA, 20 bp, Artificial
  CRISPR gRNA sequence
taaatctagttttactgaag

SEQ ID NO: 643571 - DNA, 20 bp, Artificial
  CRISPR gRNA sequence
aaatctagttttactgaagt

SEQ ID NO: 643572 - DNA, 20 bp, Artificial
  CRISPR gRNA sequence
aatctagttttactgaagtt

SEQ ID NO: 643573 - DNA, 20 bp, Artificial
  CRISPR gRNA sequence
gttttactgaagtttcttat

SEQ ID NO: 643574 - DNA, 20 bp, Artificial
  CRISPR gRNA sequence
tactgaagtttcttatggta

SEQ ID NO: 643575 - DNA, 20 bp, Artificial
  CRISPR gRNA sequence
actgaagtttcttatggtag

SEQ ID NO: 643576 - DNA, 20 bp, Artificial
  CRISPR gRNA sequence
ctgaagtttcttatggtaga

SEQ ID NO: 643577 - DNA, 20 bp, Artificial
  CRISPR gRNA sequence
aagtttcttatggtagaaat

SEQ ID NO: 643578 - DNA, 20 bp, Artificial
  CRISPR gRNA sequence
cttatggtagaaatgtgtgt

SEQ ID NO: 643579 - DNA, 20 bp, Artificial
  CRISPR gRNA sequence
ttatggtagaaatgtgtgtt

SEQ ID NO: 643580 - DNA, 20 bp, Artificial
  CRISPR gRNA sequence
atggtagaaatgtgtgttaa

SEQ ID NO: 643581 - DNA, 20 bp, Artificial
  CRISPR gRNA sequence
tggtagaaatgtgtgttaat

SEQ ID NO: 643582 - DNA, 20 bp, Artificial
  CRISPR gRNA sequence
atgaaaagttgaacaaatta

SEQ ID NO: 643583 - DNA, 20 bp, Artificial
  CRISPR gRNA sequence
aacaaattaacatttcagtt

SEQ ID NO: 643584 - DNA, 20 bp, Artificial
  CRISPR gRNA sequence
acatttcagttcatgctaag

SEQ ID NO: 643585 - DNA, 20 bp, Artificial
  CRISPR gRNA sequence
cagttcatgctaagaagcac

SEQ ID NO: 643586 - DNA, 20 bp, Artificial
  CRISPR gRNA sequence
agttcatgctaagaagcaca

SEQ ID NO: 643587 - DNA, 20 bp, Artificial
  CRISPR gRNA sequence
atgctaagaagcacacttca

SEQ ID NO: 643588 - DNA, 20 bp, Artificial
  CRISPR gRNA sequence
agaagcacacttcactattt

SEQ ID NO: 643589 - DNA, 20 bp, Artificial
  CRISPR gRNA sequence
cactatttcactagaactaa

SEQ ID NO: 643590 - DNA, 20 bp, Artificial
  CRISPR gRNA sequence
actatttcactagaactaaa

SEQ ID NO: 643591 - DNA, 20 bp, Artificial
  CRISPR gRNA sequence
tttcactagaactaaagaaa

SEQ ID NO: 643592 - DNA, 20 bp, Artificial
  CRISPR gRNA sequence
cactagaactaaagaaaaat

SEQ ID NO: 643593 - DNA, 20 bp, Artificial
  CRISPR gRNA sequence
actagaactaaagaaaaata

SEQ ID NO: 643594 - DNA, 20 bp, Artificial
  CRISPR gRNA sequence
gaactaaagaaaaataagtt

SEQ ID NO: 643595 - DNA, 20 bp, Artificial
  CRISPR gRNA sequence
aagaaaaataagttattgtt

SEQ ID NO: 643596 - DNA, 20 bp, Artificial
  CRISPR gRNA sequence
ttgttaagtatttctgcaga

SEQ ID NO: 643597 - DNA, 20 bp, Artificial
  CRISPR gRNA sequence
ttaagtatttctgcagaagc

SEQ ID NO: 643598 - DNA, 20 bp, Artificial
  CRISPR gRNA sequence
agtatttctgcagaagcaaa

SEQ ID NO: 643599 - DNA, 20 bp, Artificial
  CRISPR gRNA sequence
ctgcagaagcaaaattcagg

SEQ ID NO: 643600 - DNA, 20 bp, Artificial
  CRISPR gRNA sequence
tgcagaagcaaaattcaggg

SEQ ID NO: 643601 - DNA, 20 bp, Artificial
  CRISPR gRNA sequence
cagaagcaaaattcagggga

SEQ ID NO: 643602 - DNA, 20 bp, Artificial
  CRISPR gRNA sequence
aggggaaattcctaatttgg

SEQ ID NO: 643603 - DNA, 20 bp, Artificial
  CRISPR gRNA sequence
ctaatttggtatttgtagct

SEQ ID NO: 643604 - DNA, 20 bp, Artificial
  CRISPR gRNA sequence
atttggtatttgtagctcat

SEQ ID NO: 643605 - DNA, 20 bp, Artificial
  CRISPR gRNA sequence
ggtatttgtagctcatctaa

SEQ ID NO: 643606 - DNA, 20 bp, Artificial
  CRISPR gRNA sequence
gtatttgtagctcatctaag

SEQ ID NO: 643607 - DNA, 20 bp, Artificial
  CRISPR gRNA sequence
gtagctcatctaaggatatt

SEQ ID NO: 643608 - DNA, 20 bp, Artificial
  CRISPR gRNA sequence
tagctcatctaaggatattg

SEQ ID NO: 643609 - DNA, 20 bp, Artificial
  CRISPR gRNA sequence
atctaaggatattgtttcta

SEQ ID NO: 643610 - DNA, 20 bp, Artificial
  CRISPR gRNA sequence
aggatattgtttctatctac

SEQ ID NO: 643611 - DNA, 20 bp, Artificial
  CRISPR gRNA sequence
tttctatctactaacgaggt

SEQ ID NO: 643612 - DNA, 20 bp, Artificial
  CRISPR gRNA sequence
ctatctactaacgaggtaat

SEQ ID NO: 643613 - DNA, 20 bp, Artificial
  CRISPR gRNA sequence
tatctactaacgaggtaatt

SEQ ID NO: 643614 - DNA, 20 bp, Artificial
  CRISPR gRNA sequence
tctactaacgaggtaattat

SEQ ID NO: 643615 - DNA, 20 bp, Artificial
  CRISPR gRNA sequence
ctaacgaggtaattatagat

SEQ ID NO: 643616 - DNA, 20 bp, Artificial
  CRISPR gRNA sequence
acgaggtaattatagatatt

SEQ ID NO: 643617 - DNA, 20 bp, Artificial
  CRISPR gRNA sequence
tagatatttgaaatcaaatt

SEQ ID NO: 643618 - DNA, 20 bp, Artificial
  CRISPR gRNA sequence
gaaatcaaatttaagtagta

SEQ ID NO: 643619 - DNA, 20 bp, Artificial
  CRISPR gRNA sequence
aaatcaaatttaagtagtat

SEQ ID NO: 643620 - DNA, 20 bp, Artificial
  CRISPR gRNA sequence
aagtagtatgacttggagaa

SEQ ID NO: 643621 - DNA, 20 bp, Artificial
  CRISPR gRNA sequence
agtagtatgacttggagaaa

SEQ ID NO: 643622 - DNA, 20 bp, Artificial
  CRISPR gRNA sequence
ggagaaaaaaaaattcccat

SEQ ID NO: 643623 - DNA, 20 bp, Artificial
  CRISPR gRNA sequence
gagaaaaaaaaattcccatt

SEQ ID NO: 643624 - DNA, 20 bp, Artificial
  CRISPR gRNA sequence
ccatttgtagtatctttaac

SEQ ID NO: 643625 - DNA, 20 bp, Artificial
  CRISPR gRNA sequence
gtagtatctttaacaataat

SEQ ID NO: 643626 - DNA, 20 bp, Artificial
  CRISPR gRNA sequence
tagtatctttaacaataatt

SEQ ID NO: 643627 - DNA, 20 bp, Artificial
  CRISPR gRNA sequence
taacaataattgatagtcat

SEQ ID NO: 643628 - DNA, 20 bp, Artificial
  CRISPR gRNA sequence
aacaataattgatagtcata

SEQ ID NO: 643629 - DNA, 20 bp, Artificial
  CRISPR gRNA sequence
acaataattgatagtcataa

SEQ ID NO: 643630 - DNA, 20 bp, Artificial
  CRISPR gRNA sequence
atagtcataagtaacccatc

SEQ ID NO: 643631 - DNA, 20 bp, Artificial
  CRISPR gRNA sequence
tgggttacagtaaccactaa

SEQ ID NO: 643632 - DNA, 20 bp, Artificial
  CRISPR gRNA sequence
ggttacagtaaccactaaat

SEQ ID NO: 643633 - DNA, 20 bp, Artificial
  CRISPR gRNA sequence
cagtaaccactaaatattat

SEQ ID NO: 643634 - DNA, 20 bp, Artificial
  CRISPR gRNA sequence
aatattatacagcttataga

SEQ ID NO: 643635 - DNA, 20 bp, Artificial
  CRISPR gRNA sequence
tacagcttatagaaggtaac

SEQ ID NO: 643636 - DNA, 20 bp, Artificial
  CRISPR gRNA sequence
atagaaggtaacccagaaga

SEQ ID NO: 643637 - DNA, 20 bp, Artificial
  CRISPR gRNA sequence
tagaaggtaacccagaagat

SEQ ID NO: 643638 - DNA, 20 bp, Artificial
  CRISPR gRNA sequence
gaagaggtactggagaagag

SEQ ID NO: 643639 - DNA, 20 bp, Artificial
  CRISPR gRNA sequence
gagaagagggtatagctgaa

SEQ ID NO: 643640 - DNA, 20 bp, Artificial
  CRISPR gRNA sequence
aagtctcaaaaaaatagcac

SEQ ID NO: 643641 - DNA, 20 bp, Artificial
  CRISPR gRNA sequence
aaaaaaatagcacccattca

SEQ ID NO: 643642 - DNA, 20 bp, Artificial
  CRISPR gRNA sequence
actaaggatatgttacttga

SEQ ID NO: 643643 - DNA, 20 bp, Artificial
  CRISPR gRNA sequence
aggatatgttacttgatcaa

SEQ ID NO: 643644 - DNA, 20 bp, Artificial
  CRISPR gRNA sequence
cttgatcaagagagcatcat

SEQ ID NO: 643645 - DNA, 20 bp, Artificial
  CRISPR gRNA sequence
gatcaagagagcatcatact

SEQ ID NO: 643646 - DNA, 20 bp, Artificial
  CRISPR gRNA sequence
atcaagagagcatcatactc

SEQ ID NO: 643647 - DNA, 20 bp, Artificial
  CRISPR gRNA sequence
taaacttgatgcgaatttca

SEQ ID NO: 643648 - DNA, 20 bp, Artificial
  CRISPR gRNA sequence
aacttgatgcgaatttcaca

SEQ ID NO: 643649 - DNA, 20 bp, Artificial
  CRISPR gRNA sequence
gatgcgaatttcacatgaaa

SEQ ID NO: 643650 - DNA, 20 bp, Artificial
  CRISPR gRNA sequence
atgcgaatttcacatgaaag

SEQ ID NO: 643651 - DNA, 20 bp, Artificial
  CRISPR gRNA sequence
cacatgaaagaaacttaata

SEQ ID NO: 643652 - DNA, 20 bp, Artificial
  CRISPR gRNA sequence
acatgaaagaaacttaatag

SEQ ID NO: 643653 - DNA, 20 bp, Artificial
  CRISPR gRNA sequence
aatagccagagaataggaaa

SEQ ID NO: 643654 - DNA, 20 bp, Artificial
  CRISPR gRNA sequence
atagccagagaataggaaat

SEQ ID NO: 643655 - DNA, 20 bp, Artificial
  CRISPR gRNA sequence
actctaaagatgtcttagaa

SEQ ID NO: 643656 - DNA, 20 bp, Artificial
  CRISPR gRNA sequence
taaagatgtcttagaatgtc

SEQ ID NO: 643657 - DNA, 20 bp, Artificial
  CRISPR gRNA sequence
aagatgtcttagaatgtcta

SEQ ID NO: 643658 - DNA, 20 bp, Artificial
  CRISPR gRNA sequence
agaatgtctaagaatagcaa

SEQ ID NO: 643659 - DNA, 20 bp, Artificial
  CRISPR gRNA sequence
gaatgtctaagaatagcaaa

SEQ ID NO: 643660 - DNA, 20 bp, Artificial
  CRISPR gRNA sequence
agaatagcaaatcaagcatg

SEQ ID NO: 643661 - DNA, 20 bp, Artificial
  CRISPR gRNA sequence
ctaactataggtaaaaactt

SEQ ID NO: 643662 - DNA, 20 bp, Artificial
  CRISPR gRNA sequence
actataggtaaaaactttgt

SEQ ID NO: 643663 - DNA, 20 bp, Artificial
  CRISPR gRNA sequence
taggtaaaaactttgttttc

SEQ ID NO: 643664 - DNA, 20 bp, Artificial
  CRISPR gRNA sequence
tgttttctattctttttctg

SEQ ID NO: 643665 - DNA, 20 bp, Artificial
  CRISPR gRNA sequence
gttttctattctttttctga

SEQ ID NO: 643666 - DNA, 20 bp, Artificial
  CRISPR gRNA sequence
ttttctattctttttctgat

SEQ ID NO: 643667 - DNA, 20 bp, Artificial
  CRISPR gRNA sequence
tctattctttttctgattat

SEQ ID NO: 643668 - DNA, 20 bp, Artificial
  CRISPR gRNA sequence
ctattctttttctgattatg

SEQ ID NO: 643669 - DNA, 20 bp, Artificial
  CRISPR gRNA sequence
tattctttttctgattatga

SEQ ID NO: 643670 - DNA, 20 bp, Artificial
  CRISPR gRNA sequence
ttctttttctgattatgaaa

SEQ ID NO: 643671 - DNA, 20 bp, Artificial
  CRISPR gRNA sequence
tttttctgattatgaaagta

SEQ ID NO: 643672 - DNA, 20 bp, Artificial
  CRISPR gRNA sequence
tttctgattatgaaagtaac

SEQ ID NO: 643673 - DNA, 20 bp, Artificial
  CRISPR gRNA sequence
ttctgattatgaaagtaaca

SEQ ID NO: 643674 - DNA, 20 bp, Artificial
  CRISPR gRNA sequence
tctgattatgaaagtaacaa

SEQ ID NO: 643675 - DNA, 20 bp, Artificial
  CRISPR gRNA sequence
ctgattatgaaagtaacaat

SEQ ID NO: 643676 - DNA, 20 bp, Artificial
  CRISPR gRNA sequence
tgattatgaaagtaacaatg

SEQ ID NO: 643677 - DNA, 20 bp, Artificial
  CRISPR gRNA sequence
attatgaaagtaacaatgcc

SEQ ID NO: 643678 - DNA, 20 bp, Artificial
  CRISPR gRNA sequence
tgaaagtaacaatgcctcat

SEQ ID NO: 643679 - DNA, 20 bp, Artificial
  CRISPR gRNA sequence
attatataaaaacaggtatt

SEQ ID NO: 643680 - DNA, 20 bp, Artificial
  CRISPR gRNA sequence
tataaaaacaggtatttaca

SEQ ID NO: 643681 - DNA, 20 bp, Artificial
  CRISPR gRNA sequence
acagagatatttaaaccagt

SEQ ID NO: 643682 - DNA, 20 bp, Artificial
  CRISPR gRNA sequence
cagagatatttaaaccagta

SEQ ID NO: 643683 - DNA, 20 bp, Artificial
  CRISPR gRNA sequence
aaaccagtacctaaacctac

SEQ ID NO: 643684 - DNA, 20 bp, Artificial
  CRISPR gRNA sequence
aaccagtacctaaacctacc

SEQ ID NO: 643685 - DNA, 20 bp, Artificial
  CRISPR gRNA sequence
aacctacccctatttttaac

SEQ ID NO: 643686 - DNA, 20 bp, Artificial
  CRISPR gRNA sequence
cccctatttttaacatttta

SEQ ID NO: 643687 - DNA, 20 bp, Artificial
  CRISPR gRNA sequence
tttttaacattttagcatgt

SEQ ID NO: 643688 - DNA, 20 bp, Artificial
  CRISPR gRNA sequence
ttaacattttagcatgtttc

SEQ ID NO: 643689 - DNA, 20 bp, Artificial
  CRISPR gRNA sequence
taacattttagcatgtttct

SEQ ID NO: 643690 - DNA, 20 bp, Artificial
  CRISPR gRNA sequence
aacattttagcatgtttctt

SEQ ID NO: 643691 - DNA, 20 bp, Artificial
  CRISPR gRNA sequence
acattttagcatgtttcttt

SEQ ID NO: 643692 - DNA, 20 bp, Artificial
  CRISPR gRNA sequence
tagcatgtttcttttcaaaa

SEQ ID NO: 643693 - DNA, 20 bp, Artificial
  CRISPR gRNA sequence
agcatgtttcttttcaaaaa

SEQ ID NO: 643694 - DNA, 20 bp, Artificial
  CRISPR gRNA sequence
gcatgtttcttttcaaaaaa

SEQ ID NO: 643695 - DNA, 20 bp, Artificial
  CRISPR gRNA sequence
cttttcaaaaaaatttgaga

SEQ ID NO: 643696 - DNA, 20 bp, Artificial
  CRISPR gRNA sequence
ttttcaaaaaaatttgagat

SEQ ID NO: 643697 - DNA, 20 bp, Artificial
  CRISPR gRNA sequence
ttcaaaaaaatttgagattt

SEQ ID NO: 643698 - DNA, 20 bp, Artificial
  CRISPR gRNA sequence
tcaaaaaaatttgagatttt

SEQ ID NO: 643699 - DNA, 20 bp, Artificial
  CRISPR gRNA sequence
caaaaaaatttgagatttta

SEQ ID NO: 643700 - DNA, 20 bp, Artificial
  CRISPR gRNA sequence
aaaaaaatttgagattttat

SEQ ID NO: 643701 - DNA, 20 bp, Artificial
  CRISPR gRNA sequence
gagattttatctatcgataa

SEQ ID NO: 643702 - DNA, 20 bp, Artificial
  CRISPR gRNA sequence
agattttatctatcgataaa

SEQ ID NO: 643703 - DNA, 20 bp, Artificial
  CRISPR gRNA sequence
tatctatcgataaacagata

SEQ ID NO: 643704 - DNA, 20 bp, Artificial
  CRISPR gRNA sequence
atctatcgataaacagataa

SEQ ID NO: 643705 - DNA, 20 bp, Artificial
  CRISPR gRNA sequence
tctatcgataaacagataat

SEQ ID NO: 643706 - DNA, 20 bp, Artificial
  CRISPR gRNA sequence
tcgataaacagataatgtat

SEQ ID NO: 643707 - DNA, 20 bp, Artificial
  CRISPR gRNA sequence
taaagtatttacctctctat

SEQ ID NO: 643708 - DNA, 20 bp, Artificial
  CRISPR gRNA sequence
acctctctataataacctaa

SEQ ID NO: 643709 - DNA, 20 bp, Artificial
  CRISPR gRNA sequence
cctctctataataacctaag

SEQ ID NO: 643710 - DNA, 20 bp, Artificial
  CRISPR gRNA sequence
tctataataacctaagcatt

SEQ ID NO: 643711 - DNA, 20 bp, Artificial
  CRISPR gRNA sequence
tataataacctaagcatttc

SEQ ID NO: 643712 - DNA, 20 bp, Artificial
  CRISPR gRNA sequence
taataacctaagcatttcca

SEQ ID NO: 643713 - DNA, 20 bp, Artificial
  CRISPR gRNA sequence
agcatttccatgtcattaag

SEQ ID NO: 643714 - DNA, 20 bp, Artificial
  CRISPR gRNA sequence
ccatgtcattaagaaattct

SEQ ID NO: 643715 - DNA, 20 bp, Artificial
  CRISPR gRNA sequence
catgtcattaagaaattctt

SEQ ID NO: 643716 - DNA, 20 bp, Artificial
  CRISPR gRNA sequence
agaaattcttcaacagcata

SEQ ID NO: 643717 - DNA, 20 bp, Artificial
  CRISPR gRNA sequence
ttcaacagcataatttttaa

SEQ ID NO: 643718 - DNA, 20 bp, Artificial
  CRISPR gRNA sequence
caacagcataatttttaaga

SEQ ID NO: 643719 - DNA, 20 bp, Artificial
  CRISPR gRNA sequence
aacagcataatttttaagac

SEQ ID NO: 643720 - DNA, 20 bp, Artificial
  CRISPR gRNA sequence
ttaagactatatatacttca

SEQ ID NO: 643721 - DNA, 20 bp, Artificial
  CRISPR gRNA sequence
taagactatatatacttcag

SEQ ID NO: 643722 - DNA, 20 bp, Artificial
  CRISPR gRNA sequence
aagactatatatacttcagc

SEQ ID NO: 643723 - DNA, 20 bp, Artificial
  CRISPR gRNA sequence
agactatatatacttcagct

SEQ ID NO: 643724 - DNA, 20 bp, Artificial
  CRISPR gRNA sequence
tatatacttcagcttatgga

SEQ ID NO: 643725 - DNA, 20 bp, Artificial
  CRISPR gRNA sequence
cagcttatggaataaccatg

SEQ ID NO: 643726 - DNA, 20 bp, Artificial
  CRISPR gRNA sequence
agcttatggaataaccatga

SEQ ID NO: 643727 - DNA, 20 bp, Artificial
  CRISPR gRNA sequence
atggaataaccatgatttac

SEQ ID NO: 643728 - DNA, 20 bp, Artificial
  CRISPR gRNA sequence
tggaataaccatgatttacc

SEQ ID NO: 643729 - DNA, 20 bp, Artificial
  CRISPR gRNA sequence
acctaagcactgtaccgaaa

SEQ ID NO: 643730 - DNA, 20 bp, Artificial
  CRISPR gRNA sequence
cctaagcactgtaccgaaag

SEQ ID NO: 643731 - DNA, 20 bp, Artificial
  CRISPR gRNA sequence
agcactgtaccgaaagtaat

SEQ ID NO: 643732 - DNA, 20 bp, Artificial
  CRISPR gRNA sequence
taccgaaagtaatttccaat

SEQ ID NO: 643733 - DNA, 20 bp, Artificial
  CRISPR gRNA sequence
ccaataataatactccagtg

SEQ ID NO: 643734 - DNA, 20 bp, Artificial
  CRISPR gRNA sequence
caataataatactccagtgt

SEQ ID NO: 643735 - DNA, 20 bp, Artificial
  CRISPR gRNA sequence
cagtgtctacttttgtggat

SEQ ID NO: 643736 - DNA, 20 bp, Artificial
  CRISPR gRNA sequence
cttttgtggataaatctgtc

SEQ ID NO: 643737 - DNA, 20 bp, Artificial
  CRISPR gRNA sequence
ttgtggataaatctgtctgc

SEQ ID NO: 643738 - DNA, 20 bp, Artificial
  CRISPR gRNA sequence
tgtggataaatctgtctgca

SEQ ID NO: 643739 - DNA, 20 bp, Artificial
  CRISPR gRNA sequence
gtggataaatctgtctgcat

SEQ ID NO: 643740 - DNA, 20 bp, Artificial
  CRISPR gRNA sequence
tggataaatctgtctgcatt

SEQ ID NO: 643741 - DNA, 20 bp, Artificial
  CRISPR gRNA sequence
tctgcatttctaacaggttt

SEQ ID NO: 643742 - DNA, 20 bp, Artificial
  CRISPR gRNA sequence
catttctaacaggtttctta

SEQ ID NO: 643743 - DNA, 20 bp, Artificial
  CRISPR gRNA sequence
ctaacaggtttcttaaaatt

SEQ ID NO: 643744 - DNA, 20 bp, Artificial
  CRISPR gRNA sequence
taacaggtttcttaaaattg

SEQ ID NO: 643745 - DNA, 20 bp, Artificial
  CRISPR gRNA sequence
acaggtttcttaaaattgaa

SEQ ID NO: 643746 - DNA, 20 bp, Artificial
  CRISPR gRNA sequence
cttaaaattgaagtctcaaa

SEQ ID NO: 643747 - DNA, 20 bp, Artificial
  CRISPR gRNA sequence
ttaaaattgaagtctcaaag

SEQ ID NO: 643748 - DNA, 20 bp, Artificial
  CRISPR gRNA sequence
aaaattgaagtctcaaagaa

SEQ ID NO: 643749 - DNA, 20 bp, Artificial
  CRISPR gRNA sequence
aaattgaagtctcaaagaag

SEQ ID NO: 643750 - DNA, 20 bp, Artificial
  CRISPR gRNA sequence
aagtctcaaagaaggcatta

SEQ ID NO: 643751 - DNA, 20 bp, Artificial
  CRISPR gRNA sequence
aaagaaggcattattaggtg

SEQ ID NO: 643752 - DNA, 20 bp, Artificial
  CRISPR gRNA sequence
ttaggtgaaaagagaggcaa

SEQ ID NO: 643753 - DNA, 20 bp, Artificial
  CRISPR gRNA sequence
ggtgaaaagagaggcaagcg

SEQ ID NO: 643754 - DNA, 20 bp, Artificial
  CRISPR gRNA sequence
taaagttcccatatataaaa

SEQ ID NO: 643755 - DNA, 20 bp, Artificial
  CRISPR gRNA sequence
ccatatataaaactgccgtc

SEQ ID NO: 643756 - DNA, 20 bp, Artificial
  CRISPR gRNA sequence
ccgtccaaaatgaggtgtca

SEQ ID NO: 643757 - DNA, 20 bp, Artificial
  CRISPR gRNA sequence
aaacttgcatgagtactgtg

SEQ ID NO: 643758 - DNA, 20 bp, Artificial
  CRISPR gRNA sequence
aacttgcatgagtactgtgt

SEQ ID NO: 643759 - DNA, 20 bp, Artificial
  CRISPR gRNA sequence
gcatgagtactgtgtcaaaa

SEQ ID NO: 643760 - DNA, 20 bp, Artificial
  CRISPR gRNA sequence
catgagtactgtgtcaaaac

SEQ ID NO: 643761 - DNA, 20 bp, Artificial
  CRISPR gRNA sequence
tgtcaaaacaacattaccaa

SEQ ID NO: 643762 - DNA, 20 bp, Artificial
  CRISPR gRNA sequence
ccaatgtaatgctatcaata

SEQ ID NO: 643763 - DNA, 20 bp, Artificial
  CRISPR gRNA sequence
tcaataaaaccaatacaatg

SEQ ID NO: 643764 - DNA, 20 bp, Artificial
  CRISPR gRNA sequence
ttgatgttaaacaatctcag

SEQ ID NO: 643765 - DNA, 20 bp, Artificial
  CRISPR gRNA sequence
atgttaaacaatctcagtag

SEQ ID NO: 643766 - DNA, 20 bp, Artificial
  CRISPR gRNA sequence
aacaatctcagtagctttca

SEQ ID NO: 643767 - DNA, 20 bp, Artificial
  CRISPR gRNA sequence
agtagctttcatcatttata

SEQ ID NO: 643768 - DNA, 20 bp, Artificial
  CRISPR gRNA sequence
tcatcatttataatatggtg

SEQ ID NO: 643769 - DNA, 20 bp, Artificial
  CRISPR gRNA sequence
catcatttataatatggtga

SEQ ID NO: 643770 - DNA, 20 bp, Artificial
  CRISPR gRNA sequence
atcatttataatatggtgag

SEQ ID NO: 643771 - DNA, 20 bp, Artificial
  CRISPR gRNA sequence
ataatatggtgagtaaaaca

SEQ ID NO: 643772 - DNA, 20 bp, Artificial
  CRISPR gRNA sequence
taatatggtgagtaaaacat

SEQ ID NO: 643773 - DNA, 20 bp, Artificial
  CRISPR gRNA sequence
tattattttaaagtgtattt

SEQ ID NO: 643774 - DNA, 20 bp, Artificial
  CRISPR gRNA sequence
attattttaaagtgtattta

SEQ ID NO: 643775 - DNA, 20 bp, Artificial
  CRISPR gRNA sequence
ttattttaaagtgtatttat

SEQ ID NO: 643776 - DNA, 20 bp, Artificial
  CRISPR gRNA sequence
ttttaaagtgtatttatttc

SEQ ID NO: 643777 - DNA, 20 bp, Artificial
  CRISPR gRNA sequence
taaagtgtatttatttcatt

SEQ ID NO: 643778 - DNA, 20 bp, Artificial
  CRISPR gRNA sequence
aaagtgtatttatttcattg

SEQ ID NO: 643779 - DNA, 20 bp, Artificial
  CRISPR gRNA sequence
aagtgtatttatttcattga

SEQ ID NO: 643780 - DNA, 20 bp, Artificial
  CRISPR gRNA sequence
atttcattgattggaaataa

SEQ ID NO: 643781 - DNA, 20 bp, Artificial
  CRISPR gRNA sequence
tttcattgattggaaataaa

SEQ ID NO: 643782 - DNA, 20 bp, Artificial
  CRISPR gRNA sequence
cattgattggaaataaattt

SEQ ID NO: 643783 - DNA, 20 bp, Artificial
  CRISPR gRNA sequence
attgattggaaataaatttg

SEQ ID NO: 643784 - DNA, 20 bp, Artificial
  CRISPR gRNA sequence
attggaaataaatttgtcgc

SEQ ID NO: 643785 - DNA, 20 bp, Artificial
  CRISPR gRNA sequence
gaaataaatttgtcgcgtta

SEQ ID NO: 643786 - DNA, 20 bp, Artificial
  CRISPR gRNA sequence
gtcgcgttaattattaattc

SEQ ID NO: 643787 - DNA, 20 bp, Artificial
  CRISPR gRNA sequence
tcgcgttaattattaattcc

SEQ ID NO: 643788 - DNA, 20 bp, Artificial
  CRISPR gRNA sequence
attattaattcctgagatta

SEQ ID NO: 643789 - DNA, 20 bp, Artificial
  CRISPR gRNA sequence
ttaattcctgagattacaaa

SEQ ID NO: 643790 - DNA, 20 bp, Artificial
  CRISPR gRNA sequence
attcctgagattacaaaagt

SEQ ID NO: 643791 - DNA, 20 bp, Artificial
  CRISPR gRNA sequence
ctgagattacaaaagttttt

SEQ ID NO: 643792 - DNA, 20 bp, Artificial
  CRISPR gRNA sequence
agattacaaaagtttttttg

SEQ ID NO: 643793 - DNA, 20 bp, Artificial
  CRISPR gRNA sequence
caaaagtttttttgaaaaac

SEQ ID NO: 643794 - DNA, 20 bp, Artificial
  CRISPR gRNA sequence
ttttgaaaaacgccaattta

SEQ ID NO: 643795 - DNA, 20 bp, Artificial
  CRISPR gRNA sequence
tttgaaaaacgccaatttaa

SEQ ID NO: 643796 - DNA, 20 bp, Artificial
  CRISPR gRNA sequence
ttgaaaaacgccaatttaaa

SEQ ID NO: 643797 - DNA, 20 bp, Artificial
  CRISPR gRNA sequence
tgaaaaacgccaatttaaaa

SEQ ID NO: 643798 - DNA, 20 bp, Artificial
  CRISPR gRNA sequence
gaaaaacgccaatttaaaat

SEQ ID NO: 643799 - DNA, 20 bp, Artificial
  CRISPR gRNA sequence
aaaaacgccaatttaaaatc

SEQ ID NO: 643800 - DNA, 20 bp, Artificial
  CRISPR gRNA sequence
aaaatcaattattgaaagac

SEQ ID NO: 643801 - DNA, 20 bp, Artificial
  CRISPR gRNA sequence
aaatcaattattgaaagact

SEQ ID NO: 643802 - DNA, 20 bp, Artificial
  CRISPR gRNA sequence
ttgaaagactaaactattat

SEQ ID NO: 643803 - DNA, 20 bp, Artificial
  CRISPR gRNA sequence
aaagactaaactattatttt

SEQ ID NO: 643804 - DNA, 20 bp, Artificial
  CRISPR gRNA sequence
aactattattttctatattt

SEQ ID NO: 643805 - DNA, 20 bp, Artificial
  CRISPR gRNA sequence
ttattttctatatttttaaa

SEQ ID NO: 643806 - DNA, 20 bp, Artificial
  CRISPR gRNA sequence
ttttctatatttttaaagac

SEQ ID NO: 643807 - DNA, 20 bp, Artificial
  CRISPR gRNA sequence
tctatatttttaaagaccaa

SEQ ID NO: 643808 - DNA, 20 bp, Artificial
  CRISPR gRNA sequence
ctatatttttaaagaccaag

SEQ ID NO: 643809 - DNA, 20 bp, Artificial
  CRISPR gRNA sequence
tatatttttaaagaccaaga

SEQ ID NO: 643810 - DNA, 20 bp, Artificial
  CRISPR gRNA sequence
tatttttaaagaccaagaga

SEQ ID NO: 643811 - DNA, 20 bp, Artificial
  CRISPR gRNA sequence
ttaaagaccaagagataata

SEQ ID NO: 643812 - DNA, 20 bp, Artificial
  CRISPR gRNA sequence
taaagaccaagagataatac

SEQ ID NO: 643813 - DNA, 20 bp, Artificial
  CRISPR gRNA sequence
aaagaccaagagataataca

SEQ ID NO: 643814 - DNA, 20 bp, Artificial
  CRISPR gRNA sequence
aagaccaagagataatacat

SEQ ID NO: 643815 - DNA, 20 bp, Artificial
  CRISPR gRNA sequence
atggcatgcagtttaatgag

SEQ ID NO: 643816 - DNA, 20 bp, Artificial
  CRISPR gRNA sequence
aatgagataattaattagct

SEQ ID NO: 643817 - DNA, 20 bp, Artificial
  CRISPR gRNA sequence
atgagataattaattagctt

SEQ ID NO: 643818 - DNA, 20 bp, Artificial
  CRISPR gRNA sequence
attagctttttatgctaatt

SEQ ID NO: 643819 - DNA, 20 bp, Artificial
  CRISPR gRNA sequence
gctttttatgctaattagta

SEQ ID NO: 643820 - DNA, 20 bp, Artificial
  CRISPR gRNA sequence
tttatgctaattagtacaac

SEQ ID NO: 643821 - DNA, 20 bp, Artificial
  CRISPR gRNA sequence
ttatgctaattagtacaact

SEQ ID NO: 643822 - DNA, 20 bp, Artificial
  CRISPR gRNA sequence
tatgctaattagtacaactg

SEQ ID NO: 643823 - DNA, 20 bp, Artificial
  CRISPR gRNA sequence
atgctaattagtacaactgg

SEQ ID NO: 643824 - DNA, 20 bp, Artificial
  CRISPR gRNA sequence
tgctaattagtacaactggg

SEQ ID NO: 643825 - DNA, 20 bp, Artificial
  CRISPR gRNA sequence
attagtacaactgggaatca

SEQ ID NO: 643826 - DNA, 20 bp, Artificial
  CRISPR gRNA sequence
gtacaactgggaatcattct

SEQ ID NO: 643827 - DNA, 20 bp, Artificial
  CRISPR gRNA sequence
ggaatcattctagttaacta

SEQ ID NO: 643828 - DNA, 20 bp, Artificial
  CRISPR gRNA sequence
tagttaactatggtgattct

SEQ ID NO: 643829 - DNA, 20 bp, Artificial
  CRISPR gRNA sequence
gttaactatggtgattctaa

SEQ ID NO: 643830 - DNA, 20 bp, Artificial
  CRISPR gRNA sequence
actatggtgattctaaaaaa

SEQ ID NO: 643831 - DNA, 20 bp, Artificial
  CRISPR gRNA sequence
tggtgattctaaaaaatatg

SEQ ID NO: 643832 - DNA, 20 bp, Artificial
  CRISPR gRNA sequence
taaaaaatatgcaatagttg

SEQ ID NO: 643833 - DNA, 20 bp, Artificial
  CRISPR gRNA sequence
aaaaatatgcaatagttgga

SEQ ID NO: 643834 - DNA, 20 bp, Artificial
  CRISPR gRNA sequence
gaaataatcagatttataat

SEQ ID NO: 643835 - DNA, 20 bp, Artificial
  CRISPR gRNA sequence
ataataatataaattgatat

SEQ ID NO: 643836 - DNA, 20 bp, Artificial
  CRISPR gRNA sequence
taataatataaattgatata

SEQ ID NO: 643837 - DNA, 20 bp, Artificial
  CRISPR gRNA sequence
atataaaatatttcaaaatg

SEQ ID NO: 643838 - DNA, 20 bp, Artificial
  CRISPR gRNA sequence
caaaatgttttattagttaa

SEQ ID NO: 643839 - DNA, 20 bp, Artificial
  CRISPR gRNA sequence
aaaatgttttattagttaat

SEQ ID NO: 643840 - DNA, 20 bp, Artificial
  CRISPR gRNA sequence
tattagttaataatcatatc

SEQ ID NO: 643841 - DNA, 20 bp, Artificial
  CRISPR gRNA sequence
attagttaataatcatatct

SEQ ID NO: 643842 - DNA, 20 bp, Artificial
  CRISPR gRNA sequence
ttagttaataatcatatcta

SEQ ID NO: 643843 - DNA, 20 bp, Artificial
  CRISPR gRNA sequence
gttaataatcatatctaaag

SEQ ID NO: 643844 - DNA, 20 bp, Artificial
  CRISPR gRNA sequence
ataatcatatctaaagaatt

SEQ ID NO: 643845 - DNA, 20 bp, Artificial
  CRISPR gRNA sequence
aagaattaaacttctatctc

SEQ ID NO: 643846 - DNA, 20 bp, Artificial
  CRISPR gRNA sequence
aacttctatctctgccataa

SEQ ID NO: 643847 - DNA, 20 bp, Artificial
  CRISPR gRNA sequence
ctatctctgccataattgaa

SEQ ID NO: 643848 - DNA, 20 bp, Artificial
  CRISPR gRNA sequence
tatctctgccataattgaaa

SEQ ID NO: 643849 - DNA, 20 bp, Artificial
  CRISPR gRNA sequence
tctctgccataattgaaaaa

SEQ ID NO: 643850 - DNA, 20 bp, Artificial
  CRISPR gRNA sequence
tgccataattgaaaaataaa

SEQ ID NO: 643851 - DNA, 20 bp, Artificial
  CRISPR gRNA sequence
ccataattgaaaaataaaat

SEQ ID NO: 643852 - DNA, 20 bp, Artificial
  CRISPR gRNA sequence
aaaaataaaataaaaataaa

SEQ ID NO: 643853 - DNA, 20 bp, Artificial
  CRISPR gRNA sequence
aacaccatgaagcaaacagt

SEQ ID NO: 643854 - DNA, 20 bp, Artificial
  CRISPR gRNA sequence
cactgtataacctgtataac

SEQ ID NO: 643855 - DNA, 20 bp, Artificial
  CRISPR gRNA sequence
tataacctgtataacatatt

SEQ ID NO: 643856 - DNA, 20 bp, Artificial
  CRISPR gRNA sequence
tataacatattaccaaatat

SEQ ID NO: 643857 - DNA, 20 bp, Artificial
  CRISPR gRNA sequence
ccaaatatctctctctgggc

SEQ ID NO: 643858 - DNA, 20 bp, Artificial
  CRISPR gRNA sequence
tctctgggctattttttccc

SEQ ID NO: 643859 - DNA, 20 bp, Artificial
  CRISPR gRNA sequence
tctgggctattttttcccca

SEQ ID NO: 643860 - DNA, 20 bp, Artificial
  CRISPR gRNA sequence
tgggctattttttccccata

SEQ ID NO: 643861 - DNA, 20 bp, Artificial
  CRISPR gRNA sequence
ggctattttttccccatatt

SEQ ID NO: 643862 - DNA, 20 bp, Artificial
  CRISPR gRNA sequence
ttttttccccatatttcttg

SEQ ID NO: 643863 - DNA, 20 bp, Artificial
  CRISPR gRNA sequence
tttccccatatttcttgatg

SEQ ID NO: 643864 - DNA, 20 bp, Artificial
  CRISPR gRNA sequence
ttccccatatttcttgatga

SEQ ID NO: 643865 - DNA, 20 bp, Artificial
  CRISPR gRNA sequence
tccccatatttcttgatgac

SEQ ID NO: 643866 - DNA, 20 bp, Artificial
  CRISPR gRNA sequence
ccccatatttcttgatgaca

SEQ ID NO: 643867 - DNA, 20 bp, Artificial
  CRISPR gRNA sequence
cccatatttcttgatgacat

SEQ ID NO: 643868 - DNA, 20 bp, Artificial
  CRISPR gRNA sequence
cttgatgacatacttttaaa

SEQ ID NO: 643869 - DNA, 20 bp, Artificial
  CRISPR gRNA sequence
ttgatgacatacttttaaaa

SEQ ID NO: 643870 - DNA, 20 bp, Artificial
  CRISPR gRNA sequence
gatgacatacttttaaaatc

SEQ ID NO: 643871 - DNA, 20 bp, Artificial
  CRISPR gRNA sequence
atgacatacttttaaaatcc

SEQ ID NO: 643872 - DNA, 20 bp, Artificial
  CRISPR gRNA sequence
ttaaaatcctaacattcact

SEQ ID NO: 643873 - DNA, 20 bp, Artificial
  CRISPR gRNA sequence
taaaatcctaacattcactc

SEQ ID NO: 643874 - DNA, 20 bp, Artificial
  CRISPR gRNA sequence
aaaatcctaacattcactct

SEQ ID NO: 643875 - DNA, 20 bp, Artificial
  CRISPR gRNA sequence
aaatcctaacattcactctt

SEQ ID NO: 643876 - DNA, 20 bp, Artificial
  CRISPR gRNA sequence
acattcactcttgatttcat

SEQ ID NO: 643877 - DNA, 20 bp, Artificial
  CRISPR gRNA sequence
actcttgatttcatatgtta

SEQ ID NO: 643878 - DNA, 20 bp, Artificial
  CRISPR gRNA sequence
ttgatttcatatgttaaagt

SEQ ID NO: 643879 - DNA, 20 bp, Artificial
  CRISPR gRNA sequence
gatttcatatgttaaagtat

SEQ ID NO: 643880 - DNA, 20 bp, Artificial
  CRISPR gRNA sequence
atttcatatgttaaagtatt

SEQ ID NO: 643881 - DNA, 20 bp, Artificial
  CRISPR gRNA sequence
catatgttaaagtattcaga

SEQ ID NO: 643882 - DNA, 20 bp, Artificial
  CRISPR gRNA sequence
atatgttaaagtattcagaa

SEQ ID NO: 643883 - DNA, 20 bp, Artificial
  CRISPR gRNA sequence
aagtattcagaaaccttcac

SEQ ID NO: 643884 - DNA, 20 bp, Artificial
  CRISPR gRNA sequence
agaaaccttcacatttagcc

SEQ ID NO: 643885 - DNA, 20 bp, Artificial
  CRISPR gRNA sequence
cacatttagcctttatgtcc

SEQ ID NO: 643886 - DNA, 20 bp, Artificial
  CRISPR gRNA sequence
acatttagcctttatgtcca

SEQ ID NO: 643887 - DNA, 20 bp, Artificial
  CRISPR gRNA sequence
agcctttatgtccagtagat

SEQ ID NO: 643888 - DNA, 20 bp, Artificial
  CRISPR gRNA sequence
gcctttatgtccagtagatg

SEQ ID NO: 643889 - DNA, 20 bp, Artificial
  CRISPR gRNA sequence
tatgtccagtagatgagtta

SEQ ID NO: 643890 - DNA, 20 bp, Artificial
  CRISPR gRNA sequence
atgtccagtagatgagttat

SEQ ID NO: 643891 - DNA, 20 bp, Artificial
  CRISPR gRNA sequence
tgtccagtagatgagttatt

SEQ ID NO: 643892 - DNA, 20 bp, Artificial
  CRISPR gRNA sequence
ttcaaatgacttttaagatc

SEQ ID NO: 643893 - DNA, 20 bp, Artificial
  CRISPR gRNA sequence
aaatgacttttaagatcagt

SEQ ID NO: 643894 - DNA, 20 bp, Artificial
  CRISPR gRNA sequence
ttaagatcagtcataccctt

SEQ ID NO: 643895 - DNA, 20 bp, Artificial
  CRISPR gRNA sequence
taagatcagtcatacccttg

SEQ ID NO: 643896 - DNA, 20 bp, Artificial
  CRISPR gRNA sequence
aagatcagtcatacccttga

SEQ ID NO: 643897 - DNA, 20 bp, Artificial
  CRISPR gRNA sequence
agatcagtcatacccttgag

SEQ ID NO: 643898 - DNA, 20 bp, Artificial
  CRISPR gRNA sequence
gagattctatgacttacaaa

SEQ ID NO: 643899 - DNA, 20 bp, Artificial
  CRISPR gRNA sequence
agattctatgacttacaaaa

SEQ ID NO: 643900 - DNA, 20 bp, Artificial
  CRISPR gRNA sequence
tatgacttacaaaatataat

SEQ ID NO: 643901 - DNA, 20 bp, Artificial
  CRISPR gRNA sequence
tgacttacaaaatataatta

SEQ ID NO: 643902 - DNA, 20 bp, Artificial
  CRISPR gRNA sequence
acaaaatataattaaactta

SEQ ID NO: 643903 - DNA, 20 bp, Artificial
  CRISPR gRNA sequence
caaaatataattaaacttaa

SEQ ID NO: 643904 - DNA, 20 bp, Artificial
  CRISPR gRNA sequence
aacttaattaataactcttt

SEQ ID NO: 643905 - DNA, 20 bp, Artificial
  CRISPR gRNA sequence
aattaataactctttaagaa

SEQ ID NO: 643906 - DNA, 20 bp, Artificial
  CRISPR gRNA sequence
attaataactctttaagaac

SEQ ID NO: 643907 - DNA, 20 bp, Artificial
  CRISPR gRNA sequence
ataactctttaagaactgat

SEQ ID NO: 643908 - DNA, 20 bp, Artificial
  CRISPR gRNA sequence
tttaagaactgatttcatca

SEQ ID NO: 643909 - DNA, 20 bp, Artificial
  CRISPR gRNA sequence
taagaactgatttcatcata

SEQ ID NO: 643910 - DNA, 20 bp, Artificial
  CRISPR gRNA sequence
aagaactgatttcatcatat

SEQ ID NO: 643911 - DNA, 20 bp, Artificial
  CRISPR gRNA sequence
agaactgatttcatcatata

SEQ ID NO: 643912 - DNA, 20 bp, Artificial
  CRISPR gRNA sequence
atttcatcatatataagcag

SEQ ID NO: 643913 - DNA, 20 bp, Artificial
  CRISPR gRNA sequence
catcatatataagcagaaat

SEQ ID NO: 643914 - DNA, 20 bp, Artificial
  CRISPR gRNA sequence
atcatatataagcagaaatt

SEQ ID NO: 643915 - DNA, 20 bp, Artificial
  CRISPR gRNA sequence
tgactcctatattacgggtg

SEQ ID NO: 643916 - DNA, 20 bp, Artificial
  CRISPR gRNA sequence
ctatattacgggtgattgta

SEQ ID NO: 643917 - DNA, 20 bp, Artificial
  CRISPR gRNA sequence
tattacgggtgattgtatca

SEQ ID NO: 643918 - DNA, 20 bp, Artificial
  CRISPR gRNA sequence
cgggtgattgtatcatagaa

SEQ ID NO: 643919 - DNA, 20 bp, Artificial
  CRISPR gRNA sequence
tatcatagaacctgacacac

SEQ ID NO: 643920 - DNA, 20 bp, Artificial
  CRISPR gRNA sequence
acacacagcacacggaagtg

SEQ ID NO: 643921 - DNA, 20 bp, Artificial
  CRISPR gRNA sequence
aataaatgccattccctttc

SEQ ID NO: 643922 - DNA, 20 bp, Artificial
  CRISPR gRNA sequence
cctttcccctaacttccagc

SEQ ID NO: 643923 - DNA, 20 bp, Artificial
  CRISPR gRNA sequence
tcccctaacttccagctctc

SEQ ID NO: 643924 - DNA, 20 bp, Artificial
  CRISPR gRNA sequence
cccctaacttccagctctcc

SEQ ID NO: 643925 - DNA, 20 bp, Artificial
  CRISPR gRNA sequence
ccctaacttccagctctccc

SEQ ID NO: 643926 - DNA, 20 bp, Artificial
  CRISPR gRNA sequence
acttccagctctccccctct

SEQ ID NO: 643927 - DNA, 20 bp, Artificial
  CRISPR gRNA sequence
ccagctctccccctctgctc

SEQ ID NO: 643928 - DNA, 20 bp, Artificial
  CRISPR gRNA sequence
cagctctccccctctgctct

SEQ ID NO: 643929 - DNA, 20 bp, Artificial
  CRISPR gRNA sequence
tccccctctgctctctatca

SEQ ID NO: 643930 - DNA, 20 bp, Artificial
  CRISPR gRNA sequence
cccctctgctctctatcaat

SEQ ID NO: 643931 - DNA, 20 bp, Artificial
  CRISPR gRNA sequence
tgctctctatcaatatgtac

SEQ ID NO: 643932 - DNA, 20 bp, Artificial
  CRISPR gRNA sequence
ctctctatcaatatgtactt

SEQ ID NO: 643933 - DNA, 20 bp, Artificial
  CRISPR gRNA sequence
tctatcaatatgtacttgtt

SEQ ID NO: 643934 - DNA, 20 bp, Artificial
  CRISPR gRNA sequence
tatcaatatgtacttgttga

SEQ ID NO: 643935 - DNA, 20 bp, Artificial
  CRISPR gRNA sequence
tcaatatgtacttgttgaca

SEQ ID NO: 643936 - DNA, 20 bp, Artificial
  CRISPR gRNA sequence
gttgacaaatcaaattttat

SEQ ID NO: 643937 - DNA, 20 bp, Artificial
  CRISPR gRNA sequence
ttgacaaatcaaattttatt

SEQ ID NO: 643938 - DNA, 20 bp, Artificial
  CRISPR gRNA sequence
acaaatcaaattttatttgt

SEQ ID NO: 643939 - DNA, 20 bp, Artificial
  CRISPR gRNA sequence
tatttgtaattaaaaggtga

SEQ ID NO: 643940 - DNA, 20 bp, Artificial
  CRISPR gRNA sequence
atttgtaattaaaaggtgaa

SEQ ID NO: 643941 - DNA, 20 bp, Artificial
  CRISPR gRNA sequence
tttgtaattaaaaggtgaaa

SEQ ID NO: 643942 - DNA, 20 bp, Artificial
  CRISPR gRNA sequence
gtaattaaaaggtgaaaaaa

SEQ ID NO: 643943 - DNA, 20 bp, Artificial
  CRISPR gRNA sequence
taattaaaaggtgaaaaaat

SEQ ID NO: 643944 - DNA, 20 bp, Artificial
  CRISPR gRNA sequence
aaaggtgaaaaaatataatt

SEQ ID NO: 643945 - DNA, 20 bp, Artificial
  CRISPR gRNA sequence
catatttacaatatctattg

SEQ ID NO: 643946 - DNA, 20 bp, Artificial
  CRISPR gRNA sequence
acaatatctattgtcaaaca

SEQ ID NO: 643947 - DNA, 20 bp, Artificial
  CRISPR gRNA sequence
caatatctattgtcaaacat

SEQ ID NO: 643948 - DNA, 20 bp, Artificial
  CRISPR gRNA sequence
ttgtcaaacatccttacctt

SEQ ID NO: 643949 - DNA, 20 bp, Artificial
  CRISPR gRNA sequence
tcaaacatccttaccttaaa

SEQ ID NO: 643950 - DNA, 20 bp, Artificial
  CRISPR gRNA sequence
accttaaattaatggttgaa

SEQ ID NO: 643951 - DNA, 20 bp, Artificial
  CRISPR gRNA sequence
ccttaaattaatggttgaat

SEQ ID NO: 643952 - DNA, 20 bp, Artificial
  CRISPR gRNA sequence
aaattaatggttgaatgtaa

SEQ ID NO: 643953 - DNA, 20 bp, Artificial
  CRISPR gRNA sequence
aattaatggttgaatgtaat

SEQ ID NO: 643954 - DNA, 20 bp, Artificial
  CRISPR gRNA sequence
atggttgaatgtaatctggc

SEQ ID NO: 643955 - DNA, 20 bp, Artificial
  CRISPR gRNA sequence
aatgtaatctggcaaggaac

SEQ ID NO: 643956 - DNA, 20 bp, Artificial
  CRISPR gRNA sequence
gcaaggaacagaagtatatc

SEQ ID NO: 643957 - DNA, 20 bp, Artificial
  CRISPR gRNA sequence
ctaattctatatttttgaaa

SEQ ID NO: 643958 - DNA, 20 bp, Artificial
  CRISPR gRNA sequence
taattctatatttttgaaaa

SEQ ID NO: 643959 - DNA, 20 bp, Artificial
  CRISPR gRNA sequence
attctatatttttgaaaaag

SEQ ID NO: 643960 - DNA, 20 bp, Artificial
  CRISPR gRNA sequence
tatatttttgaaaaagaccc

SEQ ID NO: 643961 - DNA, 20 bp, Artificial
  CRISPR gRNA sequence
tatttttgaaaaagacccta

SEQ ID NO: 643962 - DNA, 20 bp, Artificial
  CRISPR gRNA sequence
ttgaaaaagaccctataaat

SEQ ID NO: 643963 - DNA, 20 bp, Artificial
  CRISPR gRNA sequence
tgaaaaagaccctataaatt

SEQ ID NO: 643964 - DNA, 20 bp, Artificial
  CRISPR gRNA sequence
gaaaaagaccctataaatta

SEQ ID NO: 643965 - DNA, 20 bp, Artificial
  CRISPR gRNA sequence
aaaaagaccctataaattag

SEQ ID NO: 643966 - DNA, 20 bp, Artificial
  CRISPR gRNA sequence
taaattagagaaagcttttt

SEQ ID NO: 643967 - DNA, 20 bp, Artificial
  CRISPR gRNA sequence
gagaaagctttttttacaag

SEQ ID NO: 643968 - DNA, 20 bp, Artificial
  CRISPR gRNA sequence
tttttacaagagtgattaaa

SEQ ID NO: 643969 - DNA, 20 bp, Artificial
  CRISPR gRNA sequence
ttttacaagagtgattaaaa

SEQ ID NO: 643970 - DNA, 20 bp, Artificial
  CRISPR gRNA sequence
tttacaagagtgattaaaac

SEQ ID NO: 643971 - DNA, 20 bp, Artificial
  CRISPR gRNA sequence
ttacaagagtgattaaaaca

SEQ ID NO: 643972 - DNA, 20 bp, Artificial
  CRISPR gRNA sequence
tacaagagtgattaaaacag

SEQ ID NO: 643973 - DNA, 20 bp, Artificial
  CRISPR gRNA sequence
acaagagtgattaaaacagt

SEQ ID NO: 643974 - DNA, 20 bp, Artificial
  CRISPR gRNA sequence
caagagtgattaaaacagtt

SEQ ID NO: 643975 - DNA, 20 bp, Artificial
  CRISPR gRNA sequence
aaacagttaacatgaattaa

SEQ ID NO: 643976 - DNA, 20 bp, Artificial
  CRISPR gRNA sequence
acatgaattaatcaatctca

SEQ ID NO: 643977 - DNA, 20 bp, Artificial
  CRISPR gRNA sequence
atcaatctcaaaaaagtcac

SEQ ID NO: 643978 - DNA, 20 bp, Artificial
  CRISPR gRNA sequence
aaaaaagtcacagaagttag

SEQ ID NO: 643979 - DNA, 20 bp, Artificial
  CRISPR gRNA sequence
ggtcagtgatatcattctat

SEQ ID NO: 643980 - DNA, 20 bp, Artificial
  CRISPR gRNA sequence
tatatccatggctctagacc

SEQ ID NO: 643981 - DNA, 20 bp, Artificial
  CRISPR gRNA sequence
tatccatggctctagacctt

SEQ ID NO: 643982 - DNA, 20 bp, Artificial
  CRISPR gRNA sequence
tagaccttcactgtgcatca

SEQ ID NO: 643983 - DNA, 20 bp, Artificial
  CRISPR gRNA sequence
gaccttcactgtgcatcaga

SEQ ID NO: 643984 - DNA, 20 bp, Artificial
  CRISPR gRNA sequence
cactgtgcatcagaattatc

SEQ ID NO: 643985 - DNA, 20 bp, Artificial
  CRISPR gRNA sequence
actgtgcatcagaattatct

SEQ ID NO: 643986 - DNA, 20 bp, Artificial
  CRISPR gRNA sequence
tgcatcagaattatctgggg

SEQ ID NO: 643987 - DNA, 20 bp, Artificial
  CRISPR gRNA sequence
tctggggaaattaataaatc

SEQ ID NO: 643988 - DNA, 20 bp, Artificial
  CRISPR gRNA sequence
gggaaattaataaatcatta

SEQ ID NO: 643989 - DNA, 20 bp, Artificial
  CRISPR gRNA sequence
ataaatcattatcaatgcct

SEQ ID NO: 643990 - DNA, 20 bp, Artificial
  CRISPR gRNA sequence
tcaatgcctgagccctaccc

SEQ ID NO: 643991 - DNA, 20 bp, Artificial
  CRISPR gRNA sequence
agccctacccctatttttat

SEQ ID NO: 643992 - DNA, 20 bp, Artificial
  CRISPR gRNA sequence
cccctatttttattaaattg

SEQ ID NO: 643993 - DNA, 20 bp, Artificial
  CRISPR gRNA sequence
tttttattaaattggtatgg

SEQ ID NO: 643994 - DNA, 20 bp, Artificial
  CRISPR gRNA sequence
ttattaaattggtatgggat

SEQ ID NO: 643995 - DNA, 20 bp, Artificial
  CRISPR gRNA sequence
tattaaattggtatgggatg

SEQ ID NO: 643996 - DNA, 20 bp, Artificial
  CRISPR gRNA sequence
attaaattggtatgggatgg

SEQ ID NO: 643997 - DNA, 20 bp, Artificial
  CRISPR gRNA sequence
ttaaattggtatgggatggg

SEQ ID NO: 643998 - DNA, 20 bp, Artificial
  CRISPR gRNA sequence
aattggtatgggatggggta

SEQ ID NO: 643999 - DNA, 20 bp, Artificial
  CRISPR gRNA sequence
gtatgggatggggtaaaaat

SEQ ID NO: 644000 - DNA, 20 bp, Artificial
  CRISPR gRNA sequence
tttaaacatatccagatgat

SEQ ID NO: 644001 - DNA, 20 bp, Artificial
  CRISPR gRNA sequence
ttaaacatatccagatgatt

SEQ ID NO: 644002 - DNA, 20 bp, Artificial
  CRISPR gRNA sequence
taaacatatccagatgattc

SEQ ID NO: 644003 - DNA, 20 bp, Artificial
  CRISPR gRNA sequence
aaacatatccagatgattct

SEQ ID NO: 644004 - DNA, 20 bp, Artificial
  CRISPR gRNA sequence
aacatatccagatgattcta

SEQ ID NO: 644005 - DNA, 20 bp, Artificial
  CRISPR gRNA sequence
taatgtgcagccaaagttga

SEQ ID NO: 644006 - DNA, 20 bp, Artificial
  CRISPR gRNA sequence
atgtgcagccaaagttgaga

SEQ ID NO: 644007 - DNA, 20 bp, Artificial
  CRISPR gRNA sequence
agaaccaccattctacatat

SEQ ID NO: 644008 - DNA, 20 bp, Artificial
  CRISPR gRNA sequence
tacatattgagaagaaataa

SEQ ID NO: 644009 - DNA, 20 bp, Artificial
  CRISPR gRNA sequence
catattgagaagaaataaat

SEQ ID NO: 644010 - DNA, 20 bp, Artificial
  CRISPR gRNA sequence
agaagaaataaattacagag

SEQ ID NO: 644011 - DNA, 20 bp, Artificial
  CRISPR gRNA sequence
cagagtagagcaactcgcaa

SEQ ID NO: 644012 - DNA, 20 bp, Artificial
  CRISPR gRNA sequence
gcaaaatgagactagaatcc

SEQ ID NO: 644013 - DNA, 20 bp, Artificial
  CRISPR gRNA sequence
gaatccaagtttccaatttt

SEQ ID NO: 644014 - DNA, 20 bp, Artificial
  CRISPR gRNA sequence
ccaattttaggacttacaag

SEQ ID NO: 644015 - DNA, 20 bp, Artificial
  CRISPR gRNA sequence
caattttaggacttacaaga

SEQ ID NO: 644016 - DNA, 20 bp, Artificial
  CRISPR gRNA sequence
taggacttacaagaaaatct

SEQ ID NO: 644017 - DNA, 20 bp, Artificial
  CRISPR gRNA sequence
aggacttacaagaaaatctc

SEQ ID NO: 644018 - DNA, 20 bp, Artificial
  CRISPR gRNA sequence
ggacttacaagaaaatctcc

SEQ ID NO: 644019 - DNA, 20 bp, Artificial
  CRISPR gRNA sequence
acaagaaaatctcctcctgg

SEQ ID NO: 644020 - DNA, 20 bp, Artificial
  CRISPR gRNA sequence
caagaaaatctcctcctgga

SEQ ID NO: 644021 - DNA, 20 bp, Artificial
  CRISPR gRNA sequence
ctcctggaatcaaaagaggt

SEQ ID NO: 644022 - DNA, 20 bp, Artificial
  CRISPR gRNA sequence
ctggaatcaaaagaggtttg

SEQ ID NO: 644023 - DNA, 20 bp, Artificial
  CRISPR gRNA sequence
gaatcaaaagaggtttgaat

SEQ ID NO: 644024 - DNA, 20 bp, Artificial
  CRISPR gRNA sequence
gaatgtacattatataatat

SEQ ID NO: 644025 - DNA, 20 bp, Artificial
  CRISPR gRNA sequence
aatgtacattatataatatg

SEQ ID NO: 644026 - DNA, 20 bp, Artificial
  CRISPR gRNA sequence
tataatatgaagatatttaa

SEQ ID NO: 644027 - DNA, 20 bp, Artificial
  CRISPR gRNA sequence
aaacatattgaggcacccat

SEQ ID NO: 644028 - DNA, 20 bp, Artificial
  CRISPR gRNA sequence
aacatattgaggcacccatg

SEQ ID NO: 644029 - DNA, 20 bp, Artificial
  CRISPR gRNA sequence
aggcacccatgacatttaat

SEQ ID NO: 644030 - DNA, 20 bp, Artificial
  CRISPR gRNA sequence
aattggcattcaaccttaca

SEQ ID NO: 644031 - DNA, 20 bp, Artificial
  CRISPR gRNA sequence
attggcattcaaccttacac

SEQ ID NO: 644032 - DNA, 20 bp, Artificial
  CRISPR gRNA sequence
gcattcaaccttacacaaaa

SEQ ID NO: 644033 - DNA, 20 bp, Artificial
  CRISPR gRNA sequence
aaccttacacaaaatgatgg

SEQ ID NO: 644034 - DNA, 20 bp, Artificial
  CRISPR gRNA sequence
acacaaaatgatggtaatca

SEQ ID NO: 644035 - DNA, 20 bp, Artificial
  CRISPR gRNA sequence
cacaaaatgatggtaatcaa

SEQ ID NO: 644036 - DNA, 20 bp, Artificial
  CRISPR gRNA sequence
actaatgccataaatggtcc

SEQ ID NO: 644037 - DNA, 20 bp, Artificial
  CRISPR gRNA sequence
ctaatgccataaatggtcct

SEQ ID NO: 644038 - DNA, 20 bp, Artificial
  CRISPR gRNA sequence
atgccataaatggtccttcc

SEQ ID NO: 644039 - DNA, 20 bp, Artificial
  CRISPR gRNA sequence
ccatcacaccatcttaattt

SEQ ID NO: 644040 - DNA, 20 bp, Artificial
  CRISPR gRNA sequence
catcacaccatcttaatttc

SEQ ID NO: 644041 - DNA, 20 bp, Artificial
  CRISPR gRNA sequence
aatttcaaaagtaacatttt

SEQ ID NO: 644042 - DNA, 20 bp, Artificial
  CRISPR gRNA sequence
atttcaaaagtaacattttc

SEQ ID NO: 644043 - DNA, 20 bp, Artificial
  CRISPR gRNA sequence
caaaagtaacattttctttg

SEQ ID NO: 644044 - DNA, 20 bp, Artificial
  CRISPR gRNA sequence
aaaagtaacattttctttgc

SEQ ID NO: 644045 - DNA, 20 bp, Artificial
  CRISPR gRNA sequence
tctttgcttctgaatctgaa

SEQ ID NO: 644046 - DNA, 20 bp, Artificial
  CRISPR gRNA sequence
ctttgcttctgaatctgaag

SEQ ID NO: 644047 - DNA, 20 bp, Artificial
  CRISPR gRNA sequence
tttgcttctgaatctgaaga

SEQ ID NO: 644048 - DNA, 20 bp, Artificial
  CRISPR gRNA sequence
tgcttctgaatctgaagaaa

SEQ ID NO: 644049 - DNA, 20 bp, Artificial
  CRISPR gRNA sequence
gcttctgaatctgaagaaaa

SEQ ID NO: 644050 - DNA, 20 bp, Artificial
  CRISPR gRNA sequence
cttctgaatctgaagaaaac

SEQ ID NO: 644051 - DNA, 20 bp, Artificial
  CRISPR gRNA sequence
ctgaatctgaagaaaacaaa

SEQ ID NO: 644052 - DNA, 20 bp, Artificial
  CRISPR gRNA sequence
tgaatctgaagaaaacaaaa

SEQ ID NO: 644053 - DNA, 20 bp, Artificial
  CRISPR gRNA sequence
aatctgaagaaaacaaaaaa

SEQ ID NO: 644054 - DNA, 20 bp, Artificial
  CRISPR gRNA sequence
aagaaaacaaaaaaatctca

SEQ ID NO: 644055 - DNA, 20 bp, Artificial
  CRISPR gRNA sequence
aaagtctaacataactactt

SEQ ID NO: 644056 - DNA, 20 bp, Artificial
  CRISPR gRNA sequence
acataactactttgcaatta

SEQ ID NO: 644057 - DNA, 20 bp, Artificial
  CRISPR gRNA sequence
ctttgcaattactttttgcc

SEQ ID NO: 644058 - DNA, 20 bp, Artificial
  CRISPR gRNA sequence
tgcaattactttttgccata

SEQ ID NO: 644059 - DNA, 20 bp, Artificial
  CRISPR gRNA sequence
gcaattactttttgccatat

SEQ ID NO: 644060 - DNA, 20 bp, Artificial
  CRISPR gRNA sequence
caattactttttgccatata

SEQ ID NO: 644061 - DNA, 20 bp, Artificial
  CRISPR gRNA sequence
ctttttgccatatataaaga

SEQ ID NO: 644062 - DNA, 20 bp, Artificial
  CRISPR gRNA sequence
tttgccatatataaagagaa

SEQ ID NO: 644063 - DNA, 20 bp, Artificial
  CRISPR gRNA sequence
ttgccatatataaagagaaa

SEQ ID NO: 644064 - DNA, 20 bp, Artificial
  CRISPR gRNA sequence
tgccatatataaagagaaag

SEQ ID NO: 644065 - DNA, 20 bp, Artificial
  CRISPR gRNA sequence
gccatatataaagagaaaga

SEQ ID NO: 644066 - DNA, 20 bp, Artificial
  CRISPR gRNA sequence
ccatatataaagagaaagaa

SEQ ID NO: 644067 - DNA, 20 bp, Artificial
  CRISPR gRNA sequence
ataactaatcttttctatac

SEQ ID NO: 644068 - DNA, 20 bp, Artificial
  CRISPR gRNA sequence
atcttttctatacaaaaatg

SEQ ID NO: 644069 - DNA, 20 bp, Artificial
  CRISPR gRNA sequence
ttctatacaaaaatgaacag

SEQ ID NO: 644070 - DNA, 20 bp, Artificial
  CRISPR gRNA sequence
tctatacaaaaatgaacaga

SEQ ID NO: 644071 - DNA, 20 bp, Artificial
  CRISPR gRNA sequence
ctatacaaaaatgaacagac

SEQ ID NO: 644072 - DNA, 20 bp, Artificial
  CRISPR gRNA sequence
tatacaaaaatgaacagaca

SEQ ID NO: 644073 - DNA, 20 bp, Artificial
  CRISPR gRNA sequence
tacaaaaatgaacagacagc

SEQ ID NO: 644074 - DNA, 20 bp, Artificial
  CRISPR gRNA sequence
aggtgatgggcagacagttt

SEQ ID NO: 644075 - DNA, 20 bp, Artificial
  CRISPR gRNA sequence
ggtgatgggcagacagtttc

SEQ ID NO: 644076 - DNA, 20 bp, Artificial
  CRISPR gRNA sequence
ccaaagcaaagcattctctc

SEQ ID NO: 644077 - DNA, 20 bp, Artificial
  CRISPR gRNA sequence
caaagcaaagcattctctca

SEQ ID NO: 644078 - DNA, 20 bp, Artificial
  CRISPR gRNA sequence
tctcactctgtcccggttaa

SEQ ID NO: 644079 - DNA, 20 bp, Artificial
  CRISPR gRNA sequence
tcactctgtcccggttaaaa

SEQ ID NO: 644080 - DNA, 20 bp, Artificial
  CRISPR gRNA sequence
actctgtcccggttaaaacc

SEQ ID NO: 644081 - DNA, 20 bp, Artificial
  CRISPR gRNA sequence
tgtcccggttaaaacctgtt

SEQ ID NO: 644082 - DNA, 20 bp, Artificial
  CRISPR gRNA sequence
tcccggttaaaacctgtttg

SEQ ID NO: 644083 - DNA, 20 bp, Artificial
  CRISPR gRNA sequence
aaacctgtttgtctggggat

SEQ ID NO: 644084 - DNA, 20 bp, Artificial
  CRISPR gRNA sequence
tttgtctggggattggctca

SEQ ID NO: 644085 - DNA, 20 bp, Artificial
  CRISPR gRNA sequence
gtctggggattggctcagct

SEQ ID NO: 644086 - DNA, 20 bp, Artificial
  CRISPR gRNA sequence
tctggggattggctcagctg

SEQ ID NO: 644087 - DNA, 20 bp, Artificial
  CRISPR gRNA sequence
gggattggctcagctgctcc

SEQ ID NO: 644088 - DNA, 20 bp, Artificial
  CRISPR gRNA sequence
gctcagctgctccagttcca

SEQ ID NO: 644089 - DNA, 20 bp, Artificial
  CRISPR gRNA sequence
agctgctccagttccagctt

SEQ ID NO: 644090 - DNA, 20 bp, Artificial
  CRISPR gRNA sequence
ctccagttccagcttcccgg

SEQ ID NO: 644091 - DNA, 20 bp, Artificial
  CRISPR gRNA sequence
cagttccagcttcccggcct

SEQ ID NO: 644092 - DNA, 20 bp, Artificial
  CRISPR gRNA sequence
cagcttcccggccttccaag

SEQ ID NO: 644093 - DNA, 20 bp, Artificial
  CRISPR gRNA sequence
cccggccttccaaggtgctg

SEQ ID NO: 644094 - DNA, 20 bp, Artificial
  CRISPR gRNA sequence
ccggccttccaaggtgctga

SEQ ID NO: 644095 - DNA, 20 bp, Artificial
  CRISPR gRNA sequence
ccaaggtgctgacgtgacct

SEQ ID NO: 644096 - DNA, 20 bp, Artificial
  CRISPR gRNA sequence
caaggtgctgacgtgacctc

SEQ ID NO: 644097 - DNA, 20 bp, Artificial
  CRISPR gRNA sequence
acgtgacctcagttgtcatt

SEQ ID NO: 644098 - DNA, 20 bp, Artificial
  CRISPR gRNA sequence
agttgtcattctgctggagc

SEQ ID NO: 644099 - DNA, 20 bp, Artificial
  CRISPR gRNA sequence
tcattctgctggagctagat

SEQ ID NO: 644100 - DNA, 20 bp, Artificial
  CRISPR gRNA sequence
tgctggagctagatccaact

SEQ ID NO: 644101 - DNA, 20 bp, Artificial
  CRISPR gRNA sequence
ctggagctagatccaactaa

SEQ ID NO: 644102 - DNA, 20 bp, Artificial
  CRISPR gRNA sequence
gagctagatccaactaacaa

SEQ ID NO: 644103 - DNA, 20 bp, Artificial
  CRISPR gRNA sequence
gatccaactaacaaaatcca

SEQ ID NO: 644104 - DNA, 20 bp, Artificial
  CRISPR gRNA sequence
acaaaatccaacacatgcag

SEQ ID NO: 644105 - DNA, 20 bp, Artificial
  CRISPR gRNA sequence
gtttctccattatccagtgc

SEQ ID NO: 644106 - DNA, 20 bp, Artificial
  CRISPR gRNA sequence
tttctccattatccagtgcc

SEQ ID NO: 644107 - DNA, 20 bp, Artificial
  CRISPR gRNA sequence
ctccattatccagtgccttc

SEQ ID NO: 644108 - DNA, 20 bp, Artificial
  CRISPR gRNA sequence
tccattatccagtgccttca

SEQ ID NO: 644109 - DNA, 20 bp, Artificial
  CRISPR gRNA sequence
cattatccagtgccttcaag

SEQ ID NO: 644110 - DNA, 20 bp, Artificial
  CRISPR gRNA sequence
tccagtgccttcaagggcag

SEQ ID NO: 644111 - DNA, 20 bp, Artificial
  CRISPR gRNA sequence
caagggcagcagagaatcag

SEQ ID NO: 644112 - DNA, 20 bp, Artificial
  CRISPR gRNA sequence
aagggcagcagagaatcagg

SEQ ID NO: 644113 - DNA, 20 bp, Artificial
  CRISPR gRNA sequence
ttctaatcttgcccttgata

SEQ ID NO: 644114 - DNA, 20 bp, Artificial
  CRISPR gRNA sequence
ctaatcttgcccttgatagt

SEQ ID NO: 644115 - DNA, 20 bp, Artificial
  CRISPR gRNA sequence
taatcttgcccttgatagtt

SEQ ID NO: 644116 - DNA, 20 bp, Artificial
  CRISPR gRNA sequence
atcttgcccttgatagtttt

SEQ ID NO: 644117 - DNA, 20 bp, Artificial
  CRISPR gRNA sequence
gcccttgatagtttttatcc

SEQ ID NO: 644118 - DNA, 20 bp, Artificial
  CRISPR gRNA sequence
cccttgatagtttttatcct

SEQ ID NO: 644119 - DNA, 20 bp, Artificial
  CRISPR gRNA sequence
gatagtttttatcctcaatc

SEQ ID NO: 644120 - DNA, 20 bp, Artificial
  CRISPR gRNA sequence
atagtttttatcctcaatcc

SEQ ID NO: 644121 - DNA, 20 bp, Artificial
  CRISPR gRNA sequence
ttatcctcaatccttaaaca

SEQ ID NO: 644122 - DNA, 20 bp, Artificial
  CRISPR gRNA sequence
tatcctcaatccttaaacac

SEQ ID NO: 644123 - DNA, 20 bp, Artificial
  CRISPR gRNA sequence
atcctcaatccttaaacact

SEQ ID NO: 644124 - DNA, 20 bp, Artificial
  CRISPR gRNA sequence
tcctcaatccttaaacactg

SEQ ID NO: 644125 - DNA, 20 bp, Artificial
  CRISPR gRNA sequence
aatccttaaacactgtgcaa

SEQ ID NO: 644126 - DNA, 20 bp, Artificial
  CRISPR gRNA sequence
aaacactgtgcaaaggttat

SEQ ID NO: 644127 - DNA, 20 bp, Artificial
  CRISPR gRNA sequence
aacactgtgcaaaggttatt

SEQ ID NO: 644128 - DNA, 20 bp, Artificial
  CRISPR gRNA sequence
tgcaaaggttattaggcaga

SEQ ID NO: 644129 - DNA, 20 bp, Artificial
  CRISPR gRNA sequence
ttaggcagatgaacatcaat

SEQ ID NO: 644130 - DNA, 20 bp, Artificial
  CRISPR gRNA sequence
ggcagatgaacatcaatgat

SEQ ID NO: 644131 - DNA, 20 bp, Artificial
  CRISPR gRNA sequence
aattaaatattagctagttg

SEQ ID NO: 644132 - DNA, 20 bp, Artificial
  CRISPR gRNA sequence
aatattagctagttgattta

SEQ ID NO: 644133 - DNA, 20 bp, Artificial
  CRISPR gRNA sequence
gctagttgatttacagaatt

SEQ ID NO: 644134 - DNA, 20 bp, Artificial
  CRISPR gRNA sequence
gttgatttacagaattttac

SEQ ID NO: 644135 - DNA, 20 bp, Artificial
  CRISPR gRNA sequence
atttacagaattttacagaa

SEQ ID NO: 644136 - DNA, 20 bp, Artificial
  CRISPR gRNA sequence
acagaattttacagaaggga

SEQ ID NO: 644137 - DNA, 20 bp, Artificial
  CRISPR gRNA sequence
cagaattttacagaagggaa

SEQ ID NO: 644138 - DNA, 20 bp, Artificial
  CRISPR gRNA sequence
tacagaagggaagcatctag

SEQ ID NO: 644139 - DNA, 20 bp, Artificial
  CRISPR gRNA sequence
acagaagggaagcatctagt

SEQ ID NO: 644140 - DNA, 20 bp, Artificial
  CRISPR gRNA sequence
cagaagggaagcatctagta

SEQ ID NO: 644141 - DNA, 20 bp, Artificial
  CRISPR gRNA sequence
gtaaactgagtttattcata

SEQ ID NO: 644142 - DNA, 20 bp, Artificial
  CRISPR gRNA sequence
agtttattcatatactgatg

SEQ ID NO: 644143 - DNA, 20 bp, Artificial
  CRISPR gRNA sequence
attcatatactgatgaagat

SEQ ID NO: 644144 - DNA, 20 bp, Artificial
  CRISPR gRNA sequence
ttcatatactgatgaagatc

SEQ ID NO: 644145 - DNA, 20 bp, Artificial
  CRISPR gRNA sequence
atatactgatgaagatctga

SEQ ID NO: 644146 - DNA, 20 bp, Artificial
  CRISPR gRNA sequence
atgaagatctgaaggcttta

SEQ ID NO: 644147 - DNA, 20 bp, Artificial
  CRISPR gRNA sequence
aaggctttagttgaggaagc

SEQ ID NO: 644148 - DNA, 20 bp, Artificial
  CRISPR gRNA sequence
tagttgaggaagctacatga

SEQ ID NO: 644149 - DNA, 20 bp, Artificial
  CRISPR gRNA sequence
agttgaggaagctacatgac

SEQ ID NO: 644150 - DNA, 20 bp, Artificial
  CRISPR gRNA sequence
gttgaggaagctacatgaca

SEQ ID NO: 644151 - DNA, 20 bp, Artificial
  CRISPR gRNA sequence
aggaagctacatgacaaaag

SEQ ID NO: 644152 - DNA, 20 bp, Artificial
  CRISPR gRNA sequence
catgacaaaagtcagcctcc

SEQ ID NO: 644153 - DNA, 20 bp, Artificial
  CRISPR gRNA sequence
ctccccccatcctcctttct

SEQ ID NO: 644154 - DNA, 20 bp, Artificial
  CRISPR gRNA sequence
cccccatcctcctttctttt

SEQ ID NO: 644155 - DNA, 20 bp, Artificial
  CRISPR gRNA sequence
ctttcttttataaagataac

SEQ ID NO: 644156 - DNA, 20 bp, Artificial
  CRISPR gRNA sequence
tcttttataaagataactga

SEQ ID NO: 644157 - DNA, 20 bp, Artificial
  CRISPR gRNA sequence
cttttataaagataactgaa

SEQ ID NO: 644158 - DNA, 20 bp, Artificial
  CRISPR gRNA sequence
ttttataaagataactgaag

SEQ ID NO: 644159 - DNA, 20 bp, Artificial
  CRISPR gRNA sequence
ttataaagataactgaagag

SEQ ID NO: 644160 - DNA, 20 bp, Artificial
  CRISPR gRNA sequence
tataaagataactgaagaga

SEQ ID NO: 644161 - DNA, 20 bp, Artificial
  CRISPR gRNA sequence
ataaagataactgaagagat

SEQ ID NO: 644162 - DNA, 20 bp, Artificial
  CRISPR gRNA sequence
taaagataactgaagagatt

SEQ ID NO: 644163 - DNA, 20 bp, Artificial
  CRISPR gRNA sequence
aagagattgaaggaaacaaa

SEQ ID NO: 644164 - DNA, 20 bp, Artificial
  CRISPR gRNA sequence
aaggaaacaaatattgtaaa

SEQ ID NO: 644165 - DNA, 20 bp, Artificial
  CRISPR gRNA sequence
taaatattactgtaagatgc

SEQ ID NO: 644166 - DNA, 20 bp, Artificial
  CRISPR gRNA sequence
ctgtaagatgccaatattat

SEQ ID NO: 644167 - DNA, 20 bp, Artificial
  CRISPR gRNA sequence
taagatgccaatattatata

SEQ ID NO: 644168 - DNA, 20 bp, Artificial
  CRISPR gRNA sequence
tatacatgattcctgaaagt

SEQ ID NO: 644169 - DNA, 20 bp, Artificial
  CRISPR gRNA sequence
ctgaaagttgagtatctatg

SEQ ID NO: 644170 - DNA, 20 bp, Artificial
  CRISPR gRNA sequence
aaagttgagtatctatgtac

SEQ ID NO: 644171 - DNA, 20 bp, Artificial
  CRISPR gRNA sequence
agtatctatgtacatatgaa

SEQ ID NO: 644172 - DNA, 20 bp, Artificial
  CRISPR gRNA sequence
tgtacatatgaagagtagag

SEQ ID NO: 644173 - DNA, 20 bp, Artificial
  CRISPR gRNA sequence
aaaaatcacatctcatctgc

SEQ ID NO: 644174 - DNA, 20 bp, Artificial
  CRISPR gRNA sequence
aaaatcacatctcatctgct

SEQ ID NO: 644175 - DNA, 20 bp, Artificial
  CRISPR gRNA sequence
atctgctttttttgaaaagg

SEQ ID NO: 644176 - DNA, 20 bp, Artificial
  CRISPR gRNA sequence
ctttttttgaaaagggattc

SEQ ID NO: 644177 - DNA, 20 bp, Artificial
  CRISPR gRNA sequence
tttttgaaaagggattcttt

SEQ ID NO: 644178 - DNA, 20 bp, Artificial
  CRISPR gRNA sequence
ttttgaaaagggattctttc

SEQ ID NO: 644179 - DNA, 20 bp, Artificial
  CRISPR gRNA sequence
tttgaaaagggattctttct

SEQ ID NO: 644180 - DNA, 20 bp, Artificial
  CRISPR gRNA sequence
ttgaaaagggattctttctt

SEQ ID NO: 644181 - DNA, 20 bp, Artificial
  CRISPR gRNA sequence
tgaaaagggattctttctta

SEQ ID NO: 644182 - DNA, 20 bp, Artificial
  CRISPR gRNA sequence
gaaaagggattctttcttat

SEQ ID NO: 644183 - DNA, 20 bp, Artificial
  CRISPR gRNA sequence
aaaagggattctttcttata

SEQ ID NO: 644184 - DNA, 20 bp, Artificial
  CRISPR gRNA sequence
tttcttataagctgtatcaa

SEQ ID NO: 644185 - DNA, 20 bp, Artificial
  CRISPR gRNA sequence
tcttataagctgtatcaagt

SEQ ID NO: 644186 - DNA, 20 bp, Artificial
  CRISPR gRNA sequence
cttataagctgtatcaagtg

SEQ ID NO: 644187 - DNA, 20 bp, Artificial
  CRISPR gRNA sequence
ttataagctgtatcaagtgt

SEQ ID NO: 644188 - DNA, 20 bp, Artificial
  CRISPR gRNA sequence
ataagctgtatcaagtgtaa

SEQ ID NO: 644189 - DNA, 20 bp, Artificial
  CRISPR gRNA sequence
taagctgtatcaagtgtaac

SEQ ID NO: 644190 - DNA, 20 bp, Artificial
  CRISPR gRNA sequence
tatcaagtgtaacttgaaca

SEQ ID NO: 644191 - DNA, 20 bp, Artificial
  CRISPR gRNA sequence
gaacatgatgtccttaaatt

SEQ ID NO: 644192 - DNA, 20 bp, Artificial
  CRISPR gRNA sequence
aacatgatgtccttaaattt

SEQ ID NO: 644193 - DNA, 20 bp, Artificial
  CRISPR gRNA sequence
aaatttttgtgatcatcaac

SEQ ID NO: 644194 - DNA, 20 bp, Artificial
  CRISPR gRNA sequence
aatttttgtgatcatcaaca

SEQ ID NO: 644195 - DNA, 20 bp, Artificial
  CRISPR gRNA sequence
ttgtgatcatcaacaatttg

SEQ ID NO: 644196 - DNA, 20 bp, Artificial
  CRISPR gRNA sequence
tgtgatcatcaacaatttgt

SEQ ID NO: 644197 - DNA, 20 bp, Artificial
  CRISPR gRNA sequence
gtgatcatcaacaatttgta

SEQ ID NO: 644198 - DNA, 20 bp, Artificial
  CRISPR gRNA sequence
tgatcatcaacaatttgtag

SEQ ID NO: 644199 - DNA, 20 bp, Artificial
  CRISPR gRNA sequence
gtagtaacagactctgagat

SEQ ID NO: 644200 - DNA, 20 bp, Artificial
  CRISPR gRNA sequence
tagtaacagactctgagatc

SEQ ID NO: 644201 - DNA, 20 bp, Artificial
  CRISPR gRNA sequence
tgagatcaagagcaacgtac

SEQ ID NO: 644202 - DNA, 20 bp, Artificial
  CRISPR gRNA sequence
agatcaagagcaacgtacgt

SEQ ID NO: 644203 - DNA, 20 bp, Artificial
  CRISPR gRNA sequence
atcttactccctataccaac

SEQ ID NO: 644204 - DNA, 20 bp, Artificial
  CRISPR gRNA sequence
actccctataccaactcagc

SEQ ID NO: 644205 - DNA, 20 bp, Artificial
  CRISPR gRNA sequence
ctccctataccaactcagca

SEQ ID NO: 644206 - DNA, 20 bp, Artificial
  CRISPR gRNA sequence
cctataccaactcagcactg

SEQ ID NO: 644207 - DNA, 20 bp, Artificial
  CRISPR gRNA sequence
taccaactcagcactgaaga

SEQ ID NO: 644208 - DNA, 20 bp, Artificial
  CRISPR gRNA sequence
agcactgaagatttgcatgc

SEQ ID NO: 644209 - DNA, 20 bp, Artificial
  CRISPR gRNA sequence
aagatttgcatgcttgagct

SEQ ID NO: 644210 - DNA, 20 bp, Artificial
  CRISPR gRNA sequence
gcatgcttgagctttcctct

SEQ ID NO: 644211 - DNA, 20 bp, Artificial
  CRISPR gRNA sequence
catgcttgagctttcctctt

SEQ ID NO: 644212 - DNA, 20 bp, Artificial
  CRISPR gRNA sequence
gagctttcctcttctagctc

SEQ ID NO: 644213 - DNA, 20 bp, Artificial
  CRISPR gRNA sequence
agctttcctcttctagctct

SEQ ID NO: 644214 - DNA, 20 bp, Artificial
  CRISPR gRNA sequence
tcctcttctagctctaaata

SEQ ID NO: 644215 - DNA, 20 bp, Artificial
  CRISPR gRNA sequence
cctcttctagctctaaataa

SEQ ID NO: 644216 - DNA, 20 bp, Artificial
  CRISPR gRNA sequence
ctcttctagctctaaataat

SEQ ID NO: 644217 - DNA, 20 bp, Artificial
  CRISPR gRNA sequence
ttctagctctaaataattcc

SEQ ID NO: 644218 - DNA, 20 bp, Artificial
  CRISPR gRNA sequence
ctagctctaaataattcctc

SEQ ID NO: 644219 - DNA, 20 bp, Artificial
  CRISPR gRNA sequence
tagctctaaataattcctca

SEQ ID NO: 644220 - DNA, 20 bp, Artificial
  CRISPR gRNA sequence
gctctaaataattcctcata

SEQ ID NO: 644221 - DNA, 20 bp, Artificial
  CRISPR gRNA sequence
taaataattcctcatataca

SEQ ID NO: 644222 - DNA, 20 bp, Artificial
  CRISPR gRNA sequence
aataattcctcatatacagc

SEQ ID NO: 644223 - DNA, 20 bp, Artificial
  CRISPR gRNA sequence
ctcatatacagcatggtaca

SEQ ID NO: 644224 - DNA, 20 bp, Artificial
  CRISPR gRNA sequence
atatacagcatggtacacag

SEQ ID NO: 644225 - DNA, 20 bp, Artificial
  CRISPR gRNA sequence
tacctacaagcacaaaacaa

SEQ ID NO: 644226 - DNA, 20 bp, Artificial
  CRISPR gRNA sequence
acctacaagcacaaaacaac

SEQ ID NO: 644227 - DNA, 20 bp, Artificial
  CRISPR gRNA sequence
cctacaagcacaaaacaaca

SEQ ID NO: 644228 - DNA, 20 bp, Artificial
  CRISPR gRNA sequence
caagcacaaaacaacattct

SEQ ID NO: 644229 - DNA, 20 bp, Artificial
  CRISPR gRNA sequence
tttacccagtacatgttatt

SEQ ID NO: 644230 - DNA, 20 bp, Artificial
  CRISPR gRNA sequence
tacccagtacatgttattac

SEQ ID NO: 644231 - DNA, 20 bp, Artificial
  CRISPR gRNA sequence
acccagtacatgttattacc

SEQ ID NO: 644232 - DNA, 20 bp, Artificial
  CRISPR gRNA sequence
cccagtacatgttattacct

SEQ ID NO: 644233 - DNA, 20 bp, Artificial
  CRISPR gRNA sequence
ttacctcctcatttaaaaga

SEQ ID NO: 644234 - DNA, 20 bp, Artificial
  CRISPR gRNA sequence
cctcctcatttaaaagaaaa

SEQ ID NO: 644235 - DNA, 20 bp, Artificial
  CRISPR gRNA sequence
ctcatttaaaagaaaaaacg

SEQ ID NO: 644236 - DNA, 20 bp, Artificial
  CRISPR gRNA sequence
atttaaaagaaaaaacgtga

SEQ ID NO: 644237 - DNA, 20 bp, Artificial
  CRISPR gRNA sequence
aaaagaaaaaacgtgaagca

SEQ ID NO: 644238 - DNA, 20 bp, Artificial
  CRISPR gRNA sequence
aaagaaaaaacgtgaagcac

SEQ ID NO: 644239 - DNA, 20 bp, Artificial
  CRISPR gRNA sequence
tgaacaaaagcatgttttaa

SEQ ID NO: 644240 - DNA, 20 bp, Artificial
  CRISPR gRNA sequence
taatgttagcttttttagtt

SEQ ID NO: 644241 - DNA, 20 bp, Artificial
  CRISPR gRNA sequence
aatgttagcttttttagtta

SEQ ID NO: 644242 - DNA, 20 bp, Artificial
  CRISPR gRNA sequence
atgttagcttttttagttag

SEQ ID NO: 644243 - DNA, 20 bp, Artificial
  CRISPR gRNA sequence
gcttttttagttagctcagt

SEQ ID NO: 644244 - DNA, 20 bp, Artificial
  CRISPR gRNA sequence
ttttagttagctcagtgacc

SEQ ID NO: 644245 - DNA, 20 bp, Artificial
  CRISPR gRNA sequence
tttagttagctcagtgacca

SEQ ID NO: 644246 - DNA, 20 bp, Artificial
  CRISPR gRNA sequence
ttagttagctcagtgaccat

SEQ ID NO: 644247 - DNA, 20 bp, Artificial
  CRISPR gRNA sequence
tagttagctcagtgaccatc

SEQ ID NO: 644248 - DNA, 20 bp, Artificial
  CRISPR gRNA sequence
agttagctcagtgaccatca

SEQ ID NO: 644249 - DNA, 20 bp, Artificial
  CRISPR gRNA sequence
gttagctcagtgaccatcag

SEQ ID NO: 644250 - DNA, 20 bp, Artificial
  CRISPR gRNA sequence
gctcagtgaccatcagcaca

SEQ ID NO: 644251 - DNA, 20 bp, Artificial
  CRISPR gRNA sequence
agtgaccatcagcacatttt

SEQ ID NO: 644252 - DNA, 20 bp, Artificial
  CRISPR gRNA sequence
ttaacctctctgacccttag

SEQ ID NO: 644253 - DNA, 20 bp, Artificial
  CRISPR gRNA sequence
taacctctctgacccttagc

SEQ ID NO: 644254 - DNA, 20 bp, Artificial
  CRISPR gRNA sequence
aacctctctgacccttagct

SEQ ID NO: 644255 - DNA, 20 bp, Artificial
  CRISPR gRNA sequence
acctctctgacccttagctc

SEQ ID NO: 644256 - DNA, 20 bp, Artificial
  CRISPR gRNA sequence
tctgacccttagctcggcat

SEQ ID NO: 644257 - DNA, 20 bp, Artificial
  CRISPR gRNA sequence
tgacccttagctcggcatct

SEQ ID NO: 644258 - DNA, 20 bp, Artificial
  CRISPR gRNA sequence
acccttagctcggcatctct

SEQ ID NO: 644259 - DNA, 20 bp, Artificial
  CRISPR gRNA sequence
agctcggcatctctaaaatg

SEQ ID NO: 644260 - DNA, 20 bp, Artificial
  CRISPR gRNA sequence
gctcggcatctctaaaatga

SEQ ID NO: 644261 - DNA, 20 bp, Artificial
  CRISPR gRNA sequence
ggcatctctaaaatgagggt

SEQ ID NO: 644262 - DNA, 20 bp, Artificial
  CRISPR gRNA sequence
taaaatgagggtaataagga

SEQ ID NO: 644263 - DNA, 20 bp, Artificial
  CRISPR gRNA sequence
aaatgagggtaataaggaac

SEQ ID NO: 644264 - DNA, 20 bp, Artificial
  CRISPR gRNA sequence
tcccgttgtgcttttagagg

SEQ ID NO: 644265 - DNA, 20 bp, Artificial
  CRISPR gRNA sequence
tgcttttagaggattaaata

SEQ ID NO: 644266 - DNA, 20 bp, Artificial
  CRISPR gRNA sequence
ttagaggattaaataagata

SEQ ID NO: 644267 - DNA, 20 bp, Artificial
  CRISPR gRNA sequence
tagaggattaaataagataa

SEQ ID NO: 644268 - DNA, 20 bp, Artificial
  CRISPR gRNA sequence
agaggattaaataagataaa

SEQ ID NO: 644269 - DNA, 20 bp, Artificial
  CRISPR gRNA sequence
gaggattaaataagataaaa

SEQ ID NO: 644270 - DNA, 20 bp, Artificial
  CRISPR gRNA sequence
aataagataaaagacaccct

SEQ ID NO: 644271 - DNA, 20 bp, Artificial
  CRISPR gRNA sequence
ttgcacattgtaagcactta

SEQ ID NO: 644272 - DNA, 20 bp, Artificial
  CRISPR gRNA sequence
cacattgtaagcacttaatg

SEQ ID NO: 644273 - DNA, 20 bp, Artificial
  CRISPR gRNA sequence
taagcacttaatgatagtta

SEQ ID NO: 644274 - DNA, 20 bp, Artificial
  CRISPR gRNA sequence
aatgatagttattactaggt

SEQ ID NO: 644275 - DNA, 20 bp, Artificial
  CRISPR gRNA sequence
atgatagttattactaggta

SEQ ID NO: 644276 - DNA, 20 bp, Artificial
  CRISPR gRNA sequence
ttactaggtatatgagtaaa

SEQ ID NO: 644277 - DNA, 20 bp, Artificial
  CRISPR gRNA sequence
ctaggtatatgagtaaaggc

SEQ ID NO: 644278 - DNA, 20 bp, Artificial
  CRISPR gRNA sequence
ggtatatgagtaaaggctct

SEQ ID NO: 644279 - DNA, 20 bp, Artificial
  CRISPR gRNA sequence
tactgctttagattcattaa

SEQ ID NO: 644280 - DNA, 20 bp, Artificial
  CRISPR gRNA sequence
ctgctttagattcattaaag

SEQ ID NO: 644281 - DNA, 20 bp, Artificial
  CRISPR gRNA sequence
ctttagattcattaaagaat

SEQ ID NO: 644282 - DNA, 20 bp, Artificial
  CRISPR gRNA sequence
tagattcattaaagaattgg

SEQ ID NO: 644283 - DNA, 20 bp, Artificial
  CRISPR gRNA sequence
agattcattaaagaattggc

SEQ ID NO: 644284 - DNA, 20 bp, Artificial
  CRISPR gRNA sequence
gattcattaaagaattggct

SEQ ID NO: 644285 - DNA, 20 bp, Artificial
  CRISPR gRNA sequence
attaaagaattggctttcat

SEQ ID NO: 644286 - DNA, 20 bp, Artificial
  CRISPR gRNA sequence
aagaattggctttcattttc

SEQ ID NO: 644287 - DNA, 20 bp, Artificial
  CRISPR gRNA sequence
gctttcattttcatttgaga

SEQ ID NO: 644288 - DNA, 20 bp, Artificial
  CRISPR gRNA sequence
tcattttcatttgagattac

SEQ ID NO: 644289 - DNA, 20 bp, Artificial
  CRISPR gRNA sequence
cattttcatttgagattact

SEQ ID NO: 644290 - DNA, 20 bp, Artificial
  CRISPR gRNA sequence
attttcatttgagattactt

SEQ ID NO: 644291 - DNA, 20 bp, Artificial
  CRISPR gRNA sequence
tcatttgagattactttata

SEQ ID NO: 644292 - DNA, 20 bp, Artificial
  CRISPR gRNA sequence
catttgagattactttataa

SEQ ID NO: 644293 - DNA, 20 bp, Artificial
  CRISPR gRNA sequence
atttgagattactttataaa

SEQ ID NO: 644294 - DNA, 20 bp, Artificial
  CRISPR gRNA sequence
gagattactttataaaaatc

SEQ ID NO: 644295 - DNA, 20 bp, Artificial
  CRISPR gRNA sequence
agattactttataaaaatca

SEQ ID NO: 644296 - DNA, 20 bp, Artificial
  CRISPR gRNA sequence
ctttataaaaatcatatggt

SEQ ID NO: 644297 - DNA, 20 bp, Artificial
  CRISPR gRNA sequence
tataaaaatcatatggttat

SEQ ID NO: 644298 - DNA, 20 bp, Artificial
  CRISPR gRNA sequence
ataaaaatcatatggttatc

SEQ ID NO: 644299 - DNA, 20 bp, Artificial
  CRISPR gRNA sequence
taaaaatcatatggttatcc

SEQ ID NO: 644300 - DNA, 20 bp, Artificial
  CRISPR gRNA sequence
tccacataagttactaatat

SEQ ID NO: 644301 - DNA, 20 bp, Artificial
  CRISPR gRNA sequence
ctaatataagtgggtttttg

SEQ ID NO: 644302 - DNA, 20 bp, Artificial
  CRISPR gRNA sequence
atataagtgggtttttgata

SEQ ID NO: 644303 - DNA, 20 bp, Artificial
  CRISPR gRNA sequence
ttgatatgtttatattttaa

SEQ ID NO: 644304 - DNA, 20 bp, Artificial
  CRISPR gRNA sequence
tgatatgtttatattttaat

SEQ ID NO: 644305 - DNA, 20 bp, Artificial
  CRISPR gRNA sequence
gatatgtttatattttaatg

SEQ ID NO: 644306 - DNA, 20 bp, Artificial
  CRISPR gRNA sequence
atatgtttatattttaatgt

SEQ ID NO: 644307 - DNA, 20 bp, Artificial
  CRISPR gRNA sequence
atattttaatgtatggcatt

SEQ ID NO: 644308 - DNA, 20 bp, Artificial
  CRISPR gRNA sequence
tattttaatgtatggcattt

SEQ ID NO: 644309 - DNA, 20 bp, Artificial
  CRISPR gRNA sequence
taatgtatggcatttaagct

SEQ ID NO: 644310 - DNA, 20 bp, Artificial
  CRISPR gRNA sequence
aatgtatggcatttaagcta

SEQ ID NO: 644311 - DNA, 20 bp, Artificial
  CRISPR gRNA sequence
atgtatggcatttaagctaa

SEQ ID NO: 644312 - DNA, 20 bp, Artificial
  CRISPR gRNA sequence
aagctaactgacactaagca

SEQ ID NO: 644313 - DNA, 20 bp, Artificial
  CRISPR gRNA sequence
agctaactgacactaagcac

SEQ ID NO: 644314 - DNA, 20 bp, Artificial
  CRISPR gRNA sequence
actgacactaagcacatgga

SEQ ID NO: 644315 - DNA, 20 bp, Artificial
  CRISPR gRNA sequence
acactaagcacatggataac

SEQ ID NO: 644316 - DNA, 20 bp, Artificial
  CRISPR gRNA sequence
agcacatggataactcttct

SEQ ID NO: 644317 - DNA, 20 bp, Artificial
  CRISPR gRNA sequence
ttctaatgtcatctaaagtg

SEQ ID NO: 644318 - DNA, 20 bp, Artificial
  CRISPR gRNA sequence
ctaatgtcatctaaagtgat

SEQ ID NO: 644319 - DNA, 20 bp, Artificial
  CRISPR gRNA sequence
taatgtcatctaaagtgata

SEQ ID NO: 644320 - DNA, 20 bp, Artificial
  CRISPR gRNA sequence
atgtcatctaaagtgatatt

SEQ ID NO: 644321 - DNA, 20 bp, Artificial
  CRISPR gRNA sequence
aagtgatatttctcaaatga

SEQ ID NO: 644322 - DNA, 20 bp, Artificial
  CRISPR gRNA sequence
ctcaaatgaaatatccttct

SEQ ID NO: 644323 - DNA, 20 bp, Artificial
  CRISPR gRNA sequence
tcaaatgaaatatccttctg

SEQ ID NO: 644324 - DNA, 20 bp, Artificial
  CRISPR gRNA sequence
aaatgaaatatccttctgtg

SEQ ID NO: 644325 - DNA, 20 bp, Artificial
  CRISPR gRNA sequence
ctgtgggaaggaccaattgg

SEQ ID NO: 644326 - DNA, 20 bp, Artificial
  CRISPR gRNA sequence
tgtgggaaggaccaattggt

SEQ ID NO: 644327 - DNA, 20 bp, Artificial
  CRISPR gRNA sequence
tgggaaggaccaattggttt

SEQ ID NO: 644328 - DNA, 20 bp, Artificial
  CRISPR gRNA sequence
gttttttaaatttctaattc

SEQ ID NO: 644329 - DNA, 20 bp, Artificial
  CRISPR gRNA sequence
tttaaatttctaattcatca

SEQ ID NO: 644330 - DNA, 20 bp, Artificial
  CRISPR gRNA sequence
ttaaatttctaattcatcac

SEQ ID NO: 644331 - DNA, 20 bp, Artificial
  CRISPR gRNA sequence
taaatttctaattcatcaca

SEQ ID NO: 644332 - DNA, 20 bp, Artificial
  CRISPR gRNA sequence
aaatttctaattcatcacat

SEQ ID NO: 644333 - DNA, 20 bp, Artificial
  CRISPR gRNA sequence
aatttctaattcatcacatt

SEQ ID NO: 644334 - DNA, 20 bp, Artificial
  CRISPR gRNA sequence
ctaattcatcacatttgtat

SEQ ID NO: 644335 - DNA, 20 bp, Artificial
  CRISPR gRNA sequence
taattcatcacatttgtata

SEQ ID NO: 644336 - DNA, 20 bp, Artificial
  CRISPR gRNA sequence
attcatcacatttgtataat

SEQ ID NO: 644337 - DNA, 20 bp, Artificial
  CRISPR gRNA sequence
atcacatttgtataatcaag

SEQ ID NO: 644338 - DNA, 20 bp, Artificial
  CRISPR gRNA sequence
gtataatcaagtcaaatttg

SEQ ID NO: 644339 - DNA, 20 bp, Artificial
  CRISPR gRNA sequence
tataatcaagtcaaatttga

SEQ ID NO: 644340 - DNA, 20 bp, Artificial
  CRISPR gRNA sequence
gacaaaaacaaaatacaagc

SEQ ID NO: 644341 - DNA, 20 bp, Artificial
  CRISPR gRNA sequence
acaaaaacaaaatacaagcc

SEQ ID NO: 644342 - DNA, 20 bp, Artificial
  CRISPR gRNA sequence
tttttattactctatcaaac

SEQ ID NO: 644343 - DNA, 20 bp, Artificial
  CRISPR gRNA sequence
ttattactctatcaaacttt

SEQ ID NO: 644344 - DNA, 20 bp, Artificial
  CRISPR gRNA sequence
tattactctatcaaactttg

SEQ ID NO: 644345 - DNA, 20 bp, Artificial
  CRISPR gRNA sequence
attactctatcaaactttgg

SEQ ID NO: 644346 - DNA, 20 bp, Artificial
  CRISPR gRNA sequence
ttactctatcaaactttggt

SEQ ID NO: 644347 - DNA, 20 bp, Artificial
  CRISPR gRNA sequence
ctctatcaaactttggtgac

SEQ ID NO: 644348 - DNA, 20 bp, Artificial
  CRISPR gRNA sequence
tatcaaactttggtgacagt

SEQ ID NO: 644349 - DNA, 20 bp, Artificial
  CRISPR gRNA sequence
tcaaactttggtgacagttt

SEQ ID NO: 644350 - DNA, 20 bp, Artificial
  CRISPR gRNA sequence
tggtgacagttttaagcatt

SEQ ID NO: 644351 - DNA, 20 bp, Artificial
  CRISPR gRNA sequence
ggtgacagttttaagcattt

SEQ ID NO: 644352 - DNA, 20 bp, Artificial
  CRISPR gRNA sequence
gtgacagttttaagcattta

SEQ ID NO: 644353 - DNA, 20 bp, Artificial
  CRISPR gRNA sequence
taagcatttactcaacttct

SEQ ID NO: 644354 - DNA, 20 bp, Artificial
  CRISPR gRNA sequence
aagcatttactcaacttcta

SEQ ID NO: 644355 - DNA, 20 bp, Artificial
  CRISPR gRNA sequence
agcatttactcaacttctat

SEQ ID NO: 644356 - DNA, 20 bp, Artificial
  CRISPR gRNA sequence
actcaacttctatatttaat

SEQ ID NO: 644357 - DNA, 20 bp, Artificial
  CRISPR gRNA sequence
ctcaacttctatatttaatt

SEQ ID NO: 644358 - DNA, 20 bp, Artificial
  CRISPR gRNA sequence
aacttctatatttaatttca

SEQ ID NO: 644359 - DNA, 20 bp, Artificial
  CRISPR gRNA sequence
ctatatttaatttcaaggca

SEQ ID NO: 644360 - DNA, 20 bp, Artificial
  CRISPR gRNA sequence
tatatttaatttcaaggcag

SEQ ID NO: 644361 - DNA, 20 bp, Artificial
  CRISPR gRNA sequence
tatttaatttcaaggcagac

SEQ ID NO: 644362 - DNA, 20 bp, Artificial
  CRISPR gRNA sequence
aatttcaaggcagactggta

SEQ ID NO: 644363 - DNA, 20 bp, Artificial
  CRISPR gRNA sequence
atttcaaggcagactggtaa

SEQ ID NO: 644364 - DNA, 20 bp, Artificial
  CRISPR gRNA sequence
caaggcagactggtaacaaa

SEQ ID NO: 644365 - DNA, 20 bp, Artificial
  CRISPR gRNA sequence
aaggcagactggtaacaaat

SEQ ID NO: 644366 - DNA, 20 bp, Artificial
  CRISPR gRNA sequence
gtaacaaatgctttccagcc

SEQ ID NO: 644367 - DNA, 20 bp, Artificial
  CRISPR gRNA sequence
tccagcctacagactgcata

SEQ ID NO: 644368 - DNA, 20 bp, Artificial
  CRISPR gRNA sequence
ccagcctacagactgcatat

SEQ ID NO: 644369 - DNA, 20 bp, Artificial
  CRISPR gRNA sequence
cagcctacagactgcatatt

SEQ ID NO: 644370 - DNA, 20 bp, Artificial
  CRISPR gRNA sequence
cagactgcatattaagtagg

SEQ ID NO: 644371 - DNA, 20 bp, Artificial
  CRISPR gRNA sequence
catattaagtaggactacta

SEQ ID NO: 644372 - DNA, 20 bp, Artificial
  CRISPR gRNA sequence
agtaggactactataaagaa

SEQ ID NO: 644373 - DNA, 20 bp, Artificial
  CRISPR gRNA sequence
ctataaagaatacttgattt

SEQ ID NO: 644374 - DNA, 20 bp, Artificial
  CRISPR gRNA sequence
taaagaatacttgattttaa

SEQ ID NO: 644375 - DNA, 20 bp, Artificial
  CRISPR gRNA sequence
gattttaagaatgatagata

SEQ ID NO: 644376 - DNA, 20 bp, Artificial
  CRISPR gRNA sequence
attttaagaatgatagatat

SEQ ID NO: 644377 - DNA, 20 bp, Artificial
  CRISPR gRNA sequence
taagaatgatagatattgac

SEQ ID NO: 644378 - DNA, 20 bp, Artificial
  CRISPR gRNA sequence
aagaatgatagatattgact

SEQ ID NO: 644379 - DNA, 20 bp, Artificial
  CRISPR gRNA sequence
agaatgatagatattgacta

SEQ ID NO: 644380 - DNA, 20 bp, Artificial
  CRISPR gRNA sequence
actattttataataaaacaa

SEQ ID NO: 644381 - DNA, 20 bp, Artificial
  CRISPR gRNA sequence
ttttataataaaacaaacta

SEQ ID NO: 644382 - DNA, 20 bp, Artificial
  CRISPR gRNA sequence
tataataaaacaaactaaaa

SEQ ID NO: 644383 - DNA, 20 bp, Artificial
  CRISPR gRNA sequence
ataataaaacaaactaaaat

SEQ ID NO: 644384 - DNA, 20 bp, Artificial
  CRISPR gRNA sequence
taataaaacaaactaaaatt

SEQ ID NO: 644385 - DNA, 20 bp, Artificial
  CRISPR gRNA sequence
aaatttaaaactaaaaatcc

SEQ ID NO: 644386 - DNA, 20 bp, Artificial
  CRISPR gRNA sequence
aaaactaaaaatccttatta

SEQ ID NO: 644387 - DNA, 20 bp, Artificial
  CRISPR gRNA sequence
aaactaaaaatccttattaa

SEQ ID NO: 644388 - DNA, 20 bp, Artificial
  CRISPR gRNA sequence
aaaatccttattaatggtgt

SEQ ID NO: 644389 - DNA, 20 bp, Artificial
  CRISPR gRNA sequence
attaatggtgtttcacttac

SEQ ID NO: 644390 - DNA, 20 bp, Artificial
  CRISPR gRNA sequence
ttaatggtgtttcacttaca

SEQ ID NO: 644391 - DNA, 20 bp, Artificial
  CRISPR gRNA sequence
atggtgtttcacttacatga

SEQ ID NO: 644392 - DNA, 20 bp, Artificial
  CRISPR gRNA sequence
cacttacatgaatctcaatt

SEQ ID NO: 644393 - DNA, 20 bp, Artificial
  CRISPR gRNA sequence
acttacatgaatctcaattc

SEQ ID NO: 644394 - DNA, 20 bp, Artificial
  CRISPR gRNA sequence
acatgaatctcaattcaaac

SEQ ID NO: 644395 - DNA, 20 bp, Artificial
  CRISPR gRNA sequence
catgaatctcaattcaaact

SEQ ID NO: 644396 - DNA, 20 bp, Artificial
  CRISPR gRNA sequence
aattcaaactaggtatgaat

SEQ ID NO: 644397 - DNA, 20 bp, Artificial
  CRISPR gRNA sequence
aaactaggtatgaattttaa

SEQ ID NO: 644398 - DNA, 20 bp, Artificial
  CRISPR gRNA sequence
ggtatgaattttaaaaaata

SEQ ID NO: 644399 - DNA, 20 bp, Artificial
  CRISPR gRNA sequence
taaaaaatagtaaaattgcc

SEQ ID NO: 644400 - DNA, 20 bp, Artificial
  CRISPR gRNA sequence
aaaaaatagtaaaattgcca

SEQ ID NO: 644401 - DNA, 20 bp, Artificial
  CRISPR gRNA sequence
aaaaatagtaaaattgccaa

SEQ ID NO: 644402 - DNA, 20 bp, Artificial
  CRISPR gRNA sequence
ccaaaataccataggggccc

SEQ ID NO: 644403 - DNA, 20 bp, Artificial
  CRISPR gRNA sequence
ggtgaaagccacgtatttaa

SEQ ID NO: 644404 - DNA, 20 bp, Artificial
  CRISPR gRNA sequence
gtgaaagccacgtatttaac

SEQ ID NO: 644405 - DNA, 20 bp, Artificial
  CRISPR gRNA sequence
aacatactgtcttaaaaggc

SEQ ID NO: 644406 - DNA, 20 bp, Artificial
  CRISPR gRNA sequence
acatactgtcttaaaaggct

SEQ ID NO: 644407 - DNA, 20 bp, Artificial
  CRISPR gRNA sequence
tcttaaaaggctatttaata

SEQ ID NO: 644408 - DNA, 20 bp, Artificial
  CRISPR gRNA sequence
aaaaggctatttaatacagc

SEQ ID NO: 644409 - DNA, 20 bp, Artificial
  CRISPR gRNA sequence
aaaggctatttaatacagcc

SEQ ID NO: 644410 - DNA, 20 bp, Artificial
  CRISPR gRNA sequence
tttaatacagccactgaatt

SEQ ID NO: 644411 - DNA, 20 bp, Artificial
  CRISPR gRNA sequence
aatacagccactgaattcta

SEQ ID NO: 644412 - DNA, 20 bp, Artificial
  CRISPR gRNA sequence
atacagccactgaattctaa

SEQ ID NO: 644413 - DNA, 20 bp, Artificial
  CRISPR gRNA sequence
aattctaacttaatgttgat

SEQ ID NO: 644414 - DNA, 20 bp, Artificial
  CRISPR gRNA sequence
taacttaatgttgatctaat

SEQ ID NO: 644415 - DNA, 20 bp, Artificial
  CRISPR gRNA sequence
acttaatgttgatctaatac

SEQ ID NO: 644416 - DNA, 20 bp, Artificial
  CRISPR gRNA sequence
aatgttgatctaatacaaag

SEQ ID NO: 644417 - DNA, 20 bp, Artificial
  CRISPR gRNA sequence
atgttgatctaatacaaagc

SEQ ID NO: 644418 - DNA, 20 bp, Artificial
  CRISPR gRNA sequence
atctaatacaaagcattacc

SEQ ID NO: 644419 - DNA, 20 bp, Artificial
  CRISPR gRNA sequence
atacaaagcattaccgtgca

SEQ ID NO: 644420 - DNA, 20 bp, Artificial
  CRISPR gRNA sequence
ccgtgcaatagtcactaaat

SEQ ID NO: 644421 - DNA, 20 bp, Artificial
  CRISPR gRNA sequence
aataaactatgaaaaacaac

SEQ ID NO: 644422 - DNA, 20 bp, Artificial
  CRISPR gRNA sequence
tgaaaaacaaccaataagag

SEQ ID NO: 644423 - DNA, 20 bp, Artificial
  CRISPR gRNA sequence
acaggtttacacttaaattt

SEQ ID NO: 644424 - DNA, 20 bp, Artificial
  CRISPR gRNA sequence
caggtttacacttaaatttt

SEQ ID NO: 644425 - DNA, 20 bp, Artificial
  CRISPR gRNA sequence
acacttaaattttttaagga

SEQ ID NO: 644426 - DNA, 20 bp, Artificial
  CRISPR gRNA sequence
cacttaaattttttaaggaa

SEQ ID NO: 644427 - DNA, 20 bp, Artificial
  CRISPR gRNA sequence
aaattttttaaggaagttcc

SEQ ID NO: 644428 - DNA, 20 bp, Artificial
  CRISPR gRNA sequence
aattttttaaggaagttcct

SEQ ID NO: 644429 - DNA, 20 bp, Artificial
  CRISPR gRNA sequence
tttaaggaagttcctcacac

SEQ ID NO: 644430 - DNA, 20 bp, Artificial
  CRISPR gRNA sequence
ttaaggaagttcctcacact

SEQ ID NO: 644431 - DNA, 20 bp, Artificial
  CRISPR gRNA sequence
taaggaagttcctcacacta

SEQ ID NO: 644432 - DNA, 20 bp, Artificial
  CRISPR gRNA sequence
aaggaagttcctcacactaa

SEQ ID NO: 644433 - DNA, 20 bp, Artificial
  CRISPR gRNA sequence
aggaagttcctcacactaat

SEQ ID NO: 644434 - DNA, 20 bp, Artificial
  CRISPR gRNA sequence
ctcacactaatctaactaca

SEQ ID NO: 644435 - DNA, 20 bp, Artificial
  CRISPR gRNA sequence
acactaatctaactacaata

SEQ ID NO: 644436 - DNA, 20 bp, Artificial
  CRISPR gRNA sequence
atctaactacaatatactta

SEQ ID NO: 644437 - DNA, 20 bp, Artificial
  CRISPR gRNA sequence
actacaatatacttaggaat

SEQ ID NO: 644438 - DNA, 20 bp, Artificial
  CRISPR gRNA sequence
caatatacttaggaatactt

SEQ ID NO: 644439 - DNA, 20 bp, Artificial
  CRISPR gRNA sequence
aggaatacttggcaacatta

SEQ ID NO: 644440 - DNA, 20 bp, Artificial
  CRISPR gRNA sequence
ggaatacttggcaacattaa

SEQ ID NO: 644441 - DNA, 20 bp, Artificial
  CRISPR gRNA sequence
ggcaacattaacagtacctg

SEQ ID NO: 644442 - DNA, 20 bp, Artificial
  CRISPR gRNA sequence
gcaacattaacagtacctgt

SEQ ID NO: 644443 - DNA, 20 bp, Artificial
  CRISPR gRNA sequence
acagtacctgtggctactct

SEQ ID NO: 644444 - DNA, 20 bp, Artificial
  CRISPR gRNA sequence
tggctactctaggtagtatt

SEQ ID NO: 644445 - DNA, 20 bp, Artificial
  CRISPR gRNA sequence
ctctaggtagtatttctttt

SEQ ID NO: 644446 - DNA, 20 bp, Artificial
  CRISPR gRNA sequence
taggtagtatttctttttaa

SEQ ID NO: 644447 - DNA, 20 bp, Artificial
  CRISPR gRNA sequence
ggtagtatttctttttaaag

SEQ ID NO: 644448 - DNA, 20 bp, Artificial
  CRISPR gRNA sequence
ctttttaaaggccaggtact

SEQ ID NO: 644449 - DNA, 20 bp, Artificial
  CRISPR gRNA sequence
tttttaaaggccaggtactt

SEQ ID NO: 644450 - DNA, 20 bp, Artificial
  CRISPR gRNA sequence
tttaaaggccaggtacttgt

SEQ ID NO: 644451 - DNA, 20 bp, Artificial
  CRISPR gRNA sequence
ttaaaggccaggtacttgta

SEQ ID NO: 644452 - DNA, 20 bp, Artificial
  CRISPR gRNA sequence
taaaggccaggtacttgtat

SEQ ID NO: 644453 - DNA, 20 bp, Artificial
  CRISPR gRNA sequence
aaaggccaggtacttgtata

SEQ ID NO: 644454 - DNA, 20 bp, Artificial
  CRISPR gRNA sequence
aaggccaggtacttgtataa

SEQ ID NO: 644455 - DNA, 20 bp, Artificial
  CRISPR gRNA sequence
gtataaagagaagtcccaat

SEQ ID NO: 644456 - DNA, 20 bp, Artificial
  CRISPR gRNA sequence
tataaagagaagtcccaata

SEQ ID NO: 644457 - DNA, 20 bp, Artificial
  CRISPR gRNA sequence
taaatccaacaaactcaata

SEQ ID NO: 644458 - DNA, 20 bp, Artificial
  CRISPR gRNA sequence
aataatatattaaaatgttt

SEQ ID NO: 644459 - DNA, 20 bp, Artificial
  CRISPR gRNA sequence
aaatgtttagcttgttgttt

SEQ ID NO: 644460 - DNA, 20 bp, Artificial
  CRISPR gRNA sequence
agcttgttgtttttcttaca

SEQ ID NO: 644461 - DNA, 20 bp, Artificial
  CRISPR gRNA sequence
gcttgttgtttttcttacag

SEQ ID NO: 644462 - DNA, 20 bp, Artificial
  CRISPR gRNA sequence
gttgtttttcttacagaaca

SEQ ID NO: 644463 - DNA, 20 bp, Artificial
  CRISPR gRNA sequence
ttgtttttcttacagaacag

SEQ ID NO: 644464 - DNA, 20 bp, Artificial
  CRISPR gRNA sequence
tttttcttacagaacagata

SEQ ID NO: 644465 - DNA, 20 bp, Artificial
  CRISPR gRNA sequence
ttcttacagaacagataata

SEQ ID NO: 644466 - DNA, 20 bp, Artificial
  CRISPR gRNA sequence
tcttacagaacagataatac

SEQ ID NO: 644467 - DNA, 20 bp, Artificial
  CRISPR gRNA sequence
cttacagaacagataatact

SEQ ID NO: 644468 - DNA, 20 bp, Artificial
  CRISPR gRNA sequence
ttacagaacagataatactt

SEQ ID NO: 644469 - DNA, 20 bp, Artificial
  CRISPR gRNA sequence
acagaacagataatactttc

SEQ ID NO: 644470 - DNA, 20 bp, Artificial
  CRISPR gRNA sequence
cagaacagataatactttct

SEQ ID NO: 644471 - DNA, 20 bp, Artificial
  CRISPR gRNA sequence
tctaggtatttgcttttcta

SEQ ID NO: 644472 - DNA, 20 bp, Artificial
  CRISPR gRNA sequence
ctaggtatttgcttttctag

SEQ ID NO: 644473 - DNA, 20 bp, Artificial
  CRISPR gRNA sequence
taggtatttgcttttctagt

SEQ ID NO: 644474 - DNA, 20 bp, Artificial
  CRISPR gRNA sequence
ggtatttgcttttctagtgc

SEQ ID NO: 644475 - DNA, 20 bp, Artificial
  CRISPR gRNA sequence
gcttttctagtgctttatga

SEQ ID NO: 644476 - DNA, 20 bp, Artificial
  CRISPR gRNA sequence
cttttctagtgctttatgat

SEQ ID NO: 644477 - DNA, 20 bp, Artificial
  CRISPR gRNA sequence
ttctagtgctttatgatttc

SEQ ID NO: 644478 - DNA, 20 bp, Artificial
  CRISPR gRNA sequence
tctagtgctttatgatttca

SEQ ID NO: 644479 - DNA, 20 bp, Artificial
  CRISPR gRNA sequence
ctagtgctttatgatttcaa

SEQ ID NO: 644480 - DNA, 20 bp, Artificial
  CRISPR gRNA sequence
tagtgctttatgatttcaac

SEQ ID NO: 644481 - DNA, 20 bp, Artificial
  CRISPR gRNA sequence
gtgctttatgatttcaacgt

SEQ ID NO: 644482 - DNA, 20 bp, Artificial
  CRISPR gRNA sequence
tatgatttcaacgtaatgtt

SEQ ID NO: 644483 - DNA, 20 bp, Artificial
  CRISPR gRNA sequence
atgatttcaacgtaatgttt

SEQ ID NO: 644484 - DNA, 20 bp, Artificial
  CRISPR gRNA sequence
tgatttcaacgtaatgtttt

SEQ ID NO: 644485 - DNA, 20 bp, Artificial
  CRISPR gRNA sequence
caacgtaatgttttgtcagt

SEQ ID NO: 644486 - DNA, 20 bp, Artificial
  CRISPR gRNA sequence
aacgtaatgttttgtcagtt

SEQ ID NO: 644487 - DNA, 20 bp, Artificial
  CRISPR gRNA sequence
tgtcagttttggcataatga

SEQ ID NO: 644488 - DNA, 20 bp, Artificial
  CRISPR gRNA sequence
gtcagttttggcataatgaa

SEQ ID NO: 644489 - DNA, 20 bp, Artificial
  CRISPR gRNA sequence
tcagttttggcataatgaaa

SEQ ID NO: 644490 - DNA, 20 bp, Artificial
  CRISPR gRNA sequence
tggcataatgaaaattaata

SEQ ID NO: 644491 - DNA, 20 bp, Artificial
  CRISPR gRNA sequence
ggcataatgaaaattaataa

SEQ ID NO: 644492 - DNA, 20 bp, Artificial
  CRISPR gRNA sequence
gcataatgaaaattaataat

SEQ ID NO: 644493 - DNA, 20 bp, Artificial
  CRISPR gRNA sequence
ataatacagatcctacctac

SEQ ID NO: 644494 - DNA, 20 bp, Artificial
  CRISPR gRNA sequence
cctacacggttgaaccctac

SEQ ID NO: 644495 - DNA, 20 bp, Artificial
  CRISPR gRNA sequence
cacggttgaaccctacttgg

SEQ ID NO: 644496 - DNA, 20 bp, Artificial
  CRISPR gRNA sequence
aaccctacttgggctgccat

SEQ ID NO: 644497 - DNA, 20 bp, Artificial
  CRISPR gRNA sequence
cttgggctgccatggtagaa

SEQ ID NO: 644498 - DNA, 20 bp, Artificial
  CRISPR gRNA sequence
gggctgccatggtagaaaga

SEQ ID NO: 644499 - DNA, 20 bp, Artificial
  CRISPR gRNA sequence
ggctgccatggtagaaagag

SEQ ID NO: 644500 - DNA, 20 bp, Artificial
  CRISPR gRNA sequence
ccatggtagaaagagagaga

SEQ ID NO: 644501 - DNA, 20 bp, Artificial
  CRISPR gRNA sequence
tgttgactaaacaaaatcac

SEQ ID NO: 644502 - DNA, 20 bp, Artificial
  CRISPR gRNA sequence
gttgactaaacaaaatcacc

SEQ ID NO: 644503 - DNA, 20 bp, Artificial
  CRISPR gRNA sequence
ttgactaaacaaaatcacct

SEQ ID NO: 644504 - DNA, 20 bp, Artificial
  CRISPR gRNA sequence
actaaacaaaatcacctatt

SEQ ID NO: 644505 - DNA, 20 bp, Artificial
  CRISPR gRNA sequence
aacaaaatcacctattttcc

SEQ ID NO: 644506 - DNA, 20 bp, Artificial
  CRISPR gRNA sequence
ttttccctatacctatgagg

SEQ ID NO: 644507 - DNA, 20 bp, Artificial
  CRISPR gRNA sequence
tccctatacctatgaggaaa

SEQ ID NO: 644508 - DNA, 20 bp, Artificial
  CRISPR gRNA sequence
ccctatacctatgaggaaaa

SEQ ID NO: 644509 - DNA, 20 bp, Artificial
  CRISPR gRNA sequence
cctatacctatgaggaaaaa

SEQ ID NO: 644510 - DNA, 20 bp, Artificial
  CRISPR gRNA sequence
tacctatgaggaaaaatatt

SEQ ID NO: 644511 - DNA, 20 bp, Artificial
  CRISPR gRNA sequence
tgaggaaaaatattacaatg

SEQ ID NO: 644512 - DNA, 20 bp, Artificial
  CRISPR gRNA sequence
caatgaaacaaaatgagatg

SEQ ID NO: 644513 - DNA, 20 bp, Artificial
  CRISPR gRNA sequence
ttatgtctataatgttaaaa

SEQ ID NO: 644514 - DNA, 20 bp, Artificial
  CRISPR gRNA sequence
atgtctataatgttaaaatt

SEQ ID NO: 644515 - DNA, 20 bp, Artificial
  CRISPR gRNA sequence
tgtctataatgttaaaattt

SEQ ID NO: 644516 - DNA, 20 bp, Artificial
  CRISPR gRNA sequence
taatgttaaaatttggttta

SEQ ID NO: 644517 - DNA, 20 bp, Artificial
  CRISPR gRNA sequence
aaatttggtttatcagtaaa

SEQ ID NO: 644518 - DNA, 20 bp, Artificial
  CRISPR gRNA sequence
ggtttatcagtaaattactt

SEQ ID NO: 644519 - DNA, 20 bp, Artificial
  CRISPR gRNA sequence
gtttatcagtaaattacttc

SEQ ID NO: 644520 - DNA, 20 bp, Artificial
  CRISPR gRNA sequence
atcagtaaattacttcatat

SEQ ID NO: 644521 - DNA, 20 bp, Artificial
  CRISPR gRNA sequence
tcagtaaattacttcatatc

SEQ ID NO: 644522 - DNA, 20 bp, Artificial
  CRISPR gRNA sequence
cttcatatctttcaagcctg

SEQ ID NO: 644523 - DNA, 20 bp, Artificial
  CRISPR gRNA sequence
catatctttcaagcctgctt

SEQ ID NO: 644524 - DNA, 20 bp, Artificial
  CRISPR gRNA sequence
atatctttcaagcctgcttt

SEQ ID NO: 644525 - DNA, 20 bp, Artificial
  CRISPR gRNA sequence
tcaagcctgctttaaaaaaa

SEQ ID NO: 644526 - DNA, 20 bp, Artificial
  CRISPR gRNA sequence
caagcctgctttaaaaaaaa

SEQ ID NO: 644527 - DNA, 20 bp, Artificial
  CRISPR gRNA sequence
aagcctgctttaaaaaaaat

SEQ ID NO: 644528 - DNA, 20 bp, Artificial
  CRISPR gRNA sequence
ctttaaaaaaaatctcagaa

SEQ ID NO: 644529 - DNA, 20 bp, Artificial
  CRISPR gRNA sequence
taaaaaaaatctcagaaacc

SEQ ID NO: 644530 - DNA, 20 bp, Artificial
  CRISPR gRNA sequence
aaaaaaaatctcagaaacca

SEQ ID NO: 644531 - DNA, 20 bp, Artificial
  CRISPR gRNA sequence
aaaaaaatctcagaaaccat

SEQ ID NO: 644532 - DNA, 20 bp, Artificial
  CRISPR gRNA sequence
agaaaccataaaaatgtttt

SEQ ID NO: 644533 - DNA, 20 bp, Artificial
  CRISPR gRNA sequence
tcattagttatttaaacact

SEQ ID NO: 644534 - DNA, 20 bp, Artificial
  CRISPR gRNA sequence
cattagttatttaaacacta

SEQ ID NO: 644535 - DNA, 20 bp, Artificial
  CRISPR gRNA sequence
attagttatttaaacactag

SEQ ID NO: 644536 - DNA, 20 bp, Artificial
  CRISPR gRNA sequence
gttatttaaacactagaata

SEQ ID NO: 644537 - DNA, 20 bp, Artificial
  CRISPR gRNA sequence
tttaaacactagaataggta

SEQ ID NO: 644538 - DNA, 20 bp, Artificial
  CRISPR gRNA sequence
aaacactagaataggtagtg

SEQ ID NO: 644539 - DNA, 20 bp, Artificial
  CRISPR gRNA sequence
aacactagaataggtagtga

SEQ ID NO: 644540 - DNA, 20 bp, Artificial
  CRISPR gRNA sequence
gaataggtagtgactaagat

SEQ ID NO: 644541 - DNA, 20 bp, Artificial
  CRISPR gRNA sequence
agatttgagaagaagatgag

SEQ ID NO: 644542 - DNA, 20 bp, Artificial
  CRISPR gRNA sequence
gagaagaagatgagaggcag

SEQ ID NO: 644543 - DNA, 20 bp, Artificial
  CRISPR gRNA sequence
agaagaagatgagaggcagt

SEQ ID NO: 644544 - DNA, 20 bp, Artificial
  CRISPR gRNA sequence
taaccagcattactcattat

SEQ ID NO: 644545 - DNA, 20 bp, Artificial
  CRISPR gRNA sequence
accagcattactcattattt

SEQ ID NO: 644546 - DNA, 20 bp, Artificial
  CRISPR gRNA sequence
ctcattatttctccaacctg

SEQ ID NO: 644547 - DNA, 20 bp, Artificial
  CRISPR gRNA sequence
attatttctccaacctggaa

SEQ ID NO: 644548 - DNA, 20 bp, Artificial
  CRISPR gRNA sequence
tttctccaacctggaaaaac

SEQ ID NO: 644549 - DNA, 20 bp, Artificial
  CRISPR gRNA sequence
ctccaacctggaaaaacttt

SEQ ID NO: 644550 - DNA, 20 bp, Artificial
  CRISPR gRNA sequence
tccaacctggaaaaactttt

SEQ ID NO: 644551 - DNA, 20 bp, Artificial
  CRISPR gRNA sequence
caacctggaaaaactttttc

SEQ ID NO: 644552 - DNA, 20 bp, Artificial
  CRISPR gRNA sequence
gaaaaactttttcttctttc

SEQ ID NO: 644553 - DNA, 20 bp, Artificial
  CRISPR gRNA sequence
tttcttctttcagaggtcaa

SEQ ID NO: 644554 - DNA, 20 bp, Artificial
  CRISPR gRNA sequence
ttcttctttcagaggtcaaa

SEQ ID NO: 644555 - DNA, 20 bp, Artificial
  CRISPR gRNA sequence
tcttctttcagaggtcaaat

SEQ ID NO: 644556 - DNA, 20 bp, Artificial
  CRISPR gRNA sequence
cttctttcagaggtcaaatt

SEQ ID NO: 644557 - DNA, 20 bp, Artificial
  CRISPR gRNA sequence
ttctttcagaggtcaaatta

SEQ ID NO: 644558 - DNA, 20 bp, Artificial
  CRISPR gRNA sequence
ctttcagaggtcaaattaaa

SEQ ID NO: 644559 - DNA, 20 bp, Artificial
  CRISPR gRNA sequence
tttcagaggtcaaattaaaa

SEQ ID NO: 644560 - DNA, 20 bp, Artificial
  CRISPR gRNA sequence
tcagaggtcaaattaaaagt

SEQ ID NO: 644561 - DNA, 20 bp, Artificial
  CRISPR gRNA sequence
cagaggtcaaattaaaagta

SEQ ID NO: 644562 - DNA, 20 bp, Artificial
  CRISPR gRNA sequence
agaggtcaaattaaaagtac

SEQ ID NO: 644563 - DNA, 20 bp, Artificial
  CRISPR gRNA sequence
aaagtacctttacctatggt

SEQ ID NO: 644564 - DNA, 20 bp, Artificial
  CRISPR gRNA sequence
tacctatggttatccagaaa

SEQ ID NO: 644565 - DNA, 20 bp, Artificial
  CRISPR gRNA sequence
acctatggttatccagaaaa

SEQ ID NO: 644566 - DNA, 20 bp, Artificial
  CRISPR gRNA sequence
cctatggttatccagaaaag

SEQ ID NO: 644567 - DNA, 20 bp, Artificial
  CRISPR gRNA sequence
tggttatccagaaaaggaat

SEQ ID NO: 644568 - DNA, 20 bp, Artificial
  CRISPR gRNA sequence
tccagaaaaggaatgagaat

SEQ ID NO: 644569 - DNA, 20 bp, Artificial
  CRISPR gRNA sequence
gaatagatacgttcactgta

SEQ ID NO: 644570 - DNA, 20 bp, Artificial
  CRISPR gRNA sequence
actgtagtctgcctaaagaa

SEQ ID NO: 644571 - DNA, 20 bp, Artificial
  CRISPR gRNA sequence
tagtctgcctaaagaaaaca

SEQ ID NO: 644572 - DNA, 20 bp, Artificial
  CRISPR gRNA sequence
cctaaagaaaacactaggaa

SEQ ID NO: 644573 - DNA, 20 bp, Artificial
  CRISPR gRNA sequence
aagaaaacactaggaaagaa

SEQ ID NO: 644574 - DNA, 20 bp, Artificial
  CRISPR gRNA sequence
ggaaagaattatgatataca

SEQ ID NO: 644575 - DNA, 20 bp, Artificial
  CRISPR gRNA sequence
tgatatacaaatttccttca

SEQ ID NO: 644576 - DNA, 20 bp, Artificial
  CRISPR gRNA sequence
ccttcacattgatgtttttc

SEQ ID NO: 644577 - DNA, 20 bp, Artificial
  CRISPR gRNA sequence
cttcacattgatgtttttct

SEQ ID NO: 644578 - DNA, 20 bp, Artificial
  CRISPR gRNA sequence
cacattgatgtttttctggc

SEQ ID NO: 644579 - DNA, 20 bp, Artificial
  CRISPR gRNA sequence
acattgatgtttttctggca

SEQ ID NO: 644580 - DNA, 20 bp, Artificial
  CRISPR gRNA sequence
atgtttttctggcaactgac

SEQ ID NO: 644581 - DNA, 20 bp, Artificial
  CRISPR gRNA sequence
ttctggcaactgacactacc

SEQ ID NO: 644582 - DNA, 20 bp, Artificial
  CRISPR gRNA sequence
tctggcaactgacactacct

SEQ ID NO: 644583 - DNA, 20 bp, Artificial
  CRISPR gRNA sequence
ctggcaactgacactaccta

SEQ ID NO: 644584 - DNA, 20 bp, Artificial
  CRISPR gRNA sequence
tggcaactgacactacctac

SEQ ID NO: 644585 - DNA, 20 bp, Artificial
  CRISPR gRNA sequence
gcaactgacactacctacta

SEQ ID NO: 644586 - DNA, 20 bp, Artificial
  CRISPR gRNA sequence
acactacctactattaagat

SEQ ID NO: 644587 - DNA, 20 bp, Artificial
  CRISPR gRNA sequence
cctactattaagataattct

SEQ ID NO: 644588 - DNA, 20 bp, Artificial
  CRISPR gRNA sequence
ctattaagataattctgaga

SEQ ID NO: 644589 - DNA, 20 bp, Artificial
  CRISPR gRNA sequence
ttaagataattctgagatta

SEQ ID NO: 644590 - DNA, 20 bp, Artificial
  CRISPR gRNA sequence
agataattctgagattacaa

SEQ ID NO: 644591 - DNA, 20 bp, Artificial
  CRISPR gRNA sequence
tgagattacaaaaaaaaaat

SEQ ID NO: 644592 - DNA, 20 bp, Artificial
  CRISPR gRNA sequence
agattacaaaaaaaaaatta

SEQ ID NO: 644593 - DNA, 20 bp, Artificial
  CRISPR gRNA sequence
caaaaaaaaaattagttcaa

SEQ ID NO: 644594 - DNA, 20 bp, Artificial
  CRISPR gRNA sequence
gttcaaatgaaggaaatcct

SEQ ID NO: 644595 - DNA, 20 bp, Artificial
  CRISPR gRNA sequence
aaatgaaggaaatccttacc

SEQ ID NO: 644596 - DNA, 20 bp, Artificial
  CRISPR gRNA sequence
acctaggctccaaattaaat

SEQ ID NO: 644597 - DNA, 20 bp, Artificial
  CRISPR gRNA sequence
cctaggctccaaattaaatt

SEQ ID NO: 644598 - DNA, 20 bp, Artificial
  CRISPR gRNA sequence
ggctccaaattaaatttaat

SEQ ID NO: 644599 - DNA, 20 bp, Artificial
  CRISPR gRNA sequence
caaattaaatttaattttaa

SEQ ID NO: 644600 - DNA, 20 bp, Artificial
  CRISPR gRNA sequence
aatttaattttaaaaagcaa

SEQ ID NO: 644601 - DNA, 20 bp, Artificial
  CRISPR gRNA sequence
aattttaaaaagcaattatt

SEQ ID NO: 644602 - DNA, 20 bp, Artificial
  CRISPR gRNA sequence
attttaaaaagcaattatta

SEQ ID NO: 644603 - DNA, 20 bp, Artificial
  CRISPR gRNA sequence
taaaaagcaattattaaaaa

SEQ ID NO: 644604 - DNA, 20 bp, Artificial
  CRISPR gRNA sequence
aaaaagcaattattaaaaat

SEQ ID NO: 644605 - DNA, 20 bp, Artificial
  CRISPR gRNA sequence
aaaagcaattattaaaaatg

SEQ ID NO: 644606 - DNA, 20 bp, Artificial
  CRISPR gRNA sequence
ttaaaaatgtttatgtccac

SEQ ID NO: 644607 - DNA, 20 bp, Artificial
  CRISPR gRNA sequence
aaaatgtttatgtccacaaa

SEQ ID NO: 644608 - DNA, 20 bp, Artificial
  CRISPR gRNA sequence
atgtccacaaaggaaagtac

SEQ ID NO: 644609 - DNA, 20 bp, Artificial
  CRISPR gRNA sequence
tgtccacaaaggaaagtacg

SEQ ID NO: 644610 - DNA, 20 bp, Artificial
  CRISPR gRNA sequence
acgtcttataacaatcagct

SEQ ID NO: 644611 - DNA, 20 bp, Artificial
  CRISPR gRNA sequence
ataacaatcagctatcaaat

SEQ ID NO: 644612 - DNA, 20 bp, Artificial
  CRISPR gRNA sequence
taacaatcagctatcaaatg

SEQ ID NO: 644613 - DNA, 20 bp, Artificial
  CRISPR gRNA sequence
tcaaatgaataatccagcac

SEQ ID NO: 644614 - DNA, 20 bp, Artificial
  CRISPR gRNA sequence
aagagtatttttaatcagtc

SEQ ID NO: 644615 - DNA, 20 bp, Artificial
  CRISPR gRNA sequence
agagtatttttaatcagtct

SEQ ID NO: 644616 - DNA, 20 bp, Artificial
  CRISPR gRNA sequence
ttaatcagtctctgtattcc

SEQ ID NO: 644617 - DNA, 20 bp, Artificial
  CRISPR gRNA sequence
taatcagtctctgtattcca

SEQ ID NO: 644618 - DNA, 20 bp, Artificial
  CRISPR gRNA sequence
aatcagtctctgtattccat

SEQ ID NO: 644619 - DNA, 20 bp, Artificial
  CRISPR gRNA sequence
atcagtctctgtattccatc

SEQ ID NO: 644620 - DNA, 20 bp, Artificial
  CRISPR gRNA sequence
tgtattccatcatacatgaa

SEQ ID NO: 644621 - DNA, 20 bp, Artificial
  CRISPR gRNA sequence
tattccatcatacatgaaat

SEQ ID NO: 644622 - DNA, 20 bp, Artificial
  CRISPR gRNA sequence
catcatacatgaaatatagt

SEQ ID NO: 644623 - DNA, 20 bp, Artificial
  CRISPR gRNA sequence
gttccatgtttggtccaaga

SEQ ID NO: 644624 - DNA, 20 bp, Artificial
  CRISPR gRNA sequence
ttccatgtttggtccaagat

SEQ ID NO: 644625 - DNA, 20 bp, Artificial
  CRISPR gRNA sequence
catgtttggtccaagatgct

SEQ ID NO: 644626 - DNA, 20 bp, Artificial
  CRISPR gRNA sequence
ggtccaagatgctaatgata

SEQ ID NO: 644627 - DNA, 20 bp, Artificial
  CRISPR gRNA sequence
gtccaagatgctaatgatag

SEQ ID NO: 644628 - DNA, 20 bp, Artificial
  CRISPR gRNA sequence
atgatagtagctgtggcaat

SEQ ID NO: 644629 - DNA, 20 bp, Artificial
  CRISPR gRNA sequence
tggcaatcaaatcagtagca

SEQ ID NO: 644630 - DNA, 20 bp, Artificial
  CRISPR gRNA sequence
acacctagagtgcaaagaaa

SEQ ID NO: 644631 - DNA, 20 bp, Artificial
  CRISPR gRNA sequence
gagtgcaaagaaacattctt

SEQ ID NO: 644632 - DNA, 20 bp, Artificial
  CRISPR gRNA sequence
tttcttactactttattctc

SEQ ID NO: 644633 - DNA, 20 bp, Artificial
  CRISPR gRNA sequence
tcttactactttattctcac

SEQ ID NO: 644634 - DNA, 20 bp, Artificial
  CRISPR gRNA sequence
cttactactttattctcact

SEQ ID NO: 644635 - DNA, 20 bp, Artificial
  CRISPR gRNA sequence
ttactactttattctcactt

SEQ ID NO: 644636 - DNA, 20 bp, Artificial
  CRISPR gRNA sequence
actactttattctcacttta

SEQ ID NO: 644637 - DNA, 20 bp, Artificial
  CRISPR gRNA sequence
ctactttattctcactttag

SEQ ID NO: 644638 - DNA, 20 bp, Artificial
  CRISPR gRNA sequence
ctttattctcactttagctc

SEQ ID NO: 644639 - DNA, 20 bp, Artificial
  CRISPR gRNA sequence
tattctcactttagctctgt

SEQ ID NO: 644640 - DNA, 20 bp, Artificial
  CRISPR gRNA sequence
attctcactttagctctgtc

SEQ ID NO: 644641 - DNA, 20 bp, Artificial
  CRISPR gRNA sequence
ttctcactttagctctgtct

SEQ ID NO: 644642 - DNA, 20 bp, Artificial
  CRISPR gRNA sequence
tcactttagctctgtctaaa

SEQ ID NO: 644643 - DNA, 20 bp, Artificial
  CRISPR gRNA sequence
actttagctctgtctaaagg

SEQ ID NO: 644644 - DNA, 20 bp, Artificial
  CRISPR gRNA sequence
tagctctgtctaaaggacag

SEQ ID NO: 644645 - DNA, 20 bp, Artificial
  CRISPR gRNA sequence
agctctgtctaaaggacagg

SEQ ID NO: 644646 - DNA, 20 bp, Artificial
  CRISPR gRNA sequence
gctctgtctaaaggacagga

SEQ ID NO: 644647 - DNA, 20 bp, Artificial
  CRISPR gRNA sequence
tgtctaaaggacaggaaata

SEQ ID NO: 644648 - DNA, 20 bp, Artificial
  CRISPR gRNA sequence
tctaaaggacaggaaataat

SEQ ID NO: 644649 - DNA, 20 bp, Artificial
  CRISPR gRNA sequence
aaggacaggaaataatgtca

SEQ ID NO: 644650 - DNA, 20 bp, Artificial
  CRISPR gRNA sequence
ctcccataacaaataaacct

SEQ ID NO: 644651 - DNA, 20 bp, Artificial
  CRISPR gRNA sequence
ccataacaaataaacctgcc

SEQ ID NO: 644652 - DNA, 20 bp, Artificial
  CRISPR gRNA sequence
ccatttcagataactgatcc

SEQ ID NO: 644653 - DNA, 20 bp, Artificial
  CRISPR gRNA sequence
cagataactgatccatgaca

SEQ ID NO: 644654 - DNA, 20 bp, Artificial
  CRISPR gRNA sequence
agataactgatccatgacag

SEQ ID NO: 644655 - DNA, 20 bp, Artificial
  CRISPR gRNA sequence
atccatgacaggttactagt

SEQ ID NO: 644656 - DNA, 20 bp, Artificial
  CRISPR gRNA sequence
ctagtattcaaaactggcac

SEQ ID NO: 644657 - DNA, 20 bp, Artificial
  CRISPR gRNA sequence
gtattcaaaactggcactta

SEQ ID NO: 644658 - DNA, 20 bp, Artificial
  CRISPR gRNA sequence
aaaactggcacttagaacat

SEQ ID NO: 644659 - DNA, 20 bp, Artificial
  CRISPR gRNA sequence
gcacttagaacattgtcacc

SEQ ID NO: 644660 - DNA, 20 bp, Artificial
  CRISPR gRNA sequence
agaacattgtcaccatgcaa

SEQ ID NO: 644661 - DNA, 20 bp, Artificial
  CRISPR gRNA sequence
gaacattgtcaccatgcaag

SEQ ID NO: 644662 - DNA, 20 bp, Artificial
  CRISPR gRNA sequence
tcaccatgcaagcaaacagg

SEQ ID NO: 644663 - DNA, 20 bp, Artificial
  CRISPR gRNA sequence
gcaggctgtagacctaaatc

SEQ ID NO: 644664 - DNA, 20 bp, Artificial
  CRISPR gRNA sequence
caggctgtagacctaaatct

SEQ ID NO: 644665 - DNA, 20 bp, Artificial
  CRISPR gRNA sequence
tagacctaaatctgctacat

SEQ ID NO: 644666 - DNA, 20 bp, Artificial
  CRISPR gRNA sequence
aatctgctacatggatcttt

SEQ ID NO: 644667 - DNA, 20 bp, Artificial
  CRISPR gRNA sequence
ctacatggatcttttttact

SEQ ID NO: 644668 - DNA, 20 bp, Artificial
  CRISPR gRNA sequence
catggatcttttttacttgt

SEQ ID NO: 644669 - DNA, 20 bp, Artificial
  CRISPR gRNA sequence
ttttacttgttttggtaaaa

SEQ ID NO: 644670 - DNA, 20 bp, Artificial
  CRISPR gRNA sequence
tttacttgttttggtaaaac

SEQ ID NO: 644671 - DNA, 20 bp, Artificial
  CRISPR gRNA sequence
ttacttgttttggtaaaacc

SEQ ID NO: 644672 - DNA, 20 bp, Artificial
  CRISPR gRNA sequence
tacttgttttggtaaaacca

SEQ ID NO: 644673 - DNA, 20 bp, Artificial
  CRISPR gRNA sequence
acttgttttggtaaaaccag

SEQ ID NO: 644674 - DNA, 20 bp, Artificial
  CRISPR gRNA sequence
cttgttttggtaaaaccagg

SEQ ID NO: 644675 - DNA, 20 bp, Artificial
  CRISPR gRNA sequence
gttttggtaaaaccaggaaa

SEQ ID NO: 644676 - DNA, 20 bp, Artificial
  CRISPR gRNA sequence
ttttggtaaaaccaggaaag

SEQ ID NO: 644677 - DNA, 20 bp, Artificial
  CRISPR gRNA sequence
tggtaaaaccaggaaagaag

SEQ ID NO: 644678 - DNA, 20 bp, Artificial
  CRISPR gRNA sequence
ggtaaaaccaggaaagaagc

SEQ ID NO: 644679 - DNA, 20 bp, Artificial
  CRISPR gRNA sequence
gtaaaaccaggaaagaagca

SEQ ID NO: 644680 - DNA, 20 bp, Artificial
  CRISPR gRNA sequence
ttaaagaagtggtgattttc

SEQ ID NO: 644681 - DNA, 20 bp, Artificial
  CRISPR gRNA sequence
taaagaagtggtgattttca

SEQ ID NO: 644682 - DNA, 20 bp, Artificial
  CRISPR gRNA sequence
aaagaagtggtgattttcat

SEQ ID NO: 644683 - DNA, 20 bp, Artificial
  CRISPR gRNA sequence
aagaagtggtgattttcatg

SEQ ID NO: 644684 - DNA, 20 bp, Artificial
  CRISPR gRNA sequence
tcatgttttcaataattctg

SEQ ID NO: 644685 - DNA, 20 bp, Artificial
  CRISPR gRNA sequence
catgttttcaataattctgt

SEQ ID NO: 644686 - DNA, 20 bp, Artificial
  CRISPR gRNA sequence
atgttttcaataattctgta

SEQ ID NO: 644687 - DNA, 20 bp, Artificial
  CRISPR gRNA sequence
tcaataattctgtatttaaa

SEQ ID NO: 644688 - DNA, 20 bp, Artificial
  CRISPR gRNA sequence
caataattctgtatttaaac

SEQ ID NO: 644689 - DNA, 20 bp, Artificial
  CRISPR gRNA sequence
aataattctgtatttaaact

SEQ ID NO: 644690 - DNA, 20 bp, Artificial
  CRISPR gRNA sequence
tgtatttaaactagaatttg

SEQ ID NO: 644691 - DNA, 20 bp, Artificial
  CRISPR gRNA sequence
tatttaaactagaatttgtg

SEQ ID NO: 644692 - DNA, 20 bp, Artificial
  CRISPR gRNA sequence
aaactagaatttgtgagcgg

SEQ ID NO: 644693 - DNA, 20 bp, Artificial
  CRISPR gRNA sequence
aactagaatttgtgagcggc

SEQ ID NO: 644694 - DNA, 20 bp, Artificial
  CRISPR gRNA sequence
gaatttgtgagcggcatctt

SEQ ID NO: 644695 - DNA, 20 bp, Artificial
  CRISPR gRNA sequence
gtgagcggcatctttgagat

SEQ ID NO: 644696 - DNA, 20 bp, Artificial
  CRISPR gRNA sequence
tgagcggcatctttgagatg

SEQ ID NO: 644697 - DNA, 20 bp, Artificial
  CRISPR gRNA sequence
tgagatgggacagatgcata

SEQ ID NO: 644698 - DNA, 20 bp, Artificial
  CRISPR gRNA sequence
gagatgggacagatgcatag

SEQ ID NO: 644699 - DNA, 20 bp, Artificial
  CRISPR gRNA sequence
agatgggacagatgcatagt

SEQ ID NO: 644700 - DNA, 20 bp, Artificial
  CRISPR gRNA sequence
actactttctgtacccggga

SEQ ID NO: 644701 - DNA, 20 bp, Artificial
  CRISPR gRNA sequence
ctttctgtacccgggaaaac

SEQ ID NO: 644702 - DNA, 20 bp, Artificial
  CRISPR gRNA sequence
tctgtacccgggaaaaccaa

SEQ ID NO: 644703 - DNA, 20 bp, Artificial
  CRISPR gRNA sequence
ctgtacccgggaaaaccaag

SEQ ID NO: 644704 - DNA, 20 bp, Artificial
  CRISPR gRNA sequence
tgtacccgggaaaaccaagg

SEQ ID NO: 644705 - DNA, 20 bp, Artificial
  CRISPR gRNA sequence
tacccgggaaaaccaaggcg

SEQ ID NO: 644706 - DNA, 20 bp, Artificial
  CRISPR gRNA sequence
ttggcagttgtcagggtatc

SEQ ID NO: 644707 - DNA, 20 bp, Artificial
  CRISPR gRNA sequence
gcagttgtcagggtatctgt

SEQ ID NO: 644708 - DNA, 20 bp, Artificial
  CRISPR gRNA sequence
tcagggtatctgtttgccca

SEQ ID NO: 644709 - DNA, 20 bp, Artificial
  CRISPR gRNA sequence
tttgcccaacttttatccag

SEQ ID NO: 644710 - DNA, 20 bp, Artificial
  CRISPR gRNA sequence
gcccaacttttatccagctg

SEQ ID NO: 644711 - DNA, 20 bp, Artificial
  CRISPR gRNA sequence
cccaacttttatccagctgg

SEQ ID NO: 644712 - DNA, 20 bp, Artificial
  CRISPR gRNA sequence
ttatccagctggagcaaagg

SEQ ID NO: 644713 - DNA, 20 bp, Artificial
  CRISPR gRNA sequence
tatccagctggagcaaaggt

SEQ ID NO: 644714 - DNA, 20 bp, Artificial
  CRISPR gRNA sequence
atccagctggagcaaaggta

SEQ ID NO: 644715 - DNA, 20 bp, Artificial
  CRISPR gRNA sequence
tccagctggagcaaaggtaa

SEQ ID NO: 644716 - DNA, 20 bp, Artificial
  CRISPR gRNA sequence
gagcaaaggtaataagctct

SEQ ID NO: 644717 - DNA, 20 bp, Artificial
  CRISPR gRNA sequence
ttgaaatagaaaaagaaagt

SEQ ID NO: 644718 - DNA, 20 bp, Artificial
  CRISPR gRNA sequence
gaaatagaaaaagaaagtgg

SEQ ID NO: 644719 - DNA, 20 bp, Artificial
  CRISPR gRNA sequence
aaatagaaaaagaaagtgga

SEQ ID NO: 644720 - DNA, 20 bp, Artificial
  CRISPR gRNA sequence
gcaaattgataattttcaaa

SEQ ID NO: 644721 - DNA, 20 bp, Artificial
  CRISPR gRNA sequence
caaattgataattttcaaaa

SEQ ID NO: 644722 - DNA, 20 bp, Artificial
  CRISPR gRNA sequence
ataattttcaaaactgaatt

SEQ ID NO: 644723 - DNA, 20 bp, Artificial
  CRISPR gRNA sequence
tcaaaactgaattaaaatgt

SEQ ID NO: 644724 - DNA, 20 bp, Artificial
  CRISPR gRNA sequence
caaaactgaattaaaatgta

SEQ ID NO: 644725 - DNA, 20 bp, Artificial
  CRISPR gRNA sequence
aaaactgaattaaaatgtat

SEQ ID NO: 644726 - DNA, 20 bp, Artificial
  CRISPR gRNA sequence
aattaaaatgtatagtacca

SEQ ID NO: 644727 - DNA, 20 bp, Artificial
  CRISPR gRNA sequence
aaatgtatagtaccatacag

SEQ ID NO: 644728 - DNA, 20 bp, Artificial
  CRISPR gRNA sequence
gtccattaaatgtaatacaa

SEQ ID NO: 644729 - DNA, 20 bp, Artificial
  CRISPR gRNA sequence
tccattaaatgtaatacaaa

SEQ ID NO: 644730 - DNA, 20 bp, Artificial
  CRISPR gRNA sequence
aatgtaatacaaacaagaat

SEQ ID NO: 644731 - DNA, 20 bp, Artificial
  CRISPR gRNA sequence
acaattcaccaagacaagtt

SEQ ID NO: 644732 - DNA, 20 bp, Artificial
  CRISPR gRNA sequence
accaagacaagttgggaggt

SEQ ID NO: 644733 - DNA, 20 bp, Artificial
  CRISPR gRNA sequence
ggaggttgtttttacacctg

SEQ ID NO: 644734 - DNA, 20 bp, Artificial
  CRISPR gRNA sequence
tttttacacctgttcttggt

SEQ ID NO: 644735 - DNA, 20 bp, Artificial
  CRISPR gRNA sequence
ttacacctgttcttggtttg

SEQ ID NO: 644736 - DNA, 20 bp, Artificial
  CRISPR gRNA sequence
tacacctgttcttggtttgc

SEQ ID NO: 644737 - DNA, 20 bp, Artificial
  CRISPR gRNA sequence
acacctgttcttggtttgct

SEQ ID NO: 644738 - DNA, 20 bp, Artificial
  CRISPR gRNA sequence
cacctgttcttggtttgctc

SEQ ID NO: 644739 - DNA, 20 bp, Artificial
  CRISPR gRNA sequence
ttcttggtttgctcccaatg

SEQ ID NO: 644740 - DNA, 20 bp, Artificial
  CRISPR gRNA sequence
ttggtttgctcccaatgtac

SEQ ID NO: 644741 - DNA, 20 bp, Artificial
  CRISPR gRNA sequence
ggtttgctcccaatgtacaa

SEQ ID NO: 644742 - DNA, 20 bp, Artificial
  CRISPR gRNA sequence
gtttgctcccaatgtacaag

SEQ ID NO: 644743 - DNA, 20 bp, Artificial
  CRISPR gRNA sequence
gctcccaatgtacaagcaat

SEQ ID NO: 644744 - DNA, 20 bp, Artificial
  CRISPR gRNA sequence
ctcccaatgtacaagcaata

SEQ ID NO: 644745 - DNA, 20 bp, Artificial
  CRISPR gRNA sequence
ccaatgtacaagcaatagga

SEQ ID NO: 644746 - DNA, 20 bp, Artificial
  CRISPR gRNA sequence
tttaagtaaataagacgtca

SEQ ID NO: 644747 - DNA, 20 bp, Artificial
  CRISPR gRNA sequence
ttaagtaaataagacgtcaa

SEQ ID NO: 644748 - DNA, 20 bp, Artificial
  CRISPR gRNA sequence
taagtaaataagacgtcaat

SEQ ID NO: 644749 - DNA, 20 bp, Artificial
  CRISPR gRNA sequence
aagtaaataagacgtcaatc

SEQ ID NO: 644750 - DNA, 20 bp, Artificial
  CRISPR gRNA sequence
agtaaataagacgtcaatct

SEQ ID NO: 644751 - DNA, 20 bp, Artificial
  CRISPR gRNA sequence
ataaaatctcaataactctt

SEQ ID NO: 644752 - DNA, 20 bp, Artificial
  CRISPR gRNA sequence
aataactcttcattagaaat

SEQ ID NO: 644753 - DNA, 20 bp, Artificial
  CRISPR gRNA sequence
ttcattagaaattaaacaaa

SEQ ID NO: 644754 - DNA, 20 bp, Artificial
  CRISPR gRNA sequence
cattagaaattaaacaaaaa

SEQ ID NO: 644755 - DNA, 20 bp, Artificial
  CRISPR gRNA sequence
attagaaattaaacaaaaat

SEQ ID NO: 644756 - DNA, 20 bp, Artificial
  CRISPR gRNA sequence
gaaattaaacaaaaataatg

SEQ ID NO: 644757 - DNA, 20 bp, Artificial
  CRISPR gRNA sequence
aacaaaaataatgcataaaa

SEQ ID NO: 644758 - DNA, 20 bp, Artificial
  CRISPR gRNA sequence
taataagaccaaatataaca

SEQ ID NO: 644759 - DNA, 20 bp, Artificial
  CRISPR gRNA sequence
aataagaccaaatataacat

SEQ ID NO: 644760 - DNA, 20 bp, Artificial
  CRISPR gRNA sequence
ataagaccaaatataacatt

SEQ ID NO: 644761 - DNA, 20 bp, Artificial
  CRISPR gRNA sequence
aaaggaagggggggggtctc

SEQ ID NO: 644762 - DNA, 20 bp, Artificial
  CRISPR gRNA sequence
aaggaagggggggggtctca

SEQ ID NO: 644763 - DNA, 20 bp, Artificial
  CRISPR gRNA sequence
aattctattgaatttataga

SEQ ID NO: 644764 - DNA, 20 bp, Artificial
  CRISPR gRNA sequence
tattgaatttatagaataat

SEQ ID NO: 644765 - DNA, 20 bp, Artificial
  CRISPR gRNA sequence
ttgaatttatagaataatat

SEQ ID NO: 644766 - DNA, 20 bp, Artificial
  CRISPR gRNA sequence
aatttatagaataatatgtt

SEQ ID NO: 644767 - DNA, 20 bp, Artificial
  CRISPR gRNA sequence
atagaataatatgttgattt

SEQ ID NO: 644768 - DNA, 20 bp, Artificial
  CRISPR gRNA sequence
tagaataatatgttgattta

SEQ ID NO: 644769 - DNA, 20 bp, Artificial
  CRISPR gRNA sequence
atttaactaataatcaattg

SEQ ID NO: 644770 - DNA, 20 bp, Artificial
  CRISPR gRNA sequence
aactaataatcaattgttct

SEQ ID NO: 644771 - DNA, 20 bp, Artificial
  CRISPR gRNA sequence
actaataatcaattgttcta

SEQ ID NO: 644772 - DNA, 20 bp, Artificial
  CRISPR gRNA sequence
ataatcaattgttctattct

SEQ ID NO: 644773 - DNA, 20 bp, Artificial
  CRISPR gRNA sequence
ttctattcttcttgtcatat

SEQ ID NO: 644774 - DNA, 20 bp, Artificial
  CRISPR gRNA sequence
tattcttcttgtcatatttc

SEQ ID NO: 644775 - DNA, 20 bp, Artificial
  CRISPR gRNA sequence
ttcttcttgtcatatttcca

SEQ ID NO: 644776 - DNA, 20 bp, Artificial
  CRISPR gRNA sequence
ttcttgtcatatttccagct

SEQ ID NO: 644777 - DNA, 20 bp, Artificial
  CRISPR gRNA sequence
cttgtcatatttccagctgt

SEQ ID NO: 644778 - DNA, 20 bp, Artificial
  CRISPR gRNA sequence
ttgtcatatttccagctgta

SEQ ID NO: 644779 - DNA, 20 bp, Artificial
  CRISPR gRNA sequence
gtcatatttccagctgtacc

SEQ ID NO: 644780 - DNA, 20 bp, Artificial
  CRISPR gRNA sequence
tcatatttccagctgtacca

SEQ ID NO: 644781 - DNA, 20 bp, Artificial
  CRISPR gRNA sequence
ccagctgtaccagaaaattt

SEQ ID NO: 644782 - DNA, 20 bp, Artificial
  CRISPR gRNA sequence
cagctgtaccagaaaatttt

SEQ ID NO: 644783 - DNA, 20 bp, Artificial
  CRISPR gRNA sequence
taccagaaaatttttttaaa

SEQ ID NO: 644784 - DNA, 20 bp, Artificial
  CRISPR gRNA sequence
ttttaaaaagaagtgcttcc

SEQ ID NO: 644785 - DNA, 20 bp, Artificial
  CRISPR gRNA sequence
tttaaaaagaagtgcttcct

SEQ ID NO: 644786 - DNA, 20 bp, Artificial
  CRISPR gRNA sequence
ttaaaaagaagtgcttcctc

SEQ ID NO: 644787 - DNA, 20 bp, Artificial
  CRISPR gRNA sequence
taaaaagaagtgcttcctca

SEQ ID NO: 644788 - DNA, 20 bp, Artificial
  CRISPR gRNA sequence
aaaaagaagtgcttcctcag

SEQ ID NO: 644789 - DNA, 20 bp, Artificial
  CRISPR gRNA sequence
aaaagaagtgcttcctcagt

SEQ ID NO: 644790 - DNA, 20 bp, Artificial
  CRISPR gRNA sequence
cctcagtaatattctgctgc

SEQ ID NO: 644791 - DNA, 20 bp, Artificial
  CRISPR gRNA sequence
ctcagtaatattctgctgct

SEQ ID NO: 644792 - DNA, 20 bp, Artificial
  CRISPR gRNA sequence
agtaatattctgctgctcta

SEQ ID NO: 644793 - DNA, 20 bp, Artificial
  CRISPR gRNA sequence
tgctgctctacaacagtaag

SEQ ID NO: 644794 - DNA, 20 bp, Artificial
  CRISPR gRNA sequence
ctgctctacaacagtaagca

SEQ ID NO: 644795 - DNA, 20 bp, Artificial
  CRISPR gRNA sequence
ctctacaacagtaagcaaaa

SEQ ID NO: 644796 - DNA, 20 bp, Artificial
  CRISPR gRNA sequence
tacaacagtaagcaaaacag

SEQ ID NO: 644797 - DNA, 20 bp, Artificial
  CRISPR gRNA sequence
caacagtaagcaaaacagca

SEQ ID NO: 644798 - DNA, 20 bp, Artificial
  CRISPR gRNA sequence
tcattgtaaaaaggttcctt

SEQ ID NO: 644799 - DNA, 20 bp, Artificial
  CRISPR gRNA sequence
cattgtaaaaaggttccttt

SEQ ID NO: 644800 - DNA, 20 bp, Artificial
  CRISPR gRNA sequence
attgtaaaaaggttcctttt

SEQ ID NO: 644801 - DNA, 20 bp, Artificial
  CRISPR gRNA sequence
taaaaaggttcctttttact

SEQ ID NO: 644802 - DNA, 20 bp, Artificial
  CRISPR gRNA sequence
ctttttactctcgaatattg

SEQ ID NO: 644803 - DNA, 20 bp, Artificial
  CRISPR gRNA sequence
tttactctcgaatattgtga

SEQ ID NO: 644804 - DNA, 20 bp, Artificial
  CRISPR gRNA sequence
ttactctcgaatattgtgag

SEQ ID NO: 644805 - DNA, 20 bp, Artificial
  CRISPR gRNA sequence
tactctcgaatattgtgaga

SEQ ID NO: 644806 - DNA, 20 bp, Artificial
  CRISPR gRNA sequence
actctcgaatattgtgagat

SEQ ID NO: 644807 - DNA, 20 bp, Artificial
  CRISPR gRNA sequence
ctctcgaatattgtgagata

SEQ ID NO: 644808 - DNA, 20 bp, Artificial
  CRISPR gRNA sequence
tcgaatattgtgagataagc

SEQ ID NO: 644809 - DNA, 20 bp, Artificial
  CRISPR gRNA sequence
gaatattgtgagataagcag

SEQ ID NO: 644810 - DNA, 20 bp, Artificial
  CRISPR gRNA sequence
tgagataagcagtaatggaa

SEQ ID NO: 644811 - DNA, 20 bp, Artificial
  CRISPR gRNA sequence
gaggatcaagtccatatagt

SEQ ID NO: 644812 - DNA, 20 bp, Artificial
  CRISPR gRNA sequence
ctcacatgttctaaataccg

SEQ ID NO: 644813 - DNA, 20 bp, Artificial
  CRISPR gRNA sequence
acatgttctaaataccgtag

SEQ ID NO: 644814 - DNA, 20 bp, Artificial
  CRISPR gRNA sequence
taaataccgtagagggggct

SEQ ID NO: 644815 - DNA, 20 bp, Artificial
  CRISPR gRNA sequence
aataccgtagagggggctta

SEQ ID NO: 644816 - DNA, 20 bp, Artificial
  CRISPR gRNA sequence
aaatatacaactaatctaac

SEQ ID NO: 644817 - DNA, 20 bp, Artificial
  CRISPR gRNA sequence
aatatacaactaatctaaca

SEQ ID NO: 644818 - DNA, 20 bp, Artificial
  CRISPR gRNA sequence
atctaacaatcttaaaaaat

SEQ ID NO: 644819 - DNA, 20 bp, Artificial
  CRISPR gRNA sequence
acaatcttaaaaaatataag

SEQ ID NO: 644820 - DNA, 20 bp, Artificial
  CRISPR gRNA sequence
aaaaaatataagtattctca

SEQ ID NO: 644821 - DNA, 20 bp, Artificial
  CRISPR gRNA sequence
aaaaatataagtattctcac

SEQ ID NO: 644822 - DNA, 20 bp, Artificial
  CRISPR gRNA sequence
tcactttgtacaggtaagtc

SEQ ID NO: 644823 - DNA, 20 bp, Artificial
  CRISPR gRNA sequence
actttgtacaggtaagtcaa

SEQ ID NO: 644824 - DNA, 20 bp, Artificial
  CRISPR gRNA sequence
tgtacaggtaagtcaactga

SEQ ID NO: 644825 - DNA, 20 bp, Artificial
  CRISPR gRNA sequence
gtacaggtaagtcaactgag

SEQ ID NO: 644826 - DNA, 20 bp, Artificial
  CRISPR gRNA sequence
tacaggtaagtcaactgagg

SEQ ID NO: 644827 - DNA, 20 bp, Artificial
  CRISPR gRNA sequence
aggctcagagatattaattt

SEQ ID NO: 644828 - DNA, 20 bp, Artificial
  CRISPR gRNA sequence
agagatattaatttattcat

SEQ ID NO: 644829 - DNA, 20 bp, Artificial
  CRISPR gRNA sequence
atttattcatacaaggtcac

SEQ ID NO: 644830 - DNA, 20 bp, Artificial
  CRISPR gRNA sequence
attcatacaaggtcactcag

SEQ ID NO: 644831 - DNA, 20 bp, Artificial
  CRISPR gRNA sequence
ttcatacaaggtcactcagt

SEQ ID NO: 644832 - DNA, 20 bp, Artificial
  CRISPR gRNA sequence
atacaaggtcactcagtcag

SEQ ID NO: 644833 - DNA, 20 bp, Artificial
  CRISPR gRNA sequence
agtcagtagctagttattcc

SEQ ID NO: 644834 - DNA, 20 bp, Artificial
  CRISPR gRNA sequence
gttattcctttgggtaaaca

SEQ ID NO: 644835 - DNA, 20 bp, Artificial
  CRISPR gRNA sequence
ttcctttgggtaaacaatga

SEQ ID NO: 644836 - DNA, 20 bp, Artificial
  CRISPR gRNA sequence
ctttgggtaaacaatgataa

SEQ ID NO: 644837 - DNA, 20 bp, Artificial
  CRISPR gRNA sequence
tgggtaaacaatgataaatt

SEQ ID NO: 644838 - DNA, 20 bp, Artificial
  CRISPR gRNA sequence
gggtaaacaatgataaattg

SEQ ID NO: 644839 - DNA, 20 bp, Artificial
  CRISPR gRNA sequence
ggtaaacaatgataaattgt

SEQ ID NO: 644840 - DNA, 20 bp, Artificial
  CRISPR gRNA sequence
tgataaatgatgatagagag

SEQ ID NO: 644841 - DNA, 20 bp, Artificial
  CRISPR gRNA sequence
atggcaatgcttagatttga

SEQ ID NO: 644842 - DNA, 20 bp, Artificial
  CRISPR gRNA sequence
agatttgaaccattgcagac

SEQ ID NO: 644843 - DNA, 20 bp, Artificial
  CRISPR gRNA sequence
gatttgaaccattgcagact

SEQ ID NO: 644844 - DNA, 20 bp, Artificial
  CRISPR gRNA sequence
gaaccattgcagactgtctt

SEQ ID NO: 644845 - DNA, 20 bp, Artificial
  CRISPR gRNA sequence
aaccattgcagactgtcttc

SEQ ID NO: 644846 - DNA, 20 bp, Artificial
  CRISPR gRNA sequence
cagactgtcttcaaagcttg

SEQ ID NO: 644847 - DNA, 20 bp, Artificial
  CRISPR gRNA sequence
tcttcaaagcttggacagat

SEQ ID NO: 644848 - DNA, 20 bp, Artificial
  CRISPR gRNA sequence
caaagcttggacagatagct

SEQ ID NO: 644849 - DNA, 20 bp, Artificial
  CRISPR gRNA sequence
aaagcttggacagatagctt

SEQ ID NO: 644850 - DNA, 20 bp, Artificial
  CRISPR gRNA sequence
ggacagatagcttaataaac

SEQ ID NO: 644851 - DNA, 20 bp, Artificial
  CRISPR gRNA sequence
gacagatagcttaataaaca

SEQ ID NO: 644852 - DNA, 20 bp, Artificial
  CRISPR gRNA sequence
aataaacaatcacaaaagga

SEQ ID NO: 644853 - DNA, 20 bp, Artificial
  CRISPR gRNA sequence
ataaacaatcacaaaaggat

SEQ ID NO: 644854 - DNA, 20 bp, Artificial
  CRISPR gRNA sequence
tatgaatacttatcaaagat

SEQ ID NO: 644855 - DNA, 20 bp, Artificial
  CRISPR gRNA sequence
atcaaagataatcttctgat

SEQ ID NO: 644856 - DNA, 20 bp, Artificial
  CRISPR gRNA sequence
tcaaagataatcttctgatt

SEQ ID NO: 644857 - DNA, 20 bp, Artificial
  CRISPR gRNA sequence
ctgatttatcaaatcaacag

SEQ ID NO: 644858 - DNA, 20 bp, Artificial
  CRISPR gRNA sequence
tgatttatcaaatcaacaga

SEQ ID NO: 644859 - DNA, 20 bp, Artificial
  CRISPR gRNA sequence
atttatcaaatcaacagact

SEQ ID NO: 644860 - DNA, 20 bp, Artificial
  CRISPR gRNA sequence
atcaaatcaacagactgaac

SEQ ID NO: 644861 - DNA, 20 bp, Artificial
  CRISPR gRNA sequence
tcaaatcaacagactgaacg

SEQ ID NO: 644862 - DNA, 20 bp, Artificial
  CRISPR gRNA sequence
aacgaaaagaaaggcttaat

SEQ ID NO: 644863 - DNA, 20 bp, Artificial
  CRISPR gRNA sequence
aataaaagtttagtgggcac

SEQ ID NO: 644864 - DNA, 20 bp, Artificial
  CRISPR gRNA sequence
ataaaagtttagtgggcact

SEQ ID NO: 644865 - DNA, 20 bp, Artificial
  CRISPR gRNA sequence
agtgggcacttactgaatgt

SEQ ID NO: 644866 - DNA, 20 bp, Artificial
  CRISPR gRNA sequence
gtgggcacttactgaatgta

SEQ ID NO: 644867 - DNA, 20 bp, Artificial
  CRISPR gRNA sequence
actgaatgtatagtgaatga

SEQ ID NO: 644868 - DNA, 20 bp, Artificial
  CRISPR gRNA sequence
ctgaatgtatagtgaatgag

SEQ ID NO: 644869 - DNA, 20 bp, Artificial
  CRISPR gRNA sequence
aatgtatagtgaatgagaga

SEQ ID NO: 644870 - DNA, 20 bp, Artificial
  CRISPR gRNA sequence
tttttctttaaggaaaggat

SEQ ID NO: 644871 - DNA, 20 bp, Artificial
  CRISPR gRNA sequence
ttttctttaaggaaaggata

SEQ ID NO: 644872 - DNA, 20 bp, Artificial
  CRISPR gRNA sequence
tttctttaaggaaaggatag

SEQ ID NO: 644873 - DNA, 20 bp, Artificial
  CRISPR gRNA sequence
ttctttaaggaaaggatagg

SEQ ID NO: 644874 - DNA, 20 bp, Artificial
  CRISPR gRNA sequence
tctttaaggaaaggatagga

SEQ ID NO: 644875 - DNA, 20 bp, Artificial
  CRISPR gRNA sequence
ctttaaggaaaggataggaa

SEQ ID NO: 644876 - DNA, 20 bp, Artificial
  CRISPR gRNA sequence
tttaaggaaaggataggaaa

SEQ ID NO: 644877 - DNA, 20 bp, Artificial
  CRISPR gRNA sequence
taaggaaaggataggaaatc

SEQ ID NO: 644878 - DNA, 20 bp, Artificial
  CRISPR gRNA sequence
aaggaaaggataggaaatct

SEQ ID NO: 644879 - DNA, 20 bp, Artificial
  CRISPR gRNA sequence
aggaaaggataggaaatctc

SEQ ID NO: 644880 - DNA, 20 bp, Artificial
  CRISPR gRNA sequence
tttaaccttccttatttcta

SEQ ID NO: 644881 - DNA, 20 bp, Artificial
  CRISPR gRNA sequence
taaccttccttatttctacg

SEQ ID NO: 644882 - DNA, 20 bp, Artificial
  CRISPR gRNA sequence
aaccttccttatttctacgt

SEQ ID NO: 644883 - DNA, 20 bp, Artificial
  CRISPR gRNA sequence
accttccttatttctacgtt

SEQ ID NO: 644884 - DNA, 20 bp, Artificial
  CRISPR gRNA sequence
ccttatttctacgttaattc

SEQ ID NO: 644885 - DNA, 20 bp, Artificial
  CRISPR gRNA sequence
cttatttctacgttaattct

SEQ ID NO: 644886 - DNA, 20 bp, Artificial
  CRISPR gRNA sequence
atttctacgttaattctctg

SEQ ID NO: 644887 - DNA, 20 bp, Artificial
  CRISPR gRNA sequence
tttctacgttaattctctga

SEQ ID NO: 644888 - DNA, 20 bp, Artificial
  CRISPR gRNA sequence
ctacgttaattctctgaaag

SEQ ID NO: 644889 - DNA, 20 bp, Artificial
  CRISPR gRNA sequence
tacgttaattctctgaaagg

SEQ ID NO: 644890 - DNA, 20 bp, Artificial
  CRISPR gRNA sequence
cgttaattctctgaaaggaa

SEQ ID NO: 644891 - DNA, 20 bp, Artificial
  CRISPR gRNA sequence
attctctgaaaggaaatgtc

SEQ ID NO: 644892 - DNA, 20 bp, Artificial
  CRISPR gRNA sequence
tctgaaaggaaatgtcttct

SEQ ID NO: 644893 - DNA, 20 bp, Artificial
  CRISPR gRNA sequence
tgaaaggaaatgtcttctta

SEQ ID NO: 644894 - DNA, 20 bp, Artificial
  CRISPR gRNA sequence
aaaggaaatgtcttcttaca

SEQ ID NO: 644895 - DNA, 20 bp, Artificial
  CRISPR gRNA sequence
cttacaataaaactgtgaca

SEQ ID NO: 644896 - DNA, 20 bp, Artificial
  CRISPR gRNA sequence
ttacaataaaactgtgacat

SEQ ID NO: 644897 - DNA, 20 bp, Artificial
  CRISPR gRNA sequence
acaataaaactgtgacatca

SEQ ID NO: 644898 - DNA, 20 bp, Artificial
  CRISPR gRNA sequence
caataaaactgtgacatcac

SEQ ID NO: 644899 - DNA, 20 bp, Artificial
  CRISPR gRNA sequence
tgacatcactgatcgtcaat

SEQ ID NO: 644900 - DNA, 20 bp, Artificial
  CRISPR gRNA sequence
atcgtcaataaatgtttgtt

SEQ ID NO: 644901 - DNA, 20 bp, Artificial
  CRISPR gRNA sequence
gttttgtaaactttgaataa

SEQ ID NO: 644902 - DNA, 20 bp, Artificial
  CRISPR gRNA sequence
ttttgtaaactttgaataat

SEQ ID NO: 644903 - DNA, 20 bp, Artificial
  CRISPR gRNA sequence
tgtaaactttgaataattag

SEQ ID NO: 644904 - DNA, 20 bp, Artificial
  CRISPR gRNA sequence
gtaaactttgaataattagg

SEQ ID NO: 644905 - DNA, 20 bp, Artificial
  CRISPR gRNA sequence
taaactttgaataattaggg

SEQ ID NO: 644906 - DNA, 20 bp, Artificial
  CRISPR gRNA sequence
tgaataattaggggaaacag

SEQ ID NO: 644907 - DNA, 20 bp, Artificial
  CRISPR gRNA sequence
gaataattaggggaaacagg

SEQ ID NO: 644908 - DNA, 20 bp, Artificial
  CRISPR gRNA sequence
aataattaggggaaacagga

SEQ ID NO: 644909 - DNA, 20 bp, Artificial
  CRISPR gRNA sequence
ggggaaacaggaatatagca

SEQ ID NO: 644910 - DNA, 20 bp, Artificial
  CRISPR gRNA sequence
gaagatagtttaaattacaa

SEQ ID NO: 644911 - DNA, 20 bp, Artificial
  CRISPR gRNA sequence
aagatagtttaaattacaaa

SEQ ID NO: 644912 - DNA, 20 bp, Artificial
  CRISPR gRNA sequence
aaattacaaataagctattt

SEQ ID NO: 644913 - DNA, 20 bp, Artificial
  CRISPR gRNA sequence
aattacaaataagctatttt

SEQ ID NO: 644914 - DNA, 20 bp, Artificial
  CRISPR gRNA sequence
caaataagctattttaaagt

SEQ ID NO: 644915 - DNA, 20 bp, Artificial
  CRISPR gRNA sequence
ttttaaagtctatatagatg

SEQ ID NO: 644916 - DNA, 20 bp, Artificial
  CRISPR gRNA sequence
taaagtctatatagatgtgt

SEQ ID NO: 644917 - DNA, 20 bp, Artificial
  CRISPR gRNA sequence
aaagtctatatagatgtgtt

SEQ ID NO: 644918 - DNA, 20 bp, Artificial
  CRISPR gRNA sequence
aagtctatatagatgtgtta

SEQ ID NO: 644919 - DNA, 20 bp, Artificial
  CRISPR gRNA sequence
tatagatgtgttaaagatgt

SEQ ID NO: 644920 - DNA, 20 bp, Artificial
  CRISPR gRNA sequence
aagatgttcatttttataac

SEQ ID NO: 644921 - DNA, 20 bp, Artificial
  CRISPR gRNA sequence
atttttataacttagaacaa

SEQ ID NO: 644922 - DNA, 20 bp, Artificial
  CRISPR gRNA sequence
ttataacttagaacaactgt

SEQ ID NO: 644923 - DNA, 20 bp, Artificial
  CRISPR gRNA sequence
tataacttagaacaactgtt

SEQ ID NO: 644924 - DNA, 20 bp, Artificial
  CRISPR gRNA sequence
ataacttagaacaactgtta

SEQ ID NO: 644925 - DNA, 20 bp, Artificial
  CRISPR gRNA sequence
taacttagaacaactgttac

SEQ ID NO: 644926 - DNA, 20 bp, Artificial
  CRISPR gRNA sequence
agaacaactgttacagaaat

SEQ ID NO: 644927 - DNA, 20 bp, Artificial
  CRISPR gRNA sequence
gaacaactgttacagaaata

SEQ ID NO: 644928 - DNA, 20 bp, Artificial
  CRISPR gRNA sequence
ttacagaaataaagctcaaa

SEQ ID NO: 644929 - DNA, 20 bp, Artificial
  CRISPR gRNA sequence
cagaaataaagctcaaataa

SEQ ID NO: 644930 - DNA, 20 bp, Artificial
  CRISPR gRNA sequence
aaataatctcaccataaaat

SEQ ID NO: 644931 - DNA, 20 bp, Artificial
  CRISPR gRNA sequence
accataaaattccttagtta

SEQ ID NO: 644932 - DNA, 20 bp, Artificial
  CRISPR gRNA sequence
cttagttacaaatatagtga

SEQ ID NO: 644933 - DNA, 20 bp, Artificial
  CRISPR gRNA sequence
agttacaaatatagtgatat

SEQ ID NO: 644934 - DNA, 20 bp, Artificial
  CRISPR gRNA sequence
gttacaaatatagtgatatc

SEQ ID NO: 644935 - DNA, 20 bp, Artificial
  CRISPR gRNA sequence
caaatatagtgatatcagat

SEQ ID NO: 644936 - DNA, 20 bp, Artificial
  CRISPR gRNA sequence
ataagaaaatgttaaaagga

SEQ ID NO: 644937 - DNA, 20 bp, Artificial
  CRISPR gRNA sequence
taagaaaatgttaaaaggac

SEQ ID NO: 644938 - DNA, 20 bp, Artificial
  CRISPR gRNA sequence
aaaggactttgaatttgcta

SEQ ID NO: 644939 - DNA, 20 bp, Artificial
  CRISPR gRNA sequence
tgaatttgctaaaaagagta

SEQ ID NO: 644940 - DNA, 20 bp, Artificial
  CRISPR gRNA sequence
gaatttgctaaaaagagtag

SEQ ID NO: 644941 - DNA, 20 bp, Artificial
  CRISPR gRNA sequence
aatttgctaaaaagagtagt

SEQ ID NO: 644942 - DNA, 20 bp, Artificial
  CRISPR gRNA sequence
gctaaaaagagtagtatatt

SEQ ID NO: 644943 - DNA, 20 bp, Artificial
  CRISPR gRNA sequence
ctaaaaagagtagtatattt

SEQ ID NO: 644944 - DNA, 20 bp, Artificial
  CRISPR gRNA sequence
aaaagagtagtatattttga

SEQ ID NO: 644945 - DNA, 20 bp, Artificial
  CRISPR gRNA sequence
tgaaatgtattgaataaaag

SEQ ID NO: 644946 - DNA, 20 bp, Artificial
  CRISPR gRNA sequence
gaaatgtattgaataaaagt

SEQ ID NO: 644947 - DNA, 20 bp, Artificial
  CRISPR gRNA sequence
aaatgtattgaataaaagtg

SEQ ID NO: 644948 - DNA, 20 bp, Artificial
  CRISPR gRNA sequence
aataaaagtgatgatatatt

SEQ ID NO: 644949 - DNA, 20 bp, Artificial
  CRISPR gRNA sequence
cataaatgatcaattaaaaa

SEQ ID NO: 644950 - DNA, 20 bp, Artificial
  CRISPR gRNA sequence
aaaagatttttagtattcag

SEQ ID NO: 644951 - DNA, 20 bp, Artificial
  CRISPR gRNA sequence
ttagtattcagaattatata

SEQ ID NO: 644952 - DNA, 20 bp, Artificial
  CRISPR gRNA sequence
tagtattcagaattatatat

SEQ ID NO: 644953 - DNA, 20 bp, Artificial
  CRISPR gRNA sequence
agtattcagaattatatatt

SEQ ID NO: 644954 - DNA, 20 bp, Artificial
  CRISPR gRNA sequence
gtattcagaattatatattt

SEQ ID NO: 644955 - DNA, 20 bp, Artificial
  CRISPR gRNA sequence
agaattatatatttcctgga

SEQ ID NO: 644956 - DNA, 20 bp, Artificial
  CRISPR gRNA sequence
tatatttcctggataaaact

SEQ ID NO: 644957 - DNA, 20 bp, Artificial
  CRISPR gRNA sequence
cctggataaaactgtgtttt

SEQ ID NO: 644958 - DNA, 20 bp, Artificial
  CRISPR gRNA sequence
ctggataaaactgtgttttg

SEQ ID NO: 644959 - DNA, 20 bp, Artificial
  CRISPR gRNA sequence
gataaaactgtgttttgttt

SEQ ID NO: 644960 - DNA, 20 bp, Artificial
  CRISPR gRNA sequence
tgttttgttttcattatttt

SEQ ID NO: 644961 - DNA, 20 bp, Artificial
  CRISPR gRNA sequence
tgttttcattattttaatgc

SEQ ID NO: 644962 - DNA, 20 bp, Artificial
  CRISPR gRNA sequence
gttttcattattttaatgct

SEQ ID NO: 644963 - DNA, 20 bp, Artificial
  CRISPR gRNA sequence
ttttcattattttaatgctc

SEQ ID NO: 644964 - DNA, 20 bp, Artificial
  CRISPR gRNA sequence
tcattattttaatgctcaca

SEQ ID NO: 644965 - DNA, 20 bp, Artificial
  CRISPR gRNA sequence
cattattttaatgctcacaa

SEQ ID NO: 644966 - DNA, 20 bp, Artificial
  CRISPR gRNA sequence
attattttaatgctcacaag

SEQ ID NO: 644967 - DNA, 20 bp, Artificial
  CRISPR gRNA sequence
ttttaatgctcacaagacac

SEQ ID NO: 644968 - DNA, 20 bp, Artificial
  CRISPR gRNA sequence
taatgctcacaagacacacc

SEQ ID NO: 644969 - DNA, 20 bp, Artificial
  CRISPR gRNA sequence
aatgctcacaagacacacct

SEQ ID NO: 644970 - DNA, 20 bp, Artificial
  CRISPR gRNA sequence
atgctcacaagacacacctc

SEQ ID NO: 644971 - DNA, 20 bp, Artificial
  CRISPR gRNA sequence
acaagacacacctcggattc

SEQ ID NO: 644972 - DNA, 20 bp, Artificial
  CRISPR gRNA sequence
ggattcgatttgcagtatac

SEQ ID NO: 644973 - DNA, 20 bp, Artificial
  CRISPR gRNA sequence
gatttgcagtatacataaaa

SEQ ID NO: 644974 - DNA, 20 bp, Artificial
  CRISPR gRNA sequence
gcagtatacataaaatgtaa

SEQ ID NO: 644975 - DNA, 20 bp, Artificial
  CRISPR gRNA sequence
cagtatacataaaatgtaag

SEQ ID NO: 644976 - DNA, 20 bp, Artificial
  CRISPR gRNA sequence
catgtctagaggtattgcaa

SEQ ID NO: 644977 - DNA, 20 bp, Artificial
  CRISPR gRNA sequence
gaggtattgcaaacttgcaa

SEQ ID NO: 644978 - DNA, 20 bp, Artificial
  CRISPR gRNA sequence
caaacttgcaaaacacatta

SEQ ID NO: 644979 - DNA, 20 bp, Artificial
  CRISPR gRNA sequence
gcaaaacacattaatagtac

SEQ ID NO: 644980 - DNA, 20 bp, Artificial
  CRISPR gRNA sequence
caaaacacattaatagtaca

SEQ ID NO: 644981 - DNA, 20 bp, Artificial
  CRISPR gRNA sequence
atagtacagttaaaacagaa

SEQ ID NO: 644982 - DNA, 20 bp, Artificial
  CRISPR gRNA sequence
aaacagaatgtgttaacctg

SEQ ID NO: 644983 - DNA, 20 bp, Artificial
  CRISPR gRNA sequence
acctgtcttctgaggttacc

SEQ ID NO: 644984 - DNA, 20 bp, Artificial
  CRISPR gRNA sequence
tcttctgaggttaccgcaca

SEQ ID NO: 644985 - DNA, 20 bp, Artificial
  CRISPR gRNA sequence
ctgaggttaccgcacaagtg

SEQ ID NO: 644986 - DNA, 20 bp, Artificial
  CRISPR gRNA sequence
tgaggttaccgcacaagtgt

SEQ ID NO: 644987 - DNA, 20 bp, Artificial
  CRISPR gRNA sequence
aggttaccgcacaagtgttt

SEQ ID NO: 644988 - DNA, 20 bp, Artificial
  CRISPR gRNA sequence
ccgcacaagtgttttaaaag

SEQ ID NO: 644989 - DNA, 20 bp, Artificial
  CRISPR gRNA sequence
taaaagttttgttttgctgt

SEQ ID NO: 644990 - DNA, 20 bp, Artificial
  CRISPR gRNA sequence
aaaagttttgttttgctgtg

SEQ ID NO: 644991 - DNA, 20 bp, Artificial
  CRISPR gRNA sequence
aaagttttgttttgctgtgg

SEQ ID NO: 644992 - DNA, 20 bp, Artificial
  CRISPR gRNA sequence
tgttttgctgtggttttaaa

SEQ ID NO: 644993 - DNA, 20 bp, Artificial
  CRISPR gRNA sequence
gttttgctgtggttttaaag

SEQ ID NO: 644994 - DNA, 20 bp, Artificial
  CRISPR gRNA sequence
ttttgctgtggttttaaagc

SEQ ID NO: 644995 - DNA, 20 bp, Artificial
  CRISPR gRNA sequence
tgctgtggttttaaagctta

SEQ ID NO: 644996 - DNA, 20 bp, Artificial
  CRISPR gRNA sequence
gctgtggttttaaagcttag

SEQ ID NO: 644997 - DNA, 20 bp, Artificial
  CRISPR gRNA sequence
ctgtggttttaaagcttagt

SEQ ID NO: 644998 - DNA, 20 bp, Artificial
  CRISPR gRNA sequence
tggttttaaagcttagtgtg

SEQ ID NO: 644999 - DNA, 20 bp, Artificial
  CRISPR gRNA sequence
taaagcttagtgtgtaatct

SEQ ID NO: 645000 - DNA, 20 bp, Artificial
  CRISPR gRNA sequence
aaagcttagtgtgtaatctc

SEQ ID NO: 645001 - DNA, 20 bp, Artificial
  CRISPR gRNA sequence
aagcttagtgtgtaatctct

SEQ ID NO: 645002 - DNA, 20 bp, Artificial
  CRISPR gRNA sequence
agtgtgtaatctctctacca

SEQ ID NO: 645003 - DNA, 20 bp, Artificial
  CRISPR gRNA sequence
gtgtgtaatctctctaccac

SEQ ID NO: 645004 - DNA, 20 bp, Artificial
  CRISPR gRNA sequence
tctaccactgcttctaacgg

SEQ ID NO: 645005 - DNA, 20 bp, Artificial
  CRISPR gRNA sequence
taccactgcttctaacggac

SEQ ID NO: 645006 - DNA, 20 bp, Artificial
  CRISPR gRNA sequence
ccactgcttctaacggacaa

SEQ ID NO: 645007 - DNA, 20 bp, Artificial
  CRISPR gRNA sequence
cttctaacggacaaaaaaaa

SEQ ID NO: 645008 - DNA, 20 bp, Artificial
  CRISPR gRNA sequence
ctaacggacaaaaaaaaaaa

SEQ ID NO: 645009 - DNA, 20 bp, Artificial
  CRISPR gRNA sequence
taacggacaaaaaaaaaaaa

SEQ ID NO: 645010 - DNA, 20 bp, Artificial
  CRISPR gRNA sequence
acggacaaaaaaaaaaaaaa

SEQ ID NO: 645011 - DNA, 20 bp, Artificial
  CRISPR gRNA sequence
caactcaaattctgtagtaa

SEQ ID NO: 645012 - DNA, 20 bp, Artificial
  CRISPR gRNA sequence
aaattctgtagtaaaccaca

SEQ ID NO: 645013 - DNA, 20 bp, Artificial
  CRISPR gRNA sequence
tgtagtaaaccacagggcag

SEQ ID NO: 645014 - DNA, 20 bp, Artificial
  CRISPR gRNA sequence
tagtaaaccacagggcagag

SEQ ID NO: 645015 - DNA, 20 bp, Artificial
  CRISPR gRNA sequence
tcagcccattccttaacaaa

SEQ ID NO: 645016 - DNA, 20 bp, Artificial
  CRISPR gRNA sequence
agcccattccttaacaaact

SEQ ID NO: 645017 - DNA, 20 bp, Artificial
  CRISPR gRNA sequence
cttaacaaacttgttgctag

SEQ ID NO: 645018 - DNA, 20 bp, Artificial
  CRISPR gRNA sequence
aacaaacttgttgctagtcc

SEQ ID NO: 645019 - DNA, 20 bp, Artificial
  CRISPR gRNA sequence
acaaacttgttgctagtcct

SEQ ID NO: 645020 - DNA, 20 bp, Artificial
  CRISPR gRNA sequence
gttgctagtcctgtctgcac

SEQ ID NO: 645021 - DNA, 20 bp, Artificial
  CRISPR gRNA sequence
ttgctagtcctgtctgcacc

SEQ ID NO: 645022 - DNA, 20 bp, Artificial
  CRISPR gRNA sequence
ctagtcctgtctgcaccatc

SEQ ID NO: 645023 - DNA, 20 bp, Artificial
  CRISPR gRNA sequence
gtcctgtctgcaccatccta

SEQ ID NO: 645024 - DNA, 20 bp, Artificial
  CRISPR gRNA sequence
tctgcaccatcctaactcgc

SEQ ID NO: 645025 - DNA, 20 bp, Artificial
  CRISPR gRNA sequence
caccatcctaactcgcctat

SEQ ID NO: 645026 - DNA, 20 bp, Artificial
  CRISPR gRNA sequence
actcgcctatgttccccagg

SEQ ID NO: 645027 - DNA, 20 bp, Artificial
  CRISPR gRNA sequence
gcctatgttccccaggcact

SEQ ID NO: 645028 - DNA, 20 bp, Artificial
  CRISPR gRNA sequence
tgttccccaggcactgagcc

SEQ ID NO: 645029 - DNA, 20 bp, Artificial
  CRISPR gRNA sequence
cccaggcactgagccaaaag

SEQ ID NO: 645030 - DNA, 20 bp, Artificial
  CRISPR gRNA sequence
agccaaaagtatcattttac

SEQ ID NO: 645031 - DNA, 20 bp, Artificial
  CRISPR gRNA sequence
tactgagtgaagaaaaaaga

SEQ ID NO: 645032 - DNA, 20 bp, Artificial
  CRISPR gRNA sequence
actgagtgaagaaaaaagag

SEQ ID NO: 645033 - DNA, 20 bp, Artificial
  CRISPR gRNA sequence
ctgagtgaagaaaaaagagt

SEQ ID NO: 645034 - DNA, 20 bp, Artificial
  CRISPR gRNA sequence
agtgaagaaaaaagagtttc

SEQ ID NO: 645035 - DNA, 20 bp, Artificial
  CRISPR gRNA sequence
cattcttccaatcttgtact

SEQ ID NO: 645036 - DNA, 20 bp, Artificial
  CRISPR gRNA sequence
attcttccaatcttgtacta

SEQ ID NO: 645037 - DNA, 20 bp, Artificial
  CRISPR gRNA sequence
ttccaatcttgtactacttt

SEQ ID NO: 645038 - DNA, 20 bp, Artificial
  CRISPR gRNA sequence
ccaatcttgtactactttca

SEQ ID NO: 645039 - DNA, 20 bp, Artificial
  CRISPR gRNA sequence
caatcttgtactactttcac

SEQ ID NO: 645040 - DNA, 20 bp, Artificial
  CRISPR gRNA sequence
gtactactttcacctcaacc

SEQ ID NO: 645041 - DNA, 20 bp, Artificial
  CRISPR gRNA sequence
tactactttcacctcaacct

SEQ ID NO: 645042 - DNA, 20 bp, Artificial
  CRISPR gRNA sequence
ctttcacctcaaccttgcaa

SEQ ID NO: 645043 - DNA, 20 bp, Artificial
  CRISPR gRNA sequence
tcacctcaaccttgcaatct

SEQ ID NO: 645044 - DNA, 20 bp, Artificial
  CRISPR gRNA sequence
cacctcaaccttgcaatctt

SEQ ID NO: 645045 - DNA, 20 bp, Artificial
  CRISPR gRNA sequence
acctcaaccttgcaatcttg

SEQ ID NO: 645046 - DNA, 20 bp, Artificial
  CRISPR gRNA sequence
aaccttgcaatcttgttttt

SEQ ID NO: 645047 - DNA, 20 bp, Artificial
  CRISPR gRNA sequence
gcaatcttgtttttccacat

SEQ ID NO: 645048 - DNA, 20 bp, Artificial
  CRISPR gRNA sequence
caatcttgtttttccacatt

SEQ ID NO: 645049 - DNA, 20 bp, Artificial
  CRISPR gRNA sequence
gtttttccacattttctaac

SEQ ID NO: 645050 - DNA, 20 bp, Artificial
  CRISPR gRNA sequence
tttttccacattttctaact

SEQ ID NO: 645051 - DNA, 20 bp, Artificial
  CRISPR gRNA sequence
ttccacattttctaactatt

SEQ ID NO: 645052 - DNA, 20 bp, Artificial
  CRISPR gRNA sequence
tccacattttctaactattg

SEQ ID NO: 645053 - DNA, 20 bp, Artificial
  CRISPR gRNA sequence
ccacattttctaactattga

SEQ ID NO: 645054 - DNA, 20 bp, Artificial
  CRISPR gRNA sequence
cacattttctaactattgaa

SEQ ID NO: 645055 - DNA, 20 bp, Artificial
  CRISPR gRNA sequence
tctaactattgaaatgaaag

SEQ ID NO: 645056 - DNA, 20 bp, Artificial
  CRISPR gRNA sequence
ctaactattgaaatgaaagc

SEQ ID NO: 645057 - DNA, 20 bp, Artificial
  CRISPR gRNA sequence
taactattgaaatgaaagca

SEQ ID NO: 645058 - DNA, 20 bp, Artificial
  CRISPR gRNA sequence
actattgaaatgaaagcatt

SEQ ID NO: 645059 - DNA, 20 bp, Artificial
  CRISPR gRNA sequence
ttgaaatgaaagcattcccc

SEQ ID NO: 645060 - DNA, 20 bp, Artificial
  CRISPR gRNA sequence
aaatgaaagcattcccccca

SEQ ID NO: 645061 - DNA, 20 bp, Artificial
  CRISPR gRNA sequence
cccccaaaatattaataaag

SEQ ID NO: 645062 - DNA, 20 bp, Artificial
  CRISPR gRNA sequence
ataaagaatagggaaaggaa

SEQ ID NO: 645063 - DNA, 20 bp, Artificial
  CRISPR gRNA sequence
tcttctagatagtacgcaga

SEQ ID NO: 645064 - DNA, 20 bp, Artificial
  CRISPR gRNA sequence
ttctagatagtacgcagagt

SEQ ID NO: 645065 - DNA, 20 bp, Artificial
  CRISPR gRNA sequence
ctagatagtacgcagagtac

SEQ ID NO: 645066 - DNA, 20 bp, Artificial
  CRISPR gRNA sequence
tagatagtacgcagagtacg

SEQ ID NO: 645067 - DNA, 20 bp, Artificial
  CRISPR gRNA sequence
gatagtacgcagagtacgag

SEQ ID NO: 645068 - DNA, 20 bp, Artificial
  CRISPR gRNA sequence
ttttaaacactgataagggc

SEQ ID NO: 645069 - DNA, 20 bp, Artificial
  CRISPR gRNA sequence
taaacactgataagggcacg

SEQ ID NO: 645070 - DNA, 20 bp, Artificial
  CRISPR gRNA sequence
aaacactgataagggcacgc

SEQ ID NO: 645071 - DNA, 20 bp, Artificial
  CRISPR gRNA sequence
aacactgataagggcacgca

SEQ ID NO: 645072 - DNA, 20 bp, Artificial
  CRISPR gRNA sequence
ataagggcacgcatagaagc

SEQ ID NO: 645073 - DNA, 20 bp, Artificial
  CRISPR gRNA sequence
tgcttgctgccagtgaattc

SEQ ID NO: 645074 - DNA, 20 bp, Artificial
  CRISPR gRNA sequence
cttgctgccagtgaattcag

SEQ ID NO: 645075 - DNA, 20 bp, Artificial
  CRISPR gRNA sequence
gctgccagtgaattcaggta

SEQ ID NO: 645076 - DNA, 20 bp, Artificial
  CRISPR gRNA sequence
ctgccagtgaattcaggtaa

SEQ ID NO: 645077 - DNA, 20 bp, Artificial
  CRISPR gRNA sequence
ccagtgaattcaggtaatgt

SEQ ID NO: 645078 - DNA, 20 bp, Artificial
  CRISPR gRNA sequence
aggtaatgtatccattgttc

SEQ ID NO: 645079 - DNA, 20 bp, Artificial
  CRISPR gRNA sequence
ttccaaattgctatggtctg

SEQ ID NO: 645080 - DNA, 20 bp, Artificial
  CRISPR gRNA sequence
caaattgctatggtctggtg

SEQ ID NO: 645081 - DNA, 20 bp, Artificial
  CRISPR gRNA sequence
ctatggtctggtgacaggaa

SEQ ID NO: 645082 - DNA, 20 bp, Artificial
  CRISPR gRNA sequence
tggtctggtgacaggaaccc

SEQ ID NO: 645083 - DNA, 20 bp, Artificial
  CRISPR gRNA sequence
gtgacaggaaccccaactag

SEQ ID NO: 645084 - DNA, 20 bp, Artificial
  CRISPR gRNA sequence
gaacaagcttgccctgcatt

SEQ ID NO: 645085 - DNA, 20 bp, Artificial
  CRISPR gRNA sequence
gccctgcattttcttttgca

SEQ ID NO: 645086 - DNA, 20 bp, Artificial
  CRISPR gRNA sequence
ccctgcattttcttttgcat

SEQ ID NO: 645087 - DNA, 20 bp, Artificial
  CRISPR gRNA sequence
cattttcttttgcatttaga

SEQ ID NO: 645088 - DNA, 20 bp, Artificial
  CRISPR gRNA sequence
tcttttgcatttagatgcca

SEQ ID NO: 645089 - DNA, 20 bp, Artificial
  CRISPR gRNA sequence
cttttgcatttagatgccaa

SEQ ID NO: 645090 - DNA, 20 bp, Artificial
  CRISPR gRNA sequence
ttttgcatttagatgccaac

SEQ ID NO: 645091 - DNA, 20 bp, Artificial
  CRISPR gRNA sequence
ttgcatttagatgccaactt

SEQ ID NO: 645092 - DNA, 20 bp, Artificial
  CRISPR gRNA sequence
tgcatttagatgccaacttt

SEQ ID NO: 645093 - DNA, 20 bp, Artificial
  CRISPR gRNA sequence
gcatttagatgccaactttg

SEQ ID NO: 645094 - DNA, 20 bp, Artificial
  CRISPR gRNA sequence
catttagatgccaactttga

SEQ ID NO: 645095 - DNA, 20 bp, Artificial
  CRISPR gRNA sequence
agatgccaactttgataagg

SEQ ID NO: 645096 - DNA, 20 bp, Artificial
  CRISPR gRNA sequence
gatgccaactttgataaggt

SEQ ID NO: 645097 - DNA, 20 bp, Artificial
  CRISPR gRNA sequence
tgataaggtcacgccttaaa

SEQ ID NO: 645098 - DNA, 20 bp, Artificial
  CRISPR gRNA sequence
gataaggtcacgccttaaaa

SEQ ID NO: 645099 - DNA, 20 bp, Artificial
  CRISPR gRNA sequence
ataaggtcacgccttaaaag

SEQ ID NO: 645100 - DNA, 20 bp, Artificial
  CRISPR gRNA sequence
aaaagatccacatagcatgc

SEQ ID NO: 645101 - DNA, 20 bp, Artificial
  CRISPR gRNA sequence
aaagatccacatagcatgca

SEQ ID NO: 645102 - DNA, 20 bp, Artificial
  CRISPR gRNA sequence
cagccattcccatactcaga

SEQ ID NO: 645103 - DNA, 20 bp, Artificial
  CRISPR gRNA sequence
agccattcccatactcagat

SEQ ID NO: 645104 - DNA, 20 bp, Artificial
  CRISPR gRNA sequence
ccatactcagataagaatgt

SEQ ID NO: 645105 - DNA, 20 bp, Artificial
  CRISPR gRNA sequence
agataagaatgtaaaaagaa

SEQ ID NO: 645106 - DNA, 20 bp, Artificial
  CRISPR gRNA sequence
acatatatgaacagatttac

SEQ ID NO: 645107 - DNA, 20 bp, Artificial
  CRISPR gRNA sequence
acagggccaacccatttata

SEQ ID NO: 645108 - DNA, 20 bp, Artificial
  CRISPR gRNA sequence
cagggccaacccatttataa

SEQ ID NO: 645109 - DNA, 20 bp, Artificial
  CRISPR gRNA sequence
ataactacacctatctagat

SEQ ID NO: 645110 - DNA, 20 bp, Artificial
  CRISPR gRNA sequence
taactacacctatctagatc

SEQ ID NO: 645111 - DNA, 20 bp, Artificial
  CRISPR gRNA sequence
cacctatctagatcctttca

SEQ ID NO: 645112 - DNA, 20 bp, Artificial
  CRISPR gRNA sequence
tctagatcctttcacacacc

SEQ ID NO: 645113 - DNA, 20 bp, Artificial
  CRISPR gRNA sequence
gatcctttcacacaccaggg

SEQ ID NO: 645114 - DNA, 20 bp, Artificial
  CRISPR gRNA sequence
tcacacaccagggacctatg

SEQ ID NO: 645115 - DNA, 20 bp, Artificial
  CRISPR gRNA sequence
cacacaccagggacctatgt

SEQ ID NO: 645116 - DNA, 20 bp, Artificial
  CRISPR gRNA sequence
acacaccagggacctatgtg

SEQ ID NO: 645117 - DNA, 20 bp, Artificial
  CRISPR gRNA sequence
tgtggagccaacaacaaagg

SEQ ID NO: 645118 - DNA, 20 bp, Artificial
  CRISPR gRNA sequence
cagagattccctcccctccc

SEQ ID NO: 645119 - DNA, 20 bp, Artificial
  CRISPR gRNA sequence
cctcccctcccaggccccca

SEQ ID NO: 645120 - DNA, 20 bp, Artificial
  CRISPR gRNA sequence
ccctcccaggcccccatgct

SEQ ID NO: 645121 - DNA, 20 bp, Artificial
  CRISPR gRNA sequence
ccaggcccccatgctcctat

SEQ ID NO: 645122 - DNA, 20 bp, Artificial
  CRISPR gRNA sequence
ctatcccagaattttctcaa

SEQ ID NO: 645123 - DNA, 20 bp, Artificial
  CRISPR gRNA sequence
tcccagaattttctcaaagg

SEQ ID NO: 645124 - DNA, 20 bp, Artificial
  CRISPR gRNA sequence
tctcaaaggagctcattgct

SEQ ID NO: 645125 - DNA, 20 bp, Artificial
  CRISPR gRNA sequence
ctcaaaggagctcattgctt

SEQ ID NO: 645126 - DNA, 20 bp, Artificial
  CRISPR gRNA sequence
tcaaaggagctcattgcttt

SEQ ID NO: 645127 - DNA, 20 bp, Artificial
  CRISPR gRNA sequence
aaaggagctcattgctttcc

SEQ ID NO: 645128 - DNA, 20 bp, Artificial
  CRISPR gRNA sequence
attgctttccctcactggct

SEQ ID NO: 645129 - DNA, 20 bp, Artificial
  CRISPR gRNA sequence
ctttccctcactggcttcct

SEQ ID NO: 645130 - DNA, 20 bp, Artificial
  CRISPR gRNA sequence
tccctcactggcttcctttg

SEQ ID NO: 645131 - DNA, 20 bp, Artificial
  CRISPR gRNA sequence
ccctcactggcttcctttga

SEQ ID NO: 645132 - DNA, 20 bp, Artificial
  CRISPR gRNA sequence
cctcactggcttcctttgag

SEQ ID NO: 645133 - DNA, 20 bp, Artificial
  CRISPR gRNA sequence
actggcttcctttgagtagt

SEQ ID NO: 645134 - DNA, 20 bp, Artificial
  CRISPR gRNA sequence
gcttcctttgagtagtgtca

SEQ ID NO: 645135 - DNA, 20 bp, Artificial
  CRISPR gRNA sequence
cctttgagtagtgtcaaaaa

SEQ ID NO: 645136 - DNA, 20 bp, Artificial
  CRISPR gRNA sequence
ctttgagtagtgtcaaaaag

SEQ ID NO: 645137 - DNA, 20 bp, Artificial
  CRISPR gRNA sequence
tgagtagtgtcaaaaagact

SEQ ID NO: 645138 - DNA, 20 bp, Artificial
  CRISPR gRNA sequence
gagtagtgtcaaaaagactt

SEQ ID NO: 645139 - DNA, 20 bp, Artificial
  CRISPR gRNA sequence
agtagtgtcaaaaagacttc

SEQ ID NO: 645140 - DNA, 20 bp, Artificial
  CRISPR gRNA sequence
cccttaatgctttgactgct

SEQ ID NO: 645141 - DNA, 20 bp, Artificial
  CRISPR gRNA sequence
ccttaatgctttgactgctt

SEQ ID NO: 645142 - DNA, 20 bp, Artificial
  CRISPR gRNA sequence
aatgctttgactgcttcttt

SEQ ID NO: 645143 - DNA, 20 bp, Artificial
  CRISPR gRNA sequence
atgctttgactgcttctttc

SEQ ID NO: 645144 - DNA, 20 bp, Artificial
  CRISPR gRNA sequence
tgactgcttctttcaattcc

SEQ ID NO: 645145 - DNA, 20 bp, Artificial
  CRISPR gRNA sequence
gactgcttctttcaattcca

SEQ ID NO: 645146 - DNA, 20 bp, Artificial
  CRISPR gRNA sequence
actgcttctttcaattccag

SEQ ID NO: 645147 - DNA, 20 bp, Artificial
  CRISPR gRNA sequence
cttctttcaattccagggac

SEQ ID NO: 645148 - DNA, 20 bp, Artificial
  CRISPR gRNA sequence
ctttcaattccagggactcc

SEQ ID NO: 645149 - DNA, 20 bp, Artificial
  CRISPR gRNA sequence
tttcaattccagggactccc

SEQ ID NO: 645150 - DNA, 20 bp, Artificial
  CRISPR gRNA sequence
tcaattccagggactccctg

SEQ ID NO: 645151 - DNA, 20 bp, Artificial
  CRISPR gRNA sequence
caattccagggactccctga

SEQ ID NO: 645152 - DNA, 20 bp, Artificial
  CRISPR gRNA sequence
aattccagggactccctgaa

SEQ ID NO: 645153 - DNA, 20 bp, Artificial
  CRISPR gRNA sequence
cagggactccctgaaatgtc

SEQ ID NO: 645154 - DNA, 20 bp, Artificial
  CRISPR gRNA sequence
cctgaaatgtccaatttatt

SEQ ID NO: 645155 - DNA, 20 bp, Artificial
  CRISPR gRNA sequence
aaatgtccaatttattcccc

SEQ ID NO: 645156 - DNA, 20 bp, Artificial
  CRISPR gRNA sequence
attcccctgaccctcccaaa

SEQ ID NO: 645157 - DNA, 20 bp, Artificial
  CRISPR gRNA sequence
ttcccctgaccctcccaaaa

SEQ ID NO: 645158 - DNA, 20 bp, Artificial
  CRISPR gRNA sequence
ccctgaccctcccaaaaggt

SEQ ID NO: 645159 - DNA, 20 bp, Artificial
  CRISPR gRNA sequence
accctcccaaaaggtttgac

SEQ ID NO: 645160 - DNA, 20 bp, Artificial
  CRISPR gRNA sequence
ccaaaaggtttgactcctct

SEQ ID NO: 645161 - DNA, 20 bp, Artificial
  CRISPR gRNA sequence
gactcctcttctactgcaaa

SEQ ID NO: 645162 - DNA, 20 bp, Artificial
  CRISPR gRNA sequence
actcctcttctactgcaaag

SEQ ID NO: 645163 - DNA, 20 bp, Artificial
  CRISPR gRNA sequence
ctcttctactgcaaagctct

SEQ ID NO: 645164 - DNA, 20 bp, Artificial
  CRISPR gRNA sequence
ttctactgcaaagctctccc

SEQ ID NO: 645165 - DNA, 20 bp, Artificial
  CRISPR gRNA sequence
ctactgcaaagctctccctc

SEQ ID NO: 645166 - DNA, 20 bp, Artificial
  CRISPR gRNA sequence
tactgcaaagctctccctca

SEQ ID NO: 645167 - DNA, 20 bp, Artificial
  CRISPR gRNA sequence
ctgcaaagctctccctcatg

SEQ ID NO: 645168 - DNA, 20 bp, Artificial
  CRISPR gRNA sequence
caaagctctccctcatgagc

SEQ ID NO: 645169 - DNA, 20 bp, Artificial
  CRISPR gRNA sequence
tccctcatgagctacccaca

SEQ ID NO: 645170 - DNA, 20 bp, Artificial
  CRISPR gRNA sequence
cctcatgagctacccacaga

SEQ ID NO: 645171 - DNA, 20 bp, Artificial
  CRISPR gRNA sequence
atgagctacccacagaaacc

SEQ ID NO: 645172 - DNA, 20 bp, Artificial
  CRISPR gRNA sequence
cccacagaaaccagttccct

SEQ ID NO: 645173 - DNA, 20 bp, Artificial
  CRISPR gRNA sequence
cctagactgccttccctccc

SEQ ID NO: 645174 - DNA, 20 bp, Artificial
  CRISPR gRNA sequence
gactgccttccctcccaatc

SEQ ID NO: 645175 - DNA, 20 bp, Artificial
  CRISPR gRNA sequence
ccttccctcccaatcatagc

SEQ ID NO: 645176 - DNA, 20 bp, Artificial
  CRISPR gRNA sequence
ccctcccaatcatagcccga

SEQ ID NO: 645177 - DNA, 20 bp, Artificial
  CRISPR gRNA sequence
cctcccaatcatagcccgaa

SEQ ID NO: 645178 - DNA, 20 bp, Artificial
  CRISPR gRNA sequence
ccaatcatagcccgaagatc

SEQ ID NO: 645179 - DNA, 20 bp, Artificial
  CRISPR gRNA sequence
ttctcccttgctgttttcct

SEQ ID NO: 645180 - DNA, 20 bp, Artificial
  CRISPR gRNA sequence
ctcccttgctgttttccttt

SEQ ID NO: 645181 - DNA, 20 bp, Artificial
  CRISPR gRNA sequence
tcccttgctgttttcctttc

SEQ ID NO: 645182 - DNA, 20 bp, Artificial
  CRISPR gRNA sequence
ccttgctgttttcctttcca

SEQ ID NO: 645183 - DNA, 20 bp, Artificial
  CRISPR gRNA sequence
gctgttttcctttccaactg

SEQ ID NO: 645184 - DNA, 20 bp, Artificial
  CRISPR gRNA sequence
ctgttttcctttccaactgt

SEQ ID NO: 645185 - DNA, 20 bp, Artificial
  CRISPR gRNA sequence
ttttcctttccaactgttcc

SEQ ID NO: 645186 - DNA, 20 bp, Artificial
  CRISPR gRNA sequence
tcctttccaactgttcccaa

SEQ ID NO: 645187 - DNA, 20 bp, Artificial
  CRISPR gRNA sequence
cctttccaactgttcccaaa

SEQ ID NO: 645188 - DNA, 20 bp, Artificial
  CRISPR gRNA sequence
ctttccaactgttcccaaaa

SEQ ID NO: 645189 - DNA, 20 bp, Artificial
  CRISPR gRNA sequence
tccaactgttcccaaaagta

SEQ ID NO: 645190 - DNA, 20 bp, Artificial
  CRISPR gRNA sequence
ccaactgttcccaaaagtac

SEQ ID NO: 645191 - DNA, 20 bp, Artificial
  CRISPR gRNA sequence
caactgttcccaaaagtacc

SEQ ID NO: 645192 - DNA, 20 bp, Artificial
  CRISPR gRNA sequence
ttcccaaaagtacctaacct

SEQ ID NO: 645193 - DNA, 20 bp, Artificial
  CRISPR gRNA sequence
ccaaaagtacctaacctgac

SEQ ID NO: 645194 - DNA, 20 bp, Artificial
  CRISPR gRNA sequence
acctgacatcattattagtg

SEQ ID NO: 645195 - DNA, 20 bp, Artificial
  CRISPR gRNA sequence
acatcattattagtgaaaat

SEQ ID NO: 645196 - DNA, 20 bp, Artificial
  CRISPR gRNA sequence
ttagtgaaaatacaccagag

SEQ ID NO: 645197 - DNA, 20 bp, Artificial
  CRISPR gRNA sequence
gtgaaaatacaccagaggtt

SEQ ID NO: 645198 - DNA, 20 bp, Artificial
  CRISPR gRNA sequence
tgggggaagggaggaatacc

SEQ ID NO: 645199 - DNA, 20 bp, Artificial
  CRISPR gRNA sequence
gggggaagggaggaatacca

SEQ ID NO: 645200 - DNA, 20 bp, Artificial
  CRISPR gRNA sequence
ggggaagggaggaataccat

SEQ ID NO: 645201 - DNA, 20 bp, Artificial
  CRISPR gRNA sequence
gagcaaaggaaaaacacaca

SEQ ID NO: 645202 - DNA, 20 bp, Artificial
  CRISPR gRNA sequence
tcattcctggactggttttc

SEQ ID NO: 645203 - DNA, 20 bp, Artificial
  CRISPR gRNA sequence
attcctggactggttttctc

SEQ ID NO: 645204 - DNA, 20 bp, Artificial
  CRISPR gRNA sequence
ctggactggttttctcttac

SEQ ID NO: 645205 - DNA, 20 bp, Artificial
  CRISPR gRNA sequence
gactggttttctcttacctt

SEQ ID NO: 645206 - DNA, 20 bp, Artificial
  CRISPR gRNA sequence
gttttctcttacctttgtct

SEQ ID NO: 645207 - DNA, 20 bp, Artificial
  CRISPR gRNA sequence
tctcttacctttgtctatac

SEQ ID NO: 645208 - DNA, 20 bp, Artificial
  CRISPR gRNA sequence
ctcttacctttgtctataca

SEQ ID NO: 645209 - DNA, 20 bp, Artificial
  CRISPR gRNA sequence
tcttacctttgtctatacac

SEQ ID NO: 645210 - DNA, 20 bp, Artificial
  CRISPR gRNA sequence
ttacctttgtctatacacaa

SEQ ID NO: 645211 - DNA, 20 bp, Artificial
  CRISPR gRNA sequence
acctttgtctatacacaata

SEQ ID NO: 645212 - DNA, 20 bp, Artificial
  CRISPR gRNA sequence
cctttgtctatacacaatac

SEQ ID NO: 645213 - DNA, 20 bp, Artificial
  CRISPR gRNA sequence
tgtctatacacaatacgtca

SEQ ID NO: 645214 - DNA, 20 bp, Artificial
  CRISPR gRNA sequence
gtctatacacaatacgtcac

SEQ ID NO: 645215 - DNA, 20 bp, Artificial
  CRISPR gRNA sequence
tctatacacaatacgtcacc

SEQ ID NO: 645216 - DNA, 20 bp, Artificial
  CRISPR gRNA sequence
tacacaatacgtcacctctg

SEQ ID NO: 645217 - DNA, 20 bp, Artificial
  CRISPR gRNA sequence
tgacacactcaaacattccc

SEQ ID NO: 645218 - DNA, 20 bp, Artificial
  CRISPR gRNA sequence
acacactcaaacattcccaa

SEQ ID NO: 645219 - DNA, 20 bp, Artificial
  CRISPR gRNA sequence
aaacattcccaaaaagcttg

SEQ ID NO: 645220 - DNA, 20 bp, Artificial
  CRISPR gRNA sequence
ccaaaaagcttgattaaatg

SEQ ID NO: 645221 - DNA, 20 bp, Artificial
  CRISPR gRNA sequence
gattaaatgattttatctgg

SEQ ID NO: 645222 - DNA, 20 bp, Artificial
  CRISPR gRNA sequence
attaaatgattttatctggc

SEQ ID NO: 645223 - DNA, 20 bp, Artificial
  CRISPR gRNA sequence
aatgattttatctggcgtat

SEQ ID NO: 645224 - DNA, 20 bp, Artificial
  CRISPR gRNA sequence
tatctggcgtatttaaagaa

SEQ ID NO: 645225 - DNA, 20 bp, Artificial
  CRISPR gRNA sequence
atctggcgtatttaaagaag

SEQ ID NO: 645226 - DNA, 20 bp, Artificial
  CRISPR gRNA sequence
tctggcgtatttaaagaagt

SEQ ID NO: 645227 - DNA, 20 bp, Artificial
  CRISPR gRNA sequence
gcgtatttaaagaagtgtag

SEQ ID NO: 645228 - DNA, 20 bp, Artificial
  CRISPR gRNA sequence
aaagaagtgtagtgtgtggg

SEQ ID NO: 645229 - DNA, 20 bp, Artificial
  CRISPR gRNA sequence
aagaagtgtagtgtgtgggg

SEQ ID NO: 645230 - DNA, 20 bp, Artificial
  CRISPR gRNA sequence
catttttttcctaacaaaaa

SEQ ID NO: 645231 - DNA, 20 bp, Artificial
  CRISPR gRNA sequence
ttttcctaacaaaaacatcg

SEQ ID NO: 645232 - DNA, 20 bp, Artificial
  CRISPR gRNA sequence
tttcctaacaaaaacatcga

SEQ ID NO: 645233 - DNA, 20 bp, Artificial
  CRISPR gRNA sequence
ttcctaacaaaaacatcgaa

SEQ ID NO: 645234 - DNA, 20 bp, Artificial
  CRISPR gRNA sequence
tcctaacaaaaacatcgaaa

SEQ ID NO: 645235 - DNA, 20 bp, Artificial
  CRISPR gRNA sequence
cctaacaaaaacatcgaaac

SEQ ID NO: 645236 - DNA, 20 bp, Artificial
  CRISPR gRNA sequence
ctaacaaaaacatcgaaaca

SEQ ID NO: 645237 - DNA, 20 bp, Artificial
  CRISPR gRNA sequence
acaaaaacatcgaaacatac

SEQ ID NO: 645238 - DNA, 20 bp, Artificial
  CRISPR gRNA sequence
ataaaattgtgaccaaaatc

SEQ ID NO: 645239 - DNA, 20 bp, Artificial
  CRISPR gRNA sequence
taaaattgtgaccaaaatca

SEQ ID NO: 645240 - DNA, 20 bp, Artificial
  CRISPR gRNA sequence
tgaccaaaatcaaaacacaa

SEQ ID NO: 645241 - DNA, 20 bp, Artificial
  CRISPR gRNA sequence
tttaaatttgtgattatcaa

SEQ ID NO: 645242 - DNA, 20 bp, Artificial
  CRISPR gRNA sequence
ttaaatttgtgattatcaaa

SEQ ID NO: 645243 - DNA, 20 bp, Artificial
  CRISPR gRNA sequence
taaatttgtgattatcaaat

SEQ ID NO: 645244 - DNA, 20 bp, Artificial
  CRISPR gRNA sequence
aaatttgtgattatcaaatg

SEQ ID NO: 645245 - DNA, 20 bp, Artificial
  CRISPR gRNA sequence
aatttgtgattatcaaatgc

SEQ ID NO: 645246 - DNA, 20 bp, Artificial
  CRISPR gRNA sequence
gtgattatcaaatgctacaa

SEQ ID NO: 645247 - DNA, 20 bp, Artificial
  CRISPR gRNA sequence
tgattatcaaatgctacaaa

SEQ ID NO: 645248 - DNA, 20 bp, Artificial
  CRISPR gRNA sequence
tcaaatgctacaaatcagaa

SEQ ID NO: 645249 - DNA, 20 bp, Artificial
  CRISPR gRNA sequence
caaatcagaattctgcaaac

SEQ ID NO: 645250 - DNA, 20 bp, Artificial
  CRISPR gRNA sequence
tgcaaacaaacaaaaatcaa

SEQ ID NO: 645251 - DNA, 20 bp, Artificial
  CRISPR gRNA sequence
caaacaaacaaaaatcaaag

SEQ ID NO: 645252 - DNA, 20 bp, Artificial
  CRISPR gRNA sequence
cttcagccacgactattgat

SEQ ID NO: 645253 - DNA, 20 bp, Artificial
  CRISPR gRNA sequence
ttcagccacgactattgata

SEQ ID NO: 645254 - DNA, 20 bp, Artificial
  CRISPR gRNA sequence
cagccacgactattgatagg

SEQ ID NO: 645255 - DNA, 20 bp, Artificial
  CRISPR gRNA sequence
agccacgactattgataggg

SEQ ID NO: 645256 - DNA, 20 bp, Artificial
  CRISPR gRNA sequence
ttgatagggtaacatcatgc

SEQ ID NO: 645257 - DNA, 20 bp, Artificial
  CRISPR gRNA sequence
atagggtaacatcatgctta

SEQ ID NO: 645258 - DNA, 20 bp, Artificial
  CRISPR gRNA sequence
aaaacttctcttgtgaaaat

SEQ ID NO: 645259 - DNA, 20 bp, Artificial
  CRISPR gRNA sequence
aaacttctcttgtgaaaatg

SEQ ID NO: 645260 - DNA, 20 bp, Artificial
  CRISPR gRNA sequence
ctcttgtgaaaatgctgtgc

SEQ ID NO: 645261 - DNA, 20 bp, Artificial
  CRISPR gRNA sequence
tcttgtgaaaatgctgtgct

SEQ ID NO: 645262 - DNA, 20 bp, Artificial
  CRISPR gRNA sequence
ttgtgaaaatgctgtgctct

SEQ ID NO: 645263 - DNA, 20 bp, Artificial
  CRISPR gRNA sequence
gtgaaaatgctgtgctctag

SEQ ID NO: 645264 - DNA, 20 bp, Artificial
  CRISPR gRNA sequence
tgaaaatgctgtgctctagc

SEQ ID NO: 645265 - DNA, 20 bp, Artificial
  CRISPR gRNA sequence
tgctctagctcaatgcttaa

SEQ ID NO: 645266 - DNA, 20 bp, Artificial
  CRISPR gRNA sequence
tagctcaatgcttaaccaga

SEQ ID NO: 645267 - DNA, 20 bp, Artificial
  CRISPR gRNA sequence
gctcaatgcttaaccagact

SEQ ID NO: 645268 - DNA, 20 bp, Artificial
  CRISPR gRNA sequence
aatgcttaaccagactcttc

SEQ ID NO: 645269 - DNA, 20 bp, Artificial
  CRISPR gRNA sequence
aaccagactcttctggaaaa

SEQ ID NO: 645270 - DNA, 20 bp, Artificial
  CRISPR gRNA sequence
accagactcttctggaaaac

SEQ ID NO: 645271 - DNA, 20 bp, Artificial
  CRISPR gRNA sequence
ttctggaaaacttttgttat

SEQ ID NO: 645272 - DNA, 20 bp, Artificial
  CRISPR gRNA sequence
ctggaaaacttttgttattt

SEQ ID NO: 645273 - DNA, 20 bp, Artificial
  CRISPR gRNA sequence
tggaaaacttttgttatttc

SEQ ID NO: 645274 - DNA, 20 bp, Artificial
  CRISPR gRNA sequence
gaaaacttttgttatttcgc

SEQ ID NO: 645275 - DNA, 20 bp, Artificial
  CRISPR gRNA sequence
ttgttatttcgctgtaatgt

SEQ ID NO: 645276 - DNA, 20 bp, Artificial
  CRISPR gRNA sequence
tgttatttcgctgtaatgtt

SEQ ID NO: 645277 - DNA, 20 bp, Artificial
  CRISPR gRNA sequence
gttatttcgctgtaatgttt

SEQ ID NO: 645278 - DNA, 20 bp, Artificial
  CRISPR gRNA sequence
ttatttcgctgtaatgtttt

SEQ ID NO: 645279 - DNA, 20 bp, Artificial
  CRISPR gRNA sequence
tttcgctgtaatgttttcaa

SEQ ID NO: 645280 - DNA, 20 bp, Artificial
  CRISPR gRNA sequence
cgctgtaatgttttcaaaaa

SEQ ID NO: 645281 - DNA, 20 bp, Artificial
  CRISPR gRNA sequence
gctgtaatgttttcaaaaag

SEQ ID NO: 645282 - DNA, 20 bp, Artificial
  CRISPR gRNA sequence
taatgttttcaaaaagattt

SEQ ID NO: 645283 - DNA, 20 bp, Artificial
  CRISPR gRNA sequence
tcaaaaagatttaagagttt

SEQ ID NO: 645284 - DNA, 20 bp, Artificial
  CRISPR gRNA sequence
caaaaagatttaagagtttc

SEQ ID NO: 645285 - DNA, 20 bp, Artificial
  CRISPR gRNA sequence
aaaaagatttaagagtttcc

SEQ ID NO: 645286 - DNA, 20 bp, Artificial
  CRISPR gRNA sequence
aagagtttccaaacaacttg

SEQ ID NO: 645287 - DNA, 20 bp, Artificial
  CRISPR gRNA sequence
agagtttccaaacaacttgt

SEQ ID NO: 645288 - DNA, 20 bp, Artificial
  CRISPR gRNA sequence
ccaaacaacttgttttacac

SEQ ID NO: 645289 - DNA, 20 bp, Artificial
  CRISPR gRNA sequence
caaacaacttgttttacact

SEQ ID NO: 645290 - DNA, 20 bp, Artificial
  CRISPR gRNA sequence
gttttacactgacttaagtt

SEQ ID NO: 645291 - DNA, 20 bp, Artificial
  CRISPR gRNA sequence
ttttacactgacttaagttt

SEQ ID NO: 645292 - DNA, 20 bp, Artificial
  CRISPR gRNA sequence
tacactgacttaagttttac

SEQ ID NO: 645293 - DNA, 20 bp, Artificial
  CRISPR gRNA sequence
acactgacttaagttttacc

SEQ ID NO: 645294 - DNA, 20 bp, Artificial
  CRISPR gRNA sequence
cactgacttaagttttacct

SEQ ID NO: 645295 - DNA, 20 bp, Artificial
  CRISPR gRNA sequence
acttaagttttacctagctc

SEQ ID NO: 645296 - DNA, 20 bp, Artificial
  CRISPR gRNA sequence
aagttttacctagctcagat

SEQ ID NO: 645297 - DNA, 20 bp, Artificial
  CRISPR gRNA sequence
agttttacctagctcagata

SEQ ID NO: 645298 - DNA, 20 bp, Artificial
  CRISPR gRNA sequence
tacctagctcagataaaaat

SEQ ID NO: 645299 - DNA, 20 bp, Artificial
  CRISPR gRNA sequence
acctagctcagataaaaata

SEQ ID NO: 645300 - DNA, 20 bp, Artificial
  CRISPR gRNA sequence
cctagctcagataaaaatag

SEQ ID NO: 645301 - DNA, 20 bp, Artificial
  CRISPR gRNA sequence
gctcagataaaaatagattt

SEQ ID NO: 645302 - DNA, 20 bp, Artificial
  CRISPR gRNA sequence
agataaaaatagatttcttg

SEQ ID NO: 645303 - DNA, 20 bp, Artificial
  CRISPR gRNA sequence
cttgggcaaaagataaatgt

SEQ ID NO: 645304 - DNA, 20 bp, Artificial
  CRISPR gRNA sequence
ttgggcaaaagataaatgta

SEQ ID NO: 645305 - DNA, 20 bp, Artificial
  CRISPR gRNA sequence
gggcaaaagataaatgtaca

SEQ ID NO: 645306 - DNA, 20 bp, Artificial
  CRISPR gRNA sequence
ggcaaaagataaatgtacaa

SEQ ID NO: 645307 - DNA, 20 bp, Artificial
  CRISPR gRNA sequence
gtttgaaaacgttttcttca

SEQ ID NO: 645308 - DNA, 20 bp, Artificial
  CRISPR gRNA sequence
tttgaaaacgttttcttcaa

SEQ ID NO: 645309 - DNA, 20 bp, Artificial
  CRISPR gRNA sequence
gaaaacgttttcttcaatca

SEQ ID NO: 645310 - DNA, 20 bp, Artificial
  CRISPR gRNA sequence
aaaacgttttcttcaatcag

SEQ ID NO: 645311 - DNA, 20 bp, Artificial
  CRISPR gRNA sequence
tcttcaatcagtatattttt

SEQ ID NO: 645312 - DNA, 20 bp, Artificial
  CRISPR gRNA sequence
cttcaatcagtatattttta

SEQ ID NO: 645313 - DNA, 20 bp, Artificial
  CRISPR gRNA sequence
ttcaatcagtatatttttat

SEQ ID NO: 645314 - DNA, 20 bp, Artificial
  CRISPR gRNA sequence
caatcagtatatttttatga

SEQ ID NO: 645315 - DNA, 20 bp, Artificial
  CRISPR gRNA sequence
aatcagtatatttttatgac

SEQ ID NO: 645316 - DNA, 20 bp, Artificial
  CRISPR gRNA sequence
ttatgacctaaaatatagta

SEQ ID NO: 645317 - DNA, 20 bp, Artificial
  CRISPR gRNA sequence
tatgacctaaaatatagtaa

SEQ ID NO: 645318 - DNA, 20 bp, Artificial
  CRISPR gRNA sequence
atgacctaaaatatagtaac

SEQ ID NO: 645319 - DNA, 20 bp, Artificial
  CRISPR gRNA sequence
tgacctaaaatatagtaaca

SEQ ID NO: 645320 - DNA, 20 bp, Artificial
  CRISPR gRNA sequence
aaatatagtaacaaaattaa

SEQ ID NO: 645321 - DNA, 20 bp, Artificial
  CRISPR gRNA sequence
agtgattccatttttcactt

SEQ ID NO: 645322 - DNA, 20 bp, Artificial
  CRISPR gRNA sequence
catttttcactttaagatat

SEQ ID NO: 645323 - DNA, 20 bp, Artificial
  CRISPR gRNA sequence
ttcactttaagatataaatt

SEQ ID NO: 645324 - DNA, 20 bp, Artificial
  CRISPR gRNA sequence
tcactttaagatataaattt

SEQ ID NO: 645325 - DNA, 20 bp, Artificial
  CRISPR gRNA sequence
cactttaagatataaattta

SEQ ID NO: 645326 - DNA, 20 bp, Artificial
  CRISPR gRNA sequence
actttaagatataaatttac

SEQ ID NO: 645327 - DNA, 20 bp, Artificial
  CRISPR gRNA sequence
taagatataaatttacctaa

SEQ ID NO: 645328 - DNA, 20 bp, Artificial
  CRISPR gRNA sequence
aagatataaatttacctaaa

SEQ ID NO: 645329 - DNA, 20 bp, Artificial
  CRISPR gRNA sequence
agatataaatttacctaaac

SEQ ID NO: 645330 - DNA, 20 bp, Artificial
  CRISPR gRNA sequence
acctaaactgtctttattta

SEQ ID NO: 645331 - DNA, 20 bp, Artificial
  CRISPR gRNA sequence
cctaaactgtctttatttaa

SEQ ID NO: 645332 - DNA, 20 bp, Artificial
  CRISPR gRNA sequence
aactgtctttatttaaattg

SEQ ID NO: 645333 - DNA, 20 bp, Artificial
  CRISPR gRNA sequence
tctttatttaaattgtcaga

SEQ ID NO: 645334 - DNA, 20 bp, Artificial
  CRISPR gRNA sequence
tatttaaattgtcagacttc

SEQ ID NO: 645335 - DNA, 20 bp, Artificial
  CRISPR gRNA sequence
atttaaattgtcagacttca

SEQ ID NO: 645336 - DNA, 20 bp, Artificial
  CRISPR gRNA sequence
tttaaattgtcagacttcat

SEQ ID NO: 645337 - DNA, 20 bp, Artificial
  CRISPR gRNA sequence
aaattgtcagacttcatgat

SEQ ID NO: 645338 - DNA, 20 bp, Artificial
  CRISPR gRNA sequence
aattgtcagacttcatgatt

SEQ ID NO: 645339 - DNA, 20 bp, Artificial
  CRISPR gRNA sequence
tcagacttcatgattagcta

SEQ ID NO: 645340 - DNA, 20 bp, Artificial
  CRISPR gRNA sequence
catgattagctatttctctt

SEQ ID NO: 645341 - DNA, 20 bp, Artificial
  CRISPR gRNA sequence
atgattagctatttctcttt

SEQ ID NO: 645342 - DNA, 20 bp, Artificial
  CRISPR gRNA sequence
gctatttctctttttaaaaa

SEQ ID NO: 645343 - DNA, 20 bp, Artificial
  CRISPR gRNA sequence
tttctctttttaaaaaaggc

SEQ ID NO: 645344 - DNA, 20 bp, Artificial
  CRISPR gRNA sequence
ctctttttaaaaaaggcatt

SEQ ID NO: 645345 - DNA, 20 bp, Artificial
  CRISPR gRNA sequence
tctttttaaaaaaggcatta

SEQ ID NO: 645346 - DNA, 20 bp, Artificial
  CRISPR gRNA sequence
tttttaaaaaaggcattacc

SEQ ID NO: 645347 - DNA, 20 bp, Artificial
  CRISPR gRNA sequence
tttaaaaaaggcattaccat

SEQ ID NO: 645348 - DNA, 20 bp, Artificial
  CRISPR gRNA sequence
ttaaaaaaggcattaccata

SEQ ID NO: 645349 - DNA, 20 bp, Artificial
  CRISPR gRNA sequence
taaaaaaggcattaccataa

SEQ ID NO: 645350 - DNA, 20 bp, Artificial
  CRISPR gRNA sequence
aaaaaaggcattaccataat

SEQ ID NO: 645351 - DNA, 20 bp, Artificial
  CRISPR gRNA sequence
aaaaaggcattaccataatg

SEQ ID NO: 645352 - DNA, 20 bp, Artificial
  CRISPR gRNA sequence
ccataatgaccaataattat

SEQ ID NO: 645353 - DNA, 20 bp, Artificial
  CRISPR gRNA sequence
taatccaaataattagtatt

SEQ ID NO: 645354 - DNA, 20 bp, Artificial
  CRISPR gRNA sequence
gtatttacatatctttaaaa

SEQ ID NO: 645355 - DNA, 20 bp, Artificial
  CRISPR gRNA sequence
acatatctttaaaatcaatc

SEQ ID NO: 645356 - DNA, 20 bp, Artificial
  CRISPR gRNA sequence
catatctttaaaatcaatct

SEQ ID NO: 645357 - DNA, 20 bp, Artificial
  CRISPR gRNA sequence
taaaatcaatctttttttaa

SEQ ID NO: 645358 - DNA, 20 bp, Artificial
  CRISPR gRNA sequence
aaaatcaatctttttttaaa

SEQ ID NO: 645359 - DNA, 20 bp, Artificial
  CRISPR gRNA sequence
aaatcaatctttttttaaaa

SEQ ID NO: 645360 - DNA, 20 bp, Artificial
  CRISPR gRNA sequence
tttttaaaaaaatctctttt

SEQ ID NO: 645361 - DNA, 20 bp, Artificial
  CRISPR gRNA sequence
ttttaaaaaaatctcttttg

SEQ ID NO: 645362 - DNA, 20 bp, Artificial
  CRISPR gRNA sequence
tttaaaaaaatctcttttgt

SEQ ID NO: 645363 - DNA, 20 bp, Artificial
  CRISPR gRNA sequence
ttaaaaaaatctcttttgtg

SEQ ID NO: 645364 - DNA, 20 bp, Artificial
  CRISPR gRNA sequence
taaaaaaatctcttttgtgg

SEQ ID NO: 645365 - DNA, 20 bp, Artificial
  CRISPR gRNA sequence
aaaaaaatctcttttgtggt

SEQ ID NO: 645366 - DNA, 20 bp, Artificial
  CRISPR gRNA sequence
aaaaaatctcttttgtggtt

SEQ ID NO: 645367 - DNA, 20 bp, Artificial
  CRISPR gRNA sequence
ttttgtggttgaaaagaaaa

SEQ ID NO: 645368 - DNA, 20 bp, Artificial
  CRISPR gRNA sequence
ttgtggttgaaaagaaaatt

SEQ ID NO: 645369 - DNA, 20 bp, Artificial
  CRISPR gRNA sequence
tgtggttgaaaagaaaatta

SEQ ID NO: 645370 - DNA, 20 bp, Artificial
  CRISPR gRNA sequence
gtggttgaaaagaaaattat

SEQ ID NO: 645371 - DNA, 20 bp, Artificial
  CRISPR gRNA sequence
tggttgaaaagaaaattatg

SEQ ID NO: 645372 - DNA, 20 bp, Artificial
  CRISPR gRNA sequence
aaaagaaaattatggaaaga

SEQ ID NO: 645373 - DNA, 20 bp, Artificial
  CRISPR gRNA sequence
tggaaagacggcaccaatct

SEQ ID NO: 645374 - DNA, 20 bp, Artificial
  CRISPR gRNA sequence
tttttctgtttaagagatcc

SEQ ID NO: 645375 - DNA, 20 bp, Artificial
  CRISPR gRNA sequence
ttctgtttaagagatccttg

SEQ ID NO: 645376 - DNA, 20 bp, Artificial
  CRISPR gRNA sequence
tctgtttaagagatccttgc

SEQ ID NO: 645377 - DNA, 20 bp, Artificial
  CRISPR gRNA sequence
ctgtttaagagatccttgcg

SEQ ID NO: 645378 - DNA, 20 bp, Artificial
  CRISPR gRNA sequence
tgtttaagagatccttgcgc

SEQ ID NO: 645379 - DNA, 20 bp, Artificial
  CRISPR gRNA sequence
tttaagagatccttgcgcct

SEQ ID NO: 645380 - DNA, 20 bp, Artificial
  CRISPR gRNA sequence
aagagatccttgcgcctgtt

SEQ ID NO: 645381 - DNA, 20 bp, Artificial
  CRISPR gRNA sequence
agagatccttgcgcctgttt

SEQ ID NO: 645382 - DNA, 20 bp, Artificial
  CRISPR gRNA sequence
gcgcctgttttttaaaggaa

SEQ ID NO: 645383 - DNA, 20 bp, Artificial
  CRISPR gRNA sequence
cgcctgttttttaaaggaag

SEQ ID NO: 645384 - DNA, 20 bp, Artificial
  CRISPR gRNA sequence
ttttttaaaggaagagttgg

SEQ ID NO: 645385 - DNA, 20 bp, Artificial
  CRISPR gRNA sequence
tttaaaggaagagttggtct

SEQ ID NO: 645386 - DNA, 20 bp, Artificial
  CRISPR gRNA sequence
ttaaaggaagagttggtcta

SEQ ID NO: 645387 - DNA, 20 bp, Artificial
  CRISPR gRNA sequence
taaaggaagagttggtctaa

SEQ ID NO: 645388 - DNA, 20 bp, Artificial
  CRISPR gRNA sequence
aaaggaagagttggtctaac

SEQ ID NO: 645389 - DNA, 20 bp, Artificial
  CRISPR gRNA sequence
aaggaagagttggtctaact

SEQ ID NO: 645390 - DNA, 20 bp, Artificial
  CRISPR gRNA sequence
gtctaactactcttacgaaa

SEQ ID NO: 645391 - DNA, 20 bp, Artificial
  CRISPR gRNA sequence
actactcttacgaaaaaaaa

SEQ ID NO: 645392 - DNA, 20 bp, Artificial
  CRISPR gRNA sequence
ctcttacgaaaaaaaaaaat

SEQ ID NO: 645393 - DNA, 20 bp, Artificial
  CRISPR gRNA sequence
ttacgaaaaaaaaaaatggc

SEQ ID NO: 645394 - DNA, 20 bp, Artificial
  CRISPR gRNA sequence
acgaaaaaaaaaaatggcta

SEQ ID NO: 645395 - DNA, 20 bp, Artificial
  CRISPR gRNA sequence
cgaaaaaaaaaaatggctag

SEQ ID NO: 645396 - DNA, 20 bp, Artificial
  CRISPR gRNA sequence
ggcacaatggttcacgtcta

SEQ ID NO: 645397 - DNA, 20 bp, Artificial
  CRISPR gRNA sequence
acgtctataatcccaacact

SEQ ID NO: 645398 - DNA, 20 bp, Artificial
  CRISPR gRNA sequence
taatcccaacactttgggag

SEQ ID NO: 645399 - DNA, 20 bp, Artificial
  CRISPR gRNA sequence
tgggaggccgcggctggaga

SEQ ID NO: 645400 - DNA, 20 bp, Artificial
  CRISPR gRNA sequence
gggaggccgcggctggagaa

SEQ ID NO: 645401 - DNA, 20 bp, Artificial
  CRISPR gRNA sequence
ggaggccgcggctggagaat

SEQ ID NO: 645402 - DNA, 20 bp, Artificial
  CRISPR gRNA sequence
gagaatcgcttgagcccaag

SEQ ID NO: 645403 - DNA, 20 bp, Artificial
  CRISPR gRNA sequence
gagcccaagtgtttgagacc

SEQ ID NO: 645404 - DNA, 20 bp, Artificial
  CRISPR gRNA sequence
agcccaagtgtttgagacca

SEQ ID NO: 645405 - DNA, 20 bp, Artificial
  CRISPR gRNA sequence
gagaccagcctgtgagacat

SEQ ID NO: 645406 - DNA, 20 bp, Artificial
  CRISPR gRNA sequence
agaccagcctgtgagacata

SEQ ID NO: 645407 - DNA, 20 bp, Artificial
  CRISPR gRNA sequence
tgagacatagtgagacctcg

SEQ ID NO: 645408 - DNA, 20 bp, Artificial
  CRISPR gRNA sequence
ggatctagagagatattagc

SEQ ID NO: 645409 - DNA, 20 bp, Artificial
  CRISPR gRNA sequence
gagagatattagccaggcat

SEQ ID NO: 645410 - DNA, 20 bp, Artificial
  CRISPR gRNA sequence
gccaggcatggtggtggcgc

SEQ ID NO: 645411 - DNA, 20 bp, Artificial
  CRISPR gRNA sequence
gccccagctagtccagaggc

SEQ ID NO: 645412 - DNA, 20 bp, Artificial
  CRISPR gRNA sequence
gtccagaggctgaggtgaga

SEQ ID NO: 645413 - DNA, 20 bp, Artificial
  CRISPR gRNA sequence
aggtgagaggatctcttgag

SEQ ID NO: 645414 - DNA, 20 bp, Artificial
  CRISPR gRNA sequence
ttgagcccaggagttcgagg

SEQ ID NO: 645415 - DNA, 20 bp, Artificial
  CRISPR gRNA sequence
gagcccaggagttcgaggct

SEQ ID NO: 645416 - DNA, 20 bp, Artificial
  CRISPR gRNA sequence
agcccaggagttcgaggctg

SEQ ID NO: 645417 - DNA, 20 bp, Artificial
  CRISPR gRNA sequence
gaggctgccacataagccat

SEQ ID NO: 645418 - DNA, 20 bp, Artificial
  CRISPR gRNA sequence
ccacataagccatgatcatg

SEQ ID NO: 645419 - DNA, 20 bp, Artificial
  CRISPR gRNA sequence
cactccaacctgggcgacag

SEQ ID NO: 645420 - DNA, 20 bp, Artificial
  CRISPR gRNA sequence
caacctgggcgacagagtga

SEQ ID NO: 645421 - DNA, 20 bp, Artificial
  CRISPR gRNA sequence
ggcgacagagtgagggaaac

SEQ ID NO: 645422 - DNA, 20 bp, Artificial
  CRISPR gRNA sequence
tctaaaaaaaaaaaaaagaa

SEQ ID NO: 645423 - DNA, 20 bp, Artificial
  CRISPR gRNA sequence
aaaaaaaaaaaaagaaaaaa

SEQ ID NO: 645424 - DNA, 20 bp, Artificial
  CRISPR gRNA sequence
tttaagtaggttttccattt

SEQ ID NO: 645425 - DNA, 20 bp, Artificial
  CRISPR gRNA sequence
ttaagtaggttttccatttc

SEQ ID NO: 645426 - DNA, 20 bp, Artificial
  CRISPR gRNA sequence
taagtaggttttccatttct

SEQ ID NO: 645427 - DNA, 20 bp, Artificial
  CRISPR gRNA sequence
aagtaggttttccatttctg

SEQ ID NO: 645428 - DNA, 20 bp, Artificial
  CRISPR gRNA sequence
agtaggttttccatttctga

SEQ ID NO: 645429 - DNA, 20 bp, Artificial
  CRISPR gRNA sequence
tccatttctgagactaaata

SEQ ID NO: 645430 - DNA, 20 bp, Artificial
  CRISPR gRNA sequence
ccatttctgagactaaatat

SEQ ID NO: 645431 - DNA, 20 bp, Artificial
  CRISPR gRNA sequence
catttctgagactaaatatc

SEQ ID NO: 645432 - DNA, 20 bp, Artificial
  CRISPR gRNA sequence
ctgagactaaatatctaaaa

SEQ ID NO: 645433 - DNA, 20 bp, Artificial
  CRISPR gRNA sequence
tgagactaaatatctaaaag

SEQ ID NO: 645434 - DNA, 20 bp, Artificial
  CRISPR gRNA sequence
agactaaatatctaaaagtt

SEQ ID NO: 645435 - DNA, 20 bp, Artificial
  CRISPR gRNA sequence
aatatctaaaagtttcttgc

SEQ ID NO: 645436 - DNA, 20 bp, Artificial
  CRISPR gRNA sequence
aaagtttcttgccacttgaa

SEQ ID NO: 645437 - DNA, 20 bp, Artificial
  CRISPR gRNA sequence
cttgccacttgaaaaatcta

SEQ ID NO: 645438 - DNA, 20 bp, Artificial
  CRISPR gRNA sequence
ttgccacttgaaaaatctaa

SEQ ID NO: 645439 - DNA, 20 bp, Artificial
  CRISPR gRNA sequence
gccacttgaaaaatctaaaa

SEQ ID NO: 645440 - DNA, 20 bp, Artificial
  CRISPR gRNA sequence
ccacttgaaaaatctaaaag

SEQ ID NO: 645441 - DNA, 20 bp, Artificial
  CRISPR gRNA sequence
gaaaaatctaaaagtgaaac

SEQ ID NO: 645442 - DNA, 20 bp, Artificial
  CRISPR gRNA sequence
aaaaatctaaaagtgaaaca

SEQ ID NO: 645443 - DNA, 20 bp, Artificial
  CRISPR gRNA sequence
aaagtgaaacatctcaagtc

SEQ ID NO: 645444 - DNA, 20 bp, Artificial
  CRISPR gRNA sequence
aagtctcactcataactcta

SEQ ID NO: 645445 - DNA, 20 bp, Artificial
  CRISPR gRNA sequence
actcataactctattcttca

SEQ ID NO: 645446 - DNA, 20 bp, Artificial
  CRISPR gRNA sequence
ataactctattcttcatatt

SEQ ID NO: 645447 - DNA, 20 bp, Artificial
  CRISPR gRNA sequence
tattcttcatattttgtact

SEQ ID NO: 645448 - DNA, 20 bp, Artificial
  CRISPR gRNA sequence
ttcttcatattttgtactat

SEQ ID NO: 645449 - DNA, 20 bp, Artificial
  CRISPR gRNA sequence
ttcatattttgtactatgat

SEQ ID NO: 645450 - DNA, 20 bp, Artificial
  CRISPR gRNA sequence
catattttgtactatgatga

SEQ ID NO: 645451 - DNA, 20 bp, Artificial
  CRISPR gRNA sequence
atattttgtactatgatgaa

SEQ ID NO: 645452 - DNA, 20 bp, Artificial
  CRISPR gRNA sequence
tgtactatgatgaacacatt

SEQ ID NO: 645453 - DNA, 20 bp, Artificial
  CRISPR gRNA sequence
gtactatgatgaacacatta

SEQ ID NO: 645454 - DNA, 20 bp, Artificial
  CRISPR gRNA sequence
tactatgatgaacacattaa

SEQ ID NO: 645455 - DNA, 20 bp, Artificial
  CRISPR gRNA sequence
tgatgaacacattaagtaat

SEQ ID NO: 645456 - DNA, 20 bp, Artificial
  CRISPR gRNA sequence
agtaatacatatatttaaca

SEQ ID NO: 645457 - DNA, 20 bp, Artificial
  CRISPR gRNA sequence
aacatgtgattaatatgtaa

SEQ ID NO: 645458 - DNA, 20 bp, Artificial
  CRISPR gRNA sequence
acatgtgattaatatgtaat

SEQ ID NO: 645459 - DNA, 20 bp, Artificial
  CRISPR gRNA sequence
atatgtaatcttgagcaaag

SEQ ID NO: 645460 - DNA, 20 bp, Artificial
  CRISPR gRNA sequence
gagcaaaggtaccaaaaagt

SEQ ID NO: 645461 - DNA, 20 bp, Artificial
  CRISPR gRNA sequence
agcaaaggtaccaaaaagta

SEQ ID NO: 645462 - DNA, 20 bp, Artificial
  CRISPR gRNA sequence
tccaattcagagcaaaagtc

SEQ ID NO: 645463 - DNA, 20 bp, Artificial
  CRISPR gRNA sequence
caattcagagcaaaagtcaa

SEQ ID NO: 645464 - DNA, 20 bp, Artificial
  CRISPR gRNA sequence
agagcaaaagtcaaaaaaat

SEQ ID NO: 645465 - DNA, 20 bp, Artificial
  CRISPR gRNA sequence
taattttaatttaaaatatt

SEQ ID NO: 645466 - DNA, 20 bp, Artificial
  CRISPR gRNA sequence
aattttaatttaaaatattc

SEQ ID NO: 645467 - DNA, 20 bp, Artificial
  CRISPR gRNA sequence
attttaatttaaaatattcc

SEQ ID NO: 645468 - DNA, 20 bp, Artificial
  CRISPR gRNA sequence
taatttaaaatattccttat

SEQ ID NO: 645469 - DNA, 20 bp, Artificial
  CRISPR gRNA sequence
aatttaaaatattccttatg

SEQ ID NO: 645470 - DNA, 20 bp, Artificial
  CRISPR gRNA sequence
atttaaaatattccttatgc

SEQ ID NO: 645471 - DNA, 20 bp, Artificial
  CRISPR gRNA sequence
aaaatattccttatgccacc

SEQ ID NO: 645472 - DNA, 20 bp, Artificial
  CRISPR gRNA sequence
aaatattccttatgccaccc

SEQ ID NO: 645473 - DNA, 20 bp, Artificial
  CRISPR gRNA sequence
cttatgccacccatcaagaa

SEQ ID NO: 645474 - DNA, 20 bp, Artificial
  CRISPR gRNA sequence
atgccacccatcaagaaagc

SEQ ID NO: 645475 - DNA, 20 bp, Artificial
  CRISPR gRNA sequence
tgccacccatcaagaaagcc

SEQ ID NO: 645476 - DNA, 20 bp, Artificial
  CRISPR gRNA sequence
tatgataaacagcagatata

SEQ ID NO: 645477 - DNA, 20 bp, Artificial
  CRISPR gRNA sequence
ctgattaattataatgggga

SEQ ID NO: 645478 - DNA, 20 bp, Artificial
  CRISPR gRNA sequence
attaattataatggggaaaa

SEQ ID NO: 645479 - DNA, 20 bp, Artificial
  CRISPR gRNA sequence
attataatggggaaaatcat

SEQ ID NO: 645480 - DNA, 20 bp, Artificial
  CRISPR gRNA sequence
taatggggaaaatcataaac

SEQ ID NO: 645481 - DNA, 20 bp, Artificial
  CRISPR gRNA sequence
gaaatcaactatatcacata

SEQ ID NO: 645482 - DNA, 20 bp, Artificial
  CRISPR gRNA sequence
tatcacatatagaaggacac

SEQ ID NO: 645483 - DNA, 20 bp, Artificial
  CRISPR gRNA sequence
tttgtcaacaggtccattgt

SEQ ID NO: 645484 - DNA, 20 bp, Artificial
  CRISPR gRNA sequence
gtcaacaggtccattgtcta

SEQ ID NO: 645485 - DNA, 20 bp, Artificial
  CRISPR gRNA sequence
tcaacaggtccattgtctat

SEQ ID NO: 645486 - DNA, 20 bp, Artificial
  CRISPR gRNA sequence
tctatgatgagcaaattagc

SEQ ID NO: 645487 - DNA, 20 bp, Artificial
  CRISPR gRNA sequence
tgatgagcaaattagcctgc

SEQ ID NO: 645488 - DNA, 20 bp, Artificial
  CRISPR gRNA sequence
gcctgctcagagtcagaaac

SEQ ID NO: 645489 - DNA, 20 bp, Artificial
  CRISPR gRNA sequence
ctcagagtcagaaacaacac

SEQ ID NO: 645490 - DNA, 20 bp, Artificial
  CRISPR gRNA sequence
agagtcagaaacaacactta

SEQ ID NO: 645491 - DNA, 20 bp, Artificial
  CRISPR gRNA sequence
agggttccctcagacacaca

SEQ ID NO: 645492 - DNA, 20 bp, Artificial
  CRISPR gRNA sequence
gggttccctcagacacacag

SEQ ID NO: 645493 - DNA, 20 bp, Artificial
  CRISPR gRNA sequence
cctcagacacacagtgaaag

SEQ ID NO: 645494 - DNA, 20 bp, Artificial
  CRISPR gRNA sequence
agacacacagtgaaagacca

SEQ ID NO: 645495 - DNA, 20 bp, Artificial
  CRISPR gRNA sequence
aggctgttaacacaagacaa

SEQ ID NO: 645496 - DNA, 20 bp, Artificial
  CRISPR gRNA sequence
ttaacacaagacaaaaaaaa

SEQ ID NO: 645497 - DNA, 20 bp, Artificial
  CRISPR gRNA sequence
acacaagacaaaaaaaataa

SEQ ID NO: 645498 - DNA, 20 bp, Artificial
  CRISPR gRNA sequence
agaagaccctttctcatccc

SEQ ID NO: 645499 - DNA, 20 bp, Artificial
  CRISPR gRNA sequence
tctcatcccttgcccatgag

SEQ ID NO: 645500 - DNA, 20 bp, Artificial
  CRISPR gRNA sequence
ctcatcccttgcccatgaga

SEQ ID NO: 645501 - DNA, 20 bp, Artificial
  CRISPR gRNA sequence
tcatcccttgcccatgagaa

SEQ ID NO: 645502 - DNA, 20 bp, Artificial
  CRISPR gRNA sequence
atcccttgcccatgagaact

SEQ ID NO: 645503 - DNA, 20 bp, Artificial
  CRISPR gRNA sequence
gcccatgagaactttaaggc

SEQ ID NO: 645504 - DNA, 20 bp, Artificial
  CRISPR gRNA sequence
cccatgagaactttaaggct

SEQ ID NO: 645505 - DNA, 20 bp, Artificial
  CRISPR gRNA sequence
taaggcttagcaagacaaac

SEQ ID NO: 645506 - DNA, 20 bp, Artificial
  CRISPR gRNA sequence
aaggcttagcaagacaaaca

SEQ ID NO: 645507 - DNA, 20 bp, Artificial
  CRISPR gRNA sequence
aggcttagcaagacaaacaa

SEQ ID NO: 645508 - DNA, 20 bp, Artificial
  CRISPR gRNA sequence
agcaagacaaacaaagaatt

SEQ ID NO: 645509 - DNA, 20 bp, Artificial
  CRISPR gRNA sequence
gcaagacaaacaaagaatta

SEQ ID NO: 645510 - DNA, 20 bp, Artificial
  CRISPR gRNA sequence
tatatttcttgggcaaggtt

SEQ ID NO: 645511 - DNA, 20 bp, Artificial
  CRISPR gRNA sequence
cttgggcaaggtttatcaca

SEQ ID NO: 645512 - DNA, 20 bp, Artificial
  CRISPR gRNA sequence
ttgggcaaggtttatcacat

SEQ ID NO: 645513 - DNA, 20 bp, Artificial
  CRISPR gRNA sequence
gggcaaggtttatcacattt

SEQ ID NO: 645514 - DNA, 20 bp, Artificial
  CRISPR gRNA sequence
ggcaaggtttatcacattta

SEQ ID NO: 645515 - DNA, 20 bp, Artificial
  CRISPR gRNA sequence
atcacatttatgtcaacaaa

SEQ ID NO: 645516 - DNA, 20 bp, Artificial
  CRISPR gRNA sequence
tcacatttatgtcaacaaag

SEQ ID NO: 645517 - DNA, 20 bp, Artificial
  CRISPR gRNA sequence
atgtcaacaaagagatgatc

SEQ ID NO: 645518 - DNA, 20 bp, Artificial
  CRISPR gRNA sequence
tgtcaacaaagagatgatca

SEQ ID NO: 645519 - DNA, 20 bp, Artificial
  CRISPR gRNA sequence
tgaggtcttatagcttcaca

SEQ ID NO: 645520 - DNA, 20 bp, Artificial
  CRISPR gRNA sequence
atagcttcacagttgtagtt

SEQ ID NO: 645521 - DNA, 20 bp, Artificial
  CRISPR gRNA sequence
tagcttcacagttgtagttt

SEQ ID NO: 645522 - DNA, 20 bp, Artificial
  CRISPR gRNA sequence
cacagttgtagtttttaaag

SEQ ID NO: 645523 - DNA, 20 bp, Artificial
  CRISPR gRNA sequence
acagttgtagtttttaaagg

SEQ ID NO: 645524 - DNA, 20 bp, Artificial
  CRISPR gRNA sequence
tagtttttaaaggagggatc

SEQ ID NO: 645525 - DNA, 20 bp, Artificial
  CRISPR gRNA sequence
ttaaaggagggatcactgaa

SEQ ID NO: 645526 - DNA, 20 bp, Artificial
  CRISPR gRNA sequence
taaaggagggatcactgaac

SEQ ID NO: 645527 - DNA, 20 bp, Artificial
  CRISPR gRNA sequence
aaaggagggatcactgaact

SEQ ID NO: 645528 - DNA, 20 bp, Artificial
  CRISPR gRNA sequence
aaggagggatcactgaactc

SEQ ID NO: 645529 - DNA, 20 bp, Artificial
  CRISPR gRNA sequence
aactcccaacaaattgtata

SEQ ID NO: 645530 - DNA, 20 bp, Artificial
  CRISPR gRNA sequence
ccaacaaattgtatagctca

SEQ ID NO: 645531 - DNA, 20 bp, Artificial
  CRISPR gRNA sequence
tatagctcattttaagtacg

SEQ ID NO: 645532 - DNA, 20 bp, Artificial
  CRISPR gRNA sequence
attttaagtacgtgtacata

SEQ ID NO: 645533 - DNA, 20 bp, Artificial
  CRISPR gRNA sequence
taagtacgtgtacatacacg

SEQ ID NO: 645534 - DNA, 20 bp, Artificial
  CRISPR gRNA sequence
aagtacgtgtacatacacgc

SEQ ID NO: 645535 - DNA, 20 bp, Artificial
  CRISPR gRNA sequence
agtacgtgtacatacacgca

SEQ ID NO: 645536 - DNA, 20 bp, Artificial
  CRISPR gRNA sequence
tccattagtatcacaaaatt

SEQ ID NO: 645537 - DNA, 20 bp, Artificial
  CRISPR gRNA sequence
ccattagtatcacaaaattc

SEQ ID NO: 645538 - DNA, 20 bp, Artificial
  CRISPR gRNA sequence
cattagtatcacaaaattct

SEQ ID NO: 645539 - DNA, 20 bp, Artificial
  CRISPR gRNA sequence
gtatcacaaaattctaattg

SEQ ID NO: 645540 - DNA, 20 bp, Artificial
  CRISPR gRNA sequence
taattgtagaattgtctcta

SEQ ID NO: 645541 - DNA, 20 bp, Artificial
  CRISPR gRNA sequence
attgtagaattgtctctaaa

SEQ ID NO: 645542 - DNA, 20 bp, Artificial
  CRISPR gRNA sequence
tagaattgtctctaaatgtt

SEQ ID NO: 645543 - DNA, 20 bp, Artificial
  CRISPR gRNA sequence
tctctaaatgtttttctcac

SEQ ID NO: 645544 - DNA, 20 bp, Artificial
  CRISPR gRNA sequence
taaatgtttttctcactgtg

SEQ ID NO: 645545 - DNA, 20 bp, Artificial
  CRISPR gRNA sequence
aatgtttttctcactgtgga

SEQ ID NO: 645546 - DNA, 20 bp, Artificial
  CRISPR gRNA sequence
ttctcactgtggaaaaagca

SEQ ID NO: 645547 - DNA, 20 bp, Artificial
  CRISPR gRNA sequence
tctcactgtggaaaaagcag

SEQ ID NO: 645548 - DNA, 20 bp, Artificial
  CRISPR gRNA sequence
ctcactgtggaaaaagcaga

SEQ ID NO: 645549 - DNA, 20 bp, Artificial
  CRISPR gRNA sequence
tcactgtggaaaaagcagat

SEQ ID NO: 645550 - DNA, 20 bp, Artificial
  CRISPR gRNA sequence
actgtggaaaaagcagattt

SEQ ID NO: 645551 - DNA, 20 bp, Artificial
  CRISPR gRNA sequence
tggaaaaagcagatttgctc

SEQ ID NO: 645552 - DNA, 20 bp, Artificial
  CRISPR gRNA sequence
gctcatctgtagcgagaacc

SEQ ID NO: 645553 - DNA, 20 bp, Artificial
  CRISPR gRNA sequence
ctcatctgtagcgagaacct

SEQ ID NO: 645554 - DNA, 20 bp, Artificial
  CRISPR gRNA sequence
atctgtagcgagaacctgac

SEQ ID NO: 645555 - DNA, 20 bp, Artificial
  CRISPR gRNA sequence
tagcgagaacctgactggca

SEQ ID NO: 645556 - DNA, 20 bp, Artificial
  CRISPR gRNA sequence
actggcacttaatagggaag

SEQ ID NO: 645557 - DNA, 20 bp, Artificial
  CRISPR gRNA sequence
gcacttaatagggaaggtat

SEQ ID NO: 645558 - DNA, 20 bp, Artificial
  CRISPR gRNA sequence
aatagggaaggtatgtaaat

SEQ ID NO: 645559 - DNA, 20 bp, Artificial
  CRISPR gRNA sequence
atagggaaggtatgtaaatc

SEQ ID NO: 645560 - DNA, 20 bp, Artificial
  CRISPR gRNA sequence
aagttcagtcattgctggaa

SEQ ID NO: 645561 - DNA, 20 bp, Artificial
  CRISPR gRNA sequence
agtcattgctggaactgtgt

SEQ ID NO: 645562 - DNA, 20 bp, Artificial
  CRISPR gRNA sequence
ctggaactgtgtaactacct

SEQ ID NO: 645563 - DNA, 20 bp, Artificial
  CRISPR gRNA sequence
gaactgtgtaactaccttca

SEQ ID NO: 645564 - DNA, 20 bp, Artificial
  CRISPR gRNA sequence
tgtaactaccttcatgtatt

SEQ ID NO: 645565 - DNA, 20 bp, Artificial
  CRISPR gRNA sequence
ccttcatgtattagagtttt

SEQ ID NO: 645566 - DNA, 20 bp, Artificial
  CRISPR gRNA sequence
catgtattagagttttcagt

SEQ ID NO: 645567 - DNA, 20 bp, Artificial
  CRISPR gRNA sequence
atgtattagagttttcagtg

SEQ ID NO: 645568 - DNA, 20 bp, Artificial
  CRISPR gRNA sequence
gagttttcagtgaaaattta

SEQ ID NO: 645569 - DNA, 20 bp, Artificial
  CRISPR gRNA sequence
tcagtgaaaatttagataat

SEQ ID NO: 645570 - DNA, 20 bp, Artificial
  CRISPR gRNA sequence
cagtgaaaatttagataatt

SEQ ID NO: 645571 - DNA, 20 bp, Artificial
  CRISPR gRNA sequence
agtgaaaatttagataattt

SEQ ID NO: 645572 - DNA, 20 bp, Artificial
  CRISPR gRNA sequence
agataatttatctcaggaat

SEQ ID NO: 645573 - DNA, 20 bp, Artificial
  CRISPR gRNA sequence
gataatttatctcaggaatt

SEQ ID NO: 645574 - DNA, 20 bp, Artificial
  CRISPR gRNA sequence
atctcaggaattcttgtttt

SEQ ID NO: 645575 - DNA, 20 bp, Artificial
  CRISPR gRNA sequence
tctcaggaattcttgttttc

SEQ ID NO: 645576 - DNA, 20 bp, Artificial
  CRISPR gRNA sequence
aggaattcttgttttcagtg

SEQ ID NO: 645577 - DNA, 20 bp, Artificial
  CRISPR gRNA sequence
ttgttttcagtgaaaattta

SEQ ID NO: 645578 - DNA, 20 bp, Artificial
  CRISPR gRNA sequence
gttttcagtgaaaatttaga

SEQ ID NO: 645579 - DNA, 20 bp, Artificial
  CRISPR gRNA sequence
ttttcagtgaaaatttagat

SEQ ID NO: 645580 - DNA, 20 bp, Artificial
  CRISPR gRNA sequence
tcagtgaaaatttagataat

SEQ ID NO: 645581 - DNA, 20 bp, Artificial
  CRISPR gRNA sequence
cagtgaaaatttagataatt

SEQ ID NO: 645582 - DNA, 20 bp, Artificial
  CRISPR gRNA sequence
agtgaaaatttagataattt

SEQ ID NO: 645583 - DNA, 20 bp, Artificial
  CRISPR gRNA sequence
agataatttatctcaggaat

SEQ ID NO: 645584 - DNA, 20 bp, Artificial
  CRISPR gRNA sequence
gataatttatctcaggaatt

SEQ ID NO: 645585 - DNA, 20 bp, Artificial
  CRISPR gRNA sequence
atctcaggaattcttgcagg

SEQ ID NO: 645586 - DNA, 20 bp, Artificial
  CRISPR gRNA sequence
tctcaggaattcttgcagga

SEQ ID NO: 645587 - DNA, 20 bp, Artificial
  CRISPR gRNA sequence
aggaattcttgcaggaggaa

SEQ ID NO: 645588 - DNA, 20 bp, Artificial
  CRISPR gRNA sequence
ttgcaggaggaaaaacaaac

SEQ ID NO: 645589 - DNA, 20 bp, Artificial
  CRISPR gRNA sequence
gcaggaggaaaaacaaacaa

SEQ ID NO: 645590 - DNA, 20 bp, Artificial
  CRISPR gRNA sequence
caggaggaaaaacaaacaac

SEQ ID NO: 645591 - DNA, 20 bp, Artificial
  CRISPR gRNA sequence
ctaaactctttggcgagatc

SEQ ID NO: 645592 - DNA, 20 bp, Artificial
  CRISPR gRNA sequence
taaactctttggcgagatca

SEQ ID NO: 645593 - DNA, 20 bp, Artificial
  CRISPR gRNA sequence
aactctttggcgagatcaca

SEQ ID NO: 645594 - DNA, 20 bp, Artificial
  CRISPR gRNA sequence
tttggcgagatcacaaagat

SEQ ID NO: 645595 - DNA, 20 bp, Artificial
  CRISPR gRNA sequence
tggcgagatcacaaagatct

SEQ ID NO: 645596 - DNA, 20 bp, Artificial
  CRISPR gRNA sequence
ggcgagatcacaaagatctt

SEQ ID NO: 645597 - DNA, 20 bp, Artificial
  CRISPR gRNA sequence
gcgagatcacaaagatctta

SEQ ID NO: 645598 - DNA, 20 bp, Artificial
  CRISPR gRNA sequence
aggcccttcttgacaacatt

SEQ ID NO: 645599 - DNA, 20 bp, Artificial
  CRISPR gRNA sequence
ggcccttcttgacaacattt

SEQ ID NO: 645600 - DNA, 20 bp, Artificial
  CRISPR gRNA sequence
cttgacaacattttagagaa

SEQ ID NO: 645601 - DNA, 20 bp, Artificial
  CRISPR gRNA sequence
ttgacaacattttagagaac

SEQ ID NO: 645602 - DNA, 20 bp, Artificial
  CRISPR gRNA sequence
gacaacattttagagaacta

SEQ ID NO: 645603 - DNA, 20 bp, Artificial
  CRISPR gRNA sequence
acaacattttagagaactat

SEQ ID NO: 645604 - DNA, 20 bp, Artificial
  CRISPR gRNA sequence
tagagaactatcaagaatac

SEQ ID NO: 645605 - DNA, 20 bp, Artificial
  CRISPR gRNA sequence
agagaactatcaagaatact

SEQ ID NO: 645606 - DNA, 20 bp, Artificial
  CRISPR gRNA sequence
gagaactatcaagaatactg

SEQ ID NO: 645607 - DNA, 20 bp, Artificial
  CRISPR gRNA sequence
tcaagaatactggaacacga

SEQ ID NO: 645608 - DNA, 20 bp, Artificial
  CRISPR gRNA sequence
gaacacgacagaacacaatg

SEQ ID NO: 645609 - DNA, 20 bp, Artificial
  CRISPR gRNA sequence
aattcgaaatcaaaagacct

SEQ ID NO: 645610 - DNA, 20 bp, Artificial
  CRISPR gRNA sequence
gaaatcaaaagacctgaagt

SEQ ID NO: 645611 - DNA, 20 bp, Artificial
  CRISPR gRNA sequence
aagtttacctgtgttctaac

SEQ ID NO: 645612 - DNA, 20 bp, Artificial
  CRISPR gRNA sequence
acctgtgttctaactgtgta

SEQ ID NO: 645613 - DNA, 20 bp, Artificial
  CRISPR gRNA sequence
cctgtgttctaactgtgtag

SEQ ID NO: 645614 - DNA, 20 bp, Artificial
  CRISPR gRNA sequence
tgttctaactgtgtaggtta

SEQ ID NO: 645615 - DNA, 20 bp, Artificial
  CRISPR gRNA sequence
taactgtgtaggttagtttt

SEQ ID NO: 645616 - DNA, 20 bp, Artificial
  CRISPR gRNA sequence
actgtgtaggttagttttca

SEQ ID NO: 645617 - DNA, 20 bp, Artificial
  CRISPR gRNA sequence
tgtaggttagttttcatatc

SEQ ID NO: 645618 - DNA, 20 bp, Artificial
  CRISPR gRNA sequence
gttttcatatctctagaaca

SEQ ID NO: 645619 - DNA, 20 bp, Artificial
  CRISPR gRNA sequence
tcatatctctagaacaaaga

SEQ ID NO: 645620 - DNA, 20 bp, Artificial
  CRISPR gRNA sequence
catatctctagaacaaagag

SEQ ID NO: 645621 - DNA, 20 bp, Artificial
  CRISPR gRNA sequence
atatctctagaacaaagaga

SEQ ID NO: 645622 - DNA, 20 bp, Artificial
  CRISPR gRNA sequence
tagaacaaagagaggtatgc

SEQ ID NO: 645623 - DNA, 20 bp, Artificial
  CRISPR gRNA sequence
gaacaaagagaggtatgcta

SEQ ID NO: 645624 - DNA, 20 bp, Artificial
  CRISPR gRNA sequence
catctcgaaagctatgatta

SEQ ID NO: 645625 - DNA, 20 bp, Artificial
  CRISPR gRNA sequence
gaaagctatgattaagtgaa

SEQ ID NO: 645626 - DNA, 20 bp, Artificial
  CRISPR gRNA sequence
tgattaagtgaaatgtaaac

SEQ ID NO: 645627 - DNA, 20 bp, Artificial
  CRISPR gRNA sequence
agtgaaatgtaaaccatcag

SEQ ID NO: 645628 - DNA, 20 bp, Artificial
  CRISPR gRNA sequence
aattaggcaaaaggaagcaa

SEQ ID NO: 645629 - DNA, 20 bp, Artificial
  CRISPR gRNA sequence
ggcaaaaggaagcaacaacg

SEQ ID NO: 645630 - DNA, 20 bp, Artificial
  CRISPR gRNA sequence
ctgagttgataggagaatgg

SEQ ID NO: 645631 - DNA, 20 bp, Artificial
  CRISPR gRNA sequence
agttgataggagaatggggt

SEQ ID NO: 645632 - DNA, 20 bp, Artificial
  CRISPR gRNA sequence
ataggagaatggggtcaatg

SEQ ID NO: 645633 - DNA, 20 bp, Artificial
  CRISPR gRNA sequence
gggaaaaaaacgattgaaat

SEQ ID NO: 645634 - DNA, 20 bp, Artificial
  CRISPR gRNA sequence
ggaaaaaaacgattgaaatt

SEQ ID NO: 645635 - DNA, 20 bp, Artificial
  CRISPR gRNA sequence
aaattactatggagcaaccc

SEQ ID NO: 645636 - DNA, 20 bp, Artificial
  CRISPR gRNA sequence
ctatggagcaacccacaagg

SEQ ID NO: 645637 - DNA, 20 bp, Artificial
  CRISPR gRNA sequence
tggagcaacccacaaggcat

SEQ ID NO: 645638 - DNA, 20 bp, Artificial
  CRISPR gRNA sequence
tccttttcagtgtttaatga

SEQ ID NO: 645639 - DNA, 20 bp, Artificial
  CRISPR gRNA sequence
ttcagtgtttaatgagattt

SEQ ID NO: 645640 - DNA, 20 bp, Artificial
  CRISPR gRNA sequence
tcagtgtttaatgagatttc

SEQ ID NO: 645641 - DNA, 20 bp, Artificial
  CRISPR gRNA sequence
cagtgtttaatgagatttcc

SEQ ID NO: 645642 - DNA, 20 bp, Artificial
  CRISPR gRNA sequence
agtgtttaatgagatttccc

SEQ ID NO: 645643 - DNA, 20 bp, Artificial
  CRISPR gRNA sequence
aatgagatttcccgaaatat

SEQ ID NO: 645644 - DNA, 20 bp, Artificial
  CRISPR gRNA sequence
atgagatttcccgaaatatt

SEQ ID NO: 645645 - DNA, 20 bp, Artificial
  CRISPR gRNA sequence
cccgaaatattcaaaatggg

SEQ ID NO: 645646 - DNA, 20 bp, Artificial
  CRISPR gRNA sequence
ccgaaatattcaaaatgggt

SEQ ID NO: 645647 - DNA, 20 bp, Artificial
  CRISPR gRNA sequence
aaaatgggtgcatgctttga

SEQ ID NO: 645648 - DNA, 20 bp, Artificial
  CRISPR gRNA sequence
tgatgtcaactaggataacc

SEQ ID NO: 645649 - DNA, 20 bp, Artificial
  CRISPR gRNA sequence
gatgtcaactaggataacct

SEQ ID NO: 645650 - DNA, 20 bp, Artificial
  CRISPR gRNA sequence
atgtcaactaggataacctg

SEQ ID NO: 645651 - DNA, 20 bp, Artificial
  CRISPR gRNA sequence
ggataacctgtgaaaaaatg

SEQ ID NO: 645652 - DNA, 20 bp, Artificial
  CRISPR gRNA sequence
tgaaaaaatgaaataaggac

SEQ ID NO: 645653 - DNA, 20 bp, Artificial
  CRISPR gRNA sequence
tataagatgtagaattatcc

SEQ ID NO: 645654 - DNA, 20 bp, Artificial
  CRISPR gRNA sequence
tccattggaaagtaggtgat

SEQ ID NO: 645655 - DNA, 20 bp, Artificial
  CRISPR gRNA sequence
gaaagtaggtgatttttatt

SEQ ID NO: 645656 - DNA, 20 bp, Artificial
  CRISPR gRNA sequence
ttattgaggaaaaaaagttt

SEQ ID NO: 645657 - DNA, 20 bp, Artificial
  CRISPR gRNA sequence
tattgaggaaaaaaagtttt

SEQ ID NO: 645658 - DNA, 20 bp, Artificial
  CRISPR gRNA sequence
attgaggaaaaaaagttttt

SEQ ID NO: 645659 - DNA, 20 bp, Artificial
  CRISPR gRNA sequence
ttgaggaaaaaaagtttttc

SEQ ID NO: 645660 - DNA, 20 bp, Artificial
  CRISPR gRNA sequence
aggaaaaaaagtttttctga

SEQ ID NO: 645661 - DNA, 20 bp, Artificial
  CRISPR gRNA sequence
ttctgacaaaattttacaaa

SEQ ID NO: 645662 - DNA, 20 bp, Artificial
  CRISPR gRNA sequence
tctgacaaaattttacaaat

SEQ ID NO: 645663 - DNA, 20 bp, Artificial
  CRISPR gRNA sequence
ctgacaaaattttacaaatt

SEQ ID NO: 645664 - DNA, 20 bp, Artificial
  CRISPR gRNA sequence
tgacaaaattttacaaattt

SEQ ID NO: 645665 - DNA, 20 bp, Artificial
  CRISPR gRNA sequence
acaaaattttacaaatttta

SEQ ID NO: 645666 - DNA, 20 bp, Artificial
  CRISPR gRNA sequence
tacaaattttaaaaaatttc

SEQ ID NO: 645667 - DNA, 20 bp, Artificial
  CRISPR gRNA sequence
acaaattttaaaaaatttct

SEQ ID NO: 645668 - DNA, 20 bp, Artificial
  CRISPR gRNA sequence
caaattttaaaaaatttctt

SEQ ID NO: 645669 - DNA, 20 bp, Artificial
  CRISPR gRNA sequence
taaaaaatttcttctacatg

SEQ ID NO: 645670 - DNA, 20 bp, Artificial
  CRISPR gRNA sequence
aaaaaatttcttctacatga

SEQ ID NO: 645671 - DNA, 20 bp, Artificial
  CRISPR gRNA sequence
aaaaatttcttctacatgac

SEQ ID NO: 645672 - DNA, 20 bp, Artificial
  CRISPR gRNA sequence
cttctacatgacgtaaatat

SEQ ID NO: 645673 - DNA, 20 bp, Artificial
  CRISPR gRNA sequence
ttctacatgacgtaaatatt

SEQ ID NO: 645674 - DNA, 20 bp, Artificial
  CRISPR gRNA sequence
ctacatgacgtaaatatttt

SEQ ID NO: 645675 - DNA, 20 bp, Artificial
  CRISPR gRNA sequence
tacatgacgtaaatatttta

SEQ ID NO: 645676 - DNA, 20 bp, Artificial
  CRISPR gRNA sequence
catgacgtaaatattttaca

SEQ ID NO: 645677 - DNA, 20 bp, Artificial
  CRISPR gRNA sequence
tacataatataaaatattat

SEQ ID NO: 645678 - DNA, 20 bp, Artificial
  CRISPR gRNA sequence
acataatataaaatattatg

SEQ ID NO: 645679 - DNA, 20 bp, Artificial
  CRISPR gRNA sequence
cataatataaaatattatgc

SEQ ID NO: 645680 - DNA, 20 bp, Artificial
  CRISPR gRNA sequence
tgcttacattagctttatgt

SEQ ID NO: 645681 - DNA, 20 bp, Artificial
  CRISPR gRNA sequence
acattagctttatgtactac

SEQ ID NO: 645682 - DNA, 20 bp, Artificial
  CRISPR gRNA sequence
cattagctttatgtactact

SEQ ID NO: 645683 - DNA, 20 bp, Artificial
  CRISPR gRNA sequence
gctttatgtactacttctgc

SEQ ID NO: 645684 - DNA, 20 bp, Artificial
  CRISPR gRNA sequence
tatgtactacttctgccatc

SEQ ID NO: 645685 - DNA, 20 bp, Artificial
  CRISPR gRNA sequence
atgtactacttctgccatcc

SEQ ID NO: 645686 - DNA, 20 bp, Artificial
  CRISPR gRNA sequence
tgtactacttctgccatccc

SEQ ID NO: 645687 - DNA, 20 bp, Artificial
  CRISPR gRNA sequence
cttctgccatccccaatgaa

SEQ ID NO: 645688 - DNA, 20 bp, Artificial
  CRISPR gRNA sequence
ctgccatccccaatgaactg

SEQ ID NO: 645689 - DNA, 20 bp, Artificial
  CRISPR gRNA sequence
tgccatccccaatgaactgt

SEQ ID NO: 645690 - DNA, 20 bp, Artificial
  CRISPR gRNA sequence
ccatccccaatgaactgtgg

SEQ ID NO: 645691 - DNA, 20 bp, Artificial
  CRISPR gRNA sequence
tggtcataataagcagattt

SEQ ID NO: 645692 - DNA, 20 bp, Artificial
  CRISPR gRNA sequence
gtgtgcatgaaaagacagag

SEQ ID NO: 645693 - DNA, 20 bp, Artificial
  CRISPR gRNA sequence
tgtgcatgaaaagacagagg

SEQ ID NO: 645694 - DNA, 20 bp, Artificial
  CRISPR gRNA sequence
ctaaaaaacccttctcactg

SEQ ID NO: 645695 - DNA, 20 bp, Artificial
  CRISPR gRNA sequence
taaaaaacccttctcactgt

SEQ ID NO: 645696 - DNA, 20 bp, Artificial
  CRISPR gRNA sequence
aaaaacccttctcactgtgc

SEQ ID NO: 645697 - DNA, 20 bp, Artificial
  CRISPR gRNA sequence
ctcactgtgccccacagttt

SEQ ID NO: 645698 - DNA, 20 bp, Artificial
  CRISPR gRNA sequence
tcactgtgccccacagtttg

SEQ ID NO: 645699 - DNA, 20 bp, Artificial
  CRISPR gRNA sequence
actgtgccccacagtttgag

SEQ ID NO: 645700 - DNA, 20 bp, Artificial
  CRISPR gRNA sequence
tgccccacagtttgagagat

SEQ ID NO: 645701 - DNA, 20 bp, Artificial
  CRISPR gRNA sequence
gagagatcagagctacaagc

SEQ ID NO: 645702 - DNA, 20 bp, Artificial
  CRISPR gRNA sequence
agagatcagagctacaagct

SEQ ID NO: 645703 - DNA, 20 bp, Artificial
  CRISPR gRNA sequence
caagctgagctactgaactg

SEQ ID NO: 645704 - DNA, 20 bp, Artificial
  CRISPR gRNA sequence
agctactgaactgatatgac

SEQ ID NO: 645705 - DNA, 20 bp, Artificial
  CRISPR gRNA sequence
ctgaactgatatgacctgag

SEQ ID NO: 645706 - DNA, 20 bp, Artificial
  CRISPR gRNA sequence
aactgatatgacctgagatc

SEQ ID NO: 645707 - DNA, 20 bp, Artificial
  CRISPR gRNA sequence
atatgacctgagatctgatc

SEQ ID NO: 645708 - DNA, 20 bp, Artificial
  CRISPR gRNA sequence
agatctgatcccactgcagt

SEQ ID NO: 645709 - DNA, 20 bp, Artificial
  CRISPR gRNA sequence
atcccactgcagtagccatc

SEQ ID NO: 645710 - DNA, 20 bp, Artificial
  CRISPR gRNA sequence
cagtagccatcgggctacag

SEQ ID NO: 645711 - DNA, 20 bp, Artificial
  CRISPR gRNA sequence
cagtggtagtgttactttac

SEQ ID NO: 645712 - DNA, 20 bp, Artificial
  CRISPR gRNA sequence
ctttaccaaaataaacccct

SEQ ID NO: 645713 - DNA, 20 bp, Artificial
  CRISPR gRNA sequence
taccaaaataaacccctcct

SEQ ID NO: 645714 - DNA, 20 bp, Artificial
  CRISPR gRNA sequence
accaaaataaacccctcctc

SEQ ID NO: 645715 - DNA, 20 bp, Artificial
  CRISPR gRNA sequence
ccaaaataaacccctcctca

SEQ ID NO: 645716 - DNA, 20 bp, Artificial
  CRISPR gRNA sequence
ctcaataggaaaacggtcca

SEQ ID NO: 645717 - DNA, 20 bp, Artificial
  CRISPR gRNA sequence
aataggaaaacggtccaaga

SEQ ID NO: 645718 - DNA, 20 bp, Artificial
  CRISPR gRNA sequence
ccaggtgccaacttctactc

SEQ ID NO: 645719 - DNA, 20 bp, Artificial
  CRISPR gRNA sequence
caggtgccaacttctactct

SEQ ID NO: 645720 - DNA, 20 bp, Artificial
  CRISPR gRNA sequence
ctactcttctggaataaaat

SEQ ID NO: 645721 - DNA, 20 bp, Artificial
  CRISPR gRNA sequence
tactcttctggaataaaatt

SEQ ID NO: 645722 - DNA, 20 bp, Artificial
  CRISPR gRNA sequence
ctcttctggaataaaattcc

SEQ ID NO: 645723 - DNA, 20 bp, Artificial
  CRISPR gRNA sequence
ttctggaataaaattccact

SEQ ID NO: 645724 - DNA, 20 bp, Artificial
  CRISPR gRNA sequence
ctggaataaaattccactaa

SEQ ID NO: 645725 - DNA, 20 bp, Artificial
  CRISPR gRNA sequence
tggaataaaattccactaac

SEQ ID NO: 645726 - DNA, 20 bp, Artificial
  CRISPR gRNA sequence
gaataaaattccactaacaa

SEQ ID NO: 645727 - DNA, 20 bp, Artificial
  CRISPR gRNA sequence
cactaacaaagttgatatag

SEQ ID NO: 645728 - DNA, 20 bp, Artificial
  CRISPR gRNA sequence
acaaagttgatatagcttta

SEQ ID NO: 645729 - DNA, 20 bp, Artificial
  CRISPR gRNA sequence
atatagctttaaagtgcttt

SEQ ID NO: 645730 - DNA, 20 bp, Artificial
  CRISPR gRNA sequence
taaagtgcttttctttaaaa

SEQ ID NO: 645731 - DNA, 20 bp, Artificial
  CRISPR gRNA sequence
aaagtgcttttctttaaaag

SEQ ID NO: 645732 - DNA, 20 bp, Artificial
  CRISPR gRNA sequence
aagtgcttttctttaaaaga

SEQ ID NO: 645733 - DNA, 20 bp, Artificial
  CRISPR gRNA sequence
ttctttaaaagaaggtacat

SEQ ID NO: 645734 - DNA, 20 bp, Artificial
  CRISPR gRNA sequence
tctttaaaagaaggtacata

SEQ ID NO: 645735 - DNA, 20 bp, Artificial
  CRISPR gRNA sequence
ctttaaaagaaggtacatat

SEQ ID NO: 645736 - DNA, 20 bp, Artificial
  CRISPR gRNA sequence
tttaaaagaaggtacatata

SEQ ID NO: 645737 - DNA, 20 bp, Artificial
  CRISPR gRNA sequence
taaaagaaggtacatatatt

SEQ ID NO: 645738 - DNA, 20 bp, Artificial
  CRISPR gRNA sequence
aaaagaaggtacatatattt

SEQ ID NO: 645739 - DNA, 20 bp, Artificial
  CRISPR gRNA sequence
aaagaaggtacatatattta

SEQ ID NO: 645740 - DNA, 20 bp, Artificial
  CRISPR gRNA sequence
aggttctactcatcctacaa

SEQ ID NO: 645741 - DNA, 20 bp, Artificial
  CRISPR gRNA sequence
ggttctactcatcctacaat

SEQ ID NO: 645742 - DNA, 20 bp, Artificial
  CRISPR gRNA sequence
tactcatcctacaattcaat

SEQ ID NO: 645743 - DNA, 20 bp, Artificial
  CRISPR gRNA sequence
ctcatcctacaattcaatct

SEQ ID NO: 645744 - DNA, 20 bp, Artificial
  CRISPR gRNA sequence
atcctacaattcaatctcga

SEQ ID NO: 645745 - DNA, 20 bp, Artificial
  CRISPR gRNA sequence
caattcaatctcgaagaata

SEQ ID NO: 645746 - DNA, 20 bp, Artificial
  CRISPR gRNA sequence
aatctcgaagaatacataaa

SEQ ID NO: 645747 - DNA, 20 bp, Artificial
  CRISPR gRNA sequence
gaagaatacataaacataaa

SEQ ID NO: 645748 - DNA, 20 bp, Artificial
  CRISPR gRNA sequence
ctttttttgctaatataaaa

SEQ ID NO: 645749 - DNA, 20 bp, Artificial
  CRISPR gRNA sequence
tttttgctaatataaaagta

SEQ ID NO: 645750 - DNA, 20 bp, Artificial
  CRISPR gRNA sequence
ttttgctaatataaaagtaa

SEQ ID NO: 645751 - DNA, 20 bp, Artificial
  CRISPR gRNA sequence
tttgctaatataaaagtaat

SEQ ID NO: 645752 - DNA, 20 bp, Artificial
  CRISPR gRNA sequence
ttgctaatataaaagtaata

SEQ ID NO: 645753 - DNA, 20 bp, Artificial
  CRISPR gRNA sequence
tgctaatataaaagtaatat

SEQ ID NO: 645754 - DNA, 20 bp, Artificial
  CRISPR gRNA sequence
gctaatataaaagtaatata

SEQ ID NO: 645755 - DNA, 20 bp, Artificial
  CRISPR gRNA sequence
ctaatataaaagtaatatat

SEQ ID NO: 645756 - DNA, 20 bp, Artificial
  CRISPR gRNA sequence
atataaaagtaatatatgct

SEQ ID NO: 645757 - DNA, 20 bp, Artificial
  CRISPR gRNA sequence
attgtaaaaaaaaatgtaaa

SEQ ID NO: 645758 - DNA, 20 bp, Artificial
  CRISPR gRNA sequence
ttgtaaaaaaaaatgtaaaa

SEQ ID NO: 645759 - DNA, 20 bp, Artificial
  CRISPR gRNA sequence
taaaaaaaaatgtaaaatct

SEQ ID NO: 645760 - DNA, 20 bp, Artificial
  CRISPR gRNA sequence
taaaagtataaatcaaacaa

SEQ ID NO: 645761 - DNA, 20 bp, Artificial
  CRISPR gRNA sequence
aaaaatgaccactattcaca

SEQ ID NO: 645762 - DNA, 20 bp, Artificial
  CRISPR gRNA sequence
ttcacatttggtgtatattc

SEQ ID NO: 645763 - DNA, 20 bp, Artificial
  CRISPR gRNA sequence
acatttggtgtatattcatc

SEQ ID NO: 645764 - DNA, 20 bp, Artificial
  CRISPR gRNA sequence
ggtgtatattcatctcatct

SEQ ID NO: 645765 - DNA, 20 bp, Artificial
  CRISPR gRNA sequence
gtgtatattcatctcatctt

SEQ ID NO: 645766 - DNA, 20 bp, Artificial
  CRISPR gRNA sequence
atctcatctttcctctatga

SEQ ID NO: 645767 - DNA, 20 bp, Artificial
  CRISPR gRNA sequence
atctttcctctatgaaatat

SEQ ID NO: 645768 - DNA, 20 bp, Artificial
  CRISPR gRNA sequence
tcctctatgaaatatacatc

SEQ ID NO: 645769 - DNA, 20 bp, Artificial
  CRISPR gRNA sequence
cctctatgaaatatacatct

SEQ ID NO: 645770 - DNA, 20 bp, Artificial
  CRISPR gRNA sequence
ctctatgaaatatacatcta

SEQ ID NO: 645771 - DNA, 20 bp, Artificial
  CRISPR gRNA sequence
tatgaaatatacatctattt

SEQ ID NO: 645772 - DNA, 20 bp, Artificial
  CRISPR gRNA sequence
tgaaatatacatctatttat

SEQ ID NO: 645773 - DNA, 20 bp, Artificial
  CRISPR gRNA sequence
tttatatatggcacgctttt

SEQ ID NO: 645774 - DNA, 20 bp, Artificial
  CRISPR gRNA sequence
atatatggcacgcttttctt

SEQ ID NO: 645775 - DNA, 20 bp, Artificial
  CRISPR gRNA sequence
tatatggcacgcttttcttt

SEQ ID NO: 645776 - DNA, 20 bp, Artificial
  CRISPR gRNA sequence
ttctttacatatttgagatc

SEQ ID NO: 645777 - DNA, 20 bp, Artificial
  CRISPR gRNA sequence
tctttacatatttgagatcc

SEQ ID NO: 645778 - DNA, 20 bp, Artificial
  CRISPR gRNA sequence
ctttacatatttgagatcct

SEQ ID NO: 645779 - DNA, 20 bp, Artificial
  CRISPR gRNA sequence
tttacatatttgagatccta

SEQ ID NO: 645780 - DNA, 20 bp, Artificial
  CRISPR gRNA sequence
tacatatttgagatcctact

SEQ ID NO: 645781 - DNA, 20 bp, Artificial
  CRISPR gRNA sequence
acatatttgagatcctacta

SEQ ID NO: 645782 - DNA, 20 bp, Artificial
  CRISPR gRNA sequence
catatttgagatcctactat

SEQ ID NO: 645783 - DNA, 20 bp, Artificial
  CRISPR gRNA sequence
gagatcctactatataaact

SEQ ID NO: 645784 - DNA, 20 bp, Artificial
  CRISPR gRNA sequence
agatcctactatataaactt

SEQ ID NO: 645785 - DNA, 20 bp, Artificial
  CRISPR gRNA sequence
ctatataaacttgtataatc

SEQ ID NO: 645786 - DNA, 20 bp, Artificial
  CRISPR gRNA sequence
tataaacttgtataatcttt

SEQ ID NO: 645787 - DNA, 20 bp, Artificial
  CRISPR gRNA sequence
gtataatctttttaatgtat

SEQ ID NO: 645788 - DNA, 20 bp, Artificial
  CRISPR gRNA sequence
tataatctttttaatgtatg

SEQ ID NO: 645789 - DNA, 20 bp, Artificial
  CRISPR gRNA sequence
tttaatgtatgtatttcaaa

SEQ ID NO: 645790 - DNA, 20 bp, Artificial
  CRISPR gRNA sequence
ttaatgtatgtatttcaaaa

SEQ ID NO: 645791 - DNA, 20 bp, Artificial
  CRISPR gRNA sequence
taatgtatgtatttcaaaaa

SEQ ID NO: 645792 - DNA, 20 bp, Artificial
  CRISPR gRNA sequence
aatgtatgtatttcaaaaaa

SEQ ID NO: 645793 - DNA, 20 bp, Artificial
  CRISPR gRNA sequence
atgtatgtatttcaaaaaat

SEQ ID NO: 645794 - DNA, 20 bp, Artificial
  CRISPR gRNA sequence
caaaaaatgtctatgccata

SEQ ID NO: 645795 - DNA, 20 bp, Artificial
  CRISPR gRNA sequence
aaaaaatgtctatgccataa

SEQ ID NO: 645796 - DNA, 20 bp, Artificial
  CRISPR gRNA sequence
tgccataatcattcttaaag

SEQ ID NO: 645797 - DNA, 20 bp, Artificial
  CRISPR gRNA sequence
ttaaagcacatggtttttaa

SEQ ID NO: 645798 - DNA, 20 bp, Artificial
  CRISPR gRNA sequence
aaagcacatggtttttaaca

SEQ ID NO: 645799 - DNA, 20 bp, Artificial
  CRISPR gRNA sequence
aagcacatggtttttaacag

SEQ ID NO: 645800 - DNA, 20 bp, Artificial
  CRISPR gRNA sequence
ttaacagctccattttattc

SEQ ID NO: 645801 - DNA, 20 bp, Artificial
  CRISPR gRNA sequence
taacagctccattttattct

SEQ ID NO: 645802 - DNA, 20 bp, Artificial
  CRISPR gRNA sequence
aacagctccattttattcta

SEQ ID NO: 645803 - DNA, 20 bp, Artificial
  CRISPR gRNA sequence
acagctccattttattctat

SEQ ID NO: 645804 - DNA, 20 bp, Artificial
  CRISPR gRNA sequence
cattttattctatccaatta

SEQ ID NO: 645805 - DNA, 20 bp, Artificial
  CRISPR gRNA sequence
tattctatccaattaatata

SEQ ID NO: 645806 - DNA, 20 bp, Artificial
  CRISPR gRNA sequence
attctatccaattaatatat

SEQ ID NO: 645807 - DNA, 20 bp, Artificial
  CRISPR gRNA sequence
ttctatccaattaatatatt

SEQ ID NO: 645808 - DNA, 20 bp, Artificial
  CRISPR gRNA sequence
tatccaattaatatattatt

SEQ ID NO: 645809 - DNA, 20 bp, Artificial
  CRISPR gRNA sequence
tccaattaatatattatttt

SEQ ID NO: 645810 - DNA, 20 bp, Artificial
  CRISPR gRNA sequence
atatattattttttaaataa

SEQ ID NO: 645811 - DNA, 20 bp, Artificial
  CRISPR gRNA sequence
ttttttaaataactgaccac

SEQ ID NO: 645812 - DNA, 20 bp, Artificial
  CRISPR gRNA sequence
tttaaataactgaccactat

SEQ ID NO: 645813 - DNA, 20 bp, Artificial
  CRISPR gRNA sequence
ttaaataactgaccactatt

SEQ ID NO: 645814 - DNA, 20 bp, Artificial
  CRISPR gRNA sequence
taaataactgaccactattt

SEQ ID NO: 645815 - DNA, 20 bp, Artificial
  CRISPR gRNA sequence
aaataactgaccactattta

SEQ ID NO: 645816 - DNA, 20 bp, Artificial
  CRISPR gRNA sequence
aataactgaccactatttaa

SEQ ID NO: 645817 - DNA, 20 bp, Artificial
  CRISPR gRNA sequence
accactatttaaaatatttc

SEQ ID NO: 645818 - DNA, 20 bp, Artificial
  CRISPR gRNA sequence
tttaaaatatttcaaattag

SEQ ID NO: 645819 - DNA, 20 bp, Artificial
  CRISPR gRNA sequence
aaaatatttcaaattagtaa

SEQ ID NO: 645820 - DNA, 20 bp, Artificial
  CRISPR gRNA sequence
aaatatttcaaattagtaat

SEQ ID NO: 645821 - DNA, 20 bp, Artificial
  CRISPR gRNA sequence
caaattagtaattaattctc

SEQ ID NO: 645822 - DNA, 20 bp, Artificial
  CRISPR gRNA sequence
aaattagtaattaattctcc

SEQ ID NO: 645823 - DNA, 20 bp, Artificial
  CRISPR gRNA sequence
gtaattaattctccgtatta

SEQ ID NO: 645824 - DNA, 20 bp, Artificial
  CRISPR gRNA sequence
attctccgtattaaataatc

SEQ ID NO: 645825 - DNA, 20 bp, Artificial
  CRISPR gRNA sequence
tccgtattaaataatcactt

SEQ ID NO: 645826 - DNA, 20 bp, Artificial
  CRISPR gRNA sequence
cgtattaaataatcactttg

SEQ ID NO: 645827 - DNA, 20 bp, Artificial
  CRISPR gRNA sequence
aataatcactttgaggagac

SEQ ID NO: 645828 - DNA, 20 bp, Artificial
  CRISPR gRNA sequence
tgaggagacttattttagaa

SEQ ID NO: 645829 - DNA, 20 bp, Artificial
  CRISPR gRNA sequence
gaggagacttattttagaag

SEQ ID NO: 645830 - DNA, 20 bp, Artificial
  CRISPR gRNA sequence
aggagacttattttagaagt

SEQ ID NO: 645831 - DNA, 20 bp, Artificial
  CRISPR gRNA sequence
attttagaagtgattttaac

SEQ ID NO: 645832 - DNA, 20 bp, Artificial
  CRISPR gRNA sequence
ttttagaagtgattttaaca

SEQ ID NO: 645833 - DNA, 20 bp, Artificial
  CRISPR gRNA sequence
tagaagtgattttaacactt

SEQ ID NO: 645834 - DNA, 20 bp, Artificial
  CRISPR gRNA sequence
agaagtgattttaacacttg

SEQ ID NO: 645835 - DNA, 20 bp, Artificial
  CRISPR gRNA sequence
gaagtgattttaacacttga

SEQ ID NO: 645836 - DNA, 20 bp, Artificial
  CRISPR gRNA sequence
taacacttgaccctaccaaa

SEQ ID NO: 645837 - DNA, 20 bp, Artificial
  CRISPR gRNA sequence
aacacttgaccctaccaaat

SEQ ID NO: 645838 - DNA, 20 bp, Artificial
  CRISPR gRNA sequence
acacttgaccctaccaaatt

SEQ ID NO: 645839 - DNA, 20 bp, Artificial
  CRISPR gRNA sequence
gaccctaccaaattctcagc

SEQ ID NO: 645840 - DNA, 20 bp, Artificial
  CRISPR gRNA sequence
accctaccaaattctcagca

SEQ ID NO: 645841 - DNA, 20 bp, Artificial
  CRISPR gRNA sequence
ccaaattctcagcaagtaaa

SEQ ID NO: 645842 - DNA, 20 bp, Artificial
  CRISPR gRNA sequence
tcagcaagtaaaacatgcaa

SEQ ID NO: 645843 - DNA, 20 bp, Artificial
  CRISPR gRNA sequence
agcaagtaaaacatgcaagc

SEQ ID NO: 645844 - DNA, 20 bp, Artificial
  CRISPR gRNA sequence
tagcagtgaaaattttataa

SEQ ID NO: 645845 - DNA, 20 bp, Artificial
  CRISPR gRNA sequence
tataatccacctccccttta

SEQ ID NO: 645846 - DNA, 20 bp, Artificial
  CRISPR gRNA sequence
ataatccacctcccctttat

SEQ ID NO: 645847 - DNA, 20 bp, Artificial
  CRISPR gRNA sequence
taatccacctcccctttatt

SEQ ID NO: 645848 - DNA, 20 bp, Artificial
  CRISPR gRNA sequence
ccctttattttactcaaata

SEQ ID NO: 645849 - DNA, 20 bp, Artificial
  CRISPR gRNA sequence
tattttactcaaataaatca

SEQ ID NO: 645850 - DNA, 20 bp, Artificial
  CRISPR gRNA sequence
attttactcaaataaatcaa

SEQ ID NO: 645851 - DNA, 20 bp, Artificial
  CRISPR gRNA sequence
ttttactcaaataaatcaaa

SEQ ID NO: 645852 - DNA, 20 bp, Artificial
  CRISPR gRNA sequence
tactcaaataaatcaaatct

SEQ ID NO: 645853 - DNA, 20 bp, Artificial
  CRISPR gRNA sequence
actcaaataaatcaaatctt

SEQ ID NO: 645854 - DNA, 20 bp, Artificial
  CRISPR gRNA sequence
ctcaaataaatcaaatctta

SEQ ID NO: 645855 - DNA, 20 bp, Artificial
  CRISPR gRNA sequence
aaataaatcaaatcttacag

SEQ ID NO: 645856 - DNA, 20 bp, Artificial
  CRISPR gRNA sequence
acaggtagtggcaaactgtg

SEQ ID NO: 645857 - DNA, 20 bp, Artificial
  CRISPR gRNA sequence
caggtagtggcaaactgtgc

SEQ ID NO: 645858 - DNA, 20 bp, Artificial
  CRISPR gRNA sequence
tgcatattgtcttgttaata

SEQ ID NO: 645859 - DNA, 20 bp, Artificial
  CRISPR gRNA sequence
tcttgttaatattcatcttg

SEQ ID NO: 645860 - DNA, 20 bp, Artificial
  CRISPR gRNA sequence
gttaatattcatcttgcaat

SEQ ID NO: 645861 - DNA, 20 bp, Artificial
  CRISPR gRNA sequence
ttaatattcatcttgcaatt

SEQ ID NO: 645862 - DNA, 20 bp, Artificial
  CRISPR gRNA sequence
atattcatcttgcaatttta

SEQ ID NO: 645863 - DNA, 20 bp, Artificial
  CRISPR gRNA sequence
atcttgcaattttagggcta

SEQ ID NO: 645864 - DNA, 20 bp, Artificial
  CRISPR gRNA sequence
gcaattttagggctacatat

SEQ ID NO: 645865 - DNA, 20 bp, Artificial
  CRISPR gRNA sequence
caattttagggctacatatc

SEQ ID NO: 645866 - DNA, 20 bp, Artificial
  CRISPR gRNA sequence
tagggctacatatcataagt

SEQ ID NO: 645867 - DNA, 20 bp, Artificial
  CRISPR gRNA sequence
agggctacatatcataagta

SEQ ID NO: 645868 - DNA, 20 bp, Artificial
  CRISPR gRNA sequence
gggctacatatcataagtaa

SEQ ID NO: 645869 - DNA, 20 bp, Artificial
  CRISPR gRNA sequence
catatcataagtaacacaac

SEQ ID NO: 645870 - DNA, 20 bp, Artificial
  CRISPR gRNA sequence
gcattgaagatactatacta

SEQ ID NO: 645871 - DNA, 20 bp, Artificial
  CRISPR gRNA sequence
cattgaagatactatactag

SEQ ID NO: 645872 - DNA, 20 bp, Artificial
  CRISPR gRNA sequence
aagatactatactaggtatt

SEQ ID NO: 645873 - DNA, 20 bp, Artificial
  CRISPR gRNA sequence
tactaggtattataaagaca

SEQ ID NO: 645874 - DNA, 20 bp, Artificial
  CRISPR gRNA sequence
ggtattataaagacattcac

SEQ ID NO: 645875 - DNA, 20 bp, Artificial
  CRISPR gRNA sequence
taaagacattcactccaacc

SEQ ID NO: 645876 - DNA, 20 bp, Artificial
  CRISPR gRNA sequence
actccaaccttgaccacaac

SEQ ID NO: 645877 - DNA, 20 bp, Artificial
  CRISPR gRNA sequence
caaccttgaccacaaccctg

SEQ ID NO: 645878 - DNA, 20 bp, Artificial
  CRISPR gRNA sequence
gaccacaaccctgtaaggca

SEQ ID NO: 645879 - DNA, 20 bp, Artificial
  CRISPR gRNA sequence
accacaaccctgtaaggcat

SEQ ID NO: 645880 - DNA, 20 bp, Artificial
  CRISPR gRNA sequence
taaggcatgtattagtatca

SEQ ID NO: 645881 - DNA, 20 bp, Artificial
  CRISPR gRNA sequence
gtatcacttttttttaacag

SEQ ID NO: 645882 - DNA, 20 bp, Artificial
  CRISPR gRNA sequence
ttttttaacagattaagaaa

SEQ ID NO: 645883 - DNA, 20 bp, Artificial
  CRISPR gRNA sequence
tttttaacagattaagaaat

SEQ ID NO: 645884 - DNA, 20 bp, Artificial
  CRISPR gRNA sequence
ttttaacagattaagaaatt

SEQ ID NO: 645885 - DNA, 20 bp, Artificial
  CRISPR gRNA sequence
tttaacagattaagaaatta

SEQ ID NO: 645886 - DNA, 20 bp, Artificial
  CRISPR gRNA sequence
ttaacagattaagaaattaa

SEQ ID NO: 645887 - DNA, 20 bp, Artificial
  CRISPR gRNA sequence
taacagattaagaaattaac

SEQ ID NO: 645888 - DNA, 20 bp, Artificial
  CRISPR gRNA sequence
aacagattaagaaattaact

SEQ ID NO: 645889 - DNA, 20 bp, Artificial
  CRISPR gRNA sequence
acagattaagaaattaactt

SEQ ID NO: 645890 - DNA, 20 bp, Artificial
  CRISPR gRNA sequence
agaaattaactttctgaaag

SEQ ID NO: 645891 - DNA, 20 bp, Artificial
  CRISPR gRNA sequence
actttctgaaaggttaagta

SEQ ID NO: 645892 - DNA, 20 bp, Artificial
  CRISPR gRNA sequence
tctgaaaggttaagtaattc

SEQ ID NO: 645893 - DNA, 20 bp, Artificial
  CRISPR gRNA sequence
ctgaaaggttaagtaattca

SEQ ID NO: 645894 - DNA, 20 bp, Artificial
  CRISPR gRNA sequence
tgaaaggttaagtaattcac

SEQ ID NO: 645895 - DNA, 20 bp, Artificial
  CRISPR gRNA sequence
aaaggttaagtaattcacac

SEQ ID NO: 645896 - DNA, 20 bp, Artificial
  CRISPR gRNA sequence
agtaattcacacagctatta

SEQ ID NO: 645897 - DNA, 20 bp, Artificial
  CRISPR gRNA sequence
acacagctattaaatgaatc

SEQ ID NO: 645898 - DNA, 20 bp, Artificial
  CRISPR gRNA sequence
ttaaatgaatcctaccaaaa

SEQ ID NO: 645899 - DNA, 20 bp, Artificial
  CRISPR gRNA sequence
aatgaatcctaccaaaactt

SEQ ID NO: 645900 - DNA, 20 bp, Artificial
  CRISPR gRNA sequence
ccaaaacttaagacacagct

SEQ ID NO: 645901 - DNA, 20 bp, Artificial
  CRISPR gRNA sequence
aagacacagctcttgaatcc

SEQ ID NO: 645902 - DNA, 20 bp, Artificial
  CRISPR gRNA sequence
agacacagctcttgaatccc

SEQ ID NO: 645903 - DNA, 20 bp, Artificial
  CRISPR gRNA sequence
ttgaatcccatttccaaaca

SEQ ID NO: 645904 - DNA, 20 bp, Artificial
  CRISPR gRNA sequence
gaatcccatttccaaacaga

SEQ ID NO: 645905 - DNA, 20 bp, Artificial
  CRISPR gRNA sequence
aatcccatttccaaacagat

SEQ ID NO: 645906 - DNA, 20 bp, Artificial
  CRISPR gRNA sequence
ccaaacagatatttagtgtt

SEQ ID NO: 645907 - DNA, 20 bp, Artificial
  CRISPR gRNA sequence
caaacagatatttagtgttc

SEQ ID NO: 645908 - DNA, 20 bp, Artificial
  CRISPR gRNA sequence
agtgttctcatttatattta

SEQ ID NO: 645909 - DNA, 20 bp, Artificial
  CRISPR gRNA sequence
gtgttctcatttatatttat

SEQ ID NO: 645910 - DNA, 20 bp, Artificial
  CRISPR gRNA sequence
tcatttatatttatgtgcta

SEQ ID NO: 645911 - DNA, 20 bp, Artificial
  CRISPR gRNA sequence
atttatatttatgtgctata

SEQ ID NO: 645912 - DNA, 20 bp, Artificial
  CRISPR gRNA sequence
atatttatgtgctatatatt

SEQ ID NO: 645913 - DNA, 20 bp, Artificial
  CRISPR gRNA sequence
tatttatgtgctatatattt

SEQ ID NO: 645914 - DNA, 20 bp, Artificial
  CRISPR gRNA sequence
atgtgctatatatttatatt

SEQ ID NO: 645915 - DNA, 20 bp, Artificial
  CRISPR gRNA sequence
tgtgctatatatttatatta

SEQ ID NO: 645916 - DNA, 20 bp, Artificial
  CRISPR gRNA sequence
tatatttatattaactgtac

SEQ ID NO: 645917 - DNA, 20 bp, Artificial
  CRISPR gRNA sequence
atattaactgtactatgacc

SEQ ID NO: 645918 - DNA, 20 bp, Artificial
  CRISPR gRNA sequence
tattaactgtactatgacca

SEQ ID NO: 645919 - DNA, 20 bp, Artificial
  CRISPR gRNA sequence
actgtactatgaccactaat

SEQ ID NO: 645920 - DNA, 20 bp, Artificial
  CRISPR gRNA sequence
tactatgaccactaatgaaa

SEQ ID NO: 645921 - DNA, 20 bp, Artificial
  CRISPR gRNA sequence
tgaccactaatgaaaataaa

SEQ ID NO: 645922 - DNA, 20 bp, Artificial
  CRISPR gRNA sequence
atgaaaataaattcctaaca

SEQ ID NO: 645923 - DNA, 20 bp, Artificial
  CRISPR gRNA sequence
ctaacactaccattattatc

SEQ ID NO: 645924 - DNA, 20 bp, Artificial
  CRISPR gRNA sequence
acactaccattattatcatg

SEQ ID NO: 645925 - DNA, 20 bp, Artificial
  CRISPR gRNA sequence
ccattattatcatgatgtta

SEQ ID NO: 645926 - DNA, 20 bp, Artificial
  CRISPR gRNA sequence
ttatcatgatgttacagtac

SEQ ID NO: 645927 - DNA, 20 bp, Artificial
  CRISPR gRNA sequence
tcatgatgttacagtacagc

SEQ ID NO: 645928 - DNA, 20 bp, Artificial
  CRISPR gRNA sequence
cagtacagcaatttggcaat

SEQ ID NO: 645929 - DNA, 20 bp, Artificial
  CRISPR gRNA sequence
ggcaatactatatttcaaga

SEQ ID NO: 645930 - DNA, 20 bp, Artificial
  CRISPR gRNA sequence
gcaatactatatttcaagaa

SEQ ID NO: 645931 - DNA, 20 bp, Artificial
  CRISPR gRNA sequence
tatttcaagaagaaaaacat

SEQ ID NO: 645932 - DNA, 20 bp, Artificial
  CRISPR gRNA sequence
caagaagaaaaacataagca

SEQ ID NO: 645933 - DNA, 20 bp, Artificial
  CRISPR gRNA sequence
aagaagaaaaacataagcaa

SEQ ID NO: 645934 - DNA, 20 bp, Artificial
  CRISPR gRNA sequence
tagaaattttaaataatatt

SEQ ID NO: 645935 - DNA, 20 bp, Artificial
  CRISPR gRNA sequence
taaataatattatcatttct

SEQ ID NO: 645936 - DNA, 20 bp, Artificial
  CRISPR gRNA sequence
aaataatattatcatttcta

SEQ ID NO: 645937 - DNA, 20 bp, Artificial
  CRISPR gRNA sequence
aataatattatcatttctaa

SEQ ID NO: 645938 - DNA, 20 bp, Artificial
  CRISPR gRNA sequence
tcatttctaaagttgcatat

SEQ ID NO: 645939 - DNA, 20 bp, Artificial
  CRISPR gRNA sequence
ctaaagttgcatattgtata

SEQ ID NO: 645940 - DNA, 20 bp, Artificial
  CRISPR gRNA sequence
taaagttgcatattgtataa

SEQ ID NO: 645941 - DNA, 20 bp, Artificial
  CRISPR gRNA sequence
aagttgcatattgtataaaa

SEQ ID NO: 645942 - DNA, 20 bp, Artificial
  CRISPR gRNA sequence
catattgtataaaaatggta

SEQ ID NO: 645943 - DNA, 20 bp, Artificial
  CRISPR gRNA sequence
tataaaaatggtaaattcta

SEQ ID NO: 645944 - DNA, 20 bp, Artificial
  CRISPR gRNA sequence
taaaatgaacactggtcttg

SEQ ID NO: 645945 - DNA, 20 bp, Artificial
  CRISPR gRNA sequence
aaatgaacactggtcttgat

SEQ ID NO: 645946 - DNA, 20 bp, Artificial
  CRISPR gRNA sequence
gtcttgatttttgtacaact

SEQ ID NO: 645947 - DNA, 20 bp, Artificial
  CRISPR gRNA sequence
gatttttgtacaactggtgt

SEQ ID NO: 645948 - DNA, 20 bp, Artificial
  CRISPR gRNA sequence
atttttgtacaactggtgtt

SEQ ID NO: 645949 - DNA, 20 bp, Artificial
  CRISPR gRNA sequence
ttgtacaactggtgttttaa

SEQ ID NO: 645950 - DNA, 20 bp, Artificial
  CRISPR gRNA sequence
tgtacaactggtgttttaaa

SEQ ID NO: 645951 - DNA, 20 bp, Artificial
  CRISPR gRNA sequence
gtacaactggtgttttaaaa

SEQ ID NO: 645952 - DNA, 20 bp, Artificial
  CRISPR gRNA sequence
tacaactggtgttttaaaac

SEQ ID NO: 645953 - DNA, 20 bp, Artificial
  CRISPR gRNA sequence
gtgttttaaaactaccactt

SEQ ID NO: 645954 - DNA, 20 bp, Artificial
  CRISPR gRNA sequence
taaaactaccacttaattac

SEQ ID NO: 645955 - DNA, 20 bp, Artificial
  CRISPR gRNA sequence
aaaactaccacttaattaca

SEQ ID NO: 645956 - DNA, 20 bp, Artificial
  CRISPR gRNA sequence
aaactaccacttaattacac

SEQ ID NO: 645957 - DNA, 20 bp, Artificial
  CRISPR gRNA sequence
ccacttaattacactgttca

SEQ ID NO: 645958 - DNA, 20 bp, Artificial
  CRISPR gRNA sequence
aattacactgttcaatatta

SEQ ID NO: 645959 - DNA, 20 bp, Artificial
  CRISPR gRNA sequence
attacactgttcaatattaa

SEQ ID NO: 645960 - DNA, 20 bp, Artificial
  CRISPR gRNA sequence
cactgttcaatattaattgc

SEQ ID NO: 645961 - DNA, 20 bp, Artificial
  CRISPR gRNA sequence
ttcaatattaattgcttgat

SEQ ID NO: 645962 - DNA, 20 bp, Artificial
  CRISPR gRNA sequence
aatattaattgcttgatgga

SEQ ID NO: 645963 - DNA, 20 bp, Artificial
  CRISPR gRNA sequence
attgcttgatggagttaatg

SEQ ID NO: 645964 - DNA, 20 bp, Artificial
  CRISPR gRNA sequence
cttgatggagttaatgtgta

SEQ ID NO: 645965 - DNA, 20 bp, Artificial
  CRISPR gRNA sequence
gatggagttaatgtgtagga

SEQ ID NO: 645966 - DNA, 20 bp, Artificial
  CRISPR gRNA sequence
atggagttaatgtgtaggaa

SEQ ID NO: 645967 - DNA, 20 bp, Artificial
  CRISPR gRNA sequence
atgtgtaggaaacaaagata

SEQ ID NO: 645968 - DNA, 20 bp, Artificial
  CRISPR gRNA sequence
aaattattaaatatacacaa

SEQ ID NO: 645969 - DNA, 20 bp, Artificial
  CRISPR gRNA sequence
ttaaatatacacaataaata

SEQ ID NO: 645970 - DNA, 20 bp, Artificial
  CRISPR gRNA sequence
aatatacacaataaataaaa

SEQ ID NO: 645971 - DNA, 20 bp, Artificial
  CRISPR gRNA sequence
agtgtaaggaatctacatct

SEQ ID NO: 645972 - DNA, 20 bp, Artificial
  CRISPR gRNA sequence
catctaaattgggtgttggg

SEQ ID NO: 645973 - DNA, 20 bp, Artificial
  CRISPR gRNA sequence
aattgggtgttggggaagca

SEQ ID NO: 645974 - DNA, 20 bp, Artificial
  CRISPR gRNA sequence
ggtgttggggaagcaaatta

SEQ ID NO: 645975 - DNA, 20 bp, Artificial
  CRISPR gRNA sequence
gggaagcaaattaatggatt

SEQ ID NO: 645976 - DNA, 20 bp, Artificial
  CRISPR gRNA sequence
atggattacaccagtttctt

SEQ ID NO: 645977 - DNA, 20 bp, Artificial
  CRISPR gRNA sequence
caccagtttcttacagttcc

SEQ ID NO: 645978 - DNA, 20 bp, Artificial
  CRISPR gRNA sequence
cttacagttccactggcaaa

SEQ ID NO: 645979 - DNA, 20 bp, Artificial
  CRISPR gRNA sequence
ttacagttccactggcaaac

SEQ ID NO: 645980 - DNA, 20 bp, Artificial
  CRISPR gRNA sequence
acagttccactggcaaacag

SEQ ID NO: 645981 - DNA, 20 bp, Artificial
  CRISPR gRNA sequence
cagttccactggcaaacagt

SEQ ID NO: 645982 - DNA, 20 bp, Artificial
  CRISPR gRNA sequence
cactggcaaacagttgaagg

SEQ ID NO: 645983 - DNA, 20 bp, Artificial
  CRISPR gRNA sequence
gcaaacagttgaagggctga

SEQ ID NO: 645984 - DNA, 20 bp, Artificial
  CRISPR gRNA sequence
aagggctgacactttcagtc

SEQ ID NO: 645985 - DNA, 20 bp, Artificial
  CRISPR gRNA sequence
acactttcagtctcacccta

SEQ ID NO: 645986 - DNA, 20 bp, Artificial
  CRISPR gRNA sequence
tcagtctcaccctatagaaa

SEQ ID NO: 645987 - DNA, 20 bp, Artificial
  CRISPR gRNA sequence
cagtctcaccctatagaaat

SEQ ID NO: 645988 - DNA, 20 bp, Artificial
  CRISPR gRNA sequence
agtctcaccctatagaaata

SEQ ID NO: 645989 - DNA, 20 bp, Artificial
  CRISPR gRNA sequence
accctatagaaatattttct

SEQ ID NO: 645990 - DNA, 20 bp, Artificial
  CRISPR gRNA sequence
tagaaatattttctcaaaaa

SEQ ID NO: 645991 - DNA, 20 bp, Artificial
  CRISPR gRNA sequence
tctcaaaaaaactaatattt

SEQ ID NO: 645992 - DNA, 20 bp, Artificial
  CRISPR gRNA sequence
ctcaaaaaaactaatattta

SEQ ID NO: 645993 - DNA, 20 bp, Artificial
  CRISPR gRNA sequence
tcaaaaaaactaatatttac

SEQ ID NO: 645994 - DNA, 20 bp, Artificial
  CRISPR gRNA sequence
aaaaaaactaatatttactg

SEQ ID NO: 645995 - DNA, 20 bp, Artificial
  CRISPR gRNA sequence
atatttactgtggtttagtt

SEQ ID NO: 645996 - DNA, 20 bp, Artificial
  CRISPR gRNA sequence
actgtggtttagttgttatt

SEQ ID NO: 645997 - DNA, 20 bp, Artificial
  CRISPR gRNA sequence
ctgtggtttagttgttatta

SEQ ID NO: 645998 - DNA, 20 bp, Artificial
  CRISPR gRNA sequence
tggtttagttgttattatta

SEQ ID NO: 645999 - DNA, 20 bp, Artificial
  CRISPR gRNA sequence
agttgttattattagtgttt

SEQ ID NO: 646000 - DNA, 20 bp, Artificial
  CRISPR gRNA sequence
gttgttattattagtgtttt

SEQ ID NO: 646001 - DNA, 20 bp, Artificial
  CRISPR gRNA sequence
ttattattagtgtttttttc

SEQ ID NO: 646002 - DNA, 20 bp, Artificial
  CRISPR gRNA sequence
ttattagtgtttttttcctt

SEQ ID NO: 646003 - DNA, 20 bp, Artificial
  CRISPR gRNA sequence
ttagtgtttttttccttttg

SEQ ID NO: 646004 - DNA, 20 bp, Artificial
  CRISPR gRNA sequence
gtgtttttttccttttgttt

SEQ ID NO: 646005 - DNA, 20 bp, Artificial
  CRISPR gRNA sequence
ttttccttttgttttgatgt

SEQ ID NO: 646006 - DNA, 20 bp, Artificial
  CRISPR gRNA sequence
tttccttttgttttgatgtt

SEQ ID NO: 646007 - DNA, 20 bp, Artificial
  CRISPR gRNA sequence
ttccttttgttttgatgttg

SEQ ID NO: 646008 - DNA, 20 bp, Artificial
  CRISPR gRNA sequence
tccttttgttttgatgttgt

SEQ ID NO: 646009 - DNA, 20 bp, Artificial
  CRISPR gRNA sequence
ccttttgttttgatgttgtc

SEQ ID NO: 646010 - DNA, 20 bp, Artificial
  CRISPR gRNA sequence
cttttgttttgatgttgtca

SEQ ID NO: 646011 - DNA, 20 bp, Artificial
  CRISPR gRNA sequence
ttgttttgatgttgtcaaat

SEQ ID NO: 646012 - DNA, 20 bp, Artificial
  CRISPR gRNA sequence
tgttttgatgttgtcaaata

SEQ ID NO: 646013 - DNA, 20 bp, Artificial
  CRISPR gRNA sequence
gttttgatgttgtcaaatag

SEQ ID NO: 646014 - DNA, 20 bp, Artificial
  CRISPR gRNA sequence
ttttgatgttgtcaaatagg

SEQ ID NO: 646015 - DNA, 20 bp, Artificial
  CRISPR gRNA sequence
tgatgttgtcaaataggtag

SEQ ID NO: 646016 - DNA, 20 bp, Artificial
  CRISPR gRNA sequence
gatgttgtcaaataggtaga

SEQ ID NO: 646017 - DNA, 20 bp, Artificial
  CRISPR gRNA sequence
atgttgtcaaataggtagat

SEQ ID NO: 646018 - DNA, 20 bp, Artificial
  CRISPR gRNA sequence
tcaaataggtagatatttga

SEQ ID NO: 646019 - DNA, 20 bp, Artificial
  CRISPR gRNA sequence
gaatggttcaaaaatcaaaa

SEQ ID NO: 646020 - DNA, 20 bp, Artificial
  CRISPR gRNA sequence
aatggttcaaaaatcaaaaa

SEQ ID NO: 646021 - DNA, 20 bp, Artificial
  CRISPR gRNA sequence
aaaaatcaaaaagtataaaa

SEQ ID NO: 646022 - DNA, 20 bp, Artificial
  CRISPR gRNA sequence
gtgaagagtcttgttccatc

SEQ ID NO: 646023 - DNA, 20 bp, Artificial
  CRISPR gRNA sequence
gttccatcccagcccctcat

SEQ ID NO: 646024 - DNA, 20 bp, Artificial
  CRISPR gRNA sequence
ttccatcccagcccctcatc

SEQ ID NO: 646025 - DNA, 20 bp, Artificial
  CRISPR gRNA sequence
catcccagcccctcatctgc

SEQ ID NO: 646026 - DNA, 20 bp, Artificial
  CRISPR gRNA sequence
atctgctcagctgtcatccc

SEQ ID NO: 646027 - DNA, 20 bp, Artificial
  CRISPR gRNA sequence
ctcagctgtcatccctctat

SEQ ID NO: 646028 - DNA, 20 bp, Artificial
  CRISPR gRNA sequence
agctgtcatccctctatcta

SEQ ID NO: 646029 - DNA, 20 bp, Artificial
  CRISPR gRNA sequence
tcatccctctatctatacac

SEQ ID NO: 646030 - DNA, 20 bp, Artificial
  CRISPR gRNA sequence
tatctatacactcccaaaca

SEQ ID NO: 646031 - DNA, 20 bp, Artificial
  CRISPR gRNA sequence
tctatacactcccaaacaat

SEQ ID NO: 646032 - DNA, 20 bp, Artificial
  CRISPR gRNA sequence
tacactcccaaacaattaat

SEQ ID NO: 646033 - DNA, 20 bp, Artificial
  CRISPR gRNA sequence
ccaaacaattaattatttca

SEQ ID NO: 646034 - DNA, 20 bp, Artificial
  CRISPR gRNA sequence
attatttcattaccttcttg

SEQ ID NO: 646035 - DNA, 20 bp, Artificial
  CRISPR gRNA sequence
tttcattaccttcttgttta

SEQ ID NO: 646036 - DNA, 20 bp, Artificial
  CRISPR gRNA sequence
cattaccttcttgtttatcc

SEQ ID NO: 646037 - DNA, 20 bp, Artificial
  CRISPR gRNA sequence
attaccttcttgtttatcct

SEQ ID NO: 646038 - DNA, 20 bp, Artificial
  CRISPR gRNA sequence
ccttcttgtttatcctatga

SEQ ID NO: 646039 - DNA, 20 bp, Artificial
  CRISPR gRNA sequence
cttgtttatcctatgagttt

SEQ ID NO: 646040 - DNA, 20 bp, Artificial
  CRISPR gRNA sequence
ttgtttatcctatgagtttt

SEQ ID NO: 646041 - DNA, 20 bp, Artificial
  CRISPR gRNA sequence
gtttatcctatgagttttta

SEQ ID NO: 646042 - DNA, 20 bp, Artificial
  CRISPR gRNA sequence
tttatcctatgagtttttaa

SEQ ID NO: 646043 - DNA, 20 bp, Artificial
  CRISPR gRNA sequence
atcctatgagtttttaaata

SEQ ID NO: 646044 - DNA, 20 bp, Artificial
  CRISPR gRNA sequence
tcctatgagtttttaaatat

SEQ ID NO: 646045 - DNA, 20 bp, Artificial
  CRISPR gRNA sequence
tgagtttttaaatataatta

SEQ ID NO: 646046 - DNA, 20 bp, Artificial
  CRISPR gRNA sequence
ttaaatataattattagtaa

SEQ ID NO: 646047 - DNA, 20 bp, Artificial
  CRISPR gRNA sequence
taaatataattattagtaaa

SEQ ID NO: 646048 - DNA, 20 bp, Artificial
  CRISPR gRNA sequence
aaatataattattagtaaac

SEQ ID NO: 646049 - DNA, 20 bp, Artificial
  CRISPR gRNA sequence
aatataattattagtaaaca

SEQ ID NO: 646050 - DNA, 20 bp, Artificial
  CRISPR gRNA sequence
ttagtaaacatttctggggt

SEQ ID NO: 646051 - DNA, 20 bp, Artificial
  CRISPR gRNA sequence
gtaaacatttctggggtttt

SEQ ID NO: 646052 - DNA, 20 bp, Artificial
  CRISPR gRNA sequence
ctggggttttttttacccaa

SEQ ID NO: 646053 - DNA, 20 bp, Artificial
  CRISPR gRNA sequence
tggggttttttttacccaac

SEQ ID NO: 646054 - DNA, 20 bp, Artificial
  CRISPR gRNA sequence
gggttttttttacccaactt

SEQ ID NO: 646055 - DNA, 20 bp, Artificial
  CRISPR gRNA sequence
tttttacccaacttattttc

SEQ ID NO: 646056 - DNA, 20 bp, Artificial
  CRISPR gRNA sequence
ttttacccaacttattttct

SEQ ID NO: 646057 - DNA, 20 bp, Artificial
  CRISPR gRNA sequence
tttacccaacttattttctt

SEQ ID NO: 646058 - DNA, 20 bp, Artificial
  CRISPR gRNA sequence
ttacccaacttattttcttc

SEQ ID NO: 646059 - DNA, 20 bp, Artificial
  CRISPR gRNA sequence
tacccaacttattttcttct

SEQ ID NO: 646060 - DNA, 20 bp, Artificial
  CRISPR gRNA sequence
acccaacttattttcttctg

SEQ ID NO: 646061 - DNA, 20 bp, Artificial
  CRISPR gRNA sequence
cccaacttattttcttctgc

SEQ ID NO: 646062 - DNA, 20 bp, Artificial
  CRISPR gRNA sequence
attttcttctgccccttcct

SEQ ID NO: 646063 - DNA, 20 bp, Artificial
  CRISPR gRNA sequence
ttttcttctgccccttcctt

SEQ ID NO: 646064 - DNA, 20 bp, Artificial
  CRISPR gRNA sequence
tcttctgccccttccttttt

SEQ ID NO: 646065 - DNA, 20 bp, Artificial
  CRISPR gRNA sequence
cttctgccccttcctttttt

SEQ ID NO: 646066 - DNA, 20 bp, Artificial
  CRISPR gRNA sequence
ttctgccccttccttttttt

SEQ ID NO: 646067 - DNA, 20 bp, Artificial
  CRISPR gRNA sequence
ctgccccttcctttttttta

SEQ ID NO: 646068 - DNA, 20 bp, Artificial
  CRISPR gRNA sequence
tgccccttccttttttttaa

SEQ ID NO: 646069 - DNA, 20 bp, Artificial
  CRISPR gRNA sequence
ccccttccttttttttaatc

SEQ ID NO: 646070 - DNA, 20 bp, Artificial
  CRISPR gRNA sequence
ccttttttttaatcttagca

SEQ ID NO: 646071 - DNA, 20 bp, Artificial
  CRISPR gRNA sequence
cttttttttaatcttagcaa

SEQ ID NO: 646072 - DNA, 20 bp, Artificial
  CRISPR gRNA sequence
ttttttaatcttagcaatat

SEQ ID NO: 646073 - DNA, 20 bp, Artificial
  CRISPR gRNA sequence
tttttaatcttagcaatata

SEQ ID NO: 646074 - DNA, 20 bp, Artificial
  CRISPR gRNA sequence
ttttaatcttagcaatatat

SEQ ID NO: 646075 - DNA, 20 bp, Artificial
  CRISPR gRNA sequence
tttaatcttagcaatatatt

SEQ ID NO: 646076 - DNA, 20 bp, Artificial
  CRISPR gRNA sequence
ttaatcttagcaatatattt

SEQ ID NO: 646077 - DNA, 20 bp, Artificial
  CRISPR gRNA sequence
taatcttagcaatatatttt

SEQ ID NO: 646078 - DNA, 20 bp, Artificial
  CRISPR gRNA sequence
aatcttagcaatatattttc

SEQ ID NO: 646079 - DNA, 20 bp, Artificial
  CRISPR gRNA sequence
atcttagcaatatattttcg

SEQ ID NO: 646080 - DNA, 20 bp, Artificial
  CRISPR gRNA sequence
agcaatatattttcgaaatc

SEQ ID NO: 646081 - DNA, 20 bp, Artificial
  CRISPR gRNA sequence
gcaatatattttcgaaatct

SEQ ID NO: 646082 - DNA, 20 bp, Artificial
  CRISPR gRNA sequence
tcgaaatctttccatattca

SEQ ID NO: 646083 - DNA, 20 bp, Artificial
  CRISPR gRNA sequence
cgaaatctttccatattcat

SEQ ID NO: 646084 - DNA, 20 bp, Artificial
  CRISPR gRNA sequence
gaaatctttccatattcatg

SEQ ID NO: 646085 - DNA, 20 bp, Artificial
  CRISPR gRNA sequence
tccatattcatgattcttat

SEQ ID NO: 646086 - DNA, 20 bp, Artificial
  CRISPR gRNA sequence
ccatattcatgattcttatt

SEQ ID NO: 646087 - DNA, 20 bp, Artificial
  CRISPR gRNA sequence
catattcatgattcttattt

SEQ ID NO: 646088 - DNA, 20 bp, Artificial
  CRISPR gRNA sequence
atgattcttattttttatat

SEQ ID NO: 646089 - DNA, 20 bp, Artificial
  CRISPR gRNA sequence
ttattttttatatacttgca

SEQ ID NO: 646090 - DNA, 20 bp, Artificial
  CRISPR gRNA sequence
attttttatatacttgcata

SEQ ID NO: 646091 - DNA, 20 bp, Artificial
  CRISPR gRNA sequence
ttttttatatacttgcataa

SEQ ID NO: 646092 - DNA, 20 bp, Artificial
  CRISPR gRNA sequence
tttatatacttgcataatat

SEQ ID NO: 646093 - DNA, 20 bp, Artificial
  CRISPR gRNA sequence
ttatatacttgcataatatt

SEQ ID NO: 646094 - DNA, 20 bp, Artificial
  CRISPR gRNA sequence
tatatacttgcataatattc

SEQ ID NO: 646095 - DNA, 20 bp, Artificial
  CRISPR gRNA sequence
atatacttgcataatattca

SEQ ID NO: 646096 - DNA, 20 bp, Artificial
  CRISPR gRNA sequence
tatacttgcataatattcaa

SEQ ID NO: 646097 - DNA, 20 bp, Artificial
  CRISPR gRNA sequence
gcataatattcaattattgg

SEQ ID NO: 646098 - DNA, 20 bp, Artificial
  CRISPR gRNA sequence
cataatattcaattattgga

SEQ ID NO: 646099 - DNA, 20 bp, Artificial
  CRISPR gRNA sequence
aattattggatatacctaat

SEQ ID NO: 646100 - DNA, 20 bp, Artificial
  CRISPR gRNA sequence
ttggatatacctaatttatt

SEQ ID NO: 646101 - DNA, 20 bp, Artificial
  CRISPR gRNA sequence
gatatacctaatttatttaa

SEQ ID NO: 646102 - DNA, 20 bp, Artificial
  CRISPR gRNA sequence
atttatttaatcaatccact

SEQ ID NO: 646103 - DNA, 20 bp, Artificial
  CRISPR gRNA sequence
atttaatcaatccactactg

SEQ ID NO: 646104 - DNA, 20 bp, Artificial
  CRISPR gRNA sequence
tttaatcaatccactactga

SEQ ID NO: 646105 - DNA, 20 bp, Artificial
  CRISPR gRNA sequence
aatcaatccactactgatgg

SEQ ID NO: 646106 - DNA, 20 bp, Artificial
  CRISPR gRNA sequence
atcaatccactactgatggg

SEQ ID NO: 646107 - DNA, 20 bp, Artificial
  CRISPR gRNA sequence
ctgatgggcattgtttgcac

SEQ ID NO: 646108 - DNA, 20 bp, Artificial
  CRISPR gRNA sequence
atgggcattgtttgcacaat

SEQ ID NO: 646109 - DNA, 20 bp, Artificial
  CRISPR gRNA sequence
tttgcacaatgtttcccatc

SEQ ID NO: 646110 - DNA, 20 bp, Artificial
  CRISPR gRNA sequence
gcacaatgtttcccatcttt

SEQ ID NO: 646111 - DNA, 20 bp, Artificial
  CRISPR gRNA sequence
cacaatgtttcccatctttt

SEQ ID NO: 646112 - DNA, 20 bp, Artificial
  CRISPR gRNA sequence
cccatcttttgatatgaaaa

SEQ ID NO: 646113 - DNA, 20 bp, Artificial
  CRISPR gRNA sequence
ccatcttttgatatgaaaaa

SEQ ID NO: 646114 - DNA, 20 bp, Artificial
  CRISPR gRNA sequence
ttgatatgaaaaacaatgct

SEQ ID NO: 646115 - DNA, 20 bp, Artificial
  CRISPR gRNA sequence
tgatatgaaaaacaatgctg

SEQ ID NO: 646116 - DNA, 20 bp, Artificial
  CRISPR gRNA sequence
gatatgaaaaacaatgctgc

SEQ ID NO: 646117 - DNA, 20 bp, Artificial
  CRISPR gRNA sequence
atatgaaaaacaatgctgca

SEQ ID NO: 646118 - DNA, 20 bp, Artificial
  CRISPR gRNA sequence
caatgaataaatctgtgcac

SEQ ID NO: 646119 - DNA, 20 bp, Artificial
  CRISPR gRNA sequence
tgcactcaacatttgacaaa

SEQ ID NO: 646120 - DNA, 20 bp, Artificial
  CRISPR gRNA sequence
aacatttgacaaattattat

SEQ ID NO: 646121 - DNA, 20 bp, Artificial
  CRISPR gRNA sequence
gacaaattattataagataa

SEQ ID NO: 646122 - DNA, 20 bp, Artificial
  CRISPR gRNA sequence
acaaattattataagataaa

SEQ ID NO: 646123 - DNA, 20 bp, Artificial
  CRISPR gRNA sequence
ttataagataaatttgtaga

SEQ ID NO: 646124 - DNA, 20 bp, Artificial
  CRISPR gRNA sequence
taagataaatttgtagaaac

SEQ ID NO: 646125 - DNA, 20 bp, Artificial
  CRISPR gRNA sequence
gtagaaacaggagtactgag

SEQ ID NO: 646126 - DNA, 20 bp, Artificial
  CRISPR gRNA sequence
tagaaacaggagtactgagt

SEQ ID NO: 646127 - DNA, 20 bp, Artificial
  CRISPR gRNA sequence
agtcaaagtttataagcatt

SEQ ID NO: 646128 - DNA, 20 bp, Artificial
  CRISPR gRNA sequence
ataagcatttgttccaattc

SEQ ID NO: 646129 - DNA, 20 bp, Artificial
  CRISPR gRNA sequence
taagcatttgttccaattca

SEQ ID NO: 646130 - DNA, 20 bp, Artificial
  CRISPR gRNA sequence
gttccaattcacatttatat

SEQ ID NO: 646131 - DNA, 20 bp, Artificial
  CRISPR gRNA sequence
ttccaattcacatttatata

SEQ ID NO: 646132 - DNA, 20 bp, Artificial
  CRISPR gRNA sequence
caattcacatttatataaat

SEQ ID NO: 646133 - DNA, 20 bp, Artificial
  CRISPR gRNA sequence
acatttatataaatttatac

SEQ ID NO: 646134 - DNA, 20 bp, Artificial
  CRISPR gRNA sequence
atataaatttatactcccat

SEQ ID NO: 646135 - DNA, 20 bp, Artificial
  CRISPR gRNA sequence
tataaatttatactcccatc

SEQ ID NO: 646136 - DNA, 20 bp, Artificial
  CRISPR gRNA sequence
atactcccatcaacaataca

SEQ ID NO: 646137 - DNA, 20 bp, Artificial
  CRISPR gRNA sequence
tactcccatcaacaatacat

SEQ ID NO: 646138 - DNA, 20 bp, Artificial
  CRISPR gRNA sequence
ccatcaacaatacataaaag

SEQ ID NO: 646139 - DNA, 20 bp, Artificial
  CRISPR gRNA sequence
tttccttgcagccttgccaa

SEQ ID NO: 646140 - DNA, 20 bp, Artificial
  CRISPR gRNA sequence
ccttgcagccttgccaacac

SEQ ID NO: 646141 - DNA, 20 bp, Artificial
  CRISPR gRNA sequence
cttgcagccttgccaacaca

SEQ ID NO: 646142 - DNA, 20 bp, Artificial
  CRISPR gRNA sequence
gcagccttgccaacacagca

SEQ ID NO: 646143 - DNA, 20 bp, Artificial
  CRISPR gRNA sequence
cagccttgccaacacagcat

SEQ ID NO: 646144 - DNA, 20 bp, Artificial
  CRISPR gRNA sequence
gccaacacagcatgacacaa

SEQ ID NO: 646145 - DNA, 20 bp, Artificial
  CRISPR gRNA sequence
ccaacacagcatgacacaaa

SEQ ID NO: 646146 - DNA, 20 bp, Artificial
  CRISPR gRNA sequence
tcagttttttgctaatataa

SEQ ID NO: 646147 - DNA, 20 bp, Artificial
  CRISPR gRNA sequence
cagttttttgctaatataat

SEQ ID NO: 646148 - DNA, 20 bp, Artificial
  CRISPR gRNA sequence
agttttttgctaatataatg

SEQ ID NO: 646149 - DNA, 20 bp, Artificial
  CRISPR gRNA sequence
tttgctaatataatgaatta

SEQ ID NO: 646150 - DNA, 20 bp, Artificial
  CRISPR gRNA sequence
ttgctaatataatgaattag

SEQ ID NO: 646151 - DNA, 20 bp, Artificial
  CRISPR gRNA sequence
tgctaatataatgaattaga

SEQ ID NO: 646152 - DNA, 20 bp, Artificial
  CRISPR gRNA sequence
gctaatataatgaattagac

SEQ ID NO: 646153 - DNA, 20 bp, Artificial
  CRISPR gRNA sequence
ctaatataatgaattagaca

SEQ ID NO: 646154 - DNA, 20 bp, Artificial
  CRISPR gRNA sequence
atataatgaattagacatgc

SEQ ID NO: 646155 - DNA, 20 bp, Artificial
  CRISPR gRNA sequence
gacatgctatgtcagtatag

SEQ ID NO: 646156 - DNA, 20 bp, Artificial
  CRISPR gRNA sequence
tgtcagtatagttttatata

SEQ ID NO: 646157 - DNA, 20 bp, Artificial
  CRISPR gRNA sequence
tatatacctcctattttggg

SEQ ID NO: 646158 - DNA, 20 bp, Artificial
  CRISPR gRNA sequence
atatacctcctattttgggt

SEQ ID NO: 646159 - DNA, 20 bp, Artificial
  CRISPR gRNA sequence
tatacctcctattttgggtg

SEQ ID NO: 646160 - DNA, 20 bp, Artificial
  CRISPR gRNA sequence
ctattttgggtgaagttaag

SEQ ID NO: 646161 - DNA, 20 bp, Artificial
  CRISPR gRNA sequence
ttttgggtgaagttaagaaa

SEQ ID NO: 646162 - DNA, 20 bp, Artificial
  CRISPR gRNA sequence
tgggtgaagttaagaaaaac

SEQ ID NO: 646163 - DNA, 20 bp, Artificial
  CRISPR gRNA sequence
gggtgaagttaagaaaaact

SEQ ID NO: 646164 - DNA, 20 bp, Artificial
  CRISPR gRNA sequence
ggtgaagttaagaaaaactt

SEQ ID NO: 646165 - DNA, 20 bp, Artificial
  CRISPR gRNA sequence
agaaaaactttatatgtgta

SEQ ID NO: 646166 - DNA, 20 bp, Artificial
  CRISPR gRNA sequence
tatatgtgtaggagccaatg

SEQ ID NO: 646167 - DNA, 20 bp, Artificial
  CRISPR gRNA sequence
atatgtgtaggagccaatgg

SEQ ID NO: 646168 - DNA, 20 bp, Artificial
  CRISPR gRNA sequence
tatgtgtaggagccaatggt

SEQ ID NO: 646169 - DNA, 20 bp, Artificial
  CRISPR gRNA sequence
ttctgtgaactgtgtgttag

SEQ ID NO: 646170 - DNA, 20 bp, Artificial
  CRISPR gRNA sequence
tctgtgaactgtgtgttaga

SEQ ID NO: 646171 - DNA, 20 bp, Artificial
  CRISPR gRNA sequence
ctgtgaactgtgtgttagaa

SEQ ID NO: 646172 - DNA, 20 bp, Artificial
  CRISPR gRNA sequence
tgtgaactgtgtgttagaat

SEQ ID NO: 646173 - DNA, 20 bp, Artificial
  CRISPR gRNA sequence
tgaactgtgtgttagaataa

SEQ ID NO: 646174 - DNA, 20 bp, Artificial
  CRISPR gRNA sequence
tgtgttagaataatttaacc

SEQ ID NO: 646175 - DNA, 20 bp, Artificial
  CRISPR gRNA sequence
gaataatttaaccaaatttc

SEQ ID NO: 646176 - DNA, 20 bp, Artificial
  CRISPR gRNA sequence
aaccaaatttctattagata

SEQ ID NO: 646177 - DNA, 20 bp, Artificial
  CRISPR gRNA sequence
accaaatttctattagatac

SEQ ID NO: 646178 - DNA, 20 bp, Artificial
  CRISPR gRNA sequence
ctattagatacttactgtac

SEQ ID NO: 646179 - DNA, 20 bp, Artificial
  CRISPR gRNA sequence
tattagatacttactgtact

SEQ ID NO: 646180 - DNA, 20 bp, Artificial
  CRISPR gRNA sequence
ttagatacttactgtacttc

SEQ ID NO: 646181 - DNA, 20 bp, Artificial
  CRISPR gRNA sequence
gatacttactgtacttcagg

SEQ ID NO: 646182 - DNA, 20 bp, Artificial
  CRISPR gRNA sequence
actgtacttcaggaattact

SEQ ID NO: 646183 - DNA, 20 bp, Artificial
  CRISPR gRNA sequence
ctgtacttcaggaattacta

SEQ ID NO: 646184 - DNA, 20 bp, Artificial
  CRISPR gRNA sequence
tacttcaggaattactagga

SEQ ID NO: 646185 - DNA, 20 bp, Artificial
  CRISPR gRNA sequence
caggaattactaggagctgt

SEQ ID NO: 646186 - DNA, 20 bp, Artificial
  CRISPR gRNA sequence
aggaattactaggagctgtt

SEQ ID NO: 646187 - DNA, 20 bp, Artificial
  CRISPR gRNA sequence
ctaggagctgttatgtatta

SEQ ID NO: 646188 - DNA, 20 bp, Artificial
  CRISPR gRNA sequence
ggagctgttatgtattagag

SEQ ID NO: 646189 - DNA, 20 bp, Artificial
  CRISPR gRNA sequence
ttatgtattagagattaacc

SEQ ID NO: 646190 - DNA, 20 bp, Artificial
  CRISPR gRNA sequence
tgtattagagattaaccgtt

SEQ ID NO: 646191 - DNA, 20 bp, Artificial
  CRISPR gRNA sequence
gagattaaccgtttaagtca

SEQ ID NO: 646192 - DNA, 20 bp, Artificial
  CRISPR gRNA sequence
accgtttaagtcatcatatg

SEQ ID NO: 646193 - DNA, 20 bp, Artificial
  CRISPR gRNA sequence
aagtcatcatatgagttgca

SEQ ID NO: 646194 - DNA, 20 bp, Artificial
  CRISPR gRNA sequence
agtcatcatatgagttgcaa

SEQ ID NO: 646195 - DNA, 20 bp, Artificial
  CRISPR gRNA sequence
caaattttacctccagcttg

SEQ ID NO: 646196 - DNA, 20 bp, Artificial
  CRISPR gRNA sequence
tacctccagcttgttgttta

SEQ ID NO: 646197 - DNA, 20 bp, Artificial
  CRISPR gRNA sequence
acctccagcttgttgtttac

SEQ ID NO: 646198 - DNA, 20 bp, Artificial
  CRISPR gRNA sequence
cctccagcttgttgtttacc

SEQ ID NO: 646199 - DNA, 20 bp, Artificial
  CRISPR gRNA sequence
cagcttgttgtttacctttt

SEQ ID NO: 646200 - DNA, 20 bp, Artificial
  CRISPR gRNA sequence
gttgtttaccttttggtttt

SEQ ID NO: 646201 - DNA, 20 bp, Artificial
  CRISPR gRNA sequence
ttgtttaccttttggtttta

SEQ ID NO: 646202 - DNA, 20 bp, Artificial
  CRISPR gRNA sequence
tttaccttttggttttattt

SEQ ID NO: 646203 - DNA, 20 bp, Artificial
  CRISPR gRNA sequence
accttttggttttatttatg

SEQ ID NO: 646204 - DNA, 20 bp, Artificial
  CRISPR gRNA sequence
ccttttggttttatttatgc

SEQ ID NO: 646205 - DNA, 20 bp, Artificial
  CRISPR gRNA sequence
ttggttttatttatgctatt

SEQ ID NO: 646206 - DNA, 20 bp, Artificial
  CRISPR gRNA sequence
tggttttatttatgctattt

SEQ ID NO: 646207 - DNA, 20 bp, Artificial
  CRISPR gRNA sequence
ggttttatttatgctatttt

SEQ ID NO: 646208 - DNA, 20 bp, Artificial
  CRISPR gRNA sequence
gttttatttatgctattttt

SEQ ID NO: 646209 - DNA, 20 bp, Artificial
  CRISPR gRNA sequence
tatttatgctattttttgcc

SEQ ID NO: 646210 - DNA, 20 bp, Artificial
  CRISPR gRNA sequence
atttatgctattttttgcca

SEQ ID NO: 646211 - DNA, 20 bp, Artificial
  CRISPR gRNA sequence
tttatgctattttttgccat

SEQ ID NO: 646212 - DNA, 20 bp, Artificial
  CRISPR gRNA sequence
atgctattttttgccatgta

SEQ ID NO: 646213 - DNA, 20 bp, Artificial
  CRISPR gRNA sequence
tgctattttttgccatgtag

SEQ ID NO: 646214 - DNA, 20 bp, Artificial
  CRISPR gRNA sequence
ttttttgccatgtagaaatt

SEQ ID NO: 646215 - DNA, 20 bp, Artificial
  CRISPR gRNA sequence
tttgccatgtagaaattttt

SEQ ID NO: 646216 - DNA, 20 bp, Artificial
  CRISPR gRNA sequence
ttgccatgtagaaattttta

SEQ ID NO: 646217 - DNA, 20 bp, Artificial
  CRISPR gRNA sequence
tgccatgtagaaatttttat

SEQ ID NO: 646218 - DNA, 20 bp, Artificial
  CRISPR gRNA sequence
gccatgtagaaatttttatt

SEQ ID NO: 646219 - DNA, 20 bp, Artificial
  CRISPR gRNA sequence
ccatgtagaaatttttatta

SEQ ID NO: 646220 - DNA, 20 bp, Artificial
  CRISPR gRNA sequence
ttattattttaaatgaatta

SEQ ID NO: 646221 - DNA, 20 bp, Artificial
  CRISPR gRNA sequence
tattattttaaatgaattaa

SEQ ID NO: 646222 - DNA, 20 bp, Artificial
  CRISPR gRNA sequence
attattttaaatgaattaat

SEQ ID NO: 646223 - DNA, 20 bp, Artificial
  CRISPR gRNA sequence
ttattttaaatgaattaatc

SEQ ID NO: 646224 - DNA, 20 bp, Artificial
  CRISPR gRNA sequence
ttttaaatgaattaatcctt

SEQ ID NO: 646225 - DNA, 20 bp, Artificial
  CRISPR gRNA sequence
taaatgaattaatcctttga

SEQ ID NO: 646226 - DNA, 20 bp, Artificial
  CRISPR gRNA sequence
aaatgaattaatcctttgaa

SEQ ID NO: 646227 - DNA, 20 bp, Artificial
  CRISPR gRNA sequence
aatgaattaatcctttgaaa

SEQ ID NO: 646228 - DNA, 20 bp, Artificial
  CRISPR gRNA sequence
atcctttgaaattgactttt

SEQ ID NO: 646229 - DNA, 20 bp, Artificial
  CRISPR gRNA sequence
tgaaattgacttttagatat

SEQ ID NO: 646230 - DNA, 20 bp, Artificial
  CRISPR gRNA sequence
gaaattgacttttagatatt

SEQ ID NO: 646231 - DNA, 20 bp, Artificial
  CRISPR gRNA sequence
aaattgacttttagatattg

SEQ ID NO: 646232 - DNA, 20 bp, Artificial
  CRISPR gRNA sequence
acttttagatattgaatttt

SEQ ID NO: 646233 - DNA, 20 bp, Artificial
  CRISPR gRNA sequence
ttagatattgaattttatta

SEQ ID NO: 646234 - DNA, 20 bp, Artificial
  CRISPR gRNA sequence
tagatattgaattttattaa

SEQ ID NO: 646235 - DNA, 20 bp, Artificial
  CRISPR gRNA sequence
agatattgaattttattaaa

SEQ ID NO: 646236 - DNA, 20 bp, Artificial
  CRISPR gRNA sequence
gatattgaattttattaaaa

SEQ ID NO: 646237 - DNA, 20 bp, Artificial
  CRISPR gRNA sequence
aattttattaaaaagagctt

SEQ ID NO: 646238 - DNA, 20 bp, Artificial
  CRISPR gRNA sequence
tattaaaaagagcttcccat

SEQ ID NO: 646239 - DNA, 20 bp, Artificial
  CRISPR gRNA sequence
attaaaaagagcttcccata

SEQ ID NO: 646240 - DNA, 20 bp, Artificial
  CRISPR gRNA sequence
ttaaaaagagcttcccatag

SEQ ID NO: 646241 - DNA, 20 bp, Artificial
  CRISPR gRNA sequence
aaaagagcttcccatagtaa

SEQ ID NO: 646242 - DNA, 20 bp, Artificial
  CRISPR gRNA sequence
cccatagtaagaccataata

SEQ ID NO: 646243 - DNA, 20 bp, Artificial
  CRISPR gRNA sequence
ccatagtaagaccataataa

SEQ ID NO: 646244 - DNA, 20 bp, Artificial
  CRISPR gRNA sequence
tcacattttcttctattact

SEQ ID NO: 646245 - DNA, 20 bp, Artificial
  CRISPR gRNA sequence
cacattttcttctattactt

SEQ ID NO: 646246 - DNA, 20 bp, Artificial
  CRISPR gRNA sequence
acattttcttctattactta

SEQ ID NO: 646247 - DNA, 20 bp, Artificial
  CRISPR gRNA sequence
tcttctattacttatatggt

SEQ ID NO: 646248 - DNA, 20 bp, Artificial
  CRISPR gRNA sequence
cttctattacttatatggtt

SEQ ID NO: 646249 - DNA, 20 bp, Artificial
  CRISPR gRNA sequence
ttctattacttatatggtta

SEQ ID NO: 646250 - DNA, 20 bp, Artificial
  CRISPR gRNA sequence
ctattacttatatggttaac

SEQ ID NO: 646251 - DNA, 20 bp, Artificial
  CRISPR gRNA sequence
tattacttatatggttaact

SEQ ID NO: 646252 - DNA, 20 bp, Artificial
  CRISPR gRNA sequence
ttacttatatggttaacttt

SEQ ID NO: 646253 - DNA, 20 bp, Artificial
  CRISPR gRNA sequence
cttatatggttaactttcat

SEQ ID NO: 646254 - DNA, 20 bp, Artificial
  CRISPR gRNA sequence
atatggttaactttcatgta

SEQ ID NO: 646255 - DNA, 20 bp, Artificial
  CRISPR gRNA sequence
tatggttaactttcatgtat

SEQ ID NO: 646256 - DNA, 20 bp, Artificial
  CRISPR gRNA sequence
actttcatgtatatatcttt

SEQ ID NO: 646257 - DNA, 20 bp, Artificial
  CRISPR gRNA sequence
tcatgtatatatctttgttc

SEQ ID NO: 646258 - DNA, 20 bp, Artificial
  CRISPR gRNA sequence
catgtatatatctttgttcc

SEQ ID NO: 646259 - DNA, 20 bp, Artificial
  CRISPR gRNA sequence
atgtatatatctttgttcca

SEQ ID NO: 646260 - DNA, 20 bp, Artificial
  CRISPR gRNA sequence
tgttccaattcagagtttat

SEQ ID NO: 646261 - DNA, 20 bp, Artificial
  CRISPR gRNA sequence
gttccaattcagagtttatc

SEQ ID NO: 646262 - DNA, 20 bp, Artificial
  CRISPR gRNA sequence
ttccaattcagagtttatcc

SEQ ID NO: 646263 - DNA, 20 bp, Artificial
  CRISPR gRNA sequence
caattcagagtttatcctga

SEQ ID NO: 646264 - DNA, 20 bp, Artificial
  CRISPR gRNA sequence
agagtttatcctgaagttca

SEQ ID NO: 646265 - DNA, 20 bp, Artificial
  CRISPR gRNA sequence
atcctgaagttcagtataag

SEQ ID NO: 646266 - DNA, 20 bp, Artificial
  CRISPR gRNA sequence
tcctgaagttcagtataaga

SEQ ID NO: 646267 - DNA, 20 bp, Artificial
  CRISPR gRNA sequence
aagttcagtataagatataa

SEQ ID NO: 646268 - DNA, 20 bp, Artificial
  CRISPR gRNA sequence
agtataagatataagcaata

SEQ ID NO: 646269 - DNA, 20 bp, Artificial
  CRISPR gRNA sequence
catctacctgtgaaagaata

SEQ ID NO: 646270 - DNA, 20 bp, Artificial
  CRISPR gRNA sequence
cctgtgaaagaatacttcac

SEQ ID NO: 646271 - DNA, 20 bp, Artificial
  CRISPR gRNA sequence
tgaaagaatacttcacagta

SEQ ID NO: 646272 - DNA, 20 bp, Artificial
  CRISPR gRNA sequence
cacagtatatcttccccatt

SEQ ID NO: 646273 - DNA, 20 bp, Artificial
  CRISPR gRNA sequence
acagtatatcttccccattt

SEQ ID NO: 646274 - DNA, 20 bp, Artificial
  CRISPR gRNA sequence
ccccattttaagtacgcttc

SEQ ID NO: 646275 - DNA, 20 bp, Artificial
  CRISPR gRNA sequence
cccattttaagtacgcttct

SEQ ID NO: 646276 - DNA, 20 bp, Artificial
  CRISPR gRNA sequence
taagtacgcttctgcatgtt

SEQ ID NO: 646277 - DNA, 20 bp, Artificial
  CRISPR gRNA sequence
aagtacgcttctgcatgttc

SEQ ID NO: 646278 - DNA, 20 bp, Artificial
  CRISPR gRNA sequence
agtacgcttctgcatgttct

SEQ ID NO: 646279 - DNA, 20 bp, Artificial
  CRISPR gRNA sequence
ctgcatgttctttaatacaa

SEQ ID NO: 646280 - DNA, 20 bp, Artificial
  CRISPR gRNA sequence
tgcatgttctttaatacaaa

SEQ ID NO: 646281 - DNA, 20 bp, Artificial
  CRISPR gRNA sequence
catgttctttaatacaaata

SEQ ID NO: 646282 - DNA, 20 bp, Artificial
  CRISPR gRNA sequence
tttaatacaaatattacaca

SEQ ID NO: 646283 - DNA, 20 bp, Artificial
  CRISPR gRNA sequence
taatacaaatattacacatt

SEQ ID NO: 646284 - DNA, 20 bp, Artificial
  CRISPR gRNA sequence
aatacaaatattacacattt

SEQ ID NO: 646285 - DNA, 20 bp, Artificial
  CRISPR gRNA sequence
atacaaatattacacattta

SEQ ID NO: 646286 - DNA, 20 bp, Artificial
  CRISPR gRNA sequence
cacatttaaatattggcatg

SEQ ID NO: 646287 - DNA, 20 bp, Artificial
  CRISPR gRNA sequence
aaatattggcatgttaattt

SEQ ID NO: 646288 - DNA, 20 bp, Artificial
  CRISPR gRNA sequence
aatattggcatgttaattta

SEQ ID NO: 646289 - DNA, 20 bp, Artificial
  CRISPR gRNA sequence
gcatgttaatttaaactgcc

SEQ ID NO: 646290 - DNA, 20 bp, Artificial
  CRISPR gRNA sequence
atttaaactgccctattact

SEQ ID NO: 646291 - DNA, 20 bp, Artificial
  CRISPR gRNA sequence
aaactgccctattactaaat

SEQ ID NO: 646292 - DNA, 20 bp, Artificial
  CRISPR gRNA sequence
aactgccctattactaaatt

SEQ ID NO: 646293 - DNA, 20 bp, Artificial
  CRISPR gRNA sequence
ccctattactaaattatttt

SEQ ID NO: 646294 - DNA, 20 bp, Artificial
  CRISPR gRNA sequence
ttactaaattattttattgt

SEQ ID NO: 646295 - DNA, 20 bp, Artificial
  CRISPR gRNA sequence
ctaaattattttattgttta

SEQ ID NO: 646296 - DNA, 20 bp, Artificial
  CRISPR gRNA sequence
aattattttattgtttatga

SEQ ID NO: 646297 - DNA, 20 bp, Artificial
  CRISPR gRNA sequence
ttttattgtttatgaattat

SEQ ID NO: 646298 - DNA, 20 bp, Artificial
  CRISPR gRNA sequence
tattgtttatgaattatttg

SEQ ID NO: 646299 - DNA, 20 bp, Artificial
  CRISPR gRNA sequence
attgtttatgaattatttgt

SEQ ID NO: 646300 - DNA, 20 bp, Artificial
  CRISPR gRNA sequence
ttgtttatgaattatttgtc

SEQ ID NO: 646301 - DNA, 20 bp, Artificial
  CRISPR gRNA sequence
tttatgaattatttgtcttt

SEQ ID NO: 646302 - DNA, 20 bp, Artificial
  CRISPR gRNA sequence
atgaattatttgtctttcag

SEQ ID NO: 646303 - DNA, 20 bp, Artificial
  CRISPR gRNA sequence
tgaattatttgtctttcagc

SEQ ID NO: 646304 - DNA, 20 bp, Artificial
  CRISPR gRNA sequence
tttgtctttcagctgattct

SEQ ID NO: 646305 - DNA, 20 bp, Artificial
  CRISPR gRNA sequence
gtctttcagctgattctctg

SEQ ID NO: 646306 - DNA, 20 bp, Artificial
  CRISPR gRNA sequence
tctttcagctgattctctgc

SEQ ID NO: 646307 - DNA, 20 bp, Artificial
  CRISPR gRNA sequence
tcagctgattctctgcagtt

SEQ ID NO: 646308 - DNA, 20 bp, Artificial
  CRISPR gRNA sequence
cagctgattctctgcagttt

SEQ ID NO: 646309 - DNA, 20 bp, Artificial
  CRISPR gRNA sequence
agctgattctctgcagttta

SEQ ID NO: 646310 - DNA, 20 bp, Artificial
  CRISPR gRNA sequence
attctctgcagtttatggat

SEQ ID NO: 646311 - DNA, 20 bp, Artificial
  CRISPR gRNA sequence
tctgcagtttatggatacaa

SEQ ID NO: 646312 - DNA, 20 bp, Artificial
  CRISPR gRNA sequence
tgcagtttatggatacaaaa

SEQ ID NO: 646313 - DNA, 20 bp, Artificial
  CRISPR gRNA sequence
cagtttatggatacaaaaca

SEQ ID NO: 646314 - DNA, 20 bp, Artificial
  CRISPR gRNA sequence
atggatacaaaacataccat

SEQ ID NO: 646315 - DNA, 20 bp, Artificial
  CRISPR gRNA sequence
tggatacaaaacataccatc

SEQ ID NO: 646316 - DNA, 20 bp, Artificial
  CRISPR gRNA sequence
caaaaagtgattattttatc

SEQ ID NO: 646317 - DNA, 20 bp, Artificial
  CRISPR gRNA sequence
ttttatctctacctatcaaa

SEQ ID NO: 646318 - DNA, 20 bp, Artificial
  CRISPR gRNA sequence
tatctctacctatcaaattt

SEQ ID NO: 646319 - DNA, 20 bp, Artificial
  CRISPR gRNA sequence
atctctacctatcaaatttt

SEQ ID NO: 646320 - DNA, 20 bp, Artificial
  CRISPR gRNA sequence
tctctacctatcaaattttt

SEQ ID NO: 646321 - DNA, 20 bp, Artificial
  CRISPR gRNA sequence
tacctatcaaatttttataa

SEQ ID NO: 646322 - DNA, 20 bp, Artificial
  CRISPR gRNA sequence
cctatcaaatttttataatc

SEQ ID NO: 646323 - DNA, 20 bp, Artificial
  CRISPR gRNA sequence
tcaaatttttataatcttat

SEQ ID NO: 646324 - DNA, 20 bp, Artificial
  CRISPR gRNA sequence
ttataatcttattttttatt

SEQ ID NO: 646325 - DNA, 20 bp, Artificial
  CRISPR gRNA sequence
tataatcttattttttatta

SEQ ID NO: 646326 - DNA, 20 bp, Artificial
  CRISPR gRNA sequence
ataatcttattttttattat

SEQ ID NO: 646327 - DNA, 20 bp, Artificial
  CRISPR gRNA sequence
taatcttattttttattatc

SEQ ID NO: 646328 - DNA, 20 bp, Artificial
  CRISPR gRNA sequence
attttttattatctaaatcc

SEQ ID NO: 646329 - DNA, 20 bp, Artificial
  CRISPR gRNA sequence
ttttttattatctaaatcca

SEQ ID NO: 646330 - DNA, 20 bp, Artificial
  CRISPR gRNA sequence
tttattatctaaatccattg

SEQ ID NO: 646331 - DNA, 20 bp, Artificial
  CRISPR gRNA sequence
ttattatctaaatccattgg

SEQ ID NO: 646332 - DNA, 20 bp, Artificial
  CRISPR gRNA sequence
tattatctaaatccattggc

SEQ ID NO: 646333 - DNA, 20 bp, Artificial
  CRISPR gRNA sequence
attatctaaatccattggca

SEQ ID NO: 646334 - DNA, 20 bp, Artificial
  CRISPR gRNA sequence
ttatctaaatccattggcag

SEQ ID NO: 646335 - DNA, 20 bp, Artificial
  CRISPR gRNA sequence
tctaaatccattggcagttt

SEQ ID NO: 646336 - DNA, 20 bp, Artificial
  CRISPR gRNA sequence
aatccattggcagtttcgtc

SEQ ID NO: 646337 - DNA, 20 bp, Artificial
  CRISPR gRNA sequence
gcagtttcgtccagcacaat

SEQ ID NO: 646338 - DNA, 20 bp, Artificial
  CRISPR gRNA sequence
cgtccagcacaatattaaaa

SEQ ID NO: 646339 - DNA, 20 bp, Artificial
  CRISPR gRNA sequence
gtccagcacaatattaaaaa

SEQ ID NO: 646340 - DNA, 20 bp, Artificial
  CRISPR gRNA sequence
aaaaagagtaaagagaacaa

SEQ ID NO: 646341 - DNA, 20 bp, Artificial
  CRISPR gRNA sequence
cctagtttctgaaattactg

SEQ ID NO: 646342 - DNA, 20 bp, Artificial
  CRISPR gRNA sequence
gtttctgaaattactgagca

SEQ ID NO: 646343 - DNA, 20 bp, Artificial
  CRISPR gRNA sequence
ctgaaattactgagcatgcg

SEQ ID NO: 646344 - DNA, 20 bp, Artificial
  CRISPR gRNA sequence
tgaaattactgagcatgcgt

SEQ ID NO: 646345 - DNA, 20 bp, Artificial
  CRISPR gRNA sequence
aaattactgagcatgcgtat

SEQ ID NO: 646346 - DNA, 20 bp, Artificial
  CRISPR gRNA sequence
ctgagcatgcgtatgtgttt

SEQ ID NO: 646347 - DNA, 20 bp, Artificial
  CRISPR gRNA sequence
agcatgcgtatgtgttttcc

SEQ ID NO: 646348 - DNA, 20 bp, Artificial
  CRISPR gRNA sequence
tcctatgaatcataatggct

SEQ ID NO: 646349 - DNA, 20 bp, Artificial
  CRISPR gRNA sequence
cctatgaatcataatggctt

SEQ ID NO: 646350 - DNA, 20 bp, Artificial
  CRISPR gRNA sequence
ctatgaatcataatggcttt

SEQ ID NO: 646351 - DNA, 20 bp, Artificial
  CRISPR gRNA sequence
tgaatcataatggcttttgg

SEQ ID NO: 646352 - DNA, 20 bp, Artificial
  CRISPR gRNA sequence
ttggactcacatacatacat

SEQ ID NO: 646353 - DNA, 20 bp, Artificial
  CRISPR gRNA sequence
tggactcacatacatacatt

SEQ ID NO: 646354 - DNA, 20 bp, Artificial
  CRISPR gRNA sequence
ggactcacatacatacattt

SEQ ID NO: 646355 - DNA, 20 bp, Artificial
  CRISPR gRNA sequence
gactcacatacatacatttg

SEQ ID NO: 646356 - DNA, 20 bp, Artificial
  CRISPR gRNA sequence
acatacatacatttgatcac

SEQ ID NO: 646357 - DNA, 20 bp, Artificial
  CRISPR gRNA sequence
gatcactatgaagaagtttc

SEQ ID NO: 646358 - DNA, 20 bp, Artificial
  CRISPR gRNA sequence
atcactatgaagaagtttcc

SEQ ID NO: 646359 - DNA, 20 bp, Artificial
  CRISPR gRNA sequence
tgaagaagtttccctttatt

SEQ ID NO: 646360 - DNA, 20 bp, Artificial
  CRISPR gRNA sequence
ccctttatttctgtttactg

SEQ ID NO: 646361 - DNA, 20 bp, Artificial
  CRISPR gRNA sequence
cctttatttctgtttactgg

SEQ ID NO: 646362 - DNA, 20 bp, Artificial
  CRISPR gRNA sequence
tatttctgtttactgggtgt

SEQ ID NO: 646363 - DNA, 20 bp, Artificial
  CRISPR gRNA sequence
atttctgtttactgggtgta

SEQ ID NO: 646364 - DNA, 20 bp, Artificial
  CRISPR gRNA sequence
tttctgtttactgggtgtag

SEQ ID NO: 646365 - DNA, 20 bp, Artificial
  CRISPR gRNA sequence
ctgtttactgggtgtagaga

SEQ ID NO: 646366 - DNA, 20 bp, Artificial
  CRISPR gRNA sequence
tgtttactgggtgtagagaa

SEQ ID NO: 646367 - DNA, 20 bp, Artificial
  CRISPR gRNA sequence
tttactgggtgtagagaatg

SEQ ID NO: 646368 - DNA, 20 bp, Artificial
  CRISPR gRNA sequence
actgggtgtagagaatggtt

SEQ ID NO: 646369 - DNA, 20 bp, Artificial
  CRISPR gRNA sequence
ctgggtgtagagaatggttg

SEQ ID NO: 646370 - DNA, 20 bp, Artificial
  CRISPR gRNA sequence
ggtgtagagaatggttgtta

SEQ ID NO: 646371 - DNA, 20 bp, Artificial
  CRISPR gRNA sequence
ttaatttttgtcctatgttt

SEQ ID NO: 646372 - DNA, 20 bp, Artificial
  CRISPR gRNA sequence
atttttgtcctatgtttttt

SEQ ID NO: 646373 - DNA, 20 bp, Artificial
  CRISPR gRNA sequence
ttgtcctatgttttttcact

SEQ ID NO: 646374 - DNA, 20 bp, Artificial
  CRISPR gRNA sequence
tgtcctatgttttttcactg

SEQ ID NO: 646375 - DNA, 20 bp, Artificial
  CRISPR gRNA sequence
gtcctatgttttttcactgt

SEQ ID NO: 646376 - DNA, 20 bp, Artificial
  CRISPR gRNA sequence
tcctatgttttttcactgtc

SEQ ID NO: 646377 - DNA, 20 bp, Artificial
  CRISPR gRNA sequence
tgttttttcactgtctatag

SEQ ID NO: 646378 - DNA, 20 bp, Artificial
  CRISPR gRNA sequence
tttcactgtctatagagaaa

SEQ ID NO: 646379 - DNA, 20 bp, Artificial
  CRISPR gRNA sequence
ttcactgtctatagagaaaa

SEQ ID NO: 646380 - DNA, 20 bp, Artificial
  CRISPR gRNA sequence
tcactgtctatagagaaaat

SEQ ID NO: 646381 - DNA, 20 bp, Artificial
  CRISPR gRNA sequence
cactgtctatagagaaaatc

SEQ ID NO: 646382 - DNA, 20 bp, Artificial
  CRISPR gRNA sequence
actgtctatagagaaaatca

SEQ ID NO: 646383 - DNA, 20 bp, Artificial
  CRISPR gRNA sequence
tctatagagaaaatcatatg

SEQ ID NO: 646384 - DNA, 20 bp, Artificial
  CRISPR gRNA sequence
tagagaaaatcatatgattg

SEQ ID NO: 646385 - DNA, 20 bp, Artificial
  CRISPR gRNA sequence
ttctctttagtttaatatga

SEQ ID NO: 646386 - DNA, 20 bp, Artificial
  CRISPR gRNA sequence
tctttagtttaatatgataa

SEQ ID NO: 646387 - DNA, 20 bp, Artificial
  CRISPR gRNA sequence
tttagtttaatatgataaat

SEQ ID NO: 646388 - DNA, 20 bp, Artificial
  CRISPR gRNA sequence
tagtttaatatgataaatat

SEQ ID NO: 646389 - DNA, 20 bp, Artificial
  CRISPR gRNA sequence
agtttaatatgataaatatt

SEQ ID NO: 646390 - DNA, 20 bp, Artificial
  CRISPR gRNA sequence
gtttaatatgataaatatta

SEQ ID NO: 646391 - DNA, 20 bp, Artificial
  CRISPR gRNA sequence
aatatgataaatattagatt

SEQ ID NO: 646392 - DNA, 20 bp, Artificial
  CRISPR gRNA sequence
atatgataaatattagattt

SEQ ID NO: 646393 - DNA, 20 bp, Artificial
  CRISPR gRNA sequence
gatttcctattattgatcca

SEQ ID NO: 646394 - DNA, 20 bp, Artificial
  CRISPR gRNA sequence
cctattattgatccatcctt

SEQ ID NO: 646395 - DNA, 20 bp, Artificial
  CRISPR gRNA sequence
ctattattgatccatccttg

SEQ ID NO: 646396 - DNA, 20 bp, Artificial
  CRISPR gRNA sequence
ttattgatccatccttgcac

SEQ ID NO: 646397 - DNA, 20 bp, Artificial
  CRISPR gRNA sequence
ttgatccatccttgcactgc

SEQ ID NO: 646398 - DNA, 20 bp, Artificial
  CRISPR gRNA sequence
atccatccttgcactgctga

SEQ ID NO: 646399 - DNA, 20 bp, Artificial
  CRISPR gRNA sequence
gcactgctgaaataaatttc

SEQ ID NO: 646400 - DNA, 20 bp, Artificial
  CRISPR gRNA sequence
cactgctgaaataaatttct

SEQ ID NO: 646401 - DNA, 20 bp, Artificial
  CRISPR gRNA sequence
ctgaaataaatttcttttgt

SEQ ID NO: 646402 - DNA, 20 bp, Artificial
  CRISPR gRNA sequence
aaataaatttcttttgttaa

SEQ ID NO: 646403 - DNA, 20 bp, Artificial
  CRISPR gRNA sequence
cttttgttaataacaaatta

SEQ ID NO: 646404 - DNA, 20 bp, Artificial
  CRISPR gRNA sequence
ttttgttaataacaaattat

SEQ ID NO: 646405 - DNA, 20 bp, Artificial
  CRISPR gRNA sequence
ttgttaataacaaattatta

SEQ ID NO: 646406 - DNA, 20 bp, Artificial
  CRISPR gRNA sequence
tgttaataacaaattattac

SEQ ID NO: 646407 - DNA, 20 bp, Artificial
  CRISPR gRNA sequence
gttaataacaaattattact

SEQ ID NO: 646408 - DNA, 20 bp, Artificial
  CRISPR gRNA sequence
ttaataacaaattattactt

SEQ ID NO: 646409 - DNA, 20 bp, Artificial
  CRISPR gRNA sequence
ataacaaattattactttca

SEQ ID NO: 646410 - DNA, 20 bp, Artificial
  CRISPR gRNA sequence
ttactttcagggaattcaaa

SEQ ID NO: 646411 - DNA, 20 bp, Artificial
  CRISPR gRNA sequence
ctttcagggaattcaaattg

SEQ ID NO: 646412 - DNA, 20 bp, Artificial
  CRISPR gRNA sequence
tcagggaattcaaattgtaa

SEQ ID NO: 646413 - DNA, 20 bp, Artificial
  CRISPR gRNA sequence
cagggaattcaaattgtaat

SEQ ID NO: 646414 - DNA, 20 bp, Artificial
  CRISPR gRNA sequence
agggaattcaaattgtaatt

SEQ ID NO: 646415 - DNA, 20 bp, Artificial
  CRISPR gRNA sequence
aaattgtaatttattttttt

SEQ ID NO: 646416 - DNA, 20 bp, Artificial
  CRISPR gRNA sequence
taatttatttttttagaaac

SEQ ID NO: 646417 - DNA, 20 bp, Artificial
  CRISPR gRNA sequence
atttttttagaaactgcctc

SEQ ID NO: 646418 - DNA, 20 bp, Artificial
  CRISPR gRNA sequence
tttttttagaaactgcctct

SEQ ID NO: 646419 - DNA, 20 bp, Artificial
  CRISPR gRNA sequence
ttttagaaactgcctcttct

SEQ ID NO: 646420 - DNA, 20 bp, Artificial
  CRISPR gRNA sequence
tttagaaactgcctcttctt

SEQ ID NO: 646421 - DNA, 20 bp, Artificial
  CRISPR gRNA sequence
ttagaaactgcctcttcttt

SEQ ID NO: 646422 - DNA, 20 bp, Artificial
  CRISPR gRNA sequence
tagaaactgcctcttctttt

SEQ ID NO: 646423 - DNA, 20 bp, Artificial
  CRISPR gRNA sequence
agaaactgcctcttcttttt

SEQ ID NO: 646424 - DNA, 20 bp, Artificial
  CRISPR gRNA sequence
gaaactgcctcttctttttg

SEQ ID NO: 646425 - DNA, 20 bp, Artificial
  CRISPR gRNA sequence
cctcttctttttggactatt

SEQ ID NO: 646426 - DNA, 20 bp, Artificial
  CRISPR gRNA sequence
ttctttttggactattatta

SEQ ID NO: 646427 - DNA, 20 bp, Artificial
  CRISPR gRNA sequence
ctttttggactattattact

SEQ ID NO: 646428 - DNA, 20 bp, Artificial
  CRISPR gRNA sequence
tttttggactattattactt

SEQ ID NO: 646429 - DNA, 20 bp, Artificial
  CRISPR gRNA sequence
tttggactattattacttga

SEQ ID NO: 646430 - DNA, 20 bp, Artificial
  CRISPR gRNA sequence
ttggactattattacttgat

SEQ ID NO: 646431 - DNA, 20 bp, Artificial
  CRISPR gRNA sequence
tggactattattacttgata

SEQ ID NO: 646432 - DNA, 20 bp, Artificial
  CRISPR gRNA sequence
ggactattattacttgatat

SEQ ID NO: 646433 - DNA, 20 bp, Artificial
  CRISPR gRNA sequence
gactattattacttgatatt

SEQ ID NO: 646434 - DNA, 20 bp, Artificial
  CRISPR gRNA sequence
ttattacttgatattgttaa

SEQ ID NO: 646435 - DNA, 20 bp, Artificial
  CRISPR gRNA sequence
ttacttgatattgttaaagg

SEQ ID NO: 646436 - DNA, 20 bp, Artificial
  CRISPR gRNA sequence
cttgatattgttaaaggaca

SEQ ID NO: 646437 - DNA, 20 bp, Artificial
  CRISPR gRNA sequence
gatattgttaaaggacaaga

SEQ ID NO: 646438 - DNA, 20 bp, Artificial
  CRISPR gRNA sequence
atattgttaaaggacaagag

SEQ ID NO: 646439 - DNA, 20 bp, Artificial
  CRISPR gRNA sequence
ttaaaggacaagaggccaag

SEQ ID NO: 646440 - DNA, 20 bp, Artificial
  CRISPR gRNA sequence
aaggacaagaggccaagcct

SEQ ID NO: 646441 - DNA, 20 bp, Artificial
  CRISPR gRNA sequence
aaagcaataaaaaattacca

SEQ ID NO: 646442 - DNA, 20 bp, Artificial
  CRISPR gRNA sequence
aagcaataaaaaattaccaa

SEQ ID NO: 646443 - DNA, 20 bp, Artificial
  CRISPR gRNA sequence
ccaaccagaaagatttgcag

SEQ ID NO: 646444 - DNA, 20 bp, Artificial
  CRISPR gRNA sequence
gcagaggagaactttaggtt

SEQ ID NO: 646445 - DNA, 20 bp, Artificial
  CRISPR gRNA sequence
cagaggagaactttaggttg

SEQ ID NO: 646446 - DNA, 20 bp, Artificial
  CRISPR gRNA sequence
taggttgaggagcaggtata

SEQ ID NO: 646447 - DNA, 20 bp, Artificial
  CRISPR gRNA sequence
aggttgaggagcaggtataa

SEQ ID NO: 646448 - DNA, 20 bp, Artificial
  CRISPR gRNA sequence
ggttgaggagcaggtataaa

SEQ ID NO: 646449 - DNA, 20 bp, Artificial
  CRISPR gRNA sequence
aggagcaggtataaactaat

SEQ ID NO: 646450 - DNA, 20 bp, Artificial
  CRISPR gRNA sequence
atagattatgtttgataatt

SEQ ID NO: 646451 - DNA, 20 bp, Artificial
  CRISPR gRNA sequence
tgtttgataattacagtttc

SEQ ID NO: 646452 - DNA, 20 bp, Artificial
  CRISPR gRNA sequence
gataattacagtttcattgg

SEQ ID NO: 646453 - DNA, 20 bp, Artificial
  CRISPR gRNA sequence
ataattacagtttcattggt

SEQ ID NO: 646454 - DNA, 20 bp, Artificial
  CRISPR gRNA sequence
cagtttcattggttaagaac

SEQ ID NO: 646455 - DNA, 20 bp, Artificial
  CRISPR gRNA sequence
cattggttaagaactgtgag

SEQ ID NO: 646456 - DNA, 20 bp, Artificial
  CRISPR gRNA sequence
attggttaagaactgtgaga

SEQ ID NO: 646457 - DNA, 20 bp, Artificial
  CRISPR gRNA sequence
gttaagaactgtgagactaa

SEQ ID NO: 646458 - DNA, 20 bp, Artificial
  CRISPR gRNA sequence
agaactgtgagactaacatt

SEQ ID NO: 646459 - DNA, 20 bp, Artificial
  CRISPR gRNA sequence
tgagactaacattttcagtc

SEQ ID NO: 646460 - DNA, 20 bp, Artificial
  CRISPR gRNA sequence
acattttcagtcctactcca

SEQ ID NO: 646461 - DNA, 20 bp, Artificial
  CRISPR gRNA sequence
tcagtcctactccataggga

SEQ ID NO: 646462 - DNA, 20 bp, Artificial
  CRISPR gRNA sequence
cagtcctactccatagggaa

SEQ ID NO: 646463 - DNA, 20 bp, Artificial
  CRISPR gRNA sequence
agtcctactccatagggaaa

SEQ ID NO: 646464 - DNA, 20 bp, Artificial
  CRISPR gRNA sequence
ctccatagggaaattatatg

SEQ ID NO: 646465 - DNA, 20 bp, Artificial
  CRISPR gRNA sequence
catagggaaattatatgctc

SEQ ID NO: 646466 - DNA, 20 bp, Artificial
  CRISPR gRNA sequence
tatgctcagcagaagtattt

SEQ ID NO: 646467 - DNA, 20 bp, Artificial
  CRISPR gRNA sequence
agcagaagtattttatccta

SEQ ID NO: 646468 - DNA, 20 bp, Artificial
  CRISPR gRNA sequence
tatcctaacactgtttatgg

SEQ ID NO: 646469 - DNA, 20 bp, Artificial
  CRISPR gRNA sequence
atcctaacactgtttatggg

SEQ ID NO: 646470 - DNA, 20 bp, Artificial
  CRISPR gRNA sequence
tcctaacactgtttatgggt

SEQ ID NO: 646471 - DNA, 20 bp, Artificial
  CRISPR gRNA sequence
acactgtttatgggttattt

SEQ ID NO: 646472 - DNA, 20 bp, Artificial
  CRISPR gRNA sequence
tttatgggttattttttatt

SEQ ID NO: 646473 - DNA, 20 bp, Artificial
  CRISPR gRNA sequence
atgggttattttttatttaa

SEQ ID NO: 646474 - DNA, 20 bp, Artificial
  CRISPR gRNA sequence
tgggttattttttatttaac

SEQ ID NO: 646475 - DNA, 20 bp, Artificial
  CRISPR gRNA sequence
ttttttatttaacaatacat

SEQ ID NO: 646476 - DNA, 20 bp, Artificial
  CRISPR gRNA sequence
tttatttaacaatacattaa

SEQ ID NO: 646477 - DNA, 20 bp, Artificial
  CRISPR gRNA sequence
ttatttaacaatacattaat

SEQ ID NO: 646478 - DNA, 20 bp, Artificial
  CRISPR gRNA sequence
tatttaacaatacattaatt

SEQ ID NO: 646479 - DNA, 20 bp, Artificial
  CRISPR gRNA sequence
atttaacaatacattaattc

SEQ ID NO: 646480 - DNA, 20 bp, Artificial
  CRISPR gRNA sequence
tttaacaatacattaattca

SEQ ID NO: 646481 - DNA, 20 bp, Artificial
  CRISPR gRNA sequence
aacaatacattaattcaact

SEQ ID NO: 646482 - DNA, 20 bp, Artificial
  CRISPR gRNA sequence
acaatacattaattcaactt

SEQ ID NO: 646483 - DNA, 20 bp, Artificial
  CRISPR gRNA sequence
attcaacttagtacagattt

SEQ ID NO: 646484 - DNA, 20 bp, Artificial
  CRISPR gRNA sequence
aacttagtacagatttactg

SEQ ID NO: 646485 - DNA, 20 bp, Artificial
  CRISPR gRNA sequence
agtacagatttactgaacat

SEQ ID NO: 646486 - DNA, 20 bp, Artificial
  CRISPR gRNA sequence
gtacagatttactgaacatc

SEQ ID NO: 646487 - DNA, 20 bp, Artificial
  CRISPR gRNA sequence
actgaacatcaactattttc

SEQ ID NO: 646488 - DNA, 20 bp, Artificial
  CRISPR gRNA sequence
ctgaacatcaactattttca

SEQ ID NO: 646489 - DNA, 20 bp, Artificial
  CRISPR gRNA sequence
aacatcaactattttcaagg

SEQ ID NO: 646490 - DNA, 20 bp, Artificial
  CRISPR gRNA sequence
ttttcaaggtattgagattg

SEQ ID NO: 646491 - DNA, 20 bp, Artificial
  CRISPR gRNA sequence
tcaaggtattgagattgtgt

SEQ ID NO: 646492 - DNA, 20 bp, Artificial
  CRISPR gRNA sequence
caaggtattgagattgtgta

SEQ ID NO: 646493 - DNA, 20 bp, Artificial
  CRISPR gRNA sequence
aaggtattgagattgtgtag

SEQ ID NO: 646494 - DNA, 20 bp, Artificial
  CRISPR gRNA sequence
agattgtgtagttcagtggc

SEQ ID NO: 646495 - DNA, 20 bp, Artificial
  CRISPR gRNA sequence
tgtagttcagtggcttgcaa

SEQ ID NO: 646496 - DNA, 20 bp, Artificial
  CRISPR gRNA sequence
agtggcttgcaaactttttt

SEQ ID NO: 646497 - DNA, 20 bp, Artificial
  CRISPR gRNA sequence
gcaaacttttttttgaccca

SEQ ID NO: 646498 - DNA, 20 bp, Artificial
  CRISPR gRNA sequence
caaacttttttttgacccag

SEQ ID NO: 646499 - DNA, 20 bp, Artificial
  CRISPR gRNA sequence
ttttttgacccagacagaca

SEQ ID NO: 646500 - DNA, 20 bp, Artificial
  CRISPR gRNA sequence
tttttgacccagacagacaa

SEQ ID NO: 646501 - DNA, 20 bp, Artificial
  CRISPR gRNA sequence
ttttgacccagacagacaat

SEQ ID NO: 646502 - DNA, 20 bp, Artificial
  CRISPR gRNA sequence
tttgacccagacagacaata

SEQ ID NO: 646503 - DNA, 20 bp, Artificial
  CRISPR gRNA sequence
ttgacccagacagacaataa

SEQ ID NO: 646504 - DNA, 20 bp, Artificial
  CRISPR gRNA sequence
tgacccagacagacaataaa

SEQ ID NO: 646505 - DNA, 20 bp, Artificial
  CRISPR gRNA sequence
gacccagacagacaataaaa

SEQ ID NO: 646506 - DNA, 20 bp, Artificial
  CRISPR gRNA sequence
acccagacagacaataaaaa

SEQ ID NO: 646507 - DNA, 20 bp, Artificial
  CRISPR gRNA sequence
ttattgcaactcactatata

SEQ ID NO: 646508 - DNA, 20 bp, Artificial
  CRISPR gRNA sequence
tattgcaactcactatatac

SEQ ID NO: 646509 - DNA, 20 bp, Artificial
  CRISPR gRNA sequence
attgcaactcactatataca

SEQ ID NO: 646510 - DNA, 20 bp, Artificial
  CRISPR gRNA sequence
ttgcaactcactatatacat

SEQ ID NO: 646511 - DNA, 20 bp, Artificial
  CRISPR gRNA sequence
caactcactatatacatatg

SEQ ID NO: 646512 - DNA, 20 bp, Artificial
  CRISPR gRNA sequence
actatatacatatgtctatg

SEQ ID NO: 646513 - DNA, 20 bp, Artificial
  CRISPR gRNA sequence
tatacatatgtctatgtatg

SEQ ID NO: 646514 - DNA, 20 bp, Artificial
  CRISPR gRNA sequence
tgtatgtctaaatacatatt

SEQ ID NO: 646515 - DNA, 20 bp, Artificial
  CRISPR gRNA sequence
aatacatattaatgtttatg

SEQ ID NO: 646516 - DNA, 20 bp, Artificial
  CRISPR gRNA sequence
atgtttatgaaaatggctta

SEQ ID NO: 646517 - DNA, 20 bp, Artificial
  CRISPR gRNA sequence
atgaaaatggcttaatgaaa

SEQ ID NO: 646518 - DNA, 20 bp, Artificial
  CRISPR gRNA sequence
tgaaaatggcttaatgaaac

SEQ ID NO: 646519 - DNA, 20 bp, Artificial
  CRISPR gRNA sequence
aatgaaacaatactacacat

SEQ ID NO: 646520 - DNA, 20 bp, Artificial
  CRISPR gRNA sequence
atgaaacaatactacacata

SEQ ID NO: 646521 - DNA, 20 bp, Artificial
  CRISPR gRNA sequence
cacataatcatagttctttc

SEQ ID NO: 646522 - DNA, 20 bp, Artificial
  CRISPR gRNA sequence
tttccttctttctttttttt

SEQ ID NO: 646523 - DNA, 20 bp, Artificial
  CRISPR gRNA sequence
tccttctttctttttttttt

SEQ ID NO: 646524 - DNA, 20 bp, Artificial
  CRISPR gRNA sequence
ccttctttctttttttttta

SEQ ID NO: 646525 - DNA, 20 bp, Artificial
  CRISPR gRNA sequence
cttctttcttttttttttaa

SEQ ID NO: 646526 - DNA, 20 bp, Artificial
  CRISPR gRNA sequence
ctttcttttttttttaagac

SEQ ID NO: 646527 - DNA, 20 bp, Artificial
  CRISPR gRNA sequence
tttcttttttttttaagaca

SEQ ID NO: 646528 - DNA, 20 bp, Artificial
  CRISPR gRNA sequence
tcttttttttttaagacagg

SEQ ID NO: 646529 - DNA, 20 bp, Artificial
  CRISPR gRNA sequence
cttttttttttaagacaggg

SEQ ID NO: 646530 - DNA, 20 bp, Artificial
  CRISPR gRNA sequence
ttttttttttaagacagggt

SEQ ID NO: 646531 - DNA, 20 bp, Artificial
  CRISPR gRNA sequence
ttttttttaagacagggtct

SEQ ID NO: 646532 - DNA, 20 bp, Artificial
  CRISPR gRNA sequence
tttttttaagacagggtctc

SEQ ID NO: 646533 - DNA, 20 bp, Artificial
  CRISPR gRNA sequence
ttttttaagacagggtctca

SEQ ID NO: 646534 - DNA, 20 bp, Artificial
  CRISPR gRNA sequence
tttttaagacagggtctcac

SEQ ID NO: 646535 - DNA, 20 bp, Artificial
  CRISPR gRNA sequence
ttttaagacagggtctcacc

SEQ ID NO: 646536 - DNA, 20 bp, Artificial
  CRISPR gRNA sequence
tttaagacagggtctcaccc

SEQ ID NO: 646537 - DNA, 20 bp, Artificial
  CRISPR gRNA sequence
ttaagacagggtctcaccct

SEQ ID NO: 646538 - DNA, 20 bp, Artificial
  CRISPR gRNA sequence
taagacagggtctcaccctg

SEQ ID NO: 646539 - DNA, 20 bp, Artificial
  CRISPR gRNA sequence
aagacagggtctcaccctgt

SEQ ID NO: 646540 - DNA, 20 bp, Artificial
  CRISPR gRNA sequence
agacagggtctcaccctgtc

SEQ ID NO: 646541 - DNA, 20 bp, Artificial
  CRISPR gRNA sequence
accctgtctcccagtgacag

SEQ ID NO: 646542 - DNA, 20 bp, Artificial
  CRISPR gRNA sequence
tctcccagtgacagattgtg

SEQ ID NO: 646543 - DNA, 20 bp, Artificial
  CRISPR gRNA sequence
ccagtgacagattgtgcagt

SEQ ID NO: 646544 - DNA, 20 bp, Artificial
  CRISPR gRNA sequence
tgcagtggcacgatcacagc

SEQ ID NO: 646545 - DNA, 20 bp, Artificial
  CRISPR gRNA sequence
actagccatgaactccaggg

SEQ ID NO: 646546 - DNA, 20 bp, Artificial
  CRISPR gRNA sequence
gccatgaactccagggctca

SEQ ID NO: 646547 - DNA, 20 bp, Artificial
  CRISPR gRNA sequence
cagggctcaagtgatcctct

SEQ ID NO: 646548 - DNA, 20 bp, Artificial
  CRISPR gRNA sequence
aagtgatcctcttgcctcag

SEQ ID NO: 646549 - DNA, 20 bp, Artificial
  CRISPR gRNA sequence
ttgcctcagccttctgcata

SEQ ID NO: 646550 - DNA, 20 bp, Artificial
  CRISPR gRNA sequence
gcctcagccttctgcatagc

SEQ ID NO: 646551 - DNA, 20 bp, Artificial
  CRISPR gRNA sequence
cctcagccttctgcatagct

SEQ ID NO: 646552 - DNA, 20 bp, Artificial
  CRISPR gRNA sequence
agccttctgcatagctaaaa

SEQ ID NO: 646553 - DNA, 20 bp, Artificial
  CRISPR gRNA sequence
ctgcatagctaaaattacag

SEQ ID NO: 646554 - DNA, 20 bp, Artificial
  CRISPR gRNA sequence
tgcatagctaaaattacagg

SEQ ID NO: 646555 - DNA, 20 bp, Artificial
  CRISPR gRNA sequence
catagctaaaattacaggtg

SEQ ID NO: 646556 - DNA, 20 bp, Artificial
  CRISPR gRNA sequence
aaattacaggtgcaagccac

SEQ ID NO: 646557 - DNA, 20 bp, Artificial
  CRISPR gRNA sequence
caggtgcaagccactgggcc

SEQ ID NO: 646558 - DNA, 20 bp, Artificial
  CRISPR gRNA sequence
ggcccagctcaatattccat

SEQ ID NO: 646559 - DNA, 20 bp, Artificial
  CRISPR gRNA sequence
aatattccatattctaacgt

SEQ ID NO: 646560 - DNA, 20 bp, Artificial
  CRISPR gRNA sequence
catattctaacgttttctat

SEQ ID NO: 646561 - DNA, 20 bp, Artificial
  CRISPR gRNA sequence
taacgttttctattccatat

SEQ ID NO: 646562 - DNA, 20 bp, Artificial
  CRISPR gRNA sequence
acgttttctattccatatca

SEQ ID NO: 646563 - DNA, 20 bp, Artificial
  CRISPR gRNA sequence
tctattccatatcattttta

SEQ ID NO: 646564 - DNA, 20 bp, Artificial
  CRISPR gRNA sequence
ctattccatatcatttttac

SEQ ID NO: 646565 - DNA, 20 bp, Artificial
  CRISPR gRNA sequence
tattccatatcatttttact

SEQ ID NO: 646566 - DNA, 20 bp, Artificial
  CRISPR gRNA sequence
ttccatatcatttttactaa

SEQ ID NO: 646567 - DNA, 20 bp, Artificial
  CRISPR gRNA sequence
catatcatttttactaaagt

SEQ ID NO: 646568 - DNA, 20 bp, Artificial
  CRISPR gRNA sequence
ttactaaagtgttggtttct

SEQ ID NO: 646569 - DNA, 20 bp, Artificial
  CRISPR gRNA sequence
tactaaagtgttggtttcta

SEQ ID NO: 646570 - DNA, 20 bp, Artificial
  CRISPR gRNA sequence
actaaagtgttggtttctat

SEQ ID NO: 646571 - DNA, 20 bp, Artificial
  CRISPR gRNA sequence
ctaaagtgttggtttctata

SEQ ID NO: 646572 - DNA, 20 bp, Artificial
  CRISPR gRNA sequence
aagtgttggtttctatacat

SEQ ID NO: 646573 - DNA, 20 bp, Artificial
  CRISPR gRNA sequence
gtttctatacattacaccga

SEQ ID NO: 646574 - DNA, 20 bp, Artificial
  CRISPR gRNA sequence
ctatacattacaccgattcc

SEQ ID NO: 646575 - DNA, 20 bp, Artificial
  CRISPR gRNA sequence
tatacattacaccgattccc

SEQ ID NO: 646576 - DNA, 20 bp, Artificial
  CRISPR gRNA sequence
tacattacaccgattcccca

SEQ ID NO: 646577 - DNA, 20 bp, Artificial
  CRISPR gRNA sequence
caccgattccccaacccata

SEQ ID NO: 646578 - DNA, 20 bp, Artificial
  CRISPR gRNA sequence
cccaacccataataaattaa

SEQ ID NO: 646579 - DNA, 20 bp, Artificial
  CRISPR gRNA sequence
aaatttacagtgttagaaat

SEQ ID NO: 646580 - DNA, 20 bp, Artificial
  CRISPR gRNA sequence
acagtgttagaaatatcata

SEQ ID NO: 646581 - DNA, 20 bp, Artificial
  CRISPR gRNA sequence
cagtgttagaaatatcatat

SEQ ID NO: 646582 - DNA, 20 bp, Artificial
  CRISPR gRNA sequence
gaaatatcatattagctaag

SEQ ID NO: 646583 - DNA, 20 bp, Artificial
  CRISPR gRNA sequence
gctaagacgaaggattctgg

SEQ ID NO: 646584 - DNA, 20 bp, Artificial
  CRISPR gRNA sequence
agacgaaggattctggaact

SEQ ID NO: 646585 - DNA, 20 bp, Artificial
  CRISPR gRNA sequence
tggaactaggcaaccaaggt

SEQ ID NO: 646586 - DNA, 20 bp, Artificial
  CRISPR gRNA sequence
gaactaggcaaccaaggttt

SEQ ID NO: 646587 - DNA, 20 bp, Artificial
  CRISPR gRNA sequence
ggcaaccaaggtttgaatca

SEQ ID NO: 646588 - DNA, 20 bp, Artificial
  CRISPR gRNA sequence
gaatcacagctttacctctt

SEQ ID NO: 646589 - DNA, 20 bp, Artificial
  CRISPR gRNA sequence
aatcacagctttacctctta

SEQ ID NO: 646590 - DNA, 20 bp, Artificial
  CRISPR gRNA sequence
tacctcttaatggcttttaa

SEQ ID NO: 646591 - DNA, 20 bp, Artificial
  CRISPR gRNA sequence
acctcttaatggcttttaat

SEQ ID NO: 646592 - DNA, 20 bp, Artificial
  CRISPR gRNA sequence
cctcttaatggcttttaatt

SEQ ID NO: 646593 - DNA, 20 bp, Artificial
  CRISPR gRNA sequence
ttaatggcttttaattgcac

SEQ ID NO: 646594 - DNA, 20 bp, Artificial
  CRISPR gRNA sequence
aatggcttttaattgcacct

SEQ ID NO: 646595 - DNA, 20 bp, Artificial
  CRISPR gRNA sequence
atggcttttaattgcacctc

SEQ ID NO: 646596 - DNA, 20 bp, Artificial
  CRISPR gRNA sequence
ttaattgcacctcagttttt

SEQ ID NO: 646597 - DNA, 20 bp, Artificial
  CRISPR gRNA sequence
taattgcacctcagtttttc

SEQ ID NO: 646598 - DNA, 20 bp, Artificial
  CRISPR gRNA sequence
aattgcacctcagtttttca

SEQ ID NO: 646599 - DNA, 20 bp, Artificial
  CRISPR gRNA sequence
attgcacctcagtttttcat

SEQ ID NO: 646600 - DNA, 20 bp, Artificial
  CRISPR gRNA sequence
cacctcagtttttcatctat

SEQ ID NO: 646601 - DNA, 20 bp, Artificial
  CRISPR gRNA sequence
agtttttcatctataacagc

SEQ ID NO: 646602 - DNA, 20 bp, Artificial
  CRISPR gRNA sequence
ttcatctataacagcggggc

SEQ ID NO: 646603 - DNA, 20 bp, Artificial
  CRISPR gRNA sequence
tcatctataacagcggggca

SEQ ID NO: 646604 - DNA, 20 bp, Artificial
  CRISPR gRNA sequence
catctataacagcggggcaa

SEQ ID NO: 646605 - DNA, 20 bp, Artificial
  CRISPR gRNA sequence
atctataacagcggggcaat

SEQ ID NO: 646606 - DNA, 20 bp, Artificial
  CRISPR gRNA sequence
taacagcggggcaatactag

SEQ ID NO: 646607 - DNA, 20 bp, Artificial
  CRISPR gRNA sequence
gcatctacctcatagggttt

SEQ ID NO: 646608 - DNA, 20 bp, Artificial
  CRISPR gRNA sequence
cctcatagggttttattgag

SEQ ID NO: 646609 - DNA, 20 bp, Artificial
  CRISPR gRNA sequence
atagggttttattgagatta

SEQ ID NO: 646610 - DNA, 20 bp, Artificial
  CRISPR gRNA sequence
tattgagattaaatgaatta

SEQ ID NO: 646611 - DNA, 20 bp, Artificial
  CRISPR gRNA sequence
attgagattaaatgaattaa

SEQ ID NO: 646612 - DNA, 20 bp, Artificial
  CRISPR gRNA sequence
ttgagattaaatgaattaat

SEQ ID NO: 646613 - DNA, 20 bp, Artificial
  CRISPR gRNA sequence
agattaaatgaattaataca

SEQ ID NO: 646614 - DNA, 20 bp, Artificial
  CRISPR gRNA sequence
aatgaattaatacatataaa

SEQ ID NO: 646615 - DNA, 20 bp, Artificial
  CRISPR gRNA sequence
atacatataaatatatgttt

SEQ ID NO: 646616 - DNA, 20 bp, Artificial
  CRISPR gRNA sequence
gaaatattatatttgatttg

SEQ ID NO: 646617 - DNA, 20 bp, Artificial
  CRISPR gRNA sequence
aaatattatatttgatttgt

SEQ ID NO: 646618 - DNA, 20 bp, Artificial
  CRISPR gRNA sequence
tatttgatttgtttgacaaa

SEQ ID NO: 646619 - DNA, 20 bp, Artificial
  CRISPR gRNA sequence
gatttgtttgacaaaacatt

SEQ ID NO: 646620 - DNA, 20 bp, Artificial
  CRISPR gRNA sequence
atttgtttgacaaaacattt

SEQ ID NO: 646621 - DNA, 20 bp, Artificial
  CRISPR gRNA sequence
gtttgacaaaacatttccct

SEQ ID NO: 646622 - DNA, 20 bp, Artificial
  CRISPR gRNA sequence
tttgacaaaacatttccctt

SEQ ID NO: 646623 - DNA, 20 bp, Artificial
  CRISPR gRNA sequence
gacaaaacatttcccttgat

SEQ ID NO: 646624 - DNA, 20 bp, Artificial
  CRISPR gRNA sequence
acaaaacatttcccttgatc

SEQ ID NO: 646625 - DNA, 20 bp, Artificial
  CRISPR gRNA sequence
cccttgatcctacagttgct

SEQ ID NO: 646626 - DNA, 20 bp, Artificial
  CRISPR gRNA sequence
ccttgatcctacagttgcta

SEQ ID NO: 646627 - DNA, 20 bp, Artificial
  CRISPR gRNA sequence
gatcctacagttgctaaaaa

SEQ ID NO: 646628 - DNA, 20 bp, Artificial
  CRISPR gRNA sequence
atcctacagttgctaaaaaa

SEQ ID NO: 646629 - DNA, 20 bp, Artificial
  CRISPR gRNA sequence
cagttgctaaaaaaagcaaa

SEQ ID NO: 646630 - DNA, 20 bp, Artificial
  CRISPR gRNA sequence
ctaaaaaaagcaaaaacttg

SEQ ID NO: 646631 - DNA, 20 bp, Artificial
  CRISPR gRNA sequence
aaaaaagcaaaaacttgcat

SEQ ID NO: 646632 - DNA, 20 bp, Artificial
  CRISPR gRNA sequence
gcatccccaaaatacaaaaa

SEQ ID NO: 646633 - DNA, 20 bp, Artificial
  CRISPR gRNA sequence
catccccaaaatacaaaaac

SEQ ID NO: 646634 - DNA, 20 bp, Artificial
  CRISPR gRNA sequence
tggagaaatcattagatata

SEQ ID NO: 646635 - DNA, 20 bp, Artificial
  CRISPR gRNA sequence
gatatacagacttcctatca

SEQ ID NO: 646636 - DNA, 20 bp, Artificial
  CRISPR gRNA sequence
cctatcatctaaaaaaaata

SEQ ID NO: 646637 - DNA, 20 bp, Artificial
  CRISPR gRNA sequence
ctatcatctaaaaaaaataa

SEQ ID NO: 646638 - DNA, 20 bp, Artificial
  CRISPR gRNA sequence
tcatctaaaaaaaataatta

SEQ ID NO: 646639 - DNA, 20 bp, Artificial
  CRISPR gRNA sequence
aaaaaaataattatgagcat

SEQ ID NO: 646640 - DNA, 20 bp, Artificial
  CRISPR gRNA sequence
tgagcatgccaatataatct

SEQ ID NO: 646641 - DNA, 20 bp, Artificial
  CRISPR gRNA sequence
aatatctgattgttttttaa

SEQ ID NO: 646642 - DNA, 20 bp, Artificial
  CRISPR gRNA sequence
attgttttttaaagtgaatc

SEQ ID NO: 646643 - DNA, 20 bp, Artificial
  CRISPR gRNA sequence
ttttttaaagtgaatctgaa

SEQ ID NO: 646644 - DNA, 20 bp, Artificial
  CRISPR gRNA sequence
tttaaagtgaatctgaactg

SEQ ID NO: 646645 - DNA, 20 bp, Artificial
  CRISPR gRNA sequence
ttaaagtgaatctgaactgg

SEQ ID NO: 646646 - DNA, 20 bp, Artificial
  CRISPR gRNA sequence
taaagtgaatctgaactgga

SEQ ID NO: 646647 - DNA, 20 bp, Artificial
  CRISPR gRNA sequence
aaagtgaatctgaactggat

SEQ ID NO: 646648 - DNA, 20 bp, Artificial
  CRISPR gRNA sequence
aagtgaatctgaactggatc

SEQ ID NO: 646649 - DNA, 20 bp, Artificial
  CRISPR gRNA sequence
aactggatcttctctttcaa

SEQ ID NO: 646650 - DNA, 20 bp, Artificial
  CRISPR gRNA sequence
gatcttctctttcaaggcct

SEQ ID NO: 646651 - DNA, 20 bp, Artificial
  CRISPR gRNA sequence
ctctttcaaggccttgagat

SEQ ID NO: 646652 - DNA, 20 bp, Artificial
  CRISPR gRNA sequence
tctttcaaggccttgagata

SEQ ID NO: 646653 - DNA, 20 bp, Artificial
  CRISPR gRNA sequence
tttcaaggccttgagataac

SEQ ID NO: 646654 - DNA, 20 bp, Artificial
  CRISPR gRNA sequence
tcaaggccttgagataacca

SEQ ID NO: 646655 - DNA, 20 bp, Artificial
  CRISPR gRNA sequence
caaggccttgagataaccag

SEQ ID NO: 646656 - DNA, 20 bp, Artificial
  CRISPR gRNA sequence
aaggccttgagataaccagt

SEQ ID NO: 646657 - DNA, 20 bp, Artificial
  CRISPR gRNA sequence
gagataaccagtaaatatta

SEQ ID NO: 646658 - DNA, 20 bp, Artificial
  CRISPR gRNA sequence
agataaccagtaaatattag

SEQ ID NO: 646659 - DNA, 20 bp, Artificial
  CRISPR gRNA sequence
gctaagttaaataatcatta

SEQ ID NO: 646660 - DNA, 20 bp, Artificial
  CRISPR gRNA sequence
agttaaataatcattaagtt

SEQ ID NO: 646661 - DNA, 20 bp, Artificial
  CRISPR gRNA sequence
aataatcattaagttgtctc

SEQ ID NO: 646662 - DNA, 20 bp, Artificial
  CRISPR gRNA sequence
agttgtctcttttattccta

SEQ ID NO: 646663 - DNA, 20 bp, Artificial
  CRISPR gRNA sequence
tctcttttattcctacttta

SEQ ID NO: 646664 - DNA, 20 bp, Artificial
  CRISPR gRNA sequence
ttttattcctactttatatg

SEQ ID NO: 646665 - DNA, 20 bp, Artificial
  CRISPR gRNA sequence
ttattcctactttatatgga

SEQ ID NO: 646666 - DNA, 20 bp, Artificial
  CRISPR gRNA sequence
tattcctactttatatggat

SEQ ID NO: 646667 - DNA, 20 bp, Artificial
  CRISPR gRNA sequence
attcctactttatatggatg

SEQ ID NO: 646668 - DNA, 20 bp, Artificial
  CRISPR gRNA sequence
ttcctactttatatggatgt

SEQ ID NO: 646669 - DNA, 20 bp, Artificial
  CRISPR gRNA sequence
ctactttatatggatgtccc

SEQ ID NO: 646670 - DNA, 20 bp, Artificial
  CRISPR gRNA sequence
ctttatatggatgtcccttg

SEQ ID NO: 646671 - DNA, 20 bp, Artificial
  CRISPR gRNA sequence
tatatggatgtcccttgctc

SEQ ID NO: 646672 - DNA, 20 bp, Artificial
  CRISPR gRNA sequence
atatggatgtcccttgctcc

SEQ ID NO: 646673 - DNA, 20 bp, Artificial
  CRISPR gRNA sequence
tatggatgtcccttgctcca

SEQ ID NO: 646674 - DNA, 20 bp, Artificial
  CRISPR gRNA sequence
gctccaatgactatcaaaga

SEQ ID NO: 646675 - DNA, 20 bp, Artificial
  CRISPR gRNA sequence
ctccaatgactatcaaagaa

SEQ ID NO: 646676 - DNA, 20 bp, Artificial
  CRISPR gRNA sequence
caatgactatcaaagaagtt

SEQ ID NO: 646677 - DNA, 20 bp, Artificial
  CRISPR gRNA sequence
tcaaagaagttgataacact

SEQ ID NO: 646678 - DNA, 20 bp, Artificial
  CRISPR gRNA sequence
ataacactaagagacttagt

SEQ ID NO: 646679 - DNA, 20 bp, Artificial
  CRISPR gRNA sequence
agagacttagtggagatcta

SEQ ID NO: 646680 - DNA, 20 bp, Artificial
  CRISPR gRNA sequence
agtggagatctataatggta

SEQ ID NO: 646681 - DNA, 20 bp, Artificial
  CRISPR gRNA sequence
gtggagatctataatggtac

SEQ ID NO: 646682 - DNA, 20 bp, Artificial
  CRISPR gRNA sequence
taatggtacaactccaactc

SEQ ID NO: 646683 - DNA, 20 bp, Artificial
  CRISPR gRNA sequence
caactcattctgaaatggta

SEQ ID NO: 646684 - DNA, 20 bp, Artificial
  CRISPR gRNA sequence
attctgaaatggtatgcaga

SEQ ID NO: 646685 - DNA, 20 bp, Artificial
  CRISPR gRNA sequence
tgaaatggtatgcagagagt

SEQ ID NO: 646686 - DNA, 20 bp, Artificial
  CRISPR gRNA sequence
aaatggtatgcagagagtag

SEQ ID NO: 646687 - DNA, 20 bp, Artificial
  CRISPR gRNA sequence
atctttacagtatttaggag

SEQ ID NO: 646688 - DNA, 20 bp, Artificial
  CRISPR gRNA sequence
tacagtatttaggagtttaa

SEQ ID NO: 646689 - DNA, 20 bp, Artificial
  CRISPR gRNA sequence
acagtatttaggagtttaaa

SEQ ID NO: 646690 - DNA, 20 bp, Artificial
  CRISPR gRNA sequence
cagtatttaggagtttaaac

SEQ ID NO: 646691 - DNA, 20 bp, Artificial
  CRISPR gRNA sequence
aggagtttaaacatcttaaa

SEQ ID NO: 646692 - DNA, 20 bp, Artificial
  CRISPR gRNA sequence
ggagtttaaacatcttaaaa

SEQ ID NO: 646693 - DNA, 20 bp, Artificial
  CRISPR gRNA sequence
aaacatcttaaaatcagcct

SEQ ID NO: 646694 - DNA, 20 bp, Artificial
  CRISPR gRNA sequence
aacatcttaaaatcagcctg

SEQ ID NO: 646695 - DNA, 20 bp, Artificial
  CRISPR gRNA sequence
aaaatcagcctggaggaaag

SEQ ID NO: 646696 - DNA, 20 bp, Artificial
  CRISPR gRNA sequence
aaatcagcctggaggaaaga

SEQ ID NO: 646697 - DNA, 20 bp, Artificial
  CRISPR gRNA sequence
gaggaaagaatgatcttatc

SEQ ID NO: 646698 - DNA, 20 bp, Artificial
  CRISPR gRNA sequence
atctcttccttaactcagtt

SEQ ID NO: 646699 - DNA, 20 bp, Artificial
  CRISPR gRNA sequence
tctcttccttaactcagttt

SEQ ID NO: 646700 - DNA, 20 bp, Artificial
  CRISPR gRNA sequence
ttccttaactcagttttttt

SEQ ID NO: 646701 - DNA, 20 bp, Artificial
  CRISPR gRNA sequence
ccttaactcagtttttttgg

SEQ ID NO: 646702 - DNA, 20 bp, Artificial
  CRISPR gRNA sequence
cttaactcagtttttttggg

SEQ ID NO: 646703 - DNA, 20 bp, Artificial
  CRISPR gRNA sequence
aactcagtttttttggggcc

SEQ ID NO: 646704 - DNA, 20 bp, Artificial
  CRISPR gRNA sequence
actcagtttttttggggcct

SEQ ID NO: 646705 - DNA, 20 bp, Artificial
  CRISPR gRNA sequence
agtttttttggggcctcttc

SEQ ID NO: 646706 - DNA, 20 bp, Artificial
  CRISPR gRNA sequence
ttttggggcctcttcaaagt

SEQ ID NO: 646707 - DNA, 20 bp, Artificial
  CRISPR gRNA sequence
tttggggcctcttcaaagtt

SEQ ID NO: 646708 - DNA, 20 bp, Artificial
  CRISPR gRNA sequence
ttggggcctcttcaaagtta

SEQ ID NO: 646709 - DNA, 20 bp, Artificial
  CRISPR gRNA sequence
tggggcctcttcaaagttaa

SEQ ID NO: 646710 - DNA, 20 bp, Artificial
  CRISPR gRNA sequence
ggggcctcttcaaagttaac

SEQ ID NO: 646711 - DNA, 20 bp, Artificial
  CRISPR gRNA sequence
gggcctcttcaaagttaact

SEQ ID NO: 646712 - DNA, 20 bp, Artificial
  CRISPR gRNA sequence
ttcaaagttaactttagagc

SEQ ID NO: 646713 - DNA, 20 bp, Artificial
  CRISPR gRNA sequence
caaagttaactttagagccc

SEQ ID NO: 646714 - DNA, 20 bp, Artificial
  CRISPR gRNA sequence
aaagttaactttagagccca

SEQ ID NO: 646715 - DNA, 20 bp, Artificial
  CRISPR gRNA sequence
actttagagcccatggagaa

SEQ ID NO: 646716 - DNA, 20 bp, Artificial
  CRISPR gRNA sequence
tagagcccatggagaatagc

SEQ ID NO: 646717 - DNA, 20 bp, Artificial
  CRISPR gRNA sequence
agagcccatggagaatagct

SEQ ID NO: 646718 - DNA, 20 bp, Artificial
  CRISPR gRNA sequence
gagcccatggagaatagctt

SEQ ID NO: 646719 - DNA, 20 bp, Artificial
  CRISPR gRNA sequence
tttcttacacataattttac

SEQ ID NO: 646720 - DNA, 20 bp, Artificial
  CRISPR gRNA sequence
ttcttacacataattttact

SEQ ID NO: 646721 - DNA, 20 bp, Artificial
  CRISPR gRNA sequence
tcttacacataattttacta

SEQ ID NO: 646722 - DNA, 20 bp, Artificial
  CRISPR gRNA sequence
cttacacataattttactat

SEQ ID NO: 646723 - DNA, 20 bp, Artificial
  CRISPR gRNA sequence
ttacacataattttactatt

SEQ ID NO: 646724 - DNA, 20 bp, Artificial
  CRISPR gRNA sequence
acacataattttactattac

SEQ ID NO: 646725 - DNA, 20 bp, Artificial
  CRISPR gRNA sequence
cacataattttactattaca

SEQ ID NO: 646726 - DNA, 20 bp, Artificial
  CRISPR gRNA sequence
tactattacataagcttgct

SEQ ID NO: 646727 - DNA, 20 bp, Artificial
  CRISPR gRNA sequence
actattacataagcttgctg

SEQ ID NO: 646728 - DNA, 20 bp, Artificial
  CRISPR gRNA sequence
ctattacataagcttgctgg

SEQ ID NO: 646729 - DNA, 20 bp, Artificial
  CRISPR gRNA sequence
ttacataagcttgctgggat

SEQ ID NO: 646730 - DNA, 20 bp, Artificial
  CRISPR gRNA sequence
cataagcttgctgggattta

SEQ ID NO: 646731 - DNA, 20 bp, Artificial
  CRISPR gRNA sequence
gctgggatttatccattgta

SEQ ID NO: 646732 - DNA, 20 bp, Artificial
  CRISPR gRNA sequence
ctgggatttatccattgtac

SEQ ID NO: 646733 - DNA, 20 bp, Artificial
  CRISPR gRNA sequence
ggatttatccattgtacaaa

SEQ ID NO: 646734 - DNA, 20 bp, Artificial
  CRISPR gRNA sequence
atccattgtacaaaacaaat

SEQ ID NO: 646735 - DNA, 20 bp, Artificial
  CRISPR gRNA sequence
tccattgtacaaaacaaatg

SEQ ID NO: 646736 - DNA, 20 bp, Artificial
  CRISPR gRNA sequence
tacaaaacaaatggtattaa

SEQ ID NO: 646737 - DNA, 20 bp, Artificial
  CRISPR gRNA sequence
aaacctctagtaaatatact

SEQ ID NO: 646738 - DNA, 20 bp, Artificial
  CRISPR gRNA sequence
tagtaaatatactacctact

SEQ ID NO: 646739 - DNA, 20 bp, Artificial
  CRISPR gRNA sequence
gtaaatatactacctacttt

SEQ ID NO: 646740 - DNA, 20 bp, Artificial
  CRISPR gRNA sequence
cctactttcaggtacaatct

SEQ ID NO: 646741 - DNA, 20 bp, Artificial
  CRISPR gRNA sequence
ctttcaggtacaatctcaag

SEQ ID NO: 646742 - DNA, 20 bp, Artificial
  CRISPR gRNA sequence
tcaggtacaatctcaagaaa

SEQ ID NO: 646743 - DNA, 20 bp, Artificial
  CRISPR gRNA sequence
caggtacaatctcaagaaat

SEQ ID NO: 646744 - DNA, 20 bp, Artificial
  CRISPR gRNA sequence
aggtacaatctcaagaaatc

SEQ ID NO: 646745 - DNA, 20 bp, Artificial
  CRISPR gRNA sequence
aagaaatcccctaactctgc

SEQ ID NO: 646746 - DNA, 20 bp, Artificial
  CRISPR gRNA sequence
actctgcaaatgtctgtttc

SEQ ID NO: 646747 - DNA, 20 bp, Artificial
  CRISPR gRNA sequence
tgcaaatgtctgtttctcta

SEQ ID NO: 646748 - DNA, 20 bp, Artificial
  CRISPR gRNA sequence
caaatgtctgtttctctaaa

SEQ ID NO: 646749 - DNA, 20 bp, Artificial
  CRISPR gRNA sequence
tttctctaaaaaacaaagaa

SEQ ID NO: 646750 - DNA, 20 bp, Artificial
  CRISPR gRNA sequence
ctctaaaaaacaaagaacca

SEQ ID NO: 646751 - DNA, 20 bp, Artificial
  CRISPR gRNA sequence
tctaaaaaacaaagaaccat

SEQ ID NO: 646752 - DNA, 20 bp, Artificial
  CRISPR gRNA sequence
taaaaaacaaagaaccatgt

SEQ ID NO: 646753 - DNA, 20 bp, Artificial
  CRISPR gRNA sequence
aaaaacaaagaaccatgttt

SEQ ID NO: 646754 - DNA, 20 bp, Artificial
  CRISPR gRNA sequence
caaagttaatttactttgga

SEQ ID NO: 646755 - DNA, 20 bp, Artificial
  CRISPR gRNA sequence
aaagttaatttactttggag

SEQ ID NO: 646756 - DNA, 20 bp, Artificial
  CRISPR gRNA sequence
atttactttggaggtaagaa

SEQ ID NO: 646757 - DNA, 20 bp, Artificial
  CRISPR gRNA sequence
actttggaggtaagaagttt

SEQ ID NO: 646758 - DNA, 20 bp, Artificial
  CRISPR gRNA sequence
ctttggaggtaagaagtttg

SEQ ID NO: 646759 - DNA, 20 bp, Artificial
  CRISPR gRNA sequence
tggaggtaagaagtttggtt

SEQ ID NO: 646760 - DNA, 20 bp, Artificial
  CRISPR gRNA sequence
ggaggtaagaagtttggttg

SEQ ID NO: 646761 - DNA, 20 bp, Artificial
  CRISPR gRNA sequence
gaggtaagaagtttggttgt

SEQ ID NO: 646762 - DNA, 20 bp, Artificial
  CRISPR gRNA sequence
ggttgttgcttggttttttt

SEQ ID NO: 646763 - DNA, 20 bp, Artificial
  CRISPR gRNA sequence
gttgttgcttggtttttttc

SEQ ID NO: 646764 - DNA, 20 bp, Artificial
  CRISPR gRNA sequence
ttgcttggtttttttcccct

SEQ ID NO: 646765 - DNA, 20 bp, Artificial
  CRISPR gRNA sequence
cttggtttttttccccttat

SEQ ID NO: 646766 - DNA, 20 bp, Artificial
  CRISPR gRNA sequence
ggtttttttccccttatctc

SEQ ID NO: 646767 - DNA, 20 bp, Artificial
  CRISPR gRNA sequence
gtttttttccccttatctct

SEQ ID NO: 646768 - DNA, 20 bp, Artificial
  CRISPR gRNA sequence
ttttccccttatctctcttt

SEQ ID NO: 646769 - DNA, 20 bp, Artificial
  CRISPR gRNA sequence
tttccccttatctctctttc

SEQ ID NO: 646770 - DNA, 20 bp, Artificial
  CRISPR gRNA sequence
ttccccttatctctctttct

SEQ ID NO: 646771 - DNA, 20 bp, Artificial
  CRISPR gRNA sequence
tccccttatctctctttctt

SEQ ID NO: 646772 - DNA, 20 bp, Artificial
  CRISPR gRNA sequence
ccccttatctctctttcttc

SEQ ID NO: 646773 - DNA, 20 bp, Artificial
  CRISPR gRNA sequence
cccttatctctctttcttca

SEQ ID NO: 646774 - DNA, 20 bp, Artificial
  CRISPR gRNA sequence
atctctctttcttcagctgt

SEQ ID NO: 646775 - DNA, 20 bp, Artificial
  CRISPR gRNA sequence
tctctctttcttcagctgta

SEQ ID NO: 646776 - DNA, 20 bp, Artificial
  CRISPR gRNA sequence
tctttcttcagctgtaccta

SEQ ID NO: 646777 - DNA, 20 bp, Artificial
  CRISPR gRNA sequence
tttcttcagctgtacctatt

SEQ ID NO: 646778 - DNA, 20 bp, Artificial
  CRISPR gRNA sequence
tcttcagctgtacctattga

SEQ ID NO: 646779 - DNA, 20 bp, Artificial
  CRISPR gRNA sequence
cttcagctgtacctattgat

SEQ ID NO: 646780 - DNA, 20 bp, Artificial
  CRISPR gRNA sequence
ttcagctgtacctattgata

SEQ ID NO: 646781 - DNA, 20 bp, Artificial
  CRISPR gRNA sequence
cagctgtacctattgatact

SEQ ID NO: 646782 - DNA, 20 bp, Artificial
  CRISPR gRNA sequence
agctgtacctattgatactt

SEQ ID NO: 646783 - DNA, 20 bp, Artificial
  CRISPR gRNA sequence
tacctattgatacttggcac

SEQ ID NO: 646784 - DNA, 20 bp, Artificial
  CRISPR gRNA sequence
ttgatacttggcacatacgt

SEQ ID NO: 646785 - DNA, 20 bp, Artificial
  CRISPR gRNA sequence
atacttggcacatacgtttt

SEQ ID NO: 646786 - DNA, 20 bp, Artificial
  CRISPR gRNA sequence
ggcacatacgttttttctaa

SEQ ID NO: 646787 - DNA, 20 bp, Artificial
  CRISPR gRNA sequence
gcacatacgttttttctaat

SEQ ID NO: 646788 - DNA, 20 bp, Artificial
  CRISPR gRNA sequence
tttctaattgttttagggaa

SEQ ID NO: 646789 - DNA, 20 bp, Artificial
  CRISPR gRNA sequence
ttctaattgttttagggaag

SEQ ID NO: 646790 - DNA, 20 bp, Artificial
  CRISPR gRNA sequence
tctaattgttttagggaagg

SEQ ID NO: 646791 - DNA, 20 bp, Artificial
  CRISPR gRNA sequence
ctaattgttttagggaagga

SEQ ID NO: 646792 - DNA, 20 bp, Artificial
  CRISPR gRNA sequence
taattgttttagggaaggag

SEQ ID NO: 646793 - DNA, 20 bp, Artificial
  CRISPR gRNA sequence
attgttttagggaaggagtg

SEQ ID NO: 646794 - DNA, 20 bp, Artificial
  CRISPR gRNA sequence
ttttagggaaggagtggaga

SEQ ID NO: 646795 - DNA, 20 bp, Artificial
  CRISPR gRNA sequence
tagggaaggagtggagagag

SEQ ID NO: 646796 - DNA, 20 bp, Artificial
  CRISPR gRNA sequence
agggaaggagtggagagagg

SEQ ID NO: 646797 - DNA, 20 bp, Artificial
  CRISPR gRNA sequence
gggaaggagtggagagaggt

SEQ ID NO: 646798 - DNA, 20 bp, Artificial
  CRISPR gRNA sequence
gtttgttttgttttagcatg

SEQ ID NO: 646799 - DNA, 20 bp, Artificial
  CRISPR gRNA sequence
tttgttttgttttagcatgt

SEQ ID NO: 646800 - DNA, 20 bp, Artificial
  CRISPR gRNA sequence
gttttgttttagcatgtttc

SEQ ID NO: 646801 - DNA, 20 bp, Artificial
  CRISPR gRNA sequence
ttttgttttagcatgtttct

SEQ ID NO: 646802 - DNA, 20 bp, Artificial
  CRISPR gRNA sequence
tgttttagcatgtttctaaa

SEQ ID NO: 646803 - DNA, 20 bp, Artificial
  CRISPR gRNA sequence
gttttagcatgtttctaaat

SEQ ID NO: 646804 - DNA, 20 bp, Artificial
  CRISPR gRNA sequence
ttttagcatgtttctaaatg

SEQ ID NO: 646805 - DNA, 20 bp, Artificial
  CRISPR gRNA sequence
tagcatgtttctaaatgtgc

SEQ ID NO: 646806 - DNA, 20 bp, Artificial
  CRISPR gRNA sequence
agcatgtttctaaatgtgcc

SEQ ID NO: 646807 - DNA, 20 bp, Artificial
  CRISPR gRNA sequence
gcatgtttctaaatgtgcct

SEQ ID NO: 646808 - DNA, 20 bp, Artificial
  CRISPR gRNA sequence
ctaaatgtgcctgggattat

SEQ ID NO: 646809 - DNA, 20 bp, Artificial
  CRISPR gRNA sequence
taaatgtgcctgggattata

SEQ ID NO: 646810 - DNA, 20 bp, Artificial
  CRISPR gRNA sequence
aatgtgcctgggattatatt

SEQ ID NO: 646811 - DNA, 20 bp, Artificial
  CRISPR gRNA sequence
ggattatattcttaaagttg

SEQ ID NO: 646812 - DNA, 20 bp, Artificial
  CRISPR gRNA sequence
tattcttaaagttggcatct

SEQ ID NO: 646813 - DNA, 20 bp, Artificial
  CRISPR gRNA sequence
ttaaagttggcatctattga

SEQ ID NO: 646814 - DNA, 20 bp, Artificial
  CRISPR gRNA sequence
aaagttggcatctattgagc

SEQ ID NO: 646815 - DNA, 20 bp, Artificial
  CRISPR gRNA sequence
aagttggcatctattgagca

SEQ ID NO: 646816 - DNA, 20 bp, Artificial
  CRISPR gRNA sequence
gcatctattgagcaaggagg

SEQ ID NO: 646817 - DNA, 20 bp, Artificial
  CRISPR gRNA sequence
ttgagcaaggaggggcaagg

SEQ ID NO: 646818 - DNA, 20 bp, Artificial
  CRISPR gRNA sequence
agcaaggaggggcaaggata

SEQ ID NO: 646819 - DNA, 20 bp, Artificial
  CRISPR gRNA sequence
gacagaaataaaggtaaata

SEQ ID NO: 646820 - DNA, 20 bp, Artificial
  CRISPR gRNA sequence
acagaaataaaggtaaatag

SEQ ID NO: 646821 - DNA, 20 bp, Artificial
  CRISPR gRNA sequence
tttttatactcatcacaagg

SEQ ID NO: 646822 - DNA, 20 bp, Artificial
  CRISPR gRNA sequence
ttatactcatcacaaggatg

SEQ ID NO: 646823 - DNA, 20 bp, Artificial
  CRISPR gRNA sequence
tatactcatcacaaggatga

SEQ ID NO: 646824 - DNA, 20 bp, Artificial
  CRISPR gRNA sequence
atactcatcacaaggatgac

SEQ ID NO: 646825 - DNA, 20 bp, Artificial
  CRISPR gRNA sequence
tactcatcacaaggatgaca

SEQ ID NO: 646826 - DNA, 20 bp, Artificial
  CRISPR gRNA sequence
atcacaaggatgacaagtgc

SEQ ID NO: 646827 - DNA, 20 bp, Artificial
  CRISPR gRNA sequence
gcaatggccagaatgcctat

SEQ ID NO: 646828 - DNA, 20 bp, Artificial
  CRISPR gRNA sequence
tctcccactgcaactgcaat

SEQ ID NO: 646829 - DNA, 20 bp, Artificial
  CRISPR gRNA sequence
ccactgcaactgcaatccca

SEQ ID NO: 646830 - DNA, 20 bp, Artificial
  CRISPR gRNA sequence
caactgcaatcccaaactcc

SEQ ID NO: 646831 - DNA, 20 bp, Artificial
  CRISPR gRNA sequence
caatcccaaactcctcctaa

SEQ ID NO: 646832 - DNA, 20 bp, Artificial
  CRISPR gRNA sequence
ctcctaatatacctgtaata

SEQ ID NO: 646833 - DNA, 20 bp, Artificial
  CRISPR gRNA sequence
ctaatatacctgtaataatc

SEQ ID NO: 646834 - DNA, 20 bp, Artificial
  CRISPR gRNA sequence
atatacctgtaataatcagt

SEQ ID NO: 646835 - DNA, 20 bp, Artificial
  CRISPR gRNA sequence
taataatcagttacgtctaa

SEQ ID NO: 646836 - DNA, 20 bp, Artificial
  CRISPR gRNA sequence
cgtctaatacatctcttgag

SEQ ID NO: 646837 - DNA, 20 bp, Artificial
  CRISPR gRNA sequence
atacatctcttgagcctggt

SEQ ID NO: 646838 - DNA, 20 bp, Artificial
  CRISPR gRNA sequence
ttgagcctggttctctgcct

SEQ ID NO: 646839 - DNA, 20 bp, Artificial
  CRISPR gRNA sequence
gagcctggttctctgcctta

SEQ ID NO: 646840 - DNA, 20 bp, Artificial
  CRISPR gRNA sequence
agcctggttctctgccttaa

SEQ ID NO: 646841 - DNA, 20 bp, Artificial
  CRISPR gRNA sequence
gttctctgccttaaatgtct

SEQ ID NO: 646842 - DNA, 20 bp, Artificial
  CRISPR gRNA sequence
tctgccttaaatgtcttcct

SEQ ID NO: 646843 - DNA, 20 bp, Artificial
  CRISPR gRNA sequence
tgccttaaatgtcttcctaa

SEQ ID NO: 646844 - DNA, 20 bp, Artificial
  CRISPR gRNA sequence
ccttaaatgtcttcctaaaa

SEQ ID NO: 646845 - DNA, 20 bp, Artificial
  CRISPR gRNA sequence
aaatgtcttcctaaaatctc

SEQ ID NO: 646846 - DNA, 20 bp, Artificial
  CRISPR gRNA sequence
aatgtcttcctaaaatctct

SEQ ID NO: 646847 - DNA, 20 bp, Artificial
  CRISPR gRNA sequence
cctaaaatctctaacattga

SEQ ID NO: 646848 - DNA, 20 bp, Artificial
  CRISPR gRNA sequence
ctaaaatctctaacattgac

SEQ ID NO: 646849 - DNA, 20 bp, Artificial
  CRISPR gRNA sequence
aaatctctaacattgacacc

SEQ ID NO: 646850 - DNA, 20 bp, Artificial
  CRISPR gRNA sequence
taacattgacacccaactcc

SEQ ID NO: 646851 - DNA, 20 bp, Artificial
  CRISPR gRNA sequence
acattgacacccaactccaa

SEQ ID NO: 646852 - DNA, 20 bp, Artificial
  CRISPR gRNA sequence
acacccaactccaaattttg

SEQ ID NO: 646853 - DNA, 20 bp, Artificial
  CRISPR gRNA sequence
caaattttgagttcaaataa

SEQ ID NO: 646854 - DNA, 20 bp, Artificial
  CRISPR gRNA sequence
tgagttcaaataatagctga

SEQ ID NO: 646855 - DNA, 20 bp, Artificial
  CRISPR gRNA sequence
gagttcaaataatagctgac

SEQ ID NO: 646856 - DNA, 20 bp, Artificial
  CRISPR gRNA sequence
agttcaaataatagctgact

SEQ ID NO: 646857 - DNA, 20 bp, Artificial
  CRISPR gRNA sequence
aaataatagctgactgaaag

SEQ ID NO: 646858 - DNA, 20 bp, Artificial
  CRISPR gRNA sequence
actgaaagttttcaatatat

SEQ ID NO: 646859 - DNA, 20 bp, Artificial
  CRISPR gRNA sequence
aaagttttcaatatattttc

SEQ ID NO: 646860 - DNA, 20 bp, Artificial
  CRISPR gRNA sequence
tcaatatattttcagtgttt

SEQ ID NO: 646861 - DNA, 20 bp, Artificial
  CRISPR gRNA sequence
caatatattttcagtgttta

SEQ ID NO: 646862 - DNA, 20 bp, Artificial
  CRISPR gRNA sequence
aatatattttcagtgtttat

SEQ ID NO: 646863 - DNA, 20 bp, Artificial
  CRISPR gRNA sequence
tcagtgtttatatttgctaa

SEQ ID NO: 646864 - DNA, 20 bp, Artificial
  CRISPR gRNA sequence
cagtgtttatatttgctaag

SEQ ID NO: 646865 - DNA, 20 bp, Artificial
  CRISPR gRNA sequence
agtgtttatatttgctaagg

SEQ ID NO: 646866 - DNA, 20 bp, Artificial
  CRISPR gRNA sequence
atatttgctaaggataatag

SEQ ID NO: 646867 - DNA, 20 bp, Artificial
  CRISPR gRNA sequence
tatttgctaaggataatagg

SEQ ID NO: 646868 - DNA, 20 bp, Artificial
  CRISPR gRNA sequence
gctaaggataataggttttc

SEQ ID NO: 646869 - DNA, 20 bp, Artificial
  CRISPR gRNA sequence
ctaaggataataggttttcc

SEQ ID NO: 646870 - DNA, 20 bp, Artificial
  CRISPR gRNA sequence
aggataataggttttcctga

SEQ ID NO: 646871 - DNA, 20 bp, Artificial
  CRISPR gRNA sequence
tcctgaaaaaaaattttctt

SEQ ID NO: 646872 - DNA, 20 bp, Artificial
  CRISPR gRNA sequence
cctgaaaaaaaattttcttc

SEQ ID NO: 646873 - DNA, 20 bp, Artificial
  CRISPR gRNA sequence
ctgaaaaaaaattttcttcc

SEQ ID NO: 646874 - DNA, 20 bp, Artificial
  CRISPR gRNA sequence
aaaaaaaattttcttcctca

SEQ ID NO: 646875 - DNA, 20 bp, Artificial
  CRISPR gRNA sequence
tcttcctcagagtaatctaa

SEQ ID NO: 646876 - DNA, 20 bp, Artificial
  CRISPR gRNA sequence
cttcctcagagtaatctaaa

SEQ ID NO: 646877 - DNA, 20 bp, Artificial
  CRISPR gRNA sequence
ttcctcagagtaatctaaaa

SEQ ID NO: 646878 - DNA, 20 bp, Artificial
  CRISPR gRNA sequence
cctcagagtaatctaaaatc

SEQ ID NO: 646879 - DNA, 20 bp, Artificial
  CRISPR gRNA sequence
ctcagagtaatctaaaatca

SEQ ID NO: 646880 - DNA, 20 bp, Artificial
  CRISPR gRNA sequence
agagtaatctaaaatcaaat

SEQ ID NO: 646881 - DNA, 20 bp, Artificial
  CRISPR gRNA sequence
aaatcaaatcttcctctata

SEQ ID NO: 646882 - DNA, 20 bp, Artificial
  CRISPR gRNA sequence
cctctataataaaaaggtgt

SEQ ID NO: 646883 - DNA, 20 bp, Artificial
  CRISPR gRNA sequence
ctctataataaaaaggtgtg

SEQ ID NO: 646884 - DNA, 20 bp, Artificial
  CRISPR gRNA sequence
tataataaaaaggtgtggat

SEQ ID NO: 646885 - DNA, 20 bp, Artificial
  CRISPR gRNA sequence
taataaaaaggtgtggatgt

SEQ ID NO: 646886 - DNA, 20 bp, Artificial
  CRISPR gRNA sequence
taggggcaaaggtgcaacgg

SEQ ID NO: 646887 - DNA, 20 bp, Artificial
  CRISPR gRNA sequence
ttttttactctgacaagtat

SEQ ID NO: 646888 - DNA, 20 bp, Artificial
  CRISPR gRNA sequence
tttttactctgacaagtatt

SEQ ID NO: 646889 - DNA, 20 bp, Artificial
  CRISPR gRNA sequence
ttttactctgacaagtattc

SEQ ID NO: 646890 - DNA, 20 bp, Artificial
  CRISPR gRNA sequence
tttactctgacaagtattct

SEQ ID NO: 646891 - DNA, 20 bp, Artificial
  CRISPR gRNA sequence
ttactctgacaagtattctg

SEQ ID NO: 646892 - DNA, 20 bp, Artificial
  CRISPR gRNA sequence
tactctgacaagtattctga

SEQ ID NO: 646893 - DNA, 20 bp, Artificial
  CRISPR gRNA sequence
actctgacaagtattctgat

SEQ ID NO: 646894 - DNA, 20 bp, Artificial
  CRISPR gRNA sequence
ctctgacaagtattctgata

SEQ ID NO: 646895 - DNA, 20 bp, Artificial
  CRISPR gRNA sequence
tgacaagtattctgatagtt

SEQ ID NO: 646896 - DNA, 20 bp, Artificial
  CRISPR gRNA sequence
acaagtattctgatagtttg

SEQ ID NO: 646897 - DNA, 20 bp, Artificial
  CRISPR gRNA sequence
tgatagtttgactttgagag

SEQ ID NO: 646898 - DNA, 20 bp, Artificial
  CRISPR gRNA sequence
atagtttgactttgagagat

SEQ ID NO: 646899 - DNA, 20 bp, Artificial
  CRISPR gRNA sequence
gactttgagagatcctaaat

SEQ ID NO: 646900 - DNA, 20 bp, Artificial
  CRISPR gRNA sequence
actttgagagatcctaaatg

SEQ ID NO: 646901 - DNA, 20 bp, Artificial
  CRISPR gRNA sequence
tgagagatcctaaatgtaaa

SEQ ID NO: 646902 - DNA, 20 bp, Artificial
  CRISPR gRNA sequence
gagagatcctaaatgtaaat

SEQ ID NO: 646903 - DNA, 20 bp, Artificial
  CRISPR gRNA sequence
agagatcctaaatgtaaatt

SEQ ID NO: 646904 - DNA, 20 bp, Artificial
  CRISPR gRNA sequence
aatgtaaattgttacagaaa

SEQ ID NO: 646905 - DNA, 20 bp, Artificial
  CRISPR gRNA sequence
ttacagaaacatctaaaacg

SEQ ID NO: 646906 - DNA, 20 bp, Artificial
  CRISPR gRNA sequence
cagaaacatctaaaacgtta

SEQ ID NO: 646907 - DNA, 20 bp, Artificial
  CRISPR gRNA sequence
aaacgttattttgaattaaa

SEQ ID NO: 646908 - DNA, 20 bp, Artificial
  CRISPR gRNA sequence
ttttgaattaaatcaaatat

SEQ ID NO: 646909 - DNA, 20 bp, Artificial
  CRISPR gRNA sequence
tgaattaaatcaaatattta

SEQ ID NO: 646910 - DNA, 20 bp, Artificial
  CRISPR gRNA sequence
gaattaaatcaaatatttaa

SEQ ID NO: 646911 - DNA, 20 bp, Artificial
  CRISPR gRNA sequence
aattaaatcaaatatttaaa

SEQ ID NO: 646912 - DNA, 20 bp, Artificial
  CRISPR gRNA sequence
aatcaaatatttaaaaagac

SEQ ID NO: 646913 - DNA, 20 bp, Artificial
  CRISPR gRNA sequence
aaaaagaccaagttttttct

SEQ ID NO: 646914 - DNA, 20 bp, Artificial
  CRISPR gRNA sequence
aaaagaccaagttttttctt

SEQ ID NO: 646915 - DNA, 20 bp, Artificial
  CRISPR gRNA sequence
tttcttcctttcctatttct

SEQ ID NO: 646916 - DNA, 20 bp, Artificial
  CRISPR gRNA sequence
ttcttcctttcctatttctt

SEQ ID NO: 646917 - DNA, 20 bp, Artificial
  CRISPR gRNA sequence
tcttcctttcctatttcttc

SEQ ID NO: 646918 - DNA, 20 bp, Artificial
  CRISPR gRNA sequence
cttcctttcctatttcttcc

SEQ ID NO: 646919 - DNA, 20 bp, Artificial
  CRISPR gRNA sequence
ttcctttcctatttcttcca

SEQ ID NO: 646920 - DNA, 20 bp, Artificial
  CRISPR gRNA sequence
cctttcctatttcttccatt

SEQ ID NO: 646921 - DNA, 20 bp, Artificial
  CRISPR gRNA sequence
ctttcctatttcttccattt

SEQ ID NO: 646922 - DNA, 20 bp, Artificial
  CRISPR gRNA sequence
tcctatttcttccatttatt

SEQ ID NO: 646923 - DNA, 20 bp, Artificial
  CRISPR gRNA sequence
cctatttcttccatttattt

SEQ ID NO: 646924 - DNA, 20 bp, Artificial
  CRISPR gRNA sequence
ctatttcttccatttattta

SEQ ID NO: 646925 - DNA, 20 bp, Artificial
  CRISPR gRNA sequence
tttcttccatttatttactg

SEQ ID NO: 646926 - DNA, 20 bp, Artificial
  CRISPR gRNA sequence
cttccatttatttactgttg

SEQ ID NO: 646927 - DNA, 20 bp, Artificial
  CRISPR gRNA sequence
ttccatttatttactgttgg

SEQ ID NO: 646928 - DNA, 20 bp, Artificial
  CRISPR gRNA sequence
ccatttatttactgttggat

SEQ ID NO: 646929 - DNA, 20 bp, Artificial
  CRISPR gRNA sequence
catttatttactgttggatg

SEQ ID NO: 646930 - DNA, 20 bp, Artificial
  CRISPR gRNA sequence
atttactgttggatggactt

SEQ ID NO: 646931 - DNA, 20 bp, Artificial
  CRISPR gRNA sequence
tttactgttggatggacttg

SEQ ID NO: 646932 - DNA, 20 bp, Artificial
  CRISPR gRNA sequence
actgttggatggacttgaga

SEQ ID NO: 646933 - DNA, 20 bp, Artificial
  CRISPR gRNA sequence
ctgttggatggacttgagaa

SEQ ID NO: 646934 - DNA, 20 bp, Artificial
  CRISPR gRNA sequence
ttggatggacttgagaaatg

SEQ ID NO: 646935 - DNA, 20 bp, Artificial
  CRISPR gRNA sequence
gatggacttgagaaatggaa

SEQ ID NO: 646936 - DNA, 20 bp, Artificial
  CRISPR gRNA sequence
gagaaatggaattaatagtg

SEQ ID NO: 646937 - DNA, 20 bp, Artificial
  CRISPR gRNA sequence
agaaatggaattaatagtga

SEQ ID NO: 646938 - DNA, 20 bp, Artificial
  CRISPR gRNA sequence
atagtgattatttaattggc

SEQ ID NO: 646939 - DNA, 20 bp, Artificial
  CRISPR gRNA sequence
tttaattggccatgtgatgt

SEQ ID NO: 646940 - DNA, 20 bp, Artificial
  CRISPR gRNA sequence
aattggccatgtgatgtatg

SEQ ID NO: 646941 - DNA, 20 bp, Artificial
  CRISPR gRNA sequence
attggccatgtgatgtatga

SEQ ID NO: 646942 - DNA, 20 bp, Artificial
  CRISPR gRNA sequence
gccatgtgatgtatgacact

SEQ ID NO: 646943 - DNA, 20 bp, Artificial
  CRISPR gRNA sequence
aatgaaccaaatgccttccc

SEQ ID NO: 646944 - DNA, 20 bp, Artificial
  CRISPR gRNA sequence
cccaaaataaagtgtatgaa

SEQ ID NO: 646945 - DNA, 20 bp, Artificial
  CRISPR gRNA sequence
ccaaaataaagtgtatgaaa

SEQ ID NO: 646946 - DNA, 20 bp, Artificial
  CRISPR gRNA sequence
agggtaagagatttttccaa

SEQ ID NO: 646947 - DNA, 20 bp, Artificial
  CRISPR gRNA sequence
ttccaaaagtcttccaaaaa

SEQ ID NO: 646948 - DNA, 20 bp, Artificial
  CRISPR gRNA sequence
tccaaaagtcttccaaaaag

SEQ ID NO: 646949 - DNA, 20 bp, Artificial
  CRISPR gRNA sequence
ccaaaagtcttccaaaaagt

SEQ ID NO: 646950 - DNA, 20 bp, Artificial
  CRISPR gRNA sequence
caaaagtcttccaaaaagtg

SEQ ID NO: 646951 - DNA, 20 bp, Artificial
  CRISPR gRNA sequence
ccaaaaagtgtgaaaatgtg

SEQ ID NO: 646952 - DNA, 20 bp, Artificial
  CRISPR gRNA sequence
caaaaagtgtgaaaatgtga

SEQ ID NO: 646953 - DNA, 20 bp, Artificial
  CRISPR gRNA sequence
aacagtaactgatttaatat

SEQ ID NO: 646954 - DNA, 20 bp, Artificial
  CRISPR gRNA sequence
atttaatatgattttgatca

SEQ ID NO: 646955 - DNA, 20 bp, Artificial
  CRISPR gRNA sequence
aatatgattttgatcaatgc

SEQ ID NO: 646956 - DNA, 20 bp, Artificial
  CRISPR gRNA sequence
atatgattttgatcaatgca

SEQ ID NO: 646957 - DNA, 20 bp, Artificial
  CRISPR gRNA sequence
tgatcaatgcaaaaacctct

SEQ ID NO: 646958 - DNA, 20 bp, Artificial
  CRISPR gRNA sequence
gatcaatgcaaaaacctctt

SEQ ID NO: 646959 - DNA, 20 bp, Artificial
  CRISPR gRNA sequence
atcaatgcaaaaacctctta

SEQ ID NO: 646960 - DNA, 20 bp, Artificial
  CRISPR gRNA sequence
ttaagaaacaaaagcacagg

SEQ ID NO: 646961 - DNA, 20 bp, Artificial
  CRISPR gRNA sequence
aagaaacaaaagcacaggct

SEQ ID NO: 646962 - DNA, 20 bp, Artificial
  CRISPR gRNA sequence
agaaacaaaagcacaggcta

SEQ ID NO: 646963 - DNA, 20 bp, Artificial
  CRISPR gRNA sequence
ggtgcggtggctcactccta

SEQ ID NO: 646964 - DNA, 20 bp, Artificial
  CRISPR gRNA sequence
actcctataatcccagcact

SEQ ID NO: 646965 - DNA, 20 bp, Artificial
  CRISPR gRNA sequence
ctataatcccagcactttgg

SEQ ID NO: 646966 - DNA, 20 bp, Artificial
  CRISPR gRNA sequence
taatcccagcactttgggag

SEQ ID NO: 646967 - DNA, 20 bp, Artificial
  CRISPR gRNA sequence
tgggagggcaacctgggcgg

SEQ ID NO: 646968 - DNA, 20 bp, Artificial
  CRISPR gRNA sequence
gggagggcaacctgggcgga

SEQ ID NO: 646969 - DNA, 20 bp, Artificial
  CRISPR gRNA sequence
ggagggcaacctgggcggat

SEQ ID NO: 646970 - DNA, 20 bp, Artificial
  CRISPR gRNA sequence
ggcggatcacgaggtcaaga

SEQ ID NO: 646971 - DNA, 20 bp, Artificial
  CRISPR gRNA sequence
gccaacatggtgaaacctca

SEQ ID NO: 646972 - DNA, 20 bp, Artificial
  CRISPR gRNA sequence
atctctactaaaaatacaaa

SEQ ID NO: 646973 - DNA, 20 bp, Artificial
  CRISPR gRNA sequence
tactaaaaatacaaaaatta

SEQ ID NO: 646974 - DNA, 20 bp, Artificial
  CRISPR gRNA sequence
ctaaaaatacaaaaattagc

SEQ ID NO: 646975 - DNA, 20 bp, Artificial
  CRISPR gRNA sequence
aaaatacaaaaattagctgg

SEQ ID NO: 646976 - DNA, 20 bp, Artificial
  CRISPR gRNA sequence
gctgggcatggtagcgcgcg

SEQ ID NO: 646977 - DNA, 20 bp, Artificial
  CRISPR gRNA sequence
ggcatggtagcgcgcgcctg

SEQ ID NO: 646978 - DNA, 20 bp, Artificial
  CRISPR gRNA sequence
tagtcccagctactcaggag

SEQ ID NO: 646979 - DNA, 20 bp, Artificial
  CRISPR gRNA sequence
ctcaggaggctgaggcagga

SEQ ID NO: 646980 - DNA, 20 bp, Artificial
  CRISPR gRNA sequence
aggaggctgaggcaggaaaa

SEQ ID NO: 646981 - DNA, 20 bp, Artificial
  CRISPR gRNA sequence
aggcaggaaaatcacttgaa

SEQ ID NO: 646982 - DNA, 20 bp, Artificial
  CRISPR gRNA sequence
gaacccgggaggcaactgta

SEQ ID NO: 646983 - DNA, 20 bp, Artificial
  CRISPR gRNA sequence
aacccgggaggcaactgtag

SEQ ID NO: 646984 - DNA, 20 bp, Artificial
  CRISPR gRNA sequence
tagtgagcccagatggtgcc

SEQ ID NO: 646985 - DNA, 20 bp, Artificial
  CRISPR gRNA sequence
cactccagcctggtgacaga

SEQ ID NO: 646986 - DNA, 20 bp, Artificial
  CRISPR gRNA sequence
cagcctggtgacagagtgag

SEQ ID NO: 646987 - DNA, 20 bp, Artificial
  CRISPR gRNA sequence
gtgacagagtgagactccat

SEQ ID NO: 646988 - DNA, 20 bp, Artificial
  CRISPR gRNA sequence
catctcaaaaaaaaaaaaaa

SEQ ID NO: 646989 - DNA, 20 bp, Artificial
  CRISPR gRNA sequence
aaaaaaaaaaaaaatcaaag

SEQ ID NO: 646990 - DNA, 20 bp, Artificial
  CRISPR gRNA sequence
tttctagaatgaaggcaaat

SEQ ID NO: 646991 - DNA, 20 bp, Artificial
  CRISPR gRNA sequence
ctagaatgaaggcaaatgca

SEQ ID NO: 646992 - DNA, 20 bp, Artificial
  CRISPR gRNA sequence
tagaatgaaggcaaatgcac

SEQ ID NO: 646993 - DNA, 20 bp, Artificial
  CRISPR gRNA sequence
gaatgaaggcaaatgcacgt

SEQ ID NO: 646994 - DNA, 20 bp, Artificial
  CRISPR gRNA sequence
acccttaaaagttacaacag

SEQ ID NO: 646995 - DNA, 20 bp, Artificial
  CRISPR gRNA sequence
aaaagttacaacagtgtagt

SEQ ID NO: 646996 - DNA, 20 bp, Artificial
  CRISPR gRNA sequence
aaagttacaacagtgtagtt

SEQ ID NO: 646997 - DNA, 20 bp, Artificial
  CRISPR gRNA sequence
caacagtgtagttttacatc

SEQ ID NO: 646998 - DNA, 20 bp, Artificial
  CRISPR gRNA sequence
tacatctggctcaaagaagg

SEQ ID NO: 646999 - DNA, 20 bp, Artificial
  CRISPR gRNA sequence
acatctggctcaaagaaggc

SEQ ID NO: 647000 - DNA, 20 bp, Artificial
  CRISPR gRNA sequence
catctggctcaaagaaggcg

SEQ ID NO: 647001 - DNA, 20 bp, Artificial
  CRISPR gRNA sequence
gctcaaagaaggcggaatca

SEQ ID NO: 647002 - DNA, 20 bp, Artificial
  CRISPR gRNA sequence
aaagaaggcggaatcacagt

SEQ ID NO: 647003 - DNA, 20 bp, Artificial
  CRISPR gRNA sequence
tagtaggtaatgctggatga

SEQ ID NO: 647004 - DNA, 20 bp, Artificial
  CRISPR gRNA sequence
gatgatggcagctgtgaaaa

SEQ ID NO: 647005 - DNA, 20 bp, Artificial
  CRISPR gRNA sequence
tgaaaaagctggataataaa

SEQ ID NO: 647006 - DNA, 20 bp, Artificial
  CRISPR gRNA sequence
gataataaatatatacaatc

SEQ ID NO: 647007 - DNA, 20 bp, Artificial
  CRISPR gRNA sequence
taataaagcatactgcatgt

SEQ ID NO: 647008 - DNA, 20 bp, Artificial
  CRISPR gRNA sequence
catgttcctacacaggtcta

SEQ ID NO: 647009 - DNA, 20 bp, Artificial
  CRISPR gRNA sequence
ctacacaggtctaaacctaa

SEQ ID NO: 647010 - DNA, 20 bp, Artificial
  CRISPR gRNA sequence
cacaggtctaaacctaattc

SEQ ID NO: 647011 - DNA, 20 bp, Artificial
  CRISPR gRNA sequence
aacctaattccattcattca

SEQ ID NO: 647012 - DNA, 20 bp, Artificial
  CRISPR gRNA sequence
attccattcattcagtattc

SEQ ID NO: 647013 - DNA, 20 bp, Artificial
  CRISPR gRNA sequence
cattcattcagtattcgata

SEQ ID NO: 647014 - DNA, 20 bp, Artificial
  CRISPR gRNA sequence
attcagtattcgatacgttt

SEQ ID NO: 647015 - DNA, 20 bp, Artificial
  CRISPR gRNA sequence
agtattcgatacgtttactg

SEQ ID NO: 647016 - DNA, 20 bp, Artificial
  CRISPR gRNA sequence
gatacgtttactgaagtttt

SEQ ID NO: 647017 - DNA, 20 bp, Artificial
  CRISPR gRNA sequence
actgaagttttaatcaatgt

SEQ ID NO: 647018 - DNA, 20 bp, Artificial
  CRISPR gRNA sequence
ctgaagttttaatcaatgtc

SEQ ID NO: 647019 - DNA, 20 bp, Artificial
  CRISPR gRNA sequence
aagttttaatcaatgtcagg

SEQ ID NO: 647020 - DNA, 20 bp, Artificial
  CRISPR gRNA sequence
taatcaatgtcaggcactgg

SEQ ID NO: 647021 - DNA, 20 bp, Artificial
  CRISPR gRNA sequence
aatcaatgtcaggcactggt

SEQ ID NO: 647022 - DNA, 20 bp, Artificial
  CRISPR gRNA sequence
atcaatgtcaggcactggtc

SEQ ID NO: 647023 - DNA, 20 bp, Artificial
  CRISPR gRNA sequence
gtctaagaaaatagtatcat

SEQ ID NO: 647024 - DNA, 20 bp, Artificial
  CRISPR gRNA sequence
agaaaatagtatcatgtctt

SEQ ID NO: 647025 - DNA, 20 bp, Artificial
  CRISPR gRNA sequence
acaatgtcttaaatatgaaa

SEQ ID NO: 647026 - DNA, 20 bp, Artificial
  CRISPR gRNA sequence
caatgtcttaaatatgaaac

SEQ ID NO: 647027 - DNA, 20 bp, Artificial
  CRISPR gRNA sequence
aaatatgaaacgatcctaat

SEQ ID NO: 647028 - DNA, 20 bp, Artificial
  CRISPR gRNA sequence
aatatgaaacgatcctaatt

SEQ ID NO: 647029 - DNA, 20 bp, Artificial
  CRISPR gRNA sequence
atttgaggtatgaggaagga

SEQ ID NO: 647030 - DNA, 20 bp, Artificial
  CRISPR gRNA sequence
gaggtatgaggaaggaaaac

SEQ ID NO: 647031 - DNA, 20 bp, Artificial
  CRISPR gRNA sequence
aggtatgaggaaggaaaaca

SEQ ID NO: 647032 - DNA, 20 bp, Artificial
  CRISPR gRNA sequence
gagagtaaacaacactagtc

SEQ ID NO: 647033 - DNA, 20 bp, Artificial
  CRISPR gRNA sequence
gtctcctcctgaataaatat

SEQ ID NO: 647034 - DNA, 20 bp, Artificial
  CRISPR gRNA sequence
ctcctgaataaatatgctat

SEQ ID NO: 647035 - DNA, 20 bp, Artificial
  CRISPR gRNA sequence
ctgaataaatatgctatact

SEQ ID NO: 647036 - DNA, 20 bp, Artificial
  CRISPR gRNA sequence
aataaatatgctatactatt

SEQ ID NO: 647037 - DNA, 20 bp, Artificial
  CRISPR gRNA sequence
tactattaaataaaattcca

SEQ ID NO: 647038 - DNA, 20 bp, Artificial
  CRISPR gRNA sequence
ttaaataaaattccataggc

SEQ ID NO: 647039 - DNA, 20 bp, Artificial
  CRISPR gRNA sequence
aataaaattccataggcata

SEQ ID NO: 647040 - DNA, 20 bp, Artificial
  CRISPR gRNA sequence
cataggcataaaacaatgga

SEQ ID NO: 647041 - DNA, 20 bp, Artificial
  CRISPR gRNA sequence
aaccacatagcgaatatttc

SEQ ID NO: 647042 - DNA, 20 bp, Artificial
  CRISPR gRNA sequence
accacatagcgaatatttcc

SEQ ID NO: 647043 - DNA, 20 bp, Artificial
  CRISPR gRNA sequence
cctttatctctctgccaccc

SEQ ID NO: 647044 - DNA, 20 bp, Artificial
  CRISPR gRNA sequence
ctttatctctctgccaccct

SEQ ID NO: 647045 - DNA, 20 bp, Artificial
  CRISPR gRNA sequence
tatctctctgccaccctggg

SEQ ID NO: 647046 - DNA, 20 bp, Artificial
  CRISPR gRNA sequence
atctctctgccaccctggga

SEQ ID NO: 647047 - DNA, 20 bp, Artificial
  CRISPR gRNA sequence
tctctctgccaccctgggaa

SEQ ID NO: 647048 - DNA, 20 bp, Artificial
  CRISPR gRNA sequence
tctgccaccctgggaaaatg

SEQ ID NO: 647049 - DNA, 20 bp, Artificial
  CRISPR gRNA sequence
tgccaccctgggaaaatgtc

SEQ ID NO: 647050 - DNA, 20 bp, Artificial
  CRISPR gRNA sequence
ccaccctgggaaaatgtctg

SEQ ID NO: 647051 - DNA, 20 bp, Artificial
  CRISPR gRNA sequence
ggaaaatgtctgttttcata

SEQ ID NO: 647052 - DNA, 20 bp, Artificial
  CRISPR gRNA sequence
ttttcatagtgaggtctctc

SEQ ID NO: 647053 - DNA, 20 bp, Artificial
  CRISPR gRNA sequence
tcatagtgaggtctctcaaa

SEQ ID NO: 647054 - DNA, 20 bp, Artificial
  CRISPR gRNA sequence
catagtgaggtctctcaaaa

SEQ ID NO: 647055 - DNA, 20 bp, Artificial
  CRISPR gRNA sequence
atagtgaggtctctcaaaat

SEQ ID NO: 647056 - DNA, 20 bp, Artificial
  CRISPR gRNA sequence
tcaaaatgatagcaaactaa

SEQ ID NO: 647057 - DNA, 20 bp, Artificial
  CRISPR gRNA sequence
aaaatgatagcaaactaatc

SEQ ID NO: 647058 - DNA, 20 bp, Artificial
  CRISPR gRNA sequence
atcagcagaggttcttgaga

SEQ ID NO: 647059 - DNA, 20 bp, Artificial
  CRISPR gRNA sequence
ttgagataatgggagcttgc

SEQ ID NO: 647060 - DNA, 20 bp, Artificial
  CRISPR gRNA sequence
gagataatgggagcttgcct

SEQ ID NO: 647061 - DNA, 20 bp, Artificial
  CRISPR gRNA sequence
agataatgggagcttgcctg

SEQ ID NO: 647062 - DNA, 20 bp, Artificial
  CRISPR gRNA sequence
gcctggctaaccaggcagcc

SEQ ID NO: 647063 - DNA, 20 bp, Artificial
  CRISPR gRNA sequence
cctggctaaccaggcagcct

SEQ ID NO: 647064 - DNA, 20 bp, Artificial
  CRISPR gRNA sequence
gctaaccaggcagcctgtcc

SEQ ID NO: 647065 - DNA, 20 bp, Artificial
  CRISPR gRNA sequence
accaggcagcctgtccatca

SEQ ID NO: 647066 - DNA, 20 bp, Artificial
  CRISPR gRNA sequence
tccatcaacttcagatccac

SEQ ID NO: 647067 - DNA, 20 bp, Artificial
  CRISPR gRNA sequence
cagatccacatatctcctga

SEQ ID NO: 647068 - DNA, 20 bp, Artificial
  CRISPR gRNA sequence
agatccacatatctcctgaa

SEQ ID NO: 647069 - DNA, 20 bp, Artificial
  CRISPR gRNA sequence
ctgaattataatcagagact

SEQ ID NO: 647070 - DNA, 20 bp, Artificial
  CRISPR gRNA sequence
aattataatcagagactgat

SEQ ID NO: 647071 - DNA, 20 bp, Artificial
  CRISPR gRNA sequence
taatcagagactgatgttca

SEQ ID NO: 647072 - DNA, 20 bp, Artificial
  CRISPR gRNA sequence
atgttcacaccctgaaacca

SEQ ID NO: 647073 - DNA, 20 bp, Artificial
  CRISPR gRNA sequence
acaccctgaaaccagtccat

SEQ ID NO: 647074 - DNA, 20 bp, Artificial
  CRISPR gRNA sequence
aaaccagtccataatttgaa

SEQ ID NO: 647075 - DNA, 20 bp, Artificial
  CRISPR gRNA sequence
gaactcctgccttaacaata

SEQ ID NO: 647076 - DNA, 20 bp, Artificial
  CRISPR gRNA sequence
aactcctgccttaacaataa

SEQ ID NO: 647077 - DNA, 20 bp, Artificial
  CRISPR gRNA sequence
ctgccttaacaataaattaa

SEQ ID NO: 647078 - DNA, 20 bp, Artificial
  CRISPR gRNA sequence
ccttaacaataaattaaaag

SEQ ID NO: 647079 - DNA, 20 bp, Artificial
  CRISPR gRNA sequence
aacaataaattaaaaggata

SEQ ID NO: 647080 - DNA, 20 bp, Artificial
  CRISPR gRNA sequence
acaataaattaaaaggatag

SEQ ID NO: 647081 - DNA, 20 bp, Artificial
  CRISPR gRNA sequence
aaaggataggtaaaggcaat

SEQ ID NO: 647082 - DNA, 20 bp, Artificial
  CRISPR gRNA sequence
aaaccatgtgaatctcaaca

SEQ ID NO: 647083 - DNA, 20 bp, Artificial
  CRISPR gRNA sequence
aacaagtatgttccatttac

SEQ ID NO: 647084 - DNA, 20 bp, Artificial
  CRISPR gRNA sequence
catttactatcttggaacag

SEQ ID NO: 647085 - DNA, 20 bp, Artificial
  CRISPR gRNA sequence
actatcttggaacagtcata

SEQ ID NO: 647086 - DNA, 20 bp, Artificial
  CRISPR gRNA sequence
ctatcttggaacagtcataa

SEQ ID NO: 647087 - DNA, 20 bp, Artificial
  CRISPR gRNA sequence
tcttggaacagtcataattg

SEQ ID NO: 647088 - DNA, 20 bp, Artificial
  CRISPR gRNA sequence
ggaacagtcataattggtat

SEQ ID NO: 647089 - DNA, 20 bp, Artificial
  CRISPR gRNA sequence
gaacagtcataattggtatt

SEQ ID NO: 647090 - DNA, 20 bp, Artificial
  CRISPR gRNA sequence
gtattagaccaagtttttcc

SEQ ID NO: 647091 - DNA, 20 bp, Artificial
  CRISPR gRNA sequence
gaccaagtttttcccgtcaa

SEQ ID NO: 647092 - DNA, 20 bp, Artificial
  CRISPR gRNA sequence
ttcccgtcaaaaccaaaaga

SEQ ID NO: 647093 - DNA, 20 bp, Artificial
  CRISPR gRNA sequence
tcccgtcaaaaccaaaagac

SEQ ID NO: 647094 - DNA, 20 bp, Artificial
  CRISPR gRNA sequence
cccgtcaaaaccaaaagaca

SEQ ID NO: 647095 - DNA, 20 bp, Artificial
  CRISPR gRNA sequence
ccgtcaaaaccaaaagacaa

SEQ ID NO: 647096 - DNA, 20 bp, Artificial
  CRISPR gRNA sequence
aacaccaaatgtcagtaaac

SEQ ID NO: 647097 - DNA, 20 bp, Artificial
  CRISPR gRNA sequence
acatggtgtaataaatactt

SEQ ID NO: 647098 - DNA, 20 bp, Artificial
  CRISPR gRNA sequence
ggattttattttactttaaa

SEQ ID NO: 647099 - DNA, 20 bp, Artificial
  CRISPR gRNA sequence
gattttattttactttaaag

SEQ ID NO: 647100 - DNA, 20 bp, Artificial
  CRISPR gRNA sequence
tattttactttaaagcattt

SEQ ID NO: 647101 - DNA, 20 bp, Artificial
  CRISPR gRNA sequence
attttactttaaagcattta

SEQ ID NO: 647102 - DNA, 20 bp, Artificial
  CRISPR gRNA sequence
ttttactttaaagcatttag

SEQ ID NO: 647103 - DNA, 20 bp, Artificial
  CRISPR gRNA sequence
tactttaaagcatttagcaa

SEQ ID NO: 647104 - DNA, 20 bp, Artificial
  CRISPR gRNA sequence
actttaaagcatttagcaaa

SEQ ID NO: 647105 - DNA, 20 bp, Artificial
  CRISPR gRNA sequence
ctttaaagcatttagcaaat

SEQ ID NO: 647106 - DNA, 20 bp, Artificial
  CRISPR gRNA sequence
taaagcatttagcaaataat

SEQ ID NO: 647107 - DNA, 20 bp, Artificial
  CRISPR gRNA sequence
aaagcatttagcaaataatt

SEQ ID NO: 647108 - DNA, 20 bp, Artificial
  CRISPR gRNA sequence
aagcatttagcaaataatta

SEQ ID NO: 647109 - DNA, 20 bp, Artificial
  CRISPR gRNA sequence
agcaaataattagccacccc

SEQ ID NO: 647110 - DNA, 20 bp, Artificial
  CRISPR gRNA sequence
gcaaataattagccacccca

SEQ ID NO: 647111 - DNA, 20 bp, Artificial
  CRISPR gRNA sequence
gccaccccattattacaatg

SEQ ID NO: 647112 - DNA, 20 bp, Artificial
  CRISPR gRNA sequence
ttacaatgtatgggtgtatg

SEQ ID NO: 647113 - DNA, 20 bp, Artificial
  CRISPR gRNA sequence
caatgtatgggtgtatgaca

SEQ ID NO: 647114 - DNA, 20 bp, Artificial
  CRISPR gRNA sequence
tgtaacatcagagctttctt

SEQ ID NO: 647115 - DNA, 20 bp, Artificial
  CRISPR gRNA sequence
tcttattttgtgtatgggta

SEQ ID NO: 647116 - DNA, 20 bp, Artificial
  CRISPR gRNA sequence
cttattttgtgtatgggtaa

SEQ ID NO: 647117 - DNA, 20 bp, Artificial
  CRISPR gRNA sequence
ttattttgtgtatgggtaaa

SEQ ID NO: 647118 - DNA, 20 bp, Artificial
  CRISPR gRNA sequence
attttgtgtatgggtaaaac

SEQ ID NO: 647119 - DNA, 20 bp, Artificial
  CRISPR gRNA sequence
ttttgtgtatgggtaaaaca

SEQ ID NO: 647120 - DNA, 20 bp, Artificial
  CRISPR gRNA sequence
tgtgtatgggtaaaacaagg

SEQ ID NO: 647121 - DNA, 20 bp, Artificial
  CRISPR gRNA sequence
gtgtatgggtaaaacaagga

SEQ ID NO: 647122 - DNA, 20 bp, Artificial
  CRISPR gRNA sequence
tgtatgggtaaaacaaggaa

SEQ ID NO: 647123 - DNA, 20 bp, Artificial
  CRISPR gRNA sequence
aactcttaaatatagcaaag

SEQ ID NO: 647124 - DNA, 20 bp, Artificial
  CRISPR gRNA sequence
ttaaatatagcaaagcactg

SEQ ID NO: 647125 - DNA, 20 bp, Artificial
  CRISPR gRNA sequence
aaatatagcaaagcactgtt

SEQ ID NO: 647126 - DNA, 20 bp, Artificial
  CRISPR gRNA sequence
aatatagcaaagcactgttt

SEQ ID NO: 647127 - DNA, 20 bp, Artificial
  CRISPR gRNA sequence
tttgaacctcttttaatgta

SEQ ID NO: 647128 - DNA, 20 bp, Artificial
  CRISPR gRNA sequence
gaacctcttttaatgtaaag

SEQ ID NO: 647129 - DNA, 20 bp, Artificial
  CRISPR gRNA sequence
aacctcttttaatgtaaagg

SEQ ID NO: 647130 - DNA, 20 bp, Artificial
  CRISPR gRNA sequence
ttttaatgtaaagggataac

SEQ ID NO: 647131 - DNA, 20 bp, Artificial
  CRISPR gRNA sequence
ttaatgtaaagggataacag

SEQ ID NO: 647132 - DNA, 20 bp, Artificial
  CRISPR gRNA sequence
taatgtaaagggataacaga

SEQ ID NO: 647133 - DNA, 20 bp, Artificial
  CRISPR gRNA sequence
aatgtaaagggataacagat

SEQ ID NO: 647134 - DNA, 20 bp, Artificial
  CRISPR gRNA sequence
atgtaaagggataacagatt

SEQ ID NO: 647135 - DNA, 20 bp, Artificial
  CRISPR gRNA sequence
tactttattgaccttctagt

SEQ ID NO: 647136 - DNA, 20 bp, Artificial
  CRISPR gRNA sequence
tattgaccttctagttaata

SEQ ID NO: 647137 - DNA, 20 bp, Artificial
  CRISPR gRNA sequence
attgaccttctagttaataa

SEQ ID NO: 647138 - DNA, 20 bp, Artificial
  CRISPR gRNA sequence
ttgaccttctagttaataac

SEQ ID NO: 647139 - DNA, 20 bp, Artificial
  CRISPR gRNA sequence
accttctagttaataacact

SEQ ID NO: 647140 - DNA, 20 bp, Artificial
  CRISPR gRNA sequence
ctagttaataacactatttt

SEQ ID NO: 647141 - DNA, 20 bp, Artificial
  CRISPR gRNA sequence
tagttaataacactattttt

SEQ ID NO: 647142 - DNA, 20 bp, Artificial
  CRISPR gRNA sequence
gttaataacactatttttag

SEQ ID NO: 647143 - DNA, 20 bp, Artificial
  CRISPR gRNA sequence
ataacactatttttagaaaa

SEQ ID NO: 647144 - DNA, 20 bp, Artificial
  CRISPR gRNA sequence
tttttagaaaaacaaaaatc

SEQ ID NO: 647145 - DNA, 20 bp, Artificial
  CRISPR gRNA sequence
ttagaaaaacaaaaatcata

SEQ ID NO: 647146 - DNA, 20 bp, Artificial
  CRISPR gRNA sequence
tagaaaaacaaaaatcatat

SEQ ID NO: 647147 - DNA, 20 bp, Artificial
  CRISPR gRNA sequence
agaaaaacaaaaatcatatt

SEQ ID NO: 647148 - DNA, 20 bp, Artificial
  CRISPR gRNA sequence
gaaaaacaaaaatcatatta

SEQ ID NO: 647149 - DNA, 20 bp, Artificial
  CRISPR gRNA sequence
ttaccatcttaaatgttaaa

SEQ ID NO: 647150 - DNA, 20 bp, Artificial
  CRISPR gRNA sequence
ccatcttaaatgttaaactc

SEQ ID NO: 647151 - DNA, 20 bp, Artificial
  CRISPR gRNA sequence
aaatgttaaactctttcttc

SEQ ID NO: 647152 - DNA, 20 bp, Artificial
  CRISPR gRNA sequence
aatgttaaactctttcttcg

SEQ ID NO: 647153 - DNA, 20 bp, Artificial
  CRISPR gRNA sequence
aactctttcttcgttacagg

SEQ ID NO: 647154 - DNA, 20 bp, Artificial
  CRISPR gRNA sequence
tttcttcgttacaggaacac

SEQ ID NO: 647155 - DNA, 20 bp, Artificial
  CRISPR gRNA sequence
tcttcgttacaggaacacaa

SEQ ID NO: 647156 - DNA, 20 bp, Artificial
  CRISPR gRNA sequence
cttcgttacaggaacacaaa

SEQ ID NO: 647157 - DNA, 20 bp, Artificial
  CRISPR gRNA sequence
ttcgttacaggaacacaaaa

SEQ ID NO: 647158 - DNA, 20 bp, Artificial
  CRISPR gRNA sequence
cgttacaggaacacaaaaaa

SEQ ID NO: 647159 - DNA, 20 bp, Artificial
  CRISPR gRNA sequence
gttacaggaacacaaaaaag

SEQ ID NO: 647160 - DNA, 20 bp, Artificial
  CRISPR gRNA sequence
caggaacacaaaaaagagat

SEQ ID NO: 647161 - DNA, 20 bp, Artificial
  CRISPR gRNA sequence
gtccattaccacagaaagaa

SEQ ID NO: 647162 - DNA, 20 bp, Artificial
  CRISPR gRNA sequence
ccacagaaagaattactctg

SEQ ID NO: 647163 - DNA, 20 bp, Artificial
  CRISPR gRNA sequence
ctctgtagctgttaataatt

SEQ ID NO: 647164 - DNA, 20 bp, Artificial
  CRISPR gRNA sequence
tgtagctgttaataattata

SEQ ID NO: 647165 - DNA, 20 bp, Artificial
  CRISPR gRNA sequence
tagctgttaataattataat

SEQ ID NO: 647166 - DNA, 20 bp, Artificial
  CRISPR gRNA sequence
ttaataattataatgtatgt

SEQ ID NO: 647167 - DNA, 20 bp, Artificial
  CRISPR gRNA sequence
ataattataatgtatgtatg

SEQ ID NO: 647168 - DNA, 20 bp, Artificial
  CRISPR gRNA sequence
taatgtatgtatgtgcttag

SEQ ID NO: 647169 - DNA, 20 bp, Artificial
  CRISPR gRNA sequence
agaaacatgaaacagtgttg

SEQ ID NO: 647170 - DNA, 20 bp, Artificial
  CRISPR gRNA sequence
gaaacatgaaacagtgttga

SEQ ID NO: 647171 - DNA, 20 bp, Artificial
  CRISPR gRNA sequence
aggacgtacaatgttaaagg

SEQ ID NO: 647172 - DNA, 20 bp, Artificial
  CRISPR gRNA sequence
aaggaaaattaattatgtca

SEQ ID NO: 647173 - DNA, 20 bp, Artificial
  CRISPR gRNA sequence
attatgtcataaataatttc

SEQ ID NO: 647174 - DNA, 20 bp, Artificial
  CRISPR gRNA sequence
tgtcataaataatttctatt

SEQ ID NO: 647175 - DNA, 20 bp, Artificial
  CRISPR gRNA sequence
ctattatacaatcccatcca

SEQ ID NO: 647176 - DNA, 20 bp, Artificial
  CRISPR gRNA sequence
tattatacaatcccatccat

SEQ ID NO: 647177 - DNA, 20 bp, Artificial
  CRISPR gRNA sequence
ttatacaatcccatccattt

SEQ ID NO: 647178 - DNA, 20 bp, Artificial
  CRISPR gRNA sequence
tacaatcccatccatttcca

SEQ ID NO: 647179 - DNA, 20 bp, Artificial
  CRISPR gRNA sequence
ccatgtttacatggtcatag

SEQ ID NO: 647180 - DNA, 20 bp, Artificial
  CRISPR gRNA sequence
catgtttacatggtcataga

SEQ ID NO: 647181 - DNA, 20 bp, Artificial
  CRISPR gRNA sequence
acatggtcatagaaaataat

SEQ ID NO: 647182 - DNA, 20 bp, Artificial
  CRISPR gRNA sequence
catggtcatagaaaataatc

SEQ ID NO: 647183 - DNA, 20 bp, Artificial
  CRISPR gRNA sequence
aacagatatactttgagttg

SEQ ID NO: 647184 - DNA, 20 bp, Artificial
  CRISPR gRNA sequence
tgagttgctaagtgaattat

SEQ ID NO: 647185 - DNA, 20 bp, Artificial
  CRISPR gRNA sequence
gagttgctaagtgaattata

SEQ ID NO: 647186 - DNA, 20 bp, Artificial
  CRISPR gRNA sequence
agttgctaagtgaattatat

SEQ ID NO: 647187 - DNA, 20 bp, Artificial
  CRISPR gRNA sequence
ctaagtgaattatatgcaaa

SEQ ID NO: 647188 - DNA, 20 bp, Artificial
  CRISPR gRNA sequence
agtgaattatatgcaaagca

SEQ ID NO: 647189 - DNA, 20 bp, Artificial
  CRISPR gRNA sequence
tatgcaaagcacttagaaca

SEQ ID NO: 647190 - DNA, 20 bp, Artificial
  CRISPR gRNA sequence
agaacaatgcctaatacaca

SEQ ID NO: 647191 - DNA, 20 bp, Artificial
  CRISPR gRNA sequence
gaacaatgcctaatacacag

SEQ ID NO: 647192 - DNA, 20 bp, Artificial
  CRISPR gRNA sequence
atacacagtaaatgctcttt

SEQ ID NO: 647193 - DNA, 20 bp, Artificial
  CRISPR gRNA sequence
tttaagaatttctgcaggct

SEQ ID NO: 647194 - DNA, 20 bp, Artificial
  CRISPR gRNA sequence
taagaatttctgcaggctgg

SEQ ID NO: 647195 - DNA, 20 bp, Artificial
  CRISPR gRNA sequence
aagaatttctgcaggctggg

SEQ ID NO: 647196 - DNA, 20 bp, Artificial
  CRISPR gRNA sequence
agaatttctgcaggctgggg

SEQ ID NO: 647197 - DNA, 20 bp, Artificial
  CRISPR gRNA sequence
ctgcaggctgggggcacagt

SEQ ID NO: 647198 - DNA, 20 bp, Artificial
  CRISPR gRNA sequence
tgcaggctgggggcacagtg

SEQ ID NO: 647199 - DNA, 20 bp, Artificial
  CRISPR gRNA sequence
caggctgggggcacagtggc

SEQ ID NO: 647200 - DNA, 20 bp, Artificial
  CRISPR gRNA sequence
ggggcacagtggctcacatc

SEQ ID NO: 647201 - DNA, 20 bp, Artificial
  CRISPR gRNA sequence
acatctgtaatcccagcatt

SEQ ID NO: 647202 - DNA, 20 bp, Artificial
  CRISPR gRNA sequence
taatcccagcattttgggag

SEQ ID NO: 647203 - DNA, 20 bp, Artificial
  CRISPR gRNA sequence
tgggaggccaaggcgggtgg

SEQ ID NO: 647204 - DNA, 20 bp, Artificial
  CRISPR gRNA sequence
gggaggccaaggcgggtgga

SEQ ID NO: 647205 - DNA, 20 bp, Artificial
  CRISPR gRNA sequence
ggaggccaaggcgggtggat

SEQ ID NO: 647206 - DNA, 20 bp, Artificial
  CRISPR gRNA sequence
cttgagtccaggagttcaag

SEQ ID NO: 647207 - DNA, 20 bp, Artificial
  CRISPR gRNA sequence
gagtccaggagttcaagacc

SEQ ID NO: 647208 - DNA, 20 bp, Artificial
  CRISPR gRNA sequence
agtccaggagttcaagacca

SEQ ID NO: 647209 - DNA, 20 bp, Artificial
  CRISPR gRNA sequence
aagaccagcctgggaaacac

SEQ ID NO: 647210 - DNA, 20 bp, Artificial
  CRISPR gRNA sequence
ggaaacacagtgggatcttg

SEQ ID NO: 647211 - DNA, 20 bp, Artificial
  CRISPR gRNA sequence
gtctgtacaaaaaacattta

SEQ ID NO: 647212 - DNA, 20 bp, Artificial
  CRISPR gRNA sequence
tctgtacaaaaaacatttaa

SEQ ID NO: 647213 - DNA, 20 bp, Artificial
  CRISPR gRNA sequence
tacaaaaaacatttaaaaaa

SEQ ID NO: 647214 - DNA, 20 bp, Artificial
  CRISPR gRNA sequence
aaaaaattatacaggcaggg

SEQ ID NO: 647215 - DNA, 20 bp, Artificial
  CRISPR gRNA sequence
aaaaattatacaggcagggt

SEQ ID NO: 647216 - DNA, 20 bp, Artificial
  CRISPR gRNA sequence
tacaggcagggtggcctgtg

SEQ ID NO: 647217 - DNA, 20 bp, Artificial
  CRISPR gRNA sequence
tgcctgtagtcccagctact

SEQ ID NO: 647218 - DNA, 20 bp, Artificial
  CRISPR gRNA sequence
tagtcccagctacttggaag

SEQ ID NO: 647219 - DNA, 20 bp, Artificial
  CRISPR gRNA sequence
cttggaaggctgaggtggga

SEQ ID NO: 647220 - DNA, 20 bp, Artificial
  CRISPR gRNA sequence
ggaaggctgaggtgggatga

SEQ ID NO: 647221 - DNA, 20 bp, Artificial
  CRISPR gRNA sequence
gaaggctgaggtgggatgat

SEQ ID NO: 647222 - DNA, 20 bp, Artificial
  CRISPR gRNA sequence
aggtgggatgatcacctgag

SEQ ID NO: 647223 - DNA, 20 bp, Artificial
  CRISPR gRNA sequence
aggctgtgaggtcgaagttg

SEQ ID NO: 647224 - DNA, 20 bp, Artificial
  CRISPR gRNA sequence
tgaggtcgaagttgacactg

SEQ ID NO: 647225 - DNA, 20 bp, Artificial
  CRISPR gRNA sequence
acactgagccatgatcgcat

SEQ ID NO: 647226 - DNA, 20 bp, Artificial
  CRISPR gRNA sequence
agccatgatcgcatcactgc

SEQ ID NO: 647227 - DNA, 20 bp, Artificial
  CRISPR gRNA sequence
cactcaagcctgggtgacag

SEQ ID NO: 647228 - DNA, 20 bp, Artificial
  CRISPR gRNA sequence
aagcctgggtgacagagtga

SEQ ID NO: 647229 - DNA, 20 bp, Artificial
  CRISPR gRNA sequence
ggtgacagagtgagaccctg

SEQ ID NO: 647230 - DNA, 20 bp, Artificial
  CRISPR gRNA sequence
tctcacacacaaaaatctgc

SEQ ID NO: 647231 - DNA, 20 bp, Artificial
  CRISPR gRNA sequence
acacacaaaaatctgctatt

SEQ ID NO: 647232 - DNA, 20 bp, Artificial
  CRISPR gRNA sequence
ctattatcattttgtatggt

SEQ ID NO: 647233 - DNA, 20 bp, Artificial
  CRISPR gRNA sequence
ttatcattttgtatggtaat

SEQ ID NO: 647234 - DNA, 20 bp, Artificial
  CRISPR gRNA sequence
tcattttgtatggtaattgg

SEQ ID NO: 647235 - DNA, 20 bp, Artificial
  CRISPR gRNA sequence
tgtatggtaattggctctga

SEQ ID NO: 647236 - DNA, 20 bp, Artificial
  CRISPR gRNA sequence
gtatggtaattggctctgaa

SEQ ID NO: 647237 - DNA, 20 bp, Artificial
  CRISPR gRNA sequence
tatggtaattggctctgaat

SEQ ID NO: 647238 - DNA, 20 bp, Artificial
  CRISPR gRNA sequence
gctctgaatgtacaattatg

SEQ ID NO: 647239 - DNA, 20 bp, Artificial
  CRISPR gRNA sequence
tgaatgtacaattatgactg

SEQ ID NO: 647240 - DNA, 20 bp, Artificial
  CRISPR gRNA sequence
aatgtacaattatgactgct

SEQ ID NO: 647241 - DNA, 20 bp, Artificial
  CRISPR gRNA sequence
tgactgctttagccctgact

SEQ ID NO: 647242 - DNA, 20 bp, Artificial
  CRISPR gRNA sequence
ctttagccctgacttccttt

SEQ ID NO: 647243 - DNA, 20 bp, Artificial
  CRISPR gRNA sequence
tagccctgacttccttttac

SEQ ID NO: 647244 - DNA, 20 bp, Artificial
  CRISPR gRNA sequence
agccctgacttccttttact

SEQ ID NO: 647245 - DNA, 20 bp, Artificial
  CRISPR gRNA sequence
gccctgacttccttttactt

SEQ ID NO: 647246 - DNA, 20 bp, Artificial
  CRISPR gRNA sequence
acttccttttacttgtgcat

SEQ ID NO: 647247 - DNA, 20 bp, Artificial
  CRISPR gRNA sequence
ccttttacttgtgcatgttc

SEQ ID NO: 647248 - DNA, 20 bp, Artificial
  CRISPR gRNA sequence
cttttacttgtgcatgttcc

SEQ ID NO: 647249 - DNA, 20 bp, Artificial
  CRISPR gRNA sequence
ttacttgtgcatgttcccct

SEQ ID NO: 647250 - DNA, 20 bp, Artificial
  CRISPR gRNA sequence
tacttgtgcatgttcccctt

SEQ ID NO: 647251 - DNA, 20 bp, Artificial
  CRISPR gRNA sequence
acttgtgcatgttccccttc

SEQ ID NO: 647252 - DNA, 20 bp, Artificial
  CRISPR gRNA sequence
cttgtgcatgttccccttct

SEQ ID NO: 647253 - DNA, 20 bp, Artificial
  CRISPR gRNA sequence
gtgcatgttccccttctcct

SEQ ID NO: 647254 - DNA, 20 bp, Artificial
  CRISPR gRNA sequence
tgcatgttccccttctcctt

SEQ ID NO: 647255 - DNA, 20 bp, Artificial
  CRISPR gRNA sequence
cccttctccttaattaacct

SEQ ID NO: 647256 - DNA, 20 bp, Artificial
  CRISPR gRNA sequence
ctccttaattaacctgcatt

SEQ ID NO: 647257 - DNA, 20 bp, Artificial
  CRISPR gRNA sequence
tccttaattaacctgcattc

SEQ ID NO: 647258 - DNA, 20 bp, Artificial
  CRISPR gRNA sequence
cttaattaacctgcattcat

SEQ ID NO: 647259 - DNA, 20 bp, Artificial
  CRISPR gRNA sequence
aattaacctgcattcattct

SEQ ID NO: 647260 - DNA, 20 bp, Artificial
  CRISPR gRNA sequence
attaacctgcattcattcta

SEQ ID NO: 647261 - DNA, 20 bp, Artificial
  CRISPR gRNA sequence
acctgcattcattctatcaa

SEQ ID NO: 647262 - DNA, 20 bp, Artificial
  CRISPR gRNA sequence
cattcattctatcaaaaatg

SEQ ID NO: 647263 - DNA, 20 bp, Artificial
  CRISPR gRNA sequence
attctatcaaaaatgtttat

SEQ ID NO: 647264 - DNA, 20 bp, Artificial
  CRISPR gRNA sequence
tatcaaaaatgtttattaaa

SEQ ID NO: 647265 - DNA, 20 bp, Artificial
  CRISPR gRNA sequence
tcaaaaatgtttattaaaaa

SEQ ID NO: 647266 - DNA, 20 bp, Artificial
  CRISPR gRNA sequence
attaaaaaacatatatcatt

SEQ ID NO: 647267 - DNA, 20 bp, Artificial
  CRISPR gRNA sequence
ttaaaaaacatatatcatta

SEQ ID NO: 647268 - DNA, 20 bp, Artificial
  CRISPR gRNA sequence
aaaaacatatatcattaaaa

SEQ ID NO: 647269 - DNA, 20 bp, Artificial
  CRISPR gRNA sequence
aaatataatttataaaaatc

SEQ ID NO: 647270 - DNA, 20 bp, Artificial
  CRISPR gRNA sequence
ataaaaatcacaattttcac

SEQ ID NO: 647271 - DNA, 20 bp, Artificial
  CRISPR gRNA sequence
taaaaatcacaattttcaca

SEQ ID NO: 647272 - DNA, 20 bp, Artificial
  CRISPR gRNA sequence
tcacatccaataatcacaat

SEQ ID NO: 647273 - DNA, 20 bp, Artificial
  CRISPR gRNA sequence
cacatccaataatcacaatt

SEQ ID NO: 647274 - DNA, 20 bp, Artificial
  CRISPR gRNA sequence
acatccaataatcacaattt

SEQ ID NO: 647275 - DNA, 20 bp, Artificial
  CRISPR gRNA sequence
ggaaaaagtaacccatatta

SEQ ID NO: 647276 - DNA, 20 bp, Artificial
  CRISPR gRNA sequence
gaaaaagtaacccatattat

SEQ ID NO: 647277 - DNA, 20 bp, Artificial
  CRISPR gRNA sequence
taaaaaattcatctaactgt

SEQ ID NO: 647278 - DNA, 20 bp, Artificial
  CRISPR gRNA sequence
atctaactgttgtacctcgt

SEQ ID NO: 647279 - DNA, 20 bp, Artificial
  CRISPR gRNA sequence
actgttgtacctcgtaattt

SEQ ID NO: 647280 - DNA, 20 bp, Artificial
  CRISPR gRNA sequence
ttgtacctcgtaatttgtac

SEQ ID NO: 647281 - DNA, 20 bp, Artificial
  CRISPR gRNA sequence
tacctcgtaatttgtactca

SEQ ID NO: 647282 - DNA, 20 bp, Artificial
  CRISPR gRNA sequence
gtaatttgtactcaacagca

SEQ ID NO: 647283 - DNA, 20 bp, Artificial
  CRISPR gRNA sequence
gtactcaacagcacttaggg

SEQ ID NO: 647284 - DNA, 20 bp, Artificial
  CRISPR gRNA sequence
tactcaacagcacttagggt

SEQ ID NO: 647285 - DNA, 20 bp, Artificial
  CRISPR gRNA sequence
aacagcacttagggtaaaat

SEQ ID NO: 647286 - DNA, 20 bp, Artificial
  CRISPR gRNA sequence
agggtaaaattccgtaggta

SEQ ID NO: 647287 - DNA, 20 bp, Artificial
  CRISPR gRNA sequence
gggtaaaattccgtaggtaa

SEQ ID NO: 647288 - DNA, 20 bp, Artificial
  CRISPR gRNA sequence
cgtaggtaaaaagcccagaa

SEQ ID NO: 647289 - DNA, 20 bp, Artificial
  CRISPR gRNA sequence
gaggtacataaggaagagaa

SEQ ID NO: 647290 - DNA, 20 bp, Artificial
  CRISPR gRNA sequence
aggtacataaggaagagaag

SEQ ID NO: 647291 - DNA, 20 bp, Artificial
  CRISPR gRNA sequence
aaatattaggcatctgagta

SEQ ID NO: 647292 - DNA, 20 bp, Artificial
  CRISPR gRNA sequence
ggcatctgagtattctgtgc

SEQ ID NO: 647293 - DNA, 20 bp, Artificial
  CRISPR gRNA sequence
agtattctgtgctgaacagc

SEQ ID NO: 647294 - DNA, 20 bp, Artificial
  CRISPR gRNA sequence
tgtgctgaacagcgaaagaa

SEQ ID NO: 647295 - DNA, 20 bp, Artificial
  CRISPR gRNA sequence
tgctgaacagcgaaagaaat

SEQ ID NO: 647296 - DNA, 20 bp, Artificial
  CRISPR gRNA sequence
aacagcgaaagaaattaatt

SEQ ID NO: 647297 - DNA, 20 bp, Artificial
  CRISPR gRNA sequence
atttcacaaaaactcctgac

SEQ ID NO: 647298 - DNA, 20 bp, Artificial
  CRISPR gRNA sequence
cacaaaaactcctgacccca

SEQ ID NO: 647299 - DNA, 20 bp, Artificial
  CRISPR gRNA sequence
acaaaaactcctgaccccaa

SEQ ID NO: 647300 - DNA, 20 bp, Artificial
  CRISPR gRNA sequence
ctgaccccaataaacagacc

SEQ ID NO: 647301 - DNA, 20 bp, Artificial
  CRISPR gRNA sequence
accccaataaacagaccagc

SEQ ID NO: 647302 - DNA, 20 bp, Artificial
  CRISPR gRNA sequence
aaaggagcaactgtcattca

SEQ ID NO: 647303 - DNA, 20 bp, Artificial
  CRISPR gRNA sequence
tcattcaacactgcctctcc

SEQ ID NO: 647304 - DNA, 20 bp, Artificial
  CRISPR gRNA sequence
aacactgcctctccaacaca

SEQ ID NO: 647305 - DNA, 20 bp, Artificial
  CRISPR gRNA sequence
cctctccaacacaagcctta

SEQ ID NO: 647306 - DNA, 20 bp, Artificial
  CRISPR gRNA sequence
tccaacacaagccttacgag

SEQ ID NO: 647307 - DNA, 20 bp, Artificial
  CRISPR gRNA sequence
caacacaagccttacgagat

SEQ ID NO: 647308 - DNA, 20 bp, Artificial
  CRISPR gRNA sequence
acgagatactgccattcaac

SEQ ID NO: 647309 - DNA, 20 bp, Artificial
  CRISPR gRNA sequence
cgagatactgccattcaacc

SEQ ID NO: 647310 - DNA, 20 bp, Artificial
  CRISPR gRNA sequence
ccattcaacccacagttact

SEQ ID NO: 647311 - DNA, 20 bp, Artificial
  CRISPR gRNA sequence
aacccacagttactgaataa

SEQ ID NO: 647312 - DNA, 20 bp, Artificial
  CRISPR gRNA sequence
ctgaataatcatatctcaca

SEQ ID NO: 647313 - DNA, 20 bp, Artificial
  CRISPR gRNA sequence
aataatcatatctcacattt

SEQ ID NO: 647314 - DNA, 20 bp, Artificial
  CRISPR gRNA sequence
acatttattggaacacttat

SEQ ID NO: 647315 - DNA, 20 bp, Artificial
  CRISPR gRNA sequence
attggaacacttattatatg

SEQ ID NO: 647316 - DNA, 20 bp, Artificial
  CRISPR gRNA sequence
ttggaacacttattatatgc

SEQ ID NO: 647317 - DNA, 20 bp, Artificial
  CRISPR gRNA sequence
gaacacttattatatgctcc

SEQ ID NO: 647318 - DNA, 20 bp, Artificial
  CRISPR gRNA sequence
attatatgctccatactttg

SEQ ID NO: 647319 - DNA, 20 bp, Artificial
  CRISPR gRNA sequence
ttatatgctccatactttgc

SEQ ID NO: 647320 - DNA, 20 bp, Artificial
  CRISPR gRNA sequence
tatgctccatactttgctaa

SEQ ID NO: 647321 - DNA, 20 bp, Artificial
  CRISPR gRNA sequence
catactttgctaagagattt

SEQ ID NO: 647322 - DNA, 20 bp, Artificial
  CRISPR gRNA sequence
tgctaagagatttaaaagct

SEQ ID NO: 647323 - DNA, 20 bp, Artificial
  CRISPR gRNA sequence
gctaagagatttaaaagctt

SEQ ID NO: 647324 - DNA, 20 bp, Artificial
  CRISPR gRNA sequence
ctaagagatttaaaagctta

SEQ ID NO: 647325 - DNA, 20 bp, Artificial
  CRISPR gRNA sequence
agagatttaaaagcttaata

SEQ ID NO: 647326 - DNA, 20 bp, Artificial
  CRISPR gRNA sequence
aaaagcttaatatcatttaa

SEQ ID NO: 647327 - DNA, 20 bp, Artificial
  CRISPR gRNA sequence
aaagcttaatatcatttaat

SEQ ID NO: 647328 - DNA, 20 bp, Artificial
  CRISPR gRNA sequence
aatatcatttaattctccca

SEQ ID NO: 647329 - DNA, 20 bp, Artificial
  CRISPR gRNA sequence
atatcatttaattctcccaa

SEQ ID NO: 647330 - DNA, 20 bp, Artificial
  CRISPR gRNA sequence
aattctcccaacagccttat

SEQ ID NO: 647331 - DNA, 20 bp, Artificial
  CRISPR gRNA sequence
attctcccaacagccttatg

SEQ ID NO: 647332 - DNA, 20 bp, Artificial
  CRISPR gRNA sequence
tcccaacagccttatgagag

SEQ ID NO: 647333 - DNA, 20 bp, Artificial
  CRISPR gRNA sequence
ccaacagccttatgagagag

SEQ ID NO: 647334 - DNA, 20 bp, Artificial
  CRISPR gRNA sequence
atgagagagatgttcttcaa

SEQ ID NO: 647335 - DNA, 20 bp, Artificial
  CRISPR gRNA sequence
tgagagagatgttcttcaac

SEQ ID NO: 647336 - DNA, 20 bp, Artificial
  CRISPR gRNA sequence
ttcaaccctttagggctgag

SEQ ID NO: 647337 - DNA, 20 bp, Artificial
  CRISPR gRNA sequence
caaccctttagggctgagag

SEQ ID NO: 647338 - DNA, 20 bp, Artificial
  CRISPR gRNA sequence
aaccctttagggctgagagg

SEQ ID NO: 647339 - DNA, 20 bp, Artificial
  CRISPR gRNA sequence
tagggctgagaggaatgagg

SEQ ID NO: 647340 - DNA, 20 bp, Artificial
  CRISPR gRNA sequence
agggctgagaggaatgaggc

SEQ ID NO: 647341 - DNA, 20 bp, Artificial
  CRISPR gRNA sequence
gggctgagaggaatgaggca

SEQ ID NO: 647342 - DNA, 20 bp, Artificial
  CRISPR gRNA sequence
agaggaatgaggcatggaga

SEQ ID NO: 647343 - DNA, 20 bp, Artificial
  CRISPR gRNA sequence
agtaacatatccaagatcac

SEQ ID NO: 647344 - DNA, 20 bp, Artificial
  CRISPR gRNA sequence
gtaagtagagccaagatttg

SEQ ID NO: 647345 - DNA, 20 bp, Artificial
  CRISPR gRNA sequence
gaacctaggccccagaattt

SEQ ID NO: 647346 - DNA, 20 bp, Artificial
  CRISPR gRNA sequence
aacctaggccccagaattta

SEQ ID NO: 647347 - DNA, 20 bp, Artificial
  CRISPR gRNA sequence
ggccccagaatttaatcagt

SEQ ID NO: 647348 - DNA, 20 bp, Artificial
  CRISPR gRNA sequence
aatcagtagttattgaacac

SEQ ID NO: 647349 - DNA, 20 bp, Artificial
  CRISPR gRNA sequence
atcagtagttattgaacacc

SEQ ID NO: 647350 - DNA, 20 bp, Artificial
  CRISPR gRNA sequence
ttgaacacctactccagaaa

SEQ ID NO: 647351 - DNA, 20 bp, Artificial
  CRISPR gRNA sequence
aacacctactccagaaaaaa

SEQ ID NO: 647352 - DNA, 20 bp, Artificial
  CRISPR gRNA sequence
ctccagaaaaaatgctaggc

SEQ ID NO: 647353 - DNA, 20 bp, Artificial
  CRISPR gRNA sequence
cagaaaaaatgctaggcaca

SEQ ID NO: 647354 - DNA, 20 bp, Artificial
  CRISPR gRNA sequence
ggcacaaggagctgctaact

SEQ ID NO: 647355 - DNA, 20 bp, Artificial
  CRISPR gRNA sequence
ctaactgcacaacagtcaag

SEQ ID NO: 647356 - DNA, 20 bp, Artificial
  CRISPR gRNA sequence
actgcacaacagtcaagaca

SEQ ID NO: 647357 - DNA, 20 bp, Artificial
  CRISPR gRNA sequence
cacaacagtcaagacatgct

SEQ ID NO: 647358 - DNA, 20 bp, Artificial
  CRISPR gRNA sequence
tgctaagggcaggggctcta

SEQ ID NO: 647359 - DNA, 20 bp, Artificial
  CRISPR gRNA sequence
ctaagggcaggggctctaac

SEQ ID NO: 647360 - DNA, 20 bp, Artificial
  CRISPR gRNA sequence
agggcaggggctctaacaat

SEQ ID NO: 647361 - DNA, 20 bp, Artificial
  CRISPR gRNA sequence
taacaattactctaggtcta

SEQ ID NO: 647362 - DNA, 20 bp, Artificial
  CRISPR gRNA sequence
acaattactctaggtctacc

SEQ ID NO: 647363 - DNA, 20 bp, Artificial
  CRISPR gRNA sequence
ctctaggtctaccctcttca

SEQ ID NO: 647364 - DNA, 20 bp, Artificial
  CRISPR gRNA sequence
taggtctaccctcttcaaat

SEQ ID NO: 647365 - DNA, 20 bp, Artificial
  CRISPR gRNA sequence
ggtctaccctcttcaaattc

SEQ ID NO: 647366 - DNA, 20 bp, Artificial
  CRISPR gRNA sequence
ccctcttcaaattctgatcc

SEQ ID NO: 647367 - DNA, 20 bp, Artificial
  CRISPR gRNA sequence
ttcaaattctgatcctgagt

SEQ ID NO: 647368 - DNA, 20 bp, Artificial
  CRISPR gRNA sequence
caaattctgatcctgagtcc

SEQ ID NO: 647369 - DNA, 20 bp, Artificial
  CRISPR gRNA sequence
aaattctgatcctgagtccc

SEQ ID NO: 647370 - DNA, 20 bp, Artificial
  CRISPR gRNA sequence
tgatcctgagtccctacatc

SEQ ID NO: 647371 - DNA, 20 bp, Artificial
  CRISPR gRNA sequence
atcctgagtccctacatcca

SEQ ID NO: 647372 - DNA, 20 bp, Artificial
  CRISPR gRNA sequence
agtccctacatccatcactg

SEQ ID NO: 647373 - DNA, 20 bp, Artificial
  CRISPR gRNA sequence
catccatcactgcagtcact

SEQ ID NO: 647374 - DNA, 20 bp, Artificial
  CRISPR gRNA sequence
cagtcactgcaactgcattt

SEQ ID NO: 647375 - DNA, 20 bp, Artificial
  CRISPR gRNA sequence
caactgcatttattgccact

SEQ ID NO: 647376 - DNA, 20 bp, Artificial
  CRISPR gRNA sequence
catttattgccacttgcacc

SEQ ID NO: 647377 - DNA, 20 bp, Artificial
  CRISPR gRNA sequence
attgccacttgcaccagaag

SEQ ID NO: 647378 - DNA, 20 bp, Artificial
  CRISPR gRNA sequence
ttgccacttgcaccagaagg

SEQ ID NO: 647379 - DNA, 20 bp, Artificial
  CRISPR gRNA sequence
ccacttgcaccagaaggcta

SEQ ID NO: 647380 - DNA, 20 bp, Artificial
  CRISPR gRNA sequence
gcaccagaaggctaattaca

SEQ ID NO: 647381 - DNA, 20 bp, Artificial
  CRISPR gRNA sequence
caccagaaggctaattacaa

SEQ ID NO: 647382 - DNA, 20 bp, Artificial
  CRISPR gRNA sequence
attacaatacttccgtttcc

SEQ ID NO: 647383 - DNA, 20 bp, Artificial
  CRISPR gRNA sequence
caatacttccgtttcccact

SEQ ID NO: 647384 - DNA, 20 bp, Artificial
  CRISPR gRNA sequence
ccgtttcccactcttgacaa

SEQ ID NO: 647385 - DNA, 20 bp, Artificial
  CRISPR gRNA sequence
cgtttcccactcttgacaat

SEQ ID NO: 647386 - DNA, 20 bp, Artificial
  CRISPR gRNA sequence
cccactcttgacaatgaaca

SEQ ID NO: 647387 - DNA, 20 bp, Artificial
  CRISPR gRNA sequence
ccactcttgacaatgaacag

SEQ ID NO: 647388 - DNA, 20 bp, Artificial
  CRISPR gRNA sequence
ttgacaatgaacaggggaaa

SEQ ID NO: 647389 - DNA, 20 bp, Artificial
  CRISPR gRNA sequence
gacaatgaacaggggaaagt

SEQ ID NO: 647390 - DNA, 20 bp, Artificial
  CRISPR gRNA sequence
acaatgaacaggggaaagtg

SEQ ID NO: 647391 - DNA, 20 bp, Artificial
  CRISPR gRNA sequence
cccaagttctgatttgtgat

SEQ ID NO: 647392 - DNA, 20 bp, Artificial
  CRISPR gRNA sequence
ccaagttctgatttgtgatt

SEQ ID NO: 647393 - DNA, 20 bp, Artificial
  CRISPR gRNA sequence
tgatttgtgatttaaaatgt

SEQ ID NO: 647394 - DNA, 20 bp, Artificial
  CRISPR gRNA sequence
atttgtgatttaaaatgtat

SEQ ID NO: 647395 - DNA, 20 bp, Artificial
  CRISPR gRNA sequence
gtgatttaaaatgtatttcc

SEQ ID NO: 647396 - DNA, 20 bp, Artificial
  CRISPR gRNA sequence
tgatttaaaatgtatttcct

SEQ ID NO: 647397 - DNA, 20 bp, Artificial
  CRISPR gRNA sequence
aaaatgtatttcctcatagt

SEQ ID NO: 647398 - DNA, 20 bp, Artificial
  CRISPR gRNA sequence
aaatgtatttcctcatagtg

SEQ ID NO: 647399 - DNA, 20 bp, Artificial
  CRISPR gRNA sequence
cctcatagtgttagtttgta

SEQ ID NO: 647400 - DNA, 20 bp, Artificial
  CRISPR gRNA sequence
ctcatagtgttagtttgtat

SEQ ID NO: 647401 - DNA, 20 bp, Artificial
  CRISPR gRNA sequence
atagtgttagtttgtataat

SEQ ID NO: 647402 - DNA, 20 bp, Artificial
  CRISPR gRNA sequence
gtttgtataatactattaac

SEQ ID NO: 647403 - DNA, 20 bp, Artificial
  CRISPR gRNA sequence
gtataatactattaacccta

SEQ ID NO: 647404 - DNA, 20 bp, Artificial
  CRISPR gRNA sequence
tataatactattaaccctac

SEQ ID NO: 647405 - DNA, 20 bp, Artificial
  CRISPR gRNA sequence
ttaaccctactacaattgcc

SEQ ID NO: 647406 - DNA, 20 bp, Artificial
  CRISPR gRNA sequence
accctactacaattgccaca

SEQ ID NO: 647407 - DNA, 20 bp, Artificial
  CRISPR gRNA sequence
ctacaattgccacattaact

SEQ ID NO: 647408 - DNA, 20 bp, Artificial
  CRISPR gRNA sequence
caattgccacattaactaag

SEQ ID NO: 647409 - DNA, 20 bp, Artificial
  CRISPR gRNA sequence
ccacattaactaagcctttt

SEQ ID NO: 647410 - DNA, 20 bp, Artificial
  CRISPR gRNA sequence
actaagcctttttattgttg

SEQ ID NO: 647411 - DNA, 20 bp, Artificial
  CRISPR gRNA sequence
agcctttttattgttgtttc

SEQ ID NO: 647412 - DNA, 20 bp, Artificial
  CRISPR gRNA sequence
tttattgttgtttctttcaa

SEQ ID NO: 647413 - DNA, 20 bp, Artificial
  CRISPR gRNA sequence
ttattgttgtttctttcaat

SEQ ID NO: 647414 - DNA, 20 bp, Artificial
  CRISPR gRNA sequence
tattgttgtttctttcaatg

SEQ ID NO: 647415 - DNA, 20 bp, Artificial
  CRISPR gRNA sequence
attgttgtttctttcaatgg

SEQ ID NO: 647416 - DNA, 20 bp, Artificial
  CRISPR gRNA sequence
ttgttgtttctttcaatgga

SEQ ID NO: 647417 - DNA, 20 bp, Artificial
  CRISPR gRNA sequence
ttgtttctttcaatggaatt

SEQ ID NO: 647418 - DNA, 20 bp, Artificial
  CRISPR gRNA sequence
tttctttcaatggaatttaa

SEQ ID NO: 647419 - DNA, 20 bp, Artificial
  CRISPR gRNA sequence
ctttcaatggaatttaacca

SEQ ID NO: 647420 - DNA, 20 bp, Artificial
  CRISPR gRNA sequence
tttcaatggaatttaaccac

SEQ ID NO: 647421 - DNA, 20 bp, Artificial
  CRISPR gRNA sequence
tcaatggaatttaaccacca

SEQ ID NO: 647422 - DNA, 20 bp, Artificial
  CRISPR gRNA sequence
caatggaatttaaccaccat

SEQ ID NO: 647423 - DNA, 20 bp, Artificial
  CRISPR gRNA sequence
aatggaatttaaccaccatt

SEQ ID NO: 647424 - DNA, 20 bp, Artificial
  CRISPR gRNA sequence
aaccaccatttttagcagtg

SEQ ID NO: 647425 - DNA, 20 bp, Artificial
  CRISPR gRNA sequence
accaccatttttagcagtgt

SEQ ID NO: 647426 - DNA, 20 bp, Artificial
  CRISPR gRNA sequence
ttagcagtgtttcaagtgaa

SEQ ID NO: 647427 - DNA, 20 bp, Artificial
  CRISPR gRNA sequence
tagcagtgtttcaagtgaaa

SEQ ID NO: 647428 - DNA, 20 bp, Artificial
  CRISPR gRNA sequence
agcagtgtttcaagtgaaaa

SEQ ID NO: 647429 - DNA, 20 bp, Artificial
  CRISPR gRNA sequence
gcagtgtttcaagtgaaaag

SEQ ID NO: 647430 - DNA, 20 bp, Artificial
  CRISPR gRNA sequence
caagtgaaaaggacattctt

SEQ ID NO: 647431 - DNA, 20 bp, Artificial
  CRISPR gRNA sequence
aagtgaaaaggacattcttt

SEQ ID NO: 647432 - DNA, 20 bp, Artificial
  CRISPR gRNA sequence
tttaaccccttcattttatt

SEQ ID NO: 647433 - DNA, 20 bp, Artificial
  CRISPR gRNA sequence
taaccccttcattttatttt

SEQ ID NO: 647434 - DNA, 20 bp, Artificial
  CRISPR gRNA sequence
aaccccttcattttattttt

SEQ ID NO: 647435 - DNA, 20 bp, Artificial
  CRISPR gRNA sequence
accccttcattttattttta

SEQ ID NO: 647436 - DNA, 20 bp, Artificial
  CRISPR gRNA sequence
cattttatttttaaagttgt

SEQ ID NO: 647437 - DNA, 20 bp, Artificial
  CRISPR gRNA sequence
attttatttttaaagttgtc

SEQ ID NO: 647438 - DNA, 20 bp, Artificial
  CRISPR gRNA sequence
tatttttaaagttgtcatac

SEQ ID NO: 647439 - DNA, 20 bp, Artificial
  CRISPR gRNA sequence
atttttaaagttgtcataca

SEQ ID NO: 647440 - DNA, 20 bp, Artificial
  CRISPR gRNA sequence
tttttaaagttgtcatacaa

SEQ ID NO: 647441 - DNA, 20 bp, Artificial
  CRISPR gRNA sequence
ttaaagttgtcatacaaaaa

SEQ ID NO: 647442 - DNA, 20 bp, Artificial
  CRISPR gRNA sequence
taaagttgtcatacaaaaaa

SEQ ID NO: 647443 - DNA, 20 bp, Artificial
  CRISPR gRNA sequence
aaagttgtcatacaaaaaac

SEQ ID NO: 647444 - DNA, 20 bp, Artificial
  CRISPR gRNA sequence
aagttgtcatacaaaaaaca

SEQ ID NO: 647445 - DNA, 20 bp, Artificial
  CRISPR gRNA sequence
tcatacaaaaaacatgagca

SEQ ID NO: 647446 - DNA, 20 bp, Artificial
  CRISPR gRNA sequence
ttttccttttagcattcagt

SEQ ID NO: 647447 - DNA, 20 bp, Artificial
  CRISPR gRNA sequence
tttccttttagcattcagtt

SEQ ID NO: 647448 - DNA, 20 bp, Artificial
  CRISPR gRNA sequence
ttccttttagcattcagttc

SEQ ID NO: 647449 - DNA, 20 bp, Artificial
  CRISPR gRNA sequence
tccttttagcattcagttct

SEQ ID NO: 647450 - DNA, 20 bp, Artificial
  CRISPR gRNA sequence
ccttttagcattcagttcta

SEQ ID NO: 647451 - DNA, 20 bp, Artificial
  CRISPR gRNA sequence
cttttagcattcagttctac

SEQ ID NO: 647452 - DNA, 20 bp, Artificial
  CRISPR gRNA sequence
ttagcattcagttctacaac

SEQ ID NO: 647453 - DNA, 20 bp, Artificial
  CRISPR gRNA sequence
tagcattcagttctacaaca

SEQ ID NO: 647454 - DNA, 20 bp, Artificial
  CRISPR gRNA sequence
agcattcagttctacaacat

SEQ ID NO: 647455 - DNA, 20 bp, Artificial
  CRISPR gRNA sequence
gcattcagttctacaacatg

SEQ ID NO: 647456 - DNA, 20 bp, Artificial
  CRISPR gRNA sequence
agttctacaacatgcataga

SEQ ID NO: 647457 - DNA, 20 bp, Artificial
  CRISPR gRNA sequence
tacaacatgcatagattctt

SEQ ID NO: 647458 - DNA, 20 bp, Artificial
  CRISPR gRNA sequence
caacatgcatagattcttat

SEQ ID NO: 647459 - DNA, 20 bp, Artificial
  CRISPR gRNA sequence
ttataaccactaccataatc

SEQ ID NO: 647460 - DNA, 20 bp, Artificial
  CRISPR gRNA sequence
ataaccactaccataatcag

SEQ ID NO: 647461 - DNA, 20 bp, Artificial
  CRISPR gRNA sequence
taaccactaccataatcagg

SEQ ID NO: 647462 - DNA, 20 bp, Artificial
  CRISPR gRNA sequence
ccataatcaggatacagaac

SEQ ID NO: 647463 - DNA, 20 bp, Artificial
  CRISPR gRNA sequence
tcattaaaaaaagagagacg

SEQ ID NO: 647464 - DNA, 20 bp, Artificial
  CRISPR gRNA sequence
attaaaaaaagagagacggc

SEQ ID NO: 647465 - DNA, 20 bp, Artificial
  CRISPR gRNA sequence
aaaaaagagagacggcttat

SEQ ID NO: 647466 - DNA, 20 bp, Artificial
  CRISPR gRNA sequence
ataaatggacttaaaagaca

SEQ ID NO: 647467 - DNA, 20 bp, Artificial
  CRISPR gRNA sequence
taaatggacttaaaagacaa

SEQ ID NO: 647468 - DNA, 20 bp, Artificial
  CRISPR gRNA sequence
aaaagacaatctctgttaca

SEQ ID NO: 647469 - DNA, 20 bp, Artificial
  CRISPR gRNA sequence
aaagacaatctctgttacat

SEQ ID NO: 647470 - DNA, 20 bp, Artificial
  CRISPR gRNA sequence
tgttacattaatgacttttt

SEQ ID NO: 647471 - DNA, 20 bp, Artificial
  CRISPR gRNA sequence
ttacattaatgactttttac

SEQ ID NO: 647472 - DNA, 20 bp, Artificial
  CRISPR gRNA sequence
cattaatgactttttactct

SEQ ID NO: 647473 - DNA, 20 bp, Artificial
  CRISPR gRNA sequence
atgactttttactctgtctt

SEQ ID NO: 647474 - DNA, 20 bp, Artificial
  CRISPR gRNA sequence
tttactctgtcttccaacac

SEQ ID NO: 647475 - DNA, 20 bp, Artificial
  CRISPR gRNA sequence
ttactctgtcttccaacaca

SEQ ID NO: 647476 - DNA, 20 bp, Artificial
  CRISPR gRNA sequence
tactctgtcttccaacacac

SEQ ID NO: 647477 - DNA, 20 bp, Artificial
  CRISPR gRNA sequence
actctgtcttccaacacacc

SEQ ID NO: 647478 - DNA, 20 bp, Artificial
  CRISPR gRNA sequence
ctctgtcttccaacacacca

SEQ ID NO: 647479 - DNA, 20 bp, Artificial
  CRISPR gRNA sequence
tgtcttccaacacaccaggc

SEQ ID NO: 647480 - DNA, 20 bp, Artificial
  CRISPR gRNA sequence
tcttccaacacaccaggctt

SEQ ID NO: 647481 - DNA, 20 bp, Artificial
  CRISPR gRNA sequence
ccaacacaccaggctttcct

SEQ ID NO: 647482 - DNA, 20 bp, Artificial
  CRISPR gRNA sequence
caacacaccaggctttcctt

SEQ ID NO: 647483 - DNA, 20 bp, Artificial
  CRISPR gRNA sequence
tccttctattctagaataag

SEQ ID NO: 647484 - DNA, 20 bp, Artificial
  CRISPR gRNA sequence
ccttctattctagaataagt

SEQ ID NO: 647485 - DNA, 20 bp, Artificial
  CRISPR gRNA sequence
cttctattctagaataagtg

SEQ ID NO: 647486 - DNA, 20 bp, Artificial
  CRISPR gRNA sequence
ctattctagaataagtgaat

SEQ ID NO: 647487 - DNA, 20 bp, Artificial
  CRISPR gRNA sequence
tattctagaataagtgaatt

SEQ ID NO: 647488 - DNA, 20 bp, Artificial
  CRISPR gRNA sequence
ttctagaataagtgaattgg

SEQ ID NO: 647489 - DNA, 20 bp, Artificial
  CRISPR gRNA sequence
tagaataagtgaattggaca

SEQ ID NO: 647490 - DNA, 20 bp, Artificial
  CRISPR gRNA sequence
gaataagtgaattggacacc

SEQ ID NO: 647491 - DNA, 20 bp, Artificial
  CRISPR gRNA sequence
gacaccacaatagaaacact

SEQ ID NO: 647492 - DNA, 20 bp, Artificial
  CRISPR gRNA sequence
ggtatatttttgcaaaatat

SEQ ID NO: 647493 - DNA, 20 bp, Artificial
  CRISPR gRNA sequence
gtatatttttgcaaaatata

SEQ ID NO: 647494 - DNA, 20 bp, Artificial
  CRISPR gRNA sequence
ttgcaaaatatattttgtat

SEQ ID NO: 647495 - DNA, 20 bp, Artificial
  CRISPR gRNA sequence
tgcaaaatatattttgtata

SEQ ID NO: 647496 - DNA, 20 bp, Artificial
  CRISPR gRNA sequence
gcaaaatatattttgtatac

SEQ ID NO: 647497 - DNA, 20 bp, Artificial
  CRISPR gRNA sequence
caaaatatattttgtatacc

SEQ ID NO: 647498 - DNA, 20 bp, Artificial
  CRISPR gRNA sequence
tgtatacctgtggctttcca

SEQ ID NO: 647499 - DNA, 20 bp, Artificial
  CRISPR gRNA sequence
gtatacctgtggctttccat

SEQ ID NO: 647500 - DNA, 20 bp, Artificial
  CRISPR gRNA sequence
tatacctgtggctttccatt

SEQ ID NO: 647501 - DNA, 20 bp, Artificial
  CRISPR gRNA sequence
tggctttccatttttaagga

SEQ ID NO: 647502 - DNA, 20 bp, Artificial
  CRISPR gRNA sequence
tccatttttaaggatattta

SEQ ID NO: 647503 - DNA, 20 bp, Artificial
  CRISPR gRNA sequence
ccatttttaaggatatttag

SEQ ID NO: 647504 - DNA, 20 bp, Artificial
  CRISPR gRNA sequence
catttttaaggatatttaga

SEQ ID NO: 647505 - DNA, 20 bp, Artificial
  CRISPR gRNA sequence
ttaaggatatttagaagctg

SEQ ID NO: 647506 - DNA, 20 bp, Artificial
  CRISPR gRNA sequence
taaggatatttagaagctgt

SEQ ID NO: 647507 - DNA, 20 bp, Artificial
  CRISPR gRNA sequence
aaggatatttagaagctgtg

SEQ ID NO: 647508 - DNA, 20 bp, Artificial
  CRISPR gRNA sequence
aggatatttagaagctgtgg

SEQ ID NO: 647509 - DNA, 20 bp, Artificial
  CRISPR gRNA sequence
agaagctgtggttttatagg

SEQ ID NO: 647510 - DNA, 20 bp, Artificial
  CRISPR gRNA sequence
gaagctgtggttttataggg

SEQ ID NO: 647511 - DNA, 20 bp, Artificial
  CRISPR gRNA sequence
tggttttataggggctttat

SEQ ID NO: 647512 - DNA, 20 bp, Artificial
  CRISPR gRNA sequence
tataggggctttatcaaaat

SEQ ID NO: 647513 - DNA, 20 bp, Artificial
  CRISPR gRNA sequence
ataggggctttatcaaaatg

SEQ ID NO: 647514 - DNA, 20 bp, Artificial
  CRISPR gRNA sequence
taggggctttatcaaaatgg

SEQ ID NO: 647515 - DNA, 20 bp, Artificial
  CRISPR gRNA sequence
tatcaaaatggttgaaattc

SEQ ID NO: 647516 - DNA, 20 bp, Artificial
  CRISPR gRNA sequence
atcaaaatggttgaaattct

SEQ ID NO: 647517 - DNA, 20 bp, Artificial
  CRISPR gRNA sequence
tcaaaatggttgaaattctt

SEQ ID NO: 647518 - DNA, 20 bp, Artificial
  CRISPR gRNA sequence
aaattcttttccatggcaga

SEQ ID NO: 647519 - DNA, 20 bp, Artificial
  CRISPR gRNA sequence
ttttccatggcagaggtttg

SEQ ID NO: 647520 - DNA, 20 bp, Artificial
  CRISPR gRNA sequence
ttccatggcagaggtttgac

SEQ ID NO: 647521 - DNA, 20 bp, Artificial
  CRISPR gRNA sequence
tccatggcagaggtttgaca

SEQ ID NO: 647522 - DNA, 20 bp, Artificial
  CRISPR gRNA sequence
ccatggcagaggtttgacaa

SEQ ID NO: 647523 - DNA, 20 bp, Artificial
  CRISPR gRNA sequence
catggcagaggtttgacaac

SEQ ID NO: 647524 - DNA, 20 bp, Artificial
  CRISPR gRNA sequence
gacaactgtggaaataatta

SEQ ID NO: 647525 - DNA, 20 bp, Artificial
  CRISPR gRNA sequence
acaactgtggaaataattaa

SEQ ID NO: 647526 - DNA, 20 bp, Artificial
  CRISPR gRNA sequence
tggaaataattaaatgagca

SEQ ID NO: 647527 - DNA, 20 bp, Artificial
  CRISPR gRNA sequence
aatgagcacaccttttcaac

SEQ ID NO: 647528 - DNA, 20 bp, Artificial
  CRISPR gRNA sequence
ttcaacactacacatgactg

SEQ ID NO: 647529 - DNA, 20 bp, Artificial
  CRISPR gRNA sequence
tcaacactacacatgactga

SEQ ID NO: 647530 - DNA, 20 bp, Artificial
  CRISPR gRNA sequence
caacactacacatgactgag

SEQ ID NO: 647531 - DNA, 20 bp, Artificial
  CRISPR gRNA sequence
aacactacacatgactgaga

SEQ ID NO: 647532 - DNA, 20 bp, Artificial
  CRISPR gRNA sequence
cacatgactgagaactgctt

SEQ ID NO: 647533 - DNA, 20 bp, Artificial
  CRISPR gRNA sequence
agaactgcttatccagaaga

SEQ ID NO: 647534 - DNA, 20 bp, Artificial
  CRISPR gRNA sequence
cttatccagaagagactagc

SEQ ID NO: 647535 - DNA, 20 bp, Artificial
  CRISPR gRNA sequence
atccagaagagactagctag

SEQ ID NO: 647536 - DNA, 20 bp, Artificial
  CRISPR gRNA sequence
tccagaagagactagctagg

SEQ ID NO: 647537 - DNA, 20 bp, Artificial
  CRISPR gRNA sequence
gctaggtggagggctctgtt

SEQ ID NO: 647538 - DNA, 20 bp, Artificial
  CRISPR gRNA sequence
ggtggagggctctgttctaa

SEQ ID NO: 647539 - DNA, 20 bp, Artificial
  CRISPR gRNA sequence
tgttctaagactatcgagta

SEQ ID NO: 647540 - DNA, 20 bp, Artificial
  CRISPR gRNA sequence
ttctaagactatcgagtata

SEQ ID NO: 647541 - DNA, 20 bp, Artificial
  CRISPR gRNA sequence
taagactatcgagtatatgt

SEQ ID NO: 647542 - DNA, 20 bp, Artificial
  CRISPR gRNA sequence
agactatcgagtatatgtta

SEQ ID NO: 647543 - DNA, 20 bp, Artificial
  CRISPR gRNA sequence
tcgagtatatgttatgtggt

SEQ ID NO: 647544 - DNA, 20 bp, Artificial
  CRISPR gRNA sequence
tgtggtatttaaagacattt

SEQ ID NO: 647545 - DNA, 20 bp, Artificial
  CRISPR gRNA sequence
aaagacatttgtaaatgtgt

SEQ ID NO: 647546 - DNA, 20 bp, Artificial
  CRISPR gRNA sequence
aagacatttgtaaatgtgtt

SEQ ID NO: 647547 - DNA, 20 bp, Artificial
  CRISPR gRNA sequence
gtaaatgtgttctatatttg

SEQ ID NO: 647548 - DNA, 20 bp, Artificial
  CRISPR gRNA sequence
taaatgtgttctatatttgt

SEQ ID NO: 647549 - DNA, 20 bp, Artificial
  CRISPR gRNA sequence
tatatttgtaaaactataac

SEQ ID NO: 647550 - DNA, 20 bp, Artificial
  CRISPR gRNA sequence
tatttgtaaaactataacta

SEQ ID NO: 647551 - DNA, 20 bp, Artificial
  CRISPR gRNA sequence
gtaaaactataactagaagt

SEQ ID NO: 647552 - DNA, 20 bp, Artificial
  CRISPR gRNA sequence
taaaactataactagaagtt

SEQ ID NO: 647553 - DNA, 20 bp, Artificial
  CRISPR gRNA sequence
taactagaagttccttatat

SEQ ID NO: 647554 - DNA, 20 bp, Artificial
  CRISPR gRNA sequence
gaagttccttatattaaaac

SEQ ID NO: 647555 - DNA, 20 bp, Artificial
  CRISPR gRNA sequence
cttatattaaaacaaaacaa

SEQ ID NO: 647556 - DNA, 20 bp, Artificial
  CRISPR gRNA sequence
atattaaaacaaaacaaaag

SEQ ID NO: 647557 - DNA, 20 bp, Artificial
  CRISPR gRNA sequence
tattaaaacaaaacaaaagt

SEQ ID NO: 647558 - DNA, 20 bp, Artificial
  CRISPR gRNA sequence
aaacaaaacaaaagtaaaaa

SEQ ID NO: 647559 - DNA, 20 bp, Artificial
  CRISPR gRNA sequence
actctaacaaactgaaaagg

SEQ ID NO: 647560 - DNA, 20 bp, Artificial
  CRISPR gRNA sequence
taacaaactgaaaaggcagt

SEQ ID NO: 647561 - DNA, 20 bp, Artificial
  CRISPR gRNA sequence
acaaactgaaaaggcagttg

SEQ ID NO: 647562 - DNA, 20 bp, Artificial
  CRISPR gRNA sequence
aaaaggcagttgaaagaata

SEQ ID NO: 647563 - DNA, 20 bp, Artificial
  CRISPR gRNA sequence
aaagaatattaatcaaagtt

SEQ ID NO: 647564 - DNA, 20 bp, Artificial
  CRISPR gRNA sequence
atcaaagttcttgtttagct

SEQ ID NO: 647565 - DNA, 20 bp, Artificial
  CRISPR gRNA sequence
ttgtttagctttacagatgc

SEQ ID NO: 647566 - DNA, 20 bp, Artificial
  CRISPR gRNA sequence
gtttagctttacagatgcca

SEQ ID NO: 647567 - DNA, 20 bp, Artificial
  CRISPR gRNA sequence
tttagctttacagatgccac

SEQ ID NO: 647568 - DNA, 20 bp, Artificial
  CRISPR gRNA sequence
agctttacagatgccaccta

SEQ ID NO: 647569 - DNA, 20 bp, Artificial
  CRISPR gRNA sequence
gctttacagatgccacctaa

SEQ ID NO: 647570 - DNA, 20 bp, Artificial
  CRISPR gRNA sequence
tacagatgccacctaaaact

SEQ ID NO: 647571 - DNA, 20 bp, Artificial
  CRISPR gRNA sequence
acagatgccacctaaaactt

SEQ ID NO: 647572 - DNA, 20 bp, Artificial
  CRISPR gRNA sequence
cagatgccacctaaaacttt

SEQ ID NO: 647573 - DNA, 20 bp, Artificial
  CRISPR gRNA sequence
aaactttttttcccagaaaa

SEQ ID NO: 647574 - DNA, 20 bp, Artificial
  CRISPR gRNA sequence
tttttcccagaaaaattttt

SEQ ID NO: 647575 - DNA, 20 bp, Artificial
  CRISPR gRNA sequence
ttttcccagaaaaatttttg

SEQ ID NO: 647576 - DNA, 20 bp, Artificial
  CRISPR gRNA sequence
tttcccagaaaaatttttgg

SEQ ID NO: 647577 - DNA, 20 bp, Artificial
  CRISPR gRNA sequence
ttcccagaaaaatttttgga

SEQ ID NO: 647578 - DNA, 20 bp, Artificial
  CRISPR gRNA sequence
tcccagaaaaatttttggaa

SEQ ID NO: 647579 - DNA, 20 bp, Artificial
  CRISPR gRNA sequence
cccagaaaaatttttggaac

SEQ ID NO: 647580 - DNA, 20 bp, Artificial
  CRISPR gRNA sequence
ccagaaaaatttttggaaca

SEQ ID NO: 647581 - DNA, 20 bp, Artificial
  CRISPR gRNA sequence
ttggaacagggtcaacgaat

SEQ ID NO: 647582 - DNA, 20 bp, Artificial
  CRISPR gRNA sequence
tggaacagggtcaacgaatg

SEQ ID NO: 647583 - DNA, 20 bp, Artificial
  CRISPR gRNA sequence
ggaacagggtcaacgaatgg

SEQ ID NO: 647584 - DNA, 20 bp, Artificial
  CRISPR gRNA sequence
gaacagggtcaacgaatggc

SEQ ID NO: 647585 - DNA, 20 bp, Artificial
  CRISPR gRNA sequence
tcagattctaatattctcta

SEQ ID NO: 647586 - DNA, 20 bp, Artificial
  CRISPR gRNA sequence
cagattctaatattctctaa

SEQ ID NO: 647587 - DNA, 20 bp, Artificial
  CRISPR gRNA sequence
agattctaatattctctaac

SEQ ID NO: 647588 - DNA, 20 bp, Artificial
  CRISPR gRNA sequence
taatattctctaacactttt

SEQ ID NO: 647589 - DNA, 20 bp, Artificial
  CRISPR gRNA sequence
atattctctaacacttttgt

SEQ ID NO: 647590 - DNA, 20 bp, Artificial
  CRISPR gRNA sequence
tctaacacttttgtaactac

SEQ ID NO: 647591 - DNA, 20 bp, Artificial
  CRISPR gRNA sequence
taacacttttgtaactacaa

SEQ ID NO: 647592 - DNA, 20 bp, Artificial
  CRISPR gRNA sequence
acacttttgtaactacaaag

SEQ ID NO: 647593 - DNA, 20 bp, Artificial
  CRISPR gRNA sequence
ttgtaactacaaagtcagtc

SEQ ID NO: 647594 - DNA, 20 bp, Artificial
  CRISPR gRNA sequence
tgtaactacaaagtcagtca

SEQ ID NO: 647595 - DNA, 20 bp, Artificial
  CRISPR gRNA sequence
gtaactacaaagtcagtcat

SEQ ID NO: 647596 - DNA, 20 bp, Artificial
  CRISPR gRNA sequence
taactacaaagtcagtcatc

SEQ ID NO: 647597 - DNA, 20 bp, Artificial
  CRISPR gRNA sequence
caaagtcagtcatcagtgct

SEQ ID NO: 647598 - DNA, 20 bp, Artificial
  CRISPR gRNA sequence
atattttgtgcttgtgaaaa

SEQ ID NO: 647599 - DNA, 20 bp, Artificial
  CRISPR gRNA sequence
tgtgcttgtgaaaaaagagt

SEQ ID NO: 647600 - DNA, 20 bp, Artificial
  CRISPR gRNA sequence
gtgcttgtgaaaaaagagtc

SEQ ID NO: 647601 - DNA, 20 bp, Artificial
  CRISPR gRNA sequence
tgcttgtgaaaaaagagtct

SEQ ID NO: 647602 - DNA, 20 bp, Artificial
  CRISPR gRNA sequence
gtgaaaaaagagtctctact

SEQ ID NO: 647603 - DNA, 20 bp, Artificial
  CRISPR gRNA sequence
tgaaaaaagagtctctactc

SEQ ID NO: 647604 - DNA, 20 bp, Artificial
  CRISPR gRNA sequence
tactcaggtctggtactacc

SEQ ID NO: 647605 - DNA, 20 bp, Artificial
  CRISPR gRNA sequence
ctcaggtctggtactacctt

SEQ ID NO: 647606 - DNA, 20 bp, Artificial
  CRISPR gRNA sequence
aggtctggtactacctttgg

SEQ ID NO: 647607 - DNA, 20 bp, Artificial
  CRISPR gRNA sequence
gtactacctttgggctgcaa

SEQ ID NO: 647608 - DNA, 20 bp, Artificial
  CRISPR gRNA sequence
cctttgggctgcaaagacag

SEQ ID NO: 647609 - DNA, 20 bp, Artificial
  CRISPR gRNA sequence
tgggctgcaaagacagttac

SEQ ID NO: 647610 - DNA, 20 bp, Artificial
  CRISPR gRNA sequence
gggctgcaaagacagttact

SEQ ID NO: 647611 - DNA, 20 bp, Artificial
  CRISPR gRNA sequence
ggctgcaaagacagttactt

SEQ ID NO: 647612 - DNA, 20 bp, Artificial
  CRISPR gRNA sequence
caaagacagttactttaatg

SEQ ID NO: 647613 - DNA, 20 bp, Artificial
  CRISPR gRNA sequence
ctttaatggtattaatttga

SEQ ID NO: 647614 - DNA, 20 bp, Artificial
  CRISPR gRNA sequence
taatggtattaatttgacag

SEQ ID NO: 647615 - DNA, 20 bp, Artificial
  CRISPR gRNA sequence
aatggtattaatttgacaga

SEQ ID NO: 647616 - DNA, 20 bp, Artificial
  CRISPR gRNA sequence
atggtattaatttgacagaa

SEQ ID NO: 647617 - DNA, 20 bp, Artificial
  CRISPR gRNA sequence
atttgacagaaaacaaaaga

SEQ ID NO: 647618 - DNA, 20 bp, Artificial
  CRISPR gRNA sequence
gacagaaaacaaaagaaaaa

SEQ ID NO: 647619 - DNA, 20 bp, Artificial
  CRISPR gRNA sequence
acagaaaacaaaagaaaaat

SEQ ID NO: 647620 - DNA, 20 bp, Artificial
  CRISPR gRNA sequence
tcccaaacttcttctccata

SEQ ID NO: 647621 - DNA, 20 bp, Artificial
  CRISPR gRNA sequence
ccaaacttcttctccatacc

SEQ ID NO: 647622 - DNA, 20 bp, Artificial
  CRISPR gRNA sequence
cttctccataccctccagca

SEQ ID NO: 647623 - DNA, 20 bp, Artificial
  CRISPR gRNA sequence
ttctccataccctccagcat

SEQ ID NO: 647624 - DNA, 20 bp, Artificial
  CRISPR gRNA sequence
ctccataccctccagcataa

SEQ ID NO: 647625 - DNA, 20 bp, Artificial
  CRISPR gRNA sequence
tccataccctccagcataat

SEQ ID NO: 647626 - DNA, 20 bp, Artificial
  CRISPR gRNA sequence
cataccctccagcataatct

SEQ ID NO: 647627 - DNA, 20 bp, Artificial
  CRISPR gRNA sequence
cagcataatctggtacctga

SEQ ID NO: 647628 - DNA, 20 bp, Artificial
  CRISPR gRNA sequence
gtacctgaaatctccattat

SEQ ID NO: 647629 - DNA, 20 bp, Artificial
  CRISPR gRNA sequence
aaatctccattatcagaaat

SEQ ID NO: 647630 - DNA, 20 bp, Artificial
  CRISPR gRNA sequence
cattatcagaaatttactac

SEQ ID NO: 647631 - DNA, 20 bp, Artificial
  CRISPR gRNA sequence
tcagaaatttactactatgg

SEQ ID NO: 647632 - DNA, 20 bp, Artificial
  CRISPR gRNA sequence
actactatggcttgggaacc

SEQ ID NO: 647633 - DNA, 20 bp, Artificial
  CRISPR gRNA sequence
ctactatggcttgggaacca

SEQ ID NO: 647634 - DNA, 20 bp, Artificial
  CRISPR gRNA sequence
ctatggcttgggaaccaatt

SEQ ID NO: 647635 - DNA, 20 bp, Artificial
  CRISPR gRNA sequence
tggcttgggaaccaatttct

SEQ ID NO: 647636 - DNA, 20 bp, Artificial
  CRISPR gRNA sequence
gggaaccaatttctagagac

SEQ ID NO: 647637 - DNA, 20 bp, Artificial
  CRISPR gRNA sequence
ggaaccaatttctagagaca

SEQ ID NO: 647638 - DNA, 20 bp, Artificial
  CRISPR gRNA sequence
ctagagacatctctattaaa

SEQ ID NO: 647639 - DNA, 20 bp, Artificial
  CRISPR gRNA sequence
tagagacatctctattaaag

SEQ ID NO: 647640 - DNA, 20 bp, Artificial
  CRISPR gRNA sequence
gagacatctctattaaagca

SEQ ID NO: 647641 - DNA, 20 bp, Artificial
  CRISPR gRNA sequence
tattaaagcatttatgccac

SEQ ID NO: 647642 - DNA, 20 bp, Artificial
  CRISPR gRNA sequence
ttaaagcatttatgccacta

SEQ ID NO: 647643 - DNA, 20 bp, Artificial
  CRISPR gRNA sequence
aagcatttatgccactataa

SEQ ID NO: 647644 - DNA, 20 bp, Artificial
  CRISPR gRNA sequence
atgccactataaaacaacag

SEQ ID NO: 647645 - DNA, 20 bp, Artificial
  CRISPR gRNA sequence
tgccactataaaacaacagt

SEQ ID NO: 647646 - DNA, 20 bp, Artificial
  CRISPR gRNA sequence
taaaacaacagtaatctatt

SEQ ID NO: 647647 - DNA, 20 bp, Artificial
  CRISPR gRNA sequence
ttaaactatgtcagtctcaa

SEQ ID NO: 647648 - DNA, 20 bp, Artificial
  CRISPR gRNA sequence
aactatgtcagtctcaaaaa

SEQ ID NO: 647649 - DNA, 20 bp, Artificial
  CRISPR gRNA sequence
tgtcagtctcaaaaacctta

SEQ ID NO: 647650 - DNA, 20 bp, Artificial
  CRISPR gRNA sequence
aaaaaccttagcttgaattc

SEQ ID NO: 647651 - DNA, 20 bp, Artificial
  CRISPR gRNA sequence
agcttgaattcatttacttg

SEQ ID NO: 647652 - DNA, 20 bp, Artificial
  CRISPR gRNA sequence
gcttgaattcatttacttga

SEQ ID NO: 647653 - DNA, 20 bp, Artificial
  CRISPR gRNA sequence
gaattcatttacttgaattg

SEQ ID NO: 647654 - DNA, 20 bp, Artificial
  CRISPR gRNA sequence
aattcatttacttgaattgt

SEQ ID NO: 647655 - DNA, 20 bp, Artificial
  CRISPR gRNA sequence
atttacttgaattgttctat

SEQ ID NO: 647656 - DNA, 20 bp, Artificial
  CRISPR gRNA sequence
acttgaattgttctatgaca

SEQ ID NO: 647657 - DNA, 20 bp, Artificial
  CRISPR gRNA sequence
cttgaattgttctatgacag

SEQ ID NO: 647658 - DNA, 20 bp, Artificial
  CRISPR gRNA sequence
gaattgttctatgacaggat

SEQ ID NO: 647659 - DNA, 20 bp, Artificial
  CRISPR gRNA sequence
aattgttctatgacaggatg

SEQ ID NO: 647660 - DNA, 20 bp, Artificial
  CRISPR gRNA sequence
ttctatgacaggatggaaag

SEQ ID NO: 647661 - DNA, 20 bp, Artificial
  CRISPR gRNA sequence
tatgacaggatggaaagctg

SEQ ID NO: 647662 - DNA, 20 bp, Artificial
  CRISPR gRNA sequence
tgacaggatggaaagctggg

SEQ ID NO: 647663 - DNA, 20 bp, Artificial
  CRISPR gRNA sequence
gggaaagggttcctagtgtc

SEQ ID NO: 647664 - DNA, 20 bp, Artificial
  CRISPR gRNA sequence
ctagtgtccacagacaggtt

SEQ ID NO: 647665 - DNA, 20 bp, Artificial
  CRISPR gRNA sequence
gtgtccacagacaggttttg

SEQ ID NO: 647666 - DNA, 20 bp, Artificial
  CRISPR gRNA sequence
tggtttgaataaagaaagat

SEQ ID NO: 647667 - DNA, 20 bp, Artificial
  CRISPR gRNA sequence
ggtttgaataaagaaagatt

SEQ ID NO: 647668 - DNA, 20 bp, Artificial
  CRISPR gRNA sequence
gtttgaataaagaaagattg

SEQ ID NO: 647669 - DNA, 20 bp, Artificial
  CRISPR gRNA sequence
gaataaagaaagattgtgaa

SEQ ID NO: 647670 - DNA, 20 bp, Artificial
  CRISPR gRNA sequence
aataaagaaagattgtgaag

SEQ ID NO: 647671 - DNA, 20 bp, Artificial
  CRISPR gRNA sequence
tgaagacacgtatcagaatc

SEQ ID NO: 647672 - DNA, 20 bp, Artificial
  CRISPR gRNA sequence
aaaggcaggcaggactgagc

SEQ ID NO: 647673 - DNA, 20 bp, Artificial
  CRISPR gRNA sequence
agcaggacagtgaagcaaca

SEQ ID NO: 647674 - DNA, 20 bp, Artificial
  CRISPR gRNA sequence
gcaaatggaagtgctaagaa

SEQ ID NO: 647675 - DNA, 20 bp, Artificial
  CRISPR gRNA sequence
caaatggaagtgctaagaaa

SEQ ID NO: 647676 - DNA, 20 bp, Artificial
  CRISPR gRNA sequence
agaaagaaaaaaagaatagt

SEQ ID NO: 647677 - DNA, 20 bp, Artificial
  CRISPR gRNA sequence
ataggtaattctctaaagcc

SEQ ID NO: 647678 - DNA, 20 bp, Artificial
  CRISPR gRNA sequence
tctaaagccagccctatctg

SEQ ID NO: 647679 - DNA, 20 bp, Artificial
  CRISPR gRNA sequence
taaagccagccctatctgta

SEQ ID NO: 647680 - DNA, 20 bp, Artificial
  CRISPR gRNA sequence
aagccagccctatctgtata

SEQ ID NO: 647681 - DNA, 20 bp, Artificial
  CRISPR gRNA sequence
tctgtataacctttgctagg

SEQ ID NO: 647682 - DNA, 20 bp, Artificial
  CRISPR gRNA sequence
tataacctttgctagggcac

SEQ ID NO: 647683 - DNA, 20 bp, Artificial
  CRISPR gRNA sequence
tgctagggcactggtggcat

SEQ ID NO: 647684 - DNA, 20 bp, Artificial
  CRISPR gRNA sequence
gctagggcactggtggcatg

SEQ ID NO: 647685 - DNA, 20 bp, Artificial
  CRISPR gRNA sequence
ctagggcactggtggcatgc

SEQ ID NO: 647686 - DNA, 20 bp, Artificial
  CRISPR gRNA sequence
gggcactggtggcatgcccc

SEQ ID NO: 647687 - DNA, 20 bp, Artificial
  CRISPR gRNA sequence
gtggcatgcccccttcctgc

SEQ ID NO: 647688 - DNA, 20 bp, Artificial
  CRISPR gRNA sequence
cctgcattctaagtactcat

SEQ ID NO: 647689 - DNA, 20 bp, Artificial
  CRISPR gRNA sequence
ctgcattctaagtactcatc

SEQ ID NO: 647690 - DNA, 20 bp, Artificial
  CRISPR gRNA sequence
cattctaagtactcatccta

SEQ ID NO: 647691 - DNA, 20 bp, Artificial
  CRISPR gRNA sequence
taagtactcatcctaccaca

SEQ ID NO: 647692 - DNA, 20 bp, Artificial
  CRISPR gRNA sequence
agtactcatcctaccacaac

SEQ ID NO: 647693 - DNA, 20 bp, Artificial
  CRISPR gRNA sequence
atcctaccacaacctcattt

SEQ ID NO: 647694 - DNA, 20 bp, Artificial
  CRISPR gRNA sequence
ccacaacctcatttttttta

SEQ ID NO: 647695 - DNA, 20 bp, Artificial
  CRISPR gRNA sequence
attttttttaatgaaatagg

SEQ ID NO: 647696 - DNA, 20 bp, Artificial
  CRISPR gRNA sequence
tttttaatgaaataggtcag

SEQ ID NO: 647697 - DNA, 20 bp, Artificial
  CRISPR gRNA sequence
ttttaatgaaataggtcagc

SEQ ID NO: 647698 - DNA, 20 bp, Artificial
  CRISPR gRNA sequence
tttaatgaaataggtcagct

SEQ ID NO: 647699 - DNA, 20 bp, Artificial
  CRISPR gRNA sequence
ttaatgaaataggtcagctc

SEQ ID NO: 647700 - DNA, 20 bp, Artificial
  CRISPR gRNA sequence
taatgaaataggtcagctcg

SEQ ID NO: 647701 - DNA, 20 bp, Artificial
  CRISPR gRNA sequence
aatgaaataggtcagctcga

SEQ ID NO: 647702 - DNA, 20 bp, Artificial
  CRISPR gRNA sequence
atgaaataggtcagctcgac

SEQ ID NO: 647703 - DNA, 20 bp, Artificial
  CRISPR gRNA sequence
gacaaagagcaaatgactga

SEQ ID NO: 647704 - DNA, 20 bp, Artificial
  CRISPR gRNA sequence
agatgaaacaaatttcccta

SEQ ID NO: 647705 - DNA, 20 bp, Artificial
  CRISPR gRNA sequence
ccctaactttagtcagagga

SEQ ID NO: 647706 - DNA, 20 bp, Artificial
  CRISPR gRNA sequence
cctaactttagtcagaggaa

SEQ ID NO: 647707 - DNA, 20 bp, Artificial
  CRISPR gRNA sequence
actttagtcagaggaagttt

SEQ ID NO: 647708 - DNA, 20 bp, Artificial
  CRISPR gRNA sequence
tagtcagaggaagtttcata

SEQ ID NO: 647709 - DNA, 20 bp, Artificial
  CRISPR gRNA sequence
agtcagaggaagtttcataa

SEQ ID NO: 647710 - DNA, 20 bp, Artificial
  CRISPR gRNA sequence
gtcagaggaagtttcataaa

SEQ ID NO: 647711 - DNA, 20 bp, Artificial
  CRISPR gRNA sequence
cataaaaaatctaatgctgc

SEQ ID NO: 647712 - DNA, 20 bp, Artificial
  CRISPR gRNA sequence
ataaaaaatctaatgctgcg

SEQ ID NO: 647713 - DNA, 20 bp, Artificial
  CRISPR gRNA sequence
atgctgcgagccagcataaa

SEQ ID NO: 647714 - DNA, 20 bp, Artificial
  CRISPR gRNA sequence
cgagccagcataaacaagag

SEQ ID NO: 647715 - DNA, 20 bp, Artificial
  CRISPR gRNA sequence
ttctgttgttattctgttac

SEQ ID NO: 647716 - DNA, 20 bp, Artificial
  CRISPR gRNA sequence
tgttgttattctgttacaga

SEQ ID NO: 647717 - DNA, 20 bp, Artificial
  CRISPR gRNA sequence
ttgttattctgttacagatg

SEQ ID NO: 647718 - DNA, 20 bp, Artificial
  CRISPR gRNA sequence
ttattctgttacagatgaca

SEQ ID NO: 647719 - DNA, 20 bp, Artificial
  CRISPR gRNA sequence
ttctgttacagatgacacac

SEQ ID NO: 647720 - DNA, 20 bp, Artificial
  CRISPR gRNA sequence
tgttacagatgacacacata

SEQ ID NO: 647721 - DNA, 20 bp, Artificial
  CRISPR gRNA sequence
ttacagatgacacacataag

SEQ ID NO: 647722 - DNA, 20 bp, Artificial
  CRISPR gRNA sequence
cagatgacacacataaggaa

SEQ ID NO: 647723 - DNA, 20 bp, Artificial
  CRISPR gRNA sequence
gtaattttgtgtattaatac

SEQ ID NO: 647724 - DNA, 20 bp, Artificial
  CRISPR gRNA sequence
tgtgtattaatactctaccc

SEQ ID NO: 647725 - DNA, 20 bp, Artificial
  CRISPR gRNA sequence
gtgtattaatactctaccct

SEQ ID NO: 647726 - DNA, 20 bp, Artificial
  CRISPR gRNA sequence
tgtattaatactctacccta

SEQ ID NO: 647727 - DNA, 20 bp, Artificial
  CRISPR gRNA sequence
atactctaccctatgatgag

SEQ ID NO: 647728 - DNA, 20 bp, Artificial
  CRISPR gRNA sequence
taccctatgatgaggcacag

SEQ ID NO: 647729 - DNA, 20 bp, Artificial
  CRISPR gRNA sequence
ccctatgatgaggcacagct

SEQ ID NO: 647730 - DNA, 20 bp, Artificial
  CRISPR gRNA sequence
tgatgaggcacagctacaga

SEQ ID NO: 647731 - DNA, 20 bp, Artificial
  CRISPR gRNA sequence
cagacatatccatcttagtc

SEQ ID NO: 647732 - DNA, 20 bp, Artificial
  CRISPR gRNA sequence
agtcagctctgagttataag

SEQ ID NO: 647733 - DNA, 20 bp, Artificial
  CRISPR gRNA sequence
gtcagctctgagttataaga

SEQ ID NO: 647734 - DNA, 20 bp, Artificial
  CRISPR gRNA sequence
tgagttataagaatatgcct

SEQ ID NO: 647735 - DNA, 20 bp, Artificial
  CRISPR gRNA sequence
agttataagaatatgcctga

SEQ ID NO: 647736 - DNA, 20 bp, Artificial
  CRISPR gRNA sequence
taagaatatgcctgaagcca

SEQ ID NO: 647737 - DNA, 20 bp, Artificial
  CRISPR gRNA sequence
aagccaagatgaatggactt

SEQ ID NO: 647738 - DNA, 20 bp, Artificial
  CRISPR gRNA sequence
gggtactgaatgcaaggctt

SEQ ID NO: 647739 - DNA, 20 bp, Artificial
  CRISPR gRNA sequence
ggtactgaatgcaaggcttt

SEQ ID NO: 647740 - DNA, 20 bp, Artificial
  CRISPR gRNA sequence
aatgcaaggctttctctaca

SEQ ID NO: 647741 - DNA, 20 bp, Artificial
  CRISPR gRNA sequence
tctctacagactcgggttca

SEQ ID NO: 647742 - DNA, 20 bp, Artificial
  CRISPR gRNA sequence
ctctacagactcgggttcag

SEQ ID NO: 647743 - DNA, 20 bp, Artificial
  CRISPR gRNA sequence
tctacagactcgggttcaga

SEQ ID NO: 647744 - DNA, 20 bp, Artificial
  CRISPR gRNA sequence
tacagactcgggttcagagg

SEQ ID NO: 647745 - DNA, 20 bp, Artificial
  CRISPR gRNA sequence
cagactcgggttcagaggtc

SEQ ID NO: 647746 - DNA, 20 bp, Artificial
  CRISPR gRNA sequence
gggttcagaggtcaccatca

SEQ ID NO: 647747 - DNA, 20 bp, Artificial
  CRISPR gRNA sequence
agaggtcaccatcatatatg

SEQ ID NO: 647748 - DNA, 20 bp, Artificial
  CRISPR gRNA sequence
ccacatcctgtgtgcataag

SEQ ID NO: 647749 - DNA, 20 bp, Artificial
  CRISPR gRNA sequence
tgtgcataagggcatgtgat

SEQ ID NO: 647750 - DNA, 20 bp, Artificial
  CRISPR gRNA sequence
aaattggcctttactagcaa

SEQ ID NO: 647751 - DNA, 20 bp, Artificial
  CRISPR gRNA sequence
gcctttactagcaatcttga

SEQ ID NO: 647752 - DNA, 20 bp, Artificial
  CRISPR gRNA sequence
tactagcaatcttgaaggag

SEQ ID NO: 647753 - DNA, 20 bp, Artificial
  CRISPR gRNA sequence
actagcaatcttgaaggaga

SEQ ID NO: 647754 - DNA, 20 bp, Artificial
  CRISPR gRNA sequence
ctagcaatcttgaaggagaa

SEQ ID NO: 647755 - DNA, 20 bp, Artificial
  CRISPR gRNA sequence
gcaatcttgaaggagaagaa

SEQ ID NO: 647756 - DNA, 20 bp, Artificial
  CRISPR gRNA sequence
gaaggagaagaaaaataatt

SEQ ID NO: 647757 - DNA, 20 bp, Artificial
  CRISPR gRNA sequence
aaggagaagaaaaataatta

SEQ ID NO: 647758 - DNA, 20 bp, Artificial
  CRISPR gRNA sequence
gttagtagtcagtaagtacc

SEQ ID NO: 647759 - DNA, 20 bp, Artificial
  CRISPR gRNA sequence
gtagtcagtaagtacctggc

SEQ ID NO: 647760 - DNA, 20 bp, Artificial
  CRISPR gRNA sequence
gcaaagaaagaagcagtctc

SEQ ID NO: 647761 - DNA, 20 bp, Artificial
  CRISPR gRNA sequence
acttattcgactttagtgag

SEQ ID NO: 647762 - DNA, 20 bp, Artificial
  CRISPR gRNA sequence
attcgactttagtgagatag

SEQ ID NO: 647763 - DNA, 20 bp, Artificial
  CRISPR gRNA sequence
ttcgactttagtgagatagt

SEQ ID NO: 647764 - DNA, 20 bp, Artificial
  CRISPR gRNA sequence
gactttagtgagatagtatc

SEQ ID NO: 647765 - DNA, 20 bp, Artificial
  CRISPR gRNA sequence
tagtgagatagtatctgttt

SEQ ID NO: 647766 - DNA, 20 bp, Artificial
  CRISPR gRNA sequence
agtgagatagtatctgtttg

SEQ ID NO: 647767 - DNA, 20 bp, Artificial
  CRISPR gRNA sequence
gtgagatagtatctgtttgt

SEQ ID NO: 647768 - DNA, 20 bp, Artificial
  CRISPR gRNA sequence
tttgtttggagaaaagaatt

SEQ ID NO: 647769 - DNA, 20 bp, Artificial
  CRISPR gRNA sequence
gtttggagaaaagaatttgc

SEQ ID NO: 647770 - DNA, 20 bp, Artificial
  CRISPR gRNA sequence
tttggagaaaagaatttgct

SEQ ID NO: 647771 - DNA, 20 bp, Artificial
  CRISPR gRNA sequence
ggagaaaagaatttgctgtt

SEQ ID NO: 647772 - DNA, 20 bp, Artificial
  CRISPR gRNA sequence
gagaaaagaatttgctgttg

SEQ ID NO: 647773 - DNA, 20 bp, Artificial
  CRISPR gRNA sequence
gctgttgaaggcagactaca

SEQ ID NO: 647774 - DNA, 20 bp, Artificial
  CRISPR gRNA sequence
ctgttgaaggcagactacat

SEQ ID NO: 647775 - DNA, 20 bp, Artificial
  CRISPR gRNA sequence
ttgaaggcagactacatgtt

SEQ ID NO: 647776 - DNA, 20 bp, Artificial
  CRISPR gRNA sequence
aaggcagactacatgttatg

SEQ ID NO: 647777 - DNA, 20 bp, Artificial
  CRISPR gRNA sequence
catgttatgtgagcccaggt

SEQ ID NO: 647778 - DNA, 20 bp, Artificial
  CRISPR gRNA sequence
tgtgagcccaggtctctccc

SEQ ID NO: 647779 - DNA, 20 bp, Artificial
  CRISPR gRNA sequence
tccctcttttcattccccag

SEQ ID NO: 647780 - DNA, 20 bp, Artificial
  CRISPR gRNA sequence
cctcttttcattccccaggt

SEQ ID NO: 647781 - DNA, 20 bp, Artificial
  CRISPR gRNA sequence
ttttcattccccaggtaaag

SEQ ID NO: 647782 - DNA, 20 bp, Artificial
  CRISPR gRNA sequence
ttcattccccaggtaaagca

SEQ ID NO: 647783 - DNA, 20 bp, Artificial
  CRISPR gRNA sequence
tcattccccaggtaaagcag

SEQ ID NO: 647784 - DNA, 20 bp, Artificial
  CRISPR gRNA sequence
cattccccaggtaaagcagc

SEQ ID NO: 647785 - DNA, 20 bp, Artificial
  CRISPR gRNA sequence
attccccaggtaaagcagcc

SEQ ID NO: 647786 - DNA, 20 bp, Artificial
  CRISPR gRNA sequence
cccaggtaaagcagccaact

SEQ ID NO: 647787 - DNA, 20 bp, Artificial
  CRISPR gRNA sequence
catctctctttcttcaaggc

SEQ ID NO: 647788 - DNA, 20 bp, Artificial
  CRISPR gRNA sequence
tctttcttcaaggccagttc

SEQ ID NO: 647789 - DNA, 20 bp, Artificial
  CRISPR gRNA sequence
tttcttcaaggccagttcct

SEQ ID NO: 647790 - DNA, 20 bp, Artificial
  CRISPR gRNA sequence
tcttcaaggccagttcctac

SEQ ID NO: 647791 - DNA, 20 bp, Artificial
  CRISPR gRNA sequence
cttcaaggccagttcctact

SEQ ID NO: 647792 - DNA, 20 bp, Artificial
  CRISPR gRNA sequence
ttcaaggccagttcctactc

SEQ ID NO: 647793 - DNA, 20 bp, Artificial
  CRISPR gRNA sequence
caaggccagttcctactccc

SEQ ID NO: 647794 - DNA, 20 bp, Artificial
  CRISPR gRNA sequence
aaggccagttcctactccca

SEQ ID NO: 647795 - DNA, 20 bp, Artificial
  CRISPR gRNA sequence
ctactcccatccacttcatg

SEQ ID NO: 647796 - DNA, 20 bp, Artificial
  CRISPR gRNA sequence
ctcccatccacttcatgaaa

SEQ ID NO: 647797 - DNA, 20 bp, Artificial
  CRISPR gRNA sequence
ccatccacttcatgaaagtt

SEQ ID NO: 647798 - DNA, 20 bp, Artificial
  CRISPR gRNA sequence
catgaaagttcattcactct

SEQ ID NO: 647799 - DNA, 20 bp, Artificial
  CRISPR gRNA sequence
atgaaagttcattcactctc

SEQ ID NO: 647800 - DNA, 20 bp, Artificial
  CRISPR gRNA sequence
attcactctccttttagtca

SEQ ID NO: 647801 - DNA, 20 bp, Artificial
  CRISPR gRNA sequence
actctccttttagtcatttg

SEQ ID NO: 647802 - DNA, 20 bp, Artificial
  CRISPR gRNA sequence
tccttttagtcatttgttca

SEQ ID NO: 647803 - DNA, 20 bp, Artificial
  CRISPR gRNA sequence
cttttagtcatttgttcata

SEQ ID NO: 647804 - DNA, 20 bp, Artificial
  CRISPR gRNA sequence
ttagtcatttgttcataaaa

SEQ ID NO: 647805 - DNA, 20 bp, Artificial
  CRISPR gRNA sequence
tagtcatttgttcataaaac

SEQ ID NO: 647806 - DNA, 20 bp, Artificial
  CRISPR gRNA sequence
agtcatttgttcataaaaca

SEQ ID NO: 647807 - DNA, 20 bp, Artificial
  CRISPR gRNA sequence
gtcatttgttcataaaacaa

SEQ ID NO: 647808 - DNA, 20 bp, Artificial
  CRISPR gRNA sequence
gttcataaaacaatgggaag

SEQ ID NO: 647809 - DNA, 20 bp, Artificial
  CRISPR gRNA sequence
ttcataaaacaatgggaagt

SEQ ID NO: 647810 - DNA, 20 bp, Artificial
  CRISPR gRNA sequence
ataaaacaatgggaagtggt

SEQ ID NO: 647811 - DNA, 20 bp, Artificial
  CRISPR gRNA sequence
ttctctgccaggtacagtgg

SEQ ID NO: 647812 - DNA, 20 bp, Artificial
  CRISPR gRNA sequence
tctgccaggtacagtggcaa

SEQ ID NO: 647813 - DNA, 20 bp, Artificial
  CRISPR gRNA sequence
tgccaggtacagtggcaaaa

SEQ ID NO: 647814 - DNA, 20 bp, Artificial
  CRISPR gRNA sequence
ccaggtacagtggcaaaatt

SEQ ID NO: 647815 - DNA, 20 bp, Artificial
  CRISPR gRNA sequence
taagtacacagatgaacaag

SEQ ID NO: 647816 - DNA, 20 bp, Artificial
  CRISPR gRNA sequence
ccccagaggagctcaaaatc

SEQ ID NO: 647817 - DNA, 20 bp, Artificial
  CRISPR gRNA sequence
aaaatctaatatgggagaca

SEQ ID NO: 647818 - DNA, 20 bp, Artificial
  CRISPR gRNA sequence
atatgggagacaaagacata

SEQ ID NO: 647819 - DNA, 20 bp, Artificial
  CRISPR gRNA sequence
taatagatacatgtacatac

SEQ ID NO: 647820 - DNA, 20 bp, Artificial
  CRISPR gRNA sequence
agtgctatagaaatatgggg

SEQ ID NO: 647821 - DNA, 20 bp, Artificial
  CRISPR gRNA sequence
tagaaatatggggaataact

SEQ ID NO: 647822 - DNA, 20 bp, Artificial
  CRISPR gRNA sequence
aaaattcaaataagcagtta

SEQ ID NO: 647823 - DNA, 20 bp, Artificial
  CRISPR gRNA sequence
aaataagcagttacactgga

SEQ ID NO: 647824 - DNA, 20 bp, Artificial
  CRISPR gRNA sequence
cactggacctttgaaaagga

SEQ ID NO: 647825 - DNA, 20 bp, Artificial
  CRISPR gRNA sequence
gacctttgaaaaggattgag

SEQ ID NO: 647826 - DNA, 20 bp, Artificial
  CRISPR gRNA sequence
tgaaaaggattgagagtttt

SEQ ID NO: 647827 - DNA, 20 bp, Artificial
  CRISPR gRNA sequence
gaaaaggattgagagttttc

SEQ ID NO: 647828 - DNA, 20 bp, Artificial
  CRISPR gRNA sequence
aaaaggattgagagttttcc

SEQ ID NO: 647829 - DNA, 20 bp, Artificial
  CRISPR gRNA sequence
agagttttcctggttgagaa

SEQ ID NO: 647830 - DNA, 20 bp, Artificial
  CRISPR gRNA sequence
tcctggttgagaaaaagtac

SEQ ID NO: 647831 - DNA, 20 bp, Artificial
  CRISPR gRNA sequence
cctggttgagaaaaagtaca

SEQ ID NO: 647832 - DNA, 20 bp, Artificial
  CRISPR gRNA sequence
ctggttgagaaaaagtacag

SEQ ID NO: 647833 - DNA, 20 bp, Artificial
  CRISPR gRNA sequence
gttgagaaaaagtacagaaa

SEQ ID NO: 647834 - DNA, 20 bp, Artificial
  CRISPR gRNA sequence
agaaaaagtacagaaatcca

SEQ ID NO: 647835 - DNA, 20 bp, Artificial
  CRISPR gRNA sequence
atgcaaagaaaaggcaattt

SEQ ID NO: 647836 - DNA, 20 bp, Artificial
  CRISPR gRNA sequence
gaaagaatatgttatattca

SEQ ID NO: 647837 - DNA, 20 bp, Artificial
  CRISPR gRNA sequence
aaagaatatgttatattcaa

SEQ ID NO: 647838 - DNA, 20 bp, Artificial
  CRISPR gRNA sequence
tattcaagacatggcaagta

SEQ ID NO: 647839 - DNA, 20 bp, Artificial
  CRISPR gRNA sequence
aagacatggcaagtatctgt

SEQ ID NO: 647840 - DNA, 20 bp, Artificial
  CRISPR gRNA sequence
tggctgaagcacagtatatg

SEQ ID NO: 647841 - DNA, 20 bp, Artificial
  CRISPR gRNA sequence
aagcacagtatatgtgaaaa

SEQ ID NO: 647842 - DNA, 20 bp, Artificial
  CRISPR gRNA sequence
caggagatgaagacaaaaag

SEQ ID NO: 647843 - DNA, 20 bp, Artificial
  CRISPR gRNA sequence
aggagatgaagacaaaaaga

SEQ ID NO: 647844 - DNA, 20 bp, Artificial
  CRISPR gRNA sequence
ggctgtttagtaaaggctgt

SEQ ID NO: 647845 - DNA, 20 bp, Artificial
  CRISPR gRNA sequence
tttagtaaaggctgtagtat

SEQ ID NO: 647846 - DNA, 20 bp, Artificial
  CRISPR gRNA sequence
agtaaaggctgtagtataaa

SEQ ID NO: 647847 - DNA, 20 bp, Artificial
  CRISPR gRNA sequence
gtaaaggctgtagtataaaa

SEQ ID NO: 647848 - DNA, 20 bp, Artificial
  CRISPR gRNA sequence
tagtataaaatgctaaagag

SEQ ID NO: 647849 - DNA, 20 bp, Artificial
  CRISPR gRNA sequence
aagagcttattagactgcat

SEQ ID NO: 647850 - DNA, 20 bp, Artificial
  CRISPR gRNA sequence
attagactgcattcctcagg

SEQ ID NO: 647851 - DNA, 20 bp, Artificial
  CRISPR gRNA sequence
ttagactgcattcctcaggt

SEQ ID NO: 647852 - DNA, 20 bp, Artificial
  CRISPR gRNA sequence
gactgcattcctcaggtaag

SEQ ID NO: 647853 - DNA, 20 bp, Artificial
  CRISPR gRNA sequence
cattcctcaggtaaggggag

SEQ ID NO: 647854 - DNA, 20 bp, Artificial
  CRISPR gRNA sequence
ctcaggtaaggggagtcatt

SEQ ID NO: 647855 - DNA, 20 bp, Artificial
  CRISPR gRNA sequence
aggtaaggggagtcattcag

SEQ ID NO: 647856 - DNA, 20 bp, Artificial
  CRISPR gRNA sequence
agaaaaaagaatggcaaaca

SEQ ID NO: 647857 - DNA, 20 bp, Artificial
  CRISPR gRNA sequence
ttgtaatagaagtaggtgac

SEQ ID NO: 647858 - DNA, 20 bp, Artificial
  CRISPR gRNA sequence
tgtaatagaagtaggtgaca

SEQ ID NO: 647859 - DNA, 20 bp, Artificial
  CRISPR gRNA sequence
gtaatagaagtaggtgacaa

SEQ ID NO: 647860 - DNA, 20 bp, Artificial
  CRISPR gRNA sequence
taatagaagtaggtgacaaa

SEQ ID NO: 647861 - DNA, 20 bp, Artificial
  CRISPR gRNA sequence
cagaaaggcaatgattaatt

SEQ ID NO: 647862 - DNA, 20 bp, Artificial
  CRISPR gRNA sequence
attctataactctaactgga

SEQ ID NO: 647863 - DNA, 20 bp, Artificial
  CRISPR gRNA sequence
tataactctaactggaaggc

SEQ ID NO: 647864 - DNA, 20 bp, Artificial
  CRISPR gRNA sequence
taactctaactggaaggcag

SEQ ID NO: 647865 - DNA, 20 bp, Artificial
  CRISPR gRNA sequence
taactggaaggcagatgacc

SEQ ID NO: 647866 - DNA, 20 bp, Artificial
  CRISPR gRNA sequence
actggaaggcagatgaccta

SEQ ID NO: 647867 - DNA, 20 bp, Artificial
  CRISPR gRNA sequence
gaaggcagatgacctacaat

SEQ ID NO: 647868 - DNA, 20 bp, Artificial
  CRISPR gRNA sequence
caattagtcctaagaaatca

SEQ ID NO: 647869 - DNA, 20 bp, Artificial
  CRISPR gRNA sequence
gtcctaagaaatcactttat

SEQ ID NO: 647870 - DNA, 20 bp, Artificial
  CRISPR gRNA sequence
agaaatcactttatcctgca

SEQ ID NO: 647871 - DNA, 20 bp, Artificial
  CRISPR gRNA sequence
tatcctgcactttatatatt

SEQ ID NO: 647872 - DNA, 20 bp, Artificial
  CRISPR gRNA sequence
atcctgcactttatatattt

SEQ ID NO: 647873 - DNA, 20 bp, Artificial
  CRISPR gRNA sequence
tcctgcactttatatattta

SEQ ID NO: 647874 - DNA, 20 bp, Artificial
  CRISPR gRNA sequence
cactttatatatttatttat

SEQ ID NO: 647875 - DNA, 20 bp, Artificial
  CRISPR gRNA sequence
tatatatttatttatttttg

SEQ ID NO: 647876 - DNA, 20 bp, Artificial
  CRISPR gRNA sequence
atatatttatttatttttga

SEQ ID NO: 647877 - DNA, 20 bp, Artificial
  CRISPR gRNA sequence
tatatttatttatttttgag

SEQ ID NO: 647878 - DNA, 20 bp, Artificial
  CRISPR gRNA sequence
atttatttttgagacagtct

SEQ ID NO: 647879 - DNA, 20 bp, Artificial
  CRISPR gRNA sequence
tttatttttgagacagtctc

SEQ ID NO: 647880 - DNA, 20 bp, Artificial
  CRISPR gRNA sequence
atttttgagacagtctcgta

SEQ ID NO: 647881 - DNA, 20 bp, Artificial
  CRISPR gRNA sequence
tttttgagacagtctcgtag

SEQ ID NO: 647882 - DNA, 20 bp, Artificial
  CRISPR gRNA sequence
ttgagacagtctcgtagtaa

SEQ ID NO: 647883 - DNA, 20 bp, Artificial
  CRISPR gRNA sequence
tgagacagtctcgtagtaac

SEQ ID NO: 647884 - DNA, 20 bp, Artificial
  CRISPR gRNA sequence
gagacagtctcgtagtaacc

SEQ ID NO: 647885 - DNA, 20 bp, Artificial
  CRISPR gRNA sequence
agacagtctcgtagtaaccc

SEQ ID NO: 647886 - DNA, 20 bp, Artificial
  CRISPR gRNA sequence
gtagtaacccaggctggagt

SEQ ID NO: 647887 - DNA, 20 bp, Artificial
  CRISPR gRNA sequence
gagtgcagttgcaagatctt

SEQ ID NO: 647888 - DNA, 20 bp, Artificial
  CRISPR gRNA sequence
caagatcttggctcactgca

SEQ ID NO: 647889 - DNA, 20 bp, Artificial
  CRISPR gRNA sequence
ggctcactgcagcctcaacc

SEQ ID NO: 647890 - DNA, 20 bp, Artificial
  CRISPR gRNA sequence
gctcactgcagcctcaacct

SEQ ID NO: 647891 - DNA, 20 bp, Artificial
  CRISPR gRNA sequence
actgcagcctcaacctcctg

SEQ ID NO: 647892 - DNA, 20 bp, Artificial
  CRISPR gRNA sequence
cagcctcaacctcctgggtt

SEQ ID NO: 647893 - DNA, 20 bp, Artificial
  CRISPR gRNA sequence
aacctcctgggttcaaggga

SEQ ID NO: 647894 - DNA, 20 bp, Artificial
  CRISPR gRNA sequence
ctgggttcaagggatcctct

SEQ ID NO: 647895 - DNA, 20 bp, Artificial
  CRISPR gRNA sequence
ggttcaagggatcctctcac

SEQ ID NO: 647896 - DNA, 20 bp, Artificial
  CRISPR gRNA sequence
aagggatcctctcacctcag

SEQ ID NO: 647897 - DNA, 20 bp, Artificial
  CRISPR gRNA sequence
tcacctcagcccctcaagta

SEQ ID NO: 647898 - DNA, 20 bp, Artificial
  CRISPR gRNA sequence
acctcagcccctcaagtagc

SEQ ID NO: 647899 - DNA, 20 bp, Artificial
  CRISPR gRNA sequence
agcccctcaagtagctggga

SEQ ID NO: 647900 - DNA, 20 bp, Artificial
  CRISPR gRNA sequence
aagtagctgggactacgggt

SEQ ID NO: 647901 - DNA, 20 bp, Artificial
  CRISPR gRNA sequence
ggactacgggtacgtgccac

SEQ ID NO: 647902 - DNA, 20 bp, Artificial
  CRISPR gRNA sequence
cgggtacgtgccacaacgcc

SEQ ID NO: 647903 - DNA, 20 bp, Artificial
  CRISPR gRNA sequence
attttttgtattttttgtag

SEQ ID NO: 647904 - DNA, 20 bp, Artificial
  CRISPR gRNA sequence
tttgtattttttgtagagac

SEQ ID NO: 647905 - DNA, 20 bp, Artificial
  CRISPR gRNA sequence
ttgtattttttgtagagaca

SEQ ID NO: 647906 - DNA, 20 bp, Artificial
  CRISPR gRNA sequence
tgtattttttgtagagacag

SEQ ID NO: 647907 - DNA, 20 bp, Artificial
  CRISPR gRNA sequence
gtattttttgtagagacagg

SEQ ID NO: 647908 - DNA, 20 bp, Artificial
  CRISPR gRNA sequence
tattttttgtagagacaggg

SEQ ID NO: 647909 - DNA, 20 bp, Artificial
  CRISPR gRNA sequence
tttgtagagacagggttttg

SEQ ID NO: 647910 - DNA, 20 bp, Artificial
  CRISPR gRNA sequence
ttgtagagacagggttttgc

SEQ ID NO: 647911 - DNA, 20 bp, Artificial
  CRISPR gRNA sequence
tgtagagacagggttttgcc

SEQ ID NO: 647912 - DNA, 20 bp, Artificial
  CRISPR gRNA sequence
gtagagacagggttttgcca

SEQ ID NO: 647913 - DNA, 20 bp, Artificial
  CRISPR gRNA sequence
tagagacagggttttgccat

SEQ ID NO: 647914 - DNA, 20 bp, Artificial
  CRISPR gRNA sequence
tgccatgttgcccaagctgc

SEQ ID NO: 647915 - DNA, 20 bp, Artificial
  CRISPR gRNA sequence
gccatgttgcccaagctgct

SEQ ID NO: 647916 - DNA, 20 bp, Artificial
  CRISPR gRNA sequence
ccatgttgcccaagctgctg

SEQ ID NO: 647917 - DNA, 20 bp, Artificial
  CRISPR gRNA sequence
cccaagctgctgtactttaa

SEQ ID NO: 647918 - DNA, 20 bp, Artificial
  CRISPR gRNA sequence
ctgtactttaattatatgaa

SEQ ID NO: 647919 - DNA, 20 bp, Artificial
  CRISPR gRNA sequence
tactttaattatatgaaaat

SEQ ID NO: 647920 - DNA, 20 bp, Artificial
  CRISPR gRNA sequence
taattatatgaaaataattt

SEQ ID NO: 647921 - DNA, 20 bp, Artificial
  CRISPR gRNA sequence
aattatatgaaaataatttt

SEQ ID NO: 647922 - DNA, 20 bp, Artificial
  CRISPR gRNA sequence
attatatgaaaataatttta

SEQ ID NO: 647923 - DNA, 20 bp, Artificial
  CRISPR gRNA sequence
tatgaaaataattttactat

SEQ ID NO: 647924 - DNA, 20 bp, Artificial
  CRISPR gRNA sequence
tactatgtttgcctaatgtc

SEQ ID NO: 647925 - DNA, 20 bp, Artificial
  CRISPR gRNA sequence
actatgtttgcctaatgtct

SEQ ID NO: 647926 - DNA, 20 bp, Artificial
  CRISPR gRNA sequence
ctatgtttgcctaatgtctc

SEQ ID NO: 647927 - DNA, 20 bp, Artificial
  CRISPR gRNA sequence
tgtttgcctaatgtctcaaa

SEQ ID NO: 647928 - DNA, 20 bp, Artificial
  CRISPR gRNA sequence
gcctaatgtctcaaactccc

SEQ ID NO: 647929 - DNA, 20 bp, Artificial
  CRISPR gRNA sequence
cctaatgtctcaaactccca

SEQ ID NO: 647930 - DNA, 20 bp, Artificial
  CRISPR gRNA sequence
atgtctcaaactcccatcta

SEQ ID NO: 647931 - DNA, 20 bp, Artificial
  CRISPR gRNA sequence
aaactcccatctaaaatatt

SEQ ID NO: 647932 - DNA, 20 bp, Artificial
  CRISPR gRNA sequence
ccatctaaaatattaaactg

SEQ ID NO: 647933 - DNA, 20 bp, Artificial
  CRISPR gRNA sequence
aaatattaaactgctattta

SEQ ID NO: 647934 - DNA, 20 bp, Artificial
  CRISPR gRNA sequence
aactgctatttaattttttt

SEQ ID NO: 647935 - DNA, 20 bp, Artificial
  CRISPR gRNA sequence
ctatttaatttttttattta

SEQ ID NO: 647936 - DNA, 20 bp, Artificial
  CRISPR gRNA sequence
tttaatttttttatttatgt

SEQ ID NO: 647937 - DNA, 20 bp, Artificial
  CRISPR gRNA sequence
aatttttttatttatgtatg

SEQ ID NO: 647938 - DNA, 20 bp, Artificial
  CRISPR gRNA sequence
atttttttatttatgtatga

SEQ ID NO: 647939 - DNA, 20 bp, Artificial
  CRISPR gRNA sequence
ttttatttatgtatgatgta

SEQ ID NO: 647940 - DNA, 20 bp, Artificial
  CRISPR gRNA sequence
tttatttatgtatgatgtaa

SEQ ID NO: 647941 - DNA, 20 bp, Artificial
  CRISPR gRNA sequence
ttatttatgtatgatgtaac

SEQ ID NO: 647942 - DNA, 20 bp, Artificial
  CRISPR gRNA sequence
tatttatgtatgatgtaact

SEQ ID NO: 647943 - DNA, 20 bp, Artificial
  CRISPR gRNA sequence
atttatgtatgatgtaactg

SEQ ID NO: 647944 - DNA, 20 bp, Artificial
  CRISPR gRNA sequence
tttatgtatgatgtaactgt

SEQ ID NO: 647945 - DNA, 20 bp, Artificial
  CRISPR gRNA sequence
atgtatgatgtaactgtgaa

SEQ ID NO: 647946 - DNA, 20 bp, Artificial
  CRISPR gRNA sequence
tgtatgatgtaactgtgaaa

SEQ ID NO: 647947 - DNA, 20 bp, Artificial
  CRISPR gRNA sequence
tgaaatctgattctctttaa

SEQ ID NO: 647948 - DNA, 20 bp, Artificial
  CRISPR gRNA sequence
attctctttaaaggaaaaaa

SEQ ID NO: 647949 - DNA, 20 bp, Artificial
  CRISPR gRNA sequence
tctttaaaggaaaaaatgca

SEQ ID NO: 647950 - DNA, 20 bp, Artificial
  CRISPR gRNA sequence
tttaaaggaaaaaatgcatt

SEQ ID NO: 647951 - DNA, 20 bp, Artificial
  CRISPR gRNA sequence
taaaggaaaaaatgcattct

SEQ ID NO: 647952 - DNA, 20 bp, Artificial
  CRISPR gRNA sequence
aaaggaaaaaatgcattctt

SEQ ID NO: 647953 - DNA, 20 bp, Artificial
  CRISPR gRNA sequence
aaggaaaaaatgcattcttc

SEQ ID NO: 647954 - DNA, 20 bp, Artificial
  CRISPR gRNA sequence
ttcttctctgtcctatacac

SEQ ID NO: 647955 - DNA, 20 bp, Artificial
  CRISPR gRNA sequence
cttctctgtcctatacacaa

SEQ ID NO: 647956 - DNA, 20 bp, Artificial
  CRISPR gRNA sequence
ttctctgtcctatacacaat

SEQ ID NO: 647957 - DNA, 20 bp, Artificial
  CRISPR gRNA sequence
ctctgtcctatacacaatat

SEQ ID NO: 647958 - DNA, 20 bp, Artificial
  CRISPR gRNA sequence
tctgtcctatacacaatatt

SEQ ID NO: 647959 - DNA, 20 bp, Artificial
  CRISPR gRNA sequence
tgtcctatacacaatatttt

SEQ ID NO: 647960 - DNA, 20 bp, Artificial
  CRISPR gRNA sequence
tcctatacacaatatttttc

SEQ ID NO: 647961 - DNA, 20 bp, Artificial
  CRISPR gRNA sequence
tacacaatatttttcataaa

SEQ ID NO: 647962 - DNA, 20 bp, Artificial
  CRISPR gRNA sequence
ttcataaagtactaaataga

SEQ ID NO: 647963 - DNA, 20 bp, Artificial
  CRISPR gRNA sequence
tcataaagtactaaatagat

SEQ ID NO: 647964 - DNA, 20 bp, Artificial
  CRISPR gRNA sequence
cataaagtactaaatagata

SEQ ID NO: 647965 - DNA, 20 bp, Artificial
  CRISPR gRNA sequence
ataaagtactaaatagatac

SEQ ID NO: 647966 - DNA, 20 bp, Artificial
  CRISPR gRNA sequence
aatagatacttgctgactga

SEQ ID NO: 647967 - DNA, 20 bp, Artificial
  CRISPR gRNA sequence
gctgactgatcaagatgcat

SEQ ID NO: 647968 - DNA, 20 bp, Artificial
  CRISPR gRNA sequence
ctgactgatcaagatgcata

SEQ ID NO: 647969 - DNA, 20 bp, Artificial
  CRISPR gRNA sequence
actgatcaagatgcataata

SEQ ID NO: 647970 - DNA, 20 bp, Artificial
  CRISPR gRNA sequence
atcaagatgcataatagtta

SEQ ID NO: 647971 - DNA, 20 bp, Artificial
  CRISPR gRNA sequence
tcctataggatcttttctag

SEQ ID NO: 647972 - DNA, 20 bp, Artificial
  CRISPR gRNA sequence
taggatcttttctagaaact

SEQ ID NO: 647973 - DNA, 20 bp, Artificial
  CRISPR gRNA sequence
ttctagaaactagttttatg

SEQ ID NO: 647974 - DNA, 20 bp, Artificial
  CRISPR gRNA sequence
tctagaaactagttttatgc

SEQ ID NO: 647975 - DNA, 20 bp, Artificial
  CRISPR gRNA sequence
ctagaaactagttttatgct

SEQ ID NO: 647976 - DNA, 20 bp, Artificial
  CRISPR gRNA sequence
tagaaactagttttatgctt

SEQ ID NO: 647977 - DNA, 20 bp, Artificial
  CRISPR gRNA sequence
gaaactagttttatgctttc

SEQ ID NO: 647978 - DNA, 20 bp, Artificial
  CRISPR gRNA sequence
gttttatgctttctgattcc

SEQ ID NO: 647979 - DNA, 20 bp, Artificial
  CRISPR gRNA sequence
tatgctttctgattccgttt

SEQ ID NO: 647980 - DNA, 20 bp, Artificial
  CRISPR gRNA sequence
atgctttctgattccgtttc

SEQ ID NO: 647981 - DNA, 20 bp, Artificial
  CRISPR gRNA sequence
tgctttctgattccgtttct

SEQ ID NO: 647982 - DNA, 20 bp, Artificial
  CRISPR gRNA sequence
tctgattccgtttctattat

SEQ ID NO: 647983 - DNA, 20 bp, Artificial
  CRISPR gRNA sequence
ctgattccgtttctattata

SEQ ID NO: 647984 - DNA, 20 bp, Artificial
  CRISPR gRNA sequence
tgattccgtttctattatat

SEQ ID NO: 647985 - DNA, 20 bp, Artificial
  CRISPR gRNA sequence
attccgtttctattatataa

SEQ ID NO: 647986 - DNA, 20 bp, Artificial
  CRISPR gRNA sequence
cgtttctattatataatatt

SEQ ID NO: 647987 - DNA, 20 bp, Artificial
  CRISPR gRNA sequence
ctattatataatatttctac

SEQ ID NO: 647988 - DNA, 20 bp, Artificial
  CRISPR gRNA sequence
tattatataatatttctact

SEQ ID NO: 647989 - DNA, 20 bp, Artificial
  CRISPR gRNA sequence
ttatataatatttctactga

SEQ ID NO: 647990 - DNA, 20 bp, Artificial
  CRISPR gRNA sequence
tataatatttctactgattc

SEQ ID NO: 647991 - DNA, 20 bp, Artificial
  CRISPR gRNA sequence
ctactgattctattatgctc

SEQ ID NO: 647992 - DNA, 20 bp, Artificial
  CRISPR gRNA sequence
tactgattctattatgctcc

SEQ ID NO: 647993 - DNA, 20 bp, Artificial
  CRISPR gRNA sequence
ctgattctattatgctccct

SEQ ID NO: 647994 - DNA, 20 bp, Artificial
  CRISPR gRNA sequence
attctattatgctccctgat

SEQ ID NO: 647995 - DNA, 20 bp, Artificial
  CRISPR gRNA sequence
tattatgctccctgatccta

SEQ ID NO: 647996 - DNA, 20 bp, Artificial
  CRISPR gRNA sequence
ttatgctccctgatcctatt

SEQ ID NO: 647997 - DNA, 20 bp, Artificial
  CRISPR gRNA sequence
tgctccctgatcctatttct

SEQ ID NO: 647998 - DNA, 20 bp, Artificial
  CRISPR gRNA sequence
cctgatcctatttctgatct

SEQ ID NO: 647999 - DNA, 20 bp, Artificial
  CRISPR gRNA sequence
atcctatttctgatctattt

SEQ ID NO: 648000 - DNA, 20 bp, Artificial
  CRISPR gRNA sequence
tttctgatctatttcttcag

SEQ ID NO: 648001 - DNA, 20 bp, Artificial
  CRISPR gRNA sequence
ctgatctatttcttcagact

SEQ ID NO: 648002 - DNA, 20 bp, Artificial
  CRISPR gRNA sequence
tgatctatttcttcagactg

SEQ ID NO: 648003 - DNA, 20 bp, Artificial
  CRISPR gRNA sequence
atctatttcttcagactgtt

SEQ ID NO: 648004 - DNA, 20 bp, Artificial
  CRISPR gRNA sequence
tttcttcagactgttggaga

SEQ ID NO: 648005 - DNA, 20 bp, Artificial
  CRISPR gRNA sequence
cttcagactgttggagaaat

SEQ ID NO: 648006 - DNA, 20 bp, Artificial
  CRISPR gRNA sequence
ttcagactgttggagaaata

SEQ ID NO: 648007 - DNA, 20 bp, Artificial
  CRISPR gRNA sequence
cagactgttggagaaatata

SEQ ID NO: 648008 - DNA, 20 bp, Artificial
  CRISPR gRNA sequence
agactgttggagaaatataa

SEQ ID NO: 648009 - DNA, 20 bp, Artificial
  CRISPR gRNA sequence
ttggagaaatataaggtcaa

SEQ ID NO: 648010 - DNA, 20 bp, Artificial
  CRISPR gRNA sequence
gagaaatataaggtcaacca

SEQ ID NO: 648011 - DNA, 20 bp, Artificial
  CRISPR gRNA sequence
gtacaagcgcatttaaaatg

SEQ ID NO: 648012 - DNA, 20 bp, Artificial
  CRISPR gRNA sequence
tacaagcgcatttaaaatgt

SEQ ID NO: 648013 - DNA, 20 bp, Artificial
  CRISPR gRNA sequence
aaaatgttgagctcttcttt

SEQ ID NO: 648014 - DNA, 20 bp, Artificial
  CRISPR gRNA sequence
aaatgttgagctcttctttc

SEQ ID NO: 648015 - DNA, 20 bp, Artificial
  CRISPR gRNA sequence
agctcttctttccttttggc

SEQ ID NO: 648016 - DNA, 20 bp, Artificial
  CRISPR gRNA sequence
ttctttccttttggctccag

SEQ ID NO: 648017 - DNA, 20 bp, Artificial
  CRISPR gRNA sequence
ctttccttttggctccagct

SEQ ID NO: 648018 - DNA, 20 bp, Artificial
  CRISPR gRNA sequence
tttccttttggctccagctc

SEQ ID NO: 648019 - DNA, 20 bp, Artificial
  CRISPR gRNA sequence
tccttttggctccagctcat

SEQ ID NO: 648020 - DNA, 20 bp, Artificial
  CRISPR gRNA sequence
ccttttggctccagctcatg

SEQ ID NO: 648021 - DNA, 20 bp, Artificial
  CRISPR gRNA sequence
cttttggctccagctcatgg

SEQ ID NO: 648022 - DNA, 20 bp, Artificial
  CRISPR gRNA sequence
ttggctccagctcatggaga

SEQ ID NO: 648023 - DNA, 20 bp, Artificial
  CRISPR gRNA sequence
tggctccagctcatggagat

SEQ ID NO: 648024 - DNA, 20 bp, Artificial
  CRISPR gRNA sequence
ggctccagctcatggagata

SEQ ID NO: 648025 - DNA, 20 bp, Artificial
  CRISPR gRNA sequence
gctccagctcatggagatat

SEQ ID NO: 648026 - DNA, 20 bp, Artificial
  CRISPR gRNA sequence
cagctcatggagatatggct

SEQ ID NO: 648027 - DNA, 20 bp, Artificial
  CRISPR gRNA sequence
atggagatatggcttcctat

SEQ ID NO: 648028 - DNA, 20 bp, Artificial
  CRISPR gRNA sequence
cctatcttaggcaaatcagt

SEQ ID NO: 648029 - DNA, 20 bp, Artificial
  CRISPR gRNA sequence
ctatcttaggcaaatcagta

SEQ ID NO: 648030 - DNA, 20 bp, Artificial
  CRISPR gRNA sequence
tcttaggcaaatcagtactt

SEQ ID NO: 648031 - DNA, 20 bp, Artificial
  CRISPR gRNA sequence
aggcaaatcagtacttgggt

SEQ ID NO: 648032 - DNA, 20 bp, Artificial
  CRISPR gRNA sequence
ggcaaatcagtacttgggtg

SEQ ID NO: 648033 - DNA, 20 bp, Artificial
  CRISPR gRNA sequence
gggtgctacactgataccat

SEQ ID NO: 648034 - DNA, 20 bp, Artificial
  CRISPR gRNA sequence
ggtgctacactgataccatt

SEQ ID NO: 648035 - DNA, 20 bp, Artificial
  CRISPR gRNA sequence
cactgataccattagctata

SEQ ID NO: 648036 - DNA, 20 bp, Artificial
  CRISPR gRNA sequence
ataccattagctatatttct

SEQ ID NO: 648037 - DNA, 20 bp, Artificial
  CRISPR gRNA sequence
gctatatttcttacattcag

SEQ ID NO: 648038 - DNA, 20 bp, Artificial
  CRISPR gRNA sequence
tatttcttacattcagtagt

SEQ ID NO: 648039 - DNA, 20 bp, Artificial
  CRISPR gRNA sequence
cttacattcagtagtaattc

SEQ ID NO: 648040 - DNA, 20 bp, Artificial
  CRISPR gRNA sequence
ttacattcagtagtaattca

SEQ ID NO: 648041 - DNA, 20 bp, Artificial
  CRISPR gRNA sequence
acattcagtagtaattcaat

SEQ ID NO: 648042 - DNA, 20 bp, Artificial
  CRISPR gRNA sequence
cattcagtagtaattcaatg

SEQ ID NO: 648043 - DNA, 20 bp, Artificial
  CRISPR gRNA sequence
agtagtaattcaatgtggaa

SEQ ID NO: 648044 - DNA, 20 bp, Artificial
  CRISPR gRNA sequence
aatgtggaagctggagttct

SEQ ID NO: 648045 - DNA, 20 bp, Artificial
  CRISPR gRNA sequence
gagttctgaaactgttagca

SEQ ID NO: 648046 - DNA, 20 bp, Artificial
  CRISPR gRNA sequence
tgaaactgttagcagatcat

SEQ ID NO: 648047 - DNA, 20 bp, Artificial
  CRISPR gRNA sequence
aaactgttagcagatcatgt

SEQ ID NO: 648048 - DNA, 20 bp, Artificial
  CRISPR gRNA sequence
ttagcagatcatgtatgata

SEQ ID NO: 648049 - DNA, 20 bp, Artificial
  CRISPR gRNA sequence
gcagatcatgtatgatattc

SEQ ID NO: 648050 - DNA, 20 bp, Artificial
  CRISPR gRNA sequence
ctggaattctaccaatattc

SEQ ID NO: 648051 - DNA, 20 bp, Artificial
  CRISPR gRNA sequence
gaattctaccaatattcttt

SEQ ID NO: 648052 - DNA, 20 bp, Artificial
  CRISPR gRNA sequence
taccaatattctttctaaca

SEQ ID NO: 648053 - DNA, 20 bp, Artificial
  CRISPR gRNA sequence
ccaatattctttctaacatt

SEQ ID NO: 648054 - DNA, 20 bp, Artificial
  CRISPR gRNA sequence
tttctaacattcattgagtt

SEQ ID NO: 648055 - DNA, 20 bp, Artificial
  CRISPR gRNA sequence
tctaacattcattgagttgc

SEQ ID NO: 648056 - DNA, 20 bp, Artificial
  CRISPR gRNA sequence
ctaacattcattgagttgct

SEQ ID NO: 648057 - DNA, 20 bp, Artificial
  CRISPR gRNA sequence
taacattcattgagttgcta

SEQ ID NO: 648058 - DNA, 20 bp, Artificial
  CRISPR gRNA sequence
acattcattgagttgctata

SEQ ID NO: 648059 - DNA, 20 bp, Artificial
  CRISPR gRNA sequence
attgagttgctataaataca

SEQ ID NO: 648060 - DNA, 20 bp, Artificial
  CRISPR gRNA sequence
agttgctataaatacaagga

SEQ ID NO: 648061 - DNA, 20 bp, Artificial
  CRISPR gRNA sequence
ctataaatacaaggaccatt

SEQ ID NO: 648062 - DNA, 20 bp, Artificial
  CRISPR gRNA sequence
taaatacaaggaccattatg

SEQ ID NO: 648063 - DNA, 20 bp, Artificial
  CRISPR gRNA sequence
tgaaatgtttgtgattaccc

SEQ ID NO: 648064 - DNA, 20 bp, Artificial
  CRISPR gRNA sequence
gtgattacccctggcatatt

SEQ ID NO: 648065 - DNA, 20 bp, Artificial
  CRISPR gRNA sequence
tgattacccctggcatatta

SEQ ID NO: 648066 - DNA, 20 bp, Artificial
  CRISPR gRNA sequence
cccctggcatattacaactt

SEQ ID NO: 648067 - DNA, 20 bp, Artificial
  CRISPR gRNA sequence
gcatattacaacttgtggaa

SEQ ID NO: 648068 - DNA, 20 bp, Artificial
  CRISPR gRNA sequence
caacttgtggaatactggtc

SEQ ID NO: 648069 - DNA, 20 bp, Artificial
  CRISPR gRNA sequence
gtggaatactggtcactaaa

SEQ ID NO: 648070 - DNA, 20 bp, Artificial
  CRISPR gRNA sequence
tggaatactggtcactaaac

SEQ ID NO: 648071 - DNA, 20 bp, Artificial
  CRISPR gRNA sequence
gtcactaaacattttgatag

SEQ ID NO: 648072 - DNA, 20 bp, Artificial
  CRISPR gRNA sequence
aacattttgatagcctcttt

SEQ ID NO: 648073 - DNA, 20 bp, Artificial
  CRISPR gRNA sequence
tgatagcctctttgaggtac

SEQ ID NO: 648074 - DNA, 20 bp, Artificial
  CRISPR gRNA sequence
gatagcctctttgaggtaca

SEQ ID NO: 648075 - DNA, 20 bp, Artificial
  CRISPR gRNA sequence
atagcctctttgaggtacaa

SEQ ID NO: 648076 - DNA, 20 bp, Artificial
  CRISPR gRNA sequence
tttgaggtacaataaagaaa

SEQ ID NO: 648077 - DNA, 20 bp, Artificial
  CRISPR gRNA sequence
tgaggtacaataaagaaaaa

SEQ ID NO: 648078 - DNA, 20 bp, Artificial
  CRISPR gRNA sequence
gaggtacaataaagaaaaac

SEQ ID NO: 648079 - DNA, 20 bp, Artificial
  CRISPR gRNA sequence
aggtacaataaagaaaaaca

SEQ ID NO: 648080 - DNA, 20 bp, Artificial
  CRISPR gRNA sequence
cagcaaaggccttttataac

SEQ ID NO: 648081 - DNA, 20 bp, Artificial
  CRISPR gRNA sequence
agcaaaggccttttataacc

SEQ ID NO: 648082 - DNA, 20 bp, Artificial
  CRISPR gRNA sequence
ttataaccacagcattggtt

SEQ ID NO: 648083 - DNA, 20 bp, Artificial
  CRISPR gRNA sequence
tataaccacagcattggttt

SEQ ID NO: 648084 - DNA, 20 bp, Artificial
  CRISPR gRNA sequence
ataaccacagcattggttta

SEQ ID NO: 648085 - DNA, 20 bp, Artificial
  CRISPR gRNA sequence
taaccacagcattggtttaa

SEQ ID NO: 648086 - DNA, 20 bp, Artificial
  CRISPR gRNA sequence
gtttaaaatggccattatta

SEQ ID NO: 648087 - DNA, 20 bp, Artificial
  CRISPR gRNA sequence
aaaatggccattattacata

SEQ ID NO: 648088 - DNA, 20 bp, Artificial
  CRISPR gRNA sequence
aaatggccattattacatat

SEQ ID NO: 648089 - DNA, 20 bp, Artificial
  CRISPR gRNA sequence
ttacatatttgtacaaaaaa

SEQ ID NO: 648090 - DNA, 20 bp, Artificial
  CRISPR gRNA sequence
catatttgtacaaaaaacta

SEQ ID NO: 648091 - DNA, 20 bp, Artificial
  CRISPR gRNA sequence
gtacaaaaaactaaatagaa

SEQ ID NO: 648092 - DNA, 20 bp, Artificial
  CRISPR gRNA sequence
tacaaaaaactaaatagaat

SEQ ID NO: 648093 - DNA, 20 bp, Artificial
  CRISPR gRNA sequence
aatagaataatatctgtttc

SEQ ID NO: 648094 - DNA, 20 bp, Artificial
  CRISPR gRNA sequence
tttccattctgaagagttcc

SEQ ID NO: 648095 - DNA, 20 bp, Artificial
  CRISPR gRNA sequence
ccattctgaagagttccttc

SEQ ID NO: 648096 - DNA, 20 bp, Artificial
  CRISPR gRNA sequence
cattctgaagagttccttct

SEQ ID NO: 648097 - DNA, 20 bp, Artificial
  CRISPR gRNA sequence
tgaagagttccttctcagtt

SEQ ID NO: 648098 - DNA, 20 bp, Artificial
  CRISPR gRNA sequence
aagagttccttctcagtttg

SEQ ID NO: 648099 - DNA, 20 bp, Artificial
  CRISPR gRNA sequence
cttctcagtttggttagaac

SEQ ID NO: 648100 - DNA, 20 bp, Artificial
  CRISPR gRNA sequence
ctcagtttggttagaacagc

SEQ ID NO: 648101 - DNA, 20 bp, Artificial
  CRISPR gRNA sequence
tcagtttggttagaacagca

SEQ ID NO: 648102 - DNA, 20 bp, Artificial
  CRISPR gRNA sequence
agtttggttagaacagcaca

SEQ ID NO: 648103 - DNA, 20 bp, Artificial
  CRISPR gRNA sequence
ggttagaacagcacactaat

SEQ ID NO: 648104 - DNA, 20 bp, Artificial
  CRISPR gRNA sequence
gttagaacagcacactaatc

SEQ ID NO: 648105 - DNA, 20 bp, Artificial
  CRISPR gRNA sequence
gaacagcacactaatcagct

SEQ ID NO: 648106 - DNA, 20 bp, Artificial
  CRISPR gRNA sequence
atcagctgttgaaatctaaa

SEQ ID NO: 648107 - DNA, 20 bp, Artificial
  CRISPR gRNA sequence
ttgaaatctaaactgattat

SEQ ID NO: 648108 - DNA, 20 bp, Artificial
  CRISPR gRNA sequence
aaatctaaactgattatttc

SEQ ID NO: 648109 - DNA, 20 bp, Artificial
  CRISPR gRNA sequence
aactgattatttctgaagtg

SEQ ID NO: 648110 - DNA, 20 bp, Artificial
  CRISPR gRNA sequence
attatttctgaagtgtcaac

SEQ ID NO: 648111 - DNA, 20 bp, Artificial
  CRISPR gRNA sequence
tttctgaagtgtcaacagat

SEQ ID NO: 648112 - DNA, 20 bp, Artificial
  CRISPR gRNA sequence
ctgaagtgtcaacagatgca

SEQ ID NO: 648113 - DNA, 20 bp, Artificial
  CRISPR gRNA sequence
tgaagtgtcaacagatgcac

SEQ ID NO: 648114 - DNA, 20 bp, Artificial
  CRISPR gRNA sequence
aagtgtcaacagatgcacaa

SEQ ID NO: 648115 - DNA, 20 bp, Artificial
  CRISPR gRNA sequence
cctggctgaaacaggaacat

SEQ ID NO: 648116 - DNA, 20 bp, Artificial
  CRISPR gRNA sequence
gctgaaacaggaacatgtgt

SEQ ID NO: 648117 - DNA, 20 bp, Artificial
  CRISPR gRNA sequence
aaacaggaacatgtgtctat

SEQ ID NO: 648118 - DNA, 20 bp, Artificial
  CRISPR gRNA sequence
ttttgtgtcaacaggctgaa

SEQ ID NO: 648119 - DNA, 20 bp, Artificial
  CRISPR gRNA sequence
tgtgtcaacaggctgaagga

SEQ ID NO: 648120 - DNA, 20 bp, Artificial
  CRISPR gRNA sequence
gtgtcaacaggctgaaggaa

SEQ ID NO: 648121 - DNA, 20 bp, Artificial
  CRISPR gRNA sequence
tgtcaacaggctgaaggaat

SEQ ID NO: 648122 - DNA, 20 bp, Artificial
  CRISPR gRNA sequence
aaggaatacaactgagagag

SEQ ID NO: 648123 - DNA, 20 bp, Artificial
  CRISPR gRNA sequence
agagagaagtgcagaaataa

SEQ ID NO: 648124 - DNA, 20 bp, Artificial
  CRISPR gRNA sequence
acatgattttataaaacatc

SEQ ID NO: 648125 - DNA, 20 bp, Artificial
  CRISPR gRNA sequence
tataaaacatctcaatcaaa

SEQ ID NO: 648126 - DNA, 20 bp, Artificial
  CRISPR gRNA sequence
ataaaacatctcaatcaaaa

SEQ ID NO: 648127 - DNA, 20 bp, Artificial
  CRISPR gRNA sequence
taaaacatctcaatcaaaaa

SEQ ID NO: 648128 - DNA, 20 bp, Artificial
  CRISPR gRNA sequence
aatcaaaaagacctagaaag

SEQ ID NO: 648129 - DNA, 20 bp, Artificial
  CRISPR gRNA sequence
gaaagccaagcaaaggaaaa

SEQ ID NO: 648130 - DNA, 20 bp, Artificial
  CRISPR gRNA sequence
tcaaaggcaggtagaggaaa

SEQ ID NO: 648131 - DNA, 20 bp, Artificial
  CRISPR gRNA sequence
tgcatatatgcttacatttt

SEQ ID NO: 648132 - DNA, 20 bp, Artificial
  CRISPR gRNA sequence
acatttttagttttttcttg

SEQ ID NO: 648133 - DNA, 20 bp, Artificial
  CRISPR gRNA sequence
catttttagttttttcttga

SEQ ID NO: 648134 - DNA, 20 bp, Artificial
  CRISPR gRNA sequence
ttagttttttcttgagaaga

SEQ ID NO: 648135 - DNA, 20 bp, Artificial
  CRISPR gRNA sequence
tagttttttcttgagaagag

SEQ ID NO: 648136 - DNA, 20 bp, Artificial
  CRISPR gRNA sequence
agttttttcttgagaagagc

SEQ ID NO: 648137 - DNA, 20 bp, Artificial
  CRISPR gRNA sequence
gttttttcttgagaagagct

SEQ ID NO: 648138 - DNA, 20 bp, Artificial
  CRISPR gRNA sequence
tttcttgagaagagctacaa

SEQ ID NO: 648139 - DNA, 20 bp, Artificial
  CRISPR gRNA sequence
ttcttgagaagagctacaac

SEQ ID NO: 648140 - DNA, 20 bp, Artificial
  CRISPR gRNA sequence
tcttgagaagagctacaact

SEQ ID NO: 648141 - DNA, 20 bp, Artificial
  CRISPR gRNA sequence
cttgagaagagctacaactc

SEQ ID NO: 648142 - DNA, 20 bp, Artificial
  CRISPR gRNA sequence
ttgagaagagctacaactct

SEQ ID NO: 648143 - DNA, 20 bp, Artificial
  CRISPR gRNA sequence
gagaagagctacaactctcc

SEQ ID NO: 648144 - DNA, 20 bp, Artificial
  CRISPR gRNA sequence
agaagagctacaactctccc

SEQ ID NO: 648145 - DNA, 20 bp, Artificial
  CRISPR gRNA sequence
caactctccctgcctaccac

SEQ ID NO: 648146 - DNA, 20 bp, Artificial
  CRISPR gRNA sequence
tccctgcctaccacccaacc

SEQ ID NO: 648147 - DNA, 20 bp, Artificial
  CRISPR gRNA sequence
cctgcctaccacccaaccct

SEQ ID NO: 648148 - DNA, 20 bp, Artificial
  CRISPR gRNA sequence
cctaccacccaaccctaaag

SEQ ID NO: 648149 - DNA, 20 bp, Artificial
  CRISPR gRNA sequence
ccacccaaccctaaagatgc

SEQ ID NO: 648150 - DNA, 20 bp, Artificial
  CRISPR gRNA sequence
aagatgcagttcagtcacgt

SEQ ID NO: 648151 - DNA, 20 bp, Artificial
  CRISPR gRNA sequence
agtcacgttcttctaccatc

SEQ ID NO: 648152 - DNA, 20 bp, Artificial
  CRISPR gRNA sequence
ttctaccatcttctgaaaag

SEQ ID NO: 648153 - DNA, 20 bp, Artificial
  CRISPR gRNA sequence
ctaccatcttctgaaaagca

SEQ ID NO: 648154 - DNA, 20 bp, Artificial
  CRISPR gRNA sequence
taccatcttctgaaaagcag

SEQ ID NO: 648155 - DNA, 20 bp, Artificial
  CRISPR gRNA sequence
ccatcttctgaaaagcagag

SEQ ID NO: 648156 - DNA, 20 bp, Artificial
  CRISPR gRNA sequence
ctgaaaagcagagactattt

SEQ ID NO: 648157 - DNA, 20 bp, Artificial
  CRISPR gRNA sequence
tgaaaagcagagactatttt

SEQ ID NO: 648158 - DNA, 20 bp, Artificial
  CRISPR gRNA sequence
aaaagcagagactattttag

SEQ ID NO: 648159 - DNA, 20 bp, Artificial
  CRISPR gRNA sequence
ttttagtgattgatggtaaa

SEQ ID NO: 648160 - DNA, 20 bp, Artificial
  CRISPR gRNA sequence
tagtgattgatggtaaaatg

SEQ ID NO: 648161 - DNA, 20 bp, Artificial
  CRISPR gRNA sequence
agtgattgatggtaaaatgc

SEQ ID NO: 648162 - DNA, 20 bp, Artificial
  CRISPR gRNA sequence
gtgattgatggtaaaatgct

SEQ ID NO: 648163 - DNA, 20 bp, Artificial
  CRISPR gRNA sequence
atggtaaaatgctgtaatat

SEQ ID NO: 648164 - DNA, 20 bp, Artificial
  CRISPR gRNA sequence
taatatcttagctccttgga

SEQ ID NO: 648165 - DNA, 20 bp, Artificial
  CRISPR gRNA sequence
agctccttggagcaaccact

SEQ ID NO: 648166 - DNA, 20 bp, Artificial
  CRISPR gRNA sequence
gctccttggagcaaccacta

SEQ ID NO: 648167 - DNA, 20 bp, Artificial
  CRISPR gRNA sequence
cttggagcaaccactatttt

SEQ ID NO: 648168 - DNA, 20 bp, Artificial
  CRISPR gRNA sequence
ggagcaaccactattttctt

SEQ ID NO: 648169 - DNA, 20 bp, Artificial
  CRISPR gRNA sequence
gagcaaccactattttcttt

SEQ ID NO: 648170 - DNA, 20 bp, Artificial
  CRISPR gRNA sequence
ttttctttcccaagtccctg

SEQ ID NO: 648171 - DNA, 20 bp, Artificial
  CRISPR gRNA sequence
tctttcccaagtccctgcac

SEQ ID NO: 648172 - DNA, 20 bp, Artificial
  CRISPR gRNA sequence
ctttcccaagtccctgcaca

SEQ ID NO: 648173 - DNA, 20 bp, Artificial
  CRISPR gRNA sequence
tttcccaagtccctgcacat

SEQ ID NO: 648174 - DNA, 20 bp, Artificial
  CRISPR gRNA sequence
tcccaagtccctgcacatat

SEQ ID NO: 648175 - DNA, 20 bp, Artificial
  CRISPR gRNA sequence
cccaagtccctgcacatata

SEQ ID NO: 648176 - DNA, 20 bp, Artificial
  CRISPR gRNA sequence
ccaagtccctgcacatatac

SEQ ID NO: 648177 - DNA, 20 bp, Artificial
  CRISPR gRNA sequence
cacatatactatctgacagt

SEQ ID NO: 648178 - DNA, 20 bp, Artificial
  CRISPR gRNA sequence
tctgacagtatttcctaaac

SEQ ID NO: 648179 - DNA, 20 bp, Artificial
  CRISPR gRNA sequence
acagtatttcctaaacttgc

SEQ ID NO: 648180 - DNA, 20 bp, Artificial
  CRISPR gRNA sequence
cctaaacttgcctgattatc

SEQ ID NO: 648181 - DNA, 20 bp, Artificial
  CRISPR gRNA sequence
ctaaacttgcctgattatca

SEQ ID NO: 648182 - DNA, 20 bp, Artificial
  CRISPR gRNA sequence
aacttgcctgattatcagaa

SEQ ID NO: 648183 - DNA, 20 bp, Artificial
  CRISPR gRNA sequence
gcctgattatcagaattaga

SEQ ID NO: 648184 - DNA, 20 bp, Artificial
  CRISPR gRNA sequence
cctgattatcagaattagag

SEQ ID NO: 648185 - DNA, 20 bp, Artificial
  CRISPR gRNA sequence
attatcagaattagagtcgc

SEQ ID NO: 648186 - DNA, 20 bp, Artificial
  CRISPR gRNA sequence
tcagaattagagtcgcaggc

SEQ ID NO: 648187 - DNA, 20 bp, Artificial
  CRISPR gRNA sequence
gagtcgcaggctcctcctcc

SEQ ID NO: 648188 - DNA, 20 bp, Artificial
  CRISPR gRNA sequence
ctcctcccttgaacactttg

SEQ ID NO: 648189 - DNA, 20 bp, Artificial
  CRISPR gRNA sequence
ctcccttgaacactttgttt

SEQ ID NO: 648190 - DNA, 20 bp, Artificial
  CRISPR gRNA sequence
ccttgaacactttgtttgat

SEQ ID NO: 648191 - DNA, 20 bp, Artificial
  CRISPR gRNA sequence
gaacactttgtttgattcag

SEQ ID NO: 648192 - DNA, 20 bp, Artificial
  CRISPR gRNA sequence
aacactttgtttgattcagt

SEQ ID NO: 648193 - DNA, 20 bp, Artificial
  CRISPR gRNA sequence
tgtttgattcagtatacttg

SEQ ID NO: 648194 - DNA, 20 bp, Artificial
  CRISPR gRNA sequence
gtttgattcagtatacttga

SEQ ID NO: 648195 - DNA, 20 bp, Artificial
  CRISPR gRNA sequence
tttgattcagtatacttgag

SEQ ID NO: 648196 - DNA, 20 bp, Artificial
  CRISPR gRNA sequence
gattcagtatacttgagttg

SEQ ID NO: 648197 - DNA, 20 bp, Artificial
  CRISPR gRNA sequence
attcagtatacttgagttga

SEQ ID NO: 648198 - DNA, 20 bp, Artificial
  CRISPR gRNA sequence
agtatacttgagttgaggtc

SEQ ID NO: 648199 - DNA, 20 bp, Artificial
  CRISPR gRNA sequence
gagttgaggtctgggactgt

SEQ ID NO: 648200 - DNA, 20 bp, Artificial
  CRISPR gRNA sequence
agttgaggtctgggactgtt

SEQ ID NO: 648201 - DNA, 20 bp, Artificial
  CRISPR gRNA sequence
aggtctgggactgtttattt

SEQ ID NO: 648202 - DNA, 20 bp, Artificial
  CRISPR gRNA sequence
ggactgtttatttttttcaa

SEQ ID NO: 648203 - DNA, 20 bp, Artificial
  CRISPR gRNA sequence
tttatttttttcaagtatct

SEQ ID NO: 648204 - DNA, 20 bp, Artificial
  CRISPR gRNA sequence
atttttttcaagtatcttag

SEQ ID NO: 648205 - DNA, 20 bp, Artificial
  CRISPR gRNA sequence
tttttttcaagtatcttaga

SEQ ID NO: 648206 - DNA, 20 bp, Artificial
  CRISPR gRNA sequence
ttttcaagtatcttagatga

SEQ ID NO: 648207 - DNA, 20 bp, Artificial
  CRISPR gRNA sequence
tttcaagtatcttagatgat

SEQ ID NO: 648208 - DNA, 20 bp, Artificial
  CRISPR gRNA sequence
ttcaagtatcttagatgatt

SEQ ID NO: 648209 - DNA, 20 bp, Artificial
  CRISPR gRNA sequence
tcaagtatcttagatgattc

SEQ ID NO: 648210 - DNA, 20 bp, Artificial
  CRISPR gRNA sequence
caagtatcttagatgattct

SEQ ID NO: 648211 - DNA, 20 bp, Artificial
  CRISPR gRNA sequence
aagtatcttagatgattctt

SEQ ID NO: 648212 - DNA, 20 bp, Artificial
  CRISPR gRNA sequence
agatgattcttacgatcaag

SEQ ID NO: 648213 - DNA, 20 bp, Artificial
  CRISPR gRNA sequence
gatgattcttacgatcaagc

SEQ ID NO: 648214 - DNA, 20 bp, Artificial
  CRISPR gRNA sequence
ttacgatcaagcaagtttga

SEQ ID NO: 648215 - DNA, 20 bp, Artificial
  CRISPR gRNA sequence
acgatcaagcaagtttgaga

SEQ ID NO: 648216 - DNA, 20 bp, Artificial
  CRISPR gRNA sequence
cgatcaagcaagtttgagaa

SEQ ID NO: 648217 - DNA, 20 bp, Artificial
  CRISPR gRNA sequence
gagaaaaagaccctatgaca

SEQ ID NO: 648218 - DNA, 20 bp, Artificial
  CRISPR gRNA sequence
agaaaaagaccctatgacat

SEQ ID NO: 648219 - DNA, 20 bp, Artificial
  CRISPR gRNA sequence
tgacataactattttaaaaa

SEQ ID NO: 648220 - DNA, 20 bp, Artificial
  CRISPR gRNA sequence
ttttaaaaataaattggttt

SEQ ID NO: 648221 - DNA, 20 bp, Artificial
  CRISPR gRNA sequence
taaaaataaattggttttaa

SEQ ID NO: 648222 - DNA, 20 bp, Artificial
  CRISPR gRNA sequence
aaaaataaattggttttaag

SEQ ID NO: 648223 - DNA, 20 bp, Artificial
  CRISPR gRNA sequence
aaaataaattggttttaagg

SEQ ID NO: 648224 - DNA, 20 bp, Artificial
  CRISPR gRNA sequence
gttttaaggattattctttc

SEQ ID NO: 648225 - DNA, 20 bp, Artificial
  CRISPR gRNA sequence
taaggattattctttcctaa

SEQ ID NO: 648226 - DNA, 20 bp, Artificial
  CRISPR gRNA sequence
aaggattattctttcctaag

SEQ ID NO: 648227 - DNA, 20 bp, Artificial
  CRISPR gRNA sequence
aggattattctttcctaaga

SEQ ID NO: 648228 - DNA, 20 bp, Artificial
  CRISPR gRNA sequence
ttctttcctaagaatttcat

SEQ ID NO: 648229 - DNA, 20 bp, Artificial
  CRISPR gRNA sequence
tttcctaagaatttcataat

SEQ ID NO: 648230 - DNA, 20 bp, Artificial
  CRISPR gRNA sequence
tcctaagaatttcataatgt

SEQ ID NO: 648231 - DNA, 20 bp, Artificial
  CRISPR gRNA sequence
cctaagaatttcataatgtc

SEQ ID NO: 648232 - DNA, 20 bp, Artificial
  CRISPR gRNA sequence
ctaagaatttcataatgtct

SEQ ID NO: 648233 - DNA, 20 bp, Artificial
  CRISPR gRNA sequence
agaatttcataatgtctctt

SEQ ID NO: 648234 - DNA, 20 bp, Artificial
  CRISPR gRNA sequence
cataatgtctcttgccatga

SEQ ID NO: 648235 - DNA, 20 bp, Artificial
  CRISPR gRNA sequence
ataatgtctcttgccatgat

SEQ ID NO: 648236 - DNA, 20 bp, Artificial
  CRISPR gRNA sequence
ttgccatgatggcagaccag

SEQ ID NO: 648237 - DNA, 20 bp, Artificial
  CRISPR gRNA sequence
gccatgatggcagaccagaa

SEQ ID NO: 648238 - DNA, 20 bp, Artificial
  CRISPR gRNA sequence
ccatgatggcagaccagaaa

SEQ ID NO: 648239 - DNA, 20 bp, Artificial
  CRISPR gRNA sequence
cgtgaccttgctgaaacact

SEQ ID NO: 648240 - DNA, 20 bp, Artificial
  CRISPR gRNA sequence
gctgaaacactcttaccaaa

SEQ ID NO: 648241 - DNA, 20 bp, Artificial
  CRISPR gRNA sequence
ctgaaacactcttaccaaat

SEQ ID NO: 648242 - DNA, 20 bp, Artificial
  CRISPR gRNA sequence
aaacactcttaccaaatctg

SEQ ID NO: 648243 - DNA, 20 bp, Artificial
  CRISPR gRNA sequence
ttaccaaatctgcagtgaca

SEQ ID NO: 648244 - DNA, 20 bp, Artificial
  CRISPR gRNA sequence
accaaatctgcagtgacata

SEQ ID NO: 648245 - DNA, 20 bp, Artificial
  CRISPR gRNA sequence
ccaaatctgcagtgacataa

SEQ ID NO: 648246 - DNA, 20 bp, Artificial
  CRISPR gRNA sequence
cagtgacataattaaatggg

SEQ ID NO: 648247 - DNA, 20 bp, Artificial
  CRISPR gRNA sequence
aatgggctaacatagctctt

SEQ ID NO: 648248 - DNA, 20 bp, Artificial
  CRISPR gRNA sequence
acatagctcttaaatttata

SEQ ID NO: 648249 - DNA, 20 bp, Artificial
  CRISPR gRNA sequence
ttaaatttatatccaatcat

SEQ ID NO: 648250 - DNA, 20 bp, Artificial
  CRISPR gRNA sequence
aaatttatatccaatcattt

SEQ ID NO: 648251 - DNA, 20 bp, Artificial
  CRISPR gRNA sequence
aatttatatccaatcatttc

SEQ ID NO: 648252 - DNA, 20 bp, Artificial
  CRISPR gRNA sequence
atatccaatcatttctcagc

SEQ ID NO: 648253 - DNA, 20 bp, Artificial
  CRISPR gRNA sequence
tatccaatcatttctcagcc

SEQ ID NO: 648254 - DNA, 20 bp, Artificial
  CRISPR gRNA sequence
ctcagccagtgattctccta

SEQ ID NO: 648255 - DNA, 20 bp, Artificial
  CRISPR gRNA sequence
tcagccagtgattctcctac

SEQ ID NO: 648256 - DNA, 20 bp, Artificial
  CRISPR gRNA sequence
agccagtgattctcctactt

SEQ ID NO: 648257 - DNA, 20 bp, Artificial
  CRISPR gRNA sequence
tcctacttaaataattctcc

SEQ ID NO: 648258 - DNA, 20 bp, Artificial
  CRISPR gRNA sequence
ctacttaaataattctccaa

SEQ ID NO: 648259 - DNA, 20 bp, Artificial
  CRISPR gRNA sequence
cttaaataattctccaaact

SEQ ID NO: 648260 - DNA, 20 bp, Artificial
  CRISPR gRNA sequence
aaataattctccaaactaaa

SEQ ID NO: 648261 - DNA, 20 bp, Artificial
  CRISPR gRNA sequence
aataattctccaaactaaag

SEQ ID NO: 648262 - DNA, 20 bp, Artificial
  CRISPR gRNA sequence
tccaaactaaagtaaagagg

SEQ ID NO: 648263 - DNA, 20 bp, Artificial
  CRISPR gRNA sequence
caaactaaagtaaagaggtg

SEQ ID NO: 648264 - DNA, 20 bp, Artificial
  CRISPR gRNA sequence
aagtaaagaggtggatgaca

SEQ ID NO: 648265 - DNA, 20 bp, Artificial
  CRISPR gRNA sequence
gcctagataatcaaaagaaa

SEQ ID NO: 648266 - DNA, 20 bp, Artificial
  CRISPR gRNA sequence
gataatcaaaagaaactcca

SEQ ID NO: 648267 - DNA, 20 bp, Artificial
  CRISPR gRNA sequence
caatccttcacatggctaga

SEQ ID NO: 648268 - DNA, 20 bp, Artificial
  CRISPR gRNA sequence
cacatggctagattttgcca

SEQ ID NO: 648269 - DNA, 20 bp, Artificial
  CRISPR gRNA sequence
acatggctagattttgccac

SEQ ID NO: 648270 - DNA, 20 bp, Artificial
  CRISPR gRNA sequence
gattttgccacaggtgacct

SEQ ID NO: 648271 - DNA, 20 bp, Artificial
  CRISPR gRNA sequence
tgccacaggtgacctggaac

SEQ ID NO: 648272 - DNA, 20 bp, Artificial
  CRISPR gRNA sequence
gccacaggtgacctggaaca

SEQ ID NO: 648273 - DNA, 20 bp, Artificial
  CRISPR gRNA sequence
ccacaggtgacctggaacac

SEQ ID NO: 648274 - DNA, 20 bp, Artificial
  CRISPR gRNA sequence
gaacacgtgatatttctgca

SEQ ID NO: 648275 - DNA, 20 bp, Artificial
  CRISPR gRNA sequence
ctgcagctagggtcagctcc

SEQ ID NO: 648276 - DNA, 20 bp, Artificial
  CRISPR gRNA sequence
tgcagctagggtcagctcct

SEQ ID NO: 648277 - DNA, 20 bp, Artificial
  CRISPR gRNA sequence
cagctagggtcagctcctcc

SEQ ID NO: 648278 - DNA, 20 bp, Artificial
  CRISPR gRNA sequence
gggtcagctcctcctcaaat

SEQ ID NO: 648279 - DNA, 20 bp, Artificial
  CRISPR gRNA sequence
ctcctcaaatgttcacacaa

SEQ ID NO: 648280 - DNA, 20 bp, Artificial
  CRISPR gRNA sequence
ctcaaatgttcacacaaaga

SEQ ID NO: 648281 - DNA, 20 bp, Artificial
  CRISPR gRNA sequence
aaatgttcacacaaagacga

SEQ ID NO: 648282 - DNA, 20 bp, Artificial
  CRISPR gRNA sequence
acacaaagacgaagccagct

SEQ ID NO: 648283 - DNA, 20 bp, Artificial
  CRISPR gRNA sequence
atttccctgttaaatgtgag

SEQ ID NO: 648284 - DNA, 20 bp, Artificial
  CRISPR gRNA sequence
ccctgttaaatgtgagtgag

SEQ ID NO: 648285 - DNA, 20 bp, Artificial
  CRISPR gRNA sequence
cctgttaaatgtgagtgagt

SEQ ID NO: 648286 - DNA, 20 bp, Artificial
  CRISPR gRNA sequence
ttaaatgtgagtgagtcacc

SEQ ID NO: 648287 - DNA, 20 bp, Artificial
  CRISPR gRNA sequence
aatgtgagtgagtcaccatc

SEQ ID NO: 648288 - DNA, 20 bp, Artificial
  CRISPR gRNA sequence
acgatttagattgctaaggt

SEQ ID NO: 648289 - DNA, 20 bp, Artificial
  CRISPR gRNA sequence
agattgctaaggtgcacata

SEQ ID NO: 648290 - DNA, 20 bp, Artificial
  CRISPR gRNA sequence
gattgctaaggtgcacatat

SEQ ID NO: 648291 - DNA, 20 bp, Artificial
  CRISPR gRNA sequence
ctaaggtgcacatattgaaa

SEQ ID NO: 648292 - DNA, 20 bp, Artificial
  CRISPR gRNA sequence
aggtgcacatattgaaatat

SEQ ID NO: 648293 - DNA, 20 bp, Artificial
  CRISPR gRNA sequence
aaatatatgcttcccggcac

SEQ ID NO: 648294 - DNA, 20 bp, Artificial
  CRISPR gRNA sequence
cccggcacaattccatatcc

SEQ ID NO: 648295 - DNA, 20 bp, Artificial
  CRISPR gRNA sequence
ccggcacaattccatatcca

SEQ ID NO: 648296 - DNA, 20 bp, Artificial
  CRISPR gRNA sequence
catatccaattacaacagta

SEQ ID NO: 648297 - DNA, 20 bp, Artificial
  CRISPR gRNA sequence
caacagtaaatccaataaag

SEQ ID NO: 648298 - DNA, 20 bp, Artificial
  CRISPR gRNA sequence
ccactcaggcaagggagaaa

SEQ ID NO: 648299 - DNA, 20 bp, Artificial
  CRISPR gRNA sequence
aggcaagggagaaataagaa

SEQ ID NO: 648300 - DNA, 20 bp, Artificial
  CRISPR gRNA sequence
attcaagtgttgctaatatc

SEQ ID NO: 648301 - DNA, 20 bp, Artificial
  CRISPR gRNA sequence
aagtgttgctaatatcctca

SEQ ID NO: 648302 - DNA, 20 bp, Artificial
  CRISPR gRNA sequence
ctaatatcctcagaggaaga

SEQ ID NO: 648303 - DNA, 20 bp, Artificial
  CRISPR gRNA sequence
atatcctcagaggaagaaat

SEQ ID NO: 648304 - DNA, 20 bp, Artificial
  CRISPR gRNA sequence
agaggaagaaatgtggatgc

SEQ ID NO: 648305 - DNA, 20 bp, Artificial
  CRISPR gRNA sequence
caaccactttcagtagactc

SEQ ID NO: 648306 - DNA, 20 bp, Artificial
  CRISPR gRNA sequence
tcagtagactccatattatc

SEQ ID NO: 648307 - DNA, 20 bp, Artificial
  CRISPR gRNA sequence
cagtagactccatattatct

SEQ ID NO: 648308 - DNA, 20 bp, Artificial
  CRISPR gRNA sequence
agtagactccatattatctt

SEQ ID NO: 648309 - DNA, 20 bp, Artificial
  CRISPR gRNA sequence
catattatctttttcaccta

SEQ ID NO: 648310 - DNA, 20 bp, Artificial
  CRISPR gRNA sequence
tctttttcacctaggaatct

SEQ ID NO: 648311 - DNA, 20 bp, Artificial
  CRISPR gRNA sequence
tttcacctaggaatctttct

SEQ ID NO: 648312 - DNA, 20 bp, Artificial
  CRISPR gRNA sequence
ttcacctaggaatctttctt

SEQ ID NO: 648313 - DNA, 20 bp, Artificial
  CRISPR gRNA sequence
tcacctaggaatctttctta

SEQ ID NO: 648314 - DNA, 20 bp, Artificial
  CRISPR gRNA sequence
cacctaggaatctttcttaa

SEQ ID NO: 648315 - DNA, 20 bp, Artificial
  CRISPR gRNA sequence
acctaggaatctttcttaag

SEQ ID NO: 648316 - DNA, 20 bp, Artificial
  CRISPR gRNA sequence
ggaatctttcttaagaaatg

SEQ ID NO: 648317 - DNA, 20 bp, Artificial
  CRISPR gRNA sequence
tcttaagaaatgtcagctgg

SEQ ID NO: 648318 - DNA, 20 bp, Artificial
  CRISPR gRNA sequence
cttaagaaatgtcagctgga

SEQ ID NO: 648319 - DNA, 20 bp, Artificial
  CRISPR gRNA sequence
ttaagaaatgtcagctggaa

SEQ ID NO: 648320 - DNA, 20 bp, Artificial
  CRISPR gRNA sequence
aagaaatgtcagctggaaaa

SEQ ID NO: 648321 - DNA, 20 bp, Artificial
  CRISPR gRNA sequence
agaaatgtcagctggaaaac

SEQ ID NO: 648322 - DNA, 20 bp, Artificial
  CRISPR gRNA sequence
gaaaaccgtgatgaatttcc

SEQ ID NO: 648323 - DNA, 20 bp, Artificial
  CRISPR gRNA sequence
ccacaacctaagcaaagtaa

SEQ ID NO: 648324 - DNA, 20 bp, Artificial
  CRISPR gRNA sequence
cacaacctaagcaaagtaaa

SEQ ID NO: 648325 - DNA, 20 bp, Artificial
  CRISPR gRNA sequence
agcaaagtaaaatcctgaaa

SEQ ID NO: 648326 - DNA, 20 bp, Artificial
  CRISPR gRNA sequence
aaagatgatcatacttcctt

SEQ ID NO: 648327 - DNA, 20 bp, Artificial
  CRISPR gRNA sequence
ccttcatgtgagttttgtaa

SEQ ID NO: 648328 - DNA, 20 bp, Artificial
  CRISPR gRNA sequence
cttcatgtgagttttgtaac

SEQ ID NO: 648329 - DNA, 20 bp, Artificial
  CRISPR gRNA sequence
catgtgagttttgtaacatc

SEQ ID NO: 648330 - DNA, 20 bp, Artificial
  CRISPR gRNA sequence
atgtgagttttgtaacatct

SEQ ID NO: 648331 - DNA, 20 bp, Artificial
  CRISPR gRNA sequence
tgtaacatctccctatagcc

SEQ ID NO: 648332 - DNA, 20 bp, Artificial
  CRISPR gRNA sequence
gtaacatctccctatagcct

SEQ ID NO: 648333 - DNA, 20 bp, Artificial
  CRISPR gRNA sequence
taacatctccctatagcctt

SEQ ID NO: 648334 - DNA, 20 bp, Artificial
  CRISPR gRNA sequence
cctatagccttcttcacttt

SEQ ID NO: 648335 - DNA, 20 bp, Artificial
  CRISPR gRNA sequence
tagccttcttcactttatgt

SEQ ID NO: 648336 - DNA, 20 bp, Artificial
  CRISPR gRNA sequence
cttcactttatgtcctactt

SEQ ID NO: 648337 - DNA, 20 bp, Artificial
  CRISPR gRNA sequence
ttcactttatgtcctacttt

SEQ ID NO: 648338 - DNA, 20 bp, Artificial
  CRISPR gRNA sequence
cactttatgtcctactttta

SEQ ID NO: 648339 - DNA, 20 bp, Artificial
  CRISPR gRNA sequence
actttatgtcctacttttaa

SEQ ID NO: 648340 - DNA, 20 bp, Artificial
  CRISPR gRNA sequence
tatgtcctacttttaagcct

SEQ ID NO: 648341 - DNA, 20 bp, Artificial
  CRISPR gRNA sequence
atgtcctacttttaagcctc

SEQ ID NO: 648342 - DNA, 20 bp, Artificial
  CRISPR gRNA sequence
tgtcctacttttaagcctca

SEQ ID NO: 648343 - DNA, 20 bp, Artificial
  CRISPR gRNA sequence
cttttaagcctcaaagcatc

SEQ ID NO: 648344 - DNA, 20 bp, Artificial
  CRISPR gRNA sequence
ttaagcctcaaagcatcagg

SEQ ID NO: 648345 - DNA, 20 bp, Artificial
  CRISPR gRNA sequence
taagcctcaaagcatcaggt

SEQ ID NO: 648346 - DNA, 20 bp, Artificial
  CRISPR gRNA sequence
aagcctcaaagcatcaggtt

SEQ ID NO: 648347 - DNA, 20 bp, Artificial
  CRISPR gRNA sequence
agcctcaaagcatcaggttt

SEQ ID NO: 648348 - DNA, 20 bp, Artificial
  CRISPR gRNA sequence
aaagcatcaggttttatagt

SEQ ID NO: 648349 - DNA, 20 bp, Artificial
  CRISPR gRNA sequence
tatagtatctgctcaaaatt

SEQ ID NO: 648350 - DNA, 20 bp, Artificial
  CRISPR gRNA sequence
atagtatctgctcaaaattc

SEQ ID NO: 648351 - DNA, 20 bp, Artificial
  CRISPR gRNA sequence
tagtatctgctcaaaattct

SEQ ID NO: 648352 - DNA, 20 bp, Artificial
  CRISPR gRNA sequence
ctcaaaattctatgcacaaa

SEQ ID NO: 648353 - DNA, 20 bp, Artificial
  CRISPR gRNA sequence
aaaattctatgcacaaagtc

SEQ ID NO: 648354 - DNA, 20 bp, Artificial
  CRISPR gRNA sequence
tatgcacaaagtcaaaattg

SEQ ID NO: 648355 - DNA, 20 bp, Artificial
  CRISPR gRNA sequence
tgcacaaagtcaaaattgta

SEQ ID NO: 648356 - DNA, 20 bp, Artificial
  CRISPR gRNA sequence
tatatgtaaatggaaacata

SEQ ID NO: 648357 - DNA, 20 bp, Artificial
  CRISPR gRNA sequence
ctgtttccaaaataggcata

SEQ ID NO: 648358 - DNA, 20 bp, Artificial
  CRISPR gRNA sequence
tgtttccaaaataggcatag

SEQ ID NO: 648359 - DNA, 20 bp, Artificial
  CRISPR gRNA sequence
tttccaaaataggcatagtt

SEQ ID NO: 648360 - DNA, 20 bp, Artificial
  CRISPR gRNA sequence
ccaaaataggcatagttttt

SEQ ID NO: 648361 - DNA, 20 bp, Artificial
  CRISPR gRNA sequence
caaaataggcatagtttttg

SEQ ID NO: 648362 - DNA, 20 bp, Artificial
  CRISPR gRNA sequence
ttgtacaaaattttatttta

SEQ ID NO: 648363 - DNA, 20 bp, Artificial
  CRISPR gRNA sequence
tgtacaaaattttattttaa

SEQ ID NO: 648364 - DNA, 20 bp, Artificial
  CRISPR gRNA sequence
gtacaaaattttattttaac

SEQ ID NO: 648365 - DNA, 20 bp, Artificial
  CRISPR gRNA sequence
tacaaaattttattttaacc

SEQ ID NO: 648366 - DNA, 20 bp, Artificial
  CRISPR gRNA sequence
tattttaaccataagttatt

SEQ ID NO: 648367 - DNA, 20 bp, Artificial
  CRISPR gRNA sequence
attttaaccataagttattt

SEQ ID NO: 648368 - DNA, 20 bp, Artificial
  CRISPR gRNA sequence
ttttaaccataagttatttg

SEQ ID NO: 648369 - DNA, 20 bp, Artificial
  CRISPR gRNA sequence
taaccataagttatttgaat

SEQ ID NO: 648370 - DNA, 20 bp, Artificial
  CRISPR gRNA sequence
aaccataagttatttgaatt

SEQ ID NO: 648371 - DNA, 20 bp, Artificial
  CRISPR gRNA sequence
accataagttatttgaattg

SEQ ID NO: 648372 - DNA, 20 bp, Artificial
  CRISPR gRNA sequence
tttgaattgtcgaataaaag

SEQ ID NO: 648373 - DNA, 20 bp, Artificial
  CRISPR gRNA sequence
gaattgtcgaataaaagact

SEQ ID NO: 648374 - DNA, 20 bp, Artificial
  CRISPR gRNA sequence
aattgtcgaataaaagactt

SEQ ID NO: 648375 - DNA, 20 bp, Artificial
  CRISPR gRNA sequence
tcgaataaaagacttaaaag

SEQ ID NO: 648376 - DNA, 20 bp, Artificial
  CRISPR gRNA sequence
aaaaggatatacctaatgta

SEQ ID NO: 648377 - DNA, 20 bp, Artificial
  CRISPR gRNA sequence
aaaggatatacctaatgtaa

SEQ ID NO: 648378 - DNA, 20 bp, Artificial
  CRISPR gRNA sequence
atgtaaatgacaagttaata

SEQ ID NO: 648379 - DNA, 20 bp, Artificial
  CRISPR gRNA sequence
ataggtgcagcacaccaaca

SEQ ID NO: 648380 - DNA, 20 bp, Artificial
  CRISPR gRNA sequence
cttgttgtgcacatgtaccc

SEQ ID NO: 648381 - DNA, 20 bp, Artificial
  CRISPR gRNA sequence
gttgtgcacatgtaccctag

SEQ ID NO: 648382 - DNA, 20 bp, Artificial
  CRISPR gRNA sequence
ttgtgcacatgtaccctaga

SEQ ID NO: 648383 - DNA, 20 bp, Artificial
  CRISPR gRNA sequence
tgcacatgtaccctagaact

SEQ ID NO: 648384 - DNA, 20 bp, Artificial
  CRISPR gRNA sequence
gaacttaaagtataataata

SEQ ID NO: 648385 - DNA, 20 bp, Artificial
  CRISPR gRNA sequence
aaagtataataataaaataa

SEQ ID NO: 648386 - DNA, 20 bp, Artificial
  CRISPR gRNA sequence
aagtataataataaaataaa

SEQ ID NO: 648387 - DNA, 20 bp, Artificial
  CRISPR gRNA sequence
aaagagtaaagtgcttaaaa

SEQ ID NO: 648388 - DNA, 20 bp, Artificial
  CRISPR gRNA sequence
aaaagtaacaataagataca

SEQ ID NO: 648389 - DNA, 20 bp, Artificial
  CRISPR gRNA sequence
aaagtaacaataagatacaa

SEQ ID NO: 648390 - DNA, 20 bp, Artificial
  CRISPR gRNA sequence
ttgaaaataaattcagggtt

SEQ ID NO: 648391 - DNA, 20 bp, Artificial
  CRISPR gRNA sequence
aaaataaattcagggtttgg

SEQ ID NO: 648392 - DNA, 20 bp, Artificial
  CRISPR gRNA sequence
agggtttggtttggtttggt

SEQ ID NO: 648393 - DNA, 20 bp, Artificial
  CRISPR gRNA sequence
ggtttggtttggttttgtta

SEQ ID NO: 648394 - DNA, 20 bp, Artificial
  CRISPR gRNA sequence
gtttggtttggttttgttat

SEQ ID NO: 648395 - DNA, 20 bp, Artificial
  CRISPR gRNA sequence
ggtttggttttgttatttac

SEQ ID NO: 648396 - DNA, 20 bp, Artificial
  CRISPR gRNA sequence
gtttggttttgttatttacc

SEQ ID NO: 648397 - DNA, 20 bp, Artificial
  CRISPR gRNA sequence
ggttttgttatttaccatac

SEQ ID NO: 648398 - DNA, 20 bp, Artificial
  CRISPR gRNA sequence
gttttgttatttaccatact

SEQ ID NO: 648399 - DNA, 20 bp, Artificial
  CRISPR gRNA sequence
tgttatttaccatacttaac

SEQ ID NO: 648400 - DNA, 20 bp, Artificial
  CRISPR gRNA sequence
gttatttaccatacttaaca

SEQ ID NO: 648401 - DNA, 20 bp, Artificial
  CRISPR gRNA sequence
ttatttaccatacttaacat

SEQ ID NO: 648402 - DNA, 20 bp, Artificial
  CRISPR gRNA sequence
tttaccatacttaacatgct

SEQ ID NO: 648403 - DNA, 20 bp, Artificial
  CRISPR gRNA sequence
accatacttaacatgcttta

SEQ ID NO: 648404 - DNA, 20 bp, Artificial
  CRISPR gRNA sequence
ccatacttaacatgctttac

SEQ ID NO: 648405 - DNA, 20 bp, Artificial
  CRISPR gRNA sequence
aacatgctttacttgcagct

SEQ ID NO: 648406 - DNA, 20 bp, Artificial
  CRISPR gRNA sequence
acatgctttacttgcagctg

SEQ ID NO: 648407 - DNA, 20 bp, Artificial
  CRISPR gRNA sequence
tacttgcagctgttggtaca

SEQ ID NO: 648408 - DNA, 20 bp, Artificial
  CRISPR gRNA sequence
acttgcagctgttggtacaa

SEQ ID NO: 648409 - DNA, 20 bp, Artificial
  CRISPR gRNA sequence
cttgcagctgttggtacaaa

SEQ ID NO: 648410 - DNA, 20 bp, Artificial
  CRISPR gRNA sequence
gcagctgttggtacaaaggt

SEQ ID NO: 648411 - DNA, 20 bp, Artificial
  CRISPR gRNA sequence
cagctgttggtacaaaggtg

SEQ ID NO: 648412 - DNA, 20 bp, Artificial
  CRISPR gRNA sequence
ttggtacaaaggtggaaaaa

SEQ ID NO: 648413 - DNA, 20 bp, Artificial
  CRISPR gRNA sequence
gtacaaaggtggaaaaagac

SEQ ID NO: 648414 - DNA, 20 bp, Artificial
  CRISPR gRNA sequence
agcactacacctagagcatc

SEQ ID NO: 648415 - DNA, 20 bp, Artificial
  CRISPR gRNA sequence
cacctagagcatcattcctc

SEQ ID NO: 648416 - DNA, 20 bp, Artificial
  CRISPR gRNA sequence
gagcatcattcctcagaaga

SEQ ID NO: 648417 - DNA, 20 bp, Artificial
  CRISPR gRNA sequence
ctcagaagaaatgatgatag

SEQ ID NO: 648418 - DNA, 20 bp, Artificial
  CRISPR gRNA sequence
agaagaaatgatgatagtat

SEQ ID NO: 648419 - DNA, 20 bp, Artificial
  CRISPR gRNA sequence
taaatacaagggccaatgca

SEQ ID NO: 648420 - DNA, 20 bp, Artificial
  CRISPR gRNA sequence
aatacaagggccaatgcaaa

SEQ ID NO: 648421 - DNA, 20 bp, Artificial
  CRISPR gRNA sequence
taaaaacctacatgaaagcc

SEQ ID NO: 648422 - DNA, 20 bp, Artificial
  CRISPR gRNA sequence
aaaacctacatgaaagcctg

SEQ ID NO: 648423 - DNA, 20 bp, Artificial
  CRISPR gRNA sequence
catgaaagcctgctctacaa

SEQ ID NO: 648424 - DNA, 20 bp, Artificial
  CRISPR gRNA sequence
ctctacaagcactaatacat

SEQ ID NO: 648425 - DNA, 20 bp, Artificial
  CRISPR gRNA sequence
tacaagcactaatacataac

SEQ ID NO: 648426 - DNA, 20 bp, Artificial
  CRISPR gRNA sequence
caagcactaatacataacaa

SEQ ID NO: 648427 - DNA, 20 bp, Artificial
  CRISPR gRNA sequence
atacataacaaagcatctaa

SEQ ID NO: 648428 - DNA, 20 bp, Artificial
  CRISPR gRNA sequence
aaacttgtgagatatttagc

SEQ ID NO: 648429 - DNA, 20 bp, Artificial
  CRISPR gRNA sequence
gtgagatatttagcttgagt

SEQ ID NO: 648430 - DNA, 20 bp, Artificial
  CRISPR gRNA sequence
tgagatatttagcttgagtc

SEQ ID NO: 648431 - DNA, 20 bp, Artificial
  CRISPR gRNA sequence
agcttgagtcttagtgaaaa

SEQ ID NO: 648432 - DNA, 20 bp, Artificial
  CRISPR gRNA sequence
gcttgagtcttagtgaaaaa

SEQ ID NO: 648433 - DNA, 20 bp, Artificial
  CRISPR gRNA sequence
gagtcttagtgaaaaaaaaa

SEQ ID NO: 648434 - DNA, 20 bp, Artificial
  CRISPR gRNA sequence
agtcttagtgaaaaaaaaaa

SEQ ID NO: 648435 - DNA, 20 bp, Artificial
  CRISPR gRNA sequence
agtgaaaaaaaaaagcagtg

SEQ ID NO: 648436 - DNA, 20 bp, Artificial
  CRISPR gRNA sequence
gtgaaaaaaaaaagcagtga

SEQ ID NO: 648437 - DNA, 20 bp, Artificial
  CRISPR gRNA sequence
cagacaggcagatgagggct

SEQ ID NO: 648438 - DNA, 20 bp, Artificial
  CRISPR gRNA sequence
agacaggcagatgagggctc

SEQ ID NO: 648439 - DNA, 20 bp, Artificial
  CRISPR gRNA sequence
aatataaggaagaactttct

SEQ ID NO: 648440 - DNA, 20 bp, Artificial
  CRISPR gRNA sequence
tctaagaattagagctgatc

SEQ ID NO: 648441 - DNA, 20 bp, Artificial
  CRISPR gRNA sequence
ctaagaattagagctgatca

SEQ ID NO: 648442 - DNA, 20 bp, Artificial
  CRISPR gRNA sequence
taagaattagagctgatcag

SEQ ID NO: 648443 - DNA, 20 bp, Artificial
  CRISPR gRNA sequence
agaattagagctgatcagca

SEQ ID NO: 648444 - DNA, 20 bp, Artificial
  CRISPR gRNA sequence
gagctgatcagcaatggaac

SEQ ID NO: 648445 - DNA, 20 bp, Artificial
  CRISPR gRNA sequence
atcagcaatggaacagtaaa

SEQ ID NO: 648446 - DNA, 20 bp, Artificial
  CRISPR gRNA sequence
cctttcctctagcacttgaa

SEQ ID NO: 648447 - DNA, 20 bp, Artificial
  CRISPR gRNA sequence
ctttcctctagcacttgaag

SEQ ID NO: 648448 - DNA, 20 bp, Artificial
  CRISPR gRNA sequence
tcctctagcacttgaagcag

SEQ ID NO: 648449 - DNA, 20 bp, Artificial
  CRISPR gRNA sequence
cctctagcacttgaagcagt

SEQ ID NO: 648450 - DNA, 20 bp, Artificial
  CRISPR gRNA sequence
ctctagcacttgaagcagtc

SEQ ID NO: 648451 - DNA, 20 bp, Artificial
  CRISPR gRNA sequence
tagcacttgaagcagtcaag

SEQ ID NO: 648452 - DNA, 20 bp, Artificial
  CRISPR gRNA sequence
gcacttgaagcagtcaagca

SEQ ID NO: 648453 - DNA, 20 bp, Artificial
  CRISPR gRNA sequence
gaagcagtcaagcaaaatcc

SEQ ID NO: 648454 - DNA, 20 bp, Artificial
  CRISPR gRNA sequence
aagcagtcaagcaaaatccc

SEQ ID NO: 648455 - DNA, 20 bp, Artificial
  CRISPR gRNA sequence
tcatgcatgctgtcaaggat

SEQ ID NO: 648456 - DNA, 20 bp, Artificial
  CRISPR gRNA sequence
tcaaggatattcttgctttg

SEQ ID NO: 648457 - DNA, 20 bp, Artificial
  CRISPR gRNA sequence
ttgctttgttaaggaagttg

SEQ ID NO: 648458 - DNA, 20 bp, Artificial
  CRISPR gRNA sequence
gctttgttaaggaagttgtt

SEQ ID NO: 648459 - DNA, 20 bp, Artificial
  CRISPR gRNA sequence
ctttgttaaggaagttgttc

SEQ ID NO: 648460 - DNA, 20 bp, Artificial
  CRISPR gRNA sequence
tgttaaggaagttgttctaa

SEQ ID NO: 648461 - DNA, 20 bp, Artificial
  CRISPR gRNA sequence
gttaaggaagttgttctaaa

SEQ ID NO: 648462 - DNA, 20 bp, Artificial
  CRISPR gRNA sequence
ttaaggaagttgttctaaat

SEQ ID NO: 648463 - DNA, 20 bp, Artificial
  CRISPR gRNA sequence
aggaagttgttctaaatgac

SEQ ID NO: 648464 - DNA, 20 bp, Artificial
  CRISPR gRNA sequence
ttctaaatgacctttggggt

SEQ ID NO: 648465 - DNA, 20 bp, Artificial
  CRISPR gRNA sequence
taaatgacctttggggtcac

SEQ ID NO: 648466 - DNA, 20 bp, Artificial
  CRISPR gRNA sequence
aatgacctttggggtcactt

SEQ ID NO: 648467 - DNA, 20 bp, Artificial
  CRISPR gRNA sequence
tggggtcacttttaagtaac

SEQ ID NO: 648468 - DNA, 20 bp, Artificial
  CRISPR gRNA sequence
ggggtcacttttaagtaact

SEQ ID NO: 648469 - DNA, 20 bp, Artificial
  CRISPR gRNA sequence
gggtcacttttaagtaactg

SEQ ID NO: 648470 - DNA, 20 bp, Artificial
  CRISPR gRNA sequence
ttaagtaactgattcaagga

SEQ ID NO: 648471 - DNA, 20 bp, Artificial
  CRISPR gRNA sequence
taagtaactgattcaaggat

SEQ ID NO: 648472 - DNA, 20 bp, Artificial
  CRISPR gRNA sequence
aagtaactgattcaaggatt

SEQ ID NO: 648473 - DNA, 20 bp, Artificial
  CRISPR gRNA sequence
agtaactgattcaaggatta

SEQ ID NO: 648474 - DNA, 20 bp, Artificial
  CRISPR gRNA sequence
attcaaggattattttcagt

SEQ ID NO: 648475 - DNA, 20 bp, Artificial
  CRISPR gRNA sequence
aaggattattttcagtgaga

SEQ ID NO: 648476 - DNA, 20 bp, Artificial
  CRISPR gRNA sequence
ttttcagtgagatgaatggc

SEQ ID NO: 648477 - DNA, 20 bp, Artificial
  CRISPR gRNA sequence
tcagtgagatgaatggcatg

SEQ ID NO: 648478 - DNA, 20 bp, Artificial
  CRISPR gRNA sequence
cagtgagatgaatggcatgg

SEQ ID NO: 648479 - DNA, 20 bp, Artificial
  CRISPR gRNA sequence
agtgagatgaatggcatggg

SEQ ID NO: 648480 - DNA, 20 bp, Artificial
  CRISPR gRNA sequence
gtgtgcacgcacacatgcgc

SEQ ID NO: 648481 - DNA, 20 bp, Artificial
  CRISPR gRNA sequence
tgtgcacgcacacatgcgct

SEQ ID NO: 648482 - DNA, 20 bp, Artificial
  CRISPR gRNA sequence
gcgcgcgcgcgcacacacac

SEQ ID NO: 648483 - DNA, 20 bp, Artificial
  CRISPR gRNA sequence
ggaagcctgatatttttaaa

SEQ ID NO: 648484 - DNA, 20 bp, Artificial
  CRISPR gRNA sequence
gaagcctgatatttttaaat

SEQ ID NO: 648485 - DNA, 20 bp, Artificial
  CRISPR gRNA sequence
atatttttaaatgtgatttt

SEQ ID NO: 648486 - DNA, 20 bp, Artificial
  CRISPR gRNA sequence
ttaaatgtgattttacaggc

SEQ ID NO: 648487 - DNA, 20 bp, Artificial
  CRISPR gRNA sequence
taaatgtgattttacaggca

SEQ ID NO: 648488 - DNA, 20 bp, Artificial
  CRISPR gRNA sequence
aaatgtgattttacaggcaa

SEQ ID NO: 648489 - DNA, 20 bp, Artificial
  CRISPR gRNA sequence
aatgtgattttacaggcaaa

SEQ ID NO: 648490 - DNA, 20 bp, Artificial
  CRISPR gRNA sequence
tacaggcaaaaagcaaagaa

SEQ ID NO: 648491 - DNA, 20 bp, Artificial
  CRISPR gRNA sequence
acaggcaaaaagcaaagaag

SEQ ID NO: 648492 - DNA, 20 bp, Artificial
  CRISPR gRNA sequence
caggcaaaaagcaaagaaga

SEQ ID NO: 648493 - DNA, 20 bp, Artificial
  CRISPR gRNA sequence
tgtcatgaaactgccattgt

SEQ ID NO: 648494 - DNA, 20 bp, Artificial
  CRISPR gRNA sequence
tcatgaaactgccattgtgc

SEQ ID NO: 648495 - DNA, 20 bp, Artificial
  CRISPR gRNA sequence
ccattgtgcagaagggggaa

SEQ ID NO: 648496 - DNA, 20 bp, Artificial
  CRISPR gRNA sequence
tgcagaagggggaaagggat

SEQ ID NO: 648497 - DNA, 20 bp, Artificial
  CRISPR gRNA sequence
ctgcctagggattatcttta

SEQ ID NO: 648498 - DNA, 20 bp, Artificial
  CRISPR gRNA sequence
tgcctagggattatctttag

SEQ ID NO: 648499 - DNA, 20 bp, Artificial
  CRISPR gRNA sequence
cctagggattatctttaggt

SEQ ID NO: 648500 - DNA, 20 bp, Artificial
  CRISPR gRNA sequence
gggattatctttaggtcaaa

SEQ ID NO: 648501 - DNA, 20 bp, Artificial
  CRISPR gRNA sequence
tctttaggtcaaagaacaaa

SEQ ID NO: 648502 - DNA, 20 bp, Artificial
  CRISPR gRNA sequence
taggtcaaagaacaaaccca

SEQ ID NO: 648503 - DNA, 20 bp, Artificial
  CRISPR gRNA sequence
aggtcaaagaacaaacccag

SEQ ID NO: 648504 - DNA, 20 bp, Artificial
  CRISPR gRNA sequence
ggtcaaagaacaaacccagg

SEQ ID NO: 648505 - DNA, 20 bp, Artificial
  CRISPR gRNA sequence
ggtaaccttcagcatactct

SEQ ID NO: 648506 - DNA, 20 bp, Artificial
  CRISPR gRNA sequence
cagcatactctctaacagtc

SEQ ID NO: 648507 - DNA, 20 bp, Artificial
  CRISPR gRNA sequence
agcatactctctaacagtct

SEQ ID NO: 648508 - DNA, 20 bp, Artificial
  CRISPR gRNA sequence
tctaacagtctgcaaaccat

SEQ ID NO: 648509 - DNA, 20 bp, Artificial
  CRISPR gRNA sequence
taacagtctgcaaaccatcc

SEQ ID NO: 648510 - DNA, 20 bp, Artificial
  CRISPR gRNA sequence
acagtctgcaaaccatcccg

SEQ ID NO: 648511 - DNA, 20 bp, Artificial
  CRISPR gRNA sequence
caaaccatcccgttcccggg

SEQ ID NO: 648512 - DNA, 20 bp, Artificial
  CRISPR gRNA sequence
ccgggacagaccaggagcta

SEQ ID NO: 648513 - DNA, 20 bp, Artificial
  CRISPR gRNA sequence
caaaactacacgacacactt

SEQ ID NO: 648514 - DNA, 20 bp, Artificial
  CRISPR gRNA sequence
cacgacacacttggatgcat

SEQ ID NO: 648515 - DNA, 20 bp, Artificial
  CRISPR gRNA sequence
ggatgcataatttttcacgt

SEQ ID NO: 648516 - DNA, 20 bp, Artificial
  CRISPR gRNA sequence
gatgcataatttttcacgta

SEQ ID NO: 648517 - DNA, 20 bp, Artificial
  CRISPR gRNA sequence
ttcacgtacaagtggatatg

SEQ ID NO: 648518 - DNA, 20 bp, Artificial
  CRISPR gRNA sequence
tcacgtacaagtggatatgt

SEQ ID NO: 648519 - DNA, 20 bp, Artificial
  CRISPR gRNA sequence
cacgtacaagtggatatgtc

SEQ ID NO: 648520 - DNA, 20 bp, Artificial
  CRISPR gRNA sequence
acgtacaagtggatatgtca

SEQ ID NO: 648521 - DNA, 20 bp, Artificial
  CRISPR gRNA sequence
tctctgctctcaagagtatt

SEQ ID NO: 648522 - DNA, 20 bp, Artificial
  CRISPR gRNA sequence
ctctgctctcaagagtattt

SEQ ID NO: 648523 - DNA, 20 bp, Artificial
  CRISPR gRNA sequence
tctgctctcaagagtatttc

SEQ ID NO: 648524 - DNA, 20 bp, Artificial
  CRISPR gRNA sequence
tgctctcaagagtatttcag

SEQ ID NO: 648525 - DNA, 20 bp, Artificial
  CRISPR gRNA sequence
ctctcaagagtatttcagtt

SEQ ID NO: 648526 - DNA, 20 bp, Artificial
  CRISPR gRNA sequence
tcaagagtatttcagtttcc

SEQ ID NO: 648527 - DNA, 20 bp, Artificial
  CRISPR gRNA sequence
aagagtatttcagtttccca

SEQ ID NO: 648528 - DNA, 20 bp, Artificial
  CRISPR gRNA sequence
cagtttcccatgtgtagaaa

SEQ ID NO: 648529 - DNA, 20 bp, Artificial
  CRISPR gRNA sequence
agtttcccatgtgtagaaag

SEQ ID NO: 648530 - DNA, 20 bp, Artificial
  CRISPR gRNA sequence
cccatgtgtagaaagtacag

SEQ ID NO: 648531 - DNA, 20 bp, Artificial
  CRISPR gRNA sequence
ccatgtgtagaaagtacagg

SEQ ID NO: 648532 - DNA, 20 bp, Artificial
  CRISPR gRNA sequence
aacctgaataagtatacaac

SEQ ID NO: 648533 - DNA, 20 bp, Artificial
  CRISPR gRNA sequence
aataagtatacaacttattt

SEQ ID NO: 648534 - DNA, 20 bp, Artificial
  CRISPR gRNA sequence
atttcctgaataagtataca

SEQ ID NO: 648535 - DNA, 20 bp, Artificial
  CRISPR gRNA sequence
tttcctgaataagtatacaa

SEQ ID NO: 648536 - DNA, 20 bp, Artificial
  CRISPR gRNA sequence
cctgaataagtatacaacaa

SEQ ID NO: 648537 - DNA, 20 bp, Artificial
  CRISPR gRNA sequence
ctgaataagtatacaacaac

SEQ ID NO: 648538 - DNA, 20 bp, Artificial
  CRISPR gRNA sequence
aataagtatacaacaacaac

SEQ ID NO: 648539 - DNA, 20 bp, Artificial
  CRISPR gRNA sequence
catcttttctcaagggtagg

SEQ ID NO: 648540 - DNA, 20 bp, Artificial
  CRISPR gRNA sequence
atcttttctcaagggtaggc

SEQ ID NO: 648541 - DNA, 20 bp, Artificial
  CRISPR gRNA sequence
ttctcaagggtaggctttgc

SEQ ID NO: 648542 - DNA, 20 bp, Artificial
  CRISPR gRNA sequence
tctcaagggtaggctttgcc

SEQ ID NO: 648543 - DNA, 20 bp, Artificial
  CRISPR gRNA sequence
ctcaagggtaggctttgcct

SEQ ID NO: 648544 - DNA, 20 bp, Artificial
  CRISPR gRNA sequence
tcaagggtaggctttgccta

SEQ ID NO: 648545 - DNA, 20 bp, Artificial
  CRISPR gRNA sequence
aagggtaggctttgcctatg

SEQ ID NO: 648546 - DNA, 20 bp, Artificial
  CRISPR gRNA sequence
tgcctatgtgtttccaagga

SEQ ID NO: 648547 - DNA, 20 bp, Artificial
  CRISPR gRNA sequence
gcctatgtgtttccaaggaa

SEQ ID NO: 648548 - DNA, 20 bp, Artificial
  CRISPR gRNA sequence
cctatgtgtttccaaggaat

SEQ ID NO: 648549 - DNA, 20 bp, Artificial
  CRISPR gRNA sequence
tgtgtttccaaggaattcaa

SEQ ID NO: 648550 - DNA, 20 bp, Artificial
  CRISPR gRNA sequence
ccaaggaattcaacttgcta

SEQ ID NO: 648551 - DNA, 20 bp, Artificial
  CRISPR gRNA sequence
caaggaattcaacttgctaa

SEQ ID NO: 648552 - DNA, 20 bp, Artificial
  CRISPR gRNA sequence
aacttgctaatcaattgaca

SEQ ID NO: 648553 - DNA, 20 bp, Artificial
  CRISPR gRNA sequence
gctaatcaattgacaaactc

SEQ ID NO: 648554 - DNA, 20 bp, Artificial
  CRISPR gRNA sequence
ctaatcaattgacaaactca

SEQ ID NO: 648555 - DNA, 20 bp, Artificial
  CRISPR gRNA sequence
atcaattgacaaactcagag

SEQ ID NO: 648556 - DNA, 20 bp, Artificial
  CRISPR gRNA sequence
acaaactcagagttctctac

SEQ ID NO: 648557 - DNA, 20 bp, Artificial
  CRISPR gRNA sequence
agagttctctaccagtcttg

SEQ ID NO: 648558 - DNA, 20 bp, Artificial
  CRISPR gRNA sequence
tctaccagtcttgaaatagg

SEQ ID NO: 648559 - DNA, 20 bp, Artificial
  CRISPR gRNA sequence
taccagtcttgaaataggaa

SEQ ID NO: 648560 - DNA, 20 bp, Artificial
  CRISPR gRNA sequence
ccagtcttgaaataggaaag

SEQ ID NO: 648561 - DNA, 20 bp, Artificial
  CRISPR gRNA sequence
gaaataggaaagaaaaagaa

SEQ ID NO: 648562 - DNA, 20 bp, Artificial
  CRISPR gRNA sequence
aaataggaaagaaaaagaaa

SEQ ID NO: 648563 - DNA, 20 bp, Artificial
  CRISPR gRNA sequence
attccttacatcctgcacaa

SEQ ID NO: 648564 - DNA, 20 bp, Artificial
  CRISPR gRNA sequence
ttccttacatcctgcacaag

SEQ ID NO: 648565 - DNA, 20 bp, Artificial
  CRISPR gRNA sequence
cttacatcctgcacaaggta

SEQ ID NO: 648566 - DNA, 20 bp, Artificial
  CRISPR gRNA sequence
acatcctgcacaaggtatct

SEQ ID NO: 648567 - DNA, 20 bp, Artificial
  CRISPR gRNA sequence
catcctgcacaaggtatcta

SEQ ID NO: 648568 - DNA, 20 bp, Artificial
  CRISPR gRNA sequence
cacaaggtatctattccctt

SEQ ID NO: 648569 - DNA, 20 bp, Artificial
  CRISPR gRNA sequence
ttcccttatacctcacctag

SEQ ID NO: 648570 - DNA, 20 bp, Artificial
  CRISPR gRNA sequence
ccttatacctcacctagcaa

SEQ ID NO: 648571 - DNA, 20 bp, Artificial
  CRISPR gRNA sequence
atacctcacctagcaactta

SEQ ID NO: 648572 - DNA, 20 bp, Artificial
  CRISPR gRNA sequence
tacctcacctagcaacttaa

SEQ ID NO: 648573 - DNA, 20 bp, Artificial
  CRISPR gRNA sequence
acctagcaacttaaatgtaa

SEQ ID NO: 648574 - DNA, 20 bp, Artificial
  CRISPR gRNA sequence
gcaacttaaatgtaattaat

SEQ ID NO: 648575 - DNA, 20 bp, Artificial
  CRISPR gRNA sequence
aaatgtaattaattgtataa

SEQ ID NO: 648576 - DNA, 20 bp, Artificial
  CRISPR gRNA sequence
aatgtaattaattgtataat

SEQ ID NO: 648577 - DNA, 20 bp, Artificial
  CRISPR gRNA sequence
attgtataatttttaagtaa

SEQ ID NO: 648578 - DNA, 20 bp, Artificial
  CRISPR gRNA sequence
tataatttttaagtaaaggt

SEQ ID NO: 648579 - DNA, 20 bp, Artificial
  CRISPR gRNA sequence
ttaagtaaaggtttattttt

SEQ ID NO: 648580 - DNA, 20 bp, Artificial
  CRISPR gRNA sequence
taagtaaaggtttatttttc

SEQ ID NO: 648581 - DNA, 20 bp, Artificial
  CRISPR gRNA sequence
aagtaaaggtttatttttct

SEQ ID NO: 648582 - DNA, 20 bp, Artificial
  CRISPR gRNA sequence
agtaaaggtttatttttctt

SEQ ID NO: 648583 - DNA, 20 bp, Artificial
  CRISPR gRNA sequence
atttttctttctgtattctt

SEQ ID NO: 648584 - DNA, 20 bp, Artificial
  CRISPR gRNA sequence
tttttctttctgtattcttt

SEQ ID NO: 648585 - DNA, 20 bp, Artificial
  CRISPR gRNA sequence
ttctttctgtattctttgtt

SEQ ID NO: 648586 - DNA, 20 bp, Artificial
  CRISPR gRNA sequence
tctttctgtattctttgttt

SEQ ID NO: 648587 - DNA, 20 bp, Artificial
  CRISPR gRNA sequence
ctttctgtattctttgtttg

SEQ ID NO: 648588 - DNA, 20 bp, Artificial
  CRISPR gRNA sequence
tttctgtattctttgtttgc

SEQ ID NO: 648589 - DNA, 20 bp, Artificial
  CRISPR gRNA sequence
tctgtattctttgtttgcta

SEQ ID NO: 648590 - DNA, 20 bp, Artificial
  CRISPR gRNA sequence
ctgtattctttgtttgctac

SEQ ID NO: 648591 - DNA, 20 bp, Artificial
  CRISPR gRNA sequence
tgtattctttgtttgctact

SEQ ID NO: 648592 - DNA, 20 bp, Artificial
  CRISPR gRNA sequence
tattctttgtttgctacttc

SEQ ID NO: 648593 - DNA, 20 bp, Artificial
  CRISPR gRNA sequence
tttgtttgctacttcttatt

SEQ ID NO: 648594 - DNA, 20 bp, Artificial
  CRISPR gRNA sequence
tgtttgctacttcttattag

SEQ ID NO: 648595 - DNA, 20 bp, Artificial
  CRISPR gRNA sequence
gtttgctacttcttattaga

SEQ ID NO: 648596 - DNA, 20 bp, Artificial
  CRISPR gRNA sequence
tttgctacttcttattagat

SEQ ID NO: 648597 - DNA, 20 bp, Artificial
  CRISPR gRNA sequence
gctacttcttattagataca

SEQ ID NO: 648598 - DNA, 20 bp, Artificial
  CRISPR gRNA sequence
ctacttcttattagatacac

SEQ ID NO: 648599 - DNA, 20 bp, Artificial
  CRISPR gRNA sequence
cttcttattagatacacaat

SEQ ID NO: 648600 - DNA, 20 bp, Artificial
  CRISPR gRNA sequence
cttattagatacacaatctt

SEQ ID NO: 648601 - DNA, 20 bp, Artificial
  CRISPR gRNA sequence
ttattagatacacaatcttt

SEQ ID NO: 648602 - DNA, 20 bp, Artificial
  CRISPR gRNA sequence
attagatacacaatcttttc

SEQ ID NO: 648603 - DNA, 20 bp, Artificial
  CRISPR gRNA sequence
ttagatacacaatcttttcc

SEQ ID NO: 648604 - DNA, 20 bp, Artificial
  CRISPR gRNA sequence
gatacacaatcttttcccct

SEQ ID NO: 648605 - DNA, 20 bp, Artificial
  CRISPR gRNA sequence
ttcccctaatagaatggcta

SEQ ID NO: 648606 - DNA, 20 bp, Artificial
  CRISPR gRNA sequence
tcccctaatagaatggctat

SEQ ID NO: 648607 - DNA, 20 bp, Artificial
  CRISPR gRNA sequence
cccctaatagaatggctata

SEQ ID NO: 648608 - DNA, 20 bp, Artificial
  CRISPR gRNA sequence
ccctaatagaatggctatat

SEQ ID NO: 648609 - DNA, 20 bp, Artificial
  CRISPR gRNA sequence
atagaatggctatatggatg

SEQ ID NO: 648610 - DNA, 20 bp, Artificial
  CRISPR gRNA sequence
tatggatgacaaggtttctt

SEQ ID NO: 648611 - DNA, 20 bp, Artificial
  CRISPR gRNA sequence
cttgatataagaattcagat

SEQ ID NO: 648612 - DNA, 20 bp, Artificial
  CRISPR gRNA sequence
ttgatataagaattcagatt

SEQ ID NO: 648613 - DNA, 20 bp, Artificial
  CRISPR gRNA sequence
gatataagaattcagatttc

SEQ ID NO: 648614 - DNA, 20 bp, Artificial
  CRISPR gRNA sequence
atataagaattcagatttca

SEQ ID NO: 648615 - DNA, 20 bp, Artificial
  CRISPR gRNA sequence
agatttcattaacccctgaa

SEQ ID NO: 648616 - DNA, 20 bp, Artificial
  CRISPR gRNA sequence
cattaacccctgaacttcat

SEQ ID NO: 648617 - DNA, 20 bp, Artificial
  CRISPR gRNA sequence
attaacccctgaacttcatt

SEQ ID NO: 648618 - DNA, 20 bp, Artificial
  CRISPR gRNA sequence
acccctgaacttcattgaac

SEQ ID NO: 648619 - DNA, 20 bp, Artificial
  CRISPR gRNA sequence
aacttcattgaactgctatg

SEQ ID NO: 648620 - DNA, 20 bp, Artificial
  CRISPR gRNA sequence
cattgaactgctatgctaaa

SEQ ID NO: 648621 - DNA, 20 bp, Artificial
  CRISPR gRNA sequence
attgaactgctatgctaaat

SEQ ID NO: 648622 - DNA, 20 bp, Artificial
  CRISPR gRNA sequence
aactgctatgctaaatactt

SEQ ID NO: 648623 - DNA, 20 bp, Artificial
  CRISPR gRNA sequence
ctatgctaaatactttggaa

SEQ ID NO: 648624 - DNA, 20 bp, Artificial
  CRISPR gRNA sequence
tgctaaatactttggaaggg

SEQ ID NO: 648625 - DNA, 20 bp, Artificial
  CRISPR gRNA sequence
aatactttggaagggtttct

SEQ ID NO: 648626 - DNA, 20 bp, Artificial
  CRISPR gRNA sequence
tggaagggtttcttatgtga

SEQ ID NO: 648627 - DNA, 20 bp, Artificial
  CRISPR gRNA sequence
ggaagggtttcttatgtgat

SEQ ID NO: 648628 - DNA, 20 bp, Artificial
  CRISPR gRNA sequence
gaagggtttcttatgtgatt

SEQ ID NO: 648629 - DNA, 20 bp, Artificial
  CRISPR gRNA sequence
cttatgtgatttaccaagat

SEQ ID NO: 648630 - DNA, 20 bp, Artificial
  CRISPR gRNA sequence
ttatgtgatttaccaagata

SEQ ID NO: 648631 - DNA, 20 bp, Artificial
  CRISPR gRNA sequence
atgtgatttaccaagataac

SEQ ID NO: 648632 - DNA, 20 bp, Artificial
  CRISPR gRNA sequence
tgtgatttaccaagataact

SEQ ID NO: 648633 - DNA, 20 bp, Artificial
  CRISPR gRNA sequence
accaagataactagtgaaat

SEQ ID NO: 648634 - DNA, 20 bp, Artificial
  CRISPR gRNA sequence
ccaagataactagtgaaatt

SEQ ID NO: 648635 - DNA, 20 bp, Artificial
  CRISPR gRNA sequence
gtgaaattagagcagataca

SEQ ID NO: 648636 - DNA, 20 bp, Artificial
  CRISPR gRNA sequence
gagcagatacagaaataaaa

SEQ ID NO: 648637 - DNA, 20 bp, Artificial
  CRISPR gRNA sequence
ctgttctagagtgtataaca

SEQ ID NO: 648638 - DNA, 20 bp, Artificial
  CRISPR gRNA sequence
tgttctagagtgtataacat

SEQ ID NO: 648639 - DNA, 20 bp, Artificial
  CRISPR gRNA sequence
ttctagagtgtataacattt

SEQ ID NO: 648640 - DNA, 20 bp, Artificial
  CRISPR gRNA sequence
tagagtgtataacatttgaa

SEQ ID NO: 648641 - DNA, 20 bp, Artificial
  CRISPR gRNA sequence
gagtgtataacatttgaaaa

SEQ ID NO: 648642 - DNA, 20 bp, Artificial
  CRISPR gRNA sequence
gaaaatttctacttaacatc

SEQ ID NO: 648643 - DNA, 20 bp, Artificial
  CRISPR gRNA sequence
aaaatttctacttaacatca

SEQ ID NO: 648644 - DNA, 20 bp, Artificial
  CRISPR gRNA sequence
ctacttaacatcaaatcatc

SEQ ID NO: 648645 - DNA, 20 bp, Artificial
  CRISPR gRNA sequence
tacttaacatcaaatcatcc

SEQ ID NO: 648646 - DNA, 20 bp, Artificial
  CRISPR gRNA sequence
cttaacatcaaatcatccat

SEQ ID NO: 648647 - DNA, 20 bp, Artificial
  CRISPR gRNA sequence
aacatcaaatcatccattcc

SEQ ID NO: 648648 - DNA, 20 bp, Artificial
  CRISPR gRNA sequence
acatcaaatcatccattccc

SEQ ID NO: 648649 - DNA, 20 bp, Artificial
  CRISPR gRNA sequence
cctgccattatcctttaata

SEQ ID NO: 648650 - DNA, 20 bp, Artificial
  CRISPR gRNA sequence
ccattatcctttaataaata

SEQ ID NO: 648651 - DNA, 20 bp, Artificial
  CRISPR gRNA sequence
tcctttaataaatatgcctc

SEQ ID NO: 648652 - DNA, 20 bp, Artificial
  CRISPR gRNA sequence
taataaatatgcctcaaatc

SEQ ID NO: 648653 - DNA, 20 bp, Artificial
  CRISPR gRNA sequence
aataaatatgcctcaaatca

SEQ ID NO: 648654 - DNA, 20 bp, Artificial
  CRISPR gRNA sequence
ataaatatgcctcaaatcat

SEQ ID NO: 648655 - DNA, 20 bp, Artificial
  CRISPR gRNA sequence
aaatcatgaatcacgaataa

SEQ ID NO: 648656 - DNA, 20 bp, Artificial
  CRISPR gRNA sequence
ttttctctctttctcctagt

SEQ ID NO: 648657 - DNA, 20 bp, Artificial
  CRISPR gRNA sequence
tttctctctttctcctagtt

SEQ ID NO: 648658 - DNA, 20 bp, Artificial
  CRISPR gRNA sequence
ttctctctttctcctagttc

SEQ ID NO: 648659 - DNA, 20 bp, Artificial
  CRISPR gRNA sequence
tctctctttctcctagttcc

SEQ ID NO: 648660 - DNA, 20 bp, Artificial
  CRISPR gRNA sequence
ctctctttctcctagttcct

SEQ ID NO: 648661 - DNA, 20 bp, Artificial
  CRISPR gRNA sequence
tctctttctcctagttccta

SEQ ID NO: 648662 - DNA, 20 bp, Artificial
  CRISPR gRNA sequence
tctttctcctagttcctaat

SEQ ID NO: 648663 - DNA, 20 bp, Artificial
  CRISPR gRNA sequence
tttctcctagttcctaatag

SEQ ID NO: 648664 - DNA, 20 bp, Artificial
  CRISPR gRNA sequence
tctcctagttcctaatagag

SEQ ID NO: 648665 - DNA, 20 bp, Artificial
  CRISPR gRNA sequence
ctcctagttcctaatagagt

SEQ ID NO: 648666 - DNA, 20 bp, Artificial
  CRISPR gRNA sequence
tcctagttcctaatagagtt

SEQ ID NO: 648667 - DNA, 20 bp, Artificial
  CRISPR gRNA sequence
ctagttcctaatagagtttt

SEQ ID NO: 648668 - DNA, 20 bp, Artificial
  CRISPR gRNA sequence
gttcctaatagagtttttaa

SEQ ID NO: 648669 - DNA, 20 bp, Artificial
  CRISPR gRNA sequence
ctaatagagtttttaattat

SEQ ID NO: 648670 - DNA, 20 bp, Artificial
  CRISPR gRNA sequence
atagagtttttaattataat

SEQ ID NO: 648671 - DNA, 20 bp, Artificial
  CRISPR gRNA sequence
ttaattataatttctcccag

SEQ ID NO: 648672 - DNA, 20 bp, Artificial
  CRISPR gRNA sequence
taattataatttctcccaga

SEQ ID NO: 648673 - DNA, 20 bp, Artificial
  CRISPR gRNA sequence
aattataatttctcccagac

SEQ ID NO: 648674 - DNA, 20 bp, Artificial
  CRISPR gRNA sequence
attataatttctcccagaca

SEQ ID NO: 648675 - DNA, 20 bp, Artificial
  CRISPR gRNA sequence
taatttctcccagacactga

SEQ ID NO: 648676 - DNA, 20 bp, Artificial
  CRISPR gRNA sequence
ctcccagacactgaagcaga

SEQ ID NO: 648677 - DNA, 20 bp, Artificial
  CRISPR gRNA sequence
tcccagacactgaagcagaa

SEQ ID NO: 648678 - DNA, 20 bp, Artificial
  CRISPR gRNA sequence
ccagacactgaagcagaaat

SEQ ID NO: 648679 - DNA, 20 bp, Artificial
  CRISPR gRNA sequence
aagcagaaatattcttcagg

SEQ ID NO: 648680 - DNA, 20 bp, Artificial
  CRISPR gRNA sequence
ttcaggaacaaaaattaaat

SEQ ID NO: 648681 - DNA, 20 bp, Artificial
  CRISPR gRNA sequence
caggaacaaaaattaaatac

SEQ ID NO: 648682 - DNA, 20 bp, Artificial
  CRISPR gRNA sequence
aggaacaaaaattaaataca

SEQ ID NO: 648683 - DNA, 20 bp, Artificial
  CRISPR gRNA sequence
aatacagaatttccaaccaa

SEQ ID NO: 648684 - DNA, 20 bp, Artificial
  CRISPR gRNA sequence
ccaaccaacaaacatttgaa

SEQ ID NO: 648685 - DNA, 20 bp, Artificial
  CRISPR gRNA sequence
caaccaacaaacatttgaaa

SEQ ID NO: 648686 - DNA, 20 bp, Artificial
  CRISPR gRNA sequence
gaaattatgtttaaaaaacc

SEQ ID NO: 648687 - DNA, 20 bp, Artificial
  CRISPR gRNA sequence
aaattatgtttaaaaaaccg

SEQ ID NO: 648688 - DNA, 20 bp, Artificial
  CRISPR gRNA sequence
tgtttaaaaaaccgtaatta

SEQ ID NO: 648689 - DNA, 20 bp, Artificial
  CRISPR gRNA sequence
aaaaaaccgtaattaagaaa

SEQ ID NO: 648690 - DNA, 20 bp, Artificial
  CRISPR gRNA sequence
aaaaaccgtaattaagaaat

SEQ ID NO: 648691 - DNA, 20 bp, Artificial
  CRISPR gRNA sequence
agaaatgtcaaacatacgta

SEQ ID NO: 648692 - DNA, 20 bp, Artificial
  CRISPR gRNA sequence
cccccattcagatgaaccaa

SEQ ID NO: 648693 - DNA, 20 bp, Artificial
  CRISPR gRNA sequence
ccccattcagatgaaccaaa

SEQ ID NO: 648694 - DNA, 20 bp, Artificial
  CRISPR gRNA sequence
agatgaaccaaaatggataa

SEQ ID NO: 648695 - DNA, 20 bp, Artificial
  CRISPR gRNA sequence
ttgtcaaggggagaaaacag

SEQ ID NO: 648696 - DNA, 20 bp, Artificial
  CRISPR gRNA sequence
tgtcaaggggagaaaacaga

SEQ ID NO: 648697 - DNA, 20 bp, Artificial
  CRISPR gRNA sequence
gtcaaggggagaaaacagac

SEQ ID NO: 648698 - DNA, 20 bp, Artificial
  CRISPR gRNA sequence
tcaaggggagaaaacagaca

SEQ ID NO: 648699 - DNA, 20 bp, Artificial
  CRISPR gRNA sequence
acatattactagttgtagtg

SEQ ID NO: 648700 - DNA, 20 bp, Artificial
  CRISPR gRNA sequence
ctagttgtagtgtaaattgt

SEQ ID NO: 648701 - DNA, 20 bp, Artificial
  CRISPR gRNA sequence
gttgtagtgtaaattgttat

SEQ ID NO: 648702 - DNA, 20 bp, Artificial
  CRISPR gRNA sequence
tagtgtaaattgttatactt

SEQ ID NO: 648703 - DNA, 20 bp, Artificial
  CRISPR gRNA sequence
ttatactttccaaagagcaa

SEQ ID NO: 648704 - DNA, 20 bp, Artificial
  CRISPR gRNA sequence
tactttccaaagagcaattt

SEQ ID NO: 648705 - DNA, 20 bp, Artificial
  CRISPR gRNA sequence
tccaaagagcaatttggcca

SEQ ID NO: 648706 - DNA, 20 bp, Artificial
  CRISPR gRNA sequence
ccaaagagcaatttggccac

SEQ ID NO: 648707 - DNA, 20 bp, Artificial
  CRISPR gRNA sequence
caaagagcaatttggccaca

SEQ ID NO: 648708 - DNA, 20 bp, Artificial
  CRISPR gRNA sequence
ggccacactttatctactaa

SEQ ID NO: 648709 - DNA, 20 bp, Artificial
  CRISPR gRNA sequence
gccacactttatctactaaa

SEQ ID NO: 648710 - DNA, 20 bp, Artificial
  CRISPR gRNA sequence
tatctactaaaatattcatt

SEQ ID NO: 648711 - DNA, 20 bp, Artificial
  CRISPR gRNA sequence
atctactaaaatattcattg

SEQ ID NO: 648712 - DNA, 20 bp, Artificial
  CRISPR gRNA sequence
tctactaaaatattcattgc

SEQ ID NO: 648713 - DNA, 20 bp, Artificial
  CRISPR gRNA sequence
ctaaaatattcattgcacag

SEQ ID NO: 648714 - DNA, 20 bp, Artificial
  CRISPR gRNA sequence
aaatattcattgcacagact

SEQ ID NO: 648715 - DNA, 20 bp, Artificial
  CRISPR gRNA sequence
attgcacagacttcttgaca

SEQ ID NO: 648716 - DNA, 20 bp, Artificial
  CRISPR gRNA sequence
cacagacttcttgacatagc

SEQ ID NO: 648717 - DNA, 20 bp, Artificial
  CRISPR gRNA sequence
cttgacatagcaaatacaca

SEQ ID NO: 648718 - DNA, 20 bp, Artificial
  CRISPR gRNA sequence
ttgacatagcaaatacacag

SEQ ID NO: 648719 - DNA, 20 bp, Artificial
  CRISPR gRNA sequence
gacatagcaaatacacagct

SEQ ID NO: 648720 - DNA, 20 bp, Artificial
  CRISPR gRNA sequence
acatagcaaatacacagcta

SEQ ID NO: 648721 - DNA, 20 bp, Artificial
  CRISPR gRNA sequence
agttatcctaaggatgtaaa

SEQ ID NO: 648722 - DNA, 20 bp, Artificial
  CRISPR gRNA sequence
tcctaaggatgtaaagaagg

SEQ ID NO: 648723 - DNA, 20 bp, Artificial
  CRISPR gRNA sequence
aggatgtaaagaaggtaaat

SEQ ID NO: 648724 - DNA, 20 bp, Artificial
  CRISPR gRNA sequence
aaacaatgtctacataataa

SEQ ID NO: 648725 - DNA, 20 bp, Artificial
  CRISPR gRNA sequence
cataataacaaaaacataga

SEQ ID NO: 648726 - DNA, 20 bp, Artificial
  CRISPR gRNA sequence
aatgtccaacagtgaatgag

SEQ ID NO: 648727 - DNA, 20 bp, Artificial
  CRISPR gRNA sequence
aatcaccatgtatcatcagt

SEQ ID NO: 648728 - DNA, 20 bp, Artificial
  CRISPR gRNA sequence
tatgcacccaagaacaacgt

SEQ ID NO: 648729 - DNA, 20 bp, Artificial
  CRISPR gRNA sequence
gtattaaaaaaaaatcctaa

SEQ ID NO: 648730 - DNA, 20 bp, Artificial
  CRISPR gRNA sequence
aaaaaaaatcctaaatgaaa

SEQ ID NO: 648731 - DNA, 20 bp, Artificial
  CRISPR gRNA sequence
aatgaaaaattgagtcatag

SEQ ID NO: 648732 - DNA, 20 bp, Artificial
  CRISPR gRNA sequence
agtcatagggcaagtatgta

SEQ ID NO: 648733 - DNA, 20 bp, Artificial
  CRISPR gRNA sequence
tttgtactattaataggaaa

SEQ ID NO: 648734 - DNA, 20 bp, Artificial
  CRISPR gRNA sequence
gtactattaataggaaagga

SEQ ID NO: 648735 - DNA, 20 bp, Artificial
  CRISPR gRNA sequence
tactattaataggaaaggaa

SEQ ID NO: 648736 - DNA, 20 bp, Artificial
  CRISPR gRNA sequence
ttaataggaaaggaaacaaa

SEQ ID NO: 648737 - DNA, 20 bp, Artificial
  CRISPR gRNA sequence
ataggaaaggaaacaaaata

SEQ ID NO: 648738 - DNA, 20 bp, Artificial
  CRISPR gRNA sequence
gtactagtatataccaaaaa

SEQ ID NO: 648739 - DNA, 20 bp, Artificial
  CRISPR gRNA sequence
tactagtatataccaaaaaa

SEQ ID NO: 648740 - DNA, 20 bp, Artificial
  CRISPR gRNA sequence
gtatataccaaaaaattatg

SEQ ID NO: 648741 - DNA, 20 bp, Artificial
  CRISPR gRNA sequence
tggaaagataattaaggaat

SEQ ID NO: 648742 - DNA, 20 bp, Artificial
  CRISPR gRNA sequence
aggaattggtagcacaggaa

SEQ ID NO: 648743 - DNA, 20 bp, Artificial
  CRISPR gRNA sequence
gtagcacaggaaactgagga

SEQ ID NO: 648744 - DNA, 20 bp, Artificial
  CRISPR gRNA sequence
aggactagggtacttgagtg

SEQ ID NO: 648745 - DNA, 20 bp, Artificial
  CRISPR gRNA sequence
gggtacttgagtggtggagc

SEQ ID NO: 648746 - DNA, 20 bp, Artificial
  CRISPR gRNA sequence
gagtggtggagcttttactt

SEQ ID NO: 648747 - DNA, 20 bp, Artificial
  CRISPR gRNA sequence
agtggtggagcttttacttt

SEQ ID NO: 648748 - DNA, 20 bp, Artificial
  CRISPR gRNA sequence
ttacttttcatgttatatct

SEQ ID NO: 648749 - DNA, 20 bp, Artificial
  CRISPR gRNA sequence
tacttttcatgttatatctt

SEQ ID NO: 648750 - DNA, 20 bp, Artificial
  CRISPR gRNA sequence
acttttcatgttatatcttt

SEQ ID NO: 648751 - DNA, 20 bp, Artificial
  CRISPR gRNA sequence
cttttcatgttatatctttc

SEQ ID NO: 648752 - DNA, 20 bp, Artificial
  CRISPR gRNA sequence
ttcatgttatatctttctct

SEQ ID NO: 648753 - DNA, 20 bp, Artificial
  CRISPR gRNA sequence
tcatgttatatctttctcta

SEQ ID NO: 648754 - DNA, 20 bp, Artificial
  CRISPR gRNA sequence
catgttatatctttctctac

SEQ ID NO: 648755 - DNA, 20 bp, Artificial
  CRISPR gRNA sequence
atgttatatctttctctacc

SEQ ID NO: 648756 - DNA, 20 bp, Artificial
  CRISPR gRNA sequence
tatctttctctaccgtttta

SEQ ID NO: 648757 - DNA, 20 bp, Artificial
  CRISPR gRNA sequence
tctctaccgttttaacttta

SEQ ID NO: 648758 - DNA, 20 bp, Artificial
  CRISPR gRNA sequence
ctctaccgttttaactttat

SEQ ID NO: 648759 - DNA, 20 bp, Artificial
  CRISPR gRNA sequence
tctaccgttttaactttata

SEQ ID NO: 648760 - DNA, 20 bp, Artificial
  CRISPR gRNA sequence
taccgttttaactttatact

SEQ ID NO: 648761 - DNA, 20 bp, Artificial
  CRISPR gRNA sequence
ccgttttaactttatactat

SEQ ID NO: 648762 - DNA, 20 bp, Artificial
  CRISPR gRNA sequence
taactttatactatgttcct

SEQ ID NO: 648763 - DNA, 20 bp, Artificial
  CRISPR gRNA sequence
aactttatactatgttccta

SEQ ID NO: 648764 - DNA, 20 bp, Artificial
  CRISPR gRNA sequence
actttatactatgttcctat

SEQ ID NO: 648765 - DNA, 20 bp, Artificial
  CRISPR gRNA sequence
tatactatgttcctatatca

SEQ ID NO: 648766 - DNA, 20 bp, Artificial
  CRISPR gRNA sequence
atactatgttcctatatcat

SEQ ID NO: 648767 - DNA, 20 bp, Artificial
  CRISPR gRNA sequence
tactatgttcctatatcatt

SEQ ID NO: 648768 - DNA, 20 bp, Artificial
  CRISPR gRNA sequence
tgttcctatatcatttttac

SEQ ID NO: 648769 - DNA, 20 bp, Artificial
  CRISPR gRNA sequence
ctatatcatttttacctaga

SEQ ID NO: 648770 - DNA, 20 bp, Artificial
  CRISPR gRNA sequence
tatcatttttacctagaatc

SEQ ID NO: 648771 - DNA, 20 bp, Artificial
  CRISPR gRNA sequence
ttacctagaatctctattta

SEQ ID NO: 648772 - DNA, 20 bp, Artificial
  CRISPR gRNA sequence
tacctagaatctctatttag

SEQ ID NO: 648773 - DNA, 20 bp, Artificial
  CRISPR gRNA sequence
acctagaatctctatttaga

SEQ ID NO: 648774 - DNA, 20 bp, Artificial
  CRISPR gRNA sequence
cctagaatctctatttagac

SEQ ID NO: 648775 - DNA, 20 bp, Artificial
  CRISPR gRNA sequence
gaatctctatttagactgct

SEQ ID NO: 648776 - DNA, 20 bp, Artificial
  CRISPR gRNA sequence
tatttagactgctctttagc

SEQ ID NO: 648777 - DNA, 20 bp, Artificial
  CRISPR gRNA sequence
tttagactgctctttagccc

SEQ ID NO: 648778 - DNA, 20 bp, Artificial
  CRISPR gRNA sequence
agactgctctttagccccac

SEQ ID NO: 648779 - DNA, 20 bp, Artificial
  CRISPR gRNA sequence
gactgctctttagccccaca

SEQ ID NO: 648780 - DNA, 20 bp, Artificial
  CRISPR gRNA sequence
ctctttagccccacactatg

SEQ ID NO: 648781 - DNA, 20 bp, Artificial
  CRISPR gRNA sequence
tttagccccacactatgtca

SEQ ID NO: 648782 - DNA, 20 bp, Artificial
  CRISPR gRNA sequence
tagccccacactatgtcaga

SEQ ID NO: 648783 - DNA, 20 bp, Artificial
  CRISPR gRNA sequence
agccccacactatgtcagaa

SEQ ID NO: 648784 - DNA, 20 bp, Artificial
  CRISPR gRNA sequence
gccccacactatgtcagaat

SEQ ID NO: 648785 - DNA, 20 bp, Artificial
  CRISPR gRNA sequence
tgtcagaattttgtaatgct

SEQ ID NO: 648786 - DNA, 20 bp, Artificial
  CRISPR gRNA sequence
tgtaatgctggccacatccc

SEQ ID NO: 648787 - DNA, 20 bp, Artificial
  CRISPR gRNA sequence
gtaatgctggccacatcccc

SEQ ID NO: 648788 - DNA, 20 bp, Artificial
  CRISPR gRNA sequence
taatgctggccacatcccct

SEQ ID NO: 648789 - DNA, 20 bp, Artificial
  CRISPR gRNA sequence
gccacatcccctgtgggatg

SEQ ID NO: 648790 - DNA, 20 bp, Artificial
  CRISPR gRNA sequence
tgggatgaagtttatcaccc

SEQ ID NO: 648791 - DNA, 20 bp, Artificial
  CRISPR gRNA sequence
atcacccacaccccatcatc

SEQ ID NO: 648792 - DNA, 20 bp, Artificial
  CRISPR gRNA sequence
tcacccacaccccatcatcc

SEQ ID NO: 648793 - DNA, 20 bp, Artificial
  CRISPR gRNA sequence
gcactatcatgccataacac

SEQ ID NO: 648794 - DNA, 20 bp, Artificial
  CRISPR gRNA sequence
tcatgccataacaccaaagt

SEQ ID NO: 648795 - DNA, 20 bp, Artificial
  CRISPR gRNA sequence
cagttcagaacttacgtaat

SEQ ID NO: 648796 - DNA, 20 bp, Artificial
  CRISPR gRNA sequence
agaacttacgtaatggatgg

SEQ ID NO: 648797 - DNA, 20 bp, Artificial
  CRISPR gRNA sequence
acgtaatggatggtttcagg

SEQ ID NO: 648798 - DNA, 20 bp, Artificial
  CRISPR gRNA sequence
cgtaatggatggtttcaggg

SEQ ID NO: 648799 - DNA, 20 bp, Artificial
  CRISPR gRNA sequence
cagggttgacatttccccta

SEQ ID NO: 648800 - DNA, 20 bp, Artificial
  CRISPR gRNA sequence
agggttgacatttcccctac

SEQ ID NO: 648801 - DNA, 20 bp, Artificial
  CRISPR gRNA sequence
acatttcccctaccactttt

SEQ ID NO: 648802 - DNA, 20 bp, Artificial
  CRISPR gRNA sequence
cccctaccacttttcccatt

SEQ ID NO: 648803 - DNA, 20 bp, Artificial
  CRISPR gRNA sequence
ccctaccacttttcccattt

SEQ ID NO: 648804 - DNA, 20 bp, Artificial
  CRISPR gRNA sequence
ccacttttcccatttcttca

SEQ ID NO: 648805 - DNA, 20 bp, Artificial
  CRISPR gRNA sequence
ttcccatttcttcacaccct

SEQ ID NO: 648806 - DNA, 20 bp, Artificial
  CRISPR gRNA sequence
tcccatttcttcacaccctt

SEQ ID NO: 648807 - DNA, 20 bp, Artificial
  CRISPR gRNA sequence
cccatttcttcacaccctta

SEQ ID NO: 648808 - DNA, 20 bp, Artificial
  CRISPR gRNA sequence
ccatttcttcacacccttat

SEQ ID NO: 648809 - DNA, 20 bp, Artificial
  CRISPR gRNA sequence
cttcacacccttatgttatg

SEQ ID NO: 648810 - DNA, 20 bp, Artificial
  CRISPR gRNA sequence
ttcacacccttatgttatgt

SEQ ID NO: 648811 - DNA, 20 bp, Artificial
  CRISPR gRNA sequence
cacacccttatgttatgtgt

SEQ ID NO: 648812 - DNA, 20 bp, Artificial
  CRISPR gRNA sequence
acacccttatgttatgtgtg

SEQ ID NO: 648813 - DNA, 20 bp, Artificial
  CRISPR gRNA sequence
atgttatgtgtgttgatttc

SEQ ID NO: 648814 - DNA, 20 bp, Artificial
  CRISPR gRNA sequence
tgttatgtgtgttgatttct

SEQ ID NO: 648815 - DNA, 20 bp, Artificial
  CRISPR gRNA sequence
tgtgtgttgatttctgcctt

SEQ ID NO: 648816 - DNA, 20 bp, Artificial
  CRISPR gRNA sequence
atttctgcctttctttctct

SEQ ID NO: 648817 - DNA, 20 bp, Artificial
  CRISPR gRNA sequence
ctgcctttctttctctaaaa

SEQ ID NO: 648818 - DNA, 20 bp, Artificial
  CRISPR gRNA sequence
tgcctttctttctctaaaat

SEQ ID NO: 648819 - DNA, 20 bp, Artificial
  CRISPR gRNA sequence
cctttctttctctaaaatct

SEQ ID NO: 648820 - DNA, 20 bp, Artificial
  CRISPR gRNA sequence
tctttctctaaaatctaagc

SEQ ID NO: 648821 - DNA, 20 bp, Artificial
  CRISPR gRNA sequence
ctttctctaaaatctaagct

SEQ ID NO: 648822 - DNA, 20 bp, Artificial
  CRISPR gRNA sequence
tttctctaaaatctaagctc

SEQ ID NO: 648823 - DNA, 20 bp, Artificial
  CRISPR gRNA sequence
tctctaaaatctaagctcct

SEQ ID NO: 648824 - DNA, 20 bp, Artificial
  CRISPR gRNA sequence
ctctaaaatctaagctcctt

SEQ ID NO: 648825 - DNA, 20 bp, Artificial
  CRISPR gRNA sequence
tctaaaatctaagctccttt

SEQ ID NO: 648826 - DNA, 20 bp, Artificial
  CRISPR gRNA sequence
taaaatctaagctcctttga

SEQ ID NO: 648827 - DNA, 20 bp, Artificial
  CRISPR gRNA sequence
aaatctaagctcctttgaga

SEQ ID NO: 648828 - DNA, 20 bp, Artificial
  CRISPR gRNA sequence
agctcctttgagagtagggt

SEQ ID NO: 648829 - DNA, 20 bp, Artificial
  CRISPR gRNA sequence
ctttgagagtagggtcaatg

SEQ ID NO: 648830 - DNA, 20 bp, Artificial
  CRISPR gRNA sequence
tgagagtagggtcaatgctg

SEQ ID NO: 648831 - DNA, 20 bp, Artificial
  CRISPR gRNA sequence
gagagtagggtcaatgctgc

SEQ ID NO: 648832 - DNA, 20 bp, Artificial
  CRISPR gRNA sequence
agagtagggtcaatgctgcc

SEQ ID NO: 648833 - DNA, 20 bp, Artificial
  CRISPR gRNA sequence
ccttaatcctagcttcccac

SEQ ID NO: 648834 - DNA, 20 bp, Artificial
  CRISPR gRNA sequence
aatcctagcttcccacaatg

SEQ ID NO: 648835 - DNA, 20 bp, Artificial
  CRISPR gRNA sequence
atcctagcttcccacaatgg

SEQ ID NO: 648836 - DNA, 20 bp, Artificial
  CRISPR gRNA sequence
gcttcccacaatggcatcct

SEQ ID NO: 648837 - DNA, 20 bp, Artificial
  CRISPR gRNA sequence
cccacaatggcatcctagga

SEQ ID NO: 648838 - DNA, 20 bp, Artificial
  CRISPR gRNA sequence
ccacaatggcatcctaggag

SEQ ID NO: 648839 - DNA, 20 bp, Artificial
  CRISPR gRNA sequence
ggaggtaccggtaataaata

SEQ ID NO: 648840 - DNA, 20 bp, Artificial
  CRISPR gRNA sequence
gagttgttttttatgagatt

SEQ ID NO: 648841 - DNA, 20 bp, Artificial
  CRISPR gRNA sequence
ttttttatgagattatcgtt

SEQ ID NO: 648842 - DNA, 20 bp, Artificial
  CRISPR gRNA sequence
tttatgagattatcgtttta

SEQ ID NO: 648843 - DNA, 20 bp, Artificial
  CRISPR gRNA sequence
ttatgagattatcgttttaa

SEQ ID NO: 648844 - DNA, 20 bp, Artificial
  CRISPR gRNA sequence
tatgagattatcgttttaag

SEQ ID NO: 648845 - DNA, 20 bp, Artificial
  CRISPR gRNA sequence
atgagattatcgttttaagg

SEQ ID NO: 648846 - DNA, 20 bp, Artificial
  CRISPR gRNA sequence
tgagattatcgttttaaggt

SEQ ID NO: 648847 - DNA, 20 bp, Artificial
  CRISPR gRNA sequence
tcgttttaaggttaaaattg

SEQ ID NO: 648848 - DNA, 20 bp, Artificial
  CRISPR gRNA sequence
taaggttaaaattgtatttt

SEQ ID NO: 648849 - DNA, 20 bp, Artificial
  CRISPR gRNA sequence
aaggttaaaattgtatttta

SEQ ID NO: 648850 - DNA, 20 bp, Artificial
  CRISPR gRNA sequence
aggttaaaattgtattttac

SEQ ID NO: 648851 - DNA, 20 bp, Artificial
  CRISPR gRNA sequence
aaattgtattttacaagaga

SEQ ID NO: 648852 - DNA, 20 bp, Artificial
  CRISPR gRNA sequence
tattttacaagagaagaatt

SEQ ID NO: 648853 - DNA, 20 bp, Artificial
  CRISPR gRNA sequence
tacaagagaagaatttccta

SEQ ID NO: 648854 - DNA, 20 bp, Artificial
  CRISPR gRNA sequence
acaagagaagaatttcctac

SEQ ID NO: 648855 - DNA, 20 bp, Artificial
  CRISPR gRNA sequence
caagagaagaatttcctact

SEQ ID NO: 648856 - DNA, 20 bp, Artificial
  CRISPR gRNA sequence
cctactttcctgaccatata

SEQ ID NO: 648857 - DNA, 20 bp, Artificial
  CRISPR gRNA sequence
ctactttcctgaccatatag

SEQ ID NO: 648858 - DNA, 20 bp, Artificial
  CRISPR gRNA sequence
ctttcctgaccatatagagt

SEQ ID NO: 648859 - DNA, 20 bp, Artificial
  CRISPR gRNA sequence
tcctgaccatatagagttgg

SEQ ID NO: 648860 - DNA, 20 bp, Artificial
  CRISPR gRNA sequence
cctgaccatatagagttggt

SEQ ID NO: 648861 - DNA, 20 bp, Artificial
  CRISPR gRNA sequence
ctgaccatatagagttggta

SEQ ID NO: 648862 - DNA, 20 bp, Artificial
  CRISPR gRNA sequence
accatatagagttggtaata

SEQ ID NO: 648863 - DNA, 20 bp, Artificial
  CRISPR gRNA sequence
gtaataaatcacctccagat

SEQ ID NO: 648864 - DNA, 20 bp, Artificial
  CRISPR gRNA sequence
cagattacagaaagaaacac

SEQ ID NO: 648865 - DNA, 20 bp, Artificial
  CRISPR gRNA sequence
cagaaagaaacactgagatg

SEQ ID NO: 648866 - DNA, 20 bp, Artificial
  CRISPR gRNA sequence
agatgctttaagcttataaa

SEQ ID NO: 648867 - DNA, 20 bp, Artificial
  CRISPR gRNA sequence
taagcttataaataatttgt

SEQ ID NO: 648868 - DNA, 20 bp, Artificial
  CRISPR gRNA sequence
aagcttataaataatttgta

SEQ ID NO: 648869 - DNA, 20 bp, Artificial
  CRISPR gRNA sequence
agcttataaataatttgtaa

SEQ ID NO: 648870 - DNA, 20 bp, Artificial
  CRISPR gRNA sequence
ataaataatttgtaattatt

SEQ ID NO: 648871 - DNA, 20 bp, Artificial
  CRISPR gRNA sequence
taaataatttgtaattatta

SEQ ID NO: 648872 - DNA, 20 bp, Artificial
  CRISPR gRNA sequence
gtaattattaaacaacaaag

SEQ ID NO: 648873 - DNA, 20 bp, Artificial
  CRISPR gRNA sequence
taattattaaacaacaaagt

SEQ ID NO: 648874 - DNA, 20 bp, Artificial
  CRISPR gRNA sequence
ttaaacaacaaagtaaatga

SEQ ID NO: 648875 - DNA, 20 bp, Artificial
  CRISPR gRNA sequence
aacaacaaagtaaatgatgg

SEQ ID NO: 648876 - DNA, 20 bp, Artificial
  CRISPR gRNA sequence
gaaatagttttaaataaaat

SEQ ID NO: 648877 - DNA, 20 bp, Artificial
  CRISPR gRNA sequence
aaatagttttaaataaaatt

SEQ ID NO: 648878 - DNA, 20 bp, Artificial
  CRISPR gRNA sequence
taaataaaatttttcaaaga

SEQ ID NO: 648879 - DNA, 20 bp, Artificial
  CRISPR gRNA sequence
aaataaaatttttcaaagaa

SEQ ID NO: 648880 - DNA, 20 bp, Artificial
  CRISPR gRNA sequence
aataaaatttttcaaagaaa

SEQ ID NO: 648881 - DNA, 20 bp, Artificial
  CRISPR gRNA sequence
ttcaaagaaaaatgcagact

SEQ ID NO: 648882 - DNA, 20 bp, Artificial
  CRISPR gRNA sequence
tcaaagaaaaatgcagactt

SEQ ID NO: 648883 - DNA, 20 bp, Artificial
  CRISPR gRNA sequence
caaagaaaaatgcagacttg

SEQ ID NO: 648884 - DNA, 20 bp, Artificial
  CRISPR gRNA sequence
aaagaaaaatgcagacttgc

SEQ ID NO: 648885 - DNA, 20 bp, Artificial
  CRISPR gRNA sequence
gcaataggtacgtcatatgg

SEQ ID NO: 648886 - DNA, 20 bp, Artificial
  CRISPR gRNA sequence
caataggtacgtcatatggt

SEQ ID NO: 648887 - DNA, 20 bp, Artificial
  CRISPR gRNA sequence
gattgaagaaaaaatattat

SEQ ID NO: 648888 - DNA, 20 bp, Artificial
  CRISPR gRNA sequence
attgaagaaaaaatattata

SEQ ID NO: 648889 - DNA, 20 bp, Artificial
  CRISPR gRNA sequence
aagaaaaaatattataataa

SEQ ID NO: 648890 - DNA, 20 bp, Artificial
  CRISPR gRNA sequence
taataatttcctcatttcca

SEQ ID NO: 648891 - DNA, 20 bp, Artificial
  CRISPR gRNA sequence
cctcatttccaatactgtca

SEQ ID NO: 648892 - DNA, 20 bp, Artificial
  CRISPR gRNA sequence
ctcatttccaatactgtcaa

SEQ ID NO: 648893 - DNA, 20 bp, Artificial
  CRISPR gRNA sequence
atttccaatactgtcaaata

SEQ ID NO: 648894 - DNA, 20 bp, Artificial
  CRISPR gRNA sequence
ccaatactgtcaaatacaat

SEQ ID NO: 648895 - DNA, 20 bp, Artificial
  CRISPR gRNA sequence
caatactgtcaaatacaatt

SEQ ID NO: 648896 - DNA, 20 bp, Artificial
  CRISPR gRNA sequence
tcaaatacaatttcaaaaaa

SEQ ID NO: 648897 - DNA, 20 bp, Artificial
  CRISPR gRNA sequence
caaaaaacaaagcaaaacac

SEQ ID NO: 648898 - DNA, 20 bp, Artificial
  CRISPR gRNA sequence
aaaaaacaaagcaaaacaca

SEQ ID NO: 648899 - DNA, 20 bp, Artificial
  CRISPR gRNA sequence
gtttcagctcacggtacaca

SEQ ID NO: 648900 - DNA, 20 bp, Artificial
  CRISPR gRNA sequence
cagctcacggtacacattta

SEQ ID NO: 648901 - DNA, 20 bp, Artificial
  CRISPR gRNA sequence
agctcacggtacacatttat

SEQ ID NO: 648902 - DNA, 20 bp, Artificial
  CRISPR gRNA sequence
acggtacacatttataacag

SEQ ID NO: 648903 - DNA, 20 bp, Artificial
  CRISPR gRNA sequence
ataacagtgaataggaacta

SEQ ID NO: 648904 - DNA, 20 bp, Artificial
  CRISPR gRNA sequence
taacagtgaataggaactac

SEQ ID NO: 648905 - DNA, 20 bp, Artificial
  CRISPR gRNA sequence
cacatcagaatggaatgatt

SEQ ID NO: 648906 - DNA, 20 bp, Artificial
  CRISPR gRNA sequence
ttgatttcttaatggattac

SEQ ID NO: 648907 - DNA, 20 bp, Artificial
  CRISPR gRNA sequence
atttcttaatggattactgc

SEQ ID NO: 648908 - DNA, 20 bp, Artificial
  CRISPR gRNA sequence
cttaatggattactgctgca

SEQ ID NO: 648909 - DNA, 20 bp, Artificial
  CRISPR gRNA sequence
ttaatggattactgctgcac

SEQ ID NO: 648910 - DNA, 20 bp, Artificial
  CRISPR gRNA sequence
aatggattactgctgcacaa

SEQ ID NO: 648911 - DNA, 20 bp, Artificial
  CRISPR gRNA sequence
atggattactgctgcacaaa

SEQ ID NO: 648912 - DNA, 20 bp, Artificial
  CRISPR gRNA sequence
ctgctgcacaaatttacaca

SEQ ID NO: 648913 - DNA, 20 bp, Artificial
  CRISPR gRNA sequence
ctgcacaaatttacacacac

SEQ ID NO: 648914 - DNA, 20 bp, Artificial
  CRISPR gRNA sequence
cacaaatttacacacaccaa

SEQ ID NO: 648915 - DNA, 20 bp, Artificial
  CRISPR gRNA sequence
acacacaccaaaaaaccatc

SEQ ID NO: 648916 - DNA, 20 bp, Artificial
  CRISPR gRNA sequence
cacacaccaaaaaaccatca

SEQ ID NO: 648917 - DNA, 20 bp, Artificial
  CRISPR gRNA sequence
tgggtaataattataaacct

SEQ ID NO: 648918 - DNA, 20 bp, Artificial
  CRISPR gRNA sequence
gggtaataattataaaccta

SEQ ID NO: 648919 - DNA, 20 bp, Artificial
  CRISPR gRNA sequence
ggtaataattataaacctat

SEQ ID NO: 648920 - DNA, 20 bp, Artificial
  CRISPR gRNA sequence
taaacctatcacagcccata

SEQ ID NO: 648921 - DNA, 20 bp, Artificial
  CRISPR gRNA sequence
tcacagcccatacagcattc

SEQ ID NO: 648922 - DNA, 20 bp, Artificial
  CRISPR gRNA sequence
tgactgaattgaaagttact

SEQ ID NO: 648923 - DNA, 20 bp, Artificial
  CRISPR gRNA sequence
actgaattgaaagttactgc

SEQ ID NO: 648924 - DNA, 20 bp, Artificial
  CRISPR gRNA sequence
aattgaaagttactgctatc

SEQ ID NO: 648925 - DNA, 20 bp, Artificial
  CRISPR gRNA sequence
aaagttactgctatctgccg

SEQ ID NO: 648926 - DNA, 20 bp, Artificial
  CRISPR gRNA sequence
ctgctatctgccgggaaatg

SEQ ID NO: 648927 - DNA, 20 bp, Artificial
  CRISPR gRNA sequence
ctatctgccgggaaatgacc

SEQ ID NO: 648928 - DNA, 20 bp, Artificial
  CRISPR gRNA sequence
tctgccgggaaatgaccaat

SEQ ID NO: 648929 - DNA, 20 bp, Artificial
  CRISPR gRNA sequence
ccgggaaatgaccaattttc

SEQ ID NO: 648930 - DNA, 20 bp, Artificial
  CRISPR gRNA sequence
tctatttctccagctccaac

SEQ ID NO: 648931 - DNA, 20 bp, Artificial
  CRISPR gRNA sequence
ctatttctccagctccaacc

SEQ ID NO: 648932 - DNA, 20 bp, Artificial
  CRISPR gRNA sequence
tatttctccagctccaacca

SEQ ID NO: 648933 - DNA, 20 bp, Artificial
  CRISPR gRNA sequence
tttctccagctccaaccaca

SEQ ID NO: 648934 - DNA, 20 bp, Artificial
  CRISPR gRNA sequence
ctccagctccaaccacaata

SEQ ID NO: 648935 - DNA, 20 bp, Artificial
  CRISPR gRNA sequence
tccagctccaaccacaatat

SEQ ID NO: 648936 - DNA, 20 bp, Artificial
  CRISPR gRNA sequence
cagctccaaccacaatatgg

SEQ ID NO: 648937 - DNA, 20 bp, Artificial
  CRISPR gRNA sequence
caaccacaatatggaatggt

SEQ ID NO: 648938 - DNA, 20 bp, Artificial
  CRISPR gRNA sequence
cttacatcaaatgctattac

SEQ ID NO: 648939 - DNA, 20 bp, Artificial
  CRISPR gRNA sequence
acatcaaatgctattacagg

SEQ ID NO: 648940 - DNA, 20 bp, Artificial
  CRISPR gRNA sequence
catcaaatgctattacagga

SEQ ID NO: 648941 - DNA, 20 bp, Artificial
  CRISPR gRNA sequence
ttacaggacacggtttgtaa

SEQ ID NO: 648942 - DNA, 20 bp, Artificial
  CRISPR gRNA sequence
caggacacggtttgtaacag

SEQ ID NO: 648943 - DNA, 20 bp, Artificial
  CRISPR gRNA sequence
gtaacagccacagcatacac

SEQ ID NO: 648944 - DNA, 20 bp, Artificial
  CRISPR gRNA sequence
taacagccacagcatacacc

SEQ ID NO: 648945 - DNA, 20 bp, Artificial
  CRISPR gRNA sequence
gtaaattgctattagagagg

SEQ ID NO: 648946 - DNA, 20 bp, Artificial
  CRISPR gRNA sequence
taaattgctattagagaggt

SEQ ID NO: 648947 - DNA, 20 bp, Artificial
  CRISPR gRNA sequence
ctattagagaggtaaacaat

SEQ ID NO: 648948 - DNA, 20 bp, Artificial
  CRISPR gRNA sequence
ttagagaggtaaacaatcag

SEQ ID NO: 648949 - DNA, 20 bp, Artificial
  CRISPR gRNA sequence
gagaggtaaacaatcaggtc

SEQ ID NO: 648950 - DNA, 20 bp, Artificial
  CRISPR gRNA sequence
gtggaattttcttattattc

SEQ ID NO: 648951 - DNA, 20 bp, Artificial
  CRISPR gRNA sequence
tcttattattcattagctat

SEQ ID NO: 648952 - DNA, 20 bp, Artificial
  CRISPR gRNA sequence
cttattattcattagctatg

SEQ ID NO: 648953 - DNA, 20 bp, Artificial
  CRISPR gRNA sequence
ttattattcattagctatga

SEQ ID NO: 648954 - DNA, 20 bp, Artificial
  CRISPR gRNA sequence
attattcattagctatgaaa

SEQ ID NO: 648955 - DNA, 20 bp, Artificial
  CRISPR gRNA sequence
ttattcattagctatgaaaa

SEQ ID NO: 648956 - DNA, 20 bp, Artificial
  CRISPR gRNA sequence
ttcattagctatgaaaactg

SEQ ID NO: 648957 - DNA, 20 bp, Artificial
  CRISPR gRNA sequence
attagctatgaaaactgtaa

SEQ ID NO: 648958 - DNA, 20 bp, Artificial
  CRISPR gRNA sequence
gctatgaaaactgtaaataa

SEQ ID NO: 648959 - DNA, 20 bp, Artificial
  CRISPR gRNA sequence
tgaaaactgtaaataaaatg

SEQ ID NO: 648960 - DNA, 20 bp, Artificial
  CRISPR gRNA sequence
taaataaaatgggtataagg

SEQ ID NO: 648961 - DNA, 20 bp, Artificial
  CRISPR gRNA sequence
cacttatcaaagacctttca

SEQ ID NO: 648962 - DNA, 20 bp, Artificial
  CRISPR gRNA sequence
atcaaagacctttcattagt

SEQ ID NO: 648963 - DNA, 20 bp, Artificial
  CRISPR gRNA sequence
tcaaagacctttcattagtg

SEQ ID NO: 648964 - DNA, 20 bp, Artificial
  CRISPR gRNA sequence
tcattagtggcaggttgtgg

SEQ ID NO: 648965 - DNA, 20 bp, Artificial
  CRISPR gRNA sequence
cattagtggcaggttgtgga

SEQ ID NO: 648966 - DNA, 20 bp, Artificial
  CRISPR gRNA sequence
attagtggcaggttgtggag

SEQ ID NO: 648967 - DNA, 20 bp, Artificial
  CRISPR gRNA sequence
gtggcaggttgtggagaagg

SEQ ID NO: 648968 - DNA, 20 bp, Artificial
  CRISPR gRNA sequence
tggagaaggggtcaagggca

SEQ ID NO: 648969 - DNA, 20 bp, Artificial
  CRISPR gRNA sequence
gttgaggtcatgctgttctg

SEQ ID NO: 648970 - DNA, 20 bp, Artificial
  CRISPR gRNA sequence
aggtcatgctgttctgactt

SEQ ID NO: 648971 - DNA, 20 bp, Artificial
  CRISPR gRNA sequence
ttctgactttacatactaat

SEQ ID NO: 648972 - DNA, 20 bp, Artificial
  CRISPR gRNA sequence
tgactttacatactaatttc

SEQ ID NO: 648973 - DNA, 20 bp, Artificial
  CRISPR gRNA sequence
actttacatactaatttcaa

SEQ ID NO: 648974 - DNA, 20 bp, Artificial
  CRISPR gRNA sequence
tacatactaatttcaaacct

SEQ ID NO: 648975 - DNA, 20 bp, Artificial
  CRISPR gRNA sequence
acatactaatttcaaacctc

SEQ ID NO: 648976 - DNA, 20 bp, Artificial
  CRISPR gRNA sequence
catactaatttcaaacctct

SEQ ID NO: 648977 - DNA, 20 bp, Artificial
  CRISPR gRNA sequence
atttcaaacctcttcccaaa

SEQ ID NO: 648978 - DNA, 20 bp, Artificial
  CRISPR gRNA sequence
caaacctcttcccaaatctg

SEQ ID NO: 648979 - DNA, 20 bp, Artificial
  CRISPR gRNA sequence
aaacctcttcccaaatctgc

SEQ ID NO: 648980 - DNA, 20 bp, Artificial
  CRISPR gRNA sequence
ttcccaaatctgcaccagaa

SEQ ID NO: 648981 - DNA, 20 bp, Artificial
  CRISPR gRNA sequence
cccaaatctgcaccagaatc

SEQ ID NO: 648982 - DNA, 20 bp, Artificial
  CRISPR gRNA sequence
ccaaatctgcaccagaatct

SEQ ID NO: 648983 - DNA, 20 bp, Artificial
  CRISPR gRNA sequence
caccagaatctctgtaacta

SEQ ID NO: 648984 - DNA, 20 bp, Artificial
  CRISPR gRNA sequence
tgtaactataaaactacata

SEQ ID NO: 648985 - DNA, 20 bp, Artificial
  CRISPR gRNA sequence
taactataaaactacatagt

SEQ ID NO: 648986 - DNA, 20 bp, Artificial
  CRISPR gRNA sequence
taaaactacatagttctctt

SEQ ID NO: 648987 - DNA, 20 bp, Artificial
  CRISPR gRNA sequence
catagttctctttctaaatc

SEQ ID NO: 648988 - DNA, 20 bp, Artificial
  CRISPR gRNA sequence
tctttctaaatcctaaggat

SEQ ID NO: 648989 - DNA, 20 bp, Artificial
  CRISPR gRNA sequence
tttctaaatcctaaggatgt

SEQ ID NO: 648990 - DNA, 20 bp, Artificial
  CRISPR gRNA sequence
tctaaatcctaaggatgttc

SEQ ID NO: 648991 - DNA, 20 bp, Artificial
  CRISPR gRNA sequence
ctaaatcctaaggatgttct

SEQ ID NO: 648992 - DNA, 20 bp, Artificial
  CRISPR gRNA sequence
taaatcctaaggatgttctc

SEQ ID NO: 648993 - DNA, 20 bp, Artificial
  CRISPR gRNA sequence
aatcctaaggatgttctcag

SEQ ID NO: 648994 - DNA, 20 bp, Artificial
  CRISPR gRNA sequence
aggatgttctcagtaaatag

SEQ ID NO: 648995 - DNA, 20 bp, Artificial
  CRISPR gRNA sequence
tcagtaaatagcacttttac

SEQ ID NO: 648996 - DNA, 20 bp, Artificial
  CRISPR gRNA sequence
agtaaatagcacttttacta

SEQ ID NO: 648997 - DNA, 20 bp, Artificial
  CRISPR gRNA sequence
ttactaaatatccagtggaa

SEQ ID NO: 648998 - DNA, 20 bp, Artificial
  CRISPR gRNA sequence
tactaaatatccagtggaat

SEQ ID NO: 648999 - DNA, 20 bp, Artificial
  CRISPR gRNA sequence
actaaatatccagtggaata

SEQ ID NO: 649000 - DNA, 20 bp, Artificial
  CRISPR gRNA sequence
ctaaatatccagtggaatac

SEQ ID NO: 649001 - DNA, 20 bp, Artificial
  CRISPR gRNA sequence
aatatccagtggaataccaa

SEQ ID NO: 649002 - DNA, 20 bp, Artificial
  CRISPR gRNA sequence
agatactattttccaaaaag

SEQ ID NO: 649003 - DNA, 20 bp, Artificial
  CRISPR gRNA sequence
ttttccaaaaagaaaacccc

SEQ ID NO: 649004 - DNA, 20 bp, Artificial
  CRISPR gRNA sequence
tccaaaaagaaaaccccatt

SEQ ID NO: 649005 - DNA, 20 bp, Artificial
  CRISPR gRNA sequence
ccaaaaagaaaaccccatta

SEQ ID NO: 649006 - DNA, 20 bp, Artificial
  CRISPR gRNA sequence
caaaaagaaaaccccattat

SEQ ID NO: 649007 - DNA, 20 bp, Artificial
  CRISPR gRNA sequence
tgtcagtttcacctagcagt

SEQ ID NO: 649008 - DNA, 20 bp, Artificial
  CRISPR gRNA sequence
cacctagcagtccttaatca

SEQ ID NO: 649009 - DNA, 20 bp, Artificial
  CRISPR gRNA sequence
acctagcagtccttaatcat

SEQ ID NO: 649010 - DNA, 20 bp, Artificial
  CRISPR gRNA sequence
gcagtccttaatcattgaat

SEQ ID NO: 649011 - DNA, 20 bp, Artificial
  CRISPR gRNA sequence
aatcattgaataatgatgtg

SEQ ID NO: 649012 - DNA, 20 bp, Artificial
  CRISPR gRNA sequence
atcattgaataatgatgtga

SEQ ID NO: 649013 - DNA, 20 bp, Artificial
  CRISPR gRNA sequence
aataatgatgtgatacggta

SEQ ID NO: 649014 - DNA, 20 bp, Artificial
  CRISPR gRNA sequence
atcaattaagtttgtaattg

SEQ ID NO: 649015 - DNA, 20 bp, Artificial
  CRISPR gRNA sequence
agtttgtaattgtcatattt

SEQ ID NO: 649016 - DNA, 20 bp, Artificial
  CRISPR gRNA sequence
gtaattgtcatattttccag

SEQ ID NO: 649017 - DNA, 20 bp, Artificial
  CRISPR gRNA sequence
taattgtcatattttccagc

SEQ ID NO: 649018 - DNA, 20 bp, Artificial
  CRISPR gRNA sequence
tcatattttccagctgtagt

SEQ ID NO: 649019 - DNA, 20 bp, Artificial
  CRISPR gRNA sequence
tccagctgtagtagtataga

SEQ ID NO: 649020 - DNA, 20 bp, Artificial
  CRISPR gRNA sequence
ccagctgtagtagtatagat

SEQ ID NO: 649021 - DNA, 20 bp, Artificial
  CRISPR gRNA sequence
cagctgtagtagtatagata

SEQ ID NO: 649022 - DNA, 20 bp, Artificial
  CRISPR gRNA sequence
tagtagtatagataacacca

SEQ ID NO: 649023 - DNA, 20 bp, Artificial
  CRISPR gRNA sequence
ccttccagatagttcatccc

SEQ ID NO: 649024 - DNA, 20 bp, Artificial
  CRISPR gRNA sequence
cttccagatagttcatccca

SEQ ID NO: 649025 - DNA, 20 bp, Artificial
  CRISPR gRNA sequence
ccagatagttcatcccattc

SEQ ID NO: 649026 - DNA, 20 bp, Artificial
  CRISPR gRNA sequence
cagatagttcatcccattct

SEQ ID NO: 649027 - DNA, 20 bp, Artificial
  CRISPR gRNA sequence
atcccattctgaacacctta

SEQ ID NO: 649028 - DNA, 20 bp, Artificial
  CRISPR gRNA sequence
tgaacaccttatttgatcta

SEQ ID NO: 649029 - DNA, 20 bp, Artificial
  CRISPR gRNA sequence
aacaccttatttgatctata

SEQ ID NO: 649030 - DNA, 20 bp, Artificial
  CRISPR gRNA sequence
atttgatctatattacacac

SEQ ID NO: 649031 - DNA, 20 bp, Artificial
  CRISPR gRNA sequence
tttgatctatattacacaca

SEQ ID NO: 649032 - DNA, 20 bp, Artificial
  CRISPR gRNA sequence
gatctatattacacacaaat

SEQ ID NO: 649033 - DNA, 20 bp, Artificial
  CRISPR gRNA sequence
atctatattacacacaaata

SEQ ID NO: 649034 - DNA, 20 bp, Artificial
  CRISPR gRNA sequence
tattacacacaaatagtcct

SEQ ID NO: 649035 - DNA, 20 bp, Artificial
  CRISPR gRNA sequence
cacacaaatagtcctagcat

SEQ ID NO: 649036 - DNA, 20 bp, Artificial
  CRISPR gRNA sequence
gcataaagacagctaatcca

SEQ ID NO: 649037 - DNA, 20 bp, Artificial
  CRISPR gRNA sequence
atccaacccaaataaaagta

SEQ ID NO: 649038 - DNA, 20 bp, Artificial
  CRISPR gRNA sequence
gaaatcaataacacacttgt

SEQ ID NO: 649039 - DNA, 20 bp, Artificial
  CRISPR gRNA sequence
aaatcaataacacacttgtt

SEQ ID NO: 649040 - DNA, 20 bp, Artificial
  CRISPR gRNA sequence
gtttacattttctctttaag

SEQ ID NO: 649041 - DNA, 20 bp, Artificial
  CRISPR gRNA sequence
tttacattttctctttaagt

SEQ ID NO: 649042 - DNA, 20 bp, Artificial
  CRISPR gRNA sequence
acattttctctttaagtcct

SEQ ID NO: 649043 - DNA, 20 bp, Artificial
  CRISPR gRNA sequence
cattttctctttaagtccta

SEQ ID NO: 649044 - DNA, 20 bp, Artificial
  CRISPR gRNA sequence
tctctttaagtcctatctat

SEQ ID NO: 649045 - DNA, 20 bp, Artificial
  CRISPR gRNA sequence
ctctttaagtcctatctatc

SEQ ID NO: 649046 - DNA, 20 bp, Artificial
  CRISPR gRNA sequence
tctttaagtcctatctatca

SEQ ID NO: 649047 - DNA, 20 bp, Artificial
  CRISPR gRNA sequence
tttaagtcctatctatcatc

SEQ ID NO: 649048 - DNA, 20 bp, Artificial
  CRISPR gRNA sequence
taagtcctatctatcatcag

SEQ ID NO: 649049 - DNA, 20 bp, Artificial
  CRISPR gRNA sequence
aagtcctatctatcatcaga

SEQ ID NO: 649050 - DNA, 20 bp, Artificial
  CRISPR gRNA sequence
agtcctatctatcatcagaa

SEQ ID NO: 649051 - DNA, 20 bp, Artificial
  CRISPR gRNA sequence
tctatcatcagaatttttgg

SEQ ID NO: 649052 - DNA, 20 bp, Artificial
  CRISPR gRNA sequence
tcatcagaatttttggttag

SEQ ID NO: 649053 - DNA, 20 bp, Artificial
  CRISPR gRNA sequence
ttggttagatatgtcaacat

SEQ ID NO: 649054 - DNA, 20 bp, Artificial
  CRISPR gRNA sequence
tggttagatatgtcaacatt

SEQ ID NO: 649055 - DNA, 20 bp, Artificial
  CRISPR gRNA sequence
ggttagatatgtcaacattc

SEQ ID NO: 649056 - DNA, 20 bp, Artificial
  CRISPR gRNA sequence
gttagatatgtcaacattct

SEQ ID NO: 649057 - DNA, 20 bp, Artificial
  CRISPR gRNA sequence
gatatgtcaacattcttttc

SEQ ID NO: 649058 - DNA, 20 bp, Artificial
  CRISPR gRNA sequence
ttttctaaagaattataact

SEQ ID NO: 649059 - DNA, 20 bp, Artificial
  CRISPR gRNA sequence
ttctaaagaattataactgc

SEQ ID NO: 649060 - DNA, 20 bp, Artificial
  CRISPR gRNA sequence
tctaaagaattataactgca

SEQ ID NO: 649061 - DNA, 20 bp, Artificial
  CRISPR gRNA sequence
ctaaagaattataactgcaa

SEQ ID NO: 649062 - DNA, 20 bp, Artificial
  CRISPR gRNA sequence
taaagaattataactgcaat

SEQ ID NO: 649063 - DNA, 20 bp, Artificial
  CRISPR gRNA sequence
aagaattataactgcaattt

SEQ ID NO: 649064 - DNA, 20 bp, Artificial
  CRISPR gRNA sequence
taactgcaatttttccaccc

SEQ ID NO: 649065 - DNA, 20 bp, Artificial
  CRISPR gRNA sequence
caatttttccacccaattaa

SEQ ID NO: 649066 - DNA, 20 bp, Artificial
  CRISPR gRNA sequence
ttccacccaattaactaact

SEQ ID NO: 649067 - DNA, 20 bp, Artificial
  CRISPR gRNA sequence
tccacccaattaactaactt

SEQ ID NO: 649068 - DNA, 20 bp, Artificial
  CRISPR gRNA sequence
ccacccaattaactaactta

SEQ ID NO: 649069 - DNA, 20 bp, Artificial
  CRISPR gRNA sequence
cacccaattaactaacttaa

SEQ ID NO: 649070 - DNA, 20 bp, Artificial
  CRISPR gRNA sequence
actaacttaagaatacatgt

SEQ ID NO: 649071 - DNA, 20 bp, Artificial
  CRISPR gRNA sequence
acttaagaatacatgtattt

SEQ ID NO: 649072 - DNA, 20 bp, Artificial
  CRISPR gRNA sequence
aagaatacatgtatttccaa

SEQ ID NO: 649073 - DNA, 20 bp, Artificial
  CRISPR gRNA sequence
agaatacatgtatttccaaa

SEQ ID NO: 649074 - DNA, 20 bp, Artificial
  CRISPR gRNA sequence
ccaaaatatcctaggaacta

SEQ ID NO: 649075 - DNA, 20 bp, Artificial
  CRISPR gRNA sequence
caaaatatcctaggaactaa

SEQ ID NO: 649076 - DNA, 20 bp, Artificial
  CRISPR gRNA sequence
ggaactaaagaaattagatt

SEQ ID NO: 649077 - DNA, 20 bp, Artificial
  CRISPR gRNA sequence
aagaaattagatttgattgt

SEQ ID NO: 649078 - DNA, 20 bp, Artificial
  CRISPR gRNA sequence
gatttgattgtttttataaa

SEQ ID NO: 649079 - DNA, 20 bp, Artificial
  CRISPR gRNA sequence
gattgtttttataaagcatt

SEQ ID NO: 649080 - DNA, 20 bp, Artificial
  CRISPR gRNA sequence
attgtttttataaagcattt

SEQ ID NO: 649081 - DNA, 20 bp, Artificial
  CRISPR gRNA sequence
tttttataaagcatttccct

SEQ ID NO: 649082 - DNA, 20 bp, Artificial
  CRISPR gRNA sequence
ttataaagcatttcccttcc

SEQ ID NO: 649083 - DNA, 20 bp, Artificial
  CRISPR gRNA sequence
tataaagcatttcccttcct

SEQ ID NO: 649084 - DNA, 20 bp, Artificial
  CRISPR gRNA sequence
ataaagcatttcccttccta

SEQ ID NO: 649085 - DNA, 20 bp, Artificial
  CRISPR gRNA sequence
taaagcatttcccttcctaa

SEQ ID NO: 649086 - DNA, 20 bp, Artificial
  CRISPR gRNA sequence
cccttcctaagaggctatta

SEQ ID NO: 649087 - DNA, 20 bp, Artificial
  CRISPR gRNA sequence
ccttcctaagaggctattaa

SEQ ID NO: 649088 - DNA, 20 bp, Artificial
  CRISPR gRNA sequence
cctaagaggctattaaatta

SEQ ID NO: 649089 - DNA, 20 bp, Artificial
  CRISPR gRNA sequence
ctaagaggctattaaattac

SEQ ID NO: 649090 - DNA, 20 bp, Artificial
  CRISPR gRNA sequence
agaggctattaaattaccat

SEQ ID NO: 649091 - DNA, 20 bp, Artificial
  CRISPR gRNA sequence
ttaaattaccatgatgatca

SEQ ID NO: 649092 - DNA, 20 bp, Artificial
  CRISPR gRNA sequence
aattaccatgatgatcaacc

SEQ ID NO: 649093 - DNA, 20 bp, Artificial
  CRISPR gRNA sequence
ccatgatgatcaaccataat

SEQ ID NO: 649094 - DNA, 20 bp, Artificial
  CRISPR gRNA sequence
aaatactattaagtataata

SEQ ID NO: 649095 - DNA, 20 bp, Artificial
  CRISPR gRNA sequence
ttaagtataatataaaagca

SEQ ID NO: 649096 - DNA, 20 bp, Artificial
  CRISPR gRNA sequence
agtataatataaaagcaaat

SEQ ID NO: 649097 - DNA, 20 bp, Artificial
  CRISPR gRNA sequence
aataaagttaccattataaa

SEQ ID NO: 649098 - DNA, 20 bp, Artificial
  CRISPR gRNA sequence
ccattataaaataaaataga

SEQ ID NO: 649099 - DNA, 20 bp, Artificial
  CRISPR gRNA sequence
taaaataaaatagatttgtg

SEQ ID NO: 649100 - DNA, 20 bp, Artificial
  CRISPR gRNA sequence
gtgaaataccacaatagatt

SEQ ID NO: 649101 - DNA, 20 bp, Artificial
  CRISPR gRNA sequence
tgaaataccacaatagattt

SEQ ID NO: 649102 - DNA, 20 bp, Artificial
  CRISPR gRNA sequence
gtgaaatggtgaaatgtgag

SEQ ID NO: 649103 - DNA, 20 bp, Artificial
  CRISPR gRNA sequence
tgaaatggtgaaatgtgagg

SEQ ID NO: 649104 - DNA, 20 bp, Artificial
  CRISPR gRNA sequence
gttttgtttgtctgtttaat

SEQ ID NO: 649105 - DNA, 20 bp, Artificial
  CRISPR gRNA sequence
ttttgtttgtctgtttaata

SEQ ID NO: 649106 - DNA, 20 bp, Artificial
  CRISPR gRNA sequence
tgtttgtctgtttaataaaa

SEQ ID NO: 649107 - DNA, 20 bp, Artificial
  CRISPR gRNA sequence
gtttgtctgtttaataaaaa

SEQ ID NO: 649108 - DNA, 20 bp, Artificial
  CRISPR gRNA sequence
tttgtctgtttaataaaaaa

SEQ ID NO: 649109 - DNA, 20 bp, Artificial
  CRISPR gRNA sequence
gtctgtttaataaaaaaggt

SEQ ID NO: 649110 - DNA, 20 bp, Artificial
  CRISPR gRNA sequence
tctgtttaataaaaaaggta

SEQ ID NO: 649111 - DNA, 20 bp, Artificial
  CRISPR gRNA sequence
tttaataaaaaaggtattct

SEQ ID NO: 649112 - DNA, 20 bp, Artificial
  CRISPR gRNA sequence
aataaaaaaggtattctaaa

SEQ ID NO: 649113 - DNA, 20 bp, Artificial
  CRISPR gRNA sequence
ataaaaaaggtattctaaat

SEQ ID NO: 649114 - DNA, 20 bp, Artificial
  CRISPR gRNA sequence
taaatcttaaaacaaggcaa

SEQ ID NO: 649115 - DNA, 20 bp, Artificial
  CRISPR gRNA sequence
aatcttaaaacaaggcaaaa

SEQ ID NO: 649116 - DNA, 20 bp, Artificial
  CRISPR gRNA sequence
aaaacaaggcaaaacaaatg

SEQ ID NO: 649117 - DNA, 20 bp, Artificial
  CRISPR gRNA sequence
aaacaaggcaaaacaaatgt

SEQ ID NO: 649118 - DNA, 20 bp, Artificial
  CRISPR gRNA sequence
cctagaatgcaagtggtaac

SEQ ID NO: 649119 - DNA, 20 bp, Artificial
  CRISPR gRNA sequence
ctagaatgcaagtggtaact

SEQ ID NO: 649120 - DNA, 20 bp, Artificial
  CRISPR gRNA sequence
gaatgcaagtggtaacttta

SEQ ID NO: 649121 - DNA, 20 bp, Artificial
  CRISPR gRNA sequence
tagaatggggttggtattca

SEQ ID NO: 649122 - DNA, 20 bp, Artificial
  CRISPR gRNA sequence
agaatggggttggtattcat

SEQ ID NO: 649123 - DNA, 20 bp, Artificial
  CRISPR gRNA sequence
gaatggggttggtattcatt

SEQ ID NO: 649124 - DNA, 20 bp, Artificial
  CRISPR gRNA sequence
gtattcattaattttcaaac

SEQ ID NO: 649125 - DNA, 20 bp, Artificial
  CRISPR gRNA sequence
attaattttcaaaccctaga

SEQ ID NO: 649126 - DNA, 20 bp, Artificial
  CRISPR gRNA sequence
attttcaaaccctagaagcc

SEQ ID NO: 649127 - DNA, 20 bp, Artificial
  CRISPR gRNA sequence
tcaaaccctagaagccttat

SEQ ID NO: 649128 - DNA, 20 bp, Artificial
  CRISPR gRNA sequence
caaaccctagaagccttatc

SEQ ID NO: 649129 - DNA, 20 bp, Artificial
  CRISPR gRNA sequence
aaaccctagaagccttatct

SEQ ID NO: 649130 - DNA, 20 bp, Artificial
  CRISPR gRNA sequence
gaagccttatctaataaata

SEQ ID NO: 649131 - DNA, 20 bp, Artificial
  CRISPR gRNA sequence
atctaataaatattaaaaag

SEQ ID NO: 649132 - DNA, 20 bp, Artificial
  CRISPR gRNA sequence
tctaataaatattaaaaagc

SEQ ID NO: 649133 - DNA, 20 bp, Artificial
  CRISPR gRNA sequence
ataaatattaaaaagctata

SEQ ID NO: 649134 - DNA, 20 bp, Artificial
  CRISPR gRNA sequence
aaaagctatatgcaaatatt

SEQ ID NO: 649135 - DNA, 20 bp, Artificial
  CRISPR gRNA sequence
tatgcaaatatttgcagtct

SEQ ID NO: 649136 - DNA, 20 bp, Artificial
  CRISPR gRNA sequence
gcagtctataaatcacaaca

SEQ ID NO: 649137 - DNA, 20 bp, Artificial
  CRISPR gRNA sequence
cagtctataaatcacaacag

SEQ ID NO: 649138 - DNA, 20 bp, Artificial
  CRISPR gRNA sequence
taaatcacaacagcaaacgt

SEQ ID NO: 649139 - DNA, 20 bp, Artificial
  CRISPR gRNA sequence
agtgctctatgcaattgtta

SEQ ID NO: 649140 - DNA, 20 bp, Artificial
  CRISPR gRNA sequence
tatgcaattgttacatttat

SEQ ID NO: 649141 - DNA, 20 bp, Artificial
  CRISPR gRNA sequence
tgcaattgttacatttattt

SEQ ID NO: 649142 - DNA, 20 bp, Artificial
  CRISPR gRNA sequence
ttacatttatttcttcaaaa

SEQ ID NO: 649143 - DNA, 20 bp, Artificial
  CRISPR gRNA sequence
catttatttcttcaaaactt

SEQ ID NO: 649144 - DNA, 20 bp, Artificial
  CRISPR gRNA sequence
atttcttcaaaacttaaggc

SEQ ID NO: 649145 - DNA, 20 bp, Artificial
  CRISPR gRNA sequence
tttcttcaaaacttaaggca

SEQ ID NO: 649146 - DNA, 20 bp, Artificial
  CRISPR gRNA sequence
cttcaaaacttaaggcaagt

SEQ ID NO: 649147 - DNA, 20 bp, Artificial
  CRISPR gRNA sequence
ttcaaaacttaaggcaagta

SEQ ID NO: 649148 - DNA, 20 bp, Artificial
  CRISPR gRNA sequence
caaaacttaaggcaagtatt

SEQ ID NO: 649149 - DNA, 20 bp, Artificial
  CRISPR gRNA sequence
aaaacttaaggcaagtatta

SEQ ID NO: 649150 - DNA, 20 bp, Artificial
  CRISPR gRNA sequence
aaggcaagtattattattat

SEQ ID NO: 649151 - DNA, 20 bp, Artificial
  CRISPR gRNA sequence
aggcaagtattattattatt

SEQ ID NO: 649152 - DNA, 20 bp, Artificial
  CRISPR gRNA sequence
ttattattataccattttac

SEQ ID NO: 649153 - DNA, 20 bp, Artificial
  CRISPR gRNA sequence
ttattataccattttacagc

SEQ ID NO: 649154 - DNA, 20 bp, Artificial
  CRISPR gRNA sequence
ttataccattttacagctga

SEQ ID NO: 649155 - DNA, 20 bp, Artificial
  CRISPR gRNA sequence
taccattttacagctgaagg

SEQ ID NO: 649156 - DNA, 20 bp, Artificial
  CRISPR gRNA sequence
tacagctgaaggaactaaat

SEQ ID NO: 649157 - DNA, 20 bp, Artificial
  CRISPR gRNA sequence
acagctgaaggaactaaatt

SEQ ID NO: 649158 - DNA, 20 bp, Artificial
  CRISPR gRNA sequence
cagctgaaggaactaaattt

SEQ ID NO: 649159 - DNA, 20 bp, Artificial
  CRISPR gRNA sequence
aaggaactaaatttaggaaa

SEQ ID NO: 649160 - DNA, 20 bp, Artificial
  CRISPR gRNA sequence
aatttaggaaatctaaggaa

SEQ ID NO: 649161 - DNA, 20 bp, Artificial
  CRISPR gRNA sequence
aggaaatctaaggaacattc

SEQ ID NO: 649162 - DNA, 20 bp, Artificial
  CRISPR gRNA sequence
ggaaatctaaggaacattcc

SEQ ID NO: 649163 - DNA, 20 bp, Artificial
  CRISPR gRNA sequence
aggaacattcctaaggtcac

SEQ ID NO: 649164 - DNA, 20 bp, Artificial
  CRISPR gRNA sequence
ctaaggtcacacagctatta

SEQ ID NO: 649165 - DNA, 20 bp, Artificial
  CRISPR gRNA sequence
aggtcacacagctattaggt

SEQ ID NO: 649166 - DNA, 20 bp, Artificial
  CRISPR gRNA sequence
ttaggttgaaaaacaatgga

SEQ ID NO: 649167 - DNA, 20 bp, Artificial
  CRISPR gRNA sequence
ggttgaaaaacaatggagtg

SEQ ID NO: 649168 - DNA, 20 bp, Artificial
  CRISPR gRNA sequence
aaaaacaatggagtgtcagt

SEQ ID NO: 649169 - DNA, 20 bp, Artificial
  CRISPR gRNA sequence
acggcttaacccaaaagtag

SEQ ID NO: 649170 - DNA, 20 bp, Artificial
  CRISPR gRNA sequence
cggcttaacccaaaagtagg

SEQ ID NO: 649171 - DNA, 20 bp, Artificial
  CRISPR gRNA sequence
aacccaaaagtagggtgcac

SEQ ID NO: 649172 - DNA, 20 bp, Artificial
  CRISPR gRNA sequence
acccaaaagtagggtgcaca

SEQ ID NO: 649173 - DNA, 20 bp, Artificial
  CRISPR gRNA sequence
caaaccaggtctatgtaata

SEQ ID NO: 649174 - DNA, 20 bp, Artificial
  CRISPR gRNA sequence
tgtaatatgaaaatcagtac

SEQ ID NO: 649175 - DNA, 20 bp, Artificial
  CRISPR gRNA sequence
ttaactacttctacagggcc

SEQ ID NO: 649176 - DNA, 20 bp, Artificial
  CRISPR gRNA sequence
aactacttctacagggcctc

SEQ ID NO: 649177 - DNA, 20 bp, Artificial
  CRISPR gRNA sequence
actacttctacagggcctca

SEQ ID NO: 649178 - DNA, 20 bp, Artificial
  CRISPR gRNA sequence
cttctacagggcctcacccc

SEQ ID NO: 649179 - DNA, 20 bp, Artificial
  CRISPR gRNA sequence
ctacagggcctcaccccaaa

SEQ ID NO: 649180 - DNA, 20 bp, Artificial
  CRISPR gRNA sequence
tacagggcctcaccccaaaa

SEQ ID NO: 649181 - DNA, 20 bp, Artificial
  CRISPR gRNA sequence
cagggcctcaccccaaaaca

SEQ ID NO: 649182 - DNA, 20 bp, Artificial
  CRISPR gRNA sequence
accccaaaacataagagtgt

SEQ ID NO: 649183 - DNA, 20 bp, Artificial
  CRISPR gRNA sequence
tgttgttgttgttgttgttt

SEQ ID NO: 649184 - DNA, 20 bp, Artificial
  CRISPR gRNA sequence
gttgttgttgttgttgtttt

SEQ ID NO: 649185 - DNA, 20 bp, Artificial
  CRISPR gRNA sequence
ttgttgttgttgttgttttt

SEQ ID NO: 649186 - DNA, 20 bp, Artificial
  CRISPR gRNA sequence
ttgttgttgttgtttttcag

SEQ ID NO: 649187 - DNA, 20 bp, Artificial
  CRISPR gRNA sequence
ttgttgttgtttttcagaca

SEQ ID NO: 649188 - DNA, 20 bp, Artificial
  CRISPR gRNA sequence
ttgttgtttttcagacagag

SEQ ID NO: 649189 - DNA, 20 bp, Artificial
  CRISPR gRNA sequence
ttgtttttcagacagagtct

SEQ ID NO: 649190 - DNA, 20 bp, Artificial
  CRISPR gRNA sequence
tttttcagacagagtctcac

SEQ ID NO: 649191 - DNA, 20 bp, Artificial
  CRISPR gRNA sequence
ttcagacagagtctcacttt

SEQ ID NO: 649192 - DNA, 20 bp, Artificial
  CRISPR gRNA sequence
tcagacagagtctcactttc

SEQ ID NO: 649193 - DNA, 20 bp, Artificial
  CRISPR gRNA sequence
cagacagagtctcactttct

SEQ ID NO: 649194 - DNA, 20 bp, Artificial
  CRISPR gRNA sequence
agacagagtctcactttctg

SEQ ID NO: 649195 - DNA, 20 bp, Artificial
  CRISPR gRNA sequence
actttctgtcgcccaggatg

SEQ ID NO: 649196 - DNA, 20 bp, Artificial
  CRISPR gRNA sequence
tctgtcgcccaggatggagt

SEQ ID NO: 649197 - DNA, 20 bp, Artificial
  CRISPR gRNA sequence
ctgtcgcccaggatggagta

SEQ ID NO: 649198 - DNA, 20 bp, Artificial
  CRISPR gRNA sequence
tgtcgcccaggatggagtac

SEQ ID NO: 649199 - DNA, 20 bp, Artificial
  CRISPR gRNA sequence
tcgcccaggatggagtacag

SEQ ID NO: 649200 - DNA, 20 bp, Artificial
  CRISPR gRNA sequence
agctcactgcaacctccacc

SEQ ID NO: 649201 - DNA, 20 bp, Artificial
  CRISPR gRNA sequence
actgcaacctccacccgcca

SEQ ID NO: 649202 - DNA, 20 bp, Artificial
  CRISPR gRNA sequence
caacctccacccgccaagtt

SEQ ID NO: 649203 - DNA, 20 bp, Artificial
  CRISPR gRNA sequence
cacccgccaagttcaaacta

SEQ ID NO: 649204 - DNA, 20 bp, Artificial
  CRISPR gRNA sequence
aaactattctcctgcctcag

SEQ ID NO: 649205 - DNA, 20 bp, Artificial
  CRISPR gRNA sequence
ttctcctgcctcagcctcca

SEQ ID NO: 649206 - DNA, 20 bp, Artificial
  CRISPR gRNA sequence
tcctgcctcagcctccagag

SEQ ID NO: 649207 - DNA, 20 bp, Artificial
  CRISPR gRNA sequence
ctgcctcagcctccagagta

SEQ ID NO: 649208 - DNA, 20 bp, Artificial
  CRISPR gRNA sequence
cctcagcctccagagtagct

SEQ ID NO: 649209 - DNA, 20 bp, Artificial
  CRISPR gRNA sequence
agcctccagagtagctggga

SEQ ID NO: 649210 - DNA, 20 bp, Artificial
  CRISPR gRNA sequence
cagagtagctgggattacag

SEQ ID NO: 649211 - DNA, 20 bp, Artificial
  CRISPR gRNA sequence
ggattacaggtgcaggccac

SEQ ID NO: 649212 - DNA, 20 bp, Artificial
  CRISPR gRNA sequence
caggtgcaggccaccacacc

SEQ ID NO: 649213 - DNA, 20 bp, Artificial
  CRISPR gRNA sequence
atttttttttcttttttttt

SEQ ID NO: 649214 - DNA, 20 bp, Artificial
  CRISPR gRNA sequence
ttttttcttttttttttttt

SEQ ID NO: 649215 - DNA, 20 bp, Artificial
  CRISPR gRNA sequence
tttttctttttttttttttt

SEQ ID NO: 649216 - DNA, 20 bp, Artificial
  CRISPR gRNA sequence
ttttcttttttttttttttt

SEQ ID NO: 649217 - DNA, 20 bp, Artificial
  CRISPR gRNA sequence
tttctttttttttttttttt

SEQ ID NO: 649218 - DNA, 20 bp, Artificial
  CRISPR gRNA sequence
ttcttttttttttttttttt

SEQ ID NO: 649219 - DNA, 20 bp, Artificial
  CRISPR gRNA sequence
tctttttttttttttttttt

SEQ ID NO: 649220 - DNA, 20 bp, Artificial
  CRISPR gRNA sequence
cttttttttttttttttttt

SEQ ID NO: 649221 - DNA, 20 bp, Artificial
  CRISPR gRNA sequence
tttttttttttttttttttg

SEQ ID NO: 649222 - DNA, 20 bp, Artificial
  CRISPR gRNA sequence
tttttttttttttttttgta

SEQ ID NO: 649223 - DNA, 20 bp, Artificial
  CRISPR gRNA sequence
ttttttttttttttttgtat

SEQ ID NO: 649224 - DNA, 20 bp, Artificial
  CRISPR gRNA sequence
tttttttttttttttgtatt

SEQ ID NO: 649225 - DNA, 20 bp, Artificial
  CRISPR gRNA sequence
ttttttttttttttgtattt

SEQ ID NO: 649226 - DNA, 20 bp, Artificial
  CRISPR gRNA sequence
tttttttttttttgtatttt

SEQ ID NO: 649227 - DNA, 20 bp, Artificial
  CRISPR gRNA sequence
ttttttttttttgtattttt

SEQ ID NO: 649228 - DNA, 20 bp, Artificial
  CRISPR gRNA sequence
tttttttttttgtattttta

SEQ ID NO: 649229 - DNA, 20 bp, Artificial
  CRISPR gRNA sequence
ttttttttttgtatttttag

SEQ ID NO: 649230 - DNA, 20 bp, Artificial
  CRISPR gRNA sequence
tttttttttgtatttttagt

SEQ ID NO: 649231 - DNA, 20 bp, Artificial
  CRISPR gRNA sequence
ttttttttgtatttttagta

SEQ ID NO: 649232 - DNA, 20 bp, Artificial
  CRISPR gRNA sequence
tttttttgtatttttagtag

SEQ ID NO: 649233 - DNA, 20 bp, Artificial
  CRISPR gRNA sequence
ttttttgtatttttagtaga

SEQ ID NO: 649234 - DNA, 20 bp, Artificial
  CRISPR gRNA sequence
tttttgtatttttagtagag

SEQ ID NO: 649235 - DNA, 20 bp, Artificial
  CRISPR gRNA sequence
ttttgtatttttagtagaga

SEQ ID NO: 649236 - DNA, 20 bp, Artificial
  CRISPR gRNA sequence
tttgtatttttagtagagac

SEQ ID NO: 649237 - DNA, 20 bp, Artificial
  CRISPR gRNA sequence
ttgtatttttagtagagacg

SEQ ID NO: 649238 - DNA, 20 bp, Artificial
  CRISPR gRNA sequence
tgtatttttagtagagacgg

SEQ ID NO: 649239 - DNA, 20 bp, Artificial
  CRISPR gRNA sequence
gtatttttagtagagacgga

SEQ ID NO: 649240 - DNA, 20 bp, Artificial
  CRISPR gRNA sequence
tatttttagtagagacggag

SEQ ID NO: 649241 - DNA, 20 bp, Artificial
  CRISPR gRNA sequence
ttagtagagacggagtttca

SEQ ID NO: 649242 - DNA, 20 bp, Artificial
  CRISPR gRNA sequence
tagtagagacggagtttcac

SEQ ID NO: 649243 - DNA, 20 bp, Artificial
  CRISPR gRNA sequence
agtagagacggagtttcacc

SEQ ID NO: 649244 - DNA, 20 bp, Artificial
  CRISPR gRNA sequence
gtagagacggagtttcacca

SEQ ID NO: 649245 - DNA, 20 bp, Artificial
  CRISPR gRNA sequence
caccattttggccaggctgg

SEQ ID NO: 649246 - DNA, 20 bp, Artificial
  CRISPR gRNA sequence
accattttggccaggctggt

SEQ ID NO: 649247 - DNA, 20 bp, Artificial
  CRISPR gRNA sequence
tggccaggctggtctcgaac

SEQ ID NO: 649248 - DNA, 20 bp, Artificial
  CRISPR gRNA sequence
ggccaggctggtctcgaact

SEQ ID NO: 649249 - DNA, 20 bp, Artificial
  CRISPR gRNA sequence
gccaggctggtctcgaactt

SEQ ID NO: 649250 - DNA, 20 bp, Artificial
  CRISPR gRNA sequence
gtctcgaacttctgacctca

SEQ ID NO: 649251 - DNA, 20 bp, Artificial
  CRISPR gRNA sequence
gaacttctgacctcaggtga

SEQ ID NO: 649252 - DNA, 20 bp, Artificial
  CRISPR gRNA sequence
ctgacctcaggtgatccacc

SEQ ID NO: 649253 - DNA, 20 bp, Artificial
  CRISPR gRNA sequence
tgacctcaggtgatccaccc

SEQ ID NO: 649254 - DNA, 20 bp, Artificial
  CRISPR gRNA sequence
acctcaggtgatccacccgt

SEQ ID NO: 649255 - DNA, 20 bp, Artificial
  CRISPR gRNA sequence
aggtgatccacccgtctcgg

SEQ ID NO: 649256 - DNA, 20 bp, Artificial
  CRISPR gRNA sequence
ggcctcccaaagtgctggga

SEQ ID NO: 649257 - DNA, 20 bp, Artificial
  CRISPR gRNA sequence
ccaaagtgctgggattacag

SEQ ID NO: 649258 - DNA, 20 bp, Artificial
  CRISPR gRNA sequence
ggattacaggcgtgagccac

SEQ ID NO: 649259 - DNA, 20 bp, Artificial
  CRISPR gRNA sequence
caggcgtgagccaccacatc

SEQ ID NO: 649260 - DNA, 20 bp, Artificial
  CRISPR gRNA sequence
gccaagataaggttttttaa

SEQ ID NO: 649261 - DNA, 20 bp, Artificial
  CRISPR gRNA sequence
tttaatcgttgttgtactac

SEQ ID NO: 649262 - DNA, 20 bp, Artificial
  CRISPR gRNA sequence
ttaatcgttgttgtactact

SEQ ID NO: 649263 - DNA, 20 bp, Artificial
  CRISPR gRNA sequence
taatcgttgttgtactactc

SEQ ID NO: 649264 - DNA, 20 bp, Artificial
  CRISPR gRNA sequence
aatcgttgttgtactactct

SEQ ID NO: 649265 - DNA, 20 bp, Artificial
  CRISPR gRNA sequence
atcgttgttgtactactctc

SEQ ID NO: 649266 - DNA, 20 bp, Artificial
  CRISPR gRNA sequence
ttgtactactctctccccat

SEQ ID NO: 649267 - DNA, 20 bp, Artificial
  CRISPR gRNA sequence
tactactctctccccatgtg

SEQ ID NO: 649268 - DNA, 20 bp, Artificial
  CRISPR gRNA sequence
ctctctccccatgtgacttt

SEQ ID NO: 649269 - DNA, 20 bp, Artificial
  CRISPR gRNA sequence
tctccccatgtgactttcgc

SEQ ID NO: 649270 - DNA, 20 bp, Artificial
  CRISPR gRNA sequence
tccccatgtgactttcgcct

SEQ ID NO: 649271 - DNA, 20 bp, Artificial
  CRISPR gRNA sequence
cccatgtgactttcgcctca

SEQ ID NO: 649272 - DNA, 20 bp, Artificial
  CRISPR gRNA sequence
tcgcctcaatgtacaggttt

SEQ ID NO: 649273 - DNA, 20 bp, Artificial
  CRISPR gRNA sequence
cgcctcaatgtacaggtttc

SEQ ID NO: 649274 - DNA, 20 bp, Artificial
  CRISPR gRNA sequence
gcctcaatgtacaggtttct

SEQ ID NO: 649275 - DNA, 20 bp, Artificial
  CRISPR gRNA sequence
aatgtacaggtttctaaaat

SEQ ID NO: 649276 - DNA, 20 bp, Artificial
  CRISPR gRNA sequence
ctaaaatagagggtttagaa

SEQ ID NO: 649277 - DNA, 20 bp, Artificial
  CRISPR gRNA sequence
taaaatagagggtttagaat

SEQ ID NO: 649278 - DNA, 20 bp, Artificial
  CRISPR gRNA sequence
aaatagagggtttagaatga

SEQ ID NO: 649279 - DNA, 20 bp, Artificial
  CRISPR gRNA sequence
agaatgaacactacagtgta

SEQ ID NO: 649280 - DNA, 20 bp, Artificial
  CRISPR gRNA sequence
gaatgaacactacagtgtaa

SEQ ID NO: 649281 - DNA, 20 bp, Artificial
  CRISPR gRNA sequence
cagtgtaaaacactttgttt

SEQ ID NO: 649282 - DNA, 20 bp, Artificial
  CRISPR gRNA sequence
tgtttgctttatagacacac

SEQ ID NO: 649283 - DNA, 20 bp, Artificial
  CRISPR gRNA sequence
gtttgctttatagacacaca

SEQ ID NO: 649284 - DNA, 20 bp, Artificial
  CRISPR gRNA sequence
tttgctttatagacacacac

SEQ ID NO: 649285 - DNA, 20 bp, Artificial
  CRISPR gRNA sequence
gctttatagacacacacaga

SEQ ID NO: 649286 - DNA, 20 bp, Artificial
  CRISPR gRNA sequence
ctttatagacacacacagag

SEQ ID NO: 649287 - DNA, 20 bp, Artificial
  CRISPR gRNA sequence
tatagacacacacagagaat

SEQ ID NO: 649288 - DNA, 20 bp, Artificial
  CRISPR gRNA sequence
atagacacacacagagaatt

SEQ ID NO: 649289 - DNA, 20 bp, Artificial
  CRISPR gRNA sequence
tagacacacacagagaattc

SEQ ID NO: 649290 - DNA, 20 bp, Artificial
  CRISPR gRNA sequence
tatttatggaagggaaagaa

SEQ ID NO: 649291 - DNA, 20 bp, Artificial
  CRISPR gRNA sequence
tttatggaagggaaagaaca

SEQ ID NO: 649292 - DNA, 20 bp, Artificial
  CRISPR gRNA sequence
atggaagggaaagaacaagg

SEQ ID NO: 649293 - DNA, 20 bp, Artificial
  CRISPR gRNA sequence
tggaagggaaagaacaagga

SEQ ID NO: 649294 - DNA, 20 bp, Artificial
  CRISPR gRNA sequence
atctgtgagttcacatttat

SEQ ID NO: 649295 - DNA, 20 bp, Artificial
  CRISPR gRNA sequence
tgagttcacatttattgtct

SEQ ID NO: 649296 - DNA, 20 bp, Artificial
  CRISPR gRNA sequence
acatttattgtctattacat

SEQ ID NO: 649297 - DNA, 20 bp, Artificial
  CRISPR gRNA sequence
attgtctattacattcctgg

SEQ ID NO: 649298 - DNA, 20 bp, Artificial
  CRISPR gRNA sequence
ttgtctattacattcctggc

SEQ ID NO: 649299 - DNA, 20 bp, Artificial
  CRISPR gRNA sequence
tctattacattcctggccct

SEQ ID NO: 649300 - DNA, 20 bp, Artificial
  CRISPR gRNA sequence
ttacattcctggccctacta

SEQ ID NO: 649301 - DNA, 20 bp, Artificial
  CRISPR gRNA sequence
cattcctggccctactacat

SEQ ID NO: 649302 - DNA, 20 bp, Artificial
  CRISPR gRNA sequence
ctggccctactacatgaatg

SEQ ID NO: 649303 - DNA, 20 bp, Artificial
  CRISPR gRNA sequence
gccctactacatgaatgaac

SEQ ID NO: 649304 - DNA, 20 bp, Artificial
  CRISPR gRNA sequence
ctacatgaatgaacaagcca

SEQ ID NO: 649305 - DNA, 20 bp, Artificial
  CRISPR gRNA sequence
catgaatgaacaagccaaat

SEQ ID NO: 649306 - DNA, 20 bp, Artificial
  CRISPR gRNA sequence
ctcaactgtgtgttgggaga

SEQ ID NO: 649307 - DNA, 20 bp, Artificial
  CRISPR gRNA sequence
aactgtgtgttgggagaaga

SEQ ID NO: 649308 - DNA, 20 bp, Artificial
  CRISPR gRNA sequence
tgtgttgggagaagagataa

SEQ ID NO: 649309 - DNA, 20 bp, Artificial
  CRISPR gRNA sequence
ggagaagagataaatacaca

SEQ ID NO: 649310 - DNA, 20 bp, Artificial
  CRISPR gRNA sequence
agtaaattcagatactatta

SEQ ID NO: 649311 - DNA, 20 bp, Artificial
  CRISPR gRNA sequence
agatactattaagtataata

SEQ ID NO: 649312 - DNA, 20 bp, Artificial
  CRISPR gRNA sequence
ttaagtataataaagaaaat

SEQ ID NO: 649313 - DNA, 20 bp, Artificial
  CRISPR gRNA sequence
agtataataaagaaaataaa

SEQ ID NO: 649314 - DNA, 20 bp, Artificial
  CRISPR gRNA sequence
gagaggggcttatttatcta

SEQ ID NO: 649315 - DNA, 20 bp, Artificial
  CRISPR gRNA sequence
atttatctaggatgctcagg

SEQ ID NO: 649316 - DNA, 20 bp, Artificial
  CRISPR gRNA sequence
tttatctaggatgctcaggc

SEQ ID NO: 649317 - DNA, 20 bp, Artificial
  CRISPR gRNA sequence
atctaggatgctcaggcaaa

SEQ ID NO: 649318 - DNA, 20 bp, Artificial
  CRISPR gRNA sequence
tctaggatgctcaggcaaag

SEQ ID NO: 649319 - DNA, 20 bp, Artificial
  CRISPR gRNA sequence
ggatgctcaggcaaagcctc

SEQ ID NO: 649320 - DNA, 20 bp, Artificial
  CRISPR gRNA sequence
aggcaaagcctcgccaagga

SEQ ID NO: 649321 - DNA, 20 bp, Artificial
  CRISPR gRNA sequence
gccaaggaggcgacagttaa

SEQ ID NO: 649322 - DNA, 20 bp, Artificial
  CRISPR gRNA sequence
aatggaaataagaaaagaag

SEQ ID NO: 649323 - DNA, 20 bp, Artificial
  CRISPR gRNA sequence
tcatgcaaaacaaggaagaa

SEQ ID NO: 649324 - DNA, 20 bp, Artificial
  CRISPR gRNA sequence
catgcaaaacaaggaagaaa

SEQ ID NO: 649325 - DNA, 20 bp, Artificial
  CRISPR gRNA sequence
atgcaaaacaaggaagaaaa

SEQ ID NO: 649326 - DNA, 20 bp, Artificial
  CRISPR gRNA sequence
agacaggaacgaacttgcca

SEQ ID NO: 649327 - DNA, 20 bp, Artificial
  CRISPR gRNA sequence
gacaggaacgaacttgccat

SEQ ID NO: 649328 - DNA, 20 bp, Artificial
  CRISPR gRNA sequence
gccatgtcccggaaaagaaa

SEQ ID NO: 649329 - DNA, 20 bp, Artificial
  CRISPR gRNA sequence
ccatgtcccggaaaagaaaa

SEQ ID NO: 649330 - DNA, 20 bp, Artificial
  CRISPR gRNA sequence
aaagttcagtgaacagggaa

SEQ ID NO: 649331 - DNA, 20 bp, Artificial
  CRISPR gRNA sequence
agtgaacagggaaagaatag

SEQ ID NO: 649332 - DNA, 20 bp, Artificial
  CRISPR gRNA sequence
taggaccttacagactttgg

SEQ ID NO: 649333 - DNA, 20 bp, Artificial
  CRISPR gRNA sequence
aggaccttacagactttgga

SEQ ID NO: 649334 - DNA, 20 bp, Artificial
  CRISPR gRNA sequence
ggaccttacagactttggaa

SEQ ID NO: 649335 - DNA, 20 bp, Artificial
  CRISPR gRNA sequence
acagactttggaaaggaatt

SEQ ID NO: 649336 - DNA, 20 bp, Artificial
  CRISPR gRNA sequence
cagactttggaaaggaattt

SEQ ID NO: 649337 - DNA, 20 bp, Artificial
  CRISPR gRNA sequence
tggaaaggaattttagttgt

SEQ ID NO: 649338 - DNA, 20 bp, Artificial
  CRISPR gRNA sequence
ggaaaggaattttagttgta

SEQ ID NO: 649339 - DNA, 20 bp, Artificial
  CRISPR gRNA sequence
gaaaggaattttagttgtat

SEQ ID NO: 649340 - DNA, 20 bp, Artificial
  CRISPR gRNA sequence
tagttgtattctagtttcag

SEQ ID NO: 649341 - DNA, 20 bp, Artificial
  CRISPR gRNA sequence
agttgtattctagtttcagt

SEQ ID NO: 649342 - DNA, 20 bp, Artificial
  CRISPR gRNA sequence
gttgtattctagtttcagtg

SEQ ID NO: 649343 - DNA, 20 bp, Artificial
  CRISPR gRNA sequence
tattctagtttcagtggaaa

SEQ ID NO: 649344 - DNA, 20 bp, Artificial
  CRISPR gRNA sequence
tagtttcagtggaaagcttt

SEQ ID NO: 649345 - DNA, 20 bp, Artificial
  CRISPR gRNA sequence
gtttcagtggaaagcttttg

SEQ ID NO: 649346 - DNA, 20 bp, Artificial
  CRISPR gRNA sequence
cagtggaaagcttttgtgtt

SEQ ID NO: 649347 - DNA, 20 bp, Artificial
  CRISPR gRNA sequence
agtggaaagcttttgtgttt

SEQ ID NO: 649348 - DNA, 20 bp, Artificial
  CRISPR gRNA sequence
ttgtgtttaaagcaatgaat

SEQ ID NO: 649349 - DNA, 20 bp, Artificial
  CRISPR gRNA sequence
tgtgtttaaagcaatgaatt

SEQ ID NO: 649350 - DNA, 20 bp, Artificial
  CRISPR gRNA sequence
gtgtttaaagcaatgaattg

SEQ ID NO: 649351 - DNA, 20 bp, Artificial
  CRISPR gRNA sequence
tgtttaaagcaatgaattgt

SEQ ID NO: 649352 - DNA, 20 bp, Artificial
  CRISPR gRNA sequence
aaagcaatgaattgttatga

SEQ ID NO: 649353 - DNA, 20 bp, Artificial
  CRISPR gRNA sequence
aagcaatgaattgttatgat

SEQ ID NO: 649354 - DNA, 20 bp, Artificial
  CRISPR gRNA sequence
ttatgatctgatttgggttt

SEQ ID NO: 649355 - DNA, 20 bp, Artificial
  CRISPR gRNA sequence
tgatctgatttgggttttag

SEQ ID NO: 649356 - DNA, 20 bp, Artificial
  CRISPR gRNA sequence
atttgggttttagaaagtca

SEQ ID NO: 649357 - DNA, 20 bp, Artificial
  CRISPR gRNA sequence
gggttttagaaagtcaggct

SEQ ID NO: 649358 - DNA, 20 bp, Artificial
  CRISPR gRNA sequence
ggttttagaaagtcaggctc

SEQ ID NO: 649359 - DNA, 20 bp, Artificial
  CRISPR gRNA sequence
tagaaagtcaggctctgtct

SEQ ID NO: 649360 - DNA, 20 bp, Artificial
  CRISPR gRNA sequence
agaaagtcaggctctgtcta

SEQ ID NO: 649361 - DNA, 20 bp, Artificial
  CRISPR gRNA sequence
gaaagtcaggctctgtctat

SEQ ID NO: 649362 - DNA, 20 bp, Artificial
  CRISPR gRNA sequence
tgtctattgtgtggaaaaca

SEQ ID NO: 649363 - DNA, 20 bp, Artificial
  CRISPR gRNA sequence
tctattgtgtggaaaacaaa

SEQ ID NO: 649364 - DNA, 20 bp, Artificial
  CRISPR gRNA sequence
ttgtgtggaaaacaaactac

SEQ ID NO: 649365 - DNA, 20 bp, Artificial
  CRISPR gRNA sequence
tgtggaaaacaaactacaga

SEQ ID NO: 649366 - DNA, 20 bp, Artificial
  CRISPR gRNA sequence
cagagaagcaagaatggaag

SEQ ID NO: 649367 - DNA, 20 bp, Artificial
  CRISPR gRNA sequence
aactgttgcaatattttagg

SEQ ID NO: 649368 - DNA, 20 bp, Artificial
  CRISPR gRNA sequence
ttgcaatattttaggcttaa

SEQ ID NO: 649369 - DNA, 20 bp, Artificial
  CRISPR gRNA sequence
caatattttaggcttaaggt

SEQ ID NO: 649370 - DNA, 20 bp, Artificial
  CRISPR gRNA sequence
taggcttaaggtactaggaa

SEQ ID NO: 649371 - DNA, 20 bp, Artificial
  CRISPR gRNA sequence
aggcttaaggtactaggaaa

SEQ ID NO: 649372 - DNA, 20 bp, Artificial
  CRISPR gRNA sequence
ggcttaaggtactaggaaat

SEQ ID NO: 649373 - DNA, 20 bp, Artificial
  CRISPR gRNA sequence
aaggtactaggaaatgatga

SEQ ID NO: 649374 - DNA, 20 bp, Artificial
  CRISPR gRNA sequence
aggtactaggaaatgatgat

SEQ ID NO: 649375 - DNA, 20 bp, Artificial
  CRISPR gRNA sequence
ggaaatgatgatagactaaa

SEQ ID NO: 649376 - DNA, 20 bp, Artificial
  CRISPR gRNA sequence
aagttacagtagcgggcctg

SEQ ID NO: 649377 - DNA, 20 bp, Artificial
  CRISPR gRNA sequence
cagtagcgggcctggtgaga

SEQ ID NO: 649378 - DNA, 20 bp, Artificial
  CRISPR gRNA sequence
gtgagaattgtttaaattca

SEQ ID NO: 649379 - DNA, 20 bp, Artificial
  CRISPR gRNA sequence
tttaaattcaggatgtattt

SEQ ID NO: 649380 - DNA, 20 bp, Artificial
  CRISPR gRNA sequence
aaattcaggatgtattttag

SEQ ID NO: 649381 - DNA, 20 bp, Artificial
  CRISPR gRNA sequence
aattcaggatgtattttaga

SEQ ID NO: 649382 - DNA, 20 bp, Artificial
  CRISPR gRNA sequence
aggatgtattttagaagcag

SEQ ID NO: 649383 - DNA, 20 bp, Artificial
  CRISPR gRNA sequence
tagaagcagagccaaggatt

SEQ ID NO: 649384 - DNA, 20 bp, Artificial
  CRISPR gRNA sequence
agaagcagagccaaggattt

SEQ ID NO: 649385 - DNA, 20 bp, Artificial
  CRISPR gRNA sequence
gaagcagagccaaggatttc

SEQ ID NO: 649386 - DNA, 20 bp, Artificial
  CRISPR gRNA sequence
ctgatagactggatgtggga

SEQ ID NO: 649387 - DNA, 20 bp, Artificial
  CRISPR gRNA sequence
tgatagactggatgtgggat

SEQ ID NO: 649388 - DNA, 20 bp, Artificial
  CRISPR gRNA sequence
atagactggatgtgggattt

SEQ ID NO: 649389 - DNA, 20 bp, Artificial
  CRISPR gRNA sequence
gatgtgggatttcctttgag

SEQ ID NO: 649390 - DNA, 20 bp, Artificial
  CRISPR gRNA sequence
cctttgaggaaagaaacagt

SEQ ID NO: 649391 - DNA, 20 bp, Artificial
  CRISPR gRNA sequence
ctttgaggaaagaaacagtg

SEQ ID NO: 649392 - DNA, 20 bp, Artificial
  CRISPR gRNA sequence
tgaggaaagaaacagtgcta

SEQ ID NO: 649393 - DNA, 20 bp, Artificial
  CRISPR gRNA sequence
gaggaaagaaacagtgctag

SEQ ID NO: 649394 - DNA, 20 bp, Artificial
  CRISPR gRNA sequence
aggaaagaaacagtgctaga

SEQ ID NO: 649395 - DNA, 20 bp, Artificial
  CRISPR gRNA sequence
gatgcagagttgaaagtcat

SEQ ID NO: 649396 - DNA, 20 bp, Artificial
  CRISPR gRNA sequence
aaagtcatgaaagcatctac

SEQ ID NO: 649397 - DNA, 20 bp, Artificial
  CRISPR gRNA sequence
cagtatctaaagaaataaac

SEQ ID NO: 649398 - DNA, 20 bp, Artificial
  CRISPR gRNA sequence
aagaaataaactgagaaaga

SEQ ID NO: 649399 - DNA, 20 bp, Artificial
  CRISPR gRNA sequence
agaaagagagaagaggacct

SEQ ID NO: 649400 - DNA, 20 bp, Artificial
  CRISPR gRNA sequence
tacataaagatatacaggct

SEQ ID NO: 649401 - DNA, 20 bp, Artificial
  CRISPR gRNA sequence
caaatagatgaaggtgagta

SEQ ID NO: 649402 - DNA, 20 bp, Artificial
  CRISPR gRNA sequence
tctgctcactaagtaattgg

SEQ ID NO: 649403 - DNA, 20 bp, Artificial
  CRISPR gRNA sequence
ctgctcactaagtaattggc

SEQ ID NO: 649404 - DNA, 20 bp, Artificial
  CRISPR gRNA sequence
tgctcactaagtaattggca

SEQ ID NO: 649405 - DNA, 20 bp, Artificial
  CRISPR gRNA sequence
ctcactaagtaattggcagc

SEQ ID NO: 649406 - DNA, 20 bp, Artificial
  CRISPR gRNA sequence
actaagtaattggcagctat

SEQ ID NO: 649407 - DNA, 20 bp, Artificial
  CRISPR gRNA sequence
agtaattggcagctattgat

SEQ ID NO: 649408 - DNA, 20 bp, Artificial
  CRISPR gRNA sequence
gcagctattgattgtaacac

SEQ ID NO: 649409 - DNA, 20 bp, Artificial
  CRISPR gRNA sequence
ttgattgtaacacttctaat

SEQ ID NO: 649410 - DNA, 20 bp, Artificial
  CRISPR gRNA sequence
attgtaacacttctaatgaa

SEQ ID NO: 649411 - DNA, 20 bp, Artificial
  CRISPR gRNA sequence
taacacttctaatgaaggca

SEQ ID NO: 649412 - DNA, 20 bp, Artificial
  CRISPR gRNA sequence
ctaatgaaggcacaccttct

SEQ ID NO: 649413 - DNA, 20 bp, Artificial
  CRISPR gRNA sequence
taatgaaggcacaccttctc

SEQ ID NO: 649414 - DNA, 20 bp, Artificial
  CRISPR gRNA sequence
atgaaggcacaccttctcta

SEQ ID NO: 649415 - DNA, 20 bp, Artificial
  CRISPR gRNA sequence
ctctatttcttctctttaga

SEQ ID NO: 649416 - DNA, 20 bp, Artificial
  CRISPR gRNA sequence
tctatttcttctctttagat

SEQ ID NO: 649417 - DNA, 20 bp, Artificial
  CRISPR gRNA sequence
tatttcttctctttagatag

SEQ ID NO: 649418 - DNA, 20 bp, Artificial
  CRISPR gRNA sequence
tttcttctctttagataggg

SEQ ID NO: 649419 - DNA, 20 bp, Artificial
  CRISPR gRNA sequence
cttctctttagatagggaca

SEQ ID NO: 649420 - DNA, 20 bp, Artificial
  CRISPR gRNA sequence
ttctctttagatagggacac

SEQ ID NO: 649421 - DNA, 20 bp, Artificial
  CRISPR gRNA sequence
ctctttagatagggacacta

SEQ ID NO: 649422 - DNA, 20 bp, Artificial
  CRISPR gRNA sequence
tctttagatagggacactag

SEQ ID NO: 649423 - DNA, 20 bp, Artificial
  CRISPR gRNA sequence
tttagatagggacactagat

SEQ ID NO: 649424 - DNA, 20 bp, Artificial
  CRISPR gRNA sequence
tagatagggacactagatct

SEQ ID NO: 649425 - DNA, 20 bp, Artificial
  CRISPR gRNA sequence
agatagggacactagatctt

SEQ ID NO: 649426 - DNA, 20 bp, Artificial
  CRISPR gRNA sequence
gatagggacactagatcttg

SEQ ID NO: 649427 - DNA, 20 bp, Artificial
  CRISPR gRNA sequence
gatcttgttgttctatcaaa

SEQ ID NO: 649428 - DNA, 20 bp, Artificial
  CRISPR gRNA sequence
gttgttctatcaaaagcttc

SEQ ID NO: 649429 - DNA, 20 bp, Artificial
  CRISPR gRNA sequence
ttgttctatcaaaagcttct

SEQ ID NO: 649430 - DNA, 20 bp, Artificial
  CRISPR gRNA sequence
ttctatcaaaagcttctagt

SEQ ID NO: 649431 - DNA, 20 bp, Artificial
  CRISPR gRNA sequence
tatcaaaagcttctagtttt

SEQ ID NO: 649432 - DNA, 20 bp, Artificial
  CRISPR gRNA sequence
tcaaaagcttctagttttct

SEQ ID NO: 649433 - DNA, 20 bp, Artificial
  CRISPR gRNA sequence
ctagttttctgatgtcctct

SEQ ID NO: 649434 - DNA, 20 bp, Artificial
  CRISPR gRNA sequence
tagttttctgatgtcctcta

SEQ ID NO: 649435 - DNA, 20 bp, Artificial
  CRISPR gRNA sequence
gttttctgatgtcctctaac

SEQ ID NO: 649436 - DNA, 20 bp, Artificial
  CRISPR gRNA sequence
tctgatgtcctctaactgga

SEQ ID NO: 649437 - DNA, 20 bp, Artificial
  CRISPR gRNA sequence
ctgatgtcctctaactggat

SEQ ID NO: 649438 - DNA, 20 bp, Artificial
  CRISPR gRNA sequence
tgatgtcctctaactggatc

SEQ ID NO: 649439 - DNA, 20 bp, Artificial
  CRISPR gRNA sequence
atgtcctctaactggatcat

SEQ ID NO: 649440 - DNA, 20 bp, Artificial
  CRISPR gRNA sequence
taactggatcatttccttta

SEQ ID NO: 649441 - DNA, 20 bp, Artificial
  CRISPR gRNA sequence
actggatcatttcctttatc

SEQ ID NO: 649442 - DNA, 20 bp, Artificial
  CRISPR gRNA sequence
gatcatttcctttatcccaa

SEQ ID NO: 649443 - DNA, 20 bp, Artificial
  CRISPR gRNA sequence
cctttatcccaatagccagt

SEQ ID NO: 649444 - DNA, 20 bp, Artificial
  CRISPR gRNA sequence
ctttatcccaatagccagta

SEQ ID NO: 649445 - DNA, 20 bp, Artificial
  CRISPR gRNA sequence
tatcccaatagccagtaatc

SEQ ID NO: 649446 - DNA, 20 bp, Artificial
  CRISPR gRNA sequence
atcccaatagccagtaatct

SEQ ID NO: 649447 - DNA, 20 bp, Artificial
  CRISPR gRNA sequence
tcccaatagccagtaatcta

SEQ ID NO: 649448 - DNA, 20 bp, Artificial
  CRISPR gRNA sequence
gaaaataaaaacacttggta

SEQ ID NO: 649449 - DNA, 20 bp, Artificial
  CRISPR gRNA sequence
ggtaaaaacagaaactcaga

SEQ ID NO: 649450 - DNA, 20 bp, Artificial
  CRISPR gRNA sequence
gtaaaaacagaaactcagaa

SEQ ID NO: 649451 - DNA, 20 bp, Artificial
  CRISPR gRNA sequence
agaaacaaaaactaatcact

SEQ ID NO: 649452 - DNA, 20 bp, Artificial
  CRISPR gRNA sequence
atcactaagctagggtctct

SEQ ID NO: 649453 - DNA, 20 bp, Artificial
  CRISPR gRNA sequence
agctagggtctctcacaggc

SEQ ID NO: 649454 - DNA, 20 bp, Artificial
  CRISPR gRNA sequence
gggtctctcacaggcaggaa

SEQ ID NO: 649455 - DNA, 20 bp, Artificial
  CRISPR gRNA sequence
tcacaggcaggaaagaagtc

SEQ ID NO: 649456 - DNA, 20 bp, Artificial
  CRISPR gRNA sequence
acaggcaggaaagaagtcaa

SEQ ID NO: 649457 - DNA, 20 bp, Artificial
  CRISPR gRNA sequence
tagagcaataaatgctttgt

SEQ ID NO: 649458 - DNA, 20 bp, Artificial
  CRISPR gRNA sequence
agagcaataaatgctttgtt

SEQ ID NO: 649459 - DNA, 20 bp, Artificial
  CRISPR gRNA sequence
gagcaataaatgctttgtta

SEQ ID NO: 649460 - DNA, 20 bp, Artificial
  CRISPR gRNA sequence
tgttataaactgacaaacac

SEQ ID NO: 649461 - DNA, 20 bp, Artificial
  CRISPR gRNA sequence
gttataaactgacaaacaca

SEQ ID NO: 649462 - DNA, 20 bp, Artificial
  CRISPR gRNA sequence
ttataaactgacaaacacaa

SEQ ID NO: 649463 - DNA, 20 bp, Artificial
  CRISPR gRNA sequence
taaactgacaaacacaatta

SEQ ID NO: 649464 - DNA, 20 bp, Artificial
  CRISPR gRNA sequence
acaaacacaattaatagaca

SEQ ID NO: 649465 - DNA, 20 bp, Artificial
  CRISPR gRNA sequence
atagacatcagtcatcaaag

SEQ ID NO: 649466 - DNA, 20 bp, Artificial
  CRISPR gRNA sequence
tgcctacctagagacatgat

SEQ ID NO: 649467 - DNA, 20 bp, Artificial
  CRISPR gRNA sequence
cctagagacatgatcctgag

SEQ ID NO: 649468 - DNA, 20 bp, Artificial
  CRISPR gRNA sequence
gagacatgatcctgagaaca

SEQ ID NO: 649469 - DNA, 20 bp, Artificial
  CRISPR gRNA sequence
agaacacagtaagatccaaa

SEQ ID NO: 649470 - DNA, 20 bp, Artificial
  CRISPR gRNA sequence
cacacttgaaaaggaagcat

SEQ ID NO: 649471 - DNA, 20 bp, Artificial
  CRISPR gRNA sequence
acacttgaaaaggaagcatt

SEQ ID NO: 649472 - DNA, 20 bp, Artificial
  CRISPR gRNA sequence
gaaaaggaagcatttggggg

SEQ ID NO: 649473 - DNA, 20 bp, Artificial
  CRISPR gRNA sequence
aaaaggaagcatttggggga

SEQ ID NO: 649474 - DNA, 20 bp, Artificial
  CRISPR gRNA sequence
gggggagcactgaagttccc

SEQ ID NO: 649475 - DNA, 20 bp, Artificial
  CRISPR gRNA sequence
ggggagcactgaagttcccc

SEQ ID NO: 649476 - DNA, 20 bp, Artificial
  CRISPR gRNA sequence
aagttccccaccaaccttaa

SEQ ID NO: 649477 - DNA, 20 bp, Artificial
  CRISPR gRNA sequence
cccaccaaccttaagaccca

SEQ ID NO: 649478 - DNA, 20 bp, Artificial
  CRISPR gRNA sequence
aagacccacccaagcaggga

SEQ ID NO: 649479 - DNA, 20 bp, Artificial
  CRISPR gRNA sequence
agacccacccaagcagggaa

SEQ ID NO: 649480 - DNA, 20 bp, Artificial
  CRISPR gRNA sequence
taattgtgatttaaaataat

SEQ ID NO: 649481 - DNA, 20 bp, Artificial
  CRISPR gRNA sequence
aattgtgatttaaaataatc

SEQ ID NO: 649482 - DNA, 20 bp, Artificial
  CRISPR gRNA sequence
attgtgatttaaaataatct

SEQ ID NO: 649483 - DNA, 20 bp, Artificial
  CRISPR gRNA sequence
tgatttaaaataatcttact

SEQ ID NO: 649484 - DNA, 20 bp, Artificial
  CRISPR gRNA sequence
aaaataatcttactagtagc

SEQ ID NO: 649485 - DNA, 20 bp, Artificial
  CRISPR gRNA sequence
aaataatcttactagtagct

SEQ ID NO: 649486 - DNA, 20 bp, Artificial
  CRISPR gRNA sequence
actagtagctgaaagtattt

SEQ ID NO: 649487 - DNA, 20 bp, Artificial
  CRISPR gRNA sequence
ctagtagctgaaagtatttt

SEQ ID NO: 649488 - DNA, 20 bp, Artificial
  CRISPR gRNA sequence
gtagctgaaagtattttaca

SEQ ID NO: 649489 - DNA, 20 bp, Artificial
  CRISPR gRNA sequence
aaagtattttacagtaattc

SEQ ID NO: 649490 - DNA, 20 bp, Artificial
  CRISPR gRNA sequence
tacagtaattcaaaggaaaa

SEQ ID NO: 649491 - DNA, 20 bp, Artificial
  CRISPR gRNA sequence
acagtaattcaaaggaaaaa

SEQ ID NO: 649492 - DNA, 20 bp, Artificial
  CRISPR gRNA sequence
cagtaattcaaaggaaaaaa

SEQ ID NO: 649493 - DNA, 20 bp, Artificial
  CRISPR gRNA sequence
aaaggaaaaaaatgtcaaac

SEQ ID NO: 649494 - DNA, 20 bp, Artificial
  CRISPR gRNA sequence
cagattgattaccacaaaca

SEQ ID NO: 649495 - DNA, 20 bp, Artificial
  CRISPR gRNA sequence
attaccacaaacagttcttt

SEQ ID NO: 649496 - DNA, 20 bp, Artificial
  CRISPR gRNA sequence
ccacaaacagttctttttgg

SEQ ID NO: 649497 - DNA, 20 bp, Artificial
  CRISPR gRNA sequence
tttttggcacataaatgcat

SEQ ID NO: 649498 - DNA, 20 bp, Artificial
  CRISPR gRNA sequence
tttggcacataaatgcatat

SEQ ID NO: 649499 - DNA, 20 bp, Artificial
  CRISPR gRNA sequence
ttggcacataaatgcatatg

SEQ ID NO: 649500 - DNA, 20 bp, Artificial
  CRISPR gRNA sequence
tggcacataaatgcatatga

SEQ ID NO: 649501 - DNA, 20 bp, Artificial
  CRISPR gRNA sequence
ggcacataaatgcatatgac

SEQ ID NO: 649502 - DNA, 20 bp, Artificial
  CRISPR gRNA sequence
gcacataaatgcatatgact

SEQ ID NO: 649503 - DNA, 20 bp, Artificial
  CRISPR gRNA sequence
gattatcattaaattgctac

SEQ ID NO: 649504 - DNA, 20 bp, Artificial
  CRISPR gRNA sequence
attatcattaaattgctact

SEQ ID NO: 649505 - DNA, 20 bp, Artificial
  CRISPR gRNA sequence
tcattaaattgctactaaaa

SEQ ID NO: 649506 - DNA, 20 bp, Artificial
  CRISPR gRNA sequence
aattgctactaaaaatatat

SEQ ID NO: 649507 - DNA, 20 bp, Artificial
  CRISPR gRNA sequence
ctactaaaaatatatggata

SEQ ID NO: 649508 - DNA, 20 bp, Artificial
  CRISPR gRNA sequence
ctaaaaatatatggatacaa

SEQ ID NO: 649509 - DNA, 20 bp, Artificial
  CRISPR gRNA sequence
aaaatatatggatacaagct

SEQ ID NO: 649510 - DNA, 20 bp, Artificial
  CRISPR gRNA sequence
gaattttcagttcagttagg

SEQ ID NO: 649511 - DNA, 20 bp, Artificial
  CRISPR gRNA sequence
aattttcagttcagttagga

SEQ ID NO: 649512 - DNA, 20 bp, Artificial
  CRISPR gRNA sequence
tcagttcagttaggattaag

SEQ ID NO: 649513 - DNA, 20 bp, Artificial
  CRISPR gRNA sequence
cagttcagttaggattaagt

SEQ ID NO: 649514 - DNA, 20 bp, Artificial
  CRISPR gRNA sequence
agttcagttaggattaagta

SEQ ID NO: 649515 - DNA, 20 bp, Artificial
  CRISPR gRNA sequence
agttaggattaagtacattg

SEQ ID NO: 649516 - DNA, 20 bp, Artificial
  CRISPR gRNA sequence
ggattaagtacattgctttc

SEQ ID NO: 649517 - DNA, 20 bp, Artificial
  CRISPR gRNA sequence
agtacattgctttcctatat

SEQ ID NO: 649518 - DNA, 20 bp, Artificial
  CRISPR gRNA sequence
ctttcctatatatgccagtt

SEQ ID NO: 649519 - DNA, 20 bp, Artificial
  CRISPR gRNA sequence
tcctatatatgccagttaga

SEQ ID NO: 649520 - DNA, 20 bp, Artificial
  CRISPR gRNA sequence
cctatatatgccagttagat

SEQ ID NO: 649521 - DNA, 20 bp, Artificial
  CRISPR gRNA sequence
ctatatatgccagttagata

SEQ ID NO: 649522 - DNA, 20 bp, Artificial
  CRISPR gRNA sequence
tatatgccagttagatatta

SEQ ID NO: 649523 - DNA, 20 bp, Artificial
  CRISPR gRNA sequence
gatattatgggcttaattca

SEQ ID NO: 649524 - DNA, 20 bp, Artificial
  CRISPR gRNA sequence
tgggcttaattcacagaacc

SEQ ID NO: 649525 - DNA, 20 bp, Artificial
  CRISPR gRNA sequence
aattcacagaaccatacgcc

SEQ ID NO: 649526 - DNA, 20 bp, Artificial
  CRISPR gRNA sequence
attcacagaaccatacgcca

SEQ ID NO: 649527 - DNA, 20 bp, Artificial
  CRISPR gRNA sequence
acagaaccatacgccaagca

SEQ ID NO: 649528 - DNA, 20 bp, Artificial
  CRISPR gRNA sequence
tatttcatgagcttccaaat

SEQ ID NO: 649529 - DNA, 20 bp, Artificial
  CRISPR gRNA sequence
catgagcttccaaataacac

SEQ ID NO: 649530 - DNA, 20 bp, Artificial
  CRISPR gRNA sequence
atgagcttccaaataacaca

SEQ ID NO: 649531 - DNA, 20 bp, Artificial
  CRISPR gRNA sequence
ccaaataacacaaaattttt

SEQ ID NO: 649532 - DNA, 20 bp, Artificial
  CRISPR gRNA sequence
caaataacacaaaatttttt

SEQ ID NO: 649533 - DNA, 20 bp, Artificial
  CRISPR gRNA sequence
ttttgtaacgttaaagaaaa

SEQ ID NO: 649534 - DNA, 20 bp, Artificial
  CRISPR gRNA sequence
tttgtaacgttaaagaaaac

SEQ ID NO: 649535 - DNA, 20 bp, Artificial
  CRISPR gRNA sequence
ttgtaacgttaaagaaaaca

SEQ ID NO: 649536 - DNA, 20 bp, Artificial
  CRISPR gRNA sequence
tgtaacgttaaagaaaacag

SEQ ID NO: 649537 - DNA, 20 bp, Artificial
  CRISPR gRNA sequence
gtaacgttaaagaaaacagt

SEQ ID NO: 649538 - DNA, 20 bp, Artificial
  CRISPR gRNA sequence
taacgttaaagaaaacagtg

SEQ ID NO: 649539 - DNA, 20 bp, Artificial
  CRISPR gRNA sequence
aagaaaacagtgaaagagat

SEQ ID NO: 649540 - DNA, 20 bp, Artificial
  CRISPR gRNA sequence
cttcttaagaagatgatctg

SEQ ID NO: 649541 - DNA, 20 bp, Artificial
  CRISPR gRNA sequence
cttaagaagatgatctgtta

SEQ ID NO: 649542 - DNA, 20 bp, Artificial
  CRISPR gRNA sequence
ttaagaagatgatctgttac

SEQ ID NO: 649543 - DNA, 20 bp, Artificial
  CRISPR gRNA sequence
aagaagatgatctgttacaa

SEQ ID NO: 649544 - DNA, 20 bp, Artificial
  CRISPR gRNA sequence
agaagatgatctgttacaat

SEQ ID NO: 649545 - DNA, 20 bp, Artificial
  CRISPR gRNA sequence
ttacaatgtaaacaaagaga

SEQ ID NO: 649546 - DNA, 20 bp, Artificial
  CRISPR gRNA sequence
caatgtaaacaaagagaata

SEQ ID NO: 649547 - DNA, 20 bp, Artificial
  CRISPR gRNA sequence
ttcaagctattaaatatact

SEQ ID NO: 649548 - DNA, 20 bp, Artificial
  CRISPR gRNA sequence
caagctattaaatatactgc

SEQ ID NO: 649549 - DNA, 20 bp, Artificial
  CRISPR gRNA sequence
aagctattaaatatactgcc

SEQ ID NO: 649550 - DNA, 20 bp, Artificial
  CRISPR gRNA sequence
ttaaatatactgccttattt

SEQ ID NO: 649551 - DNA, 20 bp, Artificial
  CRISPR gRNA sequence
aatatactgccttatttctt

SEQ ID NO: 649552 - DNA, 20 bp, Artificial
  CRISPR gRNA sequence
ccttatttcttgcagctata

SEQ ID NO: 649553 - DNA, 20 bp, Artificial
  CRISPR gRNA sequence
atttcttgcagctataggaa

SEQ ID NO: 649554 - DNA, 20 bp, Artificial
  CRISPR gRNA sequence
tttcttgcagctataggaat

SEQ ID NO: 649555 - DNA, 20 bp, Artificial
  CRISPR gRNA sequence
cttgcagctataggaatgat

SEQ ID NO: 649556 - DNA, 20 bp, Artificial
  CRISPR gRNA sequence
ttgcagctataggaatgatt

SEQ ID NO: 649557 - DNA, 20 bp, Artificial
  CRISPR gRNA sequence
gcagctataggaatgattac

SEQ ID NO: 649558 - DNA, 20 bp, Artificial
  CRISPR gRNA sequence
cagctataggaatgattaca

SEQ ID NO: 649559 - DNA, 20 bp, Artificial
  CRISPR gRNA sequence
taggaatgattacaaacaaa

SEQ ID NO: 649560 - DNA, 20 bp, Artificial
  CRISPR gRNA sequence
caaacaaatgcttgtaaaac

SEQ ID NO: 649561 - DNA, 20 bp, Artificial
  CRISPR gRNA sequence
gtaaaactagataatgattg

SEQ ID NO: 649562 - DNA, 20 bp, Artificial
  CRISPR gRNA sequence
taaaactagataatgattgc

SEQ ID NO: 649563 - DNA, 20 bp, Artificial
  CRISPR gRNA sequence
gataatgattgctcatgtaa

SEQ ID NO: 649564 - DNA, 20 bp, Artificial
  CRISPR gRNA sequence
ctcatgtaacaaattgcttg

SEQ ID NO: 649565 - DNA, 20 bp, Artificial
  CRISPR gRNA sequence
atgtaacaaattgcttggac

SEQ ID NO: 649566 - DNA, 20 bp, Artificial
  CRISPR gRNA sequence
cttggacatatttaagcaaa

SEQ ID NO: 649567 - DNA, 20 bp, Artificial
  CRISPR gRNA sequence
ggacatatttaagcaaatat

SEQ ID NO: 649568 - DNA, 20 bp, Artificial
  CRISPR gRNA sequence
gacatatttaagcaaatatt

SEQ ID NO: 649569 - DNA, 20 bp, Artificial
  CRISPR gRNA sequence
aagcaaatatttctagtaag

SEQ ID NO: 649570 - DNA, 20 bp, Artificial
  CRISPR gRNA sequence
agcaaatatttctagtaaga

SEQ ID NO: 649571 - DNA, 20 bp, Artificial
  CRISPR gRNA sequence
ctagtaagaattcaactgag

SEQ ID NO: 649572 - DNA, 20 bp, Artificial
  CRISPR gRNA sequence
tagtaagaattcaactgagg

SEQ ID NO: 649573 - DNA, 20 bp, Artificial
  CRISPR gRNA sequence
gtaagaattcaactgagggg

SEQ ID NO: 649574 - DNA, 20 bp, Artificial
  CRISPR gRNA sequence
aactgagggggaatgtaaat

SEQ ID NO: 649575 - DNA, 20 bp, Artificial
  CRISPR gRNA sequence
agggggaatgtaaatgttgg

SEQ ID NO: 649576 - DNA, 20 bp, Artificial
  CRISPR gRNA sequence
ggataaaactgggggaaata

SEQ ID NO: 649577 - DNA, 20 bp, Artificial
  CRISPR gRNA sequence
ggggaaatatcttttgtaaa

SEQ ID NO: 649578 - DNA, 20 bp, Artificial
  CRISPR gRNA sequence
ttgtaaagattgtgtatatg

SEQ ID NO: 649579 - DNA, 20 bp, Artificial
  CRISPR gRNA sequence
tgtaaagattgtgtatatga

SEQ ID NO: 649580 - DNA, 20 bp, Artificial
  CRISPR gRNA sequence
gtaaagattgtgtatatgaa

SEQ ID NO: 649581 - DNA, 20 bp, Artificial
  CRISPR gRNA sequence
taaagattgtgtatatgaac

SEQ ID NO: 649582 - DNA, 20 bp, Artificial
  CRISPR gRNA sequence
tgtatatgaacccaagtact

SEQ ID NO: 649583 - DNA, 20 bp, Artificial
  CRISPR gRNA sequence
ttacaataattgtagacaaa

SEQ ID NO: 649584 - DNA, 20 bp, Artificial
  CRISPR gRNA sequence
caataattgtagacaaatgt

SEQ ID NO: 649585 - DNA, 20 bp, Artificial
  CRISPR gRNA sequence
tagacaaatgtgataattat

SEQ ID NO: 649586 - DNA, 20 bp, Artificial
  CRISPR gRNA sequence
tcacaactcctctaagaaaa

SEQ ID NO: 649587 - DNA, 20 bp, Artificial
  CRISPR gRNA sequence
ctctaagaaaatggaggtct

SEQ ID NO: 649588 - DNA, 20 bp, Artificial
  CRISPR gRNA sequence
taagaaaatggaggtctggc

SEQ ID NO: 649589 - DNA, 20 bp, Artificial
  CRISPR gRNA sequence
agaaaatggaggtctggctc

SEQ ID NO: 649590 - DNA, 20 bp, Artificial
  CRISPR gRNA sequence
gctcacaatctggaatcaac

SEQ ID NO: 649591 - DNA, 20 bp, Artificial
  CRISPR gRNA sequence
acaatctggaatcaacagaa

SEQ ID NO: 649592 - DNA, 20 bp, Artificial
  CRISPR gRNA sequence
gaatcaacagaactgtctta

SEQ ID NO: 649593 - DNA, 20 bp, Artificial
  CRISPR gRNA sequence
tcttaacagttttaagggag

SEQ ID NO: 649594 - DNA, 20 bp, Artificial
  CRISPR gRNA sequence
aacagttttaagggagagcc

SEQ ID NO: 649595 - DNA, 20 bp, Artificial
  CRISPR gRNA sequence
acagttttaagggagagcca

SEQ ID NO: 649596 - DNA, 20 bp, Artificial
  CRISPR gRNA sequence
taagggagagccatttgatt

SEQ ID NO: 649597 - DNA, 20 bp, Artificial
  CRISPR gRNA sequence
aagggagagccatttgattc

SEQ ID NO: 649598 - DNA, 20 bp, Artificial
  CRISPR gRNA sequence
agggagagccatttgattca

SEQ ID NO: 649599 - DNA, 20 bp, Artificial
  CRISPR gRNA sequence
gattcataggattctaaatg

SEQ ID NO: 649600 - DNA, 20 bp, Artificial
  CRISPR gRNA sequence
attcataggattctaaatga

SEQ ID NO: 649601 - DNA, 20 bp, Artificial
  CRISPR gRNA sequence
ataggattctaaatgatctt

SEQ ID NO: 649602 - DNA, 20 bp, Artificial
  CRISPR gRNA sequence
taaatgatctttgagattta

SEQ ID NO: 649603 - DNA, 20 bp, Artificial
  CRISPR gRNA sequence
aatgatctttgagatttagc

SEQ ID NO: 649604 - DNA, 20 bp, Artificial
  CRISPR gRNA sequence
tgagatttagctactggatt

SEQ ID NO: 649605 - DNA, 20 bp, Artificial
  CRISPR gRNA sequence
gagatttagctactggatta

SEQ ID NO: 649606 - DNA, 20 bp, Artificial
  CRISPR gRNA sequence
agatttagctactggattaa

SEQ ID NO: 649607 - DNA, 20 bp, Artificial
  CRISPR gRNA sequence
agctactggattaaagttta

SEQ ID NO: 649608 - DNA, 20 bp, Artificial
  CRISPR gRNA sequence
gctactggattaaagtttat

SEQ ID NO: 649609 - DNA, 20 bp, Artificial
  CRISPR gRNA sequence
ctggattaaagtttattaaa

SEQ ID NO: 649610 - DNA, 20 bp, Artificial
  CRISPR gRNA sequence
gattaaagtttattaaaaac

SEQ ID NO: 649611 - DNA, 20 bp, Artificial
  CRISPR gRNA sequence
aagtttattaaaaacaacat

SEQ ID NO: 649612 - DNA, 20 bp, Artificial
  CRISPR gRNA sequence
attaaaaacaacattagaat

SEQ ID NO: 649613 - DNA, 20 bp, Artificial
  CRISPR gRNA sequence
ttaaaaacaacattagaatt

SEQ ID NO: 649614 - DNA, 20 bp, Artificial
  CRISPR gRNA sequence
aaaacaacattagaattaca

SEQ ID NO: 649615 - DNA, 20 bp, Artificial
  CRISPR gRNA sequence
gaattacatgtcattttcat

SEQ ID NO: 649616 - DNA, 20 bp, Artificial
  CRISPR gRNA sequence
catgtcattttcatgtatat

SEQ ID NO: 649617 - DNA, 20 bp, Artificial
  CRISPR gRNA sequence
tcatgtatatctactaaatg

SEQ ID NO: 649618 - DNA, 20 bp, Artificial
  CRISPR gRNA sequence
catgtatatctactaaatga

SEQ ID NO: 649619 - DNA, 20 bp, Artificial
  CRISPR gRNA sequence
atgtatatctactaaatgac

SEQ ID NO: 649620 - DNA, 20 bp, Artificial
  CRISPR gRNA sequence
ctaaatgactgatttatgac

SEQ ID NO: 649621 - DNA, 20 bp, Artificial
  CRISPR gRNA sequence
aatgactgatttatgacttg

SEQ ID NO: 649622 - DNA, 20 bp, Artificial
  CRISPR gRNA sequence
atttatgacttgaaagattt

SEQ ID NO: 649623 - DNA, 20 bp, Artificial
  CRISPR gRNA sequence
atgacttgaaagatttggat

SEQ ID NO: 649624 - DNA, 20 bp, Artificial
  CRISPR gRNA sequence
tgacttgaaagatttggatc

SEQ ID NO: 649625 - DNA, 20 bp, Artificial
  CRISPR gRNA sequence
gaaagatttggatcataaag

SEQ ID NO: 649626 - DNA, 20 bp, Artificial
  CRISPR gRNA sequence
aaagatttggatcataaaga

SEQ ID NO: 649627 - DNA, 20 bp, Artificial
  CRISPR gRNA sequence
ggatcataaagatcagaaat

SEQ ID NO: 649628 - DNA, 20 bp, Artificial
  CRISPR gRNA sequence
gatcataaagatcagaaata

SEQ ID NO: 649629 - DNA, 20 bp, Artificial
  CRISPR gRNA sequence
attactcaaaataataatag

SEQ ID NO: 649630 - DNA, 20 bp, Artificial
  CRISPR gRNA sequence
ctcaaaataataatagtaac

SEQ ID NO: 649631 - DNA, 20 bp, Artificial
  CRISPR gRNA sequence
aaaataataatagtaacact

SEQ ID NO: 649632 - DNA, 20 bp, Artificial
  CRISPR gRNA sequence
acttttaaattgtatcttta

SEQ ID NO: 649633 - DNA, 20 bp, Artificial
  CRISPR gRNA sequence
ttaaattgtatctttaagat

SEQ ID NO: 649634 - DNA, 20 bp, Artificial
  CRISPR gRNA sequence
taaattgtatctttaagatt

SEQ ID NO: 649635 - DNA, 20 bp, Artificial
  CRISPR gRNA sequence
aaattgtatctttaagattt

SEQ ID NO: 649636 - DNA, 20 bp, Artificial
  CRISPR gRNA sequence
aattgtatctttaagatttt

SEQ ID NO: 649637 - DNA, 20 bp, Artificial
  CRISPR gRNA sequence
tatctttaagattttccaat

SEQ ID NO: 649638 - DNA, 20 bp, Artificial
  CRISPR gRNA sequence
taagattttccaataatacc

SEQ ID NO: 649639 - DNA, 20 bp, Artificial
  CRISPR gRNA sequence
aagattttccaataatacct

SEQ ID NO: 649640 - DNA, 20 bp, Artificial
  CRISPR gRNA sequence
agattttccaataatacctc

SEQ ID NO: 649641 - DNA, 20 bp, Artificial
  CRISPR gRNA sequence
tccaataatacctctgacct

SEQ ID NO: 649642 - DNA, 20 bp, Artificial
  CRISPR gRNA sequence
ccaataatacctctgacctg

SEQ ID NO: 649643 - DNA, 20 bp, Artificial
  CRISPR gRNA sequence
caataatacctctgacctgt

SEQ ID NO: 649644 - DNA, 20 bp, Artificial
  CRISPR gRNA sequence
tgacctgtttgtatatacat

SEQ ID NO: 649645 - DNA, 20 bp, Artificial
  CRISPR gRNA sequence
acctgtttgtatatacattt

SEQ ID NO: 649646 - DNA, 20 bp, Artificial
  CRISPR gRNA sequence
tttgtatatacatttcaaga

SEQ ID NO: 649647 - DNA, 20 bp, Artificial
  CRISPR gRNA sequence
gtatatacatttcaagattc

SEQ ID NO: 649648 - DNA, 20 bp, Artificial
  CRISPR gRNA sequence
tatatacatttcaagattct

SEQ ID NO: 649649 - DNA, 20 bp, Artificial
  CRISPR gRNA sequence
caagattctctaggtatccc

SEQ ID NO: 649650 - DNA, 20 bp, Artificial
  CRISPR gRNA sequence
aagattctctaggtatccct

SEQ ID NO: 649651 - DNA, 20 bp, Artificial
  CRISPR gRNA sequence
tctaggtatcccttaaagtg

SEQ ID NO: 649652 - DNA, 20 bp, Artificial
  CRISPR gRNA sequence
taggtatcccttaaagtgtt

SEQ ID NO: 649653 - DNA, 20 bp, Artificial
  CRISPR gRNA sequence
ggtatcccttaaagtgtttt

SEQ ID NO: 649654 - DNA, 20 bp, Artificial
  CRISPR gRNA sequence
aaagtgttttataaaatcca

SEQ ID NO: 649655 - DNA, 20 bp, Artificial
  CRISPR gRNA sequence
aagtgttttataaaatccat

SEQ ID NO: 649656 - DNA, 20 bp, Artificial
  CRISPR gRNA sequence
tataaaatccatctctaaat

SEQ ID NO: 649657 - DNA, 20 bp, Artificial
  CRISPR gRNA sequence
ataaaatccatctctaaatt

SEQ ID NO: 649658 - DNA, 20 bp, Artificial
  CRISPR gRNA sequence
taaaatccatctctaaattc

SEQ ID NO: 649659 - DNA, 20 bp, Artificial
  CRISPR gRNA sequence
taaattctagagtgacactg

SEQ ID NO: 649660 - DNA, 20 bp, Artificial
  CRISPR gRNA sequence
aattctagagtgacactggc

SEQ ID NO: 649661 - DNA, 20 bp, Artificial
  CRISPR gRNA sequence
tagagtgacactggctgaaa

SEQ ID NO: 649662 - DNA, 20 bp, Artificial
  CRISPR gRNA sequence
gagtgacactggctgaaaag

SEQ ID NO: 649663 - DNA, 20 bp, Artificial
  CRISPR gRNA sequence
gctgaaaagatgtatatttt

SEQ ID NO: 649664 - DNA, 20 bp, Artificial
  CRISPR gRNA sequence
aaaagatgtatattttgaag

SEQ ID NO: 649665 - DNA, 20 bp, Artificial
  CRISPR gRNA sequence
tgaagccatgtgaagctttt

SEQ ID NO: 649666 - DNA, 20 bp, Artificial
  CRISPR gRNA sequence
gaagccatgtgaagcttttg

SEQ ID NO: 649667 - DNA, 20 bp, Artificial
  CRISPR gRNA sequence
aagccatgtgaagcttttga

SEQ ID NO: 649668 - DNA, 20 bp, Artificial
  CRISPR gRNA sequence
ttgaagtcatgtacttgaga

SEQ ID NO: 649669 - DNA, 20 bp, Artificial
  CRISPR gRNA sequence
tgaagtcatgtacttgagaa

SEQ ID NO: 649670 - DNA, 20 bp, Artificial
  CRISPR gRNA sequence
gaagtcatgtacttgagaag

SEQ ID NO: 649671 - DNA, 20 bp, Artificial
  CRISPR gRNA sequence
aagtcatgtacttgagaagc

SEQ ID NO: 649672 - DNA, 20 bp, Artificial
  CRISPR gRNA sequence
gagaagcttttagtccaatg

SEQ ID NO: 649673 - DNA, 20 bp, Artificial
  CRISPR gRNA sequence
agaagcttttagtccaatgt

SEQ ID NO: 649674 - DNA, 20 bp, Artificial
  CRISPR gRNA sequence
ttagtccaatgtagtattgt

SEQ ID NO: 649675 - DNA, 20 bp, Artificial
  CRISPR gRNA sequence
tagtccaatgtagtattgtt

SEQ ID NO: 649676 - DNA, 20 bp, Artificial
  CRISPR gRNA sequence
agtccaatgtagtattgttt

SEQ ID NO: 649677 - DNA, 20 bp, Artificial
  CRISPR gRNA sequence
gtccaatgtagtattgtttg

SEQ ID NO: 649678 - DNA, 20 bp, Artificial
  CRISPR gRNA sequence
tttgaatgagtgttgagaaa

SEQ ID NO: 649679 - DNA, 20 bp, Artificial
  CRISPR gRNA sequence
gaatgagtgttgagaaaaga

SEQ ID NO: 649680 - DNA, 20 bp, Artificial
  CRISPR gRNA sequence
aatgagtgttgagaaaagag

SEQ ID NO: 649681 - DNA, 20 bp, Artificial
  CRISPR gRNA sequence
agaaaagagttaaaagttgt

SEQ ID NO: 649682 - DNA, 20 bp, Artificial
  CRISPR gRNA sequence
aaagttgtctaagctagagc

SEQ ID NO: 649683 - DNA, 20 bp, Artificial
  CRISPR gRNA sequence
tctaagctagagccatcgtt

SEQ ID NO: 649684 - DNA, 20 bp, Artificial
  CRISPR gRNA sequence
agctagagccatcgttagag

SEQ ID NO: 649685 - DNA, 20 bp, Artificial
  CRISPR gRNA sequence
gagccatcgttagagcattt

SEQ ID NO: 649686 - DNA, 20 bp, Artificial
  CRISPR gRNA sequence
gagcatttattttaaaactg

SEQ ID NO: 649687 - DNA, 20 bp, Artificial
  CRISPR gRNA sequence
attttaaaactgccttctgg

SEQ ID NO: 649688 - DNA, 20 bp, Artificial
  CRISPR gRNA sequence
ttttaaaactgccttctggg

SEQ ID NO: 649689 - DNA, 20 bp, Artificial
  CRISPR gRNA sequence
taaaactgccttctgggtaa

SEQ ID NO: 649690 - DNA, 20 bp, Artificial
  CRISPR gRNA sequence
aaaactgccttctgggtaag

SEQ ID NO: 649691 - DNA, 20 bp, Artificial
  CRISPR gRNA sequence
aaactgccttctgggtaaga

SEQ ID NO: 649692 - DNA, 20 bp, Artificial
  CRISPR gRNA sequence
ccttctgggtaagactagct

SEQ ID NO: 649693 - DNA, 20 bp, Artificial
  CRISPR gRNA sequence
ctgggtaagactagctgggt

SEQ ID NO: 649694 - DNA, 20 bp, Artificial
  CRISPR gRNA sequence
tgggtaagactagctgggtg

SEQ ID NO: 649695 - DNA, 20 bp, Artificial
  CRISPR gRNA sequence
ggtaagactagctgggtgat

SEQ ID NO: 649696 - DNA, 20 bp, Artificial
  CRISPR gRNA sequence
gctgggtgatttggtctctg

SEQ ID NO: 649697 - DNA, 20 bp, Artificial
  CRISPR gRNA sequence
ggtgatttggtctctggtat

SEQ ID NO: 649698 - DNA, 20 bp, Artificial
  CRISPR gRNA sequence
ggtctctggtatcctcaaca

SEQ ID NO: 649699 - DNA, 20 bp, Artificial
  CRISPR gRNA sequence
gtctctggtatcctcaacac

SEQ ID NO: 649700 - DNA, 20 bp, Artificial
  CRISPR gRNA sequence
tggtatcctcaacacagata

SEQ ID NO: 649701 - DNA, 20 bp, Artificial
  CRISPR gRNA sequence
gtatcctcaacacagatagc

SEQ ID NO: 649702 - DNA, 20 bp, Artificial
  CRISPR gRNA sequence
aacacagatagcataactga

SEQ ID NO: 649703 - DNA, 20 bp, Artificial
  CRISPR gRNA sequence
aagtaacctgtggggttaat

SEQ ID NO: 649704 - DNA, 20 bp, Artificial
  CRISPR gRNA sequence
tggggttaatctgaataata

SEQ ID NO: 649705 - DNA, 20 bp, Artificial
  CRISPR gRNA sequence
atctgaataataatgtctgg

SEQ ID NO: 649706 - DNA, 20 bp, Artificial
  CRISPR gRNA sequence
aataataatgtctggaataa

SEQ ID NO: 649707 - DNA, 20 bp, Artificial
  CRISPR gRNA sequence
gaataactgagagacgtctc

SEQ ID NO: 649708 - DNA, 20 bp, Artificial
  CRISPR gRNA sequence
agagacgtctctaatgcatt

SEQ ID NO: 649709 - DNA, 20 bp, Artificial
  CRISPR gRNA sequence
taatgcattcagtcaatcag

SEQ ID NO: 649710 - DNA, 20 bp, Artificial
  CRISPR gRNA sequence
atgcattcagtcaatcagat

SEQ ID NO: 649711 - DNA, 20 bp, Artificial
  CRISPR gRNA sequence
agtcaatcagataaccaaca

SEQ ID NO: 649712 - DNA, 20 bp, Artificial
  CRISPR gRNA sequence
actcacaatatattttaaaa

SEQ ID NO: 649713 - DNA, 20 bp, Artificial
  CRISPR gRNA sequence
acaatatattttaaaataaa

SEQ ID NO: 649714 - DNA, 20 bp, Artificial
  CRISPR gRNA sequence
taaaataaacagcaaatctt

SEQ ID NO: 649715 - DNA, 20 bp, Artificial
  CRISPR gRNA sequence
aaaataaacagcaaatcttc

SEQ ID NO: 649716 - DNA, 20 bp, Artificial
  CRISPR gRNA sequence
aaataaacagcaaatcttct

SEQ ID NO: 649717 - DNA, 20 bp, Artificial
  CRISPR gRNA sequence
cttaattgagagactactat

SEQ ID NO: 649718 - DNA, 20 bp, Artificial
  CRISPR gRNA sequence
ttaattgagagactactatg

SEQ ID NO: 649719 - DNA, 20 bp, Artificial
  CRISPR gRNA sequence
aattgagagactactatgta

SEQ ID NO: 649720 - DNA, 20 bp, Artificial
  CRISPR gRNA sequence
attgagagactactatgtat

SEQ ID NO: 649721 - DNA, 20 bp, Artificial
  CRISPR gRNA sequence
agagactactatgtataagg

SEQ ID NO: 649722 - DNA, 20 bp, Artificial
  CRISPR gRNA sequence
ctatgtataaggcactgtgt

SEQ ID NO: 649723 - DNA, 20 bp, Artificial
  CRISPR gRNA sequence
tgtataaggcactgtgttag

SEQ ID NO: 649724 - DNA, 20 bp, Artificial
  CRISPR gRNA sequence
tgttagcttctgtggaaaag

SEQ ID NO: 649725 - DNA, 20 bp, Artificial
  CRISPR gRNA sequence
gcttctgtggaaaagataaa

SEQ ID NO: 649726 - DNA, 20 bp, Artificial
  CRISPR gRNA sequence
ctgtggaaaagataaatgaa

SEQ ID NO: 649727 - DNA, 20 bp, Artificial
  CRISPR gRNA sequence
tgtggaaaagataaatgaat

SEQ ID NO: 649728 - DNA, 20 bp, Artificial
  CRISPR gRNA sequence
tggaaaagataaatgaatat

SEQ ID NO: 649729 - DNA, 20 bp, Artificial
  CRISPR gRNA sequence
cttaaattatttcttaaaat

SEQ ID NO: 649730 - DNA, 20 bp, Artificial
  CRISPR gRNA sequence
ttaaattatttcttaaaatg

SEQ ID NO: 649731 - DNA, 20 bp, Artificial
  CRISPR gRNA sequence
aaattatttcttaaaatgta

SEQ ID NO: 649732 - DNA, 20 bp, Artificial
  CRISPR gRNA sequence
aattatttcttaaaatgtat

SEQ ID NO: 649733 - DNA, 20 bp, Artificial
  CRISPR gRNA sequence
tttcttaaaatgtattaggc

SEQ ID NO: 649734 - DNA, 20 bp, Artificial
  CRISPR gRNA sequence
cttaaaatgtattaggccct

SEQ ID NO: 649735 - DNA, 20 bp, Artificial
  CRISPR gRNA sequence
ttaaaatgtattaggccctg

SEQ ID NO: 649736 - DNA, 20 bp, Artificial
  CRISPR gRNA sequence
aaaatgtattaggccctgtg

SEQ ID NO: 649737 - DNA, 20 bp, Artificial
  CRISPR gRNA sequence
aaatgtattaggccctgtga

SEQ ID NO: 649738 - DNA, 20 bp, Artificial
  CRISPR gRNA sequence
ggccctgtgataaaagcttt

SEQ ID NO: 649739 - DNA, 20 bp, Artificial
  CRISPR gRNA sequence
tgataaaagctttactaagt

SEQ ID NO: 649740 - DNA, 20 bp, Artificial
  CRISPR gRNA sequence
tactaagtttattaaccctc

SEQ ID NO: 649741 - DNA, 20 bp, Artificial
  CRISPR gRNA sequence
actaagtttattaaccctca

SEQ ID NO: 649742 - DNA, 20 bp, Artificial
  CRISPR gRNA sequence
ctaagtttattaaccctcac

SEQ ID NO: 649743 - DNA, 20 bp, Artificial
  CRISPR gRNA sequence
agtttattaaccctcacaac

SEQ ID NO: 649744 - DNA, 20 bp, Artificial
  CRISPR gRNA sequence
attaaccctcacaacaactc

SEQ ID NO: 649745 - DNA, 20 bp, Artificial
  CRISPR gRNA sequence
ttaaccctcacaacaactcc

SEQ ID NO: 649746 - DNA, 20 bp, Artificial
  CRISPR gRNA sequence
accctcacaacaactccaag

SEQ ID NO: 649747 - DNA, 20 bp, Artificial
  CRISPR gRNA sequence
acaacaactccaagagacaa

SEQ ID NO: 649748 - DNA, 20 bp, Artificial
  CRISPR gRNA sequence
caagagacaagcactaactt

SEQ ID NO: 649749 - DNA, 20 bp, Artificial
  CRISPR gRNA sequence
actttccctattttacaaat

SEQ ID NO: 649750 - DNA, 20 bp, Artificial
  CRISPR gRNA sequence
tccctattttacaaatgagg

SEQ ID NO: 649751 - DNA, 20 bp, Artificial
  CRISPR gRNA sequence
ccctattttacaaatgaggt

SEQ ID NO: 649752 - DNA, 20 bp, Artificial
  CRISPR gRNA sequence
cctattttacaaatgaggta

SEQ ID NO: 649753 - DNA, 20 bp, Artificial
  CRISPR gRNA sequence
ttttacaaatgaggtaacta

SEQ ID NO: 649754 - DNA, 20 bp, Artificial
  CRISPR gRNA sequence
tacaaatgaggtaactaaaa

SEQ ID NO: 649755 - DNA, 20 bp, Artificial
  CRISPR gRNA sequence
acaaatgaggtaactaaaac

SEQ ID NO: 649756 - DNA, 20 bp, Artificial
  CRISPR gRNA sequence
caaatgaggtaactaaaaca

SEQ ID NO: 649757 - DNA, 20 bp, Artificial
  CRISPR gRNA sequence
aaacacagcataggaaagat

SEQ ID NO: 649758 - DNA, 20 bp, Artificial
  CRISPR gRNA sequence
tcccagtcggttaggtgcta

SEQ ID NO: 649759 - DNA, 20 bp, Artificial
  CRISPR gRNA sequence
ggtgctaaaagtcatattct

SEQ ID NO: 649760 - DNA, 20 bp, Artificial
  CRISPR gRNA sequence
aaagtcatattctgtctgct

SEQ ID NO: 649761 - DNA, 20 bp, Artificial
  CRISPR gRNA sequence
tgtctgctaccctcaggctg

SEQ ID NO: 649762 - DNA, 20 bp, Artificial
  CRISPR gRNA sequence
tctgctaccctcaggctgca

SEQ ID NO: 649763 - DNA, 20 bp, Artificial
  CRISPR gRNA sequence
ctaccctcaggctgcagaga

SEQ ID NO: 649764 - DNA, 20 bp, Artificial
  CRISPR gRNA sequence
ccctcaggctgcagagatta

SEQ ID NO: 649765 - DNA, 20 bp, Artificial
  CRISPR gRNA sequence
aggctgcagagattacaaag

SEQ ID NO: 649766 - DNA, 20 bp, Artificial
  CRISPR gRNA sequence
cagagattacaaagtcattt

SEQ ID NO: 649767 - DNA, 20 bp, Artificial
  CRISPR gRNA sequence
caaagtcattttccctgccc

SEQ ID NO: 649768 - DNA, 20 bp, Artificial
  CRISPR gRNA sequence
tccctgccctcaaggagttt

SEQ ID NO: 649769 - DNA, 20 bp, Artificial
  CRISPR gRNA sequence
ccctgccctcaaggagtttc

SEQ ID NO: 649770 - DNA, 20 bp, Artificial
  CRISPR gRNA sequence
cctgccctcaaggagtttcc

SEQ ID NO: 649771 - DNA, 20 bp, Artificial
  CRISPR gRNA sequence
ccctcaaggagtttccagtc

SEQ ID NO: 649772 - DNA, 20 bp, Artificial
  CRISPR gRNA sequence
aaggagtttccagtcacaca

SEQ ID NO: 649773 - DNA, 20 bp, Artificial
  CRISPR gRNA sequence
ccagtcacacaaaggagata

SEQ ID NO: 649774 - DNA, 20 bp, Artificial
  CRISPR gRNA sequence
cagtcacacaaaggagataa

SEQ ID NO: 649775 - DNA, 20 bp, Artificial
  CRISPR gRNA sequence
aagaaattaagcaatgataa

SEQ ID NO: 649776 - DNA, 20 bp, Artificial
  CRISPR gRNA sequence
agcaatgataaaacaggata

SEQ ID NO: 649777 - DNA, 20 bp, Artificial
  CRISPR gRNA sequence
ggaattagggatcgactgtc

SEQ ID NO: 649778 - DNA, 20 bp, Artificial
  CRISPR gRNA sequence
gaattagggatcgactgtcc

SEQ ID NO: 649779 - DNA, 20 bp, Artificial
  CRISPR gRNA sequence
gggatcgactgtcctgtgcc

SEQ ID NO: 649780 - DNA, 20 bp, Artificial
  CRISPR gRNA sequence
tcctgtgcctatgacaatag

SEQ ID NO: 649781 - DNA, 20 bp, Artificial
  CRISPR gRNA sequence
tgcctatgacaatagtaact

SEQ ID NO: 649782 - DNA, 20 bp, Artificial
  CRISPR gRNA sequence
tgacaatagtaactctgacc

SEQ ID NO: 649783 - DNA, 20 bp, Artificial
  CRISPR gRNA sequence
tgacccaaaaaaggtgaaac

SEQ ID NO: 649784 - DNA, 20 bp, Artificial
  CRISPR gRNA sequence
acccaaaaaaggtgaaactt

SEQ ID NO: 649785 - DNA, 20 bp, Artificial
  CRISPR gRNA sequence
cactcaggaaaatgtctgtt

SEQ ID NO: 649786 - DNA, 20 bp, Artificial
  CRISPR gRNA sequence
actcaggaaaatgtctgttt

SEQ ID NO: 649787 - DNA, 20 bp, Artificial
  CRISPR gRNA sequence
aggaaaatgtctgtttatgt

SEQ ID NO: 649788 - DNA, 20 bp, Artificial
  CRISPR gRNA sequence
tttatgtgtactctaatgtg

SEQ ID NO: 649789 - DNA, 20 bp, Artificial
  CRISPR gRNA sequence
atgtgtactctaatgtgaaa

SEQ ID NO: 649790 - DNA, 20 bp, Artificial
  CRISPR gRNA sequence
tgtgtactctaatgtgaaat

SEQ ID NO: 649791 - DNA, 20 bp, Artificial
  CRISPR gRNA sequence
taatgtgaaatccttttaaa

SEQ ID NO: 649792 - DNA, 20 bp, Artificial
  CRISPR gRNA sequence
atgtgaaatccttttaaact

SEQ ID NO: 649793 - DNA, 20 bp, Artificial
  CRISPR gRNA sequence
ttaaactgaatattctgttt

SEQ ID NO: 649794 - DNA, 20 bp, Artificial
  CRISPR gRNA sequence
taaactgaatattctgtttt

SEQ ID NO: 649795 - DNA, 20 bp, Artificial
  CRISPR gRNA sequence
aaactgaatattctgttttc

SEQ ID NO: 649796 - DNA, 20 bp, Artificial
  CRISPR gRNA sequence
aactgaatattctgttttct

SEQ ID NO: 649797 - DNA, 20 bp, Artificial
  CRISPR gRNA sequence
aatattctgttttctccttg

SEQ ID NO: 649798 - DNA, 20 bp, Artificial
  CRISPR gRNA sequence
tgttttctccttgattctac

SEQ ID NO: 649799 - DNA, 20 bp, Artificial
  CRISPR gRNA sequence
ttttctccttgattctacac

SEQ ID NO: 649800 - DNA, 20 bp, Artificial
  CRISPR gRNA sequence
tctccttgattctacacaag

SEQ ID NO: 649801 - DNA, 20 bp, Artificial
  CRISPR gRNA sequence
ctccttgattctacacaaga

SEQ ID NO: 649802 - DNA, 20 bp, Artificial
  CRISPR gRNA sequence
tccttgattctacacaagag

SEQ ID NO: 649803 - DNA, 20 bp, Artificial
  CRISPR gRNA sequence
cttgattctacacaagagag

SEQ ID NO: 649804 - DNA, 20 bp, Artificial
  CRISPR gRNA sequence
gattctacacaagagagaaa

SEQ ID NO: 649805 - DNA, 20 bp, Artificial
  CRISPR gRNA sequence
attctacacaagagagaaaa

SEQ ID NO: 649806 - DNA, 20 bp, Artificial
  CRISPR gRNA sequence
tacacaagagagaaaaaaag

SEQ ID NO: 649807 - DNA, 20 bp, Artificial
  CRISPR gRNA sequence
cacaagagagaaaaaaagaa

SEQ ID NO: 649808 - DNA, 20 bp, Artificial
  CRISPR gRNA sequence
ctggggtatgtatatgtggt

SEQ ID NO: 649809 - DNA, 20 bp, Artificial
  CRISPR gRNA sequence
gggtatgtatatgtggttct

SEQ ID NO: 649810 - DNA, 20 bp, Artificial
  CRISPR gRNA sequence
tgagaattccagatatgcaa

SEQ ID NO: 649811 - DNA, 20 bp, Artificial
  CRISPR gRNA sequence
agaattccagatatgcaaca

SEQ ID NO: 649812 - DNA, 20 bp, Artificial
  CRISPR gRNA sequence
cagatatgcaacagagacat

SEQ ID NO: 649813 - DNA, 20 bp, Artificial
  CRISPR gRNA sequence
aatataacacatagagcacc

SEQ ID NO: 649814 - DNA, 20 bp, Artificial
  CRISPR gRNA sequence
atataacacatagagcacca

SEQ ID NO: 649815 - DNA, 20 bp, Artificial
  CRISPR gRNA sequence
ataaaatttcagagctatac

SEQ ID NO: 649816 - DNA, 20 bp, Artificial
  CRISPR gRNA sequence
cagagctatactaggaattc

SEQ ID NO: 649817 - DNA, 20 bp, Artificial
  CRISPR gRNA sequence
agagctatactaggaattca

SEQ ID NO: 649818 - DNA, 20 bp, Artificial
  CRISPR gRNA sequence
tactaggaattcattcacca

SEQ ID NO: 649819 - DNA, 20 bp, Artificial
  CRISPR gRNA sequence
ggaattcattcaccaacaca

SEQ ID NO: 649820 - DNA, 20 bp, Artificial
  CRISPR gRNA sequence
attcaccaacacatctagtt

SEQ ID NO: 649821 - DNA, 20 bp, Artificial
  CRISPR gRNA sequence
accaacacatctagttatac

SEQ ID NO: 649822 - DNA, 20 bp, Artificial
  CRISPR gRNA sequence
gttatacaagtaaataagtc

SEQ ID NO: 649823 - DNA, 20 bp, Artificial
  CRISPR gRNA sequence
tacaagtaaataagtccatc

SEQ ID NO: 649824 - DNA, 20 bp, Artificial
  CRISPR gRNA sequence
aaaactcactctggacaagg

SEQ ID NO: 649825 - DNA, 20 bp, Artificial
  CRISPR gRNA sequence
actctggacaaggtcaccta

SEQ ID NO: 649826 - DNA, 20 bp, Artificial
  CRISPR gRNA sequence
tggacaaggtcacctaggga

SEQ ID NO: 649827 - DNA, 20 bp, Artificial
  CRISPR gRNA sequence
gacaaggtcacctagggagg

SEQ ID NO: 649828 - DNA, 20 bp, Artificial
  CRISPR gRNA sequence
gggaggtacaccaagcagcc

SEQ ID NO: 649829 - DNA, 20 bp, Artificial
  CRISPR gRNA sequence
ccagcaaacacatcttctga

SEQ ID NO: 649830 - DNA, 20 bp, Artificial
  CRISPR gRNA sequence
ctgaattgccatcctcaaat

SEQ ID NO: 649831 - DNA, 20 bp, Artificial
  CRISPR gRNA sequence
tgaattgccatcctcaaatg

SEQ ID NO: 649832 - DNA, 20 bp, Artificial
  CRISPR gRNA sequence
aattgccatcctcaaatgaa

SEQ ID NO: 649833 - DNA, 20 bp, Artificial
  CRISPR gRNA sequence
ccatcctcaaatgaaatgca

SEQ ID NO: 649834 - DNA, 20 bp, Artificial
  CRISPR gRNA sequence
aaatgaaatgcattactacc

SEQ ID NO: 649835 - DNA, 20 bp, Artificial
  CRISPR gRNA sequence
ctaccacttaattaccattt

SEQ ID NO: 649836 - DNA, 20 bp, Artificial
  CRISPR gRNA sequence
ccacttaattaccatttcaa

SEQ ID NO: 649837 - DNA, 20 bp, Artificial
  CRISPR gRNA sequence
aattaccatttcaattatac

SEQ ID NO: 649838 - DNA, 20 bp, Artificial
  CRISPR gRNA sequence
attaccatttcaattatacc

SEQ ID NO: 649839 - DNA, 20 bp, Artificial
  CRISPR gRNA sequence
ccatttcaattatacccgtc

SEQ ID NO: 649840 - DNA, 20 bp, Artificial
  CRISPR gRNA sequence
caattatacccgtcacaaac

SEQ ID NO: 649841 - DNA, 20 bp, Artificial
  CRISPR gRNA sequence
aattatacccgtcacaaaca

SEQ ID NO: 649842 - DNA, 20 bp, Artificial
  CRISPR gRNA sequence
tacccgtcacaaacagagta

SEQ ID NO: 649843 - DNA, 20 bp, Artificial
  CRISPR gRNA sequence
atgtgtgattcaatttaatt

SEQ ID NO: 649844 - DNA, 20 bp, Artificial
  CRISPR gRNA sequence
tgtgtgattcaatttaatta

SEQ ID NO: 649845 - DNA, 20 bp, Artificial
  CRISPR gRNA sequence
aatttaattaggtaatttta

SEQ ID NO: 649846 - DNA, 20 bp, Artificial
  CRISPR gRNA sequence
aattaggtaattttactttc

SEQ ID NO: 649847 - DNA, 20 bp, Artificial
  CRISPR gRNA sequence
attaggtaattttactttca

SEQ ID NO: 649848 - DNA, 20 bp, Artificial
  CRISPR gRNA sequence
ggtaattttactttcatttc

SEQ ID NO: 649849 - DNA, 20 bp, Artificial
  CRISPR gRNA sequence
tactttcatttcttcagtaa

SEQ ID NO: 649850 - DNA, 20 bp, Artificial
  CRISPR gRNA sequence
actttcatttcttcagtaat

SEQ ID NO: 649851 - DNA, 20 bp, Artificial
  CRISPR gRNA sequence
ctttcatttcttcagtaatt

SEQ ID NO: 649852 - DNA, 20 bp, Artificial
  CRISPR gRNA sequence
tcatttcttcagtaattgat

SEQ ID NO: 649853 - DNA, 20 bp, Artificial
  CRISPR gRNA sequence
catttcttcagtaattgatt

SEQ ID NO: 649854 - DNA, 20 bp, Artificial
  CRISPR gRNA sequence
atttcttcagtaattgattt

SEQ ID NO: 649855 - DNA, 20 bp, Artificial
  CRISPR gRNA sequence
cttcagtaattgatttgaat

SEQ ID NO: 649856 - DNA, 20 bp, Artificial
  CRISPR gRNA sequence
ttcagtaattgatttgaata

SEQ ID NO: 649857 - DNA, 20 bp, Artificial
  CRISPR gRNA sequence
cagtaattgatttgaataca

SEQ ID NO: 649858 - DNA, 20 bp, Artificial
  CRISPR gRNA sequence
agtaattgatttgaatacaa

SEQ ID NO: 649859 - DNA, 20 bp, Artificial
  CRISPR gRNA sequence
atttgaatacaacagaatta

SEQ ID NO: 649860 - DNA, 20 bp, Artificial
  CRISPR gRNA sequence
gaatacaacagaattaataa

SEQ ID NO: 649861 - DNA, 20 bp, Artificial
  CRISPR gRNA sequence
aatacaacagaattaataat

SEQ ID NO: 649862 - DNA, 20 bp, Artificial
  CRISPR gRNA sequence
ataattgtctcatatctgca

SEQ ID NO: 649863 - DNA, 20 bp, Artificial
  CRISPR gRNA sequence
tctcatatctgcatacacat

SEQ ID NO: 649864 - DNA, 20 bp, Artificial
  CRISPR gRNA sequence
atatctgcatacacatttct

SEQ ID NO: 649865 - DNA, 20 bp, Artificial
  CRISPR gRNA sequence
catacacatttcttttcaaa

SEQ ID NO: 649866 - DNA, 20 bp, Artificial
  CRISPR gRNA sequence
cttttcaaacaaaaattctg

SEQ ID NO: 649867 - DNA, 20 bp, Artificial
  CRISPR gRNA sequence
ttttcaaacaaaaattctga

SEQ ID NO: 649868 - DNA, 20 bp, Artificial
  CRISPR gRNA sequence
ttcaaacaaaaattctgagt

SEQ ID NO: 649869 - DNA, 20 bp, Artificial
  CRISPR gRNA sequence
tcaaacaaaaattctgagtc

SEQ ID NO: 649870 - DNA, 20 bp, Artificial
  CRISPR gRNA sequence
caaacaaaaattctgagtct

SEQ ID NO: 649871 - DNA, 20 bp, Artificial
  CRISPR gRNA sequence
aaacaaaaattctgagtctg

SEQ ID NO: 649872 - DNA, 20 bp, Artificial
  CRISPR gRNA sequence
tgagtctgtctacctgacag

SEQ ID NO: 649873 - DNA, 20 bp, Artificial
  CRISPR gRNA sequence
agtctgtctacctgacagca

SEQ ID NO: 649874 - DNA, 20 bp, Artificial
  CRISPR gRNA sequence
tctacctgacagcactcaaa

SEQ ID NO: 649875 - DNA, 20 bp, Artificial
  CRISPR gRNA sequence
cctgacagcactcaaacaga

SEQ ID NO: 649876 - DNA, 20 bp, Artificial
  CRISPR gRNA sequence
acagcactcaaacagatgaa

SEQ ID NO: 649877 - DNA, 20 bp, Artificial
  CRISPR gRNA sequence
aaacagatgaaaagcagaaa

SEQ ID NO: 649878 - DNA, 20 bp, Artificial
  CRISPR gRNA sequence
agtaagtgatccagatatgt

SEQ ID NO: 649879 - DNA, 20 bp, Artificial
  CRISPR gRNA sequence
tgttccatgcaatgctttgg

SEQ ID NO: 649880 - DNA, 20 bp, Artificial
  CRISPR gRNA sequence
catgcaatgctttggactaa

SEQ ID NO: 649881 - DNA, 20 bp, Artificial
  CRISPR gRNA sequence
tggactaatttttaaaatta

SEQ ID NO: 649882 - DNA, 20 bp, Artificial
  CRISPR gRNA sequence
ggactaatttttaaaattat

SEQ ID NO: 649883 - DNA, 20 bp, Artificial
  CRISPR gRNA sequence
gactaatttttaaaattatt

SEQ ID NO: 649884 - DNA, 20 bp, Artificial
  CRISPR gRNA sequence
atttttaaaattattgttga

SEQ ID NO: 649885 - DNA, 20 bp, Artificial
  CRISPR gRNA sequence
ttaaaattattgttgattaa

SEQ ID NO: 649886 - DNA, 20 bp, Artificial
  CRISPR gRNA sequence
taaaattattgttgattaaa

SEQ ID NO: 649887 - DNA, 20 bp, Artificial
  CRISPR gRNA sequence
aaaattattgttgattaaaa

SEQ ID NO: 649888 - DNA, 20 bp, Artificial
  CRISPR gRNA sequence
aaattattgttgattaaaag

SEQ ID NO: 649889 - DNA, 20 bp, Artificial
  CRISPR gRNA sequence
ttgttgattaaaagcggact

SEQ ID NO: 649890 - DNA, 20 bp, Artificial
  CRISPR gRNA sequence
ttgattaaaagcggactaaa

SEQ ID NO: 649891 - DNA, 20 bp, Artificial
  CRISPR gRNA sequence
attaaaagcggactaaaagc

SEQ ID NO: 649892 - DNA, 20 bp, Artificial
  CRISPR gRNA sequence
aaagcggactaaaagcatgt

SEQ ID NO: 649893 - DNA, 20 bp, Artificial
  CRISPR gRNA sequence
aaagcatgtccttcctagaa

SEQ ID NO: 649894 - DNA, 20 bp, Artificial
  CRISPR gRNA sequence
cctagaagactatttgatat

SEQ ID NO: 649895 - DNA, 20 bp, Artificial
  CRISPR gRNA sequence
ctagaagactatttgatata

SEQ ID NO: 649896 - DNA, 20 bp, Artificial
  CRISPR gRNA sequence
gaagactatttgatatatgt

SEQ ID NO: 649897 - DNA, 20 bp, Artificial
  CRISPR gRNA sequence
tttgatatatgtttgtggga

SEQ ID NO: 649898 - DNA, 20 bp, Artificial
  CRISPR gRNA sequence
gatatatgtttgtgggacct

SEQ ID NO: 649899 - DNA, 20 bp, Artificial
  CRISPR gRNA sequence
atatatgtttgtgggacctg

SEQ ID NO: 649900 - DNA, 20 bp, Artificial
  CRISPR gRNA sequence
gtgggacctgtttcttagtt

SEQ ID NO: 649901 - DNA, 20 bp, Artificial
  CRISPR gRNA sequence
tgggacctgtttcttagtta

SEQ ID NO: 649902 - DNA, 20 bp, Artificial
  CRISPR gRNA sequence
tttcttagttattatgtaat

SEQ ID NO: 649903 - DNA, 20 bp, Artificial
  CRISPR gRNA sequence
cttagttattatgtaattca

SEQ ID NO: 649904 - DNA, 20 bp, Artificial
  CRISPR gRNA sequence
ttagttattatgtaattcaa

SEQ ID NO: 649905 - DNA, 20 bp, Artificial
  CRISPR gRNA sequence
agttattatgtaattcaact

SEQ ID NO: 649906 - DNA, 20 bp, Artificial
  CRISPR gRNA sequence
gttattatgtaattcaactt

SEQ ID NO: 649907 - DNA, 20 bp, Artificial
  CRISPR gRNA sequence
ttatgtaattcaactttttt

SEQ ID NO: 649908 - DNA, 20 bp, Artificial
  CRISPR gRNA sequence
tgtaattcaacttttttctc

SEQ ID NO: 649909 - DNA, 20 bp, Artificial
  CRISPR gRNA sequence
aacttttttctcatattctt

SEQ ID NO: 649910 - DNA, 20 bp, Artificial
  CRISPR gRNA sequence
ttttctcatattctttttat

SEQ ID NO: 649911 - DNA, 20 bp, Artificial
  CRISPR gRNA sequence
tttctcatattctttttatc

SEQ ID NO: 649912 - DNA, 20 bp, Artificial
  CRISPR gRNA sequence
ttctcatattctttttatct

SEQ ID NO: 649913 - DNA, 20 bp, Artificial
  CRISPR gRNA sequence
tctcatattctttttatcta

SEQ ID NO: 649914 - DNA, 20 bp, Artificial
  CRISPR gRNA sequence
ctcatattctttttatctaa

SEQ ID NO: 649915 - DNA, 20 bp, Artificial
  CRISPR gRNA sequence
tcatattctttttatctaac

SEQ ID NO: 649916 - DNA, 20 bp, Artificial
  CRISPR gRNA sequence
atattctttttatctaacaa

SEQ ID NO: 649917 - DNA, 20 bp, Artificial
  CRISPR gRNA sequence
tttttatctaacaataaaat

SEQ ID NO: 649918 - DNA, 20 bp, Artificial
  CRISPR gRNA sequence
tttatctaacaataaaatag

SEQ ID NO: 649919 - DNA, 20 bp, Artificial
  CRISPR gRNA sequence
ttatctaacaataaaatagg

SEQ ID NO: 649920 - DNA, 20 bp, Artificial
  CRISPR gRNA sequence
tatctaacaataaaatagga

SEQ ID NO: 649921 - DNA, 20 bp, Artificial
  CRISPR gRNA sequence
atctaacaataaaataggag

SEQ ID NO: 649922 - DNA, 20 bp, Artificial
  CRISPR gRNA sequence
tctaacaataaaataggagc

SEQ ID NO: 649923 - DNA, 20 bp, Artificial
  CRISPR gRNA sequence
acaataaaataggagctatc

SEQ ID NO: 649924 - DNA, 20 bp, Artificial
  CRISPR gRNA sequence
tcattctggctaacttacca

SEQ ID NO: 649925 - DNA, 20 bp, Artificial
  CRISPR gRNA sequence
tggctaacttaccatgagcc

SEQ ID NO: 649926 - DNA, 20 bp, Artificial
  CRISPR gRNA sequence
gctaacttaccatgagccag

SEQ ID NO: 649927 - DNA, 20 bp, Artificial
  CRISPR gRNA sequence
acttaccatgagccagtcac

SEQ ID NO: 649928 - DNA, 20 bp, Artificial
  CRISPR gRNA sequence
accatgagccagtcactgtt

SEQ ID NO: 649929 - DNA, 20 bp, Artificial
  CRISPR gRNA sequence
ccatgagccagtcactgttc

SEQ ID NO: 649930 - DNA, 20 bp, Artificial
  CRISPR gRNA sequence
ttctggaagctttacatata

SEQ ID NO: 649931 - DNA, 20 bp, Artificial
  CRISPR gRNA sequence
tggaagctttacatatattg

SEQ ID NO: 649932 - DNA, 20 bp, Artificial
  CRISPR gRNA sequence
gaagctttacatatattgtg

SEQ ID NO: 649933 - DNA, 20 bp, Artificial
  CRISPR gRNA sequence
tacatatattgtgtctaatg

SEQ ID NO: 649934 - DNA, 20 bp, Artificial
  CRISPR gRNA sequence
acatatattgtgtctaatgc

SEQ ID NO: 649935 - DNA, 20 bp, Artificial
  CRISPR gRNA sequence
catatattgtgtctaatgct

SEQ ID NO: 649936 - DNA, 20 bp, Artificial
  CRISPR gRNA sequence
tgtctaatgcttaccactcc

SEQ ID NO: 649937 - DNA, 20 bp, Artificial
  CRISPR gRNA sequence
atgcttaccactcctctgac

SEQ ID NO: 649938 - DNA, 20 bp, Artificial
  CRISPR gRNA sequence
accactcctctgacagagag

SEQ ID NO: 649939 - DNA, 20 bp, Artificial
  CRISPR gRNA sequence
ccactcctctgacagagagc

SEQ ID NO: 649940 - DNA, 20 bp, Artificial
  CRISPR gRNA sequence
ctctgacagagagcaatatc

SEQ ID NO: 649941 - DNA, 20 bp, Artificial
  CRISPR gRNA sequence
tgacagagagcaatatcccc

SEQ ID NO: 649942 - DNA, 20 bp, Artificial
  CRISPR gRNA sequence
acagagagcaatatcccctt

SEQ ID NO: 649943 - DNA, 20 bp, Artificial
  CRISPR gRNA sequence
tttacaaataaagctgagct

SEQ ID NO: 649944 - DNA, 20 bp, Artificial
  CRISPR gRNA sequence
ttacaaataaagctgagctt

SEQ ID NO: 649945 - DNA, 20 bp, Artificial
  CRISPR gRNA sequence
tacaaataaagctgagcttc

SEQ ID NO: 649946 - DNA, 20 bp, Artificial
  CRISPR gRNA sequence
acaaataaagctgagcttcc

SEQ ID NO: 649947 - DNA, 20 bp, Artificial
  CRISPR gRNA sequence
caaataaagctgagcttcca

SEQ ID NO: 649948 - DNA, 20 bp, Artificial
  CRISPR gRNA sequence
agcttccaagagataaaata

SEQ ID NO: 649949 - DNA, 20 bp, Artificial
  CRISPR gRNA sequence
ccaagagataaaatatctgt

SEQ ID NO: 649950 - DNA, 20 bp, Artificial
  CRISPR gRNA sequence
caagagataaaatatctgtc

SEQ ID NO: 649951 - DNA, 20 bp, Artificial
  CRISPR gRNA sequence
tctaggggcctcacatttga

SEQ ID NO: 649952 - DNA, 20 bp, Artificial
  CRISPR gRNA sequence
ggggcctcacatttgacata

SEQ ID NO: 649953 - DNA, 20 bp, Artificial
  CRISPR gRNA sequence
acatttgacatatattaggt

SEQ ID NO: 649954 - DNA, 20 bp, Artificial
  CRISPR gRNA sequence
gacatatattaggtcccact

SEQ ID NO: 649955 - DNA, 20 bp, Artificial
  CRISPR gRNA sequence
acatatattaggtcccactt

SEQ ID NO: 649956 - DNA, 20 bp, Artificial
  CRISPR gRNA sequence
ggtcccacttctttatatac

SEQ ID NO: 649957 - DNA, 20 bp, Artificial
  CRISPR gRNA sequence
ctttatataccacagaggga

SEQ ID NO: 649958 - DNA, 20 bp, Artificial
  CRISPR gRNA sequence
tttatataccacagagggag

SEQ ID NO: 649959 - DNA, 20 bp, Artificial
  CRISPR gRNA sequence
tatataccacagagggagag

SEQ ID NO: 649960 - DNA, 20 bp, Artificial
  CRISPR gRNA sequence
atataccacagagggagaga

SEQ ID NO: 649961 - DNA, 20 bp, Artificial
  CRISPR gRNA sequence
tataccacagagggagagaa

SEQ ID NO: 649962 - DNA, 20 bp, Artificial
  CRISPR gRNA sequence
gctcaattctgtaattttta

SEQ ID NO: 649963 - DNA, 20 bp, Artificial
  CRISPR gRNA sequence
ctcaattctgtaatttttaa

SEQ ID NO: 649964 - DNA, 20 bp, Artificial
  CRISPR gRNA sequence
aattctgtaatttttaaaaa

SEQ ID NO: 649965 - DNA, 20 bp, Artificial
  CRISPR gRNA sequence
tgtaatttttaaaaacatgt

SEQ ID NO: 649966 - DNA, 20 bp, Artificial
  CRISPR gRNA sequence
taatttttaaaaacatgttt

SEQ ID NO: 649967 - DNA, 20 bp, Artificial
  CRISPR gRNA sequence
ttaaaaacatgtttactggc

SEQ ID NO: 649968 - DNA, 20 bp, Artificial
  CRISPR gRNA sequence
taaaaacatgtttactggcc

SEQ ID NO: 649969 - DNA, 20 bp, Artificial
  CRISPR gRNA sequence
aaaaacatgtttactggcca

SEQ ID NO: 649970 - DNA, 20 bp, Artificial
  CRISPR gRNA sequence
aaaacatgtttactggccag

SEQ ID NO: 649971 - DNA, 20 bp, Artificial
  CRISPR gRNA sequence
actggccaggcacggtggct

SEQ ID NO: 649972 - DNA, 20 bp, Artificial
  CRISPR gRNA sequence
ctggccaggcacggtggctc

SEQ ID NO: 649973 - DNA, 20 bp, Artificial
  CRISPR gRNA sequence
gccaggcacggtggctcacg

SEQ ID NO: 649974 - DNA, 20 bp, Artificial
  CRISPR gRNA sequence
acgcctgtgatcccagcact

SEQ ID NO: 649975 - DNA, 20 bp, Artificial
  CRISPR gRNA sequence
tgatcccagcactttgggag

SEQ ID NO: 649976 - DNA, 20 bp, Artificial
  CRISPR gRNA sequence
tgggaggctgaggtaggcag

SEQ ID NO: 649977 - DNA, 20 bp, Artificial
  CRISPR gRNA sequence
gggaggctgaggtaggcaga

SEQ ID NO: 649978 - DNA, 20 bp, Artificial
  CRISPR gRNA sequence
ggaggctgaggtaggcagat

SEQ ID NO: 649979 - DNA, 20 bp, Artificial
  CRISPR gRNA sequence
aggtaggcagattacttgag

SEQ ID NO: 649980 - DNA, 20 bp, Artificial
  CRISPR gRNA sequence
cttgaggtcagaagttcaag

SEQ ID NO: 649981 - DNA, 20 bp, Artificial
  CRISPR gRNA sequence
gaggtcagaagttcaagact

SEQ ID NO: 649982 - DNA, 20 bp, Artificial
  CRISPR gRNA sequence
aggtcagaagttcaagacta

SEQ ID NO: 649983 - DNA, 20 bp, Artificial
  CRISPR gRNA sequence
aagactagcctgaccaacat

SEQ ID NO: 649984 - DNA, 20 bp, Artificial
  CRISPR gRNA sequence
gcctgaccaacatggtaaaa

SEQ ID NO: 649985 - DNA, 20 bp, Artificial
  CRISPR gRNA sequence
accaacatggtaaaacccag

SEQ ID NO: 649986 - DNA, 20 bp, Artificial
  CRISPR gRNA sequence
tactaaaaatacaaaaattt

SEQ ID NO: 649987 - DNA, 20 bp, Artificial
  CRISPR gRNA sequence
ctaaaaatacaaaaatttgc

SEQ ID NO: 649988 - DNA, 20 bp, Artificial
  CRISPR gRNA sequence
aaaatacaaaaatttgctag

SEQ ID NO: 649989 - DNA, 20 bp, Artificial
  CRISPR gRNA sequence
gctaggcatggtggcaggta

SEQ ID NO: 649990 - DNA, 20 bp, Artificial
  CRISPR gRNA sequence
ctaggcatggtggcaggtac

SEQ ID NO: 649991 - DNA, 20 bp, Artificial
  CRISPR gRNA sequence
ggcatggtggcaggtacctg

SEQ ID NO: 649992 - DNA, 20 bp, Artificial
  CRISPR gRNA sequence
taatctcagcttctcgggag

SEQ ID NO: 649993 - DNA, 20 bp, Artificial
  CRISPR gRNA sequence
agcttctcgggaggcgaagg

SEQ ID NO: 649994 - DNA, 20 bp, Artificial
  CRISPR gRNA sequence
ctcgggaggcgaaggttgca

SEQ ID NO: 649995 - DNA, 20 bp, Artificial
  CRISPR gRNA sequence
tcgggaggcgaaggttgcag

SEQ ID NO: 649996 - DNA, 20 bp, Artificial
  CRISPR gRNA sequence
gggaggcgaaggttgcagtg

SEQ ID NO: 649997 - DNA, 20 bp, Artificial
  CRISPR gRNA sequence
cagtggagccgagatcgcac

SEQ ID NO: 649998 - DNA, 20 bp, Artificial
  CRISPR gRNA sequence
tagcctgggcgacaaagata

SEQ ID NO: 649999 - DNA, 20 bp, Artificial
  CRISPR gRNA sequence
gcctgggcgacaaagataga

SEQ ID NO: 650000 - DNA, 20 bp, Artificial
  CRISPR gRNA sequence
ggcgacaaagatagactccg

SEQ ID NO: 650001 - DNA, 20 bp, Artificial
  CRISPR gRNA sequence
cgtctcgaaaaaataaataa

SEQ ID NO: 650002 - DNA, 20 bp, Artificial
  CRISPR gRNA sequence
gaaaaaataaataaataaat

SEQ ID NO: 650003 - DNA, 20 bp, Artificial
  CRISPR gRNA sequence
actattttccagtaatgcta

SEQ ID NO: 650004 - DNA, 20 bp, Artificial
  CRISPR gRNA sequence
ttttccagtaatgctaagta

SEQ ID NO: 650005 - DNA, 20 bp, Artificial
  CRISPR gRNA sequence
tccagtaatgctaagtacta

SEQ ID NO: 650006 - DNA, 20 bp, Artificial
  CRISPR gRNA sequence
ccagtaatgctaagtactat

SEQ ID NO: 650007 - DNA, 20 bp, Artificial
  CRISPR gRNA sequence
cagtaatgctaagtactatc

SEQ ID NO: 650008 - DNA, 20 bp, Artificial
  CRISPR gRNA sequence
agtactatcaaaaagagtag

SEQ ID NO: 650009 - DNA, 20 bp, Artificial
  CRISPR gRNA sequence
tcaaaaagagtagattactc

SEQ ID NO: 650010 - DNA, 20 bp, Artificial
  CRISPR gRNA sequence
ctctgacactggttgcataa

SEQ ID NO: 650011 - DNA, 20 bp, Artificial
  CRISPR gRNA sequence
tgacactggttgcataaata

SEQ ID NO: 650012 - DNA, 20 bp, Artificial
  CRISPR gRNA sequence
acactggttgcataaatatt

SEQ ID NO: 650013 - DNA, 20 bp, Artificial
  CRISPR gRNA sequence
gttgcataaatattaagctc

SEQ ID NO: 650014 - DNA, 20 bp, Artificial
  CRISPR gRNA sequence
cataaatattaagctcaagt

SEQ ID NO: 650015 - DNA, 20 bp, Artificial
  CRISPR gRNA sequence
agctcaagttttgatcagca

SEQ ID NO: 650016 - DNA, 20 bp, Artificial
  CRISPR gRNA sequence
aagttttgatcagcacattc

SEQ ID NO: 650017 - DNA, 20 bp, Artificial
  CRISPR gRNA sequence
tgatcagcacattctatgct

SEQ ID NO: 650018 - DNA, 20 bp, Artificial
  CRISPR gRNA sequence
gatcagcacattctatgcta

SEQ ID NO: 650019 - DNA, 20 bp, Artificial
  CRISPR gRNA sequence
atcagcacattctatgctag

SEQ ID NO: 650020 - DNA, 20 bp, Artificial
  CRISPR gRNA sequence
tatgctagatgtaaaagcat

SEQ ID NO: 650021 - DNA, 20 bp, Artificial
  CRISPR gRNA sequence
tgctagatgtaaaagcattt

SEQ ID NO: 650022 - DNA, 20 bp, Artificial
  CRISPR gRNA sequence
gatgtaaaagcattttgaaa

SEQ ID NO: 650023 - DNA, 20 bp, Artificial
  CRISPR gRNA sequence
tgaaaaaagtaccttacaaa

SEQ ID NO: 650024 - DNA, 20 bp, Artificial
  CRISPR gRNA sequence
gaaaaaagtaccttacaaat

SEQ ID NO: 650025 - DNA, 20 bp, Artificial
  CRISPR gRNA sequence
aaaaaagtaccttacaaata

SEQ ID NO: 650026 - DNA, 20 bp, Artificial
  CRISPR gRNA sequence
acaaataaaatggtattctt

SEQ ID NO: 650027 - DNA, 20 bp, Artificial
  CRISPR gRNA sequence
caaataaaatggtattctta

SEQ ID NO: 650028 - DNA, 20 bp, Artificial
  CRISPR gRNA sequence
ttagtagacttaaaatttgt

SEQ ID NO: 650029 - DNA, 20 bp, Artificial
  CRISPR gRNA sequence
agtagacttaaaatttgttt

SEQ ID NO: 650030 - DNA, 20 bp, Artificial
  CRISPR gRNA sequence
gtagacttaaaatttgtttt

SEQ ID NO: 650031 - DNA, 20 bp, Artificial
  CRISPR gRNA sequence
aaaatttgtttttttaagca

SEQ ID NO: 650032 - DNA, 20 bp, Artificial
  CRISPR gRNA sequence
aaatttgtttttttaagcaa

SEQ ID NO: 650033 - DNA, 20 bp, Artificial
  CRISPR gRNA sequence
gtttttttaagcaagttaaa

SEQ ID NO: 650034 - DNA, 20 bp, Artificial
  CRISPR gRNA sequence
tttttttaagcaagttaaac

SEQ ID NO: 650035 - DNA, 20 bp, Artificial
  CRISPR gRNA sequence
ttttaagcaagttaaacata

SEQ ID NO: 650036 - DNA, 20 bp, Artificial
  CRISPR gRNA sequence
tttaagcaagttaaacatat

SEQ ID NO: 650037 - DNA, 20 bp, Artificial
  CRISPR gRNA sequence
ttaagcaagttaaacatata

SEQ ID NO: 650038 - DNA, 20 bp, Artificial
  CRISPR gRNA sequence
taagcaagttaaacatatac

SEQ ID NO: 650039 - DNA, 20 bp, Artificial
  CRISPR gRNA sequence
aagcaagttaaacatatacc

SEQ ID NO: 650040 - DNA, 20 bp, Artificial
  CRISPR gRNA sequence
agcaagttaaacatataccc

SEQ ID NO: 650041 - DNA, 20 bp, Artificial
  CRISPR gRNA sequence
aacatataccctgatctttt

SEQ ID NO: 650042 - DNA, 20 bp, Artificial
  CRISPR gRNA sequence
atctttttattattgttatt

SEQ ID NO: 650043 - DNA, 20 bp, Artificial
  CRISPR gRNA sequence
tttattattgttatttatgg

SEQ ID NO: 650044 - DNA, 20 bp, Artificial
  CRISPR gRNA sequence
ttattattgttatttatggg

SEQ ID NO: 650045 - DNA, 20 bp, Artificial
  CRISPR gRNA sequence
tattattgttatttatgggc

SEQ ID NO: 650046 - DNA, 20 bp, Artificial
  CRISPR gRNA sequence
attattgttatttatgggct

SEQ ID NO: 650047 - DNA, 20 bp, Artificial
  CRISPR gRNA sequence
ttattgttatttatgggctt

SEQ ID NO: 650048 - DNA, 20 bp, Artificial
  CRISPR gRNA sequence
ttgttatttatgggcttagt

SEQ ID NO: 650049 - DNA, 20 bp, Artificial
  CRISPR gRNA sequence
ttatttatgggcttagtaaa

SEQ ID NO: 650050 - DNA, 20 bp, Artificial
  CRISPR gRNA sequence
tttatgggcttagtaaacct

SEQ ID NO: 650051 - DNA, 20 bp, Artificial
  CRISPR gRNA sequence
atgggcttagtaaacctttt

SEQ ID NO: 650052 - DNA, 20 bp, Artificial
  CRISPR gRNA sequence
tgggcttagtaaaccttttc

SEQ ID NO: 650053 - DNA, 20 bp, Artificial
  CRISPR gRNA sequence
agtaaaccttttcttcaaca

SEQ ID NO: 650054 - DNA, 20 bp, Artificial
  CRISPR gRNA sequence
gtaaaccttttcttcaacaa

SEQ ID NO: 650055 - DNA, 20 bp, Artificial
  CRISPR gRNA sequence
ttcttcaacaatgatacaca

SEQ ID NO: 650056 - DNA, 20 bp, Artificial
  CRISPR gRNA sequence
tcttcaacaatgatacacat

SEQ ID NO: 650057 - DNA, 20 bp, Artificial
  CRISPR gRNA sequence
cttcaacaatgatacacatg

SEQ ID NO: 650058 - DNA, 20 bp, Artificial
  CRISPR gRNA sequence
ttcaacaatgatacacatgt

SEQ ID NO: 650059 - DNA, 20 bp, Artificial
  CRISPR gRNA sequence
caacaatgatacacatgtaa

SEQ ID NO: 650060 - DNA, 20 bp, Artificial
  CRISPR gRNA sequence
aacaatgatacacatgtaaa

SEQ ID NO: 650061 - DNA, 20 bp, Artificial
  CRISPR gRNA sequence
atctcacaactgataaattt

SEQ ID NO: 650062 - DNA, 20 bp, Artificial
  CRISPR gRNA sequence
tctcacaactgataaatttt

SEQ ID NO: 650063 - DNA, 20 bp, Artificial
  CRISPR gRNA sequence
acaactgataaatttttact

SEQ ID NO: 650064 - DNA, 20 bp, Artificial
  CRISPR gRNA sequence
ataaatttttactacagtat

SEQ ID NO: 650065 - DNA, 20 bp, Artificial
  CRISPR gRNA sequence
ttactacagtattaaagcag

SEQ ID NO: 650066 - DNA, 20 bp, Artificial
  CRISPR gRNA sequence
tactacagtattaaagcaga

SEQ ID NO: 650067 - DNA, 20 bp, Artificial
  CRISPR gRNA sequence
actacagtattaaagcagat

SEQ ID NO: 650068 - DNA, 20 bp, Artificial
  CRISPR gRNA sequence
ctacagtattaaagcagatt

SEQ ID NO: 650069 - DNA, 20 bp, Artificial
  CRISPR gRNA sequence
cagtattaaagcagattaat

SEQ ID NO: 650070 - DNA, 20 bp, Artificial
  CRISPR gRNA sequence
aagcagattaattttttaaa

SEQ ID NO: 650071 - DNA, 20 bp, Artificial
  CRISPR gRNA sequence
attttttaaaaatgtctcaa

SEQ ID NO: 650072 - DNA, 20 bp, Artificial
  CRISPR gRNA sequence
tttaaaaatgtctcaatggg

SEQ ID NO: 650073 - DNA, 20 bp, Artificial
  CRISPR gRNA sequence
ttaaaaatgtctcaatgggt

SEQ ID NO: 650074 - DNA, 20 bp, Artificial
  CRISPR gRNA sequence
taaaaatgtctcaatgggta

SEQ ID NO: 650075 - DNA, 20 bp, Artificial
  CRISPR gRNA sequence
aaaaatgtctcaatgggtaa

SEQ ID NO: 650076 - DNA, 20 bp, Artificial
  CRISPR gRNA sequence
aaaatgtctcaatgggtaaa

SEQ ID NO: 650077 - DNA, 20 bp, Artificial
  CRISPR gRNA sequence
aatgggtaaaagccaacctg

SEQ ID NO: 650078 - DNA, 20 bp, Artificial
  CRISPR gRNA sequence
agccttctaaataacagagt

SEQ ID NO: 650079 - DNA, 20 bp, Artificial
  CRISPR gRNA sequence
ctaaataacagagtatgatc

SEQ ID NO: 650080 - DNA, 20 bp, Artificial
  CRISPR gRNA sequence
taaataacagagtatgatct

SEQ ID NO: 650081 - DNA, 20 bp, Artificial
  CRISPR gRNA sequence
aataacagagtatgatctca

SEQ ID NO: 650082 - DNA, 20 bp, Artificial
  CRISPR gRNA sequence
aagaaagtcttctggaaccc

SEQ ID NO: 650083 - DNA, 20 bp, Artificial
  CRISPR gRNA sequence
ctggaaccctcagtgcctgt

SEQ ID NO: 650084 - DNA, 20 bp, Artificial
  CRISPR gRNA sequence
tggaaccctcagtgcctgtg

SEQ ID NO: 650085 - DNA, 20 bp, Artificial
  CRISPR gRNA sequence
gaaccctcagtgcctgtgtc

SEQ ID NO: 650086 - DNA, 20 bp, Artificial
  CRISPR gRNA sequence
agtgcctgtgtcttagacac

SEQ ID NO: 650087 - DNA, 20 bp, Artificial
  CRISPR gRNA sequence
tgtcttagacacttcgagag

SEQ ID NO: 650088 - DNA, 20 bp, Artificial
  CRISPR gRNA sequence
agacacttcgagaggaaaat

SEQ ID NO: 650089 - DNA, 20 bp, Artificial
  CRISPR gRNA sequence
gacacttcgagaggaaaatg

SEQ ID NO: 650090 - DNA, 20 bp, Artificial
  CRISPR gRNA sequence
cgagaggaaaatggaaaaac

SEQ ID NO: 650091 - DNA, 20 bp, Artificial
  CRISPR gRNA sequence
gagaggaaaatggaaaaacc

SEQ ID NO: 650092 - DNA, 20 bp, Artificial
  CRISPR gRNA sequence
gatgcaaaacctcatctcat

SEQ ID NO: 650093 - DNA, 20 bp, Artificial
  CRISPR gRNA sequence
atctcatctgctcaatatca

SEQ ID NO: 650094 - DNA, 20 bp, Artificial
  CRISPR gRNA sequence
atctgctcaatatcaagttc

SEQ ID NO: 650095 - DNA, 20 bp, Artificial
  CRISPR gRNA sequence
ctcaatatcaagttccttct

SEQ ID NO: 650096 - DNA, 20 bp, Artificial
  CRISPR gRNA sequence
aatatcaagttccttcttca

SEQ ID NO: 650097 - DNA, 20 bp, Artificial
  CRISPR gRNA sequence
cttcttcattgccatctccc

SEQ ID NO: 650098 - DNA, 20 bp, Artificial
  CRISPR gRNA sequence
cttcattgccatctcccaag

SEQ ID NO: 650099 - DNA, 20 bp, Artificial
  CRISPR gRNA sequence
ttcattgccatctcccaaga

SEQ ID NO: 650100 - DNA, 20 bp, Artificial
  CRISPR gRNA sequence
cattgccatctcccaagagg

SEQ ID NO: 650101 - DNA, 20 bp, Artificial
  CRISPR gRNA sequence
attgccatctcccaagaggg

SEQ ID NO: 650102 - DNA, 20 bp, Artificial
  CRISPR gRNA sequence
ccatctcccaagagggggaa

SEQ ID NO: 650103 - DNA, 20 bp, Artificial
  CRISPR gRNA sequence
ccaagagggggaaaaaaagc

SEQ ID NO: 650104 - DNA, 20 bp, Artificial
  CRISPR gRNA sequence
tttctggcagccttacagtc

SEQ ID NO: 650105 - DNA, 20 bp, Artificial
  CRISPR gRNA sequence
tctggcagccttacagtctc

SEQ ID NO: 650106 - DNA, 20 bp, Artificial
  CRISPR gRNA sequence
ctggcagccttacagtctcc

SEQ ID NO: 650107 - DNA, 20 bp, Artificial
  CRISPR gRNA sequence
tggcagccttacagtctccc

SEQ ID NO: 650108 - DNA, 20 bp, Artificial
  CRISPR gRNA sequence
gcagccttacagtctcccta

SEQ ID NO: 650109 - DNA, 20 bp, Artificial
  CRISPR gRNA sequence
acagtctccctaaccccctt

SEQ ID NO: 650110 - DNA, 20 bp, Artificial
  CRISPR gRNA sequence
cagtctccctaacccccttc

SEQ ID NO: 650111 - DNA, 20 bp, Artificial
  CRISPR gRNA sequence
cctaacccccttccaatctc

SEQ ID NO: 650112 - DNA, 20 bp, Artificial
  CRISPR gRNA sequence
acccccttccaatctccttt

SEQ ID NO: 650113 - DNA, 20 bp, Artificial
  CRISPR gRNA sequence
ccaatctcctttcccactaa

SEQ ID NO: 650114 - DNA, 20 bp, Artificial
  CRISPR gRNA sequence
caatctcctttcccactaaa

SEQ ID NO: 650115 - DNA, 20 bp, Artificial
  CRISPR gRNA sequence
ctttcccactaaactaaagt

SEQ ID NO: 650116 - DNA, 20 bp, Artificial
  CRISPR gRNA sequence
tcccactaaactaaagtaaa

SEQ ID NO: 650117 - DNA, 20 bp, Artificial
  CRISPR gRNA sequence
cccactaaactaaagtaaaa

SEQ ID NO: 650118 - DNA, 20 bp, Artificial
  CRISPR gRNA sequence
ccactaaactaaagtaaaaa

SEQ ID NO: 650119 - DNA, 20 bp, Artificial
  CRISPR gRNA sequence
aactaaagtaaaaagacaac

SEQ ID NO: 650120 - DNA, 20 bp, Artificial
  CRISPR gRNA sequence
aagtaaaaagacaactgagg

SEQ ID NO: 650121 - DNA, 20 bp, Artificial
  CRISPR gRNA sequence
aggggcaagatcaaagttta

SEQ ID NO: 650122 - DNA, 20 bp, Artificial
  CRISPR gRNA sequence
accgcatccacgataattta

SEQ ID NO: 650123 - DNA, 20 bp, Artificial
  CRISPR gRNA sequence
ccgcatccacgataatttag

SEQ ID NO: 650124 - DNA, 20 bp, Artificial
  CRISPR gRNA sequence
aggaatacgaccagttagga

SEQ ID NO: 650125 - DNA, 20 bp, Artificial
  CRISPR gRNA sequence
ggaatacgaccagttaggat

SEQ ID NO: 650126 - DNA, 20 bp, Artificial
  CRISPR gRNA sequence
ggatatctcttacacacaca

SEQ ID NO: 650127 - DNA, 20 bp, Artificial
  CRISPR gRNA sequence
ttacacacacagtatagtac

SEQ ID NO: 650128 - DNA, 20 bp, Artificial
  CRISPR gRNA sequence
acacacacagtatagtacac

SEQ ID NO: 650129 - DNA, 20 bp, Artificial
  CRISPR gRNA sequence
cacacacagtatagtacaca

SEQ ID NO: 650130 - DNA, 20 bp, Artificial
  CRISPR gRNA sequence
ttgcaaaagataaaagcaat

SEQ ID NO: 650131 - DNA, 20 bp, Artificial
  CRISPR gRNA sequence
tgcaaaagataaaagcaata

SEQ ID NO: 650132 - DNA, 20 bp, Artificial
  CRISPR gRNA sequence
gcaaaagataaaagcaatag

SEQ ID NO: 650133 - DNA, 20 bp, Artificial
  CRISPR gRNA sequence
caaaagataaaagcaataga

SEQ ID NO: 650134 - DNA, 20 bp, Artificial
  CRISPR gRNA sequence
gtccaagatggccactgata

SEQ ID NO: 650135 - DNA, 20 bp, Artificial
  CRISPR gRNA sequence
ataatagcactggtttataa

SEQ ID NO: 650136 - DNA, 20 bp, Artificial
  CRISPR gRNA sequence
gtttataactaatataactt

SEQ ID NO: 650137 - DNA, 20 bp, Artificial
  CRISPR gRNA sequence
ataactaatataacttaata

SEQ ID NO: 650138 - DNA, 20 bp, Artificial
  CRISPR gRNA sequence
taactaatataacttaataa

SEQ ID NO: 650139 - DNA, 20 bp, Artificial
  CRISPR gRNA sequence
atataacttaataactaggc

SEQ ID NO: 650140 - DNA, 20 bp, Artificial
  CRISPR gRNA sequence
aataactaggcaccactaac

SEQ ID NO: 650141 - DNA, 20 bp, Artificial
  CRISPR gRNA sequence
ataactaggcaccactaact

SEQ ID NO: 650142 - DNA, 20 bp, Artificial
  CRISPR gRNA sequence
ggcaccactaacttttatcc

SEQ ID NO: 650143 - DNA, 20 bp, Artificial
  CRISPR gRNA sequence
acttttatcctgctttaatt

SEQ ID NO: 650144 - DNA, 20 bp, Artificial
  CRISPR gRNA sequence
ttatcctgctttaattggct

SEQ ID NO: 650145 - DNA, 20 bp, Artificial
  CRISPR gRNA sequence
tatcctgctttaattggcta

SEQ ID NO: 650146 - DNA, 20 bp, Artificial
  CRISPR gRNA sequence
atcctgctttaattggctaa

SEQ ID NO: 650147 - DNA, 20 bp, Artificial
  CRISPR gRNA sequence
tcctgctttaattggctaat

SEQ ID NO: 650148 - DNA, 20 bp, Artificial
  CRISPR gRNA sequence
ctttaattggctaattgttc

SEQ ID NO: 650149 - DNA, 20 bp, Artificial
  CRISPR gRNA sequence
taattggctaattgttctag

SEQ ID NO: 650150 - DNA, 20 bp, Artificial
  CRISPR gRNA sequence
aattggctaattgttctaga

SEQ ID NO: 650151 - DNA, 20 bp, Artificial
  CRISPR gRNA sequence
attggctaattgttctagaa

SEQ ID NO: 650152 - DNA, 20 bp, Artificial
  CRISPR gRNA sequence
gctaattgttctagaatcaa

SEQ ID NO: 650153 - DNA, 20 bp, Artificial
  CRISPR gRNA sequence
attgttctagaatcaatccc

SEQ ID NO: 650154 - DNA, 20 bp, Artificial
  CRISPR gRNA sequence
ttctagaatcaatcccttag

SEQ ID NO: 650155 - DNA, 20 bp, Artificial
  CRISPR gRNA sequence
tagaatcaatcccttaggac

SEQ ID NO: 650156 - DNA, 20 bp, Artificial
  CRISPR gRNA sequence
gaatcaatcccttaggaccc

SEQ ID NO: 650157 - DNA, 20 bp, Artificial
  CRISPR gRNA sequence
aggacccagttcttttaacc

SEQ ID NO: 650158 - DNA, 20 bp, Artificial
  CRISPR gRNA sequence
ggacccagttcttttaacca

SEQ ID NO: 650159 - DNA, 20 bp, Artificial
  CRISPR gRNA sequence
ttttaaccaatctaccccca

SEQ ID NO: 650160 - DNA, 20 bp, Artificial
  CRISPR gRNA sequence
ttaaccaatctacccccatc

SEQ ID NO: 650161 - DNA, 20 bp, Artificial
  CRISPR gRNA sequence
taaccaatctacccccatct

SEQ ID NO: 650162 - DNA, 20 bp, Artificial
  CRISPR gRNA sequence
aaccaatctacccccatctc

SEQ ID NO: 650163 - DNA, 20 bp, Artificial
  CRISPR gRNA sequence
accaatctacccccatctcc

SEQ ID NO: 650164 - DNA, 20 bp, Artificial
  CRISPR gRNA sequence
cccccatctcctactccctg

SEQ ID NO: 650165 - DNA, 20 bp, Artificial
  CRISPR gRNA sequence
ctactccctggctttcaaat

SEQ ID NO: 650166 - DNA, 20 bp, Artificial
  CRISPR gRNA sequence
ctccctggctttcaaatatc

SEQ ID NO: 650167 - DNA, 20 bp, Artificial
  CRISPR gRNA sequence
cctggctttcaaatatctga

SEQ ID NO: 650168 - DNA, 20 bp, Artificial
  CRISPR gRNA sequence
gctttcaaatatctgaagaa

SEQ ID NO: 650169 - DNA, 20 bp, Artificial
  CRISPR gRNA sequence
tcaaatatctgaagaagtat

SEQ ID NO: 650170 - DNA, 20 bp, Artificial
  CRISPR gRNA sequence
caaatatctgaagaagtatg

SEQ ID NO: 650171 - DNA, 20 bp, Artificial
  CRISPR gRNA sequence
aaatatctgaagaagtatgc

SEQ ID NO: 650172 - DNA, 20 bp, Artificial
  CRISPR gRNA sequence
aagaagtatgcttctttctc

SEQ ID NO: 650173 - DNA, 20 bp, Artificial
  CRISPR gRNA sequence
ctttctcccgaatctaaatg

SEQ ID NO: 650174 - DNA, 20 bp, Artificial
  CRISPR gRNA sequence
tttctcccgaatctaaatgc

SEQ ID NO: 650175 - DNA, 20 bp, Artificial
  CRISPR gRNA sequence
tctcccgaatctaaatgctt

SEQ ID NO: 650176 - DNA, 20 bp, Artificial
  CRISPR gRNA sequence
ctcccgaatctaaatgctta

SEQ ID NO: 650177 - DNA, 20 bp, Artificial
  CRISPR gRNA sequence
tcccgaatctaaatgcttat

SEQ ID NO: 650178 - DNA, 20 bp, Artificial
  CRISPR gRNA sequence
ccgaatctaaatgcttattc

SEQ ID NO: 650179 - DNA, 20 bp, Artificial
  CRISPR gRNA sequence
aatgcttattcatttagctt

SEQ ID NO: 650180 - DNA, 20 bp, Artificial
  CRISPR gRNA sequence
attcatttagcttctaccag

SEQ ID NO: 650181 - DNA, 20 bp, Artificial
  CRISPR gRNA sequence
ttcatttagcttctaccaga

SEQ ID NO: 650182 - DNA, 20 bp, Artificial
  CRISPR gRNA sequence
atttagcttctaccagaaac

SEQ ID NO: 650183 - DNA, 20 bp, Artificial
  CRISPR gRNA sequence
agcttctaccagaaaccatt

SEQ ID NO: 650184 - DNA, 20 bp, Artificial
  CRISPR gRNA sequence
gcttctaccagaaaccattc

SEQ ID NO: 650185 - DNA, 20 bp, Artificial
  CRISPR gRNA sequence
ctaccagaaaccattctaat

SEQ ID NO: 650186 - DNA, 20 bp, Artificial
  CRISPR gRNA sequence
taccagaaaccattctaatc

SEQ ID NO: 650187 - DNA, 20 bp, Artificial
  CRISPR gRNA sequence
ccagaaaccattctaatctt

SEQ ID NO: 650188 - DNA, 20 bp, Artificial
  CRISPR gRNA sequence
taatcttattgccacattcc

SEQ ID NO: 650189 - DNA, 20 bp, Artificial
  CRISPR gRNA sequence
atcttattgccacattcctc

SEQ ID NO: 650190 - DNA, 20 bp, Artificial
  CRISPR gRNA sequence
attgccacattcctcatcac

SEQ ID NO: 650191 - DNA, 20 bp, Artificial
  CRISPR gRNA sequence
ttgccacattcctcatcact

SEQ ID NO: 650192 - DNA, 20 bp, Artificial
  CRISPR gRNA sequence
ccacattcctcatcacttaa

SEQ ID NO: 650193 - DNA, 20 bp, Artificial
  CRISPR gRNA sequence
ctcatcacttaagcaggcag

SEQ ID NO: 650194 - DNA, 20 bp, Artificial
  CRISPR gRNA sequence
atcacttaagcaggcagctt

SEQ ID NO: 650195 - DNA, 20 bp, Artificial
  CRISPR gRNA sequence
aagcaggcagcttccttgat

SEQ ID NO: 650196 - DNA, 20 bp, Artificial
  CRISPR gRNA sequence
agcaggcagcttccttgatt

SEQ ID NO: 650197 - DNA, 20 bp, Artificial
  CRISPR gRNA sequence
ccttgattcacttataaatt

SEQ ID NO: 650198 - DNA, 20 bp, Artificial
  CRISPR gRNA sequence
cttgattcacttataaattc

SEQ ID NO: 650199 - DNA, 20 bp, Artificial
  CRISPR gRNA sequence
gattcacttataaattctga

SEQ ID NO: 650200 - DNA, 20 bp, Artificial
  CRISPR gRNA sequence
attcacttataaattctgat

SEQ ID NO: 650201 - DNA, 20 bp, Artificial
  CRISPR gRNA sequence
acttataaattctgatttct

SEQ ID NO: 650202 - DNA, 20 bp, Artificial
  CRISPR gRNA sequence
ataaattctgatttctcttt

SEQ ID NO: 650203 - DNA, 20 bp, Artificial
  CRISPR gRNA sequence
taaattctgatttctcttta

SEQ ID NO: 650204 - DNA, 20 bp, Artificial
  CRISPR gRNA sequence
tgatttctctttatttattt

SEQ ID NO: 650205 - DNA, 20 bp, Artificial
  CRISPR gRNA sequence
atttctctttatttattttt

SEQ ID NO: 650206 - DNA, 20 bp, Artificial
  CRISPR gRNA sequence
ctctttatttatttttttgt

SEQ ID NO: 650207 - DNA, 20 bp, Artificial
  CRISPR gRNA sequence
tctttatttatttttttgtg

SEQ ID NO: 650208 - DNA, 20 bp, Artificial
  CRISPR gRNA sequence
tttatttatttttttgtgaa

SEQ ID NO: 650209 - DNA, 20 bp, Artificial
  CRISPR gRNA sequence
tatttatttttttgtgaaga

SEQ ID NO: 650210 - DNA, 20 bp, Artificial
  CRISPR gRNA sequence
atttatttttttgtgaagaa

SEQ ID NO: 650211 - DNA, 20 bp, Artificial
  CRISPR gRNA sequence
tttatttttttgtgaagaaa

SEQ ID NO: 650212 - DNA, 20 bp, Artificial
  CRISPR gRNA sequence
atttttttgtgaagaaagaa

SEQ ID NO: 650213 - DNA, 20 bp, Artificial
  CRISPR gRNA sequence
tttttttgtgaagaaagaaa

SEQ ID NO: 650214 - DNA, 20 bp, Artificial
  CRISPR gRNA sequence
ttttgtgaagaaagaaaaag

SEQ ID NO: 650215 - DNA, 20 bp, Artificial
  CRISPR gRNA sequence
tttgtgaagaaagaaaaagg

SEQ ID NO: 650216 - DNA, 20 bp, Artificial
  CRISPR gRNA sequence
ttgtgaagaaagaaaaaggg

SEQ ID NO: 650217 - DNA, 20 bp, Artificial
  CRISPR gRNA sequence
tgtgaagaaagaaaaagggg

SEQ ID NO: 650218 - DNA, 20 bp, Artificial
  CRISPR gRNA sequence
gtgaagaaagaaaaagggga

SEQ ID NO: 650219 - DNA, 20 bp, Artificial
  CRISPR gRNA sequence
tgaagaaagaaaaaggggag

SEQ ID NO: 650220 - DNA, 20 bp, Artificial
  CRISPR gRNA sequence
tttttcatttgctctattgc

SEQ ID NO: 650221 - DNA, 20 bp, Artificial
  CRISPR gRNA sequence
ttcatttgctctattgctct

SEQ ID NO: 650222 - DNA, 20 bp, Artificial
  CRISPR gRNA sequence
tcatttgctctattgctctc

SEQ ID NO: 650223 - DNA, 20 bp, Artificial
  CRISPR gRNA sequence
catttgctctattgctctct

SEQ ID NO: 650224 - DNA, 20 bp, Artificial
  CRISPR gRNA sequence
atttgctctattgctctctc

SEQ ID NO: 650225 - DNA, 20 bp, Artificial
  CRISPR gRNA sequence
gctctattgctctctccagt

SEQ ID NO: 650226 - DNA, 20 bp, Artificial
  CRISPR gRNA sequence
ctctattgctctctccagtg

SEQ ID NO: 650227 - DNA, 20 bp, Artificial
  CRISPR gRNA sequence
tattgctctctccagtggat

SEQ ID NO: 650228 - DNA, 20 bp, Artificial
  CRISPR gRNA sequence
ttgctctctccagtggatct

SEQ ID NO: 650229 - DNA, 20 bp, Artificial
  CRISPR gRNA sequence
ctctctccagtggatctact

SEQ ID NO: 650230 - DNA, 20 bp, Artificial
  CRISPR gRNA sequence
tctccagtggatctactaac

SEQ ID NO: 650231 - DNA, 20 bp, Artificial
  CRISPR gRNA sequence
tccagtggatctactaactc

SEQ ID NO: 650232 - DNA, 20 bp, Artificial
  CRISPR gRNA sequence
cagtggatctactaactcaa

SEQ ID NO: 650233 - DNA, 20 bp, Artificial
  CRISPR gRNA sequence
ctaactcaagtggagtctgt

SEQ ID NO: 650234 - DNA, 20 bp, Artificial
  CRISPR gRNA sequence
actcaagtggagtctgtggc

SEQ ID NO: 650235 - DNA, 20 bp, Artificial
  CRISPR gRNA sequence
aagtggagtctgtggcttgt

SEQ ID NO: 650236 - DNA, 20 bp, Artificial
  CRISPR gRNA sequence
tggcttgtcctccacttctg

SEQ ID NO: 650237 - DNA, 20 bp, Artificial
  CRISPR gRNA sequence
gtcctccacttctgaatctg

SEQ ID NO: 650238 - DNA, 20 bp, Artificial
  CRISPR gRNA sequence
tcctccacttctgaatctgt

SEQ ID NO: 650239 - DNA, 20 bp, Artificial
  CRISPR gRNA sequence
cacttctgaatctgttattt

SEQ ID NO: 650240 - DNA, 20 bp, Artificial
  CRISPR gRNA sequence
ctgaatctgttatttttatt

SEQ ID NO: 650241 - DNA, 20 bp, Artificial
  CRISPR gRNA sequence
tgaatctgttatttttattc

SEQ ID NO: 650242 - DNA, 20 bp, Artificial
  CRISPR gRNA sequence
aatctgttatttttattctt

SEQ ID NO: 650243 - DNA, 20 bp, Artificial
  CRISPR gRNA sequence
ttatttttattctttctttc

SEQ ID NO: 650244 - DNA, 20 bp, Artificial
  CRISPR gRNA sequence
tttttattctttctttcttc

SEQ ID NO: 650245 - DNA, 20 bp, Artificial
  CRISPR gRNA sequence
ttattctttctttcttcttg

SEQ ID NO: 650246 - DNA, 20 bp, Artificial
  CRISPR gRNA sequence
tattctttctttcttcttgc

SEQ ID NO: 650247 - DNA, 20 bp, Artificial
  CRISPR gRNA sequence
attctttctttcttcttgcc

SEQ ID NO: 650248 - DNA, 20 bp, Artificial
  CRISPR gRNA sequence
ttctttctttcttcttgcca

SEQ ID NO: 650249 - DNA, 20 bp, Artificial
  CRISPR gRNA sequence
tttctttcttcttgccagct

SEQ ID NO: 650250 - DNA, 20 bp, Artificial
  CRISPR gRNA sequence
tctttcttcttgccagcttt

SEQ ID NO: 650251 - DNA, 20 bp, Artificial
  CRISPR gRNA sequence
ctttcttcttgccagctttc

SEQ ID NO: 650252 - DNA, 20 bp, Artificial
  CRISPR gRNA sequence
tttcttcttgccagctttct

SEQ ID NO: 650253 - DNA, 20 bp, Artificial
  CRISPR gRNA sequence
tcttcttgccagctttcttc

SEQ ID NO: 650254 - DNA, 20 bp, Artificial
  CRISPR gRNA sequence
cttcttgccagctttcttct

SEQ ID NO: 650255 - DNA, 20 bp, Artificial
  CRISPR gRNA sequence
ttcttgccagctttcttcta

SEQ ID NO: 650256 - DNA, 20 bp, Artificial
  CRISPR gRNA sequence
cttgccagctttcttctatg

SEQ ID NO: 650257 - DNA, 20 bp, Artificial
  CRISPR gRNA sequence
ttgccagctttcttctatgc

SEQ ID NO: 650258 - DNA, 20 bp, Artificial
  CRISPR gRNA sequence
gccagctttcttctatgctc

SEQ ID NO: 650259 - DNA, 20 bp, Artificial
  CRISPR gRNA sequence
ccagctttcttctatgctct

SEQ ID NO: 650260 - DNA, 20 bp, Artificial
  CRISPR gRNA sequence
tcttctatgctctctatact

SEQ ID NO: 650261 - DNA, 20 bp, Artificial
  CRISPR gRNA sequence
cttctatgctctctatactt

SEQ ID NO: 650262 - DNA, 20 bp, Artificial
  CRISPR gRNA sequence
ttctatgctctctatacttc

SEQ ID NO: 650263 - DNA, 20 bp, Artificial
  CRISPR gRNA sequence
ctatgctctctatacttcac

SEQ ID NO: 650264 - DNA, 20 bp, Artificial
  CRISPR gRNA sequence
tatgctctctatacttcaca

SEQ ID NO: 650265 - DNA, 20 bp, Artificial
  CRISPR gRNA sequence
tgctctctatacttcacagc

SEQ ID NO: 650266 - DNA, 20 bp, Artificial
  CRISPR gRNA sequence
tctatacttcacagctctgc

SEQ ID NO: 650267 - DNA, 20 bp, Artificial
  CRISPR gRNA sequence
tatacttcacagctctgctc

SEQ ID NO: 650268 - DNA, 20 bp, Artificial
  CRISPR gRNA sequence
tacttcacagctctgctctt

SEQ ID NO: 650269 - DNA, 20 bp, Artificial
  CRISPR gRNA sequence
cacagctctgctctttcttt

SEQ ID NO: 650270 - DNA, 20 bp, Artificial
  CRISPR gRNA sequence
acagctctgctctttctttt

SEQ ID NO: 650271 - DNA, 20 bp, Artificial
  CRISPR gRNA sequence
tgctctttcttttataggcc

SEQ ID NO: 650272 - DNA, 20 bp, Artificial
  CRISPR gRNA sequence
ctctttcttttataggcctt

SEQ ID NO: 650273 - DNA, 20 bp, Artificial
  CRISPR gRNA sequence
tttcttttataggccttaag

SEQ ID NO: 650274 - DNA, 20 bp, Artificial
  CRISPR gRNA sequence
tcttttataggccttaagtt

SEQ ID NO: 650275 - DNA, 20 bp, Artificial
  CRISPR gRNA sequence
cttttataggccttaagtta

SEQ ID NO: 650276 - DNA, 20 bp, Artificial
  CRISPR gRNA sequence
ttttataggccttaagttat

SEQ ID NO: 650277 - DNA, 20 bp, Artificial
  CRISPR gRNA sequence
ttataggccttaagttattt

SEQ ID NO: 650278 - DNA, 20 bp, Artificial
  CRISPR gRNA sequence
tataggccttaagttatttt

SEQ ID NO: 650279 - DNA, 20 bp, Artificial
  CRISPR gRNA sequence
ataggccttaagttattttc

SEQ ID NO: 650280 - DNA, 20 bp, Artificial
  CRISPR gRNA sequence
taggccttaagttattttcg

SEQ ID NO: 650281 - DNA, 20 bp, Artificial
  CRISPR gRNA sequence
aagttattttcgcaggtcct

SEQ ID NO: 650282 - DNA, 20 bp, Artificial
  CRISPR gRNA sequence
agttattttcgcaggtccta

SEQ ID NO: 650283 - DNA, 20 bp, Artificial
  CRISPR gRNA sequence
ttttcgcaggtcctacctcc

SEQ ID NO: 650284 - DNA, 20 bp, Artificial
  CRISPR gRNA sequence
tcgcaggtcctacctccatt

SEQ ID NO: 650285 - DNA, 20 bp, Artificial
  CRISPR gRNA sequence
cgcaggtcctacctccatta

SEQ ID NO: 650286 - DNA, 20 bp, Artificial
  CRISPR gRNA sequence
gcaggtcctacctccattag

SEQ ID NO: 650287 - DNA, 20 bp, Artificial
  CRISPR gRNA sequence
cctccattagcaacatacca

SEQ ID NO: 650288 - DNA, 20 bp, Artificial
  CRISPR gRNA sequence
cattagcaacataccagaat

SEQ ID NO: 650289 - DNA, 20 bp, Artificial
  CRISPR gRNA sequence
gcaacataccagaattgtct

SEQ ID NO: 650290 - DNA, 20 bp, Artificial
  CRISPR gRNA sequence
tcttgctaaaaatagtttct

SEQ ID NO: 650291 - DNA, 20 bp, Artificial
  CRISPR gRNA sequence
gctaaaaatagtttctcttt

SEQ ID NO: 650292 - DNA, 20 bp, Artificial
  CRISPR gRNA sequence
ctaaaaatagtttctcttta

SEQ ID NO: 650293 - DNA, 20 bp, Artificial
  CRISPR gRNA sequence
aaaatagtttctctttaata

SEQ ID NO: 650294 - DNA, 20 bp, Artificial
  CRISPR gRNA sequence
ctctttaatagttttaatgt

SEQ ID NO: 650295 - DNA, 20 bp, Artificial
  CRISPR gRNA sequence
tctttaatagttttaatgta

SEQ ID NO: 650296 - DNA, 20 bp, Artificial
  CRISPR gRNA sequence
tttaatagttttaatgtaaa

SEQ ID NO: 650297 - DNA, 20 bp, Artificial
  CRISPR gRNA sequence
taatagttttaatgtaaaaa

SEQ ID NO: 650298 - DNA, 20 bp, Artificial
  CRISPR gRNA sequence
aatagttttaatgtaaaaaa

SEQ ID NO: 650299 - DNA, 20 bp, Artificial
  CRISPR gRNA sequence
atagttttaatgtaaaaaat

SEQ ID NO: 650300 - DNA, 20 bp, Artificial
  CRISPR gRNA sequence
taatgtaaaaaattagcaac

SEQ ID NO: 650301 - DNA, 20 bp, Artificial
  CRISPR gRNA sequence
aatgtaaaaaattagcaaca

SEQ ID NO: 650302 - DNA, 20 bp, Artificial
  CRISPR gRNA sequence
atgtaaaaaattagcaacat

SEQ ID NO: 650303 - DNA, 20 bp, Artificial
  CRISPR gRNA sequence
gcaacattcgagggaatttt

SEQ ID NO: 650304 - DNA, 20 bp, Artificial
  CRISPR gRNA sequence
gagggaattttaaattgatg

SEQ ID NO: 650305 - DNA, 20 bp, Artificial
  CRISPR gRNA sequence
taaattgatgaatatgaaaa

SEQ ID NO: 650306 - DNA, 20 bp, Artificial
  CRISPR gRNA sequence
aaattgatgaatatgaaaaa

SEQ ID NO: 650307 - DNA, 20 bp, Artificial
  CRISPR gRNA sequence
aattgatgaatatgaaaaag

SEQ ID NO: 650308 - DNA, 20 bp, Artificial
  CRISPR gRNA sequence
atgaatatgaaaaagagact

SEQ ID NO: 650309 - DNA, 20 bp, Artificial
  CRISPR gRNA sequence
aggctcttttttaaaagtaa

SEQ ID NO: 650310 - DNA, 20 bp, Artificial
  CRISPR gRNA sequence
ttttttaaaagtaaacttgt

SEQ ID NO: 650311 - DNA, 20 bp, Artificial
  CRISPR gRNA sequence
ttttaaaagtaaacttgttt

SEQ ID NO: 650312 - DNA, 20 bp, Artificial
  CRISPR gRNA sequence
tttaaaagtaaacttgtttg

SEQ ID NO: 650313 - DNA, 20 bp, Artificial
  CRISPR gRNA sequence
ttaaaagtaaacttgtttgt

SEQ ID NO: 650314 - DNA, 20 bp, Artificial
  CRISPR gRNA sequence
taaaagtaaacttgtttgtt

SEQ ID NO: 650315 - DNA, 20 bp, Artificial
  CRISPR gRNA sequence
aaaagtaaacttgtttgtta

SEQ ID NO: 650316 - DNA, 20 bp, Artificial
  CRISPR gRNA sequence
aaagtaaacttgtttgttac

SEQ ID NO: 650317 - DNA, 20 bp, Artificial
  CRISPR gRNA sequence
gtttgttacatgcaagatag

SEQ ID NO: 650318 - DNA, 20 bp, Artificial
  CRISPR gRNA sequence
tttgttacatgcaagataga

SEQ ID NO: 650319 - DNA, 20 bp, Artificial
  CRISPR gRNA sequence
gttacatgcaagatagaatt

SEQ ID NO: 650320 - DNA, 20 bp, Artificial
  CRISPR gRNA sequence
ttacatgcaagatagaattg

SEQ ID NO: 650321 - DNA, 20 bp, Artificial
  CRISPR gRNA sequence
catgcaagatagaattgaaa

SEQ ID NO: 650322 - DNA, 20 bp, Artificial
  CRISPR gRNA sequence
aaaatctatgttttaactca

SEQ ID NO: 650323 - DNA, 20 bp, Artificial
  CRISPR gRNA sequence
tgttttaactcattctactc

SEQ ID NO: 650324 - DNA, 20 bp, Artificial
  CRISPR gRNA sequence
taactcattctactcagatt

SEQ ID NO: 650325 - DNA, 20 bp, Artificial
  CRISPR gRNA sequence
aactcattctactcagattt

SEQ ID NO: 650326 - DNA, 20 bp, Artificial
  CRISPR gRNA sequence
actcattctactcagatttc

SEQ ID NO: 650327 - DNA, 20 bp, Artificial
  CRISPR gRNA sequence
attctactcagatttctttt

SEQ ID NO: 650328 - DNA, 20 bp, Artificial
  CRISPR gRNA sequence
tactcagatttcttttgcca

SEQ ID NO: 650329 - DNA, 20 bp, Artificial
  CRISPR gRNA sequence
ctcagatttcttttgccatc

SEQ ID NO: 650330 - DNA, 20 bp, Artificial
  CRISPR gRNA sequence
agatttcttttgccatcaga

SEQ ID NO: 650331 - DNA, 20 bp, Artificial
  CRISPR gRNA sequence
cttttgccatcagatgccac

SEQ ID NO: 650332 - DNA, 20 bp, Artificial
  CRISPR gRNA sequence
ttttgccatcagatgccaca

SEQ ID NO: 650333 - DNA, 20 bp, Artificial
  CRISPR gRNA sequence
ttgccatcagatgccacaat

SEQ ID NO: 650334 - DNA, 20 bp, Artificial
  CRISPR gRNA sequence
tgccatcagatgccacaatg

SEQ ID NO: 650335 - DNA, 20 bp, Artificial
  CRISPR gRNA sequence
gccatcagatgccacaatgt

SEQ ID NO: 650336 - DNA, 20 bp, Artificial
  CRISPR gRNA sequence
ccatcagatgccacaatgtc

SEQ ID NO: 650337 - DNA, 20 bp, Artificial
  CRISPR gRNA sequence
cttaatattgatatgtcatt

SEQ ID NO: 650338 - DNA, 20 bp, Artificial
  CRISPR gRNA sequence
aatattgatatgtcatttta

SEQ ID NO: 650339 - DNA, 20 bp, Artificial
  CRISPR gRNA sequence
atattgatatgtcattttaa

SEQ ID NO: 650340 - DNA, 20 bp, Artificial
  CRISPR gRNA sequence
atatgtcattttaatattta

SEQ ID NO: 650341 - DNA, 20 bp, Artificial
  CRISPR gRNA sequence
taatatttatatgtacatta

SEQ ID NO: 650342 - DNA, 20 bp, Artificial
  CRISPR gRNA sequence
aatatttatatgtacattat

SEQ ID NO: 650343 - DNA, 20 bp, Artificial
  CRISPR gRNA sequence
atatttatatgtacattatt

SEQ ID NO: 650344 - DNA, 20 bp, Artificial
  CRISPR gRNA sequence
atatgtacattatttagtgt

SEQ ID NO: 650345 - DNA, 20 bp, Artificial
  CRISPR gRNA sequence
tatgtacattatttagtgta

SEQ ID NO: 650346 - DNA, 20 bp, Artificial
  CRISPR gRNA sequence
tttagtgtatgacacttcat

SEQ ID NO: 650347 - DNA, 20 bp, Artificial
  CRISPR gRNA sequence
agtgtatgacacttcatgct

SEQ ID NO: 650348 - DNA, 20 bp, Artificial
  CRISPR gRNA sequence
gtgtatgacacttcatgcta

SEQ ID NO: 650349 - DNA, 20 bp, Artificial
  CRISPR gRNA sequence
catgctatgaatgaatatta

SEQ ID NO: 650350 - DNA, 20 bp, Artificial
  CRISPR gRNA sequence
atgctatgaatgaatattac

SEQ ID NO: 650351 - DNA, 20 bp, Artificial
  CRISPR gRNA sequence
tgaatgaatattactcataa

SEQ ID NO: 650352 - DNA, 20 bp, Artificial
  CRISPR gRNA sequence
ctcataaaacaattcagagt

SEQ ID NO: 650353 - DNA, 20 bp, Artificial
  CRISPR gRNA sequence
ataaaacaattcagagtata

SEQ ID NO: 650354 - DNA, 20 bp, Artificial
  CRISPR gRNA sequence
agagtatataacattatttg

SEQ ID NO: 650355 - DNA, 20 bp, Artificial
  CRISPR gRNA sequence
tttggaaatgccactgtaaa

SEQ ID NO: 650356 - DNA, 20 bp, Artificial
  CRISPR gRNA sequence
ggaaatgccactgtaaacaa

SEQ ID NO: 650357 - DNA, 20 bp, Artificial
  CRISPR gRNA sequence
gaaatgccactgtaaacaac

SEQ ID NO: 650358 - DNA, 20 bp, Artificial
  CRISPR gRNA sequence
taaacaacctagccaagtgt

SEQ ID NO: 650359 - DNA, 20 bp, Artificial
  CRISPR gRNA sequence
gccaagtgtggtggctcaca

SEQ ID NO: 650360 - DNA, 20 bp, Artificial
  CRISPR gRNA sequence
acacctgtaaactcagctac

SEQ ID NO: 650361 - DNA, 20 bp, Artificial
  CRISPR gRNA sequence
taaactcagctactcaggag

SEQ ID NO: 650362 - DNA, 20 bp, Artificial
  CRISPR gRNA sequence
agctactcaggaggctgagg

SEQ ID NO: 650363 - DNA, 20 bp, Artificial
  CRISPR gRNA sequence
ctcaggaggctgaggcggga

SEQ ID NO: 650364 - DNA, 20 bp, Artificial
  CRISPR gRNA sequence
aggaggctgaggcgggagaa

SEQ ID NO: 650365 - DNA, 20 bp, Artificial
  CRISPR gRNA sequence
aggcgggagaatcacttgag

SEQ ID NO: 650366 - DNA, 20 bp, Artificial
  CRISPR gRNA sequence
gaggccaggagttcaagacc

SEQ ID NO: 650367 - DNA, 20 bp, Artificial
  CRISPR gRNA sequence
aggccaggagttcaagacca

SEQ ID NO: 650368 - DNA, 20 bp, Artificial
  CRISPR gRNA sequence
aagaccagcctggacaacac

SEQ ID NO: 650369 - DNA, 20 bp, Artificial
  CRISPR gRNA sequence
gacaacacagtaagatagtg

SEQ ID NO: 650370 - DNA, 20 bp, Artificial
  CRISPR gRNA sequence
actctaaaaaaaaattgtta

SEQ ID NO: 650371 - DNA, 20 bp, Artificial
  CRISPR gRNA sequence
taaaaaaaaattgttaaaaa

SEQ ID NO: 650372 - DNA, 20 bp, Artificial
  CRISPR gRNA sequence
aaaaaaaattgttaaaaatt

SEQ ID NO: 650373 - DNA, 20 bp, Artificial
  CRISPR gRNA sequence
ttaaaaattagctgggcatg

SEQ ID NO: 650374 - DNA, 20 bp, Artificial
  CRISPR gRNA sequence
aaaattagctgggcatggtg

SEQ ID NO: 650375 - DNA, 20 bp, Artificial
  CRISPR gRNA sequence
gctgggcatggtggcatgca

SEQ ID NO: 650376 - DNA, 20 bp, Artificial
  CRISPR gRNA sequence
ggcatggtggcatgcacctg

SEQ ID NO: 650377 - DNA, 20 bp, Artificial
  CRISPR gRNA sequence
tagccccagatacttgagaa

SEQ ID NO: 650378 - DNA, 20 bp, Artificial
  CRISPR gRNA sequence
gagaagattgcttgagccca

SEQ ID NO: 650379 - DNA, 20 bp, Artificial
  CRISPR gRNA sequence
agaagattgcttgagcccag

SEQ ID NO: 650380 - DNA, 20 bp, Artificial
  CRISPR gRNA sequence
cttgagcccaggagttccag

SEQ ID NO: 650381 - DNA, 20 bp, Artificial
  CRISPR gRNA sequence
gagcccaggagttccaggct

SEQ ID NO: 650382 - DNA, 20 bp, Artificial
  CRISPR gRNA sequence
agcccaggagttccaggctg

SEQ ID NO: 650383 - DNA, 20 bp, Artificial
  CRISPR gRNA sequence
caggctgcactgagctataa

SEQ ID NO: 650384 - DNA, 20 bp, Artificial
  CRISPR gRNA sequence
cactgagctataatcgtgac

SEQ ID NO: 650385 - DNA, 20 bp, Artificial
  CRISPR gRNA sequence
agctataatcgtgacaccgt

SEQ ID NO: 650386 - DNA, 20 bp, Artificial
  CRISPR gRNA sequence
taatcgtgacaccgtactcc

SEQ ID NO: 650387 - DNA, 20 bp, Artificial
  CRISPR gRNA sequence
cagcctgaacaacagaacaa

SEQ ID NO: 650388 - DNA, 20 bp, Artificial
  CRISPR gRNA sequence
aacaacagaacaagacccca

SEQ ID NO: 650389 - DNA, 20 bp, Artificial
  CRISPR gRNA sequence
aggaaaggaaaaggaaagaa

SEQ ID NO: 650390 - DNA, 20 bp, Artificial
  CRISPR gRNA sequence
acaagctcaggagtacgaga

SEQ ID NO: 650391 - DNA, 20 bp, Artificial
  CRISPR gRNA sequence
aggagtacgagagcgcctga

SEQ ID NO: 650392 - DNA, 20 bp, Artificial
  CRISPR gRNA sequence
accaacatggtgaaaccccg

SEQ ID NO: 650393 - DNA, 20 bp, Artificial
  CRISPR gRNA sequence
cactaaaaatgcaaaaaaaa

SEQ ID NO: 650394 - DNA, 20 bp, Artificial
  CRISPR gRNA sequence
aaaatgcaaaaaaaaattag

SEQ ID NO: 650395 - DNA, 20 bp, Artificial
  CRISPR gRNA sequence
gccgggcatggtggcatgcc

SEQ ID NO: 650396 - DNA, 20 bp, Artificial
  CRISPR gRNA sequence
taatcccagctactcaggag

SEQ ID NO: 650397 - DNA, 20 bp, Artificial
  CRISPR gRNA sequence
ctcaggaggctgaggcagga

SEQ ID NO: 650398 - DNA, 20 bp, Artificial
  CRISPR gRNA sequence
aggaggctgaggcaggagaa

SEQ ID NO: 650399 - DNA, 20 bp, Artificial
  CRISPR gRNA sequence
aggcaggagaattgcttgaa

SEQ ID NO: 650400 - DNA, 20 bp, Artificial
  CRISPR gRNA sequence
cttgaacccaggaggcggag

SEQ ID NO: 650401 - DNA, 20 bp, Artificial
  CRISPR gRNA sequence
gaacccaggaggcggaggtt

SEQ ID NO: 650402 - DNA, 20 bp, Artificial
  CRISPR gRNA sequence
aacccaggaggcggaggttg

SEQ ID NO: 650403 - DNA, 20 bp, Artificial
  CRISPR gRNA sequence
cagtgagccagatcgcgcca

SEQ ID NO: 650404 - DNA, 20 bp, Artificial
  CRISPR gRNA sequence
cagcctgggctacagagcga

SEQ ID NO: 650405 - DNA, 20 bp, Artificial
  CRISPR gRNA sequence
ggctacagagcgagactccg

SEQ ID NO: 650406 - DNA, 20 bp, Artificial
  CRISPR gRNA sequence
cagagcgagactccgtttca

SEQ ID NO: 650407 - DNA, 20 bp, Artificial
  CRISPR gRNA sequence
cgtttcaaaaaaaaaaaaaa

SEQ ID NO: 650408 - DNA, 20 bp, Artificial
  CRISPR gRNA sequence
caaaaaaaaaaaaaagaaag

SEQ ID NO: 650409 - DNA, 20 bp, Artificial
  CRISPR gRNA sequence
aaaaaaaaaaaaaagaaaga

SEQ ID NO: 650410 - DNA, 20 bp, Artificial
  CRISPR gRNA sequence
tatgcctgtaatccagcact

SEQ ID NO: 650411 - DNA, 20 bp, Artificial
  CRISPR gRNA sequence
atgcctgtaatccagcactt

SEQ ID NO: 650412 - DNA, 20 bp, Artificial
  CRISPR gRNA sequence
tgcctgtaatccagcacttt

SEQ ID NO: 650413 - DNA, 20 bp, Artificial
  CRISPR gRNA sequence
taatccagcactttgggagg

SEQ ID NO: 650414 - DNA, 20 bp, Artificial
  CRISPR gRNA sequence
tgggaggctgaggcaggtgg

SEQ ID NO: 650415 - DNA, 20 bp, Artificial
  CRISPR gRNA sequence
gggaggctgaggcaggtgga

SEQ ID NO: 650416 - DNA, 20 bp, Artificial
  CRISPR gRNA sequence
ggaggctgaggcaggtggat

SEQ ID NO: 650417 - DNA, 20 bp, Artificial
  CRISPR gRNA sequence
aggcaggtggatagcccgag

SEQ ID NO: 650418 - DNA, 20 bp, Artificial
  CRISPR gRNA sequence
gagaccagcctgaccaactt

SEQ ID NO: 650419 - DNA, 20 bp, Artificial
  CRISPR gRNA sequence
agaccagcctgaccaactta

SEQ ID NO: 650420 - DNA, 20 bp, Artificial
  CRISPR gRNA sequence
accaacttagtgaaaccctg

SEQ ID NO: 650421 - DNA, 20 bp, Artificial
  CRISPR gRNA sequence
agtgaaaccctgtctacact

SEQ ID NO: 650422 - DNA, 20 bp, Artificial
  CRISPR gRNA sequence
gtgaaaccctgtctacacta

SEQ ID NO: 650423 - DNA, 20 bp, Artificial
  CRISPR gRNA sequence
tctacactaaaaaataaaaa

SEQ ID NO: 650424 - DNA, 20 bp, Artificial
  CRISPR gRNA sequence
cactaaaaaataaaaaaatt

SEQ ID NO: 650425 - DNA, 20 bp, Artificial
  CRISPR gRNA sequence
aaaaataaaaaaattagctg

SEQ ID NO: 650426 - DNA, 20 bp, Artificial
  CRISPR gRNA sequence
gctggacgtggtgatgggcg

SEQ ID NO: 650427 - DNA, 20 bp, Artificial
  CRISPR gRNA sequence
gacgtggtgatgggcgcctg

SEQ ID NO: 650428 - DNA, 20 bp, Artificial
  CRISPR gRNA sequence
taatcccagctactcgggag

SEQ ID NO: 650429 - DNA, 20 bp, Artificial
  CRISPR gRNA sequence
ctcgggagactgaggcagga

SEQ ID NO: 650430 - DNA, 20 bp, Artificial
  CRISPR gRNA sequence
gggagactgaggcaggagaa

SEQ ID NO: 650431 - DNA, 20 bp, Artificial
  CRISPR gRNA sequence
aggcaggagaattgcttgaa

SEQ ID NO: 650432 - DNA, 20 bp, Artificial
  CRISPR gRNA sequence
cttgaacctgggagtgaagg

SEQ ID NO: 650433 - DNA, 20 bp, Artificial
  CRISPR gRNA sequence
gaacctgggagtgaagggtt

SEQ ID NO: 650434 - DNA, 20 bp, Artificial
  CRISPR gRNA sequence
aacctgggagtgaagggttg

SEQ ID NO: 650435 - DNA, 20 bp, Artificial
  CRISPR gRNA sequence
ggagtgaagggttgcagtga

SEQ ID NO: 650436 - DNA, 20 bp, Artificial
  CRISPR gRNA sequence
cagtgagccaagatcgcgcc

SEQ ID NO: 650437 - DNA, 20 bp, Artificial
  CRISPR gRNA sequence
cactccagcctgggtgacag

SEQ ID NO: 650438 - DNA, 20 bp, Artificial
  CRISPR gRNA sequence
cagcctgggtgacagagcgg

SEQ ID NO: 650439 - DNA, 20 bp, Artificial
  CRISPR gRNA sequence
ggtgacagagcgggacactg

SEQ ID NO: 650440 - DNA, 20 bp, Artificial
  CRISPR gRNA sequence
tctcaaaaaaaaaaaaaaaa

SEQ ID NO: 650441 - DNA, 20 bp, Artificial
  CRISPR gRNA sequence
aaaaaaaaaaaaaaaaaaaa

SEQ ID NO: 650442 - DNA, 20 bp, Artificial
  CRISPR gRNA sequence
atattttgactaaatctata

SEQ ID NO: 650443 - DNA, 20 bp, Artificial
  CRISPR gRNA sequence
tattttgactaaatctatag

SEQ ID NO: 650444 - DNA, 20 bp, Artificial
  CRISPR gRNA sequence
tgactaaatctatagtaaaa

SEQ ID NO: 650445 - DNA, 20 bp, Artificial
  CRISPR gRNA sequence
gactaaatctatagtaaaat

SEQ ID NO: 650446 - DNA, 20 bp, Artificial
  CRISPR gRNA sequence
actaaatctatagtaaaata

SEQ ID NO: 650447 - DNA, 20 bp, Artificial
  CRISPR gRNA sequence
aatctatagtaaaatagtat

SEQ ID NO: 650448 - DNA, 20 bp, Artificial
  CRISPR gRNA sequence
tagtaaaatagtattcaata

SEQ ID NO: 650449 - DNA, 20 bp, Artificial
  CRISPR gRNA sequence
aataaatctgaagatatcat

SEQ ID NO: 650450 - DNA, 20 bp, Artificial
  CRISPR gRNA sequence
aagatatcatttgtacatga

SEQ ID NO: 650451 - DNA, 20 bp, Artificial
  CRISPR gRNA sequence
gtacatgaaaatgcctgatt

SEQ ID NO: 650452 - DNA, 20 bp, Artificial
  CRISPR gRNA sequence
tacatgaaaatgcctgattt

SEQ ID NO: 650453 - DNA, 20 bp, Artificial
  CRISPR gRNA sequence
atttcagtatttatcattga

SEQ ID NO: 650454 - DNA, 20 bp, Artificial
  CRISPR gRNA sequence
cagtatttatcattgatgac

SEQ ID NO: 650455 - DNA, 20 bp, Artificial
  CRISPR gRNA sequence
agtatttatcattgatgaca

SEQ ID NO: 650456 - DNA, 20 bp, Artificial
  CRISPR gRNA sequence
atcattgatgacagctgatc

SEQ ID NO: 650457 - DNA, 20 bp, Artificial
  CRISPR gRNA sequence
tcattgatgacagctgatca

SEQ ID NO: 650458 - DNA, 20 bp, Artificial
  CRISPR gRNA sequence
atgacagctgatcattttta

SEQ ID NO: 650459 - DNA, 20 bp, Artificial
  CRISPR gRNA sequence
atcatttttatgagtctata

SEQ ID NO: 650460 - DNA, 20 bp, Artificial
  CRISPR gRNA sequence
ttatgagtctataattttat

SEQ ID NO: 650461 - DNA, 20 bp, Artificial
  CRISPR gRNA sequence
tatgagtctataattttatt

SEQ ID NO: 650462 - DNA, 20 bp, Artificial
  CRISPR gRNA sequence
atgagtctataattttattg

SEQ ID NO: 650463 - DNA, 20 bp, Artificial
  CRISPR gRNA sequence
tgagtctataattttattga

SEQ ID NO: 650464 - DNA, 20 bp, Artificial
  CRISPR gRNA sequence
taattttattgaaatttcaa

SEQ ID NO: 650465 - DNA, 20 bp, Artificial
  CRISPR gRNA sequence
tattgaaatttcaaagttaa

SEQ ID NO: 650466 - DNA, 20 bp, Artificial
  CRISPR gRNA sequence
attgaaatttcaaagttaaa

SEQ ID NO: 650467 - DNA, 20 bp, Artificial
  CRISPR gRNA sequence
ttgaaatttcaaagttaaat

SEQ ID NO: 650468 - DNA, 20 bp, Artificial
  CRISPR gRNA sequence
aaatttcaaagttaaatgga

SEQ ID NO: 650469 - DNA, 20 bp, Artificial
  CRISPR gRNA sequence
caaagttaaatggatgtaat

SEQ ID NO: 650470 - DNA, 20 bp, Artificial
  CRISPR gRNA sequence
aaagttaaatggatgtaatc

SEQ ID NO: 650471 - DNA, 20 bp, Artificial
  CRISPR gRNA sequence
aatggatgtaatcagagcta

SEQ ID NO: 650472 - DNA, 20 bp, Artificial
  CRISPR gRNA sequence
ctatcagttttctggctcca

SEQ ID NO: 650473 - DNA, 20 bp, Artificial
  CRISPR gRNA sequence
tcagttttctggctccatac

SEQ ID NO: 650474 - DNA, 20 bp, Artificial
  CRISPR gRNA sequence
tctggctccatactttcttt

SEQ ID NO: 650475 - DNA, 20 bp, Artificial
  CRISPR gRNA sequence
ctggctccatactttctttt

SEQ ID NO: 650476 - DNA, 20 bp, Artificial
  CRISPR gRNA sequence
tggctccatactttctttta

SEQ ID NO: 650477 - DNA, 20 bp, Artificial
  CRISPR gRNA sequence
gctccatactttcttttaga

SEQ ID NO: 650478 - DNA, 20 bp, Artificial
  CRISPR gRNA sequence
catactttcttttagaggat

SEQ ID NO: 650479 - DNA, 20 bp, Artificial
  CRISPR gRNA sequence
tcttttagaggatggttgac

SEQ ID NO: 650480 - DNA, 20 bp, Artificial
  CRISPR gRNA sequence
cttttagaggatggttgact

SEQ ID NO: 650481 - DNA, 20 bp, Artificial
  CRISPR gRNA sequence
ttttagaggatggttgactg

SEQ ID NO: 650482 - DNA, 20 bp, Artificial
  CRISPR gRNA sequence
ttagaggatggttgactgaa

SEQ ID NO: 650483 - DNA, 20 bp, Artificial
  CRISPR gRNA sequence
tagaggatggttgactgaat

SEQ ID NO: 650484 - DNA, 20 bp, Artificial
  CRISPR gRNA sequence
agaggatggttgactgaatt

SEQ ID NO: 650485 - DNA, 20 bp, Artificial
  CRISPR gRNA sequence
gaggatggttgactgaattc

SEQ ID NO: 650486 - DNA, 20 bp, Artificial
  CRISPR gRNA sequence
actgaattcattggtctttt

SEQ ID NO: 650487 - DNA, 20 bp, Artificial
  CRISPR gRNA sequence
aattcattggtcttttcttt

SEQ ID NO: 650488 - DNA, 20 bp, Artificial
  CRISPR gRNA sequence
attggtcttttctttaaatt

SEQ ID NO: 650489 - DNA, 20 bp, Artificial
  CRISPR gRNA sequence
gtcttttctttaaattacac

SEQ ID NO: 650490 - DNA, 20 bp, Artificial
  CRISPR gRNA sequence
ttctttaaattacacaaata

SEQ ID NO: 650491 - DNA, 20 bp, Artificial
  CRISPR gRNA sequence
tctttaaattacacaaataa

SEQ ID NO: 650492 - DNA, 20 bp, Artificial
  CRISPR gRNA sequence
ctttaaattacacaaataat

SEQ ID NO: 650493 - DNA, 20 bp, Artificial
  CRISPR gRNA sequence
tttaaattacacaaataata

SEQ ID NO: 650494 - DNA, 20 bp, Artificial
  CRISPR gRNA sequence
taaattacacaaataatata

SEQ ID NO: 650495 - DNA, 20 bp, Artificial
  CRISPR gRNA sequence
aaattacacaaataatatat

SEQ ID NO: 650496 - DNA, 20 bp, Artificial
  CRISPR gRNA sequence
aattacacaaataatatatg

SEQ ID NO: 650497 - DNA, 20 bp, Artificial
  CRISPR gRNA sequence
cacaaataatatatgaattt

SEQ ID NO: 650498 - DNA, 20 bp, Artificial
  CRISPR gRNA sequence
attttttgtaagagacttaa

SEQ ID NO: 650499 - DNA, 20 bp, Artificial
  CRISPR gRNA sequence
ttttttgtaagagacttaaa

SEQ ID NO: 650500 - DNA, 20 bp, Artificial
  CRISPR gRNA sequence
tttgtaagagacttaaagaa

SEQ ID NO: 650501 - DNA, 20 bp, Artificial
  CRISPR gRNA sequence
ttgtaagagacttaaagaat

SEQ ID NO: 650502 - DNA, 20 bp, Artificial
  CRISPR gRNA sequence
tgtaagagacttaaagaatg

SEQ ID NO: 650503 - DNA, 20 bp, Artificial
  CRISPR gRNA sequence
gtaagagacttaaagaatgt

SEQ ID NO: 650504 - DNA, 20 bp, Artificial
  CRISPR gRNA sequence
taagagacttaaagaatgta

SEQ ID NO: 650505 - DNA, 20 bp, Artificial
  CRISPR gRNA sequence
aaagaatgtagaactattta

SEQ ID NO: 650506 - DNA, 20 bp, Artificial
  CRISPR gRNA sequence
aagaatgtagaactatttag

SEQ ID NO: 650507 - DNA, 20 bp, Artificial
  CRISPR gRNA sequence
tttagaataaaatataaaac

SEQ ID NO: 650508 - DNA, 20 bp, Artificial
  CRISPR gRNA sequence
agaataaaatataaaacacc

SEQ ID NO: 650509 - DNA, 20 bp, Artificial
  CRISPR gRNA sequence
gaataaaatataaaacaccc

SEQ ID NO: 650510 - DNA, 20 bp, Artificial
  CRISPR gRNA sequence
tttaccctccgatatcccaa

SEQ ID NO: 650511 - DNA, 20 bp, Artificial
  CRISPR gRNA sequence
accctccgatatcccaaagt

SEQ ID NO: 650512 - DNA, 20 bp, Artificial
  CRISPR gRNA sequence
ccctccgatatcccaaagtc

SEQ ID NO: 650513 - DNA, 20 bp, Artificial
  CRISPR gRNA sequence
cgatatcccaaagtcaacta

SEQ ID NO: 650514 - DNA, 20 bp, Artificial
  CRISPR gRNA sequence
tatcaagttttgacgtttcc

SEQ ID NO: 650515 - DNA, 20 bp, Artificial
  CRISPR gRNA sequence
tgacgtttccttcttgttct

SEQ ID NO: 650516 - DNA, 20 bp, Artificial
  CRISPR gRNA sequence
gacgtttccttcttgttctt

SEQ ID NO: 650517 - DNA, 20 bp, Artificial
  CRISPR gRNA sequence
acgtttccttcttgttctta

SEQ ID NO: 650518 - DNA, 20 bp, Artificial
  CRISPR gRNA sequence
ccttcttgttcttattattt

SEQ ID NO: 650519 - DNA, 20 bp, Artificial
  CRISPR gRNA sequence
cttcttgttcttattatttg

SEQ ID NO: 650520 - DNA, 20 bp, Artificial
  CRISPR gRNA sequence
cttgttcttattatttgttt

SEQ ID NO: 650521 - DNA, 20 bp, Artificial
  CRISPR gRNA sequence
ttgttcttattatttgtttt

SEQ ID NO: 650522 - DNA, 20 bp, Artificial
  CRISPR gRNA sequence
gttcttattatttgttttca

SEQ ID NO: 650523 - DNA, 20 bp, Artificial
  CRISPR gRNA sequence
ttcttattatttgttttcac

SEQ ID NO: 650524 - DNA, 20 bp, Artificial
  CRISPR gRNA sequence
ttattatttgttttcacaca

SEQ ID NO: 650525 - DNA, 20 bp, Artificial
  CRISPR gRNA sequence
attatttgttttcacacatt

SEQ ID NO: 650526 - DNA, 20 bp, Artificial
  CRISPR gRNA sequence
ttatttgttttcacacattc

SEQ ID NO: 650527 - DNA, 20 bp, Artificial
  CRISPR gRNA sequence
tttgttttcacacattcaca

SEQ ID NO: 650528 - DNA, 20 bp, Artificial
  CRISPR gRNA sequence
gttttcacacattcacacgc

SEQ ID NO: 650529 - DNA, 20 bp, Artificial
  CRISPR gRNA sequence
ttttcacacattcacacgca

SEQ ID NO: 650530 - DNA, 20 bp, Artificial
  CRISPR gRNA sequence
tcacacattcacacgcatac

SEQ ID NO: 650531 - DNA, 20 bp, Artificial
  CRISPR gRNA sequence
cacacattcacacgcataca

SEQ ID NO: 650532 - DNA, 20 bp, Artificial
  CRISPR gRNA sequence
acacattcacacgcatacac

SEQ ID NO: 650533 - DNA, 20 bp, Artificial
  CRISPR gRNA sequence
acacgcatacacatgcacat

SEQ ID NO: 650534 - DNA, 20 bp, Artificial
  CRISPR gRNA sequence
ttaaaaacataaatggtatt

SEQ ID NO: 650535 - DNA, 20 bp, Artificial
  CRISPR gRNA sequence
taaaaacataaatggtatta

SEQ ID NO: 650536 - DNA, 20 bp, Artificial
  CRISPR gRNA sequence
aaaaacataaatggtattat

SEQ ID NO: 650537 - DNA, 20 bp, Artificial
  CRISPR gRNA sequence
aaaacataaatggtattatc

SEQ ID NO: 650538 - DNA, 20 bp, Artificial
  CRISPR gRNA sequence
tcatatacatagagttgtat

SEQ ID NO: 650539 - DNA, 20 bp, Artificial
  CRISPR gRNA sequence
tatgaaatcaattgtctagt

SEQ ID NO: 650540 - DNA, 20 bp, Artificial
  CRISPR gRNA sequence
tctagttaactatagcttct

SEQ ID NO: 650541 - DNA, 20 bp, Artificial
  CRISPR gRNA sequence
gttaactatagcttctctgg

SEQ ID NO: 650542 - DNA, 20 bp, Artificial
  CRISPR gRNA sequence
actatagcttctctggctga

SEQ ID NO: 650543 - DNA, 20 bp, Artificial
  CRISPR gRNA sequence
tagcttctctggctgaaaaa

SEQ ID NO: 650544 - DNA, 20 bp, Artificial
  CRISPR gRNA sequence
ctctggctgaaaaaatatct

SEQ ID NO: 650545 - DNA, 20 bp, Artificial
  CRISPR gRNA sequence
tctggctgaaaaaatatctc

SEQ ID NO: 650546 - DNA, 20 bp, Artificial
  CRISPR gRNA sequence
tggctgaaaaaatatctctt

SEQ ID NO: 650547 - DNA, 20 bp, Artificial
  CRISPR gRNA sequence
gctgaaaaaatatctcttca

SEQ ID NO: 650548 - DNA, 20 bp, Artificial
  CRISPR gRNA sequence
aaaaaatatctcttcaaatt

SEQ ID NO: 650549 - DNA, 20 bp, Artificial
  CRISPR gRNA sequence
ttcaaatttgttacaggtat

SEQ ID NO: 650550 - DNA, 20 bp, Artificial
  CRISPR gRNA sequence
caaatttgttacaggtattg

SEQ ID NO: 650551 - DNA, 20 bp, Artificial
  CRISPR gRNA sequence
aaatttgttacaggtattgt

SEQ ID NO: 650552 - DNA, 20 bp, Artificial
  CRISPR gRNA sequence
gttacaggtattgtactcaa

SEQ ID NO: 650553 - DNA, 20 bp, Artificial
  CRISPR gRNA sequence
ttacaggtattgtactcaaa

SEQ ID NO: 650554 - DNA, 20 bp, Artificial
  CRISPR gRNA sequence
caggtattgtactcaaaatg

SEQ ID NO: 650555 - DNA, 20 bp, Artificial
  CRISPR gRNA sequence
tactcaaaatgtaacaccaa

SEQ ID NO: 650556 - DNA, 20 bp, Artificial
  CRISPR gRNA sequence
aaaatgtaacaccaactaaa

SEQ ID NO: 650557 - DNA, 20 bp, Artificial
  CRISPR gRNA sequence
aaactattcaaatgcatccc

SEQ ID NO: 650558 - DNA, 20 bp, Artificial
  CRISPR gRNA sequence
ttcaaatgcatccccaaaac

SEQ ID NO: 650559 - DNA, 20 bp, Artificial
  CRISPR gRNA sequence
aaatgcatccccaaaacttt

SEQ ID NO: 650560 - DNA, 20 bp, Artificial
  CRISPR gRNA sequence
tatgcaaacagcattactat

SEQ ID NO: 650561 - DNA, 20 bp, Artificial
  CRISPR gRNA sequence
atgcaaacagcattactatg

SEQ ID NO: 650562 - DNA, 20 bp, Artificial
  CRISPR gRNA sequence
tgcaaacagcattactatga

SEQ ID NO: 650563 - DNA, 20 bp, Artificial
  CRISPR gRNA sequence
ctatgatttatttatgtaaa

SEQ ID NO: 650564 - DNA, 20 bp, Artificial
  CRISPR gRNA sequence
tgatttatttatgtaaaaaa

SEQ ID NO: 650565 - DNA, 20 bp, Artificial
  CRISPR gRNA sequence
atttatgtaaaaaataattt

SEQ ID NO: 650566 - DNA, 20 bp, Artificial
  CRISPR gRNA sequence
tttatgtaaaaaataattta

SEQ ID NO: 650567 - DNA, 20 bp, Artificial
  CRISPR gRNA sequence
atgtaaaaaataatttattt

SEQ ID NO: 650568 - DNA, 20 bp, Artificial
  CRISPR gRNA sequence
tgtaaaaaataatttatttt

SEQ ID NO: 650569 - DNA, 20 bp, Artificial
  CRISPR gRNA sequence
attttaaattgtgttttgtt

SEQ ID NO: 650570 - DNA, 20 bp, Artificial
  CRISPR gRNA sequence
ttttaaattgtgttttgttg

SEQ ID NO: 650571 - DNA, 20 bp, Artificial
  CRISPR gRNA sequence
taaattgtgttttgttgagg

SEQ ID NO: 650572 - DNA, 20 bp, Artificial
  CRISPR gRNA sequence
aaattgtgttttgttgaggt

SEQ ID NO: 650573 - DNA, 20 bp, Artificial
  CRISPR gRNA sequence
aattgtgttttgttgaggta

SEQ ID NO: 650574 - DNA, 20 bp, Artificial
  CRISPR gRNA sequence
tgttttgttgaggtacgggg

SEQ ID NO: 650575 - DNA, 20 bp, Artificial
  CRISPR gRNA sequence
tgttgaggtacgggggtgtt

SEQ ID NO: 650576 - DNA, 20 bp, Artificial
  CRISPR gRNA sequence
gttgaggtacgggggtgttt

SEQ ID NO: 650577 - DNA, 20 bp, Artificial
  CRISPR gRNA sequence
ttgaggtacgggggtgtttc

SEQ ID NO: 650578 - DNA, 20 bp, Artificial
  CRISPR gRNA sequence
aggtacgggggtgtttcttt

SEQ ID NO: 650579 - DNA, 20 bp, Artificial
  CRISPR gRNA sequence
ctttttgtttttatttccaa

SEQ ID NO: 650580 - DNA, 20 bp, Artificial
  CRISPR gRNA sequence
tttttgtttttatttccaaa

SEQ ID NO: 650581 - DNA, 20 bp, Artificial
  CRISPR gRNA sequence
tttgtttttatttccaaaaa

SEQ ID NO: 650582 - DNA, 20 bp, Artificial
  CRISPR gRNA sequence
ttgtttttatttccaaaaaa

SEQ ID NO: 650583 - DNA, 20 bp, Artificial
  CRISPR gRNA sequence
tgtttttatttccaaaaaaa

SEQ ID NO: 650584 - DNA, 20 bp, Artificial
  CRISPR gRNA sequence
gtttttatttccaaaaaaaa

SEQ ID NO: 650585 - DNA, 20 bp, Artificial
  CRISPR gRNA sequence
tttttatttccaaaaaaaaa

SEQ ID NO: 650586 - DNA, 20 bp, Artificial
  CRISPR gRNA sequence
ttatttccaaaaaaaaatta

SEQ ID NO: 650587 - DNA, 20 bp, Artificial
  CRISPR gRNA sequence
tatttccaaaaaaaaattaa

SEQ ID NO: 650588 - DNA, 20 bp, Artificial
  CRISPR gRNA sequence
atttccaaaaaaaaattaaa

SEQ ID NO: 650589 - DNA, 20 bp, Artificial
  CRISPR gRNA sequence
tttccaaaaaaaaattaaat

SEQ ID NO: 650590 - DNA, 20 bp, Artificial
  CRISPR gRNA sequence
ccaaaaaaaaattaaatcta

SEQ ID NO: 650591 - DNA, 20 bp, Artificial
  CRISPR gRNA sequence
caaaaaaaaattaaatctaa

SEQ ID NO: 650592 - DNA, 20 bp, Artificial
  CRISPR gRNA sequence
aatctaaaactatcattagg

SEQ ID NO: 650593 - DNA, 20 bp, Artificial
  CRISPR gRNA sequence
aaactatcattaggtcatta

SEQ ID NO: 650594 - DNA, 20 bp, Artificial
  CRISPR gRNA sequence
tcattaggtcattaatgtgt

SEQ ID NO: 650595 - DNA, 20 bp, Artificial
  CRISPR gRNA sequence
ggtcattaatgtgtcataat

SEQ ID NO: 650596 - DNA, 20 bp, Artificial
  CRISPR gRNA sequence
atgtgtcataattcagacag

SEQ ID NO: 650597 - DNA, 20 bp, Artificial
  CRISPR gRNA sequence
agacagatggcagtgtgtaa

SEQ ID NO: 650598 - DNA, 20 bp, Artificial
  CRISPR gRNA sequence
atgcttcgagaacttaaaaa

SEQ ID NO: 650599 - DNA, 20 bp, Artificial
  CRISPR gRNA sequence
cgagaacttaaaaacagcag

SEQ ID NO: 650600 - DNA, 20 bp, Artificial
  CRISPR gRNA sequence
gagaacttaaaaacagcaga

SEQ ID NO: 650601 - DNA, 20 bp, Artificial
  CRISPR gRNA sequence
aaaaacagcagactcacaga

SEQ ID NO: 650602 - DNA, 20 bp, Artificial
  CRISPR gRNA sequence
aaaacagcagactcacagaa

SEQ ID NO: 650603 - DNA, 20 bp, Artificial
  CRISPR gRNA sequence
acagaaaaatctcatatttc

SEQ ID NO: 650604 - DNA, 20 bp, Artificial
  CRISPR gRNA sequence
atatttctttttataattct

SEQ ID NO: 650605 - DNA, 20 bp, Artificial
  CRISPR gRNA sequence
ctttttataattctcagtta

SEQ ID NO: 650606 - DNA, 20 bp, Artificial
  CRISPR gRNA sequence
tttttataattctcagttat

SEQ ID NO: 650607 - DNA, 20 bp, Artificial
  CRISPR gRNA sequence
tttataattctcagttatgt

SEQ ID NO: 650608 - DNA, 20 bp, Artificial
  CRISPR gRNA sequence
ttataattctcagttatgtc

SEQ ID NO: 650609 - DNA, 20 bp, Artificial
  CRISPR gRNA sequence
tataattctcagttatgtcc

SEQ ID NO: 650610 - DNA, 20 bp, Artificial
  CRISPR gRNA sequence
ataattctcagttatgtcca

SEQ ID NO: 650611 - DNA, 20 bp, Artificial
  CRISPR gRNA sequence
taattctcagttatgtccag

SEQ ID NO: 650612 - DNA, 20 bp, Artificial
  CRISPR gRNA sequence
tcagttatgtccagacacaa

SEQ ID NO: 650613 - DNA, 20 bp, Artificial
  CRISPR gRNA sequence
agttatgtccagacacaatc

SEQ ID NO: 650614 - DNA, 20 bp, Artificial
  CRISPR gRNA sequence
tgtccagacacaatctattg

SEQ ID NO: 650615 - DNA, 20 bp, Artificial
  CRISPR gRNA sequence
ttgctgctttcaagtagttt

SEQ ID NO: 650616 - DNA, 20 bp, Artificial
  CRISPR gRNA sequence
ctgctttcaagtagttttca

SEQ ID NO: 650617 - DNA, 20 bp, Artificial
  CRISPR gRNA sequence
ctttcaagtagttttcaaaa

SEQ ID NO: 650618 - DNA, 20 bp, Artificial
  CRISPR gRNA sequence
tcaagtagttttcaaaaatg

SEQ ID NO: 650619 - DNA, 20 bp, Artificial
  CRISPR gRNA sequence
caagtagttttcaaaaatgt

SEQ ID NO: 650620 - DNA, 20 bp, Artificial
  CRISPR gRNA sequence
aagtagttttcaaaaatgta

SEQ ID NO: 650621 - DNA, 20 bp, Artificial
  CRISPR gRNA sequence
tcaaaaatgtaataatgtaa

SEQ ID NO: 650622 - DNA, 20 bp, Artificial
  CRISPR gRNA sequence
caaaaatgtaataatgtaat

SEQ ID NO: 650623 - DNA, 20 bp, Artificial
  CRISPR gRNA sequence
aaaaatgtaataatgtaata

SEQ ID NO: 650624 - DNA, 20 bp, Artificial
  CRISPR gRNA sequence
tacatttccaaatactacat

SEQ ID NO: 650625 - DNA, 20 bp, Artificial
  CRISPR gRNA sequence
acatttccaaatactacatt

SEQ ID NO: 650626 - DNA, 20 bp, Artificial
  CRISPR gRNA sequence
catttccaaatactacattc

SEQ ID NO: 650627 - DNA, 20 bp, Artificial
  CRISPR gRNA sequence
ccaaatactacattcgagtc

SEQ ID NO: 650628 - DNA, 20 bp, Artificial
  CRISPR gRNA sequence
caaatactacattcgagtca

SEQ ID NO: 650629 - DNA, 20 bp, Artificial
  CRISPR gRNA sequence
cattcgagtcagtgttttta

SEQ ID NO: 650630 - DNA, 20 bp, Artificial
  CRISPR gRNA sequence
gagtcagtgtttttaaggcg

SEQ ID NO: 650631 - DNA, 20 bp, Artificial
  CRISPR gRNA sequence
ttaaggcgtaagtcatttta

SEQ ID NO: 650632 - DNA, 20 bp, Artificial
  CRISPR gRNA sequence
taaggcgtaagtcattttaa

SEQ ID NO: 650633 - DNA, 20 bp, Artificial
  CRISPR gRNA sequence
aaggcgtaagtcattttaaa

SEQ ID NO: 650634 - DNA, 20 bp, Artificial
  CRISPR gRNA sequence
aggcgtaagtcattttaaag

SEQ ID NO: 650635 - DNA, 20 bp, Artificial
  CRISPR gRNA sequence
taaagcagtacacaaaaatg

SEQ ID NO: 650636 - DNA, 20 bp, Artificial
  CRISPR gRNA sequence
aaagcagtacacaaaaatga

SEQ ID NO: 650637 - DNA, 20 bp, Artificial
  CRISPR gRNA sequence
aagcagtacacaaaaatgat

SEQ ID NO: 650638 - DNA, 20 bp, Artificial
  CRISPR gRNA sequence
ggtaccacctatttttagta

SEQ ID NO: 650639 - DNA, 20 bp, Artificial
  CRISPR gRNA sequence
tttttagtacctaaaaatta

SEQ ID NO: 650640 - DNA, 20 bp, Artificial
  CRISPR gRNA sequence
ttagtacctaaaaattattg

SEQ ID NO: 650641 - DNA, 20 bp, Artificial
  CRISPR gRNA sequence
tagtacctaaaaattattga

SEQ ID NO: 650642 - DNA, 20 bp, Artificial
  CRISPR gRNA sequence
agtacctaaaaattattgaa

SEQ ID NO: 650643 - DNA, 20 bp, Artificial
  CRISPR gRNA sequence
gtacctaaaaattattgaat

SEQ ID NO: 650644 - DNA, 20 bp, Artificial
  CRISPR gRNA sequence
aaaattattgaatagctcaa

SEQ ID NO: 650645 - DNA, 20 bp, Artificial
  CRISPR gRNA sequence
ttgaatagctcaattttcaa

SEQ ID NO: 650646 - DNA, 20 bp, Artificial
  CRISPR gRNA sequence
aatagctcaattttcaagct

SEQ ID NO: 650647 - DNA, 20 bp, Artificial
  CRISPR gRNA sequence
aattttcaagctttagatga

SEQ ID NO: 650648 - DNA, 20 bp, Artificial
  CRISPR gRNA sequence
tcaagctttagatgatattt

SEQ ID NO: 650649 - DNA, 20 bp, Artificial
  CRISPR gRNA sequence
caagctttagatgatatttg

SEQ ID NO: 650650 - DNA, 20 bp, Artificial
  CRISPR gRNA sequence
aagctttagatgatatttgg

SEQ ID NO: 650651 - DNA, 20 bp, Artificial
  CRISPR gRNA sequence
tagatgatatttgggtgatc

SEQ ID NO: 650652 - DNA, 20 bp, Artificial
  CRISPR gRNA sequence
agatgatatttgggtgatct

SEQ ID NO: 650653 - DNA, 20 bp, Artificial
  CRISPR gRNA sequence
gatgatatttgggtgatctg

SEQ ID NO: 650654 - DNA, 20 bp, Artificial
  CRISPR gRNA sequence
gggtgatctgagcaagcatt

SEQ ID NO: 650655 - DNA, 20 bp, Artificial
  CRISPR gRNA sequence
ggtgatctgagcaagcattt

SEQ ID NO: 650656 - DNA, 20 bp, Artificial
  CRISPR gRNA sequence
agcaagcatttctaatagaa

SEQ ID NO: 650657 - DNA, 20 bp, Artificial
  CRISPR gRNA sequence
ctaatagaaatagacctttt

SEQ ID NO: 650658 - DNA, 20 bp, Artificial
  CRISPR gRNA sequence
taatagaaatagacctttta

SEQ ID NO: 650659 - DNA, 20 bp, Artificial
  CRISPR gRNA sequence
atagaaatagaccttttaca

SEQ ID NO: 650660 - DNA, 20 bp, Artificial
  CRISPR gRNA sequence
ttacaatcacgaattaaata

SEQ ID NO: 650661 - DNA, 20 bp, Artificial
  CRISPR gRNA sequence
tacaatcacgaattaaatat

SEQ ID NO: 650662 - DNA, 20 bp, Artificial
  CRISPR gRNA sequence
acaatcacgaattaaatata

SEQ ID NO: 650663 - DNA, 20 bp, Artificial
  CRISPR gRNA sequence
caatcacgaattaaatatac

SEQ ID NO: 650664 - DNA, 20 bp, Artificial
  CRISPR gRNA sequence
aatatacatcctcagcccta

SEQ ID NO: 650665 - DNA, 20 bp, Artificial
  CRISPR gRNA sequence
agccctaaaaactatagaaa

SEQ ID NO: 650666 - DNA, 20 bp, Artificial
  CRISPR gRNA sequence
aaaactatagaaatgccact

SEQ ID NO: 650667 - DNA, 20 bp, Artificial
  CRISPR gRNA sequence
tagaaatgccacttttcagt

SEQ ID NO: 650668 - DNA, 20 bp, Artificial
  CRISPR gRNA sequence
ttcagtctaaaaagtaacag

SEQ ID NO: 650669 - DNA, 20 bp, Artificial
  CRISPR gRNA sequence
tcagtctaaaaagtaacaga

SEQ ID NO: 650670 - DNA, 20 bp, Artificial
  CRISPR gRNA sequence
cagtctaaaaagtaacagat

SEQ ID NO: 650671 - DNA, 20 bp, Artificial
  CRISPR gRNA sequence
agtctaaaaagtaacagatg

SEQ ID NO: 650672 - DNA, 20 bp, Artificial
  CRISPR gRNA sequence
aaaagtaacagatgtattga

SEQ ID NO: 650673 - DNA, 20 bp, Artificial
  CRISPR gRNA sequence
aaaataaagtcatctacttc

SEQ ID NO: 650674 - DNA, 20 bp, Artificial
  CRISPR gRNA sequence
cttcagaccatctgaataat

SEQ ID NO: 650675 - DNA, 20 bp, Artificial
  CRISPR gRNA sequence
cagaccatctgaataataag

SEQ ID NO: 650676 - DNA, 20 bp, Artificial
  CRISPR gRNA sequence
agaccatctgaataataagc

SEQ ID NO: 650677 - DNA, 20 bp, Artificial
  CRISPR gRNA sequence
aataataagcatattggcat

SEQ ID NO: 650678 - DNA, 20 bp, Artificial
  CRISPR gRNA sequence
gcataagtctgattagaaga

SEQ ID NO: 650679 - DNA, 20 bp, Artificial
  CRISPR gRNA sequence
attagaagacctataagata

SEQ ID NO: 650680 - DNA, 20 bp, Artificial
  CRISPR gRNA sequence
gaagacctataagatatttc

SEQ ID NO: 650681 - DNA, 20 bp, Artificial
  CRISPR gRNA sequence
taagatatttccatatgtaa

SEQ ID NO: 650682 - DNA, 20 bp, Artificial
  CRISPR gRNA sequence
ccatatgtaaatattacttg

SEQ ID NO: 650683 - DNA, 20 bp, Artificial
  CRISPR gRNA sequence
catatgtaaatattacttgt

SEQ ID NO: 650684 - DNA, 20 bp, Artificial
  CRISPR gRNA sequence
cttgttaaaatgtgtatttt

SEQ ID NO: 650685 - DNA, 20 bp, Artificial
  CRISPR gRNA sequence
gttaaaatgtgtatttttaa

SEQ ID NO: 650686 - DNA, 20 bp, Artificial
  CRISPR gRNA sequence
ttaaaatgtgtatttttaaa

SEQ ID NO: 650687 - DNA, 20 bp, Artificial
  CRISPR gRNA sequence
aaatgtgtatttttaaacaa

SEQ ID NO: 650688 - DNA, 20 bp, Artificial
  CRISPR gRNA sequence
ttaaacaacaaaacaaggat

SEQ ID NO: 650689 - DNA, 20 bp, Artificial
  CRISPR gRNA sequence
taaacaacaaaacaaggata

SEQ ID NO: 650690 - DNA, 20 bp, Artificial
  CRISPR gRNA sequence
aaacaacaaaacaaggatat

SEQ ID NO: 650691 - DNA, 20 bp, Artificial
  CRISPR gRNA sequence
aacaacaaaacaaggatatt

SEQ ID NO: 650692 - DNA, 20 bp, Artificial
  CRISPR gRNA sequence
atgaaaatggccatgaaaga

SEQ ID NO: 650693 - DNA, 20 bp, Artificial
  CRISPR gRNA sequence
tgaaaatggccatgaaagaa

SEQ ID NO: 650694 - DNA, 20 bp, Artificial
  CRISPR gRNA sequence
tatatacttgtagaagaaat

SEQ ID NO: 650695 - DNA, 20 bp, Artificial
  CRISPR gRNA sequence
atatacttgtagaagaaatt

SEQ ID NO: 650696 - DNA, 20 bp, Artificial
  CRISPR gRNA sequence
tatacttgtagaagaaatta

SEQ ID NO: 650697 - DNA, 20 bp, Artificial
  CRISPR gRNA sequence
gtagaagaaattatgcctat

SEQ ID NO: 650698 - DNA, 20 bp, Artificial
  CRISPR gRNA sequence
tagaagaaattatgcctatt

SEQ ID NO: 650699 - DNA, 20 bp, Artificial
  CRISPR gRNA sequence
tgcctatttagaactcaacc

SEQ ID NO: 650700 - DNA, 20 bp, Artificial
  CRISPR gRNA sequence
tttagaactcaaccagaaat

SEQ ID NO: 650701 - DNA, 20 bp, Artificial
  CRISPR gRNA sequence
agaactcaaccagaaattct

SEQ ID NO: 650702 - DNA, 20 bp, Artificial
  CRISPR gRNA sequence
gaactcaaccagaaattctc

SEQ ID NO: 650703 - DNA, 20 bp, Artificial
  CRISPR gRNA sequence
aaccagaaattctcactgtt

SEQ ID NO: 650704 - DNA, 20 bp, Artificial
  CRISPR gRNA sequence
tcactgttaattcaactgaa

SEQ ID NO: 650705 - DNA, 20 bp, Artificial
  CRISPR gRNA sequence
actgttaattcaactgaaaa

SEQ ID NO: 650706 - DNA, 20 bp, Artificial
  CRISPR gRNA sequence
ttaattcaactgaaaacaca

SEQ ID NO: 650707 - DNA, 20 bp, Artificial
  CRISPR gRNA sequence
attcaactgaaaacacagca

SEQ ID NO: 650708 - DNA, 20 bp, Artificial
  CRISPR gRNA sequence
aactgaaaacacagcaacgt

SEQ ID NO: 650709 - DNA, 20 bp, Artificial
  CRISPR gRNA sequence
aaaacacagcaacgtagtac

SEQ ID NO: 650710 - DNA, 20 bp, Artificial
  CRISPR gRNA sequence
gcacttcaaaataagatcaa

SEQ ID NO: 650711 - DNA, 20 bp, Artificial
  CRISPR gRNA sequence
caaaataagatcaagtcctg

SEQ ID NO: 650712 - DNA, 20 bp, Artificial
  CRISPR gRNA sequence
aaaataagatcaagtcctgc

SEQ ID NO: 650713 - DNA, 20 bp, Artificial
  CRISPR gRNA sequence
catgttgaatgtcttagtaa

SEQ ID NO: 650714 - DNA, 20 bp, Artificial
  CRISPR gRNA sequence
aatgtcttagtaagaagtag

SEQ ID NO: 650715 - DNA, 20 bp, Artificial
  CRISPR gRNA sequence
agtaagaagtaggtagagct

SEQ ID NO: 650716 - DNA, 20 bp, Artificial
  CRISPR gRNA sequence
gtaagaagtaggtagagctg

SEQ ID NO: 650717 - DNA, 20 bp, Artificial
  CRISPR gRNA sequence
acatagacaagggtaaggag

SEQ ID NO: 650718 - DNA, 20 bp, Artificial
  CRISPR gRNA sequence
cagcttcaatgataatgaga

SEQ ID NO: 650719 - DNA, 20 bp, Artificial
  CRISPR gRNA sequence
caatgataatgagagcaatg

SEQ ID NO: 650720 - DNA, 20 bp, Artificial
  CRISPR gRNA sequence
aatgataatgagagcaatga

SEQ ID NO: 650721 - DNA, 20 bp, Artificial
  CRISPR gRNA sequence
atttattagaacgtgacttc

SEQ ID NO: 650722 - DNA, 20 bp, Artificial
  CRISPR gRNA sequence
attagaacgtgacttcacac

SEQ ID NO: 650723 - DNA, 20 bp, Artificial
  CRISPR gRNA sequence
ttagaacgtgacttcacact

SEQ ID NO: 650724 - DNA, 20 bp, Artificial
  CRISPR gRNA sequence
gaacgtgacttcacactgat

SEQ ID NO: 650725 - DNA, 20 bp, Artificial
  CRISPR gRNA sequence
cacactgattaattatacac

SEQ ID NO: 650726 - DNA, 20 bp, Artificial
  CRISPR gRNA sequence
acactgattaattatacact

SEQ ID NO: 650727 - DNA, 20 bp, Artificial
  CRISPR gRNA sequence
attaattatacactcatcaa

SEQ ID NO: 650728 - DNA, 20 bp, Artificial
  CRISPR gRNA sequence
attatacactcatcaaaata

SEQ ID NO: 650729 - DNA, 20 bp, Artificial
  CRISPR gRNA sequence
tacactcatcaaaatatctg

SEQ ID NO: 650730 - DNA, 20 bp, Artificial
  CRISPR gRNA sequence
atcaaaatatctggagtgca

SEQ ID NO: 650731 - DNA, 20 bp, Artificial
  CRISPR gRNA sequence
gagtgcataagaaaagctaa

SEQ ID NO: 650732 - DNA, 20 bp, Artificial
  CRISPR gRNA sequence
attgaagcattccatcttgt

SEQ ID NO: 650733 - DNA, 20 bp, Artificial
  CRISPR gRNA sequence
aagcattccatcttgtacat

SEQ ID NO: 650734 - DNA, 20 bp, Artificial
  CRISPR gRNA sequence
catcttgtacatgctactaa

SEQ ID NO: 650735 - DNA, 20 bp, Artificial
  CRISPR gRNA sequence
gtacatgctactaaaaacag

SEQ ID NO: 650736 - DNA, 20 bp, Artificial
  CRISPR gRNA sequence
tacatgctactaaaaacagt

SEQ ID NO: 650737 - DNA, 20 bp, Artificial
  CRISPR gRNA sequence
ctaaaaacagtttaagtgat

SEQ ID NO: 650738 - DNA, 20 bp, Artificial
  CRISPR gRNA sequence
aaaacagtttaagtgatgga

SEQ ID NO: 650739 - DNA, 20 bp, Artificial
  CRISPR gRNA sequence
aagtgatggagaactggctt

SEQ ID NO: 650740 - DNA, 20 bp, Artificial
  CRISPR gRNA sequence
agtgatggagaactggcttt

SEQ ID NO: 650741 - DNA, 20 bp, Artificial
  CRISPR gRNA sequence
gctttaaaattacaagtata

SEQ ID NO: 650742 - DNA, 20 bp, Artificial
  CRISPR gRNA sequence
taaaattacaagtatatgga

SEQ ID NO: 650743 - DNA, 20 bp, Artificial
  CRISPR gRNA sequence
aaaattacaagtatatggaa

SEQ ID NO: 650744 - DNA, 20 bp, Artificial
  CRISPR gRNA sequence
aaattacaagtatatggaat

SEQ ID NO: 650745 - DNA, 20 bp, Artificial
  CRISPR gRNA sequence
caagtatatggaattaaatc

SEQ ID NO: 650746 - DNA, 20 bp, Artificial
  CRISPR gRNA sequence
aatctgtaaccttaaatgtg

SEQ ID NO: 650747 - DNA, 20 bp, Artificial
  CRISPR gRNA sequence
taaccttaaatgtgctatat

SEQ ID NO: 650748 - DNA, 20 bp, Artificial
  CRISPR gRNA sequence
aaatgtgctatatcaagata

SEQ ID NO: 650749 - DNA, 20 bp, Artificial
  CRISPR gRNA sequence
aatgtgctatatcaagatat

SEQ ID NO: 650750 - DNA, 20 bp, Artificial
  CRISPR gRNA sequence
tatcaagatattaatagtag

SEQ ID NO: 650751 - DNA, 20 bp, Artificial
  CRISPR gRNA sequence
atagtagtaatgaagatgat

SEQ ID NO: 650752 - DNA, 20 bp, Artificial
  CRISPR gRNA sequence
cattaacattcatgtggatt

SEQ ID NO: 650753 - DNA, 20 bp, Artificial
  CRISPR gRNA sequence
acattcatgtggattccact

SEQ ID NO: 650754 - DNA, 20 bp, Artificial
  CRISPR gRNA sequence
atgtggattccactgaacat

SEQ ID NO: 650755 - DNA, 20 bp, Artificial
  CRISPR gRNA sequence
cactgaacatggttgtatag

SEQ ID NO: 650756 - DNA, 20 bp, Artificial
  CRISPR gRNA sequence
aacatggttgtatagaatca

SEQ ID NO: 650757 - DNA, 20 bp, Artificial
  CRISPR gRNA sequence
tatagaatcagaaaacataa

SEQ ID NO: 650758 - DNA, 20 bp, Artificial
  CRISPR gRNA sequence
tttagaaacttagagatcag

SEQ ID NO: 650759 - DNA, 20 bp, Artificial
  CRISPR gRNA sequence
agaaacttagagatcagctt

SEQ ID NO: 650760 - DNA, 20 bp, Artificial
  CRISPR gRNA sequence
gaaacttagagatcagcttt

SEQ ID NO: 650761 - DNA, 20 bp, Artificial
  CRISPR gRNA sequence
agagatcagcttttgggacc

SEQ ID NO: 650762 - DNA, 20 bp, Artificial
  CRISPR gRNA sequence
gagatcagcttttgggacca

SEQ ID NO: 650763 - DNA, 20 bp, Artificial
  CRISPR gRNA sequence
ttgggaccaatttgaagatt

SEQ ID NO: 650764 - DNA, 20 bp, Artificial
  CRISPR gRNA sequence
tgggaccaatttgaagatta

SEQ ID NO: 650765 - DNA, 20 bp, Artificial
  CRISPR gRNA sequence
gggaccaatttgaagattac

SEQ ID NO: 650766 - DNA, 20 bp, Artificial
  CRISPR gRNA sequence
ggaccaatttgaagattaca

SEQ ID NO: 650767 - DNA, 20 bp, Artificial
  CRISPR gRNA sequence
gaagattacaaaatcttttt

SEQ ID NO: 650768 - DNA, 20 bp, Artificial
  CRISPR gRNA sequence
aagattacaaaatctttttc

SEQ ID NO: 650769 - DNA, 20 bp, Artificial
  CRISPR gRNA sequence
caaaatctttttcagagtga

SEQ ID NO: 650770 - DNA, 20 bp, Artificial
  CRISPR gRNA sequence
tttcagagtgagacattata

SEQ ID NO: 650771 - DNA, 20 bp, Artificial
  CRISPR gRNA sequence
ttcagagtgagacattataa

SEQ ID NO: 650772 - DNA, 20 bp, Artificial
  CRISPR gRNA sequence
tcagagtgagacattataaa

SEQ ID NO: 650773 - DNA, 20 bp, Artificial
  CRISPR gRNA sequence
cagagtgagacattataaaa

SEQ ID NO: 650774 - DNA, 20 bp, Artificial
  CRISPR gRNA sequence
agagtgagacattataaaaa

SEQ ID NO: 650775 - DNA, 20 bp, Artificial
  CRISPR gRNA sequence
taaaaataacacatccccaa

SEQ ID NO: 650776 - DNA, 20 bp, Artificial
  CRISPR gRNA sequence
ggatttttggattatttcaa

SEQ ID NO: 650777 - DNA, 20 bp, Artificial
  CRISPR gRNA sequence
ttggattatttcaacaacta

SEQ ID NO: 650778 - DNA, 20 bp, Artificial
  CRISPR gRNA sequence
tggattatttcaacaactaa

SEQ ID NO: 650779 - DNA, 20 bp, Artificial
  CRISPR gRNA sequence
ggattatttcaacaactaag

SEQ ID NO: 650780 - DNA, 20 bp, Artificial
  CRISPR gRNA sequence
gattatttcaacaactaaga

SEQ ID NO: 650781 - DNA, 20 bp, Artificial
  CRISPR gRNA sequence
tttcaacaactaagaaatca

SEQ ID NO: 650782 - DNA, 20 bp, Artificial
  CRISPR gRNA sequence
caacaactaagaaatcaagt

SEQ ID NO: 650783 - DNA, 20 bp, Artificial
  CRISPR gRNA sequence
aacaactaagaaatcaagtt

SEQ ID NO: 650784 - DNA, 20 bp, Artificial
  CRISPR gRNA sequence
agaaatcaagtttccaaatt

SEQ ID NO: 650785 - DNA, 20 bp, Artificial
  CRISPR gRNA sequence
ccaaattttttcaagtagat

SEQ ID NO: 650786 - DNA, 20 bp, Artificial
  CRISPR gRNA sequence
caaattttttcaagtagatc

SEQ ID NO: 650787 - DNA, 20 bp, Artificial
  CRISPR gRNA sequence
tttcaagtagatcagaagca

SEQ ID NO: 650788 - DNA, 20 bp, Artificial
  CRISPR gRNA sequence
ttcaagtagatcagaagcat

SEQ ID NO: 650789 - DNA, 20 bp, Artificial
  CRISPR gRNA sequence
tcaagtagatcagaagcata

SEQ ID NO: 650790 - DNA, 20 bp, Artificial
  CRISPR gRNA sequence
caagtagatcagaagcatac

SEQ ID NO: 650791 - DNA, 20 bp, Artificial
  CRISPR gRNA sequence
aagtagatcagaagcatact

SEQ ID NO: 650792 - DNA, 20 bp, Artificial
  CRISPR gRNA sequence
tttaaacagacatatgtaat

SEQ ID NO: 650793 - DNA, 20 bp, Artificial
  CRISPR gRNA sequence
aaacagacatatgtaatatg

SEQ ID NO: 650794 - DNA, 20 bp, Artificial
  CRISPR gRNA sequence
aacagacatatgtaatatgc

SEQ ID NO: 650795 - DNA, 20 bp, Artificial
  CRISPR gRNA sequence
atcttaagtattttcttcat

SEQ ID NO: 650796 - DNA, 20 bp, Artificial
  CRISPR gRNA sequence
aagtattttcttcattcaac

SEQ ID NO: 650797 - DNA, 20 bp, Artificial
  CRISPR gRNA sequence
agtattttcttcattcaaca

SEQ ID NO: 650798 - DNA, 20 bp, Artificial
  CRISPR gRNA sequence
tcttcattcaacaaatattt

SEQ ID NO: 650799 - DNA, 20 bp, Artificial
  CRISPR gRNA sequence
cttcattcaacaaatattta

SEQ ID NO: 650800 - DNA, 20 bp, Artificial
  CRISPR gRNA sequence
ttcattcaacaaatatttac

SEQ ID NO: 650801 - DNA, 20 bp, Artificial
  CRISPR gRNA sequence
cattcaacaaatatttacag

SEQ ID NO: 650802 - DNA, 20 bp, Artificial
  CRISPR gRNA sequence
attcaacaaatatttacagg

SEQ ID NO: 650803 - DNA, 20 bp, Artificial
  CRISPR gRNA sequence
aacaaatatttacagggctc

SEQ ID NO: 650804 - DNA, 20 bp, Artificial
  CRISPR gRNA sequence
acagggctcctacaatgcat

SEQ ID NO: 650805 - DNA, 20 bp, Artificial
  CRISPR gRNA sequence
cagggctcctacaatgcata

SEQ ID NO: 650806 - DNA, 20 bp, Artificial
  CRISPR gRNA sequence
ctacaatgcatacaatgcat

SEQ ID NO: 650807 - DNA, 20 bp, Artificial
  CRISPR gRNA sequence
caatgcatacaatgcatatg

SEQ ID NO: 650808 - DNA, 20 bp, Artificial
  CRISPR gRNA sequence
gggatgaagagatatgacca

SEQ ID NO: 650809 - DNA, 20 bp, Artificial
  CRISPR gRNA sequence
tccccaaagattcacatctg

SEQ ID NO: 650810 - DNA, 20 bp, Artificial
  CRISPR gRNA sequence
ccccaaagattcacatctgg

SEQ ID NO: 650811 - DNA, 20 bp, Artificial
  CRISPR gRNA sequence
cccaaagattcacatctgga

SEQ ID NO: 650812 - DNA, 20 bp, Artificial
  CRISPR gRNA sequence
acatctggaaaacctgatta

SEQ ID NO: 650813 - DNA, 20 bp, Artificial
  CRISPR gRNA sequence
gaaaacctgattaatttctt

SEQ ID NO: 650814 - DNA, 20 bp, Artificial
  CRISPR gRNA sequence
attaatttctttataatcaa

SEQ ID NO: 650815 - DNA, 20 bp, Artificial
  CRISPR gRNA sequence
atttctttataatcaaggtg

SEQ ID NO: 650816 - DNA, 20 bp, Artificial
  CRISPR gRNA sequence
ctttataatcaaggtgtggc

SEQ ID NO: 650817 - DNA, 20 bp, Artificial
  CRISPR gRNA sequence
tttataatcaaggtgtggcc

SEQ ID NO: 650818 - DNA, 20 bp, Artificial
  CRISPR gRNA sequence
tataatcaaggtgtggccca

SEQ ID NO: 650819 - DNA, 20 bp, Artificial
  CRISPR gRNA sequence
ataatcaaggtgtggcccac

SEQ ID NO: 650820 - DNA, 20 bp, Artificial
  CRISPR gRNA sequence
taatcaaggtgtggcccaca

SEQ ID NO: 650821 - DNA, 20 bp, Artificial
  CRISPR gRNA sequence
tatgctttgaaaagttactt

SEQ ID NO: 650822 - DNA, 20 bp, Artificial
  CRISPR gRNA sequence
tgaaaagttacttaattcac

SEQ ID NO: 650823 - DNA, 20 bp, Artificial
  CRISPR gRNA sequence
gaaaagttacttaattcaca

SEQ ID NO: 650824 - DNA, 20 bp, Artificial
  CRISPR gRNA sequence
aaaagttacttaattcacac

SEQ ID NO: 650825 - DNA, 20 bp, Artificial
  CRISPR gRNA sequence
cttaattcacactcagtaat

SEQ ID NO: 650826 - DNA, 20 bp, Artificial
  CRISPR gRNA sequence
aattcacactcagtaattaa

SEQ ID NO: 650827 - DNA, 20 bp, Artificial
  CRISPR gRNA sequence
attcacactcagtaattaag

SEQ ID NO: 650828 - DNA, 20 bp, Artificial
  CRISPR gRNA sequence
acactcagtaattaagacag

SEQ ID NO: 650829 - DNA, 20 bp, Artificial
  CRISPR gRNA sequence
agtaattaagacagctttcc

SEQ ID NO: 650830 - DNA, 20 bp, Artificial
  CRISPR gRNA sequence
agacagctttcctactaact

SEQ ID NO: 650831 - DNA, 20 bp, Artificial
  CRISPR gRNA sequence
tcctactaactaacatgaaa

SEQ ID NO: 650832 - DNA, 20 bp, Artificial
  CRISPR gRNA sequence
cctactaactaacatgaaat

SEQ ID NO: 650833 - DNA, 20 bp, Artificial
  CRISPR gRNA sequence
ctactaactaacatgaaata

SEQ ID NO: 650834 - DNA, 20 bp, Artificial
  CRISPR gRNA sequence
ctaactaacatgaaatacaa

SEQ ID NO: 650835 - DNA, 20 bp, Artificial
  CRISPR gRNA sequence
actaacatgaaatacaacag

SEQ ID NO: 650836 - DNA, 20 bp, Artificial
  CRISPR gRNA sequence
acatgaaatacaacagtttg

SEQ ID NO: 650837 - DNA, 20 bp, Artificial
  CRISPR gRNA sequence
gctataaaatctcatttgat

SEQ ID NO: 650838 - DNA, 20 bp, Artificial
  CRISPR gRNA sequence
ctataaaatctcatttgatg

SEQ ID NO: 650839 - DNA, 20 bp, Artificial
  CRISPR gRNA sequence
taaaatctcatttgatgcgg

SEQ ID NO: 650840 - DNA, 20 bp, Artificial
  CRISPR gRNA sequence
atttgatgcggtcagatcac

SEQ ID NO: 650841 - DNA, 20 bp, Artificial
  CRISPR gRNA sequence
gatgcggtcagatcacttca

SEQ ID NO: 650842 - DNA, 20 bp, Artificial
  CRISPR gRNA sequence
atgcggtcagatcacttcaa

SEQ ID NO: 650843 - DNA, 20 bp, Artificial
  CRISPR gRNA sequence
caataatttcatgagactgg

SEQ ID NO: 650844 - DNA, 20 bp, Artificial
  CRISPR gRNA sequence
aataatttcatgagactggt

SEQ ID NO: 650845 - DNA, 20 bp, Artificial
  CRISPR gRNA sequence
catgagactggtttggtgtt

SEQ ID NO: 650846 - DNA, 20 bp, Artificial
  CRISPR gRNA sequence
atgagactggtttggtgttt

SEQ ID NO: 650847 - DNA, 20 bp, Artificial
  CRISPR gRNA sequence
gtttggtgttttttttcctt

SEQ ID NO: 650848 - DNA, 20 bp, Artificial
  CRISPR gRNA sequence
ggtgttttttttccttctga

SEQ ID NO: 650849 - DNA, 20 bp, Artificial
  CRISPR gRNA sequence
gtgttttttttccttctgac

SEQ ID NO: 650850 - DNA, 20 bp, Artificial
  CRISPR gRNA sequence
tttttccttctgacctataa

SEQ ID NO: 650851 - DNA, 20 bp, Artificial
  CRISPR gRNA sequence
ttttccttctgacctataaa

SEQ ID NO: 650852 - DNA, 20 bp, Artificial
  CRISPR gRNA sequence
tttccttctgacctataaac

SEQ ID NO: 650853 - DNA, 20 bp, Artificial
  CRISPR gRNA sequence
ttccttctgacctataaact

SEQ ID NO: 650854 - DNA, 20 bp, Artificial
  CRISPR gRNA sequence
tccttctgacctataaactg

SEQ ID NO: 650855 - DNA, 20 bp, Artificial
  CRISPR gRNA sequence
ccttctgacctataaactgg

SEQ ID NO: 650856 - DNA, 20 bp, Artificial
  CRISPR gRNA sequence
cttctgacctataaactgga

SEQ ID NO: 650857 - DNA, 20 bp, Artificial
  CRISPR gRNA sequence
ctgacctataaactggaagt

SEQ ID NO: 650858 - DNA, 20 bp, Artificial
  CRISPR gRNA sequence
tgacctataaactggaagtg

SEQ ID NO: 650859 - DNA, 20 bp, Artificial
  CRISPR gRNA sequence
acctataaactggaagtgcc

SEQ ID NO: 650860 - DNA, 20 bp, Artificial
  CRISPR gRNA sequence
taaactggaagtgcctctat

SEQ ID NO: 650861 - DNA, 20 bp, Artificial
  CRISPR gRNA sequence
gaagtgcctctatatcacca

SEQ ID NO: 650862 - DNA, 20 bp, Artificial
  CRISPR gRNA sequence
tatatcaccagctaacttaa

SEQ ID NO: 650863 - DNA, 20 bp, Artificial
  CRISPR gRNA sequence
tatcaccagctaacttaagg

SEQ ID NO: 650864 - DNA, 20 bp, Artificial
  CRISPR gRNA sequence
acttaaggatctttcctagg

SEQ ID NO: 650865 - DNA, 20 bp, Artificial
  CRISPR gRNA sequence
aaggatctttcctaggtggt

SEQ ID NO: 650866 - DNA, 20 bp, Artificial
  CRISPR gRNA sequence
aggatctttcctaggtggta

SEQ ID NO: 650867 - DNA, 20 bp, Artificial
  CRISPR gRNA sequence
tcctaggtggtagtgctatt

SEQ ID NO: 650868 - DNA, 20 bp, Artificial
  CRISPR gRNA sequence
cctaggtggtagtgctattt

SEQ ID NO: 650869 - DNA, 20 bp, Artificial
  CRISPR gRNA sequence
ctaggtggtagtgctatttt

SEQ ID NO: 650870 - DNA, 20 bp, Artificial
  CRISPR gRNA sequence
ggtggtagtgctattttcca

SEQ ID NO: 650871 - DNA, 20 bp, Artificial
  CRISPR gRNA sequence
ttttccatcttcatctaaaa

SEQ ID NO: 650872 - DNA, 20 bp, Artificial
  CRISPR gRNA sequence
tccatcttcatctaaaatag

SEQ ID NO: 650873 - DNA, 20 bp, Artificial
  CRISPR gRNA sequence
ccatcttcatctaaaataga

SEQ ID NO: 650874 - DNA, 20 bp, Artificial
  CRISPR gRNA sequence
catcttcatctaaaatagat

SEQ ID NO: 650875 - DNA, 20 bp, Artificial
  CRISPR gRNA sequence
catctaaaatagatattaag

SEQ ID NO: 650876 - DNA, 20 bp, Artificial
  CRISPR gRNA sequence
atctaaaatagatattaaga

SEQ ID NO: 650877 - DNA, 20 bp, Artificial
  CRISPR gRNA sequence
aaatagatattaagaactct

SEQ ID NO: 650878 - DNA, 20 bp, Artificial
  CRISPR gRNA sequence
agaactcttaaactgctgac

SEQ ID NO: 650879 - DNA, 20 bp, Artificial
  CRISPR gRNA sequence
ttaaactgctgaccacatca

SEQ ID NO: 650880 - DNA, 20 bp, Artificial
  CRISPR gRNA sequence
aaactgctgaccacatcagc

SEQ ID NO: 650881 - DNA, 20 bp, Artificial
  CRISPR gRNA sequence
aactgctgaccacatcagct

SEQ ID NO: 650882 - DNA, 20 bp, Artificial
  CRISPR gRNA sequence
ctgaccacatcagctgtcga

SEQ ID NO: 650883 - DNA, 20 bp, Artificial
  CRISPR gRNA sequence
accacatcagctgtcgagat

SEQ ID NO: 650884 - DNA, 20 bp, Artificial
  CRISPR gRNA sequence
tcgagatttctgtgaatgga

SEQ ID NO: 650885 - DNA, 20 bp, Artificial
  CRISPR gRNA sequence
ctgtgaatggaagttcgaat

SEQ ID NO: 650886 - DNA, 20 bp, Artificial
  CRISPR gRNA sequence
tgtgaatggaagttcgaatt

SEQ ID NO: 650887 - DNA, 20 bp, Artificial
  CRISPR gRNA sequence
tgaatggaagttcgaattta

SEQ ID NO: 650888 - DNA, 20 bp, Artificial
  CRISPR gRNA sequence
gaatttatggcaatagtagt

SEQ ID NO: 650889 - DNA, 20 bp, Artificial
  CRISPR gRNA sequence
atggcaatagtagttgaagg

SEQ ID NO: 650890 - DNA, 20 bp, Artificial
  CRISPR gRNA sequence
tggcaatagtagttgaagga

SEQ ID NO: 650891 - DNA, 20 bp, Artificial
  CRISPR gRNA sequence
aaggaagtatcctttatggg

SEQ ID NO: 650892 - DNA, 20 bp, Artificial
  CRISPR gRNA sequence
tatgggcactataagattgt

SEQ ID NO: 650893 - DNA, 20 bp, Artificial
  CRISPR gRNA sequence
atgggcactataagattgtc

SEQ ID NO: 650894 - DNA, 20 bp, Artificial
  CRISPR gRNA sequence
tgggcactataagattgtct

SEQ ID NO: 650895 - DNA, 20 bp, Artificial
  CRISPR gRNA sequence
taagattgtcttcataaagt

SEQ ID NO: 650896 - DNA, 20 bp, Artificial
  CRISPR gRNA sequence
tcttcataaagttaggctat

SEQ ID NO: 650897 - DNA, 20 bp, Artificial
  CRISPR gRNA sequence
cataaagttaggctataaaa

SEQ ID NO: 650898 - DNA, 20 bp, Artificial
  CRISPR gRNA sequence
ataaagttaggctataaaat

SEQ ID NO: 650899 - DNA, 20 bp, Artificial
  CRISPR gRNA sequence
ggctataaaatcaacatttt

SEQ ID NO: 650900 - DNA, 20 bp, Artificial
  CRISPR gRNA sequence
taaaatcaacattttacaaa

SEQ ID NO: 650901 - DNA, 20 bp, Artificial
  CRISPR gRNA sequence
tacaaattaaagcagaaata

SEQ ID NO: 650902 - DNA, 20 bp, Artificial
  CRISPR gRNA sequence
acaaattaaagcagaaatat

SEQ ID NO: 650903 - DNA, 20 bp, Artificial
  CRISPR gRNA sequence
caaattaaagcagaaatata

SEQ ID NO: 650904 - DNA, 20 bp, Artificial
  CRISPR gRNA sequence
aagcagaaatataaatcaca

SEQ ID NO: 650905 - DNA, 20 bp, Artificial
  CRISPR gRNA sequence
aagaaaatgaatggatctca

SEQ ID NO: 650906 - DNA, 20 bp, Artificial
  CRISPR gRNA sequence
aggccagaaagaactcgtcg

SEQ ID NO: 650907 - DNA, 20 bp, Artificial
  CRISPR gRNA sequence
gtcgtaacctgattgtatgt

SEQ ID NO: 650908 - DNA, 20 bp, Artificial
  CRISPR gRNA sequence
attgtatgtattaatatagg

SEQ ID NO: 650909 - DNA, 20 bp, Artificial
  CRISPR gRNA sequence
tatgtattaatataggttac

SEQ ID NO: 650910 - DNA, 20 bp, Artificial
  CRISPR gRNA sequence
atataggttacagactgaat

SEQ ID NO: 650911 - DNA, 20 bp, Artificial
  CRISPR gRNA sequence
cagactgaatctgggggatt

SEQ ID NO: 650912 - DNA, 20 bp, Artificial
  CRISPR gRNA sequence
aatctgggggatttagccta

SEQ ID NO: 650913 - DNA, 20 bp, Artificial
  CRISPR gRNA sequence
ggggatttagcctaggaagc

SEQ ID NO: 650914 - DNA, 20 bp, Artificial
  CRISPR gRNA sequence
agcctaggaagccaagggga

SEQ ID NO: 650915 - DNA, 20 bp, Artificial
  CRISPR gRNA sequence
gcctaggaagccaaggggaa

SEQ ID NO: 650916 - DNA, 20 bp, Artificial
  CRISPR gRNA sequence
ggaagccaaggggaaaaaaa

SEQ ID NO: 650917 - DNA, 20 bp, Artificial
  CRISPR gRNA sequence
agaagtattttggttgaact

SEQ ID NO: 650918 - DNA, 20 bp, Artificial
  CRISPR gRNA sequence
tggttgaactagggaatcta

SEQ ID NO: 650919 - DNA, 20 bp, Artificial
  CRISPR gRNA sequence
ggttgaactagggaatctaa

SEQ ID NO: 650920 - DNA, 20 bp, Artificial
  CRISPR gRNA sequence
gttgaactagggaatctaaa

SEQ ID NO: 650921 - DNA, 20 bp, Artificial
  CRISPR gRNA sequence
aactagggaatctaaatcca

SEQ ID NO: 650922 - DNA, 20 bp, Artificial
  CRISPR gRNA sequence
gggaatctaaatccatgtcc

SEQ ID NO: 650923 - DNA, 20 bp, Artificial
  CRISPR gRNA sequence
aatccatgtccattaaaagg

SEQ ID NO: 650924 - DNA, 20 bp, Artificial
  CRISPR gRNA sequence
aaaggagagggaactggaca

SEQ ID NO: 650925 - DNA, 20 bp, Artificial
  CRISPR gRNA sequence
gacaaaggacttcaaccata

SEQ ID NO: 650926 - DNA, 20 bp, Artificial
  CRISPR gRNA sequence
caaccataattatccaaata

SEQ ID NO: 650927 - DNA, 20 bp, Artificial
  CRISPR gRNA sequence
aaccataattatccaaatag

SEQ ID NO: 650928 - DNA, 20 bp, Artificial
  CRISPR gRNA sequence
tccaaatagcaatgctatct

SEQ ID NO: 650929 - DNA, 20 bp, Artificial
  CRISPR gRNA sequence
tctctattgtgatgctgaat

SEQ ID NO: 650930 - DNA, 20 bp, Artificial
  CRISPR gRNA sequence
tattgtgatgctgaatatat

SEQ ID NO: 650931 - DNA, 20 bp, Artificial
  CRISPR gRNA sequence
ttgtgatgctgaatatatta

SEQ ID NO: 650932 - DNA, 20 bp, Artificial
  CRISPR gRNA sequence
tgatgctgaatatattaggt

SEQ ID NO: 650933 - DNA, 20 bp, Artificial
  CRISPR gRNA sequence
aatatattaggttctcttag

SEQ ID NO: 650934 - DNA, 20 bp, Artificial
  CRISPR gRNA sequence
ggttctcttagtctaatgcc

SEQ ID NO: 650935 - DNA, 20 bp, Artificial
  CRISPR gRNA sequence
tcttagtctaatgccattaa

SEQ ID NO: 650936 - DNA, 20 bp, Artificial
  CRISPR gRNA sequence
ttagtctaatgccattaaac

SEQ ID NO: 650937 - DNA, 20 bp, Artificial
  CRISPR gRNA sequence
agtctaatgccattaaacat

SEQ ID NO: 650938 - DNA, 20 bp, Artificial
  CRISPR gRNA sequence
gtctaatgccattaaacatt

SEQ ID NO: 650939 - DNA, 20 bp, Artificial
  CRISPR gRNA sequence
atgccattaaacatttgaat

SEQ ID NO: 650940 - DNA, 20 bp, Artificial
  CRISPR gRNA sequence
aacatttgaattatataact

SEQ ID NO: 650941 - DNA, 20 bp, Artificial
  CRISPR gRNA sequence
gaattatataactaactccc

SEQ ID NO: 650942 - DNA, 20 bp, Artificial
  CRISPR gRNA sequence
aattatataactaactccct

SEQ ID NO: 650943 - DNA, 20 bp, Artificial
  CRISPR gRNA sequence
tataactaactccctttatt

SEQ ID NO: 650944 - DNA, 20 bp, Artificial
  CRISPR gRNA sequence
actccctttattcagattcc

SEQ ID NO: 650945 - DNA, 20 bp, Artificial
  CRISPR gRNA sequence
cctttattcagattccttgc

SEQ ID NO: 650946 - DNA, 20 bp, Artificial
  CRISPR gRNA sequence
tattcagattccttgctcag

SEQ ID NO: 650947 - DNA, 20 bp, Artificial
  CRISPR gRNA sequence
attcagattccttgctcagt

SEQ ID NO: 650948 - DNA, 20 bp, Artificial
  CRISPR gRNA sequence
ttcagattccttgctcagta

SEQ ID NO: 650949 - DNA, 20 bp, Artificial
  CRISPR gRNA sequence
agattccttgctcagtaaat

SEQ ID NO: 650950 - DNA, 20 bp, Artificial
  CRISPR gRNA sequence
cttgctcagtaaatgacctt

SEQ ID NO: 650951 - DNA, 20 bp, Artificial
  CRISPR gRNA sequence
gctcagtaaatgacctttac

SEQ ID NO: 650952 - DNA, 20 bp, Artificial
  CRISPR gRNA sequence
ctcagtaaatgacctttact

SEQ ID NO: 650953 - DNA, 20 bp, Artificial
  CRISPR gRNA sequence
agtaaatgacctttactgat

SEQ ID NO: 650954 - DNA, 20 bp, Artificial
  CRISPR gRNA sequence
tactgattacccatataggt

SEQ ID NO: 650955 - DNA, 20 bp, Artificial
  CRISPR gRNA sequence
actgattacccatataggtc

SEQ ID NO: 650956 - DNA, 20 bp, Artificial
  CRISPR gRNA sequence
ctgattacccatataggtca

SEQ ID NO: 650957 - DNA, 20 bp, Artificial
  CRISPR gRNA sequence
attacccatataggtcagtt

SEQ ID NO: 650958 - DNA, 20 bp, Artificial
  CRISPR gRNA sequence
cccatataggtcagttcaca

SEQ ID NO: 650959 - DNA, 20 bp, Artificial
  CRISPR gRNA sequence
acaagaacaaaatgatctag

SEQ ID NO: 650960 - DNA, 20 bp, Artificial
  CRISPR gRNA sequence
gtcaagccaactggagtgat

SEQ ID NO: 650961 - DNA, 20 bp, Artificial
  CRISPR gRNA sequence
gagtgatccagctcctatgt

SEQ ID NO: 650962 - DNA, 20 bp, Artificial
  CRISPR gRNA sequence
ctatgtttgttggttgcatg

SEQ ID NO: 650963 - DNA, 20 bp, Artificial
  CRISPR gRNA sequence
tgtttgttggttgcatgtgt

SEQ ID NO: 650964 - DNA, 20 bp, Artificial
  CRISPR gRNA sequence
gttggttgcatgtgtgtgtg

SEQ ID NO: 650965 - DNA, 20 bp, Artificial
  CRISPR gRNA sequence
ttggttgcatgtgtgtgtgt

SEQ ID NO: 650966 - DNA, 20 bp, Artificial
  CRISPR gRNA sequence
gttgcatgtgtgtgtgtgtg

SEQ ID NO: 650967 - DNA, 20 bp, Artificial
  CRISPR gRNA sequence
catgtgtgtgtgtgtgtgct

SEQ ID NO: 650968 - DNA, 20 bp, Artificial
  CRISPR gRNA sequence
tatttttaatcaatatctaa

SEQ ID NO: 650969 - DNA, 20 bp, Artificial
  CRISPR gRNA sequence
atttttaatcaatatctaaa

SEQ ID NO: 650970 - DNA, 20 bp, Artificial
  CRISPR gRNA sequence
tttttaatcaatatctaaac

SEQ ID NO: 650971 - DNA, 20 bp, Artificial
  CRISPR gRNA sequence
ttaatcaatatctaaacata

SEQ ID NO: 650972 - DNA, 20 bp, Artificial
  CRISPR gRNA sequence
taatcaatatctaaacataa

SEQ ID NO: 650973 - DNA, 20 bp, Artificial
  CRISPR gRNA sequence
aatcaatatctaaacataaa

SEQ ID NO: 650974 - DNA, 20 bp, Artificial
  CRISPR gRNA sequence
atcaatatctaaacataaat

SEQ ID NO: 650975 - DNA, 20 bp, Artificial
  CRISPR gRNA sequence
aacataaattggcattctga

SEQ ID NO: 650976 - DNA, 20 bp, Artificial
  CRISPR gRNA sequence
gcattctgattttaaatatc

SEQ ID NO: 650977 - DNA, 20 bp, Artificial
  CRISPR gRNA sequence
tgattttaaatatcagtttt

SEQ ID NO: 650978 - DNA, 20 bp, Artificial
  CRISPR gRNA sequence
attttaaatatcagttttgt

SEQ ID NO: 650979 - DNA, 20 bp, Artificial
  CRISPR gRNA sequence
taaatatcagttttgtaaac

SEQ ID NO: 650980 - DNA, 20 bp, Artificial
  CRISPR gRNA sequence
aaatatcagttttgtaaacc

SEQ ID NO: 650981 - DNA, 20 bp, Artificial
  CRISPR gRNA sequence
aatatcagttttgtaaacct

SEQ ID NO: 650982 - DNA, 20 bp, Artificial
  CRISPR gRNA sequence
tgtaaacctgtttaatgtca

SEQ ID NO: 650983 - DNA, 20 bp, Artificial
  CRISPR gRNA sequence
gtaaacctgtttaatgtcag

SEQ ID NO: 650984 - DNA, 20 bp, Artificial
  CRISPR gRNA sequence
taaacctgtttaatgtcagt

SEQ ID NO: 650985 - DNA, 20 bp, Artificial
  CRISPR gRNA sequence
tttaatgtcagtcaaccttg

SEQ ID NO: 650986 - DNA, 20 bp, Artificial
  CRISPR gRNA sequence
aatgtcagtcaaccttgaga

SEQ ID NO: 650987 - DNA, 20 bp, Artificial
  CRISPR gRNA sequence
atgtcagtcaaccttgagat

SEQ ID NO: 650988 - DNA, 20 bp, Artificial
  CRISPR gRNA sequence
gagatacagatccactctaa

SEQ ID NO: 650989 - DNA, 20 bp, Artificial
  CRISPR gRNA sequence
agatacagatccactctaag

SEQ ID NO: 650990 - DNA, 20 bp, Artificial
  CRISPR gRNA sequence
taagtgtgccacaaatctag

SEQ ID NO: 650991 - DNA, 20 bp, Artificial
  CRISPR gRNA sequence
agtgtgccacaaatctagtt

SEQ ID NO: 650992 - DNA, 20 bp, Artificial
  CRISPR gRNA sequence
gtttcagaacttgcaaggat

SEQ ID NO: 650993 - DNA, 20 bp, Artificial
  CRISPR gRNA sequence
cagaacttgcaaggatgagt

SEQ ID NO: 650994 - DNA, 20 bp, Artificial
  CRISPR gRNA sequence
agaacttgcaaggatgagtg

SEQ ID NO: 650995 - DNA, 20 bp, Artificial
  CRISPR gRNA sequence
gcaaggatgagtgccaaatc

SEQ ID NO: 650996 - DNA, 20 bp, Artificial
  CRISPR gRNA sequence
caaggatgagtgccaaatcc

SEQ ID NO: 650997 - DNA, 20 bp, Artificial
  CRISPR gRNA sequence
cattataaataattttgtgg

SEQ ID NO: 650998 - DNA, 20 bp, Artificial
  CRISPR gRNA sequence
taaataattttgtggggaaa

SEQ ID NO: 650999 - DNA, 20 bp, Artificial
  CRISPR gRNA sequence
tgtggggaaatgttatcctc

SEQ ID NO: 651000 - DNA, 20 bp, Artificial
  CRISPR gRNA sequence
gtggggaaatgttatcctct

SEQ ID NO: 651001 - DNA, 20 bp, Artificial
  CRISPR gRNA sequence
tggggaaatgttatcctctg

SEQ ID NO: 651002 - DNA, 20 bp, Artificial
  CRISPR gRNA sequence
tcctctgagaacctatctaa

SEQ ID NO: 651003 - DNA, 20 bp, Artificial
  CRISPR gRNA sequence
tgagaacctatctaagtggc

SEQ ID NO: 651004 - DNA, 20 bp, Artificial
  CRISPR gRNA sequence
agaacctatctaagtggctt

SEQ ID NO: 651005 - DNA, 20 bp, Artificial
  CRISPR gRNA sequence
tctaagtggcttgttgccct

SEQ ID NO: 651006 - DNA, 20 bp, Artificial
  CRISPR gRNA sequence
agtggcttgttgcccttttg

SEQ ID NO: 651007 - DNA, 20 bp, Artificial
  CRISPR gRNA sequence
gttgcccttttgtctgtttc

SEQ ID NO: 651008 - DNA, 20 bp, Artificial
  CRISPR gRNA sequence
ttgcccttttgtctgtttca

SEQ ID NO: 651009 - DNA, 20 bp, Artificial
  CRISPR gRNA sequence
cccttttgtctgtttcactg

SEQ ID NO: 651010 - DNA, 20 bp, Artificial
  CRISPR gRNA sequence
ttgtctgtttcactgtacat

SEQ ID NO: 651011 - DNA, 20 bp, Artificial
  CRISPR gRNA sequence
tgtctgtttcactgtacatc

SEQ ID NO: 651012 - DNA, 20 bp, Artificial
  CRISPR gRNA sequence
gtctgtttcactgtacatcc

SEQ ID NO: 651013 - DNA, 20 bp, Artificial
  CRISPR gRNA sequence
tctgtttcactgtacatcct

SEQ ID NO: 651014 - DNA, 20 bp, Artificial
  CRISPR gRNA sequence
tttcactgtacatcctcaaa

SEQ ID NO: 651015 - DNA, 20 bp, Artificial
  CRISPR gRNA sequence
cactgtacatcctcaaattt

SEQ ID NO: 651016 - DNA, 20 bp, Artificial
  CRISPR gRNA sequence
actgtacatcctcaaattta

SEQ ID NO: 651017 - DNA, 20 bp, Artificial
  CRISPR gRNA sequence
tacatcctcaaatttacaca

SEQ ID NO: 651018 - DNA, 20 bp, Artificial
  CRISPR gRNA sequence
aaatttacacacatttgaaa

SEQ ID NO: 651019 - DNA, 20 bp, Artificial
  CRISPR gRNA sequence
acacacatttgaaaaactct

SEQ ID NO: 651020 - DNA, 20 bp, Artificial
  CRISPR gRNA sequence
cacacatttgaaaaactctt

SEQ ID NO: 651021 - DNA, 20 bp, Artificial
  CRISPR gRNA sequence
gaaaaactcttggaggtaaa

SEQ ID NO: 651022 - DNA, 20 bp, Artificial
  CRISPR gRNA sequence
aaaaactcttggaggtaaaa

SEQ ID NO: 651023 - DNA, 20 bp, Artificial
  CRISPR gRNA sequence
ttggaggtaaaaggtgagaa

SEQ ID NO: 651024 - DNA, 20 bp, Artificial
  CRISPR gRNA sequence
ggaggtaaaaggtgagaagc

SEQ ID NO: 651025 - DNA, 20 bp, Artificial
  CRISPR gRNA sequence
gaggtaaaaggtgagaagca

SEQ ID NO: 651026 - DNA, 20 bp, Artificial
  CRISPR gRNA sequence
attaatctataatggatgta

SEQ ID NO: 651027 - DNA, 20 bp, Artificial
  CRISPR gRNA sequence
atctataatggatgtaagtc

SEQ ID NO: 651028 - DNA, 20 bp, Artificial
  CRISPR gRNA sequence
taatggatgtaagtcacagt

SEQ ID NO: 651029 - DNA, 20 bp, Artificial
  CRISPR gRNA sequence
gcacatcacactcatttact

SEQ ID NO: 651030 - DNA, 20 bp, Artificial
  CRISPR gRNA sequence
atttacttctaaatgcaata

SEQ ID NO: 651031 - DNA, 20 bp, Artificial
  CRISPR gRNA sequence
acttctaaatgcaataagca

SEQ ID NO: 651032 - DNA, 20 bp, Artificial
  CRISPR gRNA sequence
cttctaaatgcaataagcag

SEQ ID NO: 651033 - DNA, 20 bp, Artificial
  CRISPR gRNA sequence
ctaaatgcaataagcagtat

SEQ ID NO: 651034 - DNA, 20 bp, Artificial
  CRISPR gRNA sequence
taaatgcaataagcagtatt

SEQ ID NO: 651035 - DNA, 20 bp, Artificial
  CRISPR gRNA sequence
aatgcaataagcagtattac

SEQ ID NO: 651036 - DNA, 20 bp, Artificial
  CRISPR gRNA sequence
cgatctcacacaaaatatca

SEQ ID NO: 651037 - DNA, 20 bp, Artificial
  CRISPR gRNA sequence
acacaaaatatcaattcatt

SEQ ID NO: 651038 - DNA, 20 bp, Artificial
  CRISPR gRNA sequence
atttggacccttgaagatac

SEQ ID NO: 651039 - DNA, 20 bp, Artificial
  CRISPR gRNA sequence
ggacccttgaagataccatc

SEQ ID NO: 651040 - DNA, 20 bp, Artificial
  CRISPR gRNA sequence
gacccttgaagataccatcc

SEQ ID NO: 651041 - DNA, 20 bp, Artificial
  CRISPR gRNA sequence
gaagataccatccttctcta

SEQ ID NO: 651042 - DNA, 20 bp, Artificial
  CRISPR gRNA sequence
aagataccatccttctctag

SEQ ID NO: 651043 - DNA, 20 bp, Artificial
  CRISPR gRNA sequence
ctctagaaaacaccccaaac

SEQ ID NO: 651044 - DNA, 20 bp, Artificial
  CRISPR gRNA sequence
tctagaaaacaccccaaacc

SEQ ID NO: 651045 - DNA, 20 bp, Artificial
  CRISPR gRNA sequence
tagaaaacaccccaaaccta

SEQ ID NO: 651046 - DNA, 20 bp, Artificial
  CRISPR gRNA sequence
gaaaacaccccaaacctatt

SEQ ID NO: 651047 - DNA, 20 bp, Artificial
  CRISPR gRNA sequence
ttttttgagccccagcacca

SEQ ID NO: 651048 - DNA, 20 bp, Artificial
  CRISPR gRNA sequence
tttgagccccagcaccagca

SEQ ID NO: 651049 - DNA, 20 bp, Artificial
  CRISPR gRNA sequence
ttgagccccagcaccagcaa

SEQ ID NO: 651050 - DNA, 20 bp, Artificial
  CRISPR gRNA sequence
tgagccccagcaccagcaat

SEQ ID NO: 651051 - DNA, 20 bp, Artificial
  CRISPR gRNA sequence
gagccccagcaccagcaatg

SEQ ID NO: 651052 - DNA, 20 bp, Artificial
  CRISPR gRNA sequence
agccccagcaccagcaatgc

SEQ ID NO: 651053 - DNA, 20 bp, Artificial
  CRISPR gRNA sequence
aataaatgtttgctggatca

SEQ ID NO: 651054 - DNA, 20 bp, Artificial
  CRISPR gRNA sequence
ataaatgtttgctggatcaa

SEQ ID NO: 651055 - DNA, 20 bp, Artificial
  CRISPR gRNA sequence
gctggatcaatgatcgaaag

SEQ ID NO: 651056 - DNA, 20 bp, Artificial
  CRISPR gRNA sequence
ctggatcaatgatcgaaaga

SEQ ID NO: 651057 - DNA, 20 bp, Artificial
  CRISPR gRNA sequence
gatcaatgatcgaaagatga

SEQ ID NO: 651058 - DNA, 20 bp, Artificial
  CRISPR gRNA sequence
tctaaggagttctgaatctc

SEQ ID NO: 651059 - DNA, 20 bp, Artificial
  CRISPR gRNA sequence
taaggagttctgaatctcca

SEQ ID NO: 651060 - DNA, 20 bp, Artificial
  CRISPR gRNA sequence
aggagttctgaatctccaca

SEQ ID NO: 651061 - DNA, 20 bp, Artificial
  CRISPR gRNA sequence
tgaatctccacatacaggaa

SEQ ID NO: 651062 - DNA, 20 bp, Artificial
  CRISPR gRNA sequence
aatctccacatacaggaaat

SEQ ID NO: 651063 - DNA, 20 bp, Artificial
  CRISPR gRNA sequence
cacatacaggaaatctcaga

SEQ ID NO: 651064 - DNA, 20 bp, Artificial
  CRISPR gRNA sequence
agaagaagtgtttctagcat

SEQ ID NO: 651065 - DNA, 20 bp, Artificial
  CRISPR gRNA sequence
ctagcattaacattcatttg

SEQ ID NO: 651066 - DNA, 20 bp, Artificial
  CRISPR gRNA sequence
tagcattaacattcatttgg

SEQ ID NO: 651067 - DNA, 20 bp, Artificial
  CRISPR gRNA sequence
gcattaacattcatttggaa

SEQ ID NO: 651068 - DNA, 20 bp, Artificial
  CRISPR gRNA sequence
acattcatttggaattctat

SEQ ID NO: 651069 - DNA, 20 bp, Artificial
  CRISPR gRNA sequence
atttggaattctatggtgtc

SEQ ID NO: 651070 - DNA, 20 bp, Artificial
  CRISPR gRNA sequence
ggaattctatggtgtcttgg

SEQ ID NO: 651071 - DNA, 20 bp, Artificial
  CRISPR gRNA sequence
gaattctatggtgtcttggg

SEQ ID NO: 651072 - DNA, 20 bp, Artificial
  CRISPR gRNA sequence
tatggtgtcttgggtagtca

SEQ ID NO: 651073 - DNA, 20 bp, Artificial
  CRISPR gRNA sequence
tggtgtcttgggtagtcagc

SEQ ID NO: 651074 - DNA, 20 bp, Artificial
  CRISPR gRNA sequence
gggtagtcagcgcttacatt

SEQ ID NO: 651075 - DNA, 20 bp, Artificial
  CRISPR gRNA sequence
ggtagtcagcgcttacattt

SEQ ID NO: 651076 - DNA, 20 bp, Artificial
  CRISPR gRNA sequence
acatttttaagatggaattc

SEQ ID NO: 651077 - DNA, 20 bp, Artificial
  CRISPR gRNA sequence
catttttaagatggaattct

SEQ ID NO: 651078 - DNA, 20 bp, Artificial
  CRISPR gRNA sequence
ttaagatggaattctgtaat

SEQ ID NO: 651079 - DNA, 20 bp, Artificial
  CRISPR gRNA sequence
taagatggaattctgtaata

SEQ ID NO: 651080 - DNA, 20 bp, Artificial
  CRISPR gRNA sequence
aagatggaattctgtaataa

SEQ ID NO: 651081 - DNA, 20 bp, Artificial
  CRISPR gRNA sequence
agatggaattctgtaataaa

SEQ ID NO: 651082 - DNA, 20 bp, Artificial
  CRISPR gRNA sequence
tgtaataaatatttcagaat

SEQ ID NO: 651083 - DNA, 20 bp, Artificial
  CRISPR gRNA sequence
taataaatatttcagaataa

SEQ ID NO: 651084 - DNA, 20 bp, Artificial
  CRISPR gRNA sequence
cagaataattatgctgatta

SEQ ID NO: 651085 - DNA, 20 bp, Artificial
  CRISPR gRNA sequence
agaataattatgctgattaa

SEQ ID NO: 651086 - DNA, 20 bp, Artificial
  CRISPR gRNA sequence
tgctgattaagatgttatct

SEQ ID NO: 651087 - DNA, 20 bp, Artificial
  CRISPR gRNA sequence
attaagatgttatctatgct

SEQ ID NO: 651088 - DNA, 20 bp, Artificial
  CRISPR gRNA sequence
agatgttatctatgctatac

SEQ ID NO: 651089 - DNA, 20 bp, Artificial
  CRISPR gRNA sequence
tctatgctatactgtcccat

SEQ ID NO: 651090 - DNA, 20 bp, Artificial
  CRISPR gRNA sequence
tgctatactgtcccatctag

SEQ ID NO: 651091 - DNA, 20 bp, Artificial
  CRISPR gRNA sequence
tactgtcccatctaggtaac

SEQ ID NO: 651092 - DNA, 20 bp, Artificial
  CRISPR gRNA sequence
tcccatctaggtaacctcat

SEQ ID NO: 651093 - DNA, 20 bp, Artificial
  CRISPR gRNA sequence
ggtaacctcatcccaagggg

SEQ ID NO: 651094 - DNA, 20 bp, Artificial
  CRISPR gRNA sequence
atcccaaggggtatgatatt

SEQ ID NO: 651095 - DNA, 20 bp, Artificial
  CRISPR gRNA sequence
tatttttaaaatattaattc

SEQ ID NO: 651096 - DNA, 20 bp, Artificial
  CRISPR gRNA sequence
ttaaaatattaattctatac

SEQ ID NO: 651097 - DNA, 20 bp, Artificial
  CRISPR gRNA sequence
taaaatattaattctataca

SEQ ID NO: 651098 - DNA, 20 bp, Artificial
  CRISPR gRNA sequence
aaaatattaattctatacaa

SEQ ID NO: 651099 - DNA, 20 bp, Artificial
  CRISPR gRNA sequence
aaatattaattctatacaaa

SEQ ID NO: 651100 - DNA, 20 bp, Artificial
  CRISPR gRNA sequence
attctatacaaaatcatttt

SEQ ID NO: 651101 - DNA, 20 bp, Artificial
  CRISPR gRNA sequence
tatacaaaatcattttaaaa

SEQ ID NO: 651102 - DNA, 20 bp, Artificial
  CRISPR gRNA sequence
tacaaaatcattttaaaata

SEQ ID NO: 651103 - DNA, 20 bp, Artificial
  CRISPR gRNA sequence
taaaataatatatattgtat

SEQ ID NO: 651104 - DNA, 20 bp, Artificial
  CRISPR gRNA sequence
aaaataatatatattgtatc

SEQ ID NO: 651105 - DNA, 20 bp, Artificial
  CRISPR gRNA sequence
aaataatatatattgtatct

SEQ ID NO: 651106 - DNA, 20 bp, Artificial
  CRISPR gRNA sequence
tatctgcatatttatctcaa

SEQ ID NO: 651107 - DNA, 20 bp, Artificial
  CRISPR gRNA sequence
catatttatctcaaagtctt

SEQ ID NO: 651108 - DNA, 20 bp, Artificial
  CRISPR gRNA sequence
atctcaaagtcttcaaaaag

SEQ ID NO: 651109 - DNA, 20 bp, Artificial
  CRISPR gRNA sequence
tctcaaagtcttcaaaaagg

SEQ ID NO: 651110 - DNA, 20 bp, Artificial
  CRISPR gRNA sequence
aaagtcttcaaaaaggctct

SEQ ID NO: 651111 - DNA, 20 bp, Artificial
  CRISPR gRNA sequence
caaaaaggctctggtgagga

SEQ ID NO: 651112 - DNA, 20 bp, Artificial
  CRISPR gRNA sequence
aaaaaggctctggtgaggag

SEQ ID NO: 651113 - DNA, 20 bp, Artificial
  CRISPR gRNA sequence
tggtgaggagtattaaattc

SEQ ID NO: 651114 - DNA, 20 bp, Artificial
  CRISPR gRNA sequence
gtgaggagtattaaattcct

SEQ ID NO: 651115 - DNA, 20 bp, Artificial
  CRISPR gRNA sequence
aattccttagctattaatgt

SEQ ID NO: 651116 - DNA, 20 bp, Artificial
  CRISPR gRNA sequence
cttagctattaatgtggcag

SEQ ID NO: 651117 - DNA, 20 bp, Artificial
  CRISPR gRNA sequence
agctattaatgtggcagaac

SEQ ID NO: 651118 - DNA, 20 bp, Artificial
  CRISPR gRNA sequence
gctattaatgtggcagaact

SEQ ID NO: 651119 - DNA, 20 bp, Artificial
  CRISPR gRNA sequence
ttaatgtggcagaactggcc

SEQ ID NO: 651120 - DNA, 20 bp, Artificial
  CRISPR gRNA sequence
atgtggcagaactggccaat

SEQ ID NO: 651121 - DNA, 20 bp, Artificial
  CRISPR gRNA sequence
gccaatgtttagctaacaac

SEQ ID NO: 651122 - DNA, 20 bp, Artificial
  CRISPR gRNA sequence
agctaacaacctgtaataag

SEQ ID NO: 651123 - DNA, 20 bp, Artificial
  CRISPR gRNA sequence
gctaacaacctgtaataagt

SEQ ID NO: 651124 - DNA, 20 bp, Artificial
  CRISPR gRNA sequence
acaacctgtaataagtatgt

SEQ ID NO: 651125 - DNA, 20 bp, Artificial
  CRISPR gRNA sequence
taataagtatgtaatatttt

SEQ ID NO: 651126 - DNA, 20 bp, Artificial
  CRISPR gRNA sequence
tcaatagcatatttatttat

SEQ ID NO: 651127 - DNA, 20 bp, Artificial
  CRISPR gRNA sequence
caatagcatatttatttata

SEQ ID NO: 651128 - DNA, 20 bp, Artificial
  CRISPR gRNA sequence
aatagcatatttatttataa

SEQ ID NO: 651129 - DNA, 20 bp, Artificial
  CRISPR gRNA sequence
atttataaggaaacaggtta

SEQ ID NO: 651130 - DNA, 20 bp, Artificial
  CRISPR gRNA sequence
tttataaggaaacaggttac

SEQ ID NO: 651131 - DNA, 20 bp, Artificial
  CRISPR gRNA sequence
ataaggaaacaggttacaga

SEQ ID NO: 651132 - DNA, 20 bp, Artificial
  CRISPR gRNA sequence
taaggaaacaggttacagaa

SEQ ID NO: 651133 - DNA, 20 bp, Artificial
  CRISPR gRNA sequence
cagaataaagacagatcatt

SEQ ID NO: 651134 - DNA, 20 bp, Artificial
  CRISPR gRNA sequence
gaatagaggcactggagtat

SEQ ID NO: 651135 - DNA, 20 bp, Artificial
  CRISPR gRNA sequence
gagtatatggcatacattaa

SEQ ID NO: 651136 - DNA, 20 bp, Artificial
  CRISPR gRNA sequence
atcttatgattttttttaaa

SEQ ID NO: 651137 - DNA, 20 bp, Artificial
  CRISPR gRNA sequence
atgattttttttaaaaaaca

SEQ ID NO: 651138 - DNA, 20 bp, Artificial
  CRISPR gRNA sequence
tgattttttttaaaaaacag

SEQ ID NO: 651139 - DNA, 20 bp, Artificial
  CRISPR gRNA sequence
tttttaaaaaacagaagtta

SEQ ID NO: 651140 - DNA, 20 bp, Artificial
  CRISPR gRNA sequence
ttttaaaaaacagaagttat

SEQ ID NO: 651141 - DNA, 20 bp, Artificial
  CRISPR gRNA sequence
tttaaaaaacagaagttatg

SEQ ID NO: 651142 - DNA, 20 bp, Artificial
  CRISPR gRNA sequence
ttaaaaaacagaagttatga

SEQ ID NO: 651143 - DNA, 20 bp, Artificial
  CRISPR gRNA sequence
taaaaaacagaagttatgat

SEQ ID NO: 651144 - DNA, 20 bp, Artificial
  CRISPR gRNA sequence
aaaaaacagaagttatgata

SEQ ID NO: 651145 - DNA, 20 bp, Artificial
  CRISPR gRNA sequence
aaaaacagaagttatgatat

SEQ ID NO: 651146 - DNA, 20 bp, Artificial
  CRISPR gRNA sequence
tgatattagatataccacaa

SEQ ID NO: 651147 - DNA, 20 bp, Artificial
  CRISPR gRNA sequence
gatataccacaaaatgttga

SEQ ID NO: 651148 - DNA, 20 bp, Artificial
  CRISPR gRNA sequence
aagagctttttgtttaaaaa

SEQ ID NO: 651149 - DNA, 20 bp, Artificial
  CRISPR gRNA sequence
tttgtttaaaaatcagtggg

SEQ ID NO: 651150 - DNA, 20 bp, Artificial
  CRISPR gRNA sequence
ttgtttaaaaatcagtgggt

SEQ ID NO: 651151 - DNA, 20 bp, Artificial
  CRISPR gRNA sequence
tgtttaaaaatcagtgggtc

SEQ ID NO: 651152 - DNA, 20 bp, Artificial
  CRISPR gRNA sequence
gtttaaaaatcagtgggtca

SEQ ID NO: 651153 - DNA, 20 bp, Artificial
  CRISPR gRNA sequence
tttaaaaatcagtgggtcaa

SEQ ID NO: 651154 - DNA, 20 bp, Artificial
  CRISPR gRNA sequence
aaaaatcagtgggtcaatca

SEQ ID NO: 651155 - DNA, 20 bp, Artificial
  CRISPR gRNA sequence
aaaatcagtgggtcaatcac

SEQ ID NO: 651156 - DNA, 20 bp, Artificial
  CRISPR gRNA sequence
attcaacttctgagaccagt

SEQ ID NO: 651157 - DNA, 20 bp, Artificial
  CRISPR gRNA sequence
aacttctgagaccagtataa

SEQ ID NO: 651158 - DNA, 20 bp, Artificial
  CRISPR gRNA sequence
ctgagaccagtataaaggat

SEQ ID NO: 651159 - DNA, 20 bp, Artificial
  CRISPR gRNA sequence
tgagaccagtataaaggatt

SEQ ID NO: 651160 - DNA, 20 bp, Artificial
  CRISPR gRNA sequence
agaccagtataaaggattcc

SEQ ID NO: 651161 - DNA, 20 bp, Artificial
  CRISPR gRNA sequence
cattaagcaaagagtttatt

SEQ ID NO: 651162 - DNA, 20 bp, Artificial
  CRISPR gRNA sequence
agcaaagagtttattaaagc

SEQ ID NO: 651163 - DNA, 20 bp, Artificial
  CRISPR gRNA sequence
attaaagcctgtgcacataa

SEQ ID NO: 651164 - DNA, 20 bp, Artificial
  CRISPR gRNA sequence
ttaaagcctgtgcacataaa

SEQ ID NO: 651165 - DNA, 20 bp, Artificial
  CRISPR gRNA sequence
aagcctgtgcacataaaact

SEQ ID NO: 651166 - DNA, 20 bp, Artificial
  CRISPR gRNA sequence
tgcacataaaactcaatata

SEQ ID NO: 651167 - DNA, 20 bp, Artificial
  CRISPR gRNA sequence
aatatagaattttgatttaa

SEQ ID NO: 651168 - DNA, 20 bp, Artificial
  CRISPR gRNA sequence
tgatttaatggggcaattga

SEQ ID NO: 651169 - DNA, 20 bp, Artificial
  CRISPR gRNA sequence
gatttaatggggcaattgag

SEQ ID NO: 651170 - DNA, 20 bp, Artificial
  CRISPR gRNA sequence
atttaatggggcaattgagg

SEQ ID NO: 651171 - DNA, 20 bp, Artificial
  CRISPR gRNA sequence
aatggggcaattgaggaaat

SEQ ID NO: 651172 - DNA, 20 bp, Artificial
  CRISPR gRNA sequence
atggggcaattgaggaaata

SEQ ID NO: 651173 - DNA, 20 bp, Artificial
  CRISPR gRNA sequence
aggaaataaggccactgatc

SEQ ID NO: 651174 - DNA, 20 bp, Artificial
  CRISPR gRNA sequence
atcaaatactgagaattact

SEQ ID NO: 651175 - DNA, 20 bp, Artificial
  CRISPR gRNA sequence
agaattacttagacatgaat

SEQ ID NO: 651176 - DNA, 20 bp, Artificial
  CRISPR gRNA sequence
cttagacatgaatgttttca

SEQ ID NO: 651177 - DNA, 20 bp, Artificial
  CRISPR gRNA sequence
agacatgaatgttttcaaaa

SEQ ID NO: 651178 - DNA, 20 bp, Artificial
  CRISPR gRNA sequence
gacatgaatgttttcaaaat

SEQ ID NO: 651179 - DNA, 20 bp, Artificial
  CRISPR gRNA sequence
tcaaaatatggtattaaact

SEQ ID NO: 651180 - DNA, 20 bp, Artificial
  CRISPR gRNA sequence
caaaatatggtattaaacta

SEQ ID NO: 651181 - DNA, 20 bp, Artificial
  CRISPR gRNA sequence
aaaatatggtattaaactac

SEQ ID NO: 651182 - DNA, 20 bp, Artificial
  CRISPR gRNA sequence
aactactgttaaagtaatat

SEQ ID NO: 651183 - DNA, 20 bp, Artificial
  CRISPR gRNA sequence
ctgttaaagtaatatgggca

SEQ ID NO: 651184 - DNA, 20 bp, Artificial
  CRISPR gRNA sequence
ttaaagtaatatgggcagaa

SEQ ID NO: 651185 - DNA, 20 bp, Artificial
  CRISPR gRNA sequence
aagtaatatgggcagaaaag

SEQ ID NO: 651186 - DNA, 20 bp, Artificial
  CRISPR gRNA sequence
atattagttttcactaatta

SEQ ID NO: 651187 - DNA, 20 bp, Artificial
  CRISPR gRNA sequence
gttttcactaattaggaaaa

SEQ ID NO: 651188 - DNA, 20 bp, Artificial
  CRISPR gRNA sequence
tcactaattaggaaaattca

SEQ ID NO: 651189 - DNA, 20 bp, Artificial
  CRISPR gRNA sequence
cactaattaggaaaattcat

SEQ ID NO: 651190 - DNA, 20 bp, Artificial
  CRISPR gRNA sequence
actaattaggaaaattcata

SEQ ID NO: 651191 - DNA, 20 bp, Artificial
  CRISPR gRNA sequence
attaggaaaattcatacttc

SEQ ID NO: 651192 - DNA, 20 bp, Artificial
  CRISPR gRNA sequence
ggaaaattcatacttcagtc

SEQ ID NO: 651193 - DNA, 20 bp, Artificial
  CRISPR gRNA sequence
atacttcagtctatatccat

SEQ ID NO: 651194 - DNA, 20 bp, Artificial
  CRISPR gRNA sequence
cagtctatatccatgtgcct

SEQ ID NO: 651195 - DNA, 20 bp, Artificial
  CRISPR gRNA sequence
agtctatatccatgtgccta

SEQ ID NO: 651196 - DNA, 20 bp, Artificial
  CRISPR gRNA sequence
tatccatgtgcctaattgct

SEQ ID NO: 651197 - DNA, 20 bp, Artificial
  CRISPR gRNA sequence
attgctatccctctcccaaa

SEQ ID NO: 651198 - DNA, 20 bp, Artificial
  CRISPR gRNA sequence
ctatccctctcccaaattgt

SEQ ID NO: 651199 - DNA, 20 bp, Artificial
  CRISPR gRNA sequence
tccctctcccaaattgtacc

SEQ ID NO: 651200 - DNA, 20 bp, Artificial
  CRISPR gRNA sequence
tcccaaattgtaccctgtgg

SEQ ID NO: 651201 - DNA, 20 bp, Artificial
  CRISPR gRNA sequence
ccaaattgtaccctgtgggt

SEQ ID NO: 651202 - DNA, 20 bp, Artificial
  CRISPR gRNA sequence
taccctgtgggtgcttcaaa

SEQ ID NO: 651203 - DNA, 20 bp, Artificial
  CRISPR gRNA sequence
tgggtgcttcaaaccagaat

SEQ ID NO: 651204 - DNA, 20 bp, Artificial
  CRISPR gRNA sequence
caaaccagaattgaactaag

SEQ ID NO: 651205 - DNA, 20 bp, Artificial
  CRISPR gRNA sequence
aaaccagaattgaactaagc

SEQ ID NO: 651206 - DNA, 20 bp, Artificial
  CRISPR gRNA sequence
aactaagctaaatcttttcc

SEQ ID NO: 651207 - DNA, 20 bp, Artificial
  CRISPR gRNA sequence
agctaaatcttttcccggaa

SEQ ID NO: 651208 - DNA, 20 bp, Artificial
  CRISPR gRNA sequence
aatcttttcccggaaacctg

SEQ ID NO: 651209 - DNA, 20 bp, Artificial
  CRISPR gRNA sequence
ttcccggaaacctgctccag

SEQ ID NO: 651210 - DNA, 20 bp, Artificial
  CRISPR gRNA sequence
tcccggaaacctgctccagt

SEQ ID NO: 651211 - DNA, 20 bp, Artificial
  CRISPR gRNA sequence
cccggaaacctgctccagta

SEQ ID NO: 651212 - DNA, 20 bp, Artificial
  CRISPR gRNA sequence
ccggaaacctgctccagtat

SEQ ID NO: 651213 - DNA, 20 bp, Artificial
  CRISPR gRNA sequence
ctccagtatttgctatcttc

SEQ ID NO: 651214 - DNA, 20 bp, Artificial
  CRISPR gRNA sequence
cagtatttgctatcttcact

SEQ ID NO: 651215 - DNA, 20 bp, Artificial
  CRISPR gRNA sequence
gctatcttcactgacagaac

SEQ ID NO: 651216 - DNA, 20 bp, Artificial
  CRISPR gRNA sequence
ctatcttcactgacagaacc

SEQ ID NO: 651217 - DNA, 20 bp, Artificial
  CRISPR gRNA sequence
tcttcactgacagaacctac

SEQ ID NO: 651218 - DNA, 20 bp, Artificial
  CRISPR gRNA sequence
cactgacagaacctaccacc

SEQ ID NO: 651219 - DNA, 20 bp, Artificial
  CRISPR gRNA sequence
actgacagaacctaccacca

SEQ ID NO: 651220 - DNA, 20 bp, Artificial
  CRISPR gRNA sequence
acagaacctaccaccaccat

SEQ ID NO: 651221 - DNA, 20 bp, Artificial
  CRISPR gRNA sequence
ccaccaccatctatcccgta

SEQ ID NO: 651222 - DNA, 20 bp, Artificial
  CRISPR gRNA sequence
tcccgtaatttaaaggttgc

SEQ ID NO: 651223 - DNA, 20 bp, Artificial
  CRISPR gRNA sequence
aaaggttgccatccttgact

SEQ ID NO: 651224 - DNA, 20 bp, Artificial
  CRISPR gRNA sequence
aaggttgccatccttgactc

SEQ ID NO: 651225 - DNA, 20 bp, Artificial
  CRISPR gRNA sequence
ccatccttgactctattgtc

SEQ ID NO: 651226 - DNA, 20 bp, Artificial
  CRISPR gRNA sequence
gactctattgtctccttaat

SEQ ID NO: 651227 - DNA, 20 bp, Artificial
  CRISPR gRNA sequence
actctattgtctccttaatt

SEQ ID NO: 651228 - DNA, 20 bp, Artificial
  CRISPR gRNA sequence
tattgtctccttaattctac

SEQ ID NO: 651229 - DNA, 20 bp, Artificial
  CRISPR gRNA sequence
ttgtctccttaattctacta

SEQ ID NO: 651230 - DNA, 20 bp, Artificial
  CRISPR gRNA sequence
tctccttaattctactaccc

SEQ ID NO: 651231 - DNA, 20 bp, Artificial
  CRISPR gRNA sequence
cttaattctactacccaagt

SEQ ID NO: 651232 - DNA, 20 bp, Artificial
  CRISPR gRNA sequence
aattctactacccaagtact

SEQ ID NO: 651233 - DNA, 20 bp, Artificial
  CRISPR gRNA sequence
attctactacccaagtactg

SEQ ID NO: 651234 - DNA, 20 bp, Artificial
  CRISPR gRNA sequence
tactacccaagtactgtcta

SEQ ID NO: 651235 - DNA, 20 bp, Artificial
  CRISPR gRNA sequence
ctacccaagtactgtctact

SEQ ID NO: 651236 - DNA, 20 bp, Artificial
  CRISPR gRNA sequence
cccaagtactgtctacttta

SEQ ID NO: 651237 - DNA, 20 bp, Artificial
  CRISPR gRNA sequence
tctactttaagatgctaaat

SEQ ID NO: 651238 - DNA, 20 bp, Artificial
  CRISPR gRNA sequence
ctttaagatgctaaatatta

SEQ ID NO: 651239 - DNA, 20 bp, Artificial
  CRISPR gRNA sequence
taagatgctaaatattacct

SEQ ID NO: 651240 - DNA, 20 bp, Artificial
  CRISPR gRNA sequence
aagatgctaaatattaccta

SEQ ID NO: 651241 - DNA, 20 bp, Artificial
  CRISPR gRNA sequence
agatgctaaatattacctag

SEQ ID NO: 651242 - DNA, 20 bp, Artificial
  CRISPR gRNA sequence
aatattacctagatccttct

SEQ ID NO: 651243 - DNA, 20 bp, Artificial
  CRISPR gRNA sequence
cctagatccttctccttcct

SEQ ID NO: 651244 - DNA, 20 bp, Artificial
  CRISPR gRNA sequence
gatccttctccttccttttt

SEQ ID NO: 651245 - DNA, 20 bp, Artificial
  CRISPR gRNA sequence
ctccttcctttttatcccac

SEQ ID NO: 651246 - DNA, 20 bp, Artificial
  CRISPR gRNA sequence
tccttcctttttatcccact

SEQ ID NO: 651247 - DNA, 20 bp, Artificial
  CRISPR gRNA sequence
cttcctttttatcccactac

SEQ ID NO: 651248 - DNA, 20 bp, Artificial
  CRISPR gRNA sequence
cctttttatcccactactgc

SEQ ID NO: 651249 - DNA, 20 bp, Artificial
  CRISPR gRNA sequence
ctttttatcccactactgct

SEQ ID NO: 651250 - DNA, 20 bp, Artificial
  CRISPR gRNA sequence
tttatcccactactgctagc

SEQ ID NO: 651251 - DNA, 20 bp, Artificial
  CRISPR gRNA sequence
ttatcccactactgctagct

SEQ ID NO: 651252 - DNA, 20 bp, Artificial
  CRISPR gRNA sequence
tatcccactactgctagctt

SEQ ID NO: 651253 - DNA, 20 bp, Artificial
  CRISPR gRNA sequence
atcccactactgctagcttg

SEQ ID NO: 651254 - DNA, 20 bp, Artificial
  CRISPR gRNA sequence
tcccactactgctagcttgc

SEQ ID NO: 651255 - DNA, 20 bp, Artificial
  CRISPR gRNA sequence
ctgctagcttgcatgacttc

SEQ ID NO: 651256 - DNA, 20 bp, Artificial
  CRISPR gRNA sequence
ctagcttgcatgacttctca

SEQ ID NO: 651257 - DNA, 20 bp, Artificial
  CRISPR gRNA sequence
gcttgcatgacttctcactc

SEQ ID NO: 651258 - DNA, 20 bp, Artificial
  CRISPR gRNA sequence
gcatgacttctcactcaatc

SEQ ID NO: 651259 - DNA, 20 bp, Artificial
  CRISPR gRNA sequence
catgacttctcactcaatca

SEQ ID NO: 651260 - DNA, 20 bp, Artificial
  CRISPR gRNA sequence
ctcactcaatcattgaaaca

SEQ ID NO: 651261 - DNA, 20 bp, Artificial
  CRISPR gRNA sequence
tcactcaatcattgaaacag

SEQ ID NO: 651262 - DNA, 20 bp, Artificial
  CRISPR gRNA sequence
actcaatcattgaaacagcc

SEQ ID NO: 651263 - DNA, 20 bp, Artificial
  CRISPR gRNA sequence
aatcattgaaacagcctgtt

SEQ ID NO: 651264 - DNA, 20 bp, Artificial
  CRISPR gRNA sequence
aaacagcctgttaaatatgc

SEQ ID NO: 651265 - DNA, 20 bp, Artificial
  CRISPR gRNA sequence
ttaaatatgcacctgcctag

SEQ ID NO: 651266 - DNA, 20 bp, Artificial
  CRISPR gRNA sequence
aatatgcacctgcctagaga

SEQ ID NO: 651267 - DNA, 20 bp, Artificial
  CRISPR gRNA sequence
cctagagactggtccccatc

SEQ ID NO: 651268 - DNA, 20 bp, Artificial
  CRISPR gRNA sequence
gagactggtccccatccaca

SEQ ID NO: 651269 - DNA, 20 bp, Artificial
  CRISPR gRNA sequence
gtccccatccacaatctttt

SEQ ID NO: 651270 - DNA, 20 bp, Artificial
  CRISPR gRNA sequence
tttccccacattgtaatcaa

SEQ ID NO: 651271 - DNA, 20 bp, Artificial
  CRISPR gRNA sequence
ttccccacattgtaatcaaa

SEQ ID NO: 651272 - DNA, 20 bp, Artificial
  CRISPR gRNA sequence
tccccacattgtaatcaaat

SEQ ID NO: 651273 - DNA, 20 bp, Artificial
  CRISPR gRNA sequence
ccccacattgtaatcaaatc

SEQ ID NO: 651274 - DNA, 20 bp, Artificial
  CRISPR gRNA sequence
cccacattgtaatcaaatcg

SEQ ID NO: 651275 - DNA, 20 bp, Artificial
  CRISPR gRNA sequence
taatcaaatcgatccatgtc

SEQ ID NO: 651276 - DNA, 20 bp, Artificial
  CRISPR gRNA sequence
aagtcacctacttcgttaaa

SEQ ID NO: 651277 - DNA, 20 bp, Artificial
  CRISPR gRNA sequence
cttcgttaaaaccattgact

SEQ ID NO: 651278 - DNA, 20 bp, Artificial
  CRISPR gRNA sequence
cgttaaaaccattgacttcc

SEQ ID NO: 651279 - DNA, 20 bp, Artificial
  CRISPR gRNA sequence
gttaaaaccattgacttcca

SEQ ID NO: 651280 - DNA, 20 bp, Artificial
  CRISPR gRNA sequence
aaaccattgacttccatgaa

SEQ ID NO: 651281 - DNA, 20 bp, Artificial
  CRISPR gRNA sequence
acttccatgaaaataaaagc

SEQ ID NO: 651282 - DNA, 20 bp, Artificial
  CRISPR gRNA sequence
ccatgaaaataaaagccaag

SEQ ID NO: 651283 - DNA, 20 bp, Artificial
  CRISPR gRNA sequence
catgaaaataaaagccaagt

SEQ ID NO: 651284 - DNA, 20 bp, Artificial
  CRISPR gRNA sequence
cctctcatacaagatgttcc

SEQ ID NO: 651285 - DNA, 20 bp, Artificial
  CRISPR gRNA sequence
ctctcatacaagatgttcca

SEQ ID NO: 651286 - DNA, 20 bp, Artificial
  CRISPR gRNA sequence
tcatacaagatgttccatta

SEQ ID NO: 651287 - DNA, 20 bp, Artificial
  CRISPR gRNA sequence
atacaagatgttccattatc

SEQ ID NO: 651288 - DNA, 20 bp, Artificial
  CRISPR gRNA sequence
cattatcctgccttgattaa

SEQ ID NO: 651289 - DNA, 20 bp, Artificial
  CRISPR gRNA sequence
tcctgccttgattaactctc

SEQ ID NO: 651290 - DNA, 20 bp, Artificial
  CRISPR gRNA sequence
ccttgattaactctccaaag

SEQ ID NO: 651291 - DNA, 20 bp, Artificial
  CRISPR gRNA sequence
gattaactctccaaagtcat

SEQ ID NO: 651292 - DNA, 20 bp, Artificial
  CRISPR gRNA sequence
attaactctccaaagtcatt

SEQ ID NO: 651293 - DNA, 20 bp, Artificial
  CRISPR gRNA sequence
actctccaaagtcattcctg

SEQ ID NO: 651294 - DNA, 20 bp, Artificial
  CRISPR gRNA sequence
tccaaagtcattcctggcct

SEQ ID NO: 651295 - DNA, 20 bp, Artificial
  CRISPR gRNA sequence
caaagtcattcctggcctcg

SEQ ID NO: 651296 - DNA, 20 bp, Artificial
  CRISPR gRNA sequence
ctggcctcgaattcctagac

SEQ ID NO: 651297 - DNA, 20 bp, Artificial
  CRISPR gRNA sequence
gcctcgaattcctagactcc

SEQ ID NO: 651298 - DNA, 20 bp, Artificial
  CRISPR gRNA sequence
gaattcctagactccaactt

SEQ ID NO: 651299 - DNA, 20 bp, Artificial
  CRISPR gRNA sequence
ctagactccaactttatagt

SEQ ID NO: 651300 - DNA, 20 bp, Artificial
  CRISPR gRNA sequence
gactccaactttatagtcta

SEQ ID NO: 651301 - DNA, 20 bp, Artificial
  CRISPR gRNA sequence
caactttatagtctagaaat

SEQ ID NO: 651302 - DNA, 20 bp, Artificial
  CRISPR gRNA sequence
tatagtctagaaataccaat

SEQ ID NO: 651303 - DNA, 20 bp, Artificial
  CRISPR gRNA sequence
atagtctagaaataccaatc

SEQ ID NO: 651304 - DNA, 20 bp, Artificial
  CRISPR gRNA sequence
tagtctagaaataccaatct

SEQ ID NO: 651305 - DNA, 20 bp, Artificial
  CRISPR gRNA sequence
gaaataccaatctgcttgta

SEQ ID NO: 651306 - DNA, 20 bp, Artificial
  CRISPR gRNA sequence
cttgtatttcccagaatatt

SEQ ID NO: 651307 - DNA, 20 bp, Artificial
  CRISPR gRNA sequence
gtatttcccagaatattgca

SEQ ID NO: 651308 - DNA, 20 bp, Artificial
  CRISPR gRNA sequence
tatttcccagaatattgcat

SEQ ID NO: 651309 - DNA, 20 bp, Artificial
  CRISPR gRNA sequence
cccagaatattgcatgctat

SEQ ID NO: 651310 - DNA, 20 bp, Artificial
  CRISPR gRNA sequence
ccagaatattgcatgctatt

SEQ ID NO: 651311 - DNA, 20 bp, Artificial
  CRISPR gRNA sequence
catgctatttctcacctctt

SEQ ID NO: 651312 - DNA, 20 bp, Artificial
  CRISPR gRNA sequence
tttctcacctcttattgtgg

SEQ ID NO: 651313 - DNA, 20 bp, Artificial
  CRISPR gRNA sequence
ctcacctcttattgtggata

SEQ ID NO: 651314 - DNA, 20 bp, Artificial
  CRISPR gRNA sequence
tcacctcttattgtggatat

SEQ ID NO: 651315 - DNA, 20 bp, Artificial
  CRISPR gRNA sequence
acctcttattgtggatatat

SEQ ID NO: 651316 - DNA, 20 bp, Artificial
  CRISPR gRNA sequence
ttattgtggatatattattt

SEQ ID NO: 651317 - DNA, 20 bp, Artificial
  CRISPR gRNA sequence
attgtggatatattatttat

SEQ ID NO: 651318 - DNA, 20 bp, Artificial
  CRISPR gRNA sequence
ttgtggatatattatttatt

SEQ ID NO: 651319 - DNA, 20 bp, Artificial
  CRISPR gRNA sequence
tggatatattatttattgaa

SEQ ID NO: 651320 - DNA, 20 bp, Artificial
  CRISPR gRNA sequence
tttattgaaaaggccttcca

SEQ ID NO: 651321 - DNA, 20 bp, Artificial
  CRISPR gRNA sequence
attgaaaaggccttccagtt

SEQ ID NO: 651322 - DNA, 20 bp, Artificial
  CRISPR gRNA sequence
ttgaaaaggccttccagtta

SEQ ID NO: 651323 - DNA, 20 bp, Artificial
  CRISPR gRNA sequence
aaaaggccttccagttactc

SEQ ID NO: 651324 - DNA, 20 bp, Artificial
  CRISPR gRNA sequence
ccagttactcctaaatccta

SEQ ID NO: 651325 - DNA, 20 bp, Artificial
  CRISPR gRNA sequence
cagttactcctaaatcctat

SEQ ID NO: 651326 - DNA, 20 bp, Artificial
  CRISPR gRNA sequence
ctcctaaatcctattcattt

SEQ ID NO: 651327 - DNA, 20 bp, Artificial
  CRISPR gRNA sequence
ctaaatcctattcatttaat

SEQ ID NO: 651328 - DNA, 20 bp, Artificial
  CRISPR gRNA sequence
aatcctattcatttaataag

SEQ ID NO: 651329 - DNA, 20 bp, Artificial
  CRISPR gRNA sequence
ttcatttaataagtctcggc

SEQ ID NO: 651330 - DNA, 20 bp, Artificial
  CRISPR gRNA sequence
atttaataagtctcggctca

SEQ ID NO: 651331 - DNA, 20 bp, Artificial
  CRISPR gRNA sequence
aataagtctcggctcaagca

SEQ ID NO: 651332 - DNA, 20 bp, Artificial
  CRISPR gRNA sequence
ataagtctcggctcaagcag

SEQ ID NO: 651333 - DNA, 20 bp, Artificial
  CRISPR gRNA sequence
ggctcaagcagtctccccct

SEQ ID NO: 651334 - DNA, 20 bp, Artificial
  CRISPR gRNA sequence
aagcagtctccccctctaaa

SEQ ID NO: 651335 - DNA, 20 bp, Artificial
  CRISPR gRNA sequence
cccctctaaaaaatatttcc

SEQ ID NO: 651336 - DNA, 20 bp, Artificial
  CRISPR gRNA sequence
taaaaaatatttccaaatga

SEQ ID NO: 651337 - DNA, 20 bp, Artificial
  CRISPR gRNA sequence
aaaaatatttccaaatgagc

SEQ ID NO: 651338 - DNA, 20 bp, Artificial
  CRISPR gRNA sequence
ccaaatgagcaccacctctc

SEQ ID NO: 651339 - DNA, 20 bp, Artificial
  CRISPR gRNA sequence
caaatgagcaccacctctca

SEQ ID NO: 651340 - DNA, 20 bp, Artificial
  CRISPR gRNA sequence
tcatcccccgtaataatcaa

SEQ ID NO: 651341 - DNA, 20 bp, Artificial
  CRISPR gRNA sequence
atcccccgtaataatcaaga

SEQ ID NO: 651342 - DNA, 20 bp, Artificial
  CRISPR gRNA sequence
agcttactacagtaaaatgc

SEQ ID NO: 651343 - DNA, 20 bp, Artificial
  CRISPR gRNA sequence
actacagtaaaatgccctat

SEQ ID NO: 651344 - DNA, 20 bp, Artificial
  CRISPR gRNA sequence
ctacagtaaaatgccctatt

SEQ ID NO: 651345 - DNA, 20 bp, Artificial
  CRISPR gRNA sequence
cagtaaaatgccctatttaa

SEQ ID NO: 651346 - DNA, 20 bp, Artificial
  CRISPR gRNA sequence
tttaatgtctgtctgtccca

SEQ ID NO: 651347 - DNA, 20 bp, Artificial
  CRISPR gRNA sequence
aatgtctgtctgtcccacta

SEQ ID NO: 651348 - DNA, 20 bp, Artificial
  CRISPR gRNA sequence
atgtctgtctgtcccactag

SEQ ID NO: 651349 - DNA, 20 bp, Artificial
  CRISPR gRNA sequence
tctgtcccactagagtatga

SEQ ID NO: 651350 - DNA, 20 bp, Artificial
  CRISPR gRNA sequence
tcccactagagtatgagttc

SEQ ID NO: 651351 - DNA, 20 bp, Artificial
  CRISPR gRNA sequence
gagtatgagttcctggagga

SEQ ID NO: 651352 - DNA, 20 bp, Artificial
  CRISPR gRNA sequence
ctggaggaaaaggactctat

SEQ ID NO: 651353 - DNA, 20 bp, Artificial
  CRISPR gRNA sequence
gaggaaaaggactctatact

SEQ ID NO: 651354 - DNA, 20 bp, Artificial
  CRISPR gRNA sequence
tatactctttattcaccttt

SEQ ID NO: 651355 - DNA, 20 bp, Artificial
  CRISPR gRNA sequence
tactctttattcacctttgg

SEQ ID NO: 651356 - DNA, 20 bp, Artificial
  CRISPR gRNA sequence
tttattcacctttggattca

SEQ ID NO: 651357 - DNA, 20 bp, Artificial
  CRISPR gRNA sequence
tattcacctttggattcacc

SEQ ID NO: 651358 - DNA, 20 bp, Artificial
  CRISPR gRNA sequence
attcacctttggattcacct

SEQ ID NO: 651359 - DNA, 20 bp, Artificial
  CRISPR gRNA sequence
ttcacctttggattcacctt

SEQ ID NO: 651360 - DNA, 20 bp, Artificial
  CRISPR gRNA sequence
acctttggattcaccttaca

SEQ ID NO: 651361 - DNA, 20 bp, Artificial
  CRISPR gRNA sequence
tggattcaccttacaatacc

SEQ ID NO: 651362 - DNA, 20 bp, Artificial
  CRISPR gRNA sequence
ggattcaccttacaatacct

SEQ ID NO: 651363 - DNA, 20 bp, Artificial
  CRISPR gRNA sequence
gattcaccttacaatacctg

SEQ ID NO: 651364 - DNA, 20 bp, Artificial
  CRISPR gRNA sequence
accttacaatacctggcaca

SEQ ID NO: 651365 - DNA, 20 bp, Artificial
  CRISPR gRNA sequence
acaatacctggcacatatga

SEQ ID NO: 651366 - DNA, 20 bp, Artificial
  CRISPR gRNA sequence
caatacctggcacatatgag

SEQ ID NO: 651367 - DNA, 20 bp, Artificial
  CRISPR gRNA sequence
gcacatatgaggtatcccac

SEQ ID NO: 651368 - DNA, 20 bp, Artificial
  CRISPR gRNA sequence
attgaattgatcaactagaa

SEQ ID NO: 651369 - DNA, 20 bp, Artificial
  CRISPR gRNA sequence
ttgaattgatcaactagaat

SEQ ID NO: 651370 - DNA, 20 bp, Artificial
  CRISPR gRNA sequence
aattgatcaactagaattga

SEQ ID NO: 651371 - DNA, 20 bp, Artificial
  CRISPR gRNA sequence
atcaactagaattgaacagc

SEQ ID NO: 651372 - DNA, 20 bp, Artificial
  CRISPR gRNA sequence
gaattgaacagcaaaatgtc

SEQ ID NO: 651373 - DNA, 20 bp, Artificial
  CRISPR gRNA sequence
aacagcaaaatgtcaaatgc

SEQ ID NO: 651374 - DNA, 20 bp, Artificial
  CRISPR gRNA sequence
ataattaataattgcattta

SEQ ID NO: 651375 - DNA, 20 bp, Artificial
  CRISPR gRNA sequence
taattaataattgcatttaa

SEQ ID NO: 651376 - DNA, 20 bp, Artificial
  CRISPR gRNA sequence
ataattgcatttaagcctac

SEQ ID NO: 651377 - DNA, 20 bp, Artificial
  CRISPR gRNA sequence
catttaagcctacttcaaat

SEQ ID NO: 651378 - DNA, 20 bp, Artificial
  CRISPR gRNA sequence
aagcctacttcaaatttaga

SEQ ID NO: 651379 - DNA, 20 bp, Artificial
  CRISPR gRNA sequence
agcctacttcaaatttagaa

SEQ ID NO: 651380 - DNA, 20 bp, Artificial
  CRISPR gRNA sequence
cttcaaatttagaacatcta

SEQ ID NO: 651381 - DNA, 20 bp, Artificial
  CRISPR gRNA sequence
caaatttagaacatctaaac

SEQ ID NO: 651382 - DNA, 20 bp, Artificial
  CRISPR gRNA sequence
aaatttagaacatctaaact

SEQ ID NO: 651383 - DNA, 20 bp, Artificial
  CRISPR gRNA sequence
agaacatctaaactactacc

SEQ ID NO: 651384 - DNA, 20 bp, Artificial
  CRISPR gRNA sequence
gaacatctaaactactaccc

SEQ ID NO: 651385 - DNA, 20 bp, Artificial
  CRISPR gRNA sequence
aactactacccccgaagtgc

SEQ ID NO: 651386 - DNA, 20 bp, Artificial
  CRISPR gRNA sequence
ctacccccgaagtgcacaat

SEQ ID NO: 651387 - DNA, 20 bp, Artificial
  CRISPR gRNA sequence
cccccgaagtgcacaatcaa

SEQ ID NO: 651388 - DNA, 20 bp, Artificial
  CRISPR gRNA sequence
aaccaacaattttattaggt

SEQ ID NO: 651389 - DNA, 20 bp, Artificial
  CRISPR gRNA sequence
tattaggtatcatcaagtga

SEQ ID NO: 651390 - DNA, 20 bp, Artificial
  CRISPR gRNA sequence
attaggtatcatcaagtgag

SEQ ID NO: 651391 - DNA, 20 bp, Artificial
  CRISPR gRNA sequence
ttaggtatcatcaagtgaga

SEQ ID NO: 651392 - DNA, 20 bp, Artificial
  CRISPR gRNA sequence
ggtatcatcaagtgagaatt

SEQ ID NO: 651393 - DNA, 20 bp, Artificial
  CRISPR gRNA sequence
atggtactaccagaagcatc

SEQ ID NO: 651394 - DNA, 20 bp, Artificial
  CRISPR gRNA sequence
tggtactaccagaagcatca

SEQ ID NO: 651395 - DNA, 20 bp, Artificial
  CRISPR gRNA sequence
ccagaagcatcaaatgaggt

SEQ ID NO: 651396 - DNA, 20 bp, Artificial
  CRISPR gRNA sequence
gattttagatgaggactctc

SEQ ID NO: 651397 - DNA, 20 bp, Artificial
  CRISPR gRNA sequence
tagatgaggactctctaaga

SEQ ID NO: 651398 - DNA, 20 bp, Artificial
  CRISPR gRNA sequence
agatgaggactctctaagaa

SEQ ID NO: 651399 - DNA, 20 bp, Artificial
  CRISPR gRNA sequence
gatgaggactctctaagaat

SEQ ID NO: 651400 - DNA, 20 bp, Artificial
  CRISPR gRNA sequence
tctaagaattgattctctgt

SEQ ID NO: 651401 - DNA, 20 bp, Artificial
  CRISPR gRNA sequence
taagaattgattctctgtag

SEQ ID NO: 651402 - DNA, 20 bp, Artificial
  CRISPR gRNA sequence
agaattgattctctgtagga

SEQ ID NO: 651403 - DNA, 20 bp, Artificial
  CRISPR gRNA sequence
attctctgtaggaataggtt

SEQ ID NO: 651404 - DNA, 20 bp, Artificial
  CRISPR gRNA sequence
tctgtaggaataggttactc

SEQ ID NO: 651405 - DNA, 20 bp, Artificial
  CRISPR gRNA sequence
tgtaggaataggttactcta

SEQ ID NO: 651406 - DNA, 20 bp, Artificial
  CRISPR gRNA sequence
taggaataggttactctatt

SEQ ID NO: 651407 - DNA, 20 bp, Artificial
  CRISPR gRNA sequence
ctctattaagggaatttttt

SEQ ID NO: 651408 - DNA, 20 bp, Artificial
  CRISPR gRNA sequence
tattaagggaatttttttct

SEQ ID NO: 651409 - DNA, 20 bp, Artificial
  CRISPR gRNA sequence
ttaagggaatttttttcttt

SEQ ID NO: 651410 - DNA, 20 bp, Artificial
  CRISPR gRNA sequence
agggaatttttttcttttgt

SEQ ID NO: 651411 - DNA, 20 bp, Artificial
  CRISPR gRNA sequence
ttttcttttgttatttgtaa

SEQ ID NO: 651412 - DNA, 20 bp, Artificial
  CRISPR gRNA sequence
tttcttttgttatttgtaat

SEQ ID NO: 651413 - DNA, 20 bp, Artificial
  CRISPR gRNA sequence
ttcttttgttatttgtaatg

SEQ ID NO: 651414 - DNA, 20 bp, Artificial
  CRISPR gRNA sequence
tcttttgttatttgtaatga

SEQ ID NO: 651415 - DNA, 20 bp, Artificial
  CRISPR gRNA sequence
cttttgttatttgtaatgac

SEQ ID NO: 651416 - DNA, 20 bp, Artificial
  CRISPR gRNA sequence
ttttgttatttgtaatgact

SEQ ID NO: 651417 - DNA, 20 bp, Artificial
  CRISPR gRNA sequence
ttgttatttgtaatgactgg

SEQ ID NO: 651418 - DNA, 20 bp, Artificial
  CRISPR gRNA sequence
tgttatttgtaatgactggt

SEQ ID NO: 651419 - DNA, 20 bp, Artificial
  CRISPR gRNA sequence
gttatttgtaatgactggta

SEQ ID NO: 651420 - DNA, 20 bp, Artificial
  CRISPR gRNA sequence
ttatttgtaatgactggtat

SEQ ID NO: 651421 - DNA, 20 bp, Artificial
  CRISPR gRNA sequence
tttgtaatgactggtatatc

SEQ ID NO: 651422 - DNA, 20 bp, Artificial
  CRISPR gRNA sequence
gtaatgactggtatatctgg

SEQ ID NO: 651423 - DNA, 20 bp, Artificial
  CRISPR gRNA sequence
taatgactggtatatctgga

SEQ ID NO: 651424 - DNA, 20 bp, Artificial
  CRISPR gRNA sequence
gtatatctggaacaccaata

SEQ ID NO: 651425 - DNA, 20 bp, Artificial
  CRISPR gRNA sequence
gaacaccaataatatgcagt

SEQ ID NO: 651426 - DNA, 20 bp, Artificial
  CRISPR gRNA sequence
gctttacatatcatcaaaac

SEQ ID NO: 651427 - DNA, 20 bp, Artificial
  CRISPR gRNA sequence
ctttacatatcatcaaaacc

SEQ ID NO: 651428 - DNA, 20 bp, Artificial
  CRISPR gRNA sequence
tacatatcatcaaaaccaca

SEQ ID NO: 651429 - DNA, 20 bp, Artificial
  CRISPR gRNA sequence
acatatcatcaaaaccacaa

SEQ ID NO: 651430 - DNA, 20 bp, Artificial
  CRISPR gRNA sequence
catatcatcaaaaccacaaa

SEQ ID NO: 651431 - DNA, 20 bp, Artificial
  CRISPR gRNA sequence
tactcaggaatgttgagcgc

SEQ ID NO: 651432 - DNA, 20 bp, Artificial
  CRISPR gRNA sequence
aggaatgttgagcgccaccc

SEQ ID NO: 651433 - DNA, 20 bp, Artificial
  CRISPR gRNA sequence
agcgccacccccctccccaa

SEQ ID NO: 651434 - DNA, 20 bp, Artificial
  CRISPR gRNA sequence
cccaattctgacatatagac

SEQ ID NO: 651435 - DNA, 20 bp, Artificial
  CRISPR gRNA sequence
tgacatatagacaaactcta

SEQ ID NO: 651436 - DNA, 20 bp, Artificial
  CRISPR gRNA sequence
acatatagacaaactctatt

SEQ ID NO: 651437 - DNA, 20 bp, Artificial
  CRISPR gRNA sequence
tatttctttcttaaccaaaa

SEQ ID NO: 651438 - DNA, 20 bp, Artificial
  CRISPR gRNA sequence
tttctttcttaaccaaaatc

SEQ ID NO: 651439 - DNA, 20 bp, Artificial
  CRISPR gRNA sequence
ctttcttaaccaaaatcttc

SEQ ID NO: 651440 - DNA, 20 bp, Artificial
  CRISPR gRNA sequence
tttcttaaccaaaatcttca

SEQ ID NO: 651441 - DNA, 20 bp, Artificial
  CRISPR gRNA sequence
tcttaaccaaaatcttcata

SEQ ID NO: 651442 - DNA, 20 bp, Artificial
  CRISPR gRNA sequence
cttaaccaaaatcttcatag

SEQ ID NO: 651443 - DNA, 20 bp, Artificial
  CRISPR gRNA sequence
ttaaccaaaatcttcataga

SEQ ID NO: 651444 - DNA, 20 bp, Artificial
  CRISPR gRNA sequence
aaccaaaatcttcatagatg

SEQ ID NO: 651445 - DNA, 20 bp, Artificial
  CRISPR gRNA sequence
accaaaatcttcatagatgc

SEQ ID NO: 651446 - DNA, 20 bp, Artificial
  CRISPR gRNA sequence
catagatgctttaaataacg

SEQ ID NO: 651447 - DNA, 20 bp, Artificial
  CRISPR gRNA sequence
atagatgctttaaataacgg

SEQ ID NO: 651448 - DNA, 20 bp, Artificial
  CRISPR gRNA sequence
taaataacggagggttcctg

SEQ ID NO: 651449 - DNA, 20 bp, Artificial
  CRISPR gRNA sequence
aaataacggagggttcctgc

SEQ ID NO: 651450 - DNA, 20 bp, Artificial
  CRISPR gRNA sequence
aataacggagggttcctgct

SEQ ID NO: 651451 - DNA, 20 bp, Artificial
  CRISPR gRNA sequence
ctgcttcaatttttacccta

SEQ ID NO: 651452 - DNA, 20 bp, Artificial
  CRISPR gRNA sequence
cttcaatttttaccctaaat

SEQ ID NO: 651453 - DNA, 20 bp, Artificial
  CRISPR gRNA sequence
caatttttaccctaaattat

SEQ ID NO: 651454 - DNA, 20 bp, Artificial
  CRISPR gRNA sequence
aatttttaccctaaattatc

SEQ ID NO: 651455 - DNA, 20 bp, Artificial
  CRISPR gRNA sequence
ttaccctaaattatcagaaa

SEQ ID NO: 651456 - DNA, 20 bp, Artificial
  CRISPR gRNA sequence
taccctaaattatcagaaat

SEQ ID NO: 651457 - DNA, 20 bp, Artificial
  CRISPR gRNA sequence
accctaaattatcagaaatc

SEQ ID NO: 651458 - DNA, 20 bp, Artificial
  CRISPR gRNA sequence
ccctaaattatcagaaatcc

SEQ ID NO: 651459 - DNA, 20 bp, Artificial
  CRISPR gRNA sequence
aattatcagaaatccctatc

SEQ ID NO: 651460 - DNA, 20 bp, Artificial
  CRISPR gRNA sequence
tcagaaatccctatctttct

SEQ ID NO: 651461 - DNA, 20 bp, Artificial
  CRISPR gRNA sequence
tctttcttccctggacctgt

SEQ ID NO: 651462 - DNA, 20 bp, Artificial
  CRISPR gRNA sequence
tcttccctggacctgtgcaa

SEQ ID NO: 651463 - DNA, 20 bp, Artificial
  CRISPR gRNA sequence
cttccctggacctgtgcaat

SEQ ID NO: 651464 - DNA, 20 bp, Artificial
  CRISPR gRNA sequence
ttccctggacctgtgcaata

SEQ ID NO: 651465 - DNA, 20 bp, Artificial
  CRISPR gRNA sequence
ccctggacctgtgcaatata

SEQ ID NO: 651466 - DNA, 20 bp, Artificial
  CRISPR gRNA sequence
cctggacctgtgcaatatac

SEQ ID NO: 651467 - DNA, 20 bp, Artificial
  CRISPR gRNA sequence
gacctgtgcaatatacagaa

SEQ ID NO: 651468 - DNA, 20 bp, Artificial
  CRISPR gRNA sequence
tgcaatatacagaaaagagc

SEQ ID NO: 651469 - DNA, 20 bp, Artificial
  CRISPR gRNA sequence
caaatagacttggatttgaa

SEQ ID NO: 651470 - DNA, 20 bp, Artificial
  CRISPR gRNA sequence
aaatagacttggatttgaaa

SEQ ID NO: 651471 - DNA, 20 bp, Artificial
  CRISPR gRNA sequence
ggatttgaaaacaaaccctt

SEQ ID NO: 651472 - DNA, 20 bp, Artificial
  CRISPR gRNA sequence
gatttgaaaacaaacccttt

SEQ ID NO: 651473 - DNA, 20 bp, Artificial
  CRISPR gRNA sequence
gaaaacaaaccctttttctt

SEQ ID NO: 651474 - DNA, 20 bp, Artificial
  CRISPR gRNA sequence
aaaacaaaccctttttctta

SEQ ID NO: 651475 - DNA, 20 bp, Artificial
  CRISPR gRNA sequence
tttcttacaagtcataggtc

SEQ ID NO: 651476 - DNA, 20 bp, Artificial
  CRISPR gRNA sequence
ttcttacaagtcataggtcc

SEQ ID NO: 651477 - DNA, 20 bp, Artificial
  CRISPR gRNA sequence
tcttacaagtcataggtcca

SEQ ID NO: 651478 - DNA, 20 bp, Artificial
  CRISPR gRNA sequence
cttacaagtcataggtccat

SEQ ID NO: 651479 - DNA, 20 bp, Artificial
  CRISPR gRNA sequence
ttacaagtcataggtccata

SEQ ID NO: 651480 - DNA, 20 bp, Artificial
  CRISPR gRNA sequence
acaagtcataggtccataaa

SEQ ID NO: 651481 - DNA, 20 bp, Artificial
  CRISPR gRNA sequence
caagtcataggtccataaaa

SEQ ID NO: 651482 - DNA, 20 bp, Artificial
  CRISPR gRNA sequence
gactgctctgagtaatagca

SEQ ID NO: 651483 - DNA, 20 bp, Artificial
  CRISPR gRNA sequence
actgctctgagtaatagcag

SEQ ID NO: 651484 - DNA, 20 bp, Artificial
  CRISPR gRNA sequence
ctctgagtaatagcagcagt

SEQ ID NO: 651485 - DNA, 20 bp, Artificial
  CRISPR gRNA sequence
tgagtaatagcagcagtgat

SEQ ID NO: 651486 - DNA, 20 bp, Artificial
  CRISPR gRNA sequence
agtaatagcagcagtgatta

SEQ ID NO: 651487 - DNA, 20 bp, Artificial
  CRISPR gRNA sequence
tttattgagtcttagcatgt

SEQ ID NO: 651488 - DNA, 20 bp, Artificial
  CRISPR gRNA sequence
attgagtcttagcatgtgcc

SEQ ID NO: 651489 - DNA, 20 bp, Artificial
  CRISPR gRNA sequence
ttgagtcttagcatgtgcca

SEQ ID NO: 651490 - DNA, 20 bp, Artificial
  CRISPR gRNA sequence
agtcttagcatgtgccagaa

SEQ ID NO: 651491 - DNA, 20 bp, Artificial
  CRISPR gRNA sequence
agcatgtgccagaagttgtg

SEQ ID NO: 651492 - DNA, 20 bp, Artificial
  CRISPR gRNA sequence
gcatgtgccagaagttgtgc

SEQ ID NO: 651493 - DNA, 20 bp, Artificial
  CRISPR gRNA sequence
tgctgagcattttgcatgta

SEQ ID NO: 651494 - DNA, 20 bp, Artificial
  CRISPR gRNA sequence
agcattttgcatgtattgcc

SEQ ID NO: 651495 - DNA, 20 bp, Artificial
  CRISPR gRNA sequence
tgcatgtattgccttattga

SEQ ID NO: 651496 - DNA, 20 bp, Artificial
  CRISPR gRNA sequence
gcatgtattgccttattgaa

SEQ ID NO: 651497 - DNA, 20 bp, Artificial
  CRISPR gRNA sequence
catgtattgccttattgaaa

SEQ ID NO: 651498 - DNA, 20 bp, Artificial
  CRISPR gRNA sequence
ccttattgaaatctcacaac

SEQ ID NO: 651499 - DNA, 20 bp, Artificial
  CRISPR gRNA sequence
attgaaatctcacaacagcc

SEQ ID NO: 651500 - DNA, 20 bp, Artificial
  CRISPR gRNA sequence
ttgaaatctcacaacagccc

SEQ ID NO: 651501 - DNA, 20 bp, Artificial
  CRISPR gRNA sequence
aaatctcacaacagcccatt

SEQ ID NO: 651502 - DNA, 20 bp, Artificial
  CRISPR gRNA sequence
acaacagcccattgaggtag

SEQ ID NO: 651503 - DNA, 20 bp, Artificial
  CRISPR gRNA sequence
aggtaggtattgcttatccc

SEQ ID NO: 651504 - DNA, 20 bp, Artificial
  CRISPR gRNA sequence
cttatccctattctacggat

SEQ ID NO: 651505 - DNA, 20 bp, Artificial
  CRISPR gRNA sequence
atccctattctacggataag

SEQ ID NO: 651506 - DNA, 20 bp, Artificial
  CRISPR gRNA sequence
tccctattctacggataagg

SEQ ID NO: 651507 - DNA, 20 bp, Artificial
  CRISPR gRNA sequence
ttctacggataaggaaactg

SEQ ID NO: 651508 - DNA, 20 bp, Artificial
  CRISPR gRNA sequence
tacggataaggaaactggag

SEQ ID NO: 651509 - DNA, 20 bp, Artificial
  CRISPR gRNA sequence
cggataaggaaactggagct

SEQ ID NO: 651510 - DNA, 20 bp, Artificial
  CRISPR gRNA sequence
gagctcagagatgtgaagtg

SEQ ID NO: 651511 - DNA, 20 bp, Artificial
  CRISPR gRNA sequence
agagatgtgaagtgacatgg

SEQ ID NO: 651512 - DNA, 20 bp, Artificial
  CRISPR gRNA sequence
taacccaggccagcataatt

SEQ ID NO: 651513 - DNA, 20 bp, Artificial
  CRISPR gRNA sequence
acccaggccagcataattgc

SEQ ID NO: 651514 - DNA, 20 bp, Artificial
  CRISPR gRNA sequence
caaagcccatatttttaacc

SEQ ID NO: 651515 - DNA, 20 bp, Artificial
  CRISPR gRNA sequence
ttaaccactcacagtctact

SEQ ID NO: 651516 - DNA, 20 bp, Artificial
  CRISPR gRNA sequence
taaccactcacagtctactg

SEQ ID NO: 651517 - DNA, 20 bp, Artificial
  CRISPR gRNA sequence
aaccactcacagtctactgc

SEQ ID NO: 651518 - DNA, 20 bp, Artificial
  CRISPR gRNA sequence
accactcacagtctactgct

SEQ ID NO: 651519 - DNA, 20 bp, Artificial
  CRISPR gRNA sequence
acagtctactgcttctgagc

SEQ ID NO: 651520 - DNA, 20 bp, Artificial
  CRISPR gRNA sequence
ctgcttctgagcctcagttt

SEQ ID NO: 651521 - DNA, 20 bp, Artificial
  CRISPR gRNA sequence
cttctgagcctcagttttaa

SEQ ID NO: 651522 - DNA, 20 bp, Artificial
  CRISPR gRNA sequence
ctgagcctcagttttaagtg

SEQ ID NO: 651523 - DNA, 20 bp, Artificial
  CRISPR gRNA sequence
tgagcctcagttttaagtgt

SEQ ID NO: 651524 - DNA, 20 bp, Artificial
  CRISPR gRNA sequence
agcctcagttttaagtgtta

SEQ ID NO: 651525 - DNA, 20 bp, Artificial
  CRISPR gRNA sequence
agttttaagtgttataaaat

SEQ ID NO: 651526 - DNA, 20 bp, Artificial
  CRISPR gRNA sequence
taagtgttataaaatagagt

SEQ ID NO: 651527 - DNA, 20 bp, Artificial
  CRISPR gRNA sequence
aagtgttataaaatagagta

SEQ ID NO: 651528 - DNA, 20 bp, Artificial
  CRISPR gRNA sequence
agtgttataaaatagagtaa

SEQ ID NO: 651529 - DNA, 20 bp, Artificial
  CRISPR gRNA sequence
taaaatagagtaattacatg

SEQ ID NO: 651530 - DNA, 20 bp, Artificial
  CRISPR gRNA sequence
catgcctacctcacagaatt

SEQ ID NO: 651531 - DNA, 20 bp, Artificial
  CRISPR gRNA sequence
cctcacagaattgatgtgga

SEQ ID NO: 651532 - DNA, 20 bp, Artificial
  CRISPR gRNA sequence
acagaattgatgtggagaca

SEQ ID NO: 651533 - DNA, 20 bp, Artificial
  CRISPR gRNA sequence
atgtggagacaaagtgaaat

SEQ ID NO: 651534 - DNA, 20 bp, Artificial
  CRISPR gRNA sequence
gcatactaagtgcactcaat

SEQ ID NO: 651535 - DNA, 20 bp, Artificial
  CRISPR gRNA sequence
agtgcactcaataaaggatg

SEQ ID NO: 651536 - DNA, 20 bp, Artificial
  CRISPR gRNA sequence
aataaaggatgcccctctac

SEQ ID NO: 651537 - DNA, 20 bp, Artificial
  CRISPR gRNA sequence
taccttctctcgctctagtg

SEQ ID NO: 651538 - DNA, 20 bp, Artificial
  CRISPR gRNA sequence
ccttctctcgctctagtggt

SEQ ID NO: 651539 - DNA, 20 bp, Artificial
  CRISPR gRNA sequence
ctctcgctctagtggtgatt

SEQ ID NO: 651540 - DNA, 20 bp, Artificial
  CRISPR gRNA sequence
tctcgctctagtggtgatta

SEQ ID NO: 651541 - DNA, 20 bp, Artificial
  CRISPR gRNA sequence
tcgctctagtggtgattata

SEQ ID NO: 651542 - DNA, 20 bp, Artificial
  CRISPR gRNA sequence
gctctagtggtgattataac

SEQ ID NO: 651543 - DNA, 20 bp, Artificial
  CRISPR gRNA sequence
tagtggtgattataacattt

SEQ ID NO: 651544 - DNA, 20 bp, Artificial
  CRISPR gRNA sequence
gtggtgattataacatttat

SEQ ID NO: 651545 - DNA, 20 bp, Artificial
  CRISPR gRNA sequence
taacatttataataaaggaa

SEQ ID NO: 651546 - DNA, 20 bp, Artificial
  CRISPR gRNA sequence
ataataaaggaaaccatccc

SEQ ID NO: 651547 - DNA, 20 bp, Artificial
  CRISPR gRNA sequence
taataaaggaaaccatccct

SEQ ID NO: 651548 - DNA, 20 bp, Artificial
  CRISPR gRNA sequence
aatattccttacctatatca

SEQ ID NO: 651549 - DNA, 20 bp, Artificial
  CRISPR gRNA sequence
cttacctatatcaaaacaga

SEQ ID NO: 651550 - DNA, 20 bp, Artificial
  CRISPR gRNA sequence
acctatatcaaaacagaggt

SEQ ID NO: 651551 - DNA, 20 bp, Artificial
  CRISPR gRNA sequence
cctatatcaaaacagaggta

SEQ ID NO: 651552 - DNA, 20 bp, Artificial
  CRISPR gRNA sequence
tatcaaaacagaggtatatt

SEQ ID NO: 651553 - DNA, 20 bp, Artificial
  CRISPR gRNA sequence
ggtctcaattaattcgcaaa

SEQ ID NO: 651554 - DNA, 20 bp, Artificial
  CRISPR gRNA sequence
aattaattcgcaaaaggaaa

SEQ ID NO: 651555 - DNA, 20 bp, Artificial
  CRISPR gRNA sequence
attcgcaaaaggaaaatacc

SEQ ID NO: 651556 - DNA, 20 bp, Artificial
  CRISPR gRNA sequence
gcaaaaggaaaataccaaca

SEQ ID NO: 651557 - DNA, 20 bp, Artificial
  CRISPR gRNA sequence
aacataaacagataagaagg

SEQ ID NO: 651558 - DNA, 20 bp, Artificial
  CRISPR gRNA sequence
acataaacagataagaaggg

SEQ ID NO: 651559 - DNA, 20 bp, Artificial
  CRISPR gRNA sequence
tacctcattttaggactgga

SEQ ID NO: 651560 - DNA, 20 bp, Artificial
  CRISPR gRNA sequence
cctcattttaggactggaac

SEQ ID NO: 651561 - DNA, 20 bp, Artificial
  CRISPR gRNA sequence
attttaggactggaactctg

SEQ ID NO: 651562 - DNA, 20 bp, Artificial
  CRISPR gRNA sequence
taggactggaactctgctat

SEQ ID NO: 651563 - DNA, 20 bp, Artificial
  CRISPR gRNA sequence
aggactggaactctgctatt

SEQ ID NO: 651564 - DNA, 20 bp, Artificial
  CRISPR gRNA sequence
ggactggaactctgctattg

SEQ ID NO: 651565 - DNA, 20 bp, Artificial
  CRISPR gRNA sequence
gaactctgctattgatattt

SEQ ID NO: 651566 - DNA, 20 bp, Artificial
  CRISPR gRNA sequence
tgctattgatatttccaaat

SEQ ID NO: 651567 - DNA, 20 bp, Artificial
  CRISPR gRNA sequence
ctattgatatttccaaatat

SEQ ID NO: 651568 - DNA, 20 bp, Artificial
  CRISPR gRNA sequence
ttgatatttccaaatatgat

SEQ ID NO: 651569 - DNA, 20 bp, Artificial
  CRISPR gRNA sequence
atatttccaaatatgataaa

SEQ ID NO: 651570 - DNA, 20 bp, Artificial
  CRISPR gRNA sequence
ccaaatatgataaaaatatg

SEQ ID NO: 651571 - DNA, 20 bp, Artificial
  CRISPR gRNA sequence
caaatatgataaaaatatgt

SEQ ID NO: 651572 - DNA, 20 bp, Artificial
  CRISPR gRNA sequence
aaaatatatcaacatgtcaa

SEQ ID NO: 651573 - DNA, 20 bp, Artificial
  CRISPR gRNA sequence
ggagagaagagcacggaacc

SEQ ID NO: 651574 - DNA, 20 bp, Artificial
  CRISPR gRNA sequence
attatggcttacaggaagac

SEQ ID NO: 651575 - DNA, 20 bp, Artificial
  CRISPR gRNA sequence
tggcttacaggaagactctc

SEQ ID NO: 651576 - DNA, 20 bp, Artificial
  CRISPR gRNA sequence
acaggaagactctcaataga

SEQ ID NO: 651577 - DNA, 20 bp, Artificial
  CRISPR gRNA sequence
caggaagactctcaatagaa

SEQ ID NO: 651578 - DNA, 20 bp, Artificial
  CRISPR gRNA sequence
tcaatagaacacaatcaatg

SEQ ID NO: 651579 - DNA, 20 bp, Artificial
  CRISPR gRNA sequence
aatagaacacaatcaatggt

SEQ ID NO: 651580 - DNA, 20 bp, Artificial
  CRISPR gRNA sequence
cctttttttaaaaaagtact

SEQ ID NO: 651581 - DNA, 20 bp, Artificial
  CRISPR gRNA sequence
tttttaaaaaagtacttcta

SEQ ID NO: 651582 - DNA, 20 bp, Artificial
  CRISPR gRNA sequence
ttttaaaaaagtacttctag

SEQ ID NO: 651583 - DNA, 20 bp, Artificial
  CRISPR gRNA sequence
tttaaaaaagtacttctagt

SEQ ID NO: 651584 - DNA, 20 bp, Artificial
  CRISPR gRNA sequence
ttaaaaaagtacttctagtg

SEQ ID NO: 651585 - DNA, 20 bp, Artificial
  CRISPR gRNA sequence
taaaaaagtacttctagtgg

SEQ ID NO: 651586 - DNA, 20 bp, Artificial
  CRISPR gRNA sequence
aaaaaagtacttctagtggg

SEQ ID NO: 651587 - DNA, 20 bp, Artificial
  CRISPR gRNA sequence
aaaaagtacttctagtggga

SEQ ID NO: 651588 - DNA, 20 bp, Artificial
  CRISPR gRNA sequence
ctagtgggaaagacagattt

SEQ ID NO: 651589 - DNA, 20 bp, Artificial
  CRISPR gRNA sequence
tagtgggaaagacagatttt

SEQ ID NO: 651590 - DNA, 20 bp, Artificial
  CRISPR gRNA sequence
gtgggaaagacagattttga

SEQ ID NO: 651591 - DNA, 20 bp, Artificial
  CRISPR gRNA sequence
tgaacaaagatagagatgat

SEQ ID NO: 651592 - DNA, 20 bp, Artificial
  CRISPR gRNA sequence
gaacaaagatagagatgata

SEQ ID NO: 651593 - DNA, 20 bp, Artificial
  CRISPR gRNA sequence
aacaaagatagagatgataa

SEQ ID NO: 651594 - DNA, 20 bp, Artificial
  CRISPR gRNA sequence
tctgccatacgttgttttgt

SEQ ID NO: 651595 - DNA, 20 bp, Artificial
  CRISPR gRNA sequence
ctgccatacgttgttttgtt

SEQ ID NO: 651596 - DNA, 20 bp, Artificial
  CRISPR gRNA sequence
tgccatacgttgttttgttt

SEQ ID NO: 651597 - DNA, 20 bp, Artificial
  CRISPR gRNA sequence
ccatacgttgttttgttttt

SEQ ID NO: 651598 - DNA, 20 bp, Artificial
  CRISPR gRNA sequence
ttttgttttttgaaaacgga

SEQ ID NO: 651599 - DNA, 20 bp, Artificial
  CRISPR gRNA sequence
tgttttttgaaaacggactt

SEQ ID NO: 651600 - DNA, 20 bp, Artificial
  CRISPR gRNA sequence
gttttttgaaaacggacttt

SEQ ID NO: 651601 - DNA, 20 bp, Artificial
  CRISPR gRNA sequence
ttttttgaaaacggacttta

SEQ ID NO: 651602 - DNA, 20 bp, Artificial
  CRISPR gRNA sequence
tttgaaaacggactttaatt

SEQ ID NO: 651603 - DNA, 20 bp, Artificial
  CRISPR gRNA sequence
ttgaaaacggactttaattc

SEQ ID NO: 651604 - DNA, 20 bp, Artificial
  CRISPR gRNA sequence
tgaaaacggactttaattct

SEQ ID NO: 651605 - DNA, 20 bp, Artificial
  CRISPR gRNA sequence
gaaaacggactttaattctc

SEQ ID NO: 651606 - DNA, 20 bp, Artificial
  CRISPR gRNA sequence
aaaacggactttaattctca

SEQ ID NO: 651607 - DNA, 20 bp, Artificial
  CRISPR gRNA sequence
taattctcagtactaagcag

SEQ ID NO: 651608 - DNA, 20 bp, Artificial
  CRISPR gRNA sequence
aattctcagtactaagcaga

SEQ ID NO: 651609 - DNA, 20 bp, Artificial
  CRISPR gRNA sequence
attctcagtactaagcagac

SEQ ID NO: 651610 - DNA, 20 bp, Artificial
  CRISPR gRNA sequence
tcagtactaagcagactaaa

SEQ ID NO: 651611 - DNA, 20 bp, Artificial
  CRISPR gRNA sequence
agtactaagcagactaaaaa

SEQ ID NO: 651612 - DNA, 20 bp, Artificial
  CRISPR gRNA sequence
agcagactaaaaagataggg

SEQ ID NO: 651613 - DNA, 20 bp, Artificial
  CRISPR gRNA sequence
aaaagatagggagttgggag

SEQ ID NO: 651614 - DNA, 20 bp, Artificial
  CRISPR gRNA sequence
ggagcggaatgaggtgcaaa

SEQ ID NO: 651615 - DNA, 20 bp, Artificial
  CRISPR gRNA sequence
cagcacttttgctgttgatt

SEQ ID NO: 651616 - DNA, 20 bp, Artificial
  CRISPR gRNA sequence
ttgctgttgattaccaacaa

SEQ ID NO: 651617 - DNA, 20 bp, Artificial
  CRISPR gRNA sequence
tgctgttgattaccaacaaa

SEQ ID NO: 651618 - DNA, 20 bp, Artificial
  CRISPR gRNA sequence
gctgttgattaccaacaaat

SEQ ID NO: 651619 - DNA, 20 bp, Artificial
  CRISPR gRNA sequence
ctgttgattaccaacaaatc

SEQ ID NO: 651620 - DNA, 20 bp, Artificial
  CRISPR gRNA sequence
ttgattaccaacaaatctat

SEQ ID NO: 651621 - DNA, 20 bp, Artificial
  CRISPR gRNA sequence
attaccaacaaatctatacc

SEQ ID NO: 651622 - DNA, 20 bp, Artificial
  CRISPR gRNA sequence
ccaacaaatctatacctctt

SEQ ID NO: 651623 - DNA, 20 bp, Artificial
  CRISPR gRNA sequence
tacctcttttactttccttt

SEQ ID NO: 651624 - DNA, 20 bp, Artificial
  CRISPR gRNA sequence
ttttactttccttttttttc

SEQ ID NO: 651625 - DNA, 20 bp, Artificial
  CRISPR gRNA sequence
ttactttccttttttttccc

SEQ ID NO: 651626 - DNA, 20 bp, Artificial
  CRISPR gRNA sequence
tactttccttttttttccct

SEQ ID NO: 651627 - DNA, 20 bp, Artificial
  CRISPR gRNA sequence
actttccttttttttccctt

SEQ ID NO: 651628 - DNA, 20 bp, Artificial
  CRISPR gRNA sequence
ctttccttttttttcccttt

SEQ ID NO: 651629 - DNA, 20 bp, Artificial
  CRISPR gRNA sequence
tccttttttttccctttttt

SEQ ID NO: 651630 - DNA, 20 bp, Artificial
  CRISPR gRNA sequence
ccttttttttcccttttttt

SEQ ID NO: 651631 - DNA, 20 bp, Artificial
  CRISPR gRNA sequence
cttttttttccctttttttc

SEQ ID NO: 651632 - DNA, 20 bp, Artificial
  CRISPR gRNA sequence
ttttttccctttttttctct

SEQ ID NO: 651633 - DNA, 20 bp, Artificial
  CRISPR gRNA sequence
tttttccctttttttctctt

SEQ ID NO: 651634 - DNA, 20 bp, Artificial
  CRISPR gRNA sequence
ttttccctttttttctcttt

SEQ ID NO: 651635 - DNA, 20 bp, Artificial
  CRISPR gRNA sequence
tttccctttttttctctttt

SEQ ID NO: 651636 - DNA, 20 bp, Artificial
  CRISPR gRNA sequence
ttccctttttttctcttttg

SEQ ID NO: 651637 - DNA, 20 bp, Artificial
  CRISPR gRNA sequence
tccctttttttctcttttgg

SEQ ID NO: 651638 - DNA, 20 bp, Artificial
  CRISPR gRNA sequence
ccctttttttctcttttggt

SEQ ID NO: 651639 - DNA, 20 bp, Artificial
  CRISPR gRNA sequence
cctttttttctcttttggta

SEQ ID NO: 651640 - DNA, 20 bp, Artificial
  CRISPR gRNA sequence
tttttctcttttggtacata

SEQ ID NO: 651641 - DNA, 20 bp, Artificial
  CRISPR gRNA sequence
ttttctcttttggtacatag

SEQ ID NO: 651642 - DNA, 20 bp, Artificial
  CRISPR gRNA sequence
tttctcttttggtacatagt

SEQ ID NO: 651643 - DNA, 20 bp, Artificial
  CRISPR gRNA sequence
ttctcttttggtacatagtt

SEQ ID NO: 651644 - DNA, 20 bp, Artificial
  CRISPR gRNA sequence
tctcttttggtacatagtta

SEQ ID NO: 651645 - DNA, 20 bp, Artificial
  CRISPR gRNA sequence
ctcttttggtacatagttat

SEQ ID NO: 651646 - DNA, 20 bp, Artificial
  CRISPR gRNA sequence
tcttttggtacatagttatg

SEQ ID NO: 651647 - DNA, 20 bp, Artificial
  CRISPR gRNA sequence
ttttggtacatagttatgac

SEQ ID NO: 651648 - DNA, 20 bp, Artificial
  CRISPR gRNA sequence
ttggtacatagttatgacat

SEQ ID NO: 651649 - DNA, 20 bp, Artificial
  CRISPR gRNA sequence
tggtacatagttatgacatt

SEQ ID NO: 651650 - DNA, 20 bp, Artificial
  CRISPR gRNA sequence
ggtacatagttatgacattt

SEQ ID NO: 651651 - DNA, 20 bp, Artificial
  CRISPR gRNA sequence
gtacatagttatgacattta

SEQ ID NO: 651652 - DNA, 20 bp, Artificial
  CRISPR gRNA sequence
tgacatttatctctgatacc

SEQ ID NO: 651653 - DNA, 20 bp, Artificial
  CRISPR gRNA sequence
atctctgatacctgtaaaga

SEQ ID NO: 651654 - DNA, 20 bp, Artificial
  CRISPR gRNA sequence
tctctgatacctgtaaagaa

SEQ ID NO: 651655 - DNA, 20 bp, Artificial
  CRISPR gRNA sequence
tgatacctgtaaagaaatta

SEQ ID NO: 651656 - DNA, 20 bp, Artificial
  CRISPR gRNA sequence
atacctgtaaagaaattaaa

SEQ ID NO: 651657 - DNA, 20 bp, Artificial
  CRISPR gRNA sequence
taaagaaattaaatcagaac

SEQ ID NO: 651658 - DNA, 20 bp, Artificial
  CRISPR gRNA sequence
aatcagaactatttttattt

SEQ ID NO: 651659 - DNA, 20 bp, Artificial
  CRISPR gRNA sequence
tttttatttaattccctaat

SEQ ID NO: 651660 - DNA, 20 bp, Artificial
  CRISPR gRNA sequence
ttatttaattccctaataaa

SEQ ID NO: 651661 - DNA, 20 bp, Artificial
  CRISPR gRNA sequence
tatttaattccctaataaac

SEQ ID NO: 651662 - DNA, 20 bp, Artificial
  CRISPR gRNA sequence
atttaattccctaataaaca

SEQ ID NO: 651663 - DNA, 20 bp, Artificial
  CRISPR gRNA sequence
tttaattccctaataaacaa

SEQ ID NO: 651664 - DNA, 20 bp, Artificial
  CRISPR gRNA sequence
aattccctaataaacaagaa

SEQ ID NO: 651665 - DNA, 20 bp, Artificial
  CRISPR gRNA sequence
attccctaataaacaagaac

SEQ ID NO: 651666 - DNA, 20 bp, Artificial
  CRISPR gRNA sequence
cctaataaacaagaactaaa

SEQ ID NO: 651667 - DNA, 20 bp, Artificial
  CRISPR gRNA sequence
ataaacaagaactaaatgta

SEQ ID NO: 651668 - DNA, 20 bp, Artificial
  CRISPR gRNA sequence
aatgtaaagtacattgggta

SEQ ID NO: 651669 - DNA, 20 bp, Artificial
  CRISPR gRNA sequence
ggtatatacacaaacctaag

SEQ ID NO: 651670 - DNA, 20 bp, Artificial
  CRISPR gRNA sequence
agtatggcgacttaaaacag

SEQ ID NO: 651671 - DNA, 20 bp, Artificial
  CRISPR gRNA sequence
aaaacagaagattttctatc

SEQ ID NO: 651672 - DNA, 20 bp, Artificial
  CRISPR gRNA sequence
aaacagaagattttctatca

SEQ ID NO: 651673 - DNA, 20 bp, Artificial
  CRISPR gRNA sequence
tctatcaagcccatctggtg

SEQ ID NO: 651674 - DNA, 20 bp, Artificial
  CRISPR gRNA sequence
ctatcaagcccatctggtgt

SEQ ID NO: 651675 - DNA, 20 bp, Artificial
  CRISPR gRNA sequence
tatcaagcccatctggtgtt

SEQ ID NO: 651676 - DNA, 20 bp, Artificial
  CRISPR gRNA sequence
tcaagcccatctggtgttat

SEQ ID NO: 651677 - DNA, 20 bp, Artificial
  CRISPR gRNA sequence
gtgttatattagggtgtgtc

SEQ ID NO: 651678 - DNA, 20 bp, Artificial
  CRISPR gRNA sequence
tattagggtgtgtcctacag

SEQ ID NO: 651679 - DNA, 20 bp, Artificial
  CRISPR gRNA sequence
gggtgtgtcctacagaaatc

SEQ ID NO: 651680 - DNA, 20 bp, Artificial
  CRISPR gRNA sequence
cagaaatccaagcaagggtg

SEQ ID NO: 651681 - DNA, 20 bp, Artificial
  CRISPR gRNA sequence
ccaaactaagctacagaaga

SEQ ID NO: 651682 - DNA, 20 bp, Artificial
  CRISPR gRNA sequence
agctacagaagaaaactcag

SEQ ID NO: 651683 - DNA, 20 bp, Artificial
  CRISPR gRNA sequence
cagaagaaaactcagaaagc

SEQ ID NO: 651684 - DNA, 20 bp, Artificial
  CRISPR gRNA sequence
agaaagctggtaagtcccat

SEQ ID NO: 651685 - DNA, 20 bp, Artificial
  CRISPR gRNA sequence
gtaagtcccataatataggc

SEQ ID NO: 651686 - DNA, 20 bp, Artificial
  CRISPR gRNA sequence
tatttcaaaaagtgcattag

SEQ ID NO: 651687 - DNA, 20 bp, Artificial
  CRISPR gRNA sequence
tttcaaaaagtgcattagaa

SEQ ID NO: 651688 - DNA, 20 bp, Artificial
  CRISPR gRNA sequence
caaaaagtgcattagaacac

SEQ ID NO: 651689 - DNA, 20 bp, Artificial
  CRISPR gRNA sequence
aaaaagtgcattagaacacc

SEQ ID NO: 651690 - DNA, 20 bp, Artificial
  CRISPR gRNA sequence
gaacacccgcctgaaaagat

SEQ ID NO: 651691 - DNA, 20 bp, Artificial
  CRISPR gRNA sequence
aaaagataatctgatatcac

SEQ ID NO: 651692 - DNA, 20 bp, Artificial
  CRISPR gRNA sequence
atatcactccaccctcataa

SEQ ID NO: 651693 - DNA, 20 bp, Artificial
  CRISPR gRNA sequence
caccctcataataactcttc

SEQ ID NO: 651694 - DNA, 20 bp, Artificial
  CRISPR gRNA sequence
ataataactcttctatttct

SEQ ID NO: 651695 - DNA, 20 bp, Artificial
  CRISPR gRNA sequence
ttctatttctgagatatttg

SEQ ID NO: 651696 - DNA, 20 bp, Artificial
  CRISPR gRNA sequence
ctatttctgagatatttgtc

SEQ ID NO: 651697 - DNA, 20 bp, Artificial
  CRISPR gRNA sequence
tatttctgagatatttgtca

SEQ ID NO: 651698 - DNA, 20 bp, Artificial
  CRISPR gRNA sequence
tttctgagatatttgtcaca

SEQ ID NO: 651699 - DNA, 20 bp, Artificial
  CRISPR gRNA sequence
ctgagatatttgtcacaaaa

SEQ ID NO: 651700 - DNA, 20 bp, Artificial
  CRISPR gRNA sequence
tgagatatttgtcacaaaaa

SEQ ID NO: 651701 - DNA, 20 bp, Artificial
  CRISPR gRNA sequence
agatatttgtcacaaaaata

SEQ ID NO: 651702 - DNA, 20 bp, Artificial
  CRISPR gRNA sequence
gtcacaaaaatatgggccag

SEQ ID NO: 651703 - DNA, 20 bp, Artificial
  CRISPR gRNA sequence
tcacaaaaatatgggccagt

SEQ ID NO: 651704 - DNA, 20 bp, Artificial
  CRISPR gRNA sequence
gacacggcagacaccctgag

SEQ ID NO: 651705 - DNA, 20 bp, Artificial
  CRISPR gRNA sequence
agaaggtgacattgtagaga

SEQ ID NO: 651706 - DNA, 20 bp, Artificial
  CRISPR gRNA sequence
tagagatagcagttatctaa

SEQ ID NO: 651707 - DNA, 20 bp, Artificial
  CRISPR gRNA sequence
tctaactaacccacaaggta

SEQ ID NO: 651708 - DNA, 20 bp, Artificial
  CRISPR gRNA sequence
actaacccacaaggtaatat

SEQ ID NO: 651709 - DNA, 20 bp, Artificial
  CRISPR gRNA sequence
acccacaaggtaatatcaca

SEQ ID NO: 651710 - DNA, 20 bp, Artificial
  CRISPR gRNA sequence
tatgtcccaatcctgataac

SEQ ID NO: 651711 - DNA, 20 bp, Artificial
  CRISPR gRNA sequence
atgtcccaatcctgataact

SEQ ID NO: 651712 - DNA, 20 bp, Artificial
  CRISPR gRNA sequence
tgtcccaatcctgataactt

SEQ ID NO: 651713 - DNA, 20 bp, Artificial
  CRISPR gRNA sequence
ataacttcatctttctgcta

SEQ ID NO: 651714 - DNA, 20 bp, Artificial
  CRISPR gRNA sequence
catctttctgctaagttctc

SEQ ID NO: 651715 - DNA, 20 bp, Artificial
  CRISPR gRNA sequence
atctttctgctaagttctct

SEQ ID NO: 651716 - DNA, 20 bp, Artificial
  CRISPR gRNA sequence
tctgctaagttctctaagag

SEQ ID NO: 651717 - DNA, 20 bp, Artificial
  CRISPR gRNA sequence
ctgctaagttctctaagagg

SEQ ID NO: 651718 - DNA, 20 bp, Artificial
  CRISPR gRNA sequence
tgctaagttctctaagaggt

SEQ ID NO: 651719 - DNA, 20 bp, Artificial
  CRISPR gRNA sequence
ctaagttctctaagaggtaa

SEQ ID NO: 651720 - DNA, 20 bp, Artificial
  CRISPR gRNA sequence
agttctctaagaggtaaatt

SEQ ID NO: 651721 - DNA, 20 bp, Artificial
  CRISPR gRNA sequence
tctaagaggtaaattgattt

SEQ ID NO: 651722 - DNA, 20 bp, Artificial
  CRISPR gRNA sequence
taagaggtaaattgatttct

SEQ ID NO: 651723 - DNA, 20 bp, Artificial
  CRISPR gRNA sequence
agaggtaaattgatttcttc

SEQ ID NO: 651724 - DNA, 20 bp, Artificial
  CRISPR gRNA sequence
atttcttcaagcctcaattt

SEQ ID NO: 651725 - DNA, 20 bp, Artificial
  CRISPR gRNA sequence
cttcaagcctcaatttccac

SEQ ID NO: 651726 - DNA, 20 bp, Artificial
  CRISPR gRNA sequence
ttcaagcctcaatttccaca

SEQ ID NO: 651727 - DNA, 20 bp, Artificial
  CRISPR gRNA sequence
caagcctcaatttccacata

SEQ ID NO: 651728 - DNA, 20 bp, Artificial
  CRISPR gRNA sequence
aagcctcaatttccacatat

SEQ ID NO: 651729 - DNA, 20 bp, Artificial
  CRISPR gRNA sequence
aatttccacatatgaaaaat

SEQ ID NO: 651730 - DNA, 20 bp, Artificial
  CRISPR gRNA sequence
ccacatatgaaaaatagaaa

SEQ ID NO: 651731 - DNA, 20 bp, Artificial
  CRISPR gRNA sequence
cacatatgaaaaatagaaat

SEQ ID NO: 651732 - DNA, 20 bp, Artificial
  CRISPR gRNA sequence
ctgcttcgctaggttctaaa

SEQ ID NO: 651733 - DNA, 20 bp, Artificial
  CRISPR gRNA sequence
tgcttcgctaggttctaaaa

SEQ ID NO: 651734 - DNA, 20 bp, Artificial
  CRISPR gRNA sequence
cttcgctaggttctaaaaat

SEQ ID NO: 651735 - DNA, 20 bp, Artificial
  CRISPR gRNA sequence
cgctaggttctaaaaatgga

SEQ ID NO: 651736 - DNA, 20 bp, Artificial
  CRISPR gRNA sequence
gctaggttctaaaaatggaa

SEQ ID NO: 651737 - DNA, 20 bp, Artificial
  CRISPR gRNA sequence
ggttctaaaaatggaaacta

SEQ ID NO: 651738 - DNA, 20 bp, Artificial
  CRISPR gRNA sequence
taaaaatggaaactagctaa

SEQ ID NO: 651739 - DNA, 20 bp, Artificial
  CRISPR gRNA sequence
aaaatggaaactagctaaga

SEQ ID NO: 651740 - DNA, 20 bp, Artificial
  CRISPR gRNA sequence
gctaagaaaaaaattaatgt

SEQ ID NO: 651741 - DNA, 20 bp, Artificial
  CRISPR gRNA sequence
agaaaaaaattaatgtgaag

SEQ ID NO: 651742 - DNA, 20 bp, Artificial
  CRISPR gRNA sequence
atgtgaagtactctgaaaag

SEQ ID NO: 651743 - DNA, 20 bp, Artificial
  CRISPR gRNA sequence
tgaaaagaataaactagatt

SEQ ID NO: 651744 - DNA, 20 bp, Artificial
  CRISPR gRNA sequence
aaaagaataaactagattcc

SEQ ID NO: 651745 - DNA, 20 bp, Artificial
  CRISPR gRNA sequence
gattccctgacctgattatt

SEQ ID NO: 651746 - DNA, 20 bp, Artificial
  CRISPR gRNA sequence
cctgacctgattattggtca

SEQ ID NO: 651747 - DNA, 20 bp, Artificial
  CRISPR gRNA sequence
acctgattattggtcagagc

SEQ ID NO: 651748 - DNA, 20 bp, Artificial
  CRISPR gRNA sequence
attattggtcagagccttgt

SEQ ID NO: 651749 - DNA, 20 bp, Artificial
  CRISPR gRNA sequence
ttggtcagagccttgtaaaa

SEQ ID NO: 651750 - DNA, 20 bp, Artificial
  CRISPR gRNA sequence
gtcagagccttgtaaaacta

SEQ ID NO: 651751 - DNA, 20 bp, Artificial
  CRISPR gRNA sequence
gtaaaactagacttactact

SEQ ID NO: 651752 - DNA, 20 bp, Artificial
  CRISPR gRNA sequence
taaaactagacttactactt

SEQ ID NO: 651753 - DNA, 20 bp, Artificial
  CRISPR gRNA sequence
gacttactacttcttccgat

SEQ ID NO: 651754 - DNA, 20 bp, Artificial
  CRISPR gRNA sequence
actacttcttccgattccat

SEQ ID NO: 651755 - DNA, 20 bp, Artificial
  CRISPR gRNA sequence
ctacttcttccgattccata

SEQ ID NO: 651756 - DNA, 20 bp, Artificial
  CRISPR gRNA sequence
cttcttccgattccatacat

SEQ ID NO: 651757 - DNA, 20 bp, Artificial
  CRISPR gRNA sequence
cttccgattccatacatgcc

SEQ ID NO: 651758 - DNA, 20 bp, Artificial
  CRISPR gRNA sequence
ttccgattccatacatgcca

SEQ ID NO: 651759 - DNA, 20 bp, Artificial
  CRISPR gRNA sequence
ccgattccatacatgccacc

SEQ ID NO: 651760 - DNA, 20 bp, Artificial
  CRISPR gRNA sequence
cgattccatacatgccacct

SEQ ID NO: 651761 - DNA, 20 bp, Artificial
  CRISPR gRNA sequence
catacatgccacctggccat

SEQ ID NO: 651762 - DNA, 20 bp, Artificial
  CRISPR gRNA sequence
gccatcagactgataaatag

SEQ ID NO: 651763 - DNA, 20 bp, Artificial
  CRISPR gRNA sequence
ataaatagcattgactgtac

SEQ ID NO: 651764 - DNA, 20 bp, Artificial
  CRISPR gRNA sequence
actgtacagttgatccactt

SEQ ID NO: 651765 - DNA, 20 bp, Artificial
  CRISPR gRNA sequence
tacagttgatccacttaaca

SEQ ID NO: 651766 - DNA, 20 bp, Artificial
  CRISPR gRNA sequence
atccacttaacagctttaaa

SEQ ID NO: 651767 - DNA, 20 bp, Artificial
  CRISPR gRNA sequence
aacagctttaaagtaataga

SEQ ID NO: 651768 - DNA, 20 bp, Artificial
  CRISPR gRNA sequence
acagctttaaagtaatagaa

SEQ ID NO: 651769 - DNA, 20 bp, Artificial
  CRISPR gRNA sequence
taaagtaatagaaacaaatt

SEQ ID NO: 651770 - DNA, 20 bp, Artificial
  CRISPR gRNA sequence
aaagtaatagaaacaaattt

SEQ ID NO: 651771 - DNA, 20 bp, Artificial
  CRISPR gRNA sequence
aagtaatagaaacaaatttt

SEQ ID NO: 651772 - DNA, 20 bp, Artificial
  CRISPR gRNA sequence
tgcatcatgatgtattttca

SEQ ID NO: 651773 - DNA, 20 bp, Artificial
  CRISPR gRNA sequence
gcatcatgatgtattttcat

SEQ ID NO: 651774 - DNA, 20 bp, Artificial
  CRISPR gRNA sequence
catcatgatgtattttcata

SEQ ID NO: 651775 - DNA, 20 bp, Artificial
  CRISPR gRNA sequence
tcatacccatttaagtaact

SEQ ID NO: 651776 - DNA, 20 bp, Artificial
  CRISPR gRNA sequence
catacccatttaagtaacta

SEQ ID NO: 651777 - DNA, 20 bp, Artificial
  CRISPR gRNA sequence
atacccatttaagtaactac

SEQ ID NO: 651778 - DNA, 20 bp, Artificial
  CRISPR gRNA sequence
aagtaactacctgcaaagta

SEQ ID NO: 651779 - DNA, 20 bp, Artificial
  CRISPR gRNA sequence
agtaactacctgcaaagtaa

SEQ ID NO: 651780 - DNA, 20 bp, Artificial
  CRISPR gRNA sequence
cctgcaaagtaaatttatac

SEQ ID NO: 651781 - DNA, 20 bp, Artificial
  CRISPR gRNA sequence
caaagtaaatttatacataa

SEQ ID NO: 651782 - DNA, 20 bp, Artificial
  CRISPR gRNA sequence
atacataaacattataaaaa

SEQ ID NO: 651783 - DNA, 20 bp, Artificial
  CRISPR gRNA sequence
tacataaacattataaaaaa

SEQ ID NO: 651784 - DNA, 20 bp, Artificial
  CRISPR gRNA sequence
taaaaaaatagataagaaaa

SEQ ID NO: 651785 - DNA, 20 bp, Artificial
  CRISPR gRNA sequence
atttaaaaattttgaacttt

SEQ ID NO: 651786 - DNA, 20 bp, Artificial
  CRISPR gRNA sequence
aaaaattttgaactttaaac

SEQ ID NO: 651787 - DNA, 20 bp, Artificial
  CRISPR gRNA sequence
aaaattttgaactttaaaca

SEQ ID NO: 651788 - DNA, 20 bp, Artificial
  CRISPR gRNA sequence
tgaactttaaacaattttca

SEQ ID NO: 651789 - DNA, 20 bp, Artificial
  CRISPR gRNA sequence
gaactttaaacaattttcaa

SEQ ID NO: 651790 - DNA, 20 bp, Artificial
  CRISPR gRNA sequence
aactttaaacaattttcaaa

SEQ ID NO: 651791 - DNA, 20 bp, Artificial
  CRISPR gRNA sequence
taaacaattttcaaaatagt

SEQ ID NO: 651792 - DNA, 20 bp, Artificial
  CRISPR gRNA sequence
aaacaattttcaaaatagtc

SEQ ID NO: 651793 - DNA, 20 bp, Artificial
  CRISPR gRNA sequence
aacaattttcaaaatagtca

SEQ ID NO: 651794 - DNA, 20 bp, Artificial
  CRISPR gRNA sequence
tcaaaatagtcacctgccag

SEQ ID NO: 651795 - DNA, 20 bp, Artificial
  CRISPR gRNA sequence
caaaatagtcacctgccagt

SEQ ID NO: 651796 - DNA, 20 bp, Artificial
  CRISPR gRNA sequence
aaaatagtcacctgccagta

SEQ ID NO: 651797 - DNA, 20 bp, Artificial
  CRISPR gRNA sequence
ccagtatagaacagtctgaa

SEQ ID NO: 651798 - DNA, 20 bp, Artificial
  CRISPR gRNA sequence
aaaccaatactgaacaacta

SEQ ID NO: 651799 - DNA, 20 bp, Artificial
  CRISPR gRNA sequence
aacaactatgcaagaattgg

SEQ ID NO: 651800 - DNA, 20 bp, Artificial
  CRISPR gRNA sequence
tgcaagaattggaaatgagc

SEQ ID NO: 651801 - DNA, 20 bp, Artificial
  CRISPR gRNA sequence
gaaatgagctaaccaagaaa

SEQ ID NO: 651802 - DNA, 20 bp, Artificial
  CRISPR gRNA sequence
accaagaaacagaaggaatc

SEQ ID NO: 651803 - DNA, 20 bp, Artificial
  CRISPR gRNA sequence
catctgatgggccgaaatac

SEQ ID NO: 651804 - DNA, 20 bp, Artificial
  CRISPR gRNA sequence
atctgatgggccgaaataca

SEQ ID NO: 651805 - DNA, 20 bp, Artificial
  CRISPR gRNA sequence
atgggccgaaatacaatatg

SEQ ID NO: 651806 - DNA, 20 bp, Artificial
  CRISPR gRNA sequence
tttttatattgttctgtctg

SEQ ID NO: 651807 - DNA, 20 bp, Artificial
  CRISPR gRNA sequence
ttatattgttctgtctgaga

SEQ ID NO: 651808 - DNA, 20 bp, Artificial
  CRISPR gRNA sequence
tatattgttctgtctgagat

SEQ ID NO: 651809 - DNA, 20 bp, Artificial
  CRISPR gRNA sequence
atattgttctgtctgagatg

SEQ ID NO: 651810 - DNA, 20 bp, Artificial
  CRISPR gRNA sequence
tattgttctgtctgagatgt

SEQ ID NO: 651811 - DNA, 20 bp, Artificial
  CRISPR gRNA sequence
ttctgtctgagatgtctgtc

SEQ ID NO: 651812 - DNA, 20 bp, Artificial
  CRISPR gRNA sequence
tgtctgagatgtctgtctca

SEQ ID NO: 651813 - DNA, 20 bp, Artificial
  CRISPR gRNA sequence
tctgagatgtctgtctcaga

SEQ ID NO: 651814 - DNA, 20 bp, Artificial
  CRISPR gRNA sequence
agatgtctgtctcagattct

SEQ ID NO: 651815 - DNA, 20 bp, Artificial
  CRISPR gRNA sequence
tctcagattcttaagtccca

SEQ ID NO: 651816 - DNA, 20 bp, Artificial
  CRISPR gRNA sequence
agattcttaagtcccagatt

SEQ ID NO: 651817 - DNA, 20 bp, Artificial
  CRISPR gRNA sequence
ttaagtcccagattctattt

SEQ ID NO: 651818 - DNA, 20 bp, Artificial
  CRISPR gRNA sequence
aagtcccagattctattttt

SEQ ID NO: 651819 - DNA, 20 bp, Artificial
  CRISPR gRNA sequence
agtcccagattctattttta

SEQ ID NO: 651820 - DNA, 20 bp, Artificial
  CRISPR gRNA sequence
tatttttaaaaatcacttaa

SEQ ID NO: 651821 - DNA, 20 bp, Artificial
  CRISPR gRNA sequence
tttttaaaaatcacttaaca

SEQ ID NO: 651822 - DNA, 20 bp, Artificial
  CRISPR gRNA sequence
ttaaaaatcacttaacactg

SEQ ID NO: 651823 - DNA, 20 bp, Artificial
  CRISPR gRNA sequence
taaaaatcacttaacactgt

SEQ ID NO: 651824 - DNA, 20 bp, Artificial
  CRISPR gRNA sequence
aaaaatcacttaacactgtg

SEQ ID NO: 651825 - DNA, 20 bp, Artificial
  CRISPR gRNA sequence
aaaatcacttaacactgtgt

SEQ ID NO: 651826 - DNA, 20 bp, Artificial
  CRISPR gRNA sequence
aacactgtgtatttccaata

SEQ ID NO: 651827 - DNA, 20 bp, Artificial
  CRISPR gRNA sequence
acactgtgtatttccaatag

SEQ ID NO: 651828 - DNA, 20 bp, Artificial
  CRISPR gRNA sequence
tgtatttccaatagccatca

SEQ ID NO: 651829 - DNA, 20 bp, Artificial
  CRISPR gRNA sequence
ccaatagccatcaaggcata

SEQ ID NO: 651830 - DNA, 20 bp, Artificial
  CRISPR gRNA sequence
caatagccatcaaggcatat

SEQ ID NO: 651831 - DNA, 20 bp, Artificial
  CRISPR gRNA sequence
tcatccctgacaccgaagat

SEQ ID NO: 651832 - DNA, 20 bp, Artificial
  CRISPR gRNA sequence
acaccgaagattgtcagcag

SEQ ID NO: 651833 - DNA, 20 bp, Artificial
  CRISPR gRNA sequence
tcagcagactcaatatgtac

SEQ ID NO: 651834 - DNA, 20 bp, Artificial
  CRISPR gRNA sequence
aatatgtacactaatgatct

SEQ ID NO: 651835 - DNA, 20 bp, Artificial
  CRISPR gRNA sequence
atgatctcaggcaacaatgt

SEQ ID NO: 651836 - DNA, 20 bp, Artificial
  CRISPR gRNA sequence
aggcaacaatgtccatcttc

SEQ ID NO: 651837 - DNA, 20 bp, Artificial
  CRISPR gRNA sequence
cttaacaaagacatcctcat

SEQ ID NO: 651838 - DNA, 20 bp, Artificial
  CRISPR gRNA sequence
ttaacaaagacatcctcatt

SEQ ID NO: 651839 - DNA, 20 bp, Artificial
  CRISPR gRNA sequence
aacaaagacatcctcattcc

SEQ ID NO: 651840 - DNA, 20 bp, Artificial
  CRISPR gRNA sequence
acaaagacatcctcattcca

SEQ ID NO: 651841 - DNA, 20 bp, Artificial
  CRISPR gRNA sequence
attccagaagaaaaagttta

SEQ ID NO: 651842 - DNA, 20 bp, Artificial
  CRISPR gRNA sequence
cagaagaaaaagtttaaagt

SEQ ID NO: 651843 - DNA, 20 bp, Artificial
  CRISPR gRNA sequence
aaagttctctaagaaaattc

SEQ ID NO: 651844 - DNA, 20 bp, Artificial
  CRISPR gRNA sequence
aagttctctaagaaaattca

SEQ ID NO: 651845 - DNA, 20 bp, Artificial
  CRISPR gRNA sequence
tctaagaaaattcattcaaa

SEQ ID NO: 651846 - DNA, 20 bp, Artificial
  CRISPR gRNA sequence
taagaaaattcattcaaaac

SEQ ID NO: 651847 - DNA, 20 bp, Artificial
  CRISPR gRNA sequence
agaaaattcattcaaaacca

SEQ ID NO: 651848 - DNA, 20 bp, Artificial
  CRISPR gRNA sequence
attcaaaaccataggaagta

SEQ ID NO: 651849 - DNA, 20 bp, Artificial
  CRISPR gRNA sequence
aaaaccataggaagtagtca

SEQ ID NO: 651850 - DNA, 20 bp, Artificial
  CRISPR gRNA sequence
taaaatgttaggatcactaa

SEQ ID NO: 651851 - DNA, 20 bp, Artificial
  CRISPR gRNA sequence
ggatcactaatacctcttac

SEQ ID NO: 651852 - DNA, 20 bp, Artificial
  CRISPR gRNA sequence
atacctcttacttcttctta

SEQ ID NO: 651853 - DNA, 20 bp, Artificial
  CRISPR gRNA sequence
ttacttcttcttaagtttat

SEQ ID NO: 651854 - DNA, 20 bp, Artificial
  CRISPR gRNA sequence
acttcttcttaagtttatct

SEQ ID NO: 651855 - DNA, 20 bp, Artificial
  CRISPR gRNA sequence
cttcttcttaagtttatctt

SEQ ID NO: 651856 - DNA, 20 bp, Artificial
  CRISPR gRNA sequence
cttcttaagtttatcttaga

SEQ ID NO: 651857 - DNA, 20 bp, Artificial
  CRISPR gRNA sequence
ttcttaagtttatcttagat

SEQ ID NO: 651858 - DNA, 20 bp, Artificial
  CRISPR gRNA sequence
cttaagtttatcttagatgc

SEQ ID NO: 651859 - DNA, 20 bp, Artificial
  CRISPR gRNA sequence
ttaagtttatcttagatgct

SEQ ID NO: 651860 - DNA, 20 bp, Artificial
  CRISPR gRNA sequence
aagtttatcttagatgctaa

SEQ ID NO: 651861 - DNA, 20 bp, Artificial
  CRISPR gRNA sequence
agtttatcttagatgctaaa

SEQ ID NO: 651862 - DNA, 20 bp, Artificial
  CRISPR gRNA sequence
atcttagatgctaaatttta

SEQ ID NO: 651863 - DNA, 20 bp, Artificial
  CRISPR gRNA sequence
tcttagatgctaaattttaa

SEQ ID NO: 651864 - DNA, 20 bp, Artificial
  CRISPR gRNA sequence
agatgctaaattttaaaacc

SEQ ID NO: 651865 - DNA, 20 bp, Artificial
  CRISPR gRNA sequence
gatgctaaattttaaaacca

SEQ ID NO: 651866 - DNA, 20 bp, Artificial
  CRISPR gRNA sequence
aattttaaaaccaaaaactg

SEQ ID NO: 651867 - DNA, 20 bp, Artificial
  CRISPR gRNA sequence
taaaaccaaaaactgtcagg

SEQ ID NO: 651868 - DNA, 20 bp, Artificial
  CRISPR gRNA sequence
aaaaccaaaaactgtcaggc

SEQ ID NO: 651869 - DNA, 20 bp, Artificial
  CRISPR gRNA sequence
aaaccaaaaactgtcaggca

SEQ ID NO: 651870 - DNA, 20 bp, Artificial
  CRISPR gRNA sequence
tcaggcattataacattttt

SEQ ID NO: 651871 - DNA, 20 bp, Artificial
  CRISPR gRNA sequence
taacatttttagttctctcc

SEQ ID NO: 651872 - DNA, 20 bp, Artificial
  CRISPR gRNA sequence
ttagttctctccctcccaag

SEQ ID NO: 651873 - DNA, 20 bp, Artificial
  CRISPR gRNA sequence
tagttctctccctcccaagt

SEQ ID NO: 651874 - DNA, 20 bp, Artificial
  CRISPR gRNA sequence
agttctctccctcccaagtc

SEQ ID NO: 651875 - DNA, 20 bp, Artificial
  CRISPR gRNA sequence
gttctctccctcccaagtca

SEQ ID NO: 651876 - DNA, 20 bp, Artificial
  CRISPR gRNA sequence
tctccctcccaagtcaccag

SEQ ID NO: 651877 - DNA, 20 bp, Artificial
  CRISPR gRNA sequence
tccctcccaagtcaccagtg

SEQ ID NO: 651878 - DNA, 20 bp, Artificial
  CRISPR gRNA sequence
cctcccaagtcaccagtgct

SEQ ID NO: 651879 - DNA, 20 bp, Artificial
  CRISPR gRNA sequence
ccaagtcaccagtgctctat

SEQ ID NO: 651880 - DNA, 20 bp, Artificial
  CRISPR gRNA sequence
tattctagcactgtcaaata

SEQ ID NO: 651881 - DNA, 20 bp, Artificial
  CRISPR gRNA sequence
ttctagcactgtcaaataat

SEQ ID NO: 651882 - DNA, 20 bp, Artificial
  CRISPR gRNA sequence
tagcactgtcaaataatgat

SEQ ID NO: 651883 - DNA, 20 bp, Artificial
  CRISPR gRNA sequence
gcactgtcaaataatgatag

SEQ ID NO: 651884 - DNA, 20 bp, Artificial
  CRISPR gRNA sequence
tcaaataatgatagctgccg

SEQ ID NO: 651885 - DNA, 20 bp, Artificial
  CRISPR gRNA sequence
ccgtcattatttttatacaa

SEQ ID NO: 651886 - DNA, 20 bp, Artificial
  CRISPR gRNA sequence
tttttatacaatagctggca

SEQ ID NO: 651887 - DNA, 20 bp, Artificial
  CRISPR gRNA sequence
ttatacaatagctggcagca

SEQ ID NO: 651888 - DNA, 20 bp, Artificial
  CRISPR gRNA sequence
tatacaatagctggcagcaa

SEQ ID NO: 651889 - DNA, 20 bp, Artificial
  CRISPR gRNA sequence
atacaatagctggcagcaag

SEQ ID NO: 651890 - DNA, 20 bp, Artificial
  CRISPR gRNA sequence
tacaatagctggcagcaagt

SEQ ID NO: 651891 - DNA, 20 bp, Artificial
  CRISPR gRNA sequence
gcagcaagttgcacagaaac

SEQ ID NO: 651892 - DNA, 20 bp, Artificial
  CRISPR gRNA sequence
cacagaaacccttcatctta

SEQ ID NO: 651893 - DNA, 20 bp, Artificial
  CRISPR gRNA sequence
catcttagaagagttaccaa

SEQ ID NO: 651894 - DNA, 20 bp, Artificial
  CRISPR gRNA sequence
atcttagaagagttaccaaa

SEQ ID NO: 651895 - DNA, 20 bp, Artificial
  CRISPR gRNA sequence
agaagagttaccaaatagct

SEQ ID NO: 651896 - DNA, 20 bp, Artificial
  CRISPR gRNA sequence
gaagagttaccaaatagctt

SEQ ID NO: 651897 - DNA, 20 bp, Artificial
  CRISPR gRNA sequence
ccaaatagcttaaacaaatg

SEQ ID NO: 651898 - DNA, 20 bp, Artificial
  CRISPR gRNA sequence
aaacaaatgctgggacctta

SEQ ID NO: 651899 - DNA, 20 bp, Artificial
  CRISPR gRNA sequence
aacaaatgctgggaccttac

SEQ ID NO: 651900 - DNA, 20 bp, Artificial
  CRISPR gRNA sequence
ggaccttacagtagtactga

SEQ ID NO: 651901 - DNA, 20 bp, Artificial
  CRISPR gRNA sequence
acagtagtactgaccacctt

SEQ ID NO: 651902 - DNA, 20 bp, Artificial
  CRISPR gRNA sequence
cagtagtactgaccaccttc

SEQ ID NO: 651903 - DNA, 20 bp, Artificial
  CRISPR gRNA sequence
accaccttcctaaagccaaa

SEQ ID NO: 651904 - DNA, 20 bp, Artificial
  CRISPR gRNA sequence
cctaaagccaaaataagtga

SEQ ID NO: 651905 - DNA, 20 bp, Artificial
  CRISPR gRNA sequence
ctaaagccaaaataagtgag

SEQ ID NO: 651906 - DNA, 20 bp, Artificial
  CRISPR gRNA sequence
aagccaaaataagtgagctc

SEQ ID NO: 651907 - DNA, 20 bp, Artificial
  CRISPR gRNA sequence
tcatgccttattgatacttt

SEQ ID NO: 651908 - DNA, 20 bp, Artificial
  CRISPR gRNA sequence
atgccttattgatacttttc

SEQ ID NO: 651909 - DNA, 20 bp, Artificial
  CRISPR gRNA sequence
attgatacttttctggccag

SEQ ID NO: 651910 - DNA, 20 bp, Artificial
  CRISPR gRNA sequence
ttgatacttttctggccaga

SEQ ID NO: 651911 - DNA, 20 bp, Artificial
  CRISPR gRNA sequence
atacttttctggccagaatg

SEQ ID NO: 651912 - DNA, 20 bp, Artificial
  CRISPR gRNA sequence
ttctggccagaatgttagct

SEQ ID NO: 651913 - DNA, 20 bp, Artificial
  CRISPR gRNA sequence
tctggccagaatgttagctg

SEQ ID NO: 651914 - DNA, 20 bp, Artificial
  CRISPR gRNA sequence
ctggccagaatgttagctgt

SEQ ID NO: 651915 - DNA, 20 bp, Artificial
  CRISPR gRNA sequence
tggccagaatgttagctgtt

SEQ ID NO: 651916 - DNA, 20 bp, Artificial
  CRISPR gRNA sequence
gccagaatgttagctgtttt

SEQ ID NO: 651917 - DNA, 20 bp, Artificial
  CRISPR gRNA sequence
gctgttttactaaaaaaaaa

SEQ ID NO: 651918 - DNA, 20 bp, Artificial
  CRISPR gRNA sequence
ttttactaaaaaaaaaaaaa

SEQ ID NO: 651919 - DNA, 20 bp, Artificial
  CRISPR gRNA sequence
tactaaaaaaaaaaaaaaaa

SEQ ID NO: 651920 - DNA, 20 bp, Artificial
  CRISPR gRNA sequence
actaaaaaaaaaaaaaaaat

SEQ ID NO: 651921 - DNA, 20 bp, Artificial
  CRISPR gRNA sequence
ctaaaaaaaaaaaaaaaatt

SEQ ID NO: 651922 - DNA, 20 bp, Artificial
  CRISPR gRNA sequence
aaaaaaaaaaaaaaatttac

SEQ ID NO: 651923 - DNA, 20 bp, Artificial
  CRISPR gRNA sequence
acttattttatttttttaac

SEQ ID NO: 651924 - DNA, 20 bp, Artificial
  CRISPR gRNA sequence
cttattttatttttttaact

SEQ ID NO: 651925 - DNA, 20 bp, Artificial
  CRISPR gRNA sequence
attttatttttttaactgtt

SEQ ID NO: 651926 - DNA, 20 bp, Artificial
  CRISPR gRNA sequence
ttttatttttttaactgttt

SEQ ID NO: 651927 - DNA, 20 bp, Artificial
  CRISPR gRNA sequence
tatttttttaactgtttaaa

SEQ ID NO: 651928 - DNA, 20 bp, Artificial
  CRISPR gRNA sequence
atttttttaactgtttaaaa

SEQ ID NO: 651929 - DNA, 20 bp, Artificial
  CRISPR gRNA sequence
tttttttaactgtttaaaaa

SEQ ID NO: 651930 - DNA, 20 bp, Artificial
  CRISPR gRNA sequence
ttttaactgtttaaaaataa

SEQ ID NO: 651931 - DNA, 20 bp, Artificial
  CRISPR gRNA sequence
tttaactgtttaaaaataac

SEQ ID NO: 651932 - DNA, 20 bp, Artificial
  CRISPR gRNA sequence
ttaactgtttaaaaataact

SEQ ID NO: 651933 - DNA, 20 bp, Artificial
  CRISPR gRNA sequence
taactgtttaaaaataactt

SEQ ID NO: 651934 - DNA, 20 bp, Artificial
  CRISPR gRNA sequence
aactgtttaaaaataacttt

SEQ ID NO: 651935 - DNA, 20 bp, Artificial
  CRISPR gRNA sequence
actgtttaaaaataactttt

SEQ ID NO: 651936 - DNA, 20 bp, Artificial
  CRISPR gRNA sequence
tttaaaaataacttttttcc

SEQ ID NO: 651937 - DNA, 20 bp, Artificial
  CRISPR gRNA sequence
aaaaataacttttttcctcc

SEQ ID NO: 651938 - DNA, 20 bp, Artificial
  CRISPR gRNA sequence
aaaataacttttttcctcct

SEQ ID NO: 651939 - DNA, 20 bp, Artificial
  CRISPR gRNA sequence
ttttcctccttacacatata

SEQ ID NO: 651940 - DNA, 20 bp, Artificial
  CRISPR gRNA sequence
tttcctccttacacatatat

SEQ ID NO: 651941 - DNA, 20 bp, Artificial
  CRISPR gRNA sequence
ttcctccttacacatatatt

SEQ ID NO: 651942 - DNA, 20 bp, Artificial
  CRISPR gRNA sequence
tcctccttacacatatattc

SEQ ID NO: 651943 - DNA, 20 bp, Artificial
  CRISPR gRNA sequence
cctccttacacatatattcc

SEQ ID NO: 651944 - DNA, 20 bp, Artificial
  CRISPR gRNA sequence
ctccttacacatatattccc

SEQ ID NO: 651945 - DNA, 20 bp, Artificial
  CRISPR gRNA sequence
cttacacatatattcccatc

SEQ ID NO: 651946 - DNA, 20 bp, Artificial
  CRISPR gRNA sequence
acacatatattcccatcctc

SEQ ID NO: 651947 - DNA, 20 bp, Artificial
  CRISPR gRNA sequence
cacatatattcccatcctct

SEQ ID NO: 651948 - DNA, 20 bp, Artificial
  CRISPR gRNA sequence
ccatcctctccttcctgcta

SEQ ID NO: 651949 - DNA, 20 bp, Artificial
  CRISPR gRNA sequence
tccttcctgctactagaaac

SEQ ID NO: 651950 - DNA, 20 bp, Artificial
  CRISPR gRNA sequence
cttcctgctactagaaactg

SEQ ID NO: 651951 - DNA, 20 bp, Artificial
  CRISPR gRNA sequence
cctgctactagaaactgtct

SEQ ID NO: 651952 - DNA, 20 bp, Artificial
  CRISPR gRNA sequence
ctgctactagaaactgtctt

SEQ ID NO: 651953 - DNA, 20 bp, Artificial
  CRISPR gRNA sequence
ctactagaaactgtcttaaa

SEQ ID NO: 651954 - DNA, 20 bp, Artificial
  CRISPR gRNA sequence
ctagaaactgtcttaaaggt

SEQ ID NO: 651955 - DNA, 20 bp, Artificial
  CRISPR gRNA sequence
gaaactgtcttaaaggtttt

SEQ ID NO: 651956 - DNA, 20 bp, Artificial
  CRISPR gRNA sequence
tcttaaaggttttcacattt

SEQ ID NO: 651957 - DNA, 20 bp, Artificial
  CRISPR gRNA sequence
aaaggttttcacatttactt

SEQ ID NO: 651958 - DNA, 20 bp, Artificial
  CRISPR gRNA sequence
aaggttttcacatttacttt

SEQ ID NO: 651959 - DNA, 20 bp, Artificial
  CRISPR gRNA sequence
tcacatttacttttagcttt

SEQ ID NO: 651960 - DNA, 20 bp, Artificial
  CRISPR gRNA sequence
cacatttacttttagcttta

SEQ ID NO: 651961 - DNA, 20 bp, Artificial
  CRISPR gRNA sequence
acatttacttttagctttaa

SEQ ID NO: 651962 - DNA, 20 bp, Artificial
  CRISPR gRNA sequence
acttttagctttaacacttt

SEQ ID NO: 651963 - DNA, 20 bp, Artificial
  CRISPR gRNA sequence
cttttagctttaacactttc

SEQ ID NO: 651964 - DNA, 20 bp, Artificial
  CRISPR gRNA sequence
ttagctttaacactttcaat

SEQ ID NO: 651965 - DNA, 20 bp, Artificial
  CRISPR gRNA sequence
tagctttaacactttcaatc

SEQ ID NO: 651966 - DNA, 20 bp, Artificial
  CRISPR gRNA sequence
agctttaacactttcaatca

SEQ ID NO: 651967 - DNA, 20 bp, Artificial
  CRISPR gRNA sequence
gctttaacactttcaatcaa

SEQ ID NO: 651968 - DNA, 20 bp, Artificial
  CRISPR gRNA sequence
taacactttcaatcaaaatt

SEQ ID NO: 651969 - DNA, 20 bp, Artificial
  CRISPR gRNA sequence
aacactttcaatcaaaattg

SEQ ID NO: 651970 - DNA, 20 bp, Artificial
  CRISPR gRNA sequence
acactttcaatcaaaattgc

SEQ ID NO: 651971 - DNA, 20 bp, Artificial
  CRISPR gRNA sequence
tcaatcaaaattgcaattct

SEQ ID NO: 651972 - DNA, 20 bp, Artificial
  CRISPR gRNA sequence
caatcaaaattgcaattctg

SEQ ID NO: 651973 - DNA, 20 bp, Artificial
  CRISPR gRNA sequence
aatcaaaattgcaattctgt

SEQ ID NO: 651974 - DNA, 20 bp, Artificial
  CRISPR gRNA sequence
caattctgtttttggaagca

SEQ ID NO: 651975 - DNA, 20 bp, Artificial
  CRISPR gRNA sequence
tgtttttggaagcaggcacc

SEQ ID NO: 651976 - DNA, 20 bp, Artificial
  CRISPR gRNA sequence
tttttggaagcaggcaccct

SEQ ID NO: 651977 - DNA, 20 bp, Artificial
  CRISPR gRNA sequence
ttggaagcaggcaccctcca

SEQ ID NO: 651978 - DNA, 20 bp, Artificial
  CRISPR gRNA sequence
tggaagcaggcaccctccag

SEQ ID NO: 651979 - DNA, 20 bp, Artificial
  CRISPR gRNA sequence
ggaagcaggcaccctccagg

SEQ ID NO: 651980 - DNA, 20 bp, Artificial
  CRISPR gRNA sequence
gaagcaggcaccctccagga

SEQ ID NO: 651981 - DNA, 20 bp, Artificial
  CRISPR gRNA sequence
caggaagtatatttgaagat

SEQ ID NO: 651982 - DNA, 20 bp, Artificial
  CRISPR gRNA sequence
gaagatattaaaaaatgcag

SEQ ID NO: 651983 - DNA, 20 bp, Artificial
  CRISPR gRNA sequence
aagatattaaaaaatgcaga

SEQ ID NO: 651984 - DNA, 20 bp, Artificial
  CRISPR gRNA sequence
aaaaatgcagaaaataaata

SEQ ID NO: 651985 - DNA, 20 bp, Artificial
  CRISPR gRNA sequence
ttttcattaaacaaagtcaa

SEQ ID NO: 651986 - DNA, 20 bp, Artificial
  CRISPR gRNA sequence
ttcattaaacaaagtcaaca

SEQ ID NO: 651987 - DNA, 20 bp, Artificial
  CRISPR gRNA sequence
tcattaaacaaagtcaacaa

SEQ ID NO: 651988 - DNA, 20 bp, Artificial
  CRISPR gRNA sequence
cattaaacaaagtcaacaat

SEQ ID NO: 651989 - DNA, 20 bp, Artificial
  CRISPR gRNA sequence
attaaacaaagtcaacaatg

SEQ ID NO: 651990 - DNA, 20 bp, Artificial
  CRISPR gRNA sequence
aacaaagtcaacaatgcatg

SEQ ID NO: 651991 - DNA, 20 bp, Artificial
  CRISPR gRNA sequence
aggaaaaccggtgatctcag

SEQ ID NO: 651992 - DNA, 20 bp, Artificial
  CRISPR gRNA sequence
ggaaaaccggtgatctcaga

SEQ ID NO: 651993 - DNA, 20 bp, Artificial
  CRISPR gRNA sequence
agacacaagtgatttgacag

SEQ ID NO: 651994 - DNA, 20 bp, Artificial
  CRISPR gRNA sequence
gacaggccagatgcacacaa

SEQ ID NO: 651995 - DNA, 20 bp, Artificial
  CRISPR gRNA sequence
acaggccagatgcacacaaa

SEQ ID NO: 651996 - DNA, 20 bp, Artificial
  CRISPR gRNA sequence
ttccaagtcacagaaaaaca

SEQ ID NO: 651997 - DNA, 20 bp, Artificial
  CRISPR gRNA sequence
caagtcacagaaaaacatca

SEQ ID NO: 651998 - DNA, 20 bp, Artificial
  CRISPR gRNA sequence
taggtctcttgttctaatta

SEQ ID NO: 651999 - DNA, 20 bp, Artificial
  CRISPR gRNA sequence
ggtctcttgttctaattaat

SEQ ID NO: 652000 - DNA, 20 bp, Artificial
  CRISPR gRNA sequence
ttgttctaattaatagacga

SEQ ID NO: 652001 - DNA, 20 bp, Artificial
  CRISPR gRNA sequence
gttctaattaatagacgaga

SEQ ID NO: 652002 - DNA, 20 bp, Artificial
  CRISPR gRNA sequence
ttctaattaatagacgagag

SEQ ID NO: 652003 - DNA, 20 bp, Artificial
  CRISPR gRNA sequence
taattaatagacgagagttc

SEQ ID NO: 652004 - DNA, 20 bp, Artificial
  CRISPR gRNA sequence
attaatagacgagagttcct

SEQ ID NO: 652005 - DNA, 20 bp, Artificial
  CRISPR gRNA sequence
atagacgagagttcctctct

SEQ ID NO: 652006 - DNA, 20 bp, Artificial
  CRISPR gRNA sequence
ctctctatcactatttgctt

SEQ ID NO: 652007 - DNA, 20 bp, Artificial
  CRISPR gRNA sequence
tctatcactatttgctttgg

SEQ ID NO: 652008 - DNA, 20 bp, Artificial
  CRISPR gRNA sequence
tatcactatttgctttggca

SEQ ID NO: 652009 - DNA, 20 bp, Artificial
  CRISPR gRNA sequence
tcactatttgctttggcaat

SEQ ID NO: 652010 - DNA, 20 bp, Artificial
  CRISPR gRNA sequence
tttgctttggcaatctaaaa

SEQ ID NO: 652011 - DNA, 20 bp, Artificial
  CRISPR gRNA sequence
gctttggcaatctaaaatgc

SEQ ID NO: 652012 - DNA, 20 bp, Artificial
  CRISPR gRNA sequence
ctttggcaatctaaaatgct

SEQ ID NO: 652013 - DNA, 20 bp, Artificial
  CRISPR gRNA sequence
tggcaatctaaaatgctgat

SEQ ID NO: 652014 - DNA, 20 bp, Artificial
  CRISPR gRNA sequence
ggcaatctaaaatgctgata

SEQ ID NO: 652015 - DNA, 20 bp, Artificial
  CRISPR gRNA sequence
gcaatctaaaatgctgatat

SEQ ID NO: 652016 - DNA, 20 bp, Artificial
  CRISPR gRNA sequence
aaatgctgatattctcctag

SEQ ID NO: 652017 - DNA, 20 bp, Artificial
  CRISPR gRNA sequence
atattctcctagatctaaca

SEQ ID NO: 652018 - DNA, 20 bp, Artificial
  CRISPR gRNA sequence
tcctagatctaacagagagg

SEQ ID NO: 652019 - DNA, 20 bp, Artificial
  CRISPR gRNA sequence
ctagatctaacagagaggaa

SEQ ID NO: 652020 - DNA, 20 bp, Artificial
  CRISPR gRNA sequence
gatctaacagagaggaaaaa

SEQ ID NO: 652021 - DNA, 20 bp, Artificial
  CRISPR gRNA sequence
acagagaggaaaaatgggta

SEQ ID NO: 652022 - DNA, 20 bp, Artificial
  CRISPR gRNA sequence
ctccatctaacacctaagtg

SEQ ID NO: 652023 - DNA, 20 bp, Artificial
  CRISPR gRNA sequence
tccatctaacacctaagtgg

SEQ ID NO: 652024 - DNA, 20 bp, Artificial
  CRISPR gRNA sequence
catctaacacctaagtgggt

SEQ ID NO: 652025 - DNA, 20 bp, Artificial
  CRISPR gRNA sequence
acacctaagtgggtaaccta

SEQ ID NO: 652026 - DNA, 20 bp, Artificial
  CRISPR gRNA sequence
agtgggtaacctagatactg

SEQ ID NO: 652027 - DNA, 20 bp, Artificial
  CRISPR gRNA sequence
gatactgtaaatagaggcta

SEQ ID NO: 652028 - DNA, 20 bp, Artificial
  CRISPR gRNA sequence
taaatagaggctacataaag

SEQ ID NO: 652029 - DNA, 20 bp, Artificial
  CRISPR gRNA sequence
cataaaggatgcaagagaca

SEQ ID NO: 652030 - DNA, 20 bp, Artificial
  CRISPR gRNA sequence
tgaagtgagagccaaaatat

SEQ ID NO: 652031 - DNA, 20 bp, Artificial
  CRISPR gRNA sequence
aagtgagagccaaaatattt

SEQ ID NO: 652032 - DNA, 20 bp, Artificial
  CRISPR gRNA sequence
aacctgcaactctttggaaa

SEQ ID NO: 652033 - DNA, 20 bp, Artificial
  CRISPR gRNA sequence
acctgcaactctttggaaaa

SEQ ID NO: 652034 - DNA, 20 bp, Artificial
  CRISPR gRNA sequence
caactctttggaaaagaacc

SEQ ID NO: 652035 - DNA, 20 bp, Artificial
  CRISPR gRNA sequence
tttggaaaagaacctgaaaa

SEQ ID NO: 652036 - DNA, 20 bp, Artificial
  CRISPR gRNA sequence
tggaaaagaacctgaaaaca

SEQ ID NO: 652037 - DNA, 20 bp, Artificial
  CRISPR gRNA sequence
ggaaaagaacctgaaaacac

SEQ ID NO: 652038 - DNA, 20 bp, Artificial
  CRISPR gRNA sequence
gaaaagaacctgaaaacacg

SEQ ID NO: 652039 - DNA, 20 bp, Artificial
  CRISPR gRNA sequence
aaaacacgtgcatcttagcc

SEQ ID NO: 652040 - DNA, 20 bp, Artificial
  CRISPR gRNA sequence
agccaaaacctgtactaaca

SEQ ID NO: 652041 - DNA, 20 bp, Artificial
  CRISPR gRNA sequence
gccaaaacctgtactaacat

SEQ ID NO: 652042 - DNA, 20 bp, Artificial
  CRISPR gRNA sequence
tactaacatggaattgccac

SEQ ID NO: 652043 - DNA, 20 bp, Artificial
  CRISPR gRNA sequence
acatggaattgccacaggct

SEQ ID NO: 652044 - DNA, 20 bp, Artificial
  CRISPR gRNA sequence
ccacaggctagtaagttaaa

SEQ ID NO: 652045 - DNA, 20 bp, Artificial
  CRISPR gRNA sequence
gtaagttaaaaaactctcta

SEQ ID NO: 652046 - DNA, 20 bp, Artificial
  CRISPR gRNA sequence
aaaaactctctaccaaacat

SEQ ID NO: 652047 - DNA, 20 bp, Artificial
  CRISPR gRNA sequence
tctaccaaacataagtttac

SEQ ID NO: 652048 - DNA, 20 bp, Artificial
  CRISPR gRNA sequence
taccaaacataagtttactg

SEQ ID NO: 652049 - DNA, 20 bp, Artificial
  CRISPR gRNA sequence
ccaaacataagtttactgtt

SEQ ID NO: 652050 - DNA, 20 bp, Artificial
  CRISPR gRNA sequence
actgttgttgggtgagaaaa

SEQ ID NO: 652051 - DNA, 20 bp, Artificial
  CRISPR gRNA sequence
ctgttgttgggtgagaaaag

SEQ ID NO: 652052 - DNA, 20 bp, Artificial
  CRISPR gRNA sequence
ttgttgggtgagaaaagctc

SEQ ID NO: 652053 - DNA, 20 bp, Artificial
  CRISPR gRNA sequence
ttgggtgagaaaagctcaaa

SEQ ID NO: 652054 - DNA, 20 bp, Artificial
  CRISPR gRNA sequence
ggtgagaaaagctcaaatgt

SEQ ID NO: 652055 - DNA, 20 bp, Artificial
  CRISPR gRNA sequence
aaatgtcaaaagcacagttc

SEQ ID NO: 652056 - DNA, 20 bp, Artificial
  CRISPR gRNA sequence
ttatttgttcaaattgatca

SEQ ID NO: 652057 - DNA, 20 bp, Artificial
  CRISPR gRNA sequence
atttgttcaaattgatcatg

SEQ ID NO: 652058 - DNA, 20 bp, Artificial
  CRISPR gRNA sequence
tttgttcaaattgatcatgc

SEQ ID NO: 652059 - DNA, 20 bp, Artificial
  CRISPR gRNA sequence
gttcaaattgatcatgccta

SEQ ID NO: 652060 - DNA, 20 bp, Artificial
  CRISPR gRNA sequence
ttcaaattgatcatgcctac

SEQ ID NO: 652061 - DNA, 20 bp, Artificial
  CRISPR gRNA sequence
aaattgatcatgcctacact

SEQ ID NO: 652062 - DNA, 20 bp, Artificial
  CRISPR gRNA sequence
atcatgcctacactctgcac

SEQ ID NO: 652063 - DNA, 20 bp, Artificial
  CRISPR gRNA sequence
cactctgcactgtttattta

SEQ ID NO: 652064 - DNA, 20 bp, Artificial
  CRISPR gRNA sequence
tgcactgtttatttaaaaag

SEQ ID NO: 652065 - DNA, 20 bp, Artificial
  CRISPR gRNA sequence
cactgtttatttaaaaagat

SEQ ID NO: 652066 - DNA, 20 bp, Artificial
  CRISPR gRNA sequence
tttatttaaaaagatgagtg

SEQ ID NO: 652067 - DNA, 20 bp, Artificial
  CRISPR gRNA sequence
atttaaaaagatgagtgaac

SEQ ID NO: 652068 - DNA, 20 bp, Artificial
  CRISPR gRNA sequence
tttaaaaagatgagtgaact

SEQ ID NO: 652069 - DNA, 20 bp, Artificial
  CRISPR gRNA sequence
aaaaagatgagtgaactgcc

SEQ ID NO: 652070 - DNA, 20 bp, Artificial
  CRISPR gRNA sequence
aaaagatgagtgaactgcct

SEQ ID NO: 652071 - DNA, 20 bp, Artificial
  CRISPR gRNA sequence
cctttctgaagcaagtactt

SEQ ID NO: 652072 - DNA, 20 bp, Artificial
  CRISPR gRNA sequence
tctgaagcaagtacttgcaa

SEQ ID NO: 652073 - DNA, 20 bp, Artificial
  CRISPR gRNA sequence
ctgaagcaagtacttgcaaa

SEQ ID NO: 652074 - DNA, 20 bp, Artificial
  CRISPR gRNA sequence
tgaagcaagtacttgcaaaa

SEQ ID NO: 652075 - DNA, 20 bp, Artificial
  CRISPR gRNA sequence
aagcaagtacttgcaaaacc

SEQ ID NO: 652076 - DNA, 20 bp, Artificial
  CRISPR gRNA sequence
gcaaaaccagaatcaaattc

SEQ ID NO: 652077 - DNA, 20 bp, Artificial
  CRISPR gRNA sequence
caaaaccagaatcaaattca

SEQ ID NO: 652078 - DNA, 20 bp, Artificial
  CRISPR gRNA sequence
agaaataaagcagccaatta

SEQ ID NO: 652079 - DNA, 20 bp, Artificial
  CRISPR gRNA sequence
accacttgacaagcattttc

SEQ ID NO: 652080 - DNA, 20 bp, Artificial
  CRISPR gRNA sequence
gacaagcattttcctgtggt

SEQ ID NO: 652081 - DNA, 20 bp, Artificial
  CRISPR gRNA sequence
acaagcattttcctgtggtt

SEQ ID NO: 652082 - DNA, 20 bp, Artificial
  CRISPR gRNA sequence
tcctgtggttgtgtctaggg

SEQ ID NO: 652083 - DNA, 20 bp, Artificial
  CRISPR gRNA sequence
cctgtggttgtgtctagggg

SEQ ID NO: 652084 - DNA, 20 bp, Artificial
  CRISPR gRNA sequence
ctgtggttgtgtctagggga

SEQ ID NO: 652085 - DNA, 20 bp, Artificial
  CRISPR gRNA sequence
tggttgtgtctaggggatga

SEQ ID NO: 652086 - DNA, 20 bp, Artificial
  CRISPR gRNA sequence
tgtctaggggatgacagtca

SEQ ID NO: 652087 - DNA, 20 bp, Artificial
  CRISPR gRNA sequence
ggggatgacagtcaagtctc

SEQ ID NO: 652088 - DNA, 20 bp, Artificial
  CRISPR gRNA sequence
tgattaacagttactcccta

SEQ ID NO: 652089 - DNA, 20 bp, Artificial
  CRISPR gRNA sequence
attaacagttactccctacc

SEQ ID NO: 652090 - DNA, 20 bp, Artificial
  CRISPR gRNA sequence
acagttactccctaccctat

SEQ ID NO: 652091 - DNA, 20 bp, Artificial
  CRISPR gRNA sequence
ctccctaccctatacatgca

SEQ ID NO: 652092 - DNA, 20 bp, Artificial
  CRISPR gRNA sequence
cctaccctatacatgcaatg

SEQ ID NO: 652093 - DNA, 20 bp, Artificial
  CRISPR gRNA sequence
ccctatacatgcaatgtttc

SEQ ID NO: 652094 - DNA, 20 bp, Artificial
  CRISPR gRNA sequence
tacatgcaatgtttctaaag

SEQ ID NO: 652095 - DNA, 20 bp, Artificial
  CRISPR gRNA sequence
ctaaagccaatagctaacta

SEQ ID NO: 652096 - DNA, 20 bp, Artificial
  CRISPR gRNA sequence
taaagccaatagctaactaa

SEQ ID NO: 652097 - DNA, 20 bp, Artificial
  CRISPR gRNA sequence
aagccaatagctaactaata

SEQ ID NO: 652098 - DNA, 20 bp, Artificial
  CRISPR gRNA sequence
actaatagaaactacatatt

SEQ ID NO: 652099 - DNA, 20 bp, Artificial
  CRISPR gRNA sequence
atagaaactacatattatct

SEQ ID NO: 652100 - DNA, 20 bp, Artificial
  CRISPR gRNA sequence
catattatctctttttactc

SEQ ID NO: 652101 - DNA, 20 bp, Artificial
  CRISPR gRNA sequence
tctctttttactctttagga

SEQ ID NO: 652102 - DNA, 20 bp, Artificial
  CRISPR gRNA sequence
tttttactctttaggaaatt

SEQ ID NO: 652103 - DNA, 20 bp, Artificial
  CRISPR gRNA sequence
tttactctttaggaaattgt

SEQ ID NO: 652104 - DNA, 20 bp, Artificial
  CRISPR gRNA sequence
ttactctttaggaaattgtg

SEQ ID NO: 652105 - DNA, 20 bp, Artificial
  CRISPR gRNA sequence
tactctttaggaaattgtgt

SEQ ID NO: 652106 - DNA, 20 bp, Artificial
  CRISPR gRNA sequence
actctttaggaaattgtgtg

SEQ ID NO: 652107 - DNA, 20 bp, Artificial
  CRISPR gRNA sequence
ctctttaggaaattgtgtga

SEQ ID NO: 652108 - DNA, 20 bp, Artificial
  CRISPR gRNA sequence
tttaggaaattgtgtgagtt

SEQ ID NO: 652109 - DNA, 20 bp, Artificial
  CRISPR gRNA sequence
taggaaattgtgtgagttat

SEQ ID NO: 652110 - DNA, 20 bp, Artificial
  CRISPR gRNA sequence
aggaaattgtgtgagttatc

SEQ ID NO: 652111 - DNA, 20 bp, Artificial
  CRISPR gRNA sequence
ggaaattgtgtgagttatct

SEQ ID NO: 652112 - DNA, 20 bp, Artificial
  CRISPR gRNA sequence
tgtgagttatctgagaaata

SEQ ID NO: 652113 - DNA, 20 bp, Artificial
  CRISPR gRNA sequence
tctgagaaataaaaacatta

SEQ ID NO: 652114 - DNA, 20 bp, Artificial
  CRISPR gRNA sequence
agaaataaaaacattacacc

SEQ ID NO: 652115 - DNA, 20 bp, Artificial
  CRISPR gRNA sequence
caccaaataactagtatatt

SEQ ID NO: 652116 - DNA, 20 bp, Artificial
  CRISPR gRNA sequence
gtatattgaaatgtaaaaat

SEQ ID NO: 652117 - DNA, 20 bp, Artificial
  CRISPR gRNA sequence
aaatgtaaaaattctattgc

SEQ ID NO: 652118 - DNA, 20 bp, Artificial
  CRISPR gRNA sequence
tattgcctaaattgtagtca

SEQ ID NO: 652119 - DNA, 20 bp, Artificial
  CRISPR gRNA sequence
ttgcctaaattgtagtcata

SEQ ID NO: 652120 - DNA, 20 bp, Artificial
  CRISPR gRNA sequence
cctaaattgtagtcatagta

SEQ ID NO: 652121 - DNA, 20 bp, Artificial
  CRISPR gRNA sequence
aattgtagtcatagtatatt

SEQ ID NO: 652122 - DNA, 20 bp, Artificial
  CRISPR gRNA sequence
tagtcatagtatatttttta

SEQ ID NO: 652123 - DNA, 20 bp, Artificial
  CRISPR gRNA sequence
tttatcaaatcaactagcaa

SEQ ID NO: 652124 - DNA, 20 bp, Artificial
  CRISPR gRNA sequence
ttatcaaatcaactagcaaa

SEQ ID NO: 652125 - DNA, 20 bp, Artificial
  CRISPR gRNA sequence
tatcaaatcaactagcaaaa

SEQ ID NO: 652126 - DNA, 20 bp, Artificial
  CRISPR gRNA sequence
atcaaatcaactagcaaaaa

SEQ ID NO: 652127 - DNA, 20 bp, Artificial
  CRISPR gRNA sequence
tcaaatcaactagcaaaaaa

SEQ ID NO: 652128 - DNA, 20 bp, Artificial
  CRISPR gRNA sequence
gcaaaaaacatgaatgcaaa

SEQ ID NO: 652129 - DNA, 20 bp, Artificial
  CRISPR gRNA sequence
attatgagattagtatgata

SEQ ID NO: 652130 - DNA, 20 bp, Artificial
  CRISPR gRNA sequence
tgagattagtatgataattt

SEQ ID NO: 652131 - DNA, 20 bp, Artificial
  CRISPR gRNA sequence
gtatgataatttagtataca

SEQ ID NO: 652132 - DNA, 20 bp, Artificial
  CRISPR gRNA sequence
agtatacattcacctgctaa

SEQ ID NO: 652133 - DNA, 20 bp, Artificial
  CRISPR gRNA sequence
gtatacattcacctgctaac

SEQ ID NO: 652134 - DNA, 20 bp, Artificial
  CRISPR gRNA sequence
acctgctaactttactagtt

SEQ ID NO: 652135 - DNA, 20 bp, Artificial
  CRISPR gRNA sequence
ctaactttactagttttttc

SEQ ID NO: 652136 - DNA, 20 bp, Artificial
  CRISPR gRNA sequence
actttactagttttttcttt

SEQ ID NO: 652137 - DNA, 20 bp, Artificial
  CRISPR gRNA sequence
tactagttttttctttctaa

SEQ ID NO: 652138 - DNA, 20 bp, Artificial
  CRISPR gRNA sequence
actagttttttctttctaaa

SEQ ID NO: 652139 - DNA, 20 bp, Artificial
  CRISPR gRNA sequence
ctagttttttctttctaaat

SEQ ID NO: 652140 - DNA, 20 bp, Artificial
  CRISPR gRNA sequence
gttttttctttctaaatgat

SEQ ID NO: 652141 - DNA, 20 bp, Artificial
  CRISPR gRNA sequence
tttctttctaaatgatacgg

SEQ ID NO: 652142 - DNA, 20 bp, Artificial
  CRISPR gRNA sequence
ttctttctaaatgatacggg

SEQ ID NO: 652143 - DNA, 20 bp, Artificial
  CRISPR gRNA sequence
tctttctaaatgatacggga

SEQ ID NO: 652144 - DNA, 20 bp, Artificial
  CRISPR gRNA sequence
ctttctaaatgatacgggaa

SEQ ID NO: 652145 - DNA, 20 bp, Artificial
  CRISPR gRNA sequence
tttctaaatgatacgggaat

SEQ ID NO: 652146 - DNA, 20 bp, Artificial
  CRISPR gRNA sequence
tctaaatgatacgggaattg

SEQ ID NO: 652147 - DNA, 20 bp, Artificial
  CRISPR gRNA sequence
ctaaatgatacgggaattgt

SEQ ID NO: 652148 - DNA, 20 bp, Artificial
  CRISPR gRNA sequence
taaatgatacgggaattgta

SEQ ID NO: 652149 - DNA, 20 bp, Artificial
  CRISPR gRNA sequence
aatgatacgggaattgtaag

SEQ ID NO: 652150 - DNA, 20 bp, Artificial
  CRISPR gRNA sequence
taaggactgcttctataatt

SEQ ID NO: 652151 - DNA, 20 bp, Artificial
  CRISPR gRNA sequence
cttctataattaaattttct

SEQ ID NO: 652152 - DNA, 20 bp, Artificial
  CRISPR gRNA sequence
ctataattaaattttcttag

SEQ ID NO: 652153 - DNA, 20 bp, Artificial
  CRISPR gRNA sequence
tataattaaattttcttagg

SEQ ID NO: 652154 - DNA, 20 bp, Artificial
  CRISPR gRNA sequence
taattaaattttcttaggaa

SEQ ID NO: 652155 - DNA, 20 bp, Artificial
  CRISPR gRNA sequence
aattttcttaggaagtgctc

SEQ ID NO: 652156 - DNA, 20 bp, Artificial
  CRISPR gRNA sequence
tcttaggaagtgctcattac

SEQ ID NO: 652157 - DNA, 20 bp, Artificial
  CRISPR gRNA sequence
cttaggaagtgctcattact

SEQ ID NO: 652158 - DNA, 20 bp, Artificial
  CRISPR gRNA sequence
ttaggaagtgctcattactt

SEQ ID NO: 652159 - DNA, 20 bp, Artificial
  CRISPR gRNA sequence
aggaagtgctcattacttaa

SEQ ID NO: 652160 - DNA, 20 bp, Artificial
  CRISPR gRNA sequence
ggaagtgctcattacttaaa

SEQ ID NO: 652161 - DNA, 20 bp, Artificial
  CRISPR gRNA sequence
attacttaaaagaattacaa

SEQ ID NO: 652162 - DNA, 20 bp, Artificial
  CRISPR gRNA sequence
cttaaaagaattacaacttt

SEQ ID NO: 652163 - DNA, 20 bp, Artificial
  CRISPR gRNA sequence
aaaagaattacaacttttaa

SEQ ID NO: 652164 - DNA, 20 bp, Artificial
  CRISPR gRNA sequence
aaagaattacaacttttaaa

SEQ ID NO: 652165 - DNA, 20 bp, Artificial
  CRISPR gRNA sequence
caacttttaaataaataaag

SEQ ID NO: 652166 - DNA, 20 bp, Artificial
  CRISPR gRNA sequence
ttaaataaataaagcaaatt

SEQ ID NO: 652167 - DNA, 20 bp, Artificial
  CRISPR gRNA sequence
taaataaataaagcaaattc

SEQ ID NO: 652168 - DNA, 20 bp, Artificial
  CRISPR gRNA sequence
aaataaataaagcaaattca

SEQ ID NO: 652169 - DNA, 20 bp, Artificial
  CRISPR gRNA sequence
aataaataaagcaaattcaa

SEQ ID NO: 652170 - DNA, 20 bp, Artificial
  CRISPR gRNA sequence
aaactcaatcataatttcaa

SEQ ID NO: 652171 - DNA, 20 bp, Artificial
  CRISPR gRNA sequence
aatcataatttcaagtcaat

SEQ ID NO: 652172 - DNA, 20 bp, Artificial
  CRISPR gRNA sequence
caagtcaatagctaaaatta

SEQ ID NO: 652173 - DNA, 20 bp, Artificial
  CRISPR gRNA sequence
aagtcaatagctaaaattac

SEQ ID NO: 652174 - DNA, 20 bp, Artificial
  CRISPR gRNA sequence
aaattacttaaagttaataa

SEQ ID NO: 652175 - DNA, 20 bp, Artificial
  CRISPR gRNA sequence
cttaaagttaataaattgca

SEQ ID NO: 652176 - DNA, 20 bp, Artificial
  CRISPR gRNA sequence
aaagttaataaattgcaaaa

SEQ ID NO: 652177 - DNA, 20 bp, Artificial
  CRISPR gRNA sequence
aagttaataaattgcaaaat

SEQ ID NO: 652178 - DNA, 20 bp, Artificial
  CRISPR gRNA sequence
ataaattgcaaaatgtattc

SEQ ID NO: 652179 - DNA, 20 bp, Artificial
  CRISPR gRNA sequence
caaaatgtattcaatggtat

SEQ ID NO: 652180 - DNA, 20 bp, Artificial
  CRISPR gRNA sequence
aatggtattctatataaatt

SEQ ID NO: 652181 - DNA, 20 bp, Artificial
  CRISPR gRNA sequence
tatataaattgcttaaattt

SEQ ID NO: 652182 - DNA, 20 bp, Artificial
  CRISPR gRNA sequence
tataaattgcttaaatttca

SEQ ID NO: 652183 - DNA, 20 bp, Artificial
  CRISPR gRNA sequence
cttaaatttcagtagtattt

SEQ ID NO: 652184 - DNA, 20 bp, Artificial
  CRISPR gRNA sequence
aaatttcagtagtatttact

SEQ ID NO: 652185 - DNA, 20 bp, Artificial
  CRISPR gRNA sequence
aatttcagtagtatttacta

SEQ ID NO: 652186 - DNA, 20 bp, Artificial
  CRISPR gRNA sequence
cagtagtatttactaattac

SEQ ID NO: 652187 - DNA, 20 bp, Artificial
  CRISPR gRNA sequence
agtagtatttactaattact

SEQ ID NO: 652188 - DNA, 20 bp, Artificial
  CRISPR gRNA sequence
actaattactaagcttgcag

SEQ ID NO: 652189 - DNA, 20 bp, Artificial
  CRISPR gRNA sequence
ctaattactaagcttgcagt

SEQ ID NO: 652190 - DNA, 20 bp, Artificial
  CRISPR gRNA sequence
attactaagcttgcagtttt

SEQ ID NO: 652191 - DNA, 20 bp, Artificial
  CRISPR gRNA sequence
ctaagcttgcagttttataa

SEQ ID NO: 652192 - DNA, 20 bp, Artificial
  CRISPR gRNA sequence
agcttgcagttttataataa

SEQ ID NO: 652193 - DNA, 20 bp, Artificial
  CRISPR gRNA sequence
gcagttttataataacttac

SEQ ID NO: 652194 - DNA, 20 bp, Artificial
  CRISPR gRNA sequence
cagttttataataacttaca

SEQ ID NO: 652195 - DNA, 20 bp, Artificial
  CRISPR gRNA sequence
tataataacttacagtttcg

SEQ ID NO: 652196 - DNA, 20 bp, Artificial
  CRISPR gRNA sequence
ataataacttacagtttcga

SEQ ID NO: 652197 - DNA, 20 bp, Artificial
  CRISPR gRNA sequence
taataacttacagtttcgag

SEQ ID NO: 652198 - DNA, 20 bp, Artificial
  CRISPR gRNA sequence
acagtttcgagagctgttag

SEQ ID NO: 652199 - DNA, 20 bp, Artificial
  CRISPR gRNA sequence
cagtttcgagagctgttaga

SEQ ID NO: 652200 - DNA, 20 bp, Artificial
  CRISPR gRNA sequence
cgagagctgttagaagtaaa

SEQ ID NO: 652201 - DNA, 20 bp, Artificial
  CRISPR gRNA sequence
gagagctgttagaagtaaaa

SEQ ID NO: 652202 - DNA, 20 bp, Artificial
  CRISPR gRNA sequence
ttagaagtaaaaagaaaaag

SEQ ID NO: 652203 - DNA, 20 bp, Artificial
  CRISPR gRNA sequence
gaagtaaaaagaaaaagttg

SEQ ID NO: 652204 - DNA, 20 bp, Artificial
  CRISPR gRNA sequence
ctctctctggatagtcagaa

SEQ ID NO: 652205 - DNA, 20 bp, Artificial
  CRISPR gRNA sequence
tctctggatagtcagaatac

SEQ ID NO: 652206 - DNA, 20 bp, Artificial
  CRISPR gRNA sequence
tctggatagtcagaatacat

SEQ ID NO: 652207 - DNA, 20 bp, Artificial
  CRISPR gRNA sequence
tggatagtcagaatacattt

SEQ ID NO: 652208 - DNA, 20 bp, Artificial
  CRISPR gRNA sequence
gatagtcagaatacatttac

SEQ ID NO: 652209 - DNA, 20 bp, Artificial
  CRISPR gRNA sequence
acaaatatgctcataattaa

SEQ ID NO: 652210 - DNA, 20 bp, Artificial
  CRISPR gRNA sequence
caaatatgctcataattaag

SEQ ID NO: 652211 - DNA, 20 bp, Artificial
  CRISPR gRNA sequence
ataattaagtacatgattca

SEQ ID NO: 652212 - DNA, 20 bp, Artificial
  CRISPR gRNA sequence
agtacatgattcacttttct

SEQ ID NO: 652213 - DNA, 20 bp, Artificial
  CRISPR gRNA sequence
acttttcttagttattaaat

SEQ ID NO: 652214 - DNA, 20 bp, Artificial
  CRISPR gRNA sequence
ttcttagttattaaatcttc

SEQ ID NO: 652215 - DNA, 20 bp, Artificial
  CRISPR gRNA sequence
tcttagttattaaatcttcg

SEQ ID NO: 652216 - DNA, 20 bp, Artificial
  CRISPR gRNA sequence
cttagttattaaatcttcgg

SEQ ID NO: 652217 - DNA, 20 bp, Artificial
  CRISPR gRNA sequence
ttagttattaaatcttcggg

SEQ ID NO: 652218 - DNA, 20 bp, Artificial
  CRISPR gRNA sequence
agttattaaatcttcggggg

SEQ ID NO: 652219 - DNA, 20 bp, Artificial
  CRISPR gRNA sequence
gttattaaatcttcgggggg

SEQ ID NO: 652220 - DNA, 20 bp, Artificial
  CRISPR gRNA sequence
ttaaatcttcgggggggggg

SEQ ID NO: 652221 - DNA, 20 bp, Artificial
  CRISPR gRNA sequence
aatcttcggggggggggaag

SEQ ID NO: 652222 - DNA, 20 bp, Artificial
  CRISPR gRNA sequence
cggggggggggaaggaaaga

SEQ ID NO: 652223 - DNA, 20 bp, Artificial
  CRISPR gRNA sequence
ggggggggggaaggaaagag

SEQ ID NO: 652224 - DNA, 20 bp, Artificial
  CRISPR gRNA sequence
tccttcacatattgccaaaa

SEQ ID NO: 652225 - DNA, 20 bp, Artificial
  CRISPR gRNA sequence
ccttcacatattgccaaaac

SEQ ID NO: 652226 - DNA, 20 bp, Artificial
  CRISPR gRNA sequence
cttcacatattgccaaaaca

SEQ ID NO: 652227 - DNA, 20 bp, Artificial
  CRISPR gRNA sequence
cacatattgccaaaacagaa

SEQ ID NO: 652228 - DNA, 20 bp, Artificial
  CRISPR gRNA sequence
acatattgccaaaacagaaa

SEQ ID NO: 652229 - DNA, 20 bp, Artificial
  CRISPR gRNA sequence
ccaaaacagaaaacttgtaa

SEQ ID NO: 652230 - DNA, 20 bp, Artificial
  CRISPR gRNA sequence
gtaaatttaattatatttac

SEQ ID NO: 652231 - DNA, 20 bp, Artificial
  CRISPR gRNA sequence
taaatttaattatatttaca

SEQ ID NO: 652232 - DNA, 20 bp, Artificial
  CRISPR gRNA sequence
aattatatttacatgtaagt

SEQ ID NO: 652233 - DNA, 20 bp, Artificial
  CRISPR gRNA sequence
attatatttacatgtaagtc

SEQ ID NO: 652234 - DNA, 20 bp, Artificial
  CRISPR gRNA sequence
tatttacatgtaagtccaat

SEQ ID NO: 652235 - DNA, 20 bp, Artificial
  CRISPR gRNA sequence
acatgtaagtccaatgtcct

SEQ ID NO: 652236 - DNA, 20 bp, Artificial
  CRISPR gRNA sequence
catgtaagtccaatgtcctt

SEQ ID NO: 652237 - DNA, 20 bp, Artificial
  CRISPR gRNA sequence
tctataacatgtaagaataa

SEQ ID NO: 652238 - DNA, 20 bp, Artificial
  CRISPR gRNA sequence
ctataacatgtaagaataaa

SEQ ID NO: 652239 - DNA, 20 bp, Artificial
  CRISPR gRNA sequence
tataacatgtaagaataaaa

SEQ ID NO: 652240 - DNA, 20 bp, Artificial
  CRISPR gRNA sequence
taacatgtaagaataaaata

SEQ ID NO: 652241 - DNA, 20 bp, Artificial
  CRISPR gRNA sequence
aagtataaagaaaacaagat

SEQ ID NO: 652242 - DNA, 20 bp, Artificial
  CRISPR gRNA sequence
caaattacttttgagtaaga

SEQ ID NO: 652243 - DNA, 20 bp, Artificial
  CRISPR gRNA sequence
aaattacttttgagtaagag

SEQ ID NO: 652244 - DNA, 20 bp, Artificial
  CRISPR gRNA sequence
cttttgagtaagagtaataa

SEQ ID NO: 652245 - DNA, 20 bp, Artificial
  CRISPR gRNA sequence
ttgagtaagagtaataaagc

SEQ ID NO: 652246 - DNA, 20 bp, Artificial
  CRISPR gRNA sequence
tgagtaagagtaataaagca

SEQ ID NO: 652247 - DNA, 20 bp, Artificial
  CRISPR gRNA sequence
gagtaagagtaataaagcac

SEQ ID NO: 652248 - DNA, 20 bp, Artificial
  CRISPR gRNA sequence
agtaagagtaataaagcact

SEQ ID NO: 652249 - DNA, 20 bp, Artificial
  CRISPR gRNA sequence
gcacttgataactaaactga

SEQ ID NO: 652250 - DNA, 20 bp, Artificial
  CRISPR gRNA sequence
cacttgataactaaactgat

SEQ ID NO: 652251 - DNA, 20 bp, Artificial
  CRISPR gRNA sequence
gataactaaactgataaaat

SEQ ID NO: 652252 - DNA, 20 bp, Artificial
  CRISPR gRNA sequence
ataactaaactgataaaata

SEQ ID NO: 652253 - DNA, 20 bp, Artificial
  CRISPR gRNA sequence
aactgataaaatattataat

SEQ ID NO: 652254 - DNA, 20 bp, Artificial
  CRISPR gRNA sequence
ataaaatattataattaaga

SEQ ID NO: 652255 - DNA, 20 bp, Artificial
  CRISPR gRNA sequence
taattaagaaaaaagcaacc

SEQ ID NO: 652256 - DNA, 20 bp, Artificial
  CRISPR gRNA sequence
agaaaaaagcaaccatattc

SEQ ID NO: 652257 - DNA, 20 bp, Artificial
  CRISPR gRNA sequence
ttaataaagtattttgtctt

SEQ ID NO: 652258 - DNA, 20 bp, Artificial
  CRISPR gRNA sequence
aataaagtattttgtcttct

SEQ ID NO: 652259 - DNA, 20 bp, Artificial
  CRISPR gRNA sequence
ataaagtattttgtcttctg

SEQ ID NO: 652260 - DNA, 20 bp, Artificial
  CRISPR gRNA sequence
tgtcttctgtcactgacagc

SEQ ID NO: 652261 - DNA, 20 bp, Artificial
  CRISPR gRNA sequence
gtcttctgtcactgacagca

SEQ ID NO: 652262 - DNA, 20 bp, Artificial
  CRISPR gRNA sequence
tcttctgtcactgacagcat

SEQ ID NO: 652263 - DNA, 20 bp, Artificial
  CRISPR gRNA sequence
ctgtcactgacagcatgtaa

SEQ ID NO: 652264 - DNA, 20 bp, Artificial
  CRISPR gRNA sequence
tgtcactgacagcatgtaag

SEQ ID NO: 652265 - DNA, 20 bp, Artificial
  CRISPR gRNA sequence
tcactgacagcatgtaagtt

SEQ ID NO: 652266 - DNA, 20 bp, Artificial
  CRISPR gRNA sequence
acagcatgtaagttgcatct

SEQ ID NO: 652267 - DNA, 20 bp, Artificial
  CRISPR gRNA sequence
catcttattacataaaaaca

SEQ ID NO: 652268 - DNA, 20 bp, Artificial
  CRISPR gRNA sequence
attacataaaaacaatgtat

SEQ ID NO: 652269 - DNA, 20 bp, Artificial
  CRISPR gRNA sequence
ttacataaaaacaatgtata

SEQ ID NO: 652270 - DNA, 20 bp, Artificial
  CRISPR gRNA sequence
cataaaaacaatgtatatta

SEQ ID NO: 652271 - DNA, 20 bp, Artificial
  CRISPR gRNA sequence
catcagtaaatgacccttta

SEQ ID NO: 652272 - DNA, 20 bp, Artificial
  CRISPR gRNA sequence
tatcaaaaacagtagccaaa

SEQ ID NO: 652273 - DNA, 20 bp, Artificial
  CRISPR gRNA sequence
atcaaaaacagtagccaaaa

SEQ ID NO: 652274 - DNA, 20 bp, Artificial
  CRISPR gRNA sequence
tcaaaaacagtagccaaaac

SEQ ID NO: 652275 - DNA, 20 bp, Artificial
  CRISPR gRNA sequence
tcttttcctacaaattcaaa

SEQ ID NO: 652276 - DNA, 20 bp, Artificial
  CRISPR gRNA sequence
ttcctacaaattcaaaacat

SEQ ID NO: 652277 - DNA, 20 bp, Artificial
  CRISPR gRNA sequence
tcctacaaattcaaaacatc

SEQ ID NO: 652278 - DNA, 20 bp, Artificial
  CRISPR gRNA sequence
cctacaaattcaaaacatct

SEQ ID NO: 652279 - DNA, 20 bp, Artificial
  CRISPR gRNA sequence
ctacaaattcaaaacatctt

SEQ ID NO: 652280 - DNA, 20 bp, Artificial
  CRISPR gRNA sequence
caaattcaaaacatctttcc

SEQ ID NO: 652281 - DNA, 20 bp, Artificial
  CRISPR gRNA sequence
aaaacatctttccaaatttt

SEQ ID NO: 652282 - DNA, 20 bp, Artificial
  CRISPR gRNA sequence
tccaaattttatcagttctt

SEQ ID NO: 652283 - DNA, 20 bp, Artificial
  CRISPR gRNA sequence
ccaaattttatcagttcttc

SEQ ID NO: 652284 - DNA, 20 bp, Artificial
  CRISPR gRNA sequence
caaattttatcagttcttct

SEQ ID NO: 652285 - DNA, 20 bp, Artificial
  CRISPR gRNA sequence
tatcagttcttctctggaca

SEQ ID NO: 652286 - DNA, 20 bp, Artificial
  CRISPR gRNA sequence
atcagttcttctctggacaa

SEQ ID NO: 652287 - DNA, 20 bp, Artificial
  CRISPR gRNA sequence
tcagttcttctctggacaaa

SEQ ID NO: 652288 - DNA, 20 bp, Artificial
  CRISPR gRNA sequence
ttctctggacaaaagccttt

SEQ ID NO: 652289 - DNA, 20 bp, Artificial
  CRISPR gRNA sequence
ctctggacaaaagcctttca

SEQ ID NO: 652290 - DNA, 20 bp, Artificial
  CRISPR gRNA sequence
tctggacaaaagcctttcaa

SEQ ID NO: 652291 - DNA, 20 bp, Artificial
  CRISPR gRNA sequence
tggacaaaagcctttcaact

SEQ ID NO: 652292 - DNA, 20 bp, Artificial
  CRISPR gRNA sequence
gacaaaagcctttcaacttt

SEQ ID NO: 652293 - DNA, 20 bp, Artificial
  CRISPR gRNA sequence
tcaactttgctacagaaatg

SEQ ID NO: 652294 - DNA, 20 bp, Artificial
  CRISPR gRNA sequence
caactttgctacagaaatgg

SEQ ID NO: 652295 - DNA, 20 bp, Artificial
  CRISPR gRNA sequence
aactttgctacagaaatgga

SEQ ID NO: 652296 - DNA, 20 bp, Artificial
  CRISPR gRNA sequence
tgctacagaaatggatataa

SEQ ID NO: 652297 - DNA, 20 bp, Artificial
  CRISPR gRNA sequence
gctacagaaatggatataaa

SEQ ID NO: 652298 - DNA, 20 bp, Artificial
  CRISPR gRNA sequence
ctacagaaatggatataaat

SEQ ID NO: 652299 - DNA, 20 bp, Artificial
  CRISPR gRNA sequence
cagaaatggatataaatgag

SEQ ID NO: 652300 - DNA, 20 bp, Artificial
  CRISPR gRNA sequence
tataaattttcaattacact

SEQ ID NO: 652301 - DNA, 20 bp, Artificial
  CRISPR gRNA sequence
taaattttcaattacacttc

SEQ ID NO: 652302 - DNA, 20 bp, Artificial
  CRISPR gRNA sequence
tcaattacacttcacttcca

SEQ ID NO: 652303 - DNA, 20 bp, Artificial
  CRISPR gRNA sequence
caattacacttcacttccaa

SEQ ID NO: 652304 - DNA, 20 bp, Artificial
  CRISPR gRNA sequence
aattacacttcacttccaat

SEQ ID NO: 652305 - DNA, 20 bp, Artificial
  CRISPR gRNA sequence
cacttcacttccaatgcttt

SEQ ID NO: 652306 - DNA, 20 bp, Artificial
  CRISPR gRNA sequence
cacttccaatgctttggaga

SEQ ID NO: 652307 - DNA, 20 bp, Artificial
  CRISPR gRNA sequence
acttccaatgctttggagaa

SEQ ID NO: 652308 - DNA, 20 bp, Artificial
  CRISPR gRNA sequence
ccaatgctttggagaagaaa

SEQ ID NO: 652309 - DNA, 20 bp, Artificial
  CRISPR gRNA sequence
caatgctttggagaagaaac

SEQ ID NO: 652310 - DNA, 20 bp, Artificial
  CRISPR gRNA sequence
tggagaagaaactttcacat

SEQ ID NO: 652311 - DNA, 20 bp, Artificial
  CRISPR gRNA sequence
ggagaagaaactttcacatt

SEQ ID NO: 652312 - DNA, 20 bp, Artificial
  CRISPR gRNA sequence
gagaagaaactttcacattt

SEQ ID NO: 652313 - DNA, 20 bp, Artificial
  CRISPR gRNA sequence
tcacattttttaaaagcaag

SEQ ID NO: 652314 - DNA, 20 bp, Artificial
  CRISPR gRNA sequence
cacattttttaaaagcaagt

SEQ ID NO: 652315 - DNA, 20 bp, Artificial
  CRISPR gRNA sequence
acattttttaaaagcaagta

SEQ ID NO: 652316 - DNA, 20 bp, Artificial
  CRISPR gRNA sequence
tttaaaagcaagtaacactg

SEQ ID NO: 652317 - DNA, 20 bp, Artificial
  CRISPR gRNA sequence
ttaaaagcaagtaacactgt

SEQ ID NO: 652318 - DNA, 20 bp, Artificial
  CRISPR gRNA sequence
taaaagcaagtaacactgta

SEQ ID NO: 652319 - DNA, 20 bp, Artificial
  CRISPR gRNA sequence
aaaagcaagtaacactgtaa

SEQ ID NO: 652320 - DNA, 20 bp, Artificial
  CRISPR gRNA sequence
aaagcaagtaacactgtaat

SEQ ID NO: 652321 - DNA, 20 bp, Artificial
  CRISPR gRNA sequence
taattttatcactgacggtt

SEQ ID NO: 652322 - DNA, 20 bp, Artificial
  CRISPR gRNA sequence
tatcactgacggtttagctt

SEQ ID NO: 652323 - DNA, 20 bp, Artificial
  CRISPR gRNA sequence
atcactgacggtttagcttt

SEQ ID NO: 652324 - DNA, 20 bp, Artificial
  CRISPR gRNA sequence
tcactgacggtttagctttc

SEQ ID NO: 652325 - DNA, 20 bp, Artificial
  CRISPR gRNA sequence
acggtttagctttctaccaa

SEQ ID NO: 652326 - DNA, 20 bp, Artificial
  CRISPR gRNA sequence
agctttctaccaaggcaaca

SEQ ID NO: 652327 - DNA, 20 bp, Artificial
  CRISPR gRNA sequence
gctttctaccaaggcaacat

SEQ ID NO: 652328 - DNA, 20 bp, Artificial
  CRISPR gRNA sequence
tctaccaaggcaacataaaa

SEQ ID NO: 652329 - DNA, 20 bp, Artificial
  CRISPR gRNA sequence
ctaccaaggcaacataaaat

SEQ ID NO: 652330 - DNA, 20 bp, Artificial
  CRISPR gRNA sequence
taccaaggcaacataaaatt

SEQ ID NO: 652331 - DNA, 20 bp, Artificial
  CRISPR gRNA sequence
ccaaggcaacataaaattat

SEQ ID NO: 652332 - DNA, 20 bp, Artificial
  CRISPR gRNA sequence
tttcattttttaactgtgaa

SEQ ID NO: 652333 - DNA, 20 bp, Artificial
  CRISPR gRNA sequence
cattttttaactgtgaagag

SEQ ID NO: 652334 - DNA, 20 bp, Artificial
  CRISPR gRNA sequence
attttttaactgtgaagagt

SEQ ID NO: 652335 - DNA, 20 bp, Artificial
  CRISPR gRNA sequence
tttaactgtgaagagtcctt

SEQ ID NO: 652336 - DNA, 20 bp, Artificial
  CRISPR gRNA sequence
ttaactgtgaagagtccttt

SEQ ID NO: 652337 - DNA, 20 bp, Artificial
  CRISPR gRNA sequence
taactgtgaagagtcctttg

SEQ ID NO: 652338 - DNA, 20 bp, Artificial
  CRISPR gRNA sequence
aactgtgaagagtcctttgg

SEQ ID NO: 652339 - DNA, 20 bp, Artificial
  CRISPR gRNA sequence
actgtgaagagtcctttgga

SEQ ID NO: 652340 - DNA, 20 bp, Artificial
  CRISPR gRNA sequence
tgaagagtcctttggaagtg

SEQ ID NO: 652341 - DNA, 20 bp, Artificial
  CRISPR gRNA sequence
tggaagtgacgtttccacat

SEQ ID NO: 652342 - DNA, 20 bp, Artificial
  CRISPR gRNA sequence
ggaagtgacgtttccacatt

SEQ ID NO: 652343 - DNA, 20 bp, Artificial
  CRISPR gRNA sequence
gaagtgacgtttccacattt

SEQ ID NO: 652344 - DNA, 20 bp, Artificial
  CRISPR gRNA sequence
ccacattttttacccaacaa

SEQ ID NO: 652345 - DNA, 20 bp, Artificial
  CRISPR gRNA sequence
cacattttttacccaacaac

SEQ ID NO: 652346 - DNA, 20 bp, Artificial
  CRISPR gRNA sequence
tttacccaacaacaacaaaa

SEQ ID NO: 652347 - DNA, 20 bp, Artificial
  CRISPR gRNA sequence
ttacccaacaacaacaaaaa

SEQ ID NO: 652348 - DNA, 20 bp, Artificial
  CRISPR gRNA sequence
tacccaacaacaacaaaaaa

SEQ ID NO: 652349 - DNA, 20 bp, Artificial
  CRISPR gRNA sequence
acccaacaacaacaaaaaat

SEQ ID NO: 652350 - DNA, 20 bp, Artificial
  CRISPR gRNA sequence
cccaacaacaacaaaaaatc

SEQ ID NO: 652351 - DNA, 20 bp, Artificial
  CRISPR gRNA sequence
gcaagtcaaaacaacaacca

SEQ ID NO: 652352 - DNA, 20 bp, Artificial
  CRISPR gRNA sequence
taacctttcttacctgatac

SEQ ID NO: 652353 - DNA, 20 bp, Artificial
  CRISPR gRNA sequence
acctttcttacctgatacag

SEQ ID NO: 652354 - DNA, 20 bp, Artificial
  CRISPR gRNA sequence
tcttacctgatacaggtaag

SEQ ID NO: 652355 - DNA, 20 bp, Artificial
  CRISPR gRNA sequence
cttacctgatacaggtaagc

SEQ ID NO: 652356 - DNA, 20 bp, Artificial
  CRISPR gRNA sequence
ttacctgatacaggtaagca

SEQ ID NO: 652357 - DNA, 20 bp, Artificial
  CRISPR gRNA sequence
acctgatacaggtaagcacc

SEQ ID NO: 652358 - DNA, 20 bp, Artificial
  CRISPR gRNA sequence
cctgatacaggtaagcacca

SEQ ID NO: 652359 - DNA, 20 bp, Artificial
  CRISPR gRNA sequence
atacaggtaagcaccagctc

SEQ ID NO: 652360 - DNA, 20 bp, Artificial
  CRISPR gRNA sequence
ccaaatgccaccttgggata

SEQ ID NO: 652361 - DNA, 20 bp, Artificial
  CRISPR gRNA sequence
gggatagttcagactagtaa

SEQ ID NO: 652362 - DNA, 20 bp, Artificial
  CRISPR gRNA sequence
ggatagttcagactagtaag

SEQ ID NO: 652363 - DNA, 20 bp, Artificial
  CRISPR gRNA sequence
agactagtaagcaggctcat

SEQ ID NO: 652364 - DNA, 20 bp, Artificial
  CRISPR gRNA sequence
gtaagcaggctcatgtttta

SEQ ID NO: 652365 - DNA, 20 bp, Artificial
  CRISPR gRNA sequence
atgttttataatactagaat

SEQ ID NO: 652366 - DNA, 20 bp, Artificial
  CRISPR gRNA sequence
tataatactagaatgaacag

SEQ ID NO: 652367 - DNA, 20 bp, Artificial
  CRISPR gRNA sequence
ataatactagaatgaacagg

SEQ ID NO: 652368 - DNA, 20 bp, Artificial
  CRISPR gRNA sequence
taatactagaatgaacagga

SEQ ID NO: 652369 - DNA, 20 bp, Artificial
  CRISPR gRNA sequence
gaatgaacaggaataaatct

SEQ ID NO: 652370 - DNA, 20 bp, Artificial
  CRISPR gRNA sequence
tgttgttctttctttagcaa

SEQ ID NO: 652371 - DNA, 20 bp, Artificial
  CRISPR gRNA sequence
ttctttctttagcaaaatct

SEQ ID NO: 652372 - DNA, 20 bp, Artificial
  CRISPR gRNA sequence
tttctttagcaaaatctata

SEQ ID NO: 652373 - DNA, 20 bp, Artificial
  CRISPR gRNA sequence
tctttagcaaaatctataac

SEQ ID NO: 652374 - DNA, 20 bp, Artificial
  CRISPR gRNA sequence
ctttagcaaaatctataaca

SEQ ID NO: 652375 - DNA, 20 bp, Artificial
  CRISPR gRNA sequence
tttagcaaaatctataacag

SEQ ID NO: 652376 - DNA, 20 bp, Artificial
  CRISPR gRNA sequence
tagcaaaatctataacagta

SEQ ID NO: 652377 - DNA, 20 bp, Artificial
  CRISPR gRNA sequence
agcaaaatctataacagtag

SEQ ID NO: 652378 - DNA, 20 bp, Artificial
  CRISPR gRNA sequence
gcaaaatctataacagtagc

SEQ ID NO: 652379 - DNA, 20 bp, Artificial
  CRISPR gRNA sequence
taacagtagctataccacaa

SEQ ID NO: 652380 - DNA, 20 bp, Artificial
  CRISPR gRNA sequence
taccacaatgtgagaggacc

SEQ ID NO: 652381 - DNA, 20 bp, Artificial
  CRISPR gRNA sequence
acaaattaaagtctgttgct

SEQ ID NO: 652382 - DNA, 20 bp, Artificial
  CRISPR gRNA sequence
aagtctgttgctggagagac

SEQ ID NO: 652383 - DNA, 20 bp, Artificial
  CRISPR gRNA sequence
ttgctggagagacacacaca

SEQ ID NO: 652384 - DNA, 20 bp, Artificial
  CRISPR gRNA sequence
ctggagagacacacacacac

SEQ ID NO: 652385 - DNA, 20 bp, Artificial
  CRISPR gRNA sequence
gagagacacacacacacaaa

SEQ ID NO: 652386 - DNA, 20 bp, Artificial
  CRISPR gRNA sequence
actgcttgtcatgtgacttg

SEQ ID NO: 652387 - DNA, 20 bp, Artificial
  CRISPR gRNA sequence
ctgcttgtcatgtgacttgg

SEQ ID NO: 652388 - DNA, 20 bp, Artificial
  CRISPR gRNA sequence
cttgtcatgtgacttggtga

SEQ ID NO: 652389 - DNA, 20 bp, Artificial
  CRISPR gRNA sequence
gtcatgtgacttggtgaggc

SEQ ID NO: 652390 - DNA, 20 bp, Artificial
  CRISPR gRNA sequence
tcatgtgacttggtgaggca

SEQ ID NO: 652391 - DNA, 20 bp, Artificial
  CRISPR gRNA sequence
ggtgaggcatgctgtccatt

SEQ ID NO: 652392 - DNA, 20 bp, Artificial
  CRISPR gRNA sequence
gtgaggcatgctgtccattg

SEQ ID NO: 652393 - DNA, 20 bp, Artificial
  CRISPR gRNA sequence
tccattgggtgtgcttgagg

SEQ ID NO: 652394 - DNA, 20 bp, Artificial
  CRISPR gRNA sequence
ggtgtgcttgaggtgaggtc

SEQ ID NO: 652395 - DNA, 20 bp, Artificial
  CRISPR gRNA sequence
gaggtgaggtcaattgccat

SEQ ID NO: 652396 - DNA, 20 bp, Artificial
  CRISPR gRNA sequence
aggtgaggtcaattgccata

SEQ ID NO: 652397 - DNA, 20 bp, Artificial
  CRISPR gRNA sequence
ccatattggagtgctccctt

SEQ ID NO: 652398 - DNA, 20 bp, Artificial
  CRISPR gRNA sequence
gagtgctccctttcgggtga

SEQ ID NO: 652399 - DNA, 20 bp, Artificial
  CRISPR gRNA sequence
cctttcgggtgaaagctcat

SEQ ID NO: 652400 - DNA, 20 bp, Artificial
  CRISPR gRNA sequence
tcgggtgaaagctcattgtc

SEQ ID NO: 652401 - DNA, 20 bp, Artificial
  CRISPR gRNA sequence
cgggtgaaagctcattgtca

SEQ ID NO: 652402 - DNA, 20 bp, Artificial
  CRISPR gRNA sequence
gggtgaaagctcattgtcac

SEQ ID NO: 652403 - DNA, 20 bp, Artificial
  CRISPR gRNA sequence
attgtcacctgctttcacaa

SEQ ID NO: 652404 - DNA, 20 bp, Artificial
  CRISPR gRNA sequence
tcacctgctttcacaaaata

SEQ ID NO: 652405 - DNA, 20 bp, Artificial
  CRISPR gRNA sequence
ctttcacaaaatataatctt

SEQ ID NO: 652406 - DNA, 20 bp, Artificial
  CRISPR gRNA sequence
tcacaaaatataatcttttg

SEQ ID NO: 652407 - DNA, 20 bp, Artificial
  CRISPR gRNA sequence
cacaaaatataatcttttgg

SEQ ID NO: 652408 - DNA, 20 bp, Artificial
  CRISPR gRNA sequence
acaaaatataatcttttggt

SEQ ID NO: 652409 - DNA, 20 bp, Artificial
  CRISPR gRNA sequence
ttggtttctattcattgtca

SEQ ID NO: 652410 - DNA, 20 bp, Artificial
  CRISPR gRNA sequence
tggtttctattcattgtcac

SEQ ID NO: 652411 - DNA, 20 bp, Artificial
  CRISPR gRNA sequence
ggtttctattcattgtcaca

SEQ ID NO: 652412 - DNA, 20 bp, Artificial
  CRISPR gRNA sequence
gtttctattcattgtcacat

SEQ ID NO: 652413 - DNA, 20 bp, Artificial
  CRISPR gRNA sequence
ctattcattgtcacataaga

SEQ ID NO: 652414 - DNA, 20 bp, Artificial
  CRISPR gRNA sequence
tattcattgtcacataagat

SEQ ID NO: 652415 - DNA, 20 bp, Artificial
  CRISPR gRNA sequence
ttcattgtcacataagatgt

SEQ ID NO: 652416 - DNA, 20 bp, Artificial
  CRISPR gRNA sequence
attgtcacataagatgtaat

SEQ ID NO: 652417 - DNA, 20 bp, Artificial
  CRISPR gRNA sequence
tcacataagatgtaattact

SEQ ID NO: 652418 - DNA, 20 bp, Artificial
  CRISPR gRNA sequence
ctaactttgctttatacacg

SEQ ID NO: 652419 - DNA, 20 bp, Artificial
  CRISPR gRNA sequence
actttgctttatacacgcaa

SEQ ID NO: 652420 - DNA, 20 bp, Artificial
  CRISPR gRNA sequence
tgctttatacacgcaatggc

SEQ ID NO: 652421 - DNA, 20 bp, Artificial
  CRISPR gRNA sequence
gctttatacacgcaatggca

SEQ ID NO: 652422 - DNA, 20 bp, Artificial
  CRISPR gRNA sequence
ctttatacacgcaatggcat

SEQ ID NO: 652423 - DNA, 20 bp, Artificial
  CRISPR gRNA sequence
tatacacgcaatggcatgca

SEQ ID NO: 652424 - DNA, 20 bp, Artificial
  CRISPR gRNA sequence
atacacgcaatggcatgcat

SEQ ID NO: 652425 - DNA, 20 bp, Artificial
  CRISPR gRNA sequence
tacacgcaatggcatgcata

SEQ ID NO: 652426 - DNA, 20 bp, Artificial
  CRISPR gRNA sequence
caaactgtaaggtaatacat

SEQ ID NO: 652427 - DNA, 20 bp, Artificial
  CRISPR gRNA sequence
aaactgtaaggtaatacatt

SEQ ID NO: 652428 - DNA, 20 bp, Artificial
  CRISPR gRNA sequence
taaggtaatacatttttccc

SEQ ID NO: 652429 - DNA, 20 bp, Artificial
  CRISPR gRNA sequence
ttcccttagaaactataagg

SEQ ID NO: 652430 - DNA, 20 bp, Artificial
  CRISPR gRNA sequence
tcccttagaaactataagga

SEQ ID NO: 652431 - DNA, 20 bp, Artificial
  CRISPR gRNA sequence
cccttagaaactataaggaa

SEQ ID NO: 652432 - DNA, 20 bp, Artificial
  CRISPR gRNA sequence
ccttagaaactataaggaaa

SEQ ID NO: 652433 - DNA, 20 bp, Artificial
  CRISPR gRNA sequence
agaaactataaggaaatatc

SEQ ID NO: 652434 - DNA, 20 bp, Artificial
  CRISPR gRNA sequence
gaaactataaggaaatatca

SEQ ID NO: 652435 - DNA, 20 bp, Artificial
  CRISPR gRNA sequence
taaggaaatatcatttagaa

SEQ ID NO: 652436 - DNA, 20 bp, Artificial
  CRISPR gRNA sequence
agaaatatacagttgaatga

SEQ ID NO: 652437 - DNA, 20 bp, Artificial
  CRISPR gRNA sequence
gaaatatacagttgaatgaa

SEQ ID NO: 652438 - DNA, 20 bp, Artificial
  CRISPR gRNA sequence
aatgaaatgatgagaagcca

SEQ ID NO: 652439 - DNA, 20 bp, Artificial
  CRISPR gRNA sequence
acaaaactttattatctcaa

SEQ ID NO: 652440 - DNA, 20 bp, Artificial
  CRISPR gRNA sequence
tattatctcaatacataagt

SEQ ID NO: 652441 - DNA, 20 bp, Artificial
  CRISPR gRNA sequence
attatctcaatacataagtt

SEQ ID NO: 652442 - DNA, 20 bp, Artificial
  CRISPR gRNA sequence
ttatctcaatacataagttg

SEQ ID NO: 652443 - DNA, 20 bp, Artificial
  CRISPR gRNA sequence
tctcaatacataagttgttg

SEQ ID NO: 652444 - DNA, 20 bp, Artificial
  CRISPR gRNA sequence
aatacataagttgttgattt

SEQ ID NO: 652445 - DNA, 20 bp, Artificial
  CRISPR gRNA sequence
ttgatttctaaagtatcttt

SEQ ID NO: 652446 - DNA, 20 bp, Artificial
  CRISPR gRNA sequence
atttctaaagtatctttcag

SEQ ID NO: 652447 - DNA, 20 bp, Artificial
  CRISPR gRNA sequence
ctaaagtatctttcagttga

SEQ ID NO: 652448 - DNA, 20 bp, Artificial
  CRISPR gRNA sequence
taaagtatctttcagttgaa

SEQ ID NO: 652449 - DNA, 20 bp, Artificial
  CRISPR gRNA sequence
aagtatctttcagttgaaag

SEQ ID NO: 652450 - DNA, 20 bp, Artificial
  CRISPR gRNA sequence
tcagttgaaagaaataactt

SEQ ID NO: 652451 - DNA, 20 bp, Artificial
  CRISPR gRNA sequence
cagttgaaagaaataacttt

SEQ ID NO: 652452 - DNA, 20 bp, Artificial
  CRISPR gRNA sequence
agttgaaagaaataactttt

SEQ ID NO: 652453 - DNA, 20 bp, Artificial
  CRISPR gRNA sequence
aaagaaataacttttctttt

SEQ ID NO: 652454 - DNA, 20 bp, Artificial
  CRISPR gRNA sequence
ttcttttaacatctaattta

SEQ ID NO: 652455 - DNA, 20 bp, Artificial
  CRISPR gRNA sequence
tcttttaacatctaatttaa

SEQ ID NO: 652456 - DNA, 20 bp, Artificial
  CRISPR gRNA sequence
cttttaacatctaatttaat

SEQ ID NO: 652457 - DNA, 20 bp, Artificial
  CRISPR gRNA sequence
ttttaacatctaatttaatt

SEQ ID NO: 652458 - DNA, 20 bp, Artificial
  CRISPR gRNA sequence
ttaacatctaatttaattgt

SEQ ID NO: 652459 - DNA, 20 bp, Artificial
  CRISPR gRNA sequence
taacatctaatttaattgtt

SEQ ID NO: 652460 - DNA, 20 bp, Artificial
  CRISPR gRNA sequence
aacatctaatttaattgtta

SEQ ID NO: 652461 - DNA, 20 bp, Artificial
  CRISPR gRNA sequence
acatctaatttaattgttaa

SEQ ID NO: 652462 - DNA, 20 bp, Artificial
  CRISPR gRNA sequence
atttaattgttaagcacaca

SEQ ID NO: 652463 - DNA, 20 bp, Artificial
  CRISPR gRNA sequence
aattgttaagcacacagaat

SEQ ID NO: 652464 - DNA, 20 bp, Artificial
  CRISPR gRNA sequence
attgttaagcacacagaatt

SEQ ID NO: 652465 - DNA, 20 bp, Artificial
  CRISPR gRNA sequence
ttaagcacacagaatttata

SEQ ID NO: 652466 - DNA, 20 bp, Artificial
  CRISPR gRNA sequence
agcacacagaatttataatg

SEQ ID NO: 652467 - DNA, 20 bp, Artificial
  CRISPR gRNA sequence
ataatgagcattttccaaaa

SEQ ID NO: 652468 - DNA, 20 bp, Artificial
  CRISPR gRNA sequence
taatgagcattttccaaaat

SEQ ID NO: 652469 - DNA, 20 bp, Artificial
  CRISPR gRNA sequence
tccaaaatgctggctatcag

SEQ ID NO: 652470 - DNA, 20 bp, Artificial
  CRISPR gRNA sequence
ccaaaatgctggctatcaga

SEQ ID NO: 652471 - DNA, 20 bp, Artificial
  CRISPR gRNA sequence
caaaatgctggctatcagag

SEQ ID NO: 652472 - DNA, 20 bp, Artificial
  CRISPR gRNA sequence
gctatcagagagaggatgga

SEQ ID NO: 652473 - DNA, 20 bp, Artificial
  CRISPR gRNA sequence
tcagagagaggatggaaaag

SEQ ID NO: 652474 - DNA, 20 bp, Artificial
  CRISPR gRNA sequence
aagaaatgtcaagttaggaa

SEQ ID NO: 652475 - DNA, 20 bp, Artificial
  CRISPR gRNA sequence
ggaaagctaattctctttca

SEQ ID NO: 652476 - DNA, 20 bp, Artificial
  CRISPR gRNA sequence
attctctttcacataatatg

SEQ ID NO: 652477 - DNA, 20 bp, Artificial
  CRISPR gRNA sequence
tctttcacataatatgtctg

SEQ ID NO: 652478 - DNA, 20 bp, Artificial
  CRISPR gRNA sequence
tttcacataatatgtctgaa

SEQ ID NO: 652479 - DNA, 20 bp, Artificial
  CRISPR gRNA sequence
tcacataatatgtctgaaaa

SEQ ID NO: 652480 - DNA, 20 bp, Artificial
  CRISPR gRNA sequence
cacataatatgtctgaaaaa

SEQ ID NO: 652481 - DNA, 20 bp, Artificial
  CRISPR gRNA sequence
acataatatgtctgaaaaat

SEQ ID NO: 652482 - DNA, 20 bp, Artificial
  CRISPR gRNA sequence
aaaaattaggttacagagaa

SEQ ID NO: 652483 - DNA, 20 bp, Artificial
  CRISPR gRNA sequence
ggttacagagaagtaaatat

SEQ ID NO: 652484 - DNA, 20 bp, Artificial
  CRISPR gRNA sequence
cagagaagtaaatatttagt

SEQ ID NO: 652485 - DNA, 20 bp, Artificial
  CRISPR gRNA sequence
agtacacaccatattaatag

SEQ ID NO: 652486 - DNA, 20 bp, Artificial
  CRISPR gRNA sequence
gtacacaccatattaataga

SEQ ID NO: 652487 - DNA, 20 bp, Artificial
  CRISPR gRNA sequence
atagacatatatgaaacctg

SEQ ID NO: 652488 - DNA, 20 bp, Artificial
  CRISPR gRNA sequence
gcctattctcaacttacaac

SEQ ID NO: 652489 - DNA, 20 bp, Artificial
  CRISPR gRNA sequence
ttctcaacttacaacaaagt

SEQ ID NO: 652490 - DNA, 20 bp, Artificial
  CRISPR gRNA sequence
tcaacttacaacaaagtaaa

SEQ ID NO: 652491 - DNA, 20 bp, Artificial
  CRISPR gRNA sequence
aacttacaacaaagtaaatt

SEQ ID NO: 652492 - DNA, 20 bp, Artificial
  CRISPR gRNA sequence
acaacaaagtaaattataaa

SEQ ID NO: 652493 - DNA, 20 bp, Artificial
  CRISPR gRNA sequence
caacaaagtaaattataaaa

SEQ ID NO: 652494 - DNA, 20 bp, Artificial
  CRISPR gRNA sequence
taaaaagtaggaaagtgttg

SEQ ID NO: 652495 - DNA, 20 bp, Artificial
  CRISPR gRNA sequence
aactgctagctactattgat

SEQ ID NO: 652496 - DNA, 20 bp, Artificial
  CRISPR gRNA sequence
ctagctactattgatttaag

SEQ ID NO: 652497 - DNA, 20 bp, Artificial
  CRISPR gRNA sequence
gctactattgatttaagtac

SEQ ID NO: 652498 - DNA, 20 bp, Artificial
  CRISPR gRNA sequence
ctattgatttaagtacacta

SEQ ID NO: 652499 - DNA, 20 bp, Artificial
  CRISPR gRNA sequence
ttgatttaagtacactactt

SEQ ID NO: 652500 - DNA, 20 bp, Artificial
  CRISPR gRNA sequence
atttaagtacactacttaac

SEQ ID NO: 652501 - DNA, 20 bp, Artificial
  CRISPR gRNA sequence
aagtacactacttaacttag

SEQ ID NO: 652502 - DNA, 20 bp, Artificial
  CRISPR gRNA sequence
agtacactacttaacttagt

SEQ ID NO: 652503 - DNA, 20 bp, Artificial
  CRISPR gRNA sequence
cttaacttagtatgtttcta

SEQ ID NO: 652504 - DNA, 20 bp, Artificial
  CRISPR gRNA sequence
aacttagtatgtttctatat

SEQ ID NO: 652505 - DNA, 20 bp, Artificial
  CRISPR gRNA sequence
acttagtatgtttctatatt

SEQ ID NO: 652506 - DNA, 20 bp, Artificial
  CRISPR gRNA sequence
agtatgtttctatatttcct

SEQ ID NO: 652507 - DNA, 20 bp, Artificial
  CRISPR gRNA sequence
gtatgtttctatatttcctt

SEQ ID NO: 652508 - DNA, 20 bp, Artificial
  CRISPR gRNA sequence
ctatatttccttcttatttc

SEQ ID NO: 652509 - DNA, 20 bp, Artificial
  CRISPR gRNA sequence
tatatttccttcttatttca

SEQ ID NO: 652510 - DNA, 20 bp, Artificial
  CRISPR gRNA sequence
tatttccttcttatttcact

SEQ ID NO: 652511 - DNA, 20 bp, Artificial
  CRISPR gRNA sequence
ccttcttatttcacttcagt

SEQ ID NO: 652512 - DNA, 20 bp, Artificial
  CRISPR gRNA sequence
cttcttatttcacttcagtg

SEQ ID NO: 652513 - DNA, 20 bp, Artificial
  CRISPR gRNA sequence
cttatttcacttcagtgctg

SEQ ID NO: 652514 - DNA, 20 bp, Artificial
  CRISPR gRNA sequence
ttatttcacttcagtgctgt

SEQ ID NO: 652515 - DNA, 20 bp, Artificial
  CRISPR gRNA sequence
atttcacttcagtgctgtca

SEQ ID NO: 652516 - DNA, 20 bp, Artificial
  CRISPR gRNA sequence
tttcacttcagtgctgtcat

SEQ ID NO: 652517 - DNA, 20 bp, Artificial
  CRISPR gRNA sequence
cacttcagtgctgtcatttt

SEQ ID NO: 652518 - DNA, 20 bp, Artificial
  CRISPR gRNA sequence
acttcagtgctgtcattttc

SEQ ID NO: 652519 - DNA, 20 bp, Artificial
  CRISPR gRNA sequence
cagtgctgtcattttctcaa

SEQ ID NO: 652520 - DNA, 20 bp, Artificial
  CRISPR gRNA sequence
agtgctgtcattttctcaaa

SEQ ID NO: 652521 - DNA, 20 bp, Artificial
  CRISPR gRNA sequence
tcattttctcaaactcattc

SEQ ID NO: 652522 - DNA, 20 bp, Artificial
  CRISPR gRNA sequence
tctcaaactcattcaaaggt

SEQ ID NO: 652523 - DNA, 20 bp, Artificial
  CRISPR gRNA sequence
ctcaaactcattcaaaggtg

SEQ ID NO: 652524 - DNA, 20 bp, Artificial
  CRISPR gRNA sequence
tcaaactcattcaaaggtga

SEQ ID NO: 652525 - DNA, 20 bp, Artificial
  CRISPR gRNA sequence
aaactcattcaaaggtgaaa

SEQ ID NO: 652526 - DNA, 20 bp, Artificial
  CRISPR gRNA sequence
attcaaaggtgaaattgtga

SEQ ID NO: 652527 - DNA, 20 bp, Artificial
  CRISPR gRNA sequence
aaaggtgaaattgtgaacag

SEQ ID NO: 652528 - DNA, 20 bp, Artificial
  CRISPR gRNA sequence
tgaacagagagaaaaaagag

SEQ ID NO: 652529 - DNA, 20 bp, Artificial
  CRISPR gRNA sequence
tcaataaagtttcataatcc

SEQ ID NO: 652530 - DNA, 20 bp, Artificial
  CRISPR gRNA sequence
aataaagtttcataatccag

SEQ ID NO: 652531 - DNA, 20 bp, Artificial
  CRISPR gRNA sequence
cataatccaggaattaaaac

SEQ ID NO: 652532 - DNA, 20 bp, Artificial
  CRISPR gRNA sequence
ataatccaggaattaaaaca

SEQ ID NO: 652533 - DNA, 20 bp, Artificial
  CRISPR gRNA sequence
aaacacaggtaatacaaagg

SEQ ID NO: 652534 - DNA, 20 bp, Artificial
  CRISPR gRNA sequence
tattaccaataacaaatcaa

SEQ ID NO: 652535 - DNA, 20 bp, Artificial
  CRISPR gRNA sequence
attaccaataacaaatcaat

SEQ ID NO: 652536 - DNA, 20 bp, Artificial
  CRISPR gRNA sequence
ttaccaataacaaatcaatg

SEQ ID NO: 652537 - DNA, 20 bp, Artificial
  CRISPR gRNA sequence
ccaataacaaatcaatgaaa

SEQ ID NO: 652538 - DNA, 20 bp, Artificial
  CRISPR gRNA sequence
atacttacacgttatatagc

SEQ ID NO: 652539 - DNA, 20 bp, Artificial
  CRISPR gRNA sequence
acacgttatatagccatcaa

SEQ ID NO: 652540 - DNA, 20 bp, Artificial
  CRISPR gRNA sequence
cacgttatatagccatcaat

SEQ ID NO: 652541 - DNA, 20 bp, Artificial
  CRISPR gRNA sequence
tatagccatcaatagcctct

SEQ ID NO: 652542 - DNA, 20 bp, Artificial
  CRISPR gRNA sequence
tgtttccatagtcaaagtgc

SEQ ID NO: 652543 - DNA, 20 bp, Artificial
  CRISPR gRNA sequence
tttccatagtcaaagtgcaa

SEQ ID NO: 652544 - DNA, 20 bp, Artificial
  CRISPR gRNA sequence
ccatagtcaaagtgcaatgc

SEQ ID NO: 652545 - DNA, 20 bp, Artificial
  CRISPR gRNA sequence
catagtcaaagtgcaatgct

SEQ ID NO: 652546 - DNA, 20 bp, Artificial
  CRISPR gRNA sequence
caaaacaaaagattataccc

SEQ ID NO: 652547 - DNA, 20 bp, Artificial
  CRISPR gRNA sequence
tacccttaatacaatgattc

SEQ ID NO: 652548 - DNA, 20 bp, Artificial
  CRISPR gRNA sequence
aatacaatgattcctttcag

SEQ ID NO: 652549 - DNA, 20 bp, Artificial
  CRISPR gRNA sequence
atacaatgattcctttcagt

SEQ ID NO: 652550 - DNA, 20 bp, Artificial
  CRISPR gRNA sequence
ctttcagtatctgccattaa

SEQ ID NO: 652551 - DNA, 20 bp, Artificial
  CRISPR gRNA sequence
tcagtatctgccattaaatt

SEQ ID NO: 652552 - DNA, 20 bp, Artificial
  CRISPR gRNA sequence
cagtatctgccattaaattc

SEQ ID NO: 652553 - DNA, 20 bp, Artificial
  CRISPR gRNA sequence
agtatctgccattaaattct

SEQ ID NO: 652554 - DNA, 20 bp, Artificial
  CRISPR gRNA sequence
ccattaaattcttaacttat

SEQ ID NO: 652555 - DNA, 20 bp, Artificial
  CRISPR gRNA sequence
aattcttaacttatttgaag

SEQ ID NO: 652556 - DNA, 20 bp, Artificial
  CRISPR gRNA sequence
ttaacttatttgaagctcca

SEQ ID NO: 652557 - DNA, 20 bp, Artificial
  CRISPR gRNA sequence
aacttatttgaagctccaag

SEQ ID NO: 652558 - DNA, 20 bp, Artificial
  CRISPR gRNA sequence
acttatttgaagctccaagc

SEQ ID NO: 652559 - DNA, 20 bp, Artificial
  CRISPR gRNA sequence
atttgaagctccaagcagtt

SEQ ID NO: 652560 - DNA, 20 bp, Artificial
  CRISPR gRNA sequence
tttgaagctccaagcagtta

SEQ ID NO: 652561 - DNA, 20 bp, Artificial
  CRISPR gRNA sequence
gaagctccaagcagttagtc

SEQ ID NO: 652562 - DNA, 20 bp, Artificial
  CRISPR gRNA sequence
aagctccaagcagttagtcc

SEQ ID NO: 652563 - DNA, 20 bp, Artificial
  CRISPR gRNA sequence
caagcagttagtccatgttg

SEQ ID NO: 652564 - DNA, 20 bp, Artificial
  CRISPR gRNA sequence
gtccatgttgctgctgccac

SEQ ID NO: 652565 - DNA, 20 bp, Artificial
  CRISPR gRNA sequence
ctgctgccacctgtgcccag

SEQ ID NO: 652566 - DNA, 20 bp, Artificial
  CRISPR gRNA sequence
ctgccacctgtgcccagaaa

SEQ ID NO: 652567 - DNA, 20 bp, Artificial
  CRISPR gRNA sequence
ccacctgtgcccagaaacat

SEQ ID NO: 652568 - DNA, 20 bp, Artificial
  CRISPR gRNA sequence
tgcccagaaacatacacagt

SEQ ID NO: 652569 - DNA, 20 bp, Artificial
  CRISPR gRNA sequence
tatgtgctcatttgcaagtc

SEQ ID NO: 652570 - DNA, 20 bp, Artificial
  CRISPR gRNA sequence
atttgcaagtcactgaactc

SEQ ID NO: 652571 - DNA, 20 bp, Artificial
  CRISPR gRNA sequence
gcaagtcactgaactctttc

SEQ ID NO: 652572 - DNA, 20 bp, Artificial
  CRISPR gRNA sequence
caagtcactgaactctttct

SEQ ID NO: 652573 - DNA, 20 bp, Artificial
  CRISPR gRNA sequence
aactctttctgcaaatgatc

SEQ ID NO: 652574 - DNA, 20 bp, Artificial
  CRISPR gRNA sequence
tttctgcaaatgatctgatt

SEQ ID NO: 652575 - DNA, 20 bp, Artificial
  CRISPR gRNA sequence
tctgcaaatgatctgattcc

SEQ ID NO: 652576 - DNA, 20 bp, Artificial
  CRISPR gRNA sequence
ctgcaaatgatctgattcct

SEQ ID NO: 652577 - DNA, 20 bp, Artificial
  CRISPR gRNA sequence
tgcaaatgatctgattcctg

SEQ ID NO: 652578 - DNA, 20 bp, Artificial
  CRISPR gRNA sequence
caaatgatctgattcctgct

SEQ ID NO: 652579 - DNA, 20 bp, Artificial
  CRISPR gRNA sequence
attcctgctggagataggat

SEQ ID NO: 652580 - DNA, 20 bp, Artificial
  CRISPR gRNA sequence
ctgctggagataggatagga

SEQ ID NO: 652581 - DNA, 20 bp, Artificial
  CRISPR gRNA sequence
ctggagataggataggaaag

SEQ ID NO: 652582 - DNA, 20 bp, Artificial
  CRISPR gRNA sequence
gagataggataggaaagata

SEQ ID NO: 652583 - DNA, 20 bp, Artificial
  CRISPR gRNA sequence
tgagatgggctagagcaaaa

SEQ ID NO: 652584 - DNA, 20 bp, Artificial
  CRISPR gRNA sequence
gagcaaaaagggaatgactc

SEQ ID NO: 652585 - DNA, 20 bp, Artificial
  CRISPR gRNA sequence
tcttaatcaaaatttattgg

SEQ ID NO: 652586 - DNA, 20 bp, Artificial
  CRISPR gRNA sequence
ttaatcaaaatttattgggt

SEQ ID NO: 652587 - DNA, 20 bp, Artificial
  CRISPR gRNA sequence
aatcaaaatttattgggttt

SEQ ID NO: 652588 - DNA, 20 bp, Artificial
  CRISPR gRNA sequence
atcaaaatttattgggttta

SEQ ID NO: 652589 - DNA, 20 bp, Artificial
  CRISPR gRNA sequence
attgggtttaagaaaaaata

SEQ ID NO: 652590 - DNA, 20 bp, Artificial
  CRISPR gRNA sequence
ttgggtttaagaaaaaatag

SEQ ID NO: 652591 - DNA, 20 bp, Artificial
  CRISPR gRNA sequence
ggtttaagaaaaaatagggg

SEQ ID NO: 652592 - DNA, 20 bp, Artificial
  CRISPR gRNA sequence
aagaaaaaatagggggtata

SEQ ID NO: 652593 - DNA, 20 bp, Artificial
  CRISPR gRNA sequence
agaaaaaatagggggtatag

SEQ ID NO: 652594 - DNA, 20 bp, Artificial
  CRISPR gRNA sequence
aaatgtgtcagctttaactg

SEQ ID NO: 652595 - DNA, 20 bp, Artificial
  CRISPR gRNA sequence
taactgggatttaagtgttt

SEQ ID NO: 652596 - DNA, 20 bp, Artificial
  CRISPR gRNA sequence
aactgggatttaagtgtttt

SEQ ID NO: 652597 - DNA, 20 bp, Artificial
  CRISPR gRNA sequence
actgggatttaagtgtttta

SEQ ID NO: 652598 - DNA, 20 bp, Artificial
  CRISPR gRNA sequence
ggatttaagtgttttaccat

SEQ ID NO: 652599 - DNA, 20 bp, Artificial
  CRISPR gRNA sequence
aagtgttttaccattcacta

SEQ ID NO: 652600 - DNA, 20 bp, Artificial
  CRISPR gRNA sequence
agtgttttaccattcactac

SEQ ID NO: 652601 - DNA, 20 bp, Artificial
  CRISPR gRNA sequence
taccattcactacttcccac

SEQ ID NO: 652602 - DNA, 20 bp, Artificial
  CRISPR gRNA sequence
accattcactacttcccaca

SEQ ID NO: 652603 - DNA, 20 bp, Artificial
  CRISPR gRNA sequence
ccattcactacttcccacaa

SEQ ID NO: 652604 - DNA, 20 bp, Artificial
  CRISPR gRNA sequence
actacttcccacaatcacac

SEQ ID NO: 652605 - DNA, 20 bp, Artificial
  CRISPR gRNA sequence
cttcccacaatcacactgca

SEQ ID NO: 652606 - DNA, 20 bp, Artificial
  CRISPR gRNA sequence
cccacaatcacactgcagtt

SEQ ID NO: 652607 - DNA, 20 bp, Artificial
  CRISPR gRNA sequence
ccacaatcacactgcagttt

SEQ ID NO: 652608 - DNA, 20 bp, Artificial
  CRISPR gRNA sequence
cagtttgaggacttccccag

SEQ ID NO: 652609 - DNA, 20 bp, Artificial
  CRISPR gRNA sequence
gaggacttccccagtataca

SEQ ID NO: 652610 - DNA, 20 bp, Artificial
  CRISPR gRNA sequence
aggacttccccagtatacag

SEQ ID NO: 652611 - DNA, 20 bp, Artificial
  CRISPR gRNA sequence
ccccagtatacagatagctc

SEQ ID NO: 652612 - DNA, 20 bp, Artificial
  CRISPR gRNA sequence
cccagtatacagatagctct

SEQ ID NO: 652613 - DNA, 20 bp, Artificial
  CRISPR gRNA sequence
tattcacaattgttgcaagt

SEQ ID NO: 652614 - DNA, 20 bp, Artificial
  CRISPR gRNA sequence
ttcacaattgttgcaagttg

SEQ ID NO: 652615 - DNA, 20 bp, Artificial
  CRISPR gRNA sequence
acaattgttgcaagttggtt

SEQ ID NO: 652616 - DNA, 20 bp, Artificial
  CRISPR gRNA sequence
ttgcaagttggttcatcatg

SEQ ID NO: 652617 - DNA, 20 bp, Artificial
  CRISPR gRNA sequence
caagttggttcatcatgttc

SEQ ID NO: 652618 - DNA, 20 bp, Artificial
  CRISPR gRNA sequence
gttcatcatgttctaatagg

SEQ ID NO: 652619 - DNA, 20 bp, Artificial
  CRISPR gRNA sequence
atcatgttctaatagggagg

SEQ ID NO: 652620 - DNA, 20 bp, Artificial
  CRISPR gRNA sequence
taatagggagggggaggaca

SEQ ID NO: 652621 - DNA, 20 bp, Artificial
  CRISPR gRNA sequence
atagggagggggaggacaaa

SEQ ID NO: 652622 - DNA, 20 bp, Artificial
  CRISPR gRNA sequence
agtgcccaacggtgtcttga

SEQ ID NO: 652623 - DNA, 20 bp, Artificial
  CRISPR gRNA sequence
gtgcccaacggtgtcttgaa

SEQ ID NO: 652624 - DNA, 20 bp, Artificial
  CRISPR gRNA sequence
gaagatttctacagcagttg

SEQ ID NO: 652625 - DNA, 20 bp, Artificial
  CRISPR gRNA sequence
aagatttctacagcagttgg

SEQ ID NO: 652626 - DNA, 20 bp, Artificial
  CRISPR gRNA sequence
ctacagcagttggccaactc

SEQ ID NO: 652627 - DNA, 20 bp, Artificial
  CRISPR gRNA sequence
tacagcagttggccaactcc

SEQ ID NO: 652628 - DNA, 20 bp, Artificial
  CRISPR gRNA sequence
cagcagttggccaactccct

SEQ ID NO: 652629 - DNA, 20 bp, Artificial
  CRISPR gRNA sequence
gccaactccctgacttgtat

SEQ ID NO: 652630 - DNA, 20 bp, Artificial
  CRISPR gRNA sequence
cctgacttgtattgacattt

SEQ ID NO: 652631 - DNA, 20 bp, Artificial
  CRISPR gRNA sequence
acttgtattgacattttaac

SEQ ID NO: 652632 - DNA, 20 bp, Artificial
  CRISPR gRNA sequence
gtattgacattttaacctac

SEQ ID NO: 652633 - DNA, 20 bp, Artificial
  CRISPR gRNA sequence
tattgacattttaacctacc

SEQ ID NO: 652634 - DNA, 20 bp, Artificial
  CRISPR gRNA sequence
acattttaacctaccccaag

SEQ ID NO: 652635 - DNA, 20 bp, Artificial
  CRISPR gRNA sequence
taacctaccccaagttctgt

SEQ ID NO: 652636 - DNA, 20 bp, Artificial
  CRISPR gRNA sequence
aacctaccccaagttctgtg

SEQ ID NO: 652637 - DNA, 20 bp, Artificial
  CRISPR gRNA sequence
acctaccccaagttctgtgt

SEQ ID NO: 652638 - DNA, 20 bp, Artificial
  CRISPR gRNA sequence
ccccaagttctgtgtaagca

SEQ ID NO: 652639 - DNA, 20 bp, Artificial
  CRISPR gRNA sequence
tgtgtaagcacctgttcaat

SEQ ID NO: 652640 - DNA, 20 bp, Artificial
  CRISPR gRNA sequence
tgtaagcacctgttcaatgt

SEQ ID NO: 652641 - DNA, 20 bp, Artificial
  CRISPR gRNA sequence
ttcaatgtaaccttaatttc

SEQ ID NO: 652642 - DNA, 20 bp, Artificial
  CRISPR gRNA sequence
aatgtaaccttaatttcctg

SEQ ID NO: 652643 - DNA, 20 bp, Artificial
  CRISPR gRNA sequence
aatttcctgccagaccatgc

SEQ ID NO: 652644 - DNA, 20 bp, Artificial
  CRISPR gRNA sequence
atttcctgccagaccatgct

SEQ ID NO: 652645 - DNA, 20 bp, Artificial
  CRISPR gRNA sequence
cctgccagaccatgcttgga

SEQ ID NO: 652646 - DNA, 20 bp, Artificial
  CRISPR gRNA sequence
ctgccagaccatgcttggac

SEQ ID NO: 652647 - DNA, 20 bp, Artificial
  CRISPR gRNA sequence
ccagaccatgcttggacaca

SEQ ID NO: 652648 - DNA, 20 bp, Artificial
  CRISPR gRNA sequence
ggacacaaatgccaagccta

SEQ ID NO: 652649 - DNA, 20 bp, Artificial
  CRISPR gRNA sequence
gacacaaatgccaagcctac

SEQ ID NO: 652650 - DNA, 20 bp, Artificial
  CRISPR gRNA sequence
cttaatacagtctgattttg

SEQ ID NO: 652651 - DNA, 20 bp, Artificial
  CRISPR gRNA sequence
aatacagtctgattttgaaa

SEQ ID NO: 652652 - DNA, 20 bp, Artificial
  CRISPR gRNA sequence
atacagtctgattttgaaaa

SEQ ID NO: 652653 - DNA, 20 bp, Artificial
  CRISPR gRNA sequence
attttgaaaatttcataaac

SEQ ID NO: 652654 - DNA, 20 bp, Artificial
  CRISPR gRNA sequence
tgaaaatttcataaactttg

SEQ ID NO: 652655 - DNA, 20 bp, Artificial
  CRISPR gRNA sequence
gaaaatttcataaactttgg

SEQ ID NO: 652656 - DNA, 20 bp, Artificial
  CRISPR gRNA sequence
aaaatttcataaactttggt

SEQ ID NO: 652657 - DNA, 20 bp, Artificial
  CRISPR gRNA sequence
cataaactttggttgtgcta

SEQ ID NO: 652658 - DNA, 20 bp, Artificial
  CRISPR gRNA sequence
ataaactttggttgtgctag

SEQ ID NO: 652659 - DNA, 20 bp, Artificial
  CRISPR gRNA sequence
tggttgtgctagagagaatc

SEQ ID NO: 652660 - DNA, 20 bp, Artificial
  CRISPR gRNA sequence
ggttgtgctagagagaatca

SEQ ID NO: 652661 - DNA, 20 bp, Artificial
  CRISPR gRNA sequence
gttgtgctagagagaatcat

SEQ ID NO: 652662 - DNA, 20 bp, Artificial
  CRISPR gRNA sequence
tgctagagagaatcatttaa

SEQ ID NO: 652663 - DNA, 20 bp, Artificial
  CRISPR gRNA sequence
gagagaatcatttaaaaaaa

SEQ ID NO: 652664 - DNA, 20 bp, Artificial
  CRISPR gRNA sequence
aaaaaaaaaaaaaactttgg

SEQ ID NO: 652665 - DNA, 20 bp, Artificial
  CRISPR gRNA sequence
aaaaaaaaaaaaactttggg

SEQ ID NO: 652666 - DNA, 20 bp, Artificial
  CRISPR gRNA sequence
tgggcaattattctcatgca

SEQ ID NO: 652667 - DNA, 20 bp, Artificial
  CRISPR gRNA sequence
gggcaattattctcatgcac

SEQ ID NO: 652668 - DNA, 20 bp, Artificial
  CRISPR gRNA sequence
ggcaattattctcatgcaca

SEQ ID NO: 652669 - DNA, 20 bp, Artificial
  CRISPR gRNA sequence
ttctcatgcacaaacgccac

SEQ ID NO: 652670 - DNA, 20 bp, Artificial
  CRISPR gRNA sequence
tcatgcacaaacgccacaca

SEQ ID NO: 652671 - DNA, 20 bp, Artificial
  CRISPR gRNA sequence
atgcacaaacgccacacaac

SEQ ID NO: 652672 - DNA, 20 bp, Artificial
  CRISPR gRNA sequence
tcagaaacaaaagtaaactg

SEQ ID NO: 652673 - DNA, 20 bp, Artificial
  CRISPR gRNA sequence
agaaacaaaagtaaactgta

SEQ ID NO: 652674 - DNA, 20 bp, Artificial
  CRISPR gRNA sequence
tatgagatgacaccccctag

SEQ ID NO: 652675 - DNA, 20 bp, Artificial
  CRISPR gRNA sequence
gctttgattcacataatgaa

SEQ ID NO: 652676 - DNA, 20 bp, Artificial
  CRISPR gRNA sequence
tgattcacataatgaaaaga

SEQ ID NO: 652677 - DNA, 20 bp, Artificial
  CRISPR gRNA sequence
gattcacataatgaaaagat

SEQ ID NO: 652678 - DNA, 20 bp, Artificial
  CRISPR gRNA sequence
attcacataatgaaaagatc

SEQ ID NO: 652679 - DNA, 20 bp, Artificial
  CRISPR gRNA sequence
acataatgaaaagatcgata

SEQ ID NO: 652680 - DNA, 20 bp, Artificial
  CRISPR gRNA sequence
actgtattctgtggggaaaa

SEQ ID NO: 652681 - DNA, 20 bp, Artificial
  CRISPR gRNA sequence
tattctgtggggaaaaaagt

SEQ ID NO: 652682 - DNA, 20 bp, Artificial
  CRISPR gRNA sequence
tgtggggaaaaaagtttaag

SEQ ID NO: 652683 - DNA, 20 bp, Artificial
  CRISPR gRNA sequence
tggggaaaaaagtttaagaa

SEQ ID NO: 652684 - DNA, 20 bp, Artificial
  CRISPR gRNA sequence
aagaattgacaagtcctgag

SEQ ID NO: 652685 - DNA, 20 bp, Artificial
  CRISPR gRNA sequence
agaattgacaagtcctgaga

SEQ ID NO: 652686 - DNA, 20 bp, Artificial
  CRISPR gRNA sequence
acaagtcctgagaagatttt

SEQ ID NO: 652687 - DNA, 20 bp, Artificial
  CRISPR gRNA sequence
agaagatttttacttttttt

SEQ ID NO: 652688 - DNA, 20 bp, Artificial
  CRISPR gRNA sequence
ttacttttttttcccccttt

SEQ ID NO: 652689 - DNA, 20 bp, Artificial
  CRISPR gRNA sequence
tacttttttttccccctttg

SEQ ID NO: 652690 - DNA, 20 bp, Artificial
  CRISPR gRNA sequence
acttttttttccccctttgg

SEQ ID NO: 652691 - DNA, 20 bp, Artificial
  CRISPR gRNA sequence
cttttttttccccctttggc

SEQ ID NO: 652692 - DNA, 20 bp, Artificial
  CRISPR gRNA sequence
ttttttccccctttggcctt

SEQ ID NO: 652693 - DNA, 20 bp, Artificial
  CRISPR gRNA sequence
tttttccccctttggccttg

SEQ ID NO: 652694 - DNA, 20 bp, Artificial
  CRISPR gRNA sequence
ttttccccctttggccttgg

SEQ ID NO: 652695 - DNA, 20 bp, Artificial
  CRISPR gRNA sequence
tttccccctttggccttggt

SEQ ID NO: 652696 - DNA, 20 bp, Artificial
  CRISPR gRNA sequence
ttccccctttggccttggtc

SEQ ID NO: 652697 - DNA, 20 bp, Artificial
  CRISPR gRNA sequence
tccccctttggccttggtcc

SEQ ID NO: 652698 - DNA, 20 bp, Artificial
  CRISPR gRNA sequence
ccccctttggccttggtcct

SEQ ID NO: 652699 - DNA, 20 bp, Artificial
  CRISPR gRNA sequence
cccctttggccttggtcctt

SEQ ID NO: 652700 - DNA, 20 bp, Artificial
  CRISPR gRNA sequence
tggccttggtcctttttgcc

SEQ ID NO: 652701 - DNA, 20 bp, Artificial
  CRISPR gRNA sequence
ggccttggtcctttttgcct

SEQ ID NO: 652702 - DNA, 20 bp, Artificial
  CRISPR gRNA sequence
gccttggtcctttttgcctt

SEQ ID NO: 652703 - DNA, 20 bp, Artificial
  CRISPR gRNA sequence
ggtcctttttgcctttagtt

SEQ ID NO: 652704 - DNA, 20 bp, Artificial
  CRISPR gRNA sequence
gtcctttttgcctttagttt

SEQ ID NO: 652705 - DNA, 20 bp, Artificial
  CRISPR gRNA sequence
tttgcctttagtttcaaaac

SEQ ID NO: 652706 - DNA, 20 bp, Artificial
  CRISPR gRNA sequence
ttgcctttagtttcaaaact

SEQ ID NO: 652707 - DNA, 20 bp, Artificial
  CRISPR gRNA sequence
tgcctttagtttcaaaactc

SEQ ID NO: 652708 - DNA, 20 bp, Artificial
  CRISPR gRNA sequence
gcctttagtttcaaaactct

SEQ ID NO: 652709 - DNA, 20 bp, Artificial
  CRISPR gRNA sequence
cctttagtttcaaaactctc

SEQ ID NO: 652710 - DNA, 20 bp, Artificial
  CRISPR gRNA sequence
tagtttcaaaactctcactg

SEQ ID NO: 652711 - DNA, 20 bp, Artificial
  CRISPR gRNA sequence
agtttcaaaactctcactgc

SEQ ID NO: 652712 - DNA, 20 bp, Artificial
  CRISPR gRNA sequence
gtttcaaaactctcactgca

SEQ ID NO: 652713 - DNA, 20 bp, Artificial
  CRISPR gRNA sequence
caaaactctcactgcaccag

SEQ ID NO: 652714 - DNA, 20 bp, Artificial
  CRISPR gRNA sequence
aaaactctcactgcaccagc

SEQ ID NO: 652715 - DNA, 20 bp, Artificial
  CRISPR gRNA sequence
tcactgcaccagcagctaaa

SEQ ID NO: 652716 - DNA, 20 bp, Artificial
  CRISPR gRNA sequence
actgcaccagcagctaaatt

SEQ ID NO: 652717 - DNA, 20 bp, Artificial
  CRISPR gRNA sequence
caccagcagctaaattattc

SEQ ID NO: 652718 - DNA, 20 bp, Artificial
  CRISPR gRNA sequence
aattattcacaatgagccat

SEQ ID NO: 652719 - DNA, 20 bp, Artificial
  CRISPR gRNA sequence
ttcacaatgagccatttctg

SEQ ID NO: 652720 - DNA, 20 bp, Artificial
  CRISPR gRNA sequence
acaatgagccatttctgtat

SEQ ID NO: 652721 - DNA, 20 bp, Artificial
  CRISPR gRNA sequence
ctgtattgatcgccaagtat

SEQ ID NO: 652722 - DNA, 20 bp, Artificial
  CRISPR gRNA sequence
tgtattgatcgccaagtata

SEQ ID NO: 652723 - DNA, 20 bp, Artificial
  CRISPR gRNA sequence
tattgatcgccaagtatatt

SEQ ID NO: 652724 - DNA, 20 bp, Artificial
  CRISPR gRNA sequence
atcgccaagtatatttagcc

SEQ ID NO: 652725 - DNA, 20 bp, Artificial
  CRISPR gRNA sequence
agccctggctcctggaattt

SEQ ID NO: 652726 - DNA, 20 bp, Artificial
  CRISPR gRNA sequence
gccctggctcctggaatttc

SEQ ID NO: 652727 - DNA, 20 bp, Artificial
  CRISPR gRNA sequence
gctcctggaatttctccatt

SEQ ID NO: 652728 - DNA, 20 bp, Artificial
  CRISPR gRNA sequence
ctggaatttctccattactt

SEQ ID NO: 652729 - DNA, 20 bp, Artificial
  CRISPR gRNA sequence
gaatttctccattacttact

SEQ ID NO: 652730 - DNA, 20 bp, Artificial
  CRISPR gRNA sequence
ctccattacttactggaaaa

SEQ ID NO: 652731 - DNA, 20 bp, Artificial
  CRISPR gRNA sequence
tccattacttactggaaaac

SEQ ID NO: 652732 - DNA, 20 bp, Artificial
  CRISPR gRNA sequence
cattacttactggaaaacag

SEQ ID NO: 652733 - DNA, 20 bp, Artificial
  CRISPR gRNA sequence
cttactggaaaacaggcagc

SEQ ID NO: 652734 - DNA, 20 bp, Artificial
  CRISPR gRNA sequence
actggaaaacaggcagcttc

SEQ ID NO: 652735 - DNA, 20 bp, Artificial
  CRISPR gRNA sequence
ctggaaaacaggcagcttca

SEQ ID NO: 652736 - DNA, 20 bp, Artificial
  CRISPR gRNA sequence
gaaaacaggcagcttcactt

SEQ ID NO: 652737 - DNA, 20 bp, Artificial
  CRISPR gRNA sequence
cacttcttgtctccaaaacc

SEQ ID NO: 652738 - DNA, 20 bp, Artificial
  CRISPR gRNA sequence
acttcttgtctccaaaacca

SEQ ID NO: 652739 - DNA, 20 bp, Artificial
  CRISPR gRNA sequence
cttgtctccaaaaccacttc

SEQ ID NO: 652740 - DNA, 20 bp, Artificial
  CRISPR gRNA sequence
ttgtctccaaaaccacttcc

SEQ ID NO: 652741 - DNA, 20 bp, Artificial
  CRISPR gRNA sequence
gtctccaaaaccacttccct

SEQ ID NO: 652742 - DNA, 20 bp, Artificial
  CRISPR gRNA sequence
tctccaaaaccacttccctt

SEQ ID NO: 652743 - DNA, 20 bp, Artificial
  CRISPR gRNA sequence
caaaaccacttcccttctcc

SEQ ID NO: 652744 - DNA, 20 bp, Artificial
  CRISPR gRNA sequence
cccttctccctcccctcccc

SEQ ID NO: 652745 - DNA, 20 bp, Artificial
  CRISPR gRNA sequence
ccttctccctcccctcccct

SEQ ID NO: 652746 - DNA, 20 bp, Artificial
  CRISPR gRNA sequence
ctccctcccctccccttctt

SEQ ID NO: 652747 - DNA, 20 bp, Artificial
  CRISPR gRNA sequence
tccctcccctccccttcttc

SEQ ID NO: 652748 - DNA, 20 bp, Artificial
  CRISPR gRNA sequence
cctcccctccccttcttcac

SEQ ID NO: 652749 - DNA, 20 bp, Artificial
  CRISPR gRNA sequence
ccctccccttcttcaccacc

SEQ ID NO: 652750 - DNA, 20 bp, Artificial
  CRISPR gRNA sequence
cccttcttcaccaccacact

SEQ ID NO: 652751 - DNA, 20 bp, Artificial
  CRISPR gRNA sequence
cttcaccaccacactccctt

SEQ ID NO: 652752 - DNA, 20 bp, Artificial
  CRISPR gRNA sequence
ttcaccaccacactccctta

SEQ ID NO: 652753 - DNA, 20 bp, Artificial
  CRISPR gRNA sequence
caccaccacactcccttacc

SEQ ID NO: 652754 - DNA, 20 bp, Artificial
  CRISPR gRNA sequence
accaccacactcccttaccc

SEQ ID NO: 652755 - DNA, 20 bp, Artificial
  CRISPR gRNA sequence
ccttaccccccccccaaaaa

SEQ ID NO: 652756 - DNA, 20 bp, Artificial
  CRISPR gRNA sequence
accccccccccaaaaaaaaa

SEQ ID NO: 652757 - DNA, 20 bp, Artificial
  CRISPR gRNA sequence
ccccccccccaaaaaaaaac

SEQ ID NO: 652758 - DNA, 20 bp, Artificial
  CRISPR gRNA sequence
ttatttctttctttatggaa

SEQ ID NO: 652759 - DNA, 20 bp, Artificial
  CRISPR gRNA sequence
tatttctttctttatggaat

SEQ ID NO: 652760 - DNA, 20 bp, Artificial
  CRISPR gRNA sequence
atttctttctttatggaata

SEQ ID NO: 652761 - DNA, 20 bp, Artificial
  CRISPR gRNA sequence
tttctttctttatggaataa

SEQ ID NO: 652762 - DNA, 20 bp, Artificial
  CRISPR gRNA sequence
ctttctttatggaataatca

SEQ ID NO: 652763 - DNA, 20 bp, Artificial
  CRISPR gRNA sequence
tttctttatggaataatcag

SEQ ID NO: 652764 - DNA, 20 bp, Artificial
  CRISPR gRNA sequence
tctttatggaataatcagat

SEQ ID NO: 652765 - DNA, 20 bp, Artificial
  CRISPR gRNA sequence
ctttatggaataatcagatc

SEQ ID NO: 652766 - DNA, 20 bp, Artificial
  CRISPR gRNA sequence
tttatggaataatcagatca

SEQ ID NO: 652767 - DNA, 20 bp, Artificial
  CRISPR gRNA sequence
tatggaataatcagatcaaa

SEQ ID NO: 652768 - DNA, 20 bp, Artificial
  CRISPR gRNA sequence
atggaataatcagatcaaat

SEQ ID NO: 652769 - DNA, 20 bp, Artificial
  CRISPR gRNA sequence
tggaataatcagatcaaatt

SEQ ID NO: 652770 - DNA, 20 bp, Artificial
  CRISPR gRNA sequence
ccaactcagtcactacatag

SEQ ID NO: 652771 - DNA, 20 bp, Artificial
  CRISPR gRNA sequence
agtcactacatagcacttaa

SEQ ID NO: 652772 - DNA, 20 bp, Artificial
  CRISPR gRNA sequence
catagcacttaaatttcaac

SEQ ID NO: 652773 - DNA, 20 bp, Artificial
  CRISPR gRNA sequence
aaatttcaacctgctgtact

SEQ ID NO: 652774 - DNA, 20 bp, Artificial
  CRISPR gRNA sequence
aatttcaacctgctgtactg

SEQ ID NO: 652775 - DNA, 20 bp, Artificial
  CRISPR gRNA sequence
caacctgctgtactgttatc

SEQ ID NO: 652776 - DNA, 20 bp, Artificial
  CRISPR gRNA sequence
aacctgctgtactgttatca

SEQ ID NO: 652777 - DNA, 20 bp, Artificial
  CRISPR gRNA sequence
ctgtactgttatcacattct

SEQ ID NO: 652778 - DNA, 20 bp, Artificial
  CRISPR gRNA sequence
tactgttatcacattctttt

SEQ ID NO: 652779 - DNA, 20 bp, Artificial
  CRISPR gRNA sequence
ttatcacattcttttaaatt

SEQ ID NO: 652780 - DNA, 20 bp, Artificial
  CRISPR gRNA sequence
tcacattcttttaaattatg

SEQ ID NO: 652781 - DNA, 20 bp, Artificial
  CRISPR gRNA sequence
ttttaaattatgattacata

SEQ ID NO: 652782 - DNA, 20 bp, Artificial
  CRISPR gRNA sequence
ttaaattatgattacataag

SEQ ID NO: 652783 - DNA, 20 bp, Artificial
  CRISPR gRNA sequence
taaattatgattacataagg

SEQ ID NO: 652784 - DNA, 20 bp, Artificial
  CRISPR gRNA sequence
aaattatgattacataaggc

SEQ ID NO: 652785 - DNA, 20 bp, Artificial
  CRISPR gRNA sequence
aattatgattacataaggct

SEQ ID NO: 652786 - DNA, 20 bp, Artificial
  CRISPR gRNA sequence
tgattacataaggctttaaa

SEQ ID NO: 652787 - DNA, 20 bp, Artificial
  CRISPR gRNA sequence
cataaggctttaaagaaaga

SEQ ID NO: 652788 - DNA, 20 bp, Artificial
  CRISPR gRNA sequence
taaagaaagagatccgtaaa

SEQ ID NO: 652789 - DNA, 20 bp, Artificial
  CRISPR gRNA sequence
aaagaaagagatccgtaaag

SEQ ID NO: 652790 - DNA, 20 bp, Artificial
  CRISPR gRNA sequence
aagaaagagatccgtaaagt

SEQ ID NO: 652791 - DNA, 20 bp, Artificial
  CRISPR gRNA sequence
aaaagaggagcagtttcttc

SEQ ID NO: 652792 - DNA, 20 bp, Artificial
  CRISPR gRNA sequence
aaagaggagcagtttcttcg

SEQ ID NO: 652793 - DNA, 20 bp, Artificial
  CRISPR gRNA sequence
cttcggatattttacaaatg

SEQ ID NO: 652794 - DNA, 20 bp, Artificial
  CRISPR gRNA sequence
ttcggatattttacaaatga

SEQ ID NO: 652795 - DNA, 20 bp, Artificial
  CRISPR gRNA sequence
cggatattttacaaatgagc

SEQ ID NO: 652796 - DNA, 20 bp, Artificial
  CRISPR gRNA sequence
ggatattttacaaatgagct

SEQ ID NO: 652797 - DNA, 20 bp, Artificial
  CRISPR gRNA sequence
tacaaatgagcttatctctt

SEQ ID NO: 652798 - DNA, 20 bp, Artificial
  CRISPR gRNA sequence
acaaatgagcttatctcttt

SEQ ID NO: 652799 - DNA, 20 bp, Artificial
  CRISPR gRNA sequence
caaatgagcttatctcttta

SEQ ID NO: 652800 - DNA, 20 bp, Artificial
  CRISPR gRNA sequence
atctctttaaaaatgtacac

SEQ ID NO: 652801 - DNA, 20 bp, Artificial
  CRISPR gRNA sequence
tctctttaaaaatgtacaca

SEQ ID NO: 652802 - DNA, 20 bp, Artificial
  CRISPR gRNA sequence
tttaaaaatgtacacattta

SEQ ID NO: 652803 - DNA, 20 bp, Artificial
  CRISPR gRNA sequence
taaaaatgtacacatttaac

SEQ ID NO: 652804 - DNA, 20 bp, Artificial
  CRISPR gRNA sequence
aaaaatgtacacatttaaca

SEQ ID NO: 652805 - DNA, 20 bp, Artificial
  CRISPR gRNA sequence
aaaatgtacacatttaacac

SEQ ID NO: 652806 - DNA, 20 bp, Artificial
  CRISPR gRNA sequence
aacacacacatattaaaaag

SEQ ID NO: 652807 - DNA, 20 bp, Artificial
  CRISPR gRNA sequence
acacacacatattaaaaaga

SEQ ID NO: 652808 - DNA, 20 bp, Artificial
  CRISPR gRNA sequence
aaaagaaagaaacgtcaggg

SEQ ID NO: 652809 - DNA, 20 bp, Artificial
  CRISPR gRNA sequence
ccccatcaatgaaatggtta

SEQ ID NO: 652810 - DNA, 20 bp, Artificial
  CRISPR gRNA sequence
ttaaccctcagagaaggaaa

SEQ ID NO: 652811 - DNA, 20 bp, Artificial
  CRISPR gRNA sequence
accctcagagaaggaaagaa

SEQ ID NO: 652812 - DNA, 20 bp, Artificial
  CRISPR gRNA sequence
agagaaggaaagaaggaaaa

SEQ ID NO: 652813 - DNA, 20 bp, Artificial
  CRISPR gRNA sequence
tcctttgattaaaaaagatt

SEQ ID NO: 652814 - DNA, 20 bp, Artificial
  CRISPR gRNA sequence
tgattaaaaaagattcatca

SEQ ID NO: 652815 - DNA, 20 bp, Artificial
  CRISPR gRNA sequence
gattaaaaaagattcatcac

SEQ ID NO: 652816 - DNA, 20 bp, Artificial
  CRISPR gRNA sequence
attaaaaaagattcatcacc

SEQ ID NO: 652817 - DNA, 20 bp, Artificial
  CRISPR gRNA sequence
aaaaagattcatcaccattt

SEQ ID NO: 652818 - DNA, 20 bp, Artificial
  CRISPR gRNA sequence
atcaccatttccagctctgt

SEQ ID NO: 652819 - DNA, 20 bp, Artificial
  CRISPR gRNA sequence
ccagctctgtcgggagatct

SEQ ID NO: 652820 - DNA, 20 bp, Artificial
  CRISPR gRNA sequence
cagctctgtcgggagatctc

SEQ ID NO: 652821 - DNA, 20 bp, Artificial
  CRISPR gRNA sequence
tgtcgggagatctcagcttc

SEQ ID NO: 652822 - DNA, 20 bp, Artificial
  CRISPR gRNA sequence
tcgggagatctcagcttctt

SEQ ID NO: 652823 - DNA, 20 bp, Artificial
  CRISPR gRNA sequence
agcttcttctaacccctcaa

SEQ ID NO: 652824 - DNA, 20 bp, Artificial
  CRISPR gRNA sequence
cttctaacccctcaaagagg

SEQ ID NO: 652825 - DNA, 20 bp, Artificial
  CRISPR gRNA sequence
ttctaacccctcaaagagga

SEQ ID NO: 652826 - DNA, 20 bp, Artificial
  CRISPR gRNA sequence
ctaacccctcaaagaggagg

SEQ ID NO: 652827 - DNA, 20 bp, Artificial
  CRISPR gRNA sequence
taacccctcaaagaggaggt

SEQ ID NO: 652828 - DNA, 20 bp, Artificial
  CRISPR gRNA sequence
acccctcaaagaggaggtga

SEQ ID NO: 652829 - DNA, 20 bp, Artificial
  CRISPR gRNA sequence
aaagaggaggtgacaatgtc

SEQ ID NO: 652830 - DNA, 20 bp, Artificial
  CRISPR gRNA sequence
aagataaacggagggagaaa

SEQ ID NO: 652831 - DNA, 20 bp, Artificial
  CRISPR gRNA sequence
tttgtgtttcccccttctct

SEQ ID NO: 652832 - DNA, 20 bp, Artificial
  CRISPR gRNA sequence
ttgtgtttcccccttctctc

SEQ ID NO: 652833 - DNA, 20 bp, Artificial
  CRISPR gRNA sequence
tgtgtttcccccttctctct

SEQ ID NO: 652834 - DNA, 20 bp, Artificial
  CRISPR gRNA sequence
gtgtttcccccttctctctt

SEQ ID NO: 652835 - DNA, 20 bp, Artificial
  CRISPR gRNA sequence
tgtttcccccttctctcttt

SEQ ID NO: 652836 - DNA, 20 bp, Artificial
  CRISPR gRNA sequence
cccccttctctctttccctc

SEQ ID NO: 652837 - DNA, 20 bp, Artificial
  CRISPR gRNA sequence
ccccttctctctttccctcc

SEQ ID NO: 652838 - DNA, 20 bp, Artificial
  CRISPR gRNA sequence
ctctctttccctcccttgcc

SEQ ID NO: 652839 - DNA, 20 bp, Artificial
  CRISPR gRNA sequence
tctctttccctcccttgccc

SEQ ID NO: 652840 - DNA, 20 bp, Artificial
  CRISPR gRNA sequence
tctttccctcccttgccccc

SEQ ID NO: 652841 - DNA, 20 bp, Artificial
  CRISPR gRNA sequence
tttccctcccttgccccctc

SEQ ID NO: 652842 - DNA, 20 bp, Artificial
  CRISPR gRNA sequence
tccctcccttgccccctcca

SEQ ID NO: 652843 - DNA, 20 bp, Artificial
  CRISPR gRNA sequence
ccctcccttgccccctccaa

SEQ ID NO: 652844 - DNA, 20 bp, Artificial
  CRISPR gRNA sequence
cctcccttgccccctccaag

SEQ ID NO: 652845 - DNA, 20 bp, Artificial
  CRISPR gRNA sequence
ccttgccccctccaagccaa

SEQ ID NO: 652846 - DNA, 20 bp, Artificial
  CRISPR gRNA sequence
gccccctccaagccaagccc

SEQ ID NO: 652847 - DNA, 20 bp, Artificial
  CRISPR gRNA sequence
ccccctccaagccaagcccc

SEQ ID NO: 652848 - DNA, 20 bp, Artificial
  CRISPR gRNA sequence
caagccaagccccctgcaga

SEQ ID NO: 652849 - DNA, 20 bp, Artificial
  CRISPR gRNA sequence
cagagttcaaggggaggagg

SEQ ID NO: 652850 - DNA, 20 bp, Artificial
  CRISPR gRNA sequence
aaggggaggaggaaggaaaa

SEQ ID NO: 652851 - DNA, 20 bp, Artificial
  CRISPR gRNA sequence
tacaggtgggtcattccaag

SEQ ID NO: 652852 - DNA, 20 bp, Artificial
  CRISPR gRNA sequence
acaggtgggtcattccaagc

SEQ ID NO: 652853 - DNA, 20 bp, Artificial
  CRISPR gRNA sequence
caggtgggtcattccaagcc

SEQ ID NO: 652854 - DNA, 20 bp, Artificial
  CRISPR gRNA sequence
caagcccaaatccagcaaac

SEQ ID NO: 652855 - DNA, 20 bp, Artificial
  CRISPR gRNA sequence
ataaacaaaaccaagaaatg

SEQ ID NO: 652856 - DNA, 20 bp, Artificial
  CRISPR gRNA sequence
ctcctcctcctcctcctcgt

SEQ ID NO: 652857 - DNA, 20 bp, Artificial
  CRISPR gRNA sequence
ctcctcctcctcctcgtcct

SEQ ID NO: 652858 - DNA, 20 bp, Artificial
  CRISPR gRNA sequence
ctcctcctcctcgtcctcct

SEQ ID NO: 652859 - DNA, 20 bp, Artificial
  CRISPR gRNA sequence
ctcctcctcgtcctcctcct

SEQ ID NO: 652860 - DNA, 20 bp, Artificial
  CRISPR gRNA sequence
ctcctcgtcctcctcctcct

SEQ ID NO: 652861 - DNA, 20 bp, Artificial
  CRISPR gRNA sequence
ctcgtcctcctcctcctcct

SEQ ID NO: 652862 - DNA, 20 bp, Artificial
  CRISPR gRNA sequence
gtcctcctcctcctcctcct

SEQ ID NO: 652863 - DNA, 20 bp, Artificial
  CRISPR gRNA sequence
ctcctcctcctccttccacc

SEQ ID NO: 652864 - DNA, 20 bp, Artificial
  CRISPR gRNA sequence
ctcctcctccttccacccct

SEQ ID NO: 652865 - DNA, 20 bp, Artificial
  CRISPR gRNA sequence
ctcctccttccacccctccc

SEQ ID NO: 652866 - DNA, 20 bp, Artificial
  CRISPR gRNA sequence
ctccttccacccctccccct

SEQ ID NO: 652867 - DNA, 20 bp, Artificial
  CRISPR gRNA sequence
cttccacccctccccctcgt

SEQ ID NO: 652868 - DNA, 20 bp, Artificial
  CRISPR gRNA sequence
ccacccctccccctcgtccc

SEQ ID NO: 652869 - DNA, 20 bp, Artificial
  CRISPR gRNA sequence
cacccctccccctcgtccct

SEQ ID NO: 652870 - DNA, 20 bp, Artificial
  CRISPR gRNA sequence
cccctcgtcccttagggatg

SEQ ID NO: 652871 - DNA, 20 bp, Artificial
  CRISPR gRNA sequence
gtcccttagggatggtctag

SEQ ID NO: 652872 - DNA, 20 bp, Artificial
  CRISPR gRNA sequence
agggatggtctagtaggaaa

SEQ ID NO: 652873 - DNA, 20 bp, Artificial
  CRISPR gRNA sequence
gggatggtctagtaggaaaa

SEQ ID NO: 652874 - DNA, 20 bp, Artificial
  CRISPR gRNA sequence
gtaggaaaagtcactcagga

SEQ ID NO: 652875 - DNA, 20 bp, Artificial
  CRISPR gRNA sequence
aggaatggcaccacgtactt

SEQ ID NO: 652876 - DNA, 20 bp, Artificial
  CRISPR gRNA sequence
tcaggaaagaggaaaaaaaa

SEQ ID NO: 652877 - DNA, 20 bp, Artificial
  CRISPR gRNA sequence
caggaaagaggaaaaaaaag

SEQ ID NO: 652878 - DNA, 20 bp, Artificial
  CRISPR gRNA sequence
aggaaagaggaaaaaaaaga

SEQ ID NO: 652879 - DNA, 20 bp, Artificial
  CRISPR gRNA sequence
tagcaatgcgattaacaaga

SEQ ID NO: 652880 - DNA, 20 bp, Artificial
  CRISPR gRNA sequence
acaagagaaaaaacttgatc

SEQ ID NO: 652881 - DNA, 20 bp, Artificial
  CRISPR gRNA sequence
gatccaccggttccttaaga

SEQ ID NO: 652882 - DNA, 20 bp, Artificial
  CRISPR gRNA sequence
atccaccggttccttaagaa

SEQ ID NO: 652883 - DNA, 20 bp, Artificial
  CRISPR gRNA sequence
cttaagaatcgaccaaaagc

SEQ ID NO: 652884 - DNA, 20 bp, Artificial
  CRISPR gRNA sequence
aagaatcgaccaaaagctaa

SEQ ID NO: 652885 - DNA, 20 bp, Artificial
  CRISPR gRNA sequence
agaatcgaccaaaagctaag

SEQ ID NO: 652886 - DNA, 20 bp, Artificial
  CRISPR gRNA sequence
agacaagaaaactgaaagaa

SEQ ID NO: 652887 - DNA, 20 bp, Artificial
  CRISPR gRNA sequence
aaagaaaagggggggggggc

SEQ ID NO: 652888 - DNA, 20 bp, Artificial
  CRISPR gRNA sequence
ggaacccaggccaacttcac

SEQ ID NO: 652889 - DNA, 20 bp, Artificial
  CRISPR gRNA sequence
cacaggactgtttttggccc

SEQ ID NO: 652890 - DNA, 20 bp, Artificial
  CRISPR gRNA sequence
acaggactgtttttggccct

SEQ ID NO: 652891 - DNA, 20 bp, Artificial
  CRISPR gRNA sequence
tttttggcccttggcaaaaa

SEQ ID NO: 652892 - DNA, 20 bp, Artificial
  CRISPR gRNA sequence
ttggcccttggcaaaaaaga

SEQ ID NO: 652893 - DNA, 20 bp, Artificial
  CRISPR gRNA sequence
tggcccttggcaaaaaagaa

SEQ ID NO: 652894 - DNA, 20 bp, Artificial
  CRISPR gRNA sequence
ggcccttggcaaaaaagaaa

SEQ ID NO: 652895 - DNA, 20 bp, Artificial
  CRISPR gRNA sequence
gcccttggcaaaaaagaaaa

SEQ ID NO: 652896 - DNA, 20 bp, Artificial
  CRISPR gRNA sequence
ggcaaaaaagaaaaaaaata

SEQ ID NO: 652897 - DNA, 20 bp, Artificial
  CRISPR gRNA sequence
gcaaaaaagaaaaaaaataa

SEQ ID NO: 652898 - DNA, 20 bp, Artificial
  CRISPR gRNA sequence
aattccatctctttcgccca

SEQ ID NO: 652899 - DNA, 20 bp, Artificial
  CRISPR gRNA sequence
attccatctctttcgcccat

SEQ ID NO: 652900 - DNA, 20 bp, Artificial
  CRISPR gRNA sequence
catctctttcgcccatacta

SEQ ID NO: 652901 - DNA, 20 bp, Artificial
  CRISPR gRNA sequence
tttcgcccatactagaacct

SEQ ID NO: 652902 - DNA, 20 bp, Artificial
  CRISPR gRNA sequence
tcgcccatactagaacctgt

SEQ ID NO: 652903 - DNA, 20 bp, Artificial
  CRISPR gRNA sequence
cgcccatactagaacctgtc

SEQ ID NO: 652904 - DNA, 20 bp, Artificial
  CRISPR gRNA sequence
gcccatactagaacctgtca

SEQ ID NO: 652905 - DNA, 20 bp, Artificial
  CRISPR gRNA sequence
gaacctgtcaaagtgattta

SEQ ID NO: 652906 - DNA, 20 bp, Artificial
  CRISPR gRNA sequence
tcaaagtgatttaactgctg

SEQ ID NO: 652907 - DNA, 20 bp, Artificial
  CRISPR gRNA sequence
aactgctgcctgtttacatg

SEQ ID NO: 652908 - DNA, 20 bp, Artificial
  CRISPR gRNA sequence
actgctgcctgtttacatgt

SEQ ID NO: 652909 - DNA, 20 bp, Artificial
  CRISPR gRNA sequence
ctgcctgtttacatgtgtca

SEQ ID NO: 652910 - DNA, 20 bp, Artificial
  CRISPR gRNA sequence
cctgtttacatgtgtcatac

SEQ ID NO: 652911 - DNA, 20 bp, Artificial
  CRISPR gRNA sequence
tttacatgtgtcataccagg

SEQ ID NO: 652912 - DNA, 20 bp, Artificial
  CRISPR gRNA sequence
acatgtgtcataccagggtt

SEQ ID NO: 652913 - DNA, 20 bp, Artificial
  CRISPR gRNA sequence
catgtgtcataccagggttt

SEQ ID NO: 652914 - DNA, 20 bp, Artificial
  CRISPR gRNA sequence
ttggttttttttttttttta

SEQ ID NO: 652915 - DNA, 20 bp, Artificial
  CRISPR gRNA sequence
tggtttttttttttttttaa

SEQ ID NO: 652916 - DNA, 20 bp, Artificial
  CRISPR gRNA sequence
ggtttttttttttttttaat

SEQ ID NO: 652917 - DNA, 20 bp, Artificial
  CRISPR gRNA sequence
gtttttttttttttttaatt

SEQ ID NO: 652918 - DNA, 20 bp, Artificial
  CRISPR gRNA sequence
ttttttttttttaattccaa

SEQ ID NO: 652919 - DNA, 20 bp, Artificial
  CRISPR gRNA sequence
tttttttttttaattccaac

SEQ ID NO: 652920 - DNA, 20 bp, Artificial
  CRISPR gRNA sequence
ttttttttttaattccaaca

SEQ ID NO: 652921 - DNA, 20 bp, Artificial
  CRISPR gRNA sequence
tttttttttaattccaacag

SEQ ID NO: 652922 - DNA, 20 bp, Artificial
  CRISPR gRNA sequence
ttttttttaattccaacagg

SEQ ID NO: 652923 - DNA, 20 bp, Artificial
  CRISPR gRNA sequence
tttttttaattccaacagga

SEQ ID NO: 652924 - DNA, 20 bp, Artificial
  CRISPR gRNA sequence
ttttttaattccaacaggat

SEQ ID NO: 652925 - DNA, 20 bp, Artificial
  CRISPR gRNA sequence
tttttaattccaacaggatc

SEQ ID NO: 652926 - DNA, 20 bp, Artificial
  CRISPR gRNA sequence
ttttaattccaacaggatct

SEQ ID NO: 652927 - DNA, 20 bp, Artificial
  CRISPR gRNA sequence
tttaattccaacaggatctg

SEQ ID NO: 652928 - DNA, 20 bp, Artificial
  CRISPR gRNA sequence
ttaattccaacaggatctgg

SEQ ID NO: 652929 - DNA, 20 bp, Artificial
  CRISPR gRNA sequence
taattccaacaggatctgga

SEQ ID NO: 652930 - DNA, 20 bp, Artificial
  CRISPR gRNA sequence
aattccaacaggatctggat

SEQ ID NO: 652931 - DNA, 20 bp, Artificial
  CRISPR gRNA sequence
attccaacaggatctggata

SEQ ID NO: 652932 - DNA, 20 bp, Artificial
  CRISPR gRNA sequence
caacaggatctggatattac

SEQ ID NO: 652933 - DNA, 20 bp, Artificial
  CRISPR gRNA sequence
gatattaccttctatctgga

SEQ ID NO: 652934 - DNA, 20 bp, Artificial
  CRISPR gRNA sequence
ccttctatctggacagcttc

SEQ ID NO: 652935 - DNA, 20 bp, Artificial
  CRISPR gRNA sequence
ctatctggacagcttcaatt

SEQ ID NO: 652936 - DNA, 20 bp, Artificial
  CRISPR gRNA sequence
tatctggacagcttcaattt

SEQ ID NO: 652937 - DNA, 20 bp, Artificial
  CRISPR gRNA sequence
tctggacagcttcaatttat

SEQ ID NO: 652938 - DNA, 20 bp, Artificial
  CRISPR gRNA sequence
gacagcttcaatttattcca

SEQ ID NO: 652939 - DNA, 20 bp, Artificial
  CRISPR gRNA sequence
caatttattccagcctaccc

SEQ ID NO: 652940 - DNA, 20 bp, Artificial
  CRISPR gRNA sequence
aatttattccagcctaccca

SEQ ID NO: 652941 - DNA, 20 bp, Artificial
  CRISPR gRNA sequence
attccagcctacccaatctt

SEQ ID NO: 652942 - DNA, 20 bp, Artificial
  CRISPR gRNA sequence
ttccagcctacccaatcttt

SEQ ID NO: 652943 - DNA, 20 bp, Artificial
  CRISPR gRNA sequence
cagcctacccaatctttctt

SEQ ID NO: 652944 - DNA, 20 bp, Artificial
  CRISPR gRNA sequence
cccaatctttcttcttggaa

SEQ ID NO: 652945 - DNA, 20 bp, Artificial
  CRISPR gRNA sequence
tcttcttggaattcaagtta

SEQ ID NO: 652946 - DNA, 20 bp, Artificial
  CRISPR gRNA sequence
cttcttggaattcaagttaa

SEQ ID NO: 652947 - DNA, 20 bp, Artificial
  CRISPR gRNA sequence
ttcttggaattcaagttaaa

SEQ ID NO: 652948 - DNA, 20 bp, Artificial
  CRISPR gRNA sequence
cttggaattcaagttaaaac

SEQ ID NO: 652949 - DNA, 20 bp, Artificial
  CRISPR gRNA sequence
ttggaattcaagttaaaaca

SEQ ID NO: 652950 - DNA, 20 bp, Artificial
  CRISPR gRNA sequence
ggaattcaagttaaaacaaa

SEQ ID NO: 652951 - DNA, 20 bp, Artificial
  CRISPR gRNA sequence
gaattcaagttaaaacaaag

SEQ ID NO: 652952 - DNA, 20 bp, Artificial
  CRISPR gRNA sequence
aagttaaaacaaagcaaaac

SEQ ID NO: 652953 - DNA, 20 bp, Artificial
  CRISPR gRNA sequence
aaacaaagcaaaacaagtcc

SEQ ID NO: 652954 - DNA, 20 bp, Artificial
  CRISPR gRNA sequence
atgacagctatagagatgag

SEQ ID NO: 652955 - DNA, 20 bp, Artificial
  CRISPR gRNA sequence
tagagatgagaactgattaa

SEQ ID NO: 652956 - DNA, 20 bp, Artificial
  CRISPR gRNA sequence
attaatcgattaacatccca

SEQ ID NO: 652957 - DNA, 20 bp, Artificial
  CRISPR gRNA sequence
atcgattaacatcccagaaa

SEQ ID NO: 652958 - DNA, 20 bp, Artificial
  CRISPR gRNA sequence
acatcccagaaacagattac

SEQ ID NO: 652959 - DNA, 20 bp, Artificial
  CRISPR gRNA sequence
caaggaggggacgataaatt

SEQ ID NO: 652960 - DNA, 20 bp, Artificial
  CRISPR gRNA sequence
aggcagaggacatcatcttc

SEQ ID NO: 652961 - DNA, 20 bp, Artificial
  CRISPR gRNA sequence
caacccgattccctgagcgt

SEQ ID NO: 652962 - DNA, 20 bp, Artificial
  CRISPR gRNA sequence
aacccgattccctgagcgtc

SEQ ID NO: 652963 - DNA, 20 bp, Artificial
  CRISPR gRNA sequence
cctgagcgtcctttacaaaa

SEQ ID NO: 652964 - DNA, 20 bp, Artificial
  CRISPR gRNA sequence
agcgtcctttacaaaaatca

SEQ ID NO: 652965 - DNA, 20 bp, Artificial
  CRISPR gRNA sequence
tacaaaaatcattaccctaa

SEQ ID NO: 652966 - DNA, 20 bp, Artificial
  CRISPR gRNA sequence
acaaaaatcattaccctaat

SEQ ID NO: 652967 - DNA, 20 bp, Artificial
  CRISPR gRNA sequence
caaaaatcattaccctaatc

SEQ ID NO: 652968 - DNA, 20 bp, Artificial
  CRISPR gRNA sequence
ccctaatcagaaccacaatc

SEQ ID NO: 652969 - DNA, 20 bp, Artificial
  CRISPR gRNA sequence
atcagaaccacaatccatcc

SEQ ID NO: 652970 - DNA, 20 bp, Artificial
  CRISPR gRNA sequence
ccagagaaaaatacctatat

SEQ ID NO: 652971 - DNA, 20 bp, Artificial
  CRISPR gRNA sequence
tattattattattattactg

SEQ ID NO: 652972 - DNA, 20 bp, Artificial
  CRISPR gRNA sequence
ttattattattactggttaa

SEQ ID NO: 652973 - DNA, 20 bp, Artificial
  CRISPR gRNA sequence
ttattattactggttaacag

SEQ ID NO: 652974 - DNA, 20 bp, Artificial
  CRISPR gRNA sequence
ttattactggttaacagcaa

SEQ ID NO: 652975 - DNA, 20 bp, Artificial
  CRISPR gRNA sequence
ttactggttaacagcaacaa

SEQ ID NO: 652976 - DNA, 20 bp, Artificial
  CRISPR gRNA sequence
ctggttaacagcaacaagtc

SEQ ID NO: 652977 - DNA, 20 bp, Artificial
  CRISPR gRNA sequence
gttaacagcaacaagtcatt

SEQ ID NO: 652978 - DNA, 20 bp, Artificial
  CRISPR gRNA sequence
acagcaacaagtcatttgat

SEQ ID NO: 652979 - DNA, 20 bp, Artificial
  CRISPR gRNA sequence
gatcacatcacagtgcaaaa

SEQ ID NO: 652980 - DNA, 20 bp, Artificial
  CRISPR gRNA sequence
atcacatcacagtgcaaaac

SEQ ID NO: 652981 - DNA, 20 bp, Artificial
  CRISPR gRNA sequence
tataattacacttaactttg

SEQ ID NO: 652982 - DNA, 20 bp, Artificial
  CRISPR gRNA sequence
cacttaactttgaaaacact

SEQ ID NO: 652983 - DNA, 20 bp, Artificial
  CRISPR gRNA sequence
aactttgaaaacactccccc

SEQ ID NO: 652984 - DNA, 20 bp, Artificial
  CRISPR gRNA sequence
actttgaaaacactcccccc

SEQ ID NO: 652985 - DNA, 20 bp, Artificial
  CRISPR gRNA sequence
tgaaaacactcccccctttg

SEQ ID NO: 652986 - DNA, 20 bp, Artificial
  CRISPR gRNA sequence
gaaaacactcccccctttgc

SEQ ID NO: 652987 - DNA, 20 bp, Artificial
  CRISPR gRNA sequence
aaaacactcccccctttgca

SEQ ID NO: 652988 - DNA, 20 bp, Artificial
  CRISPR gRNA sequence
ccccctttgcaaatcataca

SEQ ID NO: 652989 - DNA, 20 bp, Artificial
  CRISPR gRNA sequence
tgcaaatcatacacatattt

SEQ ID NO: 652990 - DNA, 20 bp, Artificial
  CRISPR gRNA sequence
gcaaatcatacacatattta

SEQ ID NO: 652991 - DNA, 20 bp, Artificial
  CRISPR gRNA sequence
caaatcatacacatatttat

SEQ ID NO: 652992 - DNA, 20 bp, Artificial
  CRISPR gRNA sequence
atatataatctatgaatcag

SEQ ID NO: 652993 - DNA, 20 bp, Artificial
  CRISPR gRNA sequence
tatataatctatgaatcaga

SEQ ID NO: 652994 - DNA, 20 bp, Artificial
  CRISPR gRNA sequence
tgaatcagaagacaaaacaa

SEQ ID NO: 652995 - DNA, 20 bp, Artificial
  CRISPR gRNA sequence
ttcttcaccacgcaaaagcc

SEQ ID NO: 652996 - DNA, 20 bp, Artificial
  CRISPR gRNA sequence
ttcaccacgcaaaagccaag

SEQ ID NO: 652997 - DNA, 20 bp, Artificial
  CRISPR gRNA sequence
caccacgcaaaagccaagcg

SEQ ID NO: 652998 - DNA, 20 bp, Artificial
  CRISPR gRNA sequence
accacgcaaaagccaagcgg

SEQ ID NO: 652999 - DNA, 20 bp, Artificial
  CRISPR gRNA sequence
acctcagcagtgcatgcagt

SEQ ID NO: 653000 - DNA, 20 bp, Artificial
  CRISPR gRNA sequence
cctcagcagtgcatgcagta

SEQ ID NO: 653001 - DNA, 20 bp, Artificial
  CRISPR gRNA sequence
agcagtgcatgcagtaaaat

SEQ ID NO: 653002 - DNA, 20 bp, Artificial
  CRISPR gRNA sequence
ttgtttgtgtttactgttaa

SEQ ID NO: 653003 - DNA, 20 bp, Artificial
  CRISPR gRNA sequence
tgtttgtgtttactgttaat

SEQ ID NO: 653004 - DNA, 20 bp, Artificial
  CRISPR gRNA sequence
gtttgtgtttactgttaatg

SEQ ID NO: 653005 - DNA, 20 bp, Artificial
  CRISPR gRNA sequence
tttgtgtttactgttaatgt

SEQ ID NO: 653006 - DNA, 20 bp, Artificial
  CRISPR gRNA sequence
gtgtttactgttaatgtgtc

SEQ ID NO: 653007 - DNA, 20 bp, Artificial
  CRISPR gRNA sequence
tgtttactgttaatgtgtcc

SEQ ID NO: 653008 - DNA, 20 bp, Artificial
  CRISPR gRNA sequence
actgttaatgtgtcctctgt

SEQ ID NO: 653009 - DNA, 20 bp, Artificial
  CRISPR gRNA sequence
ctgttaatgtgtcctctgtc

SEQ ID NO: 653010 - DNA, 20 bp, Artificial
  CRISPR gRNA sequence
ttaatgtgtcctctgtcttt

SEQ ID NO: 653011 - DNA, 20 bp, Artificial
  CRISPR gRNA sequence
atgtgtcctctgtctttctt

SEQ ID NO: 653012 - DNA, 20 bp, Artificial
  CRISPR gRNA sequence
tgtctttctttctttcctgt

SEQ ID NO: 653013 - DNA, 20 bp, Artificial
  CRISPR gRNA sequence
tctttctttctttcctgtgc

SEQ ID NO: 653014 - DNA, 20 bp, Artificial
  CRISPR gRNA sequence
tctttctttcctgtgcctaa

SEQ ID NO: 653015 - DNA, 20 bp, Artificial
  CRISPR gRNA sequence
ctttctttcctgtgcctaac

SEQ ID NO: 653016 - DNA, 20 bp, Artificial
  CRISPR gRNA sequence
tttctttcctgtgcctaacg

SEQ ID NO: 653017 - DNA, 20 bp, Artificial
  CRISPR gRNA sequence
tctttcctgtgcctaacgtg

SEQ ID NO: 653018 - DNA, 20 bp, Artificial
  CRISPR gRNA sequence
ctttcctgtgcctaacgtgt

SEQ ID NO: 653019 - DNA, 20 bp, Artificial
  CRISPR gRNA sequence
tttcctgtgcctaacgtgtg

SEQ ID NO: 653020 - DNA, 20 bp, Artificial
  CRISPR gRNA sequence
tcctgtgcctaacgtgtgtt

SEQ ID NO: 653021 - DNA, 20 bp, Artificial
  CRISPR gRNA sequence
cctgtgcctaacgtgtgttt

SEQ ID NO: 653022 - DNA, 20 bp, Artificial
  CRISPR gRNA sequence
ctgtgcctaacgtgtgtttg

SEQ ID NO: 653023 - DNA, 20 bp, Artificial
  CRISPR gRNA sequence
tgcctaacgtgtgtttgtgc

SEQ ID NO: 653024 - DNA, 20 bp, Artificial
  CRISPR gRNA sequence
acgtgtgtttgtgcactgca

SEQ ID NO: 653025 - DNA, 20 bp, Artificial
  CRISPR gRNA sequence
gtgcactgcagttggtggtg

SEQ ID NO: 653026 - DNA, 20 bp, Artificial
  CRISPR gRNA sequence
tgcactgcagttggtggtgg

SEQ ID NO: 653027 - DNA, 20 bp, Artificial
  CRISPR gRNA sequence
cagttggtggtggaaactaa

SEQ ID NO: 653028 - DNA, 20 bp, Artificial
  CRISPR gRNA sequence
gtggtggaaactaaggcagt

SEQ ID NO: 653029 - DNA, 20 bp, Artificial
  CRISPR gRNA sequence
aggcagtggatctgtagcta

SEQ ID NO: 653030 - DNA, 20 bp, Artificial
  CRISPR gRNA sequence
tagctaagggtaatcctgtt

SEQ ID NO: 653031 - DNA, 20 bp, Artificial
  CRISPR gRNA sequence
agggtaatcctgtttttact

SEQ ID NO: 653032 - DNA, 20 bp, Artificial
  CRISPR gRNA sequence
tttttacttcctccatcttc

SEQ ID NO: 653033 - DNA, 20 bp, Artificial
  CRISPR gRNA sequence
ttacttcctccatcttcagc

SEQ ID NO: 653034 - DNA, 20 bp, Artificial
  CRISPR gRNA sequence
tacttcctccatcttcagcg

SEQ ID NO: 653035 - DNA, 20 bp, Artificial
  CRISPR gRNA sequence
acttcctccatcttcagcga

SEQ ID NO: 653036 - DNA, 20 bp, Artificial
  CRISPR gRNA sequence
cttcctccatcttcagcgag

SEQ ID NO: 653037 - DNA, 20 bp, Artificial
  CRISPR gRNA sequence
cctccatcttcagcgaggag

SEQ ID NO: 653038 - DNA, 20 bp, Artificial
  CRISPR gRNA sequence
ctccatcttcagcgaggagc

SEQ ID NO: 653039 - DNA, 20 bp, Artificial
  CRISPR gRNA sequence
catcttcagcgaggagcagg

SEQ ID NO: 653040 - DNA, 20 bp, Artificial
  CRISPR gRNA sequence
cagcgaggagcagggttagc

SEQ ID NO: 653041 - DNA, 20 bp, Artificial
  CRISPR gRNA sequence
agcgaggagcagggttagcc

SEQ ID NO: 653042 - DNA, 20 bp, Artificial
  CRISPR gRNA sequence
gcccgggacagctggtcaaa

SEQ ID NO: 653043 - DNA, 20 bp, Artificial
  CRISPR gRNA sequence
gtcaaaccccgagaaaccga

SEQ ID NO: 653044 - DNA, 20 bp, Artificial
  CRISPR gRNA sequence
ccccgccggccgggctcgcg

SEQ ID NO: 653045 - DNA, 20 bp, Artificial
  CRISPR gRNA sequence
gcgcagacgcccgcgggcgg

SEQ ID NO: 653046 - DNA, 20 bp, Artificial
  CRISPR gRNA sequence
gcggcggctgcggcggcggc

SEQ ID NO: 653047 - DNA, 20 bp, Artificial
  CRISPR gRNA sequence
cggcggcggcggcggcgggc

SEQ ID NO: 653048 - DNA, 20 bp, Artificial
  CRISPR gRNA sequence
gcggcgggcagcggagcccc

SEQ ID NO: 653049 - DNA, 20 bp, Artificial
  CRISPR gRNA sequence
tgcgtgtgtgtatgagagcg

SEQ ID NO: 653050 - DNA, 20 bp, Artificial
  CRISPR gRNA sequence
gcgggcgcgtgtgcgcgtgt

SEQ ID NO: 653051 - DNA, 20 bp, Artificial
  CRISPR gRNA sequence
cgcgctaagccgctcggcgc

SEQ ID NO: 653052 - DNA, 20 bp, Artificial
  CRISPR gRNA sequence
agccgctcggcgcgctcggc

SEQ ID NO: 653053 - DNA, 20 bp, Artificial
  CRISPR gRNA sequence
ggcgcgctcggcaatcgatt

SEQ ID NO: 653054 - DNA, 20 bp, Artificial
  CRISPR gRNA sequence
ggcaatcgattacaggacaa

SEQ ID NO: 653055 - DNA, 20 bp, Artificial
  CRISPR gRNA sequence
caggacaagtgctgccccgg

SEQ ID NO: 653056 - DNA, 20 bp, Artificial
  CRISPR gRNA sequence
ccccggaggctccgcgacgc

SEQ ID NO: 653057 - DNA, 20 bp, Artificial
  CRISPR gRNA sequence
cgcgacgcgcgcactccctc

SEQ ID NO: 653058 - DNA, 20 bp, Artificial
  CRISPR gRNA sequence
cctcgcgcccacccgcgcgc

SEQ ID NO: 653059 - DNA, 20 bp, Artificial
  CRISPR gRNA sequence
gcgcccacccgcgcgcccgg

SEQ ID NO: 653060 - DNA, 20 bp, Artificial
  CRISPR gRNA sequence
gtccccggactgcggacccc

SEQ ID NO: 653061 - DNA, 20 bp, Artificial
  CRISPR gRNA sequence
cggaccccgcccccgacggg

SEQ ID NO: 653062 - DNA, 20 bp, Artificial
  CRISPR gRNA sequence
ccgagtgtgccacggcgacc

SEQ ID NO: 653063 - DNA, 20 bp, Artificial
  CRISPR gRNA sequence
cgagtgtgccacggcgaccc

SEQ ID NO: 653064 - DNA, 20 bp, Artificial
  CRISPR gRNA sequence
ccctccccgtgtcataataa

SEQ ID NO: 653065 - DNA, 20 bp, Artificial
  CRISPR gRNA sequence
cccgtgtcataataaatctc

SEQ ID NO: 653066 - DNA, 20 bp, Artificial
  CRISPR gRNA sequence
acgttttctgccggctggag

SEQ ID NO: 653067 - DNA, 20 bp, Artificial
  CRISPR gRNA sequence
tctgccggctggaggcttgg

SEQ ID NO: 653068 - DNA, 20 bp, Artificial
  CRISPR gRNA sequence
ctgccggctggaggcttgga

SEQ ID NO: 653069 - DNA, 20 bp, Artificial
  CRISPR gRNA sequence
tgccggctggaggcttggag

SEQ ID NO: 653070 - DNA, 20 bp, Artificial
  CRISPR gRNA sequence
ccggctggaggcttggagcg

SEQ ID NO: 653071 - DNA, 20 bp, Artificial
  CRISPR gRNA sequence
gaggcttggagcggtgaggt

SEQ ID NO: 653072 - DNA, 20 bp, Artificial
  CRISPR gRNA sequence
ggagcggtgaggtgacgttc

SEQ ID NO: 653073 - DNA, 20 bp, Artificial
  CRISPR gRNA sequence
gagcggtgaggtgacgttca

SEQ ID NO: 653074 - DNA, 20 bp, Artificial
  CRISPR gRNA sequence
atttcggccgcgtgaagttt

SEQ ID NO: 653075 - DNA, 20 bp, Artificial
  CRISPR gRNA sequence
cggccgcgtgaagttttctt

SEQ ID NO: 653076 - DNA, 20 bp, Artificial
  CRISPR gRNA sequence
ggccgcgtgaagttttcttt

SEQ ID NO: 653077 - DNA, 20 bp, Artificial
  CRISPR gRNA sequence
tctttcaaactgggattggt

SEQ ID NO: 653078 - DNA, 20 bp, Artificial
  CRISPR gRNA sequence
ctttcaaactgggattggtg

SEQ ID NO: 653079 - DNA, 20 bp, Artificial
  CRISPR gRNA sequence
tttcaaactgggattggtgg

SEQ ID NO: 653080 - DNA, 20 bp, Artificial
  CRISPR gRNA sequence
tcaaactgggattggtgggg

SEQ ID NO: 653081 - DNA, 20 bp, Artificial
  CRISPR gRNA sequence
caaactgggattggtgggga

SEQ ID NO: 653082 - DNA, 20 bp, Artificial
  CRISPR gRNA sequence
aaactgggattggtggggag

SEQ ID NO: 653083 - DNA, 20 bp, Artificial
  CRISPR gRNA sequence
ggattggtggggaggccggg

SEQ ID NO: 653084 - DNA, 20 bp, Artificial
  CRISPR gRNA sequence
gtggggaggccgggggaagg

SEQ ID NO: 653085 - DNA, 20 bp, Artificial
  CRISPR gRNA sequence
ggcgccctgcgcggagtccg

SEQ ID NO: 653086 - DNA, 20 bp, Artificial
  CRISPR gRNA sequence
gcgccctgcgcggagtccgg

SEQ ID NO: 653087 - DNA, 20 bp, Artificial
  CRISPR gRNA sequence
cgcggagtccgggagccgcg

SEQ ID NO: 653088 - DNA, 20 bp, Artificial
  CRISPR gRNA sequence
ccacctactggtctccgccg

SEQ ID NO: 653089 - DNA, 20 bp, Artificial
  CRISPR gRNA sequence
ctggtctccgccggcaactc

SEQ ID NO: 653090 - DNA, 20 bp, Artificial
  CRISPR gRNA sequence
gtctccgccggcaactctgc

SEQ ID NO: 653091 - DNA, 20 bp, Artificial
  CRISPR gRNA sequence
cgccggcaactctgcggccc

SEQ ID NO: 653092 - DNA, 20 bp, Artificial
  CRISPR gRNA sequence
tgcggccccatttcggaaag

SEQ ID NO: 653093 - DNA, 20 bp, Artificial
  CRISPR gRNA sequence
cggccccatttcggaaagcg

SEQ ID NO: 653094 - DNA, 20 bp, Artificial
  CRISPR gRNA sequence
cggaaagcgcaccgcattga

SEQ ID NO: 653095 - DNA, 20 bp, Artificial
  CRISPR gRNA sequence
ggaaagcgcaccgcattgac

SEQ ID NO: 653096 - DNA, 20 bp, Artificial
  CRISPR gRNA sequence
accgggacctgaagcgggat

SEQ ID NO: 653097 - DNA, 20 bp, Artificial
  CRISPR gRNA sequence
aagcgggataagaggggtcc

SEQ ID NO: 653098 - DNA, 20 bp, Artificial
  CRISPR gRNA sequence
gggaatagactgagaaagac

SEQ ID NO: 653099 - DNA, 20 bp, Artificial
  CRISPR gRNA sequence
agaaagacattcatgtctga

SEQ ID NO: 653100 - DNA, 20 bp, Artificial
  CRISPR gRNA sequence
atgtctgagatgaagctcaa

SEQ ID NO: 653101 - DNA, 20 bp, Artificial
  CRISPR gRNA sequence
agatgaagctcaactattac

SEQ ID NO: 653102 - DNA, 20 bp, Artificial
  CRISPR gRNA sequence
aactattactattttgaaag

SEQ ID NO: 653103 - DNA, 20 bp, Artificial
  CRISPR gRNA sequence
ttactattttgaaagtgctt

SEQ ID NO: 653104 - DNA, 20 bp, Artificial
  CRISPR gRNA sequence
ctattttgaaagtgctttaa

SEQ ID NO: 653105 - DNA, 20 bp, Artificial
  CRISPR gRNA sequence
ttttgaaagtgctttaacag

SEQ ID NO: 653106 - DNA, 20 bp, Artificial
  CRISPR gRNA sequence
tgaaagtgctttaacagtgc

SEQ ID NO: 653107 - DNA, 20 bp, Artificial
  CRISPR gRNA sequence
gaaagtgctttaacagtgca

SEQ ID NO: 653108 - DNA, 20 bp, Artificial
  CRISPR gRNA sequence
aaagtgctttaacagtgcaa

SEQ ID NO: 653109 - DNA, 20 bp, Artificial
  CRISPR gRNA sequence
taacagtgcaagtttaaaaa

SEQ ID NO: 653110 - DNA, 20 bp, Artificial
  CRISPR gRNA sequence
aacagtgcaagtttaaaaac

SEQ ID NO: 653111 - DNA, 20 bp, Artificial
  CRISPR gRNA sequence
acagtgcaagtttaaaaact

SEQ ID NO: 653112 - DNA, 20 bp, Artificial
  CRISPR gRNA sequence
aaaaactaaagtgttgactt

SEQ ID NO: 653113 - DNA, 20 bp, Artificial
  CRISPR gRNA sequence
aaaactaaagtgttgacttg

SEQ ID NO: 653114 - DNA, 20 bp, Artificial
  CRISPR gRNA sequence
aagtgttgacttgctttttc

SEQ ID NO: 653115 - DNA, 20 bp, Artificial
  CRISPR gRNA sequence
acttgctttttctcccccgg

SEQ ID NO: 653116 - DNA, 20 bp, Artificial
  CRISPR gRNA sequence
gctttttctcccccggggca

SEQ ID NO: 653117 - DNA, 20 bp, Artificial
  CRISPR gRNA sequence
ctttttctcccccggggcat

SEQ ID NO: 653118 - DNA, 20 bp, Artificial
  CRISPR gRNA sequence
tttctcccccggggcatgtg

SEQ ID NO: 653119 - DNA, 20 bp, Artificial
  CRISPR gRNA sequence
ttctcccccggggcatgtgc

SEQ ID NO: 653120 - DNA, 20 bp, Artificial
  CRISPR gRNA sequence
tctcccccggggcatgtgcc

SEQ ID NO: 653121 - DNA, 20 bp, Artificial
  CRISPR gRNA sequence
ctcccccggggcatgtgcca

SEQ ID NO: 653122 - DNA, 20 bp, Artificial
  CRISPR gRNA sequence
tcccccggggcatgtgccac

SEQ ID NO: 653123 - DNA, 20 bp, Artificial
  CRISPR gRNA sequence
ccccggggcatgtgccacgt

SEQ ID NO: 653124 - DNA, 20 bp, Artificial
  CRISPR gRNA sequence
ccaaagtcaaaggaacggat

SEQ ID NO: 653125 - DNA, 20 bp, Artificial
  CRISPR gRNA sequence
caaagtcaaaggaacggatg

SEQ ID NO: 653126 - DNA, 20 bp, Artificial
  CRISPR gRNA sequence
ctacccttgaagtgttacct

SEQ ID NO: 653127 - DNA, 20 bp, Artificial
  CRISPR gRNA sequence
cccttgaagtgttacctatc

SEQ ID NO: 653128 - DNA, 20 bp, Artificial
  CRISPR gRNA sequence
gaagtgttacctatcactat

SEQ ID NO: 653129 - DNA, 20 bp, Artificial
  CRISPR gRNA sequence
aagtgttacctatcactatc

SEQ ID NO: 653130 - DNA, 20 bp, Artificial
  CRISPR gRNA sequence
cctatcactatcaaccacag

SEQ ID NO: 653131 - DNA, 20 bp, Artificial
  CRISPR gRNA sequence
tcactatcaaccacagcttg

SEQ ID NO: 653132 - DNA, 20 bp, Artificial
  CRISPR gRNA sequence
tcaaccacagcttgtttatt

SEQ ID NO: 653133 - DNA, 20 bp, Artificial
  CRISPR gRNA sequence
gtttatttggaaagaactta

SEQ ID NO: 653134 - DNA, 20 bp, Artificial
  CRISPR gRNA sequence
tttatttggaaagaacttaa

SEQ ID NO: 653135 - DNA, 20 bp, Artificial
  CRISPR gRNA sequence
atttggaaagaacttaagtg

SEQ ID NO: 653136 - DNA, 20 bp, Artificial
  CRISPR gRNA sequence
tttggaaagaacttaagtga

SEQ ID NO: 653137 - DNA, 20 bp, Artificial
  CRISPR gRNA sequence
ggaaagaacttaagtgaacc

SEQ ID NO: 653138 - DNA, 20 bp, Artificial
  CRISPR gRNA sequence
gaaagaacttaagtgaaccg

SEQ ID NO: 653139 - DNA, 20 bp, Artificial
  CRISPR gRNA sequence
aagtgaaccgtcaagagaaa

SEQ ID NO: 653140 - DNA, 20 bp, Artificial
  CRISPR gRNA sequence
agtgaaccgtcaagagaaaa

SEQ ID NO: 653141 - DNA, 20 bp, Artificial
  CRISPR gRNA sequence
tttctacaaatagtagcatt

SEQ ID NO: 653142 - DNA, 20 bp, Artificial
  CRISPR gRNA sequence
tctacaaatagtagcattta

SEQ ID NO: 653143 - DNA, 20 bp, Artificial
  CRISPR gRNA sequence
ctacaaatagtagcatttag

SEQ ID NO: 653144 - DNA, 20 bp, Artificial
  CRISPR gRNA sequence
tacaaatagtagcatttagt

SEQ ID NO: 653145 - DNA, 20 bp, Artificial
  CRISPR gRNA sequence
caaatagtagcatttagtat

SEQ ID NO: 653146 - DNA, 20 bp, Artificial
  CRISPR gRNA sequence
agtatctttcctgaccacat

SEQ ID NO: 653147 - DNA, 20 bp, Artificial
  CRISPR gRNA sequence
gtatctttcctgaccacatt

SEQ ID NO: 653148 - DNA, 20 bp, Artificial
  CRISPR gRNA sequence
tcctgaccacatttgcgaaa

SEQ ID NO: 653149 - DNA, 20 bp, Artificial
  CRISPR gRNA sequence
cctgaccacatttgcgaaaa

SEQ ID NO: 653150 - DNA, 20 bp, Artificial
  CRISPR gRNA sequence
ctgaccacatttgcgaaaag

SEQ ID NO: 653151 - DNA, 20 bp, Artificial
  CRISPR gRNA sequence
accacatttgcgaaaagagg

SEQ ID NO: 653152 - DNA, 20 bp, Artificial
  CRISPR gRNA sequence
gcgaaaagagggaatagaga

SEQ ID NO: 653153 - DNA, 20 bp, Artificial
  CRISPR gRNA sequence
cgaaaagagggaatagagac

SEQ ID NO: 653154 - DNA, 20 bp, Artificial
  CRISPR gRNA sequence
ctataattaaagggaaaagg

SEQ ID NO: 653155 - DNA, 20 bp, Artificial
  CRISPR gRNA sequence
tataattaaagggaaaagga

SEQ ID NO: 653156 - DNA, 20 bp, Artificial
  CRISPR gRNA sequence
taattaaagggaaaaggaaa

SEQ ID NO: 653157 - DNA, 20 bp, Artificial
  CRISPR gRNA sequence
aagggaaaaggaaaatgaaa

SEQ ID NO: 653158 - DNA, 20 bp, Artificial
  CRISPR gRNA sequence
aaaatagtgaactgtgtagt

SEQ ID NO: 653159 - DNA, 20 bp, Artificial
  CRISPR gRNA sequence
tgtagtctggatggctgaaa

SEQ ID NO: 653160 - DNA, 20 bp, Artificial
  CRISPR gRNA sequence
gatggctgaaatttgaaaac

SEQ ID NO: 653161 - DNA, 20 bp, Artificial
  CRISPR gRNA sequence
aaatttgaaaacacatgaaa

SEQ ID NO: 653162 - DNA, 20 bp, Artificial
  CRISPR gRNA sequence
gaaaacacatgaaattatca

SEQ ID NO: 653163 - DNA, 20 bp, Artificial
  CRISPR gRNA sequence
aaaacacatgaaattatcag

SEQ ID NO: 653164 - DNA, 20 bp, Artificial
  CRISPR gRNA sequence
tcaggactgccaaacggtgt

SEQ ID NO: 653165 - DNA, 20 bp, Artificial
  CRISPR gRNA sequence
ccaaacggtgttcctgagaa

SEQ ID NO: 653166 - DNA, 20 bp, Artificial
  CRISPR gRNA sequence
ctgagaaaccatatcacaga

SEQ ID NO: 653167 - DNA, 20 bp, Artificial
  CRISPR gRNA sequence
agaaaccatatcacagattg

SEQ ID NO: 653168 - DNA, 20 bp, Artificial
  CRISPR gRNA sequence
tgaagaaaatcaatgctaga

SEQ ID NO: 653169 - DNA, 20 bp, Artificial
  CRISPR gRNA sequence
gaagagtcggaacaggcacc

SEQ ID NO: 653170 - DNA, 20 bp, Artificial
  CRISPR gRNA sequence
ttactcctttgaagaatccc

SEQ ID NO: 653171 - DNA, 20 bp, Artificial
  CRISPR gRNA sequence
actcctttgaagaatcccag

SEQ ID NO: 653172 - DNA, 20 bp, Artificial
  CRISPR gRNA sequence
ctcctttgaagaatcccaga

SEQ ID NO: 653173 - DNA, 20 bp, Artificial
  CRISPR gRNA sequence
ctttgaagaatcccagaaat

SEQ ID NO: 653174 - DNA, 20 bp, Artificial
  CRISPR gRNA sequence
tgaagaatcccagaaatagt

SEQ ID NO: 653175 - DNA, 20 bp, Artificial
  CRISPR gRNA sequence
gaagaatcccagaaatagtt

SEQ ID NO: 653176 - DNA, 20 bp, Artificial
  CRISPR gRNA sequence
aagaatcccagaaatagttg

SEQ ID NO: 653177 - DNA, 20 bp, Artificial
  CRISPR gRNA sequence
ttgaggttttttttttctgc

SEQ ID NO: 653178 - DNA, 20 bp, Artificial
  CRISPR gRNA sequence
aggttttttttttctgctga

SEQ ID NO: 653179 - DNA, 20 bp, Artificial
  CRISPR gRNA sequence
tttttttctgctgagaaaaa

SEQ ID NO: 653180 - DNA, 20 bp, Artificial
  CRISPR gRNA sequence
ttttttctgctgagaaaaaa

SEQ ID NO: 653181 - DNA, 20 bp, Artificial
  CRISPR gRNA sequence
tttttctgctgagaaaaaaa

SEQ ID NO: 653182 - DNA, 20 bp, Artificial
  CRISPR gRNA sequence
ttttctgctgagaaaaaaag

SEQ ID NO: 653183 - DNA, 20 bp, Artificial
  CRISPR gRNA sequence
tttctgctgagaaaaaaaga

SEQ ID NO: 653184 - DNA, 20 bp, Artificial
  CRISPR gRNA sequence
ttctgctgagaaaaaaagat

SEQ ID NO: 653185 - DNA, 20 bp, Artificial
  CRISPR gRNA sequence
tctgctgagaaaaaaagata

SEQ ID NO: 653186 - DNA, 20 bp, Artificial
  CRISPR gRNA sequence
ctgctgagaaaaaaagatat

SEQ ID NO: 653187 - DNA, 20 bp, Artificial
  CRISPR gRNA sequence
tgctgagaaaaaaagatata

SEQ ID NO: 653188 - DNA, 20 bp, Artificial
  CRISPR gRNA sequence
ctgagaaaaaaagatatatt

SEQ ID NO: 653189 - DNA, 20 bp, Artificial
  CRISPR gRNA sequence
agaaaaaaagatatattgga

SEQ ID NO: 653190 - DNA, 20 bp, Artificial
  CRISPR gRNA sequence
gaaattaagtcatcaacagt

SEQ ID NO: 653191 - DNA, 20 bp, Artificial
  CRISPR gRNA sequence
agtcatcaacagtaccttaa

SEQ ID NO: 653192 - DNA, 20 bp, Artificial
  CRISPR gRNA sequence
aagcaccactctgtaggtaa

SEQ ID NO: 653193 - DNA, 20 bp, Artificial
  CRISPR gRNA sequence
agcaccactctgtaggtaat

SEQ ID NO: 653194 - DNA, 20 bp, Artificial
  CRISPR gRNA sequence
tgtaggtaattttggatagt

SEQ ID NO: 653195 - DNA, 20 bp, Artificial
  CRISPR gRNA sequence
taggtaattttggatagtgt

SEQ ID NO: 653196 - DNA, 20 bp, Artificial
  CRISPR gRNA sequence
tggatagtgtcttttcttta

SEQ ID NO: 653197 - DNA, 20 bp, Artificial
  CRISPR gRNA sequence
ggatagtgtcttttctttac

SEQ ID NO: 653198 - DNA, 20 bp, Artificial
  CRISPR gRNA sequence
gatagtgtcttttctttaca

SEQ ID NO: 653199 - DNA, 20 bp, Artificial
  CRISPR gRNA sequence
ttctttacattttgatatag

SEQ ID NO: 653200 - DNA, 20 bp, Artificial
  CRISPR gRNA sequence
tctttacattttgatatagg

SEQ ID NO: 653201 - DNA, 20 bp, Artificial
  CRISPR gRNA sequence
ctttacattttgatataggg

SEQ ID NO: 653202 - DNA, 20 bp, Artificial
  CRISPR gRNA sequence
tttacattttgatataggga

SEQ ID NO: 653203 - DNA, 20 bp, Artificial
  CRISPR gRNA sequence
tacattttgatatagggaag

SEQ ID NO: 653204 - DNA, 20 bp, Artificial
  CRISPR gRNA sequence
acattttgatatagggaagg

SEQ ID NO: 653205 - DNA, 20 bp, Artificial
  CRISPR gRNA sequence
cattttgatatagggaagga

SEQ ID NO: 653206 - DNA, 20 bp, Artificial
  CRISPR gRNA sequence
tgatatagggaaggaattaa

SEQ ID NO: 653207 - DNA, 20 bp, Artificial
  CRISPR gRNA sequence
gatatagggaaggaattaat

SEQ ID NO: 653208 - DNA, 20 bp, Artificial
  CRISPR gRNA sequence
atatagggaaggaattaatt

SEQ ID NO: 653209 - DNA, 20 bp, Artificial
  CRISPR gRNA sequence
attcacatcgacacaaacga

SEQ ID NO: 653210 - DNA, 20 bp, Artificial
  CRISPR gRNA sequence
acatcgacacaaacgaagta

SEQ ID NO: 653211 - DNA, 20 bp, Artificial
  CRISPR gRNA sequence
gtgtgatactgtagctttta

SEQ ID NO: 653212 - DNA, 20 bp, Artificial
  CRISPR gRNA sequence
tgtgatactgtagcttttat

SEQ ID NO: 653213 - DNA, 20 bp, Artificial
  CRISPR gRNA sequence
tagcttttataatgaattac

SEQ ID NO: 653214 - DNA, 20 bp, Artificial
  CRISPR gRNA sequence
ttataatgaattacttcttg

SEQ ID NO: 653215 - DNA, 20 bp, Artificial
  CRISPR gRNA sequence
tataatgaattacttcttga

SEQ ID NO: 653216 - DNA, 20 bp, Artificial
  CRISPR gRNA sequence
ataatgaattacttcttgaa

SEQ ID NO: 653217 - DNA, 20 bp, Artificial
  CRISPR gRNA sequence
taatgaattacttcttgaaa

SEQ ID NO: 653218 - DNA, 20 bp, Artificial
  CRISPR gRNA sequence
cttcttgaaagttttttttc

SEQ ID NO: 653219 - DNA, 20 bp, Artificial
  CRISPR gRNA sequence
cttgaaagttttttttccta

SEQ ID NO: 653220 - DNA, 20 bp, Artificial
  CRISPR gRNA sequence
ttgaaagttttttttcctat

SEQ ID NO: 653221 - DNA, 20 bp, Artificial
  CRISPR gRNA sequence
gaaagttttttttcctatac

SEQ ID NO: 653222 - DNA, 20 bp, Artificial
  CRISPR gRNA sequence
aaagttttttttcctataca

SEQ ID NO: 653223 - DNA, 20 bp, Artificial
  CRISPR gRNA sequence
tttttcctatacaatgtatt

SEQ ID NO: 653224 - DNA, 20 bp, Artificial
  CRISPR gRNA sequence
ttttcctatacaatgtatta

SEQ ID NO: 653225 - DNA, 20 bp, Artificial
  CRISPR gRNA sequence
tttcctatacaatgtattat

SEQ ID NO: 653226 - DNA, 20 bp, Artificial
  CRISPR gRNA sequence
ttcctatacaatgtattatt

SEQ ID NO: 653227 - DNA, 20 bp, Artificial
  CRISPR gRNA sequence
tcctatacaatgtattatta

SEQ ID NO: 653228 - DNA, 20 bp, Artificial
  CRISPR gRNA sequence
cctatacaatgtattattaa

SEQ ID NO: 653229 - DNA, 20 bp, Artificial
  CRISPR gRNA sequence
ctatacaatgtattattaaa

SEQ ID NO: 653230 - DNA, 20 bp, Artificial
  CRISPR gRNA sequence
tacaatgtattattaaacaa

SEQ ID NO: 653231 - DNA, 20 bp, Artificial
  CRISPR gRNA sequence
ttaaacaattgtaacgatag

SEQ ID NO: 653232 - DNA, 20 bp, Artificial
  CRISPR gRNA sequence
aacaattgtaacgatagtct

SEQ ID NO: 653233 - DNA, 20 bp, Artificial
  CRISPR gRNA sequence
taacgatagtctctttttgt

SEQ ID NO: 653234 - DNA, 20 bp, Artificial
  CRISPR gRNA sequence
tttttgtttaactatagaaa

SEQ ID NO: 653235 - DNA, 20 bp, Artificial
  CRISPR gRNA sequence
tttgtttaactatagaaaat

SEQ ID NO: 653236 - DNA, 20 bp, Artificial
  CRISPR gRNA sequence
ttgtttaactatagaaaatg

SEQ ID NO: 653237 - DNA, 20 bp, Artificial
  CRISPR gRNA sequence
tgtttaactatagaaaatgg

SEQ ID NO: 653238 - DNA, 20 bp, Artificial
  CRISPR gRNA sequence
gtttaactatagaaaatggt

SEQ ID NO: 653239 - DNA, 20 bp, Artificial
  CRISPR gRNA sequence
tttaactatagaaaatggta

SEQ ID NO: 653240 - DNA, 20 bp, Artificial
  CRISPR gRNA sequence
aactatagaaaatggtagat

SEQ ID NO: 653241 - DNA, 20 bp, Artificial
  CRISPR gRNA sequence
actatagaaaatggtagata

SEQ ID NO: 653242 - DNA, 20 bp, Artificial
  CRISPR gRNA sequence
tagaaaatggtagatagtgt

SEQ ID NO: 653243 - DNA, 20 bp, Artificial
  CRISPR gRNA sequence
acaaattttcgttggagaga

SEQ ID NO: 653244 - DNA, 20 bp, Artificial
  CRISPR gRNA sequence
tcgttggagagaaattattt

SEQ ID NO: 653245 - DNA, 20 bp, Artificial
  CRISPR gRNA sequence
cgttggagagaaattatttg

SEQ ID NO: 653246 - DNA, 20 bp, Artificial
  CRISPR gRNA sequence
gttggagagaaattatttgg

SEQ ID NO: 653247 - DNA, 20 bp, Artificial
  CRISPR gRNA sequence
gagagaaattatttgggctc

SEQ ID NO: 653248 - DNA, 20 bp, Artificial
  CRISPR gRNA sequence
tttgggctcaggcttgcaat

SEQ ID NO: 653249 - DNA, 20 bp, Artificial
  CRISPR gRNA sequence
gggctcaggcttgcaataac

SEQ ID NO: 653250 - DNA, 20 bp, Artificial
  CRISPR gRNA sequence
ggctcaggcttgcaataaca

SEQ ID NO: 653251 - DNA, 20 bp, Artificial
  CRISPR gRNA sequence
aggcttgcaataacattatg

SEQ ID NO: 653252 - DNA, 20 bp, Artificial
  CRISPR gRNA sequence
gcaataacattatgatgatt

SEQ ID NO: 653253 - DNA, 20 bp, Artificial
  CRISPR gRNA sequence
caataacattatgatgattt

SEQ ID NO: 653254 - DNA, 20 bp, Artificial
  CRISPR gRNA sequence
tgatgattttaagaaaaatt

SEQ ID NO: 653255 - DNA, 20 bp, Artificial
  CRISPR gRNA sequence
taagaaaaattgcagttcct

SEQ ID NO: 653256 - DNA, 20 bp, Artificial
  CRISPR gRNA sequence
aagaaaaattgcagttcctg

SEQ ID NO: 653257 - DNA, 20 bp, Artificial
  CRISPR gRNA sequence
agaaaaattgcagttcctgt

SEQ ID NO: 653258 - DNA, 20 bp, Artificial
  CRISPR gRNA sequence
cagttcctgtgagttatata

SEQ ID NO: 653259 - DNA, 20 bp, Artificial
  CRISPR gRNA sequence
ctgtgagttatatattgata

SEQ ID NO: 653260 - DNA, 20 bp, Artificial
  CRISPR gRNA sequence
tgagttatatattgataagg

SEQ ID NO: 653261 - DNA, 20 bp, Artificial
  CRISPR gRNA sequence
tatattgataaggcagattt

SEQ ID NO: 653262 - DNA, 20 bp, Artificial
  CRISPR gRNA sequence
ataaggcagatttttaaaca

SEQ ID NO: 653263 - DNA, 20 bp, Artificial
  CRISPR gRNA sequence
ttaaacacttagttgctaaa

SEQ ID NO: 653264 - DNA, 20 bp, Artificial
  CRISPR gRNA sequence
taaacacttagttgctaaaa

SEQ ID NO: 653265 - DNA, 20 bp, Artificial
  CRISPR gRNA sequence
aaacacttagttgctaaaat

SEQ ID NO: 653266 - DNA, 20 bp, Artificial
  CRISPR gRNA sequence
aacacttagttgctaaaatt

SEQ ID NO: 653267 - DNA, 20 bp, Artificial
  CRISPR gRNA sequence
agttgctaaaattagttttc

SEQ ID NO: 653268 - DNA, 20 bp, Artificial
  CRISPR gRNA sequence
gttgctaaaattagttttcc

SEQ ID NO: 653269 - DNA, 20 bp, Artificial
  CRISPR gRNA sequence
ctaaaattagttttcctaaa

SEQ ID NO: 653270 - DNA, 20 bp, Artificial
  CRISPR gRNA sequence
aaattagttttcctaaagtc

SEQ ID NO: 653271 - DNA, 20 bp, Artificial
  CRISPR gRNA sequence
gttttcctaaagtcgtattt

SEQ ID NO: 653272 - DNA, 20 bp, Artificial
  CRISPR gRNA sequence
tcctaaagtcgtatttggga

SEQ ID NO: 653273 - DNA, 20 bp, Artificial
  CRISPR gRNA sequence
cctaaagtcgtatttgggaa

SEQ ID NO: 653274 - DNA, 20 bp, Artificial
  CRISPR gRNA sequence
ctaaagtcgtatttgggaaa

SEQ ID NO: 653275 - DNA, 20 bp, Artificial
  CRISPR gRNA sequence
aagtcgtatttgggaaagtc

SEQ ID NO: 653276 - DNA, 20 bp, Artificial
  CRISPR gRNA sequence
gggaaagtctgagtagagaa

SEQ ID NO: 653277 - DNA, 20 bp, Artificial
  CRISPR gRNA sequence
ggaaagtctgagtagagaac

SEQ ID NO: 653278 - DNA, 20 bp, Artificial
  CRISPR gRNA sequence
agtagagaaccagtaagtca

SEQ ID NO: 653279 - DNA, 20 bp, Artificial
  CRISPR gRNA sequence
taatcatcccaacagagagc

SEQ ID NO: 653280 - DNA, 20 bp, Artificial
  CRISPR gRNA sequence
atcatcccaacagagagcaa

SEQ ID NO: 653281 - DNA, 20 bp, Artificial
  CRISPR gRNA sequence
tagtcttaaattacctcaaa

SEQ ID NO: 653282 - DNA, 20 bp, Artificial
  CRISPR gRNA sequence
agtcttaaattacctcaaaa

SEQ ID NO: 653283 - DNA, 20 bp, Artificial
  CRISPR gRNA sequence
gtcttaaattacctcaaaaa

SEQ ID NO: 653284 - DNA, 20 bp, Artificial
  CRISPR gRNA sequence
aaattacctcaaaaaatctg

SEQ ID NO: 653285 - DNA, 20 bp, Artificial
  CRISPR gRNA sequence
aattacctcaaaaaatctgt

SEQ ID NO: 653286 - DNA, 20 bp, Artificial
  CRISPR gRNA sequence
cctcaaaaaatctgtatgtc

SEQ ID NO: 653287 - DNA, 20 bp, Artificial
  CRISPR gRNA sequence
aaaaaatctgtatgtcgttt

SEQ ID NO: 653288 - DNA, 20 bp, Artificial
  CRISPR gRNA sequence
tatgtcgtttataatatgta

SEQ ID NO: 653289 - DNA, 20 bp, Artificial
  CRISPR gRNA sequence
ataatatgtaaatgcacaat

SEQ ID NO: 653290 - DNA, 20 bp, Artificial
  CRISPR gRNA sequence
taatatgtaaatgcacaata

SEQ ID NO: 653291 - DNA, 20 bp, Artificial
  CRISPR gRNA sequence
tcgaaattgtcataagtcct

SEQ ID NO: 653292 - DNA, 20 bp, Artificial
  CRISPR gRNA sequence
gaaattgtcataagtccttc

SEQ ID NO: 653293 - DNA, 20 bp, Artificial
  CRISPR gRNA sequence
tcataagtccttcctaaaaa

SEQ ID NO: 653294 - DNA, 20 bp, Artificial
  CRISPR gRNA sequence
cctaaaaactgaacctaagt

SEQ ID NO: 653295 - DNA, 20 bp, Artificial
  CRISPR gRNA sequence
ctaaaaactgaacctaagtg

SEQ ID NO: 653296 - DNA, 20 bp, Artificial
  CRISPR gRNA sequence
aaaactgaacctaagtgttt

SEQ ID NO: 653297 - DNA, 20 bp, Artificial
  CRISPR gRNA sequence
aacctaagtgtttaggtatc

SEQ ID NO: 653298 - DNA, 20 bp, Artificial
  CRISPR gRNA sequence
agtgtttaggtatctgtact

SEQ ID NO: 653299 - DNA, 20 bp, Artificial
  CRISPR gRNA sequence
aggtatctgtactgttacag

SEQ ID NO: 653300 - DNA, 20 bp, Artificial
  CRISPR gRNA sequence
ggtatctgtactgttacaga

SEQ ID NO: 653301 - DNA, 20 bp, Artificial
  CRISPR gRNA sequence
tactgttacagagatccttg

SEQ ID NO: 653302 - DNA, 20 bp, Artificial
  CRISPR gRNA sequence
ttacagagatccttgaaaat

SEQ ID NO: 653303 - DNA, 20 bp, Artificial
  CRISPR gRNA sequence
cagagatccttgaaaatatg

SEQ ID NO: 653304 - DNA, 20 bp, Artificial
  CRISPR gRNA sequence
gaaaatatgaaataaagata

SEQ ID NO: 653305 - DNA, 20 bp, Artificial
  CRISPR gRNA sequence
aaaatatgaaataaagataa

SEQ ID NO: 653306 - DNA, 20 bp, Artificial
  CRISPR gRNA sequence
agatgaaatgtctgatagtt

SEQ ID NO: 653307 - DNA, 20 bp, Artificial
  CRISPR gRNA sequence
atagtttacacaatgtaatt

SEQ ID NO: 653308 - DNA, 20 bp, Artificial
  CRISPR gRNA sequence
acacaatgtaattatttggt

SEQ ID NO: 653309 - DNA, 20 bp, Artificial
  CRISPR gRNA sequence
cacaatgtaattatttggta

SEQ ID NO: 653310 - DNA, 20 bp, Artificial
  CRISPR gRNA sequence
tttggtagaagaggatccat

SEQ ID NO: 653311 - DNA, 20 bp, Artificial
  CRISPR gRNA sequence
ggtagaagaggatccattgt

SEQ ID NO: 653312 - DNA, 20 bp, Artificial
  CRISPR gRNA sequence
gtagaagaggatccattgtg

SEQ ID NO: 653313 - DNA, 20 bp, Artificial
  CRISPR gRNA sequence
tgaaatcttaaagatacatc

SEQ ID NO: 653314 - DNA, 20 bp, Artificial
  CRISPR gRNA sequence
aaagatacatcctcacagtt

SEQ ID NO: 653315 - DNA, 20 bp, Artificial
  CRISPR gRNA sequence
aagatacatcctcacagtta

SEQ ID NO: 653316 - DNA, 20 bp, Artificial
  CRISPR gRNA sequence
acagttaccaagttgatgta

SEQ ID NO: 653317 - DNA, 20 bp, Artificial
  CRISPR gRNA sequence
ccaagttgatgtagtccttg

SEQ ID NO: 653318 - DNA, 20 bp, Artificial
  CRISPR gRNA sequence
atgtagtccttgcccctggt

SEQ ID NO: 653319 - DNA, 20 bp, Artificial
  CRISPR gRNA sequence
gcccctggtttattgaagct

SEQ ID NO: 653320 - DNA, 20 bp, Artificial
  CRISPR gRNA sequence
cccctggtttattgaagctt

SEQ ID NO: 653321 - DNA, 20 bp, Artificial
  CRISPR gRNA sequence
gtttattgaagcttaattta

SEQ ID NO: 653322 - DNA, 20 bp, Artificial
  CRISPR gRNA sequence
attgaagcttaatttagctt

SEQ ID NO: 653323 - DNA, 20 bp, Artificial
  CRISPR gRNA sequence
ttgaagcttaatttagcttc

SEQ ID NO: 653324 - DNA, 20 bp, Artificial
  CRISPR gRNA sequence
aagcttaatttagcttcctt

SEQ ID NO: 653325 - DNA, 20 bp, Artificial
  CRISPR gRNA sequence
aatttagcttccttgaagct

SEQ ID NO: 653326 - DNA, 20 bp, Artificial
  CRISPR gRNA sequence
atttagcttccttgaagctg

SEQ ID NO: 653327 - DNA, 20 bp, Artificial
  CRISPR gRNA sequence
agcttccttgaagctggtcc

SEQ ID NO: 653328 - DNA, 20 bp, Artificial
  CRISPR gRNA sequence
gcttccttgaagctggtcct

SEQ ID NO: 653329 - DNA, 20 bp, Artificial
  CRISPR gRNA sequence
ccttgaagctggtccttttc

SEQ ID NO: 653330 - DNA, 20 bp, Artificial
  CRISPR gRNA sequence
cttgaagctggtccttttca

SEQ ID NO: 653331 - DNA, 20 bp, Artificial
  CRISPR gRNA sequence
gaagctggtccttttcaaga

SEQ ID NO: 653332 - DNA, 20 bp, Artificial
  CRISPR gRNA sequence
aagctggtccttttcaagag

SEQ ID NO: 653333 - DNA, 20 bp, Artificial
  CRISPR gRNA sequence
gtccttttcaagagttaact

SEQ ID NO: 653334 - DNA, 20 bp, Artificial
  CRISPR gRNA sequence
ttcaagagttaactttcact

SEQ ID NO: 653335 - DNA, 20 bp, Artificial
  CRISPR gRNA sequence
tcaagagttaactttcactg

SEQ ID NO: 653336 - DNA, 20 bp, Artificial
  CRISPR gRNA sequence
caagagttaactttcactgg

SEQ ID NO: 653337 - DNA, 20 bp, Artificial
  CRISPR gRNA sequence
aagagttaactttcactggc

SEQ ID NO: 653338 - DNA, 20 bp, Artificial
  CRISPR gRNA sequence
actttcactggctgcctagt

SEQ ID NO: 653339 - DNA, 20 bp, Artificial
  CRISPR gRNA sequence
tcactggctgcctagtcacc

SEQ ID NO: 653340 - DNA, 20 bp, Artificial
  CRISPR gRNA sequence
cactggctgcctagtcacca

SEQ ID NO: 653341 - DNA, 20 bp, Artificial
  CRISPR gRNA sequence
actggctgcctagtcaccag

SEQ ID NO: 653342 - DNA, 20 bp, Artificial
  CRISPR gRNA sequence
gctgcctagtcaccagaggc

SEQ ID NO: 653343 - DNA, 20 bp, Artificial
  CRISPR gRNA sequence
cctagtcaccagaggcacac

SEQ ID NO: 653344 - DNA, 20 bp, Artificial
  CRISPR gRNA sequence
gtcaccagaggcacactttc

SEQ ID NO: 653345 - DNA, 20 bp, Artificial
  CRISPR gRNA sequence
tctccctctagtggctaagg

SEQ ID NO: 653346 - DNA, 20 bp, Artificial
  CRISPR gRNA sequence
ctccctctagtggctaaggc

SEQ ID NO: 653347 - DNA, 20 bp, Artificial
  CRISPR gRNA sequence
tccctctagtggctaaggct

SEQ ID NO: 653348 - DNA, 20 bp, Artificial
  CRISPR gRNA sequence
cctctagtggctaaggcttc

SEQ ID NO: 653349 - DNA, 20 bp, Artificial
  CRISPR gRNA sequence
tagtggctaaggcttcagac

SEQ ID NO: 653350 - DNA, 20 bp, Artificial
  CRISPR gRNA sequence
gtggctaaggcttcagacac

SEQ ID NO: 653351 - DNA, 20 bp, Artificial
  CRISPR gRNA sequence
aggcttcagacactacattc

SEQ ID NO: 653352 - DNA, 20 bp, Artificial
  CRISPR gRNA sequence
cagacactacattctgtcac

SEQ ID NO: 653353 - DNA, 20 bp, Artificial
  CRISPR gRNA sequence
agacactacattctgtcacc

SEQ ID NO: 653354 - DNA, 20 bp, Artificial
  CRISPR gRNA sequence
cattctgtcaccctgcctcc

SEQ ID NO: 653355 - DNA, 20 bp, Artificial
  CRISPR gRNA sequence
tgtcaccctgcctccccctg

SEQ ID NO: 653356 - DNA, 20 bp, Artificial
  CRISPR gRNA sequence
tcaccctgcctccccctgaa

SEQ ID NO: 653357 - DNA, 20 bp, Artificial
  CRISPR gRNA sequence
cctccccctgaatggatccc

SEQ ID NO: 653358 - DNA, 20 bp, Artificial
  CRISPR gRNA sequence
cccctgaatggatcccagat

SEQ ID NO: 653359 - DNA, 20 bp, Artificial
  CRISPR gRNA sequence
aatggatcccagattttaga

SEQ ID NO: 653360 - DNA, 20 bp, Artificial
  CRISPR gRNA sequence
tagaataacaaagatctcat

SEQ ID NO: 653361 - DNA, 20 bp, Artificial
  CRISPR gRNA sequence
agaataacaaagatctcatg

SEQ ID NO: 653362 - DNA, 20 bp, Artificial
  CRISPR gRNA sequence
gaataacaaagatctcatga

SEQ ID NO: 653363 - DNA, 20 bp, Artificial
  CRISPR gRNA sequence
atgaccacctgggagaattg

SEQ ID NO: 653364 - DNA, 20 bp, Artificial
  CRISPR gRNA sequence
ggagaattggaccatcttgg

SEQ ID NO: 653365 - DNA, 20 bp, Artificial
  CRISPR gRNA sequence
gaccatcttggcaaatgttt

SEQ ID NO: 653366 - DNA, 20 bp, Artificial
  CRISPR gRNA sequence
ggcaaatgtttccctctttt

SEQ ID NO: 653367 - DNA, 20 bp, Artificial
  CRISPR gRNA sequence
gcaaatgtttccctcttttt

SEQ ID NO: 653368 - DNA, 20 bp, Artificial
  CRISPR gRNA sequence
ccctctttttaacatcctac

SEQ ID NO: 653369 - DNA, 20 bp, Artificial
  CRISPR gRNA sequence
cctctttttaacatcctaca

SEQ ID NO: 653370 - DNA, 20 bp, Artificial
  CRISPR gRNA sequence
tttttaacatcctacattcc

SEQ ID NO: 653371 - DNA, 20 bp, Artificial
  CRISPR gRNA sequence
tttaacatcctacattcctt

SEQ ID NO: 653372 - DNA, 20 bp, Artificial
  CRISPR gRNA sequence
ttaacatcctacattccttt

SEQ ID NO: 653373 - DNA, 20 bp, Artificial
  CRISPR gRNA sequence
taacatcctacattcctttc

SEQ ID NO: 653374 - DNA, 20 bp, Artificial
  CRISPR gRNA sequence
aacatcctacattcctttct

SEQ ID NO: 653375 - DNA, 20 bp, Artificial
  CRISPR gRNA sequence
acatcctacattcctttctt

SEQ ID NO: 653376 - DNA, 20 bp, Artificial
  CRISPR gRNA sequence
cattcctttcttatttgcag

SEQ ID NO: 653377 - DNA, 20 bp, Artificial
  CRISPR gRNA sequence
ctttcttatttgcaggttat

SEQ ID NO: 653378 - DNA, 20 bp, Artificial
  CRISPR gRNA sequence
tcttatttgcaggttatggt

SEQ ID NO: 653379 - DNA, 20 bp, Artificial
  CRISPR gRNA sequence
cttatttgcaggttatggtg

SEQ ID NO: 653380 - DNA, 20 bp, Artificial
  CRISPR gRNA sequence
ttatttgcaggttatggtgt

SEQ ID NO: 653381 - DNA, 20 bp, Artificial
  CRISPR gRNA sequence
atttgcaggttatggtgtat

SEQ ID NO: 653382 - DNA, 20 bp, Artificial
  CRISPR gRNA sequence
tttgcaggttatggtgtatc

SEQ ID NO: 653383 - DNA, 20 bp, Artificial
  CRISPR gRNA sequence
gcaggttatggtgtatctaa

SEQ ID NO: 653384 - DNA, 20 bp, Artificial
  CRISPR gRNA sequence
caggttatggtgtatctaac

SEQ ID NO: 653385 - DNA, 20 bp, Artificial
  CRISPR gRNA sequence
tggtgtatctaactcatcca

SEQ ID NO: 653386 - DNA, 20 bp, Artificial
  CRISPR gRNA sequence
actcatccagagaaatcaag

SEQ ID NO: 653387 - DNA, 20 bp, Artificial
  CRISPR gRNA sequence
atccagagaaatcaagatta

SEQ ID NO: 653388 - DNA, 20 bp, Artificial
  CRISPR gRNA sequence
tgttttcataccaagattgg

SEQ ID NO: 653389 - DNA, 20 bp, Artificial
  CRISPR gRNA sequence
tcataccaagattgggggtt

SEQ ID NO: 653390 - DNA, 20 bp, Artificial
  CRISPR gRNA sequence
cataccaagattgggggttt

SEQ ID NO: 653391 - DNA, 20 bp, Artificial
  CRISPR gRNA sequence
ataccaagattgggggtttt

SEQ ID NO: 653392 - DNA, 20 bp, Artificial
  CRISPR gRNA sequence
ggggttttatttcatgcctg

SEQ ID NO: 653393 - DNA, 20 bp, Artificial
  CRISPR gRNA sequence
tatttcatgcctgtggagtc

SEQ ID NO: 653394 - DNA, 20 bp, Artificial
  CRISPR gRNA sequence
atttcatgcctgtggagtct

SEQ ID NO: 653395 - DNA, 20 bp, Artificial
  CRISPR gRNA sequence
tttcatgcctgtggagtcta

SEQ ID NO: 653396 - DNA, 20 bp, Artificial
  CRISPR gRNA sequence
catgcctgtggagtctatag

SEQ ID NO: 653397 - DNA, 20 bp, Artificial
  CRISPR gRNA sequence
atgcctgtggagtctatagt

SEQ ID NO: 653398 - DNA, 20 bp, Artificial
  CRISPR gRNA sequence
tggagtctatagtcctaaga

SEQ ID NO: 653399 - DNA, 20 bp, Artificial
  CRISPR gRNA sequence
tagtcctaagattcacaatg

SEQ ID NO: 653400 - DNA, 20 bp, Artificial
  CRISPR gRNA sequence
agattcacaatgcaatccac

SEQ ID NO: 653401 - DNA, 20 bp, Artificial
  CRISPR gRNA sequence
acaatgcaatccactcatgg

SEQ ID NO: 653402 - DNA, 20 bp, Artificial
  CRISPR gRNA sequence
atgggaaagaacccttgcat

SEQ ID NO: 653403 - DNA, 20 bp, Artificial
  CRISPR gRNA sequence
gcataaactgtaattcactt

SEQ ID NO: 653404 - DNA, 20 bp, Artificial
  CRISPR gRNA sequence
cataaactgtaattcacttt

SEQ ID NO: 653405 - DNA, 20 bp, Artificial
  CRISPR gRNA sequence
taattcactttgttcagaat

SEQ ID NO: 653406 - DNA, 20 bp, Artificial
  CRISPR gRNA sequence
actttgttcagaatttctct

SEQ ID NO: 653407 - DNA, 20 bp, Artificial
  CRISPR gRNA sequence
tgttcagaatttctctgggt

SEQ ID NO: 653408 - DNA, 20 bp, Artificial
  CRISPR gRNA sequence
gttcagaatttctctgggta

SEQ ID NO: 653409 - DNA, 20 bp, Artificial
  CRISPR gRNA sequence
ttcagaatttctctgggtag

SEQ ID NO: 653410 - DNA, 20 bp, Artificial
  CRISPR gRNA sequence
agaatttctctgggtagttt

SEQ ID NO: 653411 - DNA, 20 bp, Artificial
  CRISPR gRNA sequence
ctctgggtagttttgtttgt

SEQ ID NO: 653412 - DNA, 20 bp, Artificial
  CRISPR gRNA sequence
tctgggtagttttgtttgtt

SEQ ID NO: 653413 - DNA, 20 bp, Artificial
  CRISPR gRNA sequence
tgggtagttttgtttgtttg

SEQ ID NO: 653414 - DNA, 20 bp, Artificial
  CRISPR gRNA sequence
ggtagttttgtttgtttgtt

SEQ ID NO: 653415 - DNA, 20 bp, Artificial
  CRISPR gRNA sequence
tgtttgtttgttcgttttgg

SEQ ID NO: 653416 - DNA, 20 bp, Artificial
  CRISPR gRNA sequence
gtttgtttgttcgttttggt

SEQ ID NO: 653417 - DNA, 20 bp, Artificial
  CRISPR gRNA sequence
tttgtttgttcgttttggtt

SEQ ID NO: 653418 - DNA, 20 bp, Artificial
  CRISPR gRNA sequence
gtttgttcgttttggttttg

SEQ ID NO: 653419 - DNA, 20 bp, Artificial
  CRISPR gRNA sequence
tttgttcgttttggttttgt

SEQ ID NO: 653420 - DNA, 20 bp, Artificial
  CRISPR gRNA sequence
gttcgttttggttttgtttt

SEQ ID NO: 653421 - DNA, 20 bp, Artificial
  CRISPR gRNA sequence
ttcgttttggttttgttttt

SEQ ID NO: 653422 - DNA, 20 bp, Artificial
  CRISPR gRNA sequence
gttttggttttgtttttgtt

SEQ ID NO: 653423 - DNA, 20 bp, Artificial
  CRISPR gRNA sequence
tggttttgtttttgttgaga

SEQ ID NO: 653424 - DNA, 20 bp, Artificial
  CRISPR gRNA sequence
ggttttgtttttgttgagac

SEQ ID NO: 653425 - DNA, 20 bp, Artificial
  CRISPR gRNA sequence
gttttgtttttgttgagaca

SEQ ID NO: 653426 - DNA, 20 bp, Artificial
  CRISPR gRNA sequence
tgtttttgttgagacagagt

SEQ ID NO: 653427 - DNA, 20 bp, Artificial
  CRISPR gRNA sequence
gtttttgttgagacagagtc

SEQ ID NO: 653428 - DNA, 20 bp, Artificial
  CRISPR gRNA sequence
tttttgttgagacagagtct

SEQ ID NO: 653429 - DNA, 20 bp, Artificial
  CRISPR gRNA sequence
ttgttgagacagagtctcac

SEQ ID NO: 653430 - DNA, 20 bp, Artificial
  CRISPR gRNA sequence
tgttgagacagagtctcact

SEQ ID NO: 653431 - DNA, 20 bp, Artificial
  CRISPR gRNA sequence
gttgagacagagtctcactc

SEQ ID NO: 653432 - DNA, 20 bp, Artificial
  CRISPR gRNA sequence
ttgagacagagtctcactct

SEQ ID NO: 653433 - DNA, 20 bp, Artificial
  CRISPR gRNA sequence
agacagagtctcactctgtc

SEQ ID NO: 653434 - DNA, 20 bp, Artificial
  CRISPR gRNA sequence
actctgtcacccaggctgga

SEQ ID NO: 653435 - DNA, 20 bp, Artificial
  CRISPR gRNA sequence
tgtcacccaggctggagtgc

SEQ ID NO: 653436 - DNA, 20 bp, Artificial
  CRISPR gRNA sequence
tcacccaggctggagtgcag

SEQ ID NO: 653437 - DNA, 20 bp, Artificial
  CRISPR gRNA sequence
gagtgcagtggcgccgtctc

SEQ ID NO: 653438 - DNA, 20 bp, Artificial
  CRISPR gRNA sequence
ggctcactacaatctctgct

SEQ ID NO: 653439 - DNA, 20 bp, Artificial
  CRISPR gRNA sequence
actacaatctctgcttcctg

SEQ ID NO: 653440 - DNA, 20 bp, Artificial
  CRISPR gRNA sequence
caatctctgcttcctgggtt

SEQ ID NO: 653441 - DNA, 20 bp, Artificial
  CRISPR gRNA sequence
tgcttcctgggttcatgcga

SEQ ID NO: 653442 - DNA, 20 bp, Artificial
  CRISPR gRNA sequence
cttcctgggttcatgcgatt

SEQ ID NO: 653443 - DNA, 20 bp, Artificial
  CRISPR gRNA sequence
cctgggttcatgcgattctc

SEQ ID NO: 653444 - DNA, 20 bp, Artificial
  CRISPR gRNA sequence
ctgggttcatgcgattctcc

SEQ ID NO: 653445 - DNA, 20 bp, Artificial
  CRISPR gRNA sequence
ggttcatgcgattctcctgc

SEQ ID NO: 653446 - DNA, 20 bp, Artificial
  CRISPR gRNA sequence
atgcgattctcctgcctcag

SEQ ID NO: 653447 - DNA, 20 bp, Artificial
  CRISPR gRNA sequence
tcctgcctcagccttctgag

SEQ ID NO: 653448 - DNA, 20 bp, Artificial
  CRISPR gRNA sequence
ctgcctcagccttctgagta

SEQ ID NO: 653449 - DNA, 20 bp, Artificial
  CRISPR gRNA sequence
cctcagccttctgagtagct

SEQ ID NO: 653450 - DNA, 20 bp, Artificial
  CRISPR gRNA sequence
agccttctgagtagctggga

SEQ ID NO: 653451 - DNA, 20 bp, Artificial
  CRISPR gRNA sequence
ctgagtagctgggatcacag

SEQ ID NO: 653452 - DNA, 20 bp, Artificial
  CRISPR gRNA sequence
tgagtagctgggatcacagg

SEQ ID NO: 653453 - DNA, 20 bp, Artificial
  CRISPR gRNA sequence
agtagctgggatcacaggcg

SEQ ID NO: 653454 - DNA, 20 bp, Artificial
  CRISPR gRNA sequence
tgatcccagctactcagaag

SEQ ID NO: 653455 - DNA, 20 bp, Artificial
  CRISPR gRNA sequence
ctcagaaggctgaggcagga

SEQ ID NO: 653456 - DNA, 20 bp, Artificial
  CRISPR gRNA sequence
agaaggctgaggcaggagaa

SEQ ID NO: 653457 - DNA, 20 bp, Artificial
  CRISPR gRNA sequence
aggcaggagaatcgcatgaa

SEQ ID NO: 653458 - DNA, 20 bp, Artificial
  CRISPR gRNA sequence
tagtgagccgagacggcgcc

SEQ ID NO: 653459 - DNA, 20 bp, Artificial
  CRISPR gRNA sequence
cactccagcctgggtgacag

SEQ ID NO: 653460 - DNA, 20 bp, Artificial
  CRISPR gRNA sequence
cagcctgggtgacagagtga

SEQ ID NO: 653461 - DNA, 20 bp, Artificial
  CRISPR gRNA sequence
ggtgacagagtgagactctg

SEQ ID NO: 653462 - DNA, 20 bp, Artificial
  CRISPR gRNA sequence
tgtctcaacaaaaacaaaac

SEQ ID NO: 653463 - DNA, 20 bp, Artificial
  CRISPR gRNA sequence
tctcaacaaaaacaaaacca

SEQ ID NO: 653464 - DNA, 20 bp, Artificial
  CRISPR gRNA sequence
aacaaaaacaaaaccaaaac

SEQ ID NO: 653465 - DNA, 20 bp, Artificial
  CRISPR gRNA sequence
cccagagaaattctgaacaa

SEQ ID NO: 653466 - DNA, 20 bp, Artificial
  CRISPR gRNA sequence
tgaacaaagtgaattacagt

SEQ ID NO: 653467 - DNA, 20 bp, Artificial
  CRISPR gRNA sequence
aacaaagtgaattacagttt

SEQ ID NO: 653468 - DNA, 20 bp, Artificial
  CRISPR gRNA sequence
cagtttatgcaagggttctt

SEQ ID NO: 653469 - DNA, 20 bp, Artificial
  CRISPR gRNA sequence
atgcaagggttctttcccat

SEQ ID NO: 653470 - DNA, 20 bp, Artificial
  CRISPR gRNA sequence
tgcaagggttctttcccatg

SEQ ID NO: 653471 - DNA, 20 bp, Artificial
  CRISPR gRNA sequence
tttcccatgagtggattgca

SEQ ID NO: 653472 - DNA, 20 bp, Artificial
  CRISPR gRNA sequence
tcccatgagtggattgcatt

SEQ ID NO: 653473 - DNA, 20 bp, Artificial
  CRISPR gRNA sequence
cccatgagtggattgcattg

SEQ ID NO: 653474 - DNA, 20 bp, Artificial
  CRISPR gRNA sequence
ccatgagtggattgcattgt

SEQ ID NO: 653475 - DNA, 20 bp, Artificial
  CRISPR gRNA sequence
cattgtgaatcttaggacta

SEQ ID NO: 653476 - DNA, 20 bp, Artificial
  CRISPR gRNA sequence
tgaatcttaggactatagac

SEQ ID NO: 653477 - DNA, 20 bp, Artificial
  CRISPR gRNA sequence
aggactatagactccacagg

SEQ ID NO: 653478 - DNA, 20 bp, Artificial
  CRISPR gRNA sequence
ggactatagactccacaggc

SEQ ID NO: 653479 - DNA, 20 bp, Artificial
  CRISPR gRNA sequence
tagactccacaggcatgaaa

SEQ ID NO: 653480 - DNA, 20 bp, Artificial
  CRISPR gRNA sequence
cacaggcatgaaataaaacc

SEQ ID NO: 653481 - DNA, 20 bp, Artificial
  CRISPR gRNA sequence
ggtatgaaaacataatcttg

SEQ ID NO: 653482 - DNA, 20 bp, Artificial
  CRISPR gRNA sequence
gtatgaaaacataatcttga

SEQ ID NO: 653483 - DNA, 20 bp, Artificial
  CRISPR gRNA sequence
gatttctctggatgagttag

SEQ ID NO: 653484 - DNA, 20 bp, Artificial
  CRISPR gRNA sequence
atttctctggatgagttaga

SEQ ID NO: 653485 - DNA, 20 bp, Artificial
  CRISPR gRNA sequence
ctctggatgagttagataca

SEQ ID NO: 653486 - DNA, 20 bp, Artificial
  CRISPR gRNA sequence
tctggatgagttagatacac

SEQ ID NO: 653487 - DNA, 20 bp, Artificial
  CRISPR gRNA sequence
tggatgagttagatacacca

SEQ ID NO: 653488 - DNA, 20 bp, Artificial
  CRISPR gRNA sequence
gatgagttagatacaccata

SEQ ID NO: 653489 - DNA, 20 bp, Artificial
  CRISPR gRNA sequence
gatacaccataacctgcaaa

SEQ ID NO: 653490 - DNA, 20 bp, Artificial
  CRISPR gRNA sequence
caaataagaaaggaatgtag

SEQ ID NO: 653491 - DNA, 20 bp, Artificial
  CRISPR gRNA sequence
aaaagagggaaacatttgcc

SEQ ID NO: 653492 - DNA, 20 bp, Artificial
  CRISPR gRNA sequence
gccaagatggtccaattctc

SEQ ID NO: 653493 - DNA, 20 bp, Artificial
  CRISPR gRNA sequence
ccaagatggtccaattctcc

SEQ ID NO: 653494 - DNA, 20 bp, Artificial
  CRISPR gRNA sequence
tcccaggtggtcatgagatc

SEQ ID NO: 653495 - DNA, 20 bp, Artificial
  CRISPR gRNA sequence
ccaggtggtcatgagatctt

SEQ ID NO: 653496 - DNA, 20 bp, Artificial
  CRISPR gRNA sequence
tgttattctaaaatctggga

SEQ ID NO: 653497 - DNA, 20 bp, Artificial
  CRISPR gRNA sequence
gttattctaaaatctgggat

SEQ ID NO: 653498 - DNA, 20 bp, Artificial
  CRISPR gRNA sequence
ttattctaaaatctgggatc

SEQ ID NO: 653499 - DNA, 20 bp, Artificial
  CRISPR gRNA sequence
ttctaaaatctgggatccat

SEQ ID NO: 653500 - DNA, 20 bp, Artificial
  CRISPR gRNA sequence
taaaatctgggatccattca

SEQ ID NO: 653501 - DNA, 20 bp, Artificial
  CRISPR gRNA sequence
aaatctgggatccattcagg

SEQ ID NO: 653502 - DNA, 20 bp, Artificial
  CRISPR gRNA sequence
ggatccattcagggggaggc

SEQ ID NO: 653503 - DNA, 20 bp, Artificial
  CRISPR gRNA sequence
agggggaggcagggtgacag

SEQ ID NO: 653504 - DNA, 20 bp, Artificial
  CRISPR gRNA sequence
aagccttagccactagaggg

SEQ ID NO: 653505 - DNA, 20 bp, Artificial
  CRISPR gRNA sequence
agccactagagggagaaagt

SEQ ID NO: 653506 - DNA, 20 bp, Artificial
  CRISPR gRNA sequence
gccactagagggagaaagtg

SEQ ID NO: 653507 - DNA, 20 bp, Artificial
  CRISPR gRNA sequence
gagggagaaagtgtgcctct

SEQ ID NO: 653508 - DNA, 20 bp, Artificial
  CRISPR gRNA sequence
tggtgactaggcagccagtg

SEQ ID NO: 653509 - DNA, 20 bp, Artificial
  CRISPR gRNA sequence
gtgactaggcagccagtgaa

SEQ ID NO: 653510 - DNA, 20 bp, Artificial
  CRISPR gRNA sequence
ggcagccagtgaaagttaac

SEQ ID NO: 653511 - DNA, 20 bp, Artificial
  CRISPR gRNA sequence
actcttgaaaaggaccagct

SEQ ID NO: 653512 - DNA, 20 bp, Artificial
  CRISPR gRNA sequence
ttgaaaaggaccagcttcaa

SEQ ID NO: 653513 - DNA, 20 bp, Artificial
  CRISPR gRNA sequence
gaaaaggaccagcttcaagg

SEQ ID NO: 653514 - DNA, 20 bp, Artificial
  CRISPR gRNA sequence
aaaaggaccagcttcaagga

SEQ ID NO: 653515 - DNA, 20 bp, Artificial
  CRISPR gRNA sequence
caaggaagctaaattaagct

SEQ ID NO: 653516 - DNA, 20 bp, Artificial
  CRISPR gRNA sequence
aaggaagctaaattaagctt

SEQ ID NO: 653517 - DNA, 20 bp, Artificial
  CRISPR gRNA sequence
aattaagcttcaataaacca

SEQ ID NO: 653518 - DNA, 20 bp, Artificial
  CRISPR gRNA sequence
agcttcaataaaccaggggc

SEQ ID NO: 653519 - DNA, 20 bp, Artificial
  CRISPR gRNA sequence
caataaaccaggggcaagga

SEQ ID NO: 653520 - DNA, 20 bp, Artificial
  CRISPR gRNA sequence
aataaaccaggggcaaggac

SEQ ID NO: 653521 - DNA, 20 bp, Artificial
  CRISPR gRNA sequence
catcaacttggtaactgtga

SEQ ID NO: 653522 - DNA, 20 bp, Artificial
  CRISPR gRNA sequence
ggtaactgtgaggatgtatc

SEQ ID NO: 653523 - DNA, 20 bp, Artificial
  CRISPR gRNA sequence
gtaactgtgaggatgtatct

SEQ ID NO: 653524 - DNA, 20 bp, Artificial
  CRISPR gRNA sequence
tgaggatgtatctttaagat

SEQ ID NO: 653525 - DNA, 20 bp, Artificial
  CRISPR gRNA sequence
taagatttcacaatggatcc

SEQ ID NO: 653526 - DNA, 20 bp, Artificial
  CRISPR gRNA sequence
aagatttcacaatggatcct

SEQ ID NO: 653527 - DNA, 20 bp, Artificial
  CRISPR gRNA sequence
agatttcacaatggatcctc

SEQ ID NO: 653528 - DNA, 20 bp, Artificial
  CRISPR gRNA sequence
cacaatggatcctcttctac

SEQ ID NO: 653529 - DNA, 20 bp, Artificial
  CRISPR gRNA sequence
acaatggatcctcttctacc

SEQ ID NO: 653530 - DNA, 20 bp, Artificial
  CRISPR gRNA sequence
ttctaccaaataattacatt

SEQ ID NO: 653531 - DNA, 20 bp, Artificial
  CRISPR gRNA sequence
ctaccaaataattacattgt

SEQ ID NO: 653532 - DNA, 20 bp, Artificial
  CRISPR gRNA sequence
taccaaataattacattgtg

SEQ ID NO: 653533 - DNA, 20 bp, Artificial
  CRISPR gRNA sequence
ccaaataattacattgtgta

SEQ ID NO: 653534 - DNA, 20 bp, Artificial
  CRISPR gRNA sequence
cattgtgtaaactatcagac

SEQ ID NO: 653535 - DNA, 20 bp, Artificial
  CRISPR gRNA sequence
tgtaaactatcagacatttc

SEQ ID NO: 653536 - DNA, 20 bp, Artificial
  CRISPR gRNA sequence
tcagacatttcatcttaatt

SEQ ID NO: 653537 - DNA, 20 bp, Artificial
  CRISPR gRNA sequence
catcttaatttcgattatct

SEQ ID NO: 653538 - DNA, 20 bp, Artificial
  CRISPR gRNA sequence
atcttaatttcgattatctt

SEQ ID NO: 653539 - DNA, 20 bp, Artificial
  CRISPR gRNA sequence
aatttcgattatctttattt

SEQ ID NO: 653540 - DNA, 20 bp, Artificial
  CRISPR gRNA sequence
atttcgattatctttatttc

SEQ ID NO: 653541 - DNA, 20 bp, Artificial
  CRISPR gRNA sequence
cgattatctttatttcatat

SEQ ID NO: 653542 - DNA, 20 bp, Artificial
  CRISPR gRNA sequence
gattatctttatttcatatt

SEQ ID NO: 653543 - DNA, 20 bp, Artificial
  CRISPR gRNA sequence
tctttatttcatattttcaa

SEQ ID NO: 653544 - DNA, 20 bp, Artificial
  CRISPR gRNA sequence
tatttcatattttcaaggat

SEQ ID NO: 653545 - DNA, 20 bp, Artificial
  CRISPR gRNA sequence
atttcatattttcaaggatc

SEQ ID NO: 653546 - DNA, 20 bp, Artificial
  CRISPR gRNA sequence
tttcatattttcaaggatct

SEQ ID NO: 653547 - DNA, 20 bp, Artificial
  CRISPR gRNA sequence
catattttcaaggatctctg

SEQ ID NO: 653548 - DNA, 20 bp, Artificial
  CRISPR gRNA sequence
atattttcaaggatctctgt

SEQ ID NO: 653549 - DNA, 20 bp, Artificial
  CRISPR gRNA sequence
tcaaggatctctgtaacagt

SEQ ID NO: 653550 - DNA, 20 bp, Artificial
  CRISPR gRNA sequence
caaggatctctgtaacagta

SEQ ID NO: 653551 - DNA, 20 bp, Artificial
  CRISPR gRNA sequence
aaggatctctgtaacagtac

SEQ ID NO: 653552 - DNA, 20 bp, Artificial
  CRISPR gRNA sequence
tgtaacagtacagataccta

SEQ ID NO: 653553 - DNA, 20 bp, Artificial
  CRISPR gRNA sequence
taacagtacagatacctaaa

SEQ ID NO: 653554 - DNA, 20 bp, Artificial
  CRISPR gRNA sequence
aacacttaggttcagttttt

SEQ ID NO: 653555 - DNA, 20 bp, Artificial
  CRISPR gRNA sequence
aggttcagtttttaggaagg

SEQ ID NO: 653556 - DNA, 20 bp, Artificial
  CRISPR gRNA sequence
ggttcagtttttaggaagga

SEQ ID NO: 653557 - DNA, 20 bp, Artificial
  CRISPR gRNA sequence
agtttttaggaaggacttat

SEQ ID NO: 653558 - DNA, 20 bp, Artificial
  CRISPR gRNA sequence
ttaggaaggacttatgacaa

SEQ ID NO: 653559 - DNA, 20 bp, Artificial
  CRISPR gRNA sequence
taggaaggacttatgacaat

SEQ ID NO: 653560 - DNA, 20 bp, Artificial
  CRISPR gRNA sequence
aggaaggacttatgacaatt

SEQ ID NO: 653561 - DNA, 20 bp, Artificial
  CRISPR gRNA sequence
ggaaggacttatgacaattt

SEQ ID NO: 653562 - DNA, 20 bp, Artificial
  CRISPR gRNA sequence
atgacaatttcgagaactta

SEQ ID NO: 653563 - DNA, 20 bp, Artificial
  CRISPR gRNA sequence
tgacaatttcgagaacttat

SEQ ID NO: 653564 - DNA, 20 bp, Artificial
  CRISPR gRNA sequence
cgagaacttatgttatcctt

SEQ ID NO: 653565 - DNA, 20 bp, Artificial
  CRISPR gRNA sequence
gagaacttatgttatccttt

SEQ ID NO: 653566 - DNA, 20 bp, Artificial
  CRISPR gRNA sequence
atgttatcctttacatattg

SEQ ID NO: 653567 - DNA, 20 bp, Artificial
  CRISPR gRNA sequence
tgttatcctttacatattgt

SEQ ID NO: 653568 - DNA, 20 bp, Artificial
  CRISPR gRNA sequence
tcctttacatattgtgcatt

SEQ ID NO: 653569 - DNA, 20 bp, Artificial
  CRISPR gRNA sequence
tacatattgtgcatttacat

SEQ ID NO: 653570 - DNA, 20 bp, Artificial
  CRISPR gRNA sequence
acatattgtgcatttacata

SEQ ID NO: 653571 - DNA, 20 bp, Artificial
  CRISPR gRNA sequence
catattgtgcatttacatat

SEQ ID NO: 653572 - DNA, 20 bp, Artificial
  CRISPR gRNA sequence
tgcatttacatattataaac

SEQ ID NO: 653573 - DNA, 20 bp, Artificial
  CRISPR gRNA sequence
acatattataaacgacatac

SEQ ID NO: 653574 - DNA, 20 bp, Artificial
  CRISPR gRNA sequence
catattataaacgacataca

SEQ ID NO: 653575 - DNA, 20 bp, Artificial
  CRISPR gRNA sequence
taaacgacatacagattttt

SEQ ID NO: 653576 - DNA, 20 bp, Artificial
  CRISPR gRNA sequence
tttgaggtaatttaagacta

SEQ ID NO: 653577 - DNA, 20 bp, Artificial
  CRISPR gRNA sequence
ttgaggtaatttaagactaa

SEQ ID NO: 653578 - DNA, 20 bp, Artificial
  CRISPR gRNA sequence
tgaggtaatttaagactaaa

SEQ ID NO: 653579 - DNA, 20 bp, Artificial
  CRISPR gRNA sequence
gaggtaatttaagactaaaa

SEQ ID NO: 653580 - DNA, 20 bp, Artificial
  CRISPR gRNA sequence
aggtaatttaagactaaaat

SEQ ID NO: 653581 - DNA, 20 bp, Artificial
  CRISPR gRNA sequence
aagactaaaatatttgctct

SEQ ID NO: 653582 - DNA, 20 bp, Artificial
  CRISPR gRNA sequence
agactaaaatatttgctctc

SEQ ID NO: 653583 - DNA, 20 bp, Artificial
  CRISPR gRNA sequence
aaatatttgctctctgttgg

SEQ ID NO: 653584 - DNA, 20 bp, Artificial
  CRISPR gRNA sequence
gctctctgttgggatgatta

SEQ ID NO: 653585 - DNA, 20 bp, Artificial
  CRISPR gRNA sequence
ctctctgttgggatgattag

SEQ ID NO: 653586 - DNA, 20 bp, Artificial
  CRISPR gRNA sequence
tctgttgggatgattagagt

SEQ ID NO: 653587 - DNA, 20 bp, Artificial
  CRISPR gRNA sequence
tgttgggatgattagagtga

SEQ ID NO: 653588 - DNA, 20 bp, Artificial
  CRISPR gRNA sequence
ttgggatgattagagtgact

SEQ ID NO: 653589 - DNA, 20 bp, Artificial
  CRISPR gRNA sequence
ggatgattagagtgacttac

SEQ ID NO: 653590 - DNA, 20 bp, Artificial
  CRISPR gRNA sequence
gagtgacttactggttctct

SEQ ID NO: 653591 - DNA, 20 bp, Artificial
  CRISPR gRNA sequence
actggttctctactcagact

SEQ ID NO: 653592 - DNA, 20 bp, Artificial
  CRISPR gRNA sequence
ctggttctctactcagactt

SEQ ID NO: 653593 - DNA, 20 bp, Artificial
  CRISPR gRNA sequence
gttctctactcagactttcc

SEQ ID NO: 653594 - DNA, 20 bp, Artificial
  CRISPR gRNA sequence
tctactcagactttcccaaa

SEQ ID NO: 653595 - DNA, 20 bp, Artificial
  CRISPR gRNA sequence
tactcagactttcccaaata

SEQ ID NO: 653596 - DNA, 20 bp, Artificial
  CRISPR gRNA sequence
ctcagactttcccaaatacg

SEQ ID NO: 653597 - DNA, 20 bp, Artificial
  CRISPR gRNA sequence
agactttcccaaatacgact

SEQ ID NO: 653598 - DNA, 20 bp, Artificial
  CRISPR gRNA sequence
tcccaaatacgactttagga

SEQ ID NO: 653599 - DNA, 20 bp, Artificial
  CRISPR gRNA sequence
cccaaatacgactttaggaa

SEQ ID NO: 653600 - DNA, 20 bp, Artificial
  CRISPR gRNA sequence
ccaaatacgactttaggaaa

SEQ ID NO: 653601 - DNA, 20 bp, Artificial
  CRISPR gRNA sequence
taggaaaactaattttagca

SEQ ID NO: 653602 - DNA, 20 bp, Artificial
  CRISPR gRNA sequence
aggaaaactaattttagcaa

SEQ ID NO: 653603 - DNA, 20 bp, Artificial
  CRISPR gRNA sequence
ggaaaactaattttagcaac

SEQ ID NO: 653604 - DNA, 20 bp, Artificial
  CRISPR gRNA sequence
attttagcaactaagtgttt

SEQ ID NO: 653605 - DNA, 20 bp, Artificial
  CRISPR gRNA sequence
tagcaactaagtgtttaaaa

SEQ ID NO: 653606 - DNA, 20 bp, Artificial
  CRISPR gRNA sequence
agcaactaagtgtttaaaaa

SEQ ID NO: 653607 - DNA, 20 bp, Artificial
  CRISPR gRNA sequence
gcaactaagtgtttaaaaat

SEQ ID NO: 653608 - DNA, 20 bp, Artificial
  CRISPR gRNA sequence
agtgtttaaaaatctgcctt

SEQ ID NO: 653609 - DNA, 20 bp, Artificial
  CRISPR gRNA sequence
aaaaatctgccttatcaata

SEQ ID NO: 653610 - DNA, 20 bp, Artificial
  CRISPR gRNA sequence
aaaatctgccttatcaatat

SEQ ID NO: 653611 - DNA, 20 bp, Artificial
  CRISPR gRNA sequence
ccttatcaatatataactca

SEQ ID NO: 653612 - DNA, 20 bp, Artificial
  CRISPR gRNA sequence
atcaatatataactcacagg

SEQ ID NO: 653613 - DNA, 20 bp, Artificial
  CRISPR gRNA sequence
tcaatatataactcacagga

SEQ ID NO: 653614 - DNA, 20 bp, Artificial
  CRISPR gRNA sequence
acaggaactgcaatttttct

SEQ ID NO: 653615 - DNA, 20 bp, Artificial
  CRISPR gRNA sequence
caatttttcttaaaatcatc

SEQ ID NO: 653616 - DNA, 20 bp, Artificial
  CRISPR gRNA sequence
ttcttaaaatcatcataatg

SEQ ID NO: 653617 - DNA, 20 bp, Artificial
  CRISPR gRNA sequence
tcttaaaatcatcataatgt

SEQ ID NO: 653618 - DNA, 20 bp, Artificial
  CRISPR gRNA sequence
cttaaaatcatcataatgtt

SEQ ID NO: 653619 - DNA, 20 bp, Artificial
  CRISPR gRNA sequence
ttaaaatcatcataatgtta

SEQ ID NO: 653620 - DNA, 20 bp, Artificial
  CRISPR gRNA sequence
aaaatcatcataatgttatt

SEQ ID NO: 653621 - DNA, 20 bp, Artificial
  CRISPR gRNA sequence
aaatcatcataatgttattg

SEQ ID NO: 653622 - DNA, 20 bp, Artificial
  CRISPR gRNA sequence
ttgcaagcctgagcccaaat

SEQ ID NO: 653623 - DNA, 20 bp, Artificial
  CRISPR gRNA sequence
caagcctgagcccaaataat

SEQ ID NO: 653624 - DNA, 20 bp, Artificial
  CRISPR gRNA sequence
agcccaaataatttctctcc

SEQ ID NO: 653625 - DNA, 20 bp, Artificial
  CRISPR gRNA sequence
ctctccaacgaaaatttgtt

SEQ ID NO: 653626 - DNA, 20 bp, Artificial
  CRISPR gRNA sequence
tctccaacgaaaatttgtta

SEQ ID NO: 653627 - DNA, 20 bp, Artificial
  CRISPR gRNA sequence
tccaacgaaaatttgttaat

SEQ ID NO: 653628 - DNA, 20 bp, Artificial
  CRISPR gRNA sequence
caacgaaaatttgttaatct

SEQ ID NO: 653629 - DNA, 20 bp, Artificial
  CRISPR gRNA sequence
gttaatcttgtttgctgtac

SEQ ID NO: 653630 - DNA, 20 bp, Artificial
  CRISPR gRNA sequence
ttaatcttgtttgctgtacc

SEQ ID NO: 653631 - DNA, 20 bp, Artificial
  CRISPR gRNA sequence
atcttgtttgctgtaccaca

SEQ ID NO: 653632 - DNA, 20 bp, Artificial
  CRISPR gRNA sequence
gtttgctgtaccacactatc

SEQ ID NO: 653633 - DNA, 20 bp, Artificial
  CRISPR gRNA sequence
tttgctgtaccacactatct

SEQ ID NO: 653634 - DNA, 20 bp, Artificial
  CRISPR gRNA sequence
gctgtaccacactatctacc

SEQ ID NO: 653635 - DNA, 20 bp, Artificial
  CRISPR gRNA sequence
ctgtaccacactatctacca

SEQ ID NO: 653636 - DNA, 20 bp, Artificial
  CRISPR gRNA sequence
taccacactatctaccattt

SEQ ID NO: 653637 - DNA, 20 bp, Artificial
  CRISPR gRNA sequence
tctaccattttctatagtta

SEQ ID NO: 653638 - DNA, 20 bp, Artificial
  CRISPR gRNA sequence
ccattttctatagttaaaca

SEQ ID NO: 653639 - DNA, 20 bp, Artificial
  CRISPR gRNA sequence
tctatagttaaacaaaaaga

SEQ ID NO: 653640 - DNA, 20 bp, Artificial
  CRISPR gRNA sequence
ctatagttaaacaaaaagag

SEQ ID NO: 653641 - DNA, 20 bp, Artificial
  CRISPR gRNA sequence
tatagttaaacaaaaagaga

SEQ ID NO: 653642 - DNA, 20 bp, Artificial
  CRISPR gRNA sequence
tagttaaacaaaaagagact

SEQ ID NO: 653643 - DNA, 20 bp, Artificial
  CRISPR gRNA sequence
aacaaaaagagactatcgtt

SEQ ID NO: 653644 - DNA, 20 bp, Artificial
  CRISPR gRNA sequence
tcgttacaattgtttaataa

SEQ ID NO: 653645 - DNA, 20 bp, Artificial
  CRISPR gRNA sequence
caattgtttaataatacatt

SEQ ID NO: 653646 - DNA, 20 bp, Artificial
  CRISPR gRNA sequence
tttaataatacattgtatag

SEQ ID NO: 653647 - DNA, 20 bp, Artificial
  CRISPR gRNA sequence
aataatacattgtataggaa

SEQ ID NO: 653648 - DNA, 20 bp, Artificial
  CRISPR gRNA sequence
ataatacattgtataggaaa

SEQ ID NO: 653649 - DNA, 20 bp, Artificial
  CRISPR gRNA sequence
tataggaaaaaaaactttca

SEQ ID NO: 653650 - DNA, 20 bp, Artificial
  CRISPR gRNA sequence
tcaagaagtaattcattata

SEQ ID NO: 653651 - DNA, 20 bp, Artificial
  CRISPR gRNA sequence
caagaagtaattcattataa

SEQ ID NO: 653652 - DNA, 20 bp, Artificial
  CRISPR gRNA sequence
aagaagtaattcattataaa

SEQ ID NO: 653653 - DNA, 20 bp, Artificial
  CRISPR gRNA sequence
attataaaagctacagtatc

SEQ ID NO: 653654 - DNA, 20 bp, Artificial
  CRISPR gRNA sequence
taaaagctacagtatcacac

SEQ ID NO: 653655 - DNA, 20 bp, Artificial
  CRISPR gRNA sequence
cagtatcacacaagttatat

SEQ ID NO: 653656 - DNA, 20 bp, Artificial
  CRISPR gRNA sequence
tatggtatccattacttcgt

SEQ ID NO: 653657 - DNA, 20 bp, Artificial
  CRISPR gRNA sequence
cttcgtttgtgtcgatgtga

SEQ ID NO: 653658 - DNA, 20 bp, Artificial
  CRISPR gRNA sequence
cgtttgtgtcgatgtgaatt

SEQ ID NO: 653659 - DNA, 20 bp, Artificial
  CRISPR gRNA sequence
gtttgtgtcgatgtgaatta

SEQ ID NO: 653660 - DNA, 20 bp, Artificial
  CRISPR gRNA sequence
gtgtcgatgtgaattaattc

SEQ ID NO: 653661 - DNA, 20 bp, Artificial
  CRISPR gRNA sequence
tgtcgatgtgaattaattcc

SEQ ID NO: 653662 - DNA, 20 bp, Artificial
  CRISPR gRNA sequence
attccttccctatatcaaaa

SEQ ID NO: 653663 - DNA, 20 bp, Artificial
  CRISPR gRNA sequence
cttccctatatcaaaatgta

SEQ ID NO: 653664 - DNA, 20 bp, Artificial
  CRISPR gRNA sequence
ccctatatcaaaatgtaaag

SEQ ID NO: 653665 - DNA, 20 bp, Artificial
  CRISPR gRNA sequence
cctatatcaaaatgtaaaga

SEQ ID NO: 653666 - DNA, 20 bp, Artificial
  CRISPR gRNA sequence
tatcaaaatgtaaagaaaag

SEQ ID NO: 653667 - DNA, 20 bp, Artificial
  CRISPR gRNA sequence
tccaaaattacctacagagt

SEQ ID NO: 653668 - DNA, 20 bp, Artificial
  CRISPR gRNA sequence
cctacagagtggtgcttaag

SEQ ID NO: 653669 - DNA, 20 bp, Artificial
  CRISPR gRNA sequence
cagagtggtgcttaaggtac

SEQ ID NO: 653670 - DNA, 20 bp, Artificial
  CRISPR gRNA sequence
aaggtactgttgatgactta

SEQ ID NO: 653671 - DNA, 20 bp, Artificial
  CRISPR gRNA sequence
aggtactgttgatgacttaa

SEQ ID NO: 653672 - DNA, 20 bp, Artificial
  CRISPR gRNA sequence
ttgatgacttaatttccaat

SEQ ID NO: 653673 - DNA, 20 bp, Artificial
  CRISPR gRNA sequence
atgacttaatttccaatata

SEQ ID NO: 653674 - DNA, 20 bp, Artificial
  CRISPR gRNA sequence
aatttccaatatatcttttt

SEQ ID NO: 653675 - DNA, 20 bp, Artificial
  CRISPR gRNA sequence
atttccaatatatctttttt

SEQ ID NO: 653676 - DNA, 20 bp, Artificial
  CRISPR gRNA sequence
ccaatatatctttttttctc

SEQ ID NO: 653677 - DNA, 20 bp, Artificial
  CRISPR gRNA sequence
caatatatctttttttctca

SEQ ID NO: 653678 - DNA, 20 bp, Artificial
  CRISPR gRNA sequence
tttttctcagcagaaaaaaa

SEQ ID NO: 653679 - DNA, 20 bp, Artificial
  CRISPR gRNA sequence
ttttctcagcagaaaaaaaa

SEQ ID NO: 653680 - DNA, 20 bp, Artificial
  CRISPR gRNA sequence
tttctcagcagaaaaaaaaa

SEQ ID NO: 653681 - DNA, 20 bp, Artificial
  CRISPR gRNA sequence
ttctcagcagaaaaaaaaaa

SEQ ID NO: 653682 - DNA, 20 bp, Artificial
  CRISPR gRNA sequence
tctcagcagaaaaaaaaaac

SEQ ID NO: 653683 - DNA, 20 bp, Artificial
  CRISPR gRNA sequence
ctcagcagaaaaaaaaaacc

SEQ ID NO: 653684 - DNA, 20 bp, Artificial
  CRISPR gRNA sequence
tcagcagaaaaaaaaaacct

SEQ ID NO: 653685 - DNA, 20 bp, Artificial
  CRISPR gRNA sequence
agcagaaaaaaaaaacctca

SEQ ID NO: 653686 - DNA, 20 bp, Artificial
  CRISPR gRNA sequence
aacaactatttctgggattc

SEQ ID NO: 653687 - DNA, 20 bp, Artificial
  CRISPR gRNA sequence
tttctgggattcttcaaagg

SEQ ID NO: 653688 - DNA, 20 bp, Artificial
  CRISPR gRNA sequence
ctgggattcttcaaaggagt

SEQ ID NO: 653689 - DNA, 20 bp, Artificial
  CRISPR gRNA sequence
tgggattcttcaaaggagta

SEQ ID NO: 653690 - DNA, 20 bp, Artificial
  CRISPR gRNA sequence
ggattcttcaaaggagtaag

SEQ ID NO: 653691 - DNA, 20 bp, Artificial
  CRISPR gRNA sequence
ttcaaaggagtaagagtacg

SEQ ID NO: 653692 - DNA, 20 bp, Artificial
  CRISPR gRNA sequence
caaaggagtaagagtacggt

SEQ ID NO: 653693 - DNA, 20 bp, Artificial
  CRISPR gRNA sequence
aaaggagtaagagtacggtg

SEQ ID NO: 653694 - DNA, 20 bp, Artificial
  CRISPR gRNA sequence
ttccgactcttctagcattg

SEQ ID NO: 653695 - DNA, 20 bp, Artificial
  CRISPR gRNA sequence
cgactcttctagcattgatt

SEQ ID NO: 653696 - DNA, 20 bp, Artificial
  CRISPR gRNA sequence
ttctagcattgattttcttc

SEQ ID NO: 653697 - DNA, 20 bp, Artificial
  CRISPR gRNA sequence
ctagcattgattttcttcac

SEQ ID NO: 653698 - DNA, 20 bp, Artificial
  CRISPR gRNA sequence
tagcattgattttcttcaca

SEQ ID NO: 653699 - DNA, 20 bp, Artificial
  CRISPR gRNA sequence
gcattgattttcttcacaat

SEQ ID NO: 653700 - DNA, 20 bp, Artificial
  CRISPR gRNA sequence
attttcttcacaatctgtga

SEQ ID NO: 653701 - DNA, 20 bp, Artificial
  CRISPR gRNA sequence
tcttcacaatctgtgatatg

SEQ ID NO: 653702 - DNA, 20 bp, Artificial
  CRISPR gRNA sequence
cttcacaatctgtgatatgg

SEQ ID NO: 653703 - DNA, 20 bp, Artificial
  CRISPR gRNA sequence
ttcacaatctgtgatatggt

SEQ ID NO: 653704 - DNA, 20 bp, Artificial
  CRISPR gRNA sequence
cacaatctgtgatatggttt

SEQ ID NO: 653705 - DNA, 20 bp, Artificial
  CRISPR gRNA sequence
acaatctgtgatatggtttc

SEQ ID NO: 653706 - DNA, 20 bp, Artificial
  CRISPR gRNA sequence
tgatatggtttctcaggaac

SEQ ID NO: 653707 - DNA, 20 bp, Artificial
  CRISPR gRNA sequence
ctcaggaacaccgtttggca

SEQ ID NO: 653708 - DNA, 20 bp, Artificial
  CRISPR gRNA sequence
tcaggaacaccgtttggcag

SEQ ID NO: 653709 - DNA, 20 bp, Artificial
  CRISPR gRNA sequence
aggaacaccgtttggcagtc

SEQ ID NO: 653710 - DNA, 20 bp, Artificial
  CRISPR gRNA sequence
ggcagtcctgataatttcat

SEQ ID NO: 653711 - DNA, 20 bp, Artificial
  CRISPR gRNA sequence
gcagtcctgataatttcatg

SEQ ID NO: 653712 - DNA, 20 bp, Artificial
  CRISPR gRNA sequence
ataatttcatgtgttttcaa

SEQ ID NO: 653713 - DNA, 20 bp, Artificial
  CRISPR gRNA sequence
catgtgttttcaaatttcag

SEQ ID NO: 653714 - DNA, 20 bp, Artificial
  CRISPR gRNA sequence
atgtgttttcaaatttcagc

SEQ ID NO: 653715 - DNA, 20 bp, Artificial
  CRISPR gRNA sequence
tcaaatttcagccatccaga

SEQ ID NO: 653716 - DNA, 20 bp, Artificial
  CRISPR gRNA sequence
caaatttcagccatccagac

SEQ ID NO: 653717 - DNA, 20 bp, Artificial
  CRISPR gRNA sequence
aaatttcagccatccagact

SEQ ID NO: 653718 - DNA, 20 bp, Artificial
  CRISPR gRNA sequence
cagccatccagactacacag

SEQ ID NO: 653719 - DNA, 20 bp, Artificial
  CRISPR gRNA sequence
agccatccagactacacagt

SEQ ID NO: 653720 - DNA, 20 bp, Artificial
  CRISPR gRNA sequence
cacagttcactattttcagc

SEQ ID NO: 653721 - DNA, 20 bp, Artificial
  CRISPR gRNA sequence
actattttcagctcctttca

SEQ ID NO: 653722 - DNA, 20 bp, Artificial
  CRISPR gRNA sequence
ttttcagctcctttcatttt

SEQ ID NO: 653723 - DNA, 20 bp, Artificial
  CRISPR gRNA sequence
tcagctcctttcattttcct

SEQ ID NO: 653724 - DNA, 20 bp, Artificial
  CRISPR gRNA sequence
cagctcctttcattttcctt

SEQ ID NO: 653725 - DNA, 20 bp, Artificial
  CRISPR gRNA sequence
agctcctttcattttccttt

SEQ ID NO: 653726 - DNA, 20 bp, Artificial
  CRISPR gRNA sequence
ctttcattttccttttccct

SEQ ID NO: 653727 - DNA, 20 bp, Artificial
  CRISPR gRNA sequence
tcattttccttttcccttta

SEQ ID NO: 653728 - DNA, 20 bp, Artificial
  CRISPR gRNA sequence
cattttccttttccctttaa

SEQ ID NO: 653729 - DNA, 20 bp, Artificial
  CRISPR gRNA sequence
attttccttttccctttaat

SEQ ID NO: 653730 - DNA, 20 bp, Artificial
  CRISPR gRNA sequence
tccttttccctttaattata

SEQ ID NO: 653731 - DNA, 20 bp, Artificial
  CRISPR gRNA sequence
ccttttccctttaattatag

SEQ ID NO: 653732 - DNA, 20 bp, Artificial
  CRISPR gRNA sequence
cttttccctttaattataga

SEQ ID NO: 653733 - DNA, 20 bp, Artificial
  CRISPR gRNA sequence
ttccctttaattatagaagt

SEQ ID NO: 653734 - DNA, 20 bp, Artificial
  CRISPR gRNA sequence
tccctttaattatagaagtc

SEQ ID NO: 653735 - DNA, 20 bp, Artificial
  CRISPR gRNA sequence
ccctttaattatagaagtct

SEQ ID NO: 653736 - DNA, 20 bp, Artificial
  CRISPR gRNA sequence
cctttaattatagaagtctc

SEQ ID NO: 653737 - DNA, 20 bp, Artificial
  CRISPR gRNA sequence
taattatagaagtctctatt

SEQ ID NO: 653738 - DNA, 20 bp, Artificial
  CRISPR gRNA sequence
aattatagaagtctctattc

SEQ ID NO: 653739 - DNA, 20 bp, Artificial
  CRISPR gRNA sequence
attatagaagtctctattcc

SEQ ID NO: 653740 - DNA, 20 bp, Artificial
  CRISPR gRNA sequence
tagaagtctctattccctct

SEQ ID NO: 653741 - DNA, 20 bp, Artificial
  CRISPR gRNA sequence
tattccctcttttcgcaaat

SEQ ID NO: 653742 - DNA, 20 bp, Artificial
  CRISPR gRNA sequence
ttccctcttttcgcaaatgt

SEQ ID NO: 653743 - DNA, 20 bp, Artificial
  CRISPR gRNA sequence
cctcttttcgcaaatgtggt

SEQ ID NO: 653744 - DNA, 20 bp, Artificial
  CRISPR gRNA sequence
ttttcgcaaatgtggtcagg

SEQ ID NO: 653745 - DNA, 20 bp, Artificial
  CRISPR gRNA sequence
ttcgcaaatgtggtcaggaa

SEQ ID NO: 653746 - DNA, 20 bp, Artificial
  CRISPR gRNA sequence
tcgcaaatgtggtcaggaaa

SEQ ID NO: 653747 - DNA, 20 bp, Artificial
  CRISPR gRNA sequence
cgcaaatgtggtcaggaaag

SEQ ID NO: 653748 - DNA, 20 bp, Artificial
  CRISPR gRNA sequence
gcaaatgtggtcaggaaaga

SEQ ID NO: 653749 - DNA, 20 bp, Artificial
  CRISPR gRNA sequence
aatgctactatttgtagaaa

SEQ ID NO: 653750 - DNA, 20 bp, Artificial
  CRISPR gRNA sequence
ctatttgtagaaagaatatg

SEQ ID NO: 653751 - DNA, 20 bp, Artificial
  CRISPR gRNA sequence
tttgtagaaagaatatgcat

SEQ ID NO: 653752 - DNA, 20 bp, Artificial
  CRISPR gRNA sequence
gtagaaagaatatgcatttg

SEQ ID NO: 653753 - DNA, 20 bp, Artificial
  CRISPR gRNA sequence
tagaaagaatatgcatttgt

SEQ ID NO: 653754 - DNA, 20 bp, Artificial
  CRISPR gRNA sequence
gtttttctcttgacggttca

SEQ ID NO: 653755 - DNA, 20 bp, Artificial
  CRISPR gRNA sequence
tttttctcttgacggttcac

SEQ ID NO: 653756 - DNA, 20 bp, Artificial
  CRISPR gRNA sequence
ttctcttgacggttcactta

SEQ ID NO: 653757 - DNA, 20 bp, Artificial
  CRISPR gRNA sequence
tctcttgacggttcacttaa

SEQ ID NO: 653758 - DNA, 20 bp, Artificial
  CRISPR gRNA sequence
ctcttgacggttcacttaag

SEQ ID NO: 653759 - DNA, 20 bp, Artificial
  CRISPR gRNA sequence
tcttgacggttcacttaagt

SEQ ID NO: 653760 - DNA, 20 bp, Artificial
  CRISPR gRNA sequence
ttgacggttcacttaagttc

SEQ ID NO: 653761 - DNA, 20 bp, Artificial
  CRISPR gRNA sequence
gacggttcacttaagttctt

SEQ ID NO: 653762 - DNA, 20 bp, Artificial
  CRISPR gRNA sequence
acggttcacttaagttcttt

SEQ ID NO: 653763 - DNA, 20 bp, Artificial
  CRISPR gRNA sequence
acttaagttctttccaaata

SEQ ID NO: 653764 - DNA, 20 bp, Artificial
  CRISPR gRNA sequence
aagttctttccaaataaaca

SEQ ID NO: 653765 - DNA, 20 bp, Artificial
  CRISPR gRNA sequence
agttctttccaaataaacaa

SEQ ID NO: 653766 - DNA, 20 bp, Artificial
  CRISPR gRNA sequence
tttccaaataaacaagctgt

SEQ ID NO: 653767 - DNA, 20 bp, Artificial
  CRISPR gRNA sequence
tccaaataaacaagctgtgg

SEQ ID NO: 653768 - DNA, 20 bp, Artificial
  CRISPR gRNA sequence
ccaaataaacaagctgtggt

SEQ ID NO: 653769 - DNA, 20 bp, Artificial
  CRISPR gRNA sequence
caaataaacaagctgtggtt

SEQ ID NO: 653770 - DNA, 20 bp, Artificial
  CRISPR gRNA sequence
tggttgatagtgataggtaa

SEQ ID NO: 653771 - DNA, 20 bp, Artificial
  CRISPR gRNA sequence
atagtgataggtaacacttc

SEQ ID NO: 653772 - DNA, 20 bp, Artificial
  CRISPR gRNA sequence
caagggtagcaactttttgt

SEQ ID NO: 653773 - DNA, 20 bp, Artificial
  CRISPR gRNA sequence
aagggtagcaactttttgta

SEQ ID NO: 653774 - DNA, 20 bp, Artificial
  CRISPR gRNA sequence
tttgtactcatccgttcctt

SEQ ID NO: 653775 - DNA, 20 bp, Artificial
  CRISPR gRNA sequence
ttgtactcatccgttccttt

SEQ ID NO: 653776 - DNA, 20 bp, Artificial
  CRISPR gRNA sequence
tgtactcatccgttcctttg

SEQ ID NO: 653777 - DNA, 20 bp, Artificial
  CRISPR gRNA sequence
gtactcatccgttcctttga

SEQ ID NO: 653778 - DNA, 20 bp, Artificial
  CRISPR gRNA sequence
tactcatccgttcctttgac

SEQ ID NO: 653779 - DNA, 20 bp, Artificial
  CRISPR gRNA sequence
atccgttcctttgactttgg

SEQ ID NO: 653780 - DNA, 20 bp, Artificial
  CRISPR gRNA sequence
ctttgactttggaagacgtg

SEQ ID NO: 653781 - DNA, 20 bp, Artificial
  CRISPR gRNA sequence
tgactttggaagacgtggca

SEQ ID NO: 653782 - DNA, 20 bp, Artificial
  CRISPR gRNA sequence
gactttggaagacgtggcac

SEQ ID NO: 653783 - DNA, 20 bp, Artificial
  CRISPR gRNA sequence
actttggaagacgtggcaca

SEQ ID NO: 653784 - DNA, 20 bp, Artificial
  CRISPR gRNA sequence
tggaagacgtggcacatgcc

SEQ ID NO: 653785 - DNA, 20 bp, Artificial
  CRISPR gRNA sequence
ggaagacgtggcacatgccc

SEQ ID NO: 653786 - DNA, 20 bp, Artificial
  CRISPR gRNA sequence
gaagacgtggcacatgcccc

SEQ ID NO: 653787 - DNA, 20 bp, Artificial
  CRISPR gRNA sequence
tagtttttaaacttgcactg

SEQ ID NO: 653788 - DNA, 20 bp, Artificial
  CRISPR gRNA sequence
agtttttaaacttgcactgt

SEQ ID NO: 653789 - DNA, 20 bp, Artificial
  CRISPR gRNA sequence
gtttttaaacttgcactgtt

SEQ ID NO: 653790 - DNA, 20 bp, Artificial
  CRISPR gRNA sequence
ttaaacttgcactgttaaag

SEQ ID NO: 653791 - DNA, 20 bp, Artificial
  CRISPR gRNA sequence
taaacttgcactgttaaagc

SEQ ID NO: 653792 - DNA, 20 bp, Artificial
  CRISPR gRNA sequence
aaacttgcactgttaaagca

SEQ ID NO: 653793 - DNA, 20 bp, Artificial
  CRISPR gRNA sequence
aacttgcactgttaaagcac

SEQ ID NO: 653794 - DNA, 20 bp, Artificial
  CRISPR gRNA sequence
gcactgttaaagcactttca

SEQ ID NO: 653795 - DNA, 20 bp, Artificial
  CRISPR gRNA sequence
cactgttaaagcactttcaa

SEQ ID NO: 653796 - DNA, 20 bp, Artificial
  CRISPR gRNA sequence
ttaaagcactttcaaaatag

SEQ ID NO: 653797 - DNA, 20 bp, Artificial
  CRISPR gRNA sequence
aagcactttcaaaatagtaa

SEQ ID NO: 653798 - DNA, 20 bp, Artificial
  CRISPR gRNA sequence
tcaaaatagtaatagttgag

SEQ ID NO: 653799 - DNA, 20 bp, Artificial
  CRISPR gRNA sequence
caaaatagtaatagttgagc

SEQ ID NO: 653800 - DNA, 20 bp, Artificial
  CRISPR gRNA sequence
aaaatagtaatagttgagct

SEQ ID NO: 653801 - DNA, 20 bp, Artificial
  CRISPR gRNA sequence
agcttcatctcagacatgaa

SEQ ID NO: 653802 - DNA, 20 bp, Artificial
  CRISPR gRNA sequence
catctcagacatgaatgtct

SEQ ID NO: 653803 - DNA, 20 bp, Artificial
  CRISPR gRNA sequence
atctcagacatgaatgtctt

SEQ ID NO: 653804 - DNA, 20 bp, Artificial
  CRISPR gRNA sequence
agacatgaatgtctttctca

SEQ ID NO: 653805 - DNA, 20 bp, Artificial
  CRISPR gRNA sequence
tctcagtctattccccagga

SEQ ID NO: 653806 - DNA, 20 bp, Artificial
  CRISPR gRNA sequence
ctcagtctattccccaggac

SEQ ID NO: 653807 - DNA, 20 bp, Artificial
  CRISPR gRNA sequence
tcagtctattccccaggacc

SEQ ID NO: 653808 - DNA, 20 bp, Artificial
  CRISPR gRNA sequence
agtctattccccaggacccc

SEQ ID NO: 653809 - DNA, 20 bp, Artificial
  CRISPR gRNA sequence
ttccccaggacccctcttat

SEQ ID NO: 653810 - DNA, 20 bp, Artificial
  CRISPR gRNA sequence
cccaggacccctcttatccc

SEQ ID NO: 653811 - DNA, 20 bp, Artificial
  CRISPR gRNA sequence
ttatcccgcttcaggtcccg

SEQ ID NO: 653812 - DNA, 20 bp, Artificial
  CRISPR gRNA sequence
atcccgcttcaggtcccggt

SEQ ID NO: 653813 - DNA, 20 bp, Artificial
  CRISPR gRNA sequence
tcccgcttcaggtcccggtc

SEQ ID NO: 653814 - DNA, 20 bp, Artificial
  CRISPR gRNA sequence
caggtcccggtcaatgcggt

SEQ ID NO: 653815 - DNA, 20 bp, Artificial
  CRISPR gRNA sequence
aggtcccggtcaatgcggtg

SEQ ID NO: 653816 - DNA, 20 bp, Artificial
  CRISPR gRNA sequence
tccgaaatggggccgcagag

SEQ ID NO: 653817 - DNA, 20 bp, Artificial
  CRISPR gRNA sequence
ccgaaatggggccgcagagt

SEQ ID NO: 653818 - DNA, 20 bp, Artificial
  CRISPR gRNA sequence
cgaaatggggccgcagagtt

SEQ ID NO: 653819 - DNA, 20 bp, Artificial
  CRISPR gRNA sequence
ccggcggagaccagtaggtg

SEQ ID NO: 653820 - DNA, 20 bp, Artificial
  CRISPR gRNA sequence
cacgcacactccccgactcg

SEQ ID NO: 653821 - DNA, 20 bp, Artificial
  CRISPR gRNA sequence
cccgactcggccgggacgcg

SEQ ID NO: 653822 - DNA, 20 bp, Artificial
  CRISPR gRNA sequence
ggccgggacgcggctcccgg

SEQ ID NO: 653823 - DNA, 20 bp, Artificial
  CRISPR gRNA sequence
ccggactccgcgcagggcgc

SEQ ID NO: 653824 - DNA, 20 bp, Artificial
  CRISPR gRNA sequence
cgcgcagggcgccaagatcg

SEQ ID NO: 653825 - DNA, 20 bp, Artificial
  CRISPR gRNA sequence
ccttcccccggcctccccac

SEQ ID NO: 653826 - DNA, 20 bp, Artificial
  CRISPR gRNA sequence
cccccggcctccccaccaat

SEQ ID NO: 653827 - DNA, 20 bp, Artificial
  CRISPR gRNA sequence
ccccggcctccccaccaatc

SEQ ID NO: 653828 - DNA, 20 bp, Artificial
  CRISPR gRNA sequence
cccaccaatcccagtttgaa

SEQ ID NO: 653829 - DNA, 20 bp, Artificial
  CRISPR gRNA sequence
gaaagaaaacttcacgcggc

SEQ ID NO: 653830 - DNA, 20 bp, Artificial
  CRISPR gRNA sequence
aaagaaaacttcacgcggcc

SEQ ID NO: 653831 - DNA, 20 bp, Artificial
  CRISPR gRNA sequence
cacgcggccgaaatgaacgt

SEQ ID NO: 653832 - DNA, 20 bp, Artificial
  CRISPR gRNA sequence
acgcggccgaaatgaacgtc

SEQ ID NO: 653833 - DNA, 20 bp, Artificial
  CRISPR gRNA sequence
accgctccaagcctccagcc

SEQ ID NO: 653834 - DNA, 20 bp, Artificial
  CRISPR gRNA sequence
caagcctccagccggcagaa

SEQ ID NO: 653835 - DNA, 20 bp, Artificial
  CRISPR gRNA sequence
cagccggcagaaaacgtgag

SEQ ID NO: 653836 - DNA, 20 bp, Artificial
  CRISPR gRNA sequence
attatgacacggggagggga

SEQ ID NO: 653837 - DNA, 20 bp, Artificial
  CRISPR gRNA sequence
ttatgacacggggaggggag

SEQ ID NO: 653838 - DNA, 20 bp, Artificial
  CRISPR gRNA sequence
tgacacggggaggggagatg

SEQ ID NO: 653839 - DNA, 20 bp, Artificial
  CRISPR gRNA sequence
ggaagcgggttacctggccc

SEQ ID NO: 653840 - DNA, 20 bp, Artificial
  CRISPR gRNA sequence
cctggcccccgtcgggggcg

SEQ ID NO: 653841 - DNA, 20 bp, Artificial
  CRISPR gRNA sequence
gcccccgtcgggggcggggt

SEQ ID NO: 653842 - DNA, 20 bp, Artificial
  CRISPR gRNA sequence
ggggcgacgcggccgggcgc

SEQ ID NO: 653843 - DNA, 20 bp, Artificial
  CRISPR gRNA sequence
cggggcagcacttgtcctgt

SEQ ID NO: 653844 - DNA, 20 bp, Artificial
  CRISPR gRNA sequence
gtcctgtaatcgattgccga

SEQ ID NO: 653845 - DNA, 20 bp, Artificial
  CRISPR gRNA sequence
tcctgtaatcgattgccgag

SEQ ID NO: 653846 - DNA, 20 bp, Artificial
  CRISPR gRNA sequence
taatcgattgccgagcgcgc

SEQ ID NO: 653847 - DNA, 20 bp, Artificial
  CRISPR gRNA sequence
ccgagcgcgccgagcggctt

SEQ ID NO: 653848 - DNA, 20 bp, Artificial
  CRISPR gRNA sequence
agcgcgcagacacgcgcaca

SEQ ID NO: 653849 - DNA, 20 bp, Artificial
  CRISPR gRNA sequence
gcgcgcagacacgcgcacac

SEQ ID NO: 653850 - DNA, 20 bp, Artificial
  CRISPR gRNA sequence
tcatacacacacgcacaggc

SEQ ID NO: 653851 - DNA, 20 bp, Artificial
  CRISPR gRNA sequence
atacacacacgcacaggcgc

SEQ ID NO: 653852 - DNA, 20 bp, Artificial
  CRISPR gRNA sequence
gggccccgcacacacgcacg

SEQ ID NO: 653853 - DNA, 20 bp, Artificial
  CRISPR gRNA sequence
gcccgcgcccggggctccgc

SEQ ID NO: 653854 - DNA, 20 bp, Artificial
  CRISPR gRNA sequence
cgctgcccgccgccagccgc

SEQ ID NO: 653855 - DNA, 20 bp, Artificial
  CRISPR gRNA sequence
cccgccgccagccgcccgcc

SEQ ID NO: 653856 - DNA, 20 bp, Artificial
  CRISPR gRNA sequence
cgcccgcgggcgtctgcgcg

SEQ ID NO: 653857 - DNA, 20 bp, Artificial
  CRISPR gRNA sequence
cgcgagcccggccggcgggg

SEQ ID NO: 653858 - DNA, 20 bp, Artificial
  CRISPR gRNA sequence
gggctccaccggatcggttt

SEQ ID NO: 653859 - DNA, 20 bp, Artificial
  CRISPR gRNA sequence
caccggatcggtttctcggg

SEQ ID NO: 653860 - DNA, 20 bp, Artificial
  CRISPR gRNA sequence
ctcggggtttgaccagctgt

SEQ ID NO: 653861 - DNA, 20 bp, Artificial
  CRISPR gRNA sequence
tcggggtttgaccagctgtc

SEQ ID NO: 653862 - DNA, 20 bp, Artificial
  CRISPR gRNA sequence
ggggtttgaccagctgtccc

SEQ ID NO: 653863 - DNA, 20 bp, Artificial
  CRISPR gRNA sequence
gaccagctgtcccgggctaa

SEQ ID NO: 653864 - DNA, 20 bp, Artificial
  CRISPR gRNA sequence
accagctgtcccgggctaac

SEQ ID NO: 653865 - DNA, 20 bp, Artificial
  CRISPR gRNA sequence
tcccgggctaaccctgctcc

SEQ ID NO: 653866 - DNA, 20 bp, Artificial
  CRISPR gRNA sequence
accctgctcctcgctgaaga

SEQ ID NO: 653867 - DNA, 20 bp, Artificial
  CRISPR gRNA sequence
ctcctcgctgaagatggagg

SEQ ID NO: 653868 - DNA, 20 bp, Artificial
  CRISPR gRNA sequence
ctcgctgaagatggaggaag

SEQ ID NO: 653869 - DNA, 20 bp, Artificial
  CRISPR gRNA sequence
gctgaagatggaggaagtaa

SEQ ID NO: 653870 - DNA, 20 bp, Artificial
  CRISPR gRNA sequence
aagatggaggaagtaaaaac

SEQ ID NO: 653871 - DNA, 20 bp, Artificial
  CRISPR gRNA sequence
cccttagctacagatccact

SEQ ID NO: 653872 - DNA, 20 bp, Artificial
  CRISPR gRNA sequence
agctacagatccactgcctt

SEQ ID NO: 653873 - DNA, 20 bp, Artificial
  CRISPR gRNA sequence
gctacagatccactgcctta

SEQ ID NO: 653874 - DNA, 20 bp, Artificial
  CRISPR gRNA sequence
cagatccactgccttagttt

SEQ ID NO: 653875 - DNA, 20 bp, Artificial
  CRISPR gRNA sequence
ccttagtttccaccaccaac

SEQ ID NO: 653876 - DNA, 20 bp, Artificial
  CRISPR gRNA sequence
agtttccaccaccaactgca

SEQ ID NO: 653877 - DNA, 20 bp, Artificial
  CRISPR gRNA sequence
gtttccaccaccaactgcag

SEQ ID NO: 653878 - DNA, 20 bp, Artificial
  CRISPR gRNA sequence
ccaccaccaactgcagtgca

SEQ ID NO: 653879 - DNA, 20 bp, Artificial
  CRISPR gRNA sequence
caccaccaactgcagtgcac

SEQ ID NO: 653880 - DNA, 20 bp, Artificial
  CRISPR gRNA sequence
cagtgcacaaacacacgtta

SEQ ID NO: 653881 - DNA, 20 bp, Artificial
  CRISPR gRNA sequence
ggcacaggaaagaaagaaag

SEQ ID NO: 653882 - DNA, 20 bp, Artificial
  CRISPR gRNA sequence
acagtaaacacaaacaaaag

SEQ ID NO: 653883 - DNA, 20 bp, Artificial
  CRISPR gRNA sequence
ttttactgcatgcactgctg

SEQ ID NO: 653884 - DNA, 20 bp, Artificial
  CRISPR gRNA sequence
tactgcatgcactgctgagg

SEQ ID NO: 653885 - DNA, 20 bp, Artificial
  CRISPR gRNA sequence
actgcatgcactgctgaggt

SEQ ID NO: 653886 - DNA, 20 bp, Artificial
  CRISPR gRNA sequence
ctgcatgcactgctgaggta

SEQ ID NO: 653887 - DNA, 20 bp, Artificial
  CRISPR gRNA sequence
catgcactgctgaggtaaat

SEQ ID NO: 653888 - DNA, 20 bp, Artificial
  CRISPR gRNA sequence
ctgaggtaaatctccgcttg

SEQ ID NO: 653889 - DNA, 20 bp, Artificial
  CRISPR gRNA sequence
aggtaaatctccgcttggct

SEQ ID NO: 653890 - DNA, 20 bp, Artificial
  CRISPR gRNA sequence
cgcttggcttttgcgtggtg

SEQ ID NO: 653891 - DNA, 20 bp, Artificial
  CRISPR gRNA sequence
ggcttttgcgtggtgaagaa

SEQ ID NO: 653892 - DNA, 20 bp, Artificial
  CRISPR gRNA sequence
gcttttgcgtggtgaagaac

SEQ ID NO: 653893 - DNA, 20 bp, Artificial
  CRISPR gRNA sequence
ttgcgtggtgaagaacagct

SEQ ID NO: 653894 - DNA, 20 bp, Artificial
  CRISPR gRNA sequence
tgcgtggtgaagaacagctc

SEQ ID NO: 653895 - DNA, 20 bp, Artificial
  CRISPR gRNA sequence
gcgtggtgaagaacagctct

SEQ ID NO: 653896 - DNA, 20 bp, Artificial
  CRISPR gRNA sequence
cgtggtgaagaacagctctt

SEQ ID NO: 653897 - DNA, 20 bp, Artificial
  CRISPR gRNA sequence
ttgttttgtcttctgattca

SEQ ID NO: 653898 - DNA, 20 bp, Artificial
  CRISPR gRNA sequence
gttttgtcttctgattcata

SEQ ID NO: 653899 - DNA, 20 bp, Artificial
  CRISPR gRNA sequence
ttttgtcttctgattcatag

SEQ ID NO: 653900 - DNA, 20 bp, Artificial
  CRISPR gRNA sequence
tgtcttctgattcatagatt

SEQ ID NO: 653901 - DNA, 20 bp, Artificial
  CRISPR gRNA sequence
gtcttctgattcatagatta

SEQ ID NO: 653902 - DNA, 20 bp, Artificial
  CRISPR gRNA sequence
tcttctgattcatagattat

SEQ ID NO: 653903 - DNA, 20 bp, Artificial
  CRISPR gRNA sequence
ctgattcatagattatatat

SEQ ID NO: 653904 - DNA, 20 bp, Artificial
  CRISPR gRNA sequence
tgattcatagattatatata

SEQ ID NO: 653905 - DNA, 20 bp, Artificial
  CRISPR gRNA sequence
attcatagattatatataaa

SEQ ID NO: 653906 - DNA, 20 bp, Artificial
  CRISPR gRNA sequence
atagattatatataaatatg

SEQ ID NO: 653907 - DNA, 20 bp, Artificial
  CRISPR gRNA sequence
tatataaatatgtgtatgat

SEQ ID NO: 653908 - DNA, 20 bp, Artificial
  CRISPR gRNA sequence
gcaaaggggggagtgttttc

SEQ ID NO: 653909 - DNA, 20 bp, Artificial
  CRISPR gRNA sequence
caaaggggggagtgttttca

SEQ ID NO: 653910 - DNA, 20 bp, Artificial
  CRISPR gRNA sequence
tcaaagttaagtgtaattat

SEQ ID NO: 653911 - DNA, 20 bp, Artificial
  CRISPR gRNA sequence
caaagttaagtgtaattata

SEQ ID NO: 653912 - DNA, 20 bp, Artificial
  CRISPR gRNA sequence
aaagttaagtgtaattatat

SEQ ID NO: 653913 - DNA, 20 bp, Artificial
  CRISPR gRNA sequence
agtgtaattatatagcatct

SEQ ID NO: 653914 - DNA, 20 bp, Artificial
  CRISPR gRNA sequence
tatagcatctcgttttgcac

SEQ ID NO: 653915 - DNA, 20 bp, Artificial
  CRISPR gRNA sequence
gttttgcactgtgatgtgat

SEQ ID NO: 653916 - DNA, 20 bp, Artificial
  CRISPR gRNA sequence
tgcactgtgatgtgatcaaa

SEQ ID NO: 653917 - DNA, 20 bp, Artificial
  CRISPR gRNA sequence
gcactgtgatgtgatcaaat

SEQ ID NO: 653918 - DNA, 20 bp, Artificial
  CRISPR gRNA sequence
cactgtgatgtgatcaaatg

SEQ ID NO: 653919 - DNA, 20 bp, Artificial
  CRISPR gRNA sequence
tgatgtgatcaaatgacttg

SEQ ID NO: 653920 - DNA, 20 bp, Artificial
  CRISPR gRNA sequence
gttgctgttaaccagtaata

SEQ ID NO: 653921 - DNA, 20 bp, Artificial
  CRISPR gRNA sequence
ttgctgttaaccagtaataa

SEQ ID NO: 653922 - DNA, 20 bp, Artificial
  CRISPR gRNA sequence
ctgttaaccagtaataataa

SEQ ID NO: 653923 - DNA, 20 bp, Artificial
  CRISPR gRNA sequence
ttaaccagtaataataataa

SEQ ID NO: 653924 - DNA, 20 bp, Artificial
  CRISPR gRNA sequence
accagtaataataataataa

SEQ ID NO: 653925 - DNA, 20 bp, Artificial
  CRISPR gRNA sequence
ttctctgggagggatggatt

SEQ ID NO: 653926 - DNA, 20 bp, Artificial
  CRISPR gRNA sequence
tctctgggagggatggattg

SEQ ID NO: 653927 - DNA, 20 bp, Artificial
  CRISPR gRNA sequence
ctctgggagggatggattgt

SEQ ID NO: 653928 - DNA, 20 bp, Artificial
  CRISPR gRNA sequence
tctgggagggatggattgtg

SEQ ID NO: 653929 - DNA, 20 bp, Artificial
  CRISPR gRNA sequence
tgggagggatggattgtggt

SEQ ID NO: 653930 - DNA, 20 bp, Artificial
  CRISPR gRNA sequence
ggagggatggattgtggttc

SEQ ID NO: 653931 - DNA, 20 bp, Artificial
  CRISPR gRNA sequence
tggttctgattagggtaatg

SEQ ID NO: 653932 - DNA, 20 bp, Artificial
  CRISPR gRNA sequence
tgattagggtaatgattttt

SEQ ID NO: 653933 - DNA, 20 bp, Artificial
  CRISPR gRNA sequence
attagggtaatgatttttgt

SEQ ID NO: 653934 - DNA, 20 bp, Artificial
  CRISPR gRNA sequence
gggtaatgatttttgtaaag

SEQ ID NO: 653935 - DNA, 20 bp, Artificial
  CRISPR gRNA sequence
ttgtaaaggacgctcaggga

SEQ ID NO: 653936 - DNA, 20 bp, Artificial
  CRISPR gRNA sequence
tgtaaaggacgctcagggaa

SEQ ID NO: 653937 - DNA, 20 bp, Artificial
  CRISPR gRNA sequence
gtaaaggacgctcagggaat

SEQ ID NO: 653938 - DNA, 20 bp, Artificial
  CRISPR gRNA sequence
taaaggacgctcagggaatc

SEQ ID NO: 653939 - DNA, 20 bp, Artificial
  CRISPR gRNA sequence
agggaatcgggttgaagatg

SEQ ID NO: 653940 - DNA, 20 bp, Artificial
  CRISPR gRNA sequence
aagatgatgtcctctgcctt

SEQ ID NO: 653941 - DNA, 20 bp, Artificial
  CRISPR gRNA sequence
tgccttaatttatcgtcccc

SEQ ID NO: 653942 - DNA, 20 bp, Artificial
  CRISPR gRNA sequence
ccttaatttatcgtcccctc

SEQ ID NO: 653943 - DNA, 20 bp, Artificial
  CRISPR gRNA sequence
aatttatcgtcccctccttg

SEQ ID NO: 653944 - DNA, 20 bp, Artificial
  CRISPR gRNA sequence
atttatcgtcccctccttgt

SEQ ID NO: 653945 - DNA, 20 bp, Artificial
  CRISPR gRNA sequence
atcgtcccctccttgtaatc

SEQ ID NO: 653946 - DNA, 20 bp, Artificial
  CRISPR gRNA sequence
tcgtcccctccttgtaatct

SEQ ID NO: 653947 - DNA, 20 bp, Artificial
  CRISPR gRNA sequence
cttgtaatctgtttctggga

SEQ ID NO: 653948 - DNA, 20 bp, Artificial
  CRISPR gRNA sequence
gtaatctgtttctgggatgt

SEQ ID NO: 653949 - DNA, 20 bp, Artificial
  CRISPR gRNA sequence
taatctgtttctgggatgtt

SEQ ID NO: 653950 - DNA, 20 bp, Artificial
  CRISPR gRNA sequence
tttctgggatgttaatcgat

SEQ ID NO: 653951 - DNA, 20 bp, Artificial
  CRISPR gRNA sequence
ctgggatgttaatcgattaa

SEQ ID NO: 653952 - DNA, 20 bp, Artificial
  CRISPR gRNA sequence
tgggatgttaatcgattaat

SEQ ID NO: 653953 - DNA, 20 bp, Artificial
  CRISPR gRNA sequence
ggatgttaatcgattaatca

SEQ ID NO: 653954 - DNA, 20 bp, Artificial
  CRISPR gRNA sequence
atcgattaatcagttctcat

SEQ ID NO: 653955 - DNA, 20 bp, Artificial
  CRISPR gRNA sequence
atcagttctcatctctatag

SEQ ID NO: 653956 - DNA, 20 bp, Artificial
  CRISPR gRNA sequence
tcatctctatagctgtcatg

SEQ ID NO: 653957 - DNA, 20 bp, Artificial
  CRISPR gRNA sequence
atctctatagctgtcatgaa

SEQ ID NO: 653958 - DNA, 20 bp, Artificial
  CRISPR gRNA sequence
tatagctgtcatgaatttgg

SEQ ID NO: 653959 - DNA, 20 bp, Artificial
  CRISPR gRNA sequence
tagctgtcatgaatttggac

SEQ ID NO: 653960 - DNA, 20 bp, Artificial
  CRISPR gRNA sequence
tcatgaatttggacttgttt

SEQ ID NO: 653961 - DNA, 20 bp, Artificial
  CRISPR gRNA sequence
ggacttgttttgctttgttt

SEQ ID NO: 653962 - DNA, 20 bp, Artificial
  CRISPR gRNA sequence
gacttgttttgctttgtttt

SEQ ID NO: 653963 - DNA, 20 bp, Artificial
  CRISPR gRNA sequence
gttttgctttgttttaactt

SEQ ID NO: 653964 - DNA, 20 bp, Artificial
  CRISPR gRNA sequence
ttttgctttgttttaacttg

SEQ ID NO: 653965 - DNA, 20 bp, Artificial
  CRISPR gRNA sequence
tgctttgttttaacttgaat

SEQ ID NO: 653966 - DNA, 20 bp, Artificial
  CRISPR gRNA sequence
gctttgttttaacttgaatt

SEQ ID NO: 653967 - DNA, 20 bp, Artificial
  CRISPR gRNA sequence
ctttgttttaacttgaattc

SEQ ID NO: 653968 - DNA, 20 bp, Artificial
  CRISPR gRNA sequence
tgttttaacttgaattccaa

SEQ ID NO: 653969 - DNA, 20 bp, Artificial
  CRISPR gRNA sequence
gttttaacttgaattccaag

SEQ ID NO: 653970 - DNA, 20 bp, Artificial
  CRISPR gRNA sequence
ttttaacttgaattccaaga

SEQ ID NO: 653971 - DNA, 20 bp, Artificial
  CRISPR gRNA sequence
taacttgaattccaagaaga

SEQ ID NO: 653972 - DNA, 20 bp, Artificial
  CRISPR gRNA sequence
aacttgaattccaagaagaa

SEQ ID NO: 653973 - DNA, 20 bp, Artificial
  CRISPR gRNA sequence
acttgaattccaagaagaaa

SEQ ID NO: 653974 - DNA, 20 bp, Artificial
  CRISPR gRNA sequence
gaattccaagaagaaagatt

SEQ ID NO: 653975 - DNA, 20 bp, Artificial
  CRISPR gRNA sequence
aattccaagaagaaagattg

SEQ ID NO: 653976 - DNA, 20 bp, Artificial
  CRISPR gRNA sequence
caagaagaaagattgggtag

SEQ ID NO: 653977 - DNA, 20 bp, Artificial
  CRISPR gRNA sequence
ggtaggctggaataaattga

SEQ ID NO: 653978 - DNA, 20 bp, Artificial
  CRISPR gRNA sequence
gaataaattgaagctgtcca

SEQ ID NO: 653979 - DNA, 20 bp, Artificial
  CRISPR gRNA sequence
aagctgtccagatagaaggt

SEQ ID NO: 653980 - DNA, 20 bp, Artificial
  CRISPR gRNA sequence
tccagatagaaggtaatatc

SEQ ID NO: 653981 - DNA, 20 bp, Artificial
  CRISPR gRNA sequence
ttggaattaaaaaaaaaaaa

SEQ ID NO: 653982 - DNA, 20 bp, Artificial
  CRISPR gRNA sequence
gaattaaaaaaaaaaaaaaa

SEQ ID NO: 653983 - DNA, 20 bp, Artificial
  CRISPR gRNA sequence
aaaaaaaaaaaaaaccaaaa

SEQ ID NO: 653984 - DNA, 20 bp, Artificial
  CRISPR gRNA sequence
gtatgacacatgtaaacagg

SEQ ID NO: 653985 - DNA, 20 bp, Artificial
  CRISPR gRNA sequence
aatcactttgacaggttcta

SEQ ID NO: 653986 - DNA, 20 bp, Artificial
  CRISPR gRNA sequence
tgacaggttctagtatgggc

SEQ ID NO: 653987 - DNA, 20 bp, Artificial
  CRISPR gRNA sequence
gacaggttctagtatgggcg

SEQ ID NO: 653988 - DNA, 20 bp, Artificial
  CRISPR gRNA sequence
acaggttctagtatgggcga

SEQ ID NO: 653989 - DNA, 20 bp, Artificial
  CRISPR gRNA sequence
tagtatgggcgaaagagatg

SEQ ID NO: 653990 - DNA, 20 bp, Artificial
  CRISPR gRNA sequence
gtatgggcgaaagagatgga

SEQ ID NO: 653991 - DNA, 20 bp, Artificial
  CRISPR gRNA sequence
agatttatttattttttttc

SEQ ID NO: 653992 - DNA, 20 bp, Artificial
  CRISPR gRNA sequence
atttattttttttctttttt

SEQ ID NO: 653993 - DNA, 20 bp, Artificial
  CRISPR gRNA sequence
tttattttttttcttttttg

SEQ ID NO: 653994 - DNA, 20 bp, Artificial
  CRISPR gRNA sequence
attttttttcttttttgcca

SEQ ID NO: 653995 - DNA, 20 bp, Artificial
  CRISPR gRNA sequence
ttttttttcttttttgccaa

SEQ ID NO: 653996 - DNA, 20 bp, Artificial
  CRISPR gRNA sequence
tttttcttttttgccaaggg

SEQ ID NO: 653997 - DNA, 20 bp, Artificial
  CRISPR gRNA sequence
ttttcttttttgccaagggc

SEQ ID NO: 653998 - DNA, 20 bp, Artificial
  CRISPR gRNA sequence
tttcttttttgccaagggcc

SEQ ID NO: 653999 - DNA, 20 bp, Artificial
  CRISPR gRNA sequence
ttcttttttgccaagggcca

SEQ ID NO: 654000 - DNA, 20 bp, Artificial
  CRISPR gRNA sequence
tcttttttgccaagggccaa

SEQ ID NO: 654001 - DNA, 20 bp, Artificial
  CRISPR gRNA sequence
cttttttgccaagggccaaa

SEQ ID NO: 654002 - DNA, 20 bp, Artificial
  CRISPR gRNA sequence
ttttttgccaagggccaaaa

SEQ ID NO: 654003 - DNA, 20 bp, Artificial
  CRISPR gRNA sequence
ttttgccaagggccaaaaac

SEQ ID NO: 654004 - DNA, 20 bp, Artificial
  CRISPR gRNA sequence
tttgccaagggccaaaaaca

SEQ ID NO: 654005 - DNA, 20 bp, Artificial
  CRISPR gRNA sequence
ttgccaagggccaaaaacag

SEQ ID NO: 654006 - DNA, 20 bp, Artificial
  CRISPR gRNA sequence
tgccaagggccaaaaacagt

SEQ ID NO: 654007 - DNA, 20 bp, Artificial
  CRISPR gRNA sequence
gccaagggccaaaaacagtc

SEQ ID NO: 654008 - DNA, 20 bp, Artificial
  CRISPR gRNA sequence
ccaagggccaaaaacagtcc

SEQ ID NO: 654009 - DNA, 20 bp, Artificial
  CRISPR gRNA sequence
tgaagttggcctgggttcct

SEQ ID NO: 654010 - DNA, 20 bp, Artificial
  CRISPR gRNA sequence
gcctgggttcctagctgggt

SEQ ID NO: 654011 - DNA, 20 bp, Artificial
  CRISPR gRNA sequence
ggttcctagctgggttctgc

SEQ ID NO: 654012 - DNA, 20 bp, Artificial
  CRISPR gRNA sequence
ctagctgggttctgcctgac

SEQ ID NO: 654013 - DNA, 20 bp, Artificial
  CRISPR gRNA sequence
gctgggttctgcctgactgt

SEQ ID NO: 654014 - DNA, 20 bp, Artificial
  CRISPR gRNA sequence
ggttctgcctgactgtccct

SEQ ID NO: 654015 - DNA, 20 bp, Artificial
  CRISPR gRNA sequence
tgcctgactgtccctcccct

SEQ ID NO: 654016 - DNA, 20 bp, Artificial
  CRISPR gRNA sequence
cctgactgtccctcccctct

SEQ ID NO: 654017 - DNA, 20 bp, Artificial
  CRISPR gRNA sequence
actgtccctcccctctaccc

SEQ ID NO: 654018 - DNA, 20 bp, Artificial
  CRISPR gRNA sequence
tccctcccctctacccgccc

SEQ ID NO: 654019 - DNA, 20 bp, Artificial
  CRISPR gRNA sequence
ccctctacccgccccccccc

SEQ ID NO: 654020 - DNA, 20 bp, Artificial
  CRISPR gRNA sequence
tacccgcccccccccccttt

SEQ ID NO: 654021 - DNA, 20 bp, Artificial
  CRISPR gRNA sequence
cccgcccccccccccttttc

SEQ ID NO: 654022 - DNA, 20 bp, Artificial
  CRISPR gRNA sequence
ttctttcagttttcttgtct

SEQ ID NO: 654023 - DNA, 20 bp, Artificial
  CRISPR gRNA sequence
tctttcagttttcttgtctt

SEQ ID NO: 654024 - DNA, 20 bp, Artificial
  CRISPR gRNA sequence
ctttcagttttcttgtctta

SEQ ID NO: 654025 - DNA, 20 bp, Artificial
  CRISPR gRNA sequence
tttcagttttcttgtcttag

SEQ ID NO: 654026 - DNA, 20 bp, Artificial
  CRISPR gRNA sequence
tcagttttcttgtcttagct

SEQ ID NO: 654027 - DNA, 20 bp, Artificial
  CRISPR gRNA sequence
cagttttcttgtcttagctt

SEQ ID NO: 654028 - DNA, 20 bp, Artificial
  CRISPR gRNA sequence
agttttcttgtcttagcttt

SEQ ID NO: 654029 - DNA, 20 bp, Artificial
  CRISPR gRNA sequence
tcttgtcttagcttttggtc

SEQ ID NO: 654030 - DNA, 20 bp, Artificial
  CRISPR gRNA sequence
cttgtcttagcttttggtcg

SEQ ID NO: 654031 - DNA, 20 bp, Artificial
  CRISPR gRNA sequence
ttgtcttagcttttggtcga

SEQ ID NO: 654032 - DNA, 20 bp, Artificial
  CRISPR gRNA sequence
gtcttagcttttggtcgatt

SEQ ID NO: 654033 - DNA, 20 bp, Artificial
  CRISPR gRNA sequence
tcttagcttttggtcgattc

SEQ ID NO: 654034 - DNA, 20 bp, Artificial
  CRISPR gRNA sequence
agcttttggtcgattcttaa

SEQ ID NO: 654035 - DNA, 20 bp, Artificial
  CRISPR gRNA sequence
gcttttggtcgattcttaag

SEQ ID NO: 654036 - DNA, 20 bp, Artificial
  CRISPR gRNA sequence
ttggtcgattcttaaggaac

SEQ ID NO: 654037 - DNA, 20 bp, Artificial
  CRISPR gRNA sequence
tggtcgattcttaaggaacc

SEQ ID NO: 654038 - DNA, 20 bp, Artificial
  CRISPR gRNA sequence
ggtcgattcttaaggaaccg

SEQ ID NO: 654039 - DNA, 20 bp, Artificial
  CRISPR gRNA sequence
gtcgattcttaaggaaccgg

SEQ ID NO: 654040 - DNA, 20 bp, Artificial
  CRISPR gRNA sequence
ttaaggaaccggtggatcaa

SEQ ID NO: 654041 - DNA, 20 bp, Artificial
  CRISPR gRNA sequence
aaggaaccggtggatcaagt

SEQ ID NO: 654042 - DNA, 20 bp, Artificial
  CRISPR gRNA sequence
aggaaccggtggatcaagtt

SEQ ID NO: 654043 - DNA, 20 bp, Artificial
  CRISPR gRNA sequence
tttctcttgttaatcgcatt

SEQ ID NO: 654044 - DNA, 20 bp, Artificial
  CRISPR gRNA sequence
ttctcttgttaatcgcattg

SEQ ID NO: 654045 - DNA, 20 bp, Artificial
  CRISPR gRNA sequence
tctcttgttaatcgcattgc

SEQ ID NO: 654046 - DNA, 20 bp, Artificial
  CRISPR gRNA sequence
ctcttgttaatcgcattgct

SEQ ID NO: 654047 - DNA, 20 bp, Artificial
  CRISPR gRNA sequence
tcttgttaatcgcattgcta

SEQ ID NO: 654048 - DNA, 20 bp, Artificial
  CRISPR gRNA sequence
ttgttaatcgcattgctata

SEQ ID NO: 654049 - DNA, 20 bp, Artificial
  CRISPR gRNA sequence
gttaatcgcattgctatagc

SEQ ID NO: 654050 - DNA, 20 bp, Artificial
  CRISPR gRNA sequence
ttaatcgcattgctatagca

SEQ ID NO: 654051 - DNA, 20 bp, Artificial
  CRISPR gRNA sequence
atcgcattgctatagcactg

SEQ ID NO: 654052 - DNA, 20 bp, Artificial
  CRISPR gRNA sequence
ctatagcactgactgacctc

SEQ ID NO: 654053 - DNA, 20 bp, Artificial
  CRISPR gRNA sequence
tagcactgactgacctctct

SEQ ID NO: 654054 - DNA, 20 bp, Artificial
  CRISPR gRNA sequence
actgacctctctctctctct

SEQ ID NO: 654055 - DNA, 20 bp, Artificial
  CRISPR gRNA sequence
acctctctctctctcttttt

SEQ ID NO: 654056 - DNA, 20 bp, Artificial
  CRISPR gRNA sequence
tctctctctcttttttttcc

SEQ ID NO: 654057 - DNA, 20 bp, Artificial
  CRISPR gRNA sequence
tctctctcttttttttcctc

SEQ ID NO: 654058 - DNA, 20 bp, Artificial
  CRISPR gRNA sequence
tctctcttttttttcctctt

SEQ ID NO: 654059 - DNA, 20 bp, Artificial
  CRISPR gRNA sequence
tctcttttttttcctctttc

SEQ ID NO: 654060 - DNA, 20 bp, Artificial
  CRISPR gRNA sequence
tcttttttttcctctttcct

SEQ ID NO: 654061 - DNA, 20 bp, Artificial
  CRISPR gRNA sequence
ttttttttcctctttcctga

SEQ ID NO: 654062 - DNA, 20 bp, Artificial
  CRISPR gRNA sequence
ttttttcctctttcctgaaa

SEQ ID NO: 654063 - DNA, 20 bp, Artificial
  CRISPR gRNA sequence
tttttcctctttcctgaaag

SEQ ID NO: 654064 - DNA, 20 bp, Artificial
  CRISPR gRNA sequence
ttttcctctttcctgaaagt

SEQ ID NO: 654065 - DNA, 20 bp, Artificial
  CRISPR gRNA sequence
tttcctctttcctgaaagta

SEQ ID NO: 654066 - DNA, 20 bp, Artificial
  CRISPR gRNA sequence
ttcctctttcctgaaagtac

SEQ ID NO: 654067 - DNA, 20 bp, Artificial
  CRISPR gRNA sequence
tcctctttcctgaaagtacg

SEQ ID NO: 654068 - DNA, 20 bp, Artificial
  CRISPR gRNA sequence
cctctttcctgaaagtacgt

SEQ ID NO: 654069 - DNA, 20 bp, Artificial
  CRISPR gRNA sequence
ctctttcctgaaagtacgtg

SEQ ID NO: 654070 - DNA, 20 bp, Artificial
  CRISPR gRNA sequence
tttcctgaaagtacgtggtg

SEQ ID NO: 654071 - DNA, 20 bp, Artificial
  CRISPR gRNA sequence
tcctgaaagtacgtggtgcc

SEQ ID NO: 654072 - DNA, 20 bp, Artificial
  CRISPR gRNA sequence
cctgaaagtacgtggtgcca

SEQ ID NO: 654073 - DNA, 20 bp, Artificial
  CRISPR gRNA sequence
ctgaaagtacgtggtgccat

SEQ ID NO: 654074 - DNA, 20 bp, Artificial
  CRISPR gRNA sequence
aaagtacgtggtgccattcc

SEQ ID NO: 654075 - DNA, 20 bp, Artificial
  CRISPR gRNA sequence
ctgagtgacttttcctacta

SEQ ID NO: 654076 - DNA, 20 bp, Artificial
  CRISPR gRNA sequence
agtgacttttcctactagac

SEQ ID NO: 654077 - DNA, 20 bp, Artificial
  CRISPR gRNA sequence
ttcctactagaccatcccta

SEQ ID NO: 654078 - DNA, 20 bp, Artificial
  CRISPR gRNA sequence
tcctactagaccatccctaa

SEQ ID NO: 654079 - DNA, 20 bp, Artificial
  CRISPR gRNA sequence
cctactagaccatccctaag

SEQ ID NO: 654080 - DNA, 20 bp, Artificial
  CRISPR gRNA sequence
ctactagaccatccctaagg

SEQ ID NO: 654081 - DNA, 20 bp, Artificial
  CRISPR gRNA sequence
ctagaccatccctaagggac

SEQ ID NO: 654082 - DNA, 20 bp, Artificial
  CRISPR gRNA sequence
gaccatccctaagggacgag

SEQ ID NO: 654083 - DNA, 20 bp, Artificial
  CRISPR gRNA sequence
agggacgagggggaggggtg

SEQ ID NO: 654084 - DNA, 20 bp, Artificial
  CRISPR gRNA sequence
ttctctctcatttcttggtt

SEQ ID NO: 654085 - DNA, 20 bp, Artificial
  CRISPR gRNA sequence
ctctctcatttcttggtttt

SEQ ID NO: 654086 - DNA, 20 bp, Artificial
  CRISPR gRNA sequence
tctctcatttcttggttttg

SEQ ID NO: 654087 - DNA, 20 bp, Artificial
  CRISPR gRNA sequence
tctcatttcttggttttgtt

SEQ ID NO: 654088 - DNA, 20 bp, Artificial
  CRISPR gRNA sequence
tcatttcttggttttgttta

SEQ ID NO: 654089 - DNA, 20 bp, Artificial
  CRISPR gRNA sequence
atttcttggttttgtttatc

SEQ ID NO: 654090 - DNA, 20 bp, Artificial
  CRISPR gRNA sequence
cttggttttgtttatcagcc

SEQ ID NO: 654091 - DNA, 20 bp, Artificial
  CRISPR gRNA sequence
ttggttttgtttatcagccg

SEQ ID NO: 654092 - DNA, 20 bp, Artificial
  CRISPR gRNA sequence
ggttttgtttatcagccgat

SEQ ID NO: 654093 - DNA, 20 bp, Artificial
  CRISPR gRNA sequence
gttttgtttatcagccgatc

SEQ ID NO: 654094 - DNA, 20 bp, Artificial
  CRISPR gRNA sequence
tgtttatcagccgatctgtt

SEQ ID NO: 654095 - DNA, 20 bp, Artificial
  CRISPR gRNA sequence
gtttatcagccgatctgttt

SEQ ID NO: 654096 - DNA, 20 bp, Artificial
  CRISPR gRNA sequence
tttatcagccgatctgtttg

SEQ ID NO: 654097 - DNA, 20 bp, Artificial
  CRISPR gRNA sequence
atcagccgatctgtttgctg

SEQ ID NO: 654098 - DNA, 20 bp, Artificial
  CRISPR gRNA sequence
tcagccgatctgtttgctgg

SEQ ID NO: 654099 - DNA, 20 bp, Artificial
  CRISPR gRNA sequence
tttgctggatttgggcttgg

SEQ ID NO: 654100 - DNA, 20 bp, Artificial
  CRISPR gRNA sequence
gctggatttgggcttggaat

SEQ ID NO: 654101 - DNA, 20 bp, Artificial
  CRISPR gRNA sequence
ctggatttgggcttggaatg

SEQ ID NO: 654102 - DNA, 20 bp, Artificial
  CRISPR gRNA sequence
gatttgggcttggaatgacc

SEQ ID NO: 654103 - DNA, 20 bp, Artificial
  CRISPR gRNA sequence
gggcttggaatgacccacct

SEQ ID NO: 654104 - DNA, 20 bp, Artificial
  CRISPR gRNA sequence
ggcttggaatgacccacctg

SEQ ID NO: 654105 - DNA, 20 bp, Artificial
  CRISPR gRNA sequence
ggaatgacccacctgtaaag

SEQ ID NO: 654106 - DNA, 20 bp, Artificial
  CRISPR gRNA sequence
gaatgacccacctgtaaagt

SEQ ID NO: 654107 - DNA, 20 bp, Artificial
  CRISPR gRNA sequence
taaagtgcttttccttcctc

SEQ ID NO: 654108 - DNA, 20 bp, Artificial
  CRISPR gRNA sequence
ttccttcctcctccccttga

SEQ ID NO: 654109 - DNA, 20 bp, Artificial
  CRISPR gRNA sequence
tccttcctcctccccttgaa

SEQ ID NO: 654110 - DNA, 20 bp, Artificial
  CRISPR gRNA sequence
ccttcctcctccccttgaac

SEQ ID NO: 654111 - DNA, 20 bp, Artificial
  CRISPR gRNA sequence
cttcctcctccccttgaact

SEQ ID NO: 654112 - DNA, 20 bp, Artificial
  CRISPR gRNA sequence
cctcctccccttgaactctg

SEQ ID NO: 654113 - DNA, 20 bp, Artificial
  CRISPR gRNA sequence
ctcctccccttgaactctgc

SEQ ID NO: 654114 - DNA, 20 bp, Artificial
  CRISPR gRNA sequence
ctccccttgaactctgcagg

SEQ ID NO: 654115 - DNA, 20 bp, Artificial
  CRISPR gRNA sequence
cccttgaactctgcaggggg

SEQ ID NO: 654116 - DNA, 20 bp, Artificial
  CRISPR gRNA sequence
gaactctgcagggggcttgg

SEQ ID NO: 654117 - DNA, 20 bp, Artificial
  CRISPR gRNA sequence
aactctgcagggggcttggc

SEQ ID NO: 654118 - DNA, 20 bp, Artificial
  CRISPR gRNA sequence
tgcagggggcttggcttgga

SEQ ID NO: 654119 - DNA, 20 bp, Artificial
  CRISPR gRNA sequence
cagggggcttggcttggagg

SEQ ID NO: 654120 - DNA, 20 bp, Artificial
  CRISPR gRNA sequence
ggcttggagggggcaaggga

SEQ ID NO: 654121 - DNA, 20 bp, Artificial
  CRISPR gRNA sequence
gcttggagggggcaagggag

SEQ ID NO: 654122 - DNA, 20 bp, Artificial
  CRISPR gRNA sequence
ggagggggcaagggagggaa

SEQ ID NO: 654123 - DNA, 20 bp, Artificial
  CRISPR gRNA sequence
gagggggcaagggagggaaa

SEQ ID NO: 654124 - DNA, 20 bp, Artificial
  CRISPR gRNA sequence
ctttctttctccctccgttt

SEQ ID NO: 654125 - DNA, 20 bp, Artificial
  CRISPR gRNA sequence
tttctttctccctccgttta

SEQ ID NO: 654126 - DNA, 20 bp, Artificial
  CRISPR gRNA sequence
tctttctccctccgtttatc

SEQ ID NO: 654127 - DNA, 20 bp, Artificial
  CRISPR gRNA sequence
ctttctccctccgtttatct

SEQ ID NO: 654128 - DNA, 20 bp, Artificial
  CRISPR gRNA sequence
tttctccctccgtttatctt

SEQ ID NO: 654129 - DNA, 20 bp, Artificial
  CRISPR gRNA sequence
tctccctccgtttatcttca

SEQ ID NO: 654130 - DNA, 20 bp, Artificial
  CRISPR gRNA sequence
ctccctccgtttatcttcag

SEQ ID NO: 654131 - DNA, 20 bp, Artificial
  CRISPR gRNA sequence
tccctccgtttatcttcagc

SEQ ID NO: 654132 - DNA, 20 bp, Artificial
  CRISPR gRNA sequence
cctccgtttatcttcagccc

SEQ ID NO: 654133 - DNA, 20 bp, Artificial
  CRISPR gRNA sequence
cgtttatcttcagcccgaca

SEQ ID NO: 654134 - DNA, 20 bp, Artificial
  CRISPR gRNA sequence
atcttcagcccgacattgtc

SEQ ID NO: 654135 - DNA, 20 bp, Artificial
  CRISPR gRNA sequence
tcttcagcccgacattgtca

SEQ ID NO: 654136 - DNA, 20 bp, Artificial
  CRISPR gRNA sequence
cagcccgacattgtcacctc

SEQ ID NO: 654137 - DNA, 20 bp, Artificial
  CRISPR gRNA sequence
agcccgacattgtcacctcc

SEQ ID NO: 654138 - DNA, 20 bp, Artificial
  CRISPR gRNA sequence
tcacctcctctttgaggggt

SEQ ID NO: 654139 - DNA, 20 bp, Artificial
  CRISPR gRNA sequence
ctctttgaggggttagaaga

SEQ ID NO: 654140 - DNA, 20 bp, Artificial
  CRISPR gRNA sequence
tttgaggggttagaagaagc

SEQ ID NO: 654141 - DNA, 20 bp, Artificial
  CRISPR gRNA sequence
tgaggggttagaagaagctg

SEQ ID NO: 654142 - DNA, 20 bp, Artificial
  CRISPR gRNA sequence
gaggggttagaagaagctga

SEQ ID NO: 654143 - DNA, 20 bp, Artificial
  CRISPR gRNA sequence
aggggttagaagaagctgag

SEQ ID NO: 654144 - DNA, 20 bp, Artificial
  CRISPR gRNA sequence
gaagaagctgagatctcccg

SEQ ID NO: 654145 - DNA, 20 bp, Artificial
  CRISPR gRNA sequence
agatctcccgacagagctgg

SEQ ID NO: 654146 - DNA, 20 bp, Artificial
  CRISPR gRNA sequence
ccgacagagctggaaatggt

SEQ ID NO: 654147 - DNA, 20 bp, Artificial
  CRISPR gRNA sequence
gaaatggtgatgaatctttt

SEQ ID NO: 654148 - DNA, 20 bp, Artificial
  CRISPR gRNA sequence
ttttaatcaaaggacaattt

SEQ ID NO: 654149 - DNA, 20 bp, Artificial
  CRISPR gRNA sequence
tttaatcaaaggacaatttc

SEQ ID NO: 654150 - DNA, 20 bp, Artificial
  CRISPR gRNA sequence
ttaatcaaaggacaatttct

SEQ ID NO: 654151 - DNA, 20 bp, Artificial
  CRISPR gRNA sequence
taatcaaaggacaatttctt

SEQ ID NO: 654152 - DNA, 20 bp, Artificial
  CRISPR gRNA sequence
aatcaaaggacaatttcttt

SEQ ID NO: 654153 - DNA, 20 bp, Artificial
  CRISPR gRNA sequence
atcaaaggacaatttctttt

SEQ ID NO: 654154 - DNA, 20 bp, Artificial
  CRISPR gRNA sequence
cttttgtatgtacatttcgt

SEQ ID NO: 654155 - DNA, 20 bp, Artificial
  CRISPR gRNA sequence
ttttgtatgtacatttcgtt

SEQ ID NO: 654156 - DNA, 20 bp, Artificial
  CRISPR gRNA sequence
ttgtatgtacatttcgtttc

SEQ ID NO: 654157 - DNA, 20 bp, Artificial
  CRISPR gRNA sequence
tgtatgtacatttcgtttct

SEQ ID NO: 654158 - DNA, 20 bp, Artificial
  CRISPR gRNA sequence
gtatgtacatttcgtttctc

SEQ ID NO: 654159 - DNA, 20 bp, Artificial
  CRISPR gRNA sequence
tatgtacatttcgtttctct

SEQ ID NO: 654160 - DNA, 20 bp, Artificial
  CRISPR gRNA sequence
cgtttctctttctccttttt

SEQ ID NO: 654161 - DNA, 20 bp, Artificial
  CRISPR gRNA sequence
gtttctctttctcctttttc

SEQ ID NO: 654162 - DNA, 20 bp, Artificial
  CRISPR gRNA sequence
ctctttctcctttttctttt

SEQ ID NO: 654163 - DNA, 20 bp, Artificial
  CRISPR gRNA sequence
tctttctcctttttcttttt

SEQ ID NO: 654164 - DNA, 20 bp, Artificial
  CRISPR gRNA sequence
tttctcctttttctttttcc

SEQ ID NO: 654165 - DNA, 20 bp, Artificial
  CRISPR gRNA sequence
tctcctttttctttttcctt

SEQ ID NO: 654166 - DNA, 20 bp, Artificial
  CRISPR gRNA sequence
ctcctttttctttttccttc

SEQ ID NO: 654167 - DNA, 20 bp, Artificial
  CRISPR gRNA sequence
tcctttttctttttccttct

SEQ ID NO: 654168 - DNA, 20 bp, Artificial
  CRISPR gRNA sequence
ctttttctttttccttcttt

SEQ ID NO: 654169 - DNA, 20 bp, Artificial
  CRISPR gRNA sequence
tttctttttccttctttcct

SEQ ID NO: 654170 - DNA, 20 bp, Artificial
  CRISPR gRNA sequence
ttctttttccttctttcctt

SEQ ID NO: 654171 - DNA, 20 bp, Artificial
  CRISPR gRNA sequence
tctttttccttctttccttc

SEQ ID NO: 654172 - DNA, 20 bp, Artificial
  CRISPR gRNA sequence
ctttttccttctttccttct

SEQ ID NO: 654173 - DNA, 20 bp, Artificial
  CRISPR gRNA sequence
tttttccttctttccttctc

SEQ ID NO: 654174 - DNA, 20 bp, Artificial
  CRISPR gRNA sequence
tttccttctttccttctctg

SEQ ID NO: 654175 - DNA, 20 bp, Artificial
  CRISPR gRNA sequence
ttccttctttccttctctga

SEQ ID NO: 654176 - DNA, 20 bp, Artificial
  CRISPR gRNA sequence
tccttctttccttctctgag

SEQ ID NO: 654177 - DNA, 20 bp, Artificial
  CRISPR gRNA sequence
ccttctttccttctctgagg

SEQ ID NO: 654178 - DNA, 20 bp, Artificial
  CRISPR gRNA sequence
cttctttccttctctgaggg

SEQ ID NO: 654179 - DNA, 20 bp, Artificial
  CRISPR gRNA sequence
ctttccttctctgagggtta

SEQ ID NO: 654180 - DNA, 20 bp, Artificial
  CRISPR gRNA sequence
tttccttctctgagggttaa

SEQ ID NO: 654181 - DNA, 20 bp, Artificial
  CRISPR gRNA sequence
tccttctctgagggttaata

SEQ ID NO: 654182 - DNA, 20 bp, Artificial
  CRISPR gRNA sequence
ccttctctgagggttaataa

SEQ ID NO: 654183 - DNA, 20 bp, Artificial
  CRISPR gRNA sequence
cttctctgagggttaataac

SEQ ID NO: 654184 - DNA, 20 bp, Artificial
  CRISPR gRNA sequence
ctctgagggttaataaccat

SEQ ID NO: 654185 - DNA, 20 bp, Artificial
  CRISPR gRNA sequence
tctgagggttaataaccatt

SEQ ID NO: 654186 - DNA, 20 bp, Artificial
  CRISPR gRNA sequence
tgagggttaataaccatttc

SEQ ID NO: 654187 - DNA, 20 bp, Artificial
  CRISPR gRNA sequence
agggttaataaccatttcat

SEQ ID NO: 654188 - DNA, 20 bp, Artificial
  CRISPR gRNA sequence
ataaccatttcattgatggg

SEQ ID NO: 654189 - DNA, 20 bp, Artificial
  CRISPR gRNA sequence
cattgatggggcagccttct

SEQ ID NO: 654190 - DNA, 20 bp, Artificial
  CRISPR gRNA sequence
attgatggggcagccttctt

SEQ ID NO: 654191 - DNA, 20 bp, Artificial
  CRISPR gRNA sequence
atggggcagccttctttcgc

SEQ ID NO: 654192 - DNA, 20 bp, Artificial
  CRISPR gRNA sequence
ctttcgcttctccctgacgt

SEQ ID NO: 654193 - DNA, 20 bp, Artificial
  CRISPR gRNA sequence
tttcgcttctccctgacgtt

SEQ ID NO: 654194 - DNA, 20 bp, Artificial
  CRISPR gRNA sequence
tcgcttctccctgacgtttc

SEQ ID NO: 654195 - DNA, 20 bp, Artificial
  CRISPR gRNA sequence
cgcttctccctgacgtttct

SEQ ID NO: 654196 - DNA, 20 bp, Artificial
  CRISPR gRNA sequence
gcttctccctgacgtttctt

SEQ ID NO: 654197 - DNA, 20 bp, Artificial
  CRISPR gRNA sequence
ctccctgacgtttctttctt

SEQ ID NO: 654198 - DNA, 20 bp, Artificial
  CRISPR gRNA sequence
tccctgacgtttctttcttt

SEQ ID NO: 654199 - DNA, 20 bp, Artificial
  CRISPR gRNA sequence
cctgacgtttctttcttttt

SEQ ID NO: 654200 - DNA, 20 bp, Artificial
  CRISPR gRNA sequence
acgtttctttctttttaata

SEQ ID NO: 654201 - DNA, 20 bp, Artificial
  CRISPR gRNA sequence
ctttctttttaatatgtgtg

SEQ ID NO: 654202 - DNA, 20 bp, Artificial
  CRISPR gRNA sequence
tttctttttaatatgtgtgt

SEQ ID NO: 654203 - DNA, 20 bp, Artificial
  CRISPR gRNA sequence
tctttttaatatgtgtgtgt

SEQ ID NO: 654204 - DNA, 20 bp, Artificial
  CRISPR gRNA sequence
ctttttaatatgtgtgtgtt

SEQ ID NO: 654205 - DNA, 20 bp, Artificial
  CRISPR gRNA sequence
tttttaatatgtgtgtgtta

SEQ ID NO: 654206 - DNA, 20 bp, Artificial
  CRISPR gRNA sequence
tttaatatgtgtgtgttaaa

SEQ ID NO: 654207 - DNA, 20 bp, Artificial
  CRISPR gRNA sequence
ttaatatgtgtgtgttaaat

SEQ ID NO: 654208 - DNA, 20 bp, Artificial
  CRISPR gRNA sequence
taatatgtgtgtgttaaatg

SEQ ID NO: 654209 - DNA, 20 bp, Artificial
  CRISPR gRNA sequence
aatatgtgtgtgttaaatgt

SEQ ID NO: 654210 - DNA, 20 bp, Artificial
  CRISPR gRNA sequence
atatgtgtgtgttaaatgtg

SEQ ID NO: 654211 - DNA, 20 bp, Artificial
  CRISPR gRNA sequence
aatgtgtacatttttaaaga

SEQ ID NO: 654212 - DNA, 20 bp, Artificial
  CRISPR gRNA sequence
ttaaagagataagctcattt

SEQ ID NO: 654213 - DNA, 20 bp, Artificial
  CRISPR gRNA sequence
taaagagataagctcatttg

SEQ ID NO: 654214 - DNA, 20 bp, Artificial
  CRISPR gRNA sequence
aaagagataagctcatttgt

SEQ ID NO: 654215 - DNA, 20 bp, Artificial
  CRISPR gRNA sequence
aagagataagctcatttgta

SEQ ID NO: 654216 - DNA, 20 bp, Artificial
  CRISPR gRNA sequence
atttgtaaaatatccgaaga

SEQ ID NO: 654217 - DNA, 20 bp, Artificial
  CRISPR gRNA sequence
gtaaaatatccgaagaaact

SEQ ID NO: 654218 - DNA, 20 bp, Artificial
  CRISPR gRNA sequence
taaaatatccgaagaaactg

SEQ ID NO: 654219 - DNA, 20 bp, Artificial
  CRISPR gRNA sequence
ctcctcttttaaactttacg

SEQ ID NO: 654220 - DNA, 20 bp, Artificial
  CRISPR gRNA sequence
ctcttttaaactttacggat

SEQ ID NO: 654221 - DNA, 20 bp, Artificial
  CRISPR gRNA sequence
ttttaaactttacggatctc

SEQ ID NO: 654222 - DNA, 20 bp, Artificial
  CRISPR gRNA sequence
ttaaactttacggatctctt

SEQ ID NO: 654223 - DNA, 20 bp, Artificial
  CRISPR gRNA sequence
taaactttacggatctcttt

SEQ ID NO: 654224 - DNA, 20 bp, Artificial
  CRISPR gRNA sequence
aaactttacggatctctttc

SEQ ID NO: 654225 - DNA, 20 bp, Artificial
  CRISPR gRNA sequence
aactttacggatctctttct

SEQ ID NO: 654226 - DNA, 20 bp, Artificial
  CRISPR gRNA sequence
tacggatctctttctttaaa

SEQ ID NO: 654227 - DNA, 20 bp, Artificial
  CRISPR gRNA sequence
acggatctctttctttaaag

SEQ ID NO: 654228 - DNA, 20 bp, Artificial
  CRISPR gRNA sequence
cggatctctttctttaaagc

SEQ ID NO: 654229 - DNA, 20 bp, Artificial
  CRISPR gRNA sequence
tttctttaaagccttatgta

SEQ ID NO: 654230 - DNA, 20 bp, Artificial
  CRISPR gRNA sequence
tctttaaagccttatgtaat

SEQ ID NO: 654231 - DNA, 20 bp, Artificial
  CRISPR gRNA sequence
ctttaaagccttatgtaatc

SEQ ID NO: 654232 - DNA, 20 bp, Artificial
  CRISPR gRNA sequence
tttaaagccttatgtaatca

SEQ ID NO: 654233 - DNA, 20 bp, Artificial
  CRISPR gRNA sequence
taaagccttatgtaatcata

SEQ ID NO: 654234 - DNA, 20 bp, Artificial
  CRISPR gRNA sequence
aaagccttatgtaatcataa

SEQ ID NO: 654235 - DNA, 20 bp, Artificial
  CRISPR gRNA sequence
aagccttatgtaatcataat

SEQ ID NO: 654236 - DNA, 20 bp, Artificial
  CRISPR gRNA sequence
atgtaatcataatttaaaag

SEQ ID NO: 654237 - DNA, 20 bp, Artificial
  CRISPR gRNA sequence
tgtaatcataatttaaaaga

SEQ ID NO: 654238 - DNA, 20 bp, Artificial
  CRISPR gRNA sequence
aaaagaatgtgataacagta

SEQ ID NO: 654239 - DNA, 20 bp, Artificial
  CRISPR gRNA sequence
aaagaatgtgataacagtac

SEQ ID NO: 654240 - DNA, 20 bp, Artificial
  CRISPR gRNA sequence
aaatttaagtgctatgtagt

SEQ ID NO: 654241 - DNA, 20 bp, Artificial
  CRISPR gRNA sequence
aagtgctatgtagtgactga

SEQ ID NO: 654242 - DNA, 20 bp, Artificial
  CRISPR gRNA sequence
agtgctatgtagtgactgag

SEQ ID NO: 654243 - DNA, 20 bp, Artificial
  CRISPR gRNA sequence
tgtagtgactgagttgggaa

SEQ ID NO: 654244 - DNA, 20 bp, Artificial
  CRISPR gRNA sequence
agttgggaatttgatctgat

SEQ ID NO: 654245 - DNA, 20 bp, Artificial
  CRISPR gRNA sequence
ggaatttgatctgattattc

SEQ ID NO: 654246 - DNA, 20 bp, Artificial
  CRISPR gRNA sequence
gatctgattattccataaag

SEQ ID NO: 654247 - DNA, 20 bp, Artificial
  CRISPR gRNA sequence
atctgattattccataaaga

SEQ ID NO: 654248 - DNA, 20 bp, Artificial
  CRISPR gRNA sequence
attattccataaagaaagaa

SEQ ID NO: 654249 - DNA, 20 bp, Artificial
  CRISPR gRNA sequence
ttccataaagaaagaaataa

SEQ ID NO: 654250 - DNA, 20 bp, Artificial
  CRISPR gRNA sequence
cataaagaaagaaataaaag

SEQ ID NO: 654251 - DNA, 20 bp, Artificial
  CRISPR gRNA sequence
ttttttggggggggggtaag

SEQ ID NO: 654252 - DNA, 20 bp, Artificial
  CRISPR gRNA sequence
tttttggggggggggtaagg

SEQ ID NO: 654253 - DNA, 20 bp, Artificial
  CRISPR gRNA sequence
ttttggggggggggtaaggg

SEQ ID NO: 654254 - DNA, 20 bp, Artificial
  CRISPR gRNA sequence
tttggggggggggtaaggga

SEQ ID NO: 654255 - DNA, 20 bp, Artificial
  CRISPR gRNA sequence
ttggggggggggtaagggag

SEQ ID NO: 654256 - DNA, 20 bp, Artificial
  CRISPR gRNA sequence
tggggggggggtaagggagt

SEQ ID NO: 654257 - DNA, 20 bp, Artificial
  CRISPR gRNA sequence
ggggggggggtaagggagtg

SEQ ID NO: 654258 - DNA, 20 bp, Artificial
  CRISPR gRNA sequence
gggggggggtaagggagtgt

SEQ ID NO: 654259 - DNA, 20 bp, Artificial
  CRISPR gRNA sequence
tggagacaagaagtgaagct

SEQ ID NO: 654260 - DNA, 20 bp, Artificial
  CRISPR gRNA sequence
ggagacaagaagtgaagctg

SEQ ID NO: 654261 - DNA, 20 bp, Artificial
  CRISPR gRNA sequence
gagacaagaagtgaagctgc

SEQ ID NO: 654262 - DNA, 20 bp, Artificial
  CRISPR gRNA sequence
cctgttttccagtaagtaat

SEQ ID NO: 654263 - DNA, 20 bp, Artificial
  CRISPR gRNA sequence
ttttccagtaagtaatggag

SEQ ID NO: 654264 - DNA, 20 bp, Artificial
  CRISPR gRNA sequence
tccagtaagtaatggagaaa

SEQ ID NO: 654265 - DNA, 20 bp, Artificial
  CRISPR gRNA sequence
ccagtaagtaatggagaaat

SEQ ID NO: 654266 - DNA, 20 bp, Artificial
  CRISPR gRNA sequence
cagtaagtaatggagaaatt

SEQ ID NO: 654267 - DNA, 20 bp, Artificial
  CRISPR gRNA sequence
caggagccagggctaaatat

SEQ ID NO: 654268 - DNA, 20 bp, Artificial
  CRISPR gRNA sequence
aatatacttggcgatcaata

SEQ ID NO: 654269 - DNA, 20 bp, Artificial
  CRISPR gRNA sequence
ggcgatcaatacagaaatgg

SEQ ID NO: 654270 - DNA, 20 bp, Artificial
  CRISPR gRNA sequence
gcgatcaatacagaaatggc

SEQ ID NO: 654271 - DNA, 20 bp, Artificial
  CRISPR gRNA sequence
attgtgaataatttagctgc

SEQ ID NO: 654272 - DNA, 20 bp, Artificial
  CRISPR gRNA sequence
tgaataatttagctgctggt

SEQ ID NO: 654273 - DNA, 20 bp, Artificial
  CRISPR gRNA sequence
agctgctggtgcagtgagag

SEQ ID NO: 654274 - DNA, 20 bp, Artificial
  CRISPR gRNA sequence
gctgctggtgcagtgagagt

SEQ ID NO: 654275 - DNA, 20 bp, Artificial
  CRISPR gRNA sequence
ctggtgcagtgagagttttg

SEQ ID NO: 654276 - DNA, 20 bp, Artificial
  CRISPR gRNA sequence
gtgcagtgagagttttgaaa

SEQ ID NO: 654277 - DNA, 20 bp, Artificial
  CRISPR gRNA sequence
tgaaactaaaggcaaaaagg

SEQ ID NO: 654278 - DNA, 20 bp, Artificial
  CRISPR gRNA sequence
gaaactaaaggcaaaaagga

SEQ ID NO: 654279 - DNA, 20 bp, Artificial
  CRISPR gRNA sequence
aaactaaaggcaaaaaggac

SEQ ID NO: 654280 - DNA, 20 bp, Artificial
  CRISPR gRNA sequence
aaggcaaaaaggaccaaggc

SEQ ID NO: 654281 - DNA, 20 bp, Artificial
  CRISPR gRNA sequence
ctcaggacttgtcaattctt

SEQ ID NO: 654282 - DNA, 20 bp, Artificial
  CRISPR gRNA sequence
tcaggacttgtcaattctta

SEQ ID NO: 654283 - DNA, 20 bp, Artificial
  CRISPR gRNA sequence
aggacttgtcaattcttaaa

SEQ ID NO: 654284 - DNA, 20 bp, Artificial
  CRISPR gRNA sequence
gtcaattcttaaactttttt

SEQ ID NO: 654285 - DNA, 20 bp, Artificial
  CRISPR gRNA sequence
tcaattcttaaacttttttc

SEQ ID NO: 654286 - DNA, 20 bp, Artificial
  CRISPR gRNA sequence
ttaaacttttttccccacag

SEQ ID NO: 654287 - DNA, 20 bp, Artificial
  CRISPR gRNA sequence
aaacttttttccccacagaa

SEQ ID NO: 654288 - DNA, 20 bp, Artificial
  CRISPR gRNA sequence
aacttttttccccacagaat

SEQ ID NO: 654289 - DNA, 20 bp, Artificial
  CRISPR gRNA sequence
ttttccccacagaatacagt

SEQ ID NO: 654290 - DNA, 20 bp, Artificial
  CRISPR gRNA sequence
tttccccacagaatacagtt

SEQ ID NO: 654291 - DNA, 20 bp, Artificial
  CRISPR gRNA sequence
ttccccacagaatacagtta

SEQ ID NO: 654292 - DNA, 20 bp, Artificial
  CRISPR gRNA sequence
tccccacagaatacagttag

SEQ ID NO: 654293 - DNA, 20 bp, Artificial
  CRISPR gRNA sequence
ccccacagaatacagttaga

SEQ ID NO: 654294 - DNA, 20 bp, Artificial
  CRISPR gRNA sequence
cccacagaatacagttagat

SEQ ID NO: 654295 - DNA, 20 bp, Artificial
  CRISPR gRNA sequence
gattatcgatcttttcatta

SEQ ID NO: 654296 - DNA, 20 bp, Artificial
  CRISPR gRNA sequence
tcgatcttttcattatgtga

SEQ ID NO: 654297 - DNA, 20 bp, Artificial
  CRISPR gRNA sequence
ttcattatgtgaatcaaagc

SEQ ID NO: 654298 - DNA, 20 bp, Artificial
  CRISPR gRNA sequence
tcattatgtgaatcaaagct

SEQ ID NO: 654299 - DNA, 20 bp, Artificial
  CRISPR gRNA sequence
cattatgtgaatcaaagcta

SEQ ID NO: 654300 - DNA, 20 bp, Artificial
  CRISPR gRNA sequence
attatgtgaatcaaagctag

SEQ ID NO: 654301 - DNA, 20 bp, Artificial
  CRISPR gRNA sequence
tgtgaatcaaagctaggggg

SEQ ID NO: 654302 - DNA, 20 bp, Artificial
  CRISPR gRNA sequence
gggggtgtcatctcatacag

SEQ ID NO: 654303 - DNA, 20 bp, Artificial
  CRISPR gRNA sequence
atacagtttacttttgtttc

SEQ ID NO: 654304 - DNA, 20 bp, Artificial
  CRISPR gRNA sequence
acttttgtttctgagaatta

SEQ ID NO: 654305 - DNA, 20 bp, Artificial
  CRISPR gRNA sequence
cttttgtttctgagaattat

SEQ ID NO: 654306 - DNA, 20 bp, Artificial
  CRISPR gRNA sequence
ttgtttctgagaattatgtt

SEQ ID NO: 654307 - DNA, 20 bp, Artificial
  CRISPR gRNA sequence
tgtttctgagaattatgttc

SEQ ID NO: 654308 - DNA, 20 bp, Artificial
  CRISPR gRNA sequence
gtttctgagaattatgttct

SEQ ID NO: 654309 - DNA, 20 bp, Artificial
  CRISPR gRNA sequence
tttctgagaattatgttctg

SEQ ID NO: 654310 - DNA, 20 bp, Artificial
  CRISPR gRNA sequence
ctgagaattatgttctgttg

SEQ ID NO: 654311 - DNA, 20 bp, Artificial
  CRISPR gRNA sequence
tgagaattatgttctgttgt

SEQ ID NO: 654312 - DNA, 20 bp, Artificial
  CRISPR gRNA sequence
agaattatgttctgttgtgt

SEQ ID NO: 654313 - DNA, 20 bp, Artificial
  CRISPR gRNA sequence
tgttctgttgtgtggcgttt

SEQ ID NO: 654314 - DNA, 20 bp, Artificial
  CRISPR gRNA sequence
tgttgtgtggcgtttgtgca

SEQ ID NO: 654315 - DNA, 20 bp, Artificial
  CRISPR gRNA sequence
ttgtgtggcgtttgtgcatg

SEQ ID NO: 654316 - DNA, 20 bp, Artificial
  CRISPR gRNA sequence
tgtggcgtttgtgcatgaga

SEQ ID NO: 654317 - DNA, 20 bp, Artificial
  CRISPR gRNA sequence
gtgcatgagaataattgccc

SEQ ID NO: 654318 - DNA, 20 bp, Artificial
  CRISPR gRNA sequence
tgcatgagaataattgccca

SEQ ID NO: 654319 - DNA, 20 bp, Artificial
  CRISPR gRNA sequence
cccaaagttttttttttttt

SEQ ID NO: 654320 - DNA, 20 bp, Artificial
  CRISPR gRNA sequence
tttttttttttaaatgattc

SEQ ID NO: 654321 - DNA, 20 bp, Artificial
  CRISPR gRNA sequence
ttttttttttaaatgattct

SEQ ID NO: 654322 - DNA, 20 bp, Artificial
  CRISPR gRNA sequence
tttttttttaaatgattctc

SEQ ID NO: 654323 - DNA, 20 bp, Artificial
  CRISPR gRNA sequence
ttttttttaaatgattctct

SEQ ID NO: 654324 - DNA, 20 bp, Artificial
  CRISPR gRNA sequence
tttttttaaatgattctctc

SEQ ID NO: 654325 - DNA, 20 bp, Artificial
  CRISPR gRNA sequence
ttttttaaatgattctctct

SEQ ID NO: 654326 - DNA, 20 bp, Artificial
  CRISPR gRNA sequence
tttttaaatgattctctcta

SEQ ID NO: 654327 - DNA, 20 bp, Artificial
  CRISPR gRNA sequence
ttttaaatgattctctctag

SEQ ID NO: 654328 - DNA, 20 bp, Artificial
  CRISPR gRNA sequence
tttaaatgattctctctagc

SEQ ID NO: 654329 - DNA, 20 bp, Artificial
  CRISPR gRNA sequence
ttaaatgattctctctagca

SEQ ID NO: 654330 - DNA, 20 bp, Artificial
  CRISPR gRNA sequence
taaatgattctctctagcac

SEQ ID NO: 654331 - DNA, 20 bp, Artificial
  CRISPR gRNA sequence
aaatgattctctctagcaca

SEQ ID NO: 654332 - DNA, 20 bp, Artificial
  CRISPR gRNA sequence
aatgattctctctagcacaa

SEQ ID NO: 654333 - DNA, 20 bp, Artificial
  CRISPR gRNA sequence
tctctagcacaaccaaagtt

SEQ ID NO: 654334 - DNA, 20 bp, Artificial
  CRISPR gRNA sequence
tctagcacaaccaaagttta

SEQ ID NO: 654335 - DNA, 20 bp, Artificial
  CRISPR gRNA sequence
tagcacaaccaaagtttatg

SEQ ID NO: 654336 - DNA, 20 bp, Artificial
  CRISPR gRNA sequence
gcacaaccaaagtttatgaa

SEQ ID NO: 654337 - DNA, 20 bp, Artificial
  CRISPR gRNA sequence
atgaaattttcaaaatcaga

SEQ ID NO: 654338 - DNA, 20 bp, Artificial
  CRISPR gRNA sequence
tgaaattttcaaaatcagac

SEQ ID NO: 654339 - DNA, 20 bp, Artificial
  CRISPR gRNA sequence
tcaaaatcagactgtattaa

SEQ ID NO: 654340 - DNA, 20 bp, Artificial
  CRISPR gRNA sequence
caaaatcagactgtattaag

SEQ ID NO: 654341 - DNA, 20 bp, Artificial
  CRISPR gRNA sequence
aaaatcagactgtattaagt

SEQ ID NO: 654342 - DNA, 20 bp, Artificial
  CRISPR gRNA sequence
tattaagtaggcttggcatt

SEQ ID NO: 654343 - DNA, 20 bp, Artificial
  CRISPR gRNA sequence
agtaggcttggcatttgtgt

SEQ ID NO: 654344 - DNA, 20 bp, Artificial
  CRISPR gRNA sequence
ggcatttgtgtccaagcatg

SEQ ID NO: 654345 - DNA, 20 bp, Artificial
  CRISPR gRNA sequence
gcatttgtgtccaagcatgg

SEQ ID NO: 654346 - DNA, 20 bp, Artificial
  CRISPR gRNA sequence
gtgtccaagcatggtctggc

SEQ ID NO: 654347 - DNA, 20 bp, Artificial
  CRISPR gRNA sequence
tgtccaagcatggtctggca

SEQ ID NO: 654348 - DNA, 20 bp, Artificial
  CRISPR gRNA sequence
gcaggaaattaaggttacat

SEQ ID NO: 654349 - DNA, 20 bp, Artificial
  CRISPR gRNA sequence
aggttacattgaacaggtgc

SEQ ID NO: 654350 - DNA, 20 bp, Artificial
  CRISPR gRNA sequence
cattgaacaggtgcttacac

SEQ ID NO: 654351 - DNA, 20 bp, Artificial
  CRISPR gRNA sequence
aacaggtgcttacacagaac

SEQ ID NO: 654352 - DNA, 20 bp, Artificial
  CRISPR gRNA sequence
acacagaacttggggtaggt

SEQ ID NO: 654353 - DNA, 20 bp, Artificial
  CRISPR gRNA sequence
cacagaacttggggtaggtt

SEQ ID NO: 654354 - DNA, 20 bp, Artificial
  CRISPR gRNA sequence
ggggtaggttaaaatgtcaa

SEQ ID NO: 654355 - DNA, 20 bp, Artificial
  CRISPR gRNA sequence
gggtaggttaaaatgtcaat

SEQ ID NO: 654356 - DNA, 20 bp, Artificial
  CRISPR gRNA sequence
aaatgtcaatacaagtcagg

SEQ ID NO: 654357 - DNA, 20 bp, Artificial
  CRISPR gRNA sequence
gccaactgctgtagaaatct

SEQ ID NO: 654358 - DNA, 20 bp, Artificial
  CRISPR gRNA sequence
ctgtagaaatcttcaagaca

SEQ ID NO: 654359 - DNA, 20 bp, Artificial
  CRISPR gRNA sequence
tagaaatcttcaagacaccg

SEQ ID NO: 654360 - DNA, 20 bp, Artificial
  CRISPR gRNA sequence
caagacaccgttgggcacta

SEQ ID NO: 654361 - DNA, 20 bp, Artificial
  CRISPR gRNA sequence
aagacaccgttgggcactaa

SEQ ID NO: 654362 - DNA, 20 bp, Artificial
  CRISPR gRNA sequence
ggcactaagttttttgtttt

SEQ ID NO: 654363 - DNA, 20 bp, Artificial
  CRISPR gRNA sequence
agttttttgttttgttttgt

SEQ ID NO: 654364 - DNA, 20 bp, Artificial
  CRISPR gRNA sequence
tttgttttgttttgttttct

SEQ ID NO: 654365 - DNA, 20 bp, Artificial
  CRISPR gRNA sequence
ttgttttgttttgttttctt

SEQ ID NO: 654366 - DNA, 20 bp, Artificial
  CRISPR gRNA sequence
tgttttgttttgttttctta

SEQ ID NO: 654367 - DNA, 20 bp, Artificial
  CRISPR gRNA sequence
gttttgttttgttttcttat

SEQ ID NO: 654368 - DNA, 20 bp, Artificial
  CRISPR gRNA sequence
ttttgttttgttttcttatg

SEQ ID NO: 654369 - DNA, 20 bp, Artificial
  CRISPR gRNA sequence
tgttttgttttcttatgttt

SEQ ID NO: 654370 - DNA, 20 bp, Artificial
  CRISPR gRNA sequence
gttttgttttcttatgtttg

SEQ ID NO: 654371 - DNA, 20 bp, Artificial
  CRISPR gRNA sequence
ttttgttttcttatgtttgt

SEQ ID NO: 654372 - DNA, 20 bp, Artificial
  CRISPR gRNA sequence
tgttttcttatgtttgtttg

SEQ ID NO: 654373 - DNA, 20 bp, Artificial
  CRISPR gRNA sequence
gttttcttatgtttgtttgt

SEQ ID NO: 654374 - DNA, 20 bp, Artificial
  CRISPR gRNA sequence
ttttcttatgtttgtttgtc

SEQ ID NO: 654375 - DNA, 20 bp, Artificial
  CRISPR gRNA sequence
tcttatgtttgtttgtcctc

SEQ ID NO: 654376 - DNA, 20 bp, Artificial
  CRISPR gRNA sequence
cttatgtttgtttgtcctcc

SEQ ID NO: 654377 - DNA, 20 bp, Artificial
  CRISPR gRNA sequence
ttatgtttgtttgtcctccc

SEQ ID NO: 654378 - DNA, 20 bp, Artificial
  CRISPR gRNA sequence
atgtttgtttgtcctccccc

SEQ ID NO: 654379 - DNA, 20 bp, Artificial
  CRISPR gRNA sequence
tgtttgtttgtcctccccct

SEQ ID NO: 654380 - DNA, 20 bp, Artificial
  CRISPR gRNA sequence
gtttgtcctccccctcccta

SEQ ID NO: 654381 - DNA, 20 bp, Artificial
  CRISPR gRNA sequence
tttgtcctccccctccctat

SEQ ID NO: 654382 - DNA, 20 bp, Artificial
  CRISPR gRNA sequence
gtcctccccctccctattag

SEQ ID NO: 654383 - DNA, 20 bp, Artificial
  CRISPR gRNA sequence
tcctccccctccctattaga

SEQ ID NO: 654384 - DNA, 20 bp, Artificial
  CRISPR gRNA sequence
cccctccctattagaacatg

SEQ ID NO: 654385 - DNA, 20 bp, Artificial
  CRISPR gRNA sequence
cctattagaacatgatgaac

SEQ ID NO: 654386 - DNA, 20 bp, Artificial
  CRISPR gRNA sequence
ttagaacatgatgaaccaac

SEQ ID NO: 654387 - DNA, 20 bp, Artificial
  CRISPR gRNA sequence
gaacatgatgaaccaacttg

SEQ ID NO: 654388 - DNA, 20 bp, Artificial
  CRISPR gRNA sequence
gcaacaattgtgaatagagc

SEQ ID NO: 654389 - DNA, 20 bp, Artificial
  CRISPR gRNA sequence
caacaattgtgaatagagct

SEQ ID NO: 654390 - DNA, 20 bp, Artificial
  CRISPR gRNA sequence
tgaatagagctatctgtata

SEQ ID NO: 654391 - DNA, 20 bp, Artificial
  CRISPR gRNA sequence
tctgtatactggggaagtcc

SEQ ID NO: 654392 - DNA, 20 bp, Artificial
  CRISPR gRNA sequence
tatactggggaagtcctcaa

SEQ ID NO: 654393 - DNA, 20 bp, Artificial
  CRISPR gRNA sequence
gggaagtcctcaaactgcag

SEQ ID NO: 654394 - DNA, 20 bp, Artificial
  CRISPR gRNA sequence
aaactgcagtgtgattgtgg

SEQ ID NO: 654395 - DNA, 20 bp, Artificial
  CRISPR gRNA sequence
cagtgtgattgtgggaagta

SEQ ID NO: 654396 - DNA, 20 bp, Artificial
  CRISPR gRNA sequence
tgggaagtagtgaatggtaa

SEQ ID NO: 654397 - DNA, 20 bp, Artificial
  CRISPR gRNA sequence
aaatcccagttaaagctgac

SEQ ID NO: 654398 - DNA, 20 bp, Artificial
  CRISPR gRNA sequence
aatcccagttaaagctgaca

SEQ ID NO: 654399 - DNA, 20 bp, Artificial
  CRISPR gRNA sequence
aagctgacacatttgagcta

SEQ ID NO: 654400 - DNA, 20 bp, Artificial
  CRISPR gRNA sequence
acacatttgagctatacccc

SEQ ID NO: 654401 - DNA, 20 bp, Artificial
  CRISPR gRNA sequence
gagctataccccctattttt

SEQ ID NO: 654402 - DNA, 20 bp, Artificial
  CRISPR gRNA sequence
agctataccccctatttttt

SEQ ID NO: 654403 - DNA, 20 bp, Artificial
  CRISPR gRNA sequence
taccccctattttttcttaa

SEQ ID NO: 654404 - DNA, 20 bp, Artificial
  CRISPR gRNA sequence
ttttttcttaaacccaataa

SEQ ID NO: 654405 - DNA, 20 bp, Artificial
  CRISPR gRNA sequence
tttcttaaacccaataaatt

SEQ ID NO: 654406 - DNA, 20 bp, Artificial
  CRISPR gRNA sequence
ttcttaaacccaataaattt

SEQ ID NO: 654407 - DNA, 20 bp, Artificial
  CRISPR gRNA sequence
tcttaaacccaataaatttt

SEQ ID NO: 654408 - DNA, 20 bp, Artificial
  CRISPR gRNA sequence
cttaaacccaataaattttg

SEQ ID NO: 654409 - DNA, 20 bp, Artificial
  CRISPR gRNA sequence
ttaaacccaataaattttga

SEQ ID NO: 654410 - DNA, 20 bp, Artificial
  CRISPR gRNA sequence
aaacccaataaattttgatt

SEQ ID NO: 654411 - DNA, 20 bp, Artificial
  CRISPR gRNA sequence
aacccaataaattttgatta

SEQ ID NO: 654412 - DNA, 20 bp, Artificial
  CRISPR gRNA sequence
tgattaagagagtcattccc

SEQ ID NO: 654413 - DNA, 20 bp, Artificial
  CRISPR gRNA sequence
gattaagagagtcattccct

SEQ ID NO: 654414 - DNA, 20 bp, Artificial
  CRISPR gRNA sequence
attaagagagtcattccctt

SEQ ID NO: 654415 - DNA, 20 bp, Artificial
  CRISPR gRNA sequence
agagagtcattccctttttg

SEQ ID NO: 654416 - DNA, 20 bp, Artificial
  CRISPR gRNA sequence
cctttttgctctagcccatc

SEQ ID NO: 654417 - DNA, 20 bp, Artificial
  CRISPR gRNA sequence
tttgctctagcccatctcac

SEQ ID NO: 654418 - DNA, 20 bp, Artificial
  CRISPR gRNA sequence
ttgctctagcccatctcaca

SEQ ID NO: 654419 - DNA, 20 bp, Artificial
  CRISPR gRNA sequence
tgctctagcccatctcacag

SEQ ID NO: 654420 - DNA, 20 bp, Artificial
  CRISPR gRNA sequence
gctctagcccatctcacagc

SEQ ID NO: 654421 - DNA, 20 bp, Artificial
  CRISPR gRNA sequence
ctctagcccatctcacagca

SEQ ID NO: 654422 - DNA, 20 bp, Artificial
  CRISPR gRNA sequence
tagcccatctcacagcacac

SEQ ID NO: 654423 - DNA, 20 bp, Artificial
  CRISPR gRNA sequence
gcccatctcacagcacactt

SEQ ID NO: 654424 - DNA, 20 bp, Artificial
  CRISPR gRNA sequence
acagcacacttatctttcct

SEQ ID NO: 654425 - DNA, 20 bp, Artificial
  CRISPR gRNA sequence
atctttcctatcctatctcc

SEQ ID NO: 654426 - DNA, 20 bp, Artificial
  CRISPR gRNA sequence
tctttcctatcctatctcca

SEQ ID NO: 654427 - DNA, 20 bp, Artificial
  CRISPR gRNA sequence
tcctatcctatctccagcag

SEQ ID NO: 654428 - DNA, 20 bp, Artificial
  CRISPR gRNA sequence
cctatcctatctccagcagg

SEQ ID NO: 654429 - DNA, 20 bp, Artificial
  CRISPR gRNA sequence
ctatcctatctccagcagga

SEQ ID NO: 654430 - DNA, 20 bp, Artificial
  CRISPR gRNA sequence
tcctatctccagcaggaatc

SEQ ID NO: 654431 - DNA, 20 bp, Artificial
  CRISPR gRNA sequence
tctccagcaggaatcagatc

SEQ ID NO: 654432 - DNA, 20 bp, Artificial
  CRISPR gRNA sequence
cagcaggaatcagatcattt

SEQ ID NO: 654433 - DNA, 20 bp, Artificial
  CRISPR gRNA sequence
gcagaaagagttcagtgact

SEQ ID NO: 654434 - DNA, 20 bp, Artificial
  CRISPR gRNA sequence
cagaaagagttcagtgactt

SEQ ID NO: 654435 - DNA, 20 bp, Artificial
  CRISPR gRNA sequence
agtgacttgcaaatgagcac

SEQ ID NO: 654436 - DNA, 20 bp, Artificial
  CRISPR gRNA sequence
gcaaatgagcacatacagta

SEQ ID NO: 654437 - DNA, 20 bp, Artificial
  CRISPR gRNA sequence
caaatgagcacatacagtac

SEQ ID NO: 654438 - DNA, 20 bp, Artificial
  CRISPR gRNA sequence
tgtatgtttctgggcacagg

SEQ ID NO: 654439 - DNA, 20 bp, Artificial
  CRISPR gRNA sequence
ctgggcacaggtggcagcag

SEQ ID NO: 654440 - DNA, 20 bp, Artificial
  CRISPR gRNA sequence
tgggcacaggtggcagcagc

SEQ ID NO: 654441 - DNA, 20 bp, Artificial
  CRISPR gRNA sequence
ggcacaggtggcagcagcaa

SEQ ID NO: 654442 - DNA, 20 bp, Artificial
  CRISPR gRNA sequence
actgcttggagcttcaaata

SEQ ID NO: 654443 - DNA, 20 bp, Artificial
  CRISPR gRNA sequence
cttggagcttcaaataagtt

SEQ ID NO: 654444 - DNA, 20 bp, Artificial
  CRISPR gRNA sequence
ggagcttcaaataagttaag

SEQ ID NO: 654445 - DNA, 20 bp, Artificial
  CRISPR gRNA sequence
gagcttcaaataagttaaga

SEQ ID NO: 654446 - DNA, 20 bp, Artificial
  CRISPR gRNA sequence
caaataagttaagaatttaa

SEQ ID NO: 654447 - DNA, 20 bp, Artificial
  CRISPR gRNA sequence
aaataagttaagaatttaat

SEQ ID NO: 654448 - DNA, 20 bp, Artificial
  CRISPR gRNA sequence
agaatttaatggcagatact

SEQ ID NO: 654449 - DNA, 20 bp, Artificial
  CRISPR gRNA sequence
aatggcagatactgaaagga

SEQ ID NO: 654450 - DNA, 20 bp, Artificial
  CRISPR gRNA sequence
atggcagatactgaaaggaa

SEQ ID NO: 654451 - DNA, 20 bp, Artificial
  CRISPR gRNA sequence
aaaggaatcattgtattaag

SEQ ID NO: 654452 - DNA, 20 bp, Artificial
  CRISPR gRNA sequence
tattaagggtataatctttt

SEQ ID NO: 654453 - DNA, 20 bp, Artificial
  CRISPR gRNA sequence
agggtataatcttttgtttt

SEQ ID NO: 654454 - DNA, 20 bp, Artificial
  CRISPR gRNA sequence
ttgttttgcagcattgcact

SEQ ID NO: 654455 - DNA, 20 bp, Artificial
  CRISPR gRNA sequence
tgttttgcagcattgcactt

SEQ ID NO: 654456 - DNA, 20 bp, Artificial
  CRISPR gRNA sequence
gttttgcagcattgcacttt

SEQ ID NO: 654457 - DNA, 20 bp, Artificial
  CRISPR gRNA sequence
ttttgcagcattgcactttg

SEQ ID NO: 654458 - DNA, 20 bp, Artificial
  CRISPR gRNA sequence
tgcagcattgcactttgact

SEQ ID NO: 654459 - DNA, 20 bp, Artificial
  CRISPR gRNA sequence
gcagcattgcactttgacta

SEQ ID NO: 654460 - DNA, 20 bp, Artificial
  CRISPR gRNA sequence
cagcattgcactttgactat

SEQ ID NO: 654461 - DNA, 20 bp, Artificial
  CRISPR gRNA sequence
cactttgactatggaaacag

SEQ ID NO: 654462 - DNA, 20 bp, Artificial
  CRISPR gRNA sequence
tgactatggaaacagaggct

SEQ ID NO: 654463 - DNA, 20 bp, Artificial
  CRISPR gRNA sequence
gactatggaaacagaggcta

SEQ ID NO: 654464 - DNA, 20 bp, Artificial
  CRISPR gRNA sequence
actatggaaacagaggctat

SEQ ID NO: 654465 - DNA, 20 bp, Artificial
  CRISPR gRNA sequence
tggaaacagaggctattgat

SEQ ID NO: 654466 - DNA, 20 bp, Artificial
  CRISPR gRNA sequence
ttgatggctatataacgtgt

SEQ ID NO: 654467 - DNA, 20 bp, Artificial
  CRISPR gRNA sequence
atggctatataacgtgtaag

SEQ ID NO: 654468 - DNA, 20 bp, Artificial
  CRISPR gRNA sequence
tataacgtgtaagtattagt

SEQ ID NO: 654469 - DNA, 20 bp, Artificial
  CRISPR gRNA sequence
gttttcattgatttgttatt

SEQ ID NO: 654470 - DNA, 20 bp, Artificial
  CRISPR gRNA sequence
tcattgatttgttattggta

SEQ ID NO: 654471 - DNA, 20 bp, Artificial
  CRISPR gRNA sequence
cattgatttgttattggtaa

SEQ ID NO: 654472 - DNA, 20 bp, Artificial
  CRISPR gRNA sequence
attgatttgttattggtaat

SEQ ID NO: 654473 - DNA, 20 bp, Artificial
  CRISPR gRNA sequence
atttgttattggtaataaag

SEQ ID NO: 654474 - DNA, 20 bp, Artificial
  CRISPR gRNA sequence
gttattggtaataaagttgc

SEQ ID NO: 654475 - DNA, 20 bp, Artificial
  CRISPR gRNA sequence
ttattggtaataaagttgcc

SEQ ID NO: 654476 - DNA, 20 bp, Artificial
  CRISPR gRNA sequence
ttggtaataaagttgccttt

SEQ ID NO: 654477 - DNA, 20 bp, Artificial
  CRISPR gRNA sequence
gtaataaagttgcctttgta

SEQ ID NO: 654478 - DNA, 20 bp, Artificial
  CRISPR gRNA sequence
cctttgtattacctgtgttt

SEQ ID NO: 654479 - DNA, 20 bp, Artificial
  CRISPR gRNA sequence
tgtattacctgtgttttaat

SEQ ID NO: 654480 - DNA, 20 bp, Artificial
  CRISPR gRNA sequence
gtattacctgtgttttaatt

SEQ ID NO: 654481 - DNA, 20 bp, Artificial
  CRISPR gRNA sequence
tattacctgtgttttaattc

SEQ ID NO: 654482 - DNA, 20 bp, Artificial
  CRISPR gRNA sequence
cctgtgttttaattcctgga

SEQ ID NO: 654483 - DNA, 20 bp, Artificial
  CRISPR gRNA sequence
tgttttaattcctggattat

SEQ ID NO: 654484 - DNA, 20 bp, Artificial
  CRISPR gRNA sequence
taattcctggattatgaaac

SEQ ID NO: 654485 - DNA, 20 bp, Artificial
  CRISPR gRNA sequence
aattcctggattatgaaact

SEQ ID NO: 654486 - DNA, 20 bp, Artificial
  CRISPR gRNA sequence
attcctggattatgaaactt

SEQ ID NO: 654487 - DNA, 20 bp, Artificial
  CRISPR gRNA sequence
ctggattatgaaactttatt

SEQ ID NO: 654488 - DNA, 20 bp, Artificial
  CRISPR gRNA sequence
gattatgaaactttattgag

SEQ ID NO: 654489 - DNA, 20 bp, Artificial
  CRISPR gRNA sequence
tgaaactttattgagaattc

SEQ ID NO: 654490 - DNA, 20 bp, Artificial
  CRISPR gRNA sequence
tattgagaattctgtactct

SEQ ID NO: 654491 - DNA, 20 bp, Artificial
  CRISPR gRNA sequence
attgagaattctgtactctt

SEQ ID NO: 654492 - DNA, 20 bp, Artificial
  CRISPR gRNA sequence
ttgagaattctgtactcttt

SEQ ID NO: 654493 - DNA, 20 bp, Artificial
  CRISPR gRNA sequence
agaattctgtactctttttt

SEQ ID NO: 654494 - DNA, 20 bp, Artificial
  CRISPR gRNA sequence
tgtactcttttttctctctg

SEQ ID NO: 654495 - DNA, 20 bp, Artificial
  CRISPR gRNA sequence
tactcttttttctctctgtt

SEQ ID NO: 654496 - DNA, 20 bp, Artificial
  CRISPR gRNA sequence
ttttttctctctgttcacaa

SEQ ID NO: 654497 - DNA, 20 bp, Artificial
  CRISPR gRNA sequence
ttttctctctgttcacaatt

SEQ ID NO: 654498 - DNA, 20 bp, Artificial
  CRISPR gRNA sequence
tttctctctgttcacaattt

SEQ ID NO: 654499 - DNA, 20 bp, Artificial
  CRISPR gRNA sequence
ttctctctgttcacaatttc

SEQ ID NO: 654500 - DNA, 20 bp, Artificial
  CRISPR gRNA sequence
tctctctgttcacaatttca

SEQ ID NO: 654501 - DNA, 20 bp, Artificial
  CRISPR gRNA sequence
ctctctgttcacaatttcac

SEQ ID NO: 654502 - DNA, 20 bp, Artificial
  CRISPR gRNA sequence
tctctgttcacaatttcacc

SEQ ID NO: 654503 - DNA, 20 bp, Artificial
  CRISPR gRNA sequence
tctgttcacaatttcacctt

SEQ ID NO: 654504 - DNA, 20 bp, Artificial
  CRISPR gRNA sequence
tgttcacaatttcacctttg

SEQ ID NO: 654505 - DNA, 20 bp, Artificial
  CRISPR gRNA sequence
ttcacaatttcacctttgaa

SEQ ID NO: 654506 - DNA, 20 bp, Artificial
  CRISPR gRNA sequence
acaatttcacctttgaatga

SEQ ID NO: 654507 - DNA, 20 bp, Artificial
  CRISPR gRNA sequence
cacctttgaatgagtttgag

SEQ ID NO: 654508 - DNA, 20 bp, Artificial
  CRISPR gRNA sequence
acctttgaatgagtttgaga

SEQ ID NO: 654509 - DNA, 20 bp, Artificial
  CRISPR gRNA sequence
tgaatgagtttgagaaaatg

SEQ ID NO: 654510 - DNA, 20 bp, Artificial
  CRISPR gRNA sequence
gaatgagtttgagaaaatga

SEQ ID NO: 654511 - DNA, 20 bp, Artificial
  CRISPR gRNA sequence
aatgagtttgagaaaatgac

SEQ ID NO: 654512 - DNA, 20 bp, Artificial
  CRISPR gRNA sequence
gagaaaatgacagcactgaa

SEQ ID NO: 654513 - DNA, 20 bp, Artificial
  CRISPR gRNA sequence
agaaaatgacagcactgaag

SEQ ID NO: 654514 - DNA, 20 bp, Artificial
  CRISPR gRNA sequence
aagtgaaataagaaggaaat

SEQ ID NO: 654515 - DNA, 20 bp, Artificial
  CRISPR gRNA sequence
agttaagtagtgtacttaaa

SEQ ID NO: 654516 - DNA, 20 bp, Artificial
  CRISPR gRNA sequence
agtagtgtacttaaatcaat

SEQ ID NO: 654517 - DNA, 20 bp, Artificial
  CRISPR gRNA sequence
aaatcaatagtagctagcag

SEQ ID NO: 654518 - DNA, 20 bp, Artificial
  CRISPR gRNA sequence
aatcaatagtagctagcagt

SEQ ID NO: 654519 - DNA, 20 bp, Artificial
  CRISPR gRNA sequence
gcagttcaacactttcctac

SEQ ID NO: 654520 - DNA, 20 bp, Artificial
  CRISPR gRNA sequence
aacactttcctactttttat

SEQ ID NO: 654521 - DNA, 20 bp, Artificial
  CRISPR gRNA sequence
tcctactttttataatttac

SEQ ID NO: 654522 - DNA, 20 bp, Artificial
  CRISPR gRNA sequence
cctactttttataatttact

SEQ ID NO: 654523 - DNA, 20 bp, Artificial
  CRISPR gRNA sequence
ctactttttataatttactt

SEQ ID NO: 654524 - DNA, 20 bp, Artificial
  CRISPR gRNA sequence
ctttttataatttactttgt

SEQ ID NO: 654525 - DNA, 20 bp, Artificial
  CRISPR gRNA sequence
tttataatttactttgttgt

SEQ ID NO: 654526 - DNA, 20 bp, Artificial
  CRISPR gRNA sequence
ttataatttactttgttgta

SEQ ID NO: 654527 - DNA, 20 bp, Artificial
  CRISPR gRNA sequence
tataatttactttgttgtaa

SEQ ID NO: 654528 - DNA, 20 bp, Artificial
  CRISPR gRNA sequence
ataatttactttgttgtaag

SEQ ID NO: 654529 - DNA, 20 bp, Artificial
  CRISPR gRNA sequence
taatttactttgttgtaagt

SEQ ID NO: 654530 - DNA, 20 bp, Artificial
  CRISPR gRNA sequence
actttgttgtaagttgagaa

SEQ ID NO: 654531 - DNA, 20 bp, Artificial
  CRISPR gRNA sequence
ctttgttgtaagttgagaat

SEQ ID NO: 654532 - DNA, 20 bp, Artificial
  CRISPR gRNA sequence
tgttgtaagttgagaatagg

SEQ ID NO: 654533 - DNA, 20 bp, Artificial
  CRISPR gRNA sequence
gttgtaagttgagaataggc

SEQ ID NO: 654534 - DNA, 20 bp, Artificial
  CRISPR gRNA sequence
ttgtaagttgagaataggcc

SEQ ID NO: 654535 - DNA, 20 bp, Artificial
  CRISPR gRNA sequence
taagttgagaataggccagg

SEQ ID NO: 654536 - DNA, 20 bp, Artificial
  CRISPR gRNA sequence
agaataggccaggtttcata

SEQ ID NO: 654537 - DNA, 20 bp, Artificial
  CRISPR gRNA sequence
catatatgtctattaatatg

SEQ ID NO: 654538 - DNA, 20 bp, Artificial
  CRISPR gRNA sequence
atatatgtctattaatatgg

SEQ ID NO: 654539 - DNA, 20 bp, Artificial
  CRISPR gRNA sequence
ttaatatggtgtgtactaaa

SEQ ID NO: 654540 - DNA, 20 bp, Artificial
  CRISPR gRNA sequence
atatggtgtgtactaaatat

SEQ ID NO: 654541 - DNA, 20 bp, Artificial
  CRISPR gRNA sequence
aatatttacttctctgtaac

SEQ ID NO: 654542 - DNA, 20 bp, Artificial
  CRISPR gRNA sequence
acttctctgtaacctaattt

SEQ ID NO: 654543 - DNA, 20 bp, Artificial
  CRISPR gRNA sequence
cttctctgtaacctaatttt

SEQ ID NO: 654544 - DNA, 20 bp, Artificial
  CRISPR gRNA sequence
ctctgtaacctaatttttca

SEQ ID NO: 654545 - DNA, 20 bp, Artificial
  CRISPR gRNA sequence
tctgtaacctaatttttcag

SEQ ID NO: 654546 - DNA, 20 bp, Artificial
  CRISPR gRNA sequence
tgtaacctaatttttcagac

SEQ ID NO: 654547 - DNA, 20 bp, Artificial
  CRISPR gRNA sequence
taacctaatttttcagacat

SEQ ID NO: 654548 - DNA, 20 bp, Artificial
  CRISPR gRNA sequence
atttttcagacatattatgt

SEQ ID NO: 654549 - DNA, 20 bp, Artificial
  CRISPR gRNA sequence
ttcagacatattatgtgaaa

SEQ ID NO: 654550 - DNA, 20 bp, Artificial
  CRISPR gRNA sequence
tcagacatattatgtgaaag

SEQ ID NO: 654551 - DNA, 20 bp, Artificial
  CRISPR gRNA sequence
cagacatattatgtgaaaga

SEQ ID NO: 654552 - DNA, 20 bp, Artificial
  CRISPR gRNA sequence
agacatattatgtgaaagag

SEQ ID NO: 654553 - DNA, 20 bp, Artificial
  CRISPR gRNA sequence
tgtgaaagagaattagcttt

SEQ ID NO: 654554 - DNA, 20 bp, Artificial
  CRISPR gRNA sequence
gctttcctaacttgacattt

SEQ ID NO: 654555 - DNA, 20 bp, Artificial
  CRISPR gRNA sequence
tcctaacttgacatttcttt

SEQ ID NO: 654556 - DNA, 20 bp, Artificial
  CRISPR gRNA sequence
cctaacttgacatttcttta

SEQ ID NO: 654557 - DNA, 20 bp, Artificial
  CRISPR gRNA sequence
ctaacttgacatttctttag

SEQ ID NO: 654558 - DNA, 20 bp, Artificial
  CRISPR gRNA sequence
acttgacatttctttagcta

SEQ ID NO: 654559 - DNA, 20 bp, Artificial
  CRISPR gRNA sequence
gacatttctttagctacctg

SEQ ID NO: 654560 - DNA, 20 bp, Artificial
  CRISPR gRNA sequence
acatttctttagctacctgt

SEQ ID NO: 654561 - DNA, 20 bp, Artificial
  CRISPR gRNA sequence
ctttagctacctgtcttttc

SEQ ID NO: 654562 - DNA, 20 bp, Artificial
  CRISPR gRNA sequence
tttagctacctgtcttttcc

SEQ ID NO: 654563 - DNA, 20 bp, Artificial
  CRISPR gRNA sequence
tagctacctgtcttttccat

SEQ ID NO: 654564 - DNA, 20 bp, Artificial
  CRISPR gRNA sequence
agctacctgtcttttccatc

SEQ ID NO: 654565 - DNA, 20 bp, Artificial
  CRISPR gRNA sequence
gctacctgtcttttccatcc

SEQ ID NO: 654566 - DNA, 20 bp, Artificial
  CRISPR gRNA sequence
cctgtcttttccatcctctc

SEQ ID NO: 654567 - DNA, 20 bp, Artificial
  CRISPR gRNA sequence
tcttttccatcctctctctg

SEQ ID NO: 654568 - DNA, 20 bp, Artificial
  CRISPR gRNA sequence
ttccatcctctctctgatag

SEQ ID NO: 654569 - DNA, 20 bp, Artificial
  CRISPR gRNA sequence
tccatcctctctctgatagc

SEQ ID NO: 654570 - DNA, 20 bp, Artificial
  CRISPR gRNA sequence
ccatcctctctctgatagcc

SEQ ID NO: 654571 - DNA, 20 bp, Artificial
  CRISPR gRNA sequence
catcctctctctgatagcca

SEQ ID NO: 654572 - DNA, 20 bp, Artificial
  CRISPR gRNA sequence
tctctgatagccagcatttt

SEQ ID NO: 654573 - DNA, 20 bp, Artificial
  CRISPR gRNA sequence
tctgatagccagcattttgg

SEQ ID NO: 654574 - DNA, 20 bp, Artificial
  CRISPR gRNA sequence
tgatagccagcattttggaa

SEQ ID NO: 654575 - DNA, 20 bp, Artificial
  CRISPR gRNA sequence
atagccagcattttggaaaa

SEQ ID NO: 654576 - DNA, 20 bp, Artificial
  CRISPR gRNA sequence
tggaaaatgctcattataaa

SEQ ID NO: 654577 - DNA, 20 bp, Artificial
  CRISPR gRNA sequence
ggaaaatgctcattataaat

SEQ ID NO: 654578 - DNA, 20 bp, Artificial
  CRISPR gRNA sequence
gaaaatgctcattataaatt

SEQ ID NO: 654579 - DNA, 20 bp, Artificial
  CRISPR gRNA sequence
attataaattctgtgtgctt

SEQ ID NO: 654580 - DNA, 20 bp, Artificial
  CRISPR gRNA sequence
taaattctgtgtgcttaaca

SEQ ID NO: 654581 - DNA, 20 bp, Artificial
  CRISPR gRNA sequence
tgtgtgcttaacaattaaat

SEQ ID NO: 654582 - DNA, 20 bp, Artificial
  CRISPR gRNA sequence
tgtgcttaacaattaaatta

SEQ ID NO: 654583 - DNA, 20 bp, Artificial
  CRISPR gRNA sequence
aacaattaaattagatgtta

SEQ ID NO: 654584 - DNA, 20 bp, Artificial
  CRISPR gRNA sequence
acaattaaattagatgttaa

SEQ ID NO: 654585 - DNA, 20 bp, Artificial
  CRISPR gRNA sequence
aattagatgttaaaagaaaa

SEQ ID NO: 654586 - DNA, 20 bp, Artificial
  CRISPR gRNA sequence
gatgttaaaagaaaagttat

SEQ ID NO: 654587 - DNA, 20 bp, Artificial
  CRISPR gRNA sequence
aaagaaaagttatttctttc

SEQ ID NO: 654588 - DNA, 20 bp, Artificial
  CRISPR gRNA sequence
tttctttcaactgaaagata

SEQ ID NO: 654589 - DNA, 20 bp, Artificial
  CRISPR gRNA sequence
ctttcaactgaaagatactt

SEQ ID NO: 654590 - DNA, 20 bp, Artificial
  CRISPR gRNA sequence
tttcaactgaaagatacttt

SEQ ID NO: 654591 - DNA, 20 bp, Artificial
  CRISPR gRNA sequence
tcaactgaaagatactttag

SEQ ID NO: 654592 - DNA, 20 bp, Artificial
  CRISPR gRNA sequence
caactgaaagatactttaga

SEQ ID NO: 654593 - DNA, 20 bp, Artificial
  CRISPR gRNA sequence
aactgaaagatactttagaa

SEQ ID NO: 654594 - DNA, 20 bp, Artificial
  CRISPR gRNA sequence
aaagatactttagaaatcaa

SEQ ID NO: 654595 - DNA, 20 bp, Artificial
  CRISPR gRNA sequence
tagaaatcaacaacttatgt

SEQ ID NO: 654596 - DNA, 20 bp, Artificial
  CRISPR gRNA sequence
agaaatcaacaacttatgta

SEQ ID NO: 654597 - DNA, 20 bp, Artificial
  CRISPR gRNA sequence
gaaatcaacaacttatgtat

SEQ ID NO: 654598 - DNA, 20 bp, Artificial
  CRISPR gRNA sequence
atgtattgagataataaagt

SEQ ID NO: 654599 - DNA, 20 bp, Artificial
  CRISPR gRNA sequence
tgtattgagataataaagtt

SEQ ID NO: 654600 - DNA, 20 bp, Artificial
  CRISPR gRNA sequence
agataataaagttttgttaa

SEQ ID NO: 654601 - DNA, 20 bp, Artificial
  CRISPR gRNA sequence
tgttaattttttttattgtg

SEQ ID NO: 654602 - DNA, 20 bp, Artificial
  CRISPR gRNA sequence
gttaattttttttattgtgg

SEQ ID NO: 654603 - DNA, 20 bp, Artificial
  CRISPR gRNA sequence
ttaattttttttattgtggg

SEQ ID NO: 654604 - DNA, 20 bp, Artificial
  CRISPR gRNA sequence
attttttttattgtgggttg

SEQ ID NO: 654605 - DNA, 20 bp, Artificial
  CRISPR gRNA sequence
tttttattgtgggttgatta

SEQ ID NO: 654606 - DNA, 20 bp, Artificial
  CRISPR gRNA sequence
ttttattgtgggttgattat

SEQ ID NO: 654607 - DNA, 20 bp, Artificial
  CRISPR gRNA sequence
tttattgtgggttgattatg

SEQ ID NO: 654608 - DNA, 20 bp, Artificial
  CRISPR gRNA sequence
ttattgtgggttgattatgg

SEQ ID NO: 654609 - DNA, 20 bp, Artificial
  CRISPR gRNA sequence
tattgtgggttgattatggc

SEQ ID NO: 654610 - DNA, 20 bp, Artificial
  CRISPR gRNA sequence
attgtgggttgattatggct

SEQ ID NO: 654611 - DNA, 20 bp, Artificial
  CRISPR gRNA sequence
ttgtgggttgattatggctt

SEQ ID NO: 654612 - DNA, 20 bp, Artificial
  CRISPR gRNA sequence
tgggttgattatggcttctc

SEQ ID NO: 654613 - DNA, 20 bp, Artificial
  CRISPR gRNA sequence
attatggcttctcatcattt

SEQ ID NO: 654614 - DNA, 20 bp, Artificial
  CRISPR gRNA sequence
tggcttctcatcatttcatt

SEQ ID NO: 654615 - DNA, 20 bp, Artificial
  CRISPR gRNA sequence
ctcatcatttcattcaactg

SEQ ID NO: 654616 - DNA, 20 bp, Artificial
  CRISPR gRNA sequence
tcatcatttcattcaactgt

SEQ ID NO: 654617 - DNA, 20 bp, Artificial
  CRISPR gRNA sequence
atcatttcattcaactgtat

SEQ ID NO: 654618 - DNA, 20 bp, Artificial
  CRISPR gRNA sequence
cattcaactgtatatttcta

SEQ ID NO: 654619 - DNA, 20 bp, Artificial
  CRISPR gRNA sequence
attcaactgtatatttctaa

SEQ ID NO: 654620 - DNA, 20 bp, Artificial
  CRISPR gRNA sequence
aactgtatatttctaaatga

SEQ ID NO: 654621 - DNA, 20 bp, Artificial
  CRISPR gRNA sequence
tatatttctaaatgatattt

SEQ ID NO: 654622 - DNA, 20 bp, Artificial
  CRISPR gRNA sequence
ctaaatgatatttccttata

SEQ ID NO: 654623 - DNA, 20 bp, Artificial
  CRISPR gRNA sequence
taaatgatatttccttatag

SEQ ID NO: 654624 - DNA, 20 bp, Artificial
  CRISPR gRNA sequence
aatgatatttccttatagtt

SEQ ID NO: 654625 - DNA, 20 bp, Artificial
  CRISPR gRNA sequence
ccttatagtttctaagggaa

SEQ ID NO: 654626 - DNA, 20 bp, Artificial
  CRISPR gRNA sequence
cttatagtttctaagggaaa

SEQ ID NO: 654627 - DNA, 20 bp, Artificial
  CRISPR gRNA sequence
atagtttctaagggaaaaat

SEQ ID NO: 654628 - DNA, 20 bp, Artificial
  CRISPR gRNA sequence
tagtttctaagggaaaaatg

SEQ ID NO: 654629 - DNA, 20 bp, Artificial
  CRISPR gRNA sequence
ctaagggaaaaatgtattac

SEQ ID NO: 654630 - DNA, 20 bp, Artificial
  CRISPR gRNA sequence
taagggaaaaatgtattacc

SEQ ID NO: 654631 - DNA, 20 bp, Artificial
  CRISPR gRNA sequence
agggaaaaatgtattacctt

SEQ ID NO: 654632 - DNA, 20 bp, Artificial
  CRISPR gRNA sequence
ccttacagtttgaaggctat

SEQ ID NO: 654633 - DNA, 20 bp, Artificial
  CRISPR gRNA sequence
acagtttgaaggctatgcat

SEQ ID NO: 654634 - DNA, 20 bp, Artificial
  CRISPR gRNA sequence
cagtttgaaggctatgcatg

SEQ ID NO: 654635 - DNA, 20 bp, Artificial
  CRISPR gRNA sequence
gaaggctatgcatgccattg

SEQ ID NO: 654636 - DNA, 20 bp, Artificial
  CRISPR gRNA sequence
aaggctatgcatgccattgc

SEQ ID NO: 654637 - DNA, 20 bp, Artificial
  CRISPR gRNA sequence
tgcatgccattgcgtgtata

SEQ ID NO: 654638 - DNA, 20 bp, Artificial
  CRISPR gRNA sequence
cgtgtataaagcaaagttag

SEQ ID NO: 654639 - DNA, 20 bp, Artificial
  CRISPR gRNA sequence
gtaattacatcttatgtgac

SEQ ID NO: 654640 - DNA, 20 bp, Artificial
  CRISPR gRNA sequence
catcttatgtgacaatgaat

SEQ ID NO: 654641 - DNA, 20 bp, Artificial
  CRISPR gRNA sequence
atgtgacaatgaatagaaac

SEQ ID NO: 654642 - DNA, 20 bp, Artificial
  CRISPR gRNA sequence
tgtgacaatgaatagaaacc

SEQ ID NO: 654643 - DNA, 20 bp, Artificial
  CRISPR gRNA sequence
tattttgtgaaagcaggtga

SEQ ID NO: 654644 - DNA, 20 bp, Artificial
  CRISPR gRNA sequence
tgtgaaagcaggtgacaatg

SEQ ID NO: 654645 - DNA, 20 bp, Artificial
  CRISPR gRNA sequence
gtgaaagcaggtgacaatga

SEQ ID NO: 654646 - DNA, 20 bp, Artificial
  CRISPR gRNA sequence
tgaaagcaggtgacaatgag

SEQ ID NO: 654647 - DNA, 20 bp, Artificial
  CRISPR gRNA sequence
tcacccgaaagggagcactc

SEQ ID NO: 654648 - DNA, 20 bp, Artificial
  CRISPR gRNA sequence
cacccgaaagggagcactcc

SEQ ID NO: 654649 - DNA, 20 bp, Artificial
  CRISPR gRNA sequence
acccgaaagggagcactcca

SEQ ID NO: 654650 - DNA, 20 bp, Artificial
  CRISPR gRNA sequence
caatatggcaattgacctca

SEQ ID NO: 654651 - DNA, 20 bp, Artificial
  CRISPR gRNA sequence
acctcacctcaagcacaccc

SEQ ID NO: 654652 - DNA, 20 bp, Artificial
  CRISPR gRNA sequence
acctcaagcacacccaatgg

SEQ ID NO: 654653 - DNA, 20 bp, Artificial
  CRISPR gRNA sequence
aagcacacccaatggacagc

SEQ ID NO: 654654 - DNA, 20 bp, Artificial
  CRISPR gRNA sequence
accaagtcacatgacaagca

SEQ ID NO: 654655 - DNA, 20 bp, Artificial
  CRISPR gRNA sequence
cattttatgatttttttttg

SEQ ID NO: 654656 - DNA, 20 bp, Artificial
  CRISPR gRNA sequence
attttatgatttttttttgt

SEQ ID NO: 654657 - DNA, 20 bp, Artificial
  CRISPR gRNA sequence
tatgatttttttttgtgtgt

SEQ ID NO: 654658 - DNA, 20 bp, Artificial
  CRISPR gRNA sequence
atgatttttttttgtgtgtg

SEQ ID NO: 654659 - DNA, 20 bp, Artificial
  CRISPR gRNA sequence
tgatttttttttgtgtgtgt

SEQ ID NO: 654660 - DNA, 20 bp, Artificial
  CRISPR gRNA sequence
ttttttgtgtgtgtgtgtct

SEQ ID NO: 654661 - DNA, 20 bp, Artificial
  CRISPR gRNA sequence
tttttgtgtgtgtgtgtctc

SEQ ID NO: 654662 - DNA, 20 bp, Artificial
  CRISPR gRNA sequence
ttttgtgtgtgtgtgtctct

SEQ ID NO: 654663 - DNA, 20 bp, Artificial
  CRISPR gRNA sequence
tttgtgtgtgtgtgtctctc

SEQ ID NO: 654664 - DNA, 20 bp, Artificial
  CRISPR gRNA sequence
ttgtgtgtgtgtgtctctcc

SEQ ID NO: 654665 - DNA, 20 bp, Artificial
  CRISPR gRNA sequence
tgtgtgtgtgtgtctctcca

SEQ ID NO: 654666 - DNA, 20 bp, Artificial
  CRISPR gRNA sequence
gtgtgtgtgtgtctctccag

SEQ ID NO: 654667 - DNA, 20 bp, Artificial
  CRISPR gRNA sequence
tgtgtgtgtgtctctccagc

SEQ ID NO: 654668 - DNA, 20 bp, Artificial
  CRISPR gRNA sequence
tccagcaacagactttaatt

SEQ ID NO: 654669 - DNA, 20 bp, Artificial
  CRISPR gRNA sequence
cagcaacagactttaatttg

SEQ ID NO: 654670 - DNA, 20 bp, Artificial
  CRISPR gRNA sequence
taatttgttaggtctgtggg

SEQ ID NO: 654671 - DNA, 20 bp, Artificial
  CRISPR gRNA sequence
aatttgttaggtctgtgggg

SEQ ID NO: 654672 - DNA, 20 bp, Artificial
  CRISPR gRNA sequence
atttgttaggtctgtggggt

SEQ ID NO: 654673 - DNA, 20 bp, Artificial
  CRISPR gRNA sequence
gttaggtctgtggggtcctc

SEQ ID NO: 654674 - DNA, 20 bp, Artificial
  CRISPR gRNA sequence
ttaggtctgtggggtcctct

SEQ ID NO: 654675 - DNA, 20 bp, Artificial
  CRISPR gRNA sequence
ggtctgtggggtcctctcac

SEQ ID NO: 654676 - DNA, 20 bp, Artificial
  CRISPR gRNA sequence
tggggtcctctcacattgtg

SEQ ID NO: 654677 - DNA, 20 bp, Artificial
  CRISPR gRNA sequence
tcacattgtggtatagctac

SEQ ID NO: 654678 - DNA, 20 bp, Artificial
  CRISPR gRNA sequence
acattgtggtatagctactg

SEQ ID NO: 654679 - DNA, 20 bp, Artificial
  CRISPR gRNA sequence
tggtatagctactgttatag

SEQ ID NO: 654680 - DNA, 20 bp, Artificial
  CRISPR gRNA sequence
ctgttatagattttgctaaa

SEQ ID NO: 654681 - DNA, 20 bp, Artificial
  CRISPR gRNA sequence
ttatagattttgctaaagaa

SEQ ID NO: 654682 - DNA, 20 bp, Artificial
  CRISPR gRNA sequence
tagattttgctaaagaaaga

SEQ ID NO: 654683 - DNA, 20 bp, Artificial
  CRISPR gRNA sequence
tgctaaagaaagaacaacac

SEQ ID NO: 654684 - DNA, 20 bp, Artificial
  CRISPR gRNA sequence
gctaaagaaagaacaacaca

SEQ ID NO: 654685 - DNA, 20 bp, Artificial
  CRISPR gRNA sequence
ctaaagaaagaacaacacag

SEQ ID NO: 654686 - DNA, 20 bp, Artificial
  CRISPR gRNA sequence
aagaaagaacaacacagatt

SEQ ID NO: 654687 - DNA, 20 bp, Artificial
  CRISPR gRNA sequence
attcctgttcattctagtat

SEQ ID NO: 654688 - DNA, 20 bp, Artificial
  CRISPR gRNA sequence
ttcctgttcattctagtatt

SEQ ID NO: 654689 - DNA, 20 bp, Artificial
  CRISPR gRNA sequence
ctgttcattctagtattata

SEQ ID NO: 654690 - DNA, 20 bp, Artificial
  CRISPR gRNA sequence
ttcattctagtattataaaa

SEQ ID NO: 654691 - DNA, 20 bp, Artificial
  CRISPR gRNA sequence
attctagtattataaaacat

SEQ ID NO: 654692 - DNA, 20 bp, Artificial
  CRISPR gRNA sequence
tagtattataaaacatgagc

SEQ ID NO: 654693 - DNA, 20 bp, Artificial
  CRISPR gRNA sequence
gtattataaaacatgagcct

SEQ ID NO: 654694 - DNA, 20 bp, Artificial
  CRISPR gRNA sequence
taaaacatgagcctgcttac

SEQ ID NO: 654695 - DNA, 20 bp, Artificial
  CRISPR gRNA sequence
cttactagtctgaactatcc

SEQ ID NO: 654696 - DNA, 20 bp, Artificial
  CRISPR gRNA sequence
actagtctgaactatcccaa

SEQ ID NO: 654697 - DNA, 20 bp, Artificial
  CRISPR gRNA sequence
ctagtctgaactatcccaag

SEQ ID NO: 654698 - DNA, 20 bp, Artificial
  CRISPR gRNA sequence
gtctgaactatcccaaggtg

SEQ ID NO: 654699 - DNA, 20 bp, Artificial
  CRISPR gRNA sequence
aactatcccaaggtggcatt

SEQ ID NO: 654700 - DNA, 20 bp, Artificial
  CRISPR gRNA sequence
tcccaaggtggcatttggga

SEQ ID NO: 654701 - DNA, 20 bp, Artificial
  CRISPR gRNA sequence
gggagctggtgcttacctgt

SEQ ID NO: 654702 - DNA, 20 bp, Artificial
  CRISPR gRNA sequence
ggagctggtgcttacctgta

SEQ ID NO: 654703 - DNA, 20 bp, Artificial
  CRISPR gRNA sequence
gtgcttacctgtatcaggta

SEQ ID NO: 654704 - DNA, 20 bp, Artificial
  CRISPR gRNA sequence
acctgtatcaggtaagaaag

SEQ ID NO: 654705 - DNA, 20 bp, Artificial
  CRISPR gRNA sequence
cctgtatcaggtaagaaagg

SEQ ID NO: 654706 - DNA, 20 bp, Artificial
  CRISPR gRNA sequence
tatcaggtaagaaaggttag

SEQ ID NO: 654707 - DNA, 20 bp, Artificial
  CRISPR gRNA sequence
gaatttgctggttgttgttt

SEQ ID NO: 654708 - DNA, 20 bp, Artificial
  CRISPR gRNA sequence
gctggttgttgttttgactt

SEQ ID NO: 654709 - DNA, 20 bp, Artificial
  CRISPR gRNA sequence
ctggttgttgttttgacttg

SEQ ID NO: 654710 - DNA, 20 bp, Artificial
  CRISPR gRNA sequence
gttgttgttttgacttgcca

SEQ ID NO: 654711 - DNA, 20 bp, Artificial
  CRISPR gRNA sequence
ttgttttgacttgccaggtt

SEQ ID NO: 654712 - DNA, 20 bp, Artificial
  CRISPR gRNA sequence
ttttgacttgccaggtttat

SEQ ID NO: 654713 - DNA, 20 bp, Artificial
  CRISPR gRNA sequence
tgacttgccaggtttatgac

SEQ ID NO: 654714 - DNA, 20 bp, Artificial
  CRISPR gRNA sequence
gacttgccaggtttatgact

SEQ ID NO: 654715 - DNA, 20 bp, Artificial
  CRISPR gRNA sequence
acttgccaggtttatgactg

SEQ ID NO: 654716 - DNA, 20 bp, Artificial
  CRISPR gRNA sequence
gccaggtttatgactggatt

SEQ ID NO: 654717 - DNA, 20 bp, Artificial
  CRISPR gRNA sequence
ccaggtttatgactggattt

SEQ ID NO: 654718 - DNA, 20 bp, Artificial
  CRISPR gRNA sequence
atgactggattttttgttgt

SEQ ID NO: 654719 - DNA, 20 bp, Artificial
  CRISPR gRNA sequence
tgactggattttttgttgtt

SEQ ID NO: 654720 - DNA, 20 bp, Artificial
  CRISPR gRNA sequence
gattttttgttgttgttggg

SEQ ID NO: 654721 - DNA, 20 bp, Artificial
  CRISPR gRNA sequence
tttgttgttgttgggtaaaa

SEQ ID NO: 654722 - DNA, 20 bp, Artificial
  CRISPR gRNA sequence
ttgttgttgttgggtaaaaa

SEQ ID NO: 654723 - DNA, 20 bp, Artificial
  CRISPR gRNA sequence
tgttgttgttgggtaaaaaa

SEQ ID NO: 654724 - DNA, 20 bp, Artificial
  CRISPR gRNA sequence
gttgttgttgggtaaaaaat

SEQ ID NO: 654725 - DNA, 20 bp, Artificial
  CRISPR gRNA sequence
ttgttgttgggtaaaaaatg

SEQ ID NO: 654726 - DNA, 20 bp, Artificial
  CRISPR gRNA sequence
ttgttgggtaaaaaatgtgg

SEQ ID NO: 654727 - DNA, 20 bp, Artificial
  CRISPR gRNA sequence
ttgggtaaaaaatgtggaaa

SEQ ID NO: 654728 - DNA, 20 bp, Artificial
  CRISPR gRNA sequence
ggtaaaaaatgtggaaacgt

SEQ ID NO: 654729 - DNA, 20 bp, Artificial
  CRISPR gRNA sequence
ccaaaggactcttcacagtt

SEQ ID NO: 654730 - DNA, 20 bp, Artificial
  CRISPR gRNA sequence
caaaggactcttcacagtta

SEQ ID NO: 654731 - DNA, 20 bp, Artificial
  CRISPR gRNA sequence
ttcacagttaaaaaatgaaa

SEQ ID NO: 654732 - DNA, 20 bp, Artificial
  CRISPR gRNA sequence
cacagttaaaaaatgaaata

SEQ ID NO: 654733 - DNA, 20 bp, Artificial
  CRISPR gRNA sequence
acagttaaaaaatgaaataa

SEQ ID NO: 654734 - DNA, 20 bp, Artificial
  CRISPR gRNA sequence
aaaaatgaaataattttatg

SEQ ID NO: 654735 - DNA, 20 bp, Artificial
  CRISPR gRNA sequence
tatgttgccttggtagaaag

SEQ ID NO: 654736 - DNA, 20 bp, Artificial
  CRISPR gRNA sequence
atgttgccttggtagaaagc

SEQ ID NO: 654737 - DNA, 20 bp, Artificial
  CRISPR gRNA sequence
tgttgccttggtagaaagct

SEQ ID NO: 654738 - DNA, 20 bp, Artificial
  CRISPR gRNA sequence
ccttggtagaaagctaaacc

SEQ ID NO: 654739 - DNA, 20 bp, Artificial
  CRISPR gRNA sequence
ggtagaaagctaaaccgtca

SEQ ID NO: 654740 - DNA, 20 bp, Artificial
  CRISPR gRNA sequence
gtagaaagctaaaccgtcag

SEQ ID NO: 654741 - DNA, 20 bp, Artificial
  CRISPR gRNA sequence
aaccgtcagtgataaaatta

SEQ ID NO: 654742 - DNA, 20 bp, Artificial
  CRISPR gRNA sequence
cagtgttacttgcttttaaa

SEQ ID NO: 654743 - DNA, 20 bp, Artificial
  CRISPR gRNA sequence
cttgcttttaaaaaatgtga

SEQ ID NO: 654744 - DNA, 20 bp, Artificial
  CRISPR gRNA sequence
gcttttaaaaaatgtgaaag

SEQ ID NO: 654745 - DNA, 20 bp, Artificial
  CRISPR gRNA sequence
cttttaaaaaatgtgaaagt

SEQ ID NO: 654746 - DNA, 20 bp, Artificial
  CRISPR gRNA sequence
ttaaaaaatgtgaaagtttc

SEQ ID NO: 654747 - DNA, 20 bp, Artificial
  CRISPR gRNA sequence
taaaaaatgtgaaagtttct

SEQ ID NO: 654748 - DNA, 20 bp, Artificial
  CRISPR gRNA sequence
aaaaaatgtgaaagtttctt

SEQ ID NO: 654749 - DNA, 20 bp, Artificial
  CRISPR gRNA sequence
aaaaatgtgaaagtttcttc

SEQ ID NO: 654750 - DNA, 20 bp, Artificial
  CRISPR gRNA sequence
cttctccaaagcattggaag

SEQ ID NO: 654751 - DNA, 20 bp, Artificial
  CRISPR gRNA sequence
ttctccaaagcattggaagt

SEQ ID NO: 654752 - DNA, 20 bp, Artificial
  CRISPR gRNA sequence
ctccaaagcattggaagtga

SEQ ID NO: 654753 - DNA, 20 bp, Artificial
  CRISPR gRNA sequence
tccaaagcattggaagtgaa

SEQ ID NO: 654754 - DNA, 20 bp, Artificial
  CRISPR gRNA sequence
caaagcattggaagtgaagt

SEQ ID NO: 654755 - DNA, 20 bp, Artificial
  CRISPR gRNA sequence
gaagtgaagtgtaattgaaa

SEQ ID NO: 654756 - DNA, 20 bp, Artificial
  CRISPR gRNA sequence
aaaatttatagaactcattt

SEQ ID NO: 654757 - DNA, 20 bp, Artificial
  CRISPR gRNA sequence
atagaactcatttatatcca

SEQ ID NO: 654758 - DNA, 20 bp, Artificial
  CRISPR gRNA sequence
tagaactcatttatatccat

SEQ ID NO: 654759 - DNA, 20 bp, Artificial
  CRISPR gRNA sequence
atttatatccatttctgtag

SEQ ID NO: 654760 - DNA, 20 bp, Artificial
  CRISPR gRNA sequence
atatccatttctgtagcaaa

SEQ ID NO: 654761 - DNA, 20 bp, Artificial
  CRISPR gRNA sequence
tatccatttctgtagcaaag

SEQ ID NO: 654762 - DNA, 20 bp, Artificial
  CRISPR gRNA sequence
ctgtagcaaagttgaaaggc

SEQ ID NO: 654763 - DNA, 20 bp, Artificial
  CRISPR gRNA sequence
tgtagcaaagttgaaaggct

SEQ ID NO: 654764 - DNA, 20 bp, Artificial
  CRISPR gRNA sequence
tagcaaagttgaaaggcttt

SEQ ID NO: 654765 - DNA, 20 bp, Artificial
  CRISPR gRNA sequence
aaaggcttttgtccagagaa

SEQ ID NO: 654766 - DNA, 20 bp, Artificial
  CRISPR gRNA sequence
ttgtccagagaagaactgat

SEQ ID NO: 654767 - DNA, 20 bp, Artificial
  CRISPR gRNA sequence
tgtccagagaagaactgata

SEQ ID NO: 654768 - DNA, 20 bp, Artificial
  CRISPR gRNA sequence
gtccagagaagaactgataa

SEQ ID NO: 654769 - DNA, 20 bp, Artificial
  CRISPR gRNA sequence
tccagagaagaactgataaa

SEQ ID NO: 654770 - DNA, 20 bp, Artificial
  CRISPR gRNA sequence
ataaaatttggaaagatgtt

SEQ ID NO: 654771 - DNA, 20 bp, Artificial
  CRISPR gRNA sequence
ggaaagatgttttgaatttg

SEQ ID NO: 654772 - DNA, 20 bp, Artificial
  CRISPR gRNA sequence
gaaagatgttttgaatttgt

SEQ ID NO: 654773 - DNA, 20 bp, Artificial
  CRISPR gRNA sequence
tgaatttgtaggaaaagaca

SEQ ID NO: 654774 - DNA, 20 bp, Artificial
  CRISPR gRNA sequence
gaatttgtaggaaaagacag

SEQ ID NO: 654775 - DNA, 20 bp, Artificial
  CRISPR gRNA sequence
aatttgtaggaaaagacagt

SEQ ID NO: 654776 - DNA, 20 bp, Artificial
  CRISPR gRNA sequence
gtaggaaaagacagttttgg

SEQ ID NO: 654777 - DNA, 20 bp, Artificial
  CRISPR gRNA sequence
taggaaaagacagttttggc

SEQ ID NO: 654778 - DNA, 20 bp, Artificial
  CRISPR gRNA sequence
tggctactgtttttgataaa

SEQ ID NO: 654779 - DNA, 20 bp, Artificial
  CRISPR gRNA sequence
ggctactgtttttgataaag

SEQ ID NO: 654780 - DNA, 20 bp, Artificial
  CRISPR gRNA sequence
gctactgtttttgataaagg

SEQ ID NO: 654781 - DNA, 20 bp, Artificial
  CRISPR gRNA sequence
ctgtttttgataaagggtca

SEQ ID NO: 654782 - DNA, 20 bp, Artificial
  CRISPR gRNA sequence
tttttgataaagggtcattt

SEQ ID NO: 654783 - DNA, 20 bp, Artificial
  CRISPR gRNA sequence
ttgataaagggtcatttact

SEQ ID NO: 654784 - DNA, 20 bp, Artificial
  CRISPR gRNA sequence
tgataaagggtcatttactg

SEQ ID NO: 654785 - DNA, 20 bp, Artificial
  CRISPR gRNA sequence
gataaagggtcatttactga

SEQ ID NO: 654786 - DNA, 20 bp, Artificial
  CRISPR gRNA sequence
ataaagggtcatttactgat

SEQ ID NO: 654787 - DNA, 20 bp, Artificial
  CRISPR gRNA sequence
actgatgtaatatacattgt

SEQ ID NO: 654788 - DNA, 20 bp, Artificial
  CRISPR gRNA sequence
ctgatgtaatatacattgtt

SEQ ID NO: 654789 - DNA, 20 bp, Artificial
  CRISPR gRNA sequence
atgtaatatacattgttttt

SEQ ID NO: 654790 - DNA, 20 bp, Artificial
  CRISPR gRNA sequence
tttttatgtaataagatgca

SEQ ID NO: 654791 - DNA, 20 bp, Artificial
  CRISPR gRNA sequence
ttatgtaataagatgcaact

SEQ ID NO: 654792 - DNA, 20 bp, Artificial
  CRISPR gRNA sequence
tatgtaataagatgcaactt

SEQ ID NO: 654793 - DNA, 20 bp, Artificial
  CRISPR gRNA sequence
atgtaataagatgcaactta

SEQ ID NO: 654794 - DNA, 20 bp, Artificial
  CRISPR gRNA sequence
tgtaataagatgcaacttac

SEQ ID NO: 654795 - DNA, 20 bp, Artificial
  CRISPR gRNA sequence
acatgctgtcagtgacagaa

SEQ ID NO: 654796 - DNA, 20 bp, Artificial
  CRISPR gRNA sequence
catgctgtcagtgacagaag

SEQ ID NO: 654797 - DNA, 20 bp, Artificial
  CRISPR gRNA sequence
tcagtgacagaagacaaaat

SEQ ID NO: 654798 - DNA, 20 bp, Artificial
  CRISPR gRNA sequence
tattaagaatatggttgctt

SEQ ID NO: 654799 - DNA, 20 bp, Artificial
  CRISPR gRNA sequence
attaagaatatggttgcttt

SEQ ID NO: 654800 - DNA, 20 bp, Artificial
  CRISPR gRNA sequence
ttaagaatatggttgctttt

SEQ ID NO: 654801 - DNA, 20 bp, Artificial
  CRISPR gRNA sequence
agaatatggttgcttttttc

SEQ ID NO: 654802 - DNA, 20 bp, Artificial
  CRISPR gRNA sequence
cttttttcttaattataata

SEQ ID NO: 654803 - DNA, 20 bp, Artificial
  CRISPR gRNA sequence
ttttcttaattataatattt

SEQ ID NO: 654804 - DNA, 20 bp, Artificial
  CRISPR gRNA sequence
tttcttaattataatatttt

SEQ ID NO: 654805 - DNA, 20 bp, Artificial
  CRISPR gRNA sequence
ttcttaattataatatttta

SEQ ID NO: 654806 - DNA, 20 bp, Artificial
  CRISPR gRNA sequence
tcttaattataatattttat

SEQ ID NO: 654807 - DNA, 20 bp, Artificial
  CRISPR gRNA sequence
cttaattataatattttatc

SEQ ID NO: 654808 - DNA, 20 bp, Artificial
  CRISPR gRNA sequence
ttaattataatattttatca

SEQ ID NO: 654809 - DNA, 20 bp, Artificial
  CRISPR gRNA sequence
aattataatattttatcagt

SEQ ID NO: 654810 - DNA, 20 bp, Artificial
  CRISPR gRNA sequence
attataatattttatcagtt

SEQ ID NO: 654811 - DNA, 20 bp, Artificial
  CRISPR gRNA sequence
taatattttatcagtttagt

SEQ ID NO: 654812 - DNA, 20 bp, Artificial
  CRISPR gRNA sequence
tatcagtttagttatcaagt

SEQ ID NO: 654813 - DNA, 20 bp, Artificial
  CRISPR gRNA sequence
atcagtttagttatcaagtg

SEQ ID NO: 654814 - DNA, 20 bp, Artificial
  CRISPR gRNA sequence
tcagtttagttatcaagtgc

SEQ ID NO: 654815 - DNA, 20 bp, Artificial
  CRISPR gRNA sequence
agttatcaagtgcaagtgct

SEQ ID NO: 654816 - DNA, 20 bp, Artificial
  CRISPR gRNA sequence
gttatcaagtgcaagtgctt

SEQ ID NO: 654817 - DNA, 20 bp, Artificial
  CRISPR gRNA sequence
tcaagtgcaagtgctttatt

SEQ ID NO: 654818 - DNA, 20 bp, Artificial
  CRISPR gRNA sequence
tattactcttactcaaaagt

SEQ ID NO: 654819 - DNA, 20 bp, Artificial
  CRISPR gRNA sequence
attactcttactcaaaagta

SEQ ID NO: 654820 - DNA, 20 bp, Artificial
  CRISPR gRNA sequence
ttactcttactcaaaagtaa

SEQ ID NO: 654821 - DNA, 20 bp, Artificial
  CRISPR gRNA sequence
ctcttactcaaaagtaattt

SEQ ID NO: 654822 - DNA, 20 bp, Artificial
  CRISPR gRNA sequence
ttactcaaaagtaatttgaa

SEQ ID NO: 654823 - DNA, 20 bp, Artificial
  CRISPR gRNA sequence
actcaaaagtaatttgaaat

SEQ ID NO: 654824 - DNA, 20 bp, Artificial
  CRISPR gRNA sequence
ctcaaaagtaatttgaaatc

SEQ ID NO: 654825 - DNA, 20 bp, Artificial
  CRISPR gRNA sequence
aaaagtaatttgaaatcttg

SEQ ID NO: 654826 - DNA, 20 bp, Artificial
  CRISPR gRNA sequence
gaaatcttgttttctttata

SEQ ID NO: 654827 - DNA, 20 bp, Artificial
  CRISPR gRNA sequence
aaatcttgttttctttatac

SEQ ID NO: 654828 - DNA, 20 bp, Artificial
  CRISPR gRNA sequence
gttttctttatactttagat

SEQ ID NO: 654829 - DNA, 20 bp, Artificial
  CRISPR gRNA sequence
ttttctttatactttagatt

SEQ ID NO: 654830 - DNA, 20 bp, Artificial
  CRISPR gRNA sequence
tctttatactttagatttat

SEQ ID NO: 654831 - DNA, 20 bp, Artificial
  CRISPR gRNA sequence
ctttatactttagatttata

SEQ ID NO: 654832 - DNA, 20 bp, Artificial
  CRISPR gRNA sequence
tttatactttagatttatat

SEQ ID NO: 654833 - DNA, 20 bp, Artificial
  CRISPR gRNA sequence
tatactttagatttatattt

SEQ ID NO: 654834 - DNA, 20 bp, Artificial
  CRISPR gRNA sequence
atactttagatttatatttt

SEQ ID NO: 654835 - DNA, 20 bp, Artificial
  CRISPR gRNA sequence
tactttagatttatatttta

SEQ ID NO: 654836 - DNA, 20 bp, Artificial
  CRISPR gRNA sequence
tagatttatattttattctt

SEQ ID NO: 654837 - DNA, 20 bp, Artificial
  CRISPR gRNA sequence
agatttatattttattctta

SEQ ID NO: 654838 - DNA, 20 bp, Artificial
  CRISPR gRNA sequence
gatttatattttattcttac

SEQ ID NO: 654839 - DNA, 20 bp, Artificial
  CRISPR gRNA sequence
atattttattcttacatgtt

SEQ ID NO: 654840 - DNA, 20 bp, Artificial
  CRISPR gRNA sequence
tattttattcttacatgtta

SEQ ID NO: 654841 - DNA, 20 bp, Artificial
  CRISPR gRNA sequence
tattcttacatgttatagaa

SEQ ID NO: 654842 - DNA, 20 bp, Artificial
  CRISPR gRNA sequence
attcttacatgttatagaaa

SEQ ID NO: 654843 - DNA, 20 bp, Artificial
  CRISPR gRNA sequence
ttcttacatgttatagaaag

SEQ ID NO: 654844 - DNA, 20 bp, Artificial
  CRISPR gRNA sequence
ttacatgttatagaaaggac

SEQ ID NO: 654845 - DNA, 20 bp, Artificial
  CRISPR gRNA sequence
acatgttatagaaaggacat

SEQ ID NO: 654846 - DNA, 20 bp, Artificial
  CRISPR gRNA sequence
catgttatagaaaggacatt

SEQ ID NO: 654847 - DNA, 20 bp, Artificial
  CRISPR gRNA sequence
tagaaaggacattggactta

SEQ ID NO: 654848 - DNA, 20 bp, Artificial
  CRISPR gRNA sequence
gacttacatgtaaatataat

SEQ ID NO: 654849 - DNA, 20 bp, Artificial
  CRISPR gRNA sequence
acatgtaaatataattaaat

SEQ ID NO: 654850 - DNA, 20 bp, Artificial
  CRISPR gRNA sequence
catgtaaatataattaaatt

SEQ ID NO: 654851 - DNA, 20 bp, Artificial
  CRISPR gRNA sequence
aatttacaagttttctgttt

SEQ ID NO: 654852 - DNA, 20 bp, Artificial
  CRISPR gRNA sequence
acaagttttctgttttggca

SEQ ID NO: 654853 - DNA, 20 bp, Artificial
  CRISPR gRNA sequence
caagttttctgttttggcaa

SEQ ID NO: 654854 - DNA, 20 bp, Artificial
  CRISPR gRNA sequence
tctgttttggcaatatgtga

SEQ ID NO: 654855 - DNA, 20 bp, Artificial
  CRISPR gRNA sequence
ctgttttggcaatatgtgaa

SEQ ID NO: 654856 - DNA, 20 bp, Artificial
  CRISPR gRNA sequence
tgttttggcaatatgtgaag

SEQ ID NO: 654857 - DNA, 20 bp, Artificial
  CRISPR gRNA sequence
ttttggcaatatgtgaagga

SEQ ID NO: 654858 - DNA, 20 bp, Artificial
  CRISPR gRNA sequence
tggcaatatgtgaaggaaag

SEQ ID NO: 654859 - DNA, 20 bp, Artificial
  CRISPR gRNA sequence
ggcaatatgtgaaggaaagg

SEQ ID NO: 654860 - DNA, 20 bp, Artificial
  CRISPR gRNA sequence
gcaatatgtgaaggaaaggc

SEQ ID NO: 654861 - DNA, 20 bp, Artificial
  CRISPR gRNA sequence
tctttccttccccccccccg

SEQ ID NO: 654862 - DNA, 20 bp, Artificial
  CRISPR gRNA sequence
tttccttccccccccccgaa

SEQ ID NO: 654863 - DNA, 20 bp, Artificial
  CRISPR gRNA sequence
tccttccccccccccgaaga

SEQ ID NO: 654864 - DNA, 20 bp, Artificial
  CRISPR gRNA sequence
ccttccccccccccgaagat

SEQ ID NO: 654865 - DNA, 20 bp, Artificial
  CRISPR gRNA sequence
cttccccccccccgaagatt

SEQ ID NO: 654866 - DNA, 20 bp, Artificial
  CRISPR gRNA sequence
ccccccccccgaagatttaa

SEQ ID NO: 654867 - DNA, 20 bp, Artificial
  CRISPR gRNA sequence
cccccccccgaagatttaat

SEQ ID NO: 654868 - DNA, 20 bp, Artificial
  CRISPR gRNA sequence
aataactaagaaaagtgaat

SEQ ID NO: 654869 - DNA, 20 bp, Artificial
  CRISPR gRNA sequence
ataactaagaaaagtgaatc

SEQ ID NO: 654870 - DNA, 20 bp, Artificial
  CRISPR gRNA sequence
agaaaagtgaatcatgtact

SEQ ID NO: 654871 - DNA, 20 bp, Artificial
  CRISPR gRNA sequence
aattatgagcatatttgtaa

SEQ ID NO: 654872 - DNA, 20 bp, Artificial
  CRISPR gRNA sequence
attatgagcatatttgtaaa

SEQ ID NO: 654873 - DNA, 20 bp, Artificial
  CRISPR gRNA sequence
tgagcatatttgtaaatgta

SEQ ID NO: 654874 - DNA, 20 bp, Artificial
  CRISPR gRNA sequence
gtaaatgtattctgactatc

SEQ ID NO: 654875 - DNA, 20 bp, Artificial
  CRISPR gRNA sequence
taaatgtattctgactatcc

SEQ ID NO: 654876 - DNA, 20 bp, Artificial
  CRISPR gRNA sequence
tgactatccagagagagcaa

SEQ ID NO: 654877 - DNA, 20 bp, Artificial
  CRISPR gRNA sequence
actatccagagagagcaact

SEQ ID NO: 654878 - DNA, 20 bp, Artificial
  CRISPR gRNA sequence
tccagagagagcaacttttt

SEQ ID NO: 654879 - DNA, 20 bp, Artificial
  CRISPR gRNA sequence
tttctttttacttctaacag

SEQ ID NO: 654880 - DNA, 20 bp, Artificial
  CRISPR gRNA sequence
ttctttttacttctaacagc

SEQ ID NO: 654881 - DNA, 20 bp, Artificial
  CRISPR gRNA sequence
tctttttacttctaacagct

SEQ ID NO: 654882 - DNA, 20 bp, Artificial
  CRISPR gRNA sequence
ctttttacttctaacagctc

SEQ ID NO: 654883 - DNA, 20 bp, Artificial
  CRISPR gRNA sequence
tttttacttctaacagctct

SEQ ID NO: 654884 - DNA, 20 bp, Artificial
  CRISPR gRNA sequence
tttacttctaacagctctcg

SEQ ID NO: 654885 - DNA, 20 bp, Artificial
  CRISPR gRNA sequence
ttacttctaacagctctcga

SEQ ID NO: 654886 - DNA, 20 bp, Artificial
  CRISPR gRNA sequence
tacttctaacagctctcgaa

SEQ ID NO: 654887 - DNA, 20 bp, Artificial
  CRISPR gRNA sequence
acttctaacagctctcgaaa

SEQ ID NO: 654888 - DNA, 20 bp, Artificial
  CRISPR gRNA sequence
cttctaacagctctcgaaac

SEQ ID NO: 654889 - DNA, 20 bp, Artificial
  CRISPR gRNA sequence
ctaacagctctcgaaactgt

SEQ ID NO: 654890 - DNA, 20 bp, Artificial
  CRISPR gRNA sequence
taacagctctcgaaactgta

SEQ ID NO: 654891 - DNA, 20 bp, Artificial
  CRISPR gRNA sequence
acagctctcgaaactgtaag

SEQ ID NO: 654892 - DNA, 20 bp, Artificial
  CRISPR gRNA sequence
tcgaaactgtaagttattat

SEQ ID NO: 654893 - DNA, 20 bp, Artificial
  CRISPR gRNA sequence
gaaactgtaagttattataa

SEQ ID NO: 654894 - DNA, 20 bp, Artificial
  CRISPR gRNA sequence
taagttattataaaactgca

SEQ ID NO: 654895 - DNA, 20 bp, Artificial
  CRISPR gRNA sequence
ttataaaactgcaagcttag

SEQ ID NO: 654896 - DNA, 20 bp, Artificial
  CRISPR gRNA sequence
taaaactgcaagcttagtaa

SEQ ID NO: 654897 - DNA, 20 bp, Artificial
  CRISPR gRNA sequence
caagcttagtaattagtaaa

SEQ ID NO: 654898 - DNA, 20 bp, Artificial
  CRISPR gRNA sequence
agtaattagtaaatactact

SEQ ID NO: 654899 - DNA, 20 bp, Artificial
  CRISPR gRNA sequence
gtaattagtaaatactactg

SEQ ID NO: 654900 - DNA, 20 bp, Artificial
  CRISPR gRNA sequence
gtaaatactactgaaattta

SEQ ID NO: 654901 - DNA, 20 bp, Artificial
  CRISPR gRNA sequence
ctgaaatttaagcaatttat

SEQ ID NO: 654902 - DNA, 20 bp, Artificial
  CRISPR gRNA sequence
aaatttaagcaatttatata

SEQ ID NO: 654903 - DNA, 20 bp, Artificial
  CRISPR gRNA sequence
aagcaatttatatagaatac

SEQ ID NO: 654904 - DNA, 20 bp, Artificial
  CRISPR gRNA sequence
agcaatttatatagaatacc

SEQ ID NO: 654905 - DNA, 20 bp, Artificial
  CRISPR gRNA sequence
atatagaataccattgaata

SEQ ID NO: 654906 - DNA, 20 bp, Artificial
  CRISPR gRNA sequence
tatagaataccattgaatac

SEQ ID NO: 654907 - DNA, 20 bp, Artificial
  CRISPR gRNA sequence
aatacattttgcaatttatt

SEQ ID NO: 654908 - DNA, 20 bp, Artificial
  CRISPR gRNA sequence
tgcaatttattaactttaag

SEQ ID NO: 654909 - DNA, 20 bp, Artificial
  CRISPR gRNA sequence
gcaatttattaactttaagt

SEQ ID NO: 654910 - DNA, 20 bp, Artificial
  CRISPR gRNA sequence
caatttattaactttaagta

SEQ ID NO: 654911 - DNA, 20 bp, Artificial
  CRISPR gRNA sequence
attaactttaagtaatttta

SEQ ID NO: 654912 - DNA, 20 bp, Artificial
  CRISPR gRNA sequence
ttaactttaagtaattttag

SEQ ID NO: 654913 - DNA, 20 bp, Artificial
  CRISPR gRNA sequence
actttaagtaattttagcta

SEQ ID NO: 654914 - DNA, 20 bp, Artificial
  CRISPR gRNA sequence
taagtaattttagctattga

SEQ ID NO: 654915 - DNA, 20 bp, Artificial
  CRISPR gRNA sequence
aagtaattttagctattgac

SEQ ID NO: 654916 - DNA, 20 bp, Artificial
  CRISPR gRNA sequence
agtaattttagctattgact

SEQ ID NO: 654917 - DNA, 20 bp, Artificial
  CRISPR gRNA sequence
tagctattgacttgaaatta

SEQ ID NO: 654918 - DNA, 20 bp, Artificial
  CRISPR gRNA sequence
agctattgacttgaaattat

SEQ ID NO: 654919 - DNA, 20 bp, Artificial
  CRISPR gRNA sequence
gctattgacttgaaattatg

SEQ ID NO: 654920 - DNA, 20 bp, Artificial
  CRISPR gRNA sequence
ttgacttgaaattatgattg

SEQ ID NO: 654921 - DNA, 20 bp, Artificial
  CRISPR gRNA sequence
acttgaaattatgattgagt

SEQ ID NO: 654922 - DNA, 20 bp, Artificial
  CRISPR gRNA sequence
gaaattatgattgagtttga

SEQ ID NO: 654923 - DNA, 20 bp, Artificial
  CRISPR gRNA sequence
aaattatgattgagtttgaa

SEQ ID NO: 654924 - DNA, 20 bp, Artificial
  CRISPR gRNA sequence
tgattgagtttgaatttgct

SEQ ID NO: 654925 - DNA, 20 bp, Artificial
  CRISPR gRNA sequence
agtttgaatttgctttattt

SEQ ID NO: 654926 - DNA, 20 bp, Artificial
  CRISPR gRNA sequence
gaatttgctttatttattta

SEQ ID NO: 654927 - DNA, 20 bp, Artificial
  CRISPR gRNA sequence
aatttgctttatttatttaa

SEQ ID NO: 654928 - DNA, 20 bp, Artificial
  CRISPR gRNA sequence
gctttatttatttaaaagtt

SEQ ID NO: 654929 - DNA, 20 bp, Artificial
  CRISPR gRNA sequence
ctttatttatttaaaagttg

SEQ ID NO: 654930 - DNA, 20 bp, Artificial
  CRISPR gRNA sequence
tatttatttaaaagttgtaa

SEQ ID NO: 654931 - DNA, 20 bp, Artificial
  CRISPR gRNA sequence
atttatttaaaagttgtaat

SEQ ID NO: 654932 - DNA, 20 bp, Artificial
  CRISPR gRNA sequence
tttatttaaaagttgtaatt

SEQ ID NO: 654933 - DNA, 20 bp, Artificial
  CRISPR gRNA sequence
atttaaaagttgtaattctt

SEQ ID NO: 654934 - DNA, 20 bp, Artificial
  CRISPR gRNA sequence
tttaaaagttgtaattcttt

SEQ ID NO: 654935 - DNA, 20 bp, Artificial
  CRISPR gRNA sequence
aaaagttgtaattcttttaa

SEQ ID NO: 654936 - DNA, 20 bp, Artificial
  CRISPR gRNA sequence
aaagttgtaattcttttaag

SEQ ID NO: 654937 - DNA, 20 bp, Artificial
  CRISPR gRNA sequence
taattcttttaagtaatgag

SEQ ID NO: 654938 - DNA, 20 bp, Artificial
  CRISPR gRNA sequence
ttttaagtaatgagcacttc

SEQ ID NO: 654939 - DNA, 20 bp, Artificial
  CRISPR gRNA sequence
ttaagtaatgagcacttcct

SEQ ID NO: 654940 - DNA, 20 bp, Artificial
  CRISPR gRNA sequence
taagtaatgagcacttccta

SEQ ID NO: 654941 - DNA, 20 bp, Artificial
  CRISPR gRNA sequence
aagtaatgagcacttcctaa

SEQ ID NO: 654942 - DNA, 20 bp, Artificial
  CRISPR gRNA sequence
agtaatgagcacttcctaag

SEQ ID NO: 654943 - DNA, 20 bp, Artificial
  CRISPR gRNA sequence
cctaagaaaatttaattata

SEQ ID NO: 654944 - DNA, 20 bp, Artificial
  CRISPR gRNA sequence
ctaagaaaatttaattatag

SEQ ID NO: 654945 - DNA, 20 bp, Artificial
  CRISPR gRNA sequence
agaaaatttaattatagaag

SEQ ID NO: 654946 - DNA, 20 bp, Artificial
  CRISPR gRNA sequence
aattatagaagcagtcctta

SEQ ID NO: 654947 - DNA, 20 bp, Artificial
  CRISPR gRNA sequence
attatagaagcagtccttac

SEQ ID NO: 654948 - DNA, 20 bp, Artificial
  CRISPR gRNA sequence
tagaagcagtccttacaatt

SEQ ID NO: 654949 - DNA, 20 bp, Artificial
  CRISPR gRNA sequence
acaattcccgtatcatttag

SEQ ID NO: 654950 - DNA, 20 bp, Artificial
  CRISPR gRNA sequence
caattcccgtatcatttaga

SEQ ID NO: 654951 - DNA, 20 bp, Artificial
  CRISPR gRNA sequence
ccgtatcatttagaaagaaa

SEQ ID NO: 654952 - DNA, 20 bp, Artificial
  CRISPR gRNA sequence
agaaagaaaaaactagtaaa

SEQ ID NO: 654953 - DNA, 20 bp, Artificial
  CRISPR gRNA sequence
gaaagaaaaaactagtaaag

SEQ ID NO: 654954 - DNA, 20 bp, Artificial
  CRISPR gRNA sequence
gtaaagttagcaggtgaatg

SEQ ID NO: 654955 - DNA, 20 bp, Artificial
  CRISPR gRNA sequence
gcaggtgaatgtatactaaa

SEQ ID NO: 654956 - DNA, 20 bp, Artificial
  CRISPR gRNA sequence
aattatcatactaatctcat

SEQ ID NO: 654957 - DNA, 20 bp, Artificial
  CRISPR gRNA sequence
tcatactaatctcataatga

SEQ ID NO: 654958 - DNA, 20 bp, Artificial
  CRISPR gRNA sequence
atctcataatgaatcttttg

SEQ ID NO: 654959 - DNA, 20 bp, Artificial
  CRISPR gRNA sequence
ataatgaatcttttgcattc

SEQ ID NO: 654960 - DNA, 20 bp, Artificial
  CRISPR gRNA sequence
ttgcattcatgttttttgct

SEQ ID NO: 654961 - DNA, 20 bp, Artificial
  CRISPR gRNA sequence
tgcattcatgttttttgcta

SEQ ID NO: 654962 - DNA, 20 bp, Artificial
  CRISPR gRNA sequence
gcattcatgttttttgctag

SEQ ID NO: 654963 - DNA, 20 bp, Artificial
  CRISPR gRNA sequence
cattcatgttttttgctagt

SEQ ID NO: 654964 - DNA, 20 bp, Artificial
  CRISPR gRNA sequence
atgttttttgctagttgatt

SEQ ID NO: 654965 - DNA, 20 bp, Artificial
  CRISPR gRNA sequence
tttgctagttgatttgataa

SEQ ID NO: 654966 - DNA, 20 bp, Artificial
  CRISPR gRNA sequence
ttgctagttgatttgataaa

SEQ ID NO: 654967 - DNA, 20 bp, Artificial
  CRISPR gRNA sequence
tgctagttgatttgataaaa

SEQ ID NO: 654968 - DNA, 20 bp, Artificial
  CRISPR gRNA sequence
gctagttgatttgataaaaa

SEQ ID NO: 654969 - DNA, 20 bp, Artificial
  CRISPR gRNA sequence
ctagttgatttgataaaaaa

SEQ ID NO: 654970 - DNA, 20 bp, Artificial
  CRISPR gRNA sequence
gttgatttgataaaaaatat

SEQ ID NO: 654971 - DNA, 20 bp, Artificial
  CRISPR gRNA sequence
atttgataaaaaatatacta

SEQ ID NO: 654972 - DNA, 20 bp, Artificial
  CRISPR gRNA sequence
gataaaaaatatactatgac

SEQ ID NO: 654973 - DNA, 20 bp, Artificial
  CRISPR gRNA sequence
ataaaaaatatactatgact

SEQ ID NO: 654974 - DNA, 20 bp, Artificial
  CRISPR gRNA sequence
tgactacaatttaggcaata

SEQ ID NO: 654975 - DNA, 20 bp, Artificial
  CRISPR gRNA sequence
caatttaggcaatagaattt

SEQ ID NO: 654976 - DNA, 20 bp, Artificial
  CRISPR gRNA sequence
aggcaatagaatttttacat

SEQ ID NO: 654977 - DNA, 20 bp, Artificial
  CRISPR gRNA sequence
ggcaatagaatttttacatt

SEQ ID NO: 654978 - DNA, 20 bp, Artificial
  CRISPR gRNA sequence
ttacatttcaatatactagt

SEQ ID NO: 654979 - DNA, 20 bp, Artificial
  CRISPR gRNA sequence
tacatttcaatatactagtt

SEQ ID NO: 654980 - DNA, 20 bp, Artificial
  CRISPR gRNA sequence
acatttcaatatactagtta

SEQ ID NO: 654981 - DNA, 20 bp, Artificial
  CRISPR gRNA sequence
catttcaatatactagttat

SEQ ID NO: 654982 - DNA, 20 bp, Artificial
  CRISPR gRNA sequence
caatatactagttatttggt

SEQ ID NO: 654983 - DNA, 20 bp, Artificial
  CRISPR gRNA sequence
aatatactagttatttggtg

SEQ ID NO: 654984 - DNA, 20 bp, Artificial
  CRISPR gRNA sequence
gttatttggtgtaatgtttt

SEQ ID NO: 654985 - DNA, 20 bp, Artificial
  CRISPR gRNA sequence
tttggtgtaatgtttttatt

SEQ ID NO: 654986 - DNA, 20 bp, Artificial
  CRISPR gRNA sequence
ggtgtaatgtttttatttct

SEQ ID NO: 654987 - DNA, 20 bp, Artificial
  CRISPR gRNA sequence
gtgtaatgtttttatttctc

SEQ ID NO: 654988 - DNA, 20 bp, Artificial
  CRISPR gRNA sequence
ttatttctcagataactcac

SEQ ID NO: 654989 - DNA, 20 bp, Artificial
  CRISPR gRNA sequence
tatttctcagataactcaca

SEQ ID NO: 654990 - DNA, 20 bp, Artificial
  CRISPR gRNA sequence
atttctcagataactcacac

SEQ ID NO: 654991 - DNA, 20 bp, Artificial
  CRISPR gRNA sequence
tttctcagataactcacaca

SEQ ID NO: 654992 - DNA, 20 bp, Artificial
  CRISPR gRNA sequence
ctcagataactcacacaatt

SEQ ID NO: 654993 - DNA, 20 bp, Artificial
  CRISPR gRNA sequence
tcagataactcacacaattt

SEQ ID NO: 654994 - DNA, 20 bp, Artificial
  CRISPR gRNA sequence
agataactcacacaatttcc

SEQ ID NO: 654995 - DNA, 20 bp, Artificial
  CRISPR gRNA sequence
acacaatttcctaaagagta

SEQ ID NO: 654996 - DNA, 20 bp, Artificial
  CRISPR gRNA sequence
cctaaagagtaaaaagagat

SEQ ID NO: 654997 - DNA, 20 bp, Artificial
  CRISPR gRNA sequence
ctaaagagtaaaaagagata

SEQ ID NO: 654998 - DNA, 20 bp, Artificial
  CRISPR gRNA sequence
aagagtaaaaagagataata

SEQ ID NO: 654999 - DNA, 20 bp, Artificial
  CRISPR gRNA sequence
ctattagttagctattggct

SEQ ID NO: 655000 - DNA, 20 bp, Artificial
  CRISPR gRNA sequence
tattagttagctattggctt

SEQ ID NO: 655001 - DNA, 20 bp, Artificial
  CRISPR gRNA sequence
ttagttagctattggcttta

SEQ ID NO: 655002 - DNA, 20 bp, Artificial
  CRISPR gRNA sequence
gttagctattggctttagaa

SEQ ID NO: 655003 - DNA, 20 bp, Artificial
  CRISPR gRNA sequence
gctattggctttagaaacat

SEQ ID NO: 655004 - DNA, 20 bp, Artificial
  CRISPR gRNA sequence
ttggctttagaaacattgca

SEQ ID NO: 655005 - DNA, 20 bp, Artificial
  CRISPR gRNA sequence
gctttagaaacattgcatgt

SEQ ID NO: 655006 - DNA, 20 bp, Artificial
  CRISPR gRNA sequence
tagaaacattgcatgtatag

SEQ ID NO: 655007 - DNA, 20 bp, Artificial
  CRISPR gRNA sequence
agaaacattgcatgtatagg

SEQ ID NO: 655008 - DNA, 20 bp, Artificial
  CRISPR gRNA sequence
gaaacattgcatgtataggg

SEQ ID NO: 655009 - DNA, 20 bp, Artificial
  CRISPR gRNA sequence
catgtatagggtagggagta

SEQ ID NO: 655010 - DNA, 20 bp, Artificial
  CRISPR gRNA sequence
ttaatcagagacttgactgt

SEQ ID NO: 655011 - DNA, 20 bp, Artificial
  CRISPR gRNA sequence
atcagagacttgactgtcat

SEQ ID NO: 655012 - DNA, 20 bp, Artificial
  CRISPR gRNA sequence
gactgtcatcccctagacac

SEQ ID NO: 655013 - DNA, 20 bp, Artificial
  CRISPR gRNA sequence
actgtcatcccctagacaca

SEQ ID NO: 655014 - DNA, 20 bp, Artificial
  CRISPR gRNA sequence
tcatcccctagacacaacca

SEQ ID NO: 655015 - DNA, 20 bp, Artificial
  CRISPR gRNA sequence
gacacaaccacaggaaaatg

SEQ ID NO: 655016 - DNA, 20 bp, Artificial
  CRISPR gRNA sequence
gtcaagtggttaattggctg

SEQ ID NO: 655017 - DNA, 20 bp, Artificial
  CRISPR gRNA sequence
tcaagtggttaattggctgc

SEQ ID NO: 655018 - DNA, 20 bp, Artificial
  CRISPR gRNA sequence
attggctgctttatttctga

SEQ ID NO: 655019 - DNA, 20 bp, Artificial
  CRISPR gRNA sequence
gctgctttatttctgaattt

SEQ ID NO: 655020 - DNA, 20 bp, Artificial
  CRISPR gRNA sequence
ctttatttctgaatttgatt

SEQ ID NO: 655021 - DNA, 20 bp, Artificial
  CRISPR gRNA sequence
tatttctgaatttgattctg

SEQ ID NO: 655022 - DNA, 20 bp, Artificial
  CRISPR gRNA sequence
atttctgaatttgattctgg

SEQ ID NO: 655023 - DNA, 20 bp, Artificial
  CRISPR gRNA sequence
tttctgaatttgattctggt

SEQ ID NO: 655024 - DNA, 20 bp, Artificial
  CRISPR gRNA sequence
ctgaatttgattctggtttt

SEQ ID NO: 655025 - DNA, 20 bp, Artificial
  CRISPR gRNA sequence
tgaatttgattctggttttg

SEQ ID NO: 655026 - DNA, 20 bp, Artificial
  CRISPR gRNA sequence
aatttgattctggttttgca

SEQ ID NO: 655027 - DNA, 20 bp, Artificial
  CRISPR gRNA sequence
gattctggttttgcaagtac

SEQ ID NO: 655028 - DNA, 20 bp, Artificial
  CRISPR gRNA sequence
attctggttttgcaagtact

SEQ ID NO: 655029 - DNA, 20 bp, Artificial
  CRISPR gRNA sequence
tggttttgcaagtacttgct

SEQ ID NO: 655030 - DNA, 20 bp, Artificial
  CRISPR gRNA sequence
gttttgcaagtacttgcttc

SEQ ID NO: 655031 - DNA, 20 bp, Artificial
  CRISPR gRNA sequence
tgcaagtacttgcttcagaa

SEQ ID NO: 655032 - DNA, 20 bp, Artificial
  CRISPR gRNA sequence
gcaagtacttgcttcagaaa

SEQ ID NO: 655033 - DNA, 20 bp, Artificial
  CRISPR gRNA sequence
caagtacttgcttcagaaag

SEQ ID NO: 655034 - DNA, 20 bp, Artificial
  CRISPR gRNA sequence
gcttcagaaaggcagttcac

SEQ ID NO: 655035 - DNA, 20 bp, Artificial
  CRISPR gRNA sequence
cttcagaaaggcagttcact

SEQ ID NO: 655036 - DNA, 20 bp, Artificial
  CRISPR gRNA sequence
cagaaaggcagttcactcat

SEQ ID NO: 655037 - DNA, 20 bp, Artificial
  CRISPR gRNA sequence
agaaaggcagttcactcatc

SEQ ID NO: 655038 - DNA, 20 bp, Artificial
  CRISPR gRNA sequence
actcatctttttaaataaac

SEQ ID NO: 655039 - DNA, 20 bp, Artificial
  CRISPR gRNA sequence
atctttttaaataaacagtg

SEQ ID NO: 655040 - DNA, 20 bp, Artificial
  CRISPR gRNA sequence
tttaaataaacagtgcagag

SEQ ID NO: 655041 - DNA, 20 bp, Artificial
  CRISPR gRNA sequence
ttaaataaacagtgcagagt

SEQ ID NO: 655042 - DNA, 20 bp, Artificial
  CRISPR gRNA sequence
taaataaacagtgcagagtg

SEQ ID NO: 655043 - DNA, 20 bp, Artificial
  CRISPR gRNA sequence
aaataaacagtgcagagtgt

SEQ ID NO: 655044 - DNA, 20 bp, Artificial
  CRISPR gRNA sequence
aataaacagtgcagagtgta

SEQ ID NO: 655045 - DNA, 20 bp, Artificial
  CRISPR gRNA sequence
gaacaaataagaactgtgct

SEQ ID NO: 655046 - DNA, 20 bp, Artificial
  CRISPR gRNA sequence
aacaaataagaactgtgctt

SEQ ID NO: 655047 - DNA, 20 bp, Artificial
  CRISPR gRNA sequence
tgcttttgacatttgagctt

SEQ ID NO: 655048 - DNA, 20 bp, Artificial
  CRISPR gRNA sequence
ttgacatttgagcttttctc

SEQ ID NO: 655049 - DNA, 20 bp, Artificial
  CRISPR gRNA sequence
tgacatttgagcttttctca

SEQ ID NO: 655050 - DNA, 20 bp, Artificial
  CRISPR gRNA sequence
gacatttgagcttttctcac

SEQ ID NO: 655051 - DNA, 20 bp, Artificial
  CRISPR gRNA sequence
acatttgagcttttctcacc

SEQ ID NO: 655052 - DNA, 20 bp, Artificial
  CRISPR gRNA sequence
gagcttttctcacccaacaa

SEQ ID NO: 655053 - DNA, 20 bp, Artificial
  CRISPR gRNA sequence
agcttttctcacccaacaac

SEQ ID NO: 655054 - DNA, 20 bp, Artificial
  CRISPR gRNA sequence
ttctcacccaacaacagtaa

SEQ ID NO: 655055 - DNA, 20 bp, Artificial
  CRISPR gRNA sequence
tctcacccaacaacagtaaa

SEQ ID NO: 655056 - DNA, 20 bp, Artificial
  CRISPR gRNA sequence
ctcacccaacaacagtaaac

SEQ ID NO: 655057 - DNA, 20 bp, Artificial
  CRISPR gRNA sequence
tcacccaacaacagtaaact

SEQ ID NO: 655058 - DNA, 20 bp, Artificial
  CRISPR gRNA sequence
acccaacaacagtaaactta

SEQ ID NO: 655059 - DNA, 20 bp, Artificial
  CRISPR gRNA sequence
atgtttggtagagagttttt

SEQ ID NO: 655060 - DNA, 20 bp, Artificial
  CRISPR gRNA sequence
tgtttggtagagagtttttt

SEQ ID NO: 655061 - DNA, 20 bp, Artificial
  CRISPR gRNA sequence
ggtagagagttttttaactt

SEQ ID NO: 655062 - DNA, 20 bp, Artificial
  CRISPR gRNA sequence
gtagagagttttttaactta

SEQ ID NO: 655063 - DNA, 20 bp, Artificial
  CRISPR gRNA sequence
tttaacttactagcctgtgg

SEQ ID NO: 655064 - DNA, 20 bp, Artificial
  CRISPR gRNA sequence
ttaacttactagcctgtggc

SEQ ID NO: 655065 - DNA, 20 bp, Artificial
  CRISPR gRNA sequence
taacttactagcctgtggca

SEQ ID NO: 655066 - DNA, 20 bp, Artificial
  CRISPR gRNA sequence
aacttactagcctgtggcaa

SEQ ID NO: 655067 - DNA, 20 bp, Artificial
  CRISPR gRNA sequence
acttactagcctgtggcaat

SEQ ID NO: 655068 - DNA, 20 bp, Artificial
  CRISPR gRNA sequence
actagcctgtggcaattcca

SEQ ID NO: 655069 - DNA, 20 bp, Artificial
  CRISPR gRNA sequence
ctagcctgtggcaattccat

SEQ ID NO: 655070 - DNA, 20 bp, Artificial
  CRISPR gRNA sequence
gcctgtggcaattccatgtt

SEQ ID NO: 655071 - DNA, 20 bp, Artificial
  CRISPR gRNA sequence
tggcaattccatgttagtac

SEQ ID NO: 655072 - DNA, 20 bp, Artificial
  CRISPR gRNA sequence
catgttagtacaggttttgg

SEQ ID NO: 655073 - DNA, 20 bp, Artificial
  CRISPR gRNA sequence
gtacaggttttggctaagat

SEQ ID NO: 655074 - DNA, 20 bp, Artificial
  CRISPR gRNA sequence
tggctaagatgcacgtgttt

SEQ ID NO: 655075 - DNA, 20 bp, Artificial
  CRISPR gRNA sequence
ggctaagatgcacgtgtttt

SEQ ID NO: 655076 - DNA, 20 bp, Artificial
  CRISPR gRNA sequence
gctaagatgcacgtgttttc

SEQ ID NO: 655077 - DNA, 20 bp, Artificial
  CRISPR gRNA sequence
agatgcacgtgttttcaggt

SEQ ID NO: 655078 - DNA, 20 bp, Artificial
  CRISPR gRNA sequence
tcaggttcttttccaaagag

SEQ ID NO: 655079 - DNA, 20 bp, Artificial
  CRISPR gRNA sequence
caggttcttttccaaagagt

SEQ ID NO: 655080 - DNA, 20 bp, Artificial
  CRISPR gRNA sequence
aggttcttttccaaagagtt

SEQ ID NO: 655081 - DNA, 20 bp, Artificial
  CRISPR gRNA sequence
ttttccaaagagttgcaggt

SEQ ID NO: 655082 - DNA, 20 bp, Artificial
  CRISPR gRNA sequence
ttccaaagagttgcaggtta

SEQ ID NO: 655083 - DNA, 20 bp, Artificial
  CRISPR gRNA sequence
tccaaagagttgcaggttaa

SEQ ID NO: 655084 - DNA, 20 bp, Artificial
  CRISPR gRNA sequence
ccaaagagttgcaggttaaa

SEQ ID NO: 655085 - DNA, 20 bp, Artificial
  CRISPR gRNA sequence
caaagagttgcaggttaaat

SEQ ID NO: 655086 - DNA, 20 bp, Artificial
  CRISPR gRNA sequence
caggttaaatattttggctc

SEQ ID NO: 655087 - DNA, 20 bp, Artificial
  CRISPR gRNA sequence
aatattttggctctcacttc

SEQ ID NO: 655088 - DNA, 20 bp, Artificial
  CRISPR gRNA sequence
tggctctcacttcagagctg

SEQ ID NO: 655089 - DNA, 20 bp, Artificial
  CRISPR gRNA sequence
ggctctcacttcagagctgt

SEQ ID NO: 655090 - DNA, 20 bp, Artificial
  CRISPR gRNA sequence
gctctcacttcagagctgtc

SEQ ID NO: 655091 - DNA, 20 bp, Artificial
  CRISPR gRNA sequence
tcacttcagagctgtctctt

SEQ ID NO: 655092 - DNA, 20 bp, Artificial
  CRISPR gRNA sequence
acttcagagctgtctcttgc

SEQ ID NO: 655093 - DNA, 20 bp, Artificial
  CRISPR gRNA sequence
cagagctgtctcttgcatcc

SEQ ID NO: 655094 - DNA, 20 bp, Artificial
  CRISPR gRNA sequence
agagctgtctcttgcatcct

SEQ ID NO: 655095 - DNA, 20 bp, Artificial
  CRISPR gRNA sequence
tctcttgcatcctttatgta

SEQ ID NO: 655096 - DNA, 20 bp, Artificial
  CRISPR gRNA sequence
ttgcatcctttatgtagcct

SEQ ID NO: 655097 - DNA, 20 bp, Artificial
  CRISPR gRNA sequence
gcatcctttatgtagcctct

SEQ ID NO: 655098 - DNA, 20 bp, Artificial
  CRISPR gRNA sequence
catcctttatgtagcctcta

SEQ ID NO: 655099 - DNA, 20 bp, Artificial
  CRISPR gRNA sequence
tatgtagcctctatttacag

SEQ ID NO: 655100 - DNA, 20 bp, Artificial
  CRISPR gRNA sequence
atgtagcctctatttacagt

SEQ ID NO: 655101 - DNA, 20 bp, Artificial
  CRISPR gRNA sequence
tgtagcctctatttacagta

SEQ ID NO: 655102 - DNA, 20 bp, Artificial
  CRISPR gRNA sequence
tatttacagtatctaggtta

SEQ ID NO: 655103 - DNA, 20 bp, Artificial
  CRISPR gRNA sequence
tttacagtatctaggttacc

SEQ ID NO: 655104 - DNA, 20 bp, Artificial
  CRISPR gRNA sequence
acagtatctaggttacccac

SEQ ID NO: 655105 - DNA, 20 bp, Artificial
  CRISPR gRNA sequence
cagtatctaggttacccact

SEQ ID NO: 655106 - DNA, 20 bp, Artificial
  CRISPR gRNA sequence
ggttacccacttaggtgtta

SEQ ID NO: 655107 - DNA, 20 bp, Artificial
  CRISPR gRNA sequence
cccacttaggtgttagatgg

SEQ ID NO: 655108 - DNA, 20 bp, Artificial
  CRISPR gRNA sequence
aggtgttagatggagaagat

SEQ ID NO: 655109 - DNA, 20 bp, Artificial
  CRISPR gRNA sequence
ggtgttagatggagaagata

SEQ ID NO: 655110 - DNA, 20 bp, Artificial
  CRISPR gRNA sequence
gatggagaagatacccattt

SEQ ID NO: 655111 - DNA, 20 bp, Artificial
  CRISPR gRNA sequence
ttcctctctgttagatctag

SEQ ID NO: 655112 - DNA, 20 bp, Artificial
  CRISPR gRNA sequence
tcctctctgttagatctagg

SEQ ID NO: 655113 - DNA, 20 bp, Artificial
  CRISPR gRNA sequence
cctctctgttagatctagga

SEQ ID NO: 655114 - DNA, 20 bp, Artificial
  CRISPR gRNA sequence
ctctctgttagatctaggag

SEQ ID NO: 655115 - DNA, 20 bp, Artificial
  CRISPR gRNA sequence
tctgttagatctaggagaat

SEQ ID NO: 655116 - DNA, 20 bp, Artificial
  CRISPR gRNA sequence
tgttagatctaggagaatat

SEQ ID NO: 655117 - DNA, 20 bp, Artificial
  CRISPR gRNA sequence
ttagatctaggagaatatca

SEQ ID NO: 655118 - DNA, 20 bp, Artificial
  CRISPR gRNA sequence
gatctaggagaatatcagca

SEQ ID NO: 655119 - DNA, 20 bp, Artificial
  CRISPR gRNA sequence
ggagaatatcagcattttag

SEQ ID NO: 655120 - DNA, 20 bp, Artificial
  CRISPR gRNA sequence
tagattgccaaagcaaatag

SEQ ID NO: 655121 - DNA, 20 bp, Artificial
  CRISPR gRNA sequence
agattgccaaagcaaatagt

SEQ ID NO: 655122 - DNA, 20 bp, Artificial
  CRISPR gRNA sequence
gattgccaaagcaaatagtg

SEQ ID NO: 655123 - DNA, 20 bp, Artificial
  CRISPR gRNA sequence
ccaaagcaaatagtgataga

SEQ ID NO: 655124 - DNA, 20 bp, Artificial
  CRISPR gRNA sequence
tcgtctattaattagaacaa

SEQ ID NO: 655125 - DNA, 20 bp, Artificial
  CRISPR gRNA sequence
gtctattaattagaacaaga

SEQ ID NO: 655126 - DNA, 20 bp, Artificial
  CRISPR gRNA sequence
ttaattagaacaagagacct

SEQ ID NO: 655127 - DNA, 20 bp, Artificial
  CRISPR gRNA sequence
attagaacaagagacctaga

SEQ ID NO: 655128 - DNA, 20 bp, Artificial
  CRISPR gRNA sequence
gaacaagagacctagaattg

SEQ ID NO: 655129 - DNA, 20 bp, Artificial
  CRISPR gRNA sequence
gaattggtcactctgatgtt

SEQ ID NO: 655130 - DNA, 20 bp, Artificial
  CRISPR gRNA sequence
gtcactctgatgtttttctg

SEQ ID NO: 655131 - DNA, 20 bp, Artificial
  CRISPR gRNA sequence
tgatgtttttctgtgacttg

SEQ ID NO: 655132 - DNA, 20 bp, Artificial
  CRISPR gRNA sequence
atgtttttctgtgacttgga

SEQ ID NO: 655133 - DNA, 20 bp, Artificial
  CRISPR gRNA sequence
ttctgtgacttggaataatt

SEQ ID NO: 655134 - DNA, 20 bp, Artificial
  CRISPR gRNA sequence
tctgtgacttggaataattt

SEQ ID NO: 655135 - DNA, 20 bp, Artificial
  CRISPR gRNA sequence
ctgtgacttggaataatttt

SEQ ID NO: 655136 - DNA, 20 bp, Artificial
  CRISPR gRNA sequence
tgtgacttggaataattttt

SEQ ID NO: 655137 - DNA, 20 bp, Artificial
  CRISPR gRNA sequence
tgacttggaataattttttg

SEQ ID NO: 655138 - DNA, 20 bp, Artificial
  CRISPR gRNA sequence
ggaataattttttgtgtgca

SEQ ID NO: 655139 - DNA, 20 bp, Artificial
  CRISPR gRNA sequence
gaataattttttgtgtgcat

SEQ ID NO: 655140 - DNA, 20 bp, Artificial
  CRISPR gRNA sequence
tttgtgtgcatctggcctgt

SEQ ID NO: 655141 - DNA, 20 bp, Artificial
  CRISPR gRNA sequence
ttgtgtgcatctggcctgtc

SEQ ID NO: 655142 - DNA, 20 bp, Artificial
  CRISPR gRNA sequence
tgtgtgcatctggcctgtca

SEQ ID NO: 655143 - DNA, 20 bp, Artificial
  CRISPR gRNA sequence
gtgtgcatctggcctgtcaa

SEQ ID NO: 655144 - DNA, 20 bp, Artificial
  CRISPR gRNA sequence
tgtgcatctggcctgtcaaa

SEQ ID NO: 655145 - DNA, 20 bp, Artificial
  CRISPR gRNA sequence
gcctgtcaaatcacttgtgt

SEQ ID NO: 655146 - DNA, 20 bp, Artificial
  CRISPR gRNA sequence
tcaaatcacttgtgtctgag

SEQ ID NO: 655147 - DNA, 20 bp, Artificial
  CRISPR gRNA sequence
gtgtctgagatcaccggttt

SEQ ID NO: 655148 - DNA, 20 bp, Artificial
  CRISPR gRNA sequence
tgtctgagatcaccggtttt

SEQ ID NO: 655149 - DNA, 20 bp, Artificial
  CRISPR gRNA sequence
agatcaccggttttcctaaa

SEQ ID NO: 655150 - DNA, 20 bp, Artificial
  CRISPR gRNA sequence
tcctaaatccctttacatgc

SEQ ID NO: 655151 - DNA, 20 bp, Artificial
  CRISPR gRNA sequence
cctaaatccctttacatgca

SEQ ID NO: 655152 - DNA, 20 bp, Artificial
  CRISPR gRNA sequence
ctaaatccctttacatgcat

SEQ ID NO: 655153 - DNA, 20 bp, Artificial
  CRISPR gRNA sequence
aatccctttacatgcattgt

SEQ ID NO: 655154 - DNA, 20 bp, Artificial
  CRISPR gRNA sequence
tacatgcattgttgactttg

SEQ ID NO: 655155 - DNA, 20 bp, Artificial
  CRISPR gRNA sequence
acatgcattgttgactttgt

SEQ ID NO: 655156 - DNA, 20 bp, Artificial
  CRISPR gRNA sequence
catgcattgttgactttgtt

SEQ ID NO: 655157 - DNA, 20 bp, Artificial
  CRISPR gRNA sequence
ttgactttgtttaatgaaaa

SEQ ID NO: 655158 - DNA, 20 bp, Artificial
  CRISPR gRNA sequence
actttgtttaatgaaaagaa

SEQ ID NO: 655159 - DNA, 20 bp, Artificial
  CRISPR gRNA sequence
tgtttaatgaaaagaactta

SEQ ID NO: 655160 - DNA, 20 bp, Artificial
  CRISPR gRNA sequence
gtttaatgaaaagaacttat

SEQ ID NO: 655161 - DNA, 20 bp, Artificial
  CRISPR gRNA sequence
tttaatgaaaagaacttatt

SEQ ID NO: 655162 - DNA, 20 bp, Artificial
  CRISPR gRNA sequence
aatgaaaagaacttatttat

SEQ ID NO: 655163 - DNA, 20 bp, Artificial
  CRISPR gRNA sequence
atgaaaagaacttatttatt

SEQ ID NO: 655164 - DNA, 20 bp, Artificial
  CRISPR gRNA sequence
atttattttctgcatttttt

SEQ ID NO: 655165 - DNA, 20 bp, Artificial
  CRISPR gRNA sequence
tttattttctgcatttttta

SEQ ID NO: 655166 - DNA, 20 bp, Artificial
  CRISPR gRNA sequence
attttctgcattttttaata

SEQ ID NO: 655167 - DNA, 20 bp, Artificial
  CRISPR gRNA sequence
ttttctgcattttttaatat

SEQ ID NO: 655168 - DNA, 20 bp, Artificial
  CRISPR gRNA sequence
tctgcattttttaatatctt

SEQ ID NO: 655169 - DNA, 20 bp, Artificial
  CRISPR gRNA sequence
ctgcattttttaatatcttc

SEQ ID NO: 655170 - DNA, 20 bp, Artificial
  CRISPR gRNA sequence
tgcattttttaatatcttca

SEQ ID NO: 655171 - DNA, 20 bp, Artificial
  CRISPR gRNA sequence
cattttttaatatcttcaaa

SEQ ID NO: 655172 - DNA, 20 bp, Artificial
  CRISPR gRNA sequence
tttaatatcttcaaatatac

SEQ ID NO: 655173 - DNA, 20 bp, Artificial
  CRISPR gRNA sequence
ttaatatcttcaaatatact

SEQ ID NO: 655174 - DNA, 20 bp, Artificial
  CRISPR gRNA sequence
taatatcttcaaatatactt

SEQ ID NO: 655175 - DNA, 20 bp, Artificial
  CRISPR gRNA sequence
aatatcttcaaatatacttc

SEQ ID NO: 655176 - DNA, 20 bp, Artificial
  CRISPR gRNA sequence
atatcttcaaatatacttcc

SEQ ID NO: 655177 - DNA, 20 bp, Artificial
  CRISPR gRNA sequence
caaatatacttcctggaggg

SEQ ID NO: 655178 - DNA, 20 bp, Artificial
  CRISPR gRNA sequence
aaatatacttcctggagggt

SEQ ID NO: 655179 - DNA, 20 bp, Artificial
  CRISPR gRNA sequence
cctggagggtgcctgcttcc

SEQ ID NO: 655180 - DNA, 20 bp, Artificial
  CRISPR gRNA sequence
ctggagggtgcctgcttcca

SEQ ID NO: 655181 - DNA, 20 bp, Artificial
  CRISPR gRNA sequence
gagggtgcctgcttccaaaa

SEQ ID NO: 655182 - DNA, 20 bp, Artificial
  CRISPR gRNA sequence
cttccaaaaacagaattgca

SEQ ID NO: 655183 - DNA, 20 bp, Artificial
  CRISPR gRNA sequence
ccaaaaacagaattgcaatt

SEQ ID NO: 655184 - DNA, 20 bp, Artificial
  CRISPR gRNA sequence
caaaaacagaattgcaattt

SEQ ID NO: 655185 - DNA, 20 bp, Artificial
  CRISPR gRNA sequence
caattttgattgaaagtgtt

SEQ ID NO: 655186 - DNA, 20 bp, Artificial
  CRISPR gRNA sequence
tgattgaaagtgttaaagct

SEQ ID NO: 655187 - DNA, 20 bp, Artificial
  CRISPR gRNA sequence
gattgaaagtgttaaagcta

SEQ ID NO: 655188 - DNA, 20 bp, Artificial
  CRISPR gRNA sequence
attgaaagtgttaaagctaa

SEQ ID NO: 655189 - DNA, 20 bp, Artificial
  CRISPR gRNA sequence
aaagtgttaaagctaaaagt

SEQ ID NO: 655190 - DNA, 20 bp, Artificial
  CRISPR gRNA sequence
aagctaaaagtaaatgtgaa

SEQ ID NO: 655191 - DNA, 20 bp, Artificial
  CRISPR gRNA sequence
aaagtaaatgtgaaaacctt

SEQ ID NO: 655192 - DNA, 20 bp, Artificial
  CRISPR gRNA sequence
taagacagtttctagtagca

SEQ ID NO: 655193 - DNA, 20 bp, Artificial
  CRISPR gRNA sequence
aagacagtttctagtagcag

SEQ ID NO: 655194 - DNA, 20 bp, Artificial
  CRISPR gRNA sequence
agacagtttctagtagcagg

SEQ ID NO: 655195 - DNA, 20 bp, Artificial
  CRISPR gRNA sequence
ctagtagcaggaaggagagg

SEQ ID NO: 655196 - DNA, 20 bp, Artificial
  CRISPR gRNA sequence
tagtagcaggaaggagagga

SEQ ID NO: 655197 - DNA, 20 bp, Artificial
  CRISPR gRNA sequence
gtagcaggaaggagaggatg

SEQ ID NO: 655198 - DNA, 20 bp, Artificial
  CRISPR gRNA sequence
tttttaaacagttaaaaaaa

SEQ ID NO: 655199 - DNA, 20 bp, Artificial
  CRISPR gRNA sequence
ttaaacagttaaaaaaataa

SEQ ID NO: 655200 - DNA, 20 bp, Artificial
  CRISPR gRNA sequence
taaacagttaaaaaaataaa

SEQ ID NO: 655201 - DNA, 20 bp, Artificial
  CRISPR gRNA sequence
aaacagttaaaaaaataaaa

SEQ ID NO: 655202 - DNA, 20 bp, Artificial
  CRISPR gRNA sequence
aacagttaaaaaaataaaat

SEQ ID NO: 655203 - DNA, 20 bp, Artificial
  CRISPR gRNA sequence
aaaaaataaaataagtaaat

SEQ ID NO: 655204 - DNA, 20 bp, Artificial
  CRISPR gRNA sequence
tttttttttttttagtaaaa

SEQ ID NO: 655205 - DNA, 20 bp, Artificial
  CRISPR gRNA sequence
ttttttttttttagtaaaac

SEQ ID NO: 655206 - DNA, 20 bp, Artificial
  CRISPR gRNA sequence
tttttttttttagtaaaaca

SEQ ID NO: 655207 - DNA, 20 bp, Artificial
  CRISPR gRNA sequence
ttttttttttagtaaaacag

SEQ ID NO: 655208 - DNA, 20 bp, Artificial
  CRISPR gRNA sequence
tttttttttagtaaaacagc

SEQ ID NO: 655209 - DNA, 20 bp, Artificial
  CRISPR gRNA sequence
ttttttttagtaaaacagct

SEQ ID NO: 655210 - DNA, 20 bp, Artificial
  CRISPR gRNA sequence
tttttttagtaaaacagcta

SEQ ID NO: 655211 - DNA, 20 bp, Artificial
  CRISPR gRNA sequence
ttttttagtaaaacagctaa

SEQ ID NO: 655212 - DNA, 20 bp, Artificial
  CRISPR gRNA sequence
tttttagtaaaacagctaac

SEQ ID NO: 655213 - DNA, 20 bp, Artificial
  CRISPR gRNA sequence
ttttagtaaaacagctaaca

SEQ ID NO: 655214 - DNA, 20 bp, Artificial
  CRISPR gRNA sequence
tttagtaaaacagctaacat

SEQ ID NO: 655215 - DNA, 20 bp, Artificial
  CRISPR gRNA sequence
ttagtaaaacagctaacatt

SEQ ID NO: 655216 - DNA, 20 bp, Artificial
  CRISPR gRNA sequence
tagtaaaacagctaacattc

SEQ ID NO: 655217 - DNA, 20 bp, Artificial
  CRISPR gRNA sequence
agtaaaacagctaacattct

SEQ ID NO: 655218 - DNA, 20 bp, Artificial
  CRISPR gRNA sequence
gtaaaacagctaacattctg

SEQ ID NO: 655219 - DNA, 20 bp, Artificial
  CRISPR gRNA sequence
acattctggccagaaaagta

SEQ ID NO: 655220 - DNA, 20 bp, Artificial
  CRISPR gRNA sequence
tggccagaaaagtatcaata

SEQ ID NO: 655221 - DNA, 20 bp, Artificial
  CRISPR gRNA sequence
gccagaaaagtatcaataag

SEQ ID NO: 655222 - DNA, 20 bp, Artificial
  CRISPR gRNA sequence
acttattttggctttaggaa

SEQ ID NO: 655223 - DNA, 20 bp, Artificial
  CRISPR gRNA sequence
attttggctttaggaaggtg

SEQ ID NO: 655224 - DNA, 20 bp, Artificial
  CRISPR gRNA sequence
ttttggctttaggaaggtgg

SEQ ID NO: 655225 - DNA, 20 bp, Artificial
  CRISPR gRNA sequence
tggctttaggaaggtggtca

SEQ ID NO: 655226 - DNA, 20 bp, Artificial
  CRISPR gRNA sequence
ggctttaggaaggtggtcag

SEQ ID NO: 655227 - DNA, 20 bp, Artificial
  CRISPR gRNA sequence
gctttaggaaggtggtcagt

SEQ ID NO: 655228 - DNA, 20 bp, Artificial
  CRISPR gRNA sequence
taggaaggtggtcagtacta

SEQ ID NO: 655229 - DNA, 20 bp, Artificial
  CRISPR gRNA sequence
aggaaggtggtcagtactac

SEQ ID NO: 655230 - DNA, 20 bp, Artificial
  CRISPR gRNA sequence
ggaaggtggtcagtactact

SEQ ID NO: 655231 - DNA, 20 bp, Artificial
  CRISPR gRNA sequence
ctgtaaggtcccagcatttg

SEQ ID NO: 655232 - DNA, 20 bp, Artificial
  CRISPR gRNA sequence
taaggtcccagcatttgttt

SEQ ID NO: 655233 - DNA, 20 bp, Artificial
  CRISPR gRNA sequence
gtttaagctatttggtaact

SEQ ID NO: 655234 - DNA, 20 bp, Artificial
  CRISPR gRNA sequence
tttaagctatttggtaactc

SEQ ID NO: 655235 - DNA, 20 bp, Artificial
  CRISPR gRNA sequence
aagctatttggtaactcttc

SEQ ID NO: 655236 - DNA, 20 bp, Artificial
  CRISPR gRNA sequence
agctatttggtaactcttct

SEQ ID NO: 655237 - DNA, 20 bp, Artificial
  CRISPR gRNA sequence
tttggtaactcttctaagat

SEQ ID NO: 655238 - DNA, 20 bp, Artificial
  CRISPR gRNA sequence
ggtaactcttctaagatgaa

SEQ ID NO: 655239 - DNA, 20 bp, Artificial
  CRISPR gRNA sequence
gtaactcttctaagatgaag

SEQ ID NO: 655240 - DNA, 20 bp, Artificial
  CRISPR gRNA sequence
ttctaagatgaagggtttct

SEQ ID NO: 655241 - DNA, 20 bp, Artificial
  CRISPR gRNA sequence
ctaagatgaagggtttctgt

SEQ ID NO: 655242 - DNA, 20 bp, Artificial
  CRISPR gRNA sequence
taagatgaagggtttctgtg

SEQ ID NO: 655243 - DNA, 20 bp, Artificial
  CRISPR gRNA sequence
agatgaagggtttctgtgca

SEQ ID NO: 655244 - DNA, 20 bp, Artificial
  CRISPR gRNA sequence
ctgtgcaacttgctgccagc

SEQ ID NO: 655245 - DNA, 20 bp, Artificial
  CRISPR gRNA sequence
tgtgcaacttgctgccagct

SEQ ID NO: 655246 - DNA, 20 bp, Artificial
  CRISPR gRNA sequence
tgcaacttgctgccagctat

SEQ ID NO: 655247 - DNA, 20 bp, Artificial
  CRISPR gRNA sequence
gctgccagctattgtataaa

SEQ ID NO: 655248 - DNA, 20 bp, Artificial
  CRISPR gRNA sequence
ctgccagctattgtataaaa

SEQ ID NO: 655249 - DNA, 20 bp, Artificial
  CRISPR gRNA sequence
ccagctattgtataaaaata

SEQ ID NO: 655250 - DNA, 20 bp, Artificial
  CRISPR gRNA sequence
ttgtataaaaataatgacgg

SEQ ID NO: 655251 - DNA, 20 bp, Artificial
  CRISPR gRNA sequence
tataaaaataatgacggcag

SEQ ID NO: 655252 - DNA, 20 bp, Artificial
  CRISPR gRNA sequence
tcattatttgacagtgctag

SEQ ID NO: 655253 - DNA, 20 bp, Artificial
  CRISPR gRNA sequence
tttgacagtgctagaataga

SEQ ID NO: 655254 - DNA, 20 bp, Artificial
  CRISPR gRNA sequence
gacagtgctagaatagagca

SEQ ID NO: 655255 - DNA, 20 bp, Artificial
  CRISPR gRNA sequence
acagtgctagaatagagcac

SEQ ID NO: 655256 - DNA, 20 bp, Artificial
  CRISPR gRNA sequence
gaatagagcactggtgactt

SEQ ID NO: 655257 - DNA, 20 bp, Artificial
  CRISPR gRNA sequence
gtgacttgggagggagagaa

SEQ ID NO: 655258 - DNA, 20 bp, Artificial
  CRISPR gRNA sequence
gggagggagagaactaaaaa

SEQ ID NO: 655259 - DNA, 20 bp, Artificial
  CRISPR gRNA sequence
ggagggagagaactaaaaat

SEQ ID NO: 655260 - DNA, 20 bp, Artificial
  CRISPR gRNA sequence
aaaatgttataatgcctgac

SEQ ID NO: 655261 - DNA, 20 bp, Artificial
  CRISPR gRNA sequence
taatgcctgacagtttttgg

SEQ ID NO: 655262 - DNA, 20 bp, Artificial
  CRISPR gRNA sequence
acagtttttggttttaaaat

SEQ ID NO: 655263 - DNA, 20 bp, Artificial
  CRISPR gRNA sequence
ttggttttaaaatttagcat

SEQ ID NO: 655264 - DNA, 20 bp, Artificial
  CRISPR gRNA sequence
tggttttaaaatttagcatc

SEQ ID NO: 655265 - DNA, 20 bp, Artificial
  CRISPR gRNA sequence
ggttttaaaatttagcatct

SEQ ID NO: 655266 - DNA, 20 bp, Artificial
  CRISPR gRNA sequence
gttttaaaatttagcatcta

SEQ ID NO: 655267 - DNA, 20 bp, Artificial
  CRISPR gRNA sequence
taaaatttagcatctaagat

SEQ ID NO: 655268 - DNA, 20 bp, Artificial
  CRISPR gRNA sequence
aaaatttagcatctaagata

SEQ ID NO: 655269 - DNA, 20 bp, Artificial
  CRISPR gRNA sequence
aaatttagcatctaagataa

SEQ ID NO: 655270 - DNA, 20 bp, Artificial
  CRISPR gRNA sequence
agcatctaagataaacttaa

SEQ ID NO: 655271 - DNA, 20 bp, Artificial
  CRISPR gRNA sequence
gcatctaagataaacttaag

SEQ ID NO: 655272 - DNA, 20 bp, Artificial
  CRISPR gRNA sequence
agataaacttaagaagaagt

SEQ ID NO: 655273 - DNA, 20 bp, Artificial
  CRISPR gRNA sequence
aagaagaagtaagaggtatt

SEQ ID NO: 655274 - DNA, 20 bp, Artificial
  CRISPR gRNA sequence
agaagaagtaagaggtatta

SEQ ID NO: 655275 - DNA, 20 bp, Artificial
  CRISPR gRNA sequence
gtgatcctaacattttataa

SEQ ID NO: 655276 - DNA, 20 bp, Artificial
  CRISPR gRNA sequence
acattttataatgactactt

SEQ ID NO: 655277 - DNA, 20 bp, Artificial
  CRISPR gRNA sequence
tataatgactacttcctatg

SEQ ID NO: 655278 - DNA, 20 bp, Artificial
  CRISPR gRNA sequence
ataatgactacttcctatgg

SEQ ID NO: 655279 - DNA, 20 bp, Artificial
  CRISPR gRNA sequence
taatgactacttcctatggt

SEQ ID NO: 655280 - DNA, 20 bp, Artificial
  CRISPR gRNA sequence
cttcctatggttttgaatga

SEQ ID NO: 655281 - DNA, 20 bp, Artificial
  CRISPR gRNA sequence
cctatggttttgaatgaatt

SEQ ID NO: 655282 - DNA, 20 bp, Artificial
  CRISPR gRNA sequence
ctatggttttgaatgaattt

SEQ ID NO: 655283 - DNA, 20 bp, Artificial
  CRISPR gRNA sequence
tggttttgaatgaattttct

SEQ ID NO: 655284 - DNA, 20 bp, Artificial
  CRISPR gRNA sequence
tgaatgaattttcttagaga

SEQ ID NO: 655285 - DNA, 20 bp, Artificial
  CRISPR gRNA sequence
gaatgaattttcttagagaa

SEQ ID NO: 655286 - DNA, 20 bp, Artificial
  CRISPR gRNA sequence
aatgaattttcttagagaac

SEQ ID NO: 655287 - DNA, 20 bp, Artificial
  CRISPR gRNA sequence
tcttagagaactttaaactt

SEQ ID NO: 655288 - DNA, 20 bp, Artificial
  CRISPR gRNA sequence
cttagagaactttaaacttt

SEQ ID NO: 655289 - DNA, 20 bp, Artificial
  CRISPR gRNA sequence
ttagagaactttaaactttt

SEQ ID NO: 655290 - DNA, 20 bp, Artificial
  CRISPR gRNA sequence
agagaactttaaactttttc

SEQ ID NO: 655291 - DNA, 20 bp, Artificial
  CRISPR gRNA sequence
gagaactttaaactttttct

SEQ ID NO: 655292 - DNA, 20 bp, Artificial
  CRISPR gRNA sequence
taaactttttcttctggaat

SEQ ID NO: 655293 - DNA, 20 bp, Artificial
  CRISPR gRNA sequence
aaactttttcttctggaatg

SEQ ID NO: 655294 - DNA, 20 bp, Artificial
  CRISPR gRNA sequence
aactttttcttctggaatga

SEQ ID NO: 655295 - DNA, 20 bp, Artificial
  CRISPR gRNA sequence
tttcttctggaatgaggatg

SEQ ID NO: 655296 - DNA, 20 bp, Artificial
  CRISPR gRNA sequence
ttcttctggaatgaggatgt

SEQ ID NO: 655297 - DNA, 20 bp, Artificial
  CRISPR gRNA sequence
tcttctggaatgaggatgtc

SEQ ID NO: 655298 - DNA, 20 bp, Artificial
  CRISPR gRNA sequence
cttctggaatgaggatgtct

SEQ ID NO: 655299 - DNA, 20 bp, Artificial
  CRISPR gRNA sequence
ttctggaatgaggatgtctt

SEQ ID NO: 655300 - DNA, 20 bp, Artificial
  CRISPR gRNA sequence
ctggaatgaggatgtctttg

SEQ ID NO: 655301 - DNA, 20 bp, Artificial
  CRISPR gRNA sequence
tggaatgaggatgtctttgt

SEQ ID NO: 655302 - DNA, 20 bp, Artificial
  CRISPR gRNA sequence
gaatgaggatgtctttgtta

SEQ ID NO: 655303 - DNA, 20 bp, Artificial
  CRISPR gRNA sequence
tgttaagaagatggacattg

SEQ ID NO: 655304 - DNA, 20 bp, Artificial
  CRISPR gRNA sequence
gttaagaagatggacattgt

SEQ ID NO: 655305 - DNA, 20 bp, Artificial
  CRISPR gRNA sequence
ttaagaagatggacattgtt

SEQ ID NO: 655306 - DNA, 20 bp, Artificial
  CRISPR gRNA sequence
agaagatggacattgttgcc

SEQ ID NO: 655307 - DNA, 20 bp, Artificial
  CRISPR gRNA sequence
ttgcctgagatcattagtgt

SEQ ID NO: 655308 - DNA, 20 bp, Artificial
  CRISPR gRNA sequence
cctgagatcattagtgtaca

SEQ ID NO: 655309 - DNA, 20 bp, Artificial
  CRISPR gRNA sequence
agatcattagtgtacatatt

SEQ ID NO: 655310 - DNA, 20 bp, Artificial
  CRISPR gRNA sequence
gtgtacatattgagtctgct

SEQ ID NO: 655311 - DNA, 20 bp, Artificial
  CRISPR gRNA sequence
agtctgctgacaatcttcgg

SEQ ID NO: 655312 - DNA, 20 bp, Artificial
  CRISPR gRNA sequence
ctgacaatcttcggtgtcag

SEQ ID NO: 655313 - DNA, 20 bp, Artificial
  CRISPR gRNA sequence
acaatcttcggtgtcaggga

SEQ ID NO: 655314 - DNA, 20 bp, Artificial
  CRISPR gRNA sequence
cggtgtcagggatgacagta

SEQ ID NO: 655315 - DNA, 20 bp, Artificial
  CRISPR gRNA sequence
ggtgtcagggatgacagtat

SEQ ID NO: 655316 - DNA, 20 bp, Artificial
  CRISPR gRNA sequence
gatggctattggaaatacac

SEQ ID NO: 655317 - DNA, 20 bp, Artificial
  CRISPR gRNA sequence
atggctattggaaatacaca

SEQ ID NO: 655318 - DNA, 20 bp, Artificial
  CRISPR gRNA sequence
ttggaaatacacagtgttaa

SEQ ID NO: 655319 - DNA, 20 bp, Artificial
  CRISPR gRNA sequence
gaaatacacagtgttaagtg

SEQ ID NO: 655320 - DNA, 20 bp, Artificial
  CRISPR gRNA sequence
agtgatttttaaaaatagaa

SEQ ID NO: 655321 - DNA, 20 bp, Artificial
  CRISPR gRNA sequence
ttaaaaatagaatctgggac

SEQ ID NO: 655322 - DNA, 20 bp, Artificial
  CRISPR gRNA sequence
taaaaatagaatctgggact

SEQ ID NO: 655323 - DNA, 20 bp, Artificial
  CRISPR gRNA sequence
aaaaatagaatctgggactt

SEQ ID NO: 655324 - DNA, 20 bp, Artificial
  CRISPR gRNA sequence
aaaatagaatctgggactta

SEQ ID NO: 655325 - DNA, 20 bp, Artificial
  CRISPR gRNA sequence
ggacttaagaatctgagaca

SEQ ID NO: 655326 - DNA, 20 bp, Artificial
  CRISPR gRNA sequence
aagaatctgagacagacatc

SEQ ID NO: 655327 - DNA, 20 bp, Artificial
  CRISPR gRNA sequence
agaatctgagacagacatct

SEQ ID NO: 655328 - DNA, 20 bp, Artificial
  CRISPR gRNA sequence
agacagacatctcagacaga

SEQ ID NO: 655329 - DNA, 20 bp, Artificial
  CRISPR gRNA sequence
agacagaacaatataaaaat

SEQ ID NO: 655330 - DNA, 20 bp, Artificial
  CRISPR gRNA sequence
tatttcggcccatcagatga

SEQ ID NO: 655331 - DNA, 20 bp, Artificial
  CRISPR gRNA sequence
cggcccatcagatgaaactt

SEQ ID NO: 655332 - DNA, 20 bp, Artificial
  CRISPR gRNA sequence
ggcccatcagatgaaactta

SEQ ID NO: 655333 - DNA, 20 bp, Artificial
  CRISPR gRNA sequence
actttgtgattccttctgtt

SEQ ID NO: 655334 - DNA, 20 bp, Artificial
  CRISPR gRNA sequence
ctttgtgattccttctgttt

SEQ ID NO: 655335 - DNA, 20 bp, Artificial
  CRISPR gRNA sequence
tgtgattccttctgtttctt

SEQ ID NO: 655336 - DNA, 20 bp, Artificial
  CRISPR gRNA sequence
gtgattccttctgtttcttg

SEQ ID NO: 655337 - DNA, 20 bp, Artificial
  CRISPR gRNA sequence
tgattccttctgtttcttgg

SEQ ID NO: 655338 - DNA, 20 bp, Artificial
  CRISPR gRNA sequence
cttctgtttcttggttagct

SEQ ID NO: 655339 - DNA, 20 bp, Artificial
  CRISPR gRNA sequence
ctgtttcttggttagctcat

SEQ ID NO: 655340 - DNA, 20 bp, Artificial
  CRISPR gRNA sequence
tgtttcttggttagctcatt

SEQ ID NO: 655341 - DNA, 20 bp, Artificial
  CRISPR gRNA sequence
tttcttggttagctcatttc

SEQ ID NO: 655342 - DNA, 20 bp, Artificial
  CRISPR gRNA sequence
cttggttagctcatttccaa

SEQ ID NO: 655343 - DNA, 20 bp, Artificial
  CRISPR gRNA sequence
ttggttagctcatttccaat

SEQ ID NO: 655344 - DNA, 20 bp, Artificial
  CRISPR gRNA sequence
ggttagctcatttccaattc

SEQ ID NO: 655345 - DNA, 20 bp, Artificial
  CRISPR gRNA sequence
gttagctcatttccaattct

SEQ ID NO: 655346 - DNA, 20 bp, Artificial
  CRISPR gRNA sequence
gctcatttccaattcttgca

SEQ ID NO: 655347 - DNA, 20 bp, Artificial
  CRISPR gRNA sequence
atttccaattcttgcatagt

SEQ ID NO: 655348 - DNA, 20 bp, Artificial
  CRISPR gRNA sequence
ccaattcttgcatagttgtt

SEQ ID NO: 655349 - DNA, 20 bp, Artificial
  CRISPR gRNA sequence
caattcttgcatagttgttc

SEQ ID NO: 655350 - DNA, 20 bp, Artificial
  CRISPR gRNA sequence
ttgcatagttgttcagtatt

SEQ ID NO: 655351 - DNA, 20 bp, Artificial
  CRISPR gRNA sequence
gcatagttgttcagtattgg

SEQ ID NO: 655352 - DNA, 20 bp, Artificial
  CRISPR gRNA sequence
catagttgttcagtattggt

SEQ ID NO: 655353 - DNA, 20 bp, Artificial
  CRISPR gRNA sequence
ttcagtattggtttcagact

SEQ ID NO: 655354 - DNA, 20 bp, Artificial
  CRISPR gRNA sequence
agtattggtttcagactgtt

SEQ ID NO: 655355 - DNA, 20 bp, Artificial
  CRISPR gRNA sequence
gtttcagactgttctatact

SEQ ID NO: 655356 - DNA, 20 bp, Artificial
  CRISPR gRNA sequence
cagactgttctatactggca

SEQ ID NO: 655357 - DNA, 20 bp, Artificial
  CRISPR gRNA sequence
agactgttctatactggcag

SEQ ID NO: 655358 - DNA, 20 bp, Artificial
  CRISPR gRNA sequence
ttctatactggcaggtgact

SEQ ID NO: 655359 - DNA, 20 bp, Artificial
  CRISPR gRNA sequence
tatactggcaggtgactatt

SEQ ID NO: 655360 - DNA, 20 bp, Artificial
  CRISPR gRNA sequence
tactggcaggtgactatttt

SEQ ID NO: 655361 - DNA, 20 bp, Artificial
  CRISPR gRNA sequence
gcaggtgactattttgaaaa

SEQ ID NO: 655362 - DNA, 20 bp, Artificial
  CRISPR gRNA sequence
ttttgaaaattgtttaaagt

SEQ ID NO: 655363 - DNA, 20 bp, Artificial
  CRISPR gRNA sequence
tgaaaattgtttaaagttca

SEQ ID NO: 655364 - DNA, 20 bp, Artificial
  CRISPR gRNA sequence
gaaaattgtttaaagttcaa

SEQ ID NO: 655365 - DNA, 20 bp, Artificial
  CRISPR gRNA sequence
aaaattgtttaaagttcaaa

SEQ ID NO: 655366 - DNA, 20 bp, Artificial
  CRISPR gRNA sequence
tttaaagttcaaaattttta

SEQ ID NO: 655367 - DNA, 20 bp, Artificial
  CRISPR gRNA sequence
aaagttcaaaatttttaaat

SEQ ID NO: 655368 - DNA, 20 bp, Artificial
  CRISPR gRNA sequence
aagttcaaaatttttaaatt

SEQ ID NO: 655369 - DNA, 20 bp, Artificial
  CRISPR gRNA sequence
aaaatttttaaattaatttt

SEQ ID NO: 655370 - DNA, 20 bp, Artificial
  CRISPR gRNA sequence
ttaaattaattttatttttc

SEQ ID NO: 655371 - DNA, 20 bp, Artificial
  CRISPR gRNA sequence
taaattaattttatttttct

SEQ ID NO: 655372 - DNA, 20 bp, Artificial
  CRISPR gRNA sequence
aaattaattttatttttctt

SEQ ID NO: 655373 - DNA, 20 bp, Artificial
  CRISPR gRNA sequence
aattaattttatttttctta

SEQ ID NO: 655374 - DNA, 20 bp, Artificial
  CRISPR gRNA sequence
attttatttttcttatctat

SEQ ID NO: 655375 - DNA, 20 bp, Artificial
  CRISPR gRNA sequence
tatttttcttatctattttt

SEQ ID NO: 655376 - DNA, 20 bp, Artificial
  CRISPR gRNA sequence
atttttcttatctatttttt

SEQ ID NO: 655377 - DNA, 20 bp, Artificial
  CRISPR gRNA sequence
tttttcttatctattttttt

SEQ ID NO: 655378 - DNA, 20 bp, Artificial
  CRISPR gRNA sequence
ttcttatctatttttttata

SEQ ID NO: 655379 - DNA, 20 bp, Artificial
  CRISPR gRNA sequence
tcttatctatttttttataa

SEQ ID NO: 655380 - DNA, 20 bp, Artificial
  CRISPR gRNA sequence
cttatctatttttttataat

SEQ ID NO: 655381 - DNA, 20 bp, Artificial
  CRISPR gRNA sequence
ttatctatttttttataatg

SEQ ID NO: 655382 - DNA, 20 bp, Artificial
  CRISPR gRNA sequence
atctatttttttataatgtt

SEQ ID NO: 655383 - DNA, 20 bp, Artificial
  CRISPR gRNA sequence
tctatttttttataatgttt

SEQ ID NO: 655384 - DNA, 20 bp, Artificial
  CRISPR gRNA sequence
tttttttataatgtttatgt

SEQ ID NO: 655385 - DNA, 20 bp, Artificial
  CRISPR gRNA sequence
ttttataatgtttatgtata

SEQ ID NO: 655386 - DNA, 20 bp, Artificial
  CRISPR gRNA sequence
tttataatgtttatgtataa

SEQ ID NO: 655387 - DNA, 20 bp, Artificial
  CRISPR gRNA sequence
ttataatgtttatgtataaa

SEQ ID NO: 655388 - DNA, 20 bp, Artificial
  CRISPR gRNA sequence
tataatgtttatgtataaat

SEQ ID NO: 655389 - DNA, 20 bp, Artificial
  CRISPR gRNA sequence
ataatgtttatgtataaatt

SEQ ID NO: 655390 - DNA, 20 bp, Artificial
  CRISPR gRNA sequence
taatgtttatgtataaattt

SEQ ID NO: 655391 - DNA, 20 bp, Artificial
  CRISPR gRNA sequence
atgtataaatttactttgca

SEQ ID NO: 655392 - DNA, 20 bp, Artificial
  CRISPR gRNA sequence
tgtataaatttactttgcag

SEQ ID NO: 655393 - DNA, 20 bp, Artificial
  CRISPR gRNA sequence
actttgcaggtagttactta

SEQ ID NO: 655394 - DNA, 20 bp, Artificial
  CRISPR gRNA sequence
ctttgcaggtagttacttaa

SEQ ID NO: 655395 - DNA, 20 bp, Artificial
  CRISPR gRNA sequence
tgcaggtagttacttaaatg

SEQ ID NO: 655396 - DNA, 20 bp, Artificial
  CRISPR gRNA sequence
gcaggtagttacttaaatgg

SEQ ID NO: 655397 - DNA, 20 bp, Artificial
  CRISPR gRNA sequence
caggtagttacttaaatggg

SEQ ID NO: 655398 - DNA, 20 bp, Artificial
  CRISPR gRNA sequence
cttaaatgggtatgaaaata

SEQ ID NO: 655399 - DNA, 20 bp, Artificial
  CRISPR gRNA sequence
aaatgggtatgaaaatacat

SEQ ID NO: 655400 - DNA, 20 bp, Artificial
  CRISPR gRNA sequence
aatgggtatgaaaatacatc

SEQ ID NO: 655401 - DNA, 20 bp, Artificial
  CRISPR gRNA sequence
gtttctattactttaaagct

SEQ ID NO: 655402 - DNA, 20 bp, Artificial
  CRISPR gRNA sequence
tttctattactttaaagctg

SEQ ID NO: 655403 - DNA, 20 bp, Artificial
  CRISPR gRNA sequence
ctattactttaaagctgtta

SEQ ID NO: 655404 - DNA, 20 bp, Artificial
  CRISPR gRNA sequence
tattactttaaagctgttaa

SEQ ID NO: 655405 - DNA, 20 bp, Artificial
  CRISPR gRNA sequence
ttactttaaagctgttaagt

SEQ ID NO: 655406 - DNA, 20 bp, Artificial
  CRISPR gRNA sequence
ctttaaagctgttaagtgga

SEQ ID NO: 655407 - DNA, 20 bp, Artificial
  CRISPR gRNA sequence
taaagctgttaagtggatca

SEQ ID NO: 655408 - DNA, 20 bp, Artificial
  CRISPR gRNA sequence
aaagctgttaagtggatcaa

SEQ ID NO: 655409 - DNA, 20 bp, Artificial
  CRISPR gRNA sequence
aagctgttaagtggatcaac

SEQ ID NO: 655410 - DNA, 20 bp, Artificial
  CRISPR gRNA sequence
ttaagtggatcaactgtaca

SEQ ID NO: 655411 - DNA, 20 bp, Artificial
  CRISPR gRNA sequence
agtggatcaactgtacagtc

SEQ ID NO: 655412 - DNA, 20 bp, Artificial
  CRISPR gRNA sequence
tacagtcaatgctatttatc

SEQ ID NO: 655413 - DNA, 20 bp, Artificial
  CRISPR gRNA sequence
tttatcagtctgatggccag

SEQ ID NO: 655414 - DNA, 20 bp, Artificial
  CRISPR gRNA sequence
atcagtctgatggccaggtg

SEQ ID NO: 655415 - DNA, 20 bp, Artificial
  CRISPR gRNA sequence
tcagtctgatggccaggtgg

SEQ ID NO: 655416 - DNA, 20 bp, Artificial
  CRISPR gRNA sequence
atggccaggtggcatgtatg

SEQ ID NO: 655417 - DNA, 20 bp, Artificial
  CRISPR gRNA sequence
gttttacaaggctctgacca

SEQ ID NO: 655418 - DNA, 20 bp, Artificial
  CRISPR gRNA sequence
tacaaggctctgaccaataa

SEQ ID NO: 655419 - DNA, 20 bp, Artificial
  CRISPR gRNA sequence
acaaggctctgaccaataat

SEQ ID NO: 655420 - DNA, 20 bp, Artificial
  CRISPR gRNA sequence
caaggctctgaccaataatc

SEQ ID NO: 655421 - DNA, 20 bp, Artificial
  CRISPR gRNA sequence
tgaccaataatcaggtcagg

SEQ ID NO: 655422 - DNA, 20 bp, Artificial
  CRISPR gRNA sequence
accaataatcaggtcaggga

SEQ ID NO: 655423 - DNA, 20 bp, Artificial
  CRISPR gRNA sequence
gtttattcttttcagagtac

SEQ ID NO: 655424 - DNA, 20 bp, Artificial
  CRISPR gRNA sequence
attcttttcagagtacttca

SEQ ID NO: 655425 - DNA, 20 bp, Artificial
  CRISPR gRNA sequence
ttcttttcagagtacttcac

SEQ ID NO: 655426 - DNA, 20 bp, Artificial
  CRISPR gRNA sequence
ttttcagagtacttcacatt

SEQ ID NO: 655427 - DNA, 20 bp, Artificial
  CRISPR gRNA sequence
ttcagagtacttcacattaa

SEQ ID NO: 655428 - DNA, 20 bp, Artificial
  CRISPR gRNA sequence
tcagagtacttcacattaat

SEQ ID NO: 655429 - DNA, 20 bp, Artificial
  CRISPR gRNA sequence
cagagtacttcacattaatt

SEQ ID NO: 655430 - DNA, 20 bp, Artificial
  CRISPR gRNA sequence
agagtacttcacattaattt

SEQ ID NO: 655431 - DNA, 20 bp, Artificial
  CRISPR gRNA sequence
cacattaatttttttcttag

SEQ ID NO: 655432 - DNA, 20 bp, Artificial
  CRISPR gRNA sequence
acattaatttttttcttagc

SEQ ID NO: 655433 - DNA, 20 bp, Artificial
  CRISPR gRNA sequence
atttttttcttagctagttt

SEQ ID NO: 655434 - DNA, 20 bp, Artificial
  CRISPR gRNA sequence
ttttcttagctagtttccat

SEQ ID NO: 655435 - DNA, 20 bp, Artificial
  CRISPR gRNA sequence
tttcttagctagtttccatt

SEQ ID NO: 655436 - DNA, 20 bp, Artificial
  CRISPR gRNA sequence
ttcttagctagtttccattt

SEQ ID NO: 655437 - DNA, 20 bp, Artificial
  CRISPR gRNA sequence
tcttagctagtttccatttt

SEQ ID NO: 655438 - DNA, 20 bp, Artificial
  CRISPR gRNA sequence
cttagctagtttccattttt

SEQ ID NO: 655439 - DNA, 20 bp, Artificial
  CRISPR gRNA sequence
ttagctagtttccattttta

SEQ ID NO: 655440 - DNA, 20 bp, Artificial
  CRISPR gRNA sequence
agctagtttccatttttaga

SEQ ID NO: 655441 - DNA, 20 bp, Artificial
  CRISPR gRNA sequence
gctagtttccatttttagaa

SEQ ID NO: 655442 - DNA, 20 bp, Artificial
  CRISPR gRNA sequence
gtttccatttttagaaccta

SEQ ID NO: 655443 - DNA, 20 bp, Artificial
  CRISPR gRNA sequence
ccatttttagaacctagcga

SEQ ID NO: 655444 - DNA, 20 bp, Artificial
  CRISPR gRNA sequence
catttttagaacctagcgaa

SEQ ID NO: 655445 - DNA, 20 bp, Artificial
  CRISPR gRNA sequence
ttagaacctagcgaagcaga

SEQ ID NO: 655446 - DNA, 20 bp, Artificial
  CRISPR gRNA sequence
tagaacctagcgaagcagaa

SEQ ID NO: 655447 - DNA, 20 bp, Artificial
  CRISPR gRNA sequence
agaacctagcgaagcagaag

SEQ ID NO: 655448 - DNA, 20 bp, Artificial
  CRISPR gRNA sequence
gaacctagcgaagcagaagt

SEQ ID NO: 655449 - DNA, 20 bp, Artificial
  CRISPR gRNA sequence
gcgaagcagaagtatattat

SEQ ID NO: 655450 - DNA, 20 bp, Artificial
  CRISPR gRNA sequence
tgatttctatttttcatatg

SEQ ID NO: 655451 - DNA, 20 bp, Artificial
  CRISPR gRNA sequence
ctatttttcatatgtggaaa

SEQ ID NO: 655452 - DNA, 20 bp, Artificial
  CRISPR gRNA sequence
tatttttcatatgtggaaat

SEQ ID NO: 655453 - DNA, 20 bp, Artificial
  CRISPR gRNA sequence
tttttcatatgtggaaattg

SEQ ID NO: 655454 - DNA, 20 bp, Artificial
  CRISPR gRNA sequence
ttcatatgtggaaattgagg

SEQ ID NO: 655455 - DNA, 20 bp, Artificial
  CRISPR gRNA sequence
tcatatgtggaaattgaggc

SEQ ID NO: 655456 - DNA, 20 bp, Artificial
  CRISPR gRNA sequence
catatgtggaaattgaggct

SEQ ID NO: 655457 - DNA, 20 bp, Artificial
  CRISPR gRNA sequence
atatgtggaaattgaggctt

SEQ ID NO: 655458 - DNA, 20 bp, Artificial
  CRISPR gRNA sequence
aggcttgaagaaatcaattt

SEQ ID NO: 655459 - DNA, 20 bp, Artificial
  CRISPR gRNA sequence
gaagaaatcaatttacctct

SEQ ID NO: 655460 - DNA, 20 bp, Artificial
  CRISPR gRNA sequence
aagaaatcaatttacctctt

SEQ ID NO: 655461 - DNA, 20 bp, Artificial
  CRISPR gRNA sequence
acctcttagagaacttagca

SEQ ID NO: 655462 - DNA, 20 bp, Artificial
  CRISPR gRNA sequence
cctcttagagaacttagcag

SEQ ID NO: 655463 - DNA, 20 bp, Artificial
  CRISPR gRNA sequence
ttagagaacttagcagaaag

SEQ ID NO: 655464 - DNA, 20 bp, Artificial
  CRISPR gRNA sequence
agagaacttagcagaaagat

SEQ ID NO: 655465 - DNA, 20 bp, Artificial
  CRISPR gRNA sequence
gagaacttagcagaaagatg

SEQ ID NO: 655466 - DNA, 20 bp, Artificial
  CRISPR gRNA sequence
agcagaaagatgaagttatc

SEQ ID NO: 655467 - DNA, 20 bp, Artificial
  CRISPR gRNA sequence
gcagaaagatgaagttatca

SEQ ID NO: 655468 - DNA, 20 bp, Artificial
  CRISPR gRNA sequence
tcaggattgggacataaaat

SEQ ID NO: 655469 - DNA, 20 bp, Artificial
  CRISPR gRNA sequence
ggacataaaattgtgatatt

SEQ ID NO: 655470 - DNA, 20 bp, Artificial
  CRISPR gRNA sequence
tgatattaccttgtgggtta

SEQ ID NO: 655471 - DNA, 20 bp, Artificial
  CRISPR gRNA sequence
ccttgtgggttagttagata

SEQ ID NO: 655472 - DNA, 20 bp, Artificial
  CRISPR gRNA sequence
gtgggttagttagataactg

SEQ ID NO: 655473 - DNA, 20 bp, Artificial
  CRISPR gRNA sequence
tgggttagttagataactgc

SEQ ID NO: 655474 - DNA, 20 bp, Artificial
  CRISPR gRNA sequence
gttagataactgctatctct

SEQ ID NO: 655475 - DNA, 20 bp, Artificial
  CRISPR gRNA sequence
gataactgctatctctacaa

SEQ ID NO: 655476 - DNA, 20 bp, Artificial
  CRISPR gRNA sequence
ctatctctacaatgtcacct

SEQ ID NO: 655477 - DNA, 20 bp, Artificial
  CRISPR gRNA sequence
tctctacaatgtcaccttct

SEQ ID NO: 655478 - DNA, 20 bp, Artificial
  CRISPR gRNA sequence
tacaatgtcaccttctcagg

SEQ ID NO: 655479 - DNA, 20 bp, Artificial
  CRISPR gRNA sequence
caatgtcaccttctcagggt

SEQ ID NO: 655480 - DNA, 20 bp, Artificial
  CRISPR gRNA sequence
ctcagggtgtctgccgtgtc

SEQ ID NO: 655481 - DNA, 20 bp, Artificial
  CRISPR gRNA sequence
tcagggtgtctgccgtgtcc

SEQ ID NO: 655482 - DNA, 20 bp, Artificial
  CRISPR gRNA sequence
agggtgtctgccgtgtccaa

SEQ ID NO: 655483 - DNA, 20 bp, Artificial
  CRISPR gRNA sequence
ccgtgtccaatactggccca

SEQ ID NO: 655484 - DNA, 20 bp, Artificial
  CRISPR gRNA sequence
gcccatatttttgtgacaaa

SEQ ID NO: 655485 - DNA, 20 bp, Artificial
  CRISPR gRNA sequence
ttgtgacaaatatctcagaa

SEQ ID NO: 655486 - DNA, 20 bp, Artificial
  CRISPR gRNA sequence
tgtgacaaatatctcagaaa

SEQ ID NO: 655487 - DNA, 20 bp, Artificial
  CRISPR gRNA sequence
gtgacaaatatctcagaaat

SEQ ID NO: 655488 - DNA, 20 bp, Artificial
  CRISPR gRNA sequence
tgacaaatatctcagaaata

SEQ ID NO: 655489 - DNA, 20 bp, Artificial
  CRISPR gRNA sequence
agaaatagaagagttattat

SEQ ID NO: 655490 - DNA, 20 bp, Artificial
  CRISPR gRNA sequence
ttatgagggtggagtgatat

SEQ ID NO: 655491 - DNA, 20 bp, Artificial
  CRISPR gRNA sequence
tgagggtggagtgatatcag

SEQ ID NO: 655492 - DNA, 20 bp, Artificial
  CRISPR gRNA sequence
tcttttcaggcgggtgttct

SEQ ID NO: 655493 - DNA, 20 bp, Artificial
  CRISPR gRNA sequence
ttcaggcgggtgttctaatg

SEQ ID NO: 655494 - DNA, 20 bp, Artificial
  CRISPR gRNA sequence
tcaggcgggtgttctaatgc

SEQ ID NO: 655495 - DNA, 20 bp, Artificial
  CRISPR gRNA sequence
caggcgggtgttctaatgca

SEQ ID NO: 655496 - DNA, 20 bp, Artificial
  CRISPR gRNA sequence
aggcgggtgttctaatgcac

SEQ ID NO: 655497 - DNA, 20 bp, Artificial
  CRISPR gRNA sequence
taatgcactttttgaaatag

SEQ ID NO: 655498 - DNA, 20 bp, Artificial
  CRISPR gRNA sequence
atgcactttttgaaatagag

SEQ ID NO: 655499 - DNA, 20 bp, Artificial
  CRISPR gRNA sequence
tttgaaatagagcctatatt

SEQ ID NO: 655500 - DNA, 20 bp, Artificial
  CRISPR gRNA sequence
ttgaaatagagcctatatta

SEQ ID NO: 655501 - DNA, 20 bp, Artificial
  CRISPR gRNA sequence
tgaaatagagcctatattat

SEQ ID NO: 655502 - DNA, 20 bp, Artificial
  CRISPR gRNA sequence
gaaatagagcctatattatg

SEQ ID NO: 655503 - DNA, 20 bp, Artificial
  CRISPR gRNA sequence
aaatagagcctatattatgg

SEQ ID NO: 655504 - DNA, 20 bp, Artificial
  CRISPR gRNA sequence
tattatgggacttaccagct

SEQ ID NO: 655505 - DNA, 20 bp, Artificial
  CRISPR gRNA sequence
tgggacttaccagctttctg

SEQ ID NO: 655506 - DNA, 20 bp, Artificial
  CRISPR gRNA sequence
accagctttctgagttttct

SEQ ID NO: 655507 - DNA, 20 bp, Artificial
  CRISPR gRNA sequence
ccagctttctgagttttctt

SEQ ID NO: 655508 - DNA, 20 bp, Artificial
  CRISPR gRNA sequence
tctgagttttcttctgtagc

SEQ ID NO: 655509 - DNA, 20 bp, Artificial
  CRISPR gRNA sequence
ctgagttttcttctgtagct

SEQ ID NO: 655510 - DNA, 20 bp, Artificial
  CRISPR gRNA sequence
tgagttttcttctgtagctt

SEQ ID NO: 655511 - DNA, 20 bp, Artificial
  CRISPR gRNA sequence
agttttcttctgtagcttag

SEQ ID NO: 655512 - DNA, 20 bp, Artificial
  CRISPR gRNA sequence
tcttctgtagcttagtttgg

SEQ ID NO: 655513 - DNA, 20 bp, Artificial
  CRISPR gRNA sequence
cttctgtagcttagtttggc

SEQ ID NO: 655514 - DNA, 20 bp, Artificial
  CRISPR gRNA sequence
ttctgtagcttagtttggca

SEQ ID NO: 655515 - DNA, 20 bp, Artificial
  CRISPR gRNA sequence
ctgtagcttagtttggcagt

SEQ ID NO: 655516 - DNA, 20 bp, Artificial
  CRISPR gRNA sequence
tgtagcttagtttggcagtc

SEQ ID NO: 655517 - DNA, 20 bp, Artificial
  CRISPR gRNA sequence
tagcttagtttggcagtcac

SEQ ID NO: 655518 - DNA, 20 bp, Artificial
  CRISPR gRNA sequence
agtttggcagtcacccttgc

SEQ ID NO: 655519 - DNA, 20 bp, Artificial
  CRISPR gRNA sequence
gtttggcagtcacccttgct

SEQ ID NO: 655520 - DNA, 20 bp, Artificial
  CRISPR gRNA sequence
ggcagtcacccttgcttgga

SEQ ID NO: 655521 - DNA, 20 bp, Artificial
  CRISPR gRNA sequence
gcagtcacccttgcttggat

SEQ ID NO: 655522 - DNA, 20 bp, Artificial
  CRISPR gRNA sequence
gcttggatttctgtaggaca

SEQ ID NO: 655523 - DNA, 20 bp, Artificial
  CRISPR gRNA sequence
cttggatttctgtaggacac

SEQ ID NO: 655524 - DNA, 20 bp, Artificial
  CRISPR gRNA sequence
ggatttctgtaggacacacc

SEQ ID NO: 655525 - DNA, 20 bp, Artificial
  CRISPR gRNA sequence
gatttctgtaggacacaccc

SEQ ID NO: 655526 - DNA, 20 bp, Artificial
  CRISPR gRNA sequence
ctgtaggacacaccctaata

SEQ ID NO: 655527 - DNA, 20 bp, Artificial
  CRISPR gRNA sequence
tgtaggacacaccctaatat

SEQ ID NO: 655528 - DNA, 20 bp, Artificial
  CRISPR gRNA sequence
taggacacaccctaatataa

SEQ ID NO: 655529 - DNA, 20 bp, Artificial
  CRISPR gRNA sequence
atataacaccagatgggctt

SEQ ID NO: 655530 - DNA, 20 bp, Artificial
  CRISPR gRNA sequence
gatagaaaatcttctgtttt

SEQ ID NO: 655531 - DNA, 20 bp, Artificial
  CRISPR gRNA sequence
atagaaaatcttctgtttta

SEQ ID NO: 655532 - DNA, 20 bp, Artificial
  CRISPR gRNA sequence
ctgttttaagtcgccatact

SEQ ID NO: 655533 - DNA, 20 bp, Artificial
  CRISPR gRNA sequence
tgttttaagtcgccatactt

SEQ ID NO: 655534 - DNA, 20 bp, Artificial
  CRISPR gRNA sequence
ttttaagtcgccatacttag

SEQ ID NO: 655535 - DNA, 20 bp, Artificial
  CRISPR gRNA sequence
taagtcgccatacttaggtt

SEQ ID NO: 655536 - DNA, 20 bp, Artificial
  CRISPR gRNA sequence
aagtcgccatacttaggttt

SEQ ID NO: 655537 - DNA, 20 bp, Artificial
  CRISPR gRNA sequence
agtcgccatacttaggtttg

SEQ ID NO: 655538 - DNA, 20 bp, Artificial
  CRISPR gRNA sequence
aggtttgtgtatatacccaa

SEQ ID NO: 655539 - DNA, 20 bp, Artificial
  CRISPR gRNA sequence
ggtttgtgtatatacccaat

SEQ ID NO: 655540 - DNA, 20 bp, Artificial
  CRISPR gRNA sequence
gtgtatatacccaatgtact

SEQ ID NO: 655541 - DNA, 20 bp, Artificial
  CRISPR gRNA sequence
tgtatatacccaatgtactt

SEQ ID NO: 655542 - DNA, 20 bp, Artificial
  CRISPR gRNA sequence
tacatttagttcttgtttat

SEQ ID NO: 655543 - DNA, 20 bp, Artificial
  CRISPR gRNA sequence
acatttagttcttgtttatt

SEQ ID NO: 655544 - DNA, 20 bp, Artificial
  CRISPR gRNA sequence
catttagttcttgtttatta

SEQ ID NO: 655545 - DNA, 20 bp, Artificial
  CRISPR gRNA sequence
agttcttgtttattagggaa

SEQ ID NO: 655546 - DNA, 20 bp, Artificial
  CRISPR gRNA sequence
gttcttgtttattagggaat

SEQ ID NO: 655547 - DNA, 20 bp, Artificial
  CRISPR gRNA sequence
ttgtttattagggaattaaa

SEQ ID NO: 655548 - DNA, 20 bp, Artificial
  CRISPR gRNA sequence
gtttattagggaattaaata

SEQ ID NO: 655549 - DNA, 20 bp, Artificial
  CRISPR gRNA sequence
tttattagggaattaaataa

SEQ ID NO: 655550 - DNA, 20 bp, Artificial
  CRISPR gRNA sequence
attagggaattaaataaaaa

SEQ ID NO: 655551 - DNA, 20 bp, Artificial
  CRISPR gRNA sequence
ttagggaattaaataaaaat

SEQ ID NO: 655552 - DNA, 20 bp, Artificial
  CRISPR gRNA sequence
gggaattaaataaaaatagt

SEQ ID NO: 655553 - DNA, 20 bp, Artificial
  CRISPR gRNA sequence
aataaaaatagttctgattt

SEQ ID NO: 655554 - DNA, 20 bp, Artificial
  CRISPR gRNA sequence
tgatttaatttctttacagg

SEQ ID NO: 655555 - DNA, 20 bp, Artificial
  CRISPR gRNA sequence
atttaatttctttacaggta

SEQ ID NO: 655556 - DNA, 20 bp, Artificial
  CRISPR gRNA sequence
aatttctttacaggtatcag

SEQ ID NO: 655557 - DNA, 20 bp, Artificial
  CRISPR gRNA sequence
atttctttacaggtatcaga

SEQ ID NO: 655558 - DNA, 20 bp, Artificial
  CRISPR gRNA sequence
ctttacaggtatcagagata

SEQ ID NO: 655559 - DNA, 20 bp, Artificial
  CRISPR gRNA sequence
tttacaggtatcagagataa

SEQ ID NO: 655560 - DNA, 20 bp, Artificial
  CRISPR gRNA sequence
tacaggtatcagagataaat

SEQ ID NO: 655561 - DNA, 20 bp, Artificial
  CRISPR gRNA sequence
acaggtatcagagataaatg

SEQ ID NO: 655562 - DNA, 20 bp, Artificial
  CRISPR gRNA sequence
caggtatcagagataaatgt

SEQ ID NO: 655563 - DNA, 20 bp, Artificial
  CRISPR gRNA sequence
tgtaccaaaagagaaaaaaa

SEQ ID NO: 655564 - DNA, 20 bp, Artificial
  CRISPR gRNA sequence
gttggtaatcaacagcaaaa

SEQ ID NO: 655565 - DNA, 20 bp, Artificial
  CRISPR gRNA sequence
ttggtaatcaacagcaaaag

SEQ ID NO: 655566 - DNA, 20 bp, Artificial
  CRISPR gRNA sequence
gtaatcaacagcaaaagtgc

SEQ ID NO: 655567 - DNA, 20 bp, Artificial
  CRISPR gRNA sequence
taactttttctttgcacctc

SEQ ID NO: 655568 - DNA, 20 bp, Artificial
  CRISPR gRNA sequence
tttctttgcacctcattccg

SEQ ID NO: 655569 - DNA, 20 bp, Artificial
  CRISPR gRNA sequence
ttctttgcacctcattccgc

SEQ ID NO: 655570 - DNA, 20 bp, Artificial
  CRISPR gRNA sequence
tctttgcacctcattccgct

SEQ ID NO: 655571 - DNA, 20 bp, Artificial
  CRISPR gRNA sequence
ctttgcacctcattccgctc

SEQ ID NO: 655572 - DNA, 20 bp, Artificial
  CRISPR gRNA sequence
tttgcacctcattccgctcc

SEQ ID NO: 655573 - DNA, 20 bp, Artificial
  CRISPR gRNA sequence
tgcacctcattccgctccca

SEQ ID NO: 655574 - DNA, 20 bp, Artificial
  CRISPR gRNA sequence
gcacctcattccgctcccaa

SEQ ID NO: 655575 - DNA, 20 bp, Artificial
  CRISPR gRNA sequence
cacctcattccgctcccaac

SEQ ID NO: 655576 - DNA, 20 bp, Artificial
  CRISPR gRNA sequence
attccgctcccaactcccta

SEQ ID NO: 655577 - DNA, 20 bp, Artificial
  CRISPR gRNA sequence
cgctcccaactccctatctt

SEQ ID NO: 655578 - DNA, 20 bp, Artificial
  CRISPR gRNA sequence
ccaactccctatctttttag

SEQ ID NO: 655579 - DNA, 20 bp, Artificial
  CRISPR gRNA sequence
cctatctttttagtctgctt

SEQ ID NO: 655580 - DNA, 20 bp, Artificial
  CRISPR gRNA sequence
tctttttagtctgcttagta

SEQ ID NO: 655581 - DNA, 20 bp, Artificial
  CRISPR gRNA sequence
tttagtctgcttagtactga

SEQ ID NO: 655582 - DNA, 20 bp, Artificial
  CRISPR gRNA sequence
ttagtctgcttagtactgag

SEQ ID NO: 655583 - DNA, 20 bp, Artificial
  CRISPR gRNA sequence
tagtctgcttagtactgaga

SEQ ID NO: 655584 - DNA, 20 bp, Artificial
  CRISPR gRNA sequence
agtctgcttagtactgagaa

SEQ ID NO: 655585 - DNA, 20 bp, Artificial
  CRISPR gRNA sequence
gtctgcttagtactgagaat

SEQ ID NO: 655586 - DNA, 20 bp, Artificial
  CRISPR gRNA sequence
cttagtactgagaattaaag

SEQ ID NO: 655587 - DNA, 20 bp, Artificial
  CRISPR gRNA sequence
agtactgagaattaaagtcc

SEQ ID NO: 655588 - DNA, 20 bp, Artificial
  CRISPR gRNA sequence
gtactgagaattaaagtccg

SEQ ID NO: 655589 - DNA, 20 bp, Artificial
  CRISPR gRNA sequence
agaattaaagtccgttttca

SEQ ID NO: 655590 - DNA, 20 bp, Artificial
  CRISPR gRNA sequence
aagtccgttttcaaaaaaca

SEQ ID NO: 655591 - DNA, 20 bp, Artificial
  CRISPR gRNA sequence
tcaaaaaacaaaacaacgta

SEQ ID NO: 655592 - DNA, 20 bp, Artificial
  CRISPR gRNA sequence
caaaaaacaaaacaacgtat

SEQ ID NO: 655593 - DNA, 20 bp, Artificial
  CRISPR gRNA sequence
aaaaaacaaaacaacgtatg

SEQ ID NO: 655594 - DNA, 20 bp, Artificial
  CRISPR gRNA sequence
tccttatcatctctatcttt

SEQ ID NO: 655595 - DNA, 20 bp, Artificial
  CRISPR gRNA sequence
atcatctctatctttgttca

SEQ ID NO: 655596 - DNA, 20 bp, Artificial
  CRISPR gRNA sequence
tcatctctatctttgttcaa

SEQ ID NO: 655597 - DNA, 20 bp, Artificial
  CRISPR gRNA sequence
tatctttgttcaaaatctgt

SEQ ID NO: 655598 - DNA, 20 bp, Artificial
  CRISPR gRNA sequence
tctttgttcaaaatctgtct

SEQ ID NO: 655599 - DNA, 20 bp, Artificial
  CRISPR gRNA sequence
tgttcaaaatctgtctttcc

SEQ ID NO: 655600 - DNA, 20 bp, Artificial
  CRISPR gRNA sequence
gttcaaaatctgtctttccc

SEQ ID NO: 655601 - DNA, 20 bp, Artificial
  CRISPR gRNA sequence
ttcaaaatctgtctttccca

SEQ ID NO: 655602 - DNA, 20 bp, Artificial
  CRISPR gRNA sequence
aaaatctgtctttcccacta

SEQ ID NO: 655603 - DNA, 20 bp, Artificial
  CRISPR gRNA sequence
tctttcccactagaagtact

SEQ ID NO: 655604 - DNA, 20 bp, Artificial
  CRISPR gRNA sequence
tcccactagaagtacttttt

SEQ ID NO: 655605 - DNA, 20 bp, Artificial
  CRISPR gRNA sequence
cccactagaagtactttttt

SEQ ID NO: 655606 - DNA, 20 bp, Artificial
  CRISPR gRNA sequence
ccactagaagtactttttta

SEQ ID NO: 655607 - DNA, 20 bp, Artificial
  CRISPR gRNA sequence
gaagtacttttttaaaaaaa

SEQ ID NO: 655608 - DNA, 20 bp, Artificial
  CRISPR gRNA sequence
ttttaaaaaaaggtaacacc

SEQ ID NO: 655609 - DNA, 20 bp, Artificial
  CRISPR gRNA sequence
tttaaaaaaaggtaacacca

SEQ ID NO: 655610 - DNA, 20 bp, Artificial
  CRISPR gRNA sequence
ttaaaaaaaggtaacaccat

SEQ ID NO: 655611 - DNA, 20 bp, Artificial
  CRISPR gRNA sequence
taaaaaaaggtaacaccatt

SEQ ID NO: 655612 - DNA, 20 bp, Artificial
  CRISPR gRNA sequence
aaaaaaaggtaacaccattg

SEQ ID NO: 655613 - DNA, 20 bp, Artificial
  CRISPR gRNA sequence
aaaaaaggtaacaccattga

SEQ ID NO: 655614 - DNA, 20 bp, Artificial
  CRISPR gRNA sequence
attgtgttctattgagagtc

SEQ ID NO: 655615 - DNA, 20 bp, Artificial
  CRISPR gRNA sequence
tgttctattgagagtcttcc

SEQ ID NO: 655616 - DNA, 20 bp, Artificial
  CRISPR gRNA sequence
tattgagagtcttcctgtaa

SEQ ID NO: 655617 - DNA, 20 bp, Artificial
  CRISPR gRNA sequence
ttgagagtcttcctgtaagc

SEQ ID NO: 655618 - DNA, 20 bp, Artificial
  CRISPR gRNA sequence
agagtcttcctgtaagccat

SEQ ID NO: 655619 - DNA, 20 bp, Artificial
  CRISPR gRNA sequence
cctgtaagccataatgaatt

SEQ ID NO: 655620 - DNA, 20 bp, Artificial
  CRISPR gRNA sequence
ctgtaagccataatgaattt

SEQ ID NO: 655621 - DNA, 20 bp, Artificial
  CRISPR gRNA sequence
taagccataatgaattttca

SEQ ID NO: 655622 - DNA, 20 bp, Artificial
  CRISPR gRNA sequence
tcatctctgggttccgtgct

SEQ ID NO: 655623 - DNA, 20 bp, Artificial
  CRISPR gRNA sequence
catctctgggttccgtgctc

SEQ ID NO: 655624 - DNA, 20 bp, Artificial
  CRISPR gRNA sequence
atctctgggttccgtgctct

SEQ ID NO: 655625 - DNA, 20 bp, Artificial
  CRISPR gRNA sequence
tgggttccgtgctcttctct

SEQ ID NO: 655626 - DNA, 20 bp, Artificial
  CRISPR gRNA sequence
ggttccgtgctcttctctcc

SEQ ID NO: 655627 - DNA, 20 bp, Artificial
  CRISPR gRNA sequence
cgtgctcttctctcctaact

SEQ ID NO: 655628 - DNA, 20 bp, Artificial
  CRISPR gRNA sequence
ttctctcctaacttttgaca

SEQ ID NO: 655629 - DNA, 20 bp, Artificial
  CRISPR gRNA sequence
ctctcctaacttttgacatg

SEQ ID NO: 655630 - DNA, 20 bp, Artificial
  CRISPR gRNA sequence
tctcctaacttttgacatgt

SEQ ID NO: 655631 - DNA, 20 bp, Artificial
  CRISPR gRNA sequence
tcctaacttttgacatgttg

SEQ ID NO: 655632 - DNA, 20 bp, Artificial
  CRISPR gRNA sequence
ctaacttttgacatgttgat

SEQ ID NO: 655633 - DNA, 20 bp, Artificial
  CRISPR gRNA sequence
acttttgacatgttgatata

SEQ ID NO: 655634 - DNA, 20 bp, Artificial
  CRISPR gRNA sequence
ttgacatgttgatatatttt

SEQ ID NO: 655635 - DNA, 20 bp, Artificial
  CRISPR gRNA sequence
tgacatgttgatatattttg

SEQ ID NO: 655636 - DNA, 20 bp, Artificial
  CRISPR gRNA sequence
gacatgttgatatattttga

SEQ ID NO: 655637 - DNA, 20 bp, Artificial
  CRISPR gRNA sequence
acatgttgatatattttgaa

SEQ ID NO: 655638 - DNA, 20 bp, Artificial
  CRISPR gRNA sequence
atatattttgaatatttaca

SEQ ID NO: 655639 - DNA, 20 bp, Artificial
  CRISPR gRNA sequence
tgaatatttacatattttta

SEQ ID NO: 655640 - DNA, 20 bp, Artificial
  CRISPR gRNA sequence
gaatatttacatatttttat

SEQ ID NO: 655641 - DNA, 20 bp, Artificial
  CRISPR gRNA sequence
aatatttacatatttttatc

SEQ ID NO: 655642 - DNA, 20 bp, Artificial
  CRISPR gRNA sequence
acatatttttatcatatttg

SEQ ID NO: 655643 - DNA, 20 bp, Artificial
  CRISPR gRNA sequence
catatttttatcatatttgg

SEQ ID NO: 655644 - DNA, 20 bp, Artificial
  CRISPR gRNA sequence
ttatcatatttggaaatatc

SEQ ID NO: 655645 - DNA, 20 bp, Artificial
  CRISPR gRNA sequence
tatcatatttggaaatatca

SEQ ID NO: 655646 - DNA, 20 bp, Artificial
  CRISPR gRNA sequence
atcatatttggaaatatcaa

SEQ ID NO: 655647 - DNA, 20 bp, Artificial
  CRISPR gRNA sequence
tcatatttggaaatatcaat

SEQ ID NO: 655648 - DNA, 20 bp, Artificial
  CRISPR gRNA sequence
ggaaatatcaatagcagagt

SEQ ID NO: 655649 - DNA, 20 bp, Artificial
  CRISPR gRNA sequence
gaaatatcaatagcagagtt

SEQ ID NO: 655650 - DNA, 20 bp, Artificial
  CRISPR gRNA sequence
cagtcctaaaatgaggtaga

SEQ ID NO: 655651 - DNA, 20 bp, Artificial
  CRISPR gRNA sequence
aaatgaggtagaatatgttg

SEQ ID NO: 655652 - DNA, 20 bp, Artificial
  CRISPR gRNA sequence
tttttctttacttttttccc

SEQ ID NO: 655653 - DNA, 20 bp, Artificial
  CRISPR gRNA sequence
ttctttacttttttcccttc

SEQ ID NO: 655654 - DNA, 20 bp, Artificial
  CRISPR gRNA sequence
tctttacttttttcccttct

SEQ ID NO: 655655 - DNA, 20 bp, Artificial
  CRISPR gRNA sequence
ctttacttttttcccttctt

SEQ ID NO: 655656 - DNA, 20 bp, Artificial
  CRISPR gRNA sequence
tttacttttttcccttctta

SEQ ID NO: 655657 - DNA, 20 bp, Artificial
  CRISPR gRNA sequence
tacttttttcccttcttatc

SEQ ID NO: 655658 - DNA, 20 bp, Artificial
  CRISPR gRNA sequence
acttttttcccttcttatct

SEQ ID NO: 655659 - DNA, 20 bp, Artificial
  CRISPR gRNA sequence
cttttttcccttcttatctg

SEQ ID NO: 655660 - DNA, 20 bp, Artificial
  CRISPR gRNA sequence
ttttcccttcttatctgttt

SEQ ID NO: 655661 - DNA, 20 bp, Artificial
  CRISPR gRNA sequence
tttcccttcttatctgttta

SEQ ID NO: 655662 - DNA, 20 bp, Artificial
  CRISPR gRNA sequence
ttcccttcttatctgtttat

SEQ ID NO: 655663 - DNA, 20 bp, Artificial
  CRISPR gRNA sequence
tcccttcttatctgtttatg

SEQ ID NO: 655664 - DNA, 20 bp, Artificial
  CRISPR gRNA sequence
cccttcttatctgtttatgt

SEQ ID NO: 655665 - DNA, 20 bp, Artificial
  CRISPR gRNA sequence
ccttcttatctgtttatgtt

SEQ ID NO: 655666 - DNA, 20 bp, Artificial
  CRISPR gRNA sequence
cttatctgtttatgttaaat

SEQ ID NO: 655667 - DNA, 20 bp, Artificial
  CRISPR gRNA sequence
ttatctgtttatgttaaatg

SEQ ID NO: 655668 - DNA, 20 bp, Artificial
  CRISPR gRNA sequence
atctgtttatgttaaatgta

SEQ ID NO: 655669 - DNA, 20 bp, Artificial
  CRISPR gRNA sequence
tctgtttatgttaaatgtat

SEQ ID NO: 655670 - DNA, 20 bp, Artificial
  CRISPR gRNA sequence
tttatgttaaatgtatttgt

SEQ ID NO: 655671 - DNA, 20 bp, Artificial
  CRISPR gRNA sequence
atgttaaatgtatttgttgg

SEQ ID NO: 655672 - DNA, 20 bp, Artificial
  CRISPR gRNA sequence
tgttaaatgtatttgttggc

SEQ ID NO: 655673 - DNA, 20 bp, Artificial
  CRISPR gRNA sequence
aatgtatttgttggcctgtt

SEQ ID NO: 655674 - DNA, 20 bp, Artificial
  CRISPR gRNA sequence
gttggcctgttggtattttc

SEQ ID NO: 655675 - DNA, 20 bp, Artificial
  CRISPR gRNA sequence
ttggcctgttggtattttcc

SEQ ID NO: 655676 - DNA, 20 bp, Artificial
  CRISPR gRNA sequence
gcctgttggtattttccttt

SEQ ID NO: 655677 - DNA, 20 bp, Artificial
  CRISPR gRNA sequence
ttggtattttccttttgcga

SEQ ID NO: 655678 - DNA, 20 bp, Artificial
  CRISPR gRNA sequence
gtattttccttttgcgaatt

SEQ ID NO: 655679 - DNA, 20 bp, Artificial
  CRISPR gRNA sequence
tccttttgcgaattaattga

SEQ ID NO: 655680 - DNA, 20 bp, Artificial
  CRISPR gRNA sequence
ccttttgcgaattaattgag

SEQ ID NO: 655681 - DNA, 20 bp, Artificial
  CRISPR gRNA sequence
cttttgcgaattaattgaga

SEQ ID NO: 655682 - DNA, 20 bp, Artificial
  CRISPR gRNA sequence
ttgcgaattaattgagaccc

SEQ ID NO: 655683 - DNA, 20 bp, Artificial
  CRISPR gRNA sequence
tgcgaattaattgagaccca

SEQ ID NO: 655684 - DNA, 20 bp, Artificial
  CRISPR gRNA sequence
gcgaattaattgagacccaa

SEQ ID NO: 655685 - DNA, 20 bp, Artificial
  CRISPR gRNA sequence
cgaattaattgagacccaat

SEQ ID NO: 655686 - DNA, 20 bp, Artificial
  CRISPR gRNA sequence
attgagacccaatatacctc

SEQ ID NO: 655687 - DNA, 20 bp, Artificial
  CRISPR gRNA sequence
agacccaatatacctctgtt

SEQ ID NO: 655688 - DNA, 20 bp, Artificial
  CRISPR gRNA sequence
tgttttgatataggtaagga

SEQ ID NO: 655689 - DNA, 20 bp, Artificial
  CRISPR gRNA sequence
ttttgatataggtaaggaat

SEQ ID NO: 655690 - DNA, 20 bp, Artificial
  CRISPR gRNA sequence
tgatataggtaaggaatatt

SEQ ID NO: 655691 - DNA, 20 bp, Artificial
  CRISPR gRNA sequence
gatataggtaaggaatattt

SEQ ID NO: 655692 - DNA, 20 bp, Artificial
  CRISPR gRNA sequence
atataggtaaggaatattta

SEQ ID NO: 655693 - DNA, 20 bp, Artificial
  CRISPR gRNA sequence
agggatggtttcctttatta

SEQ ID NO: 655694 - DNA, 20 bp, Artificial
  CRISPR gRNA sequence
gggatggtttcctttattat

SEQ ID NO: 655695 - DNA, 20 bp, Artificial
  CRISPR gRNA sequence
cctttattataaatgttata

SEQ ID NO: 655696 - DNA, 20 bp, Artificial
  CRISPR gRNA sequence
ctttattataaatgttataa

SEQ ID NO: 655697 - DNA, 20 bp, Artificial
  CRISPR gRNA sequence
tattataaatgttataatca

SEQ ID NO: 655698 - DNA, 20 bp, Artificial
  CRISPR gRNA sequence
attataaatgttataatcac

SEQ ID NO: 655699 - DNA, 20 bp, Artificial
  CRISPR gRNA sequence
ttataaatgttataatcacc

SEQ ID NO: 655700 - DNA, 20 bp, Artificial
  CRISPR gRNA sequence
taaatgttataatcaccact

SEQ ID NO: 655701 - DNA, 20 bp, Artificial
  CRISPR gRNA sequence
taatcaccactagagcgaga

SEQ ID NO: 655702 - DNA, 20 bp, Artificial
  CRISPR gRNA sequence
gagcgagagaaggtagaggg

SEQ ID NO: 655703 - DNA, 20 bp, Artificial
  CRISPR gRNA sequence
tattgagtgcacttagtatg

SEQ ID NO: 655704 - DNA, 20 bp, Artificial
  CRISPR gRNA sequence
attgagtgcacttagtatgc

SEQ ID NO: 655705 - DNA, 20 bp, Artificial
  CRISPR gRNA sequence
ttgagtgcacttagtatgct

SEQ ID NO: 655706 - DNA, 20 bp, Artificial
  CRISPR gRNA sequence
agtgcacttagtatgctaga

SEQ ID NO: 655707 - DNA, 20 bp, Artificial
  CRISPR gRNA sequence
agtatgctagatgctttact

SEQ ID NO: 655708 - DNA, 20 bp, Artificial
  CRISPR gRNA sequence
gtatgctagatgctttactt

SEQ ID NO: 655709 - DNA, 20 bp, Artificial
  CRISPR gRNA sequence
gatgctttacttattatttc

SEQ ID NO: 655710 - DNA, 20 bp, Artificial
  CRISPR gRNA sequence
tacttattatttcactttgt

SEQ ID NO: 655711 - DNA, 20 bp, Artificial
  CRISPR gRNA sequence
acttattatttcactttgtc

SEQ ID NO: 655712 - DNA, 20 bp, Artificial
  CRISPR gRNA sequence
cttattatttcactttgtct

SEQ ID NO: 655713 - DNA, 20 bp, Artificial
  CRISPR gRNA sequence
attatttcactttgtctcca

SEQ ID NO: 655714 - DNA, 20 bp, Artificial
  CRISPR gRNA sequence
ttatttcactttgtctccac

SEQ ID NO: 655715 - DNA, 20 bp, Artificial
  CRISPR gRNA sequence
tttcactttgtctccacatc

SEQ ID NO: 655716 - DNA, 20 bp, Artificial
  CRISPR gRNA sequence
cactttgtctccacatcaat

SEQ ID NO: 655717 - DNA, 20 bp, Artificial
  CRISPR gRNA sequence
actttgtctccacatcaatt

SEQ ID NO: 655718 - DNA, 20 bp, Artificial
  CRISPR gRNA sequence
tgtctccacatcaattctgt

SEQ ID NO: 655719 - DNA, 20 bp, Artificial
  CRISPR gRNA sequence
gtctccacatcaattctgtg

SEQ ID NO: 655720 - DNA, 20 bp, Artificial
  CRISPR gRNA sequence
tctccacatcaattctgtga

SEQ ID NO: 655721 - DNA, 20 bp, Artificial
  CRISPR gRNA sequence
cacatcaattctgtgaggta

SEQ ID NO: 655722 - DNA, 20 bp, Artificial
  CRISPR gRNA sequence
tgtgaggtaggcatgtaatt

SEQ ID NO: 655723 - DNA, 20 bp, Artificial
  CRISPR gRNA sequence
tgaggtaggcatgtaattac

SEQ ID NO: 655724 - DNA, 20 bp, Artificial
  CRISPR gRNA sequence
ctctattttataacacttaa

SEQ ID NO: 655725 - DNA, 20 bp, Artificial
  CRISPR gRNA sequence
tattttataacacttaaaac

SEQ ID NO: 655726 - DNA, 20 bp, Artificial
  CRISPR gRNA sequence
ttttataacacttaaaactg

SEQ ID NO: 655727 - DNA, 20 bp, Artificial
  CRISPR gRNA sequence
tataacacttaaaactgagg

SEQ ID NO: 655728 - DNA, 20 bp, Artificial
  CRISPR gRNA sequence
ataacacttaaaactgaggc

SEQ ID NO: 655729 - DNA, 20 bp, Artificial
  CRISPR gRNA sequence
taacacttaaaactgaggct

SEQ ID NO: 655730 - DNA, 20 bp, Artificial
  CRISPR gRNA sequence
aaaactgaggctcagaagca

SEQ ID NO: 655731 - DNA, 20 bp, Artificial
  CRISPR gRNA sequence
aaactgaggctcagaagcag

SEQ ID NO: 655732 - DNA, 20 bp, Artificial
  CRISPR gRNA sequence
aggctcagaagcagtagact

SEQ ID NO: 655733 - DNA, 20 bp, Artificial
  CRISPR gRNA sequence
agaagcagtagactgtgagt

SEQ ID NO: 655734 - DNA, 20 bp, Artificial
  CRISPR gRNA sequence
tgagtggttaaaaatatggg

SEQ ID NO: 655735 - DNA, 20 bp, Artificial
  CRISPR gRNA sequence
aaaatatgggctttgcaatt

SEQ ID NO: 655736 - DNA, 20 bp, Artificial
  CRISPR gRNA sequence
tgcaattatgctggcctggg

SEQ ID NO: 655737 - DNA, 20 bp, Artificial
  CRISPR gRNA sequence
gcaattatgctggcctgggt

SEQ ID NO: 655738 - DNA, 20 bp, Artificial
  CRISPR gRNA sequence
caattatgctggcctgggtt

SEQ ID NO: 655739 - DNA, 20 bp, Artificial
  CRISPR gRNA sequence
tgctggcctgggttagaatt

SEQ ID NO: 655740 - DNA, 20 bp, Artificial
  CRISPR gRNA sequence
gcctgggttagaattcctgc

SEQ ID NO: 655741 - DNA, 20 bp, Artificial
  CRISPR gRNA sequence
ggttagaattcctgctttgc

SEQ ID NO: 655742 - DNA, 20 bp, Artificial
  CRISPR gRNA sequence
gaattcctgctttgctgtgt

SEQ ID NO: 655743 - DNA, 20 bp, Artificial
  CRISPR gRNA sequence
ctgctttgctgtgtgacctt

SEQ ID NO: 655744 - DNA, 20 bp, Artificial
  CRISPR gRNA sequence
ctttgctgtgtgaccttggc

SEQ ID NO: 655745 - DNA, 20 bp, Artificial
  CRISPR gRNA sequence
tgctgtgtgaccttggccat

SEQ ID NO: 655746 - DNA, 20 bp, Artificial
  CRISPR gRNA sequence
gctgtgtgaccttggccatg

SEQ ID NO: 655747 - DNA, 20 bp, Artificial
  CRISPR gRNA sequence
ctgtgtgaccttggccatgt

SEQ ID NO: 655748 - DNA, 20 bp, Artificial
  CRISPR gRNA sequence
tgtgaccttggccatgtcac

SEQ ID NO: 655749 - DNA, 20 bp, Artificial
  CRISPR gRNA sequence
ggccatgtcacttcacatct

SEQ ID NO: 655750 - DNA, 20 bp, Artificial
  CRISPR gRNA sequence
gccatgtcacttcacatctc

SEQ ID NO: 655751 - DNA, 20 bp, Artificial
  CRISPR gRNA sequence
cacatctctgagctccagtt

SEQ ID NO: 655752 - DNA, 20 bp, Artificial
  CRISPR gRNA sequence
acatctctgagctccagttt

SEQ ID NO: 655753 - DNA, 20 bp, Artificial
  CRISPR gRNA sequence
tgagctccagtttccttatc

SEQ ID NO: 655754 - DNA, 20 bp, Artificial
  CRISPR gRNA sequence
agctccagtttccttatccg

SEQ ID NO: 655755 - DNA, 20 bp, Artificial
  CRISPR gRNA sequence
cagtttccttatccgtagaa

SEQ ID NO: 655756 - DNA, 20 bp, Artificial
  CRISPR gRNA sequence
ccttatccgtagaataggga

SEQ ID NO: 655757 - DNA, 20 bp, Artificial
  CRISPR gRNA sequence
cttatccgtagaatagggat

SEQ ID NO: 655758 - DNA, 20 bp, Artificial
  CRISPR gRNA sequence
atccgtagaatagggataag

SEQ ID NO: 655759 - DNA, 20 bp, Artificial
  CRISPR gRNA sequence
tccgtagaatagggataagc

SEQ ID NO: 655760 - DNA, 20 bp, Artificial
  CRISPR gRNA sequence
cctcaatgggctgttgtgag

SEQ ID NO: 655761 - DNA, 20 bp, Artificial
  CRISPR gRNA sequence
aatgggctgttgtgagattt

SEQ ID NO: 655762 - DNA, 20 bp, Artificial
  CRISPR gRNA sequence
ttgtgagatttcaataaggc

SEQ ID NO: 655763 - DNA, 20 bp, Artificial
  CRISPR gRNA sequence
tgagatttcaataaggcaat

SEQ ID NO: 655764 - DNA, 20 bp, Artificial
  CRISPR gRNA sequence
caataaggcaatacatgcaa

SEQ ID NO: 655765 - DNA, 20 bp, Artificial
  CRISPR gRNA sequence
aataaggcaatacatgcaaa

SEQ ID NO: 655766 - DNA, 20 bp, Artificial
  CRISPR gRNA sequence
agcacaacttctggcacatg

SEQ ID NO: 655767 - DNA, 20 bp, Artificial
  CRISPR gRNA sequence
ctggcacatgctaagactca

SEQ ID NO: 655768 - DNA, 20 bp, Artificial
  CRISPR gRNA sequence
tggcacatgctaagactcaa

SEQ ID NO: 655769 - DNA, 20 bp, Artificial
  CRISPR gRNA sequence
gcacatgctaagactcaata

SEQ ID NO: 655770 - DNA, 20 bp, Artificial
  CRISPR gRNA sequence
agactcaataaataatcact

SEQ ID NO: 655771 - DNA, 20 bp, Artificial
  CRISPR gRNA sequence
aataaataatcactgctgct

SEQ ID NO: 655772 - DNA, 20 bp, Artificial
  CRISPR gRNA sequence
ctgctattactcagagcagt

SEQ ID NO: 655773 - DNA, 20 bp, Artificial
  CRISPR gRNA sequence
ctattactcagagcagtcaa

SEQ ID NO: 655774 - DNA, 20 bp, Artificial
  CRISPR gRNA sequence
ttactcagagcagtcaagtt

SEQ ID NO: 655775 - DNA, 20 bp, Artificial
  CRISPR gRNA sequence
ctcagagcagtcaagttact

SEQ ID NO: 655776 - DNA, 20 bp, Artificial
  CRISPR gRNA sequence
agagcagtcaagttactttt

SEQ ID NO: 655777 - DNA, 20 bp, Artificial
  CRISPR gRNA sequence
cttttttatggacctatgac

SEQ ID NO: 655778 - DNA, 20 bp, Artificial
  CRISPR gRNA sequence
ttttatggacctatgacttg

SEQ ID NO: 655779 - DNA, 20 bp, Artificial
  CRISPR gRNA sequence
tttatggacctatgacttgt

SEQ ID NO: 655780 - DNA, 20 bp, Artificial
  CRISPR gRNA sequence
ttatggacctatgacttgta

SEQ ID NO: 655781 - DNA, 20 bp, Artificial
  CRISPR gRNA sequence
tatggacctatgacttgtaa

SEQ ID NO: 655782 - DNA, 20 bp, Artificial
  CRISPR gRNA sequence
atggacctatgacttgtaag

SEQ ID NO: 655783 - DNA, 20 bp, Artificial
  CRISPR gRNA sequence
tggacctatgacttgtaaga

SEQ ID NO: 655784 - DNA, 20 bp, Artificial
  CRISPR gRNA sequence
tgacttgtaagaaaaagggt

SEQ ID NO: 655785 - DNA, 20 bp, Artificial
  CRISPR gRNA sequence
gtaagaaaaagggtttgttt

SEQ ID NO: 655786 - DNA, 20 bp, Artificial
  CRISPR gRNA sequence
taagaaaaagggtttgtttt

SEQ ID NO: 655787 - DNA, 20 bp, Artificial
  CRISPR gRNA sequence
gttttcaaatccaagtctat

SEQ ID NO: 655788 - DNA, 20 bp, Artificial
  CRISPR gRNA sequence
ttttcaaatccaagtctatt

SEQ ID NO: 655789 - DNA, 20 bp, Artificial
  CRISPR gRNA sequence
tcaaatccaagtctatttga

SEQ ID NO: 655790 - DNA, 20 bp, Artificial
  CRISPR gRNA sequence
caaatccaagtctatttgaa

SEQ ID NO: 655791 - DNA, 20 bp, Artificial
  CRISPR gRNA sequence
aaatccaagtctatttgaaa

SEQ ID NO: 655792 - DNA, 20 bp, Artificial
  CRISPR gRNA sequence
tttgaaatctgggtcttttg

SEQ ID NO: 655793 - DNA, 20 bp, Artificial
  CRISPR gRNA sequence
gaaatctgggtcttttgctc

SEQ ID NO: 655794 - DNA, 20 bp, Artificial
  CRISPR gRNA sequence
aaatctgggtcttttgctct

SEQ ID NO: 655795 - DNA, 20 bp, Artificial
  CRISPR gRNA sequence
ggtcttttgctcttttctgt

SEQ ID NO: 655796 - DNA, 20 bp, Artificial
  CRISPR gRNA sequence
ttgctcttttctgtatattg

SEQ ID NO: 655797 - DNA, 20 bp, Artificial
  CRISPR gRNA sequence
tgctcttttctgtatattgc

SEQ ID NO: 655798 - DNA, 20 bp, Artificial
  CRISPR gRNA sequence
gctcttttctgtatattgca

SEQ ID NO: 655799 - DNA, 20 bp, Artificial
  CRISPR gRNA sequence
ctcttttctgtatattgcac

SEQ ID NO: 655800 - DNA, 20 bp, Artificial
  CRISPR gRNA sequence
ttttctgtatattgcacagg

SEQ ID NO: 655801 - DNA, 20 bp, Artificial
  CRISPR gRNA sequence
ttctgtatattgcacaggtc

SEQ ID NO: 655802 - DNA, 20 bp, Artificial
  CRISPR gRNA sequence
tctgtatattgcacaggtcc

SEQ ID NO: 655803 - DNA, 20 bp, Artificial
  CRISPR gRNA sequence
ctgtatattgcacaggtcca

SEQ ID NO: 655804 - DNA, 20 bp, Artificial
  CRISPR gRNA sequence
tgtatattgcacaggtccag

SEQ ID NO: 655805 - DNA, 20 bp, Artificial
  CRISPR gRNA sequence
tatattgcacaggtccaggg

SEQ ID NO: 655806 - DNA, 20 bp, Artificial
  CRISPR gRNA sequence
cacaggtccagggaagaaag

SEQ ID NO: 655807 - DNA, 20 bp, Artificial
  CRISPR gRNA sequence
ctgataatttagggtaaaaa

SEQ ID NO: 655808 - DNA, 20 bp, Artificial
  CRISPR gRNA sequence
tgataatttagggtaaaaat

SEQ ID NO: 655809 - DNA, 20 bp, Artificial
  CRISPR gRNA sequence
ataatttagggtaaaaattg

SEQ ID NO: 655810 - DNA, 20 bp, Artificial
  CRISPR gRNA sequence
agggtaaaaattgaagcagg

SEQ ID NO: 655811 - DNA, 20 bp, Artificial
  CRISPR gRNA sequence
gggtaaaaattgaagcagga

SEQ ID NO: 655812 - DNA, 20 bp, Artificial
  CRISPR gRNA sequence
aagcaggaaccctccgttat

SEQ ID NO: 655813 - DNA, 20 bp, Artificial
  CRISPR gRNA sequence
cgttatttaaagcatctatg

SEQ ID NO: 655814 - DNA, 20 bp, Artificial
  CRISPR gRNA sequence
tttaaagcatctatgaagat

SEQ ID NO: 655815 - DNA, 20 bp, Artificial
  CRISPR gRNA sequence
aaagcatctatgaagatttt

SEQ ID NO: 655816 - DNA, 20 bp, Artificial
  CRISPR gRNA sequence
aagcatctatgaagattttg

SEQ ID NO: 655817 - DNA, 20 bp, Artificial
  CRISPR gRNA sequence
tgaagattttggttaagaaa

SEQ ID NO: 655818 - DNA, 20 bp, Artificial
  CRISPR gRNA sequence
tggttaagaaagaaatagag

SEQ ID NO: 655819 - DNA, 20 bp, Artificial
  CRISPR gRNA sequence
ggttaagaaagaaatagagt

SEQ ID NO: 655820 - DNA, 20 bp, Artificial
  CRISPR gRNA sequence
gttaagaaagaaatagagtt

SEQ ID NO: 655821 - DNA, 20 bp, Artificial
  CRISPR gRNA sequence
agaaagaaatagagtttgtc

SEQ ID NO: 655822 - DNA, 20 bp, Artificial
  CRISPR gRNA sequence
gtctatatgtcagaattggg

SEQ ID NO: 655823 - DNA, 20 bp, Artificial
  CRISPR gRNA sequence
tctatatgtcagaattgggg

SEQ ID NO: 655824 - DNA, 20 bp, Artificial
  CRISPR gRNA sequence
tatgtcagaattggggaggg

SEQ ID NO: 655825 - DNA, 20 bp, Artificial
  CRISPR gRNA sequence
gggaggggggtggcgctcaa

SEQ ID NO: 655826 - DNA, 20 bp, Artificial
  CRISPR gRNA sequence
aacattcctgagtatagttt

SEQ ID NO: 655827 - DNA, 20 bp, Artificial
  CRISPR gRNA sequence
ctgagtatagttttgtggtt

SEQ ID NO: 655828 - DNA, 20 bp, Artificial
  CRISPR gRNA sequence
agtatagttttgtggttttg

SEQ ID NO: 655829 - DNA, 20 bp, Artificial
  CRISPR gRNA sequence
tgtggttttgatgatatgta

SEQ ID NO: 655830 - DNA, 20 bp, Artificial
  CRISPR gRNA sequence
gtggttttgatgatatgtaa

SEQ ID NO: 655831 - DNA, 20 bp, Artificial
  CRISPR gRNA sequence
tggttttgatgatatgtaaa

SEQ ID NO: 655832 - DNA, 20 bp, Artificial
  CRISPR gRNA sequence
tgatgatatgtaaagcaaat

SEQ ID NO: 655833 - DNA, 20 bp, Artificial
  CRISPR gRNA sequence
gatgatatgtaaagcaaatc

SEQ ID NO: 655834 - DNA, 20 bp, Artificial
  CRISPR gRNA sequence
atgatatgtaaagcaaatca

SEQ ID NO: 655835 - DNA, 20 bp, Artificial
  CRISPR gRNA sequence
catattattggtgttccaga

SEQ ID NO: 655836 - DNA, 20 bp, Artificial
  CRISPR gRNA sequence
ttggtgttccagatatacca

SEQ ID NO: 655837 - DNA, 20 bp, Artificial
  CRISPR gRNA sequence
gtgttccagatataccagtc

SEQ ID NO: 655838 - DNA, 20 bp, Artificial
  CRISPR gRNA sequence
cagatataccagtcattaca

SEQ ID NO: 655839 - DNA, 20 bp, Artificial
  CRISPR gRNA sequence
caaataacaaaagaaaaaaa

SEQ ID NO: 655840 - DNA, 20 bp, Artificial
  CRISPR gRNA sequence
ccttaatagagtaacctatt

SEQ ID NO: 655841 - DNA, 20 bp, Artificial
  CRISPR gRNA sequence
aatagagtaacctattccta

SEQ ID NO: 655842 - DNA, 20 bp, Artificial
  CRISPR gRNA sequence
atagagtaacctattcctac

SEQ ID NO: 655843 - DNA, 20 bp, Artificial
  CRISPR gRNA sequence
ttcctacagagaatcaattc

SEQ ID NO: 655844 - DNA, 20 bp, Artificial
  CRISPR gRNA sequence
ctacagagaatcaattctta

SEQ ID NO: 655845 - DNA, 20 bp, Artificial
  CRISPR gRNA sequence
cagagaatcaattcttagag

SEQ ID NO: 655846 - DNA, 20 bp, Artificial
  CRISPR gRNA sequence
ttagagagtcctcatctaaa

SEQ ID NO: 655847 - DNA, 20 bp, Artificial
  CRISPR gRNA sequence
agagagtcctcatctaaaat

SEQ ID NO: 655848 - DNA, 20 bp, Artificial
  CRISPR gRNA sequence
gagagtcctcatctaaaatc

SEQ ID NO: 655849 - DNA, 20 bp, Artificial
  CRISPR gRNA sequence
atctaaaatctaacctcatt

SEQ ID NO: 655850 - DNA, 20 bp, Artificial
  CRISPR gRNA sequence
aaatctaacctcatttgatg

SEQ ID NO: 655851 - DNA, 20 bp, Artificial
  CRISPR gRNA sequence
acctcatttgatgcttctgg

SEQ ID NO: 655852 - DNA, 20 bp, Artificial
  CRISPR gRNA sequence
atttgatgcttctggtagta

SEQ ID NO: 655853 - DNA, 20 bp, Artificial
  CRISPR gRNA sequence
gatgcttctggtagtaccat

SEQ ID NO: 655854 - DNA, 20 bp, Artificial
  CRISPR gRNA sequence
atgcttctggtagtaccata

SEQ ID NO: 655855 - DNA, 20 bp, Artificial
  CRISPR gRNA sequence
ctggtagtaccataaattct

SEQ ID NO: 655856 - DNA, 20 bp, Artificial
  CRISPR gRNA sequence
tggtagtaccataaattctc

SEQ ID NO: 655857 - DNA, 20 bp, Artificial
  CRISPR gRNA sequence
gtagtaccataaattctcac

SEQ ID NO: 655858 - DNA, 20 bp, Artificial
  CRISPR gRNA sequence
tcacttgatgatacctaata

SEQ ID NO: 655859 - DNA, 20 bp, Artificial
  CRISPR gRNA sequence
acttgatgatacctaataaa

SEQ ID NO: 655860 - DNA, 20 bp, Artificial
  CRISPR gRNA sequence
gatgatacctaataaaattg

SEQ ID NO: 655861 - DNA, 20 bp, Artificial
  CRISPR gRNA sequence
atgatacctaataaaattgt

SEQ ID NO: 655862 - DNA, 20 bp, Artificial
  CRISPR gRNA sequence
ataaaattgttggtttaatt

SEQ ID NO: 655863 - DNA, 20 bp, Artificial
  CRISPR gRNA sequence
ttggtttaattgttgattgt

SEQ ID NO: 655864 - DNA, 20 bp, Artificial
  CRISPR gRNA sequence
gtttaattgttgattgtgca

SEQ ID NO: 655865 - DNA, 20 bp, Artificial
  CRISPR gRNA sequence
aattgttgattgtgcacttc

SEQ ID NO: 655866 - DNA, 20 bp, Artificial
  CRISPR gRNA sequence
attgttgattgtgcacttcg

SEQ ID NO: 655867 - DNA, 20 bp, Artificial
  CRISPR gRNA sequence
ttgattgtgcacttcggggg

SEQ ID NO: 655868 - DNA, 20 bp, Artificial
  CRISPR gRNA sequence
attgtgcacttcgggggtag

SEQ ID NO: 655869 - DNA, 20 bp, Artificial
  CRISPR gRNA sequence
tgcacttcgggggtagtagt

SEQ ID NO: 655870 - DNA, 20 bp, Artificial
  CRISPR gRNA sequence
cgggggtagtagtttagatg

SEQ ID NO: 655871 - DNA, 20 bp, Artificial
  CRISPR gRNA sequence
gggggtagtagtttagatgt

SEQ ID NO: 655872 - DNA, 20 bp, Artificial
  CRISPR gRNA sequence
agatgttctaaatttgaagt

SEQ ID NO: 655873 - DNA, 20 bp, Artificial
  CRISPR gRNA sequence
gatgttctaaatttgaagta

SEQ ID NO: 655874 - DNA, 20 bp, Artificial
  CRISPR gRNA sequence
taaatttgaagtaggcttaa

SEQ ID NO: 655875 - DNA, 20 bp, Artificial
  CRISPR gRNA sequence
aatttgaagtaggcttaaat

SEQ ID NO: 655876 - DNA, 20 bp, Artificial
  CRISPR gRNA sequence
gaagtaggcttaaatgcaat

SEQ ID NO: 655877 - DNA, 20 bp, Artificial
  CRISPR gRNA sequence
aagtaggcttaaatgcaatt

SEQ ID NO: 655878 - DNA, 20 bp, Artificial
  CRISPR gRNA sequence
aaatgcaattattaattata

SEQ ID NO: 655879 - DNA, 20 bp, Artificial
  CRISPR gRNA sequence
aatgcaattattaattataa

SEQ ID NO: 655880 - DNA, 20 bp, Artificial
  CRISPR gRNA sequence
ttaattataagcatttgaca

SEQ ID NO: 655881 - DNA, 20 bp, Artificial
  CRISPR gRNA sequence
attataagcatttgacattt

SEQ ID NO: 655882 - DNA, 20 bp, Artificial
  CRISPR gRNA sequence
taagcatttgacattttgct

SEQ ID NO: 655883 - DNA, 20 bp, Artificial
  CRISPR gRNA sequence
gacattttgctgttcaattc

SEQ ID NO: 655884 - DNA, 20 bp, Artificial
  CRISPR gRNA sequence
acattttgctgttcaattct

SEQ ID NO: 655885 - DNA, 20 bp, Artificial
  CRISPR gRNA sequence
tgctgttcaattctagttga

SEQ ID NO: 655886 - DNA, 20 bp, Artificial
  CRISPR gRNA sequence
gctgttcaattctagttgat

SEQ ID NO: 655887 - DNA, 20 bp, Artificial
  CRISPR gRNA sequence
ctgttcaattctagttgatc

SEQ ID NO: 655888 - DNA, 20 bp, Artificial
  CRISPR gRNA sequence
ttcaattctagttgatcaat

SEQ ID NO: 655889 - DNA, 20 bp, Artificial
  CRISPR gRNA sequence
aattctagttgatcaattca

SEQ ID NO: 655890 - DNA, 20 bp, Artificial
  CRISPR gRNA sequence
tagttgatcaattcaataaa

SEQ ID NO: 655891 - DNA, 20 bp, Artificial
  CRISPR gRNA sequence
gttgatcaattcaataaata

SEQ ID NO: 655892 - DNA, 20 bp, Artificial
  CRISPR gRNA sequence
atcaattcaataaatatttg

SEQ ID NO: 655893 - DNA, 20 bp, Artificial
  CRISPR gRNA sequence
aataaatatttgtgggatac

SEQ ID NO: 655894 - DNA, 20 bp, Artificial
  CRISPR gRNA sequence
gtgggatacctcatatgtgc

SEQ ID NO: 655895 - DNA, 20 bp, Artificial
  CRISPR gRNA sequence
tgggatacctcatatgtgcc

SEQ ID NO: 655896 - DNA, 20 bp, Artificial
  CRISPR gRNA sequence
atatgtgccaggtattgtaa

SEQ ID NO: 655897 - DNA, 20 bp, Artificial
  CRISPR gRNA sequence
taaggtgaatccaaaggtga

SEQ ID NO: 655898 - DNA, 20 bp, Artificial
  CRISPR gRNA sequence
ttcctccaggaactcatact

SEQ ID NO: 655899 - DNA, 20 bp, Artificial
  CRISPR gRNA sequence
tcctccaggaactcatactc

SEQ ID NO: 655900 - DNA, 20 bp, Artificial
  CRISPR gRNA sequence
cctccaggaactcatactct

SEQ ID NO: 655901 - DNA, 20 bp, Artificial
  CRISPR gRNA sequence
ctccaggaactcatactcta

SEQ ID NO: 655902 - DNA, 20 bp, Artificial
  CRISPR gRNA sequence
caggaactcatactctagtg

SEQ ID NO: 655903 - DNA, 20 bp, Artificial
  CRISPR gRNA sequence
atactctagtgggacagaca

SEQ ID NO: 655904 - DNA, 20 bp, Artificial
  CRISPR gRNA sequence
tagtgggacagacagacatt

SEQ ID NO: 655905 - DNA, 20 bp, Artificial
  CRISPR gRNA sequence
gtgggacagacagacattaa

SEQ ID NO: 655906 - DNA, 20 bp, Artificial
  CRISPR gRNA sequence
aatagggcattttactgtag

SEQ ID NO: 655907 - DNA, 20 bp, Artificial
  CRISPR gRNA sequence
tactgtagtaagcttagtgt

SEQ ID NO: 655908 - DNA, 20 bp, Artificial
  CRISPR gRNA sequence
actgtagtaagcttagtgtc

SEQ ID NO: 655909 - DNA, 20 bp, Artificial
  CRISPR gRNA sequence
ctgtagtaagcttagtgtct

SEQ ID NO: 655910 - DNA, 20 bp, Artificial
  CRISPR gRNA sequence
tagtaagcttagtgtcttga

SEQ ID NO: 655911 - DNA, 20 bp, Artificial
  CRISPR gRNA sequence
agtgtcttgattattacggg

SEQ ID NO: 655912 - DNA, 20 bp, Artificial
  CRISPR gRNA sequence
gtgtcttgattattacgggg

SEQ ID NO: 655913 - DNA, 20 bp, Artificial
  CRISPR gRNA sequence
gattattacgggggatgaga

SEQ ID NO: 655914 - DNA, 20 bp, Artificial
  CRISPR gRNA sequence
attattacgggggatgagag

SEQ ID NO: 655915 - DNA, 20 bp, Artificial
  CRISPR gRNA sequence
ttacgggggatgagaggtgg

SEQ ID NO: 655916 - DNA, 20 bp, Artificial
  CRISPR gRNA sequence
cgggggatgagaggtggtgc

SEQ ID NO: 655917 - DNA, 20 bp, Artificial
  CRISPR gRNA sequence
atttggaaatattttttaga

SEQ ID NO: 655918 - DNA, 20 bp, Artificial
  CRISPR gRNA sequence
ggaaatattttttagagggg

SEQ ID NO: 655919 - DNA, 20 bp, Artificial
  CRISPR gRNA sequence
gaaatattttttagaggggg

SEQ ID NO: 655920 - DNA, 20 bp, Artificial
  CRISPR gRNA sequence
tttagagggggagactgctt

SEQ ID NO: 655921 - DNA, 20 bp, Artificial
  CRISPR gRNA sequence
ttagagggggagactgcttg

SEQ ID NO: 655922 - DNA, 20 bp, Artificial
  CRISPR gRNA sequence
tagagggggagactgcttga

SEQ ID NO: 655923 - DNA, 20 bp, Artificial
  CRISPR gRNA sequence
agagggggagactgcttgag

SEQ ID NO: 655924 - DNA, 20 bp, Artificial
  CRISPR gRNA sequence
gagggggagactgcttgagc

SEQ ID NO: 655925 - DNA, 20 bp, Artificial
  CRISPR gRNA sequence
cttgagccgagacttattaa

SEQ ID NO: 655926 - DNA, 20 bp, Artificial
  CRISPR gRNA sequence
gagccgagacttattaaatg

SEQ ID NO: 655927 - DNA, 20 bp, Artificial
  CRISPR gRNA sequence
agccgagacttattaaatga

SEQ ID NO: 655928 - DNA, 20 bp, Artificial
  CRISPR gRNA sequence
attaaatgaataggatttag

SEQ ID NO: 655929 - DNA, 20 bp, Artificial
  CRISPR gRNA sequence
ttaaatgaataggatttagg

SEQ ID NO: 655930 - DNA, 20 bp, Artificial
  CRISPR gRNA sequence
aatgaataggatttaggagt

SEQ ID NO: 655931 - DNA, 20 bp, Artificial
  CRISPR gRNA sequence
aggagtaactggaaggcctt

SEQ ID NO: 655932 - DNA, 20 bp, Artificial
  CRISPR gRNA sequence
ggagtaactggaaggccttt

SEQ ID NO: 655933 - DNA, 20 bp, Artificial
  CRISPR gRNA sequence
gaaggccttttcaataaata

SEQ ID NO: 655934 - DNA, 20 bp, Artificial
  CRISPR gRNA sequence
ttcaataaataatatatcca

SEQ ID NO: 655935 - DNA, 20 bp, Artificial
  CRISPR gRNA sequence
tcaataaataatatatccac

SEQ ID NO: 655936 - DNA, 20 bp, Artificial
  CRISPR gRNA sequence
caataaataatatatccaca

SEQ ID NO: 655937 - DNA, 20 bp, Artificial
  CRISPR gRNA sequence
aataaataatatatccacaa

SEQ ID NO: 655938 - DNA, 20 bp, Artificial
  CRISPR gRNA sequence
tgggaaatacaagcagattg

SEQ ID NO: 655939 - DNA, 20 bp, Artificial
  CRISPR gRNA sequence
ggaaatacaagcagattggt

SEQ ID NO: 655940 - DNA, 20 bp, Artificial
  CRISPR gRNA sequence
gtatttctagactataaagt

SEQ ID NO: 655941 - DNA, 20 bp, Artificial
  CRISPR gRNA sequence
ctagactataaagttggagt

SEQ ID NO: 655942 - DNA, 20 bp, Artificial
  CRISPR gRNA sequence
tagactataaagttggagtc

SEQ ID NO: 655943 - DNA, 20 bp, Artificial
  CRISPR gRNA sequence
gactataaagttggagtcta

SEQ ID NO: 655944 - DNA, 20 bp, Artificial
  CRISPR gRNA sequence
taaagttggagtctaggaat

SEQ ID NO: 655945 - DNA, 20 bp, Artificial
  CRISPR gRNA sequence
gagtctaggaattcgaggcc

SEQ ID NO: 655946 - DNA, 20 bp, Artificial
  CRISPR gRNA sequence
ggaattcgaggccaggaatg

SEQ ID NO: 655947 - DNA, 20 bp, Artificial
  CRISPR gRNA sequence
gaggccaggaatgactttgg

SEQ ID NO: 655948 - DNA, 20 bp, Artificial
  CRISPR gRNA sequence
tggagagttaatcaaggcag

SEQ ID NO: 655949 - DNA, 20 bp, Artificial
  CRISPR gRNA sequence
ggagagttaatcaaggcagg

SEQ ID NO: 655950 - DNA, 20 bp, Artificial
  CRISPR gRNA sequence
gagagttaatcaaggcagga

SEQ ID NO: 655951 - DNA, 20 bp, Artificial
  CRISPR gRNA sequence
atcaaggcaggataatggaa

SEQ ID NO: 655952 - DNA, 20 bp, Artificial
  CRISPR gRNA sequence
gtatgagaggaaacttggct

SEQ ID NO: 655953 - DNA, 20 bp, Artificial
  CRISPR gRNA sequence
tatgagaggaaacttggctt

SEQ ID NO: 655954 - DNA, 20 bp, Artificial
  CRISPR gRNA sequence
ggcttttattttcatggaag

SEQ ID NO: 655955 - DNA, 20 bp, Artificial
  CRISPR gRNA sequence
gcttttattttcatggaagt

SEQ ID NO: 655956 - DNA, 20 bp, Artificial
  CRISPR gRNA sequence
ttattttcatggaagtcaat

SEQ ID NO: 655957 - DNA, 20 bp, Artificial
  CRISPR gRNA sequence
tattttcatggaagtcaatg

SEQ ID NO: 655958 - DNA, 20 bp, Artificial
  CRISPR gRNA sequence
attttcatggaagtcaatgg

SEQ ID NO: 655959 - DNA, 20 bp, Artificial
  CRISPR gRNA sequence
ttttcatggaagtcaatggt

SEQ ID NO: 655960 - DNA, 20 bp, Artificial
  CRISPR gRNA sequence
tcatggaagtcaatggtttt

SEQ ID NO: 655961 - DNA, 20 bp, Artificial
  CRISPR gRNA sequence
catggaagtcaatggtttta

SEQ ID NO: 655962 - DNA, 20 bp, Artificial
  CRISPR gRNA sequence
atggaagtcaatggttttaa

SEQ ID NO: 655963 - DNA, 20 bp, Artificial
  CRISPR gRNA sequence
taacgaagtaggtgacttca

SEQ ID NO: 655964 - DNA, 20 bp, Artificial
  CRISPR gRNA sequence
aacgaagtaggtgacttcag

SEQ ID NO: 655965 - DNA, 20 bp, Artificial
  CRISPR gRNA sequence
acgaagtaggtgacttcagt

SEQ ID NO: 655966 - DNA, 20 bp, Artificial
  CRISPR gRNA sequence
cagtcttttgactgacatgg

SEQ ID NO: 655967 - DNA, 20 bp, Artificial
  CRISPR gRNA sequence
agtcttttgactgacatgga

SEQ ID NO: 655968 - DNA, 20 bp, Artificial
  CRISPR gRNA sequence
ttgactgacatggatcgatt

SEQ ID NO: 655969 - DNA, 20 bp, Artificial
  CRISPR gRNA sequence
tgactgacatggatcgattt

SEQ ID NO: 655970 - DNA, 20 bp, Artificial
  CRISPR gRNA sequence
gactgacatggatcgatttg

SEQ ID NO: 655971 - DNA, 20 bp, Artificial
  CRISPR gRNA sequence
actgacatggatcgatttga

SEQ ID NO: 655972 - DNA, 20 bp, Artificial
  CRISPR gRNA sequence
acatggatcgatttgattac

SEQ ID NO: 655973 - DNA, 20 bp, Artificial
  CRISPR gRNA sequence
gattacaatgtggggaaaaa

SEQ ID NO: 655974 - DNA, 20 bp, Artificial
  CRISPR gRNA sequence
attacaatgtggggaaaaag

SEQ ID NO: 655975 - DNA, 20 bp, Artificial
  CRISPR gRNA sequence
caatgtggggaaaaagattg

SEQ ID NO: 655976 - DNA, 20 bp, Artificial
  CRISPR gRNA sequence
tggatggggaccagtctcta

SEQ ID NO: 655977 - DNA, 20 bp, Artificial
  CRISPR gRNA sequence
taggcaggtgcatatttaac

SEQ ID NO: 655978 - DNA, 20 bp, Artificial
  CRISPR gRNA sequence
ggcaggtgcatatttaacag

SEQ ID NO: 655979 - DNA, 20 bp, Artificial
  CRISPR gRNA sequence
aacaggctgtttcaatgatt

SEQ ID NO: 655980 - DNA, 20 bp, Artificial
  CRISPR gRNA sequence
acaggctgtttcaatgattg

SEQ ID NO: 655981 - DNA, 20 bp, Artificial
  CRISPR gRNA sequence
tttcaatgattgagtgagaa

SEQ ID NO: 655982 - DNA, 20 bp, Artificial
  CRISPR gRNA sequence
caatgattgagtgagaagtc

SEQ ID NO: 655983 - DNA, 20 bp, Artificial
  CRISPR gRNA sequence
aatgattgagtgagaagtca

SEQ ID NO: 655984 - DNA, 20 bp, Artificial
  CRISPR gRNA sequence
agtgagaagtcatgcaagct

SEQ ID NO: 655985 - DNA, 20 bp, Artificial
  CRISPR gRNA sequence
gcagtagtgggataaaaagg

SEQ ID NO: 655986 - DNA, 20 bp, Artificial
  CRISPR gRNA sequence
ggtaatatttagcatcttaa

SEQ ID NO: 655987 - DNA, 20 bp, Artificial
  CRISPR gRNA sequence
agcatcttaaagtagacagt

SEQ ID NO: 655988 - DNA, 20 bp, Artificial
  CRISPR gRNA sequence
gcatcttaaagtagacagta

SEQ ID NO: 655989 - DNA, 20 bp, Artificial
  CRISPR gRNA sequence
aaagtagacagtacttgggt

SEQ ID NO: 655990 - DNA, 20 bp, Artificial
  CRISPR gRNA sequence
aagtagacagtacttgggta

SEQ ID NO: 655991 - DNA, 20 bp, Artificial
  CRISPR gRNA sequence
gggtagtagaattaaggaga

SEQ ID NO: 655992 - DNA, 20 bp, Artificial
  CRISPR gRNA sequence
ggtagtagaattaaggagac

SEQ ID NO: 655993 - DNA, 20 bp, Artificial
  CRISPR gRNA sequence
aggagacaatagagtcaagg

SEQ ID NO: 655994 - DNA, 20 bp, Artificial
  CRISPR gRNA sequence
taaattacgggatagatggt

SEQ ID NO: 655995 - DNA, 20 bp, Artificial
  CRISPR gRNA sequence
aaattacgggatagatggtg

SEQ ID NO: 655996 - DNA, 20 bp, Artificial
  CRISPR gRNA sequence
aattacgggatagatggtgg

SEQ ID NO: 655997 - DNA, 20 bp, Artificial
  CRISPR gRNA sequence
cgggatagatggtggtggta

SEQ ID NO: 655998 - DNA, 20 bp, Artificial
  CRISPR gRNA sequence
tgtcagtgaagatagcaaat

SEQ ID NO: 655999 - DNA, 20 bp, Artificial
  CRISPR gRNA sequence
tcagtgaagatagcaaatac

SEQ ID NO: 656000 - DNA, 20 bp, Artificial
  CRISPR gRNA sequence
gagcaggtttccgggaaaag

SEQ ID NO: 656001 - DNA, 20 bp, Artificial
  CRISPR gRNA sequence
ccgggaaaagatttagctta

SEQ ID NO: 656002 - DNA, 20 bp, Artificial
  CRISPR gRNA sequence
cgggaaaagatttagcttag

SEQ ID NO: 656003 - DNA, 20 bp, Artificial
  CRISPR gRNA sequence
agcttagttcaattctggtt

SEQ ID NO: 656004 - DNA, 20 bp, Artificial
  CRISPR gRNA sequence
gcttagttcaattctggttt

SEQ ID NO: 656005 - DNA, 20 bp, Artificial
  CRISPR gRNA sequence
agttcaattctggtttgaag

SEQ ID NO: 656006 - DNA, 20 bp, Artificial
  CRISPR gRNA sequence
gttcaattctggtttgaagc

SEQ ID NO: 656007 - DNA, 20 bp, Artificial
  CRISPR gRNA sequence
aattctggtttgaagcaccc

SEQ ID NO: 656008 - DNA, 20 bp, Artificial
  CRISPR gRNA sequence
tggtttgaagcacccacagg

SEQ ID NO: 656009 - DNA, 20 bp, Artificial
  CRISPR gRNA sequence
gtttgaagcacccacagggt

SEQ ID NO: 656010 - DNA, 20 bp, Artificial
  CRISPR gRNA sequence
gaagcacccacagggtacaa

SEQ ID NO: 656011 - DNA, 20 bp, Artificial
  CRISPR gRNA sequence
aagcacccacagggtacaat

SEQ ID NO: 656012 - DNA, 20 bp, Artificial
  CRISPR gRNA sequence
gggagagggatagcaattag

SEQ ID NO: 656013 - DNA, 20 bp, Artificial
  CRISPR gRNA sequence
ggagagggatagcaattagg

SEQ ID NO: 656014 - DNA, 20 bp, Artificial
  CRISPR gRNA sequence
ggcacatggatatagactga

SEQ ID NO: 656015 - DNA, 20 bp, Artificial
  CRISPR gRNA sequence
aagtatgaattttcctaatt

SEQ ID NO: 656016 - DNA, 20 bp, Artificial
  CRISPR gRNA sequence
tcctaattagtgaaaactaa

SEQ ID NO: 656017 - DNA, 20 bp, Artificial
  CRISPR gRNA sequence
cctaattagtgaaaactaat

SEQ ID NO: 656018 - DNA, 20 bp, Artificial
  CRISPR gRNA sequence
ctaattagtgaaaactaata

SEQ ID NO: 656019 - DNA, 20 bp, Artificial
  CRISPR gRNA sequence
attagtgaaaactaatatta

SEQ ID NO: 656020 - DNA, 20 bp, Artificial
  CRISPR gRNA sequence
gtgaaaactaatattagccc

SEQ ID NO: 656021 - DNA, 20 bp, Artificial
  CRISPR gRNA sequence
atattagcccatggtttggt

SEQ ID NO: 656022 - DNA, 20 bp, Artificial
  CRISPR gRNA sequence
gcccatggtttggttacttt

SEQ ID NO: 656023 - DNA, 20 bp, Artificial
  CRISPR gRNA sequence
ggttacttttctgcccatat

SEQ ID NO: 656024 - DNA, 20 bp, Artificial
  CRISPR gRNA sequence
gttacttttctgcccatatt

SEQ ID NO: 656025 - DNA, 20 bp, Artificial
  CRISPR gRNA sequence
cttttctgcccatattactt

SEQ ID NO: 656026 - DNA, 20 bp, Artificial
  CRISPR gRNA sequence
ttctgcccatattactttaa

SEQ ID NO: 656027 - DNA, 20 bp, Artificial
  CRISPR gRNA sequence
tctgcccatattactttaac

SEQ ID NO: 656028 - DNA, 20 bp, Artificial
  CRISPR gRNA sequence
ctgcccatattactttaaca

SEQ ID NO: 656029 - DNA, 20 bp, Artificial
  CRISPR gRNA sequence
tgcccatattactttaacag

SEQ ID NO: 656030 - DNA, 20 bp, Artificial
  CRISPR gRNA sequence
cccatattactttaacagta

SEQ ID NO: 656031 - DNA, 20 bp, Artificial
  CRISPR gRNA sequence
ctttaacagtagtttaatac

SEQ ID NO: 656032 - DNA, 20 bp, Artificial
  CRISPR gRNA sequence
taacagtagtttaataccat

SEQ ID NO: 656033 - DNA, 20 bp, Artificial
  CRISPR gRNA sequence
aacagtagtttaataccata

SEQ ID NO: 656034 - DNA, 20 bp, Artificial
  CRISPR gRNA sequence
acagtagtttaataccatat

SEQ ID NO: 656035 - DNA, 20 bp, Artificial
  CRISPR gRNA sequence
aataccatattttgaaaaca

SEQ ID NO: 656036 - DNA, 20 bp, Artificial
  CRISPR gRNA sequence
ataccatattttgaaaacat

SEQ ID NO: 656037 - DNA, 20 bp, Artificial
  CRISPR gRNA sequence
tgaaaacattcatgtctaag

SEQ ID NO: 656038 - DNA, 20 bp, Artificial
  CRISPR gRNA sequence
gaaaacattcatgtctaagt

SEQ ID NO: 656039 - DNA, 20 bp, Artificial
  CRISPR gRNA sequence
aaaacattcatgtctaagta

SEQ ID NO: 656040 - DNA, 20 bp, Artificial
  CRISPR gRNA sequence
atgtctaagtaattctcagt

SEQ ID NO: 656041 - DNA, 20 bp, Artificial
  CRISPR gRNA sequence
agtaattctcagtatttgat

SEQ ID NO: 656042 - DNA, 20 bp, Artificial
  CRISPR gRNA sequence
tcagtatttgatcagtggcc

SEQ ID NO: 656043 - DNA, 20 bp, Artificial
  CRISPR gRNA sequence
agtatttgatcagtggcctt

SEQ ID NO: 656044 - DNA, 20 bp, Artificial
  CRISPR gRNA sequence
gatcagtggccttatttcct

SEQ ID NO: 656045 - DNA, 20 bp, Artificial
  CRISPR gRNA sequence
atcagtggccttatttcctc

SEQ ID NO: 656046 - DNA, 20 bp, Artificial
  CRISPR gRNA sequence
atttcctcaattgccccatt

SEQ ID NO: 656047 - DNA, 20 bp, Artificial
  CRISPR gRNA sequence
tttcctcaattgccccatta

SEQ ID NO: 656048 - DNA, 20 bp, Artificial
  CRISPR gRNA sequence
cctcaattgccccattaaat

SEQ ID NO: 656049 - DNA, 20 bp, Artificial
  CRISPR gRNA sequence
ctcaattgccccattaaatc

SEQ ID NO: 656050 - DNA, 20 bp, Artificial
  CRISPR gRNA sequence
aattgccccattaaatcaaa

SEQ ID NO: 656051 - DNA, 20 bp, Artificial
  CRISPR gRNA sequence
ccccattaaatcaaaattct

SEQ ID NO: 656052 - DNA, 20 bp, Artificial
  CRISPR gRNA sequence
aatcaaaattctatattgag

SEQ ID NO: 656053 - DNA, 20 bp, Artificial
  CRISPR gRNA sequence
tatattgagttttatgtgca

SEQ ID NO: 656054 - DNA, 20 bp, Artificial
  CRISPR gRNA sequence
tattgagttttatgtgcaca

SEQ ID NO: 656055 - DNA, 20 bp, Artificial
  CRISPR gRNA sequence
agttttatgtgcacaggctt

SEQ ID NO: 656056 - DNA, 20 bp, Artificial
  CRISPR gRNA sequence
tatgtgcacaggctttaata

SEQ ID NO: 656057 - DNA, 20 bp, Artificial
  CRISPR gRNA sequence
atgtgcacaggctttaataa

SEQ ID NO: 656058 - DNA, 20 bp, Artificial
  CRISPR gRNA sequence
tgtgcacaggctttaataaa

SEQ ID NO: 656059 - DNA, 20 bp, Artificial
  CRISPR gRNA sequence
taataaactctttgcttaat

SEQ ID NO: 656060 - DNA, 20 bp, Artificial
  CRISPR gRNA sequence
aataaactctttgcttaatg

SEQ ID NO: 656061 - DNA, 20 bp, Artificial
  CRISPR gRNA sequence
ataaactctttgcttaatgg

SEQ ID NO: 656062 - DNA, 20 bp, Artificial
  CRISPR gRNA sequence
tttgcttaatggaatccttt

SEQ ID NO: 656063 - DNA, 20 bp, Artificial
  CRISPR gRNA sequence
tgcttaatggaatcctttat

SEQ ID NO: 656064 - DNA, 20 bp, Artificial
  CRISPR gRNA sequence
gcttaatggaatcctttata

SEQ ID NO: 656065 - DNA, 20 bp, Artificial
  CRISPR gRNA sequence
cttaatggaatcctttatac

SEQ ID NO: 656066 - DNA, 20 bp, Artificial
  CRISPR gRNA sequence
aatggaatcctttatactgg

SEQ ID NO: 656067 - DNA, 20 bp, Artificial
  CRISPR gRNA sequence
atggaatcctttatactggt

SEQ ID NO: 656068 - DNA, 20 bp, Artificial
  CRISPR gRNA sequence
tatactggtctcagaagttg

SEQ ID NO: 656069 - DNA, 20 bp, Artificial
  CRISPR gRNA sequence
atactggtctcagaagttga

SEQ ID NO: 656070 - DNA, 20 bp, Artificial
  CRISPR gRNA sequence
tactggtctcagaagttgaa

SEQ ID NO: 656071 - DNA, 20 bp, Artificial
  CRISPR gRNA sequence
gtctcagaagttgaattaat

SEQ ID NO: 656072 - DNA, 20 bp, Artificial
  CRISPR gRNA sequence
agaagttgaattaattgatg

SEQ ID NO: 656073 - DNA, 20 bp, Artificial
  CRISPR gRNA sequence
aattaattgatgtgattgac

SEQ ID NO: 656074 - DNA, 20 bp, Artificial
  CRISPR gRNA sequence
attgatgtgattgacccact

SEQ ID NO: 656075 - DNA, 20 bp, Artificial
  CRISPR gRNA sequence
atgtgattgacccactgatt

SEQ ID NO: 656076 - DNA, 20 bp, Artificial
  CRISPR gRNA sequence
acccactgatttttaaacaa

SEQ ID NO: 656077 - DNA, 20 bp, Artificial
  CRISPR gRNA sequence
atttttaaacaaaaagctct

SEQ ID NO: 656078 - DNA, 20 bp, Artificial
  CRISPR gRNA sequence
ttaaacaaaaagctcttcaa

SEQ ID NO: 656079 - DNA, 20 bp, Artificial
  CRISPR gRNA sequence
taaacaaaaagctcttcaac

SEQ ID NO: 656080 - DNA, 20 bp, Artificial
  CRISPR gRNA sequence
aaacaaaaagctcttcaaca

SEQ ID NO: 656081 - DNA, 20 bp, Artificial
  CRISPR gRNA sequence
aacaaaaagctcttcaacat

SEQ ID NO: 656082 - DNA, 20 bp, Artificial
  CRISPR gRNA sequence
ttcaacattttgtggtatat

SEQ ID NO: 656083 - DNA, 20 bp, Artificial
  CRISPR gRNA sequence
caacattttgtggtatatct

SEQ ID NO: 656084 - DNA, 20 bp, Artificial
  CRISPR gRNA sequence
aacattttgtggtatatcta

SEQ ID NO: 656085 - DNA, 20 bp, Artificial
  CRISPR gRNA sequence
tgtggtatatctaatatcat

SEQ ID NO: 656086 - DNA, 20 bp, Artificial
  CRISPR gRNA sequence
gtggtatatctaatatcata

SEQ ID NO: 656087 - DNA, 20 bp, Artificial
  CRISPR gRNA sequence
tggtatatctaatatcataa

SEQ ID NO: 656088 - DNA, 20 bp, Artificial
  CRISPR gRNA sequence
atatcataacttctgttttt

SEQ ID NO: 656089 - DNA, 20 bp, Artificial
  CRISPR gRNA sequence
ctgttttttaaaaaaaatca

SEQ ID NO: 656090 - DNA, 20 bp, Artificial
  CRISPR gRNA sequence
tgttttttaaaaaaaatcat

SEQ ID NO: 656091 - DNA, 20 bp, Artificial
  CRISPR gRNA sequence
ttttttaaaaaaaatcataa

SEQ ID NO: 656092 - DNA, 20 bp, Artificial
  CRISPR gRNA sequence
tttaaaaaaaatcataagat

SEQ ID NO: 656093 - DNA, 20 bp, Artificial
  CRISPR gRNA sequence
ttaaaaaaaatcataagatt

SEQ ID NO: 656094 - DNA, 20 bp, Artificial
  CRISPR gRNA sequence
taaaaaaaatcataagatta

SEQ ID NO: 656095 - DNA, 20 bp, Artificial
  CRISPR gRNA sequence
aaaaaaaatcataagattaa

SEQ ID NO: 656096 - DNA, 20 bp, Artificial
  CRISPR gRNA sequence
aaaaaaatcataagattaat

SEQ ID NO: 656097 - DNA, 20 bp, Artificial
  CRISPR gRNA sequence
atgtatgccatatactccag

SEQ ID NO: 656098 - DNA, 20 bp, Artificial
  CRISPR gRNA sequence
cagtgcctctattctaatga

SEQ ID NO: 656099 - DNA, 20 bp, Artificial
  CRISPR gRNA sequence
tattctaatgatctgtcttt

SEQ ID NO: 656100 - DNA, 20 bp, Artificial
  CRISPR gRNA sequence
ttctaatgatctgtctttat

SEQ ID NO: 656101 - DNA, 20 bp, Artificial
  CRISPR gRNA sequence
taatgatctgtctttattct

SEQ ID NO: 656102 - DNA, 20 bp, Artificial
  CRISPR gRNA sequence
atgatctgtctttattctgt

SEQ ID NO: 656103 - DNA, 20 bp, Artificial
  CRISPR gRNA sequence
tctttattctgtaacctgtt

SEQ ID NO: 656104 - DNA, 20 bp, Artificial
  CRISPR gRNA sequence
tattctgtaacctgtttcct

SEQ ID NO: 656105 - DNA, 20 bp, Artificial
  CRISPR gRNA sequence
attctgtaacctgtttcctt

SEQ ID NO: 656106 - DNA, 20 bp, Artificial
  CRISPR gRNA sequence
ttctgtaacctgtttcctta

SEQ ID NO: 656107 - DNA, 20 bp, Artificial
  CRISPR gRNA sequence
tgtaacctgtttccttataa

SEQ ID NO: 656108 - DNA, 20 bp, Artificial
  CRISPR gRNA sequence
taacctgtttccttataaat

SEQ ID NO: 656109 - DNA, 20 bp, Artificial
  CRISPR gRNA sequence
tttccttataaataaatatg

SEQ ID NO: 656110 - DNA, 20 bp, Artificial
  CRISPR gRNA sequence
ccttataaataaatatgcta

SEQ ID NO: 656111 - DNA, 20 bp, Artificial
  CRISPR gRNA sequence
cttataaataaatatgctat

SEQ ID NO: 656112 - DNA, 20 bp, Artificial
  CRISPR gRNA sequence
ataaataaatatgctattga

SEQ ID NO: 656113 - DNA, 20 bp, Artificial
  CRISPR gRNA sequence
taaataaatatgctattgaa

SEQ ID NO: 656114 - DNA, 20 bp, Artificial
  CRISPR gRNA sequence
ttgaaaatattacatactta

SEQ ID NO: 656115 - DNA, 20 bp, Artificial
  CRISPR gRNA sequence
aaaatattacatacttatta

SEQ ID NO: 656116 - DNA, 20 bp, Artificial
  CRISPR gRNA sequence
catacttattacaggttgtt

SEQ ID NO: 656117 - DNA, 20 bp, Artificial
  CRISPR gRNA sequence
attacaggttgttagctaaa

SEQ ID NO: 656118 - DNA, 20 bp, Artificial
  CRISPR gRNA sequence
ttacaggttgttagctaaac

SEQ ID NO: 656119 - DNA, 20 bp, Artificial
  CRISPR gRNA sequence
caggttgttagctaaacatt

SEQ ID NO: 656120 - DNA, 20 bp, Artificial
  CRISPR gRNA sequence
ttagctaaacattggccagt

SEQ ID NO: 656121 - DNA, 20 bp, Artificial
  CRISPR gRNA sequence
gctaaacattggccagttct

SEQ ID NO: 656122 - DNA, 20 bp, Artificial
  CRISPR gRNA sequence
aacattggccagttctgcca

SEQ ID NO: 656123 - DNA, 20 bp, Artificial
  CRISPR gRNA sequence
gccagttctgccacattaat

SEQ ID NO: 656124 - DNA, 20 bp, Artificial
  CRISPR gRNA sequence
tgccacattaatagctaagg

SEQ ID NO: 656125 - DNA, 20 bp, Artificial
  CRISPR gRNA sequence
ccacattaatagctaaggaa

SEQ ID NO: 656126 - DNA, 20 bp, Artificial
  CRISPR gRNA sequence
atagctaaggaatttaatac

SEQ ID NO: 656127 - DNA, 20 bp, Artificial
  CRISPR gRNA sequence
aggaatttaatactcctcac

SEQ ID NO: 656128 - DNA, 20 bp, Artificial
  CRISPR gRNA sequence
aatactcctcaccagagcct

SEQ ID NO: 656129 - DNA, 20 bp, Artificial
  CRISPR gRNA sequence
atactcctcaccagagcctt

SEQ ID NO: 656130 - DNA, 20 bp, Artificial
  CRISPR gRNA sequence
ctcaccagagcctttttgaa

SEQ ID NO: 656131 - DNA, 20 bp, Artificial
  CRISPR gRNA sequence
accagagcctttttgaagac

SEQ ID NO: 656132 - DNA, 20 bp, Artificial
  CRISPR gRNA sequence
tttgaagactttgagataaa

SEQ ID NO: 656133 - DNA, 20 bp, Artificial
  CRISPR gRNA sequence
ttgaagactttgagataaat

SEQ ID NO: 656134 - DNA, 20 bp, Artificial
  CRISPR gRNA sequence
tgaagactttgagataaata

SEQ ID NO: 656135 - DNA, 20 bp, Artificial
  CRISPR gRNA sequence
gaagactttgagataaatat

SEQ ID NO: 656136 - DNA, 20 bp, Artificial
  CRISPR gRNA sequence
aagactttgagataaatatg

SEQ ID NO: 656137 - DNA, 20 bp, Artificial
  CRISPR gRNA sequence
tgagataaatatgcagatac

SEQ ID NO: 656138 - DNA, 20 bp, Artificial
  CRISPR gRNA sequence
gagataaatatgcagataca

SEQ ID NO: 656139 - DNA, 20 bp, Artificial
  CRISPR gRNA sequence
agataaatatgcagatacaa

SEQ ID NO: 656140 - DNA, 20 bp, Artificial
  CRISPR gRNA sequence
ttttaaaatgattttgtata

SEQ ID NO: 656141 - DNA, 20 bp, Artificial
  CRISPR gRNA sequence
taaaatgattttgtatagaa

SEQ ID NO: 656142 - DNA, 20 bp, Artificial
  CRISPR gRNA sequence
aaaatgattttgtatagaat

SEQ ID NO: 656143 - DNA, 20 bp, Artificial
  CRISPR gRNA sequence
aaatgattttgtatagaatt

SEQ ID NO: 656144 - DNA, 20 bp, Artificial
  CRISPR gRNA sequence
tgtatagaattaatatttta

SEQ ID NO: 656145 - DNA, 20 bp, Artificial
  CRISPR gRNA sequence
gtatagaattaatattttaa

SEQ ID NO: 656146 - DNA, 20 bp, Artificial
  CRISPR gRNA sequence
tatagaattaatattttaaa

SEQ ID NO: 656147 - DNA, 20 bp, Artificial
  CRISPR gRNA sequence
atattttaaaaatataatat

SEQ ID NO: 656148 - DNA, 20 bp, Artificial
  CRISPR gRNA sequence
taaaaatataatatcatacc

SEQ ID NO: 656149 - DNA, 20 bp, Artificial
  CRISPR gRNA sequence
aaaaatataatatcataccc

SEQ ID NO: 656150 - DNA, 20 bp, Artificial
  CRISPR gRNA sequence
aaaatataatatcatacccc

SEQ ID NO: 656151 - DNA, 20 bp, Artificial
  CRISPR gRNA sequence
gggatgaggttacctagatg

SEQ ID NO: 656152 - DNA, 20 bp, Artificial
  CRISPR gRNA sequence
ggatgaggttacctagatgg

SEQ ID NO: 656153 - DNA, 20 bp, Artificial
  CRISPR gRNA sequence
cctagatgggacagtatagc

SEQ ID NO: 656154 - DNA, 20 bp, Artificial
  CRISPR gRNA sequence
gatgggacagtatagcatag

SEQ ID NO: 656155 - DNA, 20 bp, Artificial
  CRISPR gRNA sequence
aatcagcataattattctga

SEQ ID NO: 656156 - DNA, 20 bp, Artificial
  CRISPR gRNA sequence
atcagcataattattctgaa

SEQ ID NO: 656157 - DNA, 20 bp, Artificial
  CRISPR gRNA sequence
ttctgaaatatttattacag

SEQ ID NO: 656158 - DNA, 20 bp, Artificial
  CRISPR gRNA sequence
tgaaatatttattacagaat

SEQ ID NO: 656159 - DNA, 20 bp, Artificial
  CRISPR gRNA sequence
aaatatttattacagaattc

SEQ ID NO: 656160 - DNA, 20 bp, Artificial
  CRISPR gRNA sequence
attacagaattccatcttaa

SEQ ID NO: 656161 - DNA, 20 bp, Artificial
  CRISPR gRNA sequence
ttacagaattccatcttaaa

SEQ ID NO: 656162 - DNA, 20 bp, Artificial
  CRISPR gRNA sequence
cagaattccatcttaaaaat

SEQ ID NO: 656163 - DNA, 20 bp, Artificial
  CRISPR gRNA sequence
catcttaaaaatgtaagcgc

SEQ ID NO: 656164 - DNA, 20 bp, Artificial
  CRISPR gRNA sequence
aaaaatgtaagcgctgacta

SEQ ID NO: 656165 - DNA, 20 bp, Artificial
  CRISPR gRNA sequence
aaaatgtaagcgctgactac

SEQ ID NO: 656166 - DNA, 20 bp, Artificial
  CRISPR gRNA sequence
actacccaagacaccataga

SEQ ID NO: 656167 - DNA, 20 bp, Artificial
  CRISPR gRNA sequence
cccaagacaccatagaattc

SEQ ID NO: 656168 - DNA, 20 bp, Artificial
  CRISPR gRNA sequence
caaatgaatgttaatgctag

SEQ ID NO: 656169 - DNA, 20 bp, Artificial
  CRISPR gRNA sequence
atgctagaaacacttcttct

SEQ ID NO: 656170 - DNA, 20 bp, Artificial
  CRISPR gRNA sequence
gaaacacttcttctgagatt

SEQ ID NO: 656171 - DNA, 20 bp, Artificial
  CRISPR gRNA sequence
cttctgagatttcctgtatg

SEQ ID NO: 656172 - DNA, 20 bp, Artificial
  CRISPR gRNA sequence
ttctgagatttcctgtatgt

SEQ ID NO: 656173 - DNA, 20 bp, Artificial
  CRISPR gRNA sequence
ctgagatttcctgtatgtgg

SEQ ID NO: 656174 - DNA, 20 bp, Artificial
  CRISPR gRNA sequence
tgagatttcctgtatgtgga

SEQ ID NO: 656175 - DNA, 20 bp, Artificial
  CRISPR gRNA sequence
agatttcctgtatgtggaga

SEQ ID NO: 656176 - DNA, 20 bp, Artificial
  CRISPR gRNA sequence
cctgtatgtggagattcaga

SEQ ID NO: 656177 - DNA, 20 bp, Artificial
  CRISPR gRNA sequence
ctgtatgtggagattcagaa

SEQ ID NO: 656178 - DNA, 20 bp, Artificial
  CRISPR gRNA sequence
tatgtggagattcagaactc

SEQ ID NO: 656179 - DNA, 20 bp, Artificial
  CRISPR gRNA sequence
agaactccttagagagatat

SEQ ID NO: 656180 - DNA, 20 bp, Artificial
  CRISPR gRNA sequence
cttagagagatatttttcat

SEQ ID NO: 656181 - DNA, 20 bp, Artificial
  CRISPR gRNA sequence
agagagatatttttcatctt

SEQ ID NO: 656182 - DNA, 20 bp, Artificial
  CRISPR gRNA sequence
gagagatatttttcatcttt

SEQ ID NO: 656183 - DNA, 20 bp, Artificial
  CRISPR gRNA sequence
ttcatctttcgatcattgat

SEQ ID NO: 656184 - DNA, 20 bp, Artificial
  CRISPR gRNA sequence
tcatctttcgatcattgatc

SEQ ID NO: 656185 - DNA, 20 bp, Artificial
  CRISPR gRNA sequence
catctttcgatcattgatcc

SEQ ID NO: 656186 - DNA, 20 bp, Artificial
  CRISPR gRNA sequence
atctttcgatcattgatcca

SEQ ID NO: 656187 - DNA, 20 bp, Artificial
  CRISPR gRNA sequence
tcgatcattgatccagcaaa

SEQ ID NO: 656188 - DNA, 20 bp, Artificial
  CRISPR gRNA sequence
cgatcattgatccagcaaac

SEQ ID NO: 656189 - DNA, 20 bp, Artificial
  CRISPR gRNA sequence
gatcattgatccagcaaaca

SEQ ID NO: 656190 - DNA, 20 bp, Artificial
  CRISPR gRNA sequence
atccagcaaacatttattaa

SEQ ID NO: 656191 - DNA, 20 bp, Artificial
  CRISPR gRNA sequence
attaagcacttactgtgtat

SEQ ID NO: 656192 - DNA, 20 bp, Artificial
  CRISPR gRNA sequence
ttaagcacttactgtgtatg

SEQ ID NO: 656193 - DNA, 20 bp, Artificial
  CRISPR gRNA sequence
agcacttactgtgtatgatg

SEQ ID NO: 656194 - DNA, 20 bp, Artificial
  CRISPR gRNA sequence
actgtgtatgatgcattgct

SEQ ID NO: 656195 - DNA, 20 bp, Artificial
  CRISPR gRNA sequence
ctgtgtatgatgcattgctg

SEQ ID NO: 656196 - DNA, 20 bp, Artificial
  CRISPR gRNA sequence
tgtatgatgcattgctggtg

SEQ ID NO: 656197 - DNA, 20 bp, Artificial
  CRISPR gRNA sequence
ctggtgctggggctcaaaaa

SEQ ID NO: 656198 - DNA, 20 bp, Artificial
  CRISPR gRNA sequence
gtgctggggctcaaaaaata

SEQ ID NO: 656199 - DNA, 20 bp, Artificial
  CRISPR gRNA sequence
gggctcaaaaaataggtttg

SEQ ID NO: 656200 - DNA, 20 bp, Artificial
  CRISPR gRNA sequence
aaaaaataggtttggggtgt

SEQ ID NO: 656201 - DNA, 20 bp, Artificial
  CRISPR gRNA sequence
ggggtgttttctagagaagg

SEQ ID NO: 656202 - DNA, 20 bp, Artificial
  CRISPR gRNA sequence
gggtgttttctagagaagga

SEQ ID NO: 656203 - DNA, 20 bp, Artificial
  CRISPR gRNA sequence
tctagagaaggatggtatct

SEQ ID NO: 656204 - DNA, 20 bp, Artificial
  CRISPR gRNA sequence
ctagagaaggatggtatctt

SEQ ID NO: 656205 - DNA, 20 bp, Artificial
  CRISPR gRNA sequence
tagagaaggatggtatcttc

SEQ ID NO: 656206 - DNA, 20 bp, Artificial
  CRISPR gRNA sequence
gagaaggatggtatcttcaa

SEQ ID NO: 656207 - DNA, 20 bp, Artificial
  CRISPR gRNA sequence
caagggtccaaatgaattga

SEQ ID NO: 656208 - DNA, 20 bp, Artificial
  CRISPR gRNA sequence
aagggtccaaatgaattgat

SEQ ID NO: 656209 - DNA, 20 bp, Artificial
  CRISPR gRNA sequence
atattttgtgtgagatcgta

SEQ ID NO: 656210 - DNA, 20 bp, Artificial
  CRISPR gRNA sequence
tgtgtgagatcgtaatactg

SEQ ID NO: 656211 - DNA, 20 bp, Artificial
  CRISPR gRNA sequence
gtgtgagatcgtaatactgc

SEQ ID NO: 656212 - DNA, 20 bp, Artificial
  CRISPR gRNA sequence
tgtgagatcgtaatactgct

SEQ ID NO: 656213 - DNA, 20 bp, Artificial
  CRISPR gRNA sequence
cttattgcatttagaagtaa

SEQ ID NO: 656214 - DNA, 20 bp, Artificial
  CRISPR gRNA sequence
attgcatttagaagtaaatg

SEQ ID NO: 656215 - DNA, 20 bp, Artificial
  CRISPR gRNA sequence
ttgcatttagaagtaaatga

SEQ ID NO: 656216 - DNA, 20 bp, Artificial
  CRISPR gRNA sequence
catttagaagtaaatgagtg

SEQ ID NO: 656217 - DNA, 20 bp, Artificial
  CRISPR gRNA sequence
agaagtaaatgagtgtgatg

SEQ ID NO: 656218 - DNA, 20 bp, Artificial
  CRISPR gRNA sequence
gaagtaaatgagtgtgatgt

SEQ ID NO: 656219 - DNA, 20 bp, Artificial
  CRISPR gRNA sequence
actgtgacttacatccatta

SEQ ID NO: 656220 - DNA, 20 bp, Artificial
  CRISPR gRNA sequence
tgacttacatccattataga

SEQ ID NO: 656221 - DNA, 20 bp, Artificial
  CRISPR gRNA sequence
acatccattatagattaatg

SEQ ID NO: 656222 - DNA, 20 bp, Artificial
  CRISPR gRNA sequence
catccattatagattaatga

SEQ ID NO: 656223 - DNA, 20 bp, Artificial
  CRISPR gRNA sequence
tagattaatgagctgcttct

SEQ ID NO: 656224 - DNA, 20 bp, Artificial
  CRISPR gRNA sequence
atgagctgcttctcaccttt

SEQ ID NO: 656225 - DNA, 20 bp, Artificial
  CRISPR gRNA sequence
cttctcaccttttacctcca

SEQ ID NO: 656226 - DNA, 20 bp, Artificial
  CRISPR gRNA sequence
ctcaccttttacctccaaga

SEQ ID NO: 656227 - DNA, 20 bp, Artificial
  CRISPR gRNA sequence
tcaccttttacctccaagag

SEQ ID NO: 656228 - DNA, 20 bp, Artificial
  CRISPR gRNA sequence
accttttacctccaagagtt

SEQ ID NO: 656229 - DNA, 20 bp, Artificial
  CRISPR gRNA sequence
ttacctccaagagtttttca

SEQ ID NO: 656230 - DNA, 20 bp, Artificial
  CRISPR gRNA sequence
tacctccaagagtttttcaa

SEQ ID NO: 656231 - DNA, 20 bp, Artificial
  CRISPR gRNA sequence
acctccaagagtttttcaaa

SEQ ID NO: 656232 - DNA, 20 bp, Artificial
  CRISPR gRNA sequence
cctccaagagtttttcaaat

SEQ ID NO: 656233 - DNA, 20 bp, Artificial
  CRISPR gRNA sequence
caagagtttttcaaatgtgt

SEQ ID NO: 656234 - DNA, 20 bp, Artificial
  CRISPR gRNA sequence
ttcaaatgtgtgtaaatttg

SEQ ID NO: 656235 - DNA, 20 bp, Artificial
  CRISPR gRNA sequence
tcaaatgtgtgtaaatttga

SEQ ID NO: 656236 - DNA, 20 bp, Artificial
  CRISPR gRNA sequence
caaatgtgtgtaaatttgag

SEQ ID NO: 656237 - DNA, 20 bp, Artificial
  CRISPR gRNA sequence
aaatgtgtgtaaatttgagg

SEQ ID NO: 656238 - DNA, 20 bp, Artificial
  CRISPR gRNA sequence
gaggatgtacagtgaaacag

SEQ ID NO: 656239 - DNA, 20 bp, Artificial
  CRISPR gRNA sequence
aggatgtacagtgaaacaga

SEQ ID NO: 656240 - DNA, 20 bp, Artificial
  CRISPR gRNA sequence
agataggttctcagaggata

SEQ ID NO: 656241 - DNA, 20 bp, Artificial
  CRISPR gRNA sequence
gataggttctcagaggataa

SEQ ID NO: 656242 - DNA, 20 bp, Artificial
  CRISPR gRNA sequence
tcagaggataacatttcccc

SEQ ID NO: 656243 - DNA, 20 bp, Artificial
  CRISPR gRNA sequence
agaggataacatttccccac

SEQ ID NO: 656244 - DNA, 20 bp, Artificial
  CRISPR gRNA sequence
ccccacaaaattatttataa

SEQ ID NO: 656245 - DNA, 20 bp, Artificial
  CRISPR gRNA sequence
cccacaaaattatttataat

SEQ ID NO: 656246 - DNA, 20 bp, Artificial
  CRISPR gRNA sequence
tttataatgcaggatttggc

SEQ ID NO: 656247 - DNA, 20 bp, Artificial
  CRISPR gRNA sequence
ataatgcaggatttggcact

SEQ ID NO: 656248 - DNA, 20 bp, Artificial
  CRISPR gRNA sequence
taatgcaggatttggcactc

SEQ ID NO: 656249 - DNA, 20 bp, Artificial
  CRISPR gRNA sequence
ggcactcatccttgcaagtt

SEQ ID NO: 656250 - DNA, 20 bp, Artificial
  CRISPR gRNA sequence
gcactcatccttgcaagttc

SEQ ID NO: 656251 - DNA, 20 bp, Artificial
  CRISPR gRNA sequence
atccttgcaagttctgaaac

SEQ ID NO: 656252 - DNA, 20 bp, Artificial
  CRISPR gRNA sequence
gcaagttctgaaactagatt

SEQ ID NO: 656253 - DNA, 20 bp, Artificial
  CRISPR gRNA sequence
caagttctgaaactagattt

SEQ ID NO: 656254 - DNA, 20 bp, Artificial
  CRISPR gRNA sequence
tgaaactagatttgtggcac

SEQ ID NO: 656255 - DNA, 20 bp, Artificial
  CRISPR gRNA sequence
aaactagatttgtggcacac

SEQ ID NO: 656256 - DNA, 20 bp, Artificial
  CRISPR gRNA sequence
gatttgtggcacacttagag

SEQ ID NO: 656257 - DNA, 20 bp, Artificial
  CRISPR gRNA sequence
gtggcacacttagagtggat

SEQ ID NO: 656258 - DNA, 20 bp, Artificial
  CRISPR gRNA sequence
tggcacacttagagtggatc

SEQ ID NO: 656259 - DNA, 20 bp, Artificial
  CRISPR gRNA sequence
agagtggatctgtatctcaa

SEQ ID NO: 656260 - DNA, 20 bp, Artificial
  CRISPR gRNA sequence
gagtggatctgtatctcaag

SEQ ID NO: 656261 - DNA, 20 bp, Artificial
  CRISPR gRNA sequence
tatctcaaggttgactgaca

SEQ ID NO: 656262 - DNA, 20 bp, Artificial
  CRISPR gRNA sequence
aaggttgactgacattaaac

SEQ ID NO: 656263 - DNA, 20 bp, Artificial
  CRISPR gRNA sequence
actgacattaaacaggttta

SEQ ID NO: 656264 - DNA, 20 bp, Artificial
  CRISPR gRNA sequence
acattaaacaggtttacaaa

SEQ ID NO: 656265 - DNA, 20 bp, Artificial
  CRISPR gRNA sequence
aacaggtttacaaaactgat

SEQ ID NO: 656266 - DNA, 20 bp, Artificial
  CRISPR gRNA sequence
acaaaactgatatttaaaat

SEQ ID NO: 656267 - DNA, 20 bp, Artificial
  CRISPR gRNA sequence
caaaactgatatttaaaatc

SEQ ID NO: 656268 - DNA, 20 bp, Artificial
  CRISPR gRNA sequence
atatttaaaatcagaatgcc

SEQ ID NO: 656269 - DNA, 20 bp, Artificial
  CRISPR gRNA sequence
aaaatcagaatgccaattta

SEQ ID NO: 656270 - DNA, 20 bp, Artificial
  CRISPR gRNA sequence
aaatcagaatgccaatttat

SEQ ID NO: 656271 - DNA, 20 bp, Artificial
  CRISPR gRNA sequence
atgtttagatattgattaaa

SEQ ID NO: 656272 - DNA, 20 bp, Artificial
  CRISPR gRNA sequence
tgtttagatattgattaaaa

SEQ ID NO: 656273 - DNA, 20 bp, Artificial
  CRISPR gRNA sequence
agatattgattaaaaataaa

SEQ ID NO: 656274 - DNA, 20 bp, Artificial
  CRISPR gRNA sequence
gatattgattaaaaataaag

SEQ ID NO: 656275 - DNA, 20 bp, Artificial
  CRISPR gRNA sequence
attaaaaataaagcacacac

SEQ ID NO: 656276 - DNA, 20 bp, Artificial
  CRISPR gRNA sequence
aaaataaagcacacacacac

SEQ ID NO: 656277 - DNA, 20 bp, Artificial
  CRISPR gRNA sequence
gatcactccagttggcttga

SEQ ID NO: 656278 - DNA, 20 bp, Artificial
  CRISPR gRNA sequence
cagttggcttgactagatca

SEQ ID NO: 656279 - DNA, 20 bp, Artificial
  CRISPR gRNA sequence
gcttgactagatcattttgt

SEQ ID NO: 656280 - DNA, 20 bp, Artificial
  CRISPR gRNA sequence
gactagatcattttgttctt

SEQ ID NO: 656281 - DNA, 20 bp, Artificial
  CRISPR gRNA sequence
actagatcattttgttcttg

SEQ ID NO: 656282 - DNA, 20 bp, Artificial
  CRISPR gRNA sequence
gatcattttgttcttgtgaa

SEQ ID NO: 656283 - DNA, 20 bp, Artificial
  CRISPR gRNA sequence
tgttcttgtgaactgaccta

SEQ ID NO: 656284 - DNA, 20 bp, Artificial
  CRISPR gRNA sequence
gttcttgtgaactgacctat

SEQ ID NO: 656285 - DNA, 20 bp, Artificial
  CRISPR gRNA sequence
ttcttgtgaactgacctata

SEQ ID NO: 656286 - DNA, 20 bp, Artificial
  CRISPR gRNA sequence
ttgtgaactgacctatatgg

SEQ ID NO: 656287 - DNA, 20 bp, Artificial
  CRISPR gRNA sequence
gtgaactgacctatatgggt

SEQ ID NO: 656288 - DNA, 20 bp, Artificial
  CRISPR gRNA sequence
tgaactgacctatatgggta

SEQ ID NO: 656289 - DNA, 20 bp, Artificial
  CRISPR gRNA sequence
acctatatgggtaatcagta

SEQ ID NO: 656290 - DNA, 20 bp, Artificial
  CRISPR gRNA sequence
tatgggtaatcagtaaaggt

SEQ ID NO: 656291 - DNA, 20 bp, Artificial
  CRISPR gRNA sequence
actgagcaaggaatctgaat

SEQ ID NO: 656292 - DNA, 20 bp, Artificial
  CRISPR gRNA sequence
ctgagcaaggaatctgaata

SEQ ID NO: 656293 - DNA, 20 bp, Artificial
  CRISPR gRNA sequence
agcaaggaatctgaataaag

SEQ ID NO: 656294 - DNA, 20 bp, Artificial
  CRISPR gRNA sequence
aataaagggagttagttata

SEQ ID NO: 656295 - DNA, 20 bp, Artificial
  CRISPR gRNA sequence
gttatataattcaaatgttt

SEQ ID NO: 656296 - DNA, 20 bp, Artificial
  CRISPR gRNA sequence
tataattcaaatgtttaatg

SEQ ID NO: 656297 - DNA, 20 bp, Artificial
  CRISPR gRNA sequence
aaatgtttaatggcattaga

SEQ ID NO: 656298 - DNA, 20 bp, Artificial
  CRISPR gRNA sequence
aatggcattagactaagaga

SEQ ID NO: 656299 - DNA, 20 bp, Artificial
  CRISPR gRNA sequence
atggcattagactaagagaa

SEQ ID NO: 656300 - DNA, 20 bp, Artificial
  CRISPR gRNA sequence
gactaagagaacctaatata

SEQ ID NO: 656301 - DNA, 20 bp, Artificial
  CRISPR gRNA sequence
agagaacctaatatattcag

SEQ ID NO: 656302 - DNA, 20 bp, Artificial
  CRISPR gRNA sequence
atatattcagcatcacaata

SEQ ID NO: 656303 - DNA, 20 bp, Artificial
  CRISPR gRNA sequence
agcatcacaatagagatagc

SEQ ID NO: 656304 - DNA, 20 bp, Artificial
  CRISPR gRNA sequence
ctatttggataattatggtt

SEQ ID NO: 656305 - DNA, 20 bp, Artificial
  CRISPR gRNA sequence
tttggataattatggttgaa

SEQ ID NO: 656306 - DNA, 20 bp, Artificial
  CRISPR gRNA sequence
ggataattatggttgaagtc

SEQ ID NO: 656307 - DNA, 20 bp, Artificial
  CRISPR gRNA sequence
gataattatggttgaagtcc

SEQ ID NO: 656308 - DNA, 20 bp, Artificial
  CRISPR gRNA sequence
tggttgaagtcctttgtcca

SEQ ID NO: 656309 - DNA, 20 bp, Artificial
  CRISPR gRNA sequence
aagtcctttgtccagttccc

SEQ ID NO: 656310 - DNA, 20 bp, Artificial
  CRISPR gRNA sequence
tgtccagttccctctccttt

SEQ ID NO: 656311 - DNA, 20 bp, Artificial
  CRISPR gRNA sequence
gtccagttccctctcctttt

SEQ ID NO: 656312 - DNA, 20 bp, Artificial
  CRISPR gRNA sequence
tccagttccctctcctttta

SEQ ID NO: 656313 - DNA, 20 bp, Artificial
  CRISPR gRNA sequence
cctctccttttaatggacat

SEQ ID NO: 656314 - DNA, 20 bp, Artificial
  CRISPR gRNA sequence
tccttttaatggacatggat

SEQ ID NO: 656315 - DNA, 20 bp, Artificial
  CRISPR gRNA sequence
cttttaatggacatggattt

SEQ ID NO: 656316 - DNA, 20 bp, Artificial
  CRISPR gRNA sequence
ttaatggacatggatttaga

SEQ ID NO: 656317 - DNA, 20 bp, Artificial
  CRISPR gRNA sequence
taatggacatggatttagat

SEQ ID NO: 656318 - DNA, 20 bp, Artificial
  CRISPR gRNA sequence
aatggacatggatttagatt

SEQ ID NO: 656319 - DNA, 20 bp, Artificial
  CRISPR gRNA sequence
atggacatggatttagattc

SEQ ID NO: 656320 - DNA, 20 bp, Artificial
  CRISPR gRNA sequence
agattccctagttcaaccaa

SEQ ID NO: 656321 - DNA, 20 bp, Artificial
  CRISPR gRNA sequence
gattccctagttcaaccaaa

SEQ ID NO: 656322 - DNA, 20 bp, Artificial
  CRISPR gRNA sequence
cctagttcaaccaaaatact

SEQ ID NO: 656323 - DNA, 20 bp, Artificial
  CRISPR gRNA sequence
gttcaaccaaaatacttctg

SEQ ID NO: 656324 - DNA, 20 bp, Artificial
  CRISPR gRNA sequence
aaccaaaatacttctgagat

SEQ ID NO: 656325 - DNA, 20 bp, Artificial
  CRISPR gRNA sequence
ctgagattcatttttttttc

SEQ ID NO: 656326 - DNA, 20 bp, Artificial
  CRISPR gRNA sequence
tgagattcatttttttttcc

SEQ ID NO: 656327 - DNA, 20 bp, Artificial
  CRISPR gRNA sequence
agattcatttttttttcccc

SEQ ID NO: 656328 - DNA, 20 bp, Artificial
  CRISPR gRNA sequence
atttttttttccccttggct

SEQ ID NO: 656329 - DNA, 20 bp, Artificial
  CRISPR gRNA sequence
ttttttccccttggcttcct

SEQ ID NO: 656330 - DNA, 20 bp, Artificial
  CRISPR gRNA sequence
tttttccccttggcttccta

SEQ ID NO: 656331 - DNA, 20 bp, Artificial
  CRISPR gRNA sequence
ttttccccttggcttcctag

SEQ ID NO: 656332 - DNA, 20 bp, Artificial
  CRISPR gRNA sequence
tttccccttggcttcctagg

SEQ ID NO: 656333 - DNA, 20 bp, Artificial
  CRISPR gRNA sequence
ttccccttggcttcctaggc

SEQ ID NO: 656334 - DNA, 20 bp, Artificial
  CRISPR gRNA sequence
tccccttggcttcctaggct

SEQ ID NO: 656335 - DNA, 20 bp, Artificial
  CRISPR gRNA sequence
ccccttggcttcctaggcta

SEQ ID NO: 656336 - DNA, 20 bp, Artificial
  CRISPR gRNA sequence
cccttggcttcctaggctaa

SEQ ID NO: 656337 - DNA, 20 bp, Artificial
  CRISPR gRNA sequence
ggcttcctaggctaaatccc

SEQ ID NO: 656338 - DNA, 20 bp, Artificial
  CRISPR gRNA sequence
gcttcctaggctaaatcccc

SEQ ID NO: 656339 - DNA, 20 bp, Artificial
  CRISPR gRNA sequence
cctaggctaaatcccccaga

SEQ ID NO: 656340 - DNA, 20 bp, Artificial
  CRISPR gRNA sequence
ctaggctaaatcccccagat

SEQ ID NO: 656341 - DNA, 20 bp, Artificial
  CRISPR gRNA sequence
ggctaaatcccccagattca

SEQ ID NO: 656342 - DNA, 20 bp, Artificial
  CRISPR gRNA sequence
aatcccccagattcagtctg

SEQ ID NO: 656343 - DNA, 20 bp, Artificial
  CRISPR gRNA sequence
agtctgtaacctatattaat

SEQ ID NO: 656344 - DNA, 20 bp, Artificial
  CRISPR gRNA sequence
taacctatattaatacatac

SEQ ID NO: 656345 - DNA, 20 bp, Artificial
  CRISPR gRNA sequence
tattaatacatacaatcagg

SEQ ID NO: 656346 - DNA, 20 bp, Artificial
  CRISPR gRNA sequence
atacatacaatcaggttacg

SEQ ID NO: 656347 - DNA, 20 bp, Artificial
  CRISPR gRNA sequence
cgacgagttctttctggcct

SEQ ID NO: 656348 - DNA, 20 bp, Artificial
  CRISPR gRNA sequence
tttctggcctgagatccatt

SEQ ID NO: 656349 - DNA, 20 bp, Artificial
  CRISPR gRNA sequence
tctggcctgagatccattca

SEQ ID NO: 656350 - DNA, 20 bp, Artificial
  CRISPR gRNA sequence
ctggcctgagatccattcat

SEQ ID NO: 656351 - DNA, 20 bp, Artificial
  CRISPR gRNA sequence
tggcctgagatccattcatt

SEQ ID NO: 656352 - DNA, 20 bp, Artificial
  CRISPR gRNA sequence
gcctgagatccattcatttt

SEQ ID NO: 656353 - DNA, 20 bp, Artificial
  CRISPR gRNA sequence
agatccattcattttcttta

SEQ ID NO: 656354 - DNA, 20 bp, Artificial
  CRISPR gRNA sequence
attttctttagtgtgattta

SEQ ID NO: 656355 - DNA, 20 bp, Artificial
  CRISPR gRNA sequence
tctttagtgtgatttatatt

SEQ ID NO: 656356 - DNA, 20 bp, Artificial
  CRISPR gRNA sequence
ctttagtgtgatttatattt

SEQ ID NO: 656357 - DNA, 20 bp, Artificial
  CRISPR gRNA sequence
tttagtgtgatttatatttc

SEQ ID NO: 656358 - DNA, 20 bp, Artificial
  CRISPR gRNA sequence
tagtgtgatttatatttctg

SEQ ID NO: 656359 - DNA, 20 bp, Artificial
  CRISPR gRNA sequence
agtgtgatttatatttctgc

SEQ ID NO: 656360 - DNA, 20 bp, Artificial
  CRISPR gRNA sequence
gtgtgatttatatttctgct

SEQ ID NO: 656361 - DNA, 20 bp, Artificial
  CRISPR gRNA sequence
atatttctgctttaatttgt

SEQ ID NO: 656362 - DNA, 20 bp, Artificial
  CRISPR gRNA sequence
tatttctgctttaatttgta

SEQ ID NO: 656363 - DNA, 20 bp, Artificial
  CRISPR gRNA sequence
ctgctttaatttgtaaaatg

SEQ ID NO: 656364 - DNA, 20 bp, Artificial
  CRISPR gRNA sequence
tgctttaatttgtaaaatgt

SEQ ID NO: 656365 - DNA, 20 bp, Artificial
  CRISPR gRNA sequence
ctttaatttgtaaaatgttg

SEQ ID NO: 656366 - DNA, 20 bp, Artificial
  CRISPR gRNA sequence
taatttgtaaaatgttgatt

SEQ ID NO: 656367 - DNA, 20 bp, Artificial
  CRISPR gRNA sequence
aatttgtaaaatgttgattt

SEQ ID NO: 656368 - DNA, 20 bp, Artificial
  CRISPR gRNA sequence
atttgtaaaatgttgatttt

SEQ ID NO: 656369 - DNA, 20 bp, Artificial
  CRISPR gRNA sequence
gtaaaatgttgattttatag

SEQ ID NO: 656370 - DNA, 20 bp, Artificial
  CRISPR gRNA sequence
taaaatgttgattttatagc

SEQ ID NO: 656371 - DNA, 20 bp, Artificial
  CRISPR gRNA sequence
attttatagcctaactttat

SEQ ID NO: 656372 - DNA, 20 bp, Artificial
  CRISPR gRNA sequence
tatagcctaactttatgaag

SEQ ID NO: 656373 - DNA, 20 bp, Artificial
  CRISPR gRNA sequence
atagcctaactttatgaaga

SEQ ID NO: 656374 - DNA, 20 bp, Artificial
  CRISPR gRNA sequence
tagcctaactttatgaagac

SEQ ID NO: 656375 - DNA, 20 bp, Artificial
  CRISPR gRNA sequence
actttatgaagacaatctta

SEQ ID NO: 656376 - DNA, 20 bp, Artificial
  CRISPR gRNA sequence
tatgaagacaatcttatagt

SEQ ID NO: 656377 - DNA, 20 bp, Artificial
  CRISPR gRNA sequence
atgaagacaatcttatagtg

SEQ ID NO: 656378 - DNA, 20 bp, Artificial
  CRISPR gRNA sequence
tgaagacaatcttatagtgc

SEQ ID NO: 656379 - DNA, 20 bp, Artificial
  CRISPR gRNA sequence
atagtgcccataaaggatac

SEQ ID NO: 656380 - DNA, 20 bp, Artificial
  CRISPR gRNA sequence
tagtgcccataaaggatact

SEQ ID NO: 656381 - DNA, 20 bp, Artificial
  CRISPR gRNA sequence
ccttcaactactattgccat

SEQ ID NO: 656382 - DNA, 20 bp, Artificial
  CRISPR gRNA sequence
cttcaactactattgccata

SEQ ID NO: 656383 - DNA, 20 bp, Artificial
  CRISPR gRNA sequence
caactactattgccataaat

SEQ ID NO: 656384 - DNA, 20 bp, Artificial
  CRISPR gRNA sequence
aactactattgccataaatt

SEQ ID NO: 656385 - DNA, 20 bp, Artificial
  CRISPR gRNA sequence
ctattgccataaattcgaac

SEQ ID NO: 656386 - DNA, 20 bp, Artificial
  CRISPR gRNA sequence
ttgccataaattcgaacttc

SEQ ID NO: 656387 - DNA, 20 bp, Artificial
  CRISPR gRNA sequence
ccataaattcgaacttccat

SEQ ID NO: 656388 - DNA, 20 bp, Artificial
  CRISPR gRNA sequence
gaacttccattcacagaaat

SEQ ID NO: 656389 - DNA, 20 bp, Artificial
  CRISPR gRNA sequence
ccattcacagaaatctcgac

SEQ ID NO: 656390 - DNA, 20 bp, Artificial
  CRISPR gRNA sequence
cattcacagaaatctcgaca

SEQ ID NO: 656391 - DNA, 20 bp, Artificial
  CRISPR gRNA sequence
acagaaatctcgacagctga

SEQ ID NO: 656392 - DNA, 20 bp, Artificial
  CRISPR gRNA sequence
gacagctgatgtggtcagca

SEQ ID NO: 656393 - DNA, 20 bp, Artificial
  CRISPR gRNA sequence
atgtggtcagcagtttaaga

SEQ ID NO: 656394 - DNA, 20 bp, Artificial
  CRISPR gRNA sequence
aagagttcttaatatctatt

SEQ ID NO: 656395 - DNA, 20 bp, Artificial
  CRISPR gRNA sequence
agagttcttaatatctattt

SEQ ID NO: 656396 - DNA, 20 bp, Artificial
  CRISPR gRNA sequence
ttaatatctattttagatga

SEQ ID NO: 656397 - DNA, 20 bp, Artificial
  CRISPR gRNA sequence
aatatctattttagatgaag

SEQ ID NO: 656398 - DNA, 20 bp, Artificial
  CRISPR gRNA sequence
atatctattttagatgaaga

SEQ ID NO: 656399 - DNA, 20 bp, Artificial
  CRISPR gRNA sequence
ttttagatgaagatggaaaa

SEQ ID NO: 656400 - DNA, 20 bp, Artificial
  CRISPR gRNA sequence
tagatgaagatggaaaatag

SEQ ID NO: 656401 - DNA, 20 bp, Artificial
  CRISPR gRNA sequence
agatgaagatggaaaatagc

SEQ ID NO: 656402 - DNA, 20 bp, Artificial
  CRISPR gRNA sequence
gatgaagatggaaaatagca

SEQ ID NO: 656403 - DNA, 20 bp, Artificial
  CRISPR gRNA sequence
ccacctaggaaagatcctta

SEQ ID NO: 656404 - DNA, 20 bp, Artificial
  CRISPR gRNA sequence
ggaaagatccttaagttagc

SEQ ID NO: 656405 - DNA, 20 bp, Artificial
  CRISPR gRNA sequence
aagttagctggtgatataga

SEQ ID NO: 656406 - DNA, 20 bp, Artificial
  CRISPR gRNA sequence
agttagctggtgatatagag

SEQ ID NO: 656407 - DNA, 20 bp, Artificial
  CRISPR gRNA sequence
gctggtgatatagaggcact

SEQ ID NO: 656408 - DNA, 20 bp, Artificial
  CRISPR gRNA sequence
gtgatatagaggcacttcca

SEQ ID NO: 656409 - DNA, 20 bp, Artificial
  CRISPR gRNA sequence
ccagtttataggtcagaagg

SEQ ID NO: 656410 - DNA, 20 bp, Artificial
  CRISPR gRNA sequence
cagtttataggtcagaagga

SEQ ID NO: 656411 - DNA, 20 bp, Artificial
  CRISPR gRNA sequence
ataggtcagaaggaaaaaaa

SEQ ID NO: 656412 - DNA, 20 bp, Artificial
  CRISPR gRNA sequence
taggtcagaaggaaaaaaaa

SEQ ID NO: 656413 - DNA, 20 bp, Artificial
  CRISPR gRNA sequence
atgaaattattgaagtgatc

SEQ ID NO: 656414 - DNA, 20 bp, Artificial
  CRISPR gRNA sequence
ttgaagtgatctgaccgcat

SEQ ID NO: 656415 - DNA, 20 bp, Artificial
  CRISPR gRNA sequence
aagtgatctgaccgcatcaa

SEQ ID NO: 656416 - DNA, 20 bp, Artificial
  CRISPR gRNA sequence
accgcatcaaatgagatttt

SEQ ID NO: 656417 - DNA, 20 bp, Artificial
  CRISPR gRNA sequence
tatagcaaactgttgtattt

SEQ ID NO: 656418 - DNA, 20 bp, Artificial
  CRISPR gRNA sequence
atagcaaactgttgtatttc

SEQ ID NO: 656419 - DNA, 20 bp, Artificial
  CRISPR gRNA sequence
tagcaaactgttgtatttca

SEQ ID NO: 656420 - DNA, 20 bp, Artificial
  CRISPR gRNA sequence
ttgtatttcatgttagttag

SEQ ID NO: 656421 - DNA, 20 bp, Artificial
  CRISPR gRNA sequence
tatttcatgttagttagtag

SEQ ID NO: 656422 - DNA, 20 bp, Artificial
  CRISPR gRNA sequence
catgttagttagtaggaaag

SEQ ID NO: 656423 - DNA, 20 bp, Artificial
  CRISPR gRNA sequence
atgttagttagtaggaaagc

SEQ ID NO: 656424 - DNA, 20 bp, Artificial
  CRISPR gRNA sequence
gttagtaggaaagctgtctt

SEQ ID NO: 656425 - DNA, 20 bp, Artificial
  CRISPR gRNA sequence
gtaggaaagctgtcttaatt

SEQ ID NO: 656426 - DNA, 20 bp, Artificial
  CRISPR gRNA sequence
tcttaattactgagtgtgaa

SEQ ID NO: 656427 - DNA, 20 bp, Artificial
  CRISPR gRNA sequence
aattactgagtgtgaattaa

SEQ ID NO: 656428 - DNA, 20 bp, Artificial
  CRISPR gRNA sequence
attactgagtgtgaattaag

SEQ ID NO: 656429 - DNA, 20 bp, Artificial
  CRISPR gRNA sequence
ctgagtgtgaattaagtaac

SEQ ID NO: 656430 - DNA, 20 bp, Artificial
  CRISPR gRNA sequence
agtgtgaattaagtaacttt

SEQ ID NO: 656431 - DNA, 20 bp, Artificial
  CRISPR gRNA sequence
agtaacttttcaaagcatat

SEQ ID NO: 656432 - DNA, 20 bp, Artificial
  CRISPR gRNA sequence
ttcaaagcatatagatttat

SEQ ID NO: 656433 - DNA, 20 bp, Artificial
  CRISPR gRNA sequence
tcaaagcatatagatttatt

SEQ ID NO: 656434 - DNA, 20 bp, Artificial
  CRISPR gRNA sequence
caaagcatatagatttattt

SEQ ID NO: 656435 - DNA, 20 bp, Artificial
  CRISPR gRNA sequence
aaagcatatagatttatttg

SEQ ID NO: 656436 - DNA, 20 bp, Artificial
  CRISPR gRNA sequence
atttgtgggccacaccttga

SEQ ID NO: 656437 - DNA, 20 bp, Artificial
  CRISPR gRNA sequence
tttgtgggccacaccttgat

SEQ ID NO: 656438 - DNA, 20 bp, Artificial
  CRISPR gRNA sequence
gtgggccacaccttgattat

SEQ ID NO: 656439 - DNA, 20 bp, Artificial
  CRISPR gRNA sequence
tgggccacaccttgattata

SEQ ID NO: 656440 - DNA, 20 bp, Artificial
  CRISPR gRNA sequence
gattataaagaaattaatca

SEQ ID NO: 656441 - DNA, 20 bp, Artificial
  CRISPR gRNA sequence
attataaagaaattaatcag

SEQ ID NO: 656442 - DNA, 20 bp, Artificial
  CRISPR gRNA sequence
taaagaaattaatcaggttt

SEQ ID NO: 656443 - DNA, 20 bp, Artificial
  CRISPR gRNA sequence
atcaggttttccagatgtga

SEQ ID NO: 656444 - DNA, 20 bp, Artificial
  CRISPR gRNA sequence
tccagatgtgaatctttggg

SEQ ID NO: 656445 - DNA, 20 bp, Artificial
  CRISPR gRNA sequence
ccagatgtgaatctttgggg

SEQ ID NO: 656446 - DNA, 20 bp, Artificial
  CRISPR gRNA sequence
cagatgtgaatctttgggga

SEQ ID NO: 656447 - DNA, 20 bp, Artificial
  CRISPR gRNA sequence
tggggaaaatggtcatatct

SEQ ID NO: 656448 - DNA, 20 bp, Artificial
  CRISPR gRNA sequence
ggggaaaatggtcatatctc

SEQ ID NO: 656449 - DNA, 20 bp, Artificial
  CRISPR gRNA sequence
gggaaaatggtcatatctct

SEQ ID NO: 656450 - DNA, 20 bp, Artificial
  CRISPR gRNA sequence
ttcatccctagcatatgcat

SEQ ID NO: 656451 - DNA, 20 bp, Artificial
  CRISPR gRNA sequence
catccctagcatatgcattg

SEQ ID NO: 656452 - DNA, 20 bp, Artificial
  CRISPR gRNA sequence
atccctagcatatgcattgt

SEQ ID NO: 656453 - DNA, 20 bp, Artificial
  CRISPR gRNA sequence
gcatatgcattgtatgcatt

SEQ ID NO: 656454 - DNA, 20 bp, Artificial
  CRISPR gRNA sequence
tatgcattgtaggagccctg

SEQ ID NO: 656455 - DNA, 20 bp, Artificial
  CRISPR gRNA sequence
taggagccctgtaaatattt

SEQ ID NO: 656456 - DNA, 20 bp, Artificial
  CRISPR gRNA sequence
taaatatttgttgaatgaag

SEQ ID NO: 656457 - DNA, 20 bp, Artificial
  CRISPR gRNA sequence
gttgaatgaagaaaatactt

SEQ ID NO: 656458 - DNA, 20 bp, Artificial
  CRISPR gRNA sequence
ttgaatgaagaaaatactta

SEQ ID NO: 656459 - DNA, 20 bp, Artificial
  CRISPR gRNA sequence
aatgaagaaaatacttaaga

SEQ ID NO: 656460 - DNA, 20 bp, Artificial
  CRISPR gRNA sequence
aagattagcatattacatat

SEQ ID NO: 656461 - DNA, 20 bp, Artificial
  CRISPR gRNA sequence
agattagcatattacatatg

SEQ ID NO: 656462 - DNA, 20 bp, Artificial
  CRISPR gRNA sequence
gcatattacatatgtctgtt

SEQ ID NO: 656463 - DNA, 20 bp, Artificial
  CRISPR gRNA sequence
catatgtctgtttaaatagt

SEQ ID NO: 656464 - DNA, 20 bp, Artificial
  CRISPR gRNA sequence
tttaaatagtatgcttctga

SEQ ID NO: 656465 - DNA, 20 bp, Artificial
  CRISPR gRNA sequence
aaatagtatgcttctgatct

SEQ ID NO: 656466 - DNA, 20 bp, Artificial
  CRISPR gRNA sequence
aatagtatgcttctgatcta

SEQ ID NO: 656467 - DNA, 20 bp, Artificial
  CRISPR gRNA sequence
ctgatctacttgaaaaaatt

SEQ ID NO: 656468 - DNA, 20 bp, Artificial
  CRISPR gRNA sequence
tgatctacttgaaaaaattt

SEQ ID NO: 656469 - DNA, 20 bp, Artificial
  CRISPR gRNA sequence
atctacttgaaaaaatttgg

SEQ ID NO: 656470 - DNA, 20 bp, Artificial
  CRISPR gRNA sequence
cttgaaaaaatttggaaact

SEQ ID NO: 656471 - DNA, 20 bp, Artificial
  CRISPR gRNA sequence
gaaaaaatttggaaacttga

SEQ ID NO: 656472 - DNA, 20 bp, Artificial
  CRISPR gRNA sequence
aaaaaatttggaaacttgat

SEQ ID NO: 656473 - DNA, 20 bp, Artificial
  CRISPR gRNA sequence
ggaaacttgatttcttagtt

SEQ ID NO: 656474 - DNA, 20 bp, Artificial
  CRISPR gRNA sequence
gaaacttgatttcttagttg

SEQ ID NO: 656475 - DNA, 20 bp, Artificial
  CRISPR gRNA sequence
gatttcttagttgttgaaat

SEQ ID NO: 656476 - DNA, 20 bp, Artificial
  CRISPR gRNA sequence
atttcttagttgttgaaata

SEQ ID NO: 656477 - DNA, 20 bp, Artificial
  CRISPR gRNA sequence
cttagttgttgaaataatcc

SEQ ID NO: 656478 - DNA, 20 bp, Artificial
  CRISPR gRNA sequence
ttagttgttgaaataatcca

SEQ ID NO: 656479 - DNA, 20 bp, Artificial
  CRISPR gRNA sequence
agttgttgaaataatccaaa

SEQ ID NO: 656480 - DNA, 20 bp, Artificial
  CRISPR gRNA sequence
gttgttgaaataatccaaaa

SEQ ID NO: 656481 - DNA, 20 bp, Artificial
  CRISPR gRNA sequence
ttgaaataatccaaaaatcc

SEQ ID NO: 656482 - DNA, 20 bp, Artificial
  CRISPR gRNA sequence
aaataatccaaaaatcctaa

SEQ ID NO: 656483 - DNA, 20 bp, Artificial
  CRISPR gRNA sequence
atttacttgtgattttctct

SEQ ID NO: 656484 - DNA, 20 bp, Artificial
  CRISPR gRNA sequence
acttgtgattttctctgttt

SEQ ID NO: 656485 - DNA, 20 bp, Artificial
  CRISPR gRNA sequence
cttgtgattttctctgtttg

SEQ ID NO: 656486 - DNA, 20 bp, Artificial
  CRISPR gRNA sequence
gtgattttctctgtttgggg

SEQ ID NO: 656487 - DNA, 20 bp, Artificial
  CRISPR gRNA sequence
tgattttctctgtttgggga

SEQ ID NO: 656488 - DNA, 20 bp, Artificial
  CRISPR gRNA sequence
tctctgtttggggatgtgtt

SEQ ID NO: 656489 - DNA, 20 bp, Artificial
  CRISPR gRNA sequence
ctctgtttggggatgtgtta

SEQ ID NO: 656490 - DNA, 20 bp, Artificial
  CRISPR gRNA sequence
tctgtttggggatgtgttat

SEQ ID NO: 656491 - DNA, 20 bp, Artificial
  CRISPR gRNA sequence
tgtttggggatgtgttattt

SEQ ID NO: 656492 - DNA, 20 bp, Artificial
  CRISPR gRNA sequence
tttggggatgtgttattttt

SEQ ID NO: 656493 - DNA, 20 bp, Artificial
  CRISPR gRNA sequence
ggggatgtgttatttttata

SEQ ID NO: 656494 - DNA, 20 bp, Artificial
  CRISPR gRNA sequence
gggatgtgttatttttataa

SEQ ID NO: 656495 - DNA, 20 bp, Artificial
  CRISPR gRNA sequence
tttttataatgtctcactct

SEQ ID NO: 656496 - DNA, 20 bp, Artificial
  CRISPR gRNA sequence
ttataatgtctcactctgaa

SEQ ID NO: 656497 - DNA, 20 bp, Artificial
  CRISPR gRNA sequence
tataatgtctcactctgaaa

SEQ ID NO: 656498 - DNA, 20 bp, Artificial
  CRISPR gRNA sequence
ataatgtctcactctgaaaa

SEQ ID NO: 656499 - DNA, 20 bp, Artificial
  CRISPR gRNA sequence
taatgtctcactctgaaaaa

SEQ ID NO: 656500 - DNA, 20 bp, Artificial
  CRISPR gRNA sequence
actctgaaaaagattttgta

SEQ ID NO: 656501 - DNA, 20 bp, Artificial
  CRISPR gRNA sequence
tgaaaaagattttgtaatct

SEQ ID NO: 656502 - DNA, 20 bp, Artificial
  CRISPR gRNA sequence
aaaaagattttgtaatcttc

SEQ ID NO: 656503 - DNA, 20 bp, Artificial
  CRISPR gRNA sequence
tgtaatcttcaaattggtcc

SEQ ID NO: 656504 - DNA, 20 bp, Artificial
  CRISPR gRNA sequence
gtaatcttcaaattggtccc

SEQ ID NO: 656505 - DNA, 20 bp, Artificial
  CRISPR gRNA sequence
taatcttcaaattggtccca

SEQ ID NO: 656506 - DNA, 20 bp, Artificial
  CRISPR gRNA sequence
caaattggtcccaaaagctg

SEQ ID NO: 656507 - DNA, 20 bp, Artificial
  CRISPR gRNA sequence
aaattggtcccaaaagctga

SEQ ID NO: 656508 - DNA, 20 bp, Artificial
  CRISPR gRNA sequence
gtcccaaaagctgatctcta

SEQ ID NO: 656509 - DNA, 20 bp, Artificial
  CRISPR gRNA sequence
atctctaagtttctaaacag

SEQ ID NO: 656510 - DNA, 20 bp, Artificial
  CRISPR gRNA sequence
taagtttctaaacagttctt

SEQ ID NO: 656511 - DNA, 20 bp, Artificial
  CRISPR gRNA sequence
agtttctaaacagttcttat

SEQ ID NO: 656512 - DNA, 20 bp, Artificial
  CRISPR gRNA sequence
ctaaacagttcttatgtttt

SEQ ID NO: 656513 - DNA, 20 bp, Artificial
  CRISPR gRNA sequence
taaacagttcttatgttttc

SEQ ID NO: 656514 - DNA, 20 bp, Artificial
  CRISPR gRNA sequence
aacagttcttatgttttctg

SEQ ID NO: 656515 - DNA, 20 bp, Artificial
  CRISPR gRNA sequence
ttatgttttctgattctata

SEQ ID NO: 656516 - DNA, 20 bp, Artificial
  CRISPR gRNA sequence
atgttttctgattctataca

SEQ ID NO: 656517 - DNA, 20 bp, Artificial
  CRISPR gRNA sequence
tgttttctgattctatacaa

SEQ ID NO: 656518 - DNA, 20 bp, Artificial
  CRISPR gRNA sequence
tctgattctatacaaccatg

SEQ ID NO: 656519 - DNA, 20 bp, Artificial
  CRISPR gRNA sequence
ctgattctatacaaccatgt

SEQ ID NO: 656520 - DNA, 20 bp, Artificial
  CRISPR gRNA sequence
tgattctatacaaccatgtt

SEQ ID NO: 656521 - DNA, 20 bp, Artificial
  CRISPR gRNA sequence
attctatacaaccatgttca

SEQ ID NO: 656522 - DNA, 20 bp, Artificial
  CRISPR gRNA sequence
tatacaaccatgttcagtgg

SEQ ID NO: 656523 - DNA, 20 bp, Artificial
  CRISPR gRNA sequence
tacaaccatgttcagtggaa

SEQ ID NO: 656524 - DNA, 20 bp, Artificial
  CRISPR gRNA sequence
agtggaatccacatgaatgt

SEQ ID NO: 656525 - DNA, 20 bp, Artificial
  CRISPR gRNA sequence
atgtagatgtttccatgaca

SEQ ID NO: 656526 - DNA, 20 bp, Artificial
  CRISPR gRNA sequence
ccatgacaccaccatcatca

SEQ ID NO: 656527 - DNA, 20 bp, Artificial
  CRISPR gRNA sequence
catgacaccaccatcatcat

SEQ ID NO: 656528 - DNA, 20 bp, Artificial
  CRISPR gRNA sequence
cattactactattaatatct

SEQ ID NO: 656529 - DNA, 20 bp, Artificial
  CRISPR gRNA sequence
attactactattaatatctt

SEQ ID NO: 656530 - DNA, 20 bp, Artificial
  CRISPR gRNA sequence
ctactattaatatcttgata

SEQ ID NO: 656531 - DNA, 20 bp, Artificial
  CRISPR gRNA sequence
ctattaatatcttgatatag

SEQ ID NO: 656532 - DNA, 20 bp, Artificial
  CRISPR gRNA sequence
ttaatatcttgatatagcac

SEQ ID NO: 656533 - DNA, 20 bp, Artificial
  CRISPR gRNA sequence
atatcttgatatagcacatt

SEQ ID NO: 656534 - DNA, 20 bp, Artificial
  CRISPR gRNA sequence
gatatagcacatttaaggtt

SEQ ID NO: 656535 - DNA, 20 bp, Artificial
  CRISPR gRNA sequence
atatagcacatttaaggtta

SEQ ID NO: 656536 - DNA, 20 bp, Artificial
  CRISPR gRNA sequence
aaggttacagatttaattcc

SEQ ID NO: 656537 - DNA, 20 bp, Artificial
  CRISPR gRNA sequence
aggttacagatttaattcca

SEQ ID NO: 656538 - DNA, 20 bp, Artificial
  CRISPR gRNA sequence
cagatttaattccatatact

SEQ ID NO: 656539 - DNA, 20 bp, Artificial
  CRISPR gRNA sequence
aattccatatacttgtaatt

SEQ ID NO: 656540 - DNA, 20 bp, Artificial
  CRISPR gRNA sequence
attccatatacttgtaattt

SEQ ID NO: 656541 - DNA, 20 bp, Artificial
  CRISPR gRNA sequence
catatacttgtaattttaaa

SEQ ID NO: 656542 - DNA, 20 bp, Artificial
  CRISPR gRNA sequence
gtaattttaaagccagttct

SEQ ID NO: 656543 - DNA, 20 bp, Artificial
  CRISPR gRNA sequence
taattttaaagccagttctc

SEQ ID NO: 656544 - DNA, 20 bp, Artificial
  CRISPR gRNA sequence
taaagccagttctccatcac

SEQ ID NO: 656545 - DNA, 20 bp, Artificial
  CRISPR gRNA sequence
aaagccagttctccatcact

SEQ ID NO: 656546 - DNA, 20 bp, Artificial
  CRISPR gRNA sequence
aagccagttctccatcactt

SEQ ID NO: 656547 - DNA, 20 bp, Artificial
  CRISPR gRNA sequence
tccatcacttaaactgtttt

SEQ ID NO: 656548 - DNA, 20 bp, Artificial
  CRISPR gRNA sequence
catcacttaaactgttttta

SEQ ID NO: 656549 - DNA, 20 bp, Artificial
  CRISPR gRNA sequence
aaactgtttttagtagcatg

SEQ ID NO: 656550 - DNA, 20 bp, Artificial
  CRISPR gRNA sequence
aactgtttttagtagcatgt

SEQ ID NO: 656551 - DNA, 20 bp, Artificial
  CRISPR gRNA sequence
tttttagtagcatgtacaag

SEQ ID NO: 656552 - DNA, 20 bp, Artificial
  CRISPR gRNA sequence
ttagtagcatgtacaagatg

SEQ ID NO: 656553 - DNA, 20 bp, Artificial
  CRISPR gRNA sequence
tagtagcatgtacaagatgg

SEQ ID NO: 656554 - DNA, 20 bp, Artificial
  CRISPR gRNA sequence
agtagcatgtacaagatgga

SEQ ID NO: 656555 - DNA, 20 bp, Artificial
  CRISPR gRNA sequence
gtagcatgtacaagatggaa

SEQ ID NO: 656556 - DNA, 20 bp, Artificial
  CRISPR gRNA sequence
caattagcttttcttatgca

SEQ ID NO: 656557 - DNA, 20 bp, Artificial
  CRISPR gRNA sequence
aattagcttttcttatgcac

SEQ ID NO: 656558 - DNA, 20 bp, Artificial
  CRISPR gRNA sequence
gcttttcttatgcactccag

SEQ ID NO: 656559 - DNA, 20 bp, Artificial
  CRISPR gRNA sequence
ttcttatgcactccagatat

SEQ ID NO: 656560 - DNA, 20 bp, Artificial
  CRISPR gRNA sequence
tcttatgcactccagatatt

SEQ ID NO: 656561 - DNA, 20 bp, Artificial
  CRISPR gRNA sequence
cttatgcactccagatattt

SEQ ID NO: 656562 - DNA, 20 bp, Artificial
  CRISPR gRNA sequence
ttatgcactccagatatttt

SEQ ID NO: 656563 - DNA, 20 bp, Artificial
  CRISPR gRNA sequence
atgcactccagatattttga

SEQ ID NO: 656564 - DNA, 20 bp, Artificial
  CRISPR gRNA sequence
tgcactccagatattttgat

SEQ ID NO: 656565 - DNA, 20 bp, Artificial
  CRISPR gRNA sequence
cagatattttgatgagtgta

SEQ ID NO: 656566 - DNA, 20 bp, Artificial
  CRISPR gRNA sequence
tgatgagtgtataattaatc

SEQ ID NO: 656567 - DNA, 20 bp, Artificial
  CRISPR gRNA sequence
gatgagtgtataattaatca

SEQ ID NO: 656568 - DNA, 20 bp, Artificial
  CRISPR gRNA sequence
atgagtgtataattaatcag

SEQ ID NO: 656569 - DNA, 20 bp, Artificial
  CRISPR gRNA sequence
atcagtgtgaagtcacgttc

SEQ ID NO: 656570 - DNA, 20 bp, Artificial
  CRISPR gRNA sequence
taataaattaacattctggg

SEQ ID NO: 656571 - DNA, 20 bp, Artificial
  CRISPR gRNA sequence
ataaattaacattctgggtg

SEQ ID NO: 656572 - DNA, 20 bp, Artificial
  CRISPR gRNA sequence
acattctgggtgtctacact

SEQ ID NO: 656573 - DNA, 20 bp, Artificial
  CRISPR gRNA sequence
tgggtgtctacacttttgac

SEQ ID NO: 656574 - DNA, 20 bp, Artificial
  CRISPR gRNA sequence
ggtgtctacacttttgacgt

SEQ ID NO: 656575 - DNA, 20 bp, Artificial
  CRISPR gRNA sequence
cacttttgacgtttttgtca

SEQ ID NO: 656576 - DNA, 20 bp, Artificial
  CRISPR gRNA sequence
ttgacgtttttgtcattgct

SEQ ID NO: 656577 - DNA, 20 bp, Artificial
  CRISPR gRNA sequence
tgacgtttttgtcattgctc

SEQ ID NO: 656578 - DNA, 20 bp, Artificial
  CRISPR gRNA sequence
gacgtttttgtcattgctct

SEQ ID NO: 656579 - DNA, 20 bp, Artificial
  CRISPR gRNA sequence
acgtttttgtcattgctctc

SEQ ID NO: 656580 - DNA, 20 bp, Artificial
  CRISPR gRNA sequence
ttgtcattgctctcattatc

SEQ ID NO: 656581 - DNA, 20 bp, Artificial
  CRISPR gRNA sequence
tgtcattgctctcattatca

SEQ ID NO: 656582 - DNA, 20 bp, Artificial
  CRISPR gRNA sequence
gtcattgctctcattatcat

SEQ ID NO: 656583 - DNA, 20 bp, Artificial
  CRISPR gRNA sequence
tcattgctctcattatcatt

SEQ ID NO: 656584 - DNA, 20 bp, Artificial
  CRISPR gRNA sequence
ctctcattatcattgaagct

SEQ ID NO: 656585 - DNA, 20 bp, Artificial
  CRISPR gRNA sequence
tcattatcattgaagctgta

SEQ ID NO: 656586 - DNA, 20 bp, Artificial
  CRISPR gRNA sequence
attatcattgaagctgtagt

SEQ ID NO: 656587 - DNA, 20 bp, Artificial
  CRISPR gRNA sequence
tcattgaagctgtagttctc

SEQ ID NO: 656588 - DNA, 20 bp, Artificial
  CRISPR gRNA sequence
aagctgtagttctccttacc

SEQ ID NO: 656589 - DNA, 20 bp, Artificial
  CRISPR gRNA sequence
tagttctccttacccttgtc

SEQ ID NO: 656590 - DNA, 20 bp, Artificial
  CRISPR gRNA sequence
tccttacccttgtctatgtc

SEQ ID NO: 656591 - DNA, 20 bp, Artificial
  CRISPR gRNA sequence
cttacccttgtctatgtcag

SEQ ID NO: 656592 - DNA, 20 bp, Artificial
  CRISPR gRNA sequence
acccttgtctatgtcagctc

SEQ ID NO: 656593 - DNA, 20 bp, Artificial
  CRISPR gRNA sequence
cccttgtctatgtcagctct

SEQ ID NO: 656594 - DNA, 20 bp, Artificial
  CRISPR gRNA sequence
gtctatgtcagctctaccta

SEQ ID NO: 656595 - DNA, 20 bp, Artificial
  CRISPR gRNA sequence
tctatgtcagctctacctac

SEQ ID NO: 656596 - DNA, 20 bp, Artificial
  CRISPR gRNA sequence
tgtcagctctacctacttct

SEQ ID NO: 656597 - DNA, 20 bp, Artificial
  CRISPR gRNA sequence
tacctacttcttactaagac

SEQ ID NO: 656598 - DNA, 20 bp, Artificial
  CRISPR gRNA sequence
cctacttcttactaagacat

SEQ ID NO: 656599 - DNA, 20 bp, Artificial
  CRISPR gRNA sequence
cttcttactaagacattcaa

SEQ ID NO: 656600 - DNA, 20 bp, Artificial
  CRISPR gRNA sequence
cttactaagacattcaacat

SEQ ID NO: 656601 - DNA, 20 bp, Artificial
  CRISPR gRNA sequence
ttactaagacattcaacatg

SEQ ID NO: 656602 - DNA, 20 bp, Artificial
  CRISPR gRNA sequence
actaagacattcaacatgca

SEQ ID NO: 656603 - DNA, 20 bp, Artificial
  CRISPR gRNA sequence
ctaagacattcaacatgcag

SEQ ID NO: 656604 - DNA, 20 bp, Artificial
  CRISPR gRNA sequence
agacattcaacatgcaggac

SEQ ID NO: 656605 - DNA, 20 bp, Artificial
  CRISPR gRNA sequence
aacatgcaggacttgatctt

SEQ ID NO: 656606 - DNA, 20 bp, Artificial
  CRISPR gRNA sequence
gatcttattttgaagtgcta

SEQ ID NO: 656607 - DNA, 20 bp, Artificial
  CRISPR gRNA sequence
atcttattttgaagtgctag

SEQ ID NO: 656608 - DNA, 20 bp, Artificial
  CRISPR gRNA sequence
attttgaagtgctagggtac

SEQ ID NO: 656609 - DNA, 20 bp, Artificial
  CRISPR gRNA sequence
ttttgaagtgctagggtact

SEQ ID NO: 656610 - DNA, 20 bp, Artificial
  CRISPR gRNA sequence
tgaagtgctagggtactacg

SEQ ID NO: 656611 - DNA, 20 bp, Artificial
  CRISPR gRNA sequence
gaagtgctagggtactacgt

SEQ ID NO: 656612 - DNA, 20 bp, Artificial
  CRISPR gRNA sequence
aagtgctagggtactacgtt

SEQ ID NO: 656613 - DNA, 20 bp, Artificial
  CRISPR gRNA sequence
gggtactacgttgctgtgtt

SEQ ID NO: 656614 - DNA, 20 bp, Artificial
  CRISPR gRNA sequence
cgttgctgtgttttcagttg

SEQ ID NO: 656615 - DNA, 20 bp, Artificial
  CRISPR gRNA sequence
ctgtgttttcagttgaatta

SEQ ID NO: 656616 - DNA, 20 bp, Artificial
  CRISPR gRNA sequence
tgttttcagttgaattaaca

SEQ ID NO: 656617 - DNA, 20 bp, Artificial
  CRISPR gRNA sequence
tcagttgaattaacagtgag

SEQ ID NO: 656618 - DNA, 20 bp, Artificial
  CRISPR gRNA sequence
cagttgaattaacagtgaga

SEQ ID NO: 656619 - DNA, 20 bp, Artificial
  CRISPR gRNA sequence
agttgaattaacagtgagaa

SEQ ID NO: 656620 - DNA, 20 bp, Artificial
  CRISPR gRNA sequence
aattaacagtgagaatttct

SEQ ID NO: 656621 - DNA, 20 bp, Artificial
  CRISPR gRNA sequence
acagtgagaatttctggttg

SEQ ID NO: 656622 - DNA, 20 bp, Artificial
  CRISPR gRNA sequence
ctggttgagttctaaatagg

SEQ ID NO: 656623 - DNA, 20 bp, Artificial
  CRISPR gRNA sequence
tggttgagttctaaataggc

SEQ ID NO: 656624 - DNA, 20 bp, Artificial
  CRISPR gRNA sequence
gttgagttctaaataggcat

SEQ ID NO: 656625 - DNA, 20 bp, Artificial
  CRISPR gRNA sequence
agttctaaataggcataatt

SEQ ID NO: 656626 - DNA, 20 bp, Artificial
  CRISPR gRNA sequence
taaataggcataatttcttc

SEQ ID NO: 656627 - DNA, 20 bp, Artificial
  CRISPR gRNA sequence
aataggcataatttcttcta

SEQ ID NO: 656628 - DNA, 20 bp, Artificial
  CRISPR gRNA sequence
cttctacaagtatataaaac

SEQ ID NO: 656629 - DNA, 20 bp, Artificial
  CRISPR gRNA sequence
ttctacaagtatataaaaca

SEQ ID NO: 656630 - DNA, 20 bp, Artificial
  CRISPR gRNA sequence
ctacaagtatataaaacatt

SEQ ID NO: 656631 - DNA, 20 bp, Artificial
  CRISPR gRNA sequence
tacaagtatataaaacattt

SEQ ID NO: 656632 - DNA, 20 bp, Artificial
  CRISPR gRNA sequence
caagtatataaaacattttc

SEQ ID NO: 656633 - DNA, 20 bp, Artificial
  CRISPR gRNA sequence
tctttcatggccattttcat

SEQ ID NO: 656634 - DNA, 20 bp, Artificial
  CRISPR gRNA sequence
ctttcatggccattttcata

SEQ ID NO: 656635 - DNA, 20 bp, Artificial
  CRISPR gRNA sequence
tttcatggccattttcataa

SEQ ID NO: 656636 - DNA, 20 bp, Artificial
  CRISPR gRNA sequence
tcatggccattttcataaat

SEQ ID NO: 656637 - DNA, 20 bp, Artificial
  CRISPR gRNA sequence
catggccattttcataaata

SEQ ID NO: 656638 - DNA, 20 bp, Artificial
  CRISPR gRNA sequence
atggccattttcataaatat

SEQ ID NO: 656639 - DNA, 20 bp, Artificial
  CRISPR gRNA sequence
tcataaatatccttgttttg

SEQ ID NO: 656640 - DNA, 20 bp, Artificial
  CRISPR gRNA sequence
cataaatatccttgttttgt

SEQ ID NO: 656641 - DNA, 20 bp, Artificial
  CRISPR gRNA sequence
ataaatatccttgttttgtt

SEQ ID NO: 656642 - DNA, 20 bp, Artificial
  CRISPR gRNA sequence
gttttgttgtttaaaaatac

SEQ ID NO: 656643 - DNA, 20 bp, Artificial
  CRISPR gRNA sequence
ttttgttgtttaaaaataca

SEQ ID NO: 656644 - DNA, 20 bp, Artificial
  CRISPR gRNA sequence
tgttgtttaaaaatacacat

SEQ ID NO: 656645 - DNA, 20 bp, Artificial
  CRISPR gRNA sequence
gttgtttaaaaatacacatt

SEQ ID NO: 656646 - DNA, 20 bp, Artificial
  CRISPR gRNA sequence
ttgtttaaaaatacacattt

SEQ ID NO: 656647 - DNA, 20 bp, Artificial
  CRISPR gRNA sequence
tttaaaaatacacattttaa

SEQ ID NO: 656648 - DNA, 20 bp, Artificial
  CRISPR gRNA sequence
aaaaatacacattttaacaa

SEQ ID NO: 656649 - DNA, 20 bp, Artificial
  CRISPR gRNA sequence
aaaatacacattttaacaag

SEQ ID NO: 656650 - DNA, 20 bp, Artificial
  CRISPR gRNA sequence
taacaagtaatatttacata

SEQ ID NO: 656651 - DNA, 20 bp, Artificial
  CRISPR gRNA sequence
aacaagtaatatttacatat

SEQ ID NO: 656652 - DNA, 20 bp, Artificial
  CRISPR gRNA sequence
acaagtaatatttacatatg

SEQ ID NO: 656653 - DNA, 20 bp, Artificial
  CRISPR gRNA sequence
acatatggaaatatcttata

SEQ ID NO: 656654 - DNA, 20 bp, Artificial
  CRISPR gRNA sequence
catatggaaatatcttatag

SEQ ID NO: 656655 - DNA, 20 bp, Artificial
  CRISPR gRNA sequence
ataggtcttctaatcagact

SEQ ID NO: 656656 - DNA, 20 bp, Artificial
  CRISPR gRNA sequence
taggtcttctaatcagactt

SEQ ID NO: 656657 - DNA, 20 bp, Artificial
  CRISPR gRNA sequence
ctaatcagacttatgccaat

SEQ ID NO: 656658 - DNA, 20 bp, Artificial
  CRISPR gRNA sequence
taatcagacttatgccaata

SEQ ID NO: 656659 - DNA, 20 bp, Artificial
  CRISPR gRNA sequence
atcagacttatgccaatatg

SEQ ID NO: 656660 - DNA, 20 bp, Artificial
  CRISPR gRNA sequence
atgccaatatgcttattatt

SEQ ID NO: 656661 - DNA, 20 bp, Artificial
  CRISPR gRNA sequence
tgccaatatgcttattattc

SEQ ID NO: 656662 - DNA, 20 bp, Artificial
  CRISPR gRNA sequence
attattcagatggtctgaag

SEQ ID NO: 656663 - DNA, 20 bp, Artificial
  CRISPR gRNA sequence
ttattcagatggtctgaagt

SEQ ID NO: 656664 - DNA, 20 bp, Artificial
  CRISPR gRNA sequence
ttcagatggtctgaagtaga

SEQ ID NO: 656665 - DNA, 20 bp, Artificial
  CRISPR gRNA sequence
agatggtctgaagtagatga

SEQ ID NO: 656666 - DNA, 20 bp, Artificial
  CRISPR gRNA sequence
aagtagatgactttattttc

SEQ ID NO: 656667 - DNA, 20 bp, Artificial
  CRISPR gRNA sequence
tattttcaatacatctgtta

SEQ ID NO: 656668 - DNA, 20 bp, Artificial
  CRISPR gRNA sequence
attttcaatacatctgttac

SEQ ID NO: 656669 - DNA, 20 bp, Artificial
  CRISPR gRNA sequence
ttttcaatacatctgttact

SEQ ID NO: 656670 - DNA, 20 bp, Artificial
  CRISPR gRNA sequence
tcaatacatctgttactttt

SEQ ID NO: 656671 - DNA, 20 bp, Artificial
  CRISPR gRNA sequence
caatacatctgttacttttt

SEQ ID NO: 656672 - DNA, 20 bp, Artificial
  CRISPR gRNA sequence
aatacatctgttacttttta

SEQ ID NO: 656673 - DNA, 20 bp, Artificial
  CRISPR gRNA sequence
ttactttttagactgaaaag

SEQ ID NO: 656674 - DNA, 20 bp, Artificial
  CRISPR gRNA sequence
ctttttagactgaaaagtgg

SEQ ID NO: 656675 - DNA, 20 bp, Artificial
  CRISPR gRNA sequence
tttagactgaaaagtggcat

SEQ ID NO: 656676 - DNA, 20 bp, Artificial
  CRISPR gRNA sequence
ttagactgaaaagtggcatt

SEQ ID NO: 656677 - DNA, 20 bp, Artificial
  CRISPR gRNA sequence
tagactgaaaagtggcattt

SEQ ID NO: 656678 - DNA, 20 bp, Artificial
  CRISPR gRNA sequence
agactgaaaagtggcatttc

SEQ ID NO: 656679 - DNA, 20 bp, Artificial
  CRISPR gRNA sequence
gactgaaaagtggcatttct

SEQ ID NO: 656680 - DNA, 20 bp, Artificial
  CRISPR gRNA sequence
aaaagtggcatttctatagt

SEQ ID NO: 656681 - DNA, 20 bp, Artificial
  CRISPR gRNA sequence
ctatagtttttagggctgag

SEQ ID NO: 656682 - DNA, 20 bp, Artificial
  CRISPR gRNA sequence
tatagtttttagggctgagg

SEQ ID NO: 656683 - DNA, 20 bp, Artificial
  CRISPR gRNA sequence
tagtttttagggctgaggat

SEQ ID NO: 656684 - DNA, 20 bp, Artificial
  CRISPR gRNA sequence
ttagggctgaggatgtatat

SEQ ID NO: 656685 - DNA, 20 bp, Artificial
  CRISPR gRNA sequence
tagggctgaggatgtatatt

SEQ ID NO: 656686 - DNA, 20 bp, Artificial
  CRISPR gRNA sequence
agggctgaggatgtatattt

SEQ ID NO: 656687 - DNA, 20 bp, Artificial
  CRISPR gRNA sequence
gggctgaggatgtatattta

SEQ ID NO: 656688 - DNA, 20 bp, Artificial
  CRISPR gRNA sequence
aggatgtatatttaattcgt

SEQ ID NO: 656689 - DNA, 20 bp, Artificial
  CRISPR gRNA sequence
aattcgtgattgtaaaaggt

SEQ ID NO: 656690 - DNA, 20 bp, Artificial
  CRISPR gRNA sequence
attcgtgattgtaaaaggtc

SEQ ID NO: 656691 - DNA, 20 bp, Artificial
  CRISPR gRNA sequence
gtgattgtaaaaggtctatt

SEQ ID NO: 656692 - DNA, 20 bp, Artificial
  CRISPR gRNA sequence
taaaaggtctatttctatta

SEQ ID NO: 656693 - DNA, 20 bp, Artificial
  CRISPR gRNA sequence
tttctattagaaatgcttgc

SEQ ID NO: 656694 - DNA, 20 bp, Artificial
  CRISPR gRNA sequence
ctattagaaatgcttgctca

SEQ ID NO: 656695 - DNA, 20 bp, Artificial
  CRISPR gRNA sequence
tattagaaatgcttgctcag

SEQ ID NO: 656696 - DNA, 20 bp, Artificial
  CRISPR gRNA sequence
ttagaaatgcttgctcagat

SEQ ID NO: 656697 - DNA, 20 bp, Artificial
  CRISPR gRNA sequence
gaaatgcttgctcagatcac

SEQ ID NO: 656698 - DNA, 20 bp, Artificial
  CRISPR gRNA sequence
gctcagatcacccaaatatc

SEQ ID NO: 656699 - DNA, 20 bp, Artificial
  CRISPR gRNA sequence
ctcagatcacccaaatatca

SEQ ID NO: 656700 - DNA, 20 bp, Artificial
  CRISPR gRNA sequence
agatcacccaaatatcatct

SEQ ID NO: 656701 - DNA, 20 bp, Artificial
  CRISPR gRNA sequence
aagcttgaaaattgagctat

SEQ ID NO: 656702 - DNA, 20 bp, Artificial
  CRISPR gRNA sequence
gaaaattgagctattcaata

SEQ ID NO: 656703 - DNA, 20 bp, Artificial
  CRISPR gRNA sequence
aaaattgagctattcaataa

SEQ ID NO: 656704 - DNA, 20 bp, Artificial
  CRISPR gRNA sequence
agctattcaataatttttag

SEQ ID NO: 656705 - DNA, 20 bp, Artificial
  CRISPR gRNA sequence
ttcaataatttttaggtact

SEQ ID NO: 656706 - DNA, 20 bp, Artificial
  CRISPR gRNA sequence
aataatttttaggtactaaa

SEQ ID NO: 656707 - DNA, 20 bp, Artificial
  CRISPR gRNA sequence
ttaggtactaaaaataggtg

SEQ ID NO: 656708 - DNA, 20 bp, Artificial
  CRISPR gRNA sequence
taggtactaaaaataggtgg

SEQ ID NO: 656709 - DNA, 20 bp, Artificial
  CRISPR gRNA sequence
aggtactaaaaataggtggt

SEQ ID NO: 656710 - DNA, 20 bp, Artificial
  CRISPR gRNA sequence
ggtactaaaaataggtggta

SEQ ID NO: 656711 - DNA, 20 bp, Artificial
  CRISPR gRNA sequence
aaaataggtggtacctaatc

SEQ ID NO: 656712 - DNA, 20 bp, Artificial
  CRISPR gRNA sequence
atcatttttgtgtactgctt

SEQ ID NO: 656713 - DNA, 20 bp, Artificial
  CRISPR gRNA sequence
ttgtgtactgctttaaaatg

SEQ ID NO: 656714 - DNA, 20 bp, Artificial
  CRISPR gRNA sequence
tgtgtactgctttaaaatga

SEQ ID NO: 656715 - DNA, 20 bp, Artificial
  CRISPR gRNA sequence
gtgtactgctttaaaatgac

SEQ ID NO: 656716 - DNA, 20 bp, Artificial
  CRISPR gRNA sequence
tgtactgctttaaaatgact

SEQ ID NO: 656717 - DNA, 20 bp, Artificial
  CRISPR gRNA sequence
ctttaaaatgacttacgcct

SEQ ID NO: 656718 - DNA, 20 bp, Artificial
  CRISPR gRNA sequence
taaaatgacttacgccttaa

SEQ ID NO: 656719 - DNA, 20 bp, Artificial
  CRISPR gRNA sequence
aaaatgacttacgccttaaa

SEQ ID NO: 656720 - DNA, 20 bp, Artificial
  CRISPR gRNA sequence
aaatgacttacgccttaaaa

SEQ ID NO: 656721 - DNA, 20 bp, Artificial
  CRISPR gRNA sequence
acgccttaaaaacactgact

SEQ ID NO: 656722 - DNA, 20 bp, Artificial
  CRISPR gRNA sequence
cgccttaaaaacactgactc

SEQ ID NO: 656723 - DNA, 20 bp, Artificial
  CRISPR gRNA sequence
aaaaacactgactcgaatgt

SEQ ID NO: 656724 - DNA, 20 bp, Artificial
  CRISPR gRNA sequence
aaaacactgactcgaatgta

SEQ ID NO: 656725 - DNA, 20 bp, Artificial
  CRISPR gRNA sequence
actcgaatgtagtatttgga

SEQ ID NO: 656726 - DNA, 20 bp, Artificial
  CRISPR gRNA sequence
gaatgtagtatttggaaatg

SEQ ID NO: 656727 - DNA, 20 bp, Artificial
  CRISPR gRNA sequence
ggaaatgtaaaatgacttct

SEQ ID NO: 656728 - DNA, 20 bp, Artificial
  CRISPR gRNA sequence
gaaatgtaaaatgacttcta

SEQ ID NO: 656729 - DNA, 20 bp, Artificial
  CRISPR gRNA sequence
ctattacattattacatttt

SEQ ID NO: 656730 - DNA, 20 bp, Artificial
  CRISPR gRNA sequence
tattacattattacattttt

SEQ ID NO: 656731 - DNA, 20 bp, Artificial
  CRISPR gRNA sequence
ttacattattacatttttga

SEQ ID NO: 656732 - DNA, 20 bp, Artificial
  CRISPR gRNA sequence
cattattacatttttgaaaa

SEQ ID NO: 656733 - DNA, 20 bp, Artificial
  CRISPR gRNA sequence
ttacatttttgaaaactact

SEQ ID NO: 656734 - DNA, 20 bp, Artificial
  CRISPR gRNA sequence
catttttgaaaactacttga

SEQ ID NO: 656735 - DNA, 20 bp, Artificial
  CRISPR gRNA sequence
ttgaaaactacttgaaagca

SEQ ID NO: 656736 - DNA, 20 bp, Artificial
  CRISPR gRNA sequence
tgaaaactacttgaaagcag

SEQ ID NO: 656737 - DNA, 20 bp, Artificial
  CRISPR gRNA sequence
gaaaactacttgaaagcagc

SEQ ID NO: 656738 - DNA, 20 bp, Artificial
  CRISPR gRNA sequence
aaaactacttgaaagcagca

SEQ ID NO: 656739 - DNA, 20 bp, Artificial
  CRISPR gRNA sequence
cttgaaagcagcaatagatt

SEQ ID NO: 656740 - DNA, 20 bp, Artificial
  CRISPR gRNA sequence
gaaagcagcaatagattgtg

SEQ ID NO: 656741 - DNA, 20 bp, Artificial
  CRISPR gRNA sequence
aaagcagcaatagattgtgt

SEQ ID NO: 656742 - DNA, 20 bp, Artificial
  CRISPR gRNA sequence
tgtctggacataactgagaa

SEQ ID NO: 656743 - DNA, 20 bp, Artificial
  CRISPR gRNA sequence
gacataactgagaattataa

SEQ ID NO: 656744 - DNA, 20 bp, Artificial
  CRISPR gRNA sequence
agaattataaaaagaaatat

SEQ ID NO: 656745 - DNA, 20 bp, Artificial
  CRISPR gRNA sequence
taaaaagaaatatgagattt

SEQ ID NO: 656746 - DNA, 20 bp, Artificial
  CRISPR gRNA sequence
ttctgtgagtctgctgtttt

SEQ ID NO: 656747 - DNA, 20 bp, Artificial
  CRISPR gRNA sequence
tctgtgagtctgctgttttt

SEQ ID NO: 656748 - DNA, 20 bp, Artificial
  CRISPR gRNA sequence
ctgtgagtctgctgttttta

SEQ ID NO: 656749 - DNA, 20 bp, Artificial
  CRISPR gRNA sequence
tgtgagtctgctgtttttaa

SEQ ID NO: 656750 - DNA, 20 bp, Artificial
  CRISPR gRNA sequence
tgagtctgctgtttttaagt

SEQ ID NO: 656751 - DNA, 20 bp, Artificial
  CRISPR gRNA sequence
ctgtttttaagttctcgaag

SEQ ID NO: 656752 - DNA, 20 bp, Artificial
  CRISPR gRNA sequence
tttttaagttctcgaagcat

SEQ ID NO: 656753 - DNA, 20 bp, Artificial
  CRISPR gRNA sequence
ttaagttctcgaagcatgaa

SEQ ID NO: 656754 - DNA, 20 bp, Artificial
  CRISPR gRNA sequence
taagttctcgaagcatgaat

SEQ ID NO: 656755 - DNA, 20 bp, Artificial
  CRISPR gRNA sequence
aagttctcgaagcatgaatt

SEQ ID NO: 656756 - DNA, 20 bp, Artificial
  CRISPR gRNA sequence
agttctcgaagcatgaattt

SEQ ID NO: 656757 - DNA, 20 bp, Artificial
  CRISPR gRNA sequence
tcgaagcatgaatttacaca

SEQ ID NO: 656758 - DNA, 20 bp, Artificial
  CRISPR gRNA sequence
gaagcatgaatttacacact

SEQ ID NO: 656759 - DNA, 20 bp, Artificial
  CRISPR gRNA sequence
acacactgccatctgtctga

SEQ ID NO: 656760 - DNA, 20 bp, Artificial
  CRISPR gRNA sequence
cacactgccatctgtctgaa

SEQ ID NO: 656761 - DNA, 20 bp, Artificial
  CRISPR gRNA sequence
ccatctgtctgaattatgac

SEQ ID NO: 656762 - DNA, 20 bp, Artificial
  CRISPR gRNA sequence
tctgaattatgacacattaa

SEQ ID NO: 656763 - DNA, 20 bp, Artificial
  CRISPR gRNA sequence
aattatgacacattaatgac

SEQ ID NO: 656764 - DNA, 20 bp, Artificial
  CRISPR gRNA sequence
tgacacattaatgacctaat

SEQ ID NO: 656765 - DNA, 20 bp, Artificial
  CRISPR gRNA sequence
atgacctaatgatagtttta

SEQ ID NO: 656766 - DNA, 20 bp, Artificial
  CRISPR gRNA sequence
atgatagttttagatttaat

SEQ ID NO: 656767 - DNA, 20 bp, Artificial
  CRISPR gRNA sequence
tagatttaatttttttttgg

SEQ ID NO: 656768 - DNA, 20 bp, Artificial
  CRISPR gRNA sequence
agatttaatttttttttgga

SEQ ID NO: 656769 - DNA, 20 bp, Artificial
  CRISPR gRNA sequence
gatttaatttttttttggaa

SEQ ID NO: 656770 - DNA, 20 bp, Artificial
  CRISPR gRNA sequence
aatttttttttggaaataaa

SEQ ID NO: 656771 - DNA, 20 bp, Artificial
  CRISPR gRNA sequence
atttttttttggaaataaaa

SEQ ID NO: 656772 - DNA, 20 bp, Artificial
  CRISPR gRNA sequence
ttttttggaaataaaaacaa

SEQ ID NO: 656773 - DNA, 20 bp, Artificial
  CRISPR gRNA sequence
tttttggaaataaaaacaaa

SEQ ID NO: 656774 - DNA, 20 bp, Artificial
  CRISPR gRNA sequence
ttttggaaataaaaacaaaa

SEQ ID NO: 656775 - DNA, 20 bp, Artificial
  CRISPR gRNA sequence
tttggaaataaaaacaaaaa

SEQ ID NO: 656776 - DNA, 20 bp, Artificial
  CRISPR gRNA sequence
ttggaaataaaaacaaaaag

SEQ ID NO: 656777 - DNA, 20 bp, Artificial
  CRISPR gRNA sequence
tggaaataaaaacaaaaaga

SEQ ID NO: 656778 - DNA, 20 bp, Artificial
  CRISPR gRNA sequence
ggaaataaaaacaaaaagaa

SEQ ID NO: 656779 - DNA, 20 bp, Artificial
  CRISPR gRNA sequence
gaaataaaaacaaaaagaaa

SEQ ID NO: 656780 - DNA, 20 bp, Artificial
  CRISPR gRNA sequence
aacaaaacacaatttaaaat

SEQ ID NO: 656781 - DNA, 20 bp, Artificial
  CRISPR gRNA sequence
aaaataaattattttttaca

SEQ ID NO: 656782 - DNA, 20 bp, Artificial
  CRISPR gRNA sequence
aaataaattattttttacat

SEQ ID NO: 656783 - DNA, 20 bp, Artificial
  CRISPR gRNA sequence
ttttttacataaataaatca

SEQ ID NO: 656784 - DNA, 20 bp, Artificial
  CRISPR gRNA sequence
tttacataaataaatcatag

SEQ ID NO: 656785 - DNA, 20 bp, Artificial
  CRISPR gRNA sequence
ttacataaataaatcatagt

SEQ ID NO: 656786 - DNA, 20 bp, Artificial
  CRISPR gRNA sequence
tacataaataaatcatagta

SEQ ID NO: 656787 - DNA, 20 bp, Artificial
  CRISPR gRNA sequence
acataaataaatcatagtaa

SEQ ID NO: 656788 - DNA, 20 bp, Artificial
  CRISPR gRNA sequence
cataaataaatcatagtaat

SEQ ID NO: 656789 - DNA, 20 bp, Artificial
  CRISPR gRNA sequence
tttgcataaagttttgggga

SEQ ID NO: 656790 - DNA, 20 bp, Artificial
  CRISPR gRNA sequence
gcataaagttttggggatgc

SEQ ID NO: 656791 - DNA, 20 bp, Artificial
  CRISPR gRNA sequence
cataaagttttggggatgca

SEQ ID NO: 656792 - DNA, 20 bp, Artificial
  CRISPR gRNA sequence
tggggatgcatttgaatagt

SEQ ID NO: 656793 - DNA, 20 bp, Artificial
  CRISPR gRNA sequence
ggggatgcatttgaatagtt

SEQ ID NO: 656794 - DNA, 20 bp, Artificial
  CRISPR gRNA sequence
gggatgcatttgaatagttt

SEQ ID NO: 656795 - DNA, 20 bp, Artificial
  CRISPR gRNA sequence
gaatagttttagttggtgtt

SEQ ID NO: 656796 - DNA, 20 bp, Artificial
  CRISPR gRNA sequence
aatagttttagttggtgtta

SEQ ID NO: 656797 - DNA, 20 bp, Artificial
  CRISPR gRNA sequence
tagttggtgttacattttga

SEQ ID NO: 656798 - DNA, 20 bp, Artificial
  CRISPR gRNA sequence
agttggtgttacattttgag

SEQ ID NO: 656799 - DNA, 20 bp, Artificial
  CRISPR gRNA sequence
gttggtgttacattttgagt

SEQ ID NO: 656800 - DNA, 20 bp, Artificial
  CRISPR gRNA sequence
gtgttacattttgagtacaa

SEQ ID NO: 656801 - DNA, 20 bp, Artificial
  CRISPR gRNA sequence
cattttgagtacaatacctg

SEQ ID NO: 656802 - DNA, 20 bp, Artificial
  CRISPR gRNA sequence
tgagtacaatacctgtaaca

SEQ ID NO: 656803 - DNA, 20 bp, Artificial
  CRISPR gRNA sequence
gagtacaatacctgtaacaa

SEQ ID NO: 656804 - DNA, 20 bp, Artificial
  CRISPR gRNA sequence
agtacaatacctgtaacaaa

SEQ ID NO: 656805 - DNA, 20 bp, Artificial
  CRISPR gRNA sequence
taacaaatttgaagagatat

SEQ ID NO: 656806 - DNA, 20 bp, Artificial
  CRISPR gRNA sequence
gaagagatattttttcagcc

SEQ ID NO: 656807 - DNA, 20 bp, Artificial
  CRISPR gRNA sequence
aagagatattttttcagcca

SEQ ID NO: 656808 - DNA, 20 bp, Artificial
  CRISPR gRNA sequence
tttcagccagagaagctata

SEQ ID NO: 656809 - DNA, 20 bp, Artificial
  CRISPR gRNA sequence
ttcagccagagaagctatag

SEQ ID NO: 656810 - DNA, 20 bp, Artificial
  CRISPR gRNA sequence
tcagccagagaagctatagt

SEQ ID NO: 656811 - DNA, 20 bp, Artificial
  CRISPR gRNA sequence
cagccagagaagctatagtt

SEQ ID NO: 656812 - DNA, 20 bp, Artificial
  CRISPR gRNA sequence
agccagagaagctatagtta

SEQ ID NO: 656813 - DNA, 20 bp, Artificial
  CRISPR gRNA sequence
tagttaactagacaattgat

SEQ ID NO: 656814 - DNA, 20 bp, Artificial
  CRISPR gRNA sequence
actagacaattgatttcata

SEQ ID NO: 656815 - DNA, 20 bp, Artificial
  CRISPR gRNA sequence
gacaattgatttcatacaac

SEQ ID NO: 656816 - DNA, 20 bp, Artificial
  CRISPR gRNA sequence
atttcatacaactctatgta

SEQ ID NO: 656817 - DNA, 20 bp, Artificial
  CRISPR gRNA sequence
catacaactctatgtatatg

SEQ ID NO: 656818 - DNA, 20 bp, Artificial
  CRISPR gRNA sequence
atacaactctatgtatatga

SEQ ID NO: 656819 - DNA, 20 bp, Artificial
  CRISPR gRNA sequence
tatgtatatgataataccat

SEQ ID NO: 656820 - DNA, 20 bp, Artificial
  CRISPR gRNA sequence
tgtatatgataataccattt

SEQ ID NO: 656821 - DNA, 20 bp, Artificial
  CRISPR gRNA sequence
atgtttttaaaagcatatat

SEQ ID NO: 656822 - DNA, 20 bp, Artificial
  CRISPR gRNA sequence
tgtttttaaaagcatatatg

SEQ ID NO: 656823 - DNA, 20 bp, Artificial
  CRISPR gRNA sequence
ttaaaagcatatatgtgcat

SEQ ID NO: 656824 - DNA, 20 bp, Artificial
  CRISPR gRNA sequence
taaaagcatatatgtgcatg

SEQ ID NO: 656825 - DNA, 20 bp, Artificial
  CRISPR gRNA sequence
aaaagcatatatgtgcatgt

SEQ ID NO: 656826 - DNA, 20 bp, Artificial
  CRISPR gRNA sequence
aaagcatatatgtgcatgtg

SEQ ID NO: 656827 - DNA, 20 bp, Artificial
  CRISPR gRNA sequence
gatatagttgactttgggat

SEQ ID NO: 656828 - DNA, 20 bp, Artificial
  CRISPR gRNA sequence
atatagttgactttgggata

SEQ ID NO: 656829 - DNA, 20 bp, Artificial
  CRISPR gRNA sequence
actttgggatatcggagggt

SEQ ID NO: 656830 - DNA, 20 bp, Artificial
  CRISPR gRNA sequence
tgggatatcggagggtaaac

SEQ ID NO: 656831 - DNA, 20 bp, Artificial
  CRISPR gRNA sequence
gggatatcggagggtaaaca

SEQ ID NO: 656832 - DNA, 20 bp, Artificial
  CRISPR gRNA sequence
ggatatcggagggtaaacag

SEQ ID NO: 656833 - DNA, 20 bp, Artificial
  CRISPR gRNA sequence
tatattttattctaaatagt

SEQ ID NO: 656834 - DNA, 20 bp, Artificial
  CRISPR gRNA sequence
atattttattctaaatagtt

SEQ ID NO: 656835 - DNA, 20 bp, Artificial
  CRISPR gRNA sequence
tattttattctaaatagttc

SEQ ID NO: 656836 - DNA, 20 bp, Artificial
  CRISPR gRNA sequence
tattctaaatagttctacat

SEQ ID NO: 656837 - DNA, 20 bp, Artificial
  CRISPR gRNA sequence
attctaaatagttctacatt

SEQ ID NO: 656838 - DNA, 20 bp, Artificial
  CRISPR gRNA sequence
ttctaaatagttctacattc

SEQ ID NO: 656839 - DNA, 20 bp, Artificial
  CRISPR gRNA sequence
taaatagttctacattcttt

SEQ ID NO: 656840 - DNA, 20 bp, Artificial
  CRISPR gRNA sequence
aatagttctacattctttaa

SEQ ID NO: 656841 - DNA, 20 bp, Artificial
  CRISPR gRNA sequence
tacattctttaagtctctta

SEQ ID NO: 656842 - DNA, 20 bp, Artificial
  CRISPR gRNA sequence
cattctttaagtctcttaca

SEQ ID NO: 656843 - DNA, 20 bp, Artificial
  CRISPR gRNA sequence
tttaagtctcttacaaaaaa

SEQ ID NO: 656844 - DNA, 20 bp, Artificial
  CRISPR gRNA sequence
taagtctcttacaaaaaata

SEQ ID NO: 656845 - DNA, 20 bp, Artificial
  CRISPR gRNA sequence
aagtctcttacaaaaaataa

SEQ ID NO: 656846 - DNA, 20 bp, Artificial
  CRISPR gRNA sequence
agtctcttacaaaaaataaa

SEQ ID NO: 656847 - DNA, 20 bp, Artificial
  CRISPR gRNA sequence
ttacaaaaaataaattcata

SEQ ID NO: 656848 - DNA, 20 bp, Artificial
  CRISPR gRNA sequence
acaaaaaataaattcatata

SEQ ID NO: 656849 - DNA, 20 bp, Artificial
  CRISPR gRNA sequence
caaaaaataaattcatatat

SEQ ID NO: 656850 - DNA, 20 bp, Artificial
  CRISPR gRNA sequence
atatattatttgtgtaattt

SEQ ID NO: 656851 - DNA, 20 bp, Artificial
  CRISPR gRNA sequence
tttgtgtaatttaaagaaaa

SEQ ID NO: 656852 - DNA, 20 bp, Artificial
  CRISPR gRNA sequence
gtgtaatttaaagaaaagac

SEQ ID NO: 656853 - DNA, 20 bp, Artificial
  CRISPR gRNA sequence
tgtaatttaaagaaaagacc

SEQ ID NO: 656854 - DNA, 20 bp, Artificial
  CRISPR gRNA sequence
aaagaaaagaccaatgaatt

SEQ ID NO: 656855 - DNA, 20 bp, Artificial
  CRISPR gRNA sequence
aagaaaagaccaatgaattc

SEQ ID NO: 656856 - DNA, 20 bp, Artificial
  CRISPR gRNA sequence
agtcaaccatcctctaaaag

SEQ ID NO: 656857 - DNA, 20 bp, Artificial
  CRISPR gRNA sequence
taaaagaaagtatggagcca

SEQ ID NO: 656858 - DNA, 20 bp, Artificial
  CRISPR gRNA sequence
aaagaaagtatggagccaga

SEQ ID NO: 656859 - DNA, 20 bp, Artificial
  CRISPR gRNA sequence
atagtagctctgattacatc

SEQ ID NO: 656860 - DNA, 20 bp, Artificial
  CRISPR gRNA sequence
tgattacatccatttaactt

SEQ ID NO: 656861 - DNA, 20 bp, Artificial
  CRISPR gRNA sequence
attacatccatttaactttg

SEQ ID NO: 656862 - DNA, 20 bp, Artificial
  CRISPR gRNA sequence
catccatttaactttgaaat

SEQ ID NO: 656863 - DNA, 20 bp, Artificial
  CRISPR gRNA sequence
aactttgaaatttcaataaa

SEQ ID NO: 656864 - DNA, 20 bp, Artificial
  CRISPR gRNA sequence
actttgaaatttcaataaaa

SEQ ID NO: 656865 - DNA, 20 bp, Artificial
  CRISPR gRNA sequence
tgaaatttcaataaaattat

SEQ ID NO: 656866 - DNA, 20 bp, Artificial
  CRISPR gRNA sequence
gaaatttcaataaaattata

SEQ ID NO: 656867 - DNA, 20 bp, Artificial
  CRISPR gRNA sequence
aaatttcaataaaattatag

SEQ ID NO: 656868 - DNA, 20 bp, Artificial
  CRISPR gRNA sequence
caataaaattatagactcat

SEQ ID NO: 656869 - DNA, 20 bp, Artificial
  CRISPR gRNA sequence
aataaaattatagactcata

SEQ ID NO: 656870 - DNA, 20 bp, Artificial
  CRISPR gRNA sequence
tagactcataaaaatgatca

SEQ ID NO: 656871 - DNA, 20 bp, Artificial
  CRISPR gRNA sequence
ataaaaatgatcagctgtca

SEQ ID NO: 656872 - DNA, 20 bp, Artificial
  CRISPR gRNA sequence
tcatcaatgataaatactga

SEQ ID NO: 656873 - DNA, 20 bp, Artificial
  CRISPR gRNA sequence
aaatcaggcattttcatgta

SEQ ID NO: 656874 - DNA, 20 bp, Artificial
  CRISPR gRNA sequence
tcatgtacaaatgatatctt

SEQ ID NO: 656875 - DNA, 20 bp, Artificial
  CRISPR gRNA sequence
catgtacaaatgatatcttc

SEQ ID NO: 656876 - DNA, 20 bp, Artificial
  CRISPR gRNA sequence
atgtacaaatgatatcttca

SEQ ID NO: 656877 - DNA, 20 bp, Artificial
  CRISPR gRNA sequence
cagatttattgaatactatt

SEQ ID NO: 656878 - DNA, 20 bp, Artificial
  CRISPR gRNA sequence
agatttattgaatactattt

SEQ ID NO: 656879 - DNA, 20 bp, Artificial
  CRISPR gRNA sequence
attgaatactattttactat

SEQ ID NO: 656880 - DNA, 20 bp, Artificial
  CRISPR gRNA sequence
ttgaatactattttactata

SEQ ID NO: 656881 - DNA, 20 bp, Artificial
  CRISPR gRNA sequence
aatactattttactatagat

SEQ ID NO: 656882 - DNA, 20 bp, Artificial
  CRISPR gRNA sequence
ttttactatagatttagtca

SEQ ID NO: 656883 - DNA, 20 bp, Artificial
  CRISPR gRNA sequence
tactatagatttagtcaaaa

SEQ ID NO: 656884 - DNA, 20 bp, Artificial
  CRISPR gRNA sequence
actatagatttagtcaaaat

SEQ ID NO: 656885 - DNA, 20 bp, Artificial
  CRISPR gRNA sequence
ctatagatttagtcaaaata

SEQ ID NO: 656886 - DNA, 20 bp, Artificial
  CRISPR gRNA sequence
tagatttagtcaaaatataa

SEQ ID NO: 656887 - DNA, 20 bp, Artificial
  CRISPR gRNA sequence
agtcaaaatataaggtattt

SEQ ID NO: 656888 - DNA, 20 bp, Artificial
  CRISPR gRNA sequence
gtcaaaatataaggtatttt

SEQ ID NO: 656889 - DNA, 20 bp, Artificial
  CRISPR gRNA sequence
tctttttcttttattctttc

SEQ ID NO: 656890 - DNA, 20 bp, Artificial
  CRISPR gRNA sequence
ctttttcttttattctttct

SEQ ID NO: 656891 - DNA, 20 bp, Artificial
  CRISPR gRNA sequence
tttttcttttattctttctt

SEQ ID NO: 656892 - DNA, 20 bp, Artificial
  CRISPR gRNA sequence
tttcttttattctttctttt

SEQ ID NO: 656893 - DNA, 20 bp, Artificial
  CRISPR gRNA sequence
ttcttttattctttcttttt

SEQ ID NO: 656894 - DNA, 20 bp, Artificial
  CRISPR gRNA sequence
tcttttattctttctttttt

SEQ ID NO: 656895 - DNA, 20 bp, Artificial
  CRISPR gRNA sequence
cttttattctttcttttttc

SEQ ID NO: 656896 - DNA, 20 bp, Artificial
  CRISPR gRNA sequence
ttttattctttcttttttct

SEQ ID NO: 656897 - DNA, 20 bp, Artificial
  CRISPR gRNA sequence
ttattctttcttttttcttt

SEQ ID NO: 656898 - DNA, 20 bp, Artificial
  CRISPR gRNA sequence
tattctttcttttttctttt

SEQ ID NO: 656899 - DNA, 20 bp, Artificial
  CRISPR gRNA sequence
attctttcttttttcttttc

SEQ ID NO: 656900 - DNA, 20 bp, Artificial
  CRISPR gRNA sequence
ttctttcttttttcttttct

SEQ ID NO: 656901 - DNA, 20 bp, Artificial
  CRISPR gRNA sequence
tttcttttttcttttctttt

SEQ ID NO: 656902 - DNA, 20 bp, Artificial
  CRISPR gRNA sequence
tcttttttcttttctttttc

SEQ ID NO: 656903 - DNA, 20 bp, Artificial
  CRISPR gRNA sequence
cttttttcttttctttttct

SEQ ID NO: 656904 - DNA, 20 bp, Artificial
  CRISPR gRNA sequence
ttttttcttttctttttctt

SEQ ID NO: 656905 - DNA, 20 bp, Artificial
  CRISPR gRNA sequence
ttttcttttctttttctttt

SEQ ID NO: 656906 - DNA, 20 bp, Artificial
  CRISPR gRNA sequence
tttcttttctttttcttttt

SEQ ID NO: 656907 - DNA, 20 bp, Artificial
  CRISPR gRNA sequence
ttcttttctttttctttttc

SEQ ID NO: 656908 - DNA, 20 bp, Artificial
  CRISPR gRNA sequence
tcttttctttttctttttct

SEQ ID NO: 656909 - DNA, 20 bp, Artificial
  CRISPR gRNA sequence
cttttctttttctttttctt

SEQ ID NO: 656910 - DNA, 20 bp, Artificial
  CRISPR gRNA sequence
ttttctttttctttttcttt

SEQ ID NO: 656911 - DNA, 20 bp, Artificial
  CRISPR gRNA sequence
ttctttttctttttcttttt

SEQ ID NO: 656912 - DNA, 20 bp, Artificial
  CRISPR gRNA sequence
tctttttctttttctttttt

SEQ ID NO: 656913 - DNA, 20 bp, Artificial
  CRISPR gRNA sequence
ctttttctttttcttttttt

SEQ ID NO: 656914 - DNA, 20 bp, Artificial
  CRISPR gRNA sequence
tttttctttttctttttttt

SEQ ID NO: 656915 - DNA, 20 bp, Artificial
  CRISPR gRNA sequence
tttctttttctttttttttt

SEQ ID NO: 656916 - DNA, 20 bp, Artificial
  CRISPR gRNA sequence
ttctttttcttttttttttt

SEQ ID NO: 656917 - DNA, 20 bp, Artificial
  CRISPR gRNA sequence
tctttttctttttttttttt

SEQ ID NO: 656918 - DNA, 20 bp, Artificial
  CRISPR gRNA sequence
ctttttcttttttttttttt

SEQ ID NO: 656919 - DNA, 20 bp, Artificial
  CRISPR gRNA sequence
tttttctttttttttttttt

SEQ ID NO: 656920 - DNA, 20 bp, Artificial
  CRISPR gRNA sequence
tttctttttttttttttttt

SEQ ID NO: 656921 - DNA, 20 bp, Artificial
  CRISPR gRNA sequence
ttcttttttttttttttttt

SEQ ID NO: 656922 - DNA, 20 bp, Artificial
  CRISPR gRNA sequence
tctttttttttttttttttt

SEQ ID NO: 656923 - DNA, 20 bp, Artificial
  CRISPR gRNA sequence
cttttttttttttttttttt

SEQ ID NO: 656924 - DNA, 20 bp, Artificial
  CRISPR gRNA sequence
tttttttttttttttttttt

SEQ ID NO: 656925 - DNA, 20 bp, Artificial
  CRISPR gRNA sequence
tttttttttttttttttttg

SEQ ID NO: 656926 - DNA, 20 bp, Artificial
  CRISPR gRNA sequence
ttttttttttttttttttga

SEQ ID NO: 656927 - DNA, 20 bp, Artificial
  CRISPR gRNA sequence
tttttttttttttttttgag

SEQ ID NO: 656928 - DNA, 20 bp, Artificial
  CRISPR gRNA sequence
ttttttttttttttttgaga

SEQ ID NO: 656929 - DNA, 20 bp, Artificial
  CRISPR gRNA sequence
tttttttttttttttgagac

SEQ ID NO: 656930 - DNA, 20 bp, Artificial
  CRISPR gRNA sequence
ttttttttttttttgagaca

SEQ ID NO: 656931 - DNA, 20 bp, Artificial
  CRISPR gRNA sequence
tttttttttttttgagacag

SEQ ID NO: 656932 - DNA, 20 bp, Artificial
  CRISPR gRNA sequence
ttttttttttttgagacagt

SEQ ID NO: 656933 - DNA, 20 bp, Artificial
  CRISPR gRNA sequence
tttttttttttgagacagtg

SEQ ID NO: 656934 - DNA, 20 bp, Artificial
  CRISPR gRNA sequence
ttttttttttgagacagtgt

SEQ ID NO: 656935 - DNA, 20 bp, Artificial
  CRISPR gRNA sequence
tttttttttgagacagtgtc

SEQ ID NO: 656936 - DNA, 20 bp, Artificial
  CRISPR gRNA sequence
ttttttttgagacagtgtcc

SEQ ID NO: 656937 - DNA, 20 bp, Artificial
  CRISPR gRNA sequence
tttttttgagacagtgtccc

SEQ ID NO: 656938 - DNA, 20 bp, Artificial
  CRISPR gRNA sequence
ttttttgagacagtgtcccg

SEQ ID NO: 656939 - DNA, 20 bp, Artificial
  CRISPR gRNA sequence
tttttgagacagtgtcccgc

SEQ ID NO: 656940 - DNA, 20 bp, Artificial
  CRISPR gRNA sequence
ttttgagacagtgtcccgct

SEQ ID NO: 656941 - DNA, 20 bp, Artificial
  CRISPR gRNA sequence
tttgagacagtgtcccgctc

SEQ ID NO: 656942 - DNA, 20 bp, Artificial
  CRISPR gRNA sequence
ttgagacagtgtcccgctct

SEQ ID NO: 656943 - DNA, 20 bp, Artificial
  CRISPR gRNA sequence
tgagacagtgtcccgctctg

SEQ ID NO: 656944 - DNA, 20 bp, Artificial
  CRISPR gRNA sequence
gagacagtgtcccgctctgt

SEQ ID NO: 656945 - DNA, 20 bp, Artificial
  CRISPR gRNA sequence
agacagtgtcccgctctgtc

SEQ ID NO: 656946 - DNA, 20 bp, Artificial
  CRISPR gRNA sequence
tgtcacccaggctggagtgc

SEQ ID NO: 656947 - DNA, 20 bp, Artificial
  CRISPR gRNA sequence
tcacccaggctggagtgcag

SEQ ID NO: 656948 - DNA, 20 bp, Artificial
  CRISPR gRNA sequence
gagtgcagtggcgcgatctt

SEQ ID NO: 656949 - DNA, 20 bp, Artificial
  CRISPR gRNA sequence
ggctcactgcaacccttcac

SEQ ID NO: 656950 - DNA, 20 bp, Artificial
  CRISPR gRNA sequence
gctcactgcaacccttcact

SEQ ID NO: 656951 - DNA, 20 bp, Artificial
  CRISPR gRNA sequence
actgcaacccttcactccca

SEQ ID NO: 656952 - DNA, 20 bp, Artificial
  CRISPR gRNA sequence
caacccttcactcccaggtt

SEQ ID NO: 656953 - DNA, 20 bp, Artificial
  CRISPR gRNA sequence
cactcccaggttcaagcaat

SEQ ID NO: 656954 - DNA, 20 bp, Artificial
  CRISPR gRNA sequence
actcccaggttcaagcaatt

SEQ ID NO: 656955 - DNA, 20 bp, Artificial
  CRISPR gRNA sequence
ccaggttcaagcaattctcc

SEQ ID NO: 656956 - DNA, 20 bp, Artificial
  CRISPR gRNA sequence
aagcaattctcctgcctcag

SEQ ID NO: 656957 - DNA, 20 bp, Artificial
  CRISPR gRNA sequence
tcctgcctcagtctcccgag

SEQ ID NO: 656958 - DNA, 20 bp, Artificial
  CRISPR gRNA sequence
ctgcctcagtctcccgagta

SEQ ID NO: 656959 - DNA, 20 bp, Artificial
  CRISPR gRNA sequence
cctcagtctcccgagtagct

SEQ ID NO: 656960 - DNA, 20 bp, Artificial
  CRISPR gRNA sequence
agtctcccgagtagctggga

SEQ ID NO: 656961 - DNA, 20 bp, Artificial
  CRISPR gRNA sequence
ccgagtagctgggattacag

SEQ ID NO: 656962 - DNA, 20 bp, Artificial
  CRISPR gRNA sequence
ggattacaggcgcccatcac

SEQ ID NO: 656963 - DNA, 20 bp, Artificial
  CRISPR gRNA sequence
caggcgcccatcaccacgtc

SEQ ID NO: 656964 - DNA, 20 bp, Artificial
  CRISPR gRNA sequence
atttttttattttttagtgt

SEQ ID NO: 656965 - DNA, 20 bp, Artificial
  CRISPR gRNA sequence
ttttattttttagtgtagac

SEQ ID NO: 656966 - DNA, 20 bp, Artificial
  CRISPR gRNA sequence
tttattttttagtgtagaca

SEQ ID NO: 656967 - DNA, 20 bp, Artificial
  CRISPR gRNA sequence
ttattttttagtgtagacag

SEQ ID NO: 656968 - DNA, 20 bp, Artificial
  CRISPR gRNA sequence
tattttttagtgtagacagg

SEQ ID NO: 656969 - DNA, 20 bp, Artificial
  CRISPR gRNA sequence
attttttagtgtagacaggg

SEQ ID NO: 656970 - DNA, 20 bp, Artificial
  CRISPR gRNA sequence
ttttttagtgtagacagggt

SEQ ID NO: 656971 - DNA, 20 bp, Artificial
  CRISPR gRNA sequence
tttagtgtagacagggtttc

SEQ ID NO: 656972 - DNA, 20 bp, Artificial
  CRISPR gRNA sequence
ttagtgtagacagggtttca

SEQ ID NO: 656973 - DNA, 20 bp, Artificial
  CRISPR gRNA sequence
tagtgtagacagggtttcac

SEQ ID NO: 656974 - DNA, 20 bp, Artificial
  CRISPR gRNA sequence
agtgtagacagggtttcact

SEQ ID NO: 656975 - DNA, 20 bp, Artificial
  CRISPR gRNA sequence
gtgtagacagggtttcacta

SEQ ID NO: 656976 - DNA, 20 bp, Artificial
  CRISPR gRNA sequence
cactaagttggtcaggctgg

SEQ ID NO: 656977 - DNA, 20 bp, Artificial
  CRISPR gRNA sequence
actaagttggtcaggctggt

SEQ ID NO: 656978 - DNA, 20 bp, Artificial
  CRISPR gRNA sequence
agttggtcaggctggtctca

SEQ ID NO: 656979 - DNA, 20 bp, Artificial
  CRISPR gRNA sequence
gtcaggctggtctcaaactc

SEQ ID NO: 656980 - DNA, 20 bp, Artificial
  CRISPR gRNA sequence
gtctcaaactcttgacctcg

SEQ ID NO: 656981 - DNA, 20 bp, Artificial
  CRISPR gRNA sequence
aaactcttgacctcgggcta

SEQ ID NO: 656982 - DNA, 20 bp, Artificial
  CRISPR gRNA sequence
ttgacctcgggctatccacc

SEQ ID NO: 656983 - DNA, 20 bp, Artificial
  CRISPR gRNA sequence
gacctcgggctatccacctg

SEQ ID NO: 656984 - DNA, 20 bp, Artificial
  CRISPR gRNA sequence
acctcgggctatccacctgc

SEQ ID NO: 656985 - DNA, 20 bp, Artificial
  CRISPR gRNA sequence
gggctatccacctgcctcag

SEQ ID NO: 656986 - DNA, 20 bp, Artificial
  CRISPR gRNA sequence
tccacctgcctcagcctccc

SEQ ID NO: 656987 - DNA, 20 bp, Artificial
  CRISPR gRNA sequence
cctcagcctcccaaagtgct

SEQ ID NO: 656988 - DNA, 20 bp, Artificial
  CRISPR gRNA sequence
agcctcccaaagtgctggat

SEQ ID NO: 656989 - DNA, 20 bp, Artificial
  CRISPR gRNA sequence
ccaaagtgctggattacagg

SEQ ID NO: 656990 - DNA, 20 bp, Artificial
  CRISPR gRNA sequence
gattacaggcataaagccac

SEQ ID NO: 656991 - DNA, 20 bp, Artificial
  CRISPR gRNA sequence
caggcataaagccactgccc

SEQ ID NO: 656992 - DNA, 20 bp, Artificial
  CRISPR gRNA sequence
cccccggctctttcttttct

SEQ ID NO: 656993 - DNA, 20 bp, Artificial
  CRISPR gRNA sequence
tttcttttcttttttctttc

SEQ ID NO: 656994 - DNA, 20 bp, Artificial
  CRISPR gRNA sequence
tcttttcttttttctttctt

SEQ ID NO: 656995 - DNA, 20 bp, Artificial
  CRISPR gRNA sequence
cttttcttttttctttcttt

SEQ ID NO: 656996 - DNA, 20 bp, Artificial
  CRISPR gRNA sequence
ttttcttttttctttctttc

SEQ ID NO: 656997 - DNA, 20 bp, Artificial
  CRISPR gRNA sequence
ttcttttttctttctttctt

SEQ ID NO: 656998 - DNA, 20 bp, Artificial
  CRISPR gRNA sequence
tcttttttctttctttcttt

SEQ ID NO: 656999 - DNA, 20 bp, Artificial
  CRISPR gRNA sequence
cttttttctttctttctttt

SEQ ID NO: 657000 - DNA, 20 bp, Artificial
  CRISPR gRNA sequence
ttttttctttctttcttttt

SEQ ID NO: 657001 - DNA, 20 bp, Artificial
  CRISPR gRNA sequence
ttttctttctttcttttttt

SEQ ID NO: 657002 - DNA, 20 bp, Artificial
  CRISPR gRNA sequence
tttctttctttctttttttt

SEQ ID NO: 657003 - DNA, 20 bp, Artificial
  CRISPR gRNA sequence
ttctttctttcttttttttt

SEQ ID NO: 657004 - DNA, 20 bp, Artificial
  CRISPR gRNA sequence
tctttctttctttttttttt

SEQ ID NO: 657005 - DNA, 20 bp, Artificial
  CRISPR gRNA sequence
ctttctttcttttttttttt

SEQ ID NO: 657006 - DNA, 20 bp, Artificial
  CRISPR gRNA sequence
tttctttctttttttttttt

SEQ ID NO: 657007 - DNA, 20 bp, Artificial
  CRISPR gRNA sequence
tctttctttttttttttttt

SEQ ID NO: 657008 - DNA, 20 bp, Artificial
  CRISPR gRNA sequence
ctttcttttttttttttttg

SEQ ID NO: 657009 - DNA, 20 bp, Artificial
  CRISPR gRNA sequence
tttcttttttttttttttga

SEQ ID NO: 657010 - DNA, 20 bp, Artificial
  CRISPR gRNA sequence
tcttttttttttttttgaaa

SEQ ID NO: 657011 - DNA, 20 bp, Artificial
  CRISPR gRNA sequence
cttttttttttttttgaaac

SEQ ID NO: 657012 - DNA, 20 bp, Artificial
  CRISPR gRNA sequence
ttttttttttttttgaaacg

SEQ ID NO: 657013 - DNA, 20 bp, Artificial
  CRISPR gRNA sequence
ttttttttttttgaaacgga

SEQ ID NO: 657014 - DNA, 20 bp, Artificial
  CRISPR gRNA sequence
tttttttttttgaaacggag

SEQ ID NO: 657015 - DNA, 20 bp, Artificial
  CRISPR gRNA sequence
ttttttttttgaaacggagt

SEQ ID NO: 657016 - DNA, 20 bp, Artificial
  CRISPR gRNA sequence
tttttttttgaaacggagtc

SEQ ID NO: 657017 - DNA, 20 bp, Artificial
  CRISPR gRNA sequence
ttttttttgaaacggagtct

SEQ ID NO: 657018 - DNA, 20 bp, Artificial
  CRISPR gRNA sequence
tttttttgaaacggagtctc

SEQ ID NO: 657019 - DNA, 20 bp, Artificial
  CRISPR gRNA sequence
ttttttgaaacggagtctcg

SEQ ID NO: 657020 - DNA, 20 bp, Artificial
  CRISPR gRNA sequence
tttttgaaacggagtctcgc

SEQ ID NO: 657021 - DNA, 20 bp, Artificial
  CRISPR gRNA sequence
ttttgaaacggagtctcgct

SEQ ID NO: 657022 - DNA, 20 bp, Artificial
  CRISPR gRNA sequence
tttgaaacggagtctcgctc

SEQ ID NO: 657023 - DNA, 20 bp, Artificial
  CRISPR gRNA sequence
ttgaaacggagtctcgctct

SEQ ID NO: 657024 - DNA, 20 bp, Artificial
  CRISPR gRNA sequence
tgaaacggagtctcgctctg

SEQ ID NO: 657025 - DNA, 20 bp, Artificial
  CRISPR gRNA sequence
gaaacggagtctcgctctgt

SEQ ID NO: 657026 - DNA, 20 bp, Artificial
  CRISPR gRNA sequence
aaacggagtctcgctctgta

SEQ ID NO: 657027 - DNA, 20 bp, Artificial
  CRISPR gRNA sequence
gctctgtagcccaggctgga

SEQ ID NO: 657028 - DNA, 20 bp, Artificial
  CRISPR gRNA sequence
tgtagcccaggctggagtgc

SEQ ID NO: 657029 - DNA, 20 bp, Artificial
  CRISPR gRNA sequence
tagcccaggctggagtgccg

SEQ ID NO: 657030 - DNA, 20 bp, Artificial
  CRISPR gRNA sequence
gagtgccgtggcgcgatctg

SEQ ID NO: 657031 - DNA, 20 bp, Artificial
  CRISPR gRNA sequence
gctcactgcaacctccgcct

SEQ ID NO: 657032 - DNA, 20 bp, Artificial
  CRISPR gRNA sequence
actgcaacctccgcctcctg

SEQ ID NO: 657033 - DNA, 20 bp, Artificial
  CRISPR gRNA sequence
caacctccgcctcctgggtt

SEQ ID NO: 657034 - DNA, 20 bp, Artificial
  CRISPR gRNA sequence
cgcctcctgggttcaagcaa

SEQ ID NO: 657035 - DNA, 20 bp, Artificial
  CRISPR gRNA sequence
ctgggttcaagcaattctcc

SEQ ID NO: 657036 - DNA, 20 bp, Artificial
  CRISPR gRNA sequence
ggttcaagcaattctcctgc

SEQ ID NO: 657037 - DNA, 20 bp, Artificial
  CRISPR gRNA sequence
aagcaattctcctgcctcag

SEQ ID NO: 657038 - DNA, 20 bp, Artificial
  CRISPR gRNA sequence
tcctgcctcagcctcctgag

SEQ ID NO: 657039 - DNA, 20 bp, Artificial
  CRISPR gRNA sequence
ctgcctcagcctcctgagta

SEQ ID NO: 657040 - DNA, 20 bp, Artificial
  CRISPR gRNA sequence
cctcagcctcctgagtagct

SEQ ID NO: 657041 - DNA, 20 bp, Artificial
  CRISPR gRNA sequence
agcctcctgagtagctggga

SEQ ID NO: 657042 - DNA, 20 bp, Artificial
  CRISPR gRNA sequence
ctgagtagctgggattacag

SEQ ID NO: 657043 - DNA, 20 bp, Artificial
  CRISPR gRNA sequence
agtagctgggattacaggca

SEQ ID NO: 657044 - DNA, 20 bp, Artificial
  CRISPR gRNA sequence
ggattacaggcatgccacca

SEQ ID NO: 657045 - DNA, 20 bp, Artificial
  CRISPR gRNA sequence
caggcatgccaccatgcccg

SEQ ID NO: 657046 - DNA, 20 bp, Artificial
  CRISPR gRNA sequence
atttttttttgcatttttag

SEQ ID NO: 657047 - DNA, 20 bp, Artificial
  CRISPR gRNA sequence
ttttttgcatttttagtgga

SEQ ID NO: 657048 - DNA, 20 bp, Artificial
  CRISPR gRNA sequence
tttttgcatttttagtggag

SEQ ID NO: 657049 - DNA, 20 bp, Artificial
  CRISPR gRNA sequence
ttttgcatttttagtggaga

SEQ ID NO: 657050 - DNA, 20 bp, Artificial
  CRISPR gRNA sequence
tttgcatttttagtggagac

SEQ ID NO: 657051 - DNA, 20 bp, Artificial
  CRISPR gRNA sequence
ttgcatttttagtggagacg

SEQ ID NO: 657052 - DNA, 20 bp, Artificial
  CRISPR gRNA sequence
tgcatttttagtggagacgg

SEQ ID NO: 657053 - DNA, 20 bp, Artificial
  CRISPR gRNA sequence
gcatttttagtggagacggg

SEQ ID NO: 657054 - DNA, 20 bp, Artificial
  CRISPR gRNA sequence
catttttagtggagacgggg

SEQ ID NO: 657055 - DNA, 20 bp, Artificial
  CRISPR gRNA sequence
ttagtggagacggggtttca

SEQ ID NO: 657056 - DNA, 20 bp, Artificial
  CRISPR gRNA sequence
tagtggagacggggtttcac

SEQ ID NO: 657057 - DNA, 20 bp, Artificial
  CRISPR gRNA sequence
agtggagacggggtttcacc

SEQ ID NO: 657058 - DNA, 20 bp, Artificial
  CRISPR gRNA sequence
gtggagacggggtttcacca

SEQ ID NO: 657059 - DNA, 20 bp, Artificial
  CRISPR gRNA sequence
caccatgttggtcaggcgct

SEQ ID NO: 657060 - DNA, 20 bp, Artificial
  CRISPR gRNA sequence
accatgttggtcaggcgctc

SEQ ID NO: 657061 - DNA, 20 bp, Artificial
  CRISPR gRNA sequence
gtcaggcgctctcgtactcc

SEQ ID NO: 657062 - DNA, 20 bp, Artificial
  CRISPR gRNA sequence
tcgtactcctgagcttgtga

SEQ ID NO: 657063 - DNA, 20 bp, Artificial
  CRISPR gRNA sequence
gtactcctgagcttgtgagc

SEQ ID NO: 657064 - DNA, 20 bp, Artificial
  CRISPR gRNA sequence
ctgagcttgtgagccaccgt

SEQ ID NO: 657065 - DNA, 20 bp, Artificial
  CRISPR gRNA sequence
agcttgtgagccaccgtgcc

SEQ ID NO: 657066 - DNA, 20 bp, Artificial
  CRISPR gRNA sequence
gtgagccaccgtgcccggca

SEQ ID NO: 657067 - DNA, 20 bp, Artificial
  CRISPR gRNA sequence
tgagccaccgtgcccggcat

SEQ ID NO: 657068 - DNA, 20 bp, Artificial
  CRISPR gRNA sequence
tattcttttcttttcttttc

SEQ ID NO: 657069 - DNA, 20 bp, Artificial
  CRISPR gRNA sequence
ttttcttttcttttcatctc

SEQ ID NO: 657070 - DNA, 20 bp, Artificial
  CRISPR gRNA sequence
ttcttttcttttcatctctt

SEQ ID NO: 657071 - DNA, 20 bp, Artificial
  CRISPR gRNA sequence
tcttttcttttcatctcttg

SEQ ID NO: 657072 - DNA, 20 bp, Artificial
  CRISPR gRNA sequence
cttttcttttcatctcttgt

SEQ ID NO: 657073 - DNA, 20 bp, Artificial
  CRISPR gRNA sequence
ttttcttttcatctcttgtc

SEQ ID NO: 657074 - DNA, 20 bp, Artificial
  CRISPR gRNA sequence
ttcttttcatctcttgtctt

SEQ ID NO: 657075 - DNA, 20 bp, Artificial
  CRISPR gRNA sequence
tcttttcatctcttgtcttg

SEQ ID NO: 657076 - DNA, 20 bp, Artificial
  CRISPR gRNA sequence
cttttcatctcttgtcttgt

SEQ ID NO: 657077 - DNA, 20 bp, Artificial
  CRISPR gRNA sequence
ttttcatctcttgtcttgtc

SEQ ID NO: 657078 - DNA, 20 bp, Artificial
  CRISPR gRNA sequence
ttcatctcttgtcttgtctt

SEQ ID NO: 657079 - DNA, 20 bp, Artificial
  CRISPR gRNA sequence
tcatctcttgtcttgtcttc

SEQ ID NO: 657080 - DNA, 20 bp, Artificial
  CRISPR gRNA sequence
catctcttgtcttgtcttct

SEQ ID NO: 657081 - DNA, 20 bp, Artificial
  CRISPR gRNA sequence
atctcttgtcttgtcttctc

SEQ ID NO: 657082 - DNA, 20 bp, Artificial
  CRISPR gRNA sequence
ttgtcttgtcttctcttctc

SEQ ID NO: 657083 - DNA, 20 bp, Artificial
  CRISPR gRNA sequence
gtcttgtcttctcttctctt

SEQ ID NO: 657084 - DNA, 20 bp, Artificial
  CRISPR gRNA sequence
tcttgtcttctcttctcttt

SEQ ID NO: 657085 - DNA, 20 bp, Artificial
  CRISPR gRNA sequence
gtcttctcttctcttttctt

SEQ ID NO: 657086 - DNA, 20 bp, Artificial
  CRISPR gRNA sequence
tcttctcttctcttttcttt

SEQ ID NO: 657087 - DNA, 20 bp, Artificial
  CRISPR gRNA sequence
ctcttctcttttctttcctt

SEQ ID NO: 657088 - DNA, 20 bp, Artificial
  CRISPR gRNA sequence
tcttctcttttctttccttt

SEQ ID NO: 657089 - DNA, 20 bp, Artificial
  CRISPR gRNA sequence
ttctcttttctttccttttc

SEQ ID NO: 657090 - DNA, 20 bp, Artificial
  CRISPR gRNA sequence
ctcttttctttccttttcct

SEQ ID NO: 657091 - DNA, 20 bp, Artificial
  CRISPR gRNA sequence
tcttttctttccttttcctt

SEQ ID NO: 657092 - DNA, 20 bp, Artificial
  CRISPR gRNA sequence
ttttctttccttttcctttc

SEQ ID NO: 657093 - DNA, 20 bp, Artificial
  CRISPR gRNA sequence
ttctttccttttcctttctt

SEQ ID NO: 657094 - DNA, 20 bp, Artificial
  CRISPR gRNA sequence
tctttccttttcctttcttc

SEQ ID NO: 657095 - DNA, 20 bp, Artificial
  CRISPR gRNA sequence
ctttccttttcctttcttct

SEQ ID NO: 657096 - DNA, 20 bp, Artificial
  CRISPR gRNA sequence
tttccttttcctttcttctt

SEQ ID NO: 657097 - DNA, 20 bp, Artificial
  CRISPR gRNA sequence
tccttttcctttcttctttc

SEQ ID NO: 657098 - DNA, 20 bp, Artificial
  CRISPR gRNA sequence
ccttttcctttcttctttct

SEQ ID NO: 657099 - DNA, 20 bp, Artificial
  CRISPR gRNA sequence
cttttcctttcttctttctc

SEQ ID NO: 657100 - DNA, 20 bp, Artificial
  CRISPR gRNA sequence
ttcctttcttctttctctct

SEQ ID NO: 657101 - DNA, 20 bp, Artificial
  CRISPR gRNA sequence
tcctttcttctttctctctt

SEQ ID NO: 657102 - DNA, 20 bp, Artificial
  CRISPR gRNA sequence
cctttcttctttctctcttt

SEQ ID NO: 657103 - DNA, 20 bp, Artificial
  CRISPR gRNA sequence
ctttcttctttctctctttc

SEQ ID NO: 657104 - DNA, 20 bp, Artificial
  CRISPR gRNA sequence
tcttctttctctctttcttt

SEQ ID NO: 657105 - DNA, 20 bp, Artificial
  CRISPR gRNA sequence
cttctttctctctttctttt

SEQ ID NO: 657106 - DNA, 20 bp, Artificial
  CRISPR gRNA sequence
ttctttctctctttcttttc

SEQ ID NO: 657107 - DNA, 20 bp, Artificial
  CRISPR gRNA sequence
ctttctctctttcttttctt

SEQ ID NO: 657108 - DNA, 20 bp, Artificial
  CRISPR gRNA sequence
tttctctctttcttttcttc

SEQ ID NO: 657109 - DNA, 20 bp, Artificial
  CRISPR gRNA sequence
tctctctttcttttcttcct

SEQ ID NO: 657110 - DNA, 20 bp, Artificial
  CRISPR gRNA sequence
ctctctttcttttcttcctt

SEQ ID NO: 657111 - DNA, 20 bp, Artificial
  CRISPR gRNA sequence
tctctttcttttcttccttt

SEQ ID NO: 657112 - DNA, 20 bp, Artificial
  CRISPR gRNA sequence
tctttcttttcttcctttcc

SEQ ID NO: 657113 - DNA, 20 bp, Artificial
  CRISPR gRNA sequence
tttcttttcttcctttcctt

SEQ ID NO: 657114 - DNA, 20 bp, Artificial
  CRISPR gRNA sequence
tcttttcttcctttcctttt

SEQ ID NO: 657115 - DNA, 20 bp, Artificial
  CRISPR gRNA sequence
cttttcttcctttccttttt

SEQ ID NO: 657116 - DNA, 20 bp, Artificial
  CRISPR gRNA sequence
ttttcttcctttcctttttt

SEQ ID NO: 657117 - DNA, 20 bp, Artificial
  CRISPR gRNA sequence
ttcttcctttccttttttcc

SEQ ID NO: 657118 - DNA, 20 bp, Artificial
  CRISPR gRNA sequence
tcttcctttccttttttcct

SEQ ID NO: 657119 - DNA, 20 bp, Artificial
  CRISPR gRNA sequence
cttcctttccttttttcctt

SEQ ID NO: 657120 - DNA, 20 bp, Artificial
  CRISPR gRNA sequence
ttcctttccttttttccttt

SEQ ID NO: 657121 - DNA, 20 bp, Artificial
  CRISPR gRNA sequence
cctttccttttttccttttt

SEQ ID NO: 657122 - DNA, 20 bp, Artificial
  CRISPR gRNA sequence
ctttccttttttcctttttc

SEQ ID NO: 657123 - DNA, 20 bp, Artificial
  CRISPR gRNA sequence
tccttttttcctttttcttt

SEQ ID NO: 657124 - DNA, 20 bp, Artificial
  CRISPR gRNA sequence
ccttttttcctttttctttc

SEQ ID NO: 657125 - DNA, 20 bp, Artificial
  CRISPR gRNA sequence
cttttttcctttttctttcc

SEQ ID NO: 657126 - DNA, 20 bp, Artificial
  CRISPR gRNA sequence
ttttcctttttctttccttt

SEQ ID NO: 657127 - DNA, 20 bp, Artificial
  CRISPR gRNA sequence
tttcctttttctttcctttt

SEQ ID NO: 657128 - DNA, 20 bp, Artificial
  CRISPR gRNA sequence
ttcctttttctttccttttc

SEQ ID NO: 657129 - DNA, 20 bp, Artificial
  CRISPR gRNA sequence
tcctttttctttccttttcc

SEQ ID NO: 657130 - DNA, 20 bp, Artificial
  CRISPR gRNA sequence
cctttttctttccttttcct

SEQ ID NO: 657131 - DNA, 20 bp, Artificial
  CRISPR gRNA sequence
ctttttctttccttttcctt

SEQ ID NO: 657132 - DNA, 20 bp, Artificial
  CRISPR gRNA sequence
tttctttccttttcctttcc

SEQ ID NO: 657133 - DNA, 20 bp, Artificial
  CRISPR gRNA sequence
ttctttccttttcctttcct

SEQ ID NO: 657134 - DNA, 20 bp, Artificial
  CRISPR gRNA sequence
tctttccttttcctttcctg

SEQ ID NO: 657135 - DNA, 20 bp, Artificial
  CRISPR gRNA sequence
ctttccttttcctttcctga

SEQ ID NO: 657136 - DNA, 20 bp, Artificial
  CRISPR gRNA sequence
tttccttttcctttcctgag

SEQ ID NO: 657137 - DNA, 20 bp, Artificial
  CRISPR gRNA sequence
tccttttcctttcctgagat

SEQ ID NO: 657138 - DNA, 20 bp, Artificial
  CRISPR gRNA sequence
ccttttcctttcctgagatg

SEQ ID NO: 657139 - DNA, 20 bp, Artificial
  CRISPR gRNA sequence
cttttcctttcctgagatgg

SEQ ID NO: 657140 - DNA, 20 bp, Artificial
  CRISPR gRNA sequence
ttcctttcctgagatggggt

SEQ ID NO: 657141 - DNA, 20 bp, Artificial
  CRISPR gRNA sequence
tcctttcctgagatggggtc

SEQ ID NO: 657142 - DNA, 20 bp, Artificial
  CRISPR gRNA sequence
cctttcctgagatggggtct

SEQ ID NO: 657143 - DNA, 20 bp, Artificial
  CRISPR gRNA sequence
ctttcctgagatggggtctt

SEQ ID NO: 657144 - DNA, 20 bp, Artificial
  CRISPR gRNA sequence
tcctgagatggggtcttgtt

SEQ ID NO: 657145 - DNA, 20 bp, Artificial
  CRISPR gRNA sequence
cctgagatggggtcttgttc

SEQ ID NO: 657146 - DNA, 20 bp, Artificial
  CRISPR gRNA sequence
ctgagatggggtcttgttct

SEQ ID NO: 657147 - DNA, 20 bp, Artificial
  CRISPR gRNA sequence
agatggggtcttgttctgtt

SEQ ID NO: 657148 - DNA, 20 bp, Artificial
  CRISPR gRNA sequence
gttctgttgttcaggctgga

SEQ ID NO: 657149 - DNA, 20 bp, Artificial
  CRISPR gRNA sequence
ttctgttgttcaggctggag

SEQ ID NO: 657150 - DNA, 20 bp, Artificial
  CRISPR gRNA sequence
tgttgttcaggctggagtac

SEQ ID NO: 657151 - DNA, 20 bp, Artificial
  CRISPR gRNA sequence
ttgttcaggctggagtacgg

SEQ ID NO: 657152 - DNA, 20 bp, Artificial
  CRISPR gRNA sequence
ttcaggctggagtacggtgt

SEQ ID NO: 657153 - DNA, 20 bp, Artificial
  CRISPR gRNA sequence
aggctggagtacggtgtcac

SEQ ID NO: 657154 - DNA, 20 bp, Artificial
  CRISPR gRNA sequence
gagtacggtgtcacgattat

SEQ ID NO: 657155 - DNA, 20 bp, Artificial
  CRISPR gRNA sequence
tagctcagtgcagcctggaa

SEQ ID NO: 657156 - DNA, 20 bp, Artificial
  CRISPR gRNA sequence
agtgcagcctggaactcctg

SEQ ID NO: 657157 - DNA, 20 bp, Artificial
  CRISPR gRNA sequence
gaactcctgggctcaagcaa

SEQ ID NO: 657158 - DNA, 20 bp, Artificial
  CRISPR gRNA sequence
ctgggctcaagcaatcttct

SEQ ID NO: 657159 - DNA, 20 bp, Artificial
  CRISPR gRNA sequence
ggctcaagcaatcttctcaa

SEQ ID NO: 657160 - DNA, 20 bp, Artificial
  CRISPR gRNA sequence
aagcaatcttctcaagtatc

SEQ ID NO: 657161 - DNA, 20 bp, Artificial
  CRISPR gRNA sequence
ctcaagtatctggggctaca

SEQ ID NO: 657162 - DNA, 20 bp, Artificial
  CRISPR gRNA sequence
tcaagtatctggggctacag

SEQ ID NO: 657163 - DNA, 20 bp, Artificial
  CRISPR gRNA sequence
aagtatctggggctacaggt

SEQ ID NO: 657164 - DNA, 20 bp, Artificial
  CRISPR gRNA sequence
gggctacaggtgcatgccac

SEQ ID NO: 657165 - DNA, 20 bp, Artificial
  CRISPR gRNA sequence
caggtgcatgccaccatgcc

SEQ ID NO: 657166 - DNA, 20 bp, Artificial
  CRISPR gRNA sequence
atttttaacaattttttttt

SEQ ID NO: 657167 - DNA, 20 bp, Artificial
  CRISPR gRNA sequence
ttaacaatttttttttagag

SEQ ID NO: 657168 - DNA, 20 bp, Artificial
  CRISPR gRNA sequence
taacaatttttttttagagt

SEQ ID NO: 657169 - DNA, 20 bp, Artificial
  CRISPR gRNA sequence
aacaatttttttttagagtc

SEQ ID NO: 657170 - DNA, 20 bp, Artificial
  CRISPR gRNA sequence
acaatttttttttagagtca

SEQ ID NO: 657171 - DNA, 20 bp, Artificial
  CRISPR gRNA sequence
ttttttagagtcagggtctc

SEQ ID NO: 657172 - DNA, 20 bp, Artificial
  CRISPR gRNA sequence
tttttagagtcagggtctca

SEQ ID NO: 657173 - DNA, 20 bp, Artificial
  CRISPR gRNA sequence
ttttagagtcagggtctcac

SEQ ID NO: 657174 - DNA, 20 bp, Artificial
  CRISPR gRNA sequence
tttagagtcagggtctcact

SEQ ID NO: 657175 - DNA, 20 bp, Artificial
  CRISPR gRNA sequence
ttagagtcagggtctcacta

SEQ ID NO: 657176 - DNA, 20 bp, Artificial
  CRISPR gRNA sequence
tagagtcagggtctcactat

SEQ ID NO: 657177 - DNA, 20 bp, Artificial
  CRISPR gRNA sequence
agagtcagggtctcactatc

SEQ ID NO: 657178 - DNA, 20 bp, Artificial
  CRISPR gRNA sequence
gagtcagggtctcactatct

SEQ ID NO: 657179 - DNA, 20 bp, Artificial
  CRISPR gRNA sequence
actatcttactgtgttgtcc

SEQ ID NO: 657180 - DNA, 20 bp, Artificial
  CRISPR gRNA sequence
tcttactgtgttgtccaggc

SEQ ID NO: 657181 - DNA, 20 bp, Artificial
  CRISPR gRNA sequence
actgtgttgtccaggctggt

SEQ ID NO: 657182 - DNA, 20 bp, Artificial
  CRISPR gRNA sequence
ctgtgttgtccaggctggtc

SEQ ID NO: 657183 - DNA, 20 bp, Artificial
  CRISPR gRNA sequence
tgttgtccaggctggtcttg

SEQ ID NO: 657184 - DNA, 20 bp, Artificial
  CRISPR gRNA sequence
tccaggctggtcttgaactc

SEQ ID NO: 657185 - DNA, 20 bp, Artificial
  CRISPR gRNA sequence
gtcttgaactcctggcctca

SEQ ID NO: 657186 - DNA, 20 bp, Artificial
  CRISPR gRNA sequence
gaactcctggcctcaagtga

SEQ ID NO: 657187 - DNA, 20 bp, Artificial
  CRISPR gRNA sequence
aactcctggcctcaagtgat

SEQ ID NO: 657188 - DNA, 20 bp, Artificial
  CRISPR gRNA sequence
ctggcctcaagtgattctcc

SEQ ID NO: 657189 - DNA, 20 bp, Artificial
  CRISPR gRNA sequence
gcctcaagtgattctcccgc

SEQ ID NO: 657190 - DNA, 20 bp, Artificial
  CRISPR gRNA sequence
aagtgattctcccgcctcag

SEQ ID NO: 657191 - DNA, 20 bp, Artificial
  CRISPR gRNA sequence
tcccgcctcagcctcctgag

SEQ ID NO: 657192 - DNA, 20 bp, Artificial
  CRISPR gRNA sequence
ccgcctcagcctcctgagta

SEQ ID NO: 657193 - DNA, 20 bp, Artificial
  CRISPR gRNA sequence
agcctcctgagtagctgagt

SEQ ID NO: 657194 - DNA, 20 bp, Artificial
  CRISPR gRNA sequence
ctgagtagctgagtttacag

SEQ ID NO: 657195 - DNA, 20 bp, Artificial
  CRISPR gRNA sequence
agtagctgagtttacaggtg

SEQ ID NO: 657196 - DNA, 20 bp, Artificial
  CRISPR gRNA sequence
agtttacaggtgtgagccac

SEQ ID NO: 657197 - DNA, 20 bp, Artificial
  CRISPR gRNA sequence
acaggtgtgagccaccacac

SEQ ID NO: 657198 - DNA, 20 bp, Artificial
  CRISPR gRNA sequence
caggtgtgagccaccacact

SEQ ID NO: 657199 - DNA, 20 bp, Artificial
  CRISPR gRNA sequence
ggctaggttgtttacagtgg

SEQ ID NO: 657200 - DNA, 20 bp, Artificial
  CRISPR gRNA sequence
gctaggttgtttacagtggc

SEQ ID NO: 657201 - DNA, 20 bp, Artificial
  CRISPR gRNA sequence
ggttgtttacagtggcattt

SEQ ID NO: 657202 - DNA, 20 bp, Artificial
  CRISPR gRNA sequence
tttacagtggcatttccaaa

SEQ ID NO: 657203 - DNA, 20 bp, Artificial
  CRISPR gRNA sequence
acagtggcatttccaaataa

SEQ ID NO: 657204 - DNA, 20 bp, Artificial
  CRISPR gRNA sequence
cagtggcatttccaaataat

SEQ ID NO: 657205 - DNA, 20 bp, Artificial
  CRISPR gRNA sequence
ccaaataatgttatatactc

SEQ ID NO: 657206 - DNA, 20 bp, Artificial
  CRISPR gRNA sequence
caaataatgttatatactct

SEQ ID NO: 657207 - DNA, 20 bp, Artificial
  CRISPR gRNA sequence
tatactctgaattgttttat

SEQ ID NO: 657208 - DNA, 20 bp, Artificial
  CRISPR gRNA sequence
tgaattgttttatgagtaat

SEQ ID NO: 657209 - DNA, 20 bp, Artificial
  CRISPR gRNA sequence
aattgttttatgagtaatat

SEQ ID NO: 657210 - DNA, 20 bp, Artificial
  CRISPR gRNA sequence
ttttatgagtaatattcatt

SEQ ID NO: 657211 - DNA, 20 bp, Artificial
  CRISPR gRNA sequence
tatgagtaatattcattcat

SEQ ID NO: 657212 - DNA, 20 bp, Artificial
  CRISPR gRNA sequence
atgagtaatattcattcata

SEQ ID NO: 657213 - DNA, 20 bp, Artificial
  CRISPR gRNA sequence
tgagtaatattcattcatag

SEQ ID NO: 657214 - DNA, 20 bp, Artificial
  CRISPR gRNA sequence
attcatagcatgaagtgtca

SEQ ID NO: 657215 - DNA, 20 bp, Artificial
  CRISPR gRNA sequence
atagcatgaagtgtcataca

SEQ ID NO: 657216 - DNA, 20 bp, Artificial
  CRISPR gRNA sequence
aataatgtacatataaatat

SEQ ID NO: 657217 - DNA, 20 bp, Artificial
  CRISPR gRNA sequence
aaatgacatatcaatattaa

SEQ ID NO: 657218 - DNA, 20 bp, Artificial
  CRISPR gRNA sequence
aggagacattgtggcatctg

SEQ ID NO: 657219 - DNA, 20 bp, Artificial
  CRISPR gRNA sequence
tggcatctgatggcaaaaga

SEQ ID NO: 657220 - DNA, 20 bp, Artificial
  CRISPR gRNA sequence
atggcaaaagaaatctgagt

SEQ ID NO: 657221 - DNA, 20 bp, Artificial
  CRISPR gRNA sequence
agtagaatgagttaaaacat

SEQ ID NO: 657222 - DNA, 20 bp, Artificial
  CRISPR gRNA sequence
aaacatagattttcaattct

SEQ ID NO: 657223 - DNA, 20 bp, Artificial
  CRISPR gRNA sequence
tcaattctatcttgcatgta

SEQ ID NO: 657224 - DNA, 20 bp, Artificial
  CRISPR gRNA sequence
caattctatcttgcatgtaa

SEQ ID NO: 657225 - DNA, 20 bp, Artificial
  CRISPR gRNA sequence
aattctatcttgcatgtaac

SEQ ID NO: 657226 - DNA, 20 bp, Artificial
  CRISPR gRNA sequence
tatcttgcatgtaacaaaca

SEQ ID NO: 657227 - DNA, 20 bp, Artificial
  CRISPR gRNA sequence
tcttgcatgtaacaaacaag

SEQ ID NO: 657228 - DNA, 20 bp, Artificial
  CRISPR gRNA sequence
gcatgtaacaaacaagttta

SEQ ID NO: 657229 - DNA, 20 bp, Artificial
  CRISPR gRNA sequence
catgtaacaaacaagtttac

SEQ ID NO: 657230 - DNA, 20 bp, Artificial
  CRISPR gRNA sequence
acttttaaaaaagagcctta

SEQ ID NO: 657231 - DNA, 20 bp, Artificial
  CRISPR gRNA sequence
cttttaaaaaagagccttag

SEQ ID NO: 657232 - DNA, 20 bp, Artificial
  CRISPR gRNA sequence
ttaaaaaagagccttagtct

SEQ ID NO: 657233 - DNA, 20 bp, Artificial
  CRISPR gRNA sequence
taaaaaagagccttagtctc

SEQ ID NO: 657234 - DNA, 20 bp, Artificial
  CRISPR gRNA sequence
aaaaaagagccttagtctct

SEQ ID NO: 657235 - DNA, 20 bp, Artificial
  CRISPR gRNA sequence
aaaaagagccttagtctctt

SEQ ID NO: 657236 - DNA, 20 bp, Artificial
  CRISPR gRNA sequence
agtctctttttcatattcat

SEQ ID NO: 657237 - DNA, 20 bp, Artificial
  CRISPR gRNA sequence
gtctctttttcatattcatc

SEQ ID NO: 657238 - DNA, 20 bp, Artificial
  CRISPR gRNA sequence
tttttcatattcatcaattt

SEQ ID NO: 657239 - DNA, 20 bp, Artificial
  CRISPR gRNA sequence
tttcatattcatcaatttaa

SEQ ID NO: 657240 - DNA, 20 bp, Artificial
  CRISPR gRNA sequence
ttcatattcatcaatttaaa

SEQ ID NO: 657241 - DNA, 20 bp, Artificial
  CRISPR gRNA sequence
tcatattcatcaatttaaaa

SEQ ID NO: 657242 - DNA, 20 bp, Artificial
  CRISPR gRNA sequence
catattcatcaatttaaaat

SEQ ID NO: 657243 - DNA, 20 bp, Artificial
  CRISPR gRNA sequence
atattcatcaatttaaaatt

SEQ ID NO: 657244 - DNA, 20 bp, Artificial
  CRISPR gRNA sequence
atcaatttaaaattccctcg

SEQ ID NO: 657245 - DNA, 20 bp, Artificial
  CRISPR gRNA sequence
aaaattccctcgaatgttgc

SEQ ID NO: 657246 - DNA, 20 bp, Artificial
  CRISPR gRNA sequence
aaattccctcgaatgttgct

SEQ ID NO: 657247 - DNA, 20 bp, Artificial
  CRISPR gRNA sequence
cctcgaatgttgctaatttt

SEQ ID NO: 657248 - DNA, 20 bp, Artificial
  CRISPR gRNA sequence
gaatgttgctaattttttac

SEQ ID NO: 657249 - DNA, 20 bp, Artificial
  CRISPR gRNA sequence
ctaattttttacattaaaac

SEQ ID NO: 657250 - DNA, 20 bp, Artificial
  CRISPR gRNA sequence
attttttacattaaaactat

SEQ ID NO: 657251 - DNA, 20 bp, Artificial
  CRISPR gRNA sequence
tttacattaaaactattaaa

SEQ ID NO: 657252 - DNA, 20 bp, Artificial
  CRISPR gRNA sequence
ttacattaaaactattaaag

SEQ ID NO: 657253 - DNA, 20 bp, Artificial
  CRISPR gRNA sequence
tacattaaaactattaaaga

SEQ ID NO: 657254 - DNA, 20 bp, Artificial
  CRISPR gRNA sequence
acattaaaactattaaagag

SEQ ID NO: 657255 - DNA, 20 bp, Artificial
  CRISPR gRNA sequence
cattaaaactattaaagaga

SEQ ID NO: 657256 - DNA, 20 bp, Artificial
  CRISPR gRNA sequence
aaactattaaagagaaacta

SEQ ID NO: 657257 - DNA, 20 bp, Artificial
  CRISPR gRNA sequence
ttaaagagaaactattttta

SEQ ID NO: 657258 - DNA, 20 bp, Artificial
  CRISPR gRNA sequence
aagagaaactatttttagca

SEQ ID NO: 657259 - DNA, 20 bp, Artificial
  CRISPR gRNA sequence
tttttagcaagacaattctg

SEQ ID NO: 657260 - DNA, 20 bp, Artificial
  CRISPR gRNA sequence
ttagcaagacaattctggta

SEQ ID NO: 657261 - DNA, 20 bp, Artificial
  CRISPR gRNA sequence
tagcaagacaattctggtat

SEQ ID NO: 657262 - DNA, 20 bp, Artificial
  CRISPR gRNA sequence
agcaagacaattctggtatg

SEQ ID NO: 657263 - DNA, 20 bp, Artificial
  CRISPR gRNA sequence
gcaagacaattctggtatgt

SEQ ID NO: 657264 - DNA, 20 bp, Artificial
  CRISPR gRNA sequence
tggtatgttgctaatggagg

SEQ ID NO: 657265 - DNA, 20 bp, Artificial
  CRISPR gRNA sequence
gtatgttgctaatggaggta

SEQ ID NO: 657266 - DNA, 20 bp, Artificial
  CRISPR gRNA sequence
ctaatggaggtaggacctgc

SEQ ID NO: 657267 - DNA, 20 bp, Artificial
  CRISPR gRNA sequence
atggaggtaggacctgcgaa

SEQ ID NO: 657268 - DNA, 20 bp, Artificial
  CRISPR gRNA sequence
cgaaaataacttaaggccta

SEQ ID NO: 657269 - DNA, 20 bp, Artificial
  CRISPR gRNA sequence
aaggcctataaaagaaagag

SEQ ID NO: 657270 - DNA, 20 bp, Artificial
  CRISPR gRNA sequence
aggcctataaaagaaagagc

SEQ ID NO: 657271 - DNA, 20 bp, Artificial
  CRISPR gRNA sequence
taaaagaaagagcagagctg

SEQ ID NO: 657272 - DNA, 20 bp, Artificial
  CRISPR gRNA sequence
tgaagtatagagagcataga

SEQ ID NO: 657273 - DNA, 20 bp, Artificial
  CRISPR gRNA sequence
gcaagaagaaagaaagaata

SEQ ID NO: 657274 - DNA, 20 bp, Artificial
  CRISPR gRNA sequence
agaagtggaggacaagccac

SEQ ID NO: 657275 - DNA, 20 bp, Artificial
  CRISPR gRNA sequence
cacttgagttagtagatcca

SEQ ID NO: 657276 - DNA, 20 bp, Artificial
  CRISPR gRNA sequence
gagttagtagatccactgga

SEQ ID NO: 657277 - DNA, 20 bp, Artificial
  CRISPR gRNA sequence
agttagtagatccactggag

SEQ ID NO: 657278 - DNA, 20 bp, Artificial
  CRISPR gRNA sequence
gtagatccactggagagagc

SEQ ID NO: 657279 - DNA, 20 bp, Artificial
  CRISPR gRNA sequence
gagagagcaatagagcaaat

SEQ ID NO: 657280 - DNA, 20 bp, Artificial
  CRISPR gRNA sequence
ttcctcccctttttctttct

SEQ ID NO: 657281 - DNA, 20 bp, Artificial
  CRISPR gRNA sequence
tcctcccctttttctttctt

SEQ ID NO: 657282 - DNA, 20 bp, Artificial
  CRISPR gRNA sequence
cctcccctttttctttcttc

SEQ ID NO: 657283 - DNA, 20 bp, Artificial
  CRISPR gRNA sequence
ctcccctttttctttcttca

SEQ ID NO: 657284 - DNA, 20 bp, Artificial
  CRISPR gRNA sequence
ccctttttctttcttcacaa

SEQ ID NO: 657285 - DNA, 20 bp, Artificial
  CRISPR gRNA sequence
tttctttcttcacaaaaaaa

SEQ ID NO: 657286 - DNA, 20 bp, Artificial
  CRISPR gRNA sequence
ttctttcttcacaaaaaaat

SEQ ID NO: 657287 - DNA, 20 bp, Artificial
  CRISPR gRNA sequence
tctttcttcacaaaaaaata

SEQ ID NO: 657288 - DNA, 20 bp, Artificial
  CRISPR gRNA sequence
ctttcttcacaaaaaaataa

SEQ ID NO: 657289 - DNA, 20 bp, Artificial
  CRISPR gRNA sequence
tttcttcacaaaaaaataaa

SEQ ID NO: 657290 - DNA, 20 bp, Artificial
  CRISPR gRNA sequence
tcttcacaaaaaaataaata

SEQ ID NO: 657291 - DNA, 20 bp, Artificial
  CRISPR gRNA sequence
cttcacaaaaaaataaataa

SEQ ID NO: 657292 - DNA, 20 bp, Artificial
  CRISPR gRNA sequence
ttcacaaaaaaataaataaa

SEQ ID NO: 657293 - DNA, 20 bp, Artificial
  CRISPR gRNA sequence
cacaaaaaaataaataaaga

SEQ ID NO: 657294 - DNA, 20 bp, Artificial
  CRISPR gRNA sequence
acaaaaaaataaataaagag

SEQ ID NO: 657295 - DNA, 20 bp, Artificial
  CRISPR gRNA sequence
ataagtgaatcaaggaagct

SEQ ID NO: 657296 - DNA, 20 bp, Artificial
  CRISPR gRNA sequence
taagtgaatcaaggaagctg

SEQ ID NO: 657297 - DNA, 20 bp, Artificial
  CRISPR gRNA sequence
cctgcttaagtgatgaggaa

SEQ ID NO: 657298 - DNA, 20 bp, Artificial
  CRISPR gRNA sequence
cttaagtgatgaggaatgtg

SEQ ID NO: 657299 - DNA, 20 bp, Artificial
  CRISPR gRNA sequence
aagtgatgaggaatgtggca

SEQ ID NO: 657300 - DNA, 20 bp, Artificial
  CRISPR gRNA sequence
agtgatgaggaatgtggcaa

SEQ ID NO: 657301 - DNA, 20 bp, Artificial
  CRISPR gRNA sequence
gaatggtttctggtagaagc

SEQ ID NO: 657302 - DNA, 20 bp, Artificial
  CRISPR gRNA sequence
ctggtagaagctaaatgaat

SEQ ID NO: 657303 - DNA, 20 bp, Artificial
  CRISPR gRNA sequence
tggtagaagctaaatgaata

SEQ ID NO: 657304 - DNA, 20 bp, Artificial
  CRISPR gRNA sequence
gtagaagctaaatgaataag

SEQ ID NO: 657305 - DNA, 20 bp, Artificial
  CRISPR gRNA sequence
aatgaataagcatttagatt

SEQ ID NO: 657306 - DNA, 20 bp, Artificial
  CRISPR gRNA sequence
agattcgggagaaagaagca

SEQ ID NO: 657307 - DNA, 20 bp, Artificial
  CRISPR gRNA sequence
gattcgggagaaagaagcat

SEQ ID NO: 657308 - DNA, 20 bp, Artificial
  CRISPR gRNA sequence
gggagaaagaagcatacttc

SEQ ID NO: 657309 - DNA, 20 bp, Artificial
  CRISPR gRNA sequence
cttcagatatttgaaagcca

SEQ ID NO: 657310 - DNA, 20 bp, Artificial
  CRISPR gRNA sequence
ttcagatatttgaaagccag

SEQ ID NO: 657311 - DNA, 20 bp, Artificial
  CRISPR gRNA sequence
cagatatttgaaagccaggg

SEQ ID NO: 657312 - DNA, 20 bp, Artificial
  CRISPR gRNA sequence
agatatttgaaagccaggga

SEQ ID NO: 657313 - DNA, 20 bp, Artificial
  CRISPR gRNA sequence
gaaagccagggagtaggaga

SEQ ID NO: 657314 - DNA, 20 bp, Artificial
  CRISPR gRNA sequence
aaagccagggagtaggagat

SEQ ID NO: 657315 - DNA, 20 bp, Artificial
  CRISPR gRNA sequence
gttaaaagaactgggtccta

SEQ ID NO: 657316 - DNA, 20 bp, Artificial
  CRISPR gRNA sequence
aaagaactgggtcctaaggg

SEQ ID NO: 657317 - DNA, 20 bp, Artificial
  CRISPR gRNA sequence
ggtcctaagggattgattct

SEQ ID NO: 657318 - DNA, 20 bp, Artificial
  CRISPR gRNA sequence
agggattgattctagaacaa

SEQ ID NO: 657319 - DNA, 20 bp, Artificial
  CRISPR gRNA sequence
attctagaacaattagccaa

SEQ ID NO: 657320 - DNA, 20 bp, Artificial
  CRISPR gRNA sequence
tagaacaattagccaattaa

SEQ ID NO: 657321 - DNA, 20 bp, Artificial
  CRISPR gRNA sequence
gaacaattagccaattaaag

SEQ ID NO: 657322 - DNA, 20 bp, Artificial
  CRISPR gRNA sequence
gccaattaaagcaggataaa

SEQ ID NO: 657323 - DNA, 20 bp, Artificial
  CRISPR gRNA sequence
aagcaggataaaagttagtg

SEQ ID NO: 657324 - DNA, 20 bp, Artificial
  CRISPR gRNA sequence
gtggtgcctagttattaagt

SEQ ID NO: 657325 - DNA, 20 bp, Artificial
  CRISPR gRNA sequence
gttattaagttatattagtt

SEQ ID NO: 657326 - DNA, 20 bp, Artificial
  CRISPR gRNA sequence
ttaagttatattagttataa

SEQ ID NO: 657327 - DNA, 20 bp, Artificial
  CRISPR gRNA sequence
agttatattagttataaacc

SEQ ID NO: 657328 - DNA, 20 bp, Artificial
  CRISPR gRNA sequence
tattagttataaaccagtgc

SEQ ID NO: 657329 - DNA, 20 bp, Artificial
  CRISPR gRNA sequence
gttataaaccagtgctatta

SEQ ID NO: 657330 - DNA, 20 bp, Artificial
  CRISPR gRNA sequence
taaaccagtgctattatcag

SEQ ID NO: 657331 - DNA, 20 bp, Artificial
  CRISPR gRNA sequence
ttatcagtggccatcttgga

SEQ ID NO: 657332 - DNA, 20 bp, Artificial
  CRISPR gRNA sequence
tcagtggccatcttggacta

SEQ ID NO: 657333 - DNA, 20 bp, Artificial
  CRISPR gRNA sequence
ggactaatctattgctttta

SEQ ID NO: 657334 - DNA, 20 bp, Artificial
  CRISPR gRNA sequence
gactaatctattgcttttat

SEQ ID NO: 657335 - DNA, 20 bp, Artificial
  CRISPR gRNA sequence
atctattgcttttatctttt

SEQ ID NO: 657336 - DNA, 20 bp, Artificial
  CRISPR gRNA sequence
ttgcttttatcttttgcaaa

SEQ ID NO: 657337 - DNA, 20 bp, Artificial
  CRISPR gRNA sequence
cttttatcttttgcaaaaat

SEQ ID NO: 657338 - DNA, 20 bp, Artificial
  CRISPR gRNA sequence
ttatcttttgcaaaaatgat

SEQ ID NO: 657339 - DNA, 20 bp, Artificial
  CRISPR gRNA sequence
tatcttttgcaaaaatgatt

SEQ ID NO: 657340 - DNA, 20 bp, Artificial
  CRISPR gRNA sequence
atcttttgcaaaaatgattg

SEQ ID NO: 657341 - DNA, 20 bp, Artificial
  CRISPR gRNA sequence
tcttttgcaaaaatgattgt

SEQ ID NO: 657342 - DNA, 20 bp, Artificial
  CRISPR gRNA sequence
ttgcaaaaatgattgtgtac

SEQ ID NO: 657343 - DNA, 20 bp, Artificial
  CRISPR gRNA sequence
tgcaaaaatgattgtgtact

SEQ ID NO: 657344 - DNA, 20 bp, Artificial
  CRISPR gRNA sequence
gcaaaaatgattgtgtacta

SEQ ID NO: 657345 - DNA, 20 bp, Artificial
  CRISPR gRNA sequence
caaaaatgattgtgtactat

SEQ ID NO: 657346 - DNA, 20 bp, Artificial
  CRISPR gRNA sequence
tgtactatactgtgtgtgta

SEQ ID NO: 657347 - DNA, 20 bp, Artificial
  CRISPR gRNA sequence
tactgtgtgtgtaagagata

SEQ ID NO: 657348 - DNA, 20 bp, Artificial
  CRISPR gRNA sequence
tgtgtgtaagagatatccta

SEQ ID NO: 657349 - DNA, 20 bp, Artificial
  CRISPR gRNA sequence
actggtcgtattcctaaatt

SEQ ID NO: 657350 - DNA, 20 bp, Artificial
  CRISPR gRNA sequence
gtcgtattcctaaattatcg

SEQ ID NO: 657351 - DNA, 20 bp, Artificial
  CRISPR gRNA sequence
ctaaattatcgtggatgcgg

SEQ ID NO: 657352 - DNA, 20 bp, Artificial
  CRISPR gRNA sequence
aattatcgtggatgcggtaa

SEQ ID NO: 657353 - DNA, 20 bp, Artificial
  CRISPR gRNA sequence
tcgtggatgcggtaaacttt

SEQ ID NO: 657354 - DNA, 20 bp, Artificial
  CRISPR gRNA sequence
tgatcttgcccctcagttgt

SEQ ID NO: 657355 - DNA, 20 bp, Artificial
  CRISPR gRNA sequence
gatcttgcccctcagttgtc

SEQ ID NO: 657356 - DNA, 20 bp, Artificial
  CRISPR gRNA sequence
atcttgcccctcagttgtct

SEQ ID NO: 657357 - DNA, 20 bp, Artificial
  CRISPR gRNA sequence
gcccctcagttgtcttttta

SEQ ID NO: 657358 - DNA, 20 bp, Artificial
  CRISPR gRNA sequence
cccctcagttgtctttttac

SEQ ID NO: 657359 - DNA, 20 bp, Artificial
  CRISPR gRNA sequence
agttgtctttttactttagt

SEQ ID NO: 657360 - DNA, 20 bp, Artificial
  CRISPR gRNA sequence
tctttttactttagtttagt

SEQ ID NO: 657361 - DNA, 20 bp, Artificial
  CRISPR gRNA sequence
tttactttagtttagtggga

SEQ ID NO: 657362 - DNA, 20 bp, Artificial
  CRISPR gRNA sequence
ttactttagtttagtgggaa

SEQ ID NO: 657363 - DNA, 20 bp, Artificial
  CRISPR gRNA sequence
tactttagtttagtgggaaa

SEQ ID NO: 657364 - DNA, 20 bp, Artificial
  CRISPR gRNA sequence
actttagtttagtgggaaag

SEQ ID NO: 657365 - DNA, 20 bp, Artificial
  CRISPR gRNA sequence
ctttagtttagtgggaaagg

SEQ ID NO: 657366 - DNA, 20 bp, Artificial
  CRISPR gRNA sequence
tagtttagtgggaaaggaga

SEQ ID NO: 657367 - DNA, 20 bp, Artificial
  CRISPR gRNA sequence
agtttagtgggaaaggagat

SEQ ID NO: 657368 - DNA, 20 bp, Artificial
  CRISPR gRNA sequence
gtttagtgggaaaggagatt

SEQ ID NO: 657369 - DNA, 20 bp, Artificial
  CRISPR gRNA sequence
agtgggaaaggagattggaa

SEQ ID NO: 657370 - DNA, 20 bp, Artificial
  CRISPR gRNA sequence
gtgggaaaggagattggaag

SEQ ID NO: 657371 - DNA, 20 bp, Artificial
  CRISPR gRNA sequence
gaagggggttagggagactg

SEQ ID NO: 657372 - DNA, 20 bp, Artificial
  CRISPR gRNA sequence
gggagactgtaaggctgcca

SEQ ID NO: 657373 - DNA, 20 bp, Artificial
  CRISPR gRNA sequence
taaggctgccagaaagaact

SEQ ID NO: 657374 - DNA, 20 bp, Artificial
  CRISPR gRNA sequence
ccagaaagaactttctctgc

SEQ ID NO: 657375 - DNA, 20 bp, Artificial
  CRISPR gRNA sequence
tctctgctttttttccccct

SEQ ID NO: 657376 - DNA, 20 bp, Artificial
  CRISPR gRNA sequence
ctctgctttttttccccctc

SEQ ID NO: 657377 - DNA, 20 bp, Artificial
  CRISPR gRNA sequence
tctgctttttttccccctct

SEQ ID NO: 657378 - DNA, 20 bp, Artificial
  CRISPR gRNA sequence
tgctttttttccccctcttg

SEQ ID NO: 657379 - DNA, 20 bp, Artificial
  CRISPR gRNA sequence
ctttttttccccctcttggg

SEQ ID NO: 657380 - DNA, 20 bp, Artificial
  CRISPR gRNA sequence
tttttccccctcttgggaga

SEQ ID NO: 657381 - DNA, 20 bp, Artificial
  CRISPR gRNA sequence
ttttccccctcttgggagat

SEQ ID NO: 657382 - DNA, 20 bp, Artificial
  CRISPR gRNA sequence
tttccccctcttgggagatg

SEQ ID NO: 657383 - DNA, 20 bp, Artificial
  CRISPR gRNA sequence
ttccccctcttgggagatgg

SEQ ID NO: 657384 - DNA, 20 bp, Artificial
  CRISPR gRNA sequence
tccccctcttgggagatggc

SEQ ID NO: 657385 - DNA, 20 bp, Artificial
  CRISPR gRNA sequence
ccccctcttgggagatggca

SEQ ID NO: 657386 - DNA, 20 bp, Artificial
  CRISPR gRNA sequence
cccctcttgggagatggcaa

SEQ ID NO: 657387 - DNA, 20 bp, Artificial
  CRISPR gRNA sequence
ttgggagatggcaatgaaga

SEQ ID NO: 657388 - DNA, 20 bp, Artificial
  CRISPR gRNA sequence
gggagatggcaatgaagaag

SEQ ID NO: 657389 - DNA, 20 bp, Artificial
  CRISPR gRNA sequence
ggagatggcaatgaagaagg

SEQ ID NO: 657390 - DNA, 20 bp, Artificial
  CRISPR gRNA sequence
gatattgagcagatgagatg

SEQ ID NO: 657391 - DNA, 20 bp, Artificial
  CRISPR gRNA sequence
atattgagcagatgagatga

SEQ ID NO: 657392 - DNA, 20 bp, Artificial
  CRISPR gRNA sequence
agcagatgagatgaggtttt

SEQ ID NO: 657393 - DNA, 20 bp, Artificial
  CRISPR gRNA sequence
tgcatccagtttttgtcctc

SEQ ID NO: 657394 - DNA, 20 bp, Artificial
  CRISPR gRNA sequence
gcatccagtttttgtcctct

SEQ ID NO: 657395 - DNA, 20 bp, Artificial
  CRISPR gRNA sequence
catccagtttttgtcctctg

SEQ ID NO: 657396 - DNA, 20 bp, Artificial
  CRISPR gRNA sequence
ttgtcctctgatcgctggtt

SEQ ID NO: 657397 - DNA, 20 bp, Artificial
  CRISPR gRNA sequence
tgtcctctgatcgctggttt

SEQ ID NO: 657398 - DNA, 20 bp, Artificial
  CRISPR gRNA sequence
gtcctctgatcgctggtttt

SEQ ID NO: 657399 - DNA, 20 bp, Artificial
  CRISPR gRNA sequence
tcctctgatcgctggttttt

SEQ ID NO: 657400 - DNA, 20 bp, Artificial
  CRISPR gRNA sequence
tgatcgctggtttttccatt

SEQ ID NO: 657401 - DNA, 20 bp, Artificial
  CRISPR gRNA sequence
atcgctggtttttccatttt

SEQ ID NO: 657402 - DNA, 20 bp, Artificial
  CRISPR gRNA sequence
gtttttccattttcctctcg

SEQ ID NO: 657403 - DNA, 20 bp, Artificial
  CRISPR gRNA sequence
ttccattttcctctcgaagt

SEQ ID NO: 657404 - DNA, 20 bp, Artificial
  CRISPR gRNA sequence
tccattttcctctcgaagtg

SEQ ID NO: 657405 - DNA, 20 bp, Artificial
  CRISPR gRNA sequence
ccattttcctctcgaagtgt

SEQ ID NO: 657406 - DNA, 20 bp, Artificial
  CRISPR gRNA sequence
cattttcctctcgaagtgtc

SEQ ID NO: 657407 - DNA, 20 bp, Artificial
  CRISPR gRNA sequence
tcctctcgaagtgtctaaga

SEQ ID NO: 657408 - DNA, 20 bp, Artificial
  CRISPR gRNA sequence
cctctcgaagtgtctaagac

SEQ ID NO: 657409 - DNA, 20 bp, Artificial
  CRISPR gRNA sequence
ctctcgaagtgtctaagaca

SEQ ID NO: 657410 - DNA, 20 bp, Artificial
  CRISPR gRNA sequence
tcgaagtgtctaagacacag

SEQ ID NO: 657411 - DNA, 20 bp, Artificial
  CRISPR gRNA sequence
gaagtgtctaagacacaggc

SEQ ID NO: 657412 - DNA, 20 bp, Artificial
  CRISPR gRNA sequence
agacacaggcactgagggtt

SEQ ID NO: 657413 - DNA, 20 bp, Artificial
  CRISPR gRNA sequence
agggttccagaagactttct

SEQ ID NO: 657414 - DNA, 20 bp, Artificial
  CRISPR gRNA sequence
cagaagactttcttgagatc

SEQ ID NO: 657415 - DNA, 20 bp, Artificial
  CRISPR gRNA sequence
tcttgagatcatactctgtt

SEQ ID NO: 657416 - DNA, 20 bp, Artificial
  CRISPR gRNA sequence
cttgagatcatactctgtta

SEQ ID NO: 657417 - DNA, 20 bp, Artificial
  CRISPR gRNA sequence
ttgagatcatactctgttat

SEQ ID NO: 657418 - DNA, 20 bp, Artificial
  CRISPR gRNA sequence
gagatcatactctgttattt

SEQ ID NO: 657419 - DNA, 20 bp, Artificial
  CRISPR gRNA sequence
agatcatactctgttattta

SEQ ID NO: 657420 - DNA, 20 bp, Artificial
  CRISPR gRNA sequence
tgttatttagaaggctcagg

SEQ ID NO: 657421 - DNA, 20 bp, Artificial
  CRISPR gRNA sequence
ttatttagaaggctcaggtt

SEQ ID NO: 657422 - DNA, 20 bp, Artificial
  CRISPR gRNA sequence
tttagaaggctcaggttggc

SEQ ID NO: 657423 - DNA, 20 bp, Artificial
  CRISPR gRNA sequence
agaaggctcaggttggcttt

SEQ ID NO: 657424 - DNA, 20 bp, Artificial
  CRISPR gRNA sequence
gaaggctcaggttggctttt

SEQ ID NO: 657425 - DNA, 20 bp, Artificial
  CRISPR gRNA sequence
aggttggcttttacccattg

SEQ ID NO: 657426 - DNA, 20 bp, Artificial
  CRISPR gRNA sequence
gcttttacccattgagacat

SEQ ID NO: 657427 - DNA, 20 bp, Artificial
  CRISPR gRNA sequence
ttacccattgagacattttt

SEQ ID NO: 657428 - DNA, 20 bp, Artificial
  CRISPR gRNA sequence
tacccattgagacattttta

SEQ ID NO: 657429 - DNA, 20 bp, Artificial
  CRISPR gRNA sequence
acccattgagacatttttaa

SEQ ID NO: 657430 - DNA, 20 bp, Artificial
  CRISPR gRNA sequence
cccattgagacatttttaaa

SEQ ID NO: 657431 - DNA, 20 bp, Artificial
  CRISPR gRNA sequence
agacatttttaaaaaattaa

SEQ ID NO: 657432 - DNA, 20 bp, Artificial
  CRISPR gRNA sequence
ttaaaaaattaatctgcttt

SEQ ID NO: 657433 - DNA, 20 bp, Artificial
  CRISPR gRNA sequence
taaaaaattaatctgcttta

SEQ ID NO: 657434 - DNA, 20 bp, Artificial
  CRISPR gRNA sequence
aaaaaattaatctgctttaa

SEQ ID NO: 657435 - DNA, 20 bp, Artificial
  CRISPR gRNA sequence
aaaaattaatctgctttaat

SEQ ID NO: 657436 - DNA, 20 bp, Artificial
  CRISPR gRNA sequence
atctgctttaatactgtagt

SEQ ID NO: 657437 - DNA, 20 bp, Artificial
  CRISPR gRNA sequence
ctttaatactgtagtaaaaa

SEQ ID NO: 657438 - DNA, 20 bp, Artificial
  CRISPR gRNA sequence
taatactgtagtaaaaattt

SEQ ID NO: 657439 - DNA, 20 bp, Artificial
  CRISPR gRNA sequence
aatactgtagtaaaaattta

SEQ ID NO: 657440 - DNA, 20 bp, Artificial
  CRISPR gRNA sequence
atactgtagtaaaaatttat

SEQ ID NO: 657441 - DNA, 20 bp, Artificial
  CRISPR gRNA sequence
tagtaaaaatttatcagttg

SEQ ID NO: 657442 - DNA, 20 bp, Artificial
  CRISPR gRNA sequence
atcagttgtgagataaactt

SEQ ID NO: 657443 - DNA, 20 bp, Artificial
  CRISPR gRNA sequence
tcagttgtgagataaacttt

SEQ ID NO: 657444 - DNA, 20 bp, Artificial
  CRISPR gRNA sequence
tgagataaactttacatgtg

SEQ ID NO: 657445 - DNA, 20 bp, Artificial
  CRISPR gRNA sequence
tacatgtgtatcattgttga

SEQ ID NO: 657446 - DNA, 20 bp, Artificial
  CRISPR gRNA sequence
acatgtgtatcattgttgaa

SEQ ID NO: 657447 - DNA, 20 bp, Artificial
  CRISPR gRNA sequence
catgtgtatcattgttgaag

SEQ ID NO: 657448 - DNA, 20 bp, Artificial
  CRISPR gRNA sequence
ttgaagaaaaggtttactaa

SEQ ID NO: 657449 - DNA, 20 bp, Artificial
  CRISPR gRNA sequence
aagaaaaggtttactaagcc

SEQ ID NO: 657450 - DNA, 20 bp, Artificial
  CRISPR gRNA sequence
actaagcccataaataacaa

SEQ ID NO: 657451 - DNA, 20 bp, Artificial
  CRISPR gRNA sequence
ctaagcccataaataacaat

SEQ ID NO: 657452 - DNA, 20 bp, Artificial
  CRISPR gRNA sequence
agcccataaataacaataat

SEQ ID NO: 657453 - DNA, 20 bp, Artificial
  CRISPR gRNA sequence
aacttgcttaaaaaaacaaa

SEQ ID NO: 657454 - DNA, 20 bp, Artificial
  CRISPR gRNA sequence
acttgcttaaaaaaacaaat

SEQ ID NO: 657455 - DNA, 20 bp, Artificial
  CRISPR gRNA sequence
gcttaaaaaaacaaatttta

SEQ ID NO: 657456 - DNA, 20 bp, Artificial
  CRISPR gRNA sequence
cttaaaaaaacaaattttaa

SEQ ID NO: 657457 - DNA, 20 bp, Artificial
  CRISPR gRNA sequence
aaaaaaacaaattttaagtc

SEQ ID NO: 657458 - DNA, 20 bp, Artificial
  CRISPR gRNA sequence
aaaaaacaaattttaagtct

SEQ ID NO: 657459 - DNA, 20 bp, Artificial
  CRISPR gRNA sequence
taagtctactaagaatacca

SEQ ID NO: 657460 - DNA, 20 bp, Artificial
  CRISPR gRNA sequence
aagtctactaagaataccat

SEQ ID NO: 657461 - DNA, 20 bp, Artificial
  CRISPR gRNA sequence
agtctactaagaataccatt

SEQ ID NO: 657462 - DNA, 20 bp, Artificial
  CRISPR gRNA sequence
ctaagaataccattttattt

SEQ ID NO: 657463 - DNA, 20 bp, Artificial
  CRISPR gRNA sequence
agaataccattttatttgta

SEQ ID NO: 657464 - DNA, 20 bp, Artificial
  CRISPR gRNA sequence
tatttgtaaggtactttttt

SEQ ID NO: 657465 - DNA, 20 bp, Artificial
  CRISPR gRNA sequence
atttgtaaggtacttttttc

SEQ ID NO: 657466 - DNA, 20 bp, Artificial
  CRISPR gRNA sequence
tttgtaaggtacttttttca

SEQ ID NO: 657467 - DNA, 20 bp, Artificial
  CRISPR gRNA sequence
gtaaggtacttttttcaaaa

SEQ ID NO: 657468 - DNA, 20 bp, Artificial
  CRISPR gRNA sequence
taaggtacttttttcaaaat

SEQ ID NO: 657469 - DNA, 20 bp, Artificial
  CRISPR gRNA sequence
ttttcaaaatgcttttacat

SEQ ID NO: 657470 - DNA, 20 bp, Artificial
  CRISPR gRNA sequence
tttcaaaatgcttttacatc

SEQ ID NO: 657471 - DNA, 20 bp, Artificial
  CRISPR gRNA sequence
ttcaaaatgcttttacatct

SEQ ID NO: 657472 - DNA, 20 bp, Artificial
  CRISPR gRNA sequence
tcaaaatgcttttacatcta

SEQ ID NO: 657473 - DNA, 20 bp, Artificial
  CRISPR gRNA sequence
caaaatgcttttacatctag

SEQ ID NO: 657474 - DNA, 20 bp, Artificial
  CRISPR gRNA sequence
aaaatgcttttacatctagc

SEQ ID NO: 657475 - DNA, 20 bp, Artificial
  CRISPR gRNA sequence
ttacatctagcatagaatgt

SEQ ID NO: 657476 - DNA, 20 bp, Artificial
  CRISPR gRNA sequence
tacatctagcatagaatgtg

SEQ ID NO: 657477 - DNA, 20 bp, Artificial
  CRISPR gRNA sequence
acatctagcatagaatgtgc

SEQ ID NO: 657478 - DNA, 20 bp, Artificial
  CRISPR gRNA sequence
catctagcatagaatgtgct

SEQ ID NO: 657479 - DNA, 20 bp, Artificial
  CRISPR gRNA sequence
gcatagaatgtgctgatcaa

SEQ ID NO: 657480 - DNA, 20 bp, Artificial
  CRISPR gRNA sequence
atcaaaacttgagcttaata

SEQ ID NO: 657481 - DNA, 20 bp, Artificial
  CRISPR gRNA sequence
gagcttaatatttatgcaac

SEQ ID NO: 657482 - DNA, 20 bp, Artificial
  CRISPR gRNA sequence
agcttaatatttatgcaacc

SEQ ID NO: 657483 - DNA, 20 bp, Artificial
  CRISPR gRNA sequence
aatatttatgcaaccagtgt

SEQ ID NO: 657484 - DNA, 20 bp, Artificial
  CRISPR gRNA sequence
atatttatgcaaccagtgtc

SEQ ID NO: 657485 - DNA, 20 bp, Artificial
  CRISPR gRNA sequence
atgcaaccagtgtcagagta

SEQ ID NO: 657486 - DNA, 20 bp, Artificial
  CRISPR gRNA sequence
tgcaaccagtgtcagagtaa

SEQ ID NO: 657487 - DNA, 20 bp, Artificial
  CRISPR gRNA sequence
ctctttttgatagtacttag

SEQ ID NO: 657488 - DNA, 20 bp, Artificial
  CRISPR gRNA sequence
tttttgatagtacttagcat

SEQ ID NO: 657489 - DNA, 20 bp, Artificial
  CRISPR gRNA sequence
tttgatagtacttagcatta

SEQ ID NO: 657490 - DNA, 20 bp, Artificial
  CRISPR gRNA sequence
ttgatagtacttagcattac

SEQ ID NO: 657491 - DNA, 20 bp, Artificial
  CRISPR gRNA sequence
tgatagtacttagcattact

SEQ ID NO: 657492 - DNA, 20 bp, Artificial
  CRISPR gRNA sequence
gatagtacttagcattactg

SEQ ID NO: 657493 - DNA, 20 bp, Artificial
  CRISPR gRNA sequence
atagtacttagcattactgg

SEQ ID NO: 657494 - DNA, 20 bp, Artificial
  CRISPR gRNA sequence
agcattactggaaaatagtg

SEQ ID NO: 657495 - DNA, 20 bp, Artificial
  CRISPR gRNA sequence
gcattactggaaaatagtga

SEQ ID NO: 657496 - DNA, 20 bp, Artificial
  CRISPR gRNA sequence
ctggaaaatagtgaatattt

SEQ ID NO: 657497 - DNA, 20 bp, Artificial
  CRISPR gRNA sequence
gaaaatagtgaatatttatt

SEQ ID NO: 657498 - DNA, 20 bp, Artificial
  CRISPR gRNA sequence
attttatttatttatttatt

SEQ ID NO: 657499 - DNA, 20 bp, Artificial
  CRISPR gRNA sequence
ttttatttatttatttattt

SEQ ID NO: 657500 - DNA, 20 bp, Artificial
  CRISPR gRNA sequence
tatttatttatttatttatt

SEQ ID NO: 657501 - DNA, 20 bp, Artificial
  CRISPR gRNA sequence
atttatttatttatttattt

SEQ ID NO: 657502 - DNA, 20 bp, Artificial
  CRISPR gRNA sequence
tttatttatttatttattta

SEQ ID NO: 657503 - DNA, 20 bp, Artificial
  CRISPR gRNA sequence
atttatttatttatttattt

SEQ ID NO: 657504 - DNA, 20 bp, Artificial
  CRISPR gRNA sequence
tttatttatttatttattta

SEQ ID NO: 657505 - DNA, 20 bp, Artificial
  CRISPR gRNA sequence
atttatttatttatttattt

SEQ ID NO: 657506 - DNA, 20 bp, Artificial
  CRISPR gRNA sequence
tttatttatttatttatttt

SEQ ID NO: 657507 - DNA, 20 bp, Artificial
  CRISPR gRNA sequence
atttatttatttattttttc

SEQ ID NO: 657508 - DNA, 20 bp, Artificial
  CRISPR gRNA sequence
tttatttatttattttttcg

SEQ ID NO: 657509 - DNA, 20 bp, Artificial
  CRISPR gRNA sequence
atttatttattttttcgaga

SEQ ID NO: 657510 - DNA, 20 bp, Artificial
  CRISPR gRNA sequence
tttatttattttttcgagac

SEQ ID NO: 657511 - DNA, 20 bp, Artificial
  CRISPR gRNA sequence
atttattttttcgagacgga

SEQ ID NO: 657512 - DNA, 20 bp, Artificial
  CRISPR gRNA sequence
tttattttttcgagacggag

SEQ ID NO: 657513 - DNA, 20 bp, Artificial
  CRISPR gRNA sequence
attttttcgagacggagtct

SEQ ID NO: 657514 - DNA, 20 bp, Artificial
  CRISPR gRNA sequence
ttttttcgagacggagtcta

SEQ ID NO: 657515 - DNA, 20 bp, Artificial
  CRISPR gRNA sequence
tttcgagacggagtctatct

SEQ ID NO: 657516 - DNA, 20 bp, Artificial
  CRISPR gRNA sequence
ttcgagacggagtctatctt

SEQ ID NO: 657517 - DNA, 20 bp, Artificial
  CRISPR gRNA sequence
tcgagacggagtctatcttt

SEQ ID NO: 657518 - DNA, 20 bp, Artificial
  CRISPR gRNA sequence
cgagacggagtctatctttg

SEQ ID NO: 657519 - DNA, 20 bp, Artificial
  CRISPR gRNA sequence
gagacggagtctatctttgt

SEQ ID NO: 657520 - DNA, 20 bp, Artificial
  CRISPR gRNA sequence
tctttgtcgcccaggctaga

SEQ ID NO: 657521 - DNA, 20 bp, Artificial
  CRISPR gRNA sequence
tgtcgcccaggctagagtgc

SEQ ID NO: 657522 - DNA, 20 bp, Artificial
  CRISPR gRNA sequence
gtcgcccaggctagagtgcg

SEQ ID NO: 657523 - DNA, 20 bp, Artificial
  CRISPR gRNA sequence
tcgcccaggctagagtgcgg

SEQ ID NO: 657524 - DNA, 20 bp, Artificial
  CRISPR gRNA sequence
gagtgcggtggtgcgatctc

SEQ ID NO: 657525 - DNA, 20 bp, Artificial
  CRISPR gRNA sequence
ggctccactgcaaccttcgc

SEQ ID NO: 657526 - DNA, 20 bp, Artificial
  CRISPR gRNA sequence
cactgcaaccttcgcctccc

SEQ ID NO: 657527 - DNA, 20 bp, Artificial
  CRISPR gRNA sequence
caaccttcgcctcccgagaa

SEQ ID NO: 657528 - DNA, 20 bp, Artificial
  CRISPR gRNA sequence
cgcctcccgagaagctgaga

SEQ ID NO: 657529 - DNA, 20 bp, Artificial
  CRISPR gRNA sequence
gcctcccgagaagctgagat

SEQ ID NO: 657530 - DNA, 20 bp, Artificial
  CRISPR gRNA sequence
ccgagaagctgagattacag

SEQ ID NO: 657531 - DNA, 20 bp, Artificial
  CRISPR gRNA sequence
agattacaggtacctgccac

SEQ ID NO: 657532 - DNA, 20 bp, Artificial
  CRISPR gRNA sequence
caggtacctgccaccatgcc

SEQ ID NO: 657533 - DNA, 20 bp, Artificial
  CRISPR gRNA sequence
ccaccatgcctagcaaattt

SEQ ID NO: 657534 - DNA, 20 bp, Artificial
  CRISPR gRNA sequence
gcaaatttttgtatttttag

SEQ ID NO: 657535 - DNA, 20 bp, Artificial
  CRISPR gRNA sequence
ttgtatttttagtagagact

SEQ ID NO: 657536 - DNA, 20 bp, Artificial
  CRISPR gRNA sequence
tgtatttttagtagagactg

SEQ ID NO: 657537 - DNA, 20 bp, Artificial
  CRISPR gRNA sequence
gtatttttagtagagactgg

SEQ ID NO: 657538 - DNA, 20 bp, Artificial
  CRISPR gRNA sequence
tatttttagtagagactggg

SEQ ID NO: 657539 - DNA, 20 bp, Artificial
  CRISPR gRNA sequence
ttagtagagactgggtttta

SEQ ID NO: 657540 - DNA, 20 bp, Artificial
  CRISPR gRNA sequence
tagtagagactgggttttac

SEQ ID NO: 657541 - DNA, 20 bp, Artificial
  CRISPR gRNA sequence
agtagagactgggttttacc

SEQ ID NO: 657542 - DNA, 20 bp, Artificial
  CRISPR gRNA sequence
gtagagactgggttttacca

SEQ ID NO: 657543 - DNA, 20 bp, Artificial
  CRISPR gRNA sequence
ggttttaccatgttggtcag

SEQ ID NO: 657544 - DNA, 20 bp, Artificial
  CRISPR gRNA sequence
taccatgttggtcaggctag

SEQ ID NO: 657545 - DNA, 20 bp, Artificial
  CRISPR gRNA sequence
accatgttggtcaggctagt

SEQ ID NO: 657546 - DNA, 20 bp, Artificial
  CRISPR gRNA sequence
ccatgttggtcaggctagtc

SEQ ID NO: 657547 - DNA, 20 bp, Artificial
  CRISPR gRNA sequence
gtcaggctagtcttgaactt

SEQ ID NO: 657548 - DNA, 20 bp, Artificial
  CRISPR gRNA sequence
gtcttgaacttctgacctca

SEQ ID NO: 657549 - DNA, 20 bp, Artificial
  CRISPR gRNA sequence
gaacttctgacctcaagtaa

SEQ ID NO: 657550 - DNA, 20 bp, Artificial
  CRISPR gRNA sequence
aacttctgacctcaagtaat

SEQ ID NO: 657551 - DNA, 20 bp, Artificial
  CRISPR gRNA sequence
ctgacctcaagtaatctgcc

SEQ ID NO: 657552 - DNA, 20 bp, Artificial
  CRISPR gRNA sequence
tgacctcaagtaatctgcct

SEQ ID NO: 657553 - DNA, 20 bp, Artificial
  CRISPR gRNA sequence
acctcaagtaatctgcctac

SEQ ID NO: 657554 - DNA, 20 bp, Artificial
  CRISPR gRNA sequence
aagtaatctgcctacctcag

SEQ ID NO: 657555 - DNA, 20 bp, Artificial
  CRISPR gRNA sequence
cctacctcagcctcccaaag

SEQ ID NO: 657556 - DNA, 20 bp, Artificial
  CRISPR gRNA sequence
cctcagcctcccaaagtgct

SEQ ID NO: 657557 - DNA, 20 bp, Artificial
  CRISPR gRNA sequence
agcctcccaaagtgctggga

SEQ ID NO: 657558 - DNA, 20 bp, Artificial
  CRISPR gRNA sequence
ccaaagtgctgggatcacag

SEQ ID NO: 657559 - DNA, 20 bp, Artificial
  CRISPR gRNA sequence
ggatcacaggcgtgagccac

SEQ ID NO: 657560 - DNA, 20 bp, Artificial
  CRISPR gRNA sequence
gccagtaaacatgtttttaa

SEQ ID NO: 657561 - DNA, 20 bp, Artificial
  CRISPR gRNA sequence
ttaaaaattacagaattgag

SEQ ID NO: 657562 - DNA, 20 bp, Artificial
  CRISPR gRNA sequence
taaaaattacagaattgagc

SEQ ID NO: 657563 - DNA, 20 bp, Artificial
  CRISPR gRNA sequence
aaaaattacagaattgagca

SEQ ID NO: 657564 - DNA, 20 bp, Artificial
  CRISPR gRNA sequence
aaaattacagaattgagcaa

SEQ ID NO: 657565 - DNA, 20 bp, Artificial
  CRISPR gRNA sequence
cagaattgagcaagttttcc

SEQ ID NO: 657566 - DNA, 20 bp, Artificial
  CRISPR gRNA sequence
agcaagttttcctgtttctc

SEQ ID NO: 657567 - DNA, 20 bp, Artificial
  CRISPR gRNA sequence
tcctgtttctctccctctgt

SEQ ID NO: 657568 - DNA, 20 bp, Artificial
  CRISPR gRNA sequence
cctgtttctctccctctgtg

SEQ ID NO: 657569 - DNA, 20 bp, Artificial
  CRISPR gRNA sequence
ctgtttctctccctctgtgg

SEQ ID NO: 657570 - DNA, 20 bp, Artificial
  CRISPR gRNA sequence
tttctctccctctgtggtat

SEQ ID NO: 657571 - DNA, 20 bp, Artificial
  CRISPR gRNA sequence
ctctccctctgtggtatata

SEQ ID NO: 657572 - DNA, 20 bp, Artificial
  CRISPR gRNA sequence
tctccctctgtggtatataa

SEQ ID NO: 657573 - DNA, 20 bp, Artificial
  CRISPR gRNA sequence
tccctctgtggtatataaag

SEQ ID NO: 657574 - DNA, 20 bp, Artificial
  CRISPR gRNA sequence
cctctgtggtatataaagaa

SEQ ID NO: 657575 - DNA, 20 bp, Artificial
  CRISPR gRNA sequence
tgtggtatataaagaagtgg

SEQ ID NO: 657576 - DNA, 20 bp, Artificial
  CRISPR gRNA sequence
tggtatataaagaagtggga

SEQ ID NO: 657577 - DNA, 20 bp, Artificial
  CRISPR gRNA sequence
atatatgtcaaatgtgaggc

SEQ ID NO: 657578 - DNA, 20 bp, Artificial
  CRISPR gRNA sequence
gacagatattttatctcttg

SEQ ID NO: 657579 - DNA, 20 bp, Artificial
  CRISPR gRNA sequence
tatctcttggaagctcagct

SEQ ID NO: 657580 - DNA, 20 bp, Artificial
  CRISPR gRNA sequence
atctcttggaagctcagctt

SEQ ID NO: 657581 - DNA, 20 bp, Artificial
  CRISPR gRNA sequence
tctcttggaagctcagcttt

SEQ ID NO: 657582 - DNA, 20 bp, Artificial
  CRISPR gRNA sequence
ttggaagctcagctttattt

SEQ ID NO: 657583 - DNA, 20 bp, Artificial
  CRISPR gRNA sequence
ggaagctcagctttatttgt

SEQ ID NO: 657584 - DNA, 20 bp, Artificial
  CRISPR gRNA sequence
gaagctcagctttatttgta

SEQ ID NO: 657585 - DNA, 20 bp, Artificial
  CRISPR gRNA sequence
agctttatttgtaaaaaggg

SEQ ID NO: 657586 - DNA, 20 bp, Artificial
  CRISPR gRNA sequence
tatttgtaaaaaggggatat

SEQ ID NO: 657587 - DNA, 20 bp, Artificial
  CRISPR gRNA sequence
atttgtaaaaaggggatatt

SEQ ID NO: 657588 - DNA, 20 bp, Artificial
  CRISPR gRNA sequence
tttgtaaaaaggggatattg

SEQ ID NO: 657589 - DNA, 20 bp, Artificial
  CRISPR gRNA sequence
gtaaaaaggggatattgctc

SEQ ID NO: 657590 - DNA, 20 bp, Artificial
  CRISPR gRNA sequence
taaaaaggggatattgctct

SEQ ID NO: 657591 - DNA, 20 bp, Artificial
  CRISPR gRNA sequence
ctctctgtcagaggagtggt

SEQ ID NO: 657592 - DNA, 20 bp, Artificial
  CRISPR gRNA sequence
tctgtcagaggagtggtaag

SEQ ID NO: 657593 - DNA, 20 bp, Artificial
  CRISPR gRNA sequence
tgtcagaggagtggtaagca

SEQ ID NO: 657594 - DNA, 20 bp, Artificial
  CRISPR gRNA sequence
tcagaggagtggtaagcatt

SEQ ID NO: 657595 - DNA, 20 bp, Artificial
  CRISPR gRNA sequence
gacacaatatatgtaaagct

SEQ ID NO: 657596 - DNA, 20 bp, Artificial
  CRISPR gRNA sequence
ccagaacagtgactggctca

SEQ ID NO: 657597 - DNA, 20 bp, Artificial
  CRISPR gRNA sequence
cagaacagtgactggctcat

SEQ ID NO: 657598 - DNA, 20 bp, Artificial
  CRISPR gRNA sequence
gctcatggtaagttagccag

SEQ ID NO: 657599 - DNA, 20 bp, Artificial
  CRISPR gRNA sequence
atggtaagttagccagaatg

SEQ ID NO: 657600 - DNA, 20 bp, Artificial
  CRISPR gRNA sequence
gccagaatgatagctcctat

SEQ ID NO: 657601 - DNA, 20 bp, Artificial
  CRISPR gRNA sequence
ctattttattgttagataaa

SEQ ID NO: 657602 - DNA, 20 bp, Artificial
  CRISPR gRNA sequence
ttttattgttagataaaaag

SEQ ID NO: 657603 - DNA, 20 bp, Artificial
  CRISPR gRNA sequence
tattgttagataaaaagaat

SEQ ID NO: 657604 - DNA, 20 bp, Artificial
  CRISPR gRNA sequence
attgttagataaaaagaata

SEQ ID NO: 657605 - DNA, 20 bp, Artificial
  CRISPR gRNA sequence
ttgttagataaaaagaatat

SEQ ID NO: 657606 - DNA, 20 bp, Artificial
  CRISPR gRNA sequence
ttagataaaaagaatatgag

SEQ ID NO: 657607 - DNA, 20 bp, Artificial
  CRISPR gRNA sequence
gataaaaagaatatgagaaa

SEQ ID NO: 657608 - DNA, 20 bp, Artificial
  CRISPR gRNA sequence
aattacataataactaagaa

SEQ ID NO: 657609 - DNA, 20 bp, Artificial
  CRISPR gRNA sequence
cataataactaagaaacagg

SEQ ID NO: 657610 - DNA, 20 bp, Artificial
  CRISPR gRNA sequence
agaaacaggtcccacaaaca

SEQ ID NO: 657611 - DNA, 20 bp, Artificial
  CRISPR gRNA sequence
ctaggaaggacatgctttta

SEQ ID NO: 657612 - DNA, 20 bp, Artificial
  CRISPR gRNA sequence
taggaaggacatgcttttag

SEQ ID NO: 657613 - DNA, 20 bp, Artificial
  CRISPR gRNA sequence
ggaaggacatgcttttagtc

SEQ ID NO: 657614 - DNA, 20 bp, Artificial
  CRISPR gRNA sequence
ttagtccgcttttaatcaac

SEQ ID NO: 657615 - DNA, 20 bp, Artificial
  CRISPR gRNA sequence
tagtccgcttttaatcaaca

SEQ ID NO: 657616 - DNA, 20 bp, Artificial
  CRISPR gRNA sequence
agtccgcttttaatcaacaa

SEQ ID NO: 657617 - DNA, 20 bp, Artificial
  CRISPR gRNA sequence
gtccgcttttaatcaacaat

SEQ ID NO: 657618 - DNA, 20 bp, Artificial
  CRISPR gRNA sequence
ttaatcaacaataattttaa

SEQ ID NO: 657619 - DNA, 20 bp, Artificial
  CRISPR gRNA sequence
taatcaacaataattttaaa

SEQ ID NO: 657620 - DNA, 20 bp, Artificial
  CRISPR gRNA sequence
aatcaacaataattttaaaa

SEQ ID NO: 657621 - DNA, 20 bp, Artificial
  CRISPR gRNA sequence
atcaacaataattttaaaaa

SEQ ID NO: 657622 - DNA, 20 bp, Artificial
  CRISPR gRNA sequence
taaaaattagtccaaagcat

SEQ ID NO: 657623 - DNA, 20 bp, Artificial
  CRISPR gRNA sequence
aaaaattagtccaaagcatt

SEQ ID NO: 657624 - DNA, 20 bp, Artificial
  CRISPR gRNA sequence
aaaattagtccaaagcattg

SEQ ID NO: 657625 - DNA, 20 bp, Artificial
  CRISPR gRNA sequence
gtccaaagcattgcatggaa

SEQ ID NO: 657626 - DNA, 20 bp, Artificial
  CRISPR gRNA sequence
catggaacataacatatctg

SEQ ID NO: 657627 - DNA, 20 bp, Artificial
  CRISPR gRNA sequence
gatcacttactgaatatttc

SEQ ID NO: 657628 - DNA, 20 bp, Artificial
  CRISPR gRNA sequence
actgaatatttctgcttttc

SEQ ID NO: 657629 - DNA, 20 bp, Artificial
  CRISPR gRNA sequence
ctgaatatttctgcttttca

SEQ ID NO: 657630 - DNA, 20 bp, Artificial
  CRISPR gRNA sequence
aatatttctgcttttcatct

SEQ ID NO: 657631 - DNA, 20 bp, Artificial
  CRISPR gRNA sequence
ctgcttttcatctgtttgag

SEQ ID NO: 657632 - DNA, 20 bp, Artificial
  CRISPR gRNA sequence
tgcttttcatctgtttgagt

SEQ ID NO: 657633 - DNA, 20 bp, Artificial
  CRISPR gRNA sequence
cttttcatctgtttgagtgc

SEQ ID NO: 657634 - DNA, 20 bp, Artificial
  CRISPR gRNA sequence
ttcatctgtttgagtgctgt

SEQ ID NO: 657635 - DNA, 20 bp, Artificial
  CRISPR gRNA sequence
tcatctgtttgagtgctgtc

SEQ ID NO: 657636 - DNA, 20 bp, Artificial
  CRISPR gRNA sequence
catctgtttgagtgctgtca

SEQ ID NO: 657637 - DNA, 20 bp, Artificial
  CRISPR gRNA sequence
atctgtttgagtgctgtcag

SEQ ID NO: 657638 - DNA, 20 bp, Artificial
  CRISPR gRNA sequence
tttgagtgctgtcaggtaga

SEQ ID NO: 657639 - DNA, 20 bp, Artificial
  CRISPR gRNA sequence
gagtgctgtcaggtagacag

SEQ ID NO: 657640 - DNA, 20 bp, Artificial
  CRISPR gRNA sequence
agtgctgtcaggtagacaga

SEQ ID NO: 657641 - DNA, 20 bp, Artificial
  CRISPR gRNA sequence
tcaggtagacagactcagaa

SEQ ID NO: 657642 - DNA, 20 bp, Artificial
  CRISPR gRNA sequence
agaatttttgtttgaaaaga

SEQ ID NO: 657643 - DNA, 20 bp, Artificial
  CRISPR gRNA sequence
ttgtttgaaaagaaatgtgt

SEQ ID NO: 657644 - DNA, 20 bp, Artificial
  CRISPR gRNA sequence
tgtttgaaaagaaatgtgta

SEQ ID NO: 657645 - DNA, 20 bp, Artificial
  CRISPR gRNA sequence
gtttgaaaagaaatgtgtat

SEQ ID NO: 657646 - DNA, 20 bp, Artificial
  CRISPR gRNA sequence
tttgaaaagaaatgtgtatg

SEQ ID NO: 657647 - DNA, 20 bp, Artificial
  CRISPR gRNA sequence
gaaaagaaatgtgtatgcag

SEQ ID NO: 657648 - DNA, 20 bp, Artificial
  CRISPR gRNA sequence
aaaagaaatgtgtatgcaga

SEQ ID NO: 657649 - DNA, 20 bp, Artificial
  CRISPR gRNA sequence
ttaattctgttgtattcaaa

SEQ ID NO: 657650 - DNA, 20 bp, Artificial
  CRISPR gRNA sequence
attctgttgtattcaaatca

SEQ ID NO: 657651 - DNA, 20 bp, Artificial
  CRISPR gRNA sequence
tgttgtattcaaatcaatta

SEQ ID NO: 657652 - DNA, 20 bp, Artificial
  CRISPR gRNA sequence
ttgtattcaaatcaattact

SEQ ID NO: 657653 - DNA, 20 bp, Artificial
  CRISPR gRNA sequence
tattcaaatcaattactgaa

SEQ ID NO: 657654 - DNA, 20 bp, Artificial
  CRISPR gRNA sequence
aaatcaattactgaagaaat

SEQ ID NO: 657655 - DNA, 20 bp, Artificial
  CRISPR gRNA sequence
ctgaagaaatgaaagtaaaa

SEQ ID NO: 657656 - DNA, 20 bp, Artificial
  CRISPR gRNA sequence
aagaaatgaaagtaaaatta

SEQ ID NO: 657657 - DNA, 20 bp, Artificial
  CRISPR gRNA sequence
cctaattaaattgaatcaca

SEQ ID NO: 657658 - DNA, 20 bp, Artificial
  CRISPR gRNA sequence
attaaattgaatcacacata

SEQ ID NO: 657659 - DNA, 20 bp, Artificial
  CRISPR gRNA sequence
aattgaatcacacataaacc

SEQ ID NO: 657660 - DNA, 20 bp, Artificial
  CRISPR gRNA sequence
aatcacacataaacctactc

SEQ ID NO: 657661 - DNA, 20 bp, Artificial
  CRISPR gRNA sequence
ctctgtttgtgacgggtata

SEQ ID NO: 657662 - DNA, 20 bp, Artificial
  CRISPR gRNA sequence
tgtttgtgacgggtataatt

SEQ ID NO: 657663 - DNA, 20 bp, Artificial
  CRISPR gRNA sequence
tttgtgacgggtataattga

SEQ ID NO: 657664 - DNA, 20 bp, Artificial
  CRISPR gRNA sequence
gtgacgggtataattgaaat

SEQ ID NO: 657665 - DNA, 20 bp, Artificial
  CRISPR gRNA sequence
tgacgggtataattgaaatg

SEQ ID NO: 657666 - DNA, 20 bp, Artificial
  CRISPR gRNA sequence
aaatggtaattaagtggtag

SEQ ID NO: 657667 - DNA, 20 bp, Artificial
  CRISPR gRNA sequence
agtggtagtaatgcatttca

SEQ ID NO: 657668 - DNA, 20 bp, Artificial
  CRISPR gRNA sequence
catttgaggatggcaattca

SEQ ID NO: 657669 - DNA, 20 bp, Artificial
  CRISPR gRNA sequence
atttgaggatggcaattcag

SEQ ID NO: 657670 - DNA, 20 bp, Artificial
  CRISPR gRNA sequence
gaggatggcaattcagaaga

SEQ ID NO: 657671 - DNA, 20 bp, Artificial
  CRISPR gRNA sequence
aggatggcaattcagaagat

SEQ ID NO: 657672 - DNA, 20 bp, Artificial
  CRISPR gRNA sequence
agaagatgtgtttgctggca

SEQ ID NO: 657673 - DNA, 20 bp, Artificial
  CRISPR gRNA sequence
gctggcaggtcttggctgct

SEQ ID NO: 657674 - DNA, 20 bp, Artificial
  CRISPR gRNA sequence
ctggcaggtcttggctgctt

SEQ ID NO: 657675 - DNA, 20 bp, Artificial
  CRISPR gRNA sequence
gcaggtcttggctgcttggt

SEQ ID NO: 657676 - DNA, 20 bp, Artificial
  CRISPR gRNA sequence
ggctgcttggtgtacctccc

SEQ ID NO: 657677 - DNA, 20 bp, Artificial
  CRISPR gRNA sequence
gctgcttggtgtacctccct

SEQ ID NO: 657678 - DNA, 20 bp, Artificial
  CRISPR gRNA sequence
cttggtgtacctccctaggt

SEQ ID NO: 657679 - DNA, 20 bp, Artificial
  CRISPR gRNA sequence
ggtgtacctccctaggtgac

SEQ ID NO: 657680 - DNA, 20 bp, Artificial
  CRISPR gRNA sequence
gtgtacctccctaggtgacc

SEQ ID NO: 657681 - DNA, 20 bp, Artificial
  CRISPR gRNA sequence
cctaggtgaccttgtccaga

SEQ ID NO: 657682 - DNA, 20 bp, Artificial
  CRISPR gRNA sequence
ggtgaccttgtccagagtga

SEQ ID NO: 657683 - DNA, 20 bp, Artificial
  CRISPR gRNA sequence
gtccagagtgagtttttagg

SEQ ID NO: 657684 - DNA, 20 bp, Artificial
  CRISPR gRNA sequence
tccagagtgagtttttagga

SEQ ID NO: 657685 - DNA, 20 bp, Artificial
  CRISPR gRNA sequence
ttaggatggacttatttact

SEQ ID NO: 657686 - DNA, 20 bp, Artificial
  CRISPR gRNA sequence
taggatggacttatttactt

SEQ ID NO: 657687 - DNA, 20 bp, Artificial
  CRISPR gRNA sequence
aggatggacttatttacttg

SEQ ID NO: 657688 - DNA, 20 bp, Artificial
  CRISPR gRNA sequence
ggatggacttatttacttgt

SEQ ID NO: 657689 - DNA, 20 bp, Artificial
  CRISPR gRNA sequence
atttacttgtataactagat

SEQ ID NO: 657690 - DNA, 20 bp, Artificial
  CRISPR gRNA sequence
tttacttgtataactagatg

SEQ ID NO: 657691 - DNA, 20 bp, Artificial
  CRISPR gRNA sequence
acttgtataactagatgtgt

SEQ ID NO: 657692 - DNA, 20 bp, Artificial
  CRISPR gRNA sequence
cttgtataactagatgtgtt

SEQ ID NO: 657693 - DNA, 20 bp, Artificial
  CRISPR gRNA sequence
gtataactagatgtgttggt

SEQ ID NO: 657694 - DNA, 20 bp, Artificial
  CRISPR gRNA sequence
tataactagatgtgttggtg

SEQ ID NO: 657695 - DNA, 20 bp, Artificial
  CRISPR gRNA sequence
gatgtgttggtgaatgaatt

SEQ ID NO: 657696 - DNA, 20 bp, Artificial
  CRISPR gRNA sequence
gtgaatgaattcctagtata

SEQ ID NO: 657697 - DNA, 20 bp, Artificial
  CRISPR gRNA sequence
ctagtatagctctgaaattt

SEQ ID NO: 657698 - DNA, 20 bp, Artificial
  CRISPR gRNA sequence
gtatagctctgaaattttat

SEQ ID NO: 657699 - DNA, 20 bp, Artificial
  CRISPR gRNA sequence
tgaaattttattaatttcca

SEQ ID NO: 657700 - DNA, 20 bp, Artificial
  CRISPR gRNA sequence
aaattttattaatttccata

SEQ ID NO: 657701 - DNA, 20 bp, Artificial
  CRISPR gRNA sequence
tattaatttccatacttatg

SEQ ID NO: 657702 - DNA, 20 bp, Artificial
  CRISPR gRNA sequence
attaatttccatacttatgg

SEQ ID NO: 657703 - DNA, 20 bp, Artificial
  CRISPR gRNA sequence
ttaatttccatacttatggt

SEQ ID NO: 657704 - DNA, 20 bp, Artificial
  CRISPR gRNA sequence
atttccatacttatggtgct

SEQ ID NO: 657705 - DNA, 20 bp, Artificial
  CRISPR gRNA sequence
ccatacttatggtgctctat

SEQ ID NO: 657706 - DNA, 20 bp, Artificial
  CRISPR gRNA sequence
catacttatggtgctctatg

SEQ ID NO: 657707 - DNA, 20 bp, Artificial
  CRISPR gRNA sequence
atggtgctctatgtgttata

SEQ ID NO: 657708 - DNA, 20 bp, Artificial
  CRISPR gRNA sequence
tggtgctctatgtgttatat

SEQ ID NO: 657709 - DNA, 20 bp, Artificial
  CRISPR gRNA sequence
tatgtgttatattaaattca

SEQ ID NO: 657710 - DNA, 20 bp, Artificial
  CRISPR gRNA sequence
tgtgttatattaaattcatg

SEQ ID NO: 657711 - DNA, 20 bp, Artificial
  CRISPR gRNA sequence
tattaaattcatgtctctgt

SEQ ID NO: 657712 - DNA, 20 bp, Artificial
  CRISPR gRNA sequence
aattcatgtctctgttgcat

SEQ ID NO: 657713 - DNA, 20 bp, Artificial
  CRISPR gRNA sequence
atgtctctgttgcatatctg

SEQ ID NO: 657714 - DNA, 20 bp, Artificial
  CRISPR gRNA sequence
tgttgcatatctggaattct

SEQ ID NO: 657715 - DNA, 20 bp, Artificial
  CRISPR gRNA sequence
ttgcatatctggaattctca

SEQ ID NO: 657716 - DNA, 20 bp, Artificial
  CRISPR gRNA sequence
catatctggaattctcagaa

SEQ ID NO: 657717 - DNA, 20 bp, Artificial
  CRISPR gRNA sequence
gaattctcagaaccacatat

SEQ ID NO: 657718 - DNA, 20 bp, Artificial
  CRISPR gRNA sequence
tcagaaccacatatacatac

SEQ ID NO: 657719 - DNA, 20 bp, Artificial
  CRISPR gRNA sequence
agaaccacatatacataccc

SEQ ID NO: 657720 - DNA, 20 bp, Artificial
  CRISPR gRNA sequence
tttttttctctcttgtgtag

SEQ ID NO: 657721 - DNA, 20 bp, Artificial
  CRISPR gRNA sequence
tttttctctcttgtgtagaa

SEQ ID NO: 657722 - DNA, 20 bp, Artificial
  CRISPR gRNA sequence
ttttctctcttgtgtagaat

SEQ ID NO: 657723 - DNA, 20 bp, Artificial
  CRISPR gRNA sequence
tttctctcttgtgtagaatc

SEQ ID NO: 657724 - DNA, 20 bp, Artificial
  CRISPR gRNA sequence
ttctctcttgtgtagaatca

SEQ ID NO: 657725 - DNA, 20 bp, Artificial
  CRISPR gRNA sequence
tctctcttgtgtagaatcaa

SEQ ID NO: 657726 - DNA, 20 bp, Artificial
  CRISPR gRNA sequence
ctctcttgtgtagaatcaag

SEQ ID NO: 657727 - DNA, 20 bp, Artificial
  CRISPR gRNA sequence
tctcttgtgtagaatcaagg

SEQ ID NO: 657728 - DNA, 20 bp, Artificial
  CRISPR gRNA sequence
tcttgtgtagaatcaaggag

SEQ ID NO: 657729 - DNA, 20 bp, Artificial
  CRISPR gRNA sequence
ttgtgtagaatcaaggagaa

SEQ ID NO: 657730 - DNA, 20 bp, Artificial
  CRISPR gRNA sequence
gtgtagaatcaaggagaaaa

SEQ ID NO: 657731 - DNA, 20 bp, Artificial
  CRISPR gRNA sequence
tgtagaatcaaggagaaaac

SEQ ID NO: 657732 - DNA, 20 bp, Artificial
  CRISPR gRNA sequence
agtttaaaaggatttcacat

SEQ ID NO: 657733 - DNA, 20 bp, Artificial
  CRISPR gRNA sequence
aaaaggatttcacattagag

SEQ ID NO: 657734 - DNA, 20 bp, Artificial
  CRISPR gRNA sequence
aaaggatttcacattagagt

SEQ ID NO: 657735 - DNA, 20 bp, Artificial
  CRISPR gRNA sequence
cacattagagtacacataaa

SEQ ID NO: 657736 - DNA, 20 bp, Artificial
  CRISPR gRNA sequence
acattagagtacacataaac

SEQ ID NO: 657737 - DNA, 20 bp, Artificial
  CRISPR gRNA sequence
gagtacacataaacagacat

SEQ ID NO: 657738 - DNA, 20 bp, Artificial
  CRISPR gRNA sequence
tcctgagtgaagtttcacct

SEQ ID NO: 657739 - DNA, 20 bp, Artificial
  CRISPR gRNA sequence
cctgagtgaagtttcacctt

SEQ ID NO: 657740 - DNA, 20 bp, Artificial
  CRISPR gRNA sequence
ctgagtgaagtttcaccttt

SEQ ID NO: 657741 - DNA, 20 bp, Artificial
  CRISPR gRNA sequence
agtgaagtttcacctttttt

SEQ ID NO: 657742 - DNA, 20 bp, Artificial
  CRISPR gRNA sequence
caccttttttgggtcagagt

SEQ ID NO: 657743 - DNA, 20 bp, Artificial
  CRISPR gRNA sequence
accttttttgggtcagagtt

SEQ ID NO: 657744 - DNA, 20 bp, Artificial
  CRISPR gRNA sequence
ttttgggtcagagttactat

SEQ ID NO: 657745 - DNA, 20 bp, Artificial
  CRISPR gRNA sequence
tttgggtcagagttactatt

SEQ ID NO: 657746 - DNA, 20 bp, Artificial
  CRISPR gRNA sequence
ttgggtcagagttactattg

SEQ ID NO: 657747 - DNA, 20 bp, Artificial
  CRISPR gRNA sequence
tgggtcagagttactattgt

SEQ ID NO: 657748 - DNA, 20 bp, Artificial
  CRISPR gRNA sequence
gggtcagagttactattgtc

SEQ ID NO: 657749 - DNA, 20 bp, Artificial
  CRISPR gRNA sequence
ggtcagagttactattgtca

SEQ ID NO: 657750 - DNA, 20 bp, Artificial
  CRISPR gRNA sequence
ctattgtcataggcacagga

SEQ ID NO: 657751 - DNA, 20 bp, Artificial
  CRISPR gRNA sequence
ttgtcataggcacaggacag

SEQ ID NO: 657752 - DNA, 20 bp, Artificial
  CRISPR gRNA sequence
tcataggcacaggacagtcg

SEQ ID NO: 657753 - DNA, 20 bp, Artificial
  CRISPR gRNA sequence
attccaaatgatcttttttt

SEQ ID NO: 657754 - DNA, 20 bp, Artificial
  CRISPR gRNA sequence
caaatgatcttttttttttt

SEQ ID NO: 657755 - DNA, 20 bp, Artificial
  CRISPR gRNA sequence
ttttttttttttggatgcct

SEQ ID NO: 657756 - DNA, 20 bp, Artificial
  CRISPR gRNA sequence
tttttttttttggatgcctt

SEQ ID NO: 657757 - DNA, 20 bp, Artificial
  CRISPR gRNA sequence
ttttttttttggatgccttt

SEQ ID NO: 657758 - DNA, 20 bp, Artificial
  CRISPR gRNA sequence
tttttttttggatgccttta

SEQ ID NO: 657759 - DNA, 20 bp, Artificial
  CRISPR gRNA sequence
ttttttttggatgcctttat

SEQ ID NO: 657760 - DNA, 20 bp, Artificial
  CRISPR gRNA sequence
tttttttggatgcctttatc

SEQ ID NO: 657761 - DNA, 20 bp, Artificial
  CRISPR gRNA sequence
ttttttggatgcctttatca

SEQ ID NO: 657762 - DNA, 20 bp, Artificial
  CRISPR gRNA sequence
tttttggatgcctttatcac

SEQ ID NO: 657763 - DNA, 20 bp, Artificial
  CRISPR gRNA sequence
ttttggatgcctttatcacc

SEQ ID NO: 657764 - DNA, 20 bp, Artificial
  CRISPR gRNA sequence
tttggatgcctttatcacct

SEQ ID NO: 657765 - DNA, 20 bp, Artificial
  CRISPR gRNA sequence
ttggatgcctttatcacctc

SEQ ID NO: 657766 - DNA, 20 bp, Artificial
  CRISPR gRNA sequence
tggatgcctttatcacctcc

SEQ ID NO: 657767 - DNA, 20 bp, Artificial
  CRISPR gRNA sequence
ggatgcctttatcacctcct

SEQ ID NO: 657768 - DNA, 20 bp, Artificial
  CRISPR gRNA sequence
gatgcctttatcacctccta

SEQ ID NO: 657769 - DNA, 20 bp, Artificial
  CRISPR gRNA sequence
tatcacctcctatcctgttt

SEQ ID NO: 657770 - DNA, 20 bp, Artificial
  CRISPR gRNA sequence
atcacctcctatcctgtttt

SEQ ID NO: 657771 - DNA, 20 bp, Artificial
  CRISPR gRNA sequence
tcacctcctatcctgtttta

SEQ ID NO: 657772 - DNA, 20 bp, Artificial
  CRISPR gRNA sequence
ctatcctgttttatcattgc

SEQ ID NO: 657773 - DNA, 20 bp, Artificial
  CRISPR gRNA sequence
tcctgttttatcattgctta

SEQ ID NO: 657774 - DNA, 20 bp, Artificial
  CRISPR gRNA sequence
ttttatcattgcttaatttc

SEQ ID NO: 657775 - DNA, 20 bp, Artificial
  CRISPR gRNA sequence
tatcattgcttaatttcttg

SEQ ID NO: 657776 - DNA, 20 bp, Artificial
  CRISPR gRNA sequence
atcattgcttaatttcttga

SEQ ID NO: 657777 - DNA, 20 bp, Artificial
  CRISPR gRNA sequence
tcattgcttaatttcttgag

SEQ ID NO: 657778 - DNA, 20 bp, Artificial
  CRISPR gRNA sequence
cttaatttcttgagtacatc

SEQ ID NO: 657779 - DNA, 20 bp, Artificial
  CRISPR gRNA sequence
aatttcttgagtacatctta

SEQ ID NO: 657780 - DNA, 20 bp, Artificial
  CRISPR gRNA sequence
atttcttgagtacatcttat

SEQ ID NO: 657781 - DNA, 20 bp, Artificial
  CRISPR gRNA sequence
cttgagtacatcttatctcc

SEQ ID NO: 657782 - DNA, 20 bp, Artificial
  CRISPR gRNA sequence
ttgagtacatcttatctcct

SEQ ID NO: 657783 - DNA, 20 bp, Artificial
  CRISPR gRNA sequence
gagtacatcttatctccttt

SEQ ID NO: 657784 - DNA, 20 bp, Artificial
  CRISPR gRNA sequence
agtacatcttatctcctttg

SEQ ID NO: 657785 - DNA, 20 bp, Artificial
  CRISPR gRNA sequence
atctcctttgtgtgactgga

SEQ ID NO: 657786 - DNA, 20 bp, Artificial
  CRISPR gRNA sequence
tctcctttgtgtgactggaa

SEQ ID NO: 657787 - DNA, 20 bp, Artificial
  CRISPR gRNA sequence
ctttgtgtgactggaaactc

SEQ ID NO: 657788 - DNA, 20 bp, Artificial
  CRISPR gRNA sequence
tgtgtgactggaaactcctt

SEQ ID NO: 657789 - DNA, 20 bp, Artificial
  CRISPR gRNA sequence
gtgtgactggaaactccttg

SEQ ID NO: 657790 - DNA, 20 bp, Artificial
  CRISPR gRNA sequence
tgtgactggaaactccttga

SEQ ID NO: 657791 - DNA, 20 bp, Artificial
  CRISPR gRNA sequence
gaaactccttgagggcaggg

SEQ ID NO: 657792 - DNA, 20 bp, Artificial
  CRISPR gRNA sequence
cttgagggcagggaaaatga

SEQ ID NO: 657793 - DNA, 20 bp, Artificial
  CRISPR gRNA sequence
gagggcagggaaaatgactt

SEQ ID NO: 657794 - DNA, 20 bp, Artificial
  CRISPR gRNA sequence
agggcagggaaaatgacttt

SEQ ID NO: 657795 - DNA, 20 bp, Artificial
  CRISPR gRNA sequence
tgtaatctctgcagcctgag

SEQ ID NO: 657796 - DNA, 20 bp, Artificial
  CRISPR gRNA sequence
gtaatctctgcagcctgagg

SEQ ID NO: 657797 - DNA, 20 bp, Artificial
  CRISPR gRNA sequence
taatctctgcagcctgaggg

SEQ ID NO: 657798 - DNA, 20 bp, Artificial
  CRISPR gRNA sequence
tgcagcctgagggtagcaga

SEQ ID NO: 657799 - DNA, 20 bp, Artificial
  CRISPR gRNA sequence
cagcctgagggtagcagaca

SEQ ID NO: 657800 - DNA, 20 bp, Artificial
  CRISPR gRNA sequence
agggtagcagacagaatatg

SEQ ID NO: 657801 - DNA, 20 bp, Artificial
  CRISPR gRNA sequence
ttagcacctaaccgactggg

SEQ ID NO: 657802 - DNA, 20 bp, Artificial
  CRISPR gRNA sequence
tagcacctaaccgactggga

SEQ ID NO: 657803 - DNA, 20 bp, Artificial
  CRISPR gRNA sequence
agcacctaaccgactgggat

SEQ ID NO: 657804 - DNA, 20 bp, Artificial
  CRISPR gRNA sequence
gcacctaaccgactgggata

SEQ ID NO: 657805 - DNA, 20 bp, Artificial
  CRISPR gRNA sequence
accgactgggatagtatctt

SEQ ID NO: 657806 - DNA, 20 bp, Artificial
  CRISPR gRNA sequence
ggatagtatctttcctatgc

SEQ ID NO: 657807 - DNA, 20 bp, Artificial
  CRISPR gRNA sequence
tcctatgctgtgttttagtt

SEQ ID NO: 657808 - DNA, 20 bp, Artificial
  CRISPR gRNA sequence
cctatgctgtgttttagtta

SEQ ID NO: 657809 - DNA, 20 bp, Artificial
  CRISPR gRNA sequence
ctatgctgtgttttagttac

SEQ ID NO: 657810 - DNA, 20 bp, Artificial
  CRISPR gRNA sequence
tgctgtgttttagttacctc

SEQ ID NO: 657811 - DNA, 20 bp, Artificial
  CRISPR gRNA sequence
tgttttagttacctcatttg

SEQ ID NO: 657812 - DNA, 20 bp, Artificial
  CRISPR gRNA sequence
tagttacctcatttgtaaaa

SEQ ID NO: 657813 - DNA, 20 bp, Artificial
  CRISPR gRNA sequence
agttacctcatttgtaaaat

SEQ ID NO: 657814 - DNA, 20 bp, Artificial
  CRISPR gRNA sequence
gttacctcatttgtaaaata

SEQ ID NO: 657815 - DNA, 20 bp, Artificial
  CRISPR gRNA sequence
cctcatttgtaaaataggga

SEQ ID NO: 657816 - DNA, 20 bp, Artificial
  CRISPR gRNA sequence
atttgtaaaatagggaaagt

SEQ ID NO: 657817 - DNA, 20 bp, Artificial
  CRISPR gRNA sequence
gtaaaatagggaaagttagt

SEQ ID NO: 657818 - DNA, 20 bp, Artificial
  CRISPR gRNA sequence
taaaatagggaaagttagtg

SEQ ID NO: 657819 - DNA, 20 bp, Artificial
  CRISPR gRNA sequence
gtgcttgtctcttggagttg

SEQ ID NO: 657820 - DNA, 20 bp, Artificial
  CRISPR gRNA sequence
gtctcttggagttgttgtga

SEQ ID NO: 657821 - DNA, 20 bp, Artificial
  CRISPR gRNA sequence
tctcttggagttgttgtgag

SEQ ID NO: 657822 - DNA, 20 bp, Artificial
  CRISPR gRNA sequence
ttggagttgttgtgagggtt

SEQ ID NO: 657823 - DNA, 20 bp, Artificial
  CRISPR gRNA sequence
ggagttgttgtgagggttaa

SEQ ID NO: 657824 - DNA, 20 bp, Artificial
  CRISPR gRNA sequence
gagttgttgtgagggttaat

SEQ ID NO: 657825 - DNA, 20 bp, Artificial
  CRISPR gRNA sequence
ttgtgagggttaataaactt

SEQ ID NO: 657826 - DNA, 20 bp, Artificial
  CRISPR gRNA sequence
tgagggttaataaacttagt

SEQ ID NO: 657827 - DNA, 20 bp, Artificial
  CRISPR gRNA sequence
ataaacttagtaaagctttt

SEQ ID NO: 657828 - DNA, 20 bp, Artificial
  CRISPR gRNA sequence
agtaaagcttttatcacagg

SEQ ID NO: 657829 - DNA, 20 bp, Artificial
  CRISPR gRNA sequence
gtaaagcttttatcacaggg

SEQ ID NO: 657830 - DNA, 20 bp, Artificial
  CRISPR gRNA sequence
ttatcacagggcctaataca

SEQ ID NO: 657831 - DNA, 20 bp, Artificial
  CRISPR gRNA sequence
tatcacagggcctaatacat

SEQ ID NO: 657832 - DNA, 20 bp, Artificial
  CRISPR gRNA sequence
atcacagggcctaatacatt

SEQ ID NO: 657833 - DNA, 20 bp, Artificial
  CRISPR gRNA sequence
tcacagggcctaatacattt

SEQ ID NO: 657834 - DNA, 20 bp, Artificial
  CRISPR gRNA sequence
atacattttaagaaataatt

SEQ ID NO: 657835 - DNA, 20 bp, Artificial
  CRISPR gRNA sequence
taagaaataatttaagaaat

SEQ ID NO: 657836 - DNA, 20 bp, Artificial
  CRISPR gRNA sequence
aagaaataatttaagaaata

SEQ ID NO: 657837 - DNA, 20 bp, Artificial
  CRISPR gRNA sequence
agaaataatttaagaaatat

SEQ ID NO: 657838 - DNA, 20 bp, Artificial
  CRISPR gRNA sequence
aagaaatattcatttatctt

SEQ ID NO: 657839 - DNA, 20 bp, Artificial
  CRISPR gRNA sequence
agaaatattcatttatcttt

SEQ ID NO: 657840 - DNA, 20 bp, Artificial
  CRISPR gRNA sequence
atttatcttttccacagaag

SEQ ID NO: 657841 - DNA, 20 bp, Artificial
  CRISPR gRNA sequence
atcttttccacagaagctaa

SEQ ID NO: 657842 - DNA, 20 bp, Artificial
  CRISPR gRNA sequence
tcttttccacagaagctaac

SEQ ID NO: 657843 - DNA, 20 bp, Artificial
  CRISPR gRNA sequence
ttccacagaagctaacacag

SEQ ID NO: 657844 - DNA, 20 bp, Artificial
  CRISPR gRNA sequence
tccacagaagctaacacagt

SEQ ID NO: 657845 - DNA, 20 bp, Artificial
  CRISPR gRNA sequence
ccacagaagctaacacagtg

SEQ ID NO: 657846 - DNA, 20 bp, Artificial
  CRISPR gRNA sequence
cacagaagctaacacagtgc

SEQ ID NO: 657847 - DNA, 20 bp, Artificial
  CRISPR gRNA sequence
acacagtgccttatacatag

SEQ ID NO: 657848 - DNA, 20 bp, Artificial
  CRISPR gRNA sequence
atacatagtagtctctcaat

SEQ ID NO: 657849 - DNA, 20 bp, Artificial
  CRISPR gRNA sequence
tacatagtagtctctcaatt

SEQ ID NO: 657850 - DNA, 20 bp, Artificial
  CRISPR gRNA sequence
tcaattaagaagatttgctg

SEQ ID NO: 657851 - DNA, 20 bp, Artificial
  CRISPR gRNA sequence
aattaagaagatttgctgtt

SEQ ID NO: 657852 - DNA, 20 bp, Artificial
  CRISPR gRNA sequence
agaagatttgctgtttattt

SEQ ID NO: 657853 - DNA, 20 bp, Artificial
  CRISPR gRNA sequence
gctgtttattttaaaatata

SEQ ID NO: 657854 - DNA, 20 bp, Artificial
  CRISPR gRNA sequence
ctgtttattttaaaatatat

SEQ ID NO: 657855 - DNA, 20 bp, Artificial
  CRISPR gRNA sequence
tttattttaaaatatattgt

SEQ ID NO: 657856 - DNA, 20 bp, Artificial
  CRISPR gRNA sequence
attttaaaatatattgtgag

SEQ ID NO: 657857 - DNA, 20 bp, Artificial
  CRISPR gRNA sequence
ttttaaaatatattgtgagt

SEQ ID NO: 657858 - DNA, 20 bp, Artificial
  CRISPR gRNA sequence
taaaatatattgtgagttaa

SEQ ID NO: 657859 - DNA, 20 bp, Artificial
  CRISPR gRNA sequence
aaaatatattgtgagttaat

SEQ ID NO: 657860 - DNA, 20 bp, Artificial
  CRISPR gRNA sequence
aaatatattgtgagttaata

SEQ ID NO: 657861 - DNA, 20 bp, Artificial
  CRISPR gRNA sequence
tgagttaatatccctatgtg

SEQ ID NO: 657862 - DNA, 20 bp, Artificial
  CRISPR gRNA sequence
atatccctatgtgttggtta

SEQ ID NO: 657863 - DNA, 20 bp, Artificial
  CRISPR gRNA sequence
tgtgttggttatctgattga

SEQ ID NO: 657864 - DNA, 20 bp, Artificial
  CRISPR gRNA sequence
gttatctgattgactgaatg

SEQ ID NO: 657865 - DNA, 20 bp, Artificial
  CRISPR gRNA sequence
tctgattgactgaatgcatt

SEQ ID NO: 657866 - DNA, 20 bp, Artificial
  CRISPR gRNA sequence
attgactgaatgcattagag

SEQ ID NO: 657867 - DNA, 20 bp, Artificial
  CRISPR gRNA sequence
actgaatgcattagagacgt

SEQ ID NO: 657868 - DNA, 20 bp, Artificial
  CRISPR gRNA sequence
aatgcattagagacgtctct

SEQ ID NO: 657869 - DNA, 20 bp, Artificial
  CRISPR gRNA sequence
gagacgtctctcagttattc

SEQ ID NO: 657870 - DNA, 20 bp, Artificial
  CRISPR gRNA sequence
tcagttattccagacattat

SEQ ID NO: 657871 - DNA, 20 bp, Artificial
  CRISPR gRNA sequence
agttattccagacattatta

SEQ ID NO: 657872 - DNA, 20 bp, Artificial
  CRISPR gRNA sequence
ttccagacattattattcag

SEQ ID NO: 657873 - DNA, 20 bp, Artificial
  CRISPR gRNA sequence
cagacattattattcagatt

SEQ ID NO: 657874 - DNA, 20 bp, Artificial
  CRISPR gRNA sequence
ttattcagattaaccccaca

SEQ ID NO: 657875 - DNA, 20 bp, Artificial
  CRISPR gRNA sequence
ttcagattaaccccacaggt

SEQ ID NO: 657876 - DNA, 20 bp, Artificial
  CRISPR gRNA sequence
agattaaccccacaggttac

SEQ ID NO: 657877 - DNA, 20 bp, Artificial
  CRISPR gRNA sequence
accccacaggttacttcagt

SEQ ID NO: 657878 - DNA, 20 bp, Artificial
  CRISPR gRNA sequence
cttcagttatgctatctgtg

SEQ ID NO: 657879 - DNA, 20 bp, Artificial
  CRISPR gRNA sequence
cagttatgctatctgtgttg

SEQ ID NO: 657880 - DNA, 20 bp, Artificial
  CRISPR gRNA sequence
agttatgctatctgtgttga

SEQ ID NO: 657881 - DNA, 20 bp, Artificial
  CRISPR gRNA sequence
tgctatctgtgttgaggata

SEQ ID NO: 657882 - DNA, 20 bp, Artificial
  CRISPR gRNA sequence
tctgtgttgaggataccaga

SEQ ID NO: 657883 - DNA, 20 bp, Artificial
  CRISPR gRNA sequence
tgttgaggataccagagacc

SEQ ID NO: 657884 - DNA, 20 bp, Artificial
  CRISPR gRNA sequence
aggataccagagaccaaatc

SEQ ID NO: 657885 - DNA, 20 bp, Artificial
  CRISPR gRNA sequence
gtcttacccagaaggcagtt

SEQ ID NO: 657886 - DNA, 20 bp, Artificial
  CRISPR gRNA sequence
acccagaaggcagttttaaa

SEQ ID NO: 657887 - DNA, 20 bp, Artificial
  CRISPR gRNA sequence
cccagaaggcagttttaaaa

SEQ ID NO: 657888 - DNA, 20 bp, Artificial
  CRISPR gRNA sequence
taaaataaatgctctaacga

SEQ ID NO: 657889 - DNA, 20 bp, Artificial
  CRISPR gRNA sequence
aaaataaatgctctaacgat

SEQ ID NO: 657890 - DNA, 20 bp, Artificial
  CRISPR gRNA sequence
aaataaatgctctaacgatg

SEQ ID NO: 657891 - DNA, 20 bp, Artificial
  CRISPR gRNA sequence
taacgatggctctagcttag

SEQ ID NO: 657892 - DNA, 20 bp, Artificial
  CRISPR gRNA sequence
acgatggctctagcttagac

SEQ ID NO: 657893 - DNA, 20 bp, Artificial
  CRISPR gRNA sequence
tagcttagacaacttttaac

SEQ ID NO: 657894 - DNA, 20 bp, Artificial
  CRISPR gRNA sequence
gcttagacaacttttaactc

SEQ ID NO: 657895 - DNA, 20 bp, Artificial
  CRISPR gRNA sequence
agacaacttttaactctttt

SEQ ID NO: 657896 - DNA, 20 bp, Artificial
  CRISPR gRNA sequence
gacaacttttaactcttttc

SEQ ID NO: 657897 - DNA, 20 bp, Artificial
  CRISPR gRNA sequence
ttaactcttttctcaacact

SEQ ID NO: 657898 - DNA, 20 bp, Artificial
  CRISPR gRNA sequence
taactcttttctcaacactc

SEQ ID NO: 657899 - DNA, 20 bp, Artificial
  CRISPR gRNA sequence
aactcttttctcaacactca

SEQ ID NO: 657900 - DNA, 20 bp, Artificial
  CRISPR gRNA sequence
actcttttctcaacactcat

SEQ ID NO: 657901 - DNA, 20 bp, Artificial
  CRISPR gRNA sequence
ttttctcaacactcattcaa

SEQ ID NO: 657902 - DNA, 20 bp, Artificial
  CRISPR gRNA sequence
ttctcaacactcattcaaac

SEQ ID NO: 657903 - DNA, 20 bp, Artificial
  CRISPR gRNA sequence
tctcaacactcattcaaaca

SEQ ID NO: 657904 - DNA, 20 bp, Artificial
  CRISPR gRNA sequence
ctcaacactcattcaaacaa

SEQ ID NO: 657905 - DNA, 20 bp, Artificial
  CRISPR gRNA sequence
tcaacactcattcaaacaat

SEQ ID NO: 657906 - DNA, 20 bp, Artificial
  CRISPR gRNA sequence
aacactcattcaaacaatac

SEQ ID NO: 657907 - DNA, 20 bp, Artificial
  CRISPR gRNA sequence
attcaaacaatactacattg

SEQ ID NO: 657908 - DNA, 20 bp, Artificial
  CRISPR gRNA sequence
aaacaatactacattggact

SEQ ID NO: 657909 - DNA, 20 bp, Artificial
  CRISPR gRNA sequence
cattggactaaaagcttctc

SEQ ID NO: 657910 - DNA, 20 bp, Artificial
  CRISPR gRNA sequence
gactaaaagcttctcaagta

SEQ ID NO: 657911 - DNA, 20 bp, Artificial
  CRISPR gRNA sequence
aaagcttctcaagtacatga

SEQ ID NO: 657912 - DNA, 20 bp, Artificial
  CRISPR gRNA sequence
ctcaagtacatgacttcaaa

SEQ ID NO: 657913 - DNA, 20 bp, Artificial
  CRISPR gRNA sequence
tcaagtacatgacttcaaaa

SEQ ID NO: 657914 - DNA, 20 bp, Artificial
  CRISPR gRNA sequence
aagtacatgacttcaaaagc

SEQ ID NO: 657915 - DNA, 20 bp, Artificial
  CRISPR gRNA sequence
caaaagcttcacatggcttc

SEQ ID NO: 657916 - DNA, 20 bp, Artificial
  CRISPR gRNA sequence
aaaagcttcacatggcttca

SEQ ID NO: 657917 - DNA, 20 bp, Artificial
  CRISPR gRNA sequence
cacatggcttcaaaatatac

SEQ ID NO: 657918 - DNA, 20 bp, Artificial
  CRISPR gRNA sequence
acatggcttcaaaatataca

SEQ ID NO: 657919 - DNA, 20 bp, Artificial
  CRISPR gRNA sequence
caaaatatacatcttttcag

SEQ ID NO: 657920 - DNA, 20 bp, Artificial
  CRISPR gRNA sequence
aaaatatacatcttttcagc

SEQ ID NO: 657921 - DNA, 20 bp, Artificial
  CRISPR gRNA sequence
ttcagccagtgtcactctag

SEQ ID NO: 657922 - DNA, 20 bp, Artificial
  CRISPR gRNA sequence
tcagccagtgtcactctaga

SEQ ID NO: 657923 - DNA, 20 bp, Artificial
  CRISPR gRNA sequence
cagccagtgtcactctagaa

SEQ ID NO: 657924 - DNA, 20 bp, Artificial
  CRISPR gRNA sequence
agccagtgtcactctagaat

SEQ ID NO: 657925 - DNA, 20 bp, Artificial
  CRISPR gRNA sequence
tagaatttagagatggattt

SEQ ID NO: 657926 - DNA, 20 bp, Artificial
  CRISPR gRNA sequence
gaatttagagatggatttta

SEQ ID NO: 657927 - DNA, 20 bp, Artificial
  CRISPR gRNA sequence
agagatggattttataaaac

SEQ ID NO: 657928 - DNA, 20 bp, Artificial
  CRISPR gRNA sequence
gagatggattttataaaaca

SEQ ID NO: 657929 - DNA, 20 bp, Artificial
  CRISPR gRNA sequence
tataaaacactttaagggat

SEQ ID NO: 657930 - DNA, 20 bp, Artificial
  CRISPR gRNA sequence
ataaaacactttaagggata

SEQ ID NO: 657931 - DNA, 20 bp, Artificial
  CRISPR gRNA sequence
taaaacactttaagggatac

SEQ ID NO: 657932 - DNA, 20 bp, Artificial
  CRISPR gRNA sequence
taagggatacctagagaatc

SEQ ID NO: 657933 - DNA, 20 bp, Artificial
  CRISPR gRNA sequence
aagggatacctagagaatct

SEQ ID NO: 657934 - DNA, 20 bp, Artificial
  CRISPR gRNA sequence
agggatacctagagaatctt

SEQ ID NO: 657935 - DNA, 20 bp, Artificial
  CRISPR gRNA sequence
gagaatcttgaaatgtatat

SEQ ID NO: 657936 - DNA, 20 bp, Artificial
  CRISPR gRNA sequence
gaaatgtatatacaaacagg

SEQ ID NO: 657937 - DNA, 20 bp, Artificial
  CRISPR gRNA sequence
aaatgtatatacaaacaggt

SEQ ID NO: 657938 - DNA, 20 bp, Artificial
  CRISPR gRNA sequence
ttggaaaatcttaaagatac

SEQ ID NO: 657939 - DNA, 20 bp, Artificial
  CRISPR gRNA sequence
gaaaatcttaaagatacaat

SEQ ID NO: 657940 - DNA, 20 bp, Artificial
  CRISPR gRNA sequence
aaagatacaatttaaaagtt

SEQ ID NO: 657941 - DNA, 20 bp, Artificial
  CRISPR gRNA sequence
aagatacaatttaaaagtta

SEQ ID NO: 657942 - DNA, 20 bp, Artificial
  CRISPR gRNA sequence
aaaagttagtgttactatta

SEQ ID NO: 657943 - DNA, 20 bp, Artificial
  CRISPR gRNA sequence
aaagttagtgttactattat

SEQ ID NO: 657944 - DNA, 20 bp, Artificial
  CRISPR gRNA sequence
gtgttactattattattttg

SEQ ID NO: 657945 - DNA, 20 bp, Artificial
  CRISPR gRNA sequence
ctattattattttgagtaat

SEQ ID NO: 657946 - DNA, 20 bp, Artificial
  CRISPR gRNA sequence
ttattattttgagtaatgaa

SEQ ID NO: 657947 - DNA, 20 bp, Artificial
  CRISPR gRNA sequence
ttattttgagtaatgaatat

SEQ ID NO: 657948 - DNA, 20 bp, Artificial
  CRISPR gRNA sequence
ttttgagtaatgaatatttc

SEQ ID NO: 657949 - DNA, 20 bp, Artificial
  CRISPR gRNA sequence
tgagtaatgaatatttctga

SEQ ID NO: 657950 - DNA, 20 bp, Artificial
  CRISPR gRNA sequence
gagtaatgaatatttctgat

SEQ ID NO: 657951 - DNA, 20 bp, Artificial
  CRISPR gRNA sequence
agtaatgaatatttctgatc

SEQ ID NO: 657952 - DNA, 20 bp, Artificial
  CRISPR gRNA sequence
ctgatctttatgatccaaat

SEQ ID NO: 657953 - DNA, 20 bp, Artificial
  CRISPR gRNA sequence
tgatctttatgatccaaatc

SEQ ID NO: 657954 - DNA, 20 bp, Artificial
  CRISPR gRNA sequence
atctttatgatccaaatctt

SEQ ID NO: 657955 - DNA, 20 bp, Artificial
  CRISPR gRNA sequence
tatgatccaaatctttcaag

SEQ ID NO: 657956 - DNA, 20 bp, Artificial
  CRISPR gRNA sequence
atgatccaaatctttcaagt

SEQ ID NO: 657957 - DNA, 20 bp, Artificial
  CRISPR gRNA sequence
tgatccaaatctttcaagtc

SEQ ID NO: 657958 - DNA, 20 bp, Artificial
  CRISPR gRNA sequence
tcaagtcataaatcagtcat

SEQ ID NO: 657959 - DNA, 20 bp, Artificial
  CRISPR gRNA sequence
caagtcataaatcagtcatt

SEQ ID NO: 657960 - DNA, 20 bp, Artificial
  CRISPR gRNA sequence
aagtcataaatcagtcattt

SEQ ID NO: 657961 - DNA, 20 bp, Artificial
  CRISPR gRNA sequence
agtagatatacatgaaaatg

SEQ ID NO: 657962 - DNA, 20 bp, Artificial
  CRISPR gRNA sequence
gtagatatacatgaaaatga

SEQ ID NO: 657963 - DNA, 20 bp, Artificial
  CRISPR gRNA sequence
taatgttgtttttaataaac

SEQ ID NO: 657964 - DNA, 20 bp, Artificial
  CRISPR gRNA sequence
atgttgtttttaataaactt

SEQ ID NO: 657965 - DNA, 20 bp, Artificial
  CRISPR gRNA sequence
tttttaataaactttaatcc

SEQ ID NO: 657966 - DNA, 20 bp, Artificial
  CRISPR gRNA sequence
ttaataaactttaatccagt

SEQ ID NO: 657967 - DNA, 20 bp, Artificial
  CRISPR gRNA sequence
taataaactttaatccagta

SEQ ID NO: 657968 - DNA, 20 bp, Artificial
  CRISPR gRNA sequence
aataaactttaatccagtag

SEQ ID NO: 657969 - DNA, 20 bp, Artificial
  CRISPR gRNA sequence
ataaactttaatccagtagc

SEQ ID NO: 657970 - DNA, 20 bp, Artificial
  CRISPR gRNA sequence
taatccagtagctaaatctc

SEQ ID NO: 657971 - DNA, 20 bp, Artificial
  CRISPR gRNA sequence
aatccagtagctaaatctca

SEQ ID NO: 657972 - DNA, 20 bp, Artificial
  CRISPR gRNA sequence
atccagtagctaaatctcaa

SEQ ID NO: 657973 - DNA, 20 bp, Artificial
  CRISPR gRNA sequence
aatctcaaagatcatttaga

SEQ ID NO: 657974 - DNA, 20 bp, Artificial
  CRISPR gRNA sequence
aaagatcatttagaatccta

SEQ ID NO: 657975 - DNA, 20 bp, Artificial
  CRISPR gRNA sequence
agaatcctatgaatcaaatg

SEQ ID NO: 657976 - DNA, 20 bp, Artificial
  CRISPR gRNA sequence
gaatcctatgaatcaaatgg

SEQ ID NO: 657977 - DNA, 20 bp, Artificial
  CRISPR gRNA sequence
tgaatcaaatggctctccct

SEQ ID NO: 657978 - DNA, 20 bp, Artificial
  CRISPR gRNA sequence
tcccttaaaactgttaagac

SEQ ID NO: 657979 - DNA, 20 bp, Artificial
  CRISPR gRNA sequence
ccttaaaactgttaagacag

SEQ ID NO: 657980 - DNA, 20 bp, Artificial
  CRISPR gRNA sequence
aaaactgttaagacagttct

SEQ ID NO: 657981 - DNA, 20 bp, Artificial
  CRISPR gRNA sequence
aaactgttaagacagttctg

SEQ ID NO: 657982 - DNA, 20 bp, Artificial
  CRISPR gRNA sequence
ttaagacagttctgttgatt

SEQ ID NO: 657983 - DNA, 20 bp, Artificial
  CRISPR gRNA sequence
agacagttctgttgattcca

SEQ ID NO: 657984 - DNA, 20 bp, Artificial
  CRISPR gRNA sequence
tgttgattccagattgtgag

SEQ ID NO: 657985 - DNA, 20 bp, Artificial
  CRISPR gRNA sequence
ttgattccagattgtgagcc

SEQ ID NO: 657986 - DNA, 20 bp, Artificial
  CRISPR gRNA sequence
attccagattgtgagccaga

SEQ ID NO: 657987 - DNA, 20 bp, Artificial
  CRISPR gRNA sequence
cagattgtgagccagacctc

SEQ ID NO: 657988 - DNA, 20 bp, Artificial
  CRISPR gRNA sequence
tgagccagacctccattttc

SEQ ID NO: 657989 - DNA, 20 bp, Artificial
  CRISPR gRNA sequence
cattttcttagaggagttgt

SEQ ID NO: 657990 - DNA, 20 bp, Artificial
  CRISPR gRNA sequence
tcttagaggagttgtgataa

SEQ ID NO: 657991 - DNA, 20 bp, Artificial
  CRISPR gRNA sequence
cttagaggagttgtgataat

SEQ ID NO: 657992 - DNA, 20 bp, Artificial
  CRISPR gRNA sequence
ttagaggagttgtgataatt

SEQ ID NO: 657993 - DNA, 20 bp, Artificial
  CRISPR gRNA sequence
agaggagttgtgataattat

SEQ ID NO: 657994 - DNA, 20 bp, Artificial
  CRISPR gRNA sequence
gaggagttgtgataattatc

SEQ ID NO: 657995 - DNA, 20 bp, Artificial
  CRISPR gRNA sequence
tgataattatcacatttgtc

SEQ ID NO: 657996 - DNA, 20 bp, Artificial
  CRISPR gRNA sequence
tcacatttgtctacaattat

SEQ ID NO: 657997 - DNA, 20 bp, Artificial
  CRISPR gRNA sequence
gtctacaattattgtaacag

SEQ ID NO: 657998 - DNA, 20 bp, Artificial
  CRISPR gRNA sequence
tctacaattattgtaacagt

SEQ ID NO: 657999 - DNA, 20 bp, Artificial
  CRISPR gRNA sequence
caattattgtaacagtactt

SEQ ID NO: 658000 - DNA, 20 bp, Artificial
  CRISPR gRNA sequence
ttgtaacagtacttgggttc

SEQ ID NO: 658001 - DNA, 20 bp, Artificial
  CRISPR gRNA sequence
taacagtacttgggttcata

SEQ ID NO: 658002 - DNA, 20 bp, Artificial
  CRISPR gRNA sequence
gggttcatatacacaatctt

SEQ ID NO: 658003 - DNA, 20 bp, Artificial
  CRISPR gRNA sequence
ggttcatatacacaatcttt

SEQ ID NO: 658004 - DNA, 20 bp, Artificial
  CRISPR gRNA sequence
atatacacaatctttacaaa

SEQ ID NO: 658005 - DNA, 20 bp, Artificial
  CRISPR gRNA sequence
tacaaaagatatttccccca

SEQ ID NO: 658006 - DNA, 20 bp, Artificial
  CRISPR gRNA sequence
acaaaagatatttcccccag

SEQ ID NO: 658007 - DNA, 20 bp, Artificial
  CRISPR gRNA sequence
caaaagatatttcccccagt

SEQ ID NO: 658008 - DNA, 20 bp, Artificial
  CRISPR gRNA sequence
cccccagttttatcccaaca

SEQ ID NO: 658009 - DNA, 20 bp, Artificial
  CRISPR gRNA sequence
ccccagttttatcccaacat

SEQ ID NO: 658010 - DNA, 20 bp, Artificial
  CRISPR gRNA sequence
tatcccaacatttacattcc

SEQ ID NO: 658011 - DNA, 20 bp, Artificial
  CRISPR gRNA sequence
atcccaacatttacattccc

SEQ ID NO: 658012 - DNA, 20 bp, Artificial
  CRISPR gRNA sequence
tcccaacatttacattcccc

SEQ ID NO: 658013 - DNA, 20 bp, Artificial
  CRISPR gRNA sequence
acattccccctcagttgaat

SEQ ID NO: 658014 - DNA, 20 bp, Artificial
  CRISPR gRNA sequence
cattccccctcagttgaatt

SEQ ID NO: 658015 - DNA, 20 bp, Artificial
  CRISPR gRNA sequence
cccctcagttgaattcttac

SEQ ID NO: 658016 - DNA, 20 bp, Artificial
  CRISPR gRNA sequence
agttgaattcttactagaaa

SEQ ID NO: 658017 - DNA, 20 bp, Artificial
  CRISPR gRNA sequence
aattcttactagaaatattt

SEQ ID NO: 658018 - DNA, 20 bp, Artificial
  CRISPR gRNA sequence
ttactagaaatatttgctta

SEQ ID NO: 658019 - DNA, 20 bp, Artificial
  CRISPR gRNA sequence
actagaaatatttgcttaaa

SEQ ID NO: 658020 - DNA, 20 bp, Artificial
  CRISPR gRNA sequence
ctagaaatatttgcttaaat

SEQ ID NO: 658021 - DNA, 20 bp, Artificial
  CRISPR gRNA sequence
gaaatatttgcttaaatatg

SEQ ID NO: 658022 - DNA, 20 bp, Artificial
  CRISPR gRNA sequence
gcttaaatatgtccaagcaa

SEQ ID NO: 658023 - DNA, 20 bp, Artificial
  CRISPR gRNA sequence
cttaaatatgtccaagcaat

SEQ ID NO: 658024 - DNA, 20 bp, Artificial
  CRISPR gRNA sequence
aaatatgtccaagcaatttg

SEQ ID NO: 658025 - DNA, 20 bp, Artificial
  CRISPR gRNA sequence
aatatgtccaagcaatttgt

SEQ ID NO: 658026 - DNA, 20 bp, Artificial
  CRISPR gRNA sequence
gttacatgagcaatcattat

SEQ ID NO: 658027 - DNA, 20 bp, Artificial
  CRISPR gRNA sequence
ttacatgagcaatcattatc

SEQ ID NO: 658028 - DNA, 20 bp, Artificial
  CRISPR gRNA sequence
catgagcaatcattatctag

SEQ ID NO: 658029 - DNA, 20 bp, Artificial
  CRISPR gRNA sequence
tctagttttacaagcatttg

SEQ ID NO: 658030 - DNA, 20 bp, Artificial
  CRISPR gRNA sequence
gttttacaagcatttgtttg

SEQ ID NO: 658031 - DNA, 20 bp, Artificial
  CRISPR gRNA sequence
tacaagcatttgtttgtaat

SEQ ID NO: 658032 - DNA, 20 bp, Artificial
  CRISPR gRNA sequence
acaagcatttgtttgtaatc

SEQ ID NO: 658033 - DNA, 20 bp, Artificial
  CRISPR gRNA sequence
caagcatttgtttgtaatca

SEQ ID NO: 658034 - DNA, 20 bp, Artificial
  CRISPR gRNA sequence
gtttgtaatcattcctatag

SEQ ID NO: 658035 - DNA, 20 bp, Artificial
  CRISPR gRNA sequence
tttgtaatcattcctatagc

SEQ ID NO: 658036 - DNA, 20 bp, Artificial
  CRISPR gRNA sequence
gtaatcattcctatagctgc

SEQ ID NO: 658037 - DNA, 20 bp, Artificial
  CRISPR gRNA sequence
taatcattcctatagctgca

SEQ ID NO: 658038 - DNA, 20 bp, Artificial
  CRISPR gRNA sequence
ctatagctgcaagaaataag

SEQ ID NO: 658039 - DNA, 20 bp, Artificial
  CRISPR gRNA sequence
tagctgcaagaaataaggca

SEQ ID NO: 658040 - DNA, 20 bp, Artificial
  CRISPR gRNA sequence
caagaaataaggcagtatat

SEQ ID NO: 658041 - DNA, 20 bp, Artificial
  CRISPR gRNA sequence
aatagcttgaagaataccat

SEQ ID NO: 658042 - DNA, 20 bp, Artificial
  CRISPR gRNA sequence
atagcttgaagaataccatg

SEQ ID NO: 658043 - DNA, 20 bp, Artificial
  CRISPR gRNA sequence
gaagaataccatgtattctc

SEQ ID NO: 658044 - DNA, 20 bp, Artificial
  CRISPR gRNA sequence
aagaataccatgtattctct

SEQ ID NO: 658045 - DNA, 20 bp, Artificial
  CRISPR gRNA sequence
tctttgtttacattgtaaca

SEQ ID NO: 658046 - DNA, 20 bp, Artificial
  CRISPR gRNA sequence
tttgtttacattgtaacaga

SEQ ID NO: 658047 - DNA, 20 bp, Artificial
  CRISPR gRNA sequence
tgtttacattgtaacagatc

SEQ ID NO: 658048 - DNA, 20 bp, Artificial
  CRISPR gRNA sequence
gtttacattgtaacagatca

SEQ ID NO: 658049 - DNA, 20 bp, Artificial
  CRISPR gRNA sequence
tttacattgtaacagatcat

SEQ ID NO: 658050 - DNA, 20 bp, Artificial
  CRISPR gRNA sequence
acattgtaacagatcatctt

SEQ ID NO: 658051 - DNA, 20 bp, Artificial
  CRISPR gRNA sequence
cattgtaacagatcatcttc

SEQ ID NO: 658052 - DNA, 20 bp, Artificial
  CRISPR gRNA sequence
taacagatcatcttcttaag

SEQ ID NO: 658053 - DNA, 20 bp, Artificial
  CRISPR gRNA sequence
cttaagaagtaatcttttat

SEQ ID NO: 658054 - DNA, 20 bp, Artificial
  CRISPR gRNA sequence
ttaagaagtaatcttttatt

SEQ ID NO: 658055 - DNA, 20 bp, Artificial
  CRISPR gRNA sequence
aagaagtaatcttttattgt

SEQ ID NO: 658056 - DNA, 20 bp, Artificial
  CRISPR gRNA sequence
agaagtaatcttttattgta

SEQ ID NO: 658057 - DNA, 20 bp, Artificial
  CRISPR gRNA sequence
ttattgtatctctttcactg

SEQ ID NO: 658058 - DNA, 20 bp, Artificial
  CRISPR gRNA sequence
tattgtatctctttcactgt

SEQ ID NO: 658059 - DNA, 20 bp, Artificial
  CRISPR gRNA sequence
attgtatctctttcactgtt

SEQ ID NO: 658060 - DNA, 20 bp, Artificial
  CRISPR gRNA sequence
ttgtatctctttcactgttt

SEQ ID NO: 658061 - DNA, 20 bp, Artificial
  CRISPR gRNA sequence
tatctctttcactgttttct

SEQ ID NO: 658062 - DNA, 20 bp, Artificial
  CRISPR gRNA sequence
tttcactgttttctttaacg

SEQ ID NO: 658063 - DNA, 20 bp, Artificial
  CRISPR gRNA sequence
tcactgttttctttaacgtt

SEQ ID NO: 658064 - DNA, 20 bp, Artificial
  CRISPR gRNA sequence
cactgttttctttaacgtta

SEQ ID NO: 658065 - DNA, 20 bp, Artificial
  CRISPR gRNA sequence
actgttttctttaacgttac

SEQ ID NO: 658066 - DNA, 20 bp, Artificial
  CRISPR gRNA sequence
ttttctttaacgttacaaaa

SEQ ID NO: 658067 - DNA, 20 bp, Artificial
  CRISPR gRNA sequence
tctttaacgttacaaaaaaa

SEQ ID NO: 658068 - DNA, 20 bp, Artificial
  CRISPR gRNA sequence
ctttaacgttacaaaaaaat

SEQ ID NO: 658069 - DNA, 20 bp, Artificial
  CRISPR gRNA sequence
tttaacgttacaaaaaaatt

SEQ ID NO: 658070 - DNA, 20 bp, Artificial
  CRISPR gRNA sequence
taacgttacaaaaaaatttt

SEQ ID NO: 658071 - DNA, 20 bp, Artificial
  CRISPR gRNA sequence
aacgttacaaaaaaattttg

SEQ ID NO: 658072 - DNA, 20 bp, Artificial
  CRISPR gRNA sequence
acgttacaaaaaaattttgt

SEQ ID NO: 658073 - DNA, 20 bp, Artificial
  CRISPR gRNA sequence
caaaaaaattttgtgttatt

SEQ ID NO: 658074 - DNA, 20 bp, Artificial
  CRISPR gRNA sequence
tgtgttatttggaagctcat

SEQ ID NO: 658075 - DNA, 20 bp, Artificial
  CRISPR gRNA sequence
gtgttatttggaagctcatg

SEQ ID NO: 658076 - DNA, 20 bp, Artificial
  CRISPR gRNA sequence
tgttatttggaagctcatga

SEQ ID NO: 658077 - DNA, 20 bp, Artificial
  CRISPR gRNA sequence
tttggaagctcatgaaatat

SEQ ID NO: 658078 - DNA, 20 bp, Artificial
  CRISPR gRNA sequence
ggaagctcatgaaatataat

SEQ ID NO: 658079 - DNA, 20 bp, Artificial
  CRISPR gRNA sequence
gaagctcatgaaatataatt

SEQ ID NO: 658080 - DNA, 20 bp, Artificial
  CRISPR gRNA sequence
atgaaatataatttgcttgg

SEQ ID NO: 658081 - DNA, 20 bp, Artificial
  CRISPR gRNA sequence
gcttggcgtatggttctgtg

SEQ ID NO: 658082 - DNA, 20 bp, Artificial
  CRISPR gRNA sequence
cttggcgtatggttctgtga

SEQ ID NO: 658083 - DNA, 20 bp, Artificial
  CRISPR gRNA sequence
ggcgtatggttctgtgaatt

SEQ ID NO: 658084 - DNA, 20 bp, Artificial
  CRISPR gRNA sequence
gcgtatggttctgtgaatta

SEQ ID NO: 658085 - DNA, 20 bp, Artificial
  CRISPR gRNA sequence
tgtgaattaagcccataata

SEQ ID NO: 658086 - DNA, 20 bp, Artificial
  CRISPR gRNA sequence
tgaattaagcccataatatc

SEQ ID NO: 658087 - DNA, 20 bp, Artificial
  CRISPR gRNA sequence
agcccataatatctaactgg

SEQ ID NO: 658088 - DNA, 20 bp, Artificial
  CRISPR gRNA sequence
actggcatatataggaaagc

SEQ ID NO: 658089 - DNA, 20 bp, Artificial
  CRISPR gRNA sequence
gcatatataggaaagcaatg

SEQ ID NO: 658090 - DNA, 20 bp, Artificial
  CRISPR gRNA sequence
aatcctaactgaactgaaaa

SEQ ID NO: 658091 - DNA, 20 bp, Artificial
  CRISPR gRNA sequence
atcctaactgaactgaaaat

SEQ ID NO: 658092 - DNA, 20 bp, Artificial
  CRISPR gRNA sequence
actgaactgaaaattcaagc

SEQ ID NO: 658093 - DNA, 20 bp, Artificial
  CRISPR gRNA sequence
aactgaaaattcaagcttgt

SEQ ID NO: 658094 - DNA, 20 bp, Artificial
  CRISPR gRNA sequence
aaaattcaagcttgtatcca

SEQ ID NO: 658095 - DNA, 20 bp, Artificial
  CRISPR gRNA sequence
aagcttgtatccatatattt

SEQ ID NO: 658096 - DNA, 20 bp, Artificial
  CRISPR gRNA sequence
gtatccatatatttttagta

SEQ ID NO: 658097 - DNA, 20 bp, Artificial
  CRISPR gRNA sequence
tatccatatatttttagtag

SEQ ID NO: 658098 - DNA, 20 bp, Artificial
  CRISPR gRNA sequence
ttagtagcaatttaatgata

SEQ ID NO: 658099 - DNA, 20 bp, Artificial
  CRISPR gRNA sequence
tagtagcaatttaatgataa

SEQ ID NO: 658100 - DNA, 20 bp, Artificial
  CRISPR gRNA sequence
agtagcaatttaatgataat

SEQ ID NO: 658101 - DNA, 20 bp, Artificial
  CRISPR gRNA sequence
gtagcaatttaatgataatc

SEQ ID NO: 658102 - DNA, 20 bp, Artificial
  CRISPR gRNA sequence
aatgataatcaagtcatatg

SEQ ID NO: 658103 - DNA, 20 bp, Artificial
  CRISPR gRNA sequence
atgataatcaagtcatatgc

SEQ ID NO: 658104 - DNA, 20 bp, Artificial
  CRISPR gRNA sequence
atgtgccaaaaagaactgtt

SEQ ID NO: 658105 - DNA, 20 bp, Artificial
  CRISPR gRNA sequence
tgtgccaaaaagaactgttt

SEQ ID NO: 658106 - DNA, 20 bp, Artificial
  CRISPR gRNA sequence
tttgtggtaatcaatctgta

SEQ ID NO: 658107 - DNA, 20 bp, Artificial
  CRISPR gRNA sequence
gtggtaatcaatctgtaatt

SEQ ID NO: 658108 - DNA, 20 bp, Artificial
  CRISPR gRNA sequence
tggtaatcaatctgtaattt

SEQ ID NO: 658109 - DNA, 20 bp, Artificial
  CRISPR gRNA sequence
taattttctgtttgacattt

SEQ ID NO: 658110 - DNA, 20 bp, Artificial
  CRISPR gRNA sequence
tctgtttgacatttttttcc

SEQ ID NO: 658111 - DNA, 20 bp, Artificial
  CRISPR gRNA sequence
ctgtttgacatttttttcct

SEQ ID NO: 658112 - DNA, 20 bp, Artificial
  CRISPR gRNA sequence
tgtttgacatttttttcctt

SEQ ID NO: 658113 - DNA, 20 bp, Artificial
  CRISPR gRNA sequence
tttgacatttttttcctttg

SEQ ID NO: 658114 - DNA, 20 bp, Artificial
  CRISPR gRNA sequence
gacatttttttcctttgaat

SEQ ID NO: 658115 - DNA, 20 bp, Artificial
  CRISPR gRNA sequence
acatttttttcctttgaatt

SEQ ID NO: 658116 - DNA, 20 bp, Artificial
  CRISPR gRNA sequence
ttttcctttgaattactgta

SEQ ID NO: 658117 - DNA, 20 bp, Artificial
  CRISPR gRNA sequence
tttcctttgaattactgtaa

SEQ ID NO: 658118 - DNA, 20 bp, Artificial
  CRISPR gRNA sequence
ttcctttgaattactgtaaa

SEQ ID NO: 658119 - DNA, 20 bp, Artificial
  CRISPR gRNA sequence
tcctttgaattactgtaaaa

SEQ ID NO: 658120 - DNA, 20 bp, Artificial
  CRISPR gRNA sequence
cctttgaattactgtaaaat

SEQ ID NO: 658121 - DNA, 20 bp, Artificial
  CRISPR gRNA sequence
ctttgaattactgtaaaata

SEQ ID NO: 658122 - DNA, 20 bp, Artificial
  CRISPR gRNA sequence
tgaattactgtaaaatactt

SEQ ID NO: 658123 - DNA, 20 bp, Artificial
  CRISPR gRNA sequence
gaattactgtaaaatacttt

SEQ ID NO: 658124 - DNA, 20 bp, Artificial
  CRISPR gRNA sequence
aattactgtaaaatactttc

SEQ ID NO: 658125 - DNA, 20 bp, Artificial
  CRISPR gRNA sequence
ctgtaaaatactttcagcta

SEQ ID NO: 658126 - DNA, 20 bp, Artificial
  CRISPR gRNA sequence
taaaatactttcagctacta

SEQ ID NO: 658127 - DNA, 20 bp, Artificial
  CRISPR gRNA sequence
tcagctactagtaagattat

SEQ ID NO: 658128 - DNA, 20 bp, Artificial
  CRISPR gRNA sequence
cagctactagtaagattatt

SEQ ID NO: 658129 - DNA, 20 bp, Artificial
  CRISPR gRNA sequence
agctactagtaagattattt

SEQ ID NO: 658130 - DNA, 20 bp, Artificial
  CRISPR gRNA sequence
ctagtaagattattttaaat

SEQ ID NO: 658131 - DNA, 20 bp, Artificial
  CRISPR gRNA sequence
gtaagattattttaaatcac

SEQ ID NO: 658132 - DNA, 20 bp, Artificial
  CRISPR gRNA sequence
ttttaaatcacaattaaaat

SEQ ID NO: 658133 - DNA, 20 bp, Artificial
  CRISPR gRNA sequence
taaatcacaattaaaattga

SEQ ID NO: 658134 - DNA, 20 bp, Artificial
  CRISPR gRNA sequence
aaatcacaattaaaattgat

SEQ ID NO: 658135 - DNA, 20 bp, Artificial
  CRISPR gRNA sequence
aatcacaattaaaattgatt

SEQ ID NO: 658136 - DNA, 20 bp, Artificial
  CRISPR gRNA sequence
aaattgatttttccctgctt

SEQ ID NO: 658137 - DNA, 20 bp, Artificial
  CRISPR gRNA sequence
atttttccctgcttgggtgg

SEQ ID NO: 658138 - DNA, 20 bp, Artificial
  CRISPR gRNA sequence
ttccctgcttgggtgggtct

SEQ ID NO: 658139 - DNA, 20 bp, Artificial
  CRISPR gRNA sequence
tccctgcttgggtgggtctt

SEQ ID NO: 658140 - DNA, 20 bp, Artificial
  CRISPR gRNA sequence
ccctgcttgggtgggtctta

SEQ ID NO: 658141 - DNA, 20 bp, Artificial
  CRISPR gRNA sequence
cctgcttgggtgggtcttaa

SEQ ID NO: 658142 - DNA, 20 bp, Artificial
  CRISPR gRNA sequence
cttgggtgggtcttaaggtt

SEQ ID NO: 658143 - DNA, 20 bp, Artificial
  CRISPR gRNA sequence
gggtgggtcttaaggttggt

SEQ ID NO: 658144 - DNA, 20 bp, Artificial
  CRISPR gRNA sequence
ggtgggtcttaaggttggtg

SEQ ID NO: 658145 - DNA, 20 bp, Artificial
  CRISPR gRNA sequence
aaggttggtggggaacttca

SEQ ID NO: 658146 - DNA, 20 bp, Artificial
  CRISPR gRNA sequence
aggttggtggggaacttcag

SEQ ID NO: 658147 - DNA, 20 bp, Artificial
  CRISPR gRNA sequence
gtggggaacttcagtgctcc

SEQ ID NO: 658148 - DNA, 20 bp, Artificial
  CRISPR gRNA sequence
cagtgctcccccaaatgctt

SEQ ID NO: 658149 - DNA, 20 bp, Artificial
  CRISPR gRNA sequence
agtgctcccccaaatgcttc

SEQ ID NO: 658150 - DNA, 20 bp, Artificial
  CRISPR gRNA sequence
ccccaaatgcttccttttca

SEQ ID NO: 658151 - DNA, 20 bp, Artificial
  CRISPR gRNA sequence
ccttttcaagtgtgaagttt

SEQ ID NO: 658152 - DNA, 20 bp, Artificial
  CRISPR gRNA sequence
cttttcaagtgtgaagttta

SEQ ID NO: 658153 - DNA, 20 bp, Artificial
  CRISPR gRNA sequence
ttcaagtgtgaagtttacgg

SEQ ID NO: 658154 - DNA, 20 bp, Artificial
  CRISPR gRNA sequence
tcaagtgtgaagtttacgga

SEQ ID NO: 658155 - DNA, 20 bp, Artificial
  CRISPR gRNA sequence
caagtgtgaagtttacggat

SEQ ID NO: 658156 - DNA, 20 bp, Artificial
  CRISPR gRNA sequence
aagtgtgaagtttacggata

SEQ ID NO: 658157 - DNA, 20 bp, Artificial
  CRISPR gRNA sequence
acggatattttggatcttac

SEQ ID NO: 658158 - DNA, 20 bp, Artificial
  CRISPR gRNA sequence
cggatattttggatcttact

SEQ ID NO: 658159 - DNA, 20 bp, Artificial
  CRISPR gRNA sequence
tggatcttactgtgttctca

SEQ ID NO: 658160 - DNA, 20 bp, Artificial
  CRISPR gRNA sequence
ggatcttactgtgttctcag

SEQ ID NO: 658161 - DNA, 20 bp, Artificial
  CRISPR gRNA sequence
gatcttactgtgttctcagg

SEQ ID NO: 658162 - DNA, 20 bp, Artificial
  CRISPR gRNA sequence
actgtgttctcaggatcatg

SEQ ID NO: 658163 - DNA, 20 bp, Artificial
  CRISPR gRNA sequence
ctgtgttctcaggatcatgt

SEQ ID NO: 658164 - DNA, 20 bp, Artificial
  CRISPR gRNA sequence
tgttctcaggatcatgtctc

SEQ ID NO: 658165 - DNA, 20 bp, Artificial
  CRISPR gRNA sequence
tcaggatcatgtctctaggt

SEQ ID NO: 658166 - DNA, 20 bp, Artificial
  CRISPR gRNA sequence
aggatcatgtctctaggtag

SEQ ID NO: 658167 - DNA, 20 bp, Artificial
  CRISPR gRNA sequence
taggtaggcacagctttgat

SEQ ID NO: 658168 - DNA, 20 bp, Artificial
  CRISPR gRNA sequence
ggtaggcacagctttgatga

SEQ ID NO: 658169 - DNA, 20 bp, Artificial
  CRISPR gRNA sequence
tgatgactgatgtctattaa

SEQ ID NO: 658170 - DNA, 20 bp, Artificial
  CRISPR gRNA sequence
gatgactgatgtctattaat

SEQ ID NO: 658171 - DNA, 20 bp, Artificial
  CRISPR gRNA sequence
atgactgatgtctattaatt

SEQ ID NO: 658172 - DNA, 20 bp, Artificial
  CRISPR gRNA sequence
atgtctattaattgtgtttg

SEQ ID NO: 658173 - DNA, 20 bp, Artificial
  CRISPR gRNA sequence
ttaattgtgtttgtcagttt

SEQ ID NO: 658174 - DNA, 20 bp, Artificial
  CRISPR gRNA sequence
attgtgtttgtcagtttata

SEQ ID NO: 658175 - DNA, 20 bp, Artificial
  CRISPR gRNA sequence
tgtttgtcagtttataacaa

SEQ ID NO: 658176 - DNA, 20 bp, Artificial
  CRISPR gRNA sequence
gtcagtttataacaaagcat

SEQ ID NO: 658177 - DNA, 20 bp, Artificial
  CRISPR gRNA sequence
tcagtttataacaaagcatt

SEQ ID NO: 658178 - DNA, 20 bp, Artificial
  CRISPR gRNA sequence
ataacaaagcatttattgct

SEQ ID NO: 658179 - DNA, 20 bp, Artificial
  CRISPR gRNA sequence
taacaaagcatttattgctc

SEQ ID NO: 658180 - DNA, 20 bp, Artificial
  CRISPR gRNA sequence
attgctctaaaatgctctca

SEQ ID NO: 658181 - DNA, 20 bp, Artificial
  CRISPR gRNA sequence
ttgctctaaaatgctctcat

SEQ ID NO: 658182 - DNA, 20 bp, Artificial
  CRISPR gRNA sequence
ctctaaaatgctctcatgct

SEQ ID NO: 658183 - DNA, 20 bp, Artificial
  CRISPR gRNA sequence
taaaatgctctcatgctttg

SEQ ID NO: 658184 - DNA, 20 bp, Artificial
  CRISPR gRNA sequence
aaatgctctcatgctttggt

SEQ ID NO: 658185 - DNA, 20 bp, Artificial
  CRISPR gRNA sequence
tcatgctttggtattttgac

SEQ ID NO: 658186 - DNA, 20 bp, Artificial
  CRISPR gRNA sequence
atgctttggtattttgactt

SEQ ID NO: 658187 - DNA, 20 bp, Artificial
  CRISPR gRNA sequence
tggtattttgacttctttcc

SEQ ID NO: 658188 - DNA, 20 bp, Artificial
  CRISPR gRNA sequence
ggtattttgacttctttcct

SEQ ID NO: 658189 - DNA, 20 bp, Artificial
  CRISPR gRNA sequence
gtattttgacttctttcctg

SEQ ID NO: 658190 - DNA, 20 bp, Artificial
  CRISPR gRNA sequence
tgacttctttcctgcctgtg

SEQ ID NO: 658191 - DNA, 20 bp, Artificial
  CRISPR gRNA sequence
gacttctttcctgcctgtga

SEQ ID NO: 658192 - DNA, 20 bp, Artificial
  CRISPR gRNA sequence
acttctttcctgcctgtgag

SEQ ID NO: 658193 - DNA, 20 bp, Artificial
  CRISPR gRNA sequence
ctttcctgcctgtgagagac

SEQ ID NO: 658194 - DNA, 20 bp, Artificial
  CRISPR gRNA sequence
tttcctgcctgtgagagacc

SEQ ID NO: 658195 - DNA, 20 bp, Artificial
  CRISPR gRNA sequence
tcctgcctgtgagagaccct

SEQ ID NO: 658196 - DNA, 20 bp, Artificial
  CRISPR gRNA sequence
cctgcctgtgagagacccta

SEQ ID NO: 658197 - DNA, 20 bp, Artificial
  CRISPR gRNA sequence
ctgcctgtgagagaccctag

SEQ ID NO: 658198 - DNA, 20 bp, Artificial
  CRISPR gRNA sequence
cctgtgagagaccctagctt

SEQ ID NO: 658199 - DNA, 20 bp, Artificial
  CRISPR gRNA sequence
tgagagaccctagcttagtg

SEQ ID NO: 658200 - DNA, 20 bp, Artificial
  CRISPR gRNA sequence
gcttagtgattagtttttgt

SEQ ID NO: 658201 - DNA, 20 bp, Artificial
  CRISPR gRNA sequence
agtgattagtttttgtttct

SEQ ID NO: 658202 - DNA, 20 bp, Artificial
  CRISPR gRNA sequence
gtgattagtttttgtttctg

SEQ ID NO: 658203 - DNA, 20 bp, Artificial
  CRISPR gRNA sequence
gtttttgtttctgagtttct

SEQ ID NO: 658204 - DNA, 20 bp, Artificial
  CRISPR gRNA sequence
ttgtttctgagtttctgttt

SEQ ID NO: 658205 - DNA, 20 bp, Artificial
  CRISPR gRNA sequence
tgtttctgagtttctgtttt

SEQ ID NO: 658206 - DNA, 20 bp, Artificial
  CRISPR gRNA sequence
gtttctgagtttctgttttt

SEQ ID NO: 658207 - DNA, 20 bp, Artificial
  CRISPR gRNA sequence
tttctgagtttctgttttta

SEQ ID NO: 658208 - DNA, 20 bp, Artificial
  CRISPR gRNA sequence
ctgagtttctgtttttacca

SEQ ID NO: 658209 - DNA, 20 bp, Artificial
  CRISPR gRNA sequence
tgagtttctgtttttaccaa

SEQ ID NO: 658210 - DNA, 20 bp, Artificial
  CRISPR gRNA sequence
agtttctgtttttaccaagt

SEQ ID NO: 658211 - DNA, 20 bp, Artificial
  CRISPR gRNA sequence
ctgtttttaccaagtgtttt

SEQ ID NO: 658212 - DNA, 20 bp, Artificial
  CRISPR gRNA sequence
tgtttttaccaagtgttttt

SEQ ID NO: 658213 - DNA, 20 bp, Artificial
  CRISPR gRNA sequence
tttttaccaagtgtttttat

SEQ ID NO: 658214 - DNA, 20 bp, Artificial
  CRISPR gRNA sequence
ttaccaagtgtttttatttt

SEQ ID NO: 658215 - DNA, 20 bp, Artificial
  CRISPR gRNA sequence
taccaagtgtttttattttc

SEQ ID NO: 658216 - DNA, 20 bp, Artificial
  CRISPR gRNA sequence
accaagtgtttttattttct

SEQ ID NO: 658217 - DNA, 20 bp, Artificial
  CRISPR gRNA sequence
ccaagtgtttttattttcta

SEQ ID NO: 658218 - DNA, 20 bp, Artificial
  CRISPR gRNA sequence
ttattttctagattactggc

SEQ ID NO: 658219 - DNA, 20 bp, Artificial
  CRISPR gRNA sequence
tattttctagattactggct

SEQ ID NO: 658220 - DNA, 20 bp, Artificial
  CRISPR gRNA sequence
attttctagattactggcta

SEQ ID NO: 658221 - DNA, 20 bp, Artificial
  CRISPR gRNA sequence
ttttctagattactggctat

SEQ ID NO: 658222 - DNA, 20 bp, Artificial
  CRISPR gRNA sequence
tctagattactggctattgg

SEQ ID NO: 658223 - DNA, 20 bp, Artificial
  CRISPR gRNA sequence
ctagattactggctattggg

SEQ ID NO: 658224 - DNA, 20 bp, Artificial
  CRISPR gRNA sequence
tagattactggctattggga

SEQ ID NO: 658225 - DNA, 20 bp, Artificial
  CRISPR gRNA sequence
gattactggctattgggata

SEQ ID NO: 658226 - DNA, 20 bp, Artificial
  CRISPR gRNA sequence
ctggctattgggataaagga

SEQ ID NO: 658227 - DNA, 20 bp, Artificial
  CRISPR gRNA sequence
gctattgggataaaggaaat

SEQ ID NO: 658228 - DNA, 20 bp, Artificial
  CRISPR gRNA sequence
ttgggataaaggaaatgatc

SEQ ID NO: 658229 - DNA, 20 bp, Artificial
  CRISPR gRNA sequence
ggataaaggaaatgatccag

SEQ ID NO: 658230 - DNA, 20 bp, Artificial
  CRISPR gRNA sequence
gaggacatcagaaaactaga

SEQ ID NO: 658231 - DNA, 20 bp, Artificial
  CRISPR gRNA sequence
gaagcttttgatagaacaac

SEQ ID NO: 658232 - DNA, 20 bp, Artificial
  CRISPR gRNA sequence
ttgatagaacaacaagatct

SEQ ID NO: 658233 - DNA, 20 bp, Artificial
  CRISPR gRNA sequence
tgatagaacaacaagatcta

SEQ ID NO: 658234 - DNA, 20 bp, Artificial
  CRISPR gRNA sequence
gatagaacaacaagatctag

SEQ ID NO: 658235 - DNA, 20 bp, Artificial
  CRISPR gRNA sequence
atagaacaacaagatctagt

SEQ ID NO: 658236 - DNA, 20 bp, Artificial
  CRISPR gRNA sequence
gtgtccctatctaaagagaa

SEQ ID NO: 658237 - DNA, 20 bp, Artificial
  CRISPR gRNA sequence
tctaaagagaagaaatagag

SEQ ID NO: 658238 - DNA, 20 bp, Artificial
  CRISPR gRNA sequence
aagagaagaaatagagaagg

SEQ ID NO: 658239 - DNA, 20 bp, Artificial
  CRISPR gRNA sequence
cattagaagtgttacaatca

SEQ ID NO: 658240 - DNA, 20 bp, Artificial
  CRISPR gRNA sequence
attagaagtgttacaatcaa

SEQ ID NO: 658241 - DNA, 20 bp, Artificial
  CRISPR gRNA sequence
gaagtgttacaatcaatagc

SEQ ID NO: 658242 - DNA, 20 bp, Artificial
  CRISPR gRNA sequence
caatcaatagctgccaatta

SEQ ID NO: 658243 - DNA, 20 bp, Artificial
  CRISPR gRNA sequence
ccaattacttagtgagcaga

SEQ ID NO: 658244 - DNA, 20 bp, Artificial
  CRISPR gRNA sequence
cttagtgagcagaaaacatc

SEQ ID NO: 658245 - DNA, 20 bp, Artificial
  CRISPR gRNA sequence
agtgagcagaaaacatctgg

SEQ ID NO: 658246 - DNA, 20 bp, Artificial
  CRISPR gRNA sequence
gtgagcagaaaacatctggt

SEQ ID NO: 658247 - DNA, 20 bp, Artificial
  CRISPR gRNA sequence
gtactcaccttcatctattt

SEQ ID NO: 658248 - DNA, 20 bp, Artificial
  CRISPR gRNA sequence
accttcatctatttgcagcc

SEQ ID NO: 658249 - DNA, 20 bp, Artificial
  CRISPR gRNA sequence
catctatttgcagcctgtat

SEQ ID NO: 658250 - DNA, 20 bp, Artificial
  CRISPR gRNA sequence
atctatttgcagcctgtata

SEQ ID NO: 658251 - DNA, 20 bp, Artificial
  CRISPR gRNA sequence
tttgcagcctgtatatcttt

SEQ ID NO: 658252 - DNA, 20 bp, Artificial
  CRISPR gRNA sequence
gcagcctgtatatctttatg

SEQ ID NO: 658253 - DNA, 20 bp, Artificial
  CRISPR gRNA sequence
cagcctgtatatctttatgt

SEQ ID NO: 658254 - DNA, 20 bp, Artificial
  CRISPR gRNA sequence
tatatctttatgtacaggtc

SEQ ID NO: 658255 - DNA, 20 bp, Artificial
  CRISPR gRNA sequence
tatgtacaggtcctcttctc

SEQ ID NO: 658256 - DNA, 20 bp, Artificial
  CRISPR gRNA sequence
atgtacaggtcctcttctct

SEQ ID NO: 658257 - DNA, 20 bp, Artificial
  CRISPR gRNA sequence
tgtacaggtcctcttctctc

SEQ ID NO: 658258 - DNA, 20 bp, Artificial
  CRISPR gRNA sequence
ttctctctttctcagtttat

SEQ ID NO: 658259 - DNA, 20 bp, Artificial
  CRISPR gRNA sequence
ctctctttctcagtttattt

SEQ ID NO: 658260 - DNA, 20 bp, Artificial
  CRISPR gRNA sequence
tctctttctcagtttatttc

SEQ ID NO: 658261 - DNA, 20 bp, Artificial
  CRISPR gRNA sequence
tctttctcagtttatttctt

SEQ ID NO: 658262 - DNA, 20 bp, Artificial
  CRISPR gRNA sequence
tttctcagtttatttcttta

SEQ ID NO: 658263 - DNA, 20 bp, Artificial
  CRISPR gRNA sequence
tctcagtttatttctttaga

SEQ ID NO: 658264 - DNA, 20 bp, Artificial
  CRISPR gRNA sequence
ctcagtttatttctttagat

SEQ ID NO: 658265 - DNA, 20 bp, Artificial
  CRISPR gRNA sequence
tcagtttatttctttagata

SEQ ID NO: 658266 - DNA, 20 bp, Artificial
  CRISPR gRNA sequence
agtttatttctttagatact

SEQ ID NO: 658267 - DNA, 20 bp, Artificial
  CRISPR gRNA sequence
atttctttagatactgtaga

SEQ ID NO: 658268 - DNA, 20 bp, Artificial
  CRISPR gRNA sequence
tttctttagatactgtagat

SEQ ID NO: 658269 - DNA, 20 bp, Artificial
  CRISPR gRNA sequence
ctttagatactgtagatgct

SEQ ID NO: 658270 - DNA, 20 bp, Artificial
  CRISPR gRNA sequence
tttagatactgtagatgctt

SEQ ID NO: 658271 - DNA, 20 bp, Artificial
  CRISPR gRNA sequence
tagatactgtagatgctttc

SEQ ID NO: 658272 - DNA, 20 bp, Artificial
  CRISPR gRNA sequence
agatactgtagatgctttca

SEQ ID NO: 658273 - DNA, 20 bp, Artificial
  CRISPR gRNA sequence
gatactgtagatgctttcat

SEQ ID NO: 658274 - DNA, 20 bp, Artificial
  CRISPR gRNA sequence
tagatgctttcatgactttc

SEQ ID NO: 658275 - DNA, 20 bp, Artificial
  CRISPR gRNA sequence
tcatgactttcaactctgca

SEQ ID NO: 658276 - DNA, 20 bp, Artificial
  CRISPR gRNA sequence
catgactttcaactctgcat

SEQ ID NO: 658277 - DNA, 20 bp, Artificial
  CRISPR gRNA sequence
atgactttcaactctgcatc

SEQ ID NO: 658278 - DNA, 20 bp, Artificial
  CRISPR gRNA sequence
tcaactctgcatctagcact

SEQ ID NO: 658279 - DNA, 20 bp, Artificial
  CRISPR gRNA sequence
caactctgcatctagcactg

SEQ ID NO: 658280 - DNA, 20 bp, Artificial
  CRISPR gRNA sequence
aactctgcatctagcactgt

SEQ ID NO: 658281 - DNA, 20 bp, Artificial
  CRISPR gRNA sequence
tgcatctagcactgtttctt

SEQ ID NO: 658282 - DNA, 20 bp, Artificial
  CRISPR gRNA sequence
catctagcactgtttctttc

SEQ ID NO: 658283 - DNA, 20 bp, Artificial
  CRISPR gRNA sequence
gcactgtttctttcctcaaa

SEQ ID NO: 658284 - DNA, 20 bp, Artificial
  CRISPR gRNA sequence
tttctttcctcaaaggaaat

SEQ ID NO: 658285 - DNA, 20 bp, Artificial
  CRISPR gRNA sequence
ctttcctcaaaggaaatccc

SEQ ID NO: 658286 - DNA, 20 bp, Artificial
  CRISPR gRNA sequence
tttcctcaaaggaaatccca

SEQ ID NO: 658287 - DNA, 20 bp, Artificial
  CRISPR gRNA sequence
tcctcaaaggaaatcccaca

SEQ ID NO: 658288 - DNA, 20 bp, Artificial
  CRISPR gRNA sequence
cctcaaaggaaatcccacat

SEQ ID NO: 658289 - DNA, 20 bp, Artificial
  CRISPR gRNA sequence
ctcaaaggaaatcccacatc

SEQ ID NO: 658290 - DNA, 20 bp, Artificial
  CRISPR gRNA sequence
aaaggaaatcccacatccag

SEQ ID NO: 658291 - DNA, 20 bp, Artificial
  CRISPR gRNA sequence
tcagaaatccttggctctgc

SEQ ID NO: 658292 - DNA, 20 bp, Artificial
  CRISPR gRNA sequence
ggctctgcttctaaaataca

SEQ ID NO: 658293 - DNA, 20 bp, Artificial
  CRISPR gRNA sequence
gctctgcttctaaaatacat

SEQ ID NO: 658294 - DNA, 20 bp, Artificial
  CRISPR gRNA sequence
tgcttctaaaatacatcctg

SEQ ID NO: 658295 - DNA, 20 bp, Artificial
  CRISPR gRNA sequence
cttctaaaatacatcctgaa

SEQ ID NO: 658296 - DNA, 20 bp, Artificial
  CRISPR gRNA sequence
ctaaaatacatcctgaattt

SEQ ID NO: 658297 - DNA, 20 bp, Artificial
  CRISPR gRNA sequence
taaaatacatcctgaattta

SEQ ID NO: 658298 - DNA, 20 bp, Artificial
  CRISPR gRNA sequence
aaatacatcctgaatttaaa

SEQ ID NO: 658299 - DNA, 20 bp, Artificial
  CRISPR gRNA sequence
aatttaaacaattctcacca

SEQ ID NO: 658300 - DNA, 20 bp, Artificial
  CRISPR gRNA sequence
aaacaattctcaccaggccc

SEQ ID NO: 658301 - DNA, 20 bp, Artificial
  CRISPR gRNA sequence
aacaattctcaccaggcccg

SEQ ID NO: 658302 - DNA, 20 bp, Artificial
  CRISPR gRNA sequence
tcaccaggcccgctactgta

SEQ ID NO: 658303 - DNA, 20 bp, Artificial
  CRISPR gRNA sequence
accaggcccgctactgtaac

SEQ ID NO: 658304 - DNA, 20 bp, Artificial
  CRISPR gRNA sequence
ctgtaactttagtctatcat

SEQ ID NO: 658305 - DNA, 20 bp, Artificial
  CRISPR gRNA sequence
taactttagtctatcatcat

SEQ ID NO: 658306 - DNA, 20 bp, Artificial
  CRISPR gRNA sequence
tagtctatcatcatttccta

SEQ ID NO: 658307 - DNA, 20 bp, Artificial
  CRISPR gRNA sequence
agtctatcatcatttcctag

SEQ ID NO: 658308 - DNA, 20 bp, Artificial
  CRISPR gRNA sequence
gtctatcatcatttcctagt

SEQ ID NO: 658309 - DNA, 20 bp, Artificial
  CRISPR gRNA sequence
tcatcatttcctagtacctt

SEQ ID NO: 658310 - DNA, 20 bp, Artificial
  CRISPR gRNA sequence
cctagtaccttaagcctaaa

SEQ ID NO: 658311 - DNA, 20 bp, Artificial
  CRISPR gRNA sequence
ctagtaccttaagcctaaaa

SEQ ID NO: 658312 - DNA, 20 bp, Artificial
  CRISPR gRNA sequence
gtaccttaagcctaaaatat

SEQ ID NO: 658313 - DNA, 20 bp, Artificial
  CRISPR gRNA sequence
aagcctaaaatattgcaaca

SEQ ID NO: 658314 - DNA, 20 bp, Artificial
  CRISPR gRNA sequence
agcctaaaatattgcaacag

SEQ ID NO: 658315 - DNA, 20 bp, Artificial
  CRISPR gRNA sequence
aaatattgcaacagtttaac

SEQ ID NO: 658316 - DNA, 20 bp, Artificial
  CRISPR gRNA sequence
caacagtttaaccggtcttc

SEQ ID NO: 658317 - DNA, 20 bp, Artificial
  CRISPR gRNA sequence
aaccggtcttcctgcttcca

SEQ ID NO: 658318 - DNA, 20 bp, Artificial
  CRISPR gRNA sequence
accggtcttcctgcttccat

SEQ ID NO: 658319 - DNA, 20 bp, Artificial
  CRISPR gRNA sequence
cctgcttccattcttgcttc

SEQ ID NO: 658320 - DNA, 20 bp, Artificial
  CRISPR gRNA sequence
ctgcttccattcttgcttct

SEQ ID NO: 658321 - DNA, 20 bp, Artificial
  CRISPR gRNA sequence
cttccattcttgcttctctg

SEQ ID NO: 658322 - DNA, 20 bp, Artificial
  CRISPR gRNA sequence
ccattcttgcttctctgtag

SEQ ID NO: 658323 - DNA, 20 bp, Artificial
  CRISPR gRNA sequence
cattcttgcttctctgtagt

SEQ ID NO: 658324 - DNA, 20 bp, Artificial
  CRISPR gRNA sequence
ttgcttctctgtagtttgtt

SEQ ID NO: 658325 - DNA, 20 bp, Artificial
  CRISPR gRNA sequence
gcttctctgtagtttgtttt

SEQ ID NO: 658326 - DNA, 20 bp, Artificial
  CRISPR gRNA sequence
cttctctgtagtttgttttc

SEQ ID NO: 658327 - DNA, 20 bp, Artificial
  CRISPR gRNA sequence
ctctgtagtttgttttccac

SEQ ID NO: 658328 - DNA, 20 bp, Artificial
  CRISPR gRNA sequence
tctgtagtttgttttccaca

SEQ ID NO: 658329 - DNA, 20 bp, Artificial
  CRISPR gRNA sequence
tgtagtttgttttccacaca

SEQ ID NO: 658330 - DNA, 20 bp, Artificial
  CRISPR gRNA sequence
tagtttgttttccacacaat

SEQ ID NO: 658331 - DNA, 20 bp, Artificial
  CRISPR gRNA sequence
gttttccacacaatagacag

SEQ ID NO: 658332 - DNA, 20 bp, Artificial
  CRISPR gRNA sequence
ttttccacacaatagacaga

SEQ ID NO: 658333 - DNA, 20 bp, Artificial
  CRISPR gRNA sequence
tccacacaatagacagagcc

SEQ ID NO: 658334 - DNA, 20 bp, Artificial
  CRISPR gRNA sequence
ccacacaatagacagagcct

SEQ ID NO: 658335 - DNA, 20 bp, Artificial
  CRISPR gRNA sequence
cacacaatagacagagcctg

SEQ ID NO: 658336 - DNA, 20 bp, Artificial
  CRISPR gRNA sequence
actttctaaaacccaaatca

SEQ ID NO: 658337 - DNA, 20 bp, Artificial
  CRISPR gRNA sequence
tctaaaacccaaatcagatc

SEQ ID NO: 658338 - DNA, 20 bp, Artificial
  CRISPR gRNA sequence
ctaaaacccaaatcagatca

SEQ ID NO: 658339 - DNA, 20 bp, Artificial
  CRISPR gRNA sequence
taaaacccaaatcagatcat

SEQ ID NO: 658340 - DNA, 20 bp, Artificial
  CRISPR gRNA sequence
aaacccaaatcagatcataa

SEQ ID NO: 658341 - DNA, 20 bp, Artificial
  CRISPR gRNA sequence
attgctttaaacacaaaagc

SEQ ID NO: 658342 - DNA, 20 bp, Artificial
  CRISPR gRNA sequence
ctttaaacacaaaagctttc

SEQ ID NO: 658343 - DNA, 20 bp, Artificial
  CRISPR gRNA sequence
taaacacaaaagctttccac

SEQ ID NO: 658344 - DNA, 20 bp, Artificial
  CRISPR gRNA sequence
aaacacaaaagctttccact

SEQ ID NO: 658345 - DNA, 20 bp, Artificial
  CRISPR gRNA sequence
aacacaaaagctttccactg

SEQ ID NO: 658346 - DNA, 20 bp, Artificial
  CRISPR gRNA sequence
tccactgaaactagaataca

SEQ ID NO: 658347 - DNA, 20 bp, Artificial
  CRISPR gRNA sequence
ccactgaaactagaatacaa

SEQ ID NO: 658348 - DNA, 20 bp, Artificial
  CRISPR gRNA sequence
cactgaaactagaatacaac

SEQ ID NO: 658349 - DNA, 20 bp, Artificial
  CRISPR gRNA sequence
aaactagaatacaactaaaa

SEQ ID NO: 658350 - DNA, 20 bp, Artificial
  CRISPR gRNA sequence
gaatacaactaaaattcctt

SEQ ID NO: 658351 - DNA, 20 bp, Artificial
  CRISPR gRNA sequence
aaattcctttccaaagtctg

SEQ ID NO: 658352 - DNA, 20 bp, Artificial
  CRISPR gRNA sequence
ctttccaaagtctgtaaggt

SEQ ID NO: 658353 - DNA, 20 bp, Artificial
  CRISPR gRNA sequence
tccaaagtctgtaaggtcct

SEQ ID NO: 658354 - DNA, 20 bp, Artificial
  CRISPR gRNA sequence
ccaaagtctgtaaggtccta

SEQ ID NO: 658355 - DNA, 20 bp, Artificial
  CRISPR gRNA sequence
caaagtctgtaaggtcctaa

SEQ ID NO: 658356 - DNA, 20 bp, Artificial
  CRISPR gRNA sequence
taaggtcctaaaggctgtgg

SEQ ID NO: 658357 - DNA, 20 bp, Artificial
  CRISPR gRNA sequence
aaggctgtggccctgcctcc

SEQ ID NO: 658358 - DNA, 20 bp, Artificial
  CRISPR gRNA sequence
tggccctgcctccatctctg

SEQ ID NO: 658359 - DNA, 20 bp, Artificial
  CRISPR gRNA sequence
cctccatctctgacttcctc

SEQ ID NO: 658360 - DNA, 20 bp, Artificial
  CRISPR gRNA sequence
catctctgacttcctcttct

SEQ ID NO: 658361 - DNA, 20 bp, Artificial
  CRISPR gRNA sequence
tgacttcctcttctctattc

SEQ ID NO: 658362 - DNA, 20 bp, Artificial
  CRISPR gRNA sequence
acttcctcttctctattctt

SEQ ID NO: 658363 - DNA, 20 bp, Artificial
  CRISPR gRNA sequence
cctcttctctattctttccc

SEQ ID NO: 658364 - DNA, 20 bp, Artificial
  CRISPR gRNA sequence
ctcttctctattctttccct

SEQ ID NO: 658365 - DNA, 20 bp, Artificial
  CRISPR gRNA sequence
ttctctattctttccctgtt

SEQ ID NO: 658366 - DNA, 20 bp, Artificial
  CRISPR gRNA sequence
ctctattctttccctgttca

SEQ ID NO: 658367 - DNA, 20 bp, Artificial
  CRISPR gRNA sequence
tctattctttccctgttcac

SEQ ID NO: 658368 - DNA, 20 bp, Artificial
  CRISPR gRNA sequence
tattctttccctgttcactg

SEQ ID NO: 658369 - DNA, 20 bp, Artificial
  CRISPR gRNA sequence
ttctttccctgttcactgaa

SEQ ID NO: 658370 - DNA, 20 bp, Artificial
  CRISPR gRNA sequence
tttccctgttcactgaactt

SEQ ID NO: 658371 - DNA, 20 bp, Artificial
  CRISPR gRNA sequence
tccctgttcactgaactttt

SEQ ID NO: 658372 - DNA, 20 bp, Artificial
  CRISPR gRNA sequence
ccctgttcactgaactttta

SEQ ID NO: 658373 - DNA, 20 bp, Artificial
  CRISPR gRNA sequence
cctgttcactgaacttttaa

SEQ ID NO: 658374 - DNA, 20 bp, Artificial
  CRISPR gRNA sequence
ttcactgaacttttaatacc

SEQ ID NO: 658375 - DNA, 20 bp, Artificial
  CRISPR gRNA sequence
actgaacttttaatacctct

SEQ ID NO: 658376 - DNA, 20 bp, Artificial
  CRISPR gRNA sequence
aacttttaatacctcttccc

SEQ ID NO: 658377 - DNA, 20 bp, Artificial
  CRISPR gRNA sequence
ttaatacctcttcccttttt

SEQ ID NO: 658378 - DNA, 20 bp, Artificial
  CRISPR gRNA sequence
taatacctcttccctttttc

SEQ ID NO: 658379 - DNA, 20 bp, Artificial
  CRISPR gRNA sequence
aatacctcttccctttttct

SEQ ID NO: 658380 - DNA, 20 bp, Artificial
  CRISPR gRNA sequence
atacctcttccctttttctt

SEQ ID NO: 658381 - DNA, 20 bp, Artificial
  CRISPR gRNA sequence
ttccctttttcttttccggg

SEQ ID NO: 658382 - DNA, 20 bp, Artificial
  CRISPR gRNA sequence
ccctttttcttttccgggac

SEQ ID NO: 658383 - DNA, 20 bp, Artificial
  CRISPR gRNA sequence
cctttttcttttccgggaca

SEQ ID NO: 658384 - DNA, 20 bp, Artificial
  CRISPR gRNA sequence
tttcttttccgggacatggc

SEQ ID NO: 658385 - DNA, 20 bp, Artificial
  CRISPR gRNA sequence
ttcttttccgggacatggca

SEQ ID NO: 658386 - DNA, 20 bp, Artificial
  CRISPR gRNA sequence
tcttttccgggacatggcaa

SEQ ID NO: 658387 - DNA, 20 bp, Artificial
  CRISPR gRNA sequence
cttttccgggacatggcaag

SEQ ID NO: 658388 - DNA, 20 bp, Artificial
  CRISPR gRNA sequence
ttttccgggacatggcaagt

SEQ ID NO: 658389 - DNA, 20 bp, Artificial
  CRISPR gRNA sequence
ttccgggacatggcaagttc

SEQ ID NO: 658390 - DNA, 20 bp, Artificial
  CRISPR gRNA sequence
tccgggacatggcaagttcg

SEQ ID NO: 658391 - DNA, 20 bp, Artificial
  CRISPR gRNA sequence
ccgggacatggcaagttcgt

SEQ ID NO: 658392 - DNA, 20 bp, Artificial
  CRISPR gRNA sequence
cgggacatggcaagttcgtt

SEQ ID NO: 658393 - DNA, 20 bp, Artificial
  CRISPR gRNA sequence
gttcctgtctaaggacctct

SEQ ID NO: 658394 - DNA, 20 bp, Artificial
  CRISPR gRNA sequence
ctgtctaaggacctctgtac

SEQ ID NO: 658395 - DNA, 20 bp, Artificial
  CRISPR gRNA sequence
tctaaggacctctgtacttg

SEQ ID NO: 658396 - DNA, 20 bp, Artificial
  CRISPR gRNA sequence
aggacctctgtacttgctgt

SEQ ID NO: 658397 - DNA, 20 bp, Artificial
  CRISPR gRNA sequence
tgtacttgctgtttctttgg

SEQ ID NO: 658398 - DNA, 20 bp, Artificial
  CRISPR gRNA sequence
tacttgctgtttctttggtt

SEQ ID NO: 658399 - DNA, 20 bp, Artificial
  CRISPR gRNA sequence
gctgtttctttggtttggga

SEQ ID NO: 658400 - DNA, 20 bp, Artificial
  CRISPR gRNA sequence
ctgtttctttggtttgggac

SEQ ID NO: 658401 - DNA, 20 bp, Artificial
  CRISPR gRNA sequence
tttctttggtttgggacacg

SEQ ID NO: 658402 - DNA, 20 bp, Artificial
  CRISPR gRNA sequence
ctttggtttgggacacgttt

SEQ ID NO: 658403 - DNA, 20 bp, Artificial
  CRISPR gRNA sequence
tttggtttgggacacgtttt

SEQ ID NO: 658404 - DNA, 20 bp, Artificial
  CRISPR gRNA sequence
tggtttgggacacgttttct

SEQ ID NO: 658405 - DNA, 20 bp, Artificial
  CRISPR gRNA sequence
ggtttgggacacgttttctt

SEQ ID NO: 658406 - DNA, 20 bp, Artificial
  CRISPR gRNA sequence
gtttgggacacgttttcttc

SEQ ID NO: 658407 - DNA, 20 bp, Artificial
  CRISPR gRNA sequence
gggacacgttttcttccttg

SEQ ID NO: 658408 - DNA, 20 bp, Artificial
  CRISPR gRNA sequence
ggacacgttttcttccttgt

SEQ ID NO: 658409 - DNA, 20 bp, Artificial
  CRISPR gRNA sequence
tcttccttgttttgcatgaa

SEQ ID NO: 658410 - DNA, 20 bp, Artificial
  CRISPR gRNA sequence
cttccttgttttgcatgaaa

SEQ ID NO: 658411 - DNA, 20 bp, Artificial
  CRISPR gRNA sequence
ttccttgttttgcatgaaag

SEQ ID NO: 658412 - DNA, 20 bp, Artificial
  CRISPR gRNA sequence
ccttgttttgcatgaaagcc

SEQ ID NO: 658413 - DNA, 20 bp, Artificial
  CRISPR gRNA sequence
cttgttttgcatgaaagcct

SEQ ID NO: 658414 - DNA, 20 bp, Artificial
  CRISPR gRNA sequence
gttttgcatgaaagcctcct

SEQ ID NO: 658415 - DNA, 20 bp, Artificial
  CRISPR gRNA sequence
ttttgcatgaaagcctcctt

SEQ ID NO: 658416 - DNA, 20 bp, Artificial
  CRISPR gRNA sequence
tgcatgaaagcctccttctt

SEQ ID NO: 658417 - DNA, 20 bp, Artificial
  CRISPR gRNA sequence
gcatgaaagcctccttcttt

SEQ ID NO: 658418 - DNA, 20 bp, Artificial
  CRISPR gRNA sequence
catgaaagcctccttctttt

SEQ ID NO: 658419 - DNA, 20 bp, Artificial
  CRISPR gRNA sequence
cttcttttcttatttccatt

SEQ ID NO: 658420 - DNA, 20 bp, Artificial
  CRISPR gRNA sequence
cttttcttatttccatttaa

SEQ ID NO: 658421 - DNA, 20 bp, Artificial
  CRISPR gRNA sequence
ttttcttatttccatttaac

SEQ ID NO: 658422 - DNA, 20 bp, Artificial
  CRISPR gRNA sequence
ttcttatttccatttaactg

SEQ ID NO: 658423 - DNA, 20 bp, Artificial
  CRISPR gRNA sequence
tcttatttccatttaactgt

SEQ ID NO: 658424 - DNA, 20 bp, Artificial
  CRISPR gRNA sequence
cttatttccatttaactgtc

SEQ ID NO: 658425 - DNA, 20 bp, Artificial
  CRISPR gRNA sequence
ttatttccatttaactgtcg

SEQ ID NO: 658426 - DNA, 20 bp, Artificial
  CRISPR gRNA sequence
atttccatttaactgtcgcc

SEQ ID NO: 658427 - DNA, 20 bp, Artificial
  CRISPR gRNA sequence
tttccatttaactgtcgcct

SEQ ID NO: 658428 - DNA, 20 bp, Artificial
  CRISPR gRNA sequence
ccatttaactgtcgcctcct

SEQ ID NO: 658429 - DNA, 20 bp, Artificial
  CRISPR gRNA sequence
catttaactgtcgcctcctt

SEQ ID NO: 658430 - DNA, 20 bp, Artificial
  CRISPR gRNA sequence
aactgtcgcctccttggcga

SEQ ID NO: 658431 - DNA, 20 bp, Artificial
  CRISPR gRNA sequence
actgtcgcctccttggcgag

SEQ ID NO: 658432 - DNA, 20 bp, Artificial
  CRISPR gRNA sequence
tcgcctccttggcgaggctt

SEQ ID NO: 658433 - DNA, 20 bp, Artificial
  CRISPR gRNA sequence
cttggcgaggctttgcctga

SEQ ID NO: 658434 - DNA, 20 bp, Artificial
  CRISPR gRNA sequence
ggcgaggctttgcctgagca

SEQ ID NO: 658435 - DNA, 20 bp, Artificial
  CRISPR gRNA sequence
gcgaggctttgcctgagcat

SEQ ID NO: 658436 - DNA, 20 bp, Artificial
  CRISPR gRNA sequence
tgcctgagcatcctagataa

SEQ ID NO: 658437 - DNA, 20 bp, Artificial
  CRISPR gRNA sequence
gcctgagcatcctagataaa

SEQ ID NO: 658438 - DNA, 20 bp, Artificial
  CRISPR gRNA sequence
cctgagcatcctagataaat

SEQ ID NO: 658439 - DNA, 20 bp, Artificial
  CRISPR gRNA sequence
agcatcctagataaataagc

SEQ ID NO: 658440 - DNA, 20 bp, Artificial
  CRISPR gRNA sequence
gataaataagcccctctcca

SEQ ID NO: 658441 - DNA, 20 bp, Artificial
  CRISPR gRNA sequence
tccaggcattctatgacatt

SEQ ID NO: 658442 - DNA, 20 bp, Artificial
  CRISPR gRNA sequence
caggcattctatgacattat

SEQ ID NO: 658443 - DNA, 20 bp, Artificial
  CRISPR gRNA sequence
tatgacattatcctgtttta

SEQ ID NO: 658444 - DNA, 20 bp, Artificial
  CRISPR gRNA sequence
tgacattatcctgttttatt

SEQ ID NO: 658445 - DNA, 20 bp, Artificial
  CRISPR gRNA sequence
tcctgttttattttctttat

SEQ ID NO: 658446 - DNA, 20 bp, Artificial
  CRISPR gRNA sequence
ttttattttctttattatac

SEQ ID NO: 658447 - DNA, 20 bp, Artificial
  CRISPR gRNA sequence
tattttctttattatactta

SEQ ID NO: 658448 - DNA, 20 bp, Artificial
  CRISPR gRNA sequence
attttctttattatacttaa

SEQ ID NO: 658449 - DNA, 20 bp, Artificial
  CRISPR gRNA sequence
ttttctttattatacttaat

SEQ ID NO: 658450 - DNA, 20 bp, Artificial
  CRISPR gRNA sequence
tctttattatacttaatagt

SEQ ID NO: 658451 - DNA, 20 bp, Artificial
  CRISPR gRNA sequence
ctttattatacttaatagta

SEQ ID NO: 658452 - DNA, 20 bp, Artificial
  CRISPR gRNA sequence
tttattatacttaatagtat

SEQ ID NO: 658453 - DNA, 20 bp, Artificial
  CRISPR gRNA sequence
tattatacttaatagtatct

SEQ ID NO: 658454 - DNA, 20 bp, Artificial
  CRISPR gRNA sequence
attatacttaatagtatctg

SEQ ID NO: 658455 - DNA, 20 bp, Artificial
  CRISPR gRNA sequence
ttatacttaatagtatctga

SEQ ID NO: 658456 - DNA, 20 bp, Artificial
  CRISPR gRNA sequence
tacttaatagtatctgaatt

SEQ ID NO: 658457 - DNA, 20 bp, Artificial
  CRISPR gRNA sequence
aatagtatctgaatttactt

SEQ ID NO: 658458 - DNA, 20 bp, Artificial
  CRISPR gRNA sequence
atagtatctgaatttactta

SEQ ID NO: 658459 - DNA, 20 bp, Artificial
  CRISPR gRNA sequence
aatttacttaatttgtgtat

SEQ ID NO: 658460 - DNA, 20 bp, Artificial
  CRISPR gRNA sequence
acttaatttgtgtatttatc

SEQ ID NO: 658461 - DNA, 20 bp, Artificial
  CRISPR gRNA sequence
cttaatttgtgtatttatct

SEQ ID NO: 658462 - DNA, 20 bp, Artificial
  CRISPR gRNA sequence
aatttgtgtatttatctctt

SEQ ID NO: 658463 - DNA, 20 bp, Artificial
  CRISPR gRNA sequence
atttgtgtatttatctcttc

SEQ ID NO: 658464 - DNA, 20 bp, Artificial
  CRISPR gRNA sequence
gtgtatttatctcttctccc

SEQ ID NO: 658465 - DNA, 20 bp, Artificial
  CRISPR gRNA sequence
tgtatttatctcttctccca

SEQ ID NO: 658466 - DNA, 20 bp, Artificial
  CRISPR gRNA sequence
atctcttctcccaacacaca

SEQ ID NO: 658467 - DNA, 20 bp, Artificial
  CRISPR gRNA sequence
tctcttctcccaacacacag

SEQ ID NO: 658468 - DNA, 20 bp, Artificial
  CRISPR gRNA sequence
ttctcccaacacacagttga

SEQ ID NO: 658469 - DNA, 20 bp, Artificial
  CRISPR gRNA sequence
ctcccaacacacagttgagg

SEQ ID NO: 658470 - DNA, 20 bp, Artificial
  CRISPR gRNA sequence
tcccaacacacagttgagga

SEQ ID NO: 658471 - DNA, 20 bp, Artificial
  CRISPR gRNA sequence
ccaacacacagttgaggaac

SEQ ID NO: 658472 - DNA, 20 bp, Artificial
  CRISPR gRNA sequence
aggaacatttggcttgttca

SEQ ID NO: 658473 - DNA, 20 bp, Artificial
  CRISPR gRNA sequence
ggcttgttcattcatgtagt

SEQ ID NO: 658474 - DNA, 20 bp, Artificial
  CRISPR gRNA sequence
gcttgttcattcatgtagta

SEQ ID NO: 658475 - DNA, 20 bp, Artificial
  CRISPR gRNA sequence
gttcattcatgtagtagggc

SEQ ID NO: 658476 - DNA, 20 bp, Artificial
  CRISPR gRNA sequence
ttcattcatgtagtagggcc

SEQ ID NO: 658477 - DNA, 20 bp, Artificial
  CRISPR gRNA sequence
attcatgtagtagggccagg

SEQ ID NO: 658478 - DNA, 20 bp, Artificial
  CRISPR gRNA sequence
atgtagtagggccaggaatg

SEQ ID NO: 658479 - DNA, 20 bp, Artificial
  CRISPR gRNA sequence
acagatgaactgactccttg

SEQ ID NO: 658480 - DNA, 20 bp, Artificial
  CRISPR gRNA sequence
actccttgttctttcccttc

SEQ ID NO: 658481 - DNA, 20 bp, Artificial
  CRISPR gRNA sequence
cttgttctttcccttccata

SEQ ID NO: 658482 - DNA, 20 bp, Artificial
  CRISPR gRNA sequence
gttctttcccttccataaat

SEQ ID NO: 658483 - DNA, 20 bp, Artificial
  CRISPR gRNA sequence
ttctttcccttccataaata

SEQ ID NO: 658484 - DNA, 20 bp, Artificial
  CRISPR gRNA sequence
tttcccttccataaatagaa

SEQ ID NO: 658485 - DNA, 20 bp, Artificial
  CRISPR gRNA sequence
tcccttccataaatagaatt

SEQ ID NO: 658486 - DNA, 20 bp, Artificial
  CRISPR gRNA sequence
cccttccataaatagaattc

SEQ ID NO: 658487 - DNA, 20 bp, Artificial
  CRISPR gRNA sequence
ccttccataaatagaattct

SEQ ID NO: 658488 - DNA, 20 bp, Artificial
  CRISPR gRNA sequence
ccataaatagaattctctgt

SEQ ID NO: 658489 - DNA, 20 bp, Artificial
  CRISPR gRNA sequence
cataaatagaattctctgtg

SEQ ID NO: 658490 - DNA, 20 bp, Artificial
  CRISPR gRNA sequence
tctgtgtgtgtctataaagc

SEQ ID NO: 658491 - DNA, 20 bp, Artificial
  CRISPR gRNA sequence
tgtgtgtgtctataaagcaa

SEQ ID NO: 658492 - DNA, 20 bp, Artificial
  CRISPR gRNA sequence
tgtgtgtctataaagcaaac

SEQ ID NO: 658493 - DNA, 20 bp, Artificial
  CRISPR gRNA sequence
taaagcaaacaaagtgtttt

SEQ ID NO: 658494 - DNA, 20 bp, Artificial
  CRISPR gRNA sequence
tacactgtagtgttcattct

SEQ ID NO: 658495 - DNA, 20 bp, Artificial
  CRISPR gRNA sequence
acactgtagtgttcattcta

SEQ ID NO: 658496 - DNA, 20 bp, Artificial
  CRISPR gRNA sequence
cactgtagtgttcattctaa

SEQ ID NO: 658497 - DNA, 20 bp, Artificial
  CRISPR gRNA sequence
tagtgttcattctaaaccct

SEQ ID NO: 658498 - DNA, 20 bp, Artificial
  CRISPR gRNA sequence
attctaaaccctctatttta

SEQ ID NO: 658499 - DNA, 20 bp, Artificial
  CRISPR gRNA sequence
taaaccctctattttagaaa

SEQ ID NO: 658500 - DNA, 20 bp, Artificial
  CRISPR gRNA sequence
aaccctctattttagaaacc

SEQ ID NO: 658501 - DNA, 20 bp, Artificial
  CRISPR gRNA sequence
tattttagaaacctgtacat

SEQ ID NO: 658502 - DNA, 20 bp, Artificial
  CRISPR gRNA sequence
ttttagaaacctgtacattg

SEQ ID NO: 658503 - DNA, 20 bp, Artificial
  CRISPR gRNA sequence
tagaaacctgtacattgagg

SEQ ID NO: 658504 - DNA, 20 bp, Artificial
  CRISPR gRNA sequence
agaaacctgtacattgaggc

SEQ ID NO: 658505 - DNA, 20 bp, Artificial
  CRISPR gRNA sequence
gaaacctgtacattgaggcg

SEQ ID NO: 658506 - DNA, 20 bp, Artificial
  CRISPR gRNA sequence
tacattgaggcgaaagtcac

SEQ ID NO: 658507 - DNA, 20 bp, Artificial
  CRISPR gRNA sequence
aggcgaaagtcacatgggga

SEQ ID NO: 658508 - DNA, 20 bp, Artificial
  CRISPR gRNA sequence
aaaaaccttatcttggccag

SEQ ID NO: 658509 - DNA, 20 bp, Artificial
  CRISPR gRNA sequence
atcttggccagatgtggtgg

SEQ ID NO: 658510 - DNA, 20 bp, Artificial
  CRISPR gRNA sequence
tcttggccagatgtggtggc

SEQ ID NO: 658511 - DNA, 20 bp, Artificial
  CRISPR gRNA sequence
ggccagatgtggtggctcac

SEQ ID NO: 658512 - DNA, 20 bp, Artificial
  CRISPR gRNA sequence
gccagatgtggtggctcacg

SEQ ID NO: 658513 - DNA, 20 bp, Artificial
  CRISPR gRNA sequence
acgcctgtaatcccagcact

SEQ ID NO: 658514 - DNA, 20 bp, Artificial
  CRISPR gRNA sequence
taatcccagcactttgggag

SEQ ID NO: 658515 - DNA, 20 bp, Artificial
  CRISPR gRNA sequence
tgggaggccgagacgggtgg

SEQ ID NO: 658516 - DNA, 20 bp, Artificial
  CRISPR gRNA sequence
gggaggccgagacgggtgga

SEQ ID NO: 658517 - DNA, 20 bp, Artificial
  CRISPR gRNA sequence
ggaggccgagacgggtggat

SEQ ID NO: 658518 - DNA, 20 bp, Artificial
  CRISPR gRNA sequence
aggtcagaagttcgagacca

SEQ ID NO: 658519 - DNA, 20 bp, Artificial
  CRISPR gRNA sequence
gagaccagcctggccaaaat

SEQ ID NO: 658520 - DNA, 20 bp, Artificial
  CRISPR gRNA sequence
gccaaaatggtgaaactccg

SEQ ID NO: 658521 - DNA, 20 bp, Artificial
  CRISPR gRNA sequence
cgtctctactaaaaatacaa

SEQ ID NO: 658522 - DNA, 20 bp, Artificial
  CRISPR gRNA sequence
tactaaaaatacaaaaaaaa

SEQ ID NO: 658523 - DNA, 20 bp, Artificial
  CRISPR gRNA sequence
ctaaaaatacaaaaaaaaaa

SEQ ID NO: 658524 - DNA, 20 bp, Artificial
  CRISPR gRNA sequence
aaaatacaaaaaaaaaaaaa

SEQ ID NO: 658525 - DNA, 20 bp, Artificial
  CRISPR gRNA sequence
gtgtggtgtggtggcctgca

SEQ ID NO: 658526 - DNA, 20 bp, Artificial
  CRISPR gRNA sequence
cacctgtaatcccagctact

SEQ ID NO: 658527 - DNA, 20 bp, Artificial
  CRISPR gRNA sequence
taatcccagctactctggag

SEQ ID NO: 658528 - DNA, 20 bp, Artificial
  CRISPR gRNA sequence
ctctggaggctgaggcagga

SEQ ID NO: 658529 - DNA, 20 bp, Artificial
  CRISPR gRNA sequence
tggaggctgaggcaggagaa

SEQ ID NO: 658530 - DNA, 20 bp, Artificial
  CRISPR gRNA sequence
gaggctgaggcaggagaata

SEQ ID NO: 658531 - DNA, 20 bp, Artificial
  CRISPR gRNA sequence
aggcaggagaatagtttgaa

SEQ ID NO: 658532 - DNA, 20 bp, Artificial
  CRISPR gRNA sequence
gaacttggcgggtggaggtt

SEQ ID NO: 658533 - DNA, 20 bp, Artificial
  CRISPR gRNA sequence
aacttggcgggtggaggttg

SEQ ID NO: 658534 - DNA, 20 bp, Artificial
  CRISPR gRNA sequence
ggcgggtggaggttgcagtg

SEQ ID NO: 658535 - DNA, 20 bp, Artificial
  CRISPR gRNA sequence
gcgggtggaggttgcagtga

SEQ ID NO: 658536 - DNA, 20 bp, Artificial
  CRISPR gRNA sequence
cagtgagctgagatcatgcc

SEQ ID NO: 658537 - DNA, 20 bp, Artificial
  CRISPR gRNA sequence
agatcatgccactgtactcc

SEQ ID NO: 658538 - DNA, 20 bp, Artificial
  CRISPR gRNA sequence
tactccatcctgggcgacag

SEQ ID NO: 658539 - DNA, 20 bp, Artificial
  CRISPR gRNA sequence
catcctgggcgacagaaagt

SEQ ID NO: 658540 - DNA, 20 bp, Artificial
  CRISPR gRNA sequence
ggcgacagaaagtgagactc

SEQ ID NO: 658541 - DNA, 20 bp, Artificial
  CRISPR gRNA sequence
tgtctgaaaaacaacaacaa

SEQ ID NO: 658542 - DNA, 20 bp, Artificial
  CRISPR gRNA sequence
tctgaaaaacaacaacaaca

SEQ ID NO: 658543 - DNA, 20 bp, Artificial
  CRISPR gRNA sequence
aaaaacaacaacaacaacaa

SEQ ID NO: 658544 - DNA, 20 bp, Artificial
  CRISPR gRNA sequence
atcttctgactcttggcttg

SEQ ID NO: 658545 - DNA, 20 bp, Artificial
  CRISPR gRNA sequence
tcttctgactcttggcttgg

SEQ ID NO: 658546 - DNA, 20 bp, Artificial
  CRISPR gRNA sequence
ctgactcttggcttggtgtt

SEQ ID NO: 658547 - DNA, 20 bp, Artificial
  CRISPR gRNA sequence
tgactcttggcttggtgttc

SEQ ID NO: 658548 - DNA, 20 bp, Artificial
  CRISPR gRNA sequence
actcttggcttggtgttcct

SEQ ID NO: 658549 - DNA, 20 bp, Artificial
  CRISPR gRNA sequence
ttggcttggtgttccttgct

SEQ ID NO: 658550 - DNA, 20 bp, Artificial
  CRISPR gRNA sequence
ggcttggtgttccttgcttt

SEQ ID NO: 658551 - DNA, 20 bp, Artificial
  CRISPR gRNA sequence
gcttggtgttccttgcttta

SEQ ID NO: 658552 - DNA, 20 bp, Artificial
  CRISPR gRNA sequence
ggtgttccttgctttacatg

SEQ ID NO: 658553 - DNA, 20 bp, Artificial
  CRISPR gRNA sequence
gtgttccttgctttacatga

SEQ ID NO: 658554 - DNA, 20 bp, Artificial
  CRISPR gRNA sequence
cttgctttacatgatacact

SEQ ID NO: 658555 - DNA, 20 bp, Artificial
  CRISPR gRNA sequence
gctttacatgatacactctt

SEQ ID NO: 658556 - DNA, 20 bp, Artificial
  CRISPR gRNA sequence
ctttacatgatacactctta

SEQ ID NO: 658557 - DNA, 20 bp, Artificial
  CRISPR gRNA sequence
tacatgatacactcttatgt

SEQ ID NO: 658558 - DNA, 20 bp, Artificial
  CRISPR gRNA sequence
acatgatacactcttatgtt

SEQ ID NO: 658559 - DNA, 20 bp, Artificial
  CRISPR gRNA sequence
catgatacactcttatgttt

SEQ ID NO: 658560 - DNA, 20 bp, Artificial
  CRISPR gRNA sequence
ttatgttttggggtgaggcc

SEQ ID NO: 658561 - DNA, 20 bp, Artificial
  CRISPR gRNA sequence
atgttttggggtgaggccct

SEQ ID NO: 658562 - DNA, 20 bp, Artificial
  CRISPR gRNA sequence
tgttttggggtgaggccctg

SEQ ID NO: 658563 - DNA, 20 bp, Artificial
  CRISPR gRNA sequence
tggggtgaggccctgtagaa

SEQ ID NO: 658564 - DNA, 20 bp, Artificial
  CRISPR gRNA sequence
ggggtgaggccctgtagaag

SEQ ID NO: 658565 - DNA, 20 bp, Artificial
  CRISPR gRNA sequence
gggtgaggccctgtagaagt

SEQ ID NO: 658566 - DNA, 20 bp, Artificial
  CRISPR gRNA sequence
tagaagtagttaagagtact

SEQ ID NO: 658567 - DNA, 20 bp, Artificial
  CRISPR gRNA sequence
agagtactgattttcatatt

SEQ ID NO: 658568 - DNA, 20 bp, Artificial
  CRISPR gRNA sequence
attttcatattacatagacc

SEQ ID NO: 658569 - DNA, 20 bp, Artificial
  CRISPR gRNA sequence
tcatattacatagacctggt

SEQ ID NO: 658570 - DNA, 20 bp, Artificial
  CRISPR gRNA sequence
catattacatagacctggtt

SEQ ID NO: 658571 - DNA, 20 bp, Artificial
  CRISPR gRNA sequence
atattacatagacctggttt

SEQ ID NO: 658572 - DNA, 20 bp, Artificial
  CRISPR gRNA sequence
catagacctggtttggagtc

SEQ ID NO: 658573 - DNA, 20 bp, Artificial
  CRISPR gRNA sequence
gtttggagtcctggctgtgc

SEQ ID NO: 658574 - DNA, 20 bp, Artificial
  CRISPR gRNA sequence
ggagtcctggctgtgcaccc

SEQ ID NO: 658575 - DNA, 20 bp, Artificial
  CRISPR gRNA sequence
gagtcctggctgtgcaccct

SEQ ID NO: 658576 - DNA, 20 bp, Artificial
  CRISPR gRNA sequence
gctgtgcaccctacttttgg

SEQ ID NO: 658577 - DNA, 20 bp, Artificial
  CRISPR gRNA sequence
tgcaccctacttttgggtta

SEQ ID NO: 658578 - DNA, 20 bp, Artificial
  CRISPR gRNA sequence
cttttgggttaagccgtaag

SEQ ID NO: 658579 - DNA, 20 bp, Artificial
  CRISPR gRNA sequence
ttgggttaagccgtaaggga

SEQ ID NO: 658580 - DNA, 20 bp, Artificial
  CRISPR gRNA sequence
tgggttaagccgtaagggat

SEQ ID NO: 658581 - DNA, 20 bp, Artificial
  CRISPR gRNA sequence
gggttaagccgtaagggatt

SEQ ID NO: 658582 - DNA, 20 bp, Artificial
  CRISPR gRNA sequence
ggttaagccgtaagggatta

SEQ ID NO: 658583 - DNA, 20 bp, Artificial
  CRISPR gRNA sequence
agccgtaagggattactgac

SEQ ID NO: 658584 - DNA, 20 bp, Artificial
  CRISPR gRNA sequence
ctgacactccattgtttttc

SEQ ID NO: 658585 - DNA, 20 bp, Artificial
  CRISPR gRNA sequence
acactccattgtttttcaac

SEQ ID NO: 658586 - DNA, 20 bp, Artificial
  CRISPR gRNA sequence
cattgtttttcaacctaata

SEQ ID NO: 658587 - DNA, 20 bp, Artificial
  CRISPR gRNA sequence
tttttcaacctaatagctgt

SEQ ID NO: 658588 - DNA, 20 bp, Artificial
  CRISPR gRNA sequence
ttcaacctaatagctgtgtg

SEQ ID NO: 658589 - DNA, 20 bp, Artificial
  CRISPR gRNA sequence
tcaacctaatagctgtgtga

SEQ ID NO: 658590 - DNA, 20 bp, Artificial
  CRISPR gRNA sequence
caacctaatagctgtgtgac

SEQ ID NO: 658591 - DNA, 20 bp, Artificial
  CRISPR gRNA sequence
aacctaatagctgtgtgacc

SEQ ID NO: 658592 - DNA, 20 bp, Artificial
  CRISPR gRNA sequence
atagctgtgtgaccttagga

SEQ ID NO: 658593 - DNA, 20 bp, Artificial
  CRISPR gRNA sequence
tgtgaccttaggaatgttcc

SEQ ID NO: 658594 - DNA, 20 bp, Artificial
  CRISPR gRNA sequence
aggaatgttccttagatttc

SEQ ID NO: 658595 - DNA, 20 bp, Artificial
  CRISPR gRNA sequence
ggaatgttccttagatttcc

SEQ ID NO: 658596 - DNA, 20 bp, Artificial
  CRISPR gRNA sequence
cttagatttcctaaatttag

SEQ ID NO: 658597 - DNA, 20 bp, Artificial
  CRISPR gRNA sequence
agatttcctaaatttagttc

SEQ ID NO: 658598 - DNA, 20 bp, Artificial
  CRISPR gRNA sequence
gatttcctaaatttagttcc

SEQ ID NO: 658599 - DNA, 20 bp, Artificial
  CRISPR gRNA sequence
cctaaatttagttccttcag

SEQ ID NO: 658600 - DNA, 20 bp, Artificial
  CRISPR gRNA sequence
ctaaatttagttccttcagc

SEQ ID NO: 658601 - DNA, 20 bp, Artificial
  CRISPR gRNA sequence
aatttagttccttcagctgt

SEQ ID NO: 658602 - DNA, 20 bp, Artificial
  CRISPR gRNA sequence
agttccttcagctgtaaaat

SEQ ID NO: 658603 - DNA, 20 bp, Artificial
  CRISPR gRNA sequence
gttccttcagctgtaaaatg

SEQ ID NO: 658604 - DNA, 20 bp, Artificial
  CRISPR gRNA sequence
cttcagctgtaaaatggtat

SEQ ID NO: 658605 - DNA, 20 bp, Artificial
  CRISPR gRNA sequence
cagctgtaaaatggtataat

SEQ ID NO: 658606 - DNA, 20 bp, Artificial
  CRISPR gRNA sequence
agctgtaaaatggtataata

SEQ ID NO: 658607 - DNA, 20 bp, Artificial
  CRISPR gRNA sequence
taaaatggtataataataat

SEQ ID NO: 658608 - DNA, 20 bp, Artificial
  CRISPR gRNA sequence
gccttaagttttgaagaaat

SEQ ID NO: 658609 - DNA, 20 bp, Artificial
  CRISPR gRNA sequence
ccttaagttttgaagaaata

SEQ ID NO: 658610 - DNA, 20 bp, Artificial
  CRISPR gRNA sequence
aagttttgaagaaataaatg

SEQ ID NO: 658611 - DNA, 20 bp, Artificial
  CRISPR gRNA sequence
agttttgaagaaataaatgt

SEQ ID NO: 658612 - DNA, 20 bp, Artificial
  CRISPR gRNA sequence
tgaagaaataaatgtaacaa

SEQ ID NO: 658613 - DNA, 20 bp, Artificial
  CRISPR gRNA sequence
gaagaaataaatgtaacaat

SEQ ID NO: 658614 - DNA, 20 bp, Artificial
  CRISPR gRNA sequence
aagaaataaatgtaacaatt

SEQ ID NO: 658615 - DNA, 20 bp, Artificial
  CRISPR gRNA sequence
catagagcacttagctcatt

SEQ ID NO: 658616 - DNA, 20 bp, Artificial
  CRISPR gRNA sequence
agctcattttttggcacgtt

SEQ ID NO: 658617 - DNA, 20 bp, Artificial
  CRISPR gRNA sequence
gctcattttttggcacgttt

SEQ ID NO: 658618 - DNA, 20 bp, Artificial
  CRISPR gRNA sequence
attttttggcacgtttgctg

SEQ ID NO: 658619 - DNA, 20 bp, Artificial
  CRISPR gRNA sequence
tttggcacgtttgctgttgt

SEQ ID NO: 658620 - DNA, 20 bp, Artificial
  CRISPR gRNA sequence
ttggcacgtttgctgttgtg

SEQ ID NO: 658621 - DNA, 20 bp, Artificial
  CRISPR gRNA sequence
tggcacgtttgctgttgtga

SEQ ID NO: 658622 - DNA, 20 bp, Artificial
  CRISPR gRNA sequence
ggcacgtttgctgttgtgat

SEQ ID NO: 658623 - DNA, 20 bp, Artificial
  CRISPR gRNA sequence
gcacgtttgctgttgtgatt

SEQ ID NO: 658624 - DNA, 20 bp, Artificial
  CRISPR gRNA sequence
gctgttgtgatttatagact

SEQ ID NO: 658625 - DNA, 20 bp, Artificial
  CRISPR gRNA sequence
ctgttgtgatttatagactg

SEQ ID NO: 658626 - DNA, 20 bp, Artificial
  CRISPR gRNA sequence
ttgtgatttatagactgcaa

SEQ ID NO: 658627 - DNA, 20 bp, Artificial
  CRISPR gRNA sequence
tgatttatagactgcaaata

SEQ ID NO: 658628 - DNA, 20 bp, Artificial
  CRISPR gRNA sequence
atagactgcaaatatttgca

SEQ ID NO: 658629 - DNA, 20 bp, Artificial
  CRISPR gRNA sequence
tagactgcaaatatttgcat

SEQ ID NO: 658630 - DNA, 20 bp, Artificial
  CRISPR gRNA sequence
caaatatttgcatatagctt

SEQ ID NO: 658631 - DNA, 20 bp, Artificial
  CRISPR gRNA sequence
gcatatagctttttaatatt

SEQ ID NO: 658632 - DNA, 20 bp, Artificial
  CRISPR gRNA sequence
catatagctttttaatattt

SEQ ID NO: 658633 - DNA, 20 bp, Artificial
  CRISPR gRNA sequence
tttaatatttattagataag

SEQ ID NO: 658634 - DNA, 20 bp, Artificial
  CRISPR gRNA sequence
ttaatatttattagataagg

SEQ ID NO: 658635 - DNA, 20 bp, Artificial
  CRISPR gRNA sequence
taatatttattagataaggc

SEQ ID NO: 658636 - DNA, 20 bp, Artificial
  CRISPR gRNA sequence
aatatttattagataaggct

SEQ ID NO: 658637 - DNA, 20 bp, Artificial
  CRISPR gRNA sequence
atatttattagataaggctt

SEQ ID NO: 658638 - DNA, 20 bp, Artificial
  CRISPR gRNA sequence
attagataaggcttctaggg

SEQ ID NO: 658639 - DNA, 20 bp, Artificial
  CRISPR gRNA sequence
ttagataaggcttctagggt

SEQ ID NO: 658640 - DNA, 20 bp, Artificial
  CRISPR gRNA sequence
gataaggcttctagggtttg

SEQ ID NO: 658641 - DNA, 20 bp, Artificial
  CRISPR gRNA sequence
ctagggtttgaaaattaatg

SEQ ID NO: 658642 - DNA, 20 bp, Artificial
  CRISPR gRNA sequence
tagggtttgaaaattaatga

SEQ ID NO: 658643 - DNA, 20 bp, Artificial
  CRISPR gRNA sequence
gggtttgaaaattaatgaat

SEQ ID NO: 658644 - DNA, 20 bp, Artificial
  CRISPR gRNA sequence
gaaaattaatgaataccaac

SEQ ID NO: 658645 - DNA, 20 bp, Artificial
  CRISPR gRNA sequence
aaaattaatgaataccaacc

SEQ ID NO: 658646 - DNA, 20 bp, Artificial
  CRISPR gRNA sequence
atgaataccaaccccattct

SEQ ID NO: 658647 - DNA, 20 bp, Artificial
  CRISPR gRNA sequence
taaagttaccacttgcattc

SEQ ID NO: 658648 - DNA, 20 bp, Artificial
  CRISPR gRNA sequence
aagttaccacttgcattcta

SEQ ID NO: 658649 - DNA, 20 bp, Artificial
  CRISPR gRNA sequence
ccacttgcattctaggaaat

SEQ ID NO: 658650 - DNA, 20 bp, Artificial
  CRISPR gRNA sequence
gcattctaggaaatacattt

SEQ ID NO: 658651 - DNA, 20 bp, Artificial
  CRISPR gRNA sequence
cattctaggaaatacatttg

SEQ ID NO: 658652 - DNA, 20 bp, Artificial
  CRISPR gRNA sequence
taggaaatacatttgttttg

SEQ ID NO: 658653 - DNA, 20 bp, Artificial
  CRISPR gRNA sequence
ggaaatacatttgttttgcc

SEQ ID NO: 658654 - DNA, 20 bp, Artificial
  CRISPR gRNA sequence
gttttgccttgttttaagat

SEQ ID NO: 658655 - DNA, 20 bp, Artificial
  CRISPR gRNA sequence
ttttgccttgttttaagatt

SEQ ID NO: 658656 - DNA, 20 bp, Artificial
  CRISPR gRNA sequence
tgccttgttttaagatttag

SEQ ID NO: 658657 - DNA, 20 bp, Artificial
  CRISPR gRNA sequence
gccttgttttaagatttaga

SEQ ID NO: 658658 - DNA, 20 bp, Artificial
  CRISPR gRNA sequence
ccttgttttaagatttagaa

SEQ ID NO: 658659 - DNA, 20 bp, Artificial
  CRISPR gRNA sequence
gttttaagatttagaatacc

SEQ ID NO: 658660 - DNA, 20 bp, Artificial
  CRISPR gRNA sequence
ttttaagatttagaatacct

SEQ ID NO: 658661 - DNA, 20 bp, Artificial
  CRISPR gRNA sequence
taagatttagaatacctttt

SEQ ID NO: 658662 - DNA, 20 bp, Artificial
  CRISPR gRNA sequence
aagatttagaataccttttt

SEQ ID NO: 658663 - DNA, 20 bp, Artificial
  CRISPR gRNA sequence
agatttagaatacctttttt

SEQ ID NO: 658664 - DNA, 20 bp, Artificial
  CRISPR gRNA sequence
agaataccttttttattaaa

SEQ ID NO: 658665 - DNA, 20 bp, Artificial
  CRISPR gRNA sequence
gaataccttttttattaaac

SEQ ID NO: 658666 - DNA, 20 bp, Artificial
  CRISPR gRNA sequence
ttttattaaacagacaaaca

SEQ ID NO: 658667 - DNA, 20 bp, Artificial
  CRISPR gRNA sequence
tttattaaacagacaaacaa

SEQ ID NO: 658668 - DNA, 20 bp, Artificial
  CRISPR gRNA sequence
ttattaaacagacaaacaaa

SEQ ID NO: 658669 - DNA, 20 bp, Artificial
  CRISPR gRNA sequence
tattaaacagacaaacaaaa

SEQ ID NO: 658670 - DNA, 20 bp, Artificial
  CRISPR gRNA sequence
attaaacagacaaacaaaac

SEQ ID NO: 658671 - DNA, 20 bp, Artificial
  CRISPR gRNA sequence
ttaaacagacaaacaaaaca

SEQ ID NO: 658672 - DNA, 20 bp, Artificial
  CRISPR gRNA sequence
aacagacaaacaaaacaagt

SEQ ID NO: 658673 - DNA, 20 bp, Artificial
  CRISPR gRNA sequence
gcatcctcacatttcaccat

SEQ ID NO: 658674 - DNA, 20 bp, Artificial
  CRISPR gRNA sequence
catcctcacatttcaccatt

SEQ ID NO: 658675 - DNA, 20 bp, Artificial
  CRISPR gRNA sequence
acatttcaccatttcacaaa

SEQ ID NO: 658676 - DNA, 20 bp, Artificial
  CRISPR gRNA sequence
caccatttcacaaatctatt

SEQ ID NO: 658677 - DNA, 20 bp, Artificial
  CRISPR gRNA sequence
accatttcacaaatctattg

SEQ ID NO: 658678 - DNA, 20 bp, Artificial
  CRISPR gRNA sequence
cacaaatctattgtggtatt

SEQ ID NO: 658679 - DNA, 20 bp, Artificial
  CRISPR gRNA sequence
acaaatctattgtggtattt

SEQ ID NO: 658680 - DNA, 20 bp, Artificial
  CRISPR gRNA sequence
ttgtggtatttcacaaatct

SEQ ID NO: 658681 - DNA, 20 bp, Artificial
  CRISPR gRNA sequence
tggtatttcacaaatctatt

SEQ ID NO: 658682 - DNA, 20 bp, Artificial
  CRISPR gRNA sequence
cacaaatctattttatttta

SEQ ID NO: 658683 - DNA, 20 bp, Artificial
  CRISPR gRNA sequence
acaaatctattttattttat

SEQ ID NO: 658684 - DNA, 20 bp, Artificial
  CRISPR gRNA sequence
ttttattttataatggtaac

SEQ ID NO: 658685 - DNA, 20 bp, Artificial
  CRISPR gRNA sequence
tattttataatggtaacttt

SEQ ID NO: 658686 - DNA, 20 bp, Artificial
  CRISPR gRNA sequence
attttataatggtaacttta

SEQ ID NO: 658687 - DNA, 20 bp, Artificial
  CRISPR gRNA sequence
ttttataatggtaactttat

SEQ ID NO: 658688 - DNA, 20 bp, Artificial
  CRISPR gRNA sequence
tataatggtaactttattta

SEQ ID NO: 658689 - DNA, 20 bp, Artificial
  CRISPR gRNA sequence
ataatggtaactttatttag

SEQ ID NO: 658690 - DNA, 20 bp, Artificial
  CRISPR gRNA sequence
taatggtaactttatttagc

SEQ ID NO: 658691 - DNA, 20 bp, Artificial
  CRISPR gRNA sequence
tatttagctttttctatttg

SEQ ID NO: 658692 - DNA, 20 bp, Artificial
  CRISPR gRNA sequence
atttagctttttctatttgc

SEQ ID NO: 658693 - DNA, 20 bp, Artificial
  CRISPR gRNA sequence
tttagctttttctatttgct

SEQ ID NO: 658694 - DNA, 20 bp, Artificial
  CRISPR gRNA sequence
agctttttctatttgctttt

SEQ ID NO: 658695 - DNA, 20 bp, Artificial
  CRISPR gRNA sequence
gctttttctatttgctttta

SEQ ID NO: 658696 - DNA, 20 bp, Artificial
  CRISPR gRNA sequence
tttctatttgcttttatatt

SEQ ID NO: 658697 - DNA, 20 bp, Artificial
  CRISPR gRNA sequence
ttctatttgcttttatatta

SEQ ID NO: 658698 - DNA, 20 bp, Artificial
  CRISPR gRNA sequence
tctatttgcttttatattat

SEQ ID NO: 658699 - DNA, 20 bp, Artificial
  CRISPR gRNA sequence
ctatttgcttttatattata

SEQ ID NO: 658700 - DNA, 20 bp, Artificial
  CRISPR gRNA sequence
tatttgcttttatattatac

SEQ ID NO: 658701 - DNA, 20 bp, Artificial
  CRISPR gRNA sequence
tttgcttttatattatactt

SEQ ID NO: 658702 - DNA, 20 bp, Artificial
  CRISPR gRNA sequence
gcttttatattatacttaat

SEQ ID NO: 658703 - DNA, 20 bp, Artificial
  CRISPR gRNA sequence
cttttatattatacttaata

SEQ ID NO: 658704 - DNA, 20 bp, Artificial
  CRISPR gRNA sequence
ttatattatacttaatagta

SEQ ID NO: 658705 - DNA, 20 bp, Artificial
  CRISPR gRNA sequence
tatattatacttaatagtat

SEQ ID NO: 658706 - DNA, 20 bp, Artificial
  CRISPR gRNA sequence
atattatacttaatagtatt

SEQ ID NO: 658707 - DNA, 20 bp, Artificial
  CRISPR gRNA sequence
tattatacttaatagtattt

SEQ ID NO: 658708 - DNA, 20 bp, Artificial
  CRISPR gRNA sequence
tacttaatagtattttaatt

SEQ ID NO: 658709 - DNA, 20 bp, Artificial
  CRISPR gRNA sequence
aatagtattttaattattat

SEQ ID NO: 658710 - DNA, 20 bp, Artificial
  CRISPR gRNA sequence
atagtattttaattattatg

SEQ ID NO: 658711 - DNA, 20 bp, Artificial
  CRISPR gRNA sequence
taattattatggttgatcat

SEQ ID NO: 658712 - DNA, 20 bp, Artificial
  CRISPR gRNA sequence
aattattatggttgatcatc

SEQ ID NO: 658713 - DNA, 20 bp, Artificial
  CRISPR gRNA sequence
attattatggttgatcatca

SEQ ID NO: 658714 - DNA, 20 bp, Artificial
  CRISPR gRNA sequence
ttatggttgatcatcatggt

SEQ ID NO: 658715 - DNA, 20 bp, Artificial
  CRISPR gRNA sequence
tggttgatcatcatggtaat

SEQ ID NO: 658716 - DNA, 20 bp, Artificial
  CRISPR gRNA sequence
atcatcatggtaatttaata

SEQ ID NO: 658717 - DNA, 20 bp, Artificial
  CRISPR gRNA sequence
aatagcctcttaggaaggga

SEQ ID NO: 658718 - DNA, 20 bp, Artificial
  CRISPR gRNA sequence
atagcctcttaggaagggaa

SEQ ID NO: 658719 - DNA, 20 bp, Artificial
  CRISPR gRNA sequence
ttaggaagggaaatgcttta

SEQ ID NO: 658720 - DNA, 20 bp, Artificial
  CRISPR gRNA sequence
aggaagggaaatgctttata

SEQ ID NO: 658721 - DNA, 20 bp, Artificial
  CRISPR gRNA sequence
ggaagggaaatgctttataa

SEQ ID NO: 658722 - DNA, 20 bp, Artificial
  CRISPR gRNA sequence
tataaaaacaatcaaatcta

SEQ ID NO: 658723 - DNA, 20 bp, Artificial
  CRISPR gRNA sequence
ataaaaacaatcaaatctaa

SEQ ID NO: 658724 - DNA, 20 bp, Artificial
  CRISPR gRNA sequence
taaaaacaatcaaatctaat

SEQ ID NO: 658725 - DNA, 20 bp, Artificial
  CRISPR gRNA sequence
atttctttagttcctaggat

SEQ ID NO: 658726 - DNA, 20 bp, Artificial
  CRISPR gRNA sequence
ctttagttcctaggatattt

SEQ ID NO: 658727 - DNA, 20 bp, Artificial
  CRISPR gRNA sequence
tttagttcctaggatatttt

SEQ ID NO: 658728 - DNA, 20 bp, Artificial
  CRISPR gRNA sequence
tagttcctaggatattttgg

SEQ ID NO: 658729 - DNA, 20 bp, Artificial
  CRISPR gRNA sequence
agttcctaggatattttgga

SEQ ID NO: 658730 - DNA, 20 bp, Artificial
  CRISPR gRNA sequence
gttcctaggatattttggaa

SEQ ID NO: 658731 - DNA, 20 bp, Artificial
  CRISPR gRNA sequence
ctaggatattttggaaatac

SEQ ID NO: 658732 - DNA, 20 bp, Artificial
  CRISPR gRNA sequence
ggatattttggaaatacatg

SEQ ID NO: 658733 - DNA, 20 bp, Artificial
  CRISPR gRNA sequence
tggaaatacatgtattctta

SEQ ID NO: 658734 - DNA, 20 bp, Artificial
  CRISPR gRNA sequence
ggaaatacatgtattcttaa

SEQ ID NO: 658735 - DNA, 20 bp, Artificial
  CRISPR gRNA sequence
gaaatacatgtattcttaag

SEQ ID NO: 658736 - DNA, 20 bp, Artificial
  CRISPR gRNA sequence
ttaagttagttaattgggtg

SEQ ID NO: 658737 - DNA, 20 bp, Artificial
  CRISPR gRNA sequence
aagttagttaattgggtgga

SEQ ID NO: 658738 - DNA, 20 bp, Artificial
  CRISPR gRNA sequence
agttagttaattgggtggaa

SEQ ID NO: 658739 - DNA, 20 bp, Artificial
  CRISPR gRNA sequence
gttaattgggtggaaaaatt

SEQ ID NO: 658740 - DNA, 20 bp, Artificial
  CRISPR gRNA sequence
attgggtggaaaaattgcag

SEQ ID NO: 658741 - DNA, 20 bp, Artificial
  CRISPR gRNA sequence
ggtggaaaaattgcagttat

SEQ ID NO: 658742 - DNA, 20 bp, Artificial
  CRISPR gRNA sequence
cagttataattctttagaaa

SEQ ID NO: 658743 - DNA, 20 bp, Artificial
  CRISPR gRNA sequence
taattctttagaaaagaatg

SEQ ID NO: 658744 - DNA, 20 bp, Artificial
  CRISPR gRNA sequence
tttagaaaagaatgttgaca

SEQ ID NO: 658745 - DNA, 20 bp, Artificial
  CRISPR gRNA sequence
tagaaaagaatgttgacata

SEQ ID NO: 658746 - DNA, 20 bp, Artificial
  CRISPR gRNA sequence
agaaaagaatgttgacatat

SEQ ID NO: 658747 - DNA, 20 bp, Artificial
  CRISPR gRNA sequence
gaaaagaatgttgacatatc

SEQ ID NO: 658748 - DNA, 20 bp, Artificial
  CRISPR gRNA sequence
acatatctaaccaaaaattc

SEQ ID NO: 658749 - DNA, 20 bp, Artificial
  CRISPR gRNA sequence
accaaaaattctgatgatag

SEQ ID NO: 658750 - DNA, 20 bp, Artificial
  CRISPR gRNA sequence
tgatgatagataggacttaa

SEQ ID NO: 658751 - DNA, 20 bp, Artificial
  CRISPR gRNA sequence
atgatagataggacttaaag

SEQ ID NO: 658752 - DNA, 20 bp, Artificial
  CRISPR gRNA sequence
aaagagaaaatgtaaacaag

SEQ ID NO: 658753 - DNA, 20 bp, Artificial
  CRISPR gRNA sequence
aagagaaaatgtaaacaagt

SEQ ID NO: 658754 - DNA, 20 bp, Artificial
  CRISPR gRNA sequence
ttgatttcaaattactttta

SEQ ID NO: 658755 - DNA, 20 bp, Artificial
  CRISPR gRNA sequence
atttcaaattacttttattt

SEQ ID NO: 658756 - DNA, 20 bp, Artificial
  CRISPR gRNA sequence
caaattacttttatttgggt

SEQ ID NO: 658757 - DNA, 20 bp, Artificial
  CRISPR gRNA sequence
aaattacttttatttgggtt

SEQ ID NO: 658758 - DNA, 20 bp, Artificial
  CRISPR gRNA sequence
cttttatttgggttggatta

SEQ ID NO: 658759 - DNA, 20 bp, Artificial
  CRISPR gRNA sequence
ttatttgggttggattagct

SEQ ID NO: 658760 - DNA, 20 bp, Artificial
  CRISPR gRNA sequence
tatttgggttggattagctg

SEQ ID NO: 658761 - DNA, 20 bp, Artificial
  CRISPR gRNA sequence
atttgggttggattagctgt

SEQ ID NO: 658762 - DNA, 20 bp, Artificial
  CRISPR gRNA sequence
tttgggttggattagctgtc

SEQ ID NO: 658763 - DNA, 20 bp, Artificial
  CRISPR gRNA sequence
gggttggattagctgtcttt

SEQ ID NO: 658764 - DNA, 20 bp, Artificial
  CRISPR gRNA sequence
ggttggattagctgtcttta

SEQ ID NO: 658765 - DNA, 20 bp, Artificial
  CRISPR gRNA sequence
gattagctgtctttatgcta

SEQ ID NO: 658766 - DNA, 20 bp, Artificial
  CRISPR gRNA sequence
gctgtctttatgctaggact

SEQ ID NO: 658767 - DNA, 20 bp, Artificial
  CRISPR gRNA sequence
tctttatgctaggactattt

SEQ ID NO: 658768 - DNA, 20 bp, Artificial
  CRISPR gRNA sequence
tatgctaggactatttgtgt

SEQ ID NO: 658769 - DNA, 20 bp, Artificial
  CRISPR gRNA sequence
atgctaggactatttgtgtg

SEQ ID NO: 658770 - DNA, 20 bp, Artificial
  CRISPR gRNA sequence
tgctaggactatttgtgtgt

SEQ ID NO: 658771 - DNA, 20 bp, Artificial
  CRISPR gRNA sequence
ggactatttgtgtgtaatat

SEQ ID NO: 658772 - DNA, 20 bp, Artificial
  CRISPR gRNA sequence
tttgtgtgtaatatagatca

SEQ ID NO: 658773 - DNA, 20 bp, Artificial
  CRISPR gRNA sequence
gtgtgtaatatagatcaaat

SEQ ID NO: 658774 - DNA, 20 bp, Artificial
  CRISPR gRNA sequence
tgtgtaatatagatcaaata

SEQ ID NO: 658775 - DNA, 20 bp, Artificial
  CRISPR gRNA sequence
agaatgggatgaactatctg

SEQ ID NO: 658776 - DNA, 20 bp, Artificial
  CRISPR gRNA sequence
tctggaaggaagtggtgtta

SEQ ID NO: 658777 - DNA, 20 bp, Artificial
  CRISPR gRNA sequence
gaaggaagtggtgttatcta

SEQ ID NO: 658778 - DNA, 20 bp, Artificial
  CRISPR gRNA sequence
tctatactactacagctgga

SEQ ID NO: 658779 - DNA, 20 bp, Artificial
  CRISPR gRNA sequence
tactactacagctggaaaat

SEQ ID NO: 658780 - DNA, 20 bp, Artificial
  CRISPR gRNA sequence
ctacagctggaaaatatgac

SEQ ID NO: 658781 - DNA, 20 bp, Artificial
  CRISPR gRNA sequence
cagctggaaaatatgacaat

SEQ ID NO: 658782 - DNA, 20 bp, Artificial
  CRISPR gRNA sequence
gaaaatatgacaattacaaa

SEQ ID NO: 658783 - DNA, 20 bp, Artificial
  CRISPR gRNA sequence
caaacttaattgatcaatac

SEQ ID NO: 658784 - DNA, 20 bp, Artificial
  CRISPR gRNA sequence
aattgatcaataccgtatca

SEQ ID NO: 658785 - DNA, 20 bp, Artificial
  CRISPR gRNA sequence
attgatcaataccgtatcac

SEQ ID NO: 658786 - DNA, 20 bp, Artificial
  CRISPR gRNA sequence
atcaataccgtatcacatca

SEQ ID NO: 658787 - DNA, 20 bp, Artificial
  CRISPR gRNA sequence
ttcaatgattaaggactgct

SEQ ID NO: 658788 - DNA, 20 bp, Artificial
  CRISPR gRNA sequence
aatgattaaggactgctagg

SEQ ID NO: 658789 - DNA, 20 bp, Artificial
  CRISPR gRNA sequence
aggactgctaggtgaaactg

SEQ ID NO: 658790 - DNA, 20 bp, Artificial
  CRISPR gRNA sequence
ctaggtgaaactgacataat

SEQ ID NO: 658791 - DNA, 20 bp, Artificial
  CRISPR gRNA sequence
ggtgaaactgacataatggg

SEQ ID NO: 658792 - DNA, 20 bp, Artificial
  CRISPR gRNA sequence
acataatggggttttctttt

SEQ ID NO: 658793 - DNA, 20 bp, Artificial
  CRISPR gRNA sequence
tctttttggaaaatagtatc

SEQ ID NO: 658794 - DNA, 20 bp, Artificial
  CRISPR gRNA sequence
ctttttggaaaatagtatct

SEQ ID NO: 658795 - DNA, 20 bp, Artificial
  CRISPR gRNA sequence
tttttggaaaatagtatctt

SEQ ID NO: 658796 - DNA, 20 bp, Artificial
  CRISPR gRNA sequence
tttggaaaatagtatcttag

SEQ ID NO: 658797 - DNA, 20 bp, Artificial
  CRISPR gRNA sequence
ttggaaaatagtatcttagt

SEQ ID NO: 658798 - DNA, 20 bp, Artificial
  CRISPR gRNA sequence
tggaaaatagtatcttagtt

SEQ ID NO: 658799 - DNA, 20 bp, Artificial
  CRISPR gRNA sequence
ggaaaatagtatcttagttg

SEQ ID NO: 658800 - DNA, 20 bp, Artificial
  CRISPR gRNA sequence
gaaaatagtatcttagttgt

SEQ ID NO: 658801 - DNA, 20 bp, Artificial
  CRISPR gRNA sequence
agttgtattggtattccact

SEQ ID NO: 658802 - DNA, 20 bp, Artificial
  CRISPR gRNA sequence
gttgtattggtattccactg

SEQ ID NO: 658803 - DNA, 20 bp, Artificial
  CRISPR gRNA sequence
tattggtattccactggata

SEQ ID NO: 658804 - DNA, 20 bp, Artificial
  CRISPR gRNA sequence
gtattccactggatatttag

SEQ ID NO: 658805 - DNA, 20 bp, Artificial
  CRISPR gRNA sequence
cactggatatttagtaaaag

SEQ ID NO: 658806 - DNA, 20 bp, Artificial
  CRISPR gRNA sequence
gatatttagtaaaagtgcta

SEQ ID NO: 658807 - DNA, 20 bp, Artificial
  CRISPR gRNA sequence
agtaaaagtgctatttactg

SEQ ID NO: 658808 - DNA, 20 bp, Artificial
  CRISPR gRNA sequence
gtaaaagtgctatttactga

SEQ ID NO: 658809 - DNA, 20 bp, Artificial
  CRISPR gRNA sequence
tttactgagaacatccttag

SEQ ID NO: 658810 - DNA, 20 bp, Artificial
  CRISPR gRNA sequence
actgagaacatccttaggat

SEQ ID NO: 658811 - DNA, 20 bp, Artificial
  CRISPR gRNA sequence
ctgagaacatccttaggatt

SEQ ID NO: 658812 - DNA, 20 bp, Artificial
  CRISPR gRNA sequence
agaacatccttaggatttag

SEQ ID NO: 658813 - DNA, 20 bp, Artificial
  CRISPR gRNA sequence
aggatttagaaagagaacta

SEQ ID NO: 658814 - DNA, 20 bp, Artificial
  CRISPR gRNA sequence
ggatttagaaagagaactat

SEQ ID NO: 658815 - DNA, 20 bp, Artificial
  CRISPR gRNA sequence
agaaagagaactatgtagtt

SEQ ID NO: 658816 - DNA, 20 bp, Artificial
  CRISPR gRNA sequence
gaaagagaactatgtagttt

SEQ ID NO: 658817 - DNA, 20 bp, Artificial
  CRISPR gRNA sequence
tgtagttttatagttacaga

SEQ ID NO: 658818 - DNA, 20 bp, Artificial
  CRISPR gRNA sequence
tatagttacagagattctgg

SEQ ID NO: 658819 - DNA, 20 bp, Artificial
  CRISPR gRNA sequence
atagttacagagattctggt

SEQ ID NO: 658820 - DNA, 20 bp, Artificial
  CRISPR gRNA sequence
tagttacagagattctggtg

SEQ ID NO: 658821 - DNA, 20 bp, Artificial
  CRISPR gRNA sequence
cagagattctggtgcagatt

SEQ ID NO: 658822 - DNA, 20 bp, Artificial
  CRISPR gRNA sequence
tggtgcagatttgggaagag

SEQ ID NO: 658823 - DNA, 20 bp, Artificial
  CRISPR gRNA sequence
gtgcagatttgggaagaggt

SEQ ID NO: 658824 - DNA, 20 bp, Artificial
  CRISPR gRNA sequence
gggaagaggtttgaaattag

SEQ ID NO: 658825 - DNA, 20 bp, Artificial
  CRISPR gRNA sequence
ggaagaggtttgaaattagt

SEQ ID NO: 658826 - DNA, 20 bp, Artificial
  CRISPR gRNA sequence
gaaattagtatgtaaagtca

SEQ ID NO: 658827 - DNA, 20 bp, Artificial
  CRISPR gRNA sequence
aaattagtatgtaaagtcag

SEQ ID NO: 658828 - DNA, 20 bp, Artificial
  CRISPR gRNA sequence
gtatgtaaagtcagaacagc

SEQ ID NO: 658829 - DNA, 20 bp, Artificial
  CRISPR gRNA sequence
aactaatgtactgtttgccc

SEQ ID NO: 658830 - DNA, 20 bp, Artificial
  CRISPR gRNA sequence
atgtactgtttgcccttgac

SEQ ID NO: 658831 - DNA, 20 bp, Artificial
  CRISPR gRNA sequence
tttgcccttgaccccttctc

SEQ ID NO: 658832 - DNA, 20 bp, Artificial
  CRISPR gRNA sequence
gcccttgaccccttctccac

SEQ ID NO: 658833 - DNA, 20 bp, Artificial
  CRISPR gRNA sequence
cccttgaccccttctccaca

SEQ ID NO: 658834 - DNA, 20 bp, Artificial
  CRISPR gRNA sequence
gaccccttctccacaacctg

SEQ ID NO: 658835 - DNA, 20 bp, Artificial
  CRISPR gRNA sequence
accccttctccacaacctgc

SEQ ID NO: 658836 - DNA, 20 bp, Artificial
  CRISPR gRNA sequence
ctccacaacctgccactaat

SEQ ID NO: 658837 - DNA, 20 bp, Artificial
  CRISPR gRNA sequence
tccacaacctgccactaatg

SEQ ID NO: 658838 - DNA, 20 bp, Artificial
  CRISPR gRNA sequence
cacaacctgccactaatgaa

SEQ ID NO: 658839 - DNA, 20 bp, Artificial
  CRISPR gRNA sequence
ccactaatgaaaggtctttg

SEQ ID NO: 658840 - DNA, 20 bp, Artificial
  CRISPR gRNA sequence
atgaaaggtctttgataagt

SEQ ID NO: 658841 - DNA, 20 bp, Artificial
  CRISPR gRNA sequence
tgataagtgtaactgcctta

SEQ ID NO: 658842 - DNA, 20 bp, Artificial
  CRISPR gRNA sequence
gataagtgtaactgccttat

SEQ ID NO: 658843 - DNA, 20 bp, Artificial
  CRISPR gRNA sequence
ataagtgtaactgccttata

SEQ ID NO: 658844 - DNA, 20 bp, Artificial
  CRISPR gRNA sequence
ccttatacccattttattta

SEQ ID NO: 658845 - DNA, 20 bp, Artificial
  CRISPR gRNA sequence
atacccattttatttacagt

SEQ ID NO: 658846 - DNA, 20 bp, Artificial
  CRISPR gRNA sequence
tacccattttatttacagtt

SEQ ID NO: 658847 - DNA, 20 bp, Artificial
  CRISPR gRNA sequence
tatttacagttttcatagct

SEQ ID NO: 658848 - DNA, 20 bp, Artificial
  CRISPR gRNA sequence
atttacagttttcatagcta

SEQ ID NO: 658849 - DNA, 20 bp, Artificial
  CRISPR gRNA sequence
tttacagttttcatagctaa

SEQ ID NO: 658850 - DNA, 20 bp, Artificial
  CRISPR gRNA sequence
acagttttcatagctaatga

SEQ ID NO: 658851 - DNA, 20 bp, Artificial
  CRISPR gRNA sequence
cagttttcatagctaatgaa

SEQ ID NO: 658852 - DNA, 20 bp, Artificial
  CRISPR gRNA sequence
tcatagctaatgaataataa

SEQ ID NO: 658853 - DNA, 20 bp, Artificial
  CRISPR gRNA sequence
catagctaatgaataataag

SEQ ID NO: 658854 - DNA, 20 bp, Artificial
  CRISPR gRNA sequence
atagctaatgaataataaga

SEQ ID NO: 658855 - DNA, 20 bp, Artificial
  CRISPR gRNA sequence
atgaataataagaaaattcc

SEQ ID NO: 658856 - DNA, 20 bp, Artificial
  CRISPR gRNA sequence
caccaggacctgattgttta

SEQ ID NO: 658857 - DNA, 20 bp, Artificial
  CRISPR gRNA sequence
attgtttacctctctaatag

SEQ ID NO: 658858 - DNA, 20 bp, Artificial
  CRISPR gRNA sequence
tttacctctctaatagcaat

SEQ ID NO: 658859 - DNA, 20 bp, Artificial
  CRISPR gRNA sequence
acctctctaatagcaattta

SEQ ID NO: 658860 - DNA, 20 bp, Artificial
  CRISPR gRNA sequence
cctctctaatagcaatttac

SEQ ID NO: 658861 - DNA, 20 bp, Artificial
  CRISPR gRNA sequence
tctaatagcaatttacaaat

SEQ ID NO: 658862 - DNA, 20 bp, Artificial
  CRISPR gRNA sequence
taatagcaatttacaaatgg

SEQ ID NO: 658863 - DNA, 20 bp, Artificial
  CRISPR gRNA sequence
atagcaatttacaaatggtg

SEQ ID NO: 658864 - DNA, 20 bp, Artificial
  CRISPR gRNA sequence
acaaatggtgtatgctgtgg

SEQ ID NO: 658865 - DNA, 20 bp, Artificial
  CRISPR gRNA sequence
caaatggtgtatgctgtggc

SEQ ID NO: 658866 - DNA, 20 bp, Artificial
  CRISPR gRNA sequence
tggctgttacaaaccgtgtc

SEQ ID NO: 658867 - DNA, 20 bp, Artificial
  CRISPR gRNA sequence
ttacaaaccgtgtcctgtaa

SEQ ID NO: 658868 - DNA, 20 bp, Artificial
  CRISPR gRNA sequence
caaaccgtgtcctgtaatag

SEQ ID NO: 658869 - DNA, 20 bp, Artificial
  CRISPR gRNA sequence
taatagcatttgatgtaagt

SEQ ID NO: 658870 - DNA, 20 bp, Artificial
  CRISPR gRNA sequence
gatgtaagtagctgctcacc

SEQ ID NO: 658871 - DNA, 20 bp, Artificial
  CRISPR gRNA sequence
atgtaagtagctgctcacca

SEQ ID NO: 658872 - DNA, 20 bp, Artificial
  CRISPR gRNA sequence
ctcaccattccatattgtgg

SEQ ID NO: 658873 - DNA, 20 bp, Artificial
  CRISPR gRNA sequence
accattccatattgtggttg

SEQ ID NO: 658874 - DNA, 20 bp, Artificial
  CRISPR gRNA sequence
catattgtggttggagctgg

SEQ ID NO: 658875 - DNA, 20 bp, Artificial
  CRISPR gRNA sequence
tggttggagctggagaaata

SEQ ID NO: 658876 - DNA, 20 bp, Artificial
  CRISPR gRNA sequence
gagctggagaaatagaaaat

SEQ ID NO: 658877 - DNA, 20 bp, Artificial
  CRISPR gRNA sequence
gagaaatagaaaattggtca

SEQ ID NO: 658878 - DNA, 20 bp, Artificial
  CRISPR gRNA sequence
gtcatttcccggcagatagc

SEQ ID NO: 658879 - DNA, 20 bp, Artificial
  CRISPR gRNA sequence
cccggcagatagcagtaact

SEQ ID NO: 658880 - DNA, 20 bp, Artificial
  CRISPR gRNA sequence
ccggcagatagcagtaactt

SEQ ID NO: 658881 - DNA, 20 bp, Artificial
  CRISPR gRNA sequence
tcaattcagtcagaatgctg

SEQ ID NO: 658882 - DNA, 20 bp, Artificial
  CRISPR gRNA sequence
caattcagtcagaatgctgt

SEQ ID NO: 658883 - DNA, 20 bp, Artificial
  CRISPR gRNA sequence
aattcagtcagaatgctgta

SEQ ID NO: 658884 - DNA, 20 bp, Artificial
  CRISPR gRNA sequence
agtcagaatgctgtatgggc

SEQ ID NO: 658885 - DNA, 20 bp, Artificial
  CRISPR gRNA sequence
tatgggctgtgataggttta

SEQ ID NO: 658886 - DNA, 20 bp, Artificial
  CRISPR gRNA sequence
tgataggtttataattatta

SEQ ID NO: 658887 - DNA, 20 bp, Artificial
  CRISPR gRNA sequence
ataattattacccaaagatt

SEQ ID NO: 658888 - DNA, 20 bp, Artificial
  CRISPR gRNA sequence
taattattacccaaagattg

SEQ ID NO: 658889 - DNA, 20 bp, Artificial
  CRISPR gRNA sequence
ttacccaaagattgatggtt

SEQ ID NO: 658890 - DNA, 20 bp, Artificial
  CRISPR gRNA sequence
cccaaagattgatggttttt

SEQ ID NO: 658891 - DNA, 20 bp, Artificial
  CRISPR gRNA sequence
atggttttttggtgtgtgta

SEQ ID NO: 658892 - DNA, 20 bp, Artificial
  CRISPR gRNA sequence
tttggtgtgtgtaaatttgt

SEQ ID NO: 658893 - DNA, 20 bp, Artificial
  CRISPR gRNA sequence
ttggtgtgtgtaaatttgtg

SEQ ID NO: 658894 - DNA, 20 bp, Artificial
  CRISPR gRNA sequence
tggtgtgtgtaaatttgtgc

SEQ ID NO: 658895 - DNA, 20 bp, Artificial
  CRISPR gRNA sequence
ggtgtgtgtaaatttgtgca

SEQ ID NO: 658896 - DNA, 20 bp, Artificial
  CRISPR gRNA sequence
gtgtgtgtaaatttgtgcag

SEQ ID NO: 658897 - DNA, 20 bp, Artificial
  CRISPR gRNA sequence
gtgcagcagtaatccattaa

SEQ ID NO: 658898 - DNA, 20 bp, Artificial
  CRISPR gRNA sequence
tgcagcagtaatccattaag

SEQ ID NO: 658899 - DNA, 20 bp, Artificial
  CRISPR gRNA sequence
agaaatcaataatcattcca

SEQ ID NO: 658900 - DNA, 20 bp, Artificial
  CRISPR gRNA sequence
cattctgatgtgtagttcct

SEQ ID NO: 658901 - DNA, 20 bp, Artificial
  CRISPR gRNA sequence
tgatgtgtagttcctattca

SEQ ID NO: 658902 - DNA, 20 bp, Artificial
  CRISPR gRNA sequence
atgtgtagttcctattcact

SEQ ID NO: 658903 - DNA, 20 bp, Artificial
  CRISPR gRNA sequence
ctattcactgttataaatgt

SEQ ID NO: 658904 - DNA, 20 bp, Artificial
  CRISPR gRNA sequence
ttcactgttataaatgtgta

SEQ ID NO: 658905 - DNA, 20 bp, Artificial
  CRISPR gRNA sequence
actgttataaatgtgtaccg

SEQ ID NO: 658906 - DNA, 20 bp, Artificial
  CRISPR gRNA sequence
ttataaatgtgtaccgtgag

SEQ ID NO: 658907 - DNA, 20 bp, Artificial
  CRISPR gRNA sequence
taaatgtgtaccgtgagctg

SEQ ID NO: 658908 - DNA, 20 bp, Artificial
  CRISPR gRNA sequence
aaaccaatgtgttttgcttt

SEQ ID NO: 658909 - DNA, 20 bp, Artificial
  CRISPR gRNA sequence
tgctttgttttttgaaattg

SEQ ID NO: 658910 - DNA, 20 bp, Artificial
  CRISPR gRNA sequence
gctttgttttttgaaattgt

SEQ ID NO: 658911 - DNA, 20 bp, Artificial
  CRISPR gRNA sequence
ctttgttttttgaaattgta

SEQ ID NO: 658912 - DNA, 20 bp, Artificial
  CRISPR gRNA sequence
tgttttttgaaattgtattt

SEQ ID NO: 658913 - DNA, 20 bp, Artificial
  CRISPR gRNA sequence
gttttttgaaattgtatttg

SEQ ID NO: 658914 - DNA, 20 bp, Artificial
  CRISPR gRNA sequence
ttttttgaaattgtatttga

SEQ ID NO: 658915 - DNA, 20 bp, Artificial
  CRISPR gRNA sequence
tttgaaattgtatttgacag

SEQ ID NO: 658916 - DNA, 20 bp, Artificial
  CRISPR gRNA sequence
ttgaaattgtatttgacagt

SEQ ID NO: 658917 - DNA, 20 bp, Artificial
  CRISPR gRNA sequence
tgaaattgtatttgacagta

SEQ ID NO: 658918 - DNA, 20 bp, Artificial
  CRISPR gRNA sequence
gaaattgtatttgacagtat

SEQ ID NO: 658919 - DNA, 20 bp, Artificial
  CRISPR gRNA sequence
aaattgtatttgacagtatt

SEQ ID NO: 658920 - DNA, 20 bp, Artificial
  CRISPR gRNA sequence
tatttgacagtattggaaat

SEQ ID NO: 658921 - DNA, 20 bp, Artificial
  CRISPR gRNA sequence
gacagtattggaaatgagga

SEQ ID NO: 658922 - DNA, 20 bp, Artificial
  CRISPR gRNA sequence
acagtattggaaatgaggaa

SEQ ID NO: 658923 - DNA, 20 bp, Artificial
  CRISPR gRNA sequence
gaaatgaggaaattattata

SEQ ID NO: 658924 - DNA, 20 bp, Artificial
  CRISPR gRNA sequence
ttataatattttttcttcaa

SEQ ID NO: 658925 - DNA, 20 bp, Artificial
  CRISPR gRNA sequence
taatattttttcttcaatca

SEQ ID NO: 658926 - DNA, 20 bp, Artificial
  CRISPR gRNA sequence
tttcttcaatcaaatttctt

SEQ ID NO: 658927 - DNA, 20 bp, Artificial
  CRISPR gRNA sequence
ttcttcaatcaaatttcttt

SEQ ID NO: 658928 - DNA, 20 bp, Artificial
  CRISPR gRNA sequence
tcttcaatcaaatttctttt

SEQ ID NO: 658929 - DNA, 20 bp, Artificial
  CRISPR gRNA sequence
cttcaatcaaatttcttttt

SEQ ID NO: 658930 - DNA, 20 bp, Artificial
  CRISPR gRNA sequence
ttcaatcaaatttctttttc

SEQ ID NO: 658931 - DNA, 20 bp, Artificial
  CRISPR gRNA sequence
caatcaaatttctttttctt

SEQ ID NO: 658932 - DNA, 20 bp, Artificial
  CRISPR gRNA sequence
aatcaaatttctttttcttt

SEQ ID NO: 658933 - DNA, 20 bp, Artificial
  CRISPR gRNA sequence
ctttttctttgtgttccctt

SEQ ID NO: 658934 - DNA, 20 bp, Artificial
  CRISPR gRNA sequence
tttttctttgtgttcccttg

SEQ ID NO: 658935 - DNA, 20 bp, Artificial
  CRISPR gRNA sequence
tttctttgtgttcccttgta

SEQ ID NO: 658936 - DNA, 20 bp, Artificial
  CRISPR gRNA sequence
ttctttgtgttcccttgtac

SEQ ID NO: 658937 - DNA, 20 bp, Artificial
  CRISPR gRNA sequence
tctttgtgttcccttgtacc

SEQ ID NO: 658938 - DNA, 20 bp, Artificial
  CRISPR gRNA sequence
ctttgtgttcccttgtacca

SEQ ID NO: 658939 - DNA, 20 bp, Artificial
  CRISPR gRNA sequence
tttgtgttcccttgtaccat

SEQ ID NO: 658940 - DNA, 20 bp, Artificial
  CRISPR gRNA sequence
tgtgttcccttgtaccatat

SEQ ID NO: 658941 - DNA, 20 bp, Artificial
  CRISPR gRNA sequence
gtgttcccttgtaccatatg

SEQ ID NO: 658942 - DNA, 20 bp, Artificial
  CRISPR gRNA sequence
tgttcccttgtaccatatga

SEQ ID NO: 658943 - DNA, 20 bp, Artificial
  CRISPR gRNA sequence
ccttgtaccatatgacgtac

SEQ ID NO: 658944 - DNA, 20 bp, Artificial
  CRISPR gRNA sequence
gtaccatatgacgtacctat

SEQ ID NO: 658945 - DNA, 20 bp, Artificial
  CRISPR gRNA sequence
taccatatgacgtacctatt

SEQ ID NO: 658946 - DNA, 20 bp, Artificial
  CRISPR gRNA sequence
ttgcaagtctgcatttttct

SEQ ID NO: 658947 - DNA, 20 bp, Artificial
  CRISPR gRNA sequence
caagtctgcatttttctttg

SEQ ID NO: 658948 - DNA, 20 bp, Artificial
  CRISPR gRNA sequence
catttttctttgaaaaattt

SEQ ID NO: 658949 - DNA, 20 bp, Artificial
  CRISPR gRNA sequence
ttctttgaaaaattttattt

SEQ ID NO: 658950 - DNA, 20 bp, Artificial
  CRISPR gRNA sequence
tctttgaaaaattttattta

SEQ ID NO: 658951 - DNA, 20 bp, Artificial
  CRISPR gRNA sequence
ctttgaaaaattttatttaa

SEQ ID NO: 658952 - DNA, 20 bp, Artificial
  CRISPR gRNA sequence
tttgaaaaattttatttaaa

SEQ ID NO: 658953 - DNA, 20 bp, Artificial
  CRISPR gRNA sequence
tgaaaaattttatttaaaac

SEQ ID NO: 658954 - DNA, 20 bp, Artificial
  CRISPR gRNA sequence
gaaaaattttatttaaaact

SEQ ID NO: 658955 - DNA, 20 bp, Artificial
  CRISPR gRNA sequence
aaaaattttatttaaaacta

SEQ ID NO: 658956 - DNA, 20 bp, Artificial
  CRISPR gRNA sequence
tatttaaaactatttcaaat

SEQ ID NO: 658957 - DNA, 20 bp, Artificial
  CRISPR gRNA sequence
atttaaaactatttcaaatg

SEQ ID NO: 658958 - DNA, 20 bp, Artificial
  CRISPR gRNA sequence
tttaaaactatttcaaatgt

SEQ ID NO: 658959 - DNA, 20 bp, Artificial
  CRISPR gRNA sequence
aaaactatttcaaatgtttc

SEQ ID NO: 658960 - DNA, 20 bp, Artificial
  CRISPR gRNA sequence
aaactatttcaaatgtttct

SEQ ID NO: 658961 - DNA, 20 bp, Artificial
  CRISPR gRNA sequence
tttcaaatgtttctgtctcc

SEQ ID NO: 658962 - DNA, 20 bp, Artificial
  CRISPR gRNA sequence
caaatgtttctgtctccttt

SEQ ID NO: 658963 - DNA, 20 bp, Artificial
  CRISPR gRNA sequence
aaatgtttctgtctcctttt

SEQ ID NO: 658964 - DNA, 20 bp, Artificial
  CRISPR gRNA sequence
ctgtctcctttttaccatca

SEQ ID NO: 658965 - DNA, 20 bp, Artificial
  CRISPR gRNA sequence
tgtctcctttttaccatcat

SEQ ID NO: 658966 - DNA, 20 bp, Artificial
  CRISPR gRNA sequence
tctcctttttaccatcattt

SEQ ID NO: 658967 - DNA, 20 bp, Artificial
  CRISPR gRNA sequence
ctttttaccatcatttactt

SEQ ID NO: 658968 - DNA, 20 bp, Artificial
  CRISPR gRNA sequence
tttaccatcatttactttgt

SEQ ID NO: 658969 - DNA, 20 bp, Artificial
  CRISPR gRNA sequence
ttaccatcatttactttgtt

SEQ ID NO: 658970 - DNA, 20 bp, Artificial
  CRISPR gRNA sequence
taccatcatttactttgttg

SEQ ID NO: 658971 - DNA, 20 bp, Artificial
  CRISPR gRNA sequence
accatcatttactttgttgt

SEQ ID NO: 658972 - DNA, 20 bp, Artificial
  CRISPR gRNA sequence
ccatcatttactttgttgtt

SEQ ID NO: 658973 - DNA, 20 bp, Artificial
  CRISPR gRNA sequence
actttgttgtttaataatta

SEQ ID NO: 658974 - DNA, 20 bp, Artificial
  CRISPR gRNA sequence
ctttgttgtttaataattac

SEQ ID NO: 658975 - DNA, 20 bp, Artificial
  CRISPR gRNA sequence
tgttgtttaataattacaaa

SEQ ID NO: 658976 - DNA, 20 bp, Artificial
  CRISPR gRNA sequence
gttgtttaataattacaaat

SEQ ID NO: 658977 - DNA, 20 bp, Artificial
  CRISPR gRNA sequence
ttgtttaataattacaaatt

SEQ ID NO: 658978 - DNA, 20 bp, Artificial
  CRISPR gRNA sequence
tttaataattacaaattatt

SEQ ID NO: 658979 - DNA, 20 bp, Artificial
  CRISPR gRNA sequence
aataattacaaattatttat

SEQ ID NO: 658980 - DNA, 20 bp, Artificial
  CRISPR gRNA sequence
ataattacaaattatttata

SEQ ID NO: 658981 - DNA, 20 bp, Artificial
  CRISPR gRNA sequence
caaattatttataagcttaa

SEQ ID NO: 658982 - DNA, 20 bp, Artificial
  CRISPR gRNA sequence
tttataagcttaaagcatct

SEQ ID NO: 658983 - DNA, 20 bp, Artificial
  CRISPR gRNA sequence
ataagcttaaagcatctcag

SEQ ID NO: 658984 - DNA, 20 bp, Artificial
  CRISPR gRNA sequence
taagcttaaagcatctcagt

SEQ ID NO: 658985 - DNA, 20 bp, Artificial
  CRISPR gRNA sequence
aaagcatctcagtgtttctt

SEQ ID NO: 658986 - DNA, 20 bp, Artificial
  CRISPR gRNA sequence
aagcatctcagtgtttcttt

SEQ ID NO: 658987 - DNA, 20 bp, Artificial
  CRISPR gRNA sequence
agtgtttctttctgtaatct

SEQ ID NO: 658988 - DNA, 20 bp, Artificial
  CRISPR gRNA sequence
ctttctgtaatctggaggtg

SEQ ID NO: 658989 - DNA, 20 bp, Artificial
  CRISPR gRNA sequence
tttctgtaatctggaggtga

SEQ ID NO: 658990 - DNA, 20 bp, Artificial
  CRISPR gRNA sequence
tctgtaatctggaggtgatt

SEQ ID NO: 658991 - DNA, 20 bp, Artificial
  CRISPR gRNA sequence
ctgtaatctggaggtgattt

SEQ ID NO: 658992 - DNA, 20 bp, Artificial
  CRISPR gRNA sequence
tgtaatctggaggtgattta

SEQ ID NO: 658993 - DNA, 20 bp, Artificial
  CRISPR gRNA sequence
taatctggaggtgatttatt

SEQ ID NO: 658994 - DNA, 20 bp, Artificial
  CRISPR gRNA sequence
gaggtgatttattaccaact

SEQ ID NO: 658995 - DNA, 20 bp, Artificial
  CRISPR gRNA sequence
attaccaactctatatggtc

SEQ ID NO: 658996 - DNA, 20 bp, Artificial
  CRISPR gRNA sequence
ttaccaactctatatggtca

SEQ ID NO: 658997 - DNA, 20 bp, Artificial
  CRISPR gRNA sequence
ccaactctatatggtcagga

SEQ ID NO: 658998 - DNA, 20 bp, Artificial
  CRISPR gRNA sequence
tatatggtcaggaaagtagg

SEQ ID NO: 658999 - DNA, 20 bp, Artificial
  CRISPR gRNA sequence
tatggtcaggaaagtaggaa

SEQ ID NO: 659000 - DNA, 20 bp, Artificial
  CRISPR gRNA sequence
ttctcttgtaaaatacaatt

SEQ ID NO: 659001 - DNA, 20 bp, Artificial
  CRISPR gRNA sequence
ctcttgtaaaatacaatttt

SEQ ID NO: 659002 - DNA, 20 bp, Artificial
  CRISPR gRNA sequence
tcttgtaaaatacaatttta

SEQ ID NO: 659003 - DNA, 20 bp, Artificial
  CRISPR gRNA sequence
ttgtaaaatacaattttaac

SEQ ID NO: 659004 - DNA, 20 bp, Artificial
  CRISPR gRNA sequence
gtaaaatacaattttaacct

SEQ ID NO: 659005 - DNA, 20 bp, Artificial
  CRISPR gRNA sequence
taaaatacaattttaacctt

SEQ ID NO: 659006 - DNA, 20 bp, Artificial
  CRISPR gRNA sequence
taaccttaaaacgataatct

SEQ ID NO: 659007 - DNA, 20 bp, Artificial
  CRISPR gRNA sequence
aaccttaaaacgataatctc

SEQ ID NO: 659008 - DNA, 20 bp, Artificial
  CRISPR gRNA sequence
accttaaaacgataatctca

SEQ ID NO: 659009 - DNA, 20 bp, Artificial
  CRISPR gRNA sequence
aaaacgataatctcataaaa

SEQ ID NO: 659010 - DNA, 20 bp, Artificial
  CRISPR gRNA sequence
aaacgataatctcataaaaa

SEQ ID NO: 659011 - DNA, 20 bp, Artificial
  CRISPR gRNA sequence
ataaaaaacaactctaatgt

SEQ ID NO: 659012 - DNA, 20 bp, Artificial
  CRISPR gRNA sequence
taatgtttatttattaccgg

SEQ ID NO: 659013 - DNA, 20 bp, Artificial
  CRISPR gRNA sequence
atgtttatttattaccggta

SEQ ID NO: 659014 - DNA, 20 bp, Artificial
  CRISPR gRNA sequence
atttattaccggtacctcct

SEQ ID NO: 659015 - DNA, 20 bp, Artificial
  CRISPR gRNA sequence
tttattaccggtacctccta

SEQ ID NO: 659016 - DNA, 20 bp, Artificial
  CRISPR gRNA sequence
attaccggtacctcctagga

SEQ ID NO: 659017 - DNA, 20 bp, Artificial
  CRISPR gRNA sequence
ttaccggtacctcctaggat

SEQ ID NO: 659018 - DNA, 20 bp, Artificial
  CRISPR gRNA sequence
ccggtacctcctaggatgcc

SEQ ID NO: 659019 - DNA, 20 bp, Artificial
  CRISPR gRNA sequence
ctaggatgccattgtgggaa

SEQ ID NO: 659020 - DNA, 20 bp, Artificial
  CRISPR gRNA sequence
ggatgccattgtgggaagct

SEQ ID NO: 659021 - DNA, 20 bp, Artificial
  CRISPR gRNA sequence
tgggaagctaggattaaggc

SEQ ID NO: 659022 - DNA, 20 bp, Artificial
  CRISPR gRNA sequence
ggattaaggcagcattgacc

SEQ ID NO: 659023 - DNA, 20 bp, Artificial
  CRISPR gRNA sequence
aggcagcattgaccctactc

SEQ ID NO: 659024 - DNA, 20 bp, Artificial
  CRISPR gRNA sequence
accctactctcaaaggagct

SEQ ID NO: 659025 - DNA, 20 bp, Artificial
  CRISPR gRNA sequence
ctctcaaaggagcttagatt

SEQ ID NO: 659026 - DNA, 20 bp, Artificial
  CRISPR gRNA sequence
tcaaaggagcttagatttta

SEQ ID NO: 659027 - DNA, 20 bp, Artificial
  CRISPR gRNA sequence
aaaggagcttagattttaga

SEQ ID NO: 659028 - DNA, 20 bp, Artificial
  CRISPR gRNA sequence
agattttagagaaagaaagg

SEQ ID NO: 659029 - DNA, 20 bp, Artificial
  CRISPR gRNA sequence
gattttagagaaagaaaggc

SEQ ID NO: 659030 - DNA, 20 bp, Artificial
  CRISPR gRNA sequence
tagagaaagaaaggcagaaa

SEQ ID NO: 659031 - DNA, 20 bp, Artificial
  CRISPR gRNA sequence
agagaaagaaaggcagaaat

SEQ ID NO: 659032 - DNA, 20 bp, Artificial
  CRISPR gRNA sequence
gagaaagaaaggcagaaatc

SEQ ID NO: 659033 - DNA, 20 bp, Artificial
  CRISPR gRNA sequence
aaaccatccattacgtaagt

SEQ ID NO: 659034 - DNA, 20 bp, Artificial
  CRISPR gRNA sequence
cgtaagttctgaactggaac

SEQ ID NO: 659035 - DNA, 20 bp, Artificial
  CRISPR gRNA sequence
tgaactggaactttggtgtt

SEQ ID NO: 659036 - DNA, 20 bp, Artificial
  CRISPR gRNA sequence
aactggaactttggtgttat

SEQ ID NO: 659037 - DNA, 20 bp, Artificial
  CRISPR gRNA sequence
gaactttggtgttatggcat

SEQ ID NO: 659038 - DNA, 20 bp, Artificial
  CRISPR gRNA sequence
tggtgttatggcatgatagt

SEQ ID NO: 659039 - DNA, 20 bp, Artificial
  CRISPR gRNA sequence
ggtgttatggcatgatagtg

SEQ ID NO: 659040 - DNA, 20 bp, Artificial
  CRISPR gRNA sequence
gtgttatggcatgatagtgc

SEQ ID NO: 659041 - DNA, 20 bp, Artificial
  CRISPR gRNA sequence
tggcatgatagtgctaggga

SEQ ID NO: 659042 - DNA, 20 bp, Artificial
  CRISPR gRNA sequence
gggatgatggggtgtgggtg

SEQ ID NO: 659043 - DNA, 20 bp, Artificial
  CRISPR gRNA sequence
catcccacaggggatgtggc

SEQ ID NO: 659044 - DNA, 20 bp, Artificial
  CRISPR gRNA sequence
atcccacaggggatgtggcc

SEQ ID NO: 659045 - DNA, 20 bp, Artificial
  CRISPR gRNA sequence
caaaattctgacatagtgtg

SEQ ID NO: 659046 - DNA, 20 bp, Artificial
  CRISPR gRNA sequence
tgacatagtgtggggctaaa

SEQ ID NO: 659047 - DNA, 20 bp, Artificial
  CRISPR gRNA sequence
acatagtgtggggctaaaga

SEQ ID NO: 659048 - DNA, 20 bp, Artificial
  CRISPR gRNA sequence
aagagcagtctaaatagaga

SEQ ID NO: 659049 - DNA, 20 bp, Artificial
  CRISPR gRNA sequence
aatagagattctaggtaaaa

SEQ ID NO: 659050 - DNA, 20 bp, Artificial
  CRISPR gRNA sequence
taggtaaaaatgatatagga

SEQ ID NO: 659051 - DNA, 20 bp, Artificial
  CRISPR gRNA sequence
ggtaaaaatgatataggaac

SEQ ID NO: 659052 - DNA, 20 bp, Artificial
  CRISPR gRNA sequence
aaacggtagagaaagatata

SEQ ID NO: 659053 - DNA, 20 bp, Artificial
  CRISPR gRNA sequence
caccactcaagtaccctagt

SEQ ID NO: 659054 - DNA, 20 bp, Artificial
  CRISPR gRNA sequence
aagtaccctagtcctcagtt

SEQ ID NO: 659055 - DNA, 20 bp, Artificial
  CRISPR gRNA sequence
gtcctcagtttcctgtgcta

SEQ ID NO: 659056 - DNA, 20 bp, Artificial
  CRISPR gRNA sequence
agtttcctgtgctaccaatt

SEQ ID NO: 659057 - DNA, 20 bp, Artificial
  CRISPR gRNA sequence
cctgtgctaccaattcctta

SEQ ID NO: 659058 - DNA, 20 bp, Artificial
  CRISPR gRNA sequence
ctgtgctaccaattccttaa

SEQ ID NO: 659059 - DNA, 20 bp, Artificial
  CRISPR gRNA sequence
tgctaccaattccttaatta

SEQ ID NO: 659060 - DNA, 20 bp, Artificial
  CRISPR gRNA sequence
ccaattccttaattatcttt

SEQ ID NO: 659061 - DNA, 20 bp, Artificial
  CRISPR gRNA sequence
cttaattatctttccataat

SEQ ID NO: 659062 - DNA, 20 bp, Artificial
  CRISPR gRNA sequence
aattatctttccataatttt

SEQ ID NO: 659063 - DNA, 20 bp, Artificial
  CRISPR gRNA sequence
attatctttccataattttt

SEQ ID NO: 659064 - DNA, 20 bp, Artificial
  CRISPR gRNA sequence
tctttccataattttttggt

SEQ ID NO: 659065 - DNA, 20 bp, Artificial
  CRISPR gRNA sequence
tccataattttttggtatat

SEQ ID NO: 659066 - DNA, 20 bp, Artificial
  CRISPR gRNA sequence
ccataattttttggtatata

SEQ ID NO: 659067 - DNA, 20 bp, Artificial
  CRISPR gRNA sequence
cataattttttggtatatac

SEQ ID NO: 659068 - DNA, 20 bp, Artificial
  CRISPR gRNA sequence
tttggtatatactagtacaa

SEQ ID NO: 659069 - DNA, 20 bp, Artificial
  CRISPR gRNA sequence
ttggtatatactagtacaaa

SEQ ID NO: 659070 - DNA, 20 bp, Artificial
  CRISPR gRNA sequence
tggtatatactagtacaaat

SEQ ID NO: 659071 - DNA, 20 bp, Artificial
  CRISPR gRNA sequence
ggtatatactagtacaaatc

SEQ ID NO: 659072 - DNA, 20 bp, Artificial
  CRISPR gRNA sequence
gtatatactagtacaaatca

SEQ ID NO: 659073 - DNA, 20 bp, Artificial
  CRISPR gRNA sequence
gtacaaatcatgtgtctaca

SEQ ID NO: 659074 - DNA, 20 bp, Artificial
  CRISPR gRNA sequence
catattttgtttcctttcct

SEQ ID NO: 659075 - DNA, 20 bp, Artificial
  CRISPR gRNA sequence
tgtttcctttcctattaata

SEQ ID NO: 659076 - DNA, 20 bp, Artificial
  CRISPR gRNA sequence
gtttcctttcctattaatag

SEQ ID NO: 659077 - DNA, 20 bp, Artificial
  CRISPR gRNA sequence
tttcctttcctattaatagt

SEQ ID NO: 659078 - DNA, 20 bp, Artificial
  CRISPR gRNA sequence
cctttcctattaatagtaca

SEQ ID NO: 659079 - DNA, 20 bp, Artificial
  CRISPR gRNA sequence
ctttcctattaatagtacaa

SEQ ID NO: 659080 - DNA, 20 bp, Artificial
  CRISPR gRNA sequence
tcctattaatagtacaaata

SEQ ID NO: 659081 - DNA, 20 bp, Artificial
  CRISPR gRNA sequence
cctattaatagtacaaatag

SEQ ID NO: 659082 - DNA, 20 bp, Artificial
  CRISPR gRNA sequence
ctattaatagtacaaatagg

SEQ ID NO: 659083 - DNA, 20 bp, Artificial
  CRISPR gRNA sequence
ttaatagtacaaatagggtt

SEQ ID NO: 659084 - DNA, 20 bp, Artificial
  CRISPR gRNA sequence
atagtacaaatagggttgca

SEQ ID NO: 659085 - DNA, 20 bp, Artificial
  CRISPR gRNA sequence
catggtacatacttgcccta

SEQ ID NO: 659086 - DNA, 20 bp, Artificial
  CRISPR gRNA sequence
gccctatgactcaatttttc

SEQ ID NO: 659087 - DNA, 20 bp, Artificial
  CRISPR gRNA sequence
ccctatgactcaatttttca

SEQ ID NO: 659088 - DNA, 20 bp, Artificial
  CRISPR gRNA sequence
tgactcaatttttcatttag

SEQ ID NO: 659089 - DNA, 20 bp, Artificial
  CRISPR gRNA sequence
aatttttcatttaggatttt

SEQ ID NO: 659090 - DNA, 20 bp, Artificial
  CRISPR gRNA sequence
ttcatttaggattttttttt

SEQ ID NO: 659091 - DNA, 20 bp, Artificial
  CRISPR gRNA sequence
tcatttaggattttttttta

SEQ ID NO: 659092 - DNA, 20 bp, Artificial
  CRISPR gRNA sequence
catttaggatttttttttaa

SEQ ID NO: 659093 - DNA, 20 bp, Artificial
  CRISPR gRNA sequence
atttaggatttttttttaat

SEQ ID NO: 659094 - DNA, 20 bp, Artificial
  CRISPR gRNA sequence
aggatttttttttaatacca

SEQ ID NO: 659095 - DNA, 20 bp, Artificial
  CRISPR gRNA sequence
ggatttttttttaataccaa

SEQ ID NO: 659096 - DNA, 20 bp, Artificial
  CRISPR gRNA sequence
ttttttaataccaacgttgt

SEQ ID NO: 659097 - DNA, 20 bp, Artificial
  CRISPR gRNA sequence
tttttaataccaacgttgtt

SEQ ID NO: 659098 - DNA, 20 bp, Artificial
  CRISPR gRNA sequence
ttttaataccaacgttgttc

SEQ ID NO: 659099 - DNA, 20 bp, Artificial
  CRISPR gRNA sequence
tttaataccaacgttgttct

SEQ ID NO: 659100 - DNA, 20 bp, Artificial
  CRISPR gRNA sequence
ttaataccaacgttgttctt

SEQ ID NO: 659101 - DNA, 20 bp, Artificial
  CRISPR gRNA sequence
taataccaacgttgttcttg

SEQ ID NO: 659102 - DNA, 20 bp, Artificial
  CRISPR gRNA sequence
aataccaacgttgttcttgg

SEQ ID NO: 659103 - DNA, 20 bp, Artificial
  CRISPR gRNA sequence
ataccaacgttgttcttggg

SEQ ID NO: 659104 - DNA, 20 bp, Artificial
  CRISPR gRNA sequence
ttcttgggtgcatataatac

SEQ ID NO: 659105 - DNA, 20 bp, Artificial
  CRISPR gRNA sequence
ttgggtgcatataatacctt

SEQ ID NO: 659106 - DNA, 20 bp, Artificial
  CRISPR gRNA sequence
gggtgcatataataccttta

SEQ ID NO: 659107 - DNA, 20 bp, Artificial
  CRISPR gRNA sequence
ggtgcatataatacctttat

SEQ ID NO: 659108 - DNA, 20 bp, Artificial
  CRISPR gRNA sequence
tatacactgatgatacatgg

SEQ ID NO: 659109 - DNA, 20 bp, Artificial
  CRISPR gRNA sequence
atacactgatgatacatggt

SEQ ID NO: 659110 - DNA, 20 bp, Artificial
  CRISPR gRNA sequence
tacactgatgatacatggtg

SEQ ID NO: 659111 - DNA, 20 bp, Artificial
  CRISPR gRNA sequence
atgatacatggtgatttaat

SEQ ID NO: 659112 - DNA, 20 bp, Artificial
  CRISPR gRNA sequence
aatttgctcctcattcactg

SEQ ID NO: 659113 - DNA, 20 bp, Artificial
  CRISPR gRNA sequence
atttgctcctcattcactgt

SEQ ID NO: 659114 - DNA, 20 bp, Artificial
  CRISPR gRNA sequence
gctcctcattcactgttgga

SEQ ID NO: 659115 - DNA, 20 bp, Artificial
  CRISPR gRNA sequence
ctcctcattcactgttggac

SEQ ID NO: 659116 - DNA, 20 bp, Artificial
  CRISPR gRNA sequence
ctcattcactgttggacatt

SEQ ID NO: 659117 - DNA, 20 bp, Artificial
  CRISPR gRNA sequence
attcactgttggacatttag

SEQ ID NO: 659118 - DNA, 20 bp, Artificial
  CRISPR gRNA sequence
actgttggacatttaggttg

SEQ ID NO: 659119 - DNA, 20 bp, Artificial
  CRISPR gRNA sequence
ttggacatttaggttgtttc

SEQ ID NO: 659120 - DNA, 20 bp, Artificial
  CRISPR gRNA sequence
gacatttaggttgtttctat

SEQ ID NO: 659121 - DNA, 20 bp, Artificial
  CRISPR gRNA sequence
aggttgtttctatgtttttg

SEQ ID NO: 659122 - DNA, 20 bp, Artificial
  CRISPR gRNA sequence
ggttgtttctatgtttttgt

SEQ ID NO: 659123 - DNA, 20 bp, Artificial
  CRISPR gRNA sequence
tttctatgtttttgttatta

SEQ ID NO: 659124 - DNA, 20 bp, Artificial
  CRISPR gRNA sequence
ctatgtttttgttattatgt

SEQ ID NO: 659125 - DNA, 20 bp, Artificial
  CRISPR gRNA sequence
tatgtttttgttattatgta

SEQ ID NO: 659126 - DNA, 20 bp, Artificial
  CRISPR gRNA sequence
tgtttttgttattatgtaga

SEQ ID NO: 659127 - DNA, 20 bp, Artificial
  CRISPR gRNA sequence
ttgttattatgtagacattg

SEQ ID NO: 659128 - DNA, 20 bp, Artificial
  CRISPR gRNA sequence
tgttattatgtagacattgt

SEQ ID NO: 659129 - DNA, 20 bp, Artificial
  CRISPR gRNA sequence
gttattatgtagacattgtt

SEQ ID NO: 659130 - DNA, 20 bp, Artificial
  CRISPR gRNA sequence
ttattatgtagacattgttt

SEQ ID NO: 659131 - DNA, 20 bp, Artificial
  CRISPR gRNA sequence
ttatgtagacattgtttcag

SEQ ID NO: 659132 - DNA, 20 bp, Artificial
  CRISPR gRNA sequence
tgtagacattgtttcagtga

SEQ ID NO: 659133 - DNA, 20 bp, Artificial
  CRISPR gRNA sequence
tttcagtgatattcttgttc

SEQ ID NO: 659134 - DNA, 20 bp, Artificial
  CRISPR gRNA sequence
cagtgatattcttgttcatt

SEQ ID NO: 659135 - DNA, 20 bp, Artificial
  CRISPR gRNA sequence
agtgatattcttgttcattc

SEQ ID NO: 659136 - DNA, 20 bp, Artificial
  CRISPR gRNA sequence
ttgttcattcatttaccttc

SEQ ID NO: 659137 - DNA, 20 bp, Artificial
  CRISPR gRNA sequence
gttcattcatttaccttctt

SEQ ID NO: 659138 - DNA, 20 bp, Artificial
  CRISPR gRNA sequence
ttcattcatttaccttcttt

SEQ ID NO: 659139 - DNA, 20 bp, Artificial
  CRISPR gRNA sequence
attcatttaccttctttaca

SEQ ID NO: 659140 - DNA, 20 bp, Artificial
  CRISPR gRNA sequence
atttaccttctttacatcct

SEQ ID NO: 659141 - DNA, 20 bp, Artificial
  CRISPR gRNA sequence
accttctttacatccttagg

SEQ ID NO: 659142 - DNA, 20 bp, Artificial
  CRISPR gRNA sequence
ccttctttacatccttagga

SEQ ID NO: 659143 - DNA, 20 bp, Artificial
  CRISPR gRNA sequence
ctttacatccttaggataac

SEQ ID NO: 659144 - DNA, 20 bp, Artificial
  CRISPR gRNA sequence
tttacatccttaggataact

SEQ ID NO: 659145 - DNA, 20 bp, Artificial
  CRISPR gRNA sequence
tacatccttaggataactta

SEQ ID NO: 659146 - DNA, 20 bp, Artificial
  CRISPR gRNA sequence
acatccttaggataacttag

SEQ ID NO: 659147 - DNA, 20 bp, Artificial
  CRISPR gRNA sequence
catccttaggataacttagc

SEQ ID NO: 659148 - DNA, 20 bp, Artificial
  CRISPR gRNA sequence
aggataacttagctgtgtat

SEQ ID NO: 659149 - DNA, 20 bp, Artificial
  CRISPR gRNA sequence
ggataacttagctgtgtatt

SEQ ID NO: 659150 - DNA, 20 bp, Artificial
  CRISPR gRNA sequence
agctgtgtatttgctatgtc

SEQ ID NO: 659151 - DNA, 20 bp, Artificial
  CRISPR gRNA sequence
gctgtgtatttgctatgtca

SEQ ID NO: 659152 - DNA, 20 bp, Artificial
  CRISPR gRNA sequence
tgtatttgctatgtcaagaa

SEQ ID NO: 659153 - DNA, 20 bp, Artificial
  CRISPR gRNA sequence
gctatgtcaagaagtctgtg

SEQ ID NO: 659154 - DNA, 20 bp, Artificial
  CRISPR gRNA sequence
ctatgtcaagaagtctgtgc

SEQ ID NO: 659155 - DNA, 20 bp, Artificial
  CRISPR gRNA sequence
tgtcaagaagtctgtgcaat

SEQ ID NO: 659156 - DNA, 20 bp, Artificial
  CRISPR gRNA sequence
tgcaatgaatattttagtag

SEQ ID NO: 659157 - DNA, 20 bp, Artificial
  CRISPR gRNA sequence
tagtagataaagtgtggcca

SEQ ID NO: 659158 - DNA, 20 bp, Artificial
  CRISPR gRNA sequence
agtagataaagtgtggccaa

SEQ ID NO: 659159 - DNA, 20 bp, Artificial
  CRISPR gRNA sequence
gtagataaagtgtggccaaa

SEQ ID NO: 659160 - DNA, 20 bp, Artificial
  CRISPR gRNA sequence
ctctttggaaagtataacaa

SEQ ID NO: 659161 - DNA, 20 bp, Artificial
  CRISPR gRNA sequence
tttggaaagtataacaattt

SEQ ID NO: 659162 - DNA, 20 bp, Artificial
  CRISPR gRNA sequence
tggaaagtataacaatttac

SEQ ID NO: 659163 - DNA, 20 bp, Artificial
  CRISPR gRNA sequence
ggaaagtataacaatttaca

SEQ ID NO: 659164 - DNA, 20 bp, Artificial
  CRISPR gRNA sequence
gaaagtataacaatttacac

SEQ ID NO: 659165 - DNA, 20 bp, Artificial
  CRISPR gRNA sequence
acactacaactagtaatatg

SEQ ID NO: 659166 - DNA, 20 bp, Artificial
  CRISPR gRNA sequence
cactacaactagtaatatgt

SEQ ID NO: 659167 - DNA, 20 bp, Artificial
  CRISPR gRNA sequence
caactagtaatatgtgagtg

SEQ ID NO: 659168 - DNA, 20 bp, Artificial
  CRISPR gRNA sequence
gtaatatgtgagtgtctgtt

SEQ ID NO: 659169 - DNA, 20 bp, Artificial
  CRISPR gRNA sequence
ttttctccccttgacaaaaa

SEQ ID NO: 659170 - DNA, 20 bp, Artificial
  CRISPR gRNA sequence
tctccccttgacaaaaatgc

SEQ ID NO: 659171 - DNA, 20 bp, Artificial
  CRISPR gRNA sequence
ctccccttgacaaaaatgca

SEQ ID NO: 659172 - DNA, 20 bp, Artificial
  CRISPR gRNA sequence
tccccttgacaaaaatgcat

SEQ ID NO: 659173 - DNA, 20 bp, Artificial
  CRISPR gRNA sequence
cccttgacaaaaatgcattt

SEQ ID NO: 659174 - DNA, 20 bp, Artificial
  CRISPR gRNA sequence
gacaaaaatgcattttatcc

SEQ ID NO: 659175 - DNA, 20 bp, Artificial
  CRISPR gRNA sequence
acaaaaatgcattttatcca

SEQ ID NO: 659176 - DNA, 20 bp, Artificial
  CRISPR gRNA sequence
tatccattttggttcatctg

SEQ ID NO: 659177 - DNA, 20 bp, Artificial
  CRISPR gRNA sequence
atccattttggttcatctga

SEQ ID NO: 659178 - DNA, 20 bp, Artificial
  CRISPR gRNA sequence
tccattttggttcatctgaa

SEQ ID NO: 659179 - DNA, 20 bp, Artificial
  CRISPR gRNA sequence
tggttcatctgaatggggga

SEQ ID NO: 659180 - DNA, 20 bp, Artificial
  CRISPR gRNA sequence
ggttcatctgaatgggggaa

SEQ ID NO: 659181 - DNA, 20 bp, Artificial
  CRISPR gRNA sequence
gttcatctgaatgggggaag

SEQ ID NO: 659182 - DNA, 20 bp, Artificial
  CRISPR gRNA sequence
atctgaatgggggaagatgg

SEQ ID NO: 659183 - DNA, 20 bp, Artificial
  CRISPR gRNA sequence
aatgggggaagatggtatct

SEQ ID NO: 659184 - DNA, 20 bp, Artificial
  CRISPR gRNA sequence
cgtatgtttgacatttctta

SEQ ID NO: 659185 - DNA, 20 bp, Artificial
  CRISPR gRNA sequence
gacatttcttaattacggtt

SEQ ID NO: 659186 - DNA, 20 bp, Artificial
  CRISPR gRNA sequence
acatttcttaattacggttt

SEQ ID NO: 659187 - DNA, 20 bp, Artificial
  CRISPR gRNA sequence
cttaattacggttttttaaa

SEQ ID NO: 659188 - DNA, 20 bp, Artificial
  CRISPR gRNA sequence
ttaattacggttttttaaac

SEQ ID NO: 659189 - DNA, 20 bp, Artificial
  CRISPR gRNA sequence
aattacggttttttaaacat

SEQ ID NO: 659190 - DNA, 20 bp, Artificial
  CRISPR gRNA sequence
attacggttttttaaacata

SEQ ID NO: 659191 - DNA, 20 bp, Artificial
  CRISPR gRNA sequence
cggttttttaaacataattt

SEQ ID NO: 659192 - DNA, 20 bp, Artificial
  CRISPR gRNA sequence
tttaaacataatttcaaatg

SEQ ID NO: 659193 - DNA, 20 bp, Artificial
  CRISPR gRNA sequence
ttaaacataatttcaaatgt

SEQ ID NO: 659194 - DNA, 20 bp, Artificial
  CRISPR gRNA sequence
taaacataatttcaaatgtt

SEQ ID NO: 659195 - DNA, 20 bp, Artificial
  CRISPR gRNA sequence
aaacataatttcaaatgttt

SEQ ID NO: 659196 - DNA, 20 bp, Artificial
  CRISPR gRNA sequence
aacataatttcaaatgtttg

SEQ ID NO: 659197 - DNA, 20 bp, Artificial
  CRISPR gRNA sequence
caaatgtttgttggttggaa

SEQ ID NO: 659198 - DNA, 20 bp, Artificial
  CRISPR gRNA sequence
aaatgtttgttggttggaaa

SEQ ID NO: 659199 - DNA, 20 bp, Artificial
  CRISPR gRNA sequence
gttggttggaaattctgtat

SEQ ID NO: 659200 - DNA, 20 bp, Artificial
  CRISPR gRNA sequence
ttggttggaaattctgtatt

SEQ ID NO: 659201 - DNA, 20 bp, Artificial
  CRISPR gRNA sequence
gttggaaattctgtatttaa

SEQ ID NO: 659202 - DNA, 20 bp, Artificial
  CRISPR gRNA sequence
gaaattctgtatttaatttt

SEQ ID NO: 659203 - DNA, 20 bp, Artificial
  CRISPR gRNA sequence
tgtatttaatttttgttcct

SEQ ID NO: 659204 - DNA, 20 bp, Artificial
  CRISPR gRNA sequence
tatttaatttttgttcctga

SEQ ID NO: 659205 - DNA, 20 bp, Artificial
  CRISPR gRNA sequence
aatttttgttcctgaagaat

SEQ ID NO: 659206 - DNA, 20 bp, Artificial
  CRISPR gRNA sequence
atttttgttcctgaagaata

SEQ ID NO: 659207 - DNA, 20 bp, Artificial
  CRISPR gRNA sequence
ttgttcctgaagaatatttc

SEQ ID NO: 659208 - DNA, 20 bp, Artificial
  CRISPR gRNA sequence
tgttcctgaagaatatttct

SEQ ID NO: 659209 - DNA, 20 bp, Artificial
  CRISPR gRNA sequence
gttcctgaagaatatttctg

SEQ ID NO: 659210 - DNA, 20 bp, Artificial
  CRISPR gRNA sequence
ttcctgaagaatatttctgc

SEQ ID NO: 659211 - DNA, 20 bp, Artificial
  CRISPR gRNA sequence
ctgaagaatatttctgcttc

SEQ ID NO: 659212 - DNA, 20 bp, Artificial
  CRISPR gRNA sequence
aagaatatttctgcttcagt

SEQ ID NO: 659213 - DNA, 20 bp, Artificial
  CRISPR gRNA sequence
ctgcttcagtgtctgggaga

SEQ ID NO: 659214 - DNA, 20 bp, Artificial
  CRISPR gRNA sequence
tgcttcagtgtctgggagaa

SEQ ID NO: 659215 - DNA, 20 bp, Artificial
  CRISPR gRNA sequence
cttcagtgtctgggagaaat

SEQ ID NO: 659216 - DNA, 20 bp, Artificial
  CRISPR gRNA sequence
cagtgtctgggagaaattat

SEQ ID NO: 659217 - DNA, 20 bp, Artificial
  CRISPR gRNA sequence
agtgtctgggagaaattata

SEQ ID NO: 659218 - DNA, 20 bp, Artificial
  CRISPR gRNA sequence
ggagaaattataattaaaaa

SEQ ID NO: 659219 - DNA, 20 bp, Artificial
  CRISPR gRNA sequence
taattaaaaactctattagg

SEQ ID NO: 659220 - DNA, 20 bp, Artificial
  CRISPR gRNA sequence
aaaactctattaggaactag

SEQ ID NO: 659221 - DNA, 20 bp, Artificial
  CRISPR gRNA sequence
tattaggaactaggagaaag

SEQ ID NO: 659222 - DNA, 20 bp, Artificial
  CRISPR gRNA sequence
ttaggaactaggagaaagag

SEQ ID NO: 659223 - DNA, 20 bp, Artificial
  CRISPR gRNA sequence
ggaactaggagaaagagaga

SEQ ID NO: 659224 - DNA, 20 bp, Artificial
  CRISPR gRNA sequence
ggagaaagagagaaaaaaga

SEQ ID NO: 659225 - DNA, 20 bp, Artificial
  CRISPR gRNA sequence
tattcgtgattcatgatttg

SEQ ID NO: 659226 - DNA, 20 bp, Artificial
  CRISPR gRNA sequence
attcgtgattcatgatttga

SEQ ID NO: 659227 - DNA, 20 bp, Artificial
  CRISPR gRNA sequence
ttcgtgattcatgatttgag

SEQ ID NO: 659228 - DNA, 20 bp, Artificial
  CRISPR gRNA sequence
gtgattcatgatttgaggca

SEQ ID NO: 659229 - DNA, 20 bp, Artificial
  CRISPR gRNA sequence
atgatttgaggcatatttat

SEQ ID NO: 659230 - DNA, 20 bp, Artificial
  CRISPR gRNA sequence
gaggcatatttattaaagga

SEQ ID NO: 659231 - DNA, 20 bp, Artificial
  CRISPR gRNA sequence
aggcatatttattaaaggat

SEQ ID NO: 659232 - DNA, 20 bp, Artificial
  CRISPR gRNA sequence
attaaaggataatggcaggg

SEQ ID NO: 659233 - DNA, 20 bp, Artificial
  CRISPR gRNA sequence
ttaaaggataatggcaggga

SEQ ID NO: 659234 - DNA, 20 bp, Artificial
  CRISPR gRNA sequence
aaggataatggcagggaatg

SEQ ID NO: 659235 - DNA, 20 bp, Artificial
  CRISPR gRNA sequence
gatgttaagtagaaattttc

SEQ ID NO: 659236 - DNA, 20 bp, Artificial
  CRISPR gRNA sequence
atgttaagtagaaattttca

SEQ ID NO: 659237 - DNA, 20 bp, Artificial
  CRISPR gRNA sequence
agtagaaattttcaaatgtt

SEQ ID NO: 659238 - DNA, 20 bp, Artificial
  CRISPR gRNA sequence
tcaaatgttatacactctag

SEQ ID NO: 659239 - DNA, 20 bp, Artificial
  CRISPR gRNA sequence
caaatgttatacactctaga

SEQ ID NO: 659240 - DNA, 20 bp, Artificial
  CRISPR gRNA sequence
aaatgttatacactctagaa

SEQ ID NO: 659241 - DNA, 20 bp, Artificial
  CRISPR gRNA sequence
tacactctagaacagaagat

SEQ ID NO: 659242 - DNA, 20 bp, Artificial
  CRISPR gRNA sequence
tagaacagaagatgtgactt

SEQ ID NO: 659243 - DNA, 20 bp, Artificial
  CRISPR gRNA sequence
gaacagaagatgtgactttt

SEQ ID NO: 659244 - DNA, 20 bp, Artificial
  CRISPR gRNA sequence
ttatttctgtatctgctcta

SEQ ID NO: 659245 - DNA, 20 bp, Artificial
  CRISPR gRNA sequence
tatttctgtatctgctctaa

SEQ ID NO: 659246 - DNA, 20 bp, Artificial
  CRISPR gRNA sequence
atttctgtatctgctctaat

SEQ ID NO: 659247 - DNA, 20 bp, Artificial
  CRISPR gRNA sequence
tttctgtatctgctctaatt

SEQ ID NO: 659248 - DNA, 20 bp, Artificial
  CRISPR gRNA sequence
ctgtatctgctctaatttca

SEQ ID NO: 659249 - DNA, 20 bp, Artificial
  CRISPR gRNA sequence
tgtatctgctctaatttcac

SEQ ID NO: 659250 - DNA, 20 bp, Artificial
  CRISPR gRNA sequence
tatctgctctaatttcacta

SEQ ID NO: 659251 - DNA, 20 bp, Artificial
  CRISPR gRNA sequence
ctctaatttcactagttatc

SEQ ID NO: 659252 - DNA, 20 bp, Artificial
  CRISPR gRNA sequence
taatttcactagttatcttg

SEQ ID NO: 659253 - DNA, 20 bp, Artificial
  CRISPR gRNA sequence
atttcactagttatcttggt

SEQ ID NO: 659254 - DNA, 20 bp, Artificial
  CRISPR gRNA sequence
cactagttatcttggtaaat

SEQ ID NO: 659255 - DNA, 20 bp, Artificial
  CRISPR gRNA sequence
actagttatcttggtaaatc

SEQ ID NO: 659256 - DNA, 20 bp, Artificial
  CRISPR gRNA sequence
gttatcttggtaaatcacat

SEQ ID NO: 659257 - DNA, 20 bp, Artificial
  CRISPR gRNA sequence
tcttggtaaatcacataaga

SEQ ID NO: 659258 - DNA, 20 bp, Artificial
  CRISPR gRNA sequence
ggtaaatcacataagaaacc

SEQ ID NO: 659259 - DNA, 20 bp, Artificial
  CRISPR gRNA sequence
gtaaatcacataagaaaccc

SEQ ID NO: 659260 - DNA, 20 bp, Artificial
  CRISPR gRNA sequence
ccaaagtatttagcatagca

SEQ ID NO: 659261 - DNA, 20 bp, Artificial
  CRISPR gRNA sequence
caaagtatttagcatagcag

SEQ ID NO: 659262 - DNA, 20 bp, Artificial
  CRISPR gRNA sequence
agcatagcagttcaatgaag

SEQ ID NO: 659263 - DNA, 20 bp, Artificial
  CRISPR gRNA sequence
gcatagcagttcaatgaagt

SEQ ID NO: 659264 - DNA, 20 bp, Artificial
  CRISPR gRNA sequence
aatgaagttcaggggttaat

SEQ ID NO: 659265 - DNA, 20 bp, Artificial
  CRISPR gRNA sequence
aggggttaatgaaatctgaa

SEQ ID NO: 659266 - DNA, 20 bp, Artificial
  CRISPR gRNA sequence
atgaaatctgaattcttata

SEQ ID NO: 659267 - DNA, 20 bp, Artificial
  CRISPR gRNA sequence
aattcttatatcaagaaacc

SEQ ID NO: 659268 - DNA, 20 bp, Artificial
  CRISPR gRNA sequence
ttatatcaagaaaccttgtc

SEQ ID NO: 659269 - DNA, 20 bp, Artificial
  CRISPR gRNA sequence
atatcaagaaaccttgtcat

SEQ ID NO: 659270 - DNA, 20 bp, Artificial
  CRISPR gRNA sequence
tatcaagaaaccttgtcatc

SEQ ID NO: 659271 - DNA, 20 bp, Artificial
  CRISPR gRNA sequence
gtcatccatatagccattct

SEQ ID NO: 659272 - DNA, 20 bp, Artificial
  CRISPR gRNA sequence
tcatccatatagccattcta

SEQ ID NO: 659273 - DNA, 20 bp, Artificial
  CRISPR gRNA sequence
tattaggggaaaagattgtg

SEQ ID NO: 659274 - DNA, 20 bp, Artificial
  CRISPR gRNA sequence
ttaggggaaaagattgtgta

SEQ ID NO: 659275 - DNA, 20 bp, Artificial
  CRISPR gRNA sequence
ggggaaaagattgtgtatct

SEQ ID NO: 659276 - DNA, 20 bp, Artificial
  CRISPR gRNA sequence
tgtatctaataagaagtagc

SEQ ID NO: 659277 - DNA, 20 bp, Artificial
  CRISPR gRNA sequence
ataagaagtagcaaacaaag

SEQ ID NO: 659278 - DNA, 20 bp, Artificial
  CRISPR gRNA sequence
tacttaaaaattatacaatt

SEQ ID NO: 659279 - DNA, 20 bp, Artificial
  CRISPR gRNA sequence
acttaaaaattatacaatta

SEQ ID NO: 659280 - DNA, 20 bp, Artificial
  CRISPR gRNA sequence
cttaaaaattatacaattaa

SEQ ID NO: 659281 - DNA, 20 bp, Artificial
  CRISPR gRNA sequence
aaaaattatacaattaatta

SEQ ID NO: 659282 - DNA, 20 bp, Artificial
  CRISPR gRNA sequence
aaaattatacaattaattac

SEQ ID NO: 659283 - DNA, 20 bp, Artificial
  CRISPR gRNA sequence
tacaattaattacatttaag

SEQ ID NO: 659284 - DNA, 20 bp, Artificial
  CRISPR gRNA sequence
attacatttaagttgctagg

SEQ ID NO: 659285 - DNA, 20 bp, Artificial
  CRISPR gRNA sequence
catttaagttgctaggtgag

SEQ ID NO: 659286 - DNA, 20 bp, Artificial
  CRISPR gRNA sequence
aagttgctaggtgaggtata

SEQ ID NO: 659287 - DNA, 20 bp, Artificial
  CRISPR gRNA sequence
agttgctaggtgaggtataa

SEQ ID NO: 659288 - DNA, 20 bp, Artificial
  CRISPR gRNA sequence
ctaggtgaggtataagggaa

SEQ ID NO: 659289 - DNA, 20 bp, Artificial
  CRISPR gRNA sequence
ggtgaggtataagggaatag

SEQ ID NO: 659290 - DNA, 20 bp, Artificial
  CRISPR gRNA sequence
gtgcaggatgtaaggaataa

SEQ ID NO: 659291 - DNA, 20 bp, Artificial
  CRISPR gRNA sequence
tgcaggatgtaaggaataag

SEQ ID NO: 659292 - DNA, 20 bp, Artificial
  CRISPR gRNA sequence
atttctttttctttcctatt

SEQ ID NO: 659293 - DNA, 20 bp, Artificial
  CRISPR gRNA sequence
ctttttctttcctatttcaa

SEQ ID NO: 659294 - DNA, 20 bp, Artificial
  CRISPR gRNA sequence
tttttctttcctatttcaag

SEQ ID NO: 659295 - DNA, 20 bp, Artificial
  CRISPR gRNA sequence
tttctttcctatttcaagac

SEQ ID NO: 659296 - DNA, 20 bp, Artificial
  CRISPR gRNA sequence
ttctttcctatttcaagact

SEQ ID NO: 659297 - DNA, 20 bp, Artificial
  CRISPR gRNA sequence
tctttcctatttcaagactg

SEQ ID NO: 659298 - DNA, 20 bp, Artificial
  CRISPR gRNA sequence
ctttcctatttcaagactgg

SEQ ID NO: 659299 - DNA, 20 bp, Artificial
  CRISPR gRNA sequence
tttcctatttcaagactggt

SEQ ID NO: 659300 - DNA, 20 bp, Artificial
  CRISPR gRNA sequence
tcctatttcaagactggtag

SEQ ID NO: 659301 - DNA, 20 bp, Artificial
  CRISPR gRNA sequence
cctatttcaagactggtaga

SEQ ID NO: 659302 - DNA, 20 bp, Artificial
  CRISPR gRNA sequence
ctatttcaagactggtagag

SEQ ID NO: 659303 - DNA, 20 bp, Artificial
  CRISPR gRNA sequence
tttcaagactggtagagaac

SEQ ID NO: 659304 - DNA, 20 bp, Artificial
  CRISPR gRNA sequence
caagactggtagagaactct

SEQ ID NO: 659305 - DNA, 20 bp, Artificial
  CRISPR gRNA sequence
aagactggtagagaactctg

SEQ ID NO: 659306 - DNA, 20 bp, Artificial
  CRISPR gRNA sequence
gtagagaactctgagtttgt

SEQ ID NO: 659307 - DNA, 20 bp, Artificial
  CRISPR gRNA sequence
tgagtttgtcaattgattag

SEQ ID NO: 659308 - DNA, 20 bp, Artificial
  CRISPR gRNA sequence
agtttgtcaattgattagca

SEQ ID NO: 659309 - DNA, 20 bp, Artificial
  CRISPR gRNA sequence
gtcaattgattagcaagttg

SEQ ID NO: 659310 - DNA, 20 bp, Artificial
  CRISPR gRNA sequence
tcaattgattagcaagttga

SEQ ID NO: 659311 - DNA, 20 bp, Artificial
  CRISPR gRNA sequence
attagcaagttgaattcctt

SEQ ID NO: 659312 - DNA, 20 bp, Artificial
  CRISPR gRNA sequence
gcaagttgaattccttggaa

SEQ ID NO: 659313 - DNA, 20 bp, Artificial
  CRISPR gRNA sequence
aattccttggaaacacatag

SEQ ID NO: 659314 - DNA, 20 bp, Artificial
  CRISPR gRNA sequence
cttggaaacacataggcaaa

SEQ ID NO: 659315 - DNA, 20 bp, Artificial
  CRISPR gRNA sequence
ggaaacacataggcaaagcc

SEQ ID NO: 659316 - DNA, 20 bp, Artificial
  CRISPR gRNA sequence
gaaacacataggcaaagcct

SEQ ID NO: 659317 - DNA, 20 bp, Artificial
  CRISPR gRNA sequence
cccttgagaaaagatgaaac

SEQ ID NO: 659318 - DNA, 20 bp, Artificial
  CRISPR gRNA sequence
gagaaaagatgaaacctggt

SEQ ID NO: 659319 - DNA, 20 bp, Artificial
  CRISPR gRNA sequence
agaaaagatgaaacctggta

SEQ ID NO: 659320 - DNA, 20 bp, Artificial
  CRISPR gRNA sequence
gtactttgttgttgttgtat

SEQ ID NO: 659321 - DNA, 20 bp, Artificial
  CRISPR gRNA sequence
tgttgttgttgtatacttat

SEQ ID NO: 659322 - DNA, 20 bp, Artificial
  CRISPR gRNA sequence
gttgttgttgtatacttatt

SEQ ID NO: 659323 - DNA, 20 bp, Artificial
  CRISPR gRNA sequence
ttgttgttgtatacttattc

SEQ ID NO: 659324 - DNA, 20 bp, Artificial
  CRISPR gRNA sequence
ttgttgtatacttattcagg

SEQ ID NO: 659325 - DNA, 20 bp, Artificial
  CRISPR gRNA sequence
ttgtatacttattcaggaaa

SEQ ID NO: 659326 - DNA, 20 bp, Artificial
  CRISPR gRNA sequence
tatacttattcaggaaataa

SEQ ID NO: 659327 - DNA, 20 bp, Artificial
  CRISPR gRNA sequence
attcaggaaataagttgtat

SEQ ID NO: 659328 - DNA, 20 bp, Artificial
  CRISPR gRNA sequence
ttcaggaaataagttgtata

SEQ ID NO: 659329 - DNA, 20 bp, Artificial
  CRISPR gRNA sequence
aggaaataagttgtatactt

SEQ ID NO: 659330 - DNA, 20 bp, Artificial
  CRISPR gRNA sequence
tatacttattcaggtttaga

SEQ ID NO: 659331 - DNA, 20 bp, Artificial
  CRISPR gRNA sequence
attcaggtttagactcaccc

SEQ ID NO: 659332 - DNA, 20 bp, Artificial
  CRISPR gRNA sequence
ttcaggtttagactcaccct

SEQ ID NO: 659333 - DNA, 20 bp, Artificial
  CRISPR gRNA sequence
aggtttagactcaccctgta

SEQ ID NO: 659334 - DNA, 20 bp, Artificial
  CRISPR gRNA sequence
agactcaccctgtactttct

SEQ ID NO: 659335 - DNA, 20 bp, Artificial
  CRISPR gRNA sequence
gactcaccctgtactttcta

SEQ ID NO: 659336 - DNA, 20 bp, Artificial
  CRISPR gRNA sequence
accctgtactttctacacat

SEQ ID NO: 659337 - DNA, 20 bp, Artificial
  CRISPR gRNA sequence
tactttctacacatgggaaa

SEQ ID NO: 659338 - DNA, 20 bp, Artificial
  CRISPR gRNA sequence
tctacacatgggaaactgaa

SEQ ID NO: 659339 - DNA, 20 bp, Artificial
  CRISPR gRNA sequence
ctacacatgggaaactgaaa

SEQ ID NO: 659340 - DNA, 20 bp, Artificial
  CRISPR gRNA sequence
tacacatgggaaactgaaat

SEQ ID NO: 659341 - DNA, 20 bp, Artificial
  CRISPR gRNA sequence
cacatgggaaactgaaatac

SEQ ID NO: 659342 - DNA, 20 bp, Artificial
  CRISPR gRNA sequence
aaatactcttgagagcagag

SEQ ID NO: 659343 - DNA, 20 bp, Artificial
  CRISPR gRNA sequence
ttgagagcagagaaagttca

SEQ ID NO: 659344 - DNA, 20 bp, Artificial
  CRISPR gRNA sequence
gagagcagagaaagttcatt

SEQ ID NO: 659345 - DNA, 20 bp, Artificial
  CRISPR gRNA sequence
agagcagagaaagttcattg

SEQ ID NO: 659346 - DNA, 20 bp, Artificial
  CRISPR gRNA sequence
attgcatgacatatccactt

SEQ ID NO: 659347 - DNA, 20 bp, Artificial
  CRISPR gRNA sequence
catgacatatccacttgtac

SEQ ID NO: 659348 - DNA, 20 bp, Artificial
  CRISPR gRNA sequence
gtacgtgaaaaattatgcat

SEQ ID NO: 659349 - DNA, 20 bp, Artificial
  CRISPR gRNA sequence
tacgtgaaaaattatgcatc

SEQ ID NO: 659350 - DNA, 20 bp, Artificial
  CRISPR gRNA sequence
tgcatccaagtgtgtcgtgt

SEQ ID NO: 659351 - DNA, 20 bp, Artificial
  CRISPR gRNA sequence
tgtagctcctggtctgtccc

SEQ ID NO: 659352 - DNA, 20 bp, Artificial
  CRISPR gRNA sequence
gtagctcctggtctgtcccg

SEQ ID NO: 659353 - DNA, 20 bp, Artificial
  CRISPR gRNA sequence
tagctcctggtctgtcccgg

SEQ ID NO: 659354 - DNA, 20 bp, Artificial
  CRISPR gRNA sequence
ctggtctgtcccgggaacgg

SEQ ID NO: 659355 - DNA, 20 bp, Artificial
  CRISPR gRNA sequence
gtctgtcccgggaacgggat

SEQ ID NO: 659356 - DNA, 20 bp, Artificial
  CRISPR gRNA sequence
tcccgggaacgggatggttt

SEQ ID NO: 659357 - DNA, 20 bp, Artificial
  CRISPR gRNA sequence
gcagactgttagagagtatg

SEQ ID NO: 659358 - DNA, 20 bp, Artificial
  CRISPR gRNA sequence
cagactgttagagagtatgc

SEQ ID NO: 659359 - DNA, 20 bp, Artificial
  CRISPR gRNA sequence
ttagagagtatgctgaaggt

SEQ ID NO: 659360 - DNA, 20 bp, Artificial
  CRISPR gRNA sequence
gagagtatgctgaaggttac

SEQ ID NO: 659361 - DNA, 20 bp, Artificial
  CRISPR gRNA sequence
aaggttacctaggacctggg

SEQ ID NO: 659362 - DNA, 20 bp, Artificial
  CRISPR gRNA sequence
cctaggacctgggtttgttc

SEQ ID NO: 659363 - DNA, 20 bp, Artificial
  CRISPR gRNA sequence
ggacctgggtttgttctttg

SEQ ID NO: 659364 - DNA, 20 bp, Artificial
  CRISPR gRNA sequence
ggtttgttctttgacctaaa

SEQ ID NO: 659365 - DNA, 20 bp, Artificial
  CRISPR gRNA sequence
gttctttgacctaaagataa

SEQ ID NO: 659366 - DNA, 20 bp, Artificial
  CRISPR gRNA sequence
ttctttgacctaaagataat

SEQ ID NO: 659367 - DNA, 20 bp, Artificial
  CRISPR gRNA sequence
tttgacctaaagataatccc

SEQ ID NO: 659368 - DNA, 20 bp, Artificial
  CRISPR gRNA sequence
tgacctaaagataatcccta

SEQ ID NO: 659369 - DNA, 20 bp, Artificial
  CRISPR gRNA sequence
gacctaaagataatccctag

SEQ ID NO: 659370 - DNA, 20 bp, Artificial
  CRISPR gRNA sequence
acctaaagataatccctagg

SEQ ID NO: 659371 - DNA, 20 bp, Artificial
  CRISPR gRNA sequence
aagataatccctaggcagaa

SEQ ID NO: 659372 - DNA, 20 bp, Artificial
  CRISPR gRNA sequence
ggcagaaggcttgtacctgt

SEQ ID NO: 659373 - DNA, 20 bp, Artificial
  CRISPR gRNA sequence
gtacctgtatccctttcccc

SEQ ID NO: 659374 - DNA, 20 bp, Artificial
  CRISPR gRNA sequence
tacctgtatccctttccccc

SEQ ID NO: 659375 - DNA, 20 bp, Artificial
  CRISPR gRNA sequence
tatccctttcccccttctgc

SEQ ID NO: 659376 - DNA, 20 bp, Artificial
  CRISPR gRNA sequence
tcccccttctgcacaatggc

SEQ ID NO: 659377 - DNA, 20 bp, Artificial
  CRISPR gRNA sequence
cccccttctgcacaatggca

SEQ ID NO: 659378 - DNA, 20 bp, Artificial
  CRISPR gRNA sequence
ccccttctgcacaatggcag

SEQ ID NO: 659379 - DNA, 20 bp, Artificial
  CRISPR gRNA sequence
ctgcacaatggcagtttcat

SEQ ID NO: 659380 - DNA, 20 bp, Artificial
  CRISPR gRNA sequence
tgcacaatggcagtttcatg

SEQ ID NO: 659381 - DNA, 20 bp, Artificial
  CRISPR gRNA sequence
cacaatggcagtttcatgac

SEQ ID NO: 659382 - DNA, 20 bp, Artificial
  CRISPR gRNA sequence
catgacagagctgattgatc

SEQ ID NO: 659383 - DNA, 20 bp, Artificial
  CRISPR gRNA sequence
atgacagagctgattgatct

SEQ ID NO: 659384 - DNA, 20 bp, Artificial
  CRISPR gRNA sequence
attgatcttctttgcttttt

SEQ ID NO: 659385 - DNA, 20 bp, Artificial
  CRISPR gRNA sequence
atcttctttgctttttgcct

SEQ ID NO: 659386 - DNA, 20 bp, Artificial
  CRISPR gRNA sequence
ctttgctttttgcctgtaaa

SEQ ID NO: 659387 - DNA, 20 bp, Artificial
  CRISPR gRNA sequence
tttgctttttgcctgtaaaa

SEQ ID NO: 659388 - DNA, 20 bp, Artificial
  CRISPR gRNA sequence
tgctttttgcctgtaaaatc

SEQ ID NO: 659389 - DNA, 20 bp, Artificial
  CRISPR gRNA sequence
gctttttgcctgtaaaatca

SEQ ID NO: 659390 - DNA, 20 bp, Artificial
  CRISPR gRNA sequence
ctttttgcctgtaaaatcac

SEQ ID NO: 659391 - DNA, 20 bp, Artificial
  CRISPR gRNA sequence
tttgcctgtaaaatcacatt

SEQ ID NO: 659392 - DNA, 20 bp, Artificial
  CRISPR gRNA sequence
ttgcctgtaaaatcacattt

SEQ ID NO: 659393 - DNA, 20 bp, Artificial
  CRISPR gRNA sequence
tgcctgtaaaatcacattta

SEQ ID NO: 659394 - DNA, 20 bp, Artificial
  CRISPR gRNA sequence
gcctgtaaaatcacatttaa

SEQ ID NO: 659395 - DNA, 20 bp, Artificial
  CRISPR gRNA sequence
cctgtaaaatcacatttaaa

SEQ ID NO: 659396 - DNA, 20 bp, Artificial
  CRISPR gRNA sequence
taaaatcacatttaaaaata

SEQ ID NO: 659397 - DNA, 20 bp, Artificial
  CRISPR gRNA sequence
aaaaatatcaggcttccaag

SEQ ID NO: 659398 - DNA, 20 bp, Artificial
  CRISPR gRNA sequence
aaaatatcaggcttccaagt

SEQ ID NO: 659399 - DNA, 20 bp, Artificial
  CRISPR gRNA sequence
ccaagttcttttgtgtggct

SEQ ID NO: 659400 - DNA, 20 bp, Artificial
  CRISPR gRNA sequence
caagttcttttgtgtggctg

SEQ ID NO: 659401 - DNA, 20 bp, Artificial
  CRISPR gRNA sequence
ttttgtgtggctgtgtgtgt

SEQ ID NO: 659402 - DNA, 20 bp, Artificial
  CRISPR gRNA sequence
ttgtgtggctgtgtgtgtgt

SEQ ID NO: 659403 - DNA, 20 bp, Artificial
  CRISPR gRNA sequence
tgtgtggctgtgtgtgtgtg

SEQ ID NO: 659404 - DNA, 20 bp, Artificial
  CRISPR gRNA sequence
gtgtggctgtgtgtgtgtgt

SEQ ID NO: 659405 - DNA, 20 bp, Artificial
  CRISPR gRNA sequence
tgtggctgtgtgtgtgtgtg

SEQ ID NO: 659406 - DNA, 20 bp, Artificial
  CRISPR gRNA sequence
tgtgtgtgtgtgtgtgtgtg

SEQ ID NO: 659407 - DNA, 20 bp, Artificial
  CRISPR gRNA sequence
atctcactgaaaataatcct

SEQ ID NO: 659408 - DNA, 20 bp, Artificial
  CRISPR gRNA sequence
actgaaaataatccttgaat

SEQ ID NO: 659409 - DNA, 20 bp, Artificial
  CRISPR gRNA sequence
aaaataatccttgaatcagt

SEQ ID NO: 659410 - DNA, 20 bp, Artificial
  CRISPR gRNA sequence
gaatcagttacttaaaagtg

SEQ ID NO: 659411 - DNA, 20 bp, Artificial
  CRISPR gRNA sequence
aatcagttacttaaaagtga

SEQ ID NO: 659412 - DNA, 20 bp, Artificial
  CRISPR gRNA sequence
cttaaaagtgaccccaaagg

SEQ ID NO: 659413 - DNA, 20 bp, Artificial
  CRISPR gRNA sequence
aaaagtgaccccaaaggtca

SEQ ID NO: 659414 - DNA, 20 bp, Artificial
  CRISPR gRNA sequence
aaagtgaccccaaaggtcat

SEQ ID NO: 659415 - DNA, 20 bp, Artificial
  CRISPR gRNA sequence
agaacaacttccttaacaaa

SEQ ID NO: 659416 - DNA, 20 bp, Artificial
  CRISPR gRNA sequence
gaacaacttccttaacaaag

SEQ ID NO: 659417 - DNA, 20 bp, Artificial
  CRISPR gRNA sequence
ccttaacaaagcaagaatat

SEQ ID NO: 659418 - DNA, 20 bp, Artificial
  CRISPR gRNA sequence
cttaacaaagcaagaatatc

SEQ ID NO: 659419 - DNA, 20 bp, Artificial
  CRISPR gRNA sequence
aacaaagcaagaatatcctt

SEQ ID NO: 659420 - DNA, 20 bp, Artificial
  CRISPR gRNA sequence
acaaagcaagaatatccttg

SEQ ID NO: 659421 - DNA, 20 bp, Artificial
  CRISPR gRNA sequence
gacagcatgcatgacaggtg

SEQ ID NO: 659422 - DNA, 20 bp, Artificial
  CRISPR gRNA sequence
acagcatgcatgacaggtgg

SEQ ID NO: 659423 - DNA, 20 bp, Artificial
  CRISPR gRNA sequence
tgggattttgcttgactgct

SEQ ID NO: 659424 - DNA, 20 bp, Artificial
  CRISPR gRNA sequence
ggattttgcttgactgcttc

SEQ ID NO: 659425 - DNA, 20 bp, Artificial
  CRISPR gRNA sequence
tgcttgactgcttcaagtgc

SEQ ID NO: 659426 - DNA, 20 bp, Artificial
  CRISPR gRNA sequence
gcttgactgcttcaagtgct

SEQ ID NO: 659427 - DNA, 20 bp, Artificial
  CRISPR gRNA sequence
cttgactgcttcaagtgcta

SEQ ID NO: 659428 - DNA, 20 bp, Artificial
  CRISPR gRNA sequence
gactgcttcaagtgctagag

SEQ ID NO: 659429 - DNA, 20 bp, Artificial
  CRISPR gRNA sequence
actgcttcaagtgctagagg

SEQ ID NO: 659430 - DNA, 20 bp, Artificial
  CRISPR gRNA sequence
cttcaagtgctagaggaaag

SEQ ID NO: 659431 - DNA, 20 bp, Artificial
  CRISPR gRNA sequence
caagtgctagaggaaaggaa

SEQ ID NO: 659432 - DNA, 20 bp, Artificial
  CRISPR gRNA sequence
aagtgctagaggaaaggaag

SEQ ID NO: 659433 - DNA, 20 bp, Artificial
  CRISPR gRNA sequence
gaggaaaggaagtttactgt

SEQ ID NO: 659434 - DNA, 20 bp, Artificial
  CRISPR gRNA sequence
actgttccattgctgatcag

SEQ ID NO: 659435 - DNA, 20 bp, Artificial
  CRISPR gRNA sequence
ctgttccattgctgatcagc

SEQ ID NO: 659436 - DNA, 20 bp, Artificial
  CRISPR gRNA sequence
ttccattgctgatcagctct

SEQ ID NO: 659437 - DNA, 20 bp, Artificial
  CRISPR gRNA sequence
cattgctgatcagctctaat

SEQ ID NO: 659438 - DNA, 20 bp, Artificial
  CRISPR gRNA sequence
ctgatcagctctaattctta

SEQ ID NO: 659439 - DNA, 20 bp, Artificial
  CRISPR gRNA sequence
atcagctctaattcttagaa

SEQ ID NO: 659440 - DNA, 20 bp, Artificial
  CRISPR gRNA sequence
taattcttagaaagttcttc

SEQ ID NO: 659441 - DNA, 20 bp, Artificial
  CRISPR gRNA sequence
attcttagaaagttcttcct

SEQ ID NO: 659442 - DNA, 20 bp, Artificial
  CRISPR gRNA sequence
ttagaaagttcttccttata

SEQ ID NO: 659443 - DNA, 20 bp, Artificial
  CRISPR gRNA sequence
agaaagttcttccttatatt

SEQ ID NO: 659444 - DNA, 20 bp, Artificial
  CRISPR gRNA sequence
gaaagttcttccttatattg

SEQ ID NO: 659445 - DNA, 20 bp, Artificial
  CRISPR gRNA sequence
ttccttatattgagccctca

SEQ ID NO: 659446 - DNA, 20 bp, Artificial
  CRISPR gRNA sequence
ccttatattgagccctcatc

SEQ ID NO: 659447 - DNA, 20 bp, Artificial
  CRISPR gRNA sequence
cttatattgagccctcatct

SEQ ID NO: 659448 - DNA, 20 bp, Artificial
  CRISPR gRNA sequence
atattgagccctcatctgcc

SEQ ID NO: 659449 - DNA, 20 bp, Artificial
  CRISPR gRNA sequence
tattgagccctcatctgcct

SEQ ID NO: 659450 - DNA, 20 bp, Artificial
  CRISPR gRNA sequence
agccctcatctgcctgtctg

SEQ ID NO: 659451 - DNA, 20 bp, Artificial
  CRISPR gRNA sequence
atctgcctgtctgaaatgtc

SEQ ID NO: 659452 - DNA, 20 bp, Artificial
  CRISPR gRNA sequence
cctgtctgaaatgtcactgc

SEQ ID NO: 659453 - DNA, 20 bp, Artificial
  CRISPR gRNA sequence
tctgaaatgtcactgctttt

SEQ ID NO: 659454 - DNA, 20 bp, Artificial
  CRISPR gRNA sequence
aaatgtcactgctttttttt

SEQ ID NO: 659455 - DNA, 20 bp, Artificial
  CRISPR gRNA sequence
cttttttttttcactaagac

SEQ ID NO: 659456 - DNA, 20 bp, Artificial
  CRISPR gRNA sequence
ttttttttcactaagactca

SEQ ID NO: 659457 - DNA, 20 bp, Artificial
  CRISPR gRNA sequence
tttttttcactaagactcaa

SEQ ID NO: 659458 - DNA, 20 bp, Artificial
  CRISPR gRNA sequence
ttttttcactaagactcaag

SEQ ID NO: 659459 - DNA, 20 bp, Artificial
  CRISPR gRNA sequence
tttttcactaagactcaagc

SEQ ID NO: 659460 - DNA, 20 bp, Artificial
  CRISPR gRNA sequence
ttttcactaagactcaagct

SEQ ID NO: 659461 - DNA, 20 bp, Artificial
  CRISPR gRNA sequence
tttcactaagactcaagcta

SEQ ID NO: 659462 - DNA, 20 bp, Artificial
  CRISPR gRNA sequence
ttcactaagactcaagctaa

SEQ ID NO: 659463 - DNA, 20 bp, Artificial
  CRISPR gRNA sequence
tcactaagactcaagctaaa

SEQ ID NO: 659464 - DNA, 20 bp, Artificial
  CRISPR gRNA sequence
cactaagactcaagctaaat

SEQ ID NO: 659465 - DNA, 20 bp, Artificial
  CRISPR gRNA sequence
actaagactcaagctaaata

SEQ ID NO: 659466 - DNA, 20 bp, Artificial
  CRISPR gRNA sequence
agactcaagctaaatatctc

SEQ ID NO: 659467 - DNA, 20 bp, Artificial
  CRISPR gRNA sequence
aagctaaatatctcacaagt

SEQ ID NO: 659468 - DNA, 20 bp, Artificial
  CRISPR gRNA sequence
aatatctcacaagttttaga

SEQ ID NO: 659469 - DNA, 20 bp, Artificial
  CRISPR gRNA sequence
acaagttttagatgctttgt

SEQ ID NO: 659470 - DNA, 20 bp, Artificial
  CRISPR gRNA sequence
tagatgctttgttatgtatt

SEQ ID NO: 659471 - DNA, 20 bp, Artificial
  CRISPR gRNA sequence
agatgctttgttatgtatta

SEQ ID NO: 659472 - DNA, 20 bp, Artificial
  CRISPR gRNA sequence
gatgctttgttatgtattag

SEQ ID NO: 659473 - DNA, 20 bp, Artificial
  CRISPR gRNA sequence
tgttatgtattagtgcttgt

SEQ ID NO: 659474 - DNA, 20 bp, Artificial
  CRISPR gRNA sequence
gttatgtattagtgcttgta

SEQ ID NO: 659475 - DNA, 20 bp, Artificial
  CRISPR gRNA sequence
ttatgtattagtgcttgtag

SEQ ID NO: 659476 - DNA, 20 bp, Artificial
  CRISPR gRNA sequence
tgtattagtgcttgtagagc

SEQ ID NO: 659477 - DNA, 20 bp, Artificial
  CRISPR gRNA sequence
gtgcttgtagagcaggcttt

SEQ ID NO: 659478 - DNA, 20 bp, Artificial
  CRISPR gRNA sequence
gtagagcaggctttcatgta

SEQ ID NO: 659479 - DNA, 20 bp, Artificial
  CRISPR gRNA sequence
tagagcaggctttcatgtag

SEQ ID NO: 659480 - DNA, 20 bp, Artificial
  CRISPR gRNA sequence
tcatgtaggtttttagagtg

SEQ ID NO: 659481 - DNA, 20 bp, Artificial
  CRISPR gRNA sequence
catgtaggtttttagagtgt

SEQ ID NO: 659482 - DNA, 20 bp, Artificial
  CRISPR gRNA sequence
atgtaggtttttagagtgtt

SEQ ID NO: 659483 - DNA, 20 bp, Artificial
  CRISPR gRNA sequence
ttagagtgttttgcattggc

SEQ ID NO: 659484 - DNA, 20 bp, Artificial
  CRISPR gRNA sequence
tagagtgttttgcattggcc

SEQ ID NO: 659485 - DNA, 20 bp, Artificial
  CRISPR gRNA sequence
agagtgttttgcattggccc

SEQ ID NO: 659486 - DNA, 20 bp, Artificial
  CRISPR gRNA sequence
gagtgttttgcattggccct

SEQ ID NO: 659487 - DNA, 20 bp, Artificial
  CRISPR gRNA sequence
tgcattggcccttgtattta

SEQ ID NO: 659488 - DNA, 20 bp, Artificial
  CRISPR gRNA sequence
gcattggcccttgtatttag

SEQ ID NO: 659489 - DNA, 20 bp, Artificial
  CRISPR gRNA sequence
cattggcccttgtatttaga

SEQ ID NO: 659490 - DNA, 20 bp, Artificial
  CRISPR gRNA sequence
gcccttgtatttagaatact

SEQ ID NO: 659491 - DNA, 20 bp, Artificial
  CRISPR gRNA sequence
gtatttagaatactatcatc

SEQ ID NO: 659492 - DNA, 20 bp, Artificial
  CRISPR gRNA sequence
tatttagaatactatcatca

SEQ ID NO: 659493 - DNA, 20 bp, Artificial
  CRISPR gRNA sequence
agaatactatcatcatttct

SEQ ID NO: 659494 - DNA, 20 bp, Artificial
  CRISPR gRNA sequence
gaatactatcatcatttctt

SEQ ID NO: 659495 - DNA, 20 bp, Artificial
  CRISPR gRNA sequence
tcatcatttcttctgaggaa

SEQ ID NO: 659496 - DNA, 20 bp, Artificial
  CRISPR gRNA sequence
cttctgaggaatgatgctct

SEQ ID NO: 659497 - DNA, 20 bp, Artificial
  CRISPR gRNA sequence
ttctgaggaatgatgctcta

SEQ ID NO: 659498 - DNA, 20 bp, Artificial
  CRISPR gRNA sequence
ctgaggaatgatgctctagg

SEQ ID NO: 659499 - DNA, 20 bp, Artificial
  CRISPR gRNA sequence
tgaggaatgatgctctaggt

SEQ ID NO: 659500 - DNA, 20 bp, Artificial
  CRISPR gRNA sequence
aggaatgatgctctaggtgt

SEQ ID NO: 659501 - DNA, 20 bp, Artificial
  CRISPR gRNA sequence
taggtgtagtgcttaacata

SEQ ID NO: 659502 - DNA, 20 bp, Artificial
  CRISPR gRNA sequence
ggtgtagtgcttaacatata

SEQ ID NO: 659503 - DNA, 20 bp, Artificial
  CRISPR gRNA sequence
aacatatatattatgtcttt

SEQ ID NO: 659504 - DNA, 20 bp, Artificial
  CRISPR gRNA sequence
acatatatattatgtctttt

SEQ ID NO: 659505 - DNA, 20 bp, Artificial
  CRISPR gRNA sequence
tgtctttttccacctttgta

SEQ ID NO: 659506 - DNA, 20 bp, Artificial
  CRISPR gRNA sequence
tttccacctttgtaccaaca

SEQ ID NO: 659507 - DNA, 20 bp, Artificial
  CRISPR gRNA sequence
ttccacctttgtaccaacag

SEQ ID NO: 659508 - DNA, 20 bp, Artificial
  CRISPR gRNA sequence
tccacctttgtaccaacagc

SEQ ID NO: 659509 - DNA, 20 bp, Artificial
  CRISPR gRNA sequence
ccacctttgtaccaacagct

SEQ ID NO: 659510 - DNA, 20 bp, Artificial
  CRISPR gRNA sequence
cacctttgtaccaacagctg

SEQ ID NO: 659511 - DNA, 20 bp, Artificial
  CRISPR gRNA sequence
tgtaccaacagctgcaagta

SEQ ID NO: 659512 - DNA, 20 bp, Artificial
  CRISPR gRNA sequence
gtaccaacagctgcaagtaa

SEQ ID NO: 659513 - DNA, 20 bp, Artificial
  CRISPR gRNA sequence
taccaacagctgcaagtaaa

SEQ ID NO: 659514 - DNA, 20 bp, Artificial
  CRISPR gRNA sequence
caagtaaagcatgttaagta

SEQ ID NO: 659515 - DNA, 20 bp, Artificial
  CRISPR gRNA sequence
agtatggtaaataacaaaac

SEQ ID NO: 659516 - DNA, 20 bp, Artificial
  CRISPR gRNA sequence
aatttattttcaataacttg

SEQ ID NO: 659517 - DNA, 20 bp, Artificial
  CRISPR gRNA sequence
attttcaataacttgtatct

SEQ ID NO: 659518 - DNA, 20 bp, Artificial
  CRISPR gRNA sequence
ttttcaataacttgtatctt

SEQ ID NO: 659519 - DNA, 20 bp, Artificial
  CRISPR gRNA sequence
tcaataacttgtatcttatt

SEQ ID NO: 659520 - DNA, 20 bp, Artificial
  CRISPR gRNA sequence
caataacttgtatcttattg

SEQ ID NO: 659521 - DNA, 20 bp, Artificial
  CRISPR gRNA sequence
aataacttgtatcttattgt

SEQ ID NO: 659522 - DNA, 20 bp, Artificial
  CRISPR gRNA sequence
gtatcttattgttactttta

SEQ ID NO: 659523 - DNA, 20 bp, Artificial
  CRISPR gRNA sequence
tatcttattgttacttttaa

SEQ ID NO: 659524 - DNA, 20 bp, Artificial
  CRISPR gRNA sequence
attgttacttttaagcactt

SEQ ID NO: 659525 - DNA, 20 bp, Artificial
  CRISPR gRNA sequence
ttgttacttttaagcacttt

SEQ ID NO: 659526 - DNA, 20 bp, Artificial
  CRISPR gRNA sequence
ttacttttaagcactttact

SEQ ID NO: 659527 - DNA, 20 bp, Artificial
  CRISPR gRNA sequence
cttttaagcactttactctt

SEQ ID NO: 659528 - DNA, 20 bp, Artificial
  CRISPR gRNA sequence
ttaagcactttactctttta

SEQ ID NO: 659529 - DNA, 20 bp, Artificial
  CRISPR gRNA sequence
taagcactttactcttttaa

SEQ ID NO: 659530 - DNA, 20 bp, Artificial
  CRISPR gRNA sequence
aagcactttactcttttaat

SEQ ID NO: 659531 - DNA, 20 bp, Artificial
  CRISPR gRNA sequence
agcactttactcttttaatt

SEQ ID NO: 659532 - DNA, 20 bp, Artificial
  CRISPR gRNA sequence
tactcttttaatttatttat

SEQ ID NO: 659533 - DNA, 20 bp, Artificial
  CRISPR gRNA sequence
actcttttaatttatttatt

SEQ ID NO: 659534 - DNA, 20 bp, Artificial
  CRISPR gRNA sequence
ctcttttaatttatttattt

SEQ ID NO: 659535 - DNA, 20 bp, Artificial
  CRISPR gRNA sequence
ttttaatttatttatttatt

SEQ ID NO: 659536 - DNA, 20 bp, Artificial
  CRISPR gRNA sequence
ttaatttatttatttatttt

SEQ ID NO: 659537 - DNA, 20 bp, Artificial
  CRISPR gRNA sequence
taatttatttatttatttta

SEQ ID NO: 659538 - DNA, 20 bp, Artificial
  CRISPR gRNA sequence
aatttatttatttattttat

SEQ ID NO: 659539 - DNA, 20 bp, Artificial
  CRISPR gRNA sequence
atttatttatttattttatt

SEQ ID NO: 659540 - DNA, 20 bp, Artificial
  CRISPR gRNA sequence
atttatttattttattatta

SEQ ID NO: 659541 - DNA, 20 bp, Artificial
  CRISPR gRNA sequence
tttatttattttattattat

SEQ ID NO: 659542 - DNA, 20 bp, Artificial
  CRISPR gRNA sequence
atttattttattattatact

SEQ ID NO: 659543 - DNA, 20 bp, Artificial
  CRISPR gRNA sequence
tttattttattattatactt

SEQ ID NO: 659544 - DNA, 20 bp, Artificial
  CRISPR gRNA sequence
attttattattatactttaa

SEQ ID NO: 659545 - DNA, 20 bp, Artificial
  CRISPR gRNA sequence
ttttattattatactttaag

SEQ ID NO: 659546 - DNA, 20 bp, Artificial
  CRISPR gRNA sequence
tattattatactttaagttc

SEQ ID NO: 659547 - DNA, 20 bp, Artificial
  CRISPR gRNA sequence
attattatactttaagttct

SEQ ID NO: 659548 - DNA, 20 bp, Artificial
  CRISPR gRNA sequence
ttattatactttaagttcta

SEQ ID NO: 659549 - DNA, 20 bp, Artificial
  CRISPR gRNA sequence
ttatactttaagttctaggg

SEQ ID NO: 659550 - DNA, 20 bp, Artificial
  CRISPR gRNA sequence
tactttaagttctagggtac

SEQ ID NO: 659551 - DNA, 20 bp, Artificial
  CRISPR gRNA sequence
taagttctagggtacatgtg

SEQ ID NO: 659552 - DNA, 20 bp, Artificial
  CRISPR gRNA sequence
aagttctagggtacatgtgc

SEQ ID NO: 659553 - DNA, 20 bp, Artificial
  CRISPR gRNA sequence
agttctagggtacatgtgca

SEQ ID NO: 659554 - DNA, 20 bp, Artificial
  CRISPR gRNA sequence
tagggtacatgtgcacaaca

SEQ ID NO: 659555 - DNA, 20 bp, Artificial
  CRISPR gRNA sequence
gggtacatgtgcacaacaag

SEQ ID NO: 659556 - DNA, 20 bp, Artificial
  CRISPR gRNA sequence
gttacatatgtttacatgtg

SEQ ID NO: 659557 - DNA, 20 bp, Artificial
  CRISPR gRNA sequence
ttacatatgtttacatgtgc

SEQ ID NO: 659558 - DNA, 20 bp, Artificial
  CRISPR gRNA sequence
catatgtttacatgtgccat

SEQ ID NO: 659559 - DNA, 20 bp, Artificial
  CRISPR gRNA sequence
acatgtgccatgttggtgtg

SEQ ID NO: 659560 - DNA, 20 bp, Artificial
  CRISPR gRNA sequence
catgtgccatgttggtgtgc

SEQ ID NO: 659561 - DNA, 20 bp, Artificial
  CRISPR gRNA sequence
gtgtgctgcacctattaact

SEQ ID NO: 659562 - DNA, 20 bp, Artificial
  CRISPR gRNA sequence
cacctattaacttgtcattt

SEQ ID NO: 659563 - DNA, 20 bp, Artificial
  CRISPR gRNA sequence
ttaacttgtcatttacatta

SEQ ID NO: 659564 - DNA, 20 bp, Artificial
  CRISPR gRNA sequence
acttgtcatttacattaggt

SEQ ID NO: 659565 - DNA, 20 bp, Artificial
  CRISPR gRNA sequence
gtcatttacattaggtatat

SEQ ID NO: 659566 - DNA, 20 bp, Artificial
  CRISPR gRNA sequence
tcatttacattaggtatatc

SEQ ID NO: 659567 - DNA, 20 bp, Artificial
  CRISPR gRNA sequence
acattaggtatatcctttta

SEQ ID NO: 659568 - DNA, 20 bp, Artificial
  CRISPR gRNA sequence
cattaggtatatccttttaa

SEQ ID NO: 659569 - DNA, 20 bp, Artificial
  CRISPR gRNA sequence
ggtatatccttttaagtctt

SEQ ID NO: 659570 - DNA, 20 bp, Artificial
  CRISPR gRNA sequence
ttaagtcttttattcgacaa

SEQ ID NO: 659571 - DNA, 20 bp, Artificial
  CRISPR gRNA sequence
taagtcttttattcgacaat

SEQ ID NO: 659572 - DNA, 20 bp, Artificial
  CRISPR gRNA sequence
aagtcttttattcgacaatt

SEQ ID NO: 659573 - DNA, 20 bp, Artificial
  CRISPR gRNA sequence
agtcttttattcgacaattc

SEQ ID NO: 659574 - DNA, 20 bp, Artificial
  CRISPR gRNA sequence
ttattcgacaattcaaataa

SEQ ID NO: 659575 - DNA, 20 bp, Artificial
  CRISPR gRNA sequence
tattcgacaattcaaataac

SEQ ID NO: 659576 - DNA, 20 bp, Artificial
  CRISPR gRNA sequence
attcgacaattcaaataact

SEQ ID NO: 659577 - DNA, 20 bp, Artificial
  CRISPR gRNA sequence
ttcgacaattcaaataactt

SEQ ID NO: 659578 - DNA, 20 bp, Artificial
  CRISPR gRNA sequence
gacaattcaaataacttatg

SEQ ID NO: 659579 - DNA, 20 bp, Artificial
  CRISPR gRNA sequence
aaataacttatggttaaaat

SEQ ID NO: 659580 - DNA, 20 bp, Artificial
  CRISPR gRNA sequence
atggttaaaataaaattttg

SEQ ID NO: 659581 - DNA, 20 bp, Artificial
  CRISPR gRNA sequence
tggttaaaataaaattttgt

SEQ ID NO: 659582 - DNA, 20 bp, Artificial
  CRISPR gRNA sequence
aaataaaattttgtacaaaa

SEQ ID NO: 659583 - DNA, 20 bp, Artificial
  CRISPR gRNA sequence
tgtacaaaaactatgcctat

SEQ ID NO: 659584 - DNA, 20 bp, Artificial
  CRISPR gRNA sequence
gtacaaaaactatgcctatt

SEQ ID NO: 659585 - DNA, 20 bp, Artificial
  CRISPR gRNA sequence
tacaaaaactatgcctattt

SEQ ID NO: 659586 - DNA, 20 bp, Artificial
  CRISPR gRNA sequence
tgcctattttggaaacagaa

SEQ ID NO: 659587 - DNA, 20 bp, Artificial
  CRISPR gRNA sequence
ttttggaaacagaaatccat

SEQ ID NO: 659588 - DNA, 20 bp, Artificial
  CRISPR gRNA sequence
tggaaacagaaatccattgc

SEQ ID NO: 659589 - DNA, 20 bp, Artificial
  CRISPR gRNA sequence
ggaaacagaaatccattgct

SEQ ID NO: 659590 - DNA, 20 bp, Artificial
  CRISPR gRNA sequence
gaaacagaaatccattgctt

SEQ ID NO: 659591 - DNA, 20 bp, Artificial
  CRISPR gRNA sequence
cttatgtttccatttacata

SEQ ID NO: 659592 - DNA, 20 bp, Artificial
  CRISPR gRNA sequence
atgtttccatttacatatac

SEQ ID NO: 659593 - DNA, 20 bp, Artificial
  CRISPR gRNA sequence
tgtttccatttacatataca

SEQ ID NO: 659594 - DNA, 20 bp, Artificial
  CRISPR gRNA sequence
ccatttacatatacaatttt

SEQ ID NO: 659595 - DNA, 20 bp, Artificial
  CRISPR gRNA sequence
catttacatatacaattttg

SEQ ID NO: 659596 - DNA, 20 bp, Artificial
  CRISPR gRNA sequence
acatatacaattttgacttt

SEQ ID NO: 659597 - DNA, 20 bp, Artificial
  CRISPR gRNA sequence
catatacaattttgactttg

SEQ ID NO: 659598 - DNA, 20 bp, Artificial
  CRISPR gRNA sequence
tgactttgtgcatagaattt

SEQ ID NO: 659599 - DNA, 20 bp, Artificial
  CRISPR gRNA sequence
gactttgtgcatagaatttt

SEQ ID NO: 659600 - DNA, 20 bp, Artificial
  CRISPR gRNA sequence
actttgtgcatagaattttg

SEQ ID NO: 659601 - DNA, 20 bp, Artificial
  CRISPR gRNA sequence
tgtgcatagaattttgagca

SEQ ID NO: 659602 - DNA, 20 bp, Artificial
  CRISPR gRNA sequence
gtgcatagaattttgagcag

SEQ ID NO: 659603 - DNA, 20 bp, Artificial
  CRISPR gRNA sequence
tgcatagaattttgagcaga

SEQ ID NO: 659604 - DNA, 20 bp, Artificial
  CRISPR gRNA sequence
tgagcagatactataaaacc

SEQ ID NO: 659605 - DNA, 20 bp, Artificial
  CRISPR gRNA sequence
gagcagatactataaaacct

SEQ ID NO: 659606 - DNA, 20 bp, Artificial
  CRISPR gRNA sequence
agcagatactataaaacctg

SEQ ID NO: 659607 - DNA, 20 bp, Artificial
  CRISPR gRNA sequence
taaaacctgatgctttgagg

SEQ ID NO: 659608 - DNA, 20 bp, Artificial
  CRISPR gRNA sequence
atgctttgaggcttaaaagt

SEQ ID NO: 659609 - DNA, 20 bp, Artificial
  CRISPR gRNA sequence
tgaggcttaaaagtaggaca

SEQ ID NO: 659610 - DNA, 20 bp, Artificial
  CRISPR gRNA sequence
gaggcttaaaagtaggacat

SEQ ID NO: 659611 - DNA, 20 bp, Artificial
  CRISPR gRNA sequence
aggcttaaaagtaggacata

SEQ ID NO: 659612 - DNA, 20 bp, Artificial
  CRISPR gRNA sequence
aaaagtaggacataaagtga

SEQ ID NO: 659613 - DNA, 20 bp, Artificial
  CRISPR gRNA sequence
aaagtaggacataaagtgaa

SEQ ID NO: 659614 - DNA, 20 bp, Artificial
  CRISPR gRNA sequence
tagggagatgttacaaaact

SEQ ID NO: 659615 - DNA, 20 bp, Artificial
  CRISPR gRNA sequence
caaaactcacatgaaggaag

SEQ ID NO: 659616 - DNA, 20 bp, Artificial
  CRISPR gRNA sequence
acatgaaggaagtatgatca

SEQ ID NO: 659617 - DNA, 20 bp, Artificial
  CRISPR gRNA sequence
tcaggattttactttgctta

SEQ ID NO: 659618 - DNA, 20 bp, Artificial
  CRISPR gRNA sequence
caggattttactttgcttag

SEQ ID NO: 659619 - DNA, 20 bp, Artificial
  CRISPR gRNA sequence
aggattttactttgcttagg

SEQ ID NO: 659620 - DNA, 20 bp, Artificial
  CRISPR gRNA sequence
tactttgcttaggttgtgga

SEQ ID NO: 659621 - DNA, 20 bp, Artificial
  CRISPR gRNA sequence
actttgcttaggttgtggaa

SEQ ID NO: 659622 - DNA, 20 bp, Artificial
  CRISPR gRNA sequence
ctttgcttaggttgtggaaa

SEQ ID NO: 659623 - DNA, 20 bp, Artificial
  CRISPR gRNA sequence
tgcttaggttgtggaaattc

SEQ ID NO: 659624 - DNA, 20 bp, Artificial
  CRISPR gRNA sequence
gcttaggttgtggaaattca

SEQ ID NO: 659625 - DNA, 20 bp, Artificial
  CRISPR gRNA sequence
cttaggttgtggaaattcat

SEQ ID NO: 659626 - DNA, 20 bp, Artificial
  CRISPR gRNA sequence
aggttgtggaaattcatcac

SEQ ID NO: 659627 - DNA, 20 bp, Artificial
  CRISPR gRNA sequence
ggttgtggaaattcatcacg

SEQ ID NO: 659628 - DNA, 20 bp, Artificial
  CRISPR gRNA sequence
tggaaattcatcacggtttt

SEQ ID NO: 659629 - DNA, 20 bp, Artificial
  CRISPR gRNA sequence
atcacggttttccagctgac

SEQ ID NO: 659630 - DNA, 20 bp, Artificial
  CRISPR gRNA sequence
tccagctgacatttcttaag

SEQ ID NO: 659631 - DNA, 20 bp, Artificial
  CRISPR gRNA sequence
ccagctgacatttcttaaga

SEQ ID NO: 659632 - DNA, 20 bp, Artificial
  CRISPR gRNA sequence
cagctgacatttcttaagaa

SEQ ID NO: 659633 - DNA, 20 bp, Artificial
  CRISPR gRNA sequence
acatttcttaagaaagattc

SEQ ID NO: 659634 - DNA, 20 bp, Artificial
  CRISPR gRNA sequence
cttaagaaagattcctaggt

SEQ ID NO: 659635 - DNA, 20 bp, Artificial
  CRISPR gRNA sequence
ttaagaaagattcctaggtg

SEQ ID NO: 659636 - DNA, 20 bp, Artificial
  CRISPR gRNA sequence
aagaaagattcctaggtgaa

SEQ ID NO: 659637 - DNA, 20 bp, Artificial
  CRISPR gRNA sequence
agaaagattcctaggtgaaa

SEQ ID NO: 659638 - DNA, 20 bp, Artificial
  CRISPR gRNA sequence
ctaggtgaaaaagataatat

SEQ ID NO: 659639 - DNA, 20 bp, Artificial
  CRISPR gRNA sequence
ggtgaaaaagataatatgga

SEQ ID NO: 659640 - DNA, 20 bp, Artificial
  CRISPR gRNA sequence
ctgaaagtggttgtaggcat

SEQ ID NO: 659641 - DNA, 20 bp, Artificial
  CRISPR gRNA sequence
aaagtggttgtaggcatcca

SEQ ID NO: 659642 - DNA, 20 bp, Artificial
  CRISPR gRNA sequence
taggcatccacatttcttcc

SEQ ID NO: 659643 - DNA, 20 bp, Artificial
  CRISPR gRNA sequence
cttcctctgaggatattagc

SEQ ID NO: 659644 - DNA, 20 bp, Artificial
  CRISPR gRNA sequence
ttcctctgaggatattagca

SEQ ID NO: 659645 - DNA, 20 bp, Artificial
  CRISPR gRNA sequence
cctctgaggatattagcaac

SEQ ID NO: 659646 - DNA, 20 bp, Artificial
  CRISPR gRNA sequence
ctctgaggatattagcaaca

SEQ ID NO: 659647 - DNA, 20 bp, Artificial
  CRISPR gRNA sequence
tgaggatattagcaacactt

SEQ ID NO: 659648 - DNA, 20 bp, Artificial
  CRISPR gRNA sequence
aggatattagcaacacttga

SEQ ID NO: 659649 - DNA, 20 bp, Artificial
  CRISPR gRNA sequence
gcaacacttgaattagctta

SEQ ID NO: 659650 - DNA, 20 bp, Artificial
  CRISPR gRNA sequence
gaattagcttatgacttctt

SEQ ID NO: 659651 - DNA, 20 bp, Artificial
  CRISPR gRNA sequence
aattagcttatgacttctta

SEQ ID NO: 659652 - DNA, 20 bp, Artificial
  CRISPR gRNA sequence
gcttatgacttcttatttct

SEQ ID NO: 659653 - DNA, 20 bp, Artificial
  CRISPR gRNA sequence
atgacttcttatttctccct

SEQ ID NO: 659654 - DNA, 20 bp, Artificial
  CRISPR gRNA sequence
tgacttcttatttctccctt

SEQ ID NO: 659655 - DNA, 20 bp, Artificial
  CRISPR gRNA sequence
cttatttctcccttgcctga

SEQ ID NO: 659656 - DNA, 20 bp, Artificial
  CRISPR gRNA sequence
ttatttctcccttgcctgag

SEQ ID NO: 659657 - DNA, 20 bp, Artificial
  CRISPR gRNA sequence
atttctcccttgcctgagtg

SEQ ID NO: 659658 - DNA, 20 bp, Artificial
  CRISPR gRNA sequence
tttctcccttgcctgagtgg

SEQ ID NO: 659659 - DNA, 20 bp, Artificial
  CRISPR gRNA sequence
ctcccttgcctgagtggcag

SEQ ID NO: 659660 - DNA, 20 bp, Artificial
  CRISPR gRNA sequence
tcccttgcctgagtggcagt

SEQ ID NO: 659661 - DNA, 20 bp, Artificial
  CRISPR gRNA sequence
ccttgcctgagtggcagttt

SEQ ID NO: 659662 - DNA, 20 bp, Artificial
  CRISPR gRNA sequence
gcctgagtggcagttttact

SEQ ID NO: 659663 - DNA, 20 bp, Artificial
  CRISPR gRNA sequence
cctgagtggcagttttactg

SEQ ID NO: 659664 - DNA, 20 bp, Artificial
  CRISPR gRNA sequence
agtggcagttttactgtgcc

SEQ ID NO: 659665 - DNA, 20 bp, Artificial
  CRISPR gRNA sequence
tactgtgcctttattggatt

SEQ ID NO: 659666 - DNA, 20 bp, Artificial
  CRISPR gRNA sequence
actgtgcctttattggattt

SEQ ID NO: 659667 - DNA, 20 bp, Artificial
  CRISPR gRNA sequence
ctgtgcctttattggattta

SEQ ID NO: 659668 - DNA, 20 bp, Artificial
  CRISPR gRNA sequence
tgcctttattggatttactg

SEQ ID NO: 659669 - DNA, 20 bp, Artificial
  CRISPR gRNA sequence
tattggatttactgttgtaa

SEQ ID NO: 659670 - DNA, 20 bp, Artificial
  CRISPR gRNA sequence
attggatttactgttgtaat

SEQ ID NO: 659671 - DNA, 20 bp, Artificial
  CRISPR gRNA sequence
ttggatttactgttgtaatt

SEQ ID NO: 659672 - DNA, 20 bp, Artificial
  CRISPR gRNA sequence
gatttactgttgtaattgga

SEQ ID NO: 659673 - DNA, 20 bp, Artificial
  CRISPR gRNA sequence
actgttgtaattggatatgg

SEQ ID NO: 659674 - DNA, 20 bp, Artificial
  CRISPR gRNA sequence
ctgttgtaattggatatgga

SEQ ID NO: 659675 - DNA, 20 bp, Artificial
  CRISPR gRNA sequence
ttgtaattggatatggaatt

SEQ ID NO: 659676 - DNA, 20 bp, Artificial
  CRISPR gRNA sequence
taattggatatggaattgtg

SEQ ID NO: 659677 - DNA, 20 bp, Artificial
  CRISPR gRNA sequence
gatatggaattgtgccggga

SEQ ID NO: 659678 - DNA, 20 bp, Artificial
  CRISPR gRNA sequence
tgccgggaagcatatatttc

SEQ ID NO: 659679 - DNA, 20 bp, Artificial
  CRISPR gRNA sequence
caatatgtgcaccttagcaa

SEQ ID NO: 659680 - DNA, 20 bp, Artificial
  CRISPR gRNA sequence
aatatgtgcaccttagcaat

SEQ ID NO: 659681 - DNA, 20 bp, Artificial
  CRISPR gRNA sequence
agcaatctaaatcgttagga

SEQ ID NO: 659682 - DNA, 20 bp, Artificial
  CRISPR gRNA sequence
gcaatctaaatcgttaggat

SEQ ID NO: 659683 - DNA, 20 bp, Artificial
  CRISPR gRNA sequence
aatcgttaggatggtgactc

SEQ ID NO: 659684 - DNA, 20 bp, Artificial
  CRISPR gRNA sequence
ggatggtgactcactcacat

SEQ ID NO: 659685 - DNA, 20 bp, Artificial
  CRISPR gRNA sequence
actcacatttaacagggaaa

SEQ ID NO: 659686 - DNA, 20 bp, Artificial
  CRISPR gRNA sequence
acatttaacagggaaattag

SEQ ID NO: 659687 - DNA, 20 bp, Artificial
  CRISPR gRNA sequence
aacagggaaattagctggct

SEQ ID NO: 659688 - DNA, 20 bp, Artificial
  CRISPR gRNA sequence
acagggaaattagctggctt

SEQ ID NO: 659689 - DNA, 20 bp, Artificial
  CRISPR gRNA sequence
gctggcttcgtctttgtgtg

SEQ ID NO: 659690 - DNA, 20 bp, Artificial
  CRISPR gRNA sequence
gcttcgtctttgtgtgaaca

SEQ ID NO: 659691 - DNA, 20 bp, Artificial
  CRISPR gRNA sequence
cgtctttgtgtgaacatttg

SEQ ID NO: 659692 - DNA, 20 bp, Artificial
  CRISPR gRNA sequence
gtctttgtgtgaacatttga

SEQ ID NO: 659693 - DNA, 20 bp, Artificial
  CRISPR gRNA sequence
tgtgtgaacatttgaggagg

SEQ ID NO: 659694 - DNA, 20 bp, Artificial
  CRISPR gRNA sequence
gtgtgaacatttgaggagga

SEQ ID NO: 659695 - DNA, 20 bp, Artificial
  CRISPR gRNA sequence
tgtgaacatttgaggaggag

SEQ ID NO: 659696 - DNA, 20 bp, Artificial
  CRISPR gRNA sequence
gaggaggagctgaccctagc

SEQ ID NO: 659697 - DNA, 20 bp, Artificial
  CRISPR gRNA sequence
aggaggagctgaccctagct

SEQ ID NO: 659698 - DNA, 20 bp, Artificial
  CRISPR gRNA sequence
accctagctgcagaaatatc

SEQ ID NO: 659699 - DNA, 20 bp, Artificial
  CRISPR gRNA sequence
gctgcagaaatatcacgtgt

SEQ ID NO: 659700 - DNA, 20 bp, Artificial
  CRISPR gRNA sequence
cagaaatatcacgtgttcca

SEQ ID NO: 659701 - DNA, 20 bp, Artificial
  CRISPR gRNA sequence
caggtcacctgtggcaaaat

SEQ ID NO: 659702 - DNA, 20 bp, Artificial
  CRISPR gRNA sequence
tggcaaaatctagccatgtg

SEQ ID NO: 659703 - DNA, 20 bp, Artificial
  CRISPR gRNA sequence
gccatgtgaaggattggagt

SEQ ID NO: 659704 - DNA, 20 bp, Artificial
  CRISPR gRNA sequence
gagtttcttttgattatcta

SEQ ID NO: 659705 - DNA, 20 bp, Artificial
  CRISPR gRNA sequence
cttttgattatctaggctag

SEQ ID NO: 659706 - DNA, 20 bp, Artificial
  CRISPR gRNA sequence
ttttgattatctaggctaga

SEQ ID NO: 659707 - DNA, 20 bp, Artificial
  CRISPR gRNA sequence
ttgattatctaggctagatt

SEQ ID NO: 659708 - DNA, 20 bp, Artificial
  CRISPR gRNA sequence
tgattatctaggctagattt

SEQ ID NO: 659709 - DNA, 20 bp, Artificial
  CRISPR gRNA sequence
gattatctaggctagatttt

SEQ ID NO: 659710 - DNA, 20 bp, Artificial
  CRISPR gRNA sequence
attatctaggctagattttg

SEQ ID NO: 659711 - DNA, 20 bp, Artificial
  CRISPR gRNA sequence
tctaggctagattttgtcat

SEQ ID NO: 659712 - DNA, 20 bp, Artificial
  CRISPR gRNA sequence
ggctagattttgtcatccac

SEQ ID NO: 659713 - DNA, 20 bp, Artificial
  CRISPR gRNA sequence
gattttgtcatccacctctt

SEQ ID NO: 659714 - DNA, 20 bp, Artificial
  CRISPR gRNA sequence
tgtcatccacctctttactt

SEQ ID NO: 659715 - DNA, 20 bp, Artificial
  CRISPR gRNA sequence
gtcatccacctctttacttt

SEQ ID NO: 659716 - DNA, 20 bp, Artificial
  CRISPR gRNA sequence
tcatccacctctttacttta

SEQ ID NO: 659717 - DNA, 20 bp, Artificial
  CRISPR gRNA sequence
tttactttagtttggagaat

SEQ ID NO: 659718 - DNA, 20 bp, Artificial
  CRISPR gRNA sequence
tactttagtttggagaatta

SEQ ID NO: 659719 - DNA, 20 bp, Artificial
  CRISPR gRNA sequence
actttagtttggagaattat

SEQ ID NO: 659720 - DNA, 20 bp, Artificial
  CRISPR gRNA sequence
ctttagtttggagaattatt

SEQ ID NO: 659721 - DNA, 20 bp, Artificial
  CRISPR gRNA sequence
tagtttggagaattatttaa

SEQ ID NO: 659722 - DNA, 20 bp, Artificial
  CRISPR gRNA sequence
agtttggagaattatttaag

SEQ ID NO: 659723 - DNA, 20 bp, Artificial
  CRISPR gRNA sequence
gtttggagaattatttaagt

SEQ ID NO: 659724 - DNA, 20 bp, Artificial
  CRISPR gRNA sequence
ggagaattatttaagtagga

SEQ ID NO: 659725 - DNA, 20 bp, Artificial
  CRISPR gRNA sequence
gagaattatttaagtaggag

SEQ ID NO: 659726 - DNA, 20 bp, Artificial
  CRISPR gRNA sequence
tttaagtaggagaatcactg

SEQ ID NO: 659727 - DNA, 20 bp, Artificial
  CRISPR gRNA sequence
aagtaggagaatcactggct

SEQ ID NO: 659728 - DNA, 20 bp, Artificial
  CRISPR gRNA sequence
agtaggagaatcactggctg

SEQ ID NO: 659729 - DNA, 20 bp, Artificial
  CRISPR gRNA sequence
gctgagaaatgattggatat

SEQ ID NO: 659730 - DNA, 20 bp, Artificial
  CRISPR gRNA sequence
agaaatgattggatataaat

SEQ ID NO: 659731 - DNA, 20 bp, Artificial
  CRISPR gRNA sequence
gatataaatttaagagctat

SEQ ID NO: 659732 - DNA, 20 bp, Artificial
  CRISPR gRNA sequence
aagagctatgttagcccatt

SEQ ID NO: 659733 - DNA, 20 bp, Artificial
  CRISPR gRNA sequence
agagctatgttagcccattt

SEQ ID NO: 659734 - DNA, 20 bp, Artificial
  CRISPR gRNA sequence
tgttagcccatttaattatg

SEQ ID NO: 659735 - DNA, 20 bp, Artificial
  CRISPR gRNA sequence
gcccatttaattatgtcact

SEQ ID NO: 659736 - DNA, 20 bp, Artificial
  CRISPR gRNA sequence
aattatgtcactgcagattt

SEQ ID NO: 659737 - DNA, 20 bp, Artificial
  CRISPR gRNA sequence
attatgtcactgcagatttg

SEQ ID NO: 659738 - DNA, 20 bp, Artificial
  CRISPR gRNA sequence
tgtcactgcagatttggtaa

SEQ ID NO: 659739 - DNA, 20 bp, Artificial
  CRISPR gRNA sequence
cagatttggtaagagtgttt

SEQ ID NO: 659740 - DNA, 20 bp, Artificial
  CRISPR gRNA sequence
ggtaagagtgtttcagcaag

SEQ ID NO: 659741 - DNA, 20 bp, Artificial
  CRISPR gRNA sequence
gtaagagtgtttcagcaagg

SEQ ID NO: 659742 - DNA, 20 bp, Artificial
  CRISPR gRNA sequence
cagcaaggtcacgtagtact

SEQ ID NO: 659743 - DNA, 20 bp, Artificial
  CRISPR gRNA sequence
agcaaggtcacgtagtactt

SEQ ID NO: 659744 - DNA, 20 bp, Artificial
  CRISPR gRNA sequence
ttctggtctgccatcatggc

SEQ ID NO: 659745 - DNA, 20 bp, Artificial
  CRISPR gRNA sequence
tctggtctgccatcatggca

SEQ ID NO: 659746 - DNA, 20 bp, Artificial
  CRISPR gRNA sequence
ctggtctgccatcatggcaa

SEQ ID NO: 659747 - DNA, 20 bp, Artificial
  CRISPR gRNA sequence
tggtctgccatcatggcaag

SEQ ID NO: 659748 - DNA, 20 bp, Artificial
  CRISPR gRNA sequence
gtctgccatcatggcaagag

SEQ ID NO: 659749 - DNA, 20 bp, Artificial
  CRISPR gRNA sequence
ccatcatggcaagagacatt

SEQ ID NO: 659750 - DNA, 20 bp, Artificial
  CRISPR gRNA sequence
tgaaattcttaggaaagaat

SEQ ID NO: 659751 - DNA, 20 bp, Artificial
  CRISPR gRNA sequence
ttaggaaagaataatcctta

SEQ ID NO: 659752 - DNA, 20 bp, Artificial
  CRISPR gRNA sequence
aggaaagaataatccttaaa

SEQ ID NO: 659753 - DNA, 20 bp, Artificial
  CRISPR gRNA sequence
ggaaagaataatccttaaaa

SEQ ID NO: 659754 - DNA, 20 bp, Artificial
  CRISPR gRNA sequence
aaaaccaatttatttttaaa

SEQ ID NO: 659755 - DNA, 20 bp, Artificial
  CRISPR gRNA sequence
aaaccaatttatttttaaaa

SEQ ID NO: 659756 - DNA, 20 bp, Artificial
  CRISPR gRNA sequence
atttttaaaatagttatgtc

SEQ ID NO: 659757 - DNA, 20 bp, Artificial
  CRISPR gRNA sequence
tttttaaaatagttatgtca

SEQ ID NO: 659758 - DNA, 20 bp, Artificial
  CRISPR gRNA sequence
ttaaaatagttatgtcatag

SEQ ID NO: 659759 - DNA, 20 bp, Artificial
  CRISPR gRNA sequence
taaaatagttatgtcatagg

SEQ ID NO: 659760 - DNA, 20 bp, Artificial
  CRISPR gRNA sequence
aaaatagttatgtcataggg

SEQ ID NO: 659761 - DNA, 20 bp, Artificial
  CRISPR gRNA sequence
aaatagttatgtcatagggt

SEQ ID NO: 659762 - DNA, 20 bp, Artificial
  CRISPR gRNA sequence
tgtcatagggtctttttctc

SEQ ID NO: 659763 - DNA, 20 bp, Artificial
  CRISPR gRNA sequence
tttctcaaacttgcttgatc

SEQ ID NO: 659764 - DNA, 20 bp, Artificial
  CRISPR gRNA sequence
ttctcaaacttgcttgatcg

SEQ ID NO: 659765 - DNA, 20 bp, Artificial
  CRISPR gRNA sequence
tctcaaacttgcttgatcgt

SEQ ID NO: 659766 - DNA, 20 bp, Artificial
  CRISPR gRNA sequence
ctcaaacttgcttgatcgta

SEQ ID NO: 659767 - DNA, 20 bp, Artificial
  CRISPR gRNA sequence
tcaaacttgcttgatcgtaa

SEQ ID NO: 659768 - DNA, 20 bp, Artificial
  CRISPR gRNA sequence
aaacttgcttgatcgtaaga

SEQ ID NO: 659769 - DNA, 20 bp, Artificial
  CRISPR gRNA sequence
gcttgatcgtaagaatcatc

SEQ ID NO: 659770 - DNA, 20 bp, Artificial
  CRISPR gRNA sequence
cttgatcgtaagaatcatct

SEQ ID NO: 659771 - DNA, 20 bp, Artificial
  CRISPR gRNA sequence
gatcgtaagaatcatctaag

SEQ ID NO: 659772 - DNA, 20 bp, Artificial
  CRISPR gRNA sequence
atcgtaagaatcatctaaga

SEQ ID NO: 659773 - DNA, 20 bp, Artificial
  CRISPR gRNA sequence
agatacttgaaaaaaataaa

SEQ ID NO: 659774 - DNA, 20 bp, Artificial
  CRISPR gRNA sequence
gaaaaaaataaacagtccca

SEQ ID NO: 659775 - DNA, 20 bp, Artificial
  CRISPR gRNA sequence
aaaaaaataaacagtcccag

SEQ ID NO: 659776 - DNA, 20 bp, Artificial
  CRISPR gRNA sequence
aactcaagtatactgaatca

SEQ ID NO: 659777 - DNA, 20 bp, Artificial
  CRISPR gRNA sequence
aagtatactgaatcaaacaa

SEQ ID NO: 659778 - DNA, 20 bp, Artificial
  CRISPR gRNA sequence
aatcaaacaaagtgttcaag

SEQ ID NO: 659779 - DNA, 20 bp, Artificial
  CRISPR gRNA sequence
aagggaggaggagcctgcga

SEQ ID NO: 659780 - DNA, 20 bp, Artificial
  CRISPR gRNA sequence
cgactctaattctgataatc

SEQ ID NO: 659781 - DNA, 20 bp, Artificial
  CRISPR gRNA sequence
taattctgataatcaggcaa

SEQ ID NO: 659782 - DNA, 20 bp, Artificial
  CRISPR gRNA sequence
attctgataatcaggcaagt

SEQ ID NO: 659783 - DNA, 20 bp, Artificial
  CRISPR gRNA sequence
tgataatcaggcaagtttag

SEQ ID NO: 659784 - DNA, 20 bp, Artificial
  CRISPR gRNA sequence
ataatcaggcaagtttagga

SEQ ID NO: 659785 - DNA, 20 bp, Artificial
  CRISPR gRNA sequence
aggaaatactgtcagatagt

SEQ ID NO: 659786 - DNA, 20 bp, Artificial
  CRISPR gRNA sequence
ggaaatactgtcagatagta

SEQ ID NO: 659787 - DNA, 20 bp, Artificial
  CRISPR gRNA sequence
tcagatagtatatgtgcagg

SEQ ID NO: 659788 - DNA, 20 bp, Artificial
  CRISPR gRNA sequence
gggaaagaaaatagtggttg

SEQ ID NO: 659789 - DNA, 20 bp, Artificial
  CRISPR gRNA sequence
ggaaagaaaatagtggttgc

SEQ ID NO: 659790 - DNA, 20 bp, Artificial
  CRISPR gRNA sequence
ctccaaggagctaagatatt

SEQ ID NO: 659791 - DNA, 20 bp, Artificial
  CRISPR gRNA sequence
caaggagctaagatattaca

SEQ ID NO: 659792 - DNA, 20 bp, Artificial
  CRISPR gRNA sequence
agatattacagcattttacc

SEQ ID NO: 659793 - DNA, 20 bp, Artificial
  CRISPR gRNA sequence
cagcattttaccatcaatca

SEQ ID NO: 659794 - DNA, 20 bp, Artificial
  CRISPR gRNA sequence
taccatcaatcactaaaata

SEQ ID NO: 659795 - DNA, 20 bp, Artificial
  CRISPR gRNA sequence
accatcaatcactaaaatag

SEQ ID NO: 659796 - DNA, 20 bp, Artificial
  CRISPR gRNA sequence
ccatcaatcactaaaatagt

SEQ ID NO: 659797 - DNA, 20 bp, Artificial
  CRISPR gRNA sequence
aaatagtctctgcttttcag

SEQ ID NO: 659798 - DNA, 20 bp, Artificial
  CRISPR gRNA sequence
tgcttttcagaagatggtag

SEQ ID NO: 659799 - DNA, 20 bp, Artificial
  CRISPR gRNA sequence
cttttcagaagatggtagaa

SEQ ID NO: 659800 - DNA, 20 bp, Artificial
  CRISPR gRNA sequence
ttcagaagatggtagaagaa

SEQ ID NO: 659801 - DNA, 20 bp, Artificial
  CRISPR gRNA sequence
tcagaagatggtagaagaac

SEQ ID NO: 659802 - DNA, 20 bp, Artificial
  CRISPR gRNA sequence
cagaagatggtagaagaacg

SEQ ID NO: 659803 - DNA, 20 bp, Artificial
  CRISPR gRNA sequence
agaagatggtagaagaacgt

SEQ ID NO: 659804 - DNA, 20 bp, Artificial
  CRISPR gRNA sequence
aactgcatctttagggttgg

SEQ ID NO: 659805 - DNA, 20 bp, Artificial
  CRISPR gRNA sequence
catctttagggttgggtggt

SEQ ID NO: 659806 - DNA, 20 bp, Artificial
  CRISPR gRNA sequence
tagggttgggtggtaggcag

SEQ ID NO: 659807 - DNA, 20 bp, Artificial
  CRISPR gRNA sequence
agggttgggtggtaggcagg

SEQ ID NO: 659808 - DNA, 20 bp, Artificial
  CRISPR gRNA sequence
gggttgggtggtaggcaggg

SEQ ID NO: 659809 - DNA, 20 bp, Artificial
  CRISPR gRNA sequence
ggtggtaggcagggagagtt

SEQ ID NO: 659810 - DNA, 20 bp, Artificial
  CRISPR gRNA sequence
tagctcttctcaagaaaaaa

SEQ ID NO: 659811 - DNA, 20 bp, Artificial
  CRISPR gRNA sequence
ttctcaagaaaaaactaaaa

SEQ ID NO: 659812 - DNA, 20 bp, Artificial
  CRISPR gRNA sequence
ctcaagaaaaaactaaaaat

SEQ ID NO: 659813 - DNA, 20 bp, Artificial
  CRISPR gRNA sequence
tcaagaaaaaactaaaaatg

SEQ ID NO: 659814 - DNA, 20 bp, Artificial
  CRISPR gRNA sequence
aagaaaaaactaaaaatgta

SEQ ID NO: 659815 - DNA, 20 bp, Artificial
  CRISPR gRNA sequence
aaaatgtaagcatatatgca

SEQ ID NO: 659816 - DNA, 20 bp, Artificial
  CRISPR gRNA sequence
tattattgtggtttgccctc

SEQ ID NO: 659817 - DNA, 20 bp, Artificial
  CRISPR gRNA sequence
attattgtggtttgccctct

SEQ ID NO: 659818 - DNA, 20 bp, Artificial
  CRISPR gRNA sequence
ttattgtggtttgccctctc

SEQ ID NO: 659819 - DNA, 20 bp, Artificial
  CRISPR gRNA sequence
ttgtggtttgccctctctct

SEQ ID NO: 659820 - DNA, 20 bp, Artificial
  CRISPR gRNA sequence
tggtttgccctctctctctg

SEQ ID NO: 659821 - DNA, 20 bp, Artificial
  CRISPR gRNA sequence
gccctctctctctgtctctc

SEQ ID NO: 659822 - DNA, 20 bp, Artificial
  CRISPR gRNA sequence
ccctctctctctgtctctct

SEQ ID NO: 659823 - DNA, 20 bp, Artificial
  CRISPR gRNA sequence
tctctctgtctctctgtctg

SEQ ID NO: 659824 - DNA, 20 bp, Artificial
  CRISPR gRNA sequence
tctctgtctctctgtctgtc

SEQ ID NO: 659825 - DNA, 20 bp, Artificial
  CRISPR gRNA sequence
tctgtctctctgtctgtctt

SEQ ID NO: 659826 - DNA, 20 bp, Artificial
  CRISPR gRNA sequence
tgtctctctgtctgtctttt

SEQ ID NO: 659827 - DNA, 20 bp, Artificial
  CRISPR gRNA sequence
tctctctgtctgtcttttct

SEQ ID NO: 659828 - DNA, 20 bp, Artificial
  CRISPR gRNA sequence
tctgtctgtcttttcttttc

SEQ ID NO: 659829 - DNA, 20 bp, Artificial
  CRISPR gRNA sequence
tgtctgtcttttcttttcct

SEQ ID NO: 659830 - DNA, 20 bp, Artificial
  CRISPR gRNA sequence
tctgtcttttcttttcctct

SEQ ID NO: 659831 - DNA, 20 bp, Artificial
  CRISPR gRNA sequence
tcttttcttttcctctacct

SEQ ID NO: 659832 - DNA, 20 bp, Artificial
  CRISPR gRNA sequence
ttcttttcctctacctgcct

SEQ ID NO: 659833 - DNA, 20 bp, Artificial
  CRISPR gRNA sequence
tcttttcctctacctgcctt

SEQ ID NO: 659834 - DNA, 20 bp, Artificial
  CRISPR gRNA sequence
cttttcctctacctgccttt

SEQ ID NO: 659835 - DNA, 20 bp, Artificial
  CRISPR gRNA sequence
ttttcctctacctgcctttg

SEQ ID NO: 659836 - DNA, 20 bp, Artificial
  CRISPR gRNA sequence
ttcctctacctgcctttgat

SEQ ID NO: 659837 - DNA, 20 bp, Artificial
  CRISPR gRNA sequence
tcctctacctgcctttgata

SEQ ID NO: 659838 - DNA, 20 bp, Artificial
  CRISPR gRNA sequence
cctctacctgcctttgataa

SEQ ID NO: 659839 - DNA, 20 bp, Artificial
  CRISPR gRNA sequence
ctctacctgcctttgataat

SEQ ID NO: 659840 - DNA, 20 bp, Artificial
  CRISPR gRNA sequence
tacctgcctttgataatttt

SEQ ID NO: 659841 - DNA, 20 bp, Artificial
  CRISPR gRNA sequence
cctgcctttgataatttttc

SEQ ID NO: 659842 - DNA, 20 bp, Artificial
  CRISPR gRNA sequence
cctttgataatttttccttt

SEQ ID NO: 659843 - DNA, 20 bp, Artificial
  CRISPR gRNA sequence
tgataatttttcctttgctt

SEQ ID NO: 659844 - DNA, 20 bp, Artificial
  CRISPR gRNA sequence
gataatttttcctttgcttg

SEQ ID NO: 659845 - DNA, 20 bp, Artificial
  CRISPR gRNA sequence
ataatttttcctttgcttgg

SEQ ID NO: 659846 - DNA, 20 bp, Artificial
  CRISPR gRNA sequence
ttcctttgcttggctttcta

SEQ ID NO: 659847 - DNA, 20 bp, Artificial
  CRISPR gRNA sequence
tcctttgcttggctttctag

SEQ ID NO: 659848 - DNA, 20 bp, Artificial
  CRISPR gRNA sequence
cctttgcttggctttctagg

SEQ ID NO: 659849 - DNA, 20 bp, Artificial
  CRISPR gRNA sequence
ctttgcttggctttctaggt

SEQ ID NO: 659850 - DNA, 20 bp, Artificial
  CRISPR gRNA sequence
tgcttggctttctaggtctt

SEQ ID NO: 659851 - DNA, 20 bp, Artificial
  CRISPR gRNA sequence
gcttggctttctaggtcttt

SEQ ID NO: 659852 - DNA, 20 bp, Artificial
  CRISPR gRNA sequence
cttggctttctaggtctttt

SEQ ID NO: 659853 - DNA, 20 bp, Artificial
  CRISPR gRNA sequence
ggctttctaggtctttttga

SEQ ID NO: 659854 - DNA, 20 bp, Artificial
  CRISPR gRNA sequence
gctttctaggtctttttgat

SEQ ID NO: 659855 - DNA, 20 bp, Artificial
  CRISPR gRNA sequence
tctaggtctttttgattgag

SEQ ID NO: 659856 - DNA, 20 bp, Artificial
  CRISPR gRNA sequence
ctaggtctttttgattgaga

SEQ ID NO: 659857 - DNA, 20 bp, Artificial
  CRISPR gRNA sequence
taggtctttttgattgagat

SEQ ID NO: 659858 - DNA, 20 bp, Artificial
  CRISPR gRNA sequence
ggtctttttgattgagatgt

SEQ ID NO: 659859 - DNA, 20 bp, Artificial
  CRISPR gRNA sequence
tttgattgagatgttttata

SEQ ID NO: 659860 - DNA, 20 bp, Artificial
  CRISPR gRNA sequence
ttgattgagatgttttataa

SEQ ID NO: 659861 - DNA, 20 bp, Artificial
  CRISPR gRNA sequence
tgattgagatgttttataaa

SEQ ID NO: 659862 - DNA, 20 bp, Artificial
  CRISPR gRNA sequence
gattgagatgttttataaaa

SEQ ID NO: 659863 - DNA, 20 bp, Artificial
  CRISPR gRNA sequence
attgagatgttttataaaat

SEQ ID NO: 659864 - DNA, 20 bp, Artificial
  CRISPR gRNA sequence
agatgttttataaaatcatg

SEQ ID NO: 659865 - DNA, 20 bp, Artificial
  CRISPR gRNA sequence
tataaaatcatgtgaatatt

SEQ ID NO: 659866 - DNA, 20 bp, Artificial
  CRISPR gRNA sequence
ataaaatcatgtgaatattt

SEQ ID NO: 659867 - DNA, 20 bp, Artificial
  CRISPR gRNA sequence
taaaatcatgtgaatatttt

SEQ ID NO: 659868 - DNA, 20 bp, Artificial
  CRISPR gRNA sequence
tcacactgtattttattaca

SEQ ID NO: 659869 - DNA, 20 bp, Artificial
  CRISPR gRNA sequence
cacactgtattttattacac

SEQ ID NO: 659870 - DNA, 20 bp, Artificial
  CRISPR gRNA sequence
acactgtattttattacact

SEQ ID NO: 659871 - DNA, 20 bp, Artificial
  CRISPR gRNA sequence
tattttattacactctctat

SEQ ID NO: 659872 - DNA, 20 bp, Artificial
  CRISPR gRNA sequence
tattacactctctattattt

SEQ ID NO: 659873 - DNA, 20 bp, Artificial
  CRISPR gRNA sequence
attacactctctattattta

SEQ ID NO: 659874 - DNA, 20 bp, Artificial
  CRISPR gRNA sequence
ttacactctctattatttat

SEQ ID NO: 659875 - DNA, 20 bp, Artificial
  CRISPR gRNA sequence
cactctctattatttatttc

SEQ ID NO: 659876 - DNA, 20 bp, Artificial
  CRISPR gRNA sequence
tctattatttatttctgcac

SEQ ID NO: 659877 - DNA, 20 bp, Artificial
  CRISPR gRNA sequence
tattatttatttctgcactt

SEQ ID NO: 659878 - DNA, 20 bp, Artificial
  CRISPR gRNA sequence
ttatttatttctgcacttct

SEQ ID NO: 659879 - DNA, 20 bp, Artificial
  CRISPR gRNA sequence
tttatttctgcacttctctc

SEQ ID NO: 659880 - DNA, 20 bp, Artificial
  CRISPR gRNA sequence
atttctgcacttctctctca

SEQ ID NO: 659881 - DNA, 20 bp, Artificial
  CRISPR gRNA sequence
tttctgcacttctctctcag

SEQ ID NO: 659882 - DNA, 20 bp, Artificial
  CRISPR gRNA sequence
ctgcacttctctctcagttg

SEQ ID NO: 659883 - DNA, 20 bp, Artificial
  CRISPR gRNA sequence
tgcacttctctctcagttgt

SEQ ID NO: 659884 - DNA, 20 bp, Artificial
  CRISPR gRNA sequence
cacttctctctcagttgtat

SEQ ID NO: 659885 - DNA, 20 bp, Artificial
  CRISPR gRNA sequence
ctctctcagttgtattcctt

SEQ ID NO: 659886 - DNA, 20 bp, Artificial
  CRISPR gRNA sequence
tctctcagttgtattccttc

SEQ ID NO: 659887 - DNA, 20 bp, Artificial
  CRISPR gRNA sequence
tctcagttgtattccttcag

SEQ ID NO: 659888 - DNA, 20 bp, Artificial
  CRISPR gRNA sequence
tcagttgtattccttcagcc

SEQ ID NO: 659889 - DNA, 20 bp, Artificial
  CRISPR gRNA sequence
agttgtattccttcagcctg

SEQ ID NO: 659890 - DNA, 20 bp, Artificial
  CRISPR gRNA sequence
tattccttcagcctgttgac

SEQ ID NO: 659891 - DNA, 20 bp, Artificial
  CRISPR gRNA sequence
cttcagcctgttgacacaaa

SEQ ID NO: 659892 - DNA, 20 bp, Artificial
  CRISPR gRNA sequence
cagcctgttgacacaaaata

SEQ ID NO: 659893 - DNA, 20 bp, Artificial
  CRISPR gRNA sequence
agcctgttgacacaaaatag

SEQ ID NO: 659894 - DNA, 20 bp, Artificial
  CRISPR gRNA sequence
ttgacacaaaatagacacat

SEQ ID NO: 659895 - DNA, 20 bp, Artificial
  CRISPR gRNA sequence
acacaaaatagacacatgtt

SEQ ID NO: 659896 - DNA, 20 bp, Artificial
  CRISPR gRNA sequence
ctgtttcagccagggagttt

SEQ ID NO: 659897 - DNA, 20 bp, Artificial
  CRISPR gRNA sequence
tttcagccagggagtttgtg

SEQ ID NO: 659898 - DNA, 20 bp, Artificial
  CRISPR gRNA sequence
cagccagggagtttgtgcat

SEQ ID NO: 659899 - DNA, 20 bp, Artificial
  CRISPR gRNA sequence
agccagggagtttgtgcatc

SEQ ID NO: 659900 - DNA, 20 bp, Artificial
  CRISPR gRNA sequence
gtgcatctgttgacacttca

SEQ ID NO: 659901 - DNA, 20 bp, Artificial
  CRISPR gRNA sequence
tgcatctgttgacacttcag

SEQ ID NO: 659902 - DNA, 20 bp, Artificial
  CRISPR gRNA sequence
ttgacacttcagaaataatc

SEQ ID NO: 659903 - DNA, 20 bp, Artificial
  CRISPR gRNA sequence
acacttcagaaataatcagt

SEQ ID NO: 659904 - DNA, 20 bp, Artificial
  CRISPR gRNA sequence
cagaaataatcagtttagat

SEQ ID NO: 659905 - DNA, 20 bp, Artificial
  CRISPR gRNA sequence
agaaataatcagtttagatt

SEQ ID NO: 659906 - DNA, 20 bp, Artificial
  CRISPR gRNA sequence
agatttcaacagctgattag

SEQ ID NO: 659907 - DNA, 20 bp, Artificial
  CRISPR gRNA sequence
gatttcaacagctgattagt

SEQ ID NO: 659908 - DNA, 20 bp, Artificial
  CRISPR gRNA sequence
caacagctgattagtgtgct

SEQ ID NO: 659909 - DNA, 20 bp, Artificial
  CRISPR gRNA sequence
aacagctgattagtgtgctg

SEQ ID NO: 659910 - DNA, 20 bp, Artificial
  CRISPR gRNA sequence
attagtgtgctgttctaacc

SEQ ID NO: 659911 - DNA, 20 bp, Artificial
  CRISPR gRNA sequence
gtgtgctgttctaaccaaac

SEQ ID NO: 659912 - DNA, 20 bp, Artificial
  CRISPR gRNA sequence
ttctaaccaaactgagaagg

SEQ ID NO: 659913 - DNA, 20 bp, Artificial
  CRISPR gRNA sequence
taaccaaactgagaaggaac

SEQ ID NO: 659914 - DNA, 20 bp, Artificial
  CRISPR gRNA sequence
accaaactgagaaggaactc

SEQ ID NO: 659915 - DNA, 20 bp, Artificial
  CRISPR gRNA sequence
agaaggaactcttcagaatg

SEQ ID NO: 659916 - DNA, 20 bp, Artificial
  CRISPR gRNA sequence
ttcagaatggaaacagatat

SEQ ID NO: 659917 - DNA, 20 bp, Artificial
  CRISPR gRNA sequence
cagaatggaaacagatatta

SEQ ID NO: 659918 - DNA, 20 bp, Artificial
  CRISPR gRNA sequence
agaatggaaacagatattat

SEQ ID NO: 659919 - DNA, 20 bp, Artificial
  CRISPR gRNA sequence
ttctatttagttttttgtac

SEQ ID NO: 659920 - DNA, 20 bp, Artificial
  CRISPR gRNA sequence
tatttagttttttgtacaaa

SEQ ID NO: 659921 - DNA, 20 bp, Artificial
  CRISPR gRNA sequence
tttagttttttgtacaaata

SEQ ID NO: 659922 - DNA, 20 bp, Artificial
  CRISPR gRNA sequence
agttttttgtacaaatatgt

SEQ ID NO: 659923 - DNA, 20 bp, Artificial
  CRISPR gRNA sequence
gttttttgtacaaatatgta

SEQ ID NO: 659924 - DNA, 20 bp, Artificial
  CRISPR gRNA sequence
tttgtacaaatatgtaataa

SEQ ID NO: 659925 - DNA, 20 bp, Artificial
  CRISPR gRNA sequence
ttgtacaaatatgtaataat

SEQ ID NO: 659926 - DNA, 20 bp, Artificial
  CRISPR gRNA sequence
tgtacaaatatgtaataatg

SEQ ID NO: 659927 - DNA, 20 bp, Artificial
  CRISPR gRNA sequence
gtacaaatatgtaataatgg

SEQ ID NO: 659928 - DNA, 20 bp, Artificial
  CRISPR gRNA sequence
tacaaatatgtaataatggc

SEQ ID NO: 659929 - DNA, 20 bp, Artificial
  CRISPR gRNA sequence
taaaccaatgctgtggttat

SEQ ID NO: 659930 - DNA, 20 bp, Artificial
  CRISPR gRNA sequence
aaaccaatgctgtggttata

SEQ ID NO: 659931 - DNA, 20 bp, Artificial
  CRISPR gRNA sequence
aaccaatgctgtggttataa

SEQ ID NO: 659932 - DNA, 20 bp, Artificial
  CRISPR gRNA sequence
tggttataaaaggcctttgc

SEQ ID NO: 659933 - DNA, 20 bp, Artificial
  CRISPR gRNA sequence
taaaaggcctttgctgaagt

SEQ ID NO: 659934 - DNA, 20 bp, Artificial
  CRISPR gRNA sequence
tgctgaagttttgtttttct

SEQ ID NO: 659935 - DNA, 20 bp, Artificial
  CRISPR gRNA sequence
gctgaagttttgtttttctt

SEQ ID NO: 659936 - DNA, 20 bp, Artificial
  CRISPR gRNA sequence
ctgaagttttgtttttcttt

SEQ ID NO: 659937 - DNA, 20 bp, Artificial
  CRISPR gRNA sequence
aagttttgtttttctttatt

SEQ ID NO: 659938 - DNA, 20 bp, Artificial
  CRISPR gRNA sequence
tgtttttctttattgtacct

SEQ ID NO: 659939 - DNA, 20 bp, Artificial
  CRISPR gRNA sequence
gtttttctttattgtacctc

SEQ ID NO: 659940 - DNA, 20 bp, Artificial
  CRISPR gRNA sequence
tttttctttattgtacctca

SEQ ID NO: 659941 - DNA, 20 bp, Artificial
  CRISPR gRNA sequence
ttctttattgtacctcaaag

SEQ ID NO: 659942 - DNA, 20 bp, Artificial
  CRISPR gRNA sequence
tctttattgtacctcaaaga

SEQ ID NO: 659943 - DNA, 20 bp, Artificial
  CRISPR gRNA sequence
ctttattgtacctcaaagag

SEQ ID NO: 659944 - DNA, 20 bp, Artificial
  CRISPR gRNA sequence
tttattgtacctcaaagagg

SEQ ID NO: 659945 - DNA, 20 bp, Artificial
  CRISPR gRNA sequence
tattgtacctcaaagaggct

SEQ ID NO: 659946 - DNA, 20 bp, Artificial
  CRISPR gRNA sequence
attgtacctcaaagaggcta

SEQ ID NO: 659947 - DNA, 20 bp, Artificial
  CRISPR gRNA sequence
ttgtacctcaaagaggctat

SEQ ID NO: 659948 - DNA, 20 bp, Artificial
  CRISPR gRNA sequence
tacctcaaagaggctatcaa

SEQ ID NO: 659949 - DNA, 20 bp, Artificial
  CRISPR gRNA sequence
aaagaggctatcaaaatgtt

SEQ ID NO: 659950 - DNA, 20 bp, Artificial
  CRISPR gRNA sequence
tcaaaatgtttagtgaccag

SEQ ID NO: 659951 - DNA, 20 bp, Artificial
  CRISPR gRNA sequence
agtgaccagtattccacaag

SEQ ID NO: 659952 - DNA, 20 bp, Artificial
  CRISPR gRNA sequence
gtgaccagtattccacaagt

SEQ ID NO: 659953 - DNA, 20 bp, Artificial
  CRISPR gRNA sequence
cacaagttgtaatatgccag

SEQ ID NO: 659954 - DNA, 20 bp, Artificial
  CRISPR gRNA sequence
taatatgccaggggtaatca

SEQ ID NO: 659955 - DNA, 20 bp, Artificial
  CRISPR gRNA sequence
cataatggtccttgtattta

SEQ ID NO: 659956 - DNA, 20 bp, Artificial
  CRISPR gRNA sequence
ataatggtccttgtatttat

SEQ ID NO: 659957 - DNA, 20 bp, Artificial
  CRISPR gRNA sequence
gtatttatagcaactcaatg

SEQ ID NO: 659958 - DNA, 20 bp, Artificial
  CRISPR gRNA sequence
tatttatagcaactcaatga

SEQ ID NO: 659959 - DNA, 20 bp, Artificial
  CRISPR gRNA sequence
atagcaactcaatgaatgtt

SEQ ID NO: 659960 - DNA, 20 bp, Artificial
  CRISPR gRNA sequence
tagcaactcaatgaatgtta

SEQ ID NO: 659961 - DNA, 20 bp, Artificial
  CRISPR gRNA sequence
aatgaatgttagaaagaata

SEQ ID NO: 659962 - DNA, 20 bp, Artificial
  CRISPR gRNA sequence
gaaagaatattggtagaatt

SEQ ID NO: 659963 - DNA, 20 bp, Artificial
  CRISPR gRNA sequence
gtagaattccaggaatatca

SEQ ID NO: 659964 - DNA, 20 bp, Artificial
  CRISPR gRNA sequence
caggaatatcatacatgatc

SEQ ID NO: 659965 - DNA, 20 bp, Artificial
  CRISPR gRNA sequence
ctaacagtttcagaactcca

SEQ ID NO: 659966 - DNA, 20 bp, Artificial
  CRISPR gRNA sequence
acagtttcagaactccagct

SEQ ID NO: 659967 - DNA, 20 bp, Artificial
  CRISPR gRNA sequence
cagaactccagcttccacat

SEQ ID NO: 659968 - DNA, 20 bp, Artificial
  CRISPR gRNA sequence
agaactccagcttccacatt

SEQ ID NO: 659969 - DNA, 20 bp, Artificial
  CRISPR gRNA sequence
cagcttccacattgaattac

SEQ ID NO: 659970 - DNA, 20 bp, Artificial
  CRISPR gRNA sequence
ccacattgaattactactga

SEQ ID NO: 659971 - DNA, 20 bp, Artificial
  CRISPR gRNA sequence
cacattgaattactactgaa

SEQ ID NO: 659972 - DNA, 20 bp, Artificial
  CRISPR gRNA sequence
aattactactgaatgtaaga

SEQ ID NO: 659973 - DNA, 20 bp, Artificial
  CRISPR gRNA sequence
ctactgaatgtaagaaatat

SEQ ID NO: 659974 - DNA, 20 bp, Artificial
  CRISPR gRNA sequence
ctgaatgtaagaaatatagc

SEQ ID NO: 659975 - DNA, 20 bp, Artificial
  CRISPR gRNA sequence
aatgtaagaaatatagctaa

SEQ ID NO: 659976 - DNA, 20 bp, Artificial
  CRISPR gRNA sequence
atggtatcagtgtagcaccc

SEQ ID NO: 659977 - DNA, 20 bp, Artificial
  CRISPR gRNA sequence
atttgcctaagataggaagc

SEQ ID NO: 659978 - DNA, 20 bp, Artificial
  CRISPR gRNA sequence
gcctaagataggaagccata

SEQ ID NO: 659979 - DNA, 20 bp, Artificial
  CRISPR gRNA sequence
cctaagataggaagccatat

SEQ ID NO: 659980 - DNA, 20 bp, Artificial
  CRISPR gRNA sequence
agataggaagccatatctcc

SEQ ID NO: 659981 - DNA, 20 bp, Artificial
  CRISPR gRNA sequence
catgagctggagccaaaagg

SEQ ID NO: 659982 - DNA, 20 bp, Artificial
  CRISPR gRNA sequence
gagccaaaaggaaagaagag

SEQ ID NO: 659983 - DNA, 20 bp, Artificial
  CRISPR gRNA sequence
aacattttaaatgcgcttgt

SEQ ID NO: 659984 - DNA, 20 bp, Artificial
  CRISPR gRNA sequence
taaatgcgcttgtacaaata

SEQ ID NO: 659985 - DNA, 20 bp, Artificial
  CRISPR gRNA sequence
aaatgcgcttgtacaaatac

SEQ ID NO: 659986 - DNA, 20 bp, Artificial
  CRISPR gRNA sequence
aatgcgcttgtacaaatact

SEQ ID NO: 659987 - DNA, 20 bp, Artificial
  CRISPR gRNA sequence
gtacaaatacttacctggtt

SEQ ID NO: 659988 - DNA, 20 bp, Artificial
  CRISPR gRNA sequence
tacaaatacttacctggttg

SEQ ID NO: 659989 - DNA, 20 bp, Artificial
  CRISPR gRNA sequence
acctggttgaccttatattt

SEQ ID NO: 659990 - DNA, 20 bp, Artificial
  CRISPR gRNA sequence
cctggttgaccttatatttc

SEQ ID NO: 659991 - DNA, 20 bp, Artificial
  CRISPR gRNA sequence
gttgaccttatatttctcca

SEQ ID NO: 659992 - DNA, 20 bp, Artificial
  CRISPR gRNA sequence
accttatatttctccaacag

SEQ ID NO: 659993 - DNA, 20 bp, Artificial
  CRISPR gRNA sequence
atatttctccaacagtctga

SEQ ID NO: 659994 - DNA, 20 bp, Artificial
  CRISPR gRNA sequence
tatttctccaacagtctgaa

SEQ ID NO: 659995 - DNA, 20 bp, Artificial
  CRISPR gRNA sequence
ctccaacagtctgaagaaat

SEQ ID NO: 659996 - DNA, 20 bp, Artificial
  CRISPR gRNA sequence
tccaacagtctgaagaaata

SEQ ID NO: 659997 - DNA, 20 bp, Artificial
  CRISPR gRNA sequence
caacagtctgaagaaataga

SEQ ID NO: 659998 - DNA, 20 bp, Artificial
  CRISPR gRNA sequence
aagaaatagatcagaaatag

SEQ ID NO: 659999 - DNA, 20 bp, Artificial
  CRISPR gRNA sequence
tataatagaaacggaatcag

SEQ ID NO: 660000 - DNA, 20 bp, Artificial
  CRISPR gRNA sequence
gtttctagaaaagatcctat

SEQ ID NO: 660001 - DNA, 20 bp, Artificial
  CRISPR gRNA sequence
ctagaaaagatcctatagga

SEQ ID NO: 660002 - DNA, 20 bp, Artificial
  CRISPR gRNA sequence
tagaaaagatcctataggat

SEQ ID NO: 660003 - DNA, 20 bp, Artificial
  CRISPR gRNA sequence
gaaaagatcctataggataa

SEQ ID NO: 660004 - DNA, 20 bp, Artificial
  CRISPR gRNA sequence
taggataactattatgcatc

SEQ ID NO: 660005 - DNA, 20 bp, Artificial
  CRISPR gRNA sequence
ttatgcatcttgatcagtca

SEQ ID NO: 660006 - DNA, 20 bp, Artificial
  CRISPR gRNA sequence
tgcatcttgatcagtcagca

SEQ ID NO: 660007 - DNA, 20 bp, Artificial
  CRISPR gRNA sequence
gatcagtcagcaagtatcta

SEQ ID NO: 660008 - DNA, 20 bp, Artificial
  CRISPR gRNA sequence
atcagtcagcaagtatctat

SEQ ID NO: 660009 - DNA, 20 bp, Artificial
  CRISPR gRNA sequence
tttagtactttatgaaaaat

SEQ ID NO: 660010 - DNA, 20 bp, Artificial
  CRISPR gRNA sequence
agtactttatgaaaaatatt

SEQ ID NO: 660011 - DNA, 20 bp, Artificial
  CRISPR gRNA sequence
gtactttatgaaaaatattg

SEQ ID NO: 660012 - DNA, 20 bp, Artificial
  CRISPR gRNA sequence
tatgaaaaatattgtgtata

SEQ ID NO: 660013 - DNA, 20 bp, Artificial
  CRISPR gRNA sequence
atgaaaaatattgtgtatag

SEQ ID NO: 660014 - DNA, 20 bp, Artificial
  CRISPR gRNA sequence
tgaaaaatattgtgtatagg

SEQ ID NO: 660015 - DNA, 20 bp, Artificial
  CRISPR gRNA sequence
tgtataggacagagaagaag

SEQ ID NO: 660016 - DNA, 20 bp, Artificial
  CRISPR gRNA sequence
tttcctttaaagagaatcag

SEQ ID NO: 660017 - DNA, 20 bp, Artificial
  CRISPR gRNA sequence
ttcctttaaagagaatcaga

SEQ ID NO: 660018 - DNA, 20 bp, Artificial
  CRISPR gRNA sequence
tcctttaaagagaatcagat

SEQ ID NO: 660019 - DNA, 20 bp, Artificial
  CRISPR gRNA sequence
cctttaaagagaatcagatt

SEQ ID NO: 660020 - DNA, 20 bp, Artificial
  CRISPR gRNA sequence
ctttaaagagaatcagattt

SEQ ID NO: 660021 - DNA, 20 bp, Artificial
  CRISPR gRNA sequence
taaagagaatcagatttcac

SEQ ID NO: 660022 - DNA, 20 bp, Artificial
  CRISPR gRNA sequence
aaagagaatcagatttcaca

SEQ ID NO: 660023 - DNA, 20 bp, Artificial
  CRISPR gRNA sequence
aagagaatcagatttcacag

SEQ ID NO: 660024 - DNA, 20 bp, Artificial
  CRISPR gRNA sequence
cacagttacatcatacataa

SEQ ID NO: 660025 - DNA, 20 bp, Artificial
  CRISPR gRNA sequence
acagttacatcatacataaa

SEQ ID NO: 660026 - DNA, 20 bp, Artificial
  CRISPR gRNA sequence
catcatacataaataaaaaa

SEQ ID NO: 660027 - DNA, 20 bp, Artificial
  CRISPR gRNA sequence
aatagcagtttaatatttta

SEQ ID NO: 660028 - DNA, 20 bp, Artificial
  CRISPR gRNA sequence
aatattttagatgggagttt

SEQ ID NO: 660029 - DNA, 20 bp, Artificial
  CRISPR gRNA sequence
atattttagatgggagtttg

SEQ ID NO: 660030 - DNA, 20 bp, Artificial
  CRISPR gRNA sequence
tagatgggagtttgagacat

SEQ ID NO: 660031 - DNA, 20 bp, Artificial
  CRISPR gRNA sequence
agatgggagtttgagacatt

SEQ ID NO: 660032 - DNA, 20 bp, Artificial
  CRISPR gRNA sequence
gatgggagtttgagacatta

SEQ ID NO: 660033 - DNA, 20 bp, Artificial
  CRISPR gRNA sequence
gagacattaggcaaacatag

SEQ ID NO: 660034 - DNA, 20 bp, Artificial
  CRISPR gRNA sequence
agacattaggcaaacatagt

SEQ ID NO: 660035 - DNA, 20 bp, Artificial
  CRISPR gRNA sequence
ggcaaacatagtaaaattat

SEQ ID NO: 660036 - DNA, 20 bp, Artificial
  CRISPR gRNA sequence
ttttcatataattaaagtac

SEQ ID NO: 660037 - DNA, 20 bp, Artificial
  CRISPR gRNA sequence
tcatataattaaagtacagc

SEQ ID NO: 660038 - DNA, 20 bp, Artificial
  CRISPR gRNA sequence
catataattaaagtacagca

SEQ ID NO: 660039 - DNA, 20 bp, Artificial
  CRISPR gRNA sequence
atataattaaagtacagcag

SEQ ID NO: 660040 - DNA, 20 bp, Artificial
  CRISPR gRNA sequence
aagtacagcagcttgggcaa

SEQ ID NO: 660041 - DNA, 20 bp, Artificial
  CRISPR gRNA sequence
gggcaacatggcaaaaccct

SEQ ID NO: 660042 - DNA, 20 bp, Artificial
  CRISPR gRNA sequence
ggcaacatggcaaaaccctg

SEQ ID NO: 660043 - DNA, 20 bp, Artificial
  CRISPR gRNA sequence
tctctacaaaaaatacaaaa

SEQ ID NO: 660044 - DNA, 20 bp, Artificial
  CRISPR gRNA sequence
tacaaaaaatacaaaaaatt

SEQ ID NO: 660045 - DNA, 20 bp, Artificial
  CRISPR gRNA sequence
caaaaaatacaaaaaattag

SEQ ID NO: 660046 - DNA, 20 bp, Artificial
  CRISPR gRNA sequence
gctgggcgttgtggcacgta

SEQ ID NO: 660047 - DNA, 20 bp, Artificial
  CRISPR gRNA sequence
ggcgttgtggcacgtacccg

SEQ ID NO: 660048 - DNA, 20 bp, Artificial
  CRISPR gRNA sequence
tggcacgtacccgtagtccc

SEQ ID NO: 660049 - DNA, 20 bp, Artificial
  CRISPR gRNA sequence
cttgaggggctgaggtgaga

SEQ ID NO: 660050 - DNA, 20 bp, Artificial
  CRISPR gRNA sequence
gaggggctgaggtgagagga

SEQ ID NO: 660051 - DNA, 20 bp, Artificial
  CRISPR gRNA sequence
aggggctgaggtgagaggat

SEQ ID NO: 660052 - DNA, 20 bp, Artificial
  CRISPR gRNA sequence
aggtgagaggatcccttgaa

SEQ ID NO: 660053 - DNA, 20 bp, Artificial
  CRISPR gRNA sequence
gaacccaggaggttgaggct

SEQ ID NO: 660054 - DNA, 20 bp, Artificial
  CRISPR gRNA sequence
aacccaggaggttgaggctg

SEQ ID NO: 660055 - DNA, 20 bp, Artificial
  CRISPR gRNA sequence
aggctgcagtgagccaagat

SEQ ID NO: 660056 - DNA, 20 bp, Artificial
  CRISPR gRNA sequence
cagtgagccaagatcttgca

SEQ ID NO: 660057 - DNA, 20 bp, Artificial
  CRISPR gRNA sequence
gcaactgcactccagcctgg

SEQ ID NO: 660058 - DNA, 20 bp, Artificial
  CRISPR gRNA sequence
caactgcactccagcctggg

SEQ ID NO: 660059 - DNA, 20 bp, Artificial
  CRISPR gRNA sequence
cactccagcctgggttacta

SEQ ID NO: 660060 - DNA, 20 bp, Artificial
  CRISPR gRNA sequence
cagcctgggttactacgaga

SEQ ID NO: 660061 - DNA, 20 bp, Artificial
  CRISPR gRNA sequence
ggttactacgagactgtctc

SEQ ID NO: 660062 - DNA, 20 bp, Artificial
  CRISPR gRNA sequence
ctacgagactgtctcaaaaa

SEQ ID NO: 660063 - DNA, 20 bp, Artificial
  CRISPR gRNA sequence
cgagactgtctcaaaaataa

SEQ ID NO: 660064 - DNA, 20 bp, Artificial
  CRISPR gRNA sequence
tctcaaaaataaataaatat

SEQ ID NO: 660065 - DNA, 20 bp, Artificial
  CRISPR gRNA sequence
aaaaataaataaatatataa

SEQ ID NO: 660066 - DNA, 20 bp, Artificial
  CRISPR gRNA sequence
cttaggactaattgtaggtc

SEQ ID NO: 660067 - DNA, 20 bp, Artificial
  CRISPR gRNA sequence
ttaggactaattgtaggtca

SEQ ID NO: 660068 - DNA, 20 bp, Artificial
  CRISPR gRNA sequence
aggactaattgtaggtcatc

SEQ ID NO: 660069 - DNA, 20 bp, Artificial
  CRISPR gRNA sequence
ggactaattgtaggtcatct

SEQ ID NO: 660070 - DNA, 20 bp, Artificial
  CRISPR gRNA sequence
attgtaggtcatctgccttc

SEQ ID NO: 660071 - DNA, 20 bp, Artificial
  CRISPR gRNA sequence
taggtcatctgccttccagt

SEQ ID NO: 660072 - DNA, 20 bp, Artificial
  CRISPR gRNA sequence
ccttccagttagagttatag

SEQ ID NO: 660073 - DNA, 20 bp, Artificial
  CRISPR gRNA sequence
ccagttagagttatagaatt

SEQ ID NO: 660074 - DNA, 20 bp, Artificial
  CRISPR gRNA sequence
cagttagagttatagaatta

SEQ ID NO: 660075 - DNA, 20 bp, Artificial
  CRISPR gRNA sequence
gagttatagaattaatcatt

SEQ ID NO: 660076 - DNA, 20 bp, Artificial
  CRISPR gRNA sequence
tagaattaatcattgccttt

SEQ ID NO: 660077 - DNA, 20 bp, Artificial
  CRISPR gRNA sequence
atcattgcctttctgtagtt

SEQ ID NO: 660078 - DNA, 20 bp, Artificial
  CRISPR gRNA sequence
cctttctgtagttttgtcac

SEQ ID NO: 660079 - DNA, 20 bp, Artificial
  CRISPR gRNA sequence
tctgtagttttgtcacctac

SEQ ID NO: 660080 - DNA, 20 bp, Artificial
  CRISPR gRNA sequence
ctgtagttttgtcacctact

SEQ ID NO: 660081 - DNA, 20 bp, Artificial
  CRISPR gRNA sequence
tgtagttttgtcacctactt

SEQ ID NO: 660082 - DNA, 20 bp, Artificial
  CRISPR gRNA sequence
tagttttgtcacctacttct

SEQ ID NO: 660083 - DNA, 20 bp, Artificial
  CRISPR gRNA sequence
tgtcacctacttctattaca

SEQ ID NO: 660084 - DNA, 20 bp, Artificial
  CRISPR gRNA sequence
gtcacctacttctattacaa

SEQ ID NO: 660085 - DNA, 20 bp, Artificial
  CRISPR gRNA sequence
tcacctacttctattacaaa

SEQ ID NO: 660086 - DNA, 20 bp, Artificial
  CRISPR gRNA sequence
cttctattacaaaaatttgt

SEQ ID NO: 660087 - DNA, 20 bp, Artificial
  CRISPR gRNA sequence
ctattacaaaaatttgtttg

SEQ ID NO: 660088 - DNA, 20 bp, Artificial
  CRISPR gRNA sequence
tattacaaaaatttgtttgc

SEQ ID NO: 660089 - DNA, 20 bp, Artificial
  CRISPR gRNA sequence
ttacaaaaatttgtttgcca

SEQ ID NO: 660090 - DNA, 20 bp, Artificial
  CRISPR gRNA sequence
caaaaatttgtttgccattc

SEQ ID NO: 660091 - DNA, 20 bp, Artificial
  CRISPR gRNA sequence
gtttgccattcttttttctg

SEQ ID NO: 660092 - DNA, 20 bp, Artificial
  CRISPR gRNA sequence
tttgccattcttttttctga

SEQ ID NO: 660093 - DNA, 20 bp, Artificial
  CRISPR gRNA sequence
gccattcttttttctgaatg

SEQ ID NO: 660094 - DNA, 20 bp, Artificial
  CRISPR gRNA sequence
ccattcttttttctgaatga

SEQ ID NO: 660095 - DNA, 20 bp, Artificial
  CRISPR gRNA sequence
ttttttctgaatgactcccc

SEQ ID NO: 660096 - DNA, 20 bp, Artificial
  CRISPR gRNA sequence
ttttctgaatgactcccctt

SEQ ID NO: 660097 - DNA, 20 bp, Artificial
  CRISPR gRNA sequence
tttctgaatgactcccctta

SEQ ID NO: 660098 - DNA, 20 bp, Artificial
  CRISPR gRNA sequence
ttctgaatgactccccttac

SEQ ID NO: 660099 - DNA, 20 bp, Artificial
  CRISPR gRNA sequence
tctgaatgactccccttacc

SEQ ID NO: 660100 - DNA, 20 bp, Artificial
  CRISPR gRNA sequence
ctgaatgactccccttacct

SEQ ID NO: 660101 - DNA, 20 bp, Artificial
  CRISPR gRNA sequence
tgaatgactccccttacctg

SEQ ID NO: 660102 - DNA, 20 bp, Artificial
  CRISPR gRNA sequence
aatgactccccttacctgag

SEQ ID NO: 660103 - DNA, 20 bp, Artificial
  CRISPR gRNA sequence
cccttacctgaggaatgcag

SEQ ID NO: 660104 - DNA, 20 bp, Artificial
  CRISPR gRNA sequence
acctgaggaatgcagtctaa

SEQ ID NO: 660105 - DNA, 20 bp, Artificial
  CRISPR gRNA sequence
cctgaggaatgcagtctaat

SEQ ID NO: 660106 - DNA, 20 bp, Artificial
  CRISPR gRNA sequence
aggaatgcagtctaataagc

SEQ ID NO: 660107 - DNA, 20 bp, Artificial
  CRISPR gRNA sequence
ataagctctttagcatttta

SEQ ID NO: 660108 - DNA, 20 bp, Artificial
  CRISPR gRNA sequence
tttagcattttatactacag

SEQ ID NO: 660109 - DNA, 20 bp, Artificial
  CRISPR gRNA sequence
tagcattttatactacagcc

SEQ ID NO: 660110 - DNA, 20 bp, Artificial
  CRISPR gRNA sequence
agcattttatactacagcct

SEQ ID NO: 660111 - DNA, 20 bp, Artificial
  CRISPR gRNA sequence
gcattttatactacagcctt

SEQ ID NO: 660112 - DNA, 20 bp, Artificial
  CRISPR gRNA sequence
tatactacagcctttactaa

SEQ ID NO: 660113 - DNA, 20 bp, Artificial
  CRISPR gRNA sequence
atactacagcctttactaaa

SEQ ID NO: 660114 - DNA, 20 bp, Artificial
  CRISPR gRNA sequence
tactacagcctttactaaac

SEQ ID NO: 660115 - DNA, 20 bp, Artificial
  CRISPR gRNA sequence
cagcctttactaaacagccc

SEQ ID NO: 660116 - DNA, 20 bp, Artificial
  CRISPR gRNA sequence
tactaaacagcccaatctat

SEQ ID NO: 660117 - DNA, 20 bp, Artificial
  CRISPR gRNA sequence
actaaacagcccaatctatc

SEQ ID NO: 660118 - DNA, 20 bp, Artificial
  CRISPR gRNA sequence
ctaaacagcccaatctatct

SEQ ID NO: 660119 - DNA, 20 bp, Artificial
  CRISPR gRNA sequence
aacagcccaatctatctttt

SEQ ID NO: 660120 - DNA, 20 bp, Artificial
  CRISPR gRNA sequence
tctttttgtcttcatctcct

SEQ ID NO: 660121 - DNA, 20 bp, Artificial
  CRISPR gRNA sequence
tttgtcttcatctcctgaaa

SEQ ID NO: 660122 - DNA, 20 bp, Artificial
  CRISPR gRNA sequence
ttgtcttcatctcctgaaat

SEQ ID NO: 660123 - DNA, 20 bp, Artificial
  CRISPR gRNA sequence
tgtcttcatctcctgaaatt

SEQ ID NO: 660124 - DNA, 20 bp, Artificial
  CRISPR gRNA sequence
gtcttcatctcctgaaattc

SEQ ID NO: 660125 - DNA, 20 bp, Artificial
  CRISPR gRNA sequence
tcttcatctcctgaaattcc

SEQ ID NO: 660126 - DNA, 20 bp, Artificial
  CRISPR gRNA sequence
catctcctgaaattcctttt

SEQ ID NO: 660127 - DNA, 20 bp, Artificial
  CRISPR gRNA sequence
atctcctgaaattccttttc

SEQ ID NO: 660128 - DNA, 20 bp, Artificial
  CRISPR gRNA sequence
ctgaaattccttttcacata

SEQ ID NO: 660129 - DNA, 20 bp, Artificial
  CRISPR gRNA sequence
aaattccttttcacatatac

SEQ ID NO: 660130 - DNA, 20 bp, Artificial
  CRISPR gRNA sequence
cttttcacatatactgtgct

SEQ ID NO: 660131 - DNA, 20 bp, Artificial
  CRISPR gRNA sequence
ttcacatatactgtgcttca

SEQ ID NO: 660132 - DNA, 20 bp, Artificial
  CRISPR gRNA sequence
tcacatatactgtgcttcag

SEQ ID NO: 660133 - DNA, 20 bp, Artificial
  CRISPR gRNA sequence
cacatatactgtgcttcagc

SEQ ID NO: 660134 - DNA, 20 bp, Artificial
  CRISPR gRNA sequence
acatatactgtgcttcagcc

SEQ ID NO: 660135 - DNA, 20 bp, Artificial
  CRISPR gRNA sequence
tgcttcagccacagatactt

SEQ ID NO: 660136 - DNA, 20 bp, Artificial
  CRISPR gRNA sequence
cagccacagatacttgccat

SEQ ID NO: 660137 - DNA, 20 bp, Artificial
  CRISPR gRNA sequence
agccacagatacttgccatg

SEQ ID NO: 660138 - DNA, 20 bp, Artificial
  CRISPR gRNA sequence
gccatgtcttgaatataaca

SEQ ID NO: 660139 - DNA, 20 bp, Artificial
  CRISPR gRNA sequence
ccatgtcttgaatataacat

SEQ ID NO: 660140 - DNA, 20 bp, Artificial
  CRISPR gRNA sequence
gaatataacatattctttca

SEQ ID NO: 660141 - DNA, 20 bp, Artificial
  CRISPR gRNA sequence
aatataacatattctttcaa

SEQ ID NO: 660142 - DNA, 20 bp, Artificial
  CRISPR gRNA sequence
tttcaaattgccttttcttt

SEQ ID NO: 660143 - DNA, 20 bp, Artificial
  CRISPR gRNA sequence
tcaaattgccttttctttgc

SEQ ID NO: 660144 - DNA, 20 bp, Artificial
  CRISPR gRNA sequence
caaattgccttttctttgca

SEQ ID NO: 660145 - DNA, 20 bp, Artificial
  CRISPR gRNA sequence
aaattgccttttctttgcat

SEQ ID NO: 660146 - DNA, 20 bp, Artificial
  CRISPR gRNA sequence
ccttttctttgcatgaatcc

SEQ ID NO: 660147 - DNA, 20 bp, Artificial
  CRISPR gRNA sequence
ttctttgcatgaatccttct

SEQ ID NO: 660148 - DNA, 20 bp, Artificial
  CRISPR gRNA sequence
tctttgcatgaatccttctc

SEQ ID NO: 660149 - DNA, 20 bp, Artificial
  CRISPR gRNA sequence
ctttgcatgaatccttctcc

SEQ ID NO: 660150 - DNA, 20 bp, Artificial
  CRISPR gRNA sequence
tttgcatgaatccttctcct

SEQ ID NO: 660151 - DNA, 20 bp, Artificial
  CRISPR gRNA sequence
tgcatgaatccttctccttt

SEQ ID NO: 660152 - DNA, 20 bp, Artificial
  CRISPR gRNA sequence
gcatgaatccttctcctttc

SEQ ID NO: 660153 - DNA, 20 bp, Artificial
  CRISPR gRNA sequence
catgaatccttctcctttcc

SEQ ID NO: 660154 - DNA, 20 bp, Artificial
  CRISPR gRNA sequence
ctcctttccttggatttctg

SEQ ID NO: 660155 - DNA, 20 bp, Artificial
  CRISPR gRNA sequence
tcctttccttggatttctgt

SEQ ID NO: 660156 - DNA, 20 bp, Artificial
  CRISPR gRNA sequence
ctttccttggatttctgtac

SEQ ID NO: 660157 - DNA, 20 bp, Artificial
  CRISPR gRNA sequence
tccttggatttctgtacttt

SEQ ID NO: 660158 - DNA, 20 bp, Artificial
  CRISPR gRNA sequence
ccttggatttctgtactttt

SEQ ID NO: 660159 - DNA, 20 bp, Artificial
  CRISPR gRNA sequence
cttggatttctgtacttttt

SEQ ID NO: 660160 - DNA, 20 bp, Artificial
  CRISPR gRNA sequence
ggatttctgtactttttctc

SEQ ID NO: 660161 - DNA, 20 bp, Artificial
  CRISPR gRNA sequence
gatttctgtactttttctca

SEQ ID NO: 660162 - DNA, 20 bp, Artificial
  CRISPR gRNA sequence
ctgtactttttctcaaccag

SEQ ID NO: 660163 - DNA, 20 bp, Artificial
  CRISPR gRNA sequence
tgtactttttctcaaccagg

SEQ ID NO: 660164 - DNA, 20 bp, Artificial
  CRISPR gRNA sequence
tactttttctcaaccaggaa

SEQ ID NO: 660165 - DNA, 20 bp, Artificial
  CRISPR gRNA sequence
tttctcaaccaggaaaactc

SEQ ID NO: 660166 - DNA, 20 bp, Artificial
  CRISPR gRNA sequence
ttctcaaccaggaaaactct

SEQ ID NO: 660167 - DNA, 20 bp, Artificial
  CRISPR gRNA sequence
tctcaaccaggaaaactctc

SEQ ID NO: 660168 - DNA, 20 bp, Artificial
  CRISPR gRNA sequence
ctcaaccaggaaaactctca

SEQ ID NO: 660169 - DNA, 20 bp, Artificial
  CRISPR gRNA sequence
tcaaccaggaaaactctcaa

SEQ ID NO: 660170 - DNA, 20 bp, Artificial
  CRISPR gRNA sequence
aaccaggaaaactctcaatc

SEQ ID NO: 660171 - DNA, 20 bp, Artificial
  CRISPR gRNA sequence
tcaatccttttcaaaggtcc

SEQ ID NO: 660172 - DNA, 20 bp, Artificial
  CRISPR gRNA sequence
aatccttttcaaaggtccag

SEQ ID NO: 660173 - DNA, 20 bp, Artificial
  CRISPR gRNA sequence
ttcaaaggtccagtgtaact

SEQ ID NO: 660174 - DNA, 20 bp, Artificial
  CRISPR gRNA sequence
tcaaaggtccagtgtaactg

SEQ ID NO: 660175 - DNA, 20 bp, Artificial
  CRISPR gRNA sequence
caaaggtccagtgtaactgc

SEQ ID NO: 660176 - DNA, 20 bp, Artificial
  CRISPR gRNA sequence
aaaggtccagtgtaactgct

SEQ ID NO: 660177 - DNA, 20 bp, Artificial
  CRISPR gRNA sequence
cttatttgaatttttagtta

SEQ ID NO: 660178 - DNA, 20 bp, Artificial
  CRISPR gRNA sequence
atttgaatttttagttattc

SEQ ID NO: 660179 - DNA, 20 bp, Artificial
  CRISPR gRNA sequence
tttgaatttttagttattcc

SEQ ID NO: 660180 - DNA, 20 bp, Artificial
  CRISPR gRNA sequence
gaatttttagttattcccca

SEQ ID NO: 660181 - DNA, 20 bp, Artificial
  CRISPR gRNA sequence
aatttttagttattccccat

SEQ ID NO: 660182 - DNA, 20 bp, Artificial
  CRISPR gRNA sequence
ttagttattccccatatttc

SEQ ID NO: 660183 - DNA, 20 bp, Artificial
  CRISPR gRNA sequence
tagttattccccatatttct

SEQ ID NO: 660184 - DNA, 20 bp, Artificial
  CRISPR gRNA sequence
agttattccccatatttcta

SEQ ID NO: 660185 - DNA, 20 bp, Artificial
  CRISPR gRNA sequence
gttattccccatatttctat

SEQ ID NO: 660186 - DNA, 20 bp, Artificial
  CRISPR gRNA sequence
ttccccatatttctatagca

SEQ ID NO: 660187 - DNA, 20 bp, Artificial
  CRISPR gRNA sequence
cccatatttctatagcactg

SEQ ID NO: 660188 - DNA, 20 bp, Artificial
  CRISPR gRNA sequence
ctatagcactgagtatgtac

SEQ ID NO: 660189 - DNA, 20 bp, Artificial
  CRISPR gRNA sequence
tatagcactgagtatgtaca

SEQ ID NO: 660190 - DNA, 20 bp, Artificial
  CRISPR gRNA sequence
tagcactgagtatgtacatg

SEQ ID NO: 660191 - DNA, 20 bp, Artificial
  CRISPR gRNA sequence
agtatgtacatgtatctatt

SEQ ID NO: 660192 - DNA, 20 bp, Artificial
  CRISPR gRNA sequence
ttatagtattcaccacattg

SEQ ID NO: 660193 - DNA, 20 bp, Artificial
  CRISPR gRNA sequence
tagtattcaccacattgtat

SEQ ID NO: 660194 - DNA, 20 bp, Artificial
  CRISPR gRNA sequence
accacattgtattgctattg

SEQ ID NO: 660195 - DNA, 20 bp, Artificial
  CRISPR gRNA sequence
tattgctattgttttatgtc

SEQ ID NO: 660196 - DNA, 20 bp, Artificial
  CRISPR gRNA sequence
ctattgttttatgtctttgt

SEQ ID NO: 660197 - DNA, 20 bp, Artificial
  CRISPR gRNA sequence
ttgttttatgtctttgtctc

SEQ ID NO: 660198 - DNA, 20 bp, Artificial
  CRISPR gRNA sequence
ttttatgtctttgtctccca

SEQ ID NO: 660199 - DNA, 20 bp, Artificial
  CRISPR gRNA sequence
tatgtctttgtctcccatat

SEQ ID NO: 660200 - DNA, 20 bp, Artificial
  CRISPR gRNA sequence
atgtctttgtctcccatatt

SEQ ID NO: 660201 - DNA, 20 bp, Artificial
  CRISPR gRNA sequence
tgtctttgtctcccatatta

SEQ ID NO: 660202 - DNA, 20 bp, Artificial
  CRISPR gRNA sequence
tgtctcccatattagatttt

SEQ ID NO: 660203 - DNA, 20 bp, Artificial
  CRISPR gRNA sequence
gtctcccatattagattttg

SEQ ID NO: 660204 - DNA, 20 bp, Artificial
  CRISPR gRNA sequence
tctcccatattagattttga

SEQ ID NO: 660205 - DNA, 20 bp, Artificial
  CRISPR gRNA sequence
ccatattagattttgagctc

SEQ ID NO: 660206 - DNA, 20 bp, Artificial
  CRISPR gRNA sequence
gattttgagctcctctgggg

SEQ ID NO: 660207 - DNA, 20 bp, Artificial
  CRISPR gRNA sequence
tgagctcctctggggcagac

SEQ ID NO: 660208 - DNA, 20 bp, Artificial
  CRISPR gRNA sequence
gagctcctctggggcagact

SEQ ID NO: 660209 - DNA, 20 bp, Artificial
  CRISPR gRNA sequence
agctcctctggggcagacta

SEQ ID NO: 660210 - DNA, 20 bp, Artificial
  CRISPR gRNA sequence
ctctggggcagactatgtct

SEQ ID NO: 660211 - DNA, 20 bp, Artificial
  CRISPR gRNA sequence
tggggcagactatgtcttgt

SEQ ID NO: 660212 - DNA, 20 bp, Artificial
  CRISPR gRNA sequence
gggcagactatgtcttgttc

SEQ ID NO: 660213 - DNA, 20 bp, Artificial
  CRISPR gRNA sequence
tgtcttgttcatctgtgtac

SEQ ID NO: 660214 - DNA, 20 bp, Artificial
  CRISPR gRNA sequence
gttcatctgtgtacttataa

SEQ ID NO: 660215 - DNA, 20 bp, Artificial
  CRISPR gRNA sequence
ttcatctgtgtacttataat

SEQ ID NO: 660216 - DNA, 20 bp, Artificial
  CRISPR gRNA sequence
atctgtgtacttataatttt

SEQ ID NO: 660217 - DNA, 20 bp, Artificial
  CRISPR gRNA sequence
tgtacttataattttgccac

SEQ ID NO: 660218 - DNA, 20 bp, Artificial
  CRISPR gRNA sequence
ataattttgccactgtacct

SEQ ID NO: 660219 - DNA, 20 bp, Artificial
  CRISPR gRNA sequence
taattttgccactgtacctg

SEQ ID NO: 660220 - DNA, 20 bp, Artificial
  CRISPR gRNA sequence
tgccactgtacctggcagag

SEQ ID NO: 660221 - DNA, 20 bp, Artificial
  CRISPR gRNA sequence
gccactgtacctggcagaga

SEQ ID NO: 660222 - DNA, 20 bp, Artificial
  CRISPR gRNA sequence
ccactgtacctggcagagaa

SEQ ID NO: 660223 - DNA, 20 bp, Artificial
  CRISPR gRNA sequence
tacctggcagagaataggtg

SEQ ID NO: 660224 - DNA, 20 bp, Artificial
  CRISPR gRNA sequence
gcagagaataggtgtaccac

SEQ ID NO: 660225 - DNA, 20 bp, Artificial
  CRISPR gRNA sequence
cccattgttttatgaacaaa

SEQ ID NO: 660226 - DNA, 20 bp, Artificial
  CRISPR gRNA sequence
ccattgttttatgaacaaat

SEQ ID NO: 660227 - DNA, 20 bp, Artificial
  CRISPR gRNA sequence
ttttatgaacaaatgactaa

SEQ ID NO: 660228 - DNA, 20 bp, Artificial
  CRISPR gRNA sequence
tatgaacaaatgactaaaag

SEQ ID NO: 660229 - DNA, 20 bp, Artificial
  CRISPR gRNA sequence
atgaacaaatgactaaaagg

SEQ ID NO: 660230 - DNA, 20 bp, Artificial
  CRISPR gRNA sequence
tgaacaaatgactaaaagga

SEQ ID NO: 660231 - DNA, 20 bp, Artificial
  CRISPR gRNA sequence
aaaggagagtgaatgaactt

SEQ ID NO: 660232 - DNA, 20 bp, Artificial
  CRISPR gRNA sequence
tcatgaagtggatgggagta

SEQ ID NO: 660233 - DNA, 20 bp, Artificial
  CRISPR gRNA sequence
catgaagtggatgggagtag

SEQ ID NO: 660234 - DNA, 20 bp, Artificial
  CRISPR gRNA sequence
atgaagtggatgggagtagg

SEQ ID NO: 660235 - DNA, 20 bp, Artificial
  CRISPR gRNA sequence
gccttgaagaaagagagatg

SEQ ID NO: 660236 - DNA, 20 bp, Artificial
  CRISPR gRNA sequence
gaagaaagagagatggagtt

SEQ ID NO: 660237 - DNA, 20 bp, Artificial
  CRISPR gRNA sequence
aagaaagagagatggagttg

SEQ ID NO: 660238 - DNA, 20 bp, Artificial
  CRISPR gRNA sequence
gctgctttacctggggaatg

SEQ ID NO: 660239 - DNA, 20 bp, Artificial
  CRISPR gRNA sequence
ctttacctggggaatgaaaa

SEQ ID NO: 660240 - DNA, 20 bp, Artificial
  CRISPR gRNA sequence
tacctggggaatgaaaagag

SEQ ID NO: 660241 - DNA, 20 bp, Artificial
  CRISPR gRNA sequence
acctggggaatgaaaagagg

SEQ ID NO: 660242 - DNA, 20 bp, Artificial
  CRISPR gRNA sequence
cctggggaatgaaaagaggg

SEQ ID NO: 660243 - DNA, 20 bp, Artificial
  CRISPR gRNA sequence
gggaatgaaaagagggagag

SEQ ID NO: 660244 - DNA, 20 bp, Artificial
  CRISPR gRNA sequence
ggctcacataacatgtagtc

SEQ ID NO: 660245 - DNA, 20 bp, Artificial
  CRISPR gRNA sequence
acataacatgtagtctgcct

SEQ ID NO: 660246 - DNA, 20 bp, Artificial
  CRISPR gRNA sequence
ccttcaacagcaaattcttt

SEQ ID NO: 660247 - DNA, 20 bp, Artificial
  CRISPR gRNA sequence
caacagcaaattcttttctc

SEQ ID NO: 660248 - DNA, 20 bp, Artificial
  CRISPR gRNA sequence
aacagcaaattcttttctcc

SEQ ID NO: 660249 - DNA, 20 bp, Artificial
  CRISPR gRNA sequence
ttttctccaaacaaacagat

SEQ ID NO: 660250 - DNA, 20 bp, Artificial
  CRISPR gRNA sequence
ttctccaaacaaacagatac

SEQ ID NO: 660251 - DNA, 20 bp, Artificial
  CRISPR gRNA sequence
tctccaaacaaacagatact

SEQ ID NO: 660252 - DNA, 20 bp, Artificial
  CRISPR gRNA sequence
ctccaaacaaacagatacta

SEQ ID NO: 660253 - DNA, 20 bp, Artificial
  CRISPR gRNA sequence
tccaaacaaacagatactat

SEQ ID NO: 660254 - DNA, 20 bp, Artificial
  CRISPR gRNA sequence
caaacaaacagatactatct

SEQ ID NO: 660255 - DNA, 20 bp, Artificial
  CRISPR gRNA sequence
tctcactaaagtcgaataag

SEQ ID NO: 660256 - DNA, 20 bp, Artificial
  CRISPR gRNA sequence
actaaagtcgaataagtgag

SEQ ID NO: 660257 - DNA, 20 bp, Artificial
  CRISPR gRNA sequence
aagtcgaataagtgagactg

SEQ ID NO: 660258 - DNA, 20 bp, Artificial
  CRISPR gRNA sequence
cttctttctttgccaggtac

SEQ ID NO: 660259 - DNA, 20 bp, Artificial
  CRISPR gRNA sequence
ctttctttgccaggtactta

SEQ ID NO: 660260 - DNA, 20 bp, Artificial
  CRISPR gRNA sequence
tttctttgccaggtacttac

SEQ ID NO: 660261 - DNA, 20 bp, Artificial
  CRISPR gRNA sequence
tctttgccaggtacttactg

SEQ ID NO: 660262 - DNA, 20 bp, Artificial
  CRISPR gRNA sequence
ctttgccaggtacttactga

SEQ ID NO: 660263 - DNA, 20 bp, Artificial
  CRISPR gRNA sequence
tttgccaggtacttactgac

SEQ ID NO: 660264 - DNA, 20 bp, Artificial
  CRISPR gRNA sequence
tgccaggtacttactgacta

SEQ ID NO: 660265 - DNA, 20 bp, Artificial
  CRISPR gRNA sequence
gccaggtacttactgactac

SEQ ID NO: 660266 - DNA, 20 bp, Artificial
  CRISPR gRNA sequence
ccaggtacttactgactact

SEQ ID NO: 660267 - DNA, 20 bp, Artificial
  CRISPR gRNA sequence
actgactactaactaattat

SEQ ID NO: 660268 - DNA, 20 bp, Artificial
  CRISPR gRNA sequence
ctgactactaactaattatt

SEQ ID NO: 660269 - DNA, 20 bp, Artificial
  CRISPR gRNA sequence
actactaactaattattttt

SEQ ID NO: 660270 - DNA, 20 bp, Artificial
  CRISPR gRNA sequence
ctaactaattatttttcttc

SEQ ID NO: 660271 - DNA, 20 bp, Artificial
  CRISPR gRNA sequence
actaattatttttcttctcc

SEQ ID NO: 660272 - DNA, 20 bp, Artificial
  CRISPR gRNA sequence
attatttttcttctccttca

SEQ ID NO: 660273 - DNA, 20 bp, Artificial
  CRISPR gRNA sequence
tttttcttctccttcaagat

SEQ ID NO: 660274 - DNA, 20 bp, Artificial
  CRISPR gRNA sequence
ttcttctccttcaagattgc

SEQ ID NO: 660275 - DNA, 20 bp, Artificial
  CRISPR gRNA sequence
tcttctccttcaagattgct

SEQ ID NO: 660276 - DNA, 20 bp, Artificial
  CRISPR gRNA sequence
cttctccttcaagattgcta

SEQ ID NO: 660277 - DNA, 20 bp, Artificial
  CRISPR gRNA sequence
ttctccttcaagattgctag

SEQ ID NO: 660278 - DNA, 20 bp, Artificial
  CRISPR gRNA sequence
ctccttcaagattgctagta

SEQ ID NO: 660279 - DNA, 20 bp, Artificial
  CRISPR gRNA sequence
tccttcaagattgctagtaa

SEQ ID NO: 660280 - DNA, 20 bp, Artificial
  CRISPR gRNA sequence
cttcaagattgctagtaaag

SEQ ID NO: 660281 - DNA, 20 bp, Artificial
  CRISPR gRNA sequence
caagattgctagtaaaggcc

SEQ ID NO: 660282 - DNA, 20 bp, Artificial
  CRISPR gRNA sequence
aagattgctagtaaaggcca

SEQ ID NO: 660283 - DNA, 20 bp, Artificial
  CRISPR gRNA sequence
ctagtaaaggccaattttaa

SEQ ID NO: 660284 - DNA, 20 bp, Artificial
  CRISPR gRNA sequence
gtaaaggccaattttaatct

SEQ ID NO: 660285 - DNA, 20 bp, Artificial
  CRISPR gRNA sequence
taatctgatatcacatgccc

SEQ ID NO: 660286 - DNA, 20 bp, Artificial
  CRISPR gRNA sequence
aatctgatatcacatgccct

SEQ ID NO: 660287 - DNA, 20 bp, Artificial
  CRISPR gRNA sequence
atctgatatcacatgccctt

SEQ ID NO: 660288 - DNA, 20 bp, Artificial
  CRISPR gRNA sequence
atatcacatgcccttatgca

SEQ ID NO: 660289 - DNA, 20 bp, Artificial
  CRISPR gRNA sequence
atgcacacaggatgtggtag

SEQ ID NO: 660290 - DNA, 20 bp, Artificial
  CRISPR gRNA sequence
tgcacacaggatgtggtagg

SEQ ID NO: 660291 - DNA, 20 bp, Artificial
  CRISPR gRNA sequence
tgaacccgagtctgtagaga

SEQ ID NO: 660292 - DNA, 20 bp, Artificial
  CRISPR gRNA sequence
aacccgagtctgtagagaaa

SEQ ID NO: 660293 - DNA, 20 bp, Artificial
  CRISPR gRNA sequence
tagagaaagccttgcattca

SEQ ID NO: 660294 - DNA, 20 bp, Artificial
  CRISPR gRNA sequence
gcattcagtacccaagtcca

SEQ ID NO: 660295 - DNA, 20 bp, Artificial
  CRISPR gRNA sequence
cattcagtacccaagtccat

SEQ ID NO: 660296 - DNA, 20 bp, Artificial
  CRISPR gRNA sequence
agtacccaagtccattcatc

SEQ ID NO: 660297 - DNA, 20 bp, Artificial
  CRISPR gRNA sequence
atcttggcttcaggcatatt

SEQ ID NO: 660298 - DNA, 20 bp, Artificial
  CRISPR gRNA sequence
ggcttcaggcatattcttat

SEQ ID NO: 660299 - DNA, 20 bp, Artificial
  CRISPR gRNA sequence
gcttcaggcatattcttata

SEQ ID NO: 660300 - DNA, 20 bp, Artificial
  CRISPR gRNA sequence
caggcatattcttataactc

SEQ ID NO: 660301 - DNA, 20 bp, Artificial
  CRISPR gRNA sequence
aggcatattcttataactca

SEQ ID NO: 660302 - DNA, 20 bp, Artificial
  CRISPR gRNA sequence
ttataactcagagctgacta

SEQ ID NO: 660303 - DNA, 20 bp, Artificial
  CRISPR gRNA sequence
ataactcagagctgactaag

SEQ ID NO: 660304 - DNA, 20 bp, Artificial
  CRISPR gRNA sequence
taactcagagctgactaaga

SEQ ID NO: 660305 - DNA, 20 bp, Artificial
  CRISPR gRNA sequence
agagctgactaagatggata

SEQ ID NO: 660306 - DNA, 20 bp, Artificial
  CRISPR gRNA sequence
actaagatggatatgtctgt

SEQ ID NO: 660307 - DNA, 20 bp, Artificial
  CRISPR gRNA sequence
agatggatatgtctgtagct

SEQ ID NO: 660308 - DNA, 20 bp, Artificial
  CRISPR gRNA sequence
tagctgtgcctcatcatagg

SEQ ID NO: 660309 - DNA, 20 bp, Artificial
  CRISPR gRNA sequence
tgcctcatcatagggtagag

SEQ ID NO: 660310 - DNA, 20 bp, Artificial
  CRISPR gRNA sequence
atcatagggtagagtattaa

SEQ ID NO: 660311 - DNA, 20 bp, Artificial
  CRISPR gRNA sequence
atacacaaaattactaggga

SEQ ID NO: 660312 - DNA, 20 bp, Artificial
  CRISPR gRNA sequence
ctagggacttccttatgtgt

SEQ ID NO: 660313 - DNA, 20 bp, Artificial
  CRISPR gRNA sequence
gggacttccttatgtgtgtc

SEQ ID NO: 660314 - DNA, 20 bp, Artificial
  CRISPR gRNA sequence
ccttatgtgtgtcatctgta

SEQ ID NO: 660315 - DNA, 20 bp, Artificial
  CRISPR gRNA sequence
cttatgtgtgtcatctgtaa

SEQ ID NO: 660316 - DNA, 20 bp, Artificial
  CRISPR gRNA sequence
atgtgtgtcatctgtaacag

SEQ ID NO: 660317 - DNA, 20 bp, Artificial
  CRISPR gRNA sequence
tgtgtgtcatctgtaacaga

SEQ ID NO: 660318 - DNA, 20 bp, Artificial
  CRISPR gRNA sequence
taacagaataacaacagaac

SEQ ID NO: 660319 - DNA, 20 bp, Artificial
  CRISPR gRNA sequence
tcttttttttcctccttctc

SEQ ID NO: 660320 - DNA, 20 bp, Artificial
  CRISPR gRNA sequence
cttttttttcctccttctca

SEQ ID NO: 660321 - DNA, 20 bp, Artificial
  CRISPR gRNA sequence
ttttttttcctccttctcat

SEQ ID NO: 660322 - DNA, 20 bp, Artificial
  CRISPR gRNA sequence
ttttttcctccttctcatgt

SEQ ID NO: 660323 - DNA, 20 bp, Artificial
  CRISPR gRNA sequence
tttttcctccttctcatgtt

SEQ ID NO: 660324 - DNA, 20 bp, Artificial
  CRISPR gRNA sequence
ttttcctccttctcatgttt

SEQ ID NO: 660325 - DNA, 20 bp, Artificial
  CRISPR gRNA sequence
tttcctccttctcatgtttc

SEQ ID NO: 660326 - DNA, 20 bp, Artificial
  CRISPR gRNA sequence
ttcctccttctcatgtttct

SEQ ID NO: 660327 - DNA, 20 bp, Artificial
  CRISPR gRNA sequence
tcctccttctcatgtttctt

SEQ ID NO: 660328 - DNA, 20 bp, Artificial
  CRISPR gRNA sequence
cctccttctcatgtttcttg

SEQ ID NO: 660329 - DNA, 20 bp, Artificial
  CRISPR gRNA sequence
ctccttctcatgtttcttgt

SEQ ID NO: 660330 - DNA, 20 bp, Artificial
  CRISPR gRNA sequence
cttctcatgtttcttgtctc

SEQ ID NO: 660331 - DNA, 20 bp, Artificial
  CRISPR gRNA sequence
ctcatgtttcttgtctccca

SEQ ID NO: 660332 - DNA, 20 bp, Artificial
  CRISPR gRNA sequence
tcatgtttcttgtctcccac

SEQ ID NO: 660333 - DNA, 20 bp, Artificial
  CRISPR gRNA sequence
atgtttcttgtctcccacac

SEQ ID NO: 660334 - DNA, 20 bp, Artificial
  CRISPR gRNA sequence
cttgtctcccacactttcat

SEQ ID NO: 660335 - DNA, 20 bp, Artificial
  CRISPR gRNA sequence
ttgtctcccacactttcatc

SEQ ID NO: 660336 - DNA, 20 bp, Artificial
  CRISPR gRNA sequence
gtctcccacactttcatctc

SEQ ID NO: 660337 - DNA, 20 bp, Artificial
  CRISPR gRNA sequence
tctcccacactttcatctct

SEQ ID NO: 660338 - DNA, 20 bp, Artificial
  CRISPR gRNA sequence
ccacactttcatctcttgtt

SEQ ID NO: 660339 - DNA, 20 bp, Artificial
  CRISPR gRNA sequence
tcatctcttgtttatgctgg

SEQ ID NO: 660340 - DNA, 20 bp, Artificial
  CRISPR gRNA sequence
catctcttgtttatgctggc

SEQ ID NO: 660341 - DNA, 20 bp, Artificial
  CRISPR gRNA sequence
atctcttgtttatgctggct

SEQ ID NO: 660342 - DNA, 20 bp, Artificial
  CRISPR gRNA sequence
ttgtttatgctggctcgcag

SEQ ID NO: 660343 - DNA, 20 bp, Artificial
  CRISPR gRNA sequence
gtttatgctggctcgcagca

SEQ ID NO: 660344 - DNA, 20 bp, Artificial
  CRISPR gRNA sequence
tttatgctggctcgcagcat

SEQ ID NO: 660345 - DNA, 20 bp, Artificial
  CRISPR gRNA sequence
atgctggctcgcagcattag

SEQ ID NO: 660346 - DNA, 20 bp, Artificial
  CRISPR gRNA sequence
tgctggctcgcagcattaga

SEQ ID NO: 660347 - DNA, 20 bp, Artificial
  CRISPR gRNA sequence
gctcgcagcattagattttt

SEQ ID NO: 660348 - DNA, 20 bp, Artificial
  CRISPR gRNA sequence
gcagcattagattttttatg

SEQ ID NO: 660349 - DNA, 20 bp, Artificial
  CRISPR gRNA sequence
gattttttatgaaacttcct

SEQ ID NO: 660350 - DNA, 20 bp, Artificial
  CRISPR gRNA sequence
tttatgaaacttcctctgac

SEQ ID NO: 660351 - DNA, 20 bp, Artificial
  CRISPR gRNA sequence
ttatgaaacttcctctgact

SEQ ID NO: 660352 - DNA, 20 bp, Artificial
  CRISPR gRNA sequence
tatgaaacttcctctgacta

SEQ ID NO: 660353 - DNA, 20 bp, Artificial
  CRISPR gRNA sequence
atgaaacttcctctgactaa

SEQ ID NO: 660354 - DNA, 20 bp, Artificial
  CRISPR gRNA sequence
tgaaacttcctctgactaaa

SEQ ID NO: 660355 - DNA, 20 bp, Artificial
  CRISPR gRNA sequence
cctctgactaaagttaggga

SEQ ID NO: 660356 - DNA, 20 bp, Artificial
  CRISPR gRNA sequence
ctctgactaaagttagggaa

SEQ ID NO: 660357 - DNA, 20 bp, Artificial
  CRISPR gRNA sequence
tgactaaagttagggaaatt

SEQ ID NO: 660358 - DNA, 20 bp, Artificial
  CRISPR gRNA sequence
actaaagttagggaaatttg

SEQ ID NO: 660359 - DNA, 20 bp, Artificial
  CRISPR gRNA sequence
aagttagggaaatttgtttc

SEQ ID NO: 660360 - DNA, 20 bp, Artificial
  CRISPR gRNA sequence
gggaaatttgtttcatctca

SEQ ID NO: 660361 - DNA, 20 bp, Artificial
  CRISPR gRNA sequence
gtttcatctcagtcatttgc

SEQ ID NO: 660362 - DNA, 20 bp, Artificial
  CRISPR gRNA sequence
tttcatctcagtcatttgct

SEQ ID NO: 660363 - DNA, 20 bp, Artificial
  CRISPR gRNA sequence
catctcagtcatttgctctt

SEQ ID NO: 660364 - DNA, 20 bp, Artificial
  CRISPR gRNA sequence
atctcagtcatttgctcttt

SEQ ID NO: 660365 - DNA, 20 bp, Artificial
  CRISPR gRNA sequence
agtcatttgctctttgtcga

SEQ ID NO: 660366 - DNA, 20 bp, Artificial
  CRISPR gRNA sequence
gctctttgtcgagctgacct

SEQ ID NO: 660367 - DNA, 20 bp, Artificial
  CRISPR gRNA sequence
ctctttgtcgagctgaccta

SEQ ID NO: 660368 - DNA, 20 bp, Artificial
  CRISPR gRNA sequence
tttgtcgagctgacctattt

SEQ ID NO: 660369 - DNA, 20 bp, Artificial
  CRISPR gRNA sequence
tgtcgagctgacctatttca

SEQ ID NO: 660370 - DNA, 20 bp, Artificial
  CRISPR gRNA sequence
gtcgagctgacctatttcat

SEQ ID NO: 660371 - DNA, 20 bp, Artificial
  CRISPR gRNA sequence
tcgagctgacctatttcatt

SEQ ID NO: 660372 - DNA, 20 bp, Artificial
  CRISPR gRNA sequence
acctatttcattaaaaaaaa

SEQ ID NO: 660373 - DNA, 20 bp, Artificial
  CRISPR gRNA sequence
tttcattaaaaaaaatgagg

SEQ ID NO: 660374 - DNA, 20 bp, Artificial
  CRISPR gRNA sequence
cattaaaaaaaatgaggttg

SEQ ID NO: 660375 - DNA, 20 bp, Artificial
  CRISPR gRNA sequence
attaaaaaaaatgaggttgt

SEQ ID NO: 660376 - DNA, 20 bp, Artificial
  CRISPR gRNA sequence
aaaaaaatgaggttgtggta

SEQ ID NO: 660377 - DNA, 20 bp, Artificial
  CRISPR gRNA sequence
tggtaggatgagtacttaga

SEQ ID NO: 660378 - DNA, 20 bp, Artificial
  CRISPR gRNA sequence
agaatgcaggaagggggcat

SEQ ID NO: 660379 - DNA, 20 bp, Artificial
  CRISPR gRNA sequence
gaatgcaggaagggggcatg

SEQ ID NO: 660380 - DNA, 20 bp, Artificial
  CRISPR gRNA sequence
gcaaaggttatacagatagg

SEQ ID NO: 660381 - DNA, 20 bp, Artificial
  CRISPR gRNA sequence
tacagatagggctggcttta

SEQ ID NO: 660382 - DNA, 20 bp, Artificial
  CRISPR gRNA sequence
gctttagagaattacctatg

SEQ ID NO: 660383 - DNA, 20 bp, Artificial
  CRISPR gRNA sequence
tagagaattacctatgaatt

SEQ ID NO: 660384 - DNA, 20 bp, Artificial
  CRISPR gRNA sequence
agagaattacctatgaattg

SEQ ID NO: 660385 - DNA, 20 bp, Artificial
  CRISPR gRNA sequence
gagaattacctatgaattgt

SEQ ID NO: 660386 - DNA, 20 bp, Artificial
  CRISPR gRNA sequence
cctatgaattgttttggggc

SEQ ID NO: 660387 - DNA, 20 bp, Artificial
  CRISPR gRNA sequence
tgaattgttttggggcccct

SEQ ID NO: 660388 - DNA, 20 bp, Artificial
  CRISPR gRNA sequence
ttttggggccccttttacta

SEQ ID NO: 660389 - DNA, 20 bp, Artificial
  CRISPR gRNA sequence
tggggccccttttactattc

SEQ ID NO: 660390 - DNA, 20 bp, Artificial
  CRISPR gRNA sequence
ggggccccttttactattct

SEQ ID NO: 660391 - DNA, 20 bp, Artificial
  CRISPR gRNA sequence
gggccccttttactattctt

SEQ ID NO: 660392 - DNA, 20 bp, Artificial
  CRISPR gRNA sequence
ttactattctttttttcttt

SEQ ID NO: 660393 - DNA, 20 bp, Artificial
  CRISPR gRNA sequence
tactattctttttttctttc

SEQ ID NO: 660394 - DNA, 20 bp, Artificial
  CRISPR gRNA sequence
actattctttttttctttct

SEQ ID NO: 660395 - DNA, 20 bp, Artificial
  CRISPR gRNA sequence
ctattctttttttctttctt

SEQ ID NO: 660396 - DNA, 20 bp, Artificial
  CRISPR gRNA sequence
ttctttttttctttcttagc

SEQ ID NO: 660397 - DNA, 20 bp, Artificial
  CRISPR gRNA sequence
tttttttctttcttagcact

SEQ ID NO: 660398 - DNA, 20 bp, Artificial
  CRISPR gRNA sequence
tttttctttcttagcacttc

SEQ ID NO: 660399 - DNA, 20 bp, Artificial
  CRISPR gRNA sequence
ttttctttcttagcacttcc

SEQ ID NO: 660400 - DNA, 20 bp, Artificial
  CRISPR gRNA sequence
tttctttcttagcacttcca

SEQ ID NO: 660401 - DNA, 20 bp, Artificial
  CRISPR gRNA sequence
ttctttcttagcacttccat

SEQ ID NO: 660402 - DNA, 20 bp, Artificial
  CRISPR gRNA sequence
tctttcttagcacttccatt

SEQ ID NO: 660403 - DNA, 20 bp, Artificial
  CRISPR gRNA sequence
ctttcttagcacttccattt

SEQ ID NO: 660404 - DNA, 20 bp, Artificial
  CRISPR gRNA sequence
tttcttagcacttccatttg

SEQ ID NO: 660405 - DNA, 20 bp, Artificial
  CRISPR gRNA sequence
tcttagcacttccatttgca

SEQ ID NO: 660406 - DNA, 20 bp, Artificial
  CRISPR gRNA sequence
cttagcacttccatttgcaa

SEQ ID NO: 660407 - DNA, 20 bp, Artificial
  CRISPR gRNA sequence
ttagcacttccatttgcaaa

SEQ ID NO: 660408 - DNA, 20 bp, Artificial
  CRISPR gRNA sequence
agcacttccatttgcaaacc

SEQ ID NO: 660409 - DNA, 20 bp, Artificial
  CRISPR gRNA sequence
gcacttccatttgcaaaccc

SEQ ID NO: 660410 - DNA, 20 bp, Artificial
  CRISPR gRNA sequence
ccatttgcaaacccacttcc

SEQ ID NO: 660411 - DNA, 20 bp, Artificial
  CRISPR gRNA sequence
catttgcaaacccacttccc

SEQ ID NO: 660412 - DNA, 20 bp, Artificial
  CRISPR gRNA sequence
gcaaacccacttcccttgtg

SEQ ID NO: 660413 - DNA, 20 bp, Artificial
  CRISPR gRNA sequence
caaacccacttcccttgtgg

SEQ ID NO: 660414 - DNA, 20 bp, Artificial
  CRISPR gRNA sequence
cccttgtggtacttgcttgt

SEQ ID NO: 660415 - DNA, 20 bp, Artificial
  CRISPR gRNA sequence
ccttgtggtacttgcttgtt

SEQ ID NO: 660416 - DNA, 20 bp, Artificial
  CRISPR gRNA sequence
gtggtacttgcttgttgctt

SEQ ID NO: 660417 - DNA, 20 bp, Artificial
  CRISPR gRNA sequence
tggtacttgcttgttgcttc

SEQ ID NO: 660418 - DNA, 20 bp, Artificial
  CRISPR gRNA sequence
gcttgttgcttcactgtcct

SEQ ID NO: 660419 - DNA, 20 bp, Artificial
  CRISPR gRNA sequence
cttgttgcttcactgtcctg

SEQ ID NO: 660420 - DNA, 20 bp, Artificial
  CRISPR gRNA sequence
gttgcttcactgtcctgctc

SEQ ID NO: 660421 - DNA, 20 bp, Artificial
  CRISPR gRNA sequence
ttgcttcactgtcctgctca

SEQ ID NO: 660422 - DNA, 20 bp, Artificial
  CRISPR gRNA sequence
cttcactgtcctgctcagtc

SEQ ID NO: 660423 - DNA, 20 bp, Artificial
  CRISPR gRNA sequence
cactgtcctgctcagtcctg

SEQ ID NO: 660424 - DNA, 20 bp, Artificial
  CRISPR gRNA sequence
actgtcctgctcagtcctgc

SEQ ID NO: 660425 - DNA, 20 bp, Artificial
  CRISPR gRNA sequence
tcctgctcagtcctgcctgc

SEQ ID NO: 660426 - DNA, 20 bp, Artificial
  CRISPR gRNA sequence
ctcagtcctgcctgcctttc

SEQ ID NO: 660427 - DNA, 20 bp, Artificial
  CRISPR gRNA sequence
agtcctgcctgcctttcagg

SEQ ID NO: 660428 - DNA, 20 bp, Artificial
  CRISPR gRNA sequence
cctgcctttcagggttgcgt

SEQ ID NO: 660429 - DNA, 20 bp, Artificial
  CRISPR gRNA sequence
cctttcagggttgcgtgatt

SEQ ID NO: 660430 - DNA, 20 bp, Artificial
  CRISPR gRNA sequence
tcagggttgcgtgattctga

SEQ ID NO: 660431 - DNA, 20 bp, Artificial
  CRISPR gRNA sequence
cagggttgcgtgattctgat

SEQ ID NO: 660432 - DNA, 20 bp, Artificial
  CRISPR gRNA sequence
agggttgcgtgattctgata

SEQ ID NO: 660433 - DNA, 20 bp, Artificial
  CRISPR gRNA sequence
cgtgattctgatacgtgtct

SEQ ID NO: 660434 - DNA, 20 bp, Artificial
  CRISPR gRNA sequence
tgatacgtgtcttcacaatc

SEQ ID NO: 660435 - DNA, 20 bp, Artificial
  CRISPR gRNA sequence
atacgtgtcttcacaatctt

SEQ ID NO: 660436 - DNA, 20 bp, Artificial
  CRISPR gRNA sequence
cacaatctttctttattcaa

SEQ ID NO: 660437 - DNA, 20 bp, Artificial
  CRISPR gRNA sequence
acaatctttctttattcaaa

SEQ ID NO: 660438 - DNA, 20 bp, Artificial
  CRISPR gRNA sequence
tctttattcaaaccaaaacc

SEQ ID NO: 660439 - DNA, 20 bp, Artificial
  CRISPR gRNA sequence
ctttattcaaaccaaaacct

SEQ ID NO: 660440 - DNA, 20 bp, Artificial
  CRISPR gRNA sequence
tttattcaaaccaaaacctg

SEQ ID NO: 660441 - DNA, 20 bp, Artificial
  CRISPR gRNA sequence
tattcaaaccaaaacctgtc

SEQ ID NO: 660442 - DNA, 20 bp, Artificial
  CRISPR gRNA sequence
attcaaaccaaaacctgtct

SEQ ID NO: 660443 - DNA, 20 bp, Artificial
  CRISPR gRNA sequence
ttcaaaccaaaacctgtctg

SEQ ID NO: 660444 - DNA, 20 bp, Artificial
  CRISPR gRNA sequence
aaaccaaaacctgtctgtgg

SEQ ID NO: 660445 - DNA, 20 bp, Artificial
  CRISPR gRNA sequence
tctgtggacactaggaaccc

SEQ ID NO: 660446 - DNA, 20 bp, Artificial
  CRISPR gRNA sequence
tggacactaggaaccctttc

SEQ ID NO: 660447 - DNA, 20 bp, Artificial
  CRISPR gRNA sequence
ggaaccctttccccagcttt

SEQ ID NO: 660448 - DNA, 20 bp, Artificial
  CRISPR gRNA sequence
tccccagctttccatcctgt

SEQ ID NO: 660449 - DNA, 20 bp, Artificial
  CRISPR gRNA sequence
ccccagctttccatcctgtc

SEQ ID NO: 660450 - DNA, 20 bp, Artificial
  CRISPR gRNA sequence
cccagctttccatcctgtca

SEQ ID NO: 660451 - DNA, 20 bp, Artificial
  CRISPR gRNA sequence
tccatcctgtcatagaacaa

SEQ ID NO: 660452 - DNA, 20 bp, Artificial
  CRISPR gRNA sequence
ccatcctgtcatagaacaat

SEQ ID NO: 660453 - DNA, 20 bp, Artificial
  CRISPR gRNA sequence
catcctgtcatagaacaatt

SEQ ID NO: 660454 - DNA, 20 bp, Artificial
  CRISPR gRNA sequence
tcatagaacaattcaagtaa

SEQ ID NO: 660455 - DNA, 20 bp, Artificial
  CRISPR gRNA sequence
aagtaaatgaattcaagcta

SEQ ID NO: 660456 - DNA, 20 bp, Artificial
  CRISPR gRNA sequence
aagctaaggtttttgagact

SEQ ID NO: 660457 - DNA, 20 bp, Artificial
  CRISPR gRNA sequence
aggtttttgagactgacata

SEQ ID NO: 660458 - DNA, 20 bp, Artificial
  CRISPR gRNA sequence
ttgagactgacatagtttaa

SEQ ID NO: 660459 - DNA, 20 bp, Artificial
  CRISPR gRNA sequence
tgagactgacatagtttaat

SEQ ID NO: 660460 - DNA, 20 bp, Artificial
  CRISPR gRNA sequence
gagactgacatagtttaata

SEQ ID NO: 660461 - DNA, 20 bp, Artificial
  CRISPR gRNA sequence
agactgacatagtttaatag

SEQ ID NO: 660462 - DNA, 20 bp, Artificial
  CRISPR gRNA sequence
acatagtttaatagattact

SEQ ID NO: 660463 - DNA, 20 bp, Artificial
  CRISPR gRNA sequence
aatagattactgttgtttta

SEQ ID NO: 660464 - DNA, 20 bp, Artificial
  CRISPR gRNA sequence
atagattactgttgttttat

SEQ ID NO: 660465 - DNA, 20 bp, Artificial
  CRISPR gRNA sequence
ctgttgttttatagtggcat

SEQ ID NO: 660466 - DNA, 20 bp, Artificial
  CRISPR gRNA sequence
ttgttttatagtggcataaa

SEQ ID NO: 660467 - DNA, 20 bp, Artificial
  CRISPR gRNA sequence
ttttatagtggcataaatgc

SEQ ID NO: 660468 - DNA, 20 bp, Artificial
  CRISPR gRNA sequence
tatagtggcataaatgcttt

SEQ ID NO: 660469 - DNA, 20 bp, Artificial
  CRISPR gRNA sequence
atagtggcataaatgcttta

SEQ ID NO: 660470 - DNA, 20 bp, Artificial
  CRISPR gRNA sequence
tagtggcataaatgctttaa

SEQ ID NO: 660471 - DNA, 20 bp, Artificial
  CRISPR gRNA sequence
taatagagatgtctctagaa

SEQ ID NO: 660472 - DNA, 20 bp, Artificial
  CRISPR gRNA sequence
aatagagatgtctctagaaa

SEQ ID NO: 660473 - DNA, 20 bp, Artificial
  CRISPR gRNA sequence
atagagatgtctctagaaat

SEQ ID NO: 660474 - DNA, 20 bp, Artificial
  CRISPR gRNA sequence
tagaaattggttcccaagcc

SEQ ID NO: 660475 - DNA, 20 bp, Artificial
  CRISPR gRNA sequence
gaaattggttcccaagccat

SEQ ID NO: 660476 - DNA, 20 bp, Artificial
  CRISPR gRNA sequence
gttcccaagccatagtagta

SEQ ID NO: 660477 - DNA, 20 bp, Artificial
  CRISPR gRNA sequence
ccaagccatagtagtaaatt

SEQ ID NO: 660478 - DNA, 20 bp, Artificial
  CRISPR gRNA sequence
ctgataatggagatttcagg

SEQ ID NO: 660479 - DNA, 20 bp, Artificial
  CRISPR gRNA sequence
tgataatggagatttcaggt

SEQ ID NO: 660480 - DNA, 20 bp, Artificial
  CRISPR gRNA sequence
ataatggagatttcaggtac

SEQ ID NO: 660481 - DNA, 20 bp, Artificial
  CRISPR gRNA sequence
caggtaccagattatgctgg

SEQ ID NO: 660482 - DNA, 20 bp, Artificial
  CRISPR gRNA sequence
aggtaccagattatgctgga

SEQ ID NO: 660483 - DNA, 20 bp, Artificial
  CRISPR gRNA sequence
tgctggagggtatggagaag

SEQ ID NO: 660484 - DNA, 20 bp, Artificial
  CRISPR gRNA sequence
gagggtatggagaagaagtt

SEQ ID NO: 660485 - DNA, 20 bp, Artificial
  CRISPR gRNA sequence
gggagagtgattatttttct

SEQ ID NO: 660486 - DNA, 20 bp, Artificial
  CRISPR gRNA sequence
ggagagtgattatttttctt

SEQ ID NO: 660487 - DNA, 20 bp, Artificial
  CRISPR gRNA sequence
tttttcttttgttttctgtc

SEQ ID NO: 660488 - DNA, 20 bp, Artificial
  CRISPR gRNA sequence
ttcttttgttttctgtcaaa

SEQ ID NO: 660489 - DNA, 20 bp, Artificial
  CRISPR gRNA sequence
tcttttgttttctgtcaaat

SEQ ID NO: 660490 - DNA, 20 bp, Artificial
  CRISPR gRNA sequence
cttttgttttctgtcaaatt

SEQ ID NO: 660491 - DNA, 20 bp, Artificial
  CRISPR gRNA sequence
ttttgttttctgtcaaatta

SEQ ID NO: 660492 - DNA, 20 bp, Artificial
  CRISPR gRNA sequence
ttgttttctgtcaaattaat

SEQ ID NO: 660493 - DNA, 20 bp, Artificial
  CRISPR gRNA sequence
tgttttctgtcaaattaata

SEQ ID NO: 660494 - DNA, 20 bp, Artificial
  CRISPR gRNA sequence
gttttctgtcaaattaatac

SEQ ID NO: 660495 - DNA, 20 bp, Artificial
  CRISPR gRNA sequence
ttttctgtcaaattaatacc

SEQ ID NO: 660496 - DNA, 20 bp, Artificial
  CRISPR gRNA sequence
tctgtcaaattaataccatt

SEQ ID NO: 660497 - DNA, 20 bp, Artificial
  CRISPR gRNA sequence
ctgtcaaattaataccatta

SEQ ID NO: 660498 - DNA, 20 bp, Artificial
  CRISPR gRNA sequence
tgtcaaattaataccattaa

SEQ ID NO: 660499 - DNA, 20 bp, Artificial
  CRISPR gRNA sequence
tcaaattaataccattaaag

SEQ ID NO: 660500 - DNA, 20 bp, Artificial
  CRISPR gRNA sequence
ataccattaaagtaactgtc

SEQ ID NO: 660501 - DNA, 20 bp, Artificial
  CRISPR gRNA sequence
aagtaactgtctttgcagcc

SEQ ID NO: 660502 - DNA, 20 bp, Artificial
  CRISPR gRNA sequence
tctttgcagcccaaaggtag

SEQ ID NO: 660503 - DNA, 20 bp, Artificial
  CRISPR gRNA sequence
tgcagcccaaaggtagtacc

SEQ ID NO: 660504 - DNA, 20 bp, Artificial
  CRISPR gRNA sequence
gcagcccaaaggtagtacca

SEQ ID NO: 660505 - DNA, 20 bp, Artificial
  CRISPR gRNA sequence
cagcccaaaggtagtaccag

SEQ ID NO: 660506 - DNA, 20 bp, Artificial
  CRISPR gRNA sequence
agtagagactcttttttcac

SEQ ID NO: 660507 - DNA, 20 bp, Artificial
  CRISPR gRNA sequence
ttttttcacaagcacaaaat

SEQ ID NO: 660508 - DNA, 20 bp, Artificial
  CRISPR gRNA sequence
ttttcacaagcacaaaatat

SEQ ID NO: 660509 - DNA, 20 bp, Artificial
  CRISPR gRNA sequence
tttcacaagcacaaaatatt

SEQ ID NO: 660510 - DNA, 20 bp, Artificial
  CRISPR gRNA sequence
ttcacaagcacaaaatatta

SEQ ID NO: 660511 - DNA, 20 bp, Artificial
  CRISPR gRNA sequence
tcacaagcacaaaatattag

SEQ ID NO: 660512 - DNA, 20 bp, Artificial
  CRISPR gRNA sequence
cacaagcacaaaatattagc

SEQ ID NO: 660513 - DNA, 20 bp, Artificial
  CRISPR gRNA sequence
acaagcacaaaatattagca

SEQ ID NO: 660514 - DNA, 20 bp, Artificial
  CRISPR gRNA sequence
gcactgatgactgactttgt

SEQ ID NO: 660515 - DNA, 20 bp, Artificial
  CRISPR gRNA sequence
atgactgactttgtagttac

SEQ ID NO: 660516 - DNA, 20 bp, Artificial
  CRISPR gRNA sequence
actttgtagttacaaaagtg

SEQ ID NO: 660517 - DNA, 20 bp, Artificial
  CRISPR gRNA sequence
tgtagttacaaaagtgttag

SEQ ID NO: 660518 - DNA, 20 bp, Artificial
  CRISPR gRNA sequence
gtagttacaaaagtgttaga

SEQ ID NO: 660519 - DNA, 20 bp, Artificial
  CRISPR gRNA sequence
tagttacaaaagtgttagag

SEQ ID NO: 660520 - DNA, 20 bp, Artificial
  CRISPR gRNA sequence
caaaagtgttagagaatatt

SEQ ID NO: 660521 - DNA, 20 bp, Artificial
  CRISPR gRNA sequence
gagaatattagaatctgaaa

SEQ ID NO: 660522 - DNA, 20 bp, Artificial
  CRISPR gRNA sequence
gaatctgaaagtgactcttt

SEQ ID NO: 660523 - DNA, 20 bp, Artificial
  CRISPR gRNA sequence
aaagtgactctttggccatt

SEQ ID NO: 660524 - DNA, 20 bp, Artificial
  CRISPR gRNA sequence
tttggccattcgttgaccct

SEQ ID NO: 660525 - DNA, 20 bp, Artificial
  CRISPR gRNA sequence
tggccattcgttgaccctgt

SEQ ID NO: 660526 - DNA, 20 bp, Artificial
  CRISPR gRNA sequence
ggccattcgttgaccctgtt

SEQ ID NO: 660527 - DNA, 20 bp, Artificial
  CRISPR gRNA sequence
gccattcgttgaccctgttc

SEQ ID NO: 660528 - DNA, 20 bp, Artificial
  CRISPR gRNA sequence
gttgaccctgttccaaaaat

SEQ ID NO: 660529 - DNA, 20 bp, Artificial
  CRISPR gRNA sequence
accctgttccaaaaattttt

SEQ ID NO: 660530 - DNA, 20 bp, Artificial
  CRISPR gRNA sequence
ttccaaaaatttttctggga

SEQ ID NO: 660531 - DNA, 20 bp, Artificial
  CRISPR gRNA sequence
caaaaatttttctgggaaaa

SEQ ID NO: 660532 - DNA, 20 bp, Artificial
  CRISPR gRNA sequence
ttctgggaaaaaaagtttta

SEQ ID NO: 660533 - DNA, 20 bp, Artificial
  CRISPR gRNA sequence
tctgggaaaaaaagttttag

SEQ ID NO: 660534 - DNA, 20 bp, Artificial
  CRISPR gRNA sequence
ctgggaaaaaaagttttagg

SEQ ID NO: 660535 - DNA, 20 bp, Artificial
  CRISPR gRNA sequence
tgggaaaaaaagttttaggt

SEQ ID NO: 660536 - DNA, 20 bp, Artificial
  CRISPR gRNA sequence
ggaaaaaaagttttaggtgg

SEQ ID NO: 660537 - DNA, 20 bp, Artificial
  CRISPR gRNA sequence
taggtggcatctgtaaagct

SEQ ID NO: 660538 - DNA, 20 bp, Artificial
  CRISPR gRNA sequence
aggtggcatctgtaaagcta

SEQ ID NO: 660539 - DNA, 20 bp, Artificial
  CRISPR gRNA sequence
ggtggcatctgtaaagctaa

SEQ ID NO: 660540 - DNA, 20 bp, Artificial
  CRISPR gRNA sequence
taaagctaaacaagaacttt

SEQ ID NO: 660541 - DNA, 20 bp, Artificial
  CRISPR gRNA sequence
aacaagaactttgattaata

SEQ ID NO: 660542 - DNA, 20 bp, Artificial
  CRISPR gRNA sequence
tgattaatattctttcaact

SEQ ID NO: 660543 - DNA, 20 bp, Artificial
  CRISPR gRNA sequence
gattaatattctttcaactg

SEQ ID NO: 660544 - DNA, 20 bp, Artificial
  CRISPR gRNA sequence
attaatattctttcaactgc

SEQ ID NO: 660545 - DNA, 20 bp, Artificial
  CRISPR gRNA sequence
atattctttcaactgccttt

SEQ ID NO: 660546 - DNA, 20 bp, Artificial
  CRISPR gRNA sequence
tttcaactgccttttcagtt

SEQ ID NO: 660547 - DNA, 20 bp, Artificial
  CRISPR gRNA sequence
tcaactgccttttcagtttg

SEQ ID NO: 660548 - DNA, 20 bp, Artificial
  CRISPR gRNA sequence
caactgccttttcagtttgt

SEQ ID NO: 660549 - DNA, 20 bp, Artificial
  CRISPR gRNA sequence
aactgccttttcagtttgtt

SEQ ID NO: 660550 - DNA, 20 bp, Artificial
  CRISPR gRNA sequence
ccttttcagtttgttagagt

SEQ ID NO: 660551 - DNA, 20 bp, Artificial
  CRISPR gRNA sequence
ttcagtttgttagagttagt

SEQ ID NO: 660552 - DNA, 20 bp, Artificial
  CRISPR gRNA sequence
tcagtttgttagagttagtg

SEQ ID NO: 660553 - DNA, 20 bp, Artificial
  CRISPR gRNA sequence
cagtttgttagagttagtgt

SEQ ID NO: 660554 - DNA, 20 bp, Artificial
  CRISPR gRNA sequence
agtttgttagagttagtgtt

SEQ ID NO: 660555 - DNA, 20 bp, Artificial
  CRISPR gRNA sequence
gttagagttagtgtttttta

SEQ ID NO: 660556 - DNA, 20 bp, Artificial
  CRISPR gRNA sequence
ttagagttagtgttttttac

SEQ ID NO: 660557 - DNA, 20 bp, Artificial
  CRISPR gRNA sequence
gagttagtgttttttacttt

SEQ ID NO: 660558 - DNA, 20 bp, Artificial
  CRISPR gRNA sequence
gtgttttttacttttgtttt

SEQ ID NO: 660559 - DNA, 20 bp, Artificial
  CRISPR gRNA sequence
tttacttttgttttgtttta

SEQ ID NO: 660560 - DNA, 20 bp, Artificial
  CRISPR gRNA sequence
ttacttttgttttgttttaa

SEQ ID NO: 660561 - DNA, 20 bp, Artificial
  CRISPR gRNA sequence
tacttttgttttgttttaat

SEQ ID NO: 660562 - DNA, 20 bp, Artificial
  CRISPR gRNA sequence
acttttgttttgttttaata

SEQ ID NO: 660563 - DNA, 20 bp, Artificial
  CRISPR gRNA sequence
cttttgttttgttttaatat

SEQ ID NO: 660564 - DNA, 20 bp, Artificial
  CRISPR gRNA sequence
ttgttttgttttaatataag

SEQ ID NO: 660565 - DNA, 20 bp, Artificial
  CRISPR gRNA sequence
tgttttgttttaatataagg

SEQ ID NO: 660566 - DNA, 20 bp, Artificial
  CRISPR gRNA sequence
gttttgttttaatataagga

SEQ ID NO: 660567 - DNA, 20 bp, Artificial
  CRISPR gRNA sequence
ttttgttttaatataaggaa

SEQ ID NO: 660568 - DNA, 20 bp, Artificial
  CRISPR gRNA sequence
tgttttaatataaggaactt

SEQ ID NO: 660569 - DNA, 20 bp, Artificial
  CRISPR gRNA sequence
gttttaatataaggaacttc

SEQ ID NO: 660570 - DNA, 20 bp, Artificial
  CRISPR gRNA sequence
ttttaatataaggaacttct

SEQ ID NO: 660571 - DNA, 20 bp, Artificial
  CRISPR gRNA sequence
taatataaggaacttctagt

SEQ ID NO: 660572 - DNA, 20 bp, Artificial
  CRISPR gRNA sequence
aatataaggaacttctagtt

SEQ ID NO: 660573 - DNA, 20 bp, Artificial
  CRISPR gRNA sequence
atataaggaacttctagtta

SEQ ID NO: 660574 - DNA, 20 bp, Artificial
  CRISPR gRNA sequence
ctagttatagttttacaaat

SEQ ID NO: 660575 - DNA, 20 bp, Artificial
  CRISPR gRNA sequence
tagttatagttttacaaata

SEQ ID NO: 660576 - DNA, 20 bp, Artificial
  CRISPR gRNA sequence
gttatagttttacaaatata

SEQ ID NO: 660577 - DNA, 20 bp, Artificial
  CRISPR gRNA sequence
tagttttacaaatatagaac

SEQ ID NO: 660578 - DNA, 20 bp, Artificial
  CRISPR gRNA sequence
tacaaatatagaacacattt

SEQ ID NO: 660579 - DNA, 20 bp, Artificial
  CRISPR gRNA sequence
acaaatatagaacacattta

SEQ ID NO: 660580 - DNA, 20 bp, Artificial
  CRISPR gRNA sequence
caaatatagaacacatttac

SEQ ID NO: 660581 - DNA, 20 bp, Artificial
  CRISPR gRNA sequence
acaaatgtctttaaatacca

SEQ ID NO: 660582 - DNA, 20 bp, Artificial
  CRISPR gRNA sequence
caaatgtctttaaataccac

SEQ ID NO: 660583 - DNA, 20 bp, Artificial
  CRISPR gRNA sequence
taaataccacataacatata

SEQ ID NO: 660584 - DNA, 20 bp, Artificial
  CRISPR gRNA sequence
aaataccacataacatatac

SEQ ID NO: 660585 - DNA, 20 bp, Artificial
  CRISPR gRNA sequence
aataccacataacatatact

SEQ ID NO: 660586 - DNA, 20 bp, Artificial
  CRISPR gRNA sequence
gatagtcttagaacagagcc

SEQ ID NO: 660587 - DNA, 20 bp, Artificial
  CRISPR gRNA sequence
agaacagagccctccaccta

SEQ ID NO: 660588 - DNA, 20 bp, Artificial
  CRISPR gRNA sequence
gaacagagccctccacctag

SEQ ID NO: 660589 - DNA, 20 bp, Artificial
  CRISPR gRNA sequence
cacctagctagtctcttctg

SEQ ID NO: 660590 - DNA, 20 bp, Artificial
  CRISPR gRNA sequence
gctagtctcttctggataag

SEQ ID NO: 660591 - DNA, 20 bp, Artificial
  CRISPR gRNA sequence
gtctcttctggataagcagt

SEQ ID NO: 660592 - DNA, 20 bp, Artificial
  CRISPR gRNA sequence
ttctggataagcagttctca

SEQ ID NO: 660593 - DNA, 20 bp, Artificial
  CRISPR gRNA sequence
ctggataagcagttctcagt

SEQ ID NO: 660594 - DNA, 20 bp, Artificial
  CRISPR gRNA sequence
tggataagcagttctcagtc

SEQ ID NO: 660595 - DNA, 20 bp, Artificial
  CRISPR gRNA sequence
gataagcagttctcagtcat

SEQ ID NO: 660596 - DNA, 20 bp, Artificial
  CRISPR gRNA sequence
tcagtcatgtgtagtgttga

SEQ ID NO: 660597 - DNA, 20 bp, Artificial
  CRISPR gRNA sequence
agtcatgtgtagtgttgaaa

SEQ ID NO: 660598 - DNA, 20 bp, Artificial
  CRISPR gRNA sequence
aaaaggtgtgctcatttaat

SEQ ID NO: 660599 - DNA, 20 bp, Artificial
  CRISPR gRNA sequence
atttaattatttccacagtt

SEQ ID NO: 660600 - DNA, 20 bp, Artificial
  CRISPR gRNA sequence
aattatttccacagttgtca

SEQ ID NO: 660601 - DNA, 20 bp, Artificial
  CRISPR gRNA sequence
attatttccacagttgtcaa

SEQ ID NO: 660602 - DNA, 20 bp, Artificial
  CRISPR gRNA sequence
tttccacagttgtcaaacct

SEQ ID NO: 660603 - DNA, 20 bp, Artificial
  CRISPR gRNA sequence
ccacagttgtcaaacctctg

SEQ ID NO: 660604 - DNA, 20 bp, Artificial
  CRISPR gRNA sequence
cacagttgtcaaacctctgc

SEQ ID NO: 660605 - DNA, 20 bp, Artificial
  CRISPR gRNA sequence
tcaaacctctgccatggaaa

SEQ ID NO: 660606 - DNA, 20 bp, Artificial
  CRISPR gRNA sequence
tgccatggaaaagaatttca

SEQ ID NO: 660607 - DNA, 20 bp, Artificial
  CRISPR gRNA sequence
ccatggaaaagaatttcaac

SEQ ID NO: 660608 - DNA, 20 bp, Artificial
  CRISPR gRNA sequence
caaccattttgataaagccc

SEQ ID NO: 660609 - DNA, 20 bp, Artificial
  CRISPR gRNA sequence
aaccattttgataaagcccc

SEQ ID NO: 660610 - DNA, 20 bp, Artificial
  CRISPR gRNA sequence
tgataaagcccctataaaac

SEQ ID NO: 660611 - DNA, 20 bp, Artificial
  CRISPR gRNA sequence
gataaagcccctataaaacc

SEQ ID NO: 660612 - DNA, 20 bp, Artificial
  CRISPR gRNA sequence
ataaagcccctataaaacca

SEQ ID NO: 660613 - DNA, 20 bp, Artificial
  CRISPR gRNA sequence
taaaaccacagcttctaaat

SEQ ID NO: 660614 - DNA, 20 bp, Artificial
  CRISPR gRNA sequence
ctaaatatccttaaaaatgg

SEQ ID NO: 660615 - DNA, 20 bp, Artificial
  CRISPR gRNA sequence
taaatatccttaaaaatgga

SEQ ID NO: 660616 - DNA, 20 bp, Artificial
  CRISPR gRNA sequence
aatatccttaaaaatggaaa

SEQ ID NO: 660617 - DNA, 20 bp, Artificial
  CRISPR gRNA sequence
aaaaatggaaagccacaggt

SEQ ID NO: 660618 - DNA, 20 bp, Artificial
  CRISPR gRNA sequence
aaaatggaaagccacaggta

SEQ ID NO: 660619 - DNA, 20 bp, Artificial
  CRISPR gRNA sequence
tgcaaaaatataccaagtgt

SEQ ID NO: 660620 - DNA, 20 bp, Artificial
  CRISPR gRNA sequence
gcaaaaatataccaagtgtt

SEQ ID NO: 660621 - DNA, 20 bp, Artificial
  CRISPR gRNA sequence
caaaaatataccaagtgttt

SEQ ID NO: 660622 - DNA, 20 bp, Artificial
  CRISPR gRNA sequence
ctattgtggtgtccaattca

SEQ ID NO: 660623 - DNA, 20 bp, Artificial
  CRISPR gRNA sequence
tattgtggtgtccaattcac

SEQ ID NO: 660624 - DNA, 20 bp, Artificial
  CRISPR gRNA sequence
ttgtggtgtccaattcactt

SEQ ID NO: 660625 - DNA, 20 bp, Artificial
  CRISPR gRNA sequence
tggtgtccaattcacttatt

SEQ ID NO: 660626 - DNA, 20 bp, Artificial
  CRISPR gRNA sequence
acttattctagaatagaagg

SEQ ID NO: 660627 - DNA, 20 bp, Artificial
  CRISPR gRNA sequence
attctagaatagaaggaaag

SEQ ID NO: 660628 - DNA, 20 bp, Artificial
  CRISPR gRNA sequence
ttctagaatagaaggaaagc

SEQ ID NO: 660629 - DNA, 20 bp, Artificial
  CRISPR gRNA sequence
tagaatagaaggaaagcctg

SEQ ID NO: 660630 - DNA, 20 bp, Artificial
  CRISPR gRNA sequence
gaatagaaggaaagcctggt

SEQ ID NO: 660631 - DNA, 20 bp, Artificial
  CRISPR gRNA sequence
gtgtgttggaagacagagta

SEQ ID NO: 660632 - DNA, 20 bp, Artificial
  CRISPR gRNA sequence
gaagacagagtaaaaagtca

SEQ ID NO: 660633 - DNA, 20 bp, Artificial
  CRISPR gRNA sequence
atgtaacagagattgtcttt

SEQ ID NO: 660634 - DNA, 20 bp, Artificial
  CRISPR gRNA sequence
tcttttaagtccatttataa

SEQ ID NO: 660635 - DNA, 20 bp, Artificial
  CRISPR gRNA sequence
ttaagtccatttataagccg

SEQ ID NO: 660636 - DNA, 20 bp, Artificial
  CRISPR gRNA sequence
taagtccatttataagccgt

SEQ ID NO: 660637 - DNA, 20 bp, Artificial
  CRISPR gRNA sequence
aagtccatttataagccgtc

SEQ ID NO: 660638 - DNA, 20 bp, Artificial
  CRISPR gRNA sequence
agtccatttataagccgtct

SEQ ID NO: 660639 - DNA, 20 bp, Artificial
  CRISPR gRNA sequence
ataagccgtctctctttttt

SEQ ID NO: 660640 - DNA, 20 bp, Artificial
  CRISPR gRNA sequence
taagccgtctctcttttttt

SEQ ID NO: 660641 - DNA, 20 bp, Artificial
  CRISPR gRNA sequence
tctttttttaatgagaatgc

SEQ ID NO: 660642 - DNA, 20 bp, Artificial
  CRISPR gRNA sequence
tttttttaatgagaatgcct

SEQ ID NO: 660643 - DNA, 20 bp, Artificial
  CRISPR gRNA sequence
tttttaatgagaatgccttt

SEQ ID NO: 660644 - DNA, 20 bp, Artificial
  CRISPR gRNA sequence
ttttaatgagaatgcctttt

SEQ ID NO: 660645 - DNA, 20 bp, Artificial
  CRISPR gRNA sequence
tttaatgagaatgccttttt

SEQ ID NO: 660646 - DNA, 20 bp, Artificial
  CRISPR gRNA sequence
ttaatgagaatgcctttttg

SEQ ID NO: 660647 - DNA, 20 bp, Artificial
  CRISPR gRNA sequence
taatgagaatgcctttttgt

SEQ ID NO: 660648 - DNA, 20 bp, Artificial
  CRISPR gRNA sequence
aatgagaatgcctttttgtt

SEQ ID NO: 660649 - DNA, 20 bp, Artificial
  CRISPR gRNA sequence
atgagaatgcctttttgttc

SEQ ID NO: 660650 - DNA, 20 bp, Artificial
  CRISPR gRNA sequence
tttgttctgtatcctgatta

SEQ ID NO: 660651 - DNA, 20 bp, Artificial
  CRISPR gRNA sequence
ttgttctgtatcctgattat

SEQ ID NO: 660652 - DNA, 20 bp, Artificial
  CRISPR gRNA sequence
tgttctgtatcctgattatg

SEQ ID NO: 660653 - DNA, 20 bp, Artificial
  CRISPR gRNA sequence
gttctgtatcctgattatgg

SEQ ID NO: 660654 - DNA, 20 bp, Artificial
  CRISPR gRNA sequence
ttctgtatcctgattatggt

SEQ ID NO: 660655 - DNA, 20 bp, Artificial
  CRISPR gRNA sequence
tgtatcctgattatggtagt

SEQ ID NO: 660656 - DNA, 20 bp, Artificial
  CRISPR gRNA sequence
tatcctgattatggtagtgg

SEQ ID NO: 660657 - DNA, 20 bp, Artificial
  CRISPR gRNA sequence
attatggtagtggttataag

SEQ ID NO: 660658 - DNA, 20 bp, Artificial
  CRISPR gRNA sequence
tggtagtggttataagaatc

SEQ ID NO: 660659 - DNA, 20 bp, Artificial
  CRISPR gRNA sequence
taagaatctatgcatgttgt

SEQ ID NO: 660660 - DNA, 20 bp, Artificial
  CRISPR gRNA sequence
tgcatgttgtagaactgaat

SEQ ID NO: 660661 - DNA, 20 bp, Artificial
  CRISPR gRNA sequence
tagaactgaatgctaaaagg

SEQ ID NO: 660662 - DNA, 20 bp, Artificial
  CRISPR gRNA sequence
aatgctaaaaggaaaaaaat

SEQ ID NO: 660663 - DNA, 20 bp, Artificial
  CRISPR gRNA sequence
aaaggaaaaaaatgctcatg

SEQ ID NO: 660664 - DNA, 20 bp, Artificial
  CRISPR gRNA sequence
atgttttttgtatgacaact

SEQ ID NO: 660665 - DNA, 20 bp, Artificial
  CRISPR gRNA sequence
tttgtatgacaactttaaaa

SEQ ID NO: 660666 - DNA, 20 bp, Artificial
  CRISPR gRNA sequence
ttgtatgacaactttaaaaa

SEQ ID NO: 660667 - DNA, 20 bp, Artificial
  CRISPR gRNA sequence
tgtatgacaactttaaaaat

SEQ ID NO: 660668 - DNA, 20 bp, Artificial
  CRISPR gRNA sequence
gtatgacaactttaaaaata

SEQ ID NO: 660669 - DNA, 20 bp, Artificial
  CRISPR gRNA sequence
tatgacaactttaaaaataa

SEQ ID NO: 660670 - DNA, 20 bp, Artificial
  CRISPR gRNA sequence
taaaaataaaatgaaggggt

SEQ ID NO: 660671 - DNA, 20 bp, Artificial
  CRISPR gRNA sequence
aaaaataaaatgaaggggtt

SEQ ID NO: 660672 - DNA, 20 bp, Artificial
  CRISPR gRNA sequence
aaaataaaatgaaggggtta

SEQ ID NO: 660673 - DNA, 20 bp, Artificial
  CRISPR gRNA sequence
aagaatgtccttttcacttg

SEQ ID NO: 660674 - DNA, 20 bp, Artificial
  CRISPR gRNA sequence
ttcacttgaaacactgctaa

SEQ ID NO: 660675 - DNA, 20 bp, Artificial
  CRISPR gRNA sequence
tcacttgaaacactgctaaa

SEQ ID NO: 660676 - DNA, 20 bp, Artificial
  CRISPR gRNA sequence
cacttgaaacactgctaaaa

SEQ ID NO: 660677 - DNA, 20 bp, Artificial
  CRISPR gRNA sequence
acttgaaacactgctaaaaa

SEQ ID NO: 660678 - DNA, 20 bp, Artificial
  CRISPR gRNA sequence
gaaacactgctaaaaatggt

SEQ ID NO: 660679 - DNA, 20 bp, Artificial
  CRISPR gRNA sequence
aaacactgctaaaaatggtg

SEQ ID NO: 660680 - DNA, 20 bp, Artificial
  CRISPR gRNA sequence
ctaaaaatggtggttaaatt

SEQ ID NO: 660681 - DNA, 20 bp, Artificial
  CRISPR gRNA sequence
aaaatggtggttaaattcca

SEQ ID NO: 660682 - DNA, 20 bp, Artificial
  CRISPR gRNA sequence
aattccattgaaagaaacaa

SEQ ID NO: 660683 - DNA, 20 bp, Artificial
  CRISPR gRNA sequence
cattgaaagaaacaacaata

SEQ ID NO: 660684 - DNA, 20 bp, Artificial
  CRISPR gRNA sequence
aaagaaacaacaataaaaag

SEQ ID NO: 660685 - DNA, 20 bp, Artificial
  CRISPR gRNA sequence
agttaatgtggcaattgtag

SEQ ID NO: 660686 - DNA, 20 bp, Artificial
  CRISPR gRNA sequence
gttaatgtggcaattgtagt

SEQ ID NO: 660687 - DNA, 20 bp, Artificial
  CRISPR gRNA sequence
atgtggcaattgtagtaggg

SEQ ID NO: 660688 - DNA, 20 bp, Artificial
  CRISPR gRNA sequence
tagtagggttaatagtatta

SEQ ID NO: 660689 - DNA, 20 bp, Artificial
  CRISPR gRNA sequence
atagtattatacaaactaac

SEQ ID NO: 660690 - DNA, 20 bp, Artificial
  CRISPR gRNA sequence
tacaaactaacactatgagg

SEQ ID NO: 660691 - DNA, 20 bp, Artificial
  CRISPR gRNA sequence
acactatgaggaaatacatt

SEQ ID NO: 660692 - DNA, 20 bp, Artificial
  CRISPR gRNA sequence
tgaggaaatacattttaaat

SEQ ID NO: 660693 - DNA, 20 bp, Artificial
  CRISPR gRNA sequence
taaatcacaaatcagaactt

SEQ ID NO: 660694 - DNA, 20 bp, Artificial
  CRISPR gRNA sequence
aaatcacaaatcagaacttg

SEQ ID NO: 660695 - DNA, 20 bp, Artificial
  CRISPR gRNA sequence
aatcacaaatcagaacttgg

SEQ ID NO: 660696 - DNA, 20 bp, Artificial
  CRISPR gRNA sequence
gggaaatacactttcccctg

SEQ ID NO: 660697 - DNA, 20 bp, Artificial
  CRISPR gRNA sequence
ggaaatacactttcccctgt

SEQ ID NO: 660698 - DNA, 20 bp, Artificial
  CRISPR gRNA sequence
tcccctgttcattgtcaaga

SEQ ID NO: 660699 - DNA, 20 bp, Artificial
  CRISPR gRNA sequence
cccctgttcattgtcaagag

SEQ ID NO: 660700 - DNA, 20 bp, Artificial
  CRISPR gRNA sequence
ccctgttcattgtcaagagt

SEQ ID NO: 660701 - DNA, 20 bp, Artificial
  CRISPR gRNA sequence
ttcattgtcaagagtgggaa

SEQ ID NO: 660702 - DNA, 20 bp, Artificial
  CRISPR gRNA sequence
attgtcaagagtgggaaacg

SEQ ID NO: 660703 - DNA, 20 bp, Artificial
  CRISPR gRNA sequence
tcaagagtgggaaacggaag

SEQ ID NO: 660704 - DNA, 20 bp, Artificial
  CRISPR gRNA sequence
taattagccttctggtgcaa

SEQ ID NO: 660705 - DNA, 20 bp, Artificial
  CRISPR gRNA sequence
gccttctggtgcaagtggca

SEQ ID NO: 660706 - DNA, 20 bp, Artificial
  CRISPR gRNA sequence
ctggtgcaagtggcaataaa

SEQ ID NO: 660707 - DNA, 20 bp, Artificial
  CRISPR gRNA sequence
tggtgcaagtggcaataaat

SEQ ID NO: 660708 - DNA, 20 bp, Artificial
  CRISPR gRNA sequence
gtgcaagtggcaataaatgc

SEQ ID NO: 660709 - DNA, 20 bp, Artificial
  CRISPR gRNA sequence
cagtgactgcagtgatggat

SEQ ID NO: 660710 - DNA, 20 bp, Artificial
  CRISPR gRNA sequence
cagtgatggatgtagggact

SEQ ID NO: 660711 - DNA, 20 bp, Artificial
  CRISPR gRNA sequence
aggatcagaatttgaagagg

SEQ ID NO: 660712 - DNA, 20 bp, Artificial
  CRISPR gRNA sequence
gaagagggtagacctagagt

SEQ ID NO: 660713 - DNA, 20 bp, Artificial
  CRISPR gRNA sequence
aagagggtagacctagagta

SEQ ID NO: 660714 - DNA, 20 bp, Artificial
  CRISPR gRNA sequence
gagtaattgttagagcccct

SEQ ID NO: 660715 - DNA, 20 bp, Artificial
  CRISPR gRNA sequence
ttagagcccctgcccttagc

SEQ ID NO: 660716 - DNA, 20 bp, Artificial
  CRISPR gRNA sequence
gagcccctgcccttagcaga

SEQ ID NO: 660717 - DNA, 20 bp, Artificial
  CRISPR gRNA sequence
cccttagcagagcatgtctt

SEQ ID NO: 660718 - DNA, 20 bp, Artificial
  CRISPR gRNA sequence
agcagagcatgtcttgactg

SEQ ID NO: 660719 - DNA, 20 bp, Artificial
  CRISPR gRNA sequence
gcagagcatgtcttgactgt

SEQ ID NO: 660720 - DNA, 20 bp, Artificial
  CRISPR gRNA sequence
gactgttgtgcagttagcag

SEQ ID NO: 660721 - DNA, 20 bp, Artificial
  CRISPR gRNA sequence
actgttgtgcagttagcagc

SEQ ID NO: 660722 - DNA, 20 bp, Artificial
  CRISPR gRNA sequence
ttgtgcagttagcagctcct

SEQ ID NO: 660723 - DNA, 20 bp, Artificial
  CRISPR gRNA sequence
tgcagttagcagctccttgt

SEQ ID NO: 660724 - DNA, 20 bp, Artificial
  CRISPR gRNA sequence
gcagctccttgtgcctagca

SEQ ID NO: 660725 - DNA, 20 bp, Artificial
  CRISPR gRNA sequence
cttgtgcctagcattttttc

SEQ ID NO: 660726 - DNA, 20 bp, Artificial
  CRISPR gRNA sequence
gtgcctagcattttttctgg

SEQ ID NO: 660727 - DNA, 20 bp, Artificial
  CRISPR gRNA sequence
tgcctagcattttttctgga

SEQ ID NO: 660728 - DNA, 20 bp, Artificial
  CRISPR gRNA sequence
gcattttttctggagtaggt

SEQ ID NO: 660729 - DNA, 20 bp, Artificial
  CRISPR gRNA sequence
tttctggagtaggtgttcaa

SEQ ID NO: 660730 - DNA, 20 bp, Artificial
  CRISPR gRNA sequence
ttctggagtaggtgttcaat

SEQ ID NO: 660731 - DNA, 20 bp, Artificial
  CRISPR gRNA sequence
tctggagtaggtgttcaata

SEQ ID NO: 660732 - DNA, 20 bp, Artificial
  CRISPR gRNA sequence
ctggagtaggtgttcaataa

SEQ ID NO: 660733 - DNA, 20 bp, Artificial
  CRISPR gRNA sequence
tggagtaggtgttcaataac

SEQ ID NO: 660734 - DNA, 20 bp, Artificial
  CRISPR gRNA sequence
gagtaggtgttcaataacta

SEQ ID NO: 660735 - DNA, 20 bp, Artificial
  CRISPR gRNA sequence
aataactactgattaaattc

SEQ ID NO: 660736 - DNA, 20 bp, Artificial
  CRISPR gRNA sequence
ctgattaaattctggggcct

SEQ ID NO: 660737 - DNA, 20 bp, Artificial
  CRISPR gRNA sequence
attaaattctggggcctagg

SEQ ID NO: 660738 - DNA, 20 bp, Artificial
  CRISPR gRNA sequence
aattctggggcctaggttca

SEQ ID NO: 660739 - DNA, 20 bp, Artificial
  CRISPR gRNA sequence
tggggcctaggttcaaatct

SEQ ID NO: 660740 - DNA, 20 bp, Artificial
  CRISPR gRNA sequence
gggcctaggttcaaatcttg

SEQ ID NO: 660741 - DNA, 20 bp, Artificial
  CRISPR gRNA sequence
ggttcaaatcttggctctac

SEQ ID NO: 660742 - DNA, 20 bp, Artificial
  CRISPR gRNA sequence
aaatcttggctctacttacc

SEQ ID NO: 660743 - DNA, 20 bp, Artificial
  CRISPR gRNA sequence
ggctctacttaccagctatg

SEQ ID NO: 660744 - DNA, 20 bp, Artificial
  CRISPR gRNA sequence
gctctacttaccagctatgt

SEQ ID NO: 660745 - DNA, 20 bp, Artificial
  CRISPR gRNA sequence
tacttaccagctatgtgatc

SEQ ID NO: 660746 - DNA, 20 bp, Artificial
  CRISPR gRNA sequence
cttaccagctatgtgatctt

SEQ ID NO: 660747 - DNA, 20 bp, Artificial
  CRISPR gRNA sequence
accagctatgtgatcttgga

SEQ ID NO: 660748 - DNA, 20 bp, Artificial
  CRISPR gRNA sequence
ccagctatgtgatcttggat

SEQ ID NO: 660749 - DNA, 20 bp, Artificial
  CRISPR gRNA sequence
tgtgatcttggatatgttac

SEQ ID NO: 660750 - DNA, 20 bp, Artificial
  CRISPR gRNA sequence
ggatatgttacttaacctct

SEQ ID NO: 660751 - DNA, 20 bp, Artificial
  CRISPR gRNA sequence
gatatgttacttaacctctc

SEQ ID NO: 660752 - DNA, 20 bp, Artificial
  CRISPR gRNA sequence
cttaacctctccatgcctca

SEQ ID NO: 660753 - DNA, 20 bp, Artificial
  CRISPR gRNA sequence
aacctctccatgcctcattc

SEQ ID NO: 660754 - DNA, 20 bp, Artificial
  CRISPR gRNA sequence
acctctccatgcctcattcc

SEQ ID NO: 660755 - DNA, 20 bp, Artificial
  CRISPR gRNA sequence
tccatgcctcattcctctca

SEQ ID NO: 660756 - DNA, 20 bp, Artificial
  CRISPR gRNA sequence
catgcctcattcctctcagc

SEQ ID NO: 660757 - DNA, 20 bp, Artificial
  CRISPR gRNA sequence
attcctctcagccctaaagg

SEQ ID NO: 660758 - DNA, 20 bp, Artificial
  CRISPR gRNA sequence
ctctcagccctaaagggttg

SEQ ID NO: 660759 - DNA, 20 bp, Artificial
  CRISPR gRNA sequence
tcagccctaaagggttgaag

SEQ ID NO: 660760 - DNA, 20 bp, Artificial
  CRISPR gRNA sequence
agccctaaagggttgaagaa

SEQ ID NO: 660761 - DNA, 20 bp, Artificial
  CRISPR gRNA sequence
aagggttgaagaacatctct

SEQ ID NO: 660762 - DNA, 20 bp, Artificial
  CRISPR gRNA sequence
aagaacatctctctcataag

SEQ ID NO: 660763 - DNA, 20 bp, Artificial
  CRISPR gRNA sequence
tctcataaggctgttgggag

SEQ ID NO: 660764 - DNA, 20 bp, Artificial
  CRISPR gRNA sequence
tcataaggctgttgggagaa

SEQ ID NO: 660765 - DNA, 20 bp, Artificial
  CRISPR gRNA sequence
ataaggctgttgggagaatt

SEQ ID NO: 660766 - DNA, 20 bp, Artificial
  CRISPR gRNA sequence
ttgggagaattaaatgatat

SEQ ID NO: 660767 - DNA, 20 bp, Artificial
  CRISPR gRNA sequence
ggagaattaaatgatattaa

SEQ ID NO: 660768 - DNA, 20 bp, Artificial
  CRISPR gRNA sequence
aatgatattaagcttttaaa

SEQ ID NO: 660769 - DNA, 20 bp, Artificial
  CRISPR gRNA sequence
agcttttaaatctcttagca

SEQ ID NO: 660770 - DNA, 20 bp, Artificial
  CRISPR gRNA sequence
ttaaatctcttagcaaagta

SEQ ID NO: 660771 - DNA, 20 bp, Artificial
  CRISPR gRNA sequence
taaatctcttagcaaagtat

SEQ ID NO: 660772 - DNA, 20 bp, Artificial
  CRISPR gRNA sequence
aaatctcttagcaaagtatg

SEQ ID NO: 660773 - DNA, 20 bp, Artificial
  CRISPR gRNA sequence
aatctcttagcaaagtatgg

SEQ ID NO: 660774 - DNA, 20 bp, Artificial
  CRISPR gRNA sequence
ttagcaaagtatggagcata

SEQ ID NO: 660775 - DNA, 20 bp, Artificial
  CRISPR gRNA sequence
agcaaagtatggagcatata

SEQ ID NO: 660776 - DNA, 20 bp, Artificial
  CRISPR gRNA sequence
gcaaagtatggagcatataa

SEQ ID NO: 660777 - DNA, 20 bp, Artificial
  CRISPR gRNA sequence
caataaatgtgagatatgat

SEQ ID NO: 660778 - DNA, 20 bp, Artificial
  CRISPR gRNA sequence
ttcagtaactgtgggttgaa

SEQ ID NO: 660779 - DNA, 20 bp, Artificial
  CRISPR gRNA sequence
agtaactgtgggttgaatgg

SEQ ID NO: 660780 - DNA, 20 bp, Artificial
  CRISPR gRNA sequence
tgggttgaatggcagtatct

SEQ ID NO: 660781 - DNA, 20 bp, Artificial
  CRISPR gRNA sequence
aatggcagtatctcgtaagg

SEQ ID NO: 660782 - DNA, 20 bp, Artificial
  CRISPR gRNA sequence
gtaaggcttgtgttggagag

SEQ ID NO: 660783 - DNA, 20 bp, Artificial
  CRISPR gRNA sequence
gtgttggagaggcagtgttg

SEQ ID NO: 660784 - DNA, 20 bp, Artificial
  CRISPR gRNA sequence
tgttggagaggcagtgttga

SEQ ID NO: 660785 - DNA, 20 bp, Artificial
  CRISPR gRNA sequence
gagaggcagtgttgaatgac

SEQ ID NO: 660786 - DNA, 20 bp, Artificial
  CRISPR gRNA sequence
aatgacagttgctcctttca

SEQ ID NO: 660787 - DNA, 20 bp, Artificial
  CRISPR gRNA sequence
ctcctttcagtgctggtctg

SEQ ID NO: 660788 - DNA, 20 bp, Artificial
  CRISPR gRNA sequence
ctttcagtgctggtctgttt

SEQ ID NO: 660789 - DNA, 20 bp, Artificial
  CRISPR gRNA sequence
tcagtgctggtctgtttatt

SEQ ID NO: 660790 - DNA, 20 bp, Artificial
  CRISPR gRNA sequence
cagtgctggtctgtttattg

SEQ ID NO: 660791 - DNA, 20 bp, Artificial
  CRISPR gRNA sequence
agtgctggtctgtttattgg

SEQ ID NO: 660792 - DNA, 20 bp, Artificial
  CRISPR gRNA sequence
gtctgtttattggggtcagg

SEQ ID NO: 660793 - DNA, 20 bp, Artificial
  CRISPR gRNA sequence
tttattggggtcaggagttt

SEQ ID NO: 660794 - DNA, 20 bp, Artificial
  CRISPR gRNA sequence
attggggtcaggagtttttg

SEQ ID NO: 660795 - DNA, 20 bp, Artificial
  CRISPR gRNA sequence
ttggggtcaggagtttttgt

SEQ ID NO: 660796 - DNA, 20 bp, Artificial
  CRISPR gRNA sequence
gggtcaggagtttttgtgaa

SEQ ID NO: 660797 - DNA, 20 bp, Artificial
  CRISPR gRNA sequence
ttgtgaaattaatttctttc

SEQ ID NO: 660798 - DNA, 20 bp, Artificial
  CRISPR gRNA sequence
tgtgaaattaatttctttcg

SEQ ID NO: 660799 - DNA, 20 bp, Artificial
  CRISPR gRNA sequence
gtgaaattaatttctttcgc

SEQ ID NO: 660800 - DNA, 20 bp, Artificial
  CRISPR gRNA sequence
tgaaattaatttctttcgct

SEQ ID NO: 660801 - DNA, 20 bp, Artificial
  CRISPR gRNA sequence
atttctttcgctgttcagca

SEQ ID NO: 660802 - DNA, 20 bp, Artificial
  CRISPR gRNA sequence
ctttcgctgttcagcacaga

SEQ ID NO: 660803 - DNA, 20 bp, Artificial
  CRISPR gRNA sequence
tttcgctgttcagcacagaa

SEQ ID NO: 660804 - DNA, 20 bp, Artificial
  CRISPR gRNA sequence
tcgctgttcagcacagaata

SEQ ID NO: 660805 - DNA, 20 bp, Artificial
  CRISPR gRNA sequence
cgctgttcagcacagaatac

SEQ ID NO: 660806 - DNA, 20 bp, Artificial
  CRISPR gRNA sequence
gctgttcagcacagaatact

SEQ ID NO: 660807 - DNA, 20 bp, Artificial
  CRISPR gRNA sequence
ttcagcacagaatactcaga

SEQ ID NO: 660808 - DNA, 20 bp, Artificial
  CRISPR gRNA sequence
agcacagaatactcagatgc

SEQ ID NO: 660809 - DNA, 20 bp, Artificial
  CRISPR gRNA sequence
agatgcctaatattttaata

SEQ ID NO: 660810 - DNA, 20 bp, Artificial
  CRISPR gRNA sequence
atattttaatatttgtttct

SEQ ID NO: 660811 - DNA, 20 bp, Artificial
  CRISPR gRNA sequence
taatatttgtttcttctctt

SEQ ID NO: 660812 - DNA, 20 bp, Artificial
  CRISPR gRNA sequence
aatatttgtttcttctcttc

SEQ ID NO: 660813 - DNA, 20 bp, Artificial
  CRISPR gRNA sequence
atatttgtttcttctcttcc

SEQ ID NO: 660814 - DNA, 20 bp, Artificial
  CRISPR gRNA sequence
gtttcttctcttccttatgt

SEQ ID NO: 660815 - DNA, 20 bp, Artificial
  CRISPR gRNA sequence
tttcttctcttccttatgta

SEQ ID NO: 660816 - DNA, 20 bp, Artificial
  CRISPR gRNA sequence
cttctcttccttatgtacct

SEQ ID NO: 660817 - DNA, 20 bp, Artificial
  CRISPR gRNA sequence
ttctcttccttatgtacctc

SEQ ID NO: 660818 - DNA, 20 bp, Artificial
  CRISPR gRNA sequence
ctcttccttatgtacctcaa

SEQ ID NO: 660819 - DNA, 20 bp, Artificial
  CRISPR gRNA sequence
tcttccttatgtacctcaaa

SEQ ID NO: 660820 - DNA, 20 bp, Artificial
  CRISPR gRNA sequence
ttccttatgtacctcaaatt

SEQ ID NO: 660821 - DNA, 20 bp, Artificial
  CRISPR gRNA sequence
ccttatgtacctcaaattct

SEQ ID NO: 660822 - DNA, 20 bp, Artificial
  CRISPR gRNA sequence
cttatgtacctcaaattctg

SEQ ID NO: 660823 - DNA, 20 bp, Artificial
  CRISPR gRNA sequence
atgtacctcaaattctgggc

SEQ ID NO: 660824 - DNA, 20 bp, Artificial
  CRISPR gRNA sequence
tgtacctcaaattctgggct

SEQ ID NO: 660825 - DNA, 20 bp, Artificial
  CRISPR gRNA sequence
aaattctgggctttttacct

SEQ ID NO: 660826 - DNA, 20 bp, Artificial
  CRISPR gRNA sequence
tgggctttttacctacggaa

SEQ ID NO: 660827 - DNA, 20 bp, Artificial
  CRISPR gRNA sequence
ggctttttacctacggaatt

SEQ ID NO: 660828 - DNA, 20 bp, Artificial
  CRISPR gRNA sequence
tttacctacggaattttacc

SEQ ID NO: 660829 - DNA, 20 bp, Artificial
  CRISPR gRNA sequence
ttacctacggaattttaccc

SEQ ID NO: 660830 - DNA, 20 bp, Artificial
  CRISPR gRNA sequence
tacctacggaattttaccct

SEQ ID NO: 660831 - DNA, 20 bp, Artificial
  CRISPR gRNA sequence
acctacggaattttacccta

SEQ ID NO: 660832 - DNA, 20 bp, Artificial
  CRISPR gRNA sequence
cctacggaattttaccctaa

SEQ ID NO: 660833 - DNA, 20 bp, Artificial
  CRISPR gRNA sequence
cggaattttaccctaagtgc

SEQ ID NO: 660834 - DNA, 20 bp, Artificial
  CRISPR gRNA sequence
taccctaagtgctgttgagt

SEQ ID NO: 660835 - DNA, 20 bp, Artificial
  CRISPR gRNA sequence
accctaagtgctgttgagta

SEQ ID NO: 660836 - DNA, 20 bp, Artificial
  CRISPR gRNA sequence
ccctaagtgctgttgagtac

SEQ ID NO: 660837 - DNA, 20 bp, Artificial
  CRISPR gRNA sequence
agtgctgttgagtacaaatt

SEQ ID NO: 660838 - DNA, 20 bp, Artificial
  CRISPR gRNA sequence
ttgagtacaaattacgaggt

SEQ ID NO: 660839 - DNA, 20 bp, Artificial
  CRISPR gRNA sequence
agtacaaattacgaggtaca

SEQ ID NO: 660840 - DNA, 20 bp, Artificial
  CRISPR gRNA sequence
cgaggtacaacagttagatg

SEQ ID NO: 660841 - DNA, 20 bp, Artificial
  CRISPR gRNA sequence
gatgaattttttataatatg

SEQ ID NO: 660842 - DNA, 20 bp, Artificial
  CRISPR gRNA sequence
tttataatatgggttacttt

SEQ ID NO: 660843 - DNA, 20 bp, Artificial
  CRISPR gRNA sequence
ttataatatgggttactttt

SEQ ID NO: 660844 - DNA, 20 bp, Artificial
  CRISPR gRNA sequence
tataatatgggttacttttt

SEQ ID NO: 660845 - DNA, 20 bp, Artificial
  CRISPR gRNA sequence
ataatatgggttactttttc

SEQ ID NO: 660846 - DNA, 20 bp, Artificial
  CRISPR gRNA sequence
taatatgggttactttttcc

SEQ ID NO: 660847 - DNA, 20 bp, Artificial
  CRISPR gRNA sequence
ctttttccaaattgtgatta

SEQ ID NO: 660848 - DNA, 20 bp, Artificial
  CRISPR gRNA sequence
tttccaaattgtgattattg

SEQ ID NO: 660849 - DNA, 20 bp, Artificial
  CRISPR gRNA sequence
ttccaaattgtgattattgg

SEQ ID NO: 660850 - DNA, 20 bp, Artificial
  CRISPR gRNA sequence
tccaaattgtgattattgga

SEQ ID NO: 660851 - DNA, 20 bp, Artificial
  CRISPR gRNA sequence
ccaaattgtgattattggat

SEQ ID NO: 660852 - DNA, 20 bp, Artificial
  CRISPR gRNA sequence
caaattgtgattattggatg

SEQ ID NO: 660853 - DNA, 20 bp, Artificial
  CRISPR gRNA sequence
tgattattggatgtgaaaat

SEQ ID NO: 660854 - DNA, 20 bp, Artificial
  CRISPR gRNA sequence
ttggatgtgaaaattgtgat

SEQ ID NO: 660855 - DNA, 20 bp, Artificial
  CRISPR gRNA sequence
gatgtgaaaattgtgatttt

SEQ ID NO: 660856 - DNA, 20 bp, Artificial
  CRISPR gRNA sequence
tgatttttataaattatatt

SEQ ID NO: 660857 - DNA, 20 bp, Artificial
  CRISPR gRNA sequence
ttataaattatattttaatg

SEQ ID NO: 660858 - DNA, 20 bp, Artificial
  CRISPR gRNA sequence
tataaattatattttaatga

SEQ ID NO: 660859 - DNA, 20 bp, Artificial
  CRISPR gRNA sequence
ataaattatattttaatgat

SEQ ID NO: 660860 - DNA, 20 bp, Artificial
  CRISPR gRNA sequence
taaattatattttaatgata

SEQ ID NO: 660861 - DNA, 20 bp, Artificial
  CRISPR gRNA sequence
tattttaatgatatatgttt

SEQ ID NO: 660862 - DNA, 20 bp, Artificial
  CRISPR gRNA sequence
taatgatatatgttttttaa

SEQ ID NO: 660863 - DNA, 20 bp, Artificial
  CRISPR gRNA sequence
aatgatatatgttttttaat

SEQ ID NO: 660864 - DNA, 20 bp, Artificial
  CRISPR gRNA sequence
atgatatatgttttttaata

SEQ ID NO: 660865 - DNA, 20 bp, Artificial
  CRISPR gRNA sequence
tttaataaacatttttgata

SEQ ID NO: 660866 - DNA, 20 bp, Artificial
  CRISPR gRNA sequence
ttaataaacatttttgatag

SEQ ID NO: 660867 - DNA, 20 bp, Artificial
  CRISPR gRNA sequence
taataaacatttttgataga

SEQ ID NO: 660868 - DNA, 20 bp, Artificial
  CRISPR gRNA sequence
aataaacatttttgatagaa

SEQ ID NO: 660869 - DNA, 20 bp, Artificial
  CRISPR gRNA sequence
ataaacatttttgatagaat

SEQ ID NO: 660870 - DNA, 20 bp, Artificial
  CRISPR gRNA sequence
ttgatagaatgaatgcaggt

SEQ ID NO: 660871 - DNA, 20 bp, Artificial
  CRISPR gRNA sequence
tgatagaatgaatgcaggtt

SEQ ID NO: 660872 - DNA, 20 bp, Artificial
  CRISPR gRNA sequence
gatagaatgaatgcaggtta

SEQ ID NO: 660873 - DNA, 20 bp, Artificial
  CRISPR gRNA sequence
atagaatgaatgcaggttaa

SEQ ID NO: 660874 - DNA, 20 bp, Artificial
  CRISPR gRNA sequence
attaaggagaaggggaacat

SEQ ID NO: 660875 - DNA, 20 bp, Artificial
  CRISPR gRNA sequence
aggagaaggggaacatgcac

SEQ ID NO: 660876 - DNA, 20 bp, Artificial
  CRISPR gRNA sequence
aagcagtcataattgtacat

SEQ ID NO: 660877 - DNA, 20 bp, Artificial
  CRISPR gRNA sequence
tacattcagagccaattacc

SEQ ID NO: 660878 - DNA, 20 bp, Artificial
  CRISPR gRNA sequence
agagccaattaccatacaaa

SEQ ID NO: 660879 - DNA, 20 bp, Artificial
  CRISPR gRNA sequence
ccatacaaaatgataatagc

SEQ ID NO: 660880 - DNA, 20 bp, Artificial
  CRISPR gRNA sequence
ttgtgtgtgagacagggtct

SEQ ID NO: 660881 - DNA, 20 bp, Artificial
  CRISPR gRNA sequence
tgtgtgtgagacagggtctc

SEQ ID NO: 660882 - DNA, 20 bp, Artificial
  CRISPR gRNA sequence
gtgtgtgagacagggtctca

SEQ ID NO: 660883 - DNA, 20 bp, Artificial
  CRISPR gRNA sequence
tgtgtgagacagggtctcac

SEQ ID NO: 660884 - DNA, 20 bp, Artificial
  CRISPR gRNA sequence
actctgtcacccaggcttga

SEQ ID NO: 660885 - DNA, 20 bp, Artificial
  CRISPR gRNA sequence
tgtcacccaggcttgagtgc

SEQ ID NO: 660886 - DNA, 20 bp, Artificial
  CRISPR gRNA sequence
tcacccaggcttgagtgcag

SEQ ID NO: 660887 - DNA, 20 bp, Artificial
  CRISPR gRNA sequence
gagtgcagtgatgcgatcat

SEQ ID NO: 660888 - DNA, 20 bp, Artificial
  CRISPR gRNA sequence
agtgcagtgatgcgatcatg

SEQ ID NO: 660889 - DNA, 20 bp, Artificial
  CRISPR gRNA sequence
agtgtcaacttcgacctcac

SEQ ID NO: 660890 - DNA, 20 bp, Artificial
  CRISPR gRNA sequence
cgacctcacagcctcaggtg

SEQ ID NO: 660891 - DNA, 20 bp, Artificial
  CRISPR gRNA sequence
gacctcacagcctcaggtga

SEQ ID NO: 660892 - DNA, 20 bp, Artificial
  CRISPR gRNA sequence
acagcctcaggtgatcatcc

SEQ ID NO: 660893 - DNA, 20 bp, Artificial
  CRISPR gRNA sequence
aggtgatcatcccacctcag

SEQ ID NO: 660894 - DNA, 20 bp, Artificial
  CRISPR gRNA sequence
agccttccaagtagctggga

SEQ ID NO: 660895 - DNA, 20 bp, Artificial
  CRISPR gRNA sequence
ccaagtagctgggactacag

SEQ ID NO: 660896 - DNA, 20 bp, Artificial
  CRISPR gRNA sequence
caagtagctgggactacagg

SEQ ID NO: 660897 - DNA, 20 bp, Artificial
  CRISPR gRNA sequence
ggactacaggcacaggccac

SEQ ID NO: 660898 - DNA, 20 bp, Artificial
  CRISPR gRNA sequence
caggcacaggccaccctgcc

SEQ ID NO: 660899 - DNA, 20 bp, Artificial
  CRISPR gRNA sequence
cctgtataattttttaaatg

SEQ ID NO: 660900 - DNA, 20 bp, Artificial
  CRISPR gRNA sequence
tataattttttaaatgtttt

SEQ ID NO: 660901 - DNA, 20 bp, Artificial
  CRISPR gRNA sequence
tttaaatgttttttgtacag

SEQ ID NO: 660902 - DNA, 20 bp, Artificial
  CRISPR gRNA sequence
ttaaatgttttttgtacaga

SEQ ID NO: 660903 - DNA, 20 bp, Artificial
  CRISPR gRNA sequence
taaatgttttttgtacagac

SEQ ID NO: 660904 - DNA, 20 bp, Artificial
  CRISPR gRNA sequence
aaatgttttttgtacagaca

SEQ ID NO: 660905 - DNA, 20 bp, Artificial
  CRISPR gRNA sequence
aatgttttttgtacagacaa

SEQ ID NO: 660906 - DNA, 20 bp, Artificial
  CRISPR gRNA sequence
tttgtacagacaagatccca

SEQ ID NO: 660907 - DNA, 20 bp, Artificial
  CRISPR gRNA sequence
ttgtacagacaagatcccac

SEQ ID NO: 660908 - DNA, 20 bp, Artificial
  CRISPR gRNA sequence
tgtacagacaagatcccact

SEQ ID NO: 660909 - DNA, 20 bp, Artificial
  CRISPR gRNA sequence
gtacagacaagatcccactg

SEQ ID NO: 660910 - DNA, 20 bp, Artificial
  CRISPR gRNA sequence
tacagacaagatcccactgt

SEQ ID NO: 660911 - DNA, 20 bp, Artificial
  CRISPR gRNA sequence
tgtttcccaggctggtcttg

SEQ ID NO: 660912 - DNA, 20 bp, Artificial
  CRISPR gRNA sequence
cccaggctggtcttgaactc

SEQ ID NO: 660913 - DNA, 20 bp, Artificial
  CRISPR gRNA sequence
ccaggctggtcttgaactcc

SEQ ID NO: 660914 - DNA, 20 bp, Artificial
  CRISPR gRNA sequence
gtcttgaactcctggactca

SEQ ID NO: 660915 - DNA, 20 bp, Artificial
  CRISPR gRNA sequence
gaactcctggactcaagcaa

SEQ ID NO: 660916 - DNA, 20 bp, Artificial
  CRISPR gRNA sequence
aactcctggactcaagcaat

SEQ ID NO: 660917 - DNA, 20 bp, Artificial
  CRISPR gRNA sequence
ctggactcaagcaatccacc

SEQ ID NO: 660918 - DNA, 20 bp, Artificial
  CRISPR gRNA sequence
gactcaagcaatccacccgc

SEQ ID NO: 660919 - DNA, 20 bp, Artificial
  CRISPR gRNA sequence
aagcaatccacccgccttgg

SEQ ID NO: 660920 - DNA, 20 bp, Artificial
  CRISPR gRNA sequence
ggcctcccaaaatgctggga

SEQ ID NO: 660921 - DNA, 20 bp, Artificial
  CRISPR gRNA sequence
gcctcccaaaatgctgggat

SEQ ID NO: 660922 - DNA, 20 bp, Artificial
  CRISPR gRNA sequence
ccaaaatgctgggattacag

SEQ ID NO: 660923 - DNA, 20 bp, Artificial
  CRISPR gRNA sequence
ggattacagatgtgagccac

SEQ ID NO: 660924 - DNA, 20 bp, Artificial
  CRISPR gRNA sequence
cagatgtgagccactgtgcc

SEQ ID NO: 660925 - DNA, 20 bp, Artificial
  CRISPR gRNA sequence
tgcccccagcctgcagaaat

SEQ ID NO: 660926 - DNA, 20 bp, Artificial
  CRISPR gRNA sequence
cagaaattcttaaagagcat

SEQ ID NO: 660927 - DNA, 20 bp, Artificial
  CRISPR gRNA sequence
ttaaagagcatttactgtgt

SEQ ID NO: 660928 - DNA, 20 bp, Artificial
  CRISPR gRNA sequence
aaagagcatttactgtgtat

SEQ ID NO: 660929 - DNA, 20 bp, Artificial
  CRISPR gRNA sequence
aagagcatttactgtgtatt

SEQ ID NO: 660930 - DNA, 20 bp, Artificial
  CRISPR gRNA sequence
actgtgtattaggcattgtt

SEQ ID NO: 660931 - DNA, 20 bp, Artificial
  CRISPR gRNA sequence
ctgtgtattaggcattgttc

SEQ ID NO: 660932 - DNA, 20 bp, Artificial
  CRISPR gRNA sequence
tgtattaggcattgttctaa

SEQ ID NO: 660933 - DNA, 20 bp, Artificial
  CRISPR gRNA sequence
ggcattgttctaagtgcttt

SEQ ID NO: 660934 - DNA, 20 bp, Artificial
  CRISPR gRNA sequence
ttctaagtgctttgcatata

SEQ ID NO: 660935 - DNA, 20 bp, Artificial
  CRISPR gRNA sequence
taagtgctttgcatataatt

SEQ ID NO: 660936 - DNA, 20 bp, Artificial
  CRISPR gRNA sequence
agtgctttgcatataattca

SEQ ID NO: 660937 - DNA, 20 bp, Artificial
  CRISPR gRNA sequence
tgcatataattcacttagca

SEQ ID NO: 660938 - DNA, 20 bp, Artificial
  CRISPR gRNA sequence
gcatataattcacttagcaa

SEQ ID NO: 660939 - DNA, 20 bp, Artificial
  CRISPR gRNA sequence
catataattcacttagcaac

SEQ ID NO: 660940 - DNA, 20 bp, Artificial
  CRISPR gRNA sequence
acttagcaactcaaagtata

SEQ ID NO: 660941 - DNA, 20 bp, Artificial
  CRISPR gRNA sequence
agcaactcaaagtatatctg

SEQ ID NO: 660942 - DNA, 20 bp, Artificial
  CRISPR gRNA sequence
gcaactcaaagtatatctgt

SEQ ID NO: 660943 - DNA, 20 bp, Artificial
  CRISPR gRNA sequence
aaagtatatctgtttagatt

SEQ ID NO: 660944 - DNA, 20 bp, Artificial
  CRISPR gRNA sequence
tttagattattttctatgac

SEQ ID NO: 660945 - DNA, 20 bp, Artificial
  CRISPR gRNA sequence
agattattttctatgaccat

SEQ ID NO: 660946 - DNA, 20 bp, Artificial
  CRISPR gRNA sequence
gattattttctatgaccatg

SEQ ID NO: 660947 - DNA, 20 bp, Artificial
  CRISPR gRNA sequence
ttttctatgaccatgtaaac

SEQ ID NO: 660948 - DNA, 20 bp, Artificial
  CRISPR gRNA sequence
tctatgaccatgtaaacatg

SEQ ID NO: 660949 - DNA, 20 bp, Artificial
  CRISPR gRNA sequence
ctatgaccatgtaaacatgg

SEQ ID NO: 660950 - DNA, 20 bp, Artificial
  CRISPR gRNA sequence
tatgaccatgtaaacatgga

SEQ ID NO: 660951 - DNA, 20 bp, Artificial
  CRISPR gRNA sequence
tgaccatgtaaacatggaaa

SEQ ID NO: 660952 - DNA, 20 bp, Artificial
  CRISPR gRNA sequence
tataatagaaattatttatg

SEQ ID NO: 660953 - DNA, 20 bp, Artificial
  CRISPR gRNA sequence
tttatgacataattaatttt

SEQ ID NO: 660954 - DNA, 20 bp, Artificial
  CRISPR gRNA sequence
atgacataattaattttcct

SEQ ID NO: 660955 - DNA, 20 bp, Artificial
  CRISPR gRNA sequence
tgacataattaattttcctt

SEQ ID NO: 660956 - DNA, 20 bp, Artificial
  CRISPR gRNA sequence
attttcctttaacattgtac

SEQ ID NO: 660957 - DNA, 20 bp, Artificial
  CRISPR gRNA sequence
tcctttaacattgtacgtcc

SEQ ID NO: 660958 - DNA, 20 bp, Artificial
  CRISPR gRNA sequence
cctttaacattgtacgtcct

SEQ ID NO: 660959 - DNA, 20 bp, Artificial
  CRISPR gRNA sequence
ctttaacattgtacgtcctc

SEQ ID NO: 660960 - DNA, 20 bp, Artificial
  CRISPR gRNA sequence
taacattgtacgtcctcaac

SEQ ID NO: 660961 - DNA, 20 bp, Artificial
  CRISPR gRNA sequence
aacattgtacgtcctcaaca

SEQ ID NO: 660962 - DNA, 20 bp, Artificial
  CRISPR gRNA sequence
acattgtacgtcctcaacac

SEQ ID NO: 660963 - DNA, 20 bp, Artificial
  CRISPR gRNA sequence
tacgtcctcaacactgtttc

SEQ ID NO: 660964 - DNA, 20 bp, Artificial
  CRISPR gRNA sequence
aacactgtttcatgtttcta

SEQ ID NO: 660965 - DNA, 20 bp, Artificial
  CRISPR gRNA sequence
tttcatgtttctaagcacat

SEQ ID NO: 660966 - DNA, 20 bp, Artificial
  CRISPR gRNA sequence
catgtttctaagcacataca

SEQ ID NO: 660967 - DNA, 20 bp, Artificial
  CRISPR gRNA sequence
atgtttctaagcacatacat

SEQ ID NO: 660968 - DNA, 20 bp, Artificial
  CRISPR gRNA sequence
ctaagcacatacatacatta

SEQ ID NO: 660969 - DNA, 20 bp, Artificial
  CRISPR gRNA sequence
taagcacatacatacattat

SEQ ID NO: 660970 - DNA, 20 bp, Artificial
  CRISPR gRNA sequence
agcacatacatacattataa

SEQ ID NO: 660971 - DNA, 20 bp, Artificial
  CRISPR gRNA sequence
taattattaacagctacaga

SEQ ID NO: 660972 - DNA, 20 bp, Artificial
  CRISPR gRNA sequence
ttaacagctacagagtaatt

SEQ ID NO: 660973 - DNA, 20 bp, Artificial
  CRISPR gRNA sequence
acagctacagagtaattctt

SEQ ID NO: 660974 - DNA, 20 bp, Artificial
  CRISPR gRNA sequence
cagagtaattctttctgtgg

SEQ ID NO: 660975 - DNA, 20 bp, Artificial
  CRISPR gRNA sequence
tttctgtggtaatggactaa

SEQ ID NO: 660976 - DNA, 20 bp, Artificial
  CRISPR gRNA sequence
tctgtggtaatggactaact

SEQ ID NO: 660977 - DNA, 20 bp, Artificial
  CRISPR gRNA sequence
ctgtggtaatggactaactg

SEQ ID NO: 660978 - DNA, 20 bp, Artificial
  CRISPR gRNA sequence
tgtggtaatggactaactgg

SEQ ID NO: 660979 - DNA, 20 bp, Artificial
  CRISPR gRNA sequence
tggtaatggactaactggta

SEQ ID NO: 660980 - DNA, 20 bp, Artificial
  CRISPR gRNA sequence
actggtatctcttttttgtg

SEQ ID NO: 660981 - DNA, 20 bp, Artificial
  CRISPR gRNA sequence
gtatctcttttttgtgttcc

SEQ ID NO: 660982 - DNA, 20 bp, Artificial
  CRISPR gRNA sequence
ttttttgtgttcctgtaacg

SEQ ID NO: 660983 - DNA, 20 bp, Artificial
  CRISPR gRNA sequence
ttttgtgttcctgtaacgaa

SEQ ID NO: 660984 - DNA, 20 bp, Artificial
  CRISPR gRNA sequence
tttgtgttcctgtaacgaag

SEQ ID NO: 660985 - DNA, 20 bp, Artificial
  CRISPR gRNA sequence
ttgtgttcctgtaacgaaga

SEQ ID NO: 660986 - DNA, 20 bp, Artificial
  CRISPR gRNA sequence
tgtgttcctgtaacgaagaa

SEQ ID NO: 660987 - DNA, 20 bp, Artificial
  CRISPR gRNA sequence
gtgttcctgtaacgaagaaa

SEQ ID NO: 660988 - DNA, 20 bp, Artificial
  CRISPR gRNA sequence
tgttcctgtaacgaagaaag

SEQ ID NO: 660989 - DNA, 20 bp, Artificial
  CRISPR gRNA sequence
ctgtaacgaagaaagagttt

SEQ ID NO: 660990 - DNA, 20 bp, Artificial
  CRISPR gRNA sequence
taacgaagaaagagtttaac

SEQ ID NO: 660991 - DNA, 20 bp, Artificial
  CRISPR gRNA sequence
aacatttaagatggtaataa

SEQ ID NO: 660992 - DNA, 20 bp, Artificial
  CRISPR gRNA sequence
acatttaagatggtaataat

SEQ ID NO: 660993 - DNA, 20 bp, Artificial
  CRISPR gRNA sequence
aagatggtaataatatgatt

SEQ ID NO: 660994 - DNA, 20 bp, Artificial
  CRISPR gRNA sequence
agatggtaataatatgattt

SEQ ID NO: 660995 - DNA, 20 bp, Artificial
  CRISPR gRNA sequence
ttgtttttctaaaaatagtg

SEQ ID NO: 660996 - DNA, 20 bp, Artificial
  CRISPR gRNA sequence
tgtttttctaaaaatagtgt

SEQ ID NO: 660997 - DNA, 20 bp, Artificial
  CRISPR gRNA sequence
gtttttctaaaaatagtgtt

SEQ ID NO: 660998 - DNA, 20 bp, Artificial
  CRISPR gRNA sequence
tttttctaaaaatagtgtta

SEQ ID NO: 660999 - DNA, 20 bp, Artificial
  CRISPR gRNA sequence
ttctaaaaatagtgttatta

SEQ ID NO: 661000 - DNA, 20 bp, Artificial
  CRISPR gRNA sequence
tctaaaaatagtgttattaa

SEQ ID NO: 661001 - DNA, 20 bp, Artificial
  CRISPR gRNA sequence
ctaaaaatagtgttattaac

SEQ ID NO: 661002 - DNA, 20 bp, Artificial
  CRISPR gRNA sequence
taaaaatagtgttattaact

SEQ ID NO: 661003 - DNA, 20 bp, Artificial
  CRISPR gRNA sequence
aaaatagtgttattaactag

SEQ ID NO: 661004 - DNA, 20 bp, Artificial
  CRISPR gRNA sequence
ttaactagaaggtcaataaa

SEQ ID NO: 661005 - DNA, 20 bp, Artificial
  CRISPR gRNA sequence
actagaaggtcaataaagta

SEQ ID NO: 661006 - DNA, 20 bp, Artificial
  CRISPR gRNA sequence
gaaggtcaataaagtataat

SEQ ID NO: 661007 - DNA, 20 bp, Artificial
  CRISPR gRNA sequence
ttatccctttacattaaaag

SEQ ID NO: 661008 - DNA, 20 bp, Artificial
  CRISPR gRNA sequence
tccctttacattaaaagagg

SEQ ID NO: 661009 - DNA, 20 bp, Artificial
  CRISPR gRNA sequence
tacattaaaagaggttcaaa

SEQ ID NO: 661010 - DNA, 20 bp, Artificial
  CRISPR gRNA sequence
acattaaaagaggttcaaac

SEQ ID NO: 661011 - DNA, 20 bp, Artificial
  CRISPR gRNA sequence
cattaaaagaggttcaaaca

SEQ ID NO: 661012 - DNA, 20 bp, Artificial
  CRISPR gRNA sequence
aaagaggttcaaacagtgct

SEQ ID NO: 661013 - DNA, 20 bp, Artificial
  CRISPR gRNA sequence
aaacagtgctttgctatatt

SEQ ID NO: 661014 - DNA, 20 bp, Artificial
  CRISPR gRNA sequence
tgctatatttaagagtttaa

SEQ ID NO: 661015 - DNA, 20 bp, Artificial
  CRISPR gRNA sequence
gctatatttaagagtttaac

SEQ ID NO: 661016 - DNA, 20 bp, Artificial
  CRISPR gRNA sequence
ctatatttaagagtttaacc

SEQ ID NO: 661017 - DNA, 20 bp, Artificial
  CRISPR gRNA sequence
tatttaagagtttaaccttg

SEQ ID NO: 661018 - DNA, 20 bp, Artificial
  CRISPR gRNA sequence
aagagtttaaccttgttttt

SEQ ID NO: 661019 - DNA, 20 bp, Artificial
  CRISPR gRNA sequence
agagtttaaccttgtttttg

SEQ ID NO: 661020 - DNA, 20 bp, Artificial
  CRISPR gRNA sequence
aaccttgtttttgccttgtt

SEQ ID NO: 661021 - DNA, 20 bp, Artificial
  CRISPR gRNA sequence
accttgtttttgccttgttt

SEQ ID NO: 661022 - DNA, 20 bp, Artificial
  CRISPR gRNA sequence
gtttttgccttgttttcctt

SEQ ID NO: 661023 - DNA, 20 bp, Artificial
  CRISPR gRNA sequence
tttttgccttgttttccttg

SEQ ID NO: 661024 - DNA, 20 bp, Artificial
  CRISPR gRNA sequence
ttgccttgttttccttgttt

SEQ ID NO: 661025 - DNA, 20 bp, Artificial
  CRISPR gRNA sequence
tgccttgttttccttgtttt

SEQ ID NO: 661026 - DNA, 20 bp, Artificial
  CRISPR gRNA sequence
gccttgttttccttgtttta

SEQ ID NO: 661027 - DNA, 20 bp, Artificial
  CRISPR gRNA sequence
ccttgttttccttgttttac

SEQ ID NO: 661028 - DNA, 20 bp, Artificial
  CRISPR gRNA sequence
gttttccttgttttacccat

SEQ ID NO: 661029 - DNA, 20 bp, Artificial
  CRISPR gRNA sequence
ttttccttgttttacccata

SEQ ID NO: 661030 - DNA, 20 bp, Artificial
  CRISPR gRNA sequence
tccttgttttacccatacac

SEQ ID NO: 661031 - DNA, 20 bp, Artificial
  CRISPR gRNA sequence
ccttgttttacccatacaca

SEQ ID NO: 661032 - DNA, 20 bp, Artificial
  CRISPR gRNA sequence
cttgttttacccatacacaa

SEQ ID NO: 661033 - DNA, 20 bp, Artificial
  CRISPR gRNA sequence
gttttacccatacacaaaat

SEQ ID NO: 661034 - DNA, 20 bp, Artificial
  CRISPR gRNA sequence
ttttacccatacacaaaata

SEQ ID NO: 661035 - DNA, 20 bp, Artificial
  CRISPR gRNA sequence
tacccatacacaaaataaga

SEQ ID NO: 661036 - DNA, 20 bp, Artificial
  CRISPR gRNA sequence
acccatacacaaaataagaa

SEQ ID NO: 661037 - DNA, 20 bp, Artificial
  CRISPR gRNA sequence
cccatacacaaaataagaaa

SEQ ID NO: 661038 - DNA, 20 bp, Artificial
  CRISPR gRNA sequence
tgatgttacacagctttttt

SEQ ID NO: 661039 - DNA, 20 bp, Artificial
  CRISPR gRNA sequence
atgttacacagctttttttt

SEQ ID NO: 661040 - DNA, 20 bp, Artificial
  CRISPR gRNA sequence
cacagctttttttttttctg

SEQ ID NO: 661041 - DNA, 20 bp, Artificial
  CRISPR gRNA sequence
tttttttttctgtcatacac

SEQ ID NO: 661042 - DNA, 20 bp, Artificial
  CRISPR gRNA sequence
ttttttttctgtcatacacc

SEQ ID NO: 661043 - DNA, 20 bp, Artificial
  CRISPR gRNA sequence
tttttttctgtcatacaccc

SEQ ID NO: 661044 - DNA, 20 bp, Artificial
  CRISPR gRNA sequence
ttttttctgtcatacaccca

SEQ ID NO: 661045 - DNA, 20 bp, Artificial
  CRISPR gRNA sequence
tttttctgtcatacacccat

SEQ ID NO: 661046 - DNA, 20 bp, Artificial
  CRISPR gRNA sequence
ttttctgtcatacacccata

SEQ ID NO: 661047 - DNA, 20 bp, Artificial
  CRISPR gRNA sequence
tttctgtcatacacccatac

SEQ ID NO: 661048 - DNA, 20 bp, Artificial
  CRISPR gRNA sequence
ttctgtcatacacccataca

SEQ ID NO: 661049 - DNA, 20 bp, Artificial
  CRISPR gRNA sequence
tctgtcatacacccatacat

SEQ ID NO: 661050 - DNA, 20 bp, Artificial
  CRISPR gRNA sequence
ctgtcatacacccatacatt

SEQ ID NO: 661051 - DNA, 20 bp, Artificial
  CRISPR gRNA sequence
tgtcatacacccatacattg

SEQ ID NO: 661052 - DNA, 20 bp, Artificial
  CRISPR gRNA sequence
tcatacacccatacattgta

SEQ ID NO: 661053 - DNA, 20 bp, Artificial
  CRISPR gRNA sequence
taataatggggtggctaatt

SEQ ID NO: 661054 - DNA, 20 bp, Artificial
  CRISPR gRNA sequence
attatttgctaaatgcttta

SEQ ID NO: 661055 - DNA, 20 bp, Artificial
  CRISPR gRNA sequence
tttgctaaatgctttaaagt

SEQ ID NO: 661056 - DNA, 20 bp, Artificial
  CRISPR gRNA sequence
gctaaatgctttaaagtaaa

SEQ ID NO: 661057 - DNA, 20 bp, Artificial
  CRISPR gRNA sequence
ctaaatgctttaaagtaaaa

SEQ ID NO: 661058 - DNA, 20 bp, Artificial
  CRISPR gRNA sequence
aatgctttaaagtaaaataa

SEQ ID NO: 661059 - DNA, 20 bp, Artificial
  CRISPR gRNA sequence
taaagtaaaataaaatccaa

SEQ ID NO: 661060 - DNA, 20 bp, Artificial
  CRISPR gRNA sequence
aaagtaaaataaaatccaag

SEQ ID NO: 661061 - DNA, 20 bp, Artificial
  CRISPR gRNA sequence
aagtaaaataaaatccaagt

SEQ ID NO: 661062 - DNA, 20 bp, Artificial
  CRISPR gRNA sequence
attacaccatgtgaatattt

SEQ ID NO: 661063 - DNA, 20 bp, Artificial
  CRISPR gRNA sequence
ttacaccatgtgaatatttt

SEQ ID NO: 661064 - DNA, 20 bp, Artificial
  CRISPR gRNA sequence
caccatgtgaatattttgac

SEQ ID NO: 661065 - DNA, 20 bp, Artificial
  CRISPR gRNA sequence
tgacttttttggtttactga

SEQ ID NO: 661066 - DNA, 20 bp, Artificial
  CRISPR gRNA sequence
gacttttttggtttactgac

SEQ ID NO: 661067 - DNA, 20 bp, Artificial
  CRISPR gRNA sequence
acttttttggtttactgaca

SEQ ID NO: 661068 - DNA, 20 bp, Artificial
  CRISPR gRNA sequence
ttttggtttactgacatttg

SEQ ID NO: 661069 - DNA, 20 bp, Artificial
  CRISPR gRNA sequence
tttggtttactgacatttgg

SEQ ID NO: 661070 - DNA, 20 bp, Artificial
  CRISPR gRNA sequence
ttggtttactgacatttggt

SEQ ID NO: 661071 - DNA, 20 bp, Artificial
  CRISPR gRNA sequence
tggtttactgacatttggtg

SEQ ID NO: 661072 - DNA, 20 bp, Artificial
  CRISPR gRNA sequence
ggtttactgacatttggtgt

SEQ ID NO: 661073 - DNA, 20 bp, Artificial
  CRISPR gRNA sequence
gtttactgacatttggtgtt

SEQ ID NO: 661074 - DNA, 20 bp, Artificial
  CRISPR gRNA sequence
actgacatttggtgtttagc

SEQ ID NO: 661075 - DNA, 20 bp, Artificial
  CRISPR gRNA sequence
ctgacatttggtgtttagca

SEQ ID NO: 661076 - DNA, 20 bp, Artificial
  CRISPR gRNA sequence
acatttggtgtttagcattt

SEQ ID NO: 661077 - DNA, 20 bp, Artificial
  CRISPR gRNA sequence
ggtgtttagcatttccattg

SEQ ID NO: 661078 - DNA, 20 bp, Artificial
  CRISPR gRNA sequence
gtgtttagcatttccattgt

SEQ ID NO: 661079 - DNA, 20 bp, Artificial
  CRISPR gRNA sequence
agcatttccattgtcttttg

SEQ ID NO: 661080 - DNA, 20 bp, Artificial
  CRISPR gRNA sequence
gcatttccattgtcttttgg

SEQ ID NO: 661081 - DNA, 20 bp, Artificial
  CRISPR gRNA sequence
ccattgtcttttggttttga

SEQ ID NO: 661082 - DNA, 20 bp, Artificial
  CRISPR gRNA sequence
cattgtcttttggttttgac

SEQ ID NO: 661083 - DNA, 20 bp, Artificial
  CRISPR gRNA sequence
tcttttggttttgacgggaa

SEQ ID NO: 661084 - DNA, 20 bp, Artificial
  CRISPR gRNA sequence
ttggttttgacgggaaaaac

SEQ ID NO: 661085 - DNA, 20 bp, Artificial
  CRISPR gRNA sequence
tggttttgacgggaaaaact

SEQ ID NO: 661086 - DNA, 20 bp, Artificial
  CRISPR gRNA sequence
ggttttgacgggaaaaactt

SEQ ID NO: 661087 - DNA, 20 bp, Artificial
  CRISPR gRNA sequence
gttttgacgggaaaaacttg

SEQ ID NO: 661088 - DNA, 20 bp, Artificial
  CRISPR gRNA sequence
tgacgggaaaaacttggtct

SEQ ID NO: 661089 - DNA, 20 bp, Artificial
  CRISPR gRNA sequence
gacgggaaaaacttggtcta

SEQ ID NO: 661090 - DNA, 20 bp, Artificial
  CRISPR gRNA sequence
acgggaaaaacttggtctaa

SEQ ID NO: 661091 - DNA, 20 bp, Artificial
  CRISPR gRNA sequence
ggtctaataccaattatgac

SEQ ID NO: 661092 - DNA, 20 bp, Artificial
  CRISPR gRNA sequence
gtctaataccaattatgact

SEQ ID NO: 661093 - DNA, 20 bp, Artificial
  CRISPR gRNA sequence
ataccaattatgactgttcc

SEQ ID NO: 661094 - DNA, 20 bp, Artificial
  CRISPR gRNA sequence
tgactgttccaagatagtaa

SEQ ID NO: 661095 - DNA, 20 bp, Artificial
  CRISPR gRNA sequence
ttccaagatagtaaatggaa

SEQ ID NO: 661096 - DNA, 20 bp, Artificial
  CRISPR gRNA sequence
caagatagtaaatggaacat

SEQ ID NO: 661097 - DNA, 20 bp, Artificial
  CRISPR gRNA sequence
gttgagattcacatggtttg

SEQ ID NO: 661098 - DNA, 20 bp, Artificial
  CRISPR gRNA sequence
ttgagattcacatggtttga

SEQ ID NO: 661099 - DNA, 20 bp, Artificial
  CRISPR gRNA sequence
agattcacatggtttgagtc

SEQ ID NO: 661100 - DNA, 20 bp, Artificial
  CRISPR gRNA sequence
acatggtttgagtcatgcat

SEQ ID NO: 661101 - DNA, 20 bp, Artificial
  CRISPR gRNA sequence
gagtcatgcattgcctttac

SEQ ID NO: 661102 - DNA, 20 bp, Artificial
  CRISPR gRNA sequence
agtcatgcattgcctttacc

SEQ ID NO: 661103 - DNA, 20 bp, Artificial
  CRISPR gRNA sequence
cctttacctatccttttaat

SEQ ID NO: 661104 - DNA, 20 bp, Artificial
  CRISPR gRNA sequence
tacctatccttttaatttat

SEQ ID NO: 661105 - DNA, 20 bp, Artificial
  CRISPR gRNA sequence
acctatccttttaatttatt

SEQ ID NO: 661106 - DNA, 20 bp, Artificial
  CRISPR gRNA sequence
cctatccttttaatttattg

SEQ ID NO: 661107 - DNA, 20 bp, Artificial
  CRISPR gRNA sequence
tccttttaatttattgttaa

SEQ ID NO: 661108 - DNA, 20 bp, Artificial
  CRISPR gRNA sequence
ttaatttattgttaaggcag

SEQ ID NO: 661109 - DNA, 20 bp, Artificial
  CRISPR gRNA sequence
taatttattgttaaggcagg

SEQ ID NO: 661110 - DNA, 20 bp, Artificial
  CRISPR gRNA sequence
aatttattgttaaggcagga

SEQ ID NO: 661111 - DNA, 20 bp, Artificial
  CRISPR gRNA sequence
atttattgttaaggcaggag

SEQ ID NO: 661112 - DNA, 20 bp, Artificial
  CRISPR gRNA sequence
attgttaaggcaggagttca

SEQ ID NO: 661113 - DNA, 20 bp, Artificial
  CRISPR gRNA sequence
ttgttaaggcaggagttcaa

SEQ ID NO: 661114 - DNA, 20 bp, Artificial
  CRISPR gRNA sequence
ttaaggcaggagttcaaatt

SEQ ID NO: 661115 - DNA, 20 bp, Artificial
  CRISPR gRNA sequence
aggcaggagttcaaattatg

SEQ ID NO: 661116 - DNA, 20 bp, Artificial
  CRISPR gRNA sequence
aaattatggactggtttcag

SEQ ID NO: 661117 - DNA, 20 bp, Artificial
  CRISPR gRNA sequence
tggactggtttcagggtgtg

SEQ ID NO: 661118 - DNA, 20 bp, Artificial
  CRISPR gRNA sequence
gtttcagggtgtgaacatca

SEQ ID NO: 661119 - DNA, 20 bp, Artificial
  CRISPR gRNA sequence
cagggtgtgaacatcagtct

SEQ ID NO: 661120 - DNA, 20 bp, Artificial
  CRISPR gRNA sequence
agggtgtgaacatcagtctc

SEQ ID NO: 661121 - DNA, 20 bp, Artificial
  CRISPR gRNA sequence
tgattataattcaggagata

SEQ ID NO: 661122 - DNA, 20 bp, Artificial
  CRISPR gRNA sequence
attataattcaggagatatg

SEQ ID NO: 661123 - DNA, 20 bp, Artificial
  CRISPR gRNA sequence
taattcaggagatatgtgga

SEQ ID NO: 661124 - DNA, 20 bp, Artificial
  CRISPR gRNA sequence
aggagatatgtggatctgaa

SEQ ID NO: 661125 - DNA, 20 bp, Artificial
  CRISPR gRNA sequence
aagttgatggacaggctgcc

SEQ ID NO: 661126 - DNA, 20 bp, Artificial
  CRISPR gRNA sequence
atggacaggctgcctggtta

SEQ ID NO: 661127 - DNA, 20 bp, Artificial
  CRISPR gRNA sequence
cctggttagccaggcaagct

SEQ ID NO: 661128 - DNA, 20 bp, Artificial
  CRISPR gRNA sequence
gttagccaggcaagctccca

SEQ ID NO: 661129 - DNA, 20 bp, Artificial
  CRISPR gRNA sequence
gccaggcaagctcccattat

SEQ ID NO: 661130 - DNA, 20 bp, Artificial
  CRISPR gRNA sequence
ccattatctcaagaacctct

SEQ ID NO: 661131 - DNA, 20 bp, Artificial
  CRISPR gRNA sequence
tctcaagaacctctgctgat

SEQ ID NO: 661132 - DNA, 20 bp, Artificial
  CRISPR gRNA sequence
aagaacctctgctgattagt

SEQ ID NO: 661133 - DNA, 20 bp, Artificial
  CRISPR gRNA sequence
tgctgattagtttgctatca

SEQ ID NO: 661134 - DNA, 20 bp, Artificial
  CRISPR gRNA sequence
ctgattagtttgctatcatt

SEQ ID NO: 661135 - DNA, 20 bp, Artificial
  CRISPR gRNA sequence
attagtttgctatcattttg

SEQ ID NO: 661136 - DNA, 20 bp, Artificial
  CRISPR gRNA sequence
gtttgctatcattttgagag

SEQ ID NO: 661137 - DNA, 20 bp, Artificial
  CRISPR gRNA sequence
gctatcattttgagagacct

SEQ ID NO: 661138 - DNA, 20 bp, Artificial
  CRISPR gRNA sequence
ctatcattttgagagacctc

SEQ ID NO: 661139 - DNA, 20 bp, Artificial
  CRISPR gRNA sequence
tcattttgagagacctcact

SEQ ID NO: 661140 - DNA, 20 bp, Artificial
  CRISPR gRNA sequence
tgagagacctcactatgaaa

SEQ ID NO: 661141 - DNA, 20 bp, Artificial
  CRISPR gRNA sequence
gagagacctcactatgaaaa

SEQ ID NO: 661142 - DNA, 20 bp, Artificial
  CRISPR gRNA sequence
agagacctcactatgaaaac

SEQ ID NO: 661143 - DNA, 20 bp, Artificial
  CRISPR gRNA sequence
actatgaaaacagacatttt

SEQ ID NO: 661144 - DNA, 20 bp, Artificial
  CRISPR gRNA sequence
tgaaaacagacattttccca

SEQ ID NO: 661145 - DNA, 20 bp, Artificial
  CRISPR gRNA sequence
tcccagggtggcagagagat

SEQ ID NO: 661146 - DNA, 20 bp, Artificial
  CRISPR gRNA sequence
cccagggtggcagagagata

SEQ ID NO: 661147 - DNA, 20 bp, Artificial
  CRISPR gRNA sequence
ccagggtggcagagagataa

SEQ ID NO: 661148 - DNA, 20 bp, Artificial
  CRISPR gRNA sequence
gctatgtggttaaattcttc

SEQ ID NO: 661149 - DNA, 20 bp, Artificial
  CRISPR gRNA sequence
tgtggttaaattcttccatt

SEQ ID NO: 661150 - DNA, 20 bp, Artificial
  CRISPR gRNA sequence
aattcttccattgttttatg

SEQ ID NO: 661151 - DNA, 20 bp, Artificial
  CRISPR gRNA sequence
ttccattgttttatgcctat

SEQ ID NO: 661152 - DNA, 20 bp, Artificial
  CRISPR gRNA sequence
ccattgttttatgcctatgg

SEQ ID NO: 661153 - DNA, 20 bp, Artificial
  CRISPR gRNA sequence
cattgttttatgcctatgga

SEQ ID NO: 661154 - DNA, 20 bp, Artificial
  CRISPR gRNA sequence
ttttatgcctatggaatttt

SEQ ID NO: 661155 - DNA, 20 bp, Artificial
  CRISPR gRNA sequence
tatgcctatggaattttatt

SEQ ID NO: 661156 - DNA, 20 bp, Artificial
  CRISPR gRNA sequence
atgcctatggaattttattt

SEQ ID NO: 661157 - DNA, 20 bp, Artificial
  CRISPR gRNA sequence
tgcctatggaattttattta

SEQ ID NO: 661158 - DNA, 20 bp, Artificial
  CRISPR gRNA sequence
tggaattttatttaatagta

SEQ ID NO: 661159 - DNA, 20 bp, Artificial
  CRISPR gRNA sequence
tatttaatagtatagcatat

SEQ ID NO: 661160 - DNA, 20 bp, Artificial
  CRISPR gRNA sequence
atttaatagtatagcatatt

SEQ ID NO: 661161 - DNA, 20 bp, Artificial
  CRISPR gRNA sequence
tttaatagtatagcatattt

SEQ ID NO: 661162 - DNA, 20 bp, Artificial
  CRISPR gRNA sequence
aatagtatagcatatttatt

SEQ ID NO: 661163 - DNA, 20 bp, Artificial
  CRISPR gRNA sequence
atagtatagcatatttattc

SEQ ID NO: 661164 - DNA, 20 bp, Artificial
  CRISPR gRNA sequence
attcaggaggagactagtgt

SEQ ID NO: 661165 - DNA, 20 bp, Artificial
  CRISPR gRNA sequence
ttcaggaggagactagtgtt

SEQ ID NO: 661166 - DNA, 20 bp, Artificial
  CRISPR gRNA sequence
aggaggagactagtgttgtt

SEQ ID NO: 661167 - DNA, 20 bp, Artificial
  CRISPR gRNA sequence
gtgttgtttactctctagtc

SEQ ID NO: 661168 - DNA, 20 bp, Artificial
  CRISPR gRNA sequence
tttactctctagtcactgtt

SEQ ID NO: 661169 - DNA, 20 bp, Artificial
  CRISPR gRNA sequence
actctctagtcactgttttc

SEQ ID NO: 661170 - DNA, 20 bp, Artificial
  CRISPR gRNA sequence
ctctctagtcactgttttcc

SEQ ID NO: 661171 - DNA, 20 bp, Artificial
  CRISPR gRNA sequence
tctagtcactgttttccttc

SEQ ID NO: 661172 - DNA, 20 bp, Artificial
  CRISPR gRNA sequence
tagtcactgttttccttcct

SEQ ID NO: 661173 - DNA, 20 bp, Artificial
  CRISPR gRNA sequence
gtcactgttttccttcctca

SEQ ID NO: 661174 - DNA, 20 bp, Artificial
  CRISPR gRNA sequence
ttttccttcctcatacctca

SEQ ID NO: 661175 - DNA, 20 bp, Artificial
  CRISPR gRNA sequence
tccttcctcatacctcaaat

SEQ ID NO: 661176 - DNA, 20 bp, Artificial
  CRISPR gRNA sequence
ccttcctcatacctcaaatt

SEQ ID NO: 661177 - DNA, 20 bp, Artificial
  CRISPR gRNA sequence
cttcctcatacctcaaatta

SEQ ID NO: 661178 - DNA, 20 bp, Artificial
  CRISPR gRNA sequence
cctcatacctcaaattagga

SEQ ID NO: 661179 - DNA, 20 bp, Artificial
  CRISPR gRNA sequence
ctcatacctcaaattaggat

SEQ ID NO: 661180 - DNA, 20 bp, Artificial
  CRISPR gRNA sequence
atacctcaaattaggatcgt

SEQ ID NO: 661181 - DNA, 20 bp, Artificial
  CRISPR gRNA sequence
aaattaggatcgtttcatat

SEQ ID NO: 661182 - DNA, 20 bp, Artificial
  CRISPR gRNA sequence
ggatcgtttcatatttaaga

SEQ ID NO: 661183 - DNA, 20 bp, Artificial
  CRISPR gRNA sequence
catatttaagacattgtaag

SEQ ID NO: 661184 - DNA, 20 bp, Artificial
  CRISPR gRNA sequence
atatttaagacattgtaaga

SEQ ID NO: 661185 - DNA, 20 bp, Artificial
  CRISPR gRNA sequence
aagacattgtaagacatgat

SEQ ID NO: 661186 - DNA, 20 bp, Artificial
  CRISPR gRNA sequence
agacattgtaagacatgata

SEQ ID NO: 661187 - DNA, 20 bp, Artificial
  CRISPR gRNA sequence
taagacatgatactattttc

SEQ ID NO: 661188 - DNA, 20 bp, Artificial
  CRISPR gRNA sequence
ttttcttagaccagtgcctg

SEQ ID NO: 661189 - DNA, 20 bp, Artificial
  CRISPR gRNA sequence
tcttagaccagtgcctgaca

SEQ ID NO: 661190 - DNA, 20 bp, Artificial
  CRISPR gRNA sequence
cttagaccagtgcctgacat

SEQ ID NO: 661191 - DNA, 20 bp, Artificial
  CRISPR gRNA sequence
ttagaccagtgcctgacatt

SEQ ID NO: 661192 - DNA, 20 bp, Artificial
  CRISPR gRNA sequence
agaccagtgcctgacattga

SEQ ID NO: 661193 - DNA, 20 bp, Artificial
  CRISPR gRNA sequence
gaccagtgcctgacattgat

SEQ ID NO: 661194 - DNA, 20 bp, Artificial
  CRISPR gRNA sequence
acattgattaaaacttcagt

SEQ ID NO: 661195 - DNA, 20 bp, Artificial
  CRISPR gRNA sequence
attaaaacttcagtaaacgt

SEQ ID NO: 661196 - DNA, 20 bp, Artificial
  CRISPR gRNA sequence
aaacttcagtaaacgtatcg

SEQ ID NO: 661197 - DNA, 20 bp, Artificial
  CRISPR gRNA sequence
cagtaaacgtatcgaatact

SEQ ID NO: 661198 - DNA, 20 bp, Artificial
  CRISPR gRNA sequence
agtaaacgtatcgaatactg

SEQ ID NO: 661199 - DNA, 20 bp, Artificial
  CRISPR gRNA sequence
aatgaatggaattaggttta

SEQ ID NO: 661200 - DNA, 20 bp, Artificial
  CRISPR gRNA sequence
ggtttagacctgtgtaggaa

SEQ ID NO: 661201 - DNA, 20 bp, Artificial
  CRISPR gRNA sequence
agacctgtgtaggaacatgc

SEQ ID NO: 661202 - DNA, 20 bp, Artificial
  CRISPR gRNA sequence
gacctgtgtaggaacatgca

SEQ ID NO: 661203 - DNA, 20 bp, Artificial
  CRISPR gRNA sequence
tgtaggaacatgcagtatgc

SEQ ID NO: 661204 - DNA, 20 bp, Artificial
  CRISPR gRNA sequence
tattataatgtatgcgattg

SEQ ID NO: 661205 - DNA, 20 bp, Artificial
  CRISPR gRNA sequence
attataatgtatgcgattgt

SEQ ID NO: 661206 - DNA, 20 bp, Artificial
  CRISPR gRNA sequence
ttataatgtatgcgattgta

SEQ ID NO: 661207 - DNA, 20 bp, Artificial
  CRISPR gRNA sequence
taatgtatgcgattgtatat

SEQ ID NO: 661208 - DNA, 20 bp, Artificial
  CRISPR gRNA sequence
tatatatttattatccagct

SEQ ID NO: 661209 - DNA, 20 bp, Artificial
  CRISPR gRNA sequence
attatccagctttttcacag

SEQ ID NO: 661210 - DNA, 20 bp, Artificial
  CRISPR gRNA sequence
ttatccagctttttcacagc

SEQ ID NO: 661211 - DNA, 20 bp, Artificial
  CRISPR gRNA sequence
tccagctttttcacagctgc

SEQ ID NO: 661212 - DNA, 20 bp, Artificial
  CRISPR gRNA sequence
tttcacagctgccatcatcc

SEQ ID NO: 661213 - DNA, 20 bp, Artificial
  CRISPR gRNA sequence
ttcacagctgccatcatcca

SEQ ID NO: 661214 - DNA, 20 bp, Artificial
  CRISPR gRNA sequence
tcacagctgccatcatccag

SEQ ID NO: 661215 - DNA, 20 bp, Artificial
  CRISPR gRNA sequence
cacagctgccatcatccagc

SEQ ID NO: 661216 - DNA, 20 bp, Artificial
  CRISPR gRNA sequence
acagctgccatcatccagca

SEQ ID NO: 661217 - DNA, 20 bp, Artificial
  CRISPR gRNA sequence
ccatcatccagcattaccta

SEQ ID NO: 661218 - DNA, 20 bp, Artificial
  CRISPR gRNA sequence
cctactataactgtgattcc

SEQ ID NO: 661219 - DNA, 20 bp, Artificial
  CRISPR gRNA sequence
ctataactgtgattccgcct

SEQ ID NO: 661220 - DNA, 20 bp, Artificial
  CRISPR gRNA sequence
taactgtgattccgccttct

SEQ ID NO: 661221 - DNA, 20 bp, Artificial
  CRISPR gRNA sequence
tgattccgccttctttgagc

SEQ ID NO: 661222 - DNA, 20 bp, Artificial
  CRISPR gRNA sequence
cgccttctttgagccagatg

SEQ ID NO: 661223 - DNA, 20 bp, Artificial
  CRISPR gRNA sequence
ctttgagccagatgtaaaac

SEQ ID NO: 661224 - DNA, 20 bp, Artificial
  CRISPR gRNA sequence
tttgagccagatgtaaaact

SEQ ID NO: 661225 - DNA, 20 bp, Artificial
  CRISPR gRNA sequence
tgagccagatgtaaaactac

SEQ ID NO: 661226 - DNA, 20 bp, Artificial
  CRISPR gRNA sequence
gagccagatgtaaaactaca

SEQ ID NO: 661227 - DNA, 20 bp, Artificial
  CRISPR gRNA sequence
agccagatgtaaaactacac

SEQ ID NO: 661228 - DNA, 20 bp, Artificial
  CRISPR gRNA sequence
cactgttgtaacttttaagg

SEQ ID NO: 661229 - DNA, 20 bp, Artificial
  CRISPR gRNA sequence
ttgtaacttttaagggttaa

SEQ ID NO: 661230 - DNA, 20 bp, Artificial
  CRISPR gRNA sequence
taacttttaagggttaacgt

SEQ ID NO: 661231 - DNA, 20 bp, Artificial
  CRISPR gRNA sequence
ttaagggttaacgtgcattt

SEQ ID NO: 661232 - DNA, 20 bp, Artificial
  CRISPR gRNA sequence
taagggttaacgtgcatttg

SEQ ID NO: 661233 - DNA, 20 bp, Artificial
  CRISPR gRNA sequence
aagggttaacgtgcatttgc

SEQ ID NO: 661234 - DNA, 20 bp, Artificial
  CRISPR gRNA sequence
agggttaacgtgcatttgcc

SEQ ID NO: 661235 - DNA, 20 bp, Artificial
  CRISPR gRNA sequence
acgtgcatttgccttcattc

SEQ ID NO: 661236 - DNA, 20 bp, Artificial
  CRISPR gRNA sequence
gccttcattctagaaatagg

SEQ ID NO: 661237 - DNA, 20 bp, Artificial
  CRISPR gRNA sequence
ccttcattctagaaataggt

SEQ ID NO: 661238 - DNA, 20 bp, Artificial
  CRISPR gRNA sequence
cattctagaaataggtttat

SEQ ID NO: 661239 - DNA, 20 bp, Artificial
  CRISPR gRNA sequence
attctagaaataggtttatg

SEQ ID NO: 661240 - DNA, 20 bp, Artificial
  CRISPR gRNA sequence
tagaaataggtttatgcttt

SEQ ID NO: 661241 - DNA, 20 bp, Artificial
  CRISPR gRNA sequence
gaaataggtttatgcttttg

SEQ ID NO: 661242 - DNA, 20 bp, Artificial
  CRISPR gRNA sequence
atgcttttgtttctttgatt

SEQ ID NO: 661243 - DNA, 20 bp, Artificial
  CRISPR gRNA sequence
tgcttttgtttctttgattt

SEQ ID NO: 661244 - DNA, 20 bp, Artificial
  CRISPR gRNA sequence
ttgtttctttgatttttttt

SEQ ID NO: 661245 - DNA, 20 bp, Artificial
  CRISPR gRNA sequence
tgtttctttgattttttttt

SEQ ID NO: 661246 - DNA, 20 bp, Artificial
  CRISPR gRNA sequence
gtttctttgatttttttttt

SEQ ID NO: 661247 - DNA, 20 bp, Artificial
  CRISPR gRNA sequence
tttctttgattttttttttt

SEQ ID NO: 661248 - DNA, 20 bp, Artificial
  CRISPR gRNA sequence
ctttgatttttttttttttt

SEQ ID NO: 661249 - DNA, 20 bp, Artificial
  CRISPR gRNA sequence
tttgattttttttttttttg

SEQ ID NO: 661250 - DNA, 20 bp, Artificial
  CRISPR gRNA sequence
tgattttttttttttttgag

SEQ ID NO: 661251 - DNA, 20 bp, Artificial
  CRISPR gRNA sequence
gattttttttttttttgaga

SEQ ID NO: 661252 - DNA, 20 bp, Artificial
  CRISPR gRNA sequence
attttttttttttttgagat

SEQ ID NO: 661253 - DNA, 20 bp, Artificial
  CRISPR gRNA sequence
tttttttttttgagatggag

SEQ ID NO: 661254 - DNA, 20 bp, Artificial
  CRISPR gRNA sequence
ttttttttttgagatggagt

SEQ ID NO: 661255 - DNA, 20 bp, Artificial
  CRISPR gRNA sequence
tttttttttgagatggagtc

SEQ ID NO: 661256 - DNA, 20 bp, Artificial
  CRISPR gRNA sequence
ttttttttgagatggagtct

SEQ ID NO: 661257 - DNA, 20 bp, Artificial
  CRISPR gRNA sequence
tttttttgagatggagtctc

SEQ ID NO: 661258 - DNA, 20 bp, Artificial
  CRISPR gRNA sequence
ttttttgagatggagtctca

SEQ ID NO: 661259 - DNA, 20 bp, Artificial
  CRISPR gRNA sequence
tttttgagatggagtctcac

SEQ ID NO: 661260 - DNA, 20 bp, Artificial
  CRISPR gRNA sequence
ttttgagatggagtctcact

SEQ ID NO: 661261 - DNA, 20 bp, Artificial
  CRISPR gRNA sequence
tttgagatggagtctcactc

SEQ ID NO: 661262 - DNA, 20 bp, Artificial
  CRISPR gRNA sequence
ttgagatggagtctcactct

SEQ ID NO: 661263 - DNA, 20 bp, Artificial
  CRISPR gRNA sequence
tgagatggagtctcactctg

SEQ ID NO: 661264 - DNA, 20 bp, Artificial
  CRISPR gRNA sequence
gagatggagtctcactctgt

SEQ ID NO: 661265 - DNA, 20 bp, Artificial
  CRISPR gRNA sequence
agatggagtctcactctgtc

SEQ ID NO: 661266 - DNA, 20 bp, Artificial
  CRISPR gRNA sequence
actctgtcaccaggctggag

SEQ ID NO: 661267 - DNA, 20 bp, Artificial
  CRISPR gRNA sequence
tgtcaccaggctggagtgca

SEQ ID NO: 661268 - DNA, 20 bp, Artificial
  CRISPR gRNA sequence
tcaccaggctggagtgcagt

SEQ ID NO: 661269 - DNA, 20 bp, Artificial
  CRISPR gRNA sequence
gagtgcagtggcaccatctg

SEQ ID NO: 661270 - DNA, 20 bp, Artificial
  CRISPR gRNA sequence
ggctcactacagttgcctcc

SEQ ID NO: 661271 - DNA, 20 bp, Artificial
  CRISPR gRNA sequence
actacagttgcctcccgggt

SEQ ID NO: 661272 - DNA, 20 bp, Artificial
  CRISPR gRNA sequence
cagttgcctcccgggttcaa

SEQ ID NO: 661273 - DNA, 20 bp, Artificial
  CRISPR gRNA sequence
cctcccgggttcaagtgatt

SEQ ID NO: 661274 - DNA, 20 bp, Artificial
  CRISPR gRNA sequence
ccgggttcaagtgattttcc

SEQ ID NO: 661275 - DNA, 20 bp, Artificial
  CRISPR gRNA sequence
aagtgattttcctgcctcag

SEQ ID NO: 661276 - DNA, 20 bp, Artificial
  CRISPR gRNA sequence
tcctgcctcagcctcctgag

SEQ ID NO: 661277 - DNA, 20 bp, Artificial
  CRISPR gRNA sequence
cctgcctcagcctcctgagt

SEQ ID NO: 661278 - DNA, 20 bp, Artificial
  CRISPR gRNA sequence
ctgcctcagcctcctgagta

SEQ ID NO: 661279 - DNA, 20 bp, Artificial
  CRISPR gRNA sequence
cctcagcctcctgagtagct

SEQ ID NO: 661280 - DNA, 20 bp, Artificial
  CRISPR gRNA sequence
agcctcctgagtagctggga

SEQ ID NO: 661281 - DNA, 20 bp, Artificial
  CRISPR gRNA sequence
ctgagtagctgggactacag

SEQ ID NO: 661282 - DNA, 20 bp, Artificial
  CRISPR gRNA sequence
agtagctgggactacaggcg

SEQ ID NO: 661283 - DNA, 20 bp, Artificial
  CRISPR gRNA sequence
ggactacaggcgcgcgctac

SEQ ID NO: 661284 - DNA, 20 bp, Artificial
  CRISPR gRNA sequence
caggcgcgcgctaccatgcc

SEQ ID NO: 661285 - DNA, 20 bp, Artificial
  CRISPR gRNA sequence
ccatgcccagctaatttttg

SEQ ID NO: 661286 - DNA, 20 bp, Artificial
  CRISPR gRNA sequence
atttttgtatttttagtaga

SEQ ID NO: 661287 - DNA, 20 bp, Artificial
  CRISPR gRNA sequence
ttgtatttttagtagagatg

SEQ ID NO: 661288 - DNA, 20 bp, Artificial
  CRISPR gRNA sequence
tgtatttttagtagagatga

SEQ ID NO: 661289 - DNA, 20 bp, Artificial
  CRISPR gRNA sequence
gtatttttagtagagatgag

SEQ ID NO: 661290 - DNA, 20 bp, Artificial
  CRISPR gRNA sequence
tatttttagtagagatgagg

SEQ ID NO: 661291 - DNA, 20 bp, Artificial
  CRISPR gRNA sequence
ttagtagagatgaggtttca

SEQ ID NO: 661292 - DNA, 20 bp, Artificial
  CRISPR gRNA sequence
tagtagagatgaggtttcac

SEQ ID NO: 661293 - DNA, 20 bp, Artificial
  CRISPR gRNA sequence
agtagagatgaggtttcacc

SEQ ID NO: 661294 - DNA, 20 bp, Artificial
  CRISPR gRNA sequence
gtagagatgaggtttcacca

SEQ ID NO: 661295 - DNA, 20 bp, Artificial
  CRISPR gRNA sequence
caccatgttggccaggatgg

SEQ ID NO: 661296 - DNA, 20 bp, Artificial
  CRISPR gRNA sequence
accatgttggccaggatggt

SEQ ID NO: 661297 - DNA, 20 bp, Artificial
  CRISPR gRNA sequence
gccaggatggtctcgatctc

SEQ ID NO: 661298 - DNA, 20 bp, Artificial
  CRISPR gRNA sequence
gatctcttgacctcgtgatc

SEQ ID NO: 661299 - DNA, 20 bp, Artificial
  CRISPR gRNA sequence
ttgacctcgtgatccgccca

SEQ ID NO: 661300 - DNA, 20 bp, Artificial
  CRISPR gRNA sequence
gacctcgtgatccgcccagg

SEQ ID NO: 661301 - DNA, 20 bp, Artificial
  CRISPR gRNA sequence
acctcgtgatccgcccaggt

SEQ ID NO: 661302 - DNA, 20 bp, Artificial
  CRISPR gRNA sequence
gtgatccgcccaggttgccc

SEQ ID NO: 661303 - DNA, 20 bp, Artificial
  CRISPR gRNA sequence
ccctcccaaagtgctgggat

SEQ ID NO: 661304 - DNA, 20 bp, Artificial
  CRISPR gRNA sequence
ccaaagtgctgggattatag

SEQ ID NO: 661305 - DNA, 20 bp, Artificial
  CRISPR gRNA sequence
ggattataggagtgagccac

SEQ ID NO: 661306 - DNA, 20 bp, Artificial
  CRISPR gRNA sequence
taggagtgagccaccgcacc

SEQ ID NO: 661307 - DNA, 20 bp, Artificial
  CRISPR gRNA sequence
gcctgtgcttttgtttctta

SEQ ID NO: 661308 - DNA, 20 bp, Artificial
  CRISPR gRNA sequence
tgcttttgtttcttaagagg

SEQ ID NO: 661309 - DNA, 20 bp, Artificial
  CRISPR gRNA sequence
ttgtttcttaagaggttttt

SEQ ID NO: 661310 - DNA, 20 bp, Artificial
  CRISPR gRNA sequence
tgtttcttaagaggtttttg

SEQ ID NO: 661311 - DNA, 20 bp, Artificial
  CRISPR gRNA sequence
gtttcttaagaggtttttgc

SEQ ID NO: 661312 - DNA, 20 bp, Artificial
  CRISPR gRNA sequence
tttcttaagaggtttttgca

SEQ ID NO: 661313 - DNA, 20 bp, Artificial
  CRISPR gRNA sequence
cttaagaggtttttgcattg

SEQ ID NO: 661314 - DNA, 20 bp, Artificial
  CRISPR gRNA sequence
ttaagaggtttttgcattga

SEQ ID NO: 661315 - DNA, 20 bp, Artificial
  CRISPR gRNA sequence
aagaggtttttgcattgatc

SEQ ID NO: 661316 - DNA, 20 bp, Artificial
  CRISPR gRNA sequence
agaggtttttgcattgatca

SEQ ID NO: 661317 - DNA, 20 bp, Artificial
  CRISPR gRNA sequence
ttgcattgatcaaaatcata

SEQ ID NO: 661318 - DNA, 20 bp, Artificial
  CRISPR gRNA sequence
tgcattgatcaaaatcatat

SEQ ID NO: 661319 - DNA, 20 bp, Artificial
  CRISPR gRNA sequence
gcattgatcaaaatcatatt

SEQ ID NO: 661320 - DNA, 20 bp, Artificial
  CRISPR gRNA sequence
cattgatcaaaatcatatta

SEQ ID NO: 661321 - DNA, 20 bp, Artificial
  CRISPR gRNA sequence
atcaaaatcatattaaatca

SEQ ID NO: 661322 - DNA, 20 bp, Artificial
  CRISPR gRNA sequence
aatcagttactgttcaggtt

SEQ ID NO: 661323 - DNA, 20 bp, Artificial
  CRISPR gRNA sequence
ctgttcaggttcacattttc

SEQ ID NO: 661324 - DNA, 20 bp, Artificial
  CRISPR gRNA sequence
ttcaggttcacattttcaca

SEQ ID NO: 661325 - DNA, 20 bp, Artificial
  CRISPR gRNA sequence
aggttcacattttcacactt

SEQ ID NO: 661326 - DNA, 20 bp, Artificial
  CRISPR gRNA sequence
acattttcacactttttgga

SEQ ID NO: 661327 - DNA, 20 bp, Artificial
  CRISPR gRNA sequence
tcacactttttggaagactt

SEQ ID NO: 661328 - DNA, 20 bp, Artificial
  CRISPR gRNA sequence
cacactttttggaagacttt

SEQ ID NO: 661329 - DNA, 20 bp, Artificial
  CRISPR gRNA sequence
acactttttggaagactttt

SEQ ID NO: 661330 - DNA, 20 bp, Artificial
  CRISPR gRNA sequence
tttggaagacttttggaaaa

SEQ ID NO: 661331 - DNA, 20 bp, Artificial
  CRISPR gRNA sequence
ttggaagacttttggaaaaa

SEQ ID NO: 661332 - DNA, 20 bp, Artificial
  CRISPR gRNA sequence
tggaagacttttggaaaaat

SEQ ID NO: 661333 - DNA, 20 bp, Artificial
  CRISPR gRNA sequence
ggaagacttttggaaaaatc

SEQ ID NO: 661334 - DNA, 20 bp, Artificial
  CRISPR gRNA sequence
gaagacttttggaaaaatct

SEQ ID NO: 661335 - DNA, 20 bp, Artificial
  CRISPR gRNA sequence
ttggaaaaatctcttaccct

SEQ ID NO: 661336 - DNA, 20 bp, Artificial
  CRISPR gRNA sequence
tggaaaaatctcttaccctg

SEQ ID NO: 661337 - DNA, 20 bp, Artificial
  CRISPR gRNA sequence
ggaaaaatctcttaccctga

SEQ ID NO: 661338 - DNA, 20 bp, Artificial
  CRISPR gRNA sequence
gaaaaatctcttaccctgag

SEQ ID NO: 661339 - DNA, 20 bp, Artificial
  CRISPR gRNA sequence
ttaccctgagtttcacattc

SEQ ID NO: 661340 - DNA, 20 bp, Artificial
  CRISPR gRNA sequence
accctgagtttcacattcat

SEQ ID NO: 661341 - DNA, 20 bp, Artificial
  CRISPR gRNA sequence
ccctgagtttcacattcatt

SEQ ID NO: 661342 - DNA, 20 bp, Artificial
  CRISPR gRNA sequence
agtttcacattcattttcat

SEQ ID NO: 661343 - DNA, 20 bp, Artificial
  CRISPR gRNA sequence
cacattcattttcatacact

SEQ ID NO: 661344 - DNA, 20 bp, Artificial
  CRISPR gRNA sequence
acattcattttcatacactt

SEQ ID NO: 661345 - DNA, 20 bp, Artificial
  CRISPR gRNA sequence
attttcatacactttatttt

SEQ ID NO: 661346 - DNA, 20 bp, Artificial
  CRISPR gRNA sequence
tcatacactttattttggga

SEQ ID NO: 661347 - DNA, 20 bp, Artificial
  CRISPR gRNA sequence
catacactttattttgggaa

SEQ ID NO: 661348 - DNA, 20 bp, Artificial
  CRISPR gRNA sequence
atacactttattttgggaag

SEQ ID NO: 661349 - DNA, 20 bp, Artificial
  CRISPR gRNA sequence
tattttgggaaggcatttgg

SEQ ID NO: 661350 - DNA, 20 bp, Artificial
  CRISPR gRNA sequence
attttgggaaggcatttggt

SEQ ID NO: 661351 - DNA, 20 bp, Artificial
  CRISPR gRNA sequence
ttttgggaaggcatttggtt

SEQ ID NO: 661352 - DNA, 20 bp, Artificial
  CRISPR gRNA sequence
tgggaaggcatttggttcat

SEQ ID NO: 661353 - DNA, 20 bp, Artificial
  CRISPR gRNA sequence
gggaaggcatttggttcatt

SEQ ID NO: 661354 - DNA, 20 bp, Artificial
  CRISPR gRNA sequence
ggaaggcatttggttcattc

SEQ ID NO: 661355 - DNA, 20 bp, Artificial
  CRISPR gRNA sequence
ggttcattcagtgtcataca

SEQ ID NO: 661356 - DNA, 20 bp, Artificial
  CRISPR gRNA sequence
gttcattcagtgtcatacat

SEQ ID NO: 661357 - DNA, 20 bp, Artificial
  CRISPR gRNA sequence
attcagtgtcatacatcaca

SEQ ID NO: 661358 - DNA, 20 bp, Artificial
  CRISPR gRNA sequence
agtgtcatacatcacatggc

SEQ ID NO: 661359 - DNA, 20 bp, Artificial
  CRISPR gRNA sequence
aataatcactattaattcca

SEQ ID NO: 661360 - DNA, 20 bp, Artificial
  CRISPR gRNA sequence
ttaattccatttctcaagtc

SEQ ID NO: 661361 - DNA, 20 bp, Artificial
  CRISPR gRNA sequence
attccatttctcaagtccat

SEQ ID NO: 661362 - DNA, 20 bp, Artificial
  CRISPR gRNA sequence
catttctcaagtccatccaa

SEQ ID NO: 661363 - DNA, 20 bp, Artificial
  CRISPR gRNA sequence
ctcaagtccatccaacagta

SEQ ID NO: 661364 - DNA, 20 bp, Artificial
  CRISPR gRNA sequence
tcaagtccatccaacagtaa

SEQ ID NO: 661365 - DNA, 20 bp, Artificial
  CRISPR gRNA sequence
aagtccatccaacagtaaat

SEQ ID NO: 661366 - DNA, 20 bp, Artificial
  CRISPR gRNA sequence
ggtctttttaaatatttgat

SEQ ID NO: 661367 - DNA, 20 bp, Artificial
  CRISPR gRNA sequence
gtctttttaaatatttgatt

SEQ ID NO: 661368 - DNA, 20 bp, Artificial
  CRISPR gRNA sequence
tttaaatatttgatttaatt

SEQ ID NO: 661369 - DNA, 20 bp, Artificial
  CRISPR gRNA sequence
ttaaatatttgatttaattc

SEQ ID NO: 661370 - DNA, 20 bp, Artificial
  CRISPR gRNA sequence
taaatatttgatttaattca

SEQ ID NO: 661371 - DNA, 20 bp, Artificial
  CRISPR gRNA sequence
aaatatttgatttaattcaa

SEQ ID NO: 661372 - DNA, 20 bp, Artificial
  CRISPR gRNA sequence
aatatttgatttaattcaaa

SEQ ID NO: 661373 - DNA, 20 bp, Artificial
  CRISPR gRNA sequence
gatttaattcaaaataacgt

SEQ ID NO: 661374 - DNA, 20 bp, Artificial
  CRISPR gRNA sequence
atttaattcaaaataacgtt

SEQ ID NO: 661375 - DNA, 20 bp, Artificial
  CRISPR gRNA sequence
aattcaaaataacgttttag

SEQ ID NO: 661376 - DNA, 20 bp, Artificial
  CRISPR gRNA sequence
attcaaaataacgttttaga

SEQ ID NO: 661377 - DNA, 20 bp, Artificial
  CRISPR gRNA sequence
aaaataacgttttagatgtt

SEQ ID NO: 661378 - DNA, 20 bp, Artificial
  CRISPR gRNA sequence
tagatgtttctgtaacaatt

SEQ ID NO: 661379 - DNA, 20 bp, Artificial
  CRISPR gRNA sequence
agatgtttctgtaacaattt

SEQ ID NO: 661380 - DNA, 20 bp, Artificial
  CRISPR gRNA sequence
gatgtttctgtaacaattta

SEQ ID NO: 661381 - DNA, 20 bp, Artificial
  CRISPR gRNA sequence
ctgtaacaatttacatttag

SEQ ID NO: 661382 - DNA, 20 bp, Artificial
  CRISPR gRNA sequence
tgtaacaatttacatttagg

SEQ ID NO: 661383 - DNA, 20 bp, Artificial
  CRISPR gRNA sequence
taacaatttacatttaggat

SEQ ID NO: 661384 - DNA, 20 bp, Artificial
  CRISPR gRNA sequence
acatttaggatctctcaaag

SEQ ID NO: 661385 - DNA, 20 bp, Artificial
  CRISPR gRNA sequence
catttaggatctctcaaagt

SEQ ID NO: 661386 - DNA, 20 bp, Artificial
  CRISPR gRNA sequence
aggatctctcaaagtcaaac

SEQ ID NO: 661387 - DNA, 20 bp, Artificial
  CRISPR gRNA sequence
ggatctctcaaagtcaaact

SEQ ID NO: 661388 - DNA, 20 bp, Artificial
  CRISPR gRNA sequence
tcaaagtcaaactatcagaa

SEQ ID NO: 661389 - DNA, 20 bp, Artificial
  CRISPR gRNA sequence
aaagtcaaactatcagaata

SEQ ID NO: 661390 - DNA, 20 bp, Artificial
  CRISPR gRNA sequence
tcagaatacttgtcagagta

SEQ ID NO: 661391 - DNA, 20 bp, Artificial
  CRISPR gRNA sequence
gtcagagtaaaaaaaaaccc

SEQ ID NO: 661392 - DNA, 20 bp, Artificial
  CRISPR gRNA sequence
tcagagtaaaaaaaaacccg

SEQ ID NO: 661393 - DNA, 20 bp, Artificial
  CRISPR gRNA sequence
cacctttgcccctataacac

SEQ ID NO: 661394 - DNA, 20 bp, Artificial
  CRISPR gRNA sequence
tgcccctataacacacacac

SEQ ID NO: 661395 - DNA, 20 bp, Artificial
  CRISPR gRNA sequence
gcccctataacacacacaca

SEQ ID NO: 661396 - DNA, 20 bp, Artificial
  CRISPR gRNA sequence
cccctataacacacacacat

SEQ ID NO: 661397 - DNA, 20 bp, Artificial
  CRISPR gRNA sequence
taacacacacacatccacac

SEQ ID NO: 661398 - DNA, 20 bp, Artificial
  CRISPR gRNA sequence
tttattatagaggaagattt

SEQ ID NO: 661399 - DNA, 20 bp, Artificial
  CRISPR gRNA sequence
ttattatagaggaagatttg

SEQ ID NO: 661400 - DNA, 20 bp, Artificial
  CRISPR gRNA sequence
tattatagaggaagatttga

SEQ ID NO: 661401 - DNA, 20 bp, Artificial
  CRISPR gRNA sequence
attatagaggaagatttgat

SEQ ID NO: 661402 - DNA, 20 bp, Artificial
  CRISPR gRNA sequence
ttatagaggaagatttgatt

SEQ ID NO: 661403 - DNA, 20 bp, Artificial
  CRISPR gRNA sequence
tagaggaagatttgatttta

SEQ ID NO: 661404 - DNA, 20 bp, Artificial
  CRISPR gRNA sequence
gattttagattactctgagg

SEQ ID NO: 661405 - DNA, 20 bp, Artificial
  CRISPR gRNA sequence
attttagattactctgagga

SEQ ID NO: 661406 - DNA, 20 bp, Artificial
  CRISPR gRNA sequence
tagattactctgaggaagaa

SEQ ID NO: 661407 - DNA, 20 bp, Artificial
  CRISPR gRNA sequence
agattactctgaggaagaaa

SEQ ID NO: 661408 - DNA, 20 bp, Artificial
  CRISPR gRNA sequence
gattactctgaggaagaaaa

SEQ ID NO: 661409 - DNA, 20 bp, Artificial
  CRISPR gRNA sequence
ctctgaggaagaaaattttt

SEQ ID NO: 661410 - DNA, 20 bp, Artificial
  CRISPR gRNA sequence
tgaggaagaaaatttttttt

SEQ ID NO: 661411 - DNA, 20 bp, Artificial
  CRISPR gRNA sequence
aggaagaaaattttttttca

SEQ ID NO: 661412 - DNA, 20 bp, Artificial
  CRISPR gRNA sequence
tttttcaggaaaacctatta

SEQ ID NO: 661413 - DNA, 20 bp, Artificial
  CRISPR gRNA sequence
ttttcaggaaaacctattat

SEQ ID NO: 661414 - DNA, 20 bp, Artificial
  CRISPR gRNA sequence
tttcaggaaaacctattatc

SEQ ID NO: 661415 - DNA, 20 bp, Artificial
  CRISPR gRNA sequence
ttcaggaaaacctattatcc

SEQ ID NO: 661416 - DNA, 20 bp, Artificial
  CRISPR gRNA sequence
tcaggaaaacctattatcct

SEQ ID NO: 661417 - DNA, 20 bp, Artificial
  CRISPR gRNA sequence
caggaaaacctattatcctt

SEQ ID NO: 661418 - DNA, 20 bp, Artificial
  CRISPR gRNA sequence
aggaaaacctattatcctta

SEQ ID NO: 661419 - DNA, 20 bp, Artificial
  CRISPR gRNA sequence
ttatccttagcaaatataaa

SEQ ID NO: 661420 - DNA, 20 bp, Artificial
  CRISPR gRNA sequence
tccttagcaaatataaacac

SEQ ID NO: 661421 - DNA, 20 bp, Artificial
  CRISPR gRNA sequence
agcaaatataaacactgaaa

SEQ ID NO: 661422 - DNA, 20 bp, Artificial
  CRISPR gRNA sequence
gcaaatataaacactgaaaa

SEQ ID NO: 661423 - DNA, 20 bp, Artificial
  CRISPR gRNA sequence
aaaatatattgaaaactttc

SEQ ID NO: 661424 - DNA, 20 bp, Artificial
  CRISPR gRNA sequence
aaaactttcagtcagctatt

SEQ ID NO: 661425 - DNA, 20 bp, Artificial
  CRISPR gRNA sequence
tcagtcagctattatttgaa

SEQ ID NO: 661426 - DNA, 20 bp, Artificial
  CRISPR gRNA sequence
cagtcagctattatttgaac

SEQ ID NO: 661427 - DNA, 20 bp, Artificial
  CRISPR gRNA sequence
agtcagctattatttgaact

SEQ ID NO: 661428 - DNA, 20 bp, Artificial
  CRISPR gRNA sequence
ttatttgaactcaaaatttg

SEQ ID NO: 661429 - DNA, 20 bp, Artificial
  CRISPR gRNA sequence
tttgaactcaaaatttggag

SEQ ID NO: 661430 - DNA, 20 bp, Artificial
  CRISPR gRNA sequence
gaactcaaaatttggagttg

SEQ ID NO: 661431 - DNA, 20 bp, Artificial
  CRISPR gRNA sequence
aactcaaaatttggagttgg

SEQ ID NO: 661432 - DNA, 20 bp, Artificial
  CRISPR gRNA sequence
aaaatttggagttgggtgtc

SEQ ID NO: 661433 - DNA, 20 bp, Artificial
  CRISPR gRNA sequence
ggagttgggtgtcaatgtta

SEQ ID NO: 661434 - DNA, 20 bp, Artificial
  CRISPR gRNA sequence
gagttgggtgtcaatgttag

SEQ ID NO: 661435 - DNA, 20 bp, Artificial
  CRISPR gRNA sequence
ggtgtcaatgttagagattt

SEQ ID NO: 661436 - DNA, 20 bp, Artificial
  CRISPR gRNA sequence
gagattttaggaagacattt

SEQ ID NO: 661437 - DNA, 20 bp, Artificial
  CRISPR gRNA sequence
taggaagacatttaaggcag

SEQ ID NO: 661438 - DNA, 20 bp, Artificial
  CRISPR gRNA sequence
aggaagacatttaaggcaga

SEQ ID NO: 661439 - DNA, 20 bp, Artificial
  CRISPR gRNA sequence
ggaagacatttaaggcagag

SEQ ID NO: 661440 - DNA, 20 bp, Artificial
  CRISPR gRNA sequence
aaggcagagaaccaggctca

SEQ ID NO: 661441 - DNA, 20 bp, Artificial
  CRISPR gRNA sequence
aggcagagaaccaggctcaa

SEQ ID NO: 661442 - DNA, 20 bp, Artificial
  CRISPR gRNA sequence
aagagatgtattagacgtaa

SEQ ID NO: 661443 - DNA, 20 bp, Artificial
  CRISPR gRNA sequence
gacgtaactgattattacag

SEQ ID NO: 661444 - DNA, 20 bp, Artificial
  CRISPR gRNA sequence
attattacaggtatattagg

SEQ ID NO: 661445 - DNA, 20 bp, Artificial
  CRISPR gRNA sequence
ttacaggtatattaggagga

SEQ ID NO: 661446 - DNA, 20 bp, Artificial
  CRISPR gRNA sequence
caggtatattaggaggagtt

SEQ ID NO: 661447 - DNA, 20 bp, Artificial
  CRISPR gRNA sequence
ggaggagtttgggattgcag

SEQ ID NO: 661448 - DNA, 20 bp, Artificial
  CRISPR gRNA sequence
gggattgcagttgcagtggg

SEQ ID NO: 661449 - DNA, 20 bp, Artificial
  CRISPR gRNA sequence
ggattgcagttgcagtggga

SEQ ID NO: 661450 - DNA, 20 bp, Artificial
  CRISPR gRNA sequence
cagttgcagtgggagatagg

SEQ ID NO: 661451 - DNA, 20 bp, Artificial
  CRISPR gRNA sequence
cagtgggagataggcattct

SEQ ID NO: 661452 - DNA, 20 bp, Artificial
  CRISPR gRNA sequence
tggccattgctagcacttgt

SEQ ID NO: 661453 - DNA, 20 bp, Artificial
  CRISPR gRNA sequence
gccattgctagcacttgtca

SEQ ID NO: 661454 - DNA, 20 bp, Artificial
  CRISPR gRNA sequence
ctagcacttgtcatccttgt

SEQ ID NO: 661455 - DNA, 20 bp, Artificial
  CRISPR gRNA sequence
gcacttgtcatccttgtgat

SEQ ID NO: 661456 - DNA, 20 bp, Artificial
  CRISPR gRNA sequence
gtcatccttgtgatgagtat

SEQ ID NO: 661457 - DNA, 20 bp, Artificial
  CRISPR gRNA sequence
tcatccttgtgatgagtata

SEQ ID NO: 661458 - DNA, 20 bp, Artificial
  CRISPR gRNA sequence
gtgatgagtataaaaatagc

SEQ ID NO: 661459 - DNA, 20 bp, Artificial
  CRISPR gRNA sequence
tgatgagtataaaaatagct

SEQ ID NO: 661460 - DNA, 20 bp, Artificial
  CRISPR gRNA sequence
tttacctttatttctgtcaa

SEQ ID NO: 661461 - DNA, 20 bp, Artificial
  CRISPR gRNA sequence
acctttatttctgtcaaact

SEQ ID NO: 661462 - DNA, 20 bp, Artificial
  CRISPR gRNA sequence
cctttatttctgtcaaactt

SEQ ID NO: 661463 - DNA, 20 bp, Artificial
  CRISPR gRNA sequence
tatttctgtcaaacttgtgt

SEQ ID NO: 661464 - DNA, 20 bp, Artificial
  CRISPR gRNA sequence
atttctgtcaaacttgtgta

SEQ ID NO: 661465 - DNA, 20 bp, Artificial
  CRISPR gRNA sequence
tttctgtcaaacttgtgtat

SEQ ID NO: 661466 - DNA, 20 bp, Artificial
  CRISPR gRNA sequence
ctgtcaaacttgtgtatcct

SEQ ID NO: 661467 - DNA, 20 bp, Artificial
  CRISPR gRNA sequence
tgtcaaacttgtgtatcctt

SEQ ID NO: 661468 - DNA, 20 bp, Artificial
  CRISPR gRNA sequence
tcaaacttgtgtatccttgc

SEQ ID NO: 661469 - DNA, 20 bp, Artificial
  CRISPR gRNA sequence
gtgtatccttgcccctcctt

SEQ ID NO: 661470 - DNA, 20 bp, Artificial
  CRISPR gRNA sequence
tgtatccttgcccctccttg

SEQ ID NO: 661471 - DNA, 20 bp, Artificial
  CRISPR gRNA sequence
gcccctccttgctcaataga

SEQ ID NO: 661472 - DNA, 20 bp, Artificial
  CRISPR gRNA sequence
cccctccttgctcaatagat

SEQ ID NO: 661473 - DNA, 20 bp, Artificial
  CRISPR gRNA sequence
cttgctcaatagatgccaac

SEQ ID NO: 661474 - DNA, 20 bp, Artificial
  CRISPR gRNA sequence
gctcaatagatgccaacttt

SEQ ID NO: 661475 - DNA, 20 bp, Artificial
  CRISPR gRNA sequence
ctcaatagatgccaacttta

SEQ ID NO: 661476 - DNA, 20 bp, Artificial
  CRISPR gRNA sequence
aatagatgccaactttaaga

SEQ ID NO: 661477 - DNA, 20 bp, Artificial
  CRISPR gRNA sequence
taagaatataatcccaggca

SEQ ID NO: 661478 - DNA, 20 bp, Artificial
  CRISPR gRNA sequence
aagaatataatcccaggcac

SEQ ID NO: 661479 - DNA, 20 bp, Artificial
  CRISPR gRNA sequence
agaatataatcccaggcaca

SEQ ID NO: 661480 - DNA, 20 bp, Artificial
  CRISPR gRNA sequence
agaaacatgctaaaacaaaa

SEQ ID NO: 661481 - DNA, 20 bp, Artificial
  CRISPR gRNA sequence
gaaacatgctaaaacaaaac

SEQ ID NO: 661482 - DNA, 20 bp, Artificial
  CRISPR gRNA sequence
aaacaaaacaaacaaacacc

SEQ ID NO: 661483 - DNA, 20 bp, Artificial
  CRISPR gRNA sequence
tctccactccttccctaaaa

SEQ ID NO: 661484 - DNA, 20 bp, Artificial
  CRISPR gRNA sequence
tccactccttccctaaaaca

SEQ ID NO: 661485 - DNA, 20 bp, Artificial
  CRISPR gRNA sequence
cactccttccctaaaacaat

SEQ ID NO: 661486 - DNA, 20 bp, Artificial
  CRISPR gRNA sequence
cttccctaaaacaattagaa

SEQ ID NO: 661487 - DNA, 20 bp, Artificial
  CRISPR gRNA sequence
ccctaaaacaattagaaaaa

SEQ ID NO: 661488 - DNA, 20 bp, Artificial
  CRISPR gRNA sequence
cctaaaacaattagaaaaaa

SEQ ID NO: 661489 - DNA, 20 bp, Artificial
  CRISPR gRNA sequence
aaacaattagaaaaaacgta

SEQ ID NO: 661490 - DNA, 20 bp, Artificial
  CRISPR gRNA sequence
gaaaaaacgtatgtgccaag

SEQ ID NO: 661491 - DNA, 20 bp, Artificial
  CRISPR gRNA sequence
aagaaagagagataagggga

SEQ ID NO: 661492 - DNA, 20 bp, Artificial
  CRISPR gRNA sequence
cttacctccaaagtaaatta

SEQ ID NO: 661493 - DNA, 20 bp, Artificial
  CRISPR gRNA sequence
ttacctccaaagtaaattaa

SEQ ID NO: 661494 - DNA, 20 bp, Artificial
  CRISPR gRNA sequence
acctccaaagtaaattaact

SEQ ID NO: 661495 - DNA, 20 bp, Artificial
  CRISPR gRNA sequence
cctccaaagtaaattaactt

SEQ ID NO: 661496 - DNA, 20 bp, Artificial
  CRISPR gRNA sequence
caaagtaaattaactttgaa

SEQ ID NO: 661497 - DNA, 20 bp, Artificial
  CRISPR gRNA sequence
actttgaaacatggttcttt

SEQ ID NO: 661498 - DNA, 20 bp, Artificial
  CRISPR gRNA sequence
tgaaacatggttctttgttt

SEQ ID NO: 661499 - DNA, 20 bp, Artificial
  CRISPR gRNA sequence
gaaacatggttctttgtttt

SEQ ID NO: 661500 - DNA, 20 bp, Artificial
  CRISPR gRNA sequence
aaacatggttctttgttttt

SEQ ID NO: 661501 - DNA, 20 bp, Artificial
  CRISPR gRNA sequence
tttgttttttagagaaacag

SEQ ID NO: 661502 - DNA, 20 bp, Artificial
  CRISPR gRNA sequence
tgttttttagagaaacagac

SEQ ID NO: 661503 - DNA, 20 bp, Artificial
  CRISPR gRNA sequence
gttttttagagaaacagaca

SEQ ID NO: 661504 - DNA, 20 bp, Artificial
  CRISPR gRNA sequence
ttttttagagaaacagacat

SEQ ID NO: 661505 - DNA, 20 bp, Artificial
  CRISPR gRNA sequence
tttagagaaacagacatttg

SEQ ID NO: 661506 - DNA, 20 bp, Artificial
  CRISPR gRNA sequence
ttagagaaacagacatttgc

SEQ ID NO: 661507 - DNA, 20 bp, Artificial
  CRISPR gRNA sequence
tagagaaacagacatttgca

SEQ ID NO: 661508 - DNA, 20 bp, Artificial
  CRISPR gRNA sequence
agagaaacagacatttgcag

SEQ ID NO: 661509 - DNA, 20 bp, Artificial
  CRISPR gRNA sequence
gagaaacagacatttgcaga

SEQ ID NO: 661510 - DNA, 20 bp, Artificial
  CRISPR gRNA sequence
gcagagttaggggatttctt

SEQ ID NO: 661511 - DNA, 20 bp, Artificial
  CRISPR gRNA sequence
cagagttaggggatttcttg

SEQ ID NO: 661512 - DNA, 20 bp, Artificial
  CRISPR gRNA sequence
ggggatttcttgagattgta

SEQ ID NO: 661513 - DNA, 20 bp, Artificial
  CRISPR gRNA sequence
cttgagattgtacctgaaag

SEQ ID NO: 661514 - DNA, 20 bp, Artificial
  CRISPR gRNA sequence
ttgagattgtacctgaaagt

SEQ ID NO: 661515 - DNA, 20 bp, Artificial
  CRISPR gRNA sequence
gagattgtacctgaaagtag

SEQ ID NO: 661516 - DNA, 20 bp, Artificial
  CRISPR gRNA sequence
agattgtacctgaaagtagg

SEQ ID NO: 661517 - DNA, 20 bp, Artificial
  CRISPR gRNA sequence
tacctgaaagtaggtagtat

SEQ ID NO: 661518 - DNA, 20 bp, Artificial
  CRISPR gRNA sequence
aaagtaggtagtatatttac

SEQ ID NO: 661519 - DNA, 20 bp, Artificial
  CRISPR gRNA sequence
actagaggttttaataccat

SEQ ID NO: 661520 - DNA, 20 bp, Artificial
  CRISPR gRNA sequence
ctagaggttttaataccatt

SEQ ID NO: 661521 - DNA, 20 bp, Artificial
  CRISPR gRNA sequence
gaggttttaataccatttgt

SEQ ID NO: 661522 - DNA, 20 bp, Artificial
  CRISPR gRNA sequence
taataccatttgttttgtac

SEQ ID NO: 661523 - DNA, 20 bp, Artificial
  CRISPR gRNA sequence
aataccatttgttttgtaca

SEQ ID NO: 661524 - DNA, 20 bp, Artificial
  CRISPR gRNA sequence
ataccatttgttttgtacaa

SEQ ID NO: 661525 - DNA, 20 bp, Artificial
  CRISPR gRNA sequence
gttttgtacaatggataaat

SEQ ID NO: 661526 - DNA, 20 bp, Artificial
  CRISPR gRNA sequence
ttttgtacaatggataaatc

SEQ ID NO: 661527 - DNA, 20 bp, Artificial
  CRISPR gRNA sequence
tgtacaatggataaatccca

SEQ ID NO: 661528 - DNA, 20 bp, Artificial
  CRISPR gRNA sequence
gtacaatggataaatcccag

SEQ ID NO: 661529 - DNA, 20 bp, Artificial
  CRISPR gRNA sequence
tacaatggataaatcccagc

SEQ ID NO: 661530 - DNA, 20 bp, Artificial
  CRISPR gRNA sequence
atgtaatagtaaaattatgt

SEQ ID NO: 661531 - DNA, 20 bp, Artificial
  CRISPR gRNA sequence
tgtaatagtaaaattatgtg

SEQ ID NO: 661532 - DNA, 20 bp, Artificial
  CRISPR gRNA sequence
tgtgtaagaaaaagctattc

SEQ ID NO: 661533 - DNA, 20 bp, Artificial
  CRISPR gRNA sequence
ttctccatgggctctaaagt

SEQ ID NO: 661534 - DNA, 20 bp, Artificial
  CRISPR gRNA sequence
tccatgggctctaaagttaa

SEQ ID NO: 661535 - DNA, 20 bp, Artificial
  CRISPR gRNA sequence
catgggctctaaagttaact

SEQ ID NO: 661536 - DNA, 20 bp, Artificial
  CRISPR gRNA sequence
taaagttaactttgaagagg

SEQ ID NO: 661537 - DNA, 20 bp, Artificial
  CRISPR gRNA sequence
aagttaactttgaagaggcc

SEQ ID NO: 661538 - DNA, 20 bp, Artificial
  CRISPR gRNA sequence
actttgaagaggccccaaaa

SEQ ID NO: 661539 - DNA, 20 bp, Artificial
  CRISPR gRNA sequence
tgaagaggccccaaaaaaac

SEQ ID NO: 661540 - DNA, 20 bp, Artificial
  CRISPR gRNA sequence
gaagaggccccaaaaaaact

SEQ ID NO: 661541 - DNA, 20 bp, Artificial
  CRISPR gRNA sequence
aagaggccccaaaaaaactg

SEQ ID NO: 661542 - DNA, 20 bp, Artificial
  CRISPR gRNA sequence
agttaaggaagagataagat

SEQ ID NO: 661543 - DNA, 20 bp, Artificial
  CRISPR gRNA sequence
aggaagagataagatcattc

SEQ ID NO: 661544 - DNA, 20 bp, Artificial
  CRISPR gRNA sequence
tttcctccaggctgatttta

SEQ ID NO: 661545 - DNA, 20 bp, Artificial
  CRISPR gRNA sequence
tcctccaggctgattttaag

SEQ ID NO: 661546 - DNA, 20 bp, Artificial
  CRISPR gRNA sequence
cctccaggctgattttaaga

SEQ ID NO: 661547 - DNA, 20 bp, Artificial
  CRISPR gRNA sequence
ctccaggctgattttaagat

SEQ ID NO: 661548 - DNA, 20 bp, Artificial
  CRISPR gRNA sequence
caggctgattttaagatgtt

SEQ ID NO: 661549 - DNA, 20 bp, Artificial
  CRISPR gRNA sequence
attttaagatgtttaaactc

SEQ ID NO: 661550 - DNA, 20 bp, Artificial
  CRISPR gRNA sequence
taagatgtttaaactcctaa

SEQ ID NO: 661551 - DNA, 20 bp, Artificial
  CRISPR gRNA sequence
aagatgtttaaactcctaaa

SEQ ID NO: 661552 - DNA, 20 bp, Artificial
  CRISPR gRNA sequence
agatgtttaaactcctaaat

SEQ ID NO: 661553 - DNA, 20 bp, Artificial
  CRISPR gRNA sequence
aaactcctaaatactgtaaa

SEQ ID NO: 661554 - DNA, 20 bp, Artificial
  CRISPR gRNA sequence
aactcctaaatactgtaaag

SEQ ID NO: 661555 - DNA, 20 bp, Artificial
  CRISPR gRNA sequence
ctaaatactgtaaagattag

SEQ ID NO: 661556 - DNA, 20 bp, Artificial
  CRISPR gRNA sequence
aatactgtaaagattaggct

SEQ ID NO: 661557 - DNA, 20 bp, Artificial
  CRISPR gRNA sequence
taaagattaggctactctct

SEQ ID NO: 661558 - DNA, 20 bp, Artificial
  CRISPR gRNA sequence
ggctactctctgcataccat

SEQ ID NO: 661559 - DNA, 20 bp, Artificial
  CRISPR gRNA sequence
ctctctgcataccatttcag

SEQ ID NO: 661560 - DNA, 20 bp, Artificial
  CRISPR gRNA sequence
tctgcataccatttcagaat

SEQ ID NO: 661561 - DNA, 20 bp, Artificial
  CRISPR gRNA sequence
tgcataccatttcagaatga

SEQ ID NO: 661562 - DNA, 20 bp, Artificial
  CRISPR gRNA sequence
cataccatttcagaatgagt

SEQ ID NO: 661563 - DNA, 20 bp, Artificial
  CRISPR gRNA sequence
cagaatgagttggagttgta

SEQ ID NO: 661564 - DNA, 20 bp, Artificial
  CRISPR gRNA sequence
agaatgagttggagttgtac

SEQ ID NO: 661565 - DNA, 20 bp, Artificial
  CRISPR gRNA sequence
gagttgtaccattatagatc

SEQ ID NO: 661566 - DNA, 20 bp, Artificial
  CRISPR gRNA sequence
taccattatagatctccact

SEQ ID NO: 661567 - DNA, 20 bp, Artificial
  CRISPR gRNA sequence
tagatctccactaagtctct

SEQ ID NO: 661568 - DNA, 20 bp, Artificial
  CRISPR gRNA sequence
cactaagtctcttagtgtta

SEQ ID NO: 661569 - DNA, 20 bp, Artificial
  CRISPR gRNA sequence
agtctcttagtgttatcaac

SEQ ID NO: 661570 - DNA, 20 bp, Artificial
  CRISPR gRNA sequence
ttagtgttatcaacttcttt

SEQ ID NO: 661571 - DNA, 20 bp, Artificial
  CRISPR gRNA sequence
agtgttatcaacttctttga

SEQ ID NO: 661572 - DNA, 20 bp, Artificial
  CRISPR gRNA sequence
gtgttatcaacttctttgat

SEQ ID NO: 661573 - DNA, 20 bp, Artificial
  CRISPR gRNA sequence
tcaacttctttgatagtcat

SEQ ID NO: 661574 - DNA, 20 bp, Artificial
  CRISPR gRNA sequence
ctttgatagtcattggagca

SEQ ID NO: 661575 - DNA, 20 bp, Artificial
  CRISPR gRNA sequence
tttgatagtcattggagcaa

SEQ ID NO: 661576 - DNA, 20 bp, Artificial
  CRISPR gRNA sequence
tgatagtcattggagcaagg

SEQ ID NO: 661577 - DNA, 20 bp, Artificial
  CRISPR gRNA sequence
gatagtcattggagcaaggg

SEQ ID NO: 661578 - DNA, 20 bp, Artificial
  CRISPR gRNA sequence
atagtcattggagcaaggga

SEQ ID NO: 661579 - DNA, 20 bp, Artificial
  CRISPR gRNA sequence
gagcaagggacatccatata

SEQ ID NO: 661580 - DNA, 20 bp, Artificial
  CRISPR gRNA sequence
aatgattatttaacttagct

SEQ ID NO: 661581 - DNA, 20 bp, Artificial
  CRISPR gRNA sequence
atgattatttaacttagcta

SEQ ID NO: 661582 - DNA, 20 bp, Artificial
  CRISPR gRNA sequence
tttaacttagctaatattta

SEQ ID NO: 661583 - DNA, 20 bp, Artificial
  CRISPR gRNA sequence
aacttagctaatatttactg

SEQ ID NO: 661584 - DNA, 20 bp, Artificial
  CRISPR gRNA sequence
acttagctaatatttactgg

SEQ ID NO: 661585 - DNA, 20 bp, Artificial
  CRISPR gRNA sequence
agctaatatttactggttat

SEQ ID NO: 661586 - DNA, 20 bp, Artificial
  CRISPR gRNA sequence
gctaatatttactggttatc

SEQ ID NO: 661587 - DNA, 20 bp, Artificial
  CRISPR gRNA sequence
atatttactggttatctcaa

SEQ ID NO: 661588 - DNA, 20 bp, Artificial
  CRISPR gRNA sequence
actggttatctcaaggcctt

SEQ ID NO: 661589 - DNA, 20 bp, Artificial
  CRISPR gRNA sequence
ctggttatctcaaggccttg

SEQ ID NO: 661590 - DNA, 20 bp, Artificial
  CRISPR gRNA sequence
gttatctcaaggccttgaaa

SEQ ID NO: 661591 - DNA, 20 bp, Artificial
  CRISPR gRNA sequence
tctcaaggccttgaaagaga

SEQ ID NO: 661592 - DNA, 20 bp, Artificial
  CRISPR gRNA sequence
aaggccttgaaagagaagat

SEQ ID NO: 661593 - DNA, 20 bp, Artificial
  CRISPR gRNA sequence
gaaagagaagatccagttca

SEQ ID NO: 661594 - DNA, 20 bp, Artificial
  CRISPR gRNA sequence
aaagagaagatccagttcag

SEQ ID NO: 661595 - DNA, 20 bp, Artificial
  CRISPR gRNA sequence
agattcactttaaaaaacaa

SEQ ID NO: 661596 - DNA, 20 bp, Artificial
  CRISPR gRNA sequence
actttaaaaaacaatcagat

SEQ ID NO: 661597 - DNA, 20 bp, Artificial
  CRISPR gRNA sequence
taaaaaacaatcagatattt

SEQ ID NO: 661598 - DNA, 20 bp, Artificial
  CRISPR gRNA sequence
aaaaaacaatcagatattta

SEQ ID NO: 661599 - DNA, 20 bp, Artificial
  CRISPR gRNA sequence
aaaaacaatcagatatttag

SEQ ID NO: 661600 - DNA, 20 bp, Artificial
  CRISPR gRNA sequence
agattatattggcatgctca

SEQ ID NO: 661601 - DNA, 20 bp, Artificial
  CRISPR gRNA sequence
gattatattggcatgctcat

SEQ ID NO: 661602 - DNA, 20 bp, Artificial
  CRISPR gRNA sequence
tattggcatgctcataatta

SEQ ID NO: 661603 - DNA, 20 bp, Artificial
  CRISPR gRNA sequence
gcatgctcataattattttt

SEQ ID NO: 661604 - DNA, 20 bp, Artificial
  CRISPR gRNA sequence
ataattattttttttagatg

SEQ ID NO: 661605 - DNA, 20 bp, Artificial
  CRISPR gRNA sequence
ttttttttagatgataggaa

SEQ ID NO: 661606 - DNA, 20 bp, Artificial
  CRISPR gRNA sequence
tttttagatgataggaagtc

SEQ ID NO: 661607 - DNA, 20 bp, Artificial
  CRISPR gRNA sequence
ttttagatgataggaagtct

SEQ ID NO: 661608 - DNA, 20 bp, Artificial
  CRISPR gRNA sequence
tttagatgataggaagtctg

SEQ ID NO: 661609 - DNA, 20 bp, Artificial
  CRISPR gRNA sequence
ttagatgataggaagtctgt

SEQ ID NO: 661610 - DNA, 20 bp, Artificial
  CRISPR gRNA sequence
tagatgataggaagtctgta

SEQ ID NO: 661611 - DNA, 20 bp, Artificial
  CRISPR gRNA sequence
agatgataggaagtctgtat

SEQ ID NO: 661612 - DNA, 20 bp, Artificial
  CRISPR gRNA sequence
gatgataggaagtctgtata

SEQ ID NO: 661613 - DNA, 20 bp, Artificial
  CRISPR gRNA sequence
tatatctaatgatttctcca

SEQ ID NO: 661614 - DNA, 20 bp, Artificial
  CRISPR gRNA sequence
atgatttctccacagttttt

SEQ ID NO: 661615 - DNA, 20 bp, Artificial
  CRISPR gRNA sequence
ctccacagtttttgtatttt

SEQ ID NO: 661616 - DNA, 20 bp, Artificial
  CRISPR gRNA sequence
tccacagtttttgtattttg

SEQ ID NO: 661617 - DNA, 20 bp, Artificial
  CRISPR gRNA sequence
cacagtttttgtattttggg

SEQ ID NO: 661618 - DNA, 20 bp, Artificial
  CRISPR gRNA sequence
ttgtattttggggatgcaag

SEQ ID NO: 661619 - DNA, 20 bp, Artificial
  CRISPR gRNA sequence
tgtattttggggatgcaagt

SEQ ID NO: 661620 - DNA, 20 bp, Artificial
  CRISPR gRNA sequence
gtattttggggatgcaagtt

SEQ ID NO: 661621 - DNA, 20 bp, Artificial
  CRISPR gRNA sequence
tattttggggatgcaagttt

SEQ ID NO: 661622 - DNA, 20 bp, Artificial
  CRISPR gRNA sequence
tggggatgcaagtttttgct

SEQ ID NO: 661623 - DNA, 20 bp, Artificial
  CRISPR gRNA sequence
ggggatgcaagtttttgctt

SEQ ID NO: 661624 - DNA, 20 bp, Artificial
  CRISPR gRNA sequence
gggatgcaagtttttgcttt

SEQ ID NO: 661625 - DNA, 20 bp, Artificial
  CRISPR gRNA sequence
ttgctttttttagcaactgt

SEQ ID NO: 661626 - DNA, 20 bp, Artificial
  CRISPR gRNA sequence
tgctttttttagcaactgta

SEQ ID NO: 661627 - DNA, 20 bp, Artificial
  CRISPR gRNA sequence
gctttttttagcaactgtag

SEQ ID NO: 661628 - DNA, 20 bp, Artificial
  CRISPR gRNA sequence
ctttttttagcaactgtagg

SEQ ID NO: 661629 - DNA, 20 bp, Artificial
  CRISPR gRNA sequence
tttttagcaactgtaggatc

SEQ ID NO: 661630 - DNA, 20 bp, Artificial
  CRISPR gRNA sequence
ttttagcaactgtaggatca

SEQ ID NO: 661631 - DNA, 20 bp, Artificial
  CRISPR gRNA sequence
tttagcaactgtaggatcaa

SEQ ID NO: 661632 - DNA, 20 bp, Artificial
  CRISPR gRNA sequence
ttagcaactgtaggatcaag

SEQ ID NO: 661633 - DNA, 20 bp, Artificial
  CRISPR gRNA sequence
tagcaactgtaggatcaagg

SEQ ID NO: 661634 - DNA, 20 bp, Artificial
  CRISPR gRNA sequence
agcaactgtaggatcaaggg

SEQ ID NO: 661635 - DNA, 20 bp, Artificial
  CRISPR gRNA sequence
gcaactgtaggatcaaggga

SEQ ID NO: 661636 - DNA, 20 bp, Artificial
  CRISPR gRNA sequence
taggatcaagggaaatgttt

SEQ ID NO: 661637 - DNA, 20 bp, Artificial
  CRISPR gRNA sequence
tgtcaaacaaatcaaatata

SEQ ID NO: 661638 - DNA, 20 bp, Artificial
  CRISPR gRNA sequence
gtcaaacaaatcaaatataa

SEQ ID NO: 661639 - DNA, 20 bp, Artificial
  CRISPR gRNA sequence
tcaaacaaatcaaatataat

SEQ ID NO: 661640 - DNA, 20 bp, Artificial
  CRISPR gRNA sequence
caaacatatatttatatgta

SEQ ID NO: 661641 - DNA, 20 bp, Artificial
  CRISPR gRNA sequence
aaacatatatttatatgtat

SEQ ID NO: 661642 - DNA, 20 bp, Artificial
  CRISPR gRNA sequence
atatgtattaattcatttaa

SEQ ID NO: 661643 - DNA, 20 bp, Artificial
  CRISPR gRNA sequence
tatgtattaattcatttaat

SEQ ID NO: 661644 - DNA, 20 bp, Artificial
  CRISPR gRNA sequence
attcatttaatctcaataaa

SEQ ID NO: 661645 - DNA, 20 bp, Artificial
  CRISPR gRNA sequence
atttaatctcaataaaaccc

SEQ ID NO: 661646 - DNA, 20 bp, Artificial
  CRISPR gRNA sequence
aatctcaataaaaccctatg

SEQ ID NO: 661647 - DNA, 20 bp, Artificial
  CRISPR gRNA sequence
atctcaataaaaccctatga

SEQ ID NO: 661648 - DNA, 20 bp, Artificial
  CRISPR gRNA sequence
aataaaaccctatgaggtag

SEQ ID NO: 661649 - DNA, 20 bp, Artificial
  CRISPR gRNA sequence
tgaggtagatgctagtattg

SEQ ID NO: 661650 - DNA, 20 bp, Artificial
  CRISPR gRNA sequence
gtattgccccgctgttatag

SEQ ID NO: 661651 - DNA, 20 bp, Artificial
  CRISPR gRNA sequence
ccccgctgttatagatgaaa

SEQ ID NO: 661652 - DNA, 20 bp, Artificial
  CRISPR gRNA sequence
ttatagatgaaaaactgagg

SEQ ID NO: 661653 - DNA, 20 bp, Artificial
  CRISPR gRNA sequence
tagatgaaaaactgaggtgc

SEQ ID NO: 661654 - DNA, 20 bp, Artificial
  CRISPR gRNA sequence
aggtgcaattaaaagccatt

SEQ ID NO: 661655 - DNA, 20 bp, Artificial
  CRISPR gRNA sequence
aaagccattaagaggtaaag

SEQ ID NO: 661656 - DNA, 20 bp, Artificial
  CRISPR gRNA sequence
agaggtaaagctgtgattca

SEQ ID NO: 661657 - DNA, 20 bp, Artificial
  CRISPR gRNA sequence
tgattcaaaccttggttgcc

SEQ ID NO: 661658 - DNA, 20 bp, Artificial
  CRISPR gRNA sequence
aaaccttggttgcctagttc

SEQ ID NO: 661659 - DNA, 20 bp, Artificial
  CRISPR gRNA sequence
ggttgcctagttccagaatc

SEQ ID NO: 661660 - DNA, 20 bp, Artificial
  CRISPR gRNA sequence
gttgcctagttccagaatcc

SEQ ID NO: 661661 - DNA, 20 bp, Artificial
  CRISPR gRNA sequence
cctagttccagaatccttcg

SEQ ID NO: 661662 - DNA, 20 bp, Artificial
  CRISPR gRNA sequence
gttccagaatccttcgtctt

SEQ ID NO: 661663 - DNA, 20 bp, Artificial
  CRISPR gRNA sequence
cagaatccttcgtcttagct

SEQ ID NO: 661664 - DNA, 20 bp, Artificial
  CRISPR gRNA sequence
cgtcttagctaatatgatat

SEQ ID NO: 661665 - DNA, 20 bp, Artificial
  CRISPR gRNA sequence
gtcttagctaatatgatatt

SEQ ID NO: 661666 - DNA, 20 bp, Artificial
  CRISPR gRNA sequence
agctaatatgatatttctaa

SEQ ID NO: 661667 - DNA, 20 bp, Artificial
  CRISPR gRNA sequence
gctaatatgatatttctaac

SEQ ID NO: 661668 - DNA, 20 bp, Artificial
  CRISPR gRNA sequence
atatgatatttctaacactg

SEQ ID NO: 661669 - DNA, 20 bp, Artificial
  CRISPR gRNA sequence
ctaacactgtaaattttaat

SEQ ID NO: 661670 - DNA, 20 bp, Artificial
  CRISPR gRNA sequence
taacactgtaaattttaatt

SEQ ID NO: 661671 - DNA, 20 bp, Artificial
  CRISPR gRNA sequence
acactgtaaattttaattta

SEQ ID NO: 661672 - DNA, 20 bp, Artificial
  CRISPR gRNA sequence
taaattttaatttattatgg

SEQ ID NO: 661673 - DNA, 20 bp, Artificial
  CRISPR gRNA sequence
taatttattatgggttgggg

SEQ ID NO: 661674 - DNA, 20 bp, Artificial
  CRISPR gRNA sequence
aatttattatgggttgggga

SEQ ID NO: 661675 - DNA, 20 bp, Artificial
  CRISPR gRNA sequence
atttattatgggttggggaa

SEQ ID NO: 661676 - DNA, 20 bp, Artificial
  CRISPR gRNA sequence
attatgggttggggaatcgg

SEQ ID NO: 661677 - DNA, 20 bp, Artificial
  CRISPR gRNA sequence
ttatgggttggggaatcggt

SEQ ID NO: 661678 - DNA, 20 bp, Artificial
  CRISPR gRNA sequence
tgggttggggaatcggtgta

SEQ ID NO: 661679 - DNA, 20 bp, Artificial
  CRISPR gRNA sequence
gggaatcggtgtaatgtata

SEQ ID NO: 661680 - DNA, 20 bp, Artificial
  CRISPR gRNA sequence
tagtaaaaatgatatggaat

SEQ ID NO: 661681 - DNA, 20 bp, Artificial
  CRISPR gRNA sequence
agtaaaaatgatatggaata

SEQ ID NO: 661682 - DNA, 20 bp, Artificial
  CRISPR gRNA sequence
gtaaaaatgatatggaatag

SEQ ID NO: 661683 - DNA, 20 bp, Artificial
  CRISPR gRNA sequence
gaatatggaatattgagctg

SEQ ID NO: 661684 - DNA, 20 bp, Artificial
  CRISPR gRNA sequence
agctgggcccagtggcttgc

SEQ ID NO: 661685 - DNA, 20 bp, Artificial
  CRISPR gRNA sequence
ggcccagtggcttgcacctg

SEQ ID NO: 661686 - DNA, 20 bp, Artificial
  CRISPR gRNA sequence
gcacctgtaattttagctat

SEQ ID NO: 661687 - DNA, 20 bp, Artificial
  CRISPR gRNA sequence
cacctgtaattttagctatg

SEQ ID NO: 661688 - DNA, 20 bp, Artificial
  CRISPR gRNA sequence
taattttagctatgcagaag

SEQ ID NO: 661689 - DNA, 20 bp, Artificial
  CRISPR gRNA sequence
tagctatgcagaaggctgag

SEQ ID NO: 661690 - DNA, 20 bp, Artificial
  CRISPR gRNA sequence
agctatgcagaaggctgagg

SEQ ID NO: 661691 - DNA, 20 bp, Artificial
  CRISPR gRNA sequence
gctatgcagaaggctgaggc

SEQ ID NO: 661692 - DNA, 20 bp, Artificial
  CRISPR gRNA sequence
tgcagaaggctgaggcaaga

SEQ ID NO: 661693 - DNA, 20 bp, Artificial
  CRISPR gRNA sequence
aggcaagaggatcacttgag

SEQ ID NO: 661694 - DNA, 20 bp, Artificial
  CRISPR gRNA sequence
gagccctggagttcatggct

SEQ ID NO: 661695 - DNA, 20 bp, Artificial
  CRISPR gRNA sequence
agccctggagttcatggcta

SEQ ID NO: 661696 - DNA, 20 bp, Artificial
  CRISPR gRNA sequence
gagttcatggctagtgagct

SEQ ID NO: 661697 - DNA, 20 bp, Artificial
  CRISPR gRNA sequence
atggctagtgagctgtgatc

SEQ ID NO: 661698 - DNA, 20 bp, Artificial
  CRISPR gRNA sequence
gtgagctgtgatcgtgccac

SEQ ID NO: 661699 - DNA, 20 bp, Artificial
  CRISPR gRNA sequence
tgatcgtgccactgcacaat

SEQ ID NO: 661700 - DNA, 20 bp, Artificial
  CRISPR gRNA sequence
cacaatctgtcactgggaga

SEQ ID NO: 661701 - DNA, 20 bp, Artificial
  CRISPR gRNA sequence
tcactgggagacagggtgag

SEQ ID NO: 661702 - DNA, 20 bp, Artificial
  CRISPR gRNA sequence
ggagacagggtgagaccctg

SEQ ID NO: 661703 - DNA, 20 bp, Artificial
  CRISPR gRNA sequence
tcttaaaaaaaaaagaaaga

SEQ ID NO: 661704 - DNA, 20 bp, Artificial
  CRISPR gRNA sequence
aaaaaaaaaagaaagaagga

SEQ ID NO: 661705 - DNA, 20 bp, Artificial
  CRISPR gRNA sequence
aaaaaaaaagaaagaaggaa

SEQ ID NO: 661706 - DNA, 20 bp, Artificial
  CRISPR gRNA sequence
tgattatgtgtagtattgtt

SEQ ID NO: 661707 - DNA, 20 bp, Artificial
  CRISPR gRNA sequence
tgtgtagtattgtttcatta

SEQ ID NO: 661708 - DNA, 20 bp, Artificial
  CRISPR gRNA sequence
tttcattaagccattttcat

SEQ ID NO: 661709 - DNA, 20 bp, Artificial
  CRISPR gRNA sequence
cattaagccattttcataaa

SEQ ID NO: 661710 - DNA, 20 bp, Artificial
  CRISPR gRNA sequence
attaagccattttcataaac

SEQ ID NO: 661711 - DNA, 20 bp, Artificial
  CRISPR gRNA sequence
agccattttcataaacatta

SEQ ID NO: 661712 - DNA, 20 bp, Artificial
  CRISPR gRNA sequence
tcataaacattaatatgtat

SEQ ID NO: 661713 - DNA, 20 bp, Artificial
  CRISPR gRNA sequence
cataaacattaatatgtatt

SEQ ID NO: 661714 - DNA, 20 bp, Artificial
  CRISPR gRNA sequence
ataaacattaatatgtattt

SEQ ID NO: 661715 - DNA, 20 bp, Artificial
  CRISPR gRNA sequence
atatgtatttagacatacat

SEQ ID NO: 661716 - DNA, 20 bp, Artificial
  CRISPR gRNA sequence
agacatacatagacatatgt

SEQ ID NO: 661717 - DNA, 20 bp, Artificial
  CRISPR gRNA sequence
gacatacatagacatatgta

SEQ ID NO: 661718 - DNA, 20 bp, Artificial
  CRISPR gRNA sequence
caataaaaatatatttttta

SEQ ID NO: 661719 - DNA, 20 bp, Artificial
  CRISPR gRNA sequence
tttattgtctgtctgggtca

SEQ ID NO: 661720 - DNA, 20 bp, Artificial
  CRISPR gRNA sequence
ttattgtctgtctgggtcaa

SEQ ID NO: 661721 - DNA, 20 bp, Artificial
  CRISPR gRNA sequence
tattgtctgtctgggtcaaa

SEQ ID NO: 661722 - DNA, 20 bp, Artificial
  CRISPR gRNA sequence
attgtctgtctgggtcaaaa

SEQ ID NO: 661723 - DNA, 20 bp, Artificial
  CRISPR gRNA sequence
ttgtctgtctgggtcaaaaa

SEQ ID NO: 661724 - DNA, 20 bp, Artificial
  CRISPR gRNA sequence
tctgtctgggtcaaaaaaaa

SEQ ID NO: 661725 - DNA, 20 bp, Artificial
  CRISPR gRNA sequence
tctgggtcaaaaaaaagttt

SEQ ID NO: 661726 - DNA, 20 bp, Artificial
  CRISPR gRNA sequence
ggtcaaaaaaaagtttgcaa

SEQ ID NO: 661727 - DNA, 20 bp, Artificial
  CRISPR gRNA sequence
gcaagccactgaactacaca

SEQ ID NO: 661728 - DNA, 20 bp, Artificial
  CRISPR gRNA sequence
caagccactgaactacacaa

SEQ ID NO: 661729 - DNA, 20 bp, Artificial
  CRISPR gRNA sequence
aactacacaatctcaatacc

SEQ ID NO: 661730 - DNA, 20 bp, Artificial
  CRISPR gRNA sequence
cacaatctcaataccttgaa

SEQ ID NO: 661731 - DNA, 20 bp, Artificial
  CRISPR gRNA sequence
aataccttgaaaatagttga

SEQ ID NO: 661732 - DNA, 20 bp, Artificial
  CRISPR gRNA sequence
gaaaatagttgatgttcagt

SEQ ID NO: 661733 - DNA, 20 bp, Artificial
  CRISPR gRNA sequence
aaaatagttgatgttcagta

SEQ ID NO: 661734 - DNA, 20 bp, Artificial
  CRISPR gRNA sequence
atgttcagtaaatctgtact

SEQ ID NO: 661735 - DNA, 20 bp, Artificial
  CRISPR gRNA sequence
agtaaatctgtactaagttg

SEQ ID NO: 661736 - DNA, 20 bp, Artificial
  CRISPR gRNA sequence
tactaagttgaattaatgta

SEQ ID NO: 661737 - DNA, 20 bp, Artificial
  CRISPR gRNA sequence
agttgaattaatgtattgtt

SEQ ID NO: 661738 - DNA, 20 bp, Artificial
  CRISPR gRNA sequence
aattaatgtattgttaaata

SEQ ID NO: 661739 - DNA, 20 bp, Artificial
  CRISPR gRNA sequence
atgtattgttaaataaaaaa

SEQ ID NO: 661740 - DNA, 20 bp, Artificial
  CRISPR gRNA sequence
ttaaataaaaaataacccat

SEQ ID NO: 661741 - DNA, 20 bp, Artificial
  CRISPR gRNA sequence
aataaaaaataacccataaa

SEQ ID NO: 661742 - DNA, 20 bp, Artificial
  CRISPR gRNA sequence
ggataaaatacttctgctga

SEQ ID NO: 661743 - DNA, 20 bp, Artificial
  CRISPR gRNA sequence
ctgctgagcatataatttcc

SEQ ID NO: 661744 - DNA, 20 bp, Artificial
  CRISPR gRNA sequence
tgctgagcatataatttccc

SEQ ID NO: 661745 - DNA, 20 bp, Artificial
  CRISPR gRNA sequence
ctgagcatataatttcccta

SEQ ID NO: 661746 - DNA, 20 bp, Artificial
  CRISPR gRNA sequence
agcatataatttccctatgg

SEQ ID NO: 661747 - DNA, 20 bp, Artificial
  CRISPR gRNA sequence
ccctatggagtaggactgaa

SEQ ID NO: 661748 - DNA, 20 bp, Artificial
  CRISPR gRNA sequence
cctatggagtaggactgaaa

SEQ ID NO: 661749 - DNA, 20 bp, Artificial
  CRISPR gRNA sequence
tggagtaggactgaaaatgt

SEQ ID NO: 661750 - DNA, 20 bp, Artificial
  CRISPR gRNA sequence
aaaatgttagtctcacagtt

SEQ ID NO: 661751 - DNA, 20 bp, Artificial
  CRISPR gRNA sequence
gtctcacagttcttaaccaa

SEQ ID NO: 661752 - DNA, 20 bp, Artificial
  CRISPR gRNA sequence
acagttcttaaccaatgaaa

SEQ ID NO: 661753 - DNA, 20 bp, Artificial
  CRISPR gRNA sequence
ttaaccaatgaaactgtaat

SEQ ID NO: 661754 - DNA, 20 bp, Artificial
  CRISPR gRNA sequence
aaccaatgaaactgtaatta

SEQ ID NO: 661755 - DNA, 20 bp, Artificial
  CRISPR gRNA sequence
accaatgaaactgtaattat

SEQ ID NO: 661756 - DNA, 20 bp, Artificial
  CRISPR gRNA sequence
taattatcaaacataatcta

SEQ ID NO: 661757 - DNA, 20 bp, Artificial
  CRISPR gRNA sequence
tcaaacataatctattagtt

SEQ ID NO: 661758 - DNA, 20 bp, Artificial
  CRISPR gRNA sequence
ttagtttatacctgctcctc

SEQ ID NO: 661759 - DNA, 20 bp, Artificial
  CRISPR gRNA sequence
gtttatacctgctcctcaac

SEQ ID NO: 661760 - DNA, 20 bp, Artificial
  CRISPR gRNA sequence
atacctgctcctcaacctaa

SEQ ID NO: 661761 - DNA, 20 bp, Artificial
  CRISPR gRNA sequence
tacctgctcctcaacctaaa

SEQ ID NO: 661762 - DNA, 20 bp, Artificial
  CRISPR gRNA sequence
ctcctcaacctaaagttctc

SEQ ID NO: 661763 - DNA, 20 bp, Artificial
  CRISPR gRNA sequence
ctcaacctaaagttctcctc

SEQ ID NO: 661764 - DNA, 20 bp, Artificial
  CRISPR gRNA sequence
aacctaaagttctcctctgc

SEQ ID NO: 661765 - DNA, 20 bp, Artificial
  CRISPR gRNA sequence
aagttctcctctgcaaatct

SEQ ID NO: 661766 - DNA, 20 bp, Artificial
  CRISPR gRNA sequence
tcctctgcaaatctttctgg

SEQ ID NO: 661767 - DNA, 20 bp, Artificial
  CRISPR gRNA sequence
ctctgcaaatctttctggtt

SEQ ID NO: 661768 - DNA, 20 bp, Artificial
  CRISPR gRNA sequence
tgcaaatctttctggttggt

SEQ ID NO: 661769 - DNA, 20 bp, Artificial
  CRISPR gRNA sequence
caaatctttctggttggtaa

SEQ ID NO: 661770 - DNA, 20 bp, Artificial
  CRISPR gRNA sequence
tctggttggtaattttttat

SEQ ID NO: 661771 - DNA, 20 bp, Artificial
  CRISPR gRNA sequence
ctggttggtaattttttatt

SEQ ID NO: 661772 - DNA, 20 bp, Artificial
  CRISPR gRNA sequence
tggttggtaattttttattg

SEQ ID NO: 661773 - DNA, 20 bp, Artificial
  CRISPR gRNA sequence
gttggtaattttttattgct

SEQ ID NO: 661774 - DNA, 20 bp, Artificial
  CRISPR gRNA sequence
gtaattttttattgctttaa

SEQ ID NO: 661775 - DNA, 20 bp, Artificial
  CRISPR gRNA sequence
tttattgctttaaggcttgg

SEQ ID NO: 661776 - DNA, 20 bp, Artificial
  CRISPR gRNA sequence
ttattgctttaaggcttggc

SEQ ID NO: 661777 - DNA, 20 bp, Artificial
  CRISPR gRNA sequence
tattgctttaaggcttggcc

SEQ ID NO: 661778 - DNA, 20 bp, Artificial
  CRISPR gRNA sequence
attgctttaaggcttggcct

SEQ ID NO: 661779 - DNA, 20 bp, Artificial
  CRISPR gRNA sequence
ttgctttaaggcttggcctc

SEQ ID NO: 661780 - DNA, 20 bp, Artificial
  CRISPR gRNA sequence
ctttaaggcttggcctcttg

SEQ ID NO: 661781 - DNA, 20 bp, Artificial
  CRISPR gRNA sequence
taaggcttggcctcttgtcc

SEQ ID NO: 661782 - DNA, 20 bp, Artificial
  CRISPR gRNA sequence
aaggcttggcctcttgtcct

SEQ ID NO: 661783 - DNA, 20 bp, Artificial
  CRISPR gRNA sequence
aggcttggcctcttgtcctt

SEQ ID NO: 661784 - DNA, 20 bp, Artificial
  CRISPR gRNA sequence
ggcctcttgtcctttaacaa

SEQ ID NO: 661785 - DNA, 20 bp, Artificial
  CRISPR gRNA sequence
gcctcttgtcctttaacaat

SEQ ID NO: 661786 - DNA, 20 bp, Artificial
  CRISPR gRNA sequence
ttgtcctttaacaatatcaa

SEQ ID NO: 661787 - DNA, 20 bp, Artificial
  CRISPR gRNA sequence
gtcctttaacaatatcaagt

SEQ ID NO: 661788 - DNA, 20 bp, Artificial
  CRISPR gRNA sequence
tcctttaacaatatcaagta

SEQ ID NO: 661789 - DNA, 20 bp, Artificial
  CRISPR gRNA sequence
taacaatatcaagtaataat

SEQ ID NO: 661790 - DNA, 20 bp, Artificial
  CRISPR gRNA sequence
aacaatatcaagtaataata

SEQ ID NO: 661791 - DNA, 20 bp, Artificial
  CRISPR gRNA sequence
acaatatcaagtaataatag

SEQ ID NO: 661792 - DNA, 20 bp, Artificial
  CRISPR gRNA sequence
ctaaaaaaataaattacaat

SEQ ID NO: 661793 - DNA, 20 bp, Artificial
  CRISPR gRNA sequence
taaaaaaataaattacaatt

SEQ ID NO: 661794 - DNA, 20 bp, Artificial
  CRISPR gRNA sequence
aaaaaataaattacaatttg

SEQ ID NO: 661795 - DNA, 20 bp, Artificial
  CRISPR gRNA sequence
caatttgaattccctgaaag

SEQ ID NO: 661796 - DNA, 20 bp, Artificial
  CRISPR gRNA sequence
gaattccctgaaagtaataa

SEQ ID NO: 661797 - DNA, 20 bp, Artificial
  CRISPR gRNA sequence
aattccctgaaagtaataat

SEQ ID NO: 661798 - DNA, 20 bp, Artificial
  CRISPR gRNA sequence
cctgaaagtaataatttgtt

SEQ ID NO: 661799 - DNA, 20 bp, Artificial
  CRISPR gRNA sequence
aaagtaataatttgttatta

SEQ ID NO: 661800 - DNA, 20 bp, Artificial
  CRISPR gRNA sequence
gttattaacaaaagaaattt

SEQ ID NO: 661801 - DNA, 20 bp, Artificial
  CRISPR gRNA sequence
ttattaacaaaagaaattta

SEQ ID NO: 661802 - DNA, 20 bp, Artificial
  CRISPR gRNA sequence
ttaacaaaagaaatttattt

SEQ ID NO: 661803 - DNA, 20 bp, Artificial
  CRISPR gRNA sequence
acaaaagaaatttatttcag

SEQ ID NO: 661804 - DNA, 20 bp, Artificial
  CRISPR gRNA sequence
atttcagcagtgcaaggatg

SEQ ID NO: 661805 - DNA, 20 bp, Artificial
  CRISPR gRNA sequence
tttcagcagtgcaaggatgg

SEQ ID NO: 661806 - DNA, 20 bp, Artificial
  CRISPR gRNA sequence
cagcagtgcaaggatggatc

SEQ ID NO: 661807 - DNA, 20 bp, Artificial
  CRISPR gRNA sequence
agcagtgcaaggatggatca

SEQ ID NO: 661808 - DNA, 20 bp, Artificial
  CRISPR gRNA sequence
atatttatcatattaaacta

SEQ ID NO: 661809 - DNA, 20 bp, Artificial
  CRISPR gRNA sequence
atcatattaaactaaagaga

SEQ ID NO: 661810 - DNA, 20 bp, Artificial
  CRISPR gRNA sequence
tcatattaaactaaagagaa

SEQ ID NO: 661811 - DNA, 20 bp, Artificial
  CRISPR gRNA sequence
aactaaagagaacaatcata

SEQ ID NO: 661812 - DNA, 20 bp, Artificial
  CRISPR gRNA sequence
aagagaacaatcatatgatt

SEQ ID NO: 661813 - DNA, 20 bp, Artificial
  CRISPR gRNA sequence
tctctatagacagtgaaaaa

SEQ ID NO: 661814 - DNA, 20 bp, Artificial
  CRISPR gRNA sequence
ctctatagacagtgaaaaaa

SEQ ID NO: 661815 - DNA, 20 bp, Artificial
  CRISPR gRNA sequence
tctatagacagtgaaaaaac

SEQ ID NO: 661816 - DNA, 20 bp, Artificial
  CRISPR gRNA sequence
tatagacagtgaaaaaacat

SEQ ID NO: 661817 - DNA, 20 bp, Artificial
  CRISPR gRNA sequence
tagacagtgaaaaaacatag

SEQ ID NO: 661818 - DNA, 20 bp, Artificial
  CRISPR gRNA sequence
acaaccattctctacaccca

SEQ ID NO: 661819 - DNA, 20 bp, Artificial
  CRISPR gRNA sequence
tctacacccagtaaacagaa

SEQ ID NO: 661820 - DNA, 20 bp, Artificial
  CRISPR gRNA sequence
tacacccagtaaacagaaat

SEQ ID NO: 661821 - DNA, 20 bp, Artificial
  CRISPR gRNA sequence
cacccagtaaacagaaataa

SEQ ID NO: 661822 - DNA, 20 bp, Artificial
  CRISPR gRNA sequence
cttcatagtgatcaaatgta

SEQ ID NO: 661823 - DNA, 20 bp, Artificial
  CRISPR gRNA sequence
ttcatagtgatcaaatgtat

SEQ ID NO: 661824 - DNA, 20 bp, Artificial
  CRISPR gRNA sequence
catagtgatcaaatgtatgt

SEQ ID NO: 661825 - DNA, 20 bp, Artificial
  CRISPR gRNA sequence
atagtgatcaaatgtatgta

SEQ ID NO: 661826 - DNA, 20 bp, Artificial
  CRISPR gRNA sequence
tgattcataggaaaacacat

SEQ ID NO: 661827 - DNA, 20 bp, Artificial
  CRISPR gRNA sequence
ataggaaaacacatacgcat

SEQ ID NO: 661828 - DNA, 20 bp, Artificial
  CRISPR gRNA sequence
agtaatttcagaaactaggt

SEQ ID NO: 661829 - DNA, 20 bp, Artificial
  CRISPR gRNA sequence
cagaaactaggtagattttg

SEQ ID NO: 661830 - DNA, 20 bp, Artificial
  CRISPR gRNA sequence
agaaactaggtagattttgt

SEQ ID NO: 661831 - DNA, 20 bp, Artificial
  CRISPR gRNA sequence
ggtagattttgtttgttctc

SEQ ID NO: 661832 - DNA, 20 bp, Artificial
  CRISPR gRNA sequence
tgtttgttctctttactctt

SEQ ID NO: 661833 - DNA, 20 bp, Artificial
  CRISPR gRNA sequence
gtttgttctctttactcttt

SEQ ID NO: 661834 - DNA, 20 bp, Artificial
  CRISPR gRNA sequence
tttgttctctttactctttt

SEQ ID NO: 661835 - DNA, 20 bp, Artificial
  CRISPR gRNA sequence
gttctctttactctttttta

SEQ ID NO: 661836 - DNA, 20 bp, Artificial
  CRISPR gRNA sequence
ttctctttactcttttttaa

SEQ ID NO: 661837 - DNA, 20 bp, Artificial
  CRISPR gRNA sequence
tctttactcttttttaatat

SEQ ID NO: 661838 - DNA, 20 bp, Artificial
  CRISPR gRNA sequence
tttactcttttttaatattg

SEQ ID NO: 661839 - DNA, 20 bp, Artificial
  CRISPR gRNA sequence
tactcttttttaatattgtg

SEQ ID NO: 661840 - DNA, 20 bp, Artificial
  CRISPR gRNA sequence
actcttttttaatattgtgc

SEQ ID NO: 661841 - DNA, 20 bp, Artificial
  CRISPR gRNA sequence
ctcttttttaatattgtgct

SEQ ID NO: 661842 - DNA, 20 bp, Artificial
  CRISPR gRNA sequence
ttttttaatattgtgctgga

SEQ ID NO: 661843 - DNA, 20 bp, Artificial
  CRISPR gRNA sequence
ttttaatattgtgctggacg

SEQ ID NO: 661844 - DNA, 20 bp, Artificial
  CRISPR gRNA sequence
tttaatattgtgctggacga

SEQ ID NO: 661845 - DNA, 20 bp, Artificial
  CRISPR gRNA sequence
ttaatattgtgctggacgaa

SEQ ID NO: 661846 - DNA, 20 bp, Artificial
  CRISPR gRNA sequence
taatattgtgctggacgaaa

SEQ ID NO: 661847 - DNA, 20 bp, Artificial
  CRISPR gRNA sequence
aatattgtgctggacgaaac

SEQ ID NO: 661848 - DNA, 20 bp, Artificial
  CRISPR gRNA sequence
atattgtgctggacgaaact

SEQ ID NO: 661849 - DNA, 20 bp, Artificial
  CRISPR gRNA sequence
tgctggacgaaactgccaat

SEQ ID NO: 661850 - DNA, 20 bp, Artificial
  CRISPR gRNA sequence
gacgaaactgccaatggatt

SEQ ID NO: 661851 - DNA, 20 bp, Artificial
  CRISPR gRNA sequence
ccaatggatttagataataa

SEQ ID NO: 661852 - DNA, 20 bp, Artificial
  CRISPR gRNA sequence
agataataaaaaataagatt

SEQ ID NO: 661853 - DNA, 20 bp, Artificial
  CRISPR gRNA sequence
gataataaaaaataagatta

SEQ ID NO: 661854 - DNA, 20 bp, Artificial
  CRISPR gRNA sequence
taaaaatttgataggtagag

SEQ ID NO: 661855 - DNA, 20 bp, Artificial
  CRISPR gRNA sequence
gataggtagagataaaataa

SEQ ID NO: 661856 - DNA, 20 bp, Artificial
  CRISPR gRNA sequence
ataggtagagataaaataat

SEQ ID NO: 661857 - DNA, 20 bp, Artificial
  CRISPR gRNA sequence
tttgcagatggtatgttttg

SEQ ID NO: 661858 - DNA, 20 bp, Artificial
  CRISPR gRNA sequence
ttgcagatggtatgttttgt

SEQ ID NO: 661859 - DNA, 20 bp, Artificial
  CRISPR gRNA sequence
tgcagatggtatgttttgta

SEQ ID NO: 661860 - DNA, 20 bp, Artificial
  CRISPR gRNA sequence
gcagatggtatgttttgtat

SEQ ID NO: 661861 - DNA, 20 bp, Artificial
  CRISPR gRNA sequence
cagatggtatgttttgtatc

SEQ ID NO: 661862 - DNA, 20 bp, Artificial
  CRISPR gRNA sequence
tgtatccataaactgcagag

SEQ ID NO: 661863 - DNA, 20 bp, Artificial
  CRISPR gRNA sequence
gtatccataaactgcagaga

SEQ ID NO: 661864 - DNA, 20 bp, Artificial
  CRISPR gRNA sequence
tatccataaactgcagagaa

SEQ ID NO: 661865 - DNA, 20 bp, Artificial
  CRISPR gRNA sequence
cagagaatcagctgaaagac

SEQ ID NO: 661866 - DNA, 20 bp, Artificial
  CRISPR gRNA sequence
aaagacaaataattcataaa

SEQ ID NO: 661867 - DNA, 20 bp, Artificial
  CRISPR gRNA sequence
ataaacaataaaataattta

SEQ ID NO: 661868 - DNA, 20 bp, Artificial
  CRISPR gRNA sequence
agtaatagggcagtttaaat

SEQ ID NO: 661869 - DNA, 20 bp, Artificial
  CRISPR gRNA sequence
gtaatagggcagtttaaatt

SEQ ID NO: 661870 - DNA, 20 bp, Artificial
  CRISPR gRNA sequence
aaattaacatgccaatattt

SEQ ID NO: 661871 - DNA, 20 bp, Artificial
  CRISPR gRNA sequence
aattaacatgccaatattta

SEQ ID NO: 661872 - DNA, 20 bp, Artificial
  CRISPR gRNA sequence
acatgccaatatttaaatgt

SEQ ID NO: 661873 - DNA, 20 bp, Artificial
  CRISPR gRNA sequence
aaatgtgtaatatttgtatt

SEQ ID NO: 661874 - DNA, 20 bp, Artificial
  CRISPR gRNA sequence
aatgtgtaatatttgtatta

SEQ ID NO: 661875 - DNA, 20 bp, Artificial
  CRISPR gRNA sequence
gtattaaagaacatgcagaa

SEQ ID NO: 661876 - DNA, 20 bp, Artificial
  CRISPR gRNA sequence
tattaaagaacatgcagaag

SEQ ID NO: 661877 - DNA, 20 bp, Artificial
  CRISPR gRNA sequence
aagaacatgcagaagcgtac

SEQ ID NO: 661878 - DNA, 20 bp, Artificial
  CRISPR gRNA sequence
aaaatggggaagatatactg

SEQ ID NO: 661879 - DNA, 20 bp, Artificial
  CRISPR gRNA sequence
aaatggggaagatatactgt

SEQ ID NO: 661880 - DNA, 20 bp, Artificial
  CRISPR gRNA sequence
tgaagtattctttcacaggt

SEQ ID NO: 661881 - DNA, 20 bp, Artificial
  CRISPR gRNA sequence
tttcacaggtagatgcaata

SEQ ID NO: 661882 - DNA, 20 bp, Artificial
  CRISPR gRNA sequence
tcacaggtagatgcaatatt

SEQ ID NO: 661883 - DNA, 20 bp, Artificial
  CRISPR gRNA sequence
cacaggtagatgcaatattg

SEQ ID NO: 661884 - DNA, 20 bp, Artificial
  CRISPR gRNA sequence
acaggtagatgcaatattgc

SEQ ID NO: 661885 - DNA, 20 bp, Artificial
  CRISPR gRNA sequence
cttatatcttatactgaact

SEQ ID NO: 661886 - DNA, 20 bp, Artificial
  CRISPR gRNA sequence
atatcttatactgaacttca

SEQ ID NO: 661887 - DNA, 20 bp, Artificial
  CRISPR gRNA sequence
tatcttatactgaacttcag

SEQ ID NO: 661888 - DNA, 20 bp, Artificial
  CRISPR gRNA sequence
atactgaacttcaggataaa

SEQ ID NO: 661889 - DNA, 20 bp, Artificial
  CRISPR gRNA sequence
tactgaacttcaggataaac

SEQ ID NO: 661890 - DNA, 20 bp, Artificial
  CRISPR gRNA sequence
aacttcaggataaactctga

SEQ ID NO: 661891 - DNA, 20 bp, Artificial
  CRISPR gRNA sequence
caggataaactctgaattgg

SEQ ID NO: 661892 - DNA, 20 bp, Artificial
  CRISPR gRNA sequence
aggataaactctgaattgga

SEQ ID NO: 661893 - DNA, 20 bp, Artificial
  CRISPR gRNA sequence
tgaattggaacaaagatata

SEQ ID NO: 661894 - DNA, 20 bp, Artificial
  CRISPR gRNA sequence
aattggaacaaagatatata

SEQ ID NO: 661895 - DNA, 20 bp, Artificial
  CRISPR gRNA sequence
gaacaaagatatatacatga

SEQ ID NO: 661896 - DNA, 20 bp, Artificial
  CRISPR gRNA sequence
accatataagtaatagaaga

SEQ ID NO: 661897 - DNA, 20 bp, Artificial
  CRISPR gRNA sequence
attatggtcttactatggga

SEQ ID NO: 661898 - DNA, 20 bp, Artificial
  CRISPR gRNA sequence
ttatggtcttactatgggaa

SEQ ID NO: 661899 - DNA, 20 bp, Artificial
  CRISPR gRNA sequence
tggtcttactatgggaagct

SEQ ID NO: 661900 - DNA, 20 bp, Artificial
  CRISPR gRNA sequence
actatgggaagctcttttta

SEQ ID NO: 661901 - DNA, 20 bp, Artificial
  CRISPR gRNA sequence
ctatgggaagctctttttaa

SEQ ID NO: 661902 - DNA, 20 bp, Artificial
  CRISPR gRNA sequence
tgggaagctctttttaataa

SEQ ID NO: 661903 - DNA, 20 bp, Artificial
  CRISPR gRNA sequence
tttttaataaaattcaatat

SEQ ID NO: 661904 - DNA, 20 bp, Artificial
  CRISPR gRNA sequence
tttaataaaattcaatatct

SEQ ID NO: 661905 - DNA, 20 bp, Artificial
  CRISPR gRNA sequence
ttaataaaattcaatatcta

SEQ ID NO: 661906 - DNA, 20 bp, Artificial
  CRISPR gRNA sequence
taataaaattcaatatctaa

SEQ ID NO: 661907 - DNA, 20 bp, Artificial
  CRISPR gRNA sequence
aataaaattcaatatctaaa

SEQ ID NO: 661908 - DNA, 20 bp, Artificial
  CRISPR gRNA sequence
ataaaattcaatatctaaaa

SEQ ID NO: 661909 - DNA, 20 bp, Artificial
  CRISPR gRNA sequence
aatatctaaaagtcaatttc

SEQ ID NO: 661910 - DNA, 20 bp, Artificial
  CRISPR gRNA sequence
aaagtcaatttcaaaggatt

SEQ ID NO: 661911 - DNA, 20 bp, Artificial
  CRISPR gRNA sequence
caaaggattaattcatttaa

SEQ ID NO: 661912 - DNA, 20 bp, Artificial
  CRISPR gRNA sequence
aaaggattaattcatttaaa

SEQ ID NO: 661913 - DNA, 20 bp, Artificial
  CRISPR gRNA sequence
attcatttaaaataataaaa

SEQ ID NO: 661914 - DNA, 20 bp, Artificial
  CRISPR gRNA sequence
atttaaaataataaaaattt

SEQ ID NO: 661915 - DNA, 20 bp, Artificial
  CRISPR gRNA sequence
aaaataataaaaatttctac

SEQ ID NO: 661916 - DNA, 20 bp, Artificial
  CRISPR gRNA sequence
aaataataaaaatttctaca

SEQ ID NO: 661917 - DNA, 20 bp, Artificial
  CRISPR gRNA sequence
ctacatggcaaaaaatagca

SEQ ID NO: 661918 - DNA, 20 bp, Artificial
  CRISPR gRNA sequence
tacatggcaaaaaatagcat

SEQ ID NO: 661919 - DNA, 20 bp, Artificial
  CRISPR gRNA sequence
catggcaaaaaatagcataa

SEQ ID NO: 661920 - DNA, 20 bp, Artificial
  CRISPR gRNA sequence
gaggtaaaatttgcaactca

SEQ ID NO: 661921 - DNA, 20 bp, Artificial
  CRISPR gRNA sequence
gcaactcatatgatgactta

SEQ ID NO: 661922 - DNA, 20 bp, Artificial
  CRISPR gRNA sequence
caactcatatgatgacttaa

SEQ ID NO: 661923 - DNA, 20 bp, Artificial
  CRISPR gRNA sequence
atatgatgacttaaacggtt

SEQ ID NO: 661924 - DNA, 20 bp, Artificial
  CRISPR gRNA sequence
aaacggttaatctctaatac

SEQ ID NO: 661925 - DNA, 20 bp, Artificial
  CRISPR gRNA sequence
aacggttaatctctaataca

SEQ ID NO: 661926 - DNA, 20 bp, Artificial
  CRISPR gRNA sequence
atctctaatacataacagct

SEQ ID NO: 661927 - DNA, 20 bp, Artificial
  CRISPR gRNA sequence
taatacataacagctcctag

SEQ ID NO: 661928 - DNA, 20 bp, Artificial
  CRISPR gRNA sequence
atacataacagctcctagta

SEQ ID NO: 661929 - DNA, 20 bp, Artificial
  CRISPR gRNA sequence
ctagtaattcctgaagtaca

SEQ ID NO: 661930 - DNA, 20 bp, Artificial
  CRISPR gRNA sequence
gtaattcctgaagtacagta

SEQ ID NO: 661931 - DNA, 20 bp, Artificial
  CRISPR gRNA sequence
ctgaagtacagtaagtatct

SEQ ID NO: 661932 - DNA, 20 bp, Artificial
  CRISPR gRNA sequence
aagtacagtaagtatctaat

SEQ ID NO: 661933 - DNA, 20 bp, Artificial
  CRISPR gRNA sequence
atagaaatttggttaaatta

SEQ ID NO: 661934 - DNA, 20 bp, Artificial
  CRISPR gRNA sequence
ggttaaattattctaacaca

SEQ ID NO: 661935 - DNA, 20 bp, Artificial
  CRISPR gRNA sequence
gttaaattattctaacacac

SEQ ID NO: 661936 - DNA, 20 bp, Artificial
  CRISPR gRNA sequence
aattattctaacacacagtt

SEQ ID NO: 661937 - DNA, 20 bp, Artificial
  CRISPR gRNA sequence
ttctaacacacagttcacag

SEQ ID NO: 661938 - DNA, 20 bp, Artificial
  CRISPR gRNA sequence
taacacacagttcacagaaa

SEQ ID NO: 661939 - DNA, 20 bp, Artificial
  CRISPR gRNA sequence
acacacagttcacagaaaaa

SEQ ID NO: 661940 - DNA, 20 bp, Artificial
  CRISPR gRNA sequence
acagaaaaataccattggct

SEQ ID NO: 661941 - DNA, 20 bp, Artificial
  CRISPR gRNA sequence
gctcctacacatataaagtt

SEQ ID NO: 661942 - DNA, 20 bp, Artificial
  CRISPR gRNA sequence
ctacacatataaagtttttc

SEQ ID NO: 661943 - DNA, 20 bp, Artificial
  CRISPR gRNA sequence
cacatataaagtttttctta

SEQ ID NO: 661944 - DNA, 20 bp, Artificial
  CRISPR gRNA sequence
ttcttaacttcacccaaaat

SEQ ID NO: 661945 - DNA, 20 bp, Artificial
  CRISPR gRNA sequence
tcttaacttcacccaaaata

SEQ ID NO: 661946 - DNA, 20 bp, Artificial
  CRISPR gRNA sequence
cttaacttcacccaaaatag

SEQ ID NO: 661947 - DNA, 20 bp, Artificial
  CRISPR gRNA sequence
ttaacttcacccaaaatagg

SEQ ID NO: 661948 - DNA, 20 bp, Artificial
  CRISPR gRNA sequence
aacttcacccaaaataggag

SEQ ID NO: 661949 - DNA, 20 bp, Artificial
  CRISPR gRNA sequence
acttcacccaaaataggagg

SEQ ID NO: 661950 - DNA, 20 bp, Artificial
  CRISPR gRNA sequence
cacccaaaataggaggtata

SEQ ID NO: 661951 - DNA, 20 bp, Artificial
  CRISPR gRNA sequence
acccaaaataggaggtatat

SEQ ID NO: 661952 - DNA, 20 bp, Artificial
  CRISPR gRNA sequence
tactgacatagcatgtctaa

SEQ ID NO: 661953 - DNA, 20 bp, Artificial
  CRISPR gRNA sequence
acatagcatgtctaattcat

SEQ ID NO: 661954 - DNA, 20 bp, Artificial
  CRISPR gRNA sequence
attcattatattagcaaaaa

SEQ ID NO: 661955 - DNA, 20 bp, Artificial
  CRISPR gRNA sequence
attatattagcaaaaaactg

SEQ ID NO: 661956 - DNA, 20 bp, Artificial
  CRISPR gRNA sequence
tattagcaaaaaactgaaaa

SEQ ID NO: 661957 - DNA, 20 bp, Artificial
  CRISPR gRNA sequence
gcaaaaaactgaaaattttg

SEQ ID NO: 661958 - DNA, 20 bp, Artificial
  CRISPR gRNA sequence
aaaattttgtgtcatgctgt

SEQ ID NO: 661959 - DNA, 20 bp, Artificial
  CRISPR gRNA sequence
tgtgtcatgctgtgttggca

SEQ ID NO: 661960 - DNA, 20 bp, Artificial
  CRISPR gRNA sequence
gtgtcatgctgtgttggcaa

SEQ ID NO: 661961 - DNA, 20 bp, Artificial
  CRISPR gRNA sequence
tgtcatgctgtgttggcaag

SEQ ID NO: 661962 - DNA, 20 bp, Artificial
  CRISPR gRNA sequence
tgttggcaaggctgcaagga

SEQ ID NO: 661963 - DNA, 20 bp, Artificial
  CRISPR gRNA sequence
gcaaggctgcaaggaaacag

SEQ ID NO: 661964 - DNA, 20 bp, Artificial
  CRISPR gRNA sequence
caaggaaacagggcctttta

SEQ ID NO: 661965 - DNA, 20 bp, Artificial
  CRISPR gRNA sequence
ttatgtattgttgatgggag

SEQ ID NO: 661966 - DNA, 20 bp, Artificial
  CRISPR gRNA sequence
tatgtattgttgatgggagt

SEQ ID NO: 661967 - DNA, 20 bp, Artificial
  CRISPR gRNA sequence
atgtattgttgatgggagta

SEQ ID NO: 661968 - DNA, 20 bp, Artificial
  CRISPR gRNA sequence
tgtattgttgatgggagtat

SEQ ID NO: 661969 - DNA, 20 bp, Artificial
  CRISPR gRNA sequence
ttgatgggagtataaattta

SEQ ID NO: 661970 - DNA, 20 bp, Artificial
  CRISPR gRNA sequence
atgggagtataaatttatat

SEQ ID NO: 661971 - DNA, 20 bp, Artificial
  CRISPR gRNA sequence
atataaatgtgaattggaac

SEQ ID NO: 661972 - DNA, 20 bp, Artificial
  CRISPR gRNA sequence
tataaatgtgaattggaaca

SEQ ID NO: 661973 - DNA, 20 bp, Artificial
  CRISPR gRNA sequence
gaacaaatgcttataaactt

SEQ ID NO: 661974 - DNA, 20 bp, Artificial
  CRISPR gRNA sequence
ataaactttgactcagtact

SEQ ID NO: 661975 - DNA, 20 bp, Artificial
  CRISPR gRNA sequence
taaactttgactcagtactc

SEQ ID NO: 661976 - DNA, 20 bp, Artificial
  CRISPR gRNA sequence
tgactcagtactcctgtttc

SEQ ID NO: 661977 - DNA, 20 bp, Artificial
  CRISPR gRNA sequence
gactcagtactcctgtttct

SEQ ID NO: 661978 - DNA, 20 bp, Artificial
  CRISPR gRNA sequence
actcagtactcctgtttcta

SEQ ID NO: 661979 - DNA, 20 bp, Artificial
  CRISPR gRNA sequence
agtactcctgtttctacaaa

SEQ ID NO: 661980 - DNA, 20 bp, Artificial
  CRISPR gRNA sequence
ctgtttctacaaatttatct

SEQ ID NO: 661981 - DNA, 20 bp, Artificial
  CRISPR gRNA sequence
tttctacaaatttatcttat

SEQ ID NO: 661982 - DNA, 20 bp, Artificial
  CRISPR gRNA sequence
ctacaaatttatcttataat

SEQ ID NO: 661983 - DNA, 20 bp, Artificial
  CRISPR gRNA sequence
tacaaatttatcttataata

SEQ ID NO: 661984 - DNA, 20 bp, Artificial
  CRISPR gRNA sequence
caaatttatcttataataat

SEQ ID NO: 661985 - DNA, 20 bp, Artificial
  CRISPR gRNA sequence
atcttataataatttgtcaa

SEQ ID NO: 661986 - DNA, 20 bp, Artificial
  CRISPR gRNA sequence
tcttataataatttgtcaaa

SEQ ID NO: 661987 - DNA, 20 bp, Artificial
  CRISPR gRNA sequence
ataataatttgtcaaatgtt

SEQ ID NO: 661988 - DNA, 20 bp, Artificial
  CRISPR gRNA sequence
taataatttgtcaaatgttg

SEQ ID NO: 661989 - DNA, 20 bp, Artificial
  CRISPR gRNA sequence
gtcaaatgttgagtgcacag

SEQ ID NO: 661990 - DNA, 20 bp, Artificial
  CRISPR gRNA sequence
tcaaatgttgagtgcacaga

SEQ ID NO: 661991 - DNA, 20 bp, Artificial
  CRISPR gRNA sequence
agtgcacagatttattcatt

SEQ ID NO: 661992 - DNA, 20 bp, Artificial
  CRISPR gRNA sequence
attcattgcagcattgtttt

SEQ ID NO: 661993 - DNA, 20 bp, Artificial
  CRISPR gRNA sequence
ttcattgcagcattgttttt

SEQ ID NO: 661994 - DNA, 20 bp, Artificial
  CRISPR gRNA sequence
attgcagcattgtttttcat

SEQ ID NO: 661995 - DNA, 20 bp, Artificial
  CRISPR gRNA sequence
cagcattgtttttcatatca

SEQ ID NO: 661996 - DNA, 20 bp, Artificial
  CRISPR gRNA sequence
tttttcatatcaaaagatgg

SEQ ID NO: 661997 - DNA, 20 bp, Artificial
  CRISPR gRNA sequence
ttcatatcaaaagatgggaa

SEQ ID NO: 661998 - DNA, 20 bp, Artificial
  CRISPR gRNA sequence
tcatatcaaaagatgggaaa

SEQ ID NO: 661999 - DNA, 20 bp, Artificial
  CRISPR gRNA sequence
catatcaaaagatgggaaac

SEQ ID NO: 662000 - DNA, 20 bp, Artificial
  CRISPR gRNA sequence
atatcaaaagatgggaaaca

SEQ ID NO: 662001 - DNA, 20 bp, Artificial
  CRISPR gRNA sequence
tgcaaacaatgcccatcagt

SEQ ID NO: 662002 - DNA, 20 bp, Artificial
  CRISPR gRNA sequence
attaaataaattaggtatat

SEQ ID NO: 662003 - DNA, 20 bp, Artificial
  CRISPR gRNA sequence
aataaattaggtatatccaa

SEQ ID NO: 662004 - DNA, 20 bp, Artificial
  CRISPR gRNA sequence
ggtatatccaataattgaat

SEQ ID NO: 662005 - DNA, 20 bp, Artificial
  CRISPR gRNA sequence
aatattatgcaagtatataa

SEQ ID NO: 662006 - DNA, 20 bp, Artificial
  CRISPR gRNA sequence
tgcaagtatataaaaaataa

SEQ ID NO: 662007 - DNA, 20 bp, Artificial
  CRISPR gRNA sequence
cgaaaatatattgctaagat

SEQ ID NO: 662008 - DNA, 20 bp, Artificial
  CRISPR gRNA sequence
gaaaatatattgctaagatt

SEQ ID NO: 662009 - DNA, 20 bp, Artificial
  CRISPR gRNA sequence
ctaagattaaaaaaaaggaa

SEQ ID NO: 662010 - DNA, 20 bp, Artificial
  CRISPR gRNA sequence
agattaaaaaaaaggaaggg

SEQ ID NO: 662011 - DNA, 20 bp, Artificial
  CRISPR gRNA sequence
aaaaaaaggaaggggcagaa

SEQ ID NO: 662012 - DNA, 20 bp, Artificial
  CRISPR gRNA sequence
ggtaaaaaaaaccccagaaa

SEQ ID NO: 662013 - DNA, 20 bp, Artificial
  CRISPR gRNA sequence
actaataattatatttaaaa

SEQ ID NO: 662014 - DNA, 20 bp, Artificial
  CRISPR gRNA sequence
ctaataattatatttaaaaa

SEQ ID NO: 662015 - DNA, 20 bp, Artificial
  CRISPR gRNA sequence
ataattatatttaaaaactc

SEQ ID NO: 662016 - DNA, 20 bp, Artificial
  CRISPR gRNA sequence
tatttaaaaactcataggat

SEQ ID NO: 662017 - DNA, 20 bp, Artificial
  CRISPR gRNA sequence
aaaaactcataggataaaca

SEQ ID NO: 662018 - DNA, 20 bp, Artificial
  CRISPR gRNA sequence
aaaactcataggataaacaa

SEQ ID NO: 662019 - DNA, 20 bp, Artificial
  CRISPR gRNA sequence
ataggataaacaagaaggta

SEQ ID NO: 662020 - DNA, 20 bp, Artificial
  CRISPR gRNA sequence
attgtttgggagtgtataga

SEQ ID NO: 662021 - DNA, 20 bp, Artificial
  CRISPR gRNA sequence
tttgggagtgtatagataga

SEQ ID NO: 662022 - DNA, 20 bp, Artificial
  CRISPR gRNA sequence
gggagtgtatagatagaggg

SEQ ID NO: 662023 - DNA, 20 bp, Artificial
  CRISPR gRNA sequence
ggagtgtatagatagaggga

SEQ ID NO: 662024 - DNA, 20 bp, Artificial
  CRISPR gRNA sequence
agcagatgaggggctgggat

SEQ ID NO: 662025 - DNA, 20 bp, Artificial
  CRISPR gRNA sequence
ggatggaacaagactcttca

SEQ ID NO: 662026 - DNA, 20 bp, Artificial
  CRISPR gRNA sequence
ttcactagatatacttttat

SEQ ID NO: 662027 - DNA, 20 bp, Artificial
  CRISPR gRNA sequence
cactagatatacttttatac

SEQ ID NO: 662028 - DNA, 20 bp, Artificial
  CRISPR gRNA sequence
actagatatacttttatact

SEQ ID NO: 662029 - DNA, 20 bp, Artificial
  CRISPR gRNA sequence
gatatacttttatacttttt

SEQ ID NO: 662030 - DNA, 20 bp, Artificial
  CRISPR gRNA sequence
ttatactttttgatttttga

SEQ ID NO: 662031 - DNA, 20 bp, Artificial
  CRISPR gRNA sequence
tatactttttgatttttgaa

SEQ ID NO: 662032 - DNA, 20 bp, Artificial
  CRISPR gRNA sequence
atactttttgatttttgaac

SEQ ID NO: 662033 - DNA, 20 bp, Artificial
  CRISPR gRNA sequence
tactttttgatttttgaacc

SEQ ID NO: 662034 - DNA, 20 bp, Artificial
  CRISPR gRNA sequence
tttgatttttgaaccattca

SEQ ID NO: 662035 - DNA, 20 bp, Artificial
  CRISPR gRNA sequence
ttgatttttgaaccattcaa

SEQ ID NO: 662036 - DNA, 20 bp, Artificial
  CRISPR gRNA sequence
tgatttttgaaccattcaaa

SEQ ID NO: 662037 - DNA, 20 bp, Artificial
  CRISPR gRNA sequence
gatttttgaaccattcaaat

SEQ ID NO: 662038 - DNA, 20 bp, Artificial
  CRISPR gRNA sequence
atttttgaaccattcaaata

SEQ ID NO: 662039 - DNA, 20 bp, Artificial
  CRISPR gRNA sequence
ttgaaccattcaaatatcta

SEQ ID NO: 662040 - DNA, 20 bp, Artificial
  CRISPR gRNA sequence
tgaaccattcaaatatctac

SEQ ID NO: 662041 - DNA, 20 bp, Artificial
  CRISPR gRNA sequence
gaaccattcaaatatctacc

SEQ ID NO: 662042 - DNA, 20 bp, Artificial
  CRISPR gRNA sequence
aaccattcaaatatctacct

SEQ ID NO: 662043 - DNA, 20 bp, Artificial
  CRISPR gRNA sequence
aaatatctacctatttgaca

SEQ ID NO: 662044 - DNA, 20 bp, Artificial
  CRISPR gRNA sequence
cctatttgacaacatcaaaa

SEQ ID NO: 662045 - DNA, 20 bp, Artificial
  CRISPR gRNA sequence
tttgacaacatcaaaacaaa

SEQ ID NO: 662046 - DNA, 20 bp, Artificial
  CRISPR gRNA sequence
gacaacatcaaaacaaaagg

SEQ ID NO: 662047 - DNA, 20 bp, Artificial
  CRISPR gRNA sequence
acaacatcaaaacaaaagga

SEQ ID NO: 662048 - DNA, 20 bp, Artificial
  CRISPR gRNA sequence
ataataacaactaaaccaca

SEQ ID NO: 662049 - DNA, 20 bp, Artificial
  CRISPR gRNA sequence
aaccacagtaaatattagtt

SEQ ID NO: 662050 - DNA, 20 bp, Artificial
  CRISPR gRNA sequence
gtttttttgagaaaatattt

SEQ ID NO: 662051 - DNA, 20 bp, Artificial
  CRISPR gRNA sequence
ttttgagaaaatatttctat

SEQ ID NO: 662052 - DNA, 20 bp, Artificial
  CRISPR gRNA sequence
tttgagaaaatatttctata

SEQ ID NO: 662053 - DNA, 20 bp, Artificial
  CRISPR gRNA sequence
ttgagaaaatatttctatag

SEQ ID NO: 662054 - DNA, 20 bp, Artificial
  CRISPR gRNA sequence
tgagaaaatatttctatagg

SEQ ID NO: 662055 - DNA, 20 bp, Artificial
  CRISPR gRNA sequence
gagaaaatatttctataggg

SEQ ID NO: 662056 - DNA, 20 bp, Artificial
  CRISPR gRNA sequence
agaaaatatttctatagggt

SEQ ID NO: 662057 - DNA, 20 bp, Artificial
  CRISPR gRNA sequence
ctatagggtgagactgaaag

SEQ ID NO: 662058 - DNA, 20 bp, Artificial
  CRISPR gRNA sequence
tatagggtgagactgaaagt

SEQ ID NO: 662059 - DNA, 20 bp, Artificial
  CRISPR gRNA sequence
tagggtgagactgaaagtgt

SEQ ID NO: 662060 - DNA, 20 bp, Artificial
  CRISPR gRNA sequence
aaagtgtcagcccttcaact

SEQ ID NO: 662061 - DNA, 20 bp, Artificial
  CRISPR gRNA sequence
caactgtttgccagtggaac

SEQ ID NO: 662062 - DNA, 20 bp, Artificial
  CRISPR gRNA sequence
aactgtttgccagtggaact

SEQ ID NO: 662063 - DNA, 20 bp, Artificial
  CRISPR gRNA sequence
tttgccagtggaactgtaag

SEQ ID NO: 662064 - DNA, 20 bp, Artificial
  CRISPR gRNA sequence
gccagtggaactgtaagaaa

SEQ ID NO: 662065 - DNA, 20 bp, Artificial
  CRISPR gRNA sequence
ccagtggaactgtaagaaac

SEQ ID NO: 662066 - DNA, 20 bp, Artificial
  CRISPR gRNA sequence
taagaaactggtgtaatcca

SEQ ID NO: 662067 - DNA, 20 bp, Artificial
  CRISPR gRNA sequence
gtgtaatccattaatttgct

SEQ ID NO: 662068 - DNA, 20 bp, Artificial
  CRISPR gRNA sequence
atttgcttccccaacaccca

SEQ ID NO: 662069 - DNA, 20 bp, Artificial
  CRISPR gRNA sequence
gcttccccaacacccaattt

SEQ ID NO: 662070 - DNA, 20 bp, Artificial
  CRISPR gRNA sequence
cttccccaacacccaattta

SEQ ID NO: 662071 - DNA, 20 bp, Artificial
  CRISPR gRNA sequence
ccccaacacccaatttagat

SEQ ID NO: 662072 - DNA, 20 bp, Artificial
  CRISPR gRNA sequence
cccaacacccaatttagatg

SEQ ID NO: 662073 - DNA, 20 bp, Artificial
  CRISPR gRNA sequence
agatgtagattccttacact

SEQ ID NO: 662074 - DNA, 20 bp, Artificial
  CRISPR gRNA sequence
gatgtagattccttacactc

SEQ ID NO: 662075 - DNA, 20 bp, Artificial
  CRISPR gRNA sequence
cttacactcagatcatttgt

SEQ ID NO: 662076 - DNA, 20 bp, Artificial
  CRISPR gRNA sequence
acactcagatcatttgttga

SEQ ID NO: 662077 - DNA, 20 bp, Artificial
  CRISPR gRNA sequence
cactcagatcatttgttgat

SEQ ID NO: 662078 - DNA, 20 bp, Artificial
  CRISPR gRNA sequence
agatcatttgttgatggttt

SEQ ID NO: 662079 - DNA, 20 bp, Artificial
  CRISPR gRNA sequence
gttgatggttttatttattg

SEQ ID NO: 662080 - DNA, 20 bp, Artificial
  CRISPR gRNA sequence
ttgatggttttatttattgt

SEQ ID NO: 662081 - DNA, 20 bp, Artificial
  CRISPR gRNA sequence
atggttttatttattgtgta

SEQ ID NO: 662082 - DNA, 20 bp, Artificial
  CRISPR gRNA sequence
tatttattgtgtatatttaa

SEQ ID NO: 662083 - DNA, 20 bp, Artificial
  CRISPR gRNA sequence
atttattgtgtatatttaat

SEQ ID NO: 662084 - DNA, 20 bp, Artificial
  CRISPR gRNA sequence
tttattgtgtatatttaata

SEQ ID NO: 662085 - DNA, 20 bp, Artificial
  CRISPR gRNA sequence
attgtgtatatttaataatt

SEQ ID NO: 662086 - DNA, 20 bp, Artificial
  CRISPR gRNA sequence
ttgtgtatatttaataattt

SEQ ID NO: 662087 - DNA, 20 bp, Artificial
  CRISPR gRNA sequence
tgtatatttaataattttaa

SEQ ID NO: 662088 - DNA, 20 bp, Artificial
  CRISPR gRNA sequence
aataattttaattgcatttt

SEQ ID NO: 662089 - DNA, 20 bp, Artificial
  CRISPR gRNA sequence
ataattttaattgcatttta

SEQ ID NO: 662090 - DNA, 20 bp, Artificial
  CRISPR gRNA sequence
taattgcattttatatcttt

SEQ ID NO: 662091 - DNA, 20 bp, Artificial
  CRISPR gRNA sequence
aattgcattttatatctttg

SEQ ID NO: 662092 - DNA, 20 bp, Artificial
  CRISPR gRNA sequence
attgcattttatatctttgt

SEQ ID NO: 662093 - DNA, 20 bp, Artificial
  CRISPR gRNA sequence
cattttatatctttgtttcc

SEQ ID NO: 662094 - DNA, 20 bp, Artificial
  CRISPR gRNA sequence
tatatctttgtttcctacac

SEQ ID NO: 662095 - DNA, 20 bp, Artificial
  CRISPR gRNA sequence
atatctttgtttcctacaca

SEQ ID NO: 662096 - DNA, 20 bp, Artificial
  CRISPR gRNA sequence
tatctttgtttcctacacat

SEQ ID NO: 662097 - DNA, 20 bp, Artificial
  CRISPR gRNA sequence
tgtttcctacacattaactc

SEQ ID NO: 662098 - DNA, 20 bp, Artificial
  CRISPR gRNA sequence
gtttcctacacattaactcc

SEQ ID NO: 662099 - DNA, 20 bp, Artificial
  CRISPR gRNA sequence
tttcctacacattaactcca

SEQ ID NO: 662100 - DNA, 20 bp, Artificial
  CRISPR gRNA sequence
cctacacattaactccatca

SEQ ID NO: 662101 - DNA, 20 bp, Artificial
  CRISPR gRNA sequence
ctacacattaactccatcaa

SEQ ID NO: 662102 - DNA, 20 bp, Artificial
  CRISPR gRNA sequence
cacattaactccatcaagca

SEQ ID NO: 662103 - DNA, 20 bp, Artificial
  CRISPR gRNA sequence
actccatcaagcaattaata

SEQ ID NO: 662104 - DNA, 20 bp, Artificial
  CRISPR gRNA sequence
catcaagcaattaatattga

SEQ ID NO: 662105 - DNA, 20 bp, Artificial
  CRISPR gRNA sequence
atattgaacagtgtaattaa

SEQ ID NO: 662106 - DNA, 20 bp, Artificial
  CRISPR gRNA sequence
aacagtgtaattaagtggta

SEQ ID NO: 662107 - DNA, 20 bp, Artificial
  CRISPR gRNA sequence
agtggtagttttaaaacacc

SEQ ID NO: 662108 - DNA, 20 bp, Artificial
  CRISPR gRNA sequence
taaaacaccagttgtacaaa

SEQ ID NO: 662109 - DNA, 20 bp, Artificial
  CRISPR gRNA sequence
aaaacaccagttgtacaaaa

SEQ ID NO: 662110 - DNA, 20 bp, Artificial
  CRISPR gRNA sequence
aaacaccagttgtacaaaaa

SEQ ID NO: 662111 - DNA, 20 bp, Artificial
  CRISPR gRNA sequence
tacaaaaatcaagaccagtg

SEQ ID NO: 662112 - DNA, 20 bp, Artificial
  CRISPR gRNA sequence
attttagaatttaccatttt

SEQ ID NO: 662113 - DNA, 20 bp, Artificial
  CRISPR gRNA sequence
tagaatttaccatttttata

SEQ ID NO: 662114 - DNA, 20 bp, Artificial
  CRISPR gRNA sequence
agaatttaccatttttatac

SEQ ID NO: 662115 - DNA, 20 bp, Artificial
  CRISPR gRNA sequence
gaatttaccatttttataca

SEQ ID NO: 662116 - DNA, 20 bp, Artificial
  CRISPR gRNA sequence
accatttttatacaatatgc

SEQ ID NO: 662117 - DNA, 20 bp, Artificial
  CRISPR gRNA sequence
ccatttttatacaatatgca

SEQ ID NO: 662118 - DNA, 20 bp, Artificial
  CRISPR gRNA sequence
ttatacaatatgcaacttta

SEQ ID NO: 662119 - DNA, 20 bp, Artificial
  CRISPR gRNA sequence
tatacaatatgcaactttag

SEQ ID NO: 662120 - DNA, 20 bp, Artificial
  CRISPR gRNA sequence
atacaatatgcaactttaga

SEQ ID NO: 662121 - DNA, 20 bp, Artificial
  CRISPR gRNA sequence
tacaatatgcaactttagaa

SEQ ID NO: 662122 - DNA, 20 bp, Artificial
  CRISPR gRNA sequence
tagaaatgataatattattt

SEQ ID NO: 662123 - DNA, 20 bp, Artificial
  CRISPR gRNA sequence
agaaatgataatattattta

SEQ ID NO: 662124 - DNA, 20 bp, Artificial
  CRISPR gRNA sequence
gaaatgataatattatttaa

SEQ ID NO: 662125 - DNA, 20 bp, Artificial
  CRISPR gRNA sequence
tttaaaatttctatagatat

SEQ ID NO: 662126 - DNA, 20 bp, Artificial
  CRISPR gRNA sequence
aaaatttctatagatatttt

SEQ ID NO: 662127 - DNA, 20 bp, Artificial
  CRISPR gRNA sequence
aaatttctatagatatttta

SEQ ID NO: 662128 - DNA, 20 bp, Artificial
  CRISPR gRNA sequence
ctatagatattttaccttgc

SEQ ID NO: 662129 - DNA, 20 bp, Artificial
  CRISPR gRNA sequence
tatagatattttaccttgct

SEQ ID NO: 662130 - DNA, 20 bp, Artificial
  CRISPR gRNA sequence
tagatattttaccttgctta

SEQ ID NO: 662131 - DNA, 20 bp, Artificial
  CRISPR gRNA sequence
taccttgcttatgtttttct

SEQ ID NO: 662132 - DNA, 20 bp, Artificial
  CRISPR gRNA sequence
accttgcttatgtttttctt

SEQ ID NO: 662133 - DNA, 20 bp, Artificial
  CRISPR gRNA sequence
ccttgcttatgtttttcttc

SEQ ID NO: 662134 - DNA, 20 bp, Artificial
  CRISPR gRNA sequence
gcttatgtttttcttcttga

SEQ ID NO: 662135 - DNA, 20 bp, Artificial
  CRISPR gRNA sequence
cttatgtttttcttcttgaa

SEQ ID NO: 662136 - DNA, 20 bp, Artificial
  CRISPR gRNA sequence
atgtttttcttcttgaaata

SEQ ID NO: 662137 - DNA, 20 bp, Artificial
  CRISPR gRNA sequence
tgtttttcttcttgaaatat

SEQ ID NO: 662138 - DNA, 20 bp, Artificial
  CRISPR gRNA sequence
ttcttcttgaaatatagtat

SEQ ID NO: 662139 - DNA, 20 bp, Artificial
  CRISPR gRNA sequence
tcttcttgaaatatagtatt

SEQ ID NO: 662140 - DNA, 20 bp, Artificial
  CRISPR gRNA sequence
cttcttgaaatatagtattg

SEQ ID NO: 662141 - DNA, 20 bp, Artificial
  CRISPR gRNA sequence
ttcttgaaatatagtattgc

SEQ ID NO: 662142 - DNA, 20 bp, Artificial
  CRISPR gRNA sequence
cttgaaatatagtattgcca

SEQ ID NO: 662143 - DNA, 20 bp, Artificial
  CRISPR gRNA sequence
ttgaaatatagtattgccaa

SEQ ID NO: 662144 - DNA, 20 bp, Artificial
  CRISPR gRNA sequence
gaaatatagtattgccaaat

SEQ ID NO: 662145 - DNA, 20 bp, Artificial
  CRISPR gRNA sequence
aaatatagtattgccaaatt

SEQ ID NO: 662146 - DNA, 20 bp, Artificial
  CRISPR gRNA sequence
ccaaattgctgtactgtaac

SEQ ID NO: 662147 - DNA, 20 bp, Artificial
  CRISPR gRNA sequence
ctgtactgtaacatcatgat

SEQ ID NO: 662148 - DNA, 20 bp, Artificial
  CRISPR gRNA sequence
tactgtaacatcatgataat

SEQ ID NO: 662149 - DNA, 20 bp, Artificial
  CRISPR gRNA sequence
taacatcatgataataatgg

SEQ ID NO: 662150 - DNA, 20 bp, Artificial
  CRISPR gRNA sequence
ggaatttattttcattagtg

SEQ ID NO: 662151 - DNA, 20 bp, Artificial
  CRISPR gRNA sequence
attttcattagtggtcatag

SEQ ID NO: 662152 - DNA, 20 bp, Artificial
  CRISPR gRNA sequence
ttttcattagtggtcatagt

SEQ ID NO: 662153 - DNA, 20 bp, Artificial
  CRISPR gRNA sequence
tcattagtggtcatagtaca

SEQ ID NO: 662154 - DNA, 20 bp, Artificial
  CRISPR gRNA sequence
cattagtggtcatagtacag

SEQ ID NO: 662155 - DNA, 20 bp, Artificial
  CRISPR gRNA sequence
attagtggtcatagtacagt

SEQ ID NO: 662156 - DNA, 20 bp, Artificial
  CRISPR gRNA sequence
gtggtcatagtacagttaat

SEQ ID NO: 662157 - DNA, 20 bp, Artificial
  CRISPR gRNA sequence
atataaatatatagcacata

SEQ ID NO: 662158 - DNA, 20 bp, Artificial
  CRISPR gRNA sequence
aatatctgtttggaaatggg

SEQ ID NO: 662159 - DNA, 20 bp, Artificial
  CRISPR gRNA sequence
tttggaaatgggattcaaga

SEQ ID NO: 662160 - DNA, 20 bp, Artificial
  CRISPR gRNA sequence
ggaaatgggattcaagagct

SEQ ID NO: 662161 - DNA, 20 bp, Artificial
  CRISPR gRNA sequence
gaaatgggattcaagagctg

SEQ ID NO: 662162 - DNA, 20 bp, Artificial
  CRISPR gRNA sequence
aagagctgtgtcttaagttt

SEQ ID NO: 662163 - DNA, 20 bp, Artificial
  CRISPR gRNA sequence
tgtcttaagttttggtagga

SEQ ID NO: 662164 - DNA, 20 bp, Artificial
  CRISPR gRNA sequence
aagttttggtaggattcatt

SEQ ID NO: 662165 - DNA, 20 bp, Artificial
  CRISPR gRNA sequence
agttttggtaggattcattt

SEQ ID NO: 662166 - DNA, 20 bp, Artificial
  CRISPR gRNA sequence
tggtaggattcatttaatag

SEQ ID NO: 662167 - DNA, 20 bp, Artificial
  CRISPR gRNA sequence
ggtaggattcatttaatagc

SEQ ID NO: 662168 - DNA, 20 bp, Artificial
  CRISPR gRNA sequence
gtaggattcatttaatagct

SEQ ID NO: 662169 - DNA, 20 bp, Artificial
  CRISPR gRNA sequence
atttaatagctgtgtgaatt

SEQ ID NO: 662170 - DNA, 20 bp, Artificial
  CRISPR gRNA sequence
aatagctgtgtgaattactt

SEQ ID NO: 662171 - DNA, 20 bp, Artificial
  CRISPR gRNA sequence
atagctgtgtgaattactta

SEQ ID NO: 662172 - DNA, 20 bp, Artificial
  CRISPR gRNA sequence
tgtgaattacttaacctttc

SEQ ID NO: 662173 - DNA, 20 bp, Artificial
  CRISPR gRNA sequence
cttaacctttcagaaagtta

SEQ ID NO: 662174 - DNA, 20 bp, Artificial
  CRISPR gRNA sequence
aacctttcagaaagttaatt

SEQ ID NO: 662175 - DNA, 20 bp, Artificial
  CRISPR gRNA sequence
acctttcagaaagttaattt

SEQ ID NO: 662176 - DNA, 20 bp, Artificial
  CRISPR gRNA sequence
tcagaaagttaatttcttaa

SEQ ID NO: 662177 - DNA, 20 bp, Artificial
  CRISPR gRNA sequence
cagaaagttaatttcttaat

SEQ ID NO: 662178 - DNA, 20 bp, Artificial
  CRISPR gRNA sequence
agaaagttaatttcttaatc

SEQ ID NO: 662179 - DNA, 20 bp, Artificial
  CRISPR gRNA sequence
atttcttaatctgttaaaaa

SEQ ID NO: 662180 - DNA, 20 bp, Artificial
  CRISPR gRNA sequence
cttaatctgttaaaaaaaag

SEQ ID NO: 662181 - DNA, 20 bp, Artificial
  CRISPR gRNA sequence
ttaatctgttaaaaaaaagt

SEQ ID NO: 662182 - DNA, 20 bp, Artificial
  CRISPR gRNA sequence
aatctgttaaaaaaaagtga

SEQ ID NO: 662183 - DNA, 20 bp, Artificial
  CRISPR gRNA sequence
atctgttaaaaaaaagtgat

SEQ ID NO: 662184 - DNA, 20 bp, Artificial
  CRISPR gRNA sequence
ttaaaaaaaagtgatactaa

SEQ ID NO: 662185 - DNA, 20 bp, Artificial
  CRISPR gRNA sequence
aaaaaaagtgatactaatac

SEQ ID NO: 662186 - DNA, 20 bp, Artificial
  CRISPR gRNA sequence
atacatgccttacagggttg

SEQ ID NO: 662187 - DNA, 20 bp, Artificial
  CRISPR gRNA sequence
acagggttgtggtcaaggtt

SEQ ID NO: 662188 - DNA, 20 bp, Artificial
  CRISPR gRNA sequence
cagggttgtggtcaaggttg

SEQ ID NO: 662189 - DNA, 20 bp, Artificial
  CRISPR gRNA sequence
tggtcaaggttggagtgaat

SEQ ID NO: 662190 - DNA, 20 bp, Artificial
  CRISPR gRNA sequence
gagtgaatgtctttataata

SEQ ID NO: 662191 - DNA, 20 bp, Artificial
  CRISPR gRNA sequence
tataatacctagtatagtat

SEQ ID NO: 662192 - DNA, 20 bp, Artificial
  CRISPR gRNA sequence
ataatacctagtatagtatc

SEQ ID NO: 662193 - DNA, 20 bp, Artificial
  CRISPR gRNA sequence
taatacctagtatagtatct

SEQ ID NO: 662194 - DNA, 20 bp, Artificial
  CRISPR gRNA sequence
gtatagtatcttcaatgcaa

SEQ ID NO: 662195 - DNA, 20 bp, Artificial
  CRISPR gRNA sequence
caatgcaagcatctattatt

SEQ ID NO: 662196 - DNA, 20 bp, Artificial
  CRISPR gRNA sequence
aatgcaagcatctattattc

SEQ ID NO: 662197 - DNA, 20 bp, Artificial
  CRISPR gRNA sequence
ttattcctgtggttgtgtta

SEQ ID NO: 662198 - DNA, 20 bp, Artificial
  CRISPR gRNA sequence
ttcctgtggttgtgttactt

SEQ ID NO: 662199 - DNA, 20 bp, Artificial
  CRISPR gRNA sequence
ctgtggttgtgttacttatg

SEQ ID NO: 662200 - DNA, 20 bp, Artificial
  CRISPR gRNA sequence
tggttgtgttacttatgata

SEQ ID NO: 662201 - DNA, 20 bp, Artificial
  CRISPR gRNA sequence
tgttacttatgatatgtagc

SEQ ID NO: 662202 - DNA, 20 bp, Artificial
  CRISPR gRNA sequence
cttatgatatgtagccctaa

SEQ ID NO: 662203 - DNA, 20 bp, Artificial
  CRISPR gRNA sequence
atgatatgtagccctaaaat

SEQ ID NO: 662204 - DNA, 20 bp, Artificial
  CRISPR gRNA sequence
tgatatgtagccctaaaatt

SEQ ID NO: 662205 - DNA, 20 bp, Artificial
  CRISPR gRNA sequence
aaattgcaagatgaatatta

SEQ ID NO: 662206 - DNA, 20 bp, Artificial
  CRISPR gRNA sequence
caagatgaatattaacaaga

SEQ ID NO: 662207 - DNA, 20 bp, Artificial
  CRISPR gRNA sequence
acaagacaatatgcacagtt

SEQ ID NO: 662208 - DNA, 20 bp, Artificial
  CRISPR gRNA sequence
gccactacctgtaagatttg

SEQ ID NO: 662209 - DNA, 20 bp, Artificial
  CRISPR gRNA sequence
ccactacctgtaagatttga

SEQ ID NO: 662210 - DNA, 20 bp, Artificial
  CRISPR gRNA sequence
cctgtaagatttgatttatt

SEQ ID NO: 662211 - DNA, 20 bp, Artificial
  CRISPR gRNA sequence
taagatttgatttatttgag

SEQ ID NO: 662212 - DNA, 20 bp, Artificial
  CRISPR gRNA sequence
gatttatttgagtaaaataa

SEQ ID NO: 662213 - DNA, 20 bp, Artificial
  CRISPR gRNA sequence
atttatttgagtaaaataaa

SEQ ID NO: 662214 - DNA, 20 bp, Artificial
  CRISPR gRNA sequence
atttgagtaaaataaagggg

SEQ ID NO: 662215 - DNA, 20 bp, Artificial
  CRISPR gRNA sequence
tttgagtaaaataaagggga

SEQ ID NO: 662216 - DNA, 20 bp, Artificial
  CRISPR gRNA sequence
gagtaaaataaaggggaggt

SEQ ID NO: 662217 - DNA, 20 bp, Artificial
  CRISPR gRNA sequence
agtaaaataaaggggaggtg

SEQ ID NO: 662218 - DNA, 20 bp, Artificial
  CRISPR gRNA sequence
taaaattttcactgctataa

SEQ ID NO: 662219 - DNA, 20 bp, Artificial
  CRISPR gRNA sequence
tcactgctataattttgtgt

SEQ ID NO: 662220 - DNA, 20 bp, Artificial
  CRISPR gRNA sequence
cactgctataattttgtgtc

SEQ ID NO: 662221 - DNA, 20 bp, Artificial
  CRISPR gRNA sequence
actgctataattttgtgtct

SEQ ID NO: 662222 - DNA, 20 bp, Artificial
  CRISPR gRNA sequence
ctataattttgtgtctgctt

SEQ ID NO: 662223 - DNA, 20 bp, Artificial
  CRISPR gRNA sequence
taattttgtgtctgcttgca

SEQ ID NO: 662224 - DNA, 20 bp, Artificial
  CRISPR gRNA sequence
tgtgtctgcttgcatgtttt

SEQ ID NO: 662225 - DNA, 20 bp, Artificial
  CRISPR gRNA sequence
gtgtctgcttgcatgtttta

SEQ ID NO: 662226 - DNA, 20 bp, Artificial
  CRISPR gRNA sequence
tgtctgcttgcatgttttac

SEQ ID NO: 662227 - DNA, 20 bp, Artificial
  CRISPR gRNA sequence
cttgcatgttttacttgctg

SEQ ID NO: 662228 - DNA, 20 bp, Artificial
  CRISPR gRNA sequence
gcatgttttacttgctgaga

SEQ ID NO: 662229 - DNA, 20 bp, Artificial
  CRISPR gRNA sequence
catgttttacttgctgagaa

SEQ ID NO: 662230 - DNA, 20 bp, Artificial
  CRISPR gRNA sequence
tacttgctgagaatttggta

SEQ ID NO: 662231 - DNA, 20 bp, Artificial
  CRISPR gRNA sequence
acttgctgagaatttggtag

SEQ ID NO: 662232 - DNA, 20 bp, Artificial
  CRISPR gRNA sequence
cttgctgagaatttggtagg

SEQ ID NO: 662233 - DNA, 20 bp, Artificial
  CRISPR gRNA sequence
gctgagaatttggtagggtc

SEQ ID NO: 662234 - DNA, 20 bp, Artificial
  CRISPR gRNA sequence
ctgagaatttggtagggtca

SEQ ID NO: 662235 - DNA, 20 bp, Artificial
  CRISPR gRNA sequence
agaatttggtagggtcaagt

SEQ ID NO: 662236 - DNA, 20 bp, Artificial
  CRISPR gRNA sequence
ggtagggtcaagtgttaaaa

SEQ ID NO: 662237 - DNA, 20 bp, Artificial
  CRISPR gRNA sequence
gtagggtcaagtgttaaaat

SEQ ID NO: 662238 - DNA, 20 bp, Artificial
  CRISPR gRNA sequence
aaatcacttctaaaataagt

SEQ ID NO: 662239 - DNA, 20 bp, Artificial
  CRISPR gRNA sequence
ctaaaataagtctcctcaaa

SEQ ID NO: 662240 - DNA, 20 bp, Artificial
  CRISPR gRNA sequence
taaaataagtctcctcaaag

SEQ ID NO: 662241 - DNA, 20 bp, Artificial
  CRISPR gRNA sequence
aaataagtctcctcaaagtg

SEQ ID NO: 662242 - DNA, 20 bp, Artificial
  CRISPR gRNA sequence
ctcaaagtgattatttaata

SEQ ID NO: 662243 - DNA, 20 bp, Artificial
  CRISPR gRNA sequence
aaagtgattatttaatacgg

SEQ ID NO: 662244 - DNA, 20 bp, Artificial
  CRISPR gRNA sequence
tttaatacggagaattaatt

SEQ ID NO: 662245 - DNA, 20 bp, Artificial
  CRISPR gRNA sequence
aatacggagaattaattact

SEQ ID NO: 662246 - DNA, 20 bp, Artificial
  CRISPR gRNA sequence
atacggagaattaattacta

SEQ ID NO: 662247 - DNA, 20 bp, Artificial
  CRISPR gRNA sequence
attactaatttgaaatattt

SEQ ID NO: 662248 - DNA, 20 bp, Artificial
  CRISPR gRNA sequence
ctaatttgaaatattttaaa

SEQ ID NO: 662249 - DNA, 20 bp, Artificial
  CRISPR gRNA sequence
atttgaaatattttaaatag

SEQ ID NO: 662250 - DNA, 20 bp, Artificial
  CRISPR gRNA sequence
gaaatattttaaatagtggt

SEQ ID NO: 662251 - DNA, 20 bp, Artificial
  CRISPR gRNA sequence
aaatattttaaatagtggtc

SEQ ID NO: 662252 - DNA, 20 bp, Artificial
  CRISPR gRNA sequence
taaatagtggtcagttattt

SEQ ID NO: 662253 - DNA, 20 bp, Artificial
  CRISPR gRNA sequence
aaatagtggtcagttattta

SEQ ID NO: 662254 - DNA, 20 bp, Artificial
  CRISPR gRNA sequence
aatagtggtcagttatttaa

SEQ ID NO: 662255 - DNA, 20 bp, Artificial
  CRISPR gRNA sequence
tttaaaaaataatatattaa

SEQ ID NO: 662256 - DNA, 20 bp, Artificial
  CRISPR gRNA sequence
aaaaaataatatattaattg

SEQ ID NO: 662257 - DNA, 20 bp, Artificial
  CRISPR gRNA sequence
aaaaataatatattaattgg

SEQ ID NO: 662258 - DNA, 20 bp, Artificial
  CRISPR gRNA sequence
attggatagaataaaatgga

SEQ ID NO: 662259 - DNA, 20 bp, Artificial
  CRISPR gRNA sequence
gatagaataaaatggagctg

SEQ ID NO: 662260 - DNA, 20 bp, Artificial
  CRISPR gRNA sequence
ttaaaaaccatgtgctttaa

SEQ ID NO: 662261 - DNA, 20 bp, Artificial
  CRISPR gRNA sequence
aaaaccatgtgctttaagaa

SEQ ID NO: 662262 - DNA, 20 bp, Artificial
  CRISPR gRNA sequence
taagaatgattatggcatag

SEQ ID NO: 662263 - DNA, 20 bp, Artificial
  CRISPR gRNA sequence
aagaatgattatggcataga

SEQ ID NO: 662264 - DNA, 20 bp, Artificial
  CRISPR gRNA sequence
agaatgattatggcatagac

SEQ ID NO: 662265 - DNA, 20 bp, Artificial
  CRISPR gRNA sequence
tggcatagacattttttgaa

SEQ ID NO: 662266 - DNA, 20 bp, Artificial
  CRISPR gRNA sequence
tttgaaatacatacattaaa

SEQ ID NO: 662267 - DNA, 20 bp, Artificial
  CRISPR gRNA sequence
ttgaaatacatacattaaaa

SEQ ID NO: 662268 - DNA, 20 bp, Artificial
  CRISPR gRNA sequence
tgaaatacatacattaaaaa

SEQ ID NO: 662269 - DNA, 20 bp, Artificial
  CRISPR gRNA sequence
gaaatacatacattaaaaag

SEQ ID NO: 662270 - DNA, 20 bp, Artificial
  CRISPR gRNA sequence
aaatacatacattaaaaaga

SEQ ID NO: 662271 - DNA, 20 bp, Artificial
  CRISPR gRNA sequence
aaaagattatacaagtttat

SEQ ID NO: 662272 - DNA, 20 bp, Artificial
  CRISPR gRNA sequence
tacaagtttatatagtagga

SEQ ID NO: 662273 - DNA, 20 bp, Artificial
  CRISPR gRNA sequence
atatagtaggatctcaaata

SEQ ID NO: 662274 - DNA, 20 bp, Artificial
  CRISPR gRNA sequence
tatagtaggatctcaaatat

SEQ ID NO: 662275 - DNA, 20 bp, Artificial
  CRISPR gRNA sequence
aaatatgtaaagaaaagcgt

SEQ ID NO: 662276 - DNA, 20 bp, Artificial
  CRISPR gRNA sequence
catagaggaaagatgagatg

SEQ ID NO: 662277 - DNA, 20 bp, Artificial
  CRISPR gRNA sequence
atagaggaaagatgagatga

SEQ ID NO: 662278 - DNA, 20 bp, Artificial
  CRISPR gRNA sequence
ttgagtgttgggattctttg

SEQ ID NO: 662279 - DNA, 20 bp, Artificial
  CRISPR gRNA sequence
tgagtgttgggattctttgt

SEQ ID NO: 662280 - DNA, 20 bp, Artificial
  CRISPR gRNA sequence
gagtgttgggattctttgtg

SEQ ID NO: 662281 - DNA, 20 bp, Artificial
  CRISPR gRNA sequence
agtgttgggattctttgtga

SEQ ID NO: 662282 - DNA, 20 bp, Artificial
  CRISPR gRNA sequence
ggattctttgtgatttttgt

SEQ ID NO: 662283 - DNA, 20 bp, Artificial
  CRISPR gRNA sequence
tttgtgatttttgtttgatt

SEQ ID NO: 662284 - DNA, 20 bp, Artificial
  CRISPR gRNA sequence
tgtgatttttgtttgattta

SEQ ID NO: 662285 - DNA, 20 bp, Artificial
  CRISPR gRNA sequence
gtgatttttgtttgatttat

SEQ ID NO: 662286 - DNA, 20 bp, Artificial
  CRISPR gRNA sequence
tgatttttgtttgatttata

SEQ ID NO: 662287 - DNA, 20 bp, Artificial
  CRISPR gRNA sequence
ttgtttgatttatactttta

SEQ ID NO: 662288 - DNA, 20 bp, Artificial
  CRISPR gRNA sequence
tgtttgatttatacttttat

SEQ ID NO: 662289 - DNA, 20 bp, Artificial
  CRISPR gRNA sequence
gtttgatttatacttttata

SEQ ID NO: 662290 - DNA, 20 bp, Artificial
  CRISPR gRNA sequence
tttgatttatacttttatag

SEQ ID NO: 662291 - DNA, 20 bp, Artificial
  CRISPR gRNA sequence
gatttatacttttatagatt

SEQ ID NO: 662292 - DNA, 20 bp, Artificial
  CRISPR gRNA sequence
atttatacttttatagattt

SEQ ID NO: 662293 - DNA, 20 bp, Artificial
  CRISPR gRNA sequence
atacttttatagattttaca

SEQ ID NO: 662294 - DNA, 20 bp, Artificial
  CRISPR gRNA sequence
tacttttatagattttacat

SEQ ID NO: 662295 - DNA, 20 bp, Artificial
  CRISPR gRNA sequence
ttatagattttacatttttt

SEQ ID NO: 662296 - DNA, 20 bp, Artificial
  CRISPR gRNA sequence
tatagattttacattttttt

SEQ ID NO: 662297 - DNA, 20 bp, Artificial
  CRISPR gRNA sequence
atagattttacatttttttt

SEQ ID NO: 662298 - DNA, 20 bp, Artificial
  CRISPR gRNA sequence
tagattttacattttttttt

SEQ ID NO: 662299 - DNA, 20 bp, Artificial
  CRISPR gRNA sequence
tacatttttttttacaataa

SEQ ID NO: 662300 - DNA, 20 bp, Artificial
  CRISPR gRNA sequence
acatttttttttacaataag

SEQ ID NO: 662301 - DNA, 20 bp, Artificial
  CRISPR gRNA sequence
catttttttttacaataagc

SEQ ID NO: 662302 - DNA, 20 bp, Artificial
  CRISPR gRNA sequence
ttttttacaataagcatata

SEQ ID NO: 662303 - DNA, 20 bp, Artificial
  CRISPR gRNA sequence
tttttacaataagcatatat

SEQ ID NO: 662304 - DNA, 20 bp, Artificial
  CRISPR gRNA sequence
ttttacaataagcatatatt

SEQ ID NO: 662305 - DNA, 20 bp, Artificial
  CRISPR gRNA sequence
tttacaataagcatatatta

SEQ ID NO: 662306 - DNA, 20 bp, Artificial
  CRISPR gRNA sequence
ttacaataagcatatattac

SEQ ID NO: 662307 - DNA, 20 bp, Artificial
  CRISPR gRNA sequence
tacaataagcatatattact

SEQ ID NO: 662308 - DNA, 20 bp, Artificial
  CRISPR gRNA sequence
acaataagcatatattactt

SEQ ID NO: 662309 - DNA, 20 bp, Artificial
  CRISPR gRNA sequence
caataagcatatattacttt

SEQ ID NO: 662310 - DNA, 20 bp, Artificial
  CRISPR gRNA sequence
cttttatattagcaaaaaaa

SEQ ID NO: 662311 - DNA, 20 bp, Artificial
  CRISPR gRNA sequence
ttatattagcaaaaaaagca

SEQ ID NO: 662312 - DNA, 20 bp, Artificial
  CRISPR gRNA sequence
tatattagcaaaaaaagcaa

SEQ ID NO: 662313 - DNA, 20 bp, Artificial
  CRISPR gRNA sequence
atattagcaaaaaaagcaat

SEQ ID NO: 662314 - DNA, 20 bp, Artificial
  CRISPR gRNA sequence
tattagcaaaaaaagcaata

SEQ ID NO: 662315 - DNA, 20 bp, Artificial
  CRISPR gRNA sequence
gcaaaaaaagcaatatgttg

SEQ ID NO: 662316 - DNA, 20 bp, Artificial
  CRISPR gRNA sequence
tattgcttttttatgtttat

SEQ ID NO: 662317 - DNA, 20 bp, Artificial
  CRISPR gRNA sequence
cttttttatgtttatgtatt

SEQ ID NO: 662318 - DNA, 20 bp, Artificial
  CRISPR gRNA sequence
ttttatgtttatgtattctt

SEQ ID NO: 662319 - DNA, 20 bp, Artificial
  CRISPR gRNA sequence
tttatgtttatgtattcttc

SEQ ID NO: 662320 - DNA, 20 bp, Artificial
  CRISPR gRNA sequence
ttatgtttatgtattcttcg

SEQ ID NO: 662321 - DNA, 20 bp, Artificial
  CRISPR gRNA sequence
tatgtttatgtattcttcga

SEQ ID NO: 662322 - DNA, 20 bp, Artificial
  CRISPR gRNA sequence
atgtttatgtattcttcgag

SEQ ID NO: 662323 - DNA, 20 bp, Artificial
  CRISPR gRNA sequence
tgtttatgtattcttcgaga

SEQ ID NO: 662324 - DNA, 20 bp, Artificial
  CRISPR gRNA sequence
atgtattcttcgagattgaa

SEQ ID NO: 662325 - DNA, 20 bp, Artificial
  CRISPR gRNA sequence
tgtattcttcgagattgaat

SEQ ID NO: 662326 - DNA, 20 bp, Artificial
  CRISPR gRNA sequence
ttcgagattgaattgtagga

SEQ ID NO: 662327 - DNA, 20 bp, Artificial
  CRISPR gRNA sequence
cgagattgaattgtaggatg

SEQ ID NO: 662328 - DNA, 20 bp, Artificial
  CRISPR gRNA sequence
gagattgaattgtaggatga

SEQ ID NO: 662329 - DNA, 20 bp, Artificial
  CRISPR gRNA sequence
aattgtaggatgagtagaac

SEQ ID NO: 662330 - DNA, 20 bp, Artificial
  CRISPR gRNA sequence
taggatgagtagaacctaaa

SEQ ID NO: 662331 - DNA, 20 bp, Artificial
  CRISPR gRNA sequence
aatatatgtaccttctttta

SEQ ID NO: 662332 - DNA, 20 bp, Artificial
  CRISPR gRNA sequence
cttttaaagaaaagcacttt

SEQ ID NO: 662333 - DNA, 20 bp, Artificial
  CRISPR gRNA sequence
ttttaaagaaaagcacttta

SEQ ID NO: 662334 - DNA, 20 bp, Artificial
  CRISPR gRNA sequence
ttaaagaaaagcactttaaa

SEQ ID NO: 662335 - DNA, 20 bp, Artificial
  CRISPR gRNA sequence
taaagaaaagcactttaaag

SEQ ID NO: 662336 - DNA, 20 bp, Artificial
  CRISPR gRNA sequence
aaagaaaagcactttaaagc

SEQ ID NO: 662337 - DNA, 20 bp, Artificial
  CRISPR gRNA sequence
aagaaaagcactttaaagct

SEQ ID NO: 662338 - DNA, 20 bp, Artificial
  CRISPR gRNA sequence
taaagctatatcaactttgt

SEQ ID NO: 662339 - DNA, 20 bp, Artificial
  CRISPR gRNA sequence
aaagctatatcaactttgtt

SEQ ID NO: 662340 - DNA, 20 bp, Artificial
  CRISPR gRNA sequence
aagctatatcaactttgtta

SEQ ID NO: 662341 - DNA, 20 bp, Artificial
  CRISPR gRNA sequence
tatcaactttgttagtggaa

SEQ ID NO: 662342 - DNA, 20 bp, Artificial
  CRISPR gRNA sequence
tgttagtggaattttattcc

SEQ ID NO: 662343 - DNA, 20 bp, Artificial
  CRISPR gRNA sequence
gttagtggaattttattcca

SEQ ID NO: 662344 - DNA, 20 bp, Artificial
  CRISPR gRNA sequence
ttagtggaattttattccag

SEQ ID NO: 662345 - DNA, 20 bp, Artificial
  CRISPR gRNA sequence
gtggaattttattccagaag

SEQ ID NO: 662346 - DNA, 20 bp, Artificial
  CRISPR gRNA sequence
tattccagaagagtagaagt

SEQ ID NO: 662347 - DNA, 20 bp, Artificial
  CRISPR gRNA sequence
attccagaagagtagaagtt

SEQ ID NO: 662348 - DNA, 20 bp, Artificial
  CRISPR gRNA sequence
ttccagaagagtagaagttg

SEQ ID NO: 662349 - DNA, 20 bp, Artificial
  CRISPR gRNA sequence
cagaagagtagaagttggca

SEQ ID NO: 662350 - DNA, 20 bp, Artificial
  CRISPR gRNA sequence
gcacctggaagcactcttgg

SEQ ID NO: 662351 - DNA, 20 bp, Artificial
  CRISPR gRNA sequence
gaagcactcttggaccgttt

SEQ ID NO: 662352 - DNA, 20 bp, Artificial
  CRISPR gRNA sequence
ttggaccgttttcctattga

SEQ ID NO: 662353 - DNA, 20 bp, Artificial
  CRISPR gRNA sequence
ggaccgttttcctattgagg

SEQ ID NO: 662354 - DNA, 20 bp, Artificial
  CRISPR gRNA sequence
gaccgttttcctattgagga

SEQ ID NO: 662355 - DNA, 20 bp, Artificial
  CRISPR gRNA sequence
tcctattgaggaggggttta

SEQ ID NO: 662356 - DNA, 20 bp, Artificial
  CRISPR gRNA sequence
cctattgaggaggggtttat

SEQ ID NO: 662357 - DNA, 20 bp, Artificial
  CRISPR gRNA sequence
ctattgaggaggggtttatt

SEQ ID NO: 662358 - DNA, 20 bp, Artificial
  CRISPR gRNA sequence
ttgaggaggggtttattttg

SEQ ID NO: 662359 - DNA, 20 bp, Artificial
  CRISPR gRNA sequence
aggaggggtttattttggta

SEQ ID NO: 662360 - DNA, 20 bp, Artificial
  CRISPR gRNA sequence
attttggtaaagtaacacta

SEQ ID NO: 662361 - DNA, 20 bp, Artificial
  CRISPR gRNA sequence
ttttggtaaagtaacactac

SEQ ID NO: 662362 - DNA, 20 bp, Artificial
  CRISPR gRNA sequence
tggtaaagtaacactaccac

SEQ ID NO: 662363 - DNA, 20 bp, Artificial
  CRISPR gRNA sequence
ggtaaagtaacactaccact

SEQ ID NO: 662364 - DNA, 20 bp, Artificial
  CRISPR gRNA sequence
gtaaagtaacactaccactg

SEQ ID NO: 662365 - DNA, 20 bp, Artificial
  CRISPR gRNA sequence
ccactgtagcccgatggcta

SEQ ID NO: 662366 - DNA, 20 bp, Artificial
  CRISPR gRNA sequence
tagcccgatggctactgcag

SEQ ID NO: 662367 - DNA, 20 bp, Artificial
  CRISPR gRNA sequence
ctgcagtgggatcagatctc

SEQ ID NO: 662368 - DNA, 20 bp, Artificial
  CRISPR gRNA sequence
cagtgggatcagatctcagg

SEQ ID NO: 662369 - DNA, 20 bp, Artificial
  CRISPR gRNA sequence
aggtcatatcagttcagtag

SEQ ID NO: 662370 - DNA, 20 bp, Artificial
  CRISPR gRNA sequence
agtagctcagcttgtagctc

SEQ ID NO: 662371 - DNA, 20 bp, Artificial
  CRISPR gRNA sequence
agcttgtagctctgatctct

SEQ ID NO: 662372 - DNA, 20 bp, Artificial
  CRISPR gRNA sequence
gtagctctgatctctcaaac

SEQ ID NO: 662373 - DNA, 20 bp, Artificial
  CRISPR gRNA sequence
tagctctgatctctcaaact

SEQ ID NO: 662374 - DNA, 20 bp, Artificial
  CRISPR gRNA sequence
tgatctctcaaactgtgggg

SEQ ID NO: 662375 - DNA, 20 bp, Artificial
  CRISPR gRNA sequence
atctctcaaactgtggggca

SEQ ID NO: 662376 - DNA, 20 bp, Artificial
  CRISPR gRNA sequence
tcaaactgtggggcacagtg

SEQ ID NO: 662377 - DNA, 20 bp, Artificial
  CRISPR gRNA sequence
aaactgtggggcacagtgag

SEQ ID NO: 662378 - DNA, 20 bp, Artificial
  CRISPR gRNA sequence
tggggcacagtgagaagggt

SEQ ID NO: 662379 - DNA, 20 bp, Artificial
  CRISPR gRNA sequence
tttagaagctggcccctctg

SEQ ID NO: 662380 - DNA, 20 bp, Artificial
  CRISPR gRNA sequence
ttagaagctggcccctctgt

SEQ ID NO: 662381 - DNA, 20 bp, Artificial
  CRISPR gRNA sequence
tagaagctggcccctctgtc

SEQ ID NO: 662382 - DNA, 20 bp, Artificial
  CRISPR gRNA sequence
agaagctggcccctctgtct

SEQ ID NO: 662383 - DNA, 20 bp, Artificial
  CRISPR gRNA sequence
gaagctggcccctctgtctt

SEQ ID NO: 662384 - DNA, 20 bp, Artificial
  CRISPR gRNA sequence
gcccctctgtcttttcatgc

SEQ ID NO: 662385 - DNA, 20 bp, Artificial
  CRISPR gRNA sequence
tgtcttttcatgcacacaaa

SEQ ID NO: 662386 - DNA, 20 bp, Artificial
  CRISPR gRNA sequence
tcttttcatgcacacaaatc

SEQ ID NO: 662387 - DNA, 20 bp, Artificial
  CRISPR gRNA sequence
ttcatgcacacaaatctgct

SEQ ID NO: 662388 - DNA, 20 bp, Artificial
  CRISPR gRNA sequence
tcatgcacacaaatctgctt

SEQ ID NO: 662389 - DNA, 20 bp, Artificial
  CRISPR gRNA sequence
catgcacacaaatctgctta

SEQ ID NO: 662390 - DNA, 20 bp, Artificial
  CRISPR gRNA sequence
atgcacacaaatctgcttat

SEQ ID NO: 662391 - DNA, 20 bp, Artificial
  CRISPR gRNA sequence
cttattatgaccacagttca

SEQ ID NO: 662392 - DNA, 20 bp, Artificial
  CRISPR gRNA sequence
attatgaccacagttcattg

SEQ ID NO: 662393 - DNA, 20 bp, Artificial
  CRISPR gRNA sequence
ttatgaccacagttcattgg

SEQ ID NO: 662394 - DNA, 20 bp, Artificial
  CRISPR gRNA sequence
tgaccacagttcattgggga

SEQ ID NO: 662395 - DNA, 20 bp, Artificial
  CRISPR gRNA sequence
attggggatggcagaagtag

SEQ ID NO: 662396 - DNA, 20 bp, Artificial
  CRISPR gRNA sequence
gggatggcagaagtagtaca

SEQ ID NO: 662397 - DNA, 20 bp, Artificial
  CRISPR gRNA sequence
atgtaagcataatattttat

SEQ ID NO: 662398 - DNA, 20 bp, Artificial
  CRISPR gRNA sequence
tatattatgtaaaatattta

SEQ ID NO: 662399 - DNA, 20 bp, Artificial
  CRISPR gRNA sequence
atattatgtaaaatatttac

SEQ ID NO: 662400 - DNA, 20 bp, Artificial
  CRISPR gRNA sequence
tattatgtaaaatatttacg

SEQ ID NO: 662401 - DNA, 20 bp, Artificial
  CRISPR gRNA sequence
tgtaaaatatttacgtcatg

SEQ ID NO: 662402 - DNA, 20 bp, Artificial
  CRISPR gRNA sequence
acgtcatgtagaagaaattt

SEQ ID NO: 662403 - DNA, 20 bp, Artificial
  CRISPR gRNA sequence
cgtcatgtagaagaaatttt

SEQ ID NO: 662404 - DNA, 20 bp, Artificial
  CRISPR gRNA sequence
tttaaaatttgtaaaatttt

SEQ ID NO: 662405 - DNA, 20 bp, Artificial
  CRISPR gRNA sequence
ttaaaatttgtaaaattttg

SEQ ID NO: 662406 - DNA, 20 bp, Artificial
  CRISPR gRNA sequence
taaaatttgtaaaattttgt

SEQ ID NO: 662407 - DNA, 20 bp, Artificial
  CRISPR gRNA sequence
aaaatttgtaaaattttgtc

SEQ ID NO: 662408 - DNA, 20 bp, Artificial
  CRISPR gRNA sequence
aaatttgtaaaattttgtca

SEQ ID NO: 662409 - DNA, 20 bp, Artificial
  CRISPR gRNA sequence
gtaaaattttgtcagaaaaa

SEQ ID NO: 662410 - DNA, 20 bp, Artificial
  CRISPR gRNA sequence
taaaattttgtcagaaaaac

SEQ ID NO: 662411 - DNA, 20 bp, Artificial
  CRISPR gRNA sequence
tgtcagaaaaactttttttc

SEQ ID NO: 662412 - DNA, 20 bp, Artificial
  CRISPR gRNA sequence
gtcagaaaaactttttttcc

SEQ ID NO: 662413 - DNA, 20 bp, Artificial
  CRISPR gRNA sequence
tcagaaaaactttttttcct

SEQ ID NO: 662414 - DNA, 20 bp, Artificial
  CRISPR gRNA sequence
tttttcctcaataaaaatca

SEQ ID NO: 662415 - DNA, 20 bp, Artificial
  CRISPR gRNA sequence
ttttcctcaataaaaatcac

SEQ ID NO: 662416 - DNA, 20 bp, Artificial
  CRISPR gRNA sequence
tttcctcaataaaaatcacc

SEQ ID NO: 662417 - DNA, 20 bp, Artificial
  CRISPR gRNA sequence
ttcctcaataaaaatcacct

SEQ ID NO: 662418 - DNA, 20 bp, Artificial
  CRISPR gRNA sequence
tcctcaataaaaatcaccta

SEQ ID NO: 662419 - DNA, 20 bp, Artificial
  CRISPR gRNA sequence
cctcaataaaaatcacctac

SEQ ID NO: 662420 - DNA, 20 bp, Artificial
  CRISPR gRNA sequence
ctcaataaaaatcacctact

SEQ ID NO: 662421 - DNA, 20 bp, Artificial
  CRISPR gRNA sequence
aataaaaatcacctactttc

SEQ ID NO: 662422 - DNA, 20 bp, Artificial
  CRISPR gRNA sequence
ctttccaatggataattcta

SEQ ID NO: 662423 - DNA, 20 bp, Artificial
  CRISPR gRNA sequence
tccaatggataattctacat

SEQ ID NO: 662424 - DNA, 20 bp, Artificial
  CRISPR gRNA sequence
ccaatggataattctacatc

SEQ ID NO: 662425 - DNA, 20 bp, Artificial
  CRISPR gRNA sequence
caatggataattctacatct

SEQ ID NO: 662426 - DNA, 20 bp, Artificial
  CRISPR gRNA sequence
tacatcttatatagtcctta

SEQ ID NO: 662427 - DNA, 20 bp, Artificial
  CRISPR gRNA sequence
catcttatatagtccttatt

SEQ ID NO: 662428 - DNA, 20 bp, Artificial
  CRISPR gRNA sequence
atatagtccttatttcattt

SEQ ID NO: 662429 - DNA, 20 bp, Artificial
  CRISPR gRNA sequence
tatagtccttatttcatttt

SEQ ID NO: 662430 - DNA, 20 bp, Artificial
  CRISPR gRNA sequence
atttcattttttcacaggtt

SEQ ID NO: 662431 - DNA, 20 bp, Artificial
  CRISPR gRNA sequence
tttcattttttcacaggtta

SEQ ID NO: 662432 - DNA, 20 bp, Artificial
  CRISPR gRNA sequence
cattttttcacaggttatcc

SEQ ID NO: 662433 - DNA, 20 bp, Artificial
  CRISPR gRNA sequence
attttttcacaggttatcct

SEQ ID NO: 662434 - DNA, 20 bp, Artificial
  CRISPR gRNA sequence
tttcacaggttatcctagtt

SEQ ID NO: 662435 - DNA, 20 bp, Artificial
  CRISPR gRNA sequence
ttcacaggttatcctagttg

SEQ ID NO: 662436 - DNA, 20 bp, Artificial
  CRISPR gRNA sequence
tcacaggttatcctagttga

SEQ ID NO: 662437 - DNA, 20 bp, Artificial
  CRISPR gRNA sequence
cacaggttatcctagttgac

SEQ ID NO: 662438 - DNA, 20 bp, Artificial
  CRISPR gRNA sequence
acaggttatcctagttgaca

SEQ ID NO: 662439 - DNA, 20 bp, Artificial
  CRISPR gRNA sequence
tcctagttgacatcaaagca

SEQ ID NO: 662440 - DNA, 20 bp, Artificial
  CRISPR gRNA sequence
gttgacatcaaagcatgcac

SEQ ID NO: 662441 - DNA, 20 bp, Artificial
  CRISPR gRNA sequence
acatcaaagcatgcacccat

SEQ ID NO: 662442 - DNA, 20 bp, Artificial
  CRISPR gRNA sequence
tgaatatttcgggaaatctc

SEQ ID NO: 662443 - DNA, 20 bp, Artificial
  CRISPR gRNA sequence
gaatatttcgggaaatctca

SEQ ID NO: 662444 - DNA, 20 bp, Artificial
  CRISPR gRNA sequence
aatatttcgggaaatctcat

SEQ ID NO: 662445 - DNA, 20 bp, Artificial
  CRISPR gRNA sequence
cgggaaatctcattaaacac

SEQ ID NO: 662446 - DNA, 20 bp, Artificial
  CRISPR gRNA sequence
gggaaatctcattaaacact

SEQ ID NO: 662447 - DNA, 20 bp, Artificial
  CRISPR gRNA sequence
attaaacactgaaaaggata

SEQ ID NO: 662448 - DNA, 20 bp, Artificial
  CRISPR gRNA sequence
aacactgaaaaggataatgc

SEQ ID NO: 662449 - DNA, 20 bp, Artificial
  CRISPR gRNA sequence
aaaaggataatgccttgtgg

SEQ ID NO: 662450 - DNA, 20 bp, Artificial
  CRISPR gRNA sequence
gtgggttgctccatagtaat

SEQ ID NO: 662451 - DNA, 20 bp, Artificial
  CRISPR gRNA sequence
tgggttgctccatagtaatt

SEQ ID NO: 662452 - DNA, 20 bp, Artificial
  CRISPR gRNA sequence
ctccatagtaatttcaatcg

SEQ ID NO: 662453 - DNA, 20 bp, Artificial
  CRISPR gRNA sequence
catagtaatttcaatcgttt

SEQ ID NO: 662454 - DNA, 20 bp, Artificial
  CRISPR gRNA sequence
caatcgtttttttcccaagt

SEQ ID NO: 662455 - DNA, 20 bp, Artificial
  CRISPR gRNA sequence
aatcgtttttttcccaagtt

SEQ ID NO: 662456 - DNA, 20 bp, Artificial
  CRISPR gRNA sequence
ttttcccaagtttacattga

SEQ ID NO: 662457 - DNA, 20 bp, Artificial
  CRISPR gRNA sequence
tttcccaagtttacattgac

SEQ ID NO: 662458 - DNA, 20 bp, Artificial
  CRISPR gRNA sequence
ttcccaagtttacattgacc

SEQ ID NO: 662459 - DNA, 20 bp, Artificial
  CRISPR gRNA sequence
tcccaagtttacattgaccc

SEQ ID NO: 662460 - DNA, 20 bp, Artificial
  CRISPR gRNA sequence
cccaagtttacattgacccc

SEQ ID NO: 662461 - DNA, 20 bp, Artificial
  CRISPR gRNA sequence
ccaagtttacattgacccca

SEQ ID NO: 662462 - DNA, 20 bp, Artificial
  CRISPR gRNA sequence
acattgaccccattctccta

SEQ ID NO: 662463 - DNA, 20 bp, Artificial
  CRISPR gRNA sequence
cattgaccccattctcctat

SEQ ID NO: 662464 - DNA, 20 bp, Artificial
  CRISPR gRNA sequence
accccattctcctatcaact

SEQ ID NO: 662465 - DNA, 20 bp, Artificial
  CRISPR gRNA sequence
tcctatcaactcagtagggt

SEQ ID NO: 662466 - DNA, 20 bp, Artificial
  CRISPR gRNA sequence
ctatcaactcagtagggttt

SEQ ID NO: 662467 - DNA, 20 bp, Artificial
  CRISPR gRNA sequence
tcaactcagtagggtttcac

SEQ ID NO: 662468 - DNA, 20 bp, Artificial
  CRISPR gRNA sequence
agtagggtttcacggccgtt

SEQ ID NO: 662469 - DNA, 20 bp, Artificial
  CRISPR gRNA sequence
cacggccgttgttgcttcct

SEQ ID NO: 662470 - DNA, 20 bp, Artificial
  CRISPR gRNA sequence
acggccgttgttgcttcctt

SEQ ID NO: 662471 - DNA, 20 bp, Artificial
  CRISPR gRNA sequence
ttgcttccttttgcctaatt

SEQ ID NO: 662472 - DNA, 20 bp, Artificial
  CRISPR gRNA sequence
cttccttttgcctaatttag

SEQ ID NO: 662473 - DNA, 20 bp, Artificial
  CRISPR gRNA sequence
ccttttgcctaatttagcat

SEQ ID NO: 662474 - DNA, 20 bp, Artificial
  CRISPR gRNA sequence
cttttgcctaatttagcatc

SEQ ID NO: 662475 - DNA, 20 bp, Artificial
  CRISPR gRNA sequence
ttgcctaatttagcatcatg

SEQ ID NO: 662476 - DNA, 20 bp, Artificial
  CRISPR gRNA sequence
tgcctaatttagcatcatgc

SEQ ID NO: 662477 - DNA, 20 bp, Artificial
  CRISPR gRNA sequence
gcctaatttagcatcatgcc

SEQ ID NO: 662478 - DNA, 20 bp, Artificial
  CRISPR gRNA sequence
cctaatttagcatcatgcct

SEQ ID NO: 662479 - DNA, 20 bp, Artificial
  CRISPR gRNA sequence
atttagcatcatgcctgatg

SEQ ID NO: 662480 - DNA, 20 bp, Artificial
  CRISPR gRNA sequence
agcatcatgcctgatggttt

SEQ ID NO: 662481 - DNA, 20 bp, Artificial
  CRISPR gRNA sequence
gcatcatgcctgatggttta

SEQ ID NO: 662482 - DNA, 20 bp, Artificial
  CRISPR gRNA sequence
atggtttacatttcacttaa

SEQ ID NO: 662483 - DNA, 20 bp, Artificial
  CRISPR gRNA sequence
acatttcacttaatcatagc

SEQ ID NO: 662484 - DNA, 20 bp, Artificial
  CRISPR gRNA sequence
catttcacttaatcatagct

SEQ ID NO: 662485 - DNA, 20 bp, Artificial
  CRISPR gRNA sequence
cacttaatcatagctttcga

SEQ ID NO: 662486 - DNA, 20 bp, Artificial
  CRISPR gRNA sequence
acttaatcatagctttcgag

SEQ ID NO: 662487 - DNA, 20 bp, Artificial
  CRISPR gRNA sequence
aatcatagctttcgagatgt

SEQ ID NO: 662488 - DNA, 20 bp, Artificial
  CRISPR gRNA sequence
atcatagctttcgagatgta

SEQ ID NO: 662489 - DNA, 20 bp, Artificial
  CRISPR gRNA sequence
tcgagatgtagcatacctct

SEQ ID NO: 662490 - DNA, 20 bp, Artificial
  CRISPR gRNA sequence
cgagatgtagcatacctctc

SEQ ID NO: 662491 - DNA, 20 bp, Artificial
  CRISPR gRNA sequence
gagatgtagcatacctctct

SEQ ID NO: 662492 - DNA, 20 bp, Artificial
  CRISPR gRNA sequence
tctttgttctagagatatga

SEQ ID NO: 662493 - DNA, 20 bp, Artificial
  CRISPR gRNA sequence
tttgttctagagatatgaaa

SEQ ID NO: 662494 - DNA, 20 bp, Artificial
  CRISPR gRNA sequence
tgttctagagatatgaaaac

SEQ ID NO: 662495 - DNA, 20 bp, Artificial
  CRISPR gRNA sequence
gttctagagatatgaaaact

SEQ ID NO: 662496 - DNA, 20 bp, Artificial
  CRISPR gRNA sequence
ttctagagatatgaaaacta

SEQ ID NO: 662497 - DNA, 20 bp, Artificial
  CRISPR gRNA sequence
tagagatatgaaaactaacc

SEQ ID NO: 662498 - DNA, 20 bp, Artificial
  CRISPR gRNA sequence
gagatatgaaaactaaccta

SEQ ID NO: 662499 - DNA, 20 bp, Artificial
  CRISPR gRNA sequence
acctacacagttagaacaca

SEQ ID NO: 662500 - DNA, 20 bp, Artificial
  CRISPR gRNA sequence
cacagttagaacacaggtaa

SEQ ID NO: 662501 - DNA, 20 bp, Artificial
  CRISPR gRNA sequence
gaacacaggtaaacttcagg

SEQ ID NO: 662502 - DNA, 20 bp, Artificial
  CRISPR gRNA sequence
caggtcttttgatttcgaat

SEQ ID NO: 662503 - DNA, 20 bp, Artificial
  CRISPR gRNA sequence
aggtcttttgatttcgaatt

SEQ ID NO: 662504 - DNA, 20 bp, Artificial
  CRISPR gRNA sequence
ttgatttcgaattcagcatg

SEQ ID NO: 662505 - DNA, 20 bp, Artificial
  CRISPR gRNA sequence
tgatttcgaattcagcatgc

SEQ ID NO: 662506 - DNA, 20 bp, Artificial
  CRISPR gRNA sequence
gatttcgaattcagcatgca

SEQ ID NO: 662507 - DNA, 20 bp, Artificial
  CRISPR gRNA sequence
atttcgaattcagcatgcat

SEQ ID NO: 662508 - DNA, 20 bp, Artificial
  CRISPR gRNA sequence
cgaattcagcatgcattgtg

SEQ ID NO: 662509 - DNA, 20 bp, Artificial
  CRISPR gRNA sequence
gaattcagcatgcattgtgt

SEQ ID NO: 662510 - DNA, 20 bp, Artificial
  CRISPR gRNA sequence
agcatgcattgtgttctgtc

SEQ ID NO: 662511 - DNA, 20 bp, Artificial
  CRISPR gRNA sequence
tgttctgtcgtgttccagta

SEQ ID NO: 662512 - DNA, 20 bp, Artificial
  CRISPR gRNA sequence
tgtcgtgttccagtattctt

SEQ ID NO: 662513 - DNA, 20 bp, Artificial
  CRISPR gRNA sequence
tcgtgttccagtattcttga

SEQ ID NO: 662514 - DNA, 20 bp, Artificial
  CRISPR gRNA sequence
cagtattcttgatagttctc

SEQ ID NO: 662515 - DNA, 20 bp, Artificial
  CRISPR gRNA sequence
ttgatagttctctaaaatgt

SEQ ID NO: 662516 - DNA, 20 bp, Artificial
  CRISPR gRNA sequence
gatagttctctaaaatgttg

SEQ ID NO: 662517 - DNA, 20 bp, Artificial
  CRISPR gRNA sequence
atagttctctaaaatgttgt

SEQ ID NO: 662518 - DNA, 20 bp, Artificial
  CRISPR gRNA sequence
tctaaaatgttgtcaagaag

SEQ ID NO: 662519 - DNA, 20 bp, Artificial
  CRISPR gRNA sequence
taaaatgttgtcaagaaggg

SEQ ID NO: 662520 - DNA, 20 bp, Artificial
  CRISPR gRNA sequence
aaatgttgtcaagaagggcc

SEQ ID NO: 662521 - DNA, 20 bp, Artificial
  CRISPR gRNA sequence
tcaagaagggcctaagatct

SEQ ID NO: 662522 - DNA, 20 bp, Artificial
  CRISPR gRNA sequence
agatctttgtgatctcgcca

SEQ ID NO: 662523 - DNA, 20 bp, Artificial
  CRISPR gRNA sequence
tgtgatctcgccaaagagtt

SEQ ID NO: 662524 - DNA, 20 bp, Artificial
  CRISPR gRNA sequence
gtgatctcgccaaagagttt

SEQ ID NO: 662525 - DNA, 20 bp, Artificial
  CRISPR gRNA sequence
tgatctcgccaaagagttta

SEQ ID NO: 662526 - DNA, 20 bp, Artificial
  CRISPR gRNA sequence
gccaaagagtttagaagtat

SEQ ID NO: 662527 - DNA, 20 bp, Artificial
  CRISPR gRNA sequence
agaagtatgtatgtgtgttg

SEQ ID NO: 662528 - DNA, 20 bp, Artificial
  CRISPR gRNA sequence
gaagtatgtatgtgtgttgt

SEQ ID NO: 662529 - DNA, 20 bp, Artificial
  CRISPR gRNA sequence
tttgtttttcctcctgcaag

SEQ ID NO: 662530 - DNA, 20 bp, Artificial
  CRISPR gRNA sequence
gtttttcctcctgcaagaat

SEQ ID NO: 662531 - DNA, 20 bp, Artificial
  CRISPR gRNA sequence
tttttcctcctgcaagaatt

SEQ ID NO: 662532 - DNA, 20 bp, Artificial
  CRISPR gRNA sequence
ttcctcctgcaagaattcct

SEQ ID NO: 662533 - DNA, 20 bp, Artificial
  CRISPR gRNA sequence
tcctcctgcaagaattcctg

SEQ ID NO: 662534 - DNA, 20 bp, Artificial
  CRISPR gRNA sequence
cctcctgcaagaattcctga

SEQ ID NO: 662535 - DNA, 20 bp, Artificial
  CRISPR gRNA sequence
ctcctgcaagaattcctgag

SEQ ID NO: 662536 - DNA, 20 bp, Artificial
  CRISPR gRNA sequence
ctgcaagaattcctgagata

SEQ ID NO: 662537 - DNA, 20 bp, Artificial
  CRISPR gRNA sequence
caagaattcctgagataaat

SEQ ID NO: 662538 - DNA, 20 bp, Artificial
  CRISPR gRNA sequence
ctgagataaattatctaaat

SEQ ID NO: 662539 - DNA, 20 bp, Artificial
  CRISPR gRNA sequence
agataaattatctaaatttt

SEQ ID NO: 662540 - DNA, 20 bp, Artificial
  CRISPR gRNA sequence
tctaaattttcactgaaaac

SEQ ID NO: 662541 - DNA, 20 bp, Artificial
  CRISPR gRNA sequence
aattttcactgaaaacaaga

SEQ ID NO: 662542 - DNA, 20 bp, Artificial
  CRISPR gRNA sequence
tcactgaaaacaagaattcc

SEQ ID NO: 662543 - DNA, 20 bp, Artificial
  CRISPR gRNA sequence
cactgaaaacaagaattcct

SEQ ID NO: 662544 - DNA, 20 bp, Artificial
  CRISPR gRNA sequence
actgaaaacaagaattcctg

SEQ ID NO: 662545 - DNA, 20 bp, Artificial
  CRISPR gRNA sequence
aaaacaagaattcctgagat

SEQ ID NO: 662546 - DNA, 20 bp, Artificial
  CRISPR gRNA sequence
ctgagataaattatctaaat

SEQ ID NO: 662547 - DNA, 20 bp, Artificial
  CRISPR gRNA sequence
agataaattatctaaatttt

SEQ ID NO: 662548 - DNA, 20 bp, Artificial
  CRISPR gRNA sequence
tctaaattttcactgaaaac

SEQ ID NO: 662549 - DNA, 20 bp, Artificial
  CRISPR gRNA sequence
aattttcactgaaaactcta

SEQ ID NO: 662550 - DNA, 20 bp, Artificial
  CRISPR gRNA sequence
tcactgaaaactctaataca

SEQ ID NO: 662551 - DNA, 20 bp, Artificial
  CRISPR gRNA sequence
cactgaaaactctaatacat

SEQ ID NO: 662552 - DNA, 20 bp, Artificial
  CRISPR gRNA sequence
actgaaaactctaatacatg

SEQ ID NO: 662553 - DNA, 20 bp, Artificial
  CRISPR gRNA sequence
aaaactctaatacatgaagg

SEQ ID NO: 662554 - DNA, 20 bp, Artificial
  CRISPR gRNA sequence
taatacatgaaggtagttac

SEQ ID NO: 662555 - DNA, 20 bp, Artificial
  CRISPR gRNA sequence
atacatgaaggtagttacac

SEQ ID NO: 662556 - DNA, 20 bp, Artificial
  CRISPR gRNA sequence
cacagttccagcaatgactg

SEQ ID NO: 662557 - DNA, 20 bp, Artificial
  CRISPR gRNA sequence
cagcaatgactgaacttgaa

SEQ ID NO: 662558 - DNA, 20 bp, Artificial
  CRISPR gRNA sequence
aacttgaaccatgatttaca

SEQ ID NO: 662559 - DNA, 20 bp, Artificial
  CRISPR gRNA sequence
gaaccatgatttacatacct

SEQ ID NO: 662560 - DNA, 20 bp, Artificial
  CRISPR gRNA sequence
aaccatgatttacatacctt

SEQ ID NO: 662561 - DNA, 20 bp, Artificial
  CRISPR gRNA sequence
acataccttccctattaagt

SEQ ID NO: 662562 - DNA, 20 bp, Artificial
  CRISPR gRNA sequence
cataccttccctattaagtg

SEQ ID NO: 662563 - DNA, 20 bp, Artificial
  CRISPR gRNA sequence
ccctattaagtgccagtcag

SEQ ID NO: 662564 - DNA, 20 bp, Artificial
  CRISPR gRNA sequence
cctattaagtgccagtcagg

SEQ ID NO: 662565 - DNA, 20 bp, Artificial
  CRISPR gRNA sequence
ttaagtgccagtcaggttct

SEQ ID NO: 662566 - DNA, 20 bp, Artificial
  CRISPR gRNA sequence
agtgccagtcaggttctcgc

SEQ ID NO: 662567 - DNA, 20 bp, Artificial
  CRISPR gRNA sequence
tcgctacagatgagcaaatc

SEQ ID NO: 662568 - DNA, 20 bp, Artificial
  CRISPR gRNA sequence
gctacagatgagcaaatctg

SEQ ID NO: 662569 - DNA, 20 bp, Artificial
  CRISPR gRNA sequence
cagatgagcaaatctgcttt

SEQ ID NO: 662570 - DNA, 20 bp, Artificial
  CRISPR gRNA sequence
ctttttccacagtgagaaaa

SEQ ID NO: 662571 - DNA, 20 bp, Artificial
  CRISPR gRNA sequence
tttccacagtgagaaaaaca

SEQ ID NO: 662572 - DNA, 20 bp, Artificial
  CRISPR gRNA sequence
ttccacagtgagaaaaacat

SEQ ID NO: 662573 - DNA, 20 bp, Artificial
  CRISPR gRNA sequence
tccacagtgagaaaaacatt

SEQ ID NO: 662574 - DNA, 20 bp, Artificial
  CRISPR gRNA sequence
ccacagtgagaaaaacattt

SEQ ID NO: 662575 - DNA, 20 bp, Artificial
  CRISPR gRNA sequence
cacagtgagaaaaacattta

SEQ ID NO: 662576 - DNA, 20 bp, Artificial
  CRISPR gRNA sequence
agagacaattctacaattag

SEQ ID NO: 662577 - DNA, 20 bp, Artificial
  CRISPR gRNA sequence
gagacaattctacaattaga

SEQ ID NO: 662578 - DNA, 20 bp, Artificial
  CRISPR gRNA sequence
tacaattagaattttgtgat

SEQ ID NO: 662579 - DNA, 20 bp, Artificial
  CRISPR gRNA sequence
caattagaattttgtgatac

SEQ ID NO: 662580 - DNA, 20 bp, Artificial
  CRISPR gRNA sequence
gaattttgtgatactaatgg

SEQ ID NO: 662581 - DNA, 20 bp, Artificial
  CRISPR gRNA sequence
tgtgatactaatggaaagtg

SEQ ID NO: 662582 - DNA, 20 bp, Artificial
  CRISPR gRNA sequence
gtgatactaatggaaagtgc

SEQ ID NO: 662583 - DNA, 20 bp, Artificial
  CRISPR gRNA sequence
tgatactaatggaaagtgcg

SEQ ID NO: 662584 - DNA, 20 bp, Artificial
  CRISPR gRNA sequence
atggaaagtgcgtgtatgta

SEQ ID NO: 662585 - DNA, 20 bp, Artificial
  CRISPR gRNA sequence
aaaatgagctatacaatttg

SEQ ID NO: 662586 - DNA, 20 bp, Artificial
  CRISPR gRNA sequence
aaatgagctatacaatttgt

SEQ ID NO: 662587 - DNA, 20 bp, Artificial
  CRISPR gRNA sequence
tacaatttgttgggagttca

SEQ ID NO: 662588 - DNA, 20 bp, Artificial
  CRISPR gRNA sequence
gttgggagttcagtgatccc

SEQ ID NO: 662589 - DNA, 20 bp, Artificial
  CRISPR gRNA sequence
ttgggagttcagtgatccct

SEQ ID NO: 662590 - DNA, 20 bp, Artificial
  CRISPR gRNA sequence
ggagttcagtgatccctcct

SEQ ID NO: 662591 - DNA, 20 bp, Artificial
  CRISPR gRNA sequence
agtgatccctcctttaaaaa

SEQ ID NO: 662592 - DNA, 20 bp, Artificial
  CRISPR gRNA sequence
ctttaaaaactacaactgtg

SEQ ID NO: 662593 - DNA, 20 bp, Artificial
  CRISPR gRNA sequence
taaaaactacaactgtgaag

SEQ ID NO: 662594 - DNA, 20 bp, Artificial
  CRISPR gRNA sequence
aaaaactacaactgtgaagc

SEQ ID NO: 662595 - DNA, 20 bp, Artificial
  CRISPR gRNA sequence
aaaactacaactgtgaagct

SEQ ID NO: 662596 - DNA, 20 bp, Artificial
  CRISPR gRNA sequence
caactgtgaagctataagac

SEQ ID NO: 662597 - DNA, 20 bp, Artificial
  CRISPR gRNA sequence
tgaagctataagacctcaca

SEQ ID NO: 662598 - DNA, 20 bp, Artificial
  CRISPR gRNA sequence
taagacctcacagtgatcat

SEQ ID NO: 662599 - DNA, 20 bp, Artificial
  CRISPR gRNA sequence
acagtgatcatctctttgtt

SEQ ID NO: 662600 - DNA, 20 bp, Artificial
  CRISPR gRNA sequence
tttgttgacataaatgtgat

SEQ ID NO: 662601 - DNA, 20 bp, Artificial
  CRISPR gRNA sequence
tgttgacataaatgtgataa

SEQ ID NO: 662602 - DNA, 20 bp, Artificial
  CRISPR gRNA sequence
gttgacataaatgtgataaa

SEQ ID NO: 662603 - DNA, 20 bp, Artificial
  CRISPR gRNA sequence
ttgacataaatgtgataaac

SEQ ID NO: 662604 - DNA, 20 bp, Artificial
  CRISPR gRNA sequence
acataaatgtgataaacctt

SEQ ID NO: 662605 - DNA, 20 bp, Artificial
  CRISPR gRNA sequence
gcccaagaaatatataattc

SEQ ID NO: 662606 - DNA, 20 bp, Artificial
  CRISPR gRNA sequence
cccaagaaatatataattct

SEQ ID NO: 662607 - DNA, 20 bp, Artificial
  CRISPR gRNA sequence
tttgtttgtcttgctaagcc

SEQ ID NO: 662608 - DNA, 20 bp, Artificial
  CRISPR gRNA sequence
tgtttgtcttgctaagcctt

SEQ ID NO: 662609 - DNA, 20 bp, Artificial
  CRISPR gRNA sequence
gtttgtcttgctaagcctta

SEQ ID NO: 662610 - DNA, 20 bp, Artificial
  CRISPR gRNA sequence
tttgtcttgctaagccttaa

SEQ ID NO: 662611 - DNA, 20 bp, Artificial
  CRISPR gRNA sequence
gtcttgctaagccttaaagt

SEQ ID NO: 662612 - DNA, 20 bp, Artificial
  CRISPR gRNA sequence
tcttgctaagccttaaagtt

SEQ ID NO: 662613 - DNA, 20 bp, Artificial
  CRISPR gRNA sequence
gctaagccttaaagttctca

SEQ ID NO: 662614 - DNA, 20 bp, Artificial
  CRISPR gRNA sequence
ctaagccttaaagttctcat

SEQ ID NO: 662615 - DNA, 20 bp, Artificial
  CRISPR gRNA sequence
agccttaaagttctcatggg

SEQ ID NO: 662616 - DNA, 20 bp, Artificial
  CRISPR gRNA sequence
aaagttctcatgggcaaggg

SEQ ID NO: 662617 - DNA, 20 bp, Artificial
  CRISPR gRNA sequence
aagttctcatgggcaaggga

SEQ ID NO: 662618 - DNA, 20 bp, Artificial
  CRISPR gRNA sequence
tcatgggcaagggatgagaa

SEQ ID NO: 662619 - DNA, 20 bp, Artificial
  CRISPR gRNA sequence
atgggcaagggatgagaaag

SEQ ID NO: 662620 - DNA, 20 bp, Artificial
  CRISPR gRNA sequence
ctgaggactattattttttt

SEQ ID NO: 662621 - DNA, 20 bp, Artificial
  CRISPR gRNA sequence
tgaggactattatttttttt

SEQ ID NO: 662622 - DNA, 20 bp, Artificial
  CRISPR gRNA sequence
aggactattattttttttgt

SEQ ID NO: 662623 - DNA, 20 bp, Artificial
  CRISPR gRNA sequence
ttattttttttgtcttgtgt

SEQ ID NO: 662624 - DNA, 20 bp, Artificial
  CRISPR gRNA sequence
ttttttttgtcttgtgttaa

SEQ ID NO: 662625 - DNA, 20 bp, Artificial
  CRISPR gRNA sequence
tttttgtcttgtgttaacag

SEQ ID NO: 662626 - DNA, 20 bp, Artificial
  CRISPR gRNA sequence
ttttgtcttgtgttaacagc

SEQ ID NO: 662627 - DNA, 20 bp, Artificial
  CRISPR gRNA sequence
tttgtcttgtgttaacagcc

SEQ ID NO: 662628 - DNA, 20 bp, Artificial
  CRISPR gRNA sequence
ttgtcttgtgttaacagcct

SEQ ID NO: 662629 - DNA, 20 bp, Artificial
  CRISPR gRNA sequence
tgtcttgtgttaacagcctg

SEQ ID NO: 662630 - DNA, 20 bp, Artificial
  CRISPR gRNA sequence
gtcttgtgttaacagcctga

SEQ ID NO: 662631 - DNA, 20 bp, Artificial
  CRISPR gRNA sequence
tcttgtgttaacagcctgag

SEQ ID NO: 662632 - DNA, 20 bp, Artificial
  CRISPR gRNA sequence
gtgttaacagcctgagtgct

SEQ ID NO: 662633 - DNA, 20 bp, Artificial
  CRISPR gRNA sequence
tgttaacagcctgagtgctt

SEQ ID NO: 662634 - DNA, 20 bp, Artificial
  CRISPR gRNA sequence
acagcctgagtgctttgtga

SEQ ID NO: 662635 - DNA, 20 bp, Artificial
  CRISPR gRNA sequence
agtgctttgtgatggtcttt

SEQ ID NO: 662636 - DNA, 20 bp, Artificial
  CRISPR gRNA sequence
tgtgatggtctttcactgtg

SEQ ID NO: 662637 - DNA, 20 bp, Artificial
  CRISPR gRNA sequence
gtgatggtctttcactgtgt

SEQ ID NO: 662638 - DNA, 20 bp, Artificial
  CRISPR gRNA sequence
tgatggtctttcactgtgtg

SEQ ID NO: 662639 - DNA, 20 bp, Artificial
  CRISPR gRNA sequence
tcactgtgtgtctgagggaa

SEQ ID NO: 662640 - DNA, 20 bp, Artificial
  CRISPR gRNA sequence
cactgtgtgtctgagggaac

SEQ ID NO: 662641 - DNA, 20 bp, Artificial
  CRISPR gRNA sequence
actgtgtgtctgagggaacc

SEQ ID NO: 662642 - DNA, 20 bp, Artificial
  CRISPR gRNA sequence
tgtgtctgagggaaccctaa

SEQ ID NO: 662643 - DNA, 20 bp, Artificial
  CRISPR gRNA sequence
agggaaccctaagtgttgtt

SEQ ID NO: 662644 - DNA, 20 bp, Artificial
  CRISPR gRNA sequence
agtgttgtttctgactctga

SEQ ID NO: 662645 - DNA, 20 bp, Artificial
  CRISPR gRNA sequence
tttctgactctgagcaggct

SEQ ID NO: 662646 - DNA, 20 bp, Artificial
  CRISPR gRNA sequence
ctgactctgagcaggctaat

SEQ ID NO: 662647 - DNA, 20 bp, Artificial
  CRISPR gRNA sequence
tgactctgagcaggctaatt

SEQ ID NO: 662648 - DNA, 20 bp, Artificial
  CRISPR gRNA sequence
actctgagcaggctaatttg

SEQ ID NO: 662649 - DNA, 20 bp, Artificial
  CRISPR gRNA sequence
tgagcaggctaatttgctca

SEQ ID NO: 662650 - DNA, 20 bp, Artificial
  CRISPR gRNA sequence
agcaggctaatttgctcatc

SEQ ID NO: 662651 - DNA, 20 bp, Artificial
  CRISPR gRNA sequence
atttgctcatcatagacaat

SEQ ID NO: 662652 - DNA, 20 bp, Artificial
  CRISPR gRNA sequence
gctcatcatagacaatggac

SEQ ID NO: 662653 - DNA, 20 bp, Artificial
  CRISPR gRNA sequence
ctcatcatagacaatggacc

SEQ ID NO: 662654 - DNA, 20 bp, Artificial
  CRISPR gRNA sequence
atcatagacaatggacctgt

SEQ ID NO: 662655 - DNA, 20 bp, Artificial
  CRISPR gRNA sequence
ttgacaaacaggtacattct

SEQ ID NO: 662656 - DNA, 20 bp, Artificial
  CRISPR gRNA sequence
acaaacaggtacattctcct

SEQ ID NO: 662657 - DNA, 20 bp, Artificial
  CRISPR gRNA sequence
tccttaccgtgtccttctat

SEQ ID NO: 662658 - DNA, 20 bp, Artificial
  CRISPR gRNA sequence
cttaccgtgtccttctatat

SEQ ID NO: 662659 - DNA, 20 bp, Artificial
  CRISPR gRNA sequence
accgtgtccttctatatgtg

SEQ ID NO: 662660 - DNA, 20 bp, Artificial
  CRISPR gRNA sequence
ccgtgtccttctatatgtga

SEQ ID NO: 662661 - DNA, 20 bp, Artificial
  CRISPR gRNA sequence
ctatatgtgatatagttgat

SEQ ID NO: 662662 - DNA, 20 bp, Artificial
  CRISPR gRNA sequence
tatatgtgatatagttgatt

SEQ ID NO: 662663 - DNA, 20 bp, Artificial
  CRISPR gRNA sequence
tatgtgatatagttgatttc

SEQ ID NO: 662664 - DNA, 20 bp, Artificial
  CRISPR gRNA sequence
atttctaggtttatgatttt

SEQ ID NO: 662665 - DNA, 20 bp, Artificial
  CRISPR gRNA sequence
ctaggtttatgattttcccc

SEQ ID NO: 662666 - DNA, 20 bp, Artificial
  CRISPR gRNA sequence
taggtttatgattttcccca

SEQ ID NO: 662667 - DNA, 20 bp, Artificial
  CRISPR gRNA sequence
ggtttatgattttccccatt

SEQ ID NO: 662668 - DNA, 20 bp, Artificial
  CRISPR gRNA sequence
atgattttccccattataat

SEQ ID NO: 662669 - DNA, 20 bp, Artificial
  CRISPR gRNA sequence
tgattttccccattataatt

SEQ ID NO: 662670 - DNA, 20 bp, Artificial
  CRISPR gRNA sequence
tccccattataattaatcag

SEQ ID NO: 662671 - DNA, 20 bp, Artificial
  CRISPR gRNA sequence
ccccattataattaatcagc

SEQ ID NO: 662672 - DNA, 20 bp, Artificial
  CRISPR gRNA sequence
cccattataattaatcagca

SEQ ID NO: 662673 - DNA, 20 bp, Artificial
  CRISPR gRNA sequence
taattaatcagcagcatgat

SEQ ID NO: 662674 - DNA, 20 bp, Artificial
  CRISPR gRNA sequence
atcagcagcatgatatatct

SEQ ID NO: 662675 - DNA, 20 bp, Artificial
  CRISPR gRNA sequence
ctgtttatcatataatggct

SEQ ID NO: 662676 - DNA, 20 bp, Artificial
  CRISPR gRNA sequence
tttatcatataatggctttc

SEQ ID NO: 662677 - DNA, 20 bp, Artificial
  CRISPR gRNA sequence
atcatataatggctttcttg

SEQ ID NO: 662678 - DNA, 20 bp, Artificial
  CRISPR gRNA sequence
tcatataatggctttcttga

SEQ ID NO: 662679 - DNA, 20 bp, Artificial
  CRISPR gRNA sequence
tcttgatgggtggcataagg

SEQ ID NO: 662680 - DNA, 20 bp, Artificial
  CRISPR gRNA sequence
cttgatgggtggcataagga

SEQ ID NO: 662681 - DNA, 20 bp, Artificial
  CRISPR gRNA sequence
ttgatgggtggcataaggaa

SEQ ID NO: 662682 - DNA, 20 bp, Artificial
  CRISPR gRNA sequence
gatgggtggcataaggaata

SEQ ID NO: 662683 - DNA, 20 bp, Artificial
  CRISPR gRNA sequence
atgggtggcataaggaatat

SEQ ID NO: 662684 - DNA, 20 bp, Artificial
  CRISPR gRNA sequence
taaattaaaattaaaatttt

SEQ ID NO: 662685 - DNA, 20 bp, Artificial
  CRISPR gRNA sequence
aaattaaaattaaaattttt

SEQ ID NO: 662686 - DNA, 20 bp, Artificial
  CRISPR gRNA sequence
aattaaaattaaaatttttt

SEQ ID NO: 662687 - DNA, 20 bp, Artificial
  CRISPR gRNA sequence
aaattaaaatttttttgact

SEQ ID NO: 662688 - DNA, 20 bp, Artificial
  CRISPR gRNA sequence
aaatttttttgacttttgct

SEQ ID NO: 662689 - DNA, 20 bp, Artificial
  CRISPR gRNA sequence
ttttgacttttgctctgaat

SEQ ID NO: 662690 - DNA, 20 bp, Artificial
  CRISPR gRNA sequence
tttgacttttgctctgaatt

SEQ ID NO: 662691 - DNA, 20 bp, Artificial
  CRISPR gRNA sequence
ttgacttttgctctgaattg

SEQ ID NO: 662692 - DNA, 20 bp, Artificial
  CRISPR gRNA sequence
tgacttttgctctgaattgg

SEQ ID NO: 662693 - DNA, 20 bp, Artificial
  CRISPR gRNA sequence
gacttttgctctgaattgga

SEQ ID NO: 662694 - DNA, 20 bp, Artificial
  CRISPR gRNA sequence
acttttgctctgaattggag

SEQ ID NO: 662695 - DNA, 20 bp, Artificial
  CRISPR gRNA sequence
ttgctctgaattggagagat

SEQ ID NO: 662696 - DNA, 20 bp, Artificial
  CRISPR gRNA sequence
tgctctgaattggagagata

SEQ ID NO: 662697 - DNA, 20 bp, Artificial
  CRISPR gRNA sequence
gctctgaattggagagatac

SEQ ID NO: 662698 - DNA, 20 bp, Artificial
  CRISPR gRNA sequence
ctctgaattggagagatact

SEQ ID NO: 662699 - DNA, 20 bp, Artificial
  CRISPR gRNA sequence
tgaattggagagatactttt

SEQ ID NO: 662700 - DNA, 20 bp, Artificial
  CRISPR gRNA sequence
aattggagagatactttttg

SEQ ID NO: 662701 - DNA, 20 bp, Artificial
  CRISPR gRNA sequence
gagagatactttttggtacc

SEQ ID NO: 662702 - DNA, 20 bp, Artificial
  CRISPR gRNA sequence
tttggtacctttgctcaaga

SEQ ID NO: 662703 - DNA, 20 bp, Artificial
  CRISPR gRNA sequence
ttggtacctttgctcaagat

SEQ ID NO: 662704 - DNA, 20 bp, Artificial
  CRISPR gRNA sequence
tggtacctttgctcaagatt

SEQ ID NO: 662705 - DNA, 20 bp, Artificial
  CRISPR gRNA sequence
ggtacctttgctcaagatta

SEQ ID NO: 662706 - DNA, 20 bp, Artificial
  CRISPR gRNA sequence
gtacctttgctcaagattac

SEQ ID NO: 662707 - DNA, 20 bp, Artificial
  CRISPR gRNA sequence
tgctcaagattacatattaa

SEQ ID NO: 662708 - DNA, 20 bp, Artificial
  CRISPR gRNA sequence
gctcaagattacatattaat

SEQ ID NO: 662709 - DNA, 20 bp, Artificial
  CRISPR gRNA sequence
ctcaagattacatattaatc

SEQ ID NO: 662710 - DNA, 20 bp, Artificial
  CRISPR gRNA sequence
aagattacatattaatcaca

SEQ ID NO: 662711 - DNA, 20 bp, Artificial
  CRISPR gRNA sequence
catattaatcacatgttaaa

SEQ ID NO: 662712 - DNA, 20 bp, Artificial
  CRISPR gRNA sequence
atcacatgttaaatatatgt

SEQ ID NO: 662713 - DNA, 20 bp, Artificial
  CRISPR gRNA sequence
aatatatgtattacttaatg

SEQ ID NO: 662714 - DNA, 20 bp, Artificial
  CRISPR gRNA sequence
cttaatgtgttcatcatagt

SEQ ID NO: 662715 - DNA, 20 bp, Artificial
  CRISPR gRNA sequence
aatgtgttcatcatagtaca

SEQ ID NO: 662716 - DNA, 20 bp, Artificial
  CRISPR gRNA sequence
atgtgttcatcatagtacaa

SEQ ID NO: 662717 - DNA, 20 bp, Artificial
  CRISPR gRNA sequence
atcatagtacaaaatatgaa

SEQ ID NO: 662718 - DNA, 20 bp, Artificial
  CRISPR gRNA sequence
tgagtgagacttgagatgtt

SEQ ID NO: 662719 - DNA, 20 bp, Artificial
  CRISPR gRNA sequence
gagatgtttcacttttagat

SEQ ID NO: 662720 - DNA, 20 bp, Artificial
  CRISPR gRNA sequence
agatgtttcacttttagatt

SEQ ID NO: 662721 - DNA, 20 bp, Artificial
  CRISPR gRNA sequence
cacttttagatttttcaagt

SEQ ID NO: 662722 - DNA, 20 bp, Artificial
  CRISPR gRNA sequence
acttttagatttttcaagtg

SEQ ID NO: 662723 - DNA, 20 bp, Artificial
  CRISPR gRNA sequence
ttagatttttcaagtggcaa

SEQ ID NO: 662724 - DNA, 20 bp, Artificial
  CRISPR gRNA sequence
tagatttttcaagtggcaag

SEQ ID NO: 662725 - DNA, 20 bp, Artificial
  CRISPR gRNA sequence
agatttttcaagtggcaaga

SEQ ID NO: 662726 - DNA, 20 bp, Artificial
  CRISPR gRNA sequence
gatttttcaagtggcaagaa

SEQ ID NO: 662727 - DNA, 20 bp, Artificial
  CRISPR gRNA sequence
ttcaagtggcaagaaacttt

SEQ ID NO: 662728 - DNA, 20 bp, Artificial
  CRISPR gRNA sequence
tcaagtggcaagaaactttt

SEQ ID NO: 662729 - DNA, 20 bp, Artificial
  CRISPR gRNA sequence
caagtggcaagaaactttta

SEQ ID NO: 662730 - DNA, 20 bp, Artificial
  CRISPR gRNA sequence
aagtggcaagaaacttttag

SEQ ID NO: 662731 - DNA, 20 bp, Artificial
  CRISPR gRNA sequence
ttagatatttagtctcagaa

SEQ ID NO: 662732 - DNA, 20 bp, Artificial
  CRISPR gRNA sequence
tagatatttagtctcagaaa

SEQ ID NO: 662733 - DNA, 20 bp, Artificial
  CRISPR gRNA sequence
agatatttagtctcagaaat

SEQ ID NO: 662734 - DNA, 20 bp, Artificial
  CRISPR gRNA sequence
gatatttagtctcagaaatg

SEQ ID NO: 662735 - DNA, 20 bp, Artificial
  CRISPR gRNA sequence
agtctcagaaatggaaaacc

SEQ ID NO: 662736 - DNA, 20 bp, Artificial
  CRISPR gRNA sequence
gtctcagaaatggaaaacct

SEQ ID NO: 662737 - DNA, 20 bp, Artificial
  CRISPR gRNA sequence
agaaatggaaaacctactta

SEQ ID NO: 662738 - DNA, 20 bp, Artificial
  CRISPR gRNA sequence
cttaaaaaacattttttttc

SEQ ID NO: 662739 - DNA, 20 bp, Artificial
  CRISPR gRNA sequence
aaaaaacattttttttcttc

SEQ ID NO: 662740 - DNA, 20 bp, Artificial
  CRISPR gRNA sequence
aaaaacattttttttcttct

SEQ ID NO: 662741 - DNA, 20 bp, Artificial
  CRISPR gRNA sequence
tttttcttcttttcttttct

SEQ ID NO: 662742 - DNA, 20 bp, Artificial
  CRISPR gRNA sequence
ttttcttcttttcttttctt

SEQ ID NO: 662743 - DNA, 20 bp, Artificial
  CRISPR gRNA sequence
tttcttcttttcttttcttt

SEQ ID NO: 662744 - DNA, 20 bp, Artificial
  CRISPR gRNA sequence
ttcttcttttcttttctttt

SEQ ID NO: 662745 - DNA, 20 bp, Artificial
  CRISPR gRNA sequence
tcttcttttcttttcttttt

SEQ ID NO: 662746 - DNA, 20 bp, Artificial
  CRISPR gRNA sequence
cttcttttcttttctttttt

SEQ ID NO: 662747 - DNA, 20 bp, Artificial
  CRISPR gRNA sequence
ttcttttcttttcttttttc

SEQ ID NO: 662748 - DNA, 20 bp, Artificial
  CRISPR gRNA sequence
cttttcttttcttttttctt

SEQ ID NO: 662749 - DNA, 20 bp, Artificial
  CRISPR gRNA sequence
ttttcttttcttttttcttt

SEQ ID NO: 662750 - DNA, 20 bp, Artificial
  CRISPR gRNA sequence
ttcttttcttttttcttttt

SEQ ID NO: 662751 - DNA, 20 bp, Artificial
  CRISPR gRNA sequence
tcttttcttttttctttttt

SEQ ID NO: 662752 - DNA, 20 bp, Artificial
  CRISPR gRNA sequence
cttttcttttttcttttttt

SEQ ID NO: 662753 - DNA, 20 bp, Artificial
  CRISPR gRNA sequence
ttttcttttttctttttttt

SEQ ID NO: 662754 - DNA, 20 bp, Artificial
  CRISPR gRNA sequence
ttcttttttctttttttttt

SEQ ID NO: 662755 - DNA, 20 bp, Artificial
  CRISPR gRNA sequence
tcttttttcttttttttttt

SEQ ID NO: 662756 - DNA, 20 bp, Artificial
  CRISPR gRNA sequence
cttttttctttttttttttt

SEQ ID NO: 662757 - DNA, 20 bp, Artificial
  CRISPR gRNA sequence
ttttttcttttttttttttt

SEQ ID NO: 662758 - DNA, 20 bp, Artificial
  CRISPR gRNA sequence
ttttctttttttttttttta

SEQ ID NO: 662759 - DNA, 20 bp, Artificial
  CRISPR gRNA sequence
tttcttttttttttttttag

SEQ ID NO: 662760 - DNA, 20 bp, Artificial
  CRISPR gRNA sequence
ttcttttttttttttttaga

SEQ ID NO: 662761 - DNA, 20 bp, Artificial
  CRISPR gRNA sequence
tcttttttttttttttagac

SEQ ID NO: 662762 - DNA, 20 bp, Artificial
  CRISPR gRNA sequence
cttttttttttttttagaca

SEQ ID NO: 662763 - DNA, 20 bp, Artificial
  CRISPR gRNA sequence
ttttttttttttttagacag

SEQ ID NO: 662764 - DNA, 20 bp, Artificial
  CRISPR gRNA sequence
ttttttttttttagacaggg

SEQ ID NO: 662765 - DNA, 20 bp, Artificial
  CRISPR gRNA sequence
tttttttttttagacagggt

SEQ ID NO: 662766 - DNA, 20 bp, Artificial
  CRISPR gRNA sequence
ttttttttttagacagggtt

SEQ ID NO: 662767 - DNA, 20 bp, Artificial
  CRISPR gRNA sequence
tttttttttagacagggttt

SEQ ID NO: 662768 - DNA, 20 bp, Artificial
  CRISPR gRNA sequence
ttttttttagacagggtttc

SEQ ID NO: 662769 - DNA, 20 bp, Artificial
  CRISPR gRNA sequence
tttttttagacagggtttcc

SEQ ID NO: 662770 - DNA, 20 bp, Artificial
  CRISPR gRNA sequence
ttttttagacagggtttccc

SEQ ID NO: 662771 - DNA, 20 bp, Artificial
  CRISPR gRNA sequence
tttttagacagggtttccct

SEQ ID NO: 662772 - DNA, 20 bp, Artificial
  CRISPR gRNA sequence
ttttagacagggtttccctc

SEQ ID NO: 662773 - DNA, 20 bp, Artificial
  CRISPR gRNA sequence
tttagacagggtttccctca

SEQ ID NO: 662774 - DNA, 20 bp, Artificial
  CRISPR gRNA sequence
ttagacagggtttccctcac

SEQ ID NO: 662775 - DNA, 20 bp, Artificial
  CRISPR gRNA sequence
tagacagggtttccctcact

SEQ ID NO: 662776 - DNA, 20 bp, Artificial
  CRISPR gRNA sequence
agacagggtttccctcactc

SEQ ID NO: 662777 - DNA, 20 bp, Artificial
  CRISPR gRNA sequence
gacagggtttccctcactct

SEQ ID NO: 662778 - DNA, 20 bp, Artificial
  CRISPR gRNA sequence
ccctcactctgtcgcccagg

SEQ ID NO: 662779 - DNA, 20 bp, Artificial
  CRISPR gRNA sequence
cctcactctgtcgcccaggt

SEQ ID NO: 662780 - DNA, 20 bp, Artificial
  CRISPR gRNA sequence
actctgtcgcccaggttgga

SEQ ID NO: 662781 - DNA, 20 bp, Artificial
  CRISPR gRNA sequence
tgtcgcccaggttggagtgc

SEQ ID NO: 662782 - DNA, 20 bp, Artificial
  CRISPR gRNA sequence
tcgcccaggttggagtgcag

SEQ ID NO: 662783 - DNA, 20 bp, Artificial
  CRISPR gRNA sequence
gagtgcagtggcaccatgat

SEQ ID NO: 662784 - DNA, 20 bp, Artificial
  CRISPR gRNA sequence
atgtggcagcctcgaactcc

SEQ ID NO: 662785 - DNA, 20 bp, Artificial
  CRISPR gRNA sequence
tgtggcagcctcgaactcct

SEQ ID NO: 662786 - DNA, 20 bp, Artificial
  CRISPR gRNA sequence
gaactcctgggctcaagaga

SEQ ID NO: 662787 - DNA, 20 bp, Artificial
  CRISPR gRNA sequence
ctgggctcaagagatcctct

SEQ ID NO: 662788 - DNA, 20 bp, Artificial
  CRISPR gRNA sequence
ggctcaagagatcctctcac

SEQ ID NO: 662789 - DNA, 20 bp, Artificial
  CRISPR gRNA sequence
aagagatcctctcacctcag

SEQ ID NO: 662790 - DNA, 20 bp, Artificial
  CRISPR gRNA sequence
tcacctcagcctctggacta

SEQ ID NO: 662791 - DNA, 20 bp, Artificial
  CRISPR gRNA sequence
acctcagcctctggactagc

SEQ ID NO: 662792 - DNA, 20 bp, Artificial
  CRISPR gRNA sequence
agcctctggactagctgggg

SEQ ID NO: 662793 - DNA, 20 bp, Artificial
  CRISPR gRNA sequence
tggactagctggggctaggg

SEQ ID NO: 662794 - DNA, 20 bp, Artificial
  CRISPR gRNA sequence
gactagctggggctagggac

SEQ ID NO: 662795 - DNA, 20 bp, Artificial
  CRISPR gRNA sequence
gctggggctagggacatgcg

SEQ ID NO: 662796 - DNA, 20 bp, Artificial
  CRISPR gRNA sequence
gggctagggacatgcgccac

SEQ ID NO: 662797 - DNA, 20 bp, Artificial
  CRISPR gRNA sequence
gggacatgcgccaccaccat

SEQ ID NO: 662798 - DNA, 20 bp, Artificial
  CRISPR gRNA sequence
gctaatatctctctagatcc

SEQ ID NO: 662799 - DNA, 20 bp, Artificial
  CRISPR gRNA sequence
atatctctctagatccgagg

SEQ ID NO: 662800 - DNA, 20 bp, Artificial
  CRISPR gRNA sequence
tctagatccgaggtctcact

SEQ ID NO: 662801 - DNA, 20 bp, Artificial
  CRISPR gRNA sequence
tagatccgaggtctcactat

SEQ ID NO: 662802 - DNA, 20 bp, Artificial
  CRISPR gRNA sequence
gatccgaggtctcactatgt

SEQ ID NO: 662803 - DNA, 20 bp, Artificial
  CRISPR gRNA sequence
actatgtctcacaggctggt

SEQ ID NO: 662804 - DNA, 20 bp, Artificial
  CRISPR gRNA sequence
tgtctcacaggctggtctca

SEQ ID NO: 662805 - DNA, 20 bp, Artificial
  CRISPR gRNA sequence
acaggctggtctcaaacact

SEQ ID NO: 662806 - DNA, 20 bp, Artificial
  CRISPR gRNA sequence
gtctcaaacacttgggctca

SEQ ID NO: 662807 - DNA, 20 bp, Artificial
  CRISPR gRNA sequence
aaacacttgggctcaagcga

SEQ ID NO: 662808 - DNA, 20 bp, Artificial
  CRISPR gRNA sequence
gggctcaagcgattctccag

SEQ ID NO: 662809 - DNA, 20 bp, Artificial
  CRISPR gRNA sequence
ggctcaagcgattctccagc

SEQ ID NO: 662810 - DNA, 20 bp, Artificial
  CRISPR gRNA sequence
aagcgattctccagccgcgg

SEQ ID NO: 662811 - DNA, 20 bp, Artificial
  CRISPR gRNA sequence
tccagccgcggcctcccaaa

SEQ ID NO: 662812 - DNA, 20 bp, Artificial
  CRISPR gRNA sequence
cagccgcggcctcccaaagt

SEQ ID NO: 662813 - DNA, 20 bp, Artificial
  CRISPR gRNA sequence
ccaaagtgttgggattatag

SEQ ID NO: 662814 - DNA, 20 bp, Artificial
  CRISPR gRNA sequence
ggattatagacgtgaaccat

SEQ ID NO: 662815 - DNA, 20 bp, Artificial
  CRISPR gRNA sequence
tagacgtgaaccattgtgcc

SEQ ID NO: 662816 - DNA, 20 bp, Artificial
  CRISPR gRNA sequence
tgcctagccatttttttttt

SEQ ID NO: 662817 - DNA, 20 bp, Artificial
  CRISPR gRNA sequence
gccatttttttttttcgtaa

SEQ ID NO: 662818 - DNA, 20 bp, Artificial
  CRISPR gRNA sequence
ttttttttcgtaagagtagt

SEQ ID NO: 662819 - DNA, 20 bp, Artificial
  CRISPR gRNA sequence
tttttttcgtaagagtagtt

SEQ ID NO: 662820 - DNA, 20 bp, Artificial
  CRISPR gRNA sequence
ttttttcgtaagagtagtta

SEQ ID NO: 662821 - DNA, 20 bp, Artificial
  CRISPR gRNA sequence
tttttcgtaagagtagttag

SEQ ID NO: 662822 - DNA, 20 bp, Artificial
  CRISPR gRNA sequence
ttttcgtaagagtagttaga

SEQ ID NO: 662823 - DNA, 20 bp, Artificial
  CRISPR gRNA sequence
tttcgtaagagtagttagac

SEQ ID NO: 662824 - DNA, 20 bp, Artificial
  CRISPR gRNA sequence
ttcgtaagagtagttagacc

SEQ ID NO: 662825 - DNA, 20 bp, Artificial
  CRISPR gRNA sequence
tcgtaagagtagttagacca

SEQ ID NO: 662826 - DNA, 20 bp, Artificial
  CRISPR gRNA sequence
cgtaagagtagttagaccaa

SEQ ID NO: 662827 - DNA, 20 bp, Artificial
  CRISPR gRNA sequence
gtaagagtagttagaccaac

SEQ ID NO: 662828 - DNA, 20 bp, Artificial
  CRISPR gRNA sequence
gaccaactcttcctttaaaa

SEQ ID NO: 662829 - DNA, 20 bp, Artificial
  CRISPR gRNA sequence
ttcctttaaaaaacaggcgc

SEQ ID NO: 662830 - DNA, 20 bp, Artificial
  CRISPR gRNA sequence
cctttaaaaaacaggcgcaa

SEQ ID NO: 662831 - DNA, 20 bp, Artificial
  CRISPR gRNA sequence
ctttaaaaaacaggcgcaag

SEQ ID NO: 662832 - DNA, 20 bp, Artificial
  CRISPR gRNA sequence
taaaaaacaggcgcaaggat

SEQ ID NO: 662833 - DNA, 20 bp, Artificial
  CRISPR gRNA sequence
aaaaaacaggcgcaaggatc

SEQ ID NO: 662834 - DNA, 20 bp, Artificial
  CRISPR gRNA sequence
aaaaacaggcgcaaggatct

SEQ ID NO: 662835 - DNA, 20 bp, Artificial
  CRISPR gRNA sequence
ttaaacagaaaaatagattg

SEQ ID NO: 662836 - DNA, 20 bp, Artificial
  CRISPR gRNA sequence
aaacagaaaaatagattggt

SEQ ID NO: 662837 - DNA, 20 bp, Artificial
  CRISPR gRNA sequence
aacagaaaaatagattggtg

SEQ ID NO: 662838 - DNA, 20 bp, Artificial
  CRISPR gRNA sequence
gtgccgtctttccataattt

SEQ ID NO: 662839 - DNA, 20 bp, Artificial
  CRISPR gRNA sequence
tccataattttcttttcaac

SEQ ID NO: 662840 - DNA, 20 bp, Artificial
  CRISPR gRNA sequence
ccataattttcttttcaacc

SEQ ID NO: 662841 - DNA, 20 bp, Artificial
  CRISPR gRNA sequence
cataattttcttttcaacca

SEQ ID NO: 662842 - DNA, 20 bp, Artificial
  CRISPR gRNA sequence
tcttttcaaccacaaaagag

SEQ ID NO: 662843 - DNA, 20 bp, Artificial
  CRISPR gRNA sequence
cttttcaaccacaaaagaga

SEQ ID NO: 662844 - DNA, 20 bp, Artificial
  CRISPR gRNA sequence
ttttcaaccacaaaagagat

SEQ ID NO: 662845 - DNA, 20 bp, Artificial
  CRISPR gRNA sequence
ttcaaccacaaaagagattt

SEQ ID NO: 662846 - DNA, 20 bp, Artificial
  CRISPR gRNA sequence
tcaaccacaaaagagatttt

SEQ ID NO: 662847 - DNA, 20 bp, Artificial
  CRISPR gRNA sequence
caaccacaaaagagattttt

SEQ ID NO: 662848 - DNA, 20 bp, Artificial
  CRISPR gRNA sequence
aaccacaaaagagatttttt

SEQ ID NO: 662849 - DNA, 20 bp, Artificial
  CRISPR gRNA sequence
ttttaaaaaaagattgattt

SEQ ID NO: 662850 - DNA, 20 bp, Artificial
  CRISPR gRNA sequence
tttaaaaaaagattgatttt

SEQ ID NO: 662851 - DNA, 20 bp, Artificial
  CRISPR gRNA sequence
ttaaaaaaagattgatttta

SEQ ID NO: 662852 - DNA, 20 bp, Artificial
  CRISPR gRNA sequence
taaaaaaagattgattttaa

SEQ ID NO: 662853 - DNA, 20 bp, Artificial
  CRISPR gRNA sequence
aaaaaaagattgattttaaa

SEQ ID NO: 662854 - DNA, 20 bp, Artificial
  CRISPR gRNA sequence
aaaaaagattgattttaaag

SEQ ID NO: 662855 - DNA, 20 bp, Artificial
  CRISPR gRNA sequence
attttaaagatatgtaaata

SEQ ID NO: 662856 - DNA, 20 bp, Artificial
  CRISPR gRNA sequence
taaagatatgtaaatactaa

SEQ ID NO: 662857 - DNA, 20 bp, Artificial
  CRISPR gRNA sequence
aaagatatgtaaatactaat

SEQ ID NO: 662858 - DNA, 20 bp, Artificial
  CRISPR gRNA sequence
aagatatgtaaatactaatt

SEQ ID NO: 662859 - DNA, 20 bp, Artificial
  CRISPR gRNA sequence
attatttggattataattat

SEQ ID NO: 662860 - DNA, 20 bp, Artificial
  CRISPR gRNA sequence
tttggattataattattggt

SEQ ID NO: 662861 - DNA, 20 bp, Artificial
  CRISPR gRNA sequence
ggattataattattggtcat

SEQ ID NO: 662862 - DNA, 20 bp, Artificial
  CRISPR gRNA sequence
gattataattattggtcatt

SEQ ID NO: 662863 - DNA, 20 bp, Artificial
  CRISPR gRNA sequence
taattattggtcattatggt

SEQ ID NO: 662864 - DNA, 20 bp, Artificial
  CRISPR gRNA sequence
ttggtcattatggtaatgcc

SEQ ID NO: 662865 - DNA, 20 bp, Artificial
  CRISPR gRNA sequence
gtcattatggtaatgccttt

SEQ ID NO: 662866 - DNA, 20 bp, Artificial
  CRISPR gRNA sequence
tggtaatgccttttttaaaa

SEQ ID NO: 662867 - DNA, 20 bp, Artificial
  CRISPR gRNA sequence
ttttaaaaagagaaatagct

SEQ ID NO: 662868 - DNA, 20 bp, Artificial
  CRISPR gRNA sequence
tttaaaaagagaaatagcta

SEQ ID NO: 662869 - DNA, 20 bp, Artificial
  CRISPR gRNA sequence
ttaaaaagagaaatagctaa

SEQ ID NO: 662870 - DNA, 20 bp, Artificial
  CRISPR gRNA sequence
taaaaagagaaatagctaat

SEQ ID NO: 662871 - DNA, 20 bp, Artificial
  CRISPR gRNA sequence
aaaaagagaaatagctaatc

SEQ ID NO: 662872 - DNA, 20 bp, Artificial
  CRISPR gRNA sequence
aaaagagaaatagctaatca

SEQ ID NO: 662873 - DNA, 20 bp, Artificial
  CRISPR gRNA sequence
atcatgaagtctgacaattt

SEQ ID NO: 662874 - DNA, 20 bp, Artificial
  CRISPR gRNA sequence
acaatttaaataaagacagt

SEQ ID NO: 662875 - DNA, 20 bp, Artificial
  CRISPR gRNA sequence
aaataaagacagtttaggta

SEQ ID NO: 662876 - DNA, 20 bp, Artificial
  CRISPR gRNA sequence
aataaagacagtttaggtaa

SEQ ID NO: 662877 - DNA, 20 bp, Artificial
  CRISPR gRNA sequence
aggtaaatttatatcttaaa

SEQ ID NO: 662878 - DNA, 20 bp, Artificial
  CRISPR gRNA sequence
ggtaaatttatatcttaaag

SEQ ID NO: 662879 - DNA, 20 bp, Artificial
  CRISPR gRNA sequence
atatcttaaagtgaaaaatg

SEQ ID NO: 662880 - DNA, 20 bp, Artificial
  CRISPR gRNA sequence
tatcttaaagtgaaaaatgg

SEQ ID NO: 662881 - DNA, 20 bp, Artificial
  CRISPR gRNA sequence
aaagtgaaaaatggaatcac

SEQ ID NO: 662882 - DNA, 20 bp, Artificial
  CRISPR gRNA sequence
aagtgaaaaatggaatcact

SEQ ID NO: 662883 - DNA, 20 bp, Artificial
  CRISPR gRNA sequence
aattttgttactatatttta

SEQ ID NO: 662884 - DNA, 20 bp, Artificial
  CRISPR gRNA sequence
attttgttactatattttag

SEQ ID NO: 662885 - DNA, 20 bp, Artificial
  CRISPR gRNA sequence
tgttactatattttaggtca

SEQ ID NO: 662886 - DNA, 20 bp, Artificial
  CRISPR gRNA sequence
gttactatattttaggtcat

SEQ ID NO: 662887 - DNA, 20 bp, Artificial
  CRISPR gRNA sequence
ttactatattttaggtcata

SEQ ID NO: 662888 - DNA, 20 bp, Artificial
  CRISPR gRNA sequence
ctatattttaggtcataaaa

SEQ ID NO: 662889 - DNA, 20 bp, Artificial
  CRISPR gRNA sequence
tattttaggtcataaaaata

SEQ ID NO: 662890 - DNA, 20 bp, Artificial
  CRISPR gRNA sequence
taggtcataaaaatatactg

SEQ ID NO: 662891 - DNA, 20 bp, Artificial
  CRISPR gRNA sequence
aggtcataaaaatatactga

SEQ ID NO: 662892 - DNA, 20 bp, Artificial
  CRISPR gRNA sequence
ggtcataaaaatatactgat

SEQ ID NO: 662893 - DNA, 20 bp, Artificial
  CRISPR gRNA sequence
attgaagaaaacgttttcaa

SEQ ID NO: 662894 - DNA, 20 bp, Artificial
  CRISPR gRNA sequence
aagaaaacgttttcaaacaa

SEQ ID NO: 662895 - DNA, 20 bp, Artificial
  CRISPR gRNA sequence
tcaaacaaattgtacattta

SEQ ID NO: 662896 - DNA, 20 bp, Artificial
  CRISPR gRNA sequence
caaacaaattgtacatttat

SEQ ID NO: 662897 - DNA, 20 bp, Artificial
  CRISPR gRNA sequence
aaacaaattgtacatttatc

SEQ ID NO: 662898 - DNA, 20 bp, Artificial
  CRISPR gRNA sequence
tacatttatcttttgcccaa

SEQ ID NO: 662899 - DNA, 20 bp, Artificial
  CRISPR gRNA sequence
atcttttgcccaagaaatct

SEQ ID NO: 662900 - DNA, 20 bp, Artificial
  CRISPR gRNA sequence
tcttttgcccaagaaatcta

SEQ ID NO: 662901 - DNA, 20 bp, Artificial
  CRISPR gRNA sequence
ttgcccaagaaatctatttt

SEQ ID NO: 662902 - DNA, 20 bp, Artificial
  CRISPR gRNA sequence
tgcccaagaaatctattttt

SEQ ID NO: 662903 - DNA, 20 bp, Artificial
  CRISPR gRNA sequence
gcccaagaaatctattttta

SEQ ID NO: 662904 - DNA, 20 bp, Artificial
  CRISPR gRNA sequence
cccaagaaatctatttttat

SEQ ID NO: 662905 - DNA, 20 bp, Artificial
  CRISPR gRNA sequence
tttttatctgagctaggtaa

SEQ ID NO: 662906 - DNA, 20 bp, Artificial
  CRISPR gRNA sequence
ttatctgagctaggtaaaac

SEQ ID NO: 662907 - DNA, 20 bp, Artificial
  CRISPR gRNA sequence
tatctgagctaggtaaaact

SEQ ID NO: 662908 - DNA, 20 bp, Artificial
  CRISPR gRNA sequence
atctgagctaggtaaaactt

SEQ ID NO: 662909 - DNA, 20 bp, Artificial
  CRISPR gRNA sequence
tctgagctaggtaaaactta

SEQ ID NO: 662910 - DNA, 20 bp, Artificial
  CRISPR gRNA sequence
agctaggtaaaacttaagtc

SEQ ID NO: 662911 - DNA, 20 bp, Artificial
  CRISPR gRNA sequence
ggtaaaacttaagtcagtgt

SEQ ID NO: 662912 - DNA, 20 bp, Artificial
  CRISPR gRNA sequence
aagtcagtgtaaaacaagtt

SEQ ID NO: 662913 - DNA, 20 bp, Artificial
  CRISPR gRNA sequence
agtcagtgtaaaacaagttg

SEQ ID NO: 662914 - DNA, 20 bp, Artificial
  CRISPR gRNA sequence
tttggaaactcttaaatctt

SEQ ID NO: 662915 - DNA, 20 bp, Artificial
  CRISPR gRNA sequence
ggaaactcttaaatcttttt

SEQ ID NO: 662916 - DNA, 20 bp, Artificial
  CRISPR gRNA sequence
gaaactcttaaatctttttg

SEQ ID NO: 662917 - DNA, 20 bp, Artificial
  CRISPR gRNA sequence
ttaaatctttttgaaaacat

SEQ ID NO: 662918 - DNA, 20 bp, Artificial
  CRISPR gRNA sequence
aaatctttttgaaaacatta

SEQ ID NO: 662919 - DNA, 20 bp, Artificial
  CRISPR gRNA sequence
aatctttttgaaaacattac

SEQ ID NO: 662920 - DNA, 20 bp, Artificial
  CRISPR gRNA sequence
tttgaaaacattacagcgaa

SEQ ID NO: 662921 - DNA, 20 bp, Artificial
  CRISPR gRNA sequence
ttgaaaacattacagcgaaa

SEQ ID NO: 662922 - DNA, 20 bp, Artificial
  CRISPR gRNA sequence
tgaaaacattacagcgaaat

SEQ ID NO: 662923 - DNA, 20 bp, Artificial
  CRISPR gRNA sequence
gaaaacattacagcgaaata

SEQ ID NO: 662924 - DNA, 20 bp, Artificial
  CRISPR gRNA sequence
aaaacattacagcgaaataa

SEQ ID NO: 662925 - DNA, 20 bp, Artificial
  CRISPR gRNA sequence
cagcgaaataacaaaagttt

SEQ ID NO: 662926 - DNA, 20 bp, Artificial
  CRISPR gRNA sequence
tccagaagagtctggttaag

SEQ ID NO: 662927 - DNA, 20 bp, Artificial
  CRISPR gRNA sequence
ccagaagagtctggttaagc

SEQ ID NO: 662928 - DNA, 20 bp, Artificial
  CRISPR gRNA sequence
cagaagagtctggttaagca

SEQ ID NO: 662929 - DNA, 20 bp, Artificial
  CRISPR gRNA sequence
gttaagcattgagctagagc

SEQ ID NO: 662930 - DNA, 20 bp, Artificial
  CRISPR gRNA sequence
agcattgagctagagcacag

SEQ ID NO: 662931 - DNA, 20 bp, Artificial
  CRISPR gRNA sequence
agctagagcacagcattttc

SEQ ID NO: 662932 - DNA, 20 bp, Artificial
  CRISPR gRNA sequence
gagcacagcattttcacaag

SEQ ID NO: 662933 - DNA, 20 bp, Artificial
  CRISPR gRNA sequence
tcacaagagaagttttaagc

SEQ ID NO: 662934 - DNA, 20 bp, Artificial
  CRISPR gRNA sequence
cacaagagaagttttaagca

SEQ ID NO: 662935 - DNA, 20 bp, Artificial
  CRISPR gRNA sequence
acaagagaagttttaagcat

SEQ ID NO: 662936 - DNA, 20 bp, Artificial
  CRISPR gRNA sequence
taagcatgatgttaccctat

SEQ ID NO: 662937 - DNA, 20 bp, Artificial
  CRISPR gRNA sequence
aagcatgatgttaccctatc

SEQ ID NO: 662938 - DNA, 20 bp, Artificial
  CRISPR gRNA sequence
agcatgatgttaccctatca

SEQ ID NO: 662939 - DNA, 20 bp, Artificial
  CRISPR gRNA sequence
ccctatcaatagtcgtggct

SEQ ID NO: 662940 - DNA, 20 bp, Artificial
  CRISPR gRNA sequence
tcaatagtcgtggctgaaga

SEQ ID NO: 662941 - DNA, 20 bp, Artificial
  CRISPR gRNA sequence
aagaagttctttgatttttg

SEQ ID NO: 662942 - DNA, 20 bp, Artificial
  CRISPR gRNA sequence
tttgatttttgtttgtttgc

SEQ ID NO: 662943 - DNA, 20 bp, Artificial
  CRISPR gRNA sequence
tgatttttgtttgtttgcag

SEQ ID NO: 662944 - DNA, 20 bp, Artificial
  CRISPR gRNA sequence
gatttttgtttgtttgcaga

SEQ ID NO: 662945 - DNA, 20 bp, Artificial
  CRISPR gRNA sequence
atttttgtttgtttgcagaa

SEQ ID NO: 662946 - DNA, 20 bp, Artificial
  CRISPR gRNA sequence
ttgtttgtttgcagaattct

SEQ ID NO: 662947 - DNA, 20 bp, Artificial
  CRISPR gRNA sequence
tgtttgtttgcagaattctg

SEQ ID NO: 662948 - DNA, 20 bp, Artificial
  CRISPR gRNA sequence
gtttgtttgcagaattctga

SEQ ID NO: 662949 - DNA, 20 bp, Artificial
  CRISPR gRNA sequence
tttgtttgcagaattctgat

SEQ ID NO: 662950 - DNA, 20 bp, Artificial
  CRISPR gRNA sequence
gtttgcagaattctgatttg

SEQ ID NO: 662951 - DNA, 20 bp, Artificial
  CRISPR gRNA sequence
tttgcagaattctgatttgt

SEQ ID NO: 662952 - DNA, 20 bp, Artificial
  CRISPR gRNA sequence
gcagaattctgatttgtagc

SEQ ID NO: 662953 - DNA, 20 bp, Artificial
  CRISPR gRNA sequence
cagaattctgatttgtagca

SEQ ID NO: 662954 - DNA, 20 bp, Artificial
  CRISPR gRNA sequence
tgatttgtagcatttgataa

SEQ ID NO: 662955 - DNA, 20 bp, Artificial
  CRISPR gRNA sequence
atttgtagcatttgataatc

SEQ ID NO: 662956 - DNA, 20 bp, Artificial
  CRISPR gRNA sequence
gtagcatttgataatcacaa

SEQ ID NO: 662957 - DNA, 20 bp, Artificial
  CRISPR gRNA sequence
tagcatttgataatcacaaa

SEQ ID NO: 662958 - DNA, 20 bp, Artificial
  CRISPR gRNA sequence
gataatcacaaatttaaaaa

SEQ ID NO: 662959 - DNA, 20 bp, Artificial
  CRISPR gRNA sequence
ataatcacaaatttaaaaag

SEQ ID NO: 662960 - DNA, 20 bp, Artificial
  CRISPR gRNA sequence
aaaaaggatctttgcacttg

SEQ ID NO: 662961 - DNA, 20 bp, Artificial
  CRISPR gRNA sequence
aaaaggatctttgcacttgt

SEQ ID NO: 662962 - DNA, 20 bp, Artificial
  CRISPR gRNA sequence
tgcacttgtgttttgatttt

SEQ ID NO: 662963 - DNA, 20 bp, Artificial
  CRISPR gRNA sequence
gcacttgtgttttgattttg

SEQ ID NO: 662964 - DNA, 20 bp, Artificial
  CRISPR gRNA sequence
cacttgtgttttgattttgg

SEQ ID NO: 662965 - DNA, 20 bp, Artificial
  CRISPR gRNA sequence
gtgttttgattttggtcaca

SEQ ID NO: 662966 - DNA, 20 bp, Artificial
  CRISPR gRNA sequence
tgttttgattttggtcacaa

SEQ ID NO: 662967 - DNA, 20 bp, Artificial
  CRISPR gRNA sequence
tgattttggtcacaatttta

SEQ ID NO: 662968 - DNA, 20 bp, Artificial
  CRISPR gRNA sequence
gattttggtcacaattttat

SEQ ID NO: 662969 - DNA, 20 bp, Artificial
  CRISPR gRNA sequence
attttggtcacaattttata

SEQ ID NO: 662970 - DNA, 20 bp, Artificial
  CRISPR gRNA sequence
tggtcacaattttataaatt

SEQ ID NO: 662971 - DNA, 20 bp, Artificial
  CRISPR gRNA sequence
ggtcacaattttataaattg

SEQ ID NO: 662972 - DNA, 20 bp, Artificial
  CRISPR gRNA sequence
gtcacaattttataaattgg

SEQ ID NO: 662973 - DNA, 20 bp, Artificial
  CRISPR gRNA sequence
tataaattggtatgtttcga

SEQ ID NO: 662974 - DNA, 20 bp, Artificial
  CRISPR gRNA sequence
ataaattggtatgtttcgat

SEQ ID NO: 662975 - DNA, 20 bp, Artificial
  CRISPR gRNA sequence
taaattggtatgtttcgatg

SEQ ID NO: 662976 - DNA, 20 bp, Artificial
  CRISPR gRNA sequence
gtatgtttcgatgtttttgt

SEQ ID NO: 662977 - DNA, 20 bp, Artificial
  CRISPR gRNA sequence
cgatgtttttgttaggaaaa

SEQ ID NO: 662978 - DNA, 20 bp, Artificial
  CRISPR gRNA sequence
gatgtttttgttaggaaaaa

SEQ ID NO: 662979 - DNA, 20 bp, Artificial
  CRISPR gRNA sequence
ttgttaggaaaaaaatgtaa

SEQ ID NO: 662980 - DNA, 20 bp, Artificial
  CRISPR gRNA sequence
tgttaggaaaaaaatgtaat

SEQ ID NO: 662981 - DNA, 20 bp, Artificial
  CRISPR gRNA sequence
gttaggaaaaaaatgtaata

SEQ ID NO: 662982 - DNA, 20 bp, Artificial
  CRISPR gRNA sequence
ttaggaaaaaaatgtaatat

SEQ ID NO: 662983 - DNA, 20 bp, Artificial
  CRISPR gRNA sequence
ggaaaaaaatgtaatatact

SEQ ID NO: 662984 - DNA, 20 bp, Artificial
  CRISPR gRNA sequence
acataccaccccccccttcc

SEQ ID NO: 662985 - DNA, 20 bp, Artificial
  CRISPR gRNA sequence
ccccccccacacactacact

SEQ ID NO: 662986 - DNA, 20 bp, Artificial
  CRISPR gRNA sequence
cccccccacacactacactt

SEQ ID NO: 662987 - DNA, 20 bp, Artificial
  CRISPR gRNA sequence
cacttctttaaatacgccag

SEQ ID NO: 662988 - DNA, 20 bp, Artificial
  CRISPR gRNA sequence
ctttaaatacgccagataaa

SEQ ID NO: 662989 - DNA, 20 bp, Artificial
  CRISPR gRNA sequence
tttaaatacgccagataaaa

SEQ ID NO: 662990 - DNA, 20 bp, Artificial
  CRISPR gRNA sequence
taaatacgccagataaaatc

SEQ ID NO: 662991 - DNA, 20 bp, Artificial
  CRISPR gRNA sequence
aaatacgccagataaaatca

SEQ ID NO: 662992 - DNA, 20 bp, Artificial
  CRISPR gRNA sequence
aatacgccagataaaatcat

SEQ ID NO: 662993 - DNA, 20 bp, Artificial
  CRISPR gRNA sequence
aatcaagctttttgggaatg

SEQ ID NO: 662994 - DNA, 20 bp, Artificial
  CRISPR gRNA sequence
atcaagctttttgggaatgt

SEQ ID NO: 662995 - DNA, 20 bp, Artificial
  CRISPR gRNA sequence
tttgggaatgtttgagtgtg

SEQ ID NO: 662996 - DNA, 20 bp, Artificial
  CRISPR gRNA sequence
ttgggaatgtttgagtgtgt

SEQ ID NO: 662997 - DNA, 20 bp, Artificial
  CRISPR gRNA sequence
tgggaatgtttgagtgtgtc

SEQ ID NO: 662998 - DNA, 20 bp, Artificial
  CRISPR gRNA sequence
gggaatgtttgagtgtgtca

SEQ ID NO: 662999 - DNA, 20 bp, Artificial
  CRISPR gRNA sequence
ggaatgtttgagtgtgtcag

SEQ ID NO: 663000 - DNA, 20 bp, Artificial
  CRISPR gRNA sequence
gagtgtgtcagaggtgacgt

SEQ ID NO: 663001 - DNA, 20 bp, Artificial
  CRISPR gRNA sequence
agtgtgtcagaggtgacgta

SEQ ID NO: 663002 - DNA, 20 bp, Artificial
  CRISPR gRNA sequence
tgtatagacaaaggtaagag

SEQ ID NO: 663003 - DNA, 20 bp, Artificial
  CRISPR gRNA sequence
ctgcactgtatgtgcatgtg

SEQ ID NO: 663004 - DNA, 20 bp, Artificial
  CRISPR gRNA sequence
cactgtatgtgcatgtgtgt

SEQ ID NO: 663005 - DNA, 20 bp, Artificial
  CRISPR gRNA sequence
tatgtgcatgtgtgtttttc

SEQ ID NO: 663006 - DNA, 20 bp, Artificial
  CRISPR gRNA sequence
ttcctttgctctaatggtat

SEQ ID NO: 663007 - DNA, 20 bp, Artificial
  CRISPR gRNA sequence
tcctttgctctaatggtatt

SEQ ID NO: 663008 - DNA, 20 bp, Artificial
  CRISPR gRNA sequence
cctttgctctaatggtattc

SEQ ID NO: 663009 - DNA, 20 bp, Artificial
  CRISPR gRNA sequence
ctttgctctaatggtattcc

SEQ ID NO: 663010 - DNA, 20 bp, Artificial
  CRISPR gRNA sequence
tgctctaatggtattcctcc

SEQ ID NO: 663011 - DNA, 20 bp, Artificial
  CRISPR gRNA sequence
gctctaatggtattcctccc

SEQ ID NO: 663012 - DNA, 20 bp, Artificial
  CRISPR gRNA sequence
ctctaatggtattcctccct

SEQ ID NO: 663013 - DNA, 20 bp, Artificial
  CRISPR gRNA sequence
taatggtattcctcccttcc

SEQ ID NO: 663014 - DNA, 20 bp, Artificial
  CRISPR gRNA sequence
atggtattcctcccttcccc

SEQ ID NO: 663015 - DNA, 20 bp, Artificial
  CRISPR gRNA sequence
ctcccttcccccaaaacctc

SEQ ID NO: 663016 - DNA, 20 bp, Artificial
  CRISPR gRNA sequence
ccttcccccaaaacctctgg

SEQ ID NO: 663017 - DNA, 20 bp, Artificial
  CRISPR gRNA sequence
cccccaaaacctctggtgta

SEQ ID NO: 663018 - DNA, 20 bp, Artificial
  CRISPR gRNA sequence
ccccaaaacctctggtgtat

SEQ ID NO: 663019 - DNA, 20 bp, Artificial
  CRISPR gRNA sequence
tggtgtattttcactaataa

SEQ ID NO: 663020 - DNA, 20 bp, Artificial
  CRISPR gRNA sequence
gtgtattttcactaataatg

SEQ ID NO: 663021 - DNA, 20 bp, Artificial
  CRISPR gRNA sequence
tcactaataatgatgtcagg

SEQ ID NO: 663022 - DNA, 20 bp, Artificial
  CRISPR gRNA sequence
cactaataatgatgtcaggt

SEQ ID NO: 663023 - DNA, 20 bp, Artificial
  CRISPR gRNA sequence
actaataatgatgtcaggtt

SEQ ID NO: 663024 - DNA, 20 bp, Artificial
  CRISPR gRNA sequence
ataatgatgtcaggttaggt

SEQ ID NO: 663025 - DNA, 20 bp, Artificial
  CRISPR gRNA sequence
ggtacttttgggaacagttg

SEQ ID NO: 663026 - DNA, 20 bp, Artificial
  CRISPR gRNA sequence
ttgggaacagttggaaagga

SEQ ID NO: 663027 - DNA, 20 bp, Artificial
  CRISPR gRNA sequence
tgggaacagttggaaaggaa

SEQ ID NO: 663028 - DNA, 20 bp, Artificial
  CRISPR gRNA sequence
gggaacagttggaaaggaaa

SEQ ID NO: 663029 - DNA, 20 bp, Artificial
  CRISPR gRNA sequence
ggaacagttggaaaggaaaa

SEQ ID NO: 663030 - DNA, 20 bp, Artificial
  CRISPR gRNA sequence
gaaaggaaaacagcaaggga

SEQ ID NO: 663031 - DNA, 20 bp, Artificial
  CRISPR gRNA sequence
gatcttcgggctatgattgg

SEQ ID NO: 663032 - DNA, 20 bp, Artificial
  CRISPR gRNA sequence
cgggctatgattgggaggga

SEQ ID NO: 663033 - DNA, 20 bp, Artificial
  CRISPR gRNA sequence
gggctatgattgggagggaa

SEQ ID NO: 663034 - DNA, 20 bp, Artificial
  CRISPR gRNA sequence
tgattgggagggaaggcagt

SEQ ID NO: 663035 - DNA, 20 bp, Artificial
  CRISPR gRNA sequence
ggagggaaggcagtctaggg

SEQ ID NO: 663036 - DNA, 20 bp, Artificial
  CRISPR gRNA sequence
gggaactggtttctgtgggt

SEQ ID NO: 663037 - DNA, 20 bp, Artificial
  CRISPR gRNA sequence
gtttctgtgggtagctcatg

SEQ ID NO: 663038 - DNA, 20 bp, Artificial
  CRISPR gRNA sequence
ctgtgggtagctcatgaggg

SEQ ID NO: 663039 - DNA, 20 bp, Artificial
  CRISPR gRNA sequence
tgtgggtagctcatgaggga

SEQ ID NO: 663040 - DNA, 20 bp, Artificial
  CRISPR gRNA sequence
tgggtagctcatgagggaga

SEQ ID NO: 663041 - DNA, 20 bp, Artificial
  CRISPR gRNA sequence
atgagggagagctttgcagt

SEQ ID NO: 663042 - DNA, 20 bp, Artificial
  CRISPR gRNA sequence
tgcagtagaagaggagtcaa

SEQ ID NO: 663043 - DNA, 20 bp, Artificial
  CRISPR gRNA sequence
gcagtagaagaggagtcaaa

SEQ ID NO: 663044 - DNA, 20 bp, Artificial
  CRISPR gRNA sequence
cagtagaagaggagtcaaac

SEQ ID NO: 663045 - DNA, 20 bp, Artificial
  CRISPR gRNA sequence
ttgggagggtcaggggaata

SEQ ID NO: 663046 - DNA, 20 bp, Artificial
  CRISPR gRNA sequence
tgggagggtcaggggaataa

SEQ ID NO: 663047 - DNA, 20 bp, Artificial
  CRISPR gRNA sequence
gggagggtcaggggaataaa

SEQ ID NO: 663048 - DNA, 20 bp, Artificial
  CRISPR gRNA sequence
ggagggtcaggggaataaat

SEQ ID NO: 663049 - DNA, 20 bp, Artificial
  CRISPR gRNA sequence
gacatttcagggagtccctg

SEQ ID NO: 663050 - DNA, 20 bp, Artificial
  CRISPR gRNA sequence
cagggagtccctggaattga

SEQ ID NO: 663051 - DNA, 20 bp, Artificial
  CRISPR gRNA sequence
agggagtccctggaattgaa

SEQ ID NO: 663052 - DNA, 20 bp, Artificial
  CRISPR gRNA sequence
gaattgaaagaagcagtcaa

SEQ ID NO: 663053 - DNA, 20 bp, Artificial
  CRISPR gRNA sequence
aaagaagcagtcaaagcatt

SEQ ID NO: 663054 - DNA, 20 bp, Artificial
  CRISPR gRNA sequence
agggaagtctttttgacact

SEQ ID NO: 663055 - DNA, 20 bp, Artificial
  CRISPR gRNA sequence
tttgacactactcaaaggaa

SEQ ID NO: 663056 - DNA, 20 bp, Artificial
  CRISPR gRNA sequence
ttgacactactcaaaggaag

SEQ ID NO: 663057 - DNA, 20 bp, Artificial
  CRISPR gRNA sequence
tgacactactcaaaggaagc

SEQ ID NO: 663058 - DNA, 20 bp, Artificial
  CRISPR gRNA sequence
gacactactcaaaggaagcc

SEQ ID NO: 663059 - DNA, 20 bp, Artificial
  CRISPR gRNA sequence
acactactcaaaggaagcca

SEQ ID NO: 663060 - DNA, 20 bp, Artificial
  CRISPR gRNA sequence
ctcaaaggaagccagtgagg

SEQ ID NO: 663061 - DNA, 20 bp, Artificial
  CRISPR gRNA sequence
aaaggaagccagtgagggaa

SEQ ID NO: 663062 - DNA, 20 bp, Artificial
  CRISPR gRNA sequence
ctttgagaaaattctgggat

SEQ ID NO: 663063 - DNA, 20 bp, Artificial
  CRISPR gRNA sequence
tgagaaaattctgggatagg

SEQ ID NO: 663064 - DNA, 20 bp, Artificial
  CRISPR gRNA sequence
gagaaaattctgggatagga

SEQ ID NO: 663065 - DNA, 20 bp, Artificial
  CRISPR gRNA sequence
agaaaattctgggataggag

SEQ ID NO: 663066 - DNA, 20 bp, Artificial
  CRISPR gRNA sequence
tgggataggagcatgggggc

SEQ ID NO: 663067 - DNA, 20 bp, Artificial
  CRISPR gRNA sequence
ggataggagcatgggggcct

SEQ ID NO: 663068 - DNA, 20 bp, Artificial
  CRISPR gRNA sequence
ggaggggagggaatctctgg

SEQ ID NO: 663069 - DNA, 20 bp, Artificial
  CRISPR gRNA sequence
tggagtacctttgttgttgg

SEQ ID NO: 663070 - DNA, 20 bp, Artificial
  CRISPR gRNA sequence
gagtacctttgttgttggct

SEQ ID NO: 663071 - DNA, 20 bp, Artificial
  CRISPR gRNA sequence
tgttgttggctccacatagg

SEQ ID NO: 663072 - DNA, 20 bp, Artificial
  CRISPR gRNA sequence
gttgttggctccacataggt

SEQ ID NO: 663073 - DNA, 20 bp, Artificial
  CRISPR gRNA sequence
ttgttggctccacataggtc

SEQ ID NO: 663074 - DNA, 20 bp, Artificial
  CRISPR gRNA sequence
ttggctccacataggtccct

SEQ ID NO: 663075 - DNA, 20 bp, Artificial
  CRISPR gRNA sequence
gctccacataggtccctggt

SEQ ID NO: 663076 - DNA, 20 bp, Artificial
  CRISPR gRNA sequence
cacataggtccctggtgtgt

SEQ ID NO: 663077 - DNA, 20 bp, Artificial
  CRISPR gRNA sequence
gtgtgtgaaaggatctagat

SEQ ID NO: 663078 - DNA, 20 bp, Artificial
  CRISPR gRNA sequence
gataggtgtagttataaatg

SEQ ID NO: 663079 - DNA, 20 bp, Artificial
  CRISPR gRNA sequence
taaatgggttggccctgtaa

SEQ ID NO: 663080 - DNA, 20 bp, Artificial
  CRISPR gRNA sequence
gccctgtaaatctgttcata

SEQ ID NO: 663081 - DNA, 20 bp, Artificial
  CRISPR gRNA sequence
taaatctgttcatatatgtg

SEQ ID NO: 663082 - DNA, 20 bp, Artificial
  CRISPR gRNA sequence
ttcatatatgtgaatgtctt

SEQ ID NO: 663083 - DNA, 20 bp, Artificial
  CRISPR gRNA sequence
atatatgtgaatgtctttct

SEQ ID NO: 663084 - DNA, 20 bp, Artificial
  CRISPR gRNA sequence
tctgatttcctcttcttttt

SEQ ID NO: 663085 - DNA, 20 bp, Artificial
  CRISPR gRNA sequence
ctgatttcctcttcttttta

SEQ ID NO: 663086 - DNA, 20 bp, Artificial
  CRISPR gRNA sequence
tgatttcctcttctttttac

SEQ ID NO: 663087 - DNA, 20 bp, Artificial
  CRISPR gRNA sequence
atttcctcttctttttacat

SEQ ID NO: 663088 - DNA, 20 bp, Artificial
  CRISPR gRNA sequence
cctcttctttttacattctt

SEQ ID NO: 663089 - DNA, 20 bp, Artificial
  CRISPR gRNA sequence
ctcttctttttacattctta

SEQ ID NO: 663090 - DNA, 20 bp, Artificial
  CRISPR gRNA sequence
ttctttttacattcttatct

SEQ ID NO: 663091 - DNA, 20 bp, Artificial
  CRISPR gRNA sequence
ctttttacattcttatctga

SEQ ID NO: 663092 - DNA, 20 bp, Artificial
  CRISPR gRNA sequence
tttttacattcttatctgag

SEQ ID NO: 663093 - DNA, 20 bp, Artificial
  CRISPR gRNA sequence
tttacattcttatctgagta

SEQ ID NO: 663094 - DNA, 20 bp, Artificial
  CRISPR gRNA sequence
ttacattcttatctgagtat

SEQ ID NO: 663095 - DNA, 20 bp, Artificial
  CRISPR gRNA sequence
tacattcttatctgagtatg

SEQ ID NO: 663096 - DNA, 20 bp, Artificial
  CRISPR gRNA sequence
acattcttatctgagtatgg

SEQ ID NO: 663097 - DNA, 20 bp, Artificial
  CRISPR gRNA sequence
cattcttatctgagtatggg

SEQ ID NO: 663098 - DNA, 20 bp, Artificial
  CRISPR gRNA sequence
ttatctgagtatgggaatgg

SEQ ID NO: 663099 - DNA, 20 bp, Artificial
  CRISPR gRNA sequence
atctgagtatgggaatggct

SEQ ID NO: 663100 - DNA, 20 bp, Artificial
  CRISPR gRNA sequence
tctgagtatgggaatggctg

SEQ ID NO: 663101 - DNA, 20 bp, Artificial
  CRISPR gRNA sequence
agtatgggaatggctgaagg

SEQ ID NO: 663102 - DNA, 20 bp, Artificial
  CRISPR gRNA sequence
aaggctttattgctatctgt

SEQ ID NO: 663103 - DNA, 20 bp, Artificial
  CRISPR gRNA sequence
tattgctatctgtgtgttgc

SEQ ID NO: 663104 - DNA, 20 bp, Artificial
  CRISPR gRNA sequence
attgctatctgtgtgttgca

SEQ ID NO: 663105 - DNA, 20 bp, Artificial
  CRISPR gRNA sequence
ttgctatctgtgtgttgcat

SEQ ID NO: 663106 - DNA, 20 bp, Artificial
  CRISPR gRNA sequence
ctatctgtgtgttgcatgct

SEQ ID NO: 663107 - DNA, 20 bp, Artificial
  CRISPR gRNA sequence
tctgtgtgttgcatgctatg

SEQ ID NO: 663108 - DNA, 20 bp, Artificial
  CRISPR gRNA sequence
tgtgttgcatgctatgtgga

SEQ ID NO: 663109 - DNA, 20 bp, Artificial
  CRISPR gRNA sequence
catgctatgtggatctttta

SEQ ID NO: 663110 - DNA, 20 bp, Artificial
  CRISPR gRNA sequence
tgtggatcttttaaggcgtg

SEQ ID NO: 663111 - DNA, 20 bp, Artificial
  CRISPR gRNA sequence
ttaaggcgtgaccttatcaa

SEQ ID NO: 663112 - DNA, 20 bp, Artificial
  CRISPR gRNA sequence
taaggcgtgaccttatcaaa

SEQ ID NO: 663113 - DNA, 20 bp, Artificial
  CRISPR gRNA sequence
aaggcgtgaccttatcaaag

SEQ ID NO: 663114 - DNA, 20 bp, Artificial
  CRISPR gRNA sequence
aggcgtgaccttatcaaagt

SEQ ID NO: 663115 - DNA, 20 bp, Artificial
  CRISPR gRNA sequence
atcaaagttggcatctaaat

SEQ ID NO: 663116 - DNA, 20 bp, Artificial
  CRISPR gRNA sequence
tcaaagttggcatctaaatg

SEQ ID NO: 663117 - DNA, 20 bp, Artificial
  CRISPR gRNA sequence
gcatctaaatgcaaaagaaa

SEQ ID NO: 663118 - DNA, 20 bp, Artificial
  CRISPR gRNA sequence
aatgcaaaagaaaatgcagg

SEQ ID NO: 663119 - DNA, 20 bp, Artificial
  CRISPR gRNA sequence
gttctagttggggttcctgt

SEQ ID NO: 663120 - DNA, 20 bp, Artificial
  CRISPR gRNA sequence
ttctagttggggttcctgtc

SEQ ID NO: 663121 - DNA, 20 bp, Artificial
  CRISPR gRNA sequence
tagttggggttcctgtcacc

SEQ ID NO: 663122 - DNA, 20 bp, Artificial
  CRISPR gRNA sequence
gttggggttcctgtcaccag

SEQ ID NO: 663123 - DNA, 20 bp, Artificial
  CRISPR gRNA sequence
gggttcctgtcaccagacca

SEQ ID NO: 663124 - DNA, 20 bp, Artificial
  CRISPR gRNA sequence
ctgtcaccagaccatagcaa

SEQ ID NO: 663125 - DNA, 20 bp, Artificial
  CRISPR gRNA sequence
tcaccagaccatagcaattt

SEQ ID NO: 663126 - DNA, 20 bp, Artificial
  CRISPR gRNA sequence
ggaacaatggatacattacc

SEQ ID NO: 663127 - DNA, 20 bp, Artificial
  CRISPR gRNA sequence
gaacaatggatacattacct

SEQ ID NO: 663128 - DNA, 20 bp, Artificial
  CRISPR gRNA sequence
cctgaattcactggcagcaa

SEQ ID NO: 663129 - DNA, 20 bp, Artificial
  CRISPR gRNA sequence
aattcactggcagcaagcag

SEQ ID NO: 663130 - DNA, 20 bp, Artificial
  CRISPR gRNA sequence
actggcagcaagcagagtcc

SEQ ID NO: 663131 - DNA, 20 bp, Artificial
  CRISPR gRNA sequence
gcagcaagcagagtccctgc

SEQ ID NO: 663132 - DNA, 20 bp, Artificial
  CRISPR gRNA sequence
cttctatgcgtgcccttatc

SEQ ID NO: 663133 - DNA, 20 bp, Artificial
  CRISPR gRNA sequence
ctatgcgtgcccttatcagt

SEQ ID NO: 663134 - DNA, 20 bp, Artificial
  CRISPR gRNA sequence
tatgcgtgcccttatcagtg

SEQ ID NO: 663135 - DNA, 20 bp, Artificial
  CRISPR gRNA sequence
tgcgtgcccttatcagtgtt

SEQ ID NO: 663136 - DNA, 20 bp, Artificial
  CRISPR gRNA sequence
atcagtgtttaaaatagtgc

SEQ ID NO: 663137 - DNA, 20 bp, Artificial
  CRISPR gRNA sequence
tcagtgtttaaaatagtgcc

SEQ ID NO: 663138 - DNA, 20 bp, Artificial
  CRISPR gRNA sequence
aaaatagtgcctcgtactct

SEQ ID NO: 663139 - DNA, 20 bp, Artificial
  CRISPR gRNA sequence
aaatagtgcctcgtactctg

SEQ ID NO: 663140 - DNA, 20 bp, Artificial
  CRISPR gRNA sequence
gtactctgcgtactatctag

SEQ ID NO: 663141 - DNA, 20 bp, Artificial
  CRISPR gRNA sequence
tgcgtactatctagaagaga

SEQ ID NO: 663142 - DNA, 20 bp, Artificial
  CRISPR gRNA sequence
cgtactatctagaagagaac

SEQ ID NO: 663143 - DNA, 20 bp, Artificial
  CRISPR gRNA sequence
tctagaagagaacacctcct

SEQ ID NO: 663144 - DNA, 20 bp, Artificial
  CRISPR gRNA sequence
gaagagaacacctccttccc

SEQ ID NO: 663145 - DNA, 20 bp, Artificial
  CRISPR gRNA sequence
cttcccattctcttcctttc

SEQ ID NO: 663146 - DNA, 20 bp, Artificial
  CRISPR gRNA sequence
cccattctcttcctttccct

SEQ ID NO: 663147 - DNA, 20 bp, Artificial
  CRISPR gRNA sequence
ccattctcttcctttcccta

SEQ ID NO: 663148 - DNA, 20 bp, Artificial
  CRISPR gRNA sequence
tcttcctttccctattcttt

SEQ ID NO: 663149 - DNA, 20 bp, Artificial
  CRISPR gRNA sequence
ttcctttccctattctttat

SEQ ID NO: 663150 - DNA, 20 bp, Artificial
  CRISPR gRNA sequence
cctttccctattctttatta

SEQ ID NO: 663151 - DNA, 20 bp, Artificial
  CRISPR gRNA sequence
ctttccctattctttattaa

SEQ ID NO: 663152 - DNA, 20 bp, Artificial
  CRISPR gRNA sequence
tccctattctttattaatat

SEQ ID NO: 663153 - DNA, 20 bp, Artificial
  CRISPR gRNA sequence
ccctattctttattaatatt

SEQ ID NO: 663154 - DNA, 20 bp, Artificial
  CRISPR gRNA sequence
cctattctttattaatattt

SEQ ID NO: 663155 - DNA, 20 bp, Artificial
  CRISPR gRNA sequence
ttctttattaatattttggg

SEQ ID NO: 663156 - DNA, 20 bp, Artificial
  CRISPR gRNA sequence
tttattaatattttgggggg

SEQ ID NO: 663157 - DNA, 20 bp, Artificial
  CRISPR gRNA sequence
tattaatattttggggggaa

SEQ ID NO: 663158 - DNA, 20 bp, Artificial
  CRISPR gRNA sequence
attaatattttggggggaat

SEQ ID NO: 663159 - DNA, 20 bp, Artificial
  CRISPR gRNA sequence
ttaatattttggggggaatg

SEQ ID NO: 663160 - DNA, 20 bp, Artificial
  CRISPR gRNA sequence
atattttggggggaatgctt

SEQ ID NO: 663161 - DNA, 20 bp, Artificial
  CRISPR gRNA sequence
tggggggaatgctttcattt

SEQ ID NO: 663162 - DNA, 20 bp, Artificial
  CRISPR gRNA sequence
ggggggaatgctttcatttc

SEQ ID NO: 663163 - DNA, 20 bp, Artificial
  CRISPR gRNA sequence
gggggaatgctttcatttca

SEQ ID NO: 663164 - DNA, 20 bp, Artificial
  CRISPR gRNA sequence
tcatttcaatagttagaaaa

SEQ ID NO: 663165 - DNA, 20 bp, Artificial
  CRISPR gRNA sequence
catttcaatagttagaaaat

SEQ ID NO: 663166 - DNA, 20 bp, Artificial
  CRISPR gRNA sequence
atttcaatagttagaaaatg

SEQ ID NO: 663167 - DNA, 20 bp, Artificial
  CRISPR gRNA sequence
caatagttagaaaatgtgga

SEQ ID NO: 663168 - DNA, 20 bp, Artificial
  CRISPR gRNA sequence
aatagttagaaaatgtggaa

SEQ ID NO: 663169 - DNA, 20 bp, Artificial
  CRISPR gRNA sequence
gaaaatgtggaaaaacaaga

SEQ ID NO: 663170 - DNA, 20 bp, Artificial
  CRISPR gRNA sequence
caaggttgaggtgaaagtag

SEQ ID NO: 663171 - DNA, 20 bp, Artificial
  CRISPR gRNA sequence
aggtgaaagtagtacaagat

SEQ ID NO: 663172 - DNA, 20 bp, Artificial
  CRISPR gRNA sequence
gaagaatgaaactctttttt

SEQ ID NO: 663173 - DNA, 20 bp, Artificial
  CRISPR gRNA sequence
ttttttcttcactcagtaaa

SEQ ID NO: 663174 - DNA, 20 bp, Artificial
  CRISPR gRNA sequence
ttttcttcactcagtaaaat

SEQ ID NO: 663175 - DNA, 20 bp, Artificial
  CRISPR gRNA sequence
tttcttcactcagtaaaatg

SEQ ID NO: 663176 - DNA, 20 bp, Artificial
  CRISPR gRNA sequence
ttcttcactcagtaaaatga

SEQ ID NO: 663177 - DNA, 20 bp, Artificial
  CRISPR gRNA sequence
tcttcactcagtaaaatgat

SEQ ID NO: 663178 - DNA, 20 bp, Artificial
  CRISPR gRNA sequence
cttcactcagtaaaatgata

SEQ ID NO: 663179 - DNA, 20 bp, Artificial
  CRISPR gRNA sequence
ttcactcagtaaaatgatac

SEQ ID NO: 663180 - DNA, 20 bp, Artificial
  CRISPR gRNA sequence
cactcagtaaaatgatactt

SEQ ID NO: 663181 - DNA, 20 bp, Artificial
  CRISPR gRNA sequence
actcagtaaaatgatacttt

SEQ ID NO: 663182 - DNA, 20 bp, Artificial
  CRISPR gRNA sequence
agtaaaatgatacttttggc

SEQ ID NO: 663183 - DNA, 20 bp, Artificial
  CRISPR gRNA sequence
ttggctcagtgcctggggaa

SEQ ID NO: 663184 - DNA, 20 bp, Artificial
  CRISPR gRNA sequence
tggctcagtgcctggggaac

SEQ ID NO: 663185 - DNA, 20 bp, Artificial
  CRISPR gRNA sequence
ggctcagtgcctggggaaca

SEQ ID NO: 663186 - DNA, 20 bp, Artificial
  CRISPR gRNA sequence
gctcagtgcctggggaacat

SEQ ID NO: 663187 - DNA, 20 bp, Artificial
  CRISPR gRNA sequence
agtgcctggggaacataggc

SEQ ID NO: 663188 - DNA, 20 bp, Artificial
  CRISPR gRNA sequence
gggaacataggcgagttagg

SEQ ID NO: 663189 - DNA, 20 bp, Artificial
  CRISPR gRNA sequence
ggatggtgcagacaggacta

SEQ ID NO: 663190 - DNA, 20 bp, Artificial
  CRISPR gRNA sequence
gcaacaagtttgttaaggaa

SEQ ID NO: 663191 - DNA, 20 bp, Artificial
  CRISPR gRNA sequence
gttaaggaatgggctgagaa

SEQ ID NO: 663192 - DNA, 20 bp, Artificial
  CRISPR gRNA sequence
ttaaggaatgggctgagaac

SEQ ID NO: 663193 - DNA, 20 bp, Artificial
  CRISPR gRNA sequence
aggaatgggctgagaacccc

SEQ ID NO: 663194 - DNA, 20 bp, Artificial
  CRISPR gRNA sequence
agaaccccttgcctctgccc

SEQ ID NO: 663195 - DNA, 20 bp, Artificial
  CRISPR gRNA sequence
gcctctgccctgtggtttac

SEQ ID NO: 663196 - DNA, 20 bp, Artificial
  CRISPR gRNA sequence
cctctgccctgtggtttact

SEQ ID NO: 663197 - DNA, 20 bp, Artificial
  CRISPR gRNA sequence
tgccctgtggtttactacag

SEQ ID NO: 663198 - DNA, 20 bp, Artificial
  CRISPR gRNA sequence
ccctgtggtttactacagaa

SEQ ID NO: 663199 - DNA, 20 bp, Artificial
  CRISPR gRNA sequence
tggtttactacagaatttga

SEQ ID NO: 663200 - DNA, 20 bp, Artificial
  CRISPR gRNA sequence
actacagaatttgagttgta

SEQ ID NO: 663201 - DNA, 20 bp, Artificial
  CRISPR gRNA sequence
ctacagaatttgagttgtaa

SEQ ID NO: 663202 - DNA, 20 bp, Artificial
  CRISPR gRNA sequence
cagaatttgagttgtaactt

SEQ ID NO: 663203 - DNA, 20 bp, Artificial
  CRISPR gRNA sequence
gagttgtaactttttctttt

SEQ ID NO: 663204 - DNA, 20 bp, Artificial
  CRISPR gRNA sequence
agttgtaactttttcttttt

SEQ ID NO: 663205 - DNA, 20 bp, Artificial
  CRISPR gRNA sequence
taactttttctttttctttt

SEQ ID NO: 663206 - DNA, 20 bp, Artificial
  CRISPR gRNA sequence
tttctttttctttttttttt

SEQ ID NO: 663207 - DNA, 20 bp, Artificial
  CRISPR gRNA sequence
ttctttttcttttttttttt

SEQ ID NO: 663208 - DNA, 20 bp, Artificial
  CRISPR gRNA sequence
tctttttctttttttttttt

SEQ ID NO: 663209 - DNA, 20 bp, Artificial
  CRISPR gRNA sequence
ctttttcttttttttttttt

SEQ ID NO: 663210 - DNA, 20 bp, Artificial
  CRISPR gRNA sequence
tttttctttttttttttttt

SEQ ID NO: 663211 - DNA, 20 bp, Artificial
  CRISPR gRNA sequence
tttctttttttttttttttg

SEQ ID NO: 663212 - DNA, 20 bp, Artificial
  CRISPR gRNA sequence
ttctttttttttttttttgt

SEQ ID NO: 663213 - DNA, 20 bp, Artificial
  CRISPR gRNA sequence
tctttttttttttttttgtc

SEQ ID NO: 663214 - DNA, 20 bp, Artificial
  CRISPR gRNA sequence
ctttttttttttttttgtcc

SEQ ID NO: 663215 - DNA, 20 bp, Artificial
  CRISPR gRNA sequence
tttttttttttttttgtccg

SEQ ID NO: 663216 - DNA, 20 bp, Artificial
  CRISPR gRNA sequence
tttttttttttttgtccgtt

SEQ ID NO: 663217 - DNA, 20 bp, Artificial
  CRISPR gRNA sequence
ttttttttttttgtccgtta

SEQ ID NO: 663218 - DNA, 20 bp, Artificial
  CRISPR gRNA sequence
tttttttttttgtccgttag

SEQ ID NO: 663219 - DNA, 20 bp, Artificial
  CRISPR gRNA sequence
ttttttttttgtccgttaga

SEQ ID NO: 663220 - DNA, 20 bp, Artificial
  CRISPR gRNA sequence
tttttttttgtccgttagaa

SEQ ID NO: 663221 - DNA, 20 bp, Artificial
  CRISPR gRNA sequence
ttttttttgtccgttagaag

SEQ ID NO: 663222 - DNA, 20 bp, Artificial
  CRISPR gRNA sequence
tttttttgtccgttagaagc

SEQ ID NO: 663223 - DNA, 20 bp, Artificial
  CRISPR gRNA sequence
ttttttgtccgttagaagca

SEQ ID NO: 663224 - DNA, 20 bp, Artificial
  CRISPR gRNA sequence
tttttgtccgttagaagcag

SEQ ID NO: 663225 - DNA, 20 bp, Artificial
  CRISPR gRNA sequence
ttttgtccgttagaagcagt

SEQ ID NO: 663226 - DNA, 20 bp, Artificial
  CRISPR gRNA sequence
tttgtccgttagaagcagtg

SEQ ID NO: 663227 - DNA, 20 bp, Artificial
  CRISPR gRNA sequence
ttgtccgttagaagcagtgg

SEQ ID NO: 663228 - DNA, 20 bp, Artificial
  CRISPR gRNA sequence
tgtccgttagaagcagtggt

SEQ ID NO: 663229 - DNA, 20 bp, Artificial
  CRISPR gRNA sequence
gtccgttagaagcagtggta

SEQ ID NO: 663230 - DNA, 20 bp, Artificial
  CRISPR gRNA sequence
tccgttagaagcagtggtag

SEQ ID NO: 663231 - DNA, 20 bp, Artificial
  CRISPR gRNA sequence
gaagcagtggtagagagatt

SEQ ID NO: 663232 - DNA, 20 bp, Artificial
  CRISPR gRNA sequence
cacactaagctttaaaacca

SEQ ID NO: 663233 - DNA, 20 bp, Artificial
  CRISPR gRNA sequence
agctttaaaaccacagcaaa

SEQ ID NO: 663234 - DNA, 20 bp, Artificial
  CRISPR gRNA sequence
taaaaccacagcaaaacaaa

SEQ ID NO: 663235 - DNA, 20 bp, Artificial
  CRISPR gRNA sequence
aaaaccacagcaaaacaaaa

SEQ ID NO: 663236 - DNA, 20 bp, Artificial
  CRISPR gRNA sequence
aaaccacagcaaaacaaaac

SEQ ID NO: 663237 - DNA, 20 bp, Artificial
  CRISPR gRNA sequence
ttaaaacacttgtgcggtaa

SEQ ID NO: 663238 - DNA, 20 bp, Artificial
  CRISPR gRNA sequence
taaaacacttgtgcggtaac

SEQ ID NO: 663239 - DNA, 20 bp, Artificial
  CRISPR gRNA sequence
aaaacacttgtgcggtaacc

SEQ ID NO: 663240 - DNA, 20 bp, Artificial
  CRISPR gRNA sequence
aaacacttgtgcggtaacct

SEQ ID NO: 663241 - DNA, 20 bp, Artificial
  CRISPR gRNA sequence
gtgcggtaacctcagaagac

SEQ ID NO: 663242 - DNA, 20 bp, Artificial
  CRISPR gRNA sequence
tgcggtaacctcagaagaca

SEQ ID NO: 663243 - DNA, 20 bp, Artificial
  CRISPR gRNA sequence
agaagacaggttaacacatt

SEQ ID NO: 663244 - DNA, 20 bp, Artificial
  CRISPR gRNA sequence
acacattctgttttaactgt

SEQ ID NO: 663245 - DNA, 20 bp, Artificial
  CRISPR gRNA sequence
tgttttaactgtactattaa

SEQ ID NO: 663246 - DNA, 20 bp, Artificial
  CRISPR gRNA sequence
ttttaactgtactattaatg

SEQ ID NO: 663247 - DNA, 20 bp, Artificial
  CRISPR gRNA sequence
taactgtactattaatgtgt

SEQ ID NO: 663248 - DNA, 20 bp, Artificial
  CRISPR gRNA sequence
aactgtactattaatgtgtt

SEQ ID NO: 663249 - DNA, 20 bp, Artificial
  CRISPR gRNA sequence
actgtactattaatgtgttt

SEQ ID NO: 663250 - DNA, 20 bp, Artificial
  CRISPR gRNA sequence
tactattaatgtgttttgca

SEQ ID NO: 663251 - DNA, 20 bp, Artificial
  CRISPR gRNA sequence
ttaatgtgttttgcaagttt

SEQ ID NO: 663252 - DNA, 20 bp, Artificial
  CRISPR gRNA sequence
atgtgttttgcaagtttgca

SEQ ID NO: 663253 - DNA, 20 bp, Artificial
  CRISPR gRNA sequence
tgcaagtttgcaatacctct

SEQ ID NO: 663254 - DNA, 20 bp, Artificial
  CRISPR gRNA sequence
gcaagtttgcaatacctcta

SEQ ID NO: 663255 - DNA, 20 bp, Artificial
  CRISPR gRNA sequence
caagtttgcaatacctctag

SEQ ID NO: 663256 - DNA, 20 bp, Artificial
  CRISPR gRNA sequence
gcaatacctctagacatgga

SEQ ID NO: 663257 - DNA, 20 bp, Artificial
  CRISPR gRNA sequence
caatacctctagacatggag

SEQ ID NO: 663258 - DNA, 20 bp, Artificial
  CRISPR gRNA sequence
tagacatggaggtctttttc

SEQ ID NO: 663259 - DNA, 20 bp, Artificial
  CRISPR gRNA sequence
gacatggaggtctttttccc

SEQ ID NO: 663260 - DNA, 20 bp, Artificial
  CRISPR gRNA sequence
tttcccccttacattttatg

SEQ ID NO: 663261 - DNA, 20 bp, Artificial
  CRISPR gRNA sequence
ttcccccttacattttatgt

SEQ ID NO: 663262 - DNA, 20 bp, Artificial
  CRISPR gRNA sequence
tcccccttacattttatgta

SEQ ID NO: 663263 - DNA, 20 bp, Artificial
  CRISPR gRNA sequence
cccccttacattttatgtat

SEQ ID NO: 663264 - DNA, 20 bp, Artificial
  CRISPR gRNA sequence
ccccttacattttatgtata

SEQ ID NO: 663265 - DNA, 20 bp, Artificial
  CRISPR gRNA sequence
acattttatgtatactgcaa

SEQ ID NO: 663266 - DNA, 20 bp, Artificial
  CRISPR gRNA sequence
cattttatgtatactgcaaa

SEQ ID NO: 663267 - DNA, 20 bp, Artificial
  CRISPR gRNA sequence
tatgtatactgcaaatcgaa

SEQ ID NO: 663268 - DNA, 20 bp, Artificial
  CRISPR gRNA sequence
atgtatactgcaaatcgaat

SEQ ID NO: 663269 - DNA, 20 bp, Artificial
  CRISPR gRNA sequence
tgtatactgcaaatcgaatc

SEQ ID NO: 663270 - DNA, 20 bp, Artificial
  CRISPR gRNA sequence
caaatcgaatccgaggtgtg

SEQ ID NO: 663271 - DNA, 20 bp, Artificial
  CRISPR gRNA sequence
gtgagcattaaaataatgaa

SEQ ID NO: 663272 - DNA, 20 bp, Artificial
  CRISPR gRNA sequence
tgagcattaaaataatgaaa

SEQ ID NO: 663273 - DNA, 20 bp, Artificial
  CRISPR gRNA sequence
aaataatgaaaacaaaacac

SEQ ID NO: 663274 - DNA, 20 bp, Artificial
  CRISPR gRNA sequence
tatccaggaaatatataatt

SEQ ID NO: 663275 - DNA, 20 bp, Artificial
  CRISPR gRNA sequence
atccaggaaatatataattc

SEQ ID NO: 663276 - DNA, 20 bp, Artificial
  CRISPR gRNA sequence
tccaggaaatatataattct

SEQ ID NO: 663277 - DNA, 20 bp, Artificial
  CRISPR gRNA sequence
tgaatactaaaaatcttttt

SEQ ID NO: 663278 - DNA, 20 bp, Artificial
  CRISPR gRNA sequence
aatactaaaaatctttttaa

SEQ ID NO: 663279 - DNA, 20 bp, Artificial
  CRISPR gRNA sequence
aaaatctttttaattgatca

SEQ ID NO: 663280 - DNA, 20 bp, Artificial
  CRISPR gRNA sequence
tttaattgatcatttatgta

SEQ ID NO: 663281 - DNA, 20 bp, Artificial
  CRISPR gRNA sequence
ttaattgatcatttatgtaa

SEQ ID NO: 663282 - DNA, 20 bp, Artificial
  CRISPR gRNA sequence
taattgatcatttatgtaat

SEQ ID NO: 663283 - DNA, 20 bp, Artificial
  CRISPR gRNA sequence
aattgatcatttatgtaata

SEQ ID NO: 663284 - DNA, 20 bp, Artificial
  CRISPR gRNA sequence
attgatcatttatgtaatat

SEQ ID NO: 663285 - DNA, 20 bp, Artificial
  CRISPR gRNA sequence
atcatttatgtaatatatca

SEQ ID NO: 663286 - DNA, 20 bp, Artificial
  CRISPR gRNA sequence
atgtaatatatcatcacttt

SEQ ID NO: 663287 - DNA, 20 bp, Artificial
  CRISPR gRNA sequence
tgtaatatatcatcactttt

SEQ ID NO: 663288 - DNA, 20 bp, Artificial
  CRISPR gRNA sequence
ttattcaatacatttcaaaa

SEQ ID NO: 663289 - DNA, 20 bp, Artificial
  CRISPR gRNA sequence
tattcaatacatttcaaaat

SEQ ID NO: 663290 - DNA, 20 bp, Artificial
  CRISPR gRNA sequence
attcaatacatttcaaaata

SEQ ID NO: 663291 - DNA, 20 bp, Artificial
  CRISPR gRNA sequence
ttcaatacatttcaaaatat

SEQ ID NO: 663292 - DNA, 20 bp, Artificial
  CRISPR gRNA sequence
aatacatttcaaaatatact

SEQ ID NO: 663293 - DNA, 20 bp, Artificial
  CRISPR gRNA sequence
caaaatatactactcttttt

SEQ ID NO: 663294 - DNA, 20 bp, Artificial
  CRISPR gRNA sequence
aaaatatactactcttttta

SEQ ID NO: 663295 - DNA, 20 bp, Artificial
  CRISPR gRNA sequence
ctctttttagcaaattcaaa

SEQ ID NO: 663296 - DNA, 20 bp, Artificial
  CRISPR gRNA sequence
tttttagcaaattcaaagtc

SEQ ID NO: 663297 - DNA, 20 bp, Artificial
  CRISPR gRNA sequence
tttagcaaattcaaagtcct

SEQ ID NO: 663298 - DNA, 20 bp, Artificial
  CRISPR gRNA sequence
ttagcaaattcaaagtcctt

SEQ ID NO: 663299 - DNA, 20 bp, Artificial
  CRISPR gRNA sequence
tagcaaattcaaagtccttt

SEQ ID NO: 663300 - DNA, 20 bp, Artificial
  CRISPR gRNA sequence
agcaaattcaaagtcctttt

SEQ ID NO: 663301 - DNA, 20 bp, Artificial
  CRISPR gRNA sequence
gcaaattcaaagtcctttta

SEQ ID NO: 663302 - DNA, 20 bp, Artificial
  CRISPR gRNA sequence
aaagtccttttaacattttc

SEQ ID NO: 663303 - DNA, 20 bp, Artificial
  CRISPR gRNA sequence
ttaacattttcttataaatc

SEQ ID NO: 663304 - DNA, 20 bp, Artificial
  CRISPR gRNA sequence
taacattttcttataaatct

SEQ ID NO: 663305 - DNA, 20 bp, Artificial
  CRISPR gRNA sequence
aacattttcttataaatctg

SEQ ID NO: 663306 - DNA, 20 bp, Artificial
  CRISPR gRNA sequence
acattttcttataaatctga

SEQ ID NO: 663307 - DNA, 20 bp, Artificial
  CRISPR gRNA sequence
tcttataaatctgatatcac

SEQ ID NO: 663308 - DNA, 20 bp, Artificial
  CRISPR gRNA sequence
cttataaatctgatatcact

SEQ ID NO: 663309 - DNA, 20 bp, Artificial
  CRISPR gRNA sequence
ttataaatctgatatcacta

SEQ ID NO: 663310 - DNA, 20 bp, Artificial
  CRISPR gRNA sequence
ataaatctgatatcactata

SEQ ID NO: 663311 - DNA, 20 bp, Artificial
  CRISPR gRNA sequence
taaatctgatatcactatat

SEQ ID NO: 663312 - DNA, 20 bp, Artificial
  CRISPR gRNA sequence
atatcactatatttgtaact

SEQ ID NO: 663313 - DNA, 20 bp, Artificial
  CRISPR gRNA sequence
tatttgtaactaaggaattt

SEQ ID NO: 663314 - DNA, 20 bp, Artificial
  CRISPR gRNA sequence
gtaactaaggaattttatgg

SEQ ID NO: 663315 - DNA, 20 bp, Artificial
  CRISPR gRNA sequence
taactaaggaattttatggt

SEQ ID NO: 663316 - DNA, 20 bp, Artificial
  CRISPR gRNA sequence
aggaattttatggtgagatt

SEQ ID NO: 663317 - DNA, 20 bp, Artificial
  CRISPR gRNA sequence
tatggtgagattatttgagc

SEQ ID NO: 663318 - DNA, 20 bp, Artificial
  CRISPR gRNA sequence
atggtgagattatttgagct

SEQ ID NO: 663319 - DNA, 20 bp, Artificial
  CRISPR gRNA sequence
tggtgagattatttgagctt

SEQ ID NO: 663320 - DNA, 20 bp, Artificial
  CRISPR gRNA sequence
tttgagctttatttctgtaa

SEQ ID NO: 663321 - DNA, 20 bp, Artificial
  CRISPR gRNA sequence
gagctttatttctgtaacag

SEQ ID NO: 663322 - DNA, 20 bp, Artificial
  CRISPR gRNA sequence
agctttatttctgtaacagt

SEQ ID NO: 663323 - DNA, 20 bp, Artificial
  CRISPR gRNA sequence
tatttctgtaacagttgttc

SEQ ID NO: 663324 - DNA, 20 bp, Artificial
  CRISPR gRNA sequence
atttctgtaacagttgttct

SEQ ID NO: 663325 - DNA, 20 bp, Artificial
  CRISPR gRNA sequence
tttctgtaacagttgttcta

SEQ ID NO: 663326 - DNA, 20 bp, Artificial
  CRISPR gRNA sequence
ctgtaacagttgttctaagt

SEQ ID NO: 663327 - DNA, 20 bp, Artificial
  CRISPR gRNA sequence
tgtaacagttgttctaagtt

SEQ ID NO: 663328 - DNA, 20 bp, Artificial
  CRISPR gRNA sequence
taacagttgttctaagttat

SEQ ID NO: 663329 - DNA, 20 bp, Artificial
  CRISPR gRNA sequence
ttctaagttataaaaatgaa

SEQ ID NO: 663330 - DNA, 20 bp, Artificial
  CRISPR gRNA sequence
taagttataaaaatgaacat

SEQ ID NO: 663331 - DNA, 20 bp, Artificial
  CRISPR gRNA sequence
agttataaaaatgaacatct

SEQ ID NO: 663332 - DNA, 20 bp, Artificial
  CRISPR gRNA sequence
taaaaatgaacatctttaac

SEQ ID NO: 663333 - DNA, 20 bp, Artificial
  CRISPR gRNA sequence
taacacatctatatagactt

SEQ ID NO: 663334 - DNA, 20 bp, Artificial
  CRISPR gRNA sequence
aacacatctatatagacttt

SEQ ID NO: 663335 - DNA, 20 bp, Artificial
  CRISPR gRNA sequence
acacatctatatagacttta

SEQ ID NO: 663336 - DNA, 20 bp, Artificial
  CRISPR gRNA sequence
tatagactttaaaatagctt

SEQ ID NO: 663337 - DNA, 20 bp, Artificial
  CRISPR gRNA sequence
taaaatagcttatttgtaat

SEQ ID NO: 663338 - DNA, 20 bp, Artificial
  CRISPR gRNA sequence
aaaatagcttatttgtaatt

SEQ ID NO: 663339 - DNA, 20 bp, Artificial
  CRISPR gRNA sequence
aaatagcttatttgtaattt

SEQ ID NO: 663340 - DNA, 20 bp, Artificial
  CRISPR gRNA sequence
atttgtaatttaaactatct

SEQ ID NO: 663341 - DNA, 20 bp, Artificial
  CRISPR gRNA sequence
tttgtaatttaaactatctt

SEQ ID NO: 663342 - DNA, 20 bp, Artificial
  CRISPR gRNA sequence
gtaatttaaactatcttcaa

SEQ ID NO: 663343 - DNA, 20 bp, Artificial
  CRISPR gRNA sequence
taatttaaactatcttcaaa

SEQ ID NO: 663344 - DNA, 20 bp, Artificial
  CRISPR gRNA sequence
aaactatcttcaaatatttt

SEQ ID NO: 663345 - DNA, 20 bp, Artificial
  CRISPR gRNA sequence
aactatcttcaaatattttg

SEQ ID NO: 663346 - DNA, 20 bp, Artificial
  CRISPR gRNA sequence
tcttcaaatattttgctata

SEQ ID NO: 663347 - DNA, 20 bp, Artificial
  CRISPR gRNA sequence
caaatattttgctatattcc

SEQ ID NO: 663348 - DNA, 20 bp, Artificial
  CRISPR gRNA sequence
aaatattttgctatattcct

SEQ ID NO: 663349 - DNA, 20 bp, Artificial
  CRISPR gRNA sequence
tgctatattcctgtttcccc

SEQ ID NO: 663350 - DNA, 20 bp, Artificial
  CRISPR gRNA sequence
gctatattcctgtttcccct

SEQ ID NO: 663351 - DNA, 20 bp, Artificial
  CRISPR gRNA sequence
ctatattcctgtttccccta

SEQ ID NO: 663352 - DNA, 20 bp, Artificial
  CRISPR gRNA sequence
tattcctgtttcccctaatt

SEQ ID NO: 663353 - DNA, 20 bp, Artificial
  CRISPR gRNA sequence
ctgtttcccctaattattca

SEQ ID NO: 663354 - DNA, 20 bp, Artificial
  CRISPR gRNA sequence
tttcccctaattattcaaag

SEQ ID NO: 663355 - DNA, 20 bp, Artificial
  CRISPR gRNA sequence
cccctaattattcaaagttt

SEQ ID NO: 663356 - DNA, 20 bp, Artificial
  CRISPR gRNA sequence
ccctaattattcaaagttta

SEQ ID NO: 663357 - DNA, 20 bp, Artificial
  CRISPR gRNA sequence
attattcaaagtttacaaaa

SEQ ID NO: 663358 - DNA, 20 bp, Artificial
  CRISPR gRNA sequence
ttcaaagtttacaaaacaaa

SEQ ID NO: 663359 - DNA, 20 bp, Artificial
  CRISPR gRNA sequence
aaagtttacaaaacaaacat

SEQ ID NO: 663360 - DNA, 20 bp, Artificial
  CRISPR gRNA sequence
acaaaacaaacatttattga

SEQ ID NO: 663361 - DNA, 20 bp, Artificial
  CRISPR gRNA sequence
caaaacaaacatttattgac

SEQ ID NO: 663362 - DNA, 20 bp, Artificial
  CRISPR gRNA sequence
attgacgatcagtgatgtca

SEQ ID NO: 663363 - DNA, 20 bp, Artificial
  CRISPR gRNA sequence
ttgacgatcagtgatgtcac

SEQ ID NO: 663364 - DNA, 20 bp, Artificial
  CRISPR gRNA sequence
acgatcagtgatgtcacagt

SEQ ID NO: 663365 - DNA, 20 bp, Artificial
  CRISPR gRNA sequence
tattgtaagaagacatttcc

SEQ ID NO: 663366 - DNA, 20 bp, Artificial
  CRISPR gRNA sequence
attgtaagaagacatttcct

SEQ ID NO: 663367 - DNA, 20 bp, Artificial
  CRISPR gRNA sequence
ttgtaagaagacatttcctt

SEQ ID NO: 663368 - DNA, 20 bp, Artificial
  CRISPR gRNA sequence
taagaagacatttcctttca

SEQ ID NO: 663369 - DNA, 20 bp, Artificial
  CRISPR gRNA sequence
cctttcagagaattaacgta

SEQ ID NO: 663370 - DNA, 20 bp, Artificial
  CRISPR gRNA sequence
ctttcagagaattaacgtag

SEQ ID NO: 663371 - DNA, 20 bp, Artificial
  CRISPR gRNA sequence
tcagagaattaacgtagaaa

SEQ ID NO: 663372 - DNA, 20 bp, Artificial
  CRISPR gRNA sequence
cagagaattaacgtagaaat

SEQ ID NO: 663373 - DNA, 20 bp, Artificial
  CRISPR gRNA sequence
agagaattaacgtagaaata

SEQ ID NO: 663374 - DNA, 20 bp, Artificial
  CRISPR gRNA sequence
acgtagaaataaggaaggtt

SEQ ID NO: 663375 - DNA, 20 bp, Artificial
  CRISPR gRNA sequence
aagagatttcctatcctttc

SEQ ID NO: 663376 - DNA, 20 bp, Artificial
  CRISPR gRNA sequence
cctatcctttccttaaagaa

SEQ ID NO: 663377 - DNA, 20 bp, Artificial
  CRISPR gRNA sequence
ctatcctttccttaaagaaa

SEQ ID NO: 663378 - DNA, 20 bp, Artificial
  CRISPR gRNA sequence
tcctttccttaaagaaaaaa

SEQ ID NO: 663379 - DNA, 20 bp, Artificial
  CRISPR gRNA sequence
tccttaaagaaaaaaaggct

SEQ ID NO: 663380 - DNA, 20 bp, Artificial
  CRISPR gRNA sequence
ccttaaagaaaaaaaggcta

SEQ ID NO: 663381 - DNA, 20 bp, Artificial
  CRISPR gRNA sequence
cttaaagaaaaaaaggctat

SEQ ID NO: 663382 - DNA, 20 bp, Artificial
  CRISPR gRNA sequence
aaagaaaaaaaggctattta

SEQ ID NO: 663383 - DNA, 20 bp, Artificial
  CRISPR gRNA sequence
aagaaaaaaaggctatttat

SEQ ID NO: 663384 - DNA, 20 bp, Artificial
  CRISPR gRNA sequence
tttatcacttgccatcttat

SEQ ID NO: 663385 - DNA, 20 bp, Artificial
  CRISPR gRNA sequence
atcacttgccatcttatact

SEQ ID NO: 663386 - DNA, 20 bp, Artificial
  CRISPR gRNA sequence
tcacttgccatcttatactc

SEQ ID NO: 663387 - DNA, 20 bp, Artificial
  CRISPR gRNA sequence
gccatcttatactcattcat

SEQ ID NO: 663388 - DNA, 20 bp, Artificial
  CRISPR gRNA sequence
ccatcttatactcattcatt

SEQ ID NO: 663389 - DNA, 20 bp, Artificial
  CRISPR gRNA sequence
atactcattcattcattctc

SEQ ID NO: 663390 - DNA, 20 bp, Artificial
  CRISPR gRNA sequence
tactcattcattcattctct

SEQ ID NO: 663391 - DNA, 20 bp, Artificial
  CRISPR gRNA sequence
attcattcattctctcattc

SEQ ID NO: 663392 - DNA, 20 bp, Artificial
  CRISPR gRNA sequence
attcattctctcattcacta

SEQ ID NO: 663393 - DNA, 20 bp, Artificial
  CRISPR gRNA sequence
attctctcattcactataca

SEQ ID NO: 663394 - DNA, 20 bp, Artificial
  CRISPR gRNA sequence
tctcattcactatacattca

SEQ ID NO: 663395 - DNA, 20 bp, Artificial
  CRISPR gRNA sequence
tcattcactatacattcagt

SEQ ID NO: 663396 - DNA, 20 bp, Artificial
  CRISPR gRNA sequence
attcactatacattcagtaa

SEQ ID NO: 663397 - DNA, 20 bp, Artificial
  CRISPR gRNA sequence
actatacattcagtaagtgc

SEQ ID NO: 663398 - DNA, 20 bp, Artificial
  CRISPR gRNA sequence
tacattcagtaagtgcccac

SEQ ID NO: 663399 - DNA, 20 bp, Artificial
  CRISPR gRNA sequence
agtaagtgcccactaaactt

SEQ ID NO: 663400 - DNA, 20 bp, Artificial
  CRISPR gRNA sequence
aacttttattaagcctttct

SEQ ID NO: 663401 - DNA, 20 bp, Artificial
  CRISPR gRNA sequence
ttattaagcctttcttttcg

SEQ ID NO: 663402 - DNA, 20 bp, Artificial
  CRISPR gRNA sequence
tattaagcctttcttttcgt

SEQ ID NO: 663403 - DNA, 20 bp, Artificial
  CRISPR gRNA sequence
attaagcctttcttttcgtt

SEQ ID NO: 663404 - DNA, 20 bp, Artificial
  CRISPR gRNA sequence
ttaagcctttcttttcgttc

SEQ ID NO: 663405 - DNA, 20 bp, Artificial
  CRISPR gRNA sequence
agcctttcttttcgttcagt

SEQ ID NO: 663406 - DNA, 20 bp, Artificial
  CRISPR gRNA sequence
tcttttcgttcagtctgttg

SEQ ID NO: 663407 - DNA, 20 bp, Artificial
  CRISPR gRNA sequence
cttttcgttcagtctgttga

SEQ ID NO: 663408 - DNA, 20 bp, Artificial
  CRISPR gRNA sequence
ttttcgttcagtctgttgat

SEQ ID NO: 663409 - DNA, 20 bp, Artificial
  CRISPR gRNA sequence
ttcgttcagtctgttgattt

SEQ ID NO: 663410 - DNA, 20 bp, Artificial
  CRISPR gRNA sequence
tcgttcagtctgttgatttg

SEQ ID NO: 663411 - DNA, 20 bp, Artificial
  CRISPR gRNA sequence
cgttcagtctgttgatttga

SEQ ID NO: 663412 - DNA, 20 bp, Artificial
  CRISPR gRNA sequence
gttcagtctgttgatttgat

SEQ ID NO: 663413 - DNA, 20 bp, Artificial
  CRISPR gRNA sequence
agtctgttgatttgataaat

SEQ ID NO: 663414 - DNA, 20 bp, Artificial
  CRISPR gRNA sequence
ttgatttgataaatcagaag

SEQ ID NO: 663415 - DNA, 20 bp, Artificial
  CRISPR gRNA sequence
atttgataaatcagaagatt

SEQ ID NO: 663416 - DNA, 20 bp, Artificial
  CRISPR gRNA sequence
gataaatcagaagattatct

SEQ ID NO: 663417 - DNA, 20 bp, Artificial
  CRISPR gRNA sequence
ataaatcagaagattatctt

SEQ ID NO: 663418 - DNA, 20 bp, Artificial
  CRISPR gRNA sequence
tctttgataagtattcatat

SEQ ID NO: 663419 - DNA, 20 bp, Artificial
  CRISPR gRNA sequence
tgataagtattcatataata

SEQ ID NO: 663420 - DNA, 20 bp, Artificial
  CRISPR gRNA sequence
gataagtattcatataatac

SEQ ID NO: 663421 - DNA, 20 bp, Artificial
  CRISPR gRNA sequence
ataagtattcatataatact

SEQ ID NO: 663422 - DNA, 20 bp, Artificial
  CRISPR gRNA sequence
atataatactttttattatc

SEQ ID NO: 663423 - DNA, 20 bp, Artificial
  CRISPR gRNA sequence
tttattatccttttgtgatt

SEQ ID NO: 663424 - DNA, 20 bp, Artificial
  CRISPR gRNA sequence
ttattatccttttgtgattg

SEQ ID NO: 663425 - DNA, 20 bp, Artificial
  CRISPR gRNA sequence
tattatccttttgtgattgt

SEQ ID NO: 663426 - DNA, 20 bp, Artificial
  CRISPR gRNA sequence
attatccttttgtgattgtt

SEQ ID NO: 663427 - DNA, 20 bp, Artificial
  CRISPR gRNA sequence
ttatccttttgtgattgttt

SEQ ID NO: 663428 - DNA, 20 bp, Artificial
  CRISPR gRNA sequence
tccttttgtgattgtttatt

SEQ ID NO: 663429 - DNA, 20 bp, Artificial
  CRISPR gRNA sequence
ttgtgattgtttattaagct

SEQ ID NO: 663430 - DNA, 20 bp, Artificial
  CRISPR gRNA sequence
tgtgattgtttattaagcta

SEQ ID NO: 663431 - DNA, 20 bp, Artificial
  CRISPR gRNA sequence
gtgattgtttattaagctat

SEQ ID NO: 663432 - DNA, 20 bp, Artificial
  CRISPR gRNA sequence
tgattgtttattaagctatc

SEQ ID NO: 663433 - DNA, 20 bp, Artificial
  CRISPR gRNA sequence
tttattaagctatctgtcca

SEQ ID NO: 663434 - DNA, 20 bp, Artificial
  CRISPR gRNA sequence
attaagctatctgtccaagc

SEQ ID NO: 663435 - DNA, 20 bp, Artificial
  CRISPR gRNA sequence
ttaagctatctgtccaagct

SEQ ID NO: 663436 - DNA, 20 bp, Artificial
  CRISPR gRNA sequence
agctatctgtccaagctttg

SEQ ID NO: 663437 - DNA, 20 bp, Artificial
  CRISPR gRNA sequence
tctgtccaagctttgaagac

SEQ ID NO: 663438 - DNA, 20 bp, Artificial
  CRISPR gRNA sequence
tccaagctttgaagacagtc

SEQ ID NO: 663439 - DNA, 20 bp, Artificial
  CRISPR gRNA sequence
tgaagacagtctgcaatggt

SEQ ID NO: 663440 - DNA, 20 bp, Artificial
  CRISPR gRNA sequence
gaagacagtctgcaatggtt

SEQ ID NO: 663441 - DNA, 20 bp, Artificial
  CRISPR gRNA sequence
aagacagtctgcaatggttc

SEQ ID NO: 663442 - DNA, 20 bp, Artificial
  CRISPR gRNA sequence
caatggttcaaatctaagca

SEQ ID NO: 663443 - DNA, 20 bp, Artificial
  CRISPR gRNA sequence
aaatctaagcattgccatta

SEQ ID NO: 663444 - DNA, 20 bp, Artificial
  CRISPR gRNA sequence
agcattgccattagttgtga

SEQ ID NO: 663445 - DNA, 20 bp, Artificial
  CRISPR gRNA sequence
ccattagttgtgatatgtgt

SEQ ID NO: 663446 - DNA, 20 bp, Artificial
  CRISPR gRNA sequence
gttgtgatatgtgtgtatac

SEQ ID NO: 663447 - DNA, 20 bp, Artificial
  CRISPR gRNA sequence
tgatatgtgtgtatacatgt

SEQ ID NO: 663448 - DNA, 20 bp, Artificial
  CRISPR gRNA sequence
ttggtctctctatcatcatt

SEQ ID NO: 663449 - DNA, 20 bp, Artificial
  CRISPR gRNA sequence
gtctctctatcatcatttat

SEQ ID NO: 663450 - DNA, 20 bp, Artificial
  CRISPR gRNA sequence
tctatcatcatttatcacaa

SEQ ID NO: 663451 - DNA, 20 bp, Artificial
  CRISPR gRNA sequence
tatcatcatttatcacaatt

SEQ ID NO: 663452 - DNA, 20 bp, Artificial
  CRISPR gRNA sequence
tcatcatttatcacaattta

SEQ ID NO: 663453 - DNA, 20 bp, Artificial
  CRISPR gRNA sequence
atcacaatttatcattgttt

SEQ ID NO: 663454 - DNA, 20 bp, Artificial
  CRISPR gRNA sequence
tcacaatttatcattgttta

SEQ ID NO: 663455 - DNA, 20 bp, Artificial
  CRISPR gRNA sequence
atcattgtttacccaaagga

SEQ ID NO: 663456 - DNA, 20 bp, Artificial
  CRISPR gRNA sequence
tcattgtttacccaaaggaa

SEQ ID NO: 663457 - DNA, 20 bp, Artificial
  CRISPR gRNA sequence
tttacccaaaggaataacta

SEQ ID NO: 663458 - DNA, 20 bp, Artificial
  CRISPR gRNA sequence
acccaaaggaataactagct

SEQ ID NO: 663459 - DNA, 20 bp, Artificial
  CRISPR gRNA sequence
cccaaaggaataactagcta

SEQ ID NO: 663460 - DNA, 20 bp, Artificial
  CRISPR gRNA sequence
gctactgactgagtgacctt

SEQ ID NO: 663461 - DNA, 20 bp, Artificial
  CRISPR gRNA sequence
ctgactgagtgaccttgtat

SEQ ID NO: 663462 - DNA, 20 bp, Artificial
  CRISPR gRNA sequence
actgagtgaccttgtatgaa

SEQ ID NO: 663463 - DNA, 20 bp, Artificial
  CRISPR gRNA sequence
agtgaccttgtatgaataaa

SEQ ID NO: 663464 - DNA, 20 bp, Artificial
  CRISPR gRNA sequence
gtatgaataaattaatatct

SEQ ID NO: 663465 - DNA, 20 bp, Artificial
  CRISPR gRNA sequence
tatgaataaattaatatctc

SEQ ID NO: 663466 - DNA, 20 bp, Artificial
  CRISPR gRNA sequence
atatctctgagcctcagttg

SEQ ID NO: 663467 - DNA, 20 bp, Artificial
  CRISPR gRNA sequence
tgagcctcagttgacttacc

SEQ ID NO: 663468 - DNA, 20 bp, Artificial
  CRISPR gRNA sequence
agcctcagttgacttacctg

SEQ ID NO: 663469 - DNA, 20 bp, Artificial
  CRISPR gRNA sequence
agttgacttacctgtacaaa

SEQ ID NO: 663470 - DNA, 20 bp, Artificial
  CRISPR gRNA sequence
acttacctgtacaaagtgag

SEQ ID NO: 663471 - DNA, 20 bp, Artificial
  CRISPR gRNA sequence
acctgtacaaagtgagaata

SEQ ID NO: 663472 - DNA, 20 bp, Artificial
  CRISPR gRNA sequence
cctgtacaaagtgagaatac

SEQ ID NO: 663473 - DNA, 20 bp, Artificial
  CRISPR gRNA sequence
tacaaagtgagaatacttat

SEQ ID NO: 663474 - DNA, 20 bp, Artificial
  CRISPR gRNA sequence
atattttttaagattgttag

SEQ ID NO: 663475 - DNA, 20 bp, Artificial
  CRISPR gRNA sequence
tattttttaagattgttaga

SEQ ID NO: 663476 - DNA, 20 bp, Artificial
  CRISPR gRNA sequence
tttaagattgttagattagt

SEQ ID NO: 663477 - DNA, 20 bp, Artificial
  CRISPR gRNA sequence
ttaagattgttagattagtt

SEQ ID NO: 663478 - DNA, 20 bp, Artificial
  CRISPR gRNA sequence
taagattgttagattagttg

SEQ ID NO: 663479 - DNA, 20 bp, Artificial
  CRISPR gRNA sequence
aagattgttagattagttgt

SEQ ID NO: 663480 - DNA, 20 bp, Artificial
  CRISPR gRNA sequence
agattgttagattagttgta

SEQ ID NO: 663481 - DNA, 20 bp, Artificial
  CRISPR gRNA sequence
ttagattagttgtatattta

SEQ ID NO: 663482 - DNA, 20 bp, Artificial
  CRISPR gRNA sequence
gattagttgtatatttaagc

SEQ ID NO: 663483 - DNA, 20 bp, Artificial
  CRISPR gRNA sequence
gttgtatatttaagccccct

SEQ ID NO: 663484 - DNA, 20 bp, Artificial
  CRISPR gRNA sequence
tatatttaagccccctctac

SEQ ID NO: 663485 - DNA, 20 bp, Artificial
  CRISPR gRNA sequence
aagccccctctacggtattt

SEQ ID NO: 663486 - DNA, 20 bp, Artificial
  CRISPR gRNA sequence
agccccctctacggtattta

SEQ ID NO: 663487 - DNA, 20 bp, Artificial
  CRISPR gRNA sequence
tacggtatttagaacatgtg

SEQ ID NO: 663488 - DNA, 20 bp, Artificial
  CRISPR gRNA sequence
cggtatttagaacatgtgag

SEQ ID NO: 663489 - DNA, 20 bp, Artificial
  CRISPR gRNA sequence
agaacatgtgagtaacgtgg

SEQ ID NO: 663490 - DNA, 20 bp, Artificial
  CRISPR gRNA sequence
gaacatgtgagtaacgtggt

SEQ ID NO: 663491 - DNA, 20 bp, Artificial
  CRISPR gRNA sequence
cttattattgtttatattgc

SEQ ID NO: 663492 - DNA, 20 bp, Artificial
  CRISPR gRNA sequence
attattgtttatattgccat

SEQ ID NO: 663493 - DNA, 20 bp, Artificial
  CRISPR gRNA sequence
ttattgtttatattgccatt

SEQ ID NO: 663494 - DNA, 20 bp, Artificial
  CRISPR gRNA sequence
ttgtttatattgccattatc

SEQ ID NO: 663495 - DNA, 20 bp, Artificial
  CRISPR gRNA sequence
tttatattgccattatcctg

SEQ ID NO: 663496 - DNA, 20 bp, Artificial
  CRISPR gRNA sequence
atattgccattatcctgacc

SEQ ID NO: 663497 - DNA, 20 bp, Artificial
  CRISPR gRNA sequence
tattgccattatcctgacca

SEQ ID NO: 663498 - DNA, 20 bp, Artificial
  CRISPR gRNA sequence
ccattatcctgaccactata

SEQ ID NO: 663499 - DNA, 20 bp, Artificial
  CRISPR gRNA sequence
tcctgaccactatatggact

SEQ ID NO: 663500 - DNA, 20 bp, Artificial
  CRISPR gRNA sequence
accactatatggacttgatc

SEQ ID NO: 663501 - DNA, 20 bp, Artificial
  CRISPR gRNA sequence
tatggacttgatcctccagt

SEQ ID NO: 663502 - DNA, 20 bp, Artificial
  CRISPR gRNA sequence
gatcctccagttatttcctt

SEQ ID NO: 663503 - DNA, 20 bp, Artificial
  CRISPR gRNA sequence
atcctccagttatttccttg

SEQ ID NO: 663504 - DNA, 20 bp, Artificial
  CRISPR gRNA sequence
cagttatttccttgggtcca

SEQ ID NO: 663505 - DNA, 20 bp, Artificial
  CRISPR gRNA sequence
tttccttgggtccatgccat

SEQ ID NO: 663506 - DNA, 20 bp, Artificial
  CRISPR gRNA sequence
ccttgggtccatgccatctt

SEQ ID NO: 663507 - DNA, 20 bp, Artificial
  CRISPR gRNA sequence
cttgggtccatgccatctta

SEQ ID NO: 663508 - DNA, 20 bp, Artificial
  CRISPR gRNA sequence
gggtccatgccatcttacct

SEQ ID NO: 663509 - DNA, 20 bp, Artificial
  CRISPR gRNA sequence
ggtccatgccatcttacctc

SEQ ID NO: 663510 - DNA, 20 bp, Artificial
  CRISPR gRNA sequence
acctctcttatttttccatt

SEQ ID NO: 663511 - DNA, 20 bp, Artificial
  CRISPR gRNA sequence
cctctcttatttttccatta

SEQ ID NO: 663512 - DNA, 20 bp, Artificial
  CRISPR gRNA sequence
tcttatttttccattactgc

SEQ ID NO: 663513 - DNA, 20 bp, Artificial
  CRISPR gRNA sequence
ttatttttccattactgctt

SEQ ID NO: 663514 - DNA, 20 bp, Artificial
  CRISPR gRNA sequence
atttttccattactgcttat

SEQ ID NO: 663515 - DNA, 20 bp, Artificial
  CRISPR gRNA sequence
tttttccattactgcttatc

SEQ ID NO: 663516 - DNA, 20 bp, Artificial
  CRISPR gRNA sequence
ttccattactgcttatctca

SEQ ID NO: 663517 - DNA, 20 bp, Artificial
  CRISPR gRNA sequence
tccattactgcttatctcac

SEQ ID NO: 663518 - DNA, 20 bp, Artificial
  CRISPR gRNA sequence
ccattactgcttatctcaca

SEQ ID NO: 663519 - DNA, 20 bp, Artificial
  CRISPR gRNA sequence
cattactgcttatctcacaa

SEQ ID NO: 663520 - DNA, 20 bp, Artificial
  CRISPR gRNA sequence
ctgcttatctcacaatattc

SEQ ID NO: 663521 - DNA, 20 bp, Artificial
  CRISPR gRNA sequence
cttatctcacaatattcgag

SEQ ID NO: 663522 - DNA, 20 bp, Artificial
  CRISPR gRNA sequence
atctcacaatattcgagagt

SEQ ID NO: 663523 - DNA, 20 bp, Artificial
  CRISPR gRNA sequence
tctcacaatattcgagagta

SEQ ID NO: 663524 - DNA, 20 bp, Artificial
  CRISPR gRNA sequence
acaatattcgagagtaaaaa

SEQ ID NO: 663525 - DNA, 20 bp, Artificial
  CRISPR gRNA sequence
gagagtaaaaaggaaccttt

SEQ ID NO: 663526 - DNA, 20 bp, Artificial
  CRISPR gRNA sequence
tttacaatgaaaggctgccc

SEQ ID NO: 663527 - DNA, 20 bp, Artificial
  CRISPR gRNA sequence
ttacaatgaaaggctgccca

SEQ ID NO: 663528 - DNA, 20 bp, Artificial
  CRISPR gRNA sequence
tacaatgaaaggctgcccat

SEQ ID NO: 663529 - DNA, 20 bp, Artificial
  CRISPR gRNA sequence
acaatgaaaggctgcccatt

SEQ ID NO: 663530 - DNA, 20 bp, Artificial
  CRISPR gRNA sequence
caatgaaaggctgcccattt

SEQ ID NO: 663531 - DNA, 20 bp, Artificial
  CRISPR gRNA sequence
cccatttctcacatgtgctt

SEQ ID NO: 663532 - DNA, 20 bp, Artificial
  CRISPR gRNA sequence
ctcacatgtgctttcctctt

SEQ ID NO: 663533 - DNA, 20 bp, Artificial
  CRISPR gRNA sequence
tcacatgtgctttcctcttg

SEQ ID NO: 663534 - DNA, 20 bp, Artificial
  CRISPR gRNA sequence
acatgtgctttcctcttgat

SEQ ID NO: 663535 - DNA, 20 bp, Artificial
  CRISPR gRNA sequence
tcctcttgatgccttcatgc

SEQ ID NO: 663536 - DNA, 20 bp, Artificial
  CRISPR gRNA sequence
cctcttgatgccttcatgct

SEQ ID NO: 663537 - DNA, 20 bp, Artificial
  CRISPR gRNA sequence
ctcttgatgccttcatgctt

SEQ ID NO: 663538 - DNA, 20 bp, Artificial
  CRISPR gRNA sequence
ttgatgccttcatgcttgct

SEQ ID NO: 663539 - DNA, 20 bp, Artificial
  CRISPR gRNA sequence
gatgccttcatgcttgctgt

SEQ ID NO: 663540 - DNA, 20 bp, Artificial
  CRISPR gRNA sequence
atgccttcatgcttgctgtt

SEQ ID NO: 663541 - DNA, 20 bp, Artificial
  CRISPR gRNA sequence
catgcttgctgttttgctta

SEQ ID NO: 663542 - DNA, 20 bp, Artificial
  CRISPR gRNA sequence
atgcttgctgttttgcttac

SEQ ID NO: 663543 - DNA, 20 bp, Artificial
  CRISPR gRNA sequence
gctgttttgcttactgttgt

SEQ ID NO: 663544 - DNA, 20 bp, Artificial
  CRISPR gRNA sequence
ctgttttgcttactgttgta

SEQ ID NO: 663545 - DNA, 20 bp, Artificial
  CRISPR gRNA sequence
ttttgcttactgttgtagag

SEQ ID NO: 663546 - DNA, 20 bp, Artificial
  CRISPR gRNA sequence
tgcttactgttgtagagcag

SEQ ID NO: 663547 - DNA, 20 bp, Artificial
  CRISPR gRNA sequence
gcttactgttgtagagcagc

SEQ ID NO: 663548 - DNA, 20 bp, Artificial
  CRISPR gRNA sequence
cttactgttgtagagcagca

SEQ ID NO: 663549 - DNA, 20 bp, Artificial
  CRISPR gRNA sequence
actgttgtagagcagcagaa

SEQ ID NO: 663550 - DNA, 20 bp, Artificial
  CRISPR gRNA sequence
ctgttgtagagcagcagaat

SEQ ID NO: 663551 - DNA, 20 bp, Artificial
  CRISPR gRNA sequence
ttgtagagcagcagaatatt

SEQ ID NO: 663552 - DNA, 20 bp, Artificial
  CRISPR gRNA sequence
tagagcagcagaatattact

SEQ ID NO: 663553 - DNA, 20 bp, Artificial
  CRISPR gRNA sequence
ctgaggaagcacttcttttt

SEQ ID NO: 663554 - DNA, 20 bp, Artificial
  CRISPR gRNA sequence
aggaagcacttctttttaaa

SEQ ID NO: 663555 - DNA, 20 bp, Artificial
  CRISPR gRNA sequence
ctttttaaaaaaattttctg

SEQ ID NO: 663556 - DNA, 20 bp, Artificial
  CRISPR gRNA sequence
tttttaaaaaaattttctgg

SEQ ID NO: 663557 - DNA, 20 bp, Artificial
  CRISPR gRNA sequence
tttaaaaaaattttctggta

SEQ ID NO: 663558 - DNA, 20 bp, Artificial
  CRISPR gRNA sequence
ttaaaaaaattttctggtac

SEQ ID NO: 663559 - DNA, 20 bp, Artificial
  CRISPR gRNA sequence
taaaaaaattttctggtaca

SEQ ID NO: 663560 - DNA, 20 bp, Artificial
  CRISPR gRNA sequence
aaaaaaattttctggtacag

SEQ ID NO: 663561 - DNA, 20 bp, Artificial
  CRISPR gRNA sequence
aaaaaattttctggtacagc

SEQ ID NO: 663562 - DNA, 20 bp, Artificial
  CRISPR gRNA sequence
tctggtacagctggaaatat

SEQ ID NO: 663563 - DNA, 20 bp, Artificial
  CRISPR gRNA sequence
ctggtacagctggaaatatg

SEQ ID NO: 663564 - DNA, 20 bp, Artificial
  CRISPR gRNA sequence
tggtacagctggaaatatga

SEQ ID NO: 663565 - DNA, 20 bp, Artificial
  CRISPR gRNA sequence
gtacagctggaaatatgaca

SEQ ID NO: 663566 - DNA, 20 bp, Artificial
  CRISPR gRNA sequence
gaaatatgacaagaagaata

SEQ ID NO: 663567 - DNA, 20 bp, Artificial
  CRISPR gRNA sequence
attattagttaaatcaacat

SEQ ID NO: 663568 - DNA, 20 bp, Artificial
  CRISPR gRNA sequence
ttagttaaatcaacatatta

SEQ ID NO: 663569 - DNA, 20 bp, Artificial
  CRISPR gRNA sequence
gttaaatcaacatattattc

SEQ ID NO: 663570 - DNA, 20 bp, Artificial
  CRISPR gRNA sequence
aatcaacatattattctata

SEQ ID NO: 663571 - DNA, 20 bp, Artificial
  CRISPR gRNA sequence
ttctataaattcaatagaat

SEQ ID NO: 663572 - DNA, 20 bp, Artificial
  CRISPR gRNA sequence
tataaattcaatagaattga

SEQ ID NO: 663573 - DNA, 20 bp, Artificial
  CRISPR gRNA sequence
taaattcaatagaattgaga

SEQ ID NO: 663574 - DNA, 20 bp, Artificial
  CRISPR gRNA sequence
aatagaattgagaccccccc

SEQ ID NO: 663575 - DNA, 20 bp, Artificial
  CRISPR gRNA sequence
agacccccccccttccttta

SEQ ID NO: 663576 - DNA, 20 bp, Artificial
  CRISPR gRNA sequence
cctttaaatgttatatttgg

SEQ ID NO: 663577 - DNA, 20 bp, Artificial
  CRISPR gRNA sequence
ctttaaatgttatatttggt

SEQ ID NO: 663578 - DNA, 20 bp, Artificial
  CRISPR gRNA sequence
taaatgttatatttggtctt

SEQ ID NO: 663579 - DNA, 20 bp, Artificial
  CRISPR gRNA sequence
aaatgttatatttggtctta

SEQ ID NO: 663580 - DNA, 20 bp, Artificial
  CRISPR gRNA sequence
aatgttatatttggtcttat

SEQ ID NO: 663581 - DNA, 20 bp, Artificial
  CRISPR gRNA sequence
tatttggtcttattaaaatt

SEQ ID NO: 663582 - DNA, 20 bp, Artificial
  CRISPR gRNA sequence
ggtcttattaaaattcattt

SEQ ID NO: 663583 - DNA, 20 bp, Artificial
  CRISPR gRNA sequence
gtcttattaaaattcatttt

SEQ ID NO: 663584 - DNA, 20 bp, Artificial
  CRISPR gRNA sequence
attaaaattcattttgctat

SEQ ID NO: 663585 - DNA, 20 bp, Artificial
  CRISPR gRNA sequence
ttaaaattcattttgctata

SEQ ID NO: 663586 - DNA, 20 bp, Artificial
  CRISPR gRNA sequence
aaattcattttgctatatgc

SEQ ID NO: 663587 - DNA, 20 bp, Artificial
  CRISPR gRNA sequence
attttgctatatgctgtgga

SEQ ID NO: 663588 - DNA, 20 bp, Artificial
  CRISPR gRNA sequence
tgctatatgctgtggatttt

SEQ ID NO: 663589 - DNA, 20 bp, Artificial
  CRISPR gRNA sequence
gctatatgctgtggattttt

SEQ ID NO: 663590 - DNA, 20 bp, Artificial
  CRISPR gRNA sequence
ctatatgctgtggattttta

SEQ ID NO: 663591 - DNA, 20 bp, Artificial
  CRISPR gRNA sequence
tatgctgtggatttttatgc

SEQ ID NO: 663592 - DNA, 20 bp, Artificial
  CRISPR gRNA sequence
tggatttttatgcattattt

SEQ ID NO: 663593 - DNA, 20 bp, Artificial
  CRISPR gRNA sequence
ttatgcattatttttgttta

SEQ ID NO: 663594 - DNA, 20 bp, Artificial
  CRISPR gRNA sequence
tatgcattatttttgtttaa

SEQ ID NO: 663595 - DNA, 20 bp, Artificial
  CRISPR gRNA sequence
atgcattatttttgtttaat

SEQ ID NO: 663596 - DNA, 20 bp, Artificial
  CRISPR gRNA sequence
tgcattatttttgtttaatt

SEQ ID NO: 663597 - DNA, 20 bp, Artificial
  CRISPR gRNA sequence
tttttgtttaatttctaatg

SEQ ID NO: 663598 - DNA, 20 bp, Artificial
  CRISPR gRNA sequence
ttgtttaatttctaatgaag

SEQ ID NO: 663599 - DNA, 20 bp, Artificial
  CRISPR gRNA sequence
tgtttaatttctaatgaaga

SEQ ID NO: 663600 - DNA, 20 bp, Artificial
  CRISPR gRNA sequence
gtttaatttctaatgaagag

SEQ ID NO: 663601 - DNA, 20 bp, Artificial
  CRISPR gRNA sequence
tttaatttctaatgaagagt

SEQ ID NO: 663602 - DNA, 20 bp, Artificial
  CRISPR gRNA sequence
aatttctaatgaagagttat

SEQ ID NO: 663603 - DNA, 20 bp, Artificial
  CRISPR gRNA sequence
atttctaatgaagagttatt

SEQ ID NO: 663604 - DNA, 20 bp, Artificial
  CRISPR gRNA sequence
ctaatgaagagttattgaga

SEQ ID NO: 663605 - DNA, 20 bp, Artificial
  CRISPR gRNA sequence
taatgaagagttattgagat

SEQ ID NO: 663606 - DNA, 20 bp, Artificial
  CRISPR gRNA sequence
atgaagagttattgagattt

SEQ ID NO: 663607 - DNA, 20 bp, Artificial
  CRISPR gRNA sequence
ttgagattttatgagattga

SEQ ID NO: 663608 - DNA, 20 bp, Artificial
  CRISPR gRNA sequence
agattttatgagattgacgt

SEQ ID NO: 663609 - DNA, 20 bp, Artificial
  CRISPR gRNA sequence
tatgagattgacgtcttatt

SEQ ID NO: 663610 - DNA, 20 bp, Artificial
  CRISPR gRNA sequence
atgagattgacgtcttattt

SEQ ID NO: 663611 - DNA, 20 bp, Artificial
  CRISPR gRNA sequence
tgagattgacgtcttattta

SEQ ID NO: 663612 - DNA, 20 bp, Artificial
  CRISPR gRNA sequence
acgtcttatttacttaaaaa

SEQ ID NO: 663613 - DNA, 20 bp, Artificial
  CRISPR gRNA sequence
atttacttaaaaaatttcct

SEQ ID NO: 663614 - DNA, 20 bp, Artificial
  CRISPR gRNA sequence
tttacttaaaaaatttccta

SEQ ID NO: 663615 - DNA, 20 bp, Artificial
  CRISPR gRNA sequence
acttaaaaaatttcctattg

SEQ ID NO: 663616 - DNA, 20 bp, Artificial
  CRISPR gRNA sequence
cttaaaaaatttcctattgc

SEQ ID NO: 663617 - DNA, 20 bp, Artificial
  CRISPR gRNA sequence
aaaaaatttcctattgcttg

SEQ ID NO: 663618 - DNA, 20 bp, Artificial
  CRISPR gRNA sequence
aaaaatttcctattgcttgt

SEQ ID NO: 663619 - DNA, 20 bp, Artificial
  CRISPR gRNA sequence
cctattgcttgtacattggg

SEQ ID NO: 663620 - DNA, 20 bp, Artificial
  CRISPR gRNA sequence
ctattgcttgtacattggga

SEQ ID NO: 663621 - DNA, 20 bp, Artificial
  CRISPR gRNA sequence
ttgcttgtacattgggagca

SEQ ID NO: 663622 - DNA, 20 bp, Artificial
  CRISPR gRNA sequence
cttgtacattgggagcaaac

SEQ ID NO: 663623 - DNA, 20 bp, Artificial
  CRISPR gRNA sequence
gtacattgggagcaaaccaa

SEQ ID NO: 663624 - DNA, 20 bp, Artificial
  CRISPR gRNA sequence
tacattgggagcaaaccaag

SEQ ID NO: 663625 - DNA, 20 bp, Artificial
  CRISPR gRNA sequence
ggagcaaaccaagaacaggt

SEQ ID NO: 663626 - DNA, 20 bp, Artificial
  CRISPR gRNA sequence
ccaacttgtcttggtgaatt

SEQ ID NO: 663627 - DNA, 20 bp, Artificial
  CRISPR gRNA sequence
gtcttggtgaattgtgaatt

SEQ ID NO: 663628 - DNA, 20 bp, Artificial
  CRISPR gRNA sequence
tcttggtgaattgtgaattg

SEQ ID NO: 663629 - DNA, 20 bp, Artificial
  CRISPR gRNA sequence
ggtgaattgtgaattgctct

SEQ ID NO: 663630 - DNA, 20 bp, Artificial
  CRISPR gRNA sequence
gtgaattgtgaattgctctg

SEQ ID NO: 663631 - DNA, 20 bp, Artificial
  CRISPR gRNA sequence
tgaattgctctggtttattc

SEQ ID NO: 663632 - DNA, 20 bp, Artificial
  CRISPR gRNA sequence
ctctggtttattcttgtttg

SEQ ID NO: 663633 - DNA, 20 bp, Artificial
  CRISPR gRNA sequence
tggtttattcttgtttgtat

SEQ ID NO: 663634 - DNA, 20 bp, Artificial
  CRISPR gRNA sequence
gtttattcttgtttgtatta

SEQ ID NO: 663635 - DNA, 20 bp, Artificial
  CRISPR gRNA sequence
attcttgtttgtattacatt

SEQ ID NO: 663636 - DNA, 20 bp, Artificial
  CRISPR gRNA sequence
ttcttgtttgtattacattt

SEQ ID NO: 663637 - DNA, 20 bp, Artificial
  CRISPR gRNA sequence
ttgtttgtattacatttaat

SEQ ID NO: 663638 - DNA, 20 bp, Artificial
  CRISPR gRNA sequence
gtttgtattacatttaatgg

SEQ ID NO: 663639 - DNA, 20 bp, Artificial
  CRISPR gRNA sequence
tttgtattacatttaatgga

SEQ ID NO: 663640 - DNA, 20 bp, Artificial
  CRISPR gRNA sequence
gtattacatttaatggacaa

SEQ ID NO: 663641 - DNA, 20 bp, Artificial
  CRISPR gRNA sequence
tattacatttaatggacaag

SEQ ID NO: 663642 - DNA, 20 bp, Artificial
  CRISPR gRNA sequence
catttaatggacaagtcctg

SEQ ID NO: 663643 - DNA, 20 bp, Artificial
  CRISPR gRNA sequence
aatggacaagtcctgtatgg

SEQ ID NO: 663644 - DNA, 20 bp, Artificial
  CRISPR gRNA sequence
atggacaagtcctgtatggt

SEQ ID NO: 663645 - DNA, 20 bp, Artificial
  CRISPR gRNA sequence
tatggtactatacattttaa

SEQ ID NO: 663646 - DNA, 20 bp, Artificial
  CRISPR gRNA sequence
tacattttaattcagttttg

SEQ ID NO: 663647 - DNA, 20 bp, Artificial
  CRISPR gRNA sequence
taattcagttttgaaaatta

SEQ ID NO: 663648 - DNA, 20 bp, Artificial
  CRISPR gRNA sequence
aattcagttttgaaaattat

SEQ ID NO: 663649 - DNA, 20 bp, Artificial
  CRISPR gRNA sequence
attcagttttgaaaattatc

SEQ ID NO: 663650 - DNA, 20 bp, Artificial
  CRISPR gRNA sequence
agttttgaaaattatcaatt

SEQ ID NO: 663651 - DNA, 20 bp, Artificial
  CRISPR gRNA sequence
tgaaaattatcaatttgcaa

SEQ ID NO: 663652 - DNA, 20 bp, Artificial
  CRISPR gRNA sequence
gaaaattatcaatttgcaaa

SEQ ID NO: 663653 - DNA, 20 bp, Artificial
  CRISPR gRNA sequence
aaaattatcaatttgcaaat

SEQ ID NO: 663654 - DNA, 20 bp, Artificial
  CRISPR gRNA sequence
tcaatttgcaaattttgtct

SEQ ID NO: 663655 - DNA, 20 bp, Artificial
  CRISPR gRNA sequence
gcaaattttgtctttttcca

SEQ ID NO: 663656 - DNA, 20 bp, Artificial
  CRISPR gRNA sequence
caaattttgtctttttccac

SEQ ID NO: 663657 - DNA, 20 bp, Artificial
  CRISPR gRNA sequence
tgtctttttccactttcttt

SEQ ID NO: 663658 - DNA, 20 bp, Artificial
  CRISPR gRNA sequence
gtctttttccactttctttt

SEQ ID NO: 663659 - DNA, 20 bp, Artificial
  CRISPR gRNA sequence
tctttttccactttcttttt

SEQ ID NO: 663660 - DNA, 20 bp, Artificial
  CRISPR gRNA sequence
tttccactttctttttctat

SEQ ID NO: 663661 - DNA, 20 bp, Artificial
  CRISPR gRNA sequence
ttccactttctttttctatt

SEQ ID NO: 663662 - DNA, 20 bp, Artificial
  CRISPR gRNA sequence
tccactttctttttctattt

SEQ ID NO: 663663 - DNA, 20 bp, Artificial
  CRISPR gRNA sequence
ccactttctttttctatttc

SEQ ID NO: 663664 - DNA, 20 bp, Artificial
  CRISPR gRNA sequence
cactttctttttctatttca

SEQ ID NO: 663665 - DNA, 20 bp, Artificial
  CRISPR gRNA sequence
tctttttctatttcaagagc

SEQ ID NO: 663666 - DNA, 20 bp, Artificial
  CRISPR gRNA sequence
ctttttctatttcaagagct

SEQ ID NO: 663667 - DNA, 20 bp, Artificial
  CRISPR gRNA sequence
tttttctatttcaagagctt

SEQ ID NO: 663668 - DNA, 20 bp, Artificial
  CRISPR gRNA sequence
tttctatttcaagagcttat

SEQ ID NO: 663669 - DNA, 20 bp, Artificial
  CRISPR gRNA sequence
ttctatttcaagagcttatt

SEQ ID NO: 663670 - DNA, 20 bp, Artificial
  CRISPR gRNA sequence
tctatttcaagagcttatta

SEQ ID NO: 663671 - DNA, 20 bp, Artificial
  CRISPR gRNA sequence
ctatttcaagagcttattac

SEQ ID NO: 663672 - DNA, 20 bp, Artificial
  CRISPR gRNA sequence
tatttcaagagcttattacc

SEQ ID NO: 663673 - DNA, 20 bp, Artificial
  CRISPR gRNA sequence
tttcaagagcttattacctt

SEQ ID NO: 663674 - DNA, 20 bp, Artificial
  CRISPR gRNA sequence
caagagcttattacctttgc

SEQ ID NO: 663675 - DNA, 20 bp, Artificial
  CRISPR gRNA sequence
aagagcttattacctttgct

SEQ ID NO: 663676 - DNA, 20 bp, Artificial
  CRISPR gRNA sequence
attacctttgctccagctgg

SEQ ID NO: 663677 - DNA, 20 bp, Artificial
  CRISPR gRNA sequence
ttacctttgctccagctgga

SEQ ID NO: 663678 - DNA, 20 bp, Artificial
  CRISPR gRNA sequence
cctttgctccagctggataa

SEQ ID NO: 663679 - DNA, 20 bp, Artificial
  CRISPR gRNA sequence
tgctccagctggataaaagt

SEQ ID NO: 663680 - DNA, 20 bp, Artificial
  CRISPR gRNA sequence
gctccagctggataaaagtt

SEQ ID NO: 663681 - DNA, 20 bp, Artificial
  CRISPR gRNA sequence
ctccagctggataaaagttg

SEQ ID NO: 663682 - DNA, 20 bp, Artificial
  CRISPR gRNA sequence
cagctggataaaagttgggc

SEQ ID NO: 663683 - DNA, 20 bp, Artificial
  CRISPR gRNA sequence
gataaaagttgggcaaacag

SEQ ID NO: 663684 - DNA, 20 bp, Artificial
  CRISPR gRNA sequence
ggcaaacagataccctgaca

SEQ ID NO: 663685 - DNA, 20 bp, Artificial
  CRISPR gRNA sequence
acaactgccaacagcaccac

SEQ ID NO: 663686 - DNA, 20 bp, Artificial
  CRISPR gRNA sequence
ccaacagcaccacgccttgg

SEQ ID NO: 663687 - DNA, 20 bp, Artificial
  CRISPR gRNA sequence
ggttttcccgggtacagaaa

SEQ ID NO: 663688 - DNA, 20 bp, Artificial
  CRISPR gRNA sequence
gttttcccgggtacagaaag

SEQ ID NO: 663689 - DNA, 20 bp, Artificial
  CRISPR gRNA sequence
tcccgggtacagaaagtagt

SEQ ID NO: 663690 - DNA, 20 bp, Artificial
  CRISPR gRNA sequence
cccgggtacagaaagtagtc

SEQ ID NO: 663691 - DNA, 20 bp, Artificial
  CRISPR gRNA sequence
ccgggtacagaaagtagtca

SEQ ID NO: 663692 - DNA, 20 bp, Artificial
  CRISPR gRNA sequence
ctgggactatgcatctgtcc

SEQ ID NO: 663693 - DNA, 20 bp, Artificial
  CRISPR gRNA sequence
tgggactatgcatctgtccc

SEQ ID NO: 663694 - DNA, 20 bp, Artificial
  CRISPR gRNA sequence
ggactatgcatctgtcccat

SEQ ID NO: 663695 - DNA, 20 bp, Artificial
  CRISPR gRNA sequence
tgcatctgtcccatctcaaa

SEQ ID NO: 663696 - DNA, 20 bp, Artificial
  CRISPR gRNA sequence
tcccatctcaaagatgccgc

SEQ ID NO: 663697 - DNA, 20 bp, Artificial
  CRISPR gRNA sequence
aaagatgccgctcacaaatt

SEQ ID NO: 663698 - DNA, 20 bp, Artificial
  CRISPR gRNA sequence
acaaattctagtttaaatac

SEQ ID NO: 663699 - DNA, 20 bp, Artificial
  CRISPR gRNA sequence
tagtttaaatacagaattat

SEQ ID NO: 663700 - DNA, 20 bp, Artificial
  CRISPR gRNA sequence
gtttaaatacagaattattg

SEQ ID NO: 663701 - DNA, 20 bp, Artificial
  CRISPR gRNA sequence
aaatacagaattattgaaaa

SEQ ID NO: 663702 - DNA, 20 bp, Artificial
  CRISPR gRNA sequence
aatacagaattattgaaaac

SEQ ID NO: 663703 - DNA, 20 bp, Artificial
  CRISPR gRNA sequence
ttgaaaacatgaaaatcacc

SEQ ID NO: 663704 - DNA, 20 bp, Artificial
  CRISPR gRNA sequence
aaaacatgaaaatcaccact

SEQ ID NO: 663705 - DNA, 20 bp, Artificial
  CRISPR gRNA sequence
ctttaaaaatatgtattgta

SEQ ID NO: 663706 - DNA, 20 bp, Artificial
  CRISPR gRNA sequence
tttaaaaatatgtattgtat

SEQ ID NO: 663707 - DNA, 20 bp, Artificial
  CRISPR gRNA sequence
taaaaatatgtattgtatgt

SEQ ID NO: 663708 - DNA, 20 bp, Artificial
  CRISPR gRNA sequence
aaaaatatgtattgtatgtg

SEQ ID NO: 663709 - DNA, 20 bp, Artificial
  CRISPR gRNA sequence
aaaatatgtattgtatgtgc

SEQ ID NO: 663710 - DNA, 20 bp, Artificial
  CRISPR gRNA sequence
tatgtgcttctttcctggtt

SEQ ID NO: 663711 - DNA, 20 bp, Artificial
  CRISPR gRNA sequence
ctttcctggttttaccaaaa

SEQ ID NO: 663712 - DNA, 20 bp, Artificial
  CRISPR gRNA sequence
tttcctggttttaccaaaac

SEQ ID NO: 663713 - DNA, 20 bp, Artificial
  CRISPR gRNA sequence
tcctggttttaccaaaacaa

SEQ ID NO: 663714 - DNA, 20 bp, Artificial
  CRISPR gRNA sequence
cctggttttaccaaaacaag

SEQ ID NO: 663715 - DNA, 20 bp, Artificial
  CRISPR gRNA sequence
ctggttttaccaaaacaagt

SEQ ID NO: 663716 - DNA, 20 bp, Artificial
  CRISPR gRNA sequence
gttttaccaaaacaagtaaa

SEQ ID NO: 663717 - DNA, 20 bp, Artificial
  CRISPR gRNA sequence
taccaaaacaagtaaaaaag

SEQ ID NO: 663718 - DNA, 20 bp, Artificial
  CRISPR gRNA sequence
accaaaacaagtaaaaaaga

SEQ ID NO: 663719 - DNA, 20 bp, Artificial
  CRISPR gRNA sequence
ccaaaacaagtaaaaaagat

SEQ ID NO: 663720 - DNA, 20 bp, Artificial
  CRISPR gRNA sequence
aggtctacagcctgcaaatt

SEQ ID NO: 663721 - DNA, 20 bp, Artificial
  CRISPR gRNA sequence
ggtctacagcctgcaaattg

SEQ ID NO: 663722 - DNA, 20 bp, Artificial
  CRISPR gRNA sequence
cagcctgcaaattgcttcct

SEQ ID NO: 663723 - DNA, 20 bp, Artificial
  CRISPR gRNA sequence
caaattgcttcctgtttgct

SEQ ID NO: 663724 - DNA, 20 bp, Artificial
  CRISPR gRNA sequence
cttcctgtttgcttgcatgg

SEQ ID NO: 663725 - DNA, 20 bp, Artificial
  CRISPR gRNA sequence
cctgtttgcttgcatggtga

SEQ ID NO: 663726 - DNA, 20 bp, Artificial
  CRISPR gRNA sequence
ctgtttgcttgcatggtgac

SEQ ID NO: 663727 - DNA, 20 bp, Artificial
  CRISPR gRNA sequence
tttgcttgcatggtgacaat

SEQ ID NO: 663728 - DNA, 20 bp, Artificial
  CRISPR gRNA sequence
gcttgcatggtgacaatgtt

SEQ ID NO: 663729 - DNA, 20 bp, Artificial
  CRISPR gRNA sequence
cttgcatggtgacaatgttc

SEQ ID NO: 663730 - DNA, 20 bp, Artificial
  CRISPR gRNA sequence
gcatggtgacaatgttctaa

SEQ ID NO: 663731 - DNA, 20 bp, Artificial
  CRISPR gRNA sequence
catggtgacaatgttctaag

SEQ ID NO: 663732 - DNA, 20 bp, Artificial
  CRISPR gRNA sequence
taagtgccagttttgaatac

SEQ ID NO: 663733 - DNA, 20 bp, Artificial
  CRISPR gRNA sequence
agtgccagttttgaatacta

SEQ ID NO: 663734 - DNA, 20 bp, Artificial
  CRISPR gRNA sequence
tgaatactagtaacctgtca

SEQ ID NO: 663735 - DNA, 20 bp, Artificial
  CRISPR gRNA sequence
gaatactagtaacctgtcat

SEQ ID NO: 663736 - DNA, 20 bp, Artificial
  CRISPR gRNA sequence
aatactagtaacctgtcatg

SEQ ID NO: 663737 - DNA, 20 bp, Artificial
  CRISPR gRNA sequence
gtaacctgtcatggatcagt

SEQ ID NO: 663738 - DNA, 20 bp, Artificial
  CRISPR gRNA sequence
tcatggatcagttatctgaa

SEQ ID NO: 663739 - DNA, 20 bp, Artificial
  CRISPR gRNA sequence
tctgaaatggcaggtttatt

SEQ ID NO: 663740 - DNA, 20 bp, Artificial
  CRISPR gRNA sequence
aaatggcaggtttatttgtt

SEQ ID NO: 663741 - DNA, 20 bp, Artificial
  CRISPR gRNA sequence
atttgttatgggaggaatga

SEQ ID NO: 663742 - DNA, 20 bp, Artificial
  CRISPR gRNA sequence
tttgttatgggaggaatgac

SEQ ID NO: 663743 - DNA, 20 bp, Artificial
  CRISPR gRNA sequence
gttatgggaggaatgacatt

SEQ ID NO: 663744 - DNA, 20 bp, Artificial
  CRISPR gRNA sequence
ttatgggaggaatgacatta

SEQ ID NO: 663745 - DNA, 20 bp, Artificial
  CRISPR gRNA sequence
tgggaggaatgacattattt

SEQ ID NO: 663746 - DNA, 20 bp, Artificial
  CRISPR gRNA sequence
tttcctgtcctttagacaga

SEQ ID NO: 663747 - DNA, 20 bp, Artificial
  CRISPR gRNA sequence
cctgtcctttagacagagct

SEQ ID NO: 663748 - DNA, 20 bp, Artificial
  CRISPR gRNA sequence
ctgtcctttagacagagcta

SEQ ID NO: 663749 - DNA, 20 bp, Artificial
  CRISPR gRNA sequence
tcctttagacagagctaaag

SEQ ID NO: 663750 - DNA, 20 bp, Artificial
  CRISPR gRNA sequence
tagacagagctaaagtgaga

SEQ ID NO: 663751 - DNA, 20 bp, Artificial
  CRISPR gRNA sequence
agacagagctaaagtgagaa

SEQ ID NO: 663752 - DNA, 20 bp, Artificial
  CRISPR gRNA sequence
gacagagctaaagtgagaat

SEQ ID NO: 663753 - DNA, 20 bp, Artificial
  CRISPR gRNA sequence
aagtgagaataaagtagtaa

SEQ ID NO: 663754 - DNA, 20 bp, Artificial
  CRISPR gRNA sequence
ctttgcactctaggtgtgag

SEQ ID NO: 663755 - DNA, 20 bp, Artificial
  CRISPR gRNA sequence
tttgcactctaggtgtgagt

SEQ ID NO: 663756 - DNA, 20 bp, Artificial
  CRISPR gRNA sequence
tgcactctaggtgtgagtgt

SEQ ID NO: 663757 - DNA, 20 bp, Artificial
  CRISPR gRNA sequence
gcactctaggtgtgagtgta

SEQ ID NO: 663758 - DNA, 20 bp, Artificial
  CRISPR gRNA sequence
cactctaggtgtgagtgtac

SEQ ID NO: 663759 - DNA, 20 bp, Artificial
  CRISPR gRNA sequence
taggtgtgagtgtactatcg

SEQ ID NO: 663760 - DNA, 20 bp, Artificial
  CRISPR gRNA sequence
ggtgtgagtgtactatcgtt

SEQ ID NO: 663761 - DNA, 20 bp, Artificial
  CRISPR gRNA sequence
tcgttcgtgctactgatttg

SEQ ID NO: 663762 - DNA, 20 bp, Artificial
  CRISPR gRNA sequence
gtgctactgatttgattgcc

SEQ ID NO: 663763 - DNA, 20 bp, Artificial
  CRISPR gRNA sequence
ctgatttgattgccacagct

SEQ ID NO: 663764 - DNA, 20 bp, Artificial
  CRISPR gRNA sequence
atttgattgccacagctact

SEQ ID NO: 663765 - DNA, 20 bp, Artificial
  CRISPR gRNA sequence
gattgccacagctactatca

SEQ ID NO: 663766 - DNA, 20 bp, Artificial
  CRISPR gRNA sequence
attgccacagctactatcat

SEQ ID NO: 663767 - DNA, 20 bp, Artificial
  CRISPR gRNA sequence
ccacagctactatcattagc

SEQ ID NO: 663768 - DNA, 20 bp, Artificial
  CRISPR gRNA sequence
ctatcattagcatcttggac

SEQ ID NO: 663769 - DNA, 20 bp, Artificial
  CRISPR gRNA sequence
tcattagcatcttggaccaa

SEQ ID NO: 663770 - DNA, 20 bp, Artificial
  CRISPR gRNA sequence
gcatcttggaccaaacatgg

SEQ ID NO: 663771 - DNA, 20 bp, Artificial
  CRISPR gRNA sequence
ggaccaaacatggaacaagc

SEQ ID NO: 663772 - DNA, 20 bp, Artificial
  CRISPR gRNA sequence
gaccaaacatggaacaagct

SEQ ID NO: 663773 - DNA, 20 bp, Artificial
  CRISPR gRNA sequence
tactatatttcatgtatgat

SEQ ID NO: 663774 - DNA, 20 bp, Artificial
  CRISPR gRNA sequence
tatttcatgtatgatggaat

SEQ ID NO: 663775 - DNA, 20 bp, Artificial
  CRISPR gRNA sequence
catgtatgatggaatacaga

SEQ ID NO: 663776 - DNA, 20 bp, Artificial
  CRISPR gRNA sequence
atgtatgatggaatacagag

SEQ ID NO: 663777 - DNA, 20 bp, Artificial
  CRISPR gRNA sequence
attaaaaatactcttaaggt

SEQ ID NO: 663778 - DNA, 20 bp, Artificial
  CRISPR gRNA sequence
aaaatactcttaaggtgctg

SEQ ID NO: 663779 - DNA, 20 bp, Artificial
  CRISPR gRNA sequence
ttaaggtgctggattattca

SEQ ID NO: 663780 - DNA, 20 bp, Artificial
  CRISPR gRNA sequence
aaggtgctggattattcatt

SEQ ID NO: 663781 - DNA, 20 bp, Artificial
  CRISPR gRNA sequence
aggtgctggattattcattt

SEQ ID NO: 663782 - DNA, 20 bp, Artificial
  CRISPR gRNA sequence
gattattcatttgatagctg

SEQ ID NO: 663783 - DNA, 20 bp, Artificial
  CRISPR gRNA sequence
ttcatttgatagctgattgt

SEQ ID NO: 663784 - DNA, 20 bp, Artificial
  CRISPR gRNA sequence
atttgatagctgattgttat

SEQ ID NO: 663785 - DNA, 20 bp, Artificial
  CRISPR gRNA sequence
gatagctgattgttataaga

SEQ ID NO: 663786 - DNA, 20 bp, Artificial
  CRISPR gRNA sequence
atagctgattgttataagac

SEQ ID NO: 663787 - DNA, 20 bp, Artificial
  CRISPR gRNA sequence
attgttataagacgttaggg

SEQ ID NO: 663788 - DNA, 20 bp, Artificial
  CRISPR gRNA sequence
ttataagacgttagggtcgt

SEQ ID NO: 663789 - DNA, 20 bp, Artificial
  CRISPR gRNA sequence
taagacgttagggtcgtact

SEQ ID NO: 663790 - DNA, 20 bp, Artificial
  CRISPR gRNA sequence
gggtcgtactttcctttgtg

SEQ ID NO: 663791 - DNA, 20 bp, Artificial
  CRISPR gRNA sequence
tcctttgtggacataaacat

SEQ ID NO: 663792 - DNA, 20 bp, Artificial
  CRISPR gRNA sequence
cctttgtggacataaacatt

SEQ ID NO: 663793 - DNA, 20 bp, Artificial
  CRISPR gRNA sequence
ctttgtggacataaacattt

SEQ ID NO: 663794 - DNA, 20 bp, Artificial
  CRISPR gRNA sequence
tgtggacataaacattttta

SEQ ID NO: 663795 - DNA, 20 bp, Artificial
  CRISPR gRNA sequence
gtggacataaacatttttaa

SEQ ID NO: 663796 - DNA, 20 bp, Artificial
  CRISPR gRNA sequence
tggacataaacatttttaat

SEQ ID NO: 663797 - DNA, 20 bp, Artificial
  CRISPR gRNA sequence
ttaataattgctttttaaaa

SEQ ID NO: 663798 - DNA, 20 bp, Artificial
  CRISPR gRNA sequence
taataattgctttttaaaat

SEQ ID NO: 663799 - DNA, 20 bp, Artificial
  CRISPR gRNA sequence
aataattgctttttaaaatt

SEQ ID NO: 663800 - DNA, 20 bp, Artificial
  CRISPR gRNA sequence
ataattgctttttaaaatta

SEQ ID NO: 663801 - DNA, 20 bp, Artificial
  CRISPR gRNA sequence
ctttttaaaattaaatttaa

SEQ ID NO: 663802 - DNA, 20 bp, Artificial
  CRISPR gRNA sequence
tttaaaattaaatttaattt

SEQ ID NO: 663803 - DNA, 20 bp, Artificial
  CRISPR gRNA sequence
ttaaaattaaatttaatttg

SEQ ID NO: 663804 - DNA, 20 bp, Artificial
  CRISPR gRNA sequence
taaaattaaatttaatttgg

SEQ ID NO: 663805 - DNA, 20 bp, Artificial
  CRISPR gRNA sequence
aaaattaaatttaatttgga

SEQ ID NO: 663806 - DNA, 20 bp, Artificial
  CRISPR gRNA sequence
aaattaaatttaatttggag

SEQ ID NO: 663807 - DNA, 20 bp, Artificial
  CRISPR gRNA sequence
aatttaatttggagcctagg

SEQ ID NO: 663808 - DNA, 20 bp, Artificial
  CRISPR gRNA sequence
aatttggagcctaggtaagg

SEQ ID NO: 663809 - DNA, 20 bp, Artificial
  CRISPR gRNA sequence
atttggagcctaggtaagga

SEQ ID NO: 663810 - DNA, 20 bp, Artificial
  CRISPR gRNA sequence
ggagcctaggtaaggatttc

SEQ ID NO: 663811 - DNA, 20 bp, Artificial
  CRISPR gRNA sequence
gagcctaggtaaggatttcc

SEQ ID NO: 663812 - DNA, 20 bp, Artificial
  CRISPR gRNA sequence
ggtaaggatttccttcattt

SEQ ID NO: 663813 - DNA, 20 bp, Artificial
  CRISPR gRNA sequence
ccttcatttgaactaatttt

SEQ ID NO: 663814 - DNA, 20 bp, Artificial
  CRISPR gRNA sequence
cttcatttgaactaattttt

SEQ ID NO: 663815 - DNA, 20 bp, Artificial
  CRISPR gRNA sequence
catttgaactaatttttttt

SEQ ID NO: 663816 - DNA, 20 bp, Artificial
  CRISPR gRNA sequence
atttgaactaattttttttt

SEQ ID NO: 663817 - DNA, 20 bp, Artificial
  CRISPR gRNA sequence
gaactaattttttttttgta

SEQ ID NO: 663818 - DNA, 20 bp, Artificial
  CRISPR gRNA sequence
aactaattttttttttgtaa

SEQ ID NO: 663819 - DNA, 20 bp, Artificial
  CRISPR gRNA sequence
attttttttttgtaatctca

SEQ ID NO: 663820 - DNA, 20 bp, Artificial
  CRISPR gRNA sequence
tttttttgtaatctcagaat

SEQ ID NO: 663821 - DNA, 20 bp, Artificial
  CRISPR gRNA sequence
ttttttgtaatctcagaatt

SEQ ID NO: 663822 - DNA, 20 bp, Artificial
  CRISPR gRNA sequence
tttttgtaatctcagaatta

SEQ ID NO: 663823 - DNA, 20 bp, Artificial
  CRISPR gRNA sequence
ttttgtaatctcagaattat

SEQ ID NO: 663824 - DNA, 20 bp, Artificial
  CRISPR gRNA sequence
tttgtaatctcagaattatc

SEQ ID NO: 663825 - DNA, 20 bp, Artificial
  CRISPR gRNA sequence
ttgtaatctcagaattatct

SEQ ID NO: 663826 - DNA, 20 bp, Artificial
  CRISPR gRNA sequence
tgtaatctcagaattatctt

SEQ ID NO: 663827 - DNA, 20 bp, Artificial
  CRISPR gRNA sequence
gtaatctcagaattatctta

SEQ ID NO: 663828 - DNA, 20 bp, Artificial
  CRISPR gRNA sequence
taatctcagaattatcttaa

SEQ ID NO: 663829 - DNA, 20 bp, Artificial
  CRISPR gRNA sequence
agaattatcttaatagtagg

SEQ ID NO: 663830 - DNA, 20 bp, Artificial
  CRISPR gRNA sequence
tcttaatagtaggtagtgtc

SEQ ID NO: 663831 - DNA, 20 bp, Artificial
  CRISPR gRNA sequence
aatagtaggtagtgtcagtt

SEQ ID NO: 663832 - DNA, 20 bp, Artificial
  CRISPR gRNA sequence
atagtaggtagtgtcagttg

SEQ ID NO: 663833 - DNA, 20 bp, Artificial
  CRISPR gRNA sequence
ccagaaaaacatcaatgtga

SEQ ID NO: 663834 - DNA, 20 bp, Artificial
  CRISPR gRNA sequence
gtatatcataattctttcct

SEQ ID NO: 663835 - DNA, 20 bp, Artificial
  CRISPR gRNA sequence
tatatcataattctttccta

SEQ ID NO: 663836 - DNA, 20 bp, Artificial
  CRISPR gRNA sequence
tttcctagtgttttctttag

SEQ ID NO: 663837 - DNA, 20 bp, Artificial
  CRISPR gRNA sequence
tcctagtgttttctttaggc

SEQ ID NO: 663838 - DNA, 20 bp, Artificial
  CRISPR gRNA sequence
cctagtgttttctttaggca

SEQ ID NO: 663839 - DNA, 20 bp, Artificial
  CRISPR gRNA sequence
ctagtgttttctttaggcag

SEQ ID NO: 663840 - DNA, 20 bp, Artificial
  CRISPR gRNA sequence
gtgttttctttaggcagact

SEQ ID NO: 663841 - DNA, 20 bp, Artificial
  CRISPR gRNA sequence
tctttaggcagactacagtg

SEQ ID NO: 663842 - DNA, 20 bp, Artificial
  CRISPR gRNA sequence
ctttaggcagactacagtga

SEQ ID NO: 663843 - DNA, 20 bp, Artificial
  CRISPR gRNA sequence
tttaggcagactacagtgaa

SEQ ID NO: 663844 - DNA, 20 bp, Artificial
  CRISPR gRNA sequence
taggcagactacagtgaacg

SEQ ID NO: 663845 - DNA, 20 bp, Artificial
  CRISPR gRNA sequence
aggcagactacagtgaacgt

SEQ ID NO: 663846 - DNA, 20 bp, Artificial
  CRISPR gRNA sequence
ggcagactacagtgaacgta

SEQ ID NO: 663847 - DNA, 20 bp, Artificial
  CRISPR gRNA sequence
cagtgaacgtatctattcta

SEQ ID NO: 663848 - DNA, 20 bp, Artificial
  CRISPR gRNA sequence
ttctaattctcattcctttt

SEQ ID NO: 663849 - DNA, 20 bp, Artificial
  CRISPR gRNA sequence
taattctcattccttttctg

SEQ ID NO: 663850 - DNA, 20 bp, Artificial
  CRISPR gRNA sequence
attctcattccttttctgga

SEQ ID NO: 663851 - DNA, 20 bp, Artificial
  CRISPR gRNA sequence
tcattccttttctggataac

SEQ ID NO: 663852 - DNA, 20 bp, Artificial
  CRISPR gRNA sequence
attccttttctggataacca

SEQ ID NO: 663853 - DNA, 20 bp, Artificial
  CRISPR gRNA sequence
cttttctggataaccatagg

SEQ ID NO: 663854 - DNA, 20 bp, Artificial
  CRISPR gRNA sequence
ttctggataaccataggtaa

SEQ ID NO: 663855 - DNA, 20 bp, Artificial
  CRISPR gRNA sequence
tctggataaccataggtaaa

SEQ ID NO: 663856 - DNA, 20 bp, Artificial
  CRISPR gRNA sequence
ctggataaccataggtaaag

SEQ ID NO: 663857 - DNA, 20 bp, Artificial
  CRISPR gRNA sequence
tggataaccataggtaaagg

SEQ ID NO: 663858 - DNA, 20 bp, Artificial
  CRISPR gRNA sequence
gataaccataggtaaaggta

SEQ ID NO: 663859 - DNA, 20 bp, Artificial
  CRISPR gRNA sequence
ttaatttgacctctgaaaga

SEQ ID NO: 663860 - DNA, 20 bp, Artificial
  CRISPR gRNA sequence
taatttgacctctgaaagaa

SEQ ID NO: 663861 - DNA, 20 bp, Artificial
  CRISPR gRNA sequence
aatttgacctctgaaagaag

SEQ ID NO: 663862 - DNA, 20 bp, Artificial
  CRISPR gRNA sequence
atttgacctctgaaagaaga

SEQ ID NO: 663863 - DNA, 20 bp, Artificial
  CRISPR gRNA sequence
gacctctgaaagaagaaaaa

SEQ ID NO: 663864 - DNA, 20 bp, Artificial
  CRISPR gRNA sequence
acctctgaaagaagaaaaag

SEQ ID NO: 663865 - DNA, 20 bp, Artificial
  CRISPR gRNA sequence
tgaaagaagaaaaagttttt

SEQ ID NO: 663866 - DNA, 20 bp, Artificial
  CRISPR gRNA sequence
aaagaagaaaaagtttttcc

SEQ ID NO: 663867 - DNA, 20 bp, Artificial
  CRISPR gRNA sequence
ttccaggttggagaaataat

SEQ ID NO: 663868 - DNA, 20 bp, Artificial
  CRISPR gRNA sequence
tccaggttggagaaataatg

SEQ ID NO: 663869 - DNA, 20 bp, Artificial
  CRISPR gRNA sequence
ccaggttggagaaataatga

SEQ ID NO: 663870 - DNA, 20 bp, Artificial
  CRISPR gRNA sequence
caggttggagaaataatgag

SEQ ID NO: 663871 - DNA, 20 bp, Artificial
  CRISPR gRNA sequence
gagaaataatgagtaatgct

SEQ ID NO: 663872 - DNA, 20 bp, Artificial
  CRISPR gRNA sequence
gttagagactgcctctcatc

SEQ ID NO: 663873 - DNA, 20 bp, Artificial
  CRISPR gRNA sequence
gagactgcctctcatcttct

SEQ ID NO: 663874 - DNA, 20 bp, Artificial
  CRISPR gRNA sequence
cctctcatcttcttctcaaa

SEQ ID NO: 663875 - DNA, 20 bp, Artificial
  CRISPR gRNA sequence
tcatcttcttctcaaatctt

SEQ ID NO: 663876 - DNA, 20 bp, Artificial
  CRISPR gRNA sequence
atcttcttctcaaatcttag

SEQ ID NO: 663877 - DNA, 20 bp, Artificial
  CRISPR gRNA sequence
cttctcaaatcttagtcact

SEQ ID NO: 663878 - DNA, 20 bp, Artificial
  CRISPR gRNA sequence
ttctcaaatcttagtcacta

SEQ ID NO: 663879 - DNA, 20 bp, Artificial
  CRISPR gRNA sequence
ctcaaatcttagtcactacc

SEQ ID NO: 663880 - DNA, 20 bp, Artificial
  CRISPR gRNA sequence
tcaaatcttagtcactacct

SEQ ID NO: 663881 - DNA, 20 bp, Artificial
  CRISPR gRNA sequence
aaatcttagtcactacctat

SEQ ID NO: 663882 - DNA, 20 bp, Artificial
  CRISPR gRNA sequence
agtcactacctattctagtg

SEQ ID NO: 663883 - DNA, 20 bp, Artificial
  CRISPR gRNA sequence
gtcactacctattctagtgt

SEQ ID NO: 663884 - DNA, 20 bp, Artificial
  CRISPR gRNA sequence
cctattctagtgtttaaata

SEQ ID NO: 663885 - DNA, 20 bp, Artificial
  CRISPR gRNA sequence
ttctagtgtttaaataacta

SEQ ID NO: 663886 - DNA, 20 bp, Artificial
  CRISPR gRNA sequence
tagtgtttaaataactaatg

SEQ ID NO: 663887 - DNA, 20 bp, Artificial
  CRISPR gRNA sequence
gtgtttaaataactaatgaa

SEQ ID NO: 663888 - DNA, 20 bp, Artificial
  CRISPR gRNA sequence
aaataactaatgaaaacatt

SEQ ID NO: 663889 - DNA, 20 bp, Artificial
  CRISPR gRNA sequence
aataactaatgaaaacattt

SEQ ID NO: 663890 - DNA, 20 bp, Artificial
  CRISPR gRNA sequence
atgaaaacatttttatggtt

SEQ ID NO: 663891 - DNA, 20 bp, Artificial
  CRISPR gRNA sequence
ttatggtttctgagattttt

SEQ ID NO: 663892 - DNA, 20 bp, Artificial
  CRISPR gRNA sequence
tatggtttctgagatttttt

SEQ ID NO: 663893 - DNA, 20 bp, Artificial
  CRISPR gRNA sequence
atggtttctgagattttttt

SEQ ID NO: 663894 - DNA, 20 bp, Artificial
  CRISPR gRNA sequence
tggtttctgagatttttttt

SEQ ID NO: 663895 - DNA, 20 bp, Artificial
  CRISPR gRNA sequence
ctgagattttttttaaagca

SEQ ID NO: 663896 - DNA, 20 bp, Artificial
  CRISPR gRNA sequence
tgagattttttttaaagcag

SEQ ID NO: 663897 - DNA, 20 bp, Artificial
  CRISPR gRNA sequence
agattttttttaaagcaggc

SEQ ID NO: 663898 - DNA, 20 bp, Artificial
  CRISPR gRNA sequence
tttttaaagcaggcttgaaa

SEQ ID NO: 663899 - DNA, 20 bp, Artificial
  CRISPR gRNA sequence
ttttaaagcaggcttgaaag

SEQ ID NO: 663900 - DNA, 20 bp, Artificial
  CRISPR gRNA sequence
tttaaagcaggcttgaaaga

SEQ ID NO: 663901 - DNA, 20 bp, Artificial
  CRISPR gRNA sequence
ttaaagcaggcttgaaagat

SEQ ID NO: 663902 - DNA, 20 bp, Artificial
  CRISPR gRNA sequence
taaagcaggcttgaaagata

SEQ ID NO: 663903 - DNA, 20 bp, Artificial
  CRISPR gRNA sequence
aaagcaggcttgaaagatat

SEQ ID NO: 663904 - DNA, 20 bp, Artificial
  CRISPR gRNA sequence
aagcaggcttgaaagatatg

SEQ ID NO: 663905 - DNA, 20 bp, Artificial
  CRISPR gRNA sequence
gaaagatatgaagtaattta

SEQ ID NO: 663906 - DNA, 20 bp, Artificial
  CRISPR gRNA sequence
aaagatatgaagtaatttac

SEQ ID NO: 663907 - DNA, 20 bp, Artificial
  CRISPR gRNA sequence
actgataaaccaaattttaa

SEQ ID NO: 663908 - DNA, 20 bp, Artificial
  CRISPR gRNA sequence
ctgataaaccaaattttaac

SEQ ID NO: 663909 - DNA, 20 bp, Artificial
  CRISPR gRNA sequence
ataaaccaaattttaacatt

SEQ ID NO: 663910 - DNA, 20 bp, Artificial
  CRISPR gRNA sequence
taacattatagacataagaa

SEQ ID NO: 663911 - DNA, 20 bp, Artificial
  CRISPR gRNA sequence
aacattatagacataagaat

SEQ ID NO: 663912 - DNA, 20 bp, Artificial
  CRISPR gRNA sequence
acattatagacataagaatg

SEQ ID NO: 663913 - DNA, 20 bp, Artificial
  CRISPR gRNA sequence
tagacataagaatgttgtct

SEQ ID NO: 663914 - DNA, 20 bp, Artificial
  CRISPR gRNA sequence
tctgtccatctcattttgtt

SEQ ID NO: 663915 - DNA, 20 bp, Artificial
  CRISPR gRNA sequence
tccatctcattttgtttcat

SEQ ID NO: 663916 - DNA, 20 bp, Artificial
  CRISPR gRNA sequence
attttgtttcattgtaatat

SEQ ID NO: 663917 - DNA, 20 bp, Artificial
  CRISPR gRNA sequence
tgtttcattgtaatattttt

SEQ ID NO: 663918 - DNA, 20 bp, Artificial
  CRISPR gRNA sequence
gtttcattgtaatatttttc

SEQ ID NO: 663919 - DNA, 20 bp, Artificial
  CRISPR gRNA sequence
tttcattgtaatatttttcc

SEQ ID NO: 663920 - DNA, 20 bp, Artificial
  CRISPR gRNA sequence
cattgtaatatttttcctca

SEQ ID NO: 663921 - DNA, 20 bp, Artificial
  CRISPR gRNA sequence
attgtaatatttttcctcat

SEQ ID NO: 663922 - DNA, 20 bp, Artificial
  CRISPR gRNA sequence
taatatttttcctcataggt

SEQ ID NO: 663923 - DNA, 20 bp, Artificial
  CRISPR gRNA sequence
ttcctcataggtatagggaa

SEQ ID NO: 663924 - DNA, 20 bp, Artificial
  CRISPR gRNA sequence
tcctcataggtatagggaaa

SEQ ID NO: 663925 - DNA, 20 bp, Artificial
  CRISPR gRNA sequence
cctcataggtatagggaaaa

SEQ ID NO: 663926 - DNA, 20 bp, Artificial
  CRISPR gRNA sequence
ctcataggtatagggaaaat

SEQ ID NO: 663927 - DNA, 20 bp, Artificial
  CRISPR gRNA sequence
ataggtatagggaaaatagg

SEQ ID NO: 663928 - DNA, 20 bp, Artificial
  CRISPR gRNA sequence
tgtttagtcaacaaagggtt

SEQ ID NO: 663929 - DNA, 20 bp, Artificial
  CRISPR gRNA sequence
gtttagtcaacaaagggttg

SEQ ID NO: 663930 - DNA, 20 bp, Artificial
  CRISPR gRNA sequence
tttagtcaacaaagggttgt

SEQ ID NO: 663931 - DNA, 20 bp, Artificial
  CRISPR gRNA sequence
agtcaacaaagggttgtctc

SEQ ID NO: 663932 - DNA, 20 bp, Artificial
  CRISPR gRNA sequence
gtcaacaaagggttgtctct

SEQ ID NO: 663933 - DNA, 20 bp, Artificial
  CRISPR gRNA sequence
tctcttctctctctctctct

SEQ ID NO: 663934 - DNA, 20 bp, Artificial
  CRISPR gRNA sequence
ttctctctctctctctttct

SEQ ID NO: 663935 - DNA, 20 bp, Artificial
  CRISPR gRNA sequence
ctctctctctctctttcttt

SEQ ID NO: 663936 - DNA, 20 bp, Artificial
  CRISPR gRNA sequence
tctctctctctctttctttc

SEQ ID NO: 663937 - DNA, 20 bp, Artificial
  CRISPR gRNA sequence
tctctctctctttctttctc

SEQ ID NO: 663938 - DNA, 20 bp, Artificial
  CRISPR gRNA sequence
tctctctctttctttctctc

SEQ ID NO: 663939 - DNA, 20 bp, Artificial
  CRISPR gRNA sequence
tctctctttctttctctctc

SEQ ID NO: 663940 - DNA, 20 bp, Artificial
  CRISPR gRNA sequence
tctctttctttctctctctc

SEQ ID NO: 663941 - DNA, 20 bp, Artificial
  CRISPR gRNA sequence
tctttctttctctctctctt

SEQ ID NO: 663942 - DNA, 20 bp, Artificial
  CRISPR gRNA sequence
tttctttctctctctctttc

SEQ ID NO: 663943 - DNA, 20 bp, Artificial
  CRISPR gRNA sequence
tctttctctctctctttcta

SEQ ID NO: 663944 - DNA, 20 bp, Artificial
  CRISPR gRNA sequence
ctttctctctctctttctac

SEQ ID NO: 663945 - DNA, 20 bp, Artificial
  CRISPR gRNA sequence
tttctctctctctttctacc

SEQ ID NO: 663946 - DNA, 20 bp, Artificial
  CRISPR gRNA sequence
tctctctctctttctaccat

SEQ ID NO: 663947 - DNA, 20 bp, Artificial
  CRISPR gRNA sequence
ctctctctctttctaccatg

SEQ ID NO: 663948 - DNA, 20 bp, Artificial
  CRISPR gRNA sequence
tctctctctttctaccatgg

SEQ ID NO: 663949 - DNA, 20 bp, Artificial
  CRISPR gRNA sequence
tctctctttctaccatggca

SEQ ID NO: 663950 - DNA, 20 bp, Artificial
  CRISPR gRNA sequence
tctctttctaccatggcagc

SEQ ID NO: 663951 - DNA, 20 bp, Artificial
  CRISPR gRNA sequence
tctttctaccatggcagccc

SEQ ID NO: 663952 - DNA, 20 bp, Artificial
  CRISPR gRNA sequence
tttctaccatggcagcccaa

SEQ ID NO: 663953 - DNA, 20 bp, Artificial
  CRISPR gRNA sequence
tctaccatggcagcccaagt

SEQ ID NO: 663954 - DNA, 20 bp, Artificial
  CRISPR gRNA sequence
ctaccatggcagcccaagta

SEQ ID NO: 663955 - DNA, 20 bp, Artificial
  CRISPR gRNA sequence
taccatggcagcccaagtag

SEQ ID NO: 663956 - DNA, 20 bp, Artificial
  CRISPR gRNA sequence
ccatggcagcccaagtaggg

SEQ ID NO: 663957 - DNA, 20 bp, Artificial
  CRISPR gRNA sequence
aaccgtgtaggtaggatctg

SEQ ID NO: 663958 - DNA, 20 bp, Artificial
  CRISPR gRNA sequence
tattattaattttcattatg

SEQ ID NO: 663959 - DNA, 20 bp, Artificial
  CRISPR gRNA sequence
ttaattttcattatgccaaa

SEQ ID NO: 663960 - DNA, 20 bp, Artificial
  CRISPR gRNA sequence
attttcattatgccaaaact

SEQ ID NO: 663961 - DNA, 20 bp, Artificial
  CRISPR gRNA sequence
tcattatgccaaaactgaca

SEQ ID NO: 663962 - DNA, 20 bp, Artificial
  CRISPR gRNA sequence
cattatgccaaaactgacaa

SEQ ID NO: 663963 - DNA, 20 bp, Artificial
  CRISPR gRNA sequence
attatgccaaaactgacaaa

SEQ ID NO: 663964 - DNA, 20 bp, Artificial
  CRISPR gRNA sequence
tgccaaaactgacaaaacat

SEQ ID NO: 663965 - DNA, 20 bp, Artificial
  CRISPR gRNA sequence
acaaaacattacgttgaaat

SEQ ID NO: 663966 - DNA, 20 bp, Artificial
  CRISPR gRNA sequence
cgttgaaatcataaagcact

SEQ ID NO: 663967 - DNA, 20 bp, Artificial
  CRISPR gRNA sequence
aaatcataaagcactagaaa

SEQ ID NO: 663968 - DNA, 20 bp, Artificial
  CRISPR gRNA sequence
gaaaagcaaatacctagaaa

SEQ ID NO: 663969 - DNA, 20 bp, Artificial
  CRISPR gRNA sequence
gaaagtattatctgttctgt

SEQ ID NO: 663970 - DNA, 20 bp, Artificial
  CRISPR gRNA sequence
tctgttctgtaagaaaaaca

SEQ ID NO: 663971 - DNA, 20 bp, Artificial
  CRISPR gRNA sequence
ttctgtaagaaaaacaacaa

SEQ ID NO: 663972 - DNA, 20 bp, Artificial
  CRISPR gRNA sequence
tgtaagaaaaacaacaagct

SEQ ID NO: 663973 - DNA, 20 bp, Artificial
  CRISPR gRNA sequence
taagaaaaacaacaagctaa

SEQ ID NO: 663974 - DNA, 20 bp, Artificial
  CRISPR gRNA sequence
aacattttaatatattattg

SEQ ID NO: 663975 - DNA, 20 bp, Artificial
  CRISPR gRNA sequence
taatatattattgagtttgt

SEQ ID NO: 663976 - DNA, 20 bp, Artificial
  CRISPR gRNA sequence
aatatattattgagtttgtt

SEQ ID NO: 663977 - DNA, 20 bp, Artificial
  CRISPR gRNA sequence
atatattattgagtttgttg

SEQ ID NO: 663978 - DNA, 20 bp, Artificial
  CRISPR gRNA sequence
ttgagtttgttggatttata

SEQ ID NO: 663979 - DNA, 20 bp, Artificial
  CRISPR gRNA sequence
agtttgttggatttataata

SEQ ID NO: 663980 - DNA, 20 bp, Artificial
  CRISPR gRNA sequence
gttggatttataatattggg

SEQ ID NO: 663981 - DNA, 20 bp, Artificial
  CRISPR gRNA sequence
ttggatttataatattggga

SEQ ID NO: 663982 - DNA, 20 bp, Artificial
  CRISPR gRNA sequence
gatttataatattgggactt

SEQ ID NO: 663983 - DNA, 20 bp, Artificial
  CRISPR gRNA sequence
ataatattgggacttctctt

SEQ ID NO: 663984 - DNA, 20 bp, Artificial
  CRISPR gRNA sequence
taatattgggacttctcttt

SEQ ID NO: 663985 - DNA, 20 bp, Artificial
  CRISPR gRNA sequence
ggacttctctttatacaagt

SEQ ID NO: 663986 - DNA, 20 bp, Artificial
  CRISPR gRNA sequence
ctctttatacaagtacctgg

SEQ ID NO: 663987 - DNA, 20 bp, Artificial
  CRISPR gRNA sequence
tctttatacaagtacctggc

SEQ ID NO: 663988 - DNA, 20 bp, Artificial
  CRISPR gRNA sequence
tttatacaagtacctggcct

SEQ ID NO: 663989 - DNA, 20 bp, Artificial
  CRISPR gRNA sequence
tatacaagtacctggccttt

SEQ ID NO: 663990 - DNA, 20 bp, Artificial
  CRISPR gRNA sequence
atacaagtacctggccttta

SEQ ID NO: 663991 - DNA, 20 bp, Artificial
  CRISPR gRNA sequence
tacaagtacctggcctttaa

SEQ ID NO: 663992 - DNA, 20 bp, Artificial
  CRISPR gRNA sequence
gcctttaaaaagaaatacta

SEQ ID NO: 663993 - DNA, 20 bp, Artificial
  CRISPR gRNA sequence
taaaaagaaatactacctag

SEQ ID NO: 663994 - DNA, 20 bp, Artificial
  CRISPR gRNA sequence
aaaaagaaatactacctaga

SEQ ID NO: 663995 - DNA, 20 bp, Artificial
  CRISPR gRNA sequence
aaaagaaatactacctagag

SEQ ID NO: 663996 - DNA, 20 bp, Artificial
  CRISPR gRNA sequence
cctagagtagccacaggtac

SEQ ID NO: 663997 - DNA, 20 bp, Artificial
  CRISPR gRNA sequence
gagtagccacaggtactgtt

SEQ ID NO: 663998 - DNA, 20 bp, Artificial
  CRISPR gRNA sequence
ttaatgttgccaagtattcc

SEQ ID NO: 663999 - DNA, 20 bp, Artificial
  CRISPR gRNA sequence
atgttgccaagtattcctaa

SEQ ID NO: 664000 - DNA, 20 bp, Artificial
  CRISPR gRNA sequence
ccaagtattcctaagtatat

SEQ ID NO: 664001 - DNA, 20 bp, Artificial
  CRISPR gRNA sequence
ctaagtatattgtagttaga

SEQ ID NO: 664002 - DNA, 20 bp, Artificial
  CRISPR gRNA sequence
agtatattgtagttagatta

SEQ ID NO: 664003 - DNA, 20 bp, Artificial
  CRISPR gRNA sequence
tagttagattagtgtgagga

SEQ ID NO: 664004 - DNA, 20 bp, Artificial
  CRISPR gRNA sequence
gattagtgtgaggaacttcc

SEQ ID NO: 664005 - DNA, 20 bp, Artificial
  CRISPR gRNA sequence
gtgtgaggaacttccttaaa

SEQ ID NO: 664006 - DNA, 20 bp, Artificial
  CRISPR gRNA sequence
ccttaaaaaatttaagtgta

SEQ ID NO: 664007 - DNA, 20 bp, Artificial
  CRISPR gRNA sequence
cttaaaaaatttaagtgtaa

SEQ ID NO: 664008 - DNA, 20 bp, Artificial
  CRISPR gRNA sequence
aaaaaatttaagtgtaaacc

SEQ ID NO: 664009 - DNA, 20 bp, Artificial
  CRISPR gRNA sequence
aaaaatttaagtgtaaacct

SEQ ID NO: 664010 - DNA, 20 bp, Artificial
  CRISPR gRNA sequence
aagtgtaaacctgtaaggtt

SEQ ID NO: 664011 - DNA, 20 bp, Artificial
  CRISPR gRNA sequence
agtgtaaacctgtaaggtta

SEQ ID NO: 664012 - DNA, 20 bp, Artificial
  CRISPR gRNA sequence
taaggttactcttattggtt

SEQ ID NO: 664013 - DNA, 20 bp, Artificial
  CRISPR gRNA sequence
ctcttattggttgtttttca

SEQ ID NO: 664014 - DNA, 20 bp, Artificial
  CRISPR gRNA sequence
ttattggttgtttttcatag

SEQ ID NO: 664015 - DNA, 20 bp, Artificial
  CRISPR gRNA sequence
attggttgtttttcatagtt

SEQ ID NO: 664016 - DNA, 20 bp, Artificial
  CRISPR gRNA sequence
ttggttgtttttcatagttt

SEQ ID NO: 664017 - DNA, 20 bp, Artificial
  CRISPR gRNA sequence
gttgtttttcatagtttatt

SEQ ID NO: 664018 - DNA, 20 bp, Artificial
  CRISPR gRNA sequence
tttttcatagtttatttagt

SEQ ID NO: 664019 - DNA, 20 bp, Artificial
  CRISPR gRNA sequence
ttcatagtttatttagtgac

SEQ ID NO: 664020 - DNA, 20 bp, Artificial
  CRISPR gRNA sequence
tcatagtttatttagtgact

SEQ ID NO: 664021 - DNA, 20 bp, Artificial
  CRISPR gRNA sequence
catagtttatttagtgacta

SEQ ID NO: 664022 - DNA, 20 bp, Artificial
  CRISPR gRNA sequence
atagtttatttagtgactat

SEQ ID NO: 664023 - DNA, 20 bp, Artificial
  CRISPR gRNA sequence
atttagtgactattgcacgg

SEQ ID NO: 664024 - DNA, 20 bp, Artificial
  CRISPR gRNA sequence
tttagtgactattgcacggt

SEQ ID NO: 664025 - DNA, 20 bp, Artificial
  CRISPR gRNA sequence
agtgactattgcacggtaat

SEQ ID NO: 664026 - DNA, 20 bp, Artificial
  CRISPR gRNA sequence
gtgactattgcacggtaatg

SEQ ID NO: 664027 - DNA, 20 bp, Artificial
  CRISPR gRNA sequence
ttgcacggtaatgctttgta

SEQ ID NO: 664028 - DNA, 20 bp, Artificial
  CRISPR gRNA sequence
cacggtaatgctttgtatta

SEQ ID NO: 664029 - DNA, 20 bp, Artificial
  CRISPR gRNA sequence
tgtattagatcaacattaag

SEQ ID NO: 664030 - DNA, 20 bp, Artificial
  CRISPR gRNA sequence
gtattagatcaacattaagt

SEQ ID NO: 664031 - DNA, 20 bp, Artificial
  CRISPR gRNA sequence
tattagatcaacattaagtt

SEQ ID NO: 664032 - DNA, 20 bp, Artificial
  CRISPR gRNA sequence
gatcaacattaagttagaat

SEQ ID NO: 664033 - DNA, 20 bp, Artificial
  CRISPR gRNA sequence
agttagaattcagtggctgt

SEQ ID NO: 664034 - DNA, 20 bp, Artificial
  CRISPR gRNA sequence
gaattcagtggctgtattaa

SEQ ID NO: 664035 - DNA, 20 bp, Artificial
  CRISPR gRNA sequence
agtggctgtattaaatagcc

SEQ ID NO: 664036 - DNA, 20 bp, Artificial
  CRISPR gRNA sequence
tattaaatagccttttaaga

SEQ ID NO: 664037 - DNA, 20 bp, Artificial
  CRISPR gRNA sequence
aatagccttttaagacagta

SEQ ID NO: 664038 - DNA, 20 bp, Artificial
  CRISPR gRNA sequence
ttaagacagtatgttaaata

SEQ ID NO: 664039 - DNA, 20 bp, Artificial
  CRISPR gRNA sequence
taagacagtatgttaaatac

SEQ ID NO: 664040 - DNA, 20 bp, Artificial
  CRISPR gRNA sequence
aagacagtatgttaaatacg

SEQ ID NO: 664041 - DNA, 20 bp, Artificial
  CRISPR gRNA sequence
agacagtatgttaaatacgt

SEQ ID NO: 664042 - DNA, 20 bp, Artificial
  CRISPR gRNA sequence
aatacgtggctttcaccaag

SEQ ID NO: 664043 - DNA, 20 bp, Artificial
  CRISPR gRNA sequence
tcaccaaggggcccctatgg

SEQ ID NO: 664044 - DNA, 20 bp, Artificial
  CRISPR gRNA sequence
caccaaggggcccctatggt

SEQ ID NO: 664045 - DNA, 20 bp, Artificial
  CRISPR gRNA sequence
accaaggggcccctatggta

SEQ ID NO: 664046 - DNA, 20 bp, Artificial
  CRISPR gRNA sequence
tggtattttggcaattttac

SEQ ID NO: 664047 - DNA, 20 bp, Artificial
  CRISPR gRNA sequence
tggcaattttactatttttt

SEQ ID NO: 664048 - DNA, 20 bp, Artificial
  CRISPR gRNA sequence
ggcaattttactatttttta

SEQ ID NO: 664049 - DNA, 20 bp, Artificial
  CRISPR gRNA sequence
gcaattttactattttttaa

SEQ ID NO: 664050 - DNA, 20 bp, Artificial
  CRISPR gRNA sequence
tactattttttaaaattcat

SEQ ID NO: 664051 - DNA, 20 bp, Artificial
  CRISPR gRNA sequence
actattttttaaaattcata

SEQ ID NO: 664052 - DNA, 20 bp, Artificial
  CRISPR gRNA sequence
ctattttttaaaattcatac

SEQ ID NO: 664053 - DNA, 20 bp, Artificial
  CRISPR gRNA sequence
ttttttaaaattcataccta

SEQ ID NO: 664054 - DNA, 20 bp, Artificial
  CRISPR gRNA sequence
tttaaaattcatacctagtt

SEQ ID NO: 664055 - DNA, 20 bp, Artificial
  CRISPR gRNA sequence
ttaaaattcatacctagttt

SEQ ID NO: 664056 - DNA, 20 bp, Artificial
  CRISPR gRNA sequence
taaaattcatacctagtttg

SEQ ID NO: 664057 - DNA, 20 bp, Artificial
  CRISPR gRNA sequence
aaaattcatacctagtttga

SEQ ID NO: 664058 - DNA, 20 bp, Artificial
  CRISPR gRNA sequence
aaattcatacctagtttgaa

SEQ ID NO: 664059 - DNA, 20 bp, Artificial
  CRISPR gRNA sequence
atacctagtttgaattgaga

SEQ ID NO: 664060 - DNA, 20 bp, Artificial
  CRISPR gRNA sequence
gtttgaattgagattcatgt

SEQ ID NO: 664061 - DNA, 20 bp, Artificial
  CRISPR gRNA sequence
gaattgagattcatgtaagt

SEQ ID NO: 664062 - DNA, 20 bp, Artificial
  CRISPR gRNA sequence
aattgagattcatgtaagtg

SEQ ID NO: 664063 - DNA, 20 bp, Artificial
  CRISPR gRNA sequence
agattcatgtaagtgaaaca

SEQ ID NO: 664064 - DNA, 20 bp, Artificial
  CRISPR gRNA sequence
atgtaagtgaaacaccatta

SEQ ID NO: 664065 - DNA, 20 bp, Artificial
  CRISPR gRNA sequence
ataaggatttttagttttaa

SEQ ID NO: 664066 - DNA, 20 bp, Artificial
  CRISPR gRNA sequence
ttagttttaaattttagttt

SEQ ID NO: 664067 - DNA, 20 bp, Artificial
  CRISPR gRNA sequence
tagttttaaattttagtttg

SEQ ID NO: 664068 - DNA, 20 bp, Artificial
  CRISPR gRNA sequence
agttttaaattttagtttgt

SEQ ID NO: 664069 - DNA, 20 bp, Artificial
  CRISPR gRNA sequence
gttttaaattttagtttgtt

SEQ ID NO: 664070 - DNA, 20 bp, Artificial
  CRISPR gRNA sequence
taaattttagtttgttttat

SEQ ID NO: 664071 - DNA, 20 bp, Artificial
  CRISPR gRNA sequence
aaattttagtttgttttatt

SEQ ID NO: 664072 - DNA, 20 bp, Artificial
  CRISPR gRNA sequence
aattttagtttgttttatta

SEQ ID NO: 664073 - DNA, 20 bp, Artificial
  CRISPR gRNA sequence
tagtttgttttattataaaa

SEQ ID NO: 664074 - DNA, 20 bp, Artificial
  CRISPR gRNA sequence
agtttgttttattataaaat

SEQ ID NO: 664075 - DNA, 20 bp, Artificial
  CRISPR gRNA sequence
gtttgttttattataaaata

SEQ ID NO: 664076 - DNA, 20 bp, Artificial
  CRISPR gRNA sequence
gttttattataaaatagtca

SEQ ID NO: 664077 - DNA, 20 bp, Artificial
  CRISPR gRNA sequence
ttttattataaaatagtcaa

SEQ ID NO: 664078 - DNA, 20 bp, Artificial
  CRISPR gRNA sequence
tattataaaatagtcaatat

SEQ ID NO: 664079 - DNA, 20 bp, Artificial
  CRISPR gRNA sequence
attataaaatagtcaatatc

SEQ ID NO: 664080 - DNA, 20 bp, Artificial
  CRISPR gRNA sequence
ttataaaatagtcaatatct

SEQ ID NO: 664081 - DNA, 20 bp, Artificial
  CRISPR gRNA sequence
taaaatagtcaatatctatc

SEQ ID NO: 664082 - DNA, 20 bp, Artificial
  CRISPR gRNA sequence
tcattcttaaaatcaagtat

SEQ ID NO: 664083 - DNA, 20 bp, Artificial
  CRISPR gRNA sequence
ttaaaatcaagtattcttta

SEQ ID NO: 664084 - DNA, 20 bp, Artificial
  CRISPR gRNA sequence
aaaatcaagtattctttata

SEQ ID NO: 664085 - DNA, 20 bp, Artificial
  CRISPR gRNA sequence
aaatcaagtattctttatag

SEQ ID NO: 664086 - DNA, 20 bp, Artificial
  CRISPR gRNA sequence
tttatagtagtcctacttaa

SEQ ID NO: 664087 - DNA, 20 bp, Artificial
  CRISPR gRNA sequence
tatagtagtcctacttaata

SEQ ID NO: 664088 - DNA, 20 bp, Artificial
  CRISPR gRNA sequence
atagtagtcctacttaatat

SEQ ID NO: 664089 - DNA, 20 bp, Artificial
  CRISPR gRNA sequence
tagtagtcctacttaatatg

SEQ ID NO: 664090 - DNA, 20 bp, Artificial
  CRISPR gRNA sequence
cttaatatgcagtctgtagg

SEQ ID NO: 664091 - DNA, 20 bp, Artificial
  CRISPR gRNA sequence
aatatgcagtctgtaggctg

SEQ ID NO: 664092 - DNA, 20 bp, Artificial
  CRISPR gRNA sequence
atatgcagtctgtaggctgg

SEQ ID NO: 664093 - DNA, 20 bp, Artificial
  CRISPR gRNA sequence
taggctggaaagcatttgtt

SEQ ID NO: 664094 - DNA, 20 bp, Artificial
  CRISPR gRNA sequence
gaaagcatttgttaccagtc

SEQ ID NO: 664095 - DNA, 20 bp, Artificial
  CRISPR gRNA sequence
gttaccagtctgccttgaaa

SEQ ID NO: 664096 - DNA, 20 bp, Artificial
  CRISPR gRNA sequence
ttaccagtctgccttgaaat

SEQ ID NO: 664097 - DNA, 20 bp, Artificial
  CRISPR gRNA sequence
ccagtctgccttgaaattaa

SEQ ID NO: 664098 - DNA, 20 bp, Artificial
  CRISPR gRNA sequence
ccttgaaattaaatatagaa

SEQ ID NO: 664099 - DNA, 20 bp, Artificial
  CRISPR gRNA sequence
gaaattaaatatagaagttg

SEQ ID NO: 664100 - DNA, 20 bp, Artificial
  CRISPR gRNA sequence
aaattaaatatagaagttga

SEQ ID NO: 664101 - DNA, 20 bp, Artificial
  CRISPR gRNA sequence
aatatagaagttgagtaaat

SEQ ID NO: 664102 - DNA, 20 bp, Artificial
  CRISPR gRNA sequence
agtaaatgcttaaaactgtc

SEQ ID NO: 664103 - DNA, 20 bp, Artificial
  CRISPR gRNA sequence
aaaactgtcaccaaagtttg

SEQ ID NO: 664104 - DNA, 20 bp, Artificial
  CRISPR gRNA sequence
aaactgtcaccaaagtttga

SEQ ID NO: 664105 - DNA, 20 bp, Artificial
  CRISPR gRNA sequence
tcaccaaagtttgatagagt

SEQ ID NO: 664106 - DNA, 20 bp, Artificial
  CRISPR gRNA sequence
gatagagtaataaaaatagg

SEQ ID NO: 664107 - DNA, 20 bp, Artificial
  CRISPR gRNA sequence
atagagtaataaaaataggg

SEQ ID NO: 664108 - DNA, 20 bp, Artificial
  CRISPR gRNA sequence
gtattttgtttttgtcaaat

SEQ ID NO: 664109 - DNA, 20 bp, Artificial
  CRISPR gRNA sequence
tattttgtttttgtcaaatt

SEQ ID NO: 664110 - DNA, 20 bp, Artificial
  CRISPR gRNA sequence
tgtttttgtcaaatttgact

SEQ ID NO: 664111 - DNA, 20 bp, Artificial
  CRISPR gRNA sequence
gtttttgtcaaatttgactt

SEQ ID NO: 664112 - DNA, 20 bp, Artificial
  CRISPR gRNA sequence
tttttgtcaaatttgacttg

SEQ ID NO: 664113 - DNA, 20 bp, Artificial
  CRISPR gRNA sequence
ttgtcaaatttgacttgatt

SEQ ID NO: 664114 - DNA, 20 bp, Artificial
  CRISPR gRNA sequence
tgtcaaatttgacttgatta

SEQ ID NO: 664115 - DNA, 20 bp, Artificial
  CRISPR gRNA sequence
gtcaaatttgacttgattat

SEQ ID NO: 664116 - DNA, 20 bp, Artificial
  CRISPR gRNA sequence
tcaaatttgacttgattata

SEQ ID NO: 664117 - DNA, 20 bp, Artificial
  CRISPR gRNA sequence
gacttgattatacaaatgtg

SEQ ID NO: 664118 - DNA, 20 bp, Artificial
  CRISPR gRNA sequence
acttgattatacaaatgtga

SEQ ID NO: 664119 - DNA, 20 bp, Artificial
  CRISPR gRNA sequence
gattatacaaatgtgatgaa

SEQ ID NO: 664120 - DNA, 20 bp, Artificial
  CRISPR gRNA sequence
attatacaaatgtgatgaat

SEQ ID NO: 664121 - DNA, 20 bp, Artificial
  CRISPR gRNA sequence
tacaaatgtgatgaattaga

SEQ ID NO: 664122 - DNA, 20 bp, Artificial
  CRISPR gRNA sequence
gaaatttaaaaaaccaattg

SEQ ID NO: 664123 - DNA, 20 bp, Artificial
  CRISPR gRNA sequence
aaaaaaccaattggtccttc

SEQ ID NO: 664124 - DNA, 20 bp, Artificial
  CRISPR gRNA sequence
aaaaaccaattggtccttcc

SEQ ID NO: 664125 - DNA, 20 bp, Artificial
  CRISPR gRNA sequence
gtccttcccacagaaggata

SEQ ID NO: 664126 - DNA, 20 bp, Artificial
  CRISPR gRNA sequence
cccacagaaggatatttcat

SEQ ID NO: 664127 - DNA, 20 bp, Artificial
  CRISPR gRNA sequence
ccacagaaggatatttcatt

SEQ ID NO: 664128 - DNA, 20 bp, Artificial
  CRISPR gRNA sequence
catttgagaaatatcacttt

SEQ ID NO: 664129 - DNA, 20 bp, Artificial
  CRISPR gRNA sequence
atttgagaaatatcacttta

SEQ ID NO: 664130 - DNA, 20 bp, Artificial
  CRISPR gRNA sequence
gagaaatatcactttagatg

SEQ ID NO: 664131 - DNA, 20 bp, Artificial
  CRISPR gRNA sequence
agaaatatcactttagatga

SEQ ID NO: 664132 - DNA, 20 bp, Artificial
  CRISPR gRNA sequence
tagatgacattagaagagtt

SEQ ID NO: 664133 - DNA, 20 bp, Artificial
  CRISPR gRNA sequence
agatgacattagaagagtta

SEQ ID NO: 664134 - DNA, 20 bp, Artificial
  CRISPR gRNA sequence
gatgacattagaagagttat

SEQ ID NO: 664135 - DNA, 20 bp, Artificial
  CRISPR gRNA sequence
gaagagttatccatgtgctt

SEQ ID NO: 664136 - DNA, 20 bp, Artificial
  CRISPR gRNA sequence
tccatgtgcttagtgtcagt

SEQ ID NO: 664137 - DNA, 20 bp, Artificial
  CRISPR gRNA sequence
agtgtcagttagcttaaatg

SEQ ID NO: 664138 - DNA, 20 bp, Artificial
  CRISPR gRNA sequence
gtgtcagttagcttaaatgc

SEQ ID NO: 664139 - DNA, 20 bp, Artificial
  CRISPR gRNA sequence
gcttaaatgccatacattaa

SEQ ID NO: 664140 - DNA, 20 bp, Artificial
  CRISPR gRNA sequence
aaatgccatacattaaaata

SEQ ID NO: 664141 - DNA, 20 bp, Artificial
  CRISPR gRNA sequence
aatgccatacattaaaatat

SEQ ID NO: 664142 - DNA, 20 bp, Artificial
  CRISPR gRNA sequence
aaatataaacatatcaaaaa

SEQ ID NO: 664143 - DNA, 20 bp, Artificial
  CRISPR gRNA sequence
atattagtaacttatgtgga

SEQ ID NO: 664144 - DNA, 20 bp, Artificial
  CRISPR gRNA sequence
tattagtaacttatgtggat

SEQ ID NO: 664145 - DNA, 20 bp, Artificial
  CRISPR gRNA sequence
gtaacttatgtggataacca

SEQ ID NO: 664146 - DNA, 20 bp, Artificial
  CRISPR gRNA sequence
atgtggataaccatatgatt

SEQ ID NO: 664147 - DNA, 20 bp, Artificial
  CRISPR gRNA sequence
tgtggataaccatatgattt

SEQ ID NO: 664148 - DNA, 20 bp, Artificial
  CRISPR gRNA sequence
ttataaagtaatctcaaatg

SEQ ID NO: 664149 - DNA, 20 bp, Artificial
  CRISPR gRNA sequence
tataaagtaatctcaaatga

SEQ ID NO: 664150 - DNA, 20 bp, Artificial
  CRISPR gRNA sequence
ataaagtaatctcaaatgaa

SEQ ID NO: 664151 - DNA, 20 bp, Artificial
  CRISPR gRNA sequence
taaagtaatctcaaatgaaa

SEQ ID NO: 664152 - DNA, 20 bp, Artificial
  CRISPR gRNA sequence
aaatgaaaatgaaagccaat

SEQ ID NO: 664153 - DNA, 20 bp, Artificial
  CRISPR gRNA sequence
tttaatgaatctaaagcagt

SEQ ID NO: 664154 - DNA, 20 bp, Artificial
  CRISPR gRNA sequence
taatgaatctaaagcagtag

SEQ ID NO: 664155 - DNA, 20 bp, Artificial
  CRISPR gRNA sequence
aatgaatctaaagcagtaga

SEQ ID NO: 664156 - DNA, 20 bp, Artificial
  CRISPR gRNA sequence
atgaatctaaagcagtagag

SEQ ID NO: 664157 - DNA, 20 bp, Artificial
  CRISPR gRNA sequence
aagcagtagagcctttactc

SEQ ID NO: 664158 - DNA, 20 bp, Artificial
  CRISPR gRNA sequence
tactcatatacctagtaata

SEQ ID NO: 664159 - DNA, 20 bp, Artificial
  CRISPR gRNA sequence
actcatatacctagtaataa

SEQ ID NO: 664160 - DNA, 20 bp, Artificial
  CRISPR gRNA sequence
ctcatatacctagtaataac

SEQ ID NO: 664161 - DNA, 20 bp, Artificial
  CRISPR gRNA sequence
atatacctagtaataactat

SEQ ID NO: 664162 - DNA, 20 bp, Artificial
  CRISPR gRNA sequence
gtaataactatcattaagtg

SEQ ID NO: 664163 - DNA, 20 bp, Artificial
  CRISPR gRNA sequence
tcattaagtgcttacaatgt

SEQ ID NO: 664164 - DNA, 20 bp, Artificial
  CRISPR gRNA sequence
agtgcttacaatgtgcaata

SEQ ID NO: 664165 - DNA, 20 bp, Artificial
  CRISPR gRNA sequence
acaatgtgcaatagggtgtc

SEQ ID NO: 664166 - DNA, 20 bp, Artificial
  CRISPR gRNA sequence
caatgtgcaatagggtgtct

SEQ ID NO: 664167 - DNA, 20 bp, Artificial
  CRISPR gRNA sequence
ttatcttatttaatcctcta

SEQ ID NO: 664168 - DNA, 20 bp, Artificial
  CRISPR gRNA sequence
tatcttatttaatcctctaa

SEQ ID NO: 664169 - DNA, 20 bp, Artificial
  CRISPR gRNA sequence
atcttatttaatcctctaaa

SEQ ID NO: 664170 - DNA, 20 bp, Artificial
  CRISPR gRNA sequence
tcttatttaatcctctaaaa

SEQ ID NO: 664171 - DNA, 20 bp, Artificial
  CRISPR gRNA sequence
atttaatcctctaaaagcac

SEQ ID NO: 664172 - DNA, 20 bp, Artificial
  CRISPR gRNA sequence
tttaatcctctaaaagcaca

SEQ ID NO: 664173 - DNA, 20 bp, Artificial
  CRISPR gRNA sequence
aatcctctaaaagcacaacg

SEQ ID NO: 664174 - DNA, 20 bp, Artificial
  CRISPR gRNA sequence
atcctctaaaagcacaacgg

SEQ ID NO: 664175 - DNA, 20 bp, Artificial
  CRISPR gRNA sequence
taaaagcacaacgggatagg

SEQ ID NO: 664176 - DNA, 20 bp, Artificial
  CRISPR gRNA sequence
aaagcacaacgggataggtt

SEQ ID NO: 664177 - DNA, 20 bp, Artificial
  CRISPR gRNA sequence
cttattaccctcattttaga

SEQ ID NO: 664178 - DNA, 20 bp, Artificial
  CRISPR gRNA sequence
attaccctcattttagagat

SEQ ID NO: 664179 - DNA, 20 bp, Artificial
  CRISPR gRNA sequence
ttaccctcattttagagatg

SEQ ID NO: 664180 - DNA, 20 bp, Artificial
  CRISPR gRNA sequence
ccctcattttagagatgccg

SEQ ID NO: 664181 - DNA, 20 bp, Artificial
  CRISPR gRNA sequence
attttagagatgccgagcta

SEQ ID NO: 664182 - DNA, 20 bp, Artificial
  CRISPR gRNA sequence
tagagatgccgagctaaggg

SEQ ID NO: 664183 - DNA, 20 bp, Artificial
  CRISPR gRNA sequence
agagatgccgagctaagggt

SEQ ID NO: 664184 - DNA, 20 bp, Artificial
  CRISPR gRNA sequence
gagatgccgagctaagggtc

SEQ ID NO: 664185 - DNA, 20 bp, Artificial
  CRISPR gRNA sequence
agggtcagagaggttaaaaa

SEQ ID NO: 664186 - DNA, 20 bp, Artificial
  CRISPR gRNA sequence
aaaatgtgctgatggtcact

SEQ ID NO: 664187 - DNA, 20 bp, Artificial
  CRISPR gRNA sequence
atggtcactgagctaactaa

SEQ ID NO: 664188 - DNA, 20 bp, Artificial
  CRISPR gRNA sequence
agctaactaaaaaagctaac

SEQ ID NO: 664189 - DNA, 20 bp, Artificial
  CRISPR gRNA sequence
actaaaaaagctaacattaa

SEQ ID NO: 664190 - DNA, 20 bp, Artificial
  CRISPR gRNA sequence
aaaaagctaacattaaaaca

SEQ ID NO: 664191 - DNA, 20 bp, Artificial
  CRISPR gRNA sequence
acattaaaacatgcttttgt

SEQ ID NO: 664192 - DNA, 20 bp, Artificial
  CRISPR gRNA sequence
aaacatgcttttgttcataa

SEQ ID NO: 664193 - DNA, 20 bp, Artificial
  CRISPR gRNA sequence
ttgttcataatatgattaca

SEQ ID NO: 664194 - DNA, 20 bp, Artificial
  CRISPR gRNA sequence
tgttcataatatgattacac

SEQ ID NO: 664195 - DNA, 20 bp, Artificial
  CRISPR gRNA sequence
gttcataatatgattacaca

SEQ ID NO: 664196 - DNA, 20 bp, Artificial
  CRISPR gRNA sequence
ttcataatatgattacacat

SEQ ID NO: 664197 - DNA, 20 bp, Artificial
  CRISPR gRNA sequence
ataatatgattacacatctt

SEQ ID NO: 664198 - DNA, 20 bp, Artificial
  CRISPR gRNA sequence
cacatcttgtgcttcacgtt

SEQ ID NO: 664199 - DNA, 20 bp, Artificial
  CRISPR gRNA sequence
gtgcttcacgttttttcttt

SEQ ID NO: 664200 - DNA, 20 bp, Artificial
  CRISPR gRNA sequence
tgcttcacgttttttctttt

SEQ ID NO: 664201 - DNA, 20 bp, Artificial
  CRISPR gRNA sequence
cacgttttttcttttaaatg

SEQ ID NO: 664202 - DNA, 20 bp, Artificial
  CRISPR gRNA sequence
acgttttttcttttaaatga

SEQ ID NO: 664203 - DNA, 20 bp, Artificial
  CRISPR gRNA sequence
tttcttttaaatgaggaggt

SEQ ID NO: 664204 - DNA, 20 bp, Artificial
  CRISPR gRNA sequence
ttcttttaaatgaggaggta

SEQ ID NO: 664205 - DNA, 20 bp, Artificial
  CRISPR gRNA sequence
tcttttaaatgaggaggtaa

SEQ ID NO: 664206 - DNA, 20 bp, Artificial
  CRISPR gRNA sequence
cttttaaatgaggaggtaat

SEQ ID NO: 664207 - DNA, 20 bp, Artificial
  CRISPR gRNA sequence
ttttaaatgaggaggtaata

SEQ ID NO: 664208 - DNA, 20 bp, Artificial
  CRISPR gRNA sequence
ttaaatgaggaggtaataac

SEQ ID NO: 664209 - DNA, 20 bp, Artificial
  CRISPR gRNA sequence
taaatgaggaggtaataaca

SEQ ID NO: 664210 - DNA, 20 bp, Artificial
  CRISPR gRNA sequence
aaatgaggaggtaataacat

SEQ ID NO: 664211 - DNA, 20 bp, Artificial
  CRISPR gRNA sequence
aatgaggaggtaataacatg

SEQ ID NO: 664212 - DNA, 20 bp, Artificial
  CRISPR gRNA sequence
ggtaaagaatgttgttttgt

SEQ ID NO: 664213 - DNA, 20 bp, Artificial
  CRISPR gRNA sequence
ttttgtgcttgtaggtaaag

SEQ ID NO: 664214 - DNA, 20 bp, Artificial
  CRISPR gRNA sequence
tgtgcttgtaggtaaagctg

SEQ ID NO: 664215 - DNA, 20 bp, Artificial
  CRISPR gRNA sequence
gtgcttgtaggtaaagctgt

SEQ ID NO: 664216 - DNA, 20 bp, Artificial
  CRISPR gRNA sequence
tgcttgtaggtaaagctgtg

SEQ ID NO: 664217 - DNA, 20 bp, Artificial
  CRISPR gRNA sequence
gtaggtaaagctgtgtacca

SEQ ID NO: 664218 - DNA, 20 bp, Artificial
  CRISPR gRNA sequence
taggtaaagctgtgtaccat

SEQ ID NO: 664219 - DNA, 20 bp, Artificial
  CRISPR gRNA sequence
tgtaccatgctgtatatgag

SEQ ID NO: 664220 - DNA, 20 bp, Artificial
  CRISPR gRNA sequence
tatatgaggaattatttaga

SEQ ID NO: 664221 - DNA, 20 bp, Artificial
  CRISPR gRNA sequence
tttagagctagaagaggaaa

SEQ ID NO: 664222 - DNA, 20 bp, Artificial
  CRISPR gRNA sequence
agagctagaagaggaaagct

SEQ ID NO: 664223 - DNA, 20 bp, Artificial
  CRISPR gRNA sequence
gagctagaagaggaaagctc

SEQ ID NO: 664224 - DNA, 20 bp, Artificial
  CRISPR gRNA sequence
gaagaggaaagctcaagcat

SEQ ID NO: 664225 - DNA, 20 bp, Artificial
  CRISPR gRNA sequence
aagcatgcaaatcttcagtg

SEQ ID NO: 664226 - DNA, 20 bp, Artificial
  CRISPR gRNA sequence
cagtgctgagttggtatagg

SEQ ID NO: 664227 - DNA, 20 bp, Artificial
  CRISPR gRNA sequence
agtgctgagttggtataggg

SEQ ID NO: 664228 - DNA, 20 bp, Artificial
  CRISPR gRNA sequence
agttggtatagggagtaaga

SEQ ID NO: 664229 - DNA, 20 bp, Artificial
  CRISPR gRNA sequence
gtatagggagtaagatgagg

SEQ ID NO: 664230 - DNA, 20 bp, Artificial
  CRISPR gRNA sequence
catcacgtacgttgctcttg

SEQ ID NO: 664231 - DNA, 20 bp, Artificial
  CRISPR gRNA sequence
atcacgtacgttgctcttga

SEQ ID NO: 664232 - DNA, 20 bp, Artificial
  CRISPR gRNA sequence
ctcttgatctcagagtctgt

SEQ ID NO: 664233 - DNA, 20 bp, Artificial
  CRISPR gRNA sequence
ttgatctcagagtctgttac

SEQ ID NO: 664234 - DNA, 20 bp, Artificial
  CRISPR gRNA sequence
gatctcagagtctgttacta

SEQ ID NO: 664235 - DNA, 20 bp, Artificial
  CRISPR gRNA sequence
atctcagagtctgttactac

SEQ ID NO: 664236 - DNA, 20 bp, Artificial
  CRISPR gRNA sequence
agagtctgttactacaaatt

SEQ ID NO: 664237 - DNA, 20 bp, Artificial
  CRISPR gRNA sequence
ttactacaaattgttgatga

SEQ ID NO: 664238 - DNA, 20 bp, Artificial
  CRISPR gRNA sequence
ctacaaattgttgatgatca

SEQ ID NO: 664239 - DNA, 20 bp, Artificial
  CRISPR gRNA sequence
caaattgttgatgatcacaa

SEQ ID NO: 664240 - DNA, 20 bp, Artificial
  CRISPR gRNA sequence
ttgatgatcacaaaaattta

SEQ ID NO: 664241 - DNA, 20 bp, Artificial
  CRISPR gRNA sequence
atgatcacaaaaatttaagg

SEQ ID NO: 664242 - DNA, 20 bp, Artificial
  CRISPR gRNA sequence
aaggacatcatgttcaagtt

SEQ ID NO: 664243 - DNA, 20 bp, Artificial
  CRISPR gRNA sequence
aggacatcatgttcaagtta

SEQ ID NO: 664244 - DNA, 20 bp, Artificial
  CRISPR gRNA sequence
aagttacacttgatacagct

SEQ ID NO: 664245 - DNA, 20 bp, Artificial
  CRISPR gRNA sequence
cacttgatacagcttataag

SEQ ID NO: 664246 - DNA, 20 bp, Artificial
  CRISPR gRNA sequence
gatacagcttataagaaaga

SEQ ID NO: 664247 - DNA, 20 bp, Artificial
  CRISPR gRNA sequence
atacagcttataagaaagaa

SEQ ID NO: 664248 - DNA, 20 bp, Artificial
  CRISPR gRNA sequence
ataagaaagaatcccttttc

SEQ ID NO: 664249 - DNA, 20 bp, Artificial
  CRISPR gRNA sequence
taagaaagaatcccttttca

SEQ ID NO: 664250 - DNA, 20 bp, Artificial
  CRISPR gRNA sequence
ttcaaaaaaagcagatgaga

SEQ ID NO: 664251 - DNA, 20 bp, Artificial
  CRISPR gRNA sequence
tcaaaaaaagcagatgagat

SEQ ID NO: 664252 - DNA, 20 bp, Artificial
  CRISPR gRNA sequence
caaaaaaagcagatgagatg

SEQ ID NO: 664253 - DNA, 20 bp, Artificial
  CRISPR gRNA sequence
aaaaaaagcagatgagatgt

SEQ ID NO: 664254 - DNA, 20 bp, Artificial
  CRISPR gRNA sequence
ttaaatggcatctctctact

SEQ ID NO: 664255 - DNA, 20 bp, Artificial
  CRISPR gRNA sequence
taaatggcatctctctactc

SEQ ID NO: 664256 - DNA, 20 bp, Artificial
  CRISPR gRNA sequence
aaatggcatctctctactct

SEQ ID NO: 664257 - DNA, 20 bp, Artificial
  CRISPR gRNA sequence
aatggcatctctctactctt

SEQ ID NO: 664258 - DNA, 20 bp, Artificial
  CRISPR gRNA sequence
tctactcttcatatgtacat

SEQ ID NO: 664259 - DNA, 20 bp, Artificial
  CRISPR gRNA sequence
tactcttcatatgtacatag

SEQ ID NO: 664260 - DNA, 20 bp, Artificial
  CRISPR gRNA sequence
ctcttcatatgtacatagat

SEQ ID NO: 664261 - DNA, 20 bp, Artificial
  CRISPR gRNA sequence
ttcatatgtacatagatact

SEQ ID NO: 664262 - DNA, 20 bp, Artificial
  CRISPR gRNA sequence
catatgtacatagatactca

SEQ ID NO: 664263 - DNA, 20 bp, Artificial
  CRISPR gRNA sequence
atatgtacatagatactcaa

SEQ ID NO: 664264 - DNA, 20 bp, Artificial
  CRISPR gRNA sequence
aactttcaggaatcatgtat

SEQ ID NO: 664265 - DNA, 20 bp, Artificial
  CRISPR gRNA sequence
tcaggaatcatgtatataat

SEQ ID NO: 664266 - DNA, 20 bp, Artificial
  CRISPR gRNA sequence
caggaatcatgtatataata

SEQ ID NO: 664267 - DNA, 20 bp, Artificial
  CRISPR gRNA sequence
aggaatcatgtatataatat

SEQ ID NO: 664268 - DNA, 20 bp, Artificial
  CRISPR gRNA sequence
gcatcttacagtaatattta

SEQ ID NO: 664269 - DNA, 20 bp, Artificial
  CRISPR gRNA sequence
acagtaatatttacaatatt

SEQ ID NO: 664270 - DNA, 20 bp, Artificial
  CRISPR gRNA sequence
cagtaatatttacaatattt

SEQ ID NO: 664271 - DNA, 20 bp, Artificial
  CRISPR gRNA sequence
acaatatttgtttccttcaa

SEQ ID NO: 664272 - DNA, 20 bp, Artificial
  CRISPR gRNA sequence
caatatttgtttccttcaat

SEQ ID NO: 664273 - DNA, 20 bp, Artificial
  CRISPR gRNA sequence
gtttccttcaatctcttcag

SEQ ID NO: 664274 - DNA, 20 bp, Artificial
  CRISPR gRNA sequence
tttccttcaatctcttcagt

SEQ ID NO: 664275 - DNA, 20 bp, Artificial
  CRISPR gRNA sequence
ccttcaatctcttcagttat

SEQ ID NO: 664276 - DNA, 20 bp, Artificial
  CRISPR gRNA sequence
cttcaatctcttcagttatc

SEQ ID NO: 664277 - DNA, 20 bp, Artificial
  CRISPR gRNA sequence
caatctcttcagttatcttt

SEQ ID NO: 664278 - DNA, 20 bp, Artificial
  CRISPR gRNA sequence
aatctcttcagttatcttta

SEQ ID NO: 664279 - DNA, 20 bp, Artificial
  CRISPR gRNA sequence
ttcagttatctttataaaag

SEQ ID NO: 664280 - DNA, 20 bp, Artificial
  CRISPR gRNA sequence
cagttatctttataaaagaa

SEQ ID NO: 664281 - DNA, 20 bp, Artificial
  CRISPR gRNA sequence
agttatctttataaaagaaa

SEQ ID NO: 664282 - DNA, 20 bp, Artificial
  CRISPR gRNA sequence
tctttataaaagaaaggagg

SEQ ID NO: 664283 - DNA, 20 bp, Artificial
  CRISPR gRNA sequence
tataaaagaaaggaggatgg

SEQ ID NO: 664284 - DNA, 20 bp, Artificial
  CRISPR gRNA sequence
ataaaagaaaggaggatggg

SEQ ID NO: 664285 - DNA, 20 bp, Artificial
  CRISPR gRNA sequence
taaaagaaaggaggatgggg

SEQ ID NO: 664286 - DNA, 20 bp, Artificial
  CRISPR gRNA sequence
acttttgtcatgtagcttcc

SEQ ID NO: 664287 - DNA, 20 bp, Artificial
  CRISPR gRNA sequence
ttgtcatgtagcttcctcaa

SEQ ID NO: 664288 - DNA, 20 bp, Artificial
  CRISPR gRNA sequence
tgtcatgtagcttcctcaac

SEQ ID NO: 664289 - DNA, 20 bp, Artificial
  CRISPR gRNA sequence
gtcatgtagcttcctcaact

SEQ ID NO: 664290 - DNA, 20 bp, Artificial
  CRISPR gRNA sequence
tcatgtagcttcctcaacta

SEQ ID NO: 664291 - DNA, 20 bp, Artificial
  CRISPR gRNA sequence
cctcaactaaagccttcaga

SEQ ID NO: 664292 - DNA, 20 bp, Artificial
  CRISPR gRNA sequence
ctcaactaaagccttcagat

SEQ ID NO: 664293 - DNA, 20 bp, Artificial
  CRISPR gRNA sequence
aactaaagccttcagatctt

SEQ ID NO: 664294 - DNA, 20 bp, Artificial
  CRISPR gRNA sequence
aagccttcagatcttcatca

SEQ ID NO: 664295 - DNA, 20 bp, Artificial
  CRISPR gRNA sequence
cagatcttcatcagtatatg

SEQ ID NO: 664296 - DNA, 20 bp, Artificial
  CRISPR gRNA sequence
agatcttcatcagtatatga

SEQ ID NO: 664297 - DNA, 20 bp, Artificial
  CRISPR gRNA sequence
catcagtatatgaataaact

SEQ ID NO: 664298 - DNA, 20 bp, Artificial
  CRISPR gRNA sequence
atcagtatatgaataaactc

SEQ ID NO: 664299 - DNA, 20 bp, Artificial
  CRISPR gRNA sequence
agtttactagatgcttccct

SEQ ID NO: 664300 - DNA, 20 bp, Artificial
  CRISPR gRNA sequence
actagatgcttcccttctgt

SEQ ID NO: 664301 - DNA, 20 bp, Artificial
  CRISPR gRNA sequence
ctagatgcttcccttctgta

SEQ ID NO: 664302 - DNA, 20 bp, Artificial
  CRISPR gRNA sequence
gatgcttcccttctgtaaaa

SEQ ID NO: 664303 - DNA, 20 bp, Artificial
  CRISPR gRNA sequence
cccttctgtaaaattctgta

SEQ ID NO: 664304 - DNA, 20 bp, Artificial
  CRISPR gRNA sequence
ccttctgtaaaattctgtaa

SEQ ID NO: 664305 - DNA, 20 bp, Artificial
  CRISPR gRNA sequence
ctgtaaaattctgtaaatca

SEQ ID NO: 664306 - DNA, 20 bp, Artificial
  CRISPR gRNA sequence
tgtaaaattctgtaaatcaa

SEQ ID NO: 664307 - DNA, 20 bp, Artificial
  CRISPR gRNA sequence
taaaattctgtaaatcaact

SEQ ID NO: 664308 - DNA, 20 bp, Artificial
  CRISPR gRNA sequence
tgtaaatcaactagctaata

SEQ ID NO: 664309 - DNA, 20 bp, Artificial
  CRISPR gRNA sequence
taaatcaactagctaatatt

SEQ ID NO: 664310 - DNA, 20 bp, Artificial
  CRISPR gRNA sequence
gctaatatttaattgaattt

SEQ ID NO: 664311 - DNA, 20 bp, Artificial
  CRISPR gRNA sequence
atatttaattgaatttttat

SEQ ID NO: 664312 - DNA, 20 bp, Artificial
  CRISPR gRNA sequence
aattgaatttttatcttgtt

SEQ ID NO: 664313 - DNA, 20 bp, Artificial
  CRISPR gRNA sequence
attgaatttttatcttgttt

SEQ ID NO: 664314 - DNA, 20 bp, Artificial
  CRISPR gRNA sequence
aatttttatcttgttttctt

SEQ ID NO: 664315 - DNA, 20 bp, Artificial
  CRISPR gRNA sequence
ttatcttgttttcttcattt

SEQ ID NO: 664316 - DNA, 20 bp, Artificial
  CRISPR gRNA sequence
tatcttgttttcttcatttg

SEQ ID NO: 664317 - DNA, 20 bp, Artificial
  CRISPR gRNA sequence
atcttgttttcttcatttgg

SEQ ID NO: 664318 - DNA, 20 bp, Artificial
  CRISPR gRNA sequence
tcttgttttcttcatttggt

SEQ ID NO: 664319 - DNA, 20 bp, Artificial
  CRISPR gRNA sequence
gttttcttcatttggtccat

SEQ ID NO: 664320 - DNA, 20 bp, Artificial
  CRISPR gRNA sequence
ttttcttcatttggtccatt

SEQ ID NO: 664321 - DNA, 20 bp, Artificial
  CRISPR gRNA sequence
tcttcatttggtccatttga

SEQ ID NO: 664322 - DNA, 20 bp, Artificial
  CRISPR gRNA sequence
cttcatttggtccatttgat

SEQ ID NO: 664323 - DNA, 20 bp, Artificial
  CRISPR gRNA sequence
ttcatttggtccatttgatt

SEQ ID NO: 664324 - DNA, 20 bp, Artificial
  CRISPR gRNA sequence
catttggtccatttgattgc

SEQ ID NO: 664325 - DNA, 20 bp, Artificial
  CRISPR gRNA sequence
atttggtccatttgattgct

SEQ ID NO: 664326 - DNA, 20 bp, Artificial
  CRISPR gRNA sequence
ggtccatttgattgctgatc

SEQ ID NO: 664327 - DNA, 20 bp, Artificial
  CRISPR gRNA sequence
gtccatttgattgctgatca

SEQ ID NO: 664328 - DNA, 20 bp, Artificial
  CRISPR gRNA sequence
gattgctgatcattgatgtt

SEQ ID NO: 664329 - DNA, 20 bp, Artificial
  CRISPR gRNA sequence
attgctgatcattgatgttc

SEQ ID NO: 664330 - DNA, 20 bp, Artificial
  CRISPR gRNA sequence
ctgatcattgatgttcatct

SEQ ID NO: 664331 - DNA, 20 bp, Artificial
  CRISPR gRNA sequence
atcattgatgttcatctgcc

SEQ ID NO: 664332 - DNA, 20 bp, Artificial
  CRISPR gRNA sequence
atgttcatctgcctaataac

SEQ ID NO: 664333 - DNA, 20 bp, Artificial
  CRISPR gRNA sequence
atctgcctaataacctttgc

SEQ ID NO: 664334 - DNA, 20 bp, Artificial
  CRISPR gRNA sequence
cctaataacctttgcacagt

SEQ ID NO: 664335 - DNA, 20 bp, Artificial
  CRISPR gRNA sequence
ataacctttgcacagtgttt

SEQ ID NO: 664336 - DNA, 20 bp, Artificial
  CRISPR gRNA sequence
tgcacagtgtttaaggattg

SEQ ID NO: 664337 - DNA, 20 bp, Artificial
  CRISPR gRNA sequence
gcacagtgtttaaggattga

SEQ ID NO: 664338 - DNA, 20 bp, Artificial
  CRISPR gRNA sequence
cacagtgtttaaggattgag

SEQ ID NO: 664339 - DNA, 20 bp, Artificial
  CRISPR gRNA sequence
aaggattgaggataaaaact

SEQ ID NO: 664340 - DNA, 20 bp, Artificial
  CRISPR gRNA sequence
aggattgaggataaaaacta

SEQ ID NO: 664341 - DNA, 20 bp, Artificial
  CRISPR gRNA sequence
aggataaaaactatcaaggg

SEQ ID NO: 664342 - DNA, 20 bp, Artificial
  CRISPR gRNA sequence
tcaagggcaagattagaaga

SEQ ID NO: 664343 - DNA, 20 bp, Artificial
  CRISPR gRNA sequence
gaagaggtgactgactccct

SEQ ID NO: 664344 - DNA, 20 bp, Artificial
  CRISPR gRNA sequence
actccctgattctctgctgc

SEQ ID NO: 664345 - DNA, 20 bp, Artificial
  CRISPR gRNA sequence
cctgattctctgctgccctt

SEQ ID NO: 664346 - DNA, 20 bp, Artificial
  CRISPR gRNA sequence
attctctgctgcccttgaag

SEQ ID NO: 664347 - DNA, 20 bp, Artificial
  CRISPR gRNA sequence
tctgctgcccttgaaggcac

SEQ ID NO: 664348 - DNA, 20 bp, Artificial
  CRISPR gRNA sequence
tgctgcccttgaaggcactg

SEQ ID NO: 664349 - DNA, 20 bp, Artificial
  CRISPR gRNA sequence
ctgcccttgaaggcactgga

SEQ ID NO: 664350 - DNA, 20 bp, Artificial
  CRISPR gRNA sequence
cccttgaaggcactggataa

SEQ ID NO: 664351 - DNA, 20 bp, Artificial
  CRISPR gRNA sequence
gaaggcactggataatggag

SEQ ID NO: 664352 - DNA, 20 bp, Artificial
  CRISPR gRNA sequence
aaggcactggataatggaga

SEQ ID NO: 664353 - DNA, 20 bp, Artificial
  CRISPR gRNA sequence
gataatggagaaacaagtgc

SEQ ID NO: 664354 - DNA, 20 bp, Artificial
  CRISPR gRNA sequence
catgtgttggattttgttag

SEQ ID NO: 664355 - DNA, 20 bp, Artificial
  CRISPR gRNA sequence
gattttgttagttggatcta

SEQ ID NO: 664356 - DNA, 20 bp, Artificial
  CRISPR gRNA sequence
tgttagttggatctagctcc

SEQ ID NO: 664357 - DNA, 20 bp, Artificial
  CRISPR gRNA sequence
gttagttggatctagctcca

SEQ ID NO: 664358 - DNA, 20 bp, Artificial
  CRISPR gRNA sequence
ttagttggatctagctccag

SEQ ID NO: 664359 - DNA, 20 bp, Artificial
  CRISPR gRNA sequence
gttggatctagctccagcag

SEQ ID NO: 664360 - DNA, 20 bp, Artificial
  CRISPR gRNA sequence
gatctagctccagcagaatg

SEQ ID NO: 664361 - DNA, 20 bp, Artificial
  CRISPR gRNA sequence
gctccagcagaatgacaact

SEQ ID NO: 664362 - DNA, 20 bp, Artificial
  CRISPR gRNA sequence
cagcagaatgacaactgagg

SEQ ID NO: 664363 - DNA, 20 bp, Artificial
  CRISPR gRNA sequence
aggtcacgtcagcaccttgg

SEQ ID NO: 664364 - DNA, 20 bp, Artificial
  CRISPR gRNA sequence
ggaaggccgggaagctggaa

SEQ ID NO: 664365 - DNA, 20 bp, Artificial
  CRISPR gRNA sequence
gaaggccgggaagctggaac

SEQ ID NO: 664366 - DNA, 20 bp, Artificial
  CRISPR gRNA sequence
gaactggagcagctgagcca

SEQ ID NO: 664367 - DNA, 20 bp, Artificial
  CRISPR gRNA sequence
gagcagctgagccaatcccc

SEQ ID NO: 664368 - DNA, 20 bp, Artificial
  CRISPR gRNA sequence
agccaatccccagacaaaca

SEQ ID NO: 664369 - DNA, 20 bp, Artificial
  CRISPR gRNA sequence
taaccgggacagagtgagag

SEQ ID NO: 664370 - DNA, 20 bp, Artificial
  CRISPR gRNA sequence
aaccgggacagagtgagaga

SEQ ID NO: 664371 - DNA, 20 bp, Artificial
  CRISPR gRNA sequence
accgggacagagtgagagaa

SEQ ID NO: 664372 - DNA, 20 bp, Artificial
  CRISPR gRNA sequence
tgctttggaaactgtctgcc

SEQ ID NO: 664373 - DNA, 20 bp, Artificial
  CRISPR gRNA sequence
gctttggaaactgtctgccc

SEQ ID NO: 664374 - DNA, 20 bp, Artificial
  CRISPR gRNA sequence
ctttggaaactgtctgccca

SEQ ID NO: 664375 - DNA, 20 bp, Artificial
  CRISPR gRNA sequence
tggaaactgtctgcccatca

SEQ ID NO: 664376 - DNA, 20 bp, Artificial
  CRISPR gRNA sequence
ggaaactgtctgcccatcac

SEQ ID NO: 664377 - DNA, 20 bp, Artificial
  CRISPR gRNA sequence
gaaactgtctgcccatcacc

SEQ ID NO: 664378 - DNA, 20 bp, Artificial
  CRISPR gRNA sequence
tctgcccatcacctaaggcg

SEQ ID NO: 664379 - DNA, 20 bp, Artificial
  CRISPR gRNA sequence
cccatcacctaaggcggtga

SEQ ID NO: 664380 - DNA, 20 bp, Artificial
  CRISPR gRNA sequence
aggcggtgattctattccta

SEQ ID NO: 664381 - DNA, 20 bp, Artificial
  CRISPR gRNA sequence
tattcctatatatttttttt

SEQ ID NO: 664382 - DNA, 20 bp, Artificial
  CRISPR gRNA sequence
ttcctatatattttttttcc

SEQ ID NO: 664383 - DNA, 20 bp, Artificial
  CRISPR gRNA sequence
ctatatattttttttcctgc

SEQ ID NO: 664384 - DNA, 20 bp, Artificial
  CRISPR gRNA sequence
tatattttttttcctgctgt

SEQ ID NO: 664385 - DNA, 20 bp, Artificial
  CRISPR gRNA sequence
tttttcctgctgtctgttca

SEQ ID NO: 664386 - DNA, 20 bp, Artificial
  CRISPR gRNA sequence
ttttcctgctgtctgttcat

SEQ ID NO: 664387 - DNA, 20 bp, Artificial
  CRISPR gRNA sequence
tttcctgctgtctgttcatt

SEQ ID NO: 664388 - DNA, 20 bp, Artificial
  CRISPR gRNA sequence
ttcctgctgtctgttcattt

SEQ ID NO: 664389 - DNA, 20 bp, Artificial
  CRISPR gRNA sequence
tcctgctgtctgttcatttt

SEQ ID NO: 664390 - DNA, 20 bp, Artificial
  CRISPR gRNA sequence
cctgctgtctgttcattttt

SEQ ID NO: 664391 - DNA, 20 bp, Artificial
  CRISPR gRNA sequence
ctgctgtctgttcatttttg

SEQ ID NO: 664392 - DNA, 20 bp, Artificial
  CRISPR gRNA sequence
ctgtctgttcatttttgtat

SEQ ID NO: 664393 - DNA, 20 bp, Artificial
  CRISPR gRNA sequence
tctgttcatttttgtataga

SEQ ID NO: 664394 - DNA, 20 bp, Artificial
  CRISPR gRNA sequence
ttcatttttgtatagaaaag

SEQ ID NO: 664395 - DNA, 20 bp, Artificial
  CRISPR gRNA sequence
atttttgtatagaaaagatt

SEQ ID NO: 664396 - DNA, 20 bp, Artificial
  CRISPR gRNA sequence
ttgtatagaaaagattagtt

SEQ ID NO: 664397 - DNA, 20 bp, Artificial
  CRISPR gRNA sequence
tgtatagaaaagattagtta

SEQ ID NO: 664398 - DNA, 20 bp, Artificial
  CRISPR gRNA sequence
gtatagaaaagattagttat

SEQ ID NO: 664399 - DNA, 20 bp, Artificial
  CRISPR gRNA sequence
tatagaaaagattagttatg

SEQ ID NO: 664400 - DNA, 20 bp, Artificial
  CRISPR gRNA sequence
gttatgaggacttctttctc

SEQ ID NO: 664401 - DNA, 20 bp, Artificial
  CRISPR gRNA sequence
tgaggacttctttctcttta

SEQ ID NO: 664402 - DNA, 20 bp, Artificial
  CRISPR gRNA sequence
ctttctctttatatatggca

SEQ ID NO: 664403 - DNA, 20 bp, Artificial
  CRISPR gRNA sequence
tttctctttatatatggcaa

SEQ ID NO: 664404 - DNA, 20 bp, Artificial
  CRISPR gRNA sequence
tctctttatatatggcaaaa

SEQ ID NO: 664405 - DNA, 20 bp, Artificial
  CRISPR gRNA sequence
ctctttatatatggcaaaaa

SEQ ID NO: 664406 - DNA, 20 bp, Artificial
  CRISPR gRNA sequence
tctttatatatggcaaaaag

SEQ ID NO: 664407 - DNA, 20 bp, Artificial
  CRISPR gRNA sequence
tttatatatggcaaaaagta

SEQ ID NO: 664408 - DNA, 20 bp, Artificial
  CRISPR gRNA sequence
tatatatggcaaaaagtaat

SEQ ID NO: 664409 - DNA, 20 bp, Artificial
  CRISPR gRNA sequence
atatatggcaaaaagtaatt

SEQ ID NO: 664410 - DNA, 20 bp, Artificial
  CRISPR gRNA sequence
tatatggcaaaaagtaattg

SEQ ID NO: 664411 - DNA, 20 bp, Artificial
  CRISPR gRNA sequence
caaagtagttatgttagact

SEQ ID NO: 664412 - DNA, 20 bp, Artificial
  CRISPR gRNA sequence
tgttagactttgagattttt

SEQ ID NO: 664413 - DNA, 20 bp, Artificial
  CRISPR gRNA sequence
gactttgagatttttttgtt

SEQ ID NO: 664414 - DNA, 20 bp, Artificial
  CRISPR gRNA sequence
tgagatttttttgttttctt

SEQ ID NO: 664415 - DNA, 20 bp, Artificial
  CRISPR gRNA sequence
gagatttttttgttttcttc

SEQ ID NO: 664416 - DNA, 20 bp, Artificial
  CRISPR gRNA sequence
agatttttttgttttcttca

SEQ ID NO: 664417 - DNA, 20 bp, Artificial
  CRISPR gRNA sequence
ttttgttttcttcagattca

SEQ ID NO: 664418 - DNA, 20 bp, Artificial
  CRISPR gRNA sequence
tttgttttcttcagattcag

SEQ ID NO: 664419 - DNA, 20 bp, Artificial
  CRISPR gRNA sequence
ttgttttcttcagattcaga

SEQ ID NO: 664420 - DNA, 20 bp, Artificial
  CRISPR gRNA sequence
tgttttcttcagattcagaa

SEQ ID NO: 664421 - DNA, 20 bp, Artificial
  CRISPR gRNA sequence
gttttcttcagattcagaag

SEQ ID NO: 664422 - DNA, 20 bp, Artificial
  CRISPR gRNA sequence
ttttcttcagattcagaagc

SEQ ID NO: 664423 - DNA, 20 bp, Artificial
  CRISPR gRNA sequence
tcttcagattcagaagcaaa

SEQ ID NO: 664424 - DNA, 20 bp, Artificial
  CRISPR gRNA sequence
cttcagattcagaagcaaag

SEQ ID NO: 664425 - DNA, 20 bp, Artificial
  CRISPR gRNA sequence
ttcagattcagaagcaaaga

SEQ ID NO: 664426 - DNA, 20 bp, Artificial
  CRISPR gRNA sequence
cagattcagaagcaaagaaa

SEQ ID NO: 664427 - DNA, 20 bp, Artificial
  CRISPR gRNA sequence
agattcagaagcaaagaaaa

SEQ ID NO: 664428 - DNA, 20 bp, Artificial
  CRISPR gRNA sequence
agaagcaaagaaaatgttac

SEQ ID NO: 664429 - DNA, 20 bp, Artificial
  CRISPR gRNA sequence
cttttgaaattaagatggtg

SEQ ID NO: 664430 - DNA, 20 bp, Artificial
  CRISPR gRNA sequence
ttgaaattaagatggtgtga

SEQ ID NO: 664431 - DNA, 20 bp, Artificial
  CRISPR gRNA sequence
tgaaattaagatggtgtgat

SEQ ID NO: 664432 - DNA, 20 bp, Artificial
  CRISPR gRNA sequence
gaaattaagatggtgtgatg

SEQ ID NO: 664433 - DNA, 20 bp, Artificial
  CRISPR gRNA sequence
aaattaagatggtgtgatgg

SEQ ID NO: 664434 - DNA, 20 bp, Artificial
  CRISPR gRNA sequence
agatggtgtgatggaaggac

SEQ ID NO: 664435 - DNA, 20 bp, Artificial
  CRISPR gRNA sequence
atggcattagtaagggtgat

SEQ ID NO: 664436 - DNA, 20 bp, Artificial
  CRISPR gRNA sequence
tggcattagtaagggtgatc

SEQ ID NO: 664437 - DNA, 20 bp, Artificial
  CRISPR gRNA sequence
gtaagggtgatcatttgttg

SEQ ID NO: 664438 - DNA, 20 bp, Artificial
  CRISPR gRNA sequence
gttgattaccatcattttgt

SEQ ID NO: 664439 - DNA, 20 bp, Artificial
  CRISPR gRNA sequence
ttgattaccatcattttgtg

SEQ ID NO: 664440 - DNA, 20 bp, Artificial
  CRISPR gRNA sequence
attaccatcattttgtgtaa

SEQ ID NO: 664441 - DNA, 20 bp, Artificial
  CRISPR gRNA sequence
ccatcattttgtgtaaggtt

SEQ ID NO: 664442 - DNA, 20 bp, Artificial
  CRISPR gRNA sequence
tgtgtaaggttgaatgccaa

SEQ ID NO: 664443 - DNA, 20 bp, Artificial
  CRISPR gRNA sequence
gtgtaaggttgaatgccaat

SEQ ID NO: 664444 - DNA, 20 bp, Artificial
  CRISPR gRNA sequence
tgtaaggttgaatgccaatt

SEQ ID NO: 664445 - DNA, 20 bp, Artificial
  CRISPR gRNA sequence
aatgccaattaaatgtcatg

SEQ ID NO: 664446 - DNA, 20 bp, Artificial
  CRISPR gRNA sequence
aatgtcatgggtgcctcaat

SEQ ID NO: 664447 - DNA, 20 bp, Artificial
  CRISPR gRNA sequence
aatatgtttaaatatcttca

SEQ ID NO: 664448 - DNA, 20 bp, Artificial
  CRISPR gRNA sequence
aaatatcttcatattatata

SEQ ID NO: 664449 - DNA, 20 bp, Artificial
  CRISPR gRNA sequence
aatatcttcatattatataa

SEQ ID NO: 664450 - DNA, 20 bp, Artificial
  CRISPR gRNA sequence
catattatataatgtacatt

SEQ ID NO: 664451 - DNA, 20 bp, Artificial
  CRISPR gRNA sequence
atattatataatgtacattc

SEQ ID NO: 664452 - DNA, 20 bp, Artificial
  CRISPR gRNA sequence
tataatgtacattcaaacct

SEQ ID NO: 664453 - DNA, 20 bp, Artificial
  CRISPR gRNA sequence
aaacctcttttgattccagg

SEQ ID NO: 664454 - DNA, 20 bp, Artificial
  CRISPR gRNA sequence
ttttgattccaggaggagat

SEQ ID NO: 664455 - DNA, 20 bp, Artificial
  CRISPR gRNA sequence
ttgattccaggaggagattt

SEQ ID NO: 664456 - DNA, 20 bp, Artificial
  CRISPR gRNA sequence
tgattccaggaggagatttt

SEQ ID NO: 664457 - DNA, 20 bp, Artificial
  CRISPR gRNA sequence
gattccaggaggagattttc

SEQ ID NO: 664458 - DNA, 20 bp, Artificial
  CRISPR gRNA sequence
attccaggaggagattttct

SEQ ID NO: 664459 - DNA, 20 bp, Artificial
  CRISPR gRNA sequence
caggaggagattttcttgta

SEQ ID NO: 664460 - DNA, 20 bp, Artificial
  CRISPR gRNA sequence
tcttgtaagtcctaaaattg

SEQ ID NO: 664461 - DNA, 20 bp, Artificial
  CRISPR gRNA sequence
cttgtaagtcctaaaattgg

SEQ ID NO: 664462 - DNA, 20 bp, Artificial
  CRISPR gRNA sequence
ttgtaagtcctaaaattgga

SEQ ID NO: 664463 - DNA, 20 bp, Artificial
  CRISPR gRNA sequence
gtaagtcctaaaattggaaa

SEQ ID NO: 664464 - DNA, 20 bp, Artificial
  CRISPR gRNA sequence
taagtcctaaaattggaaac

SEQ ID NO: 664465 - DNA, 20 bp, Artificial
  CRISPR gRNA sequence
aaattggaaacttggattct

SEQ ID NO: 664466 - DNA, 20 bp, Artificial
  CRISPR gRNA sequence
gaaacttggattctagtctc

SEQ ID NO: 664467 - DNA, 20 bp, Artificial
  CRISPR gRNA sequence
ggattctagtctcattttgc

SEQ ID NO: 664468 - DNA, 20 bp, Artificial
  CRISPR gRNA sequence
gattctagtctcattttgcg

SEQ ID NO: 664469 - DNA, 20 bp, Artificial
  CRISPR gRNA sequence
tagtctcattttgcgagttg

SEQ ID NO: 664470 - DNA, 20 bp, Artificial
  CRISPR gRNA sequence
gtctcattttgcgagttgct

SEQ ID NO: 664471 - DNA, 20 bp, Artificial
  CRISPR gRNA sequence
attttgcgagttgctctact

SEQ ID NO: 664472 - DNA, 20 bp, Artificial
  CRISPR gRNA sequence
tgcgagttgctctactctgt

SEQ ID NO: 664473 - DNA, 20 bp, Artificial
  CRISPR gRNA sequence
gcgagttgctctactctgta

SEQ ID NO: 664474 - DNA, 20 bp, Artificial
  CRISPR gRNA sequence
cgagttgctctactctgtaa

SEQ ID NO: 664475 - DNA, 20 bp, Artificial
  CRISPR gRNA sequence
ctctactctgtaatttattt

SEQ ID NO: 664476 - DNA, 20 bp, Artificial
  CRISPR gRNA sequence
tactctgtaatttatttctt

SEQ ID NO: 664477 - DNA, 20 bp, Artificial
  CRISPR gRNA sequence
ctctgtaatttatttcttct

SEQ ID NO: 664478 - DNA, 20 bp, Artificial
  CRISPR gRNA sequence
tgtaatttatttcttctcaa

SEQ ID NO: 664479 - DNA, 20 bp, Artificial
  CRISPR gRNA sequence
taatttatttcttctcaata

SEQ ID NO: 664480 - DNA, 20 bp, Artificial
  CRISPR gRNA sequence
atttcttctcaatatgtaga

SEQ ID NO: 664481 - DNA, 20 bp, Artificial
  CRISPR gRNA sequence
tttcttctcaatatgtagaa

SEQ ID NO: 664482 - DNA, 20 bp, Artificial
  CRISPR gRNA sequence
cttctcaatatgtagaatgg

SEQ ID NO: 664483 - DNA, 20 bp, Artificial
  CRISPR gRNA sequence
ttctcaatatgtagaatggt

SEQ ID NO: 664484 - DNA, 20 bp, Artificial
  CRISPR gRNA sequence
ctcaatatgtagaatggtgg

SEQ ID NO: 664485 - DNA, 20 bp, Artificial
  CRISPR gRNA sequence
tcaatatgtagaatggtggt

SEQ ID NO: 664486 - DNA, 20 bp, Artificial
  CRISPR gRNA sequence
aatatgtagaatggtggttc

SEQ ID NO: 664487 - DNA, 20 bp, Artificial
  CRISPR gRNA sequence
tcaactttggctgcacatta

SEQ ID NO: 664488 - DNA, 20 bp, Artificial
  CRISPR gRNA sequence
aactttggctgcacattaga

SEQ ID NO: 664489 - DNA, 20 bp, Artificial
  CRISPR gRNA sequence
tggctgcacattagaatcat

SEQ ID NO: 664490 - DNA, 20 bp, Artificial
  CRISPR gRNA sequence
ggctgcacattagaatcatc

SEQ ID NO: 664491 - DNA, 20 bp, Artificial
  CRISPR gRNA sequence
gctgcacattagaatcatct

SEQ ID NO: 664492 - DNA, 20 bp, Artificial
  CRISPR gRNA sequence
cacattagaatcatctggat

SEQ ID NO: 664493 - DNA, 20 bp, Artificial
  CRISPR gRNA sequence
gaatcatctggatatgttta

SEQ ID NO: 664494 - DNA, 20 bp, Artificial
  CRISPR gRNA sequence
gatatgtttaaaaaatactg

SEQ ID NO: 664495 - DNA, 20 bp, Artificial
  CRISPR gRNA sequence
aaaaaatactggtattttta

SEQ ID NO: 664496 - DNA, 20 bp, Artificial
  CRISPR gRNA sequence
aaaaatactggtatttttac

SEQ ID NO: 664497 - DNA, 20 bp, Artificial
  CRISPR gRNA sequence
gtatttttaccccatcccat

SEQ ID NO: 664498 - DNA, 20 bp, Artificial
  CRISPR gRNA sequence
ttaccccatcccataccaat

SEQ ID NO: 664499 - DNA, 20 bp, Artificial
  CRISPR gRNA sequence
taccccatcccataccaatt

SEQ ID NO: 664500 - DNA, 20 bp, Artificial
  CRISPR gRNA sequence
accccatcccataccaattt

SEQ ID NO: 664501 - DNA, 20 bp, Artificial
  CRISPR gRNA sequence
ccccatcccataccaattta

SEQ ID NO: 664502 - DNA, 20 bp, Artificial
  CRISPR gRNA sequence
aataaaaataggggtagggc

SEQ ID NO: 664503 - DNA, 20 bp, Artificial
  CRISPR gRNA sequence
ataaaaataggggtagggct

SEQ ID NO: 664504 - DNA, 20 bp, Artificial
  CRISPR gRNA sequence
aggcattgataatgatttat

SEQ ID NO: 664505 - DNA, 20 bp, Artificial
  CRISPR gRNA sequence
ataatgatttattaatttcc

SEQ ID NO: 664506 - DNA, 20 bp, Artificial
  CRISPR gRNA sequence
attaatttccccagataatt

SEQ ID NO: 664507 - DNA, 20 bp, Artificial
  CRISPR gRNA sequence
ttaatttccccagataattc

SEQ ID NO: 664508 - DNA, 20 bp, Artificial
  CRISPR gRNA sequence
atttccccagataattctga

SEQ ID NO: 664509 - DNA, 20 bp, Artificial
  CRISPR gRNA sequence
ccccagataattctgatgca

SEQ ID NO: 664510 - DNA, 20 bp, Artificial
  CRISPR gRNA sequence
cccagataattctgatgcac

SEQ ID NO: 664511 - DNA, 20 bp, Artificial
  CRISPR gRNA sequence
tgatgcacagtgaaggtcta

SEQ ID NO: 664512 - DNA, 20 bp, Artificial
  CRISPR gRNA sequence
atgcacagtgaaggtctaga

SEQ ID NO: 664513 - DNA, 20 bp, Artificial
  CRISPR gRNA sequence
gagccatggatatagaatga

SEQ ID NO: 664514 - DNA, 20 bp, Artificial
  CRISPR gRNA sequence
acctaacttctgtgactttt

SEQ ID NO: 664515 - DNA, 20 bp, Artificial
  CRISPR gRNA sequence
acttctgtgacttttttgag

SEQ ID NO: 664516 - DNA, 20 bp, Artificial
  CRISPR gRNA sequence
ctgtgacttttttgagattg

SEQ ID NO: 664517 - DNA, 20 bp, Artificial
  CRISPR gRNA sequence
tgtgacttttttgagattga

SEQ ID NO: 664518 - DNA, 20 bp, Artificial
  CRISPR gRNA sequence
tgacttttttgagattgatt

SEQ ID NO: 664519 - DNA, 20 bp, Artificial
  CRISPR gRNA sequence
ttttgagattgattaattca

SEQ ID NO: 664520 - DNA, 20 bp, Artificial
  CRISPR gRNA sequence
tttgagattgattaattcat

SEQ ID NO: 664521 - DNA, 20 bp, Artificial
  CRISPR gRNA sequence
ttgagattgattaattcatg

SEQ ID NO: 664522 - DNA, 20 bp, Artificial
  CRISPR gRNA sequence
tgagattgattaattcatgt

SEQ ID NO: 664523 - DNA, 20 bp, Artificial
  CRISPR gRNA sequence
gagattgattaattcatgtt

SEQ ID NO: 664524 - DNA, 20 bp, Artificial
  CRISPR gRNA sequence
agattgattaattcatgtta

SEQ ID NO: 664525 - DNA, 20 bp, Artificial
  CRISPR gRNA sequence
attaattcatgttaactgtt

SEQ ID NO: 664526 - DNA, 20 bp, Artificial
  CRISPR gRNA sequence
attcatgttaactgttttaa

SEQ ID NO: 664527 - DNA, 20 bp, Artificial
  CRISPR gRNA sequence
atgttaactgttttaatcac

SEQ ID NO: 664528 - DNA, 20 bp, Artificial
  CRISPR gRNA sequence
actgttttaatcactcttgt

SEQ ID NO: 664529 - DNA, 20 bp, Artificial
  CRISPR gRNA sequence
ttttaatcactcttgtaaaa

SEQ ID NO: 664530 - DNA, 20 bp, Artificial
  CRISPR gRNA sequence
taatcactcttgtaaaaaaa

SEQ ID NO: 664531 - DNA, 20 bp, Artificial
  CRISPR gRNA sequence
aatcactcttgtaaaaaaag

SEQ ID NO: 664532 - DNA, 20 bp, Artificial
  CRISPR gRNA sequence
atcactcttgtaaaaaaagc

SEQ ID NO: 664533 - DNA, 20 bp, Artificial
  CRISPR gRNA sequence
ttgtaaaaaaagctttctct

SEQ ID NO: 664534 - DNA, 20 bp, Artificial
  CRISPR gRNA sequence
gtaaaaaaagctttctctaa

SEQ ID NO: 664535 - DNA, 20 bp, Artificial
  CRISPR gRNA sequence
taaaaaaagctttctctaat

SEQ ID NO: 664536 - DNA, 20 bp, Artificial
  CRISPR gRNA sequence
tctctaatttatagggtctt

SEQ ID NO: 664537 - DNA, 20 bp, Artificial
  CRISPR gRNA sequence
ctctaatttatagggtcttt

SEQ ID NO: 664538 - DNA, 20 bp, Artificial
  CRISPR gRNA sequence
tctaatttatagggtctttt

SEQ ID NO: 664539 - DNA, 20 bp, Artificial
  CRISPR gRNA sequence
taatttatagggtctttttc

SEQ ID NO: 664540 - DNA, 20 bp, Artificial
  CRISPR gRNA sequence
atttatagggtctttttcaa

SEQ ID NO: 664541 - DNA, 20 bp, Artificial
  CRISPR gRNA sequence
atagggtctttttcaaaaat

SEQ ID NO: 664542 - DNA, 20 bp, Artificial
  CRISPR gRNA sequence
tagggtctttttcaaaaata

SEQ ID NO: 664543 - DNA, 20 bp, Artificial
  CRISPR gRNA sequence
tttcaaaaatatagaattag

SEQ ID NO: 664544 - DNA, 20 bp, Artificial
  CRISPR gRNA sequence
ttcaaaaatatagaattaga

SEQ ID NO: 664545 - DNA, 20 bp, Artificial
  CRISPR gRNA sequence
tcaaaaatatagaattagaa

SEQ ID NO: 664546 - DNA, 20 bp, Artificial
  CRISPR gRNA sequence
caaaaatatagaattagaag

SEQ ID NO: 664547 - DNA, 20 bp, Artificial
  CRISPR gRNA sequence
aaaaatatagaattagaagt

SEQ ID NO: 664548 - DNA, 20 bp, Artificial
  CRISPR gRNA sequence
gaagtgtcctttgatatact

SEQ ID NO: 664549 - DNA, 20 bp, Artificial
  CRISPR gRNA sequence
tgatatacttctgttccttg

SEQ ID NO: 664550 - DNA, 20 bp, Artificial
  CRISPR gRNA sequence
gatatacttctgttccttgc

SEQ ID NO: 664551 - DNA, 20 bp, Artificial
  CRISPR gRNA sequence
atatacttctgttccttgcc

SEQ ID NO: 664552 - DNA, 20 bp, Artificial
  CRISPR gRNA sequence
ctgttccttgccagattaca

SEQ ID NO: 664553 - DNA, 20 bp, Artificial
  CRISPR gRNA sequence
tgttccttgccagattacat

SEQ ID NO: 664554 - DNA, 20 bp, Artificial
  CRISPR gRNA sequence
ttccttgccagattacattc

SEQ ID NO: 664555 - DNA, 20 bp, Artificial
  CRISPR gRNA sequence
cttgccagattacattcaac

SEQ ID NO: 664556 - DNA, 20 bp, Artificial
  CRISPR gRNA sequence
gccagattacattcaaccat

SEQ ID NO: 664557 - DNA, 20 bp, Artificial
  CRISPR gRNA sequence
ccagattacattcaaccatt

SEQ ID NO: 664558 - DNA, 20 bp, Artificial
  CRISPR gRNA sequence
cattcaaccattaatttaag

SEQ ID NO: 664559 - DNA, 20 bp, Artificial
  CRISPR gRNA sequence
aaccattaatttaaggtaag

SEQ ID NO: 664560 - DNA, 20 bp, Artificial
  CRISPR gRNA sequence
atttaaggtaaggatgtttg

SEQ ID NO: 664561 - DNA, 20 bp, Artificial
  CRISPR gRNA sequence
aaggtaaggatgtttgacaa

SEQ ID NO: 664562 - DNA, 20 bp, Artificial
  CRISPR gRNA sequence
aggtaaggatgtttgacaat

SEQ ID NO: 664563 - DNA, 20 bp, Artificial
  CRISPR gRNA sequence
gacaatagatattgtaaata

SEQ ID NO: 664564 - DNA, 20 bp, Artificial
  CRISPR gRNA sequence
acaatagatattgtaaatat

SEQ ID NO: 664565 - DNA, 20 bp, Artificial
  CRISPR gRNA sequence
taaatatgtaattatatttt

SEQ ID NO: 664566 - DNA, 20 bp, Artificial
  CRISPR gRNA sequence
tattttttcaccttttaatt

SEQ ID NO: 664567 - DNA, 20 bp, Artificial
  CRISPR gRNA sequence
tttcaccttttaattacaaa

SEQ ID NO: 664568 - DNA, 20 bp, Artificial
  CRISPR gRNA sequence
ttcaccttttaattacaaat

SEQ ID NO: 664569 - DNA, 20 bp, Artificial
  CRISPR gRNA sequence
tcaccttttaattacaaata

SEQ ID NO: 664570 - DNA, 20 bp, Artificial
  CRISPR gRNA sequence
caccttttaattacaaataa

SEQ ID NO: 664571 - DNA, 20 bp, Artificial
  CRISPR gRNA sequence
accttttaattacaaataaa

SEQ ID NO: 664572 - DNA, 20 bp, Artificial
  CRISPR gRNA sequence
ttaattacaaataaaatttg

SEQ ID NO: 664573 - DNA, 20 bp, Artificial
  CRISPR gRNA sequence
taattacaaataaaatttga

SEQ ID NO: 664574 - DNA, 20 bp, Artificial
  CRISPR gRNA sequence
aattacaaataaaatttgat

SEQ ID NO: 664575 - DNA, 20 bp, Artificial
  CRISPR gRNA sequence
attacaaataaaatttgatt

SEQ ID NO: 664576 - DNA, 20 bp, Artificial
  CRISPR gRNA sequence
caaataaaatttgatttgtc

SEQ ID NO: 664577 - DNA, 20 bp, Artificial
  CRISPR gRNA sequence
gatttgtcaacaagtacata

SEQ ID NO: 664578 - DNA, 20 bp, Artificial
  CRISPR gRNA sequence
atttgtcaacaagtacatat

SEQ ID NO: 664579 - DNA, 20 bp, Artificial
  CRISPR gRNA sequence
gtcaacaagtacatattgat

SEQ ID NO: 664580 - DNA, 20 bp, Artificial
  CRISPR gRNA sequence
tcaacaagtacatattgata

SEQ ID NO: 664581 - DNA, 20 bp, Artificial
  CRISPR gRNA sequence
atagagagcagagggggaga

SEQ ID NO: 664582 - DNA, 20 bp, Artificial
  CRISPR gRNA sequence
gaagttaggggaaagggaat

SEQ ID NO: 664583 - DNA, 20 bp, Artificial
  CRISPR gRNA sequence
ggggaaagggaatggcattt

SEQ ID NO: 664584 - DNA, 20 bp, Artificial
  CRISPR gRNA sequence
attgaacacttccgtgtgct

SEQ ID NO: 664585 - DNA, 20 bp, Artificial
  CRISPR gRNA sequence
ttgaacacttccgtgtgctg

SEQ ID NO: 664586 - DNA, 20 bp, Artificial
  CRISPR gRNA sequence
aacacttccgtgtgctgtgt

SEQ ID NO: 664587 - DNA, 20 bp, Artificial
  CRISPR gRNA sequence
ccgtgtgctgtgtgtcaggt

SEQ ID NO: 664588 - DNA, 20 bp, Artificial
  CRISPR gRNA sequence
cgtgtgctgtgtgtcaggtt

SEQ ID NO: 664589 - DNA, 20 bp, Artificial
  CRISPR gRNA sequence
tgtgtcaggttctatgatac

SEQ ID NO: 664590 - DNA, 20 bp, Artificial
  CRISPR gRNA sequence
tatgatacaatcacccgtaa

SEQ ID NO: 664591 - DNA, 20 bp, Artificial
  CRISPR gRNA sequence
tgatacaatcacccgtaata

SEQ ID NO: 664592 - DNA, 20 bp, Artificial
  CRISPR gRNA sequence
ctgcttatatatgatgaaat

SEQ ID NO: 664593 - DNA, 20 bp, Artificial
  CRISPR gRNA sequence
tgcttatatatgatgaaatc

SEQ ID NO: 664594 - DNA, 20 bp, Artificial
  CRISPR gRNA sequence
cttatatatgatgaaatcag

SEQ ID NO: 664595 - DNA, 20 bp, Artificial
  CRISPR gRNA sequence
atatatgatgaaatcagttc

SEQ ID NO: 664596 - DNA, 20 bp, Artificial
  CRISPR gRNA sequence
tatatgatgaaatcagttct

SEQ ID NO: 664597 - DNA, 20 bp, Artificial
  CRISPR gRNA sequence
ttaaagagttattaattaag

SEQ ID NO: 664598 - DNA, 20 bp, Artificial
  CRISPR gRNA sequence
aaagagttattaattaagtt

SEQ ID NO: 664599 - DNA, 20 bp, Artificial
  CRISPR gRNA sequence
aagagttattaattaagttt

SEQ ID NO: 664600 - DNA, 20 bp, Artificial
  CRISPR gRNA sequence
ttaattaagtttaattatat

SEQ ID NO: 664601 - DNA, 20 bp, Artificial
  CRISPR gRNA sequence
attaagtttaattatatttt

SEQ ID NO: 664602 - DNA, 20 bp, Artificial
  CRISPR gRNA sequence
agtttaattatattttgtaa

SEQ ID NO: 664603 - DNA, 20 bp, Artificial
  CRISPR gRNA sequence
aattatattttgtaagtcat

SEQ ID NO: 664604 - DNA, 20 bp, Artificial
  CRISPR gRNA sequence
attatattttgtaagtcata

SEQ ID NO: 664605 - DNA, 20 bp, Artificial
  CRISPR gRNA sequence
tattttgtaagtcatagaat

SEQ ID NO: 664606 - DNA, 20 bp, Artificial
  CRISPR gRNA sequence
tgtaagtcatagaatctcaa

SEQ ID NO: 664607 - DNA, 20 bp, Artificial
  CRISPR gRNA sequence
gtaagtcatagaatctcaag

SEQ ID NO: 664608 - DNA, 20 bp, Artificial
  CRISPR gRNA sequence
taagtcatagaatctcaagg

SEQ ID NO: 664609 - DNA, 20 bp, Artificial
  CRISPR gRNA sequence
aagggtatgactgatcttaa

SEQ ID NO: 664610 - DNA, 20 bp, Artificial
  CRISPR gRNA sequence
atcttaaaagtcatttgaat

SEQ ID NO: 664611 - DNA, 20 bp, Artificial
  CRISPR gRNA sequence
aaaagtcatttgaataactc

SEQ ID NO: 664612 - DNA, 20 bp, Artificial
  CRISPR gRNA sequence
aaagtcatttgaataactca

SEQ ID NO: 664613 - DNA, 20 bp, Artificial
  CRISPR gRNA sequence
gaataactcatctactggac

SEQ ID NO: 664614 - DNA, 20 bp, Artificial
  CRISPR gRNA sequence
aataactcatctactggaca

SEQ ID NO: 664615 - DNA, 20 bp, Artificial
  CRISPR gRNA sequence
atctactggacataaaggct

SEQ ID NO: 664616 - DNA, 20 bp, Artificial
  CRISPR gRNA sequence
ctggacataaaggctaaatg

SEQ ID NO: 664617 - DNA, 20 bp, Artificial
  CRISPR gRNA sequence
gacataaaggctaaatgtga

SEQ ID NO: 664618 - DNA, 20 bp, Artificial
  CRISPR gRNA sequence
aatgtgaaggtttctgaata

SEQ ID NO: 664619 - DNA, 20 bp, Artificial
  CRISPR gRNA sequence
ctgaatactttaacatatga

SEQ ID NO: 664620 - DNA, 20 bp, Artificial
  CRISPR gRNA sequence
tgaatactttaacatatgaa

SEQ ID NO: 664621 - DNA, 20 bp, Artificial
  CRISPR gRNA sequence
aatactttaacatatgaaat

SEQ ID NO: 664622 - DNA, 20 bp, Artificial
  CRISPR gRNA sequence
taacatatgaaatcaagagt

SEQ ID NO: 664623 - DNA, 20 bp, Artificial
  CRISPR gRNA sequence
aacatatgaaatcaagagtg

SEQ ID NO: 664624 - DNA, 20 bp, Artificial
  CRISPR gRNA sequence
acatatgaaatcaagagtga

SEQ ID NO: 664625 - DNA, 20 bp, Artificial
  CRISPR gRNA sequence
ggattttaaaagtatgtcat

SEQ ID NO: 664626 - DNA, 20 bp, Artificial
  CRISPR gRNA sequence
taaaagtatgtcatcaagaa

SEQ ID NO: 664627 - DNA, 20 bp, Artificial
  CRISPR gRNA sequence
aaaagtatgtcatcaagaaa

SEQ ID NO: 664628 - DNA, 20 bp, Artificial
  CRISPR gRNA sequence
aaagtatgtcatcaagaaat

SEQ ID NO: 664629 - DNA, 20 bp, Artificial
  CRISPR gRNA sequence
ggtaatatgttatacaggtt

SEQ ID NO: 664630 - DNA, 20 bp, Artificial
  CRISPR gRNA sequence
gtaatatgttatacaggtta

SEQ ID NO: 664631 - DNA, 20 bp, Artificial
  CRISPR gRNA sequence
tacaggttatacagtgtaac

SEQ ID NO: 664632 - DNA, 20 bp, Artificial
  CRISPR gRNA sequence
tacagtgtaactgtttgctt

SEQ ID NO: 664633 - DNA, 20 bp, Artificial
  CRISPR gRNA sequence
tttgcttcatggtgttgagt

SEQ ID NO: 664634 - DNA, 20 bp, Artificial
  CRISPR gRNA sequence
gcttcatggtgttgagtttt

SEQ ID NO: 664635 - DNA, 20 bp, Artificial
  CRISPR gRNA sequence
cttcatggtgttgagtttta

SEQ ID NO: 664636 - DNA, 20 bp, Artificial
  CRISPR gRNA sequence
catggtgttgagttttattt

SEQ ID NO: 664637 - DNA, 20 bp, Artificial
  CRISPR gRNA sequence
atggtgttgagttttatttt

SEQ ID NO: 664638 - DNA, 20 bp, Artificial
  CRISPR gRNA sequence
agttttatttttattttatt

SEQ ID NO: 664639 - DNA, 20 bp, Artificial
  CRISPR gRNA sequence
tatttttattttatttttca

SEQ ID NO: 664640 - DNA, 20 bp, Artificial
  CRISPR gRNA sequence
atttttattttatttttcaa

SEQ ID NO: 664641 - DNA, 20 bp, Artificial
  CRISPR gRNA sequence
tttttattttatttttcaat

SEQ ID NO: 664642 - DNA, 20 bp, Artificial
  CRISPR gRNA sequence
ttattttatttttcaattat

SEQ ID NO: 664643 - DNA, 20 bp, Artificial
  CRISPR gRNA sequence
tattttatttttcaattatg

SEQ ID NO: 664644 - DNA, 20 bp, Artificial
  CRISPR gRNA sequence
attttatttttcaattatgg

SEQ ID NO: 664645 - DNA, 20 bp, Artificial
  CRISPR gRNA sequence
ttttatttttcaattatggc

SEQ ID NO: 664646 - DNA, 20 bp, Artificial
  CRISPR gRNA sequence
tatttttcaattatggcaga

SEQ ID NO: 664647 - DNA, 20 bp, Artificial
  CRISPR gRNA sequence
atttttcaattatggcagag

SEQ ID NO: 664648 - DNA, 20 bp, Artificial
  CRISPR gRNA sequence
tttttcaattatggcagaga

SEQ ID NO: 664649 - DNA, 20 bp, Artificial
  CRISPR gRNA sequence
ttcaattatggcagagatag

SEQ ID NO: 664650 - DNA, 20 bp, Artificial
  CRISPR gRNA sequence
tcaattatggcagagataga

SEQ ID NO: 664651 - DNA, 20 bp, Artificial
  CRISPR gRNA sequence
caattatggcagagatagaa

SEQ ID NO: 664652 - DNA, 20 bp, Artificial
  CRISPR gRNA sequence
aattatggcagagatagaag

SEQ ID NO: 664653 - DNA, 20 bp, Artificial
  CRISPR gRNA sequence
tggcagagatagaagtttaa

SEQ ID NO: 664654 - DNA, 20 bp, Artificial
  CRISPR gRNA sequence
aattctttagatatgattat

SEQ ID NO: 664655 - DNA, 20 bp, Artificial
  CRISPR gRNA sequence
attctttagatatgattatt

SEQ ID NO: 664656 - DNA, 20 bp, Artificial
  CRISPR gRNA sequence
tttagatatgattattaact

SEQ ID NO: 664657 - DNA, 20 bp, Artificial
  CRISPR gRNA sequence
tagatatgattattaactaa

SEQ ID NO: 664658 - DNA, 20 bp, Artificial
  CRISPR gRNA sequence
agatatgattattaactaat

SEQ ID NO: 664659 - DNA, 20 bp, Artificial
  CRISPR gRNA sequence
gatatgattattaactaata

SEQ ID NO: 664660 - DNA, 20 bp, Artificial
  CRISPR gRNA sequence
ttaactaataaaacattttg

SEQ ID NO: 664661 - DNA, 20 bp, Artificial
  CRISPR gRNA sequence
actaataaaacattttgaaa

SEQ ID NO: 664662 - DNA, 20 bp, Artificial
  CRISPR gRNA sequence
ataaaacattttgaaatatt

SEQ ID NO: 664663 - DNA, 20 bp, Artificial
  CRISPR gRNA sequence
tgaaatattttatatcaatt

SEQ ID NO: 664664 - DNA, 20 bp, Artificial
  CRISPR gRNA sequence
gaaatattttatatcaattt

SEQ ID NO: 664665 - DNA, 20 bp, Artificial
  CRISPR gRNA sequence
aaatattttatatcaattta

SEQ ID NO: 664666 - DNA, 20 bp, Artificial
  CRISPR gRNA sequence
tatatcaatttatattatta

SEQ ID NO: 664667 - DNA, 20 bp, Artificial
  CRISPR gRNA sequence
atatcaatttatattattat

SEQ ID NO: 664668 - DNA, 20 bp, Artificial
  CRISPR gRNA sequence
tatcaatttatattattata

SEQ ID NO: 664669 - DNA, 20 bp, Artificial
  CRISPR gRNA sequence
atattattataaatctgatt

SEQ ID NO: 664670 - DNA, 20 bp, Artificial
  CRISPR gRNA sequence
tattattataaatctgatta

SEQ ID NO: 664671 - DNA, 20 bp, Artificial
  CRISPR gRNA sequence
ttataaatctgattatttcc

SEQ ID NO: 664672 - DNA, 20 bp, Artificial
  CRISPR gRNA sequence
taaatctgattatttccaac

SEQ ID NO: 664673 - DNA, 20 bp, Artificial
  CRISPR gRNA sequence
attatttccaactattgcat

SEQ ID NO: 664674 - DNA, 20 bp, Artificial
  CRISPR gRNA sequence
tttccaactattgcatattt

SEQ ID NO: 664675 - DNA, 20 bp, Artificial
  CRISPR gRNA sequence
ccaactattgcatatttttt

SEQ ID NO: 664676 - DNA, 20 bp, Artificial
  CRISPR gRNA sequence
caactattgcatatttttta

SEQ ID NO: 664677 - DNA, 20 bp, Artificial
  CRISPR gRNA sequence
ttgcatattttttagaatca

SEQ ID NO: 664678 - DNA, 20 bp, Artificial
  CRISPR gRNA sequence
catattttttagaatcacca

SEQ ID NO: 664679 - DNA, 20 bp, Artificial
  CRISPR gRNA sequence
tttagaatcaccatagttaa

SEQ ID NO: 664680 - DNA, 20 bp, Artificial
  CRISPR gRNA sequence
ttagaatcaccatagttaac

SEQ ID NO: 664681 - DNA, 20 bp, Artificial
  CRISPR gRNA sequence
tagaatcaccatagttaact

SEQ ID NO: 664682 - DNA, 20 bp, Artificial
  CRISPR gRNA sequence
agaatcaccatagttaacta

SEQ ID NO: 664683 - DNA, 20 bp, Artificial
  CRISPR gRNA sequence
gaatcaccatagttaactag

SEQ ID NO: 664684 - DNA, 20 bp, Artificial
  CRISPR gRNA sequence
actagaatgattcccagttg

SEQ ID NO: 664685 - DNA, 20 bp, Artificial
  CRISPR gRNA sequence
gaatgattcccagttgtact

SEQ ID NO: 664686 - DNA, 20 bp, Artificial
  CRISPR gRNA sequence
ccagttgtactaattagcat

SEQ ID NO: 664687 - DNA, 20 bp, Artificial
  CRISPR gRNA sequence
tactaattagcataaaaagc

SEQ ID NO: 664688 - DNA, 20 bp, Artificial
  CRISPR gRNA sequence
attagcataaaaagctaatt

SEQ ID NO: 664689 - DNA, 20 bp, Artificial
  CRISPR gRNA sequence
gcataaaaagctaattaatt

SEQ ID NO: 664690 - DNA, 20 bp, Artificial
  CRISPR gRNA sequence
attaattatctcattaaact

SEQ ID NO: 664691 - DNA, 20 bp, Artificial
  CRISPR gRNA sequence
attatctcattaaactgcat

SEQ ID NO: 664692 - DNA, 20 bp, Artificial
  CRISPR gRNA sequence
tctcattaaactgcatgcca

SEQ ID NO: 664693 - DNA, 20 bp, Artificial
  CRISPR gRNA sequence
attaaactgcatgccattag

SEQ ID NO: 664694 - DNA, 20 bp, Artificial
  CRISPR gRNA sequence
aactgcatgccattagcctt

SEQ ID NO: 664695 - DNA, 20 bp, Artificial
  CRISPR gRNA sequence
catgccattagccttgattt

SEQ ID NO: 664696 - DNA, 20 bp, Artificial
  CRISPR gRNA sequence
gccttgattttactgcacat

SEQ ID NO: 664697 - DNA, 20 bp, Artificial
  CRISPR gRNA sequence
gattttactgcacatttgat

SEQ ID NO: 664698 - DNA, 20 bp, Artificial
  CRISPR gRNA sequence
attttactgcacatttgatg

SEQ ID NO: 664699 - DNA, 20 bp, Artificial
  CRISPR gRNA sequence
tactgcacatttgatgtatt

SEQ ID NO: 664700 - DNA, 20 bp, Artificial
  CRISPR gRNA sequence
actgcacatttgatgtatta

SEQ ID NO: 664701 - DNA, 20 bp, Artificial
  CRISPR gRNA sequence
ctgcacatttgatgtattat

SEQ ID NO: 664702 - DNA, 20 bp, Artificial
  CRISPR gRNA sequence
cacatttgatgtattatctc

SEQ ID NO: 664703 - DNA, 20 bp, Artificial
  CRISPR gRNA sequence
gatgtattatctcttggtct

SEQ ID NO: 664704 - DNA, 20 bp, Artificial
  CRISPR gRNA sequence
atgtattatctcttggtctt

SEQ ID NO: 664705 - DNA, 20 bp, Artificial
  CRISPR gRNA sequence
tctcttggtctttaaaaata

SEQ ID NO: 664706 - DNA, 20 bp, Artificial
  CRISPR gRNA sequence
ttggtctttaaaaatataga

SEQ ID NO: 664707 - DNA, 20 bp, Artificial
  CRISPR gRNA sequence
ggtctttaaaaatatagaaa

SEQ ID NO: 664708 - DNA, 20 bp, Artificial
  CRISPR gRNA sequence
gtctttaaaaatatagaaaa

SEQ ID NO: 664709 - DNA, 20 bp, Artificial
  CRISPR gRNA sequence
taaaaatatagaaaataata

SEQ ID NO: 664710 - DNA, 20 bp, Artificial
  CRISPR gRNA sequence
aaaaatatagaaaataatag

SEQ ID NO: 664711 - DNA, 20 bp, Artificial
  CRISPR gRNA sequence
aaaatatagaaaataatagt

SEQ ID NO: 664712 - DNA, 20 bp, Artificial
  CRISPR gRNA sequence
agtctttcaataattgattt

SEQ ID NO: 664713 - DNA, 20 bp, Artificial
  CRISPR gRNA sequence
gtctttcaataattgatttt

SEQ ID NO: 664714 - DNA, 20 bp, Artificial
  CRISPR gRNA sequence
tcaataattgattttaaatt

SEQ ID NO: 664715 - DNA, 20 bp, Artificial
  CRISPR gRNA sequence
caataattgattttaaattg

SEQ ID NO: 664716 - DNA, 20 bp, Artificial
  CRISPR gRNA sequence
aataattgattttaaattgg

SEQ ID NO: 664717 - DNA, 20 bp, Artificial
  CRISPR gRNA sequence
attttaaattggcgtttttc

SEQ ID NO: 664718 - DNA, 20 bp, Artificial
  CRISPR gRNA sequence
taaattggcgtttttcaaaa

SEQ ID NO: 664719 - DNA, 20 bp, Artificial
  CRISPR gRNA sequence
aaattggcgtttttcaaaaa

SEQ ID NO: 664720 - DNA, 20 bp, Artificial
  CRISPR gRNA sequence
aattggcgtttttcaaaaaa

SEQ ID NO: 664721 - DNA, 20 bp, Artificial
  CRISPR gRNA sequence
gcgtttttcaaaaaaacttt

SEQ ID NO: 664722 - DNA, 20 bp, Artificial
  CRISPR gRNA sequence
ttcaaaaaaacttttgtaat

SEQ ID NO: 664723 - DNA, 20 bp, Artificial
  CRISPR gRNA sequence
tcaaaaaaacttttgtaatc

SEQ ID NO: 664724 - DNA, 20 bp, Artificial
  CRISPR gRNA sequence
caaaaaaacttttgtaatct

SEQ ID NO: 664725 - DNA, 20 bp, Artificial
  CRISPR gRNA sequence
aaaaaaacttttgtaatctc

SEQ ID NO: 664726 - DNA, 20 bp, Artificial
  CRISPR gRNA sequence
ttgtaatctcaggaattaat

SEQ ID NO: 664727 - DNA, 20 bp, Artificial
  CRISPR gRNA sequence
tgtaatctcaggaattaata

SEQ ID NO: 664728 - DNA, 20 bp, Artificial
  CRISPR gRNA sequence
gtaatctcaggaattaataa

SEQ ID NO: 664729 - DNA, 20 bp, Artificial
  CRISPR gRNA sequence
taatctcaggaattaataat

SEQ ID NO: 664730 - DNA, 20 bp, Artificial
  CRISPR gRNA sequence
aggaattaataattaacgcg

SEQ ID NO: 664731 - DNA, 20 bp, Artificial
  CRISPR gRNA sequence
ataattaacgcgacaaattt

SEQ ID NO: 664732 - DNA, 20 bp, Artificial
  CRISPR gRNA sequence
acgcgacaaatttatttcca

SEQ ID NO: 664733 - DNA, 20 bp, Artificial
  CRISPR gRNA sequence
atttccaatcaatgaaataa

SEQ ID NO: 664734 - DNA, 20 bp, Artificial
  CRISPR gRNA sequence
tttccaatcaatgaaataaa

SEQ ID NO: 664735 - DNA, 20 bp, Artificial
  CRISPR gRNA sequence
ccaatcaatgaaataaatac

SEQ ID NO: 664736 - DNA, 20 bp, Artificial
  CRISPR gRNA sequence
caatcaatgaaataaataca

SEQ ID NO: 664737 - DNA, 20 bp, Artificial
  CRISPR gRNA sequence
taaaataataaaataccatg

SEQ ID NO: 664738 - DNA, 20 bp, Artificial
  CRISPR gRNA sequence
aaaataataaaataccatgt

SEQ ID NO: 664739 - DNA, 20 bp, Artificial
  CRISPR gRNA sequence
aaataataaaataccatgtt

SEQ ID NO: 664740 - DNA, 20 bp, Artificial
  CRISPR gRNA sequence
tactcaccatattataaatg

SEQ ID NO: 664741 - DNA, 20 bp, Artificial
  CRISPR gRNA sequence
actcaccatattataaatga

SEQ ID NO: 664742 - DNA, 20 bp, Artificial
  CRISPR gRNA sequence
ctcaccatattataaatgat

SEQ ID NO: 664743 - DNA, 20 bp, Artificial
  CRISPR gRNA sequence
accatattataaatgatgaa

SEQ ID NO: 664744 - DNA, 20 bp, Artificial
  CRISPR gRNA sequence
taaatgatgaaagctactga

SEQ ID NO: 664745 - DNA, 20 bp, Artificial
  CRISPR gRNA sequence
ctgagattgtttaacatcaa

SEQ ID NO: 664746 - DNA, 20 bp, Artificial
  CRISPR gRNA sequence
agattgtttaacatcaataa

SEQ ID NO: 664747 - DNA, 20 bp, Artificial
  CRISPR gRNA sequence
tttaacatcaataacattgt

SEQ ID NO: 664748 - DNA, 20 bp, Artificial
  CRISPR gRNA sequence
aacatcaataacattgtatt

SEQ ID NO: 664749 - DNA, 20 bp, Artificial
  CRISPR gRNA sequence
acatcaataacattgtattg

SEQ ID NO: 664750 - DNA, 20 bp, Artificial
  CRISPR gRNA sequence
tattggttttattgatagca

SEQ ID NO: 664751 - DNA, 20 bp, Artificial
  CRISPR gRNA sequence
gttttattgatagcattaca

SEQ ID NO: 664752 - DNA, 20 bp, Artificial
  CRISPR gRNA sequence
tattgatagcattacattgg

SEQ ID NO: 664753 - DNA, 20 bp, Artificial
  CRISPR gRNA sequence
attgatagcattacattggt

SEQ ID NO: 664754 - DNA, 20 bp, Artificial
  CRISPR gRNA sequence
ttgatagcattacattggta

SEQ ID NO: 664755 - DNA, 20 bp, Artificial
  CRISPR gRNA sequence
atagcattacattggtaatg

SEQ ID NO: 664756 - DNA, 20 bp, Artificial
  CRISPR gRNA sequence
cattggtaatgttgttttga

SEQ ID NO: 664757 - DNA, 20 bp, Artificial
  CRISPR gRNA sequence
gtaatgttgttttgacacag

SEQ ID NO: 664758 - DNA, 20 bp, Artificial
  CRISPR gRNA sequence
ttttgacacagtactcatgc

SEQ ID NO: 664759 - DNA, 20 bp, Artificial
  CRISPR gRNA sequence
tgacacagtactcatgcaag

SEQ ID NO: 664760 - DNA, 20 bp, Artificial
  CRISPR gRNA sequence
gacacagtactcatgcaagt

SEQ ID NO: 664761 - DNA, 20 bp, Artificial
  CRISPR gRNA sequence
acacagtactcatgcaagtt

SEQ ID NO: 664762 - DNA, 20 bp, Artificial
  CRISPR gRNA sequence
atgcaagtttaaattgacac

SEQ ID NO: 664763 - DNA, 20 bp, Artificial
  CRISPR gRNA sequence
aaattgacacctcattttgg

SEQ ID NO: 664764 - DNA, 20 bp, Artificial
  CRISPR gRNA sequence
aattgacacctcattttgga

SEQ ID NO: 664765 - DNA, 20 bp, Artificial
  CRISPR gRNA sequence
acacctcattttggacggca

SEQ ID NO: 664766 - DNA, 20 bp, Artificial
  CRISPR gRNA sequence
attttggacggcagttttat

SEQ ID NO: 664767 - DNA, 20 bp, Artificial
  CRISPR gRNA sequence
tggacggcagttttatatat

SEQ ID NO: 664768 - DNA, 20 bp, Artificial
  CRISPR gRNA sequence
ggacggcagttttatatatg

SEQ ID NO: 664769 - DNA, 20 bp, Artificial
  CRISPR gRNA sequence
gacggcagttttatatatgg

SEQ ID NO: 664770 - DNA, 20 bp, Artificial
  CRISPR gRNA sequence
tatatatgggaactttataa

SEQ ID NO: 664771 - DNA, 20 bp, Artificial
  CRISPR gRNA sequence
atatatgggaactttataat

SEQ ID NO: 664772 - DNA, 20 bp, Artificial
  CRISPR gRNA sequence
tatatgggaactttataatg

SEQ ID NO: 664773 - DNA, 20 bp, Artificial
  CRISPR gRNA sequence
tataatgcgcttgcctctct

SEQ ID NO: 664774 - DNA, 20 bp, Artificial
  CRISPR gRNA sequence
ataatgcgcttgcctctctt

SEQ ID NO: 664775 - DNA, 20 bp, Artificial
  CRISPR gRNA sequence
taatgcgcttgcctctcttt

SEQ ID NO: 664776 - DNA, 20 bp, Artificial
  CRISPR gRNA sequence
gcctctcttttcacctaata

SEQ ID NO: 664777 - DNA, 20 bp, Artificial
  CRISPR gRNA sequence
cctctcttttcacctaataa

SEQ ID NO: 664778 - DNA, 20 bp, Artificial
  CRISPR gRNA sequence
tcttttcacctaataatgcc

SEQ ID NO: 664779 - DNA, 20 bp, Artificial
  CRISPR gRNA sequence
ttttcacctaataatgcctt

SEQ ID NO: 664780 - DNA, 20 bp, Artificial
  CRISPR gRNA sequence
ttcacctaataatgccttct

SEQ ID NO: 664781 - DNA, 20 bp, Artificial
  CRISPR gRNA sequence
tcacctaataatgccttctt

SEQ ID NO: 664782 - DNA, 20 bp, Artificial
  CRISPR gRNA sequence
cacctaataatgccttcttt

SEQ ID NO: 664783 - DNA, 20 bp, Artificial
  CRISPR gRNA sequence
acctaataatgccttctttg

SEQ ID NO: 664784 - DNA, 20 bp, Artificial
  CRISPR gRNA sequence
ataatgccttctttgagact

SEQ ID NO: 664785 - DNA, 20 bp, Artificial
  CRISPR gRNA sequence
ctttgagacttcaattttaa

SEQ ID NO: 664786 - DNA, 20 bp, Artificial
  CRISPR gRNA sequence
tttgagacttcaattttaag

SEQ ID NO: 664787 - DNA, 20 bp, Artificial
  CRISPR gRNA sequence
tgagacttcaattttaagaa

SEQ ID NO: 664788 - DNA, 20 bp, Artificial
  CRISPR gRNA sequence
gagacttcaattttaagaaa

SEQ ID NO: 664789 - DNA, 20 bp, Artificial
  CRISPR gRNA sequence
agacttcaattttaagaaac

SEQ ID NO: 664790 - DNA, 20 bp, Artificial
  CRISPR gRNA sequence
caattttaagaaacctgtta

SEQ ID NO: 664791 - DNA, 20 bp, Artificial
  CRISPR gRNA sequence
aattttaagaaacctgttag

SEQ ID NO: 664792 - DNA, 20 bp, Artificial
  CRISPR gRNA sequence
taagaaacctgttagaaatg

SEQ ID NO: 664793 - DNA, 20 bp, Artificial
  CRISPR gRNA sequence
aagaaacctgttagaaatgc

SEQ ID NO: 664794 - DNA, 20 bp, Artificial
  CRISPR gRNA sequence
agaaacctgttagaaatgca

SEQ ID NO: 664795 - DNA, 20 bp, Artificial
  CRISPR gRNA sequence
ttagaaatgcagacagattt

SEQ ID NO: 664796 - DNA, 20 bp, Artificial
  CRISPR gRNA sequence
gaaatgcagacagatttatc

SEQ ID NO: 664797 - DNA, 20 bp, Artificial
  CRISPR gRNA sequence
atccacaaaagtagacactg

SEQ ID NO: 664798 - DNA, 20 bp, Artificial
  CRISPR gRNA sequence
tccacaaaagtagacactgg

SEQ ID NO: 664799 - DNA, 20 bp, Artificial
  CRISPR gRNA sequence
gagtattattattggaaatt

SEQ ID NO: 664800 - DNA, 20 bp, Artificial
  CRISPR gRNA sequence
ttattggaaattactttcgg

SEQ ID NO: 664801 - DNA, 20 bp, Artificial
  CRISPR gRNA sequence
ttggaaattactttcggtac

SEQ ID NO: 664802 - DNA, 20 bp, Artificial
  CRISPR gRNA sequence
gaaattactttcggtacagt

SEQ ID NO: 664803 - DNA, 20 bp, Artificial
  CRISPR gRNA sequence
ctttcggtacagtgcttagg

SEQ ID NO: 664804 - DNA, 20 bp, Artificial
  CRISPR gRNA sequence
tcggtacagtgcttaggtaa

SEQ ID NO: 664805 - DNA, 20 bp, Artificial
  CRISPR gRNA sequence
cggtacagtgcttaggtaaa

SEQ ID NO: 664806 - DNA, 20 bp, Artificial
  CRISPR gRNA sequence
ggtacagtgcttaggtaaat

SEQ ID NO: 664807 - DNA, 20 bp, Artificial
  CRISPR gRNA sequence
aggtaaatcatggttattcc

SEQ ID NO: 664808 - DNA, 20 bp, Artificial
  CRISPR gRNA sequence
ggtaaatcatggttattcca

SEQ ID NO: 664809 - DNA, 20 bp, Artificial
  CRISPR gRNA sequence
ttccataagctgaagtatat

SEQ ID NO: 664810 - DNA, 20 bp, Artificial
  CRISPR gRNA sequence
cataagctgaagtatatata

SEQ ID NO: 664811 - DNA, 20 bp, Artificial
  CRISPR gRNA sequence
aagtatatatagtcttaaaa

SEQ ID NO: 664812 - DNA, 20 bp, Artificial
  CRISPR gRNA sequence
aaaaattatgctgttgaaga

SEQ ID NO: 664813 - DNA, 20 bp, Artificial
  CRISPR gRNA sequence
aaaattatgctgttgaagaa

SEQ ID NO: 664814 - DNA, 20 bp, Artificial
  CRISPR gRNA sequence
tgctgttgaagaatttctta

SEQ ID NO: 664815 - DNA, 20 bp, Artificial
  CRISPR gRNA sequence
ttgaagaatttcttaatgac

SEQ ID NO: 664816 - DNA, 20 bp, Artificial
  CRISPR gRNA sequence
aagaatttcttaatgacatg

SEQ ID NO: 664817 - DNA, 20 bp, Artificial
  CRISPR gRNA sequence
cttaatgacatggaaatgct

SEQ ID NO: 664818 - DNA, 20 bp, Artificial
  CRISPR gRNA sequence
ttaatgacatggaaatgctt

SEQ ID NO: 664819 - DNA, 20 bp, Artificial
  CRISPR gRNA sequence
aatgacatggaaatgcttag

SEQ ID NO: 664820 - DNA, 20 bp, Artificial
  CRISPR gRNA sequence
atgacatggaaatgcttagg

SEQ ID NO: 664821 - DNA, 20 bp, Artificial
  CRISPR gRNA sequence
aggttattatagagaggtaa

SEQ ID NO: 664822 - DNA, 20 bp, Artificial
  CRISPR gRNA sequence
ggttattatagagaggtaaa

SEQ ID NO: 664823 - DNA, 20 bp, Artificial
  CRISPR gRNA sequence
ttatagagaggtaaatactt

SEQ ID NO: 664824 - DNA, 20 bp, Artificial
  CRISPR gRNA sequence
tagagaggtaaatactttat

SEQ ID NO: 664825 - DNA, 20 bp, Artificial
  CRISPR gRNA sequence
tatagtatattatatataca

SEQ ID NO: 664826 - DNA, 20 bp, Artificial
  CRISPR gRNA sequence
atagtatattatatatacat

SEQ ID NO: 664827 - DNA, 20 bp, Artificial
  CRISPR gRNA sequence
tagtatattatatatacatc

SEQ ID NO: 664828 - DNA, 20 bp, Artificial
  CRISPR gRNA sequence
tatatacatccatacattat

SEQ ID NO: 664829 - DNA, 20 bp, Artificial
  CRISPR gRNA sequence
tctgtttatcgatagataaa

SEQ ID NO: 664830 - DNA, 20 bp, Artificial
  CRISPR gRNA sequence
tttatcgatagataaaatct

SEQ ID NO: 664831 - DNA, 20 bp, Artificial
  CRISPR gRNA sequence
atcgatagataaaatctcaa

SEQ ID NO: 664832 - DNA, 20 bp, Artificial
  CRISPR gRNA sequence
tcgatagataaaatctcaaa

SEQ ID NO: 664833 - DNA, 20 bp, Artificial
  CRISPR gRNA sequence
aaatttttttgaaaagaaac

SEQ ID NO: 664834 - DNA, 20 bp, Artificial
  CRISPR gRNA sequence
ttttgaaaagaaacatgcta

SEQ ID NO: 664835 - DNA, 20 bp, Artificial
  CRISPR gRNA sequence
tttgaaaagaaacatgctaa

SEQ ID NO: 664836 - DNA, 20 bp, Artificial
  CRISPR gRNA sequence
ttgaaaagaaacatgctaaa

SEQ ID NO: 664837 - DNA, 20 bp, Artificial
  CRISPR gRNA sequence
tgaaaagaaacatgctaaaa

SEQ ID NO: 664838 - DNA, 20 bp, Artificial
  CRISPR gRNA sequence
gaaaagaaacatgctaaaat

SEQ ID NO: 664839 - DNA, 20 bp, Artificial
  CRISPR gRNA sequence
aaaagaaacatgctaaaatg

SEQ ID NO: 664840 - DNA, 20 bp, Artificial
  CRISPR gRNA sequence
aaatgttaaaaataggggta

SEQ ID NO: 664841 - DNA, 20 bp, Artificial
  CRISPR gRNA sequence
aaaataggggtaggtttagg

SEQ ID NO: 664842 - DNA, 20 bp, Artificial
  CRISPR gRNA sequence
aggtactggtttaaatatct

SEQ ID NO: 664843 - DNA, 20 bp, Artificial
  CRISPR gRNA sequence
ggtactggtttaaatatctc

SEQ ID NO: 664844 - DNA, 20 bp, Artificial
  CRISPR gRNA sequence
gtttaaatatctctgtaaat

SEQ ID NO: 664845 - DNA, 20 bp, Artificial
  CRISPR gRNA sequence
aaatatctctgtaaatacct

SEQ ID NO: 664846 - DNA, 20 bp, Artificial
  CRISPR gRNA sequence
aatatctctgtaaatacctg

SEQ ID NO: 664847 - DNA, 20 bp, Artificial
  CRISPR gRNA sequence
tgtaaatacctgtttttata

SEQ ID NO: 664848 - DNA, 20 bp, Artificial
  CRISPR gRNA sequence
taaatacctgtttttatata

SEQ ID NO: 664849 - DNA, 20 bp, Artificial
  CRISPR gRNA sequence
tttttatataatgaggcatt

SEQ ID NO: 664850 - DNA, 20 bp, Artificial
  CRISPR gRNA sequence
ttatataatgaggcattgtt

SEQ ID NO: 664851 - DNA, 20 bp, Artificial
  CRISPR gRNA sequence
tatataatgaggcattgtta

SEQ ID NO: 664852 - DNA, 20 bp, Artificial
  CRISPR gRNA sequence
atataatgaggcattgttac

SEQ ID NO: 664853 - DNA, 20 bp, Artificial
  CRISPR gRNA sequence
tataatgaggcattgttact

SEQ ID NO: 664854 - DNA, 20 bp, Artificial
  CRISPR gRNA sequence
ttactttcataatcagaaaa

SEQ ID NO: 664855 - DNA, 20 bp, Artificial
  CRISPR gRNA sequence
ctttcataatcagaaaaaga

SEQ ID NO: 664856 - DNA, 20 bp, Artificial
  CRISPR gRNA sequence
tcataatcagaaaaagaata

SEQ ID NO: 664857 - DNA, 20 bp, Artificial
  CRISPR gRNA sequence
cataatcagaaaaagaatag

SEQ ID NO: 664858 - DNA, 20 bp, Artificial
  CRISPR gRNA sequence
ataatcagaaaaagaataga

SEQ ID NO: 664859 - DNA, 20 bp, Artificial
  CRISPR gRNA sequence
ttacctatagttagcagctt

SEQ ID NO: 664860 - DNA, 20 bp, Artificial
  CRISPR gRNA sequence
tacctatagttagcagcttt

SEQ ID NO: 664861 - DNA, 20 bp, Artificial
  CRISPR gRNA sequence
acctatagttagcagcttta

SEQ ID NO: 664862 - DNA, 20 bp, Artificial
  CRISPR gRNA sequence
cctatagttagcagctttat

SEQ ID NO: 664863 - DNA, 20 bp, Artificial
  CRISPR gRNA sequence
tagttagcagctttattttg

SEQ ID NO: 664864 - DNA, 20 bp, Artificial
  CRISPR gRNA sequence
gcagctttattttggtgggg

SEQ ID NO: 664865 - DNA, 20 bp, Artificial
  CRISPR gRNA sequence
tattttggtggggccatgct

SEQ ID NO: 664866 - DNA, 20 bp, Artificial
  CRISPR gRNA sequence
attttggtggggccatgctt

SEQ ID NO: 664867 - DNA, 20 bp, Artificial
  CRISPR gRNA sequence
ttttggtggggccatgcttg

SEQ ID NO: 664868 - DNA, 20 bp, Artificial
  CRISPR gRNA sequence
tggtggggccatgcttgatt

SEQ ID NO: 664869 - DNA, 20 bp, Artificial
  CRISPR gRNA sequence
ggtggggccatgcttgattt

SEQ ID NO: 664870 - DNA, 20 bp, Artificial
  CRISPR gRNA sequence
gtggggccatgcttgatttg

SEQ ID NO: 664871 - DNA, 20 bp, Artificial
  CRISPR gRNA sequence
gatttgctattcttagacat

SEQ ID NO: 664872 - DNA, 20 bp, Artificial
  CRISPR gRNA sequence
atttgctattcttagacatt

SEQ ID NO: 664873 - DNA, 20 bp, Artificial
  CRISPR gRNA sequence
gctattcttagacattctaa

SEQ ID NO: 664874 - DNA, 20 bp, Artificial
  CRISPR gRNA sequence
ctattcttagacattctaag

SEQ ID NO: 664875 - DNA, 20 bp, Artificial
  CRISPR gRNA sequence
ttcttagacattctaagaca

SEQ ID NO: 664876 - DNA, 20 bp, Artificial
  CRISPR gRNA sequence
ttagacattctaagacatct

SEQ ID NO: 664877 - DNA, 20 bp, Artificial
  CRISPR gRNA sequence
agacattctaagacatcttt

SEQ ID NO: 664878 - DNA, 20 bp, Artificial
  CRISPR gRNA sequence
gacattctaagacatcttta

SEQ ID NO: 664879 - DNA, 20 bp, Artificial
  CRISPR gRNA sequence
taagacatctttagagtcaa

SEQ ID NO: 664880 - DNA, 20 bp, Artificial
  CRISPR gRNA sequence
agacatctttagagtcaata

SEQ ID NO: 664881 - DNA, 20 bp, Artificial
  CRISPR gRNA sequence
tagagtcaatatttcctatt

SEQ ID NO: 664882 - DNA, 20 bp, Artificial
  CRISPR gRNA sequence
agagtcaatatttcctattc

SEQ ID NO: 664883 - DNA, 20 bp, Artificial
  CRISPR gRNA sequence
gagtcaatatttcctattct

SEQ ID NO: 664884 - DNA, 20 bp, Artificial
  CRISPR gRNA sequence
cctattctctggctattaag

SEQ ID NO: 664885 - DNA, 20 bp, Artificial
  CRISPR gRNA sequence
ctattctctggctattaagt

SEQ ID NO: 664886 - DNA, 20 bp, Artificial
  CRISPR gRNA sequence
ttctctggctattaagtttc

SEQ ID NO: 664887 - DNA, 20 bp, Artificial
  CRISPR gRNA sequence
tctggctattaagtttcttt

SEQ ID NO: 664888 - DNA, 20 bp, Artificial
  CRISPR gRNA sequence
tggctattaagtttctttca

SEQ ID NO: 664889 - DNA, 20 bp, Artificial
  CRISPR gRNA sequence
gctattaagtttctttcatg

SEQ ID NO: 664890 - DNA, 20 bp, Artificial
  CRISPR gRNA sequence
ttaagtttctttcatgtgaa

SEQ ID NO: 664891 - DNA, 20 bp, Artificial
  CRISPR gRNA sequence
agtttctttcatgtgaaatt

SEQ ID NO: 664892 - DNA, 20 bp, Artificial
  CRISPR gRNA sequence
ctttcatgtgaaattcgcat

SEQ ID NO: 664893 - DNA, 20 bp, Artificial
  CRISPR gRNA sequence
tttcatgtgaaattcgcatc

SEQ ID NO: 664894 - DNA, 20 bp, Artificial
  CRISPR gRNA sequence
tcatgtgaaattcgcatcaa

SEQ ID NO: 664895 - DNA, 20 bp, Artificial
  CRISPR gRNA sequence
catgtgaaattcgcatcaag

SEQ ID NO: 664896 - DNA, 20 bp, Artificial
  CRISPR gRNA sequence
atgtgaaattcgcatcaagt

SEQ ID NO: 664897 - DNA, 20 bp, Artificial
  CRISPR gRNA sequence
gcatcaagtttagagtatga

SEQ ID NO: 664898 - DNA, 20 bp, Artificial
  CRISPR gRNA sequence
agagtatgatgctctcttga

SEQ ID NO: 664899 - DNA, 20 bp, Artificial
  CRISPR gRNA sequence
gagtatgatgctctcttgat

SEQ ID NO: 664900 - DNA, 20 bp, Artificial
  CRISPR gRNA sequence
tcttgatcaagtaacatatc

SEQ ID NO: 664901 - DNA, 20 bp, Artificial
  CRISPR gRNA sequence
ttgatcaagtaacatatcct

SEQ ID NO: 664902 - DNA, 20 bp, Artificial
  CRISPR gRNA sequence
gatcaagtaacatatcctta

SEQ ID NO: 664903 - DNA, 20 bp, Artificial
  CRISPR gRNA sequence
atcaagtaacatatccttag

SEQ ID NO: 664904 - DNA, 20 bp, Artificial
  CRISPR gRNA sequence
agtgaatgggtgctattttt

SEQ ID NO: 664905 - DNA, 20 bp, Artificial
  CRISPR gRNA sequence
gtgaatgggtgctatttttt

SEQ ID NO: 664906 - DNA, 20 bp, Artificial
  CRISPR gRNA sequence
tttttttgagacttcagcta

SEQ ID NO: 664907 - DNA, 20 bp, Artificial
  CRISPR gRNA sequence
ttttgagacttcagctatac

SEQ ID NO: 664908 - DNA, 20 bp, Artificial
  CRISPR gRNA sequence
tttgagacttcagctatacc

SEQ ID NO: 664909 - DNA, 20 bp, Artificial
  CRISPR gRNA sequence
ttgagacttcagctataccc

SEQ ID NO: 664910 - DNA, 20 bp, Artificial
  CRISPR gRNA sequence
tgagacttcagctataccct

SEQ ID NO: 664911 - DNA, 20 bp, Artificial
  CRISPR gRNA sequence
gagacttcagctataccctc

SEQ ID NO: 664912 - DNA, 20 bp, Artificial
  CRISPR gRNA sequence
agacttcagctataccctct

SEQ ID NO: 664913 - DNA, 20 bp, Artificial
  CRISPR gRNA sequence
cagctataccctcttctcca

SEQ ID NO: 664914 - DNA, 20 bp, Artificial
  CRISPR gRNA sequence
agctataccctcttctccag

SEQ ID NO: 664915 - DNA, 20 bp, Artificial
  CRISPR gRNA sequence
taccctcttctccagtacct

SEQ ID NO: 664916 - DNA, 20 bp, Artificial
  CRISPR gRNA sequence
ttctccagtacctcttctag

SEQ ID NO: 664917 - DNA, 20 bp, Artificial
  CRISPR gRNA sequence
ctccagtacctcttctaggc

SEQ ID NO: 664918 - DNA, 20 bp, Artificial
  CRISPR gRNA sequence
tccagtacctcttctaggct

SEQ ID NO: 664919 - DNA, 20 bp, Artificial
  CRISPR gRNA sequence
cagtacctcttctaggctct

SEQ ID NO: 664920 - DNA, 20 bp, Artificial
  CRISPR gRNA sequence
ttctaggctcttttggacat

SEQ ID NO: 664921 - DNA, 20 bp, Artificial
  CRISPR gRNA sequence
ctaggctcttttggacatat

SEQ ID NO: 664922 - DNA, 20 bp, Artificial
  CRISPR gRNA sequence
taggctcttttggacatatc

SEQ ID NO: 664923 - DNA, 20 bp, Artificial
  CRISPR gRNA sequence
ggctcttttggacatatctt

SEQ ID NO: 664924 - DNA, 20 bp, Artificial
  CRISPR gRNA sequence
ttttggacatatcttctggg

SEQ ID NO: 664925 - DNA, 20 bp, Artificial
  CRISPR gRNA sequence
ttggacatatcttctgggtt

SEQ ID NO: 664926 - DNA, 20 bp, Artificial
  CRISPR gRNA sequence
tggacatatcttctgggtta

SEQ ID NO: 664927 - DNA, 20 bp, Artificial
  CRISPR gRNA sequence
ggacatatcttctgggttac

SEQ ID NO: 664928 - DNA, 20 bp, Artificial
  CRISPR gRNA sequence
gacatatcttctgggttacc

SEQ ID NO: 664929 - DNA, 20 bp, Artificial
  CRISPR gRNA sequence
ctgggttaccttctataagc

SEQ ID NO: 664930 - DNA, 20 bp, Artificial
  CRISPR gRNA sequence
tgggttaccttctataagct

SEQ ID NO: 664931 - DNA, 20 bp, Artificial
  CRISPR gRNA sequence
ggttaccttctataagctgt

SEQ ID NO: 664932 - DNA, 20 bp, Artificial
  CRISPR gRNA sequence
ccttctataagctgtataat

SEQ ID NO: 664933 - DNA, 20 bp, Artificial
  CRISPR gRNA sequence
ctataagctgtataatattt

SEQ ID NO: 664934 - DNA, 20 bp, Artificial
  CRISPR gRNA sequence
tataagctgtataatattta

SEQ ID NO: 664935 - DNA, 20 bp, Artificial
  CRISPR gRNA sequence
taagctgtataatatttagt

SEQ ID NO: 664936 - DNA, 20 bp, Artificial
  CRISPR gRNA sequence
tataatatttagtggttact

SEQ ID NO: 664937 - DNA, 20 bp, Artificial
  CRISPR gRNA sequence
agtggttactgtaacccaga

SEQ ID NO: 664938 - DNA, 20 bp, Artificial
  CRISPR gRNA sequence
gtggttactgtaacccagag

SEQ ID NO: 664939 - DNA, 20 bp, Artificial
  CRISPR gRNA sequence
ctgtaacccagagatgggtt

SEQ ID NO: 664940 - DNA, 20 bp, Artificial
  CRISPR gRNA sequence
taacccagagatgggttact

SEQ ID NO: 664941 - DNA, 20 bp, Artificial
  CRISPR gRNA sequence
cttatgactatcaattattg

SEQ ID NO: 664942 - DNA, 20 bp, Artificial
  CRISPR gRNA sequence
atgactatcaattattgtta

SEQ ID NO: 664943 - DNA, 20 bp, Artificial
  CRISPR gRNA sequence
tgactatcaattattgttaa

SEQ ID NO: 664944 - DNA, 20 bp, Artificial
  CRISPR gRNA sequence
tcaattattgttaaagatac

SEQ ID NO: 664945 - DNA, 20 bp, Artificial
  CRISPR gRNA sequence
ttgttaaagatactacaaat

SEQ ID NO: 664946 - DNA, 20 bp, Artificial
  CRISPR gRNA sequence
ttaaagatactacaaatggg

SEQ ID NO: 664947 - DNA, 20 bp, Artificial
  CRISPR gRNA sequence
aagatactacaaatgggaat

SEQ ID NO: 664948 - DNA, 20 bp, Artificial
  CRISPR gRNA sequence
caaatgggaatttttttttc

SEQ ID NO: 664949 - DNA, 20 bp, Artificial
  CRISPR gRNA sequence
ttttttctccaagtcatact

SEQ ID NO: 664950 - DNA, 20 bp, Artificial
  CRISPR gRNA sequence
tttttctccaagtcatacta

SEQ ID NO: 664951 - DNA, 20 bp, Artificial
  CRISPR gRNA sequence
ttttctccaagtcatactac

SEQ ID NO: 664952 - DNA, 20 bp, Artificial
  CRISPR gRNA sequence
tttctccaagtcatactact

SEQ ID NO: 664953 - DNA, 20 bp, Artificial
  CRISPR gRNA sequence
ttctccaagtcatactactt

SEQ ID NO: 664954 - DNA, 20 bp, Artificial
  CRISPR gRNA sequence
tctccaagtcatactactta

SEQ ID NO: 664955 - DNA, 20 bp, Artificial
  CRISPR gRNA sequence
ctccaagtcatactacttaa

SEQ ID NO: 664956 - DNA, 20 bp, Artificial
  CRISPR gRNA sequence
tccaagtcatactacttaaa

SEQ ID NO: 664957 - DNA, 20 bp, Artificial
  CRISPR gRNA sequence
caagtcatactacttaaatt

SEQ ID NO: 664958 - DNA, 20 bp, Artificial
  CRISPR gRNA sequence
cttaaatttgatttcaaata

SEQ ID NO: 664959 - DNA, 20 bp, Artificial
  CRISPR gRNA sequence
aaatttgatttcaaatatct

SEQ ID NO: 664960 - DNA, 20 bp, Artificial
  CRISPR gRNA sequence
aatttgatttcaaatatcta

SEQ ID NO: 664961 - DNA, 20 bp, Artificial
  CRISPR gRNA sequence
gatttcaaatatctataatt

SEQ ID NO: 664962 - DNA, 20 bp, Artificial
  CRISPR gRNA sequence
atttcaaatatctataatta

SEQ ID NO: 664963 - DNA, 20 bp, Artificial
  CRISPR gRNA sequence
caaatatctataattacctc

SEQ ID NO: 664964 - DNA, 20 bp, Artificial
  CRISPR gRNA sequence
aaatatctataattacctcg

SEQ ID NO: 664965 - DNA, 20 bp, Artificial
  CRISPR gRNA sequence
taattacctcgttagtagat

SEQ ID NO: 664966 - DNA, 20 bp, Artificial
  CRISPR gRNA sequence
cctcgttagtagatagaaac

SEQ ID NO: 664967 - DNA, 20 bp, Artificial
  CRISPR gRNA sequence
gttagtagatagaaacaata

SEQ ID NO: 664968 - DNA, 20 bp, Artificial
  CRISPR gRNA sequence
gtagatagaaacaatatcct

SEQ ID NO: 664969 - DNA, 20 bp, Artificial
  CRISPR gRNA sequence
agatgagctacaaataccaa

SEQ ID NO: 664970 - DNA, 20 bp, Artificial
  CRISPR gRNA sequence
gatgagctacaaataccaaa

SEQ ID NO: 664971 - DNA, 20 bp, Artificial
  CRISPR gRNA sequence
caaataccaaattaggaatt

SEQ ID NO: 664972 - DNA, 20 bp, Artificial
  CRISPR gRNA sequence
ggaatttcccctgaattttg

SEQ ID NO: 664973 - DNA, 20 bp, Artificial
  CRISPR gRNA sequence
cccctgaattttgcttctgc

SEQ ID NO: 664974 - DNA, 20 bp, Artificial
  CRISPR gRNA sequence
ccctgaattttgcttctgca

SEQ ID NO: 664975 - DNA, 20 bp, Artificial
  CRISPR gRNA sequence
aattttgcttctgcagaaat

SEQ ID NO: 664976 - DNA, 20 bp, Artificial
  CRISPR gRNA sequence
tgcttctgcagaaatactta

SEQ ID NO: 664977 - DNA, 20 bp, Artificial
  CRISPR gRNA sequence
gcttctgcagaaatacttaa

SEQ ID NO: 664978 - DNA, 20 bp, Artificial
  CRISPR gRNA sequence
cttctgcagaaatacttaac

SEQ ID NO: 664979 - DNA, 20 bp, Artificial
  CRISPR gRNA sequence
ctgcagaaatacttaacaat

SEQ ID NO: 664980 - DNA, 20 bp, Artificial
  CRISPR gRNA sequence
tgcagaaatacttaacaata

SEQ ID NO: 664981 - DNA, 20 bp, Artificial
  CRISPR gRNA sequence
cagaaatacttaacaataac

SEQ ID NO: 664982 - DNA, 20 bp, Artificial
  CRISPR gRNA sequence
aacaataacttatttttctt

SEQ ID NO: 664983 - DNA, 20 bp, Artificial
  CRISPR gRNA sequence
acaataacttatttttcttt

SEQ ID NO: 664984 - DNA, 20 bp, Artificial
  CRISPR gRNA sequence
atttttctttagttctagtg

SEQ ID NO: 664985 - DNA, 20 bp, Artificial
  CRISPR gRNA sequence
tttttctttagttctagtga

SEQ ID NO: 664986 - DNA, 20 bp, Artificial
  CRISPR gRNA sequence
ttctttagttctagtgaaat

SEQ ID NO: 664987 - DNA, 20 bp, Artificial
  CRISPR gRNA sequence
tctttagttctagtgaaata

SEQ ID NO: 664988 - DNA, 20 bp, Artificial
  CRISPR gRNA sequence
ctttagttctagtgaaatag

SEQ ID NO: 664989 - DNA, 20 bp, Artificial
  CRISPR gRNA sequence
tttagttctagtgaaatagt

SEQ ID NO: 664990 - DNA, 20 bp, Artificial
  CRISPR gRNA sequence
tagttctagtgaaatagtga

SEQ ID NO: 664991 - DNA, 20 bp, Artificial
  CRISPR gRNA sequence
agttctagtgaaatagtgaa

SEQ ID NO: 664992 - DNA, 20 bp, Artificial
  CRISPR gRNA sequence
gttctagtgaaatagtgaag

SEQ ID NO: 664993 - DNA, 20 bp, Artificial
  CRISPR gRNA sequence
tagtgaaatagtgaagtgtg

SEQ ID NO: 664994 - DNA, 20 bp, Artificial
  CRISPR gRNA sequence
gtgaaatagtgaagtgtgct

SEQ ID NO: 664995 - DNA, 20 bp, Artificial
  CRISPR gRNA sequence
cttagcatgaactgaaatgt

SEQ ID NO: 664996 - DNA, 20 bp, Artificial
  CRISPR gRNA sequence
ttagcatgaactgaaatgtt

SEQ ID NO: 664997 - DNA, 20 bp, Artificial
  CRISPR gRNA sequence
agcatgaactgaaatgttaa

SEQ ID NO: 664998 - DNA, 20 bp, Artificial
  CRISPR gRNA sequence
gcatgaactgaaatgttaat

SEQ ID NO: 664999 - DNA, 20 bp, Artificial
  CRISPR gRNA sequence
aaatgttaatttgttcaact

SEQ ID NO: 665000 - DNA, 20 bp, Artificial
  CRISPR gRNA sequence
atttgttcaacttttcatta

SEQ ID NO: 665001 - DNA, 20 bp, Artificial
  CRISPR gRNA sequence
gttcaacttttcattaacac

SEQ ID NO: 665002 - DNA, 20 bp, Artificial
  CRISPR gRNA sequence
ttcaacttttcattaacaca

SEQ ID NO: 665003 - DNA, 20 bp, Artificial
  CRISPR gRNA sequence
aacttttcattaacacacat

SEQ ID NO: 665004 - DNA, 20 bp, Artificial
  CRISPR gRNA sequence
ttcattaacacacatttcta

SEQ ID NO: 665005 - DNA, 20 bp, Artificial
  CRISPR gRNA sequence
tcattaacacacatttctac

SEQ ID NO: 665006 - DNA, 20 bp, Artificial
  CRISPR gRNA sequence
cattaacacacatttctacc

SEQ ID NO: 665007 - DNA, 20 bp, Artificial
  CRISPR gRNA sequence
attaacacacatttctacca

SEQ ID NO: 665008 - DNA, 20 bp, Artificial
  CRISPR gRNA sequence
acacacatttctaccataag

SEQ ID NO: 665009 - DNA, 20 bp, Artificial
  CRISPR gRNA sequence
ctaccataagaaacttcagt

SEQ ID NO: 665010 - DNA, 20 bp, Artificial
  CRISPR gRNA sequence
taccataagaaacttcagta

SEQ ID NO: 665011 - DNA, 20 bp, Artificial
  CRISPR gRNA sequence
ccataagaaacttcagtaaa

SEQ ID NO: 665012 - DNA, 20 bp, Artificial
  CRISPR gRNA sequence
cagtaaaactagatttaaaa

SEQ ID NO: 665013 - DNA, 20 bp, Artificial
  CRISPR gRNA sequence
agtaaaactagatttaaaaa

SEQ ID NO: 665014 - DNA, 20 bp, Artificial
  CRISPR gRNA sequence
gatttaaaaaatttgaaaga

SEQ ID NO: 665015 - DNA, 20 bp, Artificial
  CRISPR gRNA sequence
aaaaaatttgaaagacatat

SEQ ID NO: 665016 - DNA, 20 bp, Artificial
  CRISPR gRNA sequence
aaaaatttgaaagacatatt

SEQ ID NO: 665017 - DNA, 20 bp, Artificial
  CRISPR gRNA sequence
gaaagacatatttttacaaa

SEQ ID NO: 665018 - DNA, 20 bp, Artificial
  CRISPR gRNA sequence
aaagacatatttttacaaaa

SEQ ID NO: 665019 - DNA, 20 bp, Artificial
  CRISPR gRNA sequence
ttacaaaaacatattttaat

SEQ ID NO: 665020 - DNA, 20 bp, Artificial
  CRISPR gRNA sequence
tacaaaaacatattttaatc

SEQ ID NO: 665021 - DNA, 20 bp, Artificial
  CRISPR gRNA sequence
acaaaaacatattttaatct

SEQ ID NO: 665022 - DNA, 20 bp, Artificial
  CRISPR gRNA sequence
caaaaacatattttaatctt

SEQ ID NO: 665023 - DNA, 20 bp, Artificial
  CRISPR gRNA sequence
taatctttaaaatgtttatg

SEQ ID NO: 665024 - DNA, 20 bp, Artificial
  CRISPR gRNA sequence
aatctttaaaatgtttatgg

SEQ ID NO: 665025 - DNA, 20 bp, Artificial
  CRISPR gRNA sequence
atctttaaaatgtttatggt

SEQ ID NO: 665026 - DNA, 20 bp, Artificial
  CRISPR gRNA sequence
taaaatgtttatggtatacc

SEQ ID NO: 665027 - DNA, 20 bp, Artificial
  CRISPR gRNA sequence
aaaatgtttatggtatacct

SEQ ID NO: 665028 - DNA, 20 bp, Artificial
  CRISPR gRNA sequence
aaatgtttatggtatacctg

SEQ ID NO: 665029 - DNA, 20 bp, Artificial
  CRISPR gRNA sequence
atggtatacctgtggttaaa

SEQ ID NO: 665030 - DNA, 20 bp, Artificial
  CRISPR gRNA sequence
tggtatacctgtggttaaat

SEQ ID NO: 665031 - DNA, 20 bp, Artificial
  CRISPR gRNA sequence
tggttaaataacatatgcat

SEQ ID NO: 665032 - DNA, 20 bp, Artificial
  CRISPR gRNA sequence
aataacatatgcatggtttt

SEQ ID NO: 665033 - DNA, 20 bp, Artificial
  CRISPR gRNA sequence
taaatttttgattcttctat

SEQ ID NO: 665034 - DNA, 20 bp, Artificial
  CRISPR gRNA sequence
aaatttttgattcttctatg

SEQ ID NO: 665035 - DNA, 20 bp, Artificial
  CRISPR gRNA sequence
aatttttgattcttctatgt

SEQ ID NO: 665036 - DNA, 20 bp, Artificial
  CRISPR gRNA sequence
ttgattcttctatgtttaaa

SEQ ID NO: 665037 - DNA, 20 bp, Artificial
  CRISPR gRNA sequence
tgattcttctatgtttaaac

SEQ ID NO: 665038 - DNA, 20 bp, Artificial
  CRISPR gRNA sequence
gattcttctatgtttaaact

SEQ ID NO: 665039 - DNA, 20 bp, Artificial
  CRISPR gRNA sequence
attcttctatgtttaaactc

SEQ ID NO: 665040 - DNA, 20 bp, Artificial
  CRISPR gRNA sequence
ttctatgtttaaactctttt

SEQ ID NO: 665041 - DNA, 20 bp, Artificial
  CRISPR gRNA sequence
ctatgtttaaactcttttca

SEQ ID NO: 665042 - DNA, 20 bp, Artificial
  CRISPR gRNA sequence
tatgtttaaactcttttcag

SEQ ID NO: 665043 - DNA, 20 bp, Artificial
  CRISPR gRNA sequence
tgtttaaactcttttcagtg

SEQ ID NO: 665044 - DNA, 20 bp, Artificial
  CRISPR gRNA sequence
aaactcttttcagtgtctag

SEQ ID NO: 665045 - DNA, 20 bp, Artificial
  CRISPR gRNA sequence
aactcttttcagtgtctaga

SEQ ID NO: 665046 - DNA, 20 bp, Artificial
  CRISPR gRNA sequence
ttttcagtgtctagataaat

SEQ ID NO: 665047 - DNA, 20 bp, Artificial
  CRISPR gRNA sequence
ttcagtgtctagataaatct

SEQ ID NO: 665048 - DNA, 20 bp, Artificial
  CRISPR gRNA sequence
tcagtgtctagataaatctt

SEQ ID NO: 665049 - DNA, 20 bp, Artificial
  CRISPR gRNA sequence
cagtgtctagataaatcttt

SEQ ID NO: 665050 - DNA, 20 bp, Artificial
  CRISPR gRNA sequence
agtgtctagataaatcttta

SEQ ID NO: 665051 - DNA, 20 bp, Artificial
  CRISPR gRNA sequence
gataaatctttattttttaa

SEQ ID NO: 665052 - DNA, 20 bp, Artificial
  CRISPR gRNA sequence
tattttttaaagctcttcat

SEQ ID NO: 665053 - DNA, 20 bp, Artificial
  CRISPR gRNA sequence
attttttaaagctcttcatt

SEQ ID NO: 665054 - DNA, 20 bp, Artificial
  CRISPR gRNA sequence
ttttttaaagctcttcattg

SEQ ID NO: 665055 - DNA, 20 bp, Artificial
  CRISPR gRNA sequence
tttaaagctcttcattgaag

SEQ ID NO: 665056 - DNA, 20 bp, Artificial
  CRISPR gRNA sequence
ttaaagctcttcattgaaga

SEQ ID NO: 665057 - DNA, 20 bp, Artificial
  CRISPR gRNA sequence
taaagctcttcattgaagat

SEQ ID NO: 665058 - DNA, 20 bp, Artificial
  CRISPR gRNA sequence
aaagctcttcattgaagatt

SEQ ID NO: 665059 - DNA, 20 bp, Artificial
  CRISPR gRNA sequence
aagctcttcattgaagatta

SEQ ID NO: 665060 - DNA, 20 bp, Artificial
  CRISPR gRNA sequence
ttcattgaagattattcaaa

SEQ ID NO: 665061 - DNA, 20 bp, Artificial
  CRISPR gRNA sequence
cattgaagattattcaaatc

SEQ ID NO: 665062 - DNA, 20 bp, Artificial
  CRISPR gRNA sequence
attgaagattattcaaatct

SEQ ID NO: 665063 - DNA, 20 bp, Artificial
  CRISPR gRNA sequence
aagattattcaaatcttttt

SEQ ID NO: 665064 - DNA, 20 bp, Artificial
  CRISPR gRNA sequence
ttcaaatctttttctaagac

SEQ ID NO: 665065 - DNA, 20 bp, Artificial
  CRISPR gRNA sequence
aaatctttttctaagacatt

SEQ ID NO: 665066 - DNA, 20 bp, Artificial
  CRISPR gRNA sequence
tttctaagacatttgacttt

SEQ ID NO: 665067 - DNA, 20 bp, Artificial
  CRISPR gRNA sequence
ttctaagacatttgacttta

SEQ ID NO: 665068 - DNA, 20 bp, Artificial
  CRISPR gRNA sequence
tctaagacatttgactttac

SEQ ID NO: 665069 - DNA, 20 bp, Artificial
  CRISPR gRNA sequence
ctaagacatttgactttaca

SEQ ID NO: 665070 - DNA, 20 bp, Artificial
  CRISPR gRNA sequence
taagacatttgactttacat

SEQ ID NO: 665071 - DNA, 20 bp, Artificial
  CRISPR gRNA sequence
agacatttgactttacatat

SEQ ID NO: 665072 - DNA, 20 bp, Artificial
  CRISPR gRNA sequence
gactttacatatgttcattt

SEQ ID NO: 665073 - DNA, 20 bp, Artificial
  CRISPR gRNA sequence
actttacatatgttcatttt

SEQ ID NO: 665074 - DNA, 20 bp, Artificial
  CRISPR gRNA sequence
tacatatgttcattttacag

SEQ ID NO: 665075 - DNA, 20 bp, Artificial
  CRISPR gRNA sequence
acatatgttcattttacaga

SEQ ID NO: 665076 - DNA, 20 bp, Artificial
  CRISPR gRNA sequence
catatgttcattttacagac

SEQ ID NO: 665077 - DNA, 20 bp, Artificial
  CRISPR gRNA sequence
attttacagactattttaat

SEQ ID NO: 665078 - DNA, 20 bp, Artificial
  CRISPR gRNA sequence
tacagactattttaattcag

SEQ ID NO: 665079 - DNA, 20 bp, Artificial
  CRISPR gRNA sequence
acagactattttaattcagt

SEQ ID NO: 665080 - DNA, 20 bp, Artificial
  CRISPR gRNA sequence
cagactattttaattcagtg

SEQ ID NO: 665081 - DNA, 20 bp, Artificial
  CRISPR gRNA sequence
ttttaattcagtgattccca

SEQ ID NO: 665082 - DNA, 20 bp, Artificial
  CRISPR gRNA sequence
taattcagtgattcccatct

SEQ ID NO: 665083 - DNA, 20 bp, Artificial
  CRISPR gRNA sequence
aattcagtgattcccatcta

SEQ ID NO: 665084 - DNA, 20 bp, Artificial
  CRISPR gRNA sequence
attcagtgattcccatctaa

SEQ ID NO: 665085 - DNA, 20 bp, Artificial
  CRISPR gRNA sequence
agtgattcccatctaattgg

SEQ ID NO: 665086 - DNA, 20 bp, Artificial
  CRISPR gRNA sequence
ccatctaattggtcaaccac

SEQ ID NO: 665087 - DNA, 20 bp, Artificial
  CRISPR gRNA sequence
attggtcaaccaccagtatg

SEQ ID NO: 665088 - DNA, 20 bp, Artificial
  CRISPR gRNA sequence
gtcaaccaccagtatgatgg

SEQ ID NO: 665089 - DNA, 20 bp, Artificial
  CRISPR gRNA sequence
cccaaagagtctaatatgca

SEQ ID NO: 665090 - DNA, 20 bp, Artificial
  CRISPR gRNA sequence
atatgcaccccagtttgggg

SEQ ID NO: 665091 - DNA, 20 bp, Artificial
  CRISPR gRNA sequence
ggggatcacgttttaaaatg

SEQ ID NO: 665092 - DNA, 20 bp, Artificial
  CRISPR gRNA sequence
gggatcacgttttaaaatga

SEQ ID NO: 665093 - DNA, 20 bp, Artificial
  CRISPR gRNA sequence
taaaatgaatcttggatatt

SEQ ID NO: 665094 - DNA, 20 bp, Artificial
  CRISPR gRNA sequence
aaaatgaatcttggatattt

SEQ ID NO: 665095 - DNA, 20 bp, Artificial
  CRISPR gRNA sequence
aaatgaatcttggatattta

SEQ ID NO: 665096 - DNA, 20 bp, Artificial
  CRISPR gRNA sequence
ggatatttaaaaatgattta

SEQ ID NO: 665097 - DNA, 20 bp, Artificial
  CRISPR gRNA sequence
gatatttaaaaatgatttat

SEQ ID NO: 665098 - DNA, 20 bp, Artificial
  CRISPR gRNA sequence
aaaaatgatttatttagtat

SEQ ID NO: 665099 - DNA, 20 bp, Artificial
  CRISPR gRNA sequence
aaaatgatttatttagtata

SEQ ID NO: 665100 - DNA, 20 bp, Artificial
  CRISPR gRNA sequence
atttagtatattttataaca

SEQ ID NO: 665101 - DNA, 20 bp, Artificial
  CRISPR gRNA sequence
tttagtatattttataacat

SEQ ID NO: 665102 - DNA, 20 bp, Artificial
  CRISPR gRNA sequence
agtatattttataacattct

SEQ ID NO: 665103 - DNA, 20 bp, Artificial
  CRISPR gRNA sequence
gtatattttataacattcta

SEQ ID NO: 665104 - DNA, 20 bp, Artificial
  CRISPR gRNA sequence
tataacattctaatttttaa

SEQ ID NO: 665105 - DNA, 20 bp, Artificial
  CRISPR gRNA sequence
ataacattctaatttttaat

SEQ ID NO: 665106 - DNA, 20 bp, Artificial
  CRISPR gRNA sequence
taacattctaatttttaatt

SEQ ID NO: 665107 - DNA, 20 bp, Artificial
  CRISPR gRNA sequence
taatttttaatttaatgata

SEQ ID NO: 665108 - DNA, 20 bp, Artificial
  CRISPR gRNA sequence
atttttaatttaatgatatg

SEQ ID NO: 665109 - DNA, 20 bp, Artificial
  CRISPR gRNA sequence
ttaatttaatgatatgtttt

SEQ ID NO: 665110 - DNA, 20 bp, Artificial
  CRISPR gRNA sequence
taatttaatgatatgttttg

SEQ ID NO: 665111 - DNA, 20 bp, Artificial
  CRISPR gRNA sequence
aatttaatgatatgttttgg

SEQ ID NO: 665112 - DNA, 20 bp, Artificial
  CRISPR gRNA sequence
atttaatgatatgttttggc

SEQ ID NO: 665113 - DNA, 20 bp, Artificial
  CRISPR gRNA sequence
aatgatatgttttggccaat

SEQ ID NO: 665114 - DNA, 20 bp, Artificial
  CRISPR gRNA sequence
atgatatgttttggccaatt

SEQ ID NO: 665115 - DNA, 20 bp, Artificial
  CRISPR gRNA sequence
tggccaattttaatttactt

SEQ ID NO: 665116 - DNA, 20 bp, Artificial
  CRISPR gRNA sequence
ggccaattttaatttacttt

SEQ ID NO: 665117 - DNA, 20 bp, Artificial
  CRISPR gRNA sequence
gccaattttaatttacttta

SEQ ID NO: 665118 - DNA, 20 bp, Artificial
  CRISPR gRNA sequence
taatttactttatcctaaaa

SEQ ID NO: 665119 - DNA, 20 bp, Artificial
  CRISPR gRNA sequence
aatttactttatcctaaaag

SEQ ID NO: 665120 - DNA, 20 bp, Artificial
  CRISPR gRNA sequence
atttactttatcctaaaaga

SEQ ID NO: 665121 - DNA, 20 bp, Artificial
  CRISPR gRNA sequence
actttatcctaaaagaaagc

SEQ ID NO: 665122 - DNA, 20 bp, Artificial
  CRISPR gRNA sequence
ctttatcctaaaagaaagct

SEQ ID NO: 665123 - DNA, 20 bp, Artificial
  CRISPR gRNA sequence
tatcctaaaagaaagctatc

SEQ ID NO: 665124 - DNA, 20 bp, Artificial
  CRISPR gRNA sequence
atcctaaaagaaagctatct

SEQ ID NO: 665125 - DNA, 20 bp, Artificial
  CRISPR gRNA sequence
tcctaaaagaaagctatcta

SEQ ID NO: 665126 - DNA, 20 bp, Artificial
  CRISPR gRNA sequence
aaagaaagctatctatatgc

SEQ ID NO: 665127 - DNA, 20 bp, Artificial
  CRISPR gRNA sequence
tctatatgcacatttattca

SEQ ID NO: 665128 - DNA, 20 bp, Artificial
  CRISPR gRNA sequence
tatgcacatttattcaggat

SEQ ID NO: 665129 - DNA, 20 bp, Artificial
  CRISPR gRNA sequence
attcaggattcattttaatg

SEQ ID NO: 665130 - DNA, 20 bp, Artificial
  CRISPR gRNA sequence
ttcaggattcattttaatgt

SEQ ID NO: 665131 - DNA, 20 bp, Artificial
  CRISPR gRNA sequence
aggattcattttaatgttca

SEQ ID NO: 665132 - DNA, 20 bp, Artificial
  CRISPR gRNA sequence
attttaatgttcacttactt

SEQ ID NO: 665133 - DNA, 20 bp, Artificial
  CRISPR gRNA sequence
taatgttcacttacttaaag

SEQ ID NO: 665134 - DNA, 20 bp, Artificial
  CRISPR gRNA sequence
aatgttcacttacttaaaga

SEQ ID NO: 665135 - DNA, 20 bp, Artificial
  CRISPR gRNA sequence
atgttcacttacttaaagag

SEQ ID NO: 665136 - DNA, 20 bp, Artificial
  CRISPR gRNA sequence
acttacttaaagagtttatt

SEQ ID NO: 665137 - DNA, 20 bp, Artificial
  CRISPR gRNA sequence
acttaaagagtttatttacc

SEQ ID NO: 665138 - DNA, 20 bp, Artificial
  CRISPR gRNA sequence
cttaaagagtttatttacca

SEQ ID NO: 665139 - DNA, 20 bp, Artificial
  CRISPR gRNA sequence
aaagagtttatttaccatta

SEQ ID NO: 665140 - DNA, 20 bp, Artificial
  CRISPR gRNA sequence
aagagtttatttaccattat

SEQ ID NO: 665141 - DNA, 20 bp, Artificial
  CRISPR gRNA sequence
atttaccattatcacattta

SEQ ID NO: 665142 - DNA, 20 bp, Artificial
  CRISPR gRNA sequence
tttaccattatcacatttat

SEQ ID NO: 665143 - DNA, 20 bp, Artificial
  CRISPR gRNA sequence
accattatcacatttatact

SEQ ID NO: 665144 - DNA, 20 bp, Artificial
  CRISPR gRNA sequence
ccattatcacatttatactg

SEQ ID NO: 665145 - DNA, 20 bp, Artificial
  CRISPR gRNA sequence
tcacatttatactgatattt

SEQ ID NO: 665146 - DNA, 20 bp, Artificial
  CRISPR gRNA sequence
atactgatatttgcatagtt

SEQ ID NO: 665147 - DNA, 20 bp, Artificial
  CRISPR gRNA sequence
tactgatatttgcatagttt

SEQ ID NO: 665148 - DNA, 20 bp, Artificial
  CRISPR gRNA sequence
atatttgcatagttttcccc

SEQ ID NO: 665149 - DNA, 20 bp, Artificial
  CRISPR gRNA sequence
gcatagttttccccaaagtc

SEQ ID NO: 665150 - DNA, 20 bp, Artificial
  CRISPR gRNA sequence
catagttttccccaaagtct

SEQ ID NO: 665151 - DNA, 20 bp, Artificial
  CRISPR gRNA sequence
tccccaaagtctgtaacttt

SEQ ID NO: 665152 - DNA, 20 bp, Artificial
  CRISPR gRNA sequence
ccccaaagtctgtaactttg

SEQ ID NO: 665153 - DNA, 20 bp, Artificial
  CRISPR gRNA sequence
cccaaagtctgtaactttga

SEQ ID NO: 665154 - DNA, 20 bp, Artificial
  CRISPR gRNA sequence
taactttgagttcagatctg

SEQ ID NO: 665155 - DNA, 20 bp, Artificial
  CRISPR gRNA sequence
tgagttcagatctgaactta

SEQ ID NO: 665156 - DNA, 20 bp, Artificial
  CRISPR gRNA sequence
gagttcagatctgaacttaa

SEQ ID NO: 665157 - DNA, 20 bp, Artificial
  CRISPR gRNA sequence
agttcagatctgaacttaag

SEQ ID NO: 665158 - DNA, 20 bp, Artificial
  CRISPR gRNA sequence
agatctgaacttaaggtttg

SEQ ID NO: 665159 - DNA, 20 bp, Artificial
  CRISPR gRNA sequence
aacttaaggtttgtactttt

SEQ ID NO: 665160 - DNA, 20 bp, Artificial
  CRISPR gRNA sequence
aaggtttgtacttttagttg

SEQ ID NO: 665161 - DNA, 20 bp, Artificial
  CRISPR gRNA sequence
aggtttgtacttttagttgc

SEQ ID NO: 665162 - DNA, 20 bp, Artificial
  CRISPR gRNA sequence
gtacttttagttgcctttat

SEQ ID NO: 665163 - DNA, 20 bp, Artificial
  CRISPR gRNA sequence
tacttttagttgcctttatg

SEQ ID NO: 665164 - DNA, 20 bp, Artificial
  CRISPR gRNA sequence
ttagttgcctttatggatgt

SEQ ID NO: 665165 - DNA, 20 bp, Artificial
  CRISPR gRNA sequence
tagttgcctttatggatgtt

SEQ ID NO: 665166 - DNA, 20 bp, Artificial
  CRISPR gRNA sequence
agttgcctttatggatgttt

SEQ ID NO: 665167 - DNA, 20 bp, Artificial
  CRISPR gRNA sequence
gttgcctttatggatgttta

SEQ ID NO: 665168 - DNA, 20 bp, Artificial
  CRISPR gRNA sequence
cctttatggatgtttatgaa

SEQ ID NO: 665169 - DNA, 20 bp, Artificial
  CRISPR gRNA sequence
tatggatgtttatgaacaac

SEQ ID NO: 665170 - DNA, 20 bp, Artificial
  CRISPR gRNA sequence
atggatgtttatgaacaact

SEQ ID NO: 665171 - DNA, 20 bp, Artificial
  CRISPR gRNA sequence
tggatgtttatgaacaacta

SEQ ID NO: 665172 - DNA, 20 bp, Artificial
  CRISPR gRNA sequence
atgaacaactatgaataaca

SEQ ID NO: 665173 - DNA, 20 bp, Artificial
  CRISPR gRNA sequence
tgaacaactatgaataacat

SEQ ID NO: 665174 - DNA, 20 bp, Artificial
  CRISPR gRNA sequence
tgaataacattttcaagtca

SEQ ID NO: 665175 - DNA, 20 bp, Artificial
  CRISPR gRNA sequence
tcaagtcaataatttaaaaa

SEQ ID NO: 665176 - DNA, 20 bp, Artificial
  CRISPR gRNA sequence
caagtcaataatttaaaaac

SEQ ID NO: 665177 - DNA, 20 bp, Artificial
  CRISPR gRNA sequence
aagtcaataatttaaaaact

SEQ ID NO: 665178 - DNA, 20 bp, Artificial
  CRISPR gRNA sequence
aaaaactcataattctcata

SEQ ID NO: 665179 - DNA, 20 bp, Artificial
  CRISPR gRNA sequence
aaaactcataattctcatat

SEQ ID NO: 665180 - DNA, 20 bp, Artificial
  CRISPR gRNA sequence
ataattctcatataccactt

SEQ ID NO: 665181 - DNA, 20 bp, Artificial
  CRISPR gRNA sequence
tcatataccacttcactcaa

SEQ ID NO: 665182 - DNA, 20 bp, Artificial
  CRISPR gRNA sequence
atataccacttcactcaaat

SEQ ID NO: 665183 - DNA, 20 bp, Artificial
  CRISPR gRNA sequence
cactcaaatttattctgttt

SEQ ID NO: 665184 - DNA, 20 bp, Artificial
  CRISPR gRNA sequence
actcaaatttattctgtttc

SEQ ID NO: 665185 - DNA, 20 bp, Artificial
  CRISPR gRNA sequence
aaatttattctgtttccaaa

SEQ ID NO: 665186 - DNA, 20 bp, Artificial
  CRISPR gRNA sequence
attctgtttccaaaatacct

SEQ ID NO: 665187 - DNA, 20 bp, Artificial
  CRISPR gRNA sequence
ttctgtttccaaaatacctt

SEQ ID NO: 665188 - DNA, 20 bp, Artificial
  CRISPR gRNA sequence
tgtttccaaaataccttatg

SEQ ID NO: 665189 - DNA, 20 bp, Artificial
  CRISPR gRNA sequence
tttccaaaataccttatgtc

SEQ ID NO: 665190 - DNA, 20 bp, Artificial
  CRISPR gRNA sequence
ccaaaataccttatgtctgt

SEQ ID NO: 665191 - DNA, 20 bp, Artificial
  CRISPR gRNA sequence
caaaataccttatgtctgtc

SEQ ID NO: 665192 - DNA, 20 bp, Artificial
  CRISPR gRNA sequence
atgtctgtcattaatataac

SEQ ID NO: 665193 - DNA, 20 bp, Artificial
  CRISPR gRNA sequence
tgtctgtcattaatataaca

SEQ ID NO: 665194 - DNA, 20 bp, Artificial
  CRISPR gRNA sequence
tcattaatataacactctcc

SEQ ID NO: 665195 - DNA, 20 bp, Artificial
  CRISPR gRNA sequence
atataacactctcccctata

SEQ ID NO: 665196 - DNA, 20 bp, Artificial
  CRISPR gRNA sequence
tcccctatatggttcttcag

SEQ ID NO: 665197 - DNA, 20 bp, Artificial
  CRISPR gRNA sequence
ccctatatggttcttcagac

SEQ ID NO: 665198 - DNA, 20 bp, Artificial
  CRISPR gRNA sequence
tatggttcttcagacttgaa

SEQ ID NO: 665199 - DNA, 20 bp, Artificial
  CRISPR gRNA sequence
ttcagacttgaaatcttgga

SEQ ID NO: 665200 - DNA, 20 bp, Artificial
  CRISPR gRNA sequence
cagacttgaaatcttggaat

SEQ ID NO: 665201 - DNA, 20 bp, Artificial
  CRISPR gRNA sequence
agacttgaaatcttggaatc

SEQ ID NO: 665202 - DNA, 20 bp, Artificial
  CRISPR gRNA sequence
gaaatcttggaatcagatta

SEQ ID NO: 665203 - DNA, 20 bp, Artificial
  CRISPR gRNA sequence
aaatcttggaatcagattac

SEQ ID NO: 665204 - DNA, 20 bp, Artificial
  CRISPR gRNA sequence
ggaatcagattacttaatat

SEQ ID NO: 665205 - DNA, 20 bp, Artificial
  CRISPR gRNA sequence
gaatcagattacttaatatt

SEQ ID NO: 665206 - DNA, 20 bp, Artificial
  CRISPR gRNA sequence
cttaatattcttggcttctc

SEQ ID NO: 665207 - DNA, 20 bp, Artificial
  CRISPR gRNA sequence
aatattcttggcttctccta

SEQ ID NO: 665208 - DNA, 20 bp, Artificial
  CRISPR gRNA sequence
atattcttggcttctcctag

SEQ ID NO: 665209 - DNA, 20 bp, Artificial
  CRISPR gRNA sequence
ttggcttctcctagtctgtc

SEQ ID NO: 665210 - DNA, 20 bp, Artificial
  CRISPR gRNA sequence
ggcttctcctagtctgtcat

SEQ ID NO: 665211 - DNA, 20 bp, Artificial
  CRISPR gRNA sequence
gcttctcctagtctgtcatc

SEQ ID NO: 665212 - DNA, 20 bp, Artificial
  CRISPR gRNA sequence
ctcctagtctgtcatctggt

SEQ ID NO: 665213 - DNA, 20 bp, Artificial
  CRISPR gRNA sequence
tcctagtctgtcatctggta

SEQ ID NO: 665214 - DNA, 20 bp, Artificial
  CRISPR gRNA sequence
ctagtctgtcatctggtatc

SEQ ID NO: 665215 - DNA, 20 bp, Artificial
  CRISPR gRNA sequence
gtctgtcatctggtatcttg

SEQ ID NO: 665216 - DNA, 20 bp, Artificial
  CRISPR gRNA sequence
tcatctggtatcttgttctt

SEQ ID NO: 665217 - DNA, 20 bp, Artificial
  CRISPR gRNA sequence
gtatcttgttctttttccgt

SEQ ID NO: 665218 - DNA, 20 bp, Artificial
  CRISPR gRNA sequence
gttctttttccgttaagatt

SEQ ID NO: 665219 - DNA, 20 bp, Artificial
  CRISPR gRNA sequence
ttctttttccgttaagattt

SEQ ID NO: 665220 - DNA, 20 bp, Artificial
  CRISPR gRNA sequence
tttttccgttaagatttctt

SEQ ID NO: 665221 - DNA, 20 bp, Artificial
  CRISPR gRNA sequence
tttccgttaagatttctttt

SEQ ID NO: 665222 - DNA, 20 bp, Artificial
  CRISPR gRNA sequence
ttccgttaagatttcttttg

SEQ ID NO: 665223 - DNA, 20 bp, Artificial
  CRISPR gRNA sequence
tccgttaagatttcttttga

SEQ ID NO: 665224 - DNA, 20 bp, Artificial
  CRISPR gRNA sequence
ccgttaagatttcttttgat

SEQ ID NO: 665225 - DNA, 20 bp, Artificial
  CRISPR gRNA sequence
cgttaagatttcttttgatt

SEQ ID NO: 665226 - DNA, 20 bp, Artificial
  CRISPR gRNA sequence
agatttcttttgattctgtc

SEQ ID NO: 665227 - DNA, 20 bp, Artificial
  CRISPR gRNA sequence
cttttgattctgtcctctct

SEQ ID NO: 665228 - DNA, 20 bp, Artificial
  CRISPR gRNA sequence
ttttgattctgtcctctctc

SEQ ID NO: 665229 - DNA, 20 bp, Artificial
  CRISPR gRNA sequence
ttgattctgtcctctctcct

SEQ ID NO: 665230 - DNA, 20 bp, Artificial
  CRISPR gRNA sequence
tgattctgtcctctctcctc

SEQ ID NO: 665231 - DNA, 20 bp, Artificial
  CRISPR gRNA sequence
gattctgtcctctctcctct

SEQ ID NO: 665232 - DNA, 20 bp, Artificial
  CRISPR gRNA sequence
attctgtcctctctcctctt

SEQ ID NO: 665233 - DNA, 20 bp, Artificial
  CRISPR gRNA sequence
tgtcctctctcctcttgcca

SEQ ID NO: 665234 - DNA, 20 bp, Artificial
  CRISPR gRNA sequence
tcctctctcctcttgccagt

SEQ ID NO: 665235 - DNA, 20 bp, Artificial
  CRISPR gRNA sequence
tctcctcttgccagtccaca

SEQ ID NO: 665236 - DNA, 20 bp, Artificial
  CRISPR gRNA sequence
tcctcttgccagtccacatc

SEQ ID NO: 665237 - DNA, 20 bp, Artificial
  CRISPR gRNA sequence
ctcttgccagtccacatctt

SEQ ID NO: 665238 - DNA, 20 bp, Artificial
  CRISPR gRNA sequence
ttgccagtccacatcttatc

SEQ ID NO: 665239 - DNA, 20 bp, Artificial
  CRISPR gRNA sequence
gccagtccacatcttatcta

SEQ ID NO: 665240 - DNA, 20 bp, Artificial
  CRISPR gRNA sequence
ccagtccacatcttatctag

SEQ ID NO: 665241 - DNA, 20 bp, Artificial
  CRISPR gRNA sequence
atctagcctttctttacctg

SEQ ID NO: 665242 - DNA, 20 bp, Artificial
  CRISPR gRNA sequence
tctagcctttctttacctgt

SEQ ID NO: 665243 - DNA, 20 bp, Artificial
  CRISPR gRNA sequence
gcctttctttacctgtggct

SEQ ID NO: 665244 - DNA, 20 bp, Artificial
  CRISPR gRNA sequence
tctttacctgtggctgatat

SEQ ID NO: 665245 - DNA, 20 bp, Artificial
  CRISPR gRNA sequence
ctttacctgtggctgatatg

SEQ ID NO: 665246 - DNA, 20 bp, Artificial
  CRISPR gRNA sequence
tttacctgtggctgatatgc

SEQ ID NO: 665247 - DNA, 20 bp, Artificial
  CRISPR gRNA sequence
tacctgtggctgatatgcac

SEQ ID NO: 665248 - DNA, 20 bp, Artificial
  CRISPR gRNA sequence
acctgtggctgatatgcacc

SEQ ID NO: 665249 - DNA, 20 bp, Artificial
  CRISPR gRNA sequence
cctgtggctgatatgcaccc

SEQ ID NO: 665250 - DNA, 20 bp, Artificial
  CRISPR gRNA sequence
tggctgatatgcacccagca

SEQ ID NO: 665251 - DNA, 20 bp, Artificial
  CRISPR gRNA sequence
atatgcacccagcacttaca

SEQ ID NO: 665252 - DNA, 20 bp, Artificial
  CRISPR gRNA sequence
acagatatgattatactggt

SEQ ID NO: 665253 - DNA, 20 bp, Artificial
  CRISPR gRNA sequence
cagatatgattatactggtt

SEQ ID NO: 665254 - DNA, 20 bp, Artificial
  CRISPR gRNA sequence
tactggttgctaaaatatta

SEQ ID NO: 665255 - DNA, 20 bp, Artificial
  CRISPR gRNA sequence
gttgctaaaatattaaaatg

SEQ ID NO: 665256 - DNA, 20 bp, Artificial
  CRISPR gRNA sequence
ctaaaatattaaaatgcttt

SEQ ID NO: 665257 - DNA, 20 bp, Artificial
  CRISPR gRNA sequence
aaatattaaaatgcttttgt

SEQ ID NO: 665258 - DNA, 20 bp, Artificial
  CRISPR gRNA sequence
aaatgcttttgtacaggttt

SEQ ID NO: 665259 - DNA, 20 bp, Artificial
  CRISPR gRNA sequence
ttgtacaggtttgagaaaga

SEQ ID NO: 665260 - DNA, 20 bp, Artificial
  CRISPR gRNA sequence
tgtacaggtttgagaaagag

SEQ ID NO: 665261 - DNA, 20 bp, Artificial
  CRISPR gRNA sequence
gtacaggtttgagaaagaga

SEQ ID NO: 665262 - DNA, 20 bp, Artificial
  CRISPR gRNA sequence
tacaggtttgagaaagagac

SEQ ID NO: 665263 - DNA, 20 bp, Artificial
  CRISPR gRNA sequence
gagaaagagacttttcctca

SEQ ID NO: 665264 - DNA, 20 bp, Artificial
  CRISPR gRNA sequence
agaaagagacttttcctcaa

SEQ ID NO: 665265 - DNA, 20 bp, Artificial
  CRISPR gRNA sequence
ttcctcaagtccattgagta

SEQ ID NO: 665266 - DNA, 20 bp, Artificial
  CRISPR gRNA sequence
tcctcaagtccattgagtac

SEQ ID NO: 665267 - DNA, 20 bp, Artificial
  CRISPR gRNA sequence
cctcaagtccattgagtacc

SEQ ID NO: 665268 - DNA, 20 bp, Artificial
  CRISPR gRNA sequence
ctcaagtccattgagtacct

SEQ ID NO: 665269 - DNA, 20 bp, Artificial
  CRISPR gRNA sequence
aagtccattgagtacctgta

SEQ ID NO: 665270 - DNA, 20 bp, Artificial
  CRISPR gRNA sequence
agtacctgtactcccttcat

SEQ ID NO: 665271 - DNA, 20 bp, Artificial
  CRISPR gRNA sequence
tactcccttcatcccaagag

SEQ ID NO: 665272 - DNA, 20 bp, Artificial
  CRISPR gRNA sequence
ccttcatcccaagagctttg

SEQ ID NO: 665273 - DNA, 20 bp, Artificial
  CRISPR gRNA sequence
catcccaagagctttgtggg

SEQ ID NO: 665274 - DNA, 20 bp, Artificial
  CRISPR gRNA sequence
atcccaagagctttgtgggt

SEQ ID NO: 665275 - DNA, 20 bp, Artificial
  CRISPR gRNA sequence
tgtgggtaccctgcttaata

SEQ ID NO: 665276 - DNA, 20 bp, Artificial
  CRISPR gRNA sequence
gtgggtaccctgcttaatat

SEQ ID NO: 665277 - DNA, 20 bp, Artificial
  CRISPR gRNA sequence
tgggtaccctgcttaatatg

SEQ ID NO: 665278 - DNA, 20 bp, Artificial
  CRISPR gRNA sequence
cttaatatgctgtcaactgg

SEQ ID NO: 665279 - DNA, 20 bp, Artificial
  CRISPR gRNA sequence
aatatgctgtcaactggcta

SEQ ID NO: 665280 - DNA, 20 bp, Artificial
  CRISPR gRNA sequence
atatgctgtcaactggctaa

SEQ ID NO: 665281 - DNA, 20 bp, Artificial
  CRISPR gRNA sequence
tcaactggctaaccagcctg

SEQ ID NO: 665282 - DNA, 20 bp, Artificial
  CRISPR gRNA sequence
gctaaccagcctgtgtccca

SEQ ID NO: 665283 - DNA, 20 bp, Artificial
  CRISPR gRNA sequence
accagcctgtgtcccagcct

SEQ ID NO: 665284 - DNA, 20 bp, Artificial
  CRISPR gRNA sequence
tgtcccagcctgcgcatctc

SEQ ID NO: 665285 - DNA, 20 bp, Artificial
  CRISPR gRNA sequence
cgcatctcagcctcagtgtg

SEQ ID NO: 665286 - DNA, 20 bp, Artificial
  CRISPR gRNA sequence
agcctcagtgtgcccatgga

SEQ ID NO: 665287 - DNA, 20 bp, Artificial
  CRISPR gRNA sequence
agtgtgcccatggatgttct

SEQ ID NO: 665288 - DNA, 20 bp, Artificial
  CRISPR gRNA sequence
tctcccaggctaggggggtc

SEQ ID NO: 665289 - DNA, 20 bp, Artificial
  CRISPR gRNA sequence
tcccaggctaggggggtctc

SEQ ID NO: 665290 - DNA, 20 bp, Artificial
  CRISPR gRNA sequence
ccaggctaggggggtctcag

SEQ ID NO: 665291 - DNA, 20 bp, Artificial
  CRISPR gRNA sequence
ggggggtctcagattcttcc

SEQ ID NO: 665292 - DNA, 20 bp, Artificial
  CRISPR gRNA sequence
agattcttccaggaaagatg

SEQ ID NO: 665293 - DNA, 20 bp, Artificial
  CRISPR gRNA sequence
ttccaggaaagatggtaccc

SEQ ID NO: 665294 - DNA, 20 bp, Artificial
  CRISPR gRNA sequence
ccaggaaagatggtaccctg

SEQ ID NO: 665295 - DNA, 20 bp, Artificial
  CRISPR gRNA sequence
caggaaagatggtaccctgg

SEQ ID NO: 665296 - DNA, 20 bp, Artificial
  CRISPR gRNA sequence
gtgtcagtgctggtacacca

SEQ ID NO: 665297 - DNA, 20 bp, Artificial
  CRISPR gRNA sequence
gtacaccagcaaatagtact

SEQ ID NO: 665298 - DNA, 20 bp, Artificial
  CRISPR gRNA sequence
acatgggcccctgaagctat

SEQ ID NO: 665299 - DNA, 20 bp, Artificial
  CRISPR gRNA sequence
catgggcccctgaagctatg

SEQ ID NO: 665300 - DNA, 20 bp, Artificial
  CRISPR gRNA sequence
aagctatggtagtctcttgc

SEQ ID NO: 665301 - DNA, 20 bp, Artificial
  CRISPR gRNA sequence
tggtagtctcttgccagctc

SEQ ID NO: 665302 - DNA, 20 bp, Artificial
  CRISPR gRNA sequence
ttgccagctctctcttgcta

SEQ ID NO: 665303 - DNA, 20 bp, Artificial
  CRISPR gRNA sequence
gccagctctctcttgctatt

SEQ ID NO: 665304 - DNA, 20 bp, Artificial
  CRISPR gRNA sequence
ccagctctctcttgctattg

SEQ ID NO: 665305 - DNA, 20 bp, Artificial
  CRISPR gRNA sequence
tctcttgctattgcttgtgg

SEQ ID NO: 665306 - DNA, 20 bp, Artificial
  CRISPR gRNA sequence
tcttgctattgcttgtggga

SEQ ID NO: 665307 - DNA, 20 bp, Artificial
  CRISPR gRNA sequence
ttgctattgcttgtgggaac

SEQ ID NO: 665308 - DNA, 20 bp, Artificial
  CRISPR gRNA sequence
gctattgcttgtgggaactg

SEQ ID NO: 665309 - DNA, 20 bp, Artificial
  CRISPR gRNA sequence
ctattgcttgtgggaactgc

SEQ ID NO: 665310 - DNA, 20 bp, Artificial
  CRISPR gRNA sequence
ttgcttgtgggaactgcagc

SEQ ID NO: 665311 - DNA, 20 bp, Artificial
  CRISPR gRNA sequence
cttgtgggaactgcagcctc

SEQ ID NO: 665312 - DNA, 20 bp, Artificial
  CRISPR gRNA sequence
gtgggaactgcagcctctct

SEQ ID NO: 665313 - DNA, 20 bp, Artificial
  CRISPR gRNA sequence
tgggaactgcagcctctctg

SEQ ID NO: 665314 - DNA, 20 bp, Artificial
  CRISPR gRNA sequence
cagcctctctgctgttgcca

SEQ ID NO: 665315 - DNA, 20 bp, Artificial
  CRISPR gRNA sequence
tctgctgttgccagtttata

SEQ ID NO: 665316 - DNA, 20 bp, Artificial
  CRISPR gRNA sequence
tgctgttgccagtttataga

SEQ ID NO: 665317 - DNA, 20 bp, Artificial
  CRISPR gRNA sequence
ctgttgccagtttatagaat

SEQ ID NO: 665318 - DNA, 20 bp, Artificial
  CRISPR gRNA sequence
ttgccagtttatagaattgt

SEQ ID NO: 665319 - DNA, 20 bp, Artificial
  CRISPR gRNA sequence
ccagtttatagaattgttaa

SEQ ID NO: 665320 - DNA, 20 bp, Artificial
  CRISPR gRNA sequence
atagaattgttaaatacgta

SEQ ID NO: 665321 - DNA, 20 bp, Artificial
  CRISPR gRNA sequence
tagaattgttaaatacgtag

SEQ ID NO: 665322 - DNA, 20 bp, Artificial
  CRISPR gRNA sequence
ttaaatacgtagctatcacc

SEQ ID NO: 665323 - DNA, 20 bp, Artificial
  CRISPR gRNA sequence
aatacgtagctatcacccta

SEQ ID NO: 665324 - DNA, 20 bp, Artificial
  CRISPR gRNA sequence
tcaccctatctttactccaa

SEQ ID NO: 665325 - DNA, 20 bp, Artificial
  CRISPR gRNA sequence
tctttactccaagcttcata

SEQ ID NO: 665326 - DNA, 20 bp, Artificial
  CRISPR gRNA sequence
tactccaagcttcatagctg

SEQ ID NO: 665327 - DNA, 20 bp, Artificial
  CRISPR gRNA sequence
actccaagcttcatagctgt

SEQ ID NO: 665328 - DNA, 20 bp, Artificial
  CRISPR gRNA sequence
ctccaagcttcatagctgtt

SEQ ID NO: 665329 - DNA, 20 bp, Artificial
  CRISPR gRNA sequence
caagcttcatagctgttatg

SEQ ID NO: 665330 - DNA, 20 bp, Artificial
  CRISPR gRNA sequence
catagctgttatggtagatt

SEQ ID NO: 665331 - DNA, 20 bp, Artificial
  CRISPR gRNA sequence
atagctgttatggtagatta

SEQ ID NO: 665332 - DNA, 20 bp, Artificial
  CRISPR gRNA sequence
ttatggtagattagtagccc

SEQ ID NO: 665333 - DNA, 20 bp, Artificial
  CRISPR gRNA sequence
tggtagattagtagcccctt

SEQ ID NO: 665334 - DNA, 20 bp, Artificial
  CRISPR gRNA sequence
gtagccccttagttactctt

SEQ ID NO: 665335 - DNA, 20 bp, Artificial
  CRISPR gRNA sequence
agttactctttacctctagc

SEQ ID NO: 665336 - DNA, 20 bp, Artificial
  CRISPR gRNA sequence
gttactctttacctctagct

SEQ ID NO: 665337 - DNA, 20 bp, Artificial
  CRISPR gRNA sequence
ctctttacctctagctactt

SEQ ID NO: 665338 - DNA, 20 bp, Artificial
  CRISPR gRNA sequence
tttacctctagctacttatc

SEQ ID NO: 665339 - DNA, 20 bp, Artificial
  CRISPR gRNA sequence
tacctctagctacttatcct

SEQ ID NO: 665340 - DNA, 20 bp, Artificial
  CRISPR gRNA sequence
acctctagctacttatcctt

SEQ ID NO: 665341 - DNA, 20 bp, Artificial
  CRISPR gRNA sequence
cctctagctacttatccttc

SEQ ID NO: 665342 - DNA, 20 bp, Artificial
  CRISPR gRNA sequence
tagctacttatccttctgac

SEQ ID NO: 665343 - DNA, 20 bp, Artificial
  CRISPR gRNA sequence
gctacttatccttctgacat

SEQ ID NO: 665344 - DNA, 20 bp, Artificial
  CRISPR gRNA sequence
cttatccttctgacatactc

SEQ ID NO: 665345 - DNA, 20 bp, Artificial
  CRISPR gRNA sequence
atccttctgacatactcagc

SEQ ID NO: 665346 - DNA, 20 bp, Artificial
  CRISPR gRNA sequence
tccttctgacatactcagca

SEQ ID NO: 665347 - DNA, 20 bp, Artificial
  CRISPR gRNA sequence
ctgacatactcagcatagtc

SEQ ID NO: 665348 - DNA, 20 bp, Artificial
  CRISPR gRNA sequence
tgacatactcagcatagtca

SEQ ID NO: 665349 - DNA, 20 bp, Artificial
  CRISPR gRNA sequence
acatactcagcatagtcaga

SEQ ID NO: 665350 - DNA, 20 bp, Artificial
  CRISPR gRNA sequence
agcatagtcagatgaatctc

SEQ ID NO: 665351 - DNA, 20 bp, Artificial
  CRISPR gRNA sequence
cctaattttatcactcccct

SEQ ID NO: 665352 - DNA, 20 bp, Artificial
  CRISPR gRNA sequence
attttatcactcccctaaga

SEQ ID NO: 665353 - DNA, 20 bp, Artificial
  CRISPR gRNA sequence
tatcactcccctaagagatg

SEQ ID NO: 665354 - DNA, 20 bp, Artificial
  CRISPR gRNA sequence
atcactcccctaagagatgg

SEQ ID NO: 665355 - DNA, 20 bp, Artificial
  CRISPR gRNA sequence
tcactcccctaagagatgga

SEQ ID NO: 665356 - DNA, 20 bp, Artificial
  CRISPR gRNA sequence
ccctaagagatggaaatttg

SEQ ID NO: 665357 - DNA, 20 bp, Artificial
  CRISPR gRNA sequence
agagatggaaatttgaaccc

SEQ ID NO: 665358 - DNA, 20 bp, Artificial
  CRISPR gRNA sequence
gaacccagttcaaacttttt

SEQ ID NO: 665359 - DNA, 20 bp, Artificial
  CRISPR gRNA sequence
aacccagttcaaacttttta

SEQ ID NO: 665360 - DNA, 20 bp, Artificial
  CRISPR gRNA sequence
aaactttttatcaactcact

SEQ ID NO: 665361 - DNA, 20 bp, Artificial
  CRISPR gRNA sequence
tttatcaactcactttacca

SEQ ID NO: 665362 - DNA, 20 bp, Artificial
  CRISPR gRNA sequence
ttatcaactcactttaccat

SEQ ID NO: 665363 - DNA, 20 bp, Artificial
  CRISPR gRNA sequence
tatcaactcactttaccatg

SEQ ID NO: 665364 - DNA, 20 bp, Artificial
  CRISPR gRNA sequence
atcaactcactttaccatgt

SEQ ID NO: 665365 - DNA, 20 bp, Artificial
  CRISPR gRNA sequence
tcaactcactttaccatgtc

SEQ ID NO: 665366 - DNA, 20 bp, Artificial
  CRISPR gRNA sequence
actttaccatgtctgcttaa

SEQ ID NO: 665367 - DNA, 20 bp, Artificial
  CRISPR gRNA sequence
taccatgtctgcttaacctg

SEQ ID NO: 665368 - DNA, 20 bp, Artificial
  CRISPR gRNA sequence
accatgtctgcttaacctgt

SEQ ID NO: 665369 - DNA, 20 bp, Artificial
  CRISPR gRNA sequence
ccatgtctgcttaacctgtt

SEQ ID NO: 665370 - DNA, 20 bp, Artificial
  CRISPR gRNA sequence
cttaacctgttaatccatac

SEQ ID NO: 665371 - DNA, 20 bp, Artificial
  CRISPR gRNA sequence
aacctgttaatccatacctt

SEQ ID NO: 665372 - DNA, 20 bp, Artificial
  CRISPR gRNA sequence
acctgttaatccataccttt

SEQ ID NO: 665373 - DNA, 20 bp, Artificial
  CRISPR gRNA sequence
ttaatccatacctttctcag

SEQ ID NO: 665374 - DNA, 20 bp, Artificial
  CRISPR gRNA sequence
atccatacctttctcagatg

SEQ ID NO: 665375 - DNA, 20 bp, Artificial
  CRISPR gRNA sequence
tctcagatgaactcaggttt

SEQ ID NO: 665376 - DNA, 20 bp, Artificial
  CRISPR gRNA sequence
ctcagatgaactcaggttta

SEQ ID NO: 665377 - DNA, 20 bp, Artificial
  CRISPR gRNA sequence
tcagatgaactcaggtttac

SEQ ID NO: 665378 - DNA, 20 bp, Artificial
  CRISPR gRNA sequence
agatgaactcaggtttacct

SEQ ID NO: 665379 - DNA, 20 bp, Artificial
  CRISPR gRNA sequence
aggtttaccttttcccacaa

SEQ ID NO: 665380 - DNA, 20 bp, Artificial
  CRISPR gRNA sequence
accttttcccacaagatgtt

SEQ ID NO: 665381 - DNA, 20 bp, Artificial
  CRISPR gRNA sequence
ccttttcccacaagatgttc

SEQ ID NO: 665382 - DNA, 20 bp, Artificial
  CRISPR gRNA sequence
ttcccacaagatgttcttat

SEQ ID NO: 665383 - DNA, 20 bp, Artificial
  CRISPR gRNA sequence
tcccacaagatgttcttatt

SEQ ID NO: 665384 - DNA, 20 bp, Artificial
  CRISPR gRNA sequence
cccacaagatgttcttattt

SEQ ID NO: 665385 - DNA, 20 bp, Artificial
  CRISPR gRNA sequence
ccacaagatgttcttattta

SEQ ID NO: 665386 - DNA, 20 bp, Artificial
  CRISPR gRNA sequence
ttatttacctttttatgttt

SEQ ID NO: 665387 - DNA, 20 bp, Artificial
  CRISPR gRNA sequence
atttacctttttatgtttcc

SEQ ID NO: 665388 - DNA, 20 bp, Artificial
  CRISPR gRNA sequence
tttacctttttatgtttccc

SEQ ID NO: 665389 - DNA, 20 bp, Artificial
  CRISPR gRNA sequence
acctttttatgtttcccttt

SEQ ID NO: 665390 - DNA, 20 bp, Artificial
  CRISPR gRNA sequence
cctttttatgtttccctttt

SEQ ID NO: 665391 - DNA, 20 bp, Artificial
  CRISPR gRNA sequence
tttatgtttcccttttcaca

SEQ ID NO: 665392 - DNA, 20 bp, Artificial
  CRISPR gRNA sequence
ttatgtttcccttttcacat

SEQ ID NO: 665393 - DNA, 20 bp, Artificial
  CRISPR gRNA sequence
tatgtttcccttttcacatg

SEQ ID NO: 665394 - DNA, 20 bp, Artificial
  CRISPR gRNA sequence
atgtttcccttttcacatgt

SEQ ID NO: 665395 - DNA, 20 bp, Artificial
  CRISPR gRNA sequence
tgtttcccttttcacatgtt

SEQ ID NO: 665396 - DNA, 20 bp, Artificial
  CRISPR gRNA sequence
cccttttcacatgttcacat

SEQ ID NO: 665397 - DNA, 20 bp, Artificial
  CRISPR gRNA sequence
ccttttcacatgttcacatc

SEQ ID NO: 665398 - DNA, 20 bp, Artificial
  CRISPR gRNA sequence
ttcacatgttcacatctctg

SEQ ID NO: 665399 - DNA, 20 bp, Artificial
  CRISPR gRNA sequence
tcacatgttcacatctctgg

SEQ ID NO: 665400 - DNA, 20 bp, Artificial
  CRISPR gRNA sequence
cacatgttcacatctctgga

SEQ ID NO: 665401 - DNA, 20 bp, Artificial
  CRISPR gRNA sequence
acatgttcacatctctggag

SEQ ID NO: 665402 - DNA, 20 bp, Artificial
  CRISPR gRNA sequence
acatctctggagttctctct

SEQ ID NO: 665403 - DNA, 20 bp, Artificial
  CRISPR gRNA sequence
tggagttctctcttgtgcag

SEQ ID NO: 665404 - DNA, 20 bp, Artificial
  CRISPR gRNA sequence
gagttctctcttgtgcagtt

SEQ ID NO: 665405 - DNA, 20 bp, Artificial
  CRISPR gRNA sequence
tctcttgtgcagtttcaaat

SEQ ID NO: 665406 - DNA, 20 bp, Artificial
  CRISPR gRNA sequence
tcttgtgcagtttcaaatca

SEQ ID NO: 665407 - DNA, 20 bp, Artificial
  CRISPR gRNA sequence
ttgtgcagtttcaaatcaaa

SEQ ID NO: 665408 - DNA, 20 bp, Artificial
  CRISPR gRNA sequence
gtgcagtttcaaatcaaaca

SEQ ID NO: 665409 - DNA, 20 bp, Artificial
  CRISPR gRNA sequence
tgcagtttcaaatcaaacat

SEQ ID NO: 665410 - DNA, 20 bp, Artificial
  CRISPR gRNA sequence
caaatcaaacatttcctcta

SEQ ID NO: 665411 - DNA, 20 bp, Artificial
  CRISPR gRNA sequence
aaatcaaacatttcctctaa

SEQ ID NO: 665412 - DNA, 20 bp, Artificial
  CRISPR gRNA sequence
cctctaagttatatctcgat

SEQ ID NO: 665413 - DNA, 20 bp, Artificial
  CRISPR gRNA sequence
ctctaagttatatctcgatt

SEQ ID NO: 665414 - DNA, 20 bp, Artificial
  CRISPR gRNA sequence
taagttatatctcgattata

SEQ ID NO: 665415 - DNA, 20 bp, Artificial
  CRISPR gRNA sequence
agttatatctcgattatatt

SEQ ID NO: 665416 - DNA, 20 bp, Artificial
  CRISPR gRNA sequence
tatctcgattatatttcaag

SEQ ID NO: 665417 - DNA, 20 bp, Artificial
  CRISPR gRNA sequence
gattatatttcaagtaattc

SEQ ID NO: 665418 - DNA, 20 bp, Artificial
  CRISPR gRNA sequence
tatttcaagtaattcctcct

SEQ ID NO: 665419 - DNA, 20 bp, Artificial
  CRISPR gRNA sequence
caagtaattcctccttgaaa

SEQ ID NO: 665420 - DNA, 20 bp, Artificial
  CRISPR gRNA sequence
aagtaattcctccttgaaac

SEQ ID NO: 665421 - DNA, 20 bp, Artificial
  CRISPR gRNA sequence
ctccttgaaacttttactaa

SEQ ID NO: 665422 - DNA, 20 bp, Artificial
  CRISPR gRNA sequence
cttgaaacttttactaactt

SEQ ID NO: 665423 - DNA, 20 bp, Artificial
  CRISPR gRNA sequence
gaaacttttactaacttccc

SEQ ID NO: 665424 - DNA, 20 bp, Artificial
  CRISPR gRNA sequence
aaacttttactaacttccca

SEQ ID NO: 665425 - DNA, 20 bp, Artificial
  CRISPR gRNA sequence
ttactaacttcccaaataag

SEQ ID NO: 665426 - DNA, 20 bp, Artificial
  CRISPR gRNA sequence
tactaacttcccaaataaga

SEQ ID NO: 665427 - DNA, 20 bp, Artificial
  CRISPR gRNA sequence
actaacttcccaaataagaa

SEQ ID NO: 665428 - DNA, 20 bp, Artificial
  CRISPR gRNA sequence
ctaacttcccaaataagaat

SEQ ID NO: 665429 - DNA, 20 bp, Artificial
  CRISPR gRNA sequence
acttcccaaataagaatgac

SEQ ID NO: 665430 - DNA, 20 bp, Artificial
  CRISPR gRNA sequence
cccaaataagaatgaccttc

SEQ ID NO: 665431 - DNA, 20 bp, Artificial
  CRISPR gRNA sequence
ccaaataagaatgaccttct

SEQ ID NO: 665432 - DNA, 20 bp, Artificial
  CRISPR gRNA sequence
ctgttcttagaatccacata

SEQ ID NO: 665433 - DNA, 20 bp, Artificial
  CRISPR gRNA sequence
tgttcttagaatccacatag

SEQ ID NO: 665434 - DNA, 20 bp, Artificial
  CRISPR gRNA sequence
ttcttagaatccacatagca

SEQ ID NO: 665435 - DNA, 20 bp, Artificial
  CRISPR gRNA sequence
ttagaatccacatagcagct

SEQ ID NO: 665436 - DNA, 20 bp, Artificial
  CRISPR gRNA sequence
agaatccacatagcagctta

SEQ ID NO: 665437 - DNA, 20 bp, Artificial
  CRISPR gRNA sequence
gaatccacatagcagcttat

SEQ ID NO: 665438 - DNA, 20 bp, Artificial
  CRISPR gRNA sequence
atgtcttataatgtattagt

SEQ ID NO: 665439 - DNA, 20 bp, Artificial
  CRISPR gRNA sequence
tgtcttataatgtattagtt

SEQ ID NO: 665440 - DNA, 20 bp, Artificial
  CRISPR gRNA sequence
ataatgtattagttcccgaa

SEQ ID NO: 665441 - DNA, 20 bp, Artificial
  CRISPR gRNA sequence
taatgtattagttcccgaac

SEQ ID NO: 665442 - DNA, 20 bp, Artificial
  CRISPR gRNA sequence
gttcccgaactagaaagttc

SEQ ID NO: 665443 - DNA, 20 bp, Artificial
  CRISPR gRNA sequence
ccgaactagaaagttcaagg

SEQ ID NO: 665444 - DNA, 20 bp, Artificial
  CRISPR gRNA sequence
gaaagttcaaggtcatgtag

SEQ ID NO: 665445 - DNA, 20 bp, Artificial
  CRISPR gRNA sequence
aaggtcatgtagttgatctt

SEQ ID NO: 665446 - DNA, 20 bp, Artificial
  CRISPR gRNA sequence
atctttcttcccaacttagg

SEQ ID NO: 665447 - DNA, 20 bp, Artificial
  CRISPR gRNA sequence
tcttcccaacttaggaaacc

SEQ ID NO: 665448 - DNA, 20 bp, Artificial
  CRISPR gRNA sequence
cttcccaacttaggaaacct

SEQ ID NO: 665449 - DNA, 20 bp, Artificial
  CRISPR gRNA sequence
ttcccaacttaggaaacctt

SEQ ID NO: 665450 - DNA, 20 bp, Artificial
  CRISPR gRNA sequence
cccaacttaggaaacctttg

SEQ ID NO: 665451 - DNA, 20 bp, Artificial
  CRISPR gRNA sequence
ccaacttaggaaacctttgt

SEQ ID NO: 665452 - DNA, 20 bp, Artificial
  CRISPR gRNA sequence
aggaaacctttgtgcaaagc

SEQ ID NO: 665453 - DNA, 20 bp, Artificial
  CRISPR gRNA sequence
ggaaacctttgtgcaaagca

SEQ ID NO: 665454 - DNA, 20 bp, Artificial
  CRISPR gRNA sequence
tgtgcaaagcatgcgatgta

SEQ ID NO: 665455 - DNA, 20 bp, Artificial
  CRISPR gRNA sequence
gtgcaaagcatgcgatgtac

SEQ ID NO: 665456 - DNA, 20 bp, Artificial
  CRISPR gRNA sequence
tgcaaagcatgcgatgtaca

SEQ ID NO: 665457 - DNA, 20 bp, Artificial
  CRISPR gRNA sequence
cttccaagacaataaagcta

SEQ ID NO: 665458 - DNA, 20 bp, Artificial
  CRISPR gRNA sequence
ttccaagacaataaagctag

SEQ ID NO: 665459 - DNA, 20 bp, Artificial
  CRISPR gRNA sequence
ccaagacaataaagctagtg

SEQ ID NO: 665460 - DNA, 20 bp, Artificial
  CRISPR gRNA sequence
caagacaataaagctagtgg

SEQ ID NO: 665461 - DNA, 20 bp, Artificial
  CRISPR gRNA sequence
gtggttctgttattgggtat

SEQ ID NO: 665462 - DNA, 20 bp, Artificial
  CRISPR gRNA sequence
tgttattgggtatttctagt

SEQ ID NO: 665463 - DNA, 20 bp, Artificial
  CRISPR gRNA sequence
ttattgggtatttctagtta

SEQ ID NO: 665464 - DNA, 20 bp, Artificial
  CRISPR gRNA sequence
ttgggtatttctagttattc

SEQ ID NO: 665465 - DNA, 20 bp, Artificial
  CRISPR gRNA sequence
ggtatttctagttattcctt

SEQ ID NO: 665466 - DNA, 20 bp, Artificial
  CRISPR gRNA sequence
ctagttattccttcaattat

SEQ ID NO: 665467 - DNA, 20 bp, Artificial
  CRISPR gRNA sequence
tagttattccttcaattatc

SEQ ID NO: 665468 - DNA, 20 bp, Artificial
  CRISPR gRNA sequence
gttattccttcaattatcta

SEQ ID NO: 665469 - DNA, 20 bp, Artificial
  CRISPR gRNA sequence
ttccttcaattatctaataa

SEQ ID NO: 665470 - DNA, 20 bp, Artificial
  CRISPR gRNA sequence
cttcaattatctaataaaat

SEQ ID NO: 665471 - DNA, 20 bp, Artificial
  CRISPR gRNA sequence
caattatctaataaaatatt

SEQ ID NO: 665472 - DNA, 20 bp, Artificial
  CRISPR gRNA sequence
aattatctaataaaatattt

SEQ ID NO: 665473 - DNA, 20 bp, Artificial
  CRISPR gRNA sequence
tctaataaaatatttcttga

SEQ ID NO: 665474 - DNA, 20 bp, Artificial
  CRISPR gRNA sequence
ataaaatatttcttgaggct

SEQ ID NO: 665475 - DNA, 20 bp, Artificial
  CRISPR gRNA sequence
cttgaggcttactttgggtc

SEQ ID NO: 665476 - DNA, 20 bp, Artificial
  CRISPR gRNA sequence
ttgaggcttactttgggtca

SEQ ID NO: 665477 - DNA, 20 bp, Artificial
  CRISPR gRNA sequence
gaggcttactttgggtcagg

SEQ ID NO: 665478 - DNA, 20 bp, Artificial
  CRISPR gRNA sequence
aggcttactttgggtcaggc

SEQ ID NO: 665479 - DNA, 20 bp, Artificial
  CRISPR gRNA sequence
actttgggtcaggcactaag

SEQ ID NO: 665480 - DNA, 20 bp, Artificial
  CRISPR gRNA sequence
ctttgggtcaggcactaagc

SEQ ID NO: 665481 - DNA, 20 bp, Artificial
  CRISPR gRNA sequence
tgggtcaggcactaagcttg

SEQ ID NO: 665482 - DNA, 20 bp, Artificial
  CRISPR gRNA sequence
gggtcaggcactaagcttgc

SEQ ID NO: 665483 - DNA, 20 bp, Artificial
  CRISPR gRNA sequence
ggtcaggcactaagcttgct

SEQ ID NO: 665484 - DNA, 20 bp, Artificial
  CRISPR gRNA sequence
agcttgctctacagcagtga

SEQ ID NO: 665485 - DNA, 20 bp, Artificial
  CRISPR gRNA sequence
gctctacagcagtgaacaaa

SEQ ID NO: 665486 - DNA, 20 bp, Artificial
  CRISPR gRNA sequence
ctctacagcagtgaacaaaa

SEQ ID NO: 665487 - DNA, 20 bp, Artificial
  CRISPR gRNA sequence
tacagcagtgaacaaaacag

SEQ ID NO: 665488 - DNA, 20 bp, Artificial
  CRISPR gRNA sequence
cagcagtgaacaaaacagac

SEQ ID NO: 665489 - DNA, 20 bp, Artificial
  CRISPR gRNA sequence
tatccttatagagcttacag

SEQ ID NO: 665490 - DNA, 20 bp, Artificial
  CRISPR gRNA sequence
tccttatagagcttacagtt

SEQ ID NO: 665491 - DNA, 20 bp, Artificial
  CRISPR gRNA sequence
atagagcttacagttgaaag

SEQ ID NO: 665492 - DNA, 20 bp, Artificial
  CRISPR gRNA sequence
tagagcttacagttgaaaga

SEQ ID NO: 665493 - DNA, 20 bp, Artificial
  CRISPR gRNA sequence
acagttgaaagaagacatta

SEQ ID NO: 665494 - DNA, 20 bp, Artificial
  CRISPR gRNA sequence
cagttgaaagaagacattaa

SEQ ID NO: 665495 - DNA, 20 bp, Artificial
  CRISPR gRNA sequence
aaagaagacattaaaaatgt

SEQ ID NO: 665496 - DNA, 20 bp, Artificial
  CRISPR gRNA sequence
aaaatgtaagcacatatata

SEQ ID NO: 665497 - DNA, 20 bp, Artificial
  CRISPR gRNA sequence
atattagatgctgtaaaata

SEQ ID NO: 665498 - DNA, 20 bp, Artificial
  CRISPR gRNA sequence
tattagatgctgtaaaataa

SEQ ID NO: 665499 - DNA, 20 bp, Artificial
  CRISPR gRNA sequence
gatgctgtaaaataaaaata

SEQ ID NO: 665500 - DNA, 20 bp, Artificial
  CRISPR gRNA sequence
taaaataaaaataataggac

SEQ ID NO: 665501 - DNA, 20 bp, Artificial
  CRISPR gRNA sequence
taattaaaaagaacatcggg

SEQ ID NO: 665502 - DNA, 20 bp, Artificial
  CRISPR gRNA sequence
aaaagaacatcgggtcctta

SEQ ID NO: 665503 - DNA, 20 bp, Artificial
  CRISPR gRNA sequence
agtttatattgacgatttag

SEQ ID NO: 665504 - DNA, 20 bp, Artificial
  CRISPR gRNA sequence
gtttatattgacgatttaga

SEQ ID NO: 665505 - DNA, 20 bp, Artificial
  CRISPR gRNA sequence
atattgacgatttagagtaa

SEQ ID NO: 665506 - DNA, 20 bp, Artificial
  CRISPR gRNA sequence
tattgacgatttagagtaag

SEQ ID NO: 665507 - DNA, 20 bp, Artificial
  CRISPR gRNA sequence
acgatttagagtaagtgaaa

SEQ ID NO: 665508 - DNA, 20 bp, Artificial
  CRISPR gRNA sequence
agagtaagtgaaatttaaac

SEQ ID NO: 665509 - DNA, 20 bp, Artificial
  CRISPR gRNA sequence
gagtaagtgaaatttaaact

SEQ ID NO: 665510 - DNA, 20 bp, Artificial
  CRISPR gRNA sequence
aaactatagaggaggtaagg

SEQ ID NO: 665511 - DNA, 20 bp, Artificial
  CRISPR gRNA sequence
aactatagaggaggtaagga

SEQ ID NO: 665512 - DNA, 20 bp, Artificial
  CRISPR gRNA sequence
tagaggaggtaaggagtggg

SEQ ID NO: 665513 - DNA, 20 bp, Artificial
  CRISPR gRNA sequence
agatagcagtagagtatgag

SEQ ID NO: 665514 - DNA, 20 bp, Artificial
  CRISPR gRNA sequence
tatatgtgcaaaggccccgc

SEQ ID NO: 665515 - DNA, 20 bp, Artificial
  CRISPR gRNA sequence
gcttttataatatgttcacc

SEQ ID NO: 665516 - DNA, 20 bp, Artificial
  CRISPR gRNA sequence
ttataatatgttcaccaaag

SEQ ID NO: 665517 - DNA, 20 bp, Artificial
  CRISPR gRNA sequence
tataatatgttcaccaaaga

SEQ ID NO: 665518 - DNA, 20 bp, Artificial
  CRISPR gRNA sequence
ataatatgttcaccaaagaa

SEQ ID NO: 665519 - DNA, 20 bp, Artificial
  CRISPR gRNA sequence
taatatgttcaccaaagaac

SEQ ID NO: 665520 - DNA, 20 bp, Artificial
  CRISPR gRNA sequence
accaaagaactgaaagaagg

SEQ ID NO: 665521 - DNA, 20 bp, Artificial
  CRISPR gRNA sequence
aaagaaggcctgtgagcctg

SEQ ID NO: 665522 - DNA, 20 bp, Artificial
  CRISPR gRNA sequence
tgagcctgctatggagggag

SEQ ID NO: 665523 - DNA, 20 bp, Artificial
  CRISPR gRNA sequence
ctatggagggagatggagtg

SEQ ID NO: 665524 - DNA, 20 bp, Artificial
  CRISPR gRNA sequence
tggagggagatggagtggct

SEQ ID NO: 665525 - DNA, 20 bp, Artificial
  CRISPR gRNA sequence
atgatgtatctggagaggtg

SEQ ID NO: 665526 - DNA, 20 bp, Artificial
  CRISPR gRNA sequence
gagaggtgagaaggagccat

SEQ ID NO: 665527 - DNA, 20 bp, Artificial
  CRISPR gRNA sequence
tatttttttgaggatttggg

SEQ ID NO: 665528 - DNA, 20 bp, Artificial
  CRISPR gRNA sequence
atttttttgaggatttgggg

SEQ ID NO: 665529 - DNA, 20 bp, Artificial
  CRISPR gRNA sequence
tttttttgaggatttgggga

SEQ ID NO: 665530 - DNA, 20 bp, Artificial
  CRISPR gRNA sequence
ttttgaggatttggggaaga

SEQ ID NO: 665531 - DNA, 20 bp, Artificial
  CRISPR gRNA sequence
tttgaggatttggggaagaa

SEQ ID NO: 665532 - DNA, 20 bp, Artificial
  CRISPR gRNA sequence
ttgaggatttggggaagaat

SEQ ID NO: 665533 - DNA, 20 bp, Artificial
  CRISPR gRNA sequence
tgaggatttggggaagaatt

SEQ ID NO: 665534 - DNA, 20 bp, Artificial
  CRISPR gRNA sequence
gaggatttggggaagaattt

SEQ ID NO: 665535 - DNA, 20 bp, Artificial
  CRISPR gRNA sequence
aggatttggggaagaatttt

SEQ ID NO: 665536 - DNA, 20 bp, Artificial
  CRISPR gRNA sequence
ggggaagaattttggatttt

SEQ ID NO: 665537 - DNA, 20 bp, Artificial
  CRISPR gRNA sequence
gggaagaattttggattttt

SEQ ID NO: 665538 - DNA, 20 bp, Artificial
  CRISPR gRNA sequence
tggatttttatcctaaaagc

SEQ ID NO: 665539 - DNA, 20 bp, Artificial
  CRISPR gRNA sequence
ggatttttatcctaaaagca

SEQ ID NO: 665540 - DNA, 20 bp, Artificial
  CRISPR gRNA sequence
gatttttatcctaaaagcaa

SEQ ID NO: 665541 - DNA, 20 bp, Artificial
  CRISPR gRNA sequence
ttatcctaaaagcaacaaac

SEQ ID NO: 665542 - DNA, 20 bp, Artificial
  CRISPR gRNA sequence
tatcctaaaagcaacaaaca

SEQ ID NO: 665543 - DNA, 20 bp, Artificial
  CRISPR gRNA sequence
atcctaaaagcaacaaacaa

SEQ ID NO: 665544 - DNA, 20 bp, Artificial
  CRISPR gRNA sequence
tcctaaaagcaacaaacaac

SEQ ID NO: 665545 - DNA, 20 bp, Artificial
  CRISPR gRNA sequence
aaagcaacaaacaactattg

SEQ ID NO: 665546 - DNA, 20 bp, Artificial
  CRISPR gRNA sequence
ttgaaatagtgttgaacact

SEQ ID NO: 665547 - DNA, 20 bp, Artificial
  CRISPR gRNA sequence
aaatagtgttgaacactgac

SEQ ID NO: 665548 - DNA, 20 bp, Artificial
  CRISPR gRNA sequence
aacactgacttggtagaatt

SEQ ID NO: 665549 - DNA, 20 bp, Artificial
  CRISPR gRNA sequence
acttggtagaatttgattta

SEQ ID NO: 665550 - DNA, 20 bp, Artificial
  CRISPR gRNA sequence
ggtagaatttgatttatgat

SEQ ID NO: 665551 - DNA, 20 bp, Artificial
  CRISPR gRNA sequence
gtagaatttgatttatgatt

SEQ ID NO: 665552 - DNA, 20 bp, Artificial
  CRISPR gRNA sequence
gatttatgatttttttaggt

SEQ ID NO: 665553 - DNA, 20 bp, Artificial
  CRISPR gRNA sequence
atttatgatttttttaggtg

SEQ ID NO: 665554 - DNA, 20 bp, Artificial
  CRISPR gRNA sequence
atgatttttttaggtgttgg

SEQ ID NO: 665555 - DNA, 20 bp, Artificial
  CRISPR gRNA sequence
tgatttttttaggtgttggg

SEQ ID NO: 665556 - DNA, 20 bp, Artificial
  CRISPR gRNA sequence
ttttaggtgttgggtgggga

SEQ ID NO: 665557 - DNA, 20 bp, Artificial
  CRISPR gRNA sequence
tttaggtgttgggtggggag

SEQ ID NO: 665558 - DNA, 20 bp, Artificial
  CRISPR gRNA sequence
ttaggtgttgggtggggaga

SEQ ID NO: 665559 - DNA, 20 bp, Artificial
  CRISPR gRNA sequence
taggtgttgggtggggagaa

SEQ ID NO: 665560 - DNA, 20 bp, Artificial
  CRISPR gRNA sequence
aggtgttgggtggggagaag

SEQ ID NO: 665561 - DNA, 20 bp, Artificial
  CRISPR gRNA sequence
ggtgttgggtggggagaaga

SEQ ID NO: 665562 - DNA, 20 bp, Artificial
  CRISPR gRNA sequence
ggtggggagaagagcagata

SEQ ID NO: 665563 - DNA, 20 bp, Artificial
  CRISPR gRNA sequence
aaatctagaagtgcttatct

SEQ ID NO: 665564 - DNA, 20 bp, Artificial
  CRISPR gRNA sequence
aatctagaagtgcttatctt

SEQ ID NO: 665565 - DNA, 20 bp, Artificial
  CRISPR gRNA sequence
gaagtgcttatcttctgtat

SEQ ID NO: 665566 - DNA, 20 bp, Artificial
  CRISPR gRNA sequence
atcttctgtattacttgaat

SEQ ID NO: 665567 - DNA, 20 bp, Artificial
  CRISPR gRNA sequence
tcttctgtattacttgaata

SEQ ID NO: 665568 - DNA, 20 bp, Artificial
  CRISPR gRNA sequence
ctgtattacttgaataactt

SEQ ID NO: 665569 - DNA, 20 bp, Artificial
  CRISPR gRNA sequence
tgtattacttgaataacttt

SEQ ID NO: 665570 - DNA, 20 bp, Artificial
  CRISPR gRNA sequence
tattacttgaataactttct

SEQ ID NO: 665571 - DNA, 20 bp, Artificial
  CRISPR gRNA sequence
cttgaataactttcttagtt

SEQ ID NO: 665572 - DNA, 20 bp, Artificial
  CRISPR gRNA sequence
gaataactttcttagtttag

SEQ ID NO: 665573 - DNA, 20 bp, Artificial
  CRISPR gRNA sequence
aataactttcttagtttagc

SEQ ID NO: 665574 - DNA, 20 bp, Artificial
  CRISPR gRNA sequence
tcttagtttagcaaatatag

SEQ ID NO: 665575 - DNA, 20 bp, Artificial
  CRISPR gRNA sequence
cttagtttagcaaatataga

SEQ ID NO: 665576 - DNA, 20 bp, Artificial
  CRISPR gRNA sequence
ttagtttagcaaatatagag

SEQ ID NO: 665577 - DNA, 20 bp, Artificial
  CRISPR gRNA sequence
agtttagcaaatatagagca

SEQ ID NO: 665578 - DNA, 20 bp, Artificial
  CRISPR gRNA sequence
gtttagcaaatatagagcag

SEQ ID NO: 665579 - DNA, 20 bp, Artificial
  CRISPR gRNA sequence
agcaaatatagagcaggtac

SEQ ID NO: 665580 - DNA, 20 bp, Artificial
  CRISPR gRNA sequence
gcaaatatagagcaggtaca

SEQ ID NO: 665581 - DNA, 20 bp, Artificial
  CRISPR gRNA sequence
tcatagagcagaaaactttc

SEQ ID NO: 665582 - DNA, 20 bp, Artificial
  CRISPR gRNA sequence
tctgacttcattaatagaag

SEQ ID NO: 665583 - DNA, 20 bp, Artificial
  CRISPR gRNA sequence
ctgacttcattaatagaagt

SEQ ID NO: 665584 - DNA, 20 bp, Artificial
  CRISPR gRNA sequence
tgacttcattaatagaagtc

SEQ ID NO: 665585 - DNA, 20 bp, Artificial
  CRISPR gRNA sequence
acttcattaatagaagtctg

SEQ ID NO: 665586 - DNA, 20 bp, Artificial
  CRISPR gRNA sequence
cattaatagaagtctgccac

SEQ ID NO: 665587 - DNA, 20 bp, Artificial
  CRISPR gRNA sequence
attaatagaagtctgccact

SEQ ID NO: 665588 - DNA, 20 bp, Artificial
  CRISPR gRNA sequence
atagaagtctgccactccct

SEQ ID NO: 665589 - DNA, 20 bp, Artificial
  CRISPR gRNA sequence
ccactccctgagaatgcact

SEQ ID NO: 665590 - DNA, 20 bp, Artificial
  CRISPR gRNA sequence
cctgagaatgcacttgtatt

SEQ ID NO: 665591 - DNA, 20 bp, Artificial
  CRISPR gRNA sequence
agaatgcacttgtattctgc

SEQ ID NO: 665592 - DNA, 20 bp, Artificial
  CRISPR gRNA sequence
gtattctgctctgtaaagct

SEQ ID NO: 665593 - DNA, 20 bp, Artificial
  CRISPR gRNA sequence
tattctgctctgtaaagctg

SEQ ID NO: 665594 - DNA, 20 bp, Artificial
  CRISPR gRNA sequence
tgctctgtaaagctggttcc

SEQ ID NO: 665595 - DNA, 20 bp, Artificial
  CRISPR gRNA sequence
ctctgtaaagctggttcctg

SEQ ID NO: 665596 - DNA, 20 bp, Artificial
  CRISPR gRNA sequence
tgtaaagctggttcctgggg

SEQ ID NO: 665597 - DNA, 20 bp, Artificial
  CRISPR gRNA sequence
taaagctggttcctggggag

SEQ ID NO: 665598 - DNA, 20 bp, Artificial
  CRISPR gRNA sequence
gttcctggggaggagatcag

SEQ ID NO: 665599 - DNA, 20 bp, Artificial
  CRISPR gRNA sequence
ctggggaggagatcagttta

SEQ ID NO: 665600 - DNA, 20 bp, Artificial
  CRISPR gRNA sequence
gggaggagatcagtttacac

SEQ ID NO: 665601 - DNA, 20 bp, Artificial
  CRISPR gRNA sequence
acacaagatgtccagcgcct

SEQ ID NO: 665602 - DNA, 20 bp, Artificial
  CRISPR gRNA sequence
cacaagatgtccagcgcctt

SEQ ID NO: 665603 - DNA, 20 bp, Artificial
  CRISPR gRNA sequence
ctgggagagaaagaactaat

SEQ ID NO: 665604 - DNA, 20 bp, Artificial
  CRISPR gRNA sequence
tgggagagaaagaactaata

SEQ ID NO: 665605 - DNA, 20 bp, Artificial
  CRISPR gRNA sequence
ggagagaaagaactaatacc

SEQ ID NO: 665606 - DNA, 20 bp, Artificial
  CRISPR gRNA sequence
atacctagtctctgctgaca

SEQ ID NO: 665607 - DNA, 20 bp, Artificial
  CRISPR gRNA sequence
gtctctgctgacatagagct

SEQ ID NO: 665608 - DNA, 20 bp, Artificial
  CRISPR gRNA sequence
tgctgacatagagctgtgtg

SEQ ID NO: 665609 - DNA, 20 bp, Artificial
  CRISPR gRNA sequence
ctgacatagagctgtgtggc

SEQ ID NO: 665610 - DNA, 20 bp, Artificial
  CRISPR gRNA sequence
acatagagctgtgtggcact

SEQ ID NO: 665611 - DNA, 20 bp, Artificial
  CRISPR gRNA sequence
tgtggcactgactcaatccc

SEQ ID NO: 665612 - DNA, 20 bp, Artificial
  CRISPR gRNA sequence
actcaatcccagtctctgga

SEQ ID NO: 665613 - DNA, 20 bp, Artificial
  CRISPR gRNA sequence
aatcccagtctctggaaagg

SEQ ID NO: 665614 - DNA, 20 bp, Artificial
  CRISPR gRNA sequence
tggaaagggcaatgagattc

SEQ ID NO: 665615 - DNA, 20 bp, Artificial
  CRISPR gRNA sequence
gaaagggcaatgagattcct

SEQ ID NO: 665616 - DNA, 20 bp, Artificial
  CRISPR gRNA sequence
ctgaaatgaagttacattga

SEQ ID NO: 665617 - DNA, 20 bp, Artificial
  CRISPR gRNA sequence
aaatgaagttacattgagga

SEQ ID NO: 665618 - DNA, 20 bp, Artificial
  CRISPR gRNA sequence
cattgaggacagaaaggggt

SEQ ID NO: 665619 - DNA, 20 bp, Artificial
  CRISPR gRNA sequence
aggacagaaaggggtacccc

SEQ ID NO: 665620 - DNA, 20 bp, Artificial
  CRISPR gRNA sequence
gcaaccaacattcaagagaa

SEQ ID NO: 665621 - DNA, 20 bp, Artificial
  CRISPR gRNA sequence
aagagaaacccttttgaact

SEQ ID NO: 665622 - DNA, 20 bp, Artificial
  CRISPR gRNA sequence
ttgaactcatggggctgatg

SEQ ID NO: 665623 - DNA, 20 bp, Artificial
  CRISPR gRNA sequence
tgaactcatggggctgatga

SEQ ID NO: 665624 - DNA, 20 bp, Artificial
  CRISPR gRNA sequence
gaactcatggggctgatgat

SEQ ID NO: 665625 - DNA, 20 bp, Artificial
  CRISPR gRNA sequence
aactcatggggctgatgata

SEQ ID NO: 665626 - DNA, 20 bp, Artificial
  CRISPR gRNA sequence
atggggctgatgatagaaaa

SEQ ID NO: 665627 - DNA, 20 bp, Artificial
  CRISPR gRNA sequence
atgatagaaaattttgtata

SEQ ID NO: 665628 - DNA, 20 bp, Artificial
  CRISPR gRNA sequence
tgtatatgctgtcatcagtg

SEQ ID NO: 665629 - DNA, 20 bp, Artificial
  CRISPR gRNA sequence
gtatatgctgtcatcagtgt

SEQ ID NO: 665630 - DNA, 20 bp, Artificial
  CRISPR gRNA sequence
tatatgctgtcatcagtgta

SEQ ID NO: 665631 - DNA, 20 bp, Artificial
  CRISPR gRNA sequence
tcatcagtgtagttagtacc

SEQ ID NO: 665632 - DNA, 20 bp, Artificial
  CRISPR gRNA sequence
gtaccttagggaagaacagc

SEQ ID NO: 665633 - DNA, 20 bp, Artificial
  CRISPR gRNA sequence
agggaagaacagctggtaat

SEQ ID NO: 665634 - DNA, 20 bp, Artificial
  CRISPR gRNA sequence
gggaagaacagctggtaatg

SEQ ID NO: 665635 - DNA, 20 bp, Artificial
  CRISPR gRNA sequence
gtaatggtagttgcaaacac

SEQ ID NO: 665636 - DNA, 20 bp, Artificial
  CRISPR gRNA sequence
caaacacagaagtagagcac

SEQ ID NO: 665637 - DNA, 20 bp, Artificial
  CRISPR gRNA sequence
gactgagctgggcaccaaag

SEQ ID NO: 665638 - DNA, 20 bp, Artificial
  CRISPR gRNA sequence
actgagctgggcaccaaagg

SEQ ID NO: 665639 - DNA, 20 bp, Artificial
  CRISPR gRNA sequence
agctgggcaccaaaggaaac

SEQ ID NO: 665640 - DNA, 20 bp, Artificial
  CRISPR gRNA sequence
ggcaccaaaggaaacaggat

SEQ ID NO: 665641 - DNA, 20 bp, Artificial
  CRISPR gRNA sequence
tggctcgaacagggcggtgg

SEQ ID NO: 665642 - DNA, 20 bp, Artificial
  CRISPR gRNA sequence
gaacagggcggtgggatggt

SEQ ID NO: 665643 - DNA, 20 bp, Artificial
  CRISPR gRNA sequence
acattgttgggtgataaaag

SEQ ID NO: 665644 - DNA, 20 bp, Artificial
  CRISPR gRNA sequence
ttgggtgataaaagaccagt

SEQ ID NO: 665645 - DNA, 20 bp, Artificial
  CRISPR gRNA sequence
ggtgataaaagaccagtagc

SEQ ID NO: 665646 - DNA, 20 bp, Artificial
  CRISPR gRNA sequence
gtgaatagcagattaattat

SEQ ID NO: 665647 - DNA, 20 bp, Artificial
  CRISPR gRNA sequence
tgaatagcagattaattatg

SEQ ID NO: 665648 - DNA, 20 bp, Artificial
  CRISPR gRNA sequence
attatggtttaccaactctc

SEQ ID NO: 665649 - DNA, 20 bp, Artificial
  CRISPR gRNA sequence
tggtttaccaactctctgcg

SEQ ID NO: 665650 - DNA, 20 bp, Artificial
  CRISPR gRNA sequence
accaactctctgcgtggcat

SEQ ID NO: 665651 - DNA, 20 bp, Artificial
  CRISPR gRNA sequence
ccaactctctgcgtggcatg

SEQ ID NO: 665652 - DNA, 20 bp, Artificial
  CRISPR gRNA sequence
tctgcgtggcatggtatgta

SEQ ID NO: 665653 - DNA, 20 bp, Artificial
  CRISPR gRNA sequence
tgcgtggcatggtatgtaga

SEQ ID NO: 665654 - DNA, 20 bp, Artificial
  CRISPR gRNA sequence
cgtggcatggtatgtagact

SEQ ID NO: 665655 - DNA, 20 bp, Artificial
  CRISPR gRNA sequence
aagttctggggcaagtgaga

SEQ ID NO: 665656 - DNA, 20 bp, Artificial
  CRISPR gRNA sequence
tggggcaagtgagaactcta

SEQ ID NO: 665657 - DNA, 20 bp, Artificial
  CRISPR gRNA sequence
gggcaagtgagaactctagc

SEQ ID NO: 665658 - DNA, 20 bp, Artificial
  CRISPR gRNA sequence
tagccagctatatttgaagt

SEQ ID NO: 665659 - DNA, 20 bp, Artificial
  CRISPR gRNA sequence
gccagctatatttgaagtaa

SEQ ID NO: 665660 - DNA, 20 bp, Artificial
  CRISPR gRNA sequence
tatttgaagtaaaaatttaa

SEQ ID NO: 665661 - DNA, 20 bp, Artificial
  CRISPR gRNA sequence
gaagtaaaaatttaaatatg

SEQ ID NO: 665662 - DNA, 20 bp, Artificial
  CRISPR gRNA sequence
aagtaaaaatttaaatatga

SEQ ID NO: 665663 - DNA, 20 bp, Artificial
  CRISPR gRNA sequence
aaatatgaccataactgtac

SEQ ID NO: 665664 - DNA, 20 bp, Artificial
  CRISPR gRNA sequence
aatatgaccataactgtaca

SEQ ID NO: 665665 - DNA, 20 bp, Artificial
  CRISPR gRNA sequence
tacattgaaatggtagagga

SEQ ID NO: 665666 - DNA, 20 bp, Artificial
  CRISPR gRNA sequence
aaatggtagaggaggttatt

SEQ ID NO: 665667 - DNA, 20 bp, Artificial
  CRISPR gRNA sequence
ttatggttacagtttataaa

SEQ ID NO: 665668 - DNA, 20 bp, Artificial
  CRISPR gRNA sequence
tggttacagtttataaaaga

SEQ ID NO: 665669 - DNA, 20 bp, Artificial
  CRISPR gRNA sequence
cagtttataaaagatagctt

SEQ ID NO: 665670 - DNA, 20 bp, Artificial
  CRISPR gRNA sequence
ataaaagatagcttataggc

SEQ ID NO: 665671 - DNA, 20 bp, Artificial
  CRISPR gRNA sequence
taaaagatagcttataggcc

SEQ ID NO: 665672 - DNA, 20 bp, Artificial
  CRISPR gRNA sequence
ataggccaggcacagtggct

SEQ ID NO: 665673 - DNA, 20 bp, Artificial
  CRISPR gRNA sequence
taggccaggcacagtggctc

SEQ ID NO: 665674 - DNA, 20 bp, Artificial
  CRISPR gRNA sequence
acactgtaatctcagcattt

SEQ ID NO: 665675 - DNA, 20 bp, Artificial
  CRISPR gRNA sequence
taatctcagcattttgggag

SEQ ID NO: 665676 - DNA, 20 bp, Artificial
  CRISPR gRNA sequence
agcattttgggaggccaagg

SEQ ID NO: 665677 - DNA, 20 bp, Artificial
  CRISPR gRNA sequence
tgggaggccaaggcaggaga

SEQ ID NO: 665678 - DNA, 20 bp, Artificial
  CRISPR gRNA sequence
gggaggccaaggcaggagaa

SEQ ID NO: 665679 - DNA, 20 bp, Artificial
  CRISPR gRNA sequence
ggaggccaaggcaggagaac

SEQ ID NO: 665680 - DNA, 20 bp, Artificial
  CRISPR gRNA sequence
ctttagtctcaaagttcaaa

SEQ ID NO: 665681 - DNA, 20 bp, Artificial
  CRISPR gRNA sequence
tagtctcaaagttcaaaact

SEQ ID NO: 665682 - DNA, 20 bp, Artificial
  CRISPR gRNA sequence
agtctcaaagttcaaaacta

SEQ ID NO: 665683 - DNA, 20 bp, Artificial
  CRISPR gRNA sequence
gtctcaaagttcaaaactag

SEQ ID NO: 665684 - DNA, 20 bp, Artificial
  CRISPR gRNA sequence
aaagttcaaaactagtctgg

SEQ ID NO: 665685 - DNA, 20 bp, Artificial
  CRISPR gRNA sequence
aaaactagtctgggcaacat

SEQ ID NO: 665686 - DNA, 20 bp, Artificial
  CRISPR gRNA sequence
gtctgggcaacatagggaga

SEQ ID NO: 665687 - DNA, 20 bp, Artificial
  CRISPR gRNA sequence
ggcaacatagggagatctca

SEQ ID NO: 665688 - DNA, 20 bp, Artificial
  CRISPR gRNA sequence
atctctacaaaataattatt

SEQ ID NO: 665689 - DNA, 20 bp, Artificial
  CRISPR gRNA sequence
tacaaaataattattttaaa

SEQ ID NO: 665690 - DNA, 20 bp, Artificial
  CRISPR gRNA sequence
caaaataattattttaaatt

SEQ ID NO: 665691 - DNA, 20 bp, Artificial
  CRISPR gRNA sequence
ttttaaattagctaggtgtg

SEQ ID NO: 665692 - DNA, 20 bp, Artificial
  CRISPR gRNA sequence
taaattagctaggtgtggtg

SEQ ID NO: 665693 - DNA, 20 bp, Artificial
  CRISPR gRNA sequence
aaattagctaggtgtggtgg

SEQ ID NO: 665694 - DNA, 20 bp, Artificial
  CRISPR gRNA sequence
aattagctaggtgtggtggt

SEQ ID NO: 665695 - DNA, 20 bp, Artificial
  CRISPR gRNA sequence
gctaggtgtggtggtgtgca

SEQ ID NO: 665696 - DNA, 20 bp, Artificial
  CRISPR gRNA sequence
ggtgtggtggtgtgcatatg

SEQ ID NO: 665697 - DNA, 20 bp, Artificial
  CRISPR gRNA sequence
cagcgactcaggagactgag

SEQ ID NO: 665698 - DNA, 20 bp, Artificial
  CRISPR gRNA sequence
aggagactgaggagggaaga

SEQ ID NO: 665699 - DNA, 20 bp, Artificial
  CRISPR gRNA sequence
aggagggaagatcacttaag

SEQ ID NO: 665700 - DNA, 20 bp, Artificial
  CRISPR gRNA sequence
aagcccaggaagtcgatgct

SEQ ID NO: 665701 - DNA, 20 bp, Artificial
  CRISPR gRNA sequence
agcccaggaagtcgatgctg

SEQ ID NO: 665702 - DNA, 20 bp, Artificial
  CRISPR gRNA sequence
cagtgagccttgattgtgct

SEQ ID NO: 665703 - DNA, 20 bp, Artificial
  CRISPR gRNA sequence
gattgtgctactgcactcca

SEQ ID NO: 665704 - DNA, 20 bp, Artificial
  CRISPR gRNA sequence
attgtgctactgcactccag

SEQ ID NO: 665705 - DNA, 20 bp, Artificial
  CRISPR gRNA sequence
tgctactgcactccagcctg

SEQ ID NO: 665706 - DNA, 20 bp, Artificial
  CRISPR gRNA sequence
ctgcactccagcctgggcaa

SEQ ID NO: 665707 - DNA, 20 bp, Artificial
  CRISPR gRNA sequence
cactccagcctgggcaacag

SEQ ID NO: 665708 - DNA, 20 bp, Artificial
  CRISPR gRNA sequence
cagcctgggcaacagagtga

SEQ ID NO: 665709 - DNA, 20 bp, Artificial
  CRISPR gRNA sequence
ggcaacagagtgagaccctg

SEQ ID NO: 665710 - DNA, 20 bp, Artificial
  CRISPR gRNA sequence
tctcaaaaatagtatgtgca

SEQ ID NO: 665711 - DNA, 20 bp, Artificial
  CRISPR gRNA sequence
aaaaatagtatgtgcatgta

SEQ ID NO: 665712 - DNA, 20 bp, Artificial
  CRISPR gRNA sequence
gtataataaataaaatagat

SEQ ID NO: 665713 - DNA, 20 bp, Artificial
  CRISPR gRNA sequence
ataaaaatataataaacaaa

SEQ ID NO: 665714 - DNA, 20 bp, Artificial
  CRISPR gRNA sequence
aataaaaatagtatgagtac

SEQ ID NO: 665715 - DNA, 20 bp, Artificial
  CRISPR gRNA sequence
atactctctttcacagaatg

SEQ ID NO: 665716 - DNA, 20 bp, Artificial
  CRISPR gRNA sequence
tactctctttcacagaatgg

SEQ ID NO: 665717 - DNA, 20 bp, Artificial
  CRISPR gRNA sequence
tctttcacagaatggattgg

SEQ ID NO: 665718 - DNA, 20 bp, Artificial
  CRISPR gRNA sequence
tttcacagaatggattggaa

SEQ ID NO: 665719 - DNA, 20 bp, Artificial
  CRISPR gRNA sequence
tcacagaatggattggaaaa

SEQ ID NO: 665720 - DNA, 20 bp, Artificial
  CRISPR gRNA sequence
cacagaatggattggaaaat

SEQ ID NO: 665721 - DNA, 20 bp, Artificial
  CRISPR gRNA sequence
acagaatggattggaaaatg

SEQ ID NO: 665722 - DNA, 20 bp, Artificial
  CRISPR gRNA sequence
gaaaatgtaagggaagaaat

SEQ ID NO: 665723 - DNA, 20 bp, Artificial
  CRISPR gRNA sequence
gtggccatggagaggaccag

SEQ ID NO: 665724 - DNA, 20 bp, Artificial
  CRISPR gRNA sequence
agtaaaatatattagcacta

SEQ ID NO: 665725 - DNA, 20 bp, Artificial
  CRISPR gRNA sequence
gcactagagtgacagttaca

SEQ ID NO: 665726 - DNA, 20 bp, Artificial
  CRISPR gRNA sequence
gagtgacagttacacagaga

SEQ ID NO: 665727 - DNA, 20 bp, Artificial
  CRISPR gRNA sequence
cacagagaaatagaatattc

SEQ ID NO: 665728 - DNA, 20 bp, Artificial
  CRISPR gRNA sequence
tttcttttattaaattttca

SEQ ID NO: 665729 - DNA, 20 bp, Artificial
  CRISPR gRNA sequence
tcttttattaaattttcaca

SEQ ID NO: 665730 - DNA, 20 bp, Artificial
  CRISPR gRNA sequence
cttttattaaattttcacat

SEQ ID NO: 665731 - DNA, 20 bp, Artificial
  CRISPR gRNA sequence
ttttattaaattttcacatc

SEQ ID NO: 665732 - DNA, 20 bp, Artificial
  CRISPR gRNA sequence
ttattaaattttcacatctt

SEQ ID NO: 665733 - DNA, 20 bp, Artificial
  CRISPR gRNA sequence
tattaaattttcacatcttt

SEQ ID NO: 665734 - DNA, 20 bp, Artificial
  CRISPR gRNA sequence
attaaattttcacatctttt

SEQ ID NO: 665735 - DNA, 20 bp, Artificial
  CRISPR gRNA sequence
ttaaattttcacatcttttc

SEQ ID NO: 665736 - DNA, 20 bp, Artificial
  CRISPR gRNA sequence
aattttcacatcttttctgc

SEQ ID NO: 665737 - DNA, 20 bp, Artificial
  CRISPR gRNA sequence
tcacatcttttctgcataag

SEQ ID NO: 665738 - DNA, 20 bp, Artificial
  CRISPR gRNA sequence
cacatcttttctgcataagc

SEQ ID NO: 665739 - DNA, 20 bp, Artificial
  CRISPR gRNA sequence
acatcttttctgcataagct

SEQ ID NO: 665740 - DNA, 20 bp, Artificial
  CRISPR gRNA sequence
ttctgcataagctactttga

SEQ ID NO: 665741 - DNA, 20 bp, Artificial
  CRISPR gRNA sequence
tctgcataagctactttgat

SEQ ID NO: 665742 - DNA, 20 bp, Artificial
  CRISPR gRNA sequence
ctgcataagctactttgatc

SEQ ID NO: 665743 - DNA, 20 bp, Artificial
  CRISPR gRNA sequence
tgcataagctactttgatcc

SEQ ID NO: 665744 - DNA, 20 bp, Artificial
  CRISPR gRNA sequence
cataagctactttgatccca

SEQ ID NO: 665745 - DNA, 20 bp, Artificial
  CRISPR gRNA sequence
ctttgatcccacatctttca

SEQ ID NO: 665746 - DNA, 20 bp, Artificial
  CRISPR gRNA sequence
tgatcccacatctttcataa

SEQ ID NO: 665747 - DNA, 20 bp, Artificial
  CRISPR gRNA sequence
gatcccacatctttcataaa

SEQ ID NO: 665748 - DNA, 20 bp, Artificial
  CRISPR gRNA sequence
atcccacatctttcataaat

SEQ ID NO: 665749 - DNA, 20 bp, Artificial
  CRISPR gRNA sequence
tcataaatccagccttgatc

SEQ ID NO: 665750 - DNA, 20 bp, Artificial
  CRISPR gRNA sequence
cataaatccagccttgatct

SEQ ID NO: 665751 - DNA, 20 bp, Artificial
  CRISPR gRNA sequence
ataaatccagccttgatctc

SEQ ID NO: 665752 - DNA, 20 bp, Artificial
  CRISPR gRNA sequence
gatctcatatctacctttcc

SEQ ID NO: 665753 - DNA, 20 bp, Artificial
  CRISPR gRNA sequence
atctcatatctacctttccc

SEQ ID NO: 665754 - DNA, 20 bp, Artificial
  CRISPR gRNA sequence
atatctacctttccctgttg

SEQ ID NO: 665755 - DNA, 20 bp, Artificial
  CRISPR gRNA sequence
cctttccctgttgtttttct

SEQ ID NO: 665756 - DNA, 20 bp, Artificial
  CRISPR gRNA sequence
tccctgttgtttttctcttg

SEQ ID NO: 665757 - DNA, 20 bp, Artificial
  CRISPR gRNA sequence
ccctgttgtttttctcttgg

SEQ ID NO: 665758 - DNA, 20 bp, Artificial
  CRISPR gRNA sequence
cctgttgtttttctcttggt

SEQ ID NO: 665759 - DNA, 20 bp, Artificial
  CRISPR gRNA sequence
ttgtttttctcttggttaac

SEQ ID NO: 665760 - DNA, 20 bp, Artificial
  CRISPR gRNA sequence
tttttctcttggttaacatc

SEQ ID NO: 665761 - DNA, 20 bp, Artificial
  CRISPR gRNA sequence
ttctcttggttaacatctct

SEQ ID NO: 665762 - DNA, 20 bp, Artificial
  CRISPR gRNA sequence
tctcttggttaacatctcta

SEQ ID NO: 665763 - DNA, 20 bp, Artificial
  CRISPR gRNA sequence
ctcttggttaacatctctaa

SEQ ID NO: 665764 - DNA, 20 bp, Artificial
  CRISPR gRNA sequence
tcttggttaacatctctaat

SEQ ID NO: 665765 - DNA, 20 bp, Artificial
  CRISPR gRNA sequence
ttggttaacatctctaattc

SEQ ID NO: 665766 - DNA, 20 bp, Artificial
  CRISPR gRNA sequence
ggttaacatctctaattcct

SEQ ID NO: 665767 - DNA, 20 bp, Artificial
  CRISPR gRNA sequence
gttaacatctctaattcctt

SEQ ID NO: 665768 - DNA, 20 bp, Artificial
  CRISPR gRNA sequence
acatctctaattcctttctt

SEQ ID NO: 665769 - DNA, 20 bp, Artificial
  CRISPR gRNA sequence
taattcctttcttcttcaga

SEQ ID NO: 665770 - DNA, 20 bp, Artificial
  CRISPR gRNA sequence
attcctttcttcttcagacg

SEQ ID NO: 665771 - DNA, 20 bp, Artificial
  CRISPR gRNA sequence
ctttcttcttcagacggatg

SEQ ID NO: 665772 - DNA, 20 bp, Artificial
  CRISPR gRNA sequence
tcttcttcagacggatgatt

SEQ ID NO: 665773 - DNA, 20 bp, Artificial
  CRISPR gRNA sequence
cttcttcagacggatgattt

SEQ ID NO: 665774 - DNA, 20 bp, Artificial
  CRISPR gRNA sequence
ttcttcagacggatgatttc

SEQ ID NO: 665775 - DNA, 20 bp, Artificial
  CRISPR gRNA sequence
cttcagacggatgatttctg

SEQ ID NO: 665776 - DNA, 20 bp, Artificial
  CRISPR gRNA sequence
ttcagacggatgatttctgg

SEQ ID NO: 665777 - DNA, 20 bp, Artificial
  CRISPR gRNA sequence
cagacggatgatttctggaa

SEQ ID NO: 665778 - DNA, 20 bp, Artificial
  CRISPR gRNA sequence
agacggatgatttctggaat

SEQ ID NO: 665779 - DNA, 20 bp, Artificial
  CRISPR gRNA sequence
ctggaatcaaaactcagcca

SEQ ID NO: 665780 - DNA, 20 bp, Artificial
  CRISPR gRNA sequence
tggaatcaaaactcagccat

SEQ ID NO: 665781 - DNA, 20 bp, Artificial
  CRISPR gRNA sequence
gaatcaaaactcagccattg

SEQ ID NO: 665782 - DNA, 20 bp, Artificial
  CRISPR gRNA sequence
agccattgaggggatcaggt

SEQ ID NO: 665783 - DNA, 20 bp, Artificial
  CRISPR gRNA sequence
aggggatcaggtatccttgt

SEQ ID NO: 665784 - DNA, 20 bp, Artificial
  CRISPR gRNA sequence
gtcagctgtgtgtcatgcac

SEQ ID NO: 665785 - DNA, 20 bp, Artificial
  CRISPR gRNA sequence
tcagctgtgtgtcatgcaca

SEQ ID NO: 665786 - DNA, 20 bp, Artificial
  CRISPR gRNA sequence
tgtgtcatgcacaggtttga

SEQ ID NO: 665787 - DNA, 20 bp, Artificial
  CRISPR gRNA sequence
gataaacatgccttgcaagt

SEQ ID NO: 665788 - DNA, 20 bp, Artificial
  CRISPR gRNA sequence
ataaacatgccttgcaagtt

SEQ ID NO: 665789 - DNA, 20 bp, Artificial
  CRISPR gRNA sequence
gcaagtttcttttcaatctt

SEQ ID NO: 665790 - DNA, 20 bp, Artificial
  CRISPR gRNA sequence
caagtttcttttcaatcttg

SEQ ID NO: 665791 - DNA, 20 bp, Artificial
  CRISPR gRNA sequence
cttttcaatcttgtgaaaat

SEQ ID NO: 665792 - DNA, 20 bp, Artificial
  CRISPR gRNA sequence
ttttcaatcttgtgaaaata

SEQ ID NO: 665793 - DNA, 20 bp, Artificial
  CRISPR gRNA sequence
ttcaatcttgtgaaaatagc

SEQ ID NO: 665794 - DNA, 20 bp, Artificial
  CRISPR gRNA sequence
tcaatcttgtgaaaatagcc

SEQ ID NO: 665795 - DNA, 20 bp, Artificial
  CRISPR gRNA sequence
caatcttgtgaaaatagccc

SEQ ID NO: 665796 - DNA, 20 bp, Artificial
  CRISPR gRNA sequence
aatcttgtgaaaatagccct

SEQ ID NO: 665797 - DNA, 20 bp, Artificial
  CRISPR gRNA sequence
gtgaaaatagccctatggca

SEQ ID NO: 665798 - DNA, 20 bp, Artificial
  CRISPR gRNA sequence
tgaaaatagccctatggcac

SEQ ID NO: 665799 - DNA, 20 bp, Artificial
  CRISPR gRNA sequence
tggcacacaacctgagatct

SEQ ID NO: 665800 - DNA, 20 bp, Artificial
  CRISPR gRNA sequence
agatctgttttcaagttaac

SEQ ID NO: 665801 - DNA, 20 bp, Artificial
  CRISPR gRNA sequence
ttttcaagttaacatcttgt

SEQ ID NO: 665802 - DNA, 20 bp, Artificial
  CRISPR gRNA sequence
tcaagttaacatcttgtcat

SEQ ID NO: 665803 - DNA, 20 bp, Artificial
  CRISPR gRNA sequence
caagttaacatcttgtcatt

SEQ ID NO: 665804 - DNA, 20 bp, Artificial
  CRISPR gRNA sequence
aagttaacatcttgtcatta

SEQ ID NO: 665805 - DNA, 20 bp, Artificial
  CRISPR gRNA sequence
acatcttgtcattaatcaat

SEQ ID NO: 665806 - DNA, 20 bp, Artificial
  CRISPR gRNA sequence
gtcattaatcaatactgttt

SEQ ID NO: 665807 - DNA, 20 bp, Artificial
  CRISPR gRNA sequence
tcattaatcaatactgtttg

SEQ ID NO: 665808 - DNA, 20 bp, Artificial
  CRISPR gRNA sequence
atcaatactgtttgggtgtg

SEQ ID NO: 665809 - DNA, 20 bp, Artificial
  CRISPR gRNA sequence
tttgggtgtggttgttcaac

SEQ ID NO: 665810 - DNA, 20 bp, Artificial
  CRISPR gRNA sequence
gggtgtggttgttcaacctg

SEQ ID NO: 665811 - DNA, 20 bp, Artificial
  CRISPR gRNA sequence
ggtgtggttgttcaacctgt

SEQ ID NO: 665812 - DNA, 20 bp, Artificial
  CRISPR gRNA sequence
ttcaacctgttatgaatgta

SEQ ID NO: 665813 - DNA, 20 bp, Artificial
  CRISPR gRNA sequence
aacctgttatgaatgtacct

SEQ ID NO: 665814 - DNA, 20 bp, Artificial
  CRISPR gRNA sequence
ttatgaatgtacctctcata

SEQ ID NO: 665815 - DNA, 20 bp, Artificial
  CRISPR gRNA sequence
tgaatgtacctctcatatta

SEQ ID NO: 665816 - DNA, 20 bp, Artificial
  CRISPR gRNA sequence
tcatattatttcctacatat

SEQ ID NO: 665817 - DNA, 20 bp, Artificial
  CRISPR gRNA sequence
atattatttcctacatattt

SEQ ID NO: 665818 - DNA, 20 bp, Artificial
  CRISPR gRNA sequence
tttcctacatatttctccat

SEQ ID NO: 665819 - DNA, 20 bp, Artificial
  CRISPR gRNA sequence
cctacatatttctccatttc

SEQ ID NO: 665820 - DNA, 20 bp, Artificial
  CRISPR gRNA sequence
ctacatatttctccatttcg

SEQ ID NO: 665821 - DNA, 20 bp, Artificial
  CRISPR gRNA sequence
catatttctccatttcgacc

SEQ ID NO: 665822 - DNA, 20 bp, Artificial
  CRISPR gRNA sequence
ctccatttcgacctcaagaa

SEQ ID NO: 665823 - DNA, 20 bp, Artificial
  CRISPR gRNA sequence
tccatttcgacctcaagaac

SEQ ID NO: 665824 - DNA, 20 bp, Artificial
  CRISPR gRNA sequence
catttcgacctcaagaacat

SEQ ID NO: 665825 - DNA, 20 bp, Artificial
  CRISPR gRNA sequence
cgacctcaagaacattatga

SEQ ID NO: 665826 - DNA, 20 bp, Artificial
  CRISPR gRNA sequence
gacctcaagaacattatgag

SEQ ID NO: 665827 - DNA, 20 bp, Artificial
  CRISPR gRNA sequence
aagaacattatgagagcttt

SEQ ID NO: 665828 - DNA, 20 bp, Artificial
  CRISPR gRNA sequence
tgagagctttcttcagatat

SEQ ID NO: 665829 - DNA, 20 bp, Artificial
  CRISPR gRNA sequence
tcttcagatatggaattaag

SEQ ID NO: 665830 - DNA, 20 bp, Artificial
  CRISPR gRNA sequence
cttcagatatggaattaagt

SEQ ID NO: 665831 - DNA, 20 bp, Artificial
  CRISPR gRNA sequence
ttcagatatggaattaagtt

SEQ ID NO: 665832 - DNA, 20 bp, Artificial
  CRISPR gRNA sequence
cagatatggaattaagttca

SEQ ID NO: 665833 - DNA, 20 bp, Artificial
  CRISPR gRNA sequence
agatatggaattaagttcag

SEQ ID NO: 665834 - DNA, 20 bp, Artificial
  CRISPR gRNA sequence
agttcagaatgaacaaagtc

SEQ ID NO: 665835 - DNA, 20 bp, Artificial
  CRISPR gRNA sequence
agaatgaacaaagtccacat

SEQ ID NO: 665836 - DNA, 20 bp, Artificial
  CRISPR gRNA sequence
ttaaactaccagtttaataa

SEQ ID NO: 665837 - DNA, 20 bp, Artificial
  CRISPR gRNA sequence
taaactaccagtttaataat

SEQ ID NO: 665838 - DNA, 20 bp, Artificial
  CRISPR gRNA sequence
aaactaccagtttaataatt

SEQ ID NO: 665839 - DNA, 20 bp, Artificial
  CRISPR gRNA sequence
aactaccagtttaataattc

SEQ ID NO: 665840 - DNA, 20 bp, Artificial
  CRISPR gRNA sequence
ccagtttaataattccatca

SEQ ID NO: 665841 - DNA, 20 bp, Artificial
  CRISPR gRNA sequence
aataattccatcaacaataa

SEQ ID NO: 665842 - DNA, 20 bp, Artificial
  CRISPR gRNA sequence
ataattccatcaacaataaa

SEQ ID NO: 665843 - DNA, 20 bp, Artificial
  CRISPR gRNA sequence
catcaacaataaaaatatta

SEQ ID NO: 665844 - DNA, 20 bp, Artificial
  CRISPR gRNA sequence
tttttagtgaacccatattg

SEQ ID NO: 665845 - DNA, 20 bp, Artificial
  CRISPR gRNA sequence
ttagtgaacccatattggat

SEQ ID NO: 665846 - DNA, 20 bp, Artificial
  CRISPR gRNA sequence
tagtgaacccatattggatc

SEQ ID NO: 665847 - DNA, 20 bp, Artificial
  CRISPR gRNA sequence
agtgaacccatattggatca

SEQ ID NO: 665848 - DNA, 20 bp, Artificial
  CRISPR gRNA sequence
gtgaacccatattggatcat

SEQ ID NO: 665849 - DNA, 20 bp, Artificial
  CRISPR gRNA sequence
gatcatactttttaaaaagt

SEQ ID NO: 665850 - DNA, 20 bp, Artificial
  CRISPR gRNA sequence
tttaaaaagttgttacacaa

SEQ ID NO: 665851 - DNA, 20 bp, Artificial
  CRISPR gRNA sequence
ttaaaaagttgttacacaaa

SEQ ID NO: 665852 - DNA, 20 bp, Artificial
  CRISPR gRNA sequence
taaaaagttgttacacaaac

SEQ ID NO: 665853 - DNA, 20 bp, Artificial
  CRISPR gRNA sequence
aaaaagttgttacacaaaca

SEQ ID NO: 665854 - DNA, 20 bp, Artificial
  CRISPR gRNA sequence
aaaagttgttacacaaacac

SEQ ID NO: 665855 - DNA, 20 bp, Artificial
  CRISPR gRNA sequence
ttacacaaacacttaccttc

SEQ ID NO: 665856 - DNA, 20 bp, Artificial
  CRISPR gRNA sequence
cacaaacacttaccttccaa

SEQ ID NO: 665857 - DNA, 20 bp, Artificial
  CRISPR gRNA sequence
accttccaattttaattggt

SEQ ID NO: 665858 - DNA, 20 bp, Artificial
  CRISPR gRNA sequence
ccttccaattttaattggtt

SEQ ID NO: 665859 - DNA, 20 bp, Artificial
  CRISPR gRNA sequence
ccaattttaattggttcatt

SEQ ID NO: 665860 - DNA, 20 bp, Artificial
  CRISPR gRNA sequence
caattttaattggttcattg

SEQ ID NO: 665861 - DNA, 20 bp, Artificial
  CRISPR gRNA sequence
taattggttcattgtaagca

SEQ ID NO: 665862 - DNA, 20 bp, Artificial
  CRISPR gRNA sequence
aattggttcattgtaagcat

SEQ ID NO: 665863 - DNA, 20 bp, Artificial
  CRISPR gRNA sequence
attggttcattgtaagcata

SEQ ID NO: 665864 - DNA, 20 bp, Artificial
  CRISPR gRNA sequence
gttcattgtaagcatattta

SEQ ID NO: 665865 - DNA, 20 bp, Artificial
  CRISPR gRNA sequence
attgtaagcatatttatctt

SEQ ID NO: 665866 - DNA, 20 bp, Artificial
  CRISPR gRNA sequence
taagcatatttatcttagat

SEQ ID NO: 665867 - DNA, 20 bp, Artificial
  CRISPR gRNA sequence
atcttagattgacaaaattc

SEQ ID NO: 665868 - DNA, 20 bp, Artificial
  CRISPR gRNA sequence
tcttagattgacaaaattca

SEQ ID NO: 665869 - DNA, 20 bp, Artificial
  CRISPR gRNA sequence
agattgacaaaattcacatc

SEQ ID NO: 665870 - DNA, 20 bp, Artificial
  CRISPR gRNA sequence
gattgacaaaattcacatcc

SEQ ID NO: 665871 - DNA, 20 bp, Artificial
  CRISPR gRNA sequence
acaaaattcacatcctttgc

SEQ ID NO: 665872 - DNA, 20 bp, Artificial
  CRISPR gRNA sequence
acatcctttgcctttaaaaa

SEQ ID NO: 665873 - DNA, 20 bp, Artificial
  CRISPR gRNA sequence
tgcctttaaaaatcgtaaaa

SEQ ID NO: 665874 - DNA, 20 bp, Artificial
  CRISPR gRNA sequence
gcctttaaaaatcgtaaaat

SEQ ID NO: 665875 - DNA, 20 bp, Artificial
  CRISPR gRNA sequence
cctttaaaaatcgtaaaatt

SEQ ID NO: 665876 - DNA, 20 bp, Artificial
  CRISPR gRNA sequence
taaaaatcgtaaaattagcc

SEQ ID NO: 665877 - DNA, 20 bp, Artificial
  CRISPR gRNA sequence
aaaaatcgtaaaattagccc

SEQ ID NO: 665878 - DNA, 20 bp, Artificial
  CRISPR gRNA sequence
aaaatcgtaaaattagcccg

SEQ ID NO: 665879 - DNA, 20 bp, Artificial
  CRISPR gRNA sequence
gcccgtctctggtcctctgg

SEQ ID NO: 665880 - DNA, 20 bp, Artificial
  CRISPR gRNA sequence
tggtcctctggcacctttcc

SEQ ID NO: 665881 - DNA, 20 bp, Artificial
  CRISPR gRNA sequence
gtcctctggcacctttcctt

SEQ ID NO: 665882 - DNA, 20 bp, Artificial
  CRISPR gRNA sequence
tggcacctttcctttcctct

SEQ ID NO: 665883 - DNA, 20 bp, Artificial
  CRISPR gRNA sequence
gcacctttcctttcctctga

SEQ ID NO: 665884 - DNA, 20 bp, Artificial
  CRISPR gRNA sequence
tcctttcctctgaaggactt

SEQ ID NO: 665885 - DNA, 20 bp, Artificial
  CRISPR gRNA sequence
cctttcctctgaaggacttc

SEQ ID NO: 665886 - DNA, 20 bp, Artificial
  CRISPR gRNA sequence
ctttcctctgaaggacttca

SEQ ID NO: 665887 - DNA, 20 bp, Artificial
  CRISPR gRNA sequence
tcctctgaaggacttcaaaa

SEQ ID NO: 665888 - DNA, 20 bp, Artificial
  CRISPR gRNA sequence
cctctgaaggacttcaaaat

SEQ ID NO: 665889 - DNA, 20 bp, Artificial
  CRISPR gRNA sequence
ctctgaaggacttcaaaatg

SEQ ID NO: 665890 - DNA, 20 bp, Artificial
  CRISPR gRNA sequence
tgaaggacttcaaaatgttc

SEQ ID NO: 665891 - DNA, 20 bp, Artificial
  CRISPR gRNA sequence
aaggacttcaaaatgttctt

SEQ ID NO: 665892 - DNA, 20 bp, Artificial
  CRISPR gRNA sequence
caaaatgttcttgctgtagt

SEQ ID NO: 665893 - DNA, 20 bp, Artificial
  CRISPR gRNA sequence
aaaatgttcttgctgtagtg

SEQ ID NO: 665894 - DNA, 20 bp, Artificial
  CRISPR gRNA sequence
ttgctgtagtgtcccaatca

SEQ ID NO: 665895 - DNA, 20 bp, Artificial
  CRISPR gRNA sequence
gctgtagtgtcccaatcact

SEQ ID NO: 665896 - DNA, 20 bp, Artificial
  CRISPR gRNA sequence
ctgtagtgtcccaatcactt

SEQ ID NO: 665897 - DNA, 20 bp, Artificial
  CRISPR gRNA sequence
tagtgtcccaatcacttctg

SEQ ID NO: 665898 - DNA, 20 bp, Artificial
  CRISPR gRNA sequence
ctgcatctcctttctggttc

SEQ ID NO: 665899 - DNA, 20 bp, Artificial
  CRISPR gRNA sequence
tgcatctcctttctggttcc

SEQ ID NO: 665900 - DNA, 20 bp, Artificial
  CRISPR gRNA sequence
catctcctttctggttccta

SEQ ID NO: 665901 - DNA, 20 bp, Artificial
  CRISPR gRNA sequence
ctttctggttcctaaaatat

SEQ ID NO: 665902 - DNA, 20 bp, Artificial
  CRISPR gRNA sequence
tctggttcctaaaatatatc

SEQ ID NO: 665903 - DNA, 20 bp, Artificial
  CRISPR gRNA sequence
ctggttcctaaaatatatct

SEQ ID NO: 665904 - DNA, 20 bp, Artificial
  CRISPR gRNA sequence
tggttcctaaaatatatctc

SEQ ID NO: 665905 - DNA, 20 bp, Artificial
  CRISPR gRNA sequence
gttcctaaaatatatctcat

SEQ ID NO: 665906 - DNA, 20 bp, Artificial
  CRISPR gRNA sequence
ctaaaatatatctcatctga

SEQ ID NO: 665907 - DNA, 20 bp, Artificial
  CRISPR gRNA sequence
aaatatatctcatctgagcc

SEQ ID NO: 665908 - DNA, 20 bp, Artificial
  CRISPR gRNA sequence
atctgagcctgtattaattt

SEQ ID NO: 665909 - DNA, 20 bp, Artificial
  CRISPR gRNA sequence
agcctgtattaatttccttg

SEQ ID NO: 665910 - DNA, 20 bp, Artificial
  CRISPR gRNA sequence
tattaatttccttggtttgc

SEQ ID NO: 665911 - DNA, 20 bp, Artificial
  CRISPR gRNA sequence
atttccttggtttgctgtaa

SEQ ID NO: 665912 - DNA, 20 bp, Artificial
  CRISPR gRNA sequence
ccttggtttgctgtaacgaa

SEQ ID NO: 665913 - DNA, 20 bp, Artificial
  CRISPR gRNA sequence
cttggtttgctgtaacgaac

SEQ ID NO: 665914 - DNA, 20 bp, Artificial
  CRISPR gRNA sequence
ggtttgctgtaacgaactac

SEQ ID NO: 665915 - DNA, 20 bp, Artificial
  CRISPR gRNA sequence
gtttgctgtaacgaactacc

SEQ ID NO: 665916 - DNA, 20 bp, Artificial
  CRISPR gRNA sequence
gctgtaacgaactaccacag

SEQ ID NO: 665917 - DNA, 20 bp, Artificial
  CRISPR gRNA sequence
ctgtaacgaactaccacaga

SEQ ID NO: 665918 - DNA, 20 bp, Artificial
  CRISPR gRNA sequence
taacgaactaccacagactg

SEQ ID NO: 665919 - DNA, 20 bp, Artificial
  CRISPR gRNA sequence
ccacagactgggtggcttaa

SEQ ID NO: 665920 - DNA, 20 bp, Artificial
  CRISPR gRNA sequence
ggtggcttaaacaacagaag

SEQ ID NO: 665921 - DNA, 20 bp, Artificial
  CRISPR gRNA sequence
aaacaacagaagtttattgc

SEQ ID NO: 665922 - DNA, 20 bp, Artificial
  CRISPR gRNA sequence
aacaacagaagtttattgcc

SEQ ID NO: 665923 - DNA, 20 bp, Artificial
  CRISPR gRNA sequence
attgcctcacagttctggag

SEQ ID NO: 665924 - DNA, 20 bp, Artificial
  CRISPR gRNA sequence
ttgcctcacagttctggagg

SEQ ID NO: 665925 - DNA, 20 bp, Artificial
  CRISPR gRNA sequence
cctcacagttctggaggctg

SEQ ID NO: 665926 - DNA, 20 bp, Artificial
  CRISPR gRNA sequence
acagttctggaggctggaag

SEQ ID NO: 665927 - DNA, 20 bp, Artificial
  CRISPR gRNA sequence
tggaggctggaagtctgaga

SEQ ID NO: 665928 - DNA, 20 bp, Artificial
  CRISPR gRNA sequence
gaggctggaagtctgagatt

SEQ ID NO: 665929 - DNA, 20 bp, Artificial
  CRISPR gRNA sequence
gaagtctgagattaaggtgt

SEQ ID NO: 665930 - DNA, 20 bp, Artificial
  CRISPR gRNA sequence
agattaaggtgtaagcagta

SEQ ID NO: 665931 - DNA, 20 bp, Artificial
  CRISPR gRNA sequence
aggtgtaagcagtattggtt

SEQ ID NO: 665932 - DNA, 20 bp, Artificial
  CRISPR gRNA sequence
gtttcatgtgagggctgtga

SEQ ID NO: 665933 - DNA, 20 bp, Artificial
  CRISPR gRNA sequence
catgtgagggctgtgaggga

SEQ ID NO: 665934 - DNA, 20 bp, Artificial
  CRISPR gRNA sequence
atgtgagggctgtgagggag

SEQ ID NO: 665935 - DNA, 20 bp, Artificial
  CRISPR gRNA sequence
tgagggagaatctgctatgt

SEQ ID NO: 665936 - DNA, 20 bp, Artificial
  CRISPR gRNA sequence
ctatgtccctctcccctggc

SEQ ID NO: 665937 - DNA, 20 bp, Artificial
  CRISPR gRNA sequence
tgtccctctcccctggctgc

SEQ ID NO: 665938 - DNA, 20 bp, Artificial
  CRISPR gRNA sequence
tcccctggctgctgatggct

SEQ ID NO: 665939 - DNA, 20 bp, Artificial
  CRISPR gRNA sequence
ccctggctgctgatggctgc

SEQ ID NO: 665940 - DNA, 20 bp, Artificial
  CRISPR gRNA sequence
gctgctgatggctgctgata

SEQ ID NO: 665941 - DNA, 20 bp, Artificial
  CRISPR gRNA sequence
ctgatggctgctgatattcc

SEQ ID NO: 665942 - DNA, 20 bp, Artificial
  CRISPR gRNA sequence
atggctgctgatattccttg

SEQ ID NO: 665943 - DNA, 20 bp, Artificial
  CRISPR gRNA sequence
ctgatattccttggtgttcc

SEQ ID NO: 665944 - DNA, 20 bp, Artificial
  CRISPR gRNA sequence
atattccttggtgttcctgg

SEQ ID NO: 665945 - DNA, 20 bp, Artificial
  CRISPR gRNA sequence
cttggtgttcctggcttata

SEQ ID NO: 665946 - DNA, 20 bp, Artificial
  CRISPR gRNA sequence
ggtgttcctggcttatatct

SEQ ID NO: 665947 - DNA, 20 bp, Artificial
  CRISPR gRNA sequence
gtgttcctggcttatatctg

SEQ ID NO: 665948 - DNA, 20 bp, Artificial
  CRISPR gRNA sequence
ctggcttatatctgcatcac

SEQ ID NO: 665949 - DNA, 20 bp, Artificial
  CRISPR gRNA sequence
gcttatatctgcatcaccct

SEQ ID NO: 665950 - DNA, 20 bp, Artificial
  CRISPR gRNA sequence
atatctgcatcaccctcatc

SEQ ID NO: 665951 - DNA, 20 bp, Artificial
  CRISPR gRNA sequence
tatctgcatcaccctcatct

SEQ ID NO: 665952 - DNA, 20 bp, Artificial
  CRISPR gRNA sequence
catcaccctcatctttgcct

SEQ ID NO: 665953 - DNA, 20 bp, Artificial
  CRISPR gRNA sequence
atctttgccttcatgttcac

SEQ ID NO: 665954 - DNA, 20 bp, Artificial
  CRISPR gRNA sequence
tgccttcatgttcacagcat

SEQ ID NO: 665955 - DNA, 20 bp, Artificial
  CRISPR gRNA sequence
gccttcatgttcacagcatt

SEQ ID NO: 665956 - DNA, 20 bp, Artificial
  CRISPR gRNA sequence
ccttcatgttcacagcattc

SEQ ID NO: 665957 - DNA, 20 bp, Artificial
  CRISPR gRNA sequence
catgttcacagcattcaccc

SEQ ID NO: 665958 - DNA, 20 bp, Artificial
  CRISPR gRNA sequence
atgttcacagcattcacccc

SEQ ID NO: 665959 - DNA, 20 bp, Artificial
  CRISPR gRNA sequence
acagcattcaccccatatgc

SEQ ID NO: 665960 - DNA, 20 bp, Artificial
  CRISPR gRNA sequence
accccatatgcatgtctctg

SEQ ID NO: 665961 - DNA, 20 bp, Artificial
  CRISPR gRNA sequence
tgtctaaactttcccttttt

SEQ ID NO: 665962 - DNA, 20 bp, Artificial
  CRISPR gRNA sequence
tctaaactttccctttttgt

SEQ ID NO: 665963 - DNA, 20 bp, Artificial
  CRISPR gRNA sequence
aactttccctttttgtaagg

SEQ ID NO: 665964 - DNA, 20 bp, Artificial
  CRISPR gRNA sequence
tccctttttgtaaggacacc

SEQ ID NO: 665965 - DNA, 20 bp, Artificial
  CRISPR gRNA sequence
ccctttttgtaaggacacca

SEQ ID NO: 665966 - DNA, 20 bp, Artificial
  CRISPR gRNA sequence
cctttttgtaaggacaccag

SEQ ID NO: 665967 - DNA, 20 bp, Artificial
  CRISPR gRNA sequence
tttgtaaggacaccagtcac

SEQ ID NO: 665968 - DNA, 20 bp, Artificial
  CRISPR gRNA sequence
ttgtaaggacaccagtcaca

SEQ ID NO: 665969 - DNA, 20 bp, Artificial
  CRISPR gRNA sequence
tgtaaggacaccagtcacaa

SEQ ID NO: 665970 - DNA, 20 bp, Artificial
  CRISPR gRNA sequence
gtaaggacaccagtcacaat

SEQ ID NO: 665971 - DNA, 20 bp, Artificial
  CRISPR gRNA sequence
taaggacaccagtcacaata

SEQ ID NO: 665972 - DNA, 20 bp, Artificial
  CRISPR gRNA sequence
agggctcaccctactctagt

SEQ ID NO: 665973 - DNA, 20 bp, Artificial
  CRISPR gRNA sequence
accctactctagtacgactt

SEQ ID NO: 665974 - DNA, 20 bp, Artificial
  CRISPR gRNA sequence
ctctagtacgacttcatctt

SEQ ID NO: 665975 - DNA, 20 bp, Artificial
  CRISPR gRNA sequence
tagtacgacttcatcttacc

SEQ ID NO: 665976 - DNA, 20 bp, Artificial
  CRISPR gRNA sequence
gtacgacttcatcttacctt

SEQ ID NO: 665977 - DNA, 20 bp, Artificial
  CRISPR gRNA sequence
catcttaccttaattcatta

SEQ ID NO: 665978 - DNA, 20 bp, Artificial
  CRISPR gRNA sequence
atcttaccttaattcattac

SEQ ID NO: 665979 - DNA, 20 bp, Artificial
  CRISPR gRNA sequence
accttaattcattacatctg

SEQ ID NO: 665980 - DNA, 20 bp, Artificial
  CRISPR gRNA sequence
ccttaattcattacatctgc

SEQ ID NO: 665981 - DNA, 20 bp, Artificial
  CRISPR gRNA sequence
aattcattacatctgcaatt

SEQ ID NO: 665982 - DNA, 20 bp, Artificial
  CRISPR gRNA sequence
attcattacatctgcaattt

SEQ ID NO: 665983 - DNA, 20 bp, Artificial
  CRISPR gRNA sequence
attacatctgcaatttttaa

SEQ ID NO: 665984 - DNA, 20 bp, Artificial
  CRISPR gRNA sequence
catctgcaatttttaaagaa

SEQ ID NO: 665985 - DNA, 20 bp, Artificial
  CRISPR gRNA sequence
caatttttaaagaaacttag

SEQ ID NO: 665986 - DNA, 20 bp, Artificial
  CRISPR gRNA sequence
ttaaagaaacttagttttta

SEQ ID NO: 665987 - DNA, 20 bp, Artificial
  CRISPR gRNA sequence
taaagaaacttagtttttaa

SEQ ID NO: 665988 - DNA, 20 bp, Artificial
  CRISPR gRNA sequence
aaagaaacttagtttttaaa

SEQ ID NO: 665989 - DNA, 20 bp, Artificial
  CRISPR gRNA sequence
aagaaacttagtttttaaat

SEQ ID NO: 665990 - DNA, 20 bp, Artificial
  CRISPR gRNA sequence
agtttttaaattggcttgtt

SEQ ID NO: 665991 - DNA, 20 bp, Artificial
  CRISPR gRNA sequence
gtttttaaattggcttgttt

SEQ ID NO: 665992 - DNA, 20 bp, Artificial
  CRISPR gRNA sequence
ttaaattggcttgttttttg

SEQ ID NO: 665993 - DNA, 20 bp, Artificial
  CRISPR gRNA sequence
taaattggcttgttttttgg

SEQ ID NO: 665994 - DNA, 20 bp, Artificial
  CRISPR gRNA sequence
aaattggcttgttttttggt

SEQ ID NO: 665995 - DNA, 20 bp, Artificial
  CRISPR gRNA sequence
aattggcttgttttttggtg

SEQ ID NO: 665996 - DNA, 20 bp, Artificial
  CRISPR gRNA sequence
gcttgttttttggtgaaaag

SEQ ID NO: 665997 - DNA, 20 bp, Artificial
  CRISPR gRNA sequence
gttttttggtgaaaagagta

SEQ ID NO: 665998 - DNA, 20 bp, Artificial
  CRISPR gRNA sequence
ttttttggtgaaaagagtat

SEQ ID NO: 665999 - DNA, 20 bp, Artificial
  CRISPR gRNA sequence
tttggtgaaaagagtatgat

SEQ ID NO: 666000 - DNA, 20 bp, Artificial
  CRISPR gRNA sequence
ttggtgaaaagagtatgata

SEQ ID NO: 666001 - DNA, 20 bp, Artificial
  CRISPR gRNA sequence
tggtgaaaagagtatgatat

SEQ ID NO: 666002 - DNA, 20 bp, Artificial
  CRISPR gRNA sequence
ggtgaaaagagtatgatata

SEQ ID NO: 666003 - DNA, 20 bp, Artificial
  CRISPR gRNA sequence
gtgaaaagagtatgatataa

SEQ ID NO: 666004 - DNA, 20 bp, Artificial
  CRISPR gRNA sequence
tattgtataattgtcttctg

SEQ ID NO: 666005 - DNA, 20 bp, Artificial
  CRISPR gRNA sequence
attgtataattgtcttctgt

SEQ ID NO: 666006 - DNA, 20 bp, Artificial
  CRISPR gRNA sequence
ttgtataattgtcttctgtc

SEQ ID NO: 666007 - DNA, 20 bp, Artificial
  CRISPR gRNA sequence
tataattgtcttctgtctgt

SEQ ID NO: 666008 - DNA, 20 bp, Artificial
  CRISPR gRNA sequence
tcttctgtctgtgtatagcc

SEQ ID NO: 666009 - DNA, 20 bp, Artificial
  CRISPR gRNA sequence
ctgtctgtgtatagccaaag

SEQ ID NO: 666010 - DNA, 20 bp, Artificial
  CRISPR gRNA sequence
tgtctgtgtatagccaaagc

SEQ ID NO: 666011 - DNA, 20 bp, Artificial
  CRISPR gRNA sequence
tctgtgtatagccaaagcat

SEQ ID NO: 666012 - DNA, 20 bp, Artificial
  CRISPR gRNA sequence
tgtatagccaaagcatcaaa

SEQ ID NO: 666013 - DNA, 20 bp, Artificial
  CRISPR gRNA sequence
gagttagtgacagaaaagac

SEQ ID NO: 666014 - DNA, 20 bp, Artificial
  CRISPR gRNA sequence
gtgacagaaaagaccatgtt

SEQ ID NO: 666015 - DNA, 20 bp, Artificial
  CRISPR gRNA sequence
gtttagtctcctttagaaat

SEQ ID NO: 666016 - DNA, 20 bp, Artificial
  CRISPR gRNA sequence
tttagtctcctttagaaatg

SEQ ID NO: 666017 - DNA, 20 bp, Artificial
  CRISPR gRNA sequence
agtctcctttagaaatgtta

SEQ ID NO: 666018 - DNA, 20 bp, Artificial
  CRISPR gRNA sequence
gtctcctttagaaatgttag

SEQ ID NO: 666019 - DNA, 20 bp, Artificial
  CRISPR gRNA sequence
ctttagaaatgttagaggaa

SEQ ID NO: 666020 - DNA, 20 bp, Artificial
  CRISPR gRNA sequence
tagaaatgttagaggaaaag

SEQ ID NO: 666021 - DNA, 20 bp, Artificial
  CRISPR gRNA sequence
agaaatgttagaggaaaaga

SEQ ID NO: 666022 - DNA, 20 bp, Artificial
  CRISPR gRNA sequence
gaaatgttagaggaaaagaa

SEQ ID NO: 666023 - DNA, 20 bp, Artificial
  CRISPR gRNA sequence
gaggaaaagaaaaaaaattg

SEQ ID NO: 666024 - DNA, 20 bp, Artificial
  CRISPR gRNA sequence
gacttaacctaaaggcagaa

SEQ ID NO: 666025 - DNA, 20 bp, Artificial
  CRISPR gRNA sequence
aacctaaaggcagaaccaag

SEQ ID NO: 666026 - DNA, 20 bp, Artificial
  CRISPR gRNA sequence
acctaaaggcagaaccaaga

SEQ ID NO: 666027 - DNA, 20 bp, Artificial
  CRISPR gRNA sequence
aaggcagaaccaagatgttt

SEQ ID NO: 666028 - DNA, 20 bp, Artificial
  CRISPR gRNA sequence
acagaccttaccagccttga

SEQ ID NO: 666029 - DNA, 20 bp, Artificial
  CRISPR gRNA sequence
cagaccttaccagccttgac

SEQ ID NO: 666030 - DNA, 20 bp, Artificial
  CRISPR gRNA sequence
accagccttgacttctgcat

SEQ ID NO: 666031 - DNA, 20 bp, Artificial
  CRISPR gRNA sequence
ccagccttgacttctgcata

SEQ ID NO: 666032 - DNA, 20 bp, Artificial
  CRISPR gRNA sequence
gacttctgcataaagacaca

SEQ ID NO: 666033 - DNA, 20 bp, Artificial
  CRISPR gRNA sequence
acttctgcataaagacacat

SEQ ID NO: 666034 - DNA, 20 bp, Artificial
  CRISPR gRNA sequence
ctgcataaagacacatatac

SEQ ID NO: 666035 - DNA, 20 bp, Artificial
  CRISPR gRNA sequence
tgcataaagacacatatact

SEQ ID NO: 666036 - DNA, 20 bp, Artificial
  CRISPR gRNA sequence
cataaagacacatatacttt

SEQ ID NO: 666037 - DNA, 20 bp, Artificial
  CRISPR gRNA sequence
tagtgagcagattgagatag

SEQ ID NO: 666038 - DNA, 20 bp, Artificial
  CRISPR gRNA sequence
agtgagcagattgagatagt

SEQ ID NO: 666039 - DNA, 20 bp, Artificial
  CRISPR gRNA sequence
gtgagcagattgagatagtt

SEQ ID NO: 666040 - DNA, 20 bp, Artificial
  CRISPR gRNA sequence
agatagttctgactctctac

SEQ ID NO: 666041 - DNA, 20 bp, Artificial
  CRISPR gRNA sequence
tgactctctactactggccg

SEQ ID NO: 666042 - DNA, 20 bp, Artificial
  CRISPR gRNA sequence
actctctactactggccgca

SEQ ID NO: 666043 - DNA, 20 bp, Artificial
  CRISPR gRNA sequence
tctactactggccgcactgg

SEQ ID NO: 666044 - DNA, 20 bp, Artificial
  CRISPR gRNA sequence
tactactggccgcactggcc

SEQ ID NO: 666045 - DNA, 20 bp, Artificial
  CRISPR gRNA sequence
ctactggccgcactggcctg

SEQ ID NO: 666046 - DNA, 20 bp, Artificial
  CRISPR gRNA sequence
ctggccgcactggcctgatt

SEQ ID NO: 666047 - DNA, 20 bp, Artificial
  CRISPR gRNA sequence
gccgcactggcctgattcat

SEQ ID NO: 666048 - DNA, 20 bp, Artificial
  CRISPR gRNA sequence
gcctgattcatataaattca

SEQ ID NO: 666049 - DNA, 20 bp, Artificial
  CRISPR gRNA sequence
attcatataaattcaccttc

SEQ ID NO: 666050 - DNA, 20 bp, Artificial
  CRISPR gRNA sequence
atataaattcaccttcttca

SEQ ID NO: 666051 - DNA, 20 bp, Artificial
  CRISPR gRNA sequence
accttcttcaccatgtacct

SEQ ID NO: 666052 - DNA, 20 bp, Artificial
  CRISPR gRNA sequence
cttcaccatgtacctgtgac

SEQ ID NO: 666053 - DNA, 20 bp, Artificial
  CRISPR gRNA sequence
ttcaccatgtacctgtgacc

SEQ ID NO: 666054 - DNA, 20 bp, Artificial
  CRISPR gRNA sequence
caccatgtacctgtgaccct

SEQ ID NO: 666055 - DNA, 20 bp, Artificial
  CRISPR gRNA sequence
accatgtacctgtgaccctc

SEQ ID NO: 666056 - DNA, 20 bp, Artificial
  CRISPR gRNA sequence
tgaccctctaggaatccact

SEQ ID NO: 666057 - DNA, 20 bp, Artificial
  CRISPR gRNA sequence
taggaatccactgtcacctc

SEQ ID NO: 666058 - DNA, 20 bp, Artificial
  CRISPR gRNA sequence
ggaatccactgtcacctcac

SEQ ID NO: 666059 - DNA, 20 bp, Artificial
  CRISPR gRNA sequence
tcacctcacatatgtccaga

SEQ ID NO: 666060 - DNA, 20 bp, Artificial
  CRISPR gRNA sequence
acatatgtccagaaaccatt

SEQ ID NO: 666061 - DNA, 20 bp, Artificial
  CRISPR gRNA sequence
tctcagctgtcactaacaca

SEQ ID NO: 666062 - DNA, 20 bp, Artificial
  CRISPR gRNA sequence
tcagctgtcactaacacaca

SEQ ID NO: 666063 - DNA, 20 bp, Artificial
  CRISPR gRNA sequence
agctgtcactaacacacact

SEQ ID NO: 666064 - DNA, 20 bp, Artificial
  CRISPR gRNA sequence
tcactaacacacactgccca

SEQ ID NO: 666065 - DNA, 20 bp, Artificial
  CRISPR gRNA sequence
acacacactgcccacatttc

SEQ ID NO: 666066 - DNA, 20 bp, Artificial
  CRISPR gRNA sequence
cccacatttctcccctagtt

SEQ ID NO: 666067 - DNA, 20 bp, Artificial
  CRISPR gRNA sequence
ctcccctagttcccaaatgt

SEQ ID NO: 666068 - DNA, 20 bp, Artificial
  CRISPR gRNA sequence
tcccctagttcccaaatgtt

SEQ ID NO: 666069 - DNA, 20 bp, Artificial
  CRISPR gRNA sequence
ccctagttcccaaatgtttg

SEQ ID NO: 666070 - DNA, 20 bp, Artificial
  CRISPR gRNA sequence
gttcccaaatgtttgcatcc

SEQ ID NO: 666071 - DNA, 20 bp, Artificial
  CRISPR gRNA sequence
ccaaatgtttgcatccacag

SEQ ID NO: 666072 - DNA, 20 bp, Artificial
  CRISPR gRNA sequence
gcatccacagctcaggaggt

SEQ ID NO: 666073 - DNA, 20 bp, Artificial
  CRISPR gRNA sequence
catccacagctcaggaggtc

SEQ ID NO: 666074 - DNA, 20 bp, Artificial
  CRISPR gRNA sequence
aggaggtccattggcaaaga

SEQ ID NO: 666075 - DNA, 20 bp, Artificial
  CRISPR gRNA sequence
gcaaagaccctttgttgtta

SEQ ID NO: 666076 - DNA, 20 bp, Artificial
  CRISPR gRNA sequence
tgttgttacttcctatcagg

SEQ ID NO: 666077 - DNA, 20 bp, Artificial
  CRISPR gRNA sequence
gttgttacttcctatcagga

SEQ ID NO: 666078 - DNA, 20 bp, Artificial
  CRISPR gRNA sequence
ttgttacttcctatcaggag

SEQ ID NO: 666079 - DNA, 20 bp, Artificial
  CRISPR gRNA sequence
ttacttcctatcaggagaaa

SEQ ID NO: 666080 - DNA, 20 bp, Artificial
  CRISPR gRNA sequence
cttcctatcaggagaaaatc

SEQ ID NO: 666081 - DNA, 20 bp, Artificial
  CRISPR gRNA sequence
cctatcaggagaaaatcagt

SEQ ID NO: 666082 - DNA, 20 bp, Artificial
  CRISPR gRNA sequence
ctatcaggagaaaatcagtg

SEQ ID NO: 666083 - DNA, 20 bp, Artificial
  CRISPR gRNA sequence
tcaggagaaaatcagtgctt

SEQ ID NO: 666084 - DNA, 20 bp, Artificial
  CRISPR gRNA sequence
gagtcaaggatgcttctggg

SEQ ID NO: 666085 - DNA, 20 bp, Artificial
  CRISPR gRNA sequence
agtcaaggatgcttctgggt

SEQ ID NO: 666086 - DNA, 20 bp, Artificial
  CRISPR gRNA sequence
ctgggtgttttggcaggagg

SEQ ID NO: 666087 - DNA, 20 bp, Artificial
  CRISPR gRNA sequence
tgggtgttttggcaggaggt

SEQ ID NO: 666088 - DNA, 20 bp, Artificial
  CRISPR gRNA sequence
ggtgttttggcaggaggtct

SEQ ID NO: 666089 - DNA, 20 bp, Artificial
  CRISPR gRNA sequence
tggcaggaggtctctcccca

SEQ ID NO: 666090 - DNA, 20 bp, Artificial
  CRISPR gRNA sequence
ggcaggaggtctctccccag

SEQ ID NO: 666091 - DNA, 20 bp, Artificial
  CRISPR gRNA sequence
gcaggaggtctctccccagc

SEQ ID NO: 666092 - DNA, 20 bp, Artificial
  CRISPR gRNA sequence
tccccagctgtgagtgatat

SEQ ID NO: 666093 - DNA, 20 bp, Artificial
  CRISPR gRNA sequence
cccagctgtgagtgatattg

SEQ ID NO: 666094 - DNA, 20 bp, Artificial
  CRISPR gRNA sequence
tgagtgatattgtattgtct

SEQ ID NO: 666095 - DNA, 20 bp, Artificial
  CRISPR gRNA sequence
tattgtctgggccttaaaga

SEQ ID NO: 666096 - DNA, 20 bp, Artificial
  CRISPR gRNA sequence
tctgggccttaaagaagctc

SEQ ID NO: 666097 - DNA, 20 bp, Artificial
  CRISPR gRNA sequence
ggccttaaagaagctctgct

SEQ ID NO: 666098 - DNA, 20 bp, Artificial
  CRISPR gRNA sequence
aaagaagctctgctagtgcc

SEQ ID NO: 666099 - DNA, 20 bp, Artificial
  CRISPR gRNA sequence
aagaagctctgctagtgccc

SEQ ID NO: 666100 - DNA, 20 bp, Artificial
  CRISPR gRNA sequence
tgctagtgcccagagtatca

SEQ ID NO: 666101 - DNA, 20 bp, Artificial
  CRISPR gRNA sequence
ctagtgcccagagtatcagg

SEQ ID NO: 666102 - DNA, 20 bp, Artificial
  CRISPR gRNA sequence
gtgcccagagtatcaggaag

SEQ ID NO: 666103 - DNA, 20 bp, Artificial
  CRISPR gRNA sequence
ttgatcaatttctggtcata

SEQ ID NO: 666104 - DNA, 20 bp, Artificial
  CRISPR gRNA sequence
gatcaatttctggtcataat

SEQ ID NO: 666105 - DNA, 20 bp, Artificial
  CRISPR gRNA sequence
atcaatttctggtcataatc

SEQ ID NO: 666106 - DNA, 20 bp, Artificial
  CRISPR gRNA sequence
ctggtcataatcttttttcc

SEQ ID NO: 666107 - DNA, 20 bp, Artificial
  CRISPR gRNA sequence
tggtcataatcttttttcca

SEQ ID NO: 666108 - DNA, 20 bp, Artificial
  CRISPR gRNA sequence
gtcataatcttttttccaga

SEQ ID NO: 666109 - DNA, 20 bp, Artificial
  CRISPR gRNA sequence
ttttccagaatttcatttca

SEQ ID NO: 666110 - DNA, 20 bp, Artificial
  CRISPR gRNA sequence
tttccagaatttcatttcag

SEQ ID NO: 666111 - DNA, 20 bp, Artificial
  CRISPR gRNA sequence
ttccagaatttcatttcagt

SEQ ID NO: 666112 - DNA, 20 bp, Artificial
  CRISPR gRNA sequence
tccagaatttcatttcagtt

SEQ ID NO: 666113 - DNA, 20 bp, Artificial
  CRISPR gRNA sequence
ccagaatttcatttcagttc

SEQ ID NO: 666114 - DNA, 20 bp, Artificial
  CRISPR gRNA sequence
cagaatttcatttcagttcc

SEQ ID NO: 666115 - DNA, 20 bp, Artificial
  CRISPR gRNA sequence
catttcagttccatcatttt

SEQ ID NO: 666116 - DNA, 20 bp, Artificial
  CRISPR gRNA sequence
atttcagttccatcattttt

SEQ ID NO: 666117 - DNA, 20 bp, Artificial
  CRISPR gRNA sequence
cagttccatcattttttggc

SEQ ID NO: 666118 - DNA, 20 bp, Artificial
  CRISPR gRNA sequence
agttccatcattttttggct

SEQ ID NO: 666119 - DNA, 20 bp, Artificial
  CRISPR gRNA sequence
catcattttttggctgtcat

SEQ ID NO: 666120 - DNA, 20 bp, Artificial
  CRISPR gRNA sequence
tttggctgtcattcctttac

SEQ ID NO: 666121 - DNA, 20 bp, Artificial
  CRISPR gRNA sequence
ttggctgtcattcctttact

SEQ ID NO: 666122 - DNA, 20 bp, Artificial
  CRISPR gRNA sequence
tggctgtcattcctttactg

SEQ ID NO: 666123 - DNA, 20 bp, Artificial
  CRISPR gRNA sequence
ggctgtcattcctttactgt

SEQ ID NO: 666124 - DNA, 20 bp, Artificial
  CRISPR gRNA sequence
gctgtcattcctttactgta

SEQ ID NO: 666125 - DNA, 20 bp, Artificial
  CRISPR gRNA sequence
tcattcctttactgtaagca

SEQ ID NO: 666126 - DNA, 20 bp, Artificial
  CRISPR gRNA sequence
ctttactgtaagcatttaat

SEQ ID NO: 666127 - DNA, 20 bp, Artificial
  CRISPR gRNA sequence
tactgtaagcatttaatctc

SEQ ID NO: 666128 - DNA, 20 bp, Artificial
  CRISPR gRNA sequence
actgtaagcatttaatctca

SEQ ID NO: 666129 - DNA, 20 bp, Artificial
  CRISPR gRNA sequence
ctgtaagcatttaatctcag

SEQ ID NO: 666130 - DNA, 20 bp, Artificial
  CRISPR gRNA sequence
taagcatttaatctcaggca

SEQ ID NO: 666131 - DNA, 20 bp, Artificial
  CRISPR gRNA sequence
aatctcaggcaaggagtcca

SEQ ID NO: 666132 - DNA, 20 bp, Artificial
  CRISPR gRNA sequence
atctcaggcaaggagtccaa

SEQ ID NO: 666133 - DNA, 20 bp, Artificial
  CRISPR gRNA sequence
aggcaaggagtccaatgaag

SEQ ID NO: 666134 - DNA, 20 bp, Artificial
  CRISPR gRNA sequence
ggctctacttttttctctat

SEQ ID NO: 666135 - DNA, 20 bp, Artificial
  CRISPR gRNA sequence
tacttttttctctatactta

SEQ ID NO: 666136 - DNA, 20 bp, Artificial
  CRISPR gRNA sequence
cttttttctctatacttacc

SEQ ID NO: 666137 - DNA, 20 bp, Artificial
  CRISPR gRNA sequence
ttttctctatacttaccttt

SEQ ID NO: 666138 - DNA, 20 bp, Artificial
  CRISPR gRNA sequence
tttctctatacttacctttt

SEQ ID NO: 666139 - DNA, 20 bp, Artificial
  CRISPR gRNA sequence
ttctctatacttacctttta

SEQ ID NO: 666140 - DNA, 20 bp, Artificial
  CRISPR gRNA sequence
tctctatacttaccttttac

SEQ ID NO: 666141 - DNA, 20 bp, Artificial
  CRISPR gRNA sequence
ctctatacttaccttttact

SEQ ID NO: 666142 - DNA, 20 bp, Artificial
  CRISPR gRNA sequence
tctatacttaccttttacta

SEQ ID NO: 666143 - DNA, 20 bp, Artificial
  CRISPR gRNA sequence
tatacttaccttttactaac

SEQ ID NO: 666144 - DNA, 20 bp, Artificial
  CRISPR gRNA sequence
tacttaccttttactaaccc

SEQ ID NO: 666145 - DNA, 20 bp, Artificial
  CRISPR gRNA sequence
accttttactaacccttctc

SEQ ID NO: 666146 - DNA, 20 bp, Artificial
  CRISPR gRNA sequence
ccttttactaacccttctcc

SEQ ID NO: 666147 - DNA, 20 bp, Artificial
  CRISPR gRNA sequence
ttactaacccttctccccct

SEQ ID NO: 666148 - DNA, 20 bp, Artificial
  CRISPR gRNA sequence
tactaacccttctccccctt

SEQ ID NO: 666149 - DNA, 20 bp, Artificial
  CRISPR gRNA sequence
actaacccttctccccctta

SEQ ID NO: 666150 - DNA, 20 bp, Artificial
  CRISPR gRNA sequence
ctaacccttctcccccttac

SEQ ID NO: 666151 - DNA, 20 bp, Artificial
  CRISPR gRNA sequence
acccttctcccccttacaga

SEQ ID NO: 666152 - DNA, 20 bp, Artificial
  CRISPR gRNA sequence
ctcccccttacagaattctc

SEQ ID NO: 666153 - DNA, 20 bp, Artificial
  CRISPR gRNA sequence
tcccccttacagaattctcc

SEQ ID NO: 666154 - DNA, 20 bp, Artificial
  CRISPR gRNA sequence
ccccttacagaattctccca

SEQ ID NO: 666155 - DNA, 20 bp, Artificial
  CRISPR gRNA sequence
acagaattctcccaatttcc

SEQ ID NO: 666156 - DNA, 20 bp, Artificial
  CRISPR gRNA sequence
cagaattctcccaatttcct

SEQ ID NO: 666157 - DNA, 20 bp, Artificial
  CRISPR gRNA sequence
tcccaatttcctcctccttc

SEQ ID NO: 666158 - DNA, 20 bp, Artificial
  CRISPR gRNA sequence
ccaatttcctcctccttctc

SEQ ID NO: 666159 - DNA, 20 bp, Artificial
  CRISPR gRNA sequence
cctcctccttctccccgtaa

SEQ ID NO: 666160 - DNA, 20 bp, Artificial
  CRISPR gRNA sequence
ctcctccttctccccgtaac

SEQ ID NO: 666161 - DNA, 20 bp, Artificial
  CRISPR gRNA sequence
ctccttctccccgtaacaga

SEQ ID NO: 666162 - DNA, 20 bp, Artificial
  CRISPR gRNA sequence
cttctccccgtaacagaata

SEQ ID NO: 666163 - DNA, 20 bp, Artificial
  CRISPR gRNA sequence
ctccccgtaacagaataagg

SEQ ID NO: 666164 - DNA, 20 bp, Artificial
  CRISPR gRNA sequence
tccccgtaacagaataaggg

SEQ ID NO: 666165 - DNA, 20 bp, Artificial
  CRISPR gRNA sequence
cccgtaacagaataagggtt

SEQ ID NO: 666166 - DNA, 20 bp, Artificial
  CRISPR gRNA sequence
ccatgcatgtacatggttac

SEQ ID NO: 666167 - DNA, 20 bp, Artificial
  CRISPR gRNA sequence
caaaccagattgggcctgga

SEQ ID NO: 666168 - DNA, 20 bp, Artificial
  CRISPR gRNA sequence
ggcctggagagtggaggtta

SEQ ID NO: 666169 - DNA, 20 bp, Artificial
  CRISPR gRNA sequence
gagagtggaggttaaatttt

SEQ ID NO: 666170 - DNA, 20 bp, Artificial
  CRISPR gRNA sequence
aatttttggcccatgatctg

SEQ ID NO: 666171 - DNA, 20 bp, Artificial
  CRISPR gRNA sequence
ttggcccatgatctgtcagc

SEQ ID NO: 666172 - DNA, 20 bp, Artificial
  CRISPR gRNA sequence
tggcccatgatctgtcagcc

SEQ ID NO: 666173 - DNA, 20 bp, Artificial
  CRISPR gRNA sequence
ggcccatgatctgtcagcca

SEQ ID NO: 666174 - DNA, 20 bp, Artificial
  CRISPR gRNA sequence
gcccatgatctgtcagccaa

SEQ ID NO: 666175 - DNA, 20 bp, Artificial
  CRISPR gRNA sequence
tcagccaaaaatgttctatt

SEQ ID NO: 666176 - DNA, 20 bp, Artificial
  CRISPR gRNA sequence
tattacaaaagcagtggatt

SEQ ID NO: 666177 - DNA, 20 bp, Artificial
  CRISPR gRNA sequence
ttacaaaagcagtggatttt

SEQ ID NO: 666178 - DNA, 20 bp, Artificial
  CRISPR gRNA sequence
caaaagcagtggattttcta

SEQ ID NO: 666179 - DNA, 20 bp, Artificial
  CRISPR gRNA sequence
tctagttagaatcattcttg

SEQ ID NO: 666180 - DNA, 20 bp, Artificial
  CRISPR gRNA sequence
ctagttagaatcattcttgg

SEQ ID NO: 666181 - DNA, 20 bp, Artificial
  CRISPR gRNA sequence
tagttagaatcattcttggg

SEQ ID NO: 666182 - DNA, 20 bp, Artificial
  CRISPR gRNA sequence
gttagaatcattcttgggaa

SEQ ID NO: 666183 - DNA, 20 bp, Artificial
  CRISPR gRNA sequence
gaatcattcttgggaattgt

SEQ ID NO: 666184 - DNA, 20 bp, Artificial
  CRISPR gRNA sequence
ttgggaattgtgacactttg

SEQ ID NO: 666185 - DNA, 20 bp, Artificial
  CRISPR gRNA sequence
gggaattgtgacactttgca

SEQ ID NO: 666186 - DNA, 20 bp, Artificial
  CRISPR gRNA sequence
ggaattgtgacactttgcat

SEQ ID NO: 666187 - DNA, 20 bp, Artificial
  CRISPR gRNA sequence
tgacactttgcatatttggt

SEQ ID NO: 666188 - DNA, 20 bp, Artificial
  CRISPR gRNA sequence
tgcatatttggtgtacttga

SEQ ID NO: 666189 - DNA, 20 bp, Artificial
  CRISPR gRNA sequence
gcatatttggtgtacttgag

SEQ ID NO: 666190 - DNA, 20 bp, Artificial
  CRISPR gRNA sequence
catatttggtgtacttgagg

SEQ ID NO: 666191 - DNA, 20 bp, Artificial
  CRISPR gRNA sequence
ggtgtacttgaggaacagca

SEQ ID NO: 666192 - DNA, 20 bp, Artificial
  CRISPR gRNA sequence
gtgtacttgaggaacagcaa

SEQ ID NO: 666193 - DNA, 20 bp, Artificial
  CRISPR gRNA sequence
gaggaacagcaagggtacca

SEQ ID NO: 666194 - DNA, 20 bp, Artificial
  CRISPR gRNA sequence
aggaacagcaagggtaccag

SEQ ID NO: 666195 - DNA, 20 bp, Artificial
  CRISPR gRNA sequence
ggtttggttacagtggtctg

SEQ ID NO: 666196 - DNA, 20 bp, Artificial
  CRISPR gRNA sequence
gtttggttacagtggtctga

SEQ ID NO: 666197 - DNA, 20 bp, Artificial
  CRISPR gRNA sequence
ggttacagtggtctgaaaga

SEQ ID NO: 666198 - DNA, 20 bp, Artificial
  CRISPR gRNA sequence
gttacagtggtctgaaagag

SEQ ID NO: 666199 - DNA, 20 bp, Artificial
  CRISPR gRNA sequence
cagtggtctgaaagagggga

SEQ ID NO: 666200 - DNA, 20 bp, Artificial
  CRISPR gRNA sequence
aaagaggggagagatctgta

SEQ ID NO: 666201 - DNA, 20 bp, Artificial
  CRISPR gRNA sequence
tatggggtgatcatatattt

SEQ ID NO: 666202 - DNA, 20 bp, Artificial
  CRISPR gRNA sequence
cataaattatctgggtccca

SEQ ID NO: 666203 - DNA, 20 bp, Artificial
  CRISPR gRNA sequence
ataaattatctgggtcccat

SEQ ID NO: 666204 - DNA, 20 bp, Artificial
  CRISPR gRNA sequence
tctgggtcccatgtggagag

SEQ ID NO: 666205 - DNA, 20 bp, Artificial
  CRISPR gRNA sequence
ggtcccatgtggagagtgga

SEQ ID NO: 666206 - DNA, 20 bp, Artificial
  CRISPR gRNA sequence
caagcaaggtgccctgtgag

SEQ ID NO: 666207 - DNA, 20 bp, Artificial
  CRISPR gRNA sequence
tgaggaggcctgcacaaaag

SEQ ID NO: 666208 - DNA, 20 bp, Artificial
  CRISPR gRNA sequence
cacaaaagtgaagaggcctg

SEQ ID NO: 666209 - DNA, 20 bp, Artificial
  CRISPR gRNA sequence
agctgaagtgagaaggtctg

SEQ ID NO: 666210 - DNA, 20 bp, Artificial
  CRISPR gRNA sequence
aagtgagaaggtctgcgtga

SEQ ID NO: 666211 - DNA, 20 bp, Artificial
  CRISPR gRNA sequence
cgtgaaagtgatttgtgtga

SEQ ID NO: 666212 - DNA, 20 bp, Artificial
  CRISPR gRNA sequence
gtgtgaaagatggtggtgta

SEQ ID NO: 666213 - DNA, 20 bp, Artificial
  CRISPR gRNA sequence
tgtgaaagatggtggtgtat

SEQ ID NO: 666214 - DNA, 20 bp, Artificial
  CRISPR gRNA sequence
gagcaggagcagtgggggtg

SEQ ID NO: 666215 - DNA, 20 bp, Artificial
  CRISPR gRNA sequence
ttgtaagtagagcctgttgg

SEQ ID NO: 666216 - DNA, 20 bp, Artificial
  CRISPR gRNA sequence
tgtaagtagagcctgttgga

SEQ ID NO: 666217 - DNA, 20 bp, Artificial
  CRISPR gRNA sequence
gtaagtagagcctgttggac

SEQ ID NO: 666218 - DNA, 20 bp, Artificial
  CRISPR gRNA sequence
taagtagagcctgttggact

SEQ ID NO: 666219 - DNA, 20 bp, Artificial
  CRISPR gRNA sequence
ttggacttgctgatggattg

SEQ ID NO: 666220 - DNA, 20 bp, Artificial
  CRISPR gRNA sequence
gacttgctgatggattggaa

SEQ ID NO: 666221 - DNA, 20 bp, Artificial
  CRISPR gRNA sequence
gctgatggattggaagcggc

SEQ ID NO: 666222 - DNA, 20 bp, Artificial
  CRISPR gRNA sequence
ctgatggattggaagcggca

SEQ ID NO: 666223 - DNA, 20 bp, Artificial
  CRISPR gRNA sequence
atggattggaagcggcatgt

SEQ ID NO: 666224 - DNA, 20 bp, Artificial
  CRISPR gRNA sequence
gaagcggcatgtgagggaaa

SEQ ID NO: 666225 - DNA, 20 bp, Artificial
  CRISPR gRNA sequence
aggagtgactgctagtgttt

SEQ ID NO: 666226 - DNA, 20 bp, Artificial
  CRISPR gRNA sequence
ctagtgtttggcttaagtag

SEQ ID NO: 666227 - DNA, 20 bp, Artificial
  CRISPR gRNA sequence
gtgtttggcttaagtagcct

SEQ ID NO: 666228 - DNA, 20 bp, Artificial
  CRISPR gRNA sequence
ggcttaagtagcctggtgaa

SEQ ID NO: 666229 - DNA, 20 bp, Artificial
  CRISPR gRNA sequence
gcttaagtagcctggtgaat

SEQ ID NO: 666230 - DNA, 20 bp, Artificial
  CRISPR gRNA sequence
aagtagcctggtgaatagtg

SEQ ID NO: 666231 - DNA, 20 bp, Artificial
  CRISPR gRNA sequence
agtagcctggtgaatagtga

SEQ ID NO: 666232 - DNA, 20 bp, Artificial
  CRISPR gRNA sequence
gtgaatagtgatgtcactta

SEQ ID NO: 666233 - DNA, 20 bp, Artificial
  CRISPR gRNA sequence
actgacttggggaaatgaag

SEQ ID NO: 666234 - DNA, 20 bp, Artificial
  CRISPR gRNA sequence
ctgacttggggaaatgaaga

SEQ ID NO: 666235 - DNA, 20 bp, Artificial
  CRISPR gRNA sequence
acttggggaaatgaagagct

SEQ ID NO: 666236 - DNA, 20 bp, Artificial
  CRISPR gRNA sequence
ggggaaatgaagagctctgt

SEQ ID NO: 666237 - DNA, 20 bp, Artificial
  CRISPR gRNA sequence
gggaaatgaagagctctgtt

SEQ ID NO: 666238 - DNA, 20 bp, Artificial
  CRISPR gRNA sequence
tgttttgaacaggtgaagct

SEQ ID NO: 666239 - DNA, 20 bp, Artificial
  CRISPR gRNA sequence
ttttgaacaggtgaagcttg

SEQ ID NO: 666240 - DNA, 20 bp, Artificial
  CRISPR gRNA sequence
tgaacaggtgaagcttgaga

SEQ ID NO: 666241 - DNA, 20 bp, Artificial
  CRISPR gRNA sequence
gaacaggtgaagcttgagag

SEQ ID NO: 666242 - DNA, 20 bp, Artificial
  CRISPR gRNA sequence
aacaggtgaagcttgagagt

SEQ ID NO: 666243 - DNA, 20 bp, Artificial
  CRISPR gRNA sequence
gagagtcattcctagaatct

SEQ ID NO: 666244 - DNA, 20 bp, Artificial
  CRISPR gRNA sequence
agagtcattcctagaatctc

SEQ ID NO: 666245 - DNA, 20 bp, Artificial
  CRISPR gRNA sequence
ctagaatctcaaatcaagat

SEQ ID NO: 666246 - DNA, 20 bp, Artificial
  CRISPR gRNA sequence
gaatctcaaatcaagatgag

SEQ ID NO: 666247 - DNA, 20 bp, Artificial
  CRISPR gRNA sequence
aaatcaagatgagtcttaat

SEQ ID NO: 666248 - DNA, 20 bp, Artificial
  CRISPR gRNA sequence
aatcaaaatgtcttagccaa

SEQ ID NO: 666249 - DNA, 20 bp, Artificial
  CRISPR gRNA sequence
atcaaaatgtcttagccaaa

SEQ ID NO: 666250 - DNA, 20 bp, Artificial
  CRISPR gRNA sequence
agccaaaggattcgagagcc

SEQ ID NO: 666251 - DNA, 20 bp, Artificial
  CRISPR gRNA sequence
gccaaaggattcgagagcca

SEQ ID NO: 666252 - DNA, 20 bp, Artificial
  CRISPR gRNA sequence
gagagccaggatgctcctgc

SEQ ID NO: 666253 - DNA, 20 bp, Artificial
  CRISPR gRNA sequence
ctgcagagtagtgcaattat

SEQ ID NO: 666254 - DNA, 20 bp, Artificial
  CRISPR gRNA sequence
cagagtagtgcaattatggt

SEQ ID NO: 666255 - DNA, 20 bp, Artificial
  CRISPR gRNA sequence
tggtttcccttacaatgcag

SEQ ID NO: 666256 - DNA, 20 bp, Artificial
  CRISPR gRNA sequence
cccttacaatgcagcagaga

SEQ ID NO: 666257 - DNA, 20 bp, Artificial
  CRISPR gRNA sequence
ccttacaatgcagcagagaa

SEQ ID NO: 666258 - DNA, 20 bp, Artificial
  CRISPR gRNA sequence
acaatgcagcagagaaccaa

SEQ ID NO: 666259 - DNA, 20 bp, Artificial
  CRISPR gRNA sequence
caatgcagcagagaaccaaa

SEQ ID NO: 666260 - DNA, 20 bp, Artificial
  CRISPR gRNA sequence
cccaacagttttttaagact

SEQ ID NO: 666261 - DNA, 20 bp, Artificial
  CRISPR gRNA sequence
tttaagacttagtgtcctca

SEQ ID NO: 666262 - DNA, 20 bp, Artificial
  CRISPR gRNA sequence
ttaagacttagtgtcctcac

SEQ ID NO: 666263 - DNA, 20 bp, Artificial
  CRISPR gRNA sequence
taagacttagtgtcctcact

SEQ ID NO: 666264 - DNA, 20 bp, Artificial
  CRISPR gRNA sequence
aagacttagtgtcctcactt

SEQ ID NO: 666265 - DNA, 20 bp, Artificial
  CRISPR gRNA sequence
agacttagtgtcctcactta

SEQ ID NO: 666266 - DNA, 20 bp, Artificial
  CRISPR gRNA sequence
agtgtcctcacttataggtg

SEQ ID NO: 666267 - DNA, 20 bp, Artificial
  CRISPR gRNA sequence
gtgtcctcacttataggtgg

SEQ ID NO: 666268 - DNA, 20 bp, Artificial
  CRISPR gRNA sequence
acttataggtggggatatat

SEQ ID NO: 666269 - DNA, 20 bp, Artificial
  CRISPR gRNA sequence
ataggtggggatatattact

SEQ ID NO: 666270 - DNA, 20 bp, Artificial
  CRISPR gRNA sequence
taggtggggatatattactt

SEQ ID NO: 666271 - DNA, 20 bp, Artificial
  CRISPR gRNA sequence
cttatttcactgggttcttt

SEQ ID NO: 666272 - DNA, 20 bp, Artificial
  CRISPR gRNA sequence
atttcactgggttctttgaa

SEQ ID NO: 666273 - DNA, 20 bp, Artificial
  CRISPR gRNA sequence
tttcactgggttctttgaag

SEQ ID NO: 666274 - DNA, 20 bp, Artificial
  CRISPR gRNA sequence
cactgggttctttgaaggta

SEQ ID NO: 666275 - DNA, 20 bp, Artificial
  CRISPR gRNA sequence
actgggttctttgaaggtaa

SEQ ID NO: 666276 - DNA, 20 bp, Artificial
  CRISPR gRNA sequence
ggttctttgaaggtaacatt

SEQ ID NO: 666277 - DNA, 20 bp, Artificial
  CRISPR gRNA sequence
tttgaaggtaacattagata

SEQ ID NO: 666278 - DNA, 20 bp, Artificial
  CRISPR gRNA sequence
tgaaggtaacattagataat

SEQ ID NO: 666279 - DNA, 20 bp, Artificial
  CRISPR gRNA sequence
gaaggtaacattagataatg

SEQ ID NO: 666280 - DNA, 20 bp, Artificial
  CRISPR gRNA sequence
aaggtaacattagataatgt

SEQ ID NO: 666281 - DNA, 20 bp, Artificial
  CRISPR gRNA sequence
gataatgtttgtgaaactca

SEQ ID NO: 666282 - DNA, 20 bp, Artificial
  CRISPR gRNA sequence
gtgaaactcagtgtaattct

SEQ ID NO: 666283 - DNA, 20 bp, Artificial
  CRISPR gRNA sequence
tgaaactcagtgtaattctt

SEQ ID NO: 666284 - DNA, 20 bp, Artificial
  CRISPR gRNA sequence
agtgtaattcttgacaagta

SEQ ID NO: 666285 - DNA, 20 bp, Artificial
  CRISPR gRNA sequence
ttgacaagtaattagcacct

SEQ ID NO: 666286 - DNA, 20 bp, Artificial
  CRISPR gRNA sequence
gacaagtaattagcacctaa

SEQ ID NO: 666287 - DNA, 20 bp, Artificial
  CRISPR gRNA sequence
acaagtaattagcacctaat

SEQ ID NO: 666288 - DNA, 20 bp, Artificial
  CRISPR gRNA sequence
gcacctaataaatatcttcc

SEQ ID NO: 666289 - DNA, 20 bp, Artificial
  CRISPR gRNA sequence
ataaatatcttccattattg

SEQ ID NO: 666290 - DNA, 20 bp, Artificial
  CRISPR gRNA sequence
ccattattgttgttattaat

SEQ ID NO: 666291 - DNA, 20 bp, Artificial
  CRISPR gRNA sequence
cattattgttgttattaatt

SEQ ID NO: 666292 - DNA, 20 bp, Artificial
  CRISPR gRNA sequence
ttgttgttattaattttggt

SEQ ID NO: 666293 - DNA, 20 bp, Artificial
  CRISPR gRNA sequence
ttgttattaattttggtaaa

SEQ ID NO: 666294 - DNA, 20 bp, Artificial
  CRISPR gRNA sequence
ttattaattttggtaaaatg

SEQ ID NO: 666295 - DNA, 20 bp, Artificial
  CRISPR gRNA sequence
ttaattttggtaaaatgaac

SEQ ID NO: 666296 - DNA, 20 bp, Artificial
  CRISPR gRNA sequence
attttggtaaaatgaacttt

SEQ ID NO: 666297 - DNA, 20 bp, Artificial
  CRISPR gRNA sequence
tggtaaaatgaactttattt

SEQ ID NO: 666298 - DNA, 20 bp, Artificial
  CRISPR gRNA sequence
ggtaaaatgaactttattta

SEQ ID NO: 666299 - DNA, 20 bp, Artificial
  CRISPR gRNA sequence
gtaaaatgaactttatttat

SEQ ID NO: 666300 - DNA, 20 bp, Artificial
  CRISPR gRNA sequence
tatttatttatttattttga

SEQ ID NO: 666301 - DNA, 20 bp, Artificial
  CRISPR gRNA sequence
atttatttatttattttgag

SEQ ID NO: 666302 - DNA, 20 bp, Artificial
  CRISPR gRNA sequence
tttatttatttattttgaga

SEQ ID NO: 666303 - DNA, 20 bp, Artificial
  CRISPR gRNA sequence
atttatttattttgagacag

SEQ ID NO: 666304 - DNA, 20 bp, Artificial
  CRISPR gRNA sequence
tttatttattttgagacaga

SEQ ID NO: 666305 - DNA, 20 bp, Artificial
  CRISPR gRNA sequence
atttattttgagacagagtc

SEQ ID NO: 666306 - DNA, 20 bp, Artificial
  CRISPR gRNA sequence
tttattttgagacagagtct

SEQ ID NO: 666307 - DNA, 20 bp, Artificial
  CRISPR gRNA sequence
attttgagacagagtctcgc

SEQ ID NO: 666308 - DNA, 20 bp, Artificial
  CRISPR gRNA sequence
ttttgagacagagtctcgct

SEQ ID NO: 666309 - DNA, 20 bp, Artificial
  CRISPR gRNA sequence
tgagacagagtctcgctctg

SEQ ID NO: 666310 - DNA, 20 bp, Artificial
  CRISPR gRNA sequence
gagacagagtctcgctctgt

SEQ ID NO: 666311 - DNA, 20 bp, Artificial
  CRISPR gRNA sequence
agacagagtctcgctctgtt

SEQ ID NO: 666312 - DNA, 20 bp, Artificial
  CRISPR gRNA sequence
gctctgttgcccagactgga

SEQ ID NO: 666313 - DNA, 20 bp, Artificial
  CRISPR gRNA sequence
tgttgcccagactggagtgc

SEQ ID NO: 666314 - DNA, 20 bp, Artificial
  CRISPR gRNA sequence
ttgcccagactggagtgcag

SEQ ID NO: 666315 - DNA, 20 bp, Artificial
  CRISPR gRNA sequence
cccagactggagtgcagtgg

SEQ ID NO: 666316 - DNA, 20 bp, Artificial
  CRISPR gRNA sequence
gagtgcagtggcgcaatctt

SEQ ID NO: 666317 - DNA, 20 bp, Artificial
  CRISPR gRNA sequence
ggctcactgcaacctccgcc

SEQ ID NO: 666318 - DNA, 20 bp, Artificial
  CRISPR gRNA sequence
gctcactgcaacctccgcct

SEQ ID NO: 666319 - DNA, 20 bp, Artificial
  CRISPR gRNA sequence
actgcaacctccgccttctg

SEQ ID NO: 666320 - DNA, 20 bp, Artificial
  CRISPR gRNA sequence
caacctccgccttctgggtt

SEQ ID NO: 666321 - DNA, 20 bp, Artificial
  CRISPR gRNA sequence
cgccttctgggttcaagcga

SEQ ID NO: 666322 - DNA, 20 bp, Artificial
  CRISPR gRNA sequence
ctgggttcaagcgattctcc

SEQ ID NO: 666323 - DNA, 20 bp, Artificial
  CRISPR gRNA sequence
tgggttcaagcgattctcct

SEQ ID NO: 666324 - DNA, 20 bp, Artificial
  CRISPR gRNA sequence
ggttcaagcgattctcctgc

SEQ ID NO: 666325 - DNA, 20 bp, Artificial
  CRISPR gRNA sequence
aagcgattctcctgcctcag

SEQ ID NO: 666326 - DNA, 20 bp, Artificial
  CRISPR gRNA sequence
tcctgcctcagattcccaag

SEQ ID NO: 666327 - DNA, 20 bp, Artificial
  CRISPR gRNA sequence
ctgcctcagattcccaagtg

SEQ ID NO: 666328 - DNA, 20 bp, Artificial
  CRISPR gRNA sequence
cctcagattcccaagtggtg

SEQ ID NO: 666329 - DNA, 20 bp, Artificial
  CRISPR gRNA sequence
agattcccaagtggtgtgat

SEQ ID NO: 666330 - DNA, 20 bp, Artificial
  CRISPR gRNA sequence
ccaagtggtgtgattacagc

SEQ ID NO: 666331 - DNA, 20 bp, Artificial
  CRISPR gRNA sequence
cagccgcccaccactatgac

SEQ ID NO: 666332 - DNA, 20 bp, Artificial
  CRISPR gRNA sequence
tgactggctaatttttatgt

SEQ ID NO: 666333 - DNA, 20 bp, Artificial
  CRISPR gRNA sequence
gctaatttttatgtttttac

SEQ ID NO: 666334 - DNA, 20 bp, Artificial
  CRISPR gRNA sequence
atttttatgtttttactaga

SEQ ID NO: 666335 - DNA, 20 bp, Artificial
  CRISPR gRNA sequence
ttatgtttttactagagagg

SEQ ID NO: 666336 - DNA, 20 bp, Artificial
  CRISPR gRNA sequence
tatgtttttactagagagga

SEQ ID NO: 666337 - DNA, 20 bp, Artificial
  CRISPR gRNA sequence
atgtttttactagagaggag

SEQ ID NO: 666338 - DNA, 20 bp, Artificial
  CRISPR gRNA sequence
tgtttttactagagaggagg

SEQ ID NO: 666339 - DNA, 20 bp, Artificial
  CRISPR gRNA sequence
ttactagagaggaggtttca

SEQ ID NO: 666340 - DNA, 20 bp, Artificial
  CRISPR gRNA sequence
tactagagaggaggtttcac

SEQ ID NO: 666341 - DNA, 20 bp, Artificial
  CRISPR gRNA sequence
actagagaggaggtttcacc

SEQ ID NO: 666342 - DNA, 20 bp, Artificial
  CRISPR gRNA sequence
ctagagaggaggtttcacca

SEQ ID NO: 666343 - DNA, 20 bp, Artificial
  CRISPR gRNA sequence
gagaggaggtttcaccatgt

SEQ ID NO: 666344 - DNA, 20 bp, Artificial
  CRISPR gRNA sequence
caccatgttggccaggctgg

SEQ ID NO: 666345 - DNA, 20 bp, Artificial
  CRISPR gRNA sequence
accatgttggccaggctggt

SEQ ID NO: 666346 - DNA, 20 bp, Artificial
  CRISPR gRNA sequence
gccaggctggtttcaaactc

SEQ ID NO: 666347 - DNA, 20 bp, Artificial
  CRISPR gRNA sequence
gtttcaaactcttgacttca

SEQ ID NO: 666348 - DNA, 20 bp, Artificial
  CRISPR gRNA sequence
caaactcttgacttcaaatg

SEQ ID NO: 666349 - DNA, 20 bp, Artificial
  CRISPR gRNA sequence
aaactcttgacttcaaatga

SEQ ID NO: 666350 - DNA, 20 bp, Artificial
  CRISPR gRNA sequence
ttgacttcaaatgatccccc

SEQ ID NO: 666351 - DNA, 20 bp, Artificial
  CRISPR gRNA sequence
gacttcaaatgatccccctg

SEQ ID NO: 666352 - DNA, 20 bp, Artificial
  CRISPR gRNA sequence
acttcaaatgatccccctgc

SEQ ID NO: 666353 - DNA, 20 bp, Artificial
  CRISPR gRNA sequence
caaatgatccccctgcctca

SEQ ID NO: 666354 - DNA, 20 bp, Artificial
  CRISPR gRNA sequence
aaatgatccccctgcctcag

SEQ ID NO: 666355 - DNA, 20 bp, Artificial
  CRISPR gRNA sequence
cctcagcctctcaaattgct

SEQ ID NO: 666356 - DNA, 20 bp, Artificial
  CRISPR gRNA sequence
agcctctcaaattgctaaga

SEQ ID NO: 666357 - DNA, 20 bp, Artificial
  CRISPR gRNA sequence
tcaaattgctaagattacag

SEQ ID NO: 666358 - DNA, 20 bp, Artificial
  CRISPR gRNA sequence
aaattgctaagattacaggt

SEQ ID NO: 666359 - DNA, 20 bp, Artificial
  CRISPR gRNA sequence
ctaagattacaggtgtgagc

SEQ ID NO: 666360 - DNA, 20 bp, Artificial
  CRISPR gRNA sequence
agattacaggtgtgagccac

SEQ ID NO: 666361 - DNA, 20 bp, Artificial
  CRISPR gRNA sequence
caggtgtgagccactgtgcc

SEQ ID NO: 666362 - DNA, 20 bp, Artificial
  CRISPR gRNA sequence
tgccaggccaggaaaattat

SEQ ID NO: 666363 - DNA, 20 bp, Artificial
  CRISPR gRNA sequence
tttttaaagctgtttttaaa

SEQ ID NO: 666364 - DNA, 20 bp, Artificial
  CRISPR gRNA sequence
ttaaagctgtttttaaatat

SEQ ID NO: 666365 - DNA, 20 bp, Artificial
  CRISPR gRNA sequence
taaagctgtttttaaatatc

SEQ ID NO: 666366 - DNA, 20 bp, Artificial
  CRISPR gRNA sequence
aaagctgtttttaaatatca

SEQ ID NO: 666367 - DNA, 20 bp, Artificial
  CRISPR gRNA sequence
aagctgtttttaaatatcag

SEQ ID NO: 666368 - DNA, 20 bp, Artificial
  CRISPR gRNA sequence
tttttaaatatcagctttgg

SEQ ID NO: 666369 - DNA, 20 bp, Artificial
  CRISPR gRNA sequence
ttaaatatcagctttggaat

SEQ ID NO: 666370 - DNA, 20 bp, Artificial
  CRISPR gRNA sequence
taaatatcagctttggaatg

SEQ ID NO: 666371 - DNA, 20 bp, Artificial
  CRISPR gRNA sequence
aaatatcagctttggaatga

SEQ ID NO: 666372 - DNA, 20 bp, Artificial
  CRISPR gRNA sequence
aatatcagctttggaatgaa

SEQ ID NO: 666373 - DNA, 20 bp, Artificial
  CRISPR gRNA sequence
tggaatgaaattggatataa

SEQ ID NO: 666374 - DNA, 20 bp, Artificial
  CRISPR gRNA sequence
ggaatgaaattggatataaa

SEQ ID NO: 666375 - DNA, 20 bp, Artificial
  CRISPR gRNA sequence
gaatgaaattggatataaat

SEQ ID NO: 666376 - DNA, 20 bp, Artificial
  CRISPR gRNA sequence
gatataaattaatacttagt

SEQ ID NO: 666377 - DNA, 20 bp, Artificial
  CRISPR gRNA sequence
atacttagtatatccagaat

SEQ ID NO: 666378 - DNA, 20 bp, Artificial
  CRISPR gRNA sequence
agtatatccagaatctacaa

SEQ ID NO: 666379 - DNA, 20 bp, Artificial
  CRISPR gRNA sequence
gtatatccagaatctacaaa

SEQ ID NO: 666380 - DNA, 20 bp, Artificial
  CRISPR gRNA sequence
caaagaacttaaacaaattt

SEQ ID NO: 666381 - DNA, 20 bp, Artificial
  CRISPR gRNA sequence
aaacaaatttacaagaaaaa

SEQ ID NO: 666382 - DNA, 20 bp, Artificial
  CRISPR gRNA sequence
aacaaatttacaagaaaaaa

SEQ ID NO: 666383 - DNA, 20 bp, Artificial
  CRISPR gRNA sequence
acaagaaaaaaatcaaacaa

SEQ ID NO: 666384 - DNA, 20 bp, Artificial
  CRISPR gRNA sequence
caagaaaaaaatcaaacaac

SEQ ID NO: 666385 - DNA, 20 bp, Artificial
  CRISPR gRNA sequence
ctcgaaagaagacatttatg

SEQ ID NO: 666386 - DNA, 20 bp, Artificial
  CRISPR gRNA sequence
tcgaaagaagacatttatgt

SEQ ID NO: 666387 - DNA, 20 bp, Artificial
  CRISPR gRNA sequence
gaaagaagacatttatgtag

SEQ ID NO: 666388 - DNA, 20 bp, Artificial
  CRISPR gRNA sequence
atgtagctgacagacacatg

SEQ ID NO: 666389 - DNA, 20 bp, Artificial
  CRISPR gRNA sequence
tgtagctgacagacacatgg

SEQ ID NO: 666390 - DNA, 20 bp, Artificial
  CRISPR gRNA sequence
acagacacatggaaaaatgc

SEQ ID NO: 666391 - DNA, 20 bp, Artificial
  CRISPR gRNA sequence
atcatcactggccatcagag

SEQ ID NO: 666392 - DNA, 20 bp, Artificial
  CRISPR gRNA sequence
gccatcagagaaatgcaaat

SEQ ID NO: 666393 - DNA, 20 bp, Artificial
  CRISPR gRNA sequence
acaccagttagaatggcgat

SEQ ID NO: 666394 - DNA, 20 bp, Artificial
  CRISPR gRNA sequence
gaatggcgatcattaacaag

SEQ ID NO: 666395 - DNA, 20 bp, Artificial
  CRISPR gRNA sequence
acaagtcaggaaacagcagg

SEQ ID NO: 666396 - DNA, 20 bp, Artificial
  CRISPR gRNA sequence
gagaggatgtggagaaatgg

SEQ ID NO: 666397 - DNA, 20 bp, Artificial
  CRISPR gRNA sequence
ttacactgttgctgggactg

SEQ ID NO: 666398 - DNA, 20 bp, Artificial
  CRISPR gRNA sequence
tacactgttgctgggactgt

SEQ ID NO: 666399 - DNA, 20 bp, Artificial
  CRISPR gRNA sequence
acactgttgctgggactgta

SEQ ID NO: 666400 - DNA, 20 bp, Artificial
  CRISPR gRNA sequence
cactgttgctgggactgtaa

SEQ ID NO: 666401 - DNA, 20 bp, Artificial
  CRISPR gRNA sequence
ttgctgggactgtaaactag

SEQ ID NO: 666402 - DNA, 20 bp, Artificial
  CRISPR gRNA sequence
ctgggactgtaaactagttc

SEQ ID NO: 666403 - DNA, 20 bp, Artificial
  CRISPR gRNA sequence
ggactgtaaactagttcaac

SEQ ID NO: 666404 - DNA, 20 bp, Artificial
  CRISPR gRNA sequence
taaactagttcaaccattgt

SEQ ID NO: 666405 - DNA, 20 bp, Artificial
  CRISPR gRNA sequence
gttcaaccattgtggaagac

SEQ ID NO: 666406 - DNA, 20 bp, Artificial
  CRISPR gRNA sequence
aaccattgtggaagacagtg

SEQ ID NO: 666407 - DNA, 20 bp, Artificial
  CRISPR gRNA sequence
tggaagacagtgtggcaatt

SEQ ID NO: 666408 - DNA, 20 bp, Artificial
  CRISPR gRNA sequence
ctcagggatctagaactaga

SEQ ID NO: 666409 - DNA, 20 bp, Artificial
  CRISPR gRNA sequence
agggatctagaactagaaat

SEQ ID NO: 666410 - DNA, 20 bp, Artificial
  CRISPR gRNA sequence
gaactagaaatatcatttga

SEQ ID NO: 666411 - DNA, 20 bp, Artificial
  CRISPR gRNA sequence
gaaatatcatttgacccagc

SEQ ID NO: 666412 - DNA, 20 bp, Artificial
  CRISPR gRNA sequence
gacccagccatcccattact

SEQ ID NO: 666413 - DNA, 20 bp, Artificial
  CRISPR gRNA sequence
acccagccatcccattactg

SEQ ID NO: 666414 - DNA, 20 bp, Artificial
  CRISPR gRNA sequence
ctgggtatatacccaaagga

SEQ ID NO: 666415 - DNA, 20 bp, Artificial
  CRISPR gRNA sequence
ggtatatacccaaaggatta

SEQ ID NO: 666416 - DNA, 20 bp, Artificial
  CRISPR gRNA sequence
taaatcatgctgctataaag

SEQ ID NO: 666417 - DNA, 20 bp, Artificial
  CRISPR gRNA sequence
ctataaagacacatgcacac

SEQ ID NO: 666418 - DNA, 20 bp, Artificial
  CRISPR gRNA sequence
taaagacacatgcacacgtg

SEQ ID NO: 666419 - DNA, 20 bp, Artificial
  CRISPR gRNA sequence
attgaggcactattcacaat

SEQ ID NO: 666420 - DNA, 20 bp, Artificial
  CRISPR gRNA sequence
ttgaggcactattcacaata

SEQ ID NO: 666421 - DNA, 20 bp, Artificial
  CRISPR gRNA sequence
aggcactattcacaatagca

SEQ ID NO: 666422 - DNA, 20 bp, Artificial
  CRISPR gRNA sequence
ttcacaatagcaaagacttg

SEQ ID NO: 666423 - DNA, 20 bp, Artificial
  CRISPR gRNA sequence
acaatagcaaagacttggaa

SEQ ID NO: 666424 - DNA, 20 bp, Artificial
  CRISPR gRNA sequence
ggaaccaacccaaatgtcca

SEQ ID NO: 666425 - DNA, 20 bp, Artificial
  CRISPR gRNA sequence
gaaccaacccaaatgtccat

SEQ ID NO: 666426 - DNA, 20 bp, Artificial
  CRISPR gRNA sequence
gattaagaaaatgtggcaca

SEQ ID NO: 666427 - DNA, 20 bp, Artificial
  CRISPR gRNA sequence
agaaaatgtggcacatatac

SEQ ID NO: 666428 - DNA, 20 bp, Artificial
  CRISPR gRNA sequence
tgcagccacgaaaaaggatg

SEQ ID NO: 666429 - DNA, 20 bp, Artificial
  CRISPR gRNA sequence
atgtcctttgtagggacatg

SEQ ID NO: 666430 - DNA, 20 bp, Artificial
  CRISPR gRNA sequence
tgtagggacatggatgaagc

SEQ ID NO: 666431 - DNA, 20 bp, Artificial
  CRISPR gRNA sequence
gtagggacatggatgaagct

SEQ ID NO: 666432 - DNA, 20 bp, Artificial
  CRISPR gRNA sequence
tagggacatggatgaagctg

SEQ ID NO: 666433 - DNA, 20 bp, Artificial
  CRISPR gRNA sequence
gaaaccatcattatgagcaa

SEQ ID NO: 666434 - DNA, 20 bp, Artificial
  CRISPR gRNA sequence
tgagcaaactatcgcaagga

SEQ ID NO: 666435 - DNA, 20 bp, Artificial
  CRISPR gRNA sequence
tcgcaaggacagaaaaccaa

SEQ ID NO: 666436 - DNA, 20 bp, Artificial
  CRISPR gRNA sequence
tcactcataggtgggaactg

SEQ ID NO: 666437 - DNA, 20 bp, Artificial
  CRISPR gRNA sequence
actcataggtgggaactgaa

SEQ ID NO: 666438 - DNA, 20 bp, Artificial
  CRISPR gRNA sequence
ataggtgggaactgaacaat

SEQ ID NO: 666439 - DNA, 20 bp, Artificial
  CRISPR gRNA sequence
aacaatgagaacacttggac

SEQ ID NO: 666440 - DNA, 20 bp, Artificial
  CRISPR gRNA sequence
ggacacagggtggggaacat

SEQ ID NO: 666441 - DNA, 20 bp, Artificial
  CRISPR gRNA sequence
gacacagggtggggaacatc

SEQ ID NO: 666442 - DNA, 20 bp, Artificial
  CRISPR gRNA sequence
gggcctgtcatggggtgcag

SEQ ID NO: 666443 - DNA, 20 bp, Artificial
  CRISPR gRNA sequence
tcatggggtgcagggagtgg

SEQ ID NO: 666444 - DNA, 20 bp, Artificial
  CRISPR gRNA sequence
ggagatatacctaatgtaaa

SEQ ID NO: 666445 - DNA, 20 bp, Artificial
  CRISPR gRNA sequence
atgtaaatgatgagttaacg

SEQ ID NO: 666446 - DNA, 20 bp, Artificial
  CRISPR gRNA sequence
acgggtgcagcacaccaaca

SEQ ID NO: 666447 - DNA, 20 bp, Artificial
  CRISPR gRNA sequence
catgttgtgcacatgtaccc

SEQ ID NO: 666448 - DNA, 20 bp, Artificial
  CRISPR gRNA sequence
tgcacatgtaccctagaact

SEQ ID NO: 666449 - DNA, 20 bp, Artificial
  CRISPR gRNA sequence
gaacttaaagtataattaaa

SEQ ID NO: 666450 - DNA, 20 bp, Artificial
  CRISPR gRNA sequence
aaagtataattaaaaaataa

SEQ ID NO: 666451 - DNA, 20 bp, Artificial
  CRISPR gRNA sequence
aagtataattaaaaaataaa

SEQ ID NO: 666452 - DNA, 20 bp, Artificial
  CRISPR gRNA sequence
aaaaataaattagtaatgga

SEQ ID NO: 666453 - DNA, 20 bp, Artificial
  CRISPR gRNA sequence
gtaatggatagtcatttcac

SEQ ID NO: 666454 - DNA, 20 bp, Artificial
  CRISPR gRNA sequence
cacatgtgtagtatacatat

SEQ ID NO: 666455 - DNA, 20 bp, Artificial
  CRISPR gRNA sequence
acatgtgtagtatacatata

SEQ ID NO: 666456 - DNA, 20 bp, Artificial
  CRISPR gRNA sequence
atgtaaataaaacaactttt

SEQ ID NO: 666457 - DNA, 20 bp, Artificial
  CRISPR gRNA sequence
tttctttttaaatgagttgc

SEQ ID NO: 666458 - DNA, 20 bp, Artificial
  CRISPR gRNA sequence
ttctttttaaatgagttgca

SEQ ID NO: 666459 - DNA, 20 bp, Artificial
  CRISPR gRNA sequence
tctttttaaatgagttgcat

SEQ ID NO: 666460 - DNA, 20 bp, Artificial
  CRISPR gRNA sequence
ctttttaaatgagttgcatt

SEQ ID NO: 666461 - DNA, 20 bp, Artificial
  CRISPR gRNA sequence
tttttaaatgagttgcattt

SEQ ID NO: 666462 - DNA, 20 bp, Artificial
  CRISPR gRNA sequence
tttaaatgagttgcattttt

SEQ ID NO: 666463 - DNA, 20 bp, Artificial
  CRISPR gRNA sequence
ttaaatgagttgcatttttt

SEQ ID NO: 666464 - DNA, 20 bp, Artificial
  CRISPR gRNA sequence
taaatgagttgcattttttt

SEQ ID NO: 666465 - DNA, 20 bp, Artificial
  CRISPR gRNA sequence
aaatgagttgcatttttttc

SEQ ID NO: 666466 - DNA, 20 bp, Artificial
  CRISPR gRNA sequence
aatgagttgcatttttttcc

SEQ ID NO: 666467 - DNA, 20 bp, Artificial
  CRISPR gRNA sequence
catttttttcctcagaacta

SEQ ID NO: 666468 - DNA, 20 bp, Artificial
  CRISPR gRNA sequence
ttttcctcagaactacaaag

SEQ ID NO: 666469 - DNA, 20 bp, Artificial
  CRISPR gRNA sequence
tttcctcagaactacaaagt

SEQ ID NO: 666470 - DNA, 20 bp, Artificial
  CRISPR gRNA sequence
ttcctcagaactacaaagta

SEQ ID NO: 666471 - DNA, 20 bp, Artificial
  CRISPR gRNA sequence
tcctcagaactacaaagtat

SEQ ID NO: 666472 - DNA, 20 bp, Artificial
  CRISPR gRNA sequence
cctcagaactacaaagtatt

SEQ ID NO: 666473 - DNA, 20 bp, Artificial
  CRISPR gRNA sequence
ctcagaactacaaagtatta

SEQ ID NO: 666474 - DNA, 20 bp, Artificial
  CRISPR gRNA sequence
agaactacaaagtattaaaa

SEQ ID NO: 666475 - DNA, 20 bp, Artificial
  CRISPR gRNA sequence
caaagtattaaaatcaggat

SEQ ID NO: 666476 - DNA, 20 bp, Artificial
  CRISPR gRNA sequence
aaatcaggattttgaatttt

SEQ ID NO: 666477 - DNA, 20 bp, Artificial
  CRISPR gRNA sequence
tgaattttatgcgtacgtgt

SEQ ID NO: 666478 - DNA, 20 bp, Artificial
  CRISPR gRNA sequence
gaattttatgcgtacgtgtg

SEQ ID NO: 666479 - DNA, 20 bp, Artificial
  CRISPR gRNA sequence
aattttatgcgtacgtgtga

SEQ ID NO: 666480 - DNA, 20 bp, Artificial
  CRISPR gRNA sequence
tatgcgtacgtgtgaggaac

SEQ ID NO: 666481 - DNA, 20 bp, Artificial
  CRISPR gRNA sequence
atgcgtacgtgtgaggaact

SEQ ID NO: 666482 - DNA, 20 bp, Artificial
  CRISPR gRNA sequence
tgcgtacgtgtgaggaactt

SEQ ID NO: 666483 - DNA, 20 bp, Artificial
  CRISPR gRNA sequence
tctgaattataaatgtgatt

SEQ ID NO: 666484 - DNA, 20 bp, Artificial
  CRISPR gRNA sequence
ctgaattataaatgtgatta

SEQ ID NO: 666485 - DNA, 20 bp, Artificial
  CRISPR gRNA sequence
tgaattataaatgtgattag

SEQ ID NO: 666486 - DNA, 20 bp, Artificial
  CRISPR gRNA sequence
aattataaatgtgattagtg

SEQ ID NO: 666487 - DNA, 20 bp, Artificial
  CRISPR gRNA sequence
taaatgtgattagtgacatg

SEQ ID NO: 666488 - DNA, 20 bp, Artificial
  CRISPR gRNA sequence
gtgacatgagtaaatgtttg

SEQ ID NO: 666489 - DNA, 20 bp, Artificial
  CRISPR gRNA sequence
gctgcctcttaagatctgcc

SEQ ID NO: 666490 - DNA, 20 bp, Artificial
  CRISPR gRNA sequence
ctgcctcttaagatctgcca

SEQ ID NO: 666491 - DNA, 20 bp, Artificial
  CRISPR gRNA sequence
cctcttaagatctgccatgc

SEQ ID NO: 666492 - DNA, 20 bp, Artificial
  CRISPR gRNA sequence
ttaagatctgccatgccttt

SEQ ID NO: 666493 - DNA, 20 bp, Artificial
  CRISPR gRNA sequence
aagatctgccatgcctttat

SEQ ID NO: 666494 - DNA, 20 bp, Artificial
  CRISPR gRNA sequence
agatctgccatgcctttatg

SEQ ID NO: 666495 - DNA, 20 bp, Artificial
  CRISPR gRNA sequence
ccatgcctttatgcaaatca

SEQ ID NO: 666496 - DNA, 20 bp, Artificial
  CRISPR gRNA sequence
tatgcaaatcaaagttccca

SEQ ID NO: 666497 - DNA, 20 bp, Artificial
  CRISPR gRNA sequence
atgcaaatcaaagttcccac

SEQ ID NO: 666498 - DNA, 20 bp, Artificial
  CRISPR gRNA sequence
tgcaaatcaaagttcccaca

SEQ ID NO: 666499 - DNA, 20 bp, Artificial
  CRISPR gRNA sequence
ccacagaaataatgagtcaa

SEQ ID NO: 666500 - DNA, 20 bp, Artificial
  CRISPR gRNA sequence
aaattagcattttttttcct

SEQ ID NO: 666501 - DNA, 20 bp, Artificial
  CRISPR gRNA sequence
aattagcattttttttcctc

SEQ ID NO: 666502 - DNA, 20 bp, Artificial
  CRISPR gRNA sequence
gcattttttttcctctgctc

SEQ ID NO: 666503 - DNA, 20 bp, Artificial
  CRISPR gRNA sequence
tttttcctctgctctgcttg

SEQ ID NO: 666504 - DNA, 20 bp, Artificial
  CRISPR gRNA sequence
ttttcctctgctctgcttgg

SEQ ID NO: 666505 - DNA, 20 bp, Artificial
  CRISPR gRNA sequence
tttcctctgctctgcttggg

SEQ ID NO: 666506 - DNA, 20 bp, Artificial
  CRISPR gRNA sequence
ttcctctgctctgcttgggt

SEQ ID NO: 666507 - DNA, 20 bp, Artificial
  CRISPR gRNA sequence
tcctctgctctgcttgggtc

SEQ ID NO: 666508 - DNA, 20 bp, Artificial
  CRISPR gRNA sequence
cctctgctctgcttgggtca

SEQ ID NO: 666509 - DNA, 20 bp, Artificial
  CRISPR gRNA sequence
ctctgctctgcttgggtcaa

SEQ ID NO: 666510 - DNA, 20 bp, Artificial
  CRISPR gRNA sequence
tgctctgcttgggtcaattt

SEQ ID NO: 666511 - DNA, 20 bp, Artificial
  CRISPR gRNA sequence
ctctgcttgggtcaatttta

SEQ ID NO: 666512 - DNA, 20 bp, Artificial
  CRISPR gRNA sequence
tgcttgggtcaattttacta

SEQ ID NO: 666513 - DNA, 20 bp, Artificial
  CRISPR gRNA sequence
cttgggtcaattttactata

SEQ ID NO: 666514 - DNA, 20 bp, Artificial
  CRISPR gRNA sequence
gggtcaattttactatacat

SEQ ID NO: 666515 - DNA, 20 bp, Artificial
  CRISPR gRNA sequence
ggtcaattttactatacatt

SEQ ID NO: 666516 - DNA, 20 bp, Artificial
  CRISPR gRNA sequence
tactatacattgcatatcaa

SEQ ID NO: 666517 - DNA, 20 bp, Artificial
  CRISPR gRNA sequence
actatacattgcatatcaag

SEQ ID NO: 666518 - DNA, 20 bp, Artificial
  CRISPR gRNA sequence
ctatacattgcatatcaaga

SEQ ID NO: 666519 - DNA, 20 bp, Artificial
  CRISPR gRNA sequence
tacattgcatatcaagacct

SEQ ID NO: 666520 - DNA, 20 bp, Artificial
  CRISPR gRNA sequence
catatcaagacctttgattt

SEQ ID NO: 666521 - DNA, 20 bp, Artificial
  CRISPR gRNA sequence
tgatttgctcgggttttcca

SEQ ID NO: 666522 - DNA, 20 bp, Artificial
  CRISPR gRNA sequence
gatttgctcgggttttccac

SEQ ID NO: 666523 - DNA, 20 bp, Artificial
  CRISPR gRNA sequence
atttgctcgggttttccact

SEQ ID NO: 666524 - DNA, 20 bp, Artificial
  CRISPR gRNA sequence
gctcgggttttccactgatt

SEQ ID NO: 666525 - DNA, 20 bp, Artificial
  CRISPR gRNA sequence
ctcgggttttccactgattt

SEQ ID NO: 666526 - DNA, 20 bp, Artificial
  CRISPR gRNA sequence
gggttttccactgatttgac

SEQ ID NO: 666527 - DNA, 20 bp, Artificial
  CRISPR gRNA sequence
tccactgatttgacttcccc

SEQ ID NO: 666528 - DNA, 20 bp, Artificial
  CRISPR gRNA sequence
ccactgatttgacttcccct

SEQ ID NO: 666529 - DNA, 20 bp, Artificial
  CRISPR gRNA sequence
cactgatttgacttccccta

SEQ ID NO: 666530 - DNA, 20 bp, Artificial
  CRISPR gRNA sequence
atttgacttcccctaccttt

SEQ ID NO: 666531 - DNA, 20 bp, Artificial
  CRISPR gRNA sequence
gacttcccctaccttttgtt

SEQ ID NO: 666532 - DNA, 20 bp, Artificial
  CRISPR gRNA sequence
acttcccctaccttttgttt

SEQ ID NO: 666533 - DNA, 20 bp, Artificial
  CRISPR gRNA sequence
cccctaccttttgtttcaaa

SEQ ID NO: 666534 - DNA, 20 bp, Artificial
  CRISPR gRNA sequence
ccctaccttttgtttcaaaa

SEQ ID NO: 666535 - DNA, 20 bp, Artificial
  CRISPR gRNA sequence
ccttttgtttcaaaacctaa

SEQ ID NO: 666536 - DNA, 20 bp, Artificial
  CRISPR gRNA sequence
ttgtttcaaaacctaagatt

SEQ ID NO: 666537 - DNA, 20 bp, Artificial
  CRISPR gRNA sequence
tgtttcaaaacctaagatta

SEQ ID NO: 666538 - DNA, 20 bp, Artificial
  CRISPR gRNA sequence
gtttcaaaacctaagattac

SEQ ID NO: 666539 - DNA, 20 bp, Artificial
  CRISPR gRNA sequence
tttcaaaacctaagattacc

SEQ ID NO: 666540 - DNA, 20 bp, Artificial
  CRISPR gRNA sequence
caaaacctaagattaccact

SEQ ID NO: 666541 - DNA, 20 bp, Artificial
  CRISPR gRNA sequence
aaaacctaagattaccactt

SEQ ID NO: 666542 - DNA, 20 bp, Artificial
  CRISPR gRNA sequence
agattaccactttaagtgta

SEQ ID NO: 666543 - DNA, 20 bp, Artificial
  CRISPR gRNA sequence
ccactttaagtgtactggta

SEQ ID NO: 666544 - DNA, 20 bp, Artificial
  CRISPR gRNA sequence
taagtgtactggtattgtgg

SEQ ID NO: 666545 - DNA, 20 bp, Artificial
  CRISPR gRNA sequence
aagtgtactggtattgtgga

SEQ ID NO: 666546 - DNA, 20 bp, Artificial
  CRISPR gRNA sequence
agtgtactggtattgtggaa

SEQ ID NO: 666547 - DNA, 20 bp, Artificial
  CRISPR gRNA sequence
gtattgtggaaggtgtttta

SEQ ID NO: 666548 - DNA, 20 bp, Artificial
  CRISPR gRNA sequence
tggaaggtgttttattcaga

SEQ ID NO: 666549 - DNA, 20 bp, Artificial
  CRISPR gRNA sequence
tattcagaatagagtaaata

SEQ ID NO: 666550 - DNA, 20 bp, Artificial
  CRISPR gRNA sequence
attcagaatagagtaaatat

SEQ ID NO: 666551 - DNA, 20 bp, Artificial
  CRISPR gRNA sequence
ttcagaatagagtaaatata

SEQ ID NO: 666552 - DNA, 20 bp, Artificial
  CRISPR gRNA sequence
agaatagagtaaatatatat

SEQ ID NO: 666553 - DNA, 20 bp, Artificial
  CRISPR gRNA sequence
gagaatattatattgatatt

SEQ ID NO: 666554 - DNA, 20 bp, Artificial
  CRISPR gRNA sequence
tattgatattctccctattg

SEQ ID NO: 666555 - DNA, 20 bp, Artificial
  CRISPR gRNA sequence
atattctccctattgcatta

SEQ ID NO: 666556 - DNA, 20 bp, Artificial
  CRISPR gRNA sequence
tccctattgcattaacaggg

SEQ ID NO: 666557 - DNA, 20 bp, Artificial
  CRISPR gRNA sequence
cctattgcattaacagggag

SEQ ID NO: 666558 - DNA, 20 bp, Artificial
  CRISPR gRNA sequence
ttgcattaacagggagatct

SEQ ID NO: 666559 - DNA, 20 bp, Artificial
  CRISPR gRNA sequence
cattaacagggagatcttta

SEQ ID NO: 666560 - DNA, 20 bp, Artificial
  CRISPR gRNA sequence
acagggagatctttatggag

SEQ ID NO: 666561 - DNA, 20 bp, Artificial
  CRISPR gRNA sequence
tatggagcaaaggccagatc

SEQ ID NO: 666562 - DNA, 20 bp, Artificial
  CRISPR gRNA sequence
atggagcaaaggccagatca

SEQ ID NO: 666563 - DNA, 20 bp, Artificial
  CRISPR gRNA sequence
tggagcaaaggccagatcac

SEQ ID NO: 666564 - DNA, 20 bp, Artificial
  CRISPR gRNA sequence
aataaaaccacagtctgttt

SEQ ID NO: 666565 - DNA, 20 bp, Artificial
  CRISPR gRNA sequence
ataaaaccacagtctgtttt

SEQ ID NO: 666566 - DNA, 20 bp, Artificial
  CRISPR gRNA sequence
ttttttggcaatagtgttga

SEQ ID NO: 666567 - DNA, 20 bp, Artificial
  CRISPR gRNA sequence
tttggcaatagtgttgaacc

SEQ ID NO: 666568 - DNA, 20 bp, Artificial
  CRISPR gRNA sequence
ttggcaatagtgttgaacct

SEQ ID NO: 666569 - DNA, 20 bp, Artificial
  CRISPR gRNA sequence
tggcaatagtgttgaacctg

SEQ ID NO: 666570 - DNA, 20 bp, Artificial
  CRISPR gRNA sequence
ggcaatagtgttgaacctgg

SEQ ID NO: 666571 - DNA, 20 bp, Artificial
  CRISPR gRNA sequence
gcaatagtgttgaacctgga

SEQ ID NO: 666572 - DNA, 20 bp, Artificial
  CRISPR gRNA sequence
aacctggaggaaagccagtc

SEQ ID NO: 666573 - DNA, 20 bp, Artificial
  CRISPR gRNA sequence
gaggaaagccagtcttagcc

SEQ ID NO: 666574 - DNA, 20 bp, Artificial
  CRISPR gRNA sequence
agccagtataacgttagatt

SEQ ID NO: 666575 - DNA, 20 bp, Artificial
  CRISPR gRNA sequence
gccagtataacgttagattc

SEQ ID NO: 666576 - DNA, 20 bp, Artificial
  CRISPR gRNA sequence
gattccattccatcagcata

SEQ ID NO: 666577 - DNA, 20 bp, Artificial
  CRISPR gRNA sequence
cattccatcagcataatagt

SEQ ID NO: 666578 - DNA, 20 bp, Artificial
  CRISPR gRNA sequence
catcagcataatagttaata

SEQ ID NO: 666579 - DNA, 20 bp, Artificial
  CRISPR gRNA sequence
ataatagttgattgacaggg

SEQ ID NO: 666580 - DNA, 20 bp, Artificial
  CRISPR gRNA sequence
attgacagggatgtgaaggg

SEQ ID NO: 666581 - DNA, 20 bp, Artificial
  CRISPR gRNA sequence
acagggatgtgaagggtgcc

SEQ ID NO: 666582 - DNA, 20 bp, Artificial
  CRISPR gRNA sequence
ttttcctcccccctccactc

SEQ ID NO: 666583 - DNA, 20 bp, Artificial
  CRISPR gRNA sequence
ttcctcccccctccactccc

SEQ ID NO: 666584 - DNA, 20 bp, Artificial
  CRISPR gRNA sequence
tcctcccccctccactccca

SEQ ID NO: 666585 - DNA, 20 bp, Artificial
  CRISPR gRNA sequence
cctcccccctccactcccat

SEQ ID NO: 666586 - DNA, 20 bp, Artificial
  CRISPR gRNA sequence
ctcccccctccactcccatt

SEQ ID NO: 666587 - DNA, 20 bp, Artificial
  CRISPR gRNA sequence
ccccctccactcccattcca

SEQ ID NO: 666588 - DNA, 20 bp, Artificial
  CRISPR gRNA sequence
cactcccattccacactaaa

SEQ ID NO: 666589 - DNA, 20 bp, Artificial
  CRISPR gRNA sequence
ccattccacactaaactctc

SEQ ID NO: 666590 - DNA, 20 bp, Artificial
  CRISPR gRNA sequence
cacactaaactctctaggga

SEQ ID NO: 666591 - DNA, 20 bp, Artificial
  CRISPR gRNA sequence
aactctctagggaatgtgcc

SEQ ID NO: 666592 - DNA, 20 bp, Artificial
  CRISPR gRNA sequence
tctagggaatgtgccattcc

SEQ ID NO: 666593 - DNA, 20 bp, Artificial
  CRISPR gRNA sequence
tagggaatgtgccattcctt

SEQ ID NO: 666594 - DNA, 20 bp, Artificial
  CRISPR gRNA sequence
gggaatgtgccattccttta

SEQ ID NO: 666595 - DNA, 20 bp, Artificial
  CRISPR gRNA sequence
ctttacccattcctaaaatt

SEQ ID NO: 666596 - DNA, 20 bp, Artificial
  CRISPR gRNA sequence
tacccattcctaaaattctt

SEQ ID NO: 666597 - DNA, 20 bp, Artificial
  CRISPR gRNA sequence
acccattcctaaaattcttt

SEQ ID NO: 666598 - DNA, 20 bp, Artificial
  CRISPR gRNA sequence
cccattcctaaaattctttg

SEQ ID NO: 666599 - DNA, 20 bp, Artificial
  CRISPR gRNA sequence
ctaaaattctttgcttgagc

SEQ ID NO: 666600 - DNA, 20 bp, Artificial
  CRISPR gRNA sequence
aaattctttgcttgagcaca

SEQ ID NO: 666601 - DNA, 20 bp, Artificial
  CRISPR gRNA sequence
tttgcttgagcacagccaag

SEQ ID NO: 666602 - DNA, 20 bp, Artificial
  CRISPR gRNA sequence
tgcttgagcacagccaaggg

SEQ ID NO: 666603 - DNA, 20 bp, Artificial
  CRISPR gRNA sequence
gcttgagcacagccaagggc

SEQ ID NO: 666604 - DNA, 20 bp, Artificial
  CRISPR gRNA sequence
cttgagcacagccaagggct

SEQ ID NO: 666605 - DNA, 20 bp, Artificial
  CRISPR gRNA sequence
gagcacagccaagggctgct

SEQ ID NO: 666606 - DNA, 20 bp, Artificial
  CRISPR gRNA sequence
agcacagccaagggctgctg

SEQ ID NO: 666607 - DNA, 20 bp, Artificial
  CRISPR gRNA sequence
ctggactagtgcctgactgt

SEQ ID NO: 666608 - DNA, 20 bp, Artificial
  CRISPR gRNA sequence
gactagtgcctgactgtttg

SEQ ID NO: 666609 - DNA, 20 bp, Artificial
  CRISPR gRNA sequence
gtgcctgactgtttggaggc

SEQ ID NO: 666610 - DNA, 20 bp, Artificial
  CRISPR gRNA sequence
actgtttggaggctggagag

SEQ ID NO: 666611 - DNA, 20 bp, Artificial
  CRISPR gRNA sequence
tttggaggctggagagtagg

SEQ ID NO: 666612 - DNA, 20 bp, Artificial
  CRISPR gRNA sequence
ggaggctggagagtaggggg

SEQ ID NO: 666613 - DNA, 20 bp, Artificial
  CRISPR gRNA sequence
gaggctggagagtagggggt

SEQ ID NO: 666614 - DNA, 20 bp, Artificial
  CRISPR gRNA sequence
gagagtagggggtctctctg

SEQ ID NO: 666615 - DNA, 20 bp, Artificial
  CRISPR gRNA sequence
tctgaaagagttcctagtcc

SEQ ID NO: 666616 - DNA, 20 bp, Artificial
  CRISPR gRNA sequence
tgaaagagttcctagtccct

SEQ ID NO: 666617 - DNA, 20 bp, Artificial
  CRISPR gRNA sequence
aaagagttcctagtccctgt

SEQ ID NO: 666618 - DNA, 20 bp, Artificial
  CRISPR gRNA sequence
ctagtccctgtagtcgttgc

SEQ ID NO: 666619 - DNA, 20 bp, Artificial
  CRISPR gRNA sequence
gtccctgtagtcgttgctga

SEQ ID NO: 666620 - DNA, 20 bp, Artificial
  CRISPR gRNA sequence
tagtcgttgctgaggaagcc

SEQ ID NO: 666621 - DNA, 20 bp, Artificial
  CRISPR gRNA sequence
ctgaggaagcctagcaatct

SEQ ID NO: 666622 - DNA, 20 bp, Artificial
  CRISPR gRNA sequence
aggaagcctagcaatctctg

SEQ ID NO: 666623 - DNA, 20 bp, Artificial
  CRISPR gRNA sequence
gcaatctctggacatcttta

SEQ ID NO: 666624 - DNA, 20 bp, Artificial
  CRISPR gRNA sequence
tggacatctttagggatatg

SEQ ID NO: 666625 - DNA, 20 bp, Artificial
  CRISPR gRNA sequence
gacatctttagggatatgca

SEQ ID NO: 666626 - DNA, 20 bp, Artificial
  CRISPR gRNA sequence
tagggatatgcagtaaaggt

SEQ ID NO: 666627 - DNA, 20 bp, Artificial
  CRISPR gRNA sequence
agggatatgcagtaaaggtg

SEQ ID NO: 666628 - DNA, 20 bp, Artificial
  CRISPR gRNA sequence
gggatatgcagtaaaggtga

SEQ ID NO: 666629 - DNA, 20 bp, Artificial
  CRISPR gRNA sequence
ccgggctagtgtttatgtgt

SEQ ID NO: 666630 - DNA, 20 bp, Artificial
  CRISPR gRNA sequence
cgggctagtgtttatgtgtg

SEQ ID NO: 666631 - DNA, 20 bp, Artificial
  CRISPR gRNA sequence
gtgtttatgtgtgaaaaata

SEQ ID NO: 666632 - DNA, 20 bp, Artificial
  CRISPR gRNA sequence
atgtgtgaaaaataatcata

SEQ ID NO: 666633 - DNA, 20 bp, Artificial
  CRISPR gRNA sequence
tgtgtgaaaaataatcatac

SEQ ID NO: 666634 - DNA, 20 bp, Artificial
  CRISPR gRNA sequence
acctgaactaccttaatacc

SEQ ID NO: 666635 - DNA, 20 bp, Artificial
  CRISPR gRNA sequence
aactaccttaataccatggg

SEQ ID NO: 666636 - DNA, 20 bp, Artificial
  CRISPR gRNA sequence
ccttaataccatgggatcag

SEQ ID NO: 666637 - DNA, 20 bp, Artificial
  CRISPR gRNA sequence
aataccatgggatcaggatc

SEQ ID NO: 666638 - DNA, 20 bp, Artificial
  CRISPR gRNA sequence
ataccatgggatcaggatca

SEQ ID NO: 666639 - DNA, 20 bp, Artificial
  CRISPR gRNA sequence
ttgcttcccttcagccacac

SEQ ID NO: 666640 - DNA, 20 bp, Artificial
  CRISPR gRNA sequence
tgcttcccttcagccacaca

SEQ ID NO: 666641 - DNA, 20 bp, Artificial
  CRISPR gRNA sequence
gcttcccttcagccacacac

SEQ ID NO: 666642 - DNA, 20 bp, Artificial
  CRISPR gRNA sequence
cttcccttcagccacacaca

SEQ ID NO: 666643 - DNA, 20 bp, Artificial
  CRISPR gRNA sequence
cccttcagccacacacattc

SEQ ID NO: 666644 - DNA, 20 bp, Artificial
  CRISPR gRNA sequence
ccttcagccacacacattca

SEQ ID NO: 666645 - DNA, 20 bp, Artificial
  CRISPR gRNA sequence
cagccacacacattcatctt

SEQ ID NO: 666646 - DNA, 20 bp, Artificial
  CRISPR gRNA sequence
agccacacacattcatcttg

SEQ ID NO: 666647 - DNA, 20 bp, Artificial
  CRISPR gRNA sequence
atcttgtccacagaaattta

SEQ ID NO: 666648 - DNA, 20 bp, Artificial
  CRISPR gRNA sequence
gtccacagaaatttagagct

SEQ ID NO: 666649 - DNA, 20 bp, Artificial
  CRISPR gRNA sequence
tccacagaaatttagagctt

SEQ ID NO: 666650 - DNA, 20 bp, Artificial
  CRISPR gRNA sequence
agagcttattttagtctgtt

SEQ ID NO: 666651 - DNA, 20 bp, Artificial
  CRISPR gRNA sequence
gagcttattttagtctgttt

SEQ ID NO: 666652 - DNA, 20 bp, Artificial
  CRISPR gRNA sequence
attttagtctgttttttgta

SEQ ID NO: 666653 - DNA, 20 bp, Artificial
  CRISPR gRNA sequence
ttttagtctgttttttgtaa

SEQ ID NO: 666654 - DNA, 20 bp, Artificial
  CRISPR gRNA sequence
tagtctgttttttgtaaatc

SEQ ID NO: 666655 - DNA, 20 bp, Artificial
  CRISPR gRNA sequence
agtctgttttttgtaaatca

SEQ ID NO: 666656 - DNA, 20 bp, Artificial
  CRISPR gRNA sequence
gtctgttttttgtaaatcat

SEQ ID NO: 666657 - DNA, 20 bp, Artificial
  CRISPR gRNA sequence
ttttttgtaaatcatacatc

SEQ ID NO: 666658 - DNA, 20 bp, Artificial
  CRISPR gRNA sequence
tttgtaaatcatacatcata

SEQ ID NO: 666659 - DNA, 20 bp, Artificial
  CRISPR gRNA sequence
ttgtaaatcatacatcatat

SEQ ID NO: 666660 - DNA, 20 bp, Artificial
  CRISPR gRNA sequence
tgtaaatcatacatcatatc

SEQ ID NO: 666661 - DNA, 20 bp, Artificial
  CRISPR gRNA sequence
gtaaatcatacatcatatca

SEQ ID NO: 666662 - DNA, 20 bp, Artificial
  CRISPR gRNA sequence
taaatcatacatcatatcat

SEQ ID NO: 666663 - DNA, 20 bp, Artificial
  CRISPR gRNA sequence
ttttgcattgttaaaactat

SEQ ID NO: 666664 - DNA, 20 bp, Artificial
  CRISPR gRNA sequence
tgcattgttaaaactatatt

SEQ ID NO: 666665 - DNA, 20 bp, Artificial
  CRISPR gRNA sequence
gcattgttaaaactatattt

SEQ ID NO: 666666 - DNA, 20 bp, Artificial
  CRISPR gRNA sequence
cattgttaaaactatatttt

SEQ ID NO: 666667 - DNA, 20 bp, Artificial
  CRISPR gRNA sequence
ttaaaactatattttgttgg

SEQ ID NO: 666668 - DNA, 20 bp, Artificial
  CRISPR gRNA sequence
aaactatattttgttggtat

SEQ ID NO: 666669 - DNA, 20 bp, Artificial
  CRISPR gRNA sequence
tattttgttggtatttagta

SEQ ID NO: 666670 - DNA, 20 bp, Artificial
  CRISPR gRNA sequence
tgttggtatttagtactggt

SEQ ID NO: 666671 - DNA, 20 bp, Artificial
  CRISPR gRNA sequence
gttggtatttagtactggta

SEQ ID NO: 666672 - DNA, 20 bp, Artificial
  CRISPR gRNA sequence
ttggtatttagtactggtaa

SEQ ID NO: 666673 - DNA, 20 bp, Artificial
  CRISPR gRNA sequence
gtatttagtactggtaaatt

SEQ ID NO: 666674 - DNA, 20 bp, Artificial
  CRISPR gRNA sequence
agtactggtaaattagtaac

SEQ ID NO: 666675 - DNA, 20 bp, Artificial
  CRISPR gRNA sequence
gtactggtaaattagtaaca

SEQ ID NO: 666676 - DNA, 20 bp, Artificial
  CRISPR gRNA sequence
gtaaattagtaacatttgca

SEQ ID NO: 666677 - DNA, 20 bp, Artificial
  CRISPR gRNA sequence
gtaacatttgcagctttctt

SEQ ID NO: 666678 - DNA, 20 bp, Artificial
  CRISPR gRNA sequence
gcagctttcttccaactctt

SEQ ID NO: 666679 - DNA, 20 bp, Artificial
  CRISPR gRNA sequence
cagctttcttccaactcttt

SEQ ID NO: 666680 - DNA, 20 bp, Artificial
  CRISPR gRNA sequence
tcttccaactcttttttctt

SEQ ID NO: 666681 - DNA, 20 bp, Artificial
  CRISPR gRNA sequence
cttccaactcttttttcttt

SEQ ID NO: 666682 - DNA, 20 bp, Artificial
  CRISPR gRNA sequence
ttccaactcttttttctttt

SEQ ID NO: 666683 - DNA, 20 bp, Artificial
  CRISPR gRNA sequence
ccaactcttttttctttttg

SEQ ID NO: 666684 - DNA, 20 bp, Artificial
  CRISPR gRNA sequence
caactcttttttctttttgg

SEQ ID NO: 666685 - DNA, 20 bp, Artificial
  CRISPR gRNA sequence
ttttttctttttggatgtag

SEQ ID NO: 666686 - DNA, 20 bp, Artificial
  CRISPR gRNA sequence
ttttctttttggatgtaggt

SEQ ID NO: 666687 - DNA, 20 bp, Artificial
  CRISPR gRNA sequence
tttctttttggatgtaggta

SEQ ID NO: 666688 - DNA, 20 bp, Artificial
  CRISPR gRNA sequence
ttctttttggatgtaggtat

SEQ ID NO: 666689 - DNA, 20 bp, Artificial
  CRISPR gRNA sequence
tctttttggatgtaggtatt

SEQ ID NO: 666690 - DNA, 20 bp, Artificial
  CRISPR gRNA sequence
ctttttggatgtaggtattt

SEQ ID NO: 666691 - DNA, 20 bp, Artificial
  CRISPR gRNA sequence
tttttggatgtaggtatttg

SEQ ID NO: 666692 - DNA, 20 bp, Artificial
  CRISPR gRNA sequence
tttggatgtaggtatttgca

SEQ ID NO: 666693 - DNA, 20 bp, Artificial
  CRISPR gRNA sequence
ttggatgtaggtatttgcag

SEQ ID NO: 666694 - DNA, 20 bp, Artificial
  CRISPR gRNA sequence
tggatgtaggtatttgcagg

SEQ ID NO: 666695 - DNA, 20 bp, Artificial
  CRISPR gRNA sequence
ggatgtaggtatttgcagga

SEQ ID NO: 666696 - DNA, 20 bp, Artificial
  CRISPR gRNA sequence
gatgtaggtatttgcaggat

SEQ ID NO: 666697 - DNA, 20 bp, Artificial
  CRISPR gRNA sequence
gcaggatatgaactattcaa

SEQ ID NO: 666698 - DNA, 20 bp, Artificial
  CRISPR gRNA sequence
caggatatgaactattcaaa

SEQ ID NO: 666699 - DNA, 20 bp, Artificial
  CRISPR gRNA sequence
ttcaaacagttacagcattc

SEQ ID NO: 666700 - DNA, 20 bp, Artificial
  CRISPR gRNA sequence
aaacagttacagcattccag

SEQ ID NO: 666701 - DNA, 20 bp, Artificial
  CRISPR gRNA sequence
cagcattccagggattcttt

SEQ ID NO: 666702 - DNA, 20 bp, Artificial
  CRISPR gRNA sequence
cagggattctttccctggat

SEQ ID NO: 666703 - DNA, 20 bp, Artificial
  CRISPR gRNA sequence
tttccctggattctacatgc

SEQ ID NO: 666704 - DNA, 20 bp, Artificial
  CRISPR gRNA sequence
tccctggattctacatgctc

SEQ ID NO: 666705 - DNA, 20 bp, Artificial
  CRISPR gRNA sequence
ccctggattctacatgctca

SEQ ID NO: 666706 - DNA, 20 bp, Artificial
  CRISPR gRNA sequence
cctggattctacatgctcac

SEQ ID NO: 666707 - DNA, 20 bp, Artificial
  CRISPR gRNA sequence
gattctacatgctcacatgg

SEQ ID NO: 666708 - DNA, 20 bp, Artificial
  CRISPR gRNA sequence
tacatgctcacatggagtta

SEQ ID NO: 666709 - DNA, 20 bp, Artificial
  CRISPR gRNA sequence
catgctcacatggagttata

SEQ ID NO: 666710 - DNA, 20 bp, Artificial
  CRISPR gRNA sequence
acatggagttatatttgaat

SEQ ID NO: 666711 - DNA, 20 bp, Artificial
  CRISPR gRNA sequence
tatttgaataccaagaagta

SEQ ID NO: 666712 - DNA, 20 bp, Artificial
  CRISPR gRNA sequence
gaataccaagaagtattgtt

SEQ ID NO: 666713 - DNA, 20 bp, Artificial
  CRISPR gRNA sequence
aataccaagaagtattgttg

SEQ ID NO: 666714 - DNA, 20 bp, Artificial
  CRISPR gRNA sequence
ttgaatattgctgaacataa

SEQ ID NO: 666715 - DNA, 20 bp, Artificial
  CRISPR gRNA sequence
aatattgctgaacataaggt

SEQ ID NO: 666716 - DNA, 20 bp, Artificial
  CRISPR gRNA sequence
ctgaacataaggttcactag

SEQ ID NO: 666717 - DNA, 20 bp, Artificial
  CRISPR gRNA sequence
aacataaggttcactagtac

SEQ ID NO: 666718 - DNA, 20 bp, Artificial
  CRISPR gRNA sequence
actagtacagtgttttaggt

SEQ ID NO: 666719 - DNA, 20 bp, Artificial
  CRISPR gRNA sequence
gtacagtgttttaggtgaaa

SEQ ID NO: 666720 - DNA, 20 bp, Artificial
  CRISPR gRNA sequence
taggtgaaaattcaaaagtt

SEQ ID NO: 666721 - DNA, 20 bp, Artificial
  CRISPR gRNA sequence
aggtgaaaattcaaaagttt

SEQ ID NO: 666722 - DNA, 20 bp, Artificial
  CRISPR gRNA sequence
ggtgaaaattcaaaagtttt

SEQ ID NO: 666723 - DNA, 20 bp, Artificial
  CRISPR gRNA sequence
aaaagtttttttccaagtcc

SEQ ID NO: 666724 - DNA, 20 bp, Artificial
  CRISPR gRNA sequence
ttttccaagtccaagtaatt

SEQ ID NO: 666725 - DNA, 20 bp, Artificial
  CRISPR gRNA sequence
tttccaagtccaagtaattt

SEQ ID NO: 666726 - DNA, 20 bp, Artificial
  CRISPR gRNA sequence
ttccaagtccaagtaattta

SEQ ID NO: 666727 - DNA, 20 bp, Artificial
  CRISPR gRNA sequence
tccaagtccaagtaatttat

SEQ ID NO: 666728 - DNA, 20 bp, Artificial
  CRISPR gRNA sequence
ccaagtccaagtaatttatg

SEQ ID NO: 666729 - DNA, 20 bp, Artificial
  CRISPR gRNA sequence
caagtccaagtaatttatgt

SEQ ID NO: 666730 - DNA, 20 bp, Artificial
  CRISPR gRNA sequence
atgtttttagtggagtaatg

SEQ ID NO: 666731 - DNA, 20 bp, Artificial
  CRISPR gRNA sequence
tgtttttagtggagtaatga

SEQ ID NO: 666732 - DNA, 20 bp, Artificial
  CRISPR gRNA sequence
ttagtggagtaatgattcct

SEQ ID NO: 666733 - DNA, 20 bp, Artificial
  CRISPR gRNA sequence
tagtggagtaatgattccta

SEQ ID NO: 666734 - DNA, 20 bp, Artificial
  CRISPR gRNA sequence
agtggagtaatgattcctat

SEQ ID NO: 666735 - DNA, 20 bp, Artificial
  CRISPR gRNA sequence
gtggagtaatgattcctata

SEQ ID NO: 666736 - DNA, 20 bp, Artificial
  CRISPR gRNA sequence
ctatactaagcagttttgtt

SEQ ID NO: 666737 - DNA, 20 bp, Artificial
  CRISPR gRNA sequence
tactaagcagttttgttttc

SEQ ID NO: 666738 - DNA, 20 bp, Artificial
  CRISPR gRNA sequence
agcagttttgttttctttaa

SEQ ID NO: 666739 - DNA, 20 bp, Artificial
  CRISPR gRNA sequence
tgttttctttaatttggtga

SEQ ID NO: 666740 - DNA, 20 bp, Artificial
  CRISPR gRNA sequence
gttttctttaatttggtgaa

SEQ ID NO: 666741 - DNA, 20 bp, Artificial
  CRISPR gRNA sequence
ttttctttaatttggtgaag

SEQ ID NO: 666742 - DNA, 20 bp, Artificial
  CRISPR gRNA sequence
tctttaatttggtgaagtta

SEQ ID NO: 666743 - DNA, 20 bp, Artificial
  CRISPR gRNA sequence
ctttaatttggtgaagttag

SEQ ID NO: 666744 - DNA, 20 bp, Artificial
  CRISPR gRNA sequence
tttaatttggtgaagttagc

SEQ ID NO: 666745 - DNA, 20 bp, Artificial
  CRISPR gRNA sequence
taatttggtgaagttagcat

SEQ ID NO: 666746 - DNA, 20 bp, Artificial
  CRISPR gRNA sequence
aatttggtgaagttagcatt

SEQ ID NO: 666747 - DNA, 20 bp, Artificial
  CRISPR gRNA sequence
atttggtgaagttagcattt

SEQ ID NO: 666748 - DNA, 20 bp, Artificial
  CRISPR gRNA sequence
ggtgaagttagcatttggtg

SEQ ID NO: 666749 - DNA, 20 bp, Artificial
  CRISPR gRNA sequence
gtgaagttagcatttggtgt

SEQ ID NO: 666750 - DNA, 20 bp, Artificial
  CRISPR gRNA sequence
gcatttggtgttgccctcag

SEQ ID NO: 666751 - DNA, 20 bp, Artificial
  CRISPR gRNA sequence
ggtgttgccctcagtttggg

SEQ ID NO: 666752 - DNA, 20 bp, Artificial
  CRISPR gRNA sequence
gtgttgccctcagtttgggt

SEQ ID NO: 666753 - DNA, 20 bp, Artificial
  CRISPR gRNA sequence
ccctcagtttgggttagcaa

SEQ ID NO: 666754 - DNA, 20 bp, Artificial
  CRISPR gRNA sequence
agtttgggttagcaattatt

SEQ ID NO: 666755 - DNA, 20 bp, Artificial
  CRISPR gRNA sequence
gggttagcaattattcttta

SEQ ID NO: 666756 - DNA, 20 bp, Artificial
  CRISPR gRNA sequence
ggttagcaattattctttac

SEQ ID NO: 666757 - DNA, 20 bp, Artificial
  CRISPR gRNA sequence
gcaattattctttaccccac

SEQ ID NO: 666758 - DNA, 20 bp, Artificial
  CRISPR gRNA sequence
ttctttaccccacgtctcac

SEQ ID NO: 666759 - DNA, 20 bp, Artificial
  CRISPR gRNA sequence
tttaccccacgtctcaccac

SEQ ID NO: 666760 - DNA, 20 bp, Artificial
  CRISPR gRNA sequence
taccccacgtctcaccactg

SEQ ID NO: 666761 - DNA, 20 bp, Artificial
  CRISPR gRNA sequence
accccacgtctcaccactgc

SEQ ID NO: 666762 - DNA, 20 bp, Artificial
  CRISPR gRNA sequence
ccccacgtctcaccactgca

SEQ ID NO: 666763 - DNA, 20 bp, Artificial
  CRISPR gRNA sequence
accactgcagaaccacttgc

SEQ ID NO: 666764 - DNA, 20 bp, Artificial
  CRISPR gRNA sequence
cagaaccacttgctaacttt

SEQ ID NO: 666765 - DNA, 20 bp, Artificial
  CRISPR gRNA sequence
gctaacttttaatcaccacc

SEQ ID NO: 666766 - DNA, 20 bp, Artificial
  CRISPR gRNA sequence
ctaacttttaatcaccacct

SEQ ID NO: 666767 - DNA, 20 bp, Artificial
  CRISPR gRNA sequence
acttttaatcaccaccttct

SEQ ID NO: 666768 - DNA, 20 bp, Artificial
  CRISPR gRNA sequence
ttaatcaccaccttctcaag

SEQ ID NO: 666769 - DNA, 20 bp, Artificial
  CRISPR gRNA sequence
taatcaccaccttctcaagt

SEQ ID NO: 666770 - DNA, 20 bp, Artificial
  CRISPR gRNA sequence
aatcaccaccttctcaagtt

SEQ ID NO: 666771 - DNA, 20 bp, Artificial
  CRISPR gRNA sequence
atcaccaccttctcaagttt

SEQ ID NO: 666772 - DNA, 20 bp, Artificial
  CRISPR gRNA sequence
ctcaagtttaagaacttggc

SEQ ID NO: 666773 - DNA, 20 bp, Artificial
  CRISPR gRNA sequence
tcaagtttaagaacttggcc

SEQ ID NO: 666774 - DNA, 20 bp, Artificial
  CRISPR gRNA sequence
aagtttaagaacttggccag

SEQ ID NO: 666775 - DNA, 20 bp, Artificial
  CRISPR gRNA sequence
aagaacttggccagagtgat

SEQ ID NO: 666776 - DNA, 20 bp, Artificial
  CRISPR gRNA sequence
agaacttggccagagtgatc

SEQ ID NO: 666777 - DNA, 20 bp, Artificial
  CRISPR gRNA sequence
ggccagagtgatcccggaaa

SEQ ID NO: 666778 - DNA, 20 bp, Artificial
  CRISPR gRNA sequence
gccagagtgatcccggaaag

SEQ ID NO: 666779 - DNA, 20 bp, Artificial
  CRISPR gRNA sequence
aacattttccagtgagtaaa

SEQ ID NO: 666780 - DNA, 20 bp, Artificial
  CRISPR gRNA sequence
tccagtgagtaaagtccatc

SEQ ID NO: 666781 - DNA, 20 bp, Artificial
  CRISPR gRNA sequence
ccagtgagtaaagtccatct

SEQ ID NO: 666782 - DNA, 20 bp, Artificial
  CRISPR gRNA sequence
cagtgagtaaagtccatctc

SEQ ID NO: 666783 - DNA, 20 bp, Artificial
  CRISPR gRNA sequence
ttttggagatcttgacacct

SEQ ID NO: 666784 - DNA, 20 bp, Artificial
  CRISPR gRNA sequence
ttggagatcttgacacctat

SEQ ID NO: 666785 - DNA, 20 bp, Artificial
  CRISPR gRNA sequence
tggagatcttgacacctatc

SEQ ID NO: 666786 - DNA, 20 bp, Artificial
  CRISPR gRNA sequence
ggagatcttgacacctatca

SEQ ID NO: 666787 - DNA, 20 bp, Artificial
  CRISPR gRNA sequence
gagatcttgacacctatcat

SEQ ID NO: 666788 - DNA, 20 bp, Artificial
  CRISPR gRNA sequence
gacacctatcattaacaagg

SEQ ID NO: 666789 - DNA, 20 bp, Artificial
  CRISPR gRNA sequence
acacctatcattaacaaggc

SEQ ID NO: 666790 - DNA, 20 bp, Artificial
  CRISPR gRNA sequence
tcattaacaaggctgcaacc

SEQ ID NO: 666791 - DNA, 20 bp, Artificial
  CRISPR gRNA sequence
acaaggctgcaacctcctta

SEQ ID NO: 666792 - DNA, 20 bp, Artificial
  CRISPR gRNA sequence
caacctccttaaggataatc

SEQ ID NO: 666793 - DNA, 20 bp, Artificial
  CRISPR gRNA sequence
cttaaggataatcgagaaag

SEQ ID NO: 666794 - DNA, 20 bp, Artificial
  CRISPR gRNA sequence
aaggataatcgagaaaggag

SEQ ID NO: 666795 - DNA, 20 bp, Artificial
  CRISPR gRNA sequence
aggataatcgagaaaggaga

SEQ ID NO: 666796 - DNA, 20 bp, Artificial
  CRISPR gRNA sequence
ctcttctgtatgtatagcaa

SEQ ID NO: 666797 - DNA, 20 bp, Artificial
  CRISPR gRNA sequence
ttctgtatgtatagcaaaac

SEQ ID NO: 666798 - DNA, 20 bp, Artificial
  CRISPR gRNA sequence
ctgtatgtatagcaaaacat

SEQ ID NO: 666799 - DNA, 20 bp, Artificial
  CRISPR gRNA sequence
tgtatgtatagcaaaacata

SEQ ID NO: 666800 - DNA, 20 bp, Artificial
  CRISPR gRNA sequence
tatgtatagcaaaacataaa

SEQ ID NO: 666801 - DNA, 20 bp, Artificial
  CRISPR gRNA sequence
tacagcaggatgcgatagtt

SEQ ID NO: 666802 - DNA, 20 bp, Artificial
  CRISPR gRNA sequence
ttaaatagagtgcatgcatt

SEQ ID NO: 666803 - DNA, 20 bp, Artificial
  CRISPR gRNA sequence
aaatagagtgcatgcattgt

SEQ ID NO: 666804 - DNA, 20 bp, Artificial
  CRISPR gRNA sequence
aatagagtgcatgcattgtc

SEQ ID NO: 666805 - DNA, 20 bp, Artificial
  CRISPR gRNA sequence
tctggcaggctgacccaaca

SEQ ID NO: 666806 - DNA, 20 bp, Artificial
  CRISPR gRNA sequence
gcaggctgacccaacatcgt

SEQ ID NO: 666807 - DNA, 20 bp, Artificial
  CRISPR gRNA sequence
acccaacatcgtgttgcctc

SEQ ID NO: 666808 - DNA, 20 bp, Artificial
  CRISPR gRNA sequence
cctccttcattctacagatt

SEQ ID NO: 666809 - DNA, 20 bp, Artificial
  CRISPR gRNA sequence
cttcattctacagattatgt

SEQ ID NO: 666810 - DNA, 20 bp, Artificial
  CRISPR gRNA sequence
cattctacagattatgttat

SEQ ID NO: 666811 - DNA, 20 bp, Artificial
  CRISPR gRNA sequence
attctacagattatgttatg

SEQ ID NO: 666812 - DNA, 20 bp, Artificial
  CRISPR gRNA sequence
tacagattatgttatgggtt

SEQ ID NO: 666813 - DNA, 20 bp, Artificial
  CRISPR gRNA sequence
cagattatgttatgggtttc

SEQ ID NO: 666814 - DNA, 20 bp, Artificial
  CRISPR gRNA sequence
tgttatgggtttcaggtgtt

SEQ ID NO: 666815 - DNA, 20 bp, Artificial
  CRISPR gRNA sequence
tgggtttcaggtgtttttct

SEQ ID NO: 666816 - DNA, 20 bp, Artificial
  CRISPR gRNA sequence
caggtgtttttctcaggtca

SEQ ID NO: 666817 - DNA, 20 bp, Artificial
  CRISPR gRNA sequence
aggtgtttttctcaggtcag

SEQ ID NO: 666818 - DNA, 20 bp, Artificial
  CRISPR gRNA sequence
ttctcaggtcagtttcccta

SEQ ID NO: 666819 - DNA, 20 bp, Artificial
  CRISPR gRNA sequence
tctcaggtcagtttccctat

SEQ ID NO: 666820 - DNA, 20 bp, Artificial
  CRISPR gRNA sequence
ctcaggtcagtttccctatc

SEQ ID NO: 666821 - DNA, 20 bp, Artificial
  CRISPR gRNA sequence
tcaggtcagtttccctatca

SEQ ID NO: 666822 - DNA, 20 bp, Artificial
  CRISPR gRNA sequence
aggtcagtttccctatcatt

SEQ ID NO: 666823 - DNA, 20 bp, Artificial
  CRISPR gRNA sequence
ccctatcattaatgctgcaa

SEQ ID NO: 666824 - DNA, 20 bp, Artificial
  CRISPR gRNA sequence
cctatcattaatgctgcaac

SEQ ID NO: 666825 - DNA, 20 bp, Artificial
  CRISPR gRNA sequence
tcattaatgctgcaacacct

SEQ ID NO: 666826 - DNA, 20 bp, Artificial
  CRISPR gRNA sequence
atgctgcaacaccttcactg

SEQ ID NO: 666827 - DNA, 20 bp, Artificial
  CRISPR gRNA sequence
caacaccttcactgagtaga

SEQ ID NO: 666828 - DNA, 20 bp, Artificial
  CRISPR gRNA sequence
cactgagtagatatccactc

SEQ ID NO: 666829 - DNA, 20 bp, Artificial
  CRISPR gRNA sequence
actgagtagatatccactct

SEQ ID NO: 666830 - DNA, 20 bp, Artificial
  CRISPR gRNA sequence
agtagatatccactctctca

SEQ ID NO: 666831 - DNA, 20 bp, Artificial
  CRISPR gRNA sequence
tctcattcttttattacacc

SEQ ID NO: 666832 - DNA, 20 bp, Artificial
  CRISPR gRNA sequence
tcattcttttattacaccat

SEQ ID NO: 666833 - DNA, 20 bp, Artificial
  CRISPR gRNA sequence
attcttttattacaccatgg

SEQ ID NO: 666834 - DNA, 20 bp, Artificial
  CRISPR gRNA sequence
ttttattacaccatggtgaa

SEQ ID NO: 666835 - DNA, 20 bp, Artificial
  CRISPR gRNA sequence
ttattacaccatggtgaaac

SEQ ID NO: 666836 - DNA, 20 bp, Artificial
  CRISPR gRNA sequence
tattacaccatggtgaaacc

SEQ ID NO: 666837 - DNA, 20 bp, Artificial
  CRISPR gRNA sequence
attacaccatggtgaaacca

SEQ ID NO: 666838 - DNA, 20 bp, Artificial
  CRISPR gRNA sequence
ttacaccatggtgaaaccag

SEQ ID NO: 666839 - DNA, 20 bp, Artificial
  CRISPR gRNA sequence
caccatggtgaaaccagcac

SEQ ID NO: 666840 - DNA, 20 bp, Artificial
  CRISPR gRNA sequence
ccaactctcatgagttgatg

SEQ ID NO: 666841 - DNA, 20 bp, Artificial
  CRISPR gRNA sequence
tcatgagttgatgaataaac

SEQ ID NO: 666842 - DNA, 20 bp, Artificial
  CRISPR gRNA sequence
atgagttgatgaataaactc

SEQ ID NO: 666843 - DNA, 20 bp, Artificial
  CRISPR gRNA sequence
atgaataaactctaatttta

SEQ ID NO: 666844 - DNA, 20 bp, Artificial
  CRISPR gRNA sequence
taattttactgcatttataa

SEQ ID NO: 666845 - DNA, 20 bp, Artificial
  CRISPR gRNA sequence
attttactgcatttataaat

SEQ ID NO: 666846 - DNA, 20 bp, Artificial
  CRISPR gRNA sequence
tactgcatttataaatgaaa

SEQ ID NO: 666847 - DNA, 20 bp, Artificial
  CRISPR gRNA sequence
actgcatttataaatgaaac

SEQ ID NO: 666848 - DNA, 20 bp, Artificial
  CRISPR gRNA sequence
ctgcatttataaatgaaact

SEQ ID NO: 666849 - DNA, 20 bp, Artificial
  CRISPR gRNA sequence
catttataaatgaaacttta

SEQ ID NO: 666850 - DNA, 20 bp, Artificial
  CRISPR gRNA sequence
ataaatgaaactttaaaaat

SEQ ID NO: 666851 - DNA, 20 bp, Artificial
  CRISPR gRNA sequence
taaatgaaactttaaaaata

SEQ ID NO: 666852 - DNA, 20 bp, Artificial
  CRISPR gRNA sequence
taaaaatagtttctggaata

SEQ ID NO: 666853 - DNA, 20 bp, Artificial
  CRISPR gRNA sequence
aaaaatagtttctggaataa

SEQ ID NO: 666854 - DNA, 20 bp, Artificial
  CRISPR gRNA sequence
aaaatagtttctggaataag

SEQ ID NO: 666855 - DNA, 20 bp, Artificial
  CRISPR gRNA sequence
ctggaataagatcatggtga

SEQ ID NO: 666856 - DNA, 20 bp, Artificial
  CRISPR gRNA sequence
tggaataagatcatggtgaa

SEQ ID NO: 666857 - DNA, 20 bp, Artificial
  CRISPR gRNA sequence
gaataagatcatggtgaata

SEQ ID NO: 666858 - DNA, 20 bp, Artificial
  CRISPR gRNA sequence
actagattttttaaacaaag

SEQ ID NO: 666859 - DNA, 20 bp, Artificial
  CRISPR gRNA sequence
gattttttaaacaaagccat

SEQ ID NO: 666860 - DNA, 20 bp, Artificial
  CRISPR gRNA sequence
tttaaacaaagccatgttta

SEQ ID NO: 666861 - DNA, 20 bp, Artificial
  CRISPR gRNA sequence
ttaaacaaagccatgtttaa

SEQ ID NO: 666862 - DNA, 20 bp, Artificial
  CRISPR gRNA sequence
taaacaaagccatgtttaaa

SEQ ID NO: 666863 - DNA, 20 bp, Artificial
  CRISPR gRNA sequence
aaacaaagccatgtttaaat

SEQ ID NO: 666864 - DNA, 20 bp, Artificial
  CRISPR gRNA sequence
aacaaagccatgtttaaatg

SEQ ID NO: 666865 - DNA, 20 bp, Artificial
  CRISPR gRNA sequence
aaatgaatcatattgaaata

SEQ ID NO: 666866 - DNA, 20 bp, Artificial
  CRISPR gRNA sequence
aatgaatcatattgaaatac

SEQ ID NO: 666867 - DNA, 20 bp, Artificial
  CRISPR gRNA sequence
aaatacattaatatatttag

SEQ ID NO: 666868 - DNA, 20 bp, Artificial
  CRISPR gRNA sequence
atatatttagtgttggtatg

SEQ ID NO: 666869 - DNA, 20 bp, Artificial
  CRISPR gRNA sequence
agtgttggtatgttaatata

SEQ ID NO: 666870 - DNA, 20 bp, Artificial
  CRISPR gRNA sequence
gtgttggtatgttaatatat

SEQ ID NO: 666871 - DNA, 20 bp, Artificial
  CRISPR gRNA sequence
gtatgttaatatataagcca

SEQ ID NO: 666872 - DNA, 20 bp, Artificial
  CRISPR gRNA sequence
atatataagccatttatacc

SEQ ID NO: 666873 - DNA, 20 bp, Artificial
  CRISPR gRNA sequence
ataccctaagatgtcaatag

SEQ ID NO: 666874 - DNA, 20 bp, Artificial
  CRISPR gRNA sequence
taccctaagatgtcaatagt

SEQ ID NO: 666875 - DNA, 20 bp, Artificial
  CRISPR gRNA sequence
agatgtcaatagtgtcactt

SEQ ID NO: 666876 - DNA, 20 bp, Artificial
  CRISPR gRNA sequence
gccttgctggcaaatttggc

SEQ ID NO: 666877 - DNA, 20 bp, Artificial
  CRISPR gRNA sequence
ccttgctggcaaatttggct

SEQ ID NO: 666878 - DNA, 20 bp, Artificial
  CRISPR gRNA sequence
gctggcaaatttggctcata

SEQ ID NO: 666879 - DNA, 20 bp, Artificial
  CRISPR gRNA sequence
ctggcaaatttggctcataa

SEQ ID NO: 666880 - DNA, 20 bp, Artificial
  CRISPR gRNA sequence
gcaaatttggctcataataa

SEQ ID NO: 666881 - DNA, 20 bp, Artificial
  CRISPR gRNA sequence
ggctcataataagaacatgt

SEQ ID NO: 666882 - DNA, 20 bp, Artificial
  CRISPR gRNA sequence
gctcataataagaacatgtg

SEQ ID NO: 666883 - DNA, 20 bp, Artificial
  CRISPR gRNA sequence
ataataagaacatgtgtcca

SEQ ID NO: 666884 - DNA, 20 bp, Artificial
  CRISPR gRNA sequence
tttgtttaaaaacatacata

SEQ ID NO: 666885 - DNA, 20 bp, Artificial
  CRISPR gRNA sequence
ttgtttaaaaacatacataa

SEQ ID NO: 666886 - DNA, 20 bp, Artificial
  CRISPR gRNA sequence
tgtttaaaaacatacataat

SEQ ID NO: 666887 - DNA, 20 bp, Artificial
  CRISPR gRNA sequence
gtttaaaaacatacataatt

SEQ ID NO: 666888 - DNA, 20 bp, Artificial
  CRISPR gRNA sequence
tttaaaaacatacataattt

SEQ ID NO: 666889 - DNA, 20 bp, Artificial
  CRISPR gRNA sequence
aaaaacatacataatttgaa

SEQ ID NO: 666890 - DNA, 20 bp, Artificial
  CRISPR gRNA sequence
aaaacatacataatttgaaa

SEQ ID NO: 666891 - DNA, 20 bp, Artificial
  CRISPR gRNA sequence
gaaaaatatttaattgctct

SEQ ID NO: 666892 - DNA, 20 bp, Artificial
  CRISPR gRNA sequence
aaaaatatttaattgctctt

SEQ ID NO: 666893 - DNA, 20 bp, Artificial
  CRISPR gRNA sequence
aattgctctttagtgccttt

SEQ ID NO: 666894 - DNA, 20 bp, Artificial
  CRISPR gRNA sequence
attgctctttagtgcctttt

SEQ ID NO: 666895 - DNA, 20 bp, Artificial
  CRISPR gRNA sequence
ctctttagtgccttttaata

SEQ ID NO: 666896 - DNA, 20 bp, Artificial
  CRISPR gRNA sequence
tttagtgccttttaataaaa

SEQ ID NO: 666897 - DNA, 20 bp, Artificial
  CRISPR gRNA sequence
tagtgccttttaataaaaga

SEQ ID NO: 666898 - DNA, 20 bp, Artificial
  CRISPR gRNA sequence
agtgccttttaataaaagaa

SEQ ID NO: 666899 - DNA, 20 bp, Artificial
  CRISPR gRNA sequence
gtgccttttaataaaagaag

SEQ ID NO: 666900 - DNA, 20 bp, Artificial
  CRISPR gRNA sequence
ttaataaaagaaggagctca

SEQ ID NO: 666901 - DNA, 20 bp, Artificial
  CRISPR gRNA sequence
taataaaagaaggagctcac

SEQ ID NO: 666902 - DNA, 20 bp, Artificial
  CRISPR gRNA sequence
aataaaagaaggagctcacc

SEQ ID NO: 666903 - DNA, 20 bp, Artificial
  CRISPR gRNA sequence
ataaaagaaggagctcacct

SEQ ID NO: 666904 - DNA, 20 bp, Artificial
  CRISPR gRNA sequence
acctttcgattttaaaaatg

SEQ ID NO: 666905 - DNA, 20 bp, Artificial
  CRISPR gRNA sequence
tcgattttaaaaatgcttac

SEQ ID NO: 666906 - DNA, 20 bp, Artificial
  CRISPR gRNA sequence
cgattttaaaaatgcttact

SEQ ID NO: 666907 - DNA, 20 bp, Artificial
  CRISPR gRNA sequence
gattttaaaaatgcttacta

SEQ ID NO: 666908 - DNA, 20 bp, Artificial
  CRISPR gRNA sequence
taaaaatgcttactaaaaat

SEQ ID NO: 666909 - DNA, 20 bp, Artificial
  CRISPR gRNA sequence
aaaaatgcttactaaaaatt

SEQ ID NO: 666910 - DNA, 20 bp, Artificial
  CRISPR gRNA sequence
aaaatgcttactaaaaattg

SEQ ID NO: 666911 - DNA, 20 bp, Artificial
  CRISPR gRNA sequence
actaaaaattgcttttaaca

SEQ ID NO: 666912 - DNA, 20 bp, Artificial
  CRISPR gRNA sequence
ctaaaaattgcttttaacat

SEQ ID NO: 666913 - DNA, 20 bp, Artificial
  CRISPR gRNA sequence
aaaattgcttttaacatcat

SEQ ID NO: 666914 - DNA, 20 bp, Artificial
  CRISPR gRNA sequence
cttttaacatcatctgtttc

SEQ ID NO: 666915 - DNA, 20 bp, Artificial
  CRISPR gRNA sequence
ttaacatcatctgtttctaa

SEQ ID NO: 666916 - DNA, 20 bp, Artificial
  CRISPR gRNA sequence
taacatcatctgtttctaag

SEQ ID NO: 666917 - DNA, 20 bp, Artificial
  CRISPR gRNA sequence
aacatcatctgtttctaagt

SEQ ID NO: 666918 - DNA, 20 bp, Artificial
  CRISPR gRNA sequence
acatcatctgtttctaagtg

SEQ ID NO: 666919 - DNA, 20 bp, Artificial
  CRISPR gRNA sequence
tttctaagtgtttctaagtg

SEQ ID NO: 666920 - DNA, 20 bp, Artificial
  CRISPR gRNA sequence
ctaagtgtttctaagtgttt

SEQ ID NO: 666921 - DNA, 20 bp, Artificial
  CRISPR gRNA sequence
taagtgtttctaagtgtttt

SEQ ID NO: 666922 - DNA, 20 bp, Artificial
  CRISPR gRNA sequence
agtgtttctaagtgttttaa

SEQ ID NO: 666923 - DNA, 20 bp, Artificial
  CRISPR gRNA sequence
ctaagtgttttaaaagagaa

SEQ ID NO: 666924 - DNA, 20 bp, Artificial
  CRISPR gRNA sequence
taagtgttttaaaagagaaa

SEQ ID NO: 666925 - DNA, 20 bp, Artificial
  CRISPR gRNA sequence
agtgttttaaaagagaaaga

SEQ ID NO: 666926 - DNA, 20 bp, Artificial
  CRISPR gRNA sequence
taaaagagaaagatgacttg

SEQ ID NO: 666927 - DNA, 20 bp, Artificial
  CRISPR gRNA sequence
aaaagagaaagatgacttgg

SEQ ID NO: 666928 - DNA, 20 bp, Artificial
  CRISPR gRNA sequence
aaagagaaagatgacttggg

SEQ ID NO: 666929 - DNA, 20 bp, Artificial
  CRISPR gRNA sequence
ggggaagaattcaacttgat

SEQ ID NO: 666930 - DNA, 20 bp, Artificial
  CRISPR gRNA sequence
gggaagaattcaacttgatt

SEQ ID NO: 666931 - DNA, 20 bp, Artificial
  CRISPR gRNA sequence
aacttgattctgtaaatatt

SEQ ID NO: 666932 - DNA, 20 bp, Artificial
  CRISPR gRNA sequence
gattctgtaaatattttttg

SEQ ID NO: 666933 - DNA, 20 bp, Artificial
  CRISPR gRNA sequence
attctgtaaatattttttga

SEQ ID NO: 666934 - DNA, 20 bp, Artificial
  CRISPR gRNA sequence
tgtaaatattttttgaacat

SEQ ID NO: 666935 - DNA, 20 bp, Artificial
  CRISPR gRNA sequence
taaatattttttgaacatta

SEQ ID NO: 666936 - DNA, 20 bp, Artificial
  CRISPR gRNA sequence
tttgaacattattgtgtgcc

SEQ ID NO: 666937 - DNA, 20 bp, Artificial
  CRISPR gRNA sequence
ttgaacattattgtgtgcca

SEQ ID NO: 666938 - DNA, 20 bp, Artificial
  CRISPR gRNA sequence
tgaacattattgtgtgccag

SEQ ID NO: 666939 - DNA, 20 bp, Artificial
  CRISPR gRNA sequence
gaacattattgtgtgccagc

SEQ ID NO: 666940 - DNA, 20 bp, Artificial
  CRISPR gRNA sequence
aacattattgtgtgccagcc

SEQ ID NO: 666941 - DNA, 20 bp, Artificial
  CRISPR gRNA sequence
ttgtgtgccagccactgtgt

SEQ ID NO: 666942 - DNA, 20 bp, Artificial
  CRISPR gRNA sequence
tgtgccagccactgtgttaa

SEQ ID NO: 666943 - DNA, 20 bp, Artificial
  CRISPR gRNA sequence
tgttaagtgcctggaatgca

SEQ ID NO: 666944 - DNA, 20 bp, Artificial
  CRISPR gRNA sequence
agtgcctggaatgcagagat

SEQ ID NO: 666945 - DNA, 20 bp, Artificial
  CRISPR gRNA sequence
gaatgcagagatgaataaga

SEQ ID NO: 666946 - DNA, 20 bp, Artificial
  CRISPR gRNA sequence
ttcttgggtcatagcgtaca

SEQ ID NO: 666947 - DNA, 20 bp, Artificial
  CRISPR gRNA sequence
ttgggtcatagcgtacagcg

SEQ ID NO: 666948 - DNA, 20 bp, Artificial
  CRISPR gRNA sequence
gggtcatagcgtacagcgta

SEQ ID NO: 666949 - DNA, 20 bp, Artificial
  CRISPR gRNA sequence
ggtcatagcgtacagcgtaa

SEQ ID NO: 666950 - DNA, 20 bp, Artificial
  CRISPR gRNA sequence
aattatatttgcggtgtaga

SEQ ID NO: 666951 - DNA, 20 bp, Artificial
  CRISPR gRNA sequence
tatttgcggtgtagattcac

SEQ ID NO: 666952 - DNA, 20 bp, Artificial
  CRISPR gRNA sequence
gcggtgtagattcactattc

SEQ ID NO: 666953 - DNA, 20 bp, Artificial
  CRISPR gRNA sequence
cggtgtagattcactattct

SEQ ID NO: 666954 - DNA, 20 bp, Artificial
  CRISPR gRNA sequence
actattctgttaggagccat

SEQ ID NO: 666955 - DNA, 20 bp, Artificial
  CRISPR gRNA sequence
ttctgttaggagccattaat

SEQ ID NO: 666956 - DNA, 20 bp, Artificial
  CRISPR gRNA sequence
tgttaggagccattaatttc

SEQ ID NO: 666957 - DNA, 20 bp, Artificial
  CRISPR gRNA sequence
ttaggagccattaatttcac

SEQ ID NO: 666958 - DNA, 20 bp, Artificial
  CRISPR gRNA sequence
ggagccattaatttcaccaa

SEQ ID NO: 666959 - DNA, 20 bp, Artificial
  CRISPR gRNA sequence
atttcaccaaaattggacag

SEQ ID NO: 666960 - DNA, 20 bp, Artificial
  CRISPR gRNA sequence
caccaaaattggacagaaag

SEQ ID NO: 666961 - DNA, 20 bp, Artificial
  CRISPR gRNA sequence
accaaaattggacagaaagg

SEQ ID NO: 666962 - DNA, 20 bp, Artificial
  CRISPR gRNA sequence
gacagaaagggatattcttt

SEQ ID NO: 666963 - DNA, 20 bp, Artificial
  CRISPR gRNA sequence
ttttaggaaatcacattgaa

SEQ ID NO: 666964 - DNA, 20 bp, Artificial
  CRISPR gRNA sequence
ttaggaaatcacattgaaac

SEQ ID NO: 666965 - DNA, 20 bp, Artificial
  CRISPR gRNA sequence
taggaaatcacattgaaact

SEQ ID NO: 666966 - DNA, 20 bp, Artificial
  CRISPR gRNA sequence
aggaaatcacattgaaactg

SEQ ID NO: 666967 - DNA, 20 bp, Artificial
  CRISPR gRNA sequence
ggaaatcacattgaaactgg

SEQ ID NO: 666968 - DNA, 20 bp, Artificial
  CRISPR gRNA sequence
aaactggaccttgaatcatg

SEQ ID NO: 666969 - DNA, 20 bp, Artificial
  CRISPR gRNA sequence
gaccttgaatcatgaaagct

SEQ ID NO: 666970 - DNA, 20 bp, Artificial
  CRISPR gRNA sequence
gaatcatgaaagctagaaaa

SEQ ID NO: 666971 - DNA, 20 bp, Artificial
  CRISPR gRNA sequence
aatcatgaaagctagaaaat

SEQ ID NO: 666972 - DNA, 20 bp, Artificial
  CRISPR gRNA sequence
gaaaatgaggacaaatgagg

SEQ ID NO: 666973 - DNA, 20 bp, Artificial
  CRISPR gRNA sequence
catgagcaaagagagttgta

SEQ ID NO: 666974 - DNA, 20 bp, Artificial
  CRISPR gRNA sequence
taagtatgtgatgggctcta

SEQ ID NO: 666975 - DNA, 20 bp, Artificial
  CRISPR gRNA sequence
taaaggttacaaagtacaac

SEQ ID NO: 666976 - DNA, 20 bp, Artificial
  CRISPR gRNA sequence
aaggttacaaagtacaactt

SEQ ID NO: 666977 - DNA, 20 bp, Artificial
  CRISPR gRNA sequence
caaagtacaacttcaacaag

SEQ ID NO: 666978 - DNA, 20 bp, Artificial
  CRISPR gRNA sequence
caacaaggcttaatgttatt

SEQ ID NO: 666979 - DNA, 20 bp, Artificial
  CRISPR gRNA sequence
aacaaggcttaatgttattt

SEQ ID NO: 666980 - DNA, 20 bp, Artificial
  CRISPR gRNA sequence
aatgttattttattctttca

SEQ ID NO: 666981 - DNA, 20 bp, Artificial
  CRISPR gRNA sequence
atgttattttattctttcag

SEQ ID NO: 666982 - DNA, 20 bp, Artificial
  CRISPR gRNA sequence
ttttattctttcagattaga

SEQ ID NO: 666983 - DNA, 20 bp, Artificial
  CRISPR gRNA sequence
tattctttcagattagagaa

SEQ ID NO: 666984 - DNA, 20 bp, Artificial
  CRISPR gRNA sequence
attctttcagattagagaag

SEQ ID NO: 666985 - DNA, 20 bp, Artificial
  CRISPR gRNA sequence
ttctttcagattagagaagg

SEQ ID NO: 666986 - DNA, 20 bp, Artificial
  CRISPR gRNA sequence
tttcagattagagaaggcat

SEQ ID NO: 666987 - DNA, 20 bp, Artificial
  CRISPR gRNA sequence
tcagattagagaaggcatga

SEQ ID NO: 666988 - DNA, 20 bp, Artificial
  CRISPR gRNA sequence
cagattagagaaggcatgat

SEQ ID NO: 666989 - DNA, 20 bp, Artificial
  CRISPR gRNA sequence
agattagagaaggcatgata

SEQ ID NO: 666990 - DNA, 20 bp, Artificial
  CRISPR gRNA sequence
gagaaggcatgataatattt

SEQ ID NO: 666991 - DNA, 20 bp, Artificial
  CRISPR gRNA sequence
tttcatgtgtaaaaggcctt

SEQ ID NO: 666992 - DNA, 20 bp, Artificial
  CRISPR gRNA sequence
ttcatgtgtaaaaggccttc

SEQ ID NO: 666993 - DNA, 20 bp, Artificial
  CRISPR gRNA sequence
tcatgtgtaaaaggccttca

SEQ ID NO: 666994 - DNA, 20 bp, Artificial
  CRISPR gRNA sequence
catgtgtaaaaggccttcag

SEQ ID NO: 666995 - DNA, 20 bp, Artificial
  CRISPR gRNA sequence
atgtgtaaaaggccttcaga

SEQ ID NO: 666996 - DNA, 20 bp, Artificial
  CRISPR gRNA sequence
cagataatgctcatcacctg

SEQ ID NO: 666997 - DNA, 20 bp, Artificial
  CRISPR gRNA sequence
agataatgctcatcacctga

SEQ ID NO: 666998 - DNA, 20 bp, Artificial
  CRISPR gRNA sequence
atcacctgatattgggactt

SEQ ID NO: 666999 - DNA, 20 bp, Artificial
  CRISPR gRNA sequence
atattgggacttaatagtaa

SEQ ID NO: 667000 - DNA, 20 bp, Artificial
  CRISPR gRNA sequence
ggacttaatagtaacagaaa

SEQ ID NO: 667001 - DNA, 20 bp, Artificial
  CRISPR gRNA sequence
aatagtaacagaaaatactt

SEQ ID NO: 667002 - DNA, 20 bp, Artificial
  CRISPR gRNA sequence
atagtaacagaaaatactta

SEQ ID NO: 667003 - DNA, 20 bp, Artificial
  CRISPR gRNA sequence
aagaaagggagagttgaagg

SEQ ID NO: 667004 - DNA, 20 bp, Artificial
  CRISPR gRNA sequence
agaaagggagagttgaagga

SEQ ID NO: 667005 - DNA, 20 bp, Artificial
  CRISPR gRNA sequence
aaggaacctgtttttttttt

SEQ ID NO: 667006 - DNA, 20 bp, Artificial
  CRISPR gRNA sequence
ttttttttttcaatttcttt

SEQ ID NO: 667007 - DNA, 20 bp, Artificial
  CRISPR gRNA sequence
tttttttcaatttctttttt

SEQ ID NO: 667008 - DNA, 20 bp, Artificial
  CRISPR gRNA sequence
ttttttcaatttctttttta

SEQ ID NO: 667009 - DNA, 20 bp, Artificial
  CRISPR gRNA sequence
tttttcaatttcttttttag

SEQ ID NO: 667010 - DNA, 20 bp, Artificial
  CRISPR gRNA sequence
ttttcaatttcttttttaga

SEQ ID NO: 667011 - DNA, 20 bp, Artificial
  CRISPR gRNA sequence
tttcaatttcttttttagag

SEQ ID NO: 667012 - DNA, 20 bp, Artificial
  CRISPR gRNA sequence
ttcaatttcttttttagagt

SEQ ID NO: 667013 - DNA, 20 bp, Artificial
  CRISPR gRNA sequence
tcaatttcttttttagagtg

SEQ ID NO: 667014 - DNA, 20 bp, Artificial
  CRISPR gRNA sequence
caatttcttttttagagtga

SEQ ID NO: 667015 - DNA, 20 bp, Artificial
  CRISPR gRNA sequence
aatttcttttttagagtgac

SEQ ID NO: 667016 - DNA, 20 bp, Artificial
  CRISPR gRNA sequence
cttttttagagtgacataga

SEQ ID NO: 667017 - DNA, 20 bp, Artificial
  CRISPR gRNA sequence
ttttttagagtgacatagat

SEQ ID NO: 667018 - DNA, 20 bp, Artificial
  CRISPR gRNA sequence
ttttagagtgacatagatac

SEQ ID NO: 667019 - DNA, 20 bp, Artificial
  CRISPR gRNA sequence
tttagagtgacatagataca

SEQ ID NO: 667020 - DNA, 20 bp, Artificial
  CRISPR gRNA sequence
ttagagtgacatagatacat

SEQ ID NO: 667021 - DNA, 20 bp, Artificial
  CRISPR gRNA sequence
tagagtgacatagatacatt

SEQ ID NO: 667022 - DNA, 20 bp, Artificial
  CRISPR gRNA sequence
agagtgacatagatacattt

SEQ ID NO: 667023 - DNA, 20 bp, Artificial
  CRISPR gRNA sequence
gagtgacatagatacatttt

SEQ ID NO: 667024 - DNA, 20 bp, Artificial
  CRISPR gRNA sequence
tatcatcttatgattttttt

SEQ ID NO: 667025 - DNA, 20 bp, Artificial
  CRISPR gRNA sequence
atcatcttatgatttttttc

SEQ ID NO: 667026 - DNA, 20 bp, Artificial
  CRISPR gRNA sequence
tcatcttatgatttttttca

SEQ ID NO: 667027 - DNA, 20 bp, Artificial
  CRISPR gRNA sequence
atgatttttttcagaaacct

SEQ ID NO: 667028 - DNA, 20 bp, Artificial
  CRISPR gRNA sequence
tgatttttttcagaaacctt

SEQ ID NO: 667029 - DNA, 20 bp, Artificial
  CRISPR gRNA sequence
ttttcagaaacctttttgta

SEQ ID NO: 667030 - DNA, 20 bp, Artificial
  CRISPR gRNA sequence
tttcagaaacctttttgtag

SEQ ID NO: 667031 - DNA, 20 bp, Artificial
  CRISPR gRNA sequence
ttcagaaacctttttgtaga

SEQ ID NO: 667032 - DNA, 20 bp, Artificial
  CRISPR gRNA sequence
tcagaaacctttttgtagac

SEQ ID NO: 667033 - DNA, 20 bp, Artificial
  CRISPR gRNA sequence
cagaaacctttttgtagacc

SEQ ID NO: 667034 - DNA, 20 bp, Artificial
  CRISPR gRNA sequence
agaaacctttttgtagacct

SEQ ID NO: 667035 - DNA, 20 bp, Artificial
  CRISPR gRNA sequence
tttgtagaccttgttacttc

SEQ ID NO: 667036 - DNA, 20 bp, Artificial
  CRISPR gRNA sequence
ttgtagaccttgttacttct

SEQ ID NO: 667037 - DNA, 20 bp, Artificial
  CRISPR gRNA sequence
tgtagaccttgttacttctg

SEQ ID NO: 667038 - DNA, 20 bp, Artificial
  CRISPR gRNA sequence
gtagaccttgttacttctgt

SEQ ID NO: 667039 - DNA, 20 bp, Artificial
  CRISPR gRNA sequence
tagaccttgttacttctgta

SEQ ID NO: 667040 - DNA, 20 bp, Artificial
  CRISPR gRNA sequence
gttacttctgtaagatttca

SEQ ID NO: 667041 - DNA, 20 bp, Artificial
  CRISPR gRNA sequence
ttacttctgtaagatttcat

SEQ ID NO: 667042 - DNA, 20 bp, Artificial
  CRISPR gRNA sequence
cttctgtaagatttcatata

SEQ ID NO: 667043 - DNA, 20 bp, Artificial
  CRISPR gRNA sequence
ctgtaagatttcatatatgt

SEQ ID NO: 667044 - DNA, 20 bp, Artificial
  CRISPR gRNA sequence
tgtaagatttcatatatgtt

SEQ ID NO: 667045 - DNA, 20 bp, Artificial
  CRISPR gRNA sequence
taagatttcatatatgttca

SEQ ID NO: 667046 - DNA, 20 bp, Artificial
  CRISPR gRNA sequence
catatatgttcatttcctta

SEQ ID NO: 667047 - DNA, 20 bp, Artificial
  CRISPR gRNA sequence
atatatgttcatttccttac

SEQ ID NO: 667048 - DNA, 20 bp, Artificial
  CRISPR gRNA sequence
atttccttaccccaaagcca

SEQ ID NO: 667049 - DNA, 20 bp, Artificial
  CRISPR gRNA sequence
ccttaccccaaagccataat

SEQ ID NO: 667050 - DNA, 20 bp, Artificial
  CRISPR gRNA sequence
cttaccccaaagccataata

SEQ ID NO: 667051 - DNA, 20 bp, Artificial
  CRISPR gRNA sequence
accccaaagccataataaaa

SEQ ID NO: 667052 - DNA, 20 bp, Artificial
  CRISPR gRNA sequence
ccccaaagccataataaaaa

SEQ ID NO: 667053 - DNA, 20 bp, Artificial
  CRISPR gRNA sequence
ctaagcacttttctaacact

SEQ ID NO: 667054 - DNA, 20 bp, Artificial
  CRISPR gRNA sequence
agcacttttctaacactgac

SEQ ID NO: 667055 - DNA, 20 bp, Artificial
  CRISPR gRNA sequence
ttctaacactgaccataaga

SEQ ID NO: 667056 - DNA, 20 bp, Artificial
  CRISPR gRNA sequence
tctaacactgaccataagaa

SEQ ID NO: 667057 - DNA, 20 bp, Artificial
  CRISPR gRNA sequence
ctaacactgaccataagaat

SEQ ID NO: 667058 - DNA, 20 bp, Artificial
  CRISPR gRNA sequence
taacactgaccataagaatg

SEQ ID NO: 667059 - DNA, 20 bp, Artificial
  CRISPR gRNA sequence
acactgaccataagaatgaa

SEQ ID NO: 667060 - DNA, 20 bp, Artificial
  CRISPR gRNA sequence
accataagaatgaaattaac

SEQ ID NO: 667061 - DNA, 20 bp, Artificial
  CRISPR gRNA sequence
acattgctgtgagtaaactg

SEQ ID NO: 667062 - DNA, 20 bp, Artificial
  CRISPR gRNA sequence
ctgtgagtaaactgtagttt

SEQ ID NO: 667063 - DNA, 20 bp, Artificial
  CRISPR gRNA sequence
tgagtaaactgtagtttagg

SEQ ID NO: 667064 - DNA, 20 bp, Artificial
  CRISPR gRNA sequence
tagtttaggagaatcttttg

SEQ ID NO: 667065 - DNA, 20 bp, Artificial
  CRISPR gRNA sequence
aggagaatcttttgtagtga

SEQ ID NO: 667066 - DNA, 20 bp, Artificial
  CRISPR gRNA sequence
ggagaatcttttgtagtgag

SEQ ID NO: 667067 - DNA, 20 bp, Artificial
  CRISPR gRNA sequence
ttgtagtgaggaacagaact

SEQ ID NO: 667068 - DNA, 20 bp, Artificial
  CRISPR gRNA sequence
tgtagtgaggaacagaacta

SEQ ID NO: 667069 - DNA, 20 bp, Artificial
  CRISPR gRNA sequence
gtagtgaggaacagaactat

SEQ ID NO: 667070 - DNA, 20 bp, Artificial
  CRISPR gRNA sequence
tagtgaggaacagaactatt

SEQ ID NO: 667071 - DNA, 20 bp, Artificial
  CRISPR gRNA sequence
ttatttattgagtatcccta

SEQ ID NO: 667072 - DNA, 20 bp, Artificial
  CRISPR gRNA sequence
tttattgagtatccctatat

SEQ ID NO: 667073 - DNA, 20 bp, Artificial
  CRISPR gRNA sequence
attgagtatccctatatgtt

SEQ ID NO: 667074 - DNA, 20 bp, Artificial
  CRISPR gRNA sequence
ttgagtatccctatatgtta

SEQ ID NO: 667075 - DNA, 20 bp, Artificial
  CRISPR gRNA sequence
agtatccctatatgttaggt

SEQ ID NO: 667076 - DNA, 20 bp, Artificial
  CRISPR gRNA sequence
tatgttaggtactgtgtgag

SEQ ID NO: 667077 - DNA, 20 bp, Artificial
  CRISPR gRNA sequence
ggtactgtgtgaggtacttt

SEQ ID NO: 667078 - DNA, 20 bp, Artificial
  CRISPR gRNA sequence
tgtgaggtactttcatacag

SEQ ID NO: 667079 - DNA, 20 bp, Artificial
  CRISPR gRNA sequence
tcatacagtctatacaattt

SEQ ID NO: 667080 - DNA, 20 bp, Artificial
  CRISPR gRNA sequence
catacagtctatacaattta

SEQ ID NO: 667081 - DNA, 20 bp, Artificial
  CRISPR gRNA sequence
atacagtctatacaatttac

SEQ ID NO: 667082 - DNA, 20 bp, Artificial
  CRISPR gRNA sequence
tacaatttactccttaaaac

SEQ ID NO: 667083 - DNA, 20 bp, Artificial
  CRISPR gRNA sequence
actccttaaaacttccctgg

SEQ ID NO: 667084 - DNA, 20 bp, Artificial
  CRISPR gRNA sequence
ctccttaaaacttccctgga

SEQ ID NO: 667085 - DNA, 20 bp, Artificial
  CRISPR gRNA sequence
cttaaaacttccctggaaag

SEQ ID NO: 667086 - DNA, 20 bp, Artificial
  CRISPR gRNA sequence
aaaacttccctggaaagtta

SEQ ID NO: 667087 - DNA, 20 bp, Artificial
  CRISPR gRNA sequence
aaacttccctggaaagttat

SEQ ID NO: 667088 - DNA, 20 bp, Artificial
  CRISPR gRNA sequence
ccctggaaagttattatctc

SEQ ID NO: 667089 - DNA, 20 bp, Artificial
  CRISPR gRNA sequence
cctggaaagttattatctca

SEQ ID NO: 667090 - DNA, 20 bp, Artificial
  CRISPR gRNA sequence
gaaagttattatctcaaatt

SEQ ID NO: 667091 - DNA, 20 bp, Artificial
  CRISPR gRNA sequence
ttatctcaaatttctaagcc

SEQ ID NO: 667092 - DNA, 20 bp, Artificial
  CRISPR gRNA sequence
tctcaaatttctaagccagg

SEQ ID NO: 667093 - DNA, 20 bp, Artificial
  CRISPR gRNA sequence
aaatttctaagccagggaag

SEQ ID NO: 667094 - DNA, 20 bp, Artificial
  CRISPR gRNA sequence
ctaagccagggaagcattcc

SEQ ID NO: 667095 - DNA, 20 bp, Artificial
  CRISPR gRNA sequence
taagccagggaagcattcca

SEQ ID NO: 667096 - DNA, 20 bp, Artificial
  CRISPR gRNA sequence
agccagggaagcattccagg

SEQ ID NO: 667097 - DNA, 20 bp, Artificial
  CRISPR gRNA sequence
cagggaaactgaggctgact

SEQ ID NO: 667098 - DNA, 20 bp, Artificial
  CRISPR gRNA sequence
aggctgactaatatgctctg

SEQ ID NO: 667099 - DNA, 20 bp, Artificial
  CRISPR gRNA sequence
actaatatgctctgtgatat

SEQ ID NO: 667100 - DNA, 20 bp, Artificial
  CRISPR gRNA sequence
atatgctctgtgatatacag

SEQ ID NO: 667101 - DNA, 20 bp, Artificial
  CRISPR gRNA sequence
tgtgatatacagctggtaag

SEQ ID NO: 667102 - DNA, 20 bp, Artificial
  CRISPR gRNA sequence
tgatatacagctggtaagtg

SEQ ID NO: 667103 - DNA, 20 bp, Artificial
  CRISPR gRNA sequence
gtaagtgacaggtttgggat

SEQ ID NO: 667104 - DNA, 20 bp, Artificial
  CRISPR gRNA sequence
gggatgcaaaatcaaggtgg

SEQ ID NO: 667105 - DNA, 20 bp, Artificial
  CRISPR gRNA sequence
ggatgcaaaatcaaggtggt

SEQ ID NO: 667106 - DNA, 20 bp, Artificial
  CRISPR gRNA sequence
aattccacatcatatgctca

SEQ ID NO: 667107 - DNA, 20 bp, Artificial
  CRISPR gRNA sequence
cacatcatatgctcacttta

SEQ ID NO: 667108 - DNA, 20 bp, Artificial
  CRISPR gRNA sequence
actttactgtagtttagaca

SEQ ID NO: 667109 - DNA, 20 bp, Artificial
  CRISPR gRNA sequence
tactgtagtttagacaggtg

SEQ ID NO: 667110 - DNA, 20 bp, Artificial
  CRISPR gRNA sequence
actgtagtttagacaggtgt

SEQ ID NO: 667111 - DNA, 20 bp, Artificial
  CRISPR gRNA sequence
ctgtagtttagacaggtgta

SEQ ID NO: 667112 - DNA, 20 bp, Artificial
  CRISPR gRNA sequence
tagtttagacaggtgtactt

SEQ ID NO: 667113 - DNA, 20 bp, Artificial
  CRISPR gRNA sequence
agacaggtgtacttgaataa

SEQ ID NO: 667114 - DNA, 20 bp, Artificial
  CRISPR gRNA sequence
gacaggtgtacttgaataat

SEQ ID NO: 667115 - DNA, 20 bp, Artificial
  CRISPR gRNA sequence
gaataattggcaggtgacaa

SEQ ID NO: 667116 - DNA, 20 bp, Artificial
  CRISPR gRNA sequence
aataattggcaggtgacaag

SEQ ID NO: 667117 - DNA, 20 bp, Artificial
  CRISPR gRNA sequence
gcaggtgacaagtgtcagtt

SEQ ID NO: 667118 - DNA, 20 bp, Artificial
  CRISPR gRNA sequence
gggtatttaaactgaggcct

SEQ ID NO: 667119 - DNA, 20 bp, Artificial
  CRISPR gRNA sequence
ggtatttaaactgaggcctg

SEQ ID NO: 667120 - DNA, 20 bp, Artificial
  CRISPR gRNA sequence
aaactgaggcctgacttact

SEQ ID NO: 667121 - DNA, 20 bp, Artificial
  CRISPR gRNA sequence
aactgaggcctgacttactc

SEQ ID NO: 667122 - DNA, 20 bp, Artificial
  CRISPR gRNA sequence
aggcctgacttactccaaat

SEQ ID NO: 667123 - DNA, 20 bp, Artificial
  CRISPR gRNA sequence
acttactccaaataatctgt

SEQ ID NO: 667124 - DNA, 20 bp, Artificial
  CRISPR gRNA sequence
actccaaataatctgtattc

SEQ ID NO: 667125 - DNA, 20 bp, Artificial
  CRISPR gRNA sequence
ctccaaataatctgtattct

SEQ ID NO: 667126 - DNA, 20 bp, Artificial
  CRISPR gRNA sequence
caaataatctgtattctatc

SEQ ID NO: 667127 - DNA, 20 bp, Artificial
  CRISPR gRNA sequence
tattctatccccaacctttt

SEQ ID NO: 667128 - DNA, 20 bp, Artificial
  CRISPR gRNA sequence
tatccccaacctttttggca

SEQ ID NO: 667129 - DNA, 20 bp, Artificial
  CRISPR gRNA sequence
tccccaacctttttggcacc

SEQ ID NO: 667130 - DNA, 20 bp, Artificial
  CRISPR gRNA sequence
tttggcaccaagtactggtt

SEQ ID NO: 667131 - DNA, 20 bp, Artificial
  CRISPR gRNA sequence
ttggcaccaagtactggttt

SEQ ID NO: 667132 - DNA, 20 bp, Artificial
  CRISPR gRNA sequence
tggcaccaagtactggtttt

SEQ ID NO: 667133 - DNA, 20 bp, Artificial
  CRISPR gRNA sequence
ggcaccaagtactggttttg

SEQ ID NO: 667134 - DNA, 20 bp, Artificial
  CRISPR gRNA sequence
gcaccaagtactggttttgt

SEQ ID NO: 667135 - DNA, 20 bp, Artificial
  CRISPR gRNA sequence
gttttgtggaagacaatttt

SEQ ID NO: 667136 - DNA, 20 bp, Artificial
  CRISPR gRNA sequence
tgtggaagacaatttttcca

SEQ ID NO: 667137 - DNA, 20 bp, Artificial
  CRISPR gRNA sequence
gtggaagacaatttttccac

SEQ ID NO: 667138 - DNA, 20 bp, Artificial
  CRISPR gRNA sequence
tggaagacaatttttccaca

SEQ ID NO: 667139 - DNA, 20 bp, Artificial
  CRISPR gRNA sequence
ttccacagcctgagggttag

SEQ ID NO: 667140 - DNA, 20 bp, Artificial
  CRISPR gRNA sequence
tccacagcctgagggttagt

SEQ ID NO: 667141 - DNA, 20 bp, Artificial
  CRISPR gRNA sequence
ccacagcctgagggttagtg

SEQ ID NO: 667142 - DNA, 20 bp, Artificial
  CRISPR gRNA sequence
cacagcctgagggttagtgg

SEQ ID NO: 667143 - DNA, 20 bp, Artificial
  CRISPR gRNA sequence
agggttagtgggggatggtt

SEQ ID NO: 667144 - DNA, 20 bp, Artificial
  CRISPR gRNA sequence
gtgggggatggtttcgggat

SEQ ID NO: 667145 - DNA, 20 bp, Artificial
  CRISPR gRNA sequence
cgggatgattcaagagcatt

SEQ ID NO: 667146 - DNA, 20 bp, Artificial
  CRISPR gRNA sequence
gggatgattcaagagcatta

SEQ ID NO: 667147 - DNA, 20 bp, Artificial
  CRISPR gRNA sequence
aagagcattacatttattgt

SEQ ID NO: 667148 - DNA, 20 bp, Artificial
  CRISPR gRNA sequence
catttattgtgcactttgtt

SEQ ID NO: 667149 - DNA, 20 bp, Artificial
  CRISPR gRNA sequence
attgtgcactttgtttctat

SEQ ID NO: 667150 - DNA, 20 bp, Artificial
  CRISPR gRNA sequence
ttgtgcactttgtttctatt

SEQ ID NO: 667151 - DNA, 20 bp, Artificial
  CRISPR gRNA sequence
tgcactttgtttctattatt

SEQ ID NO: 667152 - DNA, 20 bp, Artificial
  CRISPR gRNA sequence
tgtttctattattacattgt

SEQ ID NO: 667153 - DNA, 20 bp, Artificial
  CRISPR gRNA sequence
gtttctattattacattgtt

SEQ ID NO: 667154 - DNA, 20 bp, Artificial
  CRISPR gRNA sequence
tttctattattacattgtta

SEQ ID NO: 667155 - DNA, 20 bp, Artificial
  CRISPR gRNA sequence
ctattattacattgttatat

SEQ ID NO: 667156 - DNA, 20 bp, Artificial
  CRISPR gRNA sequence
tattattacattgttatata

SEQ ID NO: 667157 - DNA, 20 bp, Artificial
  CRISPR gRNA sequence
ttattacattgttatatata

SEQ ID NO: 667158 - DNA, 20 bp, Artificial
  CRISPR gRNA sequence
ttacattgttatatataatg

SEQ ID NO: 667159 - DNA, 20 bp, Artificial
  CRISPR gRNA sequence
cattgttatatataatgaaa

SEQ ID NO: 667160 - DNA, 20 bp, Artificial
  CRISPR gRNA sequence
ttatatataatgaaataatt

SEQ ID NO: 667161 - DNA, 20 bp, Artificial
  CRISPR gRNA sequence
tatataatgaaataattcta

SEQ ID NO: 667162 - DNA, 20 bp, Artificial
  CRISPR gRNA sequence
tataactcatcataatgtag

SEQ ID NO: 667163 - DNA, 20 bp, Artificial
  CRISPR gRNA sequence
taactcatcataatgtagaa

SEQ ID NO: 667164 - DNA, 20 bp, Artificial
  CRISPR gRNA sequence
atcataatgtagaatctgtg

SEQ ID NO: 667165 - DNA, 20 bp, Artificial
  CRISPR gRNA sequence
tggagtcctaagcttgtttt

SEQ ID NO: 667166 - DNA, 20 bp, Artificial
  CRISPR gRNA sequence
agcttgttttcctgcaacta

SEQ ID NO: 667167 - DNA, 20 bp, Artificial
  CRISPR gRNA sequence
gttttcctgcaactagatag

SEQ ID NO: 667168 - DNA, 20 bp, Artificial
  CRISPR gRNA sequence
ttttcctgcaactagatagt

SEQ ID NO: 667169 - DNA, 20 bp, Artificial
  CRISPR gRNA sequence
tcctgcaactagatagtccc

SEQ ID NO: 667170 - DNA, 20 bp, Artificial
  CRISPR gRNA sequence
cctgcaactagatagtccca

SEQ ID NO: 667171 - DNA, 20 bp, Artificial
  CRISPR gRNA sequence
ctgcaactagatagtcccag

SEQ ID NO: 667172 - DNA, 20 bp, Artificial
  CRISPR gRNA sequence
caactagatagtcccagata

SEQ ID NO: 667173 - DNA, 20 bp, Artificial
  CRISPR gRNA sequence
gatagtcccagatagtctgg

SEQ ID NO: 667174 - DNA, 20 bp, Artificial
  CRISPR gRNA sequence
ggggtgatgggagacagtga

SEQ ID NO: 667175 - DNA, 20 bp, Artificial
  CRISPR gRNA sequence
gattctcataaggagcacac

SEQ ID NO: 667176 - DNA, 20 bp, Artificial
  CRISPR gRNA sequence
tcataaggagcacacaagct

SEQ ID NO: 667177 - DNA, 20 bp, Artificial
  CRISPR gRNA sequence
ataaggagcacacaagctag

SEQ ID NO: 667178 - DNA, 20 bp, Artificial
  CRISPR gRNA sequence
gatctctggcatgtgcagtt

SEQ ID NO: 667179 - DNA, 20 bp, Artificial
  CRISPR gRNA sequence
tggcatgtgcagttcacaat

SEQ ID NO: 667180 - DNA, 20 bp, Artificial
  CRISPR gRNA sequence
gcatgtgcagttcacaataa

SEQ ID NO: 667181 - DNA, 20 bp, Artificial
  CRISPR gRNA sequence
acaataaagttcgccatctg

SEQ ID NO: 667182 - DNA, 20 bp, Artificial
  CRISPR gRNA sequence
gccatctgaggctgggcgca

SEQ ID NO: 667183 - DNA, 20 bp, Artificial
  CRISPR gRNA sequence
aggctgggcgcagtgcttca

SEQ ID NO: 667184 - DNA, 20 bp, Artificial
  CRISPR gRNA sequence
ggcgcagtgcttcacacttg

SEQ ID NO: 667185 - DNA, 20 bp, Artificial
  CRISPR gRNA sequence
cacacttgtaatcctagtac

SEQ ID NO: 667186 - DNA, 20 bp, Artificial
  CRISPR gRNA sequence
acacttgtaatcctagtact

SEQ ID NO: 667187 - DNA, 20 bp, Artificial
  CRISPR gRNA sequence
gtaatcctagtactttggga

SEQ ID NO: 667188 - DNA, 20 bp, Artificial
  CRISPR gRNA sequence
taatcctagtactttgggag

SEQ ID NO: 667189 - DNA, 20 bp, Artificial
  CRISPR gRNA sequence
gtactttgggaggccgaggt

SEQ ID NO: 667190 - DNA, 20 bp, Artificial
  CRISPR gRNA sequence
tgggaggccgaggtgggcgg

SEQ ID NO: 667191 - DNA, 20 bp, Artificial
  CRISPR gRNA sequence
gggaggccgaggtgggcgga

SEQ ID NO: 667192 - DNA, 20 bp, Artificial
  CRISPR gRNA sequence
ggaggccgaggtgggcggat

SEQ ID NO: 667193 - DNA, 20 bp, Artificial
  CRISPR gRNA sequence
aggttgagagtttgagacca

SEQ ID NO: 667194 - DNA, 20 bp, Artificial
  CRISPR gRNA sequence
agagtttgagaccagcctga

SEQ ID NO: 667195 - DNA, 20 bp, Artificial
  CRISPR gRNA sequence
gagaccagcctgaccaacat

SEQ ID NO: 667196 - DNA, 20 bp, Artificial
  CRISPR gRNA sequence
agaccagcctgaccaacata

SEQ ID NO: 667197 - DNA, 20 bp, Artificial
  CRISPR gRNA sequence
accaacatagagaaactcca

SEQ ID NO: 667198 - DNA, 20 bp, Artificial
  CRISPR gRNA sequence
catctctactaaaaatacaa

SEQ ID NO: 667199 - DNA, 20 bp, Artificial
  CRISPR gRNA sequence
tactaaaaatacaaaaaaaa

SEQ ID NO: 667200 - DNA, 20 bp, Artificial
  CRISPR gRNA sequence
ctaaaaatacaaaaaaaaaa

SEQ ID NO: 667201 - DNA, 20 bp, Artificial
  CRISPR gRNA sequence
aaaatacaaaaaaaaaaaaa

SEQ ID NO: 667202 - DNA, 20 bp, Artificial
  CRISPR gRNA sequence
gcctggtgtggtggcgcatg

SEQ ID NO: 667203 - DNA, 20 bp, Artificial
  CRISPR gRNA sequence
gtgtggtggcgcatgtctgt

SEQ ID NO: 667204 - DNA, 20 bp, Artificial
  CRISPR gRNA sequence
taatcccagctaggctgagg

SEQ ID NO: 667205 - DNA, 20 bp, Artificial
  CRISPR gRNA sequence
ggctgaggcaggagaatcgc

SEQ ID NO: 667206 - DNA, 20 bp, Artificial
  CRISPR gRNA sequence
aggcaggagaatcgcttgaa

SEQ ID NO: 667207 - DNA, 20 bp, Artificial
  CRISPR gRNA sequence
gaaactgggaggcagaggtt

SEQ ID NO: 667208 - DNA, 20 bp, Artificial
  CRISPR gRNA sequence
aaactgggaggcagaggttg

SEQ ID NO: 667209 - DNA, 20 bp, Artificial
  CRISPR gRNA sequence
ggaggcagaggttgtggtga

SEQ ID NO: 667210 - DNA, 20 bp, Artificial
  CRISPR gRNA sequence
tggtgagccaagattgcgcc

SEQ ID NO: 667211 - DNA, 20 bp, Artificial
  CRISPR gRNA sequence
cgccattgcactccagcctg

SEQ ID NO: 667212 - DNA, 20 bp, Artificial
  CRISPR gRNA sequence
cactccagcctgggcaacaa

SEQ ID NO: 667213 - DNA, 20 bp, Artificial
  CRISPR gRNA sequence
cagcctgggcaacaagagcg

SEQ ID NO: 667214 - DNA, 20 bp, Artificial
  CRISPR gRNA sequence
ggcaacaagagcgaaactcc

SEQ ID NO: 667215 - DNA, 20 bp, Artificial
  CRISPR gRNA sequence
cgtctcaaaaaaaaaaaaaa

SEQ ID NO: 667216 - DNA, 20 bp, Artificial
  CRISPR gRNA sequence
aaaaaaaaaaaaaaaaaaaa

SEQ ID NO: 667217 - DNA, 20 bp, Artificial
  CRISPR gRNA sequence
gccgtcctatgagaatctag

SEQ ID NO: 667218 - DNA, 20 bp, Artificial
  CRISPR gRNA sequence
tgagaatctagtgccatagc

SEQ ID NO: 667219 - DNA, 20 bp, Artificial
  CRISPR gRNA sequence
gtgccatagctgatctgaca

SEQ ID NO: 667220 - DNA, 20 bp, Artificial
  CRISPR gRNA sequence
atctgacaggaggtggagct

SEQ ID NO: 667221 - DNA, 20 bp, Artificial
  CRISPR gRNA sequence
acaggaggtggagctcaagc

SEQ ID NO: 667222 - DNA, 20 bp, Artificial
  CRISPR gRNA sequence
aagcagtagtatgagagatg

SEQ ID NO: 667223 - DNA, 20 bp, Artificial
  CRISPR gRNA sequence
taaatacagatggagctcac

SEQ ID NO: 667224 - DNA, 20 bp, Artificial
  CRISPR gRNA sequence
acctcctgctatgtgaccag

SEQ ID NO: 667225 - DNA, 20 bp, Artificial
  CRISPR gRNA sequence
ctgctatgtgaccagtttcc

SEQ ID NO: 667226 - DNA, 20 bp, Artificial
  CRISPR gRNA sequence
ctatgtgaccagtttcctac

SEQ ID NO: 667227 - DNA, 20 bp, Artificial
  CRISPR gRNA sequence
tgtgaccagtttcctactgg

SEQ ID NO: 667228 - DNA, 20 bp, Artificial
  CRISPR gRNA sequence
cctactggttcctactggtc

SEQ ID NO: 667229 - DNA, 20 bp, Artificial
  CRISPR gRNA sequence
ctactggttcctactggtcc

SEQ ID NO: 667230 - DNA, 20 bp, Artificial
  CRISPR gRNA sequence
ctggttcctactggtccctg

SEQ ID NO: 667231 - DNA, 20 bp, Artificial
  CRISPR gRNA sequence
gttcctactggtccctggcc

SEQ ID NO: 667232 - DNA, 20 bp, Artificial
  CRISPR gRNA sequence
ctactggtccctggcctggg

SEQ ID NO: 667233 - DNA, 20 bp, Artificial
  CRISPR gRNA sequence
ctggtccctggcctggggtt

SEQ ID NO: 667234 - DNA, 20 bp, Artificial
  CRISPR gRNA sequence
gtccctggcctggggtttgg

SEQ ID NO: 667235 - DNA, 20 bp, Artificial
  CRISPR gRNA sequence
gcctggggtttggggatgcc

SEQ ID NO: 667236 - DNA, 20 bp, Artificial
  CRISPR gRNA sequence
gggtttggggatgcctggca

SEQ ID NO: 667237 - DNA, 20 bp, Artificial
  CRISPR gRNA sequence
ggggatgcctggcactagaa

SEQ ID NO: 667238 - DNA, 20 bp, Artificial
  CRISPR gRNA sequence
gggatgcctggcactagaac

SEQ ID NO: 667239 - DNA, 20 bp, Artificial
  CRISPR gRNA sequence
gcactagaacttatagaagt

SEQ ID NO: 667240 - DNA, 20 bp, Artificial
  CRISPR gRNA sequence
gaacttatagaagttatttg

SEQ ID NO: 667241 - DNA, 20 bp, Artificial
  CRISPR gRNA sequence
atagaagttatttgaacttc

SEQ ID NO: 667242 - DNA, 20 bp, Artificial
  CRISPR gRNA sequence
tagaagttatttgaacttca

SEQ ID NO: 667243 - DNA, 20 bp, Artificial
  CRISPR gRNA sequence
tttgaacttcaaacattgca

SEQ ID NO: 667244 - DNA, 20 bp, Artificial
  CRISPR gRNA sequence
gaacttcaaacattgcaaaa

SEQ ID NO: 667245 - DNA, 20 bp, Artificial
  CRISPR gRNA sequence
aacttcaaacattgcaaaag

SEQ ID NO: 667246 - DNA, 20 bp, Artificial
  CRISPR gRNA sequence
caaacattgcaaaagcagag

SEQ ID NO: 667247 - DNA, 20 bp, Artificial
  CRISPR gRNA sequence
aaacattgcaaaagcagagt

SEQ ID NO: 667248 - DNA, 20 bp, Artificial
  CRISPR gRNA sequence
caaaagcagagtgttttcat

SEQ ID NO: 667249 - DNA, 20 bp, Artificial
  CRISPR gRNA sequence
tcattacttaaagtagtgtt

SEQ ID NO: 667250 - DNA, 20 bp, Artificial
  CRISPR gRNA sequence
cattacttaaagtagtgttt

SEQ ID NO: 667251 - DNA, 20 bp, Artificial
  CRISPR gRNA sequence
attacttaaagtagtgttta

SEQ ID NO: 667252 - DNA, 20 bp, Artificial
  CRISPR gRNA sequence
cttaaagtagtgtttaattt

SEQ ID NO: 667253 - DNA, 20 bp, Artificial
  CRISPR gRNA sequence
aaagtagtgtttaattttag

SEQ ID NO: 667254 - DNA, 20 bp, Artificial
  CRISPR gRNA sequence
aagtagtgtttaattttagc

SEQ ID NO: 667255 - DNA, 20 bp, Artificial
  CRISPR gRNA sequence
aattttagcatgtcttactt

SEQ ID NO: 667256 - DNA, 20 bp, Artificial
  CRISPR gRNA sequence
attttagcatgtcttacttt

SEQ ID NO: 667257 - DNA, 20 bp, Artificial
  CRISPR gRNA sequence
tagcatgtcttactttctgg

SEQ ID NO: 667258 - DNA, 20 bp, Artificial
  CRISPR gRNA sequence
agcatgtcttactttctggc

SEQ ID NO: 667259 - DNA, 20 bp, Artificial
  CRISPR gRNA sequence
gcatgtcttactttctggct

SEQ ID NO: 667260 - DNA, 20 bp, Artificial
  CRISPR gRNA sequence
actttctggctatagttttt

SEQ ID NO: 667261 - DNA, 20 bp, Artificial
  CRISPR gRNA sequence
ctttctggctatagttttta

SEQ ID NO: 667262 - DNA, 20 bp, Artificial
  CRISPR gRNA sequence
tctggctatagtttttaata

SEQ ID NO: 667263 - DNA, 20 bp, Artificial
  CRISPR gRNA sequence
ctggctatagtttttaatag

SEQ ID NO: 667264 - DNA, 20 bp, Artificial
  CRISPR gRNA sequence
tggctatagtttttaataga

SEQ ID NO: 667265 - DNA, 20 bp, Artificial
  CRISPR gRNA sequence
gctatagtttttaatagact

SEQ ID NO: 667266 - DNA, 20 bp, Artificial
  CRISPR gRNA sequence
tagtttttaatagacttttc

SEQ ID NO: 667267 - DNA, 20 bp, Artificial
  CRISPR gRNA sequence
ttaatagacttttcaactat

SEQ ID NO: 667268 - DNA, 20 bp, Artificial
  CRISPR gRNA sequence
taatagacttttcaactata

SEQ ID NO: 667269 - DNA, 20 bp, Artificial
  CRISPR gRNA sequence
aatagacttttcaactatat

SEQ ID NO: 667270 - DNA, 20 bp, Artificial
  CRISPR gRNA sequence
atagacttttcaactatatg

SEQ ID NO: 667271 - DNA, 20 bp, Artificial
  CRISPR gRNA sequence
ttcaactatatggctcattt

SEQ ID NO: 667272 - DNA, 20 bp, Artificial
  CRISPR gRNA sequence
tcaactatatggctcatttt

SEQ ID NO: 667273 - DNA, 20 bp, Artificial
  CRISPR gRNA sequence
caactatatggctcatttta

SEQ ID NO: 667274 - DNA, 20 bp, Artificial
  CRISPR gRNA sequence
aactatatggctcattttaa

SEQ ID NO: 667275 - DNA, 20 bp, Artificial
  CRISPR gRNA sequence
tatggctcattttaactgaa

SEQ ID NO: 667276 - DNA, 20 bp, Artificial
  CRISPR gRNA sequence
attttaactgaaggtttaaa

SEQ ID NO: 667277 - DNA, 20 bp, Artificial
  CRISPR gRNA sequence
taactgaaggtttaaaaagt

SEQ ID NO: 667278 - DNA, 20 bp, Artificial
  CRISPR gRNA sequence
aactgaaggtttaaaaagtc

SEQ ID NO: 667279 - DNA, 20 bp, Artificial
  CRISPR gRNA sequence
actgaaggtttaaaaagtca

SEQ ID NO: 667280 - DNA, 20 bp, Artificial
  CRISPR gRNA sequence
aaggtttaaaaagtcatttt

SEQ ID NO: 667281 - DNA, 20 bp, Artificial
  CRISPR gRNA sequence
aaaaagtcattttgttgtct

SEQ ID NO: 667282 - DNA, 20 bp, Artificial
  CRISPR gRNA sequence
aaaagtcattttgttgtctc

SEQ ID NO: 667283 - DNA, 20 bp, Artificial
  CRISPR gRNA sequence
tgttgtctcagaggtataaa

SEQ ID NO: 667284 - DNA, 20 bp, Artificial
  CRISPR gRNA sequence
gttgtctcagaggtataaaa

SEQ ID NO: 667285 - DNA, 20 bp, Artificial
  CRISPR gRNA sequence
ttgtctcagaggtataaaat

SEQ ID NO: 667286 - DNA, 20 bp, Artificial
  CRISPR gRNA sequence
tctcagaggtataaaattac

SEQ ID NO: 667287 - DNA, 20 bp, Artificial
  CRISPR gRNA sequence
agaggtataaaattaccatc

SEQ ID NO: 667288 - DNA, 20 bp, Artificial
  CRISPR gRNA sequence
ccatcaaataagcagacata

SEQ ID NO: 667289 - DNA, 20 bp, Artificial
  CRISPR gRNA sequence
ttctggacctctaaatgaat

SEQ ID NO: 667290 - DNA, 20 bp, Artificial
  CRISPR gRNA sequence
tctggacctctaaatgaatt

SEQ ID NO: 667291 - DNA, 20 bp, Artificial
  CRISPR gRNA sequence
ctggacctctaaatgaattg

SEQ ID NO: 667292 - DNA, 20 bp, Artificial
  CRISPR gRNA sequence
tggacctctaaatgaattgt

SEQ ID NO: 667293 - DNA, 20 bp, Artificial
  CRISPR gRNA sequence
gacctctaaatgaattgtta

SEQ ID NO: 667294 - DNA, 20 bp, Artificial
  CRISPR gRNA sequence
taaatgaattgttaaaaacc

SEQ ID NO: 667295 - DNA, 20 bp, Artificial
  CRISPR gRNA sequence
aatgaattgttaaaaaccct

SEQ ID NO: 667296 - DNA, 20 bp, Artificial
  CRISPR gRNA sequence
ttaaaaaccctgcaaaccaa

SEQ ID NO: 667297 - DNA, 20 bp, Artificial
  CRISPR gRNA sequence
aaaaccctgcaaaccaaagc

SEQ ID NO: 667298 - DNA, 20 bp, Artificial
  CRISPR gRNA sequence
caaaccaaagcaacatttct

SEQ ID NO: 667299 - DNA, 20 bp, Artificial
  CRISPR gRNA sequence
ctcctctgaaattatatttt

SEQ ID NO: 667300 - DNA, 20 bp, Artificial
  CRISPR gRNA sequence
tcctctgaaattatattttg

SEQ ID NO: 667301 - DNA, 20 bp, Artificial
  CRISPR gRNA sequence
ctctgaaattatattttgca

SEQ ID NO: 667302 - DNA, 20 bp, Artificial
  CRISPR gRNA sequence
tgaaattatattttgcaaac

SEQ ID NO: 667303 - DNA, 20 bp, Artificial
  CRISPR gRNA sequence
aaattatattttgcaaacat

SEQ ID NO: 667304 - DNA, 20 bp, Artificial
  CRISPR gRNA sequence
tattttgcaaacatatttta

SEQ ID NO: 667305 - DNA, 20 bp, Artificial
  CRISPR gRNA sequence
tgcaaacatattttagaagg

SEQ ID NO: 667306 - DNA, 20 bp, Artificial
  CRISPR gRNA sequence
gcaaacatattttagaagga

SEQ ID NO: 667307 - DNA, 20 bp, Artificial
  CRISPR gRNA sequence
caaacatattttagaaggaa

SEQ ID NO: 667308 - DNA, 20 bp, Artificial
  CRISPR gRNA sequence
tagaaggaaaacttgaactg

SEQ ID NO: 667309 - DNA, 20 bp, Artificial
  CRISPR gRNA sequence
agaaggaaaacttgaactgt

SEQ ID NO: 667310 - DNA, 20 bp, Artificial
  CRISPR gRNA sequence
gaaggaaaacttgaactgtc

SEQ ID NO: 667311 - DNA, 20 bp, Artificial
  CRISPR gRNA sequence
gaactgtcaaaagtagtgaa

SEQ ID NO: 667312 - DNA, 20 bp, Artificial
  CRISPR gRNA sequence
aactgtcaaaagtagtgaaa

SEQ ID NO: 667313 - DNA, 20 bp, Artificial
  CRISPR gRNA sequence
tcaaaagtagtgaaatgtct

SEQ ID NO: 667314 - DNA, 20 bp, Artificial
  CRISPR gRNA sequence
cagtgtttatggatgtaata

SEQ ID NO: 667315 - DNA, 20 bp, Artificial
  CRISPR gRNA sequence
atggatgtaataagtgaatt

SEQ ID NO: 667316 - DNA, 20 bp, Artificial
  CRISPR gRNA sequence
tggatgtaataagtgaatta

SEQ ID NO: 667317 - DNA, 20 bp, Artificial
  CRISPR gRNA sequence
gctgaaaccccatccaaaaa

SEQ ID NO: 667318 - DNA, 20 bp, Artificial
  CRISPR gRNA sequence
aaaccccatccaaaaaaatt

SEQ ID NO: 667319 - DNA, 20 bp, Artificial
  CRISPR gRNA sequence
tcagtgaaatttatgagtct

SEQ ID NO: 667320 - DNA, 20 bp, Artificial
  CRISPR gRNA sequence
atgagtctttttgctatctg

SEQ ID NO: 667321 - DNA, 20 bp, Artificial
  CRISPR gRNA sequence
tgagtctttttgctatctgt

SEQ ID NO: 667322 - DNA, 20 bp, Artificial
  CRISPR gRNA sequence
tttgctatctgtatggagtt

SEQ ID NO: 667323 - DNA, 20 bp, Artificial
  CRISPR gRNA sequence
ttgctatctgtatggagttg

SEQ ID NO: 667324 - DNA, 20 bp, Artificial
  CRISPR gRNA sequence
tgctatctgtatggagttgg

SEQ ID NO: 667325 - DNA, 20 bp, Artificial
  CRISPR gRNA sequence
gctatctgtatggagttggc

SEQ ID NO: 667326 - DNA, 20 bp, Artificial
  CRISPR gRNA sequence
ctatctgtatggagttggca

SEQ ID NO: 667327 - DNA, 20 bp, Artificial
  CRISPR gRNA sequence
tctgtatggagttggcagca

SEQ ID NO: 667328 - DNA, 20 bp, Artificial
  CRISPR gRNA sequence
tatggagttggcagcaggtg

SEQ ID NO: 667329 - DNA, 20 bp, Artificial
  CRISPR gRNA sequence
gcagcaggtgtttcttactc

SEQ ID NO: 667330 - DNA, 20 bp, Artificial
  CRISPR gRNA sequence
cttactcacacactcaccaa

SEQ ID NO: 667331 - DNA, 20 bp, Artificial
  CRISPR gRNA sequence
ttactcacacactcaccaaa

SEQ ID NO: 667332 - DNA, 20 bp, Artificial
  CRISPR gRNA sequence
actcacacactcaccaaact

SEQ ID NO: 667333 - DNA, 20 bp, Artificial
  CRISPR gRNA sequence
ctcacacactcaccaaactt

SEQ ID NO: 667334 - DNA, 20 bp, Artificial
  CRISPR gRNA sequence
acacactcaccaaactttga

SEQ ID NO: 667335 - DNA, 20 bp, Artificial
  CRISPR gRNA sequence
accaaactttgaagaagagt

SEQ ID NO: 667336 - DNA, 20 bp, Artificial
  CRISPR gRNA sequence
tgaagaagagtatttttaac

SEQ ID NO: 667337 - DNA, 20 bp, Artificial
  CRISPR gRNA sequence
gaagaagagtatttttaacc

SEQ ID NO: 667338 - DNA, 20 bp, Artificial
  CRISPR gRNA sequence
aagaagagtatttttaaccc

SEQ ID NO: 667339 - DNA, 20 bp, Artificial
  CRISPR gRNA sequence
ttaacccttgctttataata

SEQ ID NO: 667340 - DNA, 20 bp, Artificial
  CRISPR gRNA sequence
taacccttgctttataatag

SEQ ID NO: 667341 - DNA, 20 bp, Artificial
  CRISPR gRNA sequence
aacccttgctttataatagg

SEQ ID NO: 667342 - DNA, 20 bp, Artificial
  CRISPR gRNA sequence
acccttgctttataataggc

SEQ ID NO: 667343 - DNA, 20 bp, Artificial
  CRISPR gRNA sequence
gctttataataggcaagttc

SEQ ID NO: 667344 - DNA, 20 bp, Artificial
  CRISPR gRNA sequence
ctttataataggcaagttcc

SEQ ID NO: 667345 - DNA, 20 bp, Artificial
  CRISPR gRNA sequence
tataataggcaagttccgat

SEQ ID NO: 667346 - DNA, 20 bp, Artificial
  CRISPR gRNA sequence
ataataggcaagttccgatg

SEQ ID NO: 667347 - DNA, 20 bp, Artificial
  CRISPR gRNA sequence
taataggcaagttccgatga

SEQ ID NO: 667348 - DNA, 20 bp, Artificial
  CRISPR gRNA sequence
cgatgatctaaatatttctt

SEQ ID NO: 667349 - DNA, 20 bp, Artificial
  CRISPR gRNA sequence
aatatttcttcatattctgt

SEQ ID NO: 667350 - DNA, 20 bp, Artificial
  CRISPR gRNA sequence
cttcatattctgtatactga

SEQ ID NO: 667351 - DNA, 20 bp, Artificial
  CRISPR gRNA sequence
ttcatattctgtatactgag

SEQ ID NO: 667352 - DNA, 20 bp, Artificial
  CRISPR gRNA sequence
catattctgtatactgagtg

SEQ ID NO: 667353 - DNA, 20 bp, Artificial
  CRISPR gRNA sequence
atattctgtatactgagtgc

SEQ ID NO: 667354 - DNA, 20 bp, Artificial
  CRISPR gRNA sequence
tgtatactgagtgccttgag

SEQ ID NO: 667355 - DNA, 20 bp, Artificial
  CRISPR gRNA sequence
tatactgagtgccttgagta

SEQ ID NO: 667356 - DNA, 20 bp, Artificial
  CRISPR gRNA sequence
agtgccttgagtaatttgaa

SEQ ID NO: 667357 - DNA, 20 bp, Artificial
  CRISPR gRNA sequence
gagtaatttgaatgatatgg

SEQ ID NO: 667358 - DNA, 20 bp, Artificial
  CRISPR gRNA sequence
agtaatttgaatgatatggg

SEQ ID NO: 667359 - DNA, 20 bp, Artificial
  CRISPR gRNA sequence
gaatgatatgggatattgac

SEQ ID NO: 667360 - DNA, 20 bp, Artificial
  CRISPR gRNA sequence
aatgatatgggatattgact

SEQ ID NO: 667361 - DNA, 20 bp, Artificial
  CRISPR gRNA sequence
actatatatgtgttaagttc

SEQ ID NO: 667362 - DNA, 20 bp, Artificial
  CRISPR gRNA sequence
tatatgtgttaagttctaaa

SEQ ID NO: 667363 - DNA, 20 bp, Artificial
  CRISPR gRNA sequence
agttctaaatccaataaact

SEQ ID NO: 667364 - DNA, 20 bp, Artificial
  CRISPR gRNA sequence
taaatccaataaacttagag

SEQ ID NO: 667365 - DNA, 20 bp, Artificial
  CRISPR gRNA sequence
aatccaataaacttagagtt

SEQ ID NO: 667366 - DNA, 20 bp, Artificial
  CRISPR gRNA sequence
agagttttaaagttgactta

SEQ ID NO: 667367 - DNA, 20 bp, Artificial
  CRISPR gRNA sequence
gagttttaaagttgacttag

SEQ ID NO: 667368 - DNA, 20 bp, Artificial
  CRISPR gRNA sequence
taaagttgacttagtcagag

SEQ ID NO: 667369 - DNA, 20 bp, Artificial
  CRISPR gRNA sequence
aaagttgacttagtcagagg

SEQ ID NO: 667370 - DNA, 20 bp, Artificial
  CRISPR gRNA sequence
aagttgacttagtcagaggg

SEQ ID NO: 667371 - DNA, 20 bp, Artificial
  CRISPR gRNA sequence
acttagtcagagggtttgct

SEQ ID NO: 667372 - DNA, 20 bp, Artificial
  CRISPR gRNA sequence
agtcagagggtttgcttcat

SEQ ID NO: 667373 - DNA, 20 bp, Artificial
  CRISPR gRNA sequence
gtcagagggtttgcttcatt

SEQ ID NO: 667374 - DNA, 20 bp, Artificial
  CRISPR gRNA sequence
gcttcattgctaacattagc

SEQ ID NO: 667375 - DNA, 20 bp, Artificial
  CRISPR gRNA sequence
cttcattgctaacattagca

SEQ ID NO: 667376 - DNA, 20 bp, Artificial
  CRISPR gRNA sequence
cattgctaacattagcacag

SEQ ID NO: 667377 - DNA, 20 bp, Artificial
  CRISPR gRNA sequence
attgctaacattagcacaga

SEQ ID NO: 667378 - DNA, 20 bp, Artificial
  CRISPR gRNA sequence
ctaacattagcacagattct

SEQ ID NO: 667379 - DNA, 20 bp, Artificial
  CRISPR gRNA sequence
acattagcacagattctttt

SEQ ID NO: 667380 - DNA, 20 bp, Artificial
  CRISPR gRNA sequence
gcacagattcttttgtgcaa

SEQ ID NO: 667381 - DNA, 20 bp, Artificial
  CRISPR gRNA sequence
ttttgtgcaaatgtaccttt

SEQ ID NO: 667382 - DNA, 20 bp, Artificial
  CRISPR gRNA sequence
ttgtgcaaatgtaccttttc

SEQ ID NO: 667383 - DNA, 20 bp, Artificial
  CRISPR gRNA sequence
tgtgcaaatgtaccttttct

SEQ ID NO: 667384 - DNA, 20 bp, Artificial
  CRISPR gRNA sequence
gtgcaaatgtaccttttctt

SEQ ID NO: 667385 - DNA, 20 bp, Artificial
  CRISPR gRNA sequence
tgcaaatgtaccttttcttc

SEQ ID NO: 667386 - DNA, 20 bp, Artificial
  CRISPR gRNA sequence
ttcttccttttatctatgtt

SEQ ID NO: 667387 - DNA, 20 bp, Artificial
  CRISPR gRNA sequence
tcttccttttatctatgttt

SEQ ID NO: 667388 - DNA, 20 bp, Artificial
  CRISPR gRNA sequence
cttccttttatctatgtttt

SEQ ID NO: 667389 - DNA, 20 bp, Artificial
  CRISPR gRNA sequence
ttccttttatctatgttttt

SEQ ID NO: 667390 - DNA, 20 bp, Artificial
  CRISPR gRNA sequence
ccttttatctatgtttttat

SEQ ID NO: 667391 - DNA, 20 bp, Artificial
  CRISPR gRNA sequence
cttttatctatgtttttatc

SEQ ID NO: 667392 - DNA, 20 bp, Artificial
  CRISPR gRNA sequence
ttatctatgtttttatcatt

SEQ ID NO: 667393 - DNA, 20 bp, Artificial
  CRISPR gRNA sequence
tatctatgtttttatcatta

SEQ ID NO: 667394 - DNA, 20 bp, Artificial
  CRISPR gRNA sequence
atctatgtttttatcattat

SEQ ID NO: 667395 - DNA, 20 bp, Artificial
  CRISPR gRNA sequence
tctatgtttttatcattata

SEQ ID NO: 667396 - DNA, 20 bp, Artificial
  CRISPR gRNA sequence
tgtttttatcattataaatc

SEQ ID NO: 667397 - DNA, 20 bp, Artificial
  CRISPR gRNA sequence
ttatcattataaatcttatt

SEQ ID NO: 667398 - DNA, 20 bp, Artificial
  CRISPR gRNA sequence
tatcattataaatcttattt

SEQ ID NO: 667399 - DNA, 20 bp, Artificial
  CRISPR gRNA sequence
atcattataaatcttatttc

SEQ ID NO: 667400 - DNA, 20 bp, Artificial
  CRISPR gRNA sequence
tcattataaatcttatttct

SEQ ID NO: 667401 - DNA, 20 bp, Artificial
  CRISPR gRNA sequence
taaatcttatttcttgcatt

SEQ ID NO: 667402 - DNA, 20 bp, Artificial
  CRISPR gRNA sequence
atttcttgcattaatataac

SEQ ID NO: 667403 - DNA, 20 bp, Artificial
  CRISPR gRNA sequence
tttcttgcattaatataaca

SEQ ID NO: 667404 - DNA, 20 bp, Artificial
  CRISPR gRNA sequence
cttgcattaatataacatca

SEQ ID NO: 667405 - DNA, 20 bp, Artificial
  CRISPR gRNA sequence
ttgcattaatataacatcac

SEQ ID NO: 667406 - DNA, 20 bp, Artificial
  CRISPR gRNA sequence
gcattaatataacatcacag

SEQ ID NO: 667407 - DNA, 20 bp, Artificial
  CRISPR gRNA sequence
cattaatataacatcacagg

SEQ ID NO: 667408 - DNA, 20 bp, Artificial
  CRISPR gRNA sequence
atataacatcacaggataag

SEQ ID NO: 667409 - DNA, 20 bp, Artificial
  CRISPR gRNA sequence
gtaaaaagtacattggttta

SEQ ID NO: 667410 - DNA, 20 bp, Artificial
  CRISPR gRNA sequence
gtttataaaagaagggacct

SEQ ID NO: 667411 - DNA, 20 bp, Artificial
  CRISPR gRNA sequence
ataaaagaagggacctattg

SEQ ID NO: 667412 - DNA, 20 bp, Artificial
  CRISPR gRNA sequence
taaaagaagggacctattga

SEQ ID NO: 667413 - DNA, 20 bp, Artificial
  CRISPR gRNA sequence
ttgacatttgctgtaccttg

SEQ ID NO: 667414 - DNA, 20 bp, Artificial
  CRISPR gRNA sequence
acatttgctgtaccttgtat

SEQ ID NO: 667415 - DNA, 20 bp, Artificial
  CRISPR gRNA sequence
gctgtaccttgtatatttgc

SEQ ID NO: 667416 - DNA, 20 bp, Artificial
  CRISPR gRNA sequence
ctgtaccttgtatatttgct

SEQ ID NO: 667417 - DNA, 20 bp, Artificial
  CRISPR gRNA sequence
taccttgtatatttgctcat

SEQ ID NO: 667418 - DNA, 20 bp, Artificial
  CRISPR gRNA sequence
gtatatttgctcatatttct

SEQ ID NO: 667419 - DNA, 20 bp, Artificial
  CRISPR gRNA sequence
tatatttgctcatatttcta

SEQ ID NO: 667420 - DNA, 20 bp, Artificial
  CRISPR gRNA sequence
gctcatatttctagatagct

SEQ ID NO: 667421 - DNA, 20 bp, Artificial
  CRISPR gRNA sequence
ctcatatttctagatagctg

SEQ ID NO: 667422 - DNA, 20 bp, Artificial
  CRISPR gRNA sequence
atatttctagatagctgttt

SEQ ID NO: 667423 - DNA, 20 bp, Artificial
  CRISPR gRNA sequence
ctagatagctgttttatttc

SEQ ID NO: 667424 - DNA, 20 bp, Artificial
  CRISPR gRNA sequence
tagatagctgttttatttcc

SEQ ID NO: 667425 - DNA, 20 bp, Artificial
  CRISPR gRNA sequence
gatagctgttttatttcctt

SEQ ID NO: 667426 - DNA, 20 bp, Artificial
  CRISPR gRNA sequence
ttttatttccttaatttggc

SEQ ID NO: 667427 - DNA, 20 bp, Artificial
  CRISPR gRNA sequence
tatttccttaatttggctgt

SEQ ID NO: 667428 - DNA, 20 bp, Artificial
  CRISPR gRNA sequence
atttccttaatttggctgta

SEQ ID NO: 667429 - DNA, 20 bp, Artificial
  CRISPR gRNA sequence
tttccttaatttggctgtaa

SEQ ID NO: 667430 - DNA, 20 bp, Artificial
  CRISPR gRNA sequence
ccttaatttggctgtaaact

SEQ ID NO: 667431 - DNA, 20 bp, Artificial
  CRISPR gRNA sequence
cttaatttggctgtaaactt

SEQ ID NO: 667432 - DNA, 20 bp, Artificial
  CRISPR gRNA sequence
aatttggctgtaaacttctt

SEQ ID NO: 667433 - DNA, 20 bp, Artificial
  CRISPR gRNA sequence
atttggctgtaaacttcttg

SEQ ID NO: 667434 - DNA, 20 bp, Artificial
  CRISPR gRNA sequence
ggctgtaaacttcttgagag

SEQ ID NO: 667435 - DNA, 20 bp, Artificial
  CRISPR gRNA sequence
gctgtaaacttcttgagagt

SEQ ID NO: 667436 - DNA, 20 bp, Artificial
  CRISPR gRNA sequence
taaacttcttgagagtaagg

SEQ ID NO: 667437 - DNA, 20 bp, Artificial
  CRISPR gRNA sequence
cttgagagtaaggatcattc

SEQ ID NO: 667438 - DNA, 20 bp, Artificial
  CRISPR gRNA sequence
ttgagagtaaggatcattct

SEQ ID NO: 667439 - DNA, 20 bp, Artificial
  CRISPR gRNA sequence
gagagtaaggatcattcttt

SEQ ID NO: 667440 - DNA, 20 bp, Artificial
  CRISPR gRNA sequence
agagtaaggatcattcttta

SEQ ID NO: 667441 - DNA, 20 bp, Artificial
  CRISPR gRNA sequence
tttatcgttgtatttattcc

SEQ ID NO: 667442 - DNA, 20 bp, Artificial
  CRISPR gRNA sequence
tatcgttgtatttattcctc

SEQ ID NO: 667443 - DNA, 20 bp, Artificial
  CRISPR gRNA sequence
atcgttgtatttattcctca

SEQ ID NO: 667444 - DNA, 20 bp, Artificial
  CRISPR gRNA sequence
tcgttgtatttattcctcaa

SEQ ID NO: 667445 - DNA, 20 bp, Artificial
  CRISPR gRNA sequence
tatttattcctcaaacttag

SEQ ID NO: 667446 - DNA, 20 bp, Artificial
  CRISPR gRNA sequence
attcctcaaacttagcacaa

SEQ ID NO: 667447 - DNA, 20 bp, Artificial
  CRISPR gRNA sequence
ttcctcaaacttagcacaat

SEQ ID NO: 667448 - DNA, 20 bp, Artificial
  CRISPR gRNA sequence
ctcaaacttagcacaatagt

SEQ ID NO: 667449 - DNA, 20 bp, Artificial
  CRISPR gRNA sequence
aaacttagcacaatagtttt

SEQ ID NO: 667450 - DNA, 20 bp, Artificial
  CRISPR gRNA sequence
agcacaatagtttttctatt

SEQ ID NO: 667451 - DNA, 20 bp, Artificial
  CRISPR gRNA sequence
gcacaatagtttttctattg

SEQ ID NO: 667452 - DNA, 20 bp, Artificial
  CRISPR gRNA sequence
ttctattgcaagccttaagt

SEQ ID NO: 667453 - DNA, 20 bp, Artificial
  CRISPR gRNA sequence
tctattgcaagccttaagta

SEQ ID NO: 667454 - DNA, 20 bp, Artificial
  CRISPR gRNA sequence
ctattgcaagccttaagtat

SEQ ID NO: 667455 - DNA, 20 bp, Artificial
  CRISPR gRNA sequence
tattgcaagccttaagtata

SEQ ID NO: 667456 - DNA, 20 bp, Artificial
  CRISPR gRNA sequence
ttgcaagccttaagtataca

SEQ ID NO: 667457 - DNA, 20 bp, Artificial
  CRISPR gRNA sequence
caagccttaagtatacattt

SEQ ID NO: 667458 - DNA, 20 bp, Artificial
  CRISPR gRNA sequence
aagtatacatttattgctgc

SEQ ID NO: 667459 - DNA, 20 bp, Artificial
  CRISPR gRNA sequence
agtatacatttattgctgct

SEQ ID NO: 667460 - DNA, 20 bp, Artificial
  CRISPR gRNA sequence
attgctgcttgatttcatga

SEQ ID NO: 667461 - DNA, 20 bp, Artificial
  CRISPR gRNA sequence
ttgctgcttgatttcatgaa

SEQ ID NO: 667462 - DNA, 20 bp, Artificial
  CRISPR gRNA sequence
ctgcttgatttcatgaaaaa

SEQ ID NO: 667463 - DNA, 20 bp, Artificial
  CRISPR gRNA sequence
cttgatttcatgaaaaactg

SEQ ID NO: 667464 - DNA, 20 bp, Artificial
  CRISPR gRNA sequence
gatttcatgaaaaactgttt

SEQ ID NO: 667465 - DNA, 20 bp, Artificial
  CRISPR gRNA sequence
atttcatgaaaaactgtttt

SEQ ID NO: 667466 - DNA, 20 bp, Artificial
  CRISPR gRNA sequence
catgaaaaactgttttaaca

SEQ ID NO: 667467 - DNA, 20 bp, Artificial
  CRISPR gRNA sequence
atgaaaaactgttttaacat

SEQ ID NO: 667468 - DNA, 20 bp, Artificial
  CRISPR gRNA sequence
ttttaacatatagcacataa

SEQ ID NO: 667469 - DNA, 20 bp, Artificial
  CRISPR gRNA sequence
taacatatagcacataacaa

SEQ ID NO: 667470 - DNA, 20 bp, Artificial
  CRISPR gRNA sequence
aacatatagcacataacaat

SEQ ID NO: 667471 - DNA, 20 bp, Artificial
  CRISPR gRNA sequence
acatatagcacataacaatg

SEQ ID NO: 667472 - DNA, 20 bp, Artificial
  CRISPR gRNA sequence
gaaaaatttctgtttgacat

SEQ ID NO: 667473 - DNA, 20 bp, Artificial
  CRISPR gRNA sequence
ctgtttgacatgttatcaaa

SEQ ID NO: 667474 - DNA, 20 bp, Artificial
  CRISPR gRNA sequence
tgtttgacatgttatcaaaa

SEQ ID NO: 667475 - DNA, 20 bp, Artificial
  CRISPR gRNA sequence
tttgacatgttatcaaaatc

SEQ ID NO: 667476 - DNA, 20 bp, Artificial
  CRISPR gRNA sequence
gacatgttatcaaaatccta

SEQ ID NO: 667477 - DNA, 20 bp, Artificial
  CRISPR gRNA sequence
acatgttatcaaaatcctag

SEQ ID NO: 667478 - DNA, 20 bp, Artificial
  CRISPR gRNA sequence
tcaaaatcctagatatttca

SEQ ID NO: 667479 - DNA, 20 bp, Artificial
  CRISPR gRNA sequence
gatatttcatcactattggg

SEQ ID NO: 667480 - DNA, 20 bp, Artificial
  CRISPR gRNA sequence
catcactattgggtaacttg

SEQ ID NO: 667481 - DNA, 20 bp, Artificial
  CRISPR gRNA sequence
atcactattgggtaacttgt

SEQ ID NO: 667482 - DNA, 20 bp, Artificial
  CRISPR gRNA sequence
ttgggtaacttgtagtcagc

SEQ ID NO: 667483 - DNA, 20 bp, Artificial
  CRISPR gRNA sequence
ggtaacttgtagtcagcctc

SEQ ID NO: 667484 - DNA, 20 bp, Artificial
  CRISPR gRNA sequence
gtagtcagcctcacttgcct

SEQ ID NO: 667485 - DNA, 20 bp, Artificial
  CRISPR gRNA sequence
tagtcagcctcacttgcctt

SEQ ID NO: 667486 - DNA, 20 bp, Artificial
  CRISPR gRNA sequence
acttgcctttaacttgatca

SEQ ID NO: 667487 - DNA, 20 bp, Artificial
  CRISPR gRNA sequence
gcctttaacttgatcatgag

SEQ ID NO: 667488 - DNA, 20 bp, Artificial
  CRISPR gRNA sequence
cctttaacttgatcatgagt

SEQ ID NO: 667489 - DNA, 20 bp, Artificial
  CRISPR gRNA sequence
taacttgatcatgagtccca

SEQ ID NO: 667490 - DNA, 20 bp, Artificial
  CRISPR gRNA sequence
aacttgatcatgagtcccac

SEQ ID NO: 667491 - DNA, 20 bp, Artificial
  CRISPR gRNA sequence
acttgatcatgagtcccact

SEQ ID NO: 667492 - DNA, 20 bp, Artificial
  CRISPR gRNA sequence
gatcatgagtcccacttgct

SEQ ID NO: 667493 - DNA, 20 bp, Artificial
  CRISPR gRNA sequence
atcatgagtcccacttgctc

SEQ ID NO: 667494 - DNA, 20 bp, Artificial
  CRISPR gRNA sequence
gctcttcagagacctttctt

SEQ ID NO: 667495 - DNA, 20 bp, Artificial
  CRISPR gRNA sequence
ctcttcagagacctttcttt

SEQ ID NO: 667496 - DNA, 20 bp, Artificial
  CRISPR gRNA sequence
ttcagagacctttctttagg

SEQ ID NO: 667497 - DNA, 20 bp, Artificial
  CRISPR gRNA sequence
cagagacctttctttaggtc

SEQ ID NO: 667498 - DNA, 20 bp, Artificial
  CRISPR gRNA sequence
agagacctttctttaggtct

SEQ ID NO: 667499 - DNA, 20 bp, Artificial
  CRISPR gRNA sequence
tctttaggtctataaagttc

SEQ ID NO: 667500 - DNA, 20 bp, Artificial
  CRISPR gRNA sequence
ctttaggtctataaagttct

SEQ ID NO: 667501 - DNA, 20 bp, Artificial
  CRISPR gRNA sequence
tttaggtctataaagttctt

SEQ ID NO: 667502 - DNA, 20 bp, Artificial
  CRISPR gRNA sequence
taggtctataaagttcttat

SEQ ID NO: 667503 - DNA, 20 bp, Artificial
  CRISPR gRNA sequence
aggtctataaagttcttatt

SEQ ID NO: 667504 - DNA, 20 bp, Artificial
  CRISPR gRNA sequence
ggtctataaagttcttatta

SEQ ID NO: 667505 - DNA, 20 bp, Artificial
  CRISPR gRNA sequence
taaagttcttattaaaatat

SEQ ID NO: 667506 - DNA, 20 bp, Artificial
  CRISPR gRNA sequence
ttattaaaatataactagtt

SEQ ID NO: 667507 - DNA, 20 bp, Artificial
  CRISPR gRNA sequence
attaaaatataactagttta

SEQ ID NO: 667508 - DNA, 20 bp, Artificial
  CRISPR gRNA sequence
ttaaaatataactagtttag

SEQ ID NO: 667509 - DNA, 20 bp, Artificial
  CRISPR gRNA sequence
aaatataactagtttagttc

SEQ ID NO: 667510 - DNA, 20 bp, Artificial
  CRISPR gRNA sequence
gtttagttcttatttaaact

SEQ ID NO: 667511 - DNA, 20 bp, Artificial
  CRISPR gRNA sequence
agttcttatttaaacttatt

SEQ ID NO: 667512 - DNA, 20 bp, Artificial
  CRISPR gRNA sequence
gttcttatttaaacttattt

SEQ ID NO: 667513 - DNA, 20 bp, Artificial
  CRISPR gRNA sequence
ttatttaaacttatttaagg

SEQ ID NO: 667514 - DNA, 20 bp, Artificial
  CRISPR gRNA sequence
atttaaacttatttaaggac

SEQ ID NO: 667515 - DNA, 20 bp, Artificial
  CRISPR gRNA sequence
tttaaacttatttaaggacc

SEQ ID NO: 667516 - DNA, 20 bp, Artificial
  CRISPR gRNA sequence
aaacttatttaaggacctcc

SEQ ID NO: 667517 - DNA, 20 bp, Artificial
  CRISPR gRNA sequence
aacttatttaaggacctccc

SEQ ID NO: 667518 - DNA, 20 bp, Artificial
  CRISPR gRNA sequence
atttaaggacctccctgact

SEQ ID NO: 667519 - DNA, 20 bp, Artificial
  CRISPR gRNA sequence
tttaaggacctccctgactt

SEQ ID NO: 667520 - DNA, 20 bp, Artificial
  CRISPR gRNA sequence
aaggacctccctgactttgc

SEQ ID NO: 667521 - DNA, 20 bp, Artificial
  CRISPR gRNA sequence
aggacctccctgactttgca

SEQ ID NO: 667522 - DNA, 20 bp, Artificial
  CRISPR gRNA sequence
cctgactttgcagccagacc

SEQ ID NO: 667523 - DNA, 20 bp, Artificial
  CRISPR gRNA sequence
actttgcagccagacctctg

SEQ ID NO: 667524 - DNA, 20 bp, Artificial
  CRISPR gRNA sequence
tgcagccagacctctgacct

SEQ ID NO: 667525 - DNA, 20 bp, Artificial
  CRISPR gRNA sequence
gcagccagacctctgacctt

SEQ ID NO: 667526 - DNA, 20 bp, Artificial
  CRISPR gRNA sequence
cagccagacctctgaccttt

SEQ ID NO: 667527 - DNA, 20 bp, Artificial
  CRISPR gRNA sequence
tgacctttacaattgaatat

SEQ ID NO: 667528 - DNA, 20 bp, Artificial
  CRISPR gRNA sequence
acctttacaattgaatatcc

SEQ ID NO: 667529 - DNA, 20 bp, Artificial
  CRISPR gRNA sequence
tacaattgaatatccttaat

SEQ ID NO: 667530 - DNA, 20 bp, Artificial
  CRISPR gRNA sequence
acaattgaatatccttaatg

SEQ ID NO: 667531 - DNA, 20 bp, Artificial
  CRISPR gRNA sequence
caattgaatatccttaatgg

SEQ ID NO: 667532 - DNA, 20 bp, Artificial
  CRISPR gRNA sequence
aatatccttaatggactcag

SEQ ID NO: 667533 - DNA, 20 bp, Artificial
  CRISPR gRNA sequence
aatggactcagattctggac

SEQ ID NO: 667534 - DNA, 20 bp, Artificial
  CRISPR gRNA sequence
atggactcagattctggacc

SEQ ID NO: 667535 - DNA, 20 bp, Artificial
  CRISPR gRNA sequence
agattctggaccctaccccc

SEQ ID NO: 667536 - DNA, 20 bp, Artificial
  CRISPR gRNA sequence
tggaccctacccccagagga

SEQ ID NO: 667537 - DNA, 20 bp, Artificial
  CRISPR gRNA sequence
gaccctacccccagaggata

SEQ ID NO: 667538 - DNA, 20 bp, Artificial
  CRISPR gRNA sequence
cccccagaggatattaggag

SEQ ID NO: 667539 - DNA, 20 bp, Artificial
  CRISPR gRNA sequence
ggaggggtgtagtagctcac

SEQ ID NO: 667540 - DNA, 20 bp, Artificial
  CRISPR gRNA sequence
actagtttagtacacagtca

SEQ ID NO: 667541 - DNA, 20 bp, Artificial
  CRISPR gRNA sequence
gtttagtacacagtcacatt

SEQ ID NO: 667542 - DNA, 20 bp, Artificial
  CRISPR gRNA sequence
agtacacagtcacatttaat

SEQ ID NO: 667543 - DNA, 20 bp, Artificial
  CRISPR gRNA sequence
gtacacagtcacatttaatg

SEQ ID NO: 667544 - DNA, 20 bp, Artificial
  CRISPR gRNA sequence
aatgtcagttctggtctgac

SEQ ID NO: 667545 - DNA, 20 bp, Artificial
  CRISPR gRNA sequence
atgtcagttctggtctgacc

SEQ ID NO: 667546 - DNA, 20 bp, Artificial
  CRISPR gRNA sequence
tggtctgaccttggtacctc

SEQ ID NO: 667547 - DNA, 20 bp, Artificial
  CRISPR gRNA sequence
gtctgaccttggtacctcgg

SEQ ID NO: 667548 - DNA, 20 bp, Artificial
  CRISPR gRNA sequence
accttggtacctcggttcct

SEQ ID NO: 667549 - DNA, 20 bp, Artificial
  CRISPR gRNA sequence
ggtacctcggttcctcaggg

SEQ ID NO: 667550 - DNA, 20 bp, Artificial
  CRISPR gRNA sequence
gtacctcggttcctcagggc

SEQ ID NO: 667551 - DNA, 20 bp, Artificial
  CRISPR gRNA sequence
ggttcctcagggcatgattt

SEQ ID NO: 667552 - DNA, 20 bp, Artificial
  CRISPR gRNA sequence
ctcagggcatgattttatgg

SEQ ID NO: 667553 - DNA, 20 bp, Artificial
  CRISPR gRNA sequence
agggcatgattttatggttt

SEQ ID NO: 667554 - DNA, 20 bp, Artificial
  CRISPR gRNA sequence
tatggtttgctctcagggtc

SEQ ID NO: 667555 - DNA, 20 bp, Artificial
  CRISPR gRNA sequence
atggtttgctctcagggtct

SEQ ID NO: 667556 - DNA, 20 bp, Artificial
  CRISPR gRNA sequence
tggtttgctctcagggtctt

SEQ ID NO: 667557 - DNA, 20 bp, Artificial
  CRISPR gRNA sequence
gctctcagggtcttgagttt

SEQ ID NO: 667558 - DNA, 20 bp, Artificial
  CRISPR gRNA sequence
ctctcagggtcttgagtttc

SEQ ID NO: 667559 - DNA, 20 bp, Artificial
  CRISPR gRNA sequence
tcagggtcttgagtttcttg

SEQ ID NO: 667560 - DNA, 20 bp, Artificial
  CRISPR gRNA sequence
agggtcttgagtttcttgcc

SEQ ID NO: 667561 - DNA, 20 bp, Artificial
  CRISPR gRNA sequence
gagtttcttgccctgaaaac

SEQ ID NO: 667562 - DNA, 20 bp, Artificial
  CRISPR gRNA sequence
agtttcttgccctgaaaacc

SEQ ID NO: 667563 - DNA, 20 bp, Artificial
  CRISPR gRNA sequence
cttgccctgaaaacccactt

SEQ ID NO: 667564 - DNA, 20 bp, Artificial
  CRISPR gRNA sequence
ttgccctgaaaacccacttt

SEQ ID NO: 667565 - DNA, 20 bp, Artificial
  CRISPR gRNA sequence
gccctgaaaacccactttcc

SEQ ID NO: 667566 - DNA, 20 bp, Artificial
  CRISPR gRNA sequence
ccctgaaaacccactttccc

SEQ ID NO: 667567 - DNA, 20 bp, Artificial
  CRISPR gRNA sequence
aaaacccactttccccatga

SEQ ID NO: 667568 - DNA, 20 bp, Artificial
  CRISPR gRNA sequence
tccccatgactggtacctga

SEQ ID NO: 667569 - DNA, 20 bp, Artificial
  CRISPR gRNA sequence
ccccatgactggtacctgat

SEQ ID NO: 667570 - DNA, 20 bp, Artificial
  CRISPR gRNA sequence
cccatgactggtacctgatg

SEQ ID NO: 667571 - DNA, 20 bp, Artificial
  CRISPR gRNA sequence
gtacctgatgatcactccat

SEQ ID NO: 667572 - DNA, 20 bp, Artificial
  CRISPR gRNA sequence
atgatcactccatttttcat

SEQ ID NO: 667573 - DNA, 20 bp, Artificial
  CRISPR gRNA sequence
catttttcatactccattgc

SEQ ID NO: 667574 - DNA, 20 bp, Artificial
  CRISPR gRNA sequence
ttcatactccattgcattcg

SEQ ID NO: 667575 - DNA, 20 bp, Artificial
  CRISPR gRNA sequence
tcatactccattgcattcgc

SEQ ID NO: 667576 - DNA, 20 bp, Artificial
  CRISPR gRNA sequence
catactccattgcattcgca

SEQ ID NO: 667577 - DNA, 20 bp, Artificial
  CRISPR gRNA sequence
atactccattgcattcgcac

SEQ ID NO: 667578 - DNA, 20 bp, Artificial
  CRISPR gRNA sequence
cattgcattcgcacatgtta

SEQ ID NO: 667579 - DNA, 20 bp, Artificial
  CRISPR gRNA sequence
cattcgcacatgttattccc

SEQ ID NO: 667580 - DNA, 20 bp, Artificial
  CRISPR gRNA sequence
gcacatgttattcccccttc

SEQ ID NO: 667581 - DNA, 20 bp, Artificial
  CRISPR gRNA sequence
ttcccccttctgggatatct

SEQ ID NO: 667582 - DNA, 20 bp, Artificial
  CRISPR gRNA sequence
ccccttctgggatatcttcc

SEQ ID NO: 667583 - DNA, 20 bp, Artificial
  CRISPR gRNA sequence
ctgggatatcttcccaccaa

SEQ ID NO: 667584 - DNA, 20 bp, Artificial
  CRISPR gRNA sequence
tgggatatcttcccaccaag

SEQ ID NO: 667585 - DNA, 20 bp, Artificial
  CRISPR gRNA sequence
ggatatcttcccaccaagtg

SEQ ID NO: 667586 - DNA, 20 bp, Artificial
  CRISPR gRNA sequence
cccaccaagtgtgactggtg

SEQ ID NO: 667587 - DNA, 20 bp, Artificial
  CRISPR gRNA sequence
ccaccaagtgtgactggtga

SEQ ID NO: 667588 - DNA, 20 bp, Artificial
  CRISPR gRNA sequence
gtgaaacttcatgtttcaag

SEQ ID NO: 667589 - DNA, 20 bp, Artificial
  CRISPR gRNA sequence
catgtttcaaggtggaattc

SEQ ID NO: 667590 - DNA, 20 bp, Artificial
  CRISPR gRNA sequence
atgtttcaaggtggaattca

SEQ ID NO: 667591 - DNA, 20 bp, Artificial
  CRISPR gRNA sequence
caaggtggaattcagtcatc

SEQ ID NO: 667592 - DNA, 20 bp, Artificial
  CRISPR gRNA sequence
aaggtggaattcagtcatct

SEQ ID NO: 667593 - DNA, 20 bp, Artificial
  CRISPR gRNA sequence
agtcatcttctttgagaaac

SEQ ID NO: 667594 - DNA, 20 bp, Artificial
  CRISPR gRNA sequence
ctttgagaaaccttccccag

SEQ ID NO: 667595 - DNA, 20 bp, Artificial
  CRISPR gRNA sequence
tttgagaaaccttccccagc

SEQ ID NO: 667596 - DNA, 20 bp, Artificial
  CRISPR gRNA sequence
tgagaaaccttccccagcct

SEQ ID NO: 667597 - DNA, 20 bp, Artificial
  CRISPR gRNA sequence
gagaaaccttccccagccta

SEQ ID NO: 667598 - DNA, 20 bp, Artificial
  CRISPR gRNA sequence
agaaaccttccccagcctac

SEQ ID NO: 667599 - DNA, 20 bp, Artificial
  CRISPR gRNA sequence
ccccagcctacccaaacttc

SEQ ID NO: 667600 - DNA, 20 bp, Artificial
  CRISPR gRNA sequence
cccagcctacccaaacttct

SEQ ID NO: 667601 - DNA, 20 bp, Artificial
  CRISPR gRNA sequence
cccaaacttctttgatcatc

SEQ ID NO: 667602 - DNA, 20 bp, Artificial
  CRISPR gRNA sequence
ctttgatcatcccctctttt

SEQ ID NO: 667603 - DNA, 20 bp, Artificial
  CRISPR gRNA sequence
tttgatcatcccctctttta

SEQ ID NO: 667604 - DNA, 20 bp, Artificial
  CRISPR gRNA sequence
tgatcatcccctcttttata

SEQ ID NO: 667605 - DNA, 20 bp, Artificial
  CRISPR gRNA sequence
gatcatcccctcttttatat

SEQ ID NO: 667606 - DNA, 20 bp, Artificial
  CRISPR gRNA sequence
atcatcccctcttttatatc

SEQ ID NO: 667607 - DNA, 20 bp, Artificial
  CRISPR gRNA sequence
ttttatatcttctccttata

SEQ ID NO: 667608 - DNA, 20 bp, Artificial
  CRISPR gRNA sequence
ttatatcttctccttatacc

SEQ ID NO: 667609 - DNA, 20 bp, Artificial
  CRISPR gRNA sequence
tatatcttctccttatacct

SEQ ID NO: 667610 - DNA, 20 bp, Artificial
  CRISPR gRNA sequence
atatcttctccttatacctg

SEQ ID NO: 667611 - DNA, 20 bp, Artificial
  CRISPR gRNA sequence
tatcttctccttatacctga

SEQ ID NO: 667612 - DNA, 20 bp, Artificial
  CRISPR gRNA sequence
ctccttatacctgagtccac

SEQ ID NO: 667613 - DNA, 20 bp, Artificial
  CRISPR gRNA sequence
tccttatacctgagtccaca

SEQ ID NO: 667614 - DNA, 20 bp, Artificial
  CRISPR gRNA sequence
cttatacctgagtccacaca

SEQ ID NO: 667615 - DNA, 20 bp, Artificial
  CRISPR gRNA sequence
atacctgagtccacacatct

SEQ ID NO: 667616 - DNA, 20 bp, Artificial
  CRISPR gRNA sequence
tacctgagtccacacatcta

SEQ ID NO: 667617 - DNA, 20 bp, Artificial
  CRISPR gRNA sequence
agtccacacatctattagtg

SEQ ID NO: 667618 - DNA, 20 bp, Artificial
  CRISPR gRNA sequence
ttagtgtactcatcatgcca

SEQ ID NO: 667619 - DNA, 20 bp, Artificial
  CRISPR gRNA sequence
gtgtactcatcatgccatat

SEQ ID NO: 667620 - DNA, 20 bp, Artificial
  CRISPR gRNA sequence
atcatgccatattctcatta

SEQ ID NO: 667621 - DNA, 20 bp, Artificial
  CRISPR gRNA sequence
tcattatttgttgactttct

SEQ ID NO: 667622 - DNA, 20 bp, Artificial
  CRISPR gRNA sequence
attatttgttgactttctgt

SEQ ID NO: 667623 - DNA, 20 bp, Artificial
  CRISPR gRNA sequence
tttgttgactttctgtctat

SEQ ID NO: 667624 - DNA, 20 bp, Artificial
  CRISPR gRNA sequence
gttgactttctgtctatatt

SEQ ID NO: 667625 - DNA, 20 bp, Artificial
  CRISPR gRNA sequence
ttgactttctgtctatattg

SEQ ID NO: 667626 - DNA, 20 bp, Artificial
  CRISPR gRNA sequence
actttctgtctatattggac

SEQ ID NO: 667627 - DNA, 20 bp, Artificial
  CRISPR gRNA sequence
tctgtctatattggactttg

SEQ ID NO: 667628 - DNA, 20 bp, Artificial
  CRISPR gRNA sequence
ctgtctatattggactttga

SEQ ID NO: 667629 - DNA, 20 bp, Artificial
  CRISPR gRNA sequence
tgtctatattggactttgag

SEQ ID NO: 667630 - DNA, 20 bp, Artificial
  CRISPR gRNA sequence
tctatattggactttgagct

SEQ ID NO: 667631 - DNA, 20 bp, Artificial
  CRISPR gRNA sequence
tattggactttgagctcatt

SEQ ID NO: 667632 - DNA, 20 bp, Artificial
  CRISPR gRNA sequence
gactttgagctcattgtagt

SEQ ID NO: 667633 - DNA, 20 bp, Artificial
  CRISPR gRNA sequence
tgagctcattgtagttcaat

SEQ ID NO: 667634 - DNA, 20 bp, Artificial
  CRISPR gRNA sequence
gagctcattgtagttcaata

SEQ ID NO: 667635 - DNA, 20 bp, Artificial
  CRISPR gRNA sequence
agctcattgtagttcaataa

SEQ ID NO: 667636 - DNA, 20 bp, Artificial
  CRISPR gRNA sequence
attgtagttcaataaatgtt

SEQ ID NO: 667637 - DNA, 20 bp, Artificial
  CRISPR gRNA sequence
tagttcaataaatgtttaaa

SEQ ID NO: 667638 - DNA, 20 bp, Artificial
  CRISPR gRNA sequence
aataaatgtttaaaagagtg

SEQ ID NO: 667639 - DNA, 20 bp, Artificial
  CRISPR gRNA sequence
aaaagagtgaattacttctg

SEQ ID NO: 667640 - DNA, 20 bp, Artificial
  CRISPR gRNA sequence
aaagagtgaattacttctgt

SEQ ID NO: 667641 - DNA, 20 bp, Artificial
  CRISPR gRNA sequence
cttctgtgactttgttttgg

SEQ ID NO: 667642 - DNA, 20 bp, Artificial
  CRISPR gRNA sequence
ctgtgactttgttttggatc

SEQ ID NO: 667643 - DNA, 20 bp, Artificial
  CRISPR gRNA sequence
tgtgactttgttttggatca

SEQ ID NO: 667644 - DNA, 20 bp, Artificial
  CRISPR gRNA sequence
tgactttgttttggatcatt

SEQ ID NO: 667645 - DNA, 20 bp, Artificial
  CRISPR gRNA sequence
tgttttggatcattgccaat

SEQ ID NO: 667646 - DNA, 20 bp, Artificial
  CRISPR gRNA sequence
gttttggatcattgccaatc

SEQ ID NO: 667647 - DNA, 20 bp, Artificial
  CRISPR gRNA sequence
ttttggatcattgccaatca

SEQ ID NO: 667648 - DNA, 20 bp, Artificial
  CRISPR gRNA sequence
tggatcattgccaatcacct

SEQ ID NO: 667649 - DNA, 20 bp, Artificial
  CRISPR gRNA sequence
ggatcattgccaatcacctg

SEQ ID NO: 667650 - DNA, 20 bp, Artificial
  CRISPR gRNA sequence
gatcattgccaatcacctgt

SEQ ID NO: 667651 - DNA, 20 bp, Artificial
  CRISPR gRNA sequence
ccaatcacctgtcctgcatc

SEQ ID NO: 667652 - DNA, 20 bp, Artificial
  CRISPR gRNA sequence
tcctgcatctacttggagga

SEQ ID NO: 667653 - DNA, 20 bp, Artificial
  CRISPR gRNA sequence
catctacttggaggatatta

SEQ ID NO: 667654 - DNA, 20 bp, Artificial
  CRISPR gRNA sequence
cttggaggatattatagata

SEQ ID NO: 667655 - DNA, 20 bp, Artificial
  CRISPR gRNA sequence
ggaggatattatagatactg

SEQ ID NO: 667656 - DNA, 20 bp, Artificial
  CRISPR gRNA sequence
gaggatattatagatactgg

SEQ ID NO: 667657 - DNA, 20 bp, Artificial
  CRISPR gRNA sequence
tagatactggatttaattga

SEQ ID NO: 667658 - DNA, 20 bp, Artificial
  CRISPR gRNA sequence
gatttaattgaatctactaa

SEQ ID NO: 667659 - DNA, 20 bp, Artificial
  CRISPR gRNA sequence
aattgaatctactaatgaca

SEQ ID NO: 667660 - DNA, 20 bp, Artificial
  CRISPR gRNA sequence
attgaatctactaatgacat

SEQ ID NO: 667661 - DNA, 20 bp, Artificial
  CRISPR gRNA sequence
aatctactaatgacatactt

SEQ ID NO: 667662 - DNA, 20 bp, Artificial
  CRISPR gRNA sequence
ctaatgacatacttacatac

SEQ ID NO: 667663 - DNA, 20 bp, Artificial
  CRISPR gRNA sequence
atgacatacttacataccta

SEQ ID NO: 667664 - DNA, 20 bp, Artificial
  CRISPR gRNA sequence
acatacctattctttttttt

SEQ ID NO: 667665 - DNA, 20 bp, Artificial
  CRISPR gRNA sequence
catacctattcttttttttt

SEQ ID NO: 667666 - DNA, 20 bp, Artificial
  CRISPR gRNA sequence
ttcttttttttttttcttct

SEQ ID NO: 667667 - DNA, 20 bp, Artificial
  CRISPR gRNA sequence
ttttttttttttcttctgtt

SEQ ID NO: 667668 - DNA, 20 bp, Artificial
  CRISPR gRNA sequence
ttttttttttcttctgttct

SEQ ID NO: 667669 - DNA, 20 bp, Artificial
  CRISPR gRNA sequence
tttttttttcttctgttctg

SEQ ID NO: 667670 - DNA, 20 bp, Artificial
  CRISPR gRNA sequence
ttttttttcttctgttctgg

SEQ ID NO: 667671 - DNA, 20 bp, Artificial
  CRISPR gRNA sequence
tttttttcttctgttctggc

SEQ ID NO: 667672 - DNA, 20 bp, Artificial
  CRISPR gRNA sequence
ttttttcttctgttctggct

SEQ ID NO: 667673 - DNA, 20 bp, Artificial
  CRISPR gRNA sequence
tttttcttctgttctggcta

SEQ ID NO: 667674 - DNA, 20 bp, Artificial
  CRISPR gRNA sequence
ttttcttctgttctggctaa

SEQ ID NO: 667675 - DNA, 20 bp, Artificial
  CRISPR gRNA sequence
tttcttctgttctggctaat

SEQ ID NO: 667676 - DNA, 20 bp, Artificial
  CRISPR gRNA sequence
ttcttctgttctggctaata

SEQ ID NO: 667677 - DNA, 20 bp, Artificial
  CRISPR gRNA sequence
tcttctgttctggctaatat

SEQ ID NO: 667678 - DNA, 20 bp, Artificial
  CRISPR gRNA sequence
cttctgttctggctaatatc

SEQ ID NO: 667679 - DNA, 20 bp, Artificial
  CRISPR gRNA sequence
ttctgttctggctaatatcc

SEQ ID NO: 667680 - DNA, 20 bp, Artificial
  CRISPR gRNA sequence
ctgttctggctaatatcctg

SEQ ID NO: 667681 - DNA, 20 bp, Artificial
  CRISPR gRNA sequence
tgttctggctaatatcctga

SEQ ID NO: 667682 - DNA, 20 bp, Artificial
  CRISPR gRNA sequence
ttctggctaatatcctgatt

SEQ ID NO: 667683 - DNA, 20 bp, Artificial
  CRISPR gRNA sequence
tggctaatatcctgatttca

SEQ ID NO: 667684 - DNA, 20 bp, Artificial
  CRISPR gRNA sequence
gctaatatcctgatttcagt

SEQ ID NO: 667685 - DNA, 20 bp, Artificial
  CRISPR gRNA sequence
atatcctgatttcagtgtac

SEQ ID NO: 667686 - DNA, 20 bp, Artificial
  CRISPR gRNA sequence
atttcagtgtacctaccttt

SEQ ID NO: 667687 - DNA, 20 bp, Artificial
  CRISPR gRNA sequence
cagtgtacctacctttgggc

SEQ ID NO: 667688 - DNA, 20 bp, Artificial
  CRISPR gRNA sequence
agtgtacctacctttgggcc

SEQ ID NO: 667689 - DNA, 20 bp, Artificial
  CRISPR gRNA sequence
cctttgggccatgctccagt

SEQ ID NO: 667690 - DNA, 20 bp, Artificial
  CRISPR gRNA sequence
tgggccatgctccagtttgt

SEQ ID NO: 667691 - DNA, 20 bp, Artificial
  CRISPR gRNA sequence
gggccatgctccagtttgtt

SEQ ID NO: 667692 - DNA, 20 bp, Artificial
  CRISPR gRNA sequence
ggccatgctccagtttgttg

SEQ ID NO: 667693 - DNA, 20 bp, Artificial
  CRISPR gRNA sequence
cagtttgttgattgctggga

SEQ ID NO: 667694 - DNA, 20 bp, Artificial
  CRISPR gRNA sequence
gttgattgctgggataacca

SEQ ID NO: 667695 - DNA, 20 bp, Artificial
  CRISPR gRNA sequence
ttgattgctgggataaccac

SEQ ID NO: 667696 - DNA, 20 bp, Artificial
  CRISPR gRNA sequence
attgctgggataaccactgg

SEQ ID NO: 667697 - DNA, 20 bp, Artificial
  CRISPR gRNA sequence
ctgggataaccactggctag

SEQ ID NO: 667698 - DNA, 20 bp, Artificial
  CRISPR gRNA sequence
ggataaccactggctagctc

SEQ ID NO: 667699 - DNA, 20 bp, Artificial
  CRISPR gRNA sequence
gctagctctatatgctgtaa

SEQ ID NO: 667700 - DNA, 20 bp, Artificial
  CRISPR gRNA sequence
gctctatatgctgtaagtct

SEQ ID NO: 667701 - DNA, 20 bp, Artificial
  CRISPR gRNA sequence
tatatgctgtaagtctttct

SEQ ID NO: 667702 - DNA, 20 bp, Artificial
  CRISPR gRNA sequence
tatgctgtaagtctttctga

SEQ ID NO: 667703 - DNA, 20 bp, Artificial
  CRISPR gRNA sequence
taagtctttctgaactacct

SEQ ID NO: 667704 - DNA, 20 bp, Artificial
  CRISPR gRNA sequence
tctgaactacctcctatact

SEQ ID NO: 667705 - DNA, 20 bp, Artificial
  CRISPR gRNA sequence
ctgaactacctcctatactc

SEQ ID NO: 667706 - DNA, 20 bp, Artificial
  CRISPR gRNA sequence
tgaactacctcctatactct

SEQ ID NO: 667707 - DNA, 20 bp, Artificial
  CRISPR gRNA sequence
aactacctcctatactcttc

SEQ ID NO: 667708 - DNA, 20 bp, Artificial
  CRISPR gRNA sequence
cctcctatactcttcccagg

SEQ ID NO: 667709 - DNA, 20 bp, Artificial
  CRISPR gRNA sequence
ctatactcttcccaggcctg

SEQ ID NO: 667710 - DNA, 20 bp, Artificial
  CRISPR gRNA sequence
tactcttcccaggcctggta

SEQ ID NO: 667711 - DNA, 20 bp, Artificial
  CRISPR gRNA sequence
ttcccaggcctggtatgttt

SEQ ID NO: 667712 - DNA, 20 bp, Artificial
  CRISPR gRNA sequence
cccaggcctggtatgtttcc

SEQ ID NO: 667713 - DNA, 20 bp, Artificial
  CRISPR gRNA sequence
ccaggcctggtatgtttcca

SEQ ID NO: 667714 - DNA, 20 bp, Artificial
  CRISPR gRNA sequence
gtatgtttccacttgaccct

SEQ ID NO: 667715 - DNA, 20 bp, Artificial
  CRISPR gRNA sequence
ccacttgaccctcatgggcc

SEQ ID NO: 667716 - DNA, 20 bp, Artificial
  CRISPR gRNA sequence
cacttgaccctcatgggcct

SEQ ID NO: 667717 - DNA, 20 bp, Artificial
  CRISPR gRNA sequence
gaccctcatgggccttactc

SEQ ID NO: 667718 - DNA, 20 bp, Artificial
  CRISPR gRNA sequence
accctcatgggccttactca

SEQ ID NO: 667719 - DNA, 20 bp, Artificial
  CRISPR gRNA sequence
atgggccttactcatcttcc

SEQ ID NO: 667720 - DNA, 20 bp, Artificial
  CRISPR gRNA sequence
actcatcttcctagactcta

SEQ ID NO: 667721 - DNA, 20 bp, Artificial
  CRISPR gRNA sequence
ctcatcttcctagactctag

SEQ ID NO: 667722 - DNA, 20 bp, Artificial
  CRISPR gRNA sequence
atcttcctagactctaggcc

SEQ ID NO: 667723 - DNA, 20 bp, Artificial
  CRISPR gRNA sequence
cctagactctaggccttcac

SEQ ID NO: 667724 - DNA, 20 bp, Artificial
  CRISPR gRNA sequence
ctagactctaggccttcaca

SEQ ID NO: 667725 - DNA, 20 bp, Artificial
  CRISPR gRNA sequence
gactctaggccttcacagac

SEQ ID NO: 667726 - DNA, 20 bp, Artificial
  CRISPR gRNA sequence
taggccttcacagacctaac

SEQ ID NO: 667727 - DNA, 20 bp, Artificial
  CRISPR gRNA sequence
ggccttcacagacctaactt

SEQ ID NO: 667728 - DNA, 20 bp, Artificial
  CRISPR gRNA sequence
cacagacctaacttaataca

SEQ ID NO: 667729 - DNA, 20 bp, Artificial
  CRISPR gRNA sequence
acagacctaacttaatacat

SEQ ID NO: 667730 - DNA, 20 bp, Artificial
  CRISPR gRNA sequence
acttaatacatgttggacat

SEQ ID NO: 667731 - DNA, 20 bp, Artificial
  CRISPR gRNA sequence
aatacatgttggacatataa

SEQ ID NO: 667732 - DNA, 20 bp, Artificial
  CRISPR gRNA sequence
atacatgttggacatataaa

SEQ ID NO: 667733 - DNA, 20 bp, Artificial
  CRISPR gRNA sequence
gacatataaatagaaactct

SEQ ID NO: 667734 - DNA, 20 bp, Artificial
  CRISPR gRNA sequence
taattgcttttttattagtt

SEQ ID NO: 667735 - DNA, 20 bp, Artificial
  CRISPR gRNA sequence
attgcttttttattagttgt

SEQ ID NO: 667736 - DNA, 20 bp, Artificial
  CRISPR gRNA sequence
cttttttattagttgtaata

SEQ ID NO: 667737 - DNA, 20 bp, Artificial
  CRISPR gRNA sequence
ttttattagttgtaatagat

SEQ ID NO: 667738 - DNA, 20 bp, Artificial
  CRISPR gRNA sequence
tttattagttgtaatagatt

SEQ ID NO: 667739 - DNA, 20 bp, Artificial
  CRISPR gRNA sequence
ttattagttgtaatagattt

SEQ ID NO: 667740 - DNA, 20 bp, Artificial
  CRISPR gRNA sequence
tattagttgtaatagattta

SEQ ID NO: 667741 - DNA, 20 bp, Artificial
  CRISPR gRNA sequence
attagttgtaatagatttat

SEQ ID NO: 667742 - DNA, 20 bp, Artificial
  CRISPR gRNA sequence
ttagttgtaatagatttata

SEQ ID NO: 667743 - DNA, 20 bp, Artificial
  CRISPR gRNA sequence
gttgtaatagatttatacta

SEQ ID NO: 667744 - DNA, 20 bp, Artificial
  CRISPR gRNA sequence
taatagatttatactaaaaa

SEQ ID NO: 667745 - DNA, 20 bp, Artificial
  CRISPR gRNA sequence
atactaaaaaaactcaacct

SEQ ID NO: 667746 - DNA, 20 bp, Artificial
  CRISPR gRNA sequence
tactaaaaaaactcaaccta

SEQ ID NO: 667747 - DNA, 20 bp, Artificial
  CRISPR gRNA sequence
aaaaaactcaacctaacacc

SEQ ID NO: 667748 - DNA, 20 bp, Artificial
  CRISPR gRNA sequence
aacctaacaccaaatttttt

SEQ ID NO: 667749 - DNA, 20 bp, Artificial
  CRISPR gRNA sequence
acaccaaatttttttttctt

SEQ ID NO: 667750 - DNA, 20 bp, Artificial
  CRISPR gRNA sequence
ttttttctttatgaaaggga

SEQ ID NO: 667751 - DNA, 20 bp, Artificial
  CRISPR gRNA sequence
tttttctttatgaaagggat

SEQ ID NO: 667752 - DNA, 20 bp, Artificial
  CRISPR gRNA sequence
ttttctttatgaaagggata

SEQ ID NO: 667753 - DNA, 20 bp, Artificial
  CRISPR gRNA sequence
tttctttatgaaagggatat

SEQ ID NO: 667754 - DNA, 20 bp, Artificial
  CRISPR gRNA sequence
ttctttatgaaagggatatt

SEQ ID NO: 667755 - DNA, 20 bp, Artificial
  CRISPR gRNA sequence
tctttatgaaagggatattt

SEQ ID NO: 667756 - DNA, 20 bp, Artificial
  CRISPR gRNA sequence
ctttatgaaagggatattta

SEQ ID NO: 667757 - DNA, 20 bp, Artificial
  CRISPR gRNA sequence
tttatgaaagggatatttaa

SEQ ID NO: 667758 - DNA, 20 bp, Artificial
  CRISPR gRNA sequence
tatgaaagggatatttaatg

SEQ ID NO: 667759 - DNA, 20 bp, Artificial
  CRISPR gRNA sequence
atgaaagggatatttaatga

SEQ ID NO: 667760 - DNA, 20 bp, Artificial
  CRISPR gRNA sequence
tgaaagggatatttaatgat

SEQ ID NO: 667761 - DNA, 20 bp, Artificial
  CRISPR gRNA sequence
aatgattaggactaatttaa

SEQ ID NO: 667762 - DNA, 20 bp, Artificial
  CRISPR gRNA sequence
atgattaggactaatttaac

SEQ ID NO: 667763 - DNA, 20 bp, Artificial
  CRISPR gRNA sequence
ggactaatttaacaataggt

SEQ ID NO: 667764 - DNA, 20 bp, Artificial
  CRISPR gRNA sequence
atttaacaataggtcaagat

SEQ ID NO: 667765 - DNA, 20 bp, Artificial
  CRISPR gRNA sequence
aacaataggtcaagatggtg

SEQ ID NO: 667766 - DNA, 20 bp, Artificial
  CRISPR gRNA sequence
acaataggtcaagatggtgc

SEQ ID NO: 667767 - DNA, 20 bp, Artificial
  CRISPR gRNA sequence
catcccttattaaatggatt

SEQ ID NO: 667768 - DNA, 20 bp, Artificial
  CRISPR gRNA sequence
atcccttattaaatggatta

SEQ ID NO: 667769 - DNA, 20 bp, Artificial
  CRISPR gRNA sequence
attaaatggattagagaagg

SEQ ID NO: 667770 - DNA, 20 bp, Artificial
  CRISPR gRNA sequence
ttaaatggattagagaagga

SEQ ID NO: 667771 - DNA, 20 bp, Artificial
  CRISPR gRNA sequence
aatggattagagaaggagct

SEQ ID NO: 667772 - DNA, 20 bp, Artificial
  CRISPR gRNA sequence
gagaaggagcttagtaaata

SEQ ID NO: 667773 - DNA, 20 bp, Artificial
  CRISPR gRNA sequence
agtaaatagctttttttttc

SEQ ID NO: 667774 - DNA, 20 bp, Artificial
  CRISPR gRNA sequence
gtaaatagctttttttttcc

SEQ ID NO: 667775 - DNA, 20 bp, Artificial
  CRISPR gRNA sequence
tttttttccttccatatgtg

SEQ ID NO: 667776 - DNA, 20 bp, Artificial
  CRISPR gRNA sequence
ttttttccttccatatgtgt

SEQ ID NO: 667777 - DNA, 20 bp, Artificial
  CRISPR gRNA sequence
tttttccttccatatgtgtt

SEQ ID NO: 667778 - DNA, 20 bp, Artificial
  CRISPR gRNA sequence
ttttccttccatatgtgttg

SEQ ID NO: 667779 - DNA, 20 bp, Artificial
  CRISPR gRNA sequence
tttccttccatatgtgttgc

SEQ ID NO: 667780 - DNA, 20 bp, Artificial
  CRISPR gRNA sequence
ttccttccatatgtgttgca

SEQ ID NO: 667781 - DNA, 20 bp, Artificial
  CRISPR gRNA sequence
tccttccatatgtgttgcaa

SEQ ID NO: 667782 - DNA, 20 bp, Artificial
  CRISPR gRNA sequence
ccttccatatgtgttgcaat

SEQ ID NO: 667783 - DNA, 20 bp, Artificial
  CRISPR gRNA sequence
cttccatatgtgttgcaatt

SEQ ID NO: 667784 - DNA, 20 bp, Artificial
  CRISPR gRNA sequence
ccatatgtgttgcaattgtc

SEQ ID NO: 667785 - DNA, 20 bp, Artificial
  CRISPR gRNA sequence
catatgtgttgcaattgtca

SEQ ID NO: 667786 - DNA, 20 bp, Artificial
  CRISPR gRNA sequence
caattgtcaaacctattaga

SEQ ID NO: 667787 - DNA, 20 bp, Artificial
  CRISPR gRNA sequence
tcaaacctattagaattagt

SEQ ID NO: 667788 - DNA, 20 bp, Artificial
  CRISPR gRNA sequence
ttagaattagttaggatttt

SEQ ID NO: 667789 - DNA, 20 bp, Artificial
  CRISPR gRNA sequence
gaattagttaggattttgag

SEQ ID NO: 667790 - DNA, 20 bp, Artificial
  CRISPR gRNA sequence
gttaggattttgagtcagtg

SEQ ID NO: 667791 - DNA, 20 bp, Artificial
  CRISPR gRNA sequence
ggattttgagtcagtgatat

SEQ ID NO: 667792 - DNA, 20 bp, Artificial
  CRISPR gRNA sequence
tgagtcagtgatatgtgtgg

SEQ ID NO: 667793 - DNA, 20 bp, Artificial
  CRISPR gRNA sequence
gagtcagtgatatgtgtggt

SEQ ID NO: 667794 - DNA, 20 bp, Artificial
  CRISPR gRNA sequence
agtcagtgatatgtgtggta

SEQ ID NO: 667795 - DNA, 20 bp, Artificial
  CRISPR gRNA sequence
aaccatttcttgccatggct

SEQ ID NO: 667796 - DNA, 20 bp, Artificial
  CRISPR gRNA sequence
cttgccatggctagcccatg

SEQ ID NO: 667797 - DNA, 20 bp, Artificial
  CRISPR gRNA sequence
ttgccatggctagcccatgt

SEQ ID NO: 667798 - DNA, 20 bp, Artificial
  CRISPR gRNA sequence
gccatggctagcccatgtcc

SEQ ID NO: 667799 - DNA, 20 bp, Artificial
  CRISPR gRNA sequence
ccatggctagcccatgtcct

SEQ ID NO: 667800 - DNA, 20 bp, Artificial
  CRISPR gRNA sequence
gcccatgtcctttatcttaa

SEQ ID NO: 667801 - DNA, 20 bp, Artificial
  CRISPR gRNA sequence
tatcttaaatttgtcagtga

SEQ ID NO: 667802 - DNA, 20 bp, Artificial
  CRISPR gRNA sequence
atcttaaatttgtcagtgat

SEQ ID NO: 667803 - DNA, 20 bp, Artificial
  CRISPR gRNA sequence
tcttaaatttgtcagtgatt

SEQ ID NO: 667804 - DNA, 20 bp, Artificial
  CRISPR gRNA sequence
aaatttgtcagtgatttaaa

SEQ ID NO: 667805 - DNA, 20 bp, Artificial
  CRISPR gRNA sequence
aatttgtcagtgatttaaag

SEQ ID NO: 667806 - DNA, 20 bp, Artificial
  CRISPR gRNA sequence
gtcagtgatttaaagattaa

SEQ ID NO: 667807 - DNA, 20 bp, Artificial
  CRISPR gRNA sequence
tcagtgatttaaagattaat

SEQ ID NO: 667808 - DNA, 20 bp, Artificial
  CRISPR gRNA sequence
aaagattaatgttgttcctt

SEQ ID NO: 667809 - DNA, 20 bp, Artificial
  CRISPR gRNA sequence
aagattaatgttgttccttt

SEQ ID NO: 667810 - DNA, 20 bp, Artificial
  CRISPR gRNA sequence
atgttgttcctttaaaaata

SEQ ID NO: 667811 - DNA, 20 bp, Artificial
  CRISPR gRNA sequence
ttcctttaaaaatattcact

SEQ ID NO: 667812 - DNA, 20 bp, Artificial
  CRISPR gRNA sequence
ctttaaaaatattcactaga

SEQ ID NO: 667813 - DNA, 20 bp, Artificial
  CRISPR gRNA sequence
taaaaatattcactagatac

SEQ ID NO: 667814 - DNA, 20 bp, Artificial
  CRISPR gRNA sequence
aaaaatattcactagataca

SEQ ID NO: 667815 - DNA, 20 bp, Artificial
  CRISPR gRNA sequence
aaaatattcactagatacat

SEQ ID NO: 667816 - DNA, 20 bp, Artificial
  CRISPR gRNA sequence
actagatacatgaaaattta

SEQ ID NO: 667817 - DNA, 20 bp, Artificial
  CRISPR gRNA sequence
gatacatgaaaatttactag

SEQ ID NO: 667818 - DNA, 20 bp, Artificial
  CRISPR gRNA sequence
actagttgtaagaaaatatt

SEQ ID NO: 667819 - DNA, 20 bp, Artificial
  CRISPR gRNA sequence
ctagttgtaagaaaatattt

SEQ ID NO: 667820 - DNA, 20 bp, Artificial
  CRISPR gRNA sequence
gttgtaagaaaatatttaaa

SEQ ID NO: 667821 - DNA, 20 bp, Artificial
  CRISPR gRNA sequence
taagaaaatatttaaaagtc

SEQ ID NO: 667822 - DNA, 20 bp, Artificial
  CRISPR gRNA sequence
aaaagtcttttctgaacatt

SEQ ID NO: 667823 - DNA, 20 bp, Artificial
  CRISPR gRNA sequence
aaagtcttttctgaacattt

SEQ ID NO: 667824 - DNA, 20 bp, Artificial
  CRISPR gRNA sequence
ttctgaacatttagttctca

SEQ ID NO: 667825 - DNA, 20 bp, Artificial
  CRISPR gRNA sequence
tctgaacatttagttctcat

SEQ ID NO: 667826 - DNA, 20 bp, Artificial
  CRISPR gRNA sequence
ctgaacatttagttctcatt

SEQ ID NO: 667827 - DNA, 20 bp, Artificial
  CRISPR gRNA sequence
tgaacatttagttctcattt

SEQ ID NO: 667828 - DNA, 20 bp, Artificial
  CRISPR gRNA sequence
aacatttagttctcatttat

SEQ ID NO: 667829 - DNA, 20 bp, Artificial
  CRISPR gRNA sequence
agttctcatttattttgaac

SEQ ID NO: 667830 - DNA, 20 bp, Artificial
  CRISPR gRNA sequence
gttctcatttattttgaact

SEQ ID NO: 667831 - DNA, 20 bp, Artificial
  CRISPR gRNA sequence
tcatttattttgaactagtc

SEQ ID NO: 667832 - DNA, 20 bp, Artificial
  CRISPR gRNA sequence
atttattttgaactagtctt

SEQ ID NO: 667833 - DNA, 20 bp, Artificial
  CRISPR gRNA sequence
attttgaactagtcttaatc

SEQ ID NO: 667834 - DNA, 20 bp, Artificial
  CRISPR gRNA sequence
ttttgaactagtcttaatca

SEQ ID NO: 667835 - DNA, 20 bp, Artificial
  CRISPR gRNA sequence
tgaactagtcttaatcactt

SEQ ID NO: 667836 - DNA, 20 bp, Artificial
  CRISPR gRNA sequence
gaactagtcttaatcacttg

SEQ ID NO: 667837 - DNA, 20 bp, Artificial
  CRISPR gRNA sequence
aactagtcttaatcacttgc

SEQ ID NO: 667838 - DNA, 20 bp, Artificial
  CRISPR gRNA sequence
gtcttaatcacttgcatttt

SEQ ID NO: 667839 - DNA, 20 bp, Artificial
  CRISPR gRNA sequence
aatcacttgcattttaccca

SEQ ID NO: 667840 - DNA, 20 bp, Artificial
  CRISPR gRNA sequence
atcacttgcattttacccat

SEQ ID NO: 667841 - DNA, 20 bp, Artificial
  CRISPR gRNA sequence
gcattttacccatgtctctt

SEQ ID NO: 667842 - DNA, 20 bp, Artificial
  CRISPR gRNA sequence
cattttacccatgtctctta

SEQ ID NO: 667843 - DNA, 20 bp, Artificial
  CRISPR gRNA sequence
tacccatgtctcttacagtc

SEQ ID NO: 667844 - DNA, 20 bp, Artificial
  CRISPR gRNA sequence
acccatgtctcttacagtca

SEQ ID NO: 667845 - DNA, 20 bp, Artificial
  CRISPR gRNA sequence
cccatgtctcttacagtcat

SEQ ID NO: 667846 - DNA, 20 bp, Artificial
  CRISPR gRNA sequence
ttacagtcatacattattag

SEQ ID NO: 667847 - DNA, 20 bp, Artificial
  CRISPR gRNA sequence
acagtcatacattattagag

SEQ ID NO: 667848 - DNA, 20 bp, Artificial
  CRISPR gRNA sequence
cagtcatacattattagagg

SEQ ID NO: 667849 - DNA, 20 bp, Artificial
  CRISPR gRNA sequence
ttagagggttttttcactta

SEQ ID NO: 667850 - DNA, 20 bp, Artificial
  CRISPR gRNA sequence
gagggttttttcacttattt

SEQ ID NO: 667851 - DNA, 20 bp, Artificial
  CRISPR gRNA sequence
tttcacttattttctatttc

SEQ ID NO: 667852 - DNA, 20 bp, Artificial
  CRISPR gRNA sequence
ttcacttattttctatttca

SEQ ID NO: 667853 - DNA, 20 bp, Artificial
  CRISPR gRNA sequence
tcacttattttctatttcaa

SEQ ID NO: 667854 - DNA, 20 bp, Artificial
  CRISPR gRNA sequence
cacttattttctatttcaac

SEQ ID NO: 667855 - DNA, 20 bp, Artificial
  CRISPR gRNA sequence
acttattttctatttcaacc

SEQ ID NO: 667856 - DNA, 20 bp, Artificial
  CRISPR gRNA sequence
attttctatttcaaccattt

SEQ ID NO: 667857 - DNA, 20 bp, Artificial
  CRISPR gRNA sequence
ttttctatttcaaccatttt

SEQ ID NO: 667858 - DNA, 20 bp, Artificial
  CRISPR gRNA sequence
tctatttcaaccattttcaa

SEQ ID NO: 667859 - DNA, 20 bp, Artificial
  CRISPR gRNA sequence
ctatttcaaccattttcaaa

SEQ ID NO: 667860 - DNA, 20 bp, Artificial
  CRISPR gRNA sequence
tatttcaaccattttcaaag

SEQ ID NO: 667861 - DNA, 20 bp, Artificial
  CRISPR gRNA sequence
tttcaaccattttcaaagtt

SEQ ID NO: 667862 - DNA, 20 bp, Artificial
  CRISPR gRNA sequence
caaccattttcaaagttttc

SEQ ID NO: 667863 - DNA, 20 bp, Artificial
  CRISPR gRNA sequence
aaccattttcaaagttttct

SEQ ID NO: 667864 - DNA, 20 bp, Artificial
  CRISPR gRNA sequence
tcaaagttttctgaattata

SEQ ID NO: 667865 - DNA, 20 bp, Artificial
  CRISPR gRNA sequence
caaagttttctgaattataa

SEQ ID NO: 667866 - DNA, 20 bp, Artificial
  CRISPR gRNA sequence
aaagttttctgaattataat

SEQ ID NO: 667867 - DNA, 20 bp, Artificial
  CRISPR gRNA sequence
tctgaattataatagttgca

SEQ ID NO: 667868 - DNA, 20 bp, Artificial
  CRISPR gRNA sequence
ctgaattataatagttgcag

SEQ ID NO: 667869 - DNA, 20 bp, Artificial
  CRISPR gRNA sequence
tgaattataatagttgcagt

SEQ ID NO: 667870 - DNA, 20 bp, Artificial
  CRISPR gRNA sequence
aattataatagttgcagttt

SEQ ID NO: 667871 - DNA, 20 bp, Artificial
  CRISPR gRNA sequence
taatagttgcagtttcataa

SEQ ID NO: 667872 - DNA, 20 bp, Artificial
  CRISPR gRNA sequence
cagtttcataactgttgctc

SEQ ID NO: 667873 - DNA, 20 bp, Artificial
  CRISPR gRNA sequence
cataactgttgctcccccat

SEQ ID NO: 667874 - DNA, 20 bp, Artificial
  CRISPR gRNA sequence
ataactgttgctcccccatt

SEQ ID NO: 667875 - DNA, 20 bp, Artificial
  CRISPR gRNA sequence
ttgctcccccattcattgat

SEQ ID NO: 667876 - DNA, 20 bp, Artificial
  CRISPR gRNA sequence
ctcccccattcattgattga

SEQ ID NO: 667877 - DNA, 20 bp, Artificial
  CRISPR gRNA sequence
ccccattcattgattgattt

SEQ ID NO: 667878 - DNA, 20 bp, Artificial
  CRISPR gRNA sequence
attgattgatttgttctcct

SEQ ID NO: 667879 - DNA, 20 bp, Artificial
  CRISPR gRNA sequence
attgatttgttctcctcgtt

SEQ ID NO: 667880 - DNA, 20 bp, Artificial
  CRISPR gRNA sequence
atttgttctcctcgttttct

SEQ ID NO: 667881 - DNA, 20 bp, Artificial
  CRISPR gRNA sequence
gttctcctcgttttctcttt

SEQ ID NO: 667882 - DNA, 20 bp, Artificial
  CRISPR gRNA sequence
ttctcctcgttttctctttc

SEQ ID NO: 667883 - DNA, 20 bp, Artificial
  CRISPR gRNA sequence
tcctcgttttctctttcctt

SEQ ID NO: 667884 - DNA, 20 bp, Artificial
  CRISPR gRNA sequence
ctcgttttctctttccttta

SEQ ID NO: 667885 - DNA, 20 bp, Artificial
  CRISPR gRNA sequence
gttttctctttcctttaatg

SEQ ID NO: 667886 - DNA, 20 bp, Artificial
  CRISPR gRNA sequence
tctctttcctttaatgttga

SEQ ID NO: 667887 - DNA, 20 bp, Artificial
  CRISPR gRNA sequence
ctctttcctttaatgttgaa

SEQ ID NO: 667888 - DNA, 20 bp, Artificial
  CRISPR gRNA sequence
tctttcctttaatgttgaaa

SEQ ID NO: 667889 - DNA, 20 bp, Artificial
  CRISPR gRNA sequence
tttcctttaatgttgaaaat

SEQ ID NO: 667890 - DNA, 20 bp, Artificial
  CRISPR gRNA sequence
tcctttaatgttgaaaattt

SEQ ID NO: 667891 - DNA, 20 bp, Artificial
  CRISPR gRNA sequence
cctttaatgttgaaaatttg

SEQ ID NO: 667892 - DNA, 20 bp, Artificial
  CRISPR gRNA sequence
ctttaatgttgaaaatttgg

SEQ ID NO: 667893 - DNA, 20 bp, Artificial
  CRISPR gRNA sequence
taatgttgaaaatttggata

SEQ ID NO: 667894 - DNA, 20 bp, Artificial
  CRISPR gRNA sequence
aatgttgaaaatttggatat

SEQ ID NO: 667895 - DNA, 20 bp, Artificial
  CRISPR gRNA sequence
atgttgaaaatttggatata

SEQ ID NO: 667896 - DNA, 20 bp, Artificial
  CRISPR gRNA sequence
aaaatttggatatatagaga

SEQ ID NO: 667897 - DNA, 20 bp, Artificial
  CRISPR gRNA sequence
ggatatatagagaagtagat

SEQ ID NO: 667898 - DNA, 20 bp, Artificial
  CRISPR gRNA sequence
gatatatagagaagtagata

SEQ ID NO: 667899 - DNA, 20 bp, Artificial
  CRISPR gRNA sequence
aatgaacctttgtgcctcca

SEQ ID NO: 667900 - DNA, 20 bp, Artificial
  CRISPR gRNA sequence
atgaacctttgtgcctccat

SEQ ID NO: 667901 - DNA, 20 bp, Artificial
  CRISPR gRNA sequence
tgtgcctccatatcccaaaa

SEQ ID NO: 667902 - DNA, 20 bp, Artificial
  CRISPR gRNA sequence
gtgcctccatatcccaaaat

SEQ ID NO: 667903 - DNA, 20 bp, Artificial
  CRISPR gRNA sequence
tgcctccatatcccaaaata

SEQ ID NO: 667904 - DNA, 20 bp, Artificial
  CRISPR gRNA sequence
catatcccaaaatactttcc

SEQ ID NO: 667905 - DNA, 20 bp, Artificial
  CRISPR gRNA sequence
tccctcccaaattattttaa

SEQ ID NO: 667906 - DNA, 20 bp, Artificial
  CRISPR gRNA sequence
ccctcccaaattattttaaa

SEQ ID NO: 667907 - DNA, 20 bp, Artificial
  CRISPR gRNA sequence
cctcccaaattattttaaag

SEQ ID NO: 667908 - DNA, 20 bp, Artificial
  CRISPR gRNA sequence
ccaaattattttaaagtaat

SEQ ID NO: 667909 - DNA, 20 bp, Artificial
  CRISPR gRNA sequence
ttttaaagtaatttccaact

SEQ ID NO: 667910 - DNA, 20 bp, Artificial
  CRISPR gRNA sequence
taaagtaatttccaacttta

SEQ ID NO: 667911 - DNA, 20 bp, Artificial
  CRISPR gRNA sequence
aaagtaatttccaactttag

SEQ ID NO: 667912 - DNA, 20 bp, Artificial
  CRISPR gRNA sequence
aagtaatttccaactttaga

SEQ ID NO: 667913 - DNA, 20 bp, Artificial
  CRISPR gRNA sequence
ccaactttagaagttcactg

SEQ ID NO: 667914 - DNA, 20 bp, Artificial
  CRISPR gRNA sequence
caactttagaagttcactga

SEQ ID NO: 667915 - DNA, 20 bp, Artificial
  CRISPR gRNA sequence
tagaagttcactgacacagt

SEQ ID NO: 667916 - DNA, 20 bp, Artificial
  CRISPR gRNA sequence
agaagttcactgacacagta

SEQ ID NO: 667917 - DNA, 20 bp, Artificial
  CRISPR gRNA sequence
gaagttcactgacacagtat

SEQ ID NO: 667918 - DNA, 20 bp, Artificial
  CRISPR gRNA sequence
actgacacagtatttgtaaa

SEQ ID NO: 667919 - DNA, 20 bp, Artificial
  CRISPR gRNA sequence
acacagtatttgtaaattat

SEQ ID NO: 667920 - DNA, 20 bp, Artificial
  CRISPR gRNA sequence
gtaaattatgggtgggcaaa

SEQ ID NO: 667921 - DNA, 20 bp, Artificial
  CRISPR gRNA sequence
taaattatgggtgggcaaaa

SEQ ID NO: 667922 - DNA, 20 bp, Artificial
  CRISPR gRNA sequence
tgggtgggcaaaagaatctc

SEQ ID NO: 667923 - DNA, 20 bp, Artificial
  CRISPR gRNA sequence
cctttccatattatcacatc

SEQ ID NO: 667924 - DNA, 20 bp, Artificial
  CRISPR gRNA sequence
tccatattatcacatcataa

SEQ ID NO: 667925 - DNA, 20 bp, Artificial
  CRISPR gRNA sequence
ccatattatcacatcataac

SEQ ID NO: 667926 - DNA, 20 bp, Artificial
  CRISPR gRNA sequence
catattatcacatcataaca

SEQ ID NO: 667927 - DNA, 20 bp, Artificial
  CRISPR gRNA sequence
tcacatcataacagaatatg

SEQ ID NO: 667928 - DNA, 20 bp, Artificial
  CRISPR gRNA sequence
tctatctatctatctatcta

SEQ ID NO: 667929 - DNA, 20 bp, Artificial
  CRISPR gRNA sequence
tctatctatctatctatctc

SEQ ID NO: 667930 - DNA, 20 bp, Artificial
  CRISPR gRNA sequence
tctatctatctatctctata

SEQ ID NO: 667931 - DNA, 20 bp, Artificial
  CRISPR gRNA sequence
tctatctatctctatataga

SEQ ID NO: 667932 - DNA, 20 bp, Artificial
  CRISPR gRNA sequence
tctatctctatatagatttt

SEQ ID NO: 667933 - DNA, 20 bp, Artificial
  CRISPR gRNA sequence
tctctatatagattttttaa

SEQ ID NO: 667934 - DNA, 20 bp, Artificial
  CRISPR gRNA sequence
tatatagattttttaaatat

SEQ ID NO: 667935 - DNA, 20 bp, Artificial
  CRISPR gRNA sequence
tatagattttttaaatatat

SEQ ID NO: 667936 - DNA, 20 bp, Artificial
  CRISPR gRNA sequence
tttaaatatatacttcaggg

SEQ ID NO: 667937 - DNA, 20 bp, Artificial
  CRISPR gRNA sequence
ttaaatatatacttcagggt

SEQ ID NO: 667938 - DNA, 20 bp, Artificial
  CRISPR gRNA sequence
taaatatatacttcagggta

SEQ ID NO: 667939 - DNA, 20 bp, Artificial
  CRISPR gRNA sequence
aaatatatacttcagggtaa

SEQ ID NO: 667940 - DNA, 20 bp, Artificial
  CRISPR gRNA sequence
aatatatacttcagggtaaa

SEQ ID NO: 667941 - DNA, 20 bp, Artificial
  CRISPR gRNA sequence
cagggtaaatagaagctcag

SEQ ID NO: 667942 - DNA, 20 bp, Artificial
  CRISPR gRNA sequence
agggtaaatagaagctcagg

SEQ ID NO: 667943 - DNA, 20 bp, Artificial
  CRISPR gRNA sequence
aggcttatctctttttctct

SEQ ID NO: 667944 - DNA, 20 bp, Artificial
  CRISPR gRNA sequence
atctctttttctcttaggag

SEQ ID NO: 667945 - DNA, 20 bp, Artificial
  CRISPR gRNA sequence
tctctttttctcttaggaga

SEQ ID NO: 667946 - DNA, 20 bp, Artificial
  CRISPR gRNA sequence
tttttctcttaggagagtgt

SEQ ID NO: 667947 - DNA, 20 bp, Artificial
  CRISPR gRNA sequence
tttctcttaggagagtgttt

SEQ ID NO: 667948 - DNA, 20 bp, Artificial
  CRISPR gRNA sequence
ttctcttaggagagtgtttt

SEQ ID NO: 667949 - DNA, 20 bp, Artificial
  CRISPR gRNA sequence
tctcttaggagagtgttttt

SEQ ID NO: 667950 - DNA, 20 bp, Artificial
  CRISPR gRNA sequence
ctcttaggagagtgttttta

SEQ ID NO: 667951 - DNA, 20 bp, Artificial
  CRISPR gRNA sequence
tcttaggagagtgtttttat

SEQ ID NO: 667952 - DNA, 20 bp, Artificial
  CRISPR gRNA sequence
ttaggagagtgtttttattt

SEQ ID NO: 667953 - DNA, 20 bp, Artificial
  CRISPR gRNA sequence
aggagagtgtttttatttct

SEQ ID NO: 667954 - DNA, 20 bp, Artificial
  CRISPR gRNA sequence
ggagagtgtttttatttctt

SEQ ID NO: 667955 - DNA, 20 bp, Artificial
  CRISPR gRNA sequence
ttatttcttttgttcctttg

SEQ ID NO: 667956 - DNA, 20 bp, Artificial
  CRISPR gRNA sequence
tatttcttttgttcctttga

SEQ ID NO: 667957 - DNA, 20 bp, Artificial
  CRISPR gRNA sequence
atttcttttgttcctttgaa

SEQ ID NO: 667958 - DNA, 20 bp, Artificial
  CRISPR gRNA sequence
tttcttttgttcctttgaac

SEQ ID NO: 667959 - DNA, 20 bp, Artificial
  CRISPR gRNA sequence
cttttgttcctttgaacttt

SEQ ID NO: 667960 - DNA, 20 bp, Artificial
  CRISPR gRNA sequence
ttttgttcctttgaactttg

SEQ ID NO: 667961 - DNA, 20 bp, Artificial
  CRISPR gRNA sequence
ttgttcctttgaactttgta

SEQ ID NO: 667962 - DNA, 20 bp, Artificial
  CRISPR gRNA sequence
tgttcctttgaactttgtag

SEQ ID NO: 667963 - DNA, 20 bp, Artificial
  CRISPR gRNA sequence
gttcctttgaactttgtagt

SEQ ID NO: 667964 - DNA, 20 bp, Artificial
  CRISPR gRNA sequence
ttcctttgaactttgtagtt

SEQ ID NO: 667965 - DNA, 20 bp, Artificial
  CRISPR gRNA sequence
ctttgaactttgtagttgta

SEQ ID NO: 667966 - DNA, 20 bp, Artificial
  CRISPR gRNA sequence
tgaactttgtagttgtaagt

SEQ ID NO: 667967 - DNA, 20 bp, Artificial
  CRISPR gRNA sequence
gaactttgtagttgtaagtt

SEQ ID NO: 667968 - DNA, 20 bp, Artificial
  CRISPR gRNA sequence
aactttgtagttgtaagttg

SEQ ID NO: 667969 - DNA, 20 bp, Artificial
  CRISPR gRNA sequence
tgtagttgtaagttgtggga

SEQ ID NO: 667970 - DNA, 20 bp, Artificial
  CRISPR gRNA sequence
gtagttgtaagttgtgggaa

SEQ ID NO: 667971 - DNA, 20 bp, Artificial
  CRISPR gRNA sequence
tagttgtaagttgtgggaac

SEQ ID NO: 667972 - DNA, 20 bp, Artificial
  CRISPR gRNA sequence
taagttgtgggaactggaat

SEQ ID NO: 667973 - DNA, 20 bp, Artificial
  CRISPR gRNA sequence
tgggaactggaattgggtac

SEQ ID NO: 667974 - DNA, 20 bp, Artificial
  CRISPR gRNA sequence
gaattgggtacatgtgtttt

SEQ ID NO: 667975 - DNA, 20 bp, Artificial
  CRISPR gRNA sequence
ggtacatgtgtttttaagtg

SEQ ID NO: 667976 - DNA, 20 bp, Artificial
  CRISPR gRNA sequence
ttaagtgttagtcaaatttc

SEQ ID NO: 667977 - DNA, 20 bp, Artificial
  CRISPR gRNA sequence
taagtgttagtcaaatttct

SEQ ID NO: 667978 - DNA, 20 bp, Artificial
  CRISPR gRNA sequence
aagtgttagtcaaatttctt

SEQ ID NO: 667979 - DNA, 20 bp, Artificial
  CRISPR gRNA sequence
agtgttagtcaaatttcttg

SEQ ID NO: 667980 - DNA, 20 bp, Artificial
  CRISPR gRNA sequence
gtcaaatttcttgctaaata

SEQ ID NO: 667981 - DNA, 20 bp, Artificial
  CRISPR gRNA sequence
cttgctaaatattgctcagc

SEQ ID NO: 667982 - DNA, 20 bp, Artificial
  CRISPR gRNA sequence
ttgctaaatattgctcagca

SEQ ID NO: 667983 - DNA, 20 bp, Artificial
  CRISPR gRNA sequence
gctaaatattgctcagcagt

SEQ ID NO: 667984 - DNA, 20 bp, Artificial
  CRISPR gRNA sequence
ctaaatattgctcagcagtt

SEQ ID NO: 667985 - DNA, 20 bp, Artificial
  CRISPR gRNA sequence
aatattgctcagcagtttat

SEQ ID NO: 667986 - DNA, 20 bp, Artificial
  CRISPR gRNA sequence
ctcagcagtttatcagatta

SEQ ID NO: 667987 - DNA, 20 bp, Artificial
  CRISPR gRNA sequence
agcagtttatcagattaggt

SEQ ID NO: 667988 - DNA, 20 bp, Artificial
  CRISPR gRNA sequence
atcagattaggtaattggtt

SEQ ID NO: 667989 - DNA, 20 bp, Artificial
  CRISPR gRNA sequence
tcagattaggtaattggttt

SEQ ID NO: 667990 - DNA, 20 bp, Artificial
  CRISPR gRNA sequence
ggtaattggtttcctaaaaa

SEQ ID NO: 667991 - DNA, 20 bp, Artificial
  CRISPR gRNA sequence
gtttcctaaaaagcttttgg

SEQ ID NO: 667992 - DNA, 20 bp, Artificial
  CRISPR gRNA sequence
cctaaaaagcttttggcagg

SEQ ID NO: 667993 - DNA, 20 bp, Artificial
  CRISPR gRNA sequence
ctaaaaagcttttggcaggg

SEQ ID NO: 667994 - DNA, 20 bp, Artificial
  CRISPR gRNA sequence
aaaagcttttggcagggttc

SEQ ID NO: 667995 - DNA, 20 bp, Artificial
  CRISPR gRNA sequence
ttggcagggttccaggtgat

SEQ ID NO: 667996 - DNA, 20 bp, Artificial
  CRISPR gRNA sequence
tggcagggttccaggtgata

SEQ ID NO: 667997 - DNA, 20 bp, Artificial
  CRISPR gRNA sequence
ggcagggttccaggtgatag

SEQ ID NO: 667998 - DNA, 20 bp, Artificial
  CRISPR gRNA sequence
gcagggttccaggtgatagg

SEQ ID NO: 667999 - DNA, 20 bp, Artificial
  CRISPR gRNA sequence
caggtgataggagaaatgaa

SEQ ID NO: 668000 - DNA, 20 bp, Artificial
  CRISPR gRNA sequence
tgattgggggcaggtgatag

SEQ ID NO: 668001 - DNA, 20 bp, Artificial
  CRISPR gRNA sequence
gattgggggcaggtgatagg

SEQ ID NO: 668002 - DNA, 20 bp, Artificial
  CRISPR gRNA sequence
attgggggcaggtgatagga

SEQ ID NO: 668003 - DNA, 20 bp, Artificial
  CRISPR gRNA sequence
ggggcaggtgataggaaagc

SEQ ID NO: 668004 - DNA, 20 bp, Artificial
  CRISPR gRNA sequence
atttagggtatgtcatagaa

SEQ ID NO: 668005 - DNA, 20 bp, Artificial
  CRISPR gRNA sequence
agggtatgtcatagaaagct

SEQ ID NO: 668006 - DNA, 20 bp, Artificial
  CRISPR gRNA sequence
gggtatgtcatagaaagctg

SEQ ID NO: 668007 - DNA, 20 bp, Artificial
  CRISPR gRNA sequence
ggcatcaaactggagggtgg

SEQ ID NO: 668008 - DNA, 20 bp, Artificial
  CRISPR gRNA sequence
gagggtggaaaaacagtggg

SEQ ID NO: 668009 - DNA, 20 bp, Artificial
  CRISPR gRNA sequence
attagatgccttaaggtggg

SEQ ID NO: 668010 - DNA, 20 bp, Artificial
  CRISPR gRNA sequence
gatgccttaaggtgggtagc

SEQ ID NO: 668011 - DNA, 20 bp, Artificial
  CRISPR gRNA sequence
aaggtgggtagcactttggg

SEQ ID NO: 668012 - DNA, 20 bp, Artificial
  CRISPR gRNA sequence
aggtgggtagcactttggga

SEQ ID NO: 668013 - DNA, 20 bp, Artificial
  CRISPR gRNA sequence
tgggaaaaatggaagttgct

SEQ ID NO: 668014 - DNA, 20 bp, Artificial
  CRISPR gRNA sequence
gggaaaaatggaagttgctg

SEQ ID NO: 668015 - DNA, 20 bp, Artificial
  CRISPR gRNA sequence
ggaaaaatggaagttgctgc

SEQ ID NO: 668016 - DNA, 20 bp, Artificial
  CRISPR gRNA sequence
ctgctaggaaaacatagaga

SEQ ID NO: 668017 - DNA, 20 bp, Artificial
  CRISPR gRNA sequence
ctaggaaaacatagagaaag

SEQ ID NO: 668018 - DNA, 20 bp, Artificial
  CRISPR gRNA sequence
ggaaaacatagagaaagtaa

SEQ ID NO: 668019 - DNA, 20 bp, Artificial
  CRISPR gRNA sequence
tgcctattttaatcatattt

SEQ ID NO: 668020 - DNA, 20 bp, Artificial
  CRISPR gRNA sequence
gcctattttaatcatatttt

SEQ ID NO: 668021 - DNA, 20 bp, Artificial
  CRISPR gRNA sequence
cctattttaatcatattttt

SEQ ID NO: 668022 - DNA, 20 bp, Artificial
  CRISPR gRNA sequence
ttttaatcatatttttactt

SEQ ID NO: 668023 - DNA, 20 bp, Artificial
  CRISPR gRNA sequence
taatcatatttttacttggg

SEQ ID NO: 668024 - DNA, 20 bp, Artificial
  CRISPR gRNA sequence
aatcatatttttacttgggc

SEQ ID NO: 668025 - DNA, 20 bp, Artificial
  CRISPR gRNA sequence
atcatatttttacttgggct

SEQ ID NO: 668026 - DNA, 20 bp, Artificial
  CRISPR gRNA sequence
ttacttgggctggcaaatgt

SEQ ID NO: 668027 - DNA, 20 bp, Artificial
  CRISPR gRNA sequence
tacttgggctggcaaatgta

SEQ ID NO: 668028 - DNA, 20 bp, Artificial
  CRISPR gRNA sequence
acttgggctggcaaatgtat

SEQ ID NO: 668029 - DNA, 20 bp, Artificial
  CRISPR gRNA sequence
cttgggctggcaaatgtatc

SEQ ID NO: 668030 - DNA, 20 bp, Artificial
  CRISPR gRNA sequence
gggctggcaaatgtatcctg

SEQ ID NO: 668031 - DNA, 20 bp, Artificial
  CRISPR gRNA sequence
ggctggcaaatgtatcctgc

SEQ ID NO: 668032 - DNA, 20 bp, Artificial
  CRISPR gRNA sequence
gcaaatgtatcctgcccaac

SEQ ID NO: 668033 - DNA, 20 bp, Artificial
  CRISPR gRNA sequence
cccaactgtggtgggacaac

SEQ ID NO: 668034 - DNA, 20 bp, Artificial
  CRISPR gRNA sequence
tggtgggacaacacaagctt

SEQ ID NO: 668035 - DNA, 20 bp, Artificial
  CRISPR gRNA sequence
tctctcttggtagtatacaa

SEQ ID NO: 668036 - DNA, 20 bp, Artificial
  CRISPR gRNA sequence
ctctcttggtagtatacaag

SEQ ID NO: 668037 - DNA, 20 bp, Artificial
  CRISPR gRNA sequence
tctcttggtagtatacaaga

SEQ ID NO: 668038 - DNA, 20 bp, Artificial
  CRISPR gRNA sequence
tcttggtagtatacaagaaa

SEQ ID NO: 668039 - DNA, 20 bp, Artificial
  CRISPR gRNA sequence
ttggtagtatacaagaaatt

SEQ ID NO: 668040 - DNA, 20 bp, Artificial
  CRISPR gRNA sequence
ggtagtatacaagaaattta

SEQ ID NO: 668041 - DNA, 20 bp, Artificial
  CRISPR gRNA sequence
gtagtatacaagaaatttat

SEQ ID NO: 668042 - DNA, 20 bp, Artificial
  CRISPR gRNA sequence
atggagatggtttatagatg

SEQ ID NO: 668043 - DNA, 20 bp, Artificial
  CRISPR gRNA sequence
tggagatggtttatagatgg

SEQ ID NO: 668044 - DNA, 20 bp, Artificial
  CRISPR gRNA sequence
atagatggagatcttttctt

SEQ ID NO: 668045 - DNA, 20 bp, Artificial
  CRISPR gRNA sequence
tagatggagatcttttcttt

SEQ ID NO: 668046 - DNA, 20 bp, Artificial
  CRISPR gRNA sequence
ttcttttctctttctctgtc

SEQ ID NO: 668047 - DNA, 20 bp, Artificial
  CRISPR gRNA sequence
tcttttctctttctctgtct

SEQ ID NO: 668048 - DNA, 20 bp, Artificial
  CRISPR gRNA sequence
cttttctctttctctgtctc

SEQ ID NO: 668049 - DNA, 20 bp, Artificial
  CRISPR gRNA sequence
ttttctctttctctgtctct

SEQ ID NO: 668050 - DNA, 20 bp, Artificial
  CRISPR gRNA sequence
ttctctttctctgtctctct

SEQ ID NO: 668051 - DNA, 20 bp, Artificial
  CRISPR gRNA sequence
tctctttctctgtctctctc

SEQ ID NO: 668052 - DNA, 20 bp, Artificial
  CRISPR gRNA sequence
ctctttctctgtctctctct

SEQ ID NO: 668053 - DNA, 20 bp, Artificial
  CRISPR gRNA sequence
tctttctctgtctctctctc

SEQ ID NO: 668054 - DNA, 20 bp, Artificial
  CRISPR gRNA sequence
tttctctgtctctctctctc

SEQ ID NO: 668055 - DNA, 20 bp, Artificial
  CRISPR gRNA sequence
tctctgtctctctctctccc

SEQ ID NO: 668056 - DNA, 20 bp, Artificial
  CRISPR gRNA sequence
ctctgtctctctctctcccc

SEQ ID NO: 668057 - DNA, 20 bp, Artificial
  CRISPR gRNA sequence
tctgtctctctctctcccct

SEQ ID NO: 668058 - DNA, 20 bp, Artificial
  CRISPR gRNA sequence
tgtctctctctctccccttt

SEQ ID NO: 668059 - DNA, 20 bp, Artificial
  CRISPR gRNA sequence
tctctctctctcccctttct

SEQ ID NO: 668060 - DNA, 20 bp, Artificial
  CRISPR gRNA sequence
tctctctcccctttctcctt

SEQ ID NO: 668061 - DNA, 20 bp, Artificial
  CRISPR gRNA sequence
tctctcccctttctccttcc

SEQ ID NO: 668062 - DNA, 20 bp, Artificial
  CRISPR gRNA sequence
tctcccctttctccttcctt

SEQ ID NO: 668063 - DNA, 20 bp, Artificial
  CRISPR gRNA sequence
tcccctttctccttccttcc

SEQ ID NO: 668064 - DNA, 20 bp, Artificial
  CRISPR gRNA sequence
ccctttctccttccttccct

SEQ ID NO: 668065 - DNA, 20 bp, Artificial
  CRISPR gRNA sequence
tctccttccttccctccctc

SEQ ID NO: 668066 - DNA, 20 bp, Artificial
  CRISPR gRNA sequence
ctccttccttccctccctcc

SEQ ID NO: 668067 - DNA, 20 bp, Artificial
  CRISPR gRNA sequence
tccttccttccctccctccc

SEQ ID NO: 668068 - DNA, 20 bp, Artificial
  CRISPR gRNA sequence
cttccttccctccctccctt

SEQ ID NO: 668069 - DNA, 20 bp, Artificial
  CRISPR gRNA sequence
ccttccctccctcccttcct

SEQ ID NO: 668070 - DNA, 20 bp, Artificial
  CRISPR gRNA sequence
cttccctccctcccttcctg

SEQ ID NO: 668071 - DNA, 20 bp, Artificial
  CRISPR gRNA sequence
ccctccctcccttcctgcct

SEQ ID NO: 668072 - DNA, 20 bp, Artificial
  CRISPR gRNA sequence
cctccctcccttcctgcctt

SEQ ID NO: 668073 - DNA, 20 bp, Artificial
  CRISPR gRNA sequence
cctcccttcctgccttcctt

SEQ ID NO: 668074 - DNA, 20 bp, Artificial
  CRISPR gRNA sequence
ccttcctgccttccttcctt

SEQ ID NO: 668075 - DNA, 20 bp, Artificial
  CRISPR gRNA sequence
cctgccttccttcctttctt

SEQ ID NO: 668076 - DNA, 20 bp, Artificial
  CRISPR gRNA sequence
ctgccttccttcctttcttc

SEQ ID NO: 668077 - DNA, 20 bp, Artificial
  CRISPR gRNA sequence
ccttccttcctttcttctct

SEQ ID NO: 668078 - DNA, 20 bp, Artificial
  CRISPR gRNA sequence
ccttcctttcttctctctct

SEQ ID NO: 668079 - DNA, 20 bp, Artificial
  CRISPR gRNA sequence
cttcctttcttctctctctc

SEQ ID NO: 668080 - DNA, 20 bp, Artificial
  CRISPR gRNA sequence
cctttcttctctctctctct

SEQ ID NO: 668081 - DNA, 20 bp, Artificial
  CRISPR gRNA sequence
ctttcttctctctctctctt

SEQ ID NO: 668082 - DNA, 20 bp, Artificial
  CRISPR gRNA sequence
tcttctctctctctctttct

SEQ ID NO: 668083 - DNA, 20 bp, Artificial
  CRISPR gRNA sequence
cttctctctctctctttctt

SEQ ID NO: 668084 - DNA, 20 bp, Artificial
  CRISPR gRNA sequence
ttctctctctctctttcttt

SEQ ID NO: 668085 - DNA, 20 bp, Artificial
  CRISPR gRNA sequence
ctctctctctctttcttttt

SEQ ID NO: 668086 - DNA, 20 bp, Artificial
  CRISPR gRNA sequence
tctctctctctttctttttt

SEQ ID NO: 668087 - DNA, 20 bp, Artificial
  CRISPR gRNA sequence
tctctctctttctttttttc

SEQ ID NO: 668088 - DNA, 20 bp, Artificial
  CRISPR gRNA sequence
tctctctttctttttttctc

SEQ ID NO: 668089 - DNA, 20 bp, Artificial
  CRISPR gRNA sequence
tctctttctttttttctctc

SEQ ID NO: 668090 - DNA, 20 bp, Artificial
  CRISPR gRNA sequence
tctttctttttttctctctc

SEQ ID NO: 668091 - DNA, 20 bp, Artificial
  CRISPR gRNA sequence
tttctttttttctctctccc

SEQ ID NO: 668092 - DNA, 20 bp, Artificial
  CRISPR gRNA sequence
tctttttttctctctccccc

SEQ ID NO: 668093 - DNA, 20 bp, Artificial
  CRISPR gRNA sequence
ctttttttctctctccccct

SEQ ID NO: 668094 - DNA, 20 bp, Artificial
  CRISPR gRNA sequence
tttttttctctctccccctc

SEQ ID NO: 668095 - DNA, 20 bp, Artificial
  CRISPR gRNA sequence
tttttctctctccccctccc

SEQ ID NO: 668096 - DNA, 20 bp, Artificial
  CRISPR gRNA sequence
ttttctctctccccctccct

SEQ ID NO: 668097 - DNA, 20 bp, Artificial
  CRISPR gRNA sequence
tttctctctccccctccctc

SEQ ID NO: 668098 - DNA, 20 bp, Artificial
  CRISPR gRNA sequence
ttctctctccccctccctcc

SEQ ID NO: 668099 - DNA, 20 bp, Artificial
  CRISPR gRNA sequence
tctctctccccctccctcct

SEQ ID NO: 668100 - DNA, 20 bp, Artificial
  CRISPR gRNA sequence
ctctctccccctccctcctt

SEQ ID NO: 668101 - DNA, 20 bp, Artificial
  CRISPR gRNA sequence
tctctccccctccctccttt

SEQ ID NO: 668102 - DNA, 20 bp, Artificial
  CRISPR gRNA sequence
tctccccctccctcctttcc

SEQ ID NO: 668103 - DNA, 20 bp, Artificial
  CRISPR gRNA sequence
tccccctccctcctttcctt

SEQ ID NO: 668104 - DNA, 20 bp, Artificial
  CRISPR gRNA sequence
cccctccctcctttccttcc

SEQ ID NO: 668105 - DNA, 20 bp, Artificial
  CRISPR gRNA sequence
cctcctttccttccttccac

SEQ ID NO: 668106 - DNA, 20 bp, Artificial
  CRISPR gRNA sequence
ctttccttccttccaccctc

SEQ ID NO: 668107 - DNA, 20 bp, Artificial
  CRISPR gRNA sequence
tccttccttccaccctccct

SEQ ID NO: 668108 - DNA, 20 bp, Artificial
  CRISPR gRNA sequence
ccttccttccaccctccctc

SEQ ID NO: 668109 - DNA, 20 bp, Artificial
  CRISPR gRNA sequence
cttccttccaccctccctcc

SEQ ID NO: 668110 - DNA, 20 bp, Artificial
  CRISPR gRNA sequence
ccttccaccctccctccctc

SEQ ID NO: 668111 - DNA, 20 bp, Artificial
  CRISPR gRNA sequence
cttccaccctccctccctcc

SEQ ID NO: 668112 - DNA, 20 bp, Artificial
  CRISPR gRNA sequence
ccaccctccctccctccttt

SEQ ID NO: 668113 - DNA, 20 bp, Artificial
  CRISPR gRNA sequence
caccctccctccctcctttc

SEQ ID NO: 668114 - DNA, 20 bp, Artificial
  CRISPR gRNA sequence
cctccctcctttccttcctt

SEQ ID NO: 668115 - DNA, 20 bp, Artificial
  CRISPR gRNA sequence
cctcctttccttccttcctt

SEQ ID NO: 668116 - DNA, 20 bp, Artificial
  CRISPR gRNA sequence
ctttccttccttccttcctt

SEQ ID NO: 668117 - DNA, 20 bp, Artificial
  CRISPR gRNA sequence
tccttccttccttccttcca

SEQ ID NO: 668118 - DNA, 20 bp, Artificial
  CRISPR gRNA sequence
ccttccttccttccttccat

SEQ ID NO: 668119 - DNA, 20 bp, Artificial
  CRISPR gRNA sequence
cttccttccttccttccatg

SEQ ID NO: 668120 - DNA, 20 bp, Artificial
  CRISPR gRNA sequence
ccttccttccttccatgctt

SEQ ID NO: 668121 - DNA, 20 bp, Artificial
  CRISPR gRNA sequence
cttccttccttccatgcttc

SEQ ID NO: 668122 - DNA, 20 bp, Artificial
  CRISPR gRNA sequence
ccttccttccatgcttcctt

SEQ ID NO: 668123 - DNA, 20 bp, Artificial
  CRISPR gRNA sequence
cttccttccatgcttccttc

SEQ ID NO: 668124 - DNA, 20 bp, Artificial
  CRISPR gRNA sequence
ccttccatgcttccttcctt

SEQ ID NO: 668125 - DNA, 20 bp, Artificial
  CRISPR gRNA sequence
cttccatgcttccttccttc

SEQ ID NO: 668126 - DNA, 20 bp, Artificial
  CRISPR gRNA sequence
ccatgcttccttccttcctt

SEQ ID NO: 668127 - DNA, 20 bp, Artificial
  CRISPR gRNA sequence
catgcttccttccttccttc

SEQ ID NO: 668128 - DNA, 20 bp, Artificial
  CRISPR gRNA sequence
ccttccttccttctttcttc

SEQ ID NO: 668129 - DNA, 20 bp, Artificial
  CRISPR gRNA sequence
cttccttccttctttcttcc

SEQ ID NO: 668130 - DNA, 20 bp, Artificial
  CRISPR gRNA sequence
ccttccttctttcttccttt

SEQ ID NO: 668131 - DNA, 20 bp, Artificial
  CRISPR gRNA sequence
cttccttctttcttcctttc

SEQ ID NO: 668132 - DNA, 20 bp, Artificial
  CRISPR gRNA sequence
ccttctttcttcctttcctt

SEQ ID NO: 668133 - DNA, 20 bp, Artificial
  CRISPR gRNA sequence
cttctttcttcctttccttt

SEQ ID NO: 668134 - DNA, 20 bp, Artificial
  CRISPR gRNA sequence
ctttcttcctttcctttcct

SEQ ID NO: 668135 - DNA, 20 bp, Artificial
  CRISPR gRNA sequence
tttcttcctttcctttcctt

SEQ ID NO: 668136 - DNA, 20 bp, Artificial
  CRISPR gRNA sequence
tcttcctttcctttccttct

SEQ ID NO: 668137 - DNA, 20 bp, Artificial
  CRISPR gRNA sequence
cttcctttcctttccttctt

SEQ ID NO: 668138 - DNA, 20 bp, Artificial
  CRISPR gRNA sequence
ttcctttcctttccttcttt

SEQ ID NO: 668139 - DNA, 20 bp, Artificial
  CRISPR gRNA sequence
cctttcctttccttcttttt

SEQ ID NO: 668140 - DNA, 20 bp, Artificial
  CRISPR gRNA sequence
ctttcctttccttctttttt

SEQ ID NO: 668141 - DNA, 20 bp, Artificial
  CRISPR gRNA sequence
tcctttccttcttttttctt

SEQ ID NO: 668142 - DNA, 20 bp, Artificial
  CRISPR gRNA sequence
cctttccttcttttttcttt

SEQ ID NO: 668143 - DNA, 20 bp, Artificial
  CRISPR gRNA sequence
ctttccttcttttttctttt

SEQ ID NO: 668144 - DNA, 20 bp, Artificial
  CRISPR gRNA sequence
tccttcttttttcttttcta

SEQ ID NO: 668145 - DNA, 20 bp, Artificial
  CRISPR gRNA sequence
ccttcttttttcttttctat

SEQ ID NO: 668146 - DNA, 20 bp, Artificial
  CRISPR gRNA sequence
cttcttttttcttttctatt

SEQ ID NO: 668147 - DNA, 20 bp, Artificial
  CRISPR gRNA sequence
cttttttcttttctattgtg

SEQ ID NO: 668148 - DNA, 20 bp, Artificial
  CRISPR gRNA sequence
ttttttcttttctattgtgt

SEQ ID NO: 668149 - DNA, 20 bp, Artificial
  CRISPR gRNA sequence
ttttcttttctattgtgtca

SEQ ID NO: 668150 - DNA, 20 bp, Artificial
  CRISPR gRNA sequence
tttcttttctattgtgtcac

SEQ ID NO: 668151 - DNA, 20 bp, Artificial
  CRISPR gRNA sequence
ttcttttctattgtgtcacc

SEQ ID NO: 668152 - DNA, 20 bp, Artificial
  CRISPR gRNA sequence
tcttttctattgtgtcacct

SEQ ID NO: 668153 - DNA, 20 bp, Artificial
  CRISPR gRNA sequence
cttttctattgtgtcaccta

SEQ ID NO: 668154 - DNA, 20 bp, Artificial
  CRISPR gRNA sequence
ttttctattgtgtcacctag

SEQ ID NO: 668155 - DNA, 20 bp, Artificial
  CRISPR gRNA sequence
ttctattgtgtcacctaggc

SEQ ID NO: 668156 - DNA, 20 bp, Artificial
  CRISPR gRNA sequence
tctattgtgtcacctaggct

SEQ ID NO: 668157 - DNA, 20 bp, Artificial
  CRISPR gRNA sequence
ctattgtgtcacctaggctt

SEQ ID NO: 668158 - DNA, 20 bp, Artificial
  CRISPR gRNA sequence
tattgtgtcacctaggcttc

SEQ ID NO: 668159 - DNA, 20 bp, Artificial
  CRISPR gRNA sequence
ttgtgtcacctaggcttcag

SEQ ID NO: 668160 - DNA, 20 bp, Artificial
  CRISPR gRNA sequence
tgtcacctaggcttcagtac

SEQ ID NO: 668161 - DNA, 20 bp, Artificial
  CRISPR gRNA sequence
ggcttcagtacagtggcaca

SEQ ID NO: 668162 - DNA, 20 bp, Artificial
  CRISPR gRNA sequence
cagtacagtggcacaatcat

SEQ ID NO: 668163 - DNA, 20 bp, Artificial
  CRISPR gRNA sequence
agtacagtggcacaatcatg

SEQ ID NO: 668164 - DNA, 20 bp, Artificial
  CRISPR gRNA sequence
actccagccttgaactcctg

SEQ ID NO: 668165 - DNA, 20 bp, Artificial
  CRISPR gRNA sequence
ctccagccttgaactcctgg

SEQ ID NO: 668166 - DNA, 20 bp, Artificial
  CRISPR gRNA sequence
cagccttgaactcctgggct

SEQ ID NO: 668167 - DNA, 20 bp, Artificial
  CRISPR gRNA sequence
gaactcctgggctgaagcaa

SEQ ID NO: 668168 - DNA, 20 bp, Artificial
  CRISPR gRNA sequence
aactcctgggctgaagcaat

SEQ ID NO: 668169 - DNA, 20 bp, Artificial
  CRISPR gRNA sequence
ctgggctgaagcaatactcc

SEQ ID NO: 668170 - DNA, 20 bp, Artificial
  CRISPR gRNA sequence
ggctgaagcaatactcctgt

SEQ ID NO: 668171 - DNA, 20 bp, Artificial
  CRISPR gRNA sequence
aagcaatactcctgtcccag

SEQ ID NO: 668172 - DNA, 20 bp, Artificial
  CRISPR gRNA sequence
ctgtcccagtcccccaagta

SEQ ID NO: 668173 - DNA, 20 bp, Artificial
  CRISPR gRNA sequence
tcccagtcccccaagtagtt

SEQ ID NO: 668174 - DNA, 20 bp, Artificial
  CRISPR gRNA sequence
ggactacaaacacgcactac

SEQ ID NO: 668175 - DNA, 20 bp, Artificial
  CRISPR gRNA sequence
caaacacgcactaccacacc

SEQ ID NO: 668176 - DNA, 20 bp, Artificial
  CRISPR gRNA sequence
ccacacctggctacatttta

SEQ ID NO: 668177 - DNA, 20 bp, Artificial
  CRISPR gRNA sequence
gctacattttaaattttttg

SEQ ID NO: 668178 - DNA, 20 bp, Artificial
  CRISPR gRNA sequence
cattttaaattttttgtata

SEQ ID NO: 668179 - DNA, 20 bp, Artificial
  CRISPR gRNA sequence
taaattttttgtatagatgg

SEQ ID NO: 668180 - DNA, 20 bp, Artificial
  CRISPR gRNA sequence
aaattttttgtatagatggg

SEQ ID NO: 668181 - DNA, 20 bp, Artificial
  CRISPR gRNA sequence
aattttttgtatagatggga

SEQ ID NO: 668182 - DNA, 20 bp, Artificial
  CRISPR gRNA sequence
tttgtatagatgggatccca

SEQ ID NO: 668183 - DNA, 20 bp, Artificial
  CRISPR gRNA sequence
ttgtatagatgggatcccac

SEQ ID NO: 668184 - DNA, 20 bp, Artificial
  CRISPR gRNA sequence
tgtatagatgggatcccact

SEQ ID NO: 668185 - DNA, 20 bp, Artificial
  CRISPR gRNA sequence
gtatagatgggatcccacta

SEQ ID NO: 668186 - DNA, 20 bp, Artificial
  CRISPR gRNA sequence
tatagatgggatcccactat

SEQ ID NO: 668187 - DNA, 20 bp, Artificial
  CRISPR gRNA sequence
tgttgcccaggctcgtcttg

SEQ ID NO: 668188 - DNA, 20 bp, Artificial
  CRISPR gRNA sequence
cccaggctcgtcttgaacca

SEQ ID NO: 668189 - DNA, 20 bp, Artificial
  CRISPR gRNA sequence
gtcttgaaccagtgggctca

SEQ ID NO: 668190 - DNA, 20 bp, Artificial
  CRISPR gRNA sequence
gaaccagtgggctcaagtga

SEQ ID NO: 668191 - DNA, 20 bp, Artificial
  CRISPR gRNA sequence
aaccagtgggctcaagtgat

SEQ ID NO: 668192 - DNA, 20 bp, Artificial
  CRISPR gRNA sequence
aagtgatctacccaggctcc

SEQ ID NO: 668193 - DNA, 20 bp, Artificial
  CRISPR gRNA sequence
cccaggctcccaaactgttg

SEQ ID NO: 668194 - DNA, 20 bp, Artificial
  CRISPR gRNA sequence
ccaaactgttgggactacag

SEQ ID NO: 668195 - DNA, 20 bp, Artificial
  CRISPR gRNA sequence
ttgggactacaggcatgagc

SEQ ID NO: 668196 - DNA, 20 bp, Artificial
  CRISPR gRNA sequence
ggactacaggcatgagccat

SEQ ID NO: 668197 - DNA, 20 bp, Artificial
  CRISPR gRNA sequence
caggcatgagccatgacacc

SEQ ID NO: 668198 - DNA, 20 bp, Artificial
  CRISPR gRNA sequence
ttctttatagaccttctccc

SEQ ID NO: 668199 - DNA, 20 bp, Artificial
  CRISPR gRNA sequence
ctttatagaccttctccccc

SEQ ID NO: 668200 - DNA, 20 bp, Artificial
  CRISPR gRNA sequence
tttatagaccttctccccct

SEQ ID NO: 668201 - DNA, 20 bp, Artificial
  CRISPR gRNA sequence
tatagaccttctcccccttc

SEQ ID NO: 668202 - DNA, 20 bp, Artificial
  CRISPR gRNA sequence
atagaccttctcccccttct

SEQ ID NO: 668203 - DNA, 20 bp, Artificial
  CRISPR gRNA sequence
tagaccttctcccccttctc

SEQ ID NO: 668204 - DNA, 20 bp, Artificial
  CRISPR gRNA sequence
ctcccccttctccctcaaca

SEQ ID NO: 668205 - DNA, 20 bp, Artificial
  CRISPR gRNA sequence
tcccccttctccctcaacaa

SEQ ID NO: 668206 - DNA, 20 bp, Artificial
  CRISPR gRNA sequence
ccccttctccctcaacaaaa

SEQ ID NO: 668207 - DNA, 20 bp, Artificial
  CRISPR gRNA sequence
ctccctcaacaaaaaagaga

SEQ ID NO: 668208 - DNA, 20 bp, Artificial
  CRISPR gRNA sequence
tccctcaacaaaaaagagaa

SEQ ID NO: 668209 - DNA, 20 bp, Artificial
  CRISPR gRNA sequence
cctcaacaaaaaagagaaaa

SEQ ID NO: 668210 - DNA, 20 bp, Artificial
  CRISPR gRNA sequence
aacaaaaaagagaaaattag

SEQ ID NO: 668211 - DNA, 20 bp, Artificial
  CRISPR gRNA sequence
gacagcaacaacaatagcag

SEQ ID NO: 668212 - DNA, 20 bp, Artificial
  CRISPR gRNA sequence
tatttaaggtttatttttca

SEQ ID NO: 668213 - DNA, 20 bp, Artificial
  CRISPR gRNA sequence
aaggtttatttttcaataga

SEQ ID NO: 668214 - DNA, 20 bp, Artificial
  CRISPR gRNA sequence
aggtttatttttcaatagat

SEQ ID NO: 668215 - DNA, 20 bp, Artificial
  CRISPR gRNA sequence
atttttcaatagatttaacg

SEQ ID NO: 668216 - DNA, 20 bp, Artificial
  CRISPR gRNA sequence
tttttcaatagatttaacgt

SEQ ID NO: 668217 - DNA, 20 bp, Artificial
  CRISPR gRNA sequence
ttcaatagatttaacgtcac

SEQ ID NO: 668218 - DNA, 20 bp, Artificial
  CRISPR gRNA sequence
tcaatagatttaacgtcaca

SEQ ID NO: 668219 - DNA, 20 bp, Artificial
  CRISPR gRNA sequence
caatagatttaacgtcacaa

SEQ ID NO: 668220 - DNA, 20 bp, Artificial
  CRISPR gRNA sequence
aatagatttaacgtcacaat

SEQ ID NO: 668221 - DNA, 20 bp, Artificial
  CRISPR gRNA sequence
aacgtcacaatgatgggcta

SEQ ID NO: 668222 - DNA, 20 bp, Artificial
  CRISPR gRNA sequence
acgtcacaatgatgggctag

SEQ ID NO: 668223 - DNA, 20 bp, Artificial
  CRISPR gRNA sequence
gtactactgtcatatcaacc

SEQ ID NO: 668224 - DNA, 20 bp, Artificial
  CRISPR gRNA sequence
ctgtcatatcaacctgacat

SEQ ID NO: 668225 - DNA, 20 bp, Artificial
  CRISPR gRNA sequence
tcatatcaacctgacatatc

SEQ ID NO: 668226 - DNA, 20 bp, Artificial
  CRISPR gRNA sequence
acatatcagaagttagtact

SEQ ID NO: 668227 - DNA, 20 bp, Artificial
  CRISPR gRNA sequence
gtactcaccatgccactatt

SEQ ID NO: 668228 - DNA, 20 bp, Artificial
  CRISPR gRNA sequence
accatgccactattgtttct

SEQ ID NO: 668229 - DNA, 20 bp, Artificial
  CRISPR gRNA sequence
ttgtttctcataggtttgga

SEQ ID NO: 668230 - DNA, 20 bp, Artificial
  CRISPR gRNA sequence
tttctcataggtttggaaac

SEQ ID NO: 668231 - DNA, 20 bp, Artificial
  CRISPR gRNA sequence
ctcataggtttggaaacaga

SEQ ID NO: 668232 - DNA, 20 bp, Artificial
  CRISPR gRNA sequence
tcataggtttggaaacagaa

SEQ ID NO: 668233 - DNA, 20 bp, Artificial
  CRISPR gRNA sequence
ataggtttggaaacagaaaa

SEQ ID NO: 668234 - DNA, 20 bp, Artificial
  CRISPR gRNA sequence
ggaaacagaaaactcagaga

SEQ ID NO: 668235 - DNA, 20 bp, Artificial
  CRISPR gRNA sequence
gaaacagaaaactcagagag

SEQ ID NO: 668236 - DNA, 20 bp, Artificial
  CRISPR gRNA sequence
agagagcagtttggttgtga

SEQ ID NO: 668237 - DNA, 20 bp, Artificial
  CRISPR gRNA sequence
ggttgtgaacacagttggtt

SEQ ID NO: 668238 - DNA, 20 bp, Artificial
  CRISPR gRNA sequence
gttgtgaacacagttggtta

SEQ ID NO: 668239 - DNA, 20 bp, Artificial
  CRISPR gRNA sequence
tgaacacagttggttaacat

SEQ ID NO: 668240 - DNA, 20 bp, Artificial
  CRISPR gRNA sequence
gttaacatgggagagaagaa

SEQ ID NO: 668241 - DNA, 20 bp, Artificial
  CRISPR gRNA sequence
acatgggagagaagaatcac

SEQ ID NO: 668242 - DNA, 20 bp, Artificial
  CRISPR gRNA sequence
tggtttggcaggaaatgaca

SEQ ID NO: 668243 - DNA, 20 bp, Artificial
  CRISPR gRNA sequence
ggtttggcaggaaatgacag

SEQ ID NO: 668244 - DNA, 20 bp, Artificial
  CRISPR gRNA sequence
gtttggcaggaaatgacagc

SEQ ID NO: 668245 - DNA, 20 bp, Artificial
  CRISPR gRNA sequence
ggcaggaaatgacagcagaa

SEQ ID NO: 668246 - DNA, 20 bp, Artificial
  CRISPR gRNA sequence
gcaggaaatgacagcagaat

SEQ ID NO: 668247 - DNA, 20 bp, Artificial
  CRISPR gRNA sequence
ctttctatatggtgggttgt

SEQ ID NO: 668248 - DNA, 20 bp, Artificial
  CRISPR gRNA sequence
tttctatatggtgggttgtc

SEQ ID NO: 668249 - DNA, 20 bp, Artificial
  CRISPR gRNA sequence
tctatatggtgggttgtcca

SEQ ID NO: 668250 - DNA, 20 bp, Artificial
  CRISPR gRNA sequence
ctatatggtgggttgtccat

SEQ ID NO: 668251 - DNA, 20 bp, Artificial
  CRISPR gRNA sequence
tatatggtgggttgtccatc

SEQ ID NO: 668252 - DNA, 20 bp, Artificial
  CRISPR gRNA sequence
tatggtgggttgtccatctg

SEQ ID NO: 668253 - DNA, 20 bp, Artificial
  CRISPR gRNA sequence
tccatctggtctgtccatgc

SEQ ID NO: 668254 - DNA, 20 bp, Artificial
  CRISPR gRNA sequence
gtctgtccatgctaatgaga

SEQ ID NO: 668255 - DNA, 20 bp, Artificial
  CRISPR gRNA sequence
tccatgctaatgagacagat

SEQ ID NO: 668256 - DNA, 20 bp, Artificial
  CRISPR gRNA sequence
atgagacagataaatgagaa

SEQ ID NO: 668257 - DNA, 20 bp, Artificial
  CRISPR gRNA sequence
tcaaaattaggtagccactc

SEQ ID NO: 668258 - DNA, 20 bp, Artificial
  CRISPR gRNA sequence
ggtagccactcactctattt

SEQ ID NO: 668259 - DNA, 20 bp, Artificial
  CRISPR gRNA sequence
actctatttcactaaaatgt

SEQ ID NO: 668260 - DNA, 20 bp, Artificial
  CRISPR gRNA sequence
tatttcactaaaatgtaaaa

SEQ ID NO: 668261 - DNA, 20 bp, Artificial
  CRISPR gRNA sequence
tttcactaaaatgtaaaatt

SEQ ID NO: 668262 - DNA, 20 bp, Artificial
  CRISPR gRNA sequence
cactaaaatgtaaaattacc

SEQ ID NO: 668263 - DNA, 20 bp, Artificial
  CRISPR gRNA sequence
actaaaatgtaaaattaccc

SEQ ID NO: 668264 - DNA, 20 bp, Artificial
  CRISPR gRNA sequence
aaatgtaaaattacccttct

SEQ ID NO: 668265 - DNA, 20 bp, Artificial
  CRISPR gRNA sequence
cccttctggactcacttttc

SEQ ID NO: 668266 - DNA, 20 bp, Artificial
  CRISPR gRNA sequence
ctggactcacttttcaaagg

SEQ ID NO: 668267 - DNA, 20 bp, Artificial
  CRISPR gRNA sequence
tggactcacttttcaaaggg

SEQ ID NO: 668268 - DNA, 20 bp, Artificial
  CRISPR gRNA sequence
gactcacttttcaaagggat

SEQ ID NO: 668269 - DNA, 20 bp, Artificial
  CRISPR gRNA sequence
acttttcaaagggatgaaga

SEQ ID NO: 668270 - DNA, 20 bp, Artificial
  CRISPR gRNA sequence
ttcaaagggatgaagaaaca

SEQ ID NO: 668271 - DNA, 20 bp, Artificial
  CRISPR gRNA sequence
tcaaagggatgaagaaacac

SEQ ID NO: 668272 - DNA, 20 bp, Artificial
  CRISPR gRNA sequence
caaagggatgaagaaacaca

SEQ ID NO: 668273 - DNA, 20 bp, Artificial
  CRISPR gRNA sequence
aaagggatgaagaaacacag

SEQ ID NO: 668274 - DNA, 20 bp, Artificial
  CRISPR gRNA sequence
agagggcaaagcaaaaaaca

SEQ ID NO: 668275 - DNA, 20 bp, Artificial
  CRISPR gRNA sequence
gagggcaaagcaaaaaacaa

SEQ ID NO: 668276 - DNA, 20 bp, Artificial
  CRISPR gRNA sequence
agccctgctcttcaacttac

SEQ ID NO: 668277 - DNA, 20 bp, Artificial
  CRISPR gRNA sequence
ctcttcaacttacttattag

SEQ ID NO: 668278 - DNA, 20 bp, Artificial
  CRISPR gRNA sequence
ttcaacttacttattagctg

SEQ ID NO: 668279 - DNA, 20 bp, Artificial
  CRISPR gRNA sequence
caacttacttattagctgtg

SEQ ID NO: 668280 - DNA, 20 bp, Artificial
  CRISPR gRNA sequence
aacttacttattagctgtgt

SEQ ID NO: 668281 - DNA, 20 bp, Artificial
  CRISPR gRNA sequence
acttattagctgtgtgattt

SEQ ID NO: 668282 - DNA, 20 bp, Artificial
  CRISPR gRNA sequence
cttattagctgtgtgatttt

SEQ ID NO: 668283 - DNA, 20 bp, Artificial
  CRISPR gRNA sequence
attagctgtgtgattttgct

SEQ ID NO: 668284 - DNA, 20 bp, Artificial
  CRISPR gRNA sequence
ttagctgtgtgattttgctc

SEQ ID NO: 668285 - DNA, 20 bp, Artificial
  CRISPR gRNA sequence
gctgtgtgattttgctcaaa

SEQ ID NO: 668286 - DNA, 20 bp, Artificial
  CRISPR gRNA sequence
tgtgattttgctcaaataat

SEQ ID NO: 668287 - DNA, 20 bp, Artificial
  CRISPR gRNA sequence
tgctcaaataattctgtttt

SEQ ID NO: 668288 - DNA, 20 bp, Artificial
  CRISPR gRNA sequence
gctcaaataattctgttttc

SEQ ID NO: 668289 - DNA, 20 bp, Artificial
  CRISPR gRNA sequence
ctcaaataattctgttttct

SEQ ID NO: 668290 - DNA, 20 bp, Artificial
  CRISPR gRNA sequence
aaataattctgttttctgcg

SEQ ID NO: 668291 - DNA, 20 bp, Artificial
  CRISPR gRNA sequence
tgttttctgcgattcagttt

SEQ ID NO: 668292 - DNA, 20 bp, Artificial
  CRISPR gRNA sequence
ttttctgcgattcagttttc

SEQ ID NO: 668293 - DNA, 20 bp, Artificial
  CRISPR gRNA sequence
tctgcgattcagttttcttg

SEQ ID NO: 668294 - DNA, 20 bp, Artificial
  CRISPR gRNA sequence
ctgcgattcagttttcttgt

SEQ ID NO: 668295 - DNA, 20 bp, Artificial
  CRISPR gRNA sequence
tgcgattcagttttcttgta

SEQ ID NO: 668296 - DNA, 20 bp, Artificial
  CRISPR gRNA sequence
cgattcagttttcttgtacg

SEQ ID NO: 668297 - DNA, 20 bp, Artificial
  CRISPR gRNA sequence
agttttcttgtacgtttact

SEQ ID NO: 668298 - DNA, 20 bp, Artificial
  CRISPR gRNA sequence
tcttgtacgtttactgggga

SEQ ID NO: 668299 - DNA, 20 bp, Artificial
  CRISPR gRNA sequence
cttgtacgtttactggggat

SEQ ID NO: 668300 - DNA, 20 bp, Artificial
  CRISPR gRNA sequence
ttgtacgtttactggggata

SEQ ID NO: 668301 - DNA, 20 bp, Artificial
  CRISPR gRNA sequence
gtacgtttactggggataat

SEQ ID NO: 668302 - DNA, 20 bp, Artificial
  CRISPR gRNA sequence
tacgtttactggggataata

SEQ ID NO: 668303 - DNA, 20 bp, Artificial
  CRISPR gRNA sequence
actggggataataatagcac

SEQ ID NO: 668304 - DNA, 20 bp, Artificial
  CRISPR gRNA sequence
ctggggataataatagcacc

SEQ ID NO: 668305 - DNA, 20 bp, Artificial
  CRISPR gRNA sequence
gggataataatagcacctac

SEQ ID NO: 668306 - DNA, 20 bp, Artificial
  CRISPR gRNA sequence
cttcatattctagtgtgaag

SEQ ID NO: 668307 - DNA, 20 bp, Artificial
  CRISPR gRNA sequence
catattctagtgtgaagatc

SEQ ID NO: 668308 - DNA, 20 bp, Artificial
  CRISPR gRNA sequence
atattctagtgtgaagatct

SEQ ID NO: 668309 - DNA, 20 bp, Artificial
  CRISPR gRNA sequence
tagtgtgaagatctattgag

SEQ ID NO: 668310 - DNA, 20 bp, Artificial
  CRISPR gRNA sequence
gtgtgaagatctattgagat

SEQ ID NO: 668311 - DNA, 20 bp, Artificial
  CRISPR gRNA sequence
ttgagatggaagatttgaaa

SEQ ID NO: 668312 - DNA, 20 bp, Artificial
  CRISPR gRNA sequence
agatggaagatttgaaaaca

SEQ ID NO: 668313 - DNA, 20 bp, Artificial
  CRISPR gRNA sequence
gaaaacactctgaactaaat

SEQ ID NO: 668314 - DNA, 20 bp, Artificial
  CRISPR gRNA sequence
aaaacactctgaactaaata

SEQ ID NO: 668315 - DNA, 20 bp, Artificial
  CRISPR gRNA sequence
tgaactaaataaactgttta

SEQ ID NO: 668316 - DNA, 20 bp, Artificial
  CRISPR gRNA sequence
aactaaataaactgtttaag

SEQ ID NO: 668317 - DNA, 20 bp, Artificial
  CRISPR gRNA sequence
aataaactgtttaagtatga

SEQ ID NO: 668318 - DNA, 20 bp, Artificial
  CRISPR gRNA sequence
tttaagtatgagttacatta

SEQ ID NO: 668319 - DNA, 20 bp, Artificial
  CRISPR gRNA sequence
aagtatgagttacattataa

SEQ ID NO: 668320 - DNA, 20 bp, Artificial
  CRISPR gRNA sequence
agtatgagttacattataat

SEQ ID NO: 668321 - DNA, 20 bp, Artificial
  CRISPR gRNA sequence
cattataatataactcataa

SEQ ID NO: 668322 - DNA, 20 bp, Artificial
  CRISPR gRNA sequence
taatataactcataaagaaa

SEQ ID NO: 668323 - DNA, 20 bp, Artificial
  CRISPR gRNA sequence
ataaagaaaagagtttctca

SEQ ID NO: 668324 - DNA, 20 bp, Artificial
  CRISPR gRNA sequence
ctcataacctctgtaggata

SEQ ID NO: 668325 - DNA, 20 bp, Artificial
  CRISPR gRNA sequence
tcataacctctgtaggatac

SEQ ID NO: 668326 - DNA, 20 bp, Artificial
  CRISPR gRNA sequence
ataacctctgtaggatactg

SEQ ID NO: 668327 - DNA, 20 bp, Artificial
  CRISPR gRNA sequence
tgtaggatactgattttgtt

SEQ ID NO: 668328 - DNA, 20 bp, Artificial
  CRISPR gRNA sequence
taggatactgattttgtttc

SEQ ID NO: 668329 - DNA, 20 bp, Artificial
  CRISPR gRNA sequence
attttgtttctggaaagaat

SEQ ID NO: 668330 - DNA, 20 bp, Artificial
  CRISPR gRNA sequence
tgtttctggaaagaatatag

SEQ ID NO: 668331 - DNA, 20 bp, Artificial
  CRISPR gRNA sequence
gtttctggaaagaatatagt

SEQ ID NO: 668332 - DNA, 20 bp, Artificial
  CRISPR gRNA sequence
tttctggaaagaatatagta

SEQ ID NO: 668333 - DNA, 20 bp, Artificial
  CRISPR gRNA sequence
ctggaaagaatatagtaatt

SEQ ID NO: 668334 - DNA, 20 bp, Artificial
  CRISPR gRNA sequence
tggaaagaatatagtaattg

SEQ ID NO: 668335 - DNA, 20 bp, Artificial
  CRISPR gRNA sequence
gaaagaatatagtaattgtt

SEQ ID NO: 668336 - DNA, 20 bp, Artificial
  CRISPR gRNA sequence
ttgctgtgaattgagaacta

SEQ ID NO: 668337 - DNA, 20 bp, Artificial
  CRISPR gRNA sequence
ctgtgaattgagaactaatt

SEQ ID NO: 668338 - DNA, 20 bp, Artificial
  CRISPR gRNA sequence
tgaattgagaactaatttaa

SEQ ID NO: 668339 - DNA, 20 bp, Artificial
  CRISPR gRNA sequence
agaactaatttaatgttaag

SEQ ID NO: 668340 - DNA, 20 bp, Artificial
  CRISPR gRNA sequence
atttaatgttaagaaaaggg

SEQ ID NO: 668341 - DNA, 20 bp, Artificial
  CRISPR gRNA sequence
aatgttaagaaaagggaaga

SEQ ID NO: 668342 - DNA, 20 bp, Artificial
  CRISPR gRNA sequence
atgttaagaaaagggaagaa

SEQ ID NO: 668343 - DNA, 20 bp, Artificial
  CRISPR gRNA sequence
agaaaagggaagaaaaacct

SEQ ID NO: 668344 - DNA, 20 bp, Artificial
  CRISPR gRNA sequence
tgttaaaaatagaaagtaca

SEQ ID NO: 668345 - DNA, 20 bp, Artificial
  CRISPR gRNA sequence
gttaaaaatagaaagtacat

SEQ ID NO: 668346 - DNA, 20 bp, Artificial
  CRISPR gRNA sequence
ttaaaaatagaaagtacatt

SEQ ID NO: 668347 - DNA, 20 bp, Artificial
  CRISPR gRNA sequence
aaaatagaaagtacattttt

SEQ ID NO: 668348 - DNA, 20 bp, Artificial
  CRISPR gRNA sequence
ttaacattttcaacagaaga

SEQ ID NO: 668349 - DNA, 20 bp, Artificial
  CRISPR gRNA sequence
taacattttcaacagaagat

SEQ ID NO: 668350 - DNA, 20 bp, Artificial
  CRISPR gRNA sequence
aacattttcaacagaagata

SEQ ID NO: 668351 - DNA, 20 bp, Artificial
  CRISPR gRNA sequence
acattttcaacagaagataa

SEQ ID NO: 668352 - DNA, 20 bp, Artificial
  CRISPR gRNA sequence
tcaacagaagataaaatatt

SEQ ID NO: 668353 - DNA, 20 bp, Artificial
  CRISPR gRNA sequence
caacagaagataaaatatta

SEQ ID NO: 668354 - DNA, 20 bp, Artificial
  CRISPR gRNA sequence
aacagaagataaaatattac

SEQ ID NO: 668355 - DNA, 20 bp, Artificial
  CRISPR gRNA sequence
ctgtctacatttttaagttt

SEQ ID NO: 668356 - DNA, 20 bp, Artificial
  CRISPR gRNA sequence
tctacatttttaagttttct

SEQ ID NO: 668357 - DNA, 20 bp, Artificial
  CRISPR gRNA sequence
catttttaagttttcttagc

SEQ ID NO: 668358 - DNA, 20 bp, Artificial
  CRISPR gRNA sequence
ttaagttttcttagcaattt

SEQ ID NO: 668359 - DNA, 20 bp, Artificial
  CRISPR gRNA sequence
taagttttcttagcaatttc

SEQ ID NO: 668360 - DNA, 20 bp, Artificial
  CRISPR gRNA sequence
aagttttcttagcaatttca

SEQ ID NO: 668361 - DNA, 20 bp, Artificial
  CRISPR gRNA sequence
agttttcttagcaatttcag

SEQ ID NO: 668362 - DNA, 20 bp, Artificial
  CRISPR gRNA sequence
tcttagcaatttcagccaat

SEQ ID NO: 668363 - DNA, 20 bp, Artificial
  CRISPR gRNA sequence
cttagcaatttcagccaatt

SEQ ID NO: 668364 - DNA, 20 bp, Artificial
  CRISPR gRNA sequence
ttagcaatttcagccaattt

SEQ ID NO: 668365 - DNA, 20 bp, Artificial
  CRISPR gRNA sequence
agcaatttcagccaatttct

SEQ ID NO: 668366 - DNA, 20 bp, Artificial
  CRISPR gRNA sequence
gcaatttcagccaatttctc

SEQ ID NO: 668367 - DNA, 20 bp, Artificial
  CRISPR gRNA sequence
cagccaatttctctaccctt

SEQ ID NO: 668368 - DNA, 20 bp, Artificial
  CRISPR gRNA sequence
agccaatttctctacccttc

SEQ ID NO: 668369 - DNA, 20 bp, Artificial
  CRISPR gRNA sequence
ctctacccttctaaaataat

SEQ ID NO: 668370 - DNA, 20 bp, Artificial
  CRISPR gRNA sequence
tctacccttctaaaataata

SEQ ID NO: 668371 - DNA, 20 bp, Artificial
  CRISPR gRNA sequence
tacccttctaaaataatata

SEQ ID NO: 668372 - DNA, 20 bp, Artificial
  CRISPR gRNA sequence
cccttctaaaataatatagc

SEQ ID NO: 668373 - DNA, 20 bp, Artificial
  CRISPR gRNA sequence
ctaaaataatatagcaaaac

SEQ ID NO: 668374 - DNA, 20 bp, Artificial
  CRISPR gRNA sequence
taaaataatatagcaaaaca

SEQ ID NO: 668375 - DNA, 20 bp, Artificial
  CRISPR gRNA sequence
aaataatatagcaaaacata

SEQ ID NO: 668376 - DNA, 20 bp, Artificial
  CRISPR gRNA sequence
tgtattcatgaattgttttt

SEQ ID NO: 668377 - DNA, 20 bp, Artificial
  CRISPR gRNA sequence
gtattcatgaattgtttttt

SEQ ID NO: 668378 - DNA, 20 bp, Artificial
  CRISPR gRNA sequence
tattcatgaattgttttttt

SEQ ID NO: 668379 - DNA, 20 bp, Artificial
  CRISPR gRNA sequence
atgaattgttttttttaaag

SEQ ID NO: 668380 - DNA, 20 bp, Artificial
  CRISPR gRNA sequence
ttttttttaaaggacacata

SEQ ID NO: 668381 - DNA, 20 bp, Artificial
  CRISPR gRNA sequence
tttttaaaggacacataatc

SEQ ID NO: 668382 - DNA, 20 bp, Artificial
  CRISPR gRNA sequence
ttttaaaggacacataatct

SEQ ID NO: 668383 - DNA, 20 bp, Artificial
  CRISPR gRNA sequence
tttaaaggacacataatctg

SEQ ID NO: 668384 - DNA, 20 bp, Artificial
  CRISPR gRNA sequence
ttaaaggacacataatctgt

SEQ ID NO: 668385 - DNA, 20 bp, Artificial
  CRISPR gRNA sequence
taaaggacacataatctgtt

SEQ ID NO: 668386 - DNA, 20 bp, Artificial
  CRISPR gRNA sequence
aaaggacacataatctgttt

SEQ ID NO: 668387 - DNA, 20 bp, Artificial
  CRISPR gRNA sequence
aaggacacataatctgttta

SEQ ID NO: 668388 - DNA, 20 bp, Artificial
  CRISPR gRNA sequence
tttacacttgaagagttgag

SEQ ID NO: 668389 - DNA, 20 bp, Artificial
  CRISPR gRNA sequence
acacttgaagagttgaggat

SEQ ID NO: 668390 - DNA, 20 bp, Artificial
  CRISPR gRNA sequence
cacttgaagagttgaggata

SEQ ID NO: 668391 - DNA, 20 bp, Artificial
  CRISPR gRNA sequence
gaagagttgaggatacagga

SEQ ID NO: 668392 - DNA, 20 bp, Artificial
  CRISPR gRNA sequence
aagagttgaggatacaggaa

SEQ ID NO: 668393 - DNA, 20 bp, Artificial
  CRISPR gRNA sequence
aggatacaggaatatgtgcg

SEQ ID NO: 668394 - DNA, 20 bp, Artificial
  CRISPR gRNA sequence
atcagtgggatccttagtag

SEQ ID NO: 668395 - DNA, 20 bp, Artificial
  CRISPR gRNA sequence
tcagtgggatccttagtagg

SEQ ID NO: 668396 - DNA, 20 bp, Artificial
  CRISPR gRNA sequence
agtaggatcataaagctctt

SEQ ID NO: 668397 - DNA, 20 bp, Artificial
  CRISPR gRNA sequence
gtaggatcataaagctctta

SEQ ID NO: 668398 - DNA, 20 bp, Artificial
  CRISPR gRNA sequence
ttaagacggaaaggaatatg

SEQ ID NO: 668399 - DNA, 20 bp, Artificial
  CRISPR gRNA sequence
aagacggaaaggaatatgca

SEQ ID NO: 668400 - DNA, 20 bp, Artificial
  CRISPR gRNA sequence
agacggaaaggaatatgcaa

SEQ ID NO: 668401 - DNA, 20 bp, Artificial
  CRISPR gRNA sequence
ctactctaacccacttgtgt

SEQ ID NO: 668402 - DNA, 20 bp, Artificial
  CRISPR gRNA sequence
tactctaacccacttgtgtt

SEQ ID NO: 668403 - DNA, 20 bp, Artificial
  CRISPR gRNA sequence
ctctaacccacttgtgttat

SEQ ID NO: 668404 - DNA, 20 bp, Artificial
  CRISPR gRNA sequence
taacccacttgtgttataga

SEQ ID NO: 668405 - DNA, 20 bp, Artificial
  CRISPR gRNA sequence
acccacttgtgttatagatt

SEQ ID NO: 668406 - DNA, 20 bp, Artificial
  CRISPR gRNA sequence
gtgttatagattaaacaaag

SEQ ID NO: 668407 - DNA, 20 bp, Artificial
  CRISPR gRNA sequence
tgttatagattaaacaaagc

SEQ ID NO: 668408 - DNA, 20 bp, Artificial
  CRISPR gRNA sequence
tagattaaacaaagctagat

SEQ ID NO: 668409 - DNA, 20 bp, Artificial
  CRISPR gRNA sequence
aacaaagctagattttagag

SEQ ID NO: 668410 - DNA, 20 bp, Artificial
  CRISPR gRNA sequence
gattttagagagaaatatag

SEQ ID NO: 668411 - DNA, 20 bp, Artificial
  CRISPR gRNA sequence
tagagagaaatatagataga

SEQ ID NO: 668412 - DNA, 20 bp, Artificial
  CRISPR gRNA sequence
agagagaaatatagatagaa

SEQ ID NO: 668413 - DNA, 20 bp, Artificial
  CRISPR gRNA sequence
gagagaaatatagatagaat

SEQ ID NO: 668414 - DNA, 20 bp, Artificial
  CRISPR gRNA sequence
tatcttccaaactaatgtaa

SEQ ID NO: 668415 - DNA, 20 bp, Artificial
  CRISPR gRNA sequence
atcttccaaactaatgtaaa

SEQ ID NO: 668416 - DNA, 20 bp, Artificial
  CRISPR gRNA sequence
tcttccaaactaatgtaaac

SEQ ID NO: 668417 - DNA, 20 bp, Artificial
  CRISPR gRNA sequence
ccaaactaatgtaaacatga

SEQ ID NO: 668418 - DNA, 20 bp, Artificial
  CRISPR gRNA sequence
caaactaatgtaaacatgat

SEQ ID NO: 668419 - DNA, 20 bp, Artificial
  CRISPR gRNA sequence
atgtaaacatgattaaaaaa

SEQ ID NO: 668420 - DNA, 20 bp, Artificial
  CRISPR gRNA sequence
aaaaaaataagtacatagaa

SEQ ID NO: 668421 - DNA, 20 bp, Artificial
  CRISPR gRNA sequence
acacctgtaatcccagtact

SEQ ID NO: 668422 - DNA, 20 bp, Artificial
  CRISPR gRNA sequence
taatcccagtactttgggag

SEQ ID NO: 668423 - DNA, 20 bp, Artificial
  CRISPR gRNA sequence
tgggaggccgaggagggtgg

SEQ ID NO: 668424 - DNA, 20 bp, Artificial
  CRISPR gRNA sequence
gggaggccgaggagggtgga

SEQ ID NO: 668425 - DNA, 20 bp, Artificial
  CRISPR gRNA sequence
ggaggccgaggagggtggat

SEQ ID NO: 668426 - DNA, 20 bp, Artificial
  CRISPR gRNA sequence
gctaacacggtgaaaccccg

SEQ ID NO: 668427 - DNA, 20 bp, Artificial
  CRISPR gRNA sequence
acacggtgaaaccccgtctc

SEQ ID NO: 668428 - DNA, 20 bp, Artificial
  CRISPR gRNA sequence
tactaaaaatacacaaaaat

SEQ ID NO: 668429 - DNA, 20 bp, Artificial
  CRISPR gRNA sequence
ctaaaaatacacaaaaatta

SEQ ID NO: 668430 - DNA, 20 bp, Artificial
  CRISPR gRNA sequence
aaaatacacaaaaattagcc

SEQ ID NO: 668431 - DNA, 20 bp, Artificial
  CRISPR gRNA sequence
gccggacatggtggcgggcg

SEQ ID NO: 668432 - DNA, 20 bp, Artificial
  CRISPR gRNA sequence
tagtcccagctacttgggag

SEQ ID NO: 668433 - DNA, 20 bp, Artificial
  CRISPR gRNA sequence
cttgggaggctggggcagga

SEQ ID NO: 668434 - DNA, 20 bp, Artificial
  CRISPR gRNA sequence
gggaggctggggcaggagaa

SEQ ID NO: 668435 - DNA, 20 bp, Artificial
  CRISPR gRNA sequence
ggaggctggggcaggagaat

SEQ ID NO: 668436 - DNA, 20 bp, Artificial
  CRISPR gRNA sequence
gggcaggagaatggcgtgaa

SEQ ID NO: 668437 - DNA, 20 bp, Artificial
  CRISPR gRNA sequence
ggaggtggagcttgcagtga

SEQ ID NO: 668438 - DNA, 20 bp, Artificial
  CRISPR gRNA sequence
gcagtgagccgaaattgcac

SEQ ID NO: 668439 - DNA, 20 bp, Artificial
  CRISPR gRNA sequence
cagtgagccgaaattgcacc

SEQ ID NO: 668440 - DNA, 20 bp, Artificial
  CRISPR gRNA sequence
caccactgcactccagcctg

SEQ ID NO: 668441 - DNA, 20 bp, Artificial
  CRISPR gRNA sequence
cactccagcctgggcgagag

SEQ ID NO: 668442 - DNA, 20 bp, Artificial
  CRISPR gRNA sequence
cagcctgggcgagagagcaa

SEQ ID NO: 668443 - DNA, 20 bp, Artificial
  CRISPR gRNA sequence
ggcgagagagcaagactctg

SEQ ID NO: 668444 - DNA, 20 bp, Artificial
  CRISPR gRNA sequence
tgtctcaaaaaaaaaaaaaa

SEQ ID NO: 668445 - DNA, 20 bp, Artificial
  CRISPR gRNA sequence
tctcaaaaaaaaaaaaaaaa

SEQ ID NO: 668446 - DNA, 20 bp, Artificial
  CRISPR gRNA sequence
aaaaaaaaaaaaaaaaaaaa

SEQ ID NO: 668447 - DNA, 20 bp, Artificial
  CRISPR gRNA sequence
gaagcccaaaggtcaattaa

SEQ ID NO: 668448 - DNA, 20 bp, Artificial
  CRISPR gRNA sequence
aaaaaatttaaaaaacaaat

SEQ ID NO: 668449 - DNA, 20 bp, Artificial
  CRISPR gRNA sequence
aaaaaacaaattgcaaagat

SEQ ID NO: 668450 - DNA, 20 bp, Artificial
  CRISPR gRNA sequence
aaaaacaaattgcaaagatg

SEQ ID NO: 668451 - DNA, 20 bp, Artificial
  CRISPR gRNA sequence
caaagatgttaagattgttt

SEQ ID NO: 668452 - DNA, 20 bp, Artificial
  CRISPR gRNA sequence
agattgtttcccatttttat

SEQ ID NO: 668453 - DNA, 20 bp, Artificial
  CRISPR gRNA sequence
tttcccatttttatagttca

SEQ ID NO: 668454 - DNA, 20 bp, Artificial
  CRISPR gRNA sequence
cccatttttatagttcatac

SEQ ID NO: 668455 - DNA, 20 bp, Artificial
  CRISPR gRNA sequence
ccatttttatagttcatact

SEQ ID NO: 668456 - DNA, 20 bp, Artificial
  CRISPR gRNA sequence
ttatagttcatacttactta

SEQ ID NO: 668457 - DNA, 20 bp, Artificial
  CRISPR gRNA sequence
tatagttcatacttacttac

SEQ ID NO: 668458 - DNA, 20 bp, Artificial
  CRISPR gRNA sequence
atagttcatacttacttact

SEQ ID NO: 668459 - DNA, 20 bp, Artificial
  CRISPR gRNA sequence
tagttcatacttacttacta

SEQ ID NO: 668460 - DNA, 20 bp, Artificial
  CRISPR gRNA sequence
atacttacttactattttca

SEQ ID NO: 668461 - DNA, 20 bp, Artificial
  CRISPR gRNA sequence
acttactattttcattcatt

SEQ ID NO: 668462 - DNA, 20 bp, Artificial
  CRISPR gRNA sequence
cttactattttcattcattt

SEQ ID NO: 668463 - DNA, 20 bp, Artificial
  CRISPR gRNA sequence
actattttcattcattttgt

SEQ ID NO: 668464 - DNA, 20 bp, Artificial
  CRISPR gRNA sequence
ctattttcattcattttgtt

SEQ ID NO: 668465 - DNA, 20 bp, Artificial
  CRISPR gRNA sequence
ttttcattcattttgttgat

SEQ ID NO: 668466 - DNA, 20 bp, Artificial
  CRISPR gRNA sequence
tcattcattttgttgattga

SEQ ID NO: 668467 - DNA, 20 bp, Artificial
  CRISPR gRNA sequence
cattcattttgttgattgac

SEQ ID NO: 668468 - DNA, 20 bp, Artificial
  CRISPR gRNA sequence
attcattttgttgattgaca

SEQ ID NO: 668469 - DNA, 20 bp, Artificial
  CRISPR gRNA sequence
attttgttgattgacagcat

SEQ ID NO: 668470 - DNA, 20 bp, Artificial
  CRISPR gRNA sequence
tgttgattgacagcattcac

SEQ ID NO: 668471 - DNA, 20 bp, Artificial
  CRISPR gRNA sequence
gttgattgacagcattcact

SEQ ID NO: 668472 - DNA, 20 bp, Artificial
  CRISPR gRNA sequence
ttgattgacagcattcacta

SEQ ID NO: 668473 - DNA, 20 bp, Artificial
  CRISPR gRNA sequence
attgacagcattcactatag

SEQ ID NO: 668474 - DNA, 20 bp, Artificial
  CRISPR gRNA sequence
acagcattcactatagataa

SEQ ID NO: 668475 - DNA, 20 bp, Artificial
  CRISPR gRNA sequence
actatagataagaggtagtt

SEQ ID NO: 668476 - DNA, 20 bp, Artificial
  CRISPR gRNA sequence
tagataagaggtagttcatg

SEQ ID NO: 668477 - DNA, 20 bp, Artificial
  CRISPR gRNA sequence
atggcagtggtttaatataa

SEQ ID NO: 668478 - DNA, 20 bp, Artificial
  CRISPR gRNA sequence
aatataaattattagagaaa

SEQ ID NO: 668479 - DNA, 20 bp, Artificial
  CRISPR gRNA sequence
atataaattattagagaaaa

SEQ ID NO: 668480 - DNA, 20 bp, Artificial
  CRISPR gRNA sequence
ttagagaaaatttaaataca

SEQ ID NO: 668481 - DNA, 20 bp, Artificial
  CRISPR gRNA sequence
gagaaaatttaaatacagaa

SEQ ID NO: 668482 - DNA, 20 bp, Artificial
  CRISPR gRNA sequence
aaatacagaaagttcaagaa

SEQ ID NO: 668483 - DNA, 20 bp, Artificial
  CRISPR gRNA sequence
aatacagaaagttcaagaaa

SEQ ID NO: 668484 - DNA, 20 bp, Artificial
  CRISPR gRNA sequence
aagaaattcatatttctgtg

SEQ ID NO: 668485 - DNA, 20 bp, Artificial
  CRISPR gRNA sequence
atatttctgtgatggaaaaa

SEQ ID NO: 668486 - DNA, 20 bp, Artificial
  CRISPR gRNA sequence
ctgtgatggaaaaaagacta

SEQ ID NO: 668487 - DNA, 20 bp, Artificial
  CRISPR gRNA sequence
tgtgatggaaaaaagactag

SEQ ID NO: 668488 - DNA, 20 bp, Artificial
  CRISPR gRNA sequence
tgatggaaaaaagactagta

SEQ ID NO: 668489 - DNA, 20 bp, Artificial
  CRISPR gRNA sequence
gtattattttacttgagcta

SEQ ID NO: 668490 - DNA, 20 bp, Artificial
  CRISPR gRNA sequence
ttttacttgagctatggaat

SEQ ID NO: 668491 - DNA, 20 bp, Artificial
  CRISPR gRNA sequence
tacttgagctatggaatact

SEQ ID NO: 668492 - DNA, 20 bp, Artificial
  CRISPR gRNA sequence
acttgagctatggaatacta

SEQ ID NO: 668493 - DNA, 20 bp, Artificial
  CRISPR gRNA sequence
cttgagctatggaatactac

SEQ ID NO: 668494 - DNA, 20 bp, Artificial
  CRISPR gRNA sequence
gagctatggaatactacaat

SEQ ID NO: 668495 - DNA, 20 bp, Artificial
  CRISPR gRNA sequence
agctatggaatactacaatt

SEQ ID NO: 668496 - DNA, 20 bp, Artificial
  CRISPR gRNA sequence
tggaatactacaatttaata

SEQ ID NO: 668497 - DNA, 20 bp, Artificial
  CRISPR gRNA sequence
caatttaatatctataacac

SEQ ID NO: 668498 - DNA, 20 bp, Artificial
  CRISPR gRNA sequence
aatatctataacacttgtgc

SEQ ID NO: 668499 - DNA, 20 bp, Artificial
  CRISPR gRNA sequence
atatctataacacttgtgct

SEQ ID NO: 668500 - DNA, 20 bp, Artificial
  CRISPR gRNA sequence
taacacttgtgcttttcatg

SEQ ID NO: 668501 - DNA, 20 bp, Artificial
  CRISPR gRNA sequence
gtgcttttcatggatacatt

SEQ ID NO: 668502 - DNA, 20 bp, Artificial
  CRISPR gRNA sequence
tgcttttcatggatacattt

SEQ ID NO: 668503 - DNA, 20 bp, Artificial
  CRISPR gRNA sequence
ttcatggatacattttaaga

SEQ ID NO: 668504 - DNA, 20 bp, Artificial
  CRISPR gRNA sequence
tcatggatacattttaagaa

SEQ ID NO: 668505 - DNA, 20 bp, Artificial
  CRISPR gRNA sequence
catggatacattttaagaac

SEQ ID NO: 668506 - DNA, 20 bp, Artificial
  CRISPR gRNA sequence
atggatacattttaagaacc

SEQ ID NO: 668507 - DNA, 20 bp, Artificial
  CRISPR gRNA sequence
taagaaccactgatttaaac

SEQ ID NO: 668508 - DNA, 20 bp, Artificial
  CRISPR gRNA sequence
aagaaccactgatttaaaca

SEQ ID NO: 668509 - DNA, 20 bp, Artificial
  CRISPR gRNA sequence
agaaccactgatttaaacaa

SEQ ID NO: 668510 - DNA, 20 bp, Artificial
  CRISPR gRNA sequence
atttaaacaagtgacacatt

SEQ ID NO: 668511 - DNA, 20 bp, Artificial
  CRISPR gRNA sequence
aaacaagtgacacattaata

SEQ ID NO: 668512 - DNA, 20 bp, Artificial
  CRISPR gRNA sequence
aacaagtgacacattaatac

SEQ ID NO: 668513 - DNA, 20 bp, Artificial
  CRISPR gRNA sequence
atacacttatttgttcacta

SEQ ID NO: 668514 - DNA, 20 bp, Artificial
  CRISPR gRNA sequence
atttgttcactattatcata

SEQ ID NO: 668515 - DNA, 20 bp, Artificial
  CRISPR gRNA sequence
tttgttcactattatcatat

SEQ ID NO: 668516 - DNA, 20 bp, Artificial
  CRISPR gRNA sequence
gttcactattatcatattca

SEQ ID NO: 668517 - DNA, 20 bp, Artificial
  CRISPR gRNA sequence
ttcactattatcatattcat

SEQ ID NO: 668518 - DNA, 20 bp, Artificial
  CRISPR gRNA sequence
actattatcatattcatttg

SEQ ID NO: 668519 - DNA, 20 bp, Artificial
  CRISPR gRNA sequence
ttatcatattcatttggtgt

SEQ ID NO: 668520 - DNA, 20 bp, Artificial
  CRISPR gRNA sequence
tcatattcatttggtgttag

SEQ ID NO: 668521 - DNA, 20 bp, Artificial
  CRISPR gRNA sequence
atttggtgttagaattctgt

SEQ ID NO: 668522 - DNA, 20 bp, Artificial
  CRISPR gRNA sequence
ggtgttagaattctgtaaat

SEQ ID NO: 668523 - DNA, 20 bp, Artificial
  CRISPR gRNA sequence
gtgttagaattctgtaaatg

SEQ ID NO: 668524 - DNA, 20 bp, Artificial
  CRISPR gRNA sequence
gaattctgtaaatgtagaat

SEQ ID NO: 668525 - DNA, 20 bp, Artificial
  CRISPR gRNA sequence
tgtaaatgtagaattaagtc

SEQ ID NO: 668526 - DNA, 20 bp, Artificial
  CRISPR gRNA sequence
taaatgtagaattaagtcac

SEQ ID NO: 668527 - DNA, 20 bp, Artificial
  CRISPR gRNA sequence
agtcactagaaaatccttaa

SEQ ID NO: 668528 - DNA, 20 bp, Artificial
  CRISPR gRNA sequence
gaaaatccttaaaataagcc

SEQ ID NO: 668529 - DNA, 20 bp, Artificial
  CRISPR gRNA sequence
aaaataagccttctctatac

SEQ ID NO: 668530 - DNA, 20 bp, Artificial
  CRISPR gRNA sequence
aaataagccttctctatacc

SEQ ID NO: 668531 - DNA, 20 bp, Artificial
  CRISPR gRNA sequence
ctctataccagattcagtga

SEQ ID NO: 668532 - DNA, 20 bp, Artificial
  CRISPR gRNA sequence
tctataccagattcagtgaa

SEQ ID NO: 668533 - DNA, 20 bp, Artificial
  CRISPR gRNA sequence
tataccagattcagtgaatt

SEQ ID NO: 668534 - DNA, 20 bp, Artificial
  CRISPR gRNA sequence
taccagattcagtgaatttc

SEQ ID NO: 668535 - DNA, 20 bp, Artificial
  CRISPR gRNA sequence
agtgaatttcatgtatataa

SEQ ID NO: 668536 - DNA, 20 bp, Artificial
  CRISPR gRNA sequence
catgtatataagatggataa

SEQ ID NO: 668537 - DNA, 20 bp, Artificial
  CRISPR gRNA sequence
atgtatataagatggataat

SEQ ID NO: 668538 - DNA, 20 bp, Artificial
  CRISPR gRNA sequence
ttaagcagcttgcataaaga

SEQ ID NO: 668539 - DNA, 20 bp, Artificial
  CRISPR gRNA sequence
agcagcttgcataaagatat

SEQ ID NO: 668540 - DNA, 20 bp, Artificial
  CRISPR gRNA sequence
gcataaagatattccacagt

SEQ ID NO: 668541 - DNA, 20 bp, Artificial
  CRISPR gRNA sequence
cataaagatattccacagtc

SEQ ID NO: 668542 - DNA, 20 bp, Artificial
  CRISPR gRNA sequence
cacagtccttttggtaaact

SEQ ID NO: 668543 - DNA, 20 bp, Artificial
  CRISPR gRNA sequence
ttggtaaacttgtacctgtg

SEQ ID NO: 668544 - DNA, 20 bp, Artificial
  CRISPR gRNA sequence
tggtaaacttgtacctgtgt

SEQ ID NO: 668545 - DNA, 20 bp, Artificial
  CRISPR gRNA sequence
ggtaaacttgtacctgtgtg

SEQ ID NO: 668546 - DNA, 20 bp, Artificial
  CRISPR gRNA sequence
gtaaacttgtacctgtgtgt

SEQ ID NO: 668547 - DNA, 20 bp, Artificial
  CRISPR gRNA sequence
gtacctgtgtgtaacaatct

SEQ ID NO: 668548 - DNA, 20 bp, Artificial
  CRISPR gRNA sequence
tacctgtgtgtaacaatctt

SEQ ID NO: 668549 - DNA, 20 bp, Artificial
  CRISPR gRNA sequence
tgtgtaacaatcttttattc

SEQ ID NO: 668550 - DNA, 20 bp, Artificial
  CRISPR gRNA sequence
ttattctgaggaaaccaaaa

SEQ ID NO: 668551 - DNA, 20 bp, Artificial
  CRISPR gRNA sequence
tattctgaggaaaccaaaat

SEQ ID NO: 668552 - DNA, 20 bp, Artificial
  CRISPR gRNA sequence
attctgaggaaaccaaaatt

SEQ ID NO: 668553 - DNA, 20 bp, Artificial
  CRISPR gRNA sequence
ttctgaggaaaccaaaattt

SEQ ID NO: 668554 - DNA, 20 bp, Artificial
  CRISPR gRNA sequence
tgaggaaaccaaaattttcc

SEQ ID NO: 668555 - DNA, 20 bp, Artificial
  CRISPR gRNA sequence
aggaaaccaaaattttcctt

SEQ ID NO: 668556 - DNA, 20 bp, Artificial
  CRISPR gRNA sequence
tccttgaaatgatttatata

SEQ ID NO: 668557 - DNA, 20 bp, Artificial
  CRISPR gRNA sequence
ccttgaaatgatttatatat

SEQ ID NO: 668558 - DNA, 20 bp, Artificial
  CRISPR gRNA sequence
cttgaaatgatttatatatt

SEQ ID NO: 668559 - DNA, 20 bp, Artificial
  CRISPR gRNA sequence
gaaatgatttatatattagt

SEQ ID NO: 668560 - DNA, 20 bp, Artificial
  CRISPR gRNA sequence
aaatgatttatatattagtt

SEQ ID NO: 668561 - DNA, 20 bp, Artificial
  CRISPR gRNA sequence
atatattagttgtatgtctt

SEQ ID NO: 668562 - DNA, 20 bp, Artificial
  CRISPR gRNA sequence
tatattagttgtatgtcttc

SEQ ID NO: 668563 - DNA, 20 bp, Artificial
  CRISPR gRNA sequence
gttgtatgtcttcagactca

SEQ ID NO: 668564 - DNA, 20 bp, Artificial
  CRISPR gRNA sequence
tatgtcttcagactcactaa

SEQ ID NO: 668565 - DNA, 20 bp, Artificial
  CRISPR gRNA sequence
cagactcactaagttcatat

SEQ ID NO: 668566 - DNA, 20 bp, Artificial
  CRISPR gRNA sequence
agactcactaagttcatata

SEQ ID NO: 668567 - DNA, 20 bp, Artificial
  CRISPR gRNA sequence
actaagttcatatactttta

SEQ ID NO: 668568 - DNA, 20 bp, Artificial
  CRISPR gRNA sequence
agttcatatacttttatttc

SEQ ID NO: 668569 - DNA, 20 bp, Artificial
  CRISPR gRNA sequence
atatacttttatttctttta

SEQ ID NO: 668570 - DNA, 20 bp, Artificial
  CRISPR gRNA sequence
ttatttcttttatttattta

SEQ ID NO: 668571 - DNA, 20 bp, Artificial
  CRISPR gRNA sequence
tatttcttttatttatttat

SEQ ID NO: 668572 - DNA, 20 bp, Artificial
  CRISPR gRNA sequence
atttcttttatttatttatt

SEQ ID NO: 668573 - DNA, 20 bp, Artificial
  CRISPR gRNA sequence
tttcttttatttatttattt

SEQ ID NO: 668574 - DNA, 20 bp, Artificial
  CRISPR gRNA sequence
cttttatttatttatttttt

SEQ ID NO: 668575 - DNA, 20 bp, Artificial
  CRISPR gRNA sequence
ttttatttatttattttttt

SEQ ID NO: 668576 - DNA, 20 bp, Artificial
  CRISPR gRNA sequence
ttatttatttattttttttg

SEQ ID NO: 668577 - DNA, 20 bp, Artificial
  CRISPR gRNA sequence
tatttatttattttttttgg

SEQ ID NO: 668578 - DNA, 20 bp, Artificial
  CRISPR gRNA sequence
atttatttattttttttgga

SEQ ID NO: 668579 - DNA, 20 bp, Artificial
  CRISPR gRNA sequence
tttatttattttttttggag

SEQ ID NO: 668580 - DNA, 20 bp, Artificial
  CRISPR gRNA sequence
atttattttttttggagacg

SEQ ID NO: 668581 - DNA, 20 bp, Artificial
  CRISPR gRNA sequence
tttattttttttggagacgg

SEQ ID NO: 668582 - DNA, 20 bp, Artificial
  CRISPR gRNA sequence
attttttttggagacggagt

SEQ ID NO: 668583 - DNA, 20 bp, Artificial
  CRISPR gRNA sequence
ttttttttggagacggagtc

SEQ ID NO: 668584 - DNA, 20 bp, Artificial
  CRISPR gRNA sequence
tttttggagacggagtctgg

SEQ ID NO: 668585 - DNA, 20 bp, Artificial
  CRISPR gRNA sequence
ttttggagacggagtctggc

SEQ ID NO: 668586 - DNA, 20 bp, Artificial
  CRISPR gRNA sequence
tttggagacggagtctggct

SEQ ID NO: 668587 - DNA, 20 bp, Artificial
  CRISPR gRNA sequence
ttggagacggagtctggctt

SEQ ID NO: 668588 - DNA, 20 bp, Artificial
  CRISPR gRNA sequence
tggagacggagtctggcttt

SEQ ID NO: 668589 - DNA, 20 bp, Artificial
  CRISPR gRNA sequence
ggagacggagtctggctttg

SEQ ID NO: 668590 - DNA, 20 bp, Artificial
  CRISPR gRNA sequence
gagacggagtctggctttgt

SEQ ID NO: 668591 - DNA, 20 bp, Artificial
  CRISPR gRNA sequence
gctttgtcgcccaggctgga

SEQ ID NO: 668592 - DNA, 20 bp, Artificial
  CRISPR gRNA sequence
tgtcgcccaggctggagtgc

SEQ ID NO: 668593 - DNA, 20 bp, Artificial
  CRISPR gRNA sequence
gtcgcccaggctggagtgca

SEQ ID NO: 668594 - DNA, 20 bp, Artificial
  CRISPR gRNA sequence
tcgcccaggctggagtgcag

SEQ ID NO: 668595 - DNA, 20 bp, Artificial
  CRISPR gRNA sequence
gagtgcagtggcgcgatctc

SEQ ID NO: 668596 - DNA, 20 bp, Artificial
  CRISPR gRNA sequence
cgctcacgcaagctccgcct

SEQ ID NO: 668597 - DNA, 20 bp, Artificial
  CRISPR gRNA sequence
acgcaagctccgcctcctgg

SEQ ID NO: 668598 - DNA, 20 bp, Artificial
  CRISPR gRNA sequence
cgcctcctgggttcacgccc

SEQ ID NO: 668599 - DNA, 20 bp, Artificial
  CRISPR gRNA sequence
ctgggttcacgcccttctcc

SEQ ID NO: 668600 - DNA, 20 bp, Artificial
  CRISPR gRNA sequence
ggttcacgcccttctcctgc

SEQ ID NO: 668601 - DNA, 20 bp, Artificial
  CRISPR gRNA sequence
acgcccttctcctgcctcag

SEQ ID NO: 668602 - DNA, 20 bp, Artificial
  CRISPR gRNA sequence
ctcctgcctcagcctccgga

SEQ ID NO: 668603 - DNA, 20 bp, Artificial
  CRISPR gRNA sequence
tcctgcctcagcctccggag

SEQ ID NO: 668604 - DNA, 20 bp, Artificial
  CRISPR gRNA sequence
ctgcctcagcctccggagta

SEQ ID NO: 668605 - DNA, 20 bp, Artificial
  CRISPR gRNA sequence
cctcagcctccggagtagct

SEQ ID NO: 668606 - DNA, 20 bp, Artificial
  CRISPR gRNA sequence
agcctccggagtagctggac

SEQ ID NO: 668607 - DNA, 20 bp, Artificial
  CRISPR gRNA sequence
cggagtagctggactttcat

SEQ ID NO: 668608 - DNA, 20 bp, Artificial
  CRISPR gRNA sequence
gactttcatttcttaatagt

SEQ ID NO: 668609 - DNA, 20 bp, Artificial
  CRISPR gRNA sequence
tcatttcttaatagtgaatt

SEQ ID NO: 668610 - DNA, 20 bp, Artificial
  CRISPR gRNA sequence
catttcttaatagtgaattg

SEQ ID NO: 668611 - DNA, 20 bp, Artificial
  CRISPR gRNA sequence
atttcttaatagtgaattgt

SEQ ID NO: 668612 - DNA, 20 bp, Artificial
  CRISPR gRNA sequence
cttaatagtgaattgtagaa

SEQ ID NO: 668613 - DNA, 20 bp, Artificial
  CRISPR gRNA sequence
ttaatagtgaattgtagaat

SEQ ID NO: 668614 - DNA, 20 bp, Artificial
  CRISPR gRNA sequence
aatagtgaattgtagaattt

SEQ ID NO: 668615 - DNA, 20 bp, Artificial
  CRISPR gRNA sequence
atagtgaattgtagaatttg

SEQ ID NO: 668616 - DNA, 20 bp, Artificial
  CRISPR gRNA sequence
tagaatttggatgtagaatt

SEQ ID NO: 668617 - DNA, 20 bp, Artificial
  CRISPR gRNA sequence
ggatgtagaatttggaagtt

SEQ ID NO: 668618 - DNA, 20 bp, Artificial
  CRISPR gRNA sequence
gatgtagaatttggaagttg

SEQ ID NO: 668619 - DNA, 20 bp, Artificial
  CRISPR gRNA sequence
ggaagttggacatctctcaa

SEQ ID NO: 668620 - DNA, 20 bp, Artificial
  CRISPR gRNA sequence
gaagttggacatctctcaag

SEQ ID NO: 668621 - DNA, 20 bp, Artificial
  CRISPR gRNA sequence
gacatctctcaagcttcttt

SEQ ID NO: 668622 - DNA, 20 bp, Artificial
  CRISPR gRNA sequence
tcaagcttcttttaaattaa

SEQ ID NO: 668623 - DNA, 20 bp, Artificial
  CRISPR gRNA sequence
aagcttcttttaaattaaaa

SEQ ID NO: 668624 - DNA, 20 bp, Artificial
  CRISPR gRNA sequence
cttttaaattaaaatatcat

SEQ ID NO: 668625 - DNA, 20 bp, Artificial
  CRISPR gRNA sequence
ttttaaattaaaatatcata

SEQ ID NO: 668626 - DNA, 20 bp, Artificial
  CRISPR gRNA sequence
ttaaattaaaatatcataat

SEQ ID NO: 668627 - DNA, 20 bp, Artificial
  CRISPR gRNA sequence
taaattaaaatatcataatt

SEQ ID NO: 668628 - DNA, 20 bp, Artificial
  CRISPR gRNA sequence
aaattaaaatatcataattt

SEQ ID NO: 668629 - DNA, 20 bp, Artificial
  CRISPR gRNA sequence
aattaaaatatcataattta

SEQ ID NO: 668630 - DNA, 20 bp, Artificial
  CRISPR gRNA sequence
aaatatcataatttatccta

SEQ ID NO: 668631 - DNA, 20 bp, Artificial
  CRISPR gRNA sequence
atcctaaacaattgaagata

SEQ ID NO: 668632 - DNA, 20 bp, Artificial
  CRISPR gRNA sequence
tcctaaacaattgaagataa

SEQ ID NO: 668633 - DNA, 20 bp, Artificial
  CRISPR gRNA sequence
aacaattgaagataaatatt

SEQ ID NO: 668634 - DNA, 20 bp, Artificial
  CRISPR gRNA sequence
aagataaatattccatggta

SEQ ID NO: 668635 - DNA, 20 bp, Artificial
  CRISPR gRNA sequence
catggtattaagtataggga

SEQ ID NO: 668636 - DNA, 20 bp, Artificial
  CRISPR gRNA sequence
agtatagggaaatgacatat

SEQ ID NO: 668637 - DNA, 20 bp, Artificial
  CRISPR gRNA sequence
atttattctcttttctatat

SEQ ID NO: 668638 - DNA, 20 bp, Artificial
  CRISPR gRNA sequence
attctcttttctatattaaa

SEQ ID NO: 668639 - DNA, 20 bp, Artificial
  CRISPR gRNA sequence
ttctcttttctatattaaac

SEQ ID NO: 668640 - DNA, 20 bp, Artificial
  CRISPR gRNA sequence
tcttttctatattaaacatt

SEQ ID NO: 668641 - DNA, 20 bp, Artificial
  CRISPR gRNA sequence
ttttctatattaaacattta

SEQ ID NO: 668642 - DNA, 20 bp, Artificial
  CRISPR gRNA sequence
ttctatattaaacatttaat

SEQ ID NO: 668643 - DNA, 20 bp, Artificial
  CRISPR gRNA sequence
tctatattaaacatttaatt

SEQ ID NO: 668644 - DNA, 20 bp, Artificial
  CRISPR gRNA sequence
ctatattaaacatttaattc

SEQ ID NO: 668645 - DNA, 20 bp, Artificial
  CRISPR gRNA sequence
tatattaaacatttaattcc

SEQ ID NO: 668646 - DNA, 20 bp, Artificial
  CRISPR gRNA sequence
tattaaacatttaattccaa

SEQ ID NO: 668647 - DNA, 20 bp, Artificial
  CRISPR gRNA sequence
aacatttaattccaaaaata

SEQ ID NO: 668648 - DNA, 20 bp, Artificial
  CRISPR gRNA sequence
aattccaaaaatattataat

SEQ ID NO: 668649 - DNA, 20 bp, Artificial
  CRISPR gRNA sequence
attccaaaaatattataata

SEQ ID NO: 668650 - DNA, 20 bp, Artificial
  CRISPR gRNA sequence
caaaaatattataataacta

SEQ ID NO: 668651 - DNA, 20 bp, Artificial
  CRISPR gRNA sequence
taataactagcagtgaatat

SEQ ID NO: 668652 - DNA, 20 bp, Artificial
  CRISPR gRNA sequence
gcagtgaatatatgaattta

SEQ ID NO: 668653 - DNA, 20 bp, Artificial
  CRISPR gRNA sequence
acgtttggagttaaaaagca

SEQ ID NO: 668654 - DNA, 20 bp, Artificial
  CRISPR gRNA sequence
cgtttggagttaaaaagcac

SEQ ID NO: 668655 - DNA, 20 bp, Artificial
  CRISPR gRNA sequence
ggagttaaaaagcacttcac

SEQ ID NO: 668656 - DNA, 20 bp, Artificial
  CRISPR gRNA sequence
gagttaaaaagcacttcaca

SEQ ID NO: 668657 - DNA, 20 bp, Artificial
  CRISPR gRNA sequence
aaaagcacttcacatacata

SEQ ID NO: 668658 - DNA, 20 bp, Artificial
  CRISPR gRNA sequence
cacatacatatttcatttaa

SEQ ID NO: 668659 - DNA, 20 bp, Artificial
  CRISPR gRNA sequence
acatacatatttcatttaat

SEQ ID NO: 668660 - DNA, 20 bp, Artificial
  CRISPR gRNA sequence
catttaatttaaataaagta

SEQ ID NO: 668661 - DNA, 20 bp, Artificial
  CRISPR gRNA sequence
atttaatttaaataaagtac

SEQ ID NO: 668662 - DNA, 20 bp, Artificial
  CRISPR gRNA sequence
aatttaaataaagtacaact

SEQ ID NO: 668663 - DNA, 20 bp, Artificial
  CRISPR gRNA sequence
atttaaataaagtacaactg

SEQ ID NO: 668664 - DNA, 20 bp, Artificial
  CRISPR gRNA sequence
aaataaagtacaactgctga

SEQ ID NO: 668665 - DNA, 20 bp, Artificial
  CRISPR gRNA sequence
aataaagtacaactgctgaa

SEQ ID NO: 668666 - DNA, 20 bp, Artificial
  CRISPR gRNA sequence
ctgaagatagatcgatagat

SEQ ID NO: 668667 - DNA, 20 bp, Artificial
  CRISPR gRNA sequence
aagatagatcgatagatgtt

SEQ ID NO: 668668 - DNA, 20 bp, Artificial
  CRISPR gRNA sequence
tatcagtataactgtatcgc

SEQ ID NO: 668669 - DNA, 20 bp, Artificial
  CRISPR gRNA sequence
tatcgcaaaccaccatgttt

SEQ ID NO: 668670 - DNA, 20 bp, Artificial
  CRISPR gRNA sequence
aatttttgtgttgggattct

SEQ ID NO: 668671 - DNA, 20 bp, Artificial
  CRISPR gRNA sequence
atttttgtgttgggattcta

SEQ ID NO: 668672 - DNA, 20 bp, Artificial
  CRISPR gRNA sequence
ttgtgttgggattctatgcc

SEQ ID NO: 668673 - DNA, 20 bp, Artificial
  CRISPR gRNA sequence
tgtgttgggattctatgcct

SEQ ID NO: 668674 - DNA, 20 bp, Artificial
  CRISPR gRNA sequence
gtgttgggattctatgccta

SEQ ID NO: 668675 - DNA, 20 bp, Artificial
  CRISPR gRNA sequence
tgttgggattctatgcctac

SEQ ID NO: 668676 - DNA, 20 bp, Artificial
  CRISPR gRNA sequence
ggattctatgcctactacac

SEQ ID NO: 668677 - DNA, 20 bp, Artificial
  CRISPR gRNA sequence
tatgcctactacacattatt

SEQ ID NO: 668678 - DNA, 20 bp, Artificial
  CRISPR gRNA sequence
tgcctactacacattatttg

SEQ ID NO: 668679 - DNA, 20 bp, Artificial
  CRISPR gRNA sequence
ctacacattatttgtgttta

SEQ ID NO: 668680 - DNA, 20 bp, Artificial
  CRISPR gRNA sequence
cacattatttgtgtttaaat

SEQ ID NO: 668681 - DNA, 20 bp, Artificial
  CRISPR gRNA sequence
tttgtgtttaaatagttctc

SEQ ID NO: 668682 - DNA, 20 bp, Artificial
  CRISPR gRNA sequence
gtgtttaaatagttctctgt

SEQ ID NO: 668683 - DNA, 20 bp, Artificial
  CRISPR gRNA sequence
tgtttaaatagttctctgtc

SEQ ID NO: 668684 - DNA, 20 bp, Artificial
  CRISPR gRNA sequence
aaatagttctctgtcttatt

SEQ ID NO: 668685 - DNA, 20 bp, Artificial
  CRISPR gRNA sequence
aatagttctctgtcttattc

SEQ ID NO: 668686 - DNA, 20 bp, Artificial
  CRISPR gRNA sequence
tctgtcttattcttctcttg

SEQ ID NO: 668687 - DNA, 20 bp, Artificial
  CRISPR gRNA sequence
tgtcttattcttctcttgtt

SEQ ID NO: 668688 - DNA, 20 bp, Artificial
  CRISPR gRNA sequence
tcttattcttctcttgttta

SEQ ID NO: 668689 - DNA, 20 bp, Artificial
  CRISPR gRNA sequence
attcttctcttgtttatatt

SEQ ID NO: 668690 - DNA, 20 bp, Artificial
  CRISPR gRNA sequence
ttcttctcttgtttatatta

SEQ ID NO: 668691 - DNA, 20 bp, Artificial
  CRISPR gRNA sequence
ttctcttgtttatattacat

SEQ ID NO: 668692 - DNA, 20 bp, Artificial
  CRISPR gRNA sequence
ctcttgtttatattacatgt

SEQ ID NO: 668693 - DNA, 20 bp, Artificial
  CRISPR gRNA sequence
tcttgtttatattacatgtt

SEQ ID NO: 668694 - DNA, 20 bp, Artificial
  CRISPR gRNA sequence
ttgtttatattacatgttta

SEQ ID NO: 668695 - DNA, 20 bp, Artificial
  CRISPR gRNA sequence
gtttatattacatgtttagg

SEQ ID NO: 668696 - DNA, 20 bp, Artificial
  CRISPR gRNA sequence
tttatattacatgtttagga

SEQ ID NO: 668697 - DNA, 20 bp, Artificial
  CRISPR gRNA sequence
atattacatgtttaggaatt

SEQ ID NO: 668698 - DNA, 20 bp, Artificial
  CRISPR gRNA sequence
tattacatgtttaggaattt

SEQ ID NO: 668699 - DNA, 20 bp, Artificial
  CRISPR gRNA sequence
catgtttaggaattttgtgt

SEQ ID NO: 668700 - DNA, 20 bp, Artificial
  CRISPR gRNA sequence
aggaattttgtgtttattat

SEQ ID NO: 668701 - DNA, 20 bp, Artificial
  CRISPR gRNA sequence
ggaattttgtgtttattatt

SEQ ID NO: 668702 - DNA, 20 bp, Artificial
  CRISPR gRNA sequence
tgtgtttattattttagaaa

SEQ ID NO: 668703 - DNA, 20 bp, Artificial
  CRISPR gRNA sequence
gtgtttattattttagaaaa

SEQ ID NO: 668704 - DNA, 20 bp, Artificial
  CRISPR gRNA sequence
tgtttattattttagaaaat

SEQ ID NO: 668705 - DNA, 20 bp, Artificial
  CRISPR gRNA sequence
attattttagaaaatgagat

SEQ ID NO: 668706 - DNA, 20 bp, Artificial
  CRISPR gRNA sequence
ttattttagaaaatgagatt

SEQ ID NO: 668707 - DNA, 20 bp, Artificial
  CRISPR gRNA sequence
ttttagaaaatgagattata

SEQ ID NO: 668708 - DNA, 20 bp, Artificial
  CRISPR gRNA sequence
tagaaaatgagattatatag

SEQ ID NO: 668709 - DNA, 20 bp, Artificial
  CRISPR gRNA sequence
agaaaatgagattatatagt

SEQ ID NO: 668710 - DNA, 20 bp, Artificial
  CRISPR gRNA sequence
gaaaatgagattatatagta

SEQ ID NO: 668711 - DNA, 20 bp, Artificial
  CRISPR gRNA sequence
tatagtagttttgtttcggt

SEQ ID NO: 668712 - DNA, 20 bp, Artificial
  CRISPR gRNA sequence
tgtttcggtgttttagaata

SEQ ID NO: 668713 - DNA, 20 bp, Artificial
  CRISPR gRNA sequence
gtttcggtgttttagaataa

SEQ ID NO: 668714 - DNA, 20 bp, Artificial
  CRISPR gRNA sequence
tttcggtgttttagaataaa

SEQ ID NO: 668715 - DNA, 20 bp, Artificial
  CRISPR gRNA sequence
cggtgttttagaataaatgg

SEQ ID NO: 668716 - DNA, 20 bp, Artificial
  CRISPR gRNA sequence
ggtgttttagaataaatgga

SEQ ID NO: 668717 - DNA, 20 bp, Artificial
  CRISPR gRNA sequence
tagaataaatggaatttcta

SEQ ID NO: 668718 - DNA, 20 bp, Artificial
  CRISPR gRNA sequence
agaataaatggaatttctat

SEQ ID NO: 668719 - DNA, 20 bp, Artificial
  CRISPR gRNA sequence
gaataaatggaatttctata

SEQ ID NO: 668720 - DNA, 20 bp, Artificial
  CRISPR gRNA sequence
ctataaaaagagttttctat

SEQ ID NO: 668721 - DNA, 20 bp, Artificial
  CRISPR gRNA sequence
tataaaaagagttttctatt

SEQ ID NO: 668722 - DNA, 20 bp, Artificial
  CRISPR gRNA sequence
taaaaagagttttctatttt

SEQ ID NO: 668723 - DNA, 20 bp, Artificial
  CRISPR gRNA sequence
tctatttttttttctagtgg

SEQ ID NO: 668724 - DNA, 20 bp, Artificial
  CRISPR gRNA sequence
ctatttttttttctagtgga

SEQ ID NO: 668725 - DNA, 20 bp, Artificial
  CRISPR gRNA sequence
tatttttttttctagtggaa

SEQ ID NO: 668726 - DNA, 20 bp, Artificial
  CRISPR gRNA sequence
tttttttttctagtggaaaa

SEQ ID NO: 668727 - DNA, 20 bp, Artificial
  CRISPR gRNA sequence
ttttttctagtggaaaacta

SEQ ID NO: 668728 - DNA, 20 bp, Artificial
  CRISPR gRNA sequence
tttttctagtggaaaactag

SEQ ID NO: 668729 - DNA, 20 bp, Artificial
  CRISPR gRNA sequence
ttttctagtggaaaactagg

SEQ ID NO: 668730 - DNA, 20 bp, Artificial
  CRISPR gRNA sequence
tttctagtggaaaactaggt

SEQ ID NO: 668731 - DNA, 20 bp, Artificial
  CRISPR gRNA sequence
ttctagtggaaaactaggtg

SEQ ID NO: 668732 - DNA, 20 bp, Artificial
  CRISPR gRNA sequence
tctagtggaaaactaggtga

SEQ ID NO: 668733 - DNA, 20 bp, Artificial
  CRISPR gRNA sequence
ctagtggaaaactaggtgat

SEQ ID NO: 668734 - DNA, 20 bp, Artificial
  CRISPR gRNA sequence
tagtggaaaactaggtgatg

SEQ ID NO: 668735 - DNA, 20 bp, Artificial
  CRISPR gRNA sequence
gtggaaaactaggtgatggt

SEQ ID NO: 668736 - DNA, 20 bp, Artificial
  CRISPR gRNA sequence
ggtgatggtgcatatgactt

SEQ ID NO: 668737 - DNA, 20 bp, Artificial
  CRISPR gRNA sequence
tatccctaggaaaagcatta

SEQ ID NO: 668738 - DNA, 20 bp, Artificial
  CRISPR gRNA sequence
atccctaggaaaagcattag

SEQ ID NO: 668739 - DNA, 20 bp, Artificial
  CRISPR gRNA sequence
tccctaggaaaagcattagt

SEQ ID NO: 668740 - DNA, 20 bp, Artificial
  CRISPR gRNA sequence
ggaaaagcattagttttgta

SEQ ID NO: 668741 - DNA, 20 bp, Artificial
  CRISPR gRNA sequence
gttttgtaatggggtttcat

SEQ ID NO: 668742 - DNA, 20 bp, Artificial
  CRISPR gRNA sequence
tgtaatggggtttcatgaag

SEQ ID NO: 668743 - DNA, 20 bp, Artificial
  CRISPR gRNA sequence
gtaatggggtttcatgaagt

SEQ ID NO: 668744 - DNA, 20 bp, Artificial
  CRISPR gRNA sequence
taatggggtttcatgaagtt

SEQ ID NO: 668745 - DNA, 20 bp, Artificial
  CRISPR gRNA sequence
catgaagtttacttccgttc

SEQ ID NO: 668746 - DNA, 20 bp, Artificial
  CRISPR gRNA sequence
atgaagtttacttccgttca

SEQ ID NO: 668747 - DNA, 20 bp, Artificial
  CRISPR gRNA sequence
acttccgttcacttttttcc

SEQ ID NO: 668748 - DNA, 20 bp, Artificial
  CRISPR gRNA sequence
cttccgttcacttttttccc

SEQ ID NO: 668749 - DNA, 20 bp, Artificial
  CRISPR gRNA sequence
ccgttcacttttttccctgc

SEQ ID NO: 668750 - DNA, 20 bp, Artificial
  CRISPR gRNA sequence
cgttcacttttttccctgcc

SEQ ID NO: 668751 - DNA, 20 bp, Artificial
  CRISPR gRNA sequence
acttttttccctgcctgttt

SEQ ID NO: 668752 - DNA, 20 bp, Artificial
  CRISPR gRNA sequence
ttttccctgcctgtttaaaa

SEQ ID NO: 668753 - DNA, 20 bp, Artificial
  CRISPR gRNA sequence
tttccctgcctgtttaaaaa

SEQ ID NO: 668754 - DNA, 20 bp, Artificial
  CRISPR gRNA sequence
ttccctgcctgtttaaaaaa

SEQ ID NO: 668755 - DNA, 20 bp, Artificial
  CRISPR gRNA sequence
tccctgcctgtttaaaaaaa

SEQ ID NO: 668756 - DNA, 20 bp, Artificial
  CRISPR gRNA sequence
ccctgcctgtttaaaaaaaa

SEQ ID NO: 668757 - DNA, 20 bp, Artificial
  CRISPR gRNA sequence
cctgcctgtttaaaaaaaat

SEQ ID NO: 668758 - DNA, 20 bp, Artificial
  CRISPR gRNA sequence
cctgtttaaaaaaaatcctg

SEQ ID NO: 668759 - DNA, 20 bp, Artificial
  CRISPR gRNA sequence
tttaaaaaaaatcctgttta

SEQ ID NO: 668760 - DNA, 20 bp, Artificial
  CRISPR gRNA sequence
aaaaaaaatcctgtttagtt

SEQ ID NO: 668761 - DNA, 20 bp, Artificial
  CRISPR gRNA sequence
aaaaaaatcctgtttagttt

SEQ ID NO: 668762 - DNA, 20 bp, Artificial
  CRISPR gRNA sequence
tttagtttacatgatgtgta

SEQ ID NO: 668763 - DNA, 20 bp, Artificial
  CRISPR gRNA sequence
agtttacatgatgtgtagga

SEQ ID NO: 668764 - DNA, 20 bp, Artificial
  CRISPR gRNA sequence
gtttacatgatgtgtaggaa

SEQ ID NO: 668765 - DNA, 20 bp, Artificial
  CRISPR gRNA sequence
acatgatgtgtaggaaagcg

SEQ ID NO: 668766 - DNA, 20 bp, Artificial
  CRISPR gRNA sequence
catgatgtgtaggaaagcgt

SEQ ID NO: 668767 - DNA, 20 bp, Artificial
  CRISPR gRNA sequence
ggaaaacattatttgttttt

SEQ ID NO: 668768 - DNA, 20 bp, Artificial
  CRISPR gRNA sequence
tttgtttttttacaatcagt

SEQ ID NO: 668769 - DNA, 20 bp, Artificial
  CRISPR gRNA sequence
gtttttttacaatcagtgat

SEQ ID NO: 668770 - DNA, 20 bp, Artificial
  CRISPR gRNA sequence
tttttttacaatcagtgatt

SEQ ID NO: 668771 - DNA, 20 bp, Artificial
  CRISPR gRNA sequence
ttttacaatcagtgatttaa

SEQ ID NO: 668772 - DNA, 20 bp, Artificial
  CRISPR gRNA sequence
tttacaatcagtgatttaaa

SEQ ID NO: 668773 - DNA, 20 bp, Artificial
  CRISPR gRNA sequence
ttacaatcagtgatttaaaa

SEQ ID NO: 668774 - DNA, 20 bp, Artificial
  CRISPR gRNA sequence
tacaatcagtgatttaaaaa

SEQ ID NO: 668775 - DNA, 20 bp, Artificial
  CRISPR gRNA sequence
acaatcagtgatttaaaaac

SEQ ID NO: 668776 - DNA, 20 bp, Artificial
  CRISPR gRNA sequence
caatcagtgatttaaaaaca

SEQ ID NO: 668777 - DNA, 20 bp, Artificial
  CRISPR gRNA sequence
aaaaacatagtcattagtgt

SEQ ID NO: 668778 - DNA, 20 bp, Artificial
  CRISPR gRNA sequence
aaaacatagtcattagtgtg

SEQ ID NO: 668779 - DNA, 20 bp, Artificial
  CRISPR gRNA sequence
gtgtgtctgtgtgttttaaa

SEQ ID NO: 668780 - DNA, 20 bp, Artificial
  CRISPR gRNA sequence
tgtgttttaaatttgtatat

SEQ ID NO: 668781 - DNA, 20 bp, Artificial
  CRISPR gRNA sequence
taaatttgtatatgaatttc

SEQ ID NO: 668782 - DNA, 20 bp, Artificial
  CRISPR gRNA sequence
aaatttgtatatgaatttct

SEQ ID NO: 668783 - DNA, 20 bp, Artificial
  CRISPR gRNA sequence
aatttgtatatgaatttctg

SEQ ID NO: 668784 - DNA, 20 bp, Artificial
  CRISPR gRNA sequence
gtatatgaatttctgtgatg

SEQ ID NO: 668785 - DNA, 20 bp, Artificial
  CRISPR gRNA sequence
tatatgaatttctgtgatgc

SEQ ID NO: 668786 - DNA, 20 bp, Artificial
  CRISPR gRNA sequence
ctgtgatgccttatctgctc

SEQ ID NO: 668787 - DNA, 20 bp, Artificial
  CRISPR gRNA sequence
tgtgatgccttatctgctct

SEQ ID NO: 668788 - DNA, 20 bp, Artificial
  CRISPR gRNA sequence
tgatgccttatctgctctgc

SEQ ID NO: 668789 - DNA, 20 bp, Artificial
  CRISPR gRNA sequence
atctgctctgctctttgcta

SEQ ID NO: 668790 - DNA, 20 bp, Artificial
  CRISPR gRNA sequence
tctgctctgctctttgctat

SEQ ID NO: 668791 - DNA, 20 bp, Artificial
  CRISPR gRNA sequence
ctctgctctttgctatgtgc

SEQ ID NO: 668792 - DNA, 20 bp, Artificial
  CRISPR gRNA sequence
tgctctttgctatgtgccat

SEQ ID NO: 668793 - DNA, 20 bp, Artificial
  CRISPR gRNA sequence
ctctttgctatgtgccatta

SEQ ID NO: 668794 - DNA, 20 bp, Artificial
  CRISPR gRNA sequence
tttgctatgtgccattaacc

SEQ ID NO: 668795 - DNA, 20 bp, Artificial
  CRISPR gRNA sequence
tgctatgtgccattaaccta

SEQ ID NO: 668796 - DNA, 20 bp, Artificial
  CRISPR gRNA sequence
gctatgtgccattaacctaa

SEQ ID NO: 668797 - DNA, 20 bp, Artificial
  CRISPR gRNA sequence
ctatgtgccattaacctaaa

SEQ ID NO: 668798 - DNA, 20 bp, Artificial
  CRISPR gRNA sequence
tgtgccattaacctaaattt

SEQ ID NO: 668799 - DNA, 20 bp, Artificial
  CRISPR gRNA sequence
acctaaatttggtagagtgt

SEQ ID NO: 668800 - DNA, 20 bp, Artificial
  CRISPR gRNA sequence
aatttggtagagtgtggtgg

SEQ ID NO: 668801 - DNA, 20 bp, Artificial
  CRISPR gRNA sequence
ggtagagtgtggtggtggtg

SEQ ID NO: 668802 - DNA, 20 bp, Artificial
  CRISPR gRNA sequence
gtagagtgtggtggtggtgt

SEQ ID NO: 668803 - DNA, 20 bp, Artificial
  CRISPR gRNA sequence
ttagtatttgcttatgatta

SEQ ID NO: 668804 - DNA, 20 bp, Artificial
  CRISPR gRNA sequence
agtatttgcttatgattatt

SEQ ID NO: 668805 - DNA, 20 bp, Artificial
  CRISPR gRNA sequence
gtatttgcttatgattattt

SEQ ID NO: 668806 - DNA, 20 bp, Artificial
  CRISPR gRNA sequence
gcttatgattattttatgag

SEQ ID NO: 668807 - DNA, 20 bp, Artificial
  CRISPR gRNA sequence
cttatgattattttatgagt

SEQ ID NO: 668808 - DNA, 20 bp, Artificial
  CRISPR gRNA sequence
atgattattttatgagttct

SEQ ID NO: 668809 - DNA, 20 bp, Artificial
  CRISPR gRNA sequence
tgattattttatgagttctt

SEQ ID NO: 668810 - DNA, 20 bp, Artificial
  CRISPR gRNA sequence
ttttatgagttctttgataa

SEQ ID NO: 668811 - DNA, 20 bp, Artificial
  CRISPR gRNA sequence
tatgagttctttgataatat

SEQ ID NO: 668812 - DNA, 20 bp, Artificial
  CRISPR gRNA sequence
atgagttctttgataatatt

SEQ ID NO: 668813 - DNA, 20 bp, Artificial
  CRISPR gRNA sequence
tgagttctttgataatatta

SEQ ID NO: 668814 - DNA, 20 bp, Artificial
  CRISPR gRNA sequence
tttgataatattattcccag

SEQ ID NO: 668815 - DNA, 20 bp, Artificial
  CRISPR gRNA sequence
tgataatattattcccaggc

SEQ ID NO: 668816 - DNA, 20 bp, Artificial
  CRISPR gRNA sequence
gataatattattcccaggca

SEQ ID NO: 668817 - DNA, 20 bp, Artificial
  CRISPR gRNA sequence
ataatattattcccaggcag

SEQ ID NO: 668818 - DNA, 20 bp, Artificial
  CRISPR gRNA sequence
ttcccaggcagagaaaaatc

SEQ ID NO: 668819 - DNA, 20 bp, Artificial
  CRISPR gRNA sequence
ccaggcagagaaaaatcaaa

SEQ ID NO: 668820 - DNA, 20 bp, Artificial
  CRISPR gRNA sequence
ctttccatattctttagttt

SEQ ID NO: 668821 - DNA, 20 bp, Artificial
  CRISPR gRNA sequence
tttccatattctttagtttg

SEQ ID NO: 668822 - DNA, 20 bp, Artificial
  CRISPR gRNA sequence
tccatattctttagtttgaa

SEQ ID NO: 668823 - DNA, 20 bp, Artificial
  CRISPR gRNA sequence
ccatattctttagtttgaat

SEQ ID NO: 668824 - DNA, 20 bp, Artificial
  CRISPR gRNA sequence
catattctttagtttgaatg

SEQ ID NO: 668825 - DNA, 20 bp, Artificial
  CRISPR gRNA sequence
tttagtttgaatgtcagtgc

SEQ ID NO: 668826 - DNA, 20 bp, Artificial
  CRISPR gRNA sequence
tagtttgaatgtcagtgctt

SEQ ID NO: 668827 - DNA, 20 bp, Artificial
  CRISPR gRNA sequence
agtttgaatgtcagtgcttg

SEQ ID NO: 668828 - DNA, 20 bp, Artificial
  CRISPR gRNA sequence
gtttgaatgtcagtgcttgt

SEQ ID NO: 668829 - DNA, 20 bp, Artificial
  CRISPR gRNA sequence
gaatgtcagtgcttgtataa

SEQ ID NO: 668830 - DNA, 20 bp, Artificial
  CRISPR gRNA sequence
aatgtcagtgcttgtataat

SEQ ID NO: 668831 - DNA, 20 bp, Artificial
  CRISPR gRNA sequence
gtataatatcaagatagagg

SEQ ID NO: 668832 - DNA, 20 bp, Artificial
  CRISPR gRNA sequence
tataatatcaagatagaggt

SEQ ID NO: 668833 - DNA, 20 bp, Artificial
  CRISPR gRNA sequence
tatcttcatttctcacccaa

SEQ ID NO: 668834 - DNA, 20 bp, Artificial
  CRISPR gRNA sequence
atcttcatttctcacccaaa

SEQ ID NO: 668835 - DNA, 20 bp, Artificial
  CRISPR gRNA sequence
tcttcatttctcacccaaac

SEQ ID NO: 668836 - DNA, 20 bp, Artificial
  CRISPR gRNA sequence
catttctcacccaaacgagg

SEQ ID NO: 668837 - DNA, 20 bp, Artificial
  CRISPR gRNA sequence
atttctcacccaaacgagga

SEQ ID NO: 668838 - DNA, 20 bp, Artificial
  CRISPR gRNA sequence
ctcacccaaacgaggatggt

SEQ ID NO: 668839 - DNA, 20 bp, Artificial
  CRISPR gRNA sequence
tcacccaaacgaggatggtt

SEQ ID NO: 668840 - DNA, 20 bp, Artificial
  CRISPR gRNA sequence
acccaaacgaggatggttaa

SEQ ID NO: 668841 - DNA, 20 bp, Artificial
  CRISPR gRNA sequence
aaatacactgggtgtgttta

SEQ ID NO: 668842 - DNA, 20 bp, Artificial
  CRISPR gRNA sequence
ggtgtgtttaacataaacta

SEQ ID NO: 668843 - DNA, 20 bp, Artificial
  CRISPR gRNA sequence
aacataaactacttaatggt

SEQ ID NO: 668844 - DNA, 20 bp, Artificial
  CRISPR gRNA sequence
acataaactacttaatggtt

SEQ ID NO: 668845 - DNA, 20 bp, Artificial
  CRISPR gRNA sequence
cttaatggttattgtgtcag

SEQ ID NO: 668846 - DNA, 20 bp, Artificial
  CRISPR gRNA sequence
aatggttattgtgtcagtat

SEQ ID NO: 668847 - DNA, 20 bp, Artificial
  CRISPR gRNA sequence
atggttattgtgtcagtata

SEQ ID NO: 668848 - DNA, 20 bp, Artificial
  CRISPR gRNA sequence
ttgtgtcagtatatatcaat

SEQ ID NO: 668849 - DNA, 20 bp, Artificial
  CRISPR gRNA sequence
tgtcagtatatatcaattaa

SEQ ID NO: 668850 - DNA, 20 bp, Artificial
  CRISPR gRNA sequence
atgaaaaattaatcaaatgt

SEQ ID NO: 668851 - DNA, 20 bp, Artificial
  CRISPR gRNA sequence
atcaaatgtttcctttgagg

SEQ ID NO: 668852 - DNA, 20 bp, Artificial
  CRISPR gRNA sequence
cctttgaggattctagtttt

SEQ ID NO: 668853 - DNA, 20 bp, Artificial
  CRISPR gRNA sequence
ctttgaggattctagttttg

SEQ ID NO: 668854 - DNA, 20 bp, Artificial
  CRISPR gRNA sequence
tgaggattctagttttgtta

SEQ ID NO: 668855 - DNA, 20 bp, Artificial
  CRISPR gRNA sequence
gaggattctagttttgttaa

SEQ ID NO: 668856 - DNA, 20 bp, Artificial
  CRISPR gRNA sequence
aggattctagttttgttaaa

SEQ ID NO: 668857 - DNA, 20 bp, Artificial
  CRISPR gRNA sequence
tagttttgttaaaagaaaac

SEQ ID NO: 668858 - DNA, 20 bp, Artificial
  CRISPR gRNA sequence
gttttgttaaaagaaaactt

SEQ ID NO: 668859 - DNA, 20 bp, Artificial
  CRISPR gRNA sequence
tgttaaaagaaaacttctgt

SEQ ID NO: 668860 - DNA, 20 bp, Artificial
  CRISPR gRNA sequence
gttaaaagaaaacttctgtg

SEQ ID NO: 668861 - DNA, 20 bp, Artificial
  CRISPR gRNA sequence
ttaaaagaaaacttctgtgt

SEQ ID NO: 668862 - DNA, 20 bp, Artificial
  CRISPR gRNA sequence
aaagaaaacttctgtgtgac

SEQ ID NO: 668863 - DNA, 20 bp, Artificial
  CRISPR gRNA sequence
ctgtgtgacctcagaaaatt

SEQ ID NO: 668864 - DNA, 20 bp, Artificial
  CRISPR gRNA sequence
tgtgtgacctcagaaaatta

SEQ ID NO: 668865 - DNA, 20 bp, Artificial
  CRISPR gRNA sequence
tgtgacctcagaaaattaat

SEQ ID NO: 668866 - DNA, 20 bp, Artificial
  CRISPR gRNA sequence
agaaaattaatacttgtatt

SEQ ID NO: 668867 - DNA, 20 bp, Artificial
  CRISPR gRNA sequence
atacttgtattcagattctc

SEQ ID NO: 668868 - DNA, 20 bp, Artificial
  CRISPR gRNA sequence
gtattcagattctcaaatga

SEQ ID NO: 668869 - DNA, 20 bp, Artificial
  CRISPR gRNA sequence
tattcagattctcaaatgag

SEQ ID NO: 668870 - DNA, 20 bp, Artificial
  CRISPR gRNA sequence
agattctcaaatgagagttg

SEQ ID NO: 668871 - DNA, 20 bp, Artificial
  CRISPR gRNA sequence
tcaaatgagagttgataaat

SEQ ID NO: 668872 - DNA, 20 bp, Artificial
  CRISPR gRNA sequence
aaatgagagttgataaataa

SEQ ID NO: 668873 - DNA, 20 bp, Artificial
  CRISPR gRNA sequence
ataaataatatttatttagg

SEQ ID NO: 668874 - DNA, 20 bp, Artificial
  CRISPR gRNA sequence
atttaggtgacatttggagc

SEQ ID NO: 668875 - DNA, 20 bp, Artificial
  CRISPR gRNA sequence
tttaggtgacatttggagca

SEQ ID NO: 668876 - DNA, 20 bp, Artificial
  CRISPR gRNA sequence
aggtgacatttggagcaaac

SEQ ID NO: 668877 - DNA, 20 bp, Artificial
  CRISPR gRNA sequence
ggtgacatttggagcaaact

SEQ ID NO: 668878 - DNA, 20 bp, Artificial
  CRISPR gRNA sequence
ggagcaaactgtcactttaa

SEQ ID NO: 668879 - DNA, 20 bp, Artificial
  CRISPR gRNA sequence
gagcaaactgtcactttaaa

SEQ ID NO: 668880 - DNA, 20 bp, Artificial
  CRISPR gRNA sequence
tcactttaaaaaataaactt

SEQ ID NO: 668881 - DNA, 20 bp, Artificial
  CRISPR gRNA sequence
taaaaaataaacttctacta

SEQ ID NO: 668882 - DNA, 20 bp, Artificial
  CRISPR gRNA sequence
aaaaaataaacttctactaa

SEQ ID NO: 668883 - DNA, 20 bp, Artificial
  CRISPR gRNA sequence
aaaaataaacttctactaat

SEQ ID NO: 668884 - DNA, 20 bp, Artificial
  CRISPR gRNA sequence
ctactaatgacattatgaca

SEQ ID NO: 668885 - DNA, 20 bp, Artificial
  CRISPR gRNA sequence
tactaatgacattatgacaa

SEQ ID NO: 668886 - DNA, 20 bp, Artificial
  CRISPR gRNA sequence
ctaatgacattatgacaaca

SEQ ID NO: 668887 - DNA, 20 bp, Artificial
  CRISPR gRNA sequence
atgacattatgacaacatcc

SEQ ID NO: 668888 - DNA, 20 bp, Artificial
  CRISPR gRNA sequence
tgacaacatccacattgggg

SEQ ID NO: 668889 - DNA, 20 bp, Artificial
  CRISPR gRNA sequence
ggggaactcaaatataggat

SEQ ID NO: 668890 - DNA, 20 bp, Artificial
  CRISPR gRNA sequence
aaatataggataagatatat

SEQ ID NO: 668891 - DNA, 20 bp, Artificial
  CRISPR gRNA sequence
tttctactgagtataacttg

SEQ ID NO: 668892 - DNA, 20 bp, Artificial
  CRISPR gRNA sequence
ttctactgagtataacttga

SEQ ID NO: 668893 - DNA, 20 bp, Artificial
  CRISPR gRNA sequence
tctactgagtataacttgaa

SEQ ID NO: 668894 - DNA, 20 bp, Artificial
  CRISPR gRNA sequence
ctactgagtataacttgaaa

SEQ ID NO: 668895 - DNA, 20 bp, Artificial
  CRISPR gRNA sequence
tactgagtataacttgaaag

SEQ ID NO: 668896 - DNA, 20 bp, Artificial
  CRISPR gRNA sequence
ctgagtataacttgaaagta

SEQ ID NO: 668897 - DNA, 20 bp, Artificial
  CRISPR gRNA sequence
agtataacttgaaagtactt

SEQ ID NO: 668898 - DNA, 20 bp, Artificial
  CRISPR gRNA sequence
gaaagtacttggaatttgta

SEQ ID NO: 668899 - DNA, 20 bp, Artificial
  CRISPR gRNA sequence
aaagtacttggaatttgtat

SEQ ID NO: 668900 - DNA, 20 bp, Artificial
  CRISPR gRNA sequence
ggaatttgtatttatttctt

SEQ ID NO: 668901 - DNA, 20 bp, Artificial
  CRISPR gRNA sequence
gaatttgtatttatttcttg

SEQ ID NO: 668902 - DNA, 20 bp, Artificial
  CRISPR gRNA sequence
gtatttatttcttggttcat

SEQ ID NO: 668903 - DNA, 20 bp, Artificial
  CRISPR gRNA sequence
tatttatttcttggttcatt

SEQ ID NO: 668904 - DNA, 20 bp, Artificial
  CRISPR gRNA sequence
atttcttggttcattttaaa

SEQ ID NO: 668905 - DNA, 20 bp, Artificial
  CRISPR gRNA sequence
tttcttggttcattttaaat

SEQ ID NO: 668906 - DNA, 20 bp, Artificial
  CRISPR gRNA sequence
cttggttcattttaaatatt

SEQ ID NO: 668907 - DNA, 20 bp, Artificial
  CRISPR gRNA sequence
ttggttcattttaaatatta

SEQ ID NO: 668908 - DNA, 20 bp, Artificial
  CRISPR gRNA sequence
ggttcattttaaatattatg

SEQ ID NO: 668909 - DNA, 20 bp, Artificial
  CRISPR gRNA sequence
gttcattttaaatattatgg

SEQ ID NO: 668910 - DNA, 20 bp, Artificial
  CRISPR gRNA sequence
attttaaatattatggcaaa

SEQ ID NO: 668911 - DNA, 20 bp, Artificial
  CRISPR gRNA sequence
taaatattatggcaaaaacc

SEQ ID NO: 668912 - DNA, 20 bp, Artificial
  CRISPR gRNA sequence
aaatattatggcaaaaacca

SEQ ID NO: 668913 - DNA, 20 bp, Artificial
  CRISPR gRNA sequence
aatattatggcaaaaaccac

SEQ ID NO: 668914 - DNA, 20 bp, Artificial
  CRISPR gRNA sequence
tggcaaaaaccacagttact

SEQ ID NO: 668915 - DNA, 20 bp, Artificial
  CRISPR gRNA sequence
ctttggcatcaacctaatat

SEQ ID NO: 668916 - DNA, 20 bp, Artificial
  CRISPR gRNA sequence
tggcatcaacctaatatttc

SEQ ID NO: 668917 - DNA, 20 bp, Artificial
  CRISPR gRNA sequence
ggcatcaacctaatatttca

SEQ ID NO: 668918 - DNA, 20 bp, Artificial
  CRISPR gRNA sequence
gcatcaacctaatatttcag

SEQ ID NO: 668919 - DNA, 20 bp, Artificial
  CRISPR gRNA sequence
atatttcagctgatacccta

SEQ ID NO: 668920 - DNA, 20 bp, Artificial
  CRISPR gRNA sequence
cagctgataccctaatttga

SEQ ID NO: 668921 - DNA, 20 bp, Artificial
  CRISPR gRNA sequence
agctgataccctaatttgaa

SEQ ID NO: 668922 - DNA, 20 bp, Artificial
  CRISPR gRNA sequence
ataccctaatttgaagtatt

SEQ ID NO: 668923 - DNA, 20 bp, Artificial
  CRISPR gRNA sequence
atttgaagtattgcaatggc

SEQ ID NO: 668924 - DNA, 20 bp, Artificial
  CRISPR gRNA sequence
gaagtattgcaatggccagt

SEQ ID NO: 668925 - DNA, 20 bp, Artificial
  CRISPR gRNA sequence
aagtattgcaatggccagtt

SEQ ID NO: 668926 - DNA, 20 bp, Artificial
  CRISPR gRNA sequence
caatggccagtttgctaatg

SEQ ID NO: 668927 - DNA, 20 bp, Artificial
  CRISPR gRNA sequence
gctaatgaacataaacacat

SEQ ID NO: 668928 - DNA, 20 bp, Artificial
  CRISPR gRNA sequence
ctaatgaacataaacacata

SEQ ID NO: 668929 - DNA, 20 bp, Artificial
  CRISPR gRNA sequence
atgaacataaacacatacag

SEQ ID NO: 668930 - DNA, 20 bp, Artificial
  CRISPR gRNA sequence
tttctctaaagcagcgatta

SEQ ID NO: 668931 - DNA, 20 bp, Artificial
  CRISPR gRNA sequence
ctctaaagcagcgattagct

SEQ ID NO: 668932 - DNA, 20 bp, Artificial
  CRISPR gRNA sequence
tctaaagcagcgattagctt

SEQ ID NO: 668933 - DNA, 20 bp, Artificial
  CRISPR gRNA sequence
taaagcagcgattagctttt

SEQ ID NO: 668934 - DNA, 20 bp, Artificial
  CRISPR gRNA sequence
aagcagcgattagcttttag

SEQ ID NO: 668935 - DNA, 20 bp, Artificial
  CRISPR gRNA sequence
gcttttagaaaacttttccc

SEQ ID NO: 668936 - DNA, 20 bp, Artificial
  CRISPR gRNA sequence
ttagaaaacttttcccagtg

SEQ ID NO: 668937 - DNA, 20 bp, Artificial
  CRISPR gRNA sequence
tagaaaacttttcccagtga

SEQ ID NO: 668938 - DNA, 20 bp, Artificial
  CRISPR gRNA sequence
agaaaacttttcccagtgag

SEQ ID NO: 668939 - DNA, 20 bp, Artificial
  CRISPR gRNA sequence
gaaaacttttcccagtgaga

SEQ ID NO: 668940 - DNA, 20 bp, Artificial
  CRISPR gRNA sequence
ttcccagtgagatttactat

SEQ ID NO: 668941 - DNA, 20 bp, Artificial
  CRISPR gRNA sequence
tcccagtgagatttactatt

SEQ ID NO: 668942 - DNA, 20 bp, Artificial
  CRISPR gRNA sequence
cccagtgagatttactattt

SEQ ID NO: 668943 - DNA, 20 bp, Artificial
  CRISPR gRNA sequence
ccagtgagatttactatttc

SEQ ID NO: 668944 - DNA, 20 bp, Artificial
  CRISPR gRNA sequence
actatttcatatttaatgtt

SEQ ID NO: 668945 - DNA, 20 bp, Artificial
  CRISPR gRNA sequence
ctatttcatatttaatgtta

SEQ ID NO: 668946 - DNA, 20 bp, Artificial
  CRISPR gRNA sequence
tttcatatttaatgttaata

SEQ ID NO: 668947 - DNA, 20 bp, Artificial
  CRISPR gRNA sequence
catatttaatgttaataaat

SEQ ID NO: 668948 - DNA, 20 bp, Artificial
  CRISPR gRNA sequence
atatttaatgttaataaatg

SEQ ID NO: 668949 - DNA, 20 bp, Artificial
  CRISPR gRNA sequence
aatgttaataaatgggaatg

SEQ ID NO: 668950 - DNA, 20 bp, Artificial
  CRISPR gRNA sequence
atgttaataaatgggaatgg

SEQ ID NO: 668951 - DNA, 20 bp, Artificial
  CRISPR gRNA sequence
ataaatgggaatgggacatg

SEQ ID NO: 668952 - DNA, 20 bp, Artificial
  CRISPR gRNA sequence
aaataacgataaggccatat

SEQ ID NO: 668953 - DNA, 20 bp, Artificial
  CRISPR gRNA sequence
agccagcagaacagaacaaa

SEQ ID NO: 668954 - DNA, 20 bp, Artificial
  CRISPR gRNA sequence
taactgaatgaaataaggta

SEQ ID NO: 668955 - DNA, 20 bp, Artificial
  CRISPR gRNA sequence
aactgaatgaaataaggtag

SEQ ID NO: 668956 - DNA, 20 bp, Artificial
  CRISPR gRNA sequence
actgaatgaaataaggtagt

SEQ ID NO: 668957 - DNA, 20 bp, Artificial
  CRISPR gRNA sequence
aatgaaataaggtagtatag

SEQ ID NO: 668958 - DNA, 20 bp, Artificial
  CRISPR gRNA sequence
cagcatttctcttttattga

SEQ ID NO: 668959 - DNA, 20 bp, Artificial
  CRISPR gRNA sequence
agcatttctcttttattgag

SEQ ID NO: 668960 - DNA, 20 bp, Artificial
  CRISPR gRNA sequence
ctcttttattgagactgtct

SEQ ID NO: 668961 - DNA, 20 bp, Artificial
  CRISPR gRNA sequence
tcttttattgagactgtctc

SEQ ID NO: 668962 - DNA, 20 bp, Artificial
  CRISPR gRNA sequence
ttttattgagactgtctcag

SEQ ID NO: 668963 - DNA, 20 bp, Artificial
  CRISPR gRNA sequence
ttattgagactgtctcagta

SEQ ID NO: 668964 - DNA, 20 bp, Artificial
  CRISPR gRNA sequence
tattgagactgtctcagtat

SEQ ID NO: 668965 - DNA, 20 bp, Artificial
  CRISPR gRNA sequence
attgagactgtctcagtatc

SEQ ID NO: 668966 - DNA, 20 bp, Artificial
  CRISPR gRNA sequence
ttgagactgtctcagtatct

SEQ ID NO: 668967 - DNA, 20 bp, Artificial
  CRISPR gRNA sequence
agactgtctcagtatctgta

SEQ ID NO: 668968 - DNA, 20 bp, Artificial
  CRISPR gRNA sequence
tctcagtatctgtatagtgt

SEQ ID NO: 668969 - DNA, 20 bp, Artificial
  CRISPR gRNA sequence
agtatctgtatagtgtatag

SEQ ID NO: 668970 - DNA, 20 bp, Artificial
  CRISPR gRNA sequence
tatagtgtatagccaaggaa

SEQ ID NO: 668971 - DNA, 20 bp, Artificial
  CRISPR gRNA sequence
gaaagccactttagaattgt

SEQ ID NO: 668972 - DNA, 20 bp, Artificial
  CRISPR gRNA sequence
aaagccactttagaattgtc

SEQ ID NO: 668973 - DNA, 20 bp, Artificial
  CRISPR gRNA sequence
tagaattgtcttctagaaaa

SEQ ID NO: 668974 - DNA, 20 bp, Artificial
  CRISPR gRNA sequence
agaattgtcttctagaaaag

SEQ ID NO: 668975 - DNA, 20 bp, Artificial
  CRISPR gRNA sequence
gaattgtcttctagaaaagt

SEQ ID NO: 668976 - DNA, 20 bp, Artificial
  CRISPR gRNA sequence
tcttctagaaaagtacacac

SEQ ID NO: 668977 - DNA, 20 bp, Artificial
  CRISPR gRNA sequence
ctagaaaagtacacacatag

SEQ ID NO: 668978 - DNA, 20 bp, Artificial
  CRISPR gRNA sequence
tagaaaagtacacacatagt

SEQ ID NO: 668979 - DNA, 20 bp, Artificial
  CRISPR gRNA sequence
gaaaagtacacacatagttg

SEQ ID NO: 668980 - DNA, 20 bp, Artificial
  CRISPR gRNA sequence
aaatctgaaataactggaag

SEQ ID NO: 668981 - DNA, 20 bp, Artificial
  CRISPR gRNA sequence
aaataactggaagttagttt

SEQ ID NO: 668982 - DNA, 20 bp, Artificial
  CRISPR gRNA sequence
gaagttagttttaagaaaac

SEQ ID NO: 668983 - DNA, 20 bp, Artificial
  CRISPR gRNA sequence
gttttaagaaaacaaaccgc

SEQ ID NO: 668984 - DNA, 20 bp, Artificial
  CRISPR gRNA sequence
taagaaaacaaaccgccttt

SEQ ID NO: 668985 - DNA, 20 bp, Artificial
  CRISPR gRNA sequence
aagaaaacaaaccgcctttt

SEQ ID NO: 668986 - DNA, 20 bp, Artificial
  CRISPR gRNA sequence
agaaaacaaaccgccttttc

SEQ ID NO: 668987 - DNA, 20 bp, Artificial
  CRISPR gRNA sequence
ttcaggatccatgcttgtct

SEQ ID NO: 668988 - DNA, 20 bp, Artificial
  CRISPR gRNA sequence
tcaggatccatgcttgtctg

SEQ ID NO: 668989 - DNA, 20 bp, Artificial
  CRISPR gRNA sequence
caggatccatgcttgtctgt

SEQ ID NO: 668990 - DNA, 20 bp, Artificial
  CRISPR gRNA sequence
aggatccatgcttgtctgtc

SEQ ID NO: 668991 - DNA, 20 bp, Artificial
  CRISPR gRNA sequence
gtctgtctagcctgaataat

SEQ ID NO: 668992 - DNA, 20 bp, Artificial
  CRISPR gRNA sequence
tctgtctagcctgaataatt

SEQ ID NO: 668993 - DNA, 20 bp, Artificial
  CRISPR gRNA sequence
tctagcctgaataatttagg

SEQ ID NO: 668994 - DNA, 20 bp, Artificial
  CRISPR gRNA sequence
gcctgaataatttaggctta

SEQ ID NO: 668995 - DNA, 20 bp, Artificial
  CRISPR gRNA sequence
aataatttaggcttacgttt

SEQ ID NO: 668996 - DNA, 20 bp, Artificial
  CRISPR gRNA sequence
aggcttacgtttaataacca

SEQ ID NO: 668997 - DNA, 20 bp, Artificial
  CRISPR gRNA sequence
ggcttacgtttaataaccat

SEQ ID NO: 668998 - DNA, 20 bp, Artificial
  CRISPR gRNA sequence
acgtttaataaccatttaaa

SEQ ID NO: 668999 - DNA, 20 bp, Artificial
  CRISPR gRNA sequence
cgtttaataaccatttaaat

SEQ ID NO: 669000 - DNA, 20 bp, Artificial
  CRISPR gRNA sequence
aataaccatttaaatacaat

SEQ ID NO: 669001 - DNA, 20 bp, Artificial
  CRISPR gRNA sequence
ataaccatttaaatacaatt

SEQ ID NO: 669002 - DNA, 20 bp, Artificial
  CRISPR gRNA sequence
aaatacaattgtaataaatt

SEQ ID NO: 669003 - DNA, 20 bp, Artificial
  CRISPR gRNA sequence
aatacaattgtaataaattc

SEQ ID NO: 669004 - DNA, 20 bp, Artificial
  CRISPR gRNA sequence
taataaattcatcatcatat

SEQ ID NO: 669005 - DNA, 20 bp, Artificial
  CRISPR gRNA sequence
atcatcatattaataaggtt

SEQ ID NO: 669006 - DNA, 20 bp, Artificial
  CRISPR gRNA sequence
ataaggtttgatgaatcaaa

SEQ ID NO: 669007 - DNA, 20 bp, Artificial
  CRISPR gRNA sequence
gatgaatcaaatttttatag

SEQ ID NO: 669008 - DNA, 20 bp, Artificial
  CRISPR gRNA sequence
atgaatcaaatttttataga

SEQ ID NO: 669009 - DNA, 20 bp, Artificial
  CRISPR gRNA sequence
ttatagaatgtttaagagaa

SEQ ID NO: 669010 - DNA, 20 bp, Artificial
  CRISPR gRNA sequence
tatagaatgtttaagagaag

SEQ ID NO: 669011 - DNA, 20 bp, Artificial
  CRISPR gRNA sequence
atagaatgtttaagagaagg

SEQ ID NO: 669012 - DNA, 20 bp, Artificial
  CRISPR gRNA sequence
tagaatgtttaagagaaggt

SEQ ID NO: 669013 - DNA, 20 bp, Artificial
  CRISPR gRNA sequence
aagagaaggttttttcctaa

SEQ ID NO: 669014 - DNA, 20 bp, Artificial
  CRISPR gRNA sequence
agagaaggttttttcctaaa

SEQ ID NO: 669015 - DNA, 20 bp, Artificial
  CRISPR gRNA sequence
tttcctaaatgaaataattg

SEQ ID NO: 669016 - DNA, 20 bp, Artificial
  CRISPR gRNA sequence
ttcctaaatgaaataattgc

SEQ ID NO: 669017 - DNA, 20 bp, Artificial
  CRISPR gRNA sequence
tcctaaatgaaataattgca

SEQ ID NO: 669018 - DNA, 20 bp, Artificial
  CRISPR gRNA sequence
cctaaatgaaataattgcag

SEQ ID NO: 669019 - DNA, 20 bp, Artificial
  CRISPR gRNA sequence
ctaaatgaaataattgcaga

SEQ ID NO: 669020 - DNA, 20 bp, Artificial
  CRISPR gRNA sequence
aatgaaataattgcagaaaa

SEQ ID NO: 669021 - DNA, 20 bp, Artificial
  CRISPR gRNA sequence
cagaaaatttggcattctat

SEQ ID NO: 669022 - DNA, 20 bp, Artificial
  CRISPR gRNA sequence
ggcattctattactgtagca

SEQ ID NO: 669023 - DNA, 20 bp, Artificial
  CRISPR gRNA sequence
gcattctattactgtagcaa

SEQ ID NO: 669024 - DNA, 20 bp, Artificial
  CRISPR gRNA sequence
tattactgtagcaaaacttg

SEQ ID NO: 669025 - DNA, 20 bp, Artificial
  CRISPR gRNA sequence
ttactgtagcaaaacttggc

SEQ ID NO: 669026 - DNA, 20 bp, Artificial
  CRISPR gRNA sequence
ctgtagcaaaacttggcaaa

SEQ ID NO: 669027 - DNA, 20 bp, Artificial
  CRISPR gRNA sequence
tagcaaaacttggcaaagac

SEQ ID NO: 669028 - DNA, 20 bp, Artificial
  CRISPR gRNA sequence
ggcaaagaccaaagtacaga

SEQ ID NO: 669029 - DNA, 20 bp, Artificial
  CRISPR gRNA sequence
gcaaagaccaaagtacagaa

SEQ ID NO: 669030 - DNA, 20 bp, Artificial
  CRISPR gRNA sequence
gattcttagtgaaatttgaa

SEQ ID NO: 669031 - DNA, 20 bp, Artificial
  CRISPR gRNA sequence
ttagtgaaatttgaatcaca

SEQ ID NO: 669032 - DNA, 20 bp, Artificial
  CRISPR gRNA sequence
agtgaaatttgaatcacagc

SEQ ID NO: 669033 - DNA, 20 bp, Artificial
  CRISPR gRNA sequence
gtgaaatttgaatcacagct

SEQ ID NO: 669034 - DNA, 20 bp, Artificial
  CRISPR gRNA sequence
gaatcacagcttctatgtgg

SEQ ID NO: 669035 - DNA, 20 bp, Artificial
  CRISPR gRNA sequence
aatcacagcttctatgtggt

SEQ ID NO: 669036 - DNA, 20 bp, Artificial
  CRISPR gRNA sequence
ctatgtggtaatgcaatgtc

SEQ ID NO: 669037 - DNA, 20 bp, Artificial
  CRISPR gRNA sequence
tatgtggtaatgcaatgtca

SEQ ID NO: 669038 - DNA, 20 bp, Artificial
  CRISPR gRNA sequence
tgtggtaatgcaatgtcagt

SEQ ID NO: 669039 - DNA, 20 bp, Artificial
  CRISPR gRNA sequence
ctaaaaaatatgtatgtaag

SEQ ID NO: 669040 - DNA, 20 bp, Artificial
  CRISPR gRNA sequence
taaaaaatatgtatgtaagc

SEQ ID NO: 669041 - DNA, 20 bp, Artificial
  CRISPR gRNA sequence
aaaaatatgtatgtaagcaa

SEQ ID NO: 669042 - DNA, 20 bp, Artificial
  CRISPR gRNA sequence
attggatttaagagttttgt

SEQ ID NO: 669043 - DNA, 20 bp, Artificial
  CRISPR gRNA sequence
gatttaagagttttgttagg

SEQ ID NO: 669044 - DNA, 20 bp, Artificial
  CRISPR gRNA sequence
aagagttttgttaggctttt

SEQ ID NO: 669045 - DNA, 20 bp, Artificial
  CRISPR gRNA sequence
agagttttgttaggcttttg

SEQ ID NO: 669046 - DNA, 20 bp, Artificial
  CRISPR gRNA sequence
tgttaggcttttgttattct

SEQ ID NO: 669047 - DNA, 20 bp, Artificial
  CRISPR gRNA sequence
gttaggcttttgttattcta

SEQ ID NO: 669048 - DNA, 20 bp, Artificial
  CRISPR gRNA sequence
ttaggcttttgttattctaa

SEQ ID NO: 669049 - DNA, 20 bp, Artificial
  CRISPR gRNA sequence
ggcttttgttattctaacta

SEQ ID NO: 669050 - DNA, 20 bp, Artificial
  CRISPR gRNA sequence
ttgttattctaactaatgtt

SEQ ID NO: 669051 - DNA, 20 bp, Artificial
  CRISPR gRNA sequence
tgttattctaactaatgttc

SEQ ID NO: 669052 - DNA, 20 bp, Artificial
  CRISPR gRNA sequence
gttattctaactaatgttcc

SEQ ID NO: 669053 - DNA, 20 bp, Artificial
  CRISPR gRNA sequence
ttattctaactaatgttcca

SEQ ID NO: 669054 - DNA, 20 bp, Artificial
  CRISPR gRNA sequence
ttctaactaatgttccatct

SEQ ID NO: 669055 - DNA, 20 bp, Artificial
  CRISPR gRNA sequence
taactaatgttccatctgga

SEQ ID NO: 669056 - DNA, 20 bp, Artificial
  CRISPR gRNA sequence
actaatgttccatctggatt

SEQ ID NO: 669057 - DNA, 20 bp, Artificial
  CRISPR gRNA sequence
atgttccatctggattttaa

SEQ ID NO: 669058 - DNA, 20 bp, Artificial
  CRISPR gRNA sequence
catctggattttaatatttg

SEQ ID NO: 669059 - DNA, 20 bp, Artificial
  CRISPR gRNA sequence
gattttaatatttgacataa

SEQ ID NO: 669060 - DNA, 20 bp, Artificial
  CRISPR gRNA sequence
taatatttgacataaatatg

SEQ ID NO: 669061 - DNA, 20 bp, Artificial
  CRISPR gRNA sequence
aatatttgacataaatatgt

SEQ ID NO: 669062 - DNA, 20 bp, Artificial
  CRISPR gRNA sequence
atatttgacataaatatgta

SEQ ID NO: 669063 - DNA, 20 bp, Artificial
  CRISPR gRNA sequence
gacataaatatgtacagtca

SEQ ID NO: 669064 - DNA, 20 bp, Artificial
  CRISPR gRNA sequence
acataaatatgtacagtcat

SEQ ID NO: 669065 - DNA, 20 bp, Artificial
  CRISPR gRNA sequence
ataacttttcaatgatagac

SEQ ID NO: 669066 - DNA, 20 bp, Artificial
  CRISPR gRNA sequence
ttcaatgatagaccacatat

SEQ ID NO: 669067 - DNA, 20 bp, Artificial
  CRISPR gRNA sequence
tcaatgatagaccacatata

SEQ ID NO: 669068 - DNA, 20 bp, Artificial
  CRISPR gRNA sequence
caatgatagaccacatatac

SEQ ID NO: 669069 - DNA, 20 bp, Artificial
  CRISPR gRNA sequence
aatgatagaccacatataca

SEQ ID NO: 669070 - DNA, 20 bp, Artificial
  CRISPR gRNA sequence
taaatagggtatttttaaga

SEQ ID NO: 669071 - DNA, 20 bp, Artificial
  CRISPR gRNA sequence
ttaagatacattttctgtgt

SEQ ID NO: 669072 - DNA, 20 bp, Artificial
  CRISPR gRNA sequence
taagatacattttctgtgta

SEQ ID NO: 669073 - DNA, 20 bp, Artificial
  CRISPR gRNA sequence
aagatacattttctgtgtat

SEQ ID NO: 669074 - DNA, 20 bp, Artificial
  CRISPR gRNA sequence
agatacattttctgtgtata

SEQ ID NO: 669075 - DNA, 20 bp, Artificial
  CRISPR gRNA sequence
tctgtgtatatgtagatacc

SEQ ID NO: 669076 - DNA, 20 bp, Artificial
  CRISPR gRNA sequence
ctgtgtatatgtagatacca

SEQ ID NO: 669077 - DNA, 20 bp, Artificial
  CRISPR gRNA sequence
tgtgtatatgtagataccat

SEQ ID NO: 669078 - DNA, 20 bp, Artificial
  CRISPR gRNA sequence
tgtatatgtagataccattg

SEQ ID NO: 669079 - DNA, 20 bp, Artificial
  CRISPR gRNA sequence
ggttacaattgcctacgtat

SEQ ID NO: 669080 - DNA, 20 bp, Artificial
  CRISPR gRNA sequence
caattgcctacgtattcagt

SEQ ID NO: 669081 - DNA, 20 bp, Artificial
  CRISPR gRNA sequence
cctacgtattcagtacagta

SEQ ID NO: 669082 - DNA, 20 bp, Artificial
  CRISPR gRNA sequence
cgtattcagtacagtaacat

SEQ ID NO: 669083 - DNA, 20 bp, Artificial
  CRISPR gRNA sequence
agtacagtaacatgctgtgc

SEQ ID NO: 669084 - DNA, 20 bp, Artificial
  CRISPR gRNA sequence
tgcaggtttgtagcttagga

SEQ ID NO: 669085 - DNA, 20 bp, Artificial
  CRISPR gRNA sequence
gtagcttaggaacaacaggc

SEQ ID NO: 669086 - DNA, 20 bp, Artificial
  CRISPR gRNA sequence
tagcttaggaacaacaggca

SEQ ID NO: 669087 - DNA, 20 bp, Artificial
  CRISPR gRNA sequence
aggaacaacaggcaatatat

SEQ ID NO: 669088 - DNA, 20 bp, Artificial
  CRISPR gRNA sequence
ggaacaacaggcaatatata

SEQ ID NO: 669089 - DNA, 20 bp, Artificial
  CRISPR gRNA sequence
ggtatgaagtaggctatcct

SEQ ID NO: 669090 - DNA, 20 bp, Artificial
  CRISPR gRNA sequence
tcctatctagatttgtgatg

SEQ ID NO: 669091 - DNA, 20 bp, Artificial
  CRISPR gRNA sequence
tctagatttgtgatgtacac

SEQ ID NO: 669092 - DNA, 20 bp, Artificial
  CRISPR gRNA sequence
gatttgtgatgtacacttga

SEQ ID NO: 669093 - DNA, 20 bp, Artificial
  CRISPR gRNA sequence
gtgatgtacacttgatagtg

SEQ ID NO: 669094 - DNA, 20 bp, Artificial
  CRISPR gRNA sequence
tgatgtacacttgatagtgt

SEQ ID NO: 669095 - DNA, 20 bp, Artificial
  CRISPR gRNA sequence
gatagtgttcacagctaagg

SEQ ID NO: 669096 - DNA, 20 bp, Artificial
  CRISPR gRNA sequence
atagtgttcacagctaagga

SEQ ID NO: 669097 - DNA, 20 bp, Artificial
  CRISPR gRNA sequence
acagctaaggacacatttct

SEQ ID NO: 669098 - DNA, 20 bp, Artificial
  CRISPR gRNA sequence
aggacacatttctcagagca

SEQ ID NO: 669099 - DNA, 20 bp, Artificial
  CRISPR gRNA sequence
ctcagagcacattcctgtag

SEQ ID NO: 669100 - DNA, 20 bp, Artificial
  CRISPR gRNA sequence
tcagagcacattcctgtagt

SEQ ID NO: 669101 - DNA, 20 bp, Artificial
  CRISPR gRNA sequence
agagcacattcctgtagtta

SEQ ID NO: 669102 - DNA, 20 bp, Artificial
  CRISPR gRNA sequence
ctgtagttaggtgatagttg

SEQ ID NO: 669103 - DNA, 20 bp, Artificial
  CRISPR gRNA sequence
tagttaggtgatagttgatt

SEQ ID NO: 669104 - DNA, 20 bp, Artificial
  CRISPR gRNA sequence
ggtgatagttgattttatgt

SEQ ID NO: 669105 - DNA, 20 bp, Artificial
  CRISPR gRNA sequence
attttatgtaatagttataa

SEQ ID NO: 669106 - DNA, 20 bp, Artificial
  CRISPR gRNA sequence
tatgtaatagttataaacat

SEQ ID NO: 669107 - DNA, 20 bp, Artificial
  CRISPR gRNA sequence
atgtaatagttataaacatg

SEQ ID NO: 669108 - DNA, 20 bp, Artificial
  CRISPR gRNA sequence
tgtaatagttataaacatgt

SEQ ID NO: 669109 - DNA, 20 bp, Artificial
  CRISPR gRNA sequence
taaacatgtcagaataatat

SEQ ID NO: 669110 - DNA, 20 bp, Artificial
  CRISPR gRNA sequence
tccttgacttagttttatat

SEQ ID NO: 669111 - DNA, 20 bp, Artificial
  CRISPR gRNA sequence
ccttgacttagttttatatg

SEQ ID NO: 669112 - DNA, 20 bp, Artificial
  CRISPR gRNA sequence
cttgacttagttttatatgg

SEQ ID NO: 669113 - DNA, 20 bp, Artificial
  CRISPR gRNA sequence
gacttagttttatatggggt

SEQ ID NO: 669114 - DNA, 20 bp, Artificial
  CRISPR gRNA sequence
acttagttttatatggggtt

SEQ ID NO: 669115 - DNA, 20 bp, Artificial
  CRISPR gRNA sequence
agttttatatggggttaaaa

SEQ ID NO: 669116 - DNA, 20 bp, Artificial
  CRISPR gRNA sequence
gttttatatggggttaaaaa

SEQ ID NO: 669117 - DNA, 20 bp, Artificial
  CRISPR gRNA sequence
tatatggggttaaaaagtaa

SEQ ID NO: 669118 - DNA, 20 bp, Artificial
  CRISPR gRNA sequence
atatggggttaaaaagtaaa

SEQ ID NO: 669119 - DNA, 20 bp, Artificial
  CRISPR gRNA sequence
tatggggttaaaaagtaaag

SEQ ID NO: 669120 - DNA, 20 bp, Artificial
  CRISPR gRNA sequence
aaaagtaaagggcaaaatac

SEQ ID NO: 669121 - DNA, 20 bp, Artificial
  CRISPR gRNA sequence
ctactctgttcatgttttta

SEQ ID NO: 669122 - DNA, 20 bp, Artificial
  CRISPR gRNA sequence
ctctgttcatgtttttagtt

SEQ ID NO: 669123 - DNA, 20 bp, Artificial
  CRISPR gRNA sequence
tgttcatgtttttagttaga

SEQ ID NO: 669124 - DNA, 20 bp, Artificial
  CRISPR gRNA sequence
ttcatgtttttagttagaga

SEQ ID NO: 669125 - DNA, 20 bp, Artificial
  CRISPR gRNA sequence
atgtttttagttagagatgg

SEQ ID NO: 669126 - DNA, 20 bp, Artificial
  CRISPR gRNA sequence
ttagttagagatggatgtgt

SEQ ID NO: 669127 - DNA, 20 bp, Artificial
  CRISPR gRNA sequence
tagttagagatggatgtgtc

SEQ ID NO: 669128 - DNA, 20 bp, Artificial
  CRISPR gRNA sequence
agttagagatggatgtgtct

SEQ ID NO: 669129 - DNA, 20 bp, Artificial
  CRISPR gRNA sequence
gttagagatggatgtgtctc

SEQ ID NO: 669130 - DNA, 20 bp, Artificial
  CRISPR gRNA sequence
gagatggatgtgtctcttca

SEQ ID NO: 669131 - DNA, 20 bp, Artificial
  CRISPR gRNA sequence
ttcaaagttttttcttttca

SEQ ID NO: 669132 - DNA, 20 bp, Artificial
  CRISPR gRNA sequence
caaagttttttcttttcaat

SEQ ID NO: 669133 - DNA, 20 bp, Artificial
  CRISPR gRNA sequence
aaagttttttcttttcaatc

SEQ ID NO: 669134 - DNA, 20 bp, Artificial
  CRISPR gRNA sequence
tttcttttcaatctttttca

SEQ ID NO: 669135 - DNA, 20 bp, Artificial
  CRISPR gRNA sequence
ttcttttcaatctttttcat

SEQ ID NO: 669136 - DNA, 20 bp, Artificial
  CRISPR gRNA sequence
tcttttcaatctttttcatt

SEQ ID NO: 669137 - DNA, 20 bp, Artificial
  CRISPR gRNA sequence
cttttcaatctttttcattt

SEQ ID NO: 669138 - DNA, 20 bp, Artificial
  CRISPR gRNA sequence
ttttcaatctttttcatttg

SEQ ID NO: 669139 - DNA, 20 bp, Artificial
  CRISPR gRNA sequence
ttcaatctttttcatttgta

SEQ ID NO: 669140 - DNA, 20 bp, Artificial
  CRISPR gRNA sequence
tcaatctttttcatttgtat

SEQ ID NO: 669141 - DNA, 20 bp, Artificial
  CRISPR gRNA sequence
caatctttttcatttgtatg

SEQ ID NO: 669142 - DNA, 20 bp, Artificial
  CRISPR gRNA sequence
aatctttttcatttgtatga

SEQ ID NO: 669143 - DNA, 20 bp, Artificial
  CRISPR gRNA sequence
tttcatttgtatgatattta

SEQ ID NO: 669144 - DNA, 20 bp, Artificial
  CRISPR gRNA sequence
ttcatttgtatgatatttaa

SEQ ID NO: 669145 - DNA, 20 bp, Artificial
  CRISPR gRNA sequence
tcatttgtatgatatttaaa

SEQ ID NO: 669146 - DNA, 20 bp, Artificial
  CRISPR gRNA sequence
catttgtatgatatttaaat

SEQ ID NO: 669147 - DNA, 20 bp, Artificial
  CRISPR gRNA sequence
atttgtatgatatttaaatc

SEQ ID NO: 669148 - DNA, 20 bp, Artificial
  CRISPR gRNA sequence
gtatgatatttaaatcagtg

SEQ ID NO: 669149 - DNA, 20 bp, Artificial
  CRISPR gRNA sequence
tatgatatttaaatcagtgc

SEQ ID NO: 669150 - DNA, 20 bp, Artificial
  CRISPR gRNA sequence
aaatcagtgctctggatatt

SEQ ID NO: 669151 - DNA, 20 bp, Artificial
  CRISPR gRNA sequence
aatcagtgctctggatattt

SEQ ID NO: 669152 - DNA, 20 bp, Artificial
  CRISPR gRNA sequence
tggatatttgcaacaaaata

SEQ ID NO: 669153 - DNA, 20 bp, Artificial
  CRISPR gRNA sequence
gatatttgcaacaaaataat

SEQ ID NO: 669154 - DNA, 20 bp, Artificial
  CRISPR gRNA sequence
gcaacaaaataatgaatatt

SEQ ID NO: 669155 - DNA, 20 bp, Artificial
  CRISPR gRNA sequence
caacaaaataatgaatattg

SEQ ID NO: 669156 - DNA, 20 bp, Artificial
  CRISPR gRNA sequence
tcactttctcagtttgagag

SEQ ID NO: 669157 - DNA, 20 bp, Artificial
  CRISPR gRNA sequence
tctcagtttgagaggatagt

SEQ ID NO: 669158 - DNA, 20 bp, Artificial
  CRISPR gRNA sequence
ctcagtttgagaggatagta

SEQ ID NO: 669159 - DNA, 20 bp, Artificial
  CRISPR gRNA sequence
tcagtttgagaggatagtaa

SEQ ID NO: 669160 - DNA, 20 bp, Artificial
  CRISPR gRNA sequence
agtttgagaggatagtaaaa

SEQ ID NO: 669161 - DNA, 20 bp, Artificial
  CRISPR gRNA sequence
gagaggatagtaaaatacat

SEQ ID NO: 669162 - DNA, 20 bp, Artificial
  CRISPR gRNA sequence
agaggatagtaaaatacatt

SEQ ID NO: 669163 - DNA, 20 bp, Artificial
  CRISPR gRNA sequence
aagggaccagggaaatatga

SEQ ID NO: 669164 - DNA, 20 bp, Artificial
  CRISPR gRNA sequence
taggagctgggtcaaatagg

SEQ ID NO: 669165 - DNA, 20 bp, Artificial
  CRISPR gRNA sequence
ggtcaaataggtacaagttt

SEQ ID NO: 669166 - DNA, 20 bp, Artificial
  CRISPR gRNA sequence
ctggatcccagggattgtga

SEQ ID NO: 669167 - DNA, 20 bp, Artificial
  CRISPR gRNA sequence
tggatcccagggattgtgaa

SEQ ID NO: 669168 - DNA, 20 bp, Artificial
  CRISPR gRNA sequence
gatcccagggattgtgaaat

SEQ ID NO: 669169 - DNA, 20 bp, Artificial
  CRISPR gRNA sequence
tgaaatggaaatttatcttt

SEQ ID NO: 669170 - DNA, 20 bp, Artificial
  CRISPR gRNA sequence
atctttttctacttctggat

SEQ ID NO: 669171 - DNA, 20 bp, Artificial
  CRISPR gRNA sequence
tctttttctacttctggatg

SEQ ID NO: 669172 - DNA, 20 bp, Artificial
  CRISPR gRNA sequence
tttctacttctggatgttac

SEQ ID NO: 669173 - DNA, 20 bp, Artificial
  CRISPR gRNA sequence
ttctacttctggatgttact

SEQ ID NO: 669174 - DNA, 20 bp, Artificial
  CRISPR gRNA sequence
tctacttctggatgttactt

SEQ ID NO: 669175 - DNA, 20 bp, Artificial
  CRISPR gRNA sequence
ctacttctggatgttacttt

SEQ ID NO: 669176 - DNA, 20 bp, Artificial
  CRISPR gRNA sequence
tacttctggatgttacttta

SEQ ID NO: 669177 - DNA, 20 bp, Artificial
  CRISPR gRNA sequence
cttctggatgttactttaga

SEQ ID NO: 669178 - DNA, 20 bp, Artificial
  CRISPR gRNA sequence
ctggatgttactttagagat

SEQ ID NO: 669179 - DNA, 20 bp, Artificial
  CRISPR gRNA sequence
tggatgttactttagagata

SEQ ID NO: 669180 - DNA, 20 bp, Artificial
  CRISPR gRNA sequence
gatgttactttagagataat

SEQ ID NO: 669181 - DNA, 20 bp, Artificial
  CRISPR gRNA sequence
ctttagagataattcttcac

SEQ ID NO: 669182 - DNA, 20 bp, Artificial
  CRISPR gRNA sequence
tagagataattcttcacatc

SEQ ID NO: 669183 - DNA, 20 bp, Artificial
  CRISPR gRNA sequence
agagataattcttcacatca

SEQ ID NO: 669184 - DNA, 20 bp, Artificial
  CRISPR gRNA sequence
gagataattcttcacatcat

SEQ ID NO: 669185 - DNA, 20 bp, Artificial
  CRISPR gRNA sequence
ttcacatcattctgaatttt

SEQ ID NO: 669186 - DNA, 20 bp, Artificial
  CRISPR gRNA sequence
cacatcattctgaattttta

SEQ ID NO: 669187 - DNA, 20 bp, Artificial
  CRISPR gRNA sequence
acatcattctgaatttttaa

SEQ ID NO: 669188 - DNA, 20 bp, Artificial
  CRISPR gRNA sequence
tgaatttttaaaatttaggt

SEQ ID NO: 669189 - DNA, 20 bp, Artificial
  CRISPR gRNA sequence
aatttttaaaatttaggtta

SEQ ID NO: 669190 - DNA, 20 bp, Artificial
  CRISPR gRNA sequence
ttaaaatttaggttatttag

SEQ ID NO: 669191 - DNA, 20 bp, Artificial
  CRISPR gRNA sequence
taaaatttaggttatttaga

SEQ ID NO: 669192 - DNA, 20 bp, Artificial
  CRISPR gRNA sequence
aaaatttaggttatttagag

SEQ ID NO: 669193 - DNA, 20 bp, Artificial
  CRISPR gRNA sequence
aaatttaggttatttagaga

SEQ ID NO: 669194 - DNA, 20 bp, Artificial
  CRISPR gRNA sequence
aggttatttagagatgtgga

SEQ ID NO: 669195 - DNA, 20 bp, Artificial
  CRISPR gRNA sequence
ggttatttagagatgtggag

SEQ ID NO: 669196 - DNA, 20 bp, Artificial
  CRISPR gRNA sequence
tttagagatgtggaggttgc

SEQ ID NO: 669197 - DNA, 20 bp, Artificial
  CRISPR gRNA sequence
agagatgtggaggttgcagt

SEQ ID NO: 669198 - DNA, 20 bp, Artificial
  CRISPR gRNA sequence
gagatgtggaggttgcagtg

SEQ ID NO: 669199 - DNA, 20 bp, Artificial
  CRISPR gRNA sequence
cagtgagccaagatcgtgcc

SEQ ID NO: 669200 - DNA, 20 bp, Artificial
  CRISPR gRNA sequence
cactccagacctggcgacag

SEQ ID NO: 669201 - DNA, 20 bp, Artificial
  CRISPR gRNA sequence
cagacctggcgacagagcaa

SEQ ID NO: 669202 - DNA, 20 bp, Artificial
  CRISPR gRNA sequence
gcgacagagcaagactccat

SEQ ID NO: 669203 - DNA, 20 bp, Artificial
  CRISPR gRNA sequence
catctcaaagaaaacaaaaa

SEQ ID NO: 669204 - DNA, 20 bp, Artificial
  CRISPR gRNA sequence
aaagaaaacaaaaattatgt

SEQ ID NO: 669205 - DNA, 20 bp, Artificial
  CRISPR gRNA sequence
tgttattcataagtttttat

SEQ ID NO: 669206 - DNA, 20 bp, Artificial
  CRISPR gRNA sequence
ttcataagtttttatggact

SEQ ID NO: 669207 - DNA, 20 bp, Artificial
  CRISPR gRNA sequence
ataagtttttatggacttct

SEQ ID NO: 669208 - DNA, 20 bp, Artificial
  CRISPR gRNA sequence
ttatggacttctgattcgtt

SEQ ID NO: 669209 - DNA, 20 bp, Artificial
  CRISPR gRNA sequence
tatggacttctgattcgttg

SEQ ID NO: 669210 - DNA, 20 bp, Artificial
  CRISPR gRNA sequence
atggacttctgattcgttgg

SEQ ID NO: 669211 - DNA, 20 bp, Artificial
  CRISPR gRNA sequence
tggacttctgattcgttgga

SEQ ID NO: 669212 - DNA, 20 bp, Artificial
  CRISPR gRNA sequence
ctgattcgttggaagttaac

SEQ ID NO: 669213 - DNA, 20 bp, Artificial
  CRISPR gRNA sequence
tgattcgttggaagttaaca

SEQ ID NO: 669214 - DNA, 20 bp, Artificial
  CRISPR gRNA sequence
attcgttggaagttaacatg

SEQ ID NO: 669215 - DNA, 20 bp, Artificial
  CRISPR gRNA sequence
gttggaagttaacatggctt

SEQ ID NO: 669216 - DNA, 20 bp, Artificial
  CRISPR gRNA sequence
gaagttaacatggctttcac

SEQ ID NO: 669217 - DNA, 20 bp, Artificial
  CRISPR gRNA sequence
acatggctttcacttccctg

SEQ ID NO: 669218 - DNA, 20 bp, Artificial
  CRISPR gRNA sequence
tcacttccctgattttcatt

SEQ ID NO: 669219 - DNA, 20 bp, Artificial
  CRISPR gRNA sequence
cacttccctgattttcattt

SEQ ID NO: 669220 - DNA, 20 bp, Artificial
  CRISPR gRNA sequence
acttccctgattttcattta

SEQ ID NO: 669221 - DNA, 20 bp, Artificial
  CRISPR gRNA sequence
ccctgattttcatttaattt

SEQ ID NO: 669222 - DNA, 20 bp, Artificial
  CRISPR gRNA sequence
cctgattttcatttaatttg

SEQ ID NO: 669223 - DNA, 20 bp, Artificial
  CRISPR gRNA sequence
attttcatttaatttgttta

SEQ ID NO: 669224 - DNA, 20 bp, Artificial
  CRISPR gRNA sequence
tcatttaatttgtttaatat

SEQ ID NO: 669225 - DNA, 20 bp, Artificial
  CRISPR gRNA sequence
catttaatttgtttaatata

SEQ ID NO: 669226 - DNA, 20 bp, Artificial
  CRISPR gRNA sequence
atttaatttgtttaatatat

SEQ ID NO: 669227 - DNA, 20 bp, Artificial
  CRISPR gRNA sequence
aatttgtttaatatatgctt

SEQ ID NO: 669228 - DNA, 20 bp, Artificial
  CRISPR gRNA sequence
atttgtttaatatatgcttt

SEQ ID NO: 669229 - DNA, 20 bp, Artificial
  CRISPR gRNA sequence
gtttaatatatgctttacat

SEQ ID NO: 669230 - DNA, 20 bp, Artificial
  CRISPR gRNA sequence
tttaatatatgctttacatt

SEQ ID NO: 669231 - DNA, 20 bp, Artificial
  CRISPR gRNA sequence
aatatatgctttacattttg

SEQ ID NO: 669232 - DNA, 20 bp, Artificial
  CRISPR gRNA sequence
atatatgctttacattttgg

SEQ ID NO: 669233 - DNA, 20 bp, Artificial
  CRISPR gRNA sequence
tacattttggaaaggtgaag

SEQ ID NO: 669234 - DNA, 20 bp, Artificial
  CRISPR gRNA sequence
acattttggaaaggtgaagt

SEQ ID NO: 669235 - DNA, 20 bp, Artificial
  CRISPR gRNA sequence
cattttggaaaggtgaagtg

SEQ ID NO: 669236 - DNA, 20 bp, Artificial
  CRISPR gRNA sequence
tggaaaggtgaagtgtacat

SEQ ID NO: 669237 - DNA, 20 bp, Artificial
  CRISPR gRNA sequence
ggaaaggtgaagtgtacatt

SEQ ID NO: 669238 - DNA, 20 bp, Artificial
  CRISPR gRNA sequence
gaaaggtgaagtgtacattg

SEQ ID NO: 669239 - DNA, 20 bp, Artificial
  CRISPR gRNA sequence
atttttctgttgtttttctt

SEQ ID NO: 669240 - DNA, 20 bp, Artificial
  CRISPR gRNA sequence
ttctgttgtttttcttgtag

SEQ ID NO: 669241 - DNA, 20 bp, Artificial
  CRISPR gRNA sequence
tctgttgtttttcttgtagt

SEQ ID NO: 669242 - DNA, 20 bp, Artificial
  CRISPR gRNA sequence
ctgttgtttttcttgtagtg

SEQ ID NO: 669243 - DNA, 20 bp, Artificial
  CRISPR gRNA sequence
tgttgtttttcttgtagtgt

SEQ ID NO: 669244 - DNA, 20 bp, Artificial
  CRISPR gRNA sequence
ttgtttttcttgtagtgtta

SEQ ID NO: 669245 - DNA, 20 bp, Artificial
  CRISPR gRNA sequence
tttttcttgtagtgttacct

SEQ ID NO: 669246 - DNA, 20 bp, Artificial
  CRISPR gRNA sequence
ttcttgtagtgttacctctt

SEQ ID NO: 669247 - DNA, 20 bp, Artificial
  CRISPR gRNA sequence
tcttgtagtgttacctcttt

SEQ ID NO: 669248 - DNA, 20 bp, Artificial
  CRISPR gRNA sequence
cttgtagtgttacctctttc

SEQ ID NO: 669249 - DNA, 20 bp, Artificial
  CRISPR gRNA sequence
ttgtagtgttacctctttca

SEQ ID NO: 669250 - DNA, 20 bp, Artificial
  CRISPR gRNA sequence
gtagtgttacctctttcaaa

SEQ ID NO: 669251 - DNA, 20 bp, Artificial
  CRISPR gRNA sequence
tagtgttacctctttcaaag

SEQ ID NO: 669252 - DNA, 20 bp, Artificial
  CRISPR gRNA sequence
cctctttcaaaggtgtaaca

SEQ ID NO: 669253 - DNA, 20 bp, Artificial
  CRISPR gRNA sequence
tttcaaaggtgtaacatgct

SEQ ID NO: 669254 - DNA, 20 bp, Artificial
  CRISPR gRNA sequence
tcaaaggtgtaacatgctat

SEQ ID NO: 669255 - DNA, 20 bp, Artificial
  CRISPR gRNA sequence
caaaggtgtaacatgctatt

SEQ ID NO: 669256 - DNA, 20 bp, Artificial
  CRISPR gRNA sequence
aaaggtgtaacatgctatta

SEQ ID NO: 669257 - DNA, 20 bp, Artificial
  CRISPR gRNA sequence
ttaaacatttgaataactgt

SEQ ID NO: 669258 - DNA, 20 bp, Artificial
  CRISPR gRNA sequence
aacatttgaataactgtcat

SEQ ID NO: 669259 - DNA, 20 bp, Artificial
  CRISPR gRNA sequence
gaataactgtcatactctaa

SEQ ID NO: 669260 - DNA, 20 bp, Artificial
  CRISPR gRNA sequence
aataactgtcatactctaaa

SEQ ID NO: 669261 - DNA, 20 bp, Artificial
  CRISPR gRNA sequence
tcatactctaaaaccttttt

SEQ ID NO: 669262 - DNA, 20 bp, Artificial
  CRISPR gRNA sequence
taaaacctttttatatttat

SEQ ID NO: 669263 - DNA, 20 bp, Artificial
  CRISPR gRNA sequence
aaacctttttatatttatga

SEQ ID NO: 669264 - DNA, 20 bp, Artificial
  CRISPR gRNA sequence
tttatatttatgaaacatag

SEQ ID NO: 669265 - DNA, 20 bp, Artificial
  CRISPR gRNA sequence
ttatatttatgaaacataga

SEQ ID NO: 669266 - DNA, 20 bp, Artificial
  CRISPR gRNA sequence
tatatttatgaaacatagat

SEQ ID NO: 669267 - DNA, 20 bp, Artificial
  CRISPR gRNA sequence
atatttatgaaacatagatc

SEQ ID NO: 669268 - DNA, 20 bp, Artificial
  CRISPR gRNA sequence
tatttatgaaacatagatca

SEQ ID NO: 669269 - DNA, 20 bp, Artificial
  CRISPR gRNA sequence
atgaaacatagatcatgtca

SEQ ID NO: 669270 - DNA, 20 bp, Artificial
  CRISPR gRNA sequence
tgaaacatagatcatgtcaa

SEQ ID NO: 669271 - DNA, 20 bp, Artificial
  CRISPR gRNA sequence
ctatcatttgtttaatattt

SEQ ID NO: 669272 - DNA, 20 bp, Artificial
  CRISPR gRNA sequence
tcatttgtttaatattttcc

SEQ ID NO: 669273 - DNA, 20 bp, Artificial
  CRISPR gRNA sequence
gtttaatattttcctggcag

SEQ ID NO: 669274 - DNA, 20 bp, Artificial
  CRISPR gRNA sequence
tttaatattttcctggcagt

SEQ ID NO: 669275 - DNA, 20 bp, Artificial
  CRISPR gRNA sequence
aatattttcctggcagtgtt

SEQ ID NO: 669276 - DNA, 20 bp, Artificial
  CRISPR gRNA sequence
atattttcctggcagtgttt

SEQ ID NO: 669277 - DNA, 20 bp, Artificial
  CRISPR gRNA sequence
tcctggcagtgttttctgtt

SEQ ID NO: 669278 - DNA, 20 bp, Artificial
  CRISPR gRNA sequence
cctggcagtgttttctgttt

SEQ ID NO: 669279 - DNA, 20 bp, Artificial
  CRISPR gRNA sequence
ctggcagtgttttctgttta

SEQ ID NO: 669280 - DNA, 20 bp, Artificial
  CRISPR gRNA sequence
gcagtgttttctgtttaatt

SEQ ID NO: 669281 - DNA, 20 bp, Artificial
  CRISPR gRNA sequence
tctgtttaatttttgtatac

SEQ ID NO: 669282 - DNA, 20 bp, Artificial
  CRISPR gRNA sequence
ctgtttaatttttgtatact

SEQ ID NO: 669283 - DNA, 20 bp, Artificial
  CRISPR gRNA sequence
tgtttaatttttgtatactt

SEQ ID NO: 669284 - DNA, 20 bp, Artificial
  CRISPR gRNA sequence
tttaatttttgtatacttct

SEQ ID NO: 669285 - DNA, 20 bp, Artificial
  CRISPR gRNA sequence
aatttttgtatacttcttct

SEQ ID NO: 669286 - DNA, 20 bp, Artificial
  CRISPR gRNA sequence
atttttgtatacttcttctg

SEQ ID NO: 669287 - DNA, 20 bp, Artificial
  CRISPR gRNA sequence
ttgtatacttcttctgtggt

SEQ ID NO: 669288 - DNA, 20 bp, Artificial
  CRISPR gRNA sequence
tgtatacttcttctgtggta

SEQ ID NO: 669289 - DNA, 20 bp, Artificial
  CRISPR gRNA sequence
gtatacttcttctgtggtaa

SEQ ID NO: 669290 - DNA, 20 bp, Artificial
  CRISPR gRNA sequence
tatacttcttctgtggtaaa

SEQ ID NO: 669291 - DNA, 20 bp, Artificial
  CRISPR gRNA sequence
cttctgtggtaaatatggag

SEQ ID NO: 669292 - DNA, 20 bp, Artificial
  CRISPR gRNA sequence
ttctgtggtaaatatggagt

SEQ ID NO: 669293 - DNA, 20 bp, Artificial
  CRISPR gRNA sequence
ctgtggtaaatatggagtta

SEQ ID NO: 669294 - DNA, 20 bp, Artificial
  CRISPR gRNA sequence
tgtggtaaatatggagttag

SEQ ID NO: 669295 - DNA, 20 bp, Artificial
  CRISPR gRNA sequence
tggtaaatatggagttagtt

SEQ ID NO: 669296 - DNA, 20 bp, Artificial
  CRISPR gRNA sequence
gtttatttctggttacttat

SEQ ID NO: 669297 - DNA, 20 bp, Artificial
  CRISPR gRNA sequence
atttctggttacttattggg

SEQ ID NO: 669298 - DNA, 20 bp, Artificial
  CRISPR gRNA sequence
tttctggttacttattggga

SEQ ID NO: 669299 - DNA, 20 bp, Artificial
  CRISPR gRNA sequence
ctggttacttattgggaaac

SEQ ID NO: 669300 - DNA, 20 bp, Artificial
  CRISPR gRNA sequence
tggttacttattgggaaact

SEQ ID NO: 669301 - DNA, 20 bp, Artificial
  CRISPR gRNA sequence
gttacttattgggaaactga

SEQ ID NO: 669302 - DNA, 20 bp, Artificial
  CRISPR gRNA sequence
cttattgggaaactgagaca

SEQ ID NO: 669303 - DNA, 20 bp, Artificial
  CRISPR gRNA sequence
attgggaaactgagacacta

SEQ ID NO: 669304 - DNA, 20 bp, Artificial
  CRISPR gRNA sequence
ttgggaaactgagacactaa

SEQ ID NO: 669305 - DNA, 20 bp, Artificial
  CRISPR gRNA sequence
ggaaactgagacactaacat

SEQ ID NO: 669306 - DNA, 20 bp, Artificial
  CRISPR gRNA sequence
agacactaacatttacctcc

SEQ ID NO: 669307 - DNA, 20 bp, Artificial
  CRISPR gRNA sequence
acatttacctccactcttac

SEQ ID NO: 669308 - DNA, 20 bp, Artificial
  CRISPR gRNA sequence
acctccactcttactcactg

SEQ ID NO: 669309 - DNA, 20 bp, Artificial
  CRISPR gRNA sequence
cctccactcttactcactga

SEQ ID NO: 669310 - DNA, 20 bp, Artificial
  CRISPR gRNA sequence
cactcttactcactgaactc

SEQ ID NO: 669311 - DNA, 20 bp, Artificial
  CRISPR gRNA sequence
ttactcactgaactccatca

SEQ ID NO: 669312 - DNA, 20 bp, Artificial
  CRISPR gRNA sequence
actcactgaactccatcact

SEQ ID NO: 669313 - DNA, 20 bp, Artificial
  CRISPR gRNA sequence
ctcactgaactccatcacta

SEQ ID NO: 669314 - DNA, 20 bp, Artificial
  CRISPR gRNA sequence
actgaactccatcactaacc

SEQ ID NO: 669315 - DNA, 20 bp, Artificial
  CRISPR gRNA sequence
aactccatcactaaccagca

SEQ ID NO: 669316 - DNA, 20 bp, Artificial
  CRISPR gRNA sequence
catcactaaccagcagtaga

SEQ ID NO: 669317 - DNA, 20 bp, Artificial
  CRISPR gRNA sequence
accagcagtagaacctagga

SEQ ID NO: 669318 - DNA, 20 bp, Artificial
  CRISPR gRNA sequence
ggaatcttacttctagttca

SEQ ID NO: 669319 - DNA, 20 bp, Artificial
  CRISPR gRNA sequence
acttctagttcagtgattgg

SEQ ID NO: 669320 - DNA, 20 bp, Artificial
  CRISPR gRNA sequence
cttctagttcagtgattggt

SEQ ID NO: 669321 - DNA, 20 bp, Artificial
  CRISPR gRNA sequence
ctagttcagtgattggttta

SEQ ID NO: 669322 - DNA, 20 bp, Artificial
  CRISPR gRNA sequence
tagttcagtgattggtttat

SEQ ID NO: 669323 - DNA, 20 bp, Artificial
  CRISPR gRNA sequence
gttcagtgattggtttattg

SEQ ID NO: 669324 - DNA, 20 bp, Artificial
  CRISPR gRNA sequence
agtgattggtttattgtatc

SEQ ID NO: 669325 - DNA, 20 bp, Artificial
  CRISPR gRNA sequence
gtttattgtatctcagtttc

SEQ ID NO: 669326 - DNA, 20 bp, Artificial
  CRISPR gRNA sequence
attgtatctcagtttctagt

SEQ ID NO: 669327 - DNA, 20 bp, Artificial
  CRISPR gRNA sequence
ttgtatctcagtttctagta

SEQ ID NO: 669328 - DNA, 20 bp, Artificial
  CRISPR gRNA sequence
tatctcagtttctagtacca

SEQ ID NO: 669329 - DNA, 20 bp, Artificial
  CRISPR gRNA sequence
agtttctagtaccagattaa

SEQ ID NO: 669330 - DNA, 20 bp, Artificial
  CRISPR gRNA sequence
ctagtaccagattaactata

SEQ ID NO: 669331 - DNA, 20 bp, Artificial
  CRISPR gRNA sequence
tagtaccagattaactatat

SEQ ID NO: 669332 - DNA, 20 bp, Artificial
  CRISPR gRNA sequence
gtaccagattaactatatta

SEQ ID NO: 669333 - DNA, 20 bp, Artificial
  CRISPR gRNA sequence
actatattagctcctcgtat

SEQ ID NO: 669334 - DNA, 20 bp, Artificial
  CRISPR gRNA sequence
tattagctcctcgtattaac

SEQ ID NO: 669335 - DNA, 20 bp, Artificial
  CRISPR gRNA sequence
gctcctcgtattaactttta

SEQ ID NO: 669336 - DNA, 20 bp, Artificial
  CRISPR gRNA sequence
ctcgtattaacttttatttg

SEQ ID NO: 669337 - DNA, 20 bp, Artificial
  CRISPR gRNA sequence
gtattaacttttatttgtga

SEQ ID NO: 669338 - DNA, 20 bp, Artificial
  CRISPR gRNA sequence
acttttatttgtgatgtttt

SEQ ID NO: 669339 - DNA, 20 bp, Artificial
  CRISPR gRNA sequence
ttatttgtgatgtttttcaa

SEQ ID NO: 669340 - DNA, 20 bp, Artificial
  CRISPR gRNA sequence
tatttgtgatgtttttcaag

SEQ ID NO: 669341 - DNA, 20 bp, Artificial
  CRISPR gRNA sequence
atttgtgatgtttttcaagg

SEQ ID NO: 669342 - DNA, 20 bp, Artificial
  CRISPR gRNA sequence
tttgtgatgtttttcaagga

SEQ ID NO: 669343 - DNA, 20 bp, Artificial
  CRISPR gRNA sequence
gtgatgtttttcaaggagtg

SEQ ID NO: 669344 - DNA, 20 bp, Artificial
  CRISPR gRNA sequence
tgatgtttttcaaggagtgg

SEQ ID NO: 669345 - DNA, 20 bp, Artificial
  CRISPR gRNA sequence
ttcaaggagtggaaaacagt

SEQ ID NO: 669346 - DNA, 20 bp, Artificial
  CRISPR gRNA sequence
tcaaggagtggaaaacagtc

SEQ ID NO: 669347 - DNA, 20 bp, Artificial
  CRISPR gRNA sequence
caaggagtggaaaacagtct

SEQ ID NO: 669348 - DNA, 20 bp, Artificial
  CRISPR gRNA sequence
aaggagtggaaaacagtctt

SEQ ID NO: 669349 - DNA, 20 bp, Artificial
  CRISPR gRNA sequence
cattttccacttcccccaaa

SEQ ID NO: 669350 - DNA, 20 bp, Artificial
  CRISPR gRNA sequence
attttccacttcccccaaat

SEQ ID NO: 669351 - DNA, 20 bp, Artificial
  CRISPR gRNA sequence
tccacttcccccaaatcaca

SEQ ID NO: 669352 - DNA, 20 bp, Artificial
  CRISPR gRNA sequence
ccacttcccccaaatcacaa

SEQ ID NO: 669353 - DNA, 20 bp, Artificial
  CRISPR gRNA sequence
cacttcccccaaatcacaaa

SEQ ID NO: 669354 - DNA, 20 bp, Artificial
  CRISPR gRNA sequence
cccccaaatcacaaagaata

SEQ ID NO: 669355 - DNA, 20 bp, Artificial
  CRISPR gRNA sequence
ccccaaatcacaaagaatat

SEQ ID NO: 669356 - DNA, 20 bp, Artificial
  CRISPR gRNA sequence
atgacgtattaagtagacct

SEQ ID NO: 669357 - DNA, 20 bp, Artificial
  CRISPR gRNA sequence
tgacgtattaagtagacctt

SEQ ID NO: 669358 - DNA, 20 bp, Artificial
  CRISPR gRNA sequence
agtagaccttaaggttttta

SEQ ID NO: 669359 - DNA, 20 bp, Artificial
  CRISPR gRNA sequence
aaggtttttaagtaaaatat

SEQ ID NO: 669360 - DNA, 20 bp, Artificial
  CRISPR gRNA sequence
aggtttttaagtaaaatatt

SEQ ID NO: 669361 - DNA, 20 bp, Artificial
  CRISPR gRNA sequence
ttaagtaaaatatttacatc

SEQ ID NO: 669362 - DNA, 20 bp, Artificial
  CRISPR gRNA sequence
taagtaaaatatttacatct

SEQ ID NO: 669363 - DNA, 20 bp, Artificial
  CRISPR gRNA sequence
aagtaaaatatttacatcta

SEQ ID NO: 669364 - DNA, 20 bp, Artificial
  CRISPR gRNA sequence
agtaaaatatttacatctat

SEQ ID NO: 669365 - DNA, 20 bp, Artificial
  CRISPR gRNA sequence
acatctattcctgtaaacct

SEQ ID NO: 669366 - DNA, 20 bp, Artificial
  CRISPR gRNA sequence
catctattcctgtaaacctt

SEQ ID NO: 669367 - DNA, 20 bp, Artificial
  CRISPR gRNA sequence
ttcctgtaaaccttctgctt

SEQ ID NO: 669368 - DNA, 20 bp, Artificial
  CRISPR gRNA sequence
ctgtaaaccttctgctttct

SEQ ID NO: 669369 - DNA, 20 bp, Artificial
  CRISPR gRNA sequence
taaaccttctgctttcttgc

SEQ ID NO: 669370 - DNA, 20 bp, Artificial
  CRISPR gRNA sequence
ctgctttcttgcatccgaga

SEQ ID NO: 669371 - DNA, 20 bp, Artificial
  CRISPR gRNA sequence
tgctttcttgcatccgagac

SEQ ID NO: 669372 - DNA, 20 bp, Artificial
  CRISPR gRNA sequence
ctttcttgcatccgagacaa

SEQ ID NO: 669373 - DNA, 20 bp, Artificial
  CRISPR gRNA sequence
tcttgcatccgagacaatac

SEQ ID NO: 669374 - DNA, 20 bp, Artificial
  CRISPR gRNA sequence
cttgcatccgagacaatact

SEQ ID NO: 669375 - DNA, 20 bp, Artificial
  CRISPR gRNA sequence
ttgcatccgagacaatactg

SEQ ID NO: 669376 - DNA, 20 bp, Artificial
  CRISPR gRNA sequence
gcatccgagacaatactgta

SEQ ID NO: 669377 - DNA, 20 bp, Artificial
  CRISPR gRNA sequence
catccgagacaatactgtac

SEQ ID NO: 669378 - DNA, 20 bp, Artificial
  CRISPR gRNA sequence
tacttatactggataagtat

SEQ ID NO: 669379 - DNA, 20 bp, Artificial
  CRISPR gRNA sequence
atactggataagtattctgt

SEQ ID NO: 669380 - DNA, 20 bp, Artificial
  CRISPR gRNA sequence
tactggataagtattctgtc

SEQ ID NO: 669381 - DNA, 20 bp, Artificial
  CRISPR gRNA sequence
gataagtattctgtctgaat

SEQ ID NO: 669382 - DNA, 20 bp, Artificial
  CRISPR gRNA sequence
tgtctgaatatttactgaat

SEQ ID NO: 669383 - DNA, 20 bp, Artificial
  CRISPR gRNA sequence
tctgaatatttactgaattt

SEQ ID NO: 669384 - DNA, 20 bp, Artificial
  CRISPR gRNA sequence
aatatttactgaatttatgc

SEQ ID NO: 669385 - DNA, 20 bp, Artificial
  CRISPR gRNA sequence
actgaatttatgcattatta

SEQ ID NO: 669386 - DNA, 20 bp, Artificial
  CRISPR gRNA sequence
ctgaatttatgcattattaa

SEQ ID NO: 669387 - DNA, 20 bp, Artificial
  CRISPR gRNA sequence
aatttatgcattattaaatg

SEQ ID NO: 669388 - DNA, 20 bp, Artificial
  CRISPR gRNA sequence
atgcattattaaatgaatga

SEQ ID NO: 669389 - DNA, 20 bp, Artificial
  CRISPR gRNA sequence
tgcattattaaatgaatgaa

SEQ ID NO: 669390 - DNA, 20 bp, Artificial
  CRISPR gRNA sequence
ttaaatgaatgaaaaaggga

SEQ ID NO: 669391 - DNA, 20 bp, Artificial
  CRISPR gRNA sequence
aatgaatgaaaaagggaaac

SEQ ID NO: 669392 - DNA, 20 bp, Artificial
  CRISPR gRNA sequence
attgaccatcatttgagagt

SEQ ID NO: 669393 - DNA, 20 bp, Artificial
  CRISPR gRNA sequence
accatcatttgagagtattg

SEQ ID NO: 669394 - DNA, 20 bp, Artificial
  CRISPR gRNA sequence
gagagtattgaagaagctta

SEQ ID NO: 669395 - DNA, 20 bp, Artificial
  CRISPR gRNA sequence
agagtattgaagaagcttaa

SEQ ID NO: 669396 - DNA, 20 bp, Artificial
  CRISPR gRNA sequence
aagaagcttaagcagaataa

SEQ ID NO: 669397 - DNA, 20 bp, Artificial
  CRISPR gRNA sequence
aagcagaataaaatttataa

SEQ ID NO: 669398 - DNA, 20 bp, Artificial
  CRISPR gRNA sequence
agcagaataaaatttataaa

SEQ ID NO: 669399 - DNA, 20 bp, Artificial
  CRISPR gRNA sequence
ataaaacagcataaattcag

SEQ ID NO: 669400 - DNA, 20 bp, Artificial
  CRISPR gRNA sequence
taaaacagcataaattcagt

SEQ ID NO: 669401 - DNA, 20 bp, Artificial
  CRISPR gRNA sequence
agtctctaactgaatgggtt

SEQ ID NO: 669402 - DNA, 20 bp, Artificial
  CRISPR gRNA sequence
taactgaatgggttccagtg

SEQ ID NO: 669403 - DNA, 20 bp, Artificial
  CRISPR gRNA sequence
actgaatgggttccagtgcc

SEQ ID NO: 669404 - DNA, 20 bp, Artificial
  CRISPR gRNA sequence
aatgggttccagtgccttag

SEQ ID NO: 669405 - DNA, 20 bp, Artificial
  CRISPR gRNA sequence
cagtgccttagatttcgtgt

SEQ ID NO: 669406 - DNA, 20 bp, Artificial
  CRISPR gRNA sequence
agatttcgtgttcatgtgtc

SEQ ID NO: 669407 - DNA, 20 bp, Artificial
  CRISPR gRNA sequence
gatttcgtgttcatgtgtca

SEQ ID NO: 669408 - DNA, 20 bp, Artificial
  CRISPR gRNA sequence
cgtgttcatgtgtcattttc

SEQ ID NO: 669409 - DNA, 20 bp, Artificial
  CRISPR gRNA sequence
gtgttcatgtgtcattttcg

SEQ ID NO: 669410 - DNA, 20 bp, Artificial
  CRISPR gRNA sequence
atgtgtcattttcgttgaat

SEQ ID NO: 669411 - DNA, 20 bp, Artificial
  CRISPR gRNA sequence
tcgttgaatttttatttctt

SEQ ID NO: 669412 - DNA, 20 bp, Artificial
  CRISPR gRNA sequence
cgttgaatttttatttcttc

SEQ ID NO: 669413 - DNA, 20 bp, Artificial
  CRISPR gRNA sequence
gttgaatttttatttcttct

SEQ ID NO: 669414 - DNA, 20 bp, Artificial
  CRISPR gRNA sequence
aatttttatttcttcttcta

SEQ ID NO: 669415 - DNA, 20 bp, Artificial
  CRISPR gRNA sequence
ttatttcttcttctaggcca

SEQ ID NO: 669416 - DNA, 20 bp, Artificial
  CRISPR gRNA sequence
tatttcttcttctaggccat

SEQ ID NO: 669417 - DNA, 20 bp, Artificial
  CRISPR gRNA sequence
atttcttcttctaggccata

SEQ ID NO: 669418 - DNA, 20 bp, Artificial
  CRISPR gRNA sequence
tttcttcttctaggccatac

SEQ ID NO: 669419 - DNA, 20 bp, Artificial
  CRISPR gRNA sequence
cttcttctaggccatactta

SEQ ID NO: 669420 - DNA, 20 bp, Artificial
  CRISPR gRNA sequence
ttcttctaggccatacttaa

SEQ ID NO: 669421 - DNA, 20 bp, Artificial
  CRISPR gRNA sequence
cttctaggccatacttaatt

SEQ ID NO: 669422 - DNA, 20 bp, Artificial
  CRISPR gRNA sequence
ttctaggccatacttaattt

SEQ ID NO: 669423 - DNA, 20 bp, Artificial
  CRISPR gRNA sequence
ctaggccatacttaattttt

SEQ ID NO: 669424 - DNA, 20 bp, Artificial
  CRISPR gRNA sequence
taggccatacttaattttta

SEQ ID NO: 669425 - DNA, 20 bp, Artificial
  CRISPR gRNA sequence
ggccatacttaatttttatt

SEQ ID NO: 669426 - DNA, 20 bp, Artificial
  CRISPR gRNA sequence
aatttttattgagttgctgt

SEQ ID NO: 669427 - DNA, 20 bp, Artificial
  CRISPR gRNA sequence
atttttattgagttgctgtg

SEQ ID NO: 669428 - DNA, 20 bp, Artificial
  CRISPR gRNA sequence
ttattgagttgctgtgttta

SEQ ID NO: 669429 - DNA, 20 bp, Artificial
  CRISPR gRNA sequence
tattgagttgctgtgtttaa

SEQ ID NO: 669430 - DNA, 20 bp, Artificial
  CRISPR gRNA sequence
attgagttgctgtgtttaac

SEQ ID NO: 669431 - DNA, 20 bp, Artificial
  CRISPR gRNA sequence
ttgagttgctgtgtttaaca

SEQ ID NO: 669432 - DNA, 20 bp, Artificial
  CRISPR gRNA sequence
agttgctgtgtttaacagtt

SEQ ID NO: 669433 - DNA, 20 bp, Artificial
  CRISPR gRNA sequence
ctgtgtttaacagttttcag

SEQ ID NO: 669434 - DNA, 20 bp, Artificial
  CRISPR gRNA sequence
tgtttaacagttttcagcaa

SEQ ID NO: 669435 - DNA, 20 bp, Artificial
  CRISPR gRNA sequence
aacagttttcagcaaaagct

SEQ ID NO: 669436 - DNA, 20 bp, Artificial
  CRISPR gRNA sequence
acagttttcagcaaaagctt

SEQ ID NO: 669437 - DNA, 20 bp, Artificial
  CRISPR gRNA sequence
tcagcaaaagcttaaaataa

SEQ ID NO: 669438 - DNA, 20 bp, Artificial
  CRISPR gRNA sequence
cagcaaaagcttaaaataaa

SEQ ID NO: 669439 - DNA, 20 bp, Artificial
  CRISPR gRNA sequence
agcaaaagcttaaaataaaa

SEQ ID NO: 669440 - DNA, 20 bp, Artificial
  CRISPR gRNA sequence
aaaataaaaacactagaaaa

SEQ ID NO: 669441 - DNA, 20 bp, Artificial
  CRISPR gRNA sequence
aaataaaaacactagaaaaa

SEQ ID NO: 669442 - DNA, 20 bp, Artificial
  CRISPR gRNA sequence
gaaaaatataaagtttaatg

SEQ ID NO: 669443 - DNA, 20 bp, Artificial
  CRISPR gRNA sequence
aatgtacctaatatgcaagg

SEQ ID NO: 669444 - DNA, 20 bp, Artificial
  CRISPR gRNA sequence
atgtacctaatatgcaaggc

SEQ ID NO: 669445 - DNA, 20 bp, Artificial
  CRISPR gRNA sequence
atatgcaaggcttgataagg

SEQ ID NO: 669446 - DNA, 20 bp, Artificial
  CRISPR gRNA sequence
gataaggtgccctataaatg

SEQ ID NO: 669447 - DNA, 20 bp, Artificial
  CRISPR gRNA sequence
ataaggtgccctataaatgg

SEQ ID NO: 669448 - DNA, 20 bp, Artificial
  CRISPR gRNA sequence
taaatggggaaacaaataaa

SEQ ID NO: 669449 - DNA, 20 bp, Artificial
  CRISPR gRNA sequence
tctcttaacagacttaactt

SEQ ID NO: 669450 - DNA, 20 bp, Artificial
  CRISPR gRNA sequence
ctcttaacagacttaacttt

SEQ ID NO: 669451 - DNA, 20 bp, Artificial
  CRISPR gRNA sequence
tcttaacagacttaactttc

SEQ ID NO: 669452 - DNA, 20 bp, Artificial
  CRISPR gRNA sequence
ttaacagacttaactttcaa

SEQ ID NO: 669453 - DNA, 20 bp, Artificial
  CRISPR gRNA sequence
aacagacttaactttcaaga

SEQ ID NO: 669454 - DNA, 20 bp, Artificial
  CRISPR gRNA sequence
acagacttaactttcaagag

SEQ ID NO: 669455 - DNA, 20 bp, Artificial
  CRISPR gRNA sequence
aactttcaagagtgctgaaa

SEQ ID NO: 669456 - DNA, 20 bp, Artificial
  CRISPR gRNA sequence
actttcaagagtgctgaaat

SEQ ID NO: 669457 - DNA, 20 bp, Artificial
  CRISPR gRNA sequence
tcaagagtgctgaaattcac

SEQ ID NO: 669458 - DNA, 20 bp, Artificial
  CRISPR gRNA sequence
caagagtgctgaaattcact

SEQ ID NO: 669459 - DNA, 20 bp, Artificial
  CRISPR gRNA sequence
aagagtgctgaaattcacta

SEQ ID NO: 669460 - DNA, 20 bp, Artificial
  CRISPR gRNA sequence
aaattcactaaggcttataa

SEQ ID NO: 669461 - DNA, 20 bp, Artificial
  CRISPR gRNA sequence
actaaggcttataaaagttt

SEQ ID NO: 669462 - DNA, 20 bp, Artificial
  CRISPR gRNA sequence
aggcttataaaagtttgtaa

SEQ ID NO: 669463 - DNA, 20 bp, Artificial
  CRISPR gRNA sequence
ataaaagtttgtaactaaag

SEQ ID NO: 669464 - DNA, 20 bp, Artificial
  CRISPR gRNA sequence
taaaagtttgtaactaaagt

SEQ ID NO: 669465 - DNA, 20 bp, Artificial
  CRISPR gRNA sequence
gtaactaaagtcagtatgta

SEQ ID NO: 669466 - DNA, 20 bp, Artificial
  CRISPR gRNA sequence
taactaaagtcagtatgtag

SEQ ID NO: 669467 - DNA, 20 bp, Artificial
  CRISPR gRNA sequence
aagtcagtatgtagaaaggt

SEQ ID NO: 669468 - DNA, 20 bp, Artificial
  CRISPR gRNA sequence
tgccttgtctatctttgaat

SEQ ID NO: 669469 - DNA, 20 bp, Artificial
  CRISPR gRNA sequence
gccttgtctatctttgaatg

SEQ ID NO: 669470 - DNA, 20 bp, Artificial
  CRISPR gRNA sequence
ccttgtctatctttgaatga

SEQ ID NO: 669471 - DNA, 20 bp, Artificial
  CRISPR gRNA sequence
gtctatctttgaatgagctg

SEQ ID NO: 669472 - DNA, 20 bp, Artificial
  CRISPR gRNA sequence
tctatctttgaatgagctgc

SEQ ID NO: 669473 - DNA, 20 bp, Artificial
  CRISPR gRNA sequence
tctttgaatgagctgcttgg

SEQ ID NO: 669474 - DNA, 20 bp, Artificial
  CRISPR gRNA sequence
tgaatgagctgcttggtgac

SEQ ID NO: 669475 - DNA, 20 bp, Artificial
  CRISPR gRNA sequence
gaatgagctgcttggtgaca

SEQ ID NO: 669476 - DNA, 20 bp, Artificial
  CRISPR gRNA sequence
aatgagctgcttggtgacat

SEQ ID NO: 669477 - DNA, 20 bp, Artificial
  CRISPR gRNA sequence
cttggtgacattattccact

SEQ ID NO: 669478 - DNA, 20 bp, Artificial
  CRISPR gRNA sequence
ggtgacattattccactaca

SEQ ID NO: 669479 - DNA, 20 bp, Artificial
  CRISPR gRNA sequence
gtgacattattccactacag

SEQ ID NO: 669480 - DNA, 20 bp, Artificial
  CRISPR gRNA sequence
ttccactacagggataagtt

SEQ ID NO: 669481 - DNA, 20 bp, Artificial
  CRISPR gRNA sequence
cactacagggataagttcaa

SEQ ID NO: 669482 - DNA, 20 bp, Artificial
  CRISPR gRNA sequence
cagggataagttcaataccc

SEQ ID NO: 669483 - DNA, 20 bp, Artificial
  CRISPR gRNA sequence
aatacccagtgagcgataat

SEQ ID NO: 669484 - DNA, 20 bp, Artificial
  CRISPR gRNA sequence
cagattgtagactgtctact

SEQ ID NO: 669485 - DNA, 20 bp, Artificial
  CRISPR gRNA sequence
tagactgtctactgcattat

SEQ ID NO: 669486 - DNA, 20 bp, Artificial
  CRISPR gRNA sequence
tctactgcattattccttac

SEQ ID NO: 669487 - DNA, 20 bp, Artificial
  CRISPR gRNA sequence
ctgcattattccttactatt

SEQ ID NO: 669488 - DNA, 20 bp, Artificial
  CRISPR gRNA sequence
cattattccttactattgta

SEQ ID NO: 669489 - DNA, 20 bp, Artificial
  CRISPR gRNA sequence
ttccttactattgtataaca

SEQ ID NO: 669490 - DNA, 20 bp, Artificial
  CRISPR gRNA sequence
cttactattgtataacactg

SEQ ID NO: 669491 - DNA, 20 bp, Artificial
  CRISPR gRNA sequence
actattgtataacactgtgt

SEQ ID NO: 669492 - DNA, 20 bp, Artificial
  CRISPR gRNA sequence
ctattgtataacactgtgta

SEQ ID NO: 669493 - DNA, 20 bp, Artificial
  CRISPR gRNA sequence
ttgtataacactgtgtattt

SEQ ID NO: 669494 - DNA, 20 bp, Artificial
  CRISPR gRNA sequence
tataacactgtgtattttca

SEQ ID NO: 669495 - DNA, 20 bp, Artificial
  CRISPR gRNA sequence
tgtattttcagcaagtttta

SEQ ID NO: 669496 - DNA, 20 bp, Artificial
  CRISPR gRNA sequence
tcagcaagttttactcaata

SEQ ID NO: 669497 - DNA, 20 bp, Artificial
  CRISPR gRNA sequence
cagcaagttttactcaatat

SEQ ID NO: 669498 - DNA, 20 bp, Artificial
  CRISPR gRNA sequence
agcaagttttactcaatata

SEQ ID NO: 669499 - DNA, 20 bp, Artificial
  CRISPR gRNA sequence
tactcaatatatttgctggc

SEQ ID NO: 669500 - DNA, 20 bp, Artificial
  CRISPR gRNA sequence
actcaatatatttgctggcg

SEQ ID NO: 669501 - DNA, 20 bp, Artificial
  CRISPR gRNA sequence
ctcaatatatttgctggcga

SEQ ID NO: 669502 - DNA, 20 bp, Artificial
  CRISPR gRNA sequence
aatatatttgctggcgacaa

SEQ ID NO: 669503 - DNA, 20 bp, Artificial
  CRISPR gRNA sequence
gctggcgacaaaatgagttt

SEQ ID NO: 669504 - DNA, 20 bp, Artificial
  CRISPR gRNA sequence
ctggcgacaaaatgagtttt

SEQ ID NO: 669505 - DNA, 20 bp, Artificial
  CRISPR gRNA sequence
gcgacaaaatgagtttttaa

SEQ ID NO: 669506 - DNA, 20 bp, Artificial
  CRISPR gRNA sequence
ttaaagaaaagaattagctg

SEQ ID NO: 669507 - DNA, 20 bp, Artificial
  CRISPR gRNA sequence
taaagaaaagaattagctga

SEQ ID NO: 669508 - DNA, 20 bp, Artificial
  CRISPR gRNA sequence
aaagaaaagaattagctgac

SEQ ID NO: 669509 - DNA, 20 bp, Artificial
  CRISPR gRNA sequence
aagaaaagaattagctgact

SEQ ID NO: 669510 - DNA, 20 bp, Artificial
  CRISPR gRNA sequence
gctgactagtaacatttagg

SEQ ID NO: 669511 - DNA, 20 bp, Artificial
  CRISPR gRNA sequence
actagtaacatttagggaga

SEQ ID NO: 669512 - DNA, 20 bp, Artificial
  CRISPR gRNA sequence
gtaacatttagggagatcat

SEQ ID NO: 669513 - DNA, 20 bp, Artificial
  CRISPR gRNA sequence
agggagatcatcagtcgaaa

SEQ ID NO: 669514 - DNA, 20 bp, Artificial
  CRISPR gRNA sequence
gggagatcatcagtcgaaac

SEQ ID NO: 669515 - DNA, 20 bp, Artificial
  CRISPR gRNA sequence
aaaactaatcttttttttga

SEQ ID NO: 669516 - DNA, 20 bp, Artificial
  CRISPR gRNA sequence
atcttttttttgaccaatta

SEQ ID NO: 669517 - DNA, 20 bp, Artificial
  CRISPR gRNA sequence
ttttttgaccaattagtgac

SEQ ID NO: 669518 - DNA, 20 bp, Artificial
  CRISPR gRNA sequence
tttttgaccaattagtgaca

SEQ ID NO: 669519 - DNA, 20 bp, Artificial
  CRISPR gRNA sequence
ttttgaccaattagtgacag

SEQ ID NO: 669520 - DNA, 20 bp, Artificial
  CRISPR gRNA sequence
tttgaccaattagtgacaga

SEQ ID NO: 669521 - DNA, 20 bp, Artificial
  CRISPR gRNA sequence
ttgaccaattagtgacagaa

SEQ ID NO: 669522 - DNA, 20 bp, Artificial
  CRISPR gRNA sequence
tgaccaattagtgacagaaa

SEQ ID NO: 669523 - DNA, 20 bp, Artificial
  CRISPR gRNA sequence
gaccaattagtgacagaaat

SEQ ID NO: 669524 - DNA, 20 bp, Artificial
  CRISPR gRNA sequence
accaattagtgacagaaatt

SEQ ID NO: 669525 - DNA, 20 bp, Artificial
  CRISPR gRNA sequence
gtgacagaaatttccgagtt

SEQ ID NO: 669526 - DNA, 20 bp, Artificial
  CRISPR gRNA sequence
ccgagttactcctttcttat

SEQ ID NO: 669527 - DNA, 20 bp, Artificial
  CRISPR gRNA sequence
cgagttactcctttcttata

SEQ ID NO: 669528 - DNA, 20 bp, Artificial
  CRISPR gRNA sequence
ctcctttcttatatttcatc

SEQ ID NO: 669529 - DNA, 20 bp, Artificial
  CRISPR gRNA sequence
ctttcttatatttcatcgtt

SEQ ID NO: 669530 - DNA, 20 bp, Artificial
  CRISPR gRNA sequence
tcttatatttcatcgttagc

SEQ ID NO: 669531 - DNA, 20 bp, Artificial
  CRISPR gRNA sequence
cttatatttcatcgttagct

SEQ ID NO: 669532 - DNA, 20 bp, Artificial
  CRISPR gRNA sequence
ttatatttcatcgttagctg

SEQ ID NO: 669533 - DNA, 20 bp, Artificial
  CRISPR gRNA sequence
atatttcatcgttagctgat

SEQ ID NO: 669534 - DNA, 20 bp, Artificial
  CRISPR gRNA sequence
tatttcatcgttagctgatt

SEQ ID NO: 669535 - DNA, 20 bp, Artificial
  CRISPR gRNA sequence
catcgttagctgatttgatt

SEQ ID NO: 669536 - DNA, 20 bp, Artificial
  CRISPR gRNA sequence
atcgttagctgatttgattg

SEQ ID NO: 669537 - DNA, 20 bp, Artificial
  CRISPR gRNA sequence
gctgatttgattgggaagag

SEQ ID NO: 669538 - DNA, 20 bp, Artificial
  CRISPR gRNA sequence
atttgattgggaagagaaaa

SEQ ID NO: 669539 - DNA, 20 bp, Artificial
  CRISPR gRNA sequence
gattgggaagagaaaagaga

SEQ ID NO: 669540 - DNA, 20 bp, Artificial
  CRISPR gRNA sequence
attgggaagagaaaagagat

SEQ ID NO: 669541 - DNA, 20 bp, Artificial
  CRISPR gRNA sequence
ggaagagaaaagagatttta

SEQ ID NO: 669542 - DNA, 20 bp, Artificial
  CRISPR gRNA sequence
taattttacccctgtcatgc

SEQ ID NO: 669543 - DNA, 20 bp, Artificial
  CRISPR gRNA sequence
aattttacccctgtcatgct

SEQ ID NO: 669544 - DNA, 20 bp, Artificial
  CRISPR gRNA sequence
attttacccctgtcatgctg

SEQ ID NO: 669545 - DNA, 20 bp, Artificial
  CRISPR gRNA sequence
tacccctgtcatgctgggcg

SEQ ID NO: 669546 - DNA, 20 bp, Artificial
  CRISPR gRNA sequence
acccctgtcatgctgggcga

SEQ ID NO: 669547 - DNA, 20 bp, Artificial
  CRISPR gRNA sequence
cccctgtcatgctgggcgag

SEQ ID NO: 669548 - DNA, 20 bp, Artificial
  CRISPR gRNA sequence
tcatgctgggcgagaattca

SEQ ID NO: 669549 - DNA, 20 bp, Artificial
  CRISPR gRNA sequence
ggcgagaattcactgtttca

SEQ ID NO: 669550 - DNA, 20 bp, Artificial
  CRISPR gRNA sequence
actgtttcaaaacagaactg

SEQ ID NO: 669551 - DNA, 20 bp, Artificial
  CRISPR gRNA sequence
tttcaaaacagaactgacaa

SEQ ID NO: 669552 - DNA, 20 bp, Artificial
  CRISPR gRNA sequence
caaaacagaactgacaagtg

SEQ ID NO: 669553 - DNA, 20 bp, Artificial
  CRISPR gRNA sequence
aaaacagaactgacaagtga

SEQ ID NO: 669554 - DNA, 20 bp, Artificial
  CRISPR gRNA sequence
acaagtgaatttcattaaga

SEQ ID NO: 669555 - DNA, 20 bp, Artificial
  CRISPR gRNA sequence
cattaagactgataatatgg

SEQ ID NO: 669556 - DNA, 20 bp, Artificial
  CRISPR gRNA sequence
attaagactgataatatggc

SEQ ID NO: 669557 - DNA, 20 bp, Artificial
  CRISPR gRNA sequence
agactgataatatggcaaca

SEQ ID NO: 669558 - DNA, 20 bp, Artificial
  CRISPR gRNA sequence
ataatatggcaacatagtga

SEQ ID NO: 669559 - DNA, 20 bp, Artificial
  CRISPR gRNA sequence
gcaactattatcagcatgaa

SEQ ID NO: 669560 - DNA, 20 bp, Artificial
  CRISPR gRNA sequence
caactattatcagcatgaag

SEQ ID NO: 669561 - DNA, 20 bp, Artificial
  CRISPR gRNA sequence
ttatcagcatgaagaaattt

SEQ ID NO: 669562 - DNA, 20 bp, Artificial
  CRISPR gRNA sequence
tcagcatgaagaaattttaa

SEQ ID NO: 669563 - DNA, 20 bp, Artificial
  CRISPR gRNA sequence
taaccaagctattatttttg

SEQ ID NO: 669564 - DNA, 20 bp, Artificial
  CRISPR gRNA sequence
aaccaagctattatttttga

SEQ ID NO: 669565 - DNA, 20 bp, Artificial
  CRISPR gRNA sequence
accaagctattatttttgac

SEQ ID NO: 669566 - DNA, 20 bp, Artificial
  CRISPR gRNA sequence
ttatttttgaccaatgttct

SEQ ID NO: 669567 - DNA, 20 bp, Artificial
  CRISPR gRNA sequence
tttttgaccaatgttctatt

SEQ ID NO: 669568 - DNA, 20 bp, Artificial
  CRISPR gRNA sequence
ttgaccaatgttctattact

SEQ ID NO: 669569 - DNA, 20 bp, Artificial
  CRISPR gRNA sequence
tgaccaatgttctattactt

SEQ ID NO: 669570 - DNA, 20 bp, Artificial
  CRISPR gRNA sequence
gaccaatgttctattacttg

SEQ ID NO: 669571 - DNA, 20 bp, Artificial
  CRISPR gRNA sequence
accaatgttctattacttgt

SEQ ID NO: 669572 - DNA, 20 bp, Artificial
  CRISPR gRNA sequence
tattacttgtcatagcgatc

SEQ ID NO: 669573 - DNA, 20 bp, Artificial
  CRISPR gRNA sequence
ttacttgtcatagcgatctt

SEQ ID NO: 669574 - DNA, 20 bp, Artificial
  CRISPR gRNA sequence
cttgtcatagcgatcttgta

SEQ ID NO: 669575 - DNA, 20 bp, Artificial
  CRISPR gRNA sequence
gtcatagcgatcttgtatct

SEQ ID NO: 669576 - DNA, 20 bp, Artificial
  CRISPR gRNA sequence
tcatagcgatcttgtatcta

SEQ ID NO: 669577 - DNA, 20 bp, Artificial
  CRISPR gRNA sequence
gtatctaatgatggtgaata

SEQ ID NO: 669578 - DNA, 20 bp, Artificial
  CRISPR gRNA sequence
tatctaatgatggtgaatat

SEQ ID NO: 669579 - DNA, 20 bp, Artificial
  CRISPR gRNA sequence
atgatggtgaatataatggg

SEQ ID NO: 669580 - DNA, 20 bp, Artificial
  CRISPR gRNA sequence
aagaggtttcattttaggtt

SEQ ID NO: 669581 - DNA, 20 bp, Artificial
  CRISPR gRNA sequence
cattttaggttttcattcaa

SEQ ID NO: 669582 - DNA, 20 bp, Artificial
  CRISPR gRNA sequence
attttaggttttcattcaaa

SEQ ID NO: 669583 - DNA, 20 bp, Artificial
  CRISPR gRNA sequence
taggttttcattcaaaaatt

SEQ ID NO: 669584 - DNA, 20 bp, Artificial
  CRISPR gRNA sequence
aggttttcattcaaaaattg

SEQ ID NO: 669585 - DNA, 20 bp, Artificial
  CRISPR gRNA sequence
ggttttcattcaaaaattgt

SEQ ID NO: 669586 - DNA, 20 bp, Artificial
  CRISPR gRNA sequence
tcattcaaaaattgtgtgtg

SEQ ID NO: 669587 - DNA, 20 bp, Artificial
  CRISPR gRNA sequence
cattcaaaaattgtgtgtgt

SEQ ID NO: 669588 - DNA, 20 bp, Artificial
  CRISPR gRNA sequence
attcaaaaattgtgtgtgtg

SEQ ID NO: 669589 - DNA, 20 bp, Artificial
  CRISPR gRNA sequence
aaaaattgtgtgtgtgtatg

SEQ ID NO: 669590 - DNA, 20 bp, Artificial
  CRISPR gRNA sequence
tgtgtgtgtatgtgtgtgtt

SEQ ID NO: 669591 - DNA, 20 bp, Artificial
  CRISPR gRNA sequence
cattttaatatttttaggtt

SEQ ID NO: 669592 - DNA, 20 bp, Artificial
  CRISPR gRNA sequence
attttaatatttttaggttt

SEQ ID NO: 669593 - DNA, 20 bp, Artificial
  CRISPR gRNA sequence
taatatttttaggttttgct

SEQ ID NO: 669594 - DNA, 20 bp, Artificial
  CRISPR gRNA sequence
aatatttttaggttttgctt

SEQ ID NO: 669595 - DNA, 20 bp, Artificial
  CRISPR gRNA sequence
atatttttaggttttgcttg

SEQ ID NO: 669596 - DNA, 20 bp, Artificial
  CRISPR gRNA sequence
ttaggttttgcttgcattgt

SEQ ID NO: 669597 - DNA, 20 bp, Artificial
  CRISPR gRNA sequence
taggttttgcttgcattgta

SEQ ID NO: 669598 - DNA, 20 bp, Artificial
  CRISPR gRNA sequence
aggttttgcttgcattgtag

SEQ ID NO: 669599 - DNA, 20 bp, Artificial
  CRISPR gRNA sequence
ggttttgcttgcattgtagg

SEQ ID NO: 669600 - DNA, 20 bp, Artificial
  CRISPR gRNA sequence
tgcttgcattgtagggctaa

SEQ ID NO: 669601 - DNA, 20 bp, Artificial
  CRISPR gRNA sequence
gcttgcattgtagggctaag

SEQ ID NO: 669602 - DNA, 20 bp, Artificial
  CRISPR gRNA sequence
cttgcattgtagggctaagt

SEQ ID NO: 669603 - DNA, 20 bp, Artificial
  CRISPR gRNA sequence
gcattgtagggctaagttca

SEQ ID NO: 669604 - DNA, 20 bp, Artificial
  CRISPR gRNA sequence
cattgtagggctaagttcat

SEQ ID NO: 669605 - DNA, 20 bp, Artificial
  CRISPR gRNA sequence
tagggctaagttcatagtga

SEQ ID NO: 669606 - DNA, 20 bp, Artificial
  CRISPR gRNA sequence
agttcatagtgaaaaaagac

SEQ ID NO: 669607 - DNA, 20 bp, Artificial
  CRISPR gRNA sequence
atagtgaaaaaagacaatta

SEQ ID NO: 669608 - DNA, 20 bp, Artificial
  CRISPR gRNA sequence
tataattttgtttatatttg

SEQ ID NO: 669609 - DNA, 20 bp, Artificial
  CRISPR gRNA sequence
tgtttatatttgtcgtggaa

SEQ ID NO: 669610 - DNA, 20 bp, Artificial
  CRISPR gRNA sequence
gtttatatttgtcgtggaaa

SEQ ID NO: 669611 - DNA, 20 bp, Artificial
  CRISPR gRNA sequence
tttatatttgtcgtggaaac

SEQ ID NO: 669612 - DNA, 20 bp, Artificial
  CRISPR gRNA sequence
atatttgtcgtggaaacagg

SEQ ID NO: 669613 - DNA, 20 bp, Artificial
  CRISPR gRNA sequence
tatttgtcgtggaaacaggc

SEQ ID NO: 669614 - DNA, 20 bp, Artificial
  CRISPR gRNA sequence
gtcgtggaaacaggctagga

SEQ ID NO: 669615 - DNA, 20 bp, Artificial
  CRISPR gRNA sequence
tcgtggaaacaggctaggaa

SEQ ID NO: 669616 - DNA, 20 bp, Artificial
  CRISPR gRNA sequence
ggaagtattagtgagaacta

SEQ ID NO: 669617 - DNA, 20 bp, Artificial
  CRISPR gRNA sequence
gtgagaactacctgttgata

SEQ ID NO: 669618 - DNA, 20 bp, Artificial
  CRISPR gRNA sequence
cctgttgatactgacatgta

SEQ ID NO: 669619 - DNA, 20 bp, Artificial
  CRISPR gRNA sequence
ttgatactgacatgtatctt

SEQ ID NO: 669620 - DNA, 20 bp, Artificial
  CRISPR gRNA sequence
atactgacatgtatcttcaa

SEQ ID NO: 669621 - DNA, 20 bp, Artificial
  CRISPR gRNA sequence
acatgtatcttcaacagtaa

SEQ ID NO: 669622 - DNA, 20 bp, Artificial
  CRISPR gRNA sequence
caacagtaaatattctgctt

SEQ ID NO: 669623 - DNA, 20 bp, Artificial
  CRISPR gRNA sequence
aacagtaaatattctgcttt

SEQ ID NO: 669624 - DNA, 20 bp, Artificial
  CRISPR gRNA sequence
tgctttctgataaagggata

SEQ ID NO: 669625 - DNA, 20 bp, Artificial
  CRISPR gRNA sequence
ctttctgataaagggatata

SEQ ID NO: 669626 - DNA, 20 bp, Artificial
  CRISPR gRNA sequence
tctgataaagggatatatgg

SEQ ID NO: 669627 - DNA, 20 bp, Artificial
  CRISPR gRNA sequence
ctgataaagggatatatggt

SEQ ID NO: 669628 - DNA, 20 bp, Artificial
  CRISPR gRNA sequence
tgataaagggatatatggta

SEQ ID NO: 669629 - DNA, 20 bp, Artificial
  CRISPR gRNA sequence
ataaagggatatatggtagg

SEQ ID NO: 669630 - DNA, 20 bp, Artificial
  CRISPR gRNA sequence
caagtccttagttcaggaat

SEQ ID NO: 669631 - DNA, 20 bp, Artificial
  CRISPR gRNA sequence
agttcaggaatttaagtgaa

SEQ ID NO: 669632 - DNA, 20 bp, Artificial
  CRISPR gRNA sequence
gttcaggaatttaagtgaat

SEQ ID NO: 669633 - DNA, 20 bp, Artificial
  CRISPR gRNA sequence
aggaatttaagtgaattgct

SEQ ID NO: 669634 - DNA, 20 bp, Artificial
  CRISPR gRNA sequence
aagtgaattgctgtgagcct

SEQ ID NO: 669635 - DNA, 20 bp, Artificial
  CRISPR gRNA sequence
agtgaattgctgtgagcctt

SEQ ID NO: 669636 - DNA, 20 bp, Artificial
  CRISPR gRNA sequence
ctgtgagcctttcttcttcc

SEQ ID NO: 669637 - DNA, 20 bp, Artificial
  CRISPR gRNA sequence
tgagcctttcttcttcccaa

SEQ ID NO: 669638 - DNA, 20 bp, Artificial
  CRISPR gRNA sequence
tcttcttcccaattctgtgc

SEQ ID NO: 669639 - DNA, 20 bp, Artificial
  CRISPR gRNA sequence
cttcttcccaattctgtgcc

SEQ ID NO: 669640 - DNA, 20 bp, Artificial
  CRISPR gRNA sequence
ttcttcccaattctgtgcct

SEQ ID NO: 669641 - DNA, 20 bp, Artificial
  CRISPR gRNA sequence
cttcccaattctgtgccttt

SEQ ID NO: 669642 - DNA, 20 bp, Artificial
  CRISPR gRNA sequence
ttcccaattctgtgccttta

SEQ ID NO: 669643 - DNA, 20 bp, Artificial
  CRISPR gRNA sequence
cccaattctgtgcctttata

SEQ ID NO: 669644 - DNA, 20 bp, Artificial
  CRISPR gRNA sequence
ccaattctgtgcctttatac

SEQ ID NO: 669645 - DNA, 20 bp, Artificial
  CRISPR gRNA sequence
tgtgcctttatacttctcct

SEQ ID NO: 669646 - DNA, 20 bp, Artificial
  CRISPR gRNA sequence
tgcctttatacttctccttc

SEQ ID NO: 669647 - DNA, 20 bp, Artificial
  CRISPR gRNA sequence
tatacttctccttccacaca

SEQ ID NO: 669648 - DNA, 20 bp, Artificial
  CRISPR gRNA sequence
atacttctccttccacacag

SEQ ID NO: 669649 - DNA, 20 bp, Artificial
  CRISPR gRNA sequence
tacttctccttccacacaga

SEQ ID NO: 669650 - DNA, 20 bp, Artificial
  CRISPR gRNA sequence
ctccttccacacagacagac

SEQ ID NO: 669651 - DNA, 20 bp, Artificial
  CRISPR gRNA sequence
tccttccacacagacagaca

SEQ ID NO: 669652 - DNA, 20 bp, Artificial
  CRISPR gRNA sequence
cttccacacagacagacact

SEQ ID NO: 669653 - DNA, 20 bp, Artificial
  CRISPR gRNA sequence
ccacacagacagacacttgt

SEQ ID NO: 669654 - DNA, 20 bp, Artificial
  CRISPR gRNA sequence
cacacagacagacacttgta

SEQ ID NO: 669655 - DNA, 20 bp, Artificial
  CRISPR gRNA sequence
gtagtgggattgtgatctct

SEQ ID NO: 669656 - DNA, 20 bp, Artificial
  CRISPR gRNA sequence
tagtgggattgtgatctctt

SEQ ID NO: 669657 - DNA, 20 bp, Artificial
  CRISPR gRNA sequence
tgatctcttcttgtctccac

SEQ ID NO: 669658 - DNA, 20 bp, Artificial
  CRISPR gRNA sequence
ttcttgtctccacctaatat

SEQ ID NO: 669659 - DNA, 20 bp, Artificial
  CRISPR gRNA sequence
cttgtctccacctaatataa

SEQ ID NO: 669660 - DNA, 20 bp, Artificial
  CRISPR gRNA sequence
ttgtctccacctaatataaa

SEQ ID NO: 669661 - DNA, 20 bp, Artificial
  CRISPR gRNA sequence
gtctccacctaatataaaca

SEQ ID NO: 669662 - DNA, 20 bp, Artificial
  CRISPR gRNA sequence
tctccacctaatataaacag

SEQ ID NO: 669663 - DNA, 20 bp, Artificial
  CRISPR gRNA sequence
cacctaatataaacagaata

SEQ ID NO: 669664 - DNA, 20 bp, Artificial
  CRISPR gRNA sequence
atataaacagaatatgaagt

SEQ ID NO: 669665 - DNA, 20 bp, Artificial
  CRISPR gRNA sequence
ggactatggcttgattgtta

SEQ ID NO: 669666 - DNA, 20 bp, Artificial
  CRISPR gRNA sequence
tggcttgattgttactgtat

SEQ ID NO: 669667 - DNA, 20 bp, Artificial
  CRISPR gRNA sequence
gattgttactgtatctttag

SEQ ID NO: 669668 - DNA, 20 bp, Artificial
  CRISPR gRNA sequence
attgttactgtatctttagt

SEQ ID NO: 669669 - DNA, 20 bp, Artificial
  CRISPR gRNA sequence
ttactgtatctttagtgctt

SEQ ID NO: 669670 - DNA, 20 bp, Artificial
  CRISPR gRNA sequence
ctgtatctttagtgcttagc

SEQ ID NO: 669671 - DNA, 20 bp, Artificial
  CRISPR gRNA sequence
tatctttagtgcttagcagt

SEQ ID NO: 669672 - DNA, 20 bp, Artificial
  CRISPR gRNA sequence
tagtgcttagcagtgtgtcc

SEQ ID NO: 669673 - DNA, 20 bp, Artificial
  CRISPR gRNA sequence
agtgcttagcagtgtgtccg

SEQ ID NO: 669674 - DNA, 20 bp, Artificial
  CRISPR gRNA sequence
gtgcttagcagtgtgtccgg

SEQ ID NO: 669675 - DNA, 20 bp, Artificial
  CRISPR gRNA sequence
agcagtgtgtccggtacaaa

SEQ ID NO: 669676 - DNA, 20 bp, Artificial
  CRISPR gRNA sequence
gcagtgtgtccggtacaaaa

SEQ ID NO: 669677 - DNA, 20 bp, Artificial
  CRISPR gRNA sequence
accccataaatatttgttga

SEQ ID NO: 669678 - DNA, 20 bp, Artificial
  CRISPR gRNA sequence
ccccataaatatttgttgag

SEQ ID NO: 669679 - DNA, 20 bp, Artificial
  CRISPR gRNA sequence
gttgagtgaaggaatgaaca

SEQ ID NO: 669680 - DNA, 20 bp, Artificial
  CRISPR gRNA sequence
ttgagtgaaggaatgaacac

SEQ ID NO: 669681 - DNA, 20 bp, Artificial
  CRISPR gRNA sequence
agtgaaggaatgaacactca

SEQ ID NO: 669682 - DNA, 20 bp, Artificial
  CRISPR gRNA sequence
acattttatcaccttgaaac

SEQ ID NO: 669683 - DNA, 20 bp, Artificial
  CRISPR gRNA sequence
tatcaccttgaaaccgggcg

SEQ ID NO: 669684 - DNA, 20 bp, Artificial
  CRISPR gRNA sequence
atcaccttgaaaccgggcgt

SEQ ID NO: 669685 - DNA, 20 bp, Artificial
  CRISPR gRNA sequence
tcaccttgaaaccgggcgta

SEQ ID NO: 669686 - DNA, 20 bp, Artificial
  CRISPR gRNA sequence
gaaaccgggcgtaaaagccc

SEQ ID NO: 669687 - DNA, 20 bp, Artificial
  CRISPR gRNA sequence
aaaccgggcgtaaaagccca

SEQ ID NO: 669688 - DNA, 20 bp, Artificial
  CRISPR gRNA sequence
ttaaactcactcgttacatt

SEQ ID NO: 669689 - DNA, 20 bp, Artificial
  CRISPR gRNA sequence
aaactcactcgttacattca

SEQ ID NO: 669690 - DNA, 20 bp, Artificial
  CRISPR gRNA sequence
aactcactcgttacattcaa

SEQ ID NO: 669691 - DNA, 20 bp, Artificial
  CRISPR gRNA sequence
actcgttacattcaattcct

SEQ ID NO: 669692 - DNA, 20 bp, Artificial
  CRISPR gRNA sequence
gttacattcaattccttttc

SEQ ID NO: 669693 - DNA, 20 bp, Artificial
  CRISPR gRNA sequence
cattcaattccttttctctg

SEQ ID NO: 669694 - DNA, 20 bp, Artificial
  CRISPR gRNA sequence
aattccttttctctgcagat

SEQ ID NO: 669695 - DNA, 20 bp, Artificial
  CRISPR gRNA sequence
cttttctctgcagattcttt

SEQ ID NO: 669696 - DNA, 20 bp, Artificial
  CRISPR gRNA sequence
ttctctgcagattctttgca

SEQ ID NO: 669697 - DNA, 20 bp, Artificial
  CRISPR gRNA sequence
tctctgcagattctttgcat

SEQ ID NO: 669698 - DNA, 20 bp, Artificial
  CRISPR gRNA sequence
ctctgcagattctttgcatt

SEQ ID NO: 669699 - DNA, 20 bp, Artificial
  CRISPR gRNA sequence
tctgcagattctttgcattt

SEQ ID NO: 669700 - DNA, 20 bp, Artificial
  CRISPR gRNA sequence
tgcagattctttgcattttt

SEQ ID NO: 669701 - DNA, 20 bp, Artificial
  CRISPR gRNA sequence
cagattctttgcatttttct

SEQ ID NO: 669702 - DNA, 20 bp, Artificial
  CRISPR gRNA sequence
tttgcatttttctgtttatt

SEQ ID NO: 669703 - DNA, 20 bp, Artificial
  CRISPR gRNA sequence
tgcatttttctgtttatttt

SEQ ID NO: 669704 - DNA, 20 bp, Artificial
  CRISPR gRNA sequence
gcatttttctgtttattttg

SEQ ID NO: 669705 - DNA, 20 bp, Artificial
  CRISPR gRNA sequence
catttttctgtttattttgt

SEQ ID NO: 669706 - DNA, 20 bp, Artificial
  CRISPR gRNA sequence
ttctgtttattttgttgcat

SEQ ID NO: 669707 - DNA, 20 bp, Artificial
  CRISPR gRNA sequence
tctgtttattttgttgcatt

SEQ ID NO: 669708 - DNA, 20 bp, Artificial
  CRISPR gRNA sequence
ctgtttattttgttgcattt

SEQ ID NO: 669709 - DNA, 20 bp, Artificial
  CRISPR gRNA sequence
tgtttattttgttgcatttc

SEQ ID NO: 669710 - DNA, 20 bp, Artificial
  CRISPR gRNA sequence
tttattttgttgcatttcac

SEQ ID NO: 669711 - DNA, 20 bp, Artificial
  CRISPR gRNA sequence
attttgttgcatttcacttg

SEQ ID NO: 669712 - DNA, 20 bp, Artificial
  CRISPR gRNA sequence
ttttgttgcatttcacttgt

SEQ ID NO: 669713 - DNA, 20 bp, Artificial
  CRISPR gRNA sequence
tgttgcatttcacttgtttg

SEQ ID NO: 669714 - DNA, 20 bp, Artificial
  CRISPR gRNA sequence
gttgcatttcacttgtttgc

SEQ ID NO: 669715 - DNA, 20 bp, Artificial
  CRISPR gRNA sequence
ttgcatttcacttgtttgcc

SEQ ID NO: 669716 - DNA, 20 bp, Artificial
  CRISPR gRNA sequence
catttcacttgtttgcctat

SEQ ID NO: 669717 - DNA, 20 bp, Artificial
  CRISPR gRNA sequence
cacttgtttgcctattactt

SEQ ID NO: 669718 - DNA, 20 bp, Artificial
  CRISPR gRNA sequence
acttgtttgcctattactta

SEQ ID NO: 669719 - DNA, 20 bp, Artificial
  CRISPR gRNA sequence
gtttgcctattacttagtaa

SEQ ID NO: 669720 - DNA, 20 bp, Artificial
  CRISPR gRNA sequence
tttgcctattacttagtaaa

SEQ ID NO: 669721 - DNA, 20 bp, Artificial
  CRISPR gRNA sequence
gcctattacttagtaaatga

SEQ ID NO: 669722 - DNA, 20 bp, Artificial
  CRISPR gRNA sequence
cctattacttagtaaatgag

SEQ ID NO: 669723 - DNA, 20 bp, Artificial
  CRISPR gRNA sequence
ttacttagtaaatgagcttg

SEQ ID NO: 669724 - DNA, 20 bp, Artificial
  CRISPR gRNA sequence
cttagtaaatgagcttgtgt

SEQ ID NO: 669725 - DNA, 20 bp, Artificial
  CRISPR gRNA sequence
agtaaatgagcttgtgtttt

SEQ ID NO: 669726 - DNA, 20 bp, Artificial
  CRISPR gRNA sequence
gtaaatgagcttgtgttttt

SEQ ID NO: 669727 - DNA, 20 bp, Artificial
  CRISPR gRNA sequence
gtgtttttaaatgttgtata

SEQ ID NO: 669728 - DNA, 20 bp, Artificial
  CRISPR gRNA sequence
tgtttttaaatgttgtatat

SEQ ID NO: 669729 - DNA, 20 bp, Artificial
  CRISPR gRNA sequence
ttaaatgttgtatattttta

SEQ ID NO: 669730 - DNA, 20 bp, Artificial
  CRISPR gRNA sequence
taaatgttgtatatttttat

SEQ ID NO: 669731 - DNA, 20 bp, Artificial
  CRISPR gRNA sequence
aaatgttgtatatttttatt

SEQ ID NO: 669732 - DNA, 20 bp, Artificial
  CRISPR gRNA sequence
aatgttgtatatttttattc

SEQ ID NO: 669733 - DNA, 20 bp, Artificial
  CRISPR gRNA sequence
tatatttttattccgtaata

SEQ ID NO: 669734 - DNA, 20 bp, Artificial
  CRISPR gRNA sequence
ttattccgtaatattcagat

SEQ ID NO: 669735 - DNA, 20 bp, Artificial
  CRISPR gRNA sequence
tattccgtaatattcagata

SEQ ID NO: 669736 - DNA, 20 bp, Artificial
  CRISPR gRNA sequence
attccgtaatattcagatat

SEQ ID NO: 669737 - DNA, 20 bp, Artificial
  CRISPR gRNA sequence
ttccgtaatattcagatatc

SEQ ID NO: 669738 - DNA, 20 bp, Artificial
  CRISPR gRNA sequence
cgtaatattcagatatcagt

SEQ ID NO: 669739 - DNA, 20 bp, Artificial
  CRISPR gRNA sequence
agatatcagttactaataaa

SEQ ID NO: 669740 - DNA, 20 bp, Artificial
  CRISPR gRNA sequence
ctaataaatatttgtttgta

SEQ ID NO: 669741 - DNA, 20 bp, Artificial
  CRISPR gRNA sequence
ataaatatttgtttgtatag

SEQ ID NO: 669742 - DNA, 20 bp, Artificial
  CRISPR gRNA sequence
gtttgtatagtatctagtaa

SEQ ID NO: 669743 - DNA, 20 bp, Artificial
  CRISPR gRNA sequence
tttgtatagtatctagtaaa

SEQ ID NO: 669744 - DNA, 20 bp, Artificial
  CRISPR gRNA sequence
gtatagtatctagtaaaata

SEQ ID NO: 669745 - DNA, 20 bp, Artificial
  CRISPR gRNA sequence
tatagtatctagtaaaatat

SEQ ID NO: 669746 - DNA, 20 bp, Artificial
  CRISPR gRNA sequence
gtaaaatataaatggcccca

SEQ ID NO: 669747 - DNA, 20 bp, Artificial
  CRISPR gRNA sequence
atggaaaaagactttgaatt

SEQ ID NO: 669748 - DNA, 20 bp, Artificial
  CRISPR gRNA sequence
tgaattcccatatttgtaga

SEQ ID NO: 669749 - DNA, 20 bp, Artificial
  CRISPR gRNA sequence
gaattcccatatttgtagaa

SEQ ID NO: 669750 - DNA, 20 bp, Artificial
  CRISPR gRNA sequence
aattcccatatttgtagaaa

SEQ ID NO: 669751 - DNA, 20 bp, Artificial
  CRISPR gRNA sequence
ccatatttgtagaaacattt

SEQ ID NO: 669752 - DNA, 20 bp, Artificial
  CRISPR gRNA sequence
gtagaaacattttcccccaa

SEQ ID NO: 669753 - DNA, 20 bp, Artificial
  CRISPR gRNA sequence
tagaaacattttcccccaac

SEQ ID NO: 669754 - DNA, 20 bp, Artificial
  CRISPR gRNA sequence
tcccccaacttggtttcttt

SEQ ID NO: 669755 - DNA, 20 bp, Artificial
  CRISPR gRNA sequence
cccccaacttggtttctttt

SEQ ID NO: 669756 - DNA, 20 bp, Artificial
  CRISPR gRNA sequence
ccccaacttggtttctttta

SEQ ID NO: 669757 - DNA, 20 bp, Artificial
  CRISPR gRNA sequence
ggtttcttttatagccagtg

SEQ ID NO: 669758 - DNA, 20 bp, Artificial
  CRISPR gRNA sequence
gtttcttttatagccagtga

SEQ ID NO: 669759 - DNA, 20 bp, Artificial
  CRISPR gRNA sequence
cttttatagccagtgatata

SEQ ID NO: 669760 - DNA, 20 bp, Artificial
  CRISPR gRNA sequence
ttttatagccagtgatatac

SEQ ID NO: 669761 - DNA, 20 bp, Artificial
  CRISPR gRNA sequence
ttatagccagtgatatacat

SEQ ID NO: 669762 - DNA, 20 bp, Artificial
  CRISPR gRNA sequence
tatagccagtgatatacata

SEQ ID NO: 669763 - DNA, 20 bp, Artificial
  CRISPR gRNA sequence
atagccagtgatatacataa

SEQ ID NO: 669764 - DNA, 20 bp, Artificial
  CRISPR gRNA sequence
tagccagtgatatacataat

SEQ ID NO: 669765 - DNA, 20 bp, Artificial
  CRISPR gRNA sequence
ggctggttcagacacacagt

SEQ ID NO: 669766 - DNA, 20 bp, Artificial
  CRISPR gRNA sequence
gctggttcagacacacagta

SEQ ID NO: 669767 - DNA, 20 bp, Artificial
  CRISPR gRNA sequence
gttcagacacacagtattat

SEQ ID NO: 669768 - DNA, 20 bp, Artificial
  CRISPR gRNA sequence
agacacacagtattattcaa

SEQ ID NO: 669769 - DNA, 20 bp, Artificial
  CRISPR gRNA sequence
ttcaacattgtgatgtggtc

SEQ ID NO: 669770 - DNA, 20 bp, Artificial
  CRISPR gRNA sequence
aacattgtgatgtggtcctg

SEQ ID NO: 669771 - DNA, 20 bp, Artificial
  CRISPR gRNA sequence
tgatgtggtcctgatcctca

SEQ ID NO: 669772 - DNA, 20 bp, Artificial
  CRISPR gRNA sequence
atcctcagcttccttttgta

SEQ ID NO: 669773 - DNA, 20 bp, Artificial
  CRISPR gRNA sequence
agcttccttttgtataaaat

SEQ ID NO: 669774 - DNA, 20 bp, Artificial
  CRISPR gRNA sequence
ccttttgtataaaatgaaac

SEQ ID NO: 669775 - DNA, 20 bp, Artificial
  CRISPR gRNA sequence
cttttgtataaaatgaaact

SEQ ID NO: 669776 - DNA, 20 bp, Artificial
  CRISPR gRNA sequence
ttgtataaaatgaaactaat

SEQ ID NO: 669777 - DNA, 20 bp, Artificial
  CRISPR gRNA sequence
tgtataaaatgaaactaata

SEQ ID NO: 669778 - DNA, 20 bp, Artificial
  CRISPR gRNA sequence
gtataaaatgaaactaatac

SEQ ID NO: 669779 - DNA, 20 bp, Artificial
  CRISPR gRNA sequence
tataaaatgaaactaatact

SEQ ID NO: 669780 - DNA, 20 bp, Artificial
  CRISPR gRNA sequence
atacttattggaaagatttg

SEQ ID NO: 669781 - DNA, 20 bp, Artificial
  CRISPR gRNA sequence
attggaaagatttgtttggt

SEQ ID NO: 669782 - DNA, 20 bp, Artificial
  CRISPR gRNA sequence
ttggaaagatttgtttggta

SEQ ID NO: 669783 - DNA, 20 bp, Artificial
  CRISPR gRNA sequence
gaaagatttgtttggtaatt

SEQ ID NO: 669784 - DNA, 20 bp, Artificial
  CRISPR gRNA sequence
gtttggtaattaaatggcta

SEQ ID NO: 669785 - DNA, 20 bp, Artificial
  CRISPR gRNA sequence
tttggtaattaaatggctaa

SEQ ID NO: 669786 - DNA, 20 bp, Artificial
  CRISPR gRNA sequence
ggtaattaaatggctaatgt

SEQ ID NO: 669787 - DNA, 20 bp, Artificial
  CRISPR gRNA sequence
gtaattaaatggctaatgtt

SEQ ID NO: 669788 - DNA, 20 bp, Artificial
  CRISPR gRNA sequence
aatggctaatgttgaaggac

SEQ ID NO: 669789 - DNA, 20 bp, Artificial
  CRISPR gRNA sequence
atgttgaaggacgcccaact

SEQ ID NO: 669790 - DNA, 20 bp, Artificial
  CRISPR gRNA sequence
aaggacgcccaactaaatgc

SEQ ID NO: 669791 - DNA, 20 bp, Artificial
  CRISPR gRNA sequence
aatgcaccttcactagatgt

SEQ ID NO: 669792 - DNA, 20 bp, Artificial
  CRISPR gRNA sequence
cactagatgttagtactttt

SEQ ID NO: 669793 - DNA, 20 bp, Artificial
  CRISPR gRNA sequence
actagatgttagtacttttc

SEQ ID NO: 669794 - DNA, 20 bp, Artificial
  CRISPR gRNA sequence
gatgttagtacttttccctc

SEQ ID NO: 669795 - DNA, 20 bp, Artificial
  CRISPR gRNA sequence
gtacttttccctctctgttc

SEQ ID NO: 669796 - DNA, 20 bp, Artificial
  CRISPR gRNA sequence
ttccctctctgttcatttgt

SEQ ID NO: 669797 - DNA, 20 bp, Artificial
  CRISPR gRNA sequence
tccctctctgttcatttgtt

SEQ ID NO: 669798 - DNA, 20 bp, Artificial
  CRISPR gRNA sequence
ccctctctgttcatttgttc

SEQ ID NO: 669799 - DNA, 20 bp, Artificial
  CRISPR gRNA sequence
cctctctgttcatttgttcc

SEQ ID NO: 669800 - DNA, 20 bp, Artificial
  CRISPR gRNA sequence
tctgttcatttgttccttcc

SEQ ID NO: 669801 - DNA, 20 bp, Artificial
  CRISPR gRNA sequence
tgttcatttgttccttccat

SEQ ID NO: 669802 - DNA, 20 bp, Artificial
  CRISPR gRNA sequence
ttcatttgttccttccattg

SEQ ID NO: 669803 - DNA, 20 bp, Artificial
  CRISPR gRNA sequence
atttgttccttccattgcta

SEQ ID NO: 669804 - DNA, 20 bp, Artificial
  CRISPR gRNA sequence
gttccttccattgctaccaa

SEQ ID NO: 669805 - DNA, 20 bp, Artificial
  CRISPR gRNA sequence
ttccttccattgctaccaat

SEQ ID NO: 669806 - DNA, 20 bp, Artificial
  CRISPR gRNA sequence
cttccattgctaccaatttc

SEQ ID NO: 669807 - DNA, 20 bp, Artificial
  CRISPR gRNA sequence
ccattgctaccaatttcaca

SEQ ID NO: 669808 - DNA, 20 bp, Artificial
  CRISPR gRNA sequence
cattgctaccaatttcacaa

SEQ ID NO: 669809 - DNA, 20 bp, Artificial
  CRISPR gRNA sequence
ctaccaatttcacaaaacta

SEQ ID NO: 669810 - DNA, 20 bp, Artificial
  CRISPR gRNA sequence
ccaatttcacaaaactagcc

SEQ ID NO: 669811 - DNA, 20 bp, Artificial
  CRISPR gRNA sequence
cacaaaactagcccacagaa

SEQ ID NO: 669812 - DNA, 20 bp, Artificial
  CRISPR gRNA sequence
acaaaactagcccacagaat

SEQ ID NO: 669813 - DNA, 20 bp, Artificial
  CRISPR gRNA sequence
gcccacagaataataaattc

SEQ ID NO: 669814 - DNA, 20 bp, Artificial
  CRISPR gRNA sequence
ctgtggccctattggccctg

SEQ ID NO: 669815 - DNA, 20 bp, Artificial
  CRISPR gRNA sequence
tggccctattggccctggat

SEQ ID NO: 669816 - DNA, 20 bp, Artificial
  CRISPR gRNA sequence
ttggccctggattttaacct

SEQ ID NO: 669817 - DNA, 20 bp, Artificial
  CRISPR gRNA sequence
gccctggattttaaccttta

SEQ ID NO: 669818 - DNA, 20 bp, Artificial
  CRISPR gRNA sequence
gattttaacctttaagggcc

SEQ ID NO: 669819 - DNA, 20 bp, Artificial
  CRISPR gRNA sequence
taacctttaagggccttaaa

SEQ ID NO: 669820 - DNA, 20 bp, Artificial
  CRISPR gRNA sequence
aacctttaagggccttaaac

SEQ ID NO: 669821 - DNA, 20 bp, Artificial
  CRISPR gRNA sequence
acctttaagggccttaaacc

SEQ ID NO: 669822 - DNA, 20 bp, Artificial
  CRISPR gRNA sequence
taagggccttaaacctttct

SEQ ID NO: 669823 - DNA, 20 bp, Artificial
  CRISPR gRNA sequence
aagggccttaaacctttctt

SEQ ID NO: 669824 - DNA, 20 bp, Artificial
  CRISPR gRNA sequence
agggccttaaacctttcttt

SEQ ID NO: 669825 - DNA, 20 bp, Artificial
  CRISPR gRNA sequence
aaacctttcttttccagcag

SEQ ID NO: 669826 - DNA, 20 bp, Artificial
  CRISPR gRNA sequence
aacctttcttttccagcagt

SEQ ID NO: 669827 - DNA, 20 bp, Artificial
  CRISPR gRNA sequence
tcttttccagcagtattatt

SEQ ID NO: 669828 - DNA, 20 bp, Artificial
  CRISPR gRNA sequence
cttttccagcagtattattt

SEQ ID NO: 669829 - DNA, 20 bp, Artificial
  CRISPR gRNA sequence
ttttccagcagtattatttt

SEQ ID NO: 669830 - DNA, 20 bp, Artificial
  CRISPR gRNA sequence
ttccagcagtattattttga

SEQ ID NO: 669831 - DNA, 20 bp, Artificial
  CRISPR gRNA sequence
tccagcagtattattttgag

SEQ ID NO: 669832 - DNA, 20 bp, Artificial
  CRISPR gRNA sequence
ccagcagtattattttgaga

SEQ ID NO: 669833 - DNA, 20 bp, Artificial
  CRISPR gRNA sequence
cagcagtattattttgagag

SEQ ID NO: 669834 - DNA, 20 bp, Artificial
  CRISPR gRNA sequence
ttttgagagacctggacacc

SEQ ID NO: 669835 - DNA, 20 bp, Artificial
  CRISPR gRNA sequence
tgagagacctggacaccgtc

SEQ ID NO: 669836 - DNA, 20 bp, Artificial
  CRISPR gRNA sequence
gagagacctggacaccgtcg

SEQ ID NO: 669837 - DNA, 20 bp, Artificial
  CRISPR gRNA sequence
agagacctggacaccgtcgt

SEQ ID NO: 669838 - DNA, 20 bp, Artificial
  CRISPR gRNA sequence
gacaccgtcgttgactctcc

SEQ ID NO: 669839 - DNA, 20 bp, Artificial
  CRISPR gRNA sequence
actctcctgtcttttccttt

SEQ ID NO: 669840 - DNA, 20 bp, Artificial
  CRISPR gRNA sequence
tcctgtcttttccttttagt

SEQ ID NO: 669841 - DNA, 20 bp, Artificial
  CRISPR gRNA sequence
ctgtcttttccttttagttc

SEQ ID NO: 669842 - DNA, 20 bp, Artificial
  CRISPR gRNA sequence
tcttttccttttagttcctc

SEQ ID NO: 669843 - DNA, 20 bp, Artificial
  CRISPR gRNA sequence
ttccttttagttcctctcaa

SEQ ID NO: 669844 - DNA, 20 bp, Artificial
  CRISPR gRNA sequence
tccttttagttcctctcaaa

SEQ ID NO: 669845 - DNA, 20 bp, Artificial
  CRISPR gRNA sequence
ccttttagttcctctcaaac

SEQ ID NO: 669846 - DNA, 20 bp, Artificial
  CRISPR gRNA sequence
cttttagttcctctcaaaca

SEQ ID NO: 669847 - DNA, 20 bp, Artificial
  CRISPR gRNA sequence
ttagttcctctcaaacactg

SEQ ID NO: 669848 - DNA, 20 bp, Artificial
  CRISPR gRNA sequence
tagttcctctcaaacactgt

SEQ ID NO: 669849 - DNA, 20 bp, Artificial
  CRISPR gRNA sequence
agttcctctcaaacactgta

SEQ ID NO: 669850 - DNA, 20 bp, Artificial
  CRISPR gRNA sequence
gttcctctcaaacactgtat

SEQ ID NO: 669851 - DNA, 20 bp, Artificial
  CRISPR gRNA sequence
ctctcaaacactgtattttg

SEQ ID NO: 669852 - DNA, 20 bp, Artificial
  CRISPR gRNA sequence
tcaaacactgtattttgcac

SEQ ID NO: 669853 - DNA, 20 bp, Artificial
  CRISPR gRNA sequence
aaacactgtattttgcactg

SEQ ID NO: 669854 - DNA, 20 bp, Artificial
  CRISPR gRNA sequence
tattttgcactgagaccgtg

SEQ ID NO: 669855 - DNA, 20 bp, Artificial
  CRISPR gRNA sequence
tgcactgagaccgtgctccc

SEQ ID NO: 669856 - DNA, 20 bp, Artificial
  CRISPR gRNA sequence
gcactgagaccgtgctccca

SEQ ID NO: 669857 - DNA, 20 bp, Artificial
  CRISPR gRNA sequence
cactgagaccgtgctcccat

SEQ ID NO: 669858 - DNA, 20 bp, Artificial
  CRISPR gRNA sequence
agaccgtgctcccatgtggc

SEQ ID NO: 669859 - DNA, 20 bp, Artificial
  CRISPR gRNA sequence
ccatgtggcgttctgtactg

SEQ ID NO: 669860 - DNA, 20 bp, Artificial
  CRISPR gRNA sequence
tgtactgtccttgtctgaga

SEQ ID NO: 669861 - DNA, 20 bp, Artificial
  CRISPR gRNA sequence
tactgtccttgtctgagaac

SEQ ID NO: 669862 - DNA, 20 bp, Artificial
  CRISPR gRNA sequence
tccttgtctgagaactgctt

SEQ ID NO: 669863 - DNA, 20 bp, Artificial
  CRISPR gRNA sequence
gtctgagaactgcttacctt

SEQ ID NO: 669864 - DNA, 20 bp, Artificial
  CRISPR gRNA sequence
tctgagaactgcttaccttg

SEQ ID NO: 669865 - DNA, 20 bp, Artificial
  CRISPR gRNA sequence
agaactgcttaccttgttag

SEQ ID NO: 669866 - DNA, 20 bp, Artificial
  CRISPR gRNA sequence
cttaccttgttaggtttgtc

SEQ ID NO: 669867 - DNA, 20 bp, Artificial
  CRISPR gRNA sequence
accttgttaggtttgtctgt

SEQ ID NO: 669868 - DNA, 20 bp, Artificial
  CRISPR gRNA sequence
ccttgttaggtttgtctgta

SEQ ID NO: 669869 - DNA, 20 bp, Artificial
  CRISPR gRNA sequence
gttaggtttgtctgtatccc

SEQ ID NO: 669870 - DNA, 20 bp, Artificial
  CRISPR gRNA sequence
ttaggtttgtctgtatcccc

SEQ ID NO: 669871 - DNA, 20 bp, Artificial
  CRISPR gRNA sequence
ggtttgtctgtatccccaac

SEQ ID NO: 669872 - DNA, 20 bp, Artificial
  CRISPR gRNA sequence
gtctgtatccccaaccagac

SEQ ID NO: 669873 - DNA, 20 bp, Artificial
  CRISPR gRNA sequence
tctgtatccccaaccagact

SEQ ID NO: 669874 - DNA, 20 bp, Artificial
  CRISPR gRNA sequence
tatccccaaccagactataa

SEQ ID NO: 669875 - DNA, 20 bp, Artificial
  CRISPR gRNA sequence
taagcctgtcttgtctagtc

SEQ ID NO: 669876 - DNA, 20 bp, Artificial
  CRISPR gRNA sequence
tcttgtctagtcctatagat

SEQ ID NO: 669877 - DNA, 20 bp, Artificial
  CRISPR gRNA sequence
gtctagtcctatagatccaa

SEQ ID NO: 669878 - DNA, 20 bp, Artificial
  CRISPR gRNA sequence
tctagtcctatagatccaat

SEQ ID NO: 669879 - DNA, 20 bp, Artificial
  CRISPR gRNA sequence
gtcctatagatccaatactt

SEQ ID NO: 669880 - DNA, 20 bp, Artificial
  CRISPR gRNA sequence
tagatccaatacttaacagt

SEQ ID NO: 669881 - DNA, 20 bp, Artificial
  CRISPR gRNA sequence
aacagtgtctagtgtgtata

SEQ ID NO: 669882 - DNA, 20 bp, Artificial
  CRISPR gRNA sequence
acagtgtctagtgtgtatac

SEQ ID NO: 669883 - DNA, 20 bp, Artificial
  CRISPR gRNA sequence
gtgtgtatactgtactctat

SEQ ID NO: 669884 - DNA, 20 bp, Artificial
  CRISPR gRNA sequence
tactctataaattggtattt

SEQ ID NO: 669885 - DNA, 20 bp, Artificial
  CRISPR gRNA sequence
tataaattggtatttgataa

SEQ ID NO: 669886 - DNA, 20 bp, Artificial
  CRISPR gRNA sequence
taaattggtatttgataaat

SEQ ID NO: 669887 - DNA, 20 bp, Artificial
  CRISPR gRNA sequence
gtatttgataaattgatttg

SEQ ID NO: 669888 - DNA, 20 bp, Artificial
  CRISPR gRNA sequence
gataaattgatttgcttatt

SEQ ID NO: 669889 - DNA, 20 bp, Artificial
  CRISPR gRNA sequence
ataaattgatttgcttattt

SEQ ID NO: 669890 - DNA, 20 bp, Artificial
  CRISPR gRNA sequence
atttgcttatttgtttttct

SEQ ID NO: 669891 - DNA, 20 bp, Artificial
  CRISPR gRNA sequence
gcttatttgtttttctgtta

SEQ ID NO: 669892 - DNA, 20 bp, Artificial
  CRISPR gRNA sequence
cttatttgtttttctgttat

SEQ ID NO: 669893 - DNA, 20 bp, Artificial
  CRISPR gRNA sequence
atttgtttttctgttattat

SEQ ID NO: 669894 - DNA, 20 bp, Artificial
  CRISPR gRNA sequence
tttgtttttctgttattatg

SEQ ID NO: 669895 - DNA, 20 bp, Artificial
  CRISPR gRNA sequence
gtttttctgttattatggga

SEQ ID NO: 669896 - DNA, 20 bp, Artificial
  CRISPR gRNA sequence
tttttctgttattatgggaa

SEQ ID NO: 669897 - DNA, 20 bp, Artificial
  CRISPR gRNA sequence
ttctgttattatgggaaagt

SEQ ID NO: 669898 - DNA, 20 bp, Artificial
  CRISPR gRNA sequence
tctgttattatgggaaagtg

SEQ ID NO: 669899 - DNA, 20 bp, Artificial
  CRISPR gRNA sequence
ctgttattatgggaaagtga

SEQ ID NO: 669900 - DNA, 20 bp, Artificial
  CRISPR gRNA sequence
tgttattatgggaaagtgat

SEQ ID NO: 669901 - DNA, 20 bp, Artificial
  CRISPR gRNA sequence
ttattatgggaaagtgatga

SEQ ID NO: 669902 - DNA, 20 bp, Artificial
  CRISPR gRNA sequence
ttatgggaaagtgatgatgg

SEQ ID NO: 669903 - DNA, 20 bp, Artificial
  CRISPR gRNA sequence
tgggaaagtgatgatggcaa

SEQ ID NO: 669904 - DNA, 20 bp, Artificial
  CRISPR gRNA sequence
aaaatcagtgaattccctga

SEQ ID NO: 669905 - DNA, 20 bp, Artificial
  CRISPR gRNA sequence
cctgatcctggaatacaatc

SEQ ID NO: 669906 - DNA, 20 bp, Artificial
  CRISPR gRNA sequence
atcctggaatacaatccagt

SEQ ID NO: 669907 - DNA, 20 bp, Artificial
  CRISPR gRNA sequence
gaatacaatccagtgacttc

SEQ ID NO: 669908 - DNA, 20 bp, Artificial
  CRISPR gRNA sequence
cccaagtccacactctttat

SEQ ID NO: 669909 - DNA, 20 bp, Artificial
  CRISPR gRNA sequence
ccaagtccacactctttata

SEQ ID NO: 669910 - DNA, 20 bp, Artificial
  CRISPR gRNA sequence
tttatatattagatgtaagt

SEQ ID NO: 669911 - DNA, 20 bp, Artificial
  CRISPR gRNA sequence
tatatattagatgtaagtag

SEQ ID NO: 669912 - DNA, 20 bp, Artificial
  CRISPR gRNA sequence
atatattagatgtaagtagt

SEQ ID NO: 669913 - DNA, 20 bp, Artificial
  CRISPR gRNA sequence
tatattagatgtaagtagta

SEQ ID NO: 669914 - DNA, 20 bp, Artificial
  CRISPR gRNA sequence
gatgtaagtagtaacaggag

SEQ ID NO: 669915 - DNA, 20 bp, Artificial
  CRISPR gRNA sequence
taatatgtaaaggaagaagc

SEQ ID NO: 669916 - DNA, 20 bp, Artificial
  CRISPR gRNA sequence
aatatgtaaaggaagaagct

SEQ ID NO: 669917 - DNA, 20 bp, Artificial
  CRISPR gRNA sequence
atatgtaaaggaagaagcta

SEQ ID NO: 669918 - DNA, 20 bp, Artificial
  CRISPR gRNA sequence
agttttctatctgtaaaagc

SEQ ID NO: 669919 - DNA, 20 bp, Artificial
  CRISPR gRNA sequence
tctatctgtaaaagctattc

SEQ ID NO: 669920 - DNA, 20 bp, Artificial
  CRISPR gRNA sequence
ctatctgtaaaagctattct

SEQ ID NO: 669921 - DNA, 20 bp, Artificial
  CRISPR gRNA sequence
tatctgtaaaagctattctt

SEQ ID NO: 669922 - DNA, 20 bp, Artificial
  CRISPR gRNA sequence
tctgtaaaagctattcttca

SEQ ID NO: 669923 - DNA, 20 bp, Artificial
  CRISPR gRNA sequence
taaaagctattcttcaggat

SEQ ID NO: 669924 - DNA, 20 bp, Artificial
  CRISPR gRNA sequence
ttcttcaggattctattcct

SEQ ID NO: 669925 - DNA, 20 bp, Artificial
  CRISPR gRNA sequence
ttcaggattctattccttaa

SEQ ID NO: 669926 - DNA, 20 bp, Artificial
  CRISPR gRNA sequence
caggattctattccttaatt

SEQ ID NO: 669927 - DNA, 20 bp, Artificial
  CRISPR gRNA sequence
aggattctattccttaattt

SEQ ID NO: 669928 - DNA, 20 bp, Artificial
  CRISPR gRNA sequence
tattccttaatttaattttg

SEQ ID NO: 669929 - DNA, 20 bp, Artificial
  CRISPR gRNA sequence
ttccttaatttaattttgct

SEQ ID NO: 669930 - DNA, 20 bp, Artificial
  CRISPR gRNA sequence
cttaatttaattttgctatg

SEQ ID NO: 669931 - DNA, 20 bp, Artificial
  CRISPR gRNA sequence
aatttaattttgctatgtag

SEQ ID NO: 669932 - DNA, 20 bp, Artificial
  CRISPR gRNA sequence
atttaattttgctatgtagt

SEQ ID NO: 669933 - DNA, 20 bp, Artificial
  CRISPR gRNA sequence
aattttgctatgtagttaaa

SEQ ID NO: 669934 - DNA, 20 bp, Artificial
  CRISPR gRNA sequence
attttgctatgtagttaaag

SEQ ID NO: 669935 - DNA, 20 bp, Artificial
  CRISPR gRNA sequence
tgctatgtagttaaagataa

SEQ ID NO: 669936 - DNA, 20 bp, Artificial
  CRISPR gRNA sequence
gctatgtagttaaagataat

SEQ ID NO: 669937 - DNA, 20 bp, Artificial
  CRISPR gRNA sequence
ctatgtagttaaagataatg

SEQ ID NO: 669938 - DNA, 20 bp, Artificial
  CRISPR gRNA sequence
tgtagttaaagataatggca

SEQ ID NO: 669939 - DNA, 20 bp, Artificial
  CRISPR gRNA sequence
aagataatggcatttaaagc

SEQ ID NO: 669940 - DNA, 20 bp, Artificial
  CRISPR gRNA sequence
aaagcttaacttgatctctt

SEQ ID NO: 669941 - DNA, 20 bp, Artificial
  CRISPR gRNA sequence
aagcttaacttgatctctta

SEQ ID NO: 669942 - DNA, 20 bp, Artificial
  CRISPR gRNA sequence
aacttgatctcttaataatg

SEQ ID NO: 669943 - DNA, 20 bp, Artificial
  CRISPR gRNA sequence
acttgatctcttaataatgg

SEQ ID NO: 669944 - DNA, 20 bp, Artificial
  CRISPR gRNA sequence
gatctcttaataatgggcat

SEQ ID NO: 669945 - DNA, 20 bp, Artificial
  CRISPR gRNA sequence
atctcttaataatgggcatc

SEQ ID NO: 669946 - DNA, 20 bp, Artificial
  CRISPR gRNA sequence
ttaataatgggcatctcttt

SEQ ID NO: 669947 - DNA, 20 bp, Artificial
  CRISPR gRNA sequence
aataatgggcatctctttcc

SEQ ID NO: 669948 - DNA, 20 bp, Artificial
  CRISPR gRNA sequence
ataatgggcatctctttccc

SEQ ID NO: 669949 - DNA, 20 bp, Artificial
  CRISPR gRNA sequence
tttcccataactaagcatag

SEQ ID NO: 669950 - DNA, 20 bp, Artificial
  CRISPR gRNA sequence
tcccataactaagcatagtt

SEQ ID NO: 669951 - DNA, 20 bp, Artificial
  CRISPR gRNA sequence
cccataactaagcatagtta

SEQ ID NO: 669952 - DNA, 20 bp, Artificial
  CRISPR gRNA sequence
ccataactaagcatagttaa

SEQ ID NO: 669953 - DNA, 20 bp, Artificial
  CRISPR gRNA sequence
agcatagttaaaatatgtcc

SEQ ID NO: 669954 - DNA, 20 bp, Artificial
  CRISPR gRNA sequence
aaatatgtcctgtgttttcc

SEQ ID NO: 669955 - DNA, 20 bp, Artificial
  CRISPR gRNA sequence
tgttttccatattatttgaa

SEQ ID NO: 669956 - DNA, 20 bp, Artificial
  CRISPR gRNA sequence
tccatattatttgaaaaact

SEQ ID NO: 669957 - DNA, 20 bp, Artificial
  CRISPR gRNA sequence
ccatattatttgaaaaacta

SEQ ID NO: 669958 - DNA, 20 bp, Artificial
  CRISPR gRNA sequence
catattatttgaaaaactat

SEQ ID NO: 669959 - DNA, 20 bp, Artificial
  CRISPR gRNA sequence
tttgaaaaactatcaggatt

SEQ ID NO: 669960 - DNA, 20 bp, Artificial
  CRISPR gRNA sequence
gaaaaactatcaggatttta

SEQ ID NO: 669961 - DNA, 20 bp, Artificial
  CRISPR gRNA sequence
aaaaactatcaggattttac

SEQ ID NO: 669962 - DNA, 20 bp, Artificial
  CRISPR gRNA sequence
tcaggattttactgtattca

SEQ ID NO: 669963 - DNA, 20 bp, Artificial
  CRISPR gRNA sequence
tactgtattcatatgaacct

SEQ ID NO: 669964 - DNA, 20 bp, Artificial
  CRISPR gRNA sequence
actgtattcatatgaacctt

SEQ ID NO: 669965 - DNA, 20 bp, Artificial
  CRISPR gRNA sequence
ctgtattcatatgaaccttg

SEQ ID NO: 669966 - DNA, 20 bp, Artificial
  CRISPR gRNA sequence
tattcatatgaaccttgtaa

SEQ ID NO: 669967 - DNA, 20 bp, Artificial
  CRISPR gRNA sequence
atatgaaccttgtaaactga

SEQ ID NO: 669968 - DNA, 20 bp, Artificial
  CRISPR gRNA sequence
gtaaactgataattcttgtg

SEQ ID NO: 669969 - DNA, 20 bp, Artificial
  CRISPR gRNA sequence
taaactgataattcttgtgt

SEQ ID NO: 669970 - DNA, 20 bp, Artificial
  CRISPR gRNA sequence
ataattcttgtgtcagctgg

SEQ ID NO: 669971 - DNA, 20 bp, Artificial
  CRISPR gRNA sequence
ttgtgtcagctggaagttta

SEQ ID NO: 669972 - DNA, 20 bp, Artificial
  CRISPR gRNA sequence
gtgtcagctggaagtttaaa

SEQ ID NO: 669973 - DNA, 20 bp, Artificial
  CRISPR gRNA sequence
tgtcagctggaagtttaaag

SEQ ID NO: 669974 - DNA, 20 bp, Artificial
  CRISPR gRNA sequence
gaagtttaaagcttcctgag

SEQ ID NO: 669975 - DNA, 20 bp, Artificial
  CRISPR gRNA sequence
aaagcttcctgagtttaagg

SEQ ID NO: 669976 - DNA, 20 bp, Artificial
  CRISPR gRNA sequence
aagcttcctgagtttaagga

SEQ ID NO: 669977 - DNA, 20 bp, Artificial
  CRISPR gRNA sequence
cctgagtttaaggaagttag

SEQ ID NO: 669978 - DNA, 20 bp, Artificial
  CRISPR gRNA sequence
ctgagtttaaggaagttagt

SEQ ID NO: 669979 - DNA, 20 bp, Artificial
  CRISPR gRNA sequence
agtttaaggaagttagttca

SEQ ID NO: 669980 - DNA, 20 bp, Artificial
  CRISPR gRNA sequence
aaggaagttagttcaaattt

SEQ ID NO: 669981 - DNA, 20 bp, Artificial
  CRISPR gRNA sequence
aggaagttagttcaaatttc

SEQ ID NO: 669982 - DNA, 20 bp, Artificial
  CRISPR gRNA sequence
gttcaaatttctgaaaggaa

SEQ ID NO: 669983 - DNA, 20 bp, Artificial
  CRISPR gRNA sequence
aaatttctgaaaggaatttt

SEQ ID NO: 669984 - DNA, 20 bp, Artificial
  CRISPR gRNA sequence
ctgaaaggaatttttttttc

SEQ ID NO: 669985 - DNA, 20 bp, Artificial
  CRISPR gRNA sequence
tgaaaggaatttttttttcc

SEQ ID NO: 669986 - DNA, 20 bp, Artificial
  CRISPR gRNA sequence
aaaggaatttttttttcctc

SEQ ID NO: 669987 - DNA, 20 bp, Artificial
  CRISPR gRNA sequence
ttttttcctctgagtgtgaa

SEQ ID NO: 669988 - DNA, 20 bp, Artificial
  CRISPR gRNA sequence
tttttcctctgagtgtgaaa

SEQ ID NO: 669989 - DNA, 20 bp, Artificial
  CRISPR gRNA sequence
ttttcctctgagtgtgaaag

SEQ ID NO: 669990 - DNA, 20 bp, Artificial
  CRISPR gRNA sequence
tttcctctgagtgtgaaagt

SEQ ID NO: 669991 - DNA, 20 bp, Artificial
  CRISPR gRNA sequence
ttcctctgagtgtgaaagtc

SEQ ID NO: 669992 - DNA, 20 bp, Artificial
  CRISPR gRNA sequence
tcctctgagtgtgaaagtca

SEQ ID NO: 669993 - DNA, 20 bp, Artificial
  CRISPR gRNA sequence
cctctgagtgtgaaagtcaa

SEQ ID NO: 669994 - DNA, 20 bp, Artificial
  CRISPR gRNA sequence
ctctgagtgtgaaagtcaaa

SEQ ID NO: 669995 - DNA, 20 bp, Artificial
  CRISPR gRNA sequence
tgagtgtgaaagtcaaacca

SEQ ID NO: 669996 - DNA, 20 bp, Artificial
  CRISPR gRNA sequence
agtgtgaaagtcaaaccaga

SEQ ID NO: 669997 - DNA, 20 bp, Artificial
  CRISPR gRNA sequence
gaatataaacttaatctcaa

SEQ ID NO: 669998 - DNA, 20 bp, Artificial
  CRISPR gRNA sequence
aatataaacttaatctcaaa

SEQ ID NO: 669999 - DNA, 20 bp, Artificial
  CRISPR gRNA sequence
aatctcaaaatgcatgaaaa

SEQ ID NO: 670000 - DNA, 20 bp, Artificial
  CRISPR gRNA sequence
atctcaaaatgcatgaaaat

SEQ ID NO: 670001 - DNA, 20 bp, Artificial
  CRISPR gRNA sequence
aaaatgcatgaaaataatgg

SEQ ID NO: 670002 - DNA, 20 bp, Artificial
  CRISPR gRNA sequence
ggtgtttatggttaaaaata

SEQ ID NO: 670003 - DNA, 20 bp, Artificial
  CRISPR gRNA sequence
atggttaaaaatatcgcaca

SEQ ID NO: 670004 - DNA, 20 bp, Artificial
  CRISPR gRNA sequence
tggttaaaaatatcgcacaa

SEQ ID NO: 670005 - DNA, 20 bp, Artificial
  CRISPR gRNA sequence
aaaatatcgcacaattaaag

SEQ ID NO: 670006 - DNA, 20 bp, Artificial
  CRISPR gRNA sequence
aaggcaggctaccttgccac

SEQ ID NO: 670007 - DNA, 20 bp, Artificial
  CRISPR gRNA sequence
ccttgccactaggtaaatta

SEQ ID NO: 670008 - DNA, 20 bp, Artificial
  CRISPR gRNA sequence
gccactaggtaaattagtca

SEQ ID NO: 670009 - DNA, 20 bp, Artificial
  CRISPR gRNA sequence
ccactaggtaaattagtcat

SEQ ID NO: 670010 - DNA, 20 bp, Artificial
  CRISPR gRNA sequence
ggtaaattagtcatgcaata

SEQ ID NO: 670011 - DNA, 20 bp, Artificial
  CRISPR gRNA sequence
gtcatgcaataggtttaatc

SEQ ID NO: 670012 - DNA, 20 bp, Artificial
  CRISPR gRNA sequence
aatctacttagaaatagcac

SEQ ID NO: 670013 - DNA, 20 bp, Artificial
  CRISPR gRNA sequence
atctacttagaaatagcact

SEQ ID NO: 670014 - DNA, 20 bp, Artificial
  CRISPR gRNA sequence
cttagaaatagcactgtgag

SEQ ID NO: 670015 - DNA, 20 bp, Artificial
  CRISPR gRNA sequence
agaaatagcactgtgaggaa

SEQ ID NO: 670016 - DNA, 20 bp, Artificial
  CRISPR gRNA sequence
gaaatagcactgtgaggaag

SEQ ID NO: 670017 - DNA, 20 bp, Artificial
  CRISPR gRNA sequence
tgaggaagaaaataaaatta

SEQ ID NO: 670018 - DNA, 20 bp, Artificial
  CRISPR gRNA sequence
attcagctgatagtgtcaga

SEQ ID NO: 670019 - DNA, 20 bp, Artificial
  CRISPR gRNA sequence
agctgatagtgtcagatcat

SEQ ID NO: 670020 - DNA, 20 bp, Artificial
  CRISPR gRNA sequence
atagtgtcagatcatggaaa

SEQ ID NO: 670021 - DNA, 20 bp, Artificial
  CRISPR gRNA sequence
actcttgccaaaaacatatt

SEQ ID NO: 670022 - DNA, 20 bp, Artificial
  CRISPR gRNA sequence
ctcttgccaaaaacatattg

SEQ ID NO: 670023 - DNA, 20 bp, Artificial
  CRISPR gRNA sequence
ttgccaaaaacatattgcta

SEQ ID NO: 670024 - DNA, 20 bp, Artificial
  CRISPR gRNA sequence
gccaaaaacatattgctaac

SEQ ID NO: 670025 - DNA, 20 bp, Artificial
  CRISPR gRNA sequence
ccaaaaacatattgctaact

SEQ ID NO: 670026 - DNA, 20 bp, Artificial
  CRISPR gRNA sequence
ctaactttgttcaggttgca

SEQ ID NO: 670027 - DNA, 20 bp, Artificial
  CRISPR gRNA sequence
actttgttcaggttgcagct

SEQ ID NO: 670028 - DNA, 20 bp, Artificial
  CRISPR gRNA sequence
tgttcaggttgcagcttttg

SEQ ID NO: 670029 - DNA, 20 bp, Artificial
  CRISPR gRNA sequence
gttcaggttgcagcttttgt

SEQ ID NO: 670030 - DNA, 20 bp, Artificial
  CRISPR gRNA sequence
ttcaggttgcagcttttgtg

SEQ ID NO: 670031 - DNA, 20 bp, Artificial
  CRISPR gRNA sequence
aggttgcagcttttgtgttt

SEQ ID NO: 670032 - DNA, 20 bp, Artificial
  CRISPR gRNA sequence
cagcttttgtgtttcattta

SEQ ID NO: 670033 - DNA, 20 bp, Artificial
  CRISPR gRNA sequence
ttgtgtttcatttaggtttc

SEQ ID NO: 670034 - DNA, 20 bp, Artificial
  CRISPR gRNA sequence
tgtgtttcatttaggtttca

SEQ ID NO: 670035 - DNA, 20 bp, Artificial
  CRISPR gRNA sequence
gtgtttcatttaggtttcag

SEQ ID NO: 670036 - DNA, 20 bp, Artificial
  CRISPR gRNA sequence
tgtttcatttaggtttcagc

SEQ ID NO: 670037 - DNA, 20 bp, Artificial
  CRISPR gRNA sequence
catttaggtttcagcttgtc

SEQ ID NO: 670038 - DNA, 20 bp, Artificial
  CRISPR gRNA sequence
atttaggtttcagcttgtcc

SEQ ID NO: 670039 - DNA, 20 bp, Artificial
  CRISPR gRNA sequence
aggtttcagcttgtcccagg

SEQ ID NO: 670040 - DNA, 20 bp, Artificial
  CRISPR gRNA sequence
ggtttcagcttgtcccagga

SEQ ID NO: 670041 - DNA, 20 bp, Artificial
  CRISPR gRNA sequence
cagcttgtcccaggaggtgt

SEQ ID NO: 670042 - DNA, 20 bp, Artificial
  CRISPR gRNA sequence
agcttgtcccaggaggtgtt

SEQ ID NO: 670043 - DNA, 20 bp, Artificial
  CRISPR gRNA sequence
gtcccaggaggtgttgctat

SEQ ID NO: 670044 - DNA, 20 bp, Artificial
  CRISPR gRNA sequence
tcccaggaggtgttgctata

SEQ ID NO: 670045 - DNA, 20 bp, Artificial
  CRISPR gRNA sequence
ctatactgtgaaggtgttag

SEQ ID NO: 670046 - DNA, 20 bp, Artificial
  CRISPR gRNA sequence
tactgtgaaggtgttaggca

SEQ ID NO: 670047 - DNA, 20 bp, Artificial
  CRISPR gRNA sequence
tgaaggtgttaggcagtgta

SEQ ID NO: 670048 - DNA, 20 bp, Artificial
  CRISPR gRNA sequence
ggcagtgtagtaatggaaca

SEQ ID NO: 670049 - DNA, 20 bp, Artificial
  CRISPR gRNA sequence
atcatttggaccttcctgga

SEQ ID NO: 670050 - DNA, 20 bp, Artificial
  CRISPR gRNA sequence
ggaccttcctggagaaacat

SEQ ID NO: 670051 - DNA, 20 bp, Artificial
  CRISPR gRNA sequence
gaccttcctggagaaacata

SEQ ID NO: 670052 - DNA, 20 bp, Artificial
  CRISPR gRNA sequence
cctggagaaacatagcttga

SEQ ID NO: 670053 - DNA, 20 bp, Artificial
  CRISPR gRNA sequence
ctggagaaacatagcttgaa

SEQ ID NO: 670054 - DNA, 20 bp, Artificial
  CRISPR gRNA sequence
gagaaacatagcttgaattt

SEQ ID NO: 670055 - DNA, 20 bp, Artificial
  CRISPR gRNA sequence
gaatttctgagtggtcagct

SEQ ID NO: 670056 - DNA, 20 bp, Artificial
  CRISPR gRNA sequence
aatttctgagtggtcagctt

SEQ ID NO: 670057 - DNA, 20 bp, Artificial
  CRISPR gRNA sequence
ctgagtggtcagcttgacat

SEQ ID NO: 670058 - DNA, 20 bp, Artificial
  CRISPR gRNA sequence
tgagtggtcagcttgacatt

SEQ ID NO: 670059 - DNA, 20 bp, Artificial
  CRISPR gRNA sequence
agtggtcagcttgacatttt

SEQ ID NO: 670060 - DNA, 20 bp, Artificial
  CRISPR gRNA sequence
gacattttaaagcagtgaga

SEQ ID NO: 670061 - DNA, 20 bp, Artificial
  CRISPR gRNA sequence
acattttaaagcagtgagaa

SEQ ID NO: 670062 - DNA, 20 bp, Artificial
  CRISPR gRNA sequence
taaagcagtgagaagttgtg

SEQ ID NO: 670063 - DNA, 20 bp, Artificial
  CRISPR gRNA sequence
aaagcagtgagaagttgtgt

SEQ ID NO: 670064 - DNA, 20 bp, Artificial
  CRISPR gRNA sequence
aagcagtgagaagttgtgtc

SEQ ID NO: 670065 - DNA, 20 bp, Artificial
  CRISPR gRNA sequence
tgtcattatttctagaatac

SEQ ID NO: 670066 - DNA, 20 bp, Artificial
  CRISPR gRNA sequence
tttctagaatactacagtag

SEQ ID NO: 670067 - DNA, 20 bp, Artificial
  CRISPR gRNA sequence
ctagaatactacagtagtta

SEQ ID NO: 670068 - DNA, 20 bp, Artificial
  CRISPR gRNA sequence
tagaatactacagtagttag

SEQ ID NO: 670069 - DNA, 20 bp, Artificial
  CRISPR gRNA sequence
gaatactacagtagttagag

SEQ ID NO: 670070 - DNA, 20 bp, Artificial
  CRISPR gRNA sequence
cagtagttagaggaaaaaga

SEQ ID NO: 670071 - DNA, 20 bp, Artificial
  CRISPR gRNA sequence
gaggaaaaagatttaaagtt

SEQ ID NO: 670072 - DNA, 20 bp, Artificial
  CRISPR gRNA sequence
aaagttcattgcggtaattg

SEQ ID NO: 670073 - DNA, 20 bp, Artificial
  CRISPR gRNA sequence
aagttcattgcggtaattgc

SEQ ID NO: 670074 - DNA, 20 bp, Artificial
  CRISPR gRNA sequence
attgcggtaattgctgtcag

SEQ ID NO: 670075 - DNA, 20 bp, Artificial
  CRISPR gRNA sequence
cggtaattgctgtcaggtgc

SEQ ID NO: 670076 - DNA, 20 bp, Artificial
  CRISPR gRNA sequence
ctgtcaggtgcttttagtaa

SEQ ID NO: 670077 - DNA, 20 bp, Artificial
  CRISPR gRNA sequence
tcaggtgcttttagtaagca

SEQ ID NO: 670078 - DNA, 20 bp, Artificial
  CRISPR gRNA sequence
ttagtaagcatgtgctgcct

SEQ ID NO: 670079 - DNA, 20 bp, Artificial
  CRISPR gRNA sequence
tagtaagcatgtgctgcctt

SEQ ID NO: 670080 - DNA, 20 bp, Artificial
  CRISPR gRNA sequence
agtaagcatgtgctgccttg

SEQ ID NO: 670081 - DNA, 20 bp, Artificial
  CRISPR gRNA sequence
gtaagcatgtgctgccttga

SEQ ID NO: 670082 - DNA, 20 bp, Artificial
  CRISPR gRNA sequence
ccttgaacaaaggcaacctg

SEQ ID NO: 670083 - DNA, 20 bp, Artificial
  CRISPR gRNA sequence
gaacaaaggcaacctgctag

SEQ ID NO: 670084 - DNA, 20 bp, Artificial
  CRISPR gRNA sequence
aacaaaggcaacctgctagg

SEQ ID NO: 670085 - DNA, 20 bp, Artificial
  CRISPR gRNA sequence
ctaggagtgtgaaagaagac

SEQ ID NO: 670086 - DNA, 20 bp, Artificial
  CRISPR gRNA sequence
ggagtgtgaaagaagacagt

SEQ ID NO: 670087 - DNA, 20 bp, Artificial
  CRISPR gRNA sequence
tggaagatgagagtgacaaa

SEQ ID NO: 670088 - DNA, 20 bp, Artificial
  CRISPR gRNA sequence
ggaagatgagagtgacaaaa

SEQ ID NO: 670089 - DNA, 20 bp, Artificial
  CRISPR gRNA sequence
gaagatgagagtgacaaaaa

SEQ ID NO: 670090 - DNA, 20 bp, Artificial
  CRISPR gRNA sequence
gggaattcttgtgctcctga

SEQ ID NO: 670091 - DNA, 20 bp, Artificial
  CRISPR gRNA sequence
ttgtgctcctgaaataattg

SEQ ID NO: 670092 - DNA, 20 bp, Artificial
  CRISPR gRNA sequence
gtgctcctgaaataattgca

SEQ ID NO: 670093 - DNA, 20 bp, Artificial
  CRISPR gRNA sequence
tgctcctgaaataattgcat

SEQ ID NO: 670094 - DNA, 20 bp, Artificial
  CRISPR gRNA sequence
ctgaaataattgcattcatt

SEQ ID NO: 670095 - DNA, 20 bp, Artificial
  CRISPR gRNA sequence
aaataattgcattcatttta

SEQ ID NO: 670096 - DNA, 20 bp, Artificial
  CRISPR gRNA sequence
cattcattttaaaggtggaa

SEQ ID NO: 670097 - DNA, 20 bp, Artificial
  CRISPR gRNA sequence
attttaaaggtggaagaaga

SEQ ID NO: 670098 - DNA, 20 bp, Artificial
  CRISPR gRNA sequence
taaaggtggaagaagattaa

SEQ ID NO: 670099 - DNA, 20 bp, Artificial
  CRISPR gRNA sequence
aaaggtggaagaagattaaa

SEQ ID NO: 670100 - DNA, 20 bp, Artificial
  CRISPR gRNA sequence
aaggtggaagaagattaaaa

SEQ ID NO: 670101 - DNA, 20 bp, Artificial
  CRISPR gRNA sequence
aaataacttttaatggttat

SEQ ID NO: 670102 - DNA, 20 bp, Artificial
  CRISPR gRNA sequence
ttaatggttattcatatgtt

SEQ ID NO: 670103 - DNA, 20 bp, Artificial
  CRISPR gRNA sequence
taatggttattcatatgttt

SEQ ID NO: 670104 - DNA, 20 bp, Artificial
  CRISPR gRNA sequence
aatggttattcatatgttta

SEQ ID NO: 670105 - DNA, 20 bp, Artificial
  CRISPR gRNA sequence
atggttattcatatgtttat

SEQ ID NO: 670106 - DNA, 20 bp, Artificial
  CRISPR gRNA sequence
ttcatatgtttatagccttt

SEQ ID NO: 670107 - DNA, 20 bp, Artificial
  CRISPR gRNA sequence
atatgtttatagcctttgag

SEQ ID NO: 670108 - DNA, 20 bp, Artificial
  CRISPR gRNA sequence
atagcctttgagaaaacaaa

SEQ ID NO: 670109 - DNA, 20 bp, Artificial
  CRISPR gRNA sequence
tagcctttgagaaaacaaag

SEQ ID NO: 670110 - DNA, 20 bp, Artificial
  CRISPR gRNA sequence
tgagaaaacaaagactttag

SEQ ID NO: 670111 - DNA, 20 bp, Artificial
  CRISPR gRNA sequence
gagaaaacaaagactttagg

SEQ ID NO: 670112 - DNA, 20 bp, Artificial
  CRISPR gRNA sequence
agaaaacaaagactttaggc

SEQ ID NO: 670113 - DNA, 20 bp, Artificial
  CRISPR gRNA sequence
taggcttctaaaactaatac

SEQ ID NO: 670114 - DNA, 20 bp, Artificial
  CRISPR gRNA sequence
aggcttctaaaactaatacc

SEQ ID NO: 670115 - DNA, 20 bp, Artificial
  CRISPR gRNA sequence
ggcttctaaaactaatacct

SEQ ID NO: 670116 - DNA, 20 bp, Artificial
  CRISPR gRNA sequence
ctaaaactaataccttacat

SEQ ID NO: 670117 - DNA, 20 bp, Artificial
  CRISPR gRNA sequence
taaaactaataccttacata

SEQ ID NO: 670118 - DNA, 20 bp, Artificial
  CRISPR gRNA sequence
aaactaataccttacataat

SEQ ID NO: 670119 - DNA, 20 bp, Artificial
  CRISPR gRNA sequence
ataccttacataatttcagt

SEQ ID NO: 670120 - DNA, 20 bp, Artificial
  CRISPR gRNA sequence
acataatttcagtaacaaag

SEQ ID NO: 670121 - DNA, 20 bp, Artificial
  CRISPR gRNA sequence
cataatttcagtaacaaaga

SEQ ID NO: 670122 - DNA, 20 bp, Artificial
  CRISPR gRNA sequence
cagtaacaaagagtacaaaa

SEQ ID NO: 670123 - DNA, 20 bp, Artificial
  CRISPR gRNA sequence
agtaacaaagagtacaaaac

SEQ ID NO: 670124 - DNA, 20 bp, Artificial
  CRISPR gRNA sequence
gtggctagcttgtcacaggg

SEQ ID NO: 670125 - DNA, 20 bp, Artificial
  CRISPR gRNA sequence
gcttgtcacagggatcaagg

SEQ ID NO: 670126 - DNA, 20 bp, Artificial
  CRISPR gRNA sequence
gtcacagggatcaaggtagc

SEQ ID NO: 670127 - DNA, 20 bp, Artificial
  CRISPR gRNA sequence
tcacagggatcaaggtagct

SEQ ID NO: 670128 - DNA, 20 bp, Artificial
  CRISPR gRNA sequence
gtatcactaggctaggcaca

SEQ ID NO: 670129 - DNA, 20 bp, Artificial
  CRISPR gRNA sequence
ggctaggcacaatccatgtg

SEQ ID NO: 670130 - DNA, 20 bp, Artificial
  CRISPR gRNA sequence
ggcacaatccatgtgaagtg

SEQ ID NO: 670131 - DNA, 20 bp, Artificial
  CRISPR gRNA sequence
aggtgatccctactgtaaca

SEQ ID NO: 670132 - DNA, 20 bp, Artificial
  CRISPR gRNA sequence
ctgtaacagcattcccctcc

SEQ ID NO: 670133 - DNA, 20 bp, Artificial
  CRISPR gRNA sequence
taacagcattcccctccctg

SEQ ID NO: 670134 - DNA, 20 bp, Artificial
  CRISPR gRNA sequence
ccctccctggaaacctgcaa

SEQ ID NO: 670135 - DNA, 20 bp, Artificial
  CRISPR gRNA sequence
cctggaaacctgcaatttgc

SEQ ID NO: 670136 - DNA, 20 bp, Artificial
  CRISPR gRNA sequence
gaaacctgcaatttgcctct

SEQ ID NO: 670137 - DNA, 20 bp, Artificial
  CRISPR gRNA sequence
caatttgcctcttagtccca

SEQ ID NO: 670138 - DNA, 20 bp, Artificial
  CRISPR gRNA sequence
gcctcttagtcccagatggg

SEQ ID NO: 670139 - DNA, 20 bp, Artificial
  CRISPR gRNA sequence
cctcttagtcccagatgggg

SEQ ID NO: 670140 - DNA, 20 bp, Artificial
  CRISPR gRNA sequence
ttagtcccagatggggagga

SEQ ID NO: 670141 - DNA, 20 bp, Artificial
  CRISPR gRNA sequence
agtcccagatggggaggaaa

SEQ ID NO: 670142 - DNA, 20 bp, Artificial
  CRISPR gRNA sequence
gtcccagatggggaggaaac

SEQ ID NO: 670143 - DNA, 20 bp, Artificial
  CRISPR gRNA sequence
ccaaacagccgcaagccata

SEQ ID NO: 670144 - DNA, 20 bp, Artificial
  CRISPR gRNA sequence
acatcctgacggggacaaag

SEQ ID NO: 670145 - DNA, 20 bp, Artificial
  CRISPR gRNA sequence
acggggacaaagtagagaaa

SEQ ID NO: 670146 - DNA, 20 bp, Artificial
  CRISPR gRNA sequence
agaagagtcttcataacatt

SEQ ID NO: 670147 - DNA, 20 bp, Artificial
  CRISPR gRNA sequence
cataacattatttgagtcaa

SEQ ID NO: 670148 - DNA, 20 bp, Artificial
  CRISPR gRNA sequence
ataacattatttgagtcaag

SEQ ID NO: 670149 - DNA, 20 bp, Artificial
  CRISPR gRNA sequence
tttgagtcaaggactttatg

SEQ ID NO: 670150 - DNA, 20 bp, Artificial
  CRISPR gRNA sequence
gagtcaaggactttatgctt

SEQ ID NO: 670151 - DNA, 20 bp, Artificial
  CRISPR gRNA sequence
agtcaaggactttatgcttt

SEQ ID NO: 670152 - DNA, 20 bp, Artificial
  CRISPR gRNA sequence
tatgctttttgtgaaggttg

SEQ ID NO: 670153 - DNA, 20 bp, Artificial
  CRISPR gRNA sequence
atgctttttgtgaaggttgt

SEQ ID NO: 670154 - DNA, 20 bp, Artificial
  CRISPR gRNA sequence
tgctttttgtgaaggttgta

SEQ ID NO: 670155 - DNA, 20 bp, Artificial
  CRISPR gRNA sequence
tttgtgaaggttgtagcact

SEQ ID NO: 670156 - DNA, 20 bp, Artificial
  CRISPR gRNA sequence
ttgtgaaggttgtagcactt

SEQ ID NO: 670157 - DNA, 20 bp, Artificial
  CRISPR gRNA sequence
tgtgaaggttgtagcacttc

SEQ ID NO: 670158 - DNA, 20 bp, Artificial
  CRISPR gRNA sequence
gtgaaggttgtagcacttct

SEQ ID NO: 670159 - DNA, 20 bp, Artificial
  CRISPR gRNA sequence
tgaaggttgtagcacttctt

SEQ ID NO: 670160 - DNA, 20 bp, Artificial
  CRISPR gRNA sequence
tagcacttcttttttctttt

SEQ ID NO: 670161 - DNA, 20 bp, Artificial
  CRISPR gRNA sequence
cttttttctttttaaagttt

SEQ ID NO: 670162 - DNA, 20 bp, Artificial
  CRISPR gRNA sequence
ttttttctttttaaagtttt

SEQ ID NO: 670163 - DNA, 20 bp, Artificial
  CRISPR gRNA sequence
ttttctttttaaagttttga

SEQ ID NO: 670164 - DNA, 20 bp, Artificial
  CRISPR gRNA sequence
tttctttttaaagttttgag

SEQ ID NO: 670165 - DNA, 20 bp, Artificial
  CRISPR gRNA sequence
ttctttttaaagttttgagt

SEQ ID NO: 670166 - DNA, 20 bp, Artificial
  CRISPR gRNA sequence
tctttttaaagttttgagta

SEQ ID NO: 670167 - DNA, 20 bp, Artificial
  CRISPR gRNA sequence
ctttttaaagttttgagtat

SEQ ID NO: 670168 - DNA, 20 bp, Artificial
  CRISPR gRNA sequence
tttttaaagttttgagtatg

SEQ ID NO: 670169 - DNA, 20 bp, Artificial
  CRISPR gRNA sequence
tttaaagttttgagtatgtt

SEQ ID NO: 670170 - DNA, 20 bp, Artificial
  CRISPR gRNA sequence
ttaaagttttgagtatgttg

SEQ ID NO: 670171 - DNA, 20 bp, Artificial
  CRISPR gRNA sequence
taaagttttgagtatgttgt

SEQ ID NO: 670172 - DNA, 20 bp, Artificial
  CRISPR gRNA sequence
aaagttttgagtatgttgtg

SEQ ID NO: 670173 - DNA, 20 bp, Artificial
  CRISPR gRNA sequence
aagttttgagtatgttgtgt

SEQ ID NO: 670174 - DNA, 20 bp, Artificial
  CRISPR gRNA sequence
tgagtatgttgtgtgtgtgt

SEQ ID NO: 670175 - DNA, 20 bp, Artificial
  CRISPR gRNA sequence
gagtatgttgtgtgtgtgtg

SEQ ID NO: 670176 - DNA, 20 bp, Artificial
  CRISPR gRNA sequence
agtatgttgtgtgtgtgtgt

SEQ ID NO: 670177 - DNA, 20 bp, Artificial
  CRISPR gRNA sequence
tgtgtgtgtgtgtgtgtgtg

SEQ ID NO: 670178 - DNA, 20 bp, Artificial
  CRISPR gRNA sequence
tctccctcctggatactagc

SEQ ID NO: 670179 - DNA, 20 bp, Artificial
  CRISPR gRNA sequence
ctccctcctggatactagcc

SEQ ID NO: 670180 - DNA, 20 bp, Artificial
  CRISPR gRNA sequence
tccctcctggatactagcca

SEQ ID NO: 670181 - DNA, 20 bp, Artificial
  CRISPR gRNA sequence
cctcctggatactagccaac

SEQ ID NO: 670182 - DNA, 20 bp, Artificial
  CRISPR gRNA sequence
ctggatactagccaacattc

SEQ ID NO: 670183 - DNA, 20 bp, Artificial
  CRISPR gRNA sequence
gatactagccaacattcaac

SEQ ID NO: 670184 - DNA, 20 bp, Artificial
  CRISPR gRNA sequence
gccaacattcaactgaagga

SEQ ID NO: 670185 - DNA, 20 bp, Artificial
  CRISPR gRNA sequence
aactgaaggaaacacatggg

SEQ ID NO: 670186 - DNA, 20 bp, Artificial
  CRISPR gRNA sequence
aaggaaacacatggggatgg

SEQ ID NO: 670187 - DNA, 20 bp, Artificial
  CRISPR gRNA sequence
atcacattgcactatctttt

SEQ ID NO: 670188 - DNA, 20 bp, Artificial
  CRISPR gRNA sequence
tcacattgcactatcttttg

SEQ ID NO: 670189 - DNA, 20 bp, Artificial
  CRISPR gRNA sequence
cactatcttttgcttaagta

SEQ ID NO: 670190 - DNA, 20 bp, Artificial
  CRISPR gRNA sequence
tcttttgcttaagtagctaa

SEQ ID NO: 670191 - DNA, 20 bp, Artificial
  CRISPR gRNA sequence
ttgcttaagtagctaacatt

SEQ ID NO: 670192 - DNA, 20 bp, Artificial
  CRISPR gRNA sequence
tgcttaagtagctaacattt

SEQ ID NO: 670193 - DNA, 20 bp, Artificial
  CRISPR gRNA sequence
gcttaagtagctaacattta

SEQ ID NO: 670194 - DNA, 20 bp, Artificial
  CRISPR gRNA sequence
cttaagtagctaacatttat

SEQ ID NO: 670195 - DNA, 20 bp, Artificial
  CRISPR gRNA sequence
aagtagctaacatttattgc

SEQ ID NO: 670196 - DNA, 20 bp, Artificial
  CRISPR gRNA sequence
agtagctaacatttattgct

SEQ ID NO: 670197 - DNA, 20 bp, Artificial
  CRISPR gRNA sequence
acatttattgcttaataaag

SEQ ID NO: 670198 - DNA, 20 bp, Artificial
  CRISPR gRNA sequence
attgcttaataaagaacatc

SEQ ID NO: 670199 - DNA, 20 bp, Artificial
  CRISPR gRNA sequence
ttgcttaataaagaacatcc

SEQ ID NO: 670200 - DNA, 20 bp, Artificial
  CRISPR gRNA sequence
cttaataaagaacatcctgc

SEQ ID NO: 670201 - DNA, 20 bp, Artificial
  CRISPR gRNA sequence
aataaagaacatcctgcaca

SEQ ID NO: 670202 - DNA, 20 bp, Artificial
  CRISPR gRNA sequence
ataaagaacatcctgcacac

SEQ ID NO: 670203 - DNA, 20 bp, Artificial
  CRISPR gRNA sequence
cacacataccaactaggttt

SEQ ID NO: 670204 - DNA, 20 bp, Artificial
  CRISPR gRNA sequence
ggtttccagtatattactat

SEQ ID NO: 670205 - DNA, 20 bp, Artificial
  CRISPR gRNA sequence
ccagtatattactatgcata

SEQ ID NO: 670206 - DNA, 20 bp, Artificial
  CRISPR gRNA sequence
cagtatattactatgcatat

SEQ ID NO: 670207 - DNA, 20 bp, Artificial
  CRISPR gRNA sequence
ctatgcatatgtataaatgt

SEQ ID NO: 670208 - DNA, 20 bp, Artificial
  CRISPR gRNA sequence
tgcatatgtataaatgtaca

SEQ ID NO: 670209 - DNA, 20 bp, Artificial
  CRISPR gRNA sequence
acatttaaacatgcttttac

SEQ ID NO: 670210 - DNA, 20 bp, Artificial
  CRISPR gRNA sequence
aaacatgcttttacctatga

SEQ ID NO: 670211 - DNA, 20 bp, Artificial
  CRISPR gRNA sequence
aacatgcttttacctatgac

SEQ ID NO: 670212 - DNA, 20 bp, Artificial
  CRISPR gRNA sequence
ttacctatgaccctcagaaa

SEQ ID NO: 670213 - DNA, 20 bp, Artificial
  CRISPR gRNA sequence
tacctatgaccctcagaaac

SEQ ID NO: 670214 - DNA, 20 bp, Artificial
  CRISPR gRNA sequence
acctatgaccctcagaaaca

SEQ ID NO: 670215 - DNA, 20 bp, Artificial
  CRISPR gRNA sequence
cctatgaccctcagaaacac

SEQ ID NO: 670216 - DNA, 20 bp, Artificial
  CRISPR gRNA sequence
tgaccctcagaaacacctga

SEQ ID NO: 670217 - DNA, 20 bp, Artificial
  CRISPR gRNA sequence
agaaacacctgaacacatag

SEQ ID NO: 670218 - DNA, 20 bp, Artificial
  CRISPR gRNA sequence
aacacatagaattaggcatg

SEQ ID NO: 670219 - DNA, 20 bp, Artificial
  CRISPR gRNA sequence
ggcatgcccagacgtttcaa

SEQ ID NO: 670220 - DNA, 20 bp, Artificial
  CRISPR gRNA sequence
caaatatgtgatctaaaagg

SEQ ID NO: 670221 - DNA, 20 bp, Artificial
  CRISPR gRNA sequence
aaatatgtgatctaaaaggt

SEQ ID NO: 670222 - DNA, 20 bp, Artificial
  CRISPR gRNA sequence
aaaggtagatctttacccca

SEQ ID NO: 670223 - DNA, 20 bp, Artificial
  CRISPR gRNA sequence
taccccagattttgtataaa

SEQ ID NO: 670224 - DNA, 20 bp, Artificial
  CRISPR gRNA sequence
accccagattttgtataaat

SEQ ID NO: 670225 - DNA, 20 bp, Artificial
  CRISPR gRNA sequence
ccccagattttgtataaata

SEQ ID NO: 670226 - DNA, 20 bp, Artificial
  CRISPR gRNA sequence
tgtataaataaatttatact

SEQ ID NO: 670227 - DNA, 20 bp, Artificial
  CRISPR gRNA sequence
gtataaataaatttatacta

SEQ ID NO: 670228 - DNA, 20 bp, Artificial
  CRISPR gRNA sequence
tataaataaatttatactat

SEQ ID NO: 670229 - DNA, 20 bp, Artificial
  CRISPR gRNA sequence
atactattacttataatagt

SEQ ID NO: 670230 - DNA, 20 bp, Artificial
  CRISPR gRNA sequence
tactattacttataatagtg

SEQ ID NO: 670231 - DNA, 20 bp, Artificial
  CRISPR gRNA sequence
ttacttataatagtgaccaa

SEQ ID NO: 670232 - DNA, 20 bp, Artificial
  CRISPR gRNA sequence
cttataatagtgaccaataa

SEQ ID NO: 670233 - DNA, 20 bp, Artificial
  CRISPR gRNA sequence
ataatagtgaccaataacta

SEQ ID NO: 670234 - DNA, 20 bp, Artificial
  CRISPR gRNA sequence
taatagtgaccaataactat

SEQ ID NO: 670235 - DNA, 20 bp, Artificial
  CRISPR gRNA sequence
ttaccaattacacaaattgt

SEQ ID NO: 670236 - DNA, 20 bp, Artificial
  CRISPR gRNA sequence
ccaattacacaaattgttat

SEQ ID NO: 670237 - DNA, 20 bp, Artificial
  CRISPR gRNA sequence
cacaaattgttatttatgga

SEQ ID NO: 670238 - DNA, 20 bp, Artificial
  CRISPR gRNA sequence
ttatttatggaaaacttaaa

SEQ ID NO: 670239 - DNA, 20 bp, Artificial
  CRISPR gRNA sequence
tttatggaaaacttaaagaa

SEQ ID NO: 670240 - DNA, 20 bp, Artificial
  CRISPR gRNA sequence
atggaaaacttaaagaatag

SEQ ID NO: 670241 - DNA, 20 bp, Artificial
  CRISPR gRNA sequence
tggaaaacttaaagaatagt

SEQ ID NO: 670242 - DNA, 20 bp, Artificial
  CRISPR gRNA sequence
aaagaatagtctggttgtat

SEQ ID NO: 670243 - DNA, 20 bp, Artificial
  CRISPR gRNA sequence
aagaatagtctggttgtatt

SEQ ID NO: 670244 - DNA, 20 bp, Artificial
  CRISPR gRNA sequence
gttgtattctgtaatcatag

SEQ ID NO: 670245 - DNA, 20 bp, Artificial
  CRISPR gRNA sequence
tattctgtaatcatagatag

SEQ ID NO: 670246 - DNA, 20 bp, Artificial
  CRISPR gRNA sequence
tgtaatcatagatagatacc

SEQ ID NO: 670247 - DNA, 20 bp, Artificial
  CRISPR gRNA sequence
taatcatagatagataccat

SEQ ID NO: 670248 - DNA, 20 bp, Artificial
  CRISPR gRNA sequence
aagggaccttaagatcctta

SEQ ID NO: 670249 - DNA, 20 bp, Artificial
  CRISPR gRNA sequence
aagatccttaacctcaggca

SEQ ID NO: 670250 - DNA, 20 bp, Artificial
  CRISPR gRNA sequence
agatccttaacctcaggcag

SEQ ID NO: 670251 - DNA, 20 bp, Artificial
  CRISPR gRNA sequence
aacctcaggcaggtaggctt

SEQ ID NO: 670252 - DNA, 20 bp, Artificial
  CRISPR gRNA sequence
acctcaggcaggtaggcttt

SEQ ID NO: 670253 - DNA, 20 bp, Artificial
  CRISPR gRNA sequence
aggcaggtaggcttttaagc

SEQ ID NO: 670254 - DNA, 20 bp, Artificial
  CRISPR gRNA sequence
ttaagcattttacctgcaca

SEQ ID NO: 670255 - DNA, 20 bp, Artificial
  CRISPR gRNA sequence
taagcattttacctgcacaa

SEQ ID NO: 670256 - DNA, 20 bp, Artificial
  CRISPR gRNA sequence
aagcattttacctgcacaaa

SEQ ID NO: 670257 - DNA, 20 bp, Artificial
  CRISPR gRNA sequence
agcattttacctgcacaaat

SEQ ID NO: 670258 - DNA, 20 bp, Artificial
  CRISPR gRNA sequence
tacctgcacaaatcggtagc

SEQ ID NO: 670259 - DNA, 20 bp, Artificial
  CRISPR gRNA sequence
acctgcacaaatcggtagca

SEQ ID NO: 670260 - DNA, 20 bp, Artificial
  CRISPR gRNA sequence
cctgcacaaatcggtagcat

SEQ ID NO: 670261 - DNA, 20 bp, Artificial
  CRISPR gRNA sequence
cacaaatcggtagcattacc

SEQ ID NO: 670262 - DNA, 20 bp, Artificial
  CRISPR gRNA sequence
cctttatttcacagaaaagg

SEQ ID NO: 670263 - DNA, 20 bp, Artificial
  CRISPR gRNA sequence
tatttcacagaaaaggaagc

SEQ ID NO: 670264 - DNA, 20 bp, Artificial
  CRISPR gRNA sequence
atttcacagaaaaggaagct

SEQ ID NO: 670265 - DNA, 20 bp, Artificial
  CRISPR gRNA sequence
tttcacagaaaaggaagcta

SEQ ID NO: 670266 - DNA, 20 bp, Artificial
  CRISPR gRNA sequence
cacagaaaaggaagctaagc

SEQ ID NO: 670267 - DNA, 20 bp, Artificial
  CRISPR gRNA sequence
acagaaaaggaagctaagcc

SEQ ID NO: 670268 - DNA, 20 bp, Artificial
  CRISPR gRNA sequence
agccccttagaaggtaactt

SEQ ID NO: 670269 - DNA, 20 bp, Artificial
  CRISPR gRNA sequence
agaaggtaacttgtacaatt

SEQ ID NO: 670270 - DNA, 20 bp, Artificial
  CRISPR gRNA sequence
gaaggtaacttgtacaattc

SEQ ID NO: 670271 - DNA, 20 bp, Artificial
  CRISPR gRNA sequence
gtacaattccaggtgacata

SEQ ID NO: 670272 - DNA, 20 bp, Artificial
  CRISPR gRNA sequence
tacaattccaggtgacatag

SEQ ID NO: 670273 - DNA, 20 bp, Artificial
  CRISPR gRNA sequence
caggtgacatagatgtgatc

SEQ ID NO: 670274 - DNA, 20 bp, Artificial
  CRISPR gRNA sequence
cagtgctaaatcaccagtta

SEQ ID NO: 670275 - DNA, 20 bp, Artificial
  CRISPR gRNA sequence
agtgctaaatcaccagttaa

SEQ ID NO: 670276 - DNA, 20 bp, Artificial
  CRISPR gRNA sequence
aatcaccagttaatagaaga

SEQ ID NO: 670277 - DNA, 20 bp, Artificial
  CRISPR gRNA sequence
atagaagaaataaaacccag

SEQ ID NO: 670278 - DNA, 20 bp, Artificial
  CRISPR gRNA sequence
gtataaattttgatctactt

SEQ ID NO: 670279 - DNA, 20 bp, Artificial
  CRISPR gRNA sequence
tataaattttgatctactta

SEQ ID NO: 670280 - DNA, 20 bp, Artificial
  CRISPR gRNA sequence
tgatctacttacctgaccag

SEQ ID NO: 670281 - DNA, 20 bp, Artificial
  CRISPR gRNA sequence
gatctacttacctgaccaga

SEQ ID NO: 670282 - DNA, 20 bp, Artificial
  CRISPR gRNA sequence
atctacttacctgaccagaa

SEQ ID NO: 670283 - DNA, 20 bp, Artificial
  CRISPR gRNA sequence
cttacctgaccagaaagcat

SEQ ID NO: 670284 - DNA, 20 bp, Artificial
  CRISPR gRNA sequence
acctgaccagaaagcatcaa

SEQ ID NO: 670285 - DNA, 20 bp, Artificial
  CRISPR gRNA sequence
cctgaccagaaagcatcaag

SEQ ID NO: 670286 - DNA, 20 bp, Artificial
  CRISPR gRNA sequence
accagaaagcatcaagtatt

SEQ ID NO: 670287 - DNA, 20 bp, Artificial
  CRISPR gRNA sequence
taaaagaagtatttttaaat

SEQ ID NO: 670288 - DNA, 20 bp, Artificial
  CRISPR gRNA sequence
aaagaagtatttttaaatgg

SEQ ID NO: 670289 - DNA, 20 bp, Artificial
  CRISPR gRNA sequence
ttaaatggataaggaactct

SEQ ID NO: 670290 - DNA, 20 bp, Artificial
  CRISPR gRNA sequence
taaatggataaggaactctc

SEQ ID NO: 670291 - DNA, 20 bp, Artificial
  CRISPR gRNA sequence
aaatggataaggaactctct

SEQ ID NO: 670292 - DNA, 20 bp, Artificial
  CRISPR gRNA sequence
aatggataaggaactctctt

SEQ ID NO: 670293 - DNA, 20 bp, Artificial
  CRISPR gRNA sequence
tcttacatctgattaatgta

SEQ ID NO: 670294 - DNA, 20 bp, Artificial
  CRISPR gRNA sequence
ttacatctgattaatgtaat

SEQ ID NO: 670295 - DNA, 20 bp, Artificial
  CRISPR gRNA sequence
acatctgattaatgtaatat

SEQ ID NO: 670296 - DNA, 20 bp, Artificial
  CRISPR gRNA sequence
catctgattaatgtaatatc

SEQ ID NO: 670297 - DNA, 20 bp, Artificial
  CRISPR gRNA sequence
attaatgtaatatcatacat

SEQ ID NO: 670298 - DNA, 20 bp, Artificial
  CRISPR gRNA sequence
atgtaatatcatacatacac

SEQ ID NO: 670299 - DNA, 20 bp, Artificial
  CRISPR gRNA sequence
aaagaaagccatttatatgc

SEQ ID NO: 670300 - DNA, 20 bp, Artificial
  CRISPR gRNA sequence
atatgccctttaactatacc

SEQ ID NO: 670301 - DNA, 20 bp, Artificial
  CRISPR gRNA sequence
tatgccctttaactatacct

SEQ ID NO: 670302 - DNA, 20 bp, Artificial
  CRISPR gRNA sequence
taactataccttatatgtct

SEQ ID NO: 670303 - DNA, 20 bp, Artificial
  CRISPR gRNA sequence
aactataccttatatgtctg

SEQ ID NO: 670304 - DNA, 20 bp, Artificial
  CRISPR gRNA sequence
actataccttatatgtctgt

SEQ ID NO: 670305 - DNA, 20 bp, Artificial
  CRISPR gRNA sequence
taccttatatgtctgtctac

SEQ ID NO: 670306 - DNA, 20 bp, Artificial
  CRISPR gRNA sequence
atatgtctgtctactttgct

SEQ ID NO: 670307 - DNA, 20 bp, Artificial
  CRISPR gRNA sequence
tatgtctgtctactttgctt

SEQ ID NO: 670308 - DNA, 20 bp, Artificial
  CRISPR gRNA sequence
tctactttgctttctatggt

SEQ ID NO: 670309 - DNA, 20 bp, Artificial
  CRISPR gRNA sequence
ctttgctttctatggtgcat

SEQ ID NO: 670310 - DNA, 20 bp, Artificial
  CRISPR gRNA sequence
tgctttctatggtgcatagt

SEQ ID NO: 670311 - DNA, 20 bp, Artificial
  CRISPR gRNA sequence
gctttctatggtgcatagtc

SEQ ID NO: 670312 - DNA, 20 bp, Artificial
  CRISPR gRNA sequence
ctttctatggtgcatagtca

SEQ ID NO: 670313 - DNA, 20 bp, Artificial
  CRISPR gRNA sequence
tctatggtgcatagtcatca

SEQ ID NO: 670314 - DNA, 20 bp, Artificial
  CRISPR gRNA sequence
ctatggtgcatagtcatcac

SEQ ID NO: 670315 - DNA, 20 bp, Artificial
  CRISPR gRNA sequence
tatggtgcatagtcatcact

SEQ ID NO: 670316 - DNA, 20 bp, Artificial
  CRISPR gRNA sequence
tggtgcatagtcatcacttt

SEQ ID NO: 670317 - DNA, 20 bp, Artificial
  CRISPR gRNA sequence
taatatgtttcacatacttt

SEQ ID NO: 670318 - DNA, 20 bp, Artificial
  CRISPR gRNA sequence
aatatgtttcacatacttta

SEQ ID NO: 670319 - DNA, 20 bp, Artificial
  CRISPR gRNA sequence
atatgtttcacatactttag

SEQ ID NO: 670320 - DNA, 20 bp, Artificial
  CRISPR gRNA sequence
cacatactttagttatgagc

SEQ ID NO: 670321 - DNA, 20 bp, Artificial
  CRISPR gRNA sequence
acatactttagttatgagct

SEQ ID NO: 670322 - DNA, 20 bp, Artificial
  CRISPR gRNA sequence
tagttatgagctttagaaag

SEQ ID NO: 670323 - DNA, 20 bp, Artificial
  CRISPR gRNA sequence
agttatgagctttagaaagc

SEQ ID NO: 670324 - DNA, 20 bp, Artificial
  CRISPR gRNA sequence
gttatgagctttagaaagct

SEQ ID NO: 670325 - DNA, 20 bp, Artificial
  CRISPR gRNA sequence
tgagctttagaaagctgttt

SEQ ID NO: 670326 - DNA, 20 bp, Artificial
  CRISPR gRNA sequence
tagaaagctgtttaaatggt

SEQ ID NO: 670327 - DNA, 20 bp, Artificial
  CRISPR gRNA sequence
agaaagctgtttaaatggtg

SEQ ID NO: 670328 - DNA, 20 bp, Artificial
  CRISPR gRNA sequence
gaaagctgtttaaatggtga

SEQ ID NO: 670329 - DNA, 20 bp, Artificial
  CRISPR gRNA sequence
tttaaatggtgatttagaaa

SEQ ID NO: 670330 - DNA, 20 bp, Artificial
  CRISPR gRNA sequence
aaatggtgatttagaaatgg

SEQ ID NO: 670331 - DNA, 20 bp, Artificial
  CRISPR gRNA sequence
aatggtgatttagaaatgga

SEQ ID NO: 670332 - DNA, 20 bp, Artificial
  CRISPR gRNA sequence
agaaatggagataactcatt

SEQ ID NO: 670333 - DNA, 20 bp, Artificial
  CRISPR gRNA sequence
gaaatggagataactcattg

SEQ ID NO: 670334 - DNA, 20 bp, Artificial
  CRISPR gRNA sequence
attgaataaccaagacttca

SEQ ID NO: 670335 - DNA, 20 bp, Artificial
  CRISPR gRNA sequence
aataaccaagacttcagttc

SEQ ID NO: 670336 - DNA, 20 bp, Artificial
  CRISPR gRNA sequence
cagttcacaaatacaaggat

SEQ ID NO: 670337 - DNA, 20 bp, Artificial
  CRISPR gRNA sequence
agttcacaaatacaaggatg

SEQ ID NO: 670338 - DNA, 20 bp, Artificial
  CRISPR gRNA sequence
acaaatacaaggatggcatg

SEQ ID NO: 670339 - DNA, 20 bp, Artificial
  CRISPR gRNA sequence
aaagtaactacttacaatga

SEQ ID NO: 670340 - DNA, 20 bp, Artificial
  CRISPR gRNA sequence
aagtaactacttacaatgag

SEQ ID NO: 670341 - DNA, 20 bp, Artificial
  CRISPR gRNA sequence
cttacaatgagaagttatct

SEQ ID NO: 670342 - DNA, 20 bp, Artificial
  CRISPR gRNA sequence
acaatgagaagttatctttt

SEQ ID NO: 670343 - DNA, 20 bp, Artificial
  CRISPR gRNA sequence
caatgagaagttatcttttt

SEQ ID NO: 670344 - DNA, 20 bp, Artificial
  CRISPR gRNA sequence
tctttttgaattagtgatct

SEQ ID NO: 670345 - DNA, 20 bp, Artificial
  CRISPR gRNA sequence
tttgaattagtgatcttatg

SEQ ID NO: 670346 - DNA, 20 bp, Artificial
  CRISPR gRNA sequence
ttgaattagtgatcttatga

SEQ ID NO: 670347 - DNA, 20 bp, Artificial
  CRISPR gRNA sequence
tgaattagtgatcttatgag

SEQ ID NO: 670348 - DNA, 20 bp, Artificial
  CRISPR gRNA sequence
gaattagtgatcttatgaga

SEQ ID NO: 670349 - DNA, 20 bp, Artificial
  CRISPR gRNA sequence
aattagtgatcttatgagaa

SEQ ID NO: 670350 - DNA, 20 bp, Artificial
  CRISPR gRNA sequence
gtgatcttatgagaatattt

SEQ ID NO: 670351 - DNA, 20 bp, Artificial
  CRISPR gRNA sequence
atgagaatatttgttgatta

SEQ ID NO: 670352 - DNA, 20 bp, Artificial
  CRISPR gRNA sequence
tgagaatatttgttgattat

SEQ ID NO: 670353 - DNA, 20 bp, Artificial
  CRISPR gRNA sequence
gttgattatttatgctctat

SEQ ID NO: 670354 - DNA, 20 bp, Artificial
  CRISPR gRNA sequence
ttgattatttatgctctata

SEQ ID NO: 670355 - DNA, 20 bp, Artificial
  CRISPR gRNA sequence
attatttatgctctatattt

SEQ ID NO: 670356 - DNA, 20 bp, Artificial
  CRISPR gRNA sequence
tttatgctctatattttgca

SEQ ID NO: 670357 - DNA, 20 bp, Artificial
  CRISPR gRNA sequence
atgctctatattttgcactg

SEQ ID NO: 670358 - DNA, 20 bp, Artificial
  CRISPR gRNA sequence
tgctctatattttgcactga

SEQ ID NO: 670359 - DNA, 20 bp, Artificial
  CRISPR gRNA sequence
tatattttgcactgaggttt

SEQ ID NO: 670360 - DNA, 20 bp, Artificial
  CRISPR gRNA sequence
tattttgcactgaggtttta

SEQ ID NO: 670361 - DNA, 20 bp, Artificial
  CRISPR gRNA sequence
tgcactgaggttttatagta

SEQ ID NO: 670362 - DNA, 20 bp, Artificial
  CRISPR gRNA sequence
gcactgaggttttatagtag

SEQ ID NO: 670363 - DNA, 20 bp, Artificial
  CRISPR gRNA sequence
cactgaggttttatagtagc

SEQ ID NO: 670364 - DNA, 20 bp, Artificial
  CRISPR gRNA sequence
aggttttatagtagctgaat

SEQ ID NO: 670365 - DNA, 20 bp, Artificial
  CRISPR gRNA sequence
tatagtagctgaatattctg

SEQ ID NO: 670366 - DNA, 20 bp, Artificial
  CRISPR gRNA sequence
atagtagctgaatattctgg

SEQ ID NO: 670367 - DNA, 20 bp, Artificial
  CRISPR gRNA sequence
tagtagctgaatattctggc

SEQ ID NO: 670368 - DNA, 20 bp, Artificial
  CRISPR gRNA sequence
aatattctggcatggtggtg

SEQ ID NO: 670369 - DNA, 20 bp, Artificial
  CRISPR gRNA sequence
tggcatggtggtgtggggct

SEQ ID NO: 670370 - DNA, 20 bp, Artificial
  CRISPR gRNA sequence
gcatggtggtgtggggctta

SEQ ID NO: 670371 - DNA, 20 bp, Artificial
  CRISPR gRNA sequence
atgaatccttgtattgctca

SEQ ID NO: 670372 - DNA, 20 bp, Artificial
  CRISPR gRNA sequence
tgaatccttgtattgctcat

SEQ ID NO: 670373 - DNA, 20 bp, Artificial
  CRISPR gRNA sequence
gtattgctcattaaatattt

SEQ ID NO: 670374 - DNA, 20 bp, Artificial
  CRISPR gRNA sequence
tattgctcattaaatatttt

SEQ ID NO: 670375 - DNA, 20 bp, Artificial
  CRISPR gRNA sequence
ctcattaaatattttacagt

SEQ ID NO: 670376 - DNA, 20 bp, Artificial
  CRISPR gRNA sequence
attaaatattttacagtgca

SEQ ID NO: 670377 - DNA, 20 bp, Artificial
  CRISPR gRNA sequence
aatattttacagtgcatagt

SEQ ID NO: 670378 - DNA, 20 bp, Artificial
  CRISPR gRNA sequence
tacagtgcatagttgcttat

SEQ ID NO: 670379 - DNA, 20 bp, Artificial
  CRISPR gRNA sequence
acagtgcatagttgcttata

SEQ ID NO: 670380 - DNA, 20 bp, Artificial
  CRISPR gRNA sequence
cagtgcatagttgcttatat

SEQ ID NO: 670381 - DNA, 20 bp, Artificial
  CRISPR gRNA sequence
cttatatatataaaaagaca

SEQ ID NO: 670382 - DNA, 20 bp, Artificial
  CRISPR gRNA sequence
atatatataaaaagacagac

SEQ ID NO: 670383 - DNA, 20 bp, Artificial
  CRISPR gRNA sequence
tatatataaaaagacagaca

SEQ ID NO: 670384 - DNA, 20 bp, Artificial
  CRISPR gRNA sequence
tatgcatacctttcactagt

SEQ ID NO: 670385 - DNA, 20 bp, Artificial
  CRISPR gRNA sequence
tcactagtgccataaaagca

SEQ ID NO: 670386 - DNA, 20 bp, Artificial
  CRISPR gRNA sequence
cactagtgccataaaagcag

SEQ ID NO: 670387 - DNA, 20 bp, Artificial
  CRISPR gRNA sequence
actagtgccataaaagcagg

SEQ ID NO: 670388 - DNA, 20 bp, Artificial
  CRISPR gRNA sequence
gtgccataaaagcagggaat

SEQ ID NO: 670389 - DNA, 20 bp, Artificial
  CRISPR gRNA sequence
tcttgttcactactgcttcg

SEQ ID NO: 670390 - DNA, 20 bp, Artificial
  CRISPR gRNA sequence
gttcactactgcttcgtggt

SEQ ID NO: 670391 - DNA, 20 bp, Artificial
  CRISPR gRNA sequence
ttcactactgcttcgtggtg

SEQ ID NO: 670392 - DNA, 20 bp, Artificial
  CRISPR gRNA sequence
actactgcttcgtggtgcct

SEQ ID NO: 670393 - DNA, 20 bp, Artificial
  CRISPR gRNA sequence
ctgcttcgtggtgcctggta

SEQ ID NO: 670394 - DNA, 20 bp, Artificial
  CRISPR gRNA sequence
cttcgtggtgcctggtacag

SEQ ID NO: 670395 - DNA, 20 bp, Artificial
  CRISPR gRNA sequence
cgtggtgcctggtacagagc

SEQ ID NO: 670396 - DNA, 20 bp, Artificial
  CRISPR gRNA sequence
gtggtgcctggtacagagca

SEQ ID NO: 670397 - DNA, 20 bp, Artificial
  CRISPR gRNA sequence
gtacagagcaggtgctcagt

SEQ ID NO: 670398 - DNA, 20 bp, Artificial
  CRISPR gRNA sequence
agtgagtaattttgaatgat

SEQ ID NO: 670399 - DNA, 20 bp, Artificial
  CRISPR gRNA sequence
tgaatgatttcttaagagtt

SEQ ID NO: 670400 - DNA, 20 bp, Artificial
  CRISPR gRNA sequence
gaatgatttcttaagagttc

SEQ ID NO: 670401 - DNA, 20 bp, Artificial
  CRISPR gRNA sequence
aatgatttcttaagagttct

SEQ ID NO: 670402 - DNA, 20 bp, Artificial
  CRISPR gRNA sequence
cttaagagttcttcatactt

SEQ ID NO: 670403 - DNA, 20 bp, Artificial
  CRISPR gRNA sequence
ttaagagttcttcatacttg

SEQ ID NO: 670404 - DNA, 20 bp, Artificial
  CRISPR gRNA sequence
aagagttcttcatacttggt

SEQ ID NO: 670405 - DNA, 20 bp, Artificial
  CRISPR gRNA sequence
agagttcttcatacttggtt

SEQ ID NO: 670406 - DNA, 20 bp, Artificial
  CRISPR gRNA sequence
ttcatacttggttgtcctat

SEQ ID NO: 670407 - DNA, 20 bp, Artificial
  CRISPR gRNA sequence
catacttggttgtcctatta

SEQ ID NO: 670408 - DNA, 20 bp, Artificial
  CRISPR gRNA sequence
atacttggttgtcctattaa

SEQ ID NO: 670409 - DNA, 20 bp, Artificial
  CRISPR gRNA sequence
ggttgtcctattaataagtt

SEQ ID NO: 670410 - DNA, 20 bp, Artificial
  CRISPR gRNA sequence
gttgtcctattaataagtta

SEQ ID NO: 670411 - DNA, 20 bp, Artificial
  CRISPR gRNA sequence
tcctattaataagttaacag

SEQ ID NO: 670412 - DNA, 20 bp, Artificial
  CRISPR gRNA sequence
ttaataagttaacagcattt

SEQ ID NO: 670413 - DNA, 20 bp, Artificial
  CRISPR gRNA sequence
ataagttaacagcatttgtc

SEQ ID NO: 670414 - DNA, 20 bp, Artificial
  CRISPR gRNA sequence
acagcatttgtcttttgaaa

SEQ ID NO: 670415 - DNA, 20 bp, Artificial
  CRISPR gRNA sequence
gtcttttgaaattactgcca

SEQ ID NO: 670416 - DNA, 20 bp, Artificial
  CRISPR gRNA sequence
tcttttgaaattactgccat

SEQ ID NO: 670417 - DNA, 20 bp, Artificial
  CRISPR gRNA sequence
ttgaaattactgccattcaa

SEQ ID NO: 670418 - DNA, 20 bp, Artificial
  CRISPR gRNA sequence
tgaaattactgccattcaag

SEQ ID NO: 670419 - DNA, 20 bp, Artificial
  CRISPR gRNA sequence
gaaattactgccattcaagc

SEQ ID NO: 670420 - DNA, 20 bp, Artificial
  CRISPR gRNA sequence
aaattactgccattcaagca

SEQ ID NO: 670421 - DNA, 20 bp, Artificial
  CRISPR gRNA sequence
ctgccattcaagcattaatt

SEQ ID NO: 670422 - DNA, 20 bp, Artificial
  CRISPR gRNA sequence
ccattcaagcattaattctc

SEQ ID NO: 670423 - DNA, 20 bp, Artificial
  CRISPR gRNA sequence
aagcattaattctcttgtac

SEQ ID NO: 670424 - DNA, 20 bp, Artificial
  CRISPR gRNA sequence
attctcttgtactttgctca

SEQ ID NO: 670425 - DNA, 20 bp, Artificial
  CRISPR gRNA sequence
tcttgtactttgctcaattt

SEQ ID NO: 670426 - DNA, 20 bp, Artificial
  CRISPR gRNA sequence
ttgtactttgctcaatttta

SEQ ID NO: 670427 - DNA, 20 bp, Artificial
  CRISPR gRNA sequence
gtactttgctcaattttaaa

SEQ ID NO: 670428 - DNA, 20 bp, Artificial
  CRISPR gRNA sequence
tactttgctcaattttaaat

SEQ ID NO: 670429 - DNA, 20 bp, Artificial
  CRISPR gRNA sequence
tgctcaattttaaatgctct

SEQ ID NO: 670430 - DNA, 20 bp, Artificial
  CRISPR gRNA sequence
gctcaattttaaatgctctg

SEQ ID NO: 670431 - DNA, 20 bp, Artificial
  CRISPR gRNA sequence
ctcaattttaaatgctctgt

SEQ ID NO: 670432 - DNA, 20 bp, Artificial
  CRISPR gRNA sequence
aattttaaatgctctgtggt

SEQ ID NO: 670433 - DNA, 20 bp, Artificial
  CRISPR gRNA sequence
taaatgctctgtggttttag

SEQ ID NO: 670434 - DNA, 20 bp, Artificial
  CRISPR gRNA sequence
aaatgctctgtggttttagg

SEQ ID NO: 670435 - DNA, 20 bp, Artificial
  CRISPR gRNA sequence
aatgctctgtggttttagga

SEQ ID NO: 670436 - DNA, 20 bp, Artificial
  CRISPR gRNA sequence
tgtggttttaggatatgttc

SEQ ID NO: 670437 - DNA, 20 bp, Artificial
  CRISPR gRNA sequence
tggttttaggatatgttcta

SEQ ID NO: 670438 - DNA, 20 bp, Artificial
  CRISPR gRNA sequence
taggatatgttctattgtat

SEQ ID NO: 670439 - DNA, 20 bp, Artificial
  CRISPR gRNA sequence
aggatatgttctattgtata

SEQ ID NO: 670440 - DNA, 20 bp, Artificial
  CRISPR gRNA sequence
ggatatgttctattgtatat

SEQ ID NO: 670441 - DNA, 20 bp, Artificial
  CRISPR gRNA sequence
tattgtatattatccattga

SEQ ID NO: 670442 - DNA, 20 bp, Artificial
  CRISPR gRNA sequence
ttgtatattatccattgagt

SEQ ID NO: 670443 - DNA, 20 bp, Artificial
  CRISPR gRNA sequence
tatattatccattgagtgta

SEQ ID NO: 670444 - DNA, 20 bp, Artificial
  CRISPR gRNA sequence
tccattgagtgtatccattc

SEQ ID NO: 670445 - DNA, 20 bp, Artificial
  CRISPR gRNA sequence
agtgtatccattctggaaaa

SEQ ID NO: 670446 - DNA, 20 bp, Artificial
  CRISPR gRNA sequence
tggaaaaaatggtgtcattc

SEQ ID NO: 670447 - DNA, 20 bp, Artificial
  CRISPR gRNA sequence
gaaaaaatggtgtcattcac

SEQ ID NO: 670448 - DNA, 20 bp, Artificial
  CRISPR gRNA sequence
acaaccaacatgtactcatg

SEQ ID NO: 670449 - DNA, 20 bp, Artificial
  CRISPR gRNA sequence
atgcctttttcctctcttca

SEQ ID NO: 670450 - DNA, 20 bp, Artificial
  CRISPR gRNA sequence
tttcctctcttcatgcttgc

SEQ ID NO: 670451 - DNA, 20 bp, Artificial
  CRISPR gRNA sequence
ttcctctcttcatgcttgcc

SEQ ID NO: 670452 - DNA, 20 bp, Artificial
  CRISPR gRNA sequence
tcctctcttcatgcttgccc

SEQ ID NO: 670453 - DNA, 20 bp, Artificial
  CRISPR gRNA sequence
cctctcttcatgcttgcccc

SEQ ID NO: 670454 - DNA, 20 bp, Artificial
  CRISPR gRNA sequence
ctctcttcatgcttgcccct

SEQ ID NO: 670455 - DNA, 20 bp, Artificial
  CRISPR gRNA sequence
tcttcatgcttgcccctatc

SEQ ID NO: 670456 - DNA, 20 bp, Artificial
  CRISPR gRNA sequence
ttcatgcttgcccctatctt

SEQ ID NO: 670457 - DNA, 20 bp, Artificial
  CRISPR gRNA sequence
catgcttgcccctatcttga

SEQ ID NO: 670458 - DNA, 20 bp, Artificial
  CRISPR gRNA sequence
atgcttgcccctatcttgag

SEQ ID NO: 670459 - DNA, 20 bp, Artificial
  CRISPR gRNA sequence
gcccctatcttgagtgccat

SEQ ID NO: 670460 - DNA, 20 bp, Artificial
  CRISPR gRNA sequence
cccctatcttgagtgccatc

SEQ ID NO: 670461 - DNA, 20 bp, Artificial
  CRISPR gRNA sequence
tcttgagtgccatctagttc

SEQ ID NO: 670462 - DNA, 20 bp, Artificial
  CRISPR gRNA sequence
gagtgccatctagttcttct

SEQ ID NO: 670463 - DNA, 20 bp, Artificial
  CRISPR gRNA sequence
agtgccatctagttcttctt

SEQ ID NO: 670464 - DNA, 20 bp, Artificial
  CRISPR gRNA sequence
gttcttcttttatataagtc

SEQ ID NO: 670465 - DNA, 20 bp, Artificial
  CRISPR gRNA sequence
ttcttttatataagtcatat

SEQ ID NO: 670466 - DNA, 20 bp, Artificial
  CRISPR gRNA sequence
cttttatataagtcatatcc

SEQ ID NO: 670467 - DNA, 20 bp, Artificial
  CRISPR gRNA sequence
ttttatataagtcatatcca

SEQ ID NO: 670468 - DNA, 20 bp, Artificial
  CRISPR gRNA sequence
ttatataagtcatatccaac

SEQ ID NO: 670469 - DNA, 20 bp, Artificial
  CRISPR gRNA sequence
tatataagtcatatccaact

SEQ ID NO: 670470 - DNA, 20 bp, Artificial
  CRISPR gRNA sequence
atataagtcatatccaactt

SEQ ID NO: 670471 - DNA, 20 bp, Artificial
  CRISPR gRNA sequence
tataagtcatatccaacttt

SEQ ID NO: 670472 - DNA, 20 bp, Artificial
  CRISPR gRNA sequence
ttagtactattttacatgcc

SEQ ID NO: 670473 - DNA, 20 bp, Artificial
  CRISPR gRNA sequence
tagtactattttacatgcca

SEQ ID NO: 670474 - DNA, 20 bp, Artificial
  CRISPR gRNA sequence
agtactattttacatgccat

SEQ ID NO: 670475 - DNA, 20 bp, Artificial
  CRISPR gRNA sequence
gtactattttacatgccatt

SEQ ID NO: 670476 - DNA, 20 bp, Artificial
  CRISPR gRNA sequence
ttttacatgccatttccttc

SEQ ID NO: 670477 - DNA, 20 bp, Artificial
  CRISPR gRNA sequence
tacatgccatttccttcata

SEQ ID NO: 670478 - DNA, 20 bp, Artificial
  CRISPR gRNA sequence
acatgccatttccttcataa

SEQ ID NO: 670479 - DNA, 20 bp, Artificial
  CRISPR gRNA sequence
catgccatttccttcataaa

SEQ ID NO: 670480 - DNA, 20 bp, Artificial
  CRISPR gRNA sequence
ccttcataaagccttctgca

SEQ ID NO: 670481 - DNA, 20 bp, Artificial
  CRISPR gRNA sequence
cttcataaagccttctgcat

SEQ ID NO: 670482 - DNA, 20 bp, Artificial
  CRISPR gRNA sequence
cataaagccttctgcatctt

SEQ ID NO: 670483 - DNA, 20 bp, Artificial
  CRISPR gRNA sequence
ataaagccttctgcatcttc

SEQ ID NO: 670484 - DNA, 20 bp, Artificial
  CRISPR gRNA sequence
ctgcatcttccctgtacttc

SEQ ID NO: 670485 - DNA, 20 bp, Artificial
  CRISPR gRNA sequence
tgcatcttccctgtacttcc

SEQ ID NO: 670486 - DNA, 20 bp, Artificial
  CRISPR gRNA sequence
catcttccctgtacttccat

SEQ ID NO: 670487 - DNA, 20 bp, Artificial
  CRISPR gRNA sequence
ccctgtacttccatgtagta

SEQ ID NO: 670488 - DNA, 20 bp, Artificial
  CRISPR gRNA sequence
cctgtacttccatgtagtaa

SEQ ID NO: 670489 - DNA, 20 bp, Artificial
  CRISPR gRNA sequence
tacttccatgtagtaaacat

SEQ ID NO: 670490 - DNA, 20 bp, Artificial
  CRISPR gRNA sequence
ccatgtagtaaacataaccc

SEQ ID NO: 670491 - DNA, 20 bp, Artificial
  CRISPR gRNA sequence
catgtagtaaacataacccc

SEQ ID NO: 670492 - DNA, 20 bp, Artificial
  CRISPR gRNA sequence
atgtttgtttgatgttgata

SEQ ID NO: 670493 - DNA, 20 bp, Artificial
  CRISPR gRNA sequence
tgtttgtttgatgttgatac

SEQ ID NO: 670494 - DNA, 20 bp, Artificial
  CRISPR gRNA sequence
gtttgatgttgatacttatg

SEQ ID NO: 670495 - DNA, 20 bp, Artificial
  CRISPR gRNA sequence
tttgatgttgatacttatga

SEQ ID NO: 670496 - DNA, 20 bp, Artificial
  CRISPR gRNA sequence
gatgttgatacttatgaaat

SEQ ID NO: 670497 - DNA, 20 bp, Artificial
  CRISPR gRNA sequence
atgttgatacttatgaaatg

SEQ ID NO: 670498 - DNA, 20 bp, Artificial
  CRISPR gRNA sequence
atacttatgaaatgctttca

SEQ ID NO: 670499 - DNA, 20 bp, Artificial
  CRISPR gRNA sequence
atgaaatgctttcacataga

SEQ ID NO: 670500 - DNA, 20 bp, Artificial
  CRISPR gRNA sequence
tgaaatgctttcacatagat

SEQ ID NO: 670501 - DNA, 20 bp, Artificial
  CRISPR gRNA sequence
tcacatagatatattaataa

SEQ ID NO: 670502 - DNA, 20 bp, Artificial
  CRISPR gRNA sequence
cacatagatatattaataag

SEQ ID NO: 670503 - DNA, 20 bp, Artificial
  CRISPR gRNA sequence
acatagatatattaataaga

SEQ ID NO: 670504 - DNA, 20 bp, Artificial
  CRISPR gRNA sequence
ataagaagcaagtagttcca

SEQ ID NO: 670505 - DNA, 20 bp, Artificial
  CRISPR gRNA sequence
caagtgtattgtttatacaa

SEQ ID NO: 670506 - DNA, 20 bp, Artificial
  CRISPR gRNA sequence
tttatacaattttatttaat

SEQ ID NO: 670507 - DNA, 20 bp, Artificial
  CRISPR gRNA sequence
atacaattttatttaatact

SEQ ID NO: 670508 - DNA, 20 bp, Artificial
  CRISPR gRNA sequence
tacaattttatttaatactc

SEQ ID NO: 670509 - DNA, 20 bp, Artificial
  CRISPR gRNA sequence
tatttaatactcaggacaac

SEQ ID NO: 670510 - DNA, 20 bp, Artificial
  CRISPR gRNA sequence
atttaatactcaggacaacc

SEQ ID NO: 670511 - DNA, 20 bp, Artificial
  CRISPR gRNA sequence
tttaatactcaggacaaccc

SEQ ID NO: 670512 - DNA, 20 bp, Artificial
  CRISPR gRNA sequence
aatactcaggacaaccctag

SEQ ID NO: 670513 - DNA, 20 bp, Artificial
  CRISPR gRNA sequence
atactcaggacaaccctagg

SEQ ID NO: 670514 - DNA, 20 bp, Artificial
  CRISPR gRNA sequence
aggacaaccctaggaggcag

SEQ ID NO: 670515 - DNA, 20 bp, Artificial
  CRISPR gRNA sequence
ggaggcagctgttgtcatta

SEQ ID NO: 670516 - DNA, 20 bp, Artificial
  CRISPR gRNA sequence
ttgtcattattttgatttta

SEQ ID NO: 670517 - DNA, 20 bp, Artificial
  CRISPR gRNA sequence
tcattattttgattttatag

SEQ ID NO: 670518 - DNA, 20 bp, Artificial
  CRISPR gRNA sequence
ttttgattttatagatgaga

SEQ ID NO: 670519 - DNA, 20 bp, Artificial
  CRISPR gRNA sequence
tgattttatagatgagaaaa

SEQ ID NO: 670520 - DNA, 20 bp, Artificial
  CRISPR gRNA sequence
gattttatagatgagaaaat

SEQ ID NO: 670521 - DNA, 20 bp, Artificial
  CRISPR gRNA sequence
attttatagatgagaaaatt

SEQ ID NO: 670522 - DNA, 20 bp, Artificial
  CRISPR gRNA sequence
tatagatgagaaaattgaaa

SEQ ID NO: 670523 - DNA, 20 bp, Artificial
  CRISPR gRNA sequence
atagatgagaaaattgaaac

SEQ ID NO: 670524 - DNA, 20 bp, Artificial
  CRISPR gRNA sequence
tagatgagaaaattgaaact

SEQ ID NO: 670525 - DNA, 20 bp, Artificial
  CRISPR gRNA sequence
aaacttaggtttcctaaggt

SEQ ID NO: 670526 - DNA, 20 bp, Artificial
  CRISPR gRNA sequence
aggtttcctaaggtcatgtg

SEQ ID NO: 670527 - DNA, 20 bp, Artificial
  CRISPR gRNA sequence
ggtttcctaaggtcatgtga

SEQ ID NO: 670528 - DNA, 20 bp, Artificial
  CRISPR gRNA sequence
cctaaggtcatgtgacttat

SEQ ID NO: 670529 - DNA, 20 bp, Artificial
  CRISPR gRNA sequence
ctaaggtcatgtgacttata

SEQ ID NO: 670530 - DNA, 20 bp, Artificial
  CRISPR gRNA sequence
aggtcatgtgacttataaat

SEQ ID NO: 670531 - DNA, 20 bp, Artificial
  CRISPR gRNA sequence
ataaatgaacgaacctggcc

SEQ ID NO: 670532 - DNA, 20 bp, Artificial
  CRISPR gRNA sequence
taaatgaacgaacctggcct

SEQ ID NO: 670533 - DNA, 20 bp, Artificial
  CRISPR gRNA sequence
gccttaaactccagggtgct

SEQ ID NO: 670534 - DNA, 20 bp, Artificial
  CRISPR gRNA sequence
aaactccagggtgctggacc

SEQ ID NO: 670535 - DNA, 20 bp, Artificial
  CRISPR gRNA sequence
aactccagggtgctggacct

SEQ ID NO: 670536 - DNA, 20 bp, Artificial
  CRISPR gRNA sequence
cagggtgctggacctagagc

SEQ ID NO: 670537 - DNA, 20 bp, Artificial
  CRISPR gRNA sequence
gacctagagcccttgctctt

SEQ ID NO: 670538 - DNA, 20 bp, Artificial
  CRISPR gRNA sequence
gagcccttgctctttaacca

SEQ ID NO: 670539 - DNA, 20 bp, Artificial
  CRISPR gRNA sequence
gctctttaaccacagggcta

SEQ ID NO: 670540 - DNA, 20 bp, Artificial
  CRISPR gRNA sequence
ctctttaaccacagggctat

SEQ ID NO: 670541 - DNA, 20 bp, Artificial
  CRISPR gRNA sequence
tttaaccacagggctatgtt

SEQ ID NO: 670542 - DNA, 20 bp, Artificial
  CRISPR gRNA sequence
taaccacagggctatgttgc

SEQ ID NO: 670543 - DNA, 20 bp, Artificial
  CRISPR gRNA sequence
aaccacagggctatgttgct

SEQ ID NO: 670544 - DNA, 20 bp, Artificial
  CRISPR gRNA sequence
accacagggctatgttgctt

SEQ ID NO: 670545 - DNA, 20 bp, Artificial
  CRISPR gRNA sequence
tgttgcttgctttaagtgat

SEQ ID NO: 670546 - DNA, 20 bp, Artificial
  CRISPR gRNA sequence
cttgctttaagtgattgcat

SEQ ID NO: 670547 - DNA, 20 bp, Artificial
  CRISPR gRNA sequence
gctttaagtgattgcatgct

SEQ ID NO: 670548 - DNA, 20 bp, Artificial
  CRISPR gRNA sequence
ctttaagtgattgcatgctt

SEQ ID NO: 670549 - DNA, 20 bp, Artificial
  CRISPR gRNA sequence
taagtgattgcatgcttttc

SEQ ID NO: 670550 - DNA, 20 bp, Artificial
  CRISPR gRNA sequence
aagtgattgcatgcttttcc

SEQ ID NO: 670551 - DNA, 20 bp, Artificial
  CRISPR gRNA sequence
agtgattgcatgcttttcca

SEQ ID NO: 670552 - DNA, 20 bp, Artificial
  CRISPR gRNA sequence
catgcttttccagtcttcac

SEQ ID NO: 670553 - DNA, 20 bp, Artificial
  CRISPR gRNA sequence
ttccagtcttcacagtttta

SEQ ID NO: 670554 - DNA, 20 bp, Artificial
  CRISPR gRNA sequence
tccagtcttcacagttttaa

SEQ ID NO: 670555 - DNA, 20 bp, Artificial
  CRISPR gRNA sequence
ccagtcttcacagttttaat

SEQ ID NO: 670556 - DNA, 20 bp, Artificial
  CRISPR gRNA sequence
cagtcttcacagttttaatg

SEQ ID NO: 670557 - DNA, 20 bp, Artificial
  CRISPR gRNA sequence
cacagttttaatgtagagga

SEQ ID NO: 670558 - DNA, 20 bp, Artificial
  CRISPR gRNA sequence
acagttttaatgtagaggat

SEQ ID NO: 670559 - DNA, 20 bp, Artificial
  CRISPR gRNA sequence
taatgtagaggatattatct

SEQ ID NO: 670560 - DNA, 20 bp, Artificial
  CRISPR gRNA sequence
aatgtagaggatattatctt

SEQ ID NO: 670561 - DNA, 20 bp, Artificial
  CRISPR gRNA sequence
atgtagaggatattatcttc

SEQ ID NO: 670562 - DNA, 20 bp, Artificial
  CRISPR gRNA sequence
tcttcacttcatacagtagg

SEQ ID NO: 670563 - DNA, 20 bp, Artificial
  CRISPR gRNA sequence
cacttcatacagtaggaagc

SEQ ID NO: 670564 - DNA, 20 bp, Artificial
  CRISPR gRNA sequence
acttcatacagtaggaagca

SEQ ID NO: 670565 - DNA, 20 bp, Artificial
  CRISPR gRNA sequence
catacagtaggaagcaggga

SEQ ID NO: 670566 - DNA, 20 bp, Artificial
  CRISPR gRNA sequence
atacagtaggaagcagggag

SEQ ID NO: 670567 - DNA, 20 bp, Artificial
  CRISPR gRNA sequence
gcaagtggcttccaacattt

SEQ ID NO: 670568 - DNA, 20 bp, Artificial
  CRISPR gRNA sequence
ccaacatttatataagtaag

SEQ ID NO: 670569 - DNA, 20 bp, Artificial
  CRISPR gRNA sequence
caacatttatataagtaagc

SEQ ID NO: 670570 - DNA, 20 bp, Artificial
  CRISPR gRNA sequence
atataagtaagcatttaaac

SEQ ID NO: 670571 - DNA, 20 bp, Artificial
  CRISPR gRNA sequence
tataagtaagcatttaaaca

SEQ ID NO: 670572 - DNA, 20 bp, Artificial
  CRISPR gRNA sequence
aaacatagatgttataatct

SEQ ID NO: 670573 - DNA, 20 bp, Artificial
  CRISPR gRNA sequence
aacatagatgttataatctg

SEQ ID NO: 670574 - DNA, 20 bp, Artificial
  CRISPR gRNA sequence
taatctggtatttccatgat

SEQ ID NO: 670575 - DNA, 20 bp, Artificial
  CRISPR gRNA sequence
gtatttccatgatttaaata

SEQ ID NO: 670576 - DNA, 20 bp, Artificial
  CRISPR gRNA sequence
ccatgatttaaatacttcat

SEQ ID NO: 670577 - DNA, 20 bp, Artificial
  CRISPR gRNA sequence
catgatttaaatacttcata

SEQ ID NO: 670578 - DNA, 20 bp, Artificial
  CRISPR gRNA sequence
aaatacttcataggatgctt

SEQ ID NO: 670579 - DNA, 20 bp, Artificial
  CRISPR gRNA sequence
aatacttcataggatgcttt

SEQ ID NO: 670580 - DNA, 20 bp, Artificial
  CRISPR gRNA sequence
cataggatgctttgtaaatg

SEQ ID NO: 670581 - DNA, 20 bp, Artificial
  CRISPR gRNA sequence
ataggatgctttgtaaatgt

SEQ ID NO: 670582 - DNA, 20 bp, Artificial
  CRISPR gRNA sequence
tgtaaatgtttttgccttta

SEQ ID NO: 670583 - DNA, 20 bp, Artificial
  CRISPR gRNA sequence
gtaaatgtttttgcctttaa

SEQ ID NO: 670584 - DNA, 20 bp, Artificial
  CRISPR gRNA sequence
taaatgtttttgcctttaat

SEQ ID NO: 670585 - DNA, 20 bp, Artificial
  CRISPR gRNA sequence
ttgcctttaattatatgcat

SEQ ID NO: 670586 - DNA, 20 bp, Artificial
  CRISPR gRNA sequence
tgcctttaattatatgcatt

SEQ ID NO: 670587 - DNA, 20 bp, Artificial
  CRISPR gRNA sequence
gcctttaattatatgcattc

SEQ ID NO: 670588 - DNA, 20 bp, Artificial
  CRISPR gRNA sequence
cctttaattatatgcattct

SEQ ID NO: 670589 - DNA, 20 bp, Artificial
  CRISPR gRNA sequence
taattatatgcattctgtaa

SEQ ID NO: 670590 - DNA, 20 bp, Artificial
  CRISPR gRNA sequence
aattatatgcattctgtaat

SEQ ID NO: 670591 - DNA, 20 bp, Artificial
  CRISPR gRNA sequence
attatatgcattctgtaatc

SEQ ID NO: 670592 - DNA, 20 bp, Artificial
  CRISPR gRNA sequence
tatgcattctgtaatcctac

SEQ ID NO: 670593 - DNA, 20 bp, Artificial
  CRISPR gRNA sequence
tgtaatcctacttaaaatgc

SEQ ID NO: 670594 - DNA, 20 bp, Artificial
  CRISPR gRNA sequence
taatcctacttaaaatgctc

SEQ ID NO: 670595 - DNA, 20 bp, Artificial
  CRISPR gRNA sequence
cttaaaatgctcattcattc

SEQ ID NO: 670596 - DNA, 20 bp, Artificial
  CRISPR gRNA sequence
aaaatgctcattcattcatt

SEQ ID NO: 670597 - DNA, 20 bp, Artificial
  CRISPR gRNA sequence
aaatgctcattcattcatta

SEQ ID NO: 670598 - DNA, 20 bp, Artificial
  CRISPR gRNA sequence
attcattcattaggagtaga

SEQ ID NO: 670599 - DNA, 20 bp, Artificial
  CRISPR gRNA sequence
attcattaggagtagaaaac

SEQ ID NO: 670600 - DNA, 20 bp, Artificial
  CRISPR gRNA sequence
attaggagtagaaaactagg

SEQ ID NO: 670601 - DNA, 20 bp, Artificial
  CRISPR gRNA sequence
ggagtagaaaactaggtatg

SEQ ID NO: 670602 - DNA, 20 bp, Artificial
  CRISPR gRNA sequence
ggtatgagcattgtaaagaa

SEQ ID NO: 670603 - DNA, 20 bp, Artificial
  CRISPR gRNA sequence
taaagaagaagaacaacaac

SEQ ID NO: 670604 - DNA, 20 bp, Artificial
  CRISPR gRNA sequence
ctgctgctacattgtggaaa

SEQ ID NO: 670605 - DNA, 20 bp, Artificial
  CRISPR gRNA sequence
ctgctacattgtggaaaata

SEQ ID NO: 670606 - DNA, 20 bp, Artificial
  CRISPR gRNA sequence
ctacattgtggaaaataagt

SEQ ID NO: 670607 - DNA, 20 bp, Artificial
  CRISPR gRNA sequence
cattgtggaaaataagtatc

SEQ ID NO: 670608 - DNA, 20 bp, Artificial
  CRISPR gRNA sequence
tggaaaataagtatctggca

SEQ ID NO: 670609 - DNA, 20 bp, Artificial
  CRISPR gRNA sequence
gcactgatctgtcaaaaatt

SEQ ID NO: 670610 - DNA, 20 bp, Artificial
  CRISPR gRNA sequence
atctgtcaaaaattgcttta

SEQ ID NO: 670611 - DNA, 20 bp, Artificial
  CRISPR gRNA sequence
tcaaaaattgctttaattcc

SEQ ID NO: 670612 - DNA, 20 bp, Artificial
  CRISPR gRNA sequence
ctttaattccccttaatcac

SEQ ID NO: 670613 - DNA, 20 bp, Artificial
  CRISPR gRNA sequence
taattccccttaatcaccac

SEQ ID NO: 670614 - DNA, 20 bp, Artificial
  CRISPR gRNA sequence
aattccccttaatcaccaca

SEQ ID NO: 670615 - DNA, 20 bp, Artificial
  CRISPR gRNA sequence
attccccttaatcaccacaa

SEQ ID NO: 670616 - DNA, 20 bp, Artificial
  CRISPR gRNA sequence
cccttaatcaccacaagttt

SEQ ID NO: 670617 - DNA, 20 bp, Artificial
  CRISPR gRNA sequence
aatcaccacaagttttctct

SEQ ID NO: 670618 - DNA, 20 bp, Artificial
  CRISPR gRNA sequence
atcaccacaagttttctctt

SEQ ID NO: 670619 - DNA, 20 bp, Artificial
  CRISPR gRNA sequence
tctctttctcactacttgat

SEQ ID NO: 670620 - DNA, 20 bp, Artificial
  CRISPR gRNA sequence
ctctttctcactacttgata

SEQ ID NO: 670621 - DNA, 20 bp, Artificial
  CRISPR gRNA sequence
tctttctcactacttgatag

SEQ ID NO: 670622 - DNA, 20 bp, Artificial
  CRISPR gRNA sequence
tttctcactacttgatagat

SEQ ID NO: 670623 - DNA, 20 bp, Artificial
  CRISPR gRNA sequence
tctcactacttgatagatct

SEQ ID NO: 670624 - DNA, 20 bp, Artificial
  CRISPR gRNA sequence
ctcactacttgatagatctt

SEQ ID NO: 670625 - DNA, 20 bp, Artificial
  CRISPR gRNA sequence
tcactacttgatagatctta

SEQ ID NO: 670626 - DNA, 20 bp, Artificial
  CRISPR gRNA sequence
actacttgatagatcttact

SEQ ID NO: 670627 - DNA, 20 bp, Artificial
  CRISPR gRNA sequence
cttgatagatcttactggtt

SEQ ID NO: 670628 - DNA, 20 bp, Artificial
  CRISPR gRNA sequence
gatagatcttactggttatt

SEQ ID NO: 670629 - DNA, 20 bp, Artificial
  CRISPR gRNA sequence
atagatcttactggttatta

SEQ ID NO: 670630 - DNA, 20 bp, Artificial
  CRISPR gRNA sequence
actggttattaatttctaac

SEQ ID NO: 670631 - DNA, 20 bp, Artificial
  CRISPR gRNA sequence
ctggttattaatttctaact

SEQ ID NO: 670632 - DNA, 20 bp, Artificial
  CRISPR gRNA sequence
gttattaatttctaactgac

SEQ ID NO: 670633 - DNA, 20 bp, Artificial
  CRISPR gRNA sequence
ttaatttctaactgaccaat

SEQ ID NO: 670634 - DNA, 20 bp, Artificial
  CRISPR gRNA sequence
atttctaactgaccaatcct

SEQ ID NO: 670635 - DNA, 20 bp, Artificial
  CRISPR gRNA sequence
ctaactgaccaatcctgcat

SEQ ID NO: 670636 - DNA, 20 bp, Artificial
  CRISPR gRNA sequence
taactgaccaatcctgcatc

SEQ ID NO: 670637 - DNA, 20 bp, Artificial
  CRISPR gRNA sequence
actgaccaatcctgcatctg

SEQ ID NO: 670638 - DNA, 20 bp, Artificial
  CRISPR gRNA sequence
accaatcctgcatctgaggg

SEQ ID NO: 670639 - DNA, 20 bp, Artificial
  CRISPR gRNA sequence
catctgagggccaaatgcag

SEQ ID NO: 670640 - DNA, 20 bp, Artificial
  CRISPR gRNA sequence
agggccaaatgcagactctg

SEQ ID NO: 670641 - DNA, 20 bp, Artificial
  CRISPR gRNA sequence
tgtttatttgactcagacca

SEQ ID NO: 670642 - DNA, 20 bp, Artificial
  CRISPR gRNA sequence
tttatttgactcagaccagt

SEQ ID NO: 670643 - DNA, 20 bp, Artificial
  CRISPR gRNA sequence
atttgactcagaccagtagt

SEQ ID NO: 670644 - DNA, 20 bp, Artificial
  CRISPR gRNA sequence
tttgactcagaccagtagta

SEQ ID NO: 670645 - DNA, 20 bp, Artificial
  CRISPR gRNA sequence
gactcagaccagtagtacag

SEQ ID NO: 670646 - DNA, 20 bp, Artificial
  CRISPR gRNA sequence
actcagaccagtagtacagt

SEQ ID NO: 670647 - DNA, 20 bp, Artificial
  CRISPR gRNA sequence
agaccagtagtacagtgttt

SEQ ID NO: 670648 - DNA, 20 bp, Artificial
  CRISPR gRNA sequence
atggaagaacagcagggaaa

SEQ ID NO: 670649 - DNA, 20 bp, Artificial
  CRISPR gRNA sequence
tggaagaacagcagggaaag

SEQ ID NO: 670650 - DNA, 20 bp, Artificial
  CRISPR gRNA sequence
ttgtagcctcgatgtcaatg

SEQ ID NO: 670651 - DNA, 20 bp, Artificial
  CRISPR gRNA sequence
tgtagcctcgatgtcaatgt

SEQ ID NO: 670652 - DNA, 20 bp, Artificial
  CRISPR gRNA sequence
gtagcctcgatgtcaatgtg

SEQ ID NO: 670653 - DNA, 20 bp, Artificial
  CRISPR gRNA sequence
tagcctcgatgtcaatgtgt

SEQ ID NO: 670654 - DNA, 20 bp, Artificial
  CRISPR gRNA sequence
gatgtcaatgtgtatgaccc

SEQ ID NO: 670655 - DNA, 20 bp, Artificial
  CRISPR gRNA sequence
gaacctggggtatggaaacc

SEQ ID NO: 670656 - DNA, 20 bp, Artificial
  CRISPR gRNA sequence
aacctggggtatggaaacct

SEQ ID NO: 670657 - DNA, 20 bp, Artificial
  CRISPR gRNA sequence
gggtatggaaacctgttggg

SEQ ID NO: 670658 - DNA, 20 bp, Artificial
  CRISPR gRNA sequence
ttgggttcccctgttgcttc

SEQ ID NO: 670659 - DNA, 20 bp, Artificial
  CRISPR gRNA sequence
ggttcccctgttgcttcact

SEQ ID NO: 670660 - DNA, 20 bp, Artificial
  CRISPR gRNA sequence
ccctgttgcttcacttcaga

SEQ ID NO: 670661 - DNA, 20 bp, Artificial
  CRISPR gRNA sequence
ttgcttcacttcagagaccc

SEQ ID NO: 670662 - DNA, 20 bp, Artificial
  CRISPR gRNA sequence
cttcacttcagagacccggt

SEQ ID NO: 670663 - DNA, 20 bp, Artificial
  CRISPR gRNA sequence
cacttcagagacccggtaaa

SEQ ID NO: 670664 - DNA, 20 bp, Artificial
  CRISPR gRNA sequence
acttcagagacccggtaaag

SEQ ID NO: 670665 - DNA, 20 bp, Artificial
  CRISPR gRNA sequence
cagagacccggtaaagctgc

SEQ ID NO: 670666 - DNA, 20 bp, Artificial
  CRISPR gRNA sequence
agagacccggtaaagctgct

SEQ ID NO: 670667 - DNA, 20 bp, Artificial
  CRISPR gRNA sequence
ctgaagtgtgttgcactgct

SEQ ID NO: 670668 - DNA, 20 bp, Artificial
  CRISPR gRNA sequence
aagtgtgttgcactgctttg

SEQ ID NO: 670669 - DNA, 20 bp, Artificial
  CRISPR gRNA sequence
cactgctttggctcctccct

SEQ ID NO: 670670 - DNA, 20 bp, Artificial
  CRISPR gRNA sequence
ctttggctcctccctccctc

SEQ ID NO: 670671 - DNA, 20 bp, Artificial
  CRISPR gRNA sequence
tggctcctccctccctctgt

SEQ ID NO: 670672 - DNA, 20 bp, Artificial
  CRISPR gRNA sequence
ggctcctccctccctctgtt

SEQ ID NO: 670673 - DNA, 20 bp, Artificial
  CRISPR gRNA sequence
gctcctccctccctctgttg

SEQ ID NO: 670674 - DNA, 20 bp, Artificial
  CRISPR gRNA sequence
ctccctccctctgttgccgt

SEQ ID NO: 670675 - DNA, 20 bp, Artificial
  CRISPR gRNA sequence
cctccctctgttgccgttgc

SEQ ID NO: 670676 - DNA, 20 bp, Artificial
  CRISPR gRNA sequence
cctctgttgccgttgcccag

SEQ ID NO: 670677 - DNA, 20 bp, Artificial
  CRISPR gRNA sequence
tgttgccgttgcccagtgat

SEQ ID NO: 670678 - DNA, 20 bp, Artificial
  CRISPR gRNA sequence
ttgccgttgcccagtgatag

SEQ ID NO: 670679 - DNA, 20 bp, Artificial
  CRISPR gRNA sequence
ccgttgcccagtgatagaaa

SEQ ID NO: 670680 - DNA, 20 bp, Artificial
  CRISPR gRNA sequence
cccagtgatagaaatcctgc

SEQ ID NO: 670681 - DNA, 20 bp, Artificial
  CRISPR gRNA sequence
ctctcttccttatctctttc

SEQ ID NO: 670682 - DNA, 20 bp, Artificial
  CRISPR gRNA sequence
tcttccttatctctttctgt

SEQ ID NO: 670683 - DNA, 20 bp, Artificial
  CRISPR gRNA sequence
ttccttatctctttctgttg

SEQ ID NO: 670684 - DNA, 20 bp, Artificial
  CRISPR gRNA sequence
ccttatctctttctgttgag

SEQ ID NO: 670685 - DNA, 20 bp, Artificial
  CRISPR gRNA sequence
cttatctctttctgttgagc

SEQ ID NO: 670686 - DNA, 20 bp, Artificial
  CRISPR gRNA sequence
atctctttctgttgagccgc

SEQ ID NO: 670687 - DNA, 20 bp, Artificial
  CRISPR gRNA sequence
tctctttctgttgagccgcc

SEQ ID NO: 670688 - DNA, 20 bp, Artificial
  CRISPR gRNA sequence
tttctgttgagccgccagca

SEQ ID NO: 670689 - DNA, 20 bp, Artificial
  CRISPR gRNA sequence
tctgttgagccgccagcagc

SEQ ID NO: 670690 - DNA, 20 bp, Artificial
  CRISPR gRNA sequence
ctgttgagccgccagcagcc

SEQ ID NO: 670691 - DNA, 20 bp, Artificial
  CRISPR gRNA sequence
tgttgagccgccagcagcct

SEQ ID NO: 670692 - DNA, 20 bp, Artificial
  CRISPR gRNA sequence
ttgagccgccagcagccttg

SEQ ID NO: 670693 - DNA, 20 bp, Artificial
  CRISPR gRNA sequence
agccgccagcagccttgcct

SEQ ID NO: 670694 - DNA, 20 bp, Artificial
  CRISPR gRNA sequence
gccttctgaccttgtttaag

SEQ ID NO: 670695 - DNA, 20 bp, Artificial
  CRISPR gRNA sequence
ccttctgaccttgtttaagc

SEQ ID NO: 670696 - DNA, 20 bp, Artificial
  CRISPR gRNA sequence
ctgaccttgtttaagcgtcc

SEQ ID NO: 670697 - DNA, 20 bp, Artificial
  CRISPR gRNA sequence
tgaccttgtttaagcgtcct

SEQ ID NO: 670698 - DNA, 20 bp, Artificial
  CRISPR gRNA sequence
accttgtttaagcgtcctta

SEQ ID NO: 670699 - DNA, 20 bp, Artificial
  CRISPR gRNA sequence
gtttaagcgtccttagtgac

SEQ ID NO: 670700 - DNA, 20 bp, Artificial
  CRISPR gRNA sequence
tttaagcgtccttagtgacc

SEQ ID NO: 670701 - DNA, 20 bp, Artificial
  CRISPR gRNA sequence
aagcgtccttagtgacctct

SEQ ID NO: 670702 - DNA, 20 bp, Artificial
  CRISPR gRNA sequence
agcgtccttagtgacctctg

SEQ ID NO: 670703 - DNA, 20 bp, Artificial
  CRISPR gRNA sequence
agtgacctctgggaatcctt

SEQ ID NO: 670704 - DNA, 20 bp, Artificial
  CRISPR gRNA sequence
gtgacctctgggaatccttg

SEQ ID NO: 670705 - DNA, 20 bp, Artificial
  CRISPR gRNA sequence
tgggaatccttgtgggtccc

SEQ ID NO: 670706 - DNA, 20 bp, Artificial
  CRISPR gRNA sequence
ggaatccttgtgggtccctt

SEQ ID NO: 670707 - DNA, 20 bp, Artificial
  CRISPR gRNA sequence
gtgggtccctttgggaacat

SEQ ID NO: 670708 - DNA, 20 bp, Artificial
  CRISPR gRNA sequence
tgggtccctttgggaacata

SEQ ID NO: 670709 - DNA, 20 bp, Artificial
  CRISPR gRNA sequence
tgggaacatacccactcagc

SEQ ID NO: 670710 - DNA, 20 bp, Artificial
  CRISPR gRNA sequence
gggaacatacccactcagct

SEQ ID NO: 670711 - DNA, 20 bp, Artificial
  CRISPR gRNA sequence
ggaacatacccactcagctg

SEQ ID NO: 670712 - DNA, 20 bp, Artificial
  CRISPR gRNA sequence
agctggattttacttcttac

SEQ ID NO: 670713 - DNA, 20 bp, Artificial
  CRISPR gRNA sequence
gattttacttcttacagaag

SEQ ID NO: 670714 - DNA, 20 bp, Artificial
  CRISPR gRNA sequence
tacttcttacagaagttagg

SEQ ID NO: 670715 - DNA, 20 bp, Artificial
  CRISPR gRNA sequence
acttcttacagaagttaggt

SEQ ID NO: 670716 - DNA, 20 bp, Artificial
  CRISPR gRNA sequence
cttcttacagaagttaggtt

SEQ ID NO: 670717 - DNA, 20 bp, Artificial
  CRISPR gRNA sequence
cttacagaagttaggttaag

SEQ ID NO: 670718 - DNA, 20 bp, Artificial
  CRISPR gRNA sequence
ttacagaagttaggttaaga

SEQ ID NO: 670719 - DNA, 20 bp, Artificial
  CRISPR gRNA sequence
acagaagttaggttaagaat

SEQ ID NO: 670720 - DNA, 20 bp, Artificial
  CRISPR gRNA sequence
cagaagttaggttaagaatt

SEQ ID NO: 670721 - DNA, 20 bp, Artificial
  CRISPR gRNA sequence
ggttaagaattttgtactgc

SEQ ID NO: 670722 - DNA, 20 bp, Artificial
  CRISPR gRNA sequence
agaattttgtactgctctta

SEQ ID NO: 670723 - DNA, 20 bp, Artificial
  CRISPR gRNA sequence
tgtactgctcttattaaaaa

SEQ ID NO: 670724 - DNA, 20 bp, Artificial
  CRISPR gRNA sequence
gtactgctcttattaaaaag

SEQ ID NO: 670725 - DNA, 20 bp, Artificial
  CRISPR gRNA sequence
tactgctcttattaaaaaga

SEQ ID NO: 670726 - DNA, 20 bp, Artificial
  CRISPR gRNA sequence
ctcttattaaaaagataatt

SEQ ID NO: 670727 - DNA, 20 bp, Artificial
  CRISPR gRNA sequence
ttattaaaaagataatttca

SEQ ID NO: 670728 - DNA, 20 bp, Artificial
  CRISPR gRNA sequence
attaaaaagataatttcaca

SEQ ID NO: 670729 - DNA, 20 bp, Artificial
  CRISPR gRNA sequence
ttaaaaagataatttcacaa

SEQ ID NO: 670730 - DNA, 20 bp, Artificial
  CRISPR gRNA sequence
aaaagataatttcacaatgt

SEQ ID NO: 670731 - DNA, 20 bp, Artificial
  CRISPR gRNA sequence
cacaatgtaatttgcttcac

SEQ ID NO: 670732 - DNA, 20 bp, Artificial
  CRISPR gRNA sequence
acaatgtaatttgcttcaca

SEQ ID NO: 670733 - DNA, 20 bp, Artificial
  CRISPR gRNA sequence
gcttcacaagcctcttacag

SEQ ID NO: 670734 - DNA, 20 bp, Artificial
  CRISPR gRNA sequence
cttcacaagcctcttacagt

SEQ ID NO: 670735 - DNA, 20 bp, Artificial
  CRISPR gRNA sequence
cacaagcctcttacagttac

SEQ ID NO: 670736 - DNA, 20 bp, Artificial
  CRISPR gRNA sequence
acaagcctcttacagttacg

SEQ ID NO: 670737 - DNA, 20 bp, Artificial
  CRISPR gRNA sequence
ttacagttacgttaagcaga

SEQ ID NO: 670738 - DNA, 20 bp, Artificial
  CRISPR gRNA sequence
acagttacgttaagcagatg

SEQ ID NO: 670739 - DNA, 20 bp, Artificial
  CRISPR gRNA sequence
cagttacgttaagcagatgg

SEQ ID NO: 670740 - DNA, 20 bp, Artificial
  CRISPR gRNA sequence
cgttaagcagatggttgcca

SEQ ID NO: 670741 - DNA, 20 bp, Artificial
  CRISPR gRNA sequence
agcagatggttgccaaacac

SEQ ID NO: 670742 - DNA, 20 bp, Artificial
  CRISPR gRNA sequence
ccaaacaccagttcaaagta

SEQ ID NO: 670743 - DNA, 20 bp, Artificial
  CRISPR gRNA sequence
aaagtagattgctcttatat

SEQ ID NO: 670744 - DNA, 20 bp, Artificial
  CRISPR gRNA sequence
ctcttatatgaaataaaatc

SEQ ID NO: 670745 - DNA, 20 bp, Artificial
  CRISPR gRNA sequence
ttatatgaaataaaatccac

SEQ ID NO: 670746 - DNA, 20 bp, Artificial
  CRISPR gRNA sequence
atatgaaataaaatccacgc

SEQ ID NO: 670747 - DNA, 20 bp, Artificial
  CRISPR gRNA sequence
tatgaaataaaatccacgct

SEQ ID NO: 670748 - DNA, 20 bp, Artificial
  CRISPR gRNA sequence
aggaaatttggcagtgtaag

SEQ ID NO: 670749 - DNA, 20 bp, Artificial
  CRISPR gRNA sequence
ggcagtgtaagctggtcttc

SEQ ID NO: 670750 - DNA, 20 bp, Artificial
  CRISPR gRNA sequence
gcagtgtaagctggtcttct

SEQ ID NO: 670751 - DNA, 20 bp, Artificial
  CRISPR gRNA sequence
gtcttcttccaaaacaggct

SEQ ID NO: 670752 - DNA, 20 bp, Artificial
  CRISPR gRNA sequence
cttccaaaacaggcttactc

SEQ ID NO: 670753 - DNA, 20 bp, Artificial
  CRISPR gRNA sequence
ttccaaaacaggcttactca

SEQ ID NO: 670754 - DNA, 20 bp, Artificial
  CRISPR gRNA sequence
ccaaaacaggcttactcaga

SEQ ID NO: 670755 - DNA, 20 bp, Artificial
  CRISPR gRNA sequence
caaaacaggcttactcagac

SEQ ID NO: 670756 - DNA, 20 bp, Artificial
  CRISPR gRNA sequence
actcagacaactttctcttt

SEQ ID NO: 670757 - DNA, 20 bp, Artificial
  CRISPR gRNA sequence
ctcagacaactttctcttta

SEQ ID NO: 670758 - DNA, 20 bp, Artificial
  CRISPR gRNA sequence
agacaactttctctttacct

SEQ ID NO: 670759 - DNA, 20 bp, Artificial
  CRISPR gRNA sequence
tctctttacctcagactggc

SEQ ID NO: 670760 - DNA, 20 bp, Artificial
  CRISPR gRNA sequence
ctctttacctcagactggca

SEQ ID NO: 670761 - DNA, 20 bp, Artificial
  CRISPR gRNA sequence
tctttacctcagactggcaa

SEQ ID NO: 670762 - DNA, 20 bp, Artificial
  CRISPR gRNA sequence
tttacctcagactggcaatc

SEQ ID NO: 670763 - DNA, 20 bp, Artificial
  CRISPR gRNA sequence
tacctcagactggcaatctg

SEQ ID NO: 670764 - DNA, 20 bp, Artificial
  CRISPR gRNA sequence
acctcagactggcaatctgc

SEQ ID NO: 670765 - DNA, 20 bp, Artificial
  CRISPR gRNA sequence
cctcagactggcaatctgct

SEQ ID NO: 670766 - DNA, 20 bp, Artificial
  CRISPR gRNA sequence
agactggcaatctgctacac

SEQ ID NO: 670767 - DNA, 20 bp, Artificial
  CRISPR gRNA sequence
gcaatctgctacacctgtat

SEQ ID NO: 670768 - DNA, 20 bp, Artificial
  CRISPR gRNA sequence
ctacacctgtattccactgt

SEQ ID NO: 670769 - DNA, 20 bp, Artificial
  CRISPR gRNA sequence
cacctgtattccactgtgga

SEQ ID NO: 670770 - DNA, 20 bp, Artificial
  CRISPR gRNA sequence
tattccactgtggagtaaaa

SEQ ID NO: 670771 - DNA, 20 bp, Artificial
  CRISPR gRNA sequence
cactgtggagtaaaaaacat

SEQ ID NO: 670772 - DNA, 20 bp, Artificial
  CRISPR gRNA sequence
tggagtaaaaaacatatcag

SEQ ID NO: 670773 - DNA, 20 bp, Artificial
  CRISPR gRNA sequence
tatacactgattcaaaggta

SEQ ID NO: 670774 - DNA, 20 bp, Artificial
  CRISPR gRNA sequence
attcaaaggtatcattcttt

SEQ ID NO: 670775 - DNA, 20 bp, Artificial
  CRISPR gRNA sequence
aaaggtatcattctttaaca

SEQ ID NO: 670776 - DNA, 20 bp, Artificial
  CRISPR gRNA sequence
tttaacatattgacatctgt

SEQ ID NO: 670777 - DNA, 20 bp, Artificial
  CRISPR gRNA sequence
taacatattgacatctgttt

SEQ ID NO: 670778 - DNA, 20 bp, Artificial
  CRISPR gRNA sequence
aacatattgacatctgtttt

SEQ ID NO: 670779 - DNA, 20 bp, Artificial
  CRISPR gRNA sequence
acatattgacatctgttttt

SEQ ID NO: 670780 - DNA, 20 bp, Artificial
  CRISPR gRNA sequence
acatctgttttttttcttta

SEQ ID NO: 670781 - DNA, 20 bp, Artificial
  CRISPR gRNA sequence
ttttttttctttactattac

SEQ ID NO: 670782 - DNA, 20 bp, Artificial
  CRISPR gRNA sequence
tttttctttactattactag

SEQ ID NO: 670783 - DNA, 20 bp, Artificial
  CRISPR gRNA sequence
ttttctttactattactagc

SEQ ID NO: 670784 - DNA, 20 bp, Artificial
  CRISPR gRNA sequence
tttctttactattactagct

SEQ ID NO: 670785 - DNA, 20 bp, Artificial
  CRISPR gRNA sequence
ttctttactattactagcta

SEQ ID NO: 670786 - DNA, 20 bp, Artificial
  CRISPR gRNA sequence
tctttactattactagctac

SEQ ID NO: 670787 - DNA, 20 bp, Artificial
  CRISPR gRNA sequence
ctttactattactagctact

SEQ ID NO: 670788 - DNA, 20 bp, Artificial
  CRISPR gRNA sequence
tttactattactagctactt

SEQ ID NO: 670789 - DNA, 20 bp, Artificial
  CRISPR gRNA sequence
tactattactagctactttg

SEQ ID NO: 670790 - DNA, 20 bp, Artificial
  CRISPR gRNA sequence
actattactagctactttgc

SEQ ID NO: 670791 - DNA, 20 bp, Artificial
  CRISPR gRNA sequence
ctattactagctactttgct

SEQ ID NO: 670792 - DNA, 20 bp, Artificial
  CRISPR gRNA sequence
ttactagctactttgctttt

SEQ ID NO: 670793 - DNA, 20 bp, Artificial
  CRISPR gRNA sequence
ctagctactttgcttttggc

SEQ ID NO: 670794 - DNA, 20 bp, Artificial
  CRISPR gRNA sequence
gctactttgcttttggcatc

SEQ ID NO: 670795 - DNA, 20 bp, Artificial
  CRISPR gRNA sequence
ctttgcttttggcatcatag

SEQ ID NO: 670796 - DNA, 20 bp, Artificial
  CRISPR gRNA sequence
tgcttttggcatcataggga

SEQ ID NO: 670797 - DNA, 20 bp, Artificial
  CRISPR gRNA sequence
gcttttggcatcatagggaa

SEQ ID NO: 670798 - DNA, 20 bp, Artificial
  CRISPR gRNA sequence
cttttggcatcatagggaaa

SEQ ID NO: 670799 - DNA, 20 bp, Artificial
  CRISPR gRNA sequence
ttggcatcatagggaaatag

SEQ ID NO: 670800 - DNA, 20 bp, Artificial
  CRISPR gRNA sequence
tggcatcatagggaaatagc

SEQ ID NO: 670801 - DNA, 20 bp, Artificial
  CRISPR gRNA sequence
ggcatcatagggaaatagca

SEQ ID NO: 670802 - DNA, 20 bp, Artificial
  CRISPR gRNA sequence
gcatcatagggaaatagcaa

SEQ ID NO: 670803 - DNA, 20 bp, Artificial
  CRISPR gRNA sequence
ggtcatcagttctgagttcc

SEQ ID NO: 670804 - DNA, 20 bp, Artificial
  CRISPR gRNA sequence
gtcatcagttctgagttcca

SEQ ID NO: 670805 - DNA, 20 bp, Artificial
  CRISPR gRNA sequence
tgagttccagtcacagctct

SEQ ID NO: 670806 - DNA, 20 bp, Artificial
  CRISPR gRNA sequence
agttccagtcacagctctga

SEQ ID NO: 670807 - DNA, 20 bp, Artificial
  CRISPR gRNA sequence
cagtcacagctctgactctc

SEQ ID NO: 670808 - DNA, 20 bp, Artificial
  CRISPR gRNA sequence
tgactctcaatatttgtatg

SEQ ID NO: 670809 - DNA, 20 bp, Artificial
  CRISPR gRNA sequence
actctcaatatttgtatgaa

SEQ ID NO: 670810 - DNA, 20 bp, Artificial
  CRISPR gRNA sequence
tcaatatttgtatgaattga

SEQ ID NO: 670811 - DNA, 20 bp, Artificial
  CRISPR gRNA sequence
aatatttgtatgaattgaat

SEQ ID NO: 670812 - DNA, 20 bp, Artificial
  CRISPR gRNA sequence
gtatgaattgaatgtgttac

SEQ ID NO: 670813 - DNA, 20 bp, Artificial
  CRISPR gRNA sequence
tatgaattgaatgtgttact

SEQ ID NO: 670814 - DNA, 20 bp, Artificial
  CRISPR gRNA sequence
aatgtgttacttcactgatt

SEQ ID NO: 670815 - DNA, 20 bp, Artificial
  CRISPR gRNA sequence
cttcactgattttaagcttc

SEQ ID NO: 670816 - DNA, 20 bp, Artificial
  CRISPR gRNA sequence
cactgattttaagcttcagt

SEQ ID NO: 670817 - DNA, 20 bp, Artificial
  CRISPR gRNA sequence
actgattttaagcttcagtt

SEQ ID NO: 670818 - DNA, 20 bp, Artificial
  CRISPR gRNA sequence
attttaagcttcagtttcct

SEQ ID NO: 670819 - DNA, 20 bp, Artificial
  CRISPR gRNA sequence
taagcttcagtttcctcatt

SEQ ID NO: 670820 - DNA, 20 bp, Artificial
  CRISPR gRNA sequence
aagcttcagtttcctcattt

SEQ ID NO: 670821 - DNA, 20 bp, Artificial
  CRISPR gRNA sequence
agcttcagtttcctcatttg

SEQ ID NO: 670822 - DNA, 20 bp, Artificial
  CRISPR gRNA sequence
cagtttcctcatttgtaaaa

SEQ ID NO: 670823 - DNA, 20 bp, Artificial
  CRISPR gRNA sequence
agtttcctcatttgtaaaat

SEQ ID NO: 670824 - DNA, 20 bp, Artificial
  CRISPR gRNA sequence
cctcatttgtaaaatgagga

SEQ ID NO: 670825 - DNA, 20 bp, Artificial
  CRISPR gRNA sequence
ctcatttgtaaaatgaggat

SEQ ID NO: 670826 - DNA, 20 bp, Artificial
  CRISPR gRNA sequence
atttgtaaaatgaggataaa

SEQ ID NO: 670827 - DNA, 20 bp, Artificial
  CRISPR gRNA sequence
gtaaaatgaggataaaatta

SEQ ID NO: 670828 - DNA, 20 bp, Artificial
  CRISPR gRNA sequence
taaaatgaggataaaattac

SEQ ID NO: 670829 - DNA, 20 bp, Artificial
  CRISPR gRNA sequence
cgtacttcatggagtggcta

SEQ ID NO: 670830 - DNA, 20 bp, Artificial
  CRISPR gRNA sequence
catggagtggctattttgat

SEQ ID NO: 670831 - DNA, 20 bp, Artificial
  CRISPR gRNA sequence
atggagtggctattttgatt

SEQ ID NO: 670832 - DNA, 20 bp, Artificial
  CRISPR gRNA sequence
ttttgattaattcagttgat

SEQ ID NO: 670833 - DNA, 20 bp, Artificial
  CRISPR gRNA sequence
tgattaattcagttgatata

SEQ ID NO: 670834 - DNA, 20 bp, Artificial
  CRISPR gRNA sequence
gattaattcagttgatatat

SEQ ID NO: 670835 - DNA, 20 bp, Artificial
  CRISPR gRNA sequence
attaattcagttgatatata

SEQ ID NO: 670836 - DNA, 20 bp, Artificial
  CRISPR gRNA sequence
attcagttgatatatataac

SEQ ID NO: 670837 - DNA, 20 bp, Artificial
  CRISPR gRNA sequence
agttgatatatataacgcac

SEQ ID NO: 670838 - DNA, 20 bp, Artificial
  CRISPR gRNA sequence
atatatataacgcacctaaa

SEQ ID NO: 670839 - DNA, 20 bp, Artificial
  CRISPR gRNA sequence
aattctttcctgtcattaat

SEQ ID NO: 670840 - DNA, 20 bp, Artificial
  CRISPR gRNA sequence
tttcctgtcattaatggttc

SEQ ID NO: 670841 - DNA, 20 bp, Artificial
  CRISPR gRNA sequence
tcctgtcattaatggttctt

SEQ ID NO: 670842 - DNA, 20 bp, Artificial
  CRISPR gRNA sequence
cctgtcattaatggttcttt

SEQ ID NO: 670843 - DNA, 20 bp, Artificial
  CRISPR gRNA sequence
ctgtcattaatggttcttta

SEQ ID NO: 670844 - DNA, 20 bp, Artificial
  CRISPR gRNA sequence
tcattaatggttctttaatt

SEQ ID NO: 670845 - DNA, 20 bp, Artificial
  CRISPR gRNA sequence
atggttctttaattaatgtt

SEQ ID NO: 670846 - DNA, 20 bp, Artificial
  CRISPR gRNA sequence
tttaattaatgttattttga

SEQ ID NO: 670847 - DNA, 20 bp, Artificial
  CRISPR gRNA sequence
taattaatgttattttgata

SEQ ID NO: 670848 - DNA, 20 bp, Artificial
  CRISPR gRNA sequence
aattaatgttattttgatat

SEQ ID NO: 670849 - DNA, 20 bp, Artificial
  CRISPR gRNA sequence
attaatgttattttgatatt

SEQ ID NO: 670850 - DNA, 20 bp, Artificial
  CRISPR gRNA sequence
atgttattttgatattgatg

SEQ ID NO: 670851 - DNA, 20 bp, Artificial
  CRISPR gRNA sequence
ttttgatattgatgatttgt

SEQ ID NO: 670852 - DNA, 20 bp, Artificial
  CRISPR gRNA sequence
tgatattgatgatttgtgtt

SEQ ID NO: 670853 - DNA, 20 bp, Artificial
  CRISPR gRNA sequence
gatattgatgatttgtgttt

SEQ ID NO: 670854 - DNA, 20 bp, Artificial
  CRISPR gRNA sequence
atattgatgatttgtgttta

SEQ ID NO: 670855 - DNA, 20 bp, Artificial
  CRISPR gRNA sequence
atgatttgtgtttaaaacct

SEQ ID NO: 670856 - DNA, 20 bp, Artificial
  CRISPR gRNA sequence
gtgtttaaaacctaaatctg

SEQ ID NO: 670857 - DNA, 20 bp, Artificial
  CRISPR gRNA sequence
tgtttaaaacctaaatctgt

SEQ ID NO: 670858 - DNA, 20 bp, Artificial
  CRISPR gRNA sequence
aaaacctaaatctgtattgt

SEQ ID NO: 670859 - DNA, 20 bp, Artificial
  CRISPR gRNA sequence
aaacctaaatctgtattgtt

SEQ ID NO: 670860 - DNA, 20 bp, Artificial
  CRISPR gRNA sequence
aatctgtattgttatattta

SEQ ID NO: 670861 - DNA, 20 bp, Artificial
  CRISPR gRNA sequence
tattgttatatttattcatc

SEQ ID NO: 670862 - DNA, 20 bp, Artificial
  CRISPR gRNA sequence
ttatatttattcatcatgtg

SEQ ID NO: 670863 - DNA, 20 bp, Artificial
  CRISPR gRNA sequence
tatttattcatcatgtgtat

SEQ ID NO: 670864 - DNA, 20 bp, Artificial
  CRISPR gRNA sequence
attcatcatgtgtatttgat

SEQ ID NO: 670865 - DNA, 20 bp, Artificial
  CRISPR gRNA sequence
ttcatcatgtgtatttgatt

SEQ ID NO: 670866 - DNA, 20 bp, Artificial
  CRISPR gRNA sequence
atcatgtgtatttgatttat

SEQ ID NO: 670867 - DNA, 20 bp, Artificial
  CRISPR gRNA sequence
gatttatgtgaggtcttcgt

SEQ ID NO: 670868 - DNA, 20 bp, Artificial
  CRISPR gRNA sequence
atttatgtgaggtcttcgta

SEQ ID NO: 670869 - DNA, 20 bp, Artificial
  CRISPR gRNA sequence
atgtgaggtcttcgtaattt

SEQ ID NO: 670870 - DNA, 20 bp, Artificial
  CRISPR gRNA sequence
tgtgaggtcttcgtaattta

SEQ ID NO: 670871 - DNA, 20 bp, Artificial
  CRISPR gRNA sequence
cgtaatttaaaaacagaaat

SEQ ID NO: 670872 - DNA, 20 bp, Artificial
  CRISPR gRNA sequence
gtaatttaaaaacagaaata

SEQ ID NO: 670873 - DNA, 20 bp, Artificial
  CRISPR gRNA sequence
aaaaacagaaatatcatacg

SEQ ID NO: 670874 - DNA, 20 bp, Artificial
  CRISPR gRNA sequence
aaaacagaaatatcatacgt

SEQ ID NO: 670875 - DNA, 20 bp, Artificial
  CRISPR gRNA sequence
gttcaacaaatacatattgg

SEQ ID NO: 670876 - DNA, 20 bp, Artificial
  CRISPR gRNA sequence
aacaaatacatattgggtgc

SEQ ID NO: 670877 - DNA, 20 bp, Artificial
  CRISPR gRNA sequence
ggtgctttgtatgtgtaagg

SEQ ID NO: 670878 - DNA, 20 bp, Artificial
  CRISPR gRNA sequence
tgtatgtgtaaggatagaat

SEQ ID NO: 670879 - DNA, 20 bp, Artificial
  CRISPR gRNA sequence
gtatgtgtaaggatagaatg

SEQ ID NO: 670880 - DNA, 20 bp, Artificial
  CRISPR gRNA sequence
tatgtgtaaggatagaatga

SEQ ID NO: 670881 - DNA, 20 bp, Artificial
  CRISPR gRNA sequence
tacaactatgaataaaggca

SEQ ID NO: 670882 - DNA, 20 bp, Artificial
  CRISPR gRNA sequence
acaactatgaataaaggcag

SEQ ID NO: 670883 - DNA, 20 bp, Artificial
  CRISPR gRNA sequence
caactatgaataaaggcagt

SEQ ID NO: 670884 - DNA, 20 bp, Artificial
  CRISPR gRNA sequence
tgaataaaggcagtatttcc

SEQ ID NO: 670885 - DNA, 20 bp, Artificial
  CRISPR gRNA sequence
cctctcaaggaccttacact

SEQ ID NO: 670886 - DNA, 20 bp, Artificial
  CRISPR gRNA sequence
ctctcaaggaccttacacta

SEQ ID NO: 670887 - DNA, 20 bp, Artificial
  CRISPR gRNA sequence
tcaaggaccttacactatag

SEQ ID NO: 670888 - DNA, 20 bp, Artificial
  CRISPR gRNA sequence
aaggaccttacactataggc

SEQ ID NO: 670889 - DNA, 20 bp, Artificial
  CRISPR gRNA sequence
acactataggcagtgtagag

SEQ ID NO: 670890 - DNA, 20 bp, Artificial
  CRISPR gRNA sequence
cactataggcagtgtagagg

SEQ ID NO: 670891 - DNA, 20 bp, Artificial
  CRISPR gRNA sequence
taggcagtgtagaggtaagg

SEQ ID NO: 670892 - DNA, 20 bp, Artificial
  CRISPR gRNA sequence
tgatgaaatcactgtaatgt

SEQ ID NO: 670893 - DNA, 20 bp, Artificial
  CRISPR gRNA sequence
atgaaatcactgtaatgtaa

SEQ ID NO: 670894 - DNA, 20 bp, Artificial
  CRISPR gRNA sequence
taatgtaaagtgaagtaaat

SEQ ID NO: 670895 - DNA, 20 bp, Artificial
  CRISPR gRNA sequence
cataggagaagaactttttg

SEQ ID NO: 670896 - DNA, 20 bp, Artificial
  CRISPR gRNA sequence
ataggagaagaactttttgc

SEQ ID NO: 670897 - DNA, 20 bp, Artificial
  CRISPR gRNA sequence
tttgctcagaaaacactcat

SEQ ID NO: 670898 - DNA, 20 bp, Artificial
  CRISPR gRNA sequence
ttgctcagaaaacactcatg

SEQ ID NO: 670899 - DNA, 20 bp, Artificial
  CRISPR gRNA sequence
tgctcagaaaacactcatga

SEQ ID NO: 670900 - DNA, 20 bp, Artificial
  CRISPR gRNA sequence
gctcagaaaacactcatgaa

SEQ ID NO: 670901 - DNA, 20 bp, Artificial
  CRISPR gRNA sequence
ctcagaaaacactcatgaaa

SEQ ID NO: 670902 - DNA, 20 bp, Artificial
  CRISPR gRNA sequence
agaaaacactcatgaaaaaa

SEQ ID NO: 670903 - DNA, 20 bp, Artificial
  CRISPR gRNA sequence
atgaaaaaaggtagcagata

SEQ ID NO: 670904 - DNA, 20 bp, Artificial
  CRISPR gRNA sequence
taatgatgtgctaattttta

SEQ ID NO: 670905 - DNA, 20 bp, Artificial
  CRISPR gRNA sequence
aatgatgtgctaatttttat

SEQ ID NO: 670906 - DNA, 20 bp, Artificial
  CRISPR gRNA sequence
atgatgtgctaatttttata

SEQ ID NO: 670907 - DNA, 20 bp, Artificial
  CRISPR gRNA sequence
atttttatagaaatagggga

SEQ ID NO: 670908 - DNA, 20 bp, Artificial
  CRISPR gRNA sequence
ttatagaaataggggaagta

SEQ ID NO: 670909 - DNA, 20 bp, Artificial
  CRISPR gRNA sequence
tatagaaataggggaagtat

SEQ ID NO: 670910 - DNA, 20 bp, Artificial
  CRISPR gRNA sequence
atagaaataggggaagtatc

SEQ ID NO: 670911 - DNA, 20 bp, Artificial
  CRISPR gRNA sequence
tagaaataggggaagtatcc

SEQ ID NO: 670912 - DNA, 20 bp, Artificial
  CRISPR gRNA sequence
gagaaaaaacaaaaaaacct

SEQ ID NO: 670913 - DNA, 20 bp, Artificial
  CRISPR gRNA sequence
agaaaaaacaaaaaaaccta

SEQ ID NO: 670914 - DNA, 20 bp, Artificial
  CRISPR gRNA sequence
gtaagtagagatgtataaat

SEQ ID NO: 670915 - DNA, 20 bp, Artificial
  CRISPR gRNA sequence
ctggaaaactgaggacagtg

SEQ ID NO: 670916 - DNA, 20 bp, Artificial
  CRISPR gRNA sequence
tggaaaactgaggacagtgg

SEQ ID NO: 670917 - DNA, 20 bp, Artificial
  CRISPR gRNA sequence
gaaaactgaggacagtggtt

SEQ ID NO: 670918 - DNA, 20 bp, Artificial
  CRISPR gRNA sequence
aggacagtggtttcactgga

SEQ ID NO: 670919 - DNA, 20 bp, Artificial
  CRISPR gRNA sequence
cactggaaaaggcatgagta

SEQ ID NO: 670920 - DNA, 20 bp, Artificial
  CRISPR gRNA sequence
actggaaaaggcatgagtaa

SEQ ID NO: 670921 - DNA, 20 bp, Artificial
  CRISPR gRNA sequence
gaaaaggcatgagtaactaa

SEQ ID NO: 670922 - DNA, 20 bp, Artificial
  CRISPR gRNA sequence
aaagactcataggacatatg

SEQ ID NO: 670923 - DNA, 20 bp, Artificial
  CRISPR gRNA sequence
ataggacatatggctgaagg

SEQ ID NO: 670924 - DNA, 20 bp, Artificial
  CRISPR gRNA sequence
aaggatatgatgggactaca

SEQ ID NO: 670925 - DNA, 20 bp, Artificial
  CRISPR gRNA sequence
cactttggatattcttaaat

SEQ ID NO: 670926 - DNA, 20 bp, Artificial
  CRISPR gRNA sequence
tggatattcttaaattccat

SEQ ID NO: 670927 - DNA, 20 bp, Artificial
  CRISPR gRNA sequence
ggatattcttaaattccata

SEQ ID NO: 670928 - DNA, 20 bp, Artificial
  CRISPR gRNA sequence
gatattcttaaattccatac

SEQ ID NO: 670929 - DNA, 20 bp, Artificial
  CRISPR gRNA sequence
ttaaattccataccaatacc

SEQ ID NO: 670930 - DNA, 20 bp, Artificial
  CRISPR gRNA sequence
aaattccataccaatacctt

SEQ ID NO: 670931 - DNA, 20 bp, Artificial
  CRISPR gRNA sequence
aattccataccaataccttt

SEQ ID NO: 670932 - DNA, 20 bp, Artificial
  CRISPR gRNA sequence
cataccaatacctttgtatt

SEQ ID NO: 670933 - DNA, 20 bp, Artificial
  CRISPR gRNA sequence
tgtatttaatgtgtaggcag

SEQ ID NO: 670934 - DNA, 20 bp, Artificial
  CRISPR gRNA sequence
gtatttaatgtgtaggcagt

SEQ ID NO: 670935 - DNA, 20 bp, Artificial
  CRISPR gRNA sequence
tatttaatgtgtaggcagta

SEQ ID NO: 670936 - DNA, 20 bp, Artificial
  CRISPR gRNA sequence
aatgtgtaggcagtaggcag

SEQ ID NO: 670937 - DNA, 20 bp, Artificial
  CRISPR gRNA sequence
atgtgtaggcagtaggcagt

SEQ ID NO: 670938 - DNA, 20 bp, Artificial
  CRISPR gRNA sequence
ttgaagacatttagaagagt

SEQ ID NO: 670939 - DNA, 20 bp, Artificial
  CRISPR gRNA sequence
gaagacatttagaagagtaa

SEQ ID NO: 670940 - DNA, 20 bp, Artificial
  CRISPR gRNA sequence
aagacatttagaagagtaat

SEQ ID NO: 670941 - DNA, 20 bp, Artificial
  CRISPR gRNA sequence
agaagagtaatatgaactct

SEQ ID NO: 670942 - DNA, 20 bp, Artificial
  CRISPR gRNA sequence
gaagagtaatatgaactctg

SEQ ID NO: 670943 - DNA, 20 bp, Artificial
  CRISPR gRNA sequence
tgcaataggaagattaatct

SEQ ID NO: 670944 - DNA, 20 bp, Artificial
  CRISPR gRNA sequence
caataggaagattaatctaa

SEQ ID NO: 670945 - DNA, 20 bp, Artificial
  CRISPR gRNA sequence
atctaacaactgaatataga

SEQ ID NO: 670946 - DNA, 20 bp, Artificial
  CRISPR gRNA sequence
acaactgaatatagatgaat

SEQ ID NO: 670947 - DNA, 20 bp, Artificial
  CRISPR gRNA sequence
aatatagatgaattggggga

SEQ ID NO: 670948 - DNA, 20 bp, Artificial
  CRISPR gRNA sequence
ggggagaagagtgtggcaaa

SEQ ID NO: 670949 - DNA, 20 bp, Artificial
  CRISPR gRNA sequence
gaaggaaagagaccagttag

SEQ ID NO: 670950 - DNA, 20 bp, Artificial
  CRISPR gRNA sequence
aaggaaagagaccagttaga

SEQ ID NO: 670951 - DNA, 20 bp, Artificial
  CRISPR gRNA sequence
gaaagtttctgatattgttc

SEQ ID NO: 670952 - DNA, 20 bp, Artificial
  CRISPR gRNA sequence
ctgatattgttccaggtgag

SEQ ID NO: 670953 - DNA, 20 bp, Artificial
  CRISPR gRNA sequence
tgatattgttccaggtgaga

SEQ ID NO: 670954 - DNA, 20 bp, Artificial
  CRISPR gRNA sequence
atattgttccaggtgagagg

SEQ ID NO: 670955 - DNA, 20 bp, Artificial
  CRISPR gRNA sequence
ttccaggtgagaggtcatgg

SEQ ID NO: 670956 - DNA, 20 bp, Artificial
  CRISPR gRNA sequence
caggtgagaggtcatgggga

SEQ ID NO: 670957 - DNA, 20 bp, Artificial
  CRISPR gRNA sequence
aaagtagttgtattgcccaa

SEQ ID NO: 670958 - DNA, 20 bp, Artificial
  CRISPR gRNA sequence
aagtagttgtattgcccaag

SEQ ID NO: 670959 - DNA, 20 bp, Artificial
  CRISPR gRNA sequence
tattgcccaagaagatgcaa

SEQ ID NO: 670960 - DNA, 20 bp, Artificial
  CRISPR gRNA sequence
cccaagaagatgcaaaaaca

SEQ ID NO: 670961 - DNA, 20 bp, Artificial
  CRISPR gRNA sequence
aacctttaggacttggcaaa

SEQ ID NO: 670962 - DNA, 20 bp, Artificial
  CRISPR gRNA sequence
taggacttggcaaatgaaat

SEQ ID NO: 670963 - DNA, 20 bp, Artificial
  CRISPR gRNA sequence
aggacttggcaaatgaaatc

SEQ ID NO: 670964 - DNA, 20 bp, Artificial
  CRISPR gRNA sequence
ggacttggcaaatgaaatca

SEQ ID NO: 670965 - DNA, 20 bp, Artificial
  CRISPR gRNA sequence
ggcaaatgaaatcattcatc

SEQ ID NO: 670966 - DNA, 20 bp, Artificial
  CRISPR gRNA sequence
gcaaatgaaatcattcatcg

SEQ ID NO: 670967 - DNA, 20 bp, Artificial
  CRISPR gRNA sequence
atcgaaaggttggataaagg

SEQ ID NO: 670968 - DNA, 20 bp, Artificial
  CRISPR gRNA sequence
gataaagggatagactgctg

SEQ ID NO: 670969 - DNA, 20 bp, Artificial
  CRISPR gRNA sequence
ctgtttggctgaggcatttc

SEQ ID NO: 670970 - DNA, 20 bp, Artificial
  CRISPR gRNA sequence
tttggctgaggcatttctat

SEQ ID NO: 670971 - DNA, 20 bp, Artificial
  CRISPR gRNA sequence
ggctgaggcatttctattta

SEQ ID NO: 670972 - DNA, 20 bp, Artificial
  CRISPR gRNA sequence
gctgaggcatttctatttaa

SEQ ID NO: 670973 - DNA, 20 bp, Artificial
  CRISPR gRNA sequence
aggcatttctatttaaagta

SEQ ID NO: 670974 - DNA, 20 bp, Artificial
  CRISPR gRNA sequence
ctatttaaagtaggtttatt

SEQ ID NO: 670975 - DNA, 20 bp, Artificial
  CRISPR gRNA sequence
tatttaaagtaggtttattt

SEQ ID NO: 670976 - DNA, 20 bp, Artificial
  CRISPR gRNA sequence
tttaaagtaggtttattttc

SEQ ID NO: 670977 - DNA, 20 bp, Artificial
  CRISPR gRNA sequence
aaagtaggtttattttctct

SEQ ID NO: 670978 - DNA, 20 bp, Artificial
  CRISPR gRNA sequence
aagtaggtttattttctctg

SEQ ID NO: 670979 - DNA, 20 bp, Artificial
  CRISPR gRNA sequence
attttctctgcattgtataa

SEQ ID NO: 670980 - DNA, 20 bp, Artificial
  CRISPR gRNA sequence
ttttctctgcattgtataat

SEQ ID NO: 670981 - DNA, 20 bp, Artificial
  CRISPR gRNA sequence
tctctgcattgtataattct

SEQ ID NO: 670982 - DNA, 20 bp, Artificial
  CRISPR gRNA sequence
ctctgcattgtataattctc

SEQ ID NO: 670983 - DNA, 20 bp, Artificial
  CRISPR gRNA sequence
tctgcattgtataattctca

SEQ ID NO: 670984 - DNA, 20 bp, Artificial
  CRISPR gRNA sequence
tgcattgtataattctcatg

SEQ ID NO: 670985 - DNA, 20 bp, Artificial
  CRISPR gRNA sequence
cattgtataattctcatgaa

SEQ ID NO: 670986 - DNA, 20 bp, Artificial
  CRISPR gRNA sequence
tataattctcatgaactagt

SEQ ID NO: 670987 - DNA, 20 bp, Artificial
  CRISPR gRNA sequence
tcatgaactagttgtccgcc

SEQ ID NO: 670988 - DNA, 20 bp, Artificial
  CRISPR gRNA sequence
atgaactagttgtccgccaa

SEQ ID NO: 670989 - DNA, 20 bp, Artificial
  CRISPR gRNA sequence
gttgtccgccaaaaaataga

SEQ ID NO: 670990 - DNA, 20 bp, Artificial
  CRISPR gRNA sequence
tccgccaaaaaatagaaact

SEQ ID NO: 670991 - DNA, 20 bp, Artificial
  CRISPR gRNA sequence
cgtctgtgggccacaatggt

SEQ ID NO: 670992 - DNA, 20 bp, Artificial
  CRISPR gRNA sequence
tgggccacaatggtgctact

SEQ ID NO: 670993 - DNA, 20 bp, Artificial
  CRISPR gRNA sequence
ctgtgttagctaataaaggt

SEQ ID NO: 670994 - DNA, 20 bp, Artificial
  CRISPR gRNA sequence
tgttagctaataaaggtgtg

SEQ ID NO: 670995 - DNA, 20 bp, Artificial
  CRISPR gRNA sequence
gctaataaaggtgtgtattt

SEQ ID NO: 670996 - DNA, 20 bp, Artificial
  CRISPR gRNA sequence
ataaaggtgtgtattttgat

SEQ ID NO: 670997 - DNA, 20 bp, Artificial
  CRISPR gRNA sequence
tgatgatgtgcacgctatac

SEQ ID NO: 670998 - DNA, 20 bp, Artificial
  CRISPR gRNA sequence
gatgatgtgcacgctataca

SEQ ID NO: 670999 - DNA, 20 bp, Artificial
  CRISPR gRNA sequence
atgatgtgcacgctatacaa

SEQ ID NO: 671000 - DNA, 20 bp, Artificial
  CRISPR gRNA sequence
tacaaggtttcatggagtgt

SEQ ID NO: 671001 - DNA, 20 bp, Artificial
  CRISPR gRNA sequence
catggagtgtgcaggatcat

SEQ ID NO: 671002 - DNA, 20 bp, Artificial
  CRISPR gRNA sequence
atggagtgtgcaggatcatc

SEQ ID NO: 671003 - DNA, 20 bp, Artificial
  CRISPR gRNA sequence
gatattttgccctccattcg

SEQ ID NO: 671004 - DNA, 20 bp, Artificial
  CRISPR gRNA sequence
tgccctccattcgtttacat

SEQ ID NO: 671005 - DNA, 20 bp, Artificial
  CRISPR gRNA sequence
gccctccattcgtttacatt

SEQ ID NO: 671006 - DNA, 20 bp, Artificial
  CRISPR gRNA sequence
ccctccattcgtttacattt

SEQ ID NO: 671007 - DNA, 20 bp, Artificial
  CRISPR gRNA sequence
cattcgtttacatttttttt

SEQ ID NO: 671008 - DNA, 20 bp, Artificial
  CRISPR gRNA sequence
gtttacattttttttccatg

SEQ ID NO: 671009 - DNA, 20 bp, Artificial
  CRISPR gRNA sequence
acattttttttccatgaaag

SEQ ID NO: 671010 - DNA, 20 bp, Artificial
  CRISPR gRNA sequence
cattttttttccatgaaagt

SEQ ID NO: 671011 - DNA, 20 bp, Artificial
  CRISPR gRNA sequence
tttttccatgaaagtaggga

SEQ ID NO: 671012 - DNA, 20 bp, Artificial
  CRISPR gRNA sequence
ttttccatgaaagtagggag

SEQ ID NO: 671013 - DNA, 20 bp, Artificial
  CRISPR gRNA sequence
tttccatgaaagtagggagg

SEQ ID NO: 671014 - DNA, 20 bp, Artificial
  CRISPR gRNA sequence
ttccatgaaagtagggagga

SEQ ID NO: 671015 - DNA, 20 bp, Artificial
  CRISPR gRNA sequence
tccatgaaagtagggaggaa

SEQ ID NO: 671016 - DNA, 20 bp, Artificial
  CRISPR gRNA sequence
ccatgaaagtagggaggaaa

SEQ ID NO: 671017 - DNA, 20 bp, Artificial
  CRISPR gRNA sequence
catgaaagtagggaggaaac

SEQ ID NO: 671018 - DNA, 20 bp, Artificial
  CRISPR gRNA sequence
tttggtctttattttgttgc

SEQ ID NO: 671019 - DNA, 20 bp, Artificial
  CRISPR gRNA sequence
ttggtctttattttgttgcc

SEQ ID NO: 671020 - DNA, 20 bp, Artificial
  CRISPR gRNA sequence
tggtctttattttgttgcca

SEQ ID NO: 671021 - DNA, 20 bp, Artificial
  CRISPR gRNA sequence
ggtctttattttgttgccaa

SEQ ID NO: 671022 - DNA, 20 bp, Artificial
  CRISPR gRNA sequence
gtctttattttgttgccaag

SEQ ID NO: 671023 - DNA, 20 bp, Artificial
  CRISPR gRNA sequence
tattttgttgccaagatctg

SEQ ID NO: 671024 - DNA, 20 bp, Artificial
  CRISPR gRNA sequence
attttgttgccaagatctgt

SEQ ID NO: 671025 - DNA, 20 bp, Artificial
  CRISPR gRNA sequence
ttttgttgccaagatctgtt

SEQ ID NO: 671026 - DNA, 20 bp, Artificial
  CRISPR gRNA sequence
tgttgccaagatctgtttaa

SEQ ID NO: 671027 - DNA, 20 bp, Artificial
  CRISPR gRNA sequence
gttgccaagatctgtttaaa

SEQ ID NO: 671028 - DNA, 20 bp, Artificial
  CRISPR gRNA sequence
ttgccaagatctgtttaaat

SEQ ID NO: 671029 - DNA, 20 bp, Artificial
  CRISPR gRNA sequence
ccaagatctgtttaaatgta

SEQ ID NO: 671030 - DNA, 20 bp, Artificial
  CRISPR gRNA sequence
tttaaatgtagataaaattc

SEQ ID NO: 671031 - DNA, 20 bp, Artificial
  CRISPR gRNA sequence
aaatgtagataaaattctac

SEQ ID NO: 671032 - DNA, 20 bp, Artificial
  CRISPR gRNA sequence
aatgtagataaaattctaca

SEQ ID NO: 671033 - DNA, 20 bp, Artificial
  CRISPR gRNA sequence
tacattaccaactcacaggt

SEQ ID NO: 671034 - DNA, 20 bp, Artificial
  CRISPR gRNA sequence
cattaccaactcacaggtgt

SEQ ID NO: 671035 - DNA, 20 bp, Artificial
  CRISPR gRNA sequence
ccaactcacaggtgtgattt

SEQ ID NO: 671036 - DNA, 20 bp, Artificial
  CRISPR gRNA sequence
acaggtgtgatttatcttta

SEQ ID NO: 671037 - DNA, 20 bp, Artificial
  CRISPR gRNA sequence
atctttatatcaataattga

SEQ ID NO: 671038 - DNA, 20 bp, Artificial
  CRISPR gRNA sequence
tctttatatcaataattgac

SEQ ID NO: 671039 - DNA, 20 bp, Artificial
  CRISPR gRNA sequence
tatatcaataattgacacaa

SEQ ID NO: 671040 - DNA, 20 bp, Artificial
  CRISPR gRNA sequence
atatcaataattgacacaag

SEQ ID NO: 671041 - DNA, 20 bp, Artificial
  CRISPR gRNA sequence
tatcaataattgacacaaga

SEQ ID NO: 671042 - DNA, 20 bp, Artificial
  CRISPR gRNA sequence
acacaagactgtcaaaactt

SEQ ID NO: 671043 - DNA, 20 bp, Artificial
  CRISPR gRNA sequence
tcaaaacttgaccacaaagg

SEQ ID NO: 671044 - DNA, 20 bp, Artificial
  CRISPR gRNA sequence
gaccacaaaggaaatcctga

SEQ ID NO: 671045 - DNA, 20 bp, Artificial
  CRISPR gRNA sequence
accacaaaggaaatcctgaa

SEQ ID NO: 671046 - DNA, 20 bp, Artificial
  CRISPR gRNA sequence
aaatgctatccttcataaac

SEQ ID NO: 671047 - DNA, 20 bp, Artificial
  CRISPR gRNA sequence
tccttcataaactattggtt

SEQ ID NO: 671048 - DNA, 20 bp, Artificial
  CRISPR gRNA sequence
cataaactattggtttagag

SEQ ID NO: 671049 - DNA, 20 bp, Artificial
  CRISPR gRNA sequence
ataaactattggtttagaga

SEQ ID NO: 671050 - DNA, 20 bp, Artificial
  CRISPR gRNA sequence
ttggtttagagattaaaatt

SEQ ID NO: 671051 - DNA, 20 bp, Artificial
  CRISPR gRNA sequence
gtttagagattaaaattgat

SEQ ID NO: 671052 - DNA, 20 bp, Artificial
  CRISPR gRNA sequence
agagattaaaattgataata

SEQ ID NO: 671053 - DNA, 20 bp, Artificial
  CRISPR gRNA sequence
gagattaaaattgataatat

SEQ ID NO: 671054 - DNA, 20 bp, Artificial
  CRISPR gRNA sequence
aaattgataatattgactta

SEQ ID NO: 671055 - DNA, 20 bp, Artificial
  CRISPR gRNA sequence
ataatattgacttactgctc

SEQ ID NO: 671056 - DNA, 20 bp, Artificial
  CRISPR gRNA sequence
acttactgctcaaattgctg

SEQ ID NO: 671057 - DNA, 20 bp, Artificial
  CRISPR gRNA sequence
actgctcaaattgctgcctt

SEQ ID NO: 671058 - DNA, 20 bp, Artificial
  CRISPR gRNA sequence
ctgctcaaattgctgcctta

SEQ ID NO: 671059 - DNA, 20 bp, Artificial
  CRISPR gRNA sequence
ctcaaattgctgccttaacc

SEQ ID NO: 671060 - DNA, 20 bp, Artificial
  CRISPR gRNA sequence
aaattgctgccttaacctac

SEQ ID NO: 671061 - DNA, 20 bp, Artificial
  CRISPR gRNA sequence
ctgccttaacctaccaccga

SEQ ID NO: 671062 - DNA, 20 bp, Artificial
  CRISPR gRNA sequence
ccttaacctaccaccgataa

SEQ ID NO: 671063 - DNA, 20 bp, Artificial
  CRISPR gRNA sequence
aacctaccaccgataattca

SEQ ID NO: 671064 - DNA, 20 bp, Artificial
  CRISPR gRNA sequence
acctaccaccgataattcat

SEQ ID NO: 671065 - DNA, 20 bp, Artificial
  CRISPR gRNA sequence
ccaccgataattcatagcag

SEQ ID NO: 671066 - DNA, 20 bp, Artificial
  CRISPR gRNA sequence
atagcaggacaaggagtata

SEQ ID NO: 671067 - DNA, 20 bp, Artificial
  CRISPR gRNA sequence
atgttaaaaaaatagagagg

SEQ ID NO: 671068 - DNA, 20 bp, Artificial
  CRISPR gRNA sequence
aaaaaatagagaggaggagg

SEQ ID NO: 671069 - DNA, 20 bp, Artificial
  CRISPR gRNA sequence
aatattgacagattcttcag

SEQ ID NO: 671070 - DNA, 20 bp, Artificial
  CRISPR gRNA sequence
acagattcttcagcaactag

SEQ ID NO: 671071 - DNA, 20 bp, Artificial
  CRISPR gRNA sequence
ttcagcaactaggtgtactg

SEQ ID NO: 671072 - DNA, 20 bp, Artificial
  CRISPR gRNA sequence
cagcaactaggtgtactgca

SEQ ID NO: 671073 - DNA, 20 bp, Artificial
  CRISPR gRNA sequence
agcaactaggtgtactgcat

SEQ ID NO: 671074 - DNA, 20 bp, Artificial
  CRISPR gRNA sequence
ggtgtactgcatggacatac

SEQ ID NO: 671075 - DNA, 20 bp, Artificial
  CRISPR gRNA sequence
catggacatacccttgacaa

SEQ ID NO: 671076 - DNA, 20 bp, Artificial
  CRISPR gRNA sequence
gacaacagcaaagcaaattt

SEQ ID NO: 671077 - DNA, 20 bp, Artificial
  CRISPR gRNA sequence
acaacagcaaagcaaatttt

SEQ ID NO: 671078 - DNA, 20 bp, Artificial
  CRISPR gRNA sequence
taaaattatgaggtagttgt

SEQ ID NO: 671079 - DNA, 20 bp, Artificial
  CRISPR gRNA sequence
aaaattatgaggtagttgtt

SEQ ID NO: 671080 - DNA, 20 bp, Artificial
  CRISPR gRNA sequence
aaattatgaggtagttgttt

SEQ ID NO: 671081 - DNA, 20 bp, Artificial
  CRISPR gRNA sequence
tgaggtagttgttttgagtg

SEQ ID NO: 671082 - DNA, 20 bp, Artificial
  CRISPR gRNA sequence
ttttgagtgagacatgcatc

SEQ ID NO: 671083 - DNA, 20 bp, Artificial
  CRISPR gRNA sequence
tgagtgagacatgcatccca

SEQ ID NO: 671084 - DNA, 20 bp, Artificial
  CRISPR gRNA sequence
gagtgagacatgcatcccag

SEQ ID NO: 671085 - DNA, 20 bp, Artificial
  CRISPR gRNA sequence
agtgagacatgcatcccagt

SEQ ID NO: 671086 - DNA, 20 bp, Artificial
  CRISPR gRNA sequence
tgatagaaagtcataattca

SEQ ID NO: 671087 - DNA, 20 bp, Artificial
  CRISPR gRNA sequence
gatagaaagtcataattcaa

SEQ ID NO: 671088 - DNA, 20 bp, Artificial
  CRISPR gRNA sequence
atagaaagtcataattcaat

SEQ ID NO: 671089 - DNA, 20 bp, Artificial
  CRISPR gRNA sequence
aatagtttggtttatggaaa

SEQ ID NO: 671090 - DNA, 20 bp, Artificial
  CRISPR gRNA sequence
ggtttatggaaacttaacat

SEQ ID NO: 671091 - DNA, 20 bp, Artificial
  CRISPR gRNA sequence
gtttatggaaacttaacatt

SEQ ID NO: 671092 - DNA, 20 bp, Artificial
  CRISPR gRNA sequence
atggaaacttaacatttctt

SEQ ID NO: 671093 - DNA, 20 bp, Artificial
  CRISPR gRNA sequence
tggaaacttaacatttcttt

SEQ ID NO: 671094 - DNA, 20 bp, Artificial
  CRISPR gRNA sequence
aacatttctttatctgacca

SEQ ID NO: 671095 - DNA, 20 bp, Artificial
  CRISPR gRNA sequence
acatttctttatctgaccat

SEQ ID NO: 671096 - DNA, 20 bp, Artificial
  CRISPR gRNA sequence
ctttatctgaccattcggga

SEQ ID NO: 671097 - DNA, 20 bp, Artificial
  CRISPR gRNA sequence
tttatctgaccattcgggac

SEQ ID NO: 671098 - DNA, 20 bp, Artificial
  CRISPR gRNA sequence
tatctgaccattcgggactt

SEQ ID NO: 671099 - DNA, 20 bp, Artificial
  CRISPR gRNA sequence
atctgaccattcgggactta

SEQ ID NO: 671100 - DNA, 20 bp, Artificial
  CRISPR gRNA sequence
tctgaccattcgggacttaa

SEQ ID NO: 671101 - DNA, 20 bp, Artificial
  CRISPR gRNA sequence
accattcgggacttaagttt

SEQ ID NO: 671102 - DNA, 20 bp, Artificial
  CRISPR gRNA sequence
gggacttaagtttctggtat

SEQ ID NO: 671103 - DNA, 20 bp, Artificial
  CRISPR gRNA sequence
aagtttctggtatcctcttc

SEQ ID NO: 671104 - DNA, 20 bp, Artificial
  CRISPR gRNA sequence
agtttctggtatcctcttca

SEQ ID NO: 671105 - DNA, 20 bp, Artificial
  CRISPR gRNA sequence
ctggtatcctcttcaactgg

SEQ ID NO: 671106 - DNA, 20 bp, Artificial
  CRISPR gRNA sequence
tggtatcctcttcaactggt

SEQ ID NO: 671107 - DNA, 20 bp, Artificial
  CRISPR gRNA sequence
gtatcctcttcaactggtgg

SEQ ID NO: 671108 - DNA, 20 bp, Artificial
  CRISPR gRNA sequence
ttcaactggtggacatagtt

SEQ ID NO: 671109 - DNA, 20 bp, Artificial
  CRISPR gRNA sequence
caactggtggacatagtttt

SEQ ID NO: 671110 - DNA, 20 bp, Artificial
  CRISPR gRNA sequence
aactggtggacatagtttta

SEQ ID NO: 671111 - DNA, 20 bp, Artificial
  CRISPR gRNA sequence
gtggacatagttttacagct

SEQ ID NO: 671112 - DNA, 20 bp, Artificial
  CRISPR gRNA sequence
tacagctaccgtaagaactg

SEQ ID NO: 671113 - DNA, 20 bp, Artificial
  CRISPR gRNA sequence
acagctaccgtaagaactgt

SEQ ID NO: 671114 - DNA, 20 bp, Artificial
  CRISPR gRNA sequence
cagctaccgtaagaactgtt

SEQ ID NO: 671115 - DNA, 20 bp, Artificial
  CRISPR gRNA sequence
ccgtaagaactgtttgccta

SEQ ID NO: 671116 - DNA, 20 bp, Artificial
  CRISPR gRNA sequence
tttgcctatgactgattttt

SEQ ID NO: 671117 - DNA, 20 bp, Artificial
  CRISPR gRNA sequence
gcctatgactgatttttgtc

SEQ ID NO: 671118 - DNA, 20 bp, Artificial
  CRISPR gRNA sequence
cctatgactgatttttgtcc

SEQ ID NO: 671119 - DNA, 20 bp, Artificial
  CRISPR gRNA sequence
tgactgatttttgtcctaaa

SEQ ID NO: 671120 - DNA, 20 bp, Artificial
  CRISPR gRNA sequence
atttttgtcctaaatataat

SEQ ID NO: 671121 - DNA, 20 bp, Artificial
  CRISPR gRNA sequence
ttgtcctaaatataatacta

SEQ ID NO: 671122 - DNA, 20 bp, Artificial
  CRISPR gRNA sequence
tgtcctaaatataatactaa

SEQ ID NO: 671123 - DNA, 20 bp, Artificial
  CRISPR gRNA sequence
gtcctaaatataatactaat

SEQ ID NO: 671124 - DNA, 20 bp, Artificial
  CRISPR gRNA sequence
tcctaaatataatactaatg

SEQ ID NO: 671125 - DNA, 20 bp, Artificial
  CRISPR gRNA sequence
aatataatactaatgtaagt

SEQ ID NO: 671126 - DNA, 20 bp, Artificial
  CRISPR gRNA sequence
atgtaagttacttgtttcat

SEQ ID NO: 671127 - DNA, 20 bp, Artificial
  CRISPR gRNA sequence
cttgtttcattggagagcca

SEQ ID NO: 671128 - DNA, 20 bp, Artificial
  CRISPR gRNA sequence
gtttcattggagagccagta

SEQ ID NO: 671129 - DNA, 20 bp, Artificial
  CRISPR gRNA sequence
tttcattggagagccagtat

SEQ ID NO: 671130 - DNA, 20 bp, Artificial
  CRISPR gRNA sequence
cattggagagccagtatcat

SEQ ID NO: 671131 - DNA, 20 bp, Artificial
  CRISPR gRNA sequence
attggagagccagtatcatg

SEQ ID NO: 671132 - DNA, 20 bp, Artificial
  CRISPR gRNA sequence
gagagccagtatcatgtcat

SEQ ID NO: 671133 - DNA, 20 bp, Artificial
  CRISPR gRNA sequence
cgagtcaaaagatcttgaat

SEQ ID NO: 671134 - DNA, 20 bp, Artificial
  CRISPR gRNA sequence
gaattgatatcaagttcaca

SEQ ID NO: 671135 - DNA, 20 bp, Artificial
  CRISPR gRNA sequence
aattgatatcaagttcacat

SEQ ID NO: 671136 - DNA, 20 bp, Artificial
  CRISPR gRNA sequence
atatcaagttcacatttact

SEQ ID NO: 671137 - DNA, 20 bp, Artificial
  CRISPR gRNA sequence
acatttactaacttgtatcc

SEQ ID NO: 671138 - DNA, 20 bp, Artificial
  CRISPR gRNA sequence
actaacttgtatcctttcaa

SEQ ID NO: 671139 - DNA, 20 bp, Artificial
  CRISPR gRNA sequence
ctaacttgtatcctttcaat

SEQ ID NO: 671140 - DNA, 20 bp, Artificial
  CRISPR gRNA sequence
acttgtatcctttcaatagc

SEQ ID NO: 671141 - DNA, 20 bp, Artificial
  CRISPR gRNA sequence
gtatcctttcaatagccact

SEQ ID NO: 671142 - DNA, 20 bp, Artificial
  CRISPR gRNA sequence
tatcctttcaatagccactt

SEQ ID NO: 671143 - DNA, 20 bp, Artificial
  CRISPR gRNA sequence
tcaatagccacttaacaacc

SEQ ID NO: 671144 - DNA, 20 bp, Artificial
  CRISPR gRNA sequence
caatagccacttaacaacca

SEQ ID NO: 671145 - DNA, 20 bp, Artificial
  CRISPR gRNA sequence
aatagccacttaacaaccat

SEQ ID NO: 671146 - DNA, 20 bp, Artificial
  CRISPR gRNA sequence
aacaaccatgcttcagtgtt

SEQ ID NO: 671147 - DNA, 20 bp, Artificial
  CRISPR gRNA sequence
acaaccatgcttcagtgttt

SEQ ID NO: 671148 - DNA, 20 bp, Artificial
  CRISPR gRNA sequence
cagtgtttatctgtggctac

SEQ ID NO: 671149 - DNA, 20 bp, Artificial
  CRISPR gRNA sequence
agtgtttatctgtggctacc

SEQ ID NO: 671150 - DNA, 20 bp, Artificial
  CRISPR gRNA sequence
atctgtggctacccttccta

SEQ ID NO: 671151 - DNA, 20 bp, Artificial
  CRISPR gRNA sequence
tctgtggctacccttcctac

SEQ ID NO: 671152 - DNA, 20 bp, Artificial
  CRISPR gRNA sequence
tggctacccttcctacaatg

SEQ ID NO: 671153 - DNA, 20 bp, Artificial
  CRISPR gRNA sequence
cccttcctacaatgcagtca

SEQ ID NO: 671154 - DNA, 20 bp, Artificial
  CRISPR gRNA sequence
cctacaatgcagtcattctg

SEQ ID NO: 671155 - DNA, 20 bp, Artificial
  CRISPR gRNA sequence
ctacaatgcagtcattctga

SEQ ID NO: 671156 - DNA, 20 bp, Artificial
  CRISPR gRNA sequence
caatgcagtcattctgagta

SEQ ID NO: 671157 - DNA, 20 bp, Artificial
  CRISPR gRNA sequence
tgagtatcaaaaaagaatat

SEQ ID NO: 671158 - DNA, 20 bp, Artificial
  CRISPR gRNA sequence
agtatcaaaaaagaatatgt

SEQ ID NO: 671159 - DNA, 20 bp, Artificial
  CRISPR gRNA sequence
tataaatcataaaaactgtt

SEQ ID NO: 671160 - DNA, 20 bp, Artificial
  CRISPR gRNA sequence
ataaatcataaaaactgttt

SEQ ID NO: 671161 - DNA, 20 bp, Artificial
  CRISPR gRNA sequence
taaatcataaaaactgtttt

SEQ ID NO: 671162 - DNA, 20 bp, Artificial
  CRISPR gRNA sequence
ttttatttttctattattat

SEQ ID NO: 671163 - DNA, 20 bp, Artificial
  CRISPR gRNA sequence
tatttttctattattattat

SEQ ID NO: 671164 - DNA, 20 bp, Artificial
  CRISPR gRNA sequence
atttttctattattattatc

SEQ ID NO: 671165 - DNA, 20 bp, Artificial
  CRISPR gRNA sequence
tttttctattattattatca

SEQ ID NO: 671166 - DNA, 20 bp, Artificial
  CRISPR gRNA sequence
ttctattattattatcatta

SEQ ID NO: 671167 - DNA, 20 bp, Artificial
  CRISPR gRNA sequence
tctattattattatcattac

SEQ ID NO: 671168 - DNA, 20 bp, Artificial
  CRISPR gRNA sequence
ctattattattatcattact

SEQ ID NO: 671169 - DNA, 20 bp, Artificial
  CRISPR gRNA sequence
tattattattatcattacta

SEQ ID NO: 671170 - DNA, 20 bp, Artificial
  CRISPR gRNA sequence
ttattattatcattactatt

SEQ ID NO: 671171 - DNA, 20 bp, Artificial
  CRISPR gRNA sequence
ttattatcattactattatc

SEQ ID NO: 671172 - DNA, 20 bp, Artificial
  CRISPR gRNA sequence
ttatcattactattatcatt

SEQ ID NO: 671173 - DNA, 20 bp, Artificial
  CRISPR gRNA sequence
tcattactattatcattaaa

SEQ ID NO: 671174 - DNA, 20 bp, Artificial
  CRISPR gRNA sequence
ctattatcattaaaaggatt

SEQ ID NO: 671175 - DNA, 20 bp, Artificial
  CRISPR gRNA sequence
ttatcattaaaaggattcta

SEQ ID NO: 671176 - DNA, 20 bp, Artificial
  CRISPR gRNA sequence
tcattaaaaggattctaaat

SEQ ID NO: 671177 - DNA, 20 bp, Artificial
  CRISPR gRNA sequence
aaaggattctaaatctgtag

SEQ ID NO: 671178 - DNA, 20 bp, Artificial
  CRISPR gRNA sequence
taaatctgtagtctaccaga

SEQ ID NO: 671179 - DNA, 20 bp, Artificial
  CRISPR gRNA sequence
aatctgtagtctaccagaga

SEQ ID NO: 671180 - DNA, 20 bp, Artificial
  CRISPR gRNA sequence
tagtctaccagagattattt

SEQ ID NO: 671181 - DNA, 20 bp, Artificial
  CRISPR gRNA sequence
ccagagattattttatctag

SEQ ID NO: 671182 - DNA, 20 bp, Artificial
  CRISPR gRNA sequence
ttttatctagcctgctgttt

SEQ ID NO: 671183 - DNA, 20 bp, Artificial
  CRISPR gRNA sequence
tatctagcctgctgttttca

SEQ ID NO: 671184 - DNA, 20 bp, Artificial
  CRISPR gRNA sequence
atctagcctgctgttttcag

SEQ ID NO: 671185 - DNA, 20 bp, Artificial
  CRISPR gRNA sequence
tctagcctgctgttttcaga

SEQ ID NO: 671186 - DNA, 20 bp, Artificial
  CRISPR gRNA sequence
gcctgctgttttcagaaaca

SEQ ID NO: 671187 - DNA, 20 bp, Artificial
  CRISPR gRNA sequence
ctgttttcagaaacatcaag

SEQ ID NO: 671188 - DNA, 20 bp, Artificial
  CRISPR gRNA sequence
ttttcagaaacatcaagtgt

SEQ ID NO: 671189 - DNA, 20 bp, Artificial
  CRISPR gRNA sequence
tcagaaacatcaagtgttat

SEQ ID NO: 671190 - DNA, 20 bp, Artificial
  CRISPR gRNA sequence
cagaaacatcaagtgttatt

SEQ ID NO: 671191 - DNA, 20 bp, Artificial
  CRISPR gRNA sequence
agaaacatcaagtgttattt

SEQ ID NO: 671192 - DNA, 20 bp, Artificial
  CRISPR gRNA sequence
tttccccccatattttagat

SEQ ID NO: 671193 - DNA, 20 bp, Artificial
  CRISPR gRNA sequence
ccccccatattttagatggt

SEQ ID NO: 671194 - DNA, 20 bp, Artificial
  CRISPR gRNA sequence
cccccatattttagatggta

SEQ ID NO: 671195 - DNA, 20 bp, Artificial
  CRISPR gRNA sequence
tagatggtactagtggctga

SEQ ID NO: 671196 - DNA, 20 bp, Artificial
  CRISPR gRNA sequence
agatggtactagtggctgag

SEQ ID NO: 671197 - DNA, 20 bp, Artificial
  CRISPR gRNA sequence
gatggtactagtggctgagt

SEQ ID NO: 671198 - DNA, 20 bp, Artificial
  CRISPR gRNA sequence
gtggctgagtcaggataaac

SEQ ID NO: 671199 - DNA, 20 bp, Artificial
  CRISPR gRNA sequence
agtcaggataaacaaatttc

SEQ ID NO: 671200 - DNA, 20 bp, Artificial
  CRISPR gRNA sequence
cccaaggtcccataacaagt

SEQ ID NO: 671201 - DNA, 20 bp, Artificial
  CRISPR gRNA sequence
ccaaggtcccataacaagtt

SEQ ID NO: 671202 - DNA, 20 bp, Artificial
  CRISPR gRNA sequence
aatggcagaagaggtggtag

SEQ ID NO: 671203 - DNA, 20 bp, Artificial
  CRISPR gRNA sequence
gttttctgccttcaggtgca

SEQ ID NO: 671204 - DNA, 20 bp, Artificial
  CRISPR gRNA sequence
tctgccttcaggtgcagggt

SEQ ID NO: 671205 - DNA, 20 bp, Artificial
  CRISPR gRNA sequence
ctgccttcaggtgcagggta

SEQ ID NO: 671206 - DNA, 20 bp, Artificial
  CRISPR gRNA sequence
tgccttcaggtgcagggtaa

SEQ ID NO: 671207 - DNA, 20 bp, Artificial
  CRISPR gRNA sequence
ccttcaggtgcagggtaact

SEQ ID NO: 671208 - DNA, 20 bp, Artificial
  CRISPR gRNA sequence
caggtgcagggtaactttac

SEQ ID NO: 671209 - DNA, 20 bp, Artificial
  CRISPR gRNA sequence
aggtgcagggtaactttact

SEQ ID NO: 671210 - DNA, 20 bp, Artificial
  CRISPR gRNA sequence
tactacactattgttggaat

SEQ ID NO: 671211 - DNA, 20 bp, Artificial
  CRISPR gRNA sequence
actacactattgttggaata

SEQ ID NO: 671212 - DNA, 20 bp, Artificial
  CRISPR gRNA sequence
ctacactattgttggaataa

SEQ ID NO: 671213 - DNA, 20 bp, Artificial
  CRISPR gRNA sequence
cactattgttggaataataa

SEQ ID NO: 671214 - DNA, 20 bp, Artificial
  CRISPR gRNA sequence
ttgttggaataataacagta

SEQ ID NO: 671215 - DNA, 20 bp, Artificial
  CRISPR gRNA sequence
ttggaataataacagtattt

SEQ ID NO: 671216 - DNA, 20 bp, Artificial
  CRISPR gRNA sequence
gaataataacagtatttcag

SEQ ID NO: 671217 - DNA, 20 bp, Artificial
  CRISPR gRNA sequence
cagaaatcagtactgtcttg

SEQ ID NO: 671218 - DNA, 20 bp, Artificial
  CRISPR gRNA sequence
agaaatcagtactgtcttga

SEQ ID NO: 671219 - DNA, 20 bp, Artificial
  CRISPR gRNA sequence
tcttgatctggagtaactcc

SEQ ID NO: 671220 - DNA, 20 bp, Artificial
  CRISPR gRNA sequence
gatctggagtaactccagtg

SEQ ID NO: 671221 - DNA, 20 bp, Artificial
  CRISPR gRNA sequence
atctggagtaactccagtgg

SEQ ID NO: 671222 - DNA, 20 bp, Artificial
  CRISPR gRNA sequence
gagtaactccagtgggttta

SEQ ID NO: 671223 - DNA, 20 bp, Artificial
  CRISPR gRNA sequence
cagtgggtttaagaaataca

SEQ ID NO: 671224 - DNA, 20 bp, Artificial
  CRISPR gRNA sequence
aagaaatacataatatagct

SEQ ID NO: 671225 - DNA, 20 bp, Artificial
  CRISPR gRNA sequence
agaaatacataatatagcta

SEQ ID NO: 671226 - DNA, 20 bp, Artificial
  CRISPR gRNA sequence
tattgaacagagaagaaaga

SEQ ID NO: 671227 - DNA, 20 bp, Artificial
  CRISPR gRNA sequence
aacagagaagaaagaggatg

SEQ ID NO: 671228 - DNA, 20 bp, Artificial
  CRISPR gRNA sequence
agaatgctacccagaagtgg

SEQ ID NO: 671229 - DNA, 20 bp, Artificial
  CRISPR gRNA sequence
gaatgctacccagaagtggc

SEQ ID NO: 671230 - DNA, 20 bp, Artificial
  CRISPR gRNA sequence
cccagaagtggctcagctgc

SEQ ID NO: 671231 - DNA, 20 bp, Artificial
  CRISPR gRNA sequence
agctgcagctcagtgacacc

SEQ ID NO: 671232 - DNA, 20 bp, Artificial
  CRISPR gRNA sequence
cagctcagtgacaccagtgt

SEQ ID NO: 671233 - DNA, 20 bp, Artificial
  CRISPR gRNA sequence
agtgacaccagtgtctggac

SEQ ID NO: 671234 - DNA, 20 bp, Artificial
  CRISPR gRNA sequence
gacatgtcccaccgtttata

SEQ ID NO: 671235 - DNA, 20 bp, Artificial
  CRISPR gRNA sequence
ataaaacaaattctttaagg

SEQ ID NO: 671236 - DNA, 20 bp, Artificial
  CRISPR gRNA sequence
taaaacaaattctttaagga

SEQ ID NO: 671237 - DNA, 20 bp, Artificial
  CRISPR gRNA sequence
tttaaggatgttgtgaagaa

SEQ ID NO: 671238 - DNA, 20 bp, Artificial
  CRISPR gRNA sequence
taaggatgttgtgaagaaac

SEQ ID NO: 671239 - DNA, 20 bp, Artificial
  CRISPR gRNA sequence
aaggatgttgtgaagaaact

SEQ ID NO: 671240 - DNA, 20 bp, Artificial
  CRISPR gRNA sequence
aggatgttgtgaagaaactg

SEQ ID NO: 671241 - DNA, 20 bp, Artificial
  CRISPR gRNA sequence
tgaagaaactgtttttcaag

SEQ ID NO: 671242 - DNA, 20 bp, Artificial
  CRISPR gRNA sequence
tttttcaagactcatccatt

SEQ ID NO: 671243 - DNA, 20 bp, Artificial
  CRISPR gRNA sequence
ttcaagactcatccatttat

SEQ ID NO: 671244 - DNA, 20 bp, Artificial
  CRISPR gRNA sequence
tcaagactcatccatttatt

SEQ ID NO: 671245 - DNA, 20 bp, Artificial
  CRISPR gRNA sequence
caagactcatccatttattt

SEQ ID NO: 671246 - DNA, 20 bp, Artificial
  CRISPR gRNA sequence
aagactcatccatttattta

SEQ ID NO: 671247 - DNA, 20 bp, Artificial
  CRISPR gRNA sequence
atccatttatttatccacag

SEQ ID NO: 671248 - DNA, 20 bp, Artificial
  CRISPR gRNA sequence
atttatccacagtcaaaagg

SEQ ID NO: 671249 - DNA, 20 bp, Artificial
  CRISPR gRNA sequence
tttatccacagtcaaaagga

SEQ ID NO: 671250 - DNA, 20 bp, Artificial
  CRISPR gRNA sequence
atccacagtcaaaaggaaca

SEQ ID NO: 671251 - DNA, 20 bp, Artificial
  CRISPR gRNA sequence
tccacagtcaaaaggaacaa

SEQ ID NO: 671252 - DNA, 20 bp, Artificial
  CRISPR gRNA sequence
catgaaattttgctgaggat

SEQ ID NO: 671253 - DNA, 20 bp, Artificial
  CRISPR gRNA sequence
tgctgaggatattaaaaaat

SEQ ID NO: 671254 - DNA, 20 bp, Artificial
  CRISPR gRNA sequence
gctgaggatattaaaaaatg

SEQ ID NO: 671255 - DNA, 20 bp, Artificial
  CRISPR gRNA sequence
ctgaggatattaaaaaatga

SEQ ID NO: 671256 - DNA, 20 bp, Artificial
  CRISPR gRNA sequence
aggatattaaaaaatgattg

SEQ ID NO: 671257 - DNA, 20 bp, Artificial
  CRISPR gRNA sequence
aaaaatgattgcatatacct

SEQ ID NO: 671258 - DNA, 20 bp, Artificial
  CRISPR gRNA sequence
catatacctttgttgtggtt

SEQ ID NO: 671259 - DNA, 20 bp, Artificial
  CRISPR gRNA sequence
tgttgtggttttactttaat

SEQ ID NO: 671260 - DNA, 20 bp, Artificial
  CRISPR gRNA sequence
gttgtggttttactttaatt

SEQ ID NO: 671261 - DNA, 20 bp, Artificial
  CRISPR gRNA sequence
ttgtggttttactttaattg

SEQ ID NO: 671262 - DNA, 20 bp, Artificial
  CRISPR gRNA sequence
tggttttactttaattgttt

SEQ ID NO: 671263 - DNA, 20 bp, Artificial
  CRISPR gRNA sequence
tactttaattgtttagactg

SEQ ID NO: 671264 - DNA, 20 bp, Artificial
  CRISPR gRNA sequence
actttaattgtttagactgt

SEQ ID NO: 671265 - DNA, 20 bp, Artificial
  CRISPR gRNA sequence
ctttaattgtttagactgtt

SEQ ID NO: 671266 - DNA, 20 bp, Artificial
  CRISPR gRNA sequence
taattgtttagactgttggt

SEQ ID NO: 671267 - DNA, 20 bp, Artificial
  CRISPR gRNA sequence
aattgtttagactgttggta

SEQ ID NO: 671268 - DNA, 20 bp, Artificial
  CRISPR gRNA sequence
attgtttagactgttggtaa

SEQ ID NO: 671269 - DNA, 20 bp, Artificial
  CRISPR gRNA sequence
tttagactgttggtaaattc

SEQ ID NO: 671270 - DNA, 20 bp, Artificial
  CRISPR gRNA sequence
agactgttggtaaattctta

SEQ ID NO: 671271 - DNA, 20 bp, Artificial
  CRISPR gRNA sequence
gactgttggtaaattcttag

SEQ ID NO: 671272 - DNA, 20 bp, Artificial
  CRISPR gRNA sequence
ttggtaaattcttagtaaat

SEQ ID NO: 671273 - DNA, 20 bp, Artificial
  CRISPR gRNA sequence
gtaaattcttagtaaataat

SEQ ID NO: 671274 - DNA, 20 bp, Artificial
  CRISPR gRNA sequence
ttagtaaataattgggcttt

SEQ ID NO: 671275 - DNA, 20 bp, Artificial
  CRISPR gRNA sequence
agtaaataattgggctttac

SEQ ID NO: 671276 - DNA, 20 bp, Artificial
  CRISPR gRNA sequence
gtaaataattgggctttaca

SEQ ID NO: 671277 - DNA, 20 bp, Artificial
  CRISPR gRNA sequence
ggctttacatcacagttttg

SEQ ID NO: 671278 - DNA, 20 bp, Artificial
  CRISPR gRNA sequence
tacatcacagttttgaaggc

SEQ ID NO: 671279 - DNA, 20 bp, Artificial
  CRISPR gRNA sequence
acatcacagttttgaaggca

SEQ ID NO: 671280 - DNA, 20 bp, Artificial
  CRISPR gRNA sequence
catcacagttttgaaggcac

SEQ ID NO: 671281 - DNA, 20 bp, Artificial
  CRISPR gRNA sequence
tgaaggcactttgttttcct

SEQ ID NO: 671282 - DNA, 20 bp, Artificial
  CRISPR gRNA sequence
gaaggcactttgttttccta

SEQ ID NO: 671283 - DNA, 20 bp, Artificial
  CRISPR gRNA sequence
aaggcactttgttttcctaa

SEQ ID NO: 671284 - DNA, 20 bp, Artificial
  CRISPR gRNA sequence
tgttttcctaacacattatt

SEQ ID NO: 671285 - DNA, 20 bp, Artificial
  CRISPR gRNA sequence
gttttcctaacacattattt

SEQ ID NO: 671286 - DNA, 20 bp, Artificial
  CRISPR gRNA sequence
ttttcctaacacattattta

SEQ ID NO: 671287 - DNA, 20 bp, Artificial
  CRISPR gRNA sequence
tcctaacacattatttaaac

SEQ ID NO: 671288 - DNA, 20 bp, Artificial
  CRISPR gRNA sequence
cctaacacattatttaaaca

SEQ ID NO: 671289 - DNA, 20 bp, Artificial
  CRISPR gRNA sequence
ctaacacattatttaaacag

SEQ ID NO: 671290 - DNA, 20 bp, Artificial
  CRISPR gRNA sequence
acacattatttaaacagctg

SEQ ID NO: 671291 - DNA, 20 bp, Artificial
  CRISPR gRNA sequence
tttaaacagctgttgggata

SEQ ID NO: 671292 - DNA, 20 bp, Artificial
  CRISPR gRNA sequence
aaacagctgttgggatatta

SEQ ID NO: 671293 - DNA, 20 bp, Artificial
  CRISPR gRNA sequence
aacagctgttgggatattaa

SEQ ID NO: 671294 - DNA, 20 bp, Artificial
  CRISPR gRNA sequence
ttgggatattaacatggatt

SEQ ID NO: 671295 - DNA, 20 bp, Artificial
  CRISPR gRNA sequence
ggatattaacatggatttaa

SEQ ID NO: 671296 - DNA, 20 bp, Artificial
  CRISPR gRNA sequence
acatggatttaatcatgttt

SEQ ID NO: 671297 - DNA, 20 bp, Artificial
  CRISPR gRNA sequence
aatcatgtttggtgtttctg

SEQ ID NO: 671298 - DNA, 20 bp, Artificial
  CRISPR gRNA sequence
atcatgtttggtgtttctgt

SEQ ID NO: 671299 - DNA, 20 bp, Artificial
  CRISPR gRNA sequence
ggtgtttctgtttagaaagt

SEQ ID NO: 671300 - DNA, 20 bp, Artificial
  CRISPR gRNA sequence
gtgtttctgtttagaaagtt

SEQ ID NO: 671301 - DNA, 20 bp, Artificial
  CRISPR gRNA sequence
ctgtttagaaagtttacgtg

SEQ ID NO: 671302 - DNA, 20 bp, Artificial
  CRISPR gRNA sequence
tgtttagaaagtttacgtga

SEQ ID NO: 671303 - DNA, 20 bp, Artificial
  CRISPR gRNA sequence
tttagaaagtttacgtgaga

SEQ ID NO: 671304 - DNA, 20 bp, Artificial
  CRISPR gRNA sequence
agaaagtttacgtgagagag

SEQ ID NO: 671305 - DNA, 20 bp, Artificial
  CRISPR gRNA sequence
gaaagtttacgtgagagaga

SEQ ID NO: 671306 - DNA, 20 bp, Artificial
  CRISPR gRNA sequence
acgtgagagagagttatatt

SEQ ID NO: 671307 - DNA, 20 bp, Artificial
  CRISPR gRNA sequence
cgtgagagagagttatatta

SEQ ID NO: 671308 - DNA, 20 bp, Artificial
  CRISPR gRNA sequence
tattagtgtagaagcaactt

SEQ ID NO: 671309 - DNA, 20 bp, Artificial
  CRISPR gRNA sequence
gtgtagaagcaacttcaata

SEQ ID NO: 671310 - DNA, 20 bp, Artificial
  CRISPR gRNA sequence
caataaattattagatagcc

SEQ ID NO: 671311 - DNA, 20 bp, Artificial
  CRISPR gRNA sequence
aataaattattagatagcca

SEQ ID NO: 671312 - DNA, 20 bp, Artificial
  CRISPR gRNA sequence
ttagatagccatattggttc

SEQ ID NO: 671313 - DNA, 20 bp, Artificial
  CRISPR gRNA sequence
gatagccatattggttcaat

SEQ ID NO: 671314 - DNA, 20 bp, Artificial
  CRISPR gRNA sequence
gttcaattagtgtatataac

SEQ ID NO: 671315 - DNA, 20 bp, Artificial
  CRISPR gRNA sequence
aattagtgtatataacacca

SEQ ID NO: 671316 - DNA, 20 bp, Artificial
  CRISPR gRNA sequence
gtgtatataacaccatttca

SEQ ID NO: 671317 - DNA, 20 bp, Artificial
  CRISPR gRNA sequence
caagtgtctggcatagactg

SEQ ID NO: 671318 - DNA, 20 bp, Artificial
  CRISPR gRNA sequence
aagtgtctggcatagactgg

SEQ ID NO: 671319 - DNA, 20 bp, Artificial
  CRISPR gRNA sequence
gcatagactgggaaatgttc

SEQ ID NO: 671320 - DNA, 20 bp, Artificial
  CRISPR gRNA sequence
ggaaatgttcatgcttataa

SEQ ID NO: 671321 - DNA, 20 bp, Artificial
  CRISPR gRNA sequence
atgcttataagttataaaat

SEQ ID NO: 671322 - DNA, 20 bp, Artificial
  CRISPR gRNA sequence
ataagttataaaatccctta

SEQ ID NO: 671323 - DNA, 20 bp, Artificial
  CRISPR gRNA sequence
taagttataaaatcccttaa

SEQ ID NO: 671324 - DNA, 20 bp, Artificial
  CRISPR gRNA sequence
taaaatcccttaagtgccca

SEQ ID NO: 671325 - DNA, 20 bp, Artificial
  CRISPR gRNA sequence
aagtgcccacttgaattgcc

SEQ ID NO: 671326 - DNA, 20 bp, Artificial
  CRISPR gRNA sequence
agtgcccacttgaattgcca

SEQ ID NO: 671327 - DNA, 20 bp, Artificial
  CRISPR gRNA sequence
gaattgccagggaacagaaa

SEQ ID NO: 671328 - DNA, 20 bp, Artificial
  CRISPR gRNA sequence
aattgccagggaacagaaac

SEQ ID NO: 671329 - DNA, 20 bp, Artificial
  CRISPR gRNA sequence
ccagggaacagaaaccaacc

SEQ ID NO: 671330 - DNA, 20 bp, Artificial
  CRISPR gRNA sequence
acacatcacacctgaaatac

SEQ ID NO: 671331 - DNA, 20 bp, Artificial
  CRISPR gRNA sequence
cacatcacacctgaaataca

SEQ ID NO: 671332 - DNA, 20 bp, Artificial
  CRISPR gRNA sequence
aaatacactttttttcattt

SEQ ID NO: 671333 - DNA, 20 bp, Artificial
  CRISPR gRNA sequence
tttttcatttggtaagtaag

SEQ ID NO: 671334 - DNA, 20 bp, Artificial
  CRISPR gRNA sequence
ttttcatttggtaagtaaga

SEQ ID NO: 671335 - DNA, 20 bp, Artificial
  CRISPR gRNA sequence
tttcatttggtaagtaagaa

SEQ ID NO: 671336 - DNA, 20 bp, Artificial
  CRISPR gRNA sequence
ttcatttggtaagtaagaat

SEQ ID NO: 671337 - DNA, 20 bp, Artificial
  CRISPR gRNA sequence
tcatttggtaagtaagaatg

SEQ ID NO: 671338 - DNA, 20 bp, Artificial
  CRISPR gRNA sequence
catttggtaagtaagaatgg

SEQ ID NO: 671339 - DNA, 20 bp, Artificial
  CRISPR gRNA sequence
atttggtaagtaagaatggt

SEQ ID NO: 671340 - DNA, 20 bp, Artificial
  CRISPR gRNA sequence
ggtaagtaagaatggtattt

SEQ ID NO: 671341 - DNA, 20 bp, Artificial
  CRISPR gRNA sequence
gtaagtaagaatggtatttt

SEQ ID NO: 671342 - DNA, 20 bp, Artificial
  CRISPR gRNA sequence
tactatcttctgttccacac

SEQ ID NO: 671343 - DNA, 20 bp, Artificial
  CRISPR gRNA sequence
actatcttctgttccacact

SEQ ID NO: 671344 - DNA, 20 bp, Artificial
  CRISPR gRNA sequence
ctatcttctgttccacactg

SEQ ID NO: 671345 - DNA, 20 bp, Artificial
  CRISPR gRNA sequence
tcttctgttccacactgtga

SEQ ID NO: 671346 - DNA, 20 bp, Artificial
  CRISPR gRNA sequence
ctgttccacactgtgaaaaa

SEQ ID NO: 671347 - DNA, 20 bp, Artificial
  CRISPR gRNA sequence
tgttccacactgtgaaaaaa

SEQ ID NO: 671348 - DNA, 20 bp, Artificial
  CRISPR gRNA sequence
ttccacactgtgaaaaaaat

SEQ ID NO: 671349 - DNA, 20 bp, Artificial
  CRISPR gRNA sequence
cacactgtgaaaaaaatatt

SEQ ID NO: 671350 - DNA, 20 bp, Artificial
  CRISPR gRNA sequence
tgaaaaaaatatttaattcc

SEQ ID NO: 671351 - DNA, 20 bp, Artificial
  CRISPR gRNA sequence
aattcccataatatttactt

SEQ ID NO: 671352 - DNA, 20 bp, Artificial
  CRISPR gRNA sequence
attcccataatatttacttc

SEQ ID NO: 671353 - DNA, 20 bp, Artificial
  CRISPR gRNA sequence
ccataatatttacttccttg

SEQ ID NO: 671354 - DNA, 20 bp, Artificial
  CRISPR gRNA sequence
acttccttgaaaaattaaaa

SEQ ID NO: 671355 - DNA, 20 bp, Artificial
  CRISPR gRNA sequence
cttccttgaaaaattaaaaa

SEQ ID NO: 671356 - DNA, 20 bp, Artificial
  CRISPR gRNA sequence
ccttgaaaaattaaaaatta

SEQ ID NO: 671357 - DNA, 20 bp, Artificial
  CRISPR gRNA sequence
cttgaaaaattaaaaattaa

SEQ ID NO: 671358 - DNA, 20 bp, Artificial
  CRISPR gRNA sequence
gaaaaattaaaaattaaaat

SEQ ID NO: 671359 - DNA, 20 bp, Artificial
  CRISPR gRNA sequence
aaaaattaaaaattaaaatt

SEQ ID NO: 671360 - DNA, 20 bp, Artificial
  CRISPR gRNA sequence
aaaattaaaattaaaatata

SEQ ID NO: 671361 - DNA, 20 bp, Artificial
  CRISPR gRNA sequence
aaattaaaatatacactttg

SEQ ID NO: 671362 - DNA, 20 bp, Artificial
  CRISPR gRNA sequence
aaatatacactttggcaact

SEQ ID NO: 671363 - DNA, 20 bp, Artificial
  CRISPR gRNA sequence
tggcaactaaacaaaaataa

SEQ ID NO: 671364 - DNA, 20 bp, Artificial
  CRISPR gRNA sequence
ggcaactaaacaaaaataag

SEQ ID NO: 671365 - DNA, 20 bp, Artificial
  CRISPR gRNA sequence
gcaactaaacaaaaataagt

SEQ ID NO: 671366 - DNA, 20 bp, Artificial
  CRISPR gRNA sequence
aacaaaaataagtcaccaat

SEQ ID NO: 671367 - DNA, 20 bp, Artificial
  CRISPR gRNA sequence
catagaaattaaactagaaa

SEQ ID NO: 671368 - DNA, 20 bp, Artificial
  CRISPR gRNA sequence
atagaaattaaactagaaag

SEQ ID NO: 671369 - DNA, 20 bp, Artificial
  CRISPR gRNA sequence
aactagaaagcttattttat

SEQ ID NO: 671370 - DNA, 20 bp, Artificial
  CRISPR gRNA sequence
gaaagcttattttatactct

SEQ ID NO: 671371 - DNA, 20 bp, Artificial
  CRISPR gRNA sequence
attttatactctataagatc

SEQ ID NO: 671372 - DNA, 20 bp, Artificial
  CRISPR gRNA sequence
ttttatactctataagatca

SEQ ID NO: 671373 - DNA, 20 bp, Artificial
  CRISPR gRNA sequence
tatactctataagatcaata

SEQ ID NO: 671374 - DNA, 20 bp, Artificial
  CRISPR gRNA sequence
atactctataagatcaataa

SEQ ID NO: 671375 - DNA, 20 bp, Artificial
  CRISPR gRNA sequence
tactctataagatcaataaa

SEQ ID NO: 671376 - DNA, 20 bp, Artificial
  CRISPR gRNA sequence
tataagatcaataaatacat

SEQ ID NO: 671377 - DNA, 20 bp, Artificial
  CRISPR gRNA sequence
taagatcaataaatacatca

SEQ ID NO: 671378 - DNA, 20 bp, Artificial
  CRISPR gRNA sequence
taaatagagaaaataaatca

SEQ ID NO: 671379 - DNA, 20 bp, Artificial
  CRISPR gRNA sequence
aaatagagaaaataaatcat

SEQ ID NO: 671380 - DNA, 20 bp, Artificial
  CRISPR gRNA sequence
aatagagaaaataaatcata

SEQ ID NO: 671381 - DNA, 20 bp, Artificial
  CRISPR gRNA sequence
tgcattattttcctggttag

SEQ ID NO: 671382 - DNA, 20 bp, Artificial
  CRISPR gRNA sequence
cattattttcctggttagga

SEQ ID NO: 671383 - DNA, 20 bp, Artificial
  CRISPR gRNA sequence
ttttcctggttaggaaactt

SEQ ID NO: 671384 - DNA, 20 bp, Artificial
  CRISPR gRNA sequence
tcctggttaggaaacttgac

SEQ ID NO: 671385 - DNA, 20 bp, Artificial
  CRISPR gRNA sequence
cctggttaggaaacttgact

SEQ ID NO: 671386 - DNA, 20 bp, Artificial
  CRISPR gRNA sequence
ctggttaggaaacttgacta

SEQ ID NO: 671387 - DNA, 20 bp, Artificial
  CRISPR gRNA sequence
gttaggaaacttgactaact

SEQ ID NO: 671388 - DNA, 20 bp, Artificial
  CRISPR gRNA sequence
ggaaacttgactaacttgtt

SEQ ID NO: 671389 - DNA, 20 bp, Artificial
  CRISPR gRNA sequence
gactaacttgtttgtagatt

SEQ ID NO: 671390 - DNA, 20 bp, Artificial
  CRISPR gRNA sequence
actaacttgtttgtagatta

SEQ ID NO: 671391 - DNA, 20 bp, Artificial
  CRISPR gRNA sequence
acttgtttgtagattagtag

SEQ ID NO: 671392 - DNA, 20 bp, Artificial
  CRISPR gRNA sequence
gtttgtagattagtagaatc

SEQ ID NO: 671393 - DNA, 20 bp, Artificial
  CRISPR gRNA sequence
tttgtagattagtagaatca

SEQ ID NO: 671394 - DNA, 20 bp, Artificial
  CRISPR gRNA sequence
gtagattagtagaatcaggt

SEQ ID NO: 671395 - DNA, 20 bp, Artificial
  CRISPR gRNA sequence
tagattagtagaatcaggtc

SEQ ID NO: 671396 - DNA, 20 bp, Artificial
  CRISPR gRNA sequence
gtagaatcaggtcatattaa

SEQ ID NO: 671397 - DNA, 20 bp, Artificial
  CRISPR gRNA sequence
ataataaagttttaacttgt

SEQ ID NO: 671398 - DNA, 20 bp, Artificial
  CRISPR gRNA sequence
taacttgtagaaagtttaat

SEQ ID NO: 671399 - DNA, 20 bp, Artificial
  CRISPR gRNA sequence
aacttgtagaaagtttaata

SEQ ID NO: 671400 - DNA, 20 bp, Artificial
  CRISPR gRNA sequence
acttgtagaaagtttaatat

SEQ ID NO: 671401 - DNA, 20 bp, Artificial
  CRISPR gRNA sequence
gtagaaagtttaatatgtat

SEQ ID NO: 671402 - DNA, 20 bp, Artificial
  CRISPR gRNA sequence
tagaaagtttaatatgtata

SEQ ID NO: 671403 - DNA, 20 bp, Artificial
  CRISPR gRNA sequence
aatatgtatatttaaaaatg

SEQ ID NO: 671404 - DNA, 20 bp, Artificial
  CRISPR gRNA sequence
atatgtatatttaaaaatgt

SEQ ID NO: 671405 - DNA, 20 bp, Artificial
  CRISPR gRNA sequence
aaaaatgtcttaaattgata

SEQ ID NO: 671406 - DNA, 20 bp, Artificial
  CRISPR gRNA sequence
aaaatgtcttaaattgatat

SEQ ID NO: 671407 - DNA, 20 bp, Artificial
  CRISPR gRNA sequence
aaattgatattttcagttct

SEQ ID NO: 671408 - DNA, 20 bp, Artificial
  CRISPR gRNA sequence
aattgatattttcagttctc

SEQ ID NO: 671409 - DNA, 20 bp, Artificial
  CRISPR gRNA sequence
atattttcagttctcattac

SEQ ID NO: 671410 - DNA, 20 bp, Artificial
  CRISPR gRNA sequence
tcagttctcattactatgta

SEQ ID NO: 671411 - DNA, 20 bp, Artificial
  CRISPR gRNA sequence
cagttctcattactatgtat

SEQ ID NO: 671412 - DNA, 20 bp, Artificial
  CRISPR gRNA sequence
agttctcattactatgtatg

SEQ ID NO: 671413 - DNA, 20 bp, Artificial
  CRISPR gRNA sequence
tcattactatgtatggtgtt

SEQ ID NO: 671414 - DNA, 20 bp, Artificial
  CRISPR gRNA sequence
attactatgtatggtgtttc

SEQ ID NO: 671415 - DNA, 20 bp, Artificial
  CRISPR gRNA sequence
ctatgtatggtgtttccaga

SEQ ID NO: 671416 - DNA, 20 bp, Artificial
  CRISPR gRNA sequence
tgtatggtgtttccagaact

SEQ ID NO: 671417 - DNA, 20 bp, Artificial
  CRISPR gRNA sequence
ccagaacttgacatttaaaa

SEQ ID NO: 671418 - DNA, 20 bp, Artificial
  CRISPR gRNA sequence
cagaacttgacatttaaaaa

SEQ ID NO: 671419 - DNA, 20 bp, Artificial
  CRISPR gRNA sequence
gacatttaaaaattatagca

SEQ ID NO: 671420 - DNA, 20 bp, Artificial
  CRISPR gRNA sequence
acatttaaaaattatagcag

SEQ ID NO: 671421 - DNA, 20 bp, Artificial
  CRISPR gRNA sequence
aaaaattatagcagtttgtg

SEQ ID NO: 671422 - DNA, 20 bp, Artificial
  CRISPR gRNA sequence
aaaattatagcagtttgtga

SEQ ID NO: 671423 - DNA, 20 bp, Artificial
  CRISPR gRNA sequence
tagcagtttgtgaaaataaa

SEQ ID NO: 671424 - DNA, 20 bp, Artificial
  CRISPR gRNA sequence
gtgaaaataaaattctaatg

SEQ ID NO: 671425 - DNA, 20 bp, Artificial
  CRISPR gRNA sequence
tgaaaataaaattctaatga

SEQ ID NO: 671426 - DNA, 20 bp, Artificial
  CRISPR gRNA sequence
taatgatgagggtagaattt

SEQ ID NO: 671427 - DNA, 20 bp, Artificial
  CRISPR gRNA sequence
atgatgagggtagaatttat

SEQ ID NO: 671428 - DNA, 20 bp, Artificial
  CRISPR gRNA sequence
attatcttaatttgaaaatt

SEQ ID NO: 671429 - DNA, 20 bp, Artificial
  CRISPR gRNA sequence
ttatcttaatttgaaaattt

SEQ ID NO: 671430 - DNA, 20 bp, Artificial
  CRISPR gRNA sequence
tcttaatttgaaaatttaaa

SEQ ID NO: 671431 - DNA, 20 bp, Artificial
  CRISPR gRNA sequence
aatttgaaaatttaaaatta

SEQ ID NO: 671432 - DNA, 20 bp, Artificial
  CRISPR gRNA sequence
atttgaaaatttaaaattaa

SEQ ID NO: 671433 - DNA, 20 bp, Artificial
  CRISPR gRNA sequence
gaaaatttaaaattaatata

SEQ ID NO: 671434 - DNA, 20 bp, Artificial
  CRISPR gRNA sequence
aaaatttaaaattaatatat

SEQ ID NO: 671435 - DNA, 20 bp, Artificial
  CRISPR gRNA sequence
aaaattaatatatttatcat

SEQ ID NO: 671436 - DNA, 20 bp, Artificial
  CRISPR gRNA sequence
aaattaatatatttatcatg

SEQ ID NO: 671437 - DNA, 20 bp, Artificial
  CRISPR gRNA sequence
atatatttatcatgcatata

SEQ ID NO: 671438 - DNA, 20 bp, Artificial
  CRISPR gRNA sequence
atcatgcatataaagtgatc

SEQ ID NO: 671439 - DNA, 20 bp, Artificial
  CRISPR gRNA sequence
tcatgcatataaagtgatct

SEQ ID NO: 671440 - DNA, 20 bp, Artificial
  CRISPR gRNA sequence
tttcttaaaaattttaaaaa

SEQ ID NO: 671441 - DNA, 20 bp, Artificial
  CRISPR gRNA sequence
ttcttaaaaattttaaaaat

SEQ ID NO: 671442 - DNA, 20 bp, Artificial
  CRISPR gRNA sequence
tcttaaaaattttaaaaatt

SEQ ID NO: 671443 - DNA, 20 bp, Artificial
  CRISPR gRNA sequence
cttaaaaattttaaaaattg

SEQ ID NO: 671444 - DNA, 20 bp, Artificial
  CRISPR gRNA sequence
ttaaaaattttaaaaattga

SEQ ID NO: 671445 - DNA, 20 bp, Artificial
  CRISPR gRNA sequence
aaaaattttaaaaattgaga

SEQ ID NO: 671446 - DNA, 20 bp, Artificial
  CRISPR gRNA sequence
aaaattttaaaaattgagaa

SEQ ID NO: 671447 - DNA, 20 bp, Artificial
  CRISPR gRNA sequence
taaaaattgagaattcatat

SEQ ID NO: 671448 - DNA, 20 bp, Artificial
  CRISPR gRNA sequence
aaaaattgagaattcatatt

SEQ ID NO: 671449 - DNA, 20 bp, Artificial
  CRISPR gRNA sequence
aaaattgagaattcatatta

SEQ ID NO: 671450 - DNA, 20 bp, Artificial
  CRISPR gRNA sequence
agaattcatattattgaaga

SEQ ID NO: 671451 - DNA, 20 bp, Artificial
  CRISPR gRNA sequence
atattattgaagaaataaat

SEQ ID NO: 671452 - DNA, 20 bp, Artificial
  CRISPR gRNA sequence
ttgaagaaataaatttccag

SEQ ID NO: 671453 - DNA, 20 bp, Artificial
  CRISPR gRNA sequence
aagaaataaatttccagact

SEQ ID NO: 671454 - DNA, 20 bp, Artificial
  CRISPR gRNA sequence
ccagactgcaaaatcatatg

SEQ ID NO: 671455 - DNA, 20 bp, Artificial
  CRISPR gRNA sequence
cagactgcaaaatcatatgc

SEQ ID NO: 671456 - DNA, 20 bp, Artificial
  CRISPR gRNA sequence
caaaatcatatgctgtcttg

SEQ ID NO: 671457 - DNA, 20 bp, Artificial
  CRISPR gRNA sequence
tcttgcacaaatgggtgact

SEQ ID NO: 671458 - DNA, 20 bp, Artificial
  CRISPR gRNA sequence
gcacaaatgggtgactttgt

SEQ ID NO: 671459 - DNA, 20 bp, Artificial
  CRISPR gRNA sequence
cacaaatgggtgactttgtg

SEQ ID NO: 671460 - DNA, 20 bp, Artificial
  CRISPR gRNA sequence
tgtgaagttatagcataaaa

SEQ ID NO: 671461 - DNA, 20 bp, Artificial
  CRISPR gRNA sequence
gtgaagttatagcataaaaa

SEQ ID NO: 671462 - DNA, 20 bp, Artificial
  CRISPR gRNA sequence
tgaagttatagcataaaaag

SEQ ID NO: 671463 - DNA, 20 bp, Artificial
  CRISPR gRNA sequence
tagcataaaaagtagtaaag

SEQ ID NO: 671464 - DNA, 20 bp, Artificial
  CRISPR gRNA sequence
taaagaagtgcctttttaca

SEQ ID NO: 671465 - DNA, 20 bp, Artificial
  CRISPR gRNA sequence
aaagaagtgcctttttacat

SEQ ID NO: 671466 - DNA, 20 bp, Artificial
  CRISPR gRNA sequence
aagaagtgcctttttacatt

SEQ ID NO: 671467 - DNA, 20 bp, Artificial
  CRISPR gRNA sequence
tttacatttatatattgttc

SEQ ID NO: 671468 - DNA, 20 bp, Artificial
  CRISPR gRNA sequence
ttacatttatatattgttca

SEQ ID NO: 671469 - DNA, 20 bp, Artificial
  CRISPR gRNA sequence
tacatttatatattgttcag

SEQ ID NO: 671470 - DNA, 20 bp, Artificial
  CRISPR gRNA sequence
acatttatatattgttcagt

SEQ ID NO: 671471 - DNA, 20 bp, Artificial
  CRISPR gRNA sequence
catttatatattgttcagtt

SEQ ID NO: 671472 - DNA, 20 bp, Artificial
  CRISPR gRNA sequence
atatattgttcagttcaata

SEQ ID NO: 671473 - DNA, 20 bp, Artificial
  CRISPR gRNA sequence
tatattgttcagttcaataa

SEQ ID NO: 671474 - DNA, 20 bp, Artificial
  CRISPR gRNA sequence
ttcagttcaataaatttatt

SEQ ID NO: 671475 - DNA, 20 bp, Artificial
  CRISPR gRNA sequence
agttcaataaatttattatg

SEQ ID NO: 671476 - DNA, 20 bp, Artificial
  CRISPR gRNA sequence
aataaatttattatgtaacc

SEQ ID NO: 671477 - DNA, 20 bp, Artificial
  CRISPR gRNA sequence
attatgtaaccaaattacat

SEQ ID NO: 671478 - DNA, 20 bp, Artificial
  CRISPR gRNA sequence
ttatgtaaccaaattacata

SEQ ID NO: 671479 - DNA, 20 bp, Artificial
  CRISPR gRNA sequence
tgtaaccaaattacatatgt

SEQ ID NO: 671480 - DNA, 20 bp, Artificial
  CRISPR gRNA sequence
catatgtttgtaaaatattt

SEQ ID NO: 671481 - DNA, 20 bp, Artificial
  CRISPR gRNA sequence
gtaaaatatttcctgtattc

SEQ ID NO: 671482 - DNA, 20 bp, Artificial
  CRISPR gRNA sequence
taaaatatttcctgtattct

SEQ ID NO: 671483 - DNA, 20 bp, Artificial
  CRISPR gRNA sequence
cctgtattctaactcatgaa

SEQ ID NO: 671484 - DNA, 20 bp, Artificial
  CRISPR gRNA sequence
ctgtattctaactcatgaac

SEQ ID NO: 671485 - DNA, 20 bp, Artificial
  CRISPR gRNA sequence
tattctaactcatgaactct

SEQ ID NO: 671486 - DNA, 20 bp, Artificial
  CRISPR gRNA sequence
taactcatgaactcttttat

SEQ ID NO: 671487 - DNA, 20 bp, Artificial
  CRISPR gRNA sequence
actcatgaactcttttatgg

SEQ ID NO: 671488 - DNA, 20 bp, Artificial
  CRISPR gRNA sequence
atgaactcttttatggccat

SEQ ID NO: 671489 - DNA, 20 bp, Artificial
  CRISPR gRNA sequence
ttttatggccatttttggag

SEQ ID NO: 671490 - DNA, 20 bp, Artificial
  CRISPR gRNA sequence
ttatggccatttttggagta

SEQ ID NO: 671491 - DNA, 20 bp, Artificial
  CRISPR gRNA sequence
tatggccatttttggagtac

SEQ ID NO: 671492 - DNA, 20 bp, Artificial
  CRISPR gRNA sequence
atggccatttttggagtaca

SEQ ID NO: 671493 - DNA, 20 bp, Artificial
  CRISPR gRNA sequence
tggccatttttggagtacat

SEQ ID NO: 671494 - DNA, 20 bp, Artificial
  CRISPR gRNA sequence
ttggagtacatactcttgtg

SEQ ID NO: 671495 - DNA, 20 bp, Artificial
  CRISPR gRNA sequence
tggagtacatactcttgtgt

SEQ ID NO: 671496 - DNA, 20 bp, Artificial
  CRISPR gRNA sequence
ggagtacatactcttgtgtt

SEQ ID NO: 671497 - DNA, 20 bp, Artificial
  CRISPR gRNA sequence
gagtacatactcttgtgtta

SEQ ID NO: 671498 - DNA, 20 bp, Artificial
  CRISPR gRNA sequence
ttgtgttaatatgggttact

SEQ ID NO: 671499 - DNA, 20 bp, Artificial
  CRISPR gRNA sequence
gtgttaatatgggttactta

SEQ ID NO: 671500 - DNA, 20 bp, Artificial
  CRISPR gRNA sequence
tgttaatatgggttacttat

SEQ ID NO: 671501 - DNA, 20 bp, Artificial
  CRISPR gRNA sequence
atatgggttacttatttaag

SEQ ID NO: 671502 - DNA, 20 bp, Artificial
  CRISPR gRNA sequence
cttatttaagttaatagtat

SEQ ID NO: 671503 - DNA, 20 bp, Artificial
  CRISPR gRNA sequence
atttaagttaatagtatttt

SEQ ID NO: 671504 - DNA, 20 bp, Artificial
  CRISPR gRNA sequence
tttaagttaatagtattttt

SEQ ID NO: 671505 - DNA, 20 bp, Artificial
  CRISPR gRNA sequence
aagttaatagtatttttttt

SEQ ID NO: 671506 - DNA, 20 bp, Artificial
  CRISPR gRNA sequence
agttaatagtattttttttg

SEQ ID NO: 671507 - DNA, 20 bp, Artificial
  CRISPR gRNA sequence
atagtattttttttgcttta

SEQ ID NO: 671508 - DNA, 20 bp, Artificial
  CRISPR gRNA sequence
tttttgctttagctttaaac

SEQ ID NO: 671509 - DNA, 20 bp, Artificial
  CRISPR gRNA sequence
ttttgctttagctttaaacc

SEQ ID NO: 671510 - DNA, 20 bp, Artificial
  CRISPR gRNA sequence
tttgctttagctttaaacct

SEQ ID NO: 671511 - DNA, 20 bp, Artificial
  CRISPR gRNA sequence
ttgctttagctttaaacctt

SEQ ID NO: 671512 - DNA, 20 bp, Artificial
  CRISPR gRNA sequence
tgctttagctttaaaccttt

SEQ ID NO: 671513 - DNA, 20 bp, Artificial
  CRISPR gRNA sequence
gctttagctttaaaccttta

SEQ ID NO: 671514 - DNA, 20 bp, Artificial
  CRISPR gRNA sequence
ctttagctttaaacctttac

SEQ ID NO: 671515 - DNA, 20 bp, Artificial
  CRISPR gRNA sequence
tagctttaaacctttactat

SEQ ID NO: 671516 - DNA, 20 bp, Artificial
  CRISPR gRNA sequence
agctttaaacctttactatt

SEQ ID NO: 671517 - DNA, 20 bp, Artificial
  CRISPR gRNA sequence
gctttaaacctttactatta

SEQ ID NO: 671518 - DNA, 20 bp, Artificial
  CRISPR gRNA sequence
taaacctttactattattat

SEQ ID NO: 671519 - DNA, 20 bp, Artificial
  CRISPR gRNA sequence
aaacctttactattattatt

SEQ ID NO: 671520 - DNA, 20 bp, Artificial
  CRISPR gRNA sequence
aacctttactattattattg

SEQ ID NO: 671521 - DNA, 20 bp, Artificial
  CRISPR gRNA sequence
tactattattattgacaaag

SEQ ID NO: 671522 - DNA, 20 bp, Artificial
  CRISPR gRNA sequence
actattattattgacaaagt

SEQ ID NO: 671523 - DNA, 20 bp, Artificial
  CRISPR gRNA sequence
ctattattattgacaaagta

SEQ ID NO: 671524 - DNA, 20 bp, Artificial
  CRISPR gRNA sequence
ttattattgacaaagtatta

SEQ ID NO: 671525 - DNA, 20 bp, Artificial
  CRISPR gRNA sequence
ttattgacaaagtattaggc

SEQ ID NO: 671526 - DNA, 20 bp, Artificial
  CRISPR gRNA sequence
ttgacaaagtattaggcaag

SEQ ID NO: 671527 - DNA, 20 bp, Artificial
  CRISPR gRNA sequence
acaaagtattaggcaagtag

SEQ ID NO: 671528 - DNA, 20 bp, Artificial
  CRISPR gRNA sequence
ggcaagtagtagatacttaa

SEQ ID NO: 671529 - DNA, 20 bp, Artificial
  CRISPR gRNA sequence
aataaatatttactggttta

SEQ ID NO: 671530 - DNA, 20 bp, Artificial
  CRISPR gRNA sequence
ataaatatttactggtttaa

SEQ ID NO: 671531 - DNA, 20 bp, Artificial
  CRISPR gRNA sequence
actggtttaatgatttttta

SEQ ID NO: 671532 - DNA, 20 bp, Artificial
  CRISPR gRNA sequence
ctggtttaatgattttttaa

SEQ ID NO: 671533 - DNA, 20 bp, Artificial
  CRISPR gRNA sequence
gtttaatgattttttaagag

SEQ ID NO: 671534 - DNA, 20 bp, Artificial
  CRISPR gRNA sequence
aatgattttttaagagaatt

SEQ ID NO: 671535 - DNA, 20 bp, Artificial
  CRISPR gRNA sequence
atgattttttaagagaattc

SEQ ID NO: 671536 - DNA, 20 bp, Artificial
  CRISPR gRNA sequence
tttaagagaattcagtgctg

SEQ ID NO: 671537 - DNA, 20 bp, Artificial
  CRISPR gRNA sequence
ttaagagaattcagtgctgt

SEQ ID NO: 671538 - DNA, 20 bp, Artificial
  CRISPR gRNA sequence
taagagaattcagtgctgtc

SEQ ID NO: 671539 - DNA, 20 bp, Artificial
  CRISPR gRNA sequence
aagagaattcagtgctgtct

SEQ ID NO: 671540 - DNA, 20 bp, Artificial
  CRISPR gRNA sequence
agagaattcagtgctgtctt

SEQ ID NO: 671541 - DNA, 20 bp, Artificial
  CRISPR gRNA sequence
agtgctgtctttgttcttta

SEQ ID NO: 671542 - DNA, 20 bp, Artificial
  CRISPR gRNA sequence
tctttgttctttattggcta

SEQ ID NO: 671543 - DNA, 20 bp, Artificial
  CRISPR gRNA sequence
tgttctttattggctaaggt

SEQ ID NO: 671544 - DNA, 20 bp, Artificial
  CRISPR gRNA sequence
gttctttattggctaaggta

SEQ ID NO: 671545 - DNA, 20 bp, Artificial
  CRISPR gRNA sequence
ttctttattggctaaggtag

SEQ ID NO: 671546 - DNA, 20 bp, Artificial
  CRISPR gRNA sequence
tttattggctaaggtagatg

SEQ ID NO: 671547 - DNA, 20 bp, Artificial
  CRISPR gRNA sequence
tattggctaaggtagatgag

SEQ ID NO: 671548 - DNA, 20 bp, Artificial
  CRISPR gRNA sequence
attggctaaggtagatgagt

SEQ ID NO: 671549 - DNA, 20 bp, Artificial
  CRISPR gRNA sequence
ttggctaaggtagatgagtt

SEQ ID NO: 671550 - DNA, 20 bp, Artificial
  CRISPR gRNA sequence
gctaaggtagatgagttcta

SEQ ID NO: 671551 - DNA, 20 bp, Artificial
  CRISPR gRNA sequence
aggtagatgagttctataaa

SEQ ID NO: 671552 - DNA, 20 bp, Artificial
  CRISPR gRNA sequence
tataaatgaatgtaaggtct

SEQ ID NO: 671553 - DNA, 20 bp, Artificial
  CRISPR gRNA sequence
taaatgaatgtaaggtctac

SEQ ID NO: 671554 - DNA, 20 bp, Artificial
  CRISPR gRNA sequence
caaatgtatgtaatgactgt

SEQ ID NO: 671555 - DNA, 20 bp, Artificial
  CRISPR gRNA sequence
ttgtgcattttattatcctt

SEQ ID NO: 671556 - DNA, 20 bp, Artificial
  CRISPR gRNA sequence
tgcattttattatccttttc

SEQ ID NO: 671557 - DNA, 20 bp, Artificial
  CRISPR gRNA sequence
tattatccttttcattctta

SEQ ID NO: 671558 - DNA, 20 bp, Artificial
  CRISPR gRNA sequence
attatccttttcattcttat

SEQ ID NO: 671559 - DNA, 20 bp, Artificial
  CRISPR gRNA sequence
ttatccttttcattcttatg

SEQ ID NO: 671560 - DNA, 20 bp, Artificial
  CRISPR gRNA sequence
tccttttcattcttatgtga

SEQ ID NO: 671561 - DNA, 20 bp, Artificial
  CRISPR gRNA sequence
ttcattcttatgtgagtaaa

SEQ ID NO: 671562 - DNA, 20 bp, Artificial
  CRISPR gRNA sequence
tcattcttatgtgagtaaaa

SEQ ID NO: 671563 - DNA, 20 bp, Artificial
  CRISPR gRNA sequence
cattcttatgtgagtaaaat

SEQ ID NO: 671564 - DNA, 20 bp, Artificial
  CRISPR gRNA sequence
attcttatgtgagtaaaatt

SEQ ID NO: 671565 - DNA, 20 bp, Artificial
  CRISPR gRNA sequence
ttatgtgagtaaaatttgag

SEQ ID NO: 671566 - DNA, 20 bp, Artificial
  CRISPR gRNA sequence
atgtgagtaaaatttgagtt

SEQ ID NO: 671567 - DNA, 20 bp, Artificial
  CRISPR gRNA sequence
tgtgagtaaaatttgagttt

SEQ ID NO: 671568 - DNA, 20 bp, Artificial
  CRISPR gRNA sequence
gagttttgattttttttttt

SEQ ID NO: 671569 - DNA, 20 bp, Artificial
  CRISPR gRNA sequence
agttttgatttttttttttt

SEQ ID NO: 671570 - DNA, 20 bp, Artificial
  CRISPR gRNA sequence
tgattttttttttttacttt

SEQ ID NO: 671571 - DNA, 20 bp, Artificial
  CRISPR gRNA sequence
gattttttttttttactttt

SEQ ID NO: 671572 - DNA, 20 bp, Artificial
  CRISPR gRNA sequence
attttttttttttacttttt

SEQ ID NO: 671573 - DNA, 20 bp, Artificial
  CRISPR gRNA sequence
tttttttttactttttcaag

SEQ ID NO: 671574 - DNA, 20 bp, Artificial
  CRISPR gRNA sequence
ttttttttactttttcaagt

SEQ ID NO: 671575 - DNA, 20 bp, Artificial
  CRISPR gRNA sequence
tttttttactttttcaagta

SEQ ID NO: 671576 - DNA, 20 bp, Artificial
  CRISPR gRNA sequence
ttttttactttttcaagtac

SEQ ID NO: 671577 - DNA, 20 bp, Artificial
  CRISPR gRNA sequence
tttttactttttcaagtaca

SEQ ID NO: 671578 - DNA, 20 bp, Artificial
  CRISPR gRNA sequence
ttttactttttcaagtacaa

SEQ ID NO: 671579 - DNA, 20 bp, Artificial
  CRISPR gRNA sequence
tttactttttcaagtacaat

SEQ ID NO: 671580 - DNA, 20 bp, Artificial
  CRISPR gRNA sequence
ttactttttcaagtacaatg

SEQ ID NO: 671581 - DNA, 20 bp, Artificial
  CRISPR gRNA sequence
tactttttcaagtacaatgg

SEQ ID NO: 671582 - DNA, 20 bp, Artificial
  CRISPR gRNA sequence
actttttcaagtacaatggt

SEQ ID NO: 671583 - DNA, 20 bp, Artificial
  CRISPR gRNA sequence
ctttttcaagtacaatggtg

SEQ ID NO: 671584 - DNA, 20 bp, Artificial
  CRISPR gRNA sequence
tttcaagtacaatggtggca

SEQ ID NO: 671585 - DNA, 20 bp, Artificial
  CRISPR gRNA sequence
ttcaagtacaatggtggcaa

SEQ ID NO: 671586 - DNA, 20 bp, Artificial
  CRISPR gRNA sequence
tcaagtacaatggtggcaaa

SEQ ID NO: 671587 - DNA, 20 bp, Artificial
  CRISPR gRNA sequence
caagtacaatggtggcaaag

SEQ ID NO: 671588 - DNA, 20 bp, Artificial
  CRISPR gRNA sequence
aagtacaatggtggcaaaga

SEQ ID NO: 671589 - DNA, 20 bp, Artificial
  CRISPR gRNA sequence
tgacattgattggattaaat

SEQ ID NO: 671590 - DNA, 20 bp, Artificial
  CRISPR gRNA sequence
attggattaaattaatttgt

SEQ ID NO: 671591 - DNA, 20 bp, Artificial
  CRISPR gRNA sequence
gattaaattaatttgttttt

SEQ ID NO: 671592 - DNA, 20 bp, Artificial
  CRISPR gRNA sequence
aattaatttgtttttaatag

SEQ ID NO: 671593 - DNA, 20 bp, Artificial
  CRISPR gRNA sequence
atttgtttttaatagattca

SEQ ID NO: 671594 - DNA, 20 bp, Artificial
  CRISPR gRNA sequence
gtttttaatagattcacaaa

SEQ ID NO: 671595 - DNA, 20 bp, Artificial
  CRISPR gRNA sequence
tttttaatagattcacaaaa

SEQ ID NO: 671596 - DNA, 20 bp, Artificial
  CRISPR gRNA sequence
ttaatagattcacaaaataa

SEQ ID NO: 671597 - DNA, 20 bp, Artificial
  CRISPR gRNA sequence
taatagattcacaaaataac

SEQ ID NO: 671598 - DNA, 20 bp, Artificial
  CRISPR gRNA sequence
aatagattcacaaaataaca

SEQ ID NO: 671599 - DNA, 20 bp, Artificial
  CRISPR gRNA sequence
atagattcacaaaataacat

SEQ ID NO: 671600 - DNA, 20 bp, Artificial
  CRISPR gRNA sequence
acaaaataacatgattttgc

SEQ ID NO: 671601 - DNA, 20 bp, Artificial
  CRISPR gRNA sequence
tgctccatttggttttagat

SEQ ID NO: 671602 - DNA, 20 bp, Artificial
  CRISPR gRNA sequence
gctccatttggttttagatt

SEQ ID NO: 671603 - DNA, 20 bp, Artificial
  CRISPR gRNA sequence
ctccatttggttttagattc

SEQ ID NO: 671604 - DNA, 20 bp, Artificial
  CRISPR gRNA sequence
catttggttttagattctac

SEQ ID NO: 671605 - DNA, 20 bp, Artificial
  CRISPR gRNA sequence
ggttttagattctacttttt

SEQ ID NO: 671606 - DNA, 20 bp, Artificial
  CRISPR gRNA sequence
gttttagattctactttttt

SEQ ID NO: 671607 - DNA, 20 bp, Artificial
  CRISPR gRNA sequence
tagattctacttttttttca

SEQ ID NO: 671608 - DNA, 20 bp, Artificial
  CRISPR gRNA sequence
agattctacttttttttcac

SEQ ID NO: 671609 - DNA, 20 bp, Artificial
  CRISPR gRNA sequence
gattctacttttttttcaca

SEQ ID NO: 671610 - DNA, 20 bp, Artificial
  CRISPR gRNA sequence
tacttttttttcacaatgat

SEQ ID NO: 671611 - DNA, 20 bp, Artificial
  CRISPR gRNA sequence
cttttttttcacaatgatct

SEQ ID NO: 671612 - DNA, 20 bp, Artificial
  CRISPR gRNA sequence
ttttttcacaatgatctata

SEQ ID NO: 671613 - DNA, 20 bp, Artificial
  CRISPR gRNA sequence
tttttcacaatgatctatac

SEQ ID NO: 671614 - DNA, 20 bp, Artificial
  CRISPR gRNA sequence
ttttcacaatgatctatacc

SEQ ID NO: 671615 - DNA, 20 bp, Artificial
  CRISPR gRNA sequence
tttcacaatgatctatacct

SEQ ID NO: 671616 - DNA, 20 bp, Artificial
  CRISPR gRNA sequence
ttcacaatgatctatacctg

SEQ ID NO: 671617 - DNA, 20 bp, Artificial
  CRISPR gRNA sequence
tcacaatgatctatacctgt

SEQ ID NO: 671618 - DNA, 20 bp, Artificial
  CRISPR gRNA sequence
cacaatgatctatacctgtt

SEQ ID NO: 671619 - DNA, 20 bp, Artificial
  CRISPR gRNA sequence
acaatgatctatacctgttt

SEQ ID NO: 671620 - DNA, 20 bp, Artificial
  CRISPR gRNA sequence
tacctgtttacctgtgtaaa

SEQ ID NO: 671621 - DNA, 20 bp, Artificial
  CRISPR gRNA sequence
tttacctgtgtaaaggcctt

SEQ ID NO: 671622 - DNA, 20 bp, Artificial
  CRISPR gRNA sequence
acctgtgtaaaggcctttat

SEQ ID NO: 671623 - DNA, 20 bp, Artificial
  CRISPR gRNA sequence
cctgtgtaaaggcctttatt

SEQ ID NO: 671624 - DNA, 20 bp, Artificial
  CRISPR gRNA sequence
tgtaaaggcctttattcagt

SEQ ID NO: 671625 - DNA, 20 bp, Artificial
  CRISPR gRNA sequence
tattcagttatccttttatt

SEQ ID NO: 671626 - DNA, 20 bp, Artificial
  CRISPR gRNA sequence
attcagttatccttttatta

SEQ ID NO: 671627 - DNA, 20 bp, Artificial
  CRISPR gRNA sequence
ttcagttatccttttattat

SEQ ID NO: 671628 - DNA, 20 bp, Artificial
  CRISPR gRNA sequence
agttatccttttattatcat

SEQ ID NO: 671629 - DNA, 20 bp, Artificial
  CRISPR gRNA sequence
tccttttattatcatattag

SEQ ID NO: 671630 - DNA, 20 bp, Artificial
  CRISPR gRNA sequence
ttattatcatattagtgaat

SEQ ID NO: 671631 - DNA, 20 bp, Artificial
  CRISPR gRNA sequence
tattatcatattagtgaatt

SEQ ID NO: 671632 - DNA, 20 bp, Artificial
  CRISPR gRNA sequence
attatcatattagtgaatta

SEQ ID NO: 671633 - DNA, 20 bp, Artificial
  CRISPR gRNA sequence
ttatcatattagtgaattaa

SEQ ID NO: 671634 - DNA, 20 bp, Artificial
  CRISPR gRNA sequence
tcatattagtgaattaaagg

SEQ ID NO: 671635 - DNA, 20 bp, Artificial
  CRISPR gRNA sequence
gtgaattaaaggcaagtcta

SEQ ID NO: 671636 - DNA, 20 bp, Artificial
  CRISPR gRNA sequence
aaggcaagtctagtgtaact

SEQ ID NO: 671637 - DNA, 20 bp, Artificial
  CRISPR gRNA sequence
gtgtaactgtccattcacta

SEQ ID NO: 671638 - DNA, 20 bp, Artificial
  CRISPR gRNA sequence
tccattcactattatgtatc

SEQ ID NO: 671639 - DNA, 20 bp, Artificial
  CRISPR gRNA sequence
actattatgtatctggaagc

SEQ ID NO: 671640 - DNA, 20 bp, Artificial
  CRISPR gRNA sequence
ttatgtatctggaagcaatg

SEQ ID NO: 671641 - DNA, 20 bp, Artificial
  CRISPR gRNA sequence
tgtatctggaagcaatgact

SEQ ID NO: 671642 - DNA, 20 bp, Artificial
  CRISPR gRNA sequence
gaagcaatgactattgtgaa

SEQ ID NO: 671643 - DNA, 20 bp, Artificial
  CRISPR gRNA sequence
ttgtgaagcctttgattgta

SEQ ID NO: 671644 - DNA, 20 bp, Artificial
  CRISPR gRNA sequence
tgaagcctttgattgtagag

SEQ ID NO: 671645 - DNA, 20 bp, Artificial
  CRISPR gRNA sequence
tgattgtagagagcctagaa

SEQ ID NO: 671646 - DNA, 20 bp, Artificial
  CRISPR gRNA sequence
gattgtagagagcctagaat

SEQ ID NO: 671647 - DNA, 20 bp, Artificial
  CRISPR gRNA sequence
attgtagagagcctagaatg

SEQ ID NO: 671648 - DNA, 20 bp, Artificial
  CRISPR gRNA sequence
tagagagcctagaatggtta

SEQ ID NO: 671649 - DNA, 20 bp, Artificial
  CRISPR gRNA sequence
gaatggttactgaaggaact

SEQ ID NO: 671650 - DNA, 20 bp, Artificial
  CRISPR gRNA sequence
ctgaaggaacttttataatt

SEQ ID NO: 671651 - DNA, 20 bp, Artificial
  CRISPR gRNA sequence
aaggaacttttataattgaa

SEQ ID NO: 671652 - DNA, 20 bp, Artificial
  CRISPR gRNA sequence
ttataattgaaaattgtttg

SEQ ID NO: 671653 - DNA, 20 bp, Artificial
  CRISPR gRNA sequence
tataattgaaaattgtttgg

SEQ ID NO: 671654 - DNA, 20 bp, Artificial
  CRISPR gRNA sequence
ataattgaaaattgtttggc

SEQ ID NO: 671655 - DNA, 20 bp, Artificial
  CRISPR gRNA sequence
taattgaaaattgtttggct

SEQ ID NO: 671656 - DNA, 20 bp, Artificial
  CRISPR gRNA sequence
aaaattgtttggcttgaaat

SEQ ID NO: 671657 - DNA, 20 bp, Artificial
  CRISPR gRNA sequence
tttggcttgaaattcacttt

SEQ ID NO: 671658 - DNA, 20 bp, Artificial
  CRISPR gRNA sequence
ggcttgaaattcactttaaa

SEQ ID NO: 671659 - DNA, 20 bp, Artificial
  CRISPR gRNA sequence
gcttgaaattcactttaaaa

SEQ ID NO: 671660 - DNA, 20 bp, Artificial
  CRISPR gRNA sequence
gaaattcactttaaaaaaga

SEQ ID NO: 671661 - DNA, 20 bp, Artificial
  CRISPR gRNA sequence
aaattcactttaaaaaagag

SEQ ID NO: 671662 - DNA, 20 bp, Artificial
  CRISPR gRNA sequence
actttaaaaaagagtatctg

SEQ ID NO: 671663 - DNA, 20 bp, Artificial
  CRISPR gRNA sequence
taaaaaagagtatctgtgca

SEQ ID NO: 671664 - DNA, 20 bp, Artificial
  CRISPR gRNA sequence
aaaaaagagtatctgtgcaa

SEQ ID NO: 671665 - DNA, 20 bp, Artificial
  CRISPR gRNA sequence
aaaaagagtatctgtgcaag

SEQ ID NO: 671666 - DNA, 20 bp, Artificial
  CRISPR gRNA sequence
tgcaagtgtctttacttctt

SEQ ID NO: 671667 - DNA, 20 bp, Artificial
  CRISPR gRNA sequence
tacttcttgtaatttgtaag

SEQ ID NO: 671668 - DNA, 20 bp, Artificial
  CRISPR gRNA sequence
acttcttgtaatttgtaagt

SEQ ID NO: 671669 - DNA, 20 bp, Artificial
  CRISPR gRNA sequence
cttcttgtaatttgtaagtg

SEQ ID NO: 671670 - DNA, 20 bp, Artificial
  CRISPR gRNA sequence
cttgtaatttgtaagtggaa

SEQ ID NO: 671671 - DNA, 20 bp, Artificial
  CRISPR gRNA sequence
ttgtaatttgtaagtggaat

SEQ ID NO: 671672 - DNA, 20 bp, Artificial
  CRISPR gRNA sequence
gtaatttgtaagtggaattg

SEQ ID NO: 671673 - DNA, 20 bp, Artificial
  CRISPR gRNA sequence
taatttgtaagtggaattgc

SEQ ID NO: 671674 - DNA, 20 bp, Artificial
  CRISPR gRNA sequence
gtaagtggaattgcttaaac

SEQ ID NO: 671675 - DNA, 20 bp, Artificial
  CRISPR gRNA sequence
taagtggaattgcttaaact

SEQ ID NO: 671676 - DNA, 20 bp, Artificial
  CRISPR gRNA sequence
cttaaactaggtgtttttat

SEQ ID NO: 671677 - DNA, 20 bp, Artificial
  CRISPR gRNA sequence
aaactaggtgtttttatggc

SEQ ID NO: 671678 - DNA, 20 bp, Artificial
  CRISPR gRNA sequence
aactaggtgtttttatggca

SEQ ID NO: 671679 - DNA, 20 bp, Artificial
  CRISPR gRNA sequence
ggtgtttttatggcatcaag

SEQ ID NO: 671680 - DNA, 20 bp, Artificial
  CRISPR gRNA sequence
ttatggcatcaagattacat

SEQ ID NO: 671681 - DNA, 20 bp, Artificial
  CRISPR gRNA sequence
tatggcatcaagattacatt

SEQ ID NO: 671682 - DNA, 20 bp, Artificial
  CRISPR gRNA sequence
atggcatcaagattacattc

SEQ ID NO: 671683 - DNA, 20 bp, Artificial
  CRISPR gRNA sequence
tggcatcaagattacattct

SEQ ID NO: 671684 - DNA, 20 bp, Artificial
  CRISPR gRNA sequence
cattctagtgtttataaata

SEQ ID NO: 671685 - DNA, 20 bp, Artificial
  CRISPR gRNA sequence
tagtgtttataaatagtatt

SEQ ID NO: 671686 - DNA, 20 bp, Artificial
  CRISPR gRNA sequence
gtgtttataaatagtatttt

SEQ ID NO: 671687 - DNA, 20 bp, Artificial
  CRISPR gRNA sequence
ataaatagtattttgaaagc

SEQ ID NO: 671688 - DNA, 20 bp, Artificial
  CRISPR gRNA sequence
taaatagtattttgaaagca

SEQ ID NO: 671689 - DNA, 20 bp, Artificial
  CRISPR gRNA sequence
tgaaagcataaagaagaaga

SEQ ID NO: 671690 - DNA, 20 bp, Artificial
  CRISPR gRNA sequence
gaaagcataaagaagaagag

SEQ ID NO: 671691 - DNA, 20 bp, Artificial
  CRISPR gRNA sequence
aaagcataaagaagaagagg

SEQ ID NO: 671692 - DNA, 20 bp, Artificial
  CRISPR gRNA sequence
gaattcatgaaaatgtttat

SEQ ID NO: 671693 - DNA, 20 bp, Artificial
  CRISPR gRNA sequence
aattcatgaaaatgtttata

SEQ ID NO: 671694 - DNA, 20 bp, Artificial
  CRISPR gRNA sequence
atgaaaatgtttatatcctg

SEQ ID NO: 671695 - DNA, 20 bp, Artificial
  CRISPR gRNA sequence
atatcctgaagctttttttt

SEQ ID NO: 671696 - DNA, 20 bp, Artificial
  CRISPR gRNA sequence
tatcctgaagcttttttttg

SEQ ID NO: 671697 - DNA, 20 bp, Artificial
  CRISPR gRNA sequence
aagcttttttttgtttggaa

SEQ ID NO: 671698 - DNA, 20 bp, Artificial
  CRISPR gRNA sequence
ttttttgtttggaaaaatat

SEQ ID NO: 671699 - DNA, 20 bp, Artificial
  CRISPR gRNA sequence
tttttgtttggaaaaatatg

SEQ ID NO: 671700 - DNA, 20 bp, Artificial
  CRISPR gRNA sequence
ttttgtttggaaaaatatgt

SEQ ID NO: 671701 - DNA, 20 bp, Artificial
  CRISPR gRNA sequence
tttgtttggaaaaatatgtg

SEQ ID NO: 671702 - DNA, 20 bp, Artificial
  CRISPR gRNA sequence
ttgtttggaaaaatatgtgg

SEQ ID NO: 671703 - DNA, 20 bp, Artificial
  CRISPR gRNA sequence
tgtttggaaaaatatgtggc

SEQ ID NO: 671704 - DNA, 20 bp, Artificial
  CRISPR gRNA sequence
gtttggaaaaatatgtggca

SEQ ID NO: 671705 - DNA, 20 bp, Artificial
  CRISPR gRNA sequence
tttggaaaaatatgtggcac

SEQ ID NO: 671706 - DNA, 20 bp, Artificial
  CRISPR gRNA sequence
ggaaaaatatgtggcacttt

SEQ ID NO: 671707 - DNA, 20 bp, Artificial
  CRISPR gRNA sequence
gaaaaatatgtggcactttt

SEQ ID NO: 671708 - DNA, 20 bp, Artificial
  CRISPR gRNA sequence
tttatcatgaaatatcttca

SEQ ID NO: 671709 - DNA, 20 bp, Artificial
  CRISPR gRNA sequence
ttatcatgaaatatcttcaa

SEQ ID NO: 671710 - DNA, 20 bp, Artificial
  CRISPR gRNA sequence
tatcatgaaatatcttcaaa

SEQ ID NO: 671711 - DNA, 20 bp, Artificial
  CRISPR gRNA sequence
atcatgaaatatcttcaaag

SEQ ID NO: 671712 - DNA, 20 bp, Artificial
  CRISPR gRNA sequence
tcatgaaatatcttcaaagc

SEQ ID NO: 671713 - DNA, 20 bp, Artificial
  CRISPR gRNA sequence
caaagctttttctacataaa

SEQ ID NO: 671714 - DNA, 20 bp, Artificial
  CRISPR gRNA sequence
aaagctttttctacataaac

SEQ ID NO: 671715 - DNA, 20 bp, Artificial
  CRISPR gRNA sequence
tttctacataaacttgacca

SEQ ID NO: 671716 - DNA, 20 bp, Artificial
  CRISPR gRNA sequence
ttctacataaacttgaccat

SEQ ID NO: 671717 - DNA, 20 bp, Artificial
  CRISPR gRNA sequence
tctacataaacttgaccata

SEQ ID NO: 671718 - DNA, 20 bp, Artificial
  CRISPR gRNA sequence
ctacataaacttgaccataa

SEQ ID NO: 671719 - DNA, 20 bp, Artificial
  CRISPR gRNA sequence
tacataaacttgaccataac

SEQ ID NO: 671720 - DNA, 20 bp, Artificial
  CRISPR gRNA sequence
cataaacttgaccataacag

SEQ ID NO: 671721 - DNA, 20 bp, Artificial
  CRISPR gRNA sequence
gaccataacagtttttttct

SEQ ID NO: 671722 - DNA, 20 bp, Artificial
  CRISPR gRNA sequence
accataacagtttttttcta

SEQ ID NO: 671723 - DNA, 20 bp, Artificial
  CRISPR gRNA sequence
ttttctattaacttattctt

SEQ ID NO: 671724 - DNA, 20 bp, Artificial
  CRISPR gRNA sequence
tttctattaacttattcttt

SEQ ID NO: 671725 - DNA, 20 bp, Artificial
  CRISPR gRNA sequence
ttctattaacttattctttc

SEQ ID NO: 671726 - DNA, 20 bp, Artificial
  CRISPR gRNA sequence
tctattaacttattctttcc

SEQ ID NO: 671727 - DNA, 20 bp, Artificial
  CRISPR gRNA sequence
ctattaacttattctttcct

SEQ ID NO: 671728 - DNA, 20 bp, Artificial
  CRISPR gRNA sequence
tattaacttattctttcctt

SEQ ID NO: 671729 - DNA, 20 bp, Artificial
  CRISPR gRNA sequence
ttaacttattctttccttgt

SEQ ID NO: 671730 - DNA, 20 bp, Artificial
  CRISPR gRNA sequence
acttattctttccttgtgtt

SEQ ID NO: 671731 - DNA, 20 bp, Artificial
  CRISPR gRNA sequence
attctttccttgtgttcaca

SEQ ID NO: 671732 - DNA, 20 bp, Artificial
  CRISPR gRNA sequence
ttctttccttgtgttcacaa

SEQ ID NO: 671733 - DNA, 20 bp, Artificial
  CRISPR gRNA sequence
tttccttgtgttcacaaacc

SEQ ID NO: 671734 - DNA, 20 bp, Artificial
  CRISPR gRNA sequence
tccttgtgttcacaaacctg

SEQ ID NO: 671735 - DNA, 20 bp, Artificial
  CRISPR gRNA sequence
ccttgtgttcacaaacctga

SEQ ID NO: 671736 - DNA, 20 bp, Artificial
  CRISPR gRNA sequence
cttgtgttcacaaacctgag

SEQ ID NO: 671737 - DNA, 20 bp, Artificial
  CRISPR gRNA sequence
gtgttcacaaacctgagtct

SEQ ID NO: 671738 - DNA, 20 bp, Artificial
  CRISPR gRNA sequence
tgttcacaaacctgagtcta

SEQ ID NO: 671739 - DNA, 20 bp, Artificial
  CRISPR gRNA sequence
acaaacctgagtctactaaa

SEQ ID NO: 671740 - DNA, 20 bp, Artificial
  CRISPR gRNA sequence
agtctactaaaatatggatg

SEQ ID NO: 671741 - DNA, 20 bp, Artificial
  CRISPR gRNA sequence
ctaaaatatggatgtaacag

SEQ ID NO: 671742 - DNA, 20 bp, Artificial
  CRISPR gRNA sequence
aaatatggatgtaacagtta

SEQ ID NO: 671743 - DNA, 20 bp, Artificial
  CRISPR gRNA sequence
taaatataaatgctaaatag

SEQ ID NO: 671744 - DNA, 20 bp, Artificial
  CRISPR gRNA sequence
aatagaagtgccattacaac

SEQ ID NO: 671745 - DNA, 20 bp, Artificial
  CRISPR gRNA sequence
caactgaagtataagaaaca

SEQ ID NO: 671746 - DNA, 20 bp, Artificial
  CRISPR gRNA sequence
aagtataagaaacatcttta

SEQ ID NO: 671747 - DNA, 20 bp, Artificial
  CRISPR gRNA sequence
tatcatcaaaactaaaatct

SEQ ID NO: 671748 - DNA, 20 bp, Artificial
  CRISPR gRNA sequence
atcatcaaaactaaaatctt

SEQ ID NO: 671749 - DNA, 20 bp, Artificial
  CRISPR gRNA sequence
tcatcaaaactaaaatcttg

SEQ ID NO: 671750 - DNA, 20 bp, Artificial
  CRISPR gRNA sequence
aaatcttgtctcatatcccc

SEQ ID NO: 671751 - DNA, 20 bp, Artificial
  CRISPR gRNA sequence
gtctcatatccccttttcat

SEQ ID NO: 671752 - DNA, 20 bp, Artificial
  CRISPR gRNA sequence
tctcatatccccttttcatt

SEQ ID NO: 671753 - DNA, 20 bp, Artificial
  CRISPR gRNA sequence
atatccccttttcattgcta

SEQ ID NO: 671754 - DNA, 20 bp, Artificial
  CRISPR gRNA sequence
ttcattgctaacagtttgtt

SEQ ID NO: 671755 - DNA, 20 bp, Artificial
  CRISPR gRNA sequence
tcattgctaacagtttgttc

SEQ ID NO: 671756 - DNA, 20 bp, Artificial
  CRISPR gRNA sequence
cattgctaacagtttgttct

SEQ ID NO: 671757 - DNA, 20 bp, Artificial
  CRISPR gRNA sequence
attgctaacagtttgttctg

SEQ ID NO: 671758 - DNA, 20 bp, Artificial
  CRISPR gRNA sequence
ctaacagtttgttctggcaa

SEQ ID NO: 671759 - DNA, 20 bp, Artificial
  CRISPR gRNA sequence
acagtttgttctggcaaaat

SEQ ID NO: 671760 - DNA, 20 bp, Artificial
  CRISPR gRNA sequence
gttctggcaaaattcttttt

SEQ ID NO: 671761 - DNA, 20 bp, Artificial
  CRISPR gRNA sequence
ttctggcaaaattcttttta

SEQ ID NO: 671762 - DNA, 20 bp, Artificial
  CRISPR gRNA sequence
tggcaaaattctttttaaat

SEQ ID NO: 671763 - DNA, 20 bp, Artificial
  CRISPR gRNA sequence
gcaaaattctttttaaatta

SEQ ID NO: 671764 - DNA, 20 bp, Artificial
  CRISPR gRNA sequence
tttttaaattaaaccattat

SEQ ID NO: 671765 - DNA, 20 bp, Artificial
  CRISPR gRNA sequence
tttaaattaaaccattattg

SEQ ID NO: 671766 - DNA, 20 bp, Artificial
  CRISPR gRNA sequence
ttaaattaaaccattattgc

SEQ ID NO: 671767 - DNA, 20 bp, Artificial
  CRISPR gRNA sequence
taaattaaaccattattgct

SEQ ID NO: 671768 - DNA, 20 bp, Artificial
  CRISPR gRNA sequence
aaattaaaccattattgctt

SEQ ID NO: 671769 - DNA, 20 bp, Artificial
  CRISPR gRNA sequence
aattaaaccattattgctta

SEQ ID NO: 671770 - DNA, 20 bp, Artificial
  CRISPR gRNA sequence
aaccattattgcttattagc

SEQ ID NO: 671771 - DNA, 20 bp, Artificial
  CRISPR gRNA sequence
ttgcttattagcatatgata

SEQ ID NO: 671772 - DNA, 20 bp, Artificial
  CRISPR gRNA sequence
cttattagcatatgataacg

SEQ ID NO: 671773 - DNA, 20 bp, Artificial
  CRISPR gRNA sequence
attagcatatgataacgtgt

SEQ ID NO: 671774 - DNA, 20 bp, Artificial
  CRISPR gRNA sequence
ttagcatatgataacgtgtg

SEQ ID NO: 671775 - DNA, 20 bp, Artificial
  CRISPR gRNA sequence
gcatatgataacgtgtgtac

SEQ ID NO: 671776 - DNA, 20 bp, Artificial
  CRISPR gRNA sequence
ccacagatatgcccaagttt

SEQ ID NO: 671777 - DNA, 20 bp, Artificial
  CRISPR gRNA sequence
cacagatatgcccaagtttt

SEQ ID NO: 671778 - DNA, 20 bp, Artificial
  CRISPR gRNA sequence
tacattctttatttcatatc

SEQ ID NO: 671779 - DNA, 20 bp, Artificial
  CRISPR gRNA sequence
acattctttatttcatatca

SEQ ID NO: 671780 - DNA, 20 bp, Artificial
  CRISPR gRNA sequence
cattctttatttcatatcag

SEQ ID NO: 671781 - DNA, 20 bp, Artificial
  CRISPR gRNA sequence
tttatttcatatcagagaaa

SEQ ID NO: 671782 - DNA, 20 bp, Artificial
  CRISPR gRNA sequence
tatttcatatcagagaaaca

SEQ ID NO: 671783 - DNA, 20 bp, Artificial
  CRISPR gRNA sequence
atttcatatcagagaaacaa

SEQ ID NO: 671784 - DNA, 20 bp, Artificial
  CRISPR gRNA sequence
tttcatatcagagaaacaag

SEQ ID NO: 671785 - DNA, 20 bp, Artificial
  CRISPR gRNA sequence
catatcagagaaacaagctt

SEQ ID NO: 671786 - DNA, 20 bp, Artificial
  CRISPR gRNA sequence
atatcagagaaacaagcttg

SEQ ID NO: 671787 - DNA, 20 bp, Artificial
  CRISPR gRNA sequence
gaaaaataactcttggtatt

SEQ ID NO: 671788 - DNA, 20 bp, Artificial
  CRISPR gRNA sequence
aaaaataactcttggtattg

SEQ ID NO: 671789 - DNA, 20 bp, Artificial
  CRISPR gRNA sequence
ttggtattgagaattgtaac

SEQ ID NO: 671790 - DNA, 20 bp, Artificial
  CRISPR gRNA sequence
ggtattgagaattgtaacag

SEQ ID NO: 671791 - DNA, 20 bp, Artificial
  CRISPR gRNA sequence
gtattgagaattgtaacagt

SEQ ID NO: 671792 - DNA, 20 bp, Artificial
  CRISPR gRNA sequence
agaattgtaacagtgatttt

SEQ ID NO: 671793 - DNA, 20 bp, Artificial
  CRISPR gRNA sequence
taacagtgatttttcatttt

SEQ ID NO: 671794 - DNA, 20 bp, Artificial
  CRISPR gRNA sequence
ttcattttactcaaatgaac

SEQ ID NO: 671795 - DNA, 20 bp, Artificial
  CRISPR gRNA sequence
tcattttactcaaatgaaca

SEQ ID NO: 671796 - DNA, 20 bp, Artificial
  CRISPR gRNA sequence
cattttactcaaatgaacaa

SEQ ID NO: 671797 - DNA, 20 bp, Artificial
  CRISPR gRNA sequence
attttactcaaatgaacaag

SEQ ID NO: 671798 - DNA, 20 bp, Artificial
  CRISPR gRNA sequence
tactcaaatgaacaagtttt

SEQ ID NO: 671799 - DNA, 20 bp, Artificial
  CRISPR gRNA sequence
actcaaatgaacaagttttc

SEQ ID NO: 671800 - DNA, 20 bp, Artificial
  CRISPR gRNA sequence
ctcaaatgaacaagttttca

SEQ ID NO: 671801 - DNA, 20 bp, Artificial
  CRISPR gRNA sequence
aaatgaacaagttttcatct

SEQ ID NO: 671802 - DNA, 20 bp, Artificial
  CRISPR gRNA sequence
tcatctttatagcccattta

SEQ ID NO: 671803 - DNA, 20 bp, Artificial
  CRISPR gRNA sequence
catctttatagcccatttat

SEQ ID NO: 671804 - DNA, 20 bp, Artificial
  CRISPR gRNA sequence
atctttatagcccatttatg

SEQ ID NO: 671805 - DNA, 20 bp, Artificial
  CRISPR gRNA sequence
tatagcccatttatgaggat

SEQ ID NO: 671806 - DNA, 20 bp, Artificial
  CRISPR gRNA sequence
atagcccatttatgaggatg

SEQ ID NO: 671807 - DNA, 20 bp, Artificial
  CRISPR gRNA sequence
tagcccatttatgaggatgt

SEQ ID NO: 671808 - DNA, 20 bp, Artificial
  CRISPR gRNA sequence
atgaggatgtctttgtgtta

SEQ ID NO: 671809 - DNA, 20 bp, Artificial
  CRISPR gRNA sequence
tgaggatgtctttgtgttac

SEQ ID NO: 671810 - DNA, 20 bp, Artificial
  CRISPR gRNA sequence
tgtgttaccaaattgtaaaa

SEQ ID NO: 671811 - DNA, 20 bp, Artificial
  CRISPR gRNA sequence
gtgttaccaaattgtaaaat

SEQ ID NO: 671812 - DNA, 20 bp, Artificial
  CRISPR gRNA sequence
tgttaccaaattgtaaaata

SEQ ID NO: 671813 - DNA, 20 bp, Artificial
  CRISPR gRNA sequence
ccaaattgtaaaataaattt

SEQ ID NO: 671814 - DNA, 20 bp, Artificial
  CRISPR gRNA sequence
taaaataaatttcatataaa

SEQ ID NO: 671815 - DNA, 20 bp, Artificial
  CRISPR gRNA sequence
catataaatctaatttcaaa

SEQ ID NO: 671816 - DNA, 20 bp, Artificial
  CRISPR gRNA sequence
atataaatctaatttcaaat

SEQ ID NO: 671817 - DNA, 20 bp, Artificial
  CRISPR gRNA sequence
atttcaaatatttgaaaagt

SEQ ID NO: 671818 - DNA, 20 bp, Artificial
  CRISPR gRNA sequence
caaatatttgaaaagtaaag

SEQ ID NO: 671819 - DNA, 20 bp, Artificial
  CRISPR gRNA sequence
aaatatttgaaaagtaaagc

SEQ ID NO: 671820 - DNA, 20 bp, Artificial
  CRISPR gRNA sequence
gaaaagtaaagcactctgaa

SEQ ID NO: 671821 - DNA, 20 bp, Artificial
  CRISPR gRNA sequence
aaaagtaaagcactctgaat

SEQ ID NO: 671822 - DNA, 20 bp, Artificial
  CRISPR gRNA sequence
tgaatattattgtacagtgg

SEQ ID NO: 671823 - DNA, 20 bp, Artificial
  CRISPR gRNA sequence
aatattattgtacagtggtt

SEQ ID NO: 671824 - DNA, 20 bp, Artificial
  CRISPR gRNA sequence
ttgtacagtggttaatagtt

SEQ ID NO: 671825 - DNA, 20 bp, Artificial
  CRISPR gRNA sequence
tacagtggttaatagttgta

SEQ ID NO: 671826 - DNA, 20 bp, Artificial
  CRISPR gRNA sequence
atagttgtaattcaatagtt

SEQ ID NO: 671827 - DNA, 20 bp, Artificial
  CRISPR gRNA sequence
taattcaatagttgtggcat

SEQ ID NO: 671828 - DNA, 20 bp, Artificial
  CRISPR gRNA sequence
aatagttgtggcatcatata

SEQ ID NO: 671829 - DNA, 20 bp, Artificial
  CRISPR gRNA sequence
tggcatcatatagtgtagct

SEQ ID NO: 671830 - DNA, 20 bp, Artificial
  CRISPR gRNA sequence
cgaatattataacaaaagtc

SEQ ID NO: 671831 - DNA, 20 bp, Artificial
  CRISPR gRNA sequence
taacaaaagtcttatatata

SEQ ID NO: 671832 - DNA, 20 bp, Artificial
  CRISPR gRNA sequence
atatatatataagttataat

SEQ ID NO: 671833 - DNA, 20 bp, Artificial
  CRISPR gRNA sequence
tatatatataagttataatt

SEQ ID NO: 671834 - DNA, 20 bp, Artificial
  CRISPR gRNA sequence
taatttagaatacacttaag

SEQ ID NO: 671835 - DNA, 20 bp, Artificial
  CRISPR gRNA sequence
agaatacacttaagtttact

SEQ ID NO: 671836 - DNA, 20 bp, Artificial
  CRISPR gRNA sequence
gaatacacttaagtttacta

SEQ ID NO: 671837 - DNA, 20 bp, Artificial
  CRISPR gRNA sequence
aagtttactacttacattta

SEQ ID NO: 671838 - DNA, 20 bp, Artificial
  CRISPR gRNA sequence
agtttactacttacatttaa

SEQ ID NO: 671839 - DNA, 20 bp, Artificial
  CRISPR gRNA sequence
actacttacatttaatcatt

SEQ ID NO: 671840 - DNA, 20 bp, Artificial
  CRISPR gRNA sequence
ctacttacatttaatcatta

SEQ ID NO: 671841 - DNA, 20 bp, Artificial
  CRISPR gRNA sequence
cttacatttaatcattaata

SEQ ID NO: 671842 - DNA, 20 bp, Artificial
  CRISPR gRNA sequence
acatttaatcattaataagt

SEQ ID NO: 671843 - DNA, 20 bp, Artificial
  CRISPR gRNA sequence
catttaatcattaataagtt

SEQ ID NO: 671844 - DNA, 20 bp, Artificial
  CRISPR gRNA sequence
aatcattaataagttaaaat

SEQ ID NO: 671845 - DNA, 20 bp, Artificial
  CRISPR gRNA sequence
atcattaataagttaaaata

SEQ ID NO: 671846 - DNA, 20 bp, Artificial
  CRISPR gRNA sequence
ataagttaaaatattaggtg

SEQ ID NO: 671847 - DNA, 20 bp, Artificial
  CRISPR gRNA sequence
aaatattaggtgttctacat

SEQ ID NO: 671848 - DNA, 20 bp, Artificial
  CRISPR gRNA sequence
ggtgttctacattaattgca

SEQ ID NO: 671849 - DNA, 20 bp, Artificial
  CRISPR gRNA sequence
tacattaattgcaaacatct

SEQ ID NO: 671850 - DNA, 20 bp, Artificial
  CRISPR gRNA sequence
cattaattgcaaacatctta

SEQ ID NO: 671851 - DNA, 20 bp, Artificial
  CRISPR gRNA sequence
attgcaaacatcttaaatag

SEQ ID NO: 671852 - DNA, 20 bp, Artificial
  CRISPR gRNA sequence
caaacatcttaaatagtgaa

SEQ ID NO: 671853 - DNA, 20 bp, Artificial
  CRISPR gRNA sequence
aaatagtgaaaataaaccat

SEQ ID NO: 671854 - DNA, 20 bp, Artificial
  CRISPR gRNA sequence
aatagtgaaaataaaccatg

SEQ ID NO: 671855 - DNA, 20 bp, Artificial
  CRISPR gRNA sequence
ctatgagtggagaaaacttt

SEQ ID NO: 671856 - DNA, 20 bp, Artificial
  CRISPR gRNA sequence
tatgagtggagaaaactttt

SEQ ID NO: 671857 - DNA, 20 bp, Artificial
  CRISPR gRNA sequence
tgagtggagaaaacttttct

SEQ ID NO: 671858 - DNA, 20 bp, Artificial
  CRISPR gRNA sequence
ttctatgtaatagttaagat

SEQ ID NO: 671859 - DNA, 20 bp, Artificial
  CRISPR gRNA sequence
tctatgtaatagttaagatt

SEQ ID NO: 671860 - DNA, 20 bp, Artificial
  CRISPR gRNA sequence
ctatgtaatagttaagattc

SEQ ID NO: 671861 - DNA, 20 bp, Artificial
  CRISPR gRNA sequence
tatgtaatagttaagattca

SEQ ID NO: 671862 - DNA, 20 bp, Artificial
  CRISPR gRNA sequence
tgtaatagttaagattcaaa

SEQ ID NO: 671863 - DNA, 20 bp, Artificial
  CRISPR gRNA sequence
agattcaaagaataattgct

SEQ ID NO: 671864 - DNA, 20 bp, Artificial
  CRISPR gRNA sequence
aaagaataattgcttttatt

SEQ ID NO: 671865 - DNA, 20 bp, Artificial
  CRISPR gRNA sequence
cttttattctagaatttcaa

SEQ ID NO: 671866 - DNA, 20 bp, Artificial
  CRISPR gRNA sequence
ttattctagaatttcaacct

SEQ ID NO: 671867 - DNA, 20 bp, Artificial
  CRISPR gRNA sequence
tattctagaatttcaaccta

SEQ ID NO: 671868 - DNA, 20 bp, Artificial
  CRISPR gRNA sequence
attctagaatttcaacctaa

SEQ ID NO: 671869 - DNA, 20 bp, Artificial
  CRISPR gRNA sequence
ttctagaatttcaacctaat

SEQ ID NO: 671870 - DNA, 20 bp, Artificial
  CRISPR gRNA sequence
tagaatttcaacctaattgt

SEQ ID NO: 671871 - DNA, 20 bp, Artificial
  CRISPR gRNA sequence
gaatttcaacctaattgtag

SEQ ID NO: 671872 - DNA, 20 bp, Artificial
  CRISPR gRNA sequence
caacctaattgtagtgagat

SEQ ID NO: 671873 - DNA, 20 bp, Artificial
  CRISPR gRNA sequence
aacctaattgtagtgagatg

SEQ ID NO: 671874 - DNA, 20 bp, Artificial
  CRISPR gRNA sequence
attgtagtgagatgggtgaa

SEQ ID NO: 671875 - DNA, 20 bp, Artificial
  CRISPR gRNA sequence
tagtgagatgggtgaaagat

SEQ ID NO: 671876 - DNA, 20 bp, Artificial
  CRISPR gRNA sequence
gttacactgggattttgttt

SEQ ID NO: 671877 - DNA, 20 bp, Artificial
  CRISPR gRNA sequence
cactgggattttgtttgtat

SEQ ID NO: 671878 - DNA, 20 bp, Artificial
  CRISPR gRNA sequence
ggattttgtttgtatatatg

SEQ ID NO: 671879 - DNA, 20 bp, Artificial
  CRISPR gRNA sequence
tgtttgtatatatgcatcat

SEQ ID NO: 671880 - DNA, 20 bp, Artificial
  CRISPR gRNA sequence
gtttgtatatatgcatcatg

SEQ ID NO: 671881 - DNA, 20 bp, Artificial
  CRISPR gRNA sequence
tttgtatatatgcatcatgt

SEQ ID NO: 671882 - DNA, 20 bp, Artificial
  CRISPR gRNA sequence
gtatatatgcatcatgtaaa

SEQ ID NO: 671883 - DNA, 20 bp, Artificial
  CRISPR gRNA sequence
tatatatgcatcatgtaaat

SEQ ID NO: 671884 - DNA, 20 bp, Artificial
  CRISPR gRNA sequence
aatgtatgacatgcgtatat

SEQ ID NO: 671885 - DNA, 20 bp, Artificial
  CRISPR gRNA sequence
atgtatgacatgcgtatatt

SEQ ID NO: 671886 - DNA, 20 bp, Artificial
  CRISPR gRNA sequence
aaatgtgttgcactttattg

SEQ ID NO: 671887 - DNA, 20 bp, Artificial
  CRISPR gRNA sequence
cactttattgatttactgta

SEQ ID NO: 671888 - DNA, 20 bp, Artificial
  CRISPR gRNA sequence
tattgatttactgtataaat

SEQ ID NO: 671889 - DNA, 20 bp, Artificial
  CRISPR gRNA sequence
attgatttactgtataaata

SEQ ID NO: 671890 - DNA, 20 bp, Artificial
  CRISPR gRNA sequence
ttgatttactgtataaatac

SEQ ID NO: 671891 - DNA, 20 bp, Artificial
  CRISPR gRNA sequence
atttactgtataaatacagc

SEQ ID NO: 671892 - DNA, 20 bp, Artificial
  CRISPR gRNA sequence
actgtataaatacagcaaaa

SEQ ID NO: 671893 - DNA, 20 bp, Artificial
  CRISPR gRNA sequence
ctgtataaatacagcaaaat

SEQ ID NO: 671894 - DNA, 20 bp, Artificial
  CRISPR gRNA sequence
tataaatacagcaaaattat

SEQ ID NO: 671895 - DNA, 20 bp, Artificial
  CRISPR gRNA sequence
tatacattcatatattctaa

SEQ ID NO: 671896 - DNA, 20 bp, Artificial
  CRISPR gRNA sequence
atatattctaaacatacttc

SEQ ID NO: 671897 - DNA, 20 bp, Artificial
  CRISPR gRNA sequence
taaacatacttctttatagt

SEQ ID NO: 671898 - DNA, 20 bp, Artificial
  CRISPR gRNA sequence
aacatacttctttatagtat

SEQ ID NO: 671899 - DNA, 20 bp, Artificial
  CRISPR gRNA sequence
ctttatagtattgttagaga

SEQ ID NO: 671900 - DNA, 20 bp, Artificial
  CRISPR gRNA sequence
tttatagtattgttagagaa

SEQ ID NO: 671901 - DNA, 20 bp, Artificial
  CRISPR gRNA sequence
tatagtattgttagagaata

SEQ ID NO: 671902 - DNA, 20 bp, Artificial
  CRISPR gRNA sequence
atagtattgttagagaatag

SEQ ID NO: 671903 - DNA, 20 bp, Artificial
  CRISPR gRNA sequence
tagtattgttagagaataga

SEQ ID NO: 671904 - DNA, 20 bp, Artificial
  CRISPR gRNA sequence
ttagagaatagattactacg

SEQ ID NO: 671905 - DNA, 20 bp, Artificial
  CRISPR gRNA sequence
gagaatagattactacggct

SEQ ID NO: 671906 - DNA, 20 bp, Artificial
  CRISPR gRNA sequence
ctacggctttactatttctt

SEQ ID NO: 671907 - DNA, 20 bp, Artificial
  CRISPR gRNA sequence
cggctttactatttcttgtc

SEQ ID NO: 671908 - DNA, 20 bp, Artificial
  CRISPR gRNA sequence
tactatttcttgtctatttc

SEQ ID NO: 671909 - DNA, 20 bp, Artificial
  CRISPR gRNA sequence
actatttcttgtctatttcg

SEQ ID NO: 671910 - DNA, 20 bp, Artificial
  CRISPR gRNA sequence
ctatttcttgtctatttcgg

SEQ ID NO: 671911 - DNA, 20 bp, Artificial
  CRISPR gRNA sequence
tttcttgtctatttcggttt

SEQ ID NO: 671912 - DNA, 20 bp, Artificial
  CRISPR gRNA sequence
cttgtctatttcggttttag

SEQ ID NO: 671913 - DNA, 20 bp, Artificial
  CRISPR gRNA sequence
ttgtctatttcggttttagc

SEQ ID NO: 671914 - DNA, 20 bp, Artificial
  CRISPR gRNA sequence
gtctatttcggttttagcaa

SEQ ID NO: 671915 - DNA, 20 bp, Artificial
  CRISPR gRNA sequence
tctatttcggttttagcaaa

SEQ ID NO: 671916 - DNA, 20 bp, Artificial
  CRISPR gRNA sequence
tttcggttttagcaaaatat

SEQ ID NO: 671917 - DNA, 20 bp, Artificial
  CRISPR gRNA sequence
cggttttagcaaaatataca

SEQ ID NO: 671918 - DNA, 20 bp, Artificial
  CRISPR gRNA sequence
ggttttagcaaaatatacat

SEQ ID NO: 671919 - DNA, 20 bp, Artificial
  CRISPR gRNA sequence
tagcaaaatatacatttttt

SEQ ID NO: 671920 - DNA, 20 bp, Artificial
  CRISPR gRNA sequence
agcaaaatatacattttttc

SEQ ID NO: 671921 - DNA, 20 bp, Artificial
  CRISPR gRNA sequence
gcaaaatatacattttttct

SEQ ID NO: 671922 - DNA, 20 bp, Artificial
  CRISPR gRNA sequence
tttctgtatttatttgtagt

SEQ ID NO: 671923 - DNA, 20 bp, Artificial
  CRISPR gRNA sequence
ttctgtatttatttgtagta

SEQ ID NO: 671924 - DNA, 20 bp, Artificial
  CRISPR gRNA sequence
tctgtatttatttgtagtat

SEQ ID NO: 671925 - DNA, 20 bp, Artificial
  CRISPR gRNA sequence
ctgtatttatttgtagtata

SEQ ID NO: 671926 - DNA, 20 bp, Artificial
  CRISPR gRNA sequence
tgtatttatttgtagtatat

SEQ ID NO: 671927 - DNA, 20 bp, Artificial
  CRISPR gRNA sequence
tatttatttgtagtatattc

SEQ ID NO: 671928 - DNA, 20 bp, Artificial
  CRISPR gRNA sequence
atttgtagtatattcttcta

SEQ ID NO: 671929 - DNA, 20 bp, Artificial
  CRISPR gRNA sequence
tttgtagtatattcttctat

SEQ ID NO: 671930 - DNA, 20 bp, Artificial
  CRISPR gRNA sequence
gtagtatattcttctataga

SEQ ID NO: 671931 - DNA, 20 bp, Artificial
  CRISPR gRNA sequence
tagtatattcttctatagat

SEQ ID NO: 671932 - DNA, 20 bp, Artificial
  CRISPR gRNA sequence
ttctatagataaaaagttct

SEQ ID NO: 671933 - DNA, 20 bp, Artificial
  CRISPR gRNA sequence
ctatagataaaaagttctaa

SEQ ID NO: 671934 - DNA, 20 bp, Artificial
  CRISPR gRNA sequence
tatagataaaaagttctaac

SEQ ID NO: 671935 - DNA, 20 bp, Artificial
  CRISPR gRNA sequence
tagataaaaagttctaacta

SEQ ID NO: 671936 - DNA, 20 bp, Artificial
  CRISPR gRNA sequence
taactatatttgtaatatct

SEQ ID NO: 671937 - DNA, 20 bp, Artificial
  CRISPR gRNA sequence
actatatttgtaatatctca

SEQ ID NO: 671938 - DNA, 20 bp, Artificial
  CRISPR gRNA sequence
tatttgtaatatctcacact

SEQ ID NO: 671939 - DNA, 20 bp, Artificial
  CRISPR gRNA sequence
gtaatatctcacacttttaa

SEQ ID NO: 671940 - DNA, 20 bp, Artificial
  CRISPR gRNA sequence
taatatctcacacttttaaa

SEQ ID NO: 671941 - DNA, 20 bp, Artificial
  CRISPR gRNA sequence
acacttttaaaaatcacatt

SEQ ID NO: 671942 - DNA, 20 bp, Artificial
  CRISPR gRNA sequence
ttaaaaatcacatttttatc

SEQ ID NO: 671943 - DNA, 20 bp, Artificial
  CRISPR gRNA sequence
taaaaatcacatttttatct

SEQ ID NO: 671944 - DNA, 20 bp, Artificial
  CRISPR gRNA sequence
aaaaatcacatttttatctg

SEQ ID NO: 671945 - DNA, 20 bp, Artificial
  CRISPR gRNA sequence
aaaatcacatttttatctgt

SEQ ID NO: 671946 - DNA, 20 bp, Artificial
  CRISPR gRNA sequence
ttatctgtttcatgttatgt

SEQ ID NO: 671947 - DNA, 20 bp, Artificial
  CRISPR gRNA sequence
tatctgtttcatgttatgtt

SEQ ID NO: 671948 - DNA, 20 bp, Artificial
  CRISPR gRNA sequence
atctgtttcatgttatgttt

SEQ ID NO: 671949 - DNA, 20 bp, Artificial
  CRISPR gRNA sequence
tctgtttcatgttatgtttt

SEQ ID NO: 671950 - DNA, 20 bp, Artificial
  CRISPR gRNA sequence
tttcatgttatgttttaatt

SEQ ID NO: 671951 - DNA, 20 bp, Artificial
  CRISPR gRNA sequence
catgttatgttttaatttcc

SEQ ID NO: 671952 - DNA, 20 bp, Artificial
  CRISPR gRNA sequence
atgttatgttttaatttccc

SEQ ID NO: 671953 - DNA, 20 bp, Artificial
  CRISPR gRNA sequence
tgttttaatttcccaattaa

SEQ ID NO: 671954 - DNA, 20 bp, Artificial
  CRISPR gRNA sequence
taatttcccaattaaactta

SEQ ID NO: 671955 - DNA, 20 bp, Artificial
  CRISPR gRNA sequence
aatttcccaattaaacttag

SEQ ID NO: 671956 - DNA, 20 bp, Artificial
  CRISPR gRNA sequence
atttcccaattaaacttagt

SEQ ID NO: 671957 - DNA, 20 bp, Artificial
  CRISPR gRNA sequence
cccaattaaacttagtagtg

SEQ ID NO: 671958 - DNA, 20 bp, Artificial
  CRISPR gRNA sequence
ccaattaaacttagtagtgt

SEQ ID NO: 671959 - DNA, 20 bp, Artificial
  CRISPR gRNA sequence
aacttagtagtgtaatgtca

SEQ ID NO: 671960 - DNA, 20 bp, Artificial
  CRISPR gRNA sequence
agtagtgtaatgtcagtcat

SEQ ID NO: 671961 - DNA, 20 bp, Artificial
  CRISPR gRNA sequence
gtagtgtaatgtcagtcata

SEQ ID NO: 671962 - DNA, 20 bp, Artificial
  CRISPR gRNA sequence
ttcataattctgagctattt

SEQ ID NO: 671963 - DNA, 20 bp, Artificial
  CRISPR gRNA sequence
cataattctgagctattttg

SEQ ID NO: 671964 - DNA, 20 bp, Artificial
  CRISPR gRNA sequence
ataattctgagctattttga

SEQ ID NO: 671965 - DNA, 20 bp, Artificial
  CRISPR gRNA sequence
tgagctattttgaaatttaa

SEQ ID NO: 671966 - DNA, 20 bp, Artificial
  CRISPR gRNA sequence
agctattttgaaatttaaaa

SEQ ID NO: 671967 - DNA, 20 bp, Artificial
  CRISPR gRNA sequence
ttttgaaatttaaaagactc

SEQ ID NO: 671968 - DNA, 20 bp, Artificial
  CRISPR gRNA sequence
tgaaatttaaaagactcata

SEQ ID NO: 671969 - DNA, 20 bp, Artificial
  CRISPR gRNA sequence
gaaatttaaaagactcatag

SEQ ID NO: 671970 - DNA, 20 bp, Artificial
  CRISPR gRNA sequence
aaatttaaaagactcatagt

SEQ ID NO: 671971 - DNA, 20 bp, Artificial
  CRISPR gRNA sequence
aaaagactcatagtttcagg

SEQ ID NO: 671972 - DNA, 20 bp, Artificial
  CRISPR gRNA sequence
aaagactcatagtttcaggt

SEQ ID NO: 671973 - DNA, 20 bp, Artificial
  CRISPR gRNA sequence
atagtttcaggttctaaaac

SEQ ID NO: 671974 - DNA, 20 bp, Artificial
  CRISPR gRNA sequence
caggttctaaaactacactt

SEQ ID NO: 671975 - DNA, 20 bp, Artificial
  CRISPR gRNA sequence
aggttctaaaactacacttt

SEQ ID NO: 671976 - DNA, 20 bp, Artificial
  CRISPR gRNA sequence
taaaactacactttcagtta

SEQ ID NO: 671977 - DNA, 20 bp, Artificial
  CRISPR gRNA sequence
aaactacactttcagttatg

SEQ ID NO: 671978 - DNA, 20 bp, Artificial
  CRISPR gRNA sequence
cactttcagttatgtatttc

SEQ ID NO: 671979 - DNA, 20 bp, Artificial
  CRISPR gRNA sequence
tcagttatgtatttcttcat

SEQ ID NO: 671980 - DNA, 20 bp, Artificial
  CRISPR gRNA sequence
cagttatgtatttcttcatt

SEQ ID NO: 671981 - DNA, 20 bp, Artificial
  CRISPR gRNA sequence
agttatgtatttcttcattc

SEQ ID NO: 671982 - DNA, 20 bp, Artificial
  CRISPR gRNA sequence
tgtatttcttcattcctgaa

SEQ ID NO: 671983 - DNA, 20 bp, Artificial
  CRISPR gRNA sequence
cttcattcctgaaatggaat

SEQ ID NO: 671984 - DNA, 20 bp, Artificial
  CRISPR gRNA sequence
ttcattcctgaaatggaatt

SEQ ID NO: 671985 - DNA, 20 bp, Artificial
  CRISPR gRNA sequence
cattcctgaaatggaattct

SEQ ID NO: 671986 - DNA, 20 bp, Artificial
  CRISPR gRNA sequence
attcctgaaatggaattctg

SEQ ID NO: 671987 - DNA, 20 bp, Artificial
  CRISPR gRNA sequence
ctgaaatggaattctgatac

SEQ ID NO: 671988 - DNA, 20 bp, Artificial
  CRISPR gRNA sequence
aaatggaattctgatacact

SEQ ID NO: 671989 - DNA, 20 bp, Artificial
  CRISPR gRNA sequence
tgatacactttatgcacact

SEQ ID NO: 671990 - DNA, 20 bp, Artificial
  CRISPR gRNA sequence
atacactttatgcacactaa

SEQ ID NO: 671991 - DNA, 20 bp, Artificial
  CRISPR gRNA sequence
tatgcacactaagtggtata

SEQ ID NO: 671992 - DNA, 20 bp, Artificial
  CRISPR gRNA sequence
atgcacactaagtggtataa

SEQ ID NO: 671993 - DNA, 20 bp, Artificial
  CRISPR gRNA sequence
tgcacactaagtggtataaa

SEQ ID NO: 671994 - DNA, 20 bp, Artificial
  CRISPR gRNA sequence
agtggtataaagtcatgctg

SEQ ID NO: 671995 - DNA, 20 bp, Artificial
  CRISPR gRNA sequence
tataaagttacacttttcag

SEQ ID NO: 671996 - DNA, 20 bp, Artificial
  CRISPR gRNA sequence
cacttttcagtgattttctt

SEQ ID NO: 671997 - DNA, 20 bp, Artificial
  CRISPR gRNA sequence
ttcagtgattttctttctta

SEQ ID NO: 671998 - DNA, 20 bp, Artificial
  CRISPR gRNA sequence
tcagtgattttctttcttaa

SEQ ID NO: 671999 - DNA, 20 bp, Artificial
  CRISPR gRNA sequence
cagtgattttctttcttaat

SEQ ID NO: 672000 - DNA, 20 bp, Artificial
  CRISPR gRNA sequence
agtgattttctttcttaatt

SEQ ID NO: 672001 - DNA, 20 bp, Artificial
  CRISPR gRNA sequence
tctttcttaattttaatttt

SEQ ID NO: 672002 - DNA, 20 bp, Artificial
  CRISPR gRNA sequence
ctttcttaattttaatttta

SEQ ID NO: 672003 - DNA, 20 bp, Artificial
  CRISPR gRNA sequence
tttcttaattttaattttaa

SEQ ID NO: 672004 - DNA, 20 bp, Artificial
  CRISPR gRNA sequence
tcttaattttaattttaaat

SEQ ID NO: 672005 - DNA, 20 bp, Artificial
  CRISPR gRNA sequence
cttaattttaattttaaatg

SEQ ID NO: 672006 - DNA, 20 bp, Artificial
  CRISPR gRNA sequence
ttaattttaattttaaatgg

SEQ ID NO: 672007 - DNA, 20 bp, Artificial
  CRISPR gRNA sequence
aattttaattttaaatggca

SEQ ID NO: 672008 - DNA, 20 bp, Artificial
  CRISPR gRNA sequence
attttaattttaaatggcaa

SEQ ID NO: 672009 - DNA, 20 bp, Artificial
  CRISPR gRNA sequence
taattttaaatggcaattat

SEQ ID NO: 672010 - DNA, 20 bp, Artificial
  CRISPR gRNA sequence
aattttaaatggcaattatg

SEQ ID NO: 672011 - DNA, 20 bp, Artificial
  CRISPR gRNA sequence
attttaaatggcaattatga

SEQ ID NO: 672012 - DNA, 20 bp, Artificial
  CRISPR gRNA sequence
taaatggcaattatgaatgg

SEQ ID NO: 672013 - DNA, 20 bp, Artificial
  CRISPR gRNA sequence
aaatggcaattatgaatgga

SEQ ID NO: 672014 - DNA, 20 bp, Artificial
  CRISPR gRNA sequence
aatggcaattatgaatggaa

SEQ ID NO: 672015 - DNA, 20 bp, Artificial
  CRISPR gRNA sequence
tgaatggaatataacactat

SEQ ID NO: 672016 - DNA, 20 bp, Artificial
  CRISPR gRNA sequence
tatgggataaccaatagcat

SEQ ID NO: 672017 - DNA, 20 bp, Artificial
  CRISPR gRNA sequence
cgcattgattttaaaagtct

SEQ ID NO: 672018 - DNA, 20 bp, Artificial
  CRISPR gRNA sequence
gcattgattttaaaagtctc

SEQ ID NO: 672019 - DNA, 20 bp, Artificial
  CRISPR gRNA sequence
attttaaaagtctcccttac

SEQ ID NO: 672020 - DNA, 20 bp, Artificial
  CRISPR gRNA sequence
taaaagtctcccttaccaga

SEQ ID NO: 672021 - DNA, 20 bp, Artificial
  CRISPR gRNA sequence
aaaagtctcccttaccagaa

SEQ ID NO: 672022 - DNA, 20 bp, Artificial
  CRISPR gRNA sequence
aaagtctcccttaccagaaa

SEQ ID NO: 672023 - DNA, 20 bp, Artificial
  CRISPR gRNA sequence
ccttaccagaaaaaatacca

SEQ ID NO: 672024 - DNA, 20 bp, Artificial
  CRISPR gRNA sequence
accagaaaaaataccatgga

SEQ ID NO: 672025 - DNA, 20 bp, Artificial
  CRISPR gRNA sequence
ccagaaaaaataccatggaa

SEQ ID NO: 672026 - DNA, 20 bp, Artificial
  CRISPR gRNA sequence
cttagattatggaaaaacct

SEQ ID NO: 672027 - DNA, 20 bp, Artificial
  CRISPR gRNA sequence
agattatggaaaaacctgtt

SEQ ID NO: 672028 - DNA, 20 bp, Artificial
  CRISPR gRNA sequence
gattatggaaaaacctgttg

SEQ ID NO: 672029 - DNA, 20 bp, Artificial
  CRISPR gRNA sequence
tggaaaaacctgttgatgca

SEQ ID NO: 672030 - DNA, 20 bp, Artificial
  CRISPR gRNA sequence
ttgatgcaagatatagaatc

SEQ ID NO: 672031 - DNA, 20 bp, Artificial
  CRISPR gRNA sequence
atgcaagatatagaatccag

SEQ ID NO: 672032 - DNA, 20 bp, Artificial
  CRISPR gRNA sequence
aagactttaaaaattcaaca

SEQ ID NO: 672033 - DNA, 20 bp, Artificial
  CRISPR gRNA sequence
taaaaattcaacatgtgaaa

SEQ ID NO: 672034 - DNA, 20 bp, Artificial
  CRISPR gRNA sequence
aaaaattcaacatgtgaaat

SEQ ID NO: 672035 - DNA, 20 bp, Artificial
  CRISPR gRNA sequence
aaaattcaacatgtgaaatt

SEQ ID NO: 672036 - DNA, 20 bp, Artificial
  CRISPR gRNA sequence
aacatgtgaaattagcatat

SEQ ID NO: 672037 - DNA, 20 bp, Artificial
  CRISPR gRNA sequence
gcatatatgccaaaaaatgc

SEQ ID NO: 672038 - DNA, 20 bp, Artificial
  CRISPR gRNA sequence
gagtaaagagataaaccaaa

SEQ ID NO: 672039 - DNA, 20 bp, Artificial
  CRISPR gRNA sequence
agtaaagagataaaccaaaa

SEQ ID NO: 672040 - DNA, 20 bp, Artificial
  CRISPR gRNA sequence
gcaaaagatatcataaacac

SEQ ID NO: 672041 - DNA, 20 bp, Artificial
  CRISPR gRNA sequence
caaaagatatcataaacact

SEQ ID NO: 672042 - DNA, 20 bp, Artificial
  CRISPR gRNA sequence
ggctaagttccttaatatat

SEQ ID NO: 672043 - DNA, 20 bp, Artificial
  CRISPR gRNA sequence
agttccttaatatataaaga

SEQ ID NO: 672044 - DNA, 20 bp, Artificial
  CRISPR gRNA sequence
cttaatatataaagagcatt

SEQ ID NO: 672045 - DNA, 20 bp, Artificial
  CRISPR gRNA sequence
aatatataaagagcatttaa

SEQ ID NO: 672046 - DNA, 20 bp, Artificial
  CRISPR gRNA sequence
atatataaagagcatttaaa

SEQ ID NO: 672047 - DNA, 20 bp, Artificial
  CRISPR gRNA sequence
aaattcagtgagaaaagact

SEQ ID NO: 672048 - DNA, 20 bp, Artificial
  CRISPR gRNA sequence
aattcagtgagaaaagactg

SEQ ID NO: 672049 - DNA, 20 bp, Artificial
  CRISPR gRNA sequence
agtgagaaaagactgacaac

SEQ ID NO: 672050 - DNA, 20 bp, Artificial
  CRISPR gRNA sequence
acaacctgatagaaaaatgg

SEQ ID NO: 672051 - DNA, 20 bp, Artificial
  CRISPR gRNA sequence
atagaaaaatgggcagacaa

SEQ ID NO: 672052 - DNA, 20 bp, Artificial
  CRISPR gRNA sequence
tgataaataattctgagaaa

SEQ ID NO: 672053 - DNA, 20 bp, Artificial
  CRISPR gRNA sequence
gataaataattctgagaaaa

SEQ ID NO: 672054 - DNA, 20 bp, Artificial
  CRISPR gRNA sequence
ataaataattctgagaaaaa

SEQ ID NO: 672055 - DNA, 20 bp, Artificial
  CRISPR gRNA sequence
tgagaaaaaataaagaacgt

SEQ ID NO: 672056 - DNA, 20 bp, Artificial
  CRISPR gRNA sequence
agaaaaaataaagaacgttt

SEQ ID NO: 672057 - DNA, 20 bp, Artificial
  CRISPR gRNA sequence
caacatggaaaaagatgtct

SEQ ID NO: 672058 - DNA, 20 bp, Artificial
  CRISPR gRNA sequence
aacatggaaaaagatgtcta

SEQ ID NO: 672059 - DNA, 20 bp, Artificial
  CRISPR gRNA sequence
acttcactcataattttaaa

SEQ ID NO: 672060 - DNA, 20 bp, Artificial
  CRISPR gRNA sequence
cactcataattttaaaatgc

SEQ ID NO: 672061 - DNA, 20 bp, Artificial
  CRISPR gRNA sequence
actcataattttaaaatgct

SEQ ID NO: 672062 - DNA, 20 bp, Artificial
  CRISPR gRNA sequence
ataattttaaaatgcttttt

SEQ ID NO: 672063 - DNA, 20 bp, Artificial
  CRISPR gRNA sequence
taaaatgctttttaaaaacc

SEQ ID NO: 672064 - DNA, 20 bp, Artificial
  CRISPR gRNA sequence
aaaatgctttttaaaaacca

SEQ ID NO: 672065 - DNA, 20 bp, Artificial
  CRISPR gRNA sequence
aaatgctttttaaaaaccat

SEQ ID NO: 672066 - DNA, 20 bp, Artificial
  CRISPR gRNA sequence
tttaaaaaccataataaaat

SEQ ID NO: 672067 - DNA, 20 bp, Artificial
  CRISPR gRNA sequence
ttaaaaaccataataaaata

SEQ ID NO: 672068 - DNA, 20 bp, Artificial
  CRISPR gRNA sequence
taaaaaccataataaaatac

SEQ ID NO: 672069 - DNA, 20 bp, Artificial
  CRISPR gRNA sequence
aaaaaccataataaaatacc

SEQ ID NO: 672070 - DNA, 20 bp, Artificial
  CRISPR gRNA sequence
aaaaccataataaaatacca

SEQ ID NO: 672071 - DNA, 20 bp, Artificial
  CRISPR gRNA sequence
taatctgtcagattgacaga

SEQ ID NO: 672072 - DNA, 20 bp, Artificial
  CRISPR gRNA sequence
aatctgtcagattgacagaa

SEQ ID NO: 672073 - DNA, 20 bp, Artificial
  CRISPR gRNA sequence
atctgtcagattgacagaac

SEQ ID NO: 672074 - DNA, 20 bp, Artificial
  CRISPR gRNA sequence
tcagattgacagaactatgt

SEQ ID NO: 672075 - DNA, 20 bp, Artificial
  CRISPR gRNA sequence
acagaactatgtggtattgt

SEQ ID NO: 672076 - DNA, 20 bp, Artificial
  CRISPR gRNA sequence
tgtggtattgtaaaataatg

SEQ ID NO: 672077 - DNA, 20 bp, Artificial
  CRISPR gRNA sequence
taaaataatgtctgtaatag

SEQ ID NO: 672078 - DNA, 20 bp, Artificial
  CRISPR gRNA sequence
taatagcaagaaacaagaaa

SEQ ID NO: 672079 - DNA, 20 bp, Artificial
  CRISPR gRNA sequence
caaatttccaatgattaact

SEQ ID NO: 672080 - DNA, 20 bp, Artificial
  CRISPR gRNA sequence
aaatttccaatgattaactg

SEQ ID NO: 672081 - DNA, 20 bp, Artificial
  CRISPR gRNA sequence
ccaatgattaactggatgaa

SEQ ID NO: 672082 - DNA, 20 bp, Artificial
  CRISPR gRNA sequence
caatgattaactggatgaac

SEQ ID NO: 672083 - DNA, 20 bp, Artificial
  CRISPR gRNA sequence
actggatgaacaaatgatgc

SEQ ID NO: 672084 - DNA, 20 bp, Artificial
  CRISPR gRNA sequence
gatgaacaaatgatgctaga

SEQ ID NO: 672085 - DNA, 20 bp, Artificial
  CRISPR gRNA sequence
gatttataaaatggattcag

SEQ ID NO: 672086 - DNA, 20 bp, Artificial
  CRISPR gRNA sequence
ataaaatggattcagactat

SEQ ID NO: 672087 - DNA, 20 bp, Artificial
  CRISPR gRNA sequence
taaaatggattcagactatt

SEQ ID NO: 672088 - DNA, 20 bp, Artificial
  CRISPR gRNA sequence
agactatttggaatttgaaa

SEQ ID NO: 672089 - DNA, 20 bp, Artificial
  CRISPR gRNA sequence
tttggaatttgaaaattatg

SEQ ID NO: 672090 - DNA, 20 bp, Artificial
  CRISPR gRNA sequence
ggaatttgaaaattatgata

SEQ ID NO: 672091 - DNA, 20 bp, Artificial
  CRISPR gRNA sequence
gaatttgaaaattatgatac

SEQ ID NO: 672092 - DNA, 20 bp, Artificial
  CRISPR gRNA sequence
gaaaattatgatactggttg

SEQ ID NO: 672093 - DNA, 20 bp, Artificial
  CRISPR gRNA sequence
aaaattatgatactggttgc

SEQ ID NO: 672094 - DNA, 20 bp, Artificial
  CRISPR gRNA sequence
tgatactggttgcttttgag

SEQ ID NO: 672095 - DNA, 20 bp, Artificial
  CRISPR gRNA sequence
gttgcttttgagatagggcc

SEQ ID NO: 672096 - DNA, 20 bp, Artificial
  CRISPR gRNA sequence
cttttgagatagggcctgaa

SEQ ID NO: 672097 - DNA, 20 bp, Artificial
  CRISPR gRNA sequence
ttgagatagggcctgaaaga

SEQ ID NO: 672098 - DNA, 20 bp, Artificial
  CRISPR gRNA sequence
tgagatagggcctgaaagat

SEQ ID NO: 672099 - DNA, 20 bp, Artificial
  CRISPR gRNA sequence
gagatagggcctgaaagata

SEQ ID NO: 672100 - DNA, 20 bp, Artificial
  CRISPR gRNA sequence
agatagggcctgaaagatag

SEQ ID NO: 672101 - DNA, 20 bp, Artificial
  CRISPR gRNA sequence
aaagatagtgagcttggtta

SEQ ID NO: 672102 - DNA, 20 bp, Artificial
  CRISPR gRNA sequence
ggttacaaaagaacttcata

SEQ ID NO: 672103 - DNA, 20 bp, Artificial
  CRISPR gRNA sequence
gttacaaaagaacttcatat

SEQ ID NO: 672104 - DNA, 20 bp, Artificial
  CRISPR gRNA sequence
caaaagaacttcatatgtaa

SEQ ID NO: 672105 - DNA, 20 bp, Artificial
  CRISPR gRNA sequence
catatgtaatttttattctt

SEQ ID NO: 672106 - DNA, 20 bp, Artificial
  CRISPR gRNA sequence
atatgtaatttttattcttt

SEQ ID NO: 672107 - DNA, 20 bp, Artificial
  CRISPR gRNA sequence
ttattctttatgttttttgt

SEQ ID NO: 672108 - DNA, 20 bp, Artificial
  CRISPR gRNA sequence
tattctttatgttttttgtt

SEQ ID NO: 672109 - DNA, 20 bp, Artificial
  CRISPR gRNA sequence
attctttatgttttttgttt

SEQ ID NO: 672110 - DNA, 20 bp, Artificial
  CRISPR gRNA sequence
ttctttatgttttttgtttt

SEQ ID NO: 672111 - DNA, 20 bp, Artificial
  CRISPR gRNA sequence
tttatgttttttgttttttc

SEQ ID NO: 672112 - DNA, 20 bp, Artificial
  CRISPR gRNA sequence
tatgttttttgttttttctt

SEQ ID NO: 672113 - DNA, 20 bp, Artificial
  CRISPR gRNA sequence
atgttttttgttttttcttt

SEQ ID NO: 672114 - DNA, 20 bp, Artificial
  CRISPR gRNA sequence
tgttttttgttttttctttg

SEQ ID NO: 672115 - DNA, 20 bp, Artificial
  CRISPR gRNA sequence
tttgttttttctttgccatg

SEQ ID NO: 672116 - DNA, 20 bp, Artificial
  CRISPR gRNA sequence
ttgttttttctttgccatgt

SEQ ID NO: 672117 - DNA, 20 bp, Artificial
  CRISPR gRNA sequence
tgttttttctttgccatgtt

SEQ ID NO: 672118 - DNA, 20 bp, Artificial
  CRISPR gRNA sequence
gttttttctttgccatgttt

SEQ ID NO: 672119 - DNA, 20 bp, Artificial
  CRISPR gRNA sequence
ttttttctttgccatgttta

SEQ ID NO: 672120 - DNA, 20 bp, Artificial
  CRISPR gRNA sequence
tttctttgccatgtttatgg

SEQ ID NO: 672121 - DNA, 20 bp, Artificial
  CRISPR gRNA sequence
ttctttgccatgtttatggg

SEQ ID NO: 672122 - DNA, 20 bp, Artificial
  CRISPR gRNA sequence
tctttgccatgtttatgggt

SEQ ID NO: 672123 - DNA, 20 bp, Artificial
  CRISPR gRNA sequence
ctttgccatgtttatgggtt

SEQ ID NO: 672124 - DNA, 20 bp, Artificial
  CRISPR gRNA sequence
tttgccatgtttatgggttc

SEQ ID NO: 672125 - DNA, 20 bp, Artificial
  CRISPR gRNA sequence
tgccatgtttatgggttctt

SEQ ID NO: 672126 - DNA, 20 bp, Artificial
  CRISPR gRNA sequence
gccatgtttatgggttcttt

SEQ ID NO: 672127 - DNA, 20 bp, Artificial
  CRISPR gRNA sequence
ccatgtttatgggttcttta

SEQ ID NO: 672128 - DNA, 20 bp, Artificial
  CRISPR gRNA sequence
atgggttctttaaacataca

SEQ ID NO: 672129 - DNA, 20 bp, Artificial
  CRISPR gRNA sequence
tgggttctttaaacatacaa

SEQ ID NO: 672130 - DNA, 20 bp, Artificial
  CRISPR gRNA sequence
tttaaacatacaaagcaagt

SEQ ID NO: 672131 - DNA, 20 bp, Artificial
  CRISPR gRNA sequence
taaacatacaaagcaagttt

SEQ ID NO: 672132 - DNA, 20 bp, Artificial
  CRISPR gRNA sequence
aaacatacaaagcaagttta

SEQ ID NO: 672133 - DNA, 20 bp, Artificial
  CRISPR gRNA sequence
aacatacaaagcaagtttaa

SEQ ID NO: 672134 - DNA, 20 bp, Artificial
  CRISPR gRNA sequence
aaagcaataaaactcttaag

SEQ ID NO: 672135 - DNA, 20 bp, Artificial
  CRISPR gRNA sequence
aagcaataaaactcttaagt

SEQ ID NO: 672136 - DNA, 20 bp, Artificial
  CRISPR gRNA sequence
ttaagttagtaaaacatctc

SEQ ID NO: 672137 - DNA, 20 bp, Artificial
  CRISPR gRNA sequence
aagttagtaaaacatctcag

SEQ ID NO: 672138 - DNA, 20 bp, Artificial
  CRISPR gRNA sequence
agttagtaaaacatctcagt

SEQ ID NO: 672139 - DNA, 20 bp, Artificial
  CRISPR gRNA sequence
gtaaaacatctcagtgaata

SEQ ID NO: 672140 - DNA, 20 bp, Artificial
  CRISPR gRNA sequence
agtgaatactacttgaacat

SEQ ID NO: 672141 - DNA, 20 bp, Artificial
  CRISPR gRNA sequence
cttgaacatctcctatatac

SEQ ID NO: 672142 - DNA, 20 bp, Artificial
  CRISPR gRNA sequence
gaacatctcctatataccac

SEQ ID NO: 672143 - DNA, 20 bp, Artificial
  CRISPR gRNA sequence
aacatctcctatataccaca

SEQ ID NO: 672144 - DNA, 20 bp, Artificial
  CRISPR gRNA sequence
ctatataccacaacattctt

SEQ ID NO: 672145 - DNA, 20 bp, Artificial
  CRISPR gRNA sequence
tataccacaacattcttgag

SEQ ID NO: 672146 - DNA, 20 bp, Artificial
  CRISPR gRNA sequence
ttgagcatgctggcaatata

SEQ ID NO: 672147 - DNA, 20 bp, Artificial
  CRISPR gRNA sequence
gagcatgctggcaatataaa

SEQ ID NO: 672148 - DNA, 20 bp, Artificial
  CRISPR gRNA sequence
agcatgctggcaatataaag

SEQ ID NO: 672149 - DNA, 20 bp, Artificial
  CRISPR gRNA sequence
gcaatataaagatggataaa

SEQ ID NO: 672150 - DNA, 20 bp, Artificial
  CRISPR gRNA sequence
tcccaactctttttaaaaac

SEQ ID NO: 672151 - DNA, 20 bp, Artificial
  CRISPR gRNA sequence
tttttaaaaactagtaaggg

SEQ ID NO: 672152 - DNA, 20 bp, Artificial
  CRISPR gRNA sequence
tttaaaaactagtaagggag

SEQ ID NO: 672153 - DNA, 20 bp, Artificial
  CRISPR gRNA sequence
ttaaaaactagtaagggagt

SEQ ID NO: 672154 - DNA, 20 bp, Artificial
  CRISPR gRNA sequence
taaaaactagtaagggagta

SEQ ID NO: 672155 - DNA, 20 bp, Artificial
  CRISPR gRNA sequence
aaaaactagtaagggagtaa

SEQ ID NO: 672156 - DNA, 20 bp, Artificial
  CRISPR gRNA sequence
aaaactagtaagggagtaac

SEQ ID NO: 672157 - DNA, 20 bp, Artificial
  CRISPR gRNA sequence
gtaagggagtaacaatttgt

SEQ ID NO: 672158 - DNA, 20 bp, Artificial
  CRISPR gRNA sequence
gtaaatagggtaaaactcaa

SEQ ID NO: 672159 - DNA, 20 bp, Artificial
  CRISPR gRNA sequence
taaatagggtaaaactcaat

SEQ ID NO: 672160 - DNA, 20 bp, Artificial
  CRISPR gRNA sequence
aatatagttggtactctgtt

SEQ ID NO: 672161 - DNA, 20 bp, Artificial
  CRISPR gRNA sequence
gtactctgttagaaatgggt

SEQ ID NO: 672162 - DNA, 20 bp, Artificial
  CRISPR gRNA sequence
tgttagaaatgggtccagga

SEQ ID NO: 672163 - DNA, 20 bp, Artificial
  CRISPR gRNA sequence
ttagaaatgggtccaggaag

SEQ ID NO: 672164 - DNA, 20 bp, Artificial
  CRISPR gRNA sequence
gaaatgggtccaggaaggat

SEQ ID NO: 672165 - DNA, 20 bp, Artificial
  CRISPR gRNA sequence
tgtagatctcagagtagttt

SEQ ID NO: 672166 - DNA, 20 bp, Artificial
  CRISPR gRNA sequence
gtagatctcagagtagttta

SEQ ID NO: 672167 - DNA, 20 bp, Artificial
  CRISPR gRNA sequence
tagatctcagagtagtttat

SEQ ID NO: 672168 - DNA, 20 bp, Artificial
  CRISPR gRNA sequence
agagtagtttatgtaccata

SEQ ID NO: 672169 - DNA, 20 bp, Artificial
  CRISPR gRNA sequence
atgtaccataagttgattga

SEQ ID NO: 672170 - DNA, 20 bp, Artificial
  CRISPR gRNA sequence
tgtaccataagttgattgat

SEQ ID NO: 672171 - DNA, 20 bp, Artificial
  CRISPR gRNA sequence
attgatcttcataaaaaccc

SEQ ID NO: 672172 - DNA, 20 bp, Artificial
  CRISPR gRNA sequence
atcttcataaaaaccctatg

SEQ ID NO: 672173 - DNA, 20 bp, Artificial
  CRISPR gRNA sequence
cataaaaaccctatgaaata

SEQ ID NO: 672174 - DNA, 20 bp, Artificial
  CRISPR gRNA sequence
ataaaaaccctatgaaatag

SEQ ID NO: 672175 - DNA, 20 bp, Artificial
  CRISPR gRNA sequence
tgaaatagagcactatatat

SEQ ID NO: 672176 - DNA, 20 bp, Artificial
  CRISPR gRNA sequence
tatatccaggaaaaaaaaga

SEQ ID NO: 672177 - DNA, 20 bp, Artificial
  CRISPR gRNA sequence
cctgtatttactcatttaat

SEQ ID NO: 672178 - DNA, 20 bp, Artificial
  CRISPR gRNA sequence
ctgtatttactcatttaatg

SEQ ID NO: 672179 - DNA, 20 bp, Artificial
  CRISPR gRNA sequence
tatttactcatttaatgctc

SEQ ID NO: 672180 - DNA, 20 bp, Artificial
  CRISPR gRNA sequence
actcatttaatgctcacagc

SEQ ID NO: 672181 - DNA, 20 bp, Artificial
  CRISPR gRNA sequence
ctcatttaatgctcacagca

SEQ ID NO: 672182 - DNA, 20 bp, Artificial
  CRISPR gRNA sequence
atttaatgctcacagcaacc

SEQ ID NO: 672183 - DNA, 20 bp, Artificial
  CRISPR gRNA sequence
aatgctcacagcaaccatag

SEQ ID NO: 672184 - DNA, 20 bp, Artificial
  CRISPR gRNA sequence
atgctcacagcaaccatagg

SEQ ID NO: 672185 - DNA, 20 bp, Artificial
  CRISPR gRNA sequence
acagcaaccataggaagtcg

SEQ ID NO: 672186 - DNA, 20 bp, Artificial
  CRISPR gRNA sequence
tcatccccgttttataaagg

SEQ ID NO: 672187 - DNA, 20 bp, Artificial
  CRISPR gRNA sequence
tataaaggacatggtgaaat

SEQ ID NO: 672188 - DNA, 20 bp, Artificial
  CRISPR gRNA sequence
ataaaggacatggtgaaatt

SEQ ID NO: 672189 - DNA, 20 bp, Artificial
  CRISPR gRNA sequence
taaaggacatggtgaaatta

SEQ ID NO: 672190 - DNA, 20 bp, Artificial
  CRISPR gRNA sequence
aacctaagttcctcactatc

SEQ ID NO: 672191 - DNA, 20 bp, Artificial
  CRISPR gRNA sequence
agttcctcactatcctcgtt

SEQ ID NO: 672192 - DNA, 20 bp, Artificial
  CRISPR gRNA sequence
ctcactatcctcgttcttaa

SEQ ID NO: 672193 - DNA, 20 bp, Artificial
  CRISPR gRNA sequence
actatcctcgttcttaatac

SEQ ID NO: 672194 - DNA, 20 bp, Artificial
  CRISPR gRNA sequence
tcctcgttcttaatacctaa

SEQ ID NO: 672195 - DNA, 20 bp, Artificial
  CRISPR gRNA sequence
gttcttaatacctaaactgt

SEQ ID NO: 672196 - DNA, 20 bp, Artificial
  CRISPR gRNA sequence
ttaatacctaaactgttctg

SEQ ID NO: 672197 - DNA, 20 bp, Artificial
  CRISPR gRNA sequence
aatacctaaactgttctgct

SEQ ID NO: 672198 - DNA, 20 bp, Artificial
  CRISPR gRNA sequence
atacctaaactgttctgctc

SEQ ID NO: 672199 - DNA, 20 bp, Artificial
  CRISPR gRNA sequence
aactgttctgctcgaacttt

SEQ ID NO: 672200 - DNA, 20 bp, Artificial
  CRISPR gRNA sequence
ttctgctcgaactttattca

SEQ ID NO: 672201 - DNA, 20 bp, Artificial
  CRISPR gRNA sequence
tgctcgaactttattcagta

SEQ ID NO: 672202 - DNA, 20 bp, Artificial
  CRISPR gRNA sequence
ctcgaactttattcagtaat

SEQ ID NO: 672203 - DNA, 20 bp, Artificial
  CRISPR gRNA sequence
gaactttattcagtaatctg

SEQ ID NO: 672204 - DNA, 20 bp, Artificial
  CRISPR gRNA sequence
tattcagtaatctgagttca

SEQ ID NO: 672205 - DNA, 20 bp, Artificial
  CRISPR gRNA sequence
attcagtaatctgagttcat

SEQ ID NO: 672206 - DNA, 20 bp, Artificial
  CRISPR gRNA sequence
ttcagtaatctgagttcatc

SEQ ID NO: 672207 - DNA, 20 bp, Artificial
  CRISPR gRNA sequence
agtaatctgagttcatctgt

SEQ ID NO: 672208 - DNA, 20 bp, Artificial
  CRISPR gRNA sequence
agttcatctgtactttgcaa

SEQ ID NO: 672209 - DNA, 20 bp, Artificial
  CRISPR gRNA sequence
atctgtactttgcaaacatg

SEQ ID NO: 672210 - DNA, 20 bp, Artificial
  CRISPR gRNA sequence
tactttgcaaacatgagact

SEQ ID NO: 672211 - DNA, 20 bp, Artificial
  CRISPR gRNA sequence
tgcaaacatgagactcagtt

SEQ ID NO: 672212 - DNA, 20 bp, Artificial
  CRISPR gRNA sequence
gcaaacatgagactcagttt

SEQ ID NO: 672213 - DNA, 20 bp, Artificial
  CRISPR gRNA sequence
caaacatgagactcagttta

SEQ ID NO: 672214 - DNA, 20 bp, Artificial
  CRISPR gRNA sequence
agtttaaataattagttcaa

SEQ ID NO: 672215 - DNA, 20 bp, Artificial
  CRISPR gRNA sequence
aaataattagttcaagatta

SEQ ID NO: 672216 - DNA, 20 bp, Artificial
  CRISPR gRNA sequence
aataattagttcaagattat

SEQ ID NO: 672217 - DNA, 20 bp, Artificial
  CRISPR gRNA sequence
gttcaagattataatgccag

SEQ ID NO: 672218 - DNA, 20 bp, Artificial
  CRISPR gRNA sequence
aagattataatgccagtact

SEQ ID NO: 672219 - DNA, 20 bp, Artificial
  CRISPR gRNA sequence
taatgccagtacttttctac

SEQ ID NO: 672220 - DNA, 20 bp, Artificial
  CRISPR gRNA sequence
ttctaccacagagccatttt

SEQ ID NO: 672221 - DNA, 20 bp, Artificial
  CRISPR gRNA sequence
tctaccacagagccattttg

SEQ ID NO: 672222 - DNA, 20 bp, Artificial
  CRISPR gRNA sequence
ctaccacagagccattttga

SEQ ID NO: 672223 - DNA, 20 bp, Artificial
  CRISPR gRNA sequence
taccacagagccattttgat

SEQ ID NO: 672224 - DNA, 20 bp, Artificial
  CRISPR gRNA sequence
ccacagagccattttgatag

SEQ ID NO: 672225 - DNA, 20 bp, Artificial
  CRISPR gRNA sequence
tgatagtgcaccctcttgtg

SEQ ID NO: 672226 - DNA, 20 bp, Artificial
  CRISPR gRNA sequence
gatagtgcaccctcttgtga

SEQ ID NO: 672227 - DNA, 20 bp, Artificial
  CRISPR gRNA sequence
atagtgcaccctcttgtgat

SEQ ID NO: 672228 - DNA, 20 bp, Artificial
  CRISPR gRNA sequence
ttgtgataagtactaatgac

SEQ ID NO: 672229 - DNA, 20 bp, Artificial
  CRISPR gRNA sequence
gtgataagtactaatgacaa

SEQ ID NO: 672230 - DNA, 20 bp, Artificial
  CRISPR gRNA sequence
tgataagtactaatgacaaa

SEQ ID NO: 672231 - DNA, 20 bp, Artificial
  CRISPR gRNA sequence
atgacaaatcacagactgtg

SEQ ID NO: 672232 - DNA, 20 bp, Artificial
  CRISPR gRNA sequence
tgtggtttctctaagaaaac

SEQ ID NO: 672233 - DNA, 20 bp, Artificial
  CRISPR gRNA sequence
ctctaagaaaacaacggcaa

SEQ ID NO: 672234 - DNA, 20 bp, Artificial
  CRISPR gRNA sequence
tctaagaaaacaacggcaat

SEQ ID NO: 672235 - DNA, 20 bp, Artificial
  CRISPR gRNA sequence
taagaaaacaacggcaatga

SEQ ID NO: 672236 - DNA, 20 bp, Artificial
  CRISPR gRNA sequence
agaaaacaacggcaatgaaa

SEQ ID NO: 672237 - DNA, 20 bp, Artificial
  CRISPR gRNA sequence
acttcctttttatgaaaata

SEQ ID NO: 672238 - DNA, 20 bp, Artificial
  CRISPR gRNA sequence
cttcctttttatgaaaatat

SEQ ID NO: 672239 - DNA, 20 bp, Artificial
  CRISPR gRNA sequence
cctttttatgaaaatatttc

SEQ ID NO: 672240 - DNA, 20 bp, Artificial
  CRISPR gRNA sequence
ctttttatgaaaatatttcc

SEQ ID NO: 672241 - DNA, 20 bp, Artificial
  CRISPR gRNA sequence
tttatgaaaatatttcctct

SEQ ID NO: 672242 - DNA, 20 bp, Artificial
  CRISPR gRNA sequence
ttatgaaaatatttcctcta

SEQ ID NO: 672243 - DNA, 20 bp, Artificial
  CRISPR gRNA sequence
tatgaaaatatttcctctaa

SEQ ID NO: 672244 - DNA, 20 bp, Artificial
  CRISPR gRNA sequence
atgaaaatatttcctctaat

SEQ ID NO: 672245 - DNA, 20 bp, Artificial
  CRISPR gRNA sequence
tgaaaatatttcctctaatc

SEQ ID NO: 672246 - DNA, 20 bp, Artificial
  CRISPR gRNA sequence
cctctaatcaagtagtacca

SEQ ID NO: 672247 - DNA, 20 bp, Artificial
  CRISPR gRNA sequence
ctctaatcaagtagtaccaa

SEQ ID NO: 672248 - DNA, 20 bp, Artificial
  CRISPR gRNA sequence
taatcaagtagtaccaaata

SEQ ID NO: 672249 - DNA, 20 bp, Artificial
  CRISPR gRNA sequence
atcaagtagtaccaaataag

SEQ ID NO: 672250 - DNA, 20 bp, Artificial
  CRISPR gRNA sequence
ttttgcttagtaactttgat

SEQ ID NO: 672251 - DNA, 20 bp, Artificial
  CRISPR gRNA sequence
tgcttagtaactttgatatg

SEQ ID NO: 672252 - DNA, 20 bp, Artificial
  CRISPR gRNA sequence
gcttagtaactttgatatga

SEQ ID NO: 672253 - DNA, 20 bp, Artificial
  CRISPR gRNA sequence
cttagtaactttgatatgac

SEQ ID NO: 672254 - DNA, 20 bp, Artificial
  CRISPR gRNA sequence
agtaactttgatatgacttc

SEQ ID NO: 672255 - DNA, 20 bp, Artificial
  CRISPR gRNA sequence
gtaactttgatatgacttct

SEQ ID NO: 672256 - DNA, 20 bp, Artificial
  CRISPR gRNA sequence
tgatatgacttcttaagaaa

SEQ ID NO: 672257 - DNA, 20 bp, Artificial
  CRISPR gRNA sequence
gatatgacttcttaagaaat

SEQ ID NO: 672258 - DNA, 20 bp, Artificial
  CRISPR gRNA sequence
atatgacttcttaagaaatt

SEQ ID NO: 672259 - DNA, 20 bp, Artificial
  CRISPR gRNA sequence
cttaagaaattttctatatt

SEQ ID NO: 672260 - DNA, 20 bp, Artificial
  CRISPR gRNA sequence
ttaagaaattttctatatta

SEQ ID NO: 672261 - DNA, 20 bp, Artificial
  CRISPR gRNA sequence
aagaaattttctatattact

SEQ ID NO: 672262 - DNA, 20 bp, Artificial
  CRISPR gRNA sequence
agaaattttctatattactg

SEQ ID NO: 672263 - DNA, 20 bp, Artificial
  CRISPR gRNA sequence
tctatattactggataaaaa

SEQ ID NO: 672264 - DNA, 20 bp, Artificial
  CRISPR gRNA sequence
ctatattactggataaaaaa

SEQ ID NO: 672265 - DNA, 20 bp, Artificial
  CRISPR gRNA sequence
tatattactggataaaaaac

SEQ ID NO: 672266 - DNA, 20 bp, Artificial
  CRISPR gRNA sequence
tattactggataaaaaactg

SEQ ID NO: 672267 - DNA, 20 bp, Artificial
  CRISPR gRNA sequence
ctggataaaaaactgatact

SEQ ID NO: 672268 - DNA, 20 bp, Artificial
  CRISPR gRNA sequence
gataaaaaactgatactcac

SEQ ID NO: 672269 - DNA, 20 bp, Artificial
  CRISPR gRNA sequence
atactcacttaaagcttgtt

SEQ ID NO: 672270 - DNA, 20 bp, Artificial
  CRISPR gRNA sequence
acttaaagcttgtttctgct

SEQ ID NO: 672271 - DNA, 20 bp, Artificial
  CRISPR gRNA sequence
aaagcttgtttctgctttat

SEQ ID NO: 672272 - DNA, 20 bp, Artificial
  CRISPR gRNA sequence
aagcttgtttctgctttatg

SEQ ID NO: 672273 - DNA, 20 bp, Artificial
  CRISPR gRNA sequence
gtttctgctttatgaaaaga

SEQ ID NO: 672274 - DNA, 20 bp, Artificial
  CRISPR gRNA sequence
tttctgctttatgaaaagac

SEQ ID NO: 672275 - DNA, 20 bp, Artificial
  CRISPR gRNA sequence
ctgctttatgaaaagactct

SEQ ID NO: 672276 - DNA, 20 bp, Artificial
  CRISPR gRNA sequence
tgctttatgaaaagactctg

SEQ ID NO: 672277 - DNA, 20 bp, Artificial
  CRISPR gRNA sequence
ctttatgaaaagactctgtc

SEQ ID NO: 672278 - DNA, 20 bp, Artificial
  CRISPR gRNA sequence
tatgaaaagactctgtcagc

SEQ ID NO: 672279 - DNA, 20 bp, Artificial
  CRISPR gRNA sequence
atgaaaagactctgtcagca

SEQ ID NO: 672280 - DNA, 20 bp, Artificial
  CRISPR gRNA sequence
tgaaaagactctgtcagcaa

SEQ ID NO: 672281 - DNA, 20 bp, Artificial
  CRISPR gRNA sequence
tgtcagcaatccagaatgaa

SEQ ID NO: 672282 - DNA, 20 bp, Artificial
  CRISPR gRNA sequence
tcagcaatccagaatgaagg

SEQ ID NO: 672283 - DNA, 20 bp, Artificial
  CRISPR gRNA sequence
tgctaacaaaattccaactt

SEQ ID NO: 672284 - DNA, 20 bp, Artificial
  CRISPR gRNA sequence
acaaaattccaacttttctg

SEQ ID NO: 672285 - DNA, 20 bp, Artificial
  CRISPR gRNA sequence
caacttttctgtgggatgat

SEQ ID NO: 672286 - DNA, 20 bp, Artificial
  CRISPR gRNA sequence
ttctgtgggatgatccaaaa

SEQ ID NO: 672287 - DNA, 20 bp, Artificial
  CRISPR gRNA sequence
tctgtgggatgatccaaaaa

SEQ ID NO: 672288 - DNA, 20 bp, Artificial
  CRISPR gRNA sequence
ctgtgggatgatccaaaaac

SEQ ID NO: 672289 - DNA, 20 bp, Artificial
  CRISPR gRNA sequence
tgtgggatgatccaaaaaca

SEQ ID NO: 672290 - DNA, 20 bp, Artificial
  CRISPR gRNA sequence
tgggatgatccaaaaacagc

SEQ ID NO: 672291 - DNA, 20 bp, Artificial
  CRISPR gRNA sequence
aatttcttaacagtggcaag

SEQ ID NO: 672292 - DNA, 20 bp, Artificial
  CRISPR gRNA sequence
cttaacagtggcaagtgtgt

SEQ ID NO: 672293 - DNA, 20 bp, Artificial
  CRISPR gRNA sequence
ttaacagtggcaagtgtgta

SEQ ID NO: 672294 - DNA, 20 bp, Artificial
  CRISPR gRNA sequence
aacagtggcaagtgtgtaca

SEQ ID NO: 672295 - DNA, 20 bp, Artificial
  CRISPR gRNA sequence
acagtggcaagtgtgtacat

SEQ ID NO: 672296 - DNA, 20 bp, Artificial
  CRISPR gRNA sequence
tgccattactgtgattagct

SEQ ID NO: 672297 - DNA, 20 bp, Artificial
  CRISPR gRNA sequence
ctgtgattagctgctttttg

SEQ ID NO: 672298 - DNA, 20 bp, Artificial
  CRISPR gRNA sequence
tgattagctgctttttggtg

SEQ ID NO: 672299 - DNA, 20 bp, Artificial
  CRISPR gRNA sequence
gctgctttttggtgtgcata

SEQ ID NO: 672300 - DNA, 20 bp, Artificial
  CRISPR gRNA sequence
ctttttggtgtgcatagatt

SEQ ID NO: 672301 - DNA, 20 bp, Artificial
  CRISPR gRNA sequence
tttggtgtgcatagattaga

SEQ ID NO: 672302 - DNA, 20 bp, Artificial
  CRISPR gRNA sequence
ttggtgtgcatagattagag

SEQ ID NO: 672303 - DNA, 20 bp, Artificial
  CRISPR gRNA sequence
tggtgtgcatagattagagt

SEQ ID NO: 672304 - DNA, 20 bp, Artificial
  CRISPR gRNA sequence
ggtgtgcatagattagagtt

SEQ ID NO: 672305 - DNA, 20 bp, Artificial
  CRISPR gRNA sequence
gtgtgcatagattagagttg

SEQ ID NO: 672306 - DNA, 20 bp, Artificial
  CRISPR gRNA sequence
gagttggaatactttgattt

SEQ ID NO: 672307 - DNA, 20 bp, Artificial
  CRISPR gRNA sequence
gaatactttgattttcaaac

SEQ ID NO: 672308 - DNA, 20 bp, Artificial
  CRISPR gRNA sequence
tgattttcaaacaacatgtt

SEQ ID NO: 672309 - DNA, 20 bp, Artificial
  CRISPR gRNA sequence
gattttcaaacaacatgttc

SEQ ID NO: 672310 - DNA, 20 bp, Artificial
  CRISPR gRNA sequence
attttcaaacaacatgttcc

SEQ ID NO: 672311 - DNA, 20 bp, Artificial
  CRISPR gRNA sequence
tcaaacaacatgttccatag

SEQ ID NO: 672312 - DNA, 20 bp, Artificial
  CRISPR gRNA sequence
caaacaacatgttccatagg

SEQ ID NO: 672313 - DNA, 20 bp, Artificial
  CRISPR gRNA sequence
aaacaacatgttccataggt

SEQ ID NO: 672314 - DNA, 20 bp, Artificial
  CRISPR gRNA sequence
cataggtaattttttagata

SEQ ID NO: 672315 - DNA, 20 bp, Artificial
  CRISPR gRNA sequence
tttagatagaaaaaataggc

SEQ ID NO: 672316 - DNA, 20 bp, Artificial
  CRISPR gRNA sequence
ttagatagaaaaaataggca

SEQ ID NO: 672317 - DNA, 20 bp, Artificial
  CRISPR gRNA sequence
tagatagaaaaaataggcag

SEQ ID NO: 672318 - DNA, 20 bp, Artificial
  CRISPR gRNA sequence
agatagaaaaaataggcaga

SEQ ID NO: 672319 - DNA, 20 bp, Artificial
  CRISPR gRNA sequence
gatagaaaaaataggcagag

SEQ ID NO: 672320 - DNA, 20 bp, Artificial
  CRISPR gRNA sequence
aagagcatgtgaggtctgtg

SEQ ID NO: 672321 - DNA, 20 bp, Artificial
  CRISPR gRNA sequence
agagcatgtgaggtctgtgt

SEQ ID NO: 672322 - DNA, 20 bp, Artificial
  CRISPR gRNA sequence
tgtactacatttatatagct

SEQ ID NO: 672323 - DNA, 20 bp, Artificial
  CRISPR gRNA sequence
catttatatagctcgaaact

SEQ ID NO: 672324 - DNA, 20 bp, Artificial
  CRISPR gRNA sequence
atatagctcgaaactgaata

SEQ ID NO: 672325 - DNA, 20 bp, Artificial
  CRISPR gRNA sequence
tatagctcgaaactgaatat

SEQ ID NO: 672326 - DNA, 20 bp, Artificial
  CRISPR gRNA sequence
gaaactgaatatatgtgttt

SEQ ID NO: 672327 - DNA, 20 bp, Artificial
  CRISPR gRNA sequence
aatatatgtgtttagtttga

SEQ ID NO: 672328 - DNA, 20 bp, Artificial
  CRISPR gRNA sequence
agtttgattttagaacattg

SEQ ID NO: 672329 - DNA, 20 bp, Artificial
  CRISPR gRNA sequence
gtttgattttagaacattgc

SEQ ID NO: 672330 - DNA, 20 bp, Artificial
  CRISPR gRNA sequence
gattttagaacattgccttg

SEQ ID NO: 672331 - DNA, 20 bp, Artificial
  CRISPR gRNA sequence
attttagaacattgccttga

SEQ ID NO: 672332 - DNA, 20 bp, Artificial
  CRISPR gRNA sequence
tagaacattgccttgacagt

SEQ ID NO: 672333 - DNA, 20 bp, Artificial
  CRISPR gRNA sequence
agaacattgccttgacagtg

SEQ ID NO: 672334 - DNA, 20 bp, Artificial
  CRISPR gRNA sequence
gaacattgccttgacagtgt

SEQ ID NO: 672335 - DNA, 20 bp, Artificial
  CRISPR gRNA sequence
ccttgacagtgtatcttcat

SEQ ID NO: 672336 - DNA, 20 bp, Artificial
  CRISPR gRNA sequence
gacagtgtatcttcatatgt

SEQ ID NO: 672337 - DNA, 20 bp, Artificial
  CRISPR gRNA sequence
acagtgtatcttcatatgtc

SEQ ID NO: 672338 - DNA, 20 bp, Artificial
  CRISPR gRNA sequence
catatgtcaaagacatttgc

SEQ ID NO: 672339 - DNA, 20 bp, Artificial
  CRISPR gRNA sequence
atatgtcaaagacatttgct

SEQ ID NO: 672340 - DNA, 20 bp, Artificial
  CRISPR gRNA sequence
gctggattaagatcctgaat

SEQ ID NO: 672341 - DNA, 20 bp, Artificial
  CRISPR gRNA sequence
ctggattaagatcctgaatt

SEQ ID NO: 672342 - DNA, 20 bp, Artificial
  CRISPR gRNA sequence
gattaagatcctgaattgtt

SEQ ID NO: 672343 - DNA, 20 bp, Artificial
  CRISPR gRNA sequence
agatcctgaattgtttctct

SEQ ID NO: 672344 - DNA, 20 bp, Artificial
  CRISPR gRNA sequence
aattgtttctcttgccctgt

SEQ ID NO: 672345 - DNA, 20 bp, Artificial
  CRISPR gRNA sequence
tttctcttgccctgttcaga

SEQ ID NO: 672346 - DNA, 20 bp, Artificial
  CRISPR gRNA sequence
ctcttgccctgttcagaagc

SEQ ID NO: 672347 - DNA, 20 bp, Artificial
  CRISPR gRNA sequence
tcttgccctgttcagaagca

SEQ ID NO: 672348 - DNA, 20 bp, Artificial
  CRISPR gRNA sequence
ttgccctgttcagaagcagg

SEQ ID NO: 672349 - DNA, 20 bp, Artificial
  CRISPR gRNA sequence
gccctgttcagaagcaggtt

SEQ ID NO: 672350 - DNA, 20 bp, Artificial
  CRISPR gRNA sequence
ccctgttcagaagcaggttt

SEQ ID NO: 672351 - DNA, 20 bp, Artificial
  CRISPR gRNA sequence
ttcagaagcaggtttataca

SEQ ID NO: 672352 - DNA, 20 bp, Artificial
  CRISPR gRNA sequence
agaagcaggtttatacaagt

SEQ ID NO: 672353 - DNA, 20 bp, Artificial
  CRISPR gRNA sequence
atacaagtactctgatgtga

SEQ ID NO: 672354 - DNA, 20 bp, Artificial
  CRISPR gRNA sequence
tacaagtactctgatgtgaa

SEQ ID NO: 672355 - DNA, 20 bp, Artificial
  CRISPR gRNA sequence
tgatgtgaaacagagaatat

SEQ ID NO: 672356 - DNA, 20 bp, Artificial
  CRISPR gRNA sequence
atgtgaaacagagaatatga

SEQ ID NO: 672357 - DNA, 20 bp, Artificial
  CRISPR gRNA sequence
aattaagaggaggcatagtt

SEQ ID NO: 672358 - DNA, 20 bp, Artificial
  CRISPR gRNA sequence
agaggaggcatagttcagtg

SEQ ID NO: 672359 - DNA, 20 bp, Artificial
  CRISPR gRNA sequence
agtgtgttaagcaatattta

SEQ ID NO: 672360 - DNA, 20 bp, Artificial
  CRISPR gRNA sequence
agcaatatttaatcttgttt

SEQ ID NO: 672361 - DNA, 20 bp, Artificial
  CRISPR gRNA sequence
aatcttgtttcttccataat

SEQ ID NO: 672362 - DNA, 20 bp, Artificial
  CRISPR gRNA sequence
atcttgtttcttccataatc

SEQ ID NO: 672363 - DNA, 20 bp, Artificial
  CRISPR gRNA sequence
gtttcttccataatcctatc

SEQ ID NO: 672364 - DNA, 20 bp, Artificial
  CRISPR gRNA sequence
tttcttccataatcctatct

SEQ ID NO: 672365 - DNA, 20 bp, Artificial
  CRISPR gRNA sequence
cttccataatcctatctcag

SEQ ID NO: 672366 - DNA, 20 bp, Artificial
  CRISPR gRNA sequence
ttccataatcctatctcagt

SEQ ID NO: 672367 - DNA, 20 bp, Artificial
  CRISPR gRNA sequence
ccataatcctatctcagtcc

SEQ ID NO: 672368 - DNA, 20 bp, Artificial
  CRISPR gRNA sequence
cataatcctatctcagtcct

SEQ ID NO: 672369 - DNA, 20 bp, Artificial
  CRISPR gRNA sequence
tctcagtcctaggagtctta

SEQ ID NO: 672370 - DNA, 20 bp, Artificial
  CRISPR gRNA sequence
agtcctaggagtcttagtga

SEQ ID NO: 672371 - DNA, 20 bp, Artificial
  CRISPR gRNA sequence
ggagtcttagtgacagactc

SEQ ID NO: 672372 - DNA, 20 bp, Artificial
  CRISPR gRNA sequence
agtgacagactcaaaagcca

SEQ ID NO: 672373 - DNA, 20 bp, Artificial
  CRISPR gRNA sequence
gtgacagactcaaaagccaa

SEQ ID NO: 672374 - DNA, 20 bp, Artificial
  CRISPR gRNA sequence
aaaagccaataccaggatta

SEQ ID NO: 672375 - DNA, 20 bp, Artificial
  CRISPR gRNA sequence
ttaaaaaaacttgtttaaaa

SEQ ID NO: 672376 - DNA, 20 bp, Artificial
  CRISPR gRNA sequence
aaaaaacttgtttaaaaagc

SEQ ID NO: 672377 - DNA, 20 bp, Artificial
  CRISPR gRNA sequence
gtttaaaaagcaaatgtcta

SEQ ID NO: 672378 - DNA, 20 bp, Artificial
  CRISPR gRNA sequence
tttaaaaagcaaatgtctaa

SEQ ID NO: 672379 - DNA, 20 bp, Artificial
  CRISPR gRNA sequence
aaaaagcaaatgtctaagtg

SEQ ID NO: 672380 - DNA, 20 bp, Artificial
  CRISPR gRNA sequence
aaaagcaaatgtctaagtga

SEQ ID NO: 672381 - DNA, 20 bp, Artificial
  CRISPR gRNA sequence
agtgaaagaaacaaatatgt

SEQ ID NO: 672382 - DNA, 20 bp, Artificial
  CRISPR gRNA sequence
tgtttacctagagttttcct

SEQ ID NO: 672383 - DNA, 20 bp, Artificial
  CRISPR gRNA sequence
tttacctagagttttcctga

SEQ ID NO: 672384 - DNA, 20 bp, Artificial
  CRISPR gRNA sequence
acctagagttttcctgagct

SEQ ID NO: 672385 - DNA, 20 bp, Artificial
  CRISPR gRNA sequence
cctagagttttcctgagcta

SEQ ID NO: 672386 - DNA, 20 bp, Artificial
  CRISPR gRNA sequence
gagttttcctgagctatctt

SEQ ID NO: 672387 - DNA, 20 bp, Artificial
  CRISPR gRNA sequence
tcctgagctatcttcacttc

SEQ ID NO: 672388 - DNA, 20 bp, Artificial
  CRISPR gRNA sequence
cctgagctatcttcacttcc

SEQ ID NO: 672389 - DNA, 20 bp, Artificial
  CRISPR gRNA sequence
ctgagctatcttcacttcca

SEQ ID NO: 672390 - DNA, 20 bp, Artificial
  CRISPR gRNA sequence
agctatcttcacttccatga

SEQ ID NO: 672391 - DNA, 20 bp, Artificial
  CRISPR gRNA sequence
tcttcacttccatgacattt

SEQ ID NO: 672392 - DNA, 20 bp, Artificial
  CRISPR gRNA sequence
cacttccatgacatttcact

SEQ ID NO: 672393 - DNA, 20 bp, Artificial
  CRISPR gRNA sequence
acttccatgacatttcacta

SEQ ID NO: 672394 - DNA, 20 bp, Artificial
  CRISPR gRNA sequence
ccatgacatttcactaaaat

SEQ ID NO: 672395 - DNA, 20 bp, Artificial
  CRISPR gRNA sequence
catgacatttcactaaaata

SEQ ID NO: 672396 - DNA, 20 bp, Artificial
  CRISPR gRNA sequence
cactaaaatatcatagaaca

SEQ ID NO: 672397 - DNA, 20 bp, Artificial
  CRISPR gRNA sequence
actaaaatatcatagaacac

SEQ ID NO: 672398 - DNA, 20 bp, Artificial
  CRISPR gRNA sequence
aaatatcatagaacacagta

SEQ ID NO: 672399 - DNA, 20 bp, Artificial
  CRISPR gRNA sequence
acatggcattcgatgatgaa

SEQ ID NO: 672400 - DNA, 20 bp, Artificial
  CRISPR gRNA sequence
gatgatgaactctattctac

SEQ ID NO: 672401 - DNA, 20 bp, Artificial
  CRISPR gRNA sequence
tattctactttatatatcat

SEQ ID NO: 672402 - DNA, 20 bp, Artificial
  CRISPR gRNA sequence
ttctactttatatatcattt

SEQ ID NO: 672403 - DNA, 20 bp, Artificial
  CRISPR gRNA sequence
tactttatatatcattttca

SEQ ID NO: 672404 - DNA, 20 bp, Artificial
  CRISPR gRNA sequence
ctttatatatcattttcatc

SEQ ID NO: 672405 - DNA, 20 bp, Artificial
  CRISPR gRNA sequence
tatatatcattttcatccat

SEQ ID NO: 672406 - DNA, 20 bp, Artificial
  CRISPR gRNA sequence
atatatcattttcatccatt

SEQ ID NO: 672407 - DNA, 20 bp, Artificial
  CRISPR gRNA sequence
tatatcattttcatccattt

SEQ ID NO: 672408 - DNA, 20 bp, Artificial
  CRISPR gRNA sequence
tcatccatttagtaggatga

SEQ ID NO: 672409 - DNA, 20 bp, Artificial
  CRISPR gRNA sequence
catccatttagtaggatgac

SEQ ID NO: 672410 - DNA, 20 bp, Artificial
  CRISPR gRNA sequence
atccatttagtaggatgaca

SEQ ID NO: 672411 - DNA, 20 bp, Artificial
  CRISPR gRNA sequence
agtaggatgacaatgagtag

SEQ ID NO: 672412 - DNA, 20 bp, Artificial
  CRISPR gRNA sequence
gtaggatgacaatgagtaga

SEQ ID NO: 672413 - DNA, 20 bp, Artificial
  CRISPR gRNA sequence
aaaatttattttcttctttt

SEQ ID NO: 672414 - DNA, 20 bp, Artificial
  CRISPR gRNA sequence
aaatttattttcttcttttc

SEQ ID NO: 672415 - DNA, 20 bp, Artificial
  CRISPR gRNA sequence
attttcttcttttcaaatta

SEQ ID NO: 672416 - DNA, 20 bp, Artificial
  CRISPR gRNA sequence
ttttcttcttttcaaattac

SEQ ID NO: 672417 - DNA, 20 bp, Artificial
  CRISPR gRNA sequence
tcttcttttcaaattacagc

SEQ ID NO: 672418 - DNA, 20 bp, Artificial
  CRISPR gRNA sequence
cttcttttcaaattacagca

SEQ ID NO: 672419 - DNA, 20 bp, Artificial
  CRISPR gRNA sequence
ttcttttcaaattacagcaa

SEQ ID NO: 672420 - DNA, 20 bp, Artificial
  CRISPR gRNA sequence
cttttcaaattacagcaaat

SEQ ID NO: 672421 - DNA, 20 bp, Artificial
  CRISPR gRNA sequence
ttttcaaattacagcaaatt

SEQ ID NO: 672422 - DNA, 20 bp, Artificial
  CRISPR gRNA sequence
ttcaaattacagcaaattca

SEQ ID NO: 672423 - DNA, 20 bp, Artificial
  CRISPR gRNA sequence
tcaaattacagcaaattcag

SEQ ID NO: 672424 - DNA, 20 bp, Artificial
  CRISPR gRNA sequence
caaattacagcaaattcagt

SEQ ID NO: 672425 - DNA, 20 bp, Artificial
  CRISPR gRNA sequence
aaattacagcaaattcagta

SEQ ID NO: 672426 - DNA, 20 bp, Artificial
  CRISPR gRNA sequence
cagcaaattcagtaaagcta

SEQ ID NO: 672427 - DNA, 20 bp, Artificial
  CRISPR gRNA sequence
agtaaagctagaaatgcaga

SEQ ID NO: 672428 - DNA, 20 bp, Artificial
  CRISPR gRNA sequence
gaaatgcagagtgatgaaga

SEQ ID NO: 672429 - DNA, 20 bp, Artificial
  CRISPR gRNA sequence
agccgtgaagatgagatcag

SEQ ID NO: 672430 - DNA, 20 bp, Artificial
  CRISPR gRNA sequence
gaagaacccctaattgagag

SEQ ID NO: 672431 - DNA, 20 bp, Artificial
  CRISPR gRNA sequence
attgagagcagcgaggtggc

SEQ ID NO: 672432 - DNA, 20 bp, Artificial
  CRISPR gRNA sequence
agagcagcgaggtggctgac

SEQ ID NO: 672433 - DNA, 20 bp, Artificial
  CRISPR gRNA sequence
acaacaggaaagtccaggag

SEQ ID NO: 672434 - DNA, 20 bp, Artificial
  CRISPR gRNA sequence
caaggcgagggaggaatccg

SEQ ID NO: 672435 - DNA, 20 bp, Artificial
  CRISPR gRNA sequence
aaggcgagggaggaatccgg

SEQ ID NO: 672436 - DNA, 20 bp, Artificial
  CRISPR gRNA sequence
ccgaatggtaaactgaaatg

SEQ ID NO: 672437 - DNA, 20 bp, Artificial
  CRISPR gRNA sequence
cgaatggtaaactgaaatgt

SEQ ID NO: 672438 - DNA, 20 bp, Artificial
  CRISPR gRNA sequence
aaatgtgacgtctgtggcat

SEQ ID NO: 672439 - DNA, 20 bp, Artificial
  CRISPR gRNA sequence
tggcatggtttgcattgggc

SEQ ID NO: 672440 - DNA, 20 bp, Artificial
  CRISPR gRNA sequence
gcattgggcccaatgtgctt

SEQ ID NO: 672441 - DNA, 20 bp, Artificial
  CRISPR gRNA sequence
cattgggcccaatgtgctta

SEQ ID NO: 672442 - DNA, 20 bp, Artificial
  CRISPR gRNA sequence
ggcccaatgtgcttatggta

SEQ ID NO: 672443 - DNA, 20 bp, Artificial
  CRISPR gRNA sequence
atggtacataaaaggagtca

SEQ ID NO: 672444 - DNA, 20 bp, Artificial
  CRISPR gRNA sequence
tggtacataaaaggagtcac

SEQ ID NO: 672445 - DNA, 20 bp, Artificial
  CRISPR gRNA sequence
gtaagcagctgaaagaataa

SEQ ID NO: 672446 - DNA, 20 bp, Artificial
  CRISPR gRNA sequence
aaagaataacctgatgactg

SEQ ID NO: 672447 - DNA, 20 bp, Artificial
  CRISPR gRNA sequence
atgactgcctgtgacatctg

SEQ ID NO: 672448 - DNA, 20 bp, Artificial
  CRISPR gRNA sequence
cctgtgacatctgatgttga

SEQ ID NO: 672449 - DNA, 20 bp, Artificial
  CRISPR gRNA sequence
tgacatctgatgttgatatt

SEQ ID NO: 672450 - DNA, 20 bp, Artificial
  CRISPR gRNA sequence
atgttgatattacctgacat

SEQ ID NO: 672451 - DNA, 20 bp, Artificial
  CRISPR gRNA sequence
atattacctgacatctattc

SEQ ID NO: 672452 - DNA, 20 bp, Artificial
  CRISPR gRNA sequence
cctgacatctattctctttc

SEQ ID NO: 672453 - DNA, 20 bp, Artificial
  CRISPR gRNA sequence
acatctattctctttccttt

SEQ ID NO: 672454 - DNA, 20 bp, Artificial
  CRISPR gRNA sequence
ttctctttcctttttattca

SEQ ID NO: 672455 - DNA, 20 bp, Artificial
  CRISPR gRNA sequence
tctttcctttttattcaggg

SEQ ID NO: 672456 - DNA, 20 bp, Artificial
  CRISPR gRNA sequence
tttcctttttattcaggggt

SEQ ID NO: 672457 - DNA, 20 bp, Artificial
  CRISPR gRNA sequence
tcctttttattcaggggtgg

SEQ ID NO: 672458 - DNA, 20 bp, Artificial
  CRISPR gRNA sequence
cctttttattcaggggtggc

SEQ ID NO: 672459 - DNA, 20 bp, Artificial
  CRISPR gRNA sequence
ctttttattcaggggtggca

SEQ ID NO: 672460 - DNA, 20 bp, Artificial
  CRISPR gRNA sequence
tttattcaggggtggcagtg

SEQ ID NO: 672461 - DNA, 20 bp, Artificial
  CRISPR gRNA sequence
ttattcaggggtggcagtgg

SEQ ID NO: 672462 - DNA, 20 bp, Artificial
  CRISPR gRNA sequence
tattcaggggtggcagtggt

SEQ ID NO: 672463 - DNA, 20 bp, Artificial
  CRISPR gRNA sequence
attcaggggtggcagtggtg

SEQ ID NO: 672464 - DNA, 20 bp, Artificial
  CRISPR gRNA sequence
ttcaggggtggcagtggtga

SEQ ID NO: 672465 - DNA, 20 bp, Artificial
  CRISPR gRNA sequence
aggggtggcagtggtgaaaa

SEQ ID NO: 672466 - DNA, 20 bp, Artificial
  CRISPR gRNA sequence
ccttttcagaattctgctag

SEQ ID NO: 672467 - DNA, 20 bp, Artificial
  CRISPR gRNA sequence
ttcagaattctgctagtatt

SEQ ID NO: 672468 - DNA, 20 bp, Artificial
  CRISPR gRNA sequence
tcagaattctgctagtattg

SEQ ID NO: 672469 - DNA, 20 bp, Artificial
  CRISPR gRNA sequence
cagaattctgctagtattgg

SEQ ID NO: 672470 - DNA, 20 bp, Artificial
  CRISPR gRNA sequence
agaattctgctagtattgga

SEQ ID NO: 672471 - DNA, 20 bp, Artificial
  CRISPR gRNA sequence
tgctagtattggattgcaga

SEQ ID NO: 672472 - DNA, 20 bp, Artificial
  CRISPR gRNA sequence
ctagtattggattgcagaaa

SEQ ID NO: 672473 - DNA, 20 bp, Artificial
  CRISPR gRNA sequence
gtattggattgcagaaaaac

SEQ ID NO: 672474 - DNA, 20 bp, Artificial
  CRISPR gRNA sequence
gattgcagaaaaacagagag

SEQ ID NO: 672475 - DNA, 20 bp, Artificial
  CRISPR gRNA sequence
cagaaaaacagagagtagcc

SEQ ID NO: 672476 - DNA, 20 bp, Artificial
  CRISPR gRNA sequence
ggtcttgacttccagccttc

SEQ ID NO: 672477 - DNA, 20 bp, Artificial
  CRISPR gRNA sequence
gacttccagccttcaaatct

SEQ ID NO: 672478 - DNA, 20 bp, Artificial
  CRISPR gRNA sequence
acttccagccttcaaatctg

SEQ ID NO: 672479 - DNA, 20 bp, Artificial
  CRISPR gRNA sequence
ccagccttcaaatctgaata

SEQ ID NO: 672480 - DNA, 20 bp, Artificial
  CRISPR gRNA sequence
cagccttcaaatctgaatag

SEQ ID NO: 672481 - DNA, 20 bp, Artificial
  CRISPR gRNA sequence
caaatctgaatagcatatca

SEQ ID NO: 672482 - DNA, 20 bp, Artificial
  CRISPR gRNA sequence
aaatctgaatagcatatcag

SEQ ID NO: 672483 - DNA, 20 bp, Artificial
  CRISPR gRNA sequence
aatagcatatcagaaaagaa

SEQ ID NO: 672484 - DNA, 20 bp, Artificial
  CRISPR gRNA sequence
gggattcagtttccacagtt

SEQ ID NO: 672485 - DNA, 20 bp, Artificial
  CRISPR gRNA sequence
ggattcagtttccacagttc

SEQ ID NO: 672486 - DNA, 20 bp, Artificial
  CRISPR gRNA sequence
agtttccacagttcttaata

SEQ ID NO: 672487 - DNA, 20 bp, Artificial
  CRISPR gRNA sequence
ccacagttcttaatatagca

SEQ ID NO: 672488 - DNA, 20 bp, Artificial
  CRISPR gRNA sequence
cacagttcttaatatagcaa

SEQ ID NO: 672489 - DNA, 20 bp, Artificial
  CRISPR gRNA sequence
ttaatatagcaataatatga

SEQ ID NO: 672490 - DNA, 20 bp, Artificial
  CRISPR gRNA sequence
aatatagcaataatatgata

SEQ ID NO: 672491 - DNA, 20 bp, Artificial
  CRISPR gRNA sequence
atatagcaataatatgataa

SEQ ID NO: 672492 - DNA, 20 bp, Artificial
  CRISPR gRNA sequence
aaaaggtataggagaatttc

SEQ ID NO: 672493 - DNA, 20 bp, Artificial
  CRISPR gRNA sequence
cattgtgtaacttaatcttt

SEQ ID NO: 672494 - DNA, 20 bp, Artificial
  CRISPR gRNA sequence
attgtgtaacttaatctttt

SEQ ID NO: 672495 - DNA, 20 bp, Artificial
  CRISPR gRNA sequence
tgtaacttaatctttttgta

SEQ ID NO: 672496 - DNA, 20 bp, Artificial
  CRISPR gRNA sequence
aatctttttgtatttctata

SEQ ID NO: 672497 - DNA, 20 bp, Artificial
  CRISPR gRNA sequence
atctttttgtatttctatac

SEQ ID NO: 672498 - DNA, 20 bp, Artificial
  CRISPR gRNA sequence
tttgtatttctatacatatt

SEQ ID NO: 672499 - DNA, 20 bp, Artificial
  CRISPR gRNA sequence
ttgtatttctatacatattt

SEQ ID NO: 672500 - DNA, 20 bp, Artificial
  CRISPR gRNA sequence
tgtatttctatacatatttt

SEQ ID NO: 672501 - DNA, 20 bp, Artificial
  CRISPR gRNA sequence
gtatttctatacatatttta

SEQ ID NO: 672502 - DNA, 20 bp, Artificial
  CRISPR gRNA sequence
tatttctatacatattttac

SEQ ID NO: 672503 - DNA, 20 bp, Artificial
  CRISPR gRNA sequence
ctatacatattttaccatac

SEQ ID NO: 672504 - DNA, 20 bp, Artificial
  CRISPR gRNA sequence
tatacatattttaccatacc

SEQ ID NO: 672505 - DNA, 20 bp, Artificial
  CRISPR gRNA sequence
tacatattttaccataccca

SEQ ID NO: 672506 - DNA, 20 bp, Artificial
  CRISPR gRNA sequence
taccatacccatgggcaggt

SEQ ID NO: 672507 - DNA, 20 bp, Artificial
  CRISPR gRNA sequence
accatacccatgggcaggta

SEQ ID NO: 672508 - DNA, 20 bp, Artificial
  CRISPR gRNA sequence
ccatacccatgggcaggtaa

SEQ ID NO: 672509 - DNA, 20 bp, Artificial
  CRISPR gRNA sequence
gctagataagagtttatact

SEQ ID NO: 672510 - DNA, 20 bp, Artificial
  CRISPR gRNA sequence
ctagataagagtttatacta

SEQ ID NO: 672511 - DNA, 20 bp, Artificial
  CRISPR gRNA sequence
gataagagtttatactacaa

SEQ ID NO: 672512 - DNA, 20 bp, Artificial
  CRISPR gRNA sequence
atactacaaaatggcactca

SEQ ID NO: 672513 - DNA, 20 bp, Artificial
  CRISPR gRNA sequence
tactacaaaatggcactcat

SEQ ID NO: 672514 - DNA, 20 bp, Artificial
  CRISPR gRNA sequence
caaaatggcactcatgcatt

SEQ ID NO: 672515 - DNA, 20 bp, Artificial
  CRISPR gRNA sequence
atgcatttatgtaagtgaat

SEQ ID NO: 672516 - DNA, 20 bp, Artificial
  CRISPR gRNA sequence
atgtaagtgaataattttca

SEQ ID NO: 672517 - DNA, 20 bp, Artificial
  CRISPR gRNA sequence
tgtaagtgaataattttcac

SEQ ID NO: 672518 - DNA, 20 bp, Artificial
  CRISPR gRNA sequence
tcactttatccagttaactc

SEQ ID NO: 672519 - DNA, 20 bp, Artificial
  CRISPR gRNA sequence
cactttatccagttaactcc

SEQ ID NO: 672520 - DNA, 20 bp, Artificial
  CRISPR gRNA sequence
actttatccagttaactcct

SEQ ID NO: 672521 - DNA, 20 bp, Artificial
  CRISPR gRNA sequence
tatccagttaactccttgaa

SEQ ID NO: 672522 - DNA, 20 bp, Artificial
  CRISPR gRNA sequence
atccagttaactccttgaaa

SEQ ID NO: 672523 - DNA, 20 bp, Artificial
  CRISPR gRNA sequence
tccagttaactccttgaaat

SEQ ID NO: 672524 - DNA, 20 bp, Artificial
  CRISPR gRNA sequence
actccttgaaatacaatttc

SEQ ID NO: 672525 - DNA, 20 bp, Artificial
  CRISPR gRNA sequence
cttgaaatacaatttctgat

SEQ ID NO: 672526 - DNA, 20 bp, Artificial
  CRISPR gRNA sequence
gaaatacaatttctgattga

SEQ ID NO: 672527 - DNA, 20 bp, Artificial
  CRISPR gRNA sequence
aaatacaatttctgattgat

SEQ ID NO: 672528 - DNA, 20 bp, Artificial
  CRISPR gRNA sequence
ctgattgatctctgcctatc

SEQ ID NO: 672529 - DNA, 20 bp, Artificial
  CRISPR gRNA sequence
tgattgatctctgcctatcc

SEQ ID NO: 672530 - DNA, 20 bp, Artificial
  CRISPR gRNA sequence
attgatctctgcctatccta

SEQ ID NO: 672531 - DNA, 20 bp, Artificial
  CRISPR gRNA sequence
atctctgcctatcctaccac

SEQ ID NO: 672532 - DNA, 20 bp, Artificial
  CRISPR gRNA sequence
tgcctatcctaccacaggtc

SEQ ID NO: 672533 - DNA, 20 bp, Artificial
  CRISPR gRNA sequence
cctatcctaccacaggtctc

SEQ ID NO: 672534 - DNA, 20 bp, Artificial
  CRISPR gRNA sequence
tcctaccacaggtctcagta

SEQ ID NO: 672535 - DNA, 20 bp, Artificial
  CRISPR gRNA sequence
ccacaggtctcagtagcagg

SEQ ID NO: 672536 - DNA, 20 bp, Artificial
  CRISPR gRNA sequence
agtagcaggcaggtgctttt

SEQ ID NO: 672537 - DNA, 20 bp, Artificial
  CRISPR gRNA sequence
ttgtagttcagggatgctgc

SEQ ID NO: 672538 - DNA, 20 bp, Artificial
  CRISPR gRNA sequence
tgtagttcagggatgctgcc

SEQ ID NO: 672539 - DNA, 20 bp, Artificial
  CRISPR gRNA sequence
gtagttcagggatgctgcca

SEQ ID NO: 672540 - DNA, 20 bp, Artificial
  CRISPR gRNA sequence
tagttcagggatgctgccat

SEQ ID NO: 672541 - DNA, 20 bp, Artificial
  CRISPR gRNA sequence
agggatgctgccatctttct

SEQ ID NO: 672542 - DNA, 20 bp, Artificial
  CRISPR gRNA sequence
ccatctttctgtaattgttg

SEQ ID NO: 672543 - DNA, 20 bp, Artificial
  CRISPR gRNA sequence
tctgtaattgttggttataa

SEQ ID NO: 672544 - DNA, 20 bp, Artificial
  CRISPR gRNA sequence
ctgtaattgttggttataac

SEQ ID NO: 672545 - DNA, 20 bp, Artificial
  CRISPR gRNA sequence
tgtaattgttggttataact

SEQ ID NO: 672546 - DNA, 20 bp, Artificial
  CRISPR gRNA sequence
taattgttggttataactcc

SEQ ID NO: 672547 - DNA, 20 bp, Artificial
  CRISPR gRNA sequence
ttggttataactcctgcaag

SEQ ID NO: 672548 - DNA, 20 bp, Artificial
  CRISPR gRNA sequence
gttataactcctgcaaggat

SEQ ID NO: 672549 - DNA, 20 bp, Artificial
  CRISPR gRNA sequence
taactcctgcaaggatatat

SEQ ID NO: 672550 - DNA, 20 bp, Artificial
  CRISPR gRNA sequence
ctgcaaggatatatgtagga

SEQ ID NO: 672551 - DNA, 20 bp, Artificial
  CRISPR gRNA sequence
caaggatatatgtaggattg

SEQ ID NO: 672552 - DNA, 20 bp, Artificial
  CRISPR gRNA sequence
aatatgacaaatagtggctg

SEQ ID NO: 672553 - DNA, 20 bp, Artificial
  CRISPR gRNA sequence
gtgtgtaggttggaatatgt

SEQ ID NO: 672554 - DNA, 20 bp, Artificial
  CRISPR gRNA sequence
gaatatgtaattctgggata

SEQ ID NO: 672555 - DNA, 20 bp, Artificial
  CRISPR gRNA sequence
tgggatagagtgaggaaaaa

SEQ ID NO: 672556 - DNA, 20 bp, Artificial
  CRISPR gRNA sequence
ggatagagtgaggaaaaagc

SEQ ID NO: 672557 - DNA, 20 bp, Artificial
  CRISPR gRNA sequence
attcatactatatttttaaa

SEQ ID NO: 672558 - DNA, 20 bp, Artificial
  CRISPR gRNA sequence
atactatatttttaaacatt

SEQ ID NO: 672559 - DNA, 20 bp, Artificial
  CRISPR gRNA sequence
tatttttaaacatttgagag

SEQ ID NO: 672560 - DNA, 20 bp, Artificial
  CRISPR gRNA sequence
ttaaacatttgagaggtgaa

SEQ ID NO: 672561 - DNA, 20 bp, Artificial
  CRISPR gRNA sequence
taaacatttgagaggtgaaa

SEQ ID NO: 672562 - DNA, 20 bp, Artificial
  CRISPR gRNA sequence
aaacatttgagaggtgaaaa

SEQ ID NO: 672563 - DNA, 20 bp, Artificial
  CRISPR gRNA sequence
aacatttgagaggtgaaaag

SEQ ID NO: 672564 - DNA, 20 bp, Artificial
  CRISPR gRNA sequence
gagaggtgaaaagttttttg

SEQ ID NO: 672565 - DNA, 20 bp, Artificial
  CRISPR gRNA sequence
agaggtgaaaagttttttgt

SEQ ID NO: 672566 - DNA, 20 bp, Artificial
  CRISPR gRNA sequence
tttgtgaaaactaaccaaat

SEQ ID NO: 672567 - DNA, 20 bp, Artificial
  CRISPR gRNA sequence
ttgtgaaaactaaccaaatg

SEQ ID NO: 672568 - DNA, 20 bp, Artificial
  CRISPR gRNA sequence
tgtgaaaactaaccaaatga

SEQ ID NO: 672569 - DNA, 20 bp, Artificial
  CRISPR gRNA sequence
gtgaaaactaaccaaatgag

SEQ ID NO: 672570 - DNA, 20 bp, Artificial
  CRISPR gRNA sequence
tgaaaactaaccaaatgaga

SEQ ID NO: 672571 - DNA, 20 bp, Artificial
  CRISPR gRNA sequence
accaaatgagaaggtcttat

SEQ ID NO: 672572 - DNA, 20 bp, Artificial
  CRISPR gRNA sequence
atttaaatctttttaaaccc

SEQ ID NO: 672573 - DNA, 20 bp, Artificial
  CRISPR gRNA sequence
tttaaatctttttaaaccct

SEQ ID NO: 672574 - DNA, 20 bp, Artificial
  CRISPR gRNA sequence
aaatctttttaaaccctttg

SEQ ID NO: 672575 - DNA, 20 bp, Artificial
  CRISPR gRNA sequence
aatctttttaaaccctttgc

SEQ ID NO: 672576 - DNA, 20 bp, Artificial
  CRISPR gRNA sequence
tttaaaccctttgccaattt

SEQ ID NO: 672577 - DNA, 20 bp, Artificial
  CRISPR gRNA sequence
ttaaaccctttgccaatttt

SEQ ID NO: 672578 - DNA, 20 bp, Artificial
  CRISPR gRNA sequence
taaaccctttgccaattttt

SEQ ID NO: 672579 - DNA, 20 bp, Artificial
  CRISPR gRNA sequence
aaaccctttgccaatttttt

SEQ ID NO: 672580 - DNA, 20 bp, Artificial
  CRISPR gRNA sequence
aaccctttgccaattttttt

SEQ ID NO: 672581 - DNA, 20 bp, Artificial
  CRISPR gRNA sequence
tgccaatttttttttcttaa

SEQ ID NO: 672582 - DNA, 20 bp, Artificial
  CRISPR gRNA sequence
gccaatttttttttcttaaa

SEQ ID NO: 672583 - DNA, 20 bp, Artificial
  CRISPR gRNA sequence
ccaatttttttttcttaaaa

SEQ ID NO: 672584 - DNA, 20 bp, Artificial
  CRISPR gRNA sequence
ttttttcttaaaaagcaaca

SEQ ID NO: 672585 - DNA, 20 bp, Artificial
  CRISPR gRNA sequence
tttttcttaaaaagcaacag

SEQ ID NO: 672586 - DNA, 20 bp, Artificial
  CRISPR gRNA sequence
ttttcttaaaaagcaacaga

SEQ ID NO: 672587 - DNA, 20 bp, Artificial
  CRISPR gRNA sequence
tttcttaaaaagcaacagaa

SEQ ID NO: 672588 - DNA, 20 bp, Artificial
  CRISPR gRNA sequence
ttcttaaaaagcaacagaaa

SEQ ID NO: 672589 - DNA, 20 bp, Artificial
  CRISPR gRNA sequence
tcttaaaaagcaacagaaat

SEQ ID NO: 672590 - DNA, 20 bp, Artificial
  CRISPR gRNA sequence
cttaaaaagcaacagaaatg

SEQ ID NO: 672591 - DNA, 20 bp, Artificial
  CRISPR gRNA sequence
ttaaaaagcaacagaaatga

SEQ ID NO: 672592 - DNA, 20 bp, Artificial
  CRISPR gRNA sequence
aaaaagcaacagaaatgaga

SEQ ID NO: 672593 - DNA, 20 bp, Artificial
  CRISPR gRNA sequence
aaaagcaacagaaatgagat

SEQ ID NO: 672594 - DNA, 20 bp, Artificial
  CRISPR gRNA sequence
ggaggatcgttgactcttaa

SEQ ID NO: 672595 - DNA, 20 bp, Artificial
  CRISPR gRNA sequence
actcttaacaaaaaagattc

SEQ ID NO: 672596 - DNA, 20 bp, Artificial
  CRISPR gRNA sequence
ttaacaaaaaagattcaagt

SEQ ID NO: 672597 - DNA, 20 bp, Artificial
  CRISPR gRNA sequence
aacaaaaaagattcaagttc

SEQ ID NO: 672598 - DNA, 20 bp, Artificial
  CRISPR gRNA sequence
acaaaaaagattcaagttca

SEQ ID NO: 672599 - DNA, 20 bp, Artificial
  CRISPR gRNA sequence
aagttcatatgaaaattggt

SEQ ID NO: 672600 - DNA, 20 bp, Artificial
  CRISPR gRNA sequence
atatgaaaattggtttaatg

SEQ ID NO: 672601 - DNA, 20 bp, Artificial
  CRISPR gRNA sequence
gtttaatggtaatgatggct

SEQ ID NO: 672602 - DNA, 20 bp, Artificial
  CRISPR gRNA sequence
aatggtaatgatggctttca

SEQ ID NO: 672603 - DNA, 20 bp, Artificial
  CRISPR gRNA sequence
atggtaatgatggctttcac

SEQ ID NO: 672604 - DNA, 20 bp, Artificial
  CRISPR gRNA sequence
tcactataatgcaaagtagt

SEQ ID NO: 672605 - DNA, 20 bp, Artificial
  CRISPR gRNA sequence
cactataatgcaaagtagtg

SEQ ID NO: 672606 - DNA, 20 bp, Artificial
  CRISPR gRNA sequence
actataatgcaaagtagtgt

SEQ ID NO: 672607 - DNA, 20 bp, Artificial
  CRISPR gRNA sequence
taatgcaaagtagtgtagtg

SEQ ID NO: 672608 - DNA, 20 bp, Artificial
  CRISPR gRNA sequence
ataactaatattctcagagt

SEQ ID NO: 672609 - DNA, 20 bp, Artificial
  CRISPR gRNA sequence
atattctcagagttttaaaa

SEQ ID NO: 672610 - DNA, 20 bp, Artificial
  CRISPR gRNA sequence
tcagagttttaaaatatact

SEQ ID NO: 672611 - DNA, 20 bp, Artificial
  CRISPR gRNA sequence
agagttttaaaatatacttt

SEQ ID NO: 672612 - DNA, 20 bp, Artificial
  CRISPR gRNA sequence
taaaatatacttttttggaa

SEQ ID NO: 672613 - DNA, 20 bp, Artificial
  CRISPR gRNA sequence
aaaatatacttttttggaag

SEQ ID NO: 672614 - DNA, 20 bp, Artificial
  CRISPR gRNA sequence
aaatatacttttttggaaga

SEQ ID NO: 672615 - DNA, 20 bp, Artificial
  CRISPR gRNA sequence
ttttggaagaaatataaatc

SEQ ID NO: 672616 - DNA, 20 bp, Artificial
  CRISPR gRNA sequence
tttggaagaaatataaatca

SEQ ID NO: 672617 - DNA, 20 bp, Artificial
  CRISPR gRNA sequence
ttggaagaaatataaatcac

SEQ ID NO: 672618 - DNA, 20 bp, Artificial
  CRISPR gRNA sequence
tggaagaaatataaatcaca

SEQ ID NO: 672619 - DNA, 20 bp, Artificial
  CRISPR gRNA sequence
ggaagaaatataaatcacaa

SEQ ID NO: 672620 - DNA, 20 bp, Artificial
  CRISPR gRNA sequence
gaagaaatataaatcacaat

SEQ ID NO: 672621 - DNA, 20 bp, Artificial
  CRISPR gRNA sequence
atttaaaagttttatttcta

SEQ ID NO: 672622 - DNA, 20 bp, Artificial
  CRISPR gRNA sequence
tttaaaagttttatttctaa

SEQ ID NO: 672623 - DNA, 20 bp, Artificial
  CRISPR gRNA sequence
aaaagttttatttctaaata

SEQ ID NO: 672624 - DNA, 20 bp, Artificial
  CRISPR gRNA sequence
aaagttttatttctaaatag

SEQ ID NO: 672625 - DNA, 20 bp, Artificial
  CRISPR gRNA sequence
tatttctaaatagtttaaca

SEQ ID NO: 672626 - DNA, 20 bp, Artificial
  CRISPR gRNA sequence
atttctaaatagtttaacaa

SEQ ID NO: 672627 - DNA, 20 bp, Artificial
  CRISPR gRNA sequence
tttctaaatagtttaacaat

SEQ ID NO: 672628 - DNA, 20 bp, Artificial
  CRISPR gRNA sequence
ctaaatagtttaacaattac

SEQ ID NO: 672629 - DNA, 20 bp, Artificial
  CRISPR gRNA sequence
taaatagtttaacaattacg

SEQ ID NO: 672630 - DNA, 20 bp, Artificial
  CRISPR gRNA sequence
aatagtttaacaattacgtg

SEQ ID NO: 672631 - DNA, 20 bp, Artificial
  CRISPR gRNA sequence
aacaattacgtgcttaaaac

SEQ ID NO: 672632 - DNA, 20 bp, Artificial
  CRISPR gRNA sequence
acaattacgtgcttaaaaca

SEQ ID NO: 672633 - DNA, 20 bp, Artificial
  CRISPR gRNA sequence
cgtgcttaaaacattaaaga

SEQ ID NO: 672634 - DNA, 20 bp, Artificial
  CRISPR gRNA sequence
aaaacattaaagatacaagg

SEQ ID NO: 672635 - DNA, 20 bp, Artificial
  CRISPR gRNA sequence
aaacattaaagatacaaggt

SEQ ID NO: 672636 - DNA, 20 bp, Artificial
  CRISPR gRNA sequence
aagatacaaggtaggtcaaa

SEQ ID NO: 672637 - DNA, 20 bp, Artificial
  CRISPR gRNA sequence
ttttaatacgaacctttcat

SEQ ID NO: 672638 - DNA, 20 bp, Artificial
  CRISPR gRNA sequence
tttaatacgaacctttcata

SEQ ID NO: 672639 - DNA, 20 bp, Artificial
  CRISPR gRNA sequence
ttaatacgaacctttcataa

SEQ ID NO: 672640 - DNA, 20 bp, Artificial
  CRISPR gRNA sequence
taatacgaacctttcataat

SEQ ID NO: 672641 - DNA, 20 bp, Artificial
  CRISPR gRNA sequence
aatacgaacctttcataata

SEQ ID NO: 672642 - DNA, 20 bp, Artificial
  CRISPR gRNA sequence
atacgaacctttcataatac

SEQ ID NO: 672643 - DNA, 20 bp, Artificial
  CRISPR gRNA sequence
tcataatacacatgaagaaa

SEQ ID NO: 672644 - DNA, 20 bp, Artificial
  CRISPR gRNA sequence
cataatacacatgaagaaat

SEQ ID NO: 672645 - DNA, 20 bp, Artificial
  CRISPR gRNA sequence
ataatacacatgaagaaata

SEQ ID NO: 672646 - DNA, 20 bp, Artificial
  CRISPR gRNA sequence
gtccattatcccttatgtag

SEQ ID NO: 672647 - DNA, 20 bp, Artificial
  CRISPR gRNA sequence
tccattatcccttatgtagg

SEQ ID NO: 672648 - DNA, 20 bp, Artificial
  CRISPR gRNA sequence
tcccttatgtaggtaaaggc

SEQ ID NO: 672649 - DNA, 20 bp, Artificial
  CRISPR gRNA sequence
atgtaggtaaaggcattgct

SEQ ID NO: 672650 - DNA, 20 bp, Artificial
  CRISPR gRNA sequence
tgtaggtaaaggcattgctg

SEQ ID NO: 672651 - DNA, 20 bp, Artificial
  CRISPR gRNA sequence
ctgaagctagaaccagggtt

SEQ ID NO: 672652 - DNA, 20 bp, Artificial
  CRISPR gRNA sequence
aagctagaaccagggttttc

SEQ ID NO: 672653 - DNA, 20 bp, Artificial
  CRISPR gRNA sequence
gaaccagggttttctgatgc

SEQ ID NO: 672654 - DNA, 20 bp, Artificial
  CRISPR gRNA sequence
tctgatgcccatactggttt

SEQ ID NO: 672655 - DNA, 20 bp, Artificial
  CRISPR gRNA sequence
ctgatgcccatactggtttt

SEQ ID NO: 672656 - DNA, 20 bp, Artificial
  CRISPR gRNA sequence
tgatgcccatactggttttg

SEQ ID NO: 672657 - DNA, 20 bp, Artificial
  CRISPR gRNA sequence
atgcccatactggttttgtt

SEQ ID NO: 672658 - DNA, 20 bp, Artificial
  CRISPR gRNA sequence
gttttgttcagacacactat

SEQ ID NO: 672659 - DNA, 20 bp, Artificial
  CRISPR gRNA sequence
tgttcagacacactattgct

SEQ ID NO: 672660 - DNA, 20 bp, Artificial
  CRISPR gRNA sequence
gttcagacacactattgctt

SEQ ID NO: 672661 - DNA, 20 bp, Artificial
  CRISPR gRNA sequence
ttcagacacactattgcttg

SEQ ID NO: 672662 - DNA, 20 bp, Artificial
  CRISPR gRNA sequence
agacacactattgcttggta

SEQ ID NO: 672663 - DNA, 20 bp, Artificial
  CRISPR gRNA sequence
ttgcttggtatgtcagtata

SEQ ID NO: 672664 - DNA, 20 bp, Artificial
  CRISPR gRNA sequence
cttggtatgtcagtatacca

SEQ ID NO: 672665 - DNA, 20 bp, Artificial
  CRISPR gRNA sequence
ggtatgtcagtataccaaga

SEQ ID NO: 672666 - DNA, 20 bp, Artificial
  CRISPR gRNA sequence
gtatgtcagtataccaagaa

SEQ ID NO: 672667 - DNA, 20 bp, Artificial
  CRISPR gRNA sequence
attataaggtatgactgtaa

SEQ ID NO: 672668 - DNA, 20 bp, Artificial
  CRISPR gRNA sequence
ttataaggtatgactgtaaa

SEQ ID NO: 672669 - DNA, 20 bp, Artificial
  CRISPR gRNA sequence
taaggtatgactgtaaacta

SEQ ID NO: 672670 - DNA, 20 bp, Artificial
  CRISPR gRNA sequence
taaactaaggctgatatctt

SEQ ID NO: 672671 - DNA, 20 bp, Artificial
  CRISPR gRNA sequence
aggctgatatcttaaaaatt

SEQ ID NO: 672672 - DNA, 20 bp, Artificial
  CRISPR gRNA sequence
atatcttaaaaattacagtg

SEQ ID NO: 672673 - DNA, 20 bp, Artificial
  CRISPR gRNA sequence
aaaaattacagtgagaagtt

SEQ ID NO: 672674 - DNA, 20 bp, Artificial
  CRISPR gRNA sequence
aaaattacagtgagaagtta

SEQ ID NO: 672675 - DNA, 20 bp, Artificial
  CRISPR gRNA sequence
cagtgagaagttatacatta

SEQ ID NO: 672676 - DNA, 20 bp, Artificial
  CRISPR gRNA sequence
tacattaaaatcagtgttat

SEQ ID NO: 672677 - DNA, 20 bp, Artificial
  CRISPR gRNA sequence
aaatcagtgttatcataatc

SEQ ID NO: 672678 - DNA, 20 bp, Artificial
  CRISPR gRNA sequence
tcataatcaaaatcatcagc

SEQ ID NO: 672679 - DNA, 20 bp, Artificial
  CRISPR gRNA sequence
tagaacatatatacttattc

SEQ ID NO: 672680 - DNA, 20 bp, Artificial
  CRISPR gRNA sequence
agaacatatatacttattcc

SEQ ID NO: 672681 - DNA, 20 bp, Artificial
  CRISPR gRNA sequence
gaacatatatacttattcca

SEQ ID NO: 672682 - DNA, 20 bp, Artificial
  CRISPR gRNA sequence
attccaatcatacagtcaat

SEQ ID NO: 672683 - DNA, 20 bp, Artificial
  CRISPR gRNA sequence
ttccaatcatacagtcaatt

SEQ ID NO: 672684 - DNA, 20 bp, Artificial
  CRISPR gRNA sequence
caatcatacagtcaattaca

SEQ ID NO: 672685 - DNA, 20 bp, Artificial
  CRISPR gRNA sequence
cattttgctttttcgttttt

SEQ ID NO: 672686 - DNA, 20 bp, Artificial
  CRISPR gRNA sequence
tgctttttcgttttttatct

SEQ ID NO: 672687 - DNA, 20 bp, Artificial
  CRISPR gRNA sequence
gctttttcgttttttatctc

SEQ ID NO: 672688 - DNA, 20 bp, Artificial
  CRISPR gRNA sequence
ctttttcgttttttatctcc

SEQ ID NO: 672689 - DNA, 20 bp, Artificial
  CRISPR gRNA sequence
tttcgttttttatctccttt

SEQ ID NO: 672690 - DNA, 20 bp, Artificial
  CRISPR gRNA sequence
ttcgttttttatctcctttt

SEQ ID NO: 672691 - DNA, 20 bp, Artificial
  CRISPR gRNA sequence
tcgttttttatctccttttt

SEQ ID NO: 672692 - DNA, 20 bp, Artificial
  CRISPR gRNA sequence
cgttttttatctccttttta

SEQ ID NO: 672693 - DNA, 20 bp, Artificial
  CRISPR gRNA sequence
gttttttatctcctttttaa

SEQ ID NO: 672694 - DNA, 20 bp, Artificial
  CRISPR gRNA sequence
tttatctcctttttaaacag

SEQ ID NO: 672695 - DNA, 20 bp, Artificial
  CRISPR gRNA sequence
ttatctcctttttaaacagc

SEQ ID NO: 672696 - DNA, 20 bp, Artificial
  CRISPR gRNA sequence
tatctcctttttaaacagca

SEQ ID NO: 672697 - DNA, 20 bp, Artificial
  CRISPR gRNA sequence
atctcctttttaaacagcac

SEQ ID NO: 672698 - DNA, 20 bp, Artificial
  CRISPR gRNA sequence
tctcctttttaaacagcacg

SEQ ID NO: 672699 - DNA, 20 bp, Artificial
  CRISPR gRNA sequence
ctttttaaacagcacgatgt

SEQ ID NO: 672700 - DNA, 20 bp, Artificial
  CRISPR gRNA sequence
tttaaacagcacgatgtttt

SEQ ID NO: 672701 - DNA, 20 bp, Artificial
  CRISPR gRNA sequence
ttaaacagcacgatgtttta

SEQ ID NO: 672702 - DNA, 20 bp, Artificial
  CRISPR gRNA sequence
taaacagcacgatgttttaa

SEQ ID NO: 672703 - DNA, 20 bp, Artificial
  CRISPR gRNA sequence
aaacagcacgatgttttaaa

SEQ ID NO: 672704 - DNA, 20 bp, Artificial
  CRISPR gRNA sequence
aacagcacgatgttttaaaa

SEQ ID NO: 672705 - DNA, 20 bp, Artificial
  CRISPR gRNA sequence
taaaaatatttatattacta

SEQ ID NO: 672706 - DNA, 20 bp, Artificial
  CRISPR gRNA sequence
aaaaatatttatattactag

SEQ ID NO: 672707 - DNA, 20 bp, Artificial
  CRISPR gRNA sequence
aaaatatttatattactagt

SEQ ID NO: 672708 - DNA, 20 bp, Artificial
  CRISPR gRNA sequence
atattactagtgtaactttt

SEQ ID NO: 672709 - DNA, 20 bp, Artificial
  CRISPR gRNA sequence
tattactagtgtaacttttt

SEQ ID NO: 672710 - DNA, 20 bp, Artificial
  CRISPR gRNA sequence
ctagtgtaacttttttcttt

SEQ ID NO: 672711 - DNA, 20 bp, Artificial
  CRISPR gRNA sequence
gtgtaacttttttctttaat

SEQ ID NO: 672712 - DNA, 20 bp, Artificial
  CRISPR gRNA sequence
ttttctttaatttttaagtg

SEQ ID NO: 672713 - DNA, 20 bp, Artificial
  CRISPR gRNA sequence
tttctttaatttttaagtgt

SEQ ID NO: 672714 - DNA, 20 bp, Artificial
  CRISPR gRNA sequence
ttctttaatttttaagtgtc

SEQ ID NO: 672715 - DNA, 20 bp, Artificial
  CRISPR gRNA sequence
tctttaatttttaagtgtct

SEQ ID NO: 672716 - DNA, 20 bp, Artificial
  CRISPR gRNA sequence
ctttaatttttaagtgtctt

SEQ ID NO: 672717 - DNA, 20 bp, Artificial
  CRISPR gRNA sequence
tttaatttttaagtgtctta

SEQ ID NO: 672718 - DNA, 20 bp, Artificial
  CRISPR gRNA sequence
taatttttaagtgtcttaga

SEQ ID NO: 672719 - DNA, 20 bp, Artificial
  CRISPR gRNA sequence
aatttttaagtgtcttagaa

SEQ ID NO: 672720 - DNA, 20 bp, Artificial
  CRISPR gRNA sequence
atttttaagtgtcttagaaa

SEQ ID NO: 672721 - DNA, 20 bp, Artificial
  CRISPR gRNA sequence
ttaagtgtcttagaaaaggt

SEQ ID NO: 672722 - DNA, 20 bp, Artificial
  CRISPR gRNA sequence
taagtgtcttagaaaaggtt

SEQ ID NO: 672723 - DNA, 20 bp, Artificial
  CRISPR gRNA sequence
aagtgtcttagaaaaggttg

SEQ ID NO: 672724 - DNA, 20 bp, Artificial
  CRISPR gRNA sequence
agtgtcttagaaaaggttga

SEQ ID NO: 672725 - DNA, 20 bp, Artificial
  CRISPR gRNA sequence
agaaaaggttgaaagatcaa

SEQ ID NO: 672726 - DNA, 20 bp, Artificial
  CRISPR gRNA sequence
gaaaaggttgaaagatcaag

SEQ ID NO: 672727 - DNA, 20 bp, Artificial
  CRISPR gRNA sequence
aaagatcaagcttggtatct

SEQ ID NO: 672728 - DNA, 20 bp, Artificial
  CRISPR gRNA sequence
ggtatctatttgataaaaag

SEQ ID NO: 672729 - DNA, 20 bp, Artificial
  CRISPR gRNA sequence
gtatctatttgataaaaagt

SEQ ID NO: 672730 - DNA, 20 bp, Artificial
  CRISPR gRNA sequence
tttgataaaaagtaaaggga

SEQ ID NO: 672731 - DNA, 20 bp, Artificial
  CRISPR gRNA sequence
gataaaaagtaaagggaaaa

SEQ ID NO: 672732 - DNA, 20 bp, Artificial
  CRISPR gRNA sequence
ataaaaagtaaagggaaaag

SEQ ID NO: 672733 - DNA, 20 bp, Artificial
  CRISPR gRNA sequence
taaaataatctacttttcat

SEQ ID NO: 672734 - DNA, 20 bp, Artificial
  CRISPR gRNA sequence
cttttcatctacgctcatga

SEQ ID NO: 672735 - DNA, 20 bp, Artificial
  CRISPR gRNA sequence
ttcatctacgctcatgaact

SEQ ID NO: 672736 - DNA, 20 bp, Artificial
  CRISPR gRNA sequence
tcatctacgctcatgaacta

SEQ ID NO: 672737 - DNA, 20 bp, Artificial
  CRISPR gRNA sequence
catctacgctcatgaactaa

SEQ ID NO: 672738 - DNA, 20 bp, Artificial
  CRISPR gRNA sequence
atctacgctcatgaactaat

SEQ ID NO: 672739 - DNA, 20 bp, Artificial
  CRISPR gRNA sequence
cgctcatgaactaattctaa

SEQ ID NO: 672740 - DNA, 20 bp, Artificial
  CRISPR gRNA sequence
atgaactaattctaacgaca

SEQ ID NO: 672741 - DNA, 20 bp, Artificial
  CRISPR gRNA sequence
attctaacgacagttctaaa

SEQ ID NO: 672742 - DNA, 20 bp, Artificial
  CRISPR gRNA sequence
taacgacagttctaaaaaca

SEQ ID NO: 672743 - DNA, 20 bp, Artificial
  CRISPR gRNA sequence
acgacagttctaaaaacaag

SEQ ID NO: 672744 - DNA, 20 bp, Artificial
  CRISPR gRNA sequence
taaaaacaagttccacaaag

SEQ ID NO: 672745 - DNA, 20 bp, Artificial
  CRISPR gRNA sequence
aaaacaagttccacaaagtt

SEQ ID NO: 672746 - DNA, 20 bp, Artificial
  CRISPR gRNA sequence
cacaaagttataatatattc

SEQ ID NO: 672747 - DNA, 20 bp, Artificial
  CRISPR gRNA sequence
taatatattcattatgtaag

SEQ ID NO: 672748 - DNA, 20 bp, Artificial
  CRISPR gRNA sequence
attatgtaagagtgattgta

SEQ ID NO: 672749 - DNA, 20 bp, Artificial
  CRISPR gRNA sequence
tgtaagagtgattgtattaa

SEQ ID NO: 672750 - DNA, 20 bp, Artificial
  CRISPR gRNA sequence
tattaaggaagataacactc

SEQ ID NO: 672751 - DNA, 20 bp, Artificial
  CRISPR gRNA sequence
aggaagataacactcattca

SEQ ID NO: 672752 - DNA, 20 bp, Artificial
  CRISPR gRNA sequence
attcaaatgtgtaacttctc

SEQ ID NO: 672753 - DNA, 20 bp, Artificial
  CRISPR gRNA sequence
aaatgtgtaacttctcctat

SEQ ID NO: 672754 - DNA, 20 bp, Artificial
  CRISPR gRNA sequence
ctcctatctagtaaaataca

SEQ ID NO: 672755 - DNA, 20 bp, Artificial
  CRISPR gRNA sequence
tcctatctagtaaaatacaa

SEQ ID NO: 672756 - DNA, 20 bp, Artificial
  CRISPR gRNA sequence
ctatctagtaaaatacaaac

SEQ ID NO: 672757 - DNA, 20 bp, Artificial
  CRISPR gRNA sequence
tctagtaaaatacaaacaaa

SEQ ID NO: 672758 - DNA, 20 bp, Artificial
  CRISPR gRNA sequence
gtaaaatacaaacaaaacac

SEQ ID NO: 672759 - DNA, 20 bp, Artificial
  CRISPR gRNA sequence
atggcttttcagttgaattg

SEQ ID NO: 672760 - DNA, 20 bp, Artificial
  CRISPR gRNA sequence
ttcagttgaattgcatgcaa

SEQ ID NO: 672761 - DNA, 20 bp, Artificial
  CRISPR gRNA sequence
tcagttgaattgcatgcaat

SEQ ID NO: 672762 - DNA, 20 bp, Artificial
  CRISPR gRNA sequence
cagttgaattgcatgcaatg

SEQ ID NO: 672763 - DNA, 20 bp, Artificial
  CRISPR gRNA sequence
agttgaattgcatgcaatgt

SEQ ID NO: 672764 - DNA, 20 bp, Artificial
  CRISPR gRNA sequence
aattgcatgcaatgttaaat

SEQ ID NO: 672765 - DNA, 20 bp, Artificial
  CRISPR gRNA sequence
catgcaatgttaaattttaa

SEQ ID NO: 672766 - DNA, 20 bp, Artificial
  CRISPR gRNA sequence
aattttaagctaaaaaataa

SEQ ID NO: 672767 - DNA, 20 bp, Artificial
  CRISPR gRNA sequence
taagctaaaaaataaactaa

SEQ ID NO: 672768 - DNA, 20 bp, Artificial
  CRISPR gRNA sequence
aagctaaaaaataaactaaa

SEQ ID NO: 672769 - DNA, 20 bp, Artificial
  CRISPR gRNA sequence
agctaaaaaataaactaaaa

SEQ ID NO: 672770 - DNA, 20 bp, Artificial
  CRISPR gRNA sequence
aaaaataaactaaaaacagt

SEQ ID NO: 672771 - DNA, 20 bp, Artificial
  CRISPR gRNA sequence
aaaacagtatttagaagatt

SEQ ID NO: 672772 - DNA, 20 bp, Artificial
  CRISPR gRNA sequence
agaagatttttaattgatct

SEQ ID NO: 672773 - DNA, 20 bp, Artificial
  CRISPR gRNA sequence
gaagatttttaattgatctt

SEQ ID NO: 672774 - DNA, 20 bp, Artificial
  CRISPR gRNA sequence
ttaattgatcttttatgttc

SEQ ID NO: 672775 - DNA, 20 bp, Artificial
  CRISPR gRNA sequence
taattgatcttttatgttct

SEQ ID NO: 672776 - DNA, 20 bp, Artificial
  CRISPR gRNA sequence
aattgatcttttatgttctg

SEQ ID NO: 672777 - DNA, 20 bp, Artificial
  CRISPR gRNA sequence
attgatcttttatgttctga

SEQ ID NO: 672778 - DNA, 20 bp, Artificial
  CRISPR gRNA sequence
atcttttatgttctgaatta

SEQ ID NO: 672779 - DNA, 20 bp, Artificial
  CRISPR gRNA sequence
ttatgttctgaattaagaaa

SEQ ID NO: 672780 - DNA, 20 bp, Artificial
  CRISPR gRNA sequence
tatgttctgaattaagaaaa

SEQ ID NO: 672781 - DNA, 20 bp, Artificial
  CRISPR gRNA sequence
atgttctgaattaagaaaat

SEQ ID NO: 672782 - DNA, 20 bp, Artificial
  CRISPR gRNA sequence
tgttctgaattaagaaaatt

SEQ ID NO: 672783 - DNA, 20 bp, Artificial
  CRISPR gRNA sequence
tgaattaagaaaattcaaag

SEQ ID NO: 672784 - DNA, 20 bp, Artificial
  CRISPR gRNA sequence
aattaagaaaattcaaagaa

SEQ ID NO: 672785 - DNA, 20 bp, Artificial
  CRISPR gRNA sequence
agaaaattcaaagaaccaga

SEQ ID NO: 672786 - DNA, 20 bp, Artificial
  CRISPR gRNA sequence
aaagaaccagagtacagttt

SEQ ID NO: 672787 - DNA, 20 bp, Artificial
  CRISPR gRNA sequence
ttagaaaatttaggttaatc

SEQ ID NO: 672788 - DNA, 20 bp, Artificial
  CRISPR gRNA sequence
tagaaaatttaggttaatca

SEQ ID NO: 672789 - DNA, 20 bp, Artificial
  CRISPR gRNA sequence
agaaaatttaggttaatcag

SEQ ID NO: 672790 - DNA, 20 bp, Artificial
  CRISPR gRNA sequence
gaaaatttaggttaatcagt

SEQ ID NO: 672791 - DNA, 20 bp, Artificial
  CRISPR gRNA sequence
aggttaatcagtgattcact

SEQ ID NO: 672792 - DNA, 20 bp, Artificial
  CRISPR gRNA sequence
ggttaatcagtgattcactg

SEQ ID NO: 672793 - DNA, 20 bp, Artificial
  CRISPR gRNA sequence
atcagtgattcactgtagct

SEQ ID NO: 672794 - DNA, 20 bp, Artificial
  CRISPR gRNA sequence
actgtagctacaataatatt

SEQ ID NO: 672795 - DNA, 20 bp, Artificial
  CRISPR gRNA sequence
tagctacaataatattcatg

SEQ ID NO: 672796 - DNA, 20 bp, Artificial
  CRISPR gRNA sequence
caataatattcatgaggatt

SEQ ID NO: 672797 - DNA, 20 bp, Artificial
  CRISPR gRNA sequence
atgaggattgttaatttgta

SEQ ID NO: 672798 - DNA, 20 bp, Artificial
  CRISPR gRNA sequence
ttaatttgtaaataaaataa

SEQ ID NO: 672799 - DNA, 20 bp, Artificial
  CRISPR gRNA sequence
atttgtaaataaaataataa

SEQ ID NO: 672800 - DNA, 20 bp, Artificial
  CRISPR gRNA sequence
gtaaataaaataataattat

SEQ ID NO: 672801 - DNA, 20 bp, Artificial
  CRISPR gRNA sequence
taaataaaataataattata

SEQ ID NO: 672802 - DNA, 20 bp, Artificial
  CRISPR gRNA sequence
tatacctactctactgtcct

SEQ ID NO: 672803 - DNA, 20 bp, Artificial
  CRISPR gRNA sequence
ctctactgtccttttgttat

SEQ ID NO: 672804 - DNA, 20 bp, Artificial
  CRISPR gRNA sequence
tactgtccttttgttattta

SEQ ID NO: 672805 - DNA, 20 bp, Artificial
  CRISPR gRNA sequence
ctgtccttttgttatttact

SEQ ID NO: 672806 - DNA, 20 bp, Artificial
  CRISPR gRNA sequence
tccttttgttatttactagt

SEQ ID NO: 672807 - DNA, 20 bp, Artificial
  CRISPR gRNA sequence
ttgttatttactagtgtggt

SEQ ID NO: 672808 - DNA, 20 bp, Artificial
  CRISPR gRNA sequence
tgttatttactagtgtggta

SEQ ID NO: 672809 - DNA, 20 bp, Artificial
  CRISPR gRNA sequence
gttatttactagtgtggtag

SEQ ID NO: 672810 - DNA, 20 bp, Artificial
  CRISPR gRNA sequence
ttatttactagtgtggtaga

SEQ ID NO: 672811 - DNA, 20 bp, Artificial
  CRISPR gRNA sequence
tttactagtgtggtagagtt

SEQ ID NO: 672812 - DNA, 20 bp, Artificial
  CRISPR gRNA sequence
actagtgtggtagagttgaa

SEQ ID NO: 672813 - DNA, 20 bp, Artificial
  CRISPR gRNA sequence
ctagtgtggtagagttgaat

SEQ ID NO: 672814 - DNA, 20 bp, Artificial
  CRISPR gRNA sequence
gtgtggtagagttgaattat

SEQ ID NO: 672815 - DNA, 20 bp, Artificial
  CRISPR gRNA sequence
aattattttatttttgaaaa

SEQ ID NO: 672816 - DNA, 20 bp, Artificial
  CRISPR gRNA sequence
ttttatttttgaaaataatc

SEQ ID NO: 672817 - DNA, 20 bp, Artificial
  CRISPR gRNA sequence
tatttttgaaaataatctaa

SEQ ID NO: 672818 - DNA, 20 bp, Artificial
  CRISPR gRNA sequence
atttttgaaaataatctaat

SEQ ID NO: 672819 - DNA, 20 bp, Artificial
  CRISPR gRNA sequence
tttttgaaaataatctaatt

SEQ ID NO: 672820 - DNA, 20 bp, Artificial
  CRISPR gRNA sequence
ttgaaaataatctaattggc

SEQ ID NO: 672821 - DNA, 20 bp, Artificial
  CRISPR gRNA sequence
tgaaaataatctaattggca

SEQ ID NO: 672822 - DNA, 20 bp, Artificial
  CRISPR gRNA sequence
gaaaataatctaattggcat

SEQ ID NO: 672823 - DNA, 20 bp, Artificial
  CRISPR gRNA sequence
aaaataatctaattggcata

SEQ ID NO: 672824 - DNA, 20 bp, Artificial
  CRISPR gRNA sequence
attggcataataaagtttat

SEQ ID NO: 672825 - DNA, 20 bp, Artificial
  CRISPR gRNA sequence
gcataataaagtttataaac

SEQ ID NO: 672826 - DNA, 20 bp, Artificial
  CRISPR gRNA sequence
ataaacagttatacagattt

SEQ ID NO: 672827 - DNA, 20 bp, Artificial
  CRISPR gRNA sequence
taaacagttatacagatttc

SEQ ID NO: 672828 - DNA, 20 bp, Artificial
  CRISPR gRNA sequence
tacagatttccacaaatcct

SEQ ID NO: 672829 - DNA, 20 bp, Artificial
  CRISPR gRNA sequence
ccacaaatcctaggaatacg

SEQ ID NO: 672830 - DNA, 20 bp, Artificial
  CRISPR gRNA sequence
cacaaatcctaggaatacga

SEQ ID NO: 672831 - DNA, 20 bp, Artificial
  CRISPR gRNA sequence
ggaatacgagactcactcaa

SEQ ID NO: 672832 - DNA, 20 bp, Artificial
  CRISPR gRNA sequence
actcaactcataacagcaag

SEQ ID NO: 672833 - DNA, 20 bp, Artificial
  CRISPR gRNA sequence
aactcataacagcaaggagt

SEQ ID NO: 672834 - DNA, 20 bp, Artificial
  CRISPR gRNA sequence
ataacagcaaggagtatgtt

SEQ ID NO: 672835 - DNA, 20 bp, Artificial
  CRISPR gRNA sequence
aagtacacttgcaacactat

SEQ ID NO: 672836 - DNA, 20 bp, Artificial
  CRISPR gRNA sequence
gcaacactatctttttttgt

SEQ ID NO: 672837 - DNA, 20 bp, Artificial
  CRISPR gRNA sequence
caacactatctttttttgtc

SEQ ID NO: 672838 - DNA, 20 bp, Artificial
  CRISPR gRNA sequence
tctttttttgtcaatcagtg

SEQ ID NO: 672839 - DNA, 20 bp, Artificial
  CRISPR gRNA sequence
tttttgtcaatcagtgttta

SEQ ID NO: 672840 - DNA, 20 bp, Artificial
  CRISPR gRNA sequence
ttttgtcaatcagtgtttat

SEQ ID NO: 672841 - DNA, 20 bp, Artificial
  CRISPR gRNA sequence
tttgtcaatcagtgtttatt

SEQ ID NO: 672842 - DNA, 20 bp, Artificial
  CRISPR gRNA sequence
ttgtcaatcagtgtttattg

SEQ ID NO: 672843 - DNA, 20 bp, Artificial
  CRISPR gRNA sequence
tgtcaatcagtgtttattgg

SEQ ID NO: 672844 - DNA, 20 bp, Artificial
  CRISPR gRNA sequence
gtcaatcagtgtttattgga

SEQ ID NO: 672845 - DNA, 20 bp, Artificial
  CRISPR gRNA sequence
tcaatcagtgtttattggag

SEQ ID NO: 672846 - DNA, 20 bp, Artificial
  CRISPR gRNA sequence
attggagcattgtgcaaatt

SEQ ID NO: 672847 - DNA, 20 bp, Artificial
  CRISPR gRNA sequence
ttggagcattgtgcaaatta

SEQ ID NO: 672848 - DNA, 20 bp, Artificial
  CRISPR gRNA sequence
gagcattgtgcaaattatta

SEQ ID NO: 672849 - DNA, 20 bp, Artificial
  CRISPR gRNA sequence
tgcaaattattatactttct

SEQ ID NO: 672850 - DNA, 20 bp, Artificial
  CRISPR gRNA sequence
ttatactttcttcagatcta

SEQ ID NO: 672851 - DNA, 20 bp, Artificial
  CRISPR gRNA sequence
tactttcttcagatctagat

SEQ ID NO: 672852 - DNA, 20 bp, Artificial
  CRISPR gRNA sequence
tcttcagatctagatttttc

SEQ ID NO: 672853 - DNA, 20 bp, Artificial
  CRISPR gRNA sequence
cttcagatctagatttttct

SEQ ID NO: 672854 - DNA, 20 bp, Artificial
  CRISPR gRNA sequence
ttcagatctagatttttctt

SEQ ID NO: 672855 - DNA, 20 bp, Artificial
  CRISPR gRNA sequence
cagatctagatttttcttaa

SEQ ID NO: 672856 - DNA, 20 bp, Artificial
  CRISPR gRNA sequence
agatctagatttttcttaaa

SEQ ID NO: 672857 - DNA, 20 bp, Artificial
  CRISPR gRNA sequence
gatttttcttaaagttaata

SEQ ID NO: 672858 - DNA, 20 bp, Artificial
  CRISPR gRNA sequence
ttcttaaagttaatagccat

SEQ ID NO: 672859 - DNA, 20 bp, Artificial
  CRISPR gRNA sequence
tcttaaagttaatagccatt

SEQ ID NO: 672860 - DNA, 20 bp, Artificial
  CRISPR gRNA sequence
cttaaagttaatagccattt

SEQ ID NO: 672861 - DNA, 20 bp, Artificial
  CRISPR gRNA sequence
ttaaagttaatagccattta

SEQ ID NO: 672862 - DNA, 20 bp, Artificial
  CRISPR gRNA sequence
aaagttaatagccatttacg

SEQ ID NO: 672863 - DNA, 20 bp, Artificial
  CRISPR gRNA sequence
aagttaatagccatttacgg

SEQ ID NO: 672864 - DNA, 20 bp, Artificial
  CRISPR gRNA sequence
atagccatttacggagaagc

SEQ ID NO: 672865 - DNA, 20 bp, Artificial
  CRISPR gRNA sequence
acggagaagctgtgatacct

SEQ ID NO: 672866 - DNA, 20 bp, Artificial
  CRISPR gRNA sequence
cggagaagctgtgatacctg

SEQ ID NO: 672867 - DNA, 20 bp, Artificial
  CRISPR gRNA sequence
tgatacctgtcatgctttgt

SEQ ID NO: 672868 - DNA, 20 bp, Artificial
  CRISPR gRNA sequence
tcatgctttgtcaactttga

SEQ ID NO: 672869 - DNA, 20 bp, Artificial
  CRISPR gRNA sequence
tgtcaactttgaaattgtgg

SEQ ID NO: 672870 - DNA, 20 bp, Artificial
  CRISPR gRNA sequence
gtcaactttgaaattgtgga

SEQ ID NO: 672871 - DNA, 20 bp, Artificial
  CRISPR gRNA sequence
tcaactttgaaattgtggac

SEQ ID NO: 672872 - DNA, 20 bp, Artificial
  CRISPR gRNA sequence
tgaaattgtggacatgatat

SEQ ID NO: 672873 - DNA, 20 bp, Artificial
  CRISPR gRNA sequence
gaaattgtggacatgatatc

SEQ ID NO: 672874 - DNA, 20 bp, Artificial
  CRISPR gRNA sequence
aaattgtggacatgatatca

SEQ ID NO: 672875 - DNA, 20 bp, Artificial
  CRISPR gRNA sequence
tggacatgatatcattaaac

SEQ ID NO: 672876 - DNA, 20 bp, Artificial
  CRISPR gRNA sequence
aactagacacttcaacatat

SEQ ID NO: 672877 - DNA, 20 bp, Artificial
  CRISPR gRNA sequence
gacacttcaacatatttctg

SEQ ID NO: 672878 - DNA, 20 bp, Artificial
  CRISPR gRNA sequence
caacatatttctgatgatcc

SEQ ID NO: 672879 - DNA, 20 bp, Artificial
  CRISPR gRNA sequence
aacatatttctgatgatcca

SEQ ID NO: 672880 - DNA, 20 bp, Artificial
  CRISPR gRNA sequence
ctgatgatccagtttataca

SEQ ID NO: 672881 - DNA, 20 bp, Artificial
  CRISPR gRNA sequence
tgatgatccagtttatacat

SEQ ID NO: 672882 - DNA, 20 bp, Artificial
  CRISPR gRNA sequence
atgatccagtttatacatct

SEQ ID NO: 672883 - DNA, 20 bp, Artificial
  CRISPR gRNA sequence
atacatctgagtgtgtcctg

SEQ ID NO: 672884 - DNA, 20 bp, Artificial
  CRISPR gRNA sequence
tacatctgagtgtgtcctgc

SEQ ID NO: 672885 - DNA, 20 bp, Artificial
  CRISPR gRNA sequence
agtgtgtcctgccattttca

SEQ ID NO: 672886 - DNA, 20 bp, Artificial
  CRISPR gRNA sequence
ccattttcaacaccacttta

SEQ ID NO: 672887 - DNA, 20 bp, Artificial
  CRISPR gRNA sequence
tcaacaccactttaatacca

SEQ ID NO: 672888 - DNA, 20 bp, Artificial
  CRISPR gRNA sequence
caacaccactttaataccat

SEQ ID NO: 672889 - DNA, 20 bp, Artificial
  CRISPR gRNA sequence
aacaccactttaataccatt

SEQ ID NO: 672890 - DNA, 20 bp, Artificial
  CRISPR gRNA sequence
taataccattttgagactag

SEQ ID NO: 672891 - DNA, 20 bp, Artificial
  CRISPR gRNA sequence
aataccattttgagactaga

SEQ ID NO: 672892 - DNA, 20 bp, Artificial
  CRISPR gRNA sequence
ataccattttgagactagaa

SEQ ID NO: 672893 - DNA, 20 bp, Artificial
  CRISPR gRNA sequence
tgagactagaaagtctattt

SEQ ID NO: 672894 - DNA, 20 bp, Artificial
  CRISPR gRNA sequence
gagactagaaagtctatttg

SEQ ID NO: 672895 - DNA, 20 bp, Artificial
  CRISPR gRNA sequence
agactagaaagtctatttgc

SEQ ID NO: 672896 - DNA, 20 bp, Artificial
  CRISPR gRNA sequence
gaaagtctatttgcatttct

SEQ ID NO: 672897 - DNA, 20 bp, Artificial
  CRISPR gRNA sequence
tttgcatttctttaatttaa

SEQ ID NO: 672898 - DNA, 20 bp, Artificial
  CRISPR gRNA sequence
gcatttctttaatttaaact

SEQ ID NO: 672899 - DNA, 20 bp, Artificial
  CRISPR gRNA sequence
catttctttaatttaaacta

SEQ ID NO: 672900 - DNA, 20 bp, Artificial
  CRISPR gRNA sequence
ctttaatttaaactagattg

SEQ ID NO: 672901 - DNA, 20 bp, Artificial
  CRISPR gRNA sequence
tttaatttaaactagattga

SEQ ID NO: 672902 - DNA, 20 bp, Artificial
  CRISPR gRNA sequence
taatttaaactagattgaga

SEQ ID NO: 672903 - DNA, 20 bp, Artificial
  CRISPR gRNA sequence
aatttaaactagattgagaa

SEQ ID NO: 672904 - DNA, 20 bp, Artificial
  CRISPR gRNA sequence
atttaaactagattgagaaa

SEQ ID NO: 672905 - DNA, 20 bp, Artificial
  CRISPR gRNA sequence
aaactagattgagaaaaatg

SEQ ID NO: 672906 - DNA, 20 bp, Artificial
  CRISPR gRNA sequence
aactagattgagaaaaatgt

SEQ ID NO: 672907 - DNA, 20 bp, Artificial
  CRISPR gRNA sequence
gattgagaaaaatgtagtca

SEQ ID NO: 672908 - DNA, 20 bp, Artificial
  CRISPR gRNA sequence
agaaaaatgtagtcagaatc

SEQ ID NO: 672909 - DNA, 20 bp, Artificial
  CRISPR gRNA sequence
gtcattagccaaatgttttc

SEQ ID NO: 672910 - DNA, 20 bp, Artificial
  CRISPR gRNA sequence
gccaaatgttttctccttaa

SEQ ID NO: 672911 - DNA, 20 bp, Artificial
  CRISPR gRNA sequence
tctccttaataccatgaact

SEQ ID NO: 672912 - DNA, 20 bp, Artificial
  CRISPR gRNA sequence
ctccttaataccatgaacta

SEQ ID NO: 672913 - DNA, 20 bp, Artificial
  CRISPR gRNA sequence
tccttaataccatgaactag

SEQ ID NO: 672914 - DNA, 20 bp, Artificial
  CRISPR gRNA sequence
cttaataccatgaactagtc

SEQ ID NO: 672915 - DNA, 20 bp, Artificial
  CRISPR gRNA sequence
aataccatgaactagtctgc

SEQ ID NO: 672916 - DNA, 20 bp, Artificial
  CRISPR gRNA sequence
ataccatgaactagtctgca

SEQ ID NO: 672917 - DNA, 20 bp, Artificial
  CRISPR gRNA sequence
gtctgcattttagaacttcc

SEQ ID NO: 672918 - DNA, 20 bp, Artificial
  CRISPR gRNA sequence
cattttagaacttcccactc

SEQ ID NO: 672919 - DNA, 20 bp, Artificial
  CRISPR gRNA sequence
tagaacttcccactcttatc

SEQ ID NO: 672920 - DNA, 20 bp, Artificial
  CRISPR gRNA sequence
agaacttcccactcttatca

SEQ ID NO: 672921 - DNA, 20 bp, Artificial
  CRISPR gRNA sequence
gaacttcccactcttatcaa

SEQ ID NO: 672922 - DNA, 20 bp, Artificial
  CRISPR gRNA sequence
cccactcttatcaattgttt

SEQ ID NO: 672923 - DNA, 20 bp, Artificial
  CRISPR gRNA sequence
ccactcttatcaattgttta

SEQ ID NO: 672924 - DNA, 20 bp, Artificial
  CRISPR gRNA sequence
ttatcaattgtttatctctc

SEQ ID NO: 672925 - DNA, 20 bp, Artificial
  CRISPR gRNA sequence
atcaattgtttatctctcat

SEQ ID NO: 672926 - DNA, 20 bp, Artificial
  CRISPR gRNA sequence
tcaattgtttatctctcata

SEQ ID NO: 672927 - DNA, 20 bp, Artificial
  CRISPR gRNA sequence
tttatctctcatattaaaga

SEQ ID NO: 672928 - DNA, 20 bp, Artificial
  CRISPR gRNA sequence
atctctcatattaaagatac

SEQ ID NO: 672929 - DNA, 20 bp, Artificial
  CRISPR gRNA sequence
tctctcatattaaagatact

SEQ ID NO: 672930 - DNA, 20 bp, Artificial
  CRISPR gRNA sequence
tcatattaaagatactgtct

SEQ ID NO: 672931 - DNA, 20 bp, Artificial
  CRISPR gRNA sequence
atattaaagatactgtctta

SEQ ID NO: 672932 - DNA, 20 bp, Artificial
  CRISPR gRNA sequence
aagatactgtcttaaaacct

SEQ ID NO: 672933 - DNA, 20 bp, Artificial
  CRISPR gRNA sequence
tcttaaaaccttataatgcc

SEQ ID NO: 672934 - DNA, 20 bp, Artificial
  CRISPR gRNA sequence
aaaaccttataatgcctttg

SEQ ID NO: 672935 - DNA, 20 bp, Artificial
  CRISPR gRNA sequence
aaaccttataatgcctttga

SEQ ID NO: 672936 - DNA, 20 bp, Artificial
  CRISPR gRNA sequence
ataatgcctttgagaaacat

SEQ ID NO: 672937 - DNA, 20 bp, Artificial
  CRISPR gRNA sequence
taatgcctttgagaaacata

SEQ ID NO: 672938 - DNA, 20 bp, Artificial
  CRISPR gRNA sequence
tgagaaacatatattttagt

SEQ ID NO: 672939 - DNA, 20 bp, Artificial
  CRISPR gRNA sequence
gagaaacatatattttagtg

SEQ ID NO: 672940 - DNA, 20 bp, Artificial
  CRISPR gRNA sequence
agaaacatatattttagtgt

SEQ ID NO: 672941 - DNA, 20 bp, Artificial
  CRISPR gRNA sequence
tagtgtttttagttcataga

SEQ ID NO: 672942 - DNA, 20 bp, Artificial
  CRISPR gRNA sequence
agtgtttttagttcatagaa

SEQ ID NO: 672943 - DNA, 20 bp, Artificial
  CRISPR gRNA sequence
gtgtttttagttcatagaat

SEQ ID NO: 672944 - DNA, 20 bp, Artificial
  CRISPR gRNA sequence
ttagttcatagaatatctaa

SEQ ID NO: 672945 - DNA, 20 bp, Artificial
  CRISPR gRNA sequence
tagttcatagaatatctaat

SEQ ID NO: 672946 - DNA, 20 bp, Artificial
  CRISPR gRNA sequence
agttcatagaatatctaata

SEQ ID NO: 672947 - DNA, 20 bp, Artificial
  CRISPR gRNA sequence
gttcatagaatatctaatat

SEQ ID NO: 672948 - DNA, 20 bp, Artificial
  CRISPR gRNA sequence
atagaatatctaatataatt

SEQ ID NO: 672949 - DNA, 20 bp, Artificial
  CRISPR gRNA sequence
atataattttttttttgagt

SEQ ID NO: 672950 - DNA, 20 bp, Artificial
  CRISPR gRNA sequence
tttttttgagttggagtctt

SEQ ID NO: 672951 - DNA, 20 bp, Artificial
  CRISPR gRNA sequence
ttttttgagttggagtcttg

SEQ ID NO: 672952 - DNA, 20 bp, Artificial
  CRISPR gRNA sequence
tttttgagttggagtcttgc

SEQ ID NO: 672953 - DNA, 20 bp, Artificial
  CRISPR gRNA sequence
ttttgagttggagtcttgct

SEQ ID NO: 672954 - DNA, 20 bp, Artificial
  CRISPR gRNA sequence
tttgagttggagtcttgctc

SEQ ID NO: 672955 - DNA, 20 bp, Artificial
  CRISPR gRNA sequence
ttgagttggagtcttgctct

SEQ ID NO: 672956 - DNA, 20 bp, Artificial
  CRISPR gRNA sequence
tgagttggagtcttgctctg

SEQ ID NO: 672957 - DNA, 20 bp, Artificial
  CRISPR gRNA sequence
gagttggagtcttgctctgt

SEQ ID NO: 672958 - DNA, 20 bp, Artificial
  CRISPR gRNA sequence
agttggagtcttgctctgtc

SEQ ID NO: 672959 - DNA, 20 bp, Artificial
  CRISPR gRNA sequence
gagtcttgctctgtcgccca

SEQ ID NO: 672960 - DNA, 20 bp, Artificial
  CRISPR gRNA sequence
gctctgtcgcccaggctgga

SEQ ID NO: 672961 - DNA, 20 bp, Artificial
  CRISPR gRNA sequence
ctctgtcgcccaggctggag

SEQ ID NO: 672962 - DNA, 20 bp, Artificial
  CRISPR gRNA sequence
tgtcgcccaggctggagtgt

SEQ ID NO: 672963 - DNA, 20 bp, Artificial
  CRISPR gRNA sequence
tcgcccaggctggagtgtag

SEQ ID NO: 672964 - DNA, 20 bp, Artificial
  CRISPR gRNA sequence
gagtgtagtggtgcaatctt

SEQ ID NO: 672965 - DNA, 20 bp, Artificial
  CRISPR gRNA sequence
ggatcactgcaccctccacc

SEQ ID NO: 672966 - DNA, 20 bp, Artificial
  CRISPR gRNA sequence
gatcactgcaccctccacct

SEQ ID NO: 672967 - DNA, 20 bp, Artificial
  CRISPR gRNA sequence
caccctccacctcctgggtt

SEQ ID NO: 672968 - DNA, 20 bp, Artificial
  CRISPR gRNA sequence
cacctcctgggttcaagcga

SEQ ID NO: 672969 - DNA, 20 bp, Artificial
  CRISPR gRNA sequence
ctgggttcaagcgatcctcc

SEQ ID NO: 672970 - DNA, 20 bp, Artificial
  CRISPR gRNA sequence
ggttcaagcgatcctcctgc

SEQ ID NO: 672971 - DNA, 20 bp, Artificial
  CRISPR gRNA sequence
aagcgatcctcctgcctcag

SEQ ID NO: 672972 - DNA, 20 bp, Artificial
  CRISPR gRNA sequence
ctgcctcagcctccaaagta

SEQ ID NO: 672973 - DNA, 20 bp, Artificial
  CRISPR gRNA sequence
cctcagcctccaaagtagct

SEQ ID NO: 672974 - DNA, 20 bp, Artificial
  CRISPR gRNA sequence
agcctccaaagtagctggaa

SEQ ID NO: 672975 - DNA, 20 bp, Artificial
  CRISPR gRNA sequence
caaagtagctggaattacat

SEQ ID NO: 672976 - DNA, 20 bp, Artificial
  CRISPR gRNA sequence
gaattacatgtgcccaccac

SEQ ID NO: 672977 - DNA, 20 bp, Artificial
  CRISPR gRNA sequence
catgtgcccaccaccaggcc

SEQ ID NO: 672978 - DNA, 20 bp, Artificial
  CRISPR gRNA sequence
atttctgtatttttagtaga

SEQ ID NO: 672979 - DNA, 20 bp, Artificial
  CRISPR gRNA sequence
ctgtatttttagtagagaca

SEQ ID NO: 672980 - DNA, 20 bp, Artificial
  CRISPR gRNA sequence
tgtatttttagtagagacag

SEQ ID NO: 672981 - DNA, 20 bp, Artificial
  CRISPR gRNA sequence
tatttttagtagagacaggg

SEQ ID NO: 672982 - DNA, 20 bp, Artificial
  CRISPR gRNA sequence
ttagtagagacagggtttca

SEQ ID NO: 672983 - DNA, 20 bp, Artificial
  CRISPR gRNA sequence
tagtagagacagggtttcac

SEQ ID NO: 672984 - DNA, 20 bp, Artificial
  CRISPR gRNA sequence
agtagagacagggtttcacc

SEQ ID NO: 672985 - DNA, 20 bp, Artificial
  CRISPR gRNA sequence
gtagagacagggtttcacca

SEQ ID NO: 672986 - DNA, 20 bp, Artificial
  CRISPR gRNA sequence
caccatgttggtctcaaact

SEQ ID NO: 672987 - DNA, 20 bp, Artificial
  CRISPR gRNA sequence
accatgttggtctcaaactc

SEQ ID NO: 672988 - DNA, 20 bp, Artificial
  CRISPR gRNA sequence
gtctcaaactcctgacctca

SEQ ID NO: 672989 - DNA, 20 bp, Artificial
  CRISPR gRNA sequence
aaactcctgacctcagttgt

SEQ ID NO: 672990 - DNA, 20 bp, Artificial
  CRISPR gRNA sequence
ctgacctcagttgttccacc

SEQ ID NO: 672991 - DNA, 20 bp, Artificial
  CRISPR gRNA sequence
acctcagttgttccacccac

SEQ ID NO: 672992 - DNA, 20 bp, Artificial
  CRISPR gRNA sequence
agttgttccacccaccctag

SEQ ID NO: 672993 - DNA, 20 bp, Artificial
  CRISPR gRNA sequence
ttccacccaccctagcctct

SEQ ID NO: 672994 - DNA, 20 bp, Artificial
  CRISPR gRNA sequence
cacccaccctagcctctcaa

SEQ ID NO: 672995 - DNA, 20 bp, Artificial
  CRISPR gRNA sequence
gcctctcaaagtgctgggat

SEQ ID NO: 672996 - DNA, 20 bp, Artificial
  CRISPR gRNA sequence
tcaaagtgctgggattacag

SEQ ID NO: 672997 - DNA, 20 bp, Artificial
  CRISPR gRNA sequence
aaagtgctgggattacaggc

SEQ ID NO: 672998 - DNA, 20 bp, Artificial
  CRISPR gRNA sequence
ggattacaggcgtgagccac

SEQ ID NO: 672999 - DNA, 20 bp, Artificial
  CRISPR gRNA sequence
caggcgtgagccaccgtgcc

SEQ ID NO: 673000 - DNA, 20 bp, Artificial
  CRISPR gRNA sequence
taatataaaattgatagtga

SEQ ID NO: 673001 - DNA, 20 bp, Artificial
  CRISPR gRNA sequence
atataaaattgatagtgaaa

SEQ ID NO: 673002 - DNA, 20 bp, Artificial
  CRISPR gRNA sequence
atagtgaaaaaagatgcaca

SEQ ID NO: 673003 - DNA, 20 bp, Artificial
  CRISPR gRNA sequence
attacaatatcatggagcat

SEQ ID NO: 673004 - DNA, 20 bp, Artificial
  CRISPR gRNA sequence
caatatcatggagcatcaga

SEQ ID NO: 673005 - DNA, 20 bp, Artificial
  CRISPR gRNA sequence
ttcttctttctctgtcatac

SEQ ID NO: 673006 - DNA, 20 bp, Artificial
  CRISPR gRNA sequence
cttctttctctgtcatactc

SEQ ID NO: 673007 - DNA, 20 bp, Artificial
  CRISPR gRNA sequence
ttctttctctgtcatactct

SEQ ID NO: 673008 - DNA, 20 bp, Artificial
  CRISPR gRNA sequence
ctttctctgtcatactctac

SEQ ID NO: 673009 - DNA, 20 bp, Artificial
  CRISPR gRNA sequence
tttctctgtcatactctact

SEQ ID NO: 673010 - DNA, 20 bp, Artificial
  CRISPR gRNA sequence
tctctgtcatactctactaa

SEQ ID NO: 673011 - DNA, 20 bp, Artificial
  CRISPR gRNA sequence
ctctgtcatactctactaaa

SEQ ID NO: 673012 - DNA, 20 bp, Artificial
  CRISPR gRNA sequence
tctgtcatactctactaaag

SEQ ID NO: 673013 - DNA, 20 bp, Artificial
  CRISPR gRNA sequence
tgtcatactctactaaagta

SEQ ID NO: 673014 - DNA, 20 bp, Artificial
  CRISPR gRNA sequence
tcatactctactaaagtacc

SEQ ID NO: 673015 - DNA, 20 bp, Artificial
  CRISPR gRNA sequence
tactaaagtaccaattgcag

SEQ ID NO: 673016 - DNA, 20 bp, Artificial
  CRISPR gRNA sequence
ctaaagtaccaattgcagtg

SEQ ID NO: 673017 - DNA, 20 bp, Artificial
  CRISPR gRNA sequence
aagtaccaattgcagtgtct

SEQ ID NO: 673018 - DNA, 20 bp, Artificial
  CRISPR gRNA sequence
cagtgtcttattaatggttt

SEQ ID NO: 673019 - DNA, 20 bp, Artificial
  CRISPR gRNA sequence
attaatggtttcattttatt

SEQ ID NO: 673020 - DNA, 20 bp, Artificial
  CRISPR gRNA sequence
ttaatggtttcattttattg

SEQ ID NO: 673021 - DNA, 20 bp, Artificial
  CRISPR gRNA sequence
atggtttcattttattgatt

SEQ ID NO: 673022 - DNA, 20 bp, Artificial
  CRISPR gRNA sequence
cattttattgatttggtatt

SEQ ID NO: 673023 - DNA, 20 bp, Artificial
  CRISPR gRNA sequence
attttattgatttggtattg

SEQ ID NO: 673024 - DNA, 20 bp, Artificial
  CRISPR gRNA sequence
tattgatttggtattgctac

SEQ ID NO: 673025 - DNA, 20 bp, Artificial
  CRISPR gRNA sequence
attgatttggtattgctact

SEQ ID NO: 673026 - DNA, 20 bp, Artificial
  CRISPR gRNA sequence
ttgatttggtattgctactt

SEQ ID NO: 673027 - DNA, 20 bp, Artificial
  CRISPR gRNA sequence
atttggtattgctactttag

SEQ ID NO: 673028 - DNA, 20 bp, Artificial
  CRISPR gRNA sequence
ggtattgctactttagtaag

SEQ ID NO: 673029 - DNA, 20 bp, Artificial
  CRISPR gRNA sequence
gtattgctactttagtaagt

SEQ ID NO: 673030 - DNA, 20 bp, Artificial
  CRISPR gRNA sequence
ctactttagtaagtaatcag

SEQ ID NO: 673031 - DNA, 20 bp, Artificial
  CRISPR gRNA sequence
ctttagtaagtaatcaggta

SEQ ID NO: 673032 - DNA, 20 bp, Artificial
  CRISPR gRNA sequence
tagtaagtaatcaggtaata

SEQ ID NO: 673033 - DNA, 20 bp, Artificial
  CRISPR gRNA sequence
agtaagtaatcaggtaatat

SEQ ID NO: 673034 - DNA, 20 bp, Artificial
  CRISPR gRNA sequence
gtaagtaatcaggtaatatt

SEQ ID NO: 673035 - DNA, 20 bp, Artificial
  CRISPR gRNA sequence
tcatcggatactccaggcac

SEQ ID NO: 673036 - DNA, 20 bp, Artificial
  CRISPR gRNA sequence
caggcactcttcactgggaa

SEQ ID NO: 673037 - DNA, 20 bp, Artificial
  CRISPR gRNA sequence
ttcactgggaatatagagag

SEQ ID NO: 673038 - DNA, 20 bp, Artificial
  CRISPR gRNA sequence
cactgggaatatagagagaa

SEQ ID NO: 673039 - DNA, 20 bp, Artificial
  CRISPR gRNA sequence
actgggaatatagagagaag

SEQ ID NO: 673040 - DNA, 20 bp, Artificial
  CRISPR gRNA sequence
ggaatatagagagaagagta

SEQ ID NO: 673041 - DNA, 20 bp, Artificial
  CRISPR gRNA sequence
atgcatgaacacatatcgat

SEQ ID NO: 673042 - DNA, 20 bp, Artificial
  CRISPR gRNA sequence
gacattatacatatagaatt

SEQ ID NO: 673043 - DNA, 20 bp, Artificial
  CRISPR gRNA sequence
tacatatagaattccctaat

SEQ ID NO: 673044 - DNA, 20 bp, Artificial
  CRISPR gRNA sequence
cctaattttgcctctcctta

SEQ ID NO: 673045 - DNA, 20 bp, Artificial
  CRISPR gRNA sequence
attttgcctctccttaatct

SEQ ID NO: 673046 - DNA, 20 bp, Artificial
  CRISPR gRNA sequence
tgcctctccttaatctactc

SEQ ID NO: 673047 - DNA, 20 bp, Artificial
  CRISPR gRNA sequence
gcctctccttaatctactcc
